United States Patent 8,445,666 (RIBONUCLEIC ACID INTERFERENCE MOLECULES) - sequence listing, part 2

SEQ ID NO: 22423 - DNA, 93 bp, Homo sapiens; identical to SEQ ID NO: 69

SEQ ID NO: 22424 - DNA, 109 bp, Homo sapiens
gtggttcaggcttggattctttcatgaggttacagtcagatgttagctgatgctatattcaactaaagacttgactagtgctggaagattcgcttccaaagtgattcac

SEQ ID NO: 22425 - DNA, 95 bp, Homo sapiens; identical to SEQ ID NO: 68

SEQ ID NO: 22426 - DNA, 93 bp, Homo sapiens; identical to SEQ ID NO: 69

SEQ ID NO: 22427 - DNA, 110 bp, Homo sapiens
cagattttcccagtgttcttgtgcagtgtatatctacaatgtatgtgcatgtgcttgtaaatatgtgcttgcatgtgtttgatattatcacagcactcatggagattctg

SEQ ID NO: 22428 - DNA, 92 bp, Homo sapiens
cctccagttccatccatgttactgcagatgatgatgatgattattatttcataataacctccagttccatccatgttactgcaaataagagg

SEQ ID NO: 22429 - DNA, 66 bp, Homo sapiens
tgtacacatataatatgaacatgtatatatgtgcgtgtgtatatatattcatattatatgagtaca

SEQ ID NO: 22430 - DNA, 58 bp, Homo sapiens
ttctgtgggtctgtgtctgtgctctgtgctgcagtacacatgggcaggccactcagga

SEQ ID NO: 22431 - DNA, 121 bp, Homo sapiens
cctctcagctctgttggcctttggtggtaggtttgcatttacttgctcaacacagaacattgctttctaatgatgtaagttaaaagtaaagatgaagcctagagaacacaataaataggag

SEQ ID NO: 22432 - DNA, 81 bp, Homo sapiens
ctctcatatctctgtgtgtctgtgtctgtatgtgtatgtatgtgtgtatgtgtgctgtgtgtgcacatgtgtggtctggag

SEQ ID NO: 22433 - DNA, 76 bp, Homo sapiens
ctcgagttaactacatttcctgaatcaccagagttaatttaatggtgattgaagatagtgaggtgtgaagccagag

SEQ ID NO: 22434 - DNA, 97 bp, Homo sapiens
tacagaaaatttaaggagtcactcactctcagggtcttgcaagagagtaggatggcatttgcagactctgagagtgagtgccaccttaaattctgta

SEQ ID NO: 22435 - DNA, 95 bp, Homo sapiens
acagaatttaaggtggcactcactctcagagtctgcaaatgccatcctactctcttgcaagaccctgagagtgagtgactccttaaattttctgt

SEQ ID NO: 22436 - DNA, 75 bp, Homo sapiens
catggccacatgaatgtgagactatcttccatgagttatggtcagcttgttcttgtctcactgtctgggtcactg

SEQ ID NO: 22437 - DNA, 69 bp, Homo sapiens
tgtgtatatatgtgtgtgtgtgtatatatatatgtgtgtgtgtatatatatatatatacacacacagat

SEQ ID NO: 22438 - DNA, 95 bp, Homo sapiens; identical to SEQ ID NO: 68

SEQ ID NO: 22439 - DNA, 93 bp, Homo sapiens; identical to SEQ ID NO: 69

SEQ ID NO: 22440 - DNA, 102 bp, Homo sapiens
tgtatgctgattttgtacctggaaactttactgaatttgtttatcagttctaacagttttttggtggattctttaggtttttccaaacataagattgtatca

SEQ ID NO: 22441 - DNA, 177 bp, Homo sapiens
gtacatatatatatatcccatctcatatatatatatatctcatcctatatatataaagaaactttatatatataaaaagaaactgtggtatatatatgatgaaatatatatatataaactgtggtatatatatgatatatatatcatatatatgatttattttatatatattccatc

SEQ ID NO: 22442 - DNA, 86 bp, Homo sapiens
gtatatatatatgtgtgtatatatatatgtgtatatatatatatatgtgtgtatatatatatatatgtatatatatatatatatat

SEQ ID NO: 22443 - DNA, 107 bp, Homo sapiens
gaattttagcattggatcccttcagctgtgacaaaggagaaggtccatggttataaagttttccattagactctcctcacacacaggaaatgaacttccataaattt

SEQ ID NO: 22444 - DNA, 95 bp, Homo sapiens; identical to SEQ ID NO: 68

SEQ ID NO: 22445 - DNA, 93 bp, Homo sapiens; identical to SEQ ID NO: 69

SEQ ID NO: 22446 - DNA, 87 bp, Homo sapiens
actcattaagaaagttttgagggaggggagatcttaaattttttttttttttgagatggagtctcactctgtcgcccaggctggagt

SEQ ID NO: 22447 - DNA, 68 bp, Homo sapiens
tatgagtgagactgggtatgtttaagaggtatatatgtatttcttattctgtgaccagtctgttcata

SEQ ID NO: 22448 - DNA, 107 bp, Homo sapiens
gagttgttcagctggactggggcatggtggatttaaaaaggattagtgacttcttcaatttatttttttaatattttatagactactgtgtacaggtctttcagctc

SEQ ID NO: 22449 - DNA, 99 bp, Homo sapiens
acataatatatacatatataatatatacatatataatatataatatacatacatttatattatatatatgtgtgtgtatatatatgtgtgtgtatgtgt

SEQ ID NO: 22450 - DNA, 76 bp, Homo sapiens
gtctcagttggggggttttaactttgtcttttcttttctttttttttgagacagagtctcactctgtcactcaggc

SEQ ID NO: 22451 - DNA, 58 bp, Homo sapiens
tgagacggggtctcgctctgtcactcaggctggagtgcagtggtgcgatctcggctca

SEQ ID NO: 22452 - DNA, 100 bp, Homo sapiens
agagtgagactctgtctcaaagaaaaggattctttcacaaacgacgaatgacagtttatcttgaacttttttttttttttggcaaagttttttttgctct

SEQ ID NO: 22453 - DNA, 97 bp, Homo sapiens
ggcaacaagagtgaaactttgtctcaaaaaaaaaaattttttttcttttttttctttttctttttttttttttgagaccgagtctcactctgtcgcc

SEQ ID NO: 22454 - DNA, 61 bp, Homo sapiens
tgagaagggggtctctcgctctgtcacccaggctggagtgcagtagtgagaccttggctca

SEQ ID NO: 22455 - DNA, 88 bp, Homo sapiens
cctctctgggtagcacagaaagctagctttttttctttttcttttctttttttttttgggatgaagtctcgctctgtcaccaggctgg

SEQ ID NO: 22456 - DNA, 107 bp, Homo sapiens
tggttctggggaaaaggaggcattcgttatctttttagcatgtcactctctgtttctcagaaaggtccagaagtttcaggaacactgagaactccagggaggatggc

SEQ ID NO: 22457 - DNA, 91 bp, Homo sapiens
ccttccaccttggcctcccaaagtgctgagattacagatgtgagccacaattttatttttagtttacaacaggaacctgggggtagggggg

SEQ ID NO: 22458 - DNA, 69 bp, Homo sapiens
gcctgggcaacataacgagaccctgtttttttttttttttgagacaggatctcactctgtcacccaggc

SEQ ID NO: 22459 - DNA, 116 bp, Homo sapiens
ggcaacaagagcgaaattccatctctaaataaattaattaaattaaaaataataaaaaattttattattgttgttatttatttatttatttttttgagacggagtcttgctctgtc

SEQ ID NO: 22460 - DNA, 58 bp, Homo sapiens
tgagaccaagtctcgctctgtcactcaggctggagtgcagtagcacaatcttggttca

SEQ ID NO: 22461 - DNA, 101 bp, Homo sapiens
agaaactggatttggtaagaaatgttgaaagcagaagtgagattcctttgaatttttttttctttttcataagtgacatctctatgtcatgtctagtttct

SEQ ID NO: 22462 - DNA, 64 bp, Homo sapiens
gtctgatttctgaggcagagagtttcttttttttttagacagagtctcgctgtgtcacccaggc

SEQ ID NO: 22463 - DNA, 117 bp, Homo sapiens
tgagccatggcacctagccatgtttggtatctttattctcattatgtagttgagaaaatctgacatcagagagagtaacctgcttaagcacaggggttagaatgtatgtcaggctta

SEQ ID NO: 22464 - DNA, 58 bp, Homo sapiens; identical to SEQ ID NO: 17852

SEQ ID NO: 22465 - DNA, 85 bp, Homo sapiens
ccaggaatctctcagtgactcaggctcttctttcgggctcttggaggaacatgagcaccagtgcgtgggtcacgcaaagacctgg

SEQ ID NO: 22466 - DNA, 92 bp, Homo sapiens
aggaaaggaatatatatatatatatatacacacacacatatacatatacatatatatgtgtgtatatatatatatgtatatatatttatctt

SEQ ID NO: 22467 - DNA, 103 bp, Homo sapiens
gccatgcctcttgttgttgttgttgttgtcactgtaaatggagtaacattttactcacagagaagacacagagcaagatcagctttaataagtgagcactggt

SEQ ID NO: 22468 - DNA, 95 bp, Homo sapiens; identical to SEQ ID NO: 68

SEQ ID NO: 22469 - DNA, 93 bp, Homo sapiens; identical to SEQ ID NO: 69

SEQ ID NO: 22470 - DNA, 95 bp, Homo sapiens; identical to SEQ ID NO: 68

SEQ ID NO: 22471 - DNA, 93 bp, Homo sapiens; identical to SEQ ID NO: 69

SEQ ID NO: 22472 - DNA, 86 bp, Homo sapiens
gggagagtcctgggaacaggagctcactcagagcagagtccacattcactcagctcccagagtggttctcttctgttcctctcccc

SEQ ID NO: 22473 - DNA, 95 bp, Homo sapiens; identical to SEQ ID NO: 68

SEQ ID NO: 22474 - DNA, 93 bp, Homo sapiens; identical to SEQ ID NO: 69

SEQ ID NO: 22475 - DNA, 93 bp, Homo sapiens
gccatgggtcattagaaatgtagtttaatttttaagtattttggaattttctagacctctcattgttattgatttctaatttaattccatggt

SEQ ID NO: 22476 - DNA, 90 bp, Homo sapiens
atatatgtaataactgtgtacgtatatacatacgtctgtgtatatgtgtatacttgtgtatatgtatatacatataactgtgtgtatata

SEQ ID NO: 22477 - DNA, 96 bp, Homo sapiens
tgaggcagagtctcactctgttgcccaggctggagtacagtggtatgattgcagctcactgctgcctcaacttcctgagctcaggtgattgtctca

SEQ ID NO: 22478 - DNA, 95 bp, Homo sapiens; identical to SEQ ID NO: 68

SEQ ID NO: 22479 - DNA, 93 bp, Homo sapiens; identical to SEQ ID NO: 69

SEQ ID NO: 22480 - DNA, 89 bp, Homo sapiens
taacaaaaatctttttttcactttcctgcctcagtgccaaaactgtcactgtcagtcactgctctggattggataaaagacagttgtta

SEQ ID NO: 22481 - DNA, 58 bp, Homo sapiens
tgagactgagtctcactctgtcactcaggctggagtacagtggcgcgatctcggctca

SEQ ID NO: 22482 - DNA, 73 bp, Homo sapiens
tatatatacacacatatgtatgtgtatatatgtttatgtactatatatacacatacatatgtgtgtatatata

SEQ ID NO: 22483 - DNA, 97 bp, Homo sapiens
aggtatatatgtgtattacacatatatgtacgtatatatatataaatgcagtgtatatgtatatatgtagtgtatatgtgtatatatagtagtatct

SEQ ID NO: 22484 - DNA, 110 bp, Homo sapiens
catttccctgataattagtgatgttgggcattttttgatgttttttggccatttgtatatctttttttgagaattgtctatgtcctttgcccacttttgatgggattatg

SEQ ID NO: 22485 - DNA, 84 bp, Homo sapiens
attcttctttctctccctctgacagagcacaaagggattttctctgatattttctgtgagcatccggtggagctcctggaggat

SEQ ID NO: 22486 - DNA, 98 bp, Homo sapiens
tctgtatgtctgtatatatgtacagataatatatgcatatagatacagtatatatacatctgtatgtatatattatctatatgtagagaatgtataga

SEQ ID NO: 22487 - DNA, 57 bp, Homo sapiens
gtttgggacagagtctcactgtgtctccagactggagtgcagtggggtgacctcggc

SEQ ID NO: 22488 - DNA, 90 bp, Homo sapiens
ggaaatataaatataaatatatatatttgaacaatcatatacatacatatgtatgtatgtgtatatgtatgtatatatatgtcatgtgcc

SEQ ID NO: 22489 - DNA, 98 bp, Homo sapiens
tacctgtaaggtatagttaactgatacatcactgaatgtggtttaactaatgtttcacattcttttttttttattattatactttaagttttagggta

SEQ ID NO: 22490 - DNA, 96 bp, Homo sapiens
cagccatggggagaatggtgaatgaagaaaggctgcaggctccggggagtccttccttaggagtttcacatcttgtgtcaccaattaagggatctg

SEQ ID NO: 22491 - DNA, 115 bp, Homo sapiens
attgtataatgtatgtttgtgcaattaaaaacagtagaaatgttaggaggtaaacttatttttatttattgtatttaaaaaatttaatgtgcacactatacatgaaaaacacagt

SEQ ID NO: 22492 - DNA, 98 bp, Homo sapiens
cgtggaactgtgggcccattaaacctctttttctttataaattacccagtcttaggtatgtctttatctggagcatgagaatgggctaatacaccatg

SEQ ID NO: 22493 - DNA, 81 bp, Homo sapiens
ggtgatatgtgagttttctgatcaggaattgaaaatgacacttataattttttttttgagatggagtctcactctctcgcc

SEQ ID NO: 22494 - DNA, 102 bp, Homo sapiens
ttgagacagtttctgctcttttgttcaagatgaagtgcagtagtgtgcacatagttcattatagcctcaaactcctgggctcaggcaatcctcctatctcag

SEQ ID NO: 22495 - DNA, 89 bp, Homo sapiens
tcctctgcactcacagtcactgagtcctatggtgtctcagctccactactccacagactcaaaggacacttatgactcacaaaagagga

SEQ ID NO: 22496 - DNA, 92 bp, Homo sapiens
ttatagacacgaaaaagtaactttcctatgttattgaaaactattgaacttagttttcttagctctgagatatgactttctcctggatatgg

SEQ ID NO: 22497 - DNA, 75 bp, Homo sapiens
ggaaagggatcttaacattactgtttttgaactttaaatgggtctgccctgagatgggatgttgtaattcctgcc

SEQ ID NO: 22498 - DNA, 119 bp, Homo sapiens
cagagttaaatatatatatatatatatatatagtgtgtgtgtatatatatatatatacagtgtgtatatatatatacagtgtgtgtgtatatgctgtgtatatatactgtgtgtgtata

SEQ ID NO: 22499 - DNA, 110 bp, Homo sapiens
tggagatacagactgccatcttgctaccatgtggattagatctctgtgaagaaagtcagcacggaggaaagaagagttgagaaatggagggagaacaagtcatattgaca

SEQ ID NO: 22500 - DNA, 76 bp, Homo sapiens
ggaggctgaggtaggaggatcatttgagcttgggagatgtaggttgcagtgatccatgattgtgccactgcactcc

SEQ ID NO: 22501 - DNA, 69 bp, Homo sapiens
ttgtttgagacagggtctctctctgtcacccaggctggggtgcagcggtatgatcttggctcactgcaa

SEQ ID NO: 22502 - DNA, 93 bp, Homo sapiens
cctttctgattgggctaaagtcaaagtgtcagttttcctttctggagactcttgaggagaactgattttcttgctttttccagcttccagagg

SEQ ID NO: 22503 - DNA, 70 bp, Homo sapiens
ttgtttggagactgagtctcgctctgtcacccaggctggagtgcagtggcgcaatctcagctcactgcaa

SEQ ID NO: 22504 - DNA, 95 bp, Homo sapiens
tagcacagtacctgacatatatagatgtatatatatatacatacagacgtatgtgtgtacatgtatatagattttttaaaaaggcccatgaacta

SEQ ID NO: 22505 - DNA, 68 bp, Homo sapiens
gagcggttttcagactggcacactgaatcataagggtacctcagtgtgtactgtctttgatgatgctc

SEQ ID NO: 22506 - DNA, 107 bp, Homo sapiens
acactgctgaactctacactcagaatggttaacatgataaattttatatgtttgttttggtttttttgttttttgtttttttttttgagatgagagtctcgctctgt

SEQ ID NO: 22507 - DNA, 94 bp, Homo sapiens
ctagtgctggaattacagaagtgagccacctcgcccattccactttttttttttttttttttgagatggagtctcgctctgtcacccagactag

SEQ ID NO: 22508 - DNA, 58 bp, Homo sapiens
tgagacagggtctcactctgtcacccaagctggagtgcagtggtatgatcatggctca

SEQ ID NO: 22509 - DNA, 109 bp, Homo sapiens
cttttgacgtatatgtctttggatttcaaatggatggtttctatttattttttcatatctctgcaactcttcctatttcctggatccaaagatatgccagcacagggag

SEQ ID NO: 22510 - DNA, 66 bp, Homo sapiens
tatatgtctatatacatatatacacacacatatgtatgtatgtctatatatgtatatgtatatatg

SEQ ID NO: 22511 - DNA, 115 bp, Homo sapiens
cactacactccagcctgggtgacagagcgagactcagtctcattaaaaaaaaaaaaaaaaaaatttttttttttgatactgagtctcgctctgtcacccagactagagtccagtg

SEQ ID NO: 22512 - DNA, 93 bp, Homo sapiens
agtctgggtgacagagcgagactcagtatcaaaaaaaaaaatttttttttttttttttttaatgagactgagtctcgctctgtcacccaggct

SEQ ID NO: 22513 - DNA, 163 bp, Homo sapiens
tatatgtgtgtgtgtatatatatatgtgtgtgtatatatgtgtatatatgtgtacatatgtgtatatatgtatatatgtgtatatattatatatgtgtgtatatatgtatatatatgtgtgtgtgtgtatatatatatgcgcatatatatgtgtatatatatg

SEQ ID NO: 22514 - DNA, 58 bp, Homo sapiens
tgagactgagtctcactctgtcgccgagtctggagtgcagtggtgtgatcttggctca

SEQ ID NO: 22515 - DNA, 82 bp, Homo sapiens
tttcaaacataaagagtagaggtaataatgatgagcatgtacttgccatcattgagtctcaacacattttgtaattttgaaa

SEQ ID NO: 22516 - DNA, 107 bp, Homo sapiens
cattgaaataagtgactgtgttatataatgcagtgtaatgtatttgtagttgagatttttctaatgcaaaaaaatttaatgtattaaatatcctgtcagttgaaatg

SEQ ID NO: 22517 - DNA, 100 bp, Homo sapiens
catcacagttagggtgagaagtcaagtgtgtctgcctcttttgcctttttttttttttatttccaaggcagagtcttgctctgtcacccaggctggaatg

SEQ ID NO: 22518 - DNA, 95 bp, Homo sapiens; identical to SEQ ID NO: 68

SEQ ID NO: 22519 - DNA, 93 bp, Homo sapiens; identical to SEQ ID NO: 69

SEQ ID NO: 22520 - DNA, 108 bp, Homo sapiens
gaactgctttgtctattggggctttttattggttccatttgaattttagaatagtatttttctaattctgtgaagaatggcattggtagtttgataggcatagtgttc

SEQ ID NO: 22521 - DNA, 107 bp, Homo sapiens
gcagagccaaaccatatcttacatgaagaaacataaatgtctgttgaattgaattatatttagcaatcctaatgtagtgtataatatggcaaaattggctgttttgt

SEQ ID NO: 22522 - DNA, 128 bp, Homo sapiens
ccaaggttggccaggtgcagtggctcagacctgtaatgccagcactttgggaggctgaggtaggtggatcatttgaggtcaggagttcgagaccagcctggccaccatggtgaaaccccatttctact

SEQ ID NO: 22523 - DNA, 104 bp, Homo sapiens
aggaagtgggtttaaattctggccagtcaaaatgaatgcaaaaagttcaccttcttaggcattcaataaatgtttgttgatctgaattaaactgacccactcct

SEQ ID NO: 22524 - DNA, 96 bp, Homo sapiens
gttttatcaaagaaaggactttgtgagcaagagttgagaatatgttattacaacatgtttcttttctttttgcattagtccttattatgatagaat

SEQ ID NO: 22525 - DNA, 97 bp, Homo sapiens
tctccatttgttttcataactcctgataataagtggtttaggggattattattttaaaataaataactttgtccaagagcatgaaactaaattgaga

SEQ ID NO: 22526 - DNA, 75 bp, Homo sapiens
gtcagtctcactcccactatgtctcccctcaacagcaccgagtttgtttccaggcagctggtgagcagagctgac

SEQ ID NO: 22527 - DNA, 75 bp, Homo sapiens
cactctaattaccagagtgattcatggtcacattgcttcctcttctgtgacttttcctctgtgtgtctctgtgtg

SEQ ID NO: 22528 - DNA, 93 bp, Homo sapiens
ctacaatctgtacaaaaattaatgacctgcctagcttccacttttagctttatgaagtgagagagcagagttatgaaggtaacattttgctag

SEQ ID NO: 22529 - DNA, 92 bp, Homo sapiens
ggagctttcatggacagagagctttggttgtgaatgaccttaattacttggctatatttttgtttataacctgctccacactcaatgaatcc

SEQ ID NO: 22530 - DNA, 95 bp, Homo sapiens; identical to SEQ ID NO: 68

SEQ ID NO: 22531 - DNA, 93 bp, Homo sapiens; identical to SEQ ID NO: 69

SEQ ID NO: 22532 - DNA, 117 bp, Homo sapiens
cttacatctccagggcagtggggcagagattctacaagggtggaggcaggcagtgagaacagaaggtgctgaagctctttgtaagagagctgacttcatctgaaacacaatgtgagg

SEQ ID NO: 22533 - DNA, 58 bp, Homo sapiens
tgagacagggtcacactctgtcaccctggctggagcgcagtggtgtgatcacagctca

SEQ ID NO: 22534 - DNA, 111 bp, Homo sapiens
tgcttaggattgccttggctgtttgcggtcttttttggtaccatatgaattttaaaatagtgtgtttctaattctgtgaagaatgccaatggtagtttaatgggaatagca

SEQ ID NO: 22535 - DNA, 68 bp, Homo sapiens
aatatatatacatatgtatacattatatatacatatatacatgtttacattatatatgtatatatatt

SEQ ID NO: 22536 - DNA, 88 bp, Homo sapiens
tattttatatatgtacacaaatatatgtatatatgtgtgtatatgtgtatatatgtatgagtatatatgtgtgtatatatacacacat

SEQ ID NO: 22537 - DNA, 116 bp, Homo sapiens
ctgtggctgtctggcatcaccgtcattcctgactctgaattgacatgctaccaataagcaatcaattttttttttttgagacagggtcttgctctgttgcccaggctggagtgcag

SEQ ID NO: 22538 - DNA, 95 bp, Homo sapiens; identical to SEQ ID NO: 68

SEQ ID NO: 22539 - DNA, 93 bp, Homo sapiens; identical to SEQ ID NO: 69

SEQ ID NO: 22540 - DNA, 68 bp, Homo sapiens
gactcagggataaaaatatgggagggaaaggagggcactcgccttcactctctgtcacaccctgagtt

SEQ ID NO: 22541 - DNA, 81 bp, Homo sapiens
ctgcaagctgagagcatttttttttttaatcaagtggtattcccaaagtcctatcactgatctgattgcttcagaaagcag

SEQ ID NO: 22542 - DNA, 95 bp, Homo sapiens; identical to SEQ ID NO: 68

SEQ ID NO: 22543 - DNA, 93 bp, Homo sapiens; identical to SEQ ID NO: 69

SEQ ID NO: 22544 - DNA, 95 bp, Homo sapiens; identical to SEQ ID NO: 68

SEQ ID NO: 22545 - DNA, 93 bp, Homo sapiens; identical to SEQ ID NO: 69

SEQ ID NO: 22546 - DNA, 95 bp, Homo sapiens; identical to SEQ ID NO: 68

SEQ ID NO: 22547 - DNA, 93 bp, Homo sapiens; identical to SEQ ID NO: 69

SEQ ID NO: 22548 - DNA, 58 bp, Homo sapiens; identical to SEQ ID NO: 315

SEQ ID NO: 22549 - DNA, 106 bp, Homo sapiens
agctgagagggtttgtttacatcagaatcccacaaacatgtgagtaatgcattgttatgatgttaggaaggctatgatgtagataagtaatagtaatgttttagtt

SEQ ID NO: 22550 - DNA, 115 bp, Homo sapiens
tataggctatatatctatatatccatgtatgatatacatatgcatatatatactatatagtatatatatctatgaatgtacatatcatatatggatatatactatacagtatata

SEQ ID NO: 22551 - DNA, 89 bp, Homo sapiens
gttgaggtccttaagaaataattgcatatatagaagagacaccagagggcttgctcagtctgtctctctctgccatgtgaggaaccagc

SEQ ID NO: 22552 - DNA, 83 bp, Homo sapiens
ctactacaaaaagcttttctgtggtatattttagtatatttttaaaatatatctaaaaactgcagaaagcttttctgtagtag

SEQ ID NO: 22553 - DNA, 119 bp, Homo sapiens
gacaattccttaggctcccttatccatgacgctgatatttggaagaatactgattatttattttgtagagtgtccaccaaatgatttgtgtgatgttttcccatgttcaggcagtggtt

SEQ ID NO: 22554 - DNA, 89 bp, Homo sapiens
accaaggtgtggggattgttgactggtcaaagagagcagggtgaagtcatgggatgtggggattgttgactggtcaaagagagcagggt

SEQ ID NO: 22555 - DNA, 97 bp, Homo sapiens; identical to SEQ ID NO: 1307

SEQ ID NO: 22556 - DNA, 88 bp, Homo sapiens; identical to SEQ ID NO: 1308

SEQ ID NO: 22557 - DNA, 81 bp, Homo sapiens; identical to SEQ ID NO: 1309

SEQ ID NO: 22558 - DNA, 77 bp, Homo sapiens; identical to SEQ ID NO: 1310

SEQ ID NO: 22559 - DNA, 157 bp, Homo sapiens
tatgcacatacacacataaaatatctgatatacaaatataaatatatatagatatctacatatctctgtatatgtatatcatatatgtgtgtatatatatgtgtgtatatatatgtatatacatgtgtatgtacctgtgtatgtacacatgtgtgtg

SEQ ID NO: 22560 - DNA, 66 bp, Homo sapiens; identical to SEQ ID NO: 8248

SEQ ID NO: 22561 - DNA, 130 bp, Homo sapiens
gagctattgcatctggccaagatagtgacttttgtacattgatttgtatcctgcaactatactgaatttgtttatcatgtctaagagtttcttggtggagttgttaggttttttttaaatgtaagatcac

SEQ ID NO: 22562 - DNA, 74 bp, Homo sapiens
agagaaagtctttggagaacataaagatgttatgaatattcattttattattaagtcctcagtggattttgtct

SEQ ID NO: 22563 - DNA, 86 bp, Homo sapiens
ttaatgtatatatttacctataaattttataggtaaaatttttatcattttatctataaaatgaatgttaagtatacaagcattaa

SEQ ID NO: 22564 - DNA, 177 bp, Homo sapiens
atctgtatatatatatatatacatatatatatatatatgtatgtatctatctatatatatataggtatctatctatatatatataggtatctatctatatataggtatctatatatatgtatatataagccatctatatatatacttataaatatatagggggtgtgtgtgtatata

SEQ ID NO: 22565 - DNA, 100 bp, Homo sapiens
tgtaacttatttgtcacattgataagtgtgaatatacatgtgtgtgtatatatatgtatttgtcaaaactctacacttaaaatgtgtgcattttattata

SEQ ID NO: 22566 - DNA, 116 bp, Homo sapiens
ataaaaatgggctgatgcttggaaaagagttacagagtcagtgggatcaatgattattattattaataatattgatatctccagtgcttatattatcttttatgctcataatttat

SEQ ID NO: 22567 - DNA, 97 bp, Homo sapiens
tcatccttctaggtgaactagaactagccacctggcccctgcccagcaccagggagccaattttttgtttttgttttttatcttaggagataaatga

SEQ ID NO: 22568 - DNA, 111 bp, Homo sapiens
agaggttccacttttgttttccgacgttgttgtggagttataaagttaatattatttaaattttttaaaattttatttgttataaattcaaggaagtagagagaggcctgt

SEQ ID NO: 22569 - DNA, 59 bp, Homo sapiens
gccatatatatatgtatacatacgtatatatgtatatatgtgtacatatatatatctgc

SEQ ID NO: 22570 - DNA, 77 bp, Homo sapiens
gtgtgtgtgtgtgtgtgtgtgtgtacttggatctaatttatatatatctgtgtgtgtatacacacacacacacagat

SEQ ID NO: 22571 - DNA, 58 bp, Homo sapiens
tgagacagagtctcacactgtcacccaggctggagtgcaatggcgtgatctctgctca

SEQ ID NO: 22572 - DNA, 113 bp, Homo sapiens
gttgagggcttatttaataacagccactgtttttctggtggcggggggttggacagagtctcgctctgtcacccaggctggagtgcagtggcatgatcttggctcactgcaac

SEQ ID NO: 22573 - DNA, 117 bp, Homo sapiens
aaggtttccactgaaaagtcttctgtcaggcatattgatgaacaattctgttatttgtttgtttttgttttgtttttctcttcctgcttttagaattttttctttattgttgacctt

SEQ ID NO: 22574 - DNA, 58 bp, Homo sapiens; identical to SEQ ID NO: 14767

SEQ ID NO: 22575 - DNA, 56 bp, Homo sapiens; identical to SEQ ID NO: 14768

SEQ ID NO: 22576 - DNA, 85 bp, Homo sapiens
gctcaatagttggcttccaggaatagtagctacaccacaatgtagttgtgtatgtaaatgtttctgtatctcagtactacagagc

SEQ ID NO: 22577 - DNA, 113 bp, Homo sapiens
ggtgacccctttccctacttgaaagtaatgttcaaaaagagtgaaaagagagcagggttttttttttgtttttcttttttttaaggctttcatagtgagtagtatttttcccc

SEQ ID NO: 22578 - DNA, 73 bp, Homo sapiens
ggggaatgaaacattgctcattgtatttcaatgtgaatgattcattcattcaccagaaactttgagtgtcccc

SEQ ID NO: 22579 - DNA, 95 bp, Homo sapiens; identical to SEQ ID NO: 68

SEQ ID NO: 22580 - DNA, 93 bp, Homo sapiens; identical to SEQ ID NO: 69

SEQ ID NO: 22581 - DNA, 89 bp, Homo sapiens
tctgactggcatgagatggtatctcaatgtggttttgatttgaatttctctgatgaccagtgatgatgagcattttttcatgtgtctga

SEQ ID NO: 22582 - DNA, 93 bp, Homo sapiens
tgattctaaattaaaagttttaatttctccacaatatgaaaatgcttcaaattttcttgttgtaaatggcagaacgttaactttagagaatca

SEQ ID NO: 22583 - DNA, 98 bp, Homo sapiens
ctgttttggttactgtagccttgtagtgtggtttgaagtcaggtagcgtgatgcttccagctttgttctttttacataggactgtcttggctatgcag

SEQ ID NO: 22584 - DNA, 58 bp, Homo sapiens
tgaggcggagtctcgctctgtcattctggctggagtgcagtggtgcgatctgggctca

SEQ ID NO: 22585 - DNA, 104 bp, Homo sapiens
tagaaattataacttcctactttctggaaagatttttttttttttaaacagagttcaaaagaaggaaattctaacaggattaagtttaggataggtttattcta

SEQ ID NO: 22586 - DNA, 93 bp, Homo sapiens
gaaaggttctcagaacaaagatgggagtagtaatgagataaaatagactattgccattactcattaattcttttttttttttgagatggagtc

SEQ ID NO: 22587 - DNA, 110 bp, Homo sapiens
tcagtggaagagaatagacagaatgggagaggagcaatatttgaggagctaatggccaagaatttttttttcctttttttttttcttttttttttttcttttttttttgg

SEQ ID NO: 22588 - DNA, 83 bp, Homo sapiens
gaagtactttatatgaattaaaatgtattaagagctttctttatttttttactcttagcattttaaaagacattaagtatttc

SEQ ID NO: 22589 - DNA, 75 bp, Homo sapiens
gctggtcctgggggttgtctgcacagagtcctgtgatatgaactgtctgtgggtctctcagccgtggataccagc

SEQ ID NO: 22590 - DNA, 91 bp, Homo sapiens
tgtcagtgtatgtgtatgagaagcaagagctagactgtctctttactatacagtttattattattattttgcctctttatgaacactagca

SEQ ID NO: 22591 - DNA, 76 bp, Homo sapiens
tggagacaaaaaatcttgtacatttgctcctttctagattgcattgagaaggagtgtgtgtgtgtgtgtgtctgta

SEQ ID NO: 22592 - DNA, 117 bp, Homo sapiens
gacctctctttggagttatttattttcttataactgtagttataattacatgtatatttttatatatttataactgatatttagcacagttaatgagagtgttttccttcttaggtt

SEQ ID NO: 22593 - DNA, 110 bp, Homo sapiens
aatactttctgtatatgtttatttctaataaccacatgtatttttattttaactacagtgcctaatgaatgaaacatggaggaatcaagagttacgtaaacatgagtgtt

SEQ ID NO: 22594 - DNA, 112 bp, Homo sapiens
ggatttttttggctattcgggctcttttttggttccatatgaaatttaaagtagttttttctaattctgcaaagaaagtcaatggtagcttgatggggatggcattgaatct

SEQ ID NO: 22595 - DNA, 110 bp, Homo sapiens
tgaatatgctgtactttgtgctatgaatttgtctgtctgtgtcactccatcataaagagaagtaccttaggatagaacatgggcttaggaccacataagccagctgttca

SEQ ID NO: 22596 - DNA, 105 bp, Homo sapiens
cttcctgcatctgttgtttctcaagggcgttcagctaaactagtcaatatgttcaagtagcatattttggaggggtgtgttctgaacaccttcagatgcaagagg

SEQ ID NO: 22597 - DNA, 119 bp, Homo sapiens
gctattggggcttttttaaatttttggttccatatgaattttacagtagtatttttctatttctgtaaaaaaaatgatgctagtaatttgattgaaagagtgttgaatctatagatagc

SEQ ID NO: 22598 - DNA, 75 bp, Homo sapiens
aggctgaggcacagagaggttaaatgactgcctgacttgtatgtggcagaaacaactgcctctgtgtctctgtgt

SEQ ID NO: 22599 - DNA, 70 bp, Homo sapiens
gtccctctgtctatgtctgtgtcctaaccccctcttcttataaggacacaggtcatactgaattagggtc

SEQ ID NO: 22600 - DNA, 95 bp, Homo sapiens; identical to SEQ ID NO: 68

SEQ ID NO: 22601 - DNA, 93 bp, Homo sapiens; identical to SEQ ID NO: 69

SEQ ID NO: 22602 - DNA, 104 bp, Homo sapiens
caaagagtataagaattcctgttttattgcacaattatcagtattcagtatttttgttcttgaaatatgaaacaattggagaaataaaagagggatctgctttg

SEQ ID NO: 22603 - DNA, 109 bp, Homo sapiens
taggaagtatggacaatatggaggggattttagtggagaagaacctttaaagtgaagactcagaagtgtgtctgcagcagggctactcaaagtgtggtccatgaactta

SEQ ID NO: 22604 - DNA, 58 bp, Homo sapiens; identical to SEQ ID NO: 6359

SEQ ID NO: 22605 - DNA, 117 bp, Homo sapiens
ccaagtaactgggactatgggtgtgagccaccacacctgtctaatttttttttttttttttttttttttgtagagacagggtctcactgtgttgctcaggctgtcttgaacccttgg

SEQ ID NO: 22606 - DNA, 102 bp, Homo sapiens
gcagtgttgaaagcatttccagacatttccaagggcagatgccaaggtcatgcatgactgtgtctgtgtgtgtaaatgtgtgtgtgctaagcattcattagc

SEQ ID NO: 22607 - DNA, 79 bp, Homo sapiens
tgctttgtttgtgttcttctgataattgcatctttaggagaaattcctgaatgaacacagagaggactttagcaacgca

SEQ ID NO: 22608 - DNA, 84 bp, Homo sapiens
gtcaggtactgagagagctggttgttaaaaaaaggctggcacctccctctttctctctcgctcattctctcgccatgtgcctgc

SEQ ID NO: 22609 - DNA, 92 bp, Homo sapiens
ataggtagaggaatagagcaacaaaagtatacagatatttaagcgtctgttttgaaataacattgcttttgttgctgtaacactatacctgt

SEQ ID NO: 22610 - DNA, 126 bp, Homo sapiens
gtatatgtattatatacatatatatacatatacgtatgtgtatatatgtatatatgtgtatatatgtatatacacatatgtatacgtatatatatgtatataatacatatatacatacatgtgtat

SEQ ID NO: 22611 - DNA, 58 bp, Homo sapiens
tgagttggagtctcactctgtcacccaggctggagtgcagtggcgagatctcagctca

SEQ ID NO: 22612 - DNA, 108 bp, Homo sapiens
ctggttacatgaaagatattagctgattatgacttgatatatttagactgttgattggtcattggttttcatttagtggtcaagagtgtctagcaaaatgctgactgg

SEQ ID NO: 22613 - DNA, 116 bp, Homo sapiens
ccttttgctgtgcagaagcattttagtttaatcaagtcccatctatgtatctttgtttttgttacatgtgcttttgggttcttgatcaggaagtctttgtctcaaagtctagaagg

SEQ ID NO: 22614 - DNA, 119 bp, Homo sapiens
gatatggattctcattgtggttttgatttgcatttttctaatgatcagtgatgttgagcatttttatatgattttttggtggtatgtatgtcttatcttaaaaagtgtctgttcatatc

SEQ ID NO: 22615 - DNA, 74 bp, Homo sapiens
ggctggggccccaggagagaccggcagaccaagagctgcttgtgtcagactgaccctctctcatgggcaaggcc

SEQ ID NO: 22616 - DNA, 98 bp, Homo sapiens
tatatgtatacatgtatagatcatgaatatgcatgtgatttatatgtatatatacatatagatacacacctatatacatatatacacagatatatata

SEQ ID NO: 22617 - DNA, 70 bp, Homo sapiens
catgtacacgtatatatatgtatatacatgtacacgtatatatgtatatatatgtatatacgtgtacatg

SEQ ID NO: 22618 - DNA, 120 bp, Homo sapiens
tgctactgattttgaaatattgattttgtatccttcaacttactgaatttgtttatcagtttaaatagttttttggtcgagtctttaggtttttccaaatataatatcatatcatctgca

SEQ ID NO: 22619 - DNA, 81 bp, Homo sapiens
gtttatgtatatataatatatagtatatatatagcatatgttgtatctatatatatattgtgtgtgtgtgtatacatatat

SEQ ID NO: 22620 - DNA, 111 bp, Homo sapiens
agataagggattggtttccttggctagttgctgcaggtcgtgggttggagttctatttttgtatatgatctggctattgtccatgtgtattcaatctcacaggcattatct

SEQ ID NO: 22621 - DNA, 95 bp, Homo sapiens; identical to SEQ ID NO: 68

SEQ ID NO: 22622 - DNA, 93 bp, Homo sapiens; identical to SEQ ID NO: 69

SEQ ID NO: 22623 - DNA, 77 bp, Homo sapiens
tgtatatatgtgtgtatatatgtatatatgtatatatatgtgtatatatgtatatatgtatatatactaaccctaca

SEQ ID NO: 22624 - DNA, 242 bp, Homo sapiens
atatgtgtgtatatatatatatgtatatatatgtgtgtatatatatgtatatatgtatatatatgtatatatgtatatatgtatatatgtatatatgtatatatatgtatatatgtatatgtgtatatatgtatatatgtatatgtgtatatatgtatatatgtatatatataagtgtatatatgtgtatatatgtgtatatttatgtatatatgtatatatgtatagatatgtatatatgt

SEQ ID NO: 22625 - DNA, 95 bp, Homo sapiens; identical to SEQ ID NO: 68

SEQ ID NO: 22626 - DNA, 93 bp, Homo sapiens; identical to SEQ ID NO: 69

SEQ ID NO: 22627 - DNA, 107 bp, Homo sapiens
tgcatcttgtaaggttttgtatattttttgtgcgttttttaaaatttattattatactttaagttttagggtacatgtgcacaatgtgcaggttagttacatatgta

SEQ ID NO: 22628 - DNA, 95 bp, Homo sapiens; identical to SEQ ID NO: 68

SEQ ID NO: 22629 - DNA, 93 bp, Homo sapiens; identical to SEQ ID NO: 69

SEQ ID NO: 22630 - DNA, 95 bp, Homo sapiens; identical to SEQ ID NO: 68

SEQ ID NO: 22631 - DNA, 93 bp, Homo sapiens; identical to SEQ ID NO: 69

SEQ ID NO: 22632 - DNA, 59 bp, Homo sapiens
gagctacatctaaagaggaatgttgaagggtatgccctctttgacagatttctcagctc

SEQ ID NO: 22633 - DNA, 58 bp, Homo sapiens
tgagacagggtctcactgtgtcacccaggctggagagcagtggcgagatcttggctca

SEQ ID NO: 22634 - DNA, 77 bp, Homo sapiens
cagagtgagactctgtctcagttactatagatggtctggtctttcacacattttaatgctgacagtgtctaaatctg

SEQ ID NO: 22635 - DNA, 103 bp, Homo sapiens
atatgcaatatatacaaatatatacatatatgtgtgtatatgtgtgtgtatatatatatatactatgaagtatgtatatgtatatagatatatatgtgctata

SEQ ID NO: 22636 - DNA, 77 bp, Homo sapiens
ttgtttgagtcgaagtctcgaagtctcactctgtcacccacgctggagtgcagtggcgcgatctcggctcaccgcaa

SEQ ID NO: 22637 - DNA, 91 bp, Homo sapiens
tttctttttctttctttctttttttttttttttctaagcactgggctaggtttttgaggtacaaagttgaaaaggaagtcagggtaagaaa

SEQ ID NO: 22638 - DNA, 89 bp, Homo sapiens
actgtattgtatatatgtatactgtatatatatatacagtttatgtgtgtatatatgctgtatatatgtgtatatatatacagtacagt

SEQ ID NO: 22639 - DNA, 107 bp, Homo sapiens
agggtttttttatttctgaatttatatgtgtgtatgtatttttaatatattttattttttagagtagttctagcttacagccaaaatgtcagaaagtaaaagaccct

SEQ ID NO: 22640 - DNA, 80 bp, Homo sapiens
gtggtaacattgcatgtcagactgaagaaagacacctgagtctatgttgagttgtgtttggccccttgcaaggttgtcat

SEQ ID NO: 22641 - DNA, 113 bp, Homo sapiens
gctactgacttttgtatgttgattgtgtatcctgcaactttgctgaatttgtttttcagttgtaaaattttttggtggagttttacgtctatatatgagattatgttgtctgc

SEQ ID NO: 22642 - DNA, 59 bp, Homo sapiens
taatcagtgactgacaggtgcaggggtagcaataccctggctccctgcatccctgattg

SEQ ID NO: 22643 - DNA, 95 bp, Homo sapiens; identical to SEQ ID NO: 68

SEQ ID NO: 22644 - DNA, 93 bp, Homo sapiens; identical to SEQ ID NO: 69

SEQ ID NO: 22645 - DNA, 113 bp, Homo sapiens
gcattttgttagatattatcaaatttttctccatgagtattgtcagattttttttgtattactactagcaatgtatgagaaaatctttttccataattttttcaacagagtgt

SEQ ID NO: 22646 - DNA, 91 bp, Homo sapiens
tatctatgtctgtgtatgtatttatagactatataatctatattctatatatattatgtatatatatatacatctggatagatagatgata

SEQ ID NO: 22647 - DNA, 72 bp, Homo sapiens
tcacttggcaactgaaattctgcttggaaatcagaattttttttaattacaaaggaaatttagttgtagtga

SEQ ID NO: 22648 - DNA, 88 bp, Homo sapiens
agggctggtatatttttatatgtaaatatatgtatattaaataaagtattaaatatgtgctacatatagcttagtatacatatgtact

SEQ ID NO: 22649 - DNA, 62 bp, Homo sapiens
ttataggctgaggtagttgtttctttgctggctgtcagctgagggctattcccagcctttag

SEQ ID NO: 22650 - DNA, 109 bp, Homo sapiens
gtagagagagctggaagatggggctgagctggtactttggaataacggggtctctctctgtctctccttgaaagctcagggtttctccctctccatgtggtctctctat

SEQ ID NO: 22651 - DNA, 56 bp, Homo sapiens
gagacaaggtctcactctgtcacccaggctggagtacagtggtgggatcatagctc

SEQ ID NO: 22652 - DNA, 78 bp, Homo sapiens
tcacatgtatgtatatgtgtgtgcataggtcctgtagatataatcacctatacatcatgtatgtatgtatgtatgtga

SEQ ID NO: 22653 - DNA, 58 bp, Homo sapiens
actgggagacacagacccactctcaatctgggtgggcaccatctaatcaactcccagt

SEQ ID NO: 22654 - DNA, 60 bp, Homo sapiens
acagactgttagaattcactgtgttcagaatggagctcgtgatcttttcccccagtctgt

SEQ ID NO: 22655 - DNA, 115 bp, Homo sapiens
tgaggtctttatcaggaatatagtgtataatctggttttaaaatcagaaaatgttgacttctgaatctgtagaactgaagataatactatgacatgatactgcaattctacctca

SEQ ID NO: 22656 - DNA, 66 bp, Homo sapiens
gtgtatatatagagagagatatataaatacgtgtgtgtatatatatatgtgtgtgtatgtatatat

SEQ ID NO: 22657 - DNA, 61 bp, Homo sapiens
cggtacctcagttggaaatgcagaagtcacctgtcttctgtgtcgctcacactgggagctg

SEQ ID NO: 22658 - DNA, 81 bp, Homo sapiens
gtaagtcaccaggaaggccaagtgcagcaccctgtacataataggattatgcagaggcatgctcactctgtctgtgactgc

SEQ ID NO: 22659 - DNA, 76 bp, Homo sapiens
ggcacatagtaagtgctcaataaatagtggctattattatttatagttattaacttttttgagaatgcaagatgcc

SEQ ID NO: 22660 - DNA, 93 bp, Homo sapiens; identical to SEQ ID NO: 69

SEQ ID NO: 22661 - DNA, 95 bp, Homo sapiens; identical to SEQ ID NO: 68

SEQ ID NO: 22662 - DNA, 93 bp, Homo sapiens; identical to SEQ ID NO: 69

SEQ ID NO: 22663 - DNA, 188 bp, Homo sapiens
atattatatatatatgtgtatatatatatacatatatatgtatttacatatatacatatatgtatttatatatatacatatatatgtatttatatatacatatatatttatatatatatacatatatatgtatttatatatatgcattttgcatatatatgcatctatctatctatgtatgtatatat

SEQ ID NO: 22664 - DNA, 77 bp, Homo sapiens
gtcatccagccattttcttaaggaggaatcatggcaaaaaaattccatgaatttttgcatattttaaatggtttgac

SEQ ID NO: 22665 - DNA, 79 bp, Homo sapiens
acatatatgtatgtttataatagatgtatgtataaacataatttctatatatctcaatatatctcacatatatgtatgt

SEQ ID NO: 22666 - DNA, 100 bp, Homo sapiens
ggtcatcttgaataacaaggctttttctttaagaaattcaattcaaatcacagacattaagattggttttgtggaaaaggtatttggtcttttactgacc

SEQ ID NO: 22667 - DNA, 101 bp, Homo sapiens
gcatgtcccaccatgcccagctaattttgtttattttttgtagagatgaggtctctactcactgtgtttcctgggctggtctccaacttctgggctcaagc

SEQ ID NO: 22668 - DNA, 80 bp, Homo sapiens
ccacaagtgcatgagatcacacccagctaattctttgcctttttgtagagatgaggtctcactgtgtctcaaactcctgg

SEQ ID NO: 22669 - DNA, 108 bp, Homo sapiens
tgtggctgaatagtacttcattgtgtataggcaccacattttcttttttttattattattatactttaagttttagggtacatgtgcacaatgtgcagttttgttaca

SEQ ID NO: 22670 - DNA, 94 bp, Homo sapiens
aaccacattttggagttaggaaaggtgttgctgagtttctttttgttttatttcttattttcgtatttcagtagctctagaggtacaagtggtt

SEQ ID NO: 22671 - DNA, 113 bp, Homo sapiens
gacgtttagttcattgttccttttgaagtatctttcttattgacttatagtggatgattactgatttaggtccaatagtctgtgatgtctttataggaaataccagaaatgtt

SEQ ID NO: 22672 - DNA, 104 bp, Homo sapiens
gatatggctagaaaatttaagtttgcataagctaagtgaagttatacgtgccgttctttatttttttaaaacttatcaaaatattatgactgtctttccatgtc

SEQ ID NO: 22673 - DNA, 70 bp, Homo sapiens
tttctgctgattagtgatatcgagtatcctttcgtgttcgttggttatttgtatatcatttttggagaaa

SEQ ID NO: 22674 - DNA, 58 bp, Homo sapiens
tgaaacagagtctcactctgtcactcaggctggagtgcagtggtgctatctctgctca

SEQ ID NO: 22675 - DNA, 119 bp, Homo sapiens
gtgggttgtgaaaaagagtctggcttccaaagtttacattcacagatgtaaagatctatttatattaagatatcttagcattttgggataaactttggccattcatttattcaatccac

SEQ ID NO: 22676 - DNA, 57 bp, Homo sapiens
tgagacaggtctcactctgtcacccaggctggagtgcagtggtgtgatctgggatca

SEQ ID NO: 22677 - DNA, 97 bp, Homo sapiens
tagagactttatgtgactggtaatccttggctctctatttctatttaaatatgaggaataatatagctaatatttacacagtgattattaagtgcta

SEQ ID NO: 22678 - DNA, 56 bp, Homo sapiens; identical to SEQ ID NO: 324

SEQ ID NO: 22679 - DNA, 111 bp, Homo sapiens
tgtgacaacccttgttgagcaaatctattgggaccattttttccaacagaatgtgctcactttgtgtctctgtcacattttggtaatgctcccaatatttcaaacttttgc

SEQ ID NO: 22680 - DNA, 89 bp, Homo sapiens
ccttatgaattttgcattttgggctggtattataaatggagttgtatattttatttcatttttaactgtccattgcaagtgtatagagg

SEQ ID NO: 22681 - DNA, 95 bp, Homo sapiens; identical to SEQ ID NO: 68

SEQ ID NO: 22682 - DNA, 93 bp, Homo sapiens; identical to SEQ ID NO: 69

SEQ ID NO: 22683 - DNA, 93 bp, Homo sapiens; identical to SEQ ID NO: 69

SEQ ID NO: 22684 - DNA, 109 bp, Homo sapiens
gccttttgtggttcatatgaattttttaatctttatttttatatttctgtgaaaaaatgtcattggaactctgatagggattgtactgaatctgtagatctctttgggt

SEQ ID NO: 22685 - DNA, 60 bp, Homo sapiens
gagactgagtctcgctctgtctcctagactggagggagtgcggtggtgcgatctcggctc

SEQ ID NO: 22686 - DNA, 58 bp, Homo sapiens
tgagacggagtctcactctgtcacccaggctggagtgcagtggcgcgatctccgctca

SEQ ID NO: 22687 - DNA, 119 bp, Homo sapiens
atatatgtgtatatacgtgtatatatgtacatatatgtgtatatacatgtgtatatgtacatatctgtatatatgtatatgtgtatatacgtggtatatacacgtatatacacatatat

SEQ ID NO: 22688 - DNA, 102 bp, Homo sapiens
ttgtccttttttcttagtcttgctttggatatgtgggctgtttttttttttattccatatgaattttaggatagcttttctagttctgtgaaaaaatgatga

SEQ ID NO: 22689 - DNA, 104 bp, Homo sapiens
cagctctaattattagaattctttgctgttggcatcttgctggaatttttcttttttcataaagagactttcttccaaaatattttcagcctcttaatcagctg

SEQ ID NO: 22690 - DNA, 57 bp, Homo sapiens
ctgcctccctcactgcgtgggtggccgagatcatgcacactgtggcgggaatagcag

SEQ ID NO: 22691 - DNA, 105 bp, Homo sapiens
gccctcttccctgtccataacttccgcacagcccctttatcaaaaactttttttctttttcttttttttagacagagtctggctctgttgcccaggctggagtgc

SEQ ID NO: 22692 - DNA, 80 bp, Homo sapiens
ggatgtctaggtctctaggaaggctggggaagttttccttgattatttccccaaatgtgttttccaagcttttagaattc

SEQ ID NO: 22693 - DNA, 96 bp, Homo sapiens
gtgggattgctagataatacggtaattctatttttagttttttgagaaatctctataatttttttccatagtagctgtgcttacttacattcccac

SEQ ID NO: 22694 - DNA, 112 bp, Homo sapiens
tgttagacaacagtatttcaggatcaaccaaatatgtacttagcgtgtgtgtatgtatagatattttttgataaatatatttgatattgatatttgagatatttatttgata

SEQ ID NO: 22695 - DNA, 111 bp, Homo sapiens
tagaagggatatctagggttgtaagataatatttgtacatgtaaatgcacatagtaataaaattgtgtatatttaagaaatagggcatctttttcctttgtattactttta

SEQ ID NO: 22696 - DNA, 96 bp, Homo sapiens
cactagtagtgtattagtttatcagagttccaatttcttttttttttttcttgagactgagtcttgctctgttgcccaggctggagtgctgtggtg

SEQ ID NO: 22697 - DNA, 85 bp, Homo sapiens
tgaggaaaggtaaaagagtcctagcccaagtatgtctcacagaggttacaatgggtctgtggctcactctttgattctttcccca

SEQ ID NO: 22698 - DNA, 119 bp, Homo sapiens
aagttcataagagggatgagaactggttaatattgagcacaaacgttactagagagtgactatctctctcagtgtggtgcttaggataaacatacattcacatactgtttattatactt

SEQ ID NO: 22699 - DNA, 114 bp, Homo sapiens
acttgttcaaaaaggaatgtcataattctgggggtttgtgtaagaaatttatttttattagtttttttttcttccaatacccctagtcattgtcatctagtttgaacttaaagt

SEQ ID NO: 22700 - DNA, 104 bp, Homo sapiens
tttaattaggatgtagccaggtattgatctttttgaatttatcctacttggaattcattgagcttcttggatgtgtagattagtatttgtcatcaaattttgag

SEQ ID NO: 22701 - DNA, 88 bp, Homo sapiens
agagaattgcttaagcccaggaggcagaggttgctgtgagccgagaccgtgccactgcctgagtgcctgagtgacagagcaagactct

SEQ ID NO: 22702 - DNA, 121 bp, Homo sapiens
cgtatgttgtatatatatgtgtgtgtatgtactacatatatacattatatatgtatatgtgtgtatgtactacatatatacattatatatatgtatatgtgtgtatgtactacatatatac

SEQ ID NO: 22703 - DNA, 85 bp, Homo sapiens
tccattttatattgtgtattcattaagaaatttttataaatatagttattcttaatgggtgatgattcagtataattcaagtggg

SEQ ID NO: 22704 - DNA, 82 bp, Homo sapiens
atatatttatatatgtgtatatatacacatatgtatatgtatatatgtgtgtatatatacacatatgtatatgtatatatgt

SEQ ID NO: 22705 - DNA, 118 bp, Homo sapiens
tgcttaggattgtcttggctatatgggctcttttttggttccatatgaaatttaaagtagttttttctaatactgtgaagaaagtcattggtagcttgatggggatagcattgaatct

SEQ ID NO: 22706 - DNA, 89 bp, Homo sapiens
cttgatcatggtgcattatcgttttgatatgctgttggattcagttaggtagtatgttgtagagaatttttgcatctatgttcatcagg

SEQ ID NO: 22707 - DNA, 72 bp, Homo sapiens
gggttccagtgaatttgcatatgtgcgtgtaattacacgtgtgtttgtgcatgtgcatgtgtttgtgtgcct

SEQ ID NO: 22708 - DNA, 63 bp, Homo sapiens
gtgcgtgtgtgtgtgtgtgtgtgtgcagcgcgcttgcacatgacacacacacactttcattcc

SEQ ID NO: 22709 - DNA, 104 bp, Homo sapiens
gaaagggtggcttctttttttttgagacggagtctcgctctgtcaccctggctggagtgcagtggcatgatctcggctcagtgcaaccttggcctcccgggttc

SEQ ID NO: 22710 - DNA, 61 bp, Homo sapiens
aagtcagagtagatagtgggcactgaaataactggactgtggccctctgtgtgcctgtctt

SEQ ID NO: 22711 - DNA, 107 bp, Homo sapiens
ggtgtgtgtgtgtgtgtgtgtgtatatatatatatgtatatgtgtgtatatatatagatgcatatatgtatatatatgtgtatacatgtgtgtatatatatctcagt

SEQ ID NO: 22712 - DNA, 164 bp, Homo sapiens
catatatatatacatgaccatatatatacatatgaccatatgtatatgaccatatatatgtgtatgtatatgtatatatgtatatgtgtgtatatatacatatacatgtgtatatatatgtgtatatatatatgaccatatatatggacatatatatatatata

SEQ ID NO: 22713 - DNA, 95 bp, Homo sapiens; identical to SEQ ID NO: 68

SEQ ID NO: 22714 - DNA, 93 bp, Homo sapiens; identical to SEQ ID NO: 69

SEQ ID NO: 22715 - DNA, 58 bp, Homo sapiens
tgagatggagtctcactctgtcacccaggctggagtgcagtggtgtaatctccactca

SEQ ID NO: 22716 - DNA, 98 bp, Homo sapiens
caaagatttctcctgtgttagatacattttaagtggttatagggatcaactaatgcatattatttaattatttaataacagggagagggactgctttg

SEQ ID NO: 22717 - DNA, 58 bp, Homo sapiens
tgagtcagagtctcgctctgtcacccaggctggagtgcagtgatgtgaccttggctta

SEQ ID NO: 22718 - DNA, 112 bp, Homo sapiens
ttagtgtgggtatgtagatgagaaactgaggctaggaggaggaggctttttttttggtttaaaatcatggtgaatggcttcaaattcagcttggttttgatatttatattgg

SEQ ID NO: 22719 - DNA, 104 bp, Homo sapiens
ggtttgttgttgttgttgtcatcgttgttgctgttgtttgagaaagggtctcactctgtcactcaggctggagtgcagtggtgcaatctgggctcattgcaacc

SEQ ID NO: 22720 - DNA, 89 bp, Homo sapiens
taatctaatttgcttttcagtttggaaactccctcactcactgcttcagacttttaaggggtttaggatagaaaggaaaggaaagatta

SEQ ID NO: 22721 - DNA, 78 bp, Homo sapiens
agacatttatttatctcacactttctgtctgtcaggaccctgggagaggctcagctaagtggatctggatcagagtct

SEQ ID NO: 22722 - DNA, 116 bp, Homo sapiens
gggagcacatgagcaaatgaggcaggaactggagtacatgagagctgaagttagccagacactctgacactggcaggagcaaacttcattcacttgaacctgctgtgttctgcccc

SEQ ID NO: 22723 - DNA, 117 bp, Homo sapiens
tttttgcttaggattgtcgtggctatgcaggctctttttttggttccatatgaaatttaaagtagttttttccaattctgtgaagagtcagtggtagcttaatggggatagcattga

SEQ ID NO: 22724 - DNA, 89 bp, Homo sapiens
ataaataaatatatatatatatatataatatttatatatatatatataatatttatatatatatgtgtgtgtgtatatatgtatgtata

SEQ ID NO: 22725 - DNA, 95 bp, Homo sapiens; identical to SEQ ID NO: 68

SEQ ID NO: 22726 - DNA, 93 bp, Homo sapiens; identical to SEQ ID NO: 69

SEQ ID NO: 22727 - DNA, 95 bp, Homo sapiens; identical to SEQ ID NO: 68

SEQ ID NO: 22728 - DNA, 93 bp, Homo sapiens; identical to SEQ ID NO: 69

SEQ ID NO: 22729 - DNA, 117 bp, Homo sapiens
tttctgtctcaataatctatctagtgctgtcaggaaggtgttggagtcctccaccttttttttttttttttttcaatatctgttctaagctgtttggtttattttggaagatgggaa

SEQ ID NO: 22730 - DNA, 58 bp, Homo sapiens; identical to SEQ ID NO: 884

SEQ ID NO: 22731 - DNA, 56 bp, Homo sapiens; identical to SEQ ID NO: 885

SEQ ID NO: 22732 - DNA, 109 bp, Homo sapiens
gttggggtggggcctaataggaggtgtttatgtcataggggcttttatgtcattatgtttatgtcattatgtcaccacataaatggcttggtgctggccttatgatgat

SEQ ID NO: 22733 - DNA, 70 bp, Homo sapiens
aatttctacagagtagagattaattttgtgttttgacacaatctaagaatctttgtatttctgagggatt

SEQ ID NO: 22734 - DNA, 110 bp, Homo sapiens
tgttattgaaagtgggatattgaagttttctattattattgtattgcagttatctctttatgtctgctaatattagctttatatatttaggtgttccattgttgaatgca

SEQ ID NO: 22735 - DNA, 116 bp, Homo sapiens
tacacctagcagtgggattgctggatgatgtagtagttctatttttaattttttgaggaacttccaaactgttcttcacagtggctgtacaaatttccgttcccaccaacagtgta

SEQ ID NO: 22736 - DNA, 116 bp, Homo sapiens
ttacttttattcaggtatttttttcttaattgttaacttttaatttttatgtgtacatagcatgtatatttatttatgaggtacatgggatattttgatactggcatgacaggtaa

SEQ ID NO: 22737 - DNA, 94 bp, Homo sapiens
agaggtgaaacacttgcttaatagtcctaatcaacatatttggtttattttttttatgaattcaactaggagtggacaagtcagtacaacctct

SEQ ID NO: 22738 - DNA, 95 bp, Homo sapiens; identical to SEQ ID NO: 68

SEQ ID NO: 22739 - DNA, 93 bp, Homo sapiens; identical to SEQ ID NO: 69

SEQ ID NO: 22740 - DNA, 89 bp, Homo sapiens
gggaggcacttcacaggacttatctatgactaatgattatgttctcctctaggaaaggtgtgatgcatgtagagtgggttcagcctcct

SEQ ID NO: 22741 - DNA, 69 bp, Homo sapiens
atgttcaactgtgtctgatgtctgtgagcccagagcttctctggttcaaagtatttccatagtaaatat

SEQ ID NO: 22742 - DNA, 94 bp, Homo sapiens
gaaatgagatcatggtgtctctgtgtgtgtatatatatatgtatatcatatatatatgatactgcaatttacatttattttctttatacatttc

SEQ ID NO: 22743 - DNA, 95 bp, Homo sapiens; identical to SEQ ID NO: 68

SEQ ID NO: 22744 - DNA, 93 bp, Homo sapiens; identical to SEQ ID NO: 69

SEQ ID NO: 22745 - DNA, 114 bp, Homo sapiens
tatggctgcatagtattccatgatgtatatgtgccacatttttttttatttttaattttattattattatactttaagttttagggtacatgtgcacaatgtgcaggttacata

SEQ ID NO: 22746 - DNA, 58 bp, Homo sapiens; identical to SEQ ID NO: 3385

SEQ ID NO: 22747 - DNA, 56 bp, Homo sapiens; identical to SEQ ID NO: 3386

SEQ ID NO: 22748 - DNA, 66 bp, Homo sapiens; identical to SEQ ID NO: 474

SEQ ID NO: 22749 - DNA, 66 bp, Homo sapiens; identical to SEQ ID NO: 8248

SEQ ID NO: 22750 - DNA, 92 bp, Homo sapiens
gtggtttgtagttctccttgaagaggtccttcccgtcccttgtaagttggattcctaggtattttattctttttgaagcaattgtgaatggc

SEQ ID NO: 22751 - DNA, 95 bp, Homo sapiens
aaggggctagaactgtgaactgtaaagctggcagagcctgagatatttccatttttattcaggctgtctgtctgcctctcatcatatggcctctt

SEQ ID NO: 22752 - DNA, 66 bp, Homo sapiens
tatggaaggtgagtggagtgtgagcagagagggggcctgtcacctttagtcatatatacttccata

SEQ ID NO: 22753 - DNA, 58 bp, Homo sapiens; identical to SEQ ID NO: 2442

SEQ ID NO: 22754 - DNA, 128 bp, Homo sapiens
tttatggttgaacagtacttgattgtacatatgcactacattttcttttaatttttatttttattttaagttccagggtacatgtgcaggatgtgcaggtttgttacataggtaaacgtgtgccatgg

SEQ ID NO: 22755 - DNA, 103 bp, Homo sapiens
attcaaatcacttctttccaatgtccagctgcttcaccccttctctctgactgagtctggggtctttataggcacaggatagggggcagggtgggccatgagt

SEQ ID NO: 22756 - DNA, 95 bp, Homo sapiens; identical to SEQ ID NO: 68

SEQ ID NO: 22757 - DNA, 93 bp, Homo sapiens; identical to SEQ ID NO: 69

SEQ ID NO: 22758 - DNA, 91 bp, Homo sapiens
tctctaacactcatcttctctctgtcacactcagggttggggtgcagccccagctgaggtctgaggacagtgggtggatgtggggcaggga

SEQ ID NO: 22759 - DNA, 59 bp, Homo sapiens
ggctcaataaagtgatgatgatgttgtttatgattatcatcatcatcattgttagggcc

SEQ ID NO: 22760 - DNA, 58 bp, Homo sapiens; identical to SEQ ID NO: 1265

SEQ ID NO: 22761 - DNA, 100 bp, Homo sapiens
tattccactgtatcccacctcaacccatctctcagtgggtcttatttatttattatagacaaggtctcactctgttgcctaggatggcatgctgggaata

SEQ ID NO: 22762 - DNA, 86 bp, Homo sapiens
atactttacttaaatgtgcatttattatgtaggttgtgtgacacatgacatactgtacattataaatttatgtttttacagagtat

SEQ ID NO: 22763 - DNA, 94 bp, Homo sapiens
atttgtgatatagtaatggaggaaaatactcaatttccgagagaggtcagggaaaacaaagtataattttttctttccaactaaatccacagat

SEQ ID NO: 22764 - DNA, 66 bp, Homo sapiens
cagtaagtgacagaagtgaaattttttttttttttgatatggagtctcactctgtcacccaggctg

SEQ ID NO: 22765 - DNA, 58 bp, Homo sapiens; identical to SEQ ID NO: 5268

SEQ ID NO: 22766 - DNA, 131 bp, Homo sapiens
ctagcaagagtggattctgttgtttgcaaccaaaaatctttttttttttttttgagacagagtctctctctgtcacccaggctggagggcagtggtgcgatcctggctcactgcagcctctgcctcacggg

SEQ ID NO: 22767 - DNA, 80 bp, Homo sapiens
tctgacaatcgatttcatatacataaaaacatggtgcttagttccatgtttttatgtatatgaaactctggggtgtaggg

SEQ ID NO: 22768 - DNA, 84 bp, Homo sapiens
agatctattcccaaacttttttttttttttttgagagacggagtcttgctctgtcacccagactagagttcagtggtgcgatct

SEQ ID NO: 22769 - DNA, 84 bp, Homo sapiens
ttcctaggctggaatatcaagagtgtaaagtggtatttttactttaaaaacccacagaaaatgtttttttattttcagcaggaa

SEQ ID NO: 22770 - DNA, 69 bp, Homo sapiens
caggaggttgtggaactgcattagcatgtgtacttattactgcctgaatctgcagccgcaggtttcctg

SEQ ID NO: 22771 - DNA, 91 bp, Homo sapiens
tatatgtacatagaagatatatgtatattgtatatacaatatatgtacatatatatgtacatatatataaaacatatatattacctcttct

SEQ ID NO: 22772 - DNA, 126 bp, Homo sapiens
ggggtctgcagccatggagcccttcttggtgctgctgttggggtccaagaaaaagccctgtgctcacttccctgtctctctccaaagtggacaatatatctgtccatactgctgcctgggactggg

SEQ ID NO: 22773 - DNA, 81 bp, Homo sapiens
ggtggaagggtgagaggtgatgggaagcagagtgagtgaagattgtcaacgttttctacacagcctctctctctctctgtc

SEQ ID NO: 22774 - DNA, 74 bp, Homo sapiens
tgactgtggtcatgttcctggtactttttttttaaatatcgattcctttgagtgcaggaacagagaactagtca

SEQ ID NO: 22775 - DNA, 101 bp, Homo sapiens
cattttgatatgtggtgcttttgtatatatttgtttttatagttttttagaggttgctctaagtattacaatatacatatgtaacacatcacagtaaactg

SEQ ID NO: 22776 - DNA, 95 bp, Homo sapiens; identical to SEQ ID NO: 580

SEQ ID NO: 22777 - DNA, 93 bp, Homo sapiens; identical to SEQ ID NO: 69

SEQ ID NO: 22778 - DNA, 60 bp, Homo sapiens
tgaggctttggtgtgcctgagagatttgcgaagtagagaagtgtctgagcacatgcctta

SEQ ID NO: 22779 - DNA, 95 bp, Homo sapiens; identical to SEQ ID NO: 68

SEQ ID NO: 22780 - DNA, 93 bp, Homo sapiens; identical to SEQ ID NO: 69

SEQ ID NO: 22781 - DNA, 109 bp, Homo sapiens
tggagtgagcagatataggatggagatgacaggagaggaacgatgctaacagtgtgaaactctcagtgtgtggttttgagctcactgcaatatatatcagaagatgcca

SEQ ID NO: 22782 - DNA, 103 bp, Homo sapiens
atcaaacaaacagcgaatactggattctcatgtaggtgagggcatgtcacagactctctgacccttacttgatgctcctgtgttgaccacctgtttcccggat

SEQ ID NO: 22783 - DNA, 72 bp, Homo sapiens
ggaggctgaggtaggaggatcacttgagcctgaaagtttgaggctgcagtgattgtacctgcactccagcct

SEQ ID NO: 22784 - DNA, 100 bp, Homo sapiens
tgcacataggcggtggatagattaatttttaaaagagtatgtatgtaaatatgtatatatacatgtaaataaaatgtgtgttcactgttaatattttgca

SEQ ID NO: 22785 - DNA, 69 bp, Homo sapiens
tatgtgtgtactttatcctatatatgcgtgtgtatatttatatatatagcatatattagtaagcatatg

SEQ ID NO: 22786 - DNA, 95 bp, Homo sapiens; identical to SEQ ID NO: 68

SEQ ID NO: 22787 - DNA, 93 bp, Homo sapiens; identical to SEQ ID NO: 69

SEQ ID NO: 22788 - DNA, 115 bp, Homo sapiens
tgcctccagctttgttctttttgcttaggattgtcttggctatatgggctcatttttggttccatatgaaatgtaaagtagttttttccaattctgtgaagaaagtcaatggtag

SEQ ID NO: 22789 - DNA, 100 bp, Homo sapiens
gtagttttaagcatgagattttgctcatcttttttcagatttatttcatactttttgatattgtcataaaagtctttgtaaaatttccgtttctgactat

SEQ ID NO: 22790 - DNA, 105 bp, Homo sapiens
tgagggatgggagggttggagtacacagactagtaggtgcaatgtccttcagacaagatagaatgcagcaatgttctggtaactaaaaaaggttcagaatactca

SEQ ID NO: 22791 - DNA, 104 bp, Homo sapiens
gagtgtgaatttctaatgtgaatagcaaaataaatgtttcaaaaattatatatttttggttttgctagtgttctaagctgtatagcacaagttatctctcattc

SEQ ID NO: 22792 - DNA, 115 bp, Homo sapiens
ttgtagtctcagctacttatgaggctgaggtggggtggattgcttgagcctgggaggttgagactgcagtcagtgagctgtgatcatgtcactgcattcacctgcacttcaacct

SEQ ID NO: 22793 - DNA, 112 bp, Homo sapiens
gcttgtaagagatacactgtagtagtcccagcaactcaggaggttgaggtagaaggatcactgaacccagggaggtcaaggctgggctgccactagtgagccataatcatgc

SEQ ID NO: 22794 - DNA, 100 bp, Homo sapiens
gtatatgtatatacgtatatgtatatatgtatatgtatacatatgcatatacatgtatatgtatatatgcatatatatgcatatatgtgtatacatatgc

SEQ ID NO: 22795 - DNA, 130 bp, Homo sapiens
acatatatataaaatatatataataagatacatgttttatatgtatatatgtatatatgtttatgtatatatgtatatacatatatgtatatgtatatatgtatgtacgtatatgtatatgtatgtatac

SEQ ID NO: 22796 - DNA, 103 bp, Homo sapiens
gcctgagtgacagagtaagaccctgtctcaaaaaaaaaaaaaaaccaaaaacagttatttatttatatttttttgagacagtatctcactgtgtcctccaggt

SEQ ID NO: 22797 - DNA, 94 bp, Homo sapiens
gaggacacagtgagatactgtctcaaaaaaatataaataaataactgtttttggtttttttttttttttgagacagggtcttactctgtcactc

SEQ ID NO: 22798 - DNA, 103 bp, Homo sapiens
gacttcaagttagctgacagtggctgctttagttccttgctccctttgctatagatattatctcactcactgtctccactctctaggttgacttcatgacttc

SEQ ID NO: 22799 - DNA, 85 bp, Homo sapiens
ttgctcttaaaagcatagctttgatttagattgacctggaataagttccatgtctgtcactcagtagctgtgtgattatgagcaa

SEQ ID NO: 22800 - DNA, 92 bp, Homo sapiens
gtgaggccctgtctaaacaaaaaaaaagaaagaaaaaagagcttaccaccatcaggtgtgctacatgtttgtttatttttgtggcatctcat

SEQ ID NO: 22801 - DNA, 118 bp, Homo sapiens
ttatattttgactttttaataatagttatctcactggtggaagatggtatttcattgtggttgtgatttgcatttctctaatgatcagtgatgttgaggtgtttttttaatatggtta

SEQ ID NO: 22802 - DNA, 121 bp, Homo sapiens
ccttatgtgttaagtgaggctctttttttttttttttgagacggagtctcactctgtcacccaggctggagtggagtgcagtagcacgatctcagctcactgcaacctctgcctcccgggt

SEQ ID NO: 22803 - DNA, 110 bp, Homo sapiens
gacaatgttgatgtaactatgtgtgtgtatgtgtatatgtatatgtatgtatatatatatatatatatatatatatatatatatatatatatttgtttttagactaagtc

SEQ ID NO: 22804 - DNA, 114 bp, Homo sapiens
ttagctctccccatgatctagcaactaaataaaatgactcctgacacagtagagtgtctccaggaccctgctccaactctactgccagcattagcagttctctatatcagctaa

SEQ ID NO: 22805 - DNA, 80 bp, Homo sapiens
gtatgtgtatatatctatatatatgcacagtttgtataatgatatatattataaaccatatataacatatatacacatat

SEQ ID NO: 22806 - DNA, 76 bp, Homo sapiens
cagcactttgggaggtcaaggctggtggatctcttgaggccaggagttcaagactagtgaaattccatctctactg

SEQ ID NO: 22807 - DNA, 94 bp, Homo sapiens
gccaaaagaataatgctagtatttatgttatggagctctaattttttttttttggacctatattgtccttagataattgctttgttattttggc

SEQ ID NO: 22808 - DNA, 64 bp, Homo sapiens
ggagtgctcacagtactgagtctgcaatgaggatgcagcctcaccattatccctgggggcaccc

SEQ ID NO: 22809 - DNA, 83 bp, Homo sapiens
gtgacttggcatgcatgggtctgtgtcagggactttttttttttttaatttttattttttgagatggagttttgctctgtcac

SEQ ID NO: 22810 - DNA, 98 bp, Homo sapiens
gattaccaggtctcttagatttatatttatttccaggtttaacttactaggtcaagtctttttctaattattatttttgagacacggtctggtctgtc

SEQ ID NO: 22811 - DNA, 115 bp, Homo sapiens
ccaaagtactaggggagaaaatctagtctatactcagatcaattaaaaagtatgtaagttttttttttttttttttgtttttgttttaagacagagtctccctctgtcacccagg

SEQ ID NO: 22812 - DNA, 81 bp, Homo sapiens
ttgttcaagtgcaagtgatgcaatgtgtgtgtgtgtatatatatatatatatatatatattttttttttttactttgacag

SEQ ID NO: 22813 - DNA, 115 bp, Homo sapiens
gatatgtaatttctgggctttgtttttgtttttttgtggggttttgtttttttttttcttcttgagacaagagtctcactttgtcacccaggctggagtgcagtggtgagatttc

SEQ ID NO: 22814 - DNA, 101 bp, Homo sapiens
cattatgacagatggatacatttcattagtgatcaatttcttcccattttttttttaatttatagaaatacacactagagtgtctcccaagggttgtaatg

SEQ ID NO: 22815 - DNA, 86 bp, Homo sapiens
gataggggccaagtcagtctgaatatcaactccacctctcggaatgtgatttttggcaagttactggctctctctcagtctctgtt

SEQ ID NO: 22816 - DNA, 113 bp, Homo sapiens
cctatgtaaaattgcagcctttctcctccaccacagttctaattcctgactccaatttttatttatttaagttccaggatacacgtgcaggatgtgcaggtttgttacatagg

SEQ ID NO: 22817 - DNA, 74 bp, Homo sapiens
aagtaatatctgttggctttggaaataatattatatttagtattatatttaatggaagttagcagatttagctt

SEQ ID NO: 22818 - DNA, 102 bp, Homo sapiens
tctggagagtctgcaagaaatggaacccccaggatggcagaacagagtgtgcagggttgtcctgattttgccagcccctttcattcttcagaaactccttga

SEQ ID NO: 22819 - DNA, 111 bp, Homo sapiens
ggcaaggcacttcactttttaaaagacaagtttgagcctctttctttttttttattattattatttttgagatgtagtctcgctctgtcgcccaggctggagtgcagtggc

SEQ ID NO: 22820 - DNA, 129 bp, Homo sapiens
aagcgtatgtgtgtgtatgtatgtatgtgtgtatatataggtatgtgtgtgtatgtatattatatgtatatgtgtgtgtacatatatgcttatatttatatatgttattatatctgtatacagcgacac

SEQ ID NO: 22821 - DNA, 109 bp, Homo sapiens
ttttgttattatagacaagctcctagtgggcactcttgtgactatacaatgttttttacatatttatgatcatttccttagcataaatctctaggagtggtttgcaaaa

SEQ ID NO: 22822 - DNA, 84 bp, Homo sapiens
catgtgcctgtagtcccagctatgtgggaggctgaggtggaaggatcacttgagtccaggaggctgaggctgcagtgagccgtg

SEQ ID NO: 22823 - DNA, 112 bp, Homo sapiens
ttccctgcaagtttcattttattaaaaaaggcttctagattttgaatttttacatttagtctctaaaaaaaattcaaaatgctcatttaatgctatttaattcagctgggag

SEQ ID NO: 22824 - DNA, 93 bp, Homo sapiens
gcacttatgctactgccacaattttctacaaagaactgactcagcaaagggtctatgctttgagtgacttgtgcgtagtgatgatagatgtgc

SEQ ID NO: 22825 - DNA, 91 bp, Homo sapiens
ggaaatgcaaaatggtacaggttctgtggaaagtagtttggcagctcctccaaaatttaaacctagaattaccatatgacccagcaattcc

SEQ ID NO: 22826 - DNA, 95 bp, Homo sapiens
gacataggctacgtgaaaacagtgagcacagggtgtggcttatctcccgagtggtttagtgatgcttcatttgttcactagattctggctttgtc

SEQ ID NO: 22827 - DNA, 72 bp, Homo sapiens
gatagatatatatgtgtatgtatatgtatatatgtatacatatatgtgtatatatatgactatatatgtgtc

SEQ ID NO: 22828 - DNA, 102 bp, Homo sapiens
tactgggattacaggtgtgagccaccgcgcccggcctgatttttttttttttttttaattatacttggctgggtacagtggctcacatctgtaattcaagta

SEQ ID NO: 22829 - DNA, 159 bp, Homo sapiens
cacacaccatggtatatatatatatacacacacacacatatatatggtatgtgtatatatatatatggtatgtgtgtatatatatacatatacacacatggtgtgtgtatatatatgtatatatatatagtgtatatatatgtatatatatatacacca

SEQ ID NO: 22830 - DNA, 115 bp, Homo sapiens
tatatacacacataccatatatatatatacacataccatatatatgtgtgtgtgtgtatatatatatataccatggtgtgtgtatgtatatatatacacacacatatatatatgg

SEQ ID NO: 22831 - DNA, 95 bp, Homo sapiens; identical to SEQ ID NO: 68

SEQ ID NO: 22832 - DNA, 93 bp, Homo sapiens; identical to SEQ ID NO: 69

SEQ ID NO: 22833 - DNA, 81 bp, Homo sapiens
gaagtctgagatcaaggtgtcagcagggttgaatccttctgaaggccctgagggagactctgttccatgcctctttgcttc

SEQ ID NO: 22834 - DNA, 116 bp, Homo sapiens
ccaagcctatctacatcctcatccttgaaacctgtaaatattaccttatgtggaaagaaaaggactttttgtagttgtgattaaattaaggatcttaaatgaggagattatcctgg

SEQ ID NO: 22835 - DNA, 71 bp, Homo sapiens
ctctgtgaagaagcactggtgatggcctgtctgtctgtctgtcaggtggttttcctgttatctatgtagag

SEQ ID NO: 22836 - DNA, 58 bp, Homo sapiens
tgagacggagtctcactctgtcacccaggctggagtacagtggtgtgatctcggctca

SEQ ID NO: 22837 - DNA, 79 bp, Homo sapiens
gtatatatgtgtgtgtgcgtatgtatacacatatatgtatatatatgtgtgtgtatatatgtatacattatatatatat

SEQ ID NO: 22838 - DNA, 97 bp, Homo sapiens
tctctttactgaggcatctgtaggaaaatgagtgtgtttctttgaatgaatgagcagtcacatttatttttattaaatctgaacttgtcctctgaga

SEQ ID NO: 22839 - DNA, 117 bp, Homo sapiens
tgtttattcaaaagaattgaaagaattttttgagcctagccgatatacttatttatattattttgtaagacagttttgctttaggctactatatttttttccagttttttgagcaca

SEQ ID NO: 22840 - DNA, 104 bp, Homo sapiens
gcccaggctggagtgcagtggcatgatttcggctcactgcagtctctggctctcaggctcaggtgattctcatgcctcagcctcccaagtagctgagattgcag

SEQ ID NO: 22841 - DNA, 115 bp, Homo sapiens
ggtagttttgatctaagtgggggaaatgatacatgctttatgtttttttaatttttcttatgtgaggaatttacaggctactccagaattgtcttactctcactgtcactgtcta

SEQ ID NO: 22842 - DNA, 110 bp, Homo sapiens
gttttatgacagaatctaggatcaccttgcctctccgctagaaaccattgtgtcagcaacaggaagtggttaagacaaggtatttttggacccacacttctatatattac

SEQ ID NO: 22843 - DNA, 129 bp, Homo sapiens
tatgtatatgtatatgtatatgtgtatatgtatatatgtgtgtgtgtatatatatgtgtgtgtgtgtatatatgtgtgtgtatgtatatgtgtgtatatatatattatatatatatatatatatatatg

SEQ ID NO: 22844 - DNA, 78 bp, Homo sapiens
gcttggcagaccctgtacgataactctgagtaaaaaattttttttttttaagacggagtctcgctctgtcacccaggc

SEQ ID NO: 22845 - DNA, 96 bp, Homo sapiens
cagcataggtatactagtgtgtgtatatgtgtgtatatatatgtgtgtatgtatatatagatacatatttgcacataggtggtgatatcatagttg

SEQ ID NO: 22846 - DNA, 80 bp, Homo sapiens
tttcaggccaagcactgctatgggcatgtaggctccagtttataaacagaagtcctccatgaccctcagtctcactgaga

SEQ ID NO: 22847 - DNA, 95 bp, Homo sapiens; identical to SEQ ID NO: 68

SEQ ID NO: 22848 - DNA, 93 bp, Homo sapiens; identical to SEQ ID NO: 69

SEQ ID NO: 22849 - DNA, 99 bp, Homo sapiens
tagttgtttcatagcttgaggtcttacatttaaggtctttaattctttttgatttgagaaatagaggtctagtttaattcttctgcctatgaataccta

SEQ ID NO: 22850 - DNA, 102 bp, Homo sapiens
tacatagaaaggtgattgctagatcatatggtagttctttgtttagtattttgaggagtgaccatacagttttccaaagtaactgcatcattttacaatgta

SEQ ID NO: 22851 - DNA, 127 bp, Homo sapiens
aagcgtatgtgtgtgtatgtatgtatgtgtgtatatataggtatgtgtgtgtatgtatattatatgtatatgtgtgtgtacatatatgcttatatttatatattattatatctgtatacagcgacac

SEQ ID NO: 22852 - DNA, 86 bp, Homo sapiens
cctatagtattctttctctttattctttttctcatcatcctttgacgaacttttgctgactggagagtctgaggactgactatagg

SEQ ID NO: 22853 - DNA, 76 bp, Homo sapiens
atgcagtcctttattttatatatatacacacatatatatgtatatgtgtgtatatatatgtttccaactgctgtgt

SEQ ID NO: 22854 - DNA, 74 bp, Homo sapiens
gtaaccttcagagatgacagtgaagattcagggaagttgcttatcatagaatattcattgcctctggtgggggc

SEQ ID NO: 22855 - DNA, 84 bp, Homo sapiens
gttcttgttcttcctctgagcttgagcgtattgacttatattttttaatttttcctggctcagggcttctaaacaaacaggaat

SEQ ID NO: 22856 - DNA, 58 bp, Homo sapiens
tatgtatgtgtatatatgtgtgtgtgtgtctatatatatatatgtctatatatatata

SEQ ID NO: 22857 - DNA, 107 bp, Homo sapiens
tatgatactatatatacatatatgatactatatatgatactatatatatgatactatatatatatggtactatatatatgatactatatatatatatatatatgatg

SEQ ID NO: 22858 - DNA, 58 bp, Homo sapiens; identical to SEQ ID NO: 884

SEQ ID NO: 22859 - DNA, 56 bp, Homo sapiens; identical to SEQ ID NO: 885

SEQ ID NO: 22860 - DNA, 91 bp, Homo sapiens
ttgcttttcttattgcctggcatggtaaaactgaatataaatgactaaatgatggtatttaaagaactatgcaggtggaagatcctagcaa

SEQ ID NO: 22861 - DNA, 67 bp, Homo sapiens
atatatgtgtgtgtgtgtatatatatatcttgattggggctaactatatatatacacacacatatat

SEQ ID NO: 22862 - DNA, 118 bp, Homo sapiens
gtacatgtgtgtgtgtgtgtgtatatatatatatgtatttgtataactgtatatatatatacagtaagccccaatcaagatacatatatatatcatgcatatatacacacacagatat

SEQ ID NO: 22863 - DNA, 114 bp, Homo sapiens
aatgtaaaattaaaatataatctttgcggtcaatttgaagtggtttgggatattggtgactcactctgtcttacttcttcttattctgattacttagattgcctttaatacatt

SEQ ID NO: 22864 - DNA, 117 bp, Homo sapiens
tagaatttttcatagtattctgattattaaacatatattaacatatgaatatttgcatatatgtatttatatagttaacatatgtataattattttctttttttctgattatttctg

SEQ ID NO: 22865 - DNA, 104 bp, Homo sapiens
ttctatatttattgctttgtggtctgagaatgtctttggtattattattattttttaatttgctgaggattttcttatggctgattgggtgatcgattttagag

SEQ ID NO: 22866 - DNA, 84 bp, Homo sapiens
atgacaaacaatataacctgtattattttttagtttatatgcatatgtataaactaaatttttaggtatgtgcttgttcttcgt

SEQ ID NO: 22867 - DNA, 116 bp, Homo sapiens
taatatgtattctagcaaaattccctatcttttggcagattctgaaaacatgtttcaaagtatttcatctctttggtatagttggggacttttctcctagtaagaaatgtgtatta

SEQ ID NO: 22868 - DNA, 118 bp, Homo sapiens
gggtgtcctcctaatgtttacattatcctgaaatgagacctgagtttacattattcatggctctgtgtttatctgtgagtgtatgagcactggtgaggatagaaacgaaccacctccc

SEQ ID NO: 22869 - DNA, 83 bp, Homo sapiens
acaagtaggtagttgccgaaatcaaataaaggaaaggatggagaatgttttttaatttattcattgggtcagtgcctatttgt

SEQ ID NO: 22870 - DNA, 99 bp, Homo sapiens
acacacacacgaatactttaaacatatgtggatatatgtacaatatatatatatgtctatacacatattttccacatatgatgtggttcggatgtttgt

SEQ ID NO: 22871 - DNA, 71 bp, Homo sapiens
gttgttgtttttgttttgttttttttttgagacagagtcttgctctgtctcccagactagagtgcagtgac

SEQ ID NO: 22872 - DNA, 104 bp, Homo sapiens
gggtatttgttgaagaaagaaaacctgtgatacatttcagaactaagataccagagttagctttgctgaatatcctcaaccatctactttgagccaagatgccc

SEQ ID NO: 22873 - DNA, 95 bp, Homo sapiens
ggtggcatgcacctgtagtgctagctgtttgggaggctgaggtaagaggatcatttgagcccaggagtttgaggttacagagatgtatgttcacc

SEQ ID NO: 22874 - DNA, 108 bp, Homo sapiens
gcagatatttattgaatacccactatgtgacaggtactattcttttttttttttgaaacagagtctcgctctgtcacccaggctggagtgcagtggtgtgatcttggc

SEQ ID NO: 22875 - DNA, 104 bp, Homo sapiens
atgcatctgtctatttgagtaaaaggcataattgtatttgtgtaaaactgaccccacaaaatttatttttatgtagacctataaaactccaattaatagagcat

SEQ ID NO: 22876 - DNA, 84 bp, Homo sapiens
tcctgtcttgaatatgtgactctgtttctgactgtacacttgtgcagttctttgggatggaagtagtgggaaaaagtaaaggga

SEQ ID NO: 22877 - DNA, 77 bp, Homo sapiens
ctcagacagacagagtagtgtgtggagactcatatcgtaaacttctgctccaagaactacttcaggaatgtactggg

SEQ ID NO: 22878 - DNA, 113 bp, Homo sapiens
atatatgtgtatatatatatatatgtgtatatatatatatatgtgtatttatatatatatgtgtatatatatatgtgtgtatatatatatatatatatatatatacatacaca

SEQ ID NO: 22879 - DNA, 99 bp, Homo sapiens
tgtaactttgtacctgtttattggggactattcttgttgagttttaaaagttctttatatattctagataaaagtcctttatcagctgtatattttgca

SEQ ID NO: 22880 - DNA, 74 bp, Homo sapiens
tttgaatgggtatgaatttattttcttatataattatcttgaattatataggatcacagtttatgaaattcaaa

SEQ ID NO: 22881 - DNA, 74 bp, Homo sapiens
gcatctgtatatatgtgtatacatacatgtttgcgtgtttataaaatatgtgcgtgtatgcatctgtacagtgt

SEQ ID NO: 22882 - DNA, 78 bp, Homo sapiens
atggtaatatatatgtgcatgacaaaagtaaacaagtttataaaaacattgtttattgtgcacattggattaatacat

SEQ ID NO: 22883 - DNA, 124 bp, Homo sapiens
cctggtctgcggcactaaccccctctgacactctgggccattgctgtctgcctccctctgtcagaatgccaggtgtgagctgagagcaggtggcactgcctggcacagggcagcggctcagcaa

SEQ ID NO: 22884 - DNA, 81 bp, Homo sapiens
tatatgtggatatatatatatatctctctcatatatatacatacatatatatgtggatatatatatatatatccacacatg

SEQ ID NO: 22885 - DNA, 109 bp, Homo sapiens
tgctctttaggcctctctgaacttttcctgtgatctcattctcagtgtctttctcctccatccctacagggacagattaactggacaggaaaagagaatgccctgggca

SEQ ID NO: 22886 - DNA, 114 bp, Homo sapiens
ccaggtagaaatcaggaggaaaattctcccaaacaggacctcacagatgagtttgagcacccttcaaggaaatgggggttggattaggagaaaagcctttgagtctttagttgg

SEQ ID NO: 22887 - DNA, 118 bp, Homo sapiens
ttctttttaacttttctaggatgaatttcctggatataataggattccacatagcaccaagttaatttttactttattttttataggaggttcatccatgttagtcagtattccagaa

SEQ ID NO: 22888 - DNA, 115 bp, Homo sapiens
ggatgtggcagcgctgcttttgaacaagagtgggtttgacttttagctgtatataaatatttttactagtagattaattgtgaccaagcagccccatccctaaattcctggccac

SEQ ID NO: 22889 - DNA, 88 bp, Homo sapiens
atgtagatatatatatgtatatatgtgtgtgtgtatacatatatttgtgtgtatatatgtatacaaatacatatatagaattttagat

SEQ ID NO: 22890 - DNA, 122 bp, Homo sapiens
ttacttgtatttgtttagaagactatatatttaatatacatacacattatttatatgtgtgcattatatatataaatatatattccatatatacatatgcatgtggtattctatatatggtc

SEQ ID NO: 22891 - DNA, 91 bp, Homo sapiens
ccttttagagcgtgggtttagatttcttcagaagcgattttgttgtcctggtaaagtttctatgaagaatccctacagactctgttaaagg

SEQ ID NO: 22892 - DNA, 95 bp, Homo sapiens; identical to SEQ ID NO: 68

SEQ ID NO: 22893 - DNA, 93 bp, Homo sapiens; identical to SEQ ID NO: 69

SEQ ID NO: 22894 - DNA, 104 bp, Homo sapiens
acagaagtgttggaccttgcttatattgtcccacagttcctagggttctgttatttttttttttaatttttccctatctgttcagtttatatcaatacttttgt

SEQ ID NO: 22895 - DNA, 59 bp, Homo sapiens
tgacaggcaccgagccagtgtttaccctgtggggctcgtgacacacacagtgtctgtca

SEQ ID NO: 22896 - DNA, 114 bp, Homo sapiens
tttatgattgaatagtacccccttgtgtatatgtaccacacattcttttttaaattattattatactttatgttctggggtacatgtgcagaacgtgcaggtttgttacatagg

SEQ ID NO: 22897 - DNA, 116 bp, Homo sapiens
tatattttaaagttaaagtcattgtttaattttatcatgtatctaaataactatgtatttgtatatgtctaaactcatatatataaatttatacagagactgtgattgtgaatatg

SEQ ID NO: 22898 - DNA, 103 bp, Homo sapiens
acaagctgacttccctcttggtcaggtggtttgttttagagttactcgatatttataactttttataagcactggtcattttttgagaactgatttggtttgt

SEQ ID NO: 22899 - DNA, 63 bp, Homo sapiens
ttgagacagtctcgctctgtcacccaggctggagtgcagtggtgcgatcttggctctctgcaa

SEQ ID NO: 22900 - DNA, 114 bp, Homo sapiens
catctggaagccttcttaaaatgctgactcctggatcctactctgagacactctctgattcagggtgtctgaggtggtgtccatgacttttcctttgtaacagtgtcctaggtg

SEQ ID NO: 22901 - DNA, 102 bp, Homo sapiens
tgttaatgttctgtgctccaggataaacatgtcaatttctttaggtgttgcttaactaatatattaacaagaattagcattatcctgctgctcccattgata

SEQ ID NO: 22902 - DNA, 84 bp, Homo sapiens
ggtaaattttatagtgtgtgtgtgtgtgtgtgtgtatatatatatacacatatactacatatatatatgtagtatatgtatacc

SEQ ID NO: 22903 - DNA, 96 bp, Homo sapiens
cagtggatattgaaatctcctgctattattgttttgctctctctctcactctgagtagtaattattttatgaatctaggggatccagtgtttagtg

SEQ ID NO: 22904 - DNA, 115 bp, Homo sapiens
tgcttaggattgtcttggctatatgggctctttttgggttccatatgaaatttaaagtagttttattctaattctgtgaaaaaagtcaatggtagcttgatggggatagtattga

SEQ ID NO: 22905 - DNA, 90 bp, Homo sapiens
gtgcaattagaggtatcagtatgaactcataatttttcatctcttgagagagagagagagagatctattggtaaataggcagcattgtgc

SEQ ID NO: 22906 - DNA, 95 bp, Homo sapiens; identical to SEQ ID NO: 580

SEQ ID NO: 22907 - DNA, 93 bp, Homo sapiens; identical to SEQ ID NO: 69

SEQ ID NO: 22908 - DNA, 95 bp, Homo sapiens; identical to SEQ ID NO: 68

SEQ ID NO: 22909 - DNA, 93 bp, Homo sapiens; identical to SEQ ID NO: 69

SEQ ID NO: 22910 - DNA, 65 bp, Homo sapiens
ggacttggggatctactgcccgccttcagggagtgtggacagtaggcagtctccagtgacagttc

SEQ ID NO: 22911 - DNA, 64 bp, Homo sapiens
tgaggttgagagtgtgattgctgcttgggctgcaggcactcacgctgtcacagtctataacccg

SEQ ID NO: 22912 - DNA, 74 bp, Homo sapiens
atatacatacatatacacatatgtatatatgtgtatatatacatatatatgcatatatgtgtgtgtatatatat

SEQ ID NO: 22913 - DNA, 103 bp, Homo sapiens
gctgtttgtatgattgatgagcctgtggttctgagttaaaaagtaagaaatttgattattttttatcaagagggacaaatgcttcatgaggtcataggagagt

SEQ ID NO: 22914 - DNA, 102 bp, Homo sapiens
gacccaatataatatgtttagaacatgtgggtgtgcacagaggattgagtgcagtaagcgctttacatggatgcctaatgtcaaattggagaatgtgaggtc

SEQ ID NO: 22915 - DNA, 95 bp, Homo sapiens; identical to SEQ ID NO: 68

SEQ ID NO: 22916 - DNA, 93 bp, Homo sapiens; identical to SEQ ID NO: 69

SEQ ID NO: 22917 - DNA, 95 bp, Homo sapiens; identical to SEQ ID NO: 68

SEQ ID NO: 22918 - DNA, 93 bp, Homo sapiens; identical to SEQ ID NO: 69

SEQ ID NO: 22919 - DNA, 84 bp, Homo sapiens
aaagttatgagaagaaactaggaaagatgaaacaggtcttttgagcagatcatttttctttttcttttttcttttcttttcttt

SEQ ID NO: 22920 - DNA, 85 bp, Homo sapiens
gcaaccagtgggagatggagagtcagggctaagggtggaaaattcataaagagaataacagttctctctctctctctgcgtgtgt

SEQ ID NO: 22921 - DNA, 95 bp, Homo sapiens; identical to SEQ ID NO: 68

SEQ ID NO: 22922 - DNA, 93 bp, Homo sapiens; identical to SEQ ID NO: 69

SEQ ID NO: 22923 - DNA, 71 bp, Homo sapiens
tgtgtgtgtatatatatacacacacacaacaatactatatatatgtgtgtgtatgtatatgtatatatata

SEQ ID NO: 22924 - DNA, 102 bp, Homo sapiens
tgacagtctctgtggctctgcatgcttatgaatatttgatattgttagatttttaattcatttattcatttttaacaggtatgttctggcatcttactgtgg

SEQ ID NO: 22925 - DNA, 81 bp, Homo sapiens
ctttataactgaagactattgtgaatcgactctttttttttctttttgagatggagtctcgctctgtcacccaggctggag

SEQ ID NO: 22926 - DNA, 58 bp, Homo sapiens
tgaggcggagtctcgctctgtcacccaggctggagtgcagtggcgcgatctcagctca

SEQ ID NO: 22927 - DNA, 117 bp, Homo sapiens
atgatgactattttcaaaggtatttgatctacatcaaagctatcttactttttctttttataaagatacatttgagcatgggggctatgggtagagacagatgattgagcccatcat

SEQ ID NO: 22928 - DNA, 114 bp, Homo sapiens
gagctactgtgatctgcactctagttgaataagtcagaaacttttttctttttttttgagacagggtttcactcttgctgtccaggctggagtgcaatggcatgatctcggctc

SEQ ID NO: 22929 - DNA, 88 bp, Homo sapiens
tggggtttcttttgccacaaggagtcagattaaattcactgggagtcctagcagatttatttttatttcataggaagaaatgagtcca

SEQ ID NO: 22930 - DNA, 92 bp, Homo sapiens
tcaagacgctttttcctgcctcatttttcctaaatctccaactcgaagtggacctagagaggtgaggaagaaggaagaagaacaggaaagag

SEQ ID NO: 22931 - DNA, 61 bp, Homo sapiens
ggaaaattagatctggcactctctgtggctgaggctgaagccactgaggtcttgattagcc

SEQ ID NO: 22932 - DNA, 106 bp, Homo sapiens
gccattggacggcatggagcctgggagcttttgtacactaggctctccagcagagagtgaggacagaggcccatcccccagggctcgccattcccctccaggaggt

SEQ ID NO: 22933 - DNA, 104 bp, Homo sapiens
ttttgtatgttgattttgtatcctgaaattttactgaatttgttgatcagttctaatagttttttggtggagtctttagtttttttttttcaaatacaaaatca

SEQ ID NO: 22934 - DNA, 113 bp, Homo sapiens
gtcttctatttatgatttacttgctaatatacattattattcattgatttttaagaatttttaatgtgtaatattgcctgtattaacaaataagaatccatgcatttgaagat

SEQ ID NO: 22935 - DNA, 114 bp, Homo sapiens
gtgttgcgttatagtagttttgcccattttcgtggctgtgtagtatttgattatatgaatataatgacgttgatttatcagttctattgatggacatttttgctgttctaatat

SEQ ID NO: 22936 - DNA, 102 bp, Homo sapiens
tcagtgttgtttgtagctgtaatttgttttttgttaatttattgtatataatgtataatatatagtagagatgatcagcaaagccgaaagttgcttctttga

SEQ ID NO: 22937 - DNA, 101 bp, Homo sapiens
gacatgggggcaggtgttagcagacttaaatttgaaggctggctctgctctgtgactctgagtaaggcacagaagcctcattttgttcatctggtacatgc

SEQ ID NO: 22938 - DNA, 107 bp, Homo sapiens
aaagatttgatcactcatctgatgagagcctgctttttaagggcacttgtatttatatatatttgcaagatataaagacagttctatggaagagtgcaataatgttt

SEQ ID NO: 22939 - DNA, 108 bp, Homo sapiens
cagcttatttattaccccagtcaatcctgtgtcagcccatcaataaaaagagactctttcactctgtgatggcctccagggaagaatatgtggtagtgagttattctg

SEQ ID NO: 22940 - DNA, 106 bp, Homo sapiens
gagatgtttgaaatagaggtattcatggatagtgacatgtatctttcattttagttaatgacagctagttacaggctatattaccattcattctgaactaaagctc

SEQ ID NO: 22941 - DNA, 75 bp, Homo sapiens
ttctttatacatatatgtatatatataaaaatacatatatagtgtgtgtatatatatgtatgtaggtaggaagga

SEQ ID NO: 22942 - DNA, 96 bp, Homo sapiens
cctgtgaagagtgctattgtggtggtttaagtgtttatagggaaaatggatagtttcaatgtatatttggttattaacttaataggactctgaagg

SEQ ID NO: 22943 - DNA, 108 bp, Homo sapiens
ggttacagaggttttgtttttgtcttgtttcactgtaatggagtggccctgtatcattattatttattattattattattttttgagatggagtctcgctctgtcacc

SEQ ID NO: 22944 - DNA, 58 bp, Homo sapiens
tgagagggtgtctcacactgtcaccctggctggagtgcagtggggtgatcttggctca

SEQ ID NO: 22945 - DNA, 98 bp, Homo sapiens
tctcatttttattaaaataggacagtttctaacaaggaaaaataaacgtttcaatgtatatttttaacacctagttaaaagcattagtaatagtggga

SEQ ID NO: 22946 - DNA, 78 bp, Homo sapiens
atattatattgtatatatgtatatgcatgtatattgtatatatacactatatatgtatatacatcatatatgtaatat

SEQ ID NO: 22947 - DNA, 88 bp, Homo sapiens
aaaattgctagatcagggatttggaatatatatgtatgtctatatatacacacatatatataatgtttcctttagtatagctaatttt

SEQ ID NO: 22948 - DNA, 96 bp, Homo sapiens
tatatatatatgtgtctttcaaatgtgtatatatatgtgtatatatatgtatatatatatgtgtgtgtgtgtgtatgtatatatgtatatatacat

SEQ ID NO: 22949 - DNA, 74 bp, Homo sapiens
agagcatggagaagctgtaaggatggaagacttaatctttttttttttttttatttgagacagagtcttgctct

SEQ ID NO: 22950 - DNA, 195 bp, Homo sapiens
gtgtgtgtgtatatatatgtgtgtgtgcatatatatgtgtatatatgtatatgtgtatatatgtatatacattatatatacatatatatgcatagatatacatatatacatatatacacacatatatacatatatgtgtatacatatatacgtatatatgtaatatgtgtatatacatatatatgtatatatata

SEQ ID NO: 22951 - DNA, 90 bp, Homo sapiens
catatatttgtgtatatttacatgtgtgtacatattttatatatatatgtatgtacacatatactttcatgtaagtatagtgaaaagatg

SEQ ID NO: 22952 - DNA, 85 bp, Homo sapiens
agaatcttactctgttgcccaggctagagtgcagtggtgtgatctcggctcactgtaactctgtcttccaggttcaagtgattct

SEQ ID NO: 22953 - DNA, 81 bp, Homo sapiens
gtctcaggactgtattgatgtacatagtatttttgttatataactagtactatgtccatattaaagtaatagaacagagat

SEQ ID NO: 22954 - DNA, 70 bp, Homo sapiens
gtattccattgtgtgtgtgtgtgtgtgtataatacaatgtgatatatatatatatatatatataaaatac

SEQ ID NO: 22955 - DNA, 118 bp, Homo sapiens
gtaactgtagtagtgtgtgtgcatatatatatgtatggtttaatttttaattatttaatggaattaaataatttaaatcaattaattttaaaatatgcacacacactatatatattat

SEQ ID NO: 22956 - DNA, 75 bp, Homo sapiens
atatatatatttatgacatatgtgtgtgtgtatatatatatatatatgtatatgtgtatatatatatatgtgaca

SEQ ID NO: 22957 - DNA, 95 bp, Homo sapiens; identical to SEQ ID NO: 68

SEQ ID NO: 22958 - DNA, 93 bp, Homo sapiens; identical to SEQ ID NO: 69

SEQ ID NO: 22959 - DNA, 76 bp, Homo sapiens
agacaacagtaatgttttacatgttgattgactcttcctctaaggaaagatttctctgtagcatgtgatgttgttt

SEQ ID NO: 22960 - DNA, 115 bp, Homo sapiens
ggagctctttgactattgcttcaattatgttactcattattgatctttttagattttttatttctctattcagtattggcaggttatatgattccagcagtttttctatttcttc

SEQ ID NO: 22961 - DNA, 85 bp, Homo sapiens
tttggctctctgtctgtctgttattggtgtataagaatgcttgtgatttttgtgcattgattttgtatcctgagactttgctgaa

SEQ ID NO: 22962 - DNA, 120 bp, Homo sapiens
ggctccagaggttcctccaatgaactggattatcttaagtagaattatgtcacttctctcagtgtcagtttctccttttgttaaaaattgggagagttggatgaggacaggggtcagtag

SEQ ID NO: 22963 - DNA, 82 bp, Homo sapiens
agtaagagatactagcttgagagatctgaatcaggaaatactaggacaaattgagatggactctctctttgtgtctctgcct

SEQ ID NO: 22964 - DNA, 105 bp, Homo sapiens
atatatgagtatgtaaatgtgtgtgtgatctctatgtgtgtgtgtatatatatatatatatacacacacacacatatatatacacacacacatatacacatatat

SEQ ID NO: 22965 - DNA, 107 bp, Homo sapiens
gttatattatgtggaacagtttgatccttttgggactttctttttatttgttagatgggtctggagcagtgcttggtctagggcaaattattcctcactactaagac

SEQ ID NO: 22966 - DNA, 116 bp, Homo sapiens
atcattgcagataaggatgatgtttatacagatatgcacagaagagtttatgccaaataatgtgtatatttttcaatatattagcagtatatcagagtttcctgtttgcttgtggt

SEQ ID NO: 22967 - DNA, 82 bp, Homo sapiens
caaaaataacatatatatgtatacacatgtgtgtttgtatgtataatatctatatgtgtgtatatatgtatgtgtatttatg

SEQ ID NO: 22968 - DNA, 58 bp, Homo sapiens; identical to SEQ ID NO: 884

SEQ ID NO: 22969 - DNA, 56 bp, Homo sapiens; identical to SEQ ID NO: 885

SEQ ID NO: 22970 - DNA, 63 bp, Homo sapiens
gctaaggaagaatctaagattctttttttttaaaatcagagttttagagtctttcttttttgc

SEQ ID NO: 22971 - DNA, 115 bp, Homo sapiens
ttggtctaggcaggtagtgctattaccttggaattattaatacttttttttttttttagtttttttttaattatactttaagttttagggtacatgtgcacaatgtgcaggttag

SEQ ID NO: 22972 - DNA, 61 bp, Homo sapiens
gagccatctctgtctgactctctacttggttcctagcagtgaactggcagagagggtgttc

SEQ ID NO: 22973 - DNA, 121 bp, Homo sapiens
gggtcctccattatataattattaggttgatgcaaaagtaattgtgatttttttttccatattttaaatgggaaaaactgcaattacctttgcaccaacctaatactgtatttccccttac

SEQ ID NO: 22974 - DNA, 64 bp, Homo sapiens
atgcttggaaccagaagtgtttcagatttcagaatatttgaatttatacttactggttgagcat

SEQ ID NO: 22975 - DNA, 119 bp, Homo sapiens
gttttttatatatacatatatgtgtgtgtgtgtgtgtatatgtgtgtatgcatatatataatatatatattttatatatatatataatatatatatatgctgaatgttgtagtagggac

SEQ ID NO: 22976 - DNA, 75 bp, Homo sapiens
tggtatgtgactcactctctgagcatctttcccatgcaaccttcagggaaggaagtgatgagtgcttcattttca

SEQ ID NO: 22977 - DNA, 81 bp, Homo sapiens
tgagattaacatcaattttctttttttttgagacagggtctcactctgtctcccagactagagtgcagtggcgtgatctcg

SEQ ID NO: 22978 - DNA, 73 bp, Homo sapiens
gttttgtgcgtgtactgggtgctggcttctatggttccttatggatgttttcgaaaaagctacaccacttgac

SEQ ID NO: 22979 - DNA, 84 bp, Homo sapiens
tggggtttttgttttgttttgtttttggggggaatagggtctctcactctgtcgcccaaattggactgcagaggcatgatctca

SEQ ID NO: 22980 - DNA, 87 bp, Homo sapiens
gcctgggctacatagtgagactcccccatctctattaaacttttttttttttttttttgagacagagtctcactctgtcgcccaggc

SEQ ID NO: 22981 - DNA, 132 bp, Homo sapiens
ggcactggggtctttatcgaaatctccctggattaaatggtcctagtttactaatgcccagtctgaggagagtcaggagagacagaagtgcttttctgaagtagagagctgtctttgacttggcaagtcctc

SEQ ID NO: 22982 - DNA, 58 bp, Homo sapiens
tgagtcagagtctcgctctgtcacccaggctggagtacaatggtgtgatcttggctca

SEQ ID NO: 22983 - DNA, 58 bp, Homo sapiens; identical to SEQ ID NO: 1391

SEQ ID NO: 22984 - DNA, 56 bp, Homo sapiens; identical to SEQ ID NO: 1392

SEQ ID NO: 22985 - DNA, 84 bp, Homo sapiens
gtctggcatctggtatgtaggatggggctccttcttttttttttttttttttttggaggcagggtctccctctgtcacccaggc

SEQ ID NO: 22986 - DNA, 69 bp, Homo sapiens
tcctgggaggaagaggtcgcagtgagccccaagcctgcctgggtgacacagtgagactctgtctcagga

SEQ ID NO: 22987 - DNA, 67 bp, Homo sapiens
tgagacacagtctcactctgtcgcccacctgggctggagtgcagtggcgagatctctttgtgtggca

SEQ ID NO: 22988 - DNA, 82 bp, Homo sapiens
ctttgggttgcttctggaggtgcccctccaaggacccatatgttcctggctggggcactctctaaggctgtggacccctcag

SEQ ID NO: 22989 - DNA, 171 bp, Homo sapiens
gggtaaaagaatgagaccctgtttcaaaaaaagactatattaatatacatatatatgtgtatatatatatatatattttttttttttttttttgagacggagtctctctctgtcacctaggctggagtgcagtggcgcaatctcagctcactgcaacctccgcctcctggg

SEQ ID NO: 22990 - DNA, 56 bp, Homo sapiens
ctgtggttatcatggtatcatactccctccaggcttcagtgccatggatatcacag

SEQ ID NO: 22991 - DNA, 56 bp, Homo sapiens
acacacacacagacacacacgtatatatgtatatatatgtgtatctatgtgtgtgt

SEQ ID NO: 22992 - DNA, 64 bp, Homo sapiens
ttgagatagtctcgctctgtcactcaggctggagtgcagtggtgcgatcttggctcgatcttgg

SEQ ID NO: 22993 - DNA, 58 bp, Homo sapiens
tgagacagagtctcactctgtcgcccagtttggagcgcagcagtgagattatagctca

SEQ ID NO: 22994 - DNA, 98 bp, Homo sapiens
ccagcctagggaacagagtgagattccatctctatttttaaaatttatttgtttatttatttttctgcgaaagggtctcactctgtcacctaggctgg

SEQ ID NO: 22995 - DNA, 98 bp, Homo sapiens
ttcaaaaggaatttgaggtatcaactaattgagatttattttctatgtatatcaagctgtcatatattatgtcttggttttgatattttacttttgaa

SEQ ID NO: 22996 - DNA, 62 bp, Homo sapiens
tgggcaacagagcaagactccctctaaaaaaaaaaaaagactgagcctcactctgtcaccca

SEQ ID NO: 22997 - DNA, 58 bp, Homo sapiens
tgagacggagtctcgctctgtctcccaggctggagtgcagtggcgcagacttggctca

SEQ ID NO: 22998 - DNA, 90 bp, Homo sapiens
ccaggctggacgacatagcaagatccagtctctatttttatttttatttatttattctgagacagagtctcactctgtcaaccaggctgg

SEQ ID NO: 22999 - DNA, 84 bp, Homo sapiens
cctctacaaaaaaaaatcagccatgtgttgtagtgcccctgtggtcccagctactcaggaggttgaggtaggaggatggcttga

SEQ ID NO: 23000 - DNA, 77 bp, Homo sapiens
gttatagagcatgagactgtccccaaggctggagtagattttttttttatttttgagaccaagtctcactctgtcac

SEQ ID NO: 23001 - DNA, 95 bp, Homo sapiens
tactccatatagtgctagagtattttaggacaaaagcctctttttttttttttttttttgagactggatctcgctctatcgcccaggctggagtg

SEQ ID NO: 23002 - DNA, 108 bp, Homo sapiens
ggcgacagagcgagactctgtctcaaaaaaaaaaaaaaaaaaaaaaagatgcagattacctttgctttatttatttatttatttaagactgagtcttgctctgtcacc

SEQ ID NO: 23003 - DNA, 90 bp, Homo sapiens
ggtagatgatctgtctagtcccaagggaagagggctgaagccagggagccaaccagcctccctcagtgcgtcccacccagacagaatccc

SEQ ID NO: 23004 - DNA, 66 bp, Homo sapiens
tctgagaagaaaagtctttgaagtctgatctgtctgtgaccctgacaggctgggctttggctcaga

SEQ ID NO: 23005 - DNA, 108 bp, Homo sapiens
ttgtacaatggcagagctagaggggactttattttttattttattttattttgtttgtttattttttttgagatggagtctcactctttcacacaggctggagtgcag

SEQ ID NO: 23006 - DNA, 65 bp, Homo sapiens
gtctctgtcaccctcaaaatagaaagaaagaaattagctttttttttttttctggagacagagtc

SEQ ID NO: 23007 - DNA, 98 bp, Homo sapiens
gagcacaggctgcccagagcgtacactgcaggttggaagcgagaccctctctctgaatcagtgtctgaatgtgtgctgcctagagttggtcgtgattc

SEQ ID NO: 23008 - DNA, 72 bp, Homo sapiens
tttgttttgagaagaagtctcactctgtcacccaggctggagtgcagtggtgcgatctcggctcactgcaag

SEQ ID NO: 23009 - DNA, 91 bp, Homo sapiens
tcggcctggccggtgagattttattttattttgttttatttatttttaaatttatttttgagatggagtctctctctgtcacccaggctgg

SEQ ID NO: 23010 - DNA, 106 bp, Homo sapiens
gcactttggaaagctgaggtaggaggatcacttgagcccaggagttttactttttatttttatttttttgagatggtgtcttgctctgtcacccaggctggagtgc

SEQ ID NO: 23011 - DNA, 103 bp, Homo sapiens
cccacttcacatagaacattctggaaatgcagccccagaatttgtcagctgggtggacagatctgtgcctccaggacttgtgtcttatttgcttgagggaagg

SEQ ID NO: 23012 - DNA, 59 bp, Homo sapiens
tcgagacagagtctcactcactctgacgctcaggctggagtgcagtggcctgatctcgg

SEQ ID NO: 23013 - DNA, 58 bp, Homo sapiens
tgagacagtgtctcactctgttgctcaggctggagcacagtggtgtgatcgcagctca

SEQ ID NO: 23014 - DNA, 112 bp, Homo sapiens
aggggcttgcttggactttgggatcttcctagaaatcggccacacaggacccagatggtctctgtgtccctctgtcatggggacaacgatcctccgcttcaatcggaccctt

SEQ ID NO: 23015 - DNA, 117 bp, Homo sapiens
gattacaggtgtgagccaccgtgcctggcacaaaccggttttttaaattttatttttatttttttgtagagatgggatctcactatgttgcccaggctggagtgcagtagtgtgatc

SEQ ID NO: 23016 - DNA, 79 bp, Homo sapiens
gagctggcgctacaggagagggcaggtggccagagggctcccttctctgcccctctgaggctctgtgtggatccagctc

SEQ ID NO: 23017 - DNA, 96 bp, Homo sapiens
tcactcatcctccaccctgcagccagagtaaccttttttcttttttctttttttgagatggagtctcactctgtcgcccaggctggagtgcagtgg

SEQ ID NO: 23018 - DNA, 84 bp, Homo sapiens
gcagaatacatgctcctctggccaagggcctctctctgtctctctgagctccctaaggatgaatgaggcttgctgttttcttgt

SEQ ID NO: 23019 - DNA, 58 bp, Homo sapiens; identical to SEQ ID NO: 22686

SEQ ID NO: 23020 - DNA, 58 bp, Homo sapiens; identical to SEQ ID NO: 315

SEQ ID NO: 23021 - DNA, 110 bp, Homo sapiens
gggtgtggtggggtgtgcctgtagttccagctactcagaaggctgaggtaggaggatcgcttgagcccaggagttggaggctgtagtgaggtatgatgacacacctcact

SEQ ID NO: 23022 - DNA, 65 bp, Homo sapiens
gccaccatgccaggcccacacaggcttttcaaattatacaagtgtgtgtgcctgtgtctgtgggt

SEQ ID NO: 23023 - DNA, 100 bp, Homo sapiens
ccaacgatgcctggtctgcggtgctcacagtctgtgtctgtgctttctacacctgtcctgctcagatgcacatgatgtcacacccaggtctccatcctgg

SEQ ID NO: 23024 - DNA, 112 bp, Homo sapiens
gcgtattttctgattcagcaggtctggagtagacccgagaatctgtacttttaatttatttattactgaaacagggtctcgctctgtcacccaggctggagtgcagtggcgc

SEQ ID NO: 23025 - DNA, 58 bp, Homo sapiens
tgagactgaatctgtctctgtcacccacgctggagtgcagtggcatgatctcagctca

SEQ ID NO: 23026 - DNA, 69 bp, Homo sapiens
gcccatgtcccataggggcgtctgcttagcaccctggtgagtggagagttgtgtgtatggggacttagc

SEQ ID NO: 23027 - DNA, 84 bp, Homo sapiens
actgcaaaaggagagtgcctgagatctgattttattttatttttgggatggagtctcactctgtcacccaggctggagtgcagt

SEQ ID NO: 23028 - DNA, 63 bp, Homo sapiens
gaaattgagacctcaccattctcgctaagctccctgagggcagggactgtgactgtctcattc

SEQ ID NO: 23029 - DNA, 58 bp, Homo sapiens
tgaaatgagtctcgctctgtcacccaggcctggagtgcagtggcatgatctcggctca

SEQ ID NO: 23030 - DNA, 71 bp, Homo sapiens
gagtaaggacagggtgggagggggcttacagacgtcacatgcacacacacaggctcacacactctgtactc

SEQ ID NO: 23031 - DNA, 96 bp, Homo sapiens
agactccgtctcaaaaaaaaaaaaaaaaaaattatcatacagtctctcaaccagtcctactgcttttttttatttattgattttgagacagggtct

SEQ ID NO: 23032 - DNA, 104 bp, Homo sapiens
gtgctttgggaaaaggtgtttacattcatggaggttttgtttcttcatctatataaaaaaatagggccgggaatgatgactcatgcttgtaatctcagcacttt

SEQ ID NO: 23033 - DNA, 62 bp, Homo sapiens
tgtgggttgtagaaaaactgtgcctgggaaggcaggcacagtcactctgtcactaacgcaca

SEQ ID NO: 23034 - DNA, 162 bp, Homo sapiens
tgagacccagtgctggaggaccagaagctatagccttatgtttccgcagttgttgttttttttcttttttgagatggagtctcactctcactctgtcacccaggctggagtgcagtggcacaatcttggctcactgcaacctccacctcctgggtgcaagtg

SEQ ID NO: 23035 - DNA, 72 bp, Homo sapiens
cttctgcctccccaggtgtagggaccagccccacagggtctgtgggtctctccccgtgtgtggagacgagag

SEQ ID NO: 23036 - DNA, 58 bp, Homo sapiens; identical to SEQ ID NO: 2221

SEQ ID NO: 23037 - DNA, 69 bp, Homo sapiens
accacagcccgacaggtggtttttttttttttttgagatggagtctcactctgtttcccaggctggagt

SEQ ID NO: 23038 - DNA, 71 bp, Homo sapiens
gagacagtcttgctctgtcgctcagactggagtgcaatggcacagtctcagctcactgcaaactctgcctc

SEQ ID NO: 23039 - DNA, 153 bp, Homo sapiens
tgtgtgtgtatatatacacgtgtgtgtatatatatacacgtgtgtgtatatatatatatacacgtgtgtgtatatatatatatacacgtgtgtgtatatatacatatatatatatatacacacccgtgtgtgtgtatgtatatatatatatat

SEQ ID NO: 23040 - DNA, 86 bp, Homo sapiens
atttggatcttgcttgttttcatcagtctatttctgtctcataattggggatgtatagactgtttacatgtaatgtgattattgat

SEQ ID NO: 23041 - DNA, 103 bp, Homo sapiens
ctgagcacatgcagggcaccaccaactgtatataaatgtttttatataaactgtatataaatataaatatataaatgtgtgctgaaactctgttttggagcag

SEQ ID NO: 23042 - DNA, 81 bp, Homo sapiens
attatctgggcttggtggcacatgccttagtttcagctactcaggaggctgaggtaggaggatcgctagagcctggggggt

SEQ ID NO: 23043 - DNA, 103 bp, Homo sapiens
ttgagaccagcctgagcaacatagcaagactccatcttttttttttttttttttttttttttttgagatggggtcttgctctgtcacccagtctggagtgcaa

SEQ ID NO: 23044 - DNA, 59 bp, Homo sapiens
tgagccccaaccctggggtgagtgacccaagacagatcactcacactctctgggcctca

SEQ ID NO: 23045 - DNA, 56 bp, Homo sapiens
gagacagagtctcccactgtcacccaggctggagtacagtggcgcgatctcggctc

SEQ ID NO: 23046 - DNA, 103 bp, Homo sapiens; identical to SEQ ID NO: 23043

SEQ ID NO: 23047 - DNA, 95 bp, Homo sapiens; identical to SEQ ID NO: 68

SEQ ID NO: 23048 - DNA, 93 bp, Homo sapiens; identical to SEQ ID NO: 69

SEQ ID NO: 23049 - DNA, 114 bp, Homo sapiens
gaggttgtagctttgggcatgttcacagtcaccctgggatggtagtagttttagcagacctctctttgtctctttctctgcctctgttggtgtcacacccagattttagactcc

SEQ ID NO: 23050 - DNA, 117 bp, Homo sapiens
ttgtttctccactaaaagctactaaatacattaagcacagtatttttcattatgattaagatagttagaaatgcaatgcttatataaaagtcacttttaaattatgaagagttacaa

SEQ ID NO: 23051 - DNA, 95 bp, Homo sapiens; identical to SEQ ID NO: 68

SEQ ID NO: 23052 - DNA, 93 bp, Homo sapiens; identical to SEQ ID NO: 69

SEQ ID NO: 23053 - DNA, 59 bp, Homo sapiens
tatatatatatgtgtgtgtatatatatataactatatataaactatgcatatgtatata

SEQ ID NO: 23054 - DNA, 116 bp, Homo sapiens
taagttatggttccttcagtgaaaaagcctaaaatttagcagataaaagctgaaatattttttatatttacagaaatgggctgggaacatttttggctctgaattaccatctcttg

SEQ ID NO: 23055 - DNA, 104 bp, Homo sapiens
tctttctcttgtctgattgctctagctaggactttcagtactatgttgaataacagtagtgacagtggacatccttatcatgttccagatcttaagaagaaagg

SEQ ID NO: 23056 - DNA, 83 bp, Homo sapiens
ctatgatatataagtgtgtgtgtatatgtgtgtatgtgtatatatatgaatatatgtacatgtatgtatgtacataaacatag

SEQ ID NO: 23057 - DNA, 80 bp, Homo sapiens
ggagcatttattaaaaccttgggactaaatgataagaaataccgaagggccatcactttcactctgtctcagagtgctct

SEQ ID NO: 23058 - DNA, 58 bp, Homo sapiens; identical to SEQ ID NO: 2381

SEQ ID NO: 23059 - DNA, 84 bp, Homo sapiens
tgagatgagagtctcactctgttacccaggctggagtgcagtggtgtgacttggacttactgcaacctctgcttcccgggttca

SEQ ID NO: 23060 - DNA, 103 bp, Homo sapiens
ggtctatcacattttctaatacagttttgagtcatgaattaagtcaacaggtatttggttggatagaaatcatgccaacaccatgtatgtgaaatttggtgcc

SEQ ID NO: 23061 - DNA, 91 bp, Homo sapiens
atgtgggctctttttttgttccatatgaaatttaaagtagttttttccagttctgtgaagaaagtcaatggtagcttgatgggggtagcat

SEQ ID NO: 23062 - DNA, 105 bp, Homo sapiens
agactttgagaatcctctctttggcaccagtgttctgaaaattgccacgatgtgtagttctttatttattcattgtgctctgtgtgtggtgggccctttcagtct

SEQ ID NO: 23063 - DNA, 104 bp, Homo sapiens
aggatacatactcactgacttggcagttctcatatatttaaatgtattttattgatcagttaaatacattattgaaatgtctctcagttaatgtgttatctcct

SEQ ID NO: 23064 - DNA, 58 bp, Homo sapiens
tgagacagagtctctatctgtcacccaggctggagtgcagtggcatgatctctgctca

SEQ ID NO: 23065 - DNA, 109 bp, Homo sapiens
tgaaaattggttcttaagtctgggtggatttatgagagacatgtgactgtgctgagtattgtcaacaattcaaaaatctcttaaaacttgcatggcagaacatttttta

SEQ ID NO: 23066 - DNA, 115 bp, Homo sapiens
ataaacctgtgttatggttaacaagtgtgattatgtggttaactcataaaagtagaaataattttcatttttagtaaatcttgacaatgttctcaacacttccatgcacatttat

SEQ ID NO: 23067 - DNA, 115 bp, Homo sapiens
ctgagaatcttagagcactagtcaaaccctgctgcatgccctcttacaccacttcaccagaagttcaaggttgtatacatggggagatggtgattattgctaatgaggacagagg

SEQ ID NO: 23068 - DNA, 103 bp, Homo sapiens
atgtatatatacacacatgtatatatataataaatgtgtatatatatatctgaaaggaatatatatatatgaaaggaatatatatacacacatatatatacat

SEQ ID NO: 23069 - DNA, 112 bp, Homo sapiens
taaaagttatgcagtctcaggtatgtctttattagcagcatgagaacagactaatatagtaatttaatatgtatttaattgaagtcgtatcagtctactgttcaacatttta

SEQ ID NO: 23070 - DNA, 70 bp, Homo sapiens
atttagccaccctctgactgtcacacatccctgggcaggaacgagttgataagatgggaggggcctaagt

SEQ ID NO: 23071 - DNA, 117 bp, Homo sapiens
agaaggggcctggtgggcagaacaggcagggtggccaccatggtcattttcactctgtcacagtgacacccaggttcccatgcacccttctttcctcccagagaacctagctgcctc

SEQ ID NO: 23072 - DNA, 68 bp, Homo sapiens
taggttttttcagaccttggtctcaatgaggagagaggctctctctgggtctgagtaatctgaaagag

SEQ ID NO: 23073 - DNA, 103 bp, Homo sapiens
ggacatacttagaatctcaatttatttaacactgagtgattctaaatggaaaattttaattttctttttatttcaacaggtttttggggaacaagtggtgtct

SEQ ID NO: 23074 - DNA, 83 bp, Homo sapiens
atgcatatgtgtatatatatgtgtatatgtatatataatgtgcatatgtgtgtatatgtatatatgtgcatatatacatatat

SEQ ID NO: 23075 - DNA, 95 bp, Homo sapiens; identical to SEQ ID NO: 6311

SEQ ID NO: 23076 - DNA, 95 bp, Homo sapiens; identical to SEQ ID NO: 68

SEQ ID NO: 23077 - DNA, 93 bp, Homo sapiens; identical to SEQ ID NO: 69

SEQ ID NO: 23078 - DNA, 84 bp, Homo sapiens
tctctctctgtgtatatacacaggtatataagtatgtacctataaatatagatatgtatatatgtgtatatatatatagagtga

SEQ ID NO: 23079 - DNA, 58 bp, Homo sapiens; identical to SEQ ID NO: 2442

SEQ ID NO: 23080 - DNA, 95 bp, Homo sapiens
agcattgtatggtctgagcccttctggttaattgcctctggatgattacatttattgtgtttattaagcagtttggggtttctccattcagagct

SEQ ID NO: 23081 - DNA, 88 bp, Homo sapiens
tgaaagaacctgggagtggtagctcctgcccgtaatcccagtacttcaggaggctgaggtaggaggatcacttgagctcaggagttca

SEQ ID NO: 23082 - DNA, 117 bp, Homo sapiens
tggtagagtttgaaaggaagggaaaggcaaaaattgggtcagtttagagagtgtgcagatatgattgtgaatgaaggatgatctgaaagatttggacttcttgtcatgactgaatca

SEQ ID NO: 23083 - DNA, 114 bp, Homo sapiens
gcacggtctccgactcggccccctgcgcccgctcagtgtcactgcctctcgctctgggaaaatggcggcggcggcggcggcggccgcggcggcggcggcggcggcggcaagtgc

SEQ ID NO: 23084 - DNA, 90 bp, Homo sapiens
ctttgagcaatgtgttttatataaaatatcttaatcatcccagcaaaaaggcaggtattattttcattttataagaaatgcagctcaagg

SEQ ID NO: 23085 - DNA, 112 bp, Homo sapiens
tggctgttgtttgtgctgtcatctgtcctcttcaattagggtgcaaactttttttttctttgagatggaattttgctcttgttgcgcaggctggagtgcaatggtgcagtca

SEQ ID NO: 23086 - DNA, 112 bp, Homo sapiens
tgatggctcttgtgctgccagtgcacggcactactgtacttagcacaatggattcttggactggataattcattgctgtggggctgtcgtgtgcactgtgggatgcttttca

SEQ ID NO: 23087 - DNA, 61 bp, Homo sapiens
ttgagagagggtctcactctgtcacccaggctggagtgcagtggtgcaacctgccttccaa

SEQ ID NO: 23088 - DNA, 77 bp, Homo sapiens
ttgagacagagtctcactctgtcgcccaggttggagcaacctccacctcctgggttcaagtgattctcctgcctcag

SEQ ID NO: 23089 - DNA, 114 bp, Homo sapiens
atatgtatacatatgtgtatatacatatatatacacgtgtgtgtatatatacatatacatatatacatatacacacacgtgtatatatatgtgtatatgtatgtgtgtggatat

SEQ ID NO: 23090 - DNA, 70 bp, Homo sapiens
ttcctgtcaagaatcgtctgttctctctggctcaggtacaggcatagtagcacagactctctcccaggga

SEQ ID NO: 23091 - DNA, 111 bp, Homo sapiens
gcctgggcgacaagagtgaaaccccgtctcaaaaaatgacaacaaaaaaatgacactatctacttgttttttttattttttgagacaagagtctcactctgtccctcaggc

SEQ ID NO: 23092 - DNA, 113 bp, Homo sapiens
gtatttgtttatatatactgtgtatatgtatatatatatatatatactgtatatatgtgtgtacatatacgggtgtgtgtgtgtctatatatatacgtgtgtgtgtatatata

SEQ ID NO: 23093 - DNA, 108 bp, Homo sapiens
agatggtcctgaaaagtcaccctgggtgttggttgttgtttcttttttttttttttctctgagacagtctcagcctgtcacccaggctggagtgcagtggcacagtct

SEQ ID NO: 23094 - DNA, 63 bp, Homo sapiens
gaggatgagtgtttcaatttacatttatttatttatttgtttgtttacgaaacactctcactc

SEQ ID NO: 23095 - DNA, 113 bp, Homo sapiens
gggaggatcctggctgcaggaggcagagcaggtgccaggctgcacttccacatcagagaacacacagtgcagcagccacttctttacttttggacagcagggccagggccccc

SEQ ID NO: 23096 - DNA, 57 bp, Homo sapiens
agtcactcgcttgtggcatttagttaggaactgactgtgtgtgtgagtgggtgtgct

SEQ ID NO: 23097 - DNA, 78 bp, Homo sapiens
agccaagaacccagaagtccagtcatgttctccctgaataattctcccacgggggactcactgtctctggctttggtt

SEQ ID NO: 23098 - DNA, 63 bp, Homo sapiens
caggagagagaaacagtgaagagggaggtgccatgcacttttttttttttttttttttttttg

SEQ ID NO: 23099 - DNA, 80 bp, Homo sapiens
gtgacatcttaataagaagcctggtggcatagtcttggatctggagccaggagtgtgcttcttgcttctttaaatagtcc

SEQ ID NO: 23100 - DNA, 82 bp, Homo sapiens
gtgatgactcctacacactgcttggccttgtacctttttccaggagggactcaggagagagtgtggagaaagctttcatcat

SEQ ID NO: 23101 - DNA, 65 bp, Homo sapiens
gtgattgccctgctggtcccagaggagctggtgtcacccccctgtctctctctcagtggtttcac

SEQ ID NO: 23102 - DNA, 77 bp, Homo sapiens
gcaaaagtggtgggatgtcatttctgaggttagggtacaaaactgctgtcacttctgttgctctcactctctcttgc

SEQ ID NO: 23103 - DNA, 115 bp, Homo sapiens
ctgagttctattttgattgctctatggtgtgagatactgttttttataatttttgttcttttgcatttgctgaggagtgttttacttccatttatgtggtcaattttataatcag

SEQ ID NO: 23104 - DNA, 76 bp, Homo sapiens
tcagttaccagagagggcagtggcacaggctccagagccagcctgcctgcctgcctgcctgactgcctgggtttga

SEQ ID NO: 23105 - DNA, 156 bp, Homo sapiens
tatacatatatgtatacatatataggatacatatatatgtatatatacatatatgtatacctatataggatacatatatatgtatatatatatacctacatatatacgtacatatatatacatatgtgtgtatatatatatacacttatatatgta

SEQ ID NO: 23106 - DNA, 144 bp, Homo sapiens
gtatacatatatgtatatatacatatatatgtatatatgtatcctatatatatatcctatgtatatatatgtgtatatatgtatgtatatatatgtgtatatatgtgtgtgtatatatatatgtatgtatatagtatccatagg

SEQ ID NO: 23107 - DNA, 86 bp, Homo sapiens
ggatgagcttgagagaacagactgagggctttagatgggtgaatgtgagaaagtctacagtgcttgctgtgctgaggaaaaaatcc

SEQ ID NO: 23108 - DNA, 92 bp, Homo sapiens
ctcaagcttgtgtggaggagaagactgaagctagatctggtggacgagaggtcctaacagtctctctctcagagctcggcccatagtaagag

SEQ ID NO: 23109 - DNA, 80 bp, Homo sapiens
aagaaaacaggggaagagcctggatcagaagagcttggttcaaggtccaagttcttcttcttcttttttttttttttttt

SEQ ID NO: 23110 - DNA, 118 bp, Homo sapiens
tcttgagtttctcgaggcttgccttgcgactaggaagacactcagctcttcctgcctatcaccagagaagacactgagctcttcagagaggccccaggcttcaggaagtccctcttgg

SEQ ID NO: 23111 - DNA, 86 bp, Homo sapiens
cccctatctgcctaggagagtgctctgtctcctgcctctgtcagtctcagggttgatcagcagagaatcccataggggtatagggg

SEQ ID NO: 23112 - DNA, 82 bp, Homo sapiens
tgggatgtcttttctgagactcagttataaaaagattacaacttttttttttttttgagacacagtctcgctctgtcaccca

SEQ ID NO: 23113 - DNA, 95 bp, Homo sapiens; identical to SEQ ID NO: 68

SEQ ID NO: 23114 - DNA, 93 bp, Homo sapiens; identical to SEQ ID NO: 69

SEQ ID NO: 23115 - DNA, 91 bp, Homo sapiens
tgcatgctctaaggccacgaagatgtcctttatatatatatatatatatatatatatttaattatactttaagttttagggtacatgtgca

SEQ ID NO: 23116 - DNA, 118 bp, Homo sapiens
gattgtcttggctatacatgctcttttttggttccttatgaaattcaaagtagttttttataattctttgaagaaagtcaagggtggattgatgggagtagcattgagtctattaatt

SEQ ID NO: 23117 - DNA, 113 bp, Homo sapiens
gtgatcatgtgctgtgcctgctccctagtgctgttcccagaaaggtgcatctgactggctgagtgggtcacatgtccacacataccgcaaagggaagctaagagagtgagtac

SEQ ID NO: 23118 - DNA, 117 bp, Homo sapiens
tcaggcagtaaaggcccaaggagtgggagagagatgagggaactgtctgtcagtggagcagacagaacacacacagcagttattaagttcaccgttccatatgggcatggttcttgg

SEQ ID NO: 23119 - DNA, 73 bp, Homo sapiens
ctggcagttcacattctcactcagtctcacactcactttgtactctgatgctgacatgaagtggctctgctgg

SEQ ID NO: 23120 - DNA, 64 bp, Homo sapiens
ggttttctatatgaatacatgtatgttcatcatatgtgtttatacatgtatatattagagatcc

SEQ ID NO: 23121 - DNA, 84 bp, Homo sapiens
tagaatgatcataatgtttgtgaagcatttaaaacagtgacagcatatggaagtgctacatgaaaggcagtcctgatgattctg

SEQ ID NO: 23122 - DNA, 116 bp, Homo sapiens
ctttgttctttttgcttaggattgtcttggctatagggtctcttttttggttccatatgaaatttaaagtagttttttctaattctgtgaagaaagtcagtggtagtttgatgggg

SEQ ID NO: 23123 - DNA, 96 bp, Homo sapiens
gtgtgtacaacattatcctttttgtgtttatttattttatatatacatacctatatacgtatacatatatatatatacacgtgtgtgtgtacacac

SEQ ID NO: 23124 - DNA, 108 bp, Homo sapiens
tgcttggtaacatgtgcctgtagtcctggctattcaggaggctgaggtggtaggatcgcttgagccagggaggcggaggctgcagtgagccatgatcatgccactgca

SEQ ID NO: 23125 - DNA, 72 bp, Homo sapiens
ttgcttgttgagttgggatctcactctgtcactctggctggagtgcagtggtgagatcttgacttactgcaa

SEQ ID NO: 23126 - DNA, 115 bp, Homo sapiens
ctcatcatttacgagaagcccccataagactgtcagtggatttctcagcagaaaccttgtgggtcagaagggagtgaggtaatctattcaaagggctgagtgggggtagtggggg

SEQ ID NO: 23127 - DNA, 152 bp, Homo sapiens
tgtgtatatacatatatacatgtatatacatatatgtatatacgtatatatatgtatatatacgtatatatacatgtatatacgtatatatacatgtatatatacgtatatatacatgtatatacgtatatatatgtatatatatatatgta

SEQ ID NO: 23128 - DNA, 65 bp, Homo sapiens
gtatgtgtctatatatgtatgtatatacgtgtgtgtgtatgtttatatatgtacagaaagcatgc

SEQ ID NO: 23129 - DNA, 69 bp, Homo sapiens
ggtttgaggtggggctgaggactgattttttttttttttttgagacagtctcgctgtgtcgcccaggct

SEQ ID NO: 23130 - DNA, 88 bp, Homo sapiens
tacttagctatatatatacatatatatatatacacacatatatatatatgtgtgtgtgtgtatatatatgtgtatatgtatgtgtgta

SEQ ID NO: 23131 - DNA, 90 bp, Homo sapiens
attattaaaggtaaattctggatgcatcaggtaattttttgcactgctgagaaagaagacactgagcagtgggagttttccttttctaat

SEQ ID NO: 23132 - DNA, 113 bp, Homo sapiens
gagtagtattccatcatatgtatatatatatacacgtatatatacacatatatatacgtgtatatatatatgtgtatatatgtatatatatattacagtttatttatccactc

SEQ ID NO: 23133 - DNA, 93 bp, Homo sapiens
tacacacacatacacgtatgtatatatgtgtgtatatatacacacacatacacgtatgtatatatgtgtgtatatataaatagcaacattgta

SEQ ID NO: 23134 - DNA, 116 bp, Homo sapiens
ggatgtggctaccaaattgttacagtagtacagtatgaactacagttaatttttcttttttcttttactttaagttcttggatacatgtgcagaatgtgcaggtttggatacatgt

SEQ ID NO: 23135 - DNA, 105 bp, Homo sapiens
gccaaaactaattcaaagtagcaacacctttttcatagtctttgaatatatttaatatggggattctaagagattctagatgttgcatgtgttgaactcatgggt

SEQ ID NO: 23136 - DNA, 118 bp, Homo sapiens
tgattgtttttgttaagtgcatagttgggacagagatacgagggtgacttttcaatgttatttctttttatttcttgaattttgaatcatgtgcttgtattatctattcagaaaacgg

SEQ ID NO: 23137 - DNA, 113 bp, Homo sapiens
attattggtgaatattaggaaattatttcttcattttgaaaactaataagggaaagattaagtatttatttttagttttcagtatgaacaatactcctaggtaaacaaatagt

SEQ ID NO: 23138 - DNA, 109 bp, Homo sapiens
catttcaagaagtagctagataatcttagacaagtcactcaatttctctgagctcagtaacaactggaaaaacatggtgattactaagactcatggaacttctggtttg

SEQ ID NO: 23139 - DNA, 93 bp, Homo sapiens
tgagccactgtgcctggccaaatcacagctttttaaaaatattgtgacttcattcattttatatttaagtagctgtagaaactgggcttctca

SEQ ID NO: 23140 - DNA, 115 bp, Homo sapiens
attcattctccctgctgtatagtattcattccattgtagaatttaccaccacttatgtattcatcctacagtttgtggatatttgtgtcgtttccagttttgggctctcatgaat

SEQ ID NO: 23141 - DNA, 98 bp, Homo sapiens
gccttatttcagggaagcctttgaagctatgatggacataagtctaaattaaatgtatgtatgtttcattatattgctcttaagactactgaggtggc

SEQ ID NO: 23142 - DNA, 111 bp, Homo sapiens
gttaaaaaatggtgaaaattgaataaagtctgtaatctacttaacatactatactaatgtatagtactgatattgtactacagctgtgtaagatgtcaccattgtggtagc

SEQ ID NO: 23143 - DNA, 119 bp, Homo sapiens
ctgggcatggtggtgtgtgcctgtagtcttgactgcttgggaggctgaggtggaaggatggcttgatcccaggaagtcaaggctgtagtgagctgagatcacaccctgctctccagcct

SEQ ID NO: 23144 - DNA, 126 bp, Homo sapiens
gagctggaattatatgtataaatatacatatgaatacattaatttgtatgtatgtatatatatatgctcatatacatatacacatgcacatatttatttacatattcatttttatatttatatata

SEQ ID NO: 23145 - DNA, 111 bp, Homo sapiens
ttccaaagtaagttggataattgtctgcattttcagtaattttaaaattgatttcaaacagtattttgaaaagtaagatttttatgcttaaaatatgtattggctttgggg

SEQ ID NO: 23146 - DNA, 70 bp, Homo sapiens
gacaactttgtgagactcccatctctacaaaaaaacattatttttttttgaggtggagtctcactctgtc

SEQ ID NO: 23147 - DNA, 134 bp, Homo sapiens
gccactcttgggtcaatagctgtgatttgcctctgaaaaactttttttttttttggaagagtctcactctgtctcccaggctggagtgcagtggcatgatctcggctcactgcaacctccacttcccgggttca

SEQ ID NO: 23148 - DNA, 121 bp, Homo sapiens
cccagctacttgggaggctgaggcatgagaatcgcttgaacccaggaggcagaggttgcagtgagtgagcagagatcgtgccactgccctccagcctgggtgacagagcaagactgtctca

SEQ ID NO: 23149 - DNA, 127 bp, Homo sapiens
aagtgcggaagaagtggacctcagctggaggccaaggtttcagagctggatgcacttggtgagtgatgagactgtgggttggtttcccttgaagacaatgtgggtgtgctttcatttggctgagtgc

SEQ ID NO: 23150 - DNA, 66 bp, Homo sapiens
ggtggctctgattctggactcctcactcactagctctgtgaccctgtcacagcgtcacagaccact

SEQ ID NO: 23151 - DNA, 105 bp, Homo sapiens
tatacacacatatacatatgtatatttgtatatatgcatgtgtgtgtatgtgtatatatatacaatctttatatacatatatggttatatgcacacacacatata

SEQ ID NO: 23152 - DNA, 114 bp, Homo sapiens
agtaacagtatcacttcagttgatatgtagagaatatagcgggcaaaagagagagtagagagactgttggggccactgctgtaatctagatgaaatttgttggtgacttggact

SEQ ID NO: 23153 - DNA, 87 bp, Homo sapiens
ttttaaggaaaatgttcaaaaattcttgatgttgtgacaaaaattatggcacagcatttcagtggaatattgtgtgttcacttgaaa

SEQ ID NO: 23154 - DNA, 111 bp, Homo sapiens
ttttctgtcatttcaaattctttggacagatcacactggttgagtaaagcagagagaagagactgttggcattcatgaccttacatttgtggtttgtgatttgacagtgga

SEQ ID NO: 23155 - DNA, 92 bp, Homo sapiens
ttctcaccttctcccatcacagccctgccctcaccatttgctgtagatctgtagtttgacagtgagcagtctgcctgattggaagggaagaa

SEQ ID NO: 23156 - DNA, 71 bp, Homo sapiens
tctgtgacacacactgtcttgcagacaggtctttgggatcacactgtactttgcaacagtctgtcacaaga

SEQ ID NO: 23157 - DNA, 95 bp, Homo sapiens; identical to SEQ ID NO: 68

SEQ ID NO: 23158 - DNA, 93 bp, Homo sapiens; identical to SEQ ID NO: 69

SEQ ID NO: 23159 - DNA, 80 bp, Homo sapiens
attcctggtagtgtacattctgtgggtctgaacaaatgtataattatatttatccatcattatgatactatacagaggat

SEQ ID NO: 23160 - DNA, 119 bp, Homo sapiens
tgaagtctcaagtgttttggtagtgattatgaattttctcaagatggttggctgtctggctgtctggctggggaacgtatatttttgaggcttgaagatcagtagaaaataggttgggc

SEQ ID NO: 23161 - DNA, 95 bp, Homo sapiens; identical to SEQ ID NO: 68

SEQ ID NO: 23162 - DNA, 93 bp, Homo sapiens; identical to SEQ ID NO: 69

SEQ ID NO: 23163 - DNA, 65 bp, Homo sapiens
ttttctcctagttctttcagattttgttttacagaattagaacacaagagagggtggggaggaag

SEQ ID NO: 23164 - DNA, 109 bp, Homo sapiens
tccaacatagttaggcatgttgtttcttgtaagatgaagtcaattttggacactgagaggagacagagatcagcttggtctgcttgaaaacactgcatgtctctaagga

SEQ ID NO: 23165 - DNA, 116 bp, Homo sapiens
cattcagacactccttttcttctctccttctctgttgttctgccactctgcctctcttctgctcgtggagcctggggtttggggcttatacggatacaggataggggggtgtggtg

SEQ ID NO: 23166 - DNA, 114 bp, Homo sapiens
tggatatatatctgaaaaagggattgtgggtcatatagtagttctaattttaatttctttagaaatctccatactgttttccataatggctgtaccaatctacatttttcacca

SEQ ID NO: 23167 - DNA, 95 bp, Homo sapiens; identical to SEQ ID NO: 580

SEQ ID NO: 23168 - DNA, 93 bp, Homo sapiens; identical to SEQ ID NO: 69

SEQ ID NO: 23169 - DNA, 56 bp, Homo sapiens; identical to SEQ ID NO: 12407

SEQ ID NO: 23170 - DNA, 83 bp, Homo sapiens
taactgtggaatggaaagtagattgttgaagacctaatgtgattagttttatcttcaaaatagttatctttccttcacagtta

SEQ ID NO: 23171 - DNA, 105 bp, Homo sapiens
gattaaatgaataaacatgtgtaaaggatttagacaggtctcagaaataaagcaagcactcaatatattttagttttaaatccattggagatgattcatttgatc

SEQ ID NO: 23172 - DNA, 99 bp, Homo sapiens
tcagttgagtgaaatgtagtcagtttctcaaacagttctaatttacactttttttttttttttttttgagagacagtcttgctaagtcgcccaggctgg

SEQ ID NO: 23173 - DNA, 115 bp, Homo sapiens
tatatatatttacaaaggtaaatacatatatgcatgtttacaaaggttatatatatatatatatatatatatgcacacatacacacacatatgtttactaagataaatatatata

SEQ ID NO: 23174 - DNA, 71 bp, Homo sapiens
atatgtgtgtgtatgtgtgcatatatatatatatatatatatataacctttgtaaacatgcatatatgtat

SEQ ID NO: 23175 - DNA, 102 bp, Homo sapiens
gattagaaaaagagaggtgaagattttattttaaaaacaaagatctccagatcatttactattttgtttttgtaaaatatttctcttcttgcttatctaatt

SEQ ID NO: 23176 - DNA, 83 bp, Homo sapiens
tacatataggtatacatacagatatagatacatgtgtacacatgcacatgtatatatgtatctacatgtgtgcatatgtatat

SEQ ID NO: 23177 - DNA, 104 bp, Homo sapiens
agaagagtttttgtagggacattttgttttgtgattttttttttgtctgttttaaatattgatgagatttgaaagtacttaaacaaaggactattgacttctct

SEQ ID NO: 23178 - DNA, 95 bp, Homo sapiens; identical to SEQ ID NO: 68

SEQ ID NO: 23179 - DNA, 93 bp, Homo sapiens; identical to SEQ ID NO: 69

SEQ ID NO: 23180 - DNA, 88 bp, Homo sapiens
gtatgttttacatatacatttacatatacatgtatgcacatatgtaagtatccatatatttatatgtatacacatacataaaatgtac

SEQ ID NO: 23181 - DNA, 107 bp, Homo sapiens
gtagactatatatatatatatatatatatatatatatatatacacacatacacacacacacacacatatatatatctatatatctatatctatatctatatatctat

SEQ ID NO: 23182 - DNA, 58 bp, Homo sapiens; identical to SEQ ID NO: 10934

SEQ ID NO: 23183 - DNA, 86 bp, Homo sapiens
tagaccatctctctctttctgtctcatatagatatatagatatagatatagatgtatagaagagagagaaagagagagagagtcta

SEQ ID NO: 23184 - DNA, 84 bp, Homo sapiens
caattcatcagaagactgtagatttctgcatatagatccagtatatacttagattcatgtgtattttattttttggtgtaattg

SEQ ID NO: 23185 - DNA, 111 bp, Homo sapiens
ggtatattgaattggtatatatacacacacaccattgaattggtatatatatatatatatatatatatatatatacacaccattgaattgtgacatatatatctatatatc

SEQ ID NO: 23186 - DNA, 56 bp, Homo sapiens
tatatatatatatatatatatatatatatatatgtgtatatatatatgtgtgtgtg

SEQ ID NO: 23187 - DNA, 117 bp, Homo sapiens
agaccttgcctcaaaaacaatagcctatgactcataaattaactttttgaatctcaattattttcaatttttattttattttcagttctggggtacatgtgcaggatgtgcaggttt

SEQ ID NO: 23188 - DNA, 116 bp, Homo sapiens
tatgtacatatgtacatgtacacatatttatatatgtgtatgtgtatatgtacatatgtgtatatgtatatatgtacatacgtatatatgtgtatatacatgtatacacacacaca

SEQ ID NO: 23189 - DNA, 87 bp, Homo sapiens
tgatatatatatacatgtgtatatatatatgtacatacatgtatatatatgtatatacacgtatatgtatacatatatatatgtatc

SEQ ID NO: 23190 - DNA, 79 bp, Homo sapiens
atgggtctggaagatttcagtcacttataaggaaagttattgactgatataatttcacttgcttgtgactgaatcccat

SEQ ID NO: 23191 - DNA, 109 bp, Homo sapiens
tataaactgacttgctaacttctaatttagtcactaaaatattacatatatatatatatacacacgtatatgtatatatgtatatatatatgacagcataataattata

SEQ ID NO: 23192 - DNA, 108 bp, Homo sapiens
gcataaaagtgctctttttgcttaaattcttcagataattggctcaactttcaaattgattttgtatatataggtaaagctgaaagagttcatccccaactcatgtgc

SEQ ID NO: 23193 - DNA, 113 bp, Homo sapiens
gcaaagcctcagcacacaactacacagataaggcctccaaaaatgacagaaatggttgttgctttttttttattattatgctttaagttctggagtacatgtgcagaatgtgc

SEQ ID NO: 23194 - DNA, 95 bp, Homo sapiens; identical to SEQ ID NO: 68

SEQ ID NO: 23195 - DNA, 93 bp, Homo sapiens; identical to SEQ ID NO: 69

SEQ ID NO: 23196 - DNA, 90 bp, Homo sapiens
gtaggtttagagtaagtatttttctataaatattttcggaggcatatgttttttagaaagagtttatgatttggtgcttgattaaacagc

SEQ ID NO: 23197 - DNA, 109 bp, Homo sapiens
tactgtattgtaatctgtctctccctttagatctaataatatttataatatttatcttatatatttgagtgttccagtgtggggtgtatatatatttgcaattgcagtg

SEQ ID NO: 23198 - DNA, 117 bp, Homo sapiens
agtccgttctacaatttgtatattgtgagtgctttataagtggatgatgatgatgatgatgatgaaatgacataactaaggctgtggaatgaagtaactcaaatgtgcatatgggtt

SEQ ID NO: 23199 - DNA, 101 bp, Homo sapiens
atagatatgtatatatgtgtgtatatatgtatgtgaatatatatacatgtatatacacacaccctatatatatgtacacacatatacatacatatatctat

SEQ ID NO: 23200 - DNA, 124 bp, Homo sapiens
gtaattatatgtatgtatatatgtgtgtatatatattccaggcatatataatatatatattataatatatatgaaaatatattatgtaattatagatatatgtatgtatatgtgtgtacatata

SEQ ID NO: 23201 - DNA, 100 bp, Homo sapiens
gcccagaggtgtgggctgggagacagaaggcagtgtggcaagattgggagctgtgaaatttgggccacattttcatgtaacttacttgtgtcttcagggc

SEQ ID NO: 23202 - DNA, 95 bp, Homo sapiens
acacacacacacacacaatatatatatatacgtatatatatatacgtgtatatatatatacgtgtatatatatatgtgtgtgtatgtatgtgtgt

SEQ ID NO: 23203 - DNA, 114 bp, Homo sapiens
gacttcttgcatatgtaaacagatagctgaattcgtttatgaccatcacaatgattaattacattgtttttcaaagcctttaggtctgtttgttccacttctcatagttttgtc

SEQ ID NO: 23204 - DNA, 74 bp, Homo sapiens
ggtttctgttccttgtattcagcatcttaactaaaatattagaatgaaatgttgaatgcagtttgattagaacc

SEQ ID NO: 23205 - DNA, 88 bp, Homo sapiens
gctcttgctaggcactcattctctctcaccctgtgaagagttatcttccaacatgatcgtgagtttcctgaggcctccccagccatgc

SEQ ID NO: 23206 - DNA, 159 bp, Homo sapiens
gtattttatacatgcatattatatatatatacatatatatatatatgtgtatatatatatacgtatatatatgtgtatatatacacatatatatgtgtatatatatgtgtatatatacgtatatatatatatgtgtatatatacgtatatatatatata

SEQ ID NO: 23207 - DNA, 111 bp, Homo sapiens
ctgtgtttgctaattggttctcatcaaaattagatagagtctcccactctcccacagaatctggaaagtagggatgctgtctttttttgatgattacatttcaagacatgg

SEQ ID NO: 23208 - DNA, 103 bp, Homo sapiens
tttctgtatagtatattcttgcagttatggattatattatttctttgtataagaaaaacaagaaatttataaatccatagctcattattgctgaacaatgaaa

SEQ ID NO: 23209 - DNA, 109 bp, Homo sapiens
catatatacatattaatctgaagtataaattacgtgtgtatgtgtatatatgtatgtctatattatgtgcatttttaaatttgtgttcatacatatatatgtatgtatg

SEQ ID NO: 23210 - DNA, 107 bp, Homo sapiens
ttggaaatgtgagaagtggaatctacttgtactttacagtttatataatattttatttaactgtaataacaactctagtgtgctgagtggaatcatgtcctccccaa

SEQ ID NO: 23211 - DNA, 81 bp, Homo sapiens
gtctgtcagtttttgctttatatatgtgtatatatagatatatatgctttatatatatatatgaaggcttatattacatac

SEQ ID NO: 23212 - DNA, 121 bp, Homo sapiens
agaggagctgtggcccttcaaggaaccaagacctgggaactccctgagccagggctgtgactccctctgtgtggccctgtggttcctggcatctccaggcttctgagtgccactgtgttcc

SEQ ID NO: 23213 - DNA, 134 bp, Homo sapiens
atatatatacgtatatatacgtatatatgtatatacatgtatatatgtatatatgtatgtatgtataagtatgtatatatgtatgtatatatgtatgtatatatatatgtatatatgtatgtatatgtgtgtat

SEQ ID NO: 23214 - DNA, 76 bp, Homo sapiens
tgtatatataaatgtaggtttatatatatctgtgacattatttatatatatatgtagatagatacagatatataca

SEQ ID NO: 23215 - DNA, 107 bp, Homo sapiens
gagtgtctgttcatcctccatagtgtcttgtcatggatcttcattttttaaaattgatatgtctataggcaggcaaagagtatagtgaatatagaaagataaaaatc

SEQ ID NO: 23216 - DNA, 95 bp, Homo sapiens; identical to SEQ ID NO: 68

SEQ ID NO: 23217 - DNA, 93 bp, Homo sapiens; identical to SEQ ID NO: 69

SEQ ID NO: 23218 - DNA, 108 bp, Homo sapiens
ttttataattttctttgtgatttattaggtgaattaaacacataagaagagattttcttgttttgtaagtttatgatgcatattagatctcagggtaaagttattgaa

SEQ ID NO: 23219 - DNA, 113 bp, Homo sapiens
tgggagcaacggttttggcatccatcaaatggaaagtttgctcaactttaattttcagtcagaattgagtgagctcaaccaattgcatgtgacatctatgaagctgactacca

SEQ ID NO: 23220 - DNA, 100 bp, Homo sapiens
actagttcatcagaggcgacagaaagacatcagcaggctcaggcatctcagcatatccacagaaatgtcactgcacttgctgtccttcagaataattggt

SEQ ID NO: 23221 - DNA, 70 bp, Homo sapiens
ttgttttgatatggagtctcactctgtcacccaggctggagtgcagtggtgagatcttggctcactgcaa

SEQ ID NO: 23222 - DNA, 113 bp, Homo sapiens
atatattatacacacataatatataatacacacatgtatataagaatatacatatatttatgtatataagaatatacatgtgtatataagtatatacgtgtgtgtgtgtatgt

SEQ ID NO: 23223 - DNA, 94 bp, Homo sapiens
tgaccaaagcactgaatattcattgcatttctaatcaaatgtaccctttataaaaggttaaagatgtaagaagtgctcttaatggcgagggtta

SEQ ID NO: 23224 - DNA, 74 bp, Homo sapiens
ctgatcaaatcaccaaactcactggcacacactgagtggcaacaccgggggcctggagtgttggtatttctcag

SEQ ID NO: 23225 - DNA, 81 bp, Homo sapiens
gtgctttatagttttcaaagccttttcttattcattattaatttaatattaatgaacttgtgagataggttggtgaggtac

SEQ ID NO: 23226 - DNA, 82 bp, Homo sapiens
tggcagagccaattatagcaaatgtctgtcagactctgtcccagggactcagttggaggtttggtgcaagtttgtactgtca

SEQ ID NO: 23227 - DNA, 103 bp, Homo sapiens
tcctgaaaggcatagtatcagtctgcacagttgtgatgatgatgatgacatcggtggtgtcagttcaaatctctgtgtatgcctgatggatcttcaaacaggg

SEQ ID NO: 23228 - DNA, 83 bp, Homo sapiens
gtgactacatttgatgactgtagtatatatttttatgaactttagtatatttgtgttatacttattgtcatttaaaaagtcac

SEQ ID NO: 23229 - DNA, 58 bp, Homo sapiens
ggcccttgattttcaagatttattatacttttgtaataactggctgtagtcaggggct

SEQ ID NO: 23230 - DNA, 95 bp, Homo sapiens; identical to SEQ ID NO: 68

SEQ ID NO: 23231 - DNA, 93 bp, Homo sapiens; identical to SEQ ID NO: 69

SEQ ID NO: 23232 - DNA, 97 bp, Homo sapiens
acttagaaaccattaaaatgaatatttctaattctgttaagaacaagatatcttaaaagttggattagaggtagagttttaaatctaatttctgggt

SEQ ID NO: 23233 - DNA, 104 bp, Homo sapiens
atatggtagtttgttgaatacttgagatgtggtgagtgcaactaagaaagtgaatctttaattttatgtactttaaattattttcagtttaaatagatacatgt

SEQ ID NO: 23234 - DNA, 95 bp, Homo sapiens; identical to SEQ ID NO: 68

SEQ ID NO: 23235 - DNA, 93 bp, Homo sapiens; identical to SEQ ID NO: 69

SEQ ID NO: 23236 - DNA, 84 bp, Homo sapiens
atgcaagttgttgagagagacagacagagaatatttacctttcctcttccttgttgttgtttccaagctctcaactaattgtat

SEQ ID NO: 23237 - DNA, 58 bp, Homo sapiens
tgagacagggtctcactctgtcacccaggctggagtgccgtggtgcgacctcagctca

SEQ ID NO: 23238 - DNA, 116 bp, Homo sapiens
tgctactgatttttgtatgttgattttatatcctgaaacttcactgaatttgttgatcatttctaatagttttcttgtggagtctttaggtttttccaaatataatatcatctgta

SEQ ID NO: 23239 - DNA, 109 bp, Homo sapiens
tagtgaaccttcatcagtggtgtgtgttcaatatcaaaacatctttctaattataaagaatcttcagttaggtgagcagatatttcatctccccaccttttggttccta

SEQ ID NO: 23240 - DNA, 64 bp, Homo sapiens
ggcatagtggtaggaaagagctcaccttacctttaaaaagagtggctctctctttctctgtatc

SEQ ID NO: 23241 - DNA, 58 bp, Homo sapiens; identical to SEQ ID NO: 315

SEQ ID NO: 23242 - DNA, 99 bp, Homo sapiens
agtcctggaatgtgtaagggcttgttttatcctcatgttctccagtcttctgtgtgtctgtgtggaaagcagtgctctagctctttaatgatcaggact

SEQ ID NO: 23243 - DNA, 69 bp, Homo sapiens
aggactctggagtctgttaaaatctttaggaagacattaattttttgaattttaacagacagaagtcct

SEQ ID NO: 23244 - DNA, 100 bp, Homo sapiens
tgtttagtttaacttgtttgggtttgctgaggttcttggatctgtacatttatttcctttaccaaattcgggaagcttccaagcattatttccttaaata

SEQ ID NO: 23245 - DNA, 111 bp, Homo sapiens
ttttgtttgtgtttaatctgcaatgtgatgtttcttagaagagttatttttaaatttacaagtgtttttaagagaagcatagtgagctgcaggttaaattaaagtccagga

SEQ ID NO: 23246 - DNA, 101 bp, Homo sapiens
gacagaccatgatatcttctggctggccttacatagttgaaggttgttttcaagatgataactcttttttttttttttttgagtcagagtctcactctgtc

SEQ ID NO: 23247 - DNA, 115 bp, Homo sapiens
tccagtgactagagctggagggtggtaagctttggttaggtttaggatatatatagatacattatatatatcaatgtatattttgatacagagtcttactgtctcctaggctgga

SEQ ID NO: 23248 - DNA, 99 bp, Homo sapiens
tgtatatacgtatatatatgtgtatatacgtatatatatgtgtatatacgtatatatatgtgtatatacgtatatatatgtgtatatatatgtatatat

SEQ ID NO: 23249 - DNA, 116 bp, Homo sapiens
atacctttgtttatatctattattgagtgatagcattgatatattgtgtattattttaataaatttcatatatgtgaaatgcatatttataataatctaagaagttggcaaagtat

SEQ ID NO: 23250 - DNA, 86 bp, Homo sapiens
gagacaggatctcactctgtttctcaggccggagtgcagtggtgtgatcatagctcactgcagcctggaacacctgggctcaagca

SEQ ID NO: 23251 - DNA, 182 bp, Homo sapiens
atgtatatgtatatatgtatatgtatatgtataatatgtgtatatatgtatatgtgtgtatatatacacgtatatatgtatacacgtgtatatatgtatatgtgtatatatacatatacacacgtgtatatatacgtatatatgtgtgtatgtatatatatgtgtgtgtgtatatatataga

SEQ ID NO: 23252 - DNA, 82 bp, Homo sapiens
ctggtaagggaagaatgcctcaagtgagcatgagtacaactccagtaatcacactgctcatgcagcccctcccacgtgctgg

SEQ ID NO: 23253 - DNA, 72 bp, Homo sapiens
tcaacctaaattcataaacagatgtgtatatatctctatttatgtatattgaagtctgtattgtgagggtga

SEQ ID NO: 23254 - DNA, 95 bp, Homo sapiens
ccccacccccaccatcactgcctctgtgcctctgaggcccccgcccagctgccgggctcagatgaaacaggccctgtgttttttttcaggagggg

SEQ ID NO: 23255 - DNA, 95 bp, Homo sapiens; identical to SEQ ID NO: 68

SEQ ID NO: 23256 - DNA, 93 bp, Homo sapiens; identical to SEQ ID NO: 69

SEQ ID NO: 23257 - DNA, 111 bp, Homo sapiens
ggtatttgggattattatgtattatatacattatgtgtgtatatatatatgtgtatatgtatatacattatgtatatatattatgtatatatatacataatattatgtatt

SEQ ID NO: 23258 - DNA, 61 bp, Homo sapiens
gccttcaagacagggtcttttttctttttttagagacagggtctcactctgtcacccaggc

SEQ ID NO: 23259 - DNA, 107 bp, Homo sapiens
agtcttaaaaagtcttagagattatttagtatagtactttatttttttccttaagaaacaatcaaggcatgtactgattaattgagttatttaagcttactgaggtt

SEQ ID NO: 23260 - DNA, 81 bp, Homo sapiens
aagatttaaggactttggctgtatcactcattttgtacttctgaagtgctgaagtgaggcttacagtatgcctttcttctt

SEQ ID NO: 23261 - DNA, 87 bp, Homo sapiens
gagtgaggaagaggggagagcatgacatttacatgggaggcttttggaaactactaacacatgtgtatttgttctcctcccccattt

SEQ ID NO: 23262 - DNA, 91 bp, Homo sapiens
gtgttttaaaattgaggacaggtctagtgatttaggtgatgtgtagatatctgcttatgttctaaattcattttcctgcaatttaaaacat

SEQ ID NO: 23263 - DNA, 69 bp, Homo sapiens
cctgatggtctgtcactgtctcccatcacccccagatggactgtctagttgcaggaaaacaagctcagg

SEQ ID NO: 23264 - DNA, 92 bp, Homo sapiens
ggcatatgggaagctacaaatggtatttttgttttctataaagttctagtgattaatgtggatactgatatgatttgaaatatccatatgcc

SEQ ID NO: 23265 - DNA, 88 bp, Homo sapiens
gctgggaggtccctacaggtcatctccgaggactctggagactgcaccctggaagataagtgactatgtagaagagtggcttcagagc

SEQ ID NO: 23266 - DNA, 70 bp, Homo sapiens
gagcttggtcttcactgtgtctgtctgtatccacagttctgggacagtacccagcacagagtacatgctc

SEQ ID NO: 23267 - DNA, 106 bp, Homo sapiens
cttaaaagaattgcagtctctcataaaatatctatatttttaactgagtccattggagatattataaactgaaagcgtatttgtaaatagggactgtgtttttaag

SEQ ID NO: 23268 - DNA, 87 bp, Homo sapiens
gagttttgatgaggactgcactgactctatacagacagggtctcactctgtcacctaggctggagtacagtggtgtgatcttagctc

SEQ ID NO: 23269 - DNA, 79 bp, Homo sapiens
gaaggtgtttggctggttacatgaatgaaagccccagtatgtgaaaggggcagtctgtcttcctgtgtgtctcactttt

SEQ ID NO: 23270 - DNA, 108 bp, Homo sapiens
ggattatcttggctatacaggctcttttttggttccatatgaaatttaaagtagtattttctaattctgtgaagaaagtcaatggtagcttgatagtaatttgaatct

SEQ ID NO: 23271 - DNA, 132 bp, Homo sapiens
gtgtgtatatatgtgtgtgtgtatatgtgtatatatatatttatatatatattatatattttatatttatatattttatatatatttatatatattttatatatatatttatatatacacacacatattaca

SEQ ID NO: 23272 - DNA, 102 bp, Homo sapiens
ggaggacttggtcattccctggaaagagatgtggttttcttgacctgcaatgaaagctagtttccttataaatcttatttccttttagtgtgtgataccttt

SEQ ID NO: 23273 - DNA, 109 bp, Homo sapiens
gtgtgtgtgtgtgtgtataaactatatatataattaaactatatatataattaaactatatatataaaactatcattatatataactattttatatatatataaaatgc

SEQ ID NO: 23274 - DNA, 69 bp, Homo sapiens
ggccgaggcaggagaattgcttgagaagttcttgagaattggtctcagaactttgagagcagcctggcc

SEQ ID NO: 23275 - DNA, 78 bp, Homo sapiens
atgtaaaatgatcaggtcaggttaaaatcattgcatttaatctaagattgttgatctgataagaatttcgttttatat

SEQ ID NO: 23276 - DNA, 79 bp, Homo sapiens
tgccccagagcaattacaggaggagttgagaaccagttatcaatattttttttaaagctcccaggtgttctgataggca

SEQ ID NO: 23277 - DNA, 95 bp, Homo sapiens; identical to SEQ ID NO: 6311

SEQ ID NO: 23278 - DNA, 98 bp, Homo sapiens
ttttgttacgcagggatgctgaattttattgaatgctctttctgcatctattgaatgatcataaagtttttgtttttaatcctgcttgtgtgatgaag

SEQ ID NO: 23279 - DNA, 72 bp, Homo sapiens
gtgaatgtgtgtttctcatatatagagagatatctatatatctctatatatagattatatatatacatacac

SEQ ID NO: 23280 - DNA, 82 bp, Homo sapiens
catgagtatgtagttaagagtgtgtgtatatatatatgtgtgtgtatatatgtatatcatttgtaatagaatctatatcatg

SEQ ID NO: 23281 - DNA, 167 bp, Homo sapiens
tagcatgtgtatatatatttacacatatttagtatatatagtgtatatatttatacatagtgtatatatatgcatataaaatatgtgtaagtatatatatatctatacaaaatatgtgtaaatgtagtatataatacacactaaatatatgtaaatatataatatat

SEQ ID NO: 23282 - DNA, 113 bp, Homo sapiens
tgtgtgccagccattgttgttctagggttttatgcacattaactcaacttaattttttttattatactttaagttttagggtacatgtgcacaacgtgcaggtttgttacata

SEQ ID NO: 23283 - DNA, 95 bp, Homo sapiens; identical to SEQ ID NO: 68

SEQ ID NO: 23284 - DNA, 93 bp, Homo sapiens; identical to SEQ ID NO: 69

SEQ ID NO: 23285 - DNA, 117 bp, Homo sapiens
tatataaattatacagttatagctatatatacctatatataatatttaacatatttatataatataaattacagagttatatatagttatatataactttaatttataatatatatg

SEQ ID NO: 23286 - DNA, 94 bp, Homo sapiens
gtatatatacatatataattatatatgtatatactatgtaagtatatacttatgtaagtgtatatacaagtatatacttatatatatcatgtat

SEQ ID NO: 23287 - DNA, 77 bp, Homo sapiens
taagatagtggactttttgatgtactgaaatgtaactaggaatttctcattgtagatcactgtagttcattattttg

SEQ ID NO: 23288 - DNA, 58 bp, Homo sapiens
tgagacggactctggctctgtcgcccaggctggagtgcagtggcctgatctcggctca

SEQ ID NO: 23289 - DNA, 115 bp, Homo sapiens
gtttccttttagaatctggaaagtattaggttggtgctgaagtatttttttttctttcaatggcaaaaaccacaattacttttgcaccaacctaatactttgctgataaagtggc

SEQ ID NO: 23290 - DNA, 90 bp, Homo sapiens
aaagtataacgaaagaaaaatatcatatgtacctgttgatttttattaaatgtgtgctatgaattgatatttttattttccatgtacttt

SEQ ID NO: 23291 - DNA, 116 bp, Homo sapiens
cataattgcaattttaagaagttttgaaagttttctttggtaaagtagacatcatataaagaatatatatctattttaaacagctattaacatttcttaaaaatttgtcatttgtg

SEQ ID NO: 23292 - DNA, 76 bp, Homo sapiens
cttaggaggttcctggattcccaatgaaattgaaataattctatttgaattttaatgcagaaaggagcttcagaag

SEQ ID NO: 23293 - DNA, 58 bp, Homo sapiens
tgagatggagtctcactctgtcacccaggctggagtgcagtggtgtgatttaggctca

SEQ ID NO: 23294 - DNA, 108 bp, Homo sapiens
gaataggacaattgtgttttcagtcagttttatatttataaatttctttctagcttcaagttggaaatacttaaatatatatattttattggcagataatgttctgtc

SEQ ID NO: 23295 - DNA, 95 bp, Homo sapiens; identical to SEQ ID NO: 580

SEQ ID NO: 23296 - DNA, 93 bp, Homo sapiens; identical to SEQ ID NO: 69

SEQ ID NO: 23297 - DNA, 95 bp, Homo sapiens; identical to SEQ ID NO: 68

SEQ ID NO: 23298 - DNA, 93 bp, Homo sapiens; identical to SEQ ID NO: 69

SEQ ID NO: 23299 - DNA, 103 bp, Homo sapiens
catgatactcaaatgaaggccagaaacatcactgaattatagaattttattttaaactgtactataattaaatatctgtttctttggaaaacatttgtttatg

SEQ ID NO: 23300 - DNA, 115 bp, Homo sapiens
ggatagctttttgaatgttctctggggagtaacattttttagagtaatgatccatgattactatagaagtatgttataaccttcaggtgtgctaggacaggtgacaaggctaatc

SEQ ID NO: 23301 - DNA, 102 bp, Homo sapiens
ggcgtgatggcatgcacctgtagtcccatctacatgggaggctgaggtaagaggatctcttgagcccaggaggtggagattgcagttagccaagattgtgcc

SEQ ID NO: 23302 - DNA, 195 bp, Homo sapiens
tatatatgcatatgtatatatgtatatgtgtatacatgtgtctatatatgtacatatctatgcatatatgtatatgtgcatatgtatatgtgtttatgtacatgcacatatgtatatatgtatatggagatatgtatgtgtatgtgtatatgtatatatgtctatatatggatatggatatatgtgtatgtatat

SEQ ID NO: 23303 - DNA, 247 bp, Homo sapiens
gtgtatgtgtatatatgtctatatatgtatatgtttatatgtatatgtatatatgtgtatacatgcatgtgtatgtctgtatatatgtgtatatgtatgtgtatgtatatatgcatatgtgtatatatgtgtatgtgtatatgtatgtgtatatgtatatgtgtatatgtatatatgtgtataagtatgtatatgtatagtatagtctatatatgtatatgtctatatataggtacatgtatatatg

SEQ ID NO: 23304 - DNA, 118 bp, Homo sapiens
ctgtggaatttttgggtgtgtaaaggcttttcctgtttctttgaacctcgtttcctggatcttgttgagatgatttcatggaaagaaggcctaataacagtgtgcaattattttattg

SEQ ID NO: 23305 - DNA, 109 bp, Homo sapiens
atatgtgtatatgtctatatatgtgtgtatgtgtgtgtatatgtatatgtgtatgtatgtatatgtgtatatgtatatgtgtatatgtatgtgcgtatatatgtatata

SEQ ID NO: 23306 - DNA, 61 bp, Homo sapiens
tgagtcagagtctcgctctgtctcccaggctcctgtgcagtgttggcgcgatctctgctca

SEQ ID NO: 23307 - DNA, 56 bp, Homo sapiens; identical to SEQ ID NO: 324

SEQ ID NO: 23308 - DNA, 115 bp, Homo sapiens
gtctcttatggagcaaagttttcagattttgatgaagtaaaatatatcacttttttttattcagtagattatgcttttggcgtcaactccgagaattgtttgcctagccctagat

SEQ ID NO: 23309 - DNA, 73 bp, Homo sapiens
ttgtttttttgagacagagtctcgctctgtcgctcaggctggagtgcagtggcgcgatctcagctcattgcaa

SEQ ID NO: 23310 - DNA, 90 bp, Homo sapiens
cagaagagaccctggggctgctgatgaagggcagagacctggctccatcccaggctgcactgcctctctgggcctcagtttccctatctg

SEQ ID NO: 23311 - DNA, 131 bp, Homo sapiens
acatttaataggaagaaatgtgggctcaataacatggtgtgagaagattgtcaggagtgtgttctttttttttttttcttaacccaaacacagcctctgtagatttttttgaatgttcaagttacaccttc

SEQ ID NO: 23312 - DNA, 118 bp, Homo sapiens
agaactacaacatggcggaaaaacaaaatgtcattcaaccttcttacacatattttgcaatttaattttttttaattgcatatgggaaggtggagacagaaatctccataatggtttt

SEQ ID NO: 23313 - DNA, 117 bp, Homo sapiens
tgttaggtagtagatacaggattcaaactcgggtctttttgcattctaagtttatatatagatattatctttagtgctgtagattaaataatttatcaattatttgctaaattagca

SEQ ID NO: 23314 - DNA, 81 bp, Homo sapiens
gtgtgtgtgtgtgtgtgtgtgtgtatgtaatagttccaggtgattcagatatatatatatatatttctggcatatatatac

SEQ ID NO: 23315 - DNA, 101 bp, Homo sapiens
atctgagtggcgaaatgagaggtaaaatggtgaaggcagatctttatatttttacaaagtagttttgctatttcatcagtaataccacagatttttcagat

SEQ ID NO: 23316 - DNA, 76 bp, Homo sapiens
atacatataaacatgtatataaatatgtatacacatttaacaatttatgcatatttatatgtatttatatatgtat

SEQ ID NO: 23317 - DNA, 85 bp, Homo sapiens
gacagagtgagacctgtctctaagagaatttttattttttatttcttttttttgaattttttttgagatggagtctcactctgtc

SEQ ID NO: 23318 - DNA, 82 bp, Homo sapiens
agttggtatttgtattgaagtaatatacatgatcaattagggaacccctgaaagattatttttgctttttaaatgattgact

SEQ ID NO: 23319 - DNA, 121 bp, Homo sapiens
ttggatatatactcagaagtgggattgctgaatcatatagtagtcatatttttaacttttaaagtaactttcatactggctacaccaacttacattcccaccaagagtgttcaaattttcc

SEQ ID NO: 23320 - DNA, 111 bp, Homo sapiens
taatagtatatatgtgtatatatactattatatgtacatataatagtatatatgtgtatatatactattatatatacatataatagtatatatataaaatagtatatatac

SEQ ID NO: 23321 - DNA, 115 bp, Homo sapiens
gtgacagatgctgaatgattactctgtgccaggaaccattgtttattattattattattattattattttacattaagttctgggatacatgtgcagaatgtgcaggtttgttat

SEQ ID NO: 23322 - DNA, 109 bp, Homo sapiens
tgtatatatttctagtgcatatatattgtatatatttctagtgcatatatgtgtgtgtgtgtgtgtgtgtgtatatatatatatatacgtatatatgcattgtggaatg

SEQ ID NO: 23323 - DNA, 110 bp, Homo sapiens
tgcttctgattgtcttggctttgcaagctcttttttggttccatatgaaatttaaagtagttttttccaattctatgaagaaaggcagtggtaacttgatcaggatagca

SEQ ID NO: 23324 - DNA, 58 bp, Homo sapiens; identical to SEQ ID NO: 1847

SEQ ID NO: 23325 - DNA, 104 bp, Homo sapiens
gcagcagccatcactggcaataaggtgttttctgctcttgtcaagtatctttatttaaatattaagggagagatatgacctttggccttggagatcactgtgac

SEQ ID NO: 23326 - DNA, 84 bp, Homo sapiens
cttgagaactcccctgtccttttgtgtggcaggtgtgaaatgtggtataggctgcaataggctgacagaaaggagagtgaagag

SEQ ID NO: 23327 - DNA, 90 bp, Homo sapiens
agaaattcttattattttatatgtgcatatgttatatatatacatttctatataagtatatatgtattatatgtgtgtatatatgtttct

SEQ ID NO: 23328 - DNA, 98 bp, Homo sapiens
tgttaaatgaagctgtcttttatatatgtatgtatatatgtgtgtatatacatgtatatatgtatgtaaaacatatatgtgcatttgctcaatttcca

SEQ ID NO: 23329 - DNA, 153 bp, Homo sapiens
agcataataaatcttttcccatccacttacttttaattatttaatttttttttttaaatttaaagtttaaaaatggtaatgtgagagaggagtgtgaggctgaagggtgctggcctggcctagccctacttttaatttatatatgtgtcattt

SEQ ID NO: 23330 - DNA, 94 bp, Homo sapiens
gtgtagtgtgtaggaaggactgtttttgtttattattatactttaggttctagggtacatgtgcacaatgtgcaggtttgttacatatgtatac

SEQ ID NO: 23331 - DNA, 106 bp, Homo sapiens
tgagaagcactagtctagagttttagtttagctttgatttataaaaataaaaattagttatttttatataaaaatagttaaattgttatattgacatagtttatca

SEQ ID NO: 23332 - DNA, 58 bp, Homo sapiens
tgacactgagtctcactctgttgctcaggttggagtgcagtggtgggatctcagctca

SEQ ID NO: 23333 - DNA, 121 bp, Homo sapiens
agcgctgctgctatggctgctgtcacttctgccatgaccccaggaagtttctagaagtgagtgtggtcactgctcatgctctgcctgtgtactgtttaatattaccatgctctggcctaga

SEQ ID NO: 23334 - DNA, 91 bp, Homo sapiens
catctgagttatcaagagatggatttaaattgttattgttatttattttcctgtaacaggtgcttttttatttttatctttttttgagatg

SEQ ID NO: 23335 - DNA, 95 bp, Homo sapiens; identical to SEQ ID NO: 580

SEQ ID NO: 23336 - DNA, 93 bp, Homo sapiens; identical to SEQ ID NO: 69

SEQ ID NO: 23337 - DNA, 97 bp, Homo sapiens
tcacctggcagccactcccagagcccctggaactctggcccaaggctctctgactgactccttcccagatcttcttggcttagtggctgaagactga

SEQ ID NO: 23338 - DNA, 112 bp, Homo sapiens
ttggccccatgactgtttatttactatgtggttgaagtttctttgtttttgattactctaaccccctcctcccagaagtttcaatgaagttaatgagatatggcatggctaa

SEQ ID NO: 23339 - DNA, 119 bp, Homo sapiens
cacagctgtcttaagtctgtgtctttccagaatgactgcacttccattataattatttatttatttattttaattgagatggagtcttgctttgtggcccagactggagtgcgaaggtg

SEQ ID NO: 23340 - DNA, 93 bp, Homo sapiens
attgtcaaggtagtgtctggctacgatagaagggatttttgacatggcctattgttttatctttttaaagtaaatgtaggtgcttttgatgat

SEQ ID NO: 23341 - DNA, 77 bp, Homo sapiens
agcttaagacatggctggatacagatgctcagacaatcacatcaggagcctgcctccctccgtgtctgggctctctg

SEQ ID NO: 23342 - DNA, 116 bp, Homo sapiens
tgtctttataagtatacaaatatatctttaaatatactagtatatatttatagatacaaatgtataaatatatctatagatgtactagtatatatatttatagactagaaaaggca

SEQ ID NO: 23343 - DNA, 113 bp, Homo sapiens
gtagtaatacaatcttgggtgaattctataatcctctgtggactagtttttttttttttaatcaaaatgaggataataatagtatgtagctcatcagatggggtaaagattat

SEQ ID NO: 23344 - DNA, 121 bp, Homo sapiens
gatgtggtgatgtgcatctgtggtcccagctattcaggaggctgaggtggaaggatggcttgagactgggaggttgaggctgcagtgagccatgattgttccactacacgccagcctggat

SEQ ID NO: 23345 - DNA, 112 bp, Homo sapiens
ttgttttaaagcttcccaggtgatctgaatgtgcaactaggattgagtctcactgtatcactgtattaggggctcaataaatgttgactaaaggatgaggagtggagacagt

SEQ ID NO: 23346 - DNA, 76 bp, Homo sapiens
gtctctctatccttctctgttatttattctgattatttttaaatctaaatgagctgattccccaggatccagagac

SEQ ID NO: 23347 - DNA, 104 bp, Homo sapiens
ggactgattgttgtaggttgtgagtcagagttctatttttatatatggtctggtcattacctgtttgtatattcactctttcacccacctcaaaggtagtgttc

SEQ ID NO: 23348 - DNA, 76 bp, Homo sapiens
ccaggcctcgctcagtccctcactctgcctgatatccctggtttcgtggttgtctgaggtgggaaggagaaactgg

SEQ ID NO: 23349 - DNA, 59 bp, Homo sapiens
ttgtttaagatgcacagtctgtgacattctgtgatagcagactgagcagactaagacaa

SEQ ID NO: 23350 - DNA, 114 bp, Homo sapiens
ggcataaaaagtcctttctgacagtaattgttggccagtgtggttagctgcttgttgaggccactcttggcacaggagagcagtgccatgtcatcacagagggggaggaatgct

SEQ ID NO: 23351 - DNA, 86 bp, Homo sapiens
gctagtccccagtgccatgaccacactaagctctggctctgtgcccctcagggatgagagagagctctggcatgttactggactac

SEQ ID NO: 23352 - DNA, 117 bp, Homo sapiens
gacagtggtaatcagattgaattgtgaatactgaaaaaaggattttttttctaaaaaaaaagatacttttcaggaaaaaaatgtttattttcttatttctaattctttgacatagtt

SEQ ID NO: 23353 - DNA, 89 bp, Homo sapiens
gagccagtgtcctgggtgcagtggcacctgtgtgtagtcccaactatttgggaggctgaggtaggaggatcactcgagcccaggagttc

SEQ ID NO: 23354 - DNA, 111 bp, Homo sapiens
gccaggcatggtggtgcatacctgtagtcctagctactcgggaggctgaggtggaaggatggcttgagcccaggaggtcaaggctgcagtgagctatgatgatgccattgc

SEQ ID NO: 23355 - DNA, 117 bp, Homo sapiens
gattttgcgaaagctagatagatggtcacgtacttgatagatgcaaagaaagttggcttctaactttttttttttaactaatacgggatcagtagtcttgtctcatgaagtgaaatt

SEQ ID NO: 23356 - DNA, 95 bp, Homo sapiens; identical to SEQ ID NO: 68

SEQ ID NO: 23357 - DNA, 93 bp, Homo sapiens; identical to SEQ ID NO: 69

SEQ ID NO: 23358 - DNA, 74 bp, Homo sapiens
taacttccgctctctctcattgactcacgggcctttgaggagtccaggagtcattggaatctggcctgaggttg

SEQ ID NO: 23359 - DNA, 58 bp, Homo sapiens; identical to SEQ ID NO: 1391

SEQ ID NO: 23360 - DNA, 56 bp, Homo sapiens; identical to SEQ ID NO: 1392

SEQ ID NO: 23361 - DNA, 115 bp, Homo sapiens
caaagtgctgggtttataggcatgagccactgtgtctggtccaatatgcatatatatatttttaacctggattatcagagctatattgtgtttaggtttataaagctgtactatg

SEQ ID NO: 23362 - DNA, 114 bp, Homo sapiens
atatatatatgtgtatatatatgtgaatatatgtgtatatatatgtgaatatatatgtgtatatatatgtgaatatatatgtgtatatatatgtgaatatatatatgtatattt

SEQ ID NO: 23363 - DNA, 94 bp, Homo sapiens
ttggagcaccattgtcttgtcttagccaagtggattttattggtatgagataccaaaccagagaaaaagccacattataaagggacagctttag

SEQ ID NO: 23364 - DNA, 113 bp, Homo sapiens
accgacagtgtataagtgtcctcttttctccacagcctcttcagcatctattatttttttgactttttattaatagccattctgactggtgtgaagtggtatctcattgtggt

SEQ ID NO: 23365 - DNA, 75 bp, Homo sapiens
tatgtatatgtatatatttgtgcatgcatacatataaacgtgtgtatgtatttattaatctatatatcccacata

SEQ ID NO: 23366 - DNA, 116 bp, Homo sapiens
gaagcagataccagactccagatgtcttctgtgaggccagatagtaaagaagtttgcagaactacaaaacaatgctattcttctcacttatttaggtttggaaaatatagtgcttt

SEQ ID NO: 23367 - DNA, 91 bp, Homo sapiens
tacatatatacacatgtatatatatgtatagatgatatatacatatatatgtatgtctgtgtgtatatgtgtatatatgtatatgtgtgtg

SEQ ID NO: 23368 - DNA, 80 bp, Homo sapiens
tgagacagagtctcacactgtcacccaggctggagtgcggtggtgtgatctcgtttcactgcaacctctgcctcctgggt

SEQ ID NO: 23369 - DNA, 108 bp, Homo sapiens
gtaggaactgagttctgggtctgtcatagcagcatttcttcaaatgtttgttgaatgaagaaatagagcaaaatggggctagagaggcaagcaagaatgaagacttgc

SEQ ID NO: 23370 - DNA, 93 bp, Homo sapiens
tgtgaacttttcagtgttttgtgcatgctcaaagctagattagttcttgttttcagattttgtacaaatgaccccaggctgtattgttcaaca

SEQ ID NO: 23371 - DNA, 68 bp, Homo sapiens
tatatatacatatgtatatgtatgtatatatgtatgtgtatatatacatacatatatatgtatgtata

SEQ ID NO: 23372 - DNA, 155 bp, Homo sapiens
tatacatacatatatatgtatgtatatatacacatacatatatacatacatatacatatgtatatatatacatacatatacatatgtatatatatacatacatatacacatatatatacatacatatacatatgtatatatatacatacatatat

SEQ ID NO: 23373 - DNA, 89 bp, Homo sapiens
ctaaaacactaaggtaatgtggaatagaagtatctgtgaggtatgtatccaatacagattttgttgtattattatcctagtcttttcag

SEQ ID NO: 23374 - DNA, 114 bp, Homo sapiens
tgtctaaatgaattgtccattgttgaaaatggggtagtgaggtcctttactgttattgtattgcactttactcaccctttaaattacttaataactgctatatgaatttaggtg

SEQ ID NO: 23375 - DNA, 98 bp, Homo sapiens
tagtaaatgatagtttgaggcaatgacaaatttgcatatgaaattatttatcttagtaattcagataataaatgcatctgtctctgtctgtctctcta

SEQ ID NO: 23376 - DNA, 79 bp, Homo sapiens
gtgccaccgtgaccagccagtgttctatttgtttgttttcttatttttattttttagagacaggctgtcgctctgtcac

SEQ ID NO: 23377 - DNA, 86 bp, Homo sapiens
cctagagagttgaggtagatgaaatacatatatatatatatatatatatatatatatatatattcatcaactcagttattccagtg

SEQ ID NO: 23378 - DNA, 97 bp, Homo sapiens
aaatcttagtttggttggatatgaaattgttggttgaagacttttttctttaaaatgttgaatagagaccgccaatttcttctgacttgcagggttt

SEQ ID NO: 23379 - DNA, 74 bp, Homo sapiens
tctgtggcttattgataactggtttgtttttatttctataagagagtatggcaaatagtgcattaagtgacaga

SEQ ID NO: 23380 - DNA, 77 bp, Homo sapiens
gtgttgatattttgacaattacagcaaggggtcaatttgtttataaccccttctgcaatgtaaagaagtaattccac

SEQ ID NO: 23381 - DNA, 95 bp, Homo sapiens; identical to SEQ ID NO: 580

SEQ ID NO: 23382 - DNA, 93 bp, Homo sapiens; identical to SEQ ID NO: 69

SEQ ID NO: 23383 - DNA, 101 bp, Homo sapiens
actcaaagttcatccaaggaaaaggcagcacaacaaatcaatataatccagataaagttgttgtgggcaatgttagttcccaaaaggatgtatctgaaagt

SEQ ID NO: 23384 - DNA, 84 bp, Homo sapiens
gtaatgaattctagacattttcttgaagagagctataggagactttgatctatgttcttttcatgggagatgggagaagcctac

SEQ ID NO: 23385 - DNA, 109 bp, Homo sapiens
tactttggtttttccagtgagaaatactatatcagtgttactttaatatgtatttatcttaatctgagcatagttgaatgtatttccattggttaaagagtcatttgta

SEQ ID NO: 23386 - DNA, 122 bp, Homo sapiens
gtcagtgatttattagtgtactgttgttgctctagttttacagaatcttttattgttttaattgacaaagagaaattgtatgtatttatggcatacagtatgatgttttgatatttgtgtac

SEQ ID NO: 23387 - DNA, 73 bp, Homo sapiens
aggactgacatcagctgaaaccactatgttccactggagtttgtgcaaaatgagtttgttgatgtcacagcct

SEQ ID NO: 23388 - DNA, 71 bp, Homo sapiens
aggagttagactcgagagcacacaaattgcaagtcaaccactgtgatatgtgtgtggctcttctttttcct

SEQ ID NO: 23389 - DNA, 74 bp, Homo sapiens
tgtgtgtgtccgtgtgtgcatgcgtgcatgtgtgtgtgtgtgtgtgtgtgagtgactgatagggacaggaggca

SEQ ID NO: 23390 - DNA, 86 bp, Homo sapiens
atagatgtgctagagggagggaaagaagttcccagaagtgcagcaactggacagaggaaacttttttttaatgtttagtacactgt

SEQ ID NO: 23391 - DNA, 115 bp, Homo sapiens
acttaatgtttgttgtggctataggtgccagatgcttcaagttctgtagtgtgtttgttcttgtcaacatttttgtctttgggcttccctttgtacctctcctcataaacagagt

SEQ ID NO: 23392 - DNA, 96 bp, Homo sapiens
atggggctgcaacctcttcttggtcctgtgtgagctcagagacacgcactgtctattgtcttctgtttctctcagtcccactgaggttttctccat

SEQ ID NO: 23393 - DNA, 119 bp, Homo sapiens
cagcctttatgactgaaagattgaacactgatttgtaagatgccacctatgtgtctctcagtgggtgcctacaacagcttactttgtgtttcagagttatatctttttcagattaactg

SEQ ID NO: 23394 - DNA, 117 bp, Homo sapiens
gggcttgagttcttgaattgattctcagatttgtcattgttggtgtatagcagtgctactagtttgtttacattgattccatatcctgaaacgttactgaattcatttttcagatcc

SEQ ID NO: 23395 - DNA, 85 bp, Homo sapiens
aggctataccaaagtatctgacagaaaatccactgactgtcagagacagtgggctttttgttttgtttcttttttaaacatgcct

SEQ ID NO: 23396 - DNA, 112 bp, Homo sapiens
gagttctcagtctgttagttcacatgagaactggttgtttaaaggagactggcataccctcctctctctttctctctcttgctctttctctatgtgacccacctgctcactc

SEQ ID NO: 23397 - DNA, 111 bp, Homo sapiens
cataggttcaatgttgtacagcagatatcagttatttattatttttatttgtgttttaaaatcagcaagtgacaaattatgtatatatatgatgtacaacatgatgttttg

SEQ ID NO: 23398 - DNA, 105 bp, Homo sapiens
gcttatatcccaagtcacttactgaggaaagatttacttgcttgtttactttttatagtgagaagtgaaagcaaagtcttacttaataaagaatggagtgttagt

SEQ ID NO: 23399 - DNA, 95 bp, Homo sapiens; identical to SEQ ID NO: 580

SEQ ID NO: 23400 - DNA, 93 bp, Homo sapiens; identical to SEQ ID NO: 69

SEQ ID NO: 23401 - DNA, 89 bp, Homo sapiens
gagctgaggaaagtatgtatgtatgtatgtatgtatgtatgtatgtatgtatgtatgtatgtattttagacaacatgcttctttggttt

SEQ ID NO: 23402 - DNA, 86 bp, Homo sapiens
cttgttagaagtgcatgaaagtaaatgtctgtatatgtctgtacatatatacatatatattgaaaccatatatgcacatggataag

SEQ ID NO: 23403 - DNA, 85 bp, Homo sapiens
gggcagctctgcctctctctctctggctctgcagggtacaggccccacagctgctttcacaggctgactttgagtgcctgctgct

SEQ ID NO: 23404 - DNA, 82 bp, Homo sapiens
tatataggagtatgtgtatgtgtatatgtatatatacatataggacatataaatacatatataaatacacatataacatata

SEQ ID NO: 23405 - DNA, 129 bp, Homo sapiens
tatatatatattcatatatgtgtatatatatgtatatacatatattctgaatatatatatacatatattctgaatatatagattcatatatatgtgtatatatgtgtgtgtgtgtgtatatatatatat

SEQ ID NO: 23406 - DNA, 113 bp, Homo sapiens
gctgggattacaggcgtgagccaccacacccagcctcttttttttttagttatttgacttataacacaactattgagaggtgacagtgtgctggcagcccttgcagcccttgc

SEQ ID NO: 23407 - DNA, 109 bp, Homo sapiens
gcaaagggtggggctctccccatttctgcacagagctgcaatgtttttgccaaagagatctagagagcaatgttgtttggggaaatggggacagactccatgctgaagc

SEQ ID NO: 23408 - DNA, 102 bp, Homo sapiens
tttggatgcatcacaaatgatgctatatatgtgtgtgtgtatatatatatatacacacacacatatatatataagctccaaccatcaaacatgcattccaaa

SEQ ID NO: 23409 - DNA, 108 bp, Homo sapiens
tttggataattcattattagtgtatagaaatgaaactgattattatatattaatctcattatacaataatcagtttcatatctatacactaataatgaattacctaaa

SEQ ID NO: 23410 - DNA, 95 bp, Homo sapiens; identical to SEQ ID NO: 68

SEQ ID NO: 23411 - DNA, 93 bp, Homo sapiens; identical to SEQ ID NO: 69

SEQ ID NO: 23412 - DNA, 95 bp, Homo sapiens; identical to SEQ ID NO: 68

SEQ ID NO: 23413 - DNA, 93 bp, Homo sapiens; identical to SEQ ID NO: 69

SEQ ID NO: 23414 - DNA, 107 bp, Homo sapiens
aatgactatactgtttttcacagttgctgtatgattttatattacatatatatatgtatcccagaaaataaaagtcactggagcgttggtgtggctatgtagtaatt

SEQ ID NO: 23415 - DNA, 106 bp, Homo sapiens
tatatattggtatatatgtctgaaaacatatatataaacaccatatatatagacaaactctctctatatatatatatgttttcagaccgttatgtgaaaagtggtg

SEQ ID NO: 23416 - DNA, 85 bp, Homo sapiens
gtatgaagtagtgttttatatacatatatatatgtatatgcatttatatacatatatatatgtatatgcatttatatacatttca

SEQ ID NO: 23417 - DNA, 95 bp, Homo sapiens
tatgtaagcatggtacactcattgcaattactgaaatgatattgatttttatattattattgctatcattatgtaaatgccgtgctttattcgta

SEQ ID NO: 23418 - DNA, 111 bp, Homo sapiens
gactttggtaaacaatccataggcccttgaaagcatttgaattctgtagaaattgaatatatatttttatagtgtcagctagttcaagtttcccaattgtgttatcagatc

SEQ ID NO: 23419 - DNA, 93 bp, Homo sapiens
cagtggtgttgttcctctctctgtgtctgtgtgttctcatcatttaactcccacttataagtgagacatgcagtatttggttttctattgctg

SEQ ID NO: 23420 - DNA, 86 bp, Homo sapiens
cttcccattgatgggtcaagaagaaaaatctttgcttttgatatattcaattgcatcaatttttagttttgatttttagtgtcagg

SEQ ID NO: 23421 - DNA, 77 bp, Homo sapiens
gtaggtgtatagttgtaatagtcatgatagtctctaatgactatttgtatttctgtggtattatacataatgtctgc

SEQ ID NO: 23422 - DNA, 113 bp, Homo sapiens
aatatatgcatttcagaaatagttgacttttaaacaagttttatcatatatatttgttaaatatgaattttaaaagcaatctggattatatttctgattattgaaaatatgtt

SEQ ID NO: 23423 - DNA, 153 bp, Homo sapiens
atatatatatatgtgtgtgtgtatatatatatgtgtgtatatatgtgtgtgtatatatatgtgtgtatatatttgtgtatatatgtgtatatatgtgtgtatatatgtgtatatatgtgcgtatatatgtatatatgtatgtatatatgtgtg

SEQ ID NO: 23424 - DNA, 70 bp, Homo sapiens
aaagctgaaagtgggtgttaaagtctccagctactactctattgaggtctgtctctctcacttcagcttt

SEQ ID NO: 23425 - DNA, 113 bp, Homo sapiens
tagaatcaccttggctattcaggctttttatttgttccatatgaattttagaatttttttctaattccatgagaaatgtcattgatagtttggtaggattagcactgaatctg

SEQ ID NO: 23426 - DNA, 84 bp, Homo sapiens
tatattgcttgtatttttatgtatgcatacatgtatgtatgtatatacatgtatatgtgtgtatatataatagtgaagtatata

SEQ ID NO: 23427 - DNA, 69 bp, Homo sapiens
tttactatatgtatgtatgtgtgtgtatatatatatatatacatgtatatataaatgatataaagtaaa

SEQ ID NO: 23428 - DNA, 77 bp, Homo sapiens
cagagagtgttgtgtgtgtgcaggtcacttcagtgaaaatgcagaagtgtcctggccacagacacagctttttcctg

SEQ ID NO: 23429 - DNA, 102 bp, Homo sapiens
ttatattctttttcctctccttatgctcttcactgctatgtttatatttatataacaggtgcaaactgagcatataatggagtgaaaaatgcagtaatatgg

SEQ ID NO: 23430 - DNA, 103 bp, Homo sapiens
tgacatctaatagagactttcttgatgagattggaatgacgttttaaaaaaatatattattttgatttagtataatcaaataagtcaatatttggaagatgca

SEQ ID NO: 23431 - DNA, 101 bp, Homo sapiens
agagaagatgagcttcattgagactggctatatatatatatatatccactggttagacatgccagaagatattatggttctgttcggtggttcagatctct

SEQ ID NO: 23432 - DNA, 111 bp, Homo sapiens
tatatatgttacactacatatatacgcatgcatatgtctatataggtatgtgtgtgttacatctatatacttatacctatacatctatgtgtatactatggtacatatata

SEQ ID NO: 23433 - DNA, 94 bp, Homo sapiens
gagttggacagcaacctgagagatcactgggtgcagagtttgccttcaggcaactgaatagctgatgatacaggatccagaaatgtcacaactc

SEQ ID NO: 23434 - DNA, 110 bp, Homo sapiens
gcatagtgagttctctacaaaatccaactgtttgctcaagatttattttatataactgtagagattaaaatctgagtgtaaaagcagactttatgtggttccaaagatgt

SEQ ID NO: 23435 - DNA, 116 bp, Homo sapiens
caaagtgctaggattacaggtgtgaactgccatgcctggccaaaaatgtattttttcttaaaaataccaaggttttggctggcgcagtggctcacgcctgtaatcccagcactttg

SEQ ID NO: 23436 - DNA, 115 bp, Homo sapiens
ggaagtaaataactgttgtgtatcatcgtaataaaaccattgaataattgctgaaataatctgattttgtttaagagttgggtgattgatgagttggcagttatttttgtctttc

SEQ ID NO: 23437 - DNA, 114 bp, Homo sapiens
tatatatgtgtgtatgtgtatatatatgtgtgtatgtgtctatatatgtgtgtgtgcgtatatatatatatatatatatatatatataaataatcatacctacggtagaagagc

SEQ ID NO: 23438 - DNA, 93 bp, Homo sapiens
tgtaaatgtatatttacatttacatacatacacatttacattttgtatatttatgtgtatgtatgtatatgtaatatttatatgtatatttat

SEQ ID NO: 23439 - DNA, 91 bp, Homo sapiens
tctgtagtctgagagtagtgcctttgtttttacagctgtactaggcactgcccaagtacaggctctctcagtggctctacctcatgacaga

SEQ ID NO: 23440 - DNA, 58 bp, Homo sapiens
tgagaccgagtctcgctctgtcacccaggctggagtgcagtggcgtgatctcggctca

SEQ ID NO: 23441 - DNA, 101 bp, Homo sapiens
taaaaataaatataaatatatgtctaaatataaatatgtgtgtgtatatatatatatatatatatatctgcatttcttgacttggttaaggtttgttttta

SEQ ID NO: 23442 - DNA, 84 bp, Homo sapiens
ggagattcttctctgaagaatctgtccagcttaagagagaagactaaagattctgttgtgaagattgtattgtgaaggatttct

SEQ ID NO: 23443 - DNA, 82 bp, Homo sapiens
gtgctcattgctatagcacacatctataggatggtatgggtatgaccctgcacctttgtgtcagaacagtgtgagtcagtac

SEQ ID NO: 23444 - DNA, 102 bp, Homo sapiens
ggtggggtatttcaggcattattctatttgggtcaaaagtggaaaattcaatttctttgattttgtatctctttggtcttattgctaaaactcttgctccct

SEQ ID NO: 23445 - DNA, 107 bp, Homo sapiens
ttgaaaagttccaaaatgtggtagctgttaattcaaagtttattttaacttaaaaatttgacctttgttttaaatataattcatctccaattttggaacttccttga

SEQ ID NO: 23446 - DNA, 78 bp, Homo sapiens
attcaggataagtattcttcatgaaacatttgtacagcatcatgtgtgggtgagtgtctgtgtgtctatgtcctggat

SEQ ID NO: 23447 - DNA, 70 bp, Homo sapiens
gtgtatctatatatctagatataggtatatctatatctatctatatctatatctatctatatacttatat

SEQ ID NO: 23448 - DNA, 89 bp, Homo sapiens
gtgtataatatatatgtgtatatacataatgtgtatatatatacataatgtgtacatatatacacattatatatatgtatattatatat

SEQ ID NO: 23449 - DNA, 85 bp, Homo sapiens
ttttctttgagatggagtctcactgtcactcaggctggagtgcagtggcacgatctcggctcactgaaagctcagcctcctgggt

SEQ ID NO: 23450 - DNA, 107 bp, Homo sapiens
tatagatagatatatagacgacagatataggtgtgtgtgtacacatttatacatgtatatatgtgtatatatacatatatgtatgtgtgtgtgtatgtacataggta

SEQ ID NO: 23451 - DNA, 72 bp, Homo sapiens
tttatataaatatatattataaaatatatttatatacatttgtatatgaatatatttgtaaatttgtataaa

SEQ ID NO: 23452 - DNA, 105 bp, Homo sapiens
tcttaagagtcactgcaagacatttatataaacattacatatatatatatatatatatatatatatatatatatatatatatgagatgcttgaagaactctaaga

SEQ ID NO: 23453 - DNA, 75 bp, Homo sapiens
atatatggaagataaattctgctaactataaaagttcatatttttttaagttatcagaagttttgttctatatat

SEQ ID NO: 23454 - DNA, 86 bp, Homo sapiens
gttctcttttatctgagatctaggtgacagcggtcatcattttccatctgctgaacatcctgatttctgaaaaataactcaagaac

SEQ ID NO: 23455 - DNA, 105 bp, Homo sapiens
tcttaggacaccaaacaaacagagcaggtggactggctgtcttctgcccttgaagtcatacactagtcaatatcttcagcttagtttgcatttgtggcaataaga

SEQ ID NO: 23456 - DNA, 56 bp, Homo sapiens
gcttgtatgtgtgtgtatatatacatatatatatatatctccatatgcatgtgagc

SEQ ID NO: 23457 - DNA, 115 bp, Homo sapiens
ttatatccattttaagcccatatagtttacccgtaagtgacagaacagtgtcagcaaatctgcattttatcttcactgtttctaaataaaaatgaacttaaatggaaacctatga

SEQ ID NO: 23458 - DNA, 115 bp, Homo sapiens
agagtatcaggaacagcctgagccaccgcactcatgtttaagtggtctgtttttttttttcaaagtaaaaagagcacttatatagtatgttttacaagttctttctgttcattct

SEQ ID NO: 23459 - DNA, 85 bp, Homo sapiens
cttgcctcagcctctcaaagtgtcaggattacaggcataagccaccatgcctggctaattgttttattttttaagttggggaaag

SEQ ID NO: 23460 - DNA, 95 bp, Homo sapiens; identical to SEQ ID NO: 68

SEQ ID NO: 23461 - DNA, 93 bp, Homo sapiens; identical to SEQ ID NO: 69

SEQ ID NO: 23462 - DNA, 95 bp, Homo sapiens; identical to SEQ ID NO: 580

SEQ ID NO: 23463 - DNA, 93 bp, Homo sapiens; identical to SEQ ID NO: 69

SEQ ID NO: 23464 - DNA, 84 bp, Homo sapiens
ggaacaatgaaaggaagagtgagagaaaacagtgtggtgaattcaccaacatctggtctaagtgtgctgttttagaagttgtcc

SEQ ID NO: 23465 - DNA, 110 bp, Homo sapiens
taatatcatctttttaaggaagacaagagagtccttgaacttttattttttaatgaggaaatatttataagggcattgtgttgtcgggggcagaggaaaggagttggtta

SEQ ID NO: 23466 - DNA, 71 bp, Homo sapiens
tctctccaaagtccagagtgcctactttgtgtcagcagacacagtggtgggtgctgggaatacaacagtga

SEQ ID NO: 23467 - DNA, 99 bp, Homo sapiens
gttgttctacttgcatgacagaaattgatcatcttgtaactttttttttagaaaagttatccttagtattatattgtggttatgcacctgggagtgggc

SEQ ID NO: 23468 - DNA, 73 bp, Homo sapiens
tccacttctttttttctttgactctctggatatataaaaattctaagggaagagagtgagctgaaggggtggg

SEQ ID NO: 23469 - DNA, 104 bp, Homo sapiens
agaaaagctactagataaattagtttagtttttacataattcatgtgatattttatctataattaattaagaaacaaaactaactgttatttctggctatttct

SEQ ID NO: 23470 - DNA, 95 bp, Homo sapiens
agtttgttgaatggtattcttgagtacaaagtacattttgggtattttaccaaaatgattttttaattttagaaatgttgctatgaaaacattct

SEQ ID NO: 23471 - DNA, 87 bp, Homo sapiens
gttattagagaaatggtggtaagtccaagtgtagttgccttttaattaatatggttatatatttgatttatctcagcttctggtttc

SEQ ID NO: 23472 - DNA, 108 bp, Homo sapiens
attttaataaagctgattttaatattctaatagttgaaactgtaggtacaagaagtcactttttgtaatacaatgttattaactgtaaatgtgtggttttgttgctgt

SEQ ID NO: 23473 - DNA, 116 bp, Homo sapiens
gtgaaagaacaaatagaataaaatgttaattgtagaatctagtaggtgtatatatatgtgtgtatatatatatatgcttactacaaacttctttaaacttttctatatgtttaaac

SEQ ID NO: 23474 - DNA, 86 bp, Homo sapiens
aagtagaagagtacagattttgaatatgtcatagaacagattctgggtgatgttcatggcatagctggaaatataggtctatactt

SEQ ID NO: 23475 - DNA, 113 bp, Homo sapiens
tggattggtaatgtgttctaaataattattttagatgatagtactttggatatgtaaggaaaagtgttctaaattattataggcttcatttaggataacattgcaaacattca

SEQ ID NO: 23476 - DNA, 118 bp, Homo sapiens
tatatattcaaggaatatatatatgtttatatattcaaggaatatatatatatgcttatatattcaaggaatatatatatatgcttatatattcaaggaatatatatatgcttatata

SEQ ID NO: 23477 - DNA, 107 bp, Homo sapiens
gaatacatatatgcttatatattcaaggaatatatatatgtttatatattcaaggaatatatatatgcttatatattcaaggaatatatatatatgcttatatattc

SEQ ID NO: 23478 - DNA, 80 bp, Homo sapiens
ttttatatatatatatattccttgctcttatataagtatatatacatatatatgagcaaggaatatgtatatataaaaga

SEQ ID NO: 23479 - DNA, 135 bp, Homo sapiens
atatacatattccttgctcatatatatgtatatatacttatataagagcaaggaatatatatatatataaaatgtatgtgtgtgtgtgtacatacatatatatatacacacacacacatatatatatatgtatgt

SEQ ID NO: 23480 - DNA, 70 bp, Homo sapiens
gtgtgtgtgtgtacatacatatatatatatgtgtgtgtgtgtatatatatatgtatgtacacacacacac

SEQ ID NO: 23481 - DNA, 82 bp, Homo sapiens
gtatatatatatacatatatatgtatacatatctacatgtatatgtagatatatgtatgtatgtatatatgtatatgtatat

SEQ ID NO: 23482 - DNA, 110 bp, Homo sapiens
ctacaactcgtccattttactgtgaaaacatctcttttatatatatatgtataggtatatatgcatatgcgtgtgtgtgtgtatatgtggatggatggatggatggatag

SEQ ID NO: 23483 - DNA, 81 bp, Homo sapiens
gctgtctttgttcttagtggctcctaggaaattagagtgtcaagtcatgatattgccttgagagaggtgagagaagacagc

SEQ ID NO: 23484 - DNA, 99 bp, Homo sapiens
gttgtcttggctatacgagctcttttggttccatatgaaatttaaagtagttttttctaattctgtgaagaaagtcaatggtagcttgatggagatagc

SEQ ID NO: 23485 - DNA, 76 bp, Homo sapiens
attgcagacagaagagtctgtgcccattgactattataaagggtggaaagaatgtaaggctgcttctaactgtagt

SEQ ID NO: 23486 - DNA, 82 bp, Homo sapiens
tgtgatgctctcaatctctgtctgaggggttgtgaaagtgtggccaccatactacacccctcatgactggattccagccaca

SEQ ID NO: 23487 - DNA, 111 bp, Homo sapiens
tatatctgtatatatatctacatgtatctgtatatatctgtaaatatctatatatatctatatagatctacatagatatatatagatctatctagatagatagatatagat

SEQ ID NO: 23488 - DNA, 109 bp, Homo sapiens
tgcttttatgaattgcctctagatgactttcattataaaccttaacaccaaaaattccatctttatttcatagttttatgaatatatctagaggcctatttgaggagta

SEQ ID NO: 23489 - DNA, 100 bp, Homo sapiens
actgctagcgtgtggtagagttgagatttgtccatgtataaactctatcagagtatatatttttaaaatttactaccctgttcccaacatttaaagcagt

SEQ ID NO: 23490 - DNA, 118 bp, Homo sapiens
tttaatgtctttgtgttcattcctctttgttatttatggaagacaggtagatgtcagactttgttgttctcacttatttccatgacagaaaagatggaataaactaatttatattgga

SEQ ID NO: 23491 - DNA, 111 bp, Homo sapiens
aggttttggatttcttcctgattcaatcttggtaggttgtatatgtctaggaatttatttatttcttctagattttccaacttatttgcatggagttgttcatagtagcct

SEQ ID NO: 23492 - DNA, 72 bp, Homo sapiens
acagccctagaaactcttctctgaggttggccaaagtagacaccaaatcagagtagctgttcagcaggctgt

SEQ ID NO: 23493 - DNA, 68 bp, Homo sapiens
ttatataaacttctgtgtgtgtgtgtgtatatatagagtctatatatatatatactatacttatataa

SEQ ID NO: 23494 - DNA, 95 bp, Homo sapiens; identical to SEQ ID NO: 68

SEQ ID NO: 23495 - DNA, 93 bp, Homo sapiens; identical to SEQ ID NO: 69

SEQ ID NO: 23496 - DNA, 96 bp, Homo sapiens
tgctgctggttttcctcagctgtcttattattcttggttgtttgtttatatttatatttgaaggactgcttgctcaatataggtagctggcatgca

SEQ ID NO: 23497 - DNA, 92 bp, Homo sapiens
cacacacacacacacacacacacacacacacacacacacacacacgtgatgatacatataaaatatgtgtgcatgcgtgtgtgtgtgtgtgt

SEQ ID NO: 23498 - DNA, 123 bp, Homo sapiens
ccaggcatgatggtgcatgcctatagtcccagctactcgggaggctgaggtaggaggatcacttgagcctgggaggtggaggttgcagtgagccgagatcacgccacagcactccagcctggg

SEQ ID NO: 23499 - DNA, 71 bp, Homo sapiens
gacttaagctctgtgtttgagctgagacattggtcttttcctgtcttcagactcagacacagactgaagtt

SEQ ID NO: 23500 - DNA, 67 bp, Homo sapiens
agactcaatgatacaggactgaggattaggtgggctgatggcataacttcagtctgtgtctgagtct

SEQ ID NO: 23501 - DNA, 99 bp, Homo sapiens
ggcttcactcacttgattgaagtttcttggtagtaaattttgaaattcagaagtttgagacctcaaactttattcttttttgtcaagattgtttcagct

SEQ ID NO: 23502 - DNA, 95 bp, Homo sapiens; identical to SEQ ID NO: 580

SEQ ID NO: 23503 - DNA, 93 bp, Homo sapiens; identical to SEQ ID NO: 69

SEQ ID NO: 23504 - DNA, 113 bp, Homo sapiens
tcttgagattatttacatcttttgcatctttataaatggaaatactatgtaataatgtgctacttcacaccatggtaccataatgtgtaatggtggtgtacttgattcccaga

SEQ ID NO: 23505 - DNA, 112 bp, Homo sapiens
cagtattactttggcaatttgggatcttttatggttatgaaagattgtttttctatttctgtgaaaaatgtcattggtattatgatagggattccattgactttgtagattg

SEQ ID NO: 23506 - DNA, 103 bp, Homo sapiens
gaatacacatattcatatatatatctcaagggaatagatatatattttatttatatatatcatgtatatctcttaatatatatacatatgtgcacatatattc

SEQ ID NO: 23507 - DNA, 119 bp, Homo sapiens
ccttcttagttaatgattacagtatatgagagataagtatgtgtgtataattttattcttaataagaaaggttggccgggtgcagtggctcacacttgtaatcccagcactttgggagg

SEQ ID NO: 23508 - DNA, 74 bp, Homo sapiens
ggcaggtgacttttttcagagaggcagtgtggtcggaaggagcttttggattttaaagaagaaacaactctgcc

SEQ ID NO: 23509 - DNA, 79 bp, Homo sapiens
gtatatatgcatgtatctatgcatgtatgtgtatatatatatatatatacatatacatacaaatacaaagtatttatac

SEQ ID NO: 23510 - DNA, 118 bp, Homo sapiens
ccatgtggccaaatggaggtcagaaaatagagactgtggtattaattgactgtgttcaaatatttacttttataaattttacaaactctgccaatgcttctcatgaaatggcctgtgg

SEQ ID NO: 23511 - DNA, 105 bp, Homo sapiens
gtggttgcataacgagggtgggtatttttcaggaagagaacacacatttaatttgacattttcttgttgaacttgaggcagccagcttccctggttttgttccat

SEQ ID NO: 23512 - DNA, 159 bp, Homo sapiens
catatatatatatatatatacacacacacacatatatgtatatgtgtatatacacatatgtgtatatgtatatgtgtatatacacatatgtgtatatgtatatgtgtatatacacatatgtgtatatatacatgtgtatatacacacatgtgtatatac

SEQ ID NO: 23513 - DNA, 106 bp, Homo sapiens
aagtcagtggcatattcatctttcattcctacaggctacacattttgttcatgttatttcttgaataaatgagtaaacttaaatgtgaggtgttatcaccaggctt

SEQ ID NO: 23514 - DNA, 110 bp, Homo sapiens
atatatgtatatgtgtatatatacgtatatgtgtatatatacatatatatgtgtatatacacatatatatgtatatatgcatatacacacatatacacatatatgtatat

SEQ ID NO: 23515 - DNA, 88 bp, Homo sapiens
cgggctcttttttggttccatatgaaatttaaagtagttttttctaattctttgaagaacgtcagtggtagcttggggaatagcactg

SEQ ID NO: 23516 - DNA, 91 bp, Homo sapiens
atgagtgactttattgctttactatatattgtttagaagaatgtatacattctactcctctggacagggagagaacaatgctgtgactcat

SEQ ID NO: 23517 - DNA, 74 bp, Homo sapiens
atatatatgtatatatacacacagatatatgtgtatatatacacatttatgtgtgtgtgtgtgtgtgtgtgtat

SEQ ID NO: 23518 - DNA, 90 bp, Homo sapiens
gggttgtagttgttctaaaaaatatcagtcctataaatttcaatttaatagaagaaattgggactgctatttatttttacctctttatcc

SEQ ID NO: 23519 - DNA, 86 bp, Homo sapiens
catgcatctgtgtaaatttgtgtatgtacatatctctatacatatatacacagatatgtacaaatttaaatttatatacatttatg

SEQ ID NO: 23520 - DNA, 157 bp, Homo sapiens
atatatatgtgtgtgtgtatgtgtgtgtatatatatgtgtatatgtatatgtatgcatatgtgtatatgtatgcatatatgtgtatatatatgtgtatatatgtgtatatgtatgcatatatgtgtatatatatgtatatataacacacatatgaac

SEQ ID NO: 23521 - DNA, 79 bp, Homo sapiens
atatatatatatatatcagatatatcatatatatatcactatatatatagggtgtgtgtgtgtttgtgtgtgtgtgtgt

SEQ ID NO: 23522 - DNA, 95 bp, Homo sapiens; identical to SEQ ID NO: 580

SEQ ID NO: 23523 - DNA, 93 bp, Homo sapiens; identical to SEQ ID NO: 69

SEQ ID NO: 23524 - DNA, 117 bp, Homo sapiens
gactagcttagagtctgcctgtctttctgccagaaccacttttatttttattttcctaacttttattttaagttcaggggtatatgagcaggtttgttacagaggtaaacttgtgtc

SEQ ID NO: 23525 - DNA, 114 bp, Homo sapiens
ctgaagccagctgataactggggtcctgcccacagcatgctgtaaccactctctgtcactgcctatgtttgctgaaggccctggggctctataatcagcaggtggcgaaaccag

SEQ ID NO: 23526 - DNA, 81 bp, Homo sapiens
ggatgcatttatatatacaagcatatatatatatatatgcttgtgtgtgtgtgtgtcgtatatgtgtgtgtgtgtgcattc

SEQ ID NO: 23527 - DNA, 101 bp, Homo sapiens
tgttacagctagtctttcattctgtggcttatcaatttattttcttaaaaatgtcttttgaagaatggattgtcttaagtttgatgaggactagtttatca

SEQ ID NO: 23528 - DNA, 58 bp, Homo sapiens
tgagacggagtctcgctctgtctcccaggctggagtgcagtggcgggatcttggctca

SEQ ID NO: 23529 - DNA, 68 bp, Homo sapiens
gtatatatatatatatatacacatatataagtagctacatatgtatgtgtatgagtgtgtgtatatat

SEQ ID NO: 23530 - DNA, 116 bp, Homo sapiens
tatggctgcgtagtattccattatgtgtgtatgtgtgtatagtgatatatatacatatatgtgtatatatatgtggatatatatacatatatacctatgaacacactatatcacta

SEQ ID NO: 23531 - DNA, 67 bp, Homo sapiens
tggatctccatgtctgtgtttcttgtcttcttatagggaacactagtcattttgtattaagggtcca

SEQ ID NO: 23532 - DNA, 104 bp, Homo sapiens
gctaatgagcaacaacacattggaaagataatatattgcaatttaatatgaataagccatgttttatatatattaacatctgtttccaaatgttgtctattggc

SEQ ID NO: 23533 - DNA, 104 bp, Homo sapiens
ggtcacacatctgcttgctaaggaagaacaattcagtctccacatttgggtaacaagtgttgtctgctcattgatttttcttttcgttagtcaatataggggcc

SEQ ID NO: 23534 - DNA, 115 bp, Homo sapiens
ctattcaaggactctgctcctgtgaatatcatgtctctgtcgaacctgctgcacacacacacacactcacagaaagagagagaaagagagggagagagagagaatcctgtaatag

SEQ ID NO: 23535 - DNA, 116 bp, Homo sapiens
tttaaaattgttccaacctgattctctatttataatagtgtgtgtgtttagatcgctatttgaaatttttatattatttaaaatagatttatgagtctgcatccaagcattttaag

SEQ ID NO: 23536 - DNA, 84 bp, Homo sapiens
tatacatgtatgtgtgtgtggggtgttatatgtatatatgtgtatatatgtacatgtgtctctctgtgtatatatacatatata

SEQ ID NO: 23537 - DNA, 134 bp, Homo sapiens
atatgatatgtgtgtgtgtgtatgtgagagagagagagacagagagagagagagagtttaagaggtatcatctcactctgacactcaggcagtggcatgatcatatctcacagcagcctcagcctcctgggctc

SEQ ID NO: 23538 - DNA, 79 bp, Homo sapiens
tctcctaaagtgactaatttgaaaggctatggtgagcaattaaaattgcatttttgtttttcaaatctgtaacttgaga

SEQ ID NO: 23539 - DNA, 58 bp, Homo sapiens; identical to SEQ ID NO: 315

SEQ ID NO: 23540 - DNA, 114 bp, Homo sapiens
actcaatagtgcttttgtacacatgtgtatatatatatatatcacatataatttatgttatatattatatgttatgtatacacacacagtaatccttaaagcaactactaaagt

SEQ ID NO: 23541 - DNA, 57 bp, Homo sapiens
tgagacgagtctcgctctgtcacccaggctggagtgcagtggcgcaatctcggctca

SEQ ID NO: 23542 - DNA, 93 bp, Homo sapiens
tgtgtgtgtataaatgaagcatatctctctctatatatacatatatgtatgtatatatatgaagaaggatatatctttatagatagatagata

SEQ ID NO: 23543 - DNA, 73 bp, Homo sapiens
tataaagatatatccttcttcatatatatacatacatatatgtatatatagagagagatatgcttcatttata

SEQ ID NO: 23544 - DNA, 90 bp, Homo sapiens
atatgtgtgtgtgcgtgtgcctatgtgtgtatatatatatatatatacatatgtgcgtgtgtacatatatatatatatgtatatctcata

SEQ ID NO: 23545 - DNA, 95 bp, Homo sapiens
tttcaacatatctggctccatatatttgagttgttttccttataagcagtataaggatgaaactttctatgtattttttctatcaggtattgaga

SEQ ID NO: 23546 - DNA, 88 bp, Homo sapiens
ctgttgagttgtgtgagtgttttgtctattctggatgttggtcccttgttggatgaatagtttgcaaatattttctcacatttcatag

SEQ ID NO: 23547 - DNA, 114 bp, Homo sapiens
gtgtgtgtgtgtgtgtatatgcatataaatatatatatgcatataaatatatatatgtatatatgtatatgtatatgtatatatatttatatctgcatcaaatatatatattca

SEQ ID NO: 23548 - DNA, 86 bp, Homo sapiens
cccaaataatgggacagtgagaatgtttatattggaatgtatctttttattttccttaggtaaactctaatgtccatcttctaggg

SEQ ID NO: 23549 - DNA, 86 bp, Homo sapiens
ctgtcctgtagaagagttgagtgcagattccatagctttctgataatttttggctattaaaattaattcaccatcatttaggacag

SEQ ID NO: 23550 - DNA, 80 bp, Homo sapiens
actgctagagaattactggtgtgtcagtatttgactggcagctctgatgtggacacaaagtgtcgttttcttcctgtagt

SEQ ID NO: 23551 - DNA, 77 bp, Homo sapiens
gggggacagccgacagttacaggcctcacccggctcccatgcaatccaaaaggccagtctcactctcactgtgcctc

SEQ ID NO: 23552 - DNA, 109 bp, Homo sapiens
ggtctttaccacatacctatagtatagtatttattttaattgaatgtatgtattttcctatagatgatcagttaaatatatacatgctatatgtatgtatactggggct

SEQ ID NO: 23553 - DNA, 65 bp, Homo sapiens
accataataatgtgagccattctttatatcaaattgtatttattataaggaattggcttattggt

SEQ ID NO: 23554 - DNA, 158 bp, Homo sapiens
cttcagcccatggatcaagcagtattttgactttcaagtcttactatttaagaaatatattttattttactttatgtttttgagacagtctcactgtgatatccaggctggagtgcagtggcacaatctgggctcaccacaacctccacctcctgggt

SEQ ID NO: 23555 - DNA, 82 bp, Homo sapiens
ggtcagatctctttcactgtctcagttataattttgcaatggtggtttcaaggttatcattagggggagaatgagaaagact

SEQ ID NO: 23556 - DNA, 128 bp, Homo sapiens
agtctgtgatccttagaaaggtgattttatttcattatttttatttttttgagatggagtctcactctgtcacctaggctggagtgcagtggcatgatcttggcccactgcaacctctccctcccggt

SEQ ID NO: 23557 - DNA, 92 bp, Homo sapiens
atatatgtgtgtatatatgtgtgtgtatatatacgtatatacgtgtgtctatctatctatatatatatatgcctgtgtgtgcgtgcgtatat

SEQ ID NO: 23558 - DNA, 82 bp, Homo sapiens
gcaatactatggataaagagaagaatggattgaagggacaactaatactctgcctcacttctgtatctctagtagtgtttgc

SEQ ID NO: 23559 - DNA, 107 bp, Homo sapiens
gacttgactttgccttgctattggtatgagattgtacaaatgtgttttaatatttttctttaagctttatttgttttcttatcaggctatggtgtgtaaaggaagtt

SEQ ID NO: 23560 - DNA, 73 bp, Homo sapiens
cttaaagctatataggcatatatatataggtatgtatacataggtatatatgtatataagtatagacttaaag

SEQ ID NO: 23561 - DNA, 70 bp, Homo sapiens
tttttttgagatgtagtctcactctgtcactcaggttggagtgcagtagtgtgatcttggctcactgaaa

SEQ ID NO: 23562 - DNA, 104 bp, Homo sapiens
gttgaacacttgacatgtggatagtgtgactgaggagttgaattttttattctatttaattttaattagtatacattttaaaaccacatctgacgagtgccagc

SEQ ID NO: 23563 - DNA, 91 bp, Homo sapiens
acacacacacacactatatacatatatacatatatatatgtatatgtgtatatatataggtatatgtgtatatatatatgtatatgtgtat

SEQ ID NO: 23564 - DNA, 96 bp, Homo sapiens
tctttacttcatatatacatatatatgtatatatatacacatacatatatatgtgtgtatgtgtgtgcatatatatacaatatatatacattaaga

SEQ ID NO: 23565 - DNA, 116 bp, Homo sapiens
gatagtgtctatgttttctataatatttggtacaaatgtttcctctttcttttttttaaaatttaagttctggggtacatgtgcagaatgtgcaggtttgttacataagtatattc

SEQ ID NO: 23566 - DNA, 95 bp, Homo sapiens
cctctactgagaggaaattatttctgtatattaatgtatatggatattttctatacatttgtgtatattaataattttgaacatttttcaagagg

SEQ ID NO: 23567 - DNA, 114 bp, Homo sapiens
ggagagttggagttctgcaaagggaatggatgatttgagggctatgtggtctttttatattttcttaaatttcccctgttcatgcatagttaaagatttgggctatttatctct

SEQ ID NO: 23568 - DNA, 91 bp, Homo sapiens
ttagggcagccccacaggcagctgcagggacttgggtttttgagaaaacagagtggacatttgccttgtgggtctcagcagcacctaaccc

SEQ ID NO: 23569 - DNA, 113 bp, Homo sapiens
ttgattgtgtagttgcttgctagtgtcagtgggctatgtacttaagtgtgtttttctttttcacttaaaagacagtttttattaacaaaagtttttcagaatctacatttcaa

SEQ ID NO: 23570 - DNA, 99 bp, Homo sapiens
ggtttaatgctctgtggctgctgtcttaaaacttcaataattttatatttgattttgtgttttgcaagtgaagtctgataggacaacggagcatttgct

SEQ ID NO: 23571 - DNA, 117 bp, Homo sapiens
tgagatggtatcttcttgtggttttgatttgcatatatctgattattatggatgtggagatttttttcatatttttgttggctgcttgtgtatcttcttttaagaagtgtctattca

SEQ ID NO: 23572 - DNA, 109 bp, Homo sapiens
tattgtacagagtctgctctctggtggcagtgtctatatttagtgacagggatgacttagtcattttttttttttggtctggccccaagtagggtctagtagagcaatg

SEQ ID NO: 23573 - DNA, 78 bp, Homo sapiens
aagtggtatctcataaacgtttttatttgtattttccttttattaggaaaatacagtttatgttgagtgtattttctt

SEQ ID NO: 23574 - DNA, 62 bp, Homo sapiens
agtggaaaggtgagtcacagagaagggggtctctgcctctgtgactgttctctgtcttccct

SEQ ID NO: 23575 - DNA, 61 bp, Homo sapiens
ggagtctcactctctctgtgctgagccacctgagctaggggtagggtgccatgagcactcc

SEQ ID NO: 23576 - DNA, 95 bp, Homo sapiens; identical to SEQ ID NO: 580

SEQ ID NO: 23577 - DNA, 93 bp, Homo sapiens; identical to SEQ ID NO: 69

SEQ ID NO: 23578 - DNA, 100 bp, Homo sapiens
ggggaactccagaagccctagcagtgtcggtcttcattctagagaggaatgtaggcacctctgggatgggtgccagactgaggcaggggcaaagttcttc

SEQ ID NO: 23579 - DNA, 109 bp, Homo sapiens
aggaagctgaaagtatggattgaagttatatacgtttgtgagttatatatgtatatatgattcatgtatgtttcacctaaatagcattaataatattttgtattttctt

SEQ ID NO: 23580 - DNA, 66 bp, Homo sapiens
gtggccgcagctgtgtgggtgtctatgccagtgggcagacgtcgccctcacttcagttgctctcac

SEQ ID NO: 23581 - DNA, 70 bp, Homo sapiens
cagcagtgagtctctgtctgcctccccaactctactgggttctctgagctaggccagtgtatcgttgctg

SEQ ID NO: 23582 - DNA, 60 bp, Homo sapiens
gttccctgtctgtctctgtgaccggaacattgctccctgcatctggaggctgaggggaac

SEQ ID NO: 23583 - DNA, 66 bp, Homo sapiens
tgcttgaactcagggtgcagaggttgcagtgagctgagatcacacctctgcactccagactaggca

SEQ ID NO: 23584 - DNA, 76 bp, Homo sapiens
ctgtgatgacaagagccccctgcaaaacgtagacattaagtaggggtggggaagggtggctctctgtgtctctggg

SEQ ID NO: 23585 - DNA, 148 bp, Homo sapiens
cggtggttggtgtttggtgtcaaatggaaacaattttttttgtttttgagacagtctcactctgtcaccgagtctggagtgcagtgatgtgacactctgtcacccagtctggagtgcagtggtgtgaccatggctcactgtagccttg

SEQ ID NO: 23586 - DNA, 104 bp, Homo sapiens
tgaattccagaggaagtgttgagaaagctgcccagcccagggccaaatgtcagggaccctcacactgtcagccacatttccacctcttccctttcaggaactca

SEQ ID NO: 23587 - DNA, 88 bp, Homo sapiens
tgttatgcctgattgcaagttgtagagctgaaagtccagtggatgaagcctctgttttgccactcacacagtctgtaactatgacaat

SEQ ID NO: 23588 - DNA, 95 bp, Homo sapiens; identical to SEQ ID NO: 68

SEQ ID NO: 23589 - DNA, 93 bp, Homo sapiens; identical to SEQ ID NO: 69

SEQ ID NO: 23590 - DNA, 115 bp, Homo sapiens
tttgagagttatttggctgctttgggcttcaaggctggagaagcaggtaatggcacagtatctcactcactgttcttcctgccctggggttggcagcaccaccagaatgcccaga

SEQ ID NO: 23591 - DNA, 69 bp, Homo sapiens
ataatatatctttatatatgtatttatatattgtgtataaatacacaatatgtaaagatacaatattgt

SEQ ID NO: 23592 - DNA, 63 bp, Homo sapiens
gaagtgacctcagtgacattctctgtctaaggcaggtagcctcagagactgcatggttgtttc

SEQ ID NO: 23593 - DNA, 104 bp, Homo sapiens
gctcccgtcacccaaggctattgcgtgtctctgtgtctctggaagttaattaagactgccagggatgggctcacagagggataggaggcccagggctgggctgc

SEQ ID NO: 23594 - DNA, 119 bp, Homo sapiens
taagaagaccatcttttttcactttggggtagagagggcttatttatttatttatttatttatttttgagatggagtctcactttgtcacccaggctggagtgcagtggtgtgatcttg

SEQ ID NO: 23595 - DNA, 61 bp, Homo sapiens
gggatcctgctgagcacacagggaggcttcagtagaagtcactttgtgtctctgtgtcacc

SEQ ID NO: 23596 - DNA, 66 bp, Homo sapiens
ttgagacggagtctcactctgtcacctaggctggagtgcagagtgcagtggtgcgatctcggctca

SEQ ID NO: 23597 - DNA, 67 bp, Homo sapiens
cacaggctctgtcactgacagagagccacccagccctgggccaggcctcactcaggacactcctgtg

SEQ ID NO: 23598 - DNA, 67 bp, Homo sapiens
cacaggagtgtcctgagtgaggcctggcccagggctgggtggctctctgtcagtgacagagcctgtg

SEQ ID NO: 23599 - DNA, 77 bp, Homo sapiens
ggagagacttttcttgggaatgggtggataggatatagtcctttttttttttttttttggagacagagtcttgctct

SEQ ID NO: 23600 - DNA, 91 bp, Homo sapiens
gcagggcaacactaagtgaaaagggtgcttataaagggttgcattattattattattattttgagacacagtttcactctgtcacccaggc

SEQ ID NO: 23601 - DNA, 76 bp, Homo sapiens
ggccatcttccctctgtctgtctgtgttcaaattttcctcttcttataaggacaccagtcacatgggattagggcc

SEQ ID NO: 23602 - DNA, 60 bp, Homo sapiens
tctgtgaagctcaggtctgagggagacaagctgtctctctcagagcctttctacctaaga

SEQ ID NO: 23603 - DNA, 70 bp, Homo sapiens
cctggtccctgtgtccctcactggctaagcctctccttcagccctgtgagaggacagaagagtcagggct

SEQ ID NO: 23604 - DNA, 72 bp, Homo sapiens
ctgggtgtggtggtgcgcacctgtaatccgagctacttgaggggctgaggtaggaggatcacttgaacccag

SEQ ID NO: 23605 - DNA, 58 bp, Homo sapiens
tgagtcagagtctcactctgtcatccaggctggagtgcagtggtacgatctcgactca

SEQ ID NO: 23606 - DNA, 58 bp, Homo sapiens
tgagacagagtctcgctctgtcacccaggctggagtgcagtggcgcgatctgggctca

SEQ ID NO: 23607 - DNA, 66 bp, Homo sapiens; identical to SEQ ID NO: 474

SEQ ID NO: 23608 - DNA, 101 bp, Homo sapiens
ttctgtctttcccctttagccttatatagcatatcttatatatatatatgctatatagcatatcactgtatatgctatataagtattggccagattcagaa

SEQ ID NO: 23609 - DNA, 71 bp, Homo sapiens
ttattcattaaacacacttgtacatgtatgtatgtatgtatgtatgtatgcatgtgtgtctgtatggttaa

SEQ ID NO: 23610 - DNA, 69 bp, Homo sapiens
cagggtccaccacatccttcactggcacgcggaacgggctccctgtgaggagaaggacattagaccctg

SEQ ID NO: 23611 - DNA, 87 bp, Homo sapiens
cagcctgcatgcaagcctttgtctcaggctctgatttccaggaacccaggctaagacaatcgttttttatttgtttgtttgttgttg

SEQ ID NO: 23612 - DNA, 60 bp, Homo sapiens
gtggtcagtctctcattctctcaaacaggcctgttcagagaacaactgggaagcttccac

SEQ ID NO: 23613 - DNA, 67 bp, Homo sapiens
gccgaggtttggctgagaaagacctgggtttggcactcagtcattcactctcagtgagaccccgagt

SEQ ID NO: 23614 - DNA, 76 bp, Homo sapiens
tacattttcactatacatatatgtgtgtgtgtgtatacatacacacatatctatatgtatgtatgtatttttgaga

SEQ ID NO: 23615 - DNA, 79 bp, Homo sapiens
gccactttgtctaggtcttgctatatatatatatgtgtgtatatatatatacatatatatgctttttatgtaaggtagt

SEQ ID NO: 23616 - DNA, 58 bp, Homo sapiens; identical to SEQ ID NO: 1847

SEQ ID NO: 23617 - DNA, 58 bp, Homo sapiens; identical to SEQ ID NO: 2257

SEQ ID NO: 23618 - DNA, 107 bp, Homo sapiens
atgaaatatctatgtataaagtcttagttttgttaatgtgtttatatatgagtgaatatatatataattgcagcaaaatattaacagtggctatatgtaggtggcat

SEQ ID NO: 23619 - DNA, 58 bp, Homo sapiens
gcccaggctggaatgcagtggtgcaatcactgttcactgcaatcttgactccctgggc

SEQ ID NO: 23620 - DNA, 123 bp, Homo sapiens
cctctttaaatccatcaagagctcctctgttgctttcagattaatttccaaaaggtctttagcatgtcagtacagacggaggagagaagagttgaatttggaggttttagaacgtggatgatg

SEQ ID NO: 23621 - DNA, 402 bp, Homo sapiens
tatatatgtgtacatatgtatatatgtatatacatatatacgtatatatgtatatacatatatacgtatatatgtatatacatatataggtatatatgtatatacatatataggtatatatgtatatatgtatatacatatataggtatgtatatacatatataggtatatatgtatatatgtatatgtgtacatatttatatgtatgtatatgtgtatatatgtatgggtatatatacatatatgtatatgtgtatatatacatatatgtatatgtgtatatatacatatatgtatatgtgtgtatatatacatatatgtatatgtgtatatatacatatatgtatatgtgtgtatatatacatatatgtatatgtgtgtatatatacatgtatgtatatg

SEQ ID NO: 23622 - DNA, 95 bp, Homo sapiens; identical to SEQ ID NO: 68

SEQ ID NO: 23623 - DNA, 93 bp, Homo sapiens; identical to SEQ ID NO: 69

SEQ ID NO: 23624 - DNA, 67 bp, Homo sapiens
ggtttcatacatatatatatatatatatgtatatatatactttatatatatgtaaatgtgtatgtcc

SEQ ID NO: 23625 - DNA, 58 bp, Homo sapiens
tgagatggagtctcgctctgtcactcaggctggagtgcagtggcgggatctcagctca

SEQ ID NO: 23626 - DNA, 116 bp, Homo sapiens
cgcaccagtgccatctgcttggccgattttggcactagcacatttttgcttgtgtctctccgctctgagcaatcatgtgcagtgccaatatgggaaaagcaggacccgcagctgcg

SEQ ID NO: 23627 - DNA, 72 bp, Homo sapiens
gggctaatatgagaagatatgtgaatctgctgagcttagactttttatatattttctccacacatgagaccc

SEQ ID NO: 23628 - DNA, 108 bp, Homo sapiens
tagacgagaattgttttgagattgacaatgcaacaagagcagtgtttttgatgaacaagagcttgttttcttcattgtgatctatgcagtagcacttattttcttctg

SEQ ID NO: 23629 - DNA, 126 bp, Homo sapiens
atatatacacacgtatatatatacacgtgtatatgtatacatacgtgtatatatgtatgtatatatacgtgtgtatatatatgtatgtatatatacacatatatatacacacacttatatatatat

SEQ ID NO: 23630 - DNA, 115 bp, Homo sapiens
ttgcactccaccctgacggcaagactctgtctcaaaaaaaaaattgtgtctttattttattcatttatttatttttgagacaaagtctcactctgtcgctcaggctggagtgcag

SEQ ID NO: 23631 - DNA, 98 bp, Homo sapiens
ccagcctgggcagtatagcaacaccccatctctaatttttaaaattaaatttattattatttttttgagatggagtctcactctgtcgcccaggctgg

SEQ ID NO: 23632 - DNA, 60 bp, Homo sapiens
ggaagcctgtctgtcagtgtgccacttacctgcagagacccacactcagacagaccttcc

SEQ ID NO: 23633 - DNA, 114 bp, Homo sapiens
agtaggcaccagatggtggttaatgtattgagaacttttttgtgtcattattttttaatcaattgcattaaaaatttatagatacattaatatgtacagaaaatggctattagg

SEQ ID NO: 23634 - DNA, 58 bp, Homo sapiens; identical to SEQ ID NO: 47

SEQ ID NO: 23635 - DNA, 107 bp, Homo sapiens
gatggaagatatggagatgctagcctctcagagaactgtattacttgatttgaattaggaatttactaactactggggatactttagtgagttttcatatgtgtatt

SEQ ID NO: 23636 - DNA, 118 bp, Homo sapiens
tgggatacagacctgcccaccgattctgctgtaagcccctagattctttcattcatttatttatttactgttgattgactgacacagggtcttactctgtcacccaggctgtagtgca

SEQ ID NO: 23637 - DNA, 61 bp, Homo sapiens
gcctgaggcccagagtttttgttttgctttttttgagacagtctcactctgtcgcccaggc

SEQ ID NO: 23638 - DNA, 104 bp, Homo sapiens
tctgacaagtttccaagtaccaggccacctggatattctctatctgtcaggaaaagatagaggtcaaagaggtgggtgggagggtgggggaaatataaatcagg

SEQ ID NO: 23639 - DNA, 112 bp, Homo sapiens
aacagattgttaatagctattatcctatagttgtggaattagaattatgaggatttttttttcttttttcttttctctattttccaaatgtatgcaataatagtgttttgtt

SEQ ID NO: 23640 - DNA, 81 bp, Homo sapiens
ctggggagagactgcaatgatcatctagtcctgatttcacagatgaaatggggtctcagagaagagagtggacttgtccag

SEQ ID NO: 23641 - DNA, 73 bp, Homo sapiens
ggtgaaaaatatgtatatatttgtgtgtatgcaaaaatatgttaatacacacaaacctgtattgtgtatcact

SEQ ID NO: 23642 - DNA, 93 bp, Homo sapiens
gtctcaagagccaggtgtggtggctcgtgcctgtaatcccagcattttgggaggctgaggtaggaggatcgcttgagcccaggagtttgaggc

SEQ ID NO: 23643 - DNA, 71 bp, Homo sapiens
ttgtttttgagacagggtctcactctgtcacccaggctggagtgcagtggtgtgatcgtggctcattgcag

SEQ ID NO: 23644 - DNA, 113 bp, Homo sapiens
tagccactaacctcttgaaatgtggctattgtggttgaatattgattttggagttgtatttaactttaattaatttaaataaaatttaaatagccacatgtggctaatggcta

SEQ ID NO: 23645 - DNA, 77 bp, Homo sapiens
tatatgtatatatatatgtttatgtatatgtttaggtctatatatatatataggtcatatatatatgaaagaatata

SEQ ID NO: 23646 - DNA, 91 bp, Homo sapiens
agtccagggaaatgacagttgagttgcacaaacccagtgttcagacttcctgagaaacttgtcttgaaatcagaagtcaaattcctgacct

SEQ ID NO: 23647 - DNA, 76 bp, Homo sapiens
tgagcgggggtcaagagcaataacgaaaaatgtttgtcataaaccgtttttcattattgctcctgacctcctctca

SEQ ID NO: 23648 - DNA, 60 bp, Homo sapiens
tctttctgcagcaacggggagtgagagggcagacttctctttctctgtcttgtacaaaga

SEQ ID NO: 23649 - DNA, 58 bp, Homo sapiens; identical to SEQ ID NO: 9046

SEQ ID NO: 23650 - DNA, 117 bp, Homo sapiens
cagagctgtaagatgattgcacctgagccacctcatgtggtatcccaggctggaagactctgagctctgagctctacctgctgaggtccccggagctgccccagatctagtccttcc

SEQ ID NO: 23651 - DNA, 95 bp, Homo sapiens; identical to SEQ ID NO: 6311

SEQ ID NO: 23652 - DNA, 79 bp, Homo sapiens
ctatatatttgattttctactatgcattagaatacataaacttgtattctaatgatttaagtttgatttcacaatatgg

SEQ ID NO: 23653 - DNA, 86 bp, Homo sapiens
ccccttagaggatgactgatttcttttggtgttcagagtcaatataattttctagcaccatctgaaatcggttataatgattgggg

SEQ ID NO: 23654 - DNA, 86 bp, Homo sapiens
cttcttcaggaagctggtttcatatggtggtttagatttaaatagtgattgtctagcaccatttgaaatcagtgttcttgggggag

SEQ ID NO: 23655 - DNA, 124 bp, Homo sapiens
ctggagatggagagttttgacaattttaagtgcatgttctgtgtgtaagaaagagtcattacgttttttttttctttcagatgttgccatgccttaaaattgctgatgattaaaatagaacatc

SEQ ID NO: 23656 - DNA, 113 bp, Homo sapiens
aggctaggttatgcagagtaacaattctaaaatcccagtaggtttaaacagtacatgtttatttattgatattcatcaatgtggaagccagggaattctgctcattgtggtct

SEQ ID NO: 23657 - DNA, 115 bp, Homo sapiens
ctagtcttcacaaacataggactgataacttgttttatattaatattttgttgtataaatacctgtatattttgtgttactgtgtgacaaaactgagtctaaaatatgtggctag

SEQ ID NO: 23658 - DNA, 71 bp, Homo sapiens
ttgtttttgagactgagtctcgctctgtcgcacaggctggagtgcagtggtgtgatcttggctcgttgcaa

SEQ ID NO: 23659 - DNA, 93 bp, Homo sapiens
cctctgttcatttgtgtgtgttgtcagtgttcagagagggctcactatgctctggggagtcttctaaaccctttacaaccattatctcatagg

SEQ ID NO: 23660 - DNA, 72 bp, Homo sapiens
accgtggatggcacagatcgtaagtgactggagggggcagaggctctgactgtgtcagtactgccattaggt

SEQ ID NO: 23661 - DNA, 72 bp, Homo sapiens
aagagatatatatgtgtgtgtgtgtctgtgtatatgagtatatgtgaatatatatgtgtgtgtatgtatttt

SEQ ID NO: 23662 - DNA, 81 bp, Homo sapiens
tggcaggtgaaggcagactgtctctaaaaatttttgctctaaggaatttttttatttttaagacagtgtctctctctgtca

SEQ ID NO: 23663 - DNA, 58 bp, Homo sapiens
tgagacagggtctcactctgtcactcaggctagagtgcagtggtgcgatcttggctta

SEQ ID NO: 23664 - DNA, 81 bp, Homo sapiens
ccacactctccaactctgagattctatgattatggtggcagaaccaagacaggaatttttaaggggtgctggggagggtgg

SEQ ID NO: 23665 - DNA, 113 bp, Homo sapiens
tgcattctgcattatatatgttaaataaaagaaagctgtattatatatatatatatatatataataaatgaaagctgtattctgtgttatatatattacatatgtattctgca

SEQ ID NO: 23666 - DNA, 57 bp, Homo sapiens
tgagactgagtctcgctctgtcactaggctggagtgcagtggtgcaatctcagctca

SEQ ID NO: 23667 - DNA, 104 bp, Homo sapiens
gttctctgtcactatcacgcattgccacttttttttcttttttgagacagagtctcgctctgtcgcccagggtggagtgcagtggcgtgatatcggctcactgc

SEQ ID NO: 23668 - DNA, 109 bp, Homo sapiens
gggtagaacacagaaattgcctttttaattcaaatgttaagcagatttatttttttataatacgggagcttgtactacactgttagactggcttatttttgttttgttc

SEQ ID NO: 23669 - DNA, 58 bp, Homo sapiens
tgagacagggtctcactctgtcacccaggctggagtgcagtggtgcgatcttagctca

SEQ ID NO: 23670 - DNA, 75 bp, Homo sapiens
ggtcacacaggtaataggttgaaaagtcaaggaatctggcttcagggactgtgttctcaacctctttgctagacc

SEQ ID NO: 23671 - DNA, 83 bp, Homo sapiens
ggtgacagagtgagaccctgtctcaaaaaaataaataaattctttttttttttttttttgagatggagtctcgctctgtcacc

SEQ ID NO: 23672 - DNA, 66 bp, Homo sapiens
agatctgggtagagtgcatttttttcttttttttttgagacagagtctcgctctgtcacccaggct

SEQ ID NO: 23673 - DNA, 92 bp, Homo sapiens
catgcttcctgttaagcctttgggactgtaaatcaattaaacttctttttaaataaattatccagtctcaggtagttctttatagcagcatg

SEQ ID NO: 23674 - DNA, 58 bp, Homo sapiens
tgagactgagtctcactctgtcgcccaagctggagtgcagcagtgcaatctcggctca

SEQ ID NO: 23675 - DNA, 119 bp, Homo sapiens
catacatgttgcaaatgacagggttttgttttttatggcagaatattttggggtttgtgtgtgtgtgagtgtgtgtgtgtgtatacatatatatatatgcataatttcctttttaagta

SEQ ID NO: 23676 - DNA, 98 bp, Homo sapiens; identical to SEQ ID NO: 1311

SEQ ID NO: 23677 - DNA, 110 bp, Homo sapiens
tatgacctatcttaattagttacatctgcaatgaccctatttccaaataaattcacattttgttgtactggggattgggacttcaatgtatcttttttaggtaaaacatg

SEQ ID NO: 23678 - DNA, 116 bp, Homo sapiens
caccttcagcctcccaaagttctgggattacaggagtgagccaccaatgtttatttatttatttatttttttgagacagtctcttactctgtggcccaggctggagtgcagtggtg

SEQ ID NO: 23679 - DNA, 63 bp, Homo sapiens
tgaataatggtgggaatgaagggaaataggcagcagcctggctctgtcccactgtcagattta

SEQ ID NO: 23680 - DNA, 56 bp, Homo sapiens
cctgagggggtcctgcaagcttctcccatgggctgcctctgtgtgactctctcggg

SEQ ID NO: 23681 - DNA, 88 bp, Homo sapiens
ggacatgaagggatttcctcagagaaatgatgtctgtgtcactcacatacattactggcattcaattctcaggatccagttctagtct

SEQ ID NO: 23682 - DNA, 68 bp, Homo sapiens
ccctgcctcactgagtcactggggaatcaaatgagatggtatgaggaccaatgactggtgagctgtgg

SEQ ID NO: 23683 - DNA, 71 bp, Homo sapiens
cggcttggtggtggggagaaggttacacctggaaccaagctcataagtcactctctccctctgccttgccg

SEQ ID NO: 23684 - DNA, 80 bp, Homo sapiens
ggtttgtgtactcggttctatgcaacatatatatatatatatgttggaaaagttgcttggaaagctgaaatttacaaact

SEQ ID NO: 23685 - DNA, 93 bp, Homo sapiens
acatgggtgtgctatgggtgtgtacgccactgtgctcgggctcatgacatgcagtccatgtctcagtattgtgagagcacacatcctcaaacc

SEQ ID NO: 23686 - DNA, 108 bp, Homo sapiens
tcaggcactcagtagataatggctgttaatcatgatcatcatcatcatcactgctattatcatgtcattatcatcaccaccattatcgttactgatgtgtcctcctgg

SEQ ID NO: 23687 - DNA, 79 bp, Homo sapiens
tcctgagtctcagtgagtgtctggttgtgaattaacagtgcccactgtttttggccacacagatatattagattctgga

SEQ ID NO: 23688 - DNA, 133 bp, Homo sapiens
tgatgttcccagggttgaagctgggggtctgtctccccaccttccactccatgtcagcctagagactcagctctgtgtcctgagaacacagagattagaagagctaatctctggctccaaatgctgtaaaagg

SEQ ID NO: 23689 - DNA, 74 bp, Homo sapiens
ggtaaaagagagtgaagatgtgatagaccagaaaccatgggtacaaatggtcggcatttttttttcttttttct

SEQ ID NO: 23690 - DNA, 73 bp, Homo sapiens
gaaacatgtctctctctgtgtgtgtgtgtgtgtgtgagagagagagagagagagagagagagatacttgtttt

SEQ ID NO: 23691 - DNA, 95 bp, Homo sapiens
tttgttaatatgtatttatgcacatatatatttacatatagatttatacatatatatgtatgttgtgtatatgcatatatgtatatattaacaaa

SEQ ID NO: 23692 - DNA, 70 bp, Homo sapiens
tatatgtaaatatatatgtgcataaatacatattaacaaatgtgtctgtgtgtgtgtatgtgtgtgtata

SEQ ID NO: 23693 - DNA, 74 bp, Homo sapiens
gaccaactctgtcattctgtcattctctcatgtcatcatgggaggtcattgatggcagtttcagttgagtggtc

SEQ ID NO: 23694 - DNA, 58 bp, Homo sapiens
tgagacggagtctcgctctgtcgctcaggctggagtgcagtggcatgatctcggctca

SEQ ID NO: 23695 - DNA, 65 bp, Homo sapiens
tctccaactgctcctctatcaagactctagcagggctgagtgatctgagagagcaggagtgcaga

SEQ ID NO: 23696 - DNA, 125 bp, Homo sapiens
tctgagtttcagtgtgttcctgtactttttttttttttttttttttgagacagagtctcgcactgtcacccaggctggagtgcagtggcgcgatcttggctcactgcaacctctgcctcctgggt

SEQ ID NO: 23697 - DNA, 116 bp, Homo sapiens
gttgaacttctttgtctagtcatattgtagttcttgtatatcctcagacttatccttttgagtttttttatttttgagttggagttttgctgttgttgcccaggctggagtgcaat

SEQ ID NO: 23698 - DNA, 85 bp, Homo sapiens
atattcacctatgttgttgagtatagcgatagtttattgttttttgttgttgttgttgtagtatagcattccattctgtgaatat

SEQ ID NO: 23699 - DNA, 58 bp, Homo sapiens
tgagcagagatcgcgccactgcactccagcctgggtgacagtgtgacactctgtctca

SEQ ID NO: 23700 - DNA, 97 bp, Homo sapiens
tagaatgtgagacgaagagatgatagaggaggggtgttagaaggtgctgcctttttatttttatttcttttattttttgagacagagtctcactcta

SEQ ID NO: 23701 - DNA, 105 bp, Homo sapiens
cattctgaaattctcaatggacactccccatccttcagtctaatgtttcgatagaaacattttgataactcctaattggtccttgtactagagattttctggttg

SEQ ID NO: 23702 - DNA, 117 bp, Homo sapiens
tgttctttttgcttatgattgtcttggctatgcaggctcttttttggttccatatgaaatttaaagtagtttttttccaattctgtgaagaaagtcaatggtagcttgatgaggata

SEQ ID NO: 23703 - DNA, 94 bp, Homo sapiens
ttcagcaacattagtctgtctgtgtgtctgtgccattagccatctaggttattgatgggtatatagcttaatactcagtactgtataacctgaa

SEQ ID NO: 23704 - DNA, 120 bp, Homo sapiens
agaacatttataaaatgcctgctctctgtaaggcactgtgttgggcactcagaatatcacagtgagcaaactggacattgttcctgatcttgcagtgcttatagtatgttgaattgtttt

SEQ ID NO: 23705 - DNA, 83 bp, Homo sapiens
tgttacatgtgtgtgtgtatacatagacacacgtatgtatatgtgtgtatatatatatatgtatacatacacacacgtataca

SEQ ID NO: 23706 - DNA, 145 bp, Homo sapiens
actatatgtatatgtatatgtaaaatacacacgtataaatgtgtgtacatatatacacgtgtatatatatgtatatatgtgcatatatttatacataattacacatatatgtatacgtgtgtgtgtgtgtgtgtgtgtatgcaca

SEQ ID NO: 23707 - DNA, 66 bp, Homo sapiens
cctgtatgtatgtatgtatgtgtgtgtacatgtatgtgtatatatttatatatatatttttggagg

SEQ ID NO: 23708 - DNA, 118 bp, Homo sapiens
cacttaggatatattattaggaggaaaaagctgactcagacatttatatatatatggtttcaatttttatgtgagttgtgagcttgtgcaaatgtttccttttagtgggcatttagtg

SEQ ID NO: 23709 - DNA, 82 bp, Homo sapiens
tgagtgtgtgtgtttgtatgtacgtatatgtatgtgtgtgtatctatatatatatgtgtgctcaggacagtgtagagattta

SEQ ID NO: 23710 - DNA, 69 bp, Homo sapiens
gccttatgacagatctgctgacaggaactgaaatacattaacactctgtcactcagatctttagagggc

SEQ ID NO: 23711 - DNA, 109 bp, Homo sapiens
tgagtacttcagctcccggcttgcgtttttgatagatatggacacacatctctcactctgtccccatggctcttgttcaatacacagttgatttagcctaagtacctta

SEQ ID NO: 23712 - DNA, 110 bp, Homo sapiens
tgcttaggattgtcttggctatacgggctcttttttggttgcatatgaaatttaaagtagttttttctaattccatgaagaaagccaatggtattttgatgaggatagca

SEQ ID NO: 23713 - DNA, 83 bp, Homo sapiens
cctgggaccacaggcagacacaatcactctcagctaattttttaaaatttttgaagagacagggtctcaccatgttgcctagg

SEQ ID NO: 23714 - DNA, 63 bp, Homo sapiens
tataggttgtgaggtagccattgaccacccactgagtgtgtcactggctgttctttacctgtg

SEQ ID NO: 23715 - DNA, 101 bp, Homo sapiens
tgcgcgaaactgtaacgatcgggctccagttcgggatctgcccaagcctctcaggagagaggcagctctggtcctcaggagagccctctcggaggtcgcca

SEQ ID NO: 23716 - DNA, 97 bp, Homo sapiens
tttgcttgtaattctccaggagctcagaaccttaaagatggggtccatgatctgtttttgttcatttgtagggtctttctgggagagtgcaaggaag

SEQ ID NO: 23717 - DNA, 102 bp, Homo sapiens
aatcccaagaggctatatactgtatgattctatttatattacatgtttgaaataacagcattatagatagagacagggacagattagtggtttccaggggtt

SEQ ID NO: 23718 - DNA, 99 bp, Homo sapiens
tctatgaagatgaaggtgtagattctgagaagagtctgtggaaacaatgaaacagcatagtttttcaatctctccgaattcccacagaaaaacttgaga

SEQ ID NO: 23719 - DNA, 81 bp, Homo sapiens
ggctgaatcacagttaggagcacagagtgggttttttttttttttttttttttttccagttctgttcccctgtccccagcc

SEQ ID NO: 23720 - DNA, 116 bp, Homo sapiens
cttctgtttattctctgatcccttcaagtagatatttttttaatccagattttctagttgttctcagcaggaaggttactctgaattaccaggtctgcctttagtggaagcagaag

SEQ ID NO: 23721 - DNA, 66 bp, Homo sapiens
gtatccaccagagagtgtgttcagtgagcccacgttagcgctcatgtgtcatggtctctaaggaac

SEQ ID NO: 23722 - DNA, 72 bp, Homo sapiens
tctgtaaaaggtgaatatttactaatagctgctgtctatgggggctgtcagaagtaaatgagcacttacgga

SEQ ID NO: 23723 - DNA, 116 bp, Homo sapiens
tgatccaatcacctcccaccaggccccaccttcaacatgtgcagattactatatatatatatatggagtctcgctctgtcttccaggctggagtgcagtggtgtgatctccgctca

SEQ ID NO: 23724 - DNA, 77 bp, Homo sapiens
taatgatgacataagaatacaaacacataaggtaacaactgctgccttgtttgtttgtttttttttggtctttattg

SEQ ID NO: 23725 - DNA, 88 bp, Homo sapiens
caggttgtgtgtgtgagagactgagatgatgggtgcgagtgcctggcatgtatacacactcactgtctccttgggctcacaggtcctg

SEQ ID NO: 23726 - DNA, 58 bp, Homo sapiens
ggcacattcttgtggtcccagctactcaggaggctgaggtaggaggatcacttgagcc

SEQ ID NO: 23727 - DNA, 114 bp, Homo sapiens
tatttcggtgatgactagaagtgatgttttgggtttttggggtttttttgagacagagtctcactgtgtcgcccaggctggagtccagtggcatgatcttggctcactgcaatg

SEQ ID NO: 23728 - DNA, 109 bp, Homo sapiens
gccaaggagtagggaaatagatttcacctcttgaggggatttgttacaaggaattttcgctaatagttttttttttttcttaggtggagtctcgctctgtcacccaggc

SEQ ID NO: 23729 - DNA, 89 bp, Homo sapiens
tctgcagctgactgagtgataaacttatcctttaagattagttggccttcaatagagtcaggtgacagagaggtatgcttcctcagtgc

SEQ ID NO: 23730 - DNA, 89 bp, Homo sapiens
ctagccaaggcaaggaagaattgtctcctagagtcatcagagagagcacagccctgctcacaccttgatttgggacttccagcccctag

SEQ ID NO: 23731 - DNA, 96 bp, Homo sapiens
gagaggagttacattatacagtgggtacagacccctaggtttgaatccaggctctgtcatttactctctgtgtgataattgtttacttaacctctc

SEQ ID NO: 23732 - DNA, 82 bp, Homo sapiens
aggcctgaggagagatatcactgtcaatttctgcactaagatccagaaatattgaattaaggaaaggcttactttgaggcct

SEQ ID NO: 23733 - DNA, 56 bp, Homo sapiens
tgctcgagacacatctcagttcttgcttgcttgactttctgagtgtctctctggca

SEQ ID NO: 23734 - DNA, 62 bp, Homo sapiens
tggggagaaaccagagcagaaaagctgaaaattgtaaaaatcagagtggctcttctcctcca

SEQ ID NO: 23735 - DNA, 111 bp, Homo sapiens
ttgcactgtgatgtgagaatgtgcttggggtgatttcaattttttttaatttattgagtcttgctttatgacaaagcatgtggttgatcttagaatatgtttcatgtgcaa

SEQ ID NO: 23736 - DNA, 116 bp, Homo sapiens
atctggctgccacactttgaggaccattagcataaaaatagacaatgaagtctatcttttatatattttagactatattatctaattttagttcctgaggaaaatttaggcttaat

SEQ ID NO: 23737 - DNA, 59 bp, Homo sapiens
ggggctgaataaggcaggaaggggcccataaagtgcctgtctccctctgtaacagttcc

SEQ ID NO: 23738 - DNA, 63 bp, Homo sapiens
ggactaggtgggccacagtgacaaatgcagtcaagatgccacggtccctctgtcccaccttcc

SEQ ID NO: 23739 - DNA, 117 bp, Homo sapiens
ggtttcctccccaggatatgagttcctggagctgggtgcctgctcctgaggccagtccctgtggctgggtccctgcttctcaccatcaggccttcctcattccccctgcctgcctgg

SEQ ID NO: 23740 - DNA, 68 bp, Homo sapiens
caggatctagaggctgtgcagacgcagacacacacagtcacgggcacatacacagtttcctgaacttg

SEQ ID NO: 23741 - DNA, 64 bp, Homo sapiens
gtgtgtgtgtgtgtttgtgtgtgttaatattgcactaatcaaatactctctctctcacacacac

SEQ ID NO: 23742 - DNA, 97 bp, Homo sapiens
agtgctgggattgcaggtgtgagccactatgctgtgatataataaaatgtctttatttatttattttgagatggtgtccgactctgtcacccaggct

SEQ ID NO: 23743 - DNA, 85 bp, Homo sapiens
gtggcaggagagagatgagtgccagcaggggaaatggcagatgcttataaaaccatcagatcgtgtgagactcactctttatcac

SEQ ID NO: 23744 - DNA, 56 bp, Homo sapiens
tgagacagtctcgctctgtcactcaggctggagtgcagtggtgcgatcttggctca

SEQ ID NO: 23745 - DNA, 69 bp, Homo sapiens
tgtttgtgtgtcagagtctcactctgtcgtccagtctggagtgcagcggtgcgatcttggctcactgca

SEQ ID NO: 23746 - DNA, 66 bp, Homo sapiens
ggagttaagatctgccactctgtctctttcccagaagagagatgagaacacgtgggtttgaactcc

SEQ ID NO: 23747 - DNA, 84 bp, Homo sapiens
gtcagtcttctctgggtatcattgtctaagtaaaacacaagtcagtgtacagacagcgttgggatcggccagaggcagataaac

SEQ ID NO: 23748 - DNA, 186 bp, Homo sapiens
tatatatataatatgtatacactatataaatacttatatatattatatatactatatataagtgtatatatgtatatatgtacttatatataagtacttatatatgtgtgtatatacttatatatataaacatatatatgtaaaacatatataagtacttatatatataagtaaaacatatatata

SEQ ID NO: 23749 - DNA, 110 bp, Homo sapiens
gttttgaaggctcttttatgccatcataaaaaggttacattttatcttgagggcaatgaagaatgaacaagttttaaaaaagtgatagtgtcaggtttgcctttttaaac

SEQ ID NO: 23750 - DNA, 95 bp, Homo sapiens
tatatatattccatgtatgtgtgtgtgtgtgtatatatatatatatatatgtgtgtgtatatatatataaacatatatatgtatgtatgtgatat

SEQ ID NO: 23751 - DNA, 116 bp, Homo sapiens
tgattttgtttacatgtgtcttcattaggctctgaactcctggagggtagataatatattctttttcatctttctgtctccaacatagcgccaaggaattttacacattaaaatca

SEQ ID NO: 23752 - DNA, 58 bp, Homo sapiens
tgagacagagtctcactctgtcacccaggctggagtgcactggtgagatctcagctca

SEQ ID NO: 23753 - DNA, 100 bp, Homo sapiens
gggagaaaagaaagaaattatcactatgtatttgtttataatcaccagactatttctatatagctgttaataaaacaaggttatttttttctttttttcc

SEQ ID NO: 23754 - DNA, 82 bp, Homo sapiens
acatgatgacagtgaacacagagctgggaagagaagctcacagtaggttctggtcagccagtgagagtcagctgcagcatgt

SEQ ID NO: 23755 - DNA, 111 bp, Homo sapiens
tatttatttttctgtatctggccactgtgtgtgtatatatatatatatatatatatatatatatatatatatatctccaaatagcacattgtacaccttgaatagataata

SEQ ID NO: 23756 - DNA, 77 bp, Homo sapiens
catagatgtgcaacttctgagtcaaaaaagcatatatatctaaagtttttatatatttggctaggttgcactctaag

SEQ ID NO: 23757 - DNA, 95 bp, Homo sapiens
gtagataattagcataatatgccacaaaaacattaaactctttctttgttggcaagttttttttgttttgttgttgttgttgtctttttgtctat

SEQ ID NO: 23758 - DNA, 101 bp, Homo sapiens
gttatattttccattatatatggaaatatatatatatattcctacacaattactgggttttatatttatatttcttttctatttgtattggatcactttac

SEQ ID NO: 23759 - DNA, 116 bp, Homo sapiens
taaataagtatatatatatatacacacatatatatatgtatatatacatatatgtgtatatatatgtatatatacatatatataaaagtccatgtattatgtattatactgtgtta

SEQ ID NO: 23760 - DNA, 111 bp, Homo sapiens
tggcagacttgctgatacactgagatactatactaactagttttgattattttttcaaagcttcatactagtgagtaaggtattatttaatggacaaagcagtagatgcta

SEQ ID NO: 23761 - DNA, 82 bp, Homo sapiens
tatatacatatacacacaatatataatatgtatatctatatatgtactaaagtaaatatatatgatgctgtatatgtatata

SEQ ID NO: 23762 - DNA, 101 bp, Homo sapiens
tatatatcatatattcattacatatgtgtcatataacatataatattatatatataatgttggcatggaaattgtatatatatgtgtgtgtatgacatgta

SEQ ID NO: 23763 - DNA, 64 bp, Homo sapiens
accacatatatatatatatatgtaacatatatatatatgttacatatattggcatggatgtggt

SEQ ID NO: 23764 - DNA, 89 bp, Homo sapiens
gtatatatatatacatagatacgtgtgtgtacatatattttctccctccatacatatgtgtgtgtgtgtgtgtgtgtgtatgtatttgt

SEQ ID NO: 23765 - DNA, 80 bp, Homo sapiens
ttaaagtatatgtactttatatatgtgtatatataaaatatagtataaaatttataccatataaagtatatatactttaa

SEQ ID NO: 23766 - DNA, 140 bp, Homo sapiens
atatatatattctggatatatatatatattctggatatatatatatatattctggatatatatatatatattctggatatatatatctatatattctggatatatatatcctggacatatatatatatattctagatata

SEQ ID NO: 23767 - DNA, 131 bp, Homo sapiens
atgtgtgtgtatgtgtgtgtatatatatgtatatatgtgtgtatatatgtatatatgtgtatatatgtatatatgtgtatatatatacacacatacacacacatgcattttttacatatatatatatatat

SEQ ID NO: 23768 - DNA, 88 bp, Homo sapiens
acagtagaatggtttattctacagaaagtttgtttaacaatttgtggaactagttagtattctatagaataaactttgtcattgctgt

SEQ ID NO: 23769 - DNA, 111 bp, Homo sapiens
atattcttgtgtaagatatggaatattggaaatgctgattatgtaatactgattacaagtatgaaataaaatagaggcaagaggaaaataattctcatctagggagagtat

SEQ ID NO: 23770 - DNA, 100 bp, Homo sapiens
cttatgaagcatagtttggctggatatgaaattcttggttgggatttttttttctttaagaatgctgaatatacactgccaatatcttctgacttatagg

SEQ ID NO: 23771 - DNA, 104 bp, Homo sapiens
ttaacattatttatgtattcagttatcagtgagcacttatactttgtgactttcaagaaatttatttgttcattttatctaggtaactgaatgtatggtgttaa

SEQ ID NO: 23772 - DNA, 89 bp, Homo sapiens
tatgtgtgtgtatatatattcatatatgtgtatatatatgaatgatatatgctcaggggaatatatatattcatatatacatgaatgag

SEQ ID NO: 23773 - DNA, 123 bp, Homo sapiens
atatattcatatatatgtatatatattcatatatgtgaatatatatacacatatatgtatatatacatatatatgaatatatatacatatatgtgtatatatattcatatatgtgtgtatata

SEQ ID NO: 23774 - DNA, 171 bp, Homo sapiens
acacatatacatacatacatatatatgtatgtgtatatatattcatatatatgtatatatatattcatgtatatgtgtatatatattcatgtatatgagtatatatattcatatatgagtatatatattcatatatgtatatatatacatgtatatgaatatatacatata

SEQ ID NO: 23775 - DNA, 95 bp, Homo sapiens; identical to SEQ ID NO: 68

SEQ ID NO: 23776 - DNA, 93 bp, Homo sapiens; identical to SEQ ID NO: 69

SEQ ID NO: 23777 - DNA, 109 bp, Homo sapiens
tatgtatgtgtgtgtgtatatatatacatatatatgtatatgtatacgtgtacatatacatatatatgtatacatatatacatatatgtatgtgtgtgtgtgtgtgtgt

SEQ ID NO: 23778 - DNA, 127 bp, Homo sapiens
gcagagaaaggaacaacaacttacactgaaatggctcatttgacaactgttatttctttttttttttttttgagttggagtctcgctctgtcaccaggttggagtgcagtggtgcgatctcaactca

SEQ ID NO: 23779 - DNA, 67 bp, Homo sapiens
ctgggatttgagacttggtgatttttttttttttttttttgagatggagtctcactctgtcgcccag

SEQ ID NO: 23780 - DNA, 83 bp, Homo sapiens
ttcagtttggagagatgtgctatgctgcttttcatcttctgagtttttatttttgagaacttgcagcttgcattccacgtgaa

SEQ ID NO: 23781 - DNA, 89 bp, Homo sapiens
gtgctacaagcctgaggctacttctcattgaaagggcctcccaggcattgagggtgtccacagttcagtgagacctcagaagcctgcac

SEQ ID NO: 23782 - DNA, 63 bp, Homo sapiens
tgcctttcaaaggacaactcactgtttgtttttttaaataaagagtgagctctgagagaggta

SEQ ID NO: 23783 - DNA, 82 bp, Homo sapiens
ttcaaaatacactggtgtctctgcagagttgttttgctgaatttagctatgacactcgctgagtcactgcagtgggcaagaa

SEQ ID NO: 23784 - DNA, 77 bp, Homo sapiens
gaaatgtcatactgtttacttgcccaagagcggcatatagagttcctggatgagaagtgatttagtagacagagttc

SEQ ID NO: 23785 - DNA, 116 bp, Homo sapiens
tctatatatctatctatctggagatatatatatatatatatttggagttatatctatatctatatctatatatatctggagttatatatatctctctatatagatatctgtctgga

SEQ ID NO: 23786 - DNA, 84 bp, Homo sapiens
ctgctagaagcacagaaataggaaggaggtgctgagtaagtagaagtattgcttgacatgtcttttacttcttttgataagtag

SEQ ID NO: 23787 - DNA, 118 bp, Homo sapiens
gtctcatttgaggctcaaggtcctctttcaggagcatatggttgtagacagaattcagggttgtttttttttttttttctgcatttgtacatcttctagtggtttgcctcttccaggc

SEQ ID NO: 23788 - DNA, 57 bp, Homo sapiens
cggggtctctctctctcactcttgtcaactaggctggagtgcagtggcgtgatcttg

SEQ ID NO: 23789 - DNA, 114 bp, Homo sapiens
taggggtcaagagagtgattggtttatcatggtcattcattatttacttttaaatgtaggttaacgtggtgggagaatggtgtctctaccagtggctctgtccagggaacttta

SEQ ID NO: 23790 - DNA, 78 bp, Homo sapiens
tgtgtctctgtttttccattctttattttgtctgggtttcacttaaacaaagttttaagtcagaaaacagagactaca

SEQ ID NO: 23791 - DNA, 56 bp, Homo sapiens; identical to SEQ ID NO: 322

SEQ ID NO: 23792 - DNA, 71 bp, Homo sapiens
gccatcttcaggtgactcagaataggagtttggggctctttccatctctgagtcactctctgccaggtagc

SEQ ID NO: 23793 - DNA, 117 bp, Homo sapiens
gagcagcatcttagcaaagtctctgcagtgtcttggcaggggaaagttttggggtctggtgatgcagggcaggtccttcaaggcagggactggtggggatttggaaagaaagttcgt

SEQ ID NO: 23794 - DNA, 114 bp, Homo sapiens
cctcccaagtagctaagactacagttgtgtgccactacacccagctaattaaaaaatattttttttaatgctgggtacagtggctcatacctgatatcctgacagtttgggagg

SEQ ID NO: 23795 - DNA, 113 bp, Homo sapiens
cgcctctgcctccaaaagtgctgggattacaggcgtgagccactgtgcccatccgtacatatatatatttttgaaacagggtcttgctctgctgcccaggctggagtgtggtg

SEQ ID NO: 23796 - DNA, 116 bp, Homo sapiens
gtttcttttgctgtgcagaagctctttaatttaattagatcccatttgtcaattttggctttttttttaatactttaagttttagggtacatgtgcacaacgtgcaggtttgttac

SEQ ID NO: 23797 - DNA, 58 bp, Homo sapiens; identical to SEQ ID NO: 454

SEQ ID NO: 23798 - DNA, 118 bp, Homo sapiens
attgttaactatagtcattctacagtgatttagaacactatctatttatacttttttttgtttttttttagtgacaggttctcactttgctgcccaggctggagtgcagtggtgcaat

SEQ ID NO: 23799 - DNA, 75 bp, Homo sapiens
tctggtggagaggttagggggaatgtgtgtgtgtgtatgcgtgtgtgtgtatgtctgtgacactttcattaaaga

SEQ ID NO: 23800 - DNA, 73 bp, Homo sapiens
gcctctgagtagctgagactacaggtgtgtaccaccacacccaactaatttttgtatttttagtagagatggc

SEQ ID NO: 23801 - DNA, 86 bp, Homo sapiens
ctccaaagtgcttgggttacaggtgtgagcttttcttttcttttctttttttggagatggagtctctctctgtcacccggctggag

SEQ ID NO: 23802 - DNA, 118 bp, Homo sapiens
ttacaggcctgccctattttattgtgcttccatatattgcactgttacaaacagcatgtgctcactttgtctctgtgttatattttggtaatctgttatggtgattggtgacctttga

SEQ ID NO: 23803 - DNA, 67 bp, Homo sapiens
gacacagtggctcacacctggaatcccagcactttgggaggctgaggtaggaggatcacttgaggtt

SEQ ID NO: 23804 - DNA, 92 bp, Homo sapiens
acagcagtccaggatcagtcaggccaggcccagaaatacaattgtatctatctatctatcatctgcctgtctgtctgtctgtctgtctgtct

SEQ ID NO: 23805 - DNA, 109 bp, Homo sapiens
acttgccgaaactatgaaagtttaaccaaatattttcagaattgtgaaggtttattttactttaattagagaatatttacagtttaacaaatatggctttgggacatgt

SEQ ID NO: 23806 - DNA, 56 bp, Homo sapiens
tttctgaggctggaagtcggagctttggaccccttcactctgacagtctcacgaga

SEQ ID NO: 23807 - DNA, 76 bp, Homo sapiens
ctcacgcagagacaggagacagacagcagctagataaagcagaagatggttgcgtaggctccagtccagggcagag

SEQ ID NO: 23808 - DNA, 67 bp, Homo sapiens
gggggcatagtaatagggagggaagtttaggtgagcagagcctctgtccttctgtctcagtgtccct

SEQ ID NO: 23809 - DNA, 94 bp, Homo sapiens
ccatcataggtgcagaaatattataagacttttctttactgaaacaattttttttttttttttggagacagagtctcgctgtcacacaggctgg

SEQ ID NO: 23810 - DNA, 74 bp, Homo sapiens
ctactttgagtgttgggtgaaatttctctcttttttttttttgagacggagtctcgctctgtcacccaggctgg

SEQ ID NO: 23811 - DNA, 95 bp, Homo sapiens
atgcattgctttctcactttgactatttgaattatgtatgcagtacacttactgcaactgcatgttgtctaaaatagtttttctataggatgtat

SEQ ID NO: 23812 - DNA, 89 bp, Homo sapiens
tcttttagaaactttctgagttctcagctctagagactatttcccaagaagttttccctaaaaagtagagaatttgttgttatgaaaga

SEQ ID NO: 23813 - DNA, 84 bp, Homo sapiens
ggctctgtccctccactgtcactcattgtctgtccccaggcgaggtggcacgaacagaggtgagtctcagaggaggtgtgtgtc

SEQ ID NO: 23814 - DNA, 72 bp, Homo sapiens
aggcaacatagtgagacgctgtctctatttcattttttgaagaaaatgggcggggaatggtggctcgtgcct

SEQ ID NO: 23815 - DNA, 116 bp, Homo sapiens
gggagccgctagagcatgtggtgtgctgtgtcggctcgatttttatgtctgtgtctttctgtgacacacgttttgtattcgactcgagttgtcctgtgtgctttgatgtggctttc

SEQ ID NO: 23816 - DNA, 73 bp, Homo sapiens
tgcgtgtgtctctctctctggtatttctcgctttggctcccgtgttgtgagcagtcctgtggaggcccccgta

SEQ ID NO: 23817 - DNA, 84 bp, Homo sapiens
cagaattgacttagagggaatagctttttgtttatttttctttcttttgtttaatgaccttgctgtctctaaggctcagttctg

SEQ ID NO: 23818 - DNA, 114 bp, Homo sapiens
gaagttaataacttaatctgatgaaatgtaattaagaggaccaaaatgatagagtatttcttttttttttttttttggtcacggttctttgataacataagcagctttggcttc

SEQ ID NO: 23819 - DNA, 133 bp, Homo sapiens
atgcatatatataatatgcattaggaaagctatatatatgaatatacatagctaatgtatattatgtgtatatatataatgcatattatatatatgcatacatatatatagatggctggataattagatatgc

SEQ ID NO: 23820 - DNA, 116 bp, Homo sapiens
cctcgtgtttgtgtatatacatatgtgtattatctgtctgtgtatatatatataaatgaggcattatatttataaatatctatatattcatagattatatagttttagggaagcat

SEQ ID NO: 23821 - DNA, 95 bp, Homo sapiens; identical to SEQ ID NO: 68

SEQ ID NO: 23822 - DNA, 93 bp, Homo sapiens; identical to SEQ ID NO: 69

SEQ ID NO: 23823 - DNA, 74 bp, Homo sapiens
gttcctaagactctctgacacctgcaactgtggcactgccagccgccactctgcctctgacagtctcgggggac

SEQ ID NO: 23824 - DNA, 90 bp, Homo sapiens
gagagggaatttaggttttgtttttttttttgtgaccctgagaagtggaattgggtttaatagaggaagctatggagaaaatttcagctc

SEQ ID NO: 23825 - DNA, 114 bp, Homo sapiens
ggttattgatagtgtatggtaaataatgggctctatgaaatctctctctacctcttggcttttttttttttttttttttttttgagatggagtctggagtcttactctgtcacc

SEQ ID NO: 23826 - DNA, 115 bp, Homo sapiens
tctttattttacatgcagcttttttcctagtacttttttccaatagagtagacattttgttctattttttcaaaagagacttactggcaactgactgctcatttgttttgttaga

SEQ ID NO: 23827 - DNA, 99 bp, Homo sapiens
aggaaggaaggaaggaaggaaatttaatgcatctataatcacccattttccctaatcagtttttattagatatattattttggttcttctttagtttct

SEQ ID NO: 23828 - DNA, 98 bp, Homo sapiens
ccaccctgggcgacatagccagacccctgtctctaaaaaaaaaaaagtttttttttttttttttttgagacagagtctcactctgtcacccaggctgg

SEQ ID NO: 23829 - DNA, 79 bp, Homo sapiens
tgagactgagtctcgctctgtcacccaggctggagtgcagtggtgcgatcttggctcactgcagcctctgtctcctggg

SEQ ID NO: 23830 - DNA, 111 bp, Homo sapiens
tgtcttgtagaccctctgttaatgatgctaaatttagtcacttgattgtagatttttatttcataaagtaactattttcctctgtgaattagcaagtaattttgcagggcg

SEQ ID NO: 23831 - DNA, 79 bp, Homo sapiens
tagccaatacagagtaaggccttgtttatttttatttatttatttttttgagacaggtctcattctgtcacccaggctg

SEQ ID NO: 23832 - DNA, 58 bp, Homo sapiens
tgagatggagtctcgctctgtcgctcaggctggagtgcagtggcgcaatctcggctca

SEQ ID NO: 23833 - DNA, 63 bp, Homo sapiens
cagtcttacgtgacactggcttttttttttttgagatagagtctcactctgtcacccaggctg

SEQ ID NO: 23834 - DNA, 105 bp, Homo sapiens
ggagtgtggagtaataaagtgaaagctggtgggggagaagagtgggctggcaatattctttttttttttttttgagacagggtttcactgtgtcacccaggctgt

SEQ ID NO: 23835 - DNA, 96 bp, Homo sapiens
tcattatatatgtatatatagatatgtgtatatatatatatatatatacacacacatatatacacacacacatatatatatatatatatatagaga

SEQ ID NO: 23836 - DNA, 104 bp, Homo sapiens
ggaggaggaatctgctcagcaggaacactagctctcactgtgtctctaaaagcgcctttgcaaaattaagacagtaagagaaacctgacattgttgccgcctcc

SEQ ID NO: 23837 - DNA, 98 bp, Homo sapiens
gggagcagggcgtgggggcaccagggctttgtctggcatgggtcctgcccagaggctgactcagtcagaccctcagtgactgcaaacactgttttccc

SEQ ID NO: 23838 - DNA, 95 bp, Homo sapiens
gacagagcaagactcattctggaaaaaaaaaatgtgtattttgaaattccattggtattttacactttttttttttagatggttttgctcttgtc

SEQ ID NO: 23839 - DNA, 110 bp, Homo sapiens
tgcttaggattgtcttggctatacgggctcttttttggttccatatgaaatttaaagtagttttttctaattctgtgaagaaagtccatggtagcttgatgggactagca

SEQ ID NO: 23840 - DNA, 76 bp, Homo sapiens
tcgcttgaacctgggaggcggagattgccatgagccaagattgccccatcgcactccagcctggatgacagagcga

SEQ ID NO: 23841 - DNA, 72 bp, Homo sapiens
gttgttttgagacagggtctcactctgtcacccaggctggagtgcagtggtgcgatcttggctcactacaac

SEQ ID NO: 23842 - DNA, 58 bp, Homo sapiens; identical to SEQ ID NO: 1099

SEQ ID NO: 23843 - DNA, 59 bp, Homo sapiens
ttgagatggagtctcactcactctgttgcccaggctggagtgcagtggtgcaatctcag

SEQ ID NO: 23844 - DNA, 56 bp, Homo sapiens
gagacagagtctcgctctgtcacccaggatggagtgcagtggcgcgacctcggctc

SEQ ID NO: 23845 - DNA, 58 bp, Homo sapiens
gtgtggatgacagatttttgttttgttttgtttgagacagagtctctgtcactcaggc

SEQ ID NO: 23846 - DNA, 74 bp, Homo sapiens
gagcttttttttttttttgagacggagtcgcactctgtcacccaggctggagtgcagtgacacaatcttggctc

SEQ ID NO: 23847 - DNA, 58 bp, Homo sapiens; identical to SEQ ID NO: 2595

SEQ ID NO: 23848 - DNA, 95 bp, Homo sapiens; identical to SEQ ID NO: 68

SEQ ID NO: 23849 - DNA, 93 bp, Homo sapiens; identical to SEQ ID NO: 69

SEQ ID NO: 23850 - DNA, 95 bp, Homo sapiens; identical to SEQ ID NO: 68

SEQ ID NO: 23851 - DNA, 93 bp, Homo sapiens; identical to SEQ ID NO: 69

SEQ ID NO: 23852 - DNA, 95 bp, Homo sapiens
ggtcttagaagaatactttcaggtttttttcattaattatgattctagctgtgggtctgttgtctgatgaaaagtctgaaacggtacctaaaact

SEQ ID NO: 23853 - DNA, 108 bp, Homo sapiens
tgctatgccttgtctgaattctgactgagagggtaattttatatttttcaaagggtgaaagtataatgtttgatcctcacaatgatagtttggcaggttgggctagca

SEQ ID NO: 23854 - DNA, 58 bp, Homo sapiens; identical to SEQ ID NO: 9124

SEQ ID NO: 23855 - DNA, 56 bp, Homo sapiens; identical to SEQ ID NO: 335

SEQ ID NO: 23856 - DNA, 86 bp, Homo sapiens
ggctcgaggcaagagctatatatatgtgtgtgtatatatatatatacacacacatatatatattttttgcataaaccttgttggct

SEQ ID NO: 23857 - DNA, 102 bp, Homo sapiens
gggatatgttaagaagttttttgtttataagtgttcatcaaaattcatgatatatttaagtcattttgatcatttgtgtacaaaaagttgtaatgataaccc

SEQ ID NO: 23858 - DNA, 95 bp, Homo sapiens; identical to SEQ ID NO: 68

SEQ ID NO: 23859 - DNA, 93 bp, Homo sapiens; identical to SEQ ID NO: 69

SEQ ID NO: 23860 - DNA, 78 bp, Homo sapiens
gataatgagaacagactgatgaaggaaagcagactgtgctttctgtaatttcctcttctttggtttattcttcagttc

SEQ ID NO: 23861 - DNA, 79 bp, Homo sapiens
ctgtagagagtgagcagtgaagagtgtagaccctgaagttatactgccttcagatctcagctttacagtttactatctg

SEQ ID NO: 23862 - DNA, 95 bp, Homo sapiens; identical to SEQ ID NO: 68

SEQ ID NO: 23863 - DNA, 93 bp, Homo sapiens; identical to SEQ ID NO: 69

SEQ ID NO: 23864 - DNA, 102 bp, Homo sapiens
tagtcctgtctgagtggcattatgaagcagccagtgtagcgctgtactgtgtgtgtgagtgtgtgtgcgggtgcgagtgtgtgtgtactataaacagctcta

SEQ ID NO: 23865 - DNA, 58 bp, Homo sapiens; identical to SEQ ID NO: 20050

SEQ ID NO: 23866 - DNA, 58 bp, Homo sapiens; identical to SEQ ID NO: 1265

SEQ ID NO: 23867 - DNA, 70 bp, Homo sapiens
tgggcctccagcttgcagacagcagatggtggggcttctcagcctctgtgattctgtgagccgattccca

SEQ ID NO: 23868 - DNA, 85 bp, Homo sapiens
tgcatccctctctccagcttgtgtgcagataactccaaacggggtcaaaaacagctctgggttgaggaagaaggtagaagatgca

SEQ ID NO: 23869 - DNA, 58 bp, Homo sapiens; identical to SEQ ID NO: 19251

SEQ ID NO: 23870 - DNA, 76 bp, Homo sapiens
cctagagagcagggactggccaggttctgagaggggtggtgctgacatgtctctctgacatacagggttctagagg

SEQ ID NO: 23871 - DNA, 110 bp, Homo sapiens
acaggcgtgagctaccacacccagctcagttttggatacttttatttacgtatgtatgtatttatttatttatttattttatttatttttgagatggagtctcactctgt

SEQ ID NO: 23872 - DNA, 115 bp, Homo sapiens
ctatgtgacacaggaaaatggaacagacaagcttggggttacagactcagacagtcattgacgctctttctcccaaacctccctgaagctatttgaaattttccagttaaaggag

SEQ ID NO: 23873 - DNA, 89 bp, Homo sapiens
gatagtgaacaaagaacatggaaaaggaagtacataagccaagcccttctctctggctgtgtgcatttggatctgtctttggtcctctc

SEQ ID NO: 23874 - DNA, 58 bp, Homo sapiens
tgaaacagagcctcactctgtcacccaggctggcgtgcagtggtgtgatctctgctca

SEQ ID NO: 23875 - DNA, 100 bp, Homo sapiens
tagataaagggtgattgcttatcaaaacaggaatgcgttctatatttgtatttaatcaaacatgccctgttttagtgttgaagcatgccacattcatctg

SEQ ID NO: 23876 - DNA, 99 bp, Homo sapiens
gtagtagcttttgaaatccttgggcattcaagttggctaattttttcattttataagaggaaggttgggacagctgatatctatttacagaggttctac

SEQ ID NO: 23877 - DNA, 58 bp, Homo sapiens
tgagacggagtctcactctgtcacccaggctggagtgcagtggtgtgatctcgggtca

SEQ ID NO: 23878 - DNA, 67 bp, Homo sapiens
aagtacatgctctgactctctgtgtgtgtagcaagtagcagcccttatgggagtcagagaggtggtt

SEQ ID NO: 23879 - DNA, 95 bp, Homo sapiens; identical to SEQ ID NO: 68

SEQ ID NO: 23880 - DNA, 93 bp, Homo sapiens; identical to SEQ ID NO: 69

SEQ ID NO: 23881 - DNA, 113 bp, Homo sapiens
tgcgcagctgtgaatgggagcggctggagcaagcagctgagacagacagacagagagtatgagaaagctgctgatgaaagagctgctgaataaaactacatttcacctgtgta

SEQ ID NO: 23882 - DNA, 166 bp, Homo sapiens
atatatatatatatatatacatacatgtgtatataatatgtgtgtatatatgtgtgtgtatatatgcatatacatacatatgtatgtataaatatgtgtgtatatatgtatatatgtgtgtatatgtgtgtatgtatgcatatacgtacatatatatgtatatgca

SEQ ID NO: 23883 - DNA, 58 bp, Homo sapiens; identical to SEQ ID NO: 315

SEQ ID NO: 23884 - DNA, 70 bp, Homo sapiens
gcacatctgtgcttgtgtatatgtgtgattatatttgtaactttatatgcattattggctataggtgagc

SEQ ID NO: 23885 - DNA, 83 bp, Homo sapiens
ctggaaagagagcagaggcaccaggcagagaagtatctttttttattttttttttgagacggagtttcactcttgttgcccag

SEQ ID NO: 23886 - DNA, 118 bp, Homo sapiens
gatacatcacctgttgatagcccaaaatcaaatagtatgaggttcttgtaaactctggggacagaaggcagagagctcagatacttgagcagaaaggggcagttgaacagaaaagatc

SEQ ID NO: 23887 - DNA, 105 bp, Homo sapiens
gcagaagccatatcatgcagtgacagtagagggcaagggagcacgatacaaaataaagcaattccttgcaaatctcagtgtttctgttgtgtgtgagaatgtgct

SEQ ID NO: 23888 - DNA, 88 bp, Homo sapiens
gtcttgttagagctttgactctttttctctctgtcctatagcttggggacataggatcaggagagagatagtaagaagataagtagac

SEQ ID NO: 23889 - DNA, 95 bp, Homo sapiens
accagagaccagcactgccagaaaggtatcacacacacacacacacacacacacacacacacacacacactttggtagtgttgtcatctactggt

SEQ ID NO: 23890 - DNA, 70 bp, Homo sapiens
tgtggagacagaaattgggaactgaatgagaaaaacaactatagtcagctctctctctctctctctcaca

SEQ ID NO: 23891 - DNA, 93 bp, Homo sapiens
tggtgcctccgtctcccgagtagctgggactataggtgcacgtcaggatgcctggataatttctatatttttagtacaggtgggatttcacca

SEQ ID NO: 23892 - DNA, 104 bp, Homo sapiens
catacatgtatatatacatatatggtaatgtatgcatatacatacatgtatatatacatatatagtaatatatgcgtatacatacatgtatatatacatatatg

SEQ ID NO: 23893 - DNA, 101 bp, Homo sapiens
gtatatatacatgtatgtatacgcatatattactatatatgtatatatacatgtatgtatatgcatacattaccatatatgtatatatacatgtatgtata

SEQ ID NO: 23894 - DNA, 115 bp, Homo sapiens
agtaaaaggatatattccccatagatgcttatgtctccagagaagttagagtgctgttgaaagtactgacattctgggtagctcacacctcatttagggaaggatccttagagct

SEQ ID NO: 23895 - DNA, 67 bp, Homo sapiens
gctgagtgagtgatgagtgggtggacgaaccaatagtaggaacatgctacacctactgtaacttggc

SEQ ID NO: 23896 - DNA, 80 bp, Homo sapiens
ctccccacaggctccagcagggctttcctgccaggtgtagggcacaggaatggctctgtctgtctctcaggtagagggag

SEQ ID NO: 23897 - DNA, 75 bp, Homo sapiens
cctctgtttctgtctctgtgattaggatatccacagagtctgtggactagagtgtaggagcaggggctagagagg

SEQ ID NO: 23898 - DNA, 83 bp, Homo sapiens
ctgtgtgtgtgtgtgtctacgtgtaagccctgaagtataaggcagcagtgagtgaggtcactggtcatagaatgagcagatag

SEQ ID NO: 23899 - DNA, 98 bp, Homo sapiens
ctgatcatcaatgaagtgaaatatctctatatgtttattagtcatatatgtttattctattaaatgtatggtcatatgttttgctcattttctgttgg

SEQ ID NO: 23900 - DNA, 105 bp, Homo sapiens
ttttaatatagctgggattgattttggctatatattgagatgtgtccaattgcacttatttttctttatatagatacccaattttcctatcaccatttattgaaa

SEQ ID NO: 23901 - DNA, 82 bp, Homo sapiens
gtgggattctgacataagacactgcataaaagctcaacacacatgccctatagtcagtgtctgtgattctctggaatcaaac

SEQ ID NO: 23902 - DNA, 59 bp, Homo sapiens
acagaatgagaccctgtctttttttttttttttttttttgagatggagtctcactctgt

SEQ ID NO: 23903 - DNA, 79 bp, Homo sapiens
tctctcaggttaagcctgactgtctttgtctctgagttacacaggaaggagagagcaggccgcaggcagaacatgaaga

SEQ ID NO: 23904 - DNA, 108 bp, Homo sapiens
ttcctttcatatttgactgccattgagtggtcttttgagttgagagagattgagggatgtctctcatttttagagggtgaattggttaactataatgctggaaaggga

SEQ ID NO: 23905 - DNA, 85 bp, Homo sapiens
ctgcagcctcaacctcccagctgtatgaccttgaattgaacacctctttttgagatggggtctcaccctgtgactcaggctgcag

SEQ ID NO: 23906 - DNA, 74 bp, Homo sapiens
gtgtccaaaaaaaaaatatatatatatatatatatatatgcatgtgtgtatatatatatatgcaagaaatacac

SEQ ID NO: 23907 - DNA, 78 bp, Homo sapiens
gattataaaaagagtatatatatacatgtgtgcatgtatatgtatatatatgtgtatatatatatatttagtgtaatt

SEQ ID NO: 23908 - DNA, 64 bp, Homo sapiens
tctccctatacagcccagggcagcagtatccatgactgatgtcaggctggagatagcatggagg

SEQ ID NO: 23909 - DNA, 95 bp, Homo sapiens; identical to SEQ ID NO: 68

SEQ ID NO: 23910 - DNA, 93 bp, Homo sapiens; identical to SEQ ID NO: 69

SEQ ID NO: 23911 - DNA, 59 bp, Homo sapiens
ggaggctgagtctcattctgtcacccatgctggagtgcagtggtgtgatctcggctcac

SEQ ID NO: 23912 - DNA, 117 bp, Homo sapiens
ctgtgtctcttaattggggcatttagcccatttacatttaaggttaatattgttatgtgtgaatttgatcttttcattatgatgttagctggttattttgctcgtttgttgatgcag

SEQ ID NO: 23913 - DNA, 116 bp, Homo sapiens
actgatttttatatgttgattttgtgtcctgaaactttactgaatttgtttatcagtatttcttctaacagtttttttggtgaagtctttagggttttctgtgtataagatcatgt

SEQ ID NO: 23914 - DNA, 114 bp, Homo sapiens
gttgccacctgcgacatgatatactgtgaagttatgaattattatttttaattgacaaattataattatgtaaatttatggggtacaaggtgatgttttgatgtaggtataaat

SEQ ID NO: 23915 - DNA, 94 bp, Homo sapiens
acactgggcaggatagagcagagtgaggtcagagtgtgaagatccagcctgatgcccaaactgacgcctcttcattctcccctgctccatctgt

SEQ ID NO: 23916 - DNA, 109 bp, Homo sapiens
gatagaagcagtaaagcttgcatttagcttggaaatgttgagaagaaacatgtatacattttcatcttcatgatcctcctcacctaaagccgtgggctactggaatgtc

SEQ ID NO: 23917 - DNA, 139 bp, Homo sapiens
gtgagtgtatatctgggtgtgggaaccttatgaggagatgagtagacatagatgtagggaagtctgtctatctgtctgtctgtcttctatctatccacctatttctatctttccacttattttccctcctgcacttcct

SEQ ID NO: 23918 - DNA, 84 bp, Homo sapiens
acaggtaggtagtccagctctggggcagtgactctatgatgtcccatggtcagtctctgtctccctgtcactgcctgaccctgt

SEQ ID NO: 23919 - DNA, 97 bp, Homo sapiens; identical to SEQ ID NO: 1307

SEQ ID NO: 23920 - DNA, 88 bp, Homo sapiens; identical to SEQ ID NO: 1308

SEQ ID NO: 23921 - DNA, 81 bp, Homo sapiens; identical to SEQ ID NO: 1309

SEQ ID NO: 23922 - DNA, 77 bp, Homo sapiens; identical to SEQ ID NO: 1310

SEQ ID NO: 23923 - DNA, 84 bp, Homo sapiens; identical to SEQ ID NO: 23918

SEQ ID NO: 23924 - DNA, 78 bp, Homo sapiens
gccttttgacaggttgagaaagtactcttcatttttattttgttgagtatttttattattattagatttgtcaaatgc

SEQ ID NO: 23925 - DNA, 95 bp, Homo sapiens; identical to SEQ ID NO: 68

SEQ ID NO: 23926 - DNA, 93 bp, Homo sapiens; identical to SEQ ID NO: 69

SEQ ID NO: 23927 - DNA, 73 bp, Homo sapiens
agcctgaatggataaggtggattatatatatttttttctttttgagatagggtctcactgtgtcacctaggct

SEQ ID NO: 23928 - DNA, 89 bp, Homo sapiens
ccagcttgggaaacatagtgggaccctatctctatttaaaattttttttttctttttgagacagagtctcgctctgtcacccaggctgg

SEQ ID NO: 23929 - DNA, 92 bp, Homo sapiens
gcagtggaagtcaacatgttaattttatggatgatgtattctttatttatttaaatctggcattgatgtttatagttttgttgctttcatgc

SEQ ID NO: 23930 - DNA, 81 bp, Homo sapiens; identical to SEQ ID NO: 20499

SEQ ID NO: 23931 - DNA, 92 bp, Homo sapiens; identical to SEQ ID NO: 23929

SEQ ID NO: 23932 - DNA, 89 bp, Homo sapiens; identical to SEQ ID NO: 23928

SEQ ID NO: 23933 - DNA, 73 bp, Homo sapiens; identical to SEQ ID NO: 23927

SEQ ID NO: 23934 - DNA, 95 bp, Homo sapiens; identical to SEQ ID NO: 68

SEQ ID NO: 23935 - DNA, 93 bp, Homo sapiens; identical to SEQ ID NO: 69

SEQ ID NO: 23936 - DNA, 56 bp, Homo sapiens
tgctttatgtagggaccagccccacagggtcggtgggtctctccctgtgtgcggcg

SEQ ID NO: 23937 - DNA, 101 bp, Homo sapiens
ctaatcacagtaccctactctgtagtaaacaatagtacatatttatagtaatataactatgctttattgatttaacctaaagaatcatattactgtgttag

SEQ ID NO: 23938 - DNA, 127 bp, Homo sapiens
atatatacatatatatacacatatatacatatgtatatgtgtgtgtatatatatacatatacatatatatatataaagagactgctgaccttggttcagtggctctgtgatagcaggtgcaatgtgt

SEQ ID NO: 23939 - DNA, 58 bp, Homo sapiens; identical to SEQ ID NO: 47

SEQ ID NO: 23940 - DNA, 109 bp, Homo sapiens
gagtctcttgtgcttctcccttacttccccccaggcaaatagagtctctctctttctgtgctgagctacctggacttgggggaggggtgacatgagcactcccagggac

SEQ ID NO: 23941 - DNA, 78 bp, Homo sapiens
tagtatagtaaattgtcattgcatgttatataatagtatattaattactataatatgcaatgacaattaactgtatta

SEQ ID NO: 23942 - DNA, 94 bp, Homo sapiens
tatataatagtacatatatactatatagtatcatatatagtatatatgatactatatatgatactatatgatagtatatatgtactattatata

SEQ ID NO: 23943 - DNA, 101 bp, Homo sapiens
tcttggacattttacaatgttgtgctttaggccttcatgtggacatacagaaacagcatctgcatgtggaaattaaggctcaggtagaaatcagaacaaga

SEQ ID NO: 23944 - DNA, 58 bp, Homo sapiens
tgagatggagtctcactctgtcacccaggctggagtgcaatggtgtgatctcggctca

SEQ ID NO: 23945 - DNA, 102 bp, Homo sapiens
atatacatatataacatatatatatatatacatatattgctatatatagcctatatataatatataagctatatatgctatatatgtatatatataggctat

SEQ ID NO: 23946 - DNA, 101 bp, Homo sapiens
tgtatatatatgtgtgtatatatatacgtgtatatatatgtgtgtgtgtatatacgtgtaaatatatatgtgtatatatatataacaaatatgtatatgca

SEQ ID NO: 23947 - DNA, 91 bp, Homo sapiens
catatatacacgtatatatatacatatatacacgtctatatatacgtatatatatatacgtgtatatatatatttgtgtctgtgtaggttg

SEQ ID NO: 23948 - DNA, 91 bp, Homo sapiens
gtgtgtgcatgtgcatgtgtacgtgtgtgcgtctgcattgcttgtgtgcgtgtgtgtctgcgtgtgtgtgtgtgtgtgtatgtgtgtgtgt

SEQ ID NO: 23949 - DNA, 58 bp, Homo sapiens
tgagacagagtgtcactctgtcacccaggctggagtgcagtggtgtgacctctgctca

SEQ ID NO: 23950 - DNA, 105 bp, Homo sapiens
gtgaacatgatgaaatagtatcttttctgtgtaaagtgttctatatatttctttatagacagaacctcttacaagagataaaattgctgattttatctgaagaac

SEQ ID NO: 23951 - DNA, 113 bp, Homo sapiens
ggtggttttgatttgcatttccctgatgattagtgatgctgaacattttttatatactttttggccatttgtatttcttcttctgagaaatgtctttcagattcttttccacc

SEQ ID NO: 23952 - DNA, 95 bp, Homo sapiens; identical to SEQ ID NO: 68

SEQ ID NO: 23953 - DNA, 93 bp, Homo sapiens; identical to SEQ ID NO: 69

SEQ ID NO: 23954 - DNA, 102 bp, Homo sapiens
gtgtgtgtgtatatatatacacatatatacatatatatgtgtatgtatatgtatatatgtgtatatgtgtatgtgtgtgtgtatgtgtgtgtatatatatat

SEQ ID NO: 23955 - DNA, 109 bp, Homo sapiens
atgccttacaattattttttgggtagctcaattattctattatttttgtttgacttagaaaacagaactaagcaatatagctaatttaaaatctaaacatgaaaggtat

SEQ ID NO: 23956 - DNA, 83 bp, Homo sapiens
cagagtctctactggggtaccatctagcagagctgtgagatgacagccaccattctccagatgcccaaatggtagatccactg

SEQ ID NO: 23957 - DNA, 111 bp, Homo sapiens
ggcaatttctatttcaaatctgaatgtgtgtttatggaagaagaactttttttctttagaaaagtagagctaaaatccatttatttcagacattgcaagagtagaaattct

SEQ ID NO: 23958 - DNA, 116 bp, Homo sapiens
gttccctaggaaaaatgtatttctctgtatgatttctgttcaaaaattgtaaatgtcacaggtttaatttacaagcacttgaatttggtatcacttgcatttaaatgcatctgaac

SEQ ID NO: 23959 - DNA, 96 bp, Homo sapiens
tacttaatcttgatgagtttttatatacacctcaaaatcagcaccttcccaaaggtgttgctttatatttgtatatatcagtagcaagttcaagta

SEQ ID NO: 23960 - DNA, 101 bp, Homo sapiens
gcatttcatctttttaagcaactgtaaaatacattgtatttctaattttgcattaaatggtgttatatagaaatacaactcattttataggtttgtcttgc

SEQ ID NO: 23961 - DNA, 107 bp, Homo sapiens
tgaatatatatgttcatatatatgtatatatatatgttcatatatatgtgtatatatatgttcatatatatgttcatatatatgtatatatatatgttcatatatat

SEQ ID NO: 23962 - DNA, 66 bp, Homo sapiens
tatgtgtgtgtatatatatgtgtgtatatatatatatgtgtgcatatatatatacacacacacata

SEQ ID NO: 23963 - DNA, 91 bp, Homo sapiens
tccttgaagaagtccttcacatcgcttgtaagttggattcctaggtattttattttctttgaagcaattgtgaatgggagttcattcatga

SEQ ID NO: 23964 - DNA, 92 bp, Homo sapiens
taggataaagtgaccacatgggcaaagttaaattgttatatattttataaatataacctatttgctcatcaagtcatctgaattttttcctg

SEQ ID NO: 23965 - DNA, 118 bp, Homo sapiens
cactccagcctgggcaacgagagcgagactccgtctcaaaaaaaaagaaaaaaaaaaaaaagccttttttttttttttttttgagacaaagtctcgctctgtcccccaggctggagtg

SEQ ID NO: 23966 - DNA, 73 bp, Homo sapiens
gatgcaaagtctcaaggtctcactctgtctcccaggctggagtgcagtgacatgatcttgactcactgcagtc

SEQ ID NO: 23967 - DNA, 65 bp, Homo sapiens
tcctgtaatagtagtctcagaacacgtgactgtcacttgtgtgtctctgtgagtgactgtgtgga

SEQ ID NO: 23968 - DNA, 97 bp, Homo sapiens
aatactggctgtttcaggcagctatcagtgacatgctctaaaatgtgccctaacatgcatgtcactagattgaaaccactagtattggccttaggca

SEQ ID NO: 23969 - DNA, 66 bp, Homo sapiens
gggaggctgaggcaggagaatcccttgaacctgggaggtctctctgtctctctcagtcattatctc

SEQ ID NO: 23970 - DNA, 79 bp, Homo sapiens
gacaagagagaacagtgagaggagttggaatagatactttactgcaaatataccaggtccttgattgttaggttctgtc

SEQ ID NO: 23971 - DNA, 93 bp, Homo sapiens
ataaataaatatatgtatatgtgtatatatacgtatatatatatatagaatacgtgtatatatatatgtatatatatacgtatatatatatat

SEQ ID NO: 23972 - DNA, 80 bp, Homo sapiens
aagtcgggtggtttctttctcagtgtggctgagttcaggacttctatgggctcagaataggggagtgtgctgactggttt

SEQ ID NO: 23973 - DNA, 150 bp, Homo sapiens
gtgtatatacatatatgtttatatacatatatatgtgtgtatatatgtatgtgtatatgtgtgtgtatacacgtgtgtgtatatataaatatgtgtgttatatgtgtatatatatgtgtgtatgtgtgtgtgtatatatatatatttggc

SEQ ID NO: 23974 - DNA, 95 bp, Homo sapiens; identical to SEQ ID NO: 68

SEQ ID NO: 23975 - DNA, 93 bp, Homo sapiens; identical to SEQ ID NO: 69

SEQ ID NO: 23976 - DNA, 127 bp, Homo sapiens
tatgtatgtgtatatatatatatacacacacgtatatatatatacacacacgtatatatatacacatatatacatatatatacacacatatacacgtgtgtgtgtatatatatatgtgtgtgtatat

SEQ ID NO: 23977 - DNA, 130 bp, Homo sapiens
atagatatacacacacatatatatatacacacacacgtgtatatgtgtgtatatatatgtatatatgtgtatatatatacgtgtgtgtatatatatatacgtgtgtgtatatatatatatacacatacat

SEQ ID NO: 23978 - DNA, 102 bp, Homo sapiens
tgttttaatttcacaacttaggagcaataaataattttgagtctctggctgtcactatcagttatcgctcaacttaatattgttgaagtttagataaggaca

SEQ ID NO: 23979 - DNA, 63 bp, Homo sapiens
gtgcacaaaattatatacatatacatgtatatacatacatgtatacatatgattttgatgaac

SEQ ID NO: 23980 - DNA, 114 bp, Homo sapiens
gtgaaacttagtgatctctgcatttaaactgtaatatagcgcttgtatataagatgttggtattttatttattttttatttttatttttttgaaacagagtctcgctctgtcac

SEQ ID NO: 23981 - DNA, 90 bp, Homo sapiens
cataaagattagttctcattcagaaggaggctgaatattttgcattgagtgtcattagcgttttttttgtttgttttttgtttttttgtg

SEQ ID NO: 23982 - DNA, 112 bp, Homo sapiens
aggtggtatctcattgtggttttgatttgcagttctctaatgatcagtgatagtgacttttttttttcatatgctcgttggctgcatgaatgtcttcatttgaggagtgtct

SEQ ID NO: 23983 - DNA, 109 bp, Homo sapiens
tatgtgtgtgtgtctctatgttgtgaacaccaagacagaagaatgattgaagtattattcttcactcatttctctctgcaagttttacattgagtcataaacaatagta

SEQ ID NO: 23984 - DNA, 94 bp, Homo sapiens
gtccagccaaaacctcaaagcgtggccttatttcaaaagtgggtctttgtggatatagcttgttaagataaggtcatcctggtttagggtagat

SEQ ID NO: 23985 - DNA, 193 bp, Homo sapiens
tatgtatatatgtattatatatacatatatgtgtatacacatatataatgctatatataatgctatataatatatacatacatgtgtatatgtatatatgcatataatatatacatacatgtgtatatgtatataatatgtacatacatgtgtatatgtatataatatgtacatacatgtgtatatgtatata

SEQ ID NO: 23986 - DNA, 73 bp, Homo sapiens
tgctgctgctcactctttgtgtctgtgctacctttatgagctgtaacacccaccacaagggtctgcggcttca

SEQ ID NO: 23987 - DNA, 111 bp, Homo sapiens
aagcagaaaatctctatggaaaagtgcagggtctagtaggaaagaccatgtagaaatcactatatattgttttatttactgtcccctatgactatctgaaagacctagctt

SEQ ID NO: 23988 - DNA, 93 bp, Homo sapiens
gtaaatatgtgtatatgtaaatatatatgcatgcatatatttgtatatataaatatatacatgtgtgcatatatatgtgtatacacacacaca

SEQ ID NO: 23989 - DNA, 106 bp, Homo sapiens
tatatgccatatatatgtgtgtatatatatatatgccatatatatgtatatatatatatgccatatatatgtgtatatatatatgcacgttatatgtgtatgtgtg

SEQ ID NO: 23990 - DNA, 78 bp, Homo sapiens
ggaacacatcacattttgtatgtagtgtgtgaggtcacaagacaaagacattatagagtggcatttgagatgggtttc

SEQ ID NO: 23991 - DNA, 118 bp, Homo sapiens
gaatgtatatataaattacaagaatgtataattataaattataatactgtgtatatcaattttaatactgtatatataaattataagaatgtataacttataagaatgttatacattt

SEQ ID NO: 23992 - DNA, 96 bp, Homo sapiens
tatatatatatatatatatgcatatatatatatatgcatatatatatatatatatgcatatatatatatatgcatatatatgtgtgtgtgtgtgta

SEQ ID NO: 23993 - DNA, 75 bp, Homo sapiens
agtatacatatacatatatatatgtacatatacgtatatgtatgtatatatacatatacatgtgtgtgtgtgtct

SEQ ID NO: 23994 - DNA, 78 bp, Homo sapiens
tactgtatatatacatactatatatatatactgtatatatacatactatatatatatatactgtatatatactgtagt

SEQ ID NO: 23995 - DNA, 83 bp, Homo sapiens
tgtgtgtgtgtgtgtgtgtgtgtgtgttactaggattagctctagtttttaacatcataacagaatatgaagcacgatgcaca

SEQ ID NO: 23996 - DNA, 76 bp, Homo sapiens
tatatatatgtgtgtgtgtgtgtatatatgtgtgtgtgtatatatatctacatatgtatgtgtttatatataatac

SEQ ID NO: 23997 - DNA, 58 bp, Homo sapiens; identical to SEQ ID NO: 2248

SEQ ID NO: 23998 - DNA, 58 bp, Homo sapiens; identical to SEQ ID NO: 20501

SEQ ID NO: 23999 - DNA, 112 bp, Homo sapiens
gcctcccaaagtgctgggattacagacgtgagctaccatgcctggcccatatttctttttcttttttcttttttcaaggcagagtctcactctgtcacccaggctggagtgc

SEQ ID NO: 24000 - DNA, 58 bp, Homo sapiens
tgggacggagtctcgctctgtctcccaggctggagtgcagtggcgggatctcggctca

SEQ ID NO: 24001 - DNA, 115 bp, Homo sapiens
gaaacctgtatatatttttatgcttttatatgttattatatgttacatatatatatatatatatatatatatgtttttagtttgtagagggctatgaagataatctttgtgtttt

SEQ ID NO: 24002 - DNA, 95 bp, Homo sapiens; identical to SEQ ID NO: 68

SEQ ID NO: 24003 - DNA, 93 bp, Homo sapiens; identical to SEQ ID NO: 69

SEQ ID NO: 24004 - DNA, 103 bp, Homo sapiens
actttggacaaccagatgcttcaaaacttgctgatggtagattaacttttcatgtaactttatttattttactgttggcacacacggcatttttgtgtaaagt

SEQ ID NO: 24005 - DNA, 112 bp, Homo sapiens
ctcagcaggtccttcaggagggattccagaagaaggcattgttaccataggagctggcagctctgtgtgtgtcactgcccctgaagacctcgcagtaggacaaggtgtggag

SEQ ID NO: 24006 - DNA, 99 bp, Homo sapiens
tgagaaaaatgatgattcttaaggattgagcttcaaatgtgaatttttctattttataaggatatagcttgggttgttaagcatcaacatagcttttca

SEQ ID NO: 24007 - DNA, 73 bp, Homo sapiens
agtcaagaagatgagagagaacacaccgccctgagaatgtgggagaggaatgtttatcttcagcttcatgtct

SEQ ID NO: 24008 - DNA, 88 bp, Homo sapiens
agagatacagaggacagagaggacagaggatgagcctgggtcatggctgacattgttcaacttttaaaaattctttatttgtattttt

SEQ ID NO: 24009 - DNA, 113 bp, Homo sapiens
aaattatgaaaatgtgtatttcatgacaatgttggcctcaagagaaaatgtattaatgttaaatattaaaatattttctttgaccccgaagttcatttgtattcttctgattt

SEQ ID NO: 24010 - DNA, 80 bp, Homo sapiens
ccaaacaattaggaaagcgtggattctttcatagtatttattgagaggcgtctccacctgatctaggctgtgtttaatgg

SEQ ID NO: 24011 - DNA, 114 bp, Homo sapiens
ttacagagtgctaggattacaggattcttttgattgatttatgaaaatgtatatagggaacatatctgtatttgatgttcaaatccaaattctgtaattctgatattatggtag

SEQ ID NO: 24012 - DNA, 113 bp, Homo sapiens
gtgaattgtttctgaagttggattaggtcctatggatgacagaagatagtctgccgacttgcagatggacttcgggatctatttgcctttaccgggcttaaaatttgttttat

SEQ ID NO: 24013 - DNA, 72 bp, Homo sapiens
ctgggtgtggtggtgtgtgcctatggtcccagctattcaggaggctgaggtaggaggatcacttgagcccag

SEQ ID NO: 24014 - DNA, 116 bp, Homo sapiens
cactccagcctgggtgatggactgagactctgtctcaaagataagaaattatttttatttttacttttattttattttttcagatggagtctcgttctgtcgcccaggctggaatg

SEQ ID NO: 24015 - DNA, 77 bp, Homo sapiens
cactacagcccatccagaagttgtggggtggcggcaggggggacctctgtgaccttgtgtgtgtgtgtgtgtgtgtg

SEQ ID NO: 24016 - DNA, 58 bp, Homo sapiens; identical to SEQ ID NO: 637

SEQ ID NO: 24017 - DNA, 75 bp, Homo sapiens
ggtcagtgtgtcagatgtggcccttcacacacaagacagagaggaagaggcataaatgttcaagcagcactgatt

SEQ ID NO: 24018 - DNA, 89 bp, Homo sapiens
ccagctgtcttgagtcactttctctctgcctgagtacatcctttagtaattcacttagagtctgaaaaaagacaaatgctgatagttgg

SEQ ID NO: 24019 - DNA, 128 bp, Homo sapiens
tctctctatatatatatatatatatatatatatatatatatatatccaggaatgaaattttttttatatatatacatatatataggtatgtgtgtgtgtgtgtatatatatatagagagagagaggga

SEQ ID NO: 24020 - DNA, 84 bp, Homo sapiens
cactttggcaggcaaggggaggggacttattattattattattatttcgagatgcagtctcactctgtcgcccaggctggagtg

SEQ ID NO: 24021 - DNA, 107 bp, Homo sapiens
caatctggcaagaggtttggacaaataggacatatttttggttaagtatctgttgacggttctatagaagtttgttctaccattcttgaagcttttctgtaggtttg

SEQ ID NO: 24022 - DNA, 110 bp, Homo sapiens
ttttggtctgggccaatttgaactgttactaccacttgaaactaagcaatttttcacaatagaaacttttttttttgagatggagtctcgctctgttgcccaggctggag

SEQ ID NO: 24023 - DNA, 89 bp, Homo sapiens
ggtacgggtgtgtgtgtgtgtgtgtgtgtgtgtgagcgcgcgcgtgtgtgtgtgtgtacacgcgcgcatgtgcgctgcatgcccatgct

SEQ ID NO: 24024 - DNA, 58 bp, Homo sapiens
tctgtagtcccaagctactcaggaggctgaggtggaaggatggcttgagggaggcgga

SEQ ID NO: 24025 - DNA, 86 bp, Homo sapiens
tcagaacgttcttaaagggaataaggatggggcttttaagtaattgctttgaaagtttttatttggtgaccttttagaaatgttga

SEQ ID NO: 24026 - DNA, 107 bp, Homo sapiens
ccagttttgtttgagaatgtccttgatgaagtactaaaaatgattaattttattaaatcttgatccttgcgtgcatgcagttgtaacattctgtgcaacaagatggg

SEQ ID NO: 24027 - DNA, 102 bp, Homo sapiens
ggactatttgagtccctcacagtaatgagcttgtgtgtttttgtcattcttttttctttttttgaaaaaacaatagagtcatttaaggaagcaaaaaggtcc

SEQ ID NO: 24028 - DNA, 61 bp, Homo sapiens
gaggatcacggttgtagtgagctatgattgcacctgtgaatagccactgcacgccagcctt

SEQ ID NO: 24029 - DNA, 58 bp, Homo sapiens
tgagatagagtctcactctgtcacccaggccggagtacagtggtgccatctctgctca

SEQ ID NO: 24030 - DNA, 75 bp, Homo sapiens
gctggatggatggagtccataggaacagaaacaggttccccaaacagaactgtcctgagctcactctgtctcagt

SEQ ID NO: 24031 - DNA, 75 bp, Homo sapiens
gtattgggggaaaagagggtagacttatgggggtcacgtgttggactcctgttgactcactctcaatctctgatc

SEQ ID NO: 24032 - DNA, 73 bp, Homo sapiens
tctgaaccctgagagctaacattcttttttaaaaaatttttttttgaaatggaggctctctctgtctctcagg

SEQ ID NO: 24033 - DNA, 63 bp, Homo sapiens
gcctcctctgtccctgtctctgtcttccttacaagtagagcctcctagggtcagagagaaggc

SEQ ID NO: 24034 - DNA, 67 bp, Homo sapiens
tctctctgtgtctctgtctccatggtggaagccagcggccatgttgtgaagcagctctatggagagg

SEQ ID NO: 24035 - DNA, 117 bp, Homo sapiens
actcaagcagttcttttcaagtgtagcacatgtcctaatgggtcacactctcagcctcacctctaggggcccaccaggactttagttataggtctagaagcaaacacgggtgttggg

SEQ ID NO: 24036 - DNA, 70 bp, Homo sapiens
ttgttttgagacagagtcccactgtgtctcccaggctggagtgcagcggtgcaatcttgactcactgcaa

SEQ ID NO: 24037 - DNA, 100 bp, Homo sapiens
gctctcatgttttcttcagattcaagattcttagcttattcagccattactgaatggtgtggttgtagtttgtaaacagggtgattgacaggtctagagc

SEQ ID NO: 24038 - DNA, 73 bp, Homo sapiens
cagagacagagtgagactccatctcaaaaaaaaaaattttttttttttttgaggaaaagttattttggacctg

SEQ ID NO: 24039 - DNA, 64 bp, Homo sapiens
ctgagatggagtctctcgctctgtcgcccaggctgcaggctggagtgcagtggcatgatctcag

SEQ ID NO: 24040 - DNA, 57 bp, Homo sapiens
ggtgacagagtgagaccgtgtctttatttatttgagacagaatctctctctgtcact

SEQ ID NO: 24041 - DNA, 115 bp, Homo sapiens
agcaggcctacaattcatccttctttgctcagcaggaatctcctgagaactcagtgtgcagagtgcagcgtgggagtcctagagatgcagatgtaaaccaggggaggccccagct

SEQ ID NO: 24042 - DNA, 117 bp, Homo sapiens
cttctgcacagactgctccatggctacaggatgtgagagcctctttctttttcttttctttttttttttttttgagacggagagtctcactctgtcgcccaggctggagtgcagtgg

SEQ ID NO: 24043 - DNA, 90 bp, Homo sapiens
tctcacatccacggaactgagaccctcactgactccttgctcatccttggcaggtcactgagtcctgtcattcagtcccctggacctgga

SEQ ID NO: 24044 - DNA, 104 bp, Homo sapiens
gaagtcactttggttgttccttcacatgaacacttctctctgggtcacttctgctgacctcagtcccacccagtgcgactggaaacaacatggaaaagggcttt

SEQ ID NO: 24045 - DNA, 100 bp, Homo sapiens
cacctgagtctccagagtacctgaaactacaggcgatttctttttctttttcaaggacggtttaaaatttttttttattttagggttgggggtacatgtg

SEQ ID NO: 24046 - DNA, 73 bp, Homo sapiens
ttgctacgtgaccttggggccggcagggcgggtcgccgccaggtgtctgtgcctcagtgtctccgttctgcga

SEQ ID NO: 24047 - DNA, 83 bp, Homo sapiens
gtgggcgctctgccacacagtcacaccgtgtctccttagcccaggggccagcaaactgtggctgagggccaaacctagctcat

SEQ ID NO: 24048 - DNA, 114 bp, Homo sapiens
ttgagatgccagcaaacccctgaacagtaactctagactttttttttttttttttttttttgagagggagtcttactctgtcacccaggctggagtgcagtggcgcgatctcgg

SEQ ID NO: 24049 - DNA, 77 bp, Homo sapiens
ggcctgtagtcctagtgactcaagaggctgaggtaggaggatgccttgagcccaggagtttgaggttacagtaaacc

SEQ ID NO: 24050 - DNA, 77 bp, Homo sapiens
gctcaggagtggccactgggcagccggctttaggattaggaaagggatccctgtgtgcctgtcaggctccccagagc

SEQ ID NO: 24051 - DNA, 75 bp, Homo sapiens
gagagaggtcagtgtggacagacaggggagggctttctgaagctctgtctagtctgtgagcagggcccgtctctc

SEQ ID NO: 24052 - DNA, 69 bp, Homo sapiens
ctgcaggctgcacccggcgcatgattcccaaactctggccctgtgtgggtctgcctggggcagaggcag

SEQ ID NO: 24053 - DNA, 105 bp, Homo sapiens
gagtaggcagatatggggaaaaaactactggtaactctctctcacagtcaatgatgatggaatttaggaaaacaagtattgttttcatctatgcatatgcttctc

SEQ ID NO: 24054 - DNA, 113 bp, Homo sapiens
catgcagtgtcttgacagaaaatgggctccttctgaaatgagatgatgaagagatgctcttgtcagatgattctcaggagacggcagtagctgtttcttagacatatgccatg

SEQ ID NO: 24055 - DNA, 88 bp, Homo sapiens
ctcagagttcatggaattgaataatctggatggatattctaatttttaaaatttcttttttccatttattttaattctgcattctggg

SEQ ID NO: 24056 - DNA, 79 bp, Homo sapiens
tgagacggagtctcactctgtcacccaggctggagtgcagtggtgcgatctcagctcactgcaagctctgtcttccggg

SEQ ID NO: 24057 - DNA, 58 bp, Homo sapiens; identical to SEQ ID NO: 2540

SEQ ID NO: 24058 - DNA, 114 bp, Homo sapiens
tatatagagatatagagatatatatagatatctatatagagagatatctatatatctatatagatatctatatagatatctatatatatgtatatagatatgtagatatataga

SEQ ID NO: 24059 - DNA, 88 bp, Homo sapiens
tctatatatctctctatctctatatagatctctatatatctctatatgtatatatggagatacatagatagatagatagatagataga

SEQ ID NO: 24060 - DNA, 78 bp, Homo sapiens
gttctttgagcctgctcttcacagtggctgggattatcatacactcccactgacagtgtgtgagctttgctctgtagc

SEQ ID NO: 24061 - DNA, 65 bp, Homo sapiens
gagcctgctcttcacagtggctgggattatcatacactcccactgacagtgtgtgagctttgctc

SEQ ID NO: 24062 - DNA, 117 bp, Homo sapiens
ccagctgcctaagctcctgtgagaagttggtagatggttcatgtcctttttcctcatttttttattttatttttttttaccagggccagtcttctgcgtaggcagagtgggcagagg

SEQ ID NO: 24063 - DNA, 84 bp, Homo sapiens
gtgcacgtgtgtgtgtgggcatgcctgtgtgtgtgcctgtgtgtgcctgtgtgtgcatgtgtgtgcctgtgtgtgtgcgtgtgt

SEQ ID NO: 24064 - DNA, 83 bp, Homo sapiens
ctgtgacttttggagcattttattttcttttttctagttcaaaattttcctggaaaataatgaagtgaactcagacaccacag

SEQ ID NO: 24065 - DNA, 92 bp, Homo sapiens
ggctggaaactcaggcagaattccttctcggggaaatgaattccttctcgaggaaatctcagtttttgttcttgagatcttcagctgactgg

SEQ ID NO: 24066 - DNA, 84 bp, Homo sapiens
cacggggatcaagcagaggctctgaagatccagagacatcctggacattctctgacattctgactgtaaaaatatgccaccatg

SEQ ID NO: 24067 - DNA, 125 bp, Homo sapiens
gagaaaaaggtgtctatagcttttcattcctagccccacaggggaggcactttcagcatcactaactgcagtctccgtaggaggctggaggacaagtgagaacagcccttctcggggaacaggag

SEQ ID NO: 24068 - DNA, 125 bp, Homo sapiens
cctgaagtgctgggattacaggcgtgagccactgcgcccggccttctttttttgtttttatgcccaagtcttctgagcgcttcctgagtggctcactctgtgcctggaacatgacaggacaggtc

SEQ ID NO: 24069 - DNA, 111 bp, Homo sapiens
gggcatagtggcacatgcctgtagtcttagctacttgggaggctgaggtaggaggatcccttgagcccaggagtttggggctgcagtgagccatgatgacaccactatacc

SEQ ID NO: 24070 - DNA, 110 bp, Homo sapiens
gtctctttctctttgtttgtgcttccaataaatggaatttatttcattttaaaagtgcgggttgtgtgagattcttcatttgttagaccgcgcgggtaggtagagaggac

SEQ ID NO: 24071 - DNA, 58 bp, Homo sapiens
tgagacagagactcactctgtcacccaggctggagtgcaatggcgtgatctctgctca

SEQ ID NO: 24072 - DNA, 58 bp, Homo sapiens
tgagcagagatcacgccattgcactccagcctgggtgacagagtgagtctctgtctca

SEQ ID NO: 24073 - DNA, 81 bp, Homo sapiens
tgcaattttttttttttttgagacagggtcttgctctgttgcccagactggggtaaagtggcatgatctcagctcactgca

SEQ ID NO: 24074 - DNA, 106 bp, Homo sapiens
gctctaacataccttgctgttttccttcaggtccaagtctgaacggggcaacaatactgctgtgtcagtttctctgagaaatacatgccgagaaagagttaggagc

SEQ ID NO: 24075 - DNA, 95 bp, Homo sapiens; identical to SEQ ID NO: 68

SEQ ID NO: 24076 - DNA, 93 bp, Homo sapiens; identical to SEQ ID NO: 69

SEQ ID NO: 24077 - DNA, 113 bp, Homo sapiens
aagctttgttcttttcgcttaggattgctttgtctataagggctcttttttggttccatatgaaatttaaagtagtttttttctaattctgtgaagaaagtcaatggtagctt

SEQ ID NO: 24078 - DNA, 95 bp, Homo sapiens; identical to SEQ ID NO: 68

SEQ ID NO: 24079 - DNA, 93 bp, Homo sapiens; identical to SEQ ID NO: 69

SEQ ID NO: 24080 - DNA, 58 bp, Homo sapiens; identical to SEQ ID NO: 47

SEQ ID NO: 24081 - DNA, 104 bp, Homo sapiens
caccaacaccaacatcaccaacagaaaaacccttcttggatcttttttttttttggatctttttgaagaggtctgaattggtgacatgtacagtgaagaatgtg

SEQ ID NO: 24082 - DNA, 89 bp, Homo sapiens
tatatatataatatatgtatatgtatatatgtgtatatataaaatcttatggtatatatatgttatacatacacatgtgtgtatgtata

SEQ ID NO: 24083 - DNA, 66 bp, Homo sapiens
ttgagcctatgtgtgtctctgtatgtgagatgggtctcctgaatatagcacactgatgggtcttga

SEQ ID NO: 24084 - DNA, 71 bp, Homo sapiens
agttacagacagtaagggacatcctaaagatccaggaaaggctggaatttgtcccctctctctgtgtcact

SEQ ID NO: 24085 - DNA, 103 bp, Homo sapiens
ctaggaaaatctaggtgatgactacagaaaaggaaatgaattcactatggatgttcatattctttgaaatgatttcctaggttttgcagttagattttcttgg

SEQ ID NO: 24086 - DNA, 81 bp, Homo sapiens
ttctggagctgtctggtcactgtgtggactgactgaggacccaacatgcctctgcctcccacaggtgctggagcgctggag

SEQ ID NO: 24087 - DNA, 95 bp, Homo sapiens
gcctggctcctgacctgtgtgcacacatgtgtctgtgtgcacgtatgtgtgcatgtgcttgtgcacgcatgaatgcatgtgtgtatgcacccggc

SEQ ID NO: 24088 - DNA, 134 bp, Homo sapiens
catgctgaatgtgtgtgcacatgtgcatgtgtgaatgtatgtgtgcttgtgtgtgcatgtgcatgtgaatgtgtgtgtgcatgtgcatgtatgaatgtgtgtgctcgtgggtgcatgtgcatgtgtcaatgtgt

SEQ ID NO: 24089 - DNA, 58 bp, Homo sapiens; identical to SEQ ID NO: 1409

SEQ ID NO: 24090 - DNA, 85 bp, Homo sapiens
tgtggctggaagggaaccaggcctgggttcaggggatcagactctctcactcaccgtgtctctcaggctgtcagaaaccagagcg

SEQ ID NO: 24091 - DNA, 94 bp, Homo sapiens
ggtaccacgtgcagggaccttgaaaacagattaagtgagagaagtcagtcaccaaagaccacatattacctgattccattcatctgcacggtcc

SEQ ID NO: 24092 - DNA, 76 bp, Homo sapiens
tgctttaggtctctgtcactcagtttctttccacgtaaagtgggatataaaacatctctgatgaaggattaaggta

SEQ ID NO: 24093 - DNA, 84 bp, Homo sapiens
tgctagtgccattgctgcaggctgcctccaagctcctttttttttttttttttttgagacagctctgtcgcccaggctggagta

SEQ ID NO: 24094 - DNA, 109 bp, Homo sapiens
ggtcctgcctcaggctccacttgactgatagtttctcagacttttctttttcttttttttgagaggtagtctcactctgtcacccaggctggagtgcagtggtgcgatc

SEQ ID NO: 24095 - DNA, 84 bp, Homo sapiens
agccttatctttcctatcagatacattttaattttaatatgtctcagttaagatgcagttactttgaaaggaaagaaaatggtt

SEQ ID NO: 24096 - DNA, 80 bp, Homo sapiens
tctttccttcagtgcagaggactccttaagtattttttattttttttgagatggagtctcactctgtcacccaggctgga

SEQ ID NO: 24097 - DNA, 109 bp, Homo sapiens
tcttgtcctgcgaagaattggtattttgataggcattgcattgaatctgtagatcacagtggatagtgtggtcattttaacaatattcttccaatccatgaacacaaga

SEQ ID NO: 24098 - DNA, 97 bp, Homo sapiens
gcctgctggttgcatccctctgtgtgctacagctactcagcacaggtactcctgtccctctctggctgtggcactttcgttgggcacctccctgggc

SEQ ID NO: 24099 - DNA, 61 bp, Homo sapiens
tcctaactgtctctgtggctcagatgctctactcagcatgtcgggttagactcagtgggga

SEQ ID NO: 24100 - DNA, 76 bp, Homo sapiens
cagcagaaactgactctctcacagttctgccggccagaaggctgaagtcaaggtgtgggaaggttggtttctactg

SEQ ID NO: 24101 - DNA, 90 bp, Homo sapiens
tgtcacttgtcagtgtcagtgttatgtgtgtgtcacacaatgtcacatgtgtcattcagtgtcacatatatcatgtcactgacagtcaca

SEQ ID NO: 24102 - DNA, 89 bp, Homo sapiens
ctgccccagacctctgagtggctctctctctggctccagtgtggtctccttaccagagaagacttccctcgccattccatccaaagcag

SEQ ID NO: 24103 - DNA, 73 bp, Homo sapiens
gctgcagtgcctgactccctgtgtcccaagggagggcccaggccccgggtacacacgggccccagcaggcagc

SEQ ID NO: 24104 - DNA, 133 bp, Homo sapiens
caccaatctctggtgctggactcagctgccaccactttgacaaagtctggagtgcagtgagtgaggacactaggtgatgggtggggagccccgcccgctgtggccggggttcctcacattttaaatatctgcc

SEQ ID NO: 24105 - DNA, 105 bp, Homo sapiens
ccatttgcatcaaatatctttttccagctgtttatcttgagtttatatgaatctttatatgttagatgaatctcttgaagacagcacatatttggtttgtgatgg

SEQ ID NO: 24106 - DNA, 71 bp, Homo sapiens
atgtatatgtatatgatgtatatgtatatgtatatgatatatatgtatatgtatatgatgtatatgtatat

SEQ ID NO: 24107 - DNA, 64 bp, Homo sapiens
tatatgtatatgatgtatatgtatatgtatatgatgtatatgtatatgtatatgtatatgtata

SEQ ID NO: 24108 - DNA, 81 bp, Homo sapiens
tctgattcagccctcaggagtcacttagctttgttatgttgattcagtgcagtagactgatgacagtgaggaagagtttga

SEQ ID NO: 24109 - DNA, 78 bp, Homo sapiens
ggaaggcacagcacataaggaagctggtacatggatttttccagactctgtcagtgtcttttgccattgaggtctttc

SEQ ID NO: 24110 - DNA, 88 bp, Homo sapiens
gaactccaatgtttttgtagattgaagtctttttttttttttttttttcttgagaaagggtctcactctgtcacccaggctggagtgc

SEQ ID NO: 24111 - DNA, 126 bp, Homo sapiens
tatatatatatatagatatataaagatatagatatatagatatctatatctaggtctatataagtatatatctatagatatctatatataggtctatatagatatatgtatagatatatatagata

SEQ ID NO: 24112 - DNA, 63 bp, Homo sapiens
tgagagggagtctcactctgtcacccagggtggagtgcaggggggagatcttggcaacctcca

SEQ ID NO: 24113 - DNA, 102 bp, Homo sapiens
gggcaacaagagtgaaactccgtctcaaaaaataaaaaatcttaaaacaattattattattattattattattattcaagacagagtctcattctgtctccc

SEQ ID NO: 24114 - DNA, 61 bp, Homo sapiens
ttgagacagtgtctcactctgtcaccaggctggagtacagtggtgcgatattggctctcaa

SEQ ID NO: 24115 - DNA, 133 bp, Homo sapiens
gtggtacggttagacgctgattcaaaggacataaaaattattattattgttttttgagacagagtctcactctgtcacccaggctgtagggcagtggtgtgatctcgggtcactacaacctctgcctcccggg

SEQ ID NO: 24116 - DNA, 124 bp, Homo sapiens
tgagagagtctcgctctgttttgtttgtttgtttgcttgttttttgagacagggtctcactctgtcacccaggctggagtgcagtggtgagatctaagctcactgcaatgtccacctcctgggt

SEQ ID NO: 24117 - DNA, 81 bp, Homo sapiens
ctttgtatagaagtgtgtggaattggacgagggggttgacctacacatgtggtttggtatacacatatcctcattacagag

SEQ ID NO: 24118 - DNA, 117 bp, Homo sapiens
cctgcttcggcctcccaaagtgctaggattacaggcgtgagccactgctgcaattttttttttttttttttgaggcggagtctcgcactgtctccggggctggagtgcaatggcgcg

SEQ ID NO: 24119 - DNA, 113 bp, Homo sapiens
catgcagtgtcttgacagaaaatgggctccttctgaaatgagatgataaagagatgctcttgtcagatgattctcaggagacggcagtagctgtttcttagacatatgccatg

SEQ ID NO: 24120 - DNA, 84 bp, Homo sapiens; identical to SEQ ID NO: 24066

SEQ ID NO: 24121 - DNA, 95 bp, Homo sapiens
taaacgcctacatcaaaaagacagaaagatcacaaactgatagcctaaccactgtttctttttttggtttttgtttttttgttgttgtttgtttg

SEQ ID NO: 24122 - DNA, 87 bp, Homo sapiens
gatgtagataaatatagacatagaccaaggtaaaggtgatgtccttttcccctttactgtgtgtatgtctgtgtgtgtctgtccgtc

SEQ ID NO: 24123 - DNA, 59 bp, Homo sapiens
ttgagacagggtctcactctgtcacccaggctggagtgcagtggtgtgatcccactcgg

SEQ ID NO: 24124 - DNA, 73 bp, Homo sapiens
tcccgagtagctgagactacaggcgcccgccaccacacctggctaattttttgtatttttagtagagacgggg

SEQ ID NO: 24125 - DNA, 58 bp, Homo sapiens; identical to SEQ ID NO: 16419

SEQ ID NO: 24126 - DNA, 104 bp, Homo sapiens
agatatatatatatacatgtacatatatatgtgtatatatatgtgtgtgtgtgtgtacatatatatagatgtgtgtgtatatgtgtgtgtgtgtgtgtgtgtgt

SEQ ID NO: 24127 - DNA, 119 bp, Homo sapiens
gccgagcgcggtggcaggcacctgtaatcccagctacttgggaggctgaggcagaagaattgcttgaactcagagggcagaggttgcagtgagccaagattgtatcactgcactccagc

SEQ ID NO: 24128 - DNA, 68 bp, Homo sapiens
tgagagtctcactgcctgtgtgggtcagtgccaaacatagcagcccacaagcagatgatgaaggcaca

SEQ ID NO: 24129 - DNA, 74 bp, Homo sapiens
ggagtctcactctgtcacccaggtgcaatcttggctcacagcgacctccgcctcctgggttcaagtgattctcc

SEQ ID NO: 24130 - DNA, 85 bp, Homo sapiens
gtatattcatatatatacacacatgtgtacatgtgtacttatatggaatatacgtgtgtgtgtgtgtgtgtgtgtgtgtgtgtat

SEQ ID NO: 24131 - DNA, 96 bp, Homo sapiens
gtgtatatatatggaatatacatatatatgtgtatatatatgtatatacacacatatatatgaatatacatatatatgtattccatatgtgtatat

SEQ ID NO: 24132 - DNA, 62 bp, Homo sapiens
tatgtgtgtgtgtatatatatgtatgtgtatatatgtatatatgtatatacacacacacata

SEQ ID NO: 24133 - DNA, 74 bp, Homo sapiens
tgtacacatacacatatgtatatatgtacacatacatatatgtatatatatgtacacacatgtgtatatgtaca

SEQ ID NO: 24134 - DNA, 86 bp, Homo sapiens
cttggtcacatggtccaacccgagtctttctcttacatcgtgaagtcgtaaggagtgaaggaatgtatggaagaatgtttgtcaag

SEQ ID NO: 24135 - DNA, 108 bp, Homo sapiens
tttacccagatagtgtatatatatatgtgtgtgtatatatatatgtatgtatatatatatatatatacatatatacacacacatatatatgaccatgattttcataaa

SEQ ID NO: 24136 - DNA, 105 bp, Homo sapiens
gctttgcacagagtagatgctcagtaactgttgcatgaatttttcttattaaaatgcttgcaacatcatctttattaaatttaacttctgtgcatgtaaagaagc

SEQ ID NO: 24137 - DNA, 86 bp, Homo sapiens
ggcaggaaagattaagtctgtagaatttggaaggaagtcgctggtactgtctctgtaattctctctcaggcccagaatttcttgcc

SEQ ID NO: 24138 - DNA, 111 bp, Homo sapiens
gggctctgaggctcacagcacagagtctgcagcctggggctgaagcgagagagaagacagagatttcatgcctggcgaggactccggaggctatggggctggggtgatccc

SEQ ID NO: 24139 - DNA, 96 bp, Homo sapiens
ggtggtgctttgtttctggctgattcccagcggtatcactcactcactgtgaaccttcgctgtggctgttcttggctcaataccccagcaaccatt

SEQ ID NO: 24140 - DNA, 104 bp, Homo sapiens
ctcaagtctttttgtattggagtctatttctctctctctctctctctttttttcttttttttttttttttgagaccgagtctggctctgtcgcccaggctggag

SEQ ID NO: 24141 - DNA, 150 bp, Homo sapiens
tatctatatctatctacctattctgtgtgtatatatatatgtgtgtgtgttctgtttatatatatatacacatgcatgtgtgtatatatatgttctgtttatgtatatatatacacacacaaatatatatatatgtgagctattctacat

SEQ ID NO: 24142 - DNA, 69 bp, Homo sapiens
ctcacttctctagaaaggtaaaagagcctagtccataggctttttttttttttttttctggagatggag

SEQ ID NO: 24143 - DNA, 85 bp, Homo sapiens
tttttttgaggcggagtctccctctgtcacccaggctggagtgtagtggcgcgatctcggctcactgaaagctctgcctcctggg

SEQ ID NO: 24144 - DNA, 101 bp, Homo sapiens
gcagaggctgggaagagcagaggcaggagaggcactgcataactcctctcaggcagccctctctctctggctctctgtaggtttgggcaactgctccttcc

SEQ ID NO: 24145 - DNA, 110 bp, Homo sapiens
agctttgttgtttttgcttaggattgtcttggctatatgggctcttttttggttccatatgaaatttaaagtagttttctctaattctgtgaagaaagtcaatagtagct

SEQ ID NO: 24146 - DNA, 88 bp, Homo sapiens
aggaggaagtcaaaaacaggaagaataataagctcatatgattcaatgactcagttgtgtctttctatttcaatattggcttcatcct

SEQ ID NO: 24147 - DNA, 113 bp, Homo sapiens
tttttgaatctagaaggccaagtacatatgcagagatgtaggtatggtaaagaatgactgaagactctaagctctcacctctgtctgaccttgaggcacttcctaagcaggaa

SEQ ID NO: 24148 - DNA, 108 bp, Homo sapiens
ctgagtagctgggaccacaggcacatcttaccatgtctagttaatttttgtatttttttgtagagacagggtttctccatgttgcccaggctggtctcaaactctcag

SEQ ID NO: 24149 - DNA, 74 bp, Homo sapiens
gccaggctttcaccttcattgaagctgcagcctcgtccatcagaggcacagacacaagaaacatagctctgagc

SEQ ID NO: 24150 - DNA, 117 bp, Homo sapiens
ctggctcgtcgaacacagggctgttcagctgttacaaagctcgtgtccaacctaacatcagtgtctctctctgatttccttttgcgagcttgagagctgcctgtgatacactgttgg

SEQ ID NO: 24151 - DNA, 78 bp, Homo sapiens; identical to SEQ ID NO: 24060

SEQ ID NO: 24152 - DNA, 65 bp, Homo sapiens; identical to SEQ ID NO: 24061

SEQ ID NO: 24153 - DNA, 76 bp, Homo sapiens
ctgacagcatgagcccaaatgtttttccgtagttcatcctggatcccggaaacatgggtggctgcctgcctgccag

SEQ ID NO: 24154 - DNA, 77 bp, Homo sapiens
gttacacagttgtgaaaagtcttgagtttttgttcttggggacaaagagaacataacatgaacataacaagtgtgac

SEQ ID NO: 24155 - DNA, 81 bp, Homo sapiens
ggggtatggtggggtagctctctaagtctcacagcattagagctcttttttgttgtttttagggactctctgtctctctct

SEQ ID NO: 24156 - DNA, 58 bp, Homo sapiens; identical to SEQ ID NO: 1215

SEQ ID NO: 24157 - DNA, 79 bp, Homo sapiens
tgagatggagtctcactctgtcacccaggctggagtgcagtggtgtgatctcagctcactgcaagctctgtcttctggg

SEQ ID NO: 24158 - DNA, 72 bp, Homo sapiens
ttagattacgtgtcagagggacaaacggtcgagtcaaattcgatcttatgtttttttggttttgttttttag

SEQ ID NO: 24159 - DNA, 114 bp, Homo sapiens
gtgtgaataaaatcaattatttggggacatttgctgtgtctttcataatgtgtggattggtgtttgcaaacagaatcatggttgtttaatcagatatggcccttttcttcacat

SEQ ID NO: 24160 - DNA, 89 bp, Homo sapiens
acatttaaccatggatggatctgtcagtcagtctcagttcatggtagacaagaaaggagatacatgctgacaagccgtgtaggaagtgt

SEQ ID NO: 24161 - DNA, 109 bp, Homo sapiens
tggaaaatatgggtctgcgtatatgtgtattttacaagagagattttgtagttttcacctgtactgtctcacttgtacctctcattagctttcatccatatcaaaccca

SEQ ID NO: 24162 - DNA, 90 bp, Homo sapiens
atgtcagctcaaccatagttatactgtgaggtataccagttggctcacctgctcagccgtgcagcctaggtcagtgtaaggaggggatat

SEQ ID NO: 24163 - DNA, 85 bp, Homo sapiens
ggtgagggagccgtgaactttctggagactgggtgctcactgcggggacggtaatccatcaaggtgaacgacagctttcccaacc

SEQ ID NO: 24164 - DNA, 120 bp, Homo sapiens
gcctctaaacaacagacatttatttctcaccattctggagtctgaaaagtctaagattaaggcactggcagatttcacatctgatgagggtgtgtttatcatagatggtgccttctctct

SEQ ID NO: 24165 - DNA, 116 bp, Homo sapiens
tcttcatctgtaaaatgggaatcattgtagttgtggtaattaaatgtctatatatatatatatgtatatagatcatttagcctagagcttaagacacagtaaacacccagaagata

SEQ ID NO: 24166 - DNA, 100 bp, Homo sapiens
ttgcccacagcatgtctcacttcacattcaggtgtctgtctgcatctctgtctggctcttgacagcaaacatcttgggggtcacaggtatgttgtagtaa

SEQ ID NO: 24167 - DNA, 95 bp, Homo sapiens; identical to SEQ ID NO: 580

SEQ ID NO: 24168 - DNA, 93 bp, Homo sapiens; identical to SEQ ID NO: 69

SEQ ID NO: 24169 - DNA, 114 bp, Homo sapiens
gttggatagtttaggtcctttgtatttcaatataaattttttaattatcttgttgatttcatcaaacaagtatttgggactaggattggtattacattgaatctataattcaat

SEQ ID NO: 24170 - DNA, 113 bp, Homo sapiens
gcataattccgctgctaggaatctatgtaacaaaaaatgtgcaaaatgtataaatatttataccatgatgtttattgttgcattaaatttattagttaaaaatggaagactgc

SEQ ID NO: 24171 - DNA, 91 bp, Homo sapiens
acatgtctccccacaaagagaagacccagctcagccatgtcccctttctgaaatcctggaatgttgtctggcttctcttgaagactcatgt

SEQ ID NO: 24172 - DNA, 61 bp, Homo sapiens
gagctggatgcctgtctccttgggaatagacttttttttgttttgagacagaatctcgctc

SEQ ID NO: 24173 - DNA, 91 bp, Homo sapiens
tggccctggtagaaagtgcccagggctaatctcacttcacaacccaaagcctcctttagtgagaacagtgactgggcagatgacaggacta

SEQ ID NO: 24174 - DNA, 127 bp, Homo sapiens
ttttttctgtatatatatatgtgtgtgtgtatatatatatgtgtgtgtatatatatatgtgtatatatatatatatgtgtatatatatatatatatacagaaaaaaaatatatatatatatattcac

SEQ ID NO: 24175 - DNA, 115 bp, Homo sapiens
tggtatctttatgtttaggtctagtcttggaacataggatatgctgttatttatatatttatttatttaagacaaggtctcgctctgttgcccaggctggagtacattggcacta

SEQ ID NO: 24176 - DNA, 110 bp, Homo sapiens
ggcacatccctgctcttggttctgcctgaggccctgcggtcagctgggtgacagaagagtgtcaggggcttctcccagggctgagggccgaaagggctctgcacagtgcc

SEQ ID NO: 24177 - DNA, 118 bp, Homo sapiens
ttgccttctctgggcttcagattccctatctgtatagtgtcactggctgagttcagatggagaatgaccattttggagcttgtggtttgcagaggggaagccaggccttcgggagcag

SEQ ID NO: 24178 - DNA, 71 bp, Homo sapiens
ggatggggcggggggctccctggattgtggctgggtctctccacactctccgtggcactctccctctgtgc

SEQ ID NO: 24179 - DNA, 116 bp, Homo sapiens
caccgtgcacagagagcagctggaatggtgactgcagggagtgtccgccctttctttcttttatttttttttgagatggagtctcgctgtgtcactcaggctggagtgcagtggtg

SEQ ID NO: 24180 - DNA, 72 bp, Homo sapiens
ggccttttctctctgtgtctgtgtcttcacacatccctctcttatgaggtcactgtcattggatttagggcc

SEQ ID NO: 24181 - DNA, 79 bp, Homo sapiens
gacaactgacatgttgggaaattgtacctgggaactggaaatccagtctctgtgattctctggcagtctgggcactgtc

SEQ ID NO: 24182 - DNA, 85 bp, Homo sapiens
tctgagaaagtgtgagatgtgactgtggggaggctctggaagctcttctcatctgtaccactcccccacaacataacacatcaga

SEQ ID NO: 24183 - DNA, 75 bp, Homo sapiens
ggcctcagtgagcacccccggctgtgacttgggccagccctccattcactcagccactgtctctctgaacatgcc

SEQ ID NO: 24184 - DNA, 89 bp, Homo sapiens
tcacagggcatccctctgtgtgtgtctgtgtcctaatccccccttcatataagcataccagctatattacactagggcctcccatgtga

SEQ ID NO: 24185 - DNA, 108 bp, Homo sapiens
taacagccaccccctgctatttgcggatgagcactctttcttttttttctttttttattattatactttaagttctagggtacatgtgcacaatgtgcaggtttgtta

SEQ ID NO: 24186 - DNA, 115 bp, Homo sapiens
ggaaatttccaggccactcggcgcaacctgagacactttcactctggatttttgttcttatttttaacagagccccctcgagtgacgtcgcaggccggtctcctggacacgtgcc

SEQ ID NO: 24187 - DNA, 97 bp, Homo sapiens
aagtgcacatttccttgatccttgcatgactgtgtggagcagagtgcctccaactcactttggacacatacagctaggtcaatgagatgttgcagtt

SEQ ID NO: 24188 - DNA, 98 bp, Homo sapiens
agtatctgctacagcagcagaaggtgcgatttttattttgtaagaactttctaaagtttttttgtttgtttgtttgtttgtttgtttggggggatgct

SEQ ID NO: 24189 - DNA, 78 bp, Homo sapiens
ggctcaggacactcacacactctctgaaccttgtgctgctctgggtcaggtgtgggaggtgcagcagtgagggaggcc

SEQ ID NO: 24190 - DNA, 103 bp, Homo sapiens
ggcggcatcttccccatggtctcttcctcagggacggcctctctccttggaaccctggctcagtccctctctaagtaaaacaagatcctggtttacgtgtacc

SEQ ID NO: 24191 - DNA, 117 bp, Homo sapiens
cagatgctgcccacatggcatgtgtgtgcatgtgcatgagcatgtatgtgtgcatgtgcttgtgtgtatgcgtgtgtgcctgtgtgtacacacatatatatgcatatattggagagt

SEQ ID NO: 24192 - DNA, 58 bp, Homo sapiens
tgagaccgagtctccctctgtcacccaggctggagtgaagtggcacgatctcggctca

SEQ ID NO: 24193 - DNA, 112 bp, Homo sapiens
gtgtgtgtgtgtgtgtgtgtgtgtgtgtgtgtgcgcgcatgcgcgcgtatatacacgtgtgtatgtatatatgtgtgtgtatatatatacacgtgtgtatgtatatatgtgt

SEQ ID NO: 24194 - DNA, 81 bp, Homo sapiens
cttttattgcaaggcagttaaagaatgttaacaagtattatcattgcctgggtgccttctggaagtgccttctagttctag

SEQ ID NO: 24195 - DNA, 112 bp, Homo sapiens
gttttccttggctcttccccattcatttagattttagtttgatgggtcaagtatatttctttaaaaatgtgtatctcttattgtataattgagtggaaagtgctgagagtac

SEQ ID NO: 24196 - DNA, 101 bp, Homo sapiens
ctacccgctttctcgagccctctgtcgctctctgaggctcactgtccccaggacaataattgaagttggggcggagcgcagggggccggggaggagggcgg

SEQ ID NO: 24197 - DNA, 90 bp, Homo sapiens
cagatgacctggctgacagcttgccctctgactctctctgtaggcagtgatgcttccggaagcttccatgtggcgctcagcacttttctg

SEQ ID NO: 24198 - DNA, 58 bp, Homo sapiens; identical to SEQ ID NO: 2221

SEQ ID NO: 24199 - DNA, 68 bp, Homo sapiens
tgtatctgcatctacatctgtatttgcatctatctctgtatctgcaggtctctgtatctgcatgtgca

SEQ ID NO: 24200 - DNA, 97 bp, Homo sapiens
cactgctggggaaaagataaaatgtgttgcaggtttggaaaacagtttagctgcacctcgaaaatgttaaacacagtttccacgtgacccagtcatg

SEQ ID NO: 24201 - DNA, 102 bp, Homo sapiens
ggtgcacctgttctgctagaacacttagcagaaatagagcttgccagactggaagttgctctgtgtgtgtcagtgagtgaatggtgagtgaacatgagggcc

SEQ ID NO: 24202 - DNA, 79 bp, Homo sapiens
tgtgttcataaagtgtaaagtggtgcacagtaatgtcccaggccctcatgttcactcaccattcactcactgacacaca

SEQ ID NO: 24203 - DNA, 110 bp, Homo sapiens
gctggtgtgacacgcgctgagcccctgctctgtgctgctgtctgtctgtctgtctttctcggctggtgtggcatgcgctgagcccctgctctgtgctgctgtctgtctgt

SEQ ID NO: 24204 - DNA, 70 bp, Homo sapiens
gcacgctgctcttcagggctgtcccagaccccaggcaaattagcacctgctgagtcactgtgagtgttgc

SEQ ID NO: 24205 - DNA, 76 bp, Homo sapiens
gcaactcactgctcactgtgaggactcagcctagaagcagatgtgcggagtgcccagggtgtagcaaggcctctgc

SEQ ID NO: 24206 - DNA, 61 bp, Homo sapiens
tatatatatacgtcgtgtgtgtgtgtatatatatatatatacacacacacacatatatata

SEQ ID NO: 24207 - DNA, 85 bp, Homo sapiens
tgtatatctgtatctgtatatgaatgtatatataagatataaatgtatctatatatacattcatgtacatgtatatacatatata

SEQ ID NO: 24208 - DNA, 91 bp, Homo sapiens
taagacaaaattgatgagatgtcacttctgtgatgaggtgacaaaagactgtcacttccatctctgtggcactctctctcttgacttcttg

SEQ ID NO: 24209 - DNA, 82 bp, Homo sapiens
ccttcttcagaccaggtttctctgacacactcacttcatggtagtcttctctgccatccagaaaagcctggaatgagaaagg

SEQ ID NO: 24210 - DNA, 95 bp, Homo sapiens; identical to SEQ ID NO: 68

SEQ ID NO: 24211 - DNA, 93 bp, Homo sapiens; identical to SEQ ID NO: 69

SEQ ID NO: 24212 - DNA, 82 bp, Homo sapiens
ggacagtggcagtggaaaggtggaagacatgtccctcccttctggccctcaagtcccctccctcggtctcactgtctctgct

SEQ ID NO: 24213 - DNA, 66 bp, Homo sapiens
tcaagtgaatctttagatgacagatgattggctgtttgcctaattttttgtatctatttaacttga

SEQ ID NO: 24214 - DNA, 73 bp, Homo sapiens
atgtggtttaaatatgtatatacatatatatgtacacacatatacatggaccatatatacatatttaacatat

SEQ ID NO: 24215 - DNA, 67 bp, Homo sapiens
ttattgtcaccgataagtcagtctgaagcaatttgaaattgtttctgattttaaggaatgacaatga

SEQ ID NO: 24216 - DNA, 74 bp, Homo sapiens
gtgtatatatatagtgcatgtgtgtgtgtgtgtgtgtgtatatatatatatataaagtgcatatatgtatatac

SEQ ID NO: 24217 - DNA, 99 bp, Homo sapiens
gtcaaccttgttattatttttcagattctgtgtatcattgttaatattttttcattcttgggcagtcacagactgatagagtggtgtgtcaggagaggc

SEQ ID NO: 24218 - DNA, 83 bp, Homo sapiens
gccactgcgcctggctgaaagggaattgctttttttttttttttttgagacagagtctcgcgctgtcacccaggctgaagtgc

SEQ ID NO: 24219 - DNA, 58 bp, Homo sapiens; identical to SEQ ID NO: 2224

SEQ ID NO: 24220 - DNA, 56 bp, Homo sapiens; identical to SEQ ID NO: 335

SEQ ID NO: 24221 - DNA, 73 bp, Homo sapiens
ccaagtctggggttgactgggacttttttttttttttcttttacacggagtctcgctctgtcaccgaggctgg

SEQ ID NO: 24222 - DNA, 103 bp, Homo sapiens
gtttctggttcttccgcatcttcaccaacacacattgttttctgtttttcttcttttttttaaaatggatgtgaaatggtatctgatgctggatttgatttgc

SEQ ID NO: 24223 - DNA, 81 bp, Homo sapiens
ctgtatctgtaactttctctctctctctctgtactggagtggctacgcagagtagaaaagagacctctgagcagaaagcag

SEQ ID NO: 24224 - DNA, 119 bp, Homo sapiens
ggctactgatttatgtttgttgattttgtatccgtcaactttactgaatttgttgatcagttctaacagttttttgtggagtcttcagggttttctgtgcataagatcatgtcatctgc

SEQ ID NO: 24225 - DNA, 112 bp, Homo sapiens
ttatttgattcttttatctttctcacgtgtgtatctgctttacttgtgagttttatatgttttcatgatggtaggtattttccttgtgtttccagatgtaggactctcttaa

SEQ ID NO: 24226 - DNA, 89 bp, Homo sapiens
ctctgtgcactgcctgagtatgctccctgtgtggtgtttgcgttctccagggtgcatgacccaagagagggagcacacaggaagctgag

SEQ ID NO: 24227 - DNA, 114 bp, Homo sapiens
gtccaggagcaaatatttttgcatacacaggtatgtgtacatgatacatatttatatgtattgatgctgtatctatagatgcatatgtgtgctatgtatgaggcaaatctgcgc

SEQ ID NO: 24228 - DNA, 158 bp, Homo sapiens
taccccagaggaaactgggtgatgtggacaggggtctctgggtatcatttctttcctttttttttttttttttgagatggagtctctctctctgtcgcccaggctggagtgcagtggtgtgatctcggctcactgcaagctccgcctcccgggttcac

SEQ ID NO: 24229 - DNA, 71 bp, Homo sapiens
gttgtttgagaccaagtctcactctgtcacttaggctggagtgcagcggcgtgatcttggctcactgcaac

SEQ ID NO: 24230 - DNA, 58 bp, Homo sapiens
tatgcatgtcagtgtgcacatgtgggtgggtgactgagtgtgcatgtgaatgtgcatg

SEQ ID NO: 24231 - DNA, 59 bp, Homo sapiens
ctccactctctgcctctgtcacatggcctccatccaaggacctgaagcagtgattgggg

SEQ ID NO: 24232 - DNA, 65 bp, Homo sapiens
ggaactctcagtgccaggcagaacccaagctcccacaccgggtgtctgcctgtctgactggttct

SEQ ID NO: 24233 - DNA, 74 bp, Homo sapiens
gcatgcatgtgcatgtgtgtgcgtgtgtgtctgtgtgttcatctgtgcacatgcatgtatgtgtgtgtgcatgt

SEQ ID NO: 24234 - DNA, 116 bp, Homo sapiens
ccttgccagctaattagcggtggccagtgtcatttttgtgatgttgcagctagtaatatgagcccagttgcatagtcacaaaagtgatcattggaaactgtgactgtactgcaggg

SEQ ID NO: 24235 - DNA, 95 bp, Homo sapiens
gtctgcctgcctgtctgcctgtctgcctgcctgtgtatctgcctgtctgctgtgtcagctactgcactagtccaggcaggggtgggtgggaagat

SEQ ID NO: 24236 - DNA, 78 bp, Homo sapiens
cagccacgttcacgcagcacggttcagtcagaagttcacacctcattcaacccagctgttgctaagtcagtgtggctg

SEQ ID NO: 24237 - DNA, 92 bp, Homo sapiens
agcccagtggggagcacagggctgcctgcccacgctcactggctggctcagtgccctccataggctcctgtccaccggcaggcgtgctgcgg

SEQ ID NO: 24238 - DNA, 119 bp, Homo sapiens
acccgctccctgtgcacgtctgtctgtgtctgaatttccctttttttttttttttttttttttgagatggagtttcactctcacagcccaggctggagtgcaatggcgcaatcttgggt

SEQ ID NO: 24239 - DNA, 78 bp, Homo sapiens
gaatctctctctgagtcactgcattcggtgcttttgggcatatgcccctggtggaactgctgggtcctgggctgattc

SEQ ID NO: 24240 - DNA, 78 bp, Homo sapiens
cggagccacactctgtcactgtaggggggtcgcttcttggccccaaagcaaagcctgaggatgtagcgtgcggttctg

SEQ ID NO: 24241 - DNA, 105 bp, Homo sapiens
ggatcagagtttcttcctggaccatttgcagcagtgacagcctctctgagtttctggggttttatccgtcagttgagggaatgggatggaagccatcaatggtct

SEQ ID NO: 24242 - DNA, 93 bp, Homo sapiens
gtcactcattgacagttttagaggaggggtgagtcactctgactgacagttttagaggaggggtgagtcatcctgattgacagttttagtggc

SEQ ID NO: 24243 - DNA, 93 bp, Homo sapiens
agccgctgttgtcaggcacagagaagacactcagcatcggatgagagaataaagccgtgtgcggtgtggcttcatgtctctcacaatagcgct

SEQ ID NO: 24244 - DNA, 58 bp, Homo sapiens
tgagtctgagtctcgctgtgtcacccaggctggagtgcaatggtgcagtctcagctca

SEQ ID NO: 24245 - DNA, 57 bp, Homo sapiens
gttgagacagagtctcgctcagtcactcaggctggagtgcagtggtccgatctcagc

SEQ ID NO: 24246 - DNA, 73 bp, Homo sapiens
gtcctgagccacagccggctgatagacaccatagtgaagaatccgatgggtgtctgtgacagtgtctcagggc

SEQ ID NO: 24247 - DNA, 90 bp, Homo sapiens
gtgactgcaggcaggcctcacacgctcagtgactgcaggcaggcctcgcacagcacaagtggcctctccttccctgaggtgtgcagtggc

SEQ ID NO: 24248 - DNA, 77 bp, Homo sapiens
cattgttccgggaaaggaaaagaggcggacaggatgcgcaagctgtcactctcagactctcctgcggttttgtggaa

SEQ ID NO: 24249 - DNA, 69 bp, Homo sapiens
gtatgcatgtgtgtgtatatgagtgtacgttgggtaaatgtgtgtgcatctgtatgtgcatgtgcgtgc

SEQ ID NO: 24250 - DNA, 83 bp, Homo sapiens
agagcattttgagcatgagtttactgctgattagagtgccactgtatttttttatatagtcgtgaattctactcataaaatct

SEQ ID NO: 24251 - DNA, 79 bp, Homo sapiens
cctttgctgtgcagaagccttttagcttgatgtgatctcattttatctttatttgctttggttatctgtgcttttgagg

SEQ ID NO: 24252 - DNA, 95 bp, Homo sapiens; identical to SEQ ID NO: 6311

SEQ ID NO: 24253 - DNA, 120 bp, Homo sapiens
gtgtgtacgtgctcctgtgtgtgtgtctgcataatcaagtgcatgcaaatgagtgtgtgcacacttgtgtgtgtgtacatgtgttggaatgttcacgtgggtgcgtgtgagtgtgtgtat

SEQ ID NO: 24254 - DNA, 91 bp, Homo sapiens
agatggtctggctggggcaggccctcctgagaacctgagctggcactgcccagtcctcactgtgtctctgcctgagccctgcctctccctc

SEQ ID NO: 24255 - DNA, 112 bp, Homo sapiens
gaagcctgtttatttatcttcaaatcattggtaattttgacatcatatgtatagatattcatatatatagatatgtctatctgtcgagagaggaattcatttgcatgccttc

SEQ ID NO: 24256 - DNA, 106 bp, Homo sapiens
tactctgcaggtgcatgggctgaaacagttgctatttatttgaatatttccaatcctgctccttcttcaactttcatccggtgggaactggccgcactgcagtgta

SEQ ID NO: 24257 - DNA, 93 bp, Homo sapiens
tgtcagtgaggaccgtccaggggacagccctgcactaggcaggaaattgcacacagagaggtcagtgaggactgtccaggggatagcgctgca

SEQ ID NO: 24258 - DNA, 89 bp, Homo sapiens
ggaaggaagggtgacttgggaccctcacactgactgtgcatggaaacccccgtggtccactctcctagtgaggcacctcgccctcttcc

SEQ ID NO: 24259 - DNA, 69 bp, Homo sapiens
gagacggagtctctgtcgctgagactggagggcaatggtgtgatctcagctcactgcagcctccgcctc

SEQ ID NO: 24260 - DNA, 129 bp, Homo sapiens
gtggctgattagagtctcacatttctgtgaattctttatttttattttttgagatggagtctcactctgtcacccaggctggagtgcagtggtgtgatctcggcacaccgcaacccccaccgcctgggt

SEQ ID NO: 24261 - DNA, 81 bp, Homo sapiens
ggtagaattactggatcatatggtagttctatttttaatttttcgaggatctgccatactcttttccacagtggctgtacc

SEQ ID NO: 24262 - DNA, 96 bp, Homo sapiens
acatagtgagaccttatctcttaaaaaaatgtagagtaagcatgtcaattttttttttttttttttttttttttttgagacagagtctcgctctgt

SEQ ID NO: 24263 - DNA, 78 bp, Homo sapiens
cagatgaggtgctaggatgttaagatgcggcatttatttccaaggagtattgtggattcttttcatctacttagtctg

SEQ ID NO: 24264 - DNA, 61 bp, Homo sapiens
aggggcgtcccgcgagctctgggatcctttggctctgcctctcactgtctgtggtgctcct

SEQ ID NO: 24265 - DNA, 116 bp, Homo sapiens
gttcttgtaaacacacacacagtctgcacacgttgttgcacacacagcagagtcagcaaacagacatccccgtgcagtgcggttcagggttgtgatagatgtggctgtgggagggt

SEQ ID NO: 24266 - DNA, 120 bp, Homo sapiens
ttgtgtttttctgtttttattgttattgctgtcctagtggatgtaaagtgggagtcactgtggctctgacttacatctccccgatgactgactagtaccacctttacatgattttgtgca

SEQ ID NO: 24267 - DNA, 103 bp, Homo sapiens
ttttagaaaatattttttatcaaagaggtttatttttgtttatttacgatgaggattcagatttacggagataataagccttattgagataataagtctaaaa

SEQ ID NO: 24268 - DNA, 60 bp, Homo sapiens
ctgtggaccctgctggactggcatggactggaaccgtctctgtcagtccctgggtcacag

SEQ ID NO: 24269 - DNA, 115 bp, Homo sapiens
cccagtagctgtggaccacaggcacacacagccacacccggctaattatttttccattttttttatggagacgggggtgtcactctgttgcccaggctggtctcaaattcctggg

SEQ ID NO: 24270 - DNA, 106 bp, Homo sapiens
gtgctcagtgaatccacaagctgcaggtgaaaggaggggagaggaacagcggagtatgtggctgtctctcactcagtgaatctgcactttgcacgagatgaagtac

SEQ ID NO: 24271 - DNA, 58 bp, Homo sapiens
tgagacaaaatctcactctgtcacccaggctggagtgcagtggtgtgatcttggctca

SEQ ID NO: 24272 - DNA, 91 bp, Homo sapiens
tgctaggtcaacctaacagtactgagtttgcttttcgatgaggaaaaaaaaaactgcagaaatgcaaattctcactcttctcagcttggca

SEQ ID NO: 24273 - DNA, 113 bp, Homo sapiens
tggcatttctattggatctctgagcttttatctgaaattaaactgtataaatgtctctcctattgatgacattactaagcatttcagaaaatggtggaaatatttaggagtca

SEQ ID NO: 24274 - DNA, 113 bp, Homo sapiens
aggtactaataactgtggcaaactaggtcatttcagattgaaaatctatatcaaaaatcagcaaagtatgggtcaagcctggtctgctgcctattttgtaatacagtattcct

SEQ ID NO: 24275 - DNA, 110 bp, Homo sapiens
tgtggaaacatcaggaatgacagcatatgatgatgcttaggacttttttttatatataaacaacctaatagcgttgtctattgtggtctttgttgattaaaagtgtcaca

SEQ ID NO: 24276 - DNA, 106 bp, Homo sapiens
atatatctatatatgtatatctatatatctatatatctatatatgtatatctatatatctatatagatatatatatatatattttttttttttttttttttgtgga

SEQ ID NO: 24277 - DNA, 84 bp, Homo sapiens
cagtcctggcctatggctctgtgcctgccagcctcattttgctggtaccccagcagtatacttccagcttgtcaggccagtctg

SEQ ID NO: 24278 - DNA, 87 bp, Homo sapiens
atgtacaaccaaggaatctcagagtctgtgtcagtcccctgccacctccatcagagctgaacccactgctgggagacttgaatacat

SEQ ID NO: 24279 - DNA, 119 bp, Homo sapiens
gacacttgagtattatatagtcatcctagaatgataaaggtttcagtggggctctctttgactgtctccttccctgacctctattatattgtctgcctttgatatctcacctagctgtt

SEQ ID NO: 24280 - DNA, 108 bp, Homo sapiens
atgattattcacaggactttattactttctttctggattatcgttaattgtttttaaatttcaatagtcttttgggtacaagtggtttttgttccatgggtgaatcgt

SEQ ID NO: 24281 - DNA, 117 bp, Homo sapiens
aggagagtttggggaactgctttatttttatattaaaacaagattgattgtaaagaagaatgcatattttacatgaattttaaaaatttcaggctggattcctcaggctataatctt

SEQ ID NO: 24282 - DNA, 61 bp, Homo sapiens
ttgagactgagtctcgctctgtcacccaggctggagtgcagtggcgcgaaagttgttttaa

SEQ ID NO: 24283 - DNA, 120 bp, Homo sapiens
tgttctttttgcttagaattgtcttggctatacaggctcttttttggttccatatgaaatttaaagtagtttttttccaattctgtgaagaaagtcaatggtagcttgatgaggatagca

SEQ ID NO: 24284 - DNA, 112 bp, Homo sapiens
tgaaggaagtgaagtgccattagactcttaaaatataatttcaaatgtatatttttgtttcttttcaaatgtatatttttgaagggtcataagaacagtttaaattgtttca

SEQ ID NO: 24285 - DNA, 76 bp, Homo sapiens
gccaggcttggtggcacgtgcctatagtcccagctactcaggaggctgaggtaggaggatcacttgagcccagggt

SEQ ID NO: 24286 - DNA, 81 bp, Homo sapiens
gtgattttcatgtgtttagtgattttcatgtgctggatcgggccagttcaaggtcctgatattcattaaaagaatgatcac

SEQ ID NO: 24287 - DNA, 77 bp, Homo sapiens
ggtgaatctgaaacttttgtcctctaaagagcctttttttttttttttttttttagagacaaggtctcactgtcacc

SEQ ID NO: 24288 - DNA, 117 bp, Homo sapiens
aagagtcaatttggaaactgaacaggagctgagctgagctactctctgactctgacattagatgtcactacaatcaaaggaaagcagagcgggcaacctagcagtgaagtgaaactt

SEQ ID NO: 24289 - DNA, 110 bp, Homo sapiens
tatatatgtcatatatgatatatagatatatatgtatatctatatatcatatagatctatatgatatagatatatatctatatatcatatcgatctatatgatatagata

SEQ ID NO: 24290 - DNA, 116 bp, Homo sapiens
taatattttcttgagcttcaaagtagatttttaaaatcagtagttattaagatttatttatattataggtaggtagctggggaatttggaaactaatgtctcataatggcatatta

SEQ ID NO: 24291 - DNA, 84 bp, Homo sapiens
tctcagagatactaagttgaagtggtcttacataagaaagtgctatcatagtttgaatatatttacaattatagtatcatgaga

SEQ ID NO: 24292 - DNA, 101 bp, Homo sapiens
agtatgtatgtatgtgtgtgtatatatatatcttcaaaattatatatagtatataatatataatccaagtatatatatgcatatatatgtacatatatatt

SEQ ID NO: 24293 - DNA, 66 bp, Homo sapiens
gttttggtgtgagacagtgtctcactccgtcacccaggatggagagtgcagtggcacaatcagagc

SEQ ID NO: 24294 - DNA, 63 bp, Homo sapiens
tgtttttgtttttttttctgagacagagtctcattctgtcacccagactggagtgcaatggca

SEQ ID NO: 24295 - DNA, 92 bp, Homo sapiens
tacagagtgtcttttgaaattatgttcttgagaaaggtaagttccctaaaaatcccaccacctcaggaacagaattttctaaaactgttgta

SEQ ID NO: 24296 - DNA, 91 bp, Homo sapiens
tgtgtgtgaaacacacatatataaacagatatatttctatatttaatgtctacattatgtgtgtatgtgtgttcatgtatgtatacacaca

SEQ ID NO: 24297 - DNA, 106 bp, Homo sapiens
tgactttcatctgcaaaaagagatgattttataagttgtcattattttgttaatttatgttaatagttttgatgctaattagccttttattttttggataaagtca

SEQ ID NO: 24298 - DNA, 90 bp, Homo sapiens
caactgtttgaggtagtatgtagatatatatatatgttaatgtgtgtgtattcatatatattgaatagtatgaaatcaaacttatagttg

SEQ ID NO: 24299 - DNA, 114 bp, Homo sapiens
tcctgagtagctgagactacagacatatgccacatgccaccgtgcctggctaatatatatatatattttttccatggagacggggtcttactatgttgatcaagctggtcttga

SEQ ID NO: 24300 - DNA, 111 bp, Homo sapiens
gtgtgtgtgtgtgtgtgcctctggccccagccctggcccatgtgtgtgtgtgtgtgtgtgtgtgcgtgtgtgtgcgcctctggtcccggccctggcccgtgtgtgtgcgcc

SEQ ID NO: 24301 - DNA, 256 bp, Homo sapiens
acatatatatatatatgtgtgtgtgtatatatatatatacgtgtatatatatatgtatatatatatatatacgtgtatatatatatgtatatatatatatatacgtgtatatatatatgtgtatatatatgtatatatatatacacacacacacatacacacatacatatatatacacacacacatatatatacatatatttgtgtatatatacgtaactgcttgtgtgtgtgcatatatatgtatacatatatgt

SEQ ID NO: 24302 - DNA, 110 bp, Homo sapiens
caccctgctgtctcccgtgccctcaaaccctcagccaccagtcggctactgcgtgcctctgtgggtctgtctgttgtgagcatttcctggaaagggagtcccgtggcctg

SEQ ID NO: 24303 - DNA, 76 bp, Homo sapiens
ggagagtcccactctcacttcctgggtcacagccgcaacccaggagaagcagagggtgtgggagaggtgctgctgc

SEQ ID NO: 24304 - DNA, 108 bp, Homo sapiens
tacttaggaatgaaattgctgtatcaggatatatatatatatatatatatatatatatatatatatatatatatatatatgttcagttttagtagatactgccaagta

SEQ ID NO: 24305 - DNA, 81 bp, Homo sapiens
gttttttaaataatctaagaaatctagttactgaagtttacatttgaaatttagtaacttttctttgattatttatctgat

SEQ ID NO: 24306 - DNA, 87 bp, Homo sapiens
ggctgcccttcatcagtgagggcacagggccagtgtgaaagccttttgtgtgcacactcgtggcttctgagctcttactcggcgtcc

SEQ ID NO: 24307 - DNA, 79 bp, Homo sapiens
ggggttcaagacttcagtgaaggaagtcaccacagatgtggtagaaatggcaagagaagtagaattagaagtggaccct

SEQ ID NO: 24308 - DNA, 72 bp, Homo sapiens
tggctgacggacacggacacactgactcccaggcgtcctgcctcgggctggttccctctgtgcttccagcca

SEQ ID NO: 24309 - DNA, 113 bp, Homo sapiens
gtgcgttcccaacacccagagtctcccagcctgtggacaaggcctctctctctccctgtgtggaggttgccctggagctctcttcacagtgctcggagcttgtcacgtgcagg

SEQ ID NO: 24310 - DNA, 111 bp, Homo sapiens
gcagaattgtgtctgcttctctagtgggcatgtctaattatttttatttgcatggaatattagtcagacatttaataattaaatatagattcacttatagaacagcaatgc

SEQ ID NO: 24311 - DNA, 117 bp, Homo sapiens
tcatttctgcatttctccttgatatatatgtgtgtgttatgtgtatgtatatatatatgtgcatatataatataaatgcatatatatttataatatgtgtggatggagagagaggta

SEQ ID NO: 24312 - DNA, 58 bp, Homo sapiens; identical to SEQ ID NO: 2263

SEQ ID NO: 24313 - DNA, 111 bp, Homo sapiens
gacttaagggtagcattgctcagaggtttttttttgagatggagtctcactctgtcaccaggctggagtgcagtggcacatctcggctcactgcaatcttgctcagaagtc

SEQ ID NO: 24314 - DNA, 99 bp, Homo sapiens
tcccttgaatgattcttcaagctccacgcatctgtggggacgttccaggtaccgccccacaatgctacctcctctttaaaagaagtcgttcagctgggg

SEQ ID NO: 24315 - DNA, 95 bp, Homo sapiens; identical to SEQ ID NO: 580

SEQ ID NO: 24316 - DNA, 93 bp, Homo sapiens; identical to SEQ ID NO: 69

SEQ ID NO: 24317 - DNA, 122 bp, Homo sapiens
tttagcaaataggtttattgagcctcattggtggagggttgacaaggatatgtaatgttattttgtctatttaacaacttacagcttatttaaactctttttcctaaatgaatcatctccct

SEQ ID NO: 24318 - DNA, 78 bp, Homo sapiens
gtcctaaagattctgattcagaaggtctcagataagtcctgagtgtctgcatctgcattttctgaggggttcttggac

SEQ ID NO: 24319 - DNA, 97 bp, Homo sapiens
ggacacaaatgaacgctcctgggcgtgagagaagtgacagtggtgccgccattttccacgtttcgttagagccgtcctggcgggtgtgaaattttcc

SEQ ID NO: 24320 - DNA, 102 bp, Homo sapiens
gtgtttcaaggtccatcaaggagagactcagagggatgattgaggaggtgtgcgctcactgtgtctgtccctgccatcatctccaaatgggattgtttgcat

SEQ ID NO: 24321 - DNA, 84 bp, Homo sapiens
atatttatatgcatataaacatatgtgcataaatatatatctacagttaggcatgtgtgcatatatttatatgtatatgtatat

SEQ ID NO: 24322 - DNA, 66 bp, Homo sapiens
atatgtgtatgagtgtgtatgtatatgtatataaatgtgcaaatacaaatatacacacacacatat

SEQ ID NO: 24323 - DNA, 73 bp, Homo sapiens
ttgttgttgttgagacggagtctcactctgtcgctcaggctggagtgcatggcgccatcacagctcactgcaa

SEQ ID NO: 24324 - DNA, 111 bp, Homo sapiens
tgtatgtttatacaaatgtatatacaaatgttatacaaatgtatatatgtttatacaaatgtatatacaaatgtttatacaaatgtgtatatatatatgtatatatataca

SEQ ID NO: 24325 - DNA, 119 bp, Homo sapiens
gtatttgtagtagagaggaggtttcaccaagtgggccaggctggtctccaactccaactccaactccaaatccaattccaggcctcaagtgatccacccacctcagcctcctaaagtgc

SEQ ID NO: 24326 - DNA, 110 bp, Homo sapiens
ataaagatctagctaacataattcagtttctacttattttgaatatatatctgtccaatttgggtccagtttggacaatttaggtgaaaactggatggctgtgtttatat

SEQ ID NO: 24327 - DNA, 71 bp, Homo sapiens
catatgtatgaatatatatatgtatgtatacatgtgtgtatgaattgtgtgtgtgtgtgtgcatgtgtgtg

SEQ ID NO: 24328 - DNA, 87 bp, Homo sapiens
gactgtggcagtgtcaccagtgcatgcttttaattattttttacttcataatggctccaaagtgcaagagtagtgatgctaacagtt

SEQ ID NO: 24329 - DNA, 145 bp, Homo sapiens
gtatgtgtgtatatttgtatgtgtgtatatacagtgtatatatgtgtatatatgtgtatatacatatatacactgtatgtatgtgtatatatgtgtatataatgtatatacacacgtgtatatatgtgcatgtgtatatacacac

SEQ ID NO: 24330 - DNA, 68 bp, Homo sapiens
gtatatacacatgtatatatgtatatctgtatatatacatatatacacacatacacatgtgtatatac

SEQ ID NO: 24331 - DNA, 175 bp, Homo sapiens
tgtctatacatatatacacgtgtatacatgtgtctatacgtatatacacatatatacatgtgtatatatgtatataatgtatatatacacaggtatatatgtgtatatatgtgtatatatgtgtatataatgtatatatacacatgtatatatgtgtatgtgtgtgtgtatgtat

SEQ ID NO: 24332 - DNA, 90 bp, Homo sapiens
tatgtgtctccatatgtgtgtctgtgtggacattcaagcatgtgtatgtgtctttctgtgtctgcatgtgcacacgtgtgtctacgtgtg

SEQ ID NO: 24333 - DNA, 108 bp, Homo sapiens
ggtccaaggacagagacttttcagtgttctagttagggttgaaatactatgtatagctgtgtaatttttttttttacccagaattgatgatgtttgagtgcatggatt

SEQ ID NO: 24334 - DNA, 88 bp, Homo sapiens
catgtgcacgtgtgttcatatgtgtatgtgtgtgcacatgcatgtctgtatgtgtgtgcgtgtgtttctgcatgtacatgtgcacatg

SEQ ID NO: 24335 - DNA, 101 bp, Homo sapiens
ggtcggtgagccttcactttggttgatatttgggtctttttttttttttttttaaacagagtctcgctctgtcatccaggctggagtgcagtagctcgatc

SEQ ID NO: 24336 - DNA, 63 bp, Homo sapiens
tctgggtgggtgcctgggtccctgtgtccatggtcctgggagaggtccctggcctcagtcaga

SEQ ID NO: 24337 - DNA, 98 bp, Homo sapiens
gatagtatttccacactgaagataatttttttatattacaggtcacagatagtatgaagcttgttaaaagttagatgtgattagtgtggatatccatc

SEQ ID NO: 24338 - DNA, 116 bp, Homo sapiens
gctcttgaatttcatttaaatggaatcatgcgtgtgtactgtatttcttaatctgacttatttcacctcattaagcatgtttttgagatctatttatgccattgacaatccggagt

SEQ ID NO: 24339 - DNA, 95 bp, Homo sapiens; identical to SEQ ID NO: 68

SEQ ID NO: 24340 - DNA, 93 bp, Homo sapiens; identical to SEQ ID NO: 69

SEQ ID NO: 24341 - DNA, 120 bp, Homo sapiens
agtgggagggctgggctgggagctgggcctttctctgggatctcagatgtccctcattctctctgggtctcagttctcctttctgctaaactttgggctcaggcctgatgaccccgggtg

SEQ ID NO: 24342 - DNA, 95 bp, Homo sapiens; identical to SEQ ID NO: 580

SEQ ID NO: 24343 - DNA, 93 bp, Homo sapiens; identical to SEQ ID NO: 69

SEQ ID NO: 24344 - DNA, 116 bp, Homo sapiens
ggctctctgaatctctgtgcttcgaatgtgatttcttttgctttttaaagaattttatatttctttacattttacatctattgtcactttatgccatttgattttatgacagggtc

SEQ ID NO: 24345 - DNA, 95 bp, Homo sapiens; identical to SEQ ID NO: 6311

SEQ ID NO: 24346 - DNA, 95 bp, Homo sapiens
cacatggtaaggactcaataaatatgtatttattgaaaaataaaataaaaggtggttttattttttattgtactttaagttctgtgatacatgtg

SEQ ID NO: 24347 - DNA, 91 bp, Homo sapiens
tgaggaaccactgaactgtttttcacagtggctctaccattttacattcccaccaacactgtgcaaaggctcccgttactccatatcctca

SEQ ID NO: 24348 - DNA, 108 bp, Homo sapiens
tacactcctatctatttggaactgtggatatgttatcagagtatatgaaaatttatctctgaatatttgtatattttccacgttctatctttgagtcctggatctgta

SEQ ID NO: 24349 - DNA, 90 bp, Homo sapiens
agcaaaggttgatcctgttgaaatatttagccacaagtcattcatatgactagagactttttgtttcatgaggtgtttacgtcctttgtt

SEQ ID NO: 24350 - DNA, 102 bp, Homo sapiens
ctagatacagaatcagattgtcagcaaggagagataatttgatgtcttcttttttatttggatttattttatttcttcctcttgcctgattgctgtagctag

SEQ ID NO: 24351 - DNA, 98 bp, Homo sapiens
caatgctcacccacagtgtgtgtgtgtgtgtgtgtgtatatatatatatatatatatatatatatatatatatatatatatatgtcttcagtgcactg

SEQ ID NO: 24352 - DNA, 99 bp, Homo sapiens
tcatatttttatggcattaagtttgaacatttttattgtaaattgacaatttataattgtatatatttatggggtacaaagtgatgttatgatttatga

SEQ ID NO: 24353 - DNA, 95 bp, Homo sapiens
ttataattgaacttatattaataagccacattaaacttattttgtacttcaaaaatatttttagtgtagcttattatgaacactcaactctatag

SEQ ID NO: 24354 - DNA, 116 bp, Homo sapiens
gacttccagtactatgttgaatagaagtggtaaaagtgggcattcttgtcttgtaccagttccaagggggaatgctttccatttatctccattcagtataatgttggctgtgggtt

SEQ ID NO: 24355 - DNA, 121 bp, Homo sapiens
atgaaggaatgggtgtttttcaactttgctaagtattctcaatgggagtgttgttagctgtttgccaaaaatgacaacatcataagcagaaggggaagttgaagtacacattttatatctt

SEQ ID NO: 24356 - DNA, 78 bp, Homo sapiens
tacatacatatacgcgtgtgtgttcacacgtacatatataaacatgtgtgtatgtgtatatatgtatatgtgtgtgta

SEQ ID NO: 24357 - DNA, 108 bp, Homo sapiens
gtgtgtatatgtgtatatgtgtgtatatatacacatatatacacatatatacatatatgtgtatatatgtatatatacacatatgtacatacatatgtatatacacac

SEQ ID NO: 24358 - DNA, 69 bp, Homo sapiens
tacatgttttatatacatgtacagatatatgtatgtatacatatgtgtatatgtatatatgtatatgta

SEQ ID NO: 24359 - DNA, 83 bp, Homo sapiens
agatctttctccaatcattttgtcctgcatgtgtgtccttacctgtaaggtggggctcttagagacagaagacagataggtct

SEQ ID NO: 24360 - DNA, 66 bp, Homo sapiens
ggcaggtctgggaaaggagaccagcttcccacatagtcttgggcctctctctctctctgggacccc

SEQ ID NO: 24361 - DNA, 95 bp, Homo sapiens; identical to SEQ ID NO: 68

SEQ ID NO: 24362 - DNA, 93 bp, Homo sapiens; identical to SEQ ID NO: 69

SEQ ID NO: 24363 - DNA, 95 bp, Homo sapiens; identical to SEQ ID NO: 68

SEQ ID NO: 24364 - DNA, 93 bp, Homo sapiens; identical to SEQ ID NO: 69

SEQ ID NO: 24365 - DNA, 95 bp, Homo sapiens; identical to SEQ ID NO: 580

SEQ ID NO: 24366 - DNA, 93 bp, Homo sapiens; identical to SEQ ID NO: 69

SEQ ID NO: 24367 - DNA, 80 bp, Homo sapiens
taaagagaaagccatatctagatagcttattttcatacagagtgaacacagagcagacaaatggtatgtggttctcttta

SEQ ID NO: 24368 - DNA, 112 bp, Homo sapiens
catagaattcttatagtagctgaaagtttatgtggaatttctggatttgtttgctttaataaaggaggaactaccatatgctgattagatgatgcagaagagggaaaaagtg

SEQ ID NO: 24369 - DNA, 58 bp, Homo sapiens
gagtctcactcactcagtgctcagtgttgcccagcctggagtgcagtggcgtgatctc

SEQ ID NO: 24370 - DNA, 58 bp, Homo sapiens
ggcgacagtatgtattctttgttttttgttttttgagacagagtctcactctgtcgcc

SEQ ID NO: 24371 - DNA, 100 bp, Homo sapiens
aaatcaaccttgtgttcctgggataaatctcatctggttttgcacataattctttttatatgttgctggatttgatttgctagtattttgtggaggattt

SEQ ID NO: 24372 - DNA, 92 bp, Homo sapiens
ggtaaagagctcctccaggacaagagctgtgctttgattttagtctctctgtgactgacccagggcccagtagtttaataggtgttctttct

SEQ ID NO: 24373 - DNA, 92 bp, Homo sapiens
ctgtgtgtgcatgagtgtgcacgtgtgtgtgtatatatatgttaaaaagtactgagccatgacaagacaccgtggacacgtaacatatttag

SEQ ID NO: 24374 - DNA, 89 bp, Homo sapiens
gacatgatgggattagtgcacttctaagaagagatactggagagctttcactctctcactcttttgcatgtgtgttctctctcttgatc

SEQ ID NO: 24375 - DNA, 58 bp, Homo sapiens
tgagacagagtctcgctctgtcgctcaggctggagtgcaatggtgtgatctcttctca

SEQ ID NO: 24376 - DNA, 72 bp, Homo sapiens
ctgatctgtgcttctgtgtggatggggatggtttcagacagaatctctctttcacacagtggccagatccag

SEQ ID NO: 24377 - DNA, 116 bp, Homo sapiens
gttggcaattactaaataagttgaactttgctccttggtgaagccatattaatttcttttttaagtaaatttgaatttcattgcagttgcaattcatgctttcagtgatatacaac

SEQ ID NO: 24378 - DNA, 56 bp, Homo sapiens
gctgaacagagatgctggatgccgaaaacagcctctgtccctgcctctctgccagc

SEQ ID NO: 24379 - DNA, 86 bp, Homo sapiens
ttgttgttgttcactatgaggagtatatcggttttaggtcacaggaatgatctagtagagatgtatttttctagtacacttgatag

SEQ ID NO: 24380 - DNA, 78 bp, Homo sapiens
cattaagaggggattgtagtatggggagttgggtagcgaaagttaagacatctctaccatctcacaccagttagaatg

SEQ ID NO: 24381 - DNA, 58 bp, Homo sapiens
tgaggcagagtctcactctgtcatccaggctagagtgcagtggtgtgatcttggctca

SEQ ID NO: 24382 - DNA, 101 bp, Homo sapiens
gtttgctgtgcactcactgccctgttgggctctctctgtggctgtgctgcccgcacagagccttgtgtgagggccgaagaggagcctgtgtccaccgctgc

SEQ ID NO: 24383 - DNA, 119 bp, Homo sapiens
gctgcctagttcctatttcttgggaaagtggcctccaggctactcatattagtttgaagagagtgatcagagtgtgcccgtgagggctgtgcttcccctgagccccggagctcctgagt

SEQ ID NO: 24384 - DNA, 78 bp, Homo sapiens
tgagacaacgaagcaagggacagagagagccacggtgttgctccagacgggcatcaggcactcggtgtctgtgtctca

SEQ ID NO: 24385 - DNA, 104 bp, Homo sapiens
tcttactttttacagtatgagatgaatataaaactagtaagagttttatattgtatagcattttattagtatctcattttatcctcactgtgaggtaagtagga

SEQ ID NO: 24386 - DNA, 112 bp, Homo sapiens
tgctcctttattttatgtaccataagaaagcaaaatttctaccactatgcaatgtatgcatgtaagaaatctgcacttgtgtcctctaaatctacatttttttaaaaaagca

SEQ ID NO: 24387 - DNA, 80 bp, Homo sapiens
cctgttgtgagtgttgaagtcattttgtgggagaatggttacttgtctcgttcgaggttgggtttaagctccacaacagg

SEQ ID NO: 24388 - DNA, 112 bp, Homo sapiens
ggattgtcttggctgtgcaggctcttttttggttccatatgaaatttaaagtagttttttctaattctgtgaagaaagtcaatggtagcttgatgggaatagcattgaatct

SEQ ID NO: 24389 - DNA, 117 bp, Homo sapiens
ccgttgaggcactgacacaggaatagggagcctgaggatgagagaagggcaccaacccctcactgaagtcagagtgctcctcgctagatgaactgtgtcttctgggtgtctgaatag

SEQ ID NO: 24390 - DNA, 113 bp, Homo sapiens
gaattgtctaaagatctcctggctcactatgctattggagaagagtttttgttgtttagttaacaatttatttctgggctggaaagggttgatgggatcagtattgatagggc

SEQ ID NO: 24391 - DNA, 112 bp, Homo sapiens
gtcagtggatatcaaacaactgtgagatttaaattgtttctaaataatgaataattcttcttttttttttctttttttttttggagacggagtcttgctctgttgcccaggc

SEQ ID NO: 24392 - DNA, 97 bp, Homo sapiens
tatatggtaagagataggggtctagttttattcttcttcatatggatagttttcccagtaccatttgttgaagagactatcctttccccattgtatg

SEQ ID NO: 24393 - DNA, 83 bp, Homo sapiens
cagcttctggtgtttgtctcctagggggttcctggtttgtgaacacgtcacctcagtctctgcctctgtcatcacacagctgc

SEQ ID NO: 24394 - DNA, 115 bp, Homo sapiens
tgttcttctttttctagttcctgaagggttagcattaagttgtttatttgagattttcttgttgttgtaaacacttattgctaaaaacttccctcttagaactggttttgctgca

SEQ ID NO: 24395 - DNA, 98 bp, Homo sapiens
tgctttgactattcagggtcttctgtgattccatataaattttgaaactttttctatttctgtggaaaaaagtcattggtattttgatagagattgca

SEQ ID NO: 24396 - DNA, 107 bp, Homo sapiens
gtcatgtcacatctttctaattctgtcagtgattagccactgtgctgcttttactcacttcacacacagacagctaagcttgtagttctatgatgaacctacatgac

SEQ ID NO: 24397 - DNA, 94 bp, Homo sapiens
cactcttaggggaagataaggtaattgtttctatttaataggcttgaagttacaggattcaattgaaagaagtggctggtttcttcctacggtg

SEQ ID NO: 24398 - DNA, 71 bp, Homo sapiens
tctcaggggtgagcttagatctttattcagactgcacttctgattcaggagagtgagcacacagcctgtga

SEQ ID NO: 24399 - DNA, 115 bp, Homo sapiens
ggttggtttggccaatgaagaatcctggcaggaagtgagagggagagaggacagtgaggtcaggctgtttattctccttcccaacagggtcatgtcaggatggctctgtccctct

SEQ ID NO: 24400 - DNA, 106 bp, Homo sapiens
gctaagcatggaaagatctggaggaagaacattctagacagagagcagattgcatctgaccctaaggcaagaatgtttgagatacagaaaagaagatcagttaggc

SEQ ID NO: 24401 - DNA, 91 bp, Homo sapiens
ccagcttgggctaacagtgagacactctcccccatctctaaaaacaattttttttttttgacacagagtctcactctgtcatttaggttgg

SEQ ID NO: 24402 - DNA, 70 bp, Homo sapiens
tgcttctgggtgcaagtgacagaagctttttttttttgagatggagtctcactctgtcacccaggctgca

SEQ ID NO: 24403 - DNA, 76 bp, Homo sapiens
cataaaggtggaactatatctatgtgtacatatatatctatatgtatctacatatagatatacctccacccttatg

SEQ ID NO: 24404 - DNA, 109 bp, Homo sapiens
agattccaatttctccacgtcattaccaacacttgttatcttttttttttgatagtagccattctaatgggtgtgaggtgatatctcattgtggttttgagttgcatct

SEQ ID NO: 24405 - DNA, 58 bp, Homo sapiens; identical to SEQ ID NO: 2224

SEQ ID NO: 24406 - DNA, 56 bp, Homo sapiens; identical to SEQ ID NO: 335

SEQ ID NO: 24407 - DNA, 71 bp, Homo sapiens
ctgattatctctgggggaggtgaggggtatgttgactgataaggggcatgagtatccttctggagtgttgg

SEQ ID NO: 24408 - DNA, 86 bp, Homo sapiens
gtagctgggactacaggtgtgtgcctctgtgtctggctgtcactcccattatatgaagcacaaactgatggatgagatcccatcac

SEQ ID NO: 24409 - DNA, 87 bp, Homo sapiens
ggtgcctagtagtcgctgggtcagtgtttgcctctcatcttaagctcgataaagtaggtgcttagaaaccagcttgtgctgggggct

SEQ ID NO: 24410 - DNA, 96 bp, Homo sapiens
atatacatacatgtgtatgtatgtatatatatatacacacacacacacacatacatgtgtgtatatatatatacacacatacgtgtgtgtgtatat

SEQ ID NO: 24411 - DNA, 58 bp, Homo sapiens
tgagtcagagtctcactctgtggctcaggctggagtgcaatggcgccatcttggctca

SEQ ID NO: 24412 - DNA, 68 bp, Homo sapiens
gtgcgtgtgtgtcaatgagcatctgcatgtgtgtacgtgaggaaatgcttgtgtgtgtgtgcacgcat

SEQ ID NO: 24413 - DNA, 68 bp, Homo sapiens
ttgttttgagacagtctcattctgtcacccaggctggggtgcagtggtgtgatcatggctcactgcaa

SEQ ID NO: 24414 - DNA, 99 bp, Homo sapiens
ggttctcactttcatgcatgcttaaatctgaaagatgatcagcaataacttgtcttttttattgagattttctagatgaagctgaaacatgtgagagct

SEQ ID NO: 24415 - DNA, 95 bp, Homo sapiens; identical to SEQ ID NO: 68

SEQ ID NO: 24416 - DNA, 93 bp, Homo sapiens; identical to SEQ ID NO: 69

SEQ ID NO: 24417 - DNA, 96 bp, Homo sapiens
tttcggagattttctaattatcgttctctgatttatttatattttaattctattgtagtcagagaacatattacatataatttgaatcctttgaaa

SEQ ID NO: 24418 - DNA, 114 bp, Homo sapiens
ctagtgcaaatttaaaaaaattcactgtggttacaaatcagtgtatctcagtgcttcatcttatcactaggactgagttcctcattgtagcccattttaatgttgcttctttag

SEQ ID NO: 24419 - DNA, 145 bp, Homo sapiens
gctgtgtcaggtatctgttttgattacatagtaatgtgaagggtaaacaactggttgtggtttttttattttttatttttttgttttttgagatggagtctcgctctgtcaccaggctggagcacagtggtgtgattttggctca

SEQ ID NO: 24420 - DNA, 95 bp, Homo sapiens
ccagcctggccaacatggtgaaacccccgtctctaatttatttatttatttatttatttatttgagatggagtctcactctgtcacgcaggctgg

SEQ ID NO: 24421 - DNA, 88 bp, Homo sapiens
taaaactggctgagcatggtgggtcatgcctgtaatctctgcagtttgggaggctgaggtagaaggatcagttgaggccaggagtttg

SEQ ID NO: 24422 - DNA, 105 bp, Homo sapiens
ccagcctgggccaggtgattgacttgtacactagaagaaccattgctttttttttttttttttttttttttttgagatagagtctcactctgtcacccaggctgg

SEQ ID NO: 24423 - DNA, 86 bp, Homo sapiens
ccacttttttttttgttttttttgagatggagtctcgctctgtctcccaggcaggagtgcagtggcgtgatcccagctcattgcaa

SEQ ID NO: 24424 - DNA, 92 bp, Homo sapiens
ttgtttttgagagggagtctcactgtgtcgctcaggctggagtgcaatggtgcaatcttggctcactgcaaccagtgcctcccgggttcaag

SEQ ID NO: 24425 - DNA, 95 bp, Homo sapiens; identical to SEQ ID NO: 68

SEQ ID NO: 24426 - DNA, 93 bp, Homo sapiens; identical to SEQ ID NO: 69

SEQ ID NO: 24427 - DNA, 99 bp, Homo sapiens
tggcttcatagtattccatggtgtatatgtgccacattttcttttttttttttaattatactttaagttttagggtacatgtgcacattgtgcaggtta

SEQ ID NO: 24428 - DNA, 91 bp, Homo sapiens
gcagggttgcaaaattacttgtgatacagaaatttagaagtgatttaatttctttattttgtttagagcttatttagtcttgtgacctggt

SEQ ID NO: 24429 - DNA, 68 bp, Homo sapiens
tgggtgacagggcaagactctgtctaaaattcttttttaattttaggcagagtctcgctctgtctcta

SEQ ID NO: 24430 - DNA, 97 bp, Homo sapiens
gttgcatcacaaaagctccttctctcactctctcagccagcaaaggtaacttgaagggttgagtccccagcagaggcggattttctatgatgttaat

SEQ ID NO: 24431 - DNA, 91 bp, Homo sapiens
gtagaagcttcctgggtccctctctgcctccctcaggacggagggcacttcccatccaaaccattaattgaggccctgcagtgcgcccagg

SEQ ID NO: 24432 - DNA, 109 bp, Homo sapiens
gccatgctgtggttcctcagattaactcccccgtctctctgagcctcagtttctcctctgggaaaacaggggtgctgggagatgggccctctgtggggcccaacctggt

SEQ ID NO: 24433 - DNA, 77 bp, Homo sapiens
tggacacagactgtctctctatggatttgcctcttctggacagttcatataaatggagtcatacagtgtgggtcaca

SEQ ID NO: 24434 - DNA, 105 bp, Homo sapiens
gccatttttactgtctcaaaggtgtggcttatcagaaacggaaaatctttctttttagataaaagaatgcatccttcagccattggtttcgagatttaaaaatgc

SEQ ID NO: 24435 - DNA, 88 bp, Homo sapiens
ctggattctcctagcattcatgatttttttttcatacaatgaattaaaattgctaaaatcatggactggctttctggttggatttcag

SEQ ID NO: 24436 - DNA, 98 bp, Homo sapiens
tgagttatttttatgcagtgttgtgctttgtttttcagatgggagtctcgctctctcacccaggctggagtatagtagcgtaatctcggctcactgca

SEQ ID NO: 24437 - DNA, 117 bp, Homo sapiens
ctgcttcagcctcctaagtagctgggattacaggtgcgtgccaccacacccggttaattattttattttattttttttgagatggtgtctcgccctgtcacccaggctggagtgcag

SEQ ID NO: 24438 - DNA, 57 bp, Homo sapiens
gctgtgtgtgtgtgtgtcagtcagagtcttactctgtcgaccaggctggagtgcagt

SEQ ID NO: 24439 - DNA, 66 bp, Homo sapiens
tgggtggatgtgcagatacacagagggctcaaaggcgcctctctgactctgtctcccaaatgccca

SEQ ID NO: 24440 - DNA, 95 bp, Homo sapiens
gtttcaagagacgaatacacagctccaaggcggggagtgggaagtcactgccgcctcacttgactgcctctctgggcctgatcgtttaaaaggac

SEQ ID NO: 24441 - DNA, 86 bp, Homo sapiens
gggcaaagcaatagggttgcttgagtgcaggagtcctatgatcatgtgagtagacactgaactccagcataggcaacatagtgccc

SEQ ID NO: 24442 - DNA, 58 bp, Homo sapiens
tgagacagggtctcactctgtcacccaggctggagtgcagtggtgggatcacagctca

SEQ ID NO: 24443 - DNA, 114 bp, Homo sapiens
ttgttgtgttctactctgagtgcttgaggtgataaaatgtttgttggttggttgttttttttcttttaagacagtgtcttgctctgtcacccaggctgaagtgcagtggcacaa

SEQ ID NO: 24444 - DNA, 79 bp, Homo sapiens
ttctgtctccctgattgtcaatgaagggttcctctaggatatattctcaggagtcaaattgttgtagagagtcacagag

SEQ ID NO: 24445 - DNA, 88 bp, Homo sapiens
tccaacctgggcaacattgtgagaccccctctctcttttttttttttttttttaagagacagagtctcactctgtcactcaggctgga

SEQ ID NO: 24446 - DNA, 93 bp, Homo sapiens
aaagagttagaaactgaactgggagaaaaaattggaattggagtacctacttccatatatatttttttctttttctttttcttttttttcttt

SEQ ID NO: 24447 - DNA, 56 bp, Homo sapiens
gagacagggtctcactctgtcactcaggctagagtgcagtggtgtgatcacggctc

SEQ ID NO: 24448 - DNA, 163 bp, Homo sapiens
gtgtgtctgtccctctcagggtcagtggtggctgcatttgctgttctgcagccagtaggagggtgaggaggggaaggggcacctgtccgtgtgtctgtccctcccaggattagtggtggctgcatctgaagccggcgggggggagaggggggcggcggggtgc

SEQ ID NO: 24449 - DNA, 60 bp, Homo sapiens
gagacacagtctcactctgtctgcactccaggctggagtgcagtggcatgatcttggctc

SEQ ID NO: 24450 - DNA, 103 bp, Homo sapiens
tcattgcactccagcctgggtggcaaagcgagactgtgtcttttttttttttttttttttttgagacagagtctcactctgctgccaggctggagtgcagtgg

SEQ ID NO: 24451 - DNA, 121 bp, Homo sapiens
gcccggctgatgagtgaaatttttttttttttttttttttttgagatggagtctcgctctctcacccaggctggagggcagtggcgcaatctcggctcactgcaagctccgcctcccgggt

SEQ ID NO: 24452 - DNA, 118 bp, Homo sapiens
atagtgacaacttctctcagcattttcttgtcaaaaaggaatatgtttctccttcatttatgaaatttagttttttttttttttggatataaaattcttggctgagagtttctctgtt

SEQ ID NO: 24453 - DNA, 90 bp, Homo sapiens
gtcaaattctaaatgtttttattataaaataaatgatctctctgatgagagagatcatttattttataataaaaacatttagaatttgac

SEQ ID NO: 24454 - DNA, 95 bp, Homo sapiens; identical to SEQ ID NO: 580

SEQ ID NO: 24455 - DNA, 93 bp, Homo sapiens; identical to SEQ ID NO: 69

SEQ ID NO: 24456 - DNA, 76 bp, Homo sapiens
atatcacttggtcatagggtatgattctttgttttttctttgagacagagtctcgctctgtcgcccaggctggtgt

SEQ ID NO: 24457 - DNA, 77 bp, Homo sapiens
ggaggttcaggtagtaggatggcttgagtacaggaggcggatgttacaagtgagcctagattgcaccactgcactcc

SEQ ID NO: 24458 - DNA, 91 bp, Homo sapiens
gagttttaaagatatgtatggatatatgtgtatatgtaaatgtgtacacacgtaatatacatatgtaatatatatatgtataatgaagatc

SEQ ID NO: 24459 - DNA, 119 bp, Homo sapiens
ggtcatctcagtgaaacctccaaatcatttgtacatgctttaagatatttcagtatatatttatgatgaaatactactcagccataaaaaggaatgaattagcagcacttgcaatgacc

SEQ ID NO: 24460 - DNA, 79 bp, Homo sapiens
gtatgtgtatatgtgtatatatatgtgtgtgtgtatatatatatgtgtgtgtgtgtgtgtgtgtacatatatatgtata

SEQ ID NO: 24461 - DNA, 95 bp, Homo sapiens; identical to SEQ ID NO: 68

SEQ ID NO: 24462 - DNA, 93 bp, Homo sapiens; identical to SEQ ID NO: 69

SEQ ID NO: 24463 - DNA, 102 bp, Homo sapiens
cctgaaactatcccctaaatgccagttcaaagagtcctccttctcacacaatgactcagtggagggaggcggcaatctgaacttgatgatggaacgacaagg

SEQ ID NO: 24464 - DNA, 98 bp, Homo sapiens
aggcgacggtgattttcccagccctgatctcactctgcctctttgtctctggggggcaggttcttggaaggagacagttttgggaagacacctccact

SEQ ID NO: 24465 - DNA, 75 bp, Homo sapiens
tccgccaacaggaagcagtgtaatagaggagaaattgacttactgtcacccactgactttctgctgtaatgtgga

SEQ ID NO: 24466 - DNA, 92 bp, Homo sapiens
gaagagtttcactgtaaaatgaagaaagcaatgaggcagtatctgtagagtcaagatttttttttcttttacaaataggtgattatctcttt

SEQ ID NO: 24467 - DNA, 82 bp, Homo sapiens
tcacctttctatggcccagagattacagccaataagtagttacctatgagagttgtctgtgtgtctggccctcacaaggaga

SEQ ID NO: 24468 - DNA, 115 bp, Homo sapiens
gcctagtagttcgactagcctgggcaacttagcaagtcctcatctctacagaatttttatttttatttttttgagacagagtctcgctctgtcgcccaggctggagtgtaatggc

SEQ ID NO: 24469 - DNA, 58 bp, Homo sapiens
tgagatggagtctcactctgtcactcaggctagagtgcagtggtgcaatcccggctca

SEQ ID NO: 24470 - DNA, 88 bp, Homo sapiens
atttcatgaaatctcaatttcttcatctgtaaaagtggaatagtaattatatccacttcgtagaaatagagcaaggattagatgaggt

SEQ ID NO: 24471 - DNA, 95 bp, Homo sapiens; identical to SEQ ID NO: 68

SEQ ID NO: 24472 - DNA, 93 bp, Homo sapiens; identical to SEQ ID NO: 69

SEQ ID NO: 24473 - DNA, 92 bp, Homo sapiens
ggcgttcagggctgtggcggcatccctgagattctgcctccgtgttcacacgggtgcttccctctgtgtctctgtatctctgagtctgtgtc

SEQ ID NO: 24474 - DNA, 95 bp, Homo sapiens; identical to SEQ ID NO: 68

SEQ ID NO: 24475 - DNA, 93 bp, Homo sapiens; identical to SEQ ID NO: 69

SEQ ID NO: 24476 - DNA, 92 bp, Homo sapiens
gctcagctccttaatttccagtgtcacacagttgtttgtaatgtagtttcttaatcaccgttgtgaaatctgtacagtgacaggttttgggc

SEQ ID NO: 24477 - DNA, 89 bp, Homo sapiens
ggctgcctcatagcttcagtattcttgtctcattcactgtgtcatgatttgctgtggtgtgacctagagtattggggagtgagagggtc

SEQ ID NO: 24478 - DNA, 101 bp, Homo sapiens
ctgtcatcataagccagaaactcccaggcagcctcttagcgctgcccagcttcccggggagcgtttgtggcctctggagtcgctgatgggcactgtcgcag

SEQ ID NO: 24479 - DNA, 76 bp, Homo sapiens
ctctctctctctctctagatatggagaaacatatatatgtatatatgtttctccatatctagagagagagagagag

SEQ ID NO: 24480 - DNA, 89 bp, Homo sapiens
tatgtgtatatatatacatatacatacacacatacatatatacatatgtatatatatttgtgtgtgcatatatatacatatatacacat

SEQ ID NO: 24481 - DNA, 97 bp, Homo sapiens
atatttgtgtgtgtatataaatgtgtatatatgtatatatatgcacacacaaatatatatacatatgtatatatgtatgtgtgtatgtatatgtata

SEQ ID NO: 24482 - DNA, 79 bp, Homo sapiens
gggctcagcaaggctgggggactgggagggaggggccgcctgtccatctctctgtctgtctgtctgtctctctgagttt

SEQ ID NO: 24483 - DNA, 57 bp, Homo sapiens
gtgagagtcagactctgtctcaaaaaaaaaaaaaaaaagaggcagattctgtctcat

SEQ ID NO: 24484 - DNA, 56 bp, Homo sapiens; identical to SEQ ID NO: 7850

SEQ ID NO: 24485 - DNA, 88 bp, Homo sapiens
tgagatggagtctcgctctgtcactcaggctggagtgcagtggcgcgatctcagctcactgcaacctctgtctcctggattcaagcga

SEQ ID NO: 24486 - DNA, 116 bp, Homo sapiens
atacatgtatatgtgctcatattcctatgtatatgtgaatacataaataaatttgatatatgtaatttatatattttcttttggggaaaatgtgacacagctgtatatacatgtgt

SEQ ID NO: 24487 - DNA, 82 bp, Homo sapiens
ttggagccctggggacctggagccgagcctacctgaacattactcatgccctttgcatggctctcccacactctttctctaa

SEQ ID NO: 24488 - DNA, 109 bp, Homo sapiens
tactttacacgtgcctagatctcaaccctcaagcccttgccccttccctgagggtcgctggtgactggagagtgtgaggcagggttgagaggcagaggtgaagtgaggg

SEQ ID NO: 24489 - DNA, 95 bp, Homo sapiens; identical to SEQ ID NO: 580

SEQ ID NO: 24490 - DNA, 93 bp, Homo sapiens; identical to SEQ ID NO: 69

SEQ ID NO: 24491 - DNA, 84 bp, Homo sapiens
gaaagatctcaattcaataattaaagtttgtatttgaatattatacttgaggtagaaactttaattattgaattgagacctttc

SEQ ID NO: 24492 - DNA, 95 bp, Homo sapiens; identical to SEQ ID NO: 68

SEQ ID NO: 24493 - DNA, 93 bp, Homo sapiens; identical to SEQ ID NO: 69

SEQ ID NO: 24494 - DNA, 79 bp, Homo sapiens
gtcctgtatcacccgctgtgtacctgtcagcaagttaccaatgccttgtggactgagttcagtgtctgtgagcaaggac

SEQ ID NO: 24495 - DNA, 95 bp, Homo sapiens; identical to SEQ ID NO: 580

SEQ ID NO: 24496 - DNA, 93 bp, Homo sapiens; identical to SEQ ID NO: 69

SEQ ID NO: 24497 - DNA, 95 bp, Homo sapiens; identical to SEQ ID NO: 68

SEQ ID NO: 24498 - DNA, 93 bp, Homo sapiens; identical to SEQ ID NO: 69

SEQ ID NO: 24499 - DNA, 112 bp, Homo sapiens
ggaagtagggtcacaggatagccaggggcccaaacaggtgggcctcacagaagtatgagtcctgacatgatgagccccactctgtgcctcactctccccattttctgcagcc

SEQ ID NO: 24500 - DNA, 99 bp, Homo sapiens
ggccagggaagatgcattttaaggaagtgatacttaagcagaggtctgaatgaaacaagagactgagcaggtgactttctgggatgtctattcctggct

SEQ ID NO: 24501 - DNA, 124 bp, Homo sapiens
cagagtactcagcagcaaacattaaggcccttagggatggtggggccacagaatgaaaggtgcctgggtccctgaatcactgcatggaagctgtccaagaaacgctttcagtggtccaagagca

SEQ ID NO: 24502 - DNA, 120 bp, Homo sapiens
ctcagaacctcttctcaggacagttgccaaatgctctttttgaaactgtgttctgaggaaagttgttttgagtcgtcgcctggggcctgatgccccaactggagacacacatgttacaat

SEQ ID NO: 24503 - DNA, 60 bp, Homo sapiens
gtgagccgagatcatgcaactgcactccagcctgggtgacagagacagactctgtctcac

SEQ ID NO: 24504 - DNA, 132 bp, Homo sapiens
ggaggaagacagcacgtttggtcttttgaggcaaagttctgagacactccgactctgagtatgatagaagtcagtgcactacagaactttgtctctagaggctgtggtcgccgatgccgccagtgctccaga

SEQ ID NO: 24505 - DNA, 74 bp, Homo sapiens
ttgagatggggtctctctctgtcacccaggctgcaacttctgcctcccaggttcaagggatcctcccacctcag

SEQ ID NO: 24506 - DNA, 89 bp, Homo sapiens
gggcagcagagctaatgggatcctgtgcttgttgctttgtgtttccacgtaggacgattacaaatcagagttactgaaaccgaatgccc

SEQ ID NO: 24507 - DNA, 116 bp, Homo sapiens
gggatcatggcggatgggaagcgggactagattgcagctcccacatggatggacagagcagtgtgtggagactcgcatcgtggttttttgctccagaactactgcaggaataaacc

SEQ ID NO: 24508 - DNA, 107 bp, Homo sapiens
tacatataccatggtatatatttttaaaaaaacatacaatggaatgtatatatatatacatatacaatggtatatattttttaaaagacatacaatggaatattgta

SEQ ID NO: 24509 - DNA, 63 bp, Homo sapiens
agtgtcactctgtctcccaggctggaatgcagtggcttgaacctgggaagcagaggtggcagt

SEQ ID NO: 24510 - DNA, 97 bp, Homo sapiens
tgggtgtctagtaagccttgattgtttctaacagactgctttggcattctctaattagcagcctcagtccctgtgtcagtctgagagctacctccca

SEQ ID NO: 24511 - DNA, 96 bp, Homo sapiens
gtagttccagctattcggtggctgaggtaggaggttcacttgagcccaggagttccaggctacagtgagctgagatcgcgccactgcactgattgc

SEQ ID NO: 24512 - DNA, 65 bp, Homo sapiens
actatagcactttttcttttttgagacggagtctcgctctatcactcaggctaaagtgcaatggt

SEQ ID NO: 24513 - DNA, 69 bp, Homo sapiens
tcagtaggcagagtttctttcttttttttttgtttgagagagagagtctcactctgtcacccaggctgg

SEQ ID NO: 24514 - DNA, 118 bp, Homo sapiens
gcttcagtttttgactttccagttccaagcagttgcctttgagttgtctgcagtatccttacattaagcccccaactccaatgctaacttaggaaagtttctcttctttaaaaccagc

SEQ ID NO: 24515 - DNA, 133 bp, Homo sapiens
cagcacgaggggactgaggaaggatctggcgaggaacaattttttttttttttttgagacagagtctcgctctgtctcccaggctggagtgcagtggcgccatctcggctcactgcaagctccgcctcctggg

SEQ ID NO: 24516 - DNA, 58 bp, Homo sapiens; identical to SEQ ID NO: 3380

SEQ ID NO: 24517 - DNA, 109 bp, Homo sapiens
tacttgatagggttttaaaactgcaagatagcgaatataatacaaaatgaagtgaatttatattttctattagaaaagcagttttaaagggggtgctttcttttatgta

SEQ ID NO: 24518 - DNA, 81 bp, Homo sapiens
gagatgggcagagttggaaagacatttcagtgagacggaaggccagtaaagcttttgtctatcagcatctgatatcattac

SEQ ID NO: 24519 - DNA, 103 bp, Homo sapiens
acagcactcaatagaatatcttgcacatatttgctactaaaaaaatatttgttctatgaatgaatgaatgaatgagtgagtgaatggtctcttcaggtgctgt

SEQ ID NO: 24520 - DNA, 84 bp, Homo sapiens
gggtggaaataattgatgttccttgtattgttttaggtgaaaatggtagaaataaatggaactgtcaaggttgtaaaccttccc

SEQ ID NO: 24521 - DNA, 84 bp, Homo sapiens
tacaaatctaagcctttatttttttttttcttctggtgcaaatcaaatgttgcaataaagaaagaagagtaggcagatactgtg

SEQ ID NO: 24522 - DNA, 118 bp, Homo sapiens
tgtatgtgtgtgtgtgtgagaagactttctgtcttcaaagtggcctttgatatgcttttatttttattttttatttttttgagacggagtctcactctgtcacccaggctggagtgca

SEQ ID NO: 24523 - DNA, 115 bp, Homo sapiens
tagggtcatcttggctatacgggttcttttttggttccatatgaaatttaaagtagttttttctaattctgtgaagaaagtcagtggtagcttgatggggatagcattgaatcta

SEQ ID NO: 24524 - DNA, 95 bp, Homo sapiens
ttggcaaattaaaagattacagtgtatttctctctcatatatatctccaaatatataagccatgcagagctgatacagtggttctactatgtcaa

SEQ ID NO: 24525 - DNA, 95 bp, Homo sapiens
ccattgctttttctgtctgtctgtcttaggtggggtctcactctgtcacacaggttggagtacaatggcacaatcacagtttgcagtctccacct

SEQ ID NO: 24526 - DNA, 105 bp, Homo sapiens
attaccaaaaggcccctagaaattgagtagacccaaggaaacaccacagcctctcactctatgtcttgtgttctgggtcaattagattctgcttgtttctgtgat

SEQ ID NO: 24527 - DNA, 58 bp, Homo sapiens
tgagttggagtctcactctgtctcccaggttggagtgcggtggcatgatctcggctca

SEQ ID NO: 24528 - DNA, 70 bp, Homo sapiens
gcgcatgtgtgtgaatgtgtatgtgcatgtggacatatgtgaccatgtgcatgtatgcatgcctgtgtgc

SEQ ID NO: 24529 - DNA, 110 bp, Homo sapiens
gtgcatttgcacaagtgcacgtttgcgtgcatgtgcgtgtgcgtatgtgtgtctctgtgtgaatgtgtgcatacatgtgggcatatgcatgtgtgcagcacatgtgtatt

SEQ ID NO: 24530 - DNA, 103 bp, Homo sapiens
gctgggtatgatgcttgtatttcacccacatgacattggatgcgcacattcactctgtgtgtgtatgcacgtttgatgcgtgaatatgcgtgcatatcaaggc

SEQ ID NO: 24531 - DNA, 83 bp, Homo sapiens
gggctgtggagtagtagaggacaactcgatggtcccaaaattcttcctccagggtgcgggtgtctctctgtctctgtgtgctc

SEQ ID NO: 24532 - DNA, 90 bp, Homo sapiens
tctctctctctctatatatatatatatatatatatacatatatatatatatacgtacatatatatatatatatgaactagttgagtgtgg

SEQ ID NO: 24533 - DNA, 73 bp, Homo sapiens
ccaggcaagttggtgtgcacctgcagtctcagctactcaggaggctgaggtgggaggatgacttgaacctagg

SEQ ID NO: 24534 - DNA, 112 bp, Homo sapiens
taggtactattataaatggaattgttttccttttagtttttagtttttggggatggagtctcactctgtcacccaggctggaatgcagttttcttaatataatttttgcttg

SEQ ID NO: 24535 - DNA, 87 bp, Homo sapiens
gcctcagttctgctttctcagtccctctgtggctggagtggcagagccacacagaagcccggggttctgatgaagccacccccaggc

SEQ ID NO: 24536 - DNA, 86 bp, Homo sapiens
gcgagaatgacgaacaggtggtttctgagtctcaagcctgagagactgagagaagagtgactgctggagtgagaagttaatattgt

SEQ ID NO: 24537 - DNA, 96 bp, Homo sapiens
gtctccctttgtgtctggtaatttttttttaactgtgagcttacatttattgtacttgatatttatgagttctaagattcctggattaaggatgat

SEQ ID NO: 24538 - DNA, 58 bp, Homo sapiens
tgagacaaggtctcactctgtcacccaggctggagtgcaatggtgcgatctcagctca

SEQ ID NO: 24539 - DNA, 79 bp, Homo sapiens
ttctgggttttgggggagtagggtttgggttttttgtttgtttgttttttgagacagagtctcgctctgtcacctaggg

SEQ ID NO: 24540 - DNA, 77 bp, Homo sapiens
aagttttatgctggcaaaaaggatggaaagggtattaaacagaagatttttttttcttttttgctgagagaaaactt

SEQ ID NO: 24541 - DNA, 72 bp, Homo sapiens
gtgtacatatgtatacgtacatgtacgtatatatacatatacgtatacatgtatatatatacatatatacac

SEQ ID NO: 24542 - DNA, 72 bp, Homo sapiens
gtgtatatatgtatatatatacatgtatacgtatatgtatatatacgtacatgtacgtatacatatgtacac

SEQ ID NO: 24543 - DNA, 114 bp, Homo sapiens
ggggcaaaattttcaagtttgtgcatccaagagaaatgttttctatgtctatatttttctaaaaagtgaaggtttagaaaaacatgcttcgaatgttaattatatgatgatccc

SEQ ID NO: 24544 - DNA, 74 bp, Homo sapiens
acatatacgtatatatctatatacatatatgtatgcaatatatagatatattttatgcatatatatgtatatgt

SEQ ID NO: 24545 - DNA, 119 bp, Homo sapiens
tgtatttatattgtcagccatgttggacagcaggtacctactaattatataggagttccttttttttttttatactttaagttctagggtacatgtgcacaacgtgcaggtttgttaca

SEQ ID NO: 24546 - DNA, 110 bp, Homo sapiens
aggcagccctgcacagacccacttccaccaatgtgttatttctctctagattctgagcacgctgctgtttctagactcatccttgttggagtggtgcagcccagatccct

SEQ ID NO: 24547 - DNA, 115 bp, Homo sapiens
ggtcaaagtgtaacttagcaatatcttggcattcagggacagacacggactcactgacaaagagtgctgttcttcccttaggtaactggtttttgtcttgcagacgctatggatc

SEQ ID NO: 24548 - DNA, 77 bp, Homo sapiens
ccctgtcagcttgattctgcataaaaataaaaagacgtccatcttttcactgtagaatgtgagctgagagcccaggg

SEQ ID NO: 24549 - DNA, 58 bp, Homo sapiens
tgagacaagttctcgctctgtcactcaggctggagtgaagtggtgtgatcttggctca

SEQ ID NO: 24550 - DNA, 130 bp, Homo sapiens
ggctttgctacacggagtgctgtgtttcggccacaggatgagaattgacaaagggcacacacacactgtttcttaattaggtttctggatgctgccacatggcacttgtcgtcagccggagctaagtcac

SEQ ID NO: 24551 - DNA, 71 bp, Homo sapiens
cccttgataggaggtcactcagtgtcagtgaaaccatgcacaataacagagagctcttccctctacaaggg

SEQ ID NO: 24552 - DNA, 83 bp, Homo sapiens
ttttcttgaggagtgtttttgttcataacaatgcctagcattagacggttaaatgatatgtggaaactgatttctcaggaaga

SEQ ID NO: 24553 - DNA, 74 bp, Homo sapiens
acacactctctctctctatatataccatatatatggtatatatataaaataccatatatatagagagagtgtgt

SEQ ID NO: 24554 - DNA, 104 bp, Homo sapiens
tctctcaactctcgagatgcatgaaagtgctgactgagcagagatggactttcttaaataggtccctcctgttcacacactcctcagccccttttcctgagaga

SEQ ID NO: 24555 - DNA, 96 bp, Homo sapiens
aaattatatatgtaattatatgtataattatatatttatatataattgtatataatatgtataattatatttgtataatatctatttatataattt

SEQ ID NO: 24556 - DNA, 58 bp, Homo sapiens
tgagacagggtctcactctgtcacccaggctggagtgcagtggtgagatcacggctca

SEQ ID NO: 24557 - DNA, 91 bp, Homo sapiens
gagcgtgtcatccttggggagagggtggtgggtaccgcgcagctgttcggtgtaactcactcacacactcccagcccctgatgaaatgttc

SEQ ID NO: 24558 - DNA, 95 bp, Homo sapiens
atatacgtatgtgtatatatacgtatgtgtatgtatacgtatacgtatgtgtatatatacgtatacgtatacgtatgtgtatatatatgtatatg

SEQ ID NO: 24559 - DNA, 91 bp, Homo sapiens
tgtgtgtatatatacccatggaaatatatacatgtgtatatatttatatacacacatatgtacattggattatgtgtataatatgcacaca

SEQ ID NO: 24560 - DNA, 67 bp, Homo sapiens
tgcctatctgtctatttatctatatctgtctacctagagagagagagggagaaagagagagaaggca

SEQ ID NO: 24561 - DNA, 106 bp, Homo sapiens
gctaacaaaggacaaacaaaggatagcacagtgcttcacagcctgggctcagaagtcagagtgcaggagcatggcaagaggcactgcacgttgtgtgaccttgggc

SEQ ID NO: 24562 - DNA, 86 bp, Homo sapiens
ggctctagacacaatgcatttcttttttatttctacgtaatgggacactctgccctgggaaattgggaagaaggcatgatccagcc

SEQ ID NO: 24563 - DNA, 58 bp, Homo sapiens
tgagatggagtctcactctgtcacccaggctggagtgcagtggtgcgatcgcagctca

SEQ ID NO: 24564 - DNA, 59 bp, Homo sapiens
gtgaccagggtgagtgatttttttttttttttttttgagatggattctcactctgtcac

SEQ ID NO: 24565 - DNA, 58 bp, Homo sapiens
tgagatggagtctcgcactgtcactcaggctggagtgcagtggtgagatctcagctca

SEQ ID NO: 24566 - DNA, 66 bp, Homo sapiens
caaagaatgactgcagtcactgagcacatactttgtgctgggtgatttacacatagtttttcagtg

SEQ ID NO: 24567 - DNA, 58 bp, Homo sapiens
tgagacggggtctcactctgtcactcaggctggagtgcagtggtgtgatctcagctca

SEQ ID NO: 24568 - DNA, 115 bp, Homo sapiens
ggtaggctgaagatctgaacagtcccagtgcggctgactctgttgctgactctcagacaggctggcttcagatcaacctctggtgctgggcaagagaaatgaacttgagttgacc

SEQ ID NO: 24569 - DNA, 105 bp, Homo sapiens
cctggcatctgctgcatggccttctcttattctctctgggtctgacacgccctcatgggctgcaggatggacagttcatgggaaggcagtgagaaatcccacagg

SEQ ID NO: 24570 - DNA, 58 bp, Homo sapiens; identical to SEQ ID NO: 18547

SEQ ID NO: 24571 - DNA, 135 bp, Homo sapiens
ttcttacctttaggtatgcctcataatttttgctgaaagttagacatgttgtagaagacagtagacatagaggtcagtatttttatgcttgaaaataagaacatctttcttactgttaggtctttattgtaggta

SEQ ID NO: 24572 - DNA, 94 bp, Homo sapiens
acatacaaatggaagaatgcagtattttttttaattttgtacctggattcactcattcaaaattatatttgtaagattcaaccatgttgtgtgt

SEQ ID NO: 24573 - DNA, 95 bp, Homo sapiens; identical to SEQ ID NO: 68

SEQ ID NO: 24574 - DNA, 93 bp, Homo sapiens; identical to SEQ ID NO: 69

SEQ ID NO: 24575 - DNA, 58 bp, Homo sapiens
tgagatggagtctcgctctgtctcccaggttggagtgcagcggtgtgatctcaactca

SEQ ID NO: 24576 - DNA, 117 bp, Homo sapiens
gttaatcgatgcatcactgtatatatgtgtgtatatacacacatatatgtacatatatttaatatatttgtgtatgtgtgtgtatatatatatatatatacttctcattatttatac

SEQ ID NO: 24577 - DNA, 113 bp, Homo sapiens
ggtcccttggctctgctctccttgccatgtggaaagtcccgtgaggcacactctgtgactgtagggggccaggctcagtttcctcatgtgtgagtcctgctgcctgagggagt

SEQ ID NO: 24578 - DNA, 81 bp, Homo sapiens
gtggcgttctccctgtgtctatgtctgtgtccaatttcttcattttataaggacaccagtcatatcgcatcaggggcccac

SEQ ID NO: 24579 - DNA, 117 bp, Homo sapiens
ttggcagctgcctgttttaaaaacaaaattttattggactgtagccacacccatttatttatatattgtttggggctgctttctcactataatggcagagttgagcaggtgcaacag

SEQ ID NO: 24580 - DNA, 94 bp, Homo sapiens
gactccgtctcaaaaaaaaaagtactagacaatgtccagactagacaaatccacagagaaagtagtctggtgattgcttagggctgggggagtt

SEQ ID NO: 24581 - DNA, 118 bp, Homo sapiens
tagacaagctaagtaggtgtaaagtagtaaacatatttgtgtatatatatgtgtgtatatatatatatacacatatatatggtatatatgtgtgtggtatgtcactgtggtgtgtgtg

SEQ ID NO: 24582 - DNA, 116 bp, Homo sapiens
gtgggaggagagagaggttagaaaggattttaaagtgttttttcaaacttggtagaaatattttttaacatattttttcttttttggatcctagaccacctttgttttttaacctt

SEQ ID NO: 24583 - DNA, 83 bp, Homo sapiens
gccaccacacctggccaaaattctttgatatttaaggaaaacttgattttttataaaaatagcaaagagccaggcagtgtagc

SEQ ID NO: 24584 - DNA, 102 bp, Homo sapiens
ttttcctgtcactgtgatgctatgttgtacaatgttatgttatgtaatgtaatgttacgtgtgccccataaaatgtatagaaaataattctgacagagaaaa

SEQ ID NO: 24585 - DNA, 82 bp, Homo sapiens
agggtaagactctgtctctaaaaataaagagtacagttctaaaacgacatttttttttttttttgagacggagtttcgctct

SEQ ID NO: 24586 - DNA, 63 bp, Homo sapiens
gcatttttctgacacatacatggacatgtatgtgtgtatatatgtatgtattagaaaacatgc

SEQ ID NO: 24587 - DNA, 132 bp, Homo sapiens
acatatatatatatgtatatatatatgacatatatatatgtcgtatatatatatgacatatatatatgtgtatatatatgacatatatatgtatatatgacatatatatgtatatatgacatatatatgtat

SEQ ID NO: 24588 - DNA, 66 bp, Homo sapiens
ttgagcctatgtgtgtctctgtatgtgagatgggtttcctgactacagcacactgatgggtcttga

SEQ ID NO: 24589 - DNA, 95 bp, Homo sapiens; identical to SEQ ID NO: 68

SEQ ID NO: 24590 - DNA, 93 bp, Homo sapiens; identical to SEQ ID NO: 69

SEQ ID NO: 24591 - DNA, 77 bp, Homo sapiens
gtgctggggaggagggtgacccacattggagcccctgcatagctggaggctgactgtgtgtgactctctctgcagac

SEQ ID NO: 24592 - DNA, 89 bp, Homo sapiens
agatacacactcactcagtgtcactttcaccgcaggcttctttctttccttgcactgtcccaggggaccttgagcggagatgtgcattt

SEQ ID NO: 24593 - DNA, 90 bp, Homo sapiens
tggtttttgtctctggttctgcttatatgctggattacgtttattgatttgcatatgttgcaccagccttgaatcccagggatgaagcca

SEQ ID NO: 24594 - DNA, 68 bp, Homo sapiens
tgtaggatggaagtgcacacactgtctctgcctgtccccagggagcaagatgtaaacttcctccttca

SEQ ID NO: 24595 - DNA, 95 bp, Homo sapiens; identical to SEQ ID NO: 68

SEQ ID NO: 24596 - DNA, 93 bp, Homo sapiens; identical to SEQ ID NO: 69

SEQ ID NO: 24597 - DNA, 116 bp, Homo sapiens
gggcatatattatgaggcatattatttatcctatccatagatgatataaaaatccaaatggactatttatttattttttattattttttgtaggctggtcttgaattcctgtgctc

SEQ ID NO: 24598 - DNA, 86 bp, Homo sapiens
ctctcagtccactgtgaccagcagatggagatgatctctggatccccaaaggattgctgtccctgagtccctgtgtgacctgacag

SEQ ID NO: 24599 - DNA, 69 bp, Homo sapiens
tccaggaagccatggaggtgatctgtgagctgagagtgaagagtgaatagttcactgatggctgatgga

SEQ ID NO: 24600 - DNA, 77 bp, Homo sapiens
aatctagctgttgctgtgaaggcattttgtaaatgtgattaacatttacaatcagttgactttaagtaaggcagatt

SEQ ID NO: 24601 - DNA, 80 bp, Homo sapiens
gactctggaaccacccatcccagctatgaatctcactgacacactaaaagtctgtgcaggagaggcaagtgtccagcttc

SEQ ID NO: 24602 - DNA, 87 bp, Homo sapiens
atgacacactgacaactggccccttcccctaggagtggacaaagggtcttgtcactccctctctgtggcccaaggttagtgtgttgt

SEQ ID NO: 24603 - DNA, 102 bp, Homo sapiens
ggtcctggaggctgtgctgtgtgtttgcactggtatgtctgatggcacttctgggtgcctcactgtctccctgtgtcacacacccacatagctgccactacc

SEQ ID NO: 24604 - DNA, 119 bp, Homo sapiens
ggaaccctgtggtcactgtgtgttcccataggagagggacagtggcattgaagtgaggctccaggagccattagcaggctagggtcctctctccttcacccagaaaagggcagggctcc

SEQ ID NO: 24605 - DNA, 103 bp, Homo sapiens
atttttttgaaaacagtgttctagaaggaaaagcggtttcctttcttttattttccttctttctttttttcctttttataacacagtgtgggctcagagaagt

SEQ ID NO: 24606 - DNA, 114 bp, Homo sapiens
ggggttgtctgggattgtatgaaagaaaattagaatcatactgtatttatatttactttggtaggttatttgtgggtggcagttttctctagttcttgggactatggcagttct

SEQ ID NO: 24607 - DNA, 134 bp, Homo sapiens
ataagcaaacatatgtatgtgtgtgtgtatatatatacatatatgtgtgtgtatatatatgtgtgtatatatatatatacacatacacatatatatgcatgtatatatatacacacacatacatatatatgcat

SEQ ID NO: 24608 - DNA, 64 bp, Homo sapiens
tgcattccagcctgggcgacagagtgagaccaggtctctctctctctctccatgtgtgtgtgta

SEQ ID NO: 24609 - DNA, 117 bp, Homo sapiens
gaatggcttttatttcttttacctttctaatagctctggttggaacttccagtacaaggttgaatagtagtagtgaaagcgggcattcttgtcttgttcctgaccctagagagagag

SEQ ID NO: 24610 - DNA, 103 bp, Homo sapiens
cacattcatgggggatctgaaatgcccttgtatcatgctcactttgtgtgaccacagtgagtagagaattcaaggtggacaattgttttctcattgcattgtg

SEQ ID NO: 24611 - DNA, 103 bp, Homo sapiens
tccagcctgggtgacccagtgagtctctgtctcaaaaaaaaaaaaaaaaaaaaaaaaaaaaaagacagatcagtgacctcactgttactacagaaggtctgga

SEQ ID NO: 24612 - DNA, 133 bp, Homo sapiens
cgtgtatatgtatacgtgtatacgtgtatatgtatatgtgtatatatgtgtatatgtgtatatgtatatatacataaacacatatacacatatacacgtatacatatatacgcatatacatatatacgcatat

SEQ ID NO: 24613 - DNA, 81 bp, Homo sapiens; identical to SEQ ID NO: 1309

SEQ ID NO: 24614 - DNA, 77 bp, Homo sapiens; identical to SEQ ID NO: 1310

SEQ ID NO: 24615 - DNA, 95 bp, Homo sapiens; identical to SEQ ID NO: 68

SEQ ID NO: 24616 - DNA, 93 bp, Homo sapiens; identical to SEQ ID NO: 69

SEQ ID NO: 24617 - DNA, 112 bp, Homo sapiens
ttacatttcatttattaaaacatggaaatagcacagaaataaccactgtctttctgagtgtgtcatatcaggaggaatatgatgttgttatatcccattacctgagatgtga

SEQ ID NO: 24618 - DNA, 73 bp, Homo sapiens
ttgttttgttgagtcagagtctggctctgtctctcaggctggagtgcagtggtatgattttggctcactgcaa

SEQ ID NO: 24619 - DNA, 133 bp, Homo sapiens
gagaaacacaagcgtgattccttttttttttttctttttttttctttttttgaggagtctcgctctgtcactcgggatggagtacagtggcgcgacctcagctcactgcaagctctgcttcccgggttcacgc

SEQ ID NO: 24620 - DNA, 70 bp, Homo sapiens
cttagagaggagagtgagctgtctcagatcaatatcccctggtaagtgagcactgtgtctttgctctggg

SEQ ID NO: 24621 - DNA, 116 bp, Homo sapiens
catggagtctttcacaaagcatagcttttaaatttttataaagtccaattcatcattaatgaattttaaaatatataatttagatttttctgaggctctttggagaagcttaattg

SEQ ID NO: 24622 - DNA, 74 bp, Homo sapiens
gagtctcactctgtcacccaggctggagtgcagtggtgtgatcatggctcactgcagccttgactcctgggctc

SEQ ID NO: 24623 - DNA, 117 bp, Homo sapiens
ttgtcttgttacaatttgcatttcattctaggattcctccgacctcttaaatagtttttttatttgcatacattaaggattattctatgtgctataaagttgtatgggtcttgacaa

SEQ ID NO: 24624 - DNA, 83 bp, Homo sapiens
gatgattctatagaagaaatgtttactagtatgtttcttttttaaaagttacatgactagaacatgatcatcatagaaaaatt

SEQ ID NO: 24625 - DNA, 123 bp, Homo sapiens
atgtatatgtatatatgatttaagatgtatgtaatatagtttatcatagagggtatatattatgtatatatgatatatattaatatatcttacatgttatatgtcatatatgcatcatatatc

SEQ ID NO: 24626 - DNA, 115 bp, Homo sapiens
ggagggagggggttactgttggatggaactgtgcttggctattggacctgagtgactgaacacagtgtccatgaaggagctggctaggcatgtgttctgcggggaccagccctgt

SEQ ID NO: 24627 - DNA, 58 bp, Homo sapiens
tgagactgagtctcgctctgtcacccaggctggagtgcagtggcacaatctcggctca

SEQ ID NO: 24628 - DNA, 139 bp, Homo sapiens
tgtcttgaaccccccatttggtgttggtcaggaagctgtggggaggaagacttctaggcagaaggcagagagaacagggtgagaggcataggactgtagtatgcagccactttagattttctgaaaactgctggttgct

SEQ ID NO: 24629 - DNA, 80 bp, Homo sapiens
tatgtatgtatgcatgcatacatgaatgtatatgtgcctgtgcatatatatatatgtatgtatgtatgcatgtctatatg

SEQ ID NO: 24630 - DNA, 100 bp, Homo sapiens
cacagagtagtgatggagctctggttttacagtcccagggcctggttttaaagccccgtctctatctgtctggccctgactccctcactcagcctctgtg

SEQ ID NO: 24631 - DNA, 95 bp, Homo sapiens; identical to SEQ ID NO: 68

SEQ ID NO: 24632 - DNA, 93 bp, Homo sapiens; identical to SEQ ID NO: 69

SEQ ID NO: 24633 - DNA, 95 bp, Homo sapiens; identical to SEQ ID NO: 68

SEQ ID NO: 24634 - DNA, 93 bp, Homo sapiens; identical to SEQ ID NO: 69

SEQ ID NO: 24635 - DNA, 80 bp, Homo sapiens
ataaacaaatactttttttaatataaatatgtcccacgcaatatttgggctatatttatactaaaaaagtatttgtttat

SEQ ID NO: 24636 - DNA, 71 bp, Homo sapiens
ggctcagggtggggcaagtttcttttcttttttttttttttttttttgagacggagtctcactctgtcgcc

SEQ ID NO: 24637 - DNA, 95 bp, Homo sapiens; identical to SEQ ID NO: 68

SEQ ID NO: 24638 - DNA, 93 bp, Homo sapiens; identical to SEQ ID NO: 69

SEQ ID NO: 24639 - DNA, 80 bp, Homo sapiens
tgagatgcagtctcgctctgtcacccaggctggagtgcagtggcgcgatcttggctcactgcaggctctgctccctgggt

SEQ ID NO: 24640 - DNA, 61 bp, Homo sapiens
ggtggcaagtgcctgtagacccagctgctcaggaggctgaggtaggaggatcacttgagcc

SEQ ID NO: 24641 - DNA, 58 bp, Homo sapiens
tgagacagggtctcactctgtcacccaggctggagtgcagtagtgtgatctctgctca

SEQ ID NO: 24642 - DNA, 95 bp, Homo sapiens; identical to SEQ ID NO: 68

SEQ ID NO: 24643 - DNA, 93 bp, Homo sapiens; identical to SEQ ID NO: 69

SEQ ID NO: 24644 - DNA, 101 bp, Homo sapiens
ttcttacctttaggtatgcctcataatttttgctgaaagttagacatgttgtataagacagtagacatagaggtcagtatttttatgcttgaaaataagaa

SEQ ID NO: 24645 - DNA, 90 bp, Homo sapiens
gtcctccaatagccatgggatcagttccttgcattgagtctctctatctgaaatacctagtgtggtttctctttctttgcctggatggac

SEQ ID NO: 24646 - DNA, 58 bp, Homo sapiens
tgagacagggtctcactgtgtcacccaggctggagtgcaatggtgcgatctcagctca

SEQ ID NO: 24647 - DNA, 82 bp, Homo sapiens
agggtctctgtcagtcagtctggagtgcagtggcatgatcatagctcactgcagcctccaacccctaggctccagagatcct

SEQ ID NO: 24648 - DNA, 114 bp, Homo sapiens
gtgtaaatctgagttcaagggagaagtctgtgtcagagacagaaatgtgtgagttgacaacgcacaccttctctttcttaagcactgatatgttcccaagttctagagtaatac

SEQ ID NO: 24649 - DNA, 115 bp, Homo sapiens
taagagtttggagtttgcagtggtatataaaattgtgggaaaaacagttaaataatatgacttttttttttttacctggtttagtactatatttgatccattctataaattcttg

SEQ ID NO: 24650 - DNA, 114 bp, Homo sapiens
gattaaatgtcagacattgtgaattgtaccctgcttggtgctgattatttttatatctctgtaaatatctttgaactttattctgggaagcagtcaagttgctctgaaacagtc

SEQ ID NO: 24651 - DNA, 56 bp, Homo sapiens; identical to SEQ ID NO: 3737

SEQ ID NO: 24652 - DNA, 145 bp, Homo sapiens
gtgtatatatatatgagtatatatatatgagtgtatatatacatatatatatatgggcatgtatatatatatatgagtgtatatatatatatgggcgtgtatatatacatatatatatataagtatatatatatatatggagata

SEQ ID NO: 24653 - DNA, 113 bp, Homo sapiens
gacccagtatggaaatccctgtatattcttaaactttttctgagtcactctgtgaaaattgtgggactttggcagtagaaagcaagagaattagaatgcagccatacaaggtt

SEQ ID NO: 24654 - DNA, 95 bp, Homo sapiens
gaggcttccacctgctccaacactctctgtcacttaatagctcctgggctgccaggcataacagagtggaccttctgggtgtatgtggcagtttc

SEQ ID NO: 24655 - DNA, 108 bp, Homo sapiens
gcagttcagttgtttgaataattctggtagacttatttagtacagattaatttcattgtatttgatgtgaatatcttttttccagattgttattggcttttaaactgt

SEQ ID NO: 24656 - DNA, 95 bp, Homo sapiens
tcagggattaagatgtgcagtgaggggattagatggggttacagtgtgtgacagtgtttgtctgtcaaattattgtgtgcgtttttattttggga

SEQ ID NO: 24657 - DNA, 106 bp, Homo sapiens
catttatagtctaattctgagaactatgcttgaaacatcattggtattcaatatgtattttttaaatgagtggttctggccttagtaaaatacttttctataaatg

SEQ ID NO: 24658 - DNA, 84 bp, Homo sapiens
gctggcttcctcaccaccttgtgcactgctgctcccacaccacagtgactagcagcacataatggtttgaattaaagctgaagt

SEQ ID NO: 24659 - DNA, 73 bp, Homo sapiens
gtgtacaaatttacataaatatgcttatgtgatacaatgtgatgaatatgaaatacaatgtaaatttgtatac

SEQ ID NO: 24660 - DNA, 90 bp, Homo sapiens
gcatttctgggaggagaattgataagggaaatagagcctcctctttgaagaggctttgactgtgtgggtctctctctttgagatcagtgc

SEQ ID NO: 24661 - DNA, 90 bp, Homo sapiens
aactgtgagtctgttaaacctctttttctttataaattaccccctcttgggtaagtctttatcagcagtgtgaaaatggactaaacagtt

SEQ ID NO: 24662 - DNA, 89 bp, Homo sapiens
tgcagaaagtcctagtaacagtattaatcttgtctctaaatctctctcatatttagatactaaattggctctacatgggctgctttgca

SEQ ID NO: 24663 - DNA, 64 bp, Homo sapiens
ttttggagctctgtgtgtgtgtgacagggagcattcctagtacacacaggcgttgactttaaga

SEQ ID NO: 24664 - DNA, 75 bp, Homo sapiens
ccagcaagtaggaggaatactggtctcaaaagccaggctccaggatacattgccggttttgtttctagtggctgg

SEQ ID NO: 24665 - DNA, 72 bp, Homo sapiens
tttcccccccagcaagttagtaacatattacctaaacatattttaggtagtatgttgttgagaaggtggaag

SEQ ID NO: 24666 - DNA, 117 bp, Homo sapiens
attctcttccacagctctgcttcagtatcaccaattatatgaatatttgatcttctttccttttttttttattatactttaagttctgggatacatgtgcagaatgtgcaggatggt

SEQ ID NO: 24667 - DNA, 86 bp, Homo sapiens
tgtgttgttgccagatttttttctttaattgatgcttagtctagtatgagaagtttcagactaggaaattaatttagtagcaagca

SEQ ID NO: 24668 - DNA, 91 bp, Homo sapiens
gcagttatcctgggagagcattttttgtctgaacctaaagggaaaatattattttttcttttttagaggcagagtctctctctctctctgt

SEQ ID NO: 24669 - DNA, 112 bp, Homo sapiens
ccccctgtcttgttgacctgaattgaactatctgcccttccagaatccaacatggtggctggatatggaatgcattgattttttttttttttttttttttaaagacaactgg

SEQ ID NO: 24670 - DNA, 95 bp, Homo sapiens; identical to SEQ ID NO: 580

SEQ ID NO: 24671 - DNA, 93 bp, Homo sapiens; identical to SEQ ID NO: 69

SEQ ID NO: 24672 - DNA, 58 bp, Homo sapiens
tatatacatacatgtgtatgtgtgtatgtatatatatacatacatgtgtatgtgtgta

SEQ ID NO: 24673 - DNA, 58 bp, Homo sapiens; identical to SEQ ID NO: 24672

SEQ ID NO: 24674 - DNA, 58 bp, Homo sapiens; identical to SEQ ID NO: 24672

SEQ ID NO: 24675 - DNA, 58 bp, Homo sapiens; identical to SEQ ID NO: 24672

SEQ ID NO: 24676 - DNA, 58 bp, Homo sapiens; identical to SEQ ID NO: 24672

SEQ ID NO: 24677 - DNA, 58 bp, Homo sapiens; identical to SEQ ID NO: 24672

SEQ ID NO: 24678 - DNA, 58 bp, Homo sapiens; identical to SEQ ID NO: 24672

SEQ ID NO: 24679 - DNA, 58 bp, Homo sapiens; identical to SEQ ID NO: 24672

SEQ ID NO: 24680 - DNA, 58 bp, Homo sapiens; identical to SEQ ID NO: 24672

SEQ ID NO: 24681 - DNA, 119 bp, Homo sapiens
tcactgaggtattttgaaagcccagtgctgacttgtttctgtccatctgcattgataaagagtgcagtctgaggacagtggggctgcctgggctggtggacagtgtatcaaagaagtgg

SEQ ID NO: 24682 - DNA, 111 bp, Homo sapiens
tagccaagctgttcctgaattcttgactaatagaaactgtgagataataaatgtttattgttttaagccaccatgttttgtcataatttgtgtatcagcaattgattgcta

SEQ ID NO: 24683 - DNA, 97 bp, Homo sapiens
cacacatatatatatatgtacatatatacacacacacatatatatgtacatatatatatatgtgtgtgtgtatatatatacgtatatatgtgtgtgt

SEQ ID NO: 24684 - DNA, 60 bp, Homo sapiens
gggtgtgtgtctgtagtcccagctactcaggaggctgaggtagtaggattgcttgaaccc

SEQ ID NO: 24685 - DNA, 95 bp, Homo sapiens; identical to SEQ ID NO: 68

SEQ ID NO: 24686 - DNA, 93 bp, Homo sapiens; identical to SEQ ID NO: 69

SEQ ID NO: 24687 - DNA, 100 bp, Homo sapiens
gacaggccccggtgtctgatgttccccaccctgcgtccaagtgttttcgttgttcagttcccacctatgagtgagaacatgcagtgtttggttttctgtc

SEQ ID NO: 24688 - DNA, 76 bp, Homo sapiens
attgtgtatatgtgtgtgcatatgtgtgtatatatatatatatatatatatatatacgcacacacatatatataat

SEQ ID NO: 24689 - DNA, 130 bp, Homo sapiens
tgagtgaggtggatctagagagctcagttttatttatttacttattattttgagacagagtctcgctctatcactcaggctggagtgcagtggcaccgtcacagctcactgcagcctagacctccagggc

SEQ ID NO: 24690 - DNA, 95 bp, Homo sapiens; identical to SEQ ID NO: 68

SEQ ID NO: 24691 - DNA, 93 bp, Homo sapiens; identical to SEQ ID NO: 69

SEQ ID NO: 24692 - DNA, 116 bp, Homo sapiens
ttcctagtccatttgatacttcttttttagattcaggaaagatttctaagattttttctttaaagaaagaaagaaatctttaatgatgagatgatgaagctctgttttccaaggaa

SEQ ID NO: 24693 - DNA, 79 bp, Homo sapiens
gggagaagtctgggtcagagacagaaatgtgtgagttgacaacacacaccttctctttcttaagcactgatatgttccc

SEQ ID NO: 24694 - DNA, 58 bp, Homo sapiens; identical to SEQ ID NO: 24641

SEQ ID NO: 24695 - DNA, 95 bp, Homo sapiens; identical to SEQ ID NO: 68

SEQ ID NO: 24696 - DNA, 93 bp, Homo sapiens; identical to SEQ ID NO: 69

SEQ ID NO: 24697 - DNA, 95 bp, Homo sapiens; identical to SEQ ID NO: 580

SEQ ID NO: 24698 - DNA, 93 bp, Homo sapiens; identical to SEQ ID NO: 69

SEQ ID NO: 24699 - DNA, 58 bp, Homo sapiens
tgagacagactctcgctctgtcacccaggctggagtgcagtggcgcgatctcggctca

SEQ ID NO: 24700 - DNA, 101 bp, Homo sapiens
ttcttacctttaggtatgcctcataatttttgctgaaagttagacatgttgtataagacagtagacatagaggtcagtatttttatgcttgaaattaagaa

SEQ ID NO: 24701 - DNA, 105 bp, Homo sapiens
agttcagagaggcaactgggtcaggtggggtagattctacagaacctttgaggccttgtctggactttggattgtaccctaaattagaaggtgaggaattggagg

SEQ ID NO: 24702 - DNA, 76 bp, Homo sapiens
ggactgtgcaggttccctgaggtagaatggacaggtcgcacaaaactgtctctctctgagtcccttcctgccttcc

SEQ ID NO: 24703 - DNA, 117 bp, Homo sapiens
ttgtgcatatacttaagtggatgctttttttgacaacggttgctattattttactttaatagatatttataaattatctcaaaagtcctttatcaagtgtctggagtcagtgtacag

SEQ ID NO: 24704 - DNA, 70 bp, Homo sapiens
atcagccctgactggcactgtctctttctacagcactgggcctgtagggacctgtggggataggattgat

SEQ ID NO: 24705 - DNA, 73 bp, Homo sapiens
gggggaagcagtcagaacacacacagcatttattaagtttgccttctgaaatggatgtggtttgtggtgcccc

SEQ ID NO: 24706 - DNA, 65 bp, Homo sapiens
atatatgtatgtgtatatatatatatgtgtgtatgtgtgtgtgtgtgtaaatgcatacattttgt

SEQ ID NO: 24707 - DNA, 62 bp, Homo sapiens
ttgctctgagatgagggagaggacatggttaaagcacttccacaaggttcaactcagagcag

SEQ ID NO: 24708 - DNA, 85 bp, Homo sapiens
aactgttaattgattataattaataattatgtaactgatatagttatatgtcagttatatggttatatatcagttatatagttat

SEQ ID NO: 24709 - DNA, 120 bp, Homo sapiens
cccaggagttcaagaccagcctgggcaacatagcaagactccatctcctcaaaattttttttaaatgtagccaggtgtggtagggcatgcttgtagttccagctgcttgggaggctgagg

SEQ ID NO: 24710 - DNA, 134 bp, Homo sapiens
tatatatatatacacacacacacacacacacacacacacacacgtgtgtatgtgtatatatctatatatacacacacacacgtgtgtatgtgtatatatctatatatacacacacacacgtgtgtatgtgtata

SEQ ID NO: 24711 - DNA, 135 bp, Homo sapiens
tggtttgctgcctccttgagacccagataaactgcagaaggggtgggacaagatcacagaaaaatgtcacaaaagttttgcatattttttttcttaattgggcatttgcttcattctgtagacctttgtttttca

SEQ ID NO: 24712 - DNA, 85 bp, Homo sapiens
gattcatcagtgtgagatcatgagaaccaaaggaaaaacatttttttttttttttttttttagtcagggtctcactctgttgctc

SEQ ID NO: 24713 - DNA, 110 bp, Homo sapiens
gttaggcatggtggcatgcatctgtagtcccagctactgggaggctgaggttggaggatcgcttgagctgaagaggtgaaggctgcagtgagcaatgttcagtgcactgc

SEQ ID NO: 24714 - DNA, 65 bp, Homo sapiens
tatgtatatatacatatgtgtacataatctatatatatttatgtgtgtgtgtgtatatatatata

SEQ ID NO: 24715 - DNA, 56 bp, Homo sapiens
cagcttctcactctgtcacacaggctggagtgcagtggtgtgatcagagctcgctg

SEQ ID NO: 24716 - DNA, 99 bp, Homo sapiens
ggctttggaagaggggctttaatgggagggctcagagtctccctctgtctccgctgccacccaccgcagtagcaaagcagaagaaagctctgtgaccct

SEQ ID NO: 24717 - DNA, 63 bp, Homo sapiens
ttgagacagagtctctctctgtcgcccaggctggagtgctagaacgcagtggctcgatctcag

SEQ ID NO: 24718 - DNA, 96 bp, Homo sapiens
tatatatatacacacagacacatatatatgtgtgtgcatatatatctatatatatgtatatatgtgtgtatatatgtttacatatgtatatatata

SEQ ID NO: 24719 - DNA, 113 bp, Homo sapiens
ccagagatggtatgcctggtctttgccgtataatggtgagttctagctgttagctacttcatagtcattacagatctcacaccagtgaatgagacagtcatatcacttgttgg

SEQ ID NO: 24720 - DNA, 87 bp, Homo sapiens
gtcatcatgagtgagctgttataaaggtgagtttgggtctctcttgctctctctcaccctttctttgcccttcctcaatgggatgat

SEQ ID NO: 24721 - DNA, 101 bp, Homo sapiens
gactttaatccattttgagttgatttttatattaatatatggtgtgaagtaagaatctaacttcattcttttgtgtatggatatctacttttcccaaagtc

SEQ ID NO: 24722 - DNA, 91 bp, Homo sapiens
caatggtggtcctatgagattataatggagctaaaagatttctttttttttttttttttttggtttattaaagttttattaaccagttttg

SEQ ID NO: 24723 - DNA, 75 bp, Homo sapiens
aggtgtaatcacagccagggcccggaggccaggggcaatggccactctctactcacatgtctctgtgacaaacct

SEQ ID NO: 24724 - DNA, 58 bp, Homo sapiens; identical to SEQ ID NO: 11136

SEQ ID NO: 24725 - DNA, 82 bp, Homo sapiens
tgagacagagtctcgctctgtcacccaggctggagtgcagtggcgtgatctctgctcactgcagcctcgacctcccgggctc

SEQ ID NO: 24726 - DNA, 86 bp, Homo sapiens
tctgttgtttttgctctgagagtgggacacttctgtttttctgaacttaagtcacaggtacttgtttcccaggctttaaacacagg

SEQ ID NO: 24727 - DNA, 80 bp, Homo sapiens
tgagaaggagtctcactctgtcacccaggctggggtggagtggcatgatctcagctcactgtaacctctgcctcccgggt

SEQ ID NO: 24728 - DNA, 93 bp, Homo sapiens; identical to SEQ ID NO: 69

SEQ ID NO: 24729 - DNA, 58 bp, Homo sapiens; identical to SEQ ID NO: 1839

SEQ ID NO: 24730 - DNA, 79 bp, Homo sapiens
cttgggtaaatgatgagcggagcagagttttttggttttttttttttttttgagacggagtctcactctgtcacccagg

SEQ ID NO: 24731 - DNA, 74 bp, Homo sapiens
ctagtgctagatgcttgtataattctatggaatttccagcaattaccatgttcgtttcagggatgctgcgctgg

SEQ ID NO: 24732 - DNA, 138 bp, Homo sapiens
ggcgtctttacagtgagggggaagcacacttaccttccccgacagggaaagctgagccccactgtccctctgacactggccattcccagcctcaactcttctggacctttgattctggagataagtgacaggttgcag

SEQ ID NO: 24733 - DNA, 100 bp, Homo sapiens
tggccccagctgctcagaagggtgaggtaggaggatcacttgagccagggaggtcaaggctgcagtgagctgagatcacaccactgtactccagcctggg

SEQ ID NO: 24734 - DNA, 108 bp, Homo sapiens
aatgttcttgtctatagaatgaggataaaaataattaccccctcaaaagattcttttttttttgaggcctcaatacttttttttatttttattttttatatatatatt

SEQ ID NO: 24735 - DNA, 66 bp, Homo sapiens
gctagatcaattctctttctctctctgtccagggaattttaattccagaaggagagatggtgtagc

SEQ ID NO: 24736 - DNA, 116 bp, Homo sapiens
atcagagacttcacttttcaaatacagaatgccatttgtgtgtcactgaggctgttgtaattgccttctgcacctgatttacagttggttcttcttgactggttacactaaatgat

SEQ ID NO: 24737 - DNA, 118 bp, Homo sapiens
tgtgccatttgtacatatatcttaggtgcattgtatacatatataaatatatatatgtctgtatctatatctgtatatctatatctatcttgcatgtatgttcatttccaaagtcaca

SEQ ID NO: 24738 - DNA, 116 bp, Homo sapiens
tggccccggtgtgtgttgttcccctccctgtgtccctgtgttctcattgtttaactcccacttctgagtgagaacacaaggtgtttcatttgctgttggaatctcttttaaggtca

SEQ ID NO: 24739 - DNA, 128 bp, Homo sapiens
ggtaagggagaattgatatttttttttggcaagaaagttcaaagatttcttttttttttttttttttttttggagacaggatctcactctgttgcccaggctggagtgcagtggtgtgatctcggctc

SEQ ID NO: 24740 - DNA, 83 bp, Homo sapiens
gggcagtgccaggcacacagaagacagtcagcacatatttgttaaatgcatgcctggattgagtgagtggcaggactctgccc

SEQ ID NO: 24741 - DNA, 78 bp, Homo sapiens
cctctggcagagtgggcctgagatccatctttttatttatttatttttttgcgaccgagtctcgctctgtcacccagg

SEQ ID NO: 24742 - DNA, 113 bp, Homo sapiens
tgttgcatagtgttccctacagtcgattttccatcatgtagttaacaatttttttttttttagtgtagtagttaagtacgtggactctggacggttgggttcaaatgtcaaca

SEQ ID NO: 24743 - DNA, 77 bp, Homo sapiens
cttgcctgggccaaggaacacccagatagctggtgaagcattatctcggtgtgtctgtgagtgtgtttctgggaggg

SEQ ID NO: 24744 - DNA, 116 bp, Homo sapiens
gcacgacgtccagactcggacatgtctgtttcacgtctgccgggaagtaatttttatgctgggagctggcttcatggcgtgggattctaattctggggatggcattttgtatgtgt

SEQ ID NO: 24745 - DNA, 110 bp, Homo sapiens
tgcaaatgtgtgaatacatatgtgtgcatacatgaatgtatatatattcatttataggttcatatatatattcatttatgcattcatatatatatgtgtattcatttgta

SEQ ID NO: 24746 - DNA, 111 bp, Homo sapiens
gaattgtgtttaaagatgtatgtgcaagggtgttcattttaaataacaatatttaaaatatttatttaaaatagagaaaacacttttatatcaaatctccaacaataattc

SEQ ID NO: 24747 - DNA, 78 bp, Homo sapiens
ttgtatcacgtgttatgaagctggactgcctgggttcgagtcctggctctgcctgtgtcactgaatgacactgtacaa

SEQ ID NO: 24748 - DNA, 105 bp, Homo sapiens
gtatctgttaggagtctagggcagagtcagttagagttgtgtcaatcatttgtaacacatgtgaattagatggtcactgatgtcctttgctttctccgtaggtat

SEQ ID NO: 24749 - DNA, 87 bp, Homo sapiens
ggtttgtctaatattgtcagtggggtgttaaagtctcccactattattctgtgggactctgagtctctctgatggtatctaagaact

SEQ ID NO: 24750 - DNA, 80 bp, Homo sapiens
gaacacacaggtgagacagaggtgggtgttggcttcttttgggggtctctctgtccctctcttttgtgtacacattgttc

SEQ ID NO: 24751 - DNA, 107 bp, Homo sapiens
tgataaaacaacgctgttctaatacacaaatgtgtgtatatgtatattgttttaaaattatgcattctgtatgtgtgtgtgcatgtgttcagaaatggcacatatca

SEQ ID NO: 24752 - DNA, 58 bp, Homo sapiens; identical to SEQ ID NO: 1673

SEQ ID NO: 24753 - DNA, 79 bp, Homo sapiens
gggaaggaacagaacccagagaggcagcctgagtagaaagtattgaaatgccctggctctgagattctcagtccatcct

SEQ ID NO: 24754 - DNA, 129 bp, Homo sapiens
cagtgggtatacatcctgtgatattattcataatatcttcgggggatattccttctaatatcacagtggctgtacactcagtgatattattcgtaataccttagggggatattcctggtatcacagcgg

SEQ ID NO: 24755 - DNA, 120 bp, Homo sapiens
gttcaattgctctgcttttaacttctctcctgtctcaccctctccatccccaccacccagagaggagagtgagcaggctgggagataggggagagggggcaataaagagtgaaagtgaac

SEQ ID NO: 24756 - DNA, 99 bp, Homo sapiens
gttatggtagatccaagctttgaattggggcatttcagacatagaagctttaaatctttattatgtaataattcctgcaatgttaaaatctactctaac

SEQ ID NO: 24757 - DNA, 58 bp, Homo sapiens
tgagactgagtctcgctctgtcacctaggctggagtacaatagcgtgatcttggctca

SEQ ID NO: 24758 - DNA, 96 bp, Homo sapiens
gccatgttggtgtgctgcacccattaactcgtcatttagattttttttatatttttttctttcttttgaggctgggtctcactctgtcattcaggc

SEQ ID NO: 24759 - DNA, 95 bp, Homo sapiens; identical to SEQ ID NO: 68

SEQ ID NO: 24760 - DNA, 93 bp, Homo sapiens; identical to SEQ ID NO: 69

SEQ ID NO: 24761 - DNA, 101 bp, Homo sapiens
gtatattttgcatttctattttataaacaataaccaattttcacatttgtagaaagaaaattagtgatattgttgatagttatggggaagctaggaagtac

SEQ ID NO: 24762 - DNA, 91 bp, Homo sapiens
tgggaggaaggcttgggagtcccctaagacacatcttcagtcacttctctctgcctgtgtctcaggaaaccagctcctcctactgtcttct

SEQ ID NO: 24763 - DNA, 91 bp, Homo sapiens
aattctatggaaagtctctagcaccttatgtaattggtaatgtctttctgctgctttcctacatgaccaactattgacttggggtagaatt

SEQ ID NO: 24764 - DNA, 79 bp, Homo sapiens
cttggggcagggtccctctttgccagagtctatctttgtgtccagtggcagagaggaagaaaatattgcctgtctcagg

SEQ ID NO: 24765 - DNA, 117 bp, Homo sapiens
cacgtatatgtatatatacatgtgtatatacacatatatatacgtgtatataacgtatatatgtatatatacatgtgtatatatgtgtatatacacacgtatatatgtgtgcatgtg

SEQ ID NO: 24766 - DNA, 114 bp, Homo sapiens
cttgctctttccacttcacagtcttaatcatgaggcaagacagtgtgctcagaaggcactgtgcagttctgctgcctgatgattccaaacttagagtgaaaagtgaagatgggc

SEQ ID NO: 24767 - DNA, 110 bp, Homo sapiens
tgcttaggattgtcttggctatactggctcttttttggttccatatgaaatttaaagtagttttttctggttctgtgaagaaagtcaatagtagcttgatggggatagca

SEQ ID NO: 24768 - DNA, 68 bp, Homo sapiens
tctttaagacagttgcatgagtattgtggggctaaagcaactaagtgattatgttgatgtctttggga

SEQ ID NO: 24769 - DNA, 81 bp, Homo sapiens
cagcgagctgggtaggccacactctcagtggctcctgactgcagtgccactgcttgaattgagggttgcagaaagctcctg

SEQ ID NO: 24770 - DNA, 95 bp, Homo sapiens; identical to SEQ ID NO: 580

SEQ ID NO: 24771 - DNA, 93 bp, Homo sapiens; identical to SEQ ID NO: 69

SEQ ID NO: 24772 - DNA, 242 bp, Homo sapiens
tcactctacctgagcccctggctgtgacactcattctacctgaggccctggctgtgacactcactctacctgagcccctggctgtgacactcactctgcctgagtccctggctgtgacactcactctgcctgggtccctggctgtgacactcactctacctgggcccccggctgtgactcactctacctgggcccctggctgtgacactcactctacctgggcccctggctgtgacactcac

SEQ ID NO: 24773 - DNA, 58 bp, Homo sapiens; identical to SEQ ID NO: 47

SEQ ID NO: 24774 - DNA, 100 bp, Homo sapiens
tgagaatttgtatttatgttgtcacatttgtggccattttgcattttttgttatattttaagtagtggaaagtattagcaaatgatgaaaatatgactca

SEQ ID NO: 24775 - DNA, 117 bp, Homo sapiens
tgataaggccacactttggatggtgtcagcactggaacttgaggatcttagcctctgtgacactctctgttgacccttgttatacttcaagcttttgtgctcattttcccacaagct

SEQ ID NO: 24776 - DNA, 95 bp, Homo sapiens; identical to SEQ ID NO: 68

SEQ ID NO: 24777 - DNA, 93 bp, Homo sapiens; identical to SEQ ID NO: 69

SEQ ID NO: 24778 - DNA, 96 bp, Homo sapiens
tagaaatttttatggctatatttatcatcggtgatcatgcagggaaaagacccaaacactgtatctctcactctgatgttgggcatttgtgttcta

SEQ ID NO: 24779 - DNA, 115 bp, Homo sapiens
gggctcccactgattctacattatggtgagttgtataattatttcattatatgttacaatgtaataataatagaaataaagtacacaataaatgtaatgtgcttaaatcatcccc

SEQ ID NO: 24780 - DNA, 81 bp, Homo sapiens
gtggcaaaaaatagtttacttttttattttctcttgaaatatcagatttaagtggagagagaaatctgaagaaggtgccac

SEQ ID NO: 24781 - DNA, 73 bp, Homo sapiens
tattactgagtttttttggggggtgggggttgggggggagttcagtcctaaagctttttttttcttagtaatg

SEQ ID NO: 24782 - DNA, 114 bp, Homo sapiens
gcgagcacgtggggtcagccagacctggactgtagccccagattgtcacttacaaacacttctgtgaagagactcagctgagttgcttggcctccctgtgcccctgtgtcttgt

SEQ ID NO: 24783 - DNA, 88 bp, Homo sapiens
cagggtgggcctcctgcctgcctgcctgactgcctggcagggcgaatttactgcaggttaatagccagctgcaaggtagccagccctg

SEQ ID NO: 24784 - DNA, 136 bp, Homo sapiens
agcagggggccatgggtgcttaaaggggtgggttccagggttgcccaaagtagagggtgagtgtgcatgtgcatgtgttcgtatgcaggtgtgggtgtgcatacctgtgtatgcatggtggcacgtgtgtgcacat

SEQ ID NO: 24785 - DNA, 97 bp, Homo sapiens
tgtgtatatatacatatatgtatatatacacatatatatgtatatacacacgtgtgtgtgtgtgtgtatatatatgtatatatatatatatatatat

SEQ ID NO: 24786 - DNA, 86 bp, Homo sapiens
atatacacacatatacgtatgtgtgtatatatacatatacatatatgtatgtgtgtatatatacatatatgtatatgtgtatatat

SEQ ID NO: 24787 - DNA, 88 bp, Homo sapiens
tctgtctgtgtgtctatatttacgttaactattaagttatttttataactttggtttggtgaggtcctgaccacctaatagtgacagg

SEQ ID NO: 24788 - DNA, 108 bp, Homo sapiens
gagtgagactccatctcttaaaaaaaaaattaacttttactttttaaaaagctatttttatggttattttcttgttttttattttttttttgagactgggtctcactc

SEQ ID NO: 24789 - DNA, 119 bp, Homo sapiens
cctgtaatttccagtattttgggcggctggggtgggcagattgcttaagctcagaagtttgagaccagactgggcaatgtggcaaaaccctgtctctttagatacaaaaaattagctgg

SEQ ID NO: 24790 - DNA, 95 bp, Homo sapiens; identical to SEQ ID NO: 68

SEQ ID NO: 24791 - DNA, 93 bp, Homo sapiens; identical to SEQ ID NO: 69

SEQ ID NO: 24792 - DNA, 103 bp, Homo sapiens
acagttcctggacccttttccttcaagagagcaaaagaaatgggattggtgggttaggacagatattctttttttttttctttgaggcagggtctctctctgt

SEQ ID NO: 24793 - DNA, 117 bp, Homo sapiens
gggtcctgcagacacctgcgcctagaggtggctgcgtcatggacagggcagggcgtgtgtccctgtctgtgtggcggtgatgacggtgctgatggtgagcggtgatgcctggggcct

SEQ ID NO: 24794 - DNA, 58 bp, Homo sapiens; identical to SEQ ID NO: 2135

SEQ ID NO: 24795 - DNA, 56 bp, Homo sapiens; identical to SEQ ID NO: 2136

SEQ ID NO: 24796 - DNA, 109 bp, Homo sapiens
tatatatgtaacatatctatacaaatatccttaacatacaaatatatccttaatatgttatatatatatgtgtgtgcttgtgtattagccttgagtgttatgtagtata

SEQ ID NO: 24797 - DNA, 103 bp, Homo sapiens
ttgttcattacctgtttcagattaccccaattttgtcagaagaaactcagaattttgaaatattagaggcttttgcaaatggaaagttgaattggaagagcaa

SEQ ID NO: 24798 - DNA, 80 bp, Homo sapiens
acttatacataagcatatacatgtgtttatatttgcttatatatgttacataaatgtatatatgtttatgtgtgtgtata

SEQ ID NO: 24799 - DNA, 56 bp, Homo sapiens
tgagacagggtctcactgtcatccaggctggagtacagtggtatgatcacagctca

SEQ ID NO: 24800 - DNA, 58 bp, Homo sapiens
tgagacagagtctcgctctgtcacccaggctggagtgcagtggtgccatctctgctca

SEQ ID NO: 24801 - DNA, 73 bp, Homo sapiens
gttgtttttgagacagtgtctcactctgtcacccaggctggagtacagtggtgggatcttggctcactgcaac

SEQ ID NO: 24802 - DNA, 86 bp, Homo sapiens
tgagatggagtctcgctctgtcgctcaggctggagtgcagtggtgtgatctcagctcactacaacctccactccctgggttcaagc

SEQ ID NO: 24803 - DNA, 86 bp, Homo sapiens
agccaggtgtgctggaatgtgcctgtcatcccagctcctcgggaggctgaggtaggtggatcacttgagcacatgaggtcaaggct

SEQ ID NO: 24804 - DNA, 90 bp, Homo sapiens
tgcaggggtggggaaggatgaacactggacttttaaagcagaaaaactattgtttatttttgtgtcactctcagattctctgtctttgca

SEQ ID NO: 24805 - DNA, 100 bp, Homo sapiens
tgattgtacattatggtgagttgtataactatttcattatatgttacagtgtaataacaatagaaataaagtgtacaagaaatgtaatgtacttgaatca

SEQ ID NO: 24806 - DNA, 112 bp, Homo sapiens
tgaggaacgagaatcgcttgaatcccagaagtggagttgagtggagtcagtgagctgagatagtgccactgcactccagcctgggtgacaaagcaagcaagactcggtctca

SEQ ID NO: 24807 - DNA, 70 bp, Homo sapiens
gagatcatcagatttagtctttttgtttttcagataagaaatctgatacctagattgggcagatgaactc

SEQ ID NO: 24808 - DNA, 105 bp, Homo sapiens
ggatactgttcagttgttctttcaaggagtcagtactgattttgaagaggctgaagaattagtttctatgaatagactgcacagaacaactacaaacaagtattt

SEQ ID NO: 24809 - DNA, 112 bp, Homo sapiens
ctctatatatatatacacacacacacacacacacacacacatatatacacacacacacacatatgtgtctatgtatgtatgtatgtatatatgagtgtgtgtgtgtgtatgt

SEQ ID NO: 24810 - DNA, 112 bp, Homo sapiens
atgagccaccacgcctggcctcgatagtgtcttgtgatgtacaaaagtttttaattttgatgaagcccattttgtctattttttattttgttgcctgtgcttttggggtcat

SEQ ID NO: 24811 - DNA, 114 bp, Homo sapiens
agaattctagttaatctcagcgctttacatggcttgtatttgcttttgaaaaaatctgaagacagaaatgactgaacacatgttccaaggtgttaaaagcttgattagggtgct

SEQ ID NO: 24812 - DNA, 70 bp, Homo sapiens
ggtttagggaagtaagtatacacacatatatgtatatgtatatatgtgtgtgtaaaacaatccctttttc

SEQ ID NO: 24813 - DNA, 118 bp, Homo sapiens
ggatcatcagctgtgtatcgaggcagcagattcctgggagtggctccagctatcctgactctgtgggtctgtcggaggccggggaatgtgcattcttttacaggctctctgaggattc

SEQ ID NO: 24814 - DNA, 80 bp, Homo sapiens
tttgttccttcagatgttcagatgtgtccagagtttcttccttccagtgggttcgtggtctcgctgacttcaggagcaaa

SEQ ID NO: 24815 - DNA, 67 bp, Homo sapiens
ggtccataggcagagactgtgtctgtctgtccccaggcccctccagaaagtcctcttgagctggacc

SEQ ID NO: 24816 - DNA, 71 bp, Homo sapiens
tagttgtcagtcattgtcagtcaatcagcttacctggcttctggccacagtgattggtacaagactgagca

SEQ ID NO: 24817 - DNA, 117 bp, Homo sapiens
tgctgagagtgtacaactatatgtgttgaaatctacagctataattgtagacttgtctatttcttctttcaggtctatcagttttttcttgacatatttcagttcttatttttggca

SEQ ID NO: 24818 - DNA, 83 bp, Homo sapiens
ggcaaaaggggttgggggttcactgcagtctgtttttttttatttttagtttttttagactgtcttgctctgtcacccaggct

SEQ ID NO: 24819 - DNA, 101 bp, Homo sapiens
ttcccgggatatttgtctcttcttacagccatctatatatatataaatttagcctttagtatgtattaaagatagagagttagggaccagtagagtgggaa

SEQ ID NO: 24820 - DNA, 78 bp, Homo sapiens
tagaaataggcccctgtgagcttctttgccctttccatcttgagagtacacagaaaggagacagcagcctatgaacta

SEQ ID NO: 24821 - DNA, 95 bp, Homo sapiens
ggaaaaggcatggaaggggaaataggtcttatgagaatgttgagtgggtggagaccattcaatatggtgaggtttgaattaaaagtgctttatgc

SEQ ID NO: 24822 - DNA, 98 bp, Homo sapiens
gaaatggccgatgttcagtcatttttaagtatttttgggatatatatatatatatatatcaagtgtttttaaatgggtgtgacacattttgcttcctc

SEQ ID NO: 24823 - DNA, 100 bp, Homo sapiens
atagtctcacgtcagttcaggtaaggttttgcagcctgaagaattacacaaattgtttttctgagatgtttggattttggaattgattataaggggctgt

SEQ ID NO: 24824 - DNA, 78 bp, Homo sapiens
tggagcttgcagtgagctgagatcacactgtgtcagggattggttcctcccggtgggttcttggtctcgctgacttca

SEQ ID NO: 24825 - DNA, 106 bp, Homo sapiens
ctattcttgaagcttcgttgaacaggatgtgttttggagattgaatgtatgtagatttatttactttctaaaagcaacaccctgtacttgggggccgccaagcgag

SEQ ID NO: 24826 - DNA, 112 bp, Homo sapiens
ttccacgtgttctaagttctatgcaggctgatccttggtttcccttttttttttttccttttcacttctgtctgacatccagtgctttctatacctgcttgacacagtggag

SEQ ID NO: 24827 - DNA, 75 bp, Homo sapiens
ctggggtggggctgaaagcacagtgcctgcagtgcaaacacactgcccctggctgtgtcactcagagcctctcag

SEQ ID NO: 24828 - DNA, 58 bp, Homo sapiens; identical to SEQ ID NO: 13889

SEQ ID NO: 24829 - DNA, 74 bp, Homo sapiens
ggattcatggtcatctctgactctctgactttcaggcccatggtcagttttaggaagcagagggaatatgtgcc

SEQ ID NO: 24830 - DNA, 104 bp, Homo sapiens
catatatgtatatatacacatgtatgtgtatgcatatgtatatacacatgtgtatatatgtatgtatacatgtatgcacatatatgtgtgtgtgtatatatatg

SEQ ID NO: 24831 - DNA, 67 bp, Homo sapiens
gtttgtatatatatgtatatacatagatgtgtgtataacacaaatgtatatgcatgtatataggtac

SEQ ID NO: 24832 - DNA, 84 bp, Homo sapiens
tgcttcacagtggggaaagagagtgtcaggaattatcaagtttaattttgttaattcttgctctggctgcttcatgctgaggca

SEQ ID NO: 24833 - DNA, 71 bp, Homo sapiens
ttgtttttgagatggagtctctctctgacactcaggctggagtgcagtggcatgatctcagctcactgcaa

SEQ ID NO: 24834 - DNA, 58 bp, Homo sapiens; identical to SEQ ID NO: 637

SEQ ID NO: 24835 - DNA, 99 bp, Homo sapiens
ttcagtcactgatcacaacaaaatttgtgggcaaaagttgtgtgaagggttaatatattttgtttatgttatgttgttgtgaggtatacatttcctgaa

SEQ ID NO: 24836 - DNA, 76 bp, Homo sapiens
tctagtcatgtgtagcaggaccacatatccatcggcgacagatgagagaggccagaatggtccttcaccacagaga

SEQ ID NO: 24837 - DNA, 119 bp, Homo sapiens
acatatatgtgtatatatatgtgtatatatacatatatgtgtatatatgtatatatacatatatatgtatacatatatgtgtgtgtatatatatatgtatacatatatgtgtatatgta

SEQ ID NO: 24838 - DNA, 119 bp, Homo sapiens
gcatgttacagtggctggaatggactttctttttaattctttgaccttgaaattttaatttattaatgagttatatttacagtacagagtagagacaaatttggcacattgttctttgc

SEQ ID NO: 24839 - DNA, 91 bp, Homo sapiens
agtgcgagggtccagggcgtgtgtgcgtgtgtctgtgagtttgtgtggatgactcgattcatctggaacacatccccgggagttttgggct

SEQ ID NO: 24840 - DNA, 78 bp, Homo sapiens
cttctacagccaagctacagcagattttctttcaaaaaagggacacagttgacagagaatagagtgaggaagtggaag

SEQ ID NO: 24841 - DNA, 68 bp, Homo sapiens
actttgttgatcacagacacacagacacaccaagtaccacataggtggtgtgtttttgatcagctagt

SEQ ID NO: 24842 - DNA, 116 bp, Homo sapiens
gagtcgaaatatctagtttattctattatttgatgatttattggctgtctttctttgtatttattttttgccattgggtgaacagagtaggctatcaggatgtactatttgtattc

SEQ ID NO: 24843 - DNA, 101 bp, Homo sapiens
ggttctcagccactatgtatttgccaaatgctctgtgttcagcagggacctcagccccactgtccctctcagggaatttgcaggacaactggtctcatgcc

SEQ ID NO: 24844 - DNA, 87 bp, Homo sapiens
ggcaatgtttacctgtgtttttttaactttaagttctaggatacatgtgcagaatgtgcaggttggttacataggtatacatgtgcc

SEQ ID NO: 24845 - DNA, 115 bp, Homo sapiens
gcatgtctcacatggcagcagacaagagaagagagtgtgtgcagagaaacttccatttatttttattttatcttttattatactttaagttccagggtacatgtacacaacatgc

SEQ ID NO: 24846 - DNA, 87 bp, Homo sapiens
gactcagagccagccaatgagacatgggcttttgttaggggctgacatacagaagagagagtccagtggtggtgggttggacaggag

SEQ ID NO: 24847 - DNA, 58 bp, Homo sapiens; identical to SEQ ID NO: 1215

SEQ ID NO: 24848 - DNA, 113 bp, Homo sapiens
ctcattgtggttttgatttgcatttctctaatgatcagtaatgttgagattttttttctttttctttttcatttttttgagatggagttttgcccatgtcgcccaggctggag

SEQ ID NO: 24849 - DNA, 111 bp, Homo sapiens
ggtagtgatgaattctctcagcatttgttcatctgaaaaagactttattttttcttcatttatgaagtttagtttcactggatgcaaaattgctggctgataattattttc

SEQ ID NO: 24850 - DNA, 97 bp, Homo sapiens
aaatcagttggctatagctgtgtggatttatttctgggcccttaattatgttcccttggtctatatatctatttttatgcctgtaccatactgtttt

SEQ ID NO: 24851 - DNA, 67 bp, Homo sapiens
cctgattggaacaaaagagctgaggaagggagaactctctctctctctgtgagtgtctttgagctgg

SEQ ID NO: 24852 - DNA, 95 bp, Homo sapiens; identical to SEQ ID NO: 68

SEQ ID NO: 24853 - DNA, 93 bp, Homo sapiens; identical to SEQ ID NO: 69

SEQ ID NO: 24854 - DNA, 114 bp, Homo sapiens
caagagcatatttattcctgagcctaggcgacactctctctgagagtctgagaaataactggtgaagattttggagaggccagatgaccctgcactaggaataaggggctaatg

SEQ ID NO: 24855 - DNA, 83 bp, Homo sapiens
tacatgtatgtattatgtatgtatgttataatacatgtatgtatttttacatgtaacgacacatgcaccatcacatacatgta

SEQ ID NO: 24856 - DNA, 98 bp, Homo sapiens
aacatcagttaaatcaagatggctgataatgttgttcacatattctatctttgctggattttttcttagttgttcttttgatttttgttgctgttgtt

SEQ ID NO: 24857 - DNA, 82 bp, Homo sapiens
ccactgtggtctgagacaggacttgctataatttcattttttcttaaatttgttgagacttgttctgttttctatcatatgg

SEQ ID NO: 24858 - DNA, 112 bp, Homo sapiens
gatggtcattatcaagttgacaggtttcctatttctattttttaagtttttttaaaaatcatgagtagatgttgagttttgtcaatctctttctatattgattgatgtaatc

SEQ ID NO: 24859 - DNA, 78 bp, Homo sapiens
gacctttctctccctctctctctgcatatatatggtactgtcagagaggactggaggggcataggtgagaaggaggtt

SEQ ID NO: 24860 - DNA, 58 bp, Homo sapiens
tgagacggagtctctctctgtcgctcaggctggagtgcagtgttgtgatctcggctca

SEQ ID NO: 24861 - DNA, 83 bp, Homo sapiens
gtcttttgtggaacatatgcactcattcctagaggtggaattgttgatcatggggtagatgcatgtttagttttataaaatac

SEQ ID NO: 24862 - DNA, 114 bp, Homo sapiens
gaagtgttccctgatcaccacatccatgccaatatctactgttttttaatttttttattatgcccattcttgcaggaataaagtggtatacattgtggttttgatttgcatttc

SEQ ID NO: 24863 - DNA, 58 bp, Homo sapiens
tgagactgagtctcactctgtcactcaggctagagtgcagtggcgtgacctcggctca

SEQ ID NO: 24864 - DNA, 70 bp, Homo sapiens
atgtatgtatatatacgtgtatgtgtatgtatatatgtatatatacgtgtgtgtgtgtatgtatatatgt

SEQ ID NO: 24865 - DNA, 90 bp, Homo sapiens
ggcaagagtgcacttctctgctataggatagaaaaataacagtgttttccctgctctctactctcagtcactcagtgcaacacttctgcc

SEQ ID NO: 24866 - DNA, 58 bp, Homo sapiens
tgagactgagtctcactctgtcacccaggctggagtgcagtggtacaatctcagctca

SEQ ID NO: 24867 - DNA, 63 bp, Homo sapiens
tgagaggctgaggtagaaggatcacttgagcccaggagttcaagtccagcctgggcaacatca

SEQ ID NO: 24868 - DNA, 78 bp, Homo sapiens
gctgctgcacccgattaaagccttctccctcagcaacactcattgtctcagtgattggctttctgtgcagtgagcagc

SEQ ID NO: 24869 - DNA, 68 bp, Homo sapiens
ccttgtgagggatgttctctgggcacagggcagaatgtggttccagactgaggatgtctcttcaaagg

SEQ ID NO: 24870 - DNA, 132 bp, Homo sapiens
ctcggcctcccaaaatgctaggattacaggcgtgagccaccgctcccggcctaattctttaattttgtttagagatgggatctcactatgttggccaggctggtctcaaactcctggcctcaagtgattctc

SEQ ID NO: 24871 - DNA, 77 bp, Homo sapiens
ggtcatccaaatatgacaggcagttttcatgacgttgtgacagccgtgaaaatgtagtgcgtagattttggacggct

SEQ ID NO: 24872 - DNA, 77 bp, Homo sapiens
gttgttgttgtttgagatggagtctcactctgtcactcaggctggagtgcaatggtgccatcttggctcactacaac

SEQ ID NO: 24873 - DNA, 117 bp, Homo sapiens
ggatagtgttttgttgttgttgttgttgttgttgttgtttgttgtttgggggggacagagtctcattctgtcacagagtacagtgcatgatctcggctcactgcaacctccacctcc

SEQ ID NO: 24874 - DNA, 121 bp, Homo sapiens
gattctccctgccacagcttcagcagctgcgattacaggcgcccgtcaccacgcccagctaattttttttttttgagacggagtttcgctcttgttgcccaggctggagttcaatggcacg

SEQ ID NO: 24875 - DNA, 118 bp, Homo sapiens
gggaggaagtggaagcttccaatatcttgaggcctaggctggaagttggtactttagtttggaaaccagcccaggtcacagcacccacccaggctcaaggggaggcgacatggacccc

SEQ ID NO: 24876 - DNA, 94 bp, Homo sapiens
ctgctgagcgccacagagtcacagaagatacagaagtcacctgtggagggtggccatgtgggggctatgggctttgtctaaatagttcgaggag

SEQ ID NO: 24877 - DNA, 95 bp, Homo sapiens; identical to SEQ ID NO: 68

SEQ ID NO: 24878 - DNA, 93 bp, Homo sapiens; identical to SEQ ID NO: 69

SEQ ID NO: 24879 - DNA, 70 bp, Homo sapiens
ttgttttgagatggagtctcactctgtcacccaggctggagtccagtagtgcaatctcagctcactgcaa

SEQ ID NO: 24880 - DNA, 93 bp, Homo sapiens
cctttaaagctcccctaactgtaatcagagtgtctctttttttttttttttgagatggagtcttgctctgtcactcaggctggagtgcagtgg

SEQ ID NO: 24881 - DNA, 106 bp, Homo sapiens
ttgtattgtcttgggttggattgtcttttatttaagaaattttatctttaataattgcccaatggtggtttctagtttcaggcattttctagtctagtcagtatgg

SEQ ID NO: 24882 - DNA, 65 bp, Homo sapiens
acatttgccagtttgttttttctttaaaataggactattgtaagaaaatgcagaaaggttagtgt

SEQ ID NO: 24883 - DNA, 56 bp, Homo sapiens
gagacagggtctcactctgtcacccaggctggagtgcagtggtgtgatcatagctc

SEQ ID NO: 24884 - DNA, 103 bp, Homo sapiens
acctcagcctcttgagtagctgggactacaggtgcataccaccatgcccagctaattttttattttttgcacagatgaggtctcactacgttgcccaggctgg

SEQ ID NO: 24885 - DNA, 95 bp, Homo sapiens; identical to SEQ ID NO: 68

SEQ ID NO: 24886 - DNA, 93 bp, Homo sapiens; identical to SEQ ID NO: 69

SEQ ID NO: 24887 - DNA, 63 bp, Homo sapiens
cagtgtgacagggtgatgggatgctaaagctgaaacacagaccctcacactctggctgcactg

SEQ ID NO: 24888 - DNA, 107 bp, Homo sapiens
cctgggcaacataatgagaccctgttttttttaaaaaaaatttttaattaaaaaatttttaattaaaaaatatttttttgagatggagtctcactctgtcacccagg

SEQ ID NO: 24889 - DNA, 85 bp, Homo sapiens
acccagcctttttgtccttttactttcagtctgtatgtctctttataggtgaagtgagtttcttgtagacaacatagagttgggt

SEQ ID NO: 24890 - DNA, 126 bp, Homo sapiens
gtatatatgtgtgtaggtatatgtatacatatgtgtgtatgtgtattatgtatttaagtatatgtatattagtgtgtttgtgtatgtgtgtaggtatacacatacacatacacagagtatatatgt

SEQ ID NO: 24891 - DNA, 115 bp, Homo sapiens
gtatatatgttatatatatacacacatacatatgtgtatatatatgtgtgtatatatgttatatatatacacacatacatatgtgtatatatatgtgtgtgtatatatatatata

SEQ ID NO: 24892 - DNA, 94 bp, Homo sapiens
tcattatctacaattttttgcatgtttgatatagtttttaatagttttttttaaacttactttcgaatatgagaagagagttgtgtgcatgtga

SEQ ID NO: 24893 - DNA, 104 bp, Homo sapiens
ttgagaccagcctgagcaacatagcaagactccatctttttttttttttttttttttttttttttgagatggggtcttgctctgtcacccagtctggagtgcaa

SEQ ID NO: 24894 - DNA, 120 bp, Homo sapiens
tatgtatgtgtatatatgtgtatatgtgtatatgtatataagtgtatatgtgtatatacatatgtgtatatgtatatatacatatatacatatacacatatatatacatatgtgtataca

SEQ ID NO: 24895 - DNA, 70 bp, Homo sapiens
atgtatatatatatacatatgtgtgtatatatatgtatatgtgtatatatatatacatatgtgtgtatat

SEQ ID NO: 24896 - DNA, 162 bp, Homo sapiens
atatatatgcataggtataggtatacatatatgtatatatatgcataggtataggtatacatatatgtatatatatgcataggtataggtatacatatatgtatatatgcatatgtatatatgcatatgtatatatgtgcatatgtatatgtatatgtgcat

SEQ ID NO: 24897 - DNA, 182 bp, Homo sapiens
gtgtatatgtatatatactatgtgtgtatatatgtatacatatatgtatatatatgcatatgtataggtatacatatatgtatatatgcataggtataggtatacatatatgtatatatatgcatagatataggtatacatatatgtatatatatgcataggtataggtatacatatatgta

SEQ ID NO: 24898 - DNA, 90 bp, Homo sapiens
catagaggagaggagaggggtgtgcgtgggtttgttcccagagacggcaggctgggtagtcaggctccaggtttgaatccttgccctgtg

SEQ ID NO: 24899 - DNA, 91 bp, Homo sapiens
ggactagggagctgagacaactgattggcagtggatgaaatcacagaggtatcaaaactatcttcaagcagctgagtcagtttcttggtgt

SEQ ID NO: 24900 - DNA, 112 bp, Homo sapiens
gttcactctgagtttgcacatccaccctttgcaggagcctcattatttttattttacaaataaggaaattggggtttgggttggtgaggtgacttgaataacagatgacaga

SEQ ID NO: 24901 - DNA, 143 bp, Homo sapiens
gaggtgtagggataggacagctgggggaggccttggccaaggtcaaggagtaggcccagtctccctctctgtgtgcctgtctgggactcggtttcctgtctgtgaagcagggctggacgggatattgacagcacctgatggtc

SEQ ID NO: 24902 - DNA, 125 bp, Homo sapiens
gaggctggtacagagtccaggcaggctcagtggccatcatgcccctacgatgactgtcactccctctccgtgcgcctggcctctgctggctctggccaggggtggtcacagcactagggtggcag

SEQ ID NO: 24903 - DNA, 134 bp, Homo sapiens
atatgtatatatgtatgtatatgtgtatgtgtctgtgtgtgtgtgtgtgtgtgtgtgtgtgtgtgtgtgtgtatgtagttgttcagacagggactcactctgtcacccaggctggaatgcagtagcacaatcat

SEQ ID NO: 24904 - DNA, 63 bp, Homo sapiens
gtggcttctgcctgtaatcctagtgccttgggaggctgaggtaggaggatcacttgaggccac

SEQ ID NO: 24905 - DNA, 80 bp, Homo sapiens
atggccggcttaaacgaaaaatgttgattcttcacagttcctagaggggaagtctgagatcaaggtgtcagcagggccat

SEQ ID NO: 24906 - DNA, 78 bp, Homo sapiens
atgaagagaagtctccagtttccagccataaaggtagctgctgctaccctattgttcttttggagatattctctgcat

SEQ ID NO: 24907 - DNA, 103 bp, Homo sapiens
tacgtgtgtgcatacaatgtgtgtgtgccacatgcatgcggctggtgcatgtgtacctgcatgtgcatgtgggcacatgtactgtgtgtgcagtttgtgtgtg

SEQ ID NO: 24908 - DNA, 65 bp, Homo sapiens
ggtgtaactgtacagtgcacatacatcttgagggtacccctgagtgtgtgtgtctgtgcatgtcc

SEQ ID NO: 24909 - DNA, 92 bp, Homo sapiens
acaggtgtgagccactgtgcccggcccatttttattttttaattaaaacaatttttttgagatgggggtctcactgtgttactcaggctggt

SEQ ID NO: 24910 - DNA, 109 bp, Homo sapiens
cttcagcttttgtttatctgagaatgtcttaatttcaccctcattttaattttttaaaattttttatttattttgagatggagtttcactcttgtcgcccaggctggag

SEQ ID NO: 24911 - DNA, 88 bp, Homo sapiens
cctggacaacacagcaagatattgtgtttactaaaaaaaaaaaaaaaaaaaaaatttgagacagtgtctcactgtgtcatcctccagg

SEQ ID NO: 24912 - DNA, 116 bp, Homo sapiens
cccaaagtgctgggattacaggcataagccaccgtgcccggcctctttttttttaattaaaaaaaaaattttaggctgggcacggtggctgatgcctataattctaacactctggg

SEQ ID NO: 24913 - DNA, 164 bp, Homo sapiens
atatacacatatacacttatatacgtatatatgtgtatatatacataaacatgtgtgtatatatatacatatacatatgtgtatatatacgtatatacgtatatatatgtgtatatatacataaacatgtgtatatatatatacatatatatatgtagcctagg

SEQ ID NO: 24914 - DNA, 71 bp, Homo sapiens
ggagactactccctgactctctctctcagtggttccaaagggctcctggccagagatgtcagaagttttcc

SEQ ID NO: 24915 - DNA, 76 bp, Homo sapiens
ggtgggaaacctggggaagagcaatctatctggtcatcctgaagtggcagaccgtgcctctgtccctttctccatc

SEQ ID NO: 24916 - DNA, 91 bp, Homo sapiens
tgtctgcgaggtccatccatgttgtgtagcatgtgtcagaatttctttttttttaagactgaatagccaggcatggtggctcatgcctata

SEQ ID NO: 24917 - DNA, 111 bp, Homo sapiens
gaggtgaaaatacgaggtgatcctgtgcatgtggtgaccctgtgtgaagtgactctgcacaaggtgactgcatgagatgaccctgcataaggccaccctatacgagctctc

SEQ ID NO: 24918 - DNA, 105 bp, Homo sapiens
aggtgtgaggctgtgagaccaggggcgtgagatgtgtgtgtggacaaggctggacagggctgggcaggggcacctcagcaaaaaccgttctgcagcagcaggctt

SEQ ID NO: 24919 - DNA, 80 bp, Homo sapiens
gagtctctgtctctcaggctggagtgcagtggcgccatctctgctcgctgcaacctccacctcctgggttccagcgattc

SEQ ID NO: 24920 - DNA, 81 bp, Homo sapiens
gccgggattacaggtatgagacaccacagccggaccttttttttttttgggacagagtctctcatattctgtctcccaggc

SEQ ID NO: 24921 - DNA, 58 bp, Homo sapiens; identical to SEQ ID NO: 7353

SEQ ID NO: 24922 - DNA, 106 bp, Homo sapiens
gagcaagaccctatctcaaagtaaaaaaatttttaaaagttaagcaagggccagcaatctcttatcttttatttttatttttttattttgagactgggtctcactc

SEQ ID NO: 24923 - DNA, 108 bp, Homo sapiens
gctggtagtataggtgcgcgccaccatgccctgctaatttttgtatttttagtaccaacaaggtttctgcatgttggccaggctggtcttgaactcctgacctcaagt

SEQ ID NO: 24924 - DNA, 77 bp, Homo sapiens
atagggggaactagagggaaatggaaagactgaaggcgccctccagtccgctttctgtttctctgagtgtcacttat

SEQ ID NO: 24925 - DNA, 60 bp, Homo sapiens
gtgtctctgacactgtgtcactttggggccccaggggatggaagccagatgtcagaacgc

SEQ ID NO: 24926 - DNA, 83 bp, Homo sapiens
gctagatcaagaggtgacaacctggaagagaaatggggctagagacaggctggctgtaaaccagtggttgtcgaggagatagc

SEQ ID NO: 24927 - DNA, 106 bp, Homo sapiens
ctgttcttgggtctggcagcctgtgactgacctggtgtccctcatgcaacctcacagaacagagtcagggtcacagcactgtcatggctgcaccatgacctggcag

SEQ ID NO: 24928 - DNA, 79 bp, Homo sapiens
cctgggacacggcagtgtcttcacgactctgacttcccactgaagtcacactctctgggacacagcagtgtctgtaagg

SEQ ID NO: 24929 - DNA, 90 bp, Homo sapiens
cagcttggaagttagaagcaagatggagttggttcggtcagatctctgtcactgtctcagttataattttgcaatggtggtttcaagatg

SEQ ID NO: 24930 - DNA, 75 bp, Homo sapiens
gggtctcactctgtcacagaggctggagtgccgtggtgcaatcatggcacactgcagccttgacttcccagactc

SEQ ID NO: 24931 - DNA, 68 bp, Homo sapiens
gggtctgtcctatctctggtggctgccctgaaagatgacagtgcccagaggaactagggatagagccc

SEQ ID NO: 24932 - DNA, 84 bp, Homo sapiens
gtatatgtgtgagcatatgttcatgagcgtgcatgtgggtacatgtgagtgtatattcctgagtgtgtgtgtgactgtgtgtac

SEQ ID NO: 24933 - DNA, 117 bp, Homo sapiens
gcattcttgagcgcttgagttaatgcgtggctaccagaaatgacaggatttttgtctgggactgcagagtggaagctgttgtttctgggacagagtctcattgttaggtgtagttgc

SEQ ID NO: 24934 - DNA, 114 bp, Homo sapiens
ttcatgtgcatctgtgtgtctgtgcccacatacatgcatgcctccgtgtttctgtgtgtgctttgcatgtgcgtgtatgcctctgtatgtaggacttggacgcagacatttggg

SEQ ID NO: 24935 - DNA, 65 bp, Homo sapiens
aggtgcagccgtgcccaggccgctggactccagacagtgccagcctgggtccctgaatcacacct

SEQ ID NO: 24936 - DNA, 83 bp, Homo sapiens
tacgtatatatacgtatatatacgtgtatatacgtgtatatacgtgtatatatgtatatatatgtgtatatatgtatatatgc

SEQ ID NO: 24937 - DNA, 95 bp, Homo sapiens; identical to SEQ ID NO: 68

SEQ ID NO: 24938 - DNA, 93 bp, Homo sapiens; identical to SEQ ID NO: 69

SEQ ID NO: 24939 - DNA, 100 bp, Homo sapiens
tgactactttagatacctcatataagtgaaatcatacagtacttgtatttgtctttttgtgactggctgacttcacttggcataatgctctcaagtttca

SEQ ID NO: 24940 - DNA, 57 bp, Homo sapiens
gcatgtgttggggaagggggcatacaggaaatctctgtatctttctctcaattttgc

SEQ ID NO: 24941 - DNA, 65 bp, Homo sapiens
ctaagagatagagggacagtggtgggactgtaggccttggcctccctgaattctctctctctgag

SEQ ID NO: 24942 - DNA, 101 bp, Homo sapiens
tgtatgtatgtttgtgtgcttatgtgtatatgtacacacacacacacacacacacacacacacacatatacatatgcatatacatatatatacacacatcc

SEQ ID NO: 24943 - DNA, 83 bp, Homo sapiens
gctgctccctctgaggctctctgagtctgtgagtggcatcacaagaggccaagcccagacatccagtgtctccctttctctgc

SEQ ID NO: 24944 - DNA, 63 bp, Homo sapiens
ctgcaccatcactgtggctcagtctctccatccaccagatgggcagattggtgacaactgtag

SEQ ID NO: 24945 - DNA, 73 bp, Homo sapiens
ctttgtaatcaggtagatgtgtttgcgtgggcatgcctgtatgtctgtgtgtgtatgtctgtgatatgcaggg

SEQ ID NO: 24946 - DNA, 95 bp, Homo sapiens
gtgagctgctgcacccggccagggtttctttttgaagctgaagtctcggtctctgtctcaggaagaccctggaggaaggtggcgagagacctcac

SEQ ID NO: 24947 - DNA, 100 bp, Homo sapiens
gctgcccacaaggcctgagcttctcttactctgtcacctaatcagagggagctccccatgaggccataggtacaggctgggagagagaaggcagggtagc

SEQ ID NO: 24948 - DNA, 79 bp, Homo sapiens
ttctagggggaggtgtctagcagggcagggctggggctggaggaagctccggtgccttctgtgctgactttccctagga

SEQ ID NO: 24949 - DNA, 107 bp, Homo sapiens
tgtatatatacatatatgtgtgtgtatatatgtgtatatgtgtatacatacgtgtgtgtgtgtatatatatatatatatatatatatatatatatatatacagcacg

SEQ ID NO: 24950 - DNA, 82 bp, Homo sapiens; identical to SEQ ID NO: 2170

SEQ ID NO: 24951 - DNA, 68 bp, Homo sapiens; identical to SEQ ID NO: 2134

SEQ ID NO: 24952 - DNA, 58 bp, Homo sapiens; identical to SEQ ID NO: 2135

SEQ ID NO: 24953 - DNA, 56 bp, Homo sapiens; identical to SEQ ID NO: 2136

SEQ ID NO: 24954 - DNA, 56 bp, Homo sapiens; identical to SEQ ID NO: 24715

SEQ ID NO: 24955 - DNA, 86 bp, Homo sapiens
tctatgtacacatatctatgtatacatatatttatgtatatatacatacatgtatatatatatgtgtgtatgcatatatatataga

SEQ ID NO: 24956 - DNA, 101 bp, Homo sapiens
agagctgaggcctgcggtgaatgctcaccctcaccctctgactgtccgctttcagaacactcagtggcaagagaggttgagatccctgaatcctgggttct

SEQ ID NO: 24957 - DNA, 116 bp, Homo sapiens
tgaacttgaactgctcactgcatcttcccagacctcctagaagttcatgatttcacagatgagagacaggagtgctgcagggttgtgtggagggtctaaggttgcacacagagtca

SEQ ID NO: 24958 - DNA, 68 bp, Homo sapiens
ctgtctcttctgagagtcccccagacttatgagacccttgggtgtgtctgtgtgactgcctccgacag

SEQ ID NO: 24959 - DNA, 136 bp, Homo sapiens
gtcacatgcaaacactacagaaccttgacagaagagagacatgtgacaagcatgcaccactgtcaagtctgtcggaggcagtcacacagacacacccaagggtctcataagtctgggggactctcagaagagacag

SEQ ID NO: 24960 - DNA, 102 bp, Homo sapiens
gttgtgtaggttccttatatattttggacattaatgtgtttcgaatatatgctttgtaaataagttatttcattatgtaggttgcctttttattcactcaac

SEQ ID NO: 24961 - DNA, 114 bp, Homo sapiens
gcccttcatgctctttcctcttaaaagtgtggtttaggtgctgcatctgtcactcacactcgcacctcagtggccagaatgtagcagcaggacccacctgactgcatggaaggc

SEQ ID NO: 24962 - DNA, 101 bp, Homo sapiens
atatgtatttgtatgtctgtgtatatatgtgtatatatatatgtgtgtgtgtgtgtataaaatcacatatatagaaaaacatatatatatatatatatatg

SEQ ID NO: 24963 - DNA, 87 bp, Homo sapiens
tgaacttgagagagatgatttagggtaactggaagaagaaatttccttttttttttttttttttttagatggagtctcgctctgtca

SEQ ID NO: 24964 - DNA, 73 bp, Homo sapiens
gttgaggacttggctgcctgtgtctctgagtcaagaagtcatgaagcagagcacccaactgcctgtgattgac

SEQ ID NO: 24965 - DNA, 79 bp, Homo sapiens
tgagattgattgggagacaggagagctccaaatagcttcagagcagctgtcagcttcagtctgtctctgcaaagactca

SEQ ID NO: 24966 - DNA, 106 bp, Homo sapiens
atatatattccttatgtattatatataatcgatatgtatatgtataaactatgtgtatatataaaaattatgtacctatataattctaatagataaaagtgtatat

SEQ ID NO: 24967 - DNA, 89 bp, Homo sapiens
tgcaactttggtagctgtccatgaagaccaatgggcatgagtcgaggcagggatttttcttatttttgtttttgtggagagtgaaggca

SEQ ID NO: 24968 - DNA, 64 bp, Homo sapiens
cactagagctttcagatctgagagtggagaccccaggaccactttctatctgtggctctgggtg

SEQ ID NO: 24969 - DNA, 88 bp, Homo sapiens
cagtgcagcttaagtgtacagtgtttgcaaagtctacagtagtgtgcagtaatgtcctagattttcacattcacttaaccgctcactg

SEQ ID NO: 24970 - DNA, 63 bp, Homo sapiens
ggggtctcactcagtcacccagtctgtgcagtcacccaggctggagtgcagtggtgtgatctc

SEQ ID NO: 24971 - DNA, 56 bp, Homo sapiens
gggctttctctcattggttttcttctttattgacttgaatggattgagggaagcct

SEQ ID NO: 24972 - DNA, 89 bp, Homo sapiens
ctgttgtgccattctgtggctctgtcactctactgctcctctgcttttctgcttgtggagcctggggtttaggatttatatggttacag

SEQ ID NO: 24973 - DNA, 95 bp, Homo sapiens; identical to SEQ ID NO: 68

SEQ ID NO: 24974 - DNA, 93 bp, Homo sapiens; identical to SEQ ID NO: 69

SEQ ID NO: 24975 - DNA, 116 bp, Homo sapiens
ggtaaaattaagaattattactggcgaatattttgcttacattttgatatttatatttttatgtctatttaattaggatggtttgcaatgtagtcaggaatgataagtactgtgcc

SEQ ID NO: 24976 - DNA, 66 bp, Homo sapiens
tgtgcttaatccaacctcacctccagcagagggagggagactgcctctctgactgcctgtggcaca

SEQ ID NO: 24977 - DNA, 83 bp, Homo sapiens
gttcaccttagacactctgaatttgttctttcctcttcctgggacaatctttcctagagggtgacagaagtgtctgtttaaac

SEQ ID NO: 24978 - DNA, 68 bp, Homo sapiens
tgatggaattgtggagactttggccttgtgattcagccctggatgagttgtctccacattacttatca

SEQ ID NO: 24979 - DNA, 103 bp, Homo sapiens
gataggcatgaaaatgttaacaatgattgtttctgagggatgggttcttattatcatttttgcttatttttattttaaaatttgtccacatgatcatgctttc

SEQ ID NO: 24980 - DNA, 113 bp, Homo sapiens
tggcctgagagcaaacattgcatgattgctattcttttaaatttgttaagtggtttttttttttttcagaatacagtttatcttggttagtatttcatgtaggcttgaagaca

SEQ ID NO: 24981 - DNA, 113 bp, Homo sapiens
ccattattctttgctgaaattgatttgattaaatgtatgtatatatatatatgtatatatataaaatatatatgactattcagattgtctatttcttcttgtgtgagttttgg

SEQ ID NO: 24982 - DNA, 79 bp, Homo sapiens
gagtaaaatgctctctactgtgtcagagtctgtgtgtccagggaaggtatagaaataggacagaataggatgctaactc

SEQ ID NO: 24983 - DNA, 74 bp, Homo sapiens
ctgtatatatacatatacatatatatgtatatctatataactatagatatatatgtatgtatgtatatgtatgg

SEQ ID NO: 24984 - DNA, 106 bp, Homo sapiens
ggtgaagataatatatatatttaaagtggatgtatttatatatatttaaagtggataccatttaaatatttggatacttatatttatatttaaataagtggatacc

SEQ ID NO: 24985 - DNA, 110 bp, Homo sapiens
tttttgtcatattcattgtattttattctccaggttgagatcttcctggttttttaaatgaccagtgatttttttgttgaaacctaaatattttcttgttatggcatgag

SEQ ID NO: 24986 - DNA, 79 bp, Homo sapiens
cctgcccagccacacactgcctctctgggaagggaaggcatcccactgcagagcaggagcgactcaggagctgggccag

SEQ ID NO: 24987 - DNA, 84 bp, Homo sapiens
gttgttgttgttttgagatggagtctcactctgtcacccaggctggagtgcaatggtgcgatctctgctcactacaacctctgc

SEQ ID NO: 24988 - DNA, 70 bp, Homo sapiens
gcctgcctcaggctctcaaagtgctgatttttttttttaaatgtctgcagttggagagaagttggcatgt

SEQ ID NO: 24989 - DNA, 81 bp, Homo sapiens
tgcatgtgtatgcatacgtctatgtctattacacatatttatatatgtgtatatatgtagacacatatgcatacatatgta

SEQ ID NO: 24990 - DNA, 95 bp, Homo sapiens
tacatacatgtgccatacatatgagagttatgtatgtgaatatatatgtatattaggtatgcagtctttatatgtgagtgtatatatgttatgta

SEQ ID NO: 24991 - DNA, 69 bp, Homo sapiens
ggtcctgtgacatgctgctagacgtgtgtgggcagaattctttgcctgactctcactcagccagaggcc

SEQ ID NO: 24992 - DNA, 82 bp, Homo sapiens
gcaggcggggcctcagtgggtctcactgactctgggcttgattctctggactgtgaagtgggcagtgaggcctggctggccc

SEQ ID NO: 24993 - DNA, 72 bp, Homo sapiens
ctgcactccccacactctctggctctgctatcctggctggttagctgggtactaggtgggctgtgggtgcag

SEQ ID NO: 24994 - DNA, 102 bp, Homo sapiens
taggttaagaacattcctatgtgtatgcattgcttgtgaatatatacatgtatgtttatctgaaagacaatttaaatatacagttggtagacgaagggctta

SEQ ID NO: 24995 - DNA, 70 bp, Homo sapiens
gcgcactcactgacagtcagaagccagctcctctccagggccagggcctgtggaagtcagtgtaaggcgc

SEQ ID NO: 24996 - DNA, 112 bp, Homo sapiens
aggaaggcctggccccatcccgcagccataagcccttttcaaaggtgtcacctaaatgtgaactgatattgatcttttaaagagcatttctctgtctggtgtgcaggcacct

SEQ ID NO: 24997 - DNA, 71 bp, Homo sapiens
ctctcactctcactgccacagctgaggctacatcacggccccagcactggcggctccctgtgcgaggagag

SEQ ID NO: 24998 - DNA, 89 bp, Homo sapiens
agttcaacatggaaagatttgtgtgtctgatgtctgtgaggagactatatcaagcaagtatttgaacactcttctttcagttgctagct

SEQ ID NO: 24999 - DNA, 89 bp, Homo sapiens
agtcagctaatataatggtttttaaatgaattaaacattcattaatgtatgaatttatatttattttgccattctgtattgcagctgct

SEQ ID NO: 25000 - DNA, 126 bp, Homo sapiens
tgtgtgtgtgtgtgtgtgtgtatatgtatatgtgtgtatatatatatataaatgtatatatataaatgtgtgtgtgtatgtgtatatatatatatatatatatatatatacacatacacacacaca

SEQ ID NO: 25001 - DNA, 102 bp, Homo sapiens
aagacagcaatttgtaaacactggccagaagtttttaatctgttgaattttttttaattttaaagttatttagaggctagtgtttttctagttattgatctt

SEQ ID NO: 25002 - DNA, 116 bp, Homo sapiens
tttccttccttagggcaattctagcttctttatcattacttgaagaatagtcattttcttaatgaatgccaggggaatgttaaagaccaaaggcagaaggcaatgaaggagagggg

SEQ ID NO: 25003 - DNA, 101 bp, Homo sapiens
agttttcttagtggttcttctaggtgttataatacatatatatgacttatcacagtctactgatattgttatttactaccttgggtgaagtgtagaaagct

SEQ ID NO: 25004 - DNA, 58 bp, Homo sapiens
tgagatggagtctcactctgtcacccaggctggggtgcagtggtgtgatcttggctca

SEQ ID NO: 25005 - DNA, 118 bp, Homo sapiens
agctttgagttattacatatatgtatgtgtgtatatatatatatatgtctgtgtatctacatatatatattatgtgtgtatatatatttatatatatgtcttgtgatattgctttagc

SEQ ID NO: 25006 - DNA, 83 bp, Homo sapiens
ctaaggttcagagagtcaggaatatatctagtgcttcagaagcaggagtcctggcaacttctccctggctctctgtatctcag

SEQ ID NO: 25007 - DNA, 76 bp, Homo sapiens
gagtctcactctgtcacccaggctgtcgtgtttacggctcactgcagcctcaaactcctgtgctcaagtgatcctc

SEQ ID NO: 25008 - DNA, 102 bp, Homo sapiens
tttttttggcctgtttccatgatgttgttgatagctgtttttggctcctcagcatttctatcaaactttttgaaaacagcaaatacctctaagctaaaagag

SEQ ID NO: 25009 - DNA, 117 bp, Homo sapiens
tctccaagacttttctttggaaagcccacatagaacagaaaaaagaaatgccatcttttaaactatctatttaactatcttgtggccccatgtttccaaggttggggtattgggaga

SEQ ID NO: 25010 - DNA, 106 bp, Homo sapiens
ggagttttatcaactctctgctctattattgagtgtgaggacacagccttgttctgatggctgtactgctgtcctagtcctctcactggaagcagggcatagctct

SEQ ID NO: 25011 - DNA, 64 bp, Homo sapiens
cagtaaacccagagtcaacaccccaagcccctcctctatgggtctgtcacactctgggcaactg

SEQ ID NO: 25012 - DNA, 98 bp, Homo sapiens
gtagtatatatatgtgtatatatatatatatatatatatatatgacatgtatatatatggtatatatatatacacacacacacacacgtatatatcac

SEQ ID NO: 25013 - DNA, 153 bp, Homo sapiens
tatgtatgtatatatgtacatgcatatacatatatacatacatatttacatacatatttgtgtatatatgtatatgtgtgtatatataaatatgtatgtacctgtgtgtacatatatatacatatatacattcctggtgtagcagtaggtttg

SEQ ID NO: 25014 - DNA, 73 bp, Homo sapiens
tgttactggatttctgtttttgattttttgagacagggtctcactctgtcacccagtctacagtgcagtgaca

SEQ ID NO: 25015 - DNA, 135 bp, Homo sapiens
ttcagcaaagctatttcacacatggtgttttgtacttcagcaggtggcacataatgtctgtggctgtctctctcttagtgatcagtgattcagatagcaacagctgaatgcctctgtttcaagtattcctttgcc

SEQ ID NO: 25016 - DNA, 109 bp, Homo sapiens
agagattctatctatctatctatctatctatctatctatctatctatctatctatctggtatattatatgagatggacagatagatataaaaagatagatagatcctct

SEQ ID NO: 25017 - DNA, 75 bp, Homo sapiens
ctcggtctctaaaagtgctgggattacaggcgtgaaccaccgcgcccggcttatttatttatttttgagatggag

SEQ ID NO: 25018 - DNA, 95 bp, Homo sapiens
gtgacttgaagatggaattattaaacaaaaaggaactggaatgtaaaaatttgggaaattctcagtatatcttttttattttcactttaagttcc

SEQ ID NO: 25019 - DNA, 116 bp, Homo sapiens
tcttaatgatgctggtgtaggcaagatttatattaatgtaatatatctatattatatataatattatatattatattacattaatataaatcttgcctacaccagcatcattaaga

SEQ ID NO: 25020 - DNA, 103 bp, Homo sapiens
tgaatatatgtgtgtgtatatatatagatagatagatatgtatatatatatgtgtatgtatatgtgtatatatgtgtatatacatatatacaatatatattca

SEQ ID NO: 25021 - DNA, 95 bp, Homo sapiens; identical to SEQ ID NO: 68

SEQ ID NO: 25022 - DNA, 93 bp, Homo sapiens; identical to SEQ ID NO: 69

SEQ ID NO: 25023 - DNA, 91 bp, Homo sapiens
ctggcgtcacttccccatctctgcttctctttaactctcactgagtctgtataaatgtgtgtccagaggtccttgtgggaactttctccgg

SEQ ID NO: 25024 - DNA, 116 bp, Homo sapiens
gaccctttgtttttcagattgttggagaaaagtgtgttgtatgtatgtgcatgcatttttatatatattgtagcatatatatggcactcttataaaacactgaggcacttattgtt

SEQ ID NO: 25025 - DNA, 63 bp, Homo sapiens
gaatatgtaagatgagaaacgtgtgggtgtgcacacgcactcacactaactcactcgctcttc

SEQ ID NO: 25026 - DNA, 58 bp, Homo sapiens; identical to SEQ ID NO: 20501

SEQ ID NO: 25027 - DNA, 93 bp, Homo sapiens
atatatatatatatatgcatgtgtgtgtgtctgtatatatatttttatatatgtgtgtgtatatatatatactatatatatcatatgtatata

SEQ ID NO: 25028 - DNA, 70 bp, Homo sapiens
ccaaagtgctgggattacaggcatgcgccaccgcgcccggctgattctatatatatttaaagggctttgg

SEQ ID NO: 25029 - DNA, 132 bp, Homo sapiens
tatacatatatacgtatatatacgtatatatatatacgtatatatacgtatatatacgtatatatatgtatacatatatatatacacatatatatatatacatacatatatatatatatatatatgtatata

SEQ ID NO: 25030 - DNA, 124 bp, Homo sapiens
tatgtgtatatatatgtgtgtatatatgtgtgcatatatatgcatatatatgtgtatatatttgtgtatatatatgcgtatatatgcgtatatatgtgtatatatgtgtatatatatacacaca

SEQ ID NO: 25031 - DNA, 96 bp, Homo sapiens
gtggtgtatggtatatgtgtatatatatatgtgtgtgtgtgtgtgcatgtgtgtgtgtatatatatacacatatatacacatatatacgcatatat

SEQ ID NO: 25032 - DNA, 116 bp, Homo sapiens
ttttatgtcttattctgaaaaatgtctactcatatcttttgcccatttttaatcagtatatatatatatatatagaaaaagatatgaatagacgtttttcagaataacacataaaa

SEQ ID NO: 25033 - DNA, 96 bp, Homo sapiens
tattctgaaaaacgtctattcatatctttttctatatatatatatatatactgattaaaaatgggcaaaagatatgagtagacatttttcagaata

SEQ ID NO: 25034 - DNA, 95 bp, Homo sapiens
caaacaaaaaagaggtagcattccaaggtccaaggctctcaaaagaaagtgtgctcagaggtttggataatgctcaaacacgtagcttgggtttg

SEQ ID NO: 25035 - DNA, 103 bp, Homo sapiens
tgactcacatcttcatttttgagtggcagtcactgtctctttgatgttcaatgttcaagtttaaattcattgacggagactttcagttaaaaatgatggatca

SEQ ID NO: 25036 - DNA, 113 bp, Homo sapiens
gtaggatcgctgggtgcatctgggaggtgtgcctttccaatgactacatttactctctcacacacttagtagagcctgcaggggttgtgtgtacctcgtgtgtatcagtgacc

SEQ ID NO: 25037 - DNA, 84 bp, Homo sapiens
cgctgatggctccctctctgggactgcatggcttcatcacacatggggatgagaactggggcctgacagtccagggcagtgagt

SEQ ID NO: 25038 - DNA, 69 bp, Homo sapiens
ggagtcagtgtctcgctgtgtcacccgggctggagtgcagtggtgtgatctcggctcactgcaacctct

SEQ ID NO: 25039 - DNA, 56 bp, Homo sapiens
gagacagtgtctcactctgtcgcccgggttggagtgcagtggtgcgatcttggctc

SEQ ID NO: 25040 - DNA, 74 bp, Homo sapiens
tccagtatctaggtggaaaggggacttttttttttttttttgagacagggtctcactctgtcaccccgactgga

SEQ ID NO: 25041 - DNA, 128 bp, Homo sapiens
cagggtgctgtagatgatgcacagggctggaggcagtgcagccccccattgtctcagtctcactccctgcccaaggcccaccagcacctgctgctcaccaaagggaaaggaagctggtcgatttggca

SEQ ID NO: 25042 - DNA, 120 bp, Homo sapiens
cagagagtgctgtgtcaggggcagaggggcctgtcgctggagctggaaggtgcctgcctttgtgtctgactcagtctcctgtctgccttgccccctcagggtctcgccagcccagcctct

SEQ ID NO: 25043 - DNA, 65 bp, Homo sapiens
ttgtttgtaggttgtagtaacagtgtgctggaccagtggtcagactcactgtctcctacagagaa

SEQ ID NO: 25044 - DNA, 90 bp, Homo sapiens
ggtcttgcgtttacctgaggttgtactctatggcttcaccattaaagtgagagagcacacagacctattccctcacggaaggcaaaaact

SEQ ID NO: 25045 - DNA, 88 bp, Homo sapiens
gtcgcagtcgggatggcgtggggctccgtgggaccctgcgtgcctctctgggcctttgcggaggatgtacagccatctctgctgggac

SEQ ID NO: 25046 - DNA, 77 bp, Homo sapiens
acatatcagactacacagtgcctgcttcagagcagacagcgtttgctggtgcggggtgtgtgtgtgtgtgtgtgtgt

SEQ ID NO: 25047 - DNA, 86 bp, Homo sapiens
gttgtccgggcccgactgcacccttcacccctgcctgccacttcctactcagtcccaagagagtgcagtcagtgagctcaaagaac

SEQ ID NO: 25048 - DNA, 117 bp, Homo sapiens
gctgctcccggggtgtccgcgctctgccccctggccattcactgtctctgtggccctctcctggtgtctgctggtggacaggttagtgagggaagaagggccttcctgggattgggc

SEQ ID NO: 25049 - DNA, 118 bp, Homo sapiens
gatgtttattcaggctggttacttaggtataatttgctgaccagaaaatttatcattttttaatgtacaatttgtggagtttggaaaggtatatagttatggaaccagtaaagacatt

SEQ ID NO: 25050 - DNA, 58 bp, Homo sapiens
tgagactgagtctcactctgtcgcccaggctggagtgcagtggagggatctcggctca

SEQ ID NO: 25051 - DNA, 115 bp, Homo sapiens
gattggaatctctgccaggacatcttgtaacatctcagacctcttttttttttttttttttttgagagtctcactctgttgtgtaggctggagtgcggtggcatgatctcaactc

SEQ ID NO: 25052 - DNA, 101 bp, Homo sapiens
tcactgagatgacttttataaagcagtgagtacagagtgtggtcatggccttcacaggatcccagtcggtgcaattcaaaatgcatgaaaggctcaaatga

SEQ ID NO: 25053 - DNA, 118 bp, Homo sapiens
cagggtgtaaaactgaccctataggcctcggctgacatgagtggattttctttctttttttttcctgagacggagactcactctgtggcccaggctggagtacagtggcacaatcttg

SEQ ID NO: 25054 - DNA, 114 bp, Homo sapiens
tggaaggtttttggttactgattcgatttcctgactgcttataggttatgtccagaatttttgtttctttataactcagtcttagtaggatatatgtttgtagaaatctatcca

SEQ ID NO: 25055 - DNA, 94 bp, Homo sapiens
gagtcatagcattttaaagcctaagaccaacttttgtatgatgccagtgatgtgctaataaaaaagtatcttttttttatgctatgagcttctc

SEQ ID NO: 25056 - DNA, 108 bp, Homo sapiens
atgtgttggattttaaatgtagagtcttccctgatgtttatttcgctgtgttgttagcagcttgttcactagcaagagattctaaaccagatttattattctagacat

SEQ ID NO: 25057 - DNA, 69 bp, Homo sapiens
ctgaggctctcactgcctctctgtggaccctctaactagggtatggccagagcgggagggaggcagcgg

SEQ ID NO: 25058 - DNA, 73 bp, Homo sapiens
gtctgtctgtctgtctgtgtgagagtgggcgtgaagttaaagctaacttccagcacttggcaaagcagcagat

SEQ ID NO: 25059 - DNA, 95 bp, Homo sapiens
ctaatgattatttgttttcctacttgtgggttgtttctctctctctgagtttacagcttttaacataacacaatcagagaacagaaaaacatcag

SEQ ID NO: 25060 - DNA, 87 bp, Homo sapiens
gctagaaatacagatgaagtttcccttcactcgcctgctgctcacctctggctctgtggccctgtgtttggagactgctgctcaagt

SEQ ID NO: 25061 - DNA, 110 bp, Homo sapiens
ttagccaaatgtgggggtacctgcctatagtctctctccctctctctatttttttttttttttttttttttactttttgagacatggtctggctctgtcacccaggctga

SEQ ID NO: 25062 - DNA, 84 bp, Homo sapiens
tatctatctatctatctatctatctatctatctatatctatagatagatagatatagatatagatatcgatatagatatagata

SEQ ID NO: 25063 - DNA, 92 bp, Homo sapiens
ccaagctgaaatacatgagtatctaggttgaatactctgcttgaatgtccagcaaagtggataaaaatagatctttactaagtagcaaatgg

SEQ ID NO: 25064 - DNA, 126 bp, Homo sapiens
ccagctttgttctttttgcttaggattgtcttggctatacaggctcttttttggttccatatgaaatttaaagtagttttttctaattctgtgaagaaagtcaatggtggcttgatggggatagca

SEQ ID NO: 25065 - DNA, 94 bp, Homo sapiens
gaggcaggtccagccaactcttaagttcattttttaaattagaattctcttgagagggatttgggagagagaataagggtctgttccttggttc

SEQ ID NO: 25066 - DNA, 98 bp, Homo sapiens
aggaaatggaagcaacacagaagagagacagatgtgagatgcaaatggagaaactgcaggctggggacatcttctgagcctctgagttcagccagcct

SEQ ID NO: 25067 - DNA, 115 bp, Homo sapiens
ttcttcctctgagattatatttcagcacaatctacaaatctacttgtatatatataaaggatacaaatgtaaatatataaagtatgtgattaagcttgatattttaggttaggaa

SEQ ID NO: 25068 - DNA, 95 bp, Homo sapiens; identical to SEQ ID NO: 580

SEQ ID NO: 25069 - DNA, 93 bp, Homo sapiens; identical to SEQ ID NO: 69

SEQ ID NO: 25070 - DNA, 87 bp, Homo sapiens
gcagcaggcactcacacttgggcaggcagctggcgcttaccccggtccatgtctttcctgtctctccatctctgactgtttccctgc

SEQ ID NO: 25071 - DNA, 62 bp, Homo sapiens
ccttgttgctcacacaaagcctgtttggtggtctcttcacacagatgcgtgtgacaacaggg

SEQ ID NO: 25072 - DNA, 64 bp, Homo sapiens
tgagggatgtgcgtgtgcatctgcatgtgtgtactgggtagatgctgcattcgttattctttca

SEQ ID NO: 25073 - DNA, 58 bp, Homo sapiens
tgagacagggtctcactctgtcacccaggctggagtgcagtggtgccatcttggctca

SEQ ID NO: 25074 - DNA, 123 bp, Homo sapiens
ttgaaaaatctggaccatttgacttcagaaagaaaatgtgaggctttgtaaatattgtcattttgaaaatatgagactttttttctccctcatgttggatgtcatagtttttaggagttttac

SEQ ID NO: 25075 - DNA, 102 bp, Homo sapiens
aggactatcttaaaattattttggaaccaaaagagtttttgttgatgtgagttgcatatatcaacatttaccaagttagtactaagatattttaaaagttct

SEQ ID NO: 25076 - DNA, 128 bp, Homo sapiens
ggtagtgaggggagggagaggatctttgtctttactttatgtcttgattttgggcaagtagagagagtgcagagaactttcctgcatttatttcctcttattgccttaagctcaacaatcctcaagcc

SEQ ID NO: 25077 - DNA, 98 bp, Homo sapiens
gcagatgccagagggtctggatgaggagagcctgcctctcgggactgtctgccaccagctcactacctctctgtccctgagacttttctctttggcca

SEQ ID NO: 25078 - DNA, 119 bp, Homo sapiens
ttgcttttgattttacgggcttataggcagaagtgacttgtcttgtgtcagatgagagtttggactctggacatttgagttaatgttgaaataagacttgggggactgttgaaaaggga

SEQ ID NO: 25079 - DNA, 64 bp, Homo sapiens
gtgcctcagtctgccactctgtaaaatggacacacaatccccactcagctatggcgatgaggcc

SEQ ID NO: 25080 - DNA, 133 bp, Homo sapiens
tactgggaagtgtagggtccttggttcttgtcttctcagagggaagaattcagccaagtgacacacagacacagtgaaacagtagcagggttttgttaaagtgacagtacactctgaaaactgagtcacagtg

SEQ ID NO: 25081 - DNA, 72 bp, Homo sapiens
ccgggttcaggtgattctcctgcctcagcctcctgagtagctgggattacaggtgtgagtcaccacacacgg

SEQ ID NO: 25082 - DNA, 69 bp, Homo sapiens
cttggctctctctctgagtcccttctcctgtattgtgacctggagaatattctctgacagaaagctagg

SEQ ID NO: 25083 - DNA, 219 bp, Homo sapiens
aatatataatatataaatatgtattatatataaacatatatgtatatgtatataatatacaaatatttttatttttaatatatatttatacattatatattacttatatatctatatatgtatatataatatatattatacatatgtatacatgtatatatgtaatacatatataccttatgtattatacatacatattatatatacatataaaatata

SEQ ID NO: 25084 - DNA, 95 bp, Homo sapiens; identical to SEQ ID NO: 580

SEQ ID NO: 25085 - DNA, 93 bp, Homo sapiens; identical to SEQ ID NO: 69

SEQ ID NO: 25086 - DNA, 131 bp, Homo sapiens
tatgcagtatatatacacatctatatatgtgtgtgcttgtgtatttatatatacatatgtgtgtgtgtatatatatatatacacacatatatatatacacatatatatatacacatatatatatatatata

SEQ ID NO: 25087 - DNA, 93 bp, Homo sapiens
ctctctttctcgctctctctctctctgaattatgtgattttgaaggctaagaagtccaagatctgtagtgggaaagccagagacccatgagag

SEQ ID NO: 25088 - DNA, 235 bp, Homo sapiens
tgtccatatatatatatatgtgtatatatatatgtgtgtatatatatgtatatatgtgtatatatatacacacatatatatgtatatacatatataagtgtatatatgtatatatatgtgtgtatatatgtatatacatatgtgtgtatatatgtatatacatatgtgtgtatatatgtatatgcatatatgtgtgtatatatgtatatgcatatatgtgtgtgtatatgtacat

SEQ ID NO: 25089 - DNA, 125 bp, Homo sapiens
ggatttgggttattattgttggtattgtggatgttttgccatttaattgagtgtcccacagtctgtctactggtatgttctaaaatctctacctccgttaacagtagaactcacacttcaccaac

SEQ ID NO: 25090 - DNA, 100 bp, Homo sapiens
acatatataaaagtgtgtatatatatacacacatatatatgtatatgtatatatgtatatgtatatatatgtgtatatatatacacatatacatatgtat

SEQ ID NO: 25091 - DNA, 120 bp, Homo sapiens
gtgggtggctgggatagggagaggaaggataggcattcttcagtagctcacaagatgtaattttttagatatctatataggtttgcaaatgttttctttccatataaagttcctatggta

SEQ ID NO: 25092 - DNA, 93 bp, Homo sapiens
aatctttaatgccagtcactgatgagagagttgatatcaaaatcctgcaggtgggaaagatcctttctttcaattgattgtttttactagatt

SEQ ID NO: 25093 - DNA, 70 bp, Homo sapiens
gggggtagacaggtgagtgtgcacagggaggcaggtatcatctccttcacagctggaactgcctacccct

SEQ ID NO: 25094 - DNA, 119 bp, Homo sapiens
cttttgttatgcagaagtctttttgttcaactaggtcccatttatttatttatgtttatgttgcatttgcttatggggatcttagtcatgaattatttgcctaggccattgtccagaag

SEQ ID NO: 25095 - DNA, 67 bp, Homo sapiens
atgcatgcatgtgtgcatgtgtgtgtacacacagacaggcacacacacacatacatatgtaatgtat

SEQ ID NO: 25096 - DNA, 116 bp, Homo sapiens
cattgtagtataacacagaatagtttcaccgttgtagtataattaacacagaatagtgtcaccactgtagtataatgtggaatagtgtcactattgtagtgtaatgcagaatagtg

SEQ ID NO: 25097 - DNA, 96 bp, Homo sapiens
gagcagcctggcgggggctcaggtgccagggagaccagtgcttgagaaatgctcctgcgaacctccctgggtcccagtctgggccacacactgctc

SEQ ID NO: 25098 - DNA, 95 bp, Homo sapiens; identical to SEQ ID NO: 68

SEQ ID NO: 25099 - DNA, 93 bp, Homo sapiens; identical to SEQ ID NO: 69

SEQ ID NO: 25100 - DNA, 58 bp, Homo sapiens; identical to SEQ ID NO: 315

SEQ ID NO: 25101 - DNA, 91 bp, Homo sapiens
gtcagggactgtagaagccactaggagatattaggttgtgaagtaaagcgggcaataagactgctggaggaattttactttgtctttagat

SEQ ID NO: 25102 - DNA, 107 bp, Homo sapiens
agttattctttatcaatagctatgaattaatccctggaactgtattctagctactttaattttttttaagtttcgggtttttttttttcctgttgatcaagttcact

SEQ ID NO: 25103 - DNA, 99 bp, Homo sapiens
tagtgagcaaccaaaggaagacaggggctctttttgctcaacctctgtgtggctgtgtgtccctgttttatttcctttaggtataaattctgttaacta

SEQ ID NO: 25104 - DNA, 84 bp, Homo sapiens
tatgatttgtgtgtgtatatatatatgtgtgtgtgcatatgtgtatatgtatatatatgtgtatatatatatttaagagtcata

SEQ ID NO: 25105 - DNA, 103 bp, Homo sapiens
gatagagcaagaccctgtctcgaaaaaaaaagaaaaatcaccttccatgtcccgacagcagctcttttttttttttttttttgagacagagtctccctctgtc

SEQ ID NO: 25106 - DNA, 101 bp, Homo sapiens
gagatccatatccttagaaaaagataatgtggagatgcattcactattttatatgatctttatttttttatttttattttttctttttgagatggagtctc

SEQ ID NO: 25107 - DNA, 117 bp, Homo sapiens
gaaaaccttcctaaagggacatcacacttttgggataggaaagaagcctgtgtgtagagaatgaggagtaagcgctggtgactggcattgtcctggacatgttctgagagggatttt

SEQ ID NO: 25108 - DNA, 60 bp, Homo sapiens
gtgagacagagtctcgctctgtcacctaggctggagtgcagtggtgtgatctcagctcac

SEQ ID NO: 25109 - DNA, 58 bp, Homo sapiens; identical to SEQ ID NO: 637

SEQ ID NO: 25110 - DNA, 110 bp, Homo sapiens
gctggatgtggtggcatgcacctgtagtccagctattcgggaggctgaggtaggaggatcacttgagcccaggaggctgaggctgcagtgagccatgatcgtcccactgc

SEQ ID NO: 25111 - DNA, 119 bp, Homo sapiens
gaggcactctccagttttacctttgaggataaattaatccaactgctgggaatgtgctcagaagatagactgcagctgtcatcctttcagggattgcctcatcagagagtcaaggtctt

SEQ ID NO: 25112 - DNA, 89 bp, Homo sapiens
tgattttgtaacccaggactttgctgaatttgtttatcagatataggagactttttgatgagtctttaggatttctaggtatacaatca

SEQ ID NO: 25113 - DNA, 58 bp, Homo sapiens; identical to SEQ ID NO: 637

SEQ ID NO: 25114 - DNA, 58 bp, Homo sapiens; identical to SEQ ID NO: 1847

SEQ ID NO: 25115 - DNA, 103 bp, Homo sapiens
ctgagagtggttcaagagctgcttctagtctgccatcttacttgcatctcattttattttgttttgtttatggcttgctttaagctattttcctactttccag

SEQ ID NO: 25116 - DNA, 89 bp, Homo sapiens
tataattttacatgcataatcatatatatgtgtgtgtgtgtaattatatatatataaaatatatgtgtgtgcttgtgtgtgtgtgtata

SEQ ID NO: 25117 - DNA, 117 bp, Homo sapiens
gtgcagccttatttctgggctctctattctgtttcattggtctatatatatgtttttgtagcagtaccatgctattttggatactgtagccctacagcaagtttgaagttgggtaac

SEQ ID NO: 25118 - DNA, 100 bp, Homo sapiens
caaatgataaactagcagcaaaagataacattaaaaactgctacaagattattagattgtaaatatgtttttgttgttttaattatgctagagttatttg

SEQ ID NO: 25119 - DNA, 58 bp, Homo sapiens
tgagtcggagtctcgctctgtcacccaggctggagtgcagaggcgcgatctcggctca

SEQ ID NO: 25120 - DNA, 69 bp, Homo sapiens
gccgacagaagatggcggatgagcagcgtgcagggttttctccctgtggctcactctctcttactgtgc

SEQ ID NO: 25121 - DNA, 120 bp, Homo sapiens
gccacttgaaacaaaactgaaacatctcaatttattatttgaatttcttttttaaatttaatttaatttaatttaagttccaggatacatgtgcaggatgtgcaggtttgttacataggt

SEQ ID NO: 25122 - DNA, 92 bp, Homo sapiens
tgatacttctgtctgaagtgaactgtttttcttctaatcagtacttctgtatatggaagtacaaatagagatagtttactcatactatgtca

SEQ ID NO: 25123 - DNA, 114 bp, Homo sapiens
cacacctcaaggcttagcaagagctacatcttttaaaagtcttctctgatccatgctgactgaaaagactgtccataaaaaacaaaggatggagtgctgcatgccagctgtgtg

SEQ ID NO: 25124 - DNA, 103 bp, Homo sapiens
cccttttagggatagccgaacaactgcctaactcctggatatattattacttagtttataaaggcaagtagctatcaatgttagggagtccttatgtaaacgg

SEQ ID NO: 25125 - DNA, 88 bp, Homo sapiens
gcttctttctatgtggccataatatgatgatgatgatgatcatgatggtgatgatcatggtggtggtggtggtgatgatgatggtggt

SEQ ID NO: 25126 - DNA, 85 bp, Homo sapiens
agcctgggtaagagaatgagaccttgttttattttattttatttttatttattttgagatggagtctcactctgtcacccaggct

SEQ ID NO: 25127 - DNA, 66 bp, Homo sapiens
gatatgtatgtatatatgcgtgtgtgtgtgtatatatatatatatatatatatatatatatatatc

SEQ ID NO: 25128 - DNA, 104 bp, Homo sapiens
catataacatctacatatacatgtatataactatatatgtttatatacagtatatgtagtatataacatatataactatatatgtgtgtatgtgtatatatatg

SEQ ID NO: 25129 - DNA, 58 bp, Homo sapiens; identical to SEQ ID NO: 3380

SEQ ID NO: 25130 - DNA, 97 bp, Homo sapiens
gctttccaggagcaaagaacttagataacattgaacactctcaaccacactcattttggttttttgtttatttcatctgatagttgagtttggtagc

SEQ ID NO: 25131 - DNA, 94 bp, Homo sapiens
agaatgggaagcagaaagagcagaggcaccgagtatgaaaaagaagggacttgacagagactctgccacttctttttactgatttcctcattct

SEQ ID NO: 25132 - DNA, 120 bp, Homo sapiens
ctagaagtccctgggtacaggtgagaggtgagtcttagagtaatcttatcttttaacttttcaatttttttttttttttccctgagacggagtctcgctctgtcacccagtctggagtgc

SEQ ID NO: 25133 - DNA, 116 bp, Homo sapiens
tgttcttggttttgaatctgacagactgcccatgtcctaaccacacacacacacacacacacacacacacgataactactgggggacatggatgtgttaatgtgaaaattattaca

SEQ ID NO: 25134 - DNA, 93 bp, Homo sapiens
gtggtggtatgcgtctgtagttccagctacttgggaggctgaggtaggaggatcacttgagcccaagaggtttaggccacagtgaaccatgat

SEQ ID NO: 25135 - DNA, 85 bp, Homo sapiens
tgagacagagtctcactctgtcgcccaggctggagcgcagtggtgcgatctcggctcaccggtttcaccgtgttaaccaggatgg

SEQ ID NO: 25136 - DNA, 118 bp, Homo sapiens
tatatatgtatgtgtatatgtgtatatatgaatatatatgcatgtgtgtataaaatacatatatttatgtatacacaaaatacatatatttatgtatacacaaaatacatatatttat

SEQ ID NO: 25137 - DNA, 71 bp, Homo sapiens
tgggactagagtaagagcaagtggatttgggatcagacagactcatgtctaaagctctgtgacctcgacca

SEQ ID NO: 25138 - DNA, 114 bp, Homo sapiens
tttggaggaggagggtttcaccttcaatagctacgtgcgaagtctagagacacattcaagtttatgagaagtttgtactttgcattgtttatgattattctgactcaagctgaa

SEQ ID NO: 25139 - DNA, 116 bp, Homo sapiens
taggcaacatgtaagatcagatggataatgtaagcagagccatggaatttttcttttttttgagacagggtctggctctgttgcccaatccagagtgcagtggcgtgaccttggct

SEQ ID NO: 25140 - DNA, 92 bp, Homo sapiens
cagggagtgatcttgtatgtgtctctctttctcagcccttccaaaaggtaagtcggtcctcagaggacaagtgcagttattttgttcccttg

SEQ ID NO: 25141 - DNA, 80 bp, Homo sapiens
ggcattaaagcctgtcactgtgtggctctgaaaacctctctgaacgtgttccctgcctctgccctgcaggtccctgtgct

SEQ ID NO: 25142 - DNA, 73 bp, Homo sapiens
gagagctgtcatttgtcctagtagccagcagcgtgactgtgctgtcttctgctctgtctccctgtcagccttc

SEQ ID NO: 25143 - DNA, 64 bp, Homo sapiens
atctctgtgtgtgtgtgcatgtgaatgtgcccgtatgtgcatgcatgcacgtgtgtaaatggat

SEQ ID NO: 25144 - DNA, 76 bp, Homo sapiens
ttgttttatttttgagatggagtctcactctgtcacccaggctggagtgcaatggcgccatctcagctcactgcaa

SEQ ID NO: 25145 - DNA, 77 bp, Homo sapiens
ggtggagagagaagagagtgtggtagaaacaataataagaagtctgcagaacttgacccctcccagcctctcccacc

SEQ ID NO: 25146 - DNA, 64 bp, Homo sapiens
ttgagacggagtctcactgtgtcaccaggctggagtgcagtggcacaatcttggctcagtacaa

SEQ ID NO: 25147 - DNA, 82 bp, Homo sapiens
ccaaactgtgctctgaccaccttgggcacatgtcgtcaggacctcctgaggctgtgtcacagatgtgtgtctgcaatcttgg

SEQ ID NO: 25148 - DNA, 82 bp, Homo sapiens
gtgtgtgcgtatatatatgtacatgtatatatgtatatgtgtatatatatgtatacgtgtgtgtgtgtgtgtgtgtgtatgt

SEQ ID NO: 25149 - DNA, 114 bp, Homo sapiens
atttatgtgcacaaatgagtcaaatgagtacaggcagtagggtagttagtttatatcacagaacagagagaccactcaccacagcctgtcacaatgaccagagcagcaaagaat

SEQ ID NO: 25150 - DNA, 58 bp, Homo sapiens; identical to SEQ ID NO: 2626

SEQ ID NO: 25151 - DNA, 86 bp, Homo sapiens
gggttcctgcaattcattcacgttctgtgcctgttcatagttggccccttcttactgctgaacagtacactgcagattgtttaccc

SEQ ID NO: 25152 - DNA, 91 bp, Homo sapiens
cacacacacacacacacacacacacacacatcctatgtgtttgtgtatctatatatagaatatgcgtgtgtgtgtgtgtgtgtgtgtgtgt

SEQ ID NO: 25153 - DNA, 264 bp, Homo sapiens
tatatatatgagtgtatatatatatatatgagcgtatatatatatatgagtacatatacatatgagtatatatatatgagtatatatatatgagtgtatatatatatgagtatatatatatgagtatatatatgtgtatatatatgtatatatgtatatatatgtgtatatatatgtatatatatatgtgtatatatatgtatatatgtatatatatatgtatatatgtatatatatatatatgagtatatatatatggaggta

SEQ ID NO: 25154 - DNA, 93 bp, Homo sapiens
aacatagtgcgataagtacagtaagacagtagcacacactctgtctctcatagagttcacacacagtccttaccatgtgccttcacatatgtt

SEQ ID NO: 25155 - DNA, 56 bp, Homo sapiens; identical to SEQ ID NO: 3737

SEQ ID NO: 25156 - DNA, 84 bp, Homo sapiens
gagaatctgatgcctgatgttctgtcactgtctctcatcaccccagatggacagtctagttgcaggaaaacaagctcagagatc

SEQ ID NO: 25157 - DNA, 157 bp, Homo sapiens
ctgcactccagtctgggtgacagagcgggactccatcagagcgagacaaaaaaaaaaaaaaaaaaaaaagaaagaaagaaaaagacagtctcgctctgtcacccaggctggagtgcagtggcacaatctcagctcactgcaacctctgcctcctggg

SEQ ID NO: 25158 - DNA, 119 bp, Homo sapiens
ttttcacaatggctgaactaatttatattcccaccagcagtgtatatatatttctaagaaaaaagggaattcttaaacatcattggtgggaatttaagttggtacagccattttgggaa

SEQ ID NO: 25159 - DNA, 72 bp, Homo sapiens
gggcccagcgtctattatttgtctaatactgaaactttttttatgtttagatacacagacaaggctgggcgc

SEQ ID NO: 25160 - DNA, 92 bp, Homo sapiens
gttgttgttgttgttttgagagactgagtctcactctgtcgcccaggctgaagtacagtggtgcagtctcagctcactgcaacctccgcctc

SEQ ID NO: 25161 - DNA, 79 bp, Homo sapiens
ctgggattacaggcatgagacactgcgtccaaccttttatttttttgagacaagagtctcatctcactctgttgcctag

SEQ ID NO: 25162 - DNA, 116 bp, Homo sapiens
gggagaggcactgacagagcaccacagcacgcgtgggattccactcccatcactgatgcagagacaagagtgtgagttcaacagtgagttcgtaagtggcctcgtgtctaagttcc

SEQ ID NO: 25163 - DNA, 142 bp, Homo sapiens
tacacatatacgtatatatatgtgtgtgtatataaatatatacacacatatgtatatatatgtgtgtatataaatatatacatacacatatacatatatgtgtgtatatatatacatatatagtatatgtgtgtatatatat

SEQ ID NO: 25164 - DNA, 75 bp, Homo sapiens
gggtctggctctgtcacccaggctgaagttcagtggtatgatctcagctcgctgcagcctctgcgtcccaggctc

SEQ ID NO: 25165 - DNA, 77 bp, Homo sapiens
tgggtctcactctgtcacccagactgcagtgcagtggcataatcacagctcactgcagccttgacctcctgggccca

SEQ ID NO: 25166 - DNA, 84 bp, Homo sapiens
cagagatgggtaacagagcatgaccccatctctacaaagatttttttttttttgagccggagtctggctgtgtcgcccaggctg

SEQ ID NO: 25167 - DNA, 94 bp, Homo sapiens
aggctgggcaacatagcgcaaccctgtctttactaaaaatatttatttaaattcttcttttttggaggtggagtctcgctctgttatccaggct

SEQ ID NO: 25168 - DNA, 58 bp, Homo sapiens
tgagacagtctctcactctgtcacccaggctggagtgcagtggtgtgatcttggctca

SEQ ID NO: 25169 - DNA, 89 bp, Homo sapiens
acttgttgtcccgctttcctcacattttcttctgccatctgtgacagcttcttgatctgtccccaggtgggtggctgtgttcaacaggt

SEQ ID NO: 25170 - DNA, 121 bp, Homo sapiens
cagtgattctaatgtacacctgggtttgcagccacagctcaaagacaattttattaattggtgactgacactcacacacctagcaattgtctttagttcactggcccatcatggggatgac

SEQ ID NO: 25171 - DNA, 96 bp, Homo sapiens
gcctcagcctcccacgtagctgggattacagatgtgtgacaccacatgcagctaatttttgtatttttagtagagacggggtttagccatgttggc

SEQ ID NO: 25172 - DNA, 116 bp, Homo sapiens
ctcccaaagtgctgagattacatgcattcttttatttatttgtttatttatttttgcagttgcaagattgaatagagtgaaaacagagctgctgccgccttttattttttgtagag

SEQ ID NO: 25173 - DNA, 70 bp, Homo sapiens
acagagcaagactgtctcaaaaaaaattttttatttatttatttatttttgagatggagtctcactctgt

SEQ ID NO: 25174 - DNA, 132 bp, Homo sapiens
ggaaacctgcagtggggagggggcagtggatgatggtggcctccttccctctgcttcattccgtcactctctgactgtactttgggtccctgcagagttggaaaggatgagaggggagaggagaggtgcact

SEQ ID NO: 25175 - DNA, 82 bp, Homo sapiens
tgtatacataggtttatgtatatatacataagtgtatatatctatatatatttgtgtgtgtgtgtatatatatatatatata

SEQ ID NO: 25176 - DNA, 109 bp, Homo sapiens
ctcctgagtagctgggaccacaggtgcacaccaccatggcttgctaacttttatttttattttttttaattttttgagatgcagtcttgctctgtcacccacgctggag

SEQ ID NO: 25177 - DNA, 58 bp, Homo sapiens; identical to SEQ ID NO: 2135

SEQ ID NO: 25178 - DNA, 56 bp, Homo sapiens; identical to SEQ ID NO: 2136

SEQ ID NO: 25179 - DNA, 101 bp, Homo sapiens
agatttctgggtagaatggtagttcagttttaagttgtttgggaaatcaccaaacgtcttttcacagtggctgaactaatttacattcccaccagcagtgt

SEQ ID NO: 25180 - DNA, 95 bp, Homo sapiens; identical to SEQ ID NO: 68

SEQ ID NO: 25181 - DNA, 93 bp, Homo sapiens; identical to SEQ ID NO: 69

SEQ ID NO: 25182 - DNA, 120 bp, Homo sapiens
tgtatatggcagttattgcactgtgcatcagcagccttaaaatgtgctatatttcttttttttttttattatactttaagttttagggtacatgtgcacattgtgcaggttagttacata

SEQ ID NO: 25183 - DNA, 62 bp, Homo sapiens
ggcaggtgtccttctcccactgttcattttttttttctttttaggaggagtgtcactctgtc

SEQ ID NO: 25184 - DNA, 73 bp, Homo sapiens
ttgttttttggagagtgagtctcgctgtgtcactcaggctggagtgcagtggcgcgatctcagctccctgcaa

SEQ ID NO: 25185 - DNA, 105 bp, Homo sapiens
gtctatgtagtgtatgtatatgtatatacattatatatatatatatatatatatatatatatatagtctatgtagtttacatacatgtctagtatatatatagac

SEQ ID NO: 25186 - DNA, 75 bp, Homo sapiens
tgtcatataaatacatttatatatatacacatatgcatatatatgtatgtgtgtgtatgtatatgtatatatgca

SEQ ID NO: 25187 - DNA, 93 bp, Homo sapiens
gagttttgatgactggctcccctagtctcattgagatatgatttgtatactatacaattcactcttttttttttttgagacggagtcttgctc

SEQ ID NO: 25188 - DNA, 79 bp, Homo sapiens
ccatgctgtgcaagtggcattaattttttttatttgtttgttttttggagatggagtgtcactctgtcacccaggctgg

SEQ ID NO: 25189 - DNA, 111 bp, Homo sapiens
ggttaggtttttagttgcctttattattctatgtgtgtgtcttttttgttttttttgtttatgagacagagtctgacattgtcactcaggctggagtgcagtggcgtgatc

SEQ ID NO: 25190 - DNA, 175 bp, Homo sapiens
tatatatgtatcatatatgtatttatatataatatgtattatatcatatatgtatttatatatgtgtattatatcatatatgtatttatatattatatgtattatatcacatatgtatttatgtataatgtatgtatcatatatgtatatatatgtgtgtgtatatatatatgta

SEQ ID NO: 25191 - DNA, 84 bp, Homo sapiens
gctagaatggtttacagaactcagaaaaacagtttattttcttttttctgagaaacaggttctcattttgttgcacaggctggt

SEQ ID NO: 25192 - DNA, 117 bp, Homo sapiens
gttctgtttggatgtggcttcagagcagggattaatcaatttatttatacttttttcttttcttttttttttttttttgaggtggattctcactctgtcacccaggttgcagtgcag

SEQ ID NO: 25193 - DNA, 74 bp, Homo sapiens
gttgttgtttgagatggagtctcactctgtcacccagggtggagtgtggtagtgtgatcttggctcacggcagc

SEQ ID NO: 25194 - DNA, 94 bp, Homo sapiens
gtgtatatatacgtgtatatattcacgtatatatacacatatatacgtatatatatattcgtatatatacgtgtatatatacatatatatacac

SEQ ID NO: 25195 - DNA, 68 bp, Homo sapiens
tgtatttaggtggagtctcactctgtcacccaggctggagtgcagtggtgtgatctcagctcactgca

SEQ ID NO: 25196 - DNA, 81 bp, Homo sapiens
ccgacttggcctctctgtgcctcagtcgccctccctgcaaagtggtgaggggccttggccagaagcagtggctcactccgg

SEQ ID NO: 25197 - DNA, 63 bp, Homo sapiens
caggcacctgcaggctgtgtgtcctggggcagggtgctcaccctctctgggcctcagtgtctg

SEQ ID NO: 25198 - DNA, 118 bp, Homo sapiens
gcacacctcttgtgtcctctcctttggagacagtttgtggaatctctctggtaatttttttttttttttctgagacagagtctcattctgtcatccaggctggaaggcagtggcacga

SEQ ID NO: 25199 - DNA, 89 bp, Homo sapiens
agcactttgtggaactgggacaggtggataaagatgctgacttttgttggtttttttgttttttttttgttttttttcagacagagtct

SEQ ID NO: 25200 - DNA, 75 bp, Homo sapiens
gtctatgtgtctgtctctgtgtccacgtttctccttcttatcggatcctattggacgagggcccaggctaatgac

SEQ ID NO: 25201 - DNA, 69 bp, Homo sapiens
agggagataaatgtatgtttctttatatttaatgcaactgcacagaagaaatgtgtcattcttctcctt

SEQ ID NO: 25202 - DNA, 95 bp, Homo sapiens; identical to SEQ ID NO: 68

SEQ ID NO: 25203 - DNA, 93 bp, Homo sapiens; identical to SEQ ID NO: 69

SEQ ID NO: 25204 - DNA, 142 bp, Homo sapiens
cctaggtaacagggtgaaaccccacctctacaaaaagtacaatttttttttttttgtagatggagtctcactctgtcacccaggctggagtgcagtggtgtcatcttggctcactgcaacctccgcctcctgggttcaagtg

SEQ ID NO: 25205 - DNA, 58 bp, Homo sapiens; identical to SEQ ID NO: 2224

SEQ ID NO: 25206 - DNA, 56 bp, Homo sapiens; identical to SEQ ID NO: 335

SEQ ID NO: 25207 - DNA, 95 bp, Homo sapiens; identical to SEQ ID NO: 68

SEQ ID NO: 25208 - DNA, 93 bp, Homo sapiens; identical to SEQ ID NO: 69

SEQ ID NO: 25209 - DNA, 120 bp, Homo sapiens
attactactttggtttaatgataattattgggcaaactctgcatctcttttcattttatttattttattaatttatttttgagacagggtctcactctatcacccagattggagtgtagt

SEQ ID NO: 25210 - DNA, 107 bp, Homo sapiens
gtttctttgattggatcatgttagtctgacactttatatatattgtaacatttggttgagatatgtacattaaaaaaagtcagctgtcacagtctgtataaaggggc

SEQ ID NO: 25211 - DNA, 58 bp, Homo sapiens; identical to SEQ ID NO: 3040

SEQ ID NO: 25212 - DNA, 56 bp, Homo sapiens; identical to SEQ ID NO: 3041

SEQ ID NO: 25213 - DNA, 133 bp, Homo sapiens
tgacaaatcacagacaccacggacaaggataaaaccaaatggtgttaaaatatgtgtgtgtgtgtgtgtgtgtgtgtcacagtctcactgtcacccagattggagtgcagtggcaccatcatgactgacggca

SEQ ID NO: 25214 - DNA, 84 bp, Homo sapiens
ggcagatgagctgacactgtagaaagagccctcagacccaggtccaaacctgactctggctacacctcgtccttgctctctgcc

SEQ ID NO: 25215 - DNA, 128 bp, Homo sapiens
ctcagtatgaaaaaaaagctgatggatattggcggacactgatggtccctgccacactcaccctcacagtgctgagcatggagttatttctgcccagtcagaatgtgagctccctaaggacaggaacc

SEQ ID NO: 25216 - DNA, 62 bp, Homo sapiens
ttgagatggagtgtctctctgtcgctcaggctggagtgtggagtacagtggcacgatctcag

SEQ ID NO: 25217 - DNA, 80 bp, Homo sapiens
ctgtctctgcctctgtcattcatcacaacacaccccaagtccacacatgtgcaggtgtcatgagtgctgagaagaatcag

SEQ ID NO: 25218 - DNA, 119 bp, Homo sapiens
ctgtatctcttttgctttggtatttatatatacatatgcatatatatacatgtgtagatacttgtatatatattatttgtaatcttttaataaaaagtacagttattatagagaaatac

SEQ ID NO: 25219 - DNA, 96 bp, Homo sapiens
gctgagtgggagaaaccagagggatcttgtgttgttagggacctggcatcatgcctggcacagagcacttgcaaaatcttcattctcaagattggc

SEQ ID NO: 25220 - DNA, 106 bp, Homo sapiens
catggtgggttccagcccagacacaggggtcagcgaggggtggtgtgacagtgagcacagaccctgggtggtggtgacagtggctgtcatggggaggaaaggaatg

SEQ ID NO: 25221 - DNA, 86 bp, Homo sapiens
cagaaccccgcagcctcagggcttgcatggggttgtgtgtttcaatgcctctgttgtatgactctgtgtgtgtgtctgtgtgtgtg

SEQ ID NO: 25222 - DNA, 66 bp, Homo sapiens
ggcctctcaaagtgctgggattgcaatatatatatatatgcatgccatgggccattgttataggcc

SEQ ID NO: 25223 - DNA, 114 bp, Homo sapiens
agattgtgtctcagactattctggaaaacagtgggacaagattgacatctttttttttttttttgagatgaagtctcgctctgttgcccaggctggagtgcagtggctcaatct

SEQ ID NO: 25224 - DNA, 105 bp, Homo sapiens
gtatttgatgttttgatgctgttcaaagggatatctttttatattttaatctatttattgtataaagaaatacactttttaaaatattgatcttatatcagaaac

SEQ ID NO: 25225 - DNA, 111 bp, Homo sapiens
aaattgggtatgttattgtatgtatgtgtatatattaagttgtatatacacgttaaatatatatacatatattatattttatacacatacatttgtttcctcatgcaattt

SEQ ID NO: 25226 - DNA, 76 bp, Homo sapiens
accctttggaaagaaatcaagtgtgtagtgcataaacattatatttggtttgatttgtttttgtctaagacagggt

SEQ ID NO: 25227 - DNA, 117 bp, Homo sapiens
ccaaagtgctaggactacaggagtgagccactgcacccaacctatatttgtatatacattaaattgtatatgttaggccgggcatggtggctcacacctgtaattccagcattttgg

SEQ ID NO: 25228 - DNA, 106 bp, Homo sapiens; identical to SEQ ID NO: 25220

SEQ ID NO: 25229 - DNA, 96 bp, Homo sapiens; identical to SEQ ID NO: 25219

SEQ ID NO: 25230 - DNA, 65 bp, Homo sapiens
cattctgagaaatttctttgtgatgtgtgcattcatgtcacagagttgagattttcttgtgattg

SEQ ID NO: 25231 - DNA, 58 bp, Homo sapiens
gagacagagtctcgctctgtcacccccaggctggagtgcagtggcatgatctctgctc

SEQ ID NO: 25232 - DNA, 113 bp, Homo sapiens
gggttcaccagctttagatcatgcttctttctaagcagcctgacttttttccagaagtgactgagcagaaaagagggtacctgggtcagaagtaatctgttgctggcggagtt

SEQ ID NO: 25233 - DNA, 87 bp, Homo sapiens
gtcacctgcattgggcttttgttcttttttttggcgacagagtctcgctctgtcacccagactagagtgcagtggcacaatcttggc

SEQ ID NO: 25234 - DNA, 76 bp, Homo sapiens
ggagtggattttaaaagttacagaaaaagagatatgagtactttttttttttttttttgagacagagactcactct

SEQ ID NO: 25235 - DNA, 80 bp, Homo sapiens
tctgtattacatatatatgtatgtatacatatttgtatgtgtaaatatactatatatacatatacgtgtatgtatgcaga

SEQ ID NO: 25236 - DNA, 150 bp, Homo sapiens
gccagggcaacataaggagactgcgtctctattttctttctttctgtttttttttttttttttttttttttgagacactgtctccctctgtcacccaggctggagtgcagtggcatgatcttggctcactgcaacatctgcctcccaggt

SEQ ID NO: 25237 - DNA, 117 bp, Homo sapiens
tatattctggtgttacatatatttattgcggtttctgggtatatatatgtgtgtgtatatatatgtatacatacatatatatgtatttaaggctaggtgtggtggctcctggctgta

SEQ ID NO: 25238 - DNA, 91 bp, Homo sapiens
gtttccaaacagtgctctctgtgactgagtctccgtgtgggctgctgggacaagtctattgattggtgtcatctgagcactctgagtaaac

SEQ ID NO: 25239 - DNA, 80 bp, Homo sapiens
ggagtctcactctgtcacccaggctggagtgcagtggcgtgatcttgcaatctccacctcctgggttcaagcgattctcc

SEQ ID NO: 25240 - DNA, 72 bp, Homo sapiens
tccaggcacatggcagagttgatggtttttggtttttttttgagacagtcttgctctgtcactcaggctgga

SEQ ID NO: 25241 - DNA, 107 bp, Homo sapiens
cttaagtactttaaattcctacaaacctgaacctaaaatatagacctcaacaactgtgagtctctgtgattttgcagatctaagtttgtggaaggctagtgcctgag

SEQ ID NO: 25242 - DNA, 82 bp, Homo sapiens
gaagttcttttgcttcctctacttgtgttaaaactgttcattttttatttttaaggtcatctggggggagtttctttgcttc

SEQ ID NO: 25243 - DNA, 95 bp, Homo sapiens; identical to SEQ ID NO: 580

SEQ ID NO: 25244 - DNA, 93 bp, Homo sapiens; identical to SEQ ID NO: 69

SEQ ID NO: 25245 - DNA, 58 bp, Homo sapiens
tgagatggagtctcactctgtcacccaggctggagtgcagtggcaagatctccgctca

SEQ ID NO: 25246 - DNA, 88 bp, Homo sapiens
tagctaggacaataggtgcacaccaccttgcccactttttttttattatacttatgttttagggtacatgtgcacattgtgcaggtta

SEQ ID NO: 25247 - DNA, 94 bp, Homo sapiens
tctgagtctgcttgccagggaatatggatttcttttctttttttttttttttttttttttgagacggagtctggctgtgtcgcccaggctgggg

SEQ ID NO: 25248 - DNA, 102 bp, Homo sapiens
tacctgacacacttaactgtgagtatggtggtagcctttttattttattttattttgagagagggtctcactttgtcacccaagatggagtgcagtcatgtg

SEQ ID NO: 25249 - DNA, 95 bp, Homo sapiens; identical to SEQ ID NO: 580

SEQ ID NO: 25250 - DNA, 93 bp, Homo sapiens; identical to SEQ ID NO: 69

SEQ ID NO: 25251 - DNA, 95 bp, Homo sapiens; identical to SEQ ID NO: 68

SEQ ID NO: 25252 - DNA, 93 bp, Homo sapiens; identical to SEQ ID NO: 69

SEQ ID NO: 25253 - DNA, 65 bp, Homo sapiens
cattctgagaaacttctttgtgatgtgtgctttcatatcacagagttttacctttctattgattg

SEQ ID NO: 25254 - DNA, 82 bp, Homo sapiens
aggtttctgagaaactgcttcatgatgtgtgcattcctctcacagagttgaaccattcttttgattgagcagtttagaacct

SEQ ID NO: 25255 - DNA, 117 bp, Homo sapiens
ctagaaagaaacattcagagacactgctttgagatgtgtgcattcaaatcacagagataatgcaatcgttggatggagcagtttggacactctgtttttgtagaatctgtgaagtga

SEQ ID NO: 25256 - DNA, 111 bp, Homo sapiens
tttacctctgctactttaaactcccctgcaggttttagagtttttgttcatttgtgaaaaaacactaacttacctgatttgaaggtttaatttttgtggctttctggtaaa

SEQ ID NO: 25257 - DNA, 83 bp, Homo sapiens
ccgttggaaaagcacagaattagtgtggaagtgaactgattttccaggtgccctccatcacagatttgcttgtctgggaaagg

SEQ ID NO: 25258 - DNA, 113 bp, Homo sapiens
gtgtcttttaattggagcatttagtccacttacatttaaagttaatattgttatgtgtgaatttgatcttgtcattatgatgttaactggttattttgctcattagttgatgc

SEQ ID NO: 25259 - DNA, 107 bp, Homo sapiens
tgtgagatgaatgcacacaccacaaagcacgttctcagaaggttttttttattattattatactttaagttttagggtacatgtgcacattgtgcaggttacttaca

SEQ ID NO: 25260 - DNA, 107 bp, Homo sapiens
ggttagaatttttggtggattcagccatttgcaaaaactgttttgtccattttgtgaatggacattttgtagttctttgaggccaatggggaaaaagtgaataccac

SEQ ID NO: 25261 - DNA, 95 bp, Homo sapiens; identical to SEQ ID NO: 68

SEQ ID NO: 25262 - DNA, 93 bp, Homo sapiens; identical to SEQ ID NO: 69

SEQ ID NO: 25263 - DNA, 119 bp, Homo sapiens
gagtagcttggattacaggcatgcaccacaatgcccggctaatttttgttttttgttttagagatggagtctcgctgtgtcacccaggctggagtgcagtggtatgatctttgctgacc

SEQ ID NO: 25264 - DNA, 66 bp, Homo sapiens
gcctttgagacactggccagtcaggcctcagttgagatgaggccaatgatgtcacgtgtaaaatgc

SEQ ID NO: 25265 - DNA, 111 bp, Homo sapiens
accttcattttgtattttgaaatcattaagcacgatgcctccaatattgtttttgttttacaaatagccaggctctttgtggtttcttgatattccatatgatttgagggt

SEQ ID NO: 25266 - DNA, 116 bp, Homo sapiens
tttattattatatatatagatagaaaatatatatatatatatatatatatatatatatatatatatatatatatatatatatatataaaatctgatgctaaactgtagtttttgag

SEQ ID NO: 25267 - DNA, 108 bp, Homo sapiens
acccagacttcactgagcaatatatccatgcgtgatggttaatattaagtgtcaacttgattggattgaagggtgcaaagtattgttcccgggtgtgtctgtgagggt

SEQ ID NO: 25268 - DNA, 58 bp, Homo sapiens; identical to SEQ ID NO: 87

SEQ ID NO: 25269 - DNA, 56 bp, Homo sapiens; identical to SEQ ID NO: 88

SEQ ID NO: 25270 - DNA, 128 bp, Homo sapiens
gtgtatatgtgtgtacatatgtgtatatatgtatatatgtgtatatatgtgaatatatgtgtatatgtgtatatatgtgtatatatgtatatatgtgtgtatatatgtgtgtatatatgtatgtgtgt

SEQ ID NO: 25271 - DNA, 109 bp, Homo sapiens
catagacacaattcatcactgatccaagtgtcattatgtggcgcatgactgaatatatatttctatagtggttttggtggcaggggttgtgtgtgtgtgtgtgtgtgtg

SEQ ID NO: 25272 - DNA, 99 bp, Homo sapiens
ctccatatgcctccagaaacatgtccctggagagtagcctgctcccacactgtcactggctgtcatggggccaataaaatctcctgcgattgtgtatct

SEQ ID NO: 25273 - DNA, 65 bp, Homo sapiens
tatacacacacagacacacacatttacatatatatgtctgtgtgtgtgtgtgtgtgtgtgtgtgt

SEQ ID NO: 25274 - DNA, 90 bp, Homo sapiens
gttttaaaacagacacagcattttaattgtttatttttgtttcacggcgtggtggatggctcttctaaaaatatgtgtctgtttgtgaac

SEQ ID NO: 25275 - DNA, 90 bp, Homo sapiens; identical to SEQ ID NO: 25274

SEQ ID NO: 25276 - DNA, 102 bp, Homo sapiens
tgcaaaatctaaaaagccatatgataagcctgatgaatgttggtttacagaactgattttctagaaaacaggtttataaaactggttttctttaaaaaggca

SEQ ID NO: 25277 - DNA, 58 bp, Homo sapiens; identical to SEQ ID NO: 2224

SEQ ID NO: 25278 - DNA, 56 bp, Homo sapiens; identical to SEQ ID NO: 335

SEQ ID NO: 25279 - DNA, 95 bp, Homo sapiens; identical to SEQ ID NO: 68

SEQ ID NO: 25280 - DNA, 93 bp, Homo sapiens; identical to SEQ ID NO: 69

SEQ ID NO: 25281 - DNA, 69 bp, Homo sapiens; identical to SEQ ID NO: 25201

SEQ ID NO: 25282 - DNA, 75 bp, Homo sapiens; identical to SEQ ID NO: 25200

SEQ ID NO: 25283 - DNA, 63 bp, Homo sapiens; identical to SEQ ID NO: 25197

SEQ ID NO: 25284 - DNA, 81 bp, Homo sapiens; identical to SEQ ID NO: 25196

SEQ ID NO: 25285 - DNA, 116 bp, Homo sapiens
cttttgttaaattttttatttttaatttttgtggggatatatatatacacacacatatatatatgtatgtatgtatgtatttatggagtggggcacatgagatgttttgatacagg

SEQ ID NO: 25286 - DNA, 116 bp, Homo sapiens
cgctctgtcacccaggctgaaacagtcaacattagtgattttatgccaaattccttttatttatttatttttgagatggagtctcactctgttgcccaggctggagtgcagtagtg

SEQ ID NO: 25287 - DNA, 68 bp, Homo sapiens; identical to SEQ ID NO: 25195

SEQ ID NO: 25288 - DNA, 74 bp, Homo sapiens; identical to SEQ ID NO: 25193

SEQ ID NO: 25289 - DNA, 105 bp, Homo sapiens
gggattacaggtgtgagccactgtgcttggctgctttttttttttttttttttttttcaaaatagagatgtttagccagatgtggtggcacaaacctgttgtccc

SEQ ID NO: 25290 - DNA, 113 bp, Homo sapiens
ctgtttggatgtggcttcagagcagggattaatcaatttatttatacttttttcttttctttttttttttttttgaggtggattctcactctgtcacccaggttgtagtgcag

SEQ ID NO: 25291 - DNA, 91 bp, Homo sapiens
cctccctaggagctgacacgcctggctaatttttttcaactttttttttttttttttttttgagacagagtctcgctgtcacccaggctgg

SEQ ID NO: 25292 - DNA, 84 bp, Homo sapiens; identical to SEQ ID NO: 25191

SEQ ID NO: 25293 - DNA, 114 bp, Homo sapiens
aatacatgtattatatataaatacatatgtattatgtatatgtattatattttatatatatatatatatgtatgtatgtatgtatgtatgtattagctggacgtgatagtgcat

SEQ ID NO: 25294 - DNA, 129 bp, Homo sapiens
catgcatttgggtgcatttgcgtaaatatcttttttttttttttttttgagagagagagtctcgcactgtcacccaggctggagtgcagtggcgcgatctgggctcactgcaagctccgcctcccaggt

SEQ ID NO: 25295 - DNA, 123 bp, Homo sapiens
caagctcagggctcctactgattctgcattatgacgagttgtataattatttcattgtatattatagtaataacagaagtaaagtgcacaatgattgcaatgtgcttgaatcatcccgaaacc

SEQ ID NO: 25296 - DNA, 148 bp, Homo sapiens
ccagcctgggcaatgcagtgagacctatatctttaaaaaagaaaaaaaaatttatttatctattttatttatttattttttttgagacggagtctcactctgtcacccaggctggagtgcagtccagtggctctgtgatctcggctca

SEQ ID NO: 25297 - DNA, 75 bp, Homo sapiens
ggcaacagagtgagaccccatctctataaaaaaaaaatttttttttttttttggagacagtctcactctgtcgcc

SEQ ID NO: 25298 - DNA, 113 bp, Homo sapiens
tatatcatatcacacatgtgtgtgtgtatatatatacatatgtgtatgtatatatatacatgtgtatatatatacatatatatgtgtgtgtgtgtgtgtgtgtgtatatatat

SEQ ID NO: 25299 - DNA, 66 bp, Homo sapiens
gtccagatccacatgggatggccaatattctaactgtgtattgtgttgtcatatgagagtcaggac

SEQ ID NO: 25300 - DNA, 81 bp, Homo sapiens
gggtgttttgggaggcctgggcgagtggcacctctaaccaatctgctaggccctcacctctcagtctcactgagacactcc

SEQ ID NO: 25301 - DNA, 83 bp, Homo sapiens
gaaactgagaaagtgagtggctattctgttctcagcacttactgtcagaggaagatgaaacatgcacacacactctctcattc

SEQ ID NO: 25302 - DNA, 99 bp, Homo sapiens
ttgtttgtttgtttgtttgtctatttatttatttttgagatggagtttcactctgtcccccaggctggagtacagtagtgcaatcttggctcgctgcaa

SEQ ID NO: 25303 - DNA, 88 bp, Homo sapiens
ctcactccaaaaacccagctgggtgactgtctgtctgtcagcattattaacagtgagagctcaagactcaggtgagtggtgggatgag

SEQ ID NO: 25304 - DNA, 126 bp, Homo sapiens
cctgagctgtcttacctgtattttactgtctgctctttctggatgcttgtaattagaagagaagtgatttccttgaaatgcatgaggctagaaagggagctagaacttaaagtggcagtgtttgtc

SEQ ID NO: 25305 - DNA, 107 bp, Homo sapiens
atatgtatatgtgtatatatgtatgaatgtgtatatatgaatatatatacacaatgtatgtatatatgtgtatgtgtgtatatatgcatgtatatatgtgtgtgtat

SEQ ID NO: 25306 - DNA, 98 bp, Homo sapiens
tctagctcctaggcaggtgaggactcttatttttcatttttattttatttatttttatttttttggagacagtatctcactctgtcacccaggctggg

SEQ ID NO: 25307 - DNA, 58 bp, Homo sapiens
tgaggcagagtctcgctctgtcacccaggctggagtgcagtggtgtgatctcggctca

SEQ ID NO: 25308 - DNA, 89 bp, Homo sapiens
gacagagtgagaccgtctcaaaaaaaaaaaaaaagaaaaaaatttttatttttgttttttgtttttttgagacagagtctcactctgtt

SEQ ID NO: 25309 - DNA, 87 bp, Homo sapiens
acagagtgagactctgtctcaaaaaaacaaaaaacaaaaataaaaatttttttctttttttttttttttgagacggtctcactctgt

SEQ ID NO: 25310 - DNA, 72 bp, Homo sapiens
tttgagcaggcagcctgagatttttttcttttttttttttgagacagagtctcactctcacccaggctcaag

SEQ ID NO: 25311 - DNA, 103 bp, Homo sapiens
tggtagtgcatgtctgtagtcacagctactcaggaggctgaggttgaaggatcacttgagcccaggaggctgaggctgcagtgagccaaaagtatgccactgc

SEQ ID NO: 25312 - DNA, 63 bp, Homo sapiens
gtttcacacttctgagtgtgacacgccctagtgggcatgcgcgttagtcggggtgacgggaac

SEQ ID NO: 25313 - DNA, 56 bp, Homo sapiens
ctctgcaaggcagcttcctcacttattcagtgaggacacagccacctgttgcagag

SEQ ID NO: 25314 - DNA, 120 bp, Homo sapiens
ggaatatttcctcagagaaatagagcttgggggtcagggacatgggacctgccactgacctgctctgtgactctgagacagtggcttccactctctgagctcagatccccactgggcagg

SEQ ID NO: 25315 - DNA, 115 bp, Homo sapiens
ggtgttttaactttttggttaaactgatttcaaagtgtagttattacatttattgtagatgagattgcttttaatttcattttgagatagttaattgttcttgtgtagaaatgct

SEQ ID NO: 25316 - DNA, 101 bp, Homo sapiens
cccaaatactatgagtgcccaagatgtgaaagtgggaaaaaggaatcatctgctctcatacacacaccctcacttgggaacctgaaagtctagatcatggg

SEQ ID NO: 25317 - DNA, 120 bp, Homo sapiens
ccatttctgagtagtattcaattatatatatacatacatatatatatatatacacatacatatatatatatatatatgtatatatatccacagtttctttatccacttgttgattgatgg

SEQ ID NO: 25318 - DNA, 91 bp, Homo sapiens
gtatcttgtgctgatctcctctctcaccctgtgacttagaatgccttaaccatctaggaatgcagctcagtaggtctcagcctcattttac

SEQ ID NO: 25319 - DNA, 104 bp, Homo sapiens; identical to SEQ ID NO: 23562

SEQ ID NO: 25320 - DNA, 114 bp, Homo sapiens
tggttcatgttcaggcagcaaaactgttggtaagttatactttttatgtatgtatgaatgcatgtatatatttatttgttttcttttctgtagaaatgaggcctgtgtggccca

SEQ ID NO: 25321 - DNA, 104 bp, Homo sapiens
tagccggcagtggtggtgcacacctatattcccagctattcaggaggctgaggtaggaggatcacttgatactgggaggtgaaggttgcagtcagctgtggctg

SEQ ID NO: 25322 - DNA, 62 bp, Homo sapiens
tagtgacagggtctcactctgtcacccaggctggagtgcagtggtgtgatcagagctcactg

SEQ ID NO: 25323 - DNA, 110 bp, Homo sapiens
gggctgatgtcaagccctgattcagtactgcctgatttttttttttagaatcacaactctgttctttaagtcatgggccatgaagtcagaaggtgctggtgtgacagcct

SEQ ID NO: 25324 - DNA, 94 bp, Homo sapiens
tgcatagtatttcatggtatatatgtatcatattttttttatccagtctatcactgacggacatgtaggttgattccatgactttgctattgta

SEQ ID NO: 25325 - DNA, 68 bp, Homo sapiens
tgttttgagacagagtctcgctctgtcactctggctggagtgcagtgatgagatctcgtcttactgca

SEQ ID NO: 25326 - DNA, 58 bp, Homo sapiens
tgagatggagtctcactctgtcaccgaggctggagtacagtggtgtgatctcagctca

SEQ ID NO: 25327 - DNA, 85 bp, Homo sapiens
gtgcctggccaatatttatttattttgagactcatttaaacccgggaggcagaggttgcggtgactcaagatagtggcactgcac

SEQ ID NO: 25328 - DNA, 57 bp, Homo sapiens
tgagaaggagtctcactcactctttcgtccaggctggagtgcagtggcgccatctcg

SEQ ID NO: 25329 - DNA, 114 bp, Homo sapiens; identical to SEQ ID NO: 25320

SEQ ID NO: 25330 - DNA, 112 bp, Homo sapiens
ggctgttgaacacttgacatgtggatagtgtgactgaggagttgaagtttttattctatttaattttaattagtatacattttaaaaccacatctgacgagtgccagctcaa

SEQ ID NO: 25331 - DNA, 135 bp, Homo sapiens
atacatatatatatgtgtgtatatatatgtgtatatatatgtgtgtatatatatgtgtatctatgtatatatatgtgtgtacatatatgtatatatatgtgtgtgtgtgtatatatatatatatatatatatgca

SEQ ID NO: 25332 - DNA, 112 bp, Homo sapiens; identical to SEQ ID NO: 25330

SEQ ID NO: 25333 - DNA, 114 bp, Homo sapiens; identical to SEQ ID NO: 25320

SEQ ID NO: 25334 - DNA, 62 bp, Homo sapiens; identical to SEQ ID NO: 25322

SEQ ID NO: 25335 - DNA, 70 bp, Homo sapiens
ttgctttgagacagggtctcactctgtcacccaggctggagtgcagaggcctgatcacgactcactgcag

SEQ ID NO: 25336 - DNA, 58 bp, Homo sapiens
tgagatagagtctccctctgtcacccaggctggagtgcagtggcatgatctcggctca

SEQ ID NO: 25337 - DNA, 63 bp, Homo sapiens
gtgtatatatatgtgtgtatacatttcttcctgtgtatgtatgtatatatgtatgttatacac

SEQ ID NO: 25338 - DNA, 73 bp, Homo sapiens
gtatacatattatgtatatatacatgcacgtgtatatacatacacatgcctgtatgtatatgtatatgtatac

SEQ ID NO: 25339 - DNA, 106 bp, Homo sapiens
gtggtgaaaggacagacacaatgatcagcagagaagaatacagagctcagaaacagacacaactgatttttattttattttttgagacagagtctccctgtcaccc

SEQ ID NO: 25340 - DNA, 60 bp, Homo sapiens
ttgagatggagtctcgctctgtcactcaggctggagtgcagtggcgtgacctcagcttag

SEQ ID NO: 25341 - DNA, 79 bp, Homo sapiens
ttagagacagggtctcactgtgtcacccaaactggagtgcagtggtgtgaacacagctcactgtcgctttgatctctgg

SEQ ID NO: 25342 - DNA, 86 bp, Homo sapiens
ccagcctgggggacagactgagactgtctcagaagaaaaacattttttttttatagagatggggtctcagtctgtcagcaggctgg

SEQ ID NO: 25343 - DNA, 74 bp, Homo sapiens
ccagcctgggcaacatagcaagaccccatctcttttttttttaagacagagtctcgctctgtcacccaggctgg

SEQ ID NO: 25344 - DNA, 107 bp, Homo sapiens
ggtgtgagccactgtgtccggccgggatttattaataagcactttttttttttttgagatggaggttcactcttgttgcccaagctggaatgcagtggcacaatttc

SEQ ID NO: 25345 - DNA, 77 bp, Homo sapiens
gattgtgagtatggtacgtaacaggaattacatctggtaagttgtatagttttgtgtaggaactctatattcatagc

SEQ ID NO: 25346 - DNA, 58 bp, Homo sapiens; identical to SEQ ID NO: 1237

SEQ ID NO: 25347 - DNA, 95 bp, Homo sapiens
tgtgtgtgtgtgtgtttgtgtgtatatgtgtgtgtgtgtatatatgtgtgtgggtgtatacacacacacacacagagatagataagaaaactgac

SEQ ID NO: 25348 - DNA, 86 bp, Homo sapiens
gtaacattgcatcaaatactatctctctccgtgtctccattttcttatctataaaacagggaagatggtgatgatggtaatgatac

SEQ ID NO: 25349 - DNA, 58 bp, Homo sapiens; identical to SEQ ID NO: 6617

SEQ ID NO: 25350 - DNA, 56 bp, Homo sapiens; identical to SEQ ID NO: 6618

SEQ ID NO: 25351 - DNA, 93 bp, Homo sapiens; identical to SEQ ID NO: 69

SEQ ID NO: 25352 - DNA, 101 bp, Homo sapiens
tatcaaagtcttgatgttggtggctagagagaacttcttaggttttctacctgtattagtccgttttcatactgctataaagaactgcccaagacggggta

SEQ ID NO: 25353 - DNA, 82 bp, Homo sapiens
ggctgggattacaggcgcacaccaccaagtcttgctaattattttatatttttagtagagacggggtgtcactgtgttggct

SEQ ID NO: 25354 - DNA, 58 bp, Homo sapiens; identical to SEQ ID NO: 2135

SEQ ID NO: 25355 - DNA, 56 bp, Homo sapiens; identical to SEQ ID NO: 2136

SEQ ID NO: 25356 - DNA, 58 bp, Homo sapiens; identical to SEQ ID NO: 1763

SEQ ID NO: 25357 - DNA, 68 bp, Homo sapiens
cgggagagggagagggagaggatttagttattttttgagatggagtctcgctctgtctcccaggctgg

SEQ ID NO: 25358 - DNA, 78 bp, Homo sapiens
gcctgggcatcatggtgaaaccttgtctctacaacaaatgtaaaaaattagtcagacttcatggtgtatgcctgtggt

SEQ ID NO: 25359 - DNA, 83 bp, Homo sapiens
gttaggtgactgatttgagagctttcttttaatttttatttttatttattttttgagatggagtctcactctgtcacccaggc

SEQ ID NO: 25360 - DNA, 58 bp, Homo sapiens
tgagacagggtctcactctgtcacccaggctggagtgcagtggcgagatctcggctca

SEQ ID NO: 25361 - DNA, 77 bp, Homo sapiens
gtacctgtagtcccagctactcaggaggctgaggtggaaggatcacttgagcccaggaagttgaggctgcagtgagc

SEQ ID NO: 25362 - DNA, 113 bp, Homo sapiens
gtttgctactttttttgagtttttttggtctatgttcatagagactattggtctgtgtagacttctgtttttgtactaccatagtctagttttgatgtaaaggtaatgttggc

SEQ ID NO: 25363 - DNA, 305 bp, Homo sapiens
atgtgtgtgtgtatatatatatgtgtgtgtatgtgtatatatatatatacgtatatatatgtatatatatgtatatatatgtatatatgtatatatatgtatatatatgtatatatatgtgtgtgtgtatatatatacgtatatatatgtatatatgtgtgtgtatatatgtgtatatatgtgtgtatatatgtgtgtatatataatgtgtgtatatatatgtgtgtatatatatgtgtatgtatatatatgggtatatatatgtgtgtgtatatatatgggtacatatctatatatctatatat

SEQ ID NO: 25364 - DNA, 58 bp, Homo sapiens
tgagatggagtctcactctgtcacccaggctggagtgcagtggcgggatctcggctca

SEQ ID NO: 25365 - DNA, 58 bp, Homo sapiens
tgagttggagtctcactctgtcacccaggctggagtgcagtggtgtaatcccagttca

SEQ ID NO: 25366 - DNA, 83 bp, Homo sapiens
ctattggcagaagactgtgccagtctttgcttcatactcttaactgatgaatgagtgctgagatgggaggaatcctgctaaag

SEQ ID NO: 25367 - DNA, 58 bp, Homo sapiens
tgagacagagtctcactgtgtcgcccagggtggagtgcagtggcacgatctcctctca

SEQ ID NO: 25368 - DNA, 74 bp, Homo sapiens
ctcagcctcccaaagtgctgggattgcaggcatgagccaccgcgtctgcgtctctgcgtctatctgtggctgag

SEQ ID NO: 25369 - DNA, 93 bp, Homo sapiens
caatcttttggaactgtgattttcaagatattagaagttcaggctttggactttagagattttgatttttttatgatttcaacattgggattg

SEQ ID NO: 25370 - DNA, 114 bp, Homo sapiens; identical to SEQ ID NO: 25223

SEQ ID NO: 25371 - DNA, 108 bp, Homo sapiens
tgccatgggccattgtcttaaaaaatatatatatatataaatatatatataataaatatatatatttttttaattttatttttttgagacggagttttgctcttgtca

SEQ ID NO: 25372 - DNA, 59 bp, Homo sapiens
ccggcctggtgtggacgtgaatttattttgagacagtctcactctgtcacccaggctgg

SEQ ID NO: 25373 - DNA, 58 bp, Homo sapiens
tgaggcggagtctcgctctgtcacccaggctggagtgtagtggcgcgatctcggctca

SEQ ID NO: 25374 - DNA, 109 bp, Homo sapiens
caaatgggagaggcagggtaaaacttaccagagaagctgtcatttattttattttattattattattttttttttttgagtcggagtctcactctgtctccccggcttg

SEQ ID NO: 25375 - DNA, 92 bp, Homo sapiens
gggaaagaaagtgggatctagaggggaaagtgggagaagagattttccttttttcctttttttttttttgatatggagtctcactgtcaccc

SEQ ID NO: 25376 - DNA, 56 bp, Homo sapiens; identical to SEQ ID NO: 14407

SEQ ID NO: 25377 - DNA, 81 bp, Homo sapiens
gtgttggtgaaatacatgtgtatatgtagttgtgtgtaaaggtatataggtacatgcacaaatatatttcccttttggcat

SEQ ID NO: 25378 - DNA, 93 bp, Homo sapiens
tggcctctaacctgggaaatgagtgattgtgatggtgtcgtccatggagatgatgttacttgcatatttatttttcatgtaggtagagagtga

SEQ ID NO: 25379 - DNA, 94 bp, Homo sapiens
cattttggattatgtggtatcatgaatcagatggtatgttttgttattttattttatttagacaaggtctggctctgttccccaggctggggtg

SEQ ID NO: 25380 - DNA, 93 bp, Homo sapiens
catggtagtgaataagtctcacgagatctgatggttttaaaagggatttccccttttgcttggctctcactctctctcttgtctgccgccatg

SEQ ID NO: 25381 - DNA, 83 bp, Homo sapiens
gctttgtcttctgaatttgtggagagaatattctaggttaacagaataatctatttatttacttatttattttgagatggagt

SEQ ID NO: 25382 - DNA, 58 bp, Homo sapiens
tgagaccgagtctcgctctgtcacccaggctggagtgcagtggtgtgatctctgctca

SEQ ID NO: 25383 - DNA, 62 bp, Homo sapiens; identical to SEQ ID NO: 25216

SEQ ID NO: 25384 - DNA, 80 bp, Homo sapiens
ctgggaaacatagtgagaccctatctcttaaaaaaaaatttttttttttttttgagagggagtctcattctgtcacccag

SEQ ID NO: 25385 - DNA, 85 bp, Homo sapiens
tttttttgagacagagtctcactctgtcgcccaggctggagtgcagtggtgtgatctcggctcactgaaagctccatctcccagg

SEQ ID NO: 25386 - DNA, 58 bp, Homo sapiens; identical to SEQ ID NO: 2626

SEQ ID NO: 25387 - DNA, 85 bp, Homo sapiens
caccttgtgactatgtgttggcaaagctttgatggtaagagtatgtctctctctgtgaaagatgttcaaatcaagtggcccagtg

SEQ ID NO: 25388 - DNA, 104 bp, Homo sapiens
gagtagctgggactacatgtgcacaccactatgccccactaatttttgtatatatgcatattttttggtagagatgatgtctcgctgtgttgcccaggctggtc

SEQ ID NO: 25389 - DNA, 82 bp, Homo sapiens
ggctctgtgccaggctgcctgaatggttccctgcttcctctgggatcgaggggcccaactcagggagggcctggatggaccc

SEQ ID NO: 25390 - DNA, 90 bp, Homo sapiens
tgagctgtcttatctgtgttttactgtctgctttatctggctgcttgtagttagaagagaagtgatttccttgaaatgcatgacgctaca

SEQ ID NO: 25391 - DNA, 71 bp, Homo sapiens
ttgttgtctgaagaaactgaggcacagaggcggaaacgcttgctctgtgctatgttattaacaaacagcag

SEQ ID NO: 25392 - DNA, 110 bp, Homo sapiens
ttggctgaaagactgaggtgtgcaggacaggaccagcctcgggcagtcctgtgtgaggacacagggctgttatcaggaactggcctagtaggtgccacatgctgtgctga

SEQ ID NO: 25393 - DNA, 58 bp, Homo sapiens
tgagacggagtctcactctgtcacccaggctggagtgcagtggtgggatatcagctca

SEQ ID NO: 25394 - DNA, 110 bp, Homo sapiens
ggatgtattcctccagggctgtttggggtgtcagtgcaaatgtaaagacaacctaccaactgattttgtttttcagagcattgaggctgaaaactagaagggttgtgttc

SEQ ID NO: 25395 - DNA, 254 bp, Homo sapiens
gcaaatatatatatatatatatatatatatatacacacacacatacatatatatgtgtgtatatatatgtgtgtatatatacatatatgtgtgtatatatacatatgtgtgggtatacatatgtatgtgtgtatatatatacatatatatgtgtgtgtgtatatatacatatatatgtgtgtgtatatatatacatatatgtgtgtgtgtatatatatatacatatatatatgtgtgtatatatatatgagata

SEQ ID NO: 25396 - DNA, 58 bp, Homo sapiens; identical to SEQ ID NO: 1409

SEQ ID NO: 25397 - DNA, 109 bp, Homo sapiens
ccaaacgtacctgctcgacaatgtgtctaaattcattaactattttgttttaacgatatttcgttttaaagttttattttatccacatgttgacttcattttactttgg

SEQ ID NO: 25398 - DNA, 109 bp, Homo sapiens
agtcatgtatctatgtatctatttgtcatctatgtatgtatatatgtatgtgtctttgtgtatatatgtatgtatgtatgtatctatctgtgtatttatctatgtgact

SEQ ID NO: 25399 - DNA, 74 bp, Homo sapiens
gtcctaactctcactatctctgattgtgaccttattgagtgatagggtcttaaaagaggtagtcagtcgggcac

SEQ ID NO: 25400 - DNA, 69 bp, Homo sapiens
ggtgacagagtgagatcccatcttttcttttgtttttttttttttgagtcagggtctcactgtgtctcc

SEQ ID NO: 25401 - DNA, 84 bp, Homo sapiens
tgagactgagtctccctctgtcacccaggctggagtacagtggcgcaatctcggctcactgtaagctctgcttcccgggttcac

SEQ ID NO: 25402 - DNA, 88 bp, Homo sapiens
agagagtgagtccaactctaaatacagatgccactcattaagaggcaaacacatgtacttttttttttttgagacggagtctctctct

SEQ ID NO: 25403 - DNA, 76 bp, Homo sapiens
gctgcaagtcaggccagggagcatcataattttttttttaagagacaggatcttgctctcctgcccaggctggagt

SEQ ID NO: 25404 - DNA, 58 bp, Homo sapiens; identical to SEQ ID NO: 25307

SEQ ID NO: 25405 - DNA, 76 bp, Homo sapiens
gagacggggttacgccatgttgccaaggctggtctgtgaatctctggatctctctctggctcggcttccttatctc

SEQ ID NO: 25406 - DNA, 86 bp, Homo sapiens; identical to SEQ ID NO: 2169

SEQ ID NO: 25407 - DNA, 72 bp, Homo sapiens
aagacatatttatgtccatgtgtataaggacacaaatacgtccttacacacacacagacacaaatacatctt

SEQ ID NO: 25408 - DNA, 96 bp, Homo sapiens
tgctgctttttttttttttgctttattttgttttgaggcagggtctcactctgtcacacaggctgaagtatagtggtgcaatcatggcttactgca

SEQ ID NO: 25409 - DNA, 132 bp, Homo sapiens
tacatagatttatgtacacagatatgcatgtgtttgtacacatatatttgtacgtatatgtatatttgtatatacatatgtatatgtgtgtatatatgcatgtgtacgtcatgtatatatacatatatatgt

SEQ ID NO: 25410 - DNA, 117 bp, Homo sapiens
tgtgtgtgtgtgtatatatgtgtgtgtgtgtatatgtatgtgcatatatatacatatatatgtatatatacatgacgtacacatgcatatatacacacatatacatatgtatataca

SEQ ID NO: 25411 - DNA, 111 bp, Homo sapiens
atgataaagaagaactttctggtacatggaaggactccacagtggaaggggctgacactacagagtgagcttcctattacaggagatattcaaaccagatagacgtatcat

SEQ ID NO: 25412 - DNA, 75 bp, Homo sapiens
ccctatgaaacaaagaaagaggagtgtgggggcaaaagaggaatctcacagactcacaccctcttttacatgggg

SEQ ID NO: 25413 - DNA, 76 bp, Homo sapiens
tccacaggcactggctgtctccctccctccatctcttggctctctcaataggagtgagacttgacgcctcctggga

SEQ ID NO: 25414 - DNA, 95 bp, Homo sapiens
ggatctgagtccattaaacctctttttctttataaattacccagtctcaggtatgtctttattagcagagtgagaatggactaatacagtaatcc

SEQ ID NO: 25415 - DNA, 126 bp, Homo sapiens
ggcatgcaacttaccccctcaagatgtgaggctgttatgcaattaagaagctccttttatttactttaatttttaaatttaacttggatttcagtttcaggggttcatgtgcaggtttgtcttaca

SEQ ID NO: 25416 - DNA, 89 bp, Homo sapiens
ggtagatgtgggttcagatctctgcgtctgtcccgctgtgccaagtgctggggcagacgcgggcagagactggacagcggcacggtgcc

SEQ ID NO: 25417 - DNA, 102 bp, Homo sapiens
gtgtggtcactgctgagtctctcctgaaggcactgaacaatccccgatcacagcacaggagagagtgaacagtcgagcacactttctgtgctgtgaacctcg

SEQ ID NO: 25418 - DNA, 107 bp, Homo sapiens
ggctgcagccgcgtgtgacccatgggagacaatgcaggatgggaagaaggggaggccagcgtctctccctcactctgcctcctggggtttctgccgcagctgctgct

SEQ ID NO: 25419 - DNA, 71 bp, Homo sapiens
cctgcttgctctctgagatcttgctgtctgcctatatatctgtagtagaaaccattctgagggctaaaagg

SEQ ID NO: 25420 - DNA, 95 bp, Homo sapiens; identical to SEQ ID NO: 580

SEQ ID NO: 25421 - DNA, 93 bp, Homo sapiens; identical to SEQ ID NO: 69

SEQ ID NO: 25422 - DNA, 57 bp, Homo sapiens
tgagacagagtctggctctgtcactcaggctggagtgcagtggcatgactcagctca

SEQ ID NO: 25423 - DNA, 97 bp, Homo sapiens
tgggacagcgtctcactctgttacctaggctggagtacagtagtgtgatcatagctcactgcagactcaacctccctgggctaaagtgatcctccca

SEQ ID NO: 25424 - DNA, 116 bp, Homo sapiens
tgtctgtgtgtatatatatgtacatacacatatgtgtgtatatatatgtacatatacacatatgtgtgtatatatatgtacatatatatacacacatatgtgtgtgtatatatata

SEQ ID NO: 25425 - DNA, 104 bp, Homo sapiens
tacacacacatatgtgtgtatatatatgtacatatatatacacacatatgtgtatatgtacatatatatacacacatatgtgtatgtacatatatatacacaca

SEQ ID NO: 25426 - DNA, 134 bp, Homo sapiens
tggctatcacaggggcgacttttgctgagagggaagaagaggagtcttttgtttttttttttttttttttttgtgatggagtctcactctgtcacccagactggagtacagtttgtgatggagtctcactctgt

SEQ ID NO: 25427 - DNA, 58 bp, Homo sapiens
tgagacagggtctcactctgtcactcaggctggagtgcaatggtgtggtcttggctca

SEQ ID NO: 25428 - DNA, 64 bp, Homo sapiens
tgccatagagctcactgtaagtgtgcacaaagtagagatcctgtgagcacacagtgagaaggca

SEQ ID NO: 25429 - DNA, 109 bp, Homo sapiens
cccagaaattggttgagagaaatagttgtgaaggataaaggtgacagtgagcagagacaggccaggggagccttcagaccacaatgctggtctggcacccatgaaaggg

SEQ ID NO: 25430 - DNA, 58 bp, Homo sapiens
tgagacagagtctgtctctgtcgcccaggctggagtgtagtggcgtgatcttgactca

SEQ ID NO: 25431 - DNA, 167 bp, Homo sapiens
atatgtattatatatacgcatatacagatatatgtgtatatgtatatgtatatacatatgtattatatatacacatatacacatatatgtgtatatgtatatgtatatacatataatatgtattatatatacatatgcacatatgtatatatgtataatatacatat

SEQ ID NO: 25432 - DNA, 127 bp, Homo sapiens
atatacacatatatctgtatatgcgtatatataatacatattatatgtattataatatatgttataatatattataaatgtactatagtatatgtatgtatcatattatatatgtatgtatgatata

SEQ ID NO: 25433 - DNA, 79 bp, Homo sapiens
atgtttgtccttcagtcctcatgggatgcttgtttccttggcaggttttcatttgggtgcaggcttgattggatgacat

SEQ ID NO: 25434 - DNA, 95 bp, Homo sapiens; identical to SEQ ID NO: 68

SEQ ID NO: 25435 - DNA, 93 bp, Homo sapiens; identical to SEQ ID NO: 69

SEQ ID NO: 25436 - DNA, 58 bp, Homo sapiens
tgagacagagtctcactctgtggcccaggctggagtgcaatggtgagctcttggctca

SEQ ID NO: 25437 - DNA, 102 bp, Homo sapiens
gtgaccgtgcacttccttctgagagagaactgtgccaggggagggctgagctccaccctctccctcagtctctaagacactgaagccatgctgtgctctcac

SEQ ID NO: 25438 - DNA, 106 bp, Homo sapiens
acttaaatgagacccaaattgatgtctcacccatttcttttttaaaaaaattttttatttccatagattattggggaacaggtggtatttgggtacgtgagtaagt

SEQ ID NO: 25439 - DNA, 86 bp, Homo sapiens
atgtgtgtgtatgaatatatgtgtatatgattatgtgtgtgtatatgtgtatgtaattatgtgtgtgtatctgtgcacttgtgtat

SEQ ID NO: 25440 - DNA, 161 bp, Homo sapiens
atacatatatatatatatatatatatgcacacacatatatatgtatatatgtgtgtatacatatgtatatacgtgtatatgtgcgtatatatacgtatatacgtttatatatatgtatatatgtgtatatatatacacacccacatgcacacatatataca

SEQ ID NO: 25441 - DNA, 58 bp, Homo sapiens; identical to SEQ ID NO: 2442

SEQ ID NO: 25442 - DNA, 84 bp, Homo sapiens
tacatatgtatgtatatatgtttctatgtgtatatgtatttatattttaatataagtaaacatacatgtatatatgcatacgtg

SEQ ID NO: 25443 - DNA, 116 bp, Homo sapiens
cagtctcctgagtagctaggactacaaggatttatgcctccatgcccagctaattttttcatttttagtagatgtgggggtctcactttgttgcccaggttggtctcgaactcctg

SEQ ID NO: 25444 - DNA, 58 bp, Homo sapiens; identical to SEQ ID NO: 2442

SEQ ID NO: 25445 - DNA, 79 bp, Homo sapiens
ccccacctctcaagtagctgggactacaggtgcgtgacaacacaccctgctaagttttaaaatttttgtggagatgggg

SEQ ID NO: 25446 - DNA, 58 bp, Homo sapiens
tgagactgagtctcactctgtcacccaggctggagtgcagtggcgcgatctcagctca

SEQ ID NO: 25447 - DNA, 58 bp, Homo sapiens; identical to SEQ ID NO: 2626

SEQ ID NO: 25448 - DNA, 120 bp, Homo sapiens
actgctgagcttcacttacaatccctgggggcagggccctggaatctgtatttttatttttaattatttattatgagacagaatctcactctgtcgcccaggctggagtgcagtggtgca

SEQ ID NO: 25449 - DNA, 106 bp, Homo sapiens
ttttgctaaagggagaagaatcctgtgagaatgtgagaatggagtgcttcctgcaggatggcttatttttttttaatttttattttttattttttttgaggcagaa

SEQ ID NO: 25450 - DNA, 113 bp, Homo sapiens
tagcataaattaaagaaggaatagtgctatacagaacaatgttttttatattttactgggtttaagtaactataatctgaagcaggttctgataaattaagatatttatgtta

SEQ ID NO: 25451 - DNA, 58 bp, Homo sapiens; identical to SEQ ID NO: 2540

SEQ ID NO: 25452 - DNA, 58 bp, Homo sapiens
tgagactgagtctcactctgtcactcaggctggagtgcagtggtgcaatcttggctca

SEQ ID NO: 25453 - DNA, 83 bp, Homo sapiens
aaggattctattcattgtgaatttcagaagctgttatttggtcctctaaataattatttatatgaaagcaatgaatactcttt

SEQ ID NO: 25454 - DNA, 83 bp, Homo sapiens
ccagcctgggtgacagaacaagaccctgtctcttaaaatttttttttttttgaaacagagtctcagtctgtctcccaggctgg

SEQ ID NO: 25455 - DNA, 75 bp, Homo sapiens
cctgggagacagactgagactctgtttcaaaaaaaaaaaaattttaagagacagggtcttgttctgtcacccagg

SEQ ID NO: 25456 - DNA, 76 bp, Homo sapiens
cctccttacttctctctgtctctacttagtatccatttctgctgaggcagatccagatgggcagaggttggggagg

SEQ ID NO: 25457 - DNA, 115 bp, Homo sapiens
gtgaagcagaacacagagtccagaaatagacctaaacagaaatagacataaacaagcaactgattttttattttttttatttttatttttgaggtggagtctcactctgtctccc

SEQ ID NO: 25458 - DNA, 106 bp, Homo sapiens
ctctgaatgtcacactgagaagttccaatgatcaaaaaaaaactgaggctcccggagacaaggatctttttttttttttaattaaacaactactgtgtgccaaggg

SEQ ID NO: 25459 - DNA, 66 bp, Homo sapiens
tgtgggcaaagggctgcagttagtcccttgttacactcagtgacaggtgactctgagctgtctgga

SEQ ID NO: 25460 - DNA, 110 bp, Homo sapiens
gatataacatcatgtgaaggtagaccactgtaaattaaagatatatatagtatgtatatatatatatatatataaatatattggagtattttccattcaaatgttaagtt

SEQ ID NO: 25461 - DNA, 90 bp, Homo sapiens
gctggtattacaggcatggtgccaccacacccagctaaattttttgtattttcagtagggatggggtttcaccatgttactcgggctggt

SEQ ID NO: 25462 - DNA, 95 bp, Homo sapiens; identical to SEQ ID NO: 68

SEQ ID NO: 25463 - DNA, 93 bp, Homo sapiens; identical to SEQ ID NO: 69

SEQ ID NO: 25464 - DNA, 58 bp, Homo sapiens; identical to SEQ ID NO: 315

SEQ ID NO: 25465 - DNA, 117 bp, Homo sapiens
ggtccatcaaggcccaccccaaagtctactgcctggactgagctgacttctttcttttttttttttttaagacagagtctcgctcagtcgcccaggctggagtgcagtggctcgacc

SEQ ID NO: 25466 - DNA, 67 bp, Homo sapiens
cagctggcatcaatgggctgtcttctgctcccacccagtgggtgtgaagtcactctctggctctctg

SEQ ID NO: 25467 - DNA, 125 bp, Homo sapiens
ttgttctttttccttatgattgtcttggctatacaggctcttttttggttccatatgaaatttaaagtagttttttctaattctgtgaagaaagtcaatggtagcttgatagggataacattgaa

SEQ ID NO: 25468 - DNA, 77 bp, Homo sapiens
gagggtgtcagatcagactggcctcagatcgcagcactgaaagcttctctcatggccaatccctgtgtgaggccctc

SEQ ID NO: 25469 - DNA, 113 bp, Homo sapiens
gtaccaaagaaaatgtctatagtctggaaaagatttatcactaagtatgactgtctatcactctggatgtacccccttgttataaatctccagcaagactgatcacttggtat

SEQ ID NO: 25470 - DNA, 115 bp, Homo sapiens
cactaaaagatctgaaagtgtggtaggtgtctgaatgtgtctatgaaaaagatgggtataattttttttttcttgagacagagtctcactctgttgcccaggctggagcacagtg

SEQ ID NO: 25471 - DNA, 76 bp, Homo sapiens
tgatcagagctgcttccatgaggatgactttctgtgggaacgtggagagagtgcacagtggggaaaaatcaggtca

SEQ ID NO: 25472 - DNA, 61 bp, Homo sapiens
gagacagggtctcactctgtcactcaggctggagtgcagtgtagtggcatgatcttagctc

SEQ ID NO: 25473 - DNA, 79 bp, Homo sapiens
atggagtgagactctgtctcaaacaaacaaacaaaacgacacattttttttttttttttgagacggagtctcactctgt

SEQ ID NO: 25474 - DNA, 118 bp, Homo sapiens
ttcctgtcctgtaaaagcatgcagatgaaagtatctttaatgtataattacatttttatatgtgtataatcttagattacatgggaattgagtatctggaatggatcggccttaggaa

SEQ ID NO: 25475 - DNA, 93 bp, Homo sapiens
tcatttccatgcctcctcatgcacccccaaactcagctggtcattttgcaaatgcaggttgtcagctgtgagtgagcactggtaacagaaaga

SEQ ID NO: 25476 - DNA, 95 bp, Homo sapiens
gatgtgttggtgcacacctgtggtcccagctactcccagctactcccaactactcaagaggctgaggtaggaggatcacttgagcccagcaggtc

SEQ ID NO: 25477 - DNA, 132 bp, Homo sapiens
atatacacatgtgtgtgcctatgtgtatatataaatacagatatacatatgtgtatatatgcatgtatatatgtatatgtgtatatgtgtgtatatacatgtgtacatatgcagatatatacgtgtgtgtat

SEQ ID NO: 25478 - DNA, 91 bp, Homo sapiens
atgctgtctcatttttggttccatatgaaatttaaagtagttttttccaattctgtgaagaaagtcaatggtagcttgatggggatagcat

SEQ ID NO: 25479 - DNA, 58 bp, Homo sapiens; identical to SEQ ID NO: 605

SEQ ID NO: 25480 - DNA, 106 bp, Homo sapiens
ttggccattggatcagccaccccagccgcactgagtctgagatgtgagtcagcacagctggcccactttgacttcctaggttttctctgtaatcctctttccccaa

SEQ ID NO: 25481 - DNA, 61 bp, Homo sapiens
tgtctcactctgtcacccaagctggactgcagtggtcagtagctgagtgtcagagtctaca

SEQ ID NO: 25482 - DNA, 72 bp, Homo sapiens
gaaacaagggagataaccttaaactctggctgcctctgagcctggcagaacagagccatatctctctctttc

SEQ ID NO: 25483 - DNA, 109 bp, Homo sapiens
ggcagtggagttagaatcacagagggatggctctggaaagagtacattttatatatatttatatatatatataatttatgaaacagagtctctctctgtcgcccaggcc

SEQ ID NO: 25484 - DNA, 71 bp, Homo sapiens
gttgtttgagactgagtctcgctctgtcacccacgctggagtgtagtggcgccatctcggctcactgcagc

SEQ ID NO: 25485 - DNA, 119 bp, Homo sapiens
gtatccttctccaccctccctgattgtgttctctctctagtcctttttttttcttttttctttctttttttttggagacaggatctcactctgtcactcaggtgggagtgcagtggtgc

SEQ ID NO: 25486 - DNA, 75 bp, Homo sapiens
tggctttttaaatgtttctgtatatattttaaaatctgttaagatatatatacatatgatatttaacaagagcta

SEQ ID NO: 25487 - DNA, 95 bp, Homo sapiens
ctgagtccggcacctgtgcgccgctccctctgtgcctcccgggcagccccgcctgccggcctcggagtccgcggcgccggcggctagaggtccag

SEQ ID NO: 25488 - DNA, 113 bp, Homo sapiens
agctgggcatggtggtgcacacctgtggtcccagctcttcaggaggctgaggtgggaggatgttttgagcctaggagttcgaggctacagtgagctatggttgtgccactgct

SEQ ID NO: 25489 - DNA, 64 bp, Homo sapiens
tagagagacatggtctcactctgtctcccaggctggagtgcagtggtgtgaccataactcactg

SEQ ID NO: 25490 - DNA, 80 bp, Homo sapiens
gaccctccatgctcaagtctgtaaaaggcagtgaagagaacatgactctgaagtcagacagaacagagtttgcagtggtt

SEQ ID NO: 25491 - DNA, 95 bp, Homo sapiens
gtcgggcgtggtcccagctattcgggaggctgaggtaggaggatcacttgagcccaggagatcaacgcttcagtgagctgcaatcacaccattgc

SEQ ID NO: 25492 - DNA, 82 bp, Homo sapiens
atatgtgtgtgtgtatatatatacgtatatgtgtgtgtgtatatatatacatatatgtgtgtatatatacatgtatatatat

SEQ ID NO: 25493 - DNA, 57 bp, Homo sapiens
ttttagatggtgtctcactgtgtcacccaggctggagtacagtggcaccatcttgag

SEQ ID NO: 25494 - DNA, 100 bp, Homo sapiens
ctgaataatattctgagtatagatacagcacattttatttatctgtttatcagtttagttgatagacatttgggttgtttctactttggggctattaggg

SEQ ID NO: 25495 - DNA, 137 bp, Homo sapiens
gtgtgtgtgtgtgtgtgtgtttgtgtatgtgcatatatatgtatgtgtgtatatatatgtatatatacacatgtacacatatacagtatatatatataaaatacatataaatacatacatacatacatacatacaca

SEQ ID NO: 25496 - DNA, 96 bp, Homo sapiens
tatgtatgtatgtatgtatttatatgtattttatatatatatactgtatatgtgtacatgtgtatatatacatatatatacacacatacatatata

SEQ ID NO: 25497 - DNA, 56 bp, Homo sapiens
ggtgaaggggtgactttctttttttttcttttttgagagagtctcgctctgtcacc

SEQ ID NO: 25498 - DNA, 79 bp, Homo sapiens
gcctggctggggatcagagttttttagagcaacttcggtgggggaaggccagtgagttgagagtgttgattggttgggt

SEQ ID NO: 25499 - DNA, 75 bp, Homo sapiens
ttgttttgttttgagatggagtctcactctgtcacccaggctggagtgcaatggcccgatctcagctcactgcaa

SEQ ID NO: 25500 - DNA, 58 bp, Homo sapiens
tgaggcagagtctcgctctgtctcccaggctggagtgcagtggcgcgatcttggctca

SEQ ID NO: 25501 - DNA, 91 bp, Homo sapiens
gtagagccaaatatggtttttggttttttttgtttttttttttttttggaaaaaaaaaatgctgagctcagccaggtccagtggctcctgc

SEQ ID NO: 25502 - DNA, 114 bp, Homo sapiens
ctggagtgaatgtaaggaaaactgacttcttggtgttacgtaattgtttttaactttaaaatgttttgtgatgctgtctgatgcctgtcatactctcttactcttctcccccag

SEQ ID NO: 25503 - DNA, 110 bp, Homo sapiens
cttttgctgtgattgtgaggctaccccagccatgtggaactgtgagtccgttaaacctctttttctttataaattacccagttttaggtatgtccttatagcagtgttag

SEQ ID NO: 25504 - DNA, 75 bp, Homo sapiens
gctttttattgctagtcgactaaccaggagacaggagtccagctcaaatctgtctctctgtgctggctttaaggc

SEQ ID NO: 25505 - DNA, 58 bp, Homo sapiens
tgagacagagtctcactctgtcgcccaggctggagtgcagtggtgtgatcctggctca

SEQ ID NO: 25506 - DNA, 60 bp, Homo sapiens
tgagatggagtctcactctgtcacccaggctggagtgcagtgtggcatgatctctgctca

SEQ ID NO: 25507 - DNA, 114 bp, Homo sapiens
ggtcatgtgctgcaagaaaaaggcagaagcaaggtcagaggtttaggagagttggctaaactgtgaaacactcactgtgactattggaattgccttaatcacaggcacagagtc

SEQ ID NO: 25508 - DNA, 56 bp, Homo sapiens
gagacagggtctcactctgtcacccaggctggagtgcagtagtatgatcctagctc

SEQ ID NO: 25509 - DNA, 58 bp, Homo sapiens; identical to SEQ ID NO: 1391

SEQ ID NO: 25510 - DNA, 56 bp, Homo sapiens; identical to SEQ ID NO: 1392

SEQ ID NO: 25511 - DNA, 59 bp, Homo sapiens
tcagtatgtgcacctgtagcctcagctacttgggaggctgaggtaggaggatcgtttga

SEQ ID NO: 25512 - DNA, 58 bp, Homo sapiens
tgagctggagtctcactctgtcacccaggctggagtgcagtggtgcggtctcagctca

SEQ ID NO: 25513 - DNA, 56 bp, Homo sapiens
tagtgaatatatatatgtgtgtgtatatattcatatatatatgtatatatatactg

SEQ ID NO: 25514 - DNA, 84 bp, Homo sapiens
ggagaagccacatagctgattcattcactgtgagtgtctgtcagtcagtgggtgataactgtcagaagcttcgggctcatttcc

SEQ ID NO: 25515 - DNA, 104 bp, Homo sapiens
ggtttttgctatgtctttgcatttttcaagttttactatgacgtgtccagttgtggatttcattttatgtgtcttccttgggctttgttgggcttcttcaaacc

SEQ ID NO: 25516 - DNA, 116 bp, Homo sapiens
gttactttatttccaggttctctattctgttccattggtctgtgtatctatttttatactagtaccattctgttttggttactgcagccttgtagtataatttgaagttaggtaat

SEQ ID NO: 25517 - DNA, 87 bp, Homo sapiens
gtgccagaggagtgaagcaaggctctacgctcatctttttttttttttttttttttgagactgagtctcgctcagtcgcccaggcgc

SEQ ID NO: 25518 - DNA, 90 bp, Homo sapiens
catacatatttatatgtgtctgtatatgtaaatacatatatacatatttatatgtgtatctacatatatacacacatataaatacgtatg

SEQ ID NO: 25519 - DNA, 108 bp, Homo sapiens
gggctatagagcagattttcttcgggtggtcagtagtcagtgaggtcaagaccatcacccccaagcctgaatccccccagagcctgctggagtaaacagttgtggccc

SEQ ID NO: 25520 - DNA, 176 bp, Homo sapiens
tatatatatatatatatgtatatatatatgtatgtatatatgtatatatatgtatatatatgtatatatgtatatatatatgtatgtatatatgtatatatatgtatatatatgtatatatatatatacgtgtatatatacacgtatatatatatatatgtacatatatgcagcca

SEQ ID NO: 25521 - DNA, 110 bp, Homo sapiens
caaagtttctctgcatttgttcattgtctttcactaaaatttctgttcttttttttttttttttttttggattctttgttgaaagacagtagtgtgtagttttaagtttg

SEQ ID NO: 25522 - DNA, 96 bp, Homo sapiens
gcagctactgtctgtcctggtaacttctatctgtttttttttttttttttgagatggagttttactcttgttgcctaggctggagtgtagtgtggc

SEQ ID NO: 25523 - DNA, 106 bp, Homo sapiens
tggtactgtagaggaaaaaaaaggaaggtgcattaatgtgggttctccaaagaaacagaatctatctatctatctacctacctacctatccatccatcatctatca

SEQ ID NO: 25524 - DNA, 84 bp, Homo sapiens
gaagtataatttagaatttaaccaactgggcgagagggtacgttttcatatactctcactcacactgaattttccctatacttt

SEQ ID NO: 25525 - DNA, 118 bp, Homo sapiens
atacatatctgtatctatatctatgtgtgtgtatatatatatgtgtatatatgtgtatctgtatatatatatgtgtgtgtatatatatctatgtgcgtgatatatatatctaggatgc

SEQ ID NO: 25526 - DNA, 79 bp, Homo sapiens
agtctgtcactcactctttgggaacttaagcctcccagactctgcagaggtgtttctcccatgtctgtgagcccagatt

SEQ ID NO: 25527 - DNA, 59 bp, Homo sapiens
aggttttgacagaagtttgacagctcaggctgtgggagggctcatctctgtcaacatct

SEQ ID NO: 25528 - DNA, 133 bp, Homo sapiens
tatatatattacataaatatatataattattatatgtaattatatatatgtctgtgtatatatatatatacacatctgtatatatatatgtatatacatctatatgtatatatgtgtgtgtatatatgtatgt

SEQ ID NO: 25529 - DNA, 79 bp, Homo sapiens
tgggacagaagttagagttcacaggtctttcctcaacaggagaataattaactctagattaatcacagctcttgtccca

SEQ ID NO: 25530 - DNA, 57 bp, Homo sapiens
agagagagagagagagagggagagatctggtgtctcttccttttttttttttttttt

SEQ ID NO: 25531 - DNA, 91 bp, Homo sapiens
gaggcaggagaatcacttgaacctgggaggtggagatcacagtgagctgagatcgtgccactgcactccagcctgggtgagactcagtctc

SEQ ID NO: 25532 - DNA, 100 bp, Homo sapiens
ggcattgagttatttctaaaggaaaaccaagagaattgtgttcctttttatgatcaacttttcttttcttttttttttttggagactgtctcactctgtc

SEQ ID NO: 25533 - DNA, 93 bp, Homo sapiens; identical to SEQ ID NO: 25380

SEQ ID NO: 25534 - DNA, 93 bp, Homo sapiens; identical to SEQ ID NO: 25378

SEQ ID NO: 25535 - DNA, 81 bp, Homo sapiens
gtgttggtgaaatacatgtgtatatgtagttgtgtgtaaaggtatgtaggtacatgcacaaatatatttcccttttggcat

SEQ ID NO: 25536 - DNA, 119 bp, Homo sapiens
gctggatgtgatggcatgtgcctgtagttccagctactcgggaggctgaggtgggaggatggtttgagcctgggaagtcgaggctgcagtgagctatgatggcaccattacattccagc

SEQ ID NO: 25537 - DNA, 58 bp, Homo sapiens; identical to SEQ ID NO: 1936

SEQ ID NO: 25538 - DNA, 76 bp, Homo sapiens
ggaggctgaggtagaaggatcacttgaggccaggagtttgaggctgcagtgagctatgattgtgccactgcactcc

SEQ ID NO: 25539 - DNA, 59 bp, Homo sapiens
ccggcctggtgcagacgtgaatttattttgagacagtctcactctgtcacccaggctgg

SEQ ID NO: 25540 - DNA, 93 bp, Homo sapiens; identical to SEQ ID NO: 25369

SEQ ID NO: 25541 - DNA, 87 bp, Homo sapiens
tgaggcgacatgacagacatcataacccagcaaaagttattttttaaaattttttttttttgagatggagtctcactctgtcgccca

SEQ ID NO: 25542 - DNA, 118 bp, Homo sapiens
agcatgagccactgcatctggcctgtgtgacacaattctgtttttttgtctttttttttttttgggatggagtctcgctctgtcacccaggctggagtgcggtggtgcgatcttggct

SEQ ID NO: 25543 - DNA, 58 bp, Homo sapiens; identical to SEQ ID NO: 7309

SEQ ID NO: 25544 - DNA, 58 bp, Homo sapiens
catgagccactgtgcctgggccagtatctcacactttgactcaggtccaggcttcatg

SEQ ID NO: 25545 - DNA, 106 bp, Homo sapiens
aaaagaagcaaaaattagccaggcatggaggtacaacctgtagtcccagctacttgggaggctgaggtaggaggatctcttgagcctggaaggttttttttttttt

SEQ ID NO: 25546 - DNA, 58 bp, Homo sapiens
tgagacagggtctcactctgtcacccaggctggagtgcagtggcatgaccctgactca

SEQ ID NO: 25547 - DNA, 83 bp, Homo sapiens
atgtatatatatgtatatatgtatatatatgtatatatgtatatatgtatatatatgtatatatgtatatatgtatatatata

SEQ ID NO: 25548 - DNA, 67 bp, Homo sapiens
tgtgttatatatatatgtatatgtgtttatgtatatatatatatatgtatatgtgtatatgtacata

SEQ ID NO: 25549 - DNA, 58 bp, Homo sapiens
tgagacagagtctcactctgtcgcccaggctggagtgcagtggtgcgattttggctca

SEQ ID NO: 25550 - DNA, 56 bp, Homo sapiens
gagacagagtctcactctgtcgcccaggctggagtgcagtggtgcgattttggctc

SEQ ID NO: 25551 - DNA, 94 bp, Homo sapiens
gcgtgacagagtgaaactctgtctcaaaaaaacaaaaacctcctgatttttttttttttttttttttttgagatggagtctggctctgtcgccc

SEQ ID NO: 25552 - DNA, 84 bp, Homo sapiens
gtctctggggaggcagcgagtggcccactttcttctttgctttttttttttgagatggagtctcactcactctgtctcccaggc

SEQ ID NO: 25553 - DNA, 75 bp, Homo sapiens
gggcttaatggaacaaaaacatggcttcattatatttgattttcattcaaatggtgatctagttccattgtgtct

SEQ ID NO: 25554 - DNA, 74 bp, Homo sapiens
tgaaatatctttgtctccctgtctctgtcaaaagtgggaaaatgcaagatagaccaggagggccgtgtgtttca

SEQ ID NO: 25555 - DNA, 78 bp, Homo sapiens
ttatttattgtattattattggggttttttagagacaaggtctcactctgtcacccaggctggagtgcagtggcatga

SEQ ID NO: 25556 - DNA, 58 bp, Homo sapiens; identical to SEQ ID NO: 25546

SEQ ID NO: 25557 - DNA, 86 bp, Homo sapiens
ggtggattatctgaagtcagaagtttgagaccagcctggctaacatggttgaaaccctgtctctactaaaactacagaaattagcc

SEQ ID NO: 25558 - DNA, 102 bp, Homo sapiens
actctcagactgggtcgcctcattttactctaggagggagacttttttttttttttttttttttttgagacggagttttgctcttgtcgcccaggctggagt

SEQ ID NO: 25559 - DNA, 118 bp, Homo sapiens
tctctcaaatctctttttgtaatagtggttgatttcggtttttaatgcttattttgttttattgaattaaatagaaaagactgatatattgtttggcaaaatcctgggttttgtttga

SEQ ID NO: 25560 - DNA, 88 bp, Homo sapiens
tagtggatcccttagctgggaaaagggaagtagtcaagtacttttttttttttttttttttttttttccctgagacggagtctcgctg

SEQ ID NO: 25561 - DNA, 72 bp, Homo sapiens
ggctgggtgaggtggctcatgcctataatcctagcattttgagaggctgaggtaggaggatctcatgaagcc

SEQ ID NO: 25562 - DNA, 113 bp, Homo sapiens
caagacagcctgctcttctcactgtcgtaaggggcagtatcaatatttatgttttcaaggtttctaaccaagctaaataagaaagactcttgctctccagtgaagttcttggc

SEQ ID NO: 25563 - DNA, 113 bp, Homo sapiens
catgtcaggtcctggttgtccgaatcagaagcttttttttagattgtacttcattttttattttttattttttgtagagacagagtctggctatgttgtccaggctggttgtg

SEQ ID NO: 25564 - DNA, 66 bp, Homo sapiens
cagagtggcttgctgggaggagcatggattttttttttttcttttttgagacaggatctcactctg

SEQ ID NO: 25565 - DNA, 56 bp, Homo sapiens
tcagtcactgactcactcattggacaaccattcactgagtgctgttatgtgcctga

SEQ ID NO: 25566 - DNA, 118 bp, Homo sapiens
ggaaagggaaatatagaatcacatggggtcagcgggagagtgcaagcccggggccctggcctgtctgtcactctgtccctctgtggccctcagaggaaagcatgcatcgctggagtcc

SEQ ID NO: 25567 - DNA, 172 bp, Homo sapiens
gacacagtgagaccctgtctcaaaaaaagaaaagaaaaaaaaagcatggtttggtcttgctttgttttttttgtttttgtttttttgttttttgagctagagtctctctctgtcacccaggctggagtgcagtggtgcaatctcggctcactgcaacctccgcctcctgggt

SEQ ID NO: 25568 - DNA, 79 bp, Homo sapiens
gcccacacagtgcctgtctgagtccttctgtgcccaaatgtggagcaggctgcagagacttgaagcctggggttttgtg

SEQ ID NO: 25569 - DNA, 102 bp, Homo sapiens
gaaaatacacaggaggaaacctatgatttcctcttgagctatggattatttagaagtatgtggtttggttcacaagagtttgcagatcttcctgttattttc

SEQ ID NO: 25570 - DNA, 58 bp, Homo sapiens
tgagacagggtctcactctgtcacccaggctggagtgcagtggtgtgatcctggctca

SEQ ID NO: 25571 - DNA, 71 bp, Homo sapiens
ttgtttttgagatggagtctcactctgtcacccaggctggggtacaggggtgcgatctcagctcactgcaa

SEQ ID NO: 25572 - DNA, 83 bp, Homo sapiens
ctgggattacagatgtaagctgctacacccagctcttttctattttttattttttagagacagggtcttactctgacacccag

SEQ ID NO: 25573 - DNA, 74 bp, Homo sapiens
ggtgattaggtttgagctttgtaatttttcaattttttttttttttttttgaggcagagtcttactctgtcacc

SEQ ID NO: 25574 - DNA, 101 bp, Homo sapiens
tgaggtgggagaatagcttgaacttgggaggcacagattgcagtgagcagagactgcgccactgcacttcagcctgggtgacagagcaagactccatctca

SEQ ID NO: 25575 - DNA, 114 bp, Homo sapiens
tctcccaggcctgctgcctttctgggggctgcagcttctgaggcccggggtgggagcagtcagtccgtctgtctcaggcctgtgagcatggaggggccctggcctgctggaaga

SEQ ID NO: 25576 - DNA, 132 bp, Homo sapiens
ccagcctgggcaacatagtgataccccatctcttttttttttttttgagatggagtctcactctgtcacccaggctggagtgcagaggtgtgatcttggctcactgcaacctttgcctcccaggttcaagtg

SEQ ID NO: 25577 - DNA, 78 bp, Homo sapiens
cccagggtgctttctgctcattctgtctctgtaggtcctctagcaggtcagacagctgcagacacagagggaagcccc

SEQ ID NO: 25578 - DNA, 115 bp, Homo sapiens
ttccaccaacgatatatgagagttttcattcatccataacctctgcaacatttggtgttgtcattttctttttgtgtttttgagatggagtctctctctgtcacctaggctggag

SEQ ID NO: 25579 - DNA, 70 bp, Homo sapiens
tttcagggagccgagatcacaccactgctctccagcctgggcaatggagcaagactctctctctctcaaa

SEQ ID NO: 25580 - DNA, 95 bp, Homo sapiens; identical to SEQ ID NO: 68

SEQ ID NO: 25581 - DNA, 93 bp, Homo sapiens; identical to SEQ ID NO: 69

SEQ ID NO: 25582 - DNA, 72 bp, Homo sapiens
ggcacatagcagatggcccagcagtgccccaggatccactccagcctctgtctcagccacactgcctctgcc

SEQ ID NO: 25583 - DNA, 58 bp, Homo sapiens
tgacacaaggtctcactctgtcacccaggctggagtgcagtggtgcgatcttggctca

SEQ ID NO: 25584 - DNA, 64 bp, Homo sapiens
gtccttgagatggccacagggcaaggacctcaccctctgtggctgtgttttcaggcgttgggac

SEQ ID NO: 25585 - DNA, 114 bp, Homo sapiens
gaggccgaggccaggagtttgagagcagcctgggcaacatagcaagattctttgttttttttttgagacagagtctcgctctgtcgccaggctggagtgcaatggtacggtctc

SEQ ID NO: 25586 - DNA, 142 bp, Homo sapiens
tctgtatctgcaagatagtatatctatatctatagatatcgatatctatagatatatatacacatgtctatatatatagatatgtatacatatagatatagatatatagatatctatagatatagatatgtatacatatcta

SEQ ID NO: 25587 - DNA, 135 bp, Homo sapiens
gaggattaaatgagatatgtctcaaatttttgttgaaaactggacattttattttatcttattttacttatttttgagacaaggtctcactcactctgtcactcaggctagagtgcagtggtgcaatcttggctc

SEQ ID NO: 25588 - DNA, 81 bp, Homo sapiens
ttctggcccaaactccatccagattttgttgttctccagggggctatatcagaattttggcagagaaagaagggctatgaa

SEQ ID NO: 25589 - DNA, 115 bp, Homo sapiens
ttatatatatatgttacataatatatgtaacattatatatacctgttatataatatatatacatatataacaggtatatataatgttatataatatatataacattaatatataa

SEQ ID NO: 25590 - DNA, 115 bp, Homo sapiens
ttatatattaatgttatatatattatataacattatatatacctgttatatatgtatatatattatataacaggtatatataatgttacatatattatgtaacatatatatataa

SEQ ID NO: 25591 - DNA, 91 bp, Homo sapiens
tgcaaaacgatcttacagacagaagcgtggtctttttttttttttttttttttgagatggagtctcattctgtcacccgggctggagtgca

SEQ ID NO: 25592 - DNA, 111 bp, Homo sapiens
tctgtctcatcctctgggactcttgctgtctgaccctctgtctctattcctcgcctgctttttttttttttttttgagacagggtctcactcggtccagaggtgaagctga

SEQ ID NO: 25593 - DNA, 83 bp, Homo sapiens
cactatgggaggcagaggtaggtggatcacttgagcccaggagttcgagaccagcctggccaacatggtgaaaccctgtctct

SEQ ID NO: 25594 - DNA, 83 bp, Homo sapiens
accccatcctgggccacagagcaagactctatttttttttttttttttgagaccgagtctcactctgtcacccattctggagt

SEQ ID NO: 25595 - DNA, 84 bp, Homo sapiens
tgagacagagtctcactctgtctcgcccagactggagtgagtgcagtggcgtgatctcggctcactgcagcctctgcctcctgg

SEQ ID NO: 25596 - DNA, 122 bp, Homo sapiens
agtgccctagaaatggatatggggtaggagctggcacctgccaggcacccactgtgcgtgtggtcaagagggagggttctggctgggcgtggtagcttgcacctataatcccagcactttgg

SEQ ID NO: 25597 - DNA, 104 bp, Homo sapiens
tgcctcaacctcctgagtagctgggattacaggcgcccgtcaccatttttttttttttttgagacagagtctggctgtgtcatccaggctggagtgcagtggca

SEQ ID NO: 25598 - DNA, 58 bp, Homo sapiens; identical to SEQ ID NO: 1391

SEQ ID NO: 25599 - DNA, 56 bp, Homo sapiens; identical to SEQ ID NO: 1392

SEQ ID NO: 25600 - DNA, 69 bp, Homo sapiens
gccgggcacagagggacaccacatttttaaaaatttttttgaaacagggtctcactctgtcacccaggc

SEQ ID NO: 25601 - DNA, 110 bp, Homo sapiens
gtgtctcagtgctagatgtgtgagcaggaaaggggcaggatctgatttacatttttatttttaaattagttttttttttttttttgagacggagtctcgctctgttgccc

SEQ ID NO: 25602 - DNA, 61 bp, Homo sapiens
tggggatggggtggtttctttattcttttttttttgagacaaagtctcactctgtcgccca

SEQ ID NO: 25603 - DNA, 69 bp, Homo sapiens
gtatatatatatgatgtgtacatgtatgtgtgtctctgtgtatgtgtgtatgtatctgtgtgtgtgtgc

SEQ ID NO: 25604 - DNA, 104 bp, Homo sapiens
tcacaaaactctatgtggccacccctgtttgtgtgttgttgttgttgtttttgtttttttttagagacaggctctcactctgtcgccaggcttgagtactgtgg

SEQ ID NO: 25605 - DNA, 86 bp, Homo sapiens
ggggttcccgtggctcctggaaaagctacagactaggcatggccaggccctgcctgtgtctctctgtgccagccacgatgagcctc

SEQ ID NO: 25606 - DNA, 76 bp, Homo sapiens
agtcacactctgtctgtgaaggtgacagacaagcacgagggcaattatagtcttgtttgtgatgcgggctgtggct

SEQ ID NO: 25607 - DNA, 86 bp, Homo sapiens
gtgcatgtgtgcacacatgtgtctgtatgtgtggacatgcatgtgagtttgcatgcatgtgtgtgcatatgtgtgtatgcatgtgt

SEQ ID NO: 25608 - DNA, 83 bp, Homo sapiens
gcatcaatgtgtgtctgtgtgtcagagcatgcaaatgcgacgggtgtgcgtgtatgagacagaaaagaccacacacgtgatgc

SEQ ID NO: 25609 - DNA, 91 bp, Homo sapiens
aaaaaaaaaaaaaaaaaaatggagcatatgacatgggagcatattggtgtggctttttctttcgtttcttttttttttttttttttttttt

SEQ ID NO: 25610 - DNA, 68 bp, Homo sapiens
cctgaagacatctgcaaagatcctacttttctttcttttagagacagggtctcactgtgtctcccagg

SEQ ID NO: 25611 - DNA, 60 bp, Homo sapiens
taccatgggcatatatttgcatttctctttagggtgtgtgtgtgtgtgtgtgtgtgtgtg

SEQ ID NO: 25612 - DNA, 82 bp, Homo sapiens
tcccatcccagatcttctgggaactgtgagtgcaccagaggcagctccttgggcacataagtgactcactgtctgggaggga

SEQ ID NO: 25613 - DNA, 58 bp, Homo sapiens; identical to SEQ ID NO: 315

SEQ ID NO: 25614 - DNA, 99 bp, Homo sapiens
ggattgactccaattttgaaacaagttctaccgtgggtgaaatgctaccaaatagcctcacactacagagagacctttcatgaaagcaagagtcaatgt

SEQ ID NO: 25615 - DNA, 114 bp, Homo sapiens
cactgtgttatatatatatgtatatgtgtttatgtatatatatatatatatatatgtatatgtgtatatgtatatatacatatatatgtatatgtgtgtatatatatacacaca

SEQ ID NO: 25616 - DNA, 58 bp, Homo sapiens; identical to SEQ ID NO: 25549

SEQ ID NO: 25617 - DNA, 56 bp, Homo sapiens; identical to SEQ ID NO: 25550

SEQ ID NO: 25618 - DNA, 90 bp, Homo sapiens
tgggtctctggggaggcagcaagtggcccactttcttctttgctttttttttttgagatggagtctcactcactctgtctcccaggctgg

SEQ ID NO: 25619 - DNA, 73 bp, Homo sapiens
gttttcctcatagtagtgataagagaaaagtgaaatatctttgtctccctgtctctgtcaaaagtgggaaaac

SEQ ID NO: 25620 - DNA, 78 bp, Homo sapiens; identical to SEQ ID NO: 25555

SEQ ID NO: 25621 - DNA, 73 bp, Homo sapiens
gttgttttgttttgtgttttgttttgaggcagggtctcgctctgtctctcaggctggagtgcagtggggcgat

SEQ ID NO: 25622 - DNA, 88 bp, Homo sapiens
acagaatgagaccctgtctcaaaaaaaaaaaaaaaaaaaaaggagcttaaattgattttttttttcttgagatggcgtctcactctgt

SEQ ID NO: 25623 - DNA, 111 bp, Homo sapiens
tgtctgccagtctcctctctgggactcagtttcttctttctctctttctttttttttttttttttttgagatagagtctcgctgttgtccaggctggagtgcaatggcgca

SEQ ID NO: 25624 - DNA, 85 bp, Homo sapiens
ccatgtgtgtacagccacagcttctagtactggggacacacttggcatccccagggaactagagtgtgagaagagagacaggagg

SEQ ID NO: 25625 - DNA, 106 bp, Homo sapiens
ctccgtgggtggcactttttacgcaggcagcttctctgttttttttgttttttgtaacctgcaagcttagaaatctcaggttgtgctcctggggctgctcctgggg

SEQ ID NO: 25626 - DNA, 88 bp, Homo sapiens; identical to SEQ ID NO: 25622

SEQ ID NO: 25627 - DNA, 73 bp, Homo sapiens; identical to SEQ ID NO: 25621

SEQ ID NO: 25628 - DNA, 78 bp, Homo sapiens; identical to SEQ ID NO: 25555

SEQ ID NO: 25629 - DNA, 73 bp, Homo sapiens; identical to SEQ ID NO: 25619

SEQ ID NO: 25630 - DNA, 84 bp, Homo sapiens; identical to SEQ ID NO: 25552

SEQ ID NO: 25631 - DNA, 94 bp, Homo sapiens; identical to SEQ ID NO: 25551

SEQ ID NO: 25632 - DNA, 58 bp, Homo sapiens; identical to SEQ ID NO: 25549

SEQ ID NO: 25633 - DNA, 56 bp, Homo sapiens; identical to SEQ ID NO: 25550

SEQ ID NO: 25634 - DNA, 67 bp, Homo sapiens; identical to SEQ ID NO: 25548

SEQ ID NO: 25635 - DNA, 113 bp, Homo sapiens
caaggatcgcctgggttgtagcgtgtgtcagaattgtgttgctcttttttttttttttttgagatggagtctcgctctgtcagccacgctggagtgctgtggcacgatctctg

SEQ ID NO: 25636 - DNA, 128 bp, Homo sapiens
tctaacatagtgcatgaataaattagcctatctagcctagtttgagaagtcacaaaactgagaggagaggtaatgaaggcctgcaccattgtcagaactgtgacaattgttgcgggaggtcagggacc

SEQ ID NO: 25637 - DNA, 106 bp, Homo sapiens; identical to SEQ ID NO: 25625

SEQ ID NO: 25638 - DNA, 85 bp, Homo sapiens; identical to SEQ ID NO: 25624

SEQ ID NO: 25639 - DNA, 58 bp, Homo sapiens; identical to SEQ ID NO: 25546

SEQ ID NO: 25640 - DNA, 106 bp, Homo sapiens; identical to SEQ ID NO: 25545

SEQ ID NO: 25641 - DNA, 58 bp, Homo sapiens; identical to SEQ ID NO: 25544

SEQ ID NO: 25642 - DNA, 58 bp, Homo sapiens; identical to SEQ ID NO: 7309

SEQ ID NO: 25643 - DNA, 105 bp, Homo sapiens
atatatatatacatatatatgtgtgtatatatatacatatatatgtgtgtatatatatatatacacatatatgtgtgtgtgtatatatgtatgtgtatatatata

SEQ ID NO: 25644 - DNA, 152 bp, Homo sapiens
ctatcactcagaaaaactagcgagttcagattttggtctctcttttttttttttataatttaaaaacatttttacagacagggtctcactctctcacccaggctagagtgcagtggtgcaatcatggctcactgtagcctccaattcctggg

SEQ ID NO: 25645 - DNA, 87 bp, Homo sapiens
agacttaggcctgtctctgtctctgtgacatcactgctgcttcccctgaattcaaggacagtgaggtctcagacagcagccgtgtct

SEQ ID NO: 25646 - DNA, 90 bp, Homo sapiens
agactctgtctccaaaaaaaaaaaaaaaaaaaaaaaaaaaaaaaagactttttttttgggttttttttgtttttttttgagacgaagtct

SEQ ID NO: 25647 - DNA, 113 bp, Homo sapiens
gtggggctgggggaggttggctggaggaggagaaaggggcgggcatctgggagggtctcagccactctcagaggcttattcatctcatcctcctttccctccccccttcttgt

SEQ ID NO: 25648 - DNA, 97 bp, Homo sapiens
ggcctgatgtacccctgaagttttctgttagcgaggctaattcaagaagtgtgaaaaaagtaacactggcagctttcaaggaactaaaatcggagtt

SEQ ID NO: 25649 - DNA, 74 bp, Homo sapiens
gccactaatgtctctctatctcagtgtccacattggtgaagctcgctgggagcatcagagaggacagcacaggc

SEQ ID NO: 25650 - DNA, 117 bp, Homo sapiens
acacatatatgtgtatatatatacacatatatgtgtatatatatacacatatatgtgtatatatatacacatatatgtgtatatatatatacacatatatgtgtatatatatatata

SEQ ID NO: 25651 - DNA, 103 bp, Homo sapiens
tgtgtatgtatacatatacatacatatatacatacatatatgtgtgtatatatgtatgtatacatatatgtgtgtatatagtatgtgtatgtatacacacaca

SEQ ID NO: 25652 - DNA, 83 bp, Homo sapiens
tatacatatatatatgtatgtatacgtatacatacacatacatatatatgtatgtgtatatatgtatgtatacgtatacatac

SEQ ID NO: 25653 - DNA, 79 bp, Homo sapiens
gtagtcatttttttttttttgagacagtctcgctctgtcgctcaggctggagtgcagtggtgtgatctcagcttactgc

SEQ ID NO: 25654 - DNA, 95 bp, Homo sapiens; identical to SEQ ID NO: 68

SEQ ID NO: 25655 - DNA, 93 bp, Homo sapiens; identical to SEQ ID NO: 69

SEQ ID NO: 25656 - DNA, 110 bp, Homo sapiens
ctggtctcaaactcctggcctcaagtgatcctcctgtctcagcttcccaaagttctttcttttttcttttctttgagacggagtctcactctgtcgccaggcaatcccag

SEQ ID NO: 25657 - DNA, 104 bp, Homo sapiens
tgcactccagcctgggtgacagagcaagactgcctcaaaaaaaaaaaaaccttttttttttttttagaggtagagtctgactctgtcgcccaggctggagcaca

SEQ ID NO: 25658 - DNA, 110 bp, Homo sapiens
agcctgggtaacatagggagatcctttctctacaaaataataataataataataataataataataaatttatttattttgagacggagtcttgctctgtctcccaggct

SEQ ID NO: 25659 - DNA, 58 bp, Homo sapiens; identical to SEQ ID NO: 884

SEQ ID NO: 25660 - DNA, 56 bp, Homo sapiens; identical to SEQ ID NO: 885

SEQ ID NO: 25661 - DNA, 88 bp, Homo sapiens
ggagtcttgagcaagtcatttaactctctaaacctcagttttcttttcttttttttctttttggagattgagtcttgctctgtcaccc

SEQ ID NO: 25662 - DNA, 104 bp, Homo sapiens
acaaaagtttatatatatgtatatatacacacacacatatatatgtgtgtgtatatatatgtatgtgtgtgtctatatatatatatatatatgtatgtatgtat

SEQ ID NO: 25663 - DNA, 58 bp, Homo sapiens
tgagaccgactctcgctctgtcacccaggctggagtgcagtggtgcaatctcggctca

SEQ ID NO: 25664 - DNA, 75 bp, Homo sapiens
ctgtgggtgggagggtggggctgtgatatatcttttttttttttttaatcgagagagtctctctctgtcccccag

SEQ ID NO: 25665 - DNA, 95 bp, Homo sapiens
gcatagtcttaagcaagtcactctgcctctctgagcctcagtttccccatctgtagttggttgtaacagtgaaaagcttgcttatgtgaaaatgc

SEQ ID NO: 25666 - DNA, 63 bp, Homo sapiens
ctgtgtccctgcctgtctgtctgtccgtcctctgcgccggtttcgggctccagcagggactgg

SEQ ID NO: 25667 - DNA, 75 bp, Homo sapiens
ttgttttgttttgagatggagtctcactctgtcacccaggctggagtgcagtggcgcaatctcagctcaccacaa

SEQ ID NO: 25668 - DNA, 101 bp, Homo sapiens
ggctgggtgctttctgttttggaaggttactaattattgattcaatttattattgttattttatttatttatttttttttgagacggagtctcgctctgtc

SEQ ID NO: 25669 - DNA, 57 bp, Homo sapiens
tgagatggagtctcactctgtcacccaggctggagtgcagtggtgtgactcagctca

SEQ ID NO: 25670 - DNA, 58 bp, Homo sapiens; identical to SEQ ID NO: 1868

SEQ ID NO: 25671 - DNA, 62 bp, Homo sapiens
tatgcgtatatatgtatatatgtgtatatatgcgtatatatgtatatatgtgtatacgtata

SEQ ID NO: 25672 - DNA, 75 bp, Homo sapiens
gttccaggatgtgaatctgcaggtgcatgtgtgtgcatgtacgcatgtgtgtgagtctgtgtatatgtctgtgac

SEQ ID NO: 25673 - DNA, 68 bp, Homo sapiens
ttgttttgagacagggtcactctgtcactcaggctggagtgcagagtcctgatcatgactcactgcag

SEQ ID NO: 25674 - DNA, 56 bp, Homo sapiens
gaggcagagtctcactctgtcacccaggctggagtgcagtgttgtgatctcggctc

SEQ ID NO: 25675 - DNA, 116 bp, Homo sapiens
gctgataggtcaaagcagaaatttaaaaaaatgtatctggacggtgacagaagtatgtatccagtcacgtcactgttcaactacccctagttaagtccttttaccgctccgccagc

SEQ ID NO: 25676 - DNA, 88 bp, Homo sapiens
atatatatacatatgtgtgtgtatatatatatacgtatatgtgtgtgtatatatatacgtatatatatgtgtgtatatatatatctat

SEQ ID NO: 25677 - DNA, 96 bp, Homo sapiens
cctggccaacatggcaaaaccctgtctctacggccctcattctttttttttttttttttctttagtagagacaggtgtttcaccatgttggccagg

SEQ ID NO: 25678 - DNA, 58 bp, Homo sapiens; identical to SEQ ID NO: 2263

SEQ ID NO: 25679 - DNA, 75 bp, Homo sapiens
ctctggctggtgtcaccctcccagagctctttttttttttggagaaggagtctcactctgtcacccaggctggag

SEQ ID NO: 25680 - DNA, 94 bp, Homo sapiens
gctgagaaccctcccagaagaatgtgcgcatgcctgcagtgtggcttgtaacactggatctatcacacacatactcactctgaaggcttttagc

SEQ ID NO: 25681 - DNA, 58 bp, Homo sapiens; identical to SEQ ID NO: 2758

SEQ ID NO: 25682 - DNA, 114 bp, Homo sapiens
gcctcctgagtcactgggactacagatgtgtgccaccacacttggctaatttttaaattttttgtagagacaggtgtcgcaccatgttgcccagactagtcttgaactcctggc

SEQ ID NO: 25683 - DNA, 63 bp, Homo sapiens
agctgagacacggagaggctgtgtgatttttggctgatcacacagcctctctgtgtctctgct

SEQ ID NO: 25684 - DNA, 100 bp, Homo sapiens
ctacaggcacatgccaccgtgcatggctcattgagcacttcttaacttttttttttttgagatggagtctggctctgtcacccacgctggagtgtagtgg

SEQ ID NO: 25685 - DNA, 56 bp, Homo sapiens; identical to SEQ ID NO: 324

SEQ ID NO: 25686 - DNA, 108 bp, Homo sapiens
tatatatatgtatgtatacatatgtatgtgtatatatatgtatgtgtgtatatatgtgtgtatatatatgtatgtgtgtatatatgtatgtatatgtatatatatata

SEQ ID NO: 25687 - DNA, 135 bp, Homo sapiens
gtcacatccttggcctgagcagggtttgttggcgtcacatgccgaaggagtcttctaatgtctctccctctctgcgtgtctgctctcacacccgtgcaggcatgacgagtgttctgatgtcagccattggactcc

SEQ ID NO: 25688 - DNA, 59 bp, Homo sapiens
gccagcaggtcctgagtgtgtgcatgcatgcgtgtgtgcgcacttgtgtgtgtgtgtgc

SEQ ID NO: 25689 - DNA, 123 bp, Homo sapiens
gctcagcctctcaaagtgtctgccagcttttatgtgtctgaaaatatgtttatttaactttcttaaaatatattttcattgggcataaaattctaggtttgcagtttttgccttcagcacttt

SEQ ID NO: 25690 - DNA, 58 bp, Homo sapiens; identical to SEQ ID NO: 7309

SEQ ID NO: 25691 - DNA, 77 bp, Homo sapiens
gagcatgtagcttgttaagttgcaaagatgcaaatgaaagctgtgtttctcattgcaattcaagacctgtgctgctc

SEQ ID NO: 25692 - DNA, 117 bp, Homo sapiens
gcttcctgtgtagctgggaccacagttgtgtgccaccacgcccgactaatttttatattttttgtagagatgcggttttgccactttcgccagtctgaagaccatagctttcttagc

SEQ ID NO: 25693 - DNA, 77 bp, Homo sapiens
gtggcaaccctgagtccagcaagtctattggcaccattttcccaatagcacgtgctcactttgtgtctctgtgtcac

SEQ ID NO: 25694 - DNA, 112 bp, Homo sapiens
cttatgtagctttttgatattgtctcaatgtcaatatgtgatcatttttatagtaatctgtgttaattgtcatttatgaaatattggtccacaatggattgaaaagaataag

SEQ ID NO: 25695 - DNA, 99 bp, Homo sapiens
ttagccaaatgtggtggtgcctgtgtatagtctctctccctctctttttttttttttctaactttttgtgacatggtctggctctgtcacccaggctga

SEQ ID NO: 25696 - DNA, 78 bp, Homo sapiens
tatgtatataggtgtatgtgtatatatctatgtatatgtatgtgtatgtatgtatgtatatgtgcatttatgtgtgta

SEQ ID NO: 25697 - DNA, 113 bp, Homo sapiens; identical to SEQ ID NO: 4096

SEQ ID NO: 25698 - DNA, 58 bp, Homo sapiens; identical to SEQ ID NO: 13889

SEQ ID NO: 25699 - DNA, 81 bp, Homo sapiens
tttgtaagcactattgggacagtattatattaatatgtttaattcttttaaaacatagatgcttaacccaatgcttgcaaa

SEQ ID NO: 25700 - DNA, 135 bp, Homo sapiens
gtcacatccttggcctgagcagggtttgttggcgtcacatgccgaaggagtcttctaatgtctctccctctctgcgtgtctgctctcacgcccgtgcaggcatgacgagtgttctgatgtcagccattggactcc

SEQ ID NO: 25701 - DNA, 103 bp, Homo sapiens
gccactgcatctggcctgtgtgacacaattctgttttttgtcttttttttttttgggggggggatggagtctcgctctgtcacccaggctggagtgcggtggc

SEQ ID NO: 25702 - DNA, 117 bp, Homo sapiens; identical to SEQ ID NO: 23050

SEQ ID NO: 25703 - DNA, 113 bp, Homo sapiens
tgtgtttgaattctggctccaccattcactaagctctataactggacaaattacttaacctctgtgtgtctcagttttttggaaaattgggtaatagtaatagaacaaactca

SEQ ID NO: 25704 - DNA, 95 bp, Homo sapiens; identical to SEQ ID NO: 68

SEQ ID NO: 25705 - DNA, 93 bp, Homo sapiens; identical to SEQ ID NO: 69

SEQ ID NO: 25706 - DNA, 86 bp, Homo sapiens
gcatgacatataacatacaatatataaatatgtaataggttatatattatataaattcatgtgtgtatatgtatgtgtgtgtgtgt

SEQ ID NO: 25707 - DNA, 81 bp, Homo sapiens; identical to SEQ ID NO: 7982

SEQ ID NO: 25708 - DNA, 71 bp, Homo sapiens
ctgtttttgagacagggtctcactctgtcacccaggctggagtgcatggttgcgatcctggctcacggcag

SEQ ID NO: 25709 - DNA, 78 bp, Homo sapiens
aacttgggtggctgttttaatattcttcattggtgctcttttttttttgagacagtgtctggctctgtcacccaggtt

SEQ ID NO: 25710 - DNA, 57 bp, Homo sapiens
tgagacagagtctcgctctgtcacccaggctggggcgcagtgcgtgatcctggctca

SEQ ID NO: 25711 - DNA, 75 bp, Homo sapiens
gggtctcactctgtcactcaggctggagtgcagtggtgtgatcatggctcactgcagccttgacctctggggccc

SEQ ID NO: 25712 - DNA, 79 bp, Homo sapiens
ctaatctgggcaatatagtgagactttttttttttttttttttttttgatttggagtctcactctgtcgcccaggctgg

SEQ ID NO: 25713 - DNA, 133 bp, Homo sapiens
gccacattacctttcctataaaacactccatcaggaaggatgcctcataatctgtctctctgccactcaattatgaattcttcactatatgcaagtgcttctagaagtggttggttggtttgttttcagacag

SEQ ID NO: 25714 - DNA, 82 bp, Homo sapiens
gaaacaggagacaggatgggtttggcctgtaggtcatagtttgctggctcctatgaattttgtgttttttgttttttgtttt

SEQ ID NO: 25715 - DNA, 74 bp, Homo sapiens
tatgtgtgggctaaacacatactttatatatgtttaaaaagtgtgtgtttagcccatgttcatttttccacata

SEQ ID NO: 25716 - DNA, 99 bp, Homo sapiens
tcactcccagtctggcacactctctctggctctgactctatacacgtgtgtatctgtggtactttgtgtgtgtggtctgctttgtgcatttgtatgtgg

SEQ ID NO: 25717 - DNA, 75 bp, Homo sapiens
gtgtgtgccacaatgactggctgtttttattattattattatttagagatgggagtcttgctgtgtggctcacat

SEQ ID NO: 25718 - DNA, 68 bp, Homo sapiens
gggggactgctgtgtacttactatattgttttatatagactttagtgtacttatctgtatgtgccccc

SEQ ID NO: 25719 - DNA, 76 bp, Homo sapiens
gtttataaagtgtgaatatgtataggtatgtgtttgtatgtgatacatacatacatatataaaacattatatagat

SEQ ID NO: 25720 - DNA, 91 bp, Homo sapiens
agtttaggattatctatttaaatatttgacaaaattcatctgtaaaaccatacgggtatggaggatttttgttggtggcatattttaaact

SEQ ID NO: 25721 - DNA, 93 bp, Homo sapiens
ggcggctgcaccgtcttacacccaccagcgctgtgggaggggccagcttcccccatcctcaccggcactgtctgtctgtaaatcctagcctcc

SEQ ID NO: 25722 - DNA, 58 bp, Homo sapiens
tgagtcagggtctcactctgtcacccaggctggagtgcagtgacgacatgatggctta

SEQ ID NO: 25723 - DNA, 66 bp, Homo sapiens
tgccttggagctttggatgtagagagattgggacatggtttcactgtatttgatcactgaaaggca

SEQ ID NO: 25724 - DNA, 138 bp, Homo sapiens
atatgtgtgtatatatgtatatatgtgtacatatgtatatatgtgtatatatgtatatatatgtgtgtatatatgtgtatatatatgtgtatatatgtgtatatatatatgtgtgtgtgtgtgtatatatatatatat

SEQ ID NO: 25725 - DNA, 92 bp, Homo sapiens
tccagtcatgttgaaagggtattataaggggatatttttcccatttggcctgggataaaatatttctttttgatgtccagtttccatcagga

SEQ ID NO: 25726 - DNA, 73 bp, Homo sapiens
gcgcgtccatgcctccctctctgtgaggctctggggcttctccagcctgattctgcagggtgctatctcgtgc

SEQ ID NO: 25727 - DNA, 62 bp, Homo sapiens
atgtatgcagagctacatgtgtgtatgtgtcatgtgtatatatatgttagctttgtatatat

SEQ ID NO: 25728 - DNA, 76 bp, Homo sapiens
tggcgggaggtagcagtttgaaatgaaatggatgcatccatccttttttcatccctctcactctctctccttgtta

SEQ ID NO: 25729 - DNA, 72 bp, Homo sapiens
ctcttcctagtgtctgagtatcactgagtctgaccatttcaaggtggcctcagagtgtccagacaggctgag

SEQ ID NO: 25730 - DNA, 112 bp, Homo sapiens
tttttgttttgtttttgtttgggttttgtagtttttttctttcttttttttttccttaaaattaagaaagagaactgaattccatgactgggttaactaattgtaatagagg

SEQ ID NO: 25731 - DNA, 109 bp, Homo sapiens
acacatatgtatacatataaatataaatttatatatttttatatatttacatttatacattatataaatatataagtacatatttgtatgtacacacatatatatgtgt

SEQ ID NO: 25732 - DNA, 91 bp, Homo sapiens
ttatatgtatacatatgtgtgtatatatacaaatatatatgtaaactaatatataaaaataagtatatatatgtagatatagtacatataa

SEQ ID NO: 25733 - DNA, 75 bp, Homo sapiens
tgcacagaacataatgacttcagtatttccaaccctattgtgagagaaggaagtatgtttttatgtttagtagca

SEQ ID NO: 25734 - DNA, 91 bp, Homo sapiens
gtgcaggaactgaaagcgtttaattgggagagaataaatgtatgtatttgtgcatttagttcagtccttataaattctatggttctggtac

SEQ ID NO: 25735 - DNA, 74 bp, Homo sapiens
atatgtatatatatagagagacacatagatagaaaaccatatatatatatgtatgtgtctatgtatgtacatat

SEQ ID NO: 25736 - DNA, 90 bp, Homo sapiens
tgacatctcttggaagtcgttcctttatcttatgcctcacagaaccatgtgagcaaaggcatggagttgggaaagctgagagcgtgctca

SEQ ID NO: 25737 - DNA, 68 bp, Homo sapiens
ggatatatatatgcatatgtatgtatatatatatatatatatatatatatatatatatatatatacac

SEQ ID NO: 25738 - DNA, 234 bp, Homo sapiens
tatatatatatatttatatatatatttatatatttatatatataaatatatatatttatataaatatatatatttatatatatttatatttatatatatttatatatatatatttatatttatatatatttatatatatatttatatatatatatataaaagttccagggtacgtgtgtgtgtatatatatagcctatatatatatgtgtatgtgtgtatatatatatctctct

SEQ ID NO: 25739 - DNA, 113 bp, Homo sapiens
ttgctgtcatttgcccgtttgaccagggggttatttggatattttgttgttgagttttgagttctttatttttctagataaaagtcctttgtcagatatgtggtgatatgcaa

SEQ ID NO: 25740 - DNA, 107 bp, Homo sapiens
aggtcaagactctgtggtcccttcttctaatgtgtgtttctttttttcttttaaaagccttgcactatttcagacatttaatctaggaccacatttttttttgtctt

SEQ ID NO: 25741 - DNA, 98 bp, Homo sapiens
tttgctgctgttgttgttttgaatcagggtctcactctgtcacccaggctggagtgtagtggcatgatcttggctcaatgcaatctctgccttgcggg

SEQ ID NO: 25742 - DNA, 58 bp, Homo sapiens; identical to SEQ ID NO: 605

SEQ ID NO: 25743 - DNA, 72 bp, Homo sapiens
gcggtgatatgttaatacgtctgcagcactcagaggcctgacagagagcagacacgggacagtgacagctgc

SEQ ID NO: 25744 - DNA, 94 bp, Homo sapiens
gaatggaaagtttttaaagtcgatcctagaagaggtagaacatactttcctttttgtagttttatttttctttattaacttttattttaagttc

SEQ ID NO: 25745 - DNA, 81 bp, Homo sapiens
tatatatacatacacaaaaatatatgtgtatatatacatatgcatataacatgtgtgtgtatatatatatgtgtgttttag

SEQ ID NO: 25746 - DNA, 114 bp, Homo sapiens
cactggaaatctttgaatttttaattgtagggattttaactctaaaaatatttggccactaaatgtatatttttaatttctctgctttcctatagaaaattgagattaattgtg

SEQ ID NO: 25747 - DNA, 93 bp, Homo sapiens
gataatctgtttttttactatgataatctatgataaattgcttaaactctgtgagctcaaatttatttttatttttagtagagacagggtctc

SEQ ID NO: 25748 - DNA, 95 bp, Homo sapiens; identical to SEQ ID NO: 68

SEQ ID NO: 25749 - DNA, 93 bp, Homo sapiens; identical to SEQ ID NO: 69

SEQ ID NO: 25750 - DNA, 93 bp, Homo sapiens
tgactccagtttcaaaagaagttctactgtaggtaaaatgctatgaaacagcatgacttgctacagagaaatctgtcaggaaagaaagagtca

SEQ ID NO: 25751 - DNA, 153 bp, Homo sapiens
tatgtatgtatgtatgtgtgtgtatgtatatatatacagtgtgtatgtatatatatatacacacaacgtatctatctataaccatatatatataaccatatatatatggttatagatagatacgttgtgtgtgtatatatacatatatataca

SEQ ID NO: 25752 - DNA, 117 bp, Homo sapiens
tgttttttctaaaaattaatgctgtaaataggaaacatttggaaactttttttgcttttcatttctaaatacttttctgtttttcttcattaatgtttaaattttagagagcaaaca

SEQ ID NO: 25753 - DNA, 115 bp, Homo sapiens
gtataataaagaggaaatgcatcaaattcagcaaaaataatactttgcatttgtgagtattgcaatgtaaataagttaaaaggctatttgtattgcattttatagtattttatac

SEQ ID NO: 25754 - DNA, 96 bp, Homo sapiens
tacatactgcaaaattccacttaagtgaatttctagtactgaaaaaataatttttagtgttataaattagattaagtgttgtttggggttgaagta

SEQ ID NO: 25755 - DNA, 101 bp, Homo sapiens
cttagggagaaggctatagctaatcaatagtacttaagctactcaagaggacagataacagagagagcttaacatatttgtagaaagagaatctctacaag

SEQ ID NO: 25756 - DNA, 103 bp, Homo sapiens
gttgttaattgtcattatcaagtaatatgtactgtactgtaattgtgtgtggtatacttttataggattgacagtgcggtacatgagtaatgcattgtgctac

SEQ ID NO: 25757 - DNA, 86 bp, Homo sapiens
gtgatagtgagtgagttgtcatgagatctgatgatttaaaagtgtggcacttcccctgctctctctctagctctcactcctgccac

SEQ ID NO: 25758 - DNA, 107 bp, Homo sapiens
acagaaacatgacagaaacagcatttggaattgtggaattctatgaaatatttttttctttttacttcctatattttccaaatgctctgctgtgaacatgtgttggt

SEQ ID NO: 25759 - DNA, 113 bp, Homo sapiens
gtattgatgcttacatattatgagattatattaaatatgatacacacttactataaatgtcaatttgtaaatgtgaggtatataatgatgtttttcatacgtgttttgcttac

SEQ ID NO: 25760 - DNA, 85 bp, Homo sapiens
tattctgtttctaattaaaggcttatggctcaggcaagagcttcactgggtctgccttctgtcagtgtcacaaggagatagtgta

SEQ ID NO: 25761 - DNA, 102 bp, Homo sapiens
tttagtgacatgtctgtcaaaagcaatggactaaattgctcagcagttaatttatattaattttgagaaatgcatttcagtttttgattatgttaataagac

SEQ ID NO: 25762 - DNA, 113 bp, Homo sapiens
agaaataagcctgtctctttggtgctttgccaactacagctcttctgactgactcagtcattcattagctttagtctagtcttgctgtgttcagagggtcagtctgtgcttct

SEQ ID NO: 25763 - DNA, 84 bp, Homo sapiens
gcatgcgccaccgcgcccggcccagtatatccttttttttaaagcttgaatagtataccagtgtgtgtgtgtgtgtgtgtgtgt

SEQ ID NO: 25764 - DNA, 82 bp, Homo sapiens
ggagggcttttgcacaggaattttgtctggttcagggtgtcagagccttagaggggccaggaggatgtccgtgcagctatct

SEQ ID NO: 25765 - DNA, 85 bp, Homo sapiens
acagggactcactctgtcactcaggctggagtgcagcggtacgattttggctcactgcagcctgggtgacagagtgagttcctgt

SEQ ID NO: 25766 - DNA, 113 bp, Homo sapiens
gtgattttaatgacaaggaagttcactatcagattgggacttagaattttttttttaacctagtataccttagattctgattttggttttgttcaccttgttttaaagattat

SEQ ID NO: 25767 - DNA, 117 bp, Homo sapiens
gtctacagttccaggcagtaatatggctttacaataatttattttaatttctaatttgtttaaattagaaattgagagaaattatttcaatgtctttttgttcttggtaaagtgaac

SEQ ID NO: 25768 - DNA, 117 bp, Homo sapiens
tgaatacattatatattcataattatattcatattcatattatataatatgaatatataatatattcatatataatatgaatatatatatgatatgaaatgtatctttatgttgtca

SEQ ID NO: 25769 - DNA, 110 bp, Homo sapiens
tatgccacactcactctaaatgtcagcaaatgatgtcctcttttattgtatttatttattttttttgagatgggatctcactgtcacccaggctggagtgcagtggcatg

SEQ ID NO: 25770 - DNA, 100 bp, Homo sapiens
ctttatactcattttgttcataaggacaatatctaaaaatatcttttattattattttttgtcttttaactttatgttgtggacatcttagagagtagag

SEQ ID NO: 25771 - DNA, 97 bp, Homo sapiens
agatacacttacaatgcaaattggaatgtttccccgtaagactttttttttttttttttttgcatggagatcacagttaagcaagttggagtgtgct

SEQ ID NO: 25772 - DNA, 94 bp, Homo sapiens
tgtatatgggaatgtatgtatatatatttgtgtgtgcatatgtatgtatatacgtatgtacatatatgtatatacacacatacacacatataca

SEQ ID NO: 25773 - DNA, 115 bp, Homo sapiens
ctgggtaatcaggggatctgccattgagtttggtagcacaaatttttgtatttttccttaagggatgatgaaagatcagtggactcctaactatctgcagtctgtggagtctcag

SEQ ID NO: 25774 - DNA, 93 bp, Homo sapiens
ctggtagtgtttagcattatattccagagttttaaatagtgcctgatacctaataggtgctcaaattttttttatttgatgctgaataaacag

SEQ ID NO: 25775 - DNA, 236 bp, Homo sapiens
tatgtacgtatatgtgtatatatgtgtatatatgtgtatatatacgtatacgtgtatatatgtgtatatacgtatacgtgtatatatgtgtatatacgtatatatacgtatatgtgtatatatgtgtatttatacgtatatgtgtattatgtgtatatatacgtatatgtgtatatatgtgtatatatacgtatatgtgtatatgtgtatatatacttatatatgtgtatatgtgt

SEQ ID NO: 25776 - DNA, 76 bp, Homo sapiens
tatatgtgtgtatatatgtatatatgtatgtatatatgtatatatacatacatatatgtatatatacacacatata

SEQ ID NO: 25777 - DNA, 113 bp, Homo sapiens
atacagcttatcatatatatcatatatatgtgtatatatacatatatatgtgtatatatacatatatgtatatatgtgtgtatatatacatatatatgtatatatgtgtgtat

SEQ ID NO: 25778 - DNA, 104 bp, Homo sapiens
tgtgtgtgtgtgtgtgtgtgtatatataaacttgtgtgtgtgtatatatatataacttgtatataacatatgtaacttatataacatacacacacacacacaca

SEQ ID NO: 25779 - DNA, 79 bp, Homo sapiens
cccaggagatgctcactgcagagactgagttcctcaccaaggcaccaggctgtttcttacgctaaaggcatcctaaggg

SEQ ID NO: 25780 - DNA, 64 bp, Homo sapiens
aagtgcctcagctgagcatattctcatcctccatggggacaggagagtgtggacactggcactt

SEQ ID NO: 25781 - DNA, 100 bp, Homo sapiens
attcactatagtacaagtacttgttctgttcaaagatgtattctgagtctctaactcagtatctggcacatagtgctaagtatctgttaaatgaatgaat

SEQ ID NO: 25782 - DNA, 105 bp, Homo sapiens
agcaaaaatgaatagttttgtctagctctagtttattttagatctttatttttctaataattactaaaagggaaattagagggagaagaattgagtagaattgct

SEQ ID NO: 25783 - DNA, 78 bp, Homo sapiens
cagtgcctggccttagtatttttttttctaaatcactgagctcttctgtagagaagtgtcgatactggagaaggactg

SEQ ID NO: 25784 - DNA, 78 bp, Homo sapiens
tctctgttagcttatctgtgtatctcactcagtctttataaagaccgatcagagttaccctgtcacgctgacatgagg

SEQ ID NO: 25785 - DNA, 59 bp, Homo sapiens
tggagacggaatctctctctgtcactcaggctggagtgcagtggtgtgatctgggttca

SEQ ID NO: 25786 - DNA, 140 bp, Homo sapiens
ttatatacgtgtgtgtgtatatatacatatatgtatgtgtgtgtatatatgtatatatgtgtataaataggtacatatatatgtttatatatgtgtacacacattatacatatatatatacgcacacatatatatatata

SEQ ID NO: 25787 - DNA, 87 bp, Homo sapiens
atgaaagtgtatatatatatatgtgtgcgtatatatatatgtataatgtgtgtacacatatataaacatatatatgtacctatttat

SEQ ID NO: 25788 - DNA, 57 bp, Homo sapiens
tgagacagagtctcactctgtcgcccaggctggagtgcagtggtgtgattcggctca

SEQ ID NO: 25789 - DNA, 66 bp, Homo sapiens
ttgagcctatgtgtgtctctgtctgtgagatgggtctcctgaatacagcacactgatgggtcttga

SEQ ID NO: 25790 - DNA, 91 bp, Homo sapiens
ctgtttccttcataaattacgcagtctcaggtagttctttacagcagtgggagaacagactgagaacaccagtatctaggggaattatcag

SEQ ID NO: 25791 - DNA, 62 bp, Homo sapiens
tcattctcgctctctttctggcatcagacttcacgtctgaaaagagagaagacactgaatgg

SEQ ID NO: 25792 - DNA, 67 bp, Homo sapiens
gagacggaggctcgctctgtcgcacaggctggagtacagtggtgcgatctcagctgactccaagctc

SEQ ID NO: 25793 - DNA, 108 bp, Homo sapiens
tcttgccttttatagtaaagaaggtaccaacagaagtgagtttgtagatcccatgagaaaaagtgagctaccactgatctaatggtatctgttttctatgcagtaaga

SEQ ID NO: 25794 - DNA, 117 bp, Homo sapiens
atgatgtgtatatatatatacatatatgtatatagatgtgtatatatatacatatatgcatatagatgtgtatatatacatatatgtatatagatgtgtatatatgtgtgtgtgcat

SEQ ID NO: 25795 - DNA, 71 bp, Homo sapiens
ttgtttttgagactgagtctcgctctgtcacccaggttggagtgcaatggcgtgatctctgcttactacaa

SEQ ID NO: 25796 - DNA, 70 bp, Homo sapiens
tagatataaatctacacacacagatatatatatatgtgtatatatatctatatgtgtgtatatctatcta

SEQ ID NO: 25797 - DNA, 100 bp, Homo sapiens
agagatgatgctgcagcttctcaaatatcagcatttgatttacatctgacacagtctctgtcttcttggtatctttatttgtgatattgttgccttctct

SEQ ID NO: 25798 - DNA, 66 bp, Homo sapiens
accacgcctgtctaatttttgtatttttctgtagaaatgaggttttacgaagttgtccaggctggt

SEQ ID NO: 25799 - DNA, 74 bp, Homo sapiens
aaattcaggagactatttttatctattttaagcttatgataataagcttaaaatagatgttatcttttgctttt

SEQ ID NO: 25800 - DNA, 107 bp, Homo sapiens
acatatagatatatgctcactaatagtatatatgtatagtatatattgtataacaaacagtatatattatatatataattttcactattagtgtatatatcatttgt

SEQ ID NO: 25801 - DNA, 93 bp, Homo sapiens
tacattgtccagggttacagggatgaagtagaggtgctgggatctggctcacggtctctccctctggctcacaaactcagcccctggagtgtg

SEQ ID NO: 25802 - DNA, 97 bp, Homo sapiens
ggatttgttcctggcccctaatgattgctgaagaggggtgagttgagcacatgaggtgcaactcactctatctctgtggtatggtttgactgtgtcc

SEQ ID NO: 25803 - DNA, 95 bp, Homo sapiens
tccttttgtagaggacttgtcattctctctagctgtctttaacattttttcttttattgagaccatggagaatctgatgactatgtgtcttggga

SEQ ID NO: 25804 - DNA, 67 bp, Homo sapiens
gcctgaaactctctctgaatcacatttgggtatttaggtaactgaaagccactgaagagttttaggc

SEQ ID NO: 25805 - DNA, 110 bp, Homo sapiens
attaagaaatgcatgctaagtctagtttttatgttatttgattttacattttagtactggtatcattaaaacatacagttaaggattttagcatgacatgaacttttaat

SEQ ID NO: 25806 - DNA, 98 bp, Homo sapiens
tgataatttcagtggtagttctgtttctatatatataaattttatatacatatataaaattttatgtgtgtatacattaaattgtcataaaattatga

SEQ ID NO: 25807 - DNA, 83 bp, Homo sapiens
ggagatcaagtaagaggcaaatgtagtagtttaggtgagagaaggcagtgacctggattagggcagaggcagctgagattgac

SEQ ID NO: 25808 - DNA, 69 bp, Homo sapiens
tcttcttcacaggtggaccaggagaggtgtggcctgaaagccacacagtatctgtctctgtcaggaagg

SEQ ID NO: 25809 - DNA, 104 bp, Homo sapiens
acaagacaggaaagcaagcattccaggtgagtaaatattaatatgaagagtccattctgttgtcattttgaaattgtcttccctggttggacctagcctagtgt

SEQ ID NO: 25810 - DNA, 91 bp, Homo sapiens
gggttaaaaatatatatgtgtgtatatatatacgtatatatatgcgtacatatgtatagatgtgtgtatatatatacatatatgtacacct

SEQ ID NO: 25811 - DNA, 187 bp, Homo sapiens
atatatatatatatacacacatatatacacatatatgaatatatatatacatatatacacatatatgaatatatatatacatatatacacatatatatgaatatatatacgtgtatgcgtatatacacgtatatatatatatatatatatacccagacatatatatatgtgtgtgtatatatatata

SEQ ID NO: 25812 - DNA, 74 bp, Homo sapiens
tatgtgtgtgtatatatatataaaattgtgtataatatatatacagaatgtgtgtgtatgtatgtatgtgcata

SEQ ID NO: 25813 - DNA, 83 bp, Homo sapiens
attcttgctttatgcaaatatatggaaacatatattataaacattatatatatagtttacatatgtttgtacaaagcaagaat

SEQ ID NO: 25814 - DNA, 119 bp, Homo sapiens
aggtatatttcaattaatattatgatgcatgagtatacattttataaatatgtatgtgaatgttatatatttatatatgtgatatatttatttacactaaaaattctgttggataacct

SEQ ID NO: 25815 - DNA, 58 bp, Homo sapiens; identical to SEQ ID NO: 12246

SEQ ID NO: 25816 - DNA, 86 bp, Homo sapiens
ttagttcatggcttctgtcactcagtgtgtgtacttgcacaggcacaggcacatacacacactggaaggtggaaacatgatcctaa

SEQ ID NO: 25817 - DNA, 56 bp, Homo sapiens
atgtgtatgtgtgtgtgtgtatatatttgtatatactcacatatacatatatgcat

SEQ ID NO: 25818 - DNA, 121 bp, Homo sapiens
tgtgtaaacatgttcaattattattatgtatcatgatgtacatatggatttaaacatgttcaatttattattatgtatcatgatgtacatgtggatacatatacatataatcaattaaaca

SEQ ID NO: 25819 - DNA, 57 bp, Homo sapiens
tgtctctctcagtgtggctgggtctgggccttttatgagctcataatgggggagcac

SEQ ID NO: 25820 - DNA, 95 bp, Homo sapiens; identical to SEQ ID NO: 580

SEQ ID NO: 25821 - DNA, 93 bp, Homo sapiens; identical to SEQ ID NO: 69

SEQ ID NO: 25822 - DNA, 104 bp, Homo sapiens
gcacttcagcctggacaacagagctgtcctgtctcaaaaacagaaaaaaaaaagaaaagagagagagagagagagacgcctactgctgagatccttttgaatgt

SEQ ID NO: 25823 - DNA, 125 bp, Homo sapiens
tataaaggacatttttggaacaattgtgaaattttgaatatggacaagaaattagatactagtgttgtgttaatgttgatttcttgagtgtgatattgatgtttggttatgtcaaagaatgtcca

SEQ ID NO: 25824 - DNA, 162 bp, Homo sapiens
atatatgtatatatgtatatacacacatatacgtatatatgtatgtgtgtatatacatatatacgtatatgtgtgtatatacatatatacgtatatgtgtatatacatatatgtatatacatatatacgtatatacgtatatatgatatatatgtatatatg

SEQ ID NO: 25825 - DNA, 116 bp, Homo sapiens
atttcttcactttttcaatttcgtcggtagcaggttctctaaagccacaaggaatttttatatatattccagtggtagtaggatcccttcccgagaatagggaacaagaaagaaat

SEQ ID NO: 25826 - DNA, 84 bp, Homo sapiens
ttaggcaatgtttgtagctccattagaaaaggctgcgggtccatctgtaggcatttctatcaagagtgacaaaattgtccctaa

SEQ ID NO: 25827 - DNA, 85 bp, Homo sapiens
gagagaagtttcagtggaaagtaaaatcatagtcatacttggaaactgtcagactcacaaattgcttgtgcttttaatgtctctc

SEQ ID NO: 25828 - DNA, 92 bp, Homo sapiens
tagtatgcacttgaaagcaggtataaaatgcttacaactgaatatgttgaaaatatatatttatgtagggaatgcaatataagtgcctagta

SEQ ID NO: 25829 - DNA, 97 bp, Homo sapiens
atgtataatatatatttccagtggaaaatatatctatatctatttctctctctctctatatatatatatatttccagtggaaaatctatatttatat

SEQ ID NO: 25830 - DNA, 103 bp, Homo sapiens
gggaacatatatattttttagaaccttacacattggttaattgtcatagaaagatagtttttcaaaactggatagagtgctaattataagtataggttaaacc

SEQ ID NO: 25831 - DNA, 93 bp, Homo sapiens
tcatcatgttgcacttgtcaggaggaaggagaaaactcaccatttaggcctgaatggctttttttttctatttcaagccaagttaataaatga

SEQ ID NO: 25832 - DNA, 67 bp, Homo sapiens
gttatctctgaccctcagtgcctcagaatgtgactgtatctggagctagggtcttcaaagaggtaat

SEQ ID NO: 25833 - DNA, 84 bp, Homo sapiens
gatgaatggtgcctttctagatggaggcatggggataatccccagtcactctctgggactgtcatgattttaggtgcccacgtc

SEQ ID NO: 25834 - DNA, 70 bp, Homo sapiens
catacatacatatgtgtatgtagatatatatgtatataaccatctatccatacatatgtgtatatgtatg

SEQ ID NO: 25835 - DNA, 68 bp, Homo sapiens
catatgtatatgtgtatgtgtacatatatgttcatatatgtgtgtatatatgtttatgtgtatatatg

SEQ ID NO: 25836 - DNA, 154 bp, Homo sapiens
tatacacatatatgtgtatatacatgagtatatgagtatatatgtatgtatatatagtacatatgtgtatatatgtatatatagtacatatgtgtgtatatgtgtatatatgtgtacatatatgtgtgtgcgtatatatatgtatatatctcgc

SEQ ID NO: 25837 - DNA, 87 bp, Homo sapiens
tggatatatatatggagatatatatatatggatagatatatatggagatatatggatatgtatatatggatatatatatgaatccat

SEQ ID NO: 25838 - DNA, 87 bp, Homo sapiens
tatatatatagctatatatgtgcatatatatattatctatatatctacatatatacgtatgtgtgtgtgcgtgtatatatatatata

SEQ ID NO: 25839 - DNA, 95 bp, Homo sapiens; identical to SEQ ID NO: 68

SEQ ID NO: 25840 - DNA, 93 bp, Homo sapiens; identical to SEQ ID NO: 69

SEQ ID NO: 25841 - DNA, 107 bp, Homo sapiens
cctgatgacagacatttgtgttgtttcacgtttgggctcttatgagtaaatatttctgaatatttttgtgtaagacttttatggacatatgtttgatttctcttggg

SEQ ID NO: 25842 - DNA, 107 bp, Homo sapiens
agacttccagtgctatgtggaataggagtggtgagagtaagcatccttgtctttttcttgttcttaaggggaatgcttccagcttgtgtccatttagtatgatgttt

SEQ ID NO: 25843 - DNA, 117 bp, Homo sapiens
gattttccttaccctttccattccatttcaatgtttttgctgccccaacctcagtctctttcagtcttgaggacccacagtggaaaagtttagtagactggaatcaaagctgaagtc

SEQ ID NO: 25844 - DNA, 86 bp, Homo sapiens
ccagtaggattcttaggctgtagtttcatattgtttccatctcatctaggtgggaccctttatgccactgcttcatatctccttgg

SEQ ID NO: 25845 - DNA, 71 bp, Homo sapiens
tatatttacatacactttgtcatagggtataaatttcaattttattaaatatgatagtgtatgaaaatatg

SEQ ID NO: 25846 - DNA, 123 bp, Homo sapiens
tatatatatgtgtgtgtgtatatatatatatgttgggttatataccagttgtatgtatgtgtatgtacatatatatatatacatatatatgtatatatatgtacacacacataaatgtgtcaa

SEQ ID NO: 25847 - DNA, 79 bp, Homo sapiens
tggagcatcaagtacgtgaggttgaaaaatggaagtgagaattattttctctacccttcagtctttcttgatgttacta

SEQ ID NO: 25848 - DNA, 109 bp, Homo sapiens
tctatgcatatgtaacatatatatgtaatatatgtgggtatgtatataaaatatatatgtatatatttatatatataaatatatgtatgtaatatgtgcttattataga

SEQ ID NO: 25849 - DNA, 95 bp, Homo sapiens; identical to SEQ ID NO: 68

SEQ ID NO: 25850 - DNA, 93 bp, Homo sapiens; identical to SEQ ID NO: 69

SEQ ID NO: 25851 - DNA, 112 bp, Homo sapiens
tttcaaaatttagctttatttaaaaatgttttggggatcctttggggatataatttttaaattttattcctttcccaagaggtctcaatcaaattttagttatttttcaaaa

SEQ ID NO: 25852 - DNA, 102 bp, Homo sapiens
cagagcttgcatgtttattttcacttatttgcaattgtcttcaatattatagatattttattctccccaatgcatttaccttccaaaatagagcaggctttg

SEQ ID NO: 25853 - DNA, 87 bp, Homo sapiens
tctgtttgatagaggctttaatggggtggatttcctgagctgatataagactcttttccacactcactgagtggctgcattgatgga

SEQ ID NO: 25854 - DNA, 108 bp, Homo sapiens
tgggactcctctgatgtgccattgtagctccagaacttcttggagggttgattcctgtcaacttcaacttcttaccttgagtttggactttgtcttggcccagtccta

SEQ ID NO: 25855 - DNA, 113 bp, Homo sapiens
cttgagttcaggttctcctgttttatttttaatctttcgtagggcagatacttttagggtgtcttgtgattctgttgaagtgttcttattggtagttcagcttctctttcagg

SEQ ID NO: 25856 - DNA, 78 bp, Homo sapiens
tgggacaacattcataggcaggacaggttccacatgcagaaaggaaatgcaaaattgtggctggcagcctctgtccca

SEQ ID NO: 25857 - DNA, 83 bp, Homo sapiens
gtgtatatatatgtatgtgtgtgtatatatatacatccatacacatatatagacacacacgtatatatgtacacacacacaca

SEQ ID NO: 25858 - DNA, 95 bp, Homo sapiens; identical to SEQ ID NO: 6311

SEQ ID NO: 25859 - DNA, 118 bp, Homo sapiens
ttgattgtatatttttcgttattaatttggtggtatggaaaagaaaaaaatatgtttttttaaaaaatctgtctattccttgtaaagatgttttagtgaggaaattatgtacatttaa

SEQ ID NO: 25860 - DNA, 108 bp, Homo sapiens
caggaattgtgtgagttatttattttattttacttttttttgaaacagagtctcactctgtcacccaggctggagttcagtggcatgatcatggctcactgaaacctg

SEQ ID NO: 25861 - DNA, 58 bp, Homo sapiens; identical to SEQ ID NO: 1265

SEQ ID NO: 25862 - DNA, 91 bp, Homo sapiens
acatatatattaattcatatatgtatatatacatgtattaatttatatatacatgtgtgtatatatgtatgtataaatgtacatgtatgta

SEQ ID NO: 25863 - DNA, 119 bp, Homo sapiens
gtcctgtgctccgcaggggcggggcggccgctctccctgtcctccaggagctcacgtgtgcctgcctgtgagcgcctcgacgacagagccggcgcctgccccagtgtctgcgccgggac

SEQ ID NO: 25864 - DNA, 98 bp, Homo sapiens
tacacttgttattatatagcctatatatgtgtttttgtgtatatatttatgctagatatatatagtgaatatgtgtgtctatatattgtatatgtgta

SEQ ID NO: 25865 - DNA, 70 bp, Homo sapiens
aggaagtcgtagttcagtgtttagggtcgtggacaaaagtccagtgcctggaattgaatttttttttttt

SEQ ID NO: 25866 - DNA, 118 bp, Homo sapiens
ggggagggatagcattaggggatatacttaacataaatgacgagttaatactatgagtatttaattatatcaataggagaacacaatttctgttgtgtgtatagtgctgaaggtctcc

SEQ ID NO: 25867 - DNA, 113 bp, Homo sapiens
aatattattaataatcaaatgcagtgtgtgatgacataaggaaagaactaagaattattgtttatttatagttacacaatacactaggcagtgtttgattatataagcatgtt

SEQ ID NO: 25868 - DNA, 113 bp, Homo sapiens
tttaagagaaacagtatcaaattgagtcaaaactgaagtcttattactttataattttaaatatgtaaaatttctcaaactactctttgttgaaaggctgtgattttcttgaa

SEQ ID NO: 25869 - DNA, 116 bp, Homo sapiens
gctctgtttcccaggctggagtacagtggtatgattagtggcttttttacttattttttgtagagactgagtctcactttcttgtccaggctggtctccaactcctggcctcaagt

SEQ ID NO: 25870 - DNA, 123 bp, Homo sapiens
tacatacattctacaccatatatatgtgtatgtatatatatacatgcatatacatgtatacatatatatgtatatatgtgtgtatacatgtacacatatatataatgcatatacatgatgtat

SEQ ID NO: 25871 - DNA, 131 bp, Homo sapiens
atatatgtgcgtgtgtgtgtgtgtatatatatgtgtgtatatatatatgcatacatatatatgtatatatatatacatacatatatatgtatatatatatatacactcatacatatgtatatatatacaca

SEQ ID NO: 25872 - DNA, 109 bp, Homo sapiens
catgcaatagtctcttctagaagttgtccctgccttgctagcgatctttctaggttgtttagtttctaggtctattagggaagttcatgaaataaatgcttattggatg

SEQ ID NO: 25873 - DNA, 69 bp, Homo sapiens
ggggatgacctctcccagcaccctgtctaatgcacctggcaacagactgaggacagagaggtcatcccc

SEQ ID NO: 25874 - DNA, 79 bp, Homo sapiens
gacaagttggccttgtctcagtgtctcacgtctgtaatctcagtactctgggaggccgagaagggcggatcacaaggtc

SEQ ID NO: 25875 - DNA, 117 bp, Homo sapiens
ctgataatattttgtacatactcagctaaagtgttaacattaatttttttactttttgaaatgcaacttccagaaaattttaaattacactagtggtgtgcattatatttctattag

SEQ ID NO: 25876 - DNA, 95 bp, Homo sapiens
gtatgtctatttctaaacgtgtatgtatatatatgtatccatatctatagacatatgcataaaatctatagacatatacatatatctacatatat

SEQ ID NO: 25877 - DNA, 156 bp, Homo sapiens
tgtatcatatataaatgtatatatgatatatgatacatttatacatacatcatacatatatttatatatgatatatgcatcatatatgtatatatctatatacaggtgatgcatatataatatctttatatgtgcatatagatatcatatatatgg

SEQ ID NO: 25878 - DNA, 75 bp, Homo sapiens
tttatatgtgtatatatgctatatatatagcatttatataacattttatatatatagcatatatatagcattaaa

SEQ ID NO: 25879 - DNA, 64 bp, Homo sapiens
gtgaaggaggcgagggtagagatttcctagggtctatctctctatctctcagtgccttttaagc

SEQ ID NO: 25880 - DNA, 146 bp, Homo sapiens
gggcaggtgggactctctccccaggcaggcggggactctctctctcccggggcagggggggactctctctctctcccggggcacgcggggactctctctctctccccgggcaggtgggactctctgggcaggtggggctctctctg

SEQ ID NO: 25881 - DNA, 81 bp, Homo sapiens
atatatacaatttatataggtatgtacatatatgtatttatatatgtatatgtgcatatatacatatatagttttatatat

SEQ ID NO: 25882 - DNA, 89 bp, Homo sapiens
atatatatacatatgtatgtgaatatatatatacgtgtgtgtatatatatgtatatgtgtgtatatatgtatatgtatacacacacgta

SEQ ID NO: 25883 - DNA, 69 bp, Homo sapiens
cagaaagtctgcagagacacctgagagtcgacatttctatgagctcctaggtgatgctgaccacttctg

SEQ ID NO: 25884 - DNA, 100 bp, Homo sapiens
gtatatataagtgtatatatgtatatatgagtatatatactctctatatatgacagtgtgtgtatatatatatatatatatataatctttgcctaaatac

SEQ ID NO: 25885 - DNA, 80 bp, Homo sapiens
ttctttggttggtaagtaactaaatgaaaatgctttactactaagtatttttattaaatactagtaccactaaattagaa

SEQ ID NO: 25886 - DNA, 221 bp, Homo sapiens
tacatatatatacgtatatgtatgtatatatgtatatatgtatatatacatacatatacgtatatgtatgtatatatgtatatatacgtatatatacgtatatgtatgtatatatgtatatatacatatatacgtatatatacgtatatatacgtatatatacgtatatatgtatatatacatatatatatgtatatatacgtatatatacgtatatatac

SEQ ID NO: 25887 - DNA, 102 bp, Homo sapiens
atatgtatatatacatatatacatacatatacgtatatatacgtatatatacatatatacatacatatacgtatatgtatgtatatatacatatatacatat

SEQ ID NO: 25888 - DNA, 79 bp, Homo sapiens
atgggctttcttctgtgtgtgtctgtatccaaatttcctcctcatgtaaggacacaacatatactagattatggcccat

SEQ ID NO: 25889 - DNA, 113 bp, Homo sapiens
gataacgagtcatcaagtgtgctatgctggcattaatcgagcttcacaaattgaatttatttctatttcctgcttgttattgctagaaatggaattcttgtgggaaaaaattc

SEQ ID NO: 25890 - DNA, 90 bp, Homo sapiens
tacagtctgtgtaactatatttatatgaaattcaaaaaagacaaagctaatcttttgtattagaagttataatatggttatacggatgta

SEQ ID NO: 25891 - DNA, 113 bp, Homo sapiens
gggtctggcactggttctatcataaggttattgcataaatcctaattctgtcaccatttctaaacagtgttttaggatggaatgaaataataagtgtaaacattctgtcgcct

SEQ ID NO: 25892 - DNA, 85 bp, Homo sapiens
gaccctcagtgtatgagtgtttatgagttctgtttttgtggatgacatcaccaagggagagtactaaagtgatcaaaggagggtc

SEQ ID NO: 25893 - DNA, 98 bp, Homo sapiens
atatgagattataaataacaaatagggtctattcagagaagacagtgagaaaacagtgtcttctaaaattcccatattgttaaagtgttgtctgatat

SEQ ID NO: 25894 - DNA, 58 bp, Homo sapiens; identical to SEQ ID NO: 5055

SEQ ID NO: 25895 - DNA, 84 bp, Homo sapiens
gtaatgaaattatatatctatatgtaaaaattccattgttacatggaattatattattacatatggatacagatgaaacaatac

SEQ ID NO: 25896 - DNA, 70 bp, Homo sapiens
agatctatctacatatatttataaatagatagctatctatatctatctatatatgtgtgtgtgtatgtct

SEQ ID NO: 25897 - DNA, 102 bp, Homo sapiens
attgtatacattgttttgtgatagatgactgaatgaaatagcaacactccttcattatatattattattcatttaaatatcacaaggcaattcattttcaat

SEQ ID NO: 25898 - DNA, 112 bp, Homo sapiens
ttcattcaagttgttgctgtatcaataacttcttggttttttaaatgtatttttgatctttttaattgacataaagttgtatatatttatcacaagcaacatggtgtttgaa

SEQ ID NO: 25899 - DNA, 56 bp, Homo sapiens
tacacatatatgtgtgtacatatatatacatatatgtgtatatacatatatgtgtg

SEQ ID NO: 25900 - DNA, 71 bp, Homo sapiens
tcttggaagtgttgtttttgctttaaaataaagcagtctatttttattttaaagcaataatatttcactga

SEQ ID NO: 25901 - DNA, 94 bp, Homo sapiens
gtagattgttataagaagttaaagaaaccaaaaatataatatatataaatgttatatattttttcttttttttttttttttgagacagtctcgc

SEQ ID NO: 25902 - DNA, 85 bp, Homo sapiens
tgtctgaaagttcacatatctctgtcactctgtgattggtcagcggtgccttatttagtttggtgagactgtgtctttctggata

SEQ ID NO: 25903 - DNA, 112 bp, Homo sapiens
gccactgtgaatatggtttttttttatttttatttttttgggttttttttggttttttttttactgaaaaacaacttcttcaagaaagaaaataactgtgttctactgctgc

SEQ ID NO: 25904 - DNA, 95 bp, Homo sapiens; identical to SEQ ID NO: 68

SEQ ID NO: 25905 - DNA, 93 bp, Homo sapiens; identical to SEQ ID NO: 69

SEQ ID NO: 25906 - DNA, 109 bp, Homo sapiens
tgtacataagctgttcttctcagtggttaataatattgtattttttattttatttttactcattaataatcaatacaattatattgatctatgtcgttagttttgtata

SEQ ID NO: 25907 - DNA, 91 bp, Homo sapiens
tgctgtcttactctctctcatatttatgcatatatgtatgtatgtgtgtataaattttctgagccattttgagagtaactttgagacacca

SEQ ID NO: 25908 - DNA, 109 bp, Homo sapiens
gttggtgttgtaattgtgacttcaaaagtctattccaatgttctgtcaatccagatgcttcaagatgatggggaacatggtaagatcagtgaatttcatgagcatgagc

SEQ ID NO: 25909 - DNA, 95 bp, Homo sapiens; identical to SEQ ID NO: 68

SEQ ID NO: 25910 - DNA, 93 bp, Homo sapiens; identical to SEQ ID NO: 69

SEQ ID NO: 25911 - DNA, 67 bp, Homo sapiens
gagacagtgcctcactctgtcacccagactgtagtgcagtggtgatatcttggctcactgcaacctc

SEQ ID NO: 25912 - DNA, 107 bp, Homo sapiens
tgagaaactgtgagatatgtatgtgtgtgtgtgtgtgtatatatatacatatatatgtatatatgtatatatatcacatttgattatatatatatcacatttgatta

SEQ ID NO: 25913 - DNA, 95 bp, Homo sapiens; identical to SEQ ID NO: 580

SEQ ID NO: 25914 - DNA, 93 bp, Homo sapiens; identical to SEQ ID NO: 69

SEQ ID NO: 25915 - DNA, 95 bp, Homo sapiens; identical to SEQ ID NO: 68

SEQ ID NO: 25916 - DNA, 93 bp, Homo sapiens; identical to SEQ ID NO: 69

SEQ ID NO: 25917 - DNA, 95 bp, Homo sapiens; identical to SEQ ID NO: 580

SEQ ID NO: 25918 - DNA, 93 bp, Homo sapiens; identical to SEQ ID NO: 69

SEQ ID NO: 25919 - DNA, 93 bp, Homo sapiens
ctgtgtttctcctggacataaatatacttggaagactgctacatttgaaagcagttttttttttttaaattaagaccctgagatagaacacag

SEQ ID NO: 25920 - DNA, 115 bp, Homo sapiens
agatttaaagaatagacttctaaaaatttatttatatatatatatatatacacacacacacacacatatatacgtatatatacgtatatatatatgagagatattctttccattt

SEQ ID NO: 25921 - DNA, 86 bp, Homo sapiens
aagttaatgggtacagcaaaccaacatggcaaatgtatatatgtatgtaacaaacccacacgttgtgcacatgtatcctagaactt

SEQ ID NO: 25922 - DNA, 104 bp, Homo sapiens
ccttcacttatgaaggttagtttggctggatatgaaattctgggttgaaaattatttctttaagaatgttaaatattggtccccactctcttctgggtgtaagg

SEQ ID NO: 25923 - DNA, 70 bp, Homo sapiens
aagcctatatgtgtgtgtatgtatatatatactttaagttttgggatgcatgtgcagaacatgcaggttt

SEQ ID NO: 25924 - DNA, 104 bp, Homo sapiens
agtcaacaaacatgaaaaaatgctcatcatcactggttattagagaaacacaaatcattatcttgtattctaacagttatgagtgtggtggtatgttttggact

SEQ ID NO: 25925 - DNA, 83 bp, Homo sapiens
tgtggaaatttatgcaacaaatttatatatatatgtgtgtgtgtgcacatatatatacagatagatagatagatacacccata

SEQ ID NO: 25926 - DNA, 83 bp, Homo sapiens
gcttggagctatggtgtaagtgctttgaggatgttttgttttcataaaaatgggtcagggttgtcaatcttacctctttaggc

SEQ ID NO: 25927 - DNA, 102 bp, Homo sapiens
gctgggattacaggtgtgagccactgcacctggtcggtatattttctttttaaaaatttatctaatccaggacagtgctgacatttttttattttccaaagc

SEQ ID NO: 25928 - DNA, 85 bp, Homo sapiens
ttgcagagacaggggagtggagacagggggaggaggagcgggaaatcctctggtgtctgtgtctggctctctggaaaagctgtga

SEQ ID NO: 25929 - DNA, 115 bp, Homo sapiens
tggaacaagtgtgaataagttttatagccctctatttacatgtcatactttttgattttttaaatcaagagggacctgtataaagctaagaattgagacagactatatgtgtcta

SEQ ID NO: 25930 - DNA, 95 bp, Homo sapiens; identical to SEQ ID NO: 68

SEQ ID NO: 25931 - DNA, 93 bp, Homo sapiens; identical to SEQ ID NO: 69

SEQ ID NO: 25932 - DNA, 129 bp, Homo sapiens
ccagggttgactagagtttggcctttcttttctttttttttttttttttttgagacagagtctcgctctgtcacccaggctggagtgcagtggcgggatctcggctcactgcaagctccgcctcccggg

SEQ ID NO: 25933 - DNA, 58 bp, Homo sapiens; identical to SEQ ID NO: 1745

SEQ ID NO: 25934 - DNA, 93 bp, Homo sapiens
gagtttcaccatgttggccaggctggtatcgaactcctggcctcaggagtttatatatatatatatgccttggcctctcaaagtgctgggatt

SEQ ID NO: 25935 - DNA, 73 bp, Homo sapiens
gtatgtgtgcttggttgtgtgcattgataaaataaaattcacattactatgtactagacaacctcacaggtgc

SEQ ID NO: 25936 - DNA, 96 bp, Homo sapiens
gccagcatttactgttgtcattagtttttatttttaccactctgataagagtgtagtgatacatcactgtggctttaatatgcatttcccaatggc

SEQ ID NO: 25937 - DNA, 100 bp, Homo sapiens
ccattcccattaaaaagagaactgatctcacagccagcaatgaggctgagcctgcatgttgggtctcgttgtgtgcatgagagcaggactgtgaggaagg

SEQ ID NO: 25938 - DNA, 119 bp, Homo sapiens
acttgatattgttggctgctgctattattatggtgattagcattaccaggattattattattattattttttggttgctaaattggttacctattgctatgtaagaaactatcttgagt

SEQ ID NO: 25939 - DNA, 78 bp, Homo sapiens
ggatattactcagacaagagaggcagcactccacctcagggtgtttgtactagttgttccccctgtccaaaattatcc

SEQ ID NO: 25940 - DNA, 58 bp, Homo sapiens; identical to SEQ ID NO: 2595

SEQ ID NO: 25941 - DNA, 84 bp, Homo sapiens
ctgagcatgacagaatattttgtttaaatttcatgagattaagctccaccctttagactgaaaaaatattttccacatgctgag

SEQ ID NO: 25942 - DNA, 58 bp, Homo sapiens; identical to SEQ ID NO: 1868

SEQ ID NO: 25943 - DNA, 69 bp, Homo sapiens
tctgctgtctgggtgactcagtcattcccatctttgggatttggagagtctgagcagaccaggggcaga

SEQ ID NO: 25944 - DNA, 113 bp, Homo sapiens
gctactagtttctgtgtcttttagatgaaatttcaagagagaattttgagactactggccagccagtagcttgcctcttccttcctctgttccaatcagctacagctaactgc

SEQ ID NO: 25945 - DNA, 67 bp, Homo sapiens
ccaaattagggggtagagtcaacttttttttttttgagatggagtctcactctgtcacccagtctgg

SEQ ID NO: 25946 - DNA, 90 bp, Homo sapiens
cctatatagggtacttactatgaatggaggttacaggactcaaagttgctctgggtgagtcagtgagtgagtggtgagtgaatgtgaagg

SEQ ID NO: 25947 - DNA, 91 bp, Homo sapiens
gattatagcaaggaattgttcattttattaggggtgatgatagtttcataattttttttttttcttttttgagatggagtcttgctctgtc

SEQ ID NO: 25948 - DNA, 119 bp, Homo sapiens
gggctttccatttgcttccagcttcctccaggttgtcagtcctctctttatttgtaagttttaatactatttttgaaagcaggataacacccatcagagctgcagcagtccagttgtgc

SEQ ID NO: 25949 - DNA, 73 bp, Homo sapiens
gacaaagtctctctctgtcgcccaggctggagtgctgtggcctcctgagtagctgagattacaggcgcgtgtc

SEQ ID NO: 25950 - DNA, 90 bp, Homo sapiens
gtacggacatcagatgccaggccagattaagtgtatttgtatataaatagtacttatagcatgaaatcacttgaaatatggtggacctgc

SEQ ID NO: 25951 - DNA, 71 bp, Homo sapiens
ctcccccgggcacagggaacagggtccaagttatatattgatttttagatctgctgccctttctgggtaag

SEQ ID NO: 25952 - DNA, 89 bp, Homo sapiens
ttctttgttttggctgtctttgttataacagaacattgcctttggatttggaatgttataatttggatgtaagtagaaaaataagcgaa

SEQ ID NO: 25953 - DNA, 74 bp, Homo sapiens
tatctatagatatctatatctatctatctatatatctatccatatttatctatatctgtagatatctatagata

SEQ ID NO: 25954 - DNA, 94 bp, Homo sapiens
gctgatctttgctttctcactacacacactgtcaggaggaccagttgtgagacttccgcaagtggcatcaggtaggagatggaggaggagaggc

SEQ ID NO: 25955 - DNA, 127 bp, Homo sapiens
tgtatatatgtatatacgtgcatatatacatatgtgtatatatgcacatatatacatgcatatatatatacatatatgtatatatacacatacgtgtgtgtgtatgtgtgtgtgtatatgtgtgtgt

SEQ ID NO: 25956 - DNA, 94 bp, Homo sapiens
caagtgccaggcaccgtgctatatcctgtcaagtataaattgttacttactttttatagtgaagaaaatagtcctagagtgcttgagtgatttg

SEQ ID NO: 25957 - DNA, 91 bp, Homo sapiens
agatctgtaacttctgttttctgttactttatttctataaatgcaaactttgatttatttaaatattgaaagaaagaacagttacagttct

SEQ ID NO: 25958 - DNA, 115 bp, Homo sapiens
ctattatttgtgaataaattatatatatataaattatatatatatgtgtatatatgtatatatacgtgtatatatatatgtgtgtgtatatataatatatacacatatatattag

SEQ ID NO: 25959 - DNA, 99 bp, Homo sapiens
aggagagctgctcagttcagaaaattggtaaaaaaacaggagtctctggctgtgtctcaggcctcttagtcatatcaaaaatttgttagcagtttttct

SEQ ID NO: 25960 - DNA, 118 bp, Homo sapiens
agagtgaagaattgtctgaaccctggtaataaaaatcgggaggaaatggatggatgaaaagtatggaataaatccagtctagtattattttctcctatagttttcaaattctttcttt

SEQ ID NO: 25961 - DNA, 226 bp, Homo sapiens
tatatatacatatatatgtgtatgtgtgcatgtatatgtgtgtgtgtgtatatatatatatacacatatacgtatatgtatatatatacacatatacgtatatgtatatatatatacatatacgtatatgtatatatatatatacatatacgtatatgtgtatatatatatataaatacatatacgtatatgtgtgtgtatatatatatatatatatatatatata

SEQ ID NO: 25962 - DNA, 124 bp, Homo sapiens
acagatgatcagacatatatatatatatatatatatatatatataaaatctcaggtatatatatatatataggtgtatatatatatatcaggtgtgtgtatatatatatgtatatatatatata

SEQ ID NO: 25963 - DNA, 92 bp, Homo sapiens
gtaggaggggaatgttcctggcagaggagattttatgtacttatctatatatgtatgtattctagcagagggatattctaaaatctgaaggc

SEQ ID NO: 25964 - DNA, 63 bp, Homo sapiens
ggagtctcactctgtcacccaggctggagtgctatggcgtgatctcggctcagtgtaacctcc

SEQ ID NO: 25965 - DNA, 112 bp, Homo sapiens
ggattgccttggctatatgggctctgttttggttccatatgaaatttaaagtagttttttctaattctgtgaagaaagtcaatggtagcttgatggggttagcattaaatct

SEQ ID NO: 25966 - DNA, 62 bp, Homo sapiens
gctatatatatatatgtgtgtgtgtatatatacatatatatatactatatatactatatagt

SEQ ID NO: 25967 - DNA, 83 bp, Homo sapiens
gcctgatgctgcccttccttttttgcctaagagaccactgatcacggagtggttctagacagtctagagagaatgcacagtgc

SEQ ID NO: 25968 - DNA, 63 bp, Homo sapiens
tgggtgaaaatacgtctcttagacctgttttatttttgggacagggtctcactctgtcaccca

SEQ ID NO: 25969 - DNA, 67 bp, Homo sapiens
tatattatatatacacacacacatatatggatgtttatatgtatatgtatgtgtgtatatgtatata

SEQ ID NO: 25970 - DNA, 158 bp, Homo sapiens
gtgtatactaaatatatatgtatatatatgtatatatgtgtgtatatgtagtatatgtgtgtatatatgtatatatgtgtgtgcatatatatgtatatacatatatgtgtgcatatatatgtatatacatatatgtgtgcatatatatgtatatacat

SEQ ID NO: 25971 - DNA, 77 bp, Homo sapiens
tcaagtgtgtgcctgtgcacgtgcatgtgtgcgcgcgcgcacgcgcacacacacacacacacacacacacacactga

SEQ ID NO: 25972 - DNA, 143 bp, Homo sapiens
atataaatatatatatatatatcatatatatagtatatatatatatttcatatatatatagtgtgtatatatatctatatagtgtgtgtgtgtgtgtatatatatatatatatatatatatatatatatatatatatacttta

SEQ ID NO: 25973 - DNA, 85 bp, Homo sapiens
gtgtgtgtgactgctttatttttttaattttattgattgattgattgatttttttgatctggagtttggcttttgtcgcccaggc

SEQ ID NO: 25974 - DNA, 90 bp, Homo sapiens
tggttttgtaccctgagactttactgaatttgtttatcagatctaggagcttttcggatgaatcttttgagttttctaggtatacaatca

SEQ ID NO: 25975 - DNA, 104 bp, Homo sapiens
ctcattataatgtgatgatttgtcacagttagctgttcctagcagacatacattgctatgaatagttttatttattcatctggaaaaattgtaagtgtcatgag

SEQ ID NO: 25976 - DNA, 77 bp, Homo sapiens
tatacatatgccacatatacatcatacagacatatatgtatgcatatatgtatttatgcatatgtcttatatgtatg

SEQ ID NO: 25977 - DNA, 156 bp, Homo sapiens
aaaaaaattatatatatatgtgtgtgtatatatacacgtatatatatgtatatatacatatatacgtatgtatgtatttttttacatatatacacgtgtatatatgtatatatgtatatatacatatatacatatatacgtatatacgtgtgtata

SEQ ID NO: 25978 - DNA, 95 bp, Homo sapiens; identical to SEQ ID NO: 6311

SEQ ID NO: 25979 - DNA, 110 bp, Homo sapiens
aagttaggcttctaccctttcacagaaacaggtatggaggctctatctttcttaatgattatatttgaaagaaatggctcccagatccttgagaaagaaattcctgattt

SEQ ID NO: 25980 - DNA, 95 bp, Homo sapiens; identical to SEQ ID NO: 6311

SEQ ID NO: 25981 - DNA, 82 bp, Homo sapiens
aaactgaggtacaaggatattaagttaatcttcccaaagattttgtgggaagcaactatagaattagttctggtcccagttt

SEQ ID NO: 25982 - DNA, 93 bp, Homo sapiens
tagtaaacaggaagaaaggctttaggtgggccgttttttttttttttttttgagtggtagatatttgaatgcatttttggattctgtgaactg

SEQ ID NO: 25983 - DNA, 85 bp, Homo sapiens
cttgtgcattcagatgaactccatgggatgggaaaagcccacagctcggtgtgtctctgggtgtgtgagtctgtctactttgggg

SEQ ID NO: 25984 - DNA, 58 bp, Homo sapiens
tgagacggagtctcactctgtcactcaggctggagtgcagtggtgagatctcggctca

SEQ ID NO: 25985 - DNA, 95 bp, Homo sapiens; identical to SEQ ID NO: 68

SEQ ID NO: 25986 - DNA, 93 bp, Homo sapiens; identical to SEQ ID NO: 69

SEQ ID NO: 25987 - DNA, 71 bp, Homo sapiens
gttctatatatatactctttatatataatatatgtatatatagtatactatatagagtatatgtatagaat

SEQ ID NO: 25988 - DNA, 58 bp, Homo sapiens
tgagacagggtctcactctgtcacccaggctggggtgcagtggcgtgatctctgctca

SEQ ID NO: 25989 - DNA, 113 bp, Homo sapiens
gagtaaaacgtgataaaaatgggaagatcattggtgagtatatttataattgttagtagaagcaattaatgtatatattttaaaagatctttaaatggtattaagaaagcatc

SEQ ID NO: 25990 - DNA, 79 bp, Homo sapiens
acttagagttagtgatattgtgagaaagagtcactcactcactgtgtggtggctggaattataatatgcaaacttgggt

SEQ ID NO: 25991 - DNA, 195 bp, Homo sapiens
atgtgtatatacatatatatgtgtatatatatattcatatatatatgtgtgtatatatgtatatatatgtatatgtatatatatgcatatatacgcgtatatatatacatatatatgcatatatatgtatatatacgcgtatatatatacatatatatgcatatatatatgtatatatacgcgtatatatatata

SEQ ID NO: 25992 - DNA, 144 bp, Homo sapiens
tatatatatatacgcgtatatatacatatatatatgcatatatatgtatatatatacgcgtatatatacatatatatgcatatatatgtatatatatacgcgtatatatgcatatatatacatatacatatatatacatatata

SEQ ID NO: 25993 - DNA, 95 bp, Homo sapiens; identical to SEQ ID NO: 580

SEQ ID NO: 25994 - DNA, 93 bp, Homo sapiens; identical to SEQ ID NO: 69

SEQ ID NO: 25995 - DNA, 95 bp, Homo sapiens
caatgcgggctcttttttggttccatatgaaatttaaagtagttttttccaattctgtgaagaaagtctttggtagcttgatggggatggcattg

SEQ ID NO: 25996 - DNA, 58 bp, Homo sapiens
tgagccagggtctcactctgtcacccaggctggagtgcagtggcgtgatctcggctca

SEQ ID NO: 25997 - DNA, 97 bp, Homo sapiens
gtacctgccagctctaagagtctctgactctgtaagaagacctcaacatgatcagtctttgcttatgaagtaaaatagagaaaggagacacaagtac

SEQ ID NO: 25998 - DNA, 73 bp, Homo sapiens
tagtgtaggtagcagaatcagaaactgcatctcctgaatccagggtcagcaatctctttgttatgctatgctg

SEQ ID NO: 25999 - DNA, 110 bp, Homo sapiens
gccaggcatggtggcatgctcctgtagtcccagctacttgggaggctgaggtaagaggatcagttgagcttgggaggtcaaggctgcagtgagcgtgattatgccattgc

SEQ ID NO: 26000 - DNA, 57 bp, Homo sapiens
gggtagcacgctcactcactgcctcccttggctgggggggtgaggggtcccctgccc

SEQ ID NO: 26001 - DNA, 66 bp, Homo sapiens
tactctcagccactctcaggctgaggcgtgagaatcgcttgaacctgggagacagaggttgcagtg

SEQ ID NO: 26002 - DNA, 80 bp, Homo sapiens
gggtgaccagctgtctctgaactgaggaggtttccaggatttgggacttttttttttttttttttgagacagagtctctc

SEQ ID NO: 26003 - DNA, 87 bp, Homo sapiens
ttcttgagtagggctgttacatgtcagaaatgtgtttggagaggcacctctgggagcatgtcatgggatggattccttatgcaggga

SEQ ID NO: 26004 - DNA, 79 bp, Homo sapiens
actaaaaaattattcactgttgatctgaaatttattccattaaatttgaattccagatcaaccacaaataatttttagt

SEQ ID NO: 26005 - DNA, 73 bp, Homo sapiens
gcagagactactgagaggtgacagtgtgctggcagtcctcacagctgtcgctcgctctcggcacctcctctgc

SEQ ID NO: 26006 - DNA, 106 bp, Homo sapiens
tcaaacactagtgtagatgtttctgtgaaggcattttgtagatgtgattaatatttacaatcagttgaatgtaagtaaaggagattactctggataacgtgggtga

SEQ ID NO: 26007 - DNA, 97 bp, Homo sapiens
cagtagttaacacaagagctagttgtttaaaagagcctggcatctcccttgcttcctctctcactatgtgacatactggctctcccttcaacttctg

SEQ ID NO: 26008 - DNA, 71 bp, Homo sapiens
cacagaaagtaaacatgtaagatgataggtatgttaatttgcttcattatagtaaccatttgctatctgtg

SEQ ID NO: 26009 - DNA, 74 bp, Homo sapiens
gctgggtgcagtgagtcacacctgcaatcctagtgctttgggaggctgaggttggaggatcacttgagaccagc

SEQ ID NO: 26010 - DNA, 108 bp, Homo sapiens
ttttgtgtatccatgcaatattttctctattattattattattattggtaataactattacttttaataataatagaaatagatataacaatttgcatggtttcgaaa

SEQ ID NO: 26011 - DNA, 91 bp, Homo sapiens
ctgtagattgtggggatctattaatgaggggtatttttgtgttttatatattttttagaggcagagtctcactctttcacccaggctgcag

SEQ ID NO: 26012 - DNA, 103 bp, Homo sapiens
tgatttttgtatgttgattgtgtatcctgctattttactgaatttgtttatcagttctaacagtttttggtggagtctgtaggtttttctaagtataagatca

SEQ ID NO: 26013 - DNA, 80 bp, Homo sapiens
aggcccagttgaacaacgtaagtattttcagaatttgtatgaaacagtcctctgattttatttgtattcttcaaaggctt

SEQ ID NO: 26014 - DNA, 116 bp, Homo sapiens
ataaataaacaaacagataaatatatatgtgtatatatgtgtatatatgtatatatgtgtacatatatgtgcatatatatgtgtgtatgtgtgtatatatatatataatcaacgca

SEQ ID NO: 26015 - DNA, 58 bp, Homo sapiens
tgagacagagtctcactctgtcgctcaggctggaggacagtggtgcgatctcagctca

SEQ ID NO: 26016 - DNA, 93 bp, Homo sapiens
ggttttgtttgttttttcttttttttgatacagggttggtctcactctgtcacccaggccagagagtgcagtggcagaatcatggcttacctg

SEQ ID NO: 26017 - DNA, 113 bp, Homo sapiens
atattatagaataaatgttatttatatattatatatttacatatattaatattactatattatttatatatgtaaataaatatatgtatattcataaacttatttctatttat

SEQ ID NO: 26018 - DNA, 103 bp, Homo sapiens
ttgaggcaggagaatcacttgaacccgggaggcagaggtcacagtgagctgagatggtgccactgcactcctgcctgggtgacggagcgagactccaactcaa

SEQ ID NO: 26019 - DNA, 79 bp, Homo sapiens
cttgggcagggagtggtggctcgtgcctgtagtcccagctacttgggaggctgaggtaggaggatcacttgagtctggg

SEQ ID NO: 26020 - DNA, 110 bp, Homo sapiens
ctcactgaaggttcagataatagttagcattttttagtaacaaagtatttttaaattaaggtatgtactttaaaaaatgcattatgctattacacttaacagacagtgtg

SEQ ID NO: 26021 - DNA, 113 bp, Homo sapiens
ctgtgtgtgtatgtgctatgagtggtgtgtgtaaatgtgtggtgtgtgtgtgactgtgtgtgtgtatgtggcgtaaggggtgtgtgtggtgcgaatggcatgagggggtgtgg

SEQ ID NO: 26022 - DNA, 93 bp, Homo sapiens
gagaagattgtcagatataattttttttttagtttttctgagtcatgctttctcataaaatatgatgtaggactgctataactgactgcttcc

SEQ ID NO: 26023 - DNA, 109 bp, Homo sapiens
gttctcacagttctggaggctgggaagcccaaggtcgaggccgattcactgtctggtaaggaagggcctgctttctggctcatggatggcactcccttgctgtgtcctc

SEQ ID NO: 26024 - DNA, 120 bp, Homo sapiens
gataattgactgtgtgtgatgtatatcaggtgctgtgctttgtactttaaattataaatttatatattactataaattcaaataaagtataactgatcctcattacaactgtaagttatt

SEQ ID NO: 26025 - DNA, 88 bp, Homo sapiens
tgtgtgtgtgtgtgtgtgtgtgtgtatgtgtctgtgtgtgtgtgtgtgtatgtgtatatatatatatatatatatatatatgtacagc

SEQ ID NO: 26026 - DNA, 104 bp, Homo sapiens
ttcactttgacaaaataaagattctgaagtatttcaaagattatatttatattcctgataaaccattatctatgtttgtatttgagacatgttgttgaagtggg

SEQ ID NO: 26027 - DNA, 112 bp, Homo sapiens
gttcttttgtgtgacctttcagtgcctcaaacttgtgaaactatattgacaattgcatcaaacatttttttttatcaaacatgtttcatgcacagaatgtccacagaataat

SEQ ID NO: 26028 - DNA, 79 bp, Homo sapiens
tttagcaggtggggaattcagacagagcacagtgagaatggcatatctctgttccaagatgtctgggacattagctgga

SEQ ID NO: 26029 - DNA, 92 bp, Homo sapiens
acacacatctctatctttctatacatgtatctatctatctgcatctatatctgtctatatatatgtgtatgtgtgtgtgtgtgtgtgtgtgt

SEQ ID NO: 26030 - DNA, 117 bp, Homo sapiens
tatcaagctcatttgtgttttctgaaatgccttaaagttcacacaactgattttgtaatggtgtgaattcttagatcataataaacattcagagatgtgtttgagcagccagtgatg

SEQ ID NO: 26031 - DNA, 56 bp, Homo sapiens
gggctggatgtggttcctcactttggaaggctgaggtagatggatcgcttgaggcc

SEQ ID NO: 26032 - DNA, 87 bp, Homo sapiens
atgtttgtatgtattatctatatctacatatatatacacatctttatatatatgaatgtatgtatatatgtgtatatatacacacat

SEQ ID NO: 26033 - DNA, 95 bp, Homo sapiens; identical to SEQ ID NO: 68

SEQ ID NO: 26034 - DNA, 93 bp, Homo sapiens; identical to SEQ ID NO: 69

SEQ ID NO: 26035 - DNA, 105 bp, Homo sapiens
ttgcaagtgtgcataagctatttcttatgaaaccattttaaaaggaatgagaaatatcactatttttatatgagaatcaatagatgtaacttgtgctgattgcag

SEQ ID NO: 26036 - DNA, 117 bp, Homo sapiens
cagttgtcttatagtaaactttgccacctttcattcttctgcttgtaaaactttctttttttaaagaaggaaacatataggtcataagtcagaaaggcaaagaactctcatgatctg

SEQ ID NO: 26037 - DNA, 114 bp, Homo sapiens
ctattttctcaccccttagagcctcgttttattaatttttacaaatgaggttgtaatattttaatattttatatagggctttgtaaggataagtgagatgatgtaggtgaatga

SEQ ID NO: 26038 - DNA, 108 bp, Homo sapiens
tattattggactctgagctttgtggtgatagattaggtcagggatttctttctttctttttttggagacagagtctcactgtgtcacccaggctggagtgcagtggta

SEQ ID NO: 26039 - DNA, 96 bp, Homo sapiens
agctgatgacatctcattcttccaagaactttgctaacacatttcttattttgattttgaaatgtctgtggtagtagtgacatgaagcaattagct

SEQ ID NO: 26040 - DNA, 80 bp, Homo sapiens
cacagatgaggaatgtttggatagcttctaattttcggtaagtgaagctgtataaacatttgtcaaaatgttgttctgtg

SEQ ID NO: 26041 - DNA, 93 bp, Homo sapiens
tgtggtaacactgtgtcaagcatgcctataggtgctgttttttcaacagcatgtgctcactttgtgtctgtgtcacatttgttaattctcaca

SEQ ID NO: 26042 - DNA, 99 bp, Homo sapiens
ctcccccttaatatacagtaggaagatattaatactttccatggattttaataatgaaacagcatgaggaagtgtggactgggtgtcagtaggaaggag

SEQ ID NO: 26043 - DNA, 115 bp, Homo sapiens
gaatgaagtatttggagtgtcaatgaaaccagcaacaaaattatttatataaggaactttctttctgtcatgaattgattgtgctggatgtttgcagaatcaaaagtaatcattt

SEQ ID NO: 26044 - DNA, 72 bp, Homo sapiens
ttccaaaactggctgtctgtctcagtggttggtgcattagagccagctcacacagattttggccatggggag

SEQ ID NO: 26045 - DNA, 116 bp, Homo sapiens
ccccatctactcctctgtgttccttgagtgcactcagtttcgttttcagcagaagttgtgtcatacactcactgtgcaaagctgacagtccctaacatcatttgttttgatgaggg

SEQ ID NO: 26046 - DNA, 108 bp, Homo sapiens
agtttaacattcatggtttcagcagtgtgccaatgatctcatgagtacttcaaatatttatttgttactttgtgaagacaggatgctgaatccatgacctgagaagct

SEQ ID NO: 26047 - DNA, 84 bp, Homo sapiens
cagaaaagtagtaaggtggtgaagatcacagataccatgtcagcctctctgggtctgaatcttggctccaccctttgctgtctg

SEQ ID NO: 26048 - DNA, 87 bp, Homo sapiens
tacagtgtatatatatatatacatacagtatatatatactgtatatatatactatatatactgtatatatatactatatatatactg

SEQ ID NO: 26049 - DNA, 111 bp, Homo sapiens
tatatatatacagtatatatatacagtatatatactatatgtatatacatatactatatgtatatatacacatatagtatatatagtatatatatacacagtatatatgtg

SEQ ID NO: 26050 - DNA, 105 bp, Homo sapiens
atatatactgtgtatatatatactatatatactatatgtgtatatatacatatagtatatgtatatacatatagtatatatactgtatatatatactgtatatat

SEQ ID NO: 26051 - DNA, 107 bp, Homo sapiens
ttattctcagagtgtatgtattcatatatatgtaaacatacatgaatatactcattgatgtatatgtatatatgtatattatatatgttagcaaataaatgggttaa

SEQ ID NO: 26052 - DNA, 107 bp, Homo sapiens
ggttgatattatttcttctttaaatgtctggggaaattatctattaggctatctaagcttgaaggttgttttgttcttgttttgttttgtgggggaagtttttaact

SEQ ID NO: 26053 - DNA, 118 bp, Homo sapiens
tcatagaattattttttataactaatggtgctggaatatatatatatatatatatatatatatatatatatatatatatatatatataatagttgttataactaatggtgctggaaaa

SEQ ID NO: 26054 - DNA, 115 bp, Homo sapiens
tccaacaatgtgaagtggaattccatgagaactttataatttttctagaatatttaattatagtgtgattaaaaactgtggaattgttctggtttttagaattccttttggacat

SEQ ID NO: 26055 - DNA, 109 bp, Homo sapiens
tagatttttttctagaccatatatatatgtctatatatatgtctatatatatatgtctatatatatgtctatatatatatgtctatatatatgtctatatagatgtcta

SEQ ID NO: 26056 - DNA, 93 bp, Homo sapiens
ttttttactttttgaagaacttgagcatctgtttttataaatgatggtttttatttataaatatggatgctattagcaacttatggtattaaa

SEQ ID NO: 26057 - DNA, 112 bp, Homo sapiens
ggattgtcttgcctatataggctctttttggttccatatgaaatttaaagtagtttttttctaattctgcgaagaatgtcagtgggagcttgaggagaatagcattgaatct

SEQ ID NO: 26058 - DNA, 65 bp, Homo sapiens
taggcagatgagaagtagtgtatgtatgtgtgtgtattcatatatatttatgttacatttgcctg

SEQ ID NO: 26059 - DNA, 83 bp, Homo sapiens
gctccatggagtcacactgtgactgagaggtggtcactgtggcatatatgcacagtccacgcagggtgtgaagtctgtggggc

SEQ ID NO: 26060 - DNA, 117 bp, Homo sapiens
gctttggctgtgcaggctcttttttcattccatatgaattgtagaattgtttttctagttctgtgaagaattatggtggtattttgatgggaattttgcattaaatgtgtagattgc

SEQ ID NO: 26061 - DNA, 117 bp, Homo sapiens
tccagctttgttctttttgcttaggattgtcttggctatgtgggctgttttttggttccatatgaaatttaaagtagttttttcctaattctgtgaagaaagtcaatggtagcttga

SEQ ID NO: 26062 - DNA, 95 bp, Homo sapiens; identical to SEQ ID NO: 68

SEQ ID NO: 26063 - DNA, 93 bp, Homo sapiens; identical to SEQ ID NO: 69

SEQ ID NO: 26064 - DNA, 113 bp, Homo sapiens
tgccggctgctgcaatggggcgggcagttacaggtgctggcacaggcactgactctctgtgaggctgtggccagaccaggtgcactgcaggaagcttccccagctggcaccgg

SEQ ID NO: 26065 - DNA, 116 bp, Homo sapiens
ctaggatgaactacactacttatgtgttaatgactaaggtttagattttttttttttttttttttttgagagtctcactctgtcatccaggctggagtacagtggtgcaatctcag

SEQ ID NO: 26066 - DNA, 57 bp, Homo sapiens
ttggttgtcctagtaggttgtgttctgtgagcctcacccactgggtgttataaccaa

SEQ ID NO: 26067 - DNA, 80 bp, Homo sapiens
atgtatatatgtatatgtatacatatatatatgtatgtgtgtatatatgtacgtatatatgtatatgtatacatatatat

SEQ ID NO: 26068 - DNA, 102 bp, Homo sapiens
gtgctcctgtattggatgcatgtatatatactttttaaaatatatattttttattatactttaagttctagggtacatgtgcacaatgtgcaggtttgttac

SEQ ID NO: 26069 - DNA, 115 bp, Homo sapiens
tatttgttcatgttgaagtagtgtgaaagtaggcacattagtatgaaagtatttctattaaagctgaattgctataataacactaaatcctgtgttggcatggaataactagatg

SEQ ID NO: 26070 - DNA, 113 bp, Homo sapiens
cattaatttactgtcctccgattgtcagttctgagggacatatagaagagctcaggctagttactatgtttatgatttttactcaagggctttataatattttggcattaatg

SEQ ID NO: 26071 - DNA, 56 bp, Homo sapiens
tgtgtatatatatagctatagttgtatgtatatacatatagttatatatatataca

SEQ ID NO: 26072 - DNA, 112 bp, Homo sapiens
gttcaagcctagtgctttataacttgctgtctaatgcttttgtaatgtaaagtaacttttacatgattccaaaggaaaaggaagaggcccctttaagaagtaagcttgtgat

SEQ ID NO: 26073 - DNA, 119 bp, Homo sapiens
gtgagtaatgtcactggtgtcagttttgcctcttcaatagaaatatatactactaaattgattttattttcttcaatgtcctataattttcttttatcaggtctgttccagttactcat

SEQ ID NO: 26074 - DNA, 118 bp, Homo sapiens
gctgtagagttttgtaatagatgattttaatcagtttaagaaagtttcttttaatttttaatttgttggaagtttctattattgatagataatgcattttgttaaatgtttttgtagc

SEQ ID NO: 26075 - DNA, 113 bp, Homo sapiens
tgtcccttctcttctatccttctctggtgctcctctctgccactctgccactcttctgctcatggagcctgaggtttggggtttttgtgggtacaggatgggggcatggcaga

SEQ ID NO: 26076 - DNA, 101 bp, Homo sapiens
tgctaagagtcaggaagcctaagtagttggctccacgatgctaaatttatctttatgttaattcggtataatgagtctttttactgagcccctacaaagca

SEQ ID NO: 26077 - DNA, 88 bp, Homo sapiens
gtctgtatatatatatctttgtgtgtatgtgtgcatgtgtatatgtgtatatatatatatacatacacacatatgtatacatacatat

SEQ ID NO: 26078 - DNA, 97 bp, Homo sapiens
tcctgttcacttggagctataaaactatataaatctatatgtgtgagaaactctcactgtatttaatgtgtttttttcagtgctactgtctacagga

SEQ ID NO: 26079 - DNA, 86 bp, Homo sapiens
tgtcttaaatatcattctctccatatatatttttaattttattttaaattccaggatacatgtggaggatgtgcaggtttgtgaca

SEQ ID NO: 26080 - DNA, 73 bp, Homo sapiens
cagagggaaggagaaagattacctgtctcaactaaatctaggacagtggttcttctttttaaagacccacctg

SEQ ID NO: 26081 - DNA, 100 bp, Homo sapiens
tgaaagatcttcagagaaaagagtggaggttcttaatctttcttaattttatactttaagaaacataatagaaaattacttagtttttgatcacttttca

SEQ ID NO: 26082 - DNA, 79 bp, Homo sapiens
agcaagacggaagcactgtttgtctatatatatatatgtatatacatatatatatataaacatttttaggtatcatgct

SEQ ID NO: 26083 - DNA, 77 bp, Homo sapiens
ggtagttttggcttgatccagacattttccagtcagtgacccctgttgtcaactgtctctgtgagggcatggctgct

SEQ ID NO: 26084 - DNA, 87 bp, Homo sapiens
tttgtttttgagctagagactcactctgtcacgtaggctggagtgcagtggcgcaatttcggctcactgcaaactttgcctcccagg

SEQ ID NO: 26085 - DNA, 147 bp, Homo sapiens
gtacatacgtacatgtatgtgtactatatatgtatatatacatacatatatagcagatatacatgcatgtacgtatgtatatatgtatatgtatctactatatatgtatacatatatacatgtatctatactatatatacatatata

SEQ ID NO: 26086 - DNA, 180 bp, Homo sapiens
atatatacatatatgtatatatgtatatatgtatatatacacatatatacatgtgtatctatgtatacgtatatatgtatatttacagtatatatagtgtatatatatacaatatatatgtatatattgtatatacgcaatatatgtatatattgtgtgtatatatgtatctattgtgtg

SEQ ID NO: 26087 - DNA, 87 bp, Homo sapiens
tacacgtcgttttgtgtatgtgtgtgtgcatgtgcacgtgtgtctgtgtaagtgtgcacacacacgcatgtgtgcatgatgttggta

SEQ ID NO: 26088 - DNA, 75 bp, Homo sapiens
atatatacatgtacgtatgtatatacatgtacatgcatatgtactatatatgtatacatatatacatgtatatat

SEQ ID NO: 26089 - DNA, 123 bp, Homo sapiens
gctttgttctttctgcttaggattgtcttggctatgtgggctcttttttggttccatatgaaatttaaagtagttttttctaattctgtgaggaaagtcaatgttagcttgatgaggatagca

SEQ ID NO: 26090 - DNA, 96 bp, Homo sapiens
cgttgactacttttccatatcaaattattgaaagagttttaaaaaatatttttattagtttctctgacaattagatgtggattcgagtaaaagagg

SEQ ID NO: 26091 - DNA, 96 bp, Homo sapiens
gcttgctagattctagataagtcactctttactgtttctgtcagatgtcattcactgggggacagtaatgtgccttatggagataaggtgaattgc

SEQ ID NO: 26092 - DNA, 85 bp, Homo sapiens
agtgagagtgcaaatccaaggaaaactgggaagagagcgagttagcgacacaattctctctttttcattcttggtgatcatcact

SEQ ID NO: 26093 - DNA, 95 bp, Homo sapiens; identical to SEQ ID NO: 68

SEQ ID NO: 26094 - DNA, 93 bp, Homo sapiens; identical to SEQ ID NO: 69

SEQ ID NO: 26095 - DNA, 70 bp, Homo sapiens
ccacaggtgactgagcagacagagagttccaggagaccacccaggatgactgatgctgaggggatggtgg

SEQ ID NO: 26096 - DNA, 58 bp, Homo sapiens; identical to SEQ ID NO: 884

SEQ ID NO: 26097 - DNA, 56 bp, Homo sapiens; identical to SEQ ID NO: 885

SEQ ID NO: 26098 - DNA, 92 bp, Homo sapiens
tggatctgctttaattagtaggccagaattctttgtatttatttcattaatcattagaaacagttgttactggagtgtttgaaagcagtcta

SEQ ID NO: 26099 - DNA, 93 bp, Homo sapiens
tctctcacacatgctctttctctctctctgagatgcaagatcaattactgacgttgctcaagagagaaggtaaatgagaaaaaaggtgaaagg

SEQ ID NO: 26100 - DNA, 84 bp, Homo sapiens
tctataacatgtttatatatgtgtgtatattatgtataattttatgtatgtatctatgttacacaatattgaatttgttataga

SEQ ID NO: 26101 - DNA, 83 bp, Homo sapiens
agctggggattcttcagttctgagctctttggaaaaaggtgtggtctgctggaagggagtgctagagcacagaatgtatagtt

SEQ ID NO: 26102 - DNA, 58 bp, Homo sapiens
tgagacggagtctcgctctgtcacccagactggagtgcagtggcatgatcttggctca

SEQ ID NO: 26103 - DNA, 71 bp, Homo sapiens
tgattaggttagctctctctcactgtctcagtcataattttgcagaggcagttcaggaggtgattggatca

SEQ ID NO: 26104 - DNA, 58 bp, Homo sapiens; identical to SEQ ID NO: 2758

SEQ ID NO: 26105 - DNA, 95 bp, Homo sapiens
gatggaattaggttgtgggctatgtatatttcatttaaaacagcaggatctattttttttctgcttattattacattgccccatgtagttttatc

SEQ ID NO: 26106 - DNA, 95 bp, Homo sapiens; identical to SEQ ID NO: 68

SEQ ID NO: 26107 - DNA, 93 bp, Homo sapiens; identical to SEQ ID NO: 69

SEQ ID NO: 26108 - DNA, 130 bp, Homo sapiens
tacacatatgtatatataaatatatgtgaatatatacacatatgcatatataaatgtatgtaaatatatacatatatgtatatataaatatatgtgtaaacatatttacatatatgtatatatgtacata

SEQ ID NO: 26109 - DNA, 95 bp, Homo sapiens; identical to SEQ ID NO: 68

SEQ ID NO: 26110 - DNA, 93 bp, Homo sapiens; identical to SEQ ID NO: 69

SEQ ID NO: 26111 - DNA, 112 bp, Homo sapiens
cctacacttggccagccaattattccagcaccatttgttaaatagggtgtccttcccccactttatatatttgtttgctttgttgaagaacagttggctgtaagtatttggg

SEQ ID NO: 26112 - DNA, 107 bp, Homo sapiens
tgcctctttgttctccctttttcccctccagtttagtggttagaatgtatttattatagcaggattaatacagggattcactaagcagcgttaagaagacttaggta

SEQ ID NO: 26113 - DNA, 87 bp, Homo sapiens
gcaggggccagatgggaaatggagtgtccttttattatgagaccacagtgagagactttttttttttttccagagtctcgttcttgc

SEQ ID NO: 26114 - DNA, 105 bp, Homo sapiens
tcctaatgtatgcttgtgtttagctatcttcttgctgttgacttctaattttgttgcattatggtcaggaaaatgtggtctggacaatgtcaattgtatagtgga

SEQ ID NO: 26115 - DNA, 110 bp, Homo sapiens
tagtttgggagagtagttcatattttggtagaacatgatttatttatttatttatttatttatttatttatttatttattgagatggagtctcactctgtcaccaggctg

SEQ ID NO: 26116 - DNA, 58 bp, Homo sapiens
tgaggcagagtctccctctgtcacccaggctggagtgcagtggcgagatcttggctca

SEQ ID NO: 26117 - DNA, 114 bp, Homo sapiens
gctgggtatggtggtgcatgtctgttgttgtcccaggaggctgaggtaggaggatcacttgagcccaggagttcgaggccgcaacgagttgtaatcaaaccactgcactccagc

SEQ ID NO: 26118 - DNA, 58 bp, Homo sapiens
tgagagggagtctcactctgtcacccaggctgcagtgcagtggtgagatctcagctca

SEQ ID NO: 26119 - DNA, 83 bp, Homo sapiens
caggctattttctgtatgtctgtgcatgtagagatacatttggtgcatgcatagttattagagcgtatgaagtcacctgtctg

SEQ ID NO: 26120 - DNA, 108 bp, Homo sapiens
gcattgtgctgggtgaaaagggcaaatcttaaaatgccacatacgatacgattccttttttgttatttttttgagacagagtcttgctctgtcaccaggctagagtgc

SEQ ID NO: 26121 - DNA, 74 bp, Homo sapiens
gggtgagccaccacgcctggcctttttgtttttgttttttgttttttttgagacagggtctcactgtgtcaccc

SEQ ID NO: 26122 - DNA, 59 bp, Homo sapiens
tgagattgagtctcactctgtcgcccaggctggagagtcagtggtgagatactggctca

SEQ ID NO: 26123 - DNA, 58 bp, Homo sapiens; identical to SEQ ID NO: 1391

SEQ ID NO: 26124 - DNA, 56 bp, Homo sapiens; identical to SEQ ID NO: 1392

SEQ ID NO: 26125 - DNA, 88 bp, Homo sapiens
atatatatgtgtgtgtgtgtatatatatgtgtatatgtatatattttttatatgtaaaatatatatgtatatatttttttgagacaca

SEQ ID NO: 26126 - DNA, 116 bp, Homo sapiens
gtctcatgtacagtcctcttgcctcgtcctttggttgattcccagtctgtttcttttcttttcttttttttaagagacagggtctcactccgtcacccaggctggagtgcagtggc

SEQ ID NO: 26127 - DNA, 121 bp, Homo sapiens
acacgtgtatctgtgtgtgcatgcataggtgcaggtatgtgtgcatgagcatgtgtgtgttcacatgtgtatctgtgtgtgtaccttcctgtgtctctgggtgtgcaaatacgtgtgcatg

SEQ ID NO: 26128 - DNA, 110 bp, Homo sapiens
ggctggagtgcagaggttattgcctaaagtttggggattttttttgagtgagagtctcactctgtcactcagactggagtacagtggcatgatcatggcttactgcagcc

SEQ ID NO: 26129 - DNA, 76 bp, Homo sapiens
ggagtagggacactctggttctctctctcagttttgcttttcagcctaatgagagactagtcccagccttcactct

SEQ ID NO: 26130 - DNA, 102 bp, Homo sapiens
ttcacttgacaagtgtttattgggtgcctgggtccctgtaagacttccttcttctaagcccaagtctccagggttcctagatcctgcgaagatttcaaggaa

SEQ ID NO: 26131 - DNA, 100 bp, Homo sapiens
gactgggggtttgaggccagcctgggtaacacagtgagtctctgtctctacaaaaaataattcaaaaattagccaggcatggtagcatgtgcctgtagtc

SEQ ID NO: 26132 - DNA, 111 bp, Homo sapiens
tgtcctctgcatttcatcttttatatttatatatatatatttatatttatatatttatatataatatataatttttatatatatatataaaactttaagttttagggtaca

SEQ ID NO: 26133 - DNA, 101 bp, Homo sapiens
catatcagagtgcatctggttatagattatagcgatacaattactttttattttttgtaaacagggtcttgctgtctcctacgctggagtgcagtggtgtg

SEQ ID NO: 26134 - DNA, 113 bp, Homo sapiens
ctgggacaatcattctacctctttgggcctcagttttctcatctgtatgttggggataataatgatgatgatgatgatgataggggccaggtgcgtggtggctgttttcccag

SEQ ID NO: 26135 - DNA, 58 bp, Homo sapiens
tgaggccgagtctcactctgtcacccgggctggagtatagcagtgcaatcttggctca

SEQ ID NO: 26136 - DNA, 67 bp, Homo sapiens
tgtttcctagctgttcactgagtgcttggaagtgtcggctcccacactgggtgtcacagtagagaca

SEQ ID NO: 26137 - DNA, 76 bp, Homo sapiens
tcataaaattaaatgttgtcagaagactgagaagctcaggaggtgagctgctggccctggcgagtatttaagatgg

SEQ ID NO: 26138 - DNA, 89 bp, Homo sapiens
gttgacgcatatggtgtggagagttgatttctgggctctctgttctgttcagttggtctctctgtctgtctttatgccaccactacaat

SEQ ID NO: 26139 - DNA, 58 bp, Homo sapiens
tgagctgagaccacaccactgcactccagcctggatgacagagtgagtctctgtctca

SEQ ID NO: 26140 - DNA, 106 bp, Homo sapiens
gcctggtggcacacacctgtagttccagctacttgggaggctgaggtaggaggatcgcttgagcccaggaggttgaggctgcagtgagctatgattgtgccactgc

SEQ ID NO: 26141 - DNA, 115 bp, Homo sapiens
cagcctgggcaacacagtgagacttaatcccccccaaaaaaacttcttatttttattattttttttaatttttaattttttttggagacagagtctcactctgtcacccctgctg

SEQ ID NO: 26142 - DNA, 100 bp, Homo sapiens
gtgttttttgggagggggaggggatcataacaattattaaaaattatggaaacttttttttcttttttttagagactctctgtcacccaggctgaagtgc

SEQ ID NO: 26143 - DNA, 91 bp, Homo sapiens
cctatctcaaaacaaaaaggggcagggtactgacttggactgtgtataactcagtgcttttcttttttttttttttttaattagagaaggg

SEQ ID NO: 26144 - DNA, 74 bp, Homo sapiens
tctgggtggtgggatttcaggtgatttttttttttttttttgagacggagtctcactctgtcccccaggctgga

SEQ ID NO: 26145 - DNA, 106 bp, Homo sapiens
gacctcccacttggcttgatgctcctctgttgctgtttcaaaattcctttattattattattatttttagagacagggtcttgctgcgttacccaggctggagtgc

SEQ ID NO: 26146 - DNA, 148 bp, Homo sapiens
taatatatatgtgtgtgtatatatatatatgtgtgtgtgtgtgtatatatatattatacatatatacatacatattatatatacatatatacacgtatattgtatgtatatattatatatatgtatgtatgtgtatatattatatata

SEQ ID NO: 26147 - DNA, 144 bp, Homo sapiens
cagcctgggtgacagagactccatctcaaaaaaaaaaaaaaaaaggggggcggggttttacatttttattttatttatttatttattgagatggagtctcactctgtcactcaggctggagtgcagtggtgcgatctcggctca

SEQ ID NO: 26148 - DNA, 61 bp, Homo sapiens
gtggtgtcccagagtcactccgtcagtggtctgaggagtttcggaagctctgggtcctcgc

SEQ ID NO: 26149 - DNA, 63 bp, Homo sapiens
cgagcaaataaagcaagattttttttttttttgagatagagtcttgctctgttgccaggctgg

SEQ ID NO: 26150 - DNA, 76 bp, Homo sapiens
ggtccctgcttctcactgcagggaagtggccggtgctgtcactgggtctcactccctgaatgagagtgcaggcacc

SEQ ID NO: 26151 - DNA, 177 bp, Homo sapiens
tgggaggatcgtttgagcccaggagtttgagaccagcctgggcaacatagcaagaccccatctcttttattttttattttattttatttatttatttatgagacagagtctcactctgtcacccaggctggagtacaatggcacaatctcggctccctgccacctccgcctcctggg

SEQ ID NO: 26152 - DNA, 115 bp, Homo sapiens
atgagatatatacacatatcctttatatatatatatacacacacacacacacacacatataaatgtcctatgtctgtgtgtgtgtatatacatatgtgtgtgtgtgtgtatacat

SEQ ID NO: 26153 - DNA, 150 bp, Homo sapiens
gtgtaaacccagtgatattattcgtaatatctaagggagaccttactcgtaatatcacagtgggtgtacactgtgtgtaaaccctgtaatattatttgtgaaatctaaggaagatattactcctaatatcacagtgggtgtacatcctgt

SEQ ID NO: 26154 - DNA, 105 bp, Homo sapiens
gatattgatgaaatatcgcttctgatgtttgtcctatcatggtgtttacagagggtttacacatatgatattgatgaagtatcgcttctgatatttgtcacatca

SEQ ID NO: 26155 - DNA, 88 bp, Homo sapiens
agtggggaccagaaaggctggtggagttgacttggctgagattgctgggcccctgtgtgtcacttcctctgactttctggtgaccact

SEQ ID NO: 26156 - DNA, 70 bp, Homo sapiens
gtgactgtaggatagcaggagggagccacatggagacagagtggatctgcatcttgatcatgctggtcat

SEQ ID NO: 26157 - DNA, 61 bp, Homo sapiens
ttgagtcggagtctcactctgtcacccaggctggagttggagtgcaatggcccgatcttgg

SEQ ID NO: 26158 - DNA, 80 bp, Homo sapiens
ccagccaggctcctgggctttctatggactccagagacatctcgttctgtagagagaagacagtgagtagggatccttgg

SEQ ID NO: 26159 - DNA, 95 bp, Homo sapiens; identical to SEQ ID NO: 68

SEQ ID NO: 26160 - DNA, 93 bp, Homo sapiens; identical to SEQ ID NO: 69

SEQ ID NO: 26161 - DNA, 91 bp, Homo sapiens
acagtcagacactacagccgctgcagtgacaggcagctccaggtgccggcacaggcactggctctctgtgaggctgtggctggaccaggtg

SEQ ID NO: 26162 - DNA, 115 bp, Homo sapiens
agatgagactgtagactgcattaggagagagacagtaatagatgtgacttttttttttttttttgagacagaattttgctcttgttgctcaaggtggagtgcaatggtgtgatct

SEQ ID NO: 26163 - DNA, 68 bp, Homo sapiens
tgggagagtgtaaaatcccagggagggtgggatcgactgtctcccactctgtttgaacttacttccca

SEQ ID NO: 26164 - DNA, 108 bp, Homo sapiens
tactgtcgtattccattatattaatataccaaagcatattattcatttttcttttgagggaaatttggatgatttctgtttctattattaaaaacaggaatatgtgtg

SEQ ID NO: 26165 - DNA, 102 bp, Homo sapiens
tcacccctgtccagggaggttgcctggagaatgagccactctcaaagtcactcagacctgggctcacctggtggctctgccagtcctacctgttgacagtga

SEQ ID NO: 26166 - DNA, 77 bp, Homo sapiens
gctcaatgaagcgggaattggccctgaggttctcagactccctctgagtccctgagagtgagtttcctcaaatgagt

SEQ ID NO: 26167 - DNA, 101 bp, Homo sapiens
gtggtcccagctgcttgggaggctgaggtagaaggatagattgagcccaggaggttgaggctgcagtgagctatgattgtgccattgcaccccagtctggg

SEQ ID NO: 26168 - DNA, 96 bp, Homo sapiens
aagggaggctgggctgtactcagaggctctctctctggcatggattctgtgatgcagagtgagggtggagctgcgggtgaaggccttgccacactt

SEQ ID NO: 26169 - DNA, 58 bp, Homo sapiens; identical to SEQ ID NO: 5932

SEQ ID NO: 26170 - DNA, 106 bp, Homo sapiens
ggacagctgaactccgggactggccagtgttgagaggcggagacttgggcaattgctggacgctgccctgggcattgcacttgtctcggtctgacagtgccggccc

SEQ ID NO: 26171 - DNA, 86 bp, Homo sapiens
gtcctgggggctccaaagtgctgttcgtgcaggtagtgtgattacccaacctactgctgagctagcacttcccgagcccccgggac

SEQ ID NO: 26172 - DNA, 103 bp, Homo sapiens
cgctccagccctgccggggctaaagtgctgacagtgcagatagtggtcctctccgtgctaccgcactgtgggtacttgctgctccagcagggcacgcacagcg

SEQ ID NO: 26173 - DNA, 127 bp, Homo sapiens
tggagggtggaaaggggagggatggagaatcttcctgggagaagtggggttggaagggttgtttttttttttttttccgagacaagatctcactctgtcacctaggctgcagtccagtgtcccaatc

SEQ ID NO: 26174 - DNA, 77 bp, Homo sapiens
tatctgtgtgtgtgtgtgtgtgtgtgtatttatgtatatatgtatatacacacatatatacgtagacacacacacac

SEQ ID NO: 26175 - DNA, 199 bp, Homo sapiens
tgtatatatatatatgtgtgtgtgtatatatatatatgtgtgtgtgtgtgtatatatatatacgtgtatatatatgtatatatacacgtatatatatgtgtatatatatgtgtgtatatatatgtgtgtatatatatatgtgtgtgtatatatatacgtatatatatgtgtgtatatatatacgtgtatatatatatat

SEQ ID NO: 26176 - DNA, 77 bp, Homo sapiens
cacacactgcagctcacacacttcaggttttgtgctcccagacaatgcctgtcctcatgagagcactgttgtctgtg

SEQ ID NO: 26177 - DNA, 113 bp, Homo sapiens
gtaaaacgcattttttttttttttttttggtggcggggacagagtctcaccctgtctcccaggctggagtgcagtggcgcaatctcagctcactgcaaactctgactcctggg

SEQ ID NO: 26178 - DNA, 58 bp, Homo sapiens; identical to SEQ ID NO: 14767

SEQ ID NO: 26179 - DNA, 56 bp, Homo sapiens; identical to SEQ ID NO: 14768

SEQ ID NO: 26180 - DNA, 102 bp, Homo sapiens
ggagtggtggtgggcacctgtagtttcaactatttgggaggctgaggttgaaggatcgcttaagcccaggaggcagaagttgcagtgaactgtgattacacc

SEQ ID NO: 26181 - DNA, 77 bp, Homo sapiens
gctctctctctgtcacccaggctggagtacagtggtgcaatcacaactcactgcagcctcagttgccacctgagggc

SEQ ID NO: 26182 - DNA, 80 bp, Homo sapiens
cctgatggaaagaaatggcaggtgcattttgttttattattattattattttgagacggagtctcactctgtcgcccagg

SEQ ID NO: 26183 - DNA, 101 bp, Homo sapiens
ccagcctgggcaacataatggaaccccgtctctaccaaaaaaaaaaaaaaaaattttttttttttttttgagacggagtctcactctgtcacccaggctgg

SEQ ID NO: 26184 - DNA, 58 bp, Homo sapiens
tgagtcagggtctcactctgtcacctaggctggggtgctggggcacaattttggctca

SEQ ID NO: 26185 - DNA, 59 bp, Homo sapiens
ggggagggcaaagggaaggattttcacagtacctgcgtgcctccctgccagtcttcccc

SEQ ID NO: 26186 - DNA, 74 bp, Homo sapiens
ctcctctctgggagtctgagactgccctttctttttttttgagacagagtctcactgtgtctcccaggctagag

SEQ ID NO: 26187 - DNA, 136 bp, Homo sapiens
ttaggagagaaagagggagatggaactgggaggaaactgatttccattctttttcagttttttttgttgttttttttttgaggcggagtctcgctctgtcacccacgctggagtgcagtggtgcgatctcggctca

SEQ ID NO: 26188 - DNA, 58 bp, Homo sapiens
tgaggcggagtctcgctctgtcacccacgctggagtgcagtggtgcgatctcggctca

SEQ ID NO: 26189 - DNA, 105 bp, Homo sapiens
acatatatatgctttatatatatatacacatatatgttttatatataaactatatatgttacatatacacatatatgttatatatataaactgtatatgttatgt

SEQ ID NO: 26190 - DNA, 87 bp, Homo sapiens
ctgagaccctgtctcaaaaaatatatatattataaatacttaattctaaattttatgatataattgtattgagaggataggggaagg

SEQ ID NO: 26191 - DNA, 103 bp, Homo sapiens
gtcaccgcacccggcctctttttgttttgttttgttttttttgtttttttttttttttttgagacaaggtcttgctctgctgcccaggttggagggcagtggc

SEQ ID NO: 26192 - DNA, 102 bp, Homo sapiens
catgagagtaaaagtctgaagaggcctcatctgctgagactgcttccctcctgtcccaggatctagcttgttttggtttgggcagttttgtttaatccagtg

SEQ ID NO: 26193 - DNA, 80 bp, Homo sapiens
tgggcaatatagtgagactccattgctgcaaaaaaataatttttttttttttttgagacggagtctcgctctgtcaccca

SEQ ID NO: 26194 - DNA, 80 bp, Homo sapiens
tcttgagatgggtgaattaaggatcttttggtttgtttccttacttatcggaaatttttaattttaattcagcctccaga

SEQ ID NO: 26195 - DNA, 80 bp, Homo sapiens
agggccactcaggtacaatgtggatgccgaggtccaagtgaccactggccagtctgtgtccctcactgcctctctgccct

SEQ ID NO: 26196 - DNA, 72 bp, Homo sapiens
cagcctggaagacagagcaagactccatctcaaaaaaaaaaaaaggtcagggtctctctgtctcccaggctg

SEQ ID NO: 26197 - DNA, 58 bp, Homo sapiens; identical to SEQ ID NO: 637

SEQ ID NO: 26198 - DNA, 77 bp, Homo sapiens
tctccaaagcagcaactagaactttgacctttgggtgctaactctttgttgttgttgttttgtttttgtttttgaga

SEQ ID NO: 26199 - DNA, 60 bp, Homo sapiens
atatatatatgtgtgtatatatatgtgtgtgtgtgtatatatatatatatatatatatat

SEQ ID NO: 26200 - DNA, 79 bp, Homo sapiens
cagtttcttgggtgtggcctttttgtgatcaaccagcattctacaggttatttgcagtatgctataaatccaggtattg

SEQ ID NO: 26201 - DNA, 81 bp, Homo sapiens
tcataccatgactcaatatatatatgcttatatataatcacatacatatatgtatataggcattaaattgagtacttatga

SEQ ID NO: 26202 - DNA, 58 bp, Homo sapiens
tgagacggagtctcactgtctcacccaggctggagtgcagtggtgcgatctcggctca

SEQ ID NO: 26203 - DNA, 113 bp, Homo sapiens
gctgtaaaagctagagctgttgctaagggaaccaacggaggaatgtgaatttgtaaatctctcaatcacattaacattttgtgtaatatctgacctcagctttactttaaggt

SEQ ID NO: 26204 - DNA, 99 bp, Homo sapiens
gaaatgtatttagaaagtccttcaaaaatatttttaaatgcagatatatatatttctatatatgtatacattgaaagaaattttggggagattcatttc

SEQ ID NO: 26205 - DNA, 71 bp, Homo sapiens
aagcacaagtgtgtgtgcacacatatatatgtatatacatatgtgtgtgtatgtacttcagtactgtgttt

SEQ ID NO: 26206 - DNA, 80 bp, Homo sapiens
tgagatcgagtctcactctgtcacccaggctggagtgcagtggtgcaatctcggctcactgcaacctctgactcctgggt

SEQ ID NO: 26207 - DNA, 70 bp, Homo sapiens
aaggtctgctgctgagcccagggcaggtggttccacagctccctctctgactctcagaatctaacacctt

SEQ ID NO: 26208 - DNA, 115 bp, Homo sapiens
cataacacaatgtgctactatgtgttatatataacactatatatatatatatatatatatatcactatatatatgtgttatatgtataatacatatattatgtgtatgtgttatg

SEQ ID NO: 26209 - DNA, 58 bp, Homo sapiens
tgagacagggtctcactctgtcacccaggctggagtgcagtagcatgatcttggatca

SEQ ID NO: 26210 - DNA, 97 bp, Homo sapiens; identical to SEQ ID NO: 1307

SEQ ID NO: 26211 - DNA, 88 bp, Homo sapiens; identical to SEQ ID NO: 1308

SEQ ID NO: 26212 - DNA, 81 bp, Homo sapiens; identical to SEQ ID NO: 1309

SEQ ID NO: 26213 - DNA, 77 bp, Homo sapiens; identical to SEQ ID NO: 1310

SEQ ID NO: 26214 - DNA, 114 bp, Homo sapiens
attgtgattgttgggggagaatgtgagtgaaagcttcctagaggaggggaaatccatgttggttttttatttttttagacggagtctcactctgttgccaggctgcagtgcagt

SEQ ID NO: 26215 - DNA, 116 bp, Homo sapiens
tgaatatttccaagtctgcaagtaaaggttctgaaacacagtagagaatgaccacagagatctataccaaatgctttctgatcctaaactaattatggactttggattctctttca

SEQ ID NO: 26216 - DNA, 67 bp, Homo sapiens
gaagagaaggatggcaggagatggtgagctggaatgcctgcctcgctctgtgcgacatcctcccttc

SEQ ID NO: 26217 - DNA, 102 bp, Homo sapiens
ttgttttcccctggtaggcaatcaaaatcaaacagtgccagttcttttttttcaggaataactggaaatgttaccactgaaagcctaagaagtgggattcag

SEQ ID NO: 26218 - DNA, 66 bp, Homo sapiens
ctcactgtgtctgtatctctgaaggacagtggagccacagctgctccccagggatggactggtgag

SEQ ID NO: 26219 - DNA, 86 bp, Homo sapiens
atacatatatatatgtgtgtgtgtgtgtgtgtatatatatatatatatatacacacacacacacacacacacatatatatatgtat

SEQ ID NO: 26220 - DNA, 95 bp, Homo sapiens
gcctccctgttggtttccactctgacaagacagactgctcttcctaccccatctgttgttggagggtttgttattcagtggtacccttagtaggc

SEQ ID NO: 26221 - DNA, 58 bp, Homo sapiens
tgagacagagtctcactctatcacccaggttggagtgcaatggcatgatctctgctca

SEQ ID NO: 26222 - DNA, 114 bp, Homo sapiens
gaaaatatctgtggatgtttatggatggtatatgtatttatgtgtgagtatgtattacacacacacacacacatttatatccataaaatctaagctcataatttcaatagatat

SEQ ID NO: 26223 - DNA, 120 bp, Homo sapiens
tctgacatattagccttacgattttattttggaatgataaactaatactcaatttgtaattttcacttgaaagttgcagaataattgaatatgttctttaaaagtgtttgaatattcaga

SEQ ID NO: 26224 - DNA, 111 bp, Homo sapiens
gctgtgcatggtgacatgccctggtagtcctagctacttgggaggctgaggtaagaggatcaattgggcccaggagtttgaggttacagtgagctatgattgtgccacagc

SEQ ID NO: 26225 - DNA, 77 bp, Homo sapiens
ctacaagcctcacaggttagttgtgtggatccatgagacactgtgtgagggacacacaccacctgtcagtcttgtag

SEQ ID NO: 26226 - DNA, 119 bp, Homo sapiens
gcctgggcgacagagaccttgtcttaaaacaaacaaacaaaaaccgatggggacctctccttttgtttatttttatttatttatttgttggagacagagtttctctctctcgcccaggc

SEQ ID NO: 26227 - DNA, 75 bp, Homo sapiens
gcccatttttatggttatttcttgattatatgctaattatttagtgtttgcaaaaatagccaggctataaggggt

SEQ ID NO: 26228 - DNA, 86 bp, Homo sapiens
ggcttaccccataggaaatgtatttgtttatgtaactgaaagtccagttacataaagcccgtttacataaaaaggtagggttgacc

SEQ ID NO: 26229 - DNA, 105 bp, Homo sapiens
gccataggcagtatataaacaagtgagtctggctatgttccaataaaactttatttatagaaacagatggtggtctggccttgtttgccaacccctgacttaggc

SEQ ID NO: 26230 - DNA, 82 bp, Homo sapiens
ctttgaatactcctgccagcatgagatcaggagtcagctgtcccttactgcttctgactcagcctgtttcactgtatcagag

SEQ ID NO: 26231 - DNA, 102 bp, Homo sapiens
gtgacacatgattgtgtgtgtgcatgtatgtgtatatatatgtgtgcatgtacatatatatgtatatatatgcatgcttatatatgtgcagaaatgtgtagc

SEQ ID NO: 26232 - DNA, 58 bp, Homo sapiens
tgagacagggtctctctctgtcgcccaggctggagtgcagtggcgtgatctcggctca

SEQ ID NO: 26233 - DNA, 74 bp, Homo sapiens
gcagctggccggaccacacactcactcacatgttcgctcctgctgcaggctgagtgtgcagttgtggaggctgc

SEQ ID NO: 26234 - DNA, 61 bp, Homo sapiens
gtgttgtagaagggggccagtgtttgctttggagacaccctggactctctctctccctcac

SEQ ID NO: 26235 - DNA, 79 bp, Homo sapiens
aaaggagacagggaaatctagtgttttagttggggggcattgcccagctaaataaaattaatgtttttttttttttttt

SEQ ID NO: 26236 - DNA, 58 bp, Homo sapiens
tgagacagggtctcactctgtcacccaggctggagtgcagtggtaagatcacagctca

SEQ ID NO: 26237 - DNA, 119 bp, Homo sapiens
ggaggcatcaccatcttcttcgtgtctttgtgagaatattacttttactccattcagtgtgatgtttgctgtgtgtttccagtagctatttccatatttttcatctagtaagagtcttt

SEQ ID NO: 26238 - DNA, 56 bp, Homo sapiens
agtgcacagccagctttcttgtggatgcctgtcctgaggtctgctgggctggcgct

SEQ ID NO: 26239 - DNA, 79 bp, Homo sapiens
ctaaggtcattctgagaggtgacagtgtgctggcagccctcacagccctcgctccctctcagtgcctccctggccttgg

SEQ ID NO: 26240 - DNA, 71 bp, Homo sapiens
ttgtttttgagacagggtctcactctgtcacccaggctggagtacagtggtgagatcatagctcactgcag

SEQ ID NO: 26241 - DNA, 111 bp, Homo sapiens
agtagctaggactacaggtgcacagcactgcacatggctaacttttttttttgatatggagtcttgctctgttgcccaggctagagtgcagtagcaccatctcagctcact

SEQ ID NO: 26242 - DNA, 131 bp, Homo sapiens
tcaggggctcagggaagtgcagaggtagctgtgactccgcactgatgtgcctcgcccttctctcactctgactcttctgccaaccacatcttcaaaatcttcggggcaggggcaagtgtaggtttggagaa

SEQ ID NO: 26243 - DNA, 103 bp, Homo sapiens
tattacacatgagtcattggaatggtgagtgcaatgtaactgcatatcaaatctgtaacctcacaggcacattaactccccaaccctctctcgccttgtggtg

SEQ ID NO: 26244 - DNA, 71 bp, Homo sapiens
atgtatgtgcatatatatatatatatgtgtgtgtgtgtgtgcatacatatggtgtatatatgcatgtgtgt

SEQ ID NO: 26245 - DNA, 94 bp, Homo sapiens
atatatatacacacatatatagatgtgtgtatatatatatatatatagatgtgtgtgtatatatatatatatatatagatgtgtttatatatat

SEQ ID NO: 26246 - DNA, 106 bp, Homo sapiens
tgctatctggcagctacctgggaagggcagctggcatgtactcttttttttttttttttttttttgagacagtcttgcttgtcacccaggctagagtgcagtggca

SEQ ID NO: 26247 - DNA, 84 bp, Homo sapiens
ggagtgcatgtggaaaacaggtttctccttttaattagctttgccgctgggaggaccttctctctccactttctgtccagctct

SEQ ID NO: 26248 - DNA, 110 bp, Homo sapiens
tcccgagtagctgggactacaggcgcgggccaccatgctccactatttattttattttattttatttttgtggagacgtgggtctcgctatgtactcaggctggtctgga

SEQ ID NO: 26249 - DNA, 67 bp, Homo sapiens
ggctctgggtgtggctggctctctttctcactcagcagggaacccaagtcgccagccgaagagagcc

SEQ ID NO: 26250 - DNA, 58 bp, Homo sapiens; identical to SEQ ID NO: 884

SEQ ID NO: 26251 - DNA, 56 bp, Homo sapiens; identical to SEQ ID NO: 885

SEQ ID NO: 26252 - DNA, 111 bp, Homo sapiens
ctctatgttcttcccacagtaggcataattttttttttttttttttttgcagttgcaagatttaatagagtgaaaacagagctcccatacaaagggagggaacccaaagag

SEQ ID NO: 26253 - DNA, 72 bp, Homo sapiens
gaatgtgtgtgtgtgtgtacacgtgtatgtgattataaatattttatatgtatatatatgagatacatattt

SEQ ID NO: 26254 - DNA, 68 bp, Homo sapiens
ctgtgagttacagcttcttgatttcctcatcagtaaaatgaagagattagatgaagcaattcttatag

SEQ ID NO: 26255 - DNA, 70 bp, Homo sapiens
gaggccaggtcatggcaggaaggtgtgtcctggggaggttggccttctctcaggctctgtccctgaactc

SEQ ID NO: 26256 - DNA, 101 bp, Homo sapiens
gtggtggcaagtggctgtagtcccagctactcaggatgctgaggtggaaggatgctttgagcctgggaggttgaggctgcagtgagccaagattgcaccac

SEQ ID NO: 26257 - DNA, 58 bp, Homo sapiens; identical to SEQ ID NO: 1215

SEQ ID NO: 26258 - DNA, 92 bp, Homo sapiens
ttatcttgattaaaagtgtgtgtatatgtatatatgtgtgtataaactatacatgtatataaaactatatatgtagtttaaaagtcaagtga

SEQ ID NO: 26259 - DNA, 116 bp, Homo sapiens
ggttgttgtggtgcgcacccacctgtagtcccagctactcaggaggctgaggtgggaggatgacttgagtctgggaggttgaggctgcagtgagcttgatggcaccactgcagtcc

SEQ ID NO: 26260 - DNA, 106 bp, Homo sapiens
ttgagggcttaactgtttttggtctcatccttagaaagaaattgaaaagtgattttcttctatgatgaaaaaatagtcaaaacttgacagttgtattgatcttcaa

SEQ ID NO: 26261 - DNA, 110 bp, Homo sapiens
gggttgaataatcaaatttattttgccatttgagaccaattcttctgtgtgtatgtgcacgtgcatgtgtgcacagtggtagcagggaagggagtagtttgctttaactc

SEQ ID NO: 26262 - DNA, 62 bp, Homo sapiens
tgtgtctgtctgtgtgtctgttagtgtattttatgtgtctaacagacacacacacacacaca

SEQ ID NO: 26263 - DNA, 95 bp, Homo sapiens; identical to SEQ ID NO: 68

SEQ ID NO: 26264 - DNA, 93 bp, Homo sapiens; identical to SEQ ID NO: 69

SEQ ID NO: 26265 - DNA, 88 bp, Homo sapiens
tccctgtaccccagcctgcttgctctgacgccgtcaaatccattgagagatgctgtcagacactctgcctgtgctaggaatgcaaaga

SEQ ID NO: 26266 - DNA, 86 bp, Homo sapiens
gcatactcacatcaccctggaatgactggttttggtagagctatatttggccgtctctttcccagtctctctgttatatggtctgc

SEQ ID NO: 26267 - DNA, 72 bp, Homo sapiens
gggtggtgtgctaacaatgttggttgaattggtcaaaaatgtcattaaaagccagtctctgtcactctgccc

SEQ ID NO: 26268 - DNA, 103 bp, Homo sapiens
tatcagatatatgatttgctaacattttctgtgactctgtgggttgtttttttttatattcttgatagtgtccactgatgtgtaaaagtttttaaatttgatg

SEQ ID NO: 26269 - DNA, 108 bp, Homo sapiens
tgtccgacatccaccagaccacactccgggaaacagatgagagggagcacagggtggcccaggccccacatctggagcctgtgactgtggcctaaggcagctcggcca

SEQ ID NO: 26270 - DNA, 58 bp, Homo sapiens; identical to SEQ ID NO: 2442

SEQ ID NO: 26271 - DNA, 89 bp, Homo sapiens
gggcactgcctagtggagctgtgagaagagagccaccattcttcagaccttagaatagtatgtccactgacagcttgcactgtgtgcct

SEQ ID NO: 26272 - DNA, 56 bp, Homo sapiens
atctatgtatctatgtatcaaggcacctgcatgtgccttgagagatggattctgat

SEQ ID NO: 26273 - DNA, 103 bp, Homo sapiens
gacttctccttgtgctcatgtgagccaatttttattttattttattttattttattattattatactttaagttttagggtacatgtgcacaatgtgcaggtt

SEQ ID NO: 26274 - DNA, 122 bp, Homo sapiens
tttttctgtttttaaattttacattattctgtgacatgcctttatttttctcacatcgtaaattatttatttatgacaggttctgagggcactgatagttttatgttttccagagaaaggaa

SEQ ID NO: 26275 - DNA, 105 bp, Homo sapiens
ctgagactgaagtactggtaagtaggtctttttctattttaataagtgaaagctaaatttcagtcttcttattaatgaccttatttttgcccttcgtggattgag

SEQ ID NO: 26276 - DNA, 56 bp, Homo sapiens; identical to SEQ ID NO: 1392

SEQ ID NO: 26277 - DNA, 81 bp, Homo sapiens
ctttatttgattttatttttgacatggagtctcactctgtcactcaggcaggagtgcagctttatcaagtatatgataaag

SEQ ID NO: 26278 - DNA, 91 bp, Homo sapiens
acagagcgagactccatctcaaaaaagagtgccatctgattccaggcaggtccctaactttttttttttttgagacagagtctcactctgt

SEQ ID NO: 26279 - DNA, 82 bp, Homo sapiens
gagtgagacaccgtactcagcctgtttttattttttaaattaaaaaaattttttttagagacaaggtctcactgtgtcactc

SEQ ID NO: 26280 - DNA, 58 bp, Homo sapiens
tgagacagggtctcactctgtcacccaggttggagtgcagtgatatgatcttggctca

SEQ ID NO: 26281 - DNA, 81 bp, Homo sapiens
aggactggatgtggagtgcaggacagcaaggacaagctggaacccgctggcctctctgtgtctgtcaccacatctaaccct

SEQ ID NO: 26282 - DNA, 69 bp, Homo sapiens
tccagtttggaaggcagaggatctgagctggccttcaaggcggctctcagcctctgtctctgtctgtga

SEQ ID NO: 26283 - DNA, 77 bp, Homo sapiens
ggtaggtcacacacttagaagttgtatttcagaggataattgtcagacgtcatgactgatgagtgtgtgaacttggc

SEQ ID NO: 26284 - DNA, 83 bp, Homo sapiens
gcagggagtaagtcaaggagctaaccctgtaaactgaagcctaggagtttttttgtttttcagatagggtcttgctatgttgc

SEQ ID NO: 26285 - DNA, 58 bp, Homo sapiens
gatgcctggttggtttcagttttggttgttacactgaaactgagtggtaatcatgctc

SEQ ID NO: 26286 - DNA, 86 bp, Homo sapiens
gacatcaattgaggacttactgtatttctatctggtaatagtagctttctgtgacccactgactgattatcagaatcctcatggtc

SEQ ID NO: 26287 - DNA, 58 bp, Homo sapiens
gagttgtcccctcagaggaaaaagaatggaaacttttttttttttgagacggagtctc

SEQ ID NO: 26288 - DNA, 134 bp, Homo sapiens
agtatactttgaatctcgaattttgtgtgtgtgtcctttcgtttggaggaatcgttgttccttctagaaggtaggatagttttggatgctgggtgatgctactttagaaattgtgatgatcctggacgaaggga

SEQ ID NO: 26289 - DNA, 86 bp, Homo sapiens
gcaatgcgttgaagctgtgatggatacgtgggggtttattatataatattatccaaatatatatatatatagcttgaaatatgtgc

SEQ ID NO: 26290 - DNA, 58 bp, Homo sapiens; identical to SEQ ID NO: 47

SEQ ID NO: 26291 - DNA, 111 bp, Homo sapiens
gcttaaaggcaaagaagaccagacatggtggcctatgcctgtaatcccagcactttgggaggctgaggtaggaggatcatttgaggtcaggagttcgagaccggcctgggc

SEQ ID NO: 26292 - DNA, 71 bp, Homo sapiens
gtatgcctataatgagcagaagggagcaggcaaataattttgtcctcctctgatgtgtgtgtgtgtgcgtg

SEQ ID NO: 26293 - DNA, 94 bp, Homo sapiens
ggacattggagttgatttttttttctattagaataaagctgctgtggacattggtttacagatctttgtatcttagagtagaatgtctggatca

SEQ ID NO: 26294 - DNA, 114 bp, Homo sapiens
gtgatggcatctcatggttttgatttgcgtttttctaatgatcagtgatattgaactttttttcatgttattattagccacgtgtatgtcttcttttgagaaatgtctgttcat

SEQ ID NO: 26295 - DNA, 104 bp, Homo sapiens
ctatgtggctagttcactgtagttctaagtttatttgttgttttaatatagaaatttaagtggactttaagtattaggattattcaaaatgaacagtatgttag

SEQ ID NO: 26296 - DNA, 90 bp, Homo sapiens
tctcagaggttttgttcactctgttttgtttttttttgtttttaatttctttctaagttatttcagagagctggtctttcacctctgaga

SEQ ID NO: 26297 - DNA, 73 bp, Homo sapiens
tcctgggtctctgtgtgtgtctaagcagccgctctgccgaaacctcacatagctcagtgtattggacccagga

SEQ ID NO: 26298 - DNA, 117 bp, Homo sapiens
gtgtgcatgcccagatccagatgctgtttataggtctgctccccgggagccgtgtgtctggctctctgggtgaccttctgaaggcctgtgtagggcactgggtcgggacaggtgtcc

SEQ ID NO: 26299 - DNA, 95 bp, Homo sapiens; identical to SEQ ID NO: 68

SEQ ID NO: 26300 - DNA, 93 bp, Homo sapiens; identical to SEQ ID NO: 69

SEQ ID NO: 26301 - DNA, 95 bp, Homo sapiens; identical to SEQ ID NO: 68

SEQ ID NO: 26302 - DNA, 93 bp, Homo sapiens; identical to SEQ ID NO: 69

SEQ ID NO: 26303 - DNA, 61 bp, Homo sapiens
caggatggccacagttctgatcgcaggggatccaggaacctctcactctgtcgctctcctg

SEQ ID NO: 26304 - DNA, 172 bp, Homo sapiens
ccatattgtggcatgtgtgagtagttttttcctgttcattgctgaataatatttctttttatgaatatgaatataccatactttcacgtaagtctttttgtggccatatatttttatttcttttaggtaaataactaaaagagaaatttgtggatcatagcgtgggtgtatg

SEQ ID NO: 26305 - DNA, 63 bp, Homo sapiens
atagttctagctactgggaggctgaggaagaaggatcacttgagtccaggagttggaggctgt

SEQ ID NO: 26306 - DNA, 91 bp, Homo sapiens
gtatatatatgtatattgcatatgtgtatatatataattttgtataaatgctgtaaaatgtgtgtgtgcatgtgtatgtgcatatgtgcac

SEQ ID NO: 26307 - DNA, 64 bp, Homo sapiens
gatagagagtgttccacttgtgaagaatcttttttttttttttgcaatggagtctcactctgtc

SEQ ID NO: 26308 - DNA, 73 bp, Homo sapiens
gggtctcactgtcactcaggctggagtggaatggtgtgataataactcactgcagccttgacctcctgggctc

SEQ ID NO: 26309 - DNA, 88 bp, Homo sapiens
tgattgtaggagggagagctctgttactccatgagtgcaggctgctgtagctgatgtttataacaaagtttttgtaatgatgttatca

SEQ ID NO: 26310 - DNA, 110 bp, Homo sapiens
tatggaattagtagttatttaatatatatcactttggaatattcaacaattgaatatatctttataatagcagtgattataactgtattataattatttaaatgtccatg

SEQ ID NO: 26311 - DNA, 89 bp, Homo sapiens
ctctgcagtgtacaaagcatcgtcactcactctctcaggtgggccttgcagtaggctggtgagggagagagacaggctgagatttagag

SEQ ID NO: 26312 - DNA, 82 bp, Homo sapiens
gagatggagtctcactctgtcactcaggctggagtgcagtggcgagatctcggctctctacaacctctgtctcctgggttca

SEQ ID NO: 26313 - DNA, 89 bp, Homo sapiens
gccaaatctacggaactttaaattattgatgctttctaatttttaattattttgaggtttgtgtaagctgaagctttaggagatttggc

SEQ ID NO: 26314 - DNA, 84 bp, Homo sapiens
tcaaggagagtgggaagaagtgcaggtaaaaaggggcacaccatgactgcctctctctgtatctcaaagtcttgcttacactga

SEQ ID NO: 26315 - DNA, 105 bp, Homo sapiens
tagcagaagtaaatgtgcaaactgtacctataatatggtctttttttttctttgtttttattattatactttgttttagggtacatgtgcacaatgtgcaggtta

SEQ ID NO: 26316 - DNA, 84 bp, Homo sapiens
ctttctctctcacacacacattcacagacacacagaacatttaaatatggtttctgtgtgtgtgtgtgggcacatatgtgaaag

SEQ ID NO: 26317 - DNA, 72 bp, Homo sapiens
agactggcgaaagtctagctctgttcttaaccagttgggtgactttggactagacacacgctctctgggtct

SEQ ID NO: 26318 - DNA, 95 bp, Homo sapiens
gtgttgtttggagtaatcgtctctgaagacagagagggctcctacatttcccgcagggccttctcgtgtcctctttggcactcaataaatgagac

SEQ ID NO: 26319 - DNA, 173 bp, Homo sapiens
tgtctgtatttatgccttttctcttgtactacagaaagctcttcgaaggtacggttcagatcactgtcagctttgaagttcctttaattggtacaagcacacacacacccacacacactgcattccacatacccatatacacacatgtgcgatgagggaagtgtgtgtgtttg

SEQ ID NO: 26320 - DNA, 89 bp, Homo sapiens
tccattgtctatgatccacacatctgtctctgttatggccactggattgtgctacttaatcctgtcagagtgtcttctcagggaaggga

SEQ ID NO: 26321 - DNA, 110 bp, Homo sapiens
ccatttgcacaatttcatcaaatatggatatgttggtttcagattatctttataatttttgaagaatctttagaagttagacatacaattttaggatgaaattctaatgg

SEQ ID NO: 26322 - DNA, 96 bp, Homo sapiens
atgaatttgtatgaatcagagaggaaagtgaggtcacatgtggaaaattaacaaggaaaaagcacatacttcctccatctttgagggaaaatttat

SEQ ID NO: 26323 - DNA, 111 bp, Homo sapiens
attagcatgaataatcaaaatttctgtgtcattctaaaataaacttgtgggactagaagaaatctttattttttgattgacagaagaaatcttattgattgattttctaat

SEQ ID NO: 26324 - DNA, 95 bp, Homo sapiens
catacatatattatatatatgtgtgtgtgtgtttatatatatatatatatatgtgtatatatatatatatatatatatatatatatatgtatgag

SEQ ID NO: 26325 - DNA, 119 bp, Homo sapiens
gtgtcacattttggcaattcttgcaatgtttcaaactttttcattattattttatctgttcttgtgatctgtgatcggtgaacatttatgttaccattgtaattgttttggggtgccac

SEQ ID NO: 26326 - DNA, 157 bp, Homo sapiens
tatatatatattctatatatatatattctatatatgtattctgtatatatattctatatatattctatatatatattctgtatatatatattctgtatatatattctgtatatatatattctgtatatatattctgtatatatatatatatatatag

SEQ ID NO: 26327 - DNA, 109 bp, Homo sapiens
tcaaagctcattagtaagaaaacatccatttgtgatgggtatttttatgttatttatctaataaaacataaaaacataaatcacctggctttcataatgttagatttga

SEQ ID NO: 26328 - DNA, 58 bp, Homo sapiens; identical to SEQ ID NO: 1215

SEQ ID NO: 26329 - DNA, 69 bp, Homo sapiens
ccgtctgtctgtctatgactgtctagttgtcccttcgactgctcaggcaaagtttgagacatctagggg

SEQ ID NO: 26330 - DNA, 117 bp, Homo sapiens
catataaactcaagaggataaaaattctaattgcattccaattattgatgaagttttttttaattgtttatgctatcagtgggaatttgatttgttttaaaacttgatgttcatatg

SEQ ID NO: 26331 - DNA, 58 bp, Homo sapiens; identical to SEQ ID NO: 1265

SEQ ID NO: 26332 - DNA, 107 bp, Homo sapiens
cttgctccagaggtttctgcagaaggggagatagaatgtaaactagtaggtaaataaaacatagtttgcagactgcacttctagaaatggatgcagagggctgcagg

SEQ ID NO: 26333 - DNA, 160 bp, Homo sapiens
ggctgtgagggtgcctggtcaccgagcctgtctctgtgtggctgtgagggtgtctggtcaccgagcctgtctctttgtggctgtgagggtgcctggtcaccgagcctgtctctgtgtggctgtgagggtgcctggtcaccgagcctgtctctgtgtggct

SEQ ID NO: 26334 - DNA, 78 bp, Homo sapiens
agccatgtatatttttttaagtagaatgaaaattggggtgtcaaaaattaccttaattttcaccttgagatattggct

SEQ ID NO: 26335 - DNA, 103 bp, Homo sapiens
ctatgaactattaatgagtcgatgaaatatcagtggctatcatagtttatttttcaatatgaagagaaactgatattttatctggtgttaattaaaatattag

SEQ ID NO: 26336 - DNA, 116 bp, Homo sapiens
cgtgtgtgtgtgtgtgcataaaatatgtgtatgtgtgtatatatatgtaaatacatttatatatataatatatcaaatatagacatttctgctatttatgcattcatgaaaaatat

SEQ ID NO: 26337 - DNA, 69 bp, Homo sapiens
acagaaagagttaagatgtatgtatatatgacaaccaatgtatgcatatatttctataattatttttgt

SEQ ID NO: 26338 - DNA, 87 bp, Homo sapiens
ttagtttagctctatatttgtgtatatatgtacatgtatttagtatatatgtgacatatatgtacacagtatatgtatctgcattaa

SEQ ID NO: 26339 - DNA, 79 bp, Homo sapiens
tgtgtatatatacgtgtgtgtatataagtgtatatatatgtgtgtatatatatatatacacacacactgtagtagaaca

SEQ ID NO: 26340 - DNA, 77 bp, Homo sapiens
tgttctactacagtgtgtgtgtatatatatatatacacacatatatatacacttatatacacacacgtatatataca

SEQ ID NO: 26341 - DNA, 58 bp, Homo sapiens; identical to SEQ ID NO: 1435

SEQ ID NO: 26342 - DNA, 109 bp, Homo sapiens
cttttgagaattgtctattcatgtccttagtccacattttgatgggattttatttttttttctgatttgagttcgctgtagattctggataatagtcttttgtcagaag

SEQ ID NO: 26343 - DNA, 96 bp, Homo sapiens
ttatcagatatatacaagccatttaagtgcttggaaatagtttgtttattaattcagacaacccaagtacttggaaagaaagtataaatttaatga

SEQ ID NO: 26344 - DNA, 83 bp, Homo sapiens
aaggattggacatggactattagaaacagaaaatggttgtcccatctctctcaatttctgactgtcctatttgcataattctt

SEQ ID NO: 26345 - DNA, 72 bp, Homo sapiens
tggttcaagctttgtgtgtgtacgtacatgactattttgcatatattatgtatatatacaattctttagcta

SEQ ID NO: 26346 - DNA, 58 bp, Homo sapiens; identical to SEQ ID NO: 22836

SEQ ID NO: 26347 - DNA, 100 bp, Homo sapiens
attgtctgtgctaatttataactctatgggggcattggttaatttttagatttttgtttagtaaagatgtgaataatttctgtctaatagaacagataat

SEQ ID NO: 26348 - DNA, 118 bp, Homo sapiens
ccagctttgttctttttgcttaggattgtcttggctatgtgggcacttttttggttccatatgaaatttaaagtagttttttccaattctgtgaagaaagtcagtggtagcttgatgg

SEQ ID NO: 26349 - DNA, 107 bp, Homo sapiens
ttgaaaaaagaacaggataagagcaatgttcaggaacaagggagataactttaaagtctggctgcctgtgggccgggtggaacagagccatatttctcttctttcaa

SEQ ID NO: 26350 - DNA, 116 bp, Homo sapiens
tggataaggatagaggtagtgacgttggaaagaagaaaaataattttattttatttttattatttttaaaattattttatttcatttcatgttagacagggtctctctgttgtcca

SEQ ID NO: 26351 - DNA, 93 bp, Homo sapiens
gctctcagtttggctgttgctggtgtaaggaatgctagtaatttttttacattgattttgtactccgcaactttgctgaagttgtttatcagc

SEQ ID NO: 26352 - DNA, 95 bp, Homo sapiens; identical to SEQ ID NO: 68

SEQ ID NO: 26353 - DNA, 93 bp, Homo sapiens; identical to SEQ ID NO: 69

SEQ ID NO: 26354 - DNA, 85 bp, Homo sapiens
atgcttttgacatttttgcccctgacacatttttaaaaggtgtttgaaaatatatttaaagattagttaggggtttcaaaagtat

SEQ ID NO: 26355 - DNA, 98 bp, Homo sapiens
ggccggttggctgttttttgaaacagggtctcactctgtcacccaggctggagtgcagtggtgtgatcttggttcactgcaacctctgcctcctgggc

SEQ ID NO: 26356 - DNA, 139 bp, Homo sapiens
ttgtgtatatatacatctatatacaaatatgcaaatatatgtattagtatatatacacaaatacgtatatacaaatgtatatatttgtatatatgcaaacatatatatatatttgcattggttgtatgatatagtaggt

SEQ ID NO: 26357 - DNA, 76 bp, Homo sapiens
acagagttaactgacttgtgtgggagaggaactgacctatttttttttttttttttgagacagagtctcgctctgt

SEQ ID NO: 26358 - DNA, 99 bp, Homo sapiens
tgtgtgtatgcatatatataacatataatatacatattatatagatgtatgtgtgtatatatatgtgtgtgtatatgtatatgtgtgtgtctatatata

SEQ ID NO: 26359 - DNA, 81 bp, Homo sapiens
acatatcctatatataattatatgtatgaatttattgaatccgtcgataatttatatgtatacttgtatataaatccatgt

SEQ ID NO: 26360 - DNA, 116 bp, Homo sapiens
aatagattgtttttcatggtgatatgaattagcaattctgaaactattttatatatatttcaggattgaacaaatggttaatatattgataatcatgggaaccagacatctctgtt

SEQ ID NO: 26361 - DNA, 89 bp, Homo sapiens
tttcactccccagaatctggatctgcatgtgctggagctggccaattcttaaactgtaggctgcctgatgtcatgttgcgggcttgaaa

SEQ ID NO: 26362 - DNA, 114 bp, Homo sapiens
gataagcagaagttcttcctattaatctaggtgagcttagcattgtttaaaaatttatagttaatattttctctattctgagttcacaaagattattttctatattttgctctc

SEQ ID NO: 26363 - DNA, 109 bp, Homo sapiens
tatatgtatatatccaagtatttatttttcctaaacttttgaaaatatatataatacattatatataacatattttaaatatatagaaaaaatagtgtgtatacatata

SEQ ID NO: 26364 - DNA, 70 bp, Homo sapiens
atgtttgagcgtaaagtgagcatgtattaatgagtaatttcattatatatatcagttttacctcttgcat

SEQ ID NO: 26365 - DNA, 79 bp, Homo sapiens
ggtgagatttgagtagagacacagtcaaatctgtagtaaatgtgtggatttatttctgagttctctgttgggttccact

SEQ ID NO: 26366 - DNA, 76 bp, Homo sapiens
ttggcagggacaagtgagagacgagtgagtgcttacgggaaaaagcttaagttgtctgttccctcttcattgctga

SEQ ID NO: 26367 - DNA, 90 bp, Homo sapiens
ccaacgattttatgacaaaggaatgcatttaagtatataactgtatgttatatcattttctatgtattattttggccattgttattgtgg

SEQ ID NO: 26368 - DNA, 72 bp, Homo sapiens
tacttttggcaagaactgagatacagaaaagttagataatttgccataggtcacagaattttgtcagaagta

SEQ ID NO: 26369 - DNA, 80 bp, Homo sapiens
acctcttaaatatagatatatgtatgcgtgtgtgtgtgtatatatatatatatatgcatacataatacatatagaaaggt

SEQ ID NO: 26370 - DNA, 173 bp, Homo sapiens
tatatatagtatatatagtatagtatagtatgtatctaaatatactatataactatatgtctatatatagatatttatatctatatatagagatctatatatagatatataatatacctatatatctgctgtctatatctatatatgctatatatatctatatatgctatgta

SEQ ID NO: 26371 - DNA, 91 bp, Homo sapiens
gaacggtataatcaggcggtttggggtattttttcaaatgacaacgagctaagatgttttgagaaggatggctcagaataagcttctgttt

SEQ ID NO: 26372 - DNA, 72 bp, Homo sapiens
ccagagtgtgacgctgacactctgagttgcgaccacctctcctgggtcactttgggtgttggctcgctttgg

SEQ ID NO: 26373 - DNA, 291 bp, Homo sapiens
acatttgtgcatgtatatatatatatatatatatatgtattatatatacgtatatatgtatatatgtgtatatacatatatgtatatatgtgtatatacatatatgtatatatgtgtatatacatatatgcatatatgtgtatatatacatatatacatgtatacgtatatatacgtatatgtgtatatgtatatatacatatacgtatatgtgtatatatacgtatatgtatatgtatatatacgtatatgtatatatacacatataggtatatatatgtatatatattc

SEQ ID NO: 26374 - DNA, 95 bp, Homo sapiens
gctcctggcgggtggggtgaggccttaggtggtgggtgcaggtgggacaagcccactgaagtcagagagctcaccctgaggatgcgctagagagc

SEQ ID NO: 26375 - DNA, 107 bp, Homo sapiens
tatatacgtatatatacatatgtgcgtatatacgtatatatacatatgtgtgtatatatgtatatatacatatgtgtgtacatatatacacttatttacacaggtgt

SEQ ID NO: 26376 - DNA, 59 bp, Homo sapiens
gtgatagacctttcgaggcagagggacattagcactcatctgtctctgagagcggtcac

SEQ ID NO: 26377 - DNA, 118 bp, Homo sapiens
ccagctttgttctttttgcctaggattgtcttggctatgtgggctcttttttggttccatatgaaatttaaagtagttttttccaattctgggaagaaagtcagtggtagcttgatgg

SEQ ID NO: 26378 - DNA, 79 bp, Homo sapiens
gagaacctggtacttgccttgagggatggtttttacatttttttaaaagctgtaatacaaaaggcaaaggacaggtggc

SEQ ID NO: 26379 - DNA, 96 bp, Homo sapiens
tggtagagttccatataaatatgtgtgatacatatatatatataatatatataataatatatatatgtatctctcaagtctgtctggagtaaatca

SEQ ID NO: 26380 - DNA, 58 bp, Homo sapiens; identical to SEQ ID NO: 1101

SEQ ID NO: 26381 - DNA, 56 bp, Homo sapiens; identical to SEQ ID NO: 1102

SEQ ID NO: 26382 - DNA, 93 bp, Homo sapiens
ggtttgcaggctgctgctcattcaaggttgagccctgagtttctcactgtctgaaggaatagagaccttgtttagaagcagtgccagtgagct

SEQ ID NO: 26383 - DNA, 111 bp, Homo sapiens
ggcgaaggaagggcgggtggctgtggagtagtgggtcctggggcatcacaagagtgagtgagcagagcagcgacagcaggactagaacatgaggaccttgtccactgagcc

SEQ ID NO: 26384 - DNA, 86 bp, Homo sapiens
ccttgcattctctccctctgtgtatgtcaacatttatatttgtctatatctatatacacacagatctaaaggtagagatgaaaagg

SEQ ID NO: 26385 - DNA, 103 bp, Homo sapiens
accagcttgggtaacatagcgagaccccgtatctacaaatttttttttttttttttttttttttttttgagacagagtcttgctctgtcacccaggctagagt

SEQ ID NO: 26386 - DNA, 99 bp, Homo sapiens
gaagaggtccttcatgtcccttgtaaattggattcctaggtattttattttctttgaagcaattgtgaatgggagttcactcatgatttggctctgttt

SEQ ID NO: 26387 - DNA, 83 bp, Homo sapiens
gcttcttcccagatctatatttttataattaagtcattatactcaaatgattcttcagtttaaaaaaaaatctggggccaggc

SEQ ID NO: 26388 - DNA, 95 bp, Homo sapiens; identical to SEQ ID NO: 68

SEQ ID NO: 26389 - DNA, 93 bp, Homo sapiens; identical to SEQ ID NO: 69

SEQ ID NO: 26390 - DNA, 103 bp, Homo sapiens
gcttgattgtggtaatcatttcacaatgtgtgtatatatacacaatatacaaacatgtgtgtatatatatatctgtaaatgtatactttttcatcaattatgc

SEQ ID NO: 26391 - DNA, 77 bp, Homo sapiens
tgtgaaaatagcatgcgtagctgagcctcgggccaatttgtgtctttgtactcagcacacacactctgtctttcaca

SEQ ID NO: 26392 - DNA, 77 bp, Homo sapiens
gagtatctgggactataggtgcaggccactgtacgtgcgtgcgtgtgtatgtgtgtgtgtgtctgtgcgaccatgcc

SEQ ID NO: 26393 - DNA, 97 bp, Homo sapiens
gtgtgacagtgggacttattttcaaatgtaatatcatatatatgaatatatgtatttatatatgtgtataagcagatcaaagcagagcccattcacc

SEQ ID NO: 26394 - DNA, 96 bp, Homo sapiens
tgtcctgtcctgtcctttcctgtctgtccatgtctcgctctgtcgcccagtctggagtgcagtggtggaatcttggcttactgcagcctcggttca

SEQ ID NO: 26395 - DNA, 72 bp, Homo sapiens
gtgtgtatacatgtgtgtggtttacatttgcatttgtgtgtgttgtgtttatatatgtatgtgtgtgtgtat

SEQ ID NO: 26396 - DNA, 98 bp, Homo sapiens
tgttttggataactcatgtaatcagtgagatattcttaaacaaatgtttttgtttttattatgtcttattaagatggttaatagttatctataagaca

SEQ ID NO: 26397 - DNA, 83 bp, Homo sapiens
gctatgtaggtcagttaatgtatttcttagttttgttactacaaactacaaagtcgtatgtctagcattggacttatatatgc

SEQ ID NO: 26398 - DNA, 112 bp, Homo sapiens
ctggaaaggcggctgaagccagggagccaagttgtctcgctcagtgagtcccactcccatggagctcatcgagctaagaaccactggtttgaaattttcgctgtcagcacag

SEQ ID NO: 26399 - DNA, 88 bp, Homo sapiens
gggcatagattcatgtttctattttttcacaacatatttagcacttaataaatatttattgaatgaacagatgcatttctggaggtcc

SEQ ID NO: 26400 - DNA, 123 bp, Homo sapiens
gtgatagaccttggacttctcgaaatatatatatgtaattaatatatatatatatatatatatatatatatatatatatatatattttttttttttttttttgagacggtgtctcactctgtc

SEQ ID NO: 26401 - DNA, 114 bp, Homo sapiens
gaaacacctccttcttcccatgaaaaagtggcctctgggcaggagataccagggggcagagctctgtgtgtgtctcctggcttgtctgcaatggcaagaggaagtgtgtgtgtc

SEQ ID NO: 26402 - DNA, 81 bp, Homo sapiens
ctgatgtctctaaagtcactccatgatgaaagggcaaaaacggatgagttcagaaaattgtgagaagactggaaacgtcag

SEQ ID NO: 26403 - DNA, 81 bp, Homo sapiens
tccacctaggatgctctctgattctctggcaatcactctggctgtggcttgcagaagactctggagcactccttggcaggg

SEQ ID NO: 26404 - DNA, 111 bp, Homo sapiens
ggatgaacaccaacagattctaagcgttatgctatatggaatgaatggaagaaagaccagaaggccagaataaaagggctcaggaataaaggaaatctgaaggttgaatct

SEQ ID NO: 26405 - DNA, 80 bp, Homo sapiens
gcgtatatatatgcatatatatgcatatatatatgcgtatatatgtgtatatgtatgcgtatatatgcgtatatatacgc

SEQ ID NO: 26406 - DNA, 105 bp, Homo sapiens
cttagcagaaaccaggcccctctcaaaattcgaacctatggaatttcataaattttataaaggttgtttagttttgggaagggctattatcattcttgctttaag

SEQ ID NO: 26407 - DNA, 80 bp, Homo sapiens
caccatcttgatcctgggctttgaggctccagaactgtgagaaaatacattctgttgtttcagtcactcagtctgtggtg

SEQ ID NO: 26408 - DNA, 126 bp, Homo sapiens
caagctttgttctttttgcttaggattatcttggctatatgggctcttttttggttccatatgaaatttaaagtagttttttctaattctgtgaagaaagtcaaaggtagcttgatgggaatagca

SEQ ID NO: 26409 - DNA, 111 bp, Homo sapiens
gtcactctgttagcgtctcatttgggtttatattgcttttgaatgggtttgaagttatttttctgtatttattggtcttgttttccttgatgaattgtctgtaattgttgc

SEQ ID NO: 26410 - DNA, 101 bp, Homo sapiens
cagattattcttgtgcataattatggatgtatatatgtatatatacacatgcacatatatatgtatatacattcataattatgcacaacaaaaataatctg

SEQ ID NO: 26411 - DNA, 108 bp, Homo sapiens
gccttcttgcacttagaagattattgccctcataaaaatctggtaaatattcatactgttttttgatatttttattgtgtcctaatcttctgtgtgactctttgaggt

SEQ ID NO: 26412 - DNA, 105 bp, Homo sapiens
cttttctgggtaacatattttatgttcttttgaactagggattcactctgtgtgtgtgtgtgtttgtttaaaggaaagaaggagtgaaagagggaggaagggagg

SEQ ID NO: 26413 - DNA, 76 bp, Homo sapiens
ctcactctctctgtctgggtgtcaagaggagaagctggttctccctcgtgcttgttccacacatgaaagttctgag

SEQ ID NO: 26414 - DNA, 95 bp, Homo sapiens; identical to SEQ ID NO: 68

SEQ ID NO: 26415 - DNA, 93 bp, Homo sapiens; identical to SEQ ID NO: 69

SEQ ID NO: 26416 - DNA, 57 bp, Homo sapiens
tgagatgtgtctcgctctgtcacccaggctggagtgcagtggcgagatctcagctca

SEQ ID NO: 26417 - DNA, 96 bp, Homo sapiens
cattgagacttgctttgtggacaaacatagtctcttctggagagtattccatgtaaactttagaagaatgtgtgttctgctttgtttgaaaaaatg

SEQ ID NO: 26418 - DNA, 115 bp, Homo sapiens
ctgttccttactctttccgtaactccactgacccagactcactctctctatctttactgattggttaatgtagggagtggaggtaggagtgggatgatgaaacaggagagagcag

SEQ ID NO: 26419 - DNA, 96 bp, Homo sapiens
gactttgttgttttgctaaatagctatatatatgtgtatgtatgtatatatatgaaattgttttgctattaacaaaatgggtaagataccacagtc

SEQ ID NO: 26420 - DNA, 80 bp, Homo sapiens
acatgtctgtagtgcagctacaataatttattgtttaaaacaatgataatttattgtgtcgcctgggtactgggcattgt

SEQ ID NO: 26421 - DNA, 76 bp, Homo sapiens
agtacatcgtatttattatttgatgaagtacatgatatatatcatttatttcattatttataccataggatgaact

SEQ ID NO: 26422 - DNA, 112 bp, Homo sapiens
ggtatggtccacggctagttcttcacaatggcatgtgagtggaagtgatgtgtttcacttcacttcaaaccagggctttgagagacagagagagagtcttgctccgttatcc

SEQ ID NO: 26423 - DNA, 109 bp, Homo sapiens
gtggaggaggcgtagagaaattactaaggaggaaaggaaactatattgaatattctgtttatatatatagtctcacttaattttcacaagcattttgtgcccattttac

SEQ ID NO: 26424 - DNA, 115 bp, Homo sapiens
ccttgaagaggtcattcacgtcccttgtaagttggattcctaagtattttattttctttgaagcaattgtgaatgggagttcactcatgatttggctctgtttgtctgttattgg

SEQ ID NO: 26425 - DNA, 95 bp, Homo sapiens; identical to SEQ ID NO: 68

SEQ ID NO: 26426 - DNA, 93 bp, Homo sapiens; identical to SEQ ID NO: 69

SEQ ID NO: 26427 - DNA, 68 bp, Homo sapiens
atatatgcatttcatatatatttatagatatatttcatatatatgggtgtgtatgtgagtgtgtgtgt

SEQ ID NO: 26428 - DNA, 103 bp, Homo sapiens
cccatgcaggggaggagcctccattctcagaacacagagaggtgagatgacctggtttgtgggctggccagggaacagggcatgcctcctttctctggaaggg

SEQ ID NO: 26429 - DNA, 83 bp, Homo sapiens
tcagttctttcttgagagagagagagagacacctatcactgcaggaaagccagtggtttaatctgttctttcttgagaactga

SEQ ID NO: 26430 - DNA, 91 bp, Homo sapiens
gcttatgtctttatatatactacctaatacgtgtgtgtgtgtatgctttctaatatatacttatatatgtaagtgtatccataatatatgc

SEQ ID NO: 26431 - DNA, 289 bp, Homo sapiens
tacttggtcattatatatatatgtatatatatgtgtatatatatacacatgtatatatatgtgtatatatatacacatgtatatatatgtgtatatatatacatgtatatgtgtatatatatacatgtatatatatgtgtatatatacatgtatatatatgtgtatatatatacatgtatatatatgtgtatatatatacatgtatatatatgtgtatatatatacatgtatatatatgtgtatatatatacatgtatatatatgtgtatatatacatatacacacaca

SEQ ID NO: 26432 - DNA, 79 bp, Homo sapiens
cagtgtctcactgtgtcactcaggctggagtgcagtgtcacaatcatggcttactgcagtcttgacctcgtgggctctg

SEQ ID NO: 26433 - DNA, 116 bp, Homo sapiens
gaaataataaaaggtatttttaaaatgtcatcaagtctctatatatatgtgcatgtgtgtatatacatatatatatatggcactgtgtcagacattattcagaatagattattagc

SEQ ID NO: 26434 - DNA, 121 bp, Homo sapiens
tatgtgtatatatatgtgtgtatatatatatgtgtgtgtatatatgtgtgtgtgtatatatatatacatatatatacatatatatatatacatgtatatatatatatacacgtattcttgc

SEQ ID NO: 26435 - DNA, 67 bp, Homo sapiens
atctaaatgtgtacatatatgtttgtatatgtatattgatgcatatatgagcatgttatgcatagat

SEQ ID NO: 26436 - DNA, 118 bp, Homo sapiens
tatccatgaatggatgagtaaagtatatatatatatccagtcatccatacacacacacacacacacacacacacacacacacacacacacactttatccagtcattcattcatggata

SEQ ID NO: 26437 - DNA, 120 bp, Homo sapiens
aaatgtactgaatttgtagattgattctgtatcctgccattttactgaatttgtttataagttctaagagtttttatgggggagtttttaagagttttaaatacatatatcacttcattt

SEQ ID NO: 26438 - DNA, 62 bp, Homo sapiens
tggagtaggtagagtgtcactcttttttttttttttgagatcgagtctcgctctgtcaccca

SEQ ID NO: 26439 - DNA, 84 bp, Homo sapiens
agctgataaacttttccttgagctatatatgtattttttaaacaaatgaagggatacaatgtattgcttggtgaaaaaacagtt

SEQ ID NO: 26440 - DNA, 88 bp, Homo sapiens
ttttttgtggttccttatgacttttaaagtactttttttctaattctgtgaagaatgactttggtagttttataggaatagcattgaa

SEQ ID NO: 26441 - DNA, 58 bp, Homo sapiens
tgagactgagtctcgctctgtcacccaggctggagtgcagtggcacgatctcagctca

SEQ ID NO: 26442 - DNA, 98 bp, Homo sapiens
tcactttatgtttttttgctaatgacattacttgctgtttattttatatttattttagacaatggaaatgatgttagacaaaaagcaaattctagtga

SEQ ID NO: 26443 - DNA, 103 bp, Homo sapiens
ttgtagatagtggatattagttctttgttggatgtaaagtttgcaaattttttttccaattctgtagactgtttattcaatatttctttgctgtgcagaatct

SEQ ID NO: 26444 - DNA, 85 bp, Homo sapiens
gtgtgtgtgtgtatatatatatctcatatatatgtgtgtgtatatatatgtgtgtgtgtgtgtatatatatatatatacacacac

SEQ ID NO: 26445 - DNA, 113 bp, Homo sapiens
tatacgtaattatatatatgtgtgtatatatattcatatatatgtgtatatatattcatatatatgtgtatatatattcatatatatatgtgtgtgtgtatatatatatatat

SEQ ID NO: 26446 - DNA, 110 bp, Homo sapiens
gcctgtcaactgatgtatatatgtatatgtgtgtgtatatatgtatatataacatatataatacatatatgtataatttgtctacattatgtaactaagattgaaattgc

SEQ ID NO: 26447 - DNA, 134 bp, Homo sapiens
tatatatgtatacttacacatatatacatacgtgtaatatgtatgtgtatatgtatgtttatatatgtgtatatgtatgtatatatgtatatatgtatatgtgtgtatatgtatatatgtgaaatacacatata

SEQ ID NO: 26448 - DNA, 109 bp, Homo sapiens
acccaacatggttaagatggtggtttttaggttatgcctgggtacaaggatgaatagttcacatcctttcaaagcccacacaacttcctcatttacaatcttactgggt

SEQ ID NO: 26449 - DNA, 117 bp, Homo sapiens
gtctcagttttaactatcactacatgaaaagagttgattgaatttctgatacatacatttttattaatgtatccaatagcaaatttaaaatggtacattgagggtggttgtgatggc

SEQ ID NO: 26450 - DNA, 88 bp, Homo sapiens
agatgattttattcagcagcagctctcatcagcagcctactctcacactgtctgccctgtctcagctgcttagtccagtgactcatct

SEQ ID NO: 26451 - DNA, 114 bp, Homo sapiens
ttaatgcttgcaatatttacaaatagaatttgaaaagacatgtttatttcattgttttaaatgcgcagaggtagatatgttttaaattaattgtcttatgtttgggagcactag

SEQ ID NO: 26452 - DNA, 95 bp, Homo sapiens; identical to SEQ ID NO: 68

SEQ ID NO: 26453 - DNA, 93 bp, Homo sapiens; identical to SEQ ID NO: 69

SEQ ID NO: 26454 - DNA, 68 bp, Homo sapiens
atatatgcatgcatgtgtgtatatatatatgtgaacatatatgtgtgtatatttatgcatgtatatat

SEQ ID NO: 26455 - DNA, 116 bp, Homo sapiens
ctgtgcgttagctctttagtttaattaagtcccatttatctattttttattttggtcatctcaccagaagtgtattaaaaggcttgagaaaagattgtgagcagtgtcaaccatgg

SEQ ID NO: 26456 - DNA, 67 bp, Homo sapiens
gtggtgctagcttgtatagtatgtcctccacagagataactcatacacttcaggcagactagcccac

SEQ ID NO: 26457 - DNA, 94 bp, Homo sapiens
cacagattctgattattttaattgcaggtatgctaatcaaaacaaaaaaattctatgtttataattttgtgtgctgcattgtcagtttctgatg

SEQ ID NO: 26458 - DNA, 105 bp, Homo sapiens
gagggtgttggggttgtgacaagtgtacagatgtgattttggtgtttatgctggaggcaagtatggtttgggtggcttctgattaaaggtaaactctccagtctt

SEQ ID NO: 26459 - DNA, 58 bp, Homo sapiens
tgagatggagtctctctctgtcaccctggctggagtgcagtggggcgatctcagctca

SEQ ID NO: 26460 - DNA, 114 bp, Homo sapiens
gctgtcttatctgtgttttactgtctgctctttttggctgcttgttgttagaagagaagtgatttccttgaaatgcatgaggttagaaagggagctggaacttaaagtggcagt

SEQ ID NO: 26461 - DNA, 87 bp, Homo sapiens
gtagacatagatgtagatgaatgatcaagtaaaagtatatatatgtatatgcatttatatgtcaaatatatctatatatatacctac

SEQ ID NO: 26462 - DNA, 90 bp, Homo sapiens
atgacattcttatactttaggtgccttaaatctgagggtcacatatttctgtaagactctcagtctttcaaaagtgataactgtgtgcgt

SEQ ID NO: 26463 - DNA, 104 bp, Homo sapiens
tctgtataggtggtgggactatcaactttcttttgcatgcttaaatttatttctaatttatttgtacaagaatatgcatagcttttactatcaaaatatattga

SEQ ID NO: 26464 - DNA, 111 bp, Homo sapiens
agatacataaaggttactgatatagtttttagcaaattctctttattttttatgttttgactgtatatatttcactgagggtgttgttaggtatataaaggttatgtgttt

SEQ ID NO: 26465 - DNA, 61 bp, Homo sapiens
tctattatatatagaatatatgtatatatgttaaatttatatatgtgtctgtatgtgtaga

SEQ ID NO: 26466 - DNA, 82 bp, Homo sapiens
caactattccatgttctcactaaagtgtgggagctaataaagtgggtctcacaaagatagagagtagatagagagtagattg

SEQ ID NO: 26467 - DNA, 85 bp, Homo sapiens
tttagtatgtatatatactccagaatatatatatgtgtgtatatatatatacacgtgtgtgtgtgtgtgtgtgtgtatatttgaa

SEQ ID NO: 26468 - DNA, 110 bp, Homo sapiens
ggctggcttcttttacatagcaatatttataagaaatttatatatatttttgtggcttgataacttatttttattgctgaataatattatgttgtatgaatgtgccagtt

SEQ ID NO: 26469 - DNA, 72 bp, Homo sapiens
gcagctaggggtctgagccactcacagacaccaaggaaggtgctatagtcagcagccatgacttcaacttgc

SEQ ID NO: 26470 - DNA, 68 bp, Homo sapiens
tatatatatgtatatatattcacacacatatatatgtatatgtgtgtgtgtgtacatacacatatata

SEQ ID NO: 26471 - DNA, 88 bp, Homo sapiens
caatatattttaggatgtttacattagtatttttttcagtctgtattctgctgaaaacaatcatgatgtaaataaaaatgagatggtg

SEQ ID NO: 26472 - DNA, 117 bp, Homo sapiens
ctgactttactgtgacagtagtcactttactaacttaacatttcagattttcatgtacgaaaggtggtctaagaaatactttaaggttatttagggagctgtcattagatgaagcag

SEQ ID NO: 26473 - DNA, 62 bp, Homo sapiens
atatatacatatgtagatacatatatatgtagatatatatgtgtatatatatatgtgtgtat

SEQ ID NO: 26474 - DNA, 100 bp, Homo sapiens
ggggatgtaggaagaggcaaatgagtagtttttattcagtgggtataattcaagttatgcaaattgaatgaattctagagatctgctatacaacatgtct

SEQ ID NO: 26475 - DNA, 113 bp, Homo sapiens
tatatgtatacacagttgttgtatatgcatatctttgtatatgtatttgtgtatatttttttatatgtatacacaaatatgtatacatgcatacacttttttgtatacatata

SEQ ID NO: 26476 - DNA, 84 bp, Homo sapiens
tggggtttttttgggaggacggagtctcgctctgtcgctcaggctggagtgcagtggcgagatcttggctccaggcatgttcca

SEQ ID NO: 26477 - DNA, 92 bp, Homo sapiens
gtataaaaggcgtagcaattcattgttctagaagttttttggttgttttttgtttttttagagtcaatgtcttgctctgtcacccagggtgc

SEQ ID NO: 26478 - DNA, 78 bp, Homo sapiens
accttatcttattgatagtttttgtaatccccatgttttggggggcagatagaatggggtaaaaaaaaagaatggggt

SEQ ID NO: 26479 - DNA, 112 bp, Homo sapiens
taatatatttaacatggtggcatagctattttgtagtttttttctatattctcaaatggagaaaatgattagaattaacctacagaaagtaatattatttaccaatatatta

SEQ ID NO: 26480 - DNA, 95 bp, Homo sapiens
ctggtagagatgattagataattttattgaatatattcatttcctttaagataaggaaattgagactcaaaaagattgtttgacttctcttatag

SEQ ID NO: 26481 - DNA, 107 bp, Homo sapiens
acatgggagttcaaatgtattaaaatcatctgactttgtagttgagttttaataagtaattcacagtgcaaaacacctgattataagtcaatttgactacccatagt

SEQ ID NO: 26482 - DNA, 114 bp, Homo sapiens
gtactttgtaaactagaatgctctattcaaatataaatttttaatattcttttaataatttatattaggattaaaaataaacttgatcattttggataatttataacattgtgc

SEQ ID NO: 26483 - DNA, 101 bp, Homo sapiens
taatggtattactgggttgaatggtagttctaagttctttgagaaattgcaaaactgcttttcacagtggctgaactaatttacactcatgccagccgttg

SEQ ID NO: 26484 - DNA, 107 bp, Homo sapiens
gtgttcaatacatgtaaatatgggtttgtttgtatatttatttattctttattggagtacttataaagtcaaagacaaattataatagcctcatgttatgatctcat

SEQ ID NO: 26485 - DNA, 95 bp, Homo sapiens; identical to SEQ ID NO: 68

SEQ ID NO: 26486 - DNA, 93 bp, Homo sapiens; identical to SEQ ID NO: 69

SEQ ID NO: 26487 - DNA, 59 bp, Homo sapiens
atatatgtgtgtgtgtgatatatatgtatatatacatatatatacacacacacatatat

SEQ ID NO: 26488 - DNA, 114 bp, Homo sapiens
ttgctttggttatgcaggctcttttttggttccatatgaattttagaattgtttttttctaattctgtgaagagtgatgttggtattttgatggggattgcattaaatttgtag

SEQ ID NO: 26489 - DNA, 92 bp, Homo sapiens
ggaagaaaaagttttctctagaagattgtggtttatatttttctactttaaatatcagccatcatttttatttatatagaggaaaaaatgcc

SEQ ID NO: 26490 - DNA, 118 bp, Homo sapiens
aggctttattcaaaatctccaattgcagtgctctttgtattttatgtaaaatgtatctcttcttaatatattttttaaaaatatttaagtcaacaaaactggtaatggaatagatcct

SEQ ID NO: 26491 - DNA, 58 bp, Homo sapiens
tgagatggagtctcactctgtctctcagcctggagtgcagtggtgggatctcagctca

SEQ ID NO: 26492 - DNA, 85 bp, Homo sapiens
ctcccttttctcatttctactgggaacactttcattagaagccatttgggctcagatctttgtctcagtgtctgtcctgggagaa

SEQ ID NO: 26493 - DNA, 95 bp, Homo sapiens; identical to SEQ ID NO: 68

SEQ ID NO: 26494 - DNA, 93 bp, Homo sapiens; identical to SEQ ID NO: 69

SEQ ID NO: 26495 - DNA, 95 bp, Homo sapiens; identical to SEQ ID NO: 68

SEQ ID NO: 26496 - DNA, 93 bp, Homo sapiens; identical to SEQ ID NO: 69

SEQ ID NO: 26497 - DNA, 118 bp, Homo sapiens
gatccaccaattatagttgtggacgttgaagtagatatattgggtacatttgggtatgtatatatatatatgcattattctcaatagccaaaatgtgtaagcaacccaggtggccatc

SEQ ID NO: 26498 - DNA, 95 bp, Homo sapiens; identical to SEQ ID NO: 68

SEQ ID NO: 26499 - DNA, 93 bp, Homo sapiens; identical to SEQ ID NO: 69

SEQ ID NO: 26500 - DNA, 103 bp, Homo sapiens
agtgatgactaaataaaagtgtataaatgcgtctttctttgaatatatgtatattagcacctaagtcattcattcagcatttatttactttgtatctattact

SEQ ID NO: 26501 - DNA, 95 bp, Homo sapiens; identical to SEQ ID NO: 580

SEQ ID NO: 26502 - DNA, 93 bp, Homo sapiens; identical to SEQ ID NO: 69

SEQ ID NO: 26503 - DNA, 95 bp, Homo sapiens; identical to SEQ ID NO: 68

SEQ ID NO: 26504 - DNA, 93 bp, Homo sapiens; identical to SEQ ID NO: 69

SEQ ID NO: 26505 - DNA, 78 bp, Homo sapiens
cagtttttgtgtgaacgtaagtttttatttctttctgataaatgcccagaagtgaaatcattgggtctacgctagctg

SEQ ID NO: 26506 - DNA, 95 bp, Homo sapiens; identical to SEQ ID NO: 68

SEQ ID NO: 26507 - DNA, 93 bp, Homo sapiens; identical to SEQ ID NO: 69

SEQ ID NO: 26508 - DNA, 97 bp, Homo sapiens; identical to SEQ ID NO: 1307

SEQ ID NO: 26509 - DNA, 88 bp, Homo sapiens; identical to SEQ ID NO: 1308

SEQ ID NO: 26510 - DNA, 81 bp, Homo sapiens; identical to SEQ ID NO: 1309

SEQ ID NO: 26511 - DNA, 77 bp, Homo sapiens; identical to SEQ ID NO: 1310

SEQ ID NO: 26512 - DNA, 105 bp, Homo sapiens
tgctgtttggtttactattgctttataatgtattttgaaatataatgtattttaatgtataatgtattttgaagtattttgaatataatgtatattatgcctgca

SEQ ID NO: 26513 - DNA, 95 bp, Homo sapiens; identical to SEQ ID NO: 68

SEQ ID NO: 26514 - DNA, 93 bp, Homo sapiens; identical to SEQ ID NO: 69

SEQ ID NO: 26515 - DNA, 75 bp, Homo sapiens
gtatttatttgtgtatgtatttatgagacagggtctcactctgtcactcaaactagagtgcagtggcacaattac

SEQ ID NO: 26516 - DNA, 92 bp, Homo sapiens
tgtgtatatatacgcttatataatatatgcatatctatctgtaatataatatctacgtgtaatatatatgtatatatgtgtgtatatatata

SEQ ID NO: 26517 - DNA, 113 bp, Homo sapiens
ataaaattgaaataacaagtagaaaaatgctttaataactgtataatagttgtatcatttttgttaattattatagttattaaagcattttcctacttcgttaataactttat

SEQ ID NO: 26518 - DNA, 84 bp, Homo sapiens
agctgcactatacaatcaatgacatcttacaagtaaatagtattatttttcttacttataggtatatgaaatagtggtgtagct

SEQ ID NO: 26519 - DNA, 95 bp, Homo sapiens; identical to SEQ ID NO: 68

SEQ ID NO: 26520 - DNA, 93 bp, Homo sapiens; identical to SEQ ID NO: 69

SEQ ID NO: 26521 - DNA, 68 bp, Homo sapiens
ctttatgtgtgtgtgtgtattcatatatatatatgatacatatatatgatacatatatatatatctag

SEQ ID NO: 26522 - DNA, 120 bp, Homo sapiens
aggagctaagcaaaattatgcaggaaagaaatttatgttgtctgctaataatggtccatttatccttttttttcttttttgcccttgcataatttctctagctaattttgttttattctt

SEQ ID NO: 26523 - DNA, 112 bp, Homo sapiens
agaagtgtctgttcatgttttttgtccattatttaaaggagttgattttttgcttataaatttaagtttcttgtagattctggattgtagacctttgtcagatgcatagtct

SEQ ID NO: 26524 - DNA, 111 bp, Homo sapiens
atgtatgtgtatatatacacatacatataaaacatacatgtatatatagaaatgtgtgtatatatattatatatgtgtgtgtgtgtgtatatatatatttccctggaatac

SEQ ID NO: 26525 - DNA, 117 bp, Homo sapiens
gggagattttgtataactaattcaatttctgtgctcatgtttctgttcagaatttatatttttttatgattcactcttggtaagttatatgtgtctaggaatttatcaatttcttct

SEQ ID NO: 26526 - DNA, 115 bp, Homo sapiens
gggtaggaagaacaaaccccaggcggtcctgggcagtttgtcccaaacttgtgatattatattctgtaggagggagagcaaaaggtctcaggctgttttaggcaattccttccta

SEQ ID NO: 26527 - DNA, 78 bp, Homo sapiens
gtaaaaaaataattagcctgtttgtaaaactatctttatcttttaaaaaagttgtacaattggcaattgtttttttgc

SEQ ID NO: 26528 - DNA, 81 bp, Homo sapiens
ttcaccattgaccaaaacattggtatgccatgcatgaatagtgtgtatgtatgtgtgtgtctgtgtgtgtccgtgtgtgaa

SEQ ID NO: 26529 - DNA, 98 bp, Homo sapiens
agctggagacttaagctaaatatacttgattatttattctatatctgcttgtgctgagtagactgaaaaattattcttatcctaagtcttggccagtt

SEQ ID NO: 26530 - DNA, 93 bp, Homo sapiens
gttttgctcaggtgacattaaatagtccagcagaggtcagagcctgcagtaaattgatgcactgattttgatgtaatgtgccttagattttgc

SEQ ID NO: 26531 - DNA, 84 bp, Homo sapiens
tcattaattcctacaagagaacactgttagaatgagcctggcacctgcccctctctctctctgattttctctcttagcatgtga

SEQ ID NO: 26532 - DNA, 114 bp, Homo sapiens
gatatatatgctatatatatgcttatatatatgctatacatatgctatatatatgctatatatatatgcttatatatatgctatatatatgctatatatatttatatgccaagt

SEQ ID NO: 26533 - DNA, 113 bp, Homo sapiens
tgctttttaaatatatatgtatatagtgtatacatatgtgtgtatttaattaaatgcaagaatttaatttttacatattatataaatatatatattcatttcaatttgttgca

SEQ ID NO: 26534 - DNA, 113 bp, Homo sapiens
tggctctgtcattgattgttattgtttattgagcgcgtactatgtgcaaaacactgttgtgagctctttgcatatattgcttcattattagttgtggggatacaagcaagtca

SEQ ID NO: 26535 - DNA, 89 bp, Homo sapiens
gttttaattgtgggcattttagaaaccaaatcaacaacattcatttttttgtttttgttttttgggttttgtttgtttgtttttgagac

SEQ ID NO: 26536 - DNA, 87 bp, Homo sapiens
agattaaaaccagatgttatgaagacatactgagaacttatacctgtaatatactctgtatgtgtgcatgtgcatgtgtgtgtatct

SEQ ID NO: 26537 - DNA, 81 bp, Homo sapiens
gccatctagacacaatccattctgtagaatgcatctgaacaatttgtatagattgcatatggaatgtattgtaaagatggt

SEQ ID NO: 26538 - DNA, 113 bp, Homo sapiens
aggaatacctttgctgggagaatgctgggagtatttttgcaattttttattcatactttttaatatcttatactaaaaaatgtctcatgcttaacagcaatgatagtatttct

SEQ ID NO: 26539 - DNA, 74 bp, Homo sapiens
cttctccacatctcagtttcttcttctgtagaatgggattaatacaatttactttagagcactgatgtgagaag

SEQ ID NO: 26540 - DNA, 68 bp, Homo sapiens
gaaaactgacctgaggcattaggtgactttgggaagtaactcagtctctctctgcttcaggtttcttc

SEQ ID NO: 26541 - DNA, 74 bp, Homo sapiens
gcctgtcacccagctggaatgcagaatgcagtggcatgatctcagctcactcacagcaactccatctctcaggc

SEQ ID NO: 26542 - DNA, 114 bp, Homo sapiens
caagtggtggcagaggagatggaaagaagtgtacgggtttgaaatgttttgtagaaagatttatagactataaatcataggcttctccagctctaacattgtaacaactatatg

SEQ ID NO: 26543 - DNA, 60 bp, Homo sapiens
aagggatctgagtgcagtcagacctcatttgggtccagacttcattcctctatgtctctt

SEQ ID NO: 26544 - DNA, 109 bp, Homo sapiens
caggggaaatgcatcattcattgtcttagttaagctagtgtggtcctgaatgggcaattgtaggttactttttttttttttaagttgcagtgttgcattttaatgcctg

SEQ ID NO: 26545 - DNA, 124 bp, Homo sapiens
tatatgtacacatatgttcatatgagtgtatatatatacatacatatatacttgtgtgtatatatgtatatacatctacacatatatacaaccacgtatatatgtggagatgtgtatgtatata

SEQ ID NO: 26546 - DNA, 58 bp, Homo sapiens
tgagactgagtctcgctctgtcacccaggctggagtgcagtggcgggatctcagctca

SEQ ID NO: 26547 - DNA, 89 bp, Homo sapiens
actgtcctgctcatcctgtgtctcactcagtggctggcataaatgatatattcaataaatatttactgagtgaatgattaggtcagtag

SEQ ID NO: 26548 - DNA, 117 bp, Homo sapiens
gaattgtggacacacttcagaaaatgagactgaccagatattgacagaagagtaagaggacttcccagttgacagtaagttgatttgcccagccttagggtcaagtgtgaaatgatc

SEQ ID NO: 26549 - DNA, 58 bp, Homo sapiens; identical to SEQ ID NO: 1265

SEQ ID NO: 26550 - DNA, 107 bp, Homo sapiens
tggttgttctgactgtactgattaagtcagccatggtgaggaagttggttgtttatacaaacaatgccatggctatattgtgattttggatgcaatttaaacattca

SEQ ID NO: 26551 - DNA, 103 bp, Homo sapiens
tcccagccctatcctcacatgtcagtttaatttcacaccatttcattttatatgtatttatgttattttattgtgtgtttaacatgttgttaggtgttgtgga

SEQ ID NO: 26552 - DNA, 69 bp, Homo sapiens
tgatggcatcagggcactcaggtcatttacaagagtagtgtgtgagaccctgtgtgtcactgccactca

SEQ ID NO: 26553 - DNA, 83 bp, Homo sapiens
gtctgagtctcactctgtcgcccaggctggagtgcagtggctcactgtaacctccgcctcccgggttcaagcgattctcctgc

SEQ ID NO: 26554 - DNA, 86 bp, Homo sapiens
gtgatagtgagttctcacgagagctgatggtttcaaaatgtggcacttcccctttggtcgctctctgtctctctctgttgctgcac

SEQ ID NO: 26555 - DNA, 119 bp, Homo sapiens
gggtggtgggtcctcactgcccggccagccaggggtgtatgtggatttcttttctttttttttgagacggagtctcgctctgtcacccaggctggagcgcagtggcgtgatctcagctc

SEQ ID NO: 26556 - DNA, 68 bp, Homo sapiens
tgtgtgtgtgtgtgtatgtatgtgtatatatatttttatatatatatatatatatatagagagagaga

SEQ ID NO: 26557 - DNA, 119 bp, Homo sapiens
ctattgacatttttttttaaaggctagcctgggtagcatagtgaagactccatctctatacttttttttttttttttgagaaagagtctcactcggtcacccaggctggagtgtagtgg

SEQ ID NO: 26558 - DNA, 87 bp, Homo sapiens
tttgagacgttgtctcactctgtcactcaggctggagtgcagtggcgcaatctcagatcactgcaacctctgcctcccgggttcaag

SEQ ID NO: 26559 - DNA, 58 bp, Homo sapiens
tgagactgagtctcgctctgtctcccaggctggagtgcagtggtgtgatctcagttca

SEQ ID NO: 26560 - DNA, 117 bp, Homo sapiens
gcaaaaatatcacagttttttaacatttaggttatcatactggagttagtaagatgttttttctttactaaaccttgataattttattagaggaagaaattgatgagattactgggc

SEQ ID NO: 26561 - DNA, 100 bp, Homo sapiens
gttgtgattcaaagtgggccctgctgctgaaaaaagtttgtttttaccattcttaaaaatacgatgttcagaatagaattagagctaagggagtcgtgat

SEQ ID NO: 26562 - DNA, 85 bp, Homo sapiens
tgaattcttactgcttacattttctgccagttcatctctaaagatgggtgactataagacagaggaagaaagtagtaaagaatca

SEQ ID NO: 26563 - DNA, 93 bp, Homo sapiens
tggaaagttgctggttttccagagtgtaaagactcatcccagttggtttcagaagcatcttttttattttgtaaaaccttagcacatattcca

SEQ ID NO: 26564 - DNA, 117 bp, Homo sapiens
tgtattttctatgtttgtagtgctttctctcagtcaaaatatttgctaaacacttactctctgtctggcatagtttttggcccaatagaagcaaggcaccagccaacaccaaagtca

SEQ ID NO: 26565 - DNA, 94 bp, Homo sapiens
ggcgtgttttgggatgattagtttggtagctgtgagtaggatggattagagtgggtgaagacagagatcaatggggtcgttttcccagtaggct

SEQ ID NO: 26566 - DNA, 58 bp, Homo sapiens
tgagactgagtctcactctgtcacccaggctggagtgcagtggtgtgatctcggctca

SEQ ID NO: 26567 - DNA, 113 bp, Homo sapiens
cataaactttcagctgtggaatgcctacagccaaaccattctgtctctcacacacttttttgtgaacagtcttggttctgtcctgagggcatttgcacctgctgttccttatg

SEQ ID NO: 26568 - DNA, 99 bp, Homo sapiens
ctgccagctaaataaaacttttaacatttttttaatttaaaaagtaacacatgtgctcagcaaggtgttttaaatttcaagagtgtagacagtgggcag

SEQ ID NO: 26569 - DNA, 88 bp, Homo sapiens
acacagagatatgtatgtttgtacacctattttatgtatgtatatattacatttacatagatatagatatgtatatgcatgtatgtgt

SEQ ID NO: 26570 - DNA, 112 bp, Homo sapiens
agcttcattgagttatacttgacaagtaaaaaattgtacatatatgaggggtacaatgtaatgttttgatgtttgtatatagactttgtgaaatgactattgcaatcaagct

SEQ ID NO: 26571 - DNA, 88 bp, Homo sapiens
agggaaaacaagtagcagagctaggttttgaactctggtcgtcctgacagcagagtctgtgctctccatcaccatgctaacattccct

SEQ ID NO: 26572 - DNA, 67 bp, Homo sapiens
gtggagtgatggtccacatcggtggccgggaagacctttgagatcagtgtgtggagtgatggtccac

SEQ ID NO: 26573 - DNA, 86 bp, Homo sapiens
gaggcaaggttaccagccatggagacagaactgacagtcctaggattgataataagtgtcttgtcttttaaaaaagaacctccctc

SEQ ID NO: 26574 - DNA, 86 bp, Homo sapiens
cagttatcaggacaaatcacagcagagacacctcatttcccaatcatcctggataaatgaagactgactgtctgtcactgagcctg

SEQ ID NO: 26575 - DNA, 89 bp, Homo sapiens
gaagatttggtgctcttccagtagggacccctctgtctccctcagtgtctgacagttttcctagccatgtctggatgcatttactctgc

SEQ ID NO: 26576 - DNA, 89 bp, Homo sapiens
gtgtatgtatgtatgtatgtatgtatgtgcatgtgtgtaggtatatatatgtgtgtgtgtgtataaatatatatatatatatatatata

SEQ ID NO: 26577 - DNA, 96 bp, Homo sapiens
agtcggaaaggatatggtgaagctagagcacagggccactcacactctctgtcatgtctccctggctgctatctcatctgatcaggcatttcttct

SEQ ID NO: 26578 - DNA, 76 bp, Homo sapiens
ctgtagtcccagctacttgggaggctgaggtggaaggatctcttgggctcagtagctcagtagatagaggctgcag

SEQ ID NO: 26579 - DNA, 89 bp, Homo sapiens
caagaaatcgaatgtcaccagaactccagaggctgcttgtgtctgttccagtcactgactcagaattttgtgatggcatggaaagcttg

SEQ ID NO: 26580 - DNA, 99 bp, Homo sapiens
gcatatccaagtaccctggatagataggttaattattatttaattaatggtgagtaaataatgaattcaacacatttttcttaagtgtcttgtttgtgc

SEQ ID NO: 26581 - DNA, 107 bp, Homo sapiens
tttgcaaatgtgtgcttgtgtttagctatctttttgctgctgacttctaattttgttgtattgtggtcaggaaaatgtggtttggacaaggtcaatcgtatagtgga

SEQ ID NO: 26582 - DNA, 114 bp, Homo sapiens
atattggttatggcttcattattaaactttaattctgaatatatatatatgtgtgtgtaatgaatatgcatatatgtatttatttgtatctatttagtatattatatctaatgt

SEQ ID NO: 26583 - DNA, 126 bp, Homo sapiens
tcaaacacttgcttacaaatagtgcgttctgtcatgttttgaaaagccagttagttagatttgagagccaggtttgaaaactgaggtagatttttttttcttttgcatcaagaatacctgctgtgc

SEQ ID NO: 26584 - DNA, 109 bp, Homo sapiens
atcactcagtggctcctacctggctggagaactgttggacaagggagtgacaatgacattttgtagatgtgacagcatagcaagtggagaacctaaactgagacatgat

SEQ ID NO: 26585 - DNA, 113 bp, Homo sapiens
ccatataggattactcaacaaggaatcttacagtcagtaagtatatatatttgtcaacagaaaatacagtgtgccaaggaagtactggttaacaaggtccctatcctatatgg

SEQ ID NO: 26586 - DNA, 62 bp, Homo sapiens
catagatggaggacagagctggtgcacatctgtaatgtcacccagctttgttgacatcagtg

SEQ ID NO: 26587 - DNA, 88 bp, Homo sapiens
catgtagctatcaggacaggagtctgtcttctcatttcctctgcccagaaaagtgagtctctctcagactttgacattctgctatctg

SEQ ID NO: 26588 - DNA, 95 bp, Homo sapiens; identical to SEQ ID NO: 68

SEQ ID NO: 26589 - DNA, 93 bp, Homo sapiens; identical to SEQ ID NO: 69

SEQ ID NO: 26590 - DNA, 76 bp, Homo sapiens
tcttagctcagtgtcactgtctcagaccccatggattgtatgtggtctagcagtgcatccttgccaatatataaga

SEQ ID NO: 26591 - DNA, 70 bp, Homo sapiens
acaatttggtatgagatgtgagtagggacacagagcccccactctcggtctctctctcctgccactatgt

SEQ ID NO: 26592 - DNA, 70 bp, Homo sapiens
gagagggagagagagagagagagagaaacttgtttgaaagttttagtcattaaccttctgtcttcatctc

SEQ ID NO: 26593 - DNA, 86 bp, Homo sapiens
gccatttggtggctcttaaggatgggattctcagagaacagactctgaaaatgggaatagtttgtaggatgtttactaaatagtgc

SEQ ID NO: 26594 - DNA, 103 bp, Homo sapiens
gcagtctgcagtgtctattgttcccatgtttatgtctgtgcctgatcaatgtttagctcccacttataaatgacaacatgtggatttggttttctgttcctgc

SEQ ID NO: 26595 - DNA, 127 bp, Homo sapiens
ctttcttaacttctctgtgttgagtatcaaacaaatacaataggtcaaccactcactgttcagtgtgtggaaaccctactgattgaggcttctcagaagcaaggggtaaaggaagaacaggaagtgg

SEQ ID NO: 26596 - DNA, 73 bp, Homo sapiens; identical to SEQ ID NO: 16159

SEQ ID NO: 26597 - DNA, 111 bp, Homo sapiens
tcctttttgcttaggattgtcttggctatacgggctattttttggttccatatgaaatttaaagtagttttttctaattctgtgaagaaagtcagtggtagcttgatggga

SEQ ID NO: 26598 - DNA, 95 bp, Homo sapiens; identical to SEQ ID NO: 68

SEQ ID NO: 26599 - DNA, 93 bp, Homo sapiens; identical to SEQ ID NO: 69

SEQ ID NO: 26600 - DNA, 84 bp, Homo sapiens
tcaccagtgtgtaatttatcattatttgtatacatcagctgccccaaagcaagctgacatttagctttaaatacaaactggtgg

SEQ ID NO: 26601 - DNA, 115 bp, Homo sapiens
ttcagaaaatatggtatctttgggcaaaaatcgctgtgtatttatttatttatttatttatttatctatctatttatttatttgagacagagtcttgctctgtcaccaggctgga

SEQ ID NO: 26602 - DNA, 80 bp, Homo sapiens
tgtgtgtatatatatgtatatgtgtgtatatatgtacatctatatatatatacacacacacatatatatatatacacaca

SEQ ID NO: 26603 - DNA, 108 bp, Homo sapiens
ttatatatatatatgcacacacacatatatcttttatgtatatataagatatatatatatatatatacatacacatatatcttttgtgtacatataagatatatataa

SEQ ID NO: 26604 - DNA, 87 bp, Homo sapiens
gctcaccttctgccattatactgaaagttccctgaggcctcctcagaagctgagtgatgtcagtgtagagtctgcataaccatgagc

SEQ ID NO: 26605 - DNA, 95 bp, Homo sapiens; identical to SEQ ID NO: 68

SEQ ID NO: 26606 - DNA, 93 bp, Homo sapiens; identical to SEQ ID NO: 69

SEQ ID NO: 26607 - DNA, 105 bp, Homo sapiens
ccctgacacaatattggagagccaaaaggaaaggacattttgggttgaaattttttcttttaaaaatgtgtccttgagttctattaacaatagctgaagcctggg

SEQ ID NO: 26608 - DNA, 109 bp, Homo sapiens
tagactgagagctgagtttcacagtagcctgaggtttttggttattttatttgattttttgaaggggtgggtgggattggtaaggggaaggagggcagtttaaagtcta

SEQ ID NO: 26609 - DNA, 86 bp, Homo sapiens
ctcaaccaaccttttttttttttttgagacagagtctggctgtgcccggccactttctaagctttgtgaagagtgagttgactgag

SEQ ID NO: 26610 - DNA, 119 bp, Homo sapiens
tgtcttttgcttaaagagagcaagagttgttgcagatagatagtgggagagcagtggatatttatccatttttttttttttttgagacagtcttgctctgtcacccaggctggagtgca

SEQ ID NO: 26611 - DNA, 78 bp, Homo sapiens
gggaagtaattttttaaatttcagaattgtaatgacggatgacccatttcctaatattgcaattctcaaattctttcc

SEQ ID NO: 26612 - DNA, 75 bp, Homo sapiens
aatctttaatatattttagtgcatgcttcaatgttgggatattgattggaattgcactgattgtattgatggatt

SEQ ID NO: 26613 - DNA, 80 bp, Homo sapiens
cagaggcagcatcaaaacttaattctaagttctgcaagcctagagggtttgagaactgtttatgatgaaaatggctactg

SEQ ID NO: 26614 - DNA, 74 bp, Homo sapiens
gcttgaggccatcatgaggacattcattcttttttttttttttttttgagagagtctcgctctgtcgcccaggc

SEQ ID NO: 26615 - DNA, 106 bp, Homo sapiens
gagaaataggaacactttttgttttgttttgttttgtttttatttatactgttggtgggagtgtaaattagttcaaccattgtggcagacagtgtggcgattcctc

SEQ ID NO: 26616 - DNA, 58 bp, Homo sapiens
tgagacggagtctccctctgtcactcaggctggagtgcagtggtgtgaactcggctca

SEQ ID NO: 26617 - DNA, 91 bp, Homo sapiens
cctggtataaattttttttggcacaatgcttcagttctgagtgtgcactcactcgcatgatgctttggcttaaagagcatttcttttgagg

SEQ ID NO: 26618 - DNA, 85 bp, Homo sapiens
tgagtagtattccatggtgtgtgtttgtgtaaaatatatatataatatatttttttacatatatatataacattgtctttactca

SEQ ID NO: 26619 - DNA, 74 bp, Homo sapiens
tgttttttgagttagagtctcactcactctgtcgctcaggctggagtacagtggcacaatctcggctcatggca

SEQ ID NO: 26620 - DNA, 125 bp, Homo sapiens
ccacaggctgcaaagatccgtgagagaaacgtggtttcccaggtgggggtcacacaatcactcactgcttcccgtggctgggagtgggggtttctttggctccatgccactcccaggtgggcagt

SEQ ID NO: 26621 - DNA, 101 bp, Homo sapiens
tacagatgaaggaattggagcttagagaagtgacagagctgttaattggcagaacctacggctctgtcacttctccaagggtttgaatctgtgctcttgtg

SEQ ID NO: 26622 - DNA, 118 bp, Homo sapiens
gaatgagctcagttggatgtttctattttgaggtcctccatatgattacagtcacatacaactgtggctccagtcatttgaagattccacaggacttgatgtctaagatagtttcttc

SEQ ID NO: 26623 - DNA, 113 bp, Homo sapiens
atttgtttttaattgtatgctagagaaggtatgtaagttttatttttctatgtataactcttgataaaatatctttttatatatttttgtagcggaagttgggtgctacaaat

SEQ ID NO: 26624 - DNA, 117 bp, Homo sapiens
ccaattacagttctggcctaagttttggtgttggacttttatttttattttaatttattttattttattttatttgagaccgagtcttactctgtcacccaggctggagtgcaatgg

SEQ ID NO: 26625 - DNA, 95 bp, Homo sapiens; identical to SEQ ID NO: 68

SEQ ID NO: 26626 - DNA, 93 bp, Homo sapiens; identical to SEQ ID NO: 69

SEQ ID NO: 26627 - DNA, 112 bp, Homo sapiens
atgaggtttaaatgaaaaaaaatatgcaaggactgagtacagtgtctgcacacaatgggtgcccaataaatagcagtcattatgatcaggtcgctttttcaacccattctca

SEQ ID NO: 26628 - DNA, 93 bp, Homo sapiens
agtccatagccattctgaaaattatcaaggcacaggtagtagtttcttaaataggactaaagacttgagagtaattccttatggctgttgact

SEQ ID NO: 26629 - DNA, 116 bp, Homo sapiens
tatgtaaatataactatagatacgtatatatagttatgtaaatataactatatatatttatatatagttatgtaaatataactatatttatatattcatgtaaatatatttatata

SEQ ID NO: 26630 - DNA, 62 bp, Homo sapiens
ataactatatataaatatatatagttatatttacataactatatatacgtatctatagttat

SEQ ID NO: 26631 - DNA, 144 bp, Homo sapiens
tacatatatacacatatgtgtgtatatacatgtgtgtatatatacacgtatatacgtatatgtgtgtatatatatgtatgtatatacatatatatgtgtatatatgtatgtatatacatatatatgtgtatatatgtatgtata

SEQ ID NO: 26632 - DNA, 113 bp, Homo sapiens
gtatgtatatacatatatatgtgtatatatgtatgtatatacatatatatgtgtatatatgtatgtatatacatatatatgtgtatatatgtatatgtttacatagatacaca

SEQ ID NO: 26633 - DNA, 105 bp, Homo sapiens
tatatatatatatgtgtgtgtgtgtgcatgtgtgtatgtatatgtgtgtatatatatgtgtatgtgtatgtttctacatatacacacatagagactatatatgta

SEQ ID NO: 26634 - DNA, 94 bp, Homo sapiens
gaacaacagcttagaagttagaaggaagatggagtcaggtcagatctctttcactgtcacaatttcctgttataatttttgcaaaggtgttttc

SEQ ID NO: 26635 - DNA, 113 bp, Homo sapiens
tagcatttctctgtagttttgatctgtatactctaagtattttattctttgaaatgaatatatgttgtgggtagaatgtttgtgtgccctcaaaatttatatattgaaatcta

SEQ ID NO: 26636 - DNA, 80 bp, Homo sapiens
gctcctttttggctccatatgaaatttaaagtagttttttcaaattctgcccagagagtcaatggtagcttaacaggagt

SEQ ID NO: 26637 - DNA, 96 bp, Homo sapiens
caggtattgcagaaataggcaaatcaaatggtatgaaatgttgtaagtgtacgttaaatcccatgcctttaggttagctggcctgtctccattcct

SEQ ID NO: 26638 - DNA, 114 bp, Homo sapiens
ggaccaagtactatggttgtgtttgaactaaggagcacagaatccagtgagcagagaaatgctgatgatgatggttccatccaagtcttatcataacacacagtttaatcctcc

SEQ ID NO: 26639 - DNA, 106 bp, Homo sapiens
ttcccaagtctgaatgagcaataaaactgacacgcactgtgtctgccaggaaatgcactggcaagactcagattgctcacatgtgttatggtcacagatgttggaa

SEQ ID NO: 26640 - DNA, 56 bp, Homo sapiens; identical to SEQ ID NO: 14894

SEQ ID NO: 26641 - DNA, 97 bp, Homo sapiens
tgtgtgtgtgtgtgtgtgtgtgtatgtatatatatatatatatatgtgtgtgtgtatatatatgtgtatatatgtgtgtgtatatatgtgtgtatat

SEQ ID NO: 26642 - DNA, 81 bp, Homo sapiens
cagattgaatttagctccagccacttaaagtcttataaatttcaggtttttttttttttttgtggatggagtctcactctg

SEQ ID NO: 26643 - DNA, 98 bp, Homo sapiens; identical to SEQ ID NO: 1311

SEQ ID NO: 26644 - DNA, 58 bp, Homo sapiens
tgagatggagtctcactctgtcacccaggctggagtacagtggtgggatctccactca

SEQ ID NO: 26645 - DNA, 79 bp, Homo sapiens
cacccagaagttgcaggtgcgaggatatagttttgttttataaagcatatttgtgtgtgtgtgtctgtgtgtctgtgtg

SEQ ID NO: 26646 - DNA, 111 bp, Homo sapiens
ctattgacatgatcacgtggtttttgttctgtattgtaattataaatgaggttttgcattgattgtttttcaaatattaaacaaccttgaattcctgggatctgtccatgg

SEQ ID NO: 26647 - DNA, 110 bp, Homo sapiens
aaatgtatatacatgcagaaaatggcttgaaggaatgatagagtttattctattttattagaatgatgagaaatattttttaatagtccagatcttctgtgatattattt

SEQ ID NO: 26648 - DNA, 95 bp, Homo sapiens
gaggtcaggatatgaattaccctgagagaagacagtgactaaatgggggtgtgggcatgtcttctggggtataggtgatgttgtttcttgagctc

SEQ ID NO: 26649 - DNA, 58 bp, Homo sapiens; identical to SEQ ID NO: 23944

SEQ ID NO: 26650 - DNA, 114 bp, Homo sapiens
gcaatcatgtttgctgtttggagggcacaatatttactttattttttttaattttttttttttttaaaacggagttttgctcttgttgcccaggctggaatgcaatggcgcgat

SEQ ID NO: 26651 - DNA, 58 bp, Homo sapiens; identical to SEQ ID NO: 303

SEQ ID NO: 26652 - DNA, 87 bp, Homo sapiens
gggtagggcctcaggaagttcacaccttttgcagcagggagaagcctggtctctcctgtttctgggtggtagcctgggattcaatct

SEQ ID NO: 26653 - DNA, 105 bp, Homo sapiens; identical to SEQ ID NO: 26607

SEQ ID NO: 26654 - DNA, 83 bp, Homo sapiens
actatgaacaaactatgaaggcaaatgtgattatatatttgtgaagacaatgaatctaatgtgcctaatgtttgttcattagt

SEQ ID NO: 26655 - DNA, 83 bp, Homo sapiens
catgcctcagctagtttgtttggcaaagagaatgaacatagacagctgttttatatcaattagctacaattagttgtgccatg

SEQ ID NO: 26656 - DNA, 105 bp, Homo sapiens
gttaggtgtctatgagttggagcttactttggttaactgcttgtatatgtgtctatatttatatttaatagtaccattttgggcatccgttgtagctagcttaac

SEQ ID NO: 26657 - DNA, 58 bp, Homo sapiens; identical to SEQ ID NO: 25004

SEQ ID NO: 26658 - DNA, 65 bp, Homo sapiens
ctcccctgcaatgttttaggcaaacatgatcatatctgatttatgccagaacacagacaggtaag

SEQ ID NO: 26659 - DNA, 85 bp, Homo sapiens
ctcaaccaacctttttttttttttgagacagagtctggctgtgcccggccactttctaagctttgtgaagagtgagttgactgag

SEQ ID NO: 26660 - DNA, 87 bp, Homo sapiens
gcttgaggccatcatgaggacattcattctttttttttttttttttttttttttttttttgagagagtctcgctctgtcgcccaggc

SEQ ID NO: 26661 - DNA, 88 bp, Homo sapiens
gcaaaagaattggtagctgcaggttattgctatggatatcaatcatgatatatatgtatataatctaatgtacctgaaaatgttttgc

SEQ ID NO: 26662 - DNA, 154 bp, Homo sapiens
catatacatgtgtatgtatatatgtgtgtgtacacacacatatacatgtgtatgtatatatgtatgtgagtatatgtacacatatatacatgtacatatgtgtatatatatgtgtgtatatatatatgtgtatatatataaaaacacacatgca

SEQ ID NO: 26663 - DNA, 95 bp, Homo sapiens
tctgccatgaaaagtgtgagctgatttagttgttcagaaacaggatgcccaattagttttcaaagacacatgcatcaaatcacagtcaccgtaga

SEQ ID NO: 26664 - DNA, 74 bp, Homo sapiens
tgagtgatgagagtgtggaatctgggatagagctaaatggctcttcctaagaaaagtaggcatttcagaaacca

SEQ ID NO: 26665 - DNA, 64 bp, Homo sapiens; identical to SEQ ID NO: 15176

SEQ ID NO: 26666 - DNA, 59 bp, Homo sapiens; identical to SEQ ID NO: 15177

SEQ ID NO: 26667 - DNA, 114 bp, Homo sapiens
tgtcaggaactgagaattacttacaacagctttgtatattgggacagtagtgaaatagctgatgccacaattccctctatgtataagtctactgaggatcatgtcattcctaca

SEQ ID NO: 26668 - DNA, 79 bp, Homo sapiens
ctccagaacctctctagggccctgctggctgcagcctgttgtgagtgagtagacaagggagggaagccctcatctggag

SEQ ID NO: 26669 - DNA, 94 bp, Homo sapiens
cttacatttgtagagggctttggagttaaataaaatatgctttgttatgagttattttatttaatgattaaaacaacctattggaggaagtgag

SEQ ID NO: 26670 - DNA, 86 bp, Homo sapiens
tcacccactcacagagaagcccacatgaggaaacaggttatgtcttggacatctctgtccccctcagtgtctggtatagtgactga

SEQ ID NO: 26671 - DNA, 117 bp, Homo sapiens
gcgatttcctctctccttggcctgcccgagctccacagtgaatgggtactgtgttgtctgtctctctcatggcactgtttctagctcctggagtagcagcaggcatacagtaggtgc

SEQ ID NO: 26672 - DNA, 82 bp, Homo sapiens
gtgcatgtgtgtgtgtgcatgcatgtttgcctgtgtttgtgcgcctgtgtgcctgtgtgtgtgtatgtgtgtttttatgtgc

SEQ ID NO: 26673 - DNA, 85 bp, Homo sapiens
gcaggcaggactggaatgagacttttatttttatttatttatttatttattttgagatggagtctcgctctgtcacccaggctgc

SEQ ID NO: 26674 - DNA, 148 bp, Homo sapiens
gtatatatatatacacatacatatatatgtatgtatgtatatatatgtgtatatatctgtatatgtatgtatatgtatgtgtatatatatgtatatgtgtgtatatatatatgtatgtgtgtatatatacatatatatatatgtatat

SEQ ID NO: 26675 - DNA, 90 bp, Homo sapiens
accaaggtcacaaagatttcttccgttgtttttttctttgtatttcaaatatattcttagaagaatggaaagttgtgtgtgtctaagggt

SEQ ID NO: 26676 - DNA, 58 bp, Homo sapiens
tgagactgagtctcactctgtcgctcaggctggagtgcagtggcatgatctcggctca

SEQ ID NO: 26677 - DNA, 82 bp, Homo sapiens
agaagttatgttttgagatggagtctcgctctctcacccaggctggagtacaatggcgcgatctcggctcactgcaacctct

SEQ ID NO: 26678 - DNA, 112 bp, Homo sapiens
cagaacagagatggcatggacagagcccatggagaaggaggaggaaaaagagagtttggctttgtttttttttttttttaagacagggtctctggctgtgtcacccaggctg

SEQ ID NO: 26679 - DNA, 110 bp, Homo sapiens
tgattgtgccactgcacttcaacctgggcaacagcaagaccctgtctctctctctaaaaaaaaaaaggaggtggaatcagggctggctctgtgattggctttggccagca

SEQ ID NO: 26680 - DNA, 58 bp, Homo sapiens; identical to SEQ ID NO: 1215

SEQ ID NO: 26681 - DNA, 107 bp, Homo sapiens
tatttggtatatgtgctcattgggcaagatggtatatgtatatgtgtatgtatatattaaggatacataaattttttctcttgaaaaatggtattatatgccgggtg

SEQ ID NO: 26682 - DNA, 76 bp, Homo sapiens
gggtgtgctcagtaaaggtgaccttttatctttttttttttttttttttttgagatggagtctcactctgtcgccc

SEQ ID NO: 26683 - DNA, 85 bp, Homo sapiens
ctacagagataaaggacggtgactcttgtgtcagttagttgttgtcacaaaatgctgcataacaagtcactccaaatctcagtgg

SEQ ID NO: 26684 - DNA, 67 bp, Homo sapiens
gcagcgagccagagtctcactctgtcgcccaggctggagtgcagtgatgtgatctcaggctcactac

SEQ ID NO: 26685 - DNA, 62 bp, Homo sapiens
tgagacggagtctctctcactctgtcacccaggttggagtgcagtggtgggacctcggctca

SEQ ID NO: 26686 - DNA, 96 bp, Homo sapiens
gtatatatacacgtatatatgtatatatatacacgtatatatgtatatatatacacgtatatatacacgtatatatgtatatatatacacgtatat

SEQ ID NO: 26687 - DNA, 87 bp, Homo sapiens
ccctggcactctctctgattctctctggaccagcggtgtccaatcttttggcttccctgggccacattggaaggagagttgtcttgg

SEQ ID NO: 26688 - DNA, 71 bp, Homo sapiens
ctgcttatctattgtctgcctctcccactgtcagtgcctagaagagtggctgaggcataggaggtactcag

SEQ ID NO: 26689 - DNA, 58 bp, Homo sapiens
tgagacagggtctcactctgtcacccaggctggagtgtagtagtgcaaccacggctca

SEQ ID NO: 26690 - DNA, 71 bp, Homo sapiens
ggctgggcatggtggctcacacctgtaatcttagcacttgggaggctgaggtaggtggatcacttgaggcc

SEQ ID NO: 26691 - DNA, 90 bp, Homo sapiens
gttgcttgagccactcagtctgtggctctttgttccagcagccctgggaaactagagagctacccgctgactgaaacctccccttgcaac

SEQ ID NO: 26692 - DNA, 95 bp, Homo sapiens; identical to SEQ ID NO: 68

SEQ ID NO: 26693 - DNA, 93 bp, Homo sapiens; identical to SEQ ID NO: 69

SEQ ID NO: 26694 - DNA, 130 bp, Homo sapiens
gtagtttttcttatagaggtctttcaactcctttgttaagtattttcctaagtatatatatatatttgcagctattctaaaaggggttgagttcttgatttggttctctgcttggtcgctgttggtgtat

SEQ ID NO: 26695 - DNA, 140 bp, Homo sapiens
gtttctgagtaattgagtgggtgaggctatttgtggggattgggggttgggggtgtggctgaatcaacattcattgctgtgcatggctgtttacaagaatcatgttactaagtgcaatcaaaagtgcgaagcaaactgtc

SEQ ID NO: 26696 - DNA, 110 bp, Homo sapiens
tagccatctctctataatcttatcaaccctcgatagtgtcattttttaatttataattatgagtgaaaatggtacttcagtatggttttaaattggagtggacttgacta

SEQ ID NO: 26697 - DNA, 119 bp, Homo sapiens
cattcagcatataagattatatatgacatacaatacacacatgtagttgtatgcatgtatatatttgtatataactacatgtgtatttttgtggtcatacatgatcttatatatgtatg

SEQ ID NO: 26698 - DNA, 138 bp, Homo sapiens
gggagaatgagagggagccgttgtctgttatttatttatttatttatttatctttagatggattctctctctgtcacccaggctagagtgcaatggcgcaatctcagctcactgcaacatctgcctccagggttcaag

SEQ ID NO: 26699 - DNA, 85 bp, Homo sapiens
tcaatgggtctaatttttatttttaaaagcttccttcctattgaggaatttggctgattcatggagatatgtttggcagcattga

SEQ ID NO: 26700 - DNA, 80 bp, Homo sapiens
ggtgcacagaggcagacacccttacaaatggagattttttttttttttttttttttgtgacagagtctccctctgtcacc

SEQ ID NO: 26701 - DNA, 81 bp, Homo sapiens
acctcagcttcccaagtagctgggactacagcgacataccactgcacccagctaatttttcattttttgtagcaaagaggt

SEQ ID NO: 26702 - DNA, 105 bp, Homo sapiens
gttttgactagtgttttctgaatagctttgggtaaataatttattgtttctatctaaaacaatggtcccttgcctttgcataactttcagtacataagtttgaat

SEQ ID NO: 26703 - DNA, 122 bp, Homo sapiens
ccagacttaagattttccactactctatgctgctgtgttggagagtagtgagaagtaaggctggacaggtggagcctgagggggtttgggccttgagaatccaagctaaggtacctgagtag

SEQ ID NO: 26704 - DNA, 89 bp, Homo sapiens
gggggtagaagatctttattttaccaacttaaaaccataattcttagttgttgttttttttttttgagacagggtctcactctgcctct

SEQ ID NO: 26705 - DNA, 111 bp, Homo sapiens
aagcctataattcagctttcactattgggtttatttttggaagacttcagattttggtctgcacttttctaccatctggaacaaccagtgtatgattgtgtttgtttgttt

SEQ ID NO: 26706 - DNA, 57 bp, Homo sapiens
ggagcatcagcaacagtggtgaagggtagacgtgtcacactgtgtgtgtgatgctcc

SEQ ID NO: 26707 - DNA, 102 bp, Homo sapiens
gtgctgggattataggcatgagccactgtgcccagcccccttgactgttaatttttatatttcagagctcacaacagttgcatcaccagcttccttccagcc

SEQ ID NO: 26708 - DNA, 83 bp, Homo sapiens
tggcctccacacaggtgagagtgatcagaatccatacgactcaacaaatagtcatctggcaccacgccatgcgcaggagcccg

SEQ ID NO: 26709 - DNA, 111 bp, Homo sapiens
ttcaggggtggctctgaaggagcaactccatttttttttcctttttttcttttttcttttttttttttttttttgagatggagtctcactcactcttttgcccagcctgga

SEQ ID NO: 26710 - DNA, 98 bp, Homo sapiens
tcatccactgggcagtttggcaggaagcggggaggggagttgttttgggaagacttcactgactctcaatctctcttctccaagaccacaggggttga

SEQ ID NO: 26711 - DNA, 99 bp, Homo sapiens
tctctgggttctttgtctgttttagatatctagacatatatgtctgtctctgtgtgtatgtgcatgtttatgtgttgcagaaacagttgggaaaagaga

SEQ ID NO: 26712 - DNA, 111 bp, Homo sapiens
cctaaaatacttatgtgtgtatatatatataaaatatgtacgtatgtatgaaataatgtataaatatatttgtacattgtgtgtatatatatacatgaaagagaaagcggg

SEQ ID NO: 26713 - DNA, 105 bp, Homo sapiens
tacatatatatttatatgtgtgtgtatatatatgtgtatgtatgtatgcatatatatgtgtgtgtatatatatatatatatatatacacatatacacacacatat

SEQ ID NO: 26714 - DNA, 86 bp, Homo sapiens
tatgtgttctttttgtgaatatatgtatgcatttctattgagtagaattgctagagcatatatatatatacatatatatacacata

SEQ ID NO: 26715 - DNA, 87 bp, Homo sapiens
tcacaatgtgtacaccccctgtgtcattaaaagtaaaattgccccaggatattacgaaatagaacacagggagcacaccccgtgtga

SEQ ID NO: 26716 - DNA, 74 bp, Homo sapiens
ccttctgaagtcacagttacagtgctagctaggtgacgatactttgcaggactggaacaaggttctttagaagg

SEQ ID NO: 26717 - DNA, 102 bp, Homo sapiens
gagagagcaagcagtatggatatctgggtatggtcagcagctttctaaagtggtccctaatgatctctgcctcctggtattcatgttctatgtaggttcctt

SEQ ID NO: 26718 - DNA, 109 bp, Homo sapiens
gatgttatttgtagtcttatagagagatattactttaaatatcacagtgggtgtacacacatggggtacacccactggcatattatttgtaatatcttcgagagatatc

SEQ ID NO: 26719 - DNA, 91 bp, Homo sapiens
tctaatctctctgaatctgagttatcaatgcatatgaattcaaaagattatctgcaaagtatatgctttaacttttgtcacagagaaaaga

SEQ ID NO: 26720 - DNA, 100 bp, Homo sapiens
gatcctgattttgtcaaatgtaatcccatgtatttatgttcttatataataaagttagtgaagacatggtggttattttcataaaagaactctttggatc

SEQ ID NO: 26721 - DNA, 86 bp, Homo sapiens
tttcagattcagtaggtctagggtagaacctaaaaatttatatttttaataagtttctaggtgatgctcatgctactggtatgaga

SEQ ID NO: 26722 - DNA, 83 bp, Homo sapiens
ctggtattacaggtgtgagccaccgtgcttattttattttattttattttatttttgagacagggtctcactctgttgcccag

SEQ ID NO: 26723 - DNA, 108 bp, Homo sapiens
gcaaaactgagatcagtttagtgtcatttttttagtcagtatagtgtgagctcattaaatatttgaaaaacatgattttaaattgatttctaatatttcatgttatgc

SEQ ID NO: 26724 - DNA, 58 bp, Homo sapiens
tgagacagagtctcactctgtcgcccaggctggagtgcagtggtgcaatatctgctca

SEQ ID NO: 26725 - DNA, 80 bp, Homo sapiens
cacacgtatatacacacacacatatatatacacacgtatacgtgtgtgtatatatatataaaaggctgtgtaatacggtg

SEQ ID NO: 26726 - DNA, 111 bp, Homo sapiens
gccaggcataatagcgtgcgcctgtagtcatagctagttgggaggctgaggtagaaggatcacttgagcccaggagtttgaggctacagtgagctatgattgtgccactgc

SEQ ID NO: 26727 - DNA, 112 bp, Homo sapiens
gactccctgagactgtcccacaattcactggtgccctgttcatttttttaagattcttttttttatttcattttgggtagttttcactgctgtgttgtccagttcactagtc

SEQ ID NO: 26728 - DNA, 116 bp, Homo sapiens
gggatggtgggcagactatgtgtacgaaggattgggccaaaaaagattatgaagtatcttttcttttttttttttttttttttttttttttgagacacagtctcgctctgtcaccc

SEQ ID NO: 26729 - DNA, 58 bp, Homo sapiens
tgagacggagtctcactgtgtcaccagggctggagtgcagtggcctgatctcggctca

SEQ ID NO: 26730 - DNA, 90 bp, Homo sapiens
cagaattggtgggtgacatttcataggcagccccctaacgctcagtctgtctcagacaccctgctggactgcctgtgcctactaggagtg

SEQ ID NO: 26731 - DNA, 92 bp, Homo sapiens
cgggtggtgtcctacacagagcaaagacaacagaactagagtccaaagatgaaagctgttccttctaactgtggagatcaaggtagtgcccg

SEQ ID NO: 26732 - DNA, 95 bp, Homo sapiens; identical to SEQ ID NO: 68

SEQ ID NO: 26733 - DNA, 93 bp, Homo sapiens; identical to SEQ ID NO: 69

SEQ ID NO: 26734 - DNA, 63 bp, Homo sapiens
tgcacgtgtgtcagtgtgtgtgtgtctgtatgcgagggtatatgcatgtattgtgtgtgtgta

SEQ ID NO: 26735 - DNA, 80 bp, Homo sapiens
tatacactgacacacgcatatactcacacatgcagacacacactaacacacatgtgcagatatgtgtacacagatgtata

SEQ ID NO: 26736 - DNA, 80 bp, Homo sapiens
cagaaaaggaatattagtggaaatactgatacaatttgcataaagtatgtatattagtattatgtctagtgttctttctg

SEQ ID NO: 26737 - DNA, 112 bp, Homo sapiens
ctgaaaatattccaaatactatttgtagagaggttctaggatgtattgctttcataaaacaagaatacgctcctgggaaattgcaactttctgtgactaaaaatattcttag

SEQ ID NO: 26738 - DNA, 122 bp, Homo sapiens
ggcagagcacataatggcagaagccctagtgtggtggagccccagcttcttttaggaaagtctttatttattattgtcttgctgagaaatggtgagaagaaattggactcaccttttggagc

SEQ ID NO: 26739 - DNA, 119 bp, Homo sapiens
gggtcatcatgggagaggaactggtggctttattataagaggaagagagacttgagtgagcacattagcatgctcagtcccctcactatgtgataccctgtgccatctcaggactctgc

SEQ ID NO: 26740 - DNA, 110 bp, Homo sapiens
gattgtcctgctttcctcaggttttcttctgccatctgtgacagcttcttgatctgtccccagatgggtggctgtgctcgtgacagttggagtcctcctcagcatcagtc

SEQ ID NO: 26741 - DNA, 113 bp, Homo sapiens
gttatttgtgggattttcataaatgttctttatcatgttgagtaagtggtattttatttttaatttattcagtgtttttagcatgaaaggatgtttggattttgtcagatgat

SEQ ID NO: 26742 - DNA, 115 bp, Homo sapiens
gtcaaatgtagtaaaataggaaacaatcagttttgagtatttattattgtttaaaaattattttatttaatggtaagtttacataacttaattttcagttatggctatttttaac

SEQ ID NO: 26743 - DNA, 93 bp, Homo sapiens; identical to SEQ ID NO: 69

SEQ ID NO: 26744 - DNA, 68 bp, Homo sapiens
agaggtgagaccctctctgtatctttatttgccaattggtgaaggataggtagggatcctactcctct

SEQ ID NO: 26745 - DNA, 72 bp, Homo sapiens
agagaagctcagcagcaggagtcaggtgacgtcagtgtcatcttctgacactctctgtcttgctctttatgc

SEQ ID NO: 26746 - DNA, 85 bp, Homo sapiens
ggccatgatgggtccccgagaaacgctgagcacttacttccagctctaaaatgatgtgactctgtgggtctgtgaccctgtgacc

SEQ ID NO: 26747 - DNA, 59 bp, Homo sapiens
tgagactcgagtctcgctctgtcacccaggccggagtgcagtggcgcgatctcggctca

SEQ ID NO: 26748 - DNA, 58 bp, Homo sapiens
gtgtatgtgtatatatatatacatgcatgcatgtatatatttgtgtgtacacacacac

SEQ ID NO: 26749 - DNA, 81 bp, Homo sapiens
atatgtgtttattcatatacatatatttaaatatttacaggtaaatcattttaaatatgtgtatttacaggtaaatcatgt

SEQ ID NO: 26750 - DNA, 107 bp, Homo sapiens
ggagacaagagtgaagttatggccctctaatggtgagaagaagggaagcaaaaaattctacttttttttttttttttttttttgagagagagtctcgctctgtcacc

SEQ ID NO: 26751 - DNA, 101 bp, Homo sapiens
gagtcaatggggatgttttcatcacacatgcagggagagggagttctagaaagagcatctgcttctgatatgcttggtgttgaagtcagtcctaatcaatc

SEQ ID NO: 26752 - DNA, 67 bp, Homo sapiens
cagggaaaaaaggggacatatggggacctcctcttttggctttggagtccccctcactctgtctctg

SEQ ID NO: 26753 - DNA, 74 bp, Homo sapiens
agatggagtctcactctgtgccccaggctggaggtttttttttttttttttggggacagagtctcgctctgtct

SEQ ID NO: 26754 - DNA, 95 bp, Homo sapiens; identical to SEQ ID NO: 580

SEQ ID NO: 26755 - DNA, 93 bp, Homo sapiens; identical to SEQ ID NO: 69

SEQ ID NO: 26756 - DNA, 110 bp, Homo sapiens
tgcttaggattgtcttggctatatgggttcttttttggttccatatgaaatttaaagtagttttttcgaattccgtgaagaacgtcagtggtaacttgacggggatagca

SEQ ID NO: 26757 - DNA, 105 bp, Homo sapiens
acagtaactttactgtccttacaatttagtagtgtataatgtgccatcttatggaattattatatttatcaaactatttctcttgtttgacagttaaggatttgt

SEQ ID NO: 26758 - DNA, 95 bp, Homo sapiens; identical to SEQ ID NO: 68

SEQ ID NO: 26759 - DNA, 93 bp, Homo sapiens; identical to SEQ ID NO: 69

SEQ ID NO: 26760 - DNA, 72 bp, Homo sapiens
atttgctctctttagctatttaatctcttctgcatgttcagagggagaaaatgagtgatgagagagagaagt

SEQ ID NO: 26761 - DNA, 101 bp, Homo sapiens
attgttattcttgctgattatgtttctgtcattgacactgtgtatcactgagttgggatgtgtattagatagaatcatggaaggtaaggttatagaacaat

SEQ ID NO: 26762 - DNA, 95 bp, Homo sapiens; identical to SEQ ID NO: 68

SEQ ID NO: 26763 - DNA, 93 bp, Homo sapiens; identical to SEQ ID NO: 69

SEQ ID NO: 26764 - DNA, 58 bp, Homo sapiens
tgagagggagtctcactctgtcacccaggctggagtgcagtggtgtgatcccggctca

SEQ ID NO: 26765 - DNA, 116 bp, Homo sapiens
aagtgaattaacatgcctagtttgcaaatttaaatatatatatatatatatatatatatatatatatatatatatatatatatatacatttgttaagaaaagttgaatgtccttca

SEQ ID NO: 26766 - DNA, 96 bp, Homo sapiens
atcatgacatagaggaggctgtacagagtgagcactagaacttgccatgcatcatttctgtccacattctattggccagaactaagtcacatggat

SEQ ID NO: 26767 - DNA, 95 bp, Homo sapiens; identical to SEQ ID NO: 68

SEQ ID NO: 26768 - DNA, 93 bp, Homo sapiens; identical to SEQ ID NO: 69

SEQ ID NO: 26769 - DNA, 101 bp, Homo sapiens
ggtcagcaaatctgtgttcaagtccttactcagactctcactaacattgggaaaatcactgaccctctctgggtctgagctggaagcatcaagattggacc

SEQ ID NO: 26770 - DNA, 77 bp, Homo sapiens
cttcataccagaaactgagagtagtcagagaggtgttttcagcaagggagaggcacattcagatttttggtttgggg

SEQ ID NO: 26771 - DNA, 89 bp, Homo sapiens
tctatctatcatctgtctatctctctgtcgcgggttagcagcaactgtctgggccagtgatgcaggggtaaacaaatgtaccaagacag

SEQ ID NO: 26772 - DNA, 81 bp, Homo sapiens
tatatacatacgtgtgtgtgtgtgtgtgtgtgtatatatatatagataaaactcctctttatatacatacgtgtgtgtgtg

SEQ ID NO: 26773 - DNA, 118 bp, Homo sapiens
cattgcaatccagcctgggtgaaaaagcgagaccctgtctctaaaaaataaaaattaaaagttaattttttttttttgagatggagtctcactctgtctttcaggctggagtgcagtg

SEQ ID NO: 26774 - DNA, 56 bp, Homo sapiens
ggagccatagcaagaagggagaggtgtgtgtcctctctgtctctgtctctgtctct

SEQ ID NO: 26775 - DNA, 76 bp, Homo sapiens
cagctcagtgttttacagtgatgaagatgatgttgatgatgatgatgatgatgtcaacatccatcattctgaggtg

SEQ ID NO: 26776 - DNA, 75 bp, Homo sapiens
ttctccactgggatggtgtggaataactcaagtgagtcagctcacaggaggctgctgcccttccatcgtggaggg

SEQ ID NO: 26777 - DNA, 63 bp, Homo sapiens
gtgcttctctcagtgtctgacacctggtgagatttgccacctgtttggtgcatgggtgagtgt

SEQ ID NO: 26778 - DNA, 72 bp, Homo sapiens
ctttaactgcagagttcctcgtcctagcttgatgcattcatgcattaggtgctcactcactgtgtgttaaag

SEQ ID NO: 26779 - DNA, 59 bp, Homo sapiens
cacagggctgaggggctggagcttggggtaccaatggtgacagtctctccctccctgtg

SEQ ID NO: 26780 - DNA, 88 bp, Homo sapiens
gagtgattgaaagcatgagctctagagacaggctgttgggttcatatcccgttctgccactcactggctgtgcctcagttttctcatc

SEQ ID NO: 26781 - DNA, 94 bp, Homo sapiens
ggtatattcctgtggtagttcttagaggaaaagctcacagtgtggatctctacatactgctctgtccctctgagtggcagctgcaagttattcc

SEQ ID NO: 26782 - DNA, 63 bp, Homo sapiens
tgagttgagacagtgtctcactctgtagcccaggctggagtgcagtggtgcaatctcagctta

SEQ ID NO: 26783 - DNA, 314 bp, Homo sapiens
atatatatacgtatatatatgtgtatatatatacgtatatatatgtgtatatatatacgtatatatatgtgtatatatatacgtatatatgtatatatgtgtatatatatacgtatatatgtgtatatatatatacatatatatatatgtgtgtatatatatatacatatatatatgtgtgtatatatatatacatatatatatgtgtgtatatatatatacatatatatatgtgtgtatatatatatacatatatatatgtgtgtatatatatatacatatatatatatatgtgtatatataactttggatgc

SEQ ID NO: 26784 - DNA, 115 bp, Homo sapiens
aaacttccaggtatagattgagcacaagggtgtctctcacttttaacttgagactgattcaggactttgtaaaattgttgaaactctaatgctaatcgtataatctattcagttt

SEQ ID NO: 26785 - DNA, 95 bp, Homo sapiens; identical to SEQ ID NO: 68

SEQ ID NO: 26786 - DNA, 93 bp, Homo sapiens; identical to SEQ ID NO: 69

SEQ ID NO: 26787 - DNA, 88 bp, Homo sapiens
gttgtcctcacagtgtgaatgccatgtgttcgtcaagttcacttggatttctcccacacactcacactctgtattctgggaattaagc

SEQ ID NO: 26788 - DNA, 58 bp, Homo sapiens
tgagagtgagtctcactctgtcgcccaggctggagtgcagaggcatgatctcggctca

SEQ ID NO: 26789 - DNA, 116 bp, Homo sapiens
atatccatattctgagatagctggtgcaattttcagcatatgacctaacttttgtgtctctgtttctgagtatataaaatcaggaaaattgcagaactatctcagagcatgggcat

SEQ ID NO: 26790 - DNA, 121 bp, Homo sapiens
tagtctagtaaagttcttagaatacttcctagcatgtagtagcacttgaaaagttttattttttattatgatgggacttatttgcaatgtgtatgggagcattcttgactgcctcaatgac

SEQ ID NO: 26791 - DNA, 63 bp, Homo sapiens
atacacacacatacatatacacacatatatatcaatatgtgtgtatatatttatatgtggtat

SEQ ID NO: 26792 - DNA, 58 bp, Homo sapiens
tgagaccgagtctccctctgtcacccaggctggagtgcagtggcacgatctcggctca

SEQ ID NO: 26793 - DNA, 107 bp, Homo sapiens
gagctgcattgcacagggttttgggtgggtggcatagcacttcctcagtccctctgtctgatgtctcagtaggtcaggcactgccccagtccactggctctaagccc

SEQ ID NO: 26794 - DNA, 79 bp, Homo sapiens
gtggccttcttctctgggtgtctgtctctgtgtctctcctcttattagaaagatgtcagtcatgttggattaagggccc

SEQ ID NO: 26795 - DNA, 88 bp, Homo sapiens
gggagaagataaagctgaggatctgatggagtcagaacacagagggctctgtcttatcaagttgggaagtatagctcagtcttccacc

SEQ ID NO: 26796 - DNA, 88 bp, Homo sapiens
tacaacaaagtgaatactgcaggtgacagtgtggaaatctatttttcattatacaactgtcacttgatgtacatacttctttgctgtg

SEQ ID NO: 26797 - DNA, 91 bp, Homo sapiens
gtgcccttaataaatatcagtcgtgtctatgagtgcacgtgcctgtgtgtgcaggcacactcccttagttcaggtgatatcttaggtgtat

SEQ ID NO: 26798 - DNA, 95 bp, Homo sapiens; identical to SEQ ID NO: 580

SEQ ID NO: 26799 - DNA, 93 bp, Homo sapiens; identical to SEQ ID NO: 69

SEQ ID NO: 26800 - DNA, 87 bp, Homo sapiens
tagctcaaagtggaaaagatttggtgcctttgtcaggttaaaaaaaaagtgctattgaatttttaaatatctcttctactttggtta

SEQ ID NO: 26801 - DNA, 101 bp, Homo sapiens
ttctgtaaaagaggaacaaattggaactgtgttataaataatatgacagtcatgtgaattatataaatattagttttaattctatttgatttgttacagag

SEQ ID NO: 26802 - DNA, 83 bp, Homo sapiens
tatgtatgtatgcatgcatctatgtatgtatgtatataattgacactacttgcaataatctggaatgcatgtatatagatata

SEQ ID NO: 26803 - DNA, 117 bp, Homo sapiens
cttttctgagtttgtgcttccctctaccagcttttttttttttttttttttttttttttttttggctaaagaaaattaaggtggtgggtagagaagtggtaatgatgatttaaaaag

SEQ ID NO: 26804 - DNA, 117 bp, Homo sapiens
gcctgagattctccattcccattgggtcacataaactgagtgagagcagacaggggagatggtgagtggctgccatattccaatcagtgcaagatttctcttttctggttcataaag

SEQ ID NO: 26805 - DNA, 87 bp, Homo sapiens
gaagagacaaagaagactgggcaactaatacctcagggcagcagagctatgagggtttaatagtttctctttttttttttttttttt

SEQ ID NO: 26806 - DNA, 98 bp, Homo sapiens
ttctcagatacattcacatctctgattttcttgcacttaagacttttttcttttagtttttcttgcagttaagaggacgtgtgagtagattgccaggg

SEQ ID NO: 26807 - DNA, 119 bp, Homo sapiens
gtatgatacacatatgatatataatgtatcatatatgtatatatgtgtgtatatacatatatatactatatatatgcatttgtatatatgtgtgtgtatttatatgtgtgtgtgtgtgt

SEQ ID NO: 26808 - DNA, 83 bp, Homo sapiens
tctgcccagtggtggctgtggttgccttcatttgttaccaagagaggacagagtgaacagattgcctgagccaggtgggtgga

SEQ ID NO: 26809 - DNA, 100 bp, Homo sapiens
ctgcccttcccttttccccaggaaaacaatgatctggtttatcctcattatgtaaagtagtttgcatttttcagaactttgttgaaagggaattaaacag

SEQ ID NO: 26810 - DNA, 85 bp, Homo sapiens
ccattttgctatatattttattttacatattagtttcagataaaaccaatatttgagtcatgtagtaggaagaattgtaaaatgg

SEQ ID NO: 26811 - DNA, 58 bp, Homo sapiens; identical to SEQ ID NO: 3368

SEQ ID NO: 26812 - DNA, 97 bp, Homo sapiens
ccaaaaaggggaatgtgggaaagcttcatggaaaaggtaatttttaaatttatttttatttttttgagatggagtctcactctgtcacccaggctgg

SEQ ID NO: 26813 - DNA, 116 bp, Homo sapiens
tctagttttcagttgtacaggatcacttttgccccttcttttaaaatgttattattattattattattattattattattattgagatggagtcttgctctgtcactgaggctgga

SEQ ID NO: 26814 - DNA, 120 bp, Homo sapiens
cttgtggagtacttgtgtaatattgtactcatttttttctattgcttatcttctttttttaaattatactttaagttctggagtacaagtgcagaatgtgcaggtttgttacataggtat

SEQ ID NO: 26815 - DNA, 118 bp, Homo sapiens
ggccaattgtatgattgggtggtctaaaaataagtttagtttttgtttttgttttaaattgcggtttaataaaataacaaatgtgagttatacttcccagttggagttacttaaggct

SEQ ID NO: 26816 - DNA, 111 bp, Homo sapiens
atgtgtgttattgcctctgaggaccttccagtggaataggatgtggaggtggaatagtgatattgatgatcctgatcctgatcctctgtaggtctaggttaatgtgtgcat

SEQ ID NO: 26817 - DNA, 87 bp, Homo sapiens
cacaatattccctggtagtatgtttaatatttaagtctttatagctacagggatagtggagtatttaacaggggaggggacagggtg

SEQ ID NO: 26818 - DNA, 88 bp, Homo sapiens
gtctcctcatgatccttaaccatatctgcaaagtttttttgtctatatataaagtgacattcacagattccaaggattaagacatgac

SEQ ID NO: 26819 - DNA, 113 bp, Homo sapiens
ggattgttttttctatatggtctcttttttggttccatatgaaatttaaagtagtttttttctaattctgtgaggaaagtcaatggtagcttgaggggcatagcatcaaatct

SEQ ID NO: 26820 - DNA, 98 bp, Homo sapiens
gtccattttatctgacatatatgtatatatataaatatatacatatacatatatatataaaaaaatgtgtctgcgtgtgtgtctgtgtaagtatggcc

SEQ ID NO: 26821 - DNA, 79 bp, Homo sapiens
cagtattctctctctctctttctggaccttggaattacattccccttatagggtttatgaagggttttagtgattgctg

SEQ ID NO: 26822 - DNA, 104 bp, Homo sapiens
aaactagtatttacttagtacagtgtaatttaaaccttgaaaactaaagtgttttatttatttgtaaaaatcttttcaagagtaattagaactgtgcctggttt

SEQ ID NO: 26823 - DNA, 84 bp, Homo sapiens
gtagatggaatgactgtgtcatattgaaggtgtatatttaactttttaaagtggctttgcacaagtgtataggaattcatttgc

SEQ ID NO: 26824 - DNA, 86 bp, Homo sapiens
ctccagcctgagcgacagagccagaccttgtcttgaaaaaaaaggtggggaatggggggctaactctgtctctcagtttaactgag

SEQ ID NO: 26825 - DNA, 111 bp, Homo sapiens
caggagcagagagattggtcaggtgcttggagccataaggtcactcaccttccattgagaacacactgaccacagctcccaccacctgaaccaaagttcatttcgctttgg

SEQ ID NO: 26826 - DNA, 103 bp, Homo sapiens
ctgactctgccaggcctcagcgttctttttttttttaattatttttatttttatttttagttttgagatggagtctcgctctgtcgcccaggctggagtgcag

SEQ ID NO: 26827 - DNA, 77 bp, Homo sapiens
gtacatgcatagatgttcttacgtgtgtgtgtgcacttgtgcatatatatatgtatgtaagctttttatttatttat

SEQ ID NO: 26828 - DNA, 112 bp, Homo sapiens
gatgcttgcttttggatggcgtctctggactgcacatttggggatagatccaatgggtgtgacttcagtgtgacctcagagggttgctgagccttgggtgagacatctccag

SEQ ID NO: 26829 - DNA, 105 bp, Homo sapiens
gtgttaaacattcagtgtggcagtgttcttagctttctttttttttttttttttttttttgagacggagtctcgctgtgacagccaggcaggaatgcagtggcat

SEQ ID NO: 26830 - DNA, 87 bp, Homo sapiens
tcctttaaatatactttttctgattatcatgacaaacttctttatttatttgtcatgagctcctgagtaaagaggcaaatggaagga

SEQ ID NO: 26831 - DNA, 107 bp, Homo sapiens
cacagtctagtgttaggtagcacagcagagtgactgtagttaatgatttttattatatatttcaaaataactagagtggaattgaaatgttctagcacaaagaaatg

SEQ ID NO: 26832 - DNA, 58 bp, Homo sapiens; identical to SEQ ID NO: 18547

SEQ ID NO: 26833 - DNA, 80 bp, Homo sapiens
gctgggtctgctctactcctggcatcaggcatcattcctgtgatcctagcaaagaagttaaggagtcagcagagatttgc

SEQ ID NO: 26834 - DNA, 100 bp, Homo sapiens
cacatcctatatgtgtatatatgtatatatacacgtatatatacacacgtatatatgtatattatatgtgtatatatgtgtatatatgtgtgtatatatg

SEQ ID NO: 26835 - DNA, 67 bp, Homo sapiens
aggatctgccccactcagtgactcccagcctaggagagacctgggagctgaaatctaggctgatcct

SEQ ID NO: 26836 - DNA, 58 bp, Homo sapiens
gtgtctactgtgcatttgaagatgaagattatttatgtttagagagcactgtagacac

SEQ ID NO: 26837 - DNA, 94 bp, Homo sapiens
cagctgtgtgacaccatgcatggcttatttttgtatttttatttacatatatatatatattttgagatggagtctcactctgtcacccaggctg

SEQ ID NO: 26838 - DNA, 86 bp, Homo sapiens
gagcatgacaatcacatcttttgcttagtttgtgtgttagacatcaaaaatggcaaagaattctaaagatgtttctagtcatactt

SEQ ID NO: 26839 - DNA, 90 bp, Homo sapiens
ggcccaagcttggtttcatgctgtcggcatcttgaaattaacaataatttttgaacaggaagttgcatgttttcattttgcacagggacc

SEQ ID NO: 26840 - DNA, 71 bp, Homo sapiens
gaagctctctctagctctgtctctgttgctgtagctgcagcctatggaaggactgttgtgaagatagcttc

SEQ ID NO: 26841 - DNA, 97 bp, Homo sapiens
tacaggtattgaattcattattttctttttctatttttcaatgattaaataattgttgtacgtatttgggggcatgtgtaatattttgatacctgta

SEQ ID NO: 26842 - DNA, 90 bp, Homo sapiens
agtatctgactgtatggagtttctgttcacttcacatgtcccactcttccacctagttgtaagtctctcaaactctcaaagtcagaaact

SEQ ID NO: 26843 - DNA, 74 bp, Homo sapiens
ttctgtctctctgtgggtgactgtgcacgtgtgtacccacatgtgtgcacaggaagcatcactgcagaaccgac

SEQ ID NO: 26844 - DNA, 62 bp, Homo sapiens
gtatgtgcatatgcatgtgtgtgtgtatatatatgtatatatatgtatgtgtatgtacgtat

SEQ ID NO: 26845 - DNA, 110 bp, Homo sapiens
ttgaggaaggcactgacagggcacaaagtaattccctaaggtgacagaagagacagaaccattctcctttttatggaatgacgacccttacccagaacttgttctctcag

SEQ ID NO: 26846 - DNA, 101 bp, Homo sapiens
ggcatggtgacacctgtctataatcccagctactcaggtggctgaggtaggaggatcacttgaggccatgagttttatacctgcctgggcaaaatagagag

SEQ ID NO: 26847 - DNA, 84 bp, Homo sapiens
cccaaaatatttttaaatgtctcttgaaatctttcactcacgtgtgattgaagagtgtgttatttaatctccaagtgttttggg

SEQ ID NO: 26848 - DNA, 93 bp, Homo sapiens
attaattctatgagtgacaggtgagtgtgcagaatgtctcactgacatacttcttcccaagcaaactgacctctgaacaaatgtggatttaat

SEQ ID NO: 26849 - DNA, 80 bp, Homo sapiens
tggctctagctagagacactagagactgatgagatccagctggaatggggcataaaggactgtggtgggcatggtagcca

SEQ ID NO: 26850 - DNA, 81 bp, Homo sapiens
gtgacccaatcagtgagagctcctcctgtgacattctttttttattttttaaaagagagagatggggtctcgattgatcac

SEQ ID NO: 26851 - DNA, 109 bp, Homo sapiens
atctttaaatatctaatttttagaagtaaatgtgtatatttaaattatacacatttaaaattgtgtatatttaaatatataacatgatgttatggatagtaaaaaggtg

SEQ ID NO: 26852 - DNA, 58 bp, Homo sapiens; identical to SEQ ID NO: 315

SEQ ID NO: 26853 - DNA, 116 bp, Homo sapiens
caaacctgtttgtcaacttcttgggcaagttattttctatttatttatttatttttaattatttaattattattattattaagttccagggtacgtgtgcaagatgtgcaggtttg

SEQ ID NO: 26854 - DNA, 73 bp, Homo sapiens
tgtagtagctcttccctgagaccagcgacgtcccagagagggacgttctgtcggtctgagtctgagtcctgca

SEQ ID NO: 26855 - DNA, 77 bp, Homo sapiens
tcatcatcatcatcatcatcatcatcaggatattgaggctttctcaaggacttggaatgtgagctggatcatgatga

SEQ ID NO: 26856 - DNA, 114 bp, Homo sapiens
cagttcacaaagataacattttctccacatccttgccaacacttgtaattttctatttgtttgataatagtcatgctagtgagtgtgaagtggtgatatctcactgtggctttg

SEQ ID NO: 26857 - DNA, 103 bp, Homo sapiens
gcaacactaagaaaatctctatccccttccacatggtatcactttatatatttgaaattaaccatgaagaaggcagtcatacttggagaggttaaagagatgc

SEQ ID NO: 26858 - DNA, 111 bp, Homo sapiens
ccacatcatgcacctctttgggcacaggatctgcatgtgctatcaactcttacactctgtggctctcaaatagacactgcagcatccgcctcatctcacaggctgacctgg

SEQ ID NO: 26859 - DNA, 77 bp, Homo sapiens
ttgatttttgattttacaggctcataggtgaaacagacttgccttgtctcagatgagactgtggacttttgagttaa

SEQ ID NO: 26860 - DNA, 97 bp, Homo sapiens
ttcttaaagtcagttagcatatgtccccagaaattaagttttttttacatttgctaagactgctttagtttctttgcatatctaatgatttttagag

SEQ ID NO: 26861 - DNA, 113 bp, Homo sapiens
cgtatatgtgcttgatgtattataattcataataaatttataaaaatattattcataataatatttataccgattattattgctttattataaatcatcattgcatttttatg

SEQ ID NO: 26862 - DNA, 85 bp, Homo sapiens
tttcagactagtaaattccaagtctgttttaataaaaaagtattttgcctaatggaaatacaatggaatggaatgtagtctgaaa

SEQ ID NO: 26863 - DNA, 103 bp, Homo sapiens
tcagtgtttgctttgaaccaagcactttgcttcagagatcatagagagcagtaagacaacatctccaatctcatggaacatacaaagtagctgcagaaactga

SEQ ID NO: 26864 - DNA, 92 bp, Homo sapiens
gatgagcacacaagtggcaagaataaaacactgagagaaaacaacggggagcaccaacattcagtcagtcagtcactcaacaaatgctcatc

SEQ ID NO: 26865 - DNA, 70 bp, Homo sapiens
gagttacatgcatctctctggatcttccactatagagcaagtgatctgatttagatggattcaaaaactc

SEQ ID NO: 26866 - DNA, 135 bp, Homo sapiens
atatgtgtatgtatatccaatcatatatatggagatatatatatgatcatatacatggatatatatgtgtatatattatcatatatatggatgtgtgcatatatgtatgtatatatgtgtatgtatgtacatata

SEQ ID NO: 26867 - DNA, 98 bp, Homo sapiens
ttatacatgtaaaagcaaatgtgtatatatatatatatatatatatatatatatatatatatatatgtatgtgtgtgcatgtgtgtgtgtgtgtgtga

SEQ ID NO: 26868 - DNA, 108 bp, Homo sapiens
tcaaagtttcttggaaactagaaaatcatgggatttgacattcatcctgtctccttccaaagtagagggcaatcaaaactcatgacttatttctgagatgagcttaga

SEQ ID NO: 26869 - DNA, 98 bp, Homo sapiens
tcaaatcttatttattgctgtatctcctgcacatgaaatattttatttaataaatatttgaggaagtgtgggaattggaggaagagagggagggagga

SEQ ID NO: 26870 - DNA, 76 bp, Homo sapiens
tatgactttttcttattgtgtacttcaggtattcgggaaactgtccttacctaagttatgcaatagataagttata

SEQ ID NO: 26871 - DNA, 61 bp, Homo sapiens
gagtttagggaaacagaagtttgttatggtctccatctaaacaaccttctgactctctctc

SEQ ID NO: 26872 - DNA, 89 bp, Homo sapiens
ggacaatgaattctgcattctgcttttgtttttgttttttgaggcaaagtctcactctttctctcaggctggaatgcagtggcattacc

SEQ ID NO: 26873 - DNA, 84 bp, Homo sapiens
ctcagctgataagtgatggaacaaagattggaactcaggtcttgtgccaaaacctatgtttttattttgcattgtatctctggg

SEQ ID NO: 26874 - DNA, 123 bp, Homo sapiens
gacacatggagactggataagagtaatgatgatgatgatggtagctatgatgatgatgataatcatgatgatgatgatgatggtacaattgacatctactctgtgttccaggcattgttttca

SEQ ID NO: 26875 - DNA, 116 bp, Homo sapiens
gctgtcttatctgtgctttactgtgttctctttctggctgcttgttgttagaagagaagtgatttccttgaaatgcatgaggttagaaagggagctggatcttaaagtggtagtat

SEQ ID NO: 26876 - DNA, 105 bp, Homo sapiens
aggagggcagtgttttacccagagtagtgtcactctctgaatgtctatatgctgtgatggatagaagaacactaggcctgagaggtgaagccagctggtcttcct

SEQ ID NO: 26877 - DNA, 62 bp, Homo sapiens
acatacagagggaatgaggcagaaaggagatgaggatctctctctctctctctcgtgtgtgt

SEQ ID NO: 26878 - DNA, 95 bp, Homo sapiens; identical to SEQ ID NO: 580

SEQ ID NO: 26879 - DNA, 93 bp, Homo sapiens; identical to SEQ ID NO: 69

SEQ ID NO: 26880 - DNA, 70 bp, Homo sapiens
tggcttccttatctgctctctctttctcacttgttcaggcttcgggaaggcagggttgcagttggagcta

SEQ ID NO: 26881 - DNA, 75 bp, Homo sapiens
ctgtggcaagagttgtcattttgtggttgacaccccaagcaagggagtttggtcattgacctagctgtgctgtag

SEQ ID NO: 26882 - DNA, 70 bp, Homo sapiens
agtcacccacacacacactgccacccacctgggacatttctgcctggtttgttgttctctgtggctgact

SEQ ID NO: 26883 - DNA, 103 bp, Homo sapiens
gcttccaaatattctaggccttgggtgtttcagagattttgttgtactgtggacagatttcaggaggattttcacacacacgccatcctaaatttttcagagc

SEQ ID NO: 26884 - DNA, 87 bp, Homo sapiens
tggtcagaaccctggcagagcgaggacaagtatggcattgaggtgcccgaagtgcctgtgaccctctctgagagggaaaagtgacca

SEQ ID NO: 26885 - DNA, 120 bp, Homo sapiens
ctcaccctctcaagagagtagtcattcccttcttggtatcctctactgttagacagcctctctctgtctctctttgattcctaaatgaaggtccaggctctgcttcctggagaccgtcag

SEQ ID NO: 26886 - DNA, 95 bp, Homo sapiens; identical to SEQ ID NO: 580

SEQ ID NO: 26887 - DNA, 93 bp, Homo sapiens; identical to SEQ ID NO: 69

SEQ ID NO: 26888 - DNA, 103 bp, Homo sapiens
catgtttatagaatgtgaactatttcttacatatatacccatacacacatatgttatatttatatatctgtgggtatgtagaaataatatctaatctgttatg

SEQ ID NO: 26889 - DNA, 86 bp, Homo sapiens
caatgggacatataatatatgtgattatgtataatatatgtgacatatgtaatatatatgtttataatatatcatatatcctattg

SEQ ID NO: 26890 - DNA, 88 bp, Homo sapiens
ttgatactgggtttcacagctgccagaactgtgagaaatatgtttctttttaaaaataaagtacacagtctgtgatattctggtacag

SEQ ID NO: 26891 - DNA, 192 bp, Homo sapiens
accatatatatatacatatatatgtatatatatgtatatatatatgtatatatatatgtatatatatatgtatatgtatatgtatatatatatgtatatatatgtgtgtgtatatatatatgtatatatatatgtatatatatatgtatatatatgtgtgtgtatatttgtgtgtatgtatataaacacata

SEQ ID NO: 26892 - DNA, 91 bp, Homo sapiens
taatacatatatattataaatacaaagtacataatattgaagtaatatatattactttgatatatatgtatatatgtaagtttatgtgtta

SEQ ID NO: 26893 - DNA, 129 bp, Homo sapiens
tgtacatatatgatatatgtatatgtgtatacatagaaatatatatgtatatctgtatgtatatgtgtgtatatatgtctatacatatacgtattccatatactgtgcaactatattgtcaatgtctac

SEQ ID NO: 26894 - DNA, 64 bp, Homo sapiens
accactagctagctatgagagctggagagctctctttctcactctctctcagttaactgttggt

SEQ ID NO: 26895 - DNA, 111 bp, Homo sapiens
tattgtgaaaagtttcagatgagattattttcttttagtctttttaaatatcactatatgtatttaaatagaagcaataaactagagagagtgtttcttgaaaagacaatg

SEQ ID NO: 26896 - DNA, 84 bp, Homo sapiens
ctgttaaagtgttgttcagacttattgcctaatgatgctggtgaaggctgtctctctcagtatctgtttgcacaacaaggtcag

SEQ ID NO: 26897 - DNA, 75 bp, Homo sapiens
ggtcttagagcttgtaaataagagggctgggatctgaaacccagcattctggctctctcactgcctttcttaacc

SEQ ID NO: 26898 - DNA, 100 bp, Homo sapiens
gtaaaatcaaatgaaagtgcaactcagtctttttgtctcacctttgtgtcctagaacatggtagccccggggagacttgtcactttgagagccgttttcc

SEQ ID NO: 26899 - DNA, 116 bp, Homo sapiens
gatgtcttgtctcctggtccttgctgagcccatattgagcagctgatctccctctctctctgagtttcagctccacctcagtaataataatcacagactctggaggtagagaagtc

SEQ ID NO: 26900 - DNA, 133 bp, Homo sapiens
tgcattgtatatatatatgtgtgtgtgtgtatatatatatgtgtgtatatatatgtatatatgtgtatatatagtatatatatgtgtgtatatatgtgtatatatatgtatgtgtatatatatatgtatgtat

SEQ ID NO: 26901 - DNA, 85 bp, Homo sapiens
ttgctggagacacagcttaggctagtgaagaaacagttctgagttctaaacctcactcagcctgacactgtgtgtcctcaggcaa

SEQ ID NO: 26902 - DNA, 80 bp, Homo sapiens
ctccaagcctcagtctctctatctgtaaaatagggattctaatattacacttagagggttgttttggagatcatgagaga

SEQ ID NO: 26903 - DNA, 105 bp, Homo sapiens
cagcgtgacgtgaacagagccatgtaaagtctcgatgtcctgctcctgaggagacacagcagacagtgggctggtcatgtggggttcatggcatccgcgtggctg

SEQ ID NO: 26904 - DNA, 79 bp, Homo sapiens
ggggacaggcactcccttgggctcactcatcaggctgcatctgggctgtgtccactgtctgtctgtccccctggagggc

SEQ ID NO: 26905 - DNA, 110 bp, Homo sapiens
tgggacattgcatgtttgctagacttaatcattctaacacatagcgtatgactctcactgagtgttctttcatgatttctgtagcatggtgaaacactgaaaatgtctga

SEQ ID NO: 26906 - DNA, 68 bp, Homo sapiens
tgcagtcataagacctgggacctagagccaggaacactctctctgggtgtcaggttcctcagactaca

SEQ ID NO: 26907 - DNA, 111 bp, Homo sapiens
aggctggatgggtacaatgtctgggcatataaagtttttatctatattttcatctgcatatgtagagtgaagacacagtgtacacgcattaaaataacctaaacaacacct

SEQ ID NO: 26908 - DNA, 134 bp, Homo sapiens
cagtcttcagggttaggctgagctaggtttgaatctcggttccttgcataagtcacaaactgtctctgagtctcagtttccccacttggcctggcaggattgcagagaggattgcaggaggtagcttttgtggc

SEQ ID NO: 26909 - DNA, 91 bp, Homo sapiens
cagcacagccatgtggggcagcataaacacagctcatagcacactccacgtgccaactttgaaattatgtgattcatatatggtggggctg

SEQ ID NO: 26910 - DNA, 70 bp, Homo sapiens
cattgtcctctgtgctctctctactcctgtctgtaagggcaggcacagagaattcagtgaggactagatg

SEQ ID NO: 26911 - DNA, 117 bp, Homo sapiens
aggtatatatatgcacctctagacaagtgtgtgtatatatatatatatagacaggtatatatacatatatatatatatatgtacctctagacagtatataggtatatatatgtacct

SEQ ID NO: 26912 - DNA, 116 bp, Homo sapiens
gtatatatatgtgtgtgtgtgcatatatatgtgtgtgtatatatatatgtgtgtgtgtatatatatatatacacatatatatatatacctctttctctctatatatatgtatgtac

SEQ ID NO: 26913 - DNA, 86 bp, Homo sapiens
ccttatcctgtttcactctgatctttgcaggaaccgggatgtaggtgctgcagttggagaaagagaagctggttaatggggcaggg

SEQ ID NO: 26914 - DNA, 96 bp, Homo sapiens
tccttggaaaagtcacttcccgtttctgagctcagcttccacatctgtggactgaagtgaggcagcagcttgaagcgtgaggatttgattcgggga

SEQ ID NO: 26915 - DNA, 65 bp, Homo sapiens
gggctcatctcactgtctctgtccctagagcctagggcagagaaggtgctaagaaaatgagcact

SEQ ID NO: 26916 - DNA, 167 bp, Homo sapiens
tatatatatgtctctctatatatatgtctatatatatatgtctctctatatatatgtctatatatatatatgtctctatatatatatgtctatatatatatatatgtctatatatatatatatgtctatatatatatatgtctgtatatatatatatggtgtgggca

SEQ ID NO: 26917 - DNA, 99 bp, Homo sapiens
atatatatatatacagacatatatatatatagacatatatatatatatagacatatatatatatatagacatatatatatagagacatatatatatata

SEQ ID NO: 26918 - DNA, 249 bp, Homo sapiens
atatatatatatatatatatatatgtttatatatatatgtctatatatatgtctatatatatatgtctatatatatgtctatatatgtctatatatatgtctgcatatatatgtctatatatatatgtctatatatatgtctgcatatatatgtctatatatatgtctatatatatgtctatatatgtctatatatatatgtctatatatatgtctatatatatgtctatatatatgtctctatatata

SEQ ID NO: 26919 - DNA, 64 bp, Homo sapiens
gaggggcttgggagggcaggaaggacacatcaccatgagccttctcccaccctctctgtctctc

SEQ ID NO: 26920 - DNA, 107 bp, Homo sapiens
cctgggccgaccgtctttggcctgacttaggtcttgttttttttgttgttgtttgtttttttttttattttatgtttttgagacgtagtctggctctgtcgcccggg

SEQ ID NO: 26921 - DNA, 109 bp, Homo sapiens
ttaataatagataactttctacttgaaactgtgtattgcctagaaatatatttttatgttaattgtttaaagtgaaaaatgcatacttcctggaaggatctcttattaa

SEQ ID NO: 26922 - DNA, 62 bp, Homo sapiens
tgagttggagtctcgcactgtctgtcacttgggctgtagtgcagtggtgcgatctcggctca

SEQ ID NO: 26923 - DNA, 118 bp, Homo sapiens
tagtgggatgtggtggtgggtacctgtaatcccacttactcaggaggcagaggtagaagaatcacttgaacccgggaggtggacattgcagtgagccaagatcatgccactgcactcc

SEQ ID NO: 26924 - DNA, 88 bp, Homo sapiens
atatacacatatacgtatatatatgtgtatacatataaacgtatatatatgtgtatacatatatatacacacacgtatacgtgtatat

SEQ ID NO: 26925 - DNA, 95 bp, Homo sapiens; identical to SEQ ID NO: 68

SEQ ID NO: 26926 - DNA, 93 bp, Homo sapiens; identical to SEQ ID NO: 69

SEQ ID NO: 26927 - DNA, 62 bp, Homo sapiens
ctgggcacgtctgtaattctagcaccttgggaggttgaggtggaaggatcacttgaggccag

SEQ ID NO: 26928 - DNA, 113 bp, Homo sapiens
ggagaggttggaggttgactagaatcatggcttcagctcattctagaaaattatttttctaatgataaaatagagaagcaaaaatgatttgggaaaatataaatttagcttac

SEQ ID NO: 26929 - DNA, 68 bp, Homo sapiens
ggatgcagccctgcggaggcttgagtggtgctaactgagcagagagtagtcagtgtggtctgcagtcc

SEQ ID NO: 26930 - DNA, 113 bp, Homo sapiens
gatttattcctaggtactttatatttttgttgctcttgtgaatagtatattttgaagtttatactttcaaaatatttttactggggcatagtaaattaaattatttttagatt

SEQ ID NO: 26931 - DNA, 90 bp, Homo sapiens
cagagttggggatggggaaatgggaagtatactttttttttttttttttttttttttttgagaaagtgtctcactctgtcacccgggctg

SEQ ID NO: 26932 - DNA, 99 bp, Homo sapiens
agagttccagaaaaccagtggtagaggaagagatctgaatttgaaggaagatttgggttcaaatcctgactttgctttctctgacctgggtggaatttt

SEQ ID NO: 26933 - DNA, 98 bp, Homo sapiens
gctacctgctgagagatatcccagatgctgactggccactaataatagtctggctgcctgtttgccatctgttcctgaattagcagctgccattctct

SEQ ID NO: 26934 - DNA, 97 bp, Homo sapiens
tagcctctatcttagagaagacaaattacctcatcattttctttctttttttttttttttttttttgagatgaagtcttactctgtcacccaggctg

SEQ ID NO: 26935 - DNA, 105 bp, Homo sapiens
ttgtatatatgtatatgtacatgtgtgcatgtgtgctttgtgtgaagtgtgtattatatgtatgtatatatgtgtatgtgcaaattgtgtattgtgtatgtgtat

SEQ ID NO: 26936 - DNA, 76 bp, Homo sapiens
gattttcaggcagagcgagatccagatgattaaacaatatttctataaatgtgtctctgtctatctgtctgctatc

SEQ ID NO: 26937 - DNA, 77 bp, Homo sapiens
ggctcttggattgagtggctccctctggcataagcaagctgttaagttagcctgtcagtgtctctgtctcctcagct

SEQ ID NO: 26938 - DNA, 95 bp, Homo sapiens; identical to SEQ ID NO: 6311

SEQ ID NO: 26939 - DNA, 95 bp, Homo sapiens
gcctgatctcatcaagtcctgctcatcgtggtgctcactacattctctgtggtgatgatcttgacagtggctctgttctcctggtggctttctgc

SEQ ID NO: 26940 - DNA, 112 bp, Homo sapiens
gaactgggttcaaatcccaccctcaccatgtatgatggacaaataattccatctctcgaaactcagtttgtttatctgtaatgtgtctgctttgggatttgttagaaggatc

SEQ ID NO: 26941 - DNA, 139 bp, Homo sapiens
ggagtaggacctcttaaagttctgctggatttctttcttttttttttttttttgagatggggtctggctctgtggctctgtctcccgggctggagtgcagtggcgcgatctgggctcactgcaagctccaccccctggg

SEQ ID NO: 26942 - DNA, 77 bp, Homo sapiens
ggtctgtatagtagtttcttagagtgtagtgggctgggcagaaatgactctgacactctgagataagtgtggggaac

SEQ ID NO: 26943 - DNA, 104 bp, Homo sapiens
gctttgttctttttgcttaggattgtcttggctatgtggtttctttatttggttccatatgaaatttaaagtagttttttacaattctgtgaagagtcaatggt

SEQ ID NO: 26944 - DNA, 97 bp, Homo sapiens
gtttgtttgtttttgttttgagatggagtctctctctgtcacccaggctggagtgcggtggcacgatctcagctcactgcaaactctgcttcctggg

SEQ ID NO: 26945 - DNA, 86 bp, Homo sapiens
ccaagtttcagttcatgtaaacatcctacactcagctgtaatacatggattggctgggaggtggatgtttacttcagctgacttgg

SEQ ID NO: 26946 - DNA, 100 bp, Homo sapiens
tgttcagaaagtctgttgttgtaaacatccccgactggaagctgtaagacacagctaagctttcagtcagatgtttgctgctaccggctattcacagaca

SEQ ID NO: 26947 - DNA, 110 bp, Homo sapiens
tagagaatggtaattattattgaatggattgaaaacaagaatagagtctctttgggagtatctgtgttttttgtttttttttttttccatgtaattgggggcattttctg

SEQ ID NO: 26948 - DNA, 86 bp, Homo sapiens
tggggctgcgtagtgttagggtcaggcagctttgaagtggaatccggatccgccactctcgctgcgtgatattgggcatgccatca

SEQ ID NO: 26949 - DNA, 102 bp, Homo sapiens
ggcatatgggtccggaggatattcaccagatataaacttaatgagagcaggcattgtgtcttattctctctgtatcacaaggagtagcacataatatatgtt

SEQ ID NO: 26950 - DNA, 104 bp, Homo sapiens
agaccccatgcaacatcaatcctctaagaccttagaaaactgtagctcacagcaaagagagatcagagaaggcctcacagaggagggataatcactatgtgtct

SEQ ID NO: 26951 - DNA, 80 bp, Homo sapiens
tatgtggggacagtgtgaggaagaggctgagtggctggaaaggagccatatcataccctgctttaaacagttgccaaata

SEQ ID NO: 26952 - DNA, 64 bp, Homo sapiens
caccttgtttattctaggtgttcaataaattgtttgttgaatgaatgaatgaatgaatgaggtg

SEQ ID NO: 26953 - DNA, 116 bp, Homo sapiens
cagccaggggatgagccatgttgggcgtccagacatgtttggccttcagatggctgcagtcccagccactctctgcctgtcacacatggagaccccaagtgagaaccattcagctg

SEQ ID NO: 26954 - DNA, 105 bp, Homo sapiens
atgcttgtcttgtttcacctatgcatgttacctgccggaccttagaggaagttggttgtatgcatgacacattggctagcattggtttgagggtgtaaccatgta

SEQ ID NO: 26955 - DNA, 87 bp, Homo sapiens
atgggcacagaggactgtaaaatgtgagactttcacagctcaatgaaaagggctgtgagagcacagagaggactagaatgtaaccat

SEQ ID NO: 26956 - DNA, 73 bp, Homo sapiens
gacagtgatgagggtgagagtcaggacttgtattcatttattcattttttgagtcacagtctcactctgttgc

SEQ ID NO: 26957 - DNA, 95 bp, Homo sapiens; identical to SEQ ID NO: 580

SEQ ID NO: 26958 - DNA, 93 bp, Homo sapiens; identical to SEQ ID NO: 69

SEQ ID NO: 26959 - DNA, 107 bp, Homo sapiens
gctttcagtaattggctttctttggtataagttagagtagaagtctctgtgcctctcagtgtgagatttctccaaacttatccctagtacgtagcattatggagtgt

SEQ ID NO: 26960 - DNA, 120 bp, Homo sapiens
gtcatcaacagagcaatttatggacatgatctggatcacagatgtaaaaaacattttgttttatatataaactgatattttacaagtgaccaactcgagccctgtgttaaggaggatctg

SEQ ID NO: 26961 - DNA, 77 bp, Homo sapiens
gatatttctatttgtatatgttaggacattgcttgatgattcatagcaaggtcctttagacattaatgtgagttatc

SEQ ID NO: 26962 - DNA, 58 bp, Homo sapiens
tgagacagggtctcactgtgtcacccaggctggagtgcaatggtgtgatcttggctca

SEQ ID NO: 26963 - DNA, 69 bp, Homo sapiens
gcttaaagacctgagtctctctctctgtgcaggctggagcgcagtagtgcaggcataggtcactacagc

SEQ ID NO: 26964 - DNA, 76 bp, Homo sapiens
ttctggctgtgtctgtctctggcacatactcacttatgggtaagcaagacagcaagacagtccacaagccgcagag

SEQ ID NO: 26965 - DNA, 112 bp, Homo sapiens
ggatgcaccgttcttaatgggcccctcactggctacgagagtttgggattttgaaagggactcagagcagagagtgagcttcgccaatatctgaaactgcaacatttcttcc

SEQ ID NO: 26966 - DNA, 94 bp, Homo sapiens
cctgggacactgggctgtggctaccagacaaaggggatggtatctctgcctctcactttcccagtggaaagccaagcagcaggaccccaaaagg

SEQ ID NO: 26967 - DNA, 100 bp, Homo sapiens
ggagtgaggaacagaggatttgcccacctgtctctgtgtcagtcaggtctaagaaccagccacagaggctcaaaaatgcaaatcaaatgtgtctgcttca

SEQ ID NO: 26968 - DNA, 76 bp, Homo sapiens
cactgtcttattctgtcagggtcactgagggtcacgggttagaacacctggggcggccctgtgaagcaaggtaatg

SEQ ID NO: 26969 - DNA, 61 bp, Homo sapiens
ctccctctaggggctcaggcccagggagatcagatttctgtgcctgagtgcctggctggag

SEQ ID NO: 26970 - DNA, 98 bp, Homo sapiens
tacttaaattgaactattcactgtatttctgaatgttctcataattttattatattttaaaattagggtcatatttcaaatacatgttcatgtaggta

SEQ ID NO: 26971 - DNA, 74 bp, Homo sapiens
gtgtgtgtgtgcgcatgtgtgtgtgtctgtgtgtatgtctgtatgtgtgcatatgtgtgtgtgtgtgtgtgtgt

SEQ ID NO: 26972 - DNA, 95 bp, Homo sapiens; identical to SEQ ID NO: 68

SEQ ID NO: 26973 - DNA, 93 bp, Homo sapiens; identical to SEQ ID NO: 69

SEQ ID NO: 26974 - DNA, 114 bp, Homo sapiens
ttaatatcatatctgtatatgtatatatataatctgtgtgtatatgtgtatatatatatatatatatatatatatatacagattaattctgggtacaacaaatagcactgttag

SEQ ID NO: 26975 - DNA, 96 bp, Homo sapiens
atcggatctgcttgtttagtcaatatcttgttcagtttcttaggacacttgtctttgcgtgggaatagaggatgggactgaaacttctagatggat

SEQ ID NO: 26976 - DNA, 84 bp, Homo sapiens
gggttgggcaacagagaaaggtaccaaaaacaaacgtaacttttttgtgtgtgtgtgatggagtctcactctgtcacccaggct

SEQ ID NO: 26977 - DNA, 65 bp, Homo sapiens
agagttcagattctttgttagggccactggaaaatcagccccatcctgacacagtgtctcactct

SEQ ID NO: 26978 - DNA, 61 bp, Homo sapiens
aatcatttttcaggattgtccaagtggctttgtggccagagctgattttcttgatgtgatt

SEQ ID NO: 26979 - DNA, 116 bp, Homo sapiens
gtaattgtggctttgagttgatcacttctcctttctgggacccaaaatttttgtttctcacagaagagagtcagggtgcagaaaaatagaagcatcttcctggagtaccagtgttc

SEQ ID NO: 26980 - DNA, 75 bp, Homo sapiens
gtatagatgaagtccaaaggccatatgctggagaagcccctcttgctcaggaagacctgtgtttttgttctatgc

SEQ ID NO: 26981 - DNA, 103 bp, Homo sapiens
tagtttttaaataggtggttagatatactgttcttttttttttttttgtagatgactcagagaaacagagacattgcctgtctaactatgcctaatagaacta

SEQ ID NO: 26982 - DNA, 90 bp, Homo sapiens
tatgtatttgtgtatttatatgtatgtatatgtacacacatgtatgcacacatatatgtatatgtacacacatgtatgcacacatatatg

SEQ ID NO: 26983 - DNA, 95 bp, Homo sapiens; identical to SEQ ID NO: 68

SEQ ID NO: 26984 - DNA, 93 bp, Homo sapiens; identical to SEQ ID NO: 69

SEQ ID NO: 26985 - DNA, 69 bp, Homo sapiens
atgcacaacatatatgtatatatgtatatatacacacatatatatgtatatgcatgtatatatgtgtat

SEQ ID NO: 26986 - DNA, 117 bp, Homo sapiens
gccataatatccagaaaatcaaggccacattgggttttactgtgacagagagtagagagttagcacattgccagggcaaaactctgtgtgactgtgtgtgtgtgtgtgtgtgtgtgt

SEQ ID NO: 26987 - DNA, 76 bp, Homo sapiens
tgagaaaggggtgattagtgccattcctaaggaaaaagtttcagaggagtgagtgatcacaatgatagctttttta

SEQ ID NO: 26988 - DNA, 83 bp, Homo sapiens
gagcgtgtgtgtgtggagagacagaggatagggtaaatttttccctgaagtgagtcaagtgctctctccactaaaatctgctc

SEQ ID NO: 26989 - DNA, 107 bp, Homo sapiens
tttcagattttattccattgtggtcagagaatatgctcgatactatttcaattttttgaatattttaagacttgctttgtgacctaacatatggtctatccttgaga

SEQ ID NO: 26990 - DNA, 95 bp, Homo sapiens; identical to SEQ ID NO: 68

SEQ ID NO: 26991 - DNA, 93 bp, Homo sapiens; identical to SEQ ID NO: 69

SEQ ID NO: 26992 - DNA, 117 bp, Homo sapiens
tctcatttgaattgctgatttcctctaagtaaagtagtttctgtttgactggtttcaagatttttctttatctttagtttttagaaacttgcttatgtgccttggttttcactgagg

SEQ ID NO: 26993 - DNA, 80 bp, Homo sapiens
tatatgcatatatatatgcatatacatgtgtgtgtatatgtaagtgtgtgtgtgtgtatatatatatatatatatatatg

SEQ ID NO: 26994 - DNA, 104 bp, Homo sapiens
gcagtgaagtcatgataatagaggggttgaaaatgctagaatatatgtgtgttcatttgcatgtgattctgtatgaattctagatgtcactctgaagttgctgt

SEQ ID NO: 26995 - DNA, 110 bp, Homo sapiens
tatacatatatatgtgtgtttatataacagtacatcatatgtttttaatatatttaaaactatgtatgtgtgtgtgtgtaaatatatatacacacacgtatgtatgtata

SEQ ID NO: 26996 - DNA, 111 bp, Homo sapiens
atatagatataaatacagatacagatacatagatatatatgtttatatctattctctacatagtatatatgtcataggtttgtgtgtgtgtatatgtgtgtgtgtatatat

SEQ ID NO: 26997 - DNA, 96 bp, Homo sapiens
gatggatcatgaggtcaaacattttaatatattttcttttactgttctatcccagaacctagaggattcttgaatcattgttattctcatgccatt

SEQ ID NO: 26998 - DNA, 95 bp, Homo sapiens; identical to SEQ ID NO: 68

SEQ ID NO: 26999 - DNA, 93 bp, Homo sapiens; identical to SEQ ID NO: 69

SEQ ID NO: 27000 - DNA, 108 bp, Homo sapiens
tgtatatatttgtaatgtgtgtgtatatatattttgtaatgtatatataatttttaatgtatatatttgtgtatatataacacatacacacacacatatgtgtataca

SEQ ID NO: 27001 - DNA, 68 bp, Homo sapiens
gtgcatgttaggtgacccccgacacacataacccaagtactctgacgtgtgtgtccacactgcagcac

SEQ ID NO: 27002 - DNA, 117 bp, Homo sapiens
ctcattgtgactggttgtcctgctttcctcaggttttcttccaccatctgtgacagcttcttgatctgtcgccaggtgagtggctgtgttcaacgggtgttgcttgtgacagttggg

SEQ ID NO: 27003 - DNA, 111 bp, Homo sapiens
cataatactatgcatatgtgtgattttatttttctagtcaaatctcaatatttattaatatgaaaacattaaggggaatagtattacatattggaagaacaaggtattaag

SEQ ID NO: 27004 - DNA, 79 bp, Homo sapiens
gtcagagttctggagaaattgagccaaaacaatgtgtatgtgtttgtacacatgtgtgcacatatgtttctctctctgc

SEQ ID NO: 27005 - DNA, 229 bp, Homo sapiens
tatatacatatatgtgtgtctatatctatatatgtatatatacatatatagatatctatgtatatatacatatatagatatctatatgcagatatctatatactatatctatacatatatagatatagacacacatatatgtatatatatgtatatagatatctatatatgtatatatacatagatatatgtatatatacatagatataatgatatagacacacatata

SEQ ID NO: 27006 - DNA, 132 bp, Homo sapiens
tacatatatagatatccatatatacatatatggatacatatatatgtatatatggatatctatatatgtatatacatggatatctatatatgtagatatatggatatctgtgtatgtatatatgggtatcta

SEQ ID NO: 27007 - DNA, 66 bp, Homo sapiens
catatatagatatccatatatacatatatatgtatccatatatgtatatatggatatctatatatg

SEQ ID NO: 27008 - DNA, 75 bp, Homo sapiens
tgtataaatgtgtcaattatatatgtatatgtgtatatagatacatatatgtatgtatatagatacatatataca

SEQ ID NO: 27009 - DNA, 92 bp, Homo sapiens
gatggtcctgacatgggatggcttcacttaaaattttttgtctttactatggatttatcaggacatgactccgttgtaagtctaggagcatt

SEQ ID NO: 27010 - DNA, 115 bp, Homo sapiens
aatgttctgatcagagtctgtcttcaacagccacagaacctctgaaaattttgtttttttcttattatctgaaggccattaaagaaaattaaagattctgatcttaagtagcatt

SEQ ID NO: 27011 - DNA, 79 bp, Homo sapiens
ctattctcattgataagcttgaggaaatggggcaaaacatttgattccaccctcagttcctctcagtgtctgtgattag

SEQ ID NO: 27012 - DNA, 80 bp, Homo sapiens
tacggccttttttctgtgtcagtgtggagagagagcaagcgctagtgtctctttctcttcttataaaaacaccagtcgta

SEQ ID NO: 27013 - DNA, 84 bp, Homo sapiens
gcacaagctaggatgtatatatatatatatgaagtatttatatgtgtcacaaatgtatatatgtttctatatcttactgtttgc

SEQ ID NO: 27014 - DNA, 69 bp, Homo sapiens
ctgtgtaaagctagagttagtaagcagcagtgtacattcaagccttgctccgacctggcttcaaagcag

SEQ ID NO: 27015 - DNA, 114 bp, Homo sapiens
agttagattgacacggcaagctttttgttttgtacgcttctaattggctgtggttgaattctgtttgggaagtggttgatgggtttgcatcataagctagtgttagggtctact

SEQ ID NO: 27016 - DNA, 100 bp, Homo sapiens
tagtttgccatatatatatatgcctatatatgtgtgtgtatatatataggtgtgtgtgtatatatatgtatatatgtgtgtgtgtatatatatcatttta

SEQ ID NO: 27017 - DNA, 74 bp, Homo sapiens
gtttgttttgaggtggagtctcactctgtcacccaggctggagtgcagtgacgcgatctcggctcactgcaagc

SEQ ID NO: 27018 - DNA, 70 bp, Homo sapiens
attcaagcacatatatctatacacatatacatatatgtgcatgtatgtataattatatgaaagtttgaat

SEQ ID NO: 27019 - DNA, 116 bp, Homo sapiens
cagttaacgaaggaaaggaaattccagcactttattaggcagcatcatatatttttatctgtgttctaattaatgagatgtgtctaaggaatttaataattgtacttagtaaactg

SEQ ID NO: 27020 - DNA, 73 bp, Homo sapiens
aagtgtctcttaataaaaacgagaggtaaaatggattttcttatttttttactttttgtttccagaggtgctt

SEQ ID NO: 27021 - DNA, 65 bp, Homo sapiens
ttgagagggagtctcactctgtcacccaggctggagtgcagtggcatgatcttggctcatttcaa

SEQ ID NO: 27022 - DNA, 109 bp, Homo sapiens
ctacttcattctctttgttctgcagacggcctttctttctttctttttttttttttttgaggcagaggaggcagagtctggctctgtcgcccaggctggagtgcagtgg

SEQ ID NO: 27023 - DNA, 87 bp, Homo sapiens
atctctatagtaattcactgaaactctgtgcctcacttttcacacctgtaagatgaggctgatagacagaggaaggacctttgaggt

SEQ ID NO: 27024 - DNA, 113 bp, Homo sapiens
gatttgagagtgtcacagggttttgtgtgtttttgtgtgtgtgtgcgtgtgcatgtgtatgtgtggaataactgaaggaaaaggagaaggagcagggttgggcagagagagtc

SEQ ID NO: 27025 - DNA, 131 bp, Homo sapiens
gtggaaggtattggatcatgggatggatccctcatgaatggcttggtacccttctcacagtagtgagtgagttctcgctctgagttgatgccagatctggttgttcaaaagagtgtggcatcctcgttccc

SEQ ID NO: 27026 - DNA, 96 bp, Homo sapiens
gatgcaaaggaaaagagtgtttggttatctattgctttgtgactgattgttccaaagcatactggctttaacaacaattattttcctcatgatttc

SEQ ID NO: 27027 - DNA, 101 bp, Homo sapiens
tatctatctatctattcatctatctatctatctatctatctacccattgatatggtaagggacagaaagaaagacagacagattatgtggattggctgatg

SEQ ID NO: 27028 - DNA, 137 bp, Homo sapiens
tatatatcaaggaatatatatatacacatacatatcaaggaatatatatatatcaaggaatatatatatatatcaaggaatatatatatatgtgtgtgtgtatatatatatgtgtgtatatatatatatatcaagga

SEQ ID NO: 27029 - DNA, 79 bp, Homo sapiens
ggggaaaagaagacagtgtgtgaactgttcaatgctgtgaggaaagcaatgtgttctctctcttttagtcttcgtgctc

SEQ ID NO: 27030 - DNA, 85 bp, Homo sapiens
cattttgtaaagagtcactgaccctcactctctatcagctgttgtgctggggctgggaatagtgagaaggctgaagctcaaaatg

SEQ ID NO: 27031 - DNA, 81 bp, Homo sapiens
tgaacagtctgtgcacagagcctgactgtataggaggatagaacacctcttttgcggggctgactgggcatggacagttta

SEQ ID NO: 27032 - DNA, 58 bp, Homo sapiens; identical to SEQ ID NO: 637

SEQ ID NO: 27033 - DNA, 93 bp, Homo sapiens
actctctgtctctgtctgtctccacctcccaccctcctcacacacacacacagacacacacacaccagggacaggcatacagtagacagtggt

SEQ ID NO: 27034 - DNA, 87 bp, Homo sapiens
tagaggtttgaggtgttcagtacaagggcaactaactcctccgtcaactggaatagagtttgctatgagcatgtttactgatcttta

SEQ ID NO: 27035 - DNA, 58 bp, Homo sapiens
tgagagagagtctcactctgtctccaaggctggagtgcagtggtgcgatctcagctca

SEQ ID NO: 27036 - DNA, 117 bp, Homo sapiens
tcattttcctttcctgttagctgaccctccaaactgtgggaatttcttcagtgctacaagtgaggcaggacagaaaccagttccttgggcagcacaataaaaggtcagggatgttga

SEQ ID NO: 27037 - DNA, 78 bp, Homo sapiens
tccagtgtatagaaagctgtctggcctatgctcagcatggtcagtcagtctttctgactataaatccagtgcacttga

SEQ ID NO: 27038 - DNA, 82 bp, Homo sapiens
cattcagctcccacacaggacagcacaggaggagggagggaggacacgtgacccactggctgttctttttaatagtttgatg

SEQ ID NO: 27039 - DNA, 80 bp, Homo sapiens
cttggtgccaatcaaaggatcctgcctgagatctccccgccccactcccagctctccgtcagtgtctgtgtggcactgag

SEQ ID NO: 27040 - DNA, 143 bp, Homo sapiens
actatcattcatatatatatacacgtgtatatatatatatgtgtgtatatatgtgtatgtacgtgtgtgtatatatgtgtgtgtatgtatgtgtatatatatatgtgtgtgtgtgtgtgtgtgtgtatatatatatatgtaga

SEQ ID NO: 27041 - DNA, 78 bp, Homo sapiens
cctacctgcatatatatattcatatacatatgtatctatatatgtatgtatgtgtgtgtgtgactttgcagacctagg

SEQ ID NO: 27042 - DNA, 58 bp, Homo sapiens
gtcatcaggcctggacaggacaatggccctgcacagtgtctgcctgtctgccagtggc

SEQ ID NO: 27043 - DNA, 118 bp, Homo sapiens
ccagctttgttctttttgcttaggattgtcttggttatgtgggctcttttttggttccatatgaaatttaaagtagttttttccagttgtgtgaagaatgtcaatagtagcttgatgg

SEQ ID NO: 27044 - DNA, 58 bp, Homo sapiens
tgagagagtgtctcactctgtcacccaggctggagggcagtgatgtgatattggctca

SEQ ID NO: 27045 - DNA, 78 bp, Homo sapiens
actcacctgggggacttaggggcctgaatggatttttttttttgagaaagagtctctctctgtcacccaggctggagt

SEQ ID NO: 27046 - DNA, 109 bp, Homo sapiens
tcaaagtgctgggattacaggtgggagccaccacgcccggctaatctagatatttattaaaattattcaccaggcgtggtggctcatgcctgtaatgtcagcactttgg

SEQ ID NO: 27047 - DNA, 114 bp, Homo sapiens
tttgcaaagcagtaagtgtgaggcatttctgatggggtttagcagtattgatataattgtctcaatttattttttagaccataacaataaactggcttgcaaatctgtggtgag

SEQ ID NO: 27048 - DNA, 77 bp, Homo sapiens
gtagactgccgtcttctccctgggtcctcacatgctcatccctctgtatctgtgtgtctgtgtagatggccgtcttc

SEQ ID NO: 27049 - DNA, 73 bp, Homo sapiens
gtccctctgtatctgtgtgtctgggtcccagtctcctcttcttagaaggtcaccagtcatactgaactagggc

SEQ ID NO: 27050 - DNA, 103 bp, Homo sapiens
gggaacttacatctgccagggacgatgtatgaaccatccagagctaataatttatctttttttaaattttgagatggagtctcactctgtcacctagcctccc

SEQ ID NO: 27051 - DNA, 118 bp, Homo sapiens
tgtctctgtctctctctctctctatatatatatgtgtgtgtgtgtgtatatatatatatacacacacatatatatacatacacacacatatatatacagacacaaaaagagagagata

SEQ ID NO: 27052 - DNA, 157 bp, Homo sapiens
atatgtgtgtgaatatatatatgagtgtgtgtgtatatatatatctctctctttttgtgtctgtatatatatgtgtgtgtatgtatatatatgtgtgtgtatatatatatatacacacacacacacatatatatatagagagagagagagacagaga

SEQ ID NO: 27053 - DNA, 105 bp, Homo sapiens
tgaacttgaccttttcagctcatgtcatacttcataggaccaatgtatttatctatttttgtccatattcagtatggaatgaggttgacactttttcagattaca

SEQ ID NO: 27054 - DNA, 102 bp, Homo sapiens
ctcctcagaggagcacactactgaaaaaggctaattatatatttgtttgttcagcccacaaatagcattttgacagccgttttgtgtgtgtgtgttgcgggg

SEQ ID NO: 27055 - DNA, 106 bp, Homo sapiens
ccagctgctttgtctggggatagtccctaccagcctccctgggtgcctctaatctagggcacctgcacccacctcaggctctggggccgggcaaagtcccagctgg

SEQ ID NO: 27056 - DNA, 100 bp, Homo sapiens
ccttttgtgcaagaaaggggagataagataatatatatttgtgtgtataccagaaacaatatattgatttttaaaacaatcccctatttgtgataacagg

SEQ ID NO: 27057 - DNA, 58 bp, Homo sapiens
tatatatatatgtatacatatatatgtgtatacatatatatgaatatatatgtgtata

SEQ ID NO: 27058 - DNA, 82 bp, Homo sapiens
acatagattttggatatatatatgtgtgtgtgtgtgtatatatatatatatctcacatatatgtttattccatatctcatgt

SEQ ID NO: 27059 - DNA, 81 bp, Homo sapiens
attggtggtaaatattgcatgtacacttgggtagtatgattattctgctgcttttgggtggaatgttctctgagtattagt

SEQ ID NO: 27060 - DNA, 58 bp, Homo sapiens
tgagacagagtctcgctctgtcacccaggttggagtgcaatggcgtgatctcggctca

SEQ ID NO: 27061 - DNA, 58 bp, Homo sapiens; identical to SEQ ID NO: 3385

SEQ ID NO: 27062 - DNA, 56 bp, Homo sapiens; identical to SEQ ID NO: 3386

SEQ ID NO: 27063 - DNA, 88 bp, Homo sapiens
tatatttatgtacatatagtgacactatgttatgtatacacacatatagtgaagatatatatatatatgcattgaatatatagatata

SEQ ID NO: 27064 - DNA, 66 bp, Homo sapiens
ccggcagatgcagtaaggcccagctgtagagtgaatgcacagagcaggggctggataatcacctgg

SEQ ID NO: 27065 - DNA, 97 bp, Homo sapiens
gatttttagggagagaacacagtgggtgcaaaggcctgagacagaacagtgtgatcagaacatccatgggcctgggtgttgttggaccttgagatgc

SEQ ID NO: 27066 - DNA, 66 bp, Homo sapiens
cagcgctgactgcagaggctgggttcaggcttccttctgaccctccctcactctgcctctttgctg

SEQ ID NO: 27067 - DNA, 116 bp, Homo sapiens
caaatgccttccttacctgtggctgagtcctcacctgcttcagtttcatccactttttttttctttttttttgagatggagttttgctcttgttgcccaggctggagtgcacagtg

SEQ ID NO: 27068 - DNA, 58 bp, Homo sapiens; identical to SEQ ID NO: 7353

SEQ ID NO: 27069 - DNA, 95 bp, Homo sapiens; identical to SEQ ID NO: 68

SEQ ID NO: 27070 - DNA, 93 bp, Homo sapiens; identical to SEQ ID NO: 69

SEQ ID NO: 27071 - DNA, 117 bp, Homo sapiens
ctttttttgagcttgtaagtgatactgttttattttaaattattgttattaattaattaattaattaattttgtttttgagacggactttcgctctttcgcccaggctggagtgaag

SEQ ID NO: 27072 - DNA, 110 bp, Homo sapiens
gtgtatatatatatgtatatatatgtgtgtatatgtatatatgtgtatatatgtatatatgtgtatacatgtgtatatgtgtatatatgtgtatatgtgtatatatgtgt

SEQ ID NO: 27073 - DNA, 110 bp, Homo sapiens
ctgttgatgccacggctttccttggggcttcccctgcctctgggtagtgaaggtcacagtcactgcctcccagggtaggctctcagcactcaggactctgtgtctcacag

SEQ ID NO: 27074 - DNA, 96 bp, Homo sapiens
cagtgccagcctgatcgcgttctggaagacccagtctcagactctgtgcctttaaagtccggtcctcagtgtcctttcagaatcatgttggggctg

SEQ ID NO: 27075 - DNA, 68 bp, Homo sapiens
ggtgcccaattctatctgcgcttggggacacaggccccaagaggtgaagagtagacagtgaggacagt

SEQ ID NO: 27076 - DNA, 83 bp, Homo sapiens
agaaaagcataaggagtttgtgcacagttttgtctgtatatgtttatatttacacacaaggcgggcatcagggtagtttttct

SEQ ID NO: 27077 - DNA, 61 bp, Homo sapiens
ggtgagacaagtctcactctgtcacccaggctggagtgcagtggtgctatcttggctcact

SEQ ID NO: 27078 - DNA, 119 bp, Homo sapiens
actggggcaaagatgactaaaacacttttcctgccctcgaggagctcacagtctagtatgtctcatcccctactagactgaagctccttgaggacagggatggtcatactcacctcggt

SEQ ID NO: 27079 - DNA, 93 bp, Homo sapiens
ttctctgctctcttttgtactgagttacttgttctctttggcttttgcggtacagggattactccatactgtgagggagaacttgaactttgt

SEQ ID NO: 27080 - DNA, 119 bp, Homo sapiens
ttgattaagaacacaggctttggatccagactgtttgggtatgaaccccatctcttgtcaattacttgatgtggccaacctctcatgcctcagtttcctcagctacagaatggggttaa

SEQ ID NO: 27081 - DNA, 88 bp, Homo sapiens
ggagttgagggggattggggactcattgcagagtgtgtagagtatgcagagagtgcagagtgtgcagtatgatctctttttggattct

SEQ ID NO: 27082 - DNA, 87 bp, Homo sapiens
cccagtatgatcgcctaaaatcagggaagacatacatttatatgtatatataaggaatgtttgtgttgttaagtgataaaaactggg

SEQ ID NO: 27083 - DNA, 71 bp, Homo sapiens
ggtatgcaaaggaccaccagagcacagagtcaaggaaggctgacttctctcagtctctgtgggtcagaacc

SEQ ID NO: 27084 - DNA, 87 bp, Homo sapiens
ctgggctgtggtgtggtggggagactgtggcatgttatggaagtggtgactagtctagcatggcagaagtctgtgagctcagtgcag

SEQ ID NO: 27085 - DNA, 113 bp, Homo sapiens
gccacagtgaacaacgaggcaaagggcagggtcgccagcactgacagtcactggctgtgtcatgcaggcgaattcgggagcccttctgtgccacactctgattctttgtgtgt

SEQ ID NO: 27086 - DNA, 118 bp, Homo sapiens
gaagggggcacgaggactcagagccagatggcctgggttcaaaccctggcacagtcactgactcgatacgtgaccctaggccagctacctcccctctctgtgcctcagtttcctcttc

SEQ ID NO: 27087 - DNA, 104 bp, Homo sapiens
gcaggggacaaaatgaaaagcaagacaccctggggctggggcatgggacactgagggactgtgtgtgtgagcaaaggacaggaggggtgtgtgtgtgcctgtgc

SEQ ID NO: 27088 - DNA, 75 bp, Homo sapiens
ggccacagctggggttggtgaggacaatactggccttggatgactcaggcactcactctatgaccttggcaagcc

SEQ ID NO: 27089 - DNA, 64 bp, Homo sapiens
cagtgactcagtgactcagaggggccagccaaggccagggcccctgaggcactccagttcagtg

SEQ ID NO: 27090 - DNA, 89 bp, Homo sapiens
gttcgcctctgcatggacatgctgtgtggcccaggggaagcctctgaccctctctgagcctcagttgcctcatctgtagagcagggaca

SEQ ID NO: 27091 - DNA, 104 bp, Homo sapiens
ggggtctctcctgctcatccctaatgcccagtgccagtctccctgtctgagctcacccacttgcaggacttggcactgggcatcctctctctggggtgcacccc

SEQ ID NO: 27092 - DNA, 91 bp, Homo sapiens
ggcgtgaccagagcacacgacatatctggggagtggggagtggtgggtaaatgcgctcgctcactctctctcatgttgttgaagtggagcc

SEQ ID NO: 27093 - DNA, 91 bp, Homo sapiens
gtgggtggggacccagtcagcctgactctctgtctgctcccatgaaatgaaaactcagacgttcaagttggctgctgggtgcctgggtgac

SEQ ID NO: 27094 - DNA, 118 bp, Homo sapiens
ggttcagaccccagagagcaccctgccctcagcacagagcctggcacgtggccacatccagtgcctgcctccctgtgtcccctgaaaggcagctgttacatttttggactctgtctcc

SEQ ID NO: 27095 - DNA, 85 bp, Homo sapiens
caggggtgagctagagaatgcataggtggggtcgggagagcctggtttgggcccaaccctgtctctctctatgtgaccttgagca

SEQ ID NO: 27096 - DNA, 88 bp, Homo sapiens
gggacgcagactccatcccgcagttgttcgacggagatttccttatctcctggccacagtctgtgggtccgtgtgtgcttaataaccc

SEQ ID NO: 27097 - DNA, 82 bp, Homo sapiens
ccgctctcactctatgtgtgatgaaactgagcacagagaggttaagtaacatgcccagggtcacacagcaggtgaggcatgg

SEQ ID NO: 27098 - DNA, 112 bp, Homo sapiens
gtgagtccctgttgatgtcagggatggaggcgggtaacataagacaccagggctgtgcctgggtccctgcctgcctcacaccagagcatcttgccaactagaagaggattcc

SEQ ID NO: 27099 - DNA, 114 bp, Homo sapiens
ggctagagcagaacccttgggcttgagaaaggacaaaagcagtgagtgtgcacaggccgggcagcctcggttgggctcaccttaaaggctagtttcaggctcagcttaaagacc

SEQ ID NO: 27100 - DNA, 95 bp, Homo sapiens; identical to SEQ ID NO: 68

SEQ ID NO: 27101 - DNA, 93 bp, Homo sapiens; identical to SEQ ID NO: 69

SEQ ID NO: 27102 - DNA, 112 bp, Homo sapiens
tcatacgttaggagatggactcatcccagagtgagttaagtcgatgcttcagacatgtgactgaggacacaagttttctcatctttccaaacagccatctcctgatcgttgg

SEQ ID NO: 27103 - DNA, 97 bp, Homo sapiens
tgtggttctgtgaagcatcaggtccaggagaggctcagagaagacagtgagctgaatctgggtttgcagggaaggtgttgggctcactgaagccagg

SEQ ID NO: 27104 - DNA, 68 bp, Homo sapiens
tgtgcatgtgtatgtttatgtccatttgtgcatgtttgtgtgtatgtgtatctgcatgtgcatgtgta

SEQ ID NO: 27105 - DNA, 82 bp, Homo sapiens
gtacgtgtgtgtgcatttgcacatatgtgcacgtgtatgtttatgtgcgtgtgtgcatgtgtgtatgtgcatttgcatgtgc

SEQ ID NO: 27106 - DNA, 226 bp, Homo sapiens
gtgtatgtgcatgtgcatgtatatgtgtgtgtgcacatgtatgtgcatctacatgtgcatgtgtatgtacatgtgcatgtgtatttgcatgtgtgtgcatttgcatgtgcatgtgtacgtgtgtgtgcatgtacgtgtgtacgtgtatgtgcatgtgcatttgcatgtgcgtgtgtatgtgcatacgcatgtgaattttcatgtgcgtgtgtatgtgtatgtgcat

SEQ ID NO: 27107 - DNA, 91 bp, Homo sapiens
ttacacctaagtattttatttttaagttattgtatgacattatatttttaatgtagggttctaagcatttatggataatatacaggtgtaa

SEQ ID NO: 27108 - DNA, 67 bp, Homo sapiens
ccagagagctagctcactctctgtctgccatgtgaaattcaaggagaagtgagccagcagcaactgg

SEQ ID NO: 27109 - DNA, 117 bp, Homo sapiens
tgccatttaaaatgtatgaattgcttatttctgtaattattttattatttacttatttttattttactttaagttctgggatacttgtgcagaacgtgcaggttcattacataggta

SEQ ID NO: 27110 - DNA, 62 bp, Homo sapiens
cacggctcgctctgtggctgtcagtccaccgggctgaagcatccacatagccgacaagcctg

SEQ ID NO: 27111 - DNA, 94 bp, Homo sapiens
tggatctgctcaggcccctctgtggtgggaaccccccggcccccctctccctgctgtgggtctctgtcactgagtggccccgtgagcatctcta

SEQ ID NO: 27112 - DNA, 99 bp, Homo sapiens
gtactgtatggggctgggatgacattttgtacctgtagatttttcttgcaaaaagtatttttttacataagcataaaatgacaaagcaggcagcagtgc

SEQ ID NO: 27113 - DNA, 82 bp, Homo sapiens
gtatatactgtagagcaagatcttgccttttttttttttttttttttttttgagacagggtctcttgctctgttgtccatgc

SEQ ID NO: 27114 - DNA, 180 bp, Homo sapiens
atgattgttcatatacatgtatatatgtgtctgtatgtatatacatacgtatacacgtatatgtatatatgtatatacatacgtatacacgtatatgtatatatgtatatacatacgtatacacgtatatgtatatatgtatatacatacgtatacacgtatatgtatatatgtgtatac

SEQ ID NO: 27115 - DNA, 118 bp, Homo sapiens
tttaacgtggagcctcccgagatcccgtgttacagctgacctatgctcctccttcgagtgtgtctctgtctctggcttccctccatctctttatttccctccaagtttatttgttgaa

SEQ ID NO: 27116 - DNA, 107 bp, Homo sapiens
ccttgaagaggtccttcatgtcccttgtaagttggattcctaggtattttattttctttgaagcaattgtgaatgggagttcactcatgatttggctctctgtttgg

SEQ ID NO: 27117 - DNA, 103 bp, Homo sapiens
tttctgtgctcggcccttccttgcctgactcactttctctctcctgtggcaggtccctgtgtcagaggtagaaggaggggtgggggtgggggcgtcacagaga

SEQ ID NO: 27118 - DNA, 116 bp, Homo sapiens
ctgggctgaacaaatgacgtcctagaacccgacagttgagggactcacggcaagatcaccattctgtgtctcagtctctccatctgggaaatggggacaacagaccctcctcccag

SEQ ID NO: 27119 - DNA, 73 bp, Homo sapiens
gagtgtctgtcactccgtgtggcctccctgagggtctgtctctctgtgtggcctccctaagcgtctgtcactc

SEQ ID NO: 27120 - DNA, 65 bp, Homo sapiens
gtgtctgtcactctgtgtggcctccctgagtgtctctccacgtggcttcactgagtgtctgtcac

SEQ ID NO: 27121 - DNA, 120 bp, Homo sapiens
gccttccacatgcaacacttgatggctgtctcgagggcctcctgtgtctcaccctctgtctcccgtggtgtacaggctgactctccctggctgctgtcattgactggtgggctaactgtg

SEQ ID NO: 27122 - DNA, 106 bp, Homo sapiens
gggactgccaggggatgccaggaactgggcctggggatgctagcctctgcacacactccctctctggcagcctggctgtccccttctggccctactgccctgggca

SEQ ID NO: 27123 - DNA, 83 bp, Homo sapiens
gcctttgggcttcccccggggctccaggtcagcccctgtccttctgaggtctctcctgcctgcctccctggaacccactgggt

SEQ ID NO: 27124 - DNA, 140 bp, Homo sapiens
cccagtgttctgtgtctgctcaggccctgtggtcagtcagtatcctgtggccgcccacacttactgtgtcactgtttctgttttggagtctgggcacggcttcatgttgctgccgggtcactcccaggctacaatgcagg

SEQ ID NO: 27125 - DNA, 117 bp, Homo sapiens
gttgtgttagtccatttatattgctatgaagaaatacctgaggctgggtaatttattttttaaaaacagaggtttatcttggctcacggttctgcaagctgtacagggagcatggca

SEQ ID NO: 27126 - DNA, 142 bp, Homo sapiens
tgcatttgcacatgtgtagtgtgtgcacgtgtctgtgtgtgaatgtatgtgtggtgtgtgtgcacaagtgtctgtgtgtgtgcatgtgcaggtgccggcatgggtgtagtgtttgtgcacacatgcacatgcgtctcttcac

SEQ ID NO: 27127 - DNA, 80 bp, Homo sapiens
aaactgagagaactcagagaccagtgccagagcagttccttggtatgctgagtgccggtctcctgggcccactattgttt

SEQ ID NO: 27128 - DNA, 114 bp, Homo sapiens
acacacatttacatatatgtatataaatttacacatacttacatatatttacatatatgtaaatatgtttatatatgtaaatgtgtgtacatatatgtaaatatatacgtatat

SEQ ID NO: 27129 - DNA, 139 bp, Homo sapiens
ggacagtcctgctgggtgggccactatgtggacgcaggggaaatggccccacctggctgcacactcactctccgactggcactttctctcccagcagccgttactggaaaggccacagcaggggaggggcttgctggtc

SEQ ID NO: 27130 - DNA, 90 bp, Homo sapiens
tccctgcaggctgtcagctgccagcctctgtgcctcagtgtgtttctggcaacggagacctggtgccttcagacactgggccttcaggga

SEQ ID NO: 27131 - DNA, 88 bp, Homo sapiens
ctcctccctctgtctcactgtctgcctctgaggggcccacagccaggtgggtcaggcttctggaagcaccaggacagggttccagggg

SEQ ID NO: 27132 - DNA, 80 bp, Homo sapiens
cctattctaggagtagactggctgtggtcagcagggaccaccactgagtgccacccacagcccctccactcttgtacagg

SEQ ID NO: 27133 - DNA, 133 bp, Homo sapiens
tgggggcagctgtgtctttgtatgtagttcttgacgtcctgtcacacgcacaggctgttctgtcacacacacaggctgttgtcaccagctccctgtgcatccagcgcatcacgggaagctgagtcacccaagc

SEQ ID NO: 27134 - DNA, 68 bp, Homo sapiens
caggggtcgaggacggggccagtctagaagtgctcacaggcctggccaggctgcctgtctgccacctg

SEQ ID NO: 27135 - DNA, 83 bp, Homo sapiens
gggaaggtctctctctcagtgcttctccaccttggcaccgtggctgttttggaatggacgagtctttgttgaggggccatcct

SEQ ID NO: 27136 - DNA, 119 bp, Homo sapiens
ctctgccatctgctccgcgctttgctttcggggctgcctctgtggctgtctccctcacaccggggctcccgccaaccccatgaggcagcccctgtgtaaggctcctggtcagccaagag

SEQ ID NO: 27137 - DNA, 58 bp, Homo sapiens
ggagtcctggcttcccgctcacagccattgggccttgggtgagtcagtcagtctctcc

SEQ ID NO: 27138 - DNA, 59 bp, Homo sapiens
ctgcaggtggggacaggccagcagtggctgaccacagtctgtctctgtccctgctgcag

SEQ ID NO: 27139 - DNA, 69 bp, Homo sapiens
gggagctgtggcctcttcacccacacacagaaggatgccagtccctctgtcggtctgaggtcagcttcc

SEQ ID NO: 27140 - DNA, 114 bp, Homo sapiens
acagggaacacaggtctaaacagaaattagaggctcaatttatattttaattttaaggaatcaaattagtgagtgagaagagcaaataatttactgtttacctccaacatttgt

SEQ ID NO: 27141 - DNA, 81 bp, Homo sapiens
cactgtgccatgacaccatctctgagtctcatcacaagtccgcaagggtggaggccgggagagatgtgcgccaagcaagtg

SEQ ID NO: 27142 - DNA, 60 bp, Homo sapiens
cctgcgtggagtgaggccttcggtctttttttgagacggagtctcactctgtcacccagg

SEQ ID NO: 27143 - DNA, 71 bp, Homo sapiens
atgccccactctgagggcctcactctgtgccagttgccacagaagagtggggctccaaaggatgagagcgt

SEQ ID NO: 27144 - DNA, 116 bp, Homo sapiens
ctgtcctgagctctaacctaggatgtaacttcgggcctcagacagccttgacagcctccctgggtgccacatggctacttgagacccagcaggcctgggaaagactgtagggaggg

SEQ ID NO: 27145 - DNA, 114 bp, Homo sapiens
tagaggtggagcaggtggaatgggaagcatgagagacaggcacactcactctaacttttagtgaaaaagtctgcttataagtgtgtccatgaaattgaaacccctgttgttcta

SEQ ID NO: 27146 - DNA, 58 bp, Homo sapiens
tgagacagagtctcactctgtctcccaggctggagtacagtggtgcgatcttggctca

SEQ ID NO: 27147 - DNA, 89 bp, Homo sapiens
ccttcaaggaccatgccttgtttaaagttctacattcctctgatactctcagcagtcacagaacagagacaggaaacattgtgtggagg

SEQ ID NO: 27148 - DNA, 59 bp, Homo sapiens
ggtctgaggttcgaccgccattgtctggaagaaggatgtttcgtgttggaccttggact

SEQ ID NO: 27149 - DNA, 75 bp, Homo sapiens
acagtactgactgaacagtctgtcgcttccccagtgatttgggggaaatgtggcctcattgtgttcagttcctgt

SEQ ID NO: 27150 - DNA, 79 bp, Homo sapiens
tgcttgcggagcagcttctgcatcaccatgtgtcgggcgctactgcccgagatgctcatgtgctcctgctcgctcagca

SEQ ID NO: 27151 - DNA, 87 bp, Homo sapiens
gctgccatctgaaagacagtaaagacagagttcagtctgttggagccgagcagtctcccgctctcgtcaacacctcacgcagacagc

SEQ ID NO: 27152 - DNA, 72 bp, Homo sapiens
gtcagtgagcggacttgcgtgtttgcgctttggtcagttgtctgtgtgtctgcatgtctgtgcgctgctgtc

SEQ ID NO: 27153 - DNA, 135 bp, Homo sapiens
tgcatgcacgtgtgtctgcatatttttgcatgtctgcaattgtattttcatgtctgctcgtgtttgtgtgcatctgcatgtgtgtctgcatgtgcatgcacctgtgtgtgtgtgtgcacatttctgtctgcatat

SEQ ID NO: 27154 - DNA, 59 bp, Homo sapiens
gcagggaacagccagacatgtgggagccattgctctctctctggctctgtttatattgc

SEQ ID NO: 27155 - DNA, 56 bp, Homo sapiens; identical to SEQ ID NO: 6618

SEQ ID NO: 27156 - DNA, 74 bp, Homo sapiens
gtctgtgtgggtgattgtaggattttggttttttttcttttttttaagacagggtctcggtctgtcactcaggc

SEQ ID NO: 27157 - DNA, 109 bp, Homo sapiens
tgagagaaggccgaagacctggtattaaagtgatgattccagatttttttttttttctgagacaagagtctgtctgtcacccgggctggagtgcaatagcctgatctca

SEQ ID NO: 27158 - DNA, 62 bp, Homo sapiens
tgagatcctgcctgtagggacaccttacatagaaagtgtctgtgtctctgagtatcttctca

SEQ ID NO: 27159 - DNA, 86 bp, Homo sapiens
tcagggttggtgaggtttcccgttgcactgggaaaacaggtggggctctgctcagtgtgtgggtggctcagtccctgccctggtgc

SEQ ID NO: 27160 - DNA, 88 bp, Homo sapiens
ggattttagtaggtttctattctactactctgtgtgtgtgtgtatatatatatatgcaaaagttattgaatgttaacttctatgactc

SEQ ID NO: 27161 - DNA, 113 bp, Homo sapiens
gaaggcgccaggagcaggcaggtgggagggaaagtgttcggcagggcagaaaccctgcctggctgtatccaactgtcactcccactggaggcgctgtgtatgcagggcccggc

SEQ ID NO: 27162 - DNA, 58 bp, Homo sapiens; identical to SEQ ID NO: 1435

SEQ ID NO: 27163 - DNA, 58 bp, Homo sapiens; identical to SEQ ID NO: 11194

SEQ ID NO: 27164 - DNA, 84 bp, Homo sapiens
cagctgtttgagatcattgtgaacctccttcctttctttttttttttttttttgagatggagtctcactctgtctcccaggctg

SEQ ID NO: 27165 - DNA, 117 bp, Homo sapiens
tccagcctgggtgacagagcgagactctgtctcaaaaaaaaaaaaagaatattttattttattttatttttatttttaatttttgagacagagtctcgctctgtcgcccaggctaga

SEQ ID NO: 27166 - DNA, 153 bp, Homo sapiens
ggcgacagagcgagactctgtctcaaaaattaaaaataaaaataaaataaaataaaatattctttttttttttttgagacagagtctcgctctgtcacccaggctggagtgcagtggcacaatcttggctcactgcaagctccgcctcctggg

SEQ ID NO: 27167 - DNA, 56 bp, Homo sapiens; identical to SEQ ID NO: 24883

SEQ ID NO: 27168 - DNA, 82 bp, Homo sapiens
gagtttcacactgagttgcatttgcctgggcgcgtgttctgtggtatgttctttggcatgtctgtgactcagtttgtggctt

SEQ ID NO: 27169 - DNA, 71 bp, Homo sapiens
gtcccagctactcagaaggctgagaggacagaggatcccttgagcccaggaagtcgtggctgcagtgagac

SEQ ID NO: 27170 - DNA, 118 bp, Homo sapiens
tgacagagccagactccgtctcaaaaaataataataataataaaacatcaggatgtggtttgttttttttgtttgtttgtttgttttttgttttttgagacagagtctcgctctgtca

SEQ ID NO: 27171 - DNA, 114 bp, Homo sapiens
caactcacctggcagccactcccagagcccctggaactctggcccaaggctctctgactgactccttcccagatctccttggcttagctcctgaagactgacactgcctgattg

SEQ ID NO: 27172 - DNA, 60 bp, Homo sapiens
tgatttaagtacttttctgaatgcatatttcaatatgtataattgaagagtgctgaatta

SEQ ID NO: 27173 - DNA, 78 bp, Homo sapiens
ctgagtctgattaggaggaatcaggcctcaagggagcctgtgactttaatggagcctgtgactctgagtctgactagg

SEQ ID NO: 27174 - DNA, 72 bp, Homo sapiens
atgtgtgtatatatatatgtgtgtgtgtatatatgtacatacatacacaggcacacatatgtctacatatat

SEQ ID NO: 27175 - DNA, 91 bp, Homo sapiens
acccatttgcaatcccctttaccccaaattcctaaagttcctgggtgtacaaatctcagacattttgaggaatttgccctgtgcattgggt

SEQ ID NO: 27176 - DNA, 58 bp, Homo sapiens
gtatatatgtgtgcacatacatgtatataagtatgtatatgtgtgtatatgtatatac

SEQ ID NO: 27177 - DNA, 81 bp, Homo sapiens
cagtgcttataagcctgtttaagaattgtttttatctttatgtaaagagtaacagaaacttttgaaatgctttaagccctg

SEQ ID NO: 27178 - DNA, 77 bp, Homo sapiens
gcagaagtcacagctgagagagaggggacacacacgcgcctgtctgcctgtctacacttggaaccagtgagtttagt

SEQ ID NO: 27179 - DNA, 115 bp, Homo sapiens
gtgtccatgtctggcctgggcactcgagagggcagatttgtgggttttttttttttttttttttttttttctgagacagtctcgctctgtcgcccaggctggagtgcaatggcgc

SEQ ID NO: 27180 - DNA, 81 bp, Homo sapiens
gggttgccccctctctgtctgtctgtgacctcatctccccttcttaggaggataccaggcagacaggatcagtgcccaccc

SEQ ID NO: 27181 - DNA, 90 bp, Homo sapiens
gatatgttgattttgcatcctgtcactttactgaatttgtttattatttctaaacagtttttggtagagtctttagcattttctgcatgc

SEQ ID NO: 27182 - DNA, 102 bp, Homo sapiens
agacagttagattaaaaaattctgtatgcatatttaaaaagtaaccactgtgagtacagtgtgtgcagggtgggtgtagtgtgcagggttggtggagtgtgt

SEQ ID NO: 27183 - DNA, 107 bp, Homo sapiens
acgtgtatatatatatatacgtgtgtgtatatatatatacgtgtgtgtatatatatatatacgtgtgtgtgtatatatatatatatacgtgtgtatatatatatata

SEQ ID NO: 27184 - DNA, 83 bp, Homo sapiens
gttgtttgtttgtttttttgagacggagtctcgctctgtcactcaggctggagtacagtggtgggatctcggctcagtacaac

SEQ ID NO: 27185 - DNA, 91 bp, Homo sapiens
gcaaaggtttaatacagtataggtttcataaccataatttattttttaattgaggcttatttttctgaaactaatgaagtatatcctttgt

SEQ ID NO: 27186 - DNA, 89 bp, Homo sapiens
gccatcactacaaaaggttatacagtcaatatatatatatgcaatatatttattgcatttttgactgtacaaccttttgtagtgatggc

SEQ ID NO: 27187 - DNA, 93 bp, Homo sapiens
atgaggctgaggcaggagaatatatatatatatatatatatatatatatatatatatatatatatatatgtgtatttctctgtctctctccat

SEQ ID NO: 27188 - DNA, 95 bp, Homo sapiens; identical to SEQ ID NO: 68

SEQ ID NO: 27189 - DNA, 93 bp, Homo sapiens; identical to SEQ ID NO: 69

SEQ ID NO: 27190 - DNA, 111 bp, Homo sapiens
gtcattatttaccatctccctagtaggtgtatagatgtatataaatatatccattttccatgtctgactttgtaagtctgtgtgtgtaattgggattggcaatacaatagc

SEQ ID NO: 27191 - DNA, 95 bp, Homo sapiens; identical to SEQ ID NO: 68

SEQ ID NO: 27192 - DNA, 93 bp, Homo sapiens; identical to SEQ ID NO: 69

SEQ ID NO: 27193 - DNA, 93 bp, Homo sapiens; identical to SEQ ID NO: 69

SEQ ID NO: 27194 - DNA, 116 bp, Homo sapiens
tcctcttgtatctcattgagcttctttgccgtccaggttctgaatttatatctttaatttcagacatttcatcctggttaggatcgattgttagggagctagtgcaatcctttgga

SEQ ID NO: 27195 - DNA, 65 bp, Homo sapiens
cacactccacaactcactctgactctggcaaatacagaggaacagtgggttcccaaggagttgtg

SEQ ID NO: 27196 - DNA, 83 bp, Homo sapiens
tcatctttctgaaactctcaatcactgtcaactatgcctagcaatgctgaaaccaagtggaccatgagtttctagtctgatga

SEQ ID NO: 27197 - DNA, 71 bp, Homo sapiens
ctgacttactgtggagcagggattaagagcctgagccgacctcacattctctctgacttactgtggagcag

SEQ ID NO: 27198 - DNA, 71 bp, Homo sapiens
ctgacttactgtggagcagggattaagagcctgagctgacctcacattctctctgacttactgtggagcag

SEQ ID NO: 27199 - DNA, 100 bp, Homo sapiens
ggagacggggtctcactctatcgcccagattcaagtgtagtgtgtgagcacagctcactgcagccttgacctcccgggctcaagtgatcctcctgcctcc

SEQ ID NO: 27200 - DNA, 71 bp, Homo sapiens; identical to SEQ ID NO: 27198

SEQ ID NO: 27201 - DNA, 119 bp, Homo sapiens
aacttgggtttagttacaggggtactactgtacatactatacaaaatagctataattatatatatatcttaattatatgtgtgtgtgtataatttgtttgtactctataaatacatgtt

SEQ ID NO: 27202 - DNA, 95 bp, Homo sapiens
atcacgtgcctcccggtttgcagaaggcgagcgtgatgcagataaatcgtgcatctgtatcaggaactgcatatgtaagccagaattgctcgggt

SEQ ID NO: 27203 - DNA, 70 bp, Homo sapiens
ttgaggcagggtctcactctgtcactgctctggagtgcggtggcaaaatgttggctcactgcagcctcaa

SEQ ID NO: 27204 - DNA, 59 bp, Homo sapiens
agtccatgtggaactatttatgacactctcagtgtcataatcaggtgaccgtgtgtcct

SEQ ID NO: 27205 - DNA, 115 bp, Homo sapiens
actgagcacaattctataccaaaacacagtgctagaatcttttttatataaagatttgctttaaagaaagcaaataccgaactaaaaaagatttctgtcttaggagatttgcagt

SEQ ID NO: 27206 - DNA, 65 bp, Homo sapiens
tcttcacagtcagtgtgtctctccatatgtgcatgtgcgtacacgggacacctaattgtgaatga

SEQ ID NO: 27207 - DNA, 149 bp, Homo sapiens
atgtttatatatatatgtatatatatgtatatatgtatatatatgtgtacatatgtatatgtgtatatatgtatatatgtatgtatatatgtctatatgtatgtatatgcatatatgtacatatatacatatgtatatgcacatgtata

SEQ ID NO: 27208 - DNA, 140 bp, Homo sapiens
atatatgtgcatatgtatacgtatatatgtgcatgtatgtatatatgtacatatgtatatgtatatatgtatatatgtacatatgtatatatgtatatatgtacatatgtgtatgtatatatgtacatgtatgtatatat

SEQ ID NO: 27209 - DNA, 121 bp, Homo sapiens
atgtatacatatatgtatatgtgtatatatgtatacatatatgtatatgtgtgtatatatgtatatgtgtatatatatgtatatatgtgtgtgtatatatatacacacacatacatatatg

SEQ ID NO: 27210 - DNA, 93 bp, Homo sapiens
gtttttgatattgtatttccaaagatcagtttctgattttgtatttcaaaaaatcagtgatgttgatctttttttttgtatgacgttggctac

SEQ ID NO: 27211 - DNA, 94 bp, Homo sapiens
ggacttcagtgcttaagttttacaacccactggttttgaataatttattgtctataatataagacccttggctgttttctaagcactggatgcc

SEQ ID NO: 27212 - DNA, 226 bp, Homo sapiens
tatatatgtatacatatatattcatatacacacatatatgtgggtgtgtatatatatgtatgtatacatataccaacatatatgtgtgtatatatatgtatgtatacatatacacatatatgtatacatatatatgtgtgtatatatatttatatattttttagttatatattttatatatatctatatatctatatctatatgtatatttatatctatatctata

SEQ ID NO: 27213 - DNA, 95 bp, Homo sapiens
tacacacatatatgttggtatatgtatacatacatatatatacacacccacatatatgtgtgtatatgaatatatatgtatacatatataaaata

SEQ ID NO: 27214 - DNA, 77 bp, Homo sapiens
ctgtgaaactgtgtgcaaagatttttattttaatggtaacgttaaataggaatcggtgggaggcaaaagtccaacag

SEQ ID NO: 27215 - DNA, 72 bp, Homo sapiens
atgtatgtggttaggtatatgtaggtatatgtatatgtatgtatatgtatatatacatgactagtcaagcat

SEQ ID NO: 27216 - DNA, 92 bp, Homo sapiens
gaggcaggaggatcgcttgagttcaaggctgtagtgagctatgatggcaccatggcactccagccttgagcaacagactgagactctgtctc

SEQ ID NO: 27217 - DNA, 98 bp, Homo sapiens
ttcattctcagagtggtttgttcctattgctgatattaatgtcgtataaatatttatatagtaggatagaaatgggggtcaaattagtatagaaagga

SEQ ID NO: 27218 - DNA, 115 bp, Homo sapiens
taggtaacttgatttgtattctcagatggtgcaaatatgctcaactaatttactttttgattaaaaaaataatatttaagaactcactttgtaccaggtatgtgcaaattgctta

SEQ ID NO: 27219 - DNA, 113 bp, Homo sapiens
ttcctttttgtgtgttgtgtacatcttcagaatatttgtatctctttttttatttgtaggaactgatttacatgttgttttggtttatgacaatttatgctcagttattggag

SEQ ID NO: 27220 - DNA, 94 bp, Homo sapiens
gtatgtgtgtatatgtatatttgtgtatatatatagatatatatgtatatgtgtatatatatgtgtgtatatgtatatttgtgtgtttgcatat

SEQ ID NO: 27221 - DNA, 81 bp, Homo sapiens
tccctccattttttttttttttttcccctgaggacagagccccggctctgtcagggagaaaaatacaggaagaaggactga

SEQ ID NO: 27222 - DNA, 88 bp, Homo sapiens
ctcaggaggctgaggtggtaggatcacttgagtccaaggggtcgaggtttcggtgatccatgatagtaccactgcactccagcctggg

SEQ ID NO: 27223 - DNA, 95 bp, Homo sapiens; identical to SEQ ID NO: 68

SEQ ID NO: 27224 - DNA, 93 bp, Homo sapiens; identical to SEQ ID NO: 69

SEQ ID NO: 27225 - DNA, 58 bp, Homo sapiens
acatgtctgtgtgtgtatatatatacatatatgtgtatatatacacatacatatatgt

SEQ ID NO: 27226 - DNA, 88 bp, Homo sapiens
gggttggttccaagtctttgctattgtggatagtactgcaataaacatatgtatgtatgtatctttatagcagaatgatttataatcc

SEQ ID NO: 27227 - DNA, 102 bp, Homo sapiens
agtgagaatacagtgtccatataaaggtagactaccggaatttgccagtatgtttctggtttttatttttatttatttatttttttgagacagagtctcgct

SEQ ID NO: 27228 - DNA, 85 bp, Homo sapiens
tgttttcctgttatttcaatgggtttgttttgatctaaatatatatatatcgatttaagctttgatttgttttgacagaagaaca

SEQ ID NO: 27229 - DNA, 86 bp, Homo sapiens
gtgtgtgtatgtctgtgtgtgtgtgtgtgcgtgtgtgtgtatctgcagatatacatatatctgtatatgtatatttctaggatcat

SEQ ID NO: 27230 - DNA, 103 bp, Homo sapiens
tacttgtcgaatgactactcttttatgtgggaggtaaatatttttatttctgaaggaagagagcaactattgacctgtgaacgagggtagttacctgaaagta

SEQ ID NO: 27231 - DNA, 100 bp, Homo sapiens
cactggaactttacatcctgagaaagtgtcagttggtttggagaaaattcatatatgcaaacctttcaccttcttttcagatgtgatttgcatttcggtg

SEQ ID NO: 27232 - DNA, 110 bp, Homo sapiens
gattatgttgagtcttgagtgcagtttgagaattgactttttttttaaagttttgctattttaaaaactgttattatttttaattgacacataactaattatacataatt

SEQ ID NO: 27233 - DNA, 86 bp, Homo sapiens
ctgggctgagtggctcctcggctcggtggtggagctccagtcctcacgtggtgtccttcctctgtgtgtgtctctctgtgtcccag

SEQ ID NO: 27234 - DNA, 110 bp, Homo sapiens
agacgacttgggtaaggagaagtttaattaggtcccagctatttatctttgtttttattgcatttccttttgggttcttggtcatgaaatccttgcctaagccaatgtct

SEQ ID NO: 27235 - DNA, 110 bp, Homo sapiens
tatatagtttggtgaacttctaatggaacttggtacctttttttttattattatactttaagttttagggtacatgtgcacattgtgcaggttagttacatacgtatata

SEQ ID NO: 27236 - DNA, 116 bp, Homo sapiens
caaaaagataagaatttcttttgtttgcactagtcatgtgacaggaaaagataacactaaagattttttttttttgcacatgctgtgatgatatcatgggaagttaaataattttg

SEQ ID NO: 27237 - DNA, 77 bp, Homo sapiens
aatctttaagacaacatctaggaaaaaaatttctaagattttttttaagacactttggcctaggtttcttgaagatt

SEQ ID NO: 27238 - DNA, 85 bp, Homo sapiens
acagtatgtgcataaaatgctcagcatagtatctggcattatatatgtatatatatgctaagcattttatatgcataatatatgt

SEQ ID NO: 27239 - DNA, 101 bp, Homo sapiens
ttggtagtggaatatcgatagcctttatatctggagtacgagacaggatgtgtttttgtttttcagacattcagtatagatgttgagggttctgaatccaa

SEQ ID NO: 27240 - DNA, 95 bp, Homo sapiens
ccattaactgacataagaaacagatgactcacagtctggggaaggagaaggtgatgacgtctgtttttgatgttttgtatttgagatgttggtgg

SEQ ID NO: 27241 - DNA, 66 bp, Homo sapiens
acagagcctctctctctctctgctgagctgccgggagctggtggaggggtgacatggcacctctgt

SEQ ID NO: 27242 - DNA, 108 bp, Homo sapiens
caaaaacacaacccgctgtcagtttttatatattttgtatatatacatgtgtgtgtatatatatgtatgtatacagtcgaccttctgtatccatgggttctgtgtctg

SEQ ID NO: 27243 - DNA, 80 bp, Homo sapiens
tatatctatatatctatatgccactatatctatatatctatatatagatatatatatagtctcatatatatatacatata

SEQ ID NO: 27244 - DNA, 88 bp, Homo sapiens
agtgatcgttgttgagtagtgattctgatgtaagacaagctcacagcttgtgaccacaaggatcattatatgaactgcaaggatcatt

SEQ ID NO: 27245 - DNA, 73 bp, Homo sapiens
ctgccctccagaacttggtcagtttgcatgttctttagaaaacagtagtgtcagaccacaggcataagggcag

SEQ ID NO: 27246 - DNA, 90 bp, Homo sapiens
agggcattgttgagcaaggacttactgtagtagtatgtggtattgttttgcatgtttttatactgtctgtacttggtctgcatatgctgt

SEQ ID NO: 27247 - DNA, 111 bp, Homo sapiens
atttatttttatttttaaatcaggaatgaatgccgaatgttgtcaaacaatttttctatatctattgagatgacaatatggaggtttcattagttggacaatatgatgaat

SEQ ID NO: 27248 - DNA, 78 bp, Homo sapiens
agtaaggaactacaaggggcaagaggaaatcttttttctttaatttttgagacagagcctcactctgtggttcaggct

SEQ ID NO: 27249 - DNA, 74 bp, Homo sapiens
ccaaaacgaagcaaaacacgcactgaattgaacaataagtgtgtgtcagtgtgtgtgtgtatatgtgtgtgtgg

SEQ ID NO: 27250 - DNA, 67 bp, Homo sapiens
gtcataggttctgagaagacagtgatgaaagtcaacagcagcactgtccaatagaactttctgtgat

SEQ ID NO: 27251 - DNA, 83 bp, Homo sapiens
gggccggtctcactccctctgtccctgccaacagcaccgagtttgtttctaggcagtggatgagcagggttgagaacttgtcc

SEQ ID NO: 27252 - DNA, 94 bp, Homo sapiens
gttgccagggactgtgaattgctggcctgtgagttttcatcagatgtgggaatctttttttttttttttccagcaaaattcaccgtaaggagat

SEQ ID NO: 27253 - DNA, 122 bp, Homo sapiens
ttctaccaagctgtttcttgtgctggggctggcaaggcgcatgatggggcctctactggaagagacaacagacagaggagaagtggcaggaccaggccagaccttggggcccagggagtggc

SEQ ID NO: 27254 - DNA, 129 bp, Homo sapiens
tcgctcttatcaaaagctggcaccattaaagggcattcatcatcaataagacaataggacactgtctctctcagattttggcccatttccttgtgcctgtatgagctctgtgaatgtggttcgctattg

SEQ ID NO: 27255 - DNA, 136 bp, Homo sapiens
tatatatgttatataacatacgtatattatatatgttatataacatatgtatattatatgttatataatatacatatattatatatgttatataacatacgtatattatatgttatataacatacgtatattatat

SEQ ID NO: 27256 - DNA, 80 bp, Homo sapiens
atgtttatatgtatacatatatgtatatgtatagatctacacacatatacatatatatgtgtatatatatatgacagcat

SEQ ID NO: 27257 - DNA, 64 bp, Homo sapiens
actcccacactgtgaggagactgaggccacatggagaggtgactgtgttccatcacgtgggtgt

SEQ ID NO: 27258 - DNA, 165 bp, Homo sapiens
tatatatatacgtatatatatatacgtatatatatacatatatatacgtatatatatacacgtatatatatgtatatatatacgtatatatatatacgtatatatatatatatacgtatatatatacgtatatatatgtacatatatatacgtatatatatatac

SEQ ID NO: 27259 - DNA, 112 bp, Homo sapiens
gttagaagagtcatatagagatgcttcagaaaaaacattataattattataaatataatactgttataataataagacagatgataggaattctagatgactgttttttgat

SEQ ID NO: 27260 - DNA, 58 bp, Homo sapiens; identical to SEQ ID NO: 2442

SEQ ID NO: 27261 - DNA, 113 bp, Homo sapiens
tttcaaagttaggttgtgggttcttgagtgtttcgctcgttattgtactttatgtatgcatgtatgtatgtatgtagaaacagtttccttaagttcctcaggctggtctggag

SEQ ID NO: 27262 - DNA, 70 bp, Homo sapiens
tctgtctgcttttgtagaaagcaagaatatatattgatttctacaaaagtttctttttttttgagacgga

SEQ ID NO: 27263 - DNA, 115 bp, Homo sapiens
tgatttttgtgtgttgactttgtatcctgcaactttactgaatttgttgatcagttctaatagtattcttgtggagtctttaggcttttccaagtataagattatatatatatca

SEQ ID NO: 27264 - DNA, 76 bp, Homo sapiens
tcatataggcatactgggaattctgacaggagtgagtgacagccctaatccctgtctctctgtatgtcagtgacct

SEQ ID NO: 27265 - DNA, 117 bp, Homo sapiens
ggtacatttcatctaggttatcaaattagtgggcatatattattcatggtattcttttattattattttcgtgtccgtgagatttgtagtgatgtctgctacttcattgccggtatt

SEQ ID NO: 27266 - DNA, 113 bp, Homo sapiens
tcctccatgggcactggcctggaatcaggagcagtggaattctttttttttttttttttttttttttagacagaagctcactgtgtcacccaggctagtgtacagtggtgtga

SEQ ID NO: 27267 - DNA, 95 bp, Homo sapiens; identical to SEQ ID NO: 68

SEQ ID NO: 27268 - DNA, 93 bp, Homo sapiens; identical to SEQ ID NO: 69

SEQ ID NO: 27269 - DNA, 107 bp, Homo sapiens
tttttgctcaaaattgctttggctgttcagggtctttaataggtctctacaaattttagaatctatttctatttctgtgaagaatgtcattagaattttgataggga

SEQ ID NO: 27270 - DNA, 58 bp, Homo sapiens; identical to SEQ ID NO: 1409

SEQ ID NO: 27271 - DNA, 62 bp, Homo sapiens
acatatgagtgtatgtatgtgtatgtatatatatacatacagacacacacacacacatatgt

SEQ ID NO: 27272 - DNA, 71 bp, Homo sapiens
catgggggcatggctgcttcagacatttttcttttttttttttttgagacagtctcagtctgtcacccgtg

SEQ ID NO: 27273 - DNA, 114 bp, Homo sapiens
gctgtcttatctgcgttttactgtctgctctttctggctgcttatagttagaagagaagtgatttccttgaaatacatgaggctagaaagggagctggaacttaaagtggcagt

SEQ ID NO: 27274 - DNA, 60 bp, Homo sapiens
tgtgagccaattccttatcacaattctctttatatatatatagggaagctggggctcaca

SEQ ID NO: 27275 - DNA, 101 bp, Homo sapiens
ggtgattggtgtgaagatgatatgggacccaggcagagatatctacctgtctctctatctatctatctgtctgcctgtctgtctgtctttgtatcaaagct

SEQ ID NO: 27276 - DNA, 78 bp, Homo sapiens
tagtaatgccagtgtgtgtgtatatgtctgtgtatttatatacacaattatatatatataatataatggcacatattg

SEQ ID NO: 27277 - DNA, 126 bp, Homo sapiens
ccagtctgtggatgttcctcaatttgtttagccattcacaaattaacaggtagttggttgttttctgttctgagctattgcaaatagagatgctataaatatttgtgtacaggttttgggcaaaca

SEQ ID NO: 27278 - DNA, 73 bp, Homo sapiens
cattttgataatggccattacaactagagtaaggttatatctcactgtggttgtgatttgcattttcctgatg

SEQ ID NO: 27279 - DNA, 95 bp, Homo sapiens; identical to SEQ ID NO: 68

SEQ ID NO: 27280 - DNA, 93 bp, Homo sapiens; identical to SEQ ID NO: 69

SEQ ID NO: 27281 - DNA, 93 bp, Homo sapiens
acaggggggctctgtcaccgactctgagtctttacgccacttttttgagagcatcatatggccgggcttaggtcacatggcttatacctttgt

SEQ ID NO: 27282 - DNA, 112 bp, Homo sapiens
tagctgggtgtggtgtcgtgtgcctgtagtcttagctacttgggaggctgaggtgggaggatgacttgagcttgggaggcagaggttacagtgagctgagaccgtgccacta

SEQ ID NO: 27283 - DNA, 98 bp, Homo sapiens
tccctcacattggaaattgtaagagacctgactgtgctctcagccacttaaaactagttgatgtctacagttctctgaaatgtgggtcttaacttgga

SEQ ID NO: 27284 - DNA, 111 bp, Homo sapiens
ctagtctacaaaggtacgcatatattaaacattatgttgtatactatatatatataaactttatatatgtaaacatatatctagatatataaacaaacttttgtcaattgg

SEQ ID NO: 27285 - DNA, 89 bp, Homo sapiens
gcatgactgtatttgtttttatttggaacttacttgtttttatttctaaatctgagttttaaatagacactacaattactttcttatgc

SEQ ID NO: 27286 - DNA, 78 bp, Homo sapiens
tatctccactgcctcagttcaggtcttcattatgtgtccctcgcattcctgcactactttcaggcagagatggagatg

SEQ ID NO: 27287 - DNA, 117 bp, Homo sapiens
gatcactggtttaactccttggaagagaagaaaactataaatatatatatatatatatatatatatatatatattttttttttttttttttttttttgagacagagtctcgatctgt

SEQ ID NO: 27288 - DNA, 84 bp, Homo sapiens
gctcagatagtctggctcaagaacccaatttttttttttttttttttttgagatagggtgttgttctgttgcccaggctagagt

SEQ ID NO: 27289 - DNA, 111 bp, Homo sapiens
gctctattgtaaacatgtaggcatagcttgttttattgtgctttgtagatattattattattattattattattattttaattgaagggttgtggcaactttgtgtggagc

SEQ ID NO: 27290 - DNA, 119 bp, Homo sapiens
ctgttcctctggaggatagccaggtgctccctgaaaggaggtgcactctcactgtttctctggatgggtagccaggtgcttcctgaaaggaggtgcactctcactgttcctctggagga

SEQ ID NO: 27291 - DNA, 72 bp, Homo sapiens
ctgtttctctggatgggtagctaggtgctccctgaaaggaggtgcactctcactgtttctctggatgggtag

SEQ ID NO: 27292 - DNA, 143 bp, Homo sapiens
gaaaggaggtgcactctcactgtttctctggatgggtagctaggtgcatcctgaaaggaggtgcactctcactgtttctctggatgggtagcgaggtgcttcctgaaaggaggtgcactctcactgtttctctggatgggtag

SEQ ID NO: 27293 - DNA, 88 bp, Homo sapiens
cctgcaggtcatggtccaagtcccacacctgagtcagctcacaggctcggagctcactgactgaagggggagtcaggttcacctgagg

SEQ ID NO: 27294 - DNA, 110 bp, Homo sapiens
ggataagaagaagaaggagaacattctaagctgggttcatcatgtgtgtaaagtctgggaagtgattttttttttttttttagacggagtctcactctgtcgcccaggct

SEQ ID NO: 27295 - DNA, 105 bp, Homo sapiens
caatgtactaggtactgaaagaaaatagtagtgcttctgtttatatatatatttcttattttttgagacagagtctcactttctctcccatgctacagtgcagtg

SEQ ID NO: 27296 - DNA, 60 bp, Homo sapiens
gtgagacggagtctcactctgtcgctgaggctggagtgcagtggtgcgatctcggctcac

SEQ ID NO: 27297 - DNA, 56 bp, Homo sapiens
gagacagagtctcactctgtcactcaggctggagtgcagtggtgtgattttggctc

SEQ ID NO: 27298 - DNA, 82 bp, Homo sapiens
gttgaatgagagtagtgagagtgggcatccttgtcttgtcaaagttctcaaggagaatgcttccagtttttactcattcagc

SEQ ID NO: 27299 - DNA, 64 bp, Homo sapiens
tcagattgaacattattaatgtatagaaatgctaagatttttgtacattgattttgtgttctga

SEQ ID NO: 27300 - DNA, 102 bp, Homo sapiens
gacatgagactctcctggaaactagtatttttagaagactttttgttcttgaaaaataagagggcctggaaaagctacagtacccgtctgagtctgcaagtt

SEQ ID NO: 27301 - DNA, 58 bp, Homo sapiens; identical to SEQ ID NO: 315

SEQ ID NO: 27302 - DNA, 58 bp, Homo sapiens; identical to SEQ ID NO: 3701

SEQ ID NO: 27303 - DNA, 80 bp, Homo sapiens
cagcacaggcagacttaacttaacctttcttttttttttttttttttttgagactgggtctcagtctgtctctcaggctg

SEQ ID NO: 27304 - DNA, 75 bp, Homo sapiens
gccatatatatacatacacatatacatatacatatgtgtgtgtgtgtatgtgtgtgtgtgtgtgtgtgtgtgtgt

SEQ ID NO: 27305 - DNA, 120 bp, Homo sapiens
attcacaggcttcataggtgggtaaaaagcaggttttattattttatttatattgtattttatttgtatttattattttattttagaaatggtgtcttgctctgtcactcaggctggagt

SEQ ID NO: 27306 - DNA, 74 bp, Homo sapiens
tttgttttttgagtcagagtctcactctgttgcccaggctggaatacagtggtgcgatctcagctcactgcaag

SEQ ID NO: 27307 - DNA, 58 bp, Homo sapiens; identical to SEQ ID NO: 4572

SEQ ID NO: 27308 - DNA, 58 bp, Homo sapiens; identical to SEQ ID NO: 884

SEQ ID NO: 27309 - DNA, 56 bp, Homo sapiens; identical to SEQ ID NO: 885

SEQ ID NO: 27310 - DNA, 110 bp, Homo sapiens
acaaagttagaattctgatctaactatatatatatatatatatatatatatatatatatatatatatatgtatatataaatatatataatgagatggagtctcgctctgt

SEQ ID NO: 27311 - DNA, 115 bp, Homo sapiens
tgtaaagaaaaaagatcgaggggatgaaaacactgtagcaaagcattggtttttttttttttcctgagtggtagaattatgagtgatgctgtgttttccagatactttctttgga

SEQ ID NO: 27312 - DNA, 107 bp, Homo sapiens
gccaggcacacagcagggattcagtaaatattggtagaataaatgagtgacaagtgagtgaacatatctaggtcacttccatcatgctccatcatgctgtgctgtgc

SEQ ID NO: 27313 - DNA, 103 bp, Homo sapiens
gctcttgcaggctggactcccctccgctttattttactatgagctcatcgcctctgtcactctctgtaagcgtcttaagcgtgggtgtcccactttacggagt

SEQ ID NO: 27314 - DNA, 75 bp, Homo sapiens
gttgttgcttaagagcacctgcctggcatgcagctcagagcactgtctgcccagactgtgaccaaagcacataac

SEQ ID NO: 27315 - DNA, 88 bp, Homo sapiens
ccagcacaatgggcccagataagtattcttttttttttttttttttttttttttttgagagggagtctcgctctgtcacccaggctgg

SEQ ID NO: 27316 - DNA, 89 bp, Homo sapiens
tggagcaggggaaaaatgcagaaagattttttttttctagctgaaggctggacatacaaaatcagtctgagtttgcacagaatgttcta

SEQ ID NO: 27317 - DNA, 124 bp, Homo sapiens
tccagctttgttcttttggcttaggattgtcttggctatgtagactctttttggttccatatgaaatttaaagtagttttttccaattctgtgaagaaagtcattggtagcttgatggggacag

SEQ ID NO: 27318 - DNA, 92 bp, Homo sapiens
ggacatcacctggatagtgtgctctactctttttcttgtctttccttttttttttgaaacagtgtctcactctgtcatctaggctggagtcc

SEQ ID NO: 27319 - DNA, 118 bp, Homo sapiens
tcttttgagaattgtctattcatgtccttaacccgctttttgatgggatggtttgtttttttttcttactgatttgtttgagttcgttgaagattctggatatcagtcctttgttgga

SEQ ID NO: 27320 - DNA, 58 bp, Homo sapiens; identical to SEQ ID NO: 6327

SEQ ID NO: 27321 - DNA, 112 bp, Homo sapiens
tctatctatatattcgacacatatatggggtatgtatatatatattcatgtatatctggagatctccatatatatatatatatgtgcacacacacatgtaattatagctagg

SEQ ID NO: 27322 - DNA, 102 bp, Homo sapiens
cttcaagatggatttctccatggtttaactatgagttctgattttcaagtgctctataaattttgagctcattaacatattgaagaagtgtgcgttttgtag

SEQ ID NO: 27323 - DNA, 78 bp, Homo sapiens
cgtatgtaagtgcatgcatgtgtgtatgtgtgggtgtgagtctatgtatatatatgtttatgcatgcatatgtttatg

SEQ ID NO: 27324 - DNA, 99 bp, Homo sapiens
ctcgggtggagattggtgaactcggttctcctgatcagaagcccattggacagggtatgaatcagaaggaagtgaggacagtggtgagtcctcctgcag

SEQ ID NO: 27325 - DNA, 88 bp, Homo sapiens
cttcctactctgcctgtgtgcctgcctggctttgccatttgtgtctcatccccaaggttagctggggttacgctgagagttgtgggag

SEQ ID NO: 27326 - DNA, 58 bp, Homo sapiens
tgagatggagtctcactctgtcactcaggctgaagtgcagtggtgtgatctcggctca

SEQ ID NO: 27327 - DNA, 95 bp, Homo sapiens
ctctgcttttgagccctgagcaactttctgtctggctgacagcctggttgaaggaacctcccggaaaggcagaatggccggggccggtaacaggg

SEQ ID NO: 27328 - DNA, 75 bp, Homo sapiens
gcctgtctagatgagtgtccaccatgctcccaggagggctgcagagtcctcactgccactctctgacaccctggc

SEQ ID NO: 27329 - DNA, 71 bp, Homo sapiens
tggggaatggagccaaagggactgagaagtttccccaaggttggttggtctcggtctctgtctctctcaca

SEQ ID NO: 27330 - DNA, 74 bp, Homo sapiens
gacacaaggtaggacatgaggtctgaatccccaacaagatccactgggagctggcttgatccctccagtgtgtc

SEQ ID NO: 27331 - DNA, 143 bp, Homo sapiens
tcccaaactgaatgcataccaagggtgatgaaagttttctttttttttttttttttttttgaaagagtctcactctgtcacccaggctggagtgcaatggtgcaaggggctcactgcaacctccgacttccaggttcaagcag

SEQ ID NO: 27332 - DNA, 56 bp, Homo sapiens; identical to SEQ ID NO: 9059

SEQ ID NO: 27333 - DNA, 107 bp, Homo sapiens
agaccgaatcaggctctctcacaggcatttgtacttctcctctatggatcttatcggggtttatatttgtatatttggatgtgataggaaagtcttccttctcctct

SEQ ID NO: 27334 - DNA, 74 bp, Homo sapiens
ggactgggtgatgtgtgagtgcacacggaggcacacactcgctcatccgtgtccacttctgcatctcaccgtct

SEQ ID NO: 27335 - DNA, 71 bp, Homo sapiens
tgctctattagttcatgagagagttggttgtttataaaagcctggcctctctcttgctcactgtctcagca

SEQ ID NO: 27336 - DNA, 93 bp, Homo sapiens
tcctctgttcctttttggggcctcaagaggattgggcctgggacacagacacacagattcactggcaggaacacagaaaggaacccacaagga

SEQ ID NO: 27337 - DNA, 121 bp, Homo sapiens
ggtagagaggatacagacactcagactccagaactcgaagggctcttctgaccaccctgtgcaatcttctctccttccaggtgaggacacagagaggtaaaatagtcacaccgcagtgagt

SEQ ID NO: 27338 - DNA, 103 bp, Homo sapiens
tatatatatgtattatgtgtacatgtatatgtgtgtgtgtgtgtatgtatatatacacacacacacacacacacacacacacatacacacacacatatatata

SEQ ID NO: 27339 - DNA, 66 bp, Homo sapiens
agccttctgcgggctttgctgggtgaattggctcctgcctcacaggcaccctctgaggctctcaga

SEQ ID NO: 27340 - DNA, 72 bp, Homo sapiens
gtgtattttgattgcttttgattaactttaacaaactaaagaagtttgctgaaattaaacatcaaagtacac

SEQ ID NO: 27341 - DNA, 111 bp, Homo sapiens
tggggtgggtacaggggatatgaggctggtcttggtcctttgagagagtctgaggctgtctctgagaggctatctagaagttagggagatgtttgtttggagctggcacca

SEQ ID NO: 27342 - DNA, 77 bp, Homo sapiens
ggttgagtgtcagtgactgtcacatatagggataggtcaggtggcttctggaggtggcaaggtactggagctgaatc

SEQ ID NO: 27343 - DNA, 72 bp, Homo sapiens
atatatatatatctcatatatatgacgtatatataaatatatatatctcatgtatatgacgtatatatatat

SEQ ID NO: 27344 - DNA, 128 bp, Homo sapiens
gtgtgtatgtgtgtgtatgcatgtgtgtatgtatatgtgtgtatagtgtgtgtgtatatatgtgtgtatgtatatgtgtgtatagtatgtgtgtatgtgtgtgtatgcacgtgtgtgtatgtatatgt

SEQ ID NO: 27345 - DNA, 68 bp, Homo sapiens
aggtgtcggaggtgacagagctgcagctaaagcccaattttcgttgacactcagagtctctgacagct

SEQ ID NO: 27346 - DNA, 72 bp, Homo sapiens
gcaacagtgggtttgttacataagtaagttcggccacctcttgctgtcttgctcactctcaccctctcttgc

SEQ ID NO: 27347 - DNA, 95 bp, Homo sapiens; identical to SEQ ID NO: 68

SEQ ID NO: 27348 - DNA, 93 bp, Homo sapiens; identical to SEQ ID NO: 69

SEQ ID NO: 27349 - DNA, 88 bp, Homo sapiens
tcaccgtggattgagggtggaccccaaactgccctgacaaagcagctccctgcttgctgtctctgcctgtcactttccttctgtggga

SEQ ID NO: 27350 - DNA, 78 bp, Homo sapiens
agaaggagggatgtcagagttcctcaaggtcagttgaattttgctgaggtttaaggggaattttttttttctttttct

SEQ ID NO: 27351 - DNA, 111 bp, Homo sapiens
gggatattttaataatctgcttgttttcagaggaacattgttttccagaggaaaatattttgattttttttttcatctaactaatgtttttctaagagaggtttaaaaccc

SEQ ID NO: 27352 - DNA, 72 bp, Homo sapiens
tagctgggtcacagggtgtttttttttttttttctttttttgagacagggtctcactctgtcacccaggctg

SEQ ID NO: 27353 - DNA, 84 bp, Homo sapiens
aagtccttgaatttttcttttatttgcaggttcttgtatcgtgtggtataaagcccgaaattcaggttgtgttcactggggctt

SEQ ID NO: 27354 - DNA, 97 bp, Homo sapiens
aggcaggaggatcacttgagcccagggatttgaggctgtagtgggctatgattacaccactgcactccagcctgggcaacagagtgagattctgtct

SEQ ID NO: 27355 - DNA, 72 bp, Homo sapiens
agggagaaaggaagatggagccaagacttagacacttgaatgtttcttttttctctttttttttttctttct

SEQ ID NO: 27356 - DNA, 130 bp, Homo sapiens
gtgtgtatatatatgtcactatatatatatgtcactgtatatatgtgtatatatgtcactatatatatcgtgtatatatatatatagtgacatatatatatacacacacacatatatacatatatatata

SEQ ID NO: 27357 - DNA, 58 bp, Homo sapiens
tgagactgagtctcactctgtcgcccaagctggagtgcagtggcacgatctcagctca

SEQ ID NO: 27358 - DNA, 81 bp, Homo sapiens
gtgagtcactcaacctctctgtgtttcagtttcctcatccatgaaacgataaaaaatgataggccaggtgcagtggctcac

SEQ ID NO: 27359 - DNA, 119 bp, Homo sapiens
ggccacagtatttatcaggcggcgcttcgctcccctccgccttctcttcccggttcttcccggagtcgggaaaagctgggttgagagggcgaaaaaggatgaggtgactggtctgggct

SEQ ID NO: 27360 - DNA, 109 bp, Homo sapiens
agattttctatgttatcttctgtaagttttagagttttgcattttaaacataggtctataatttgttttaatttttgcaaaacgtgtatggtctatgcatagagttttt

SEQ ID NO: 27361 - DNA, 58 bp, Homo sapiens; identical to SEQ ID NO: 285

SEQ ID NO: 27362 - DNA, 102 bp, Homo sapiens
atccccagtacgtttcttcagttagacgattctttttctttcttttttttttttgagataaggtctcattctgtcacccaggctggagtgcggtggtgcgat

SEQ ID NO: 27363 - DNA, 78 bp, Homo sapiens
ttgctggtaagtggcagagccaggattcaggcaagcctgctctcagccactctgccgctgttcctctgtcgtaagcaa

SEQ ID NO: 27364 - DNA, 58 bp, Homo sapiens
tgagacagagtctcgctctgtcacccaggctggagtgcagcggtatgatcttggctca

SEQ ID NO: 27365 - DNA, 64 bp, Homo sapiens
tcactcagtctgagcctctgtgtccccatcttttaagtggtaatgcccagagggttcagtgtga

SEQ ID NO: 27366 - DNA, 110 bp, Homo sapiens
gcctctttccccagagtgggcgggccctgtgcaggtctcatcttcaaaggatgggccgtccccagagagaagagagtggccagaagccccctgccctgccccaagcaggc

SEQ ID NO: 27367 - DNA, 76 bp, Homo sapiens
acatatccacatcaacgtatgtatgtatgtatgtatgtatgtatgtatgtatgtatgtatgtaagtgtgtgtgtgt

SEQ ID NO: 27368 - DNA, 111 bp, Homo sapiens
agctctgtcttagacatgttcactcagagatgccttttattttattttatttttttattattattttttagttggagtcttgctctgttgcccagtctagagtgcagtgtt

SEQ ID NO: 27369 - DNA, 92 bp, Homo sapiens
agagctcaatcaatgcttgttgaatgaatgaacaatgggactacctgggccaatatataatttatttattcaaaaatatttattgagtgtct

SEQ ID NO: 27370 - DNA, 69 bp, Homo sapiens
gctcctgggccccaccctgggctctgtagaaggcacaggatactgagagtagagtgggagcaggattgc

SEQ ID NO: 27371 - DNA, 105 bp, Homo sapiens
tgctaaggtcagggtgggacgttgtggagctcactttgtcttttttttttttttttttttttttttttttagacacactctcactctgtcgcccaggctggagta

SEQ ID NO: 27372 - DNA, 81 bp, Homo sapiens
ggtcacagggttcattgatgagtgaataaggctgcacagtctccatcgtatgctcctaacagaagtcagtgagcccttgct

SEQ ID NO: 27373 - DNA, 87 bp, Homo sapiens
tgcatttctgtggtatgcattgtaatgtgtctcatttttttttttatttgagacagagtctccctctgttgcccaggctggagtgca

SEQ ID NO: 27374 - DNA, 75 bp, Homo sapiens
ctgacacactgtgtctctggtcatggtgcaggaacttttatgtttttgatctgacaacagagcataaggttttgg

SEQ ID NO: 27375 - DNA, 84 bp, Homo sapiens; identical to SEQ ID NO: 15839

SEQ ID NO: 27376 - DNA, 68 bp, Homo sapiens
ggtggcagagtgagtgggaatccaggtctcctgagtgtagcacttggactctgtcactctctccctca

SEQ ID NO: 27377 - DNA, 82 bp, Homo sapiens
gtgtgtgtgtgtgctatcaaccaataggatgtatgaatgtgtgtttatatatgtgtatgtatatctctcacacacacagcat

SEQ ID NO: 27378 - DNA, 64 bp, Homo sapiens
gtcaagtcacagagcagacagggtcagcccctcagccctggctctagctgatggactcagtgac

SEQ ID NO: 27379 - DNA, 125 bp, Homo sapiens
ggtgtgtatctctgtgtctctgtgtgtgcacgggggtatatgcatgatggtgtgtttctgagtgtctgcatgtccatgtgtcatatgagcccctgtatatgtctctgtgtgtgtgtctctgggat

SEQ ID NO: 27380 - DNA, 112 bp, Homo sapiens
gtgcatgtatgagcatgtgtctgtgcactcatgtgagactgtgcgtgtgtctgtgcatgtgtgtatgtgtgactaggtgtgtgcatgtgattgtgtgtgcttatgcatgtgt

SEQ ID NO: 27381 - DNA, 97 bp, Homo sapiens
gttgctgggtcatatagtaattctatgtttagctttttgaggaatcaccaaattgtttttcacagtggctgtagtattttacatttccactagcaac

SEQ ID NO: 27382 - DNA, 79 bp, Homo sapiens
caggtcactcccagggggtggtcagctttgggaggccacctttgagcctgaactgacaccctctgtgtatgtgtatctg

SEQ ID NO: 27383 - DNA, 92 bp, Homo sapiens
acatacatatatgtatatgtatgtatatacatatgtatatatgcatgtgtatatatatgtgtgtatatgtatatatgtgtgtatatatgtgt

SEQ ID NO: 27384 - DNA, 95 bp, Homo sapiens
gctattattattattattcggcacatgtgaaaccactcaaagaccctccagggctctacagagtaatcagtgtgcatagattgtttgtgaggagc

SEQ ID NO: 27385 - DNA, 97 bp, Homo sapiens
tagcaattagatgcagcctctgattctgtctctctcaatttcctgttaacatatccaaggagattcagaaaagtatgaaaatgaaaactgcatgctg

SEQ ID NO: 27386 - DNA, 95 bp, Homo sapiens; identical to SEQ ID NO: 68

SEQ ID NO: 27387 - DNA, 93 bp, Homo sapiens; identical to SEQ ID NO: 69

SEQ ID NO: 27388 - DNA, 97 bp, Homo sapiens
ccgttatacaaacattcatgatactctcactgtctgtattgccttgttctgggcaaggaagtgcaagaagggagaggtgaatagacagctgactagg

SEQ ID NO: 27389 - DNA, 95 bp, Homo sapiens
ttgcattcttcagcttcctctgatgtacctagggatagatttctatttatatttcatgattgggatttgttgggattctgggatctgagaatcga

SEQ ID NO: 27390 - DNA, 65 bp, Homo sapiens
tggacttcagagatagacccaggattctattctgccttactcccagggtctctctctgtcaccca

SEQ ID NO: 27391 - DNA, 80 bp, Homo sapiens
agagtagcctgtgggtttcttgagggtacgggccgtgttttattcatctcagctcactcagtctctctcacagtgcctct

SEQ ID NO: 27392 - DNA, 104 bp, Homo sapiens
tgggtagggtgtgtgagatttgagagaaacagaaaagttaataatccaaaggttttttttttttttttttttttgagacagtctcactctgtcacccagactgg

SEQ ID NO: 27393 - DNA, 58 bp, Homo sapiens
cagtgagggcaacgacagggatctctggagaatgactctgtgtctgtgtccctttctg

SEQ ID NO: 27394 - DNA, 124 bp, Homo sapiens
gtatacatatatacacatatatgtatatatacacatacatatatacatatgtgtgtatgtatatatatgtgtgttatgtgtacctatatacacatatatgtgtatatatattcacacatatata

SEQ ID NO: 27395 - DNA, 90 bp, Homo sapiens
gctctagcactgaccaagtgtgtaaactgggggacctgttgtactgtctctgtctctcagtttcttcatttaaaaagtgaatatagcagc

SEQ ID NO: 27396 - DNA, 106 bp, Homo sapiens
gaaaacgtactatctttttgatagaaggaaaatatctttttaaaaaactttaaaaagctctttctttttattttaaacttttatcagactgagtgacatgtttctc

SEQ ID NO: 27397 - DNA, 61 bp, Homo sapiens
tggcacacccctgtgatcctagctactcaggaggctgaggtaggaggatcacttgaggcca

SEQ ID NO: 27398 - DNA, 101 bp, Homo sapiens
ggctgtggggaaataggaatgcttttacactgttggtgggaatataaattggttcaaccattacagaagacagtgtggaaattcctcaaggatctagaacc

SEQ ID NO: 27399 - DNA, 129 bp, Homo sapiens
attgagctgaaagtacagggagttctcctatacatggcccctgtacccattcacgcacaatctcactcactcactattgacatcccccaccagaggggtacatttgtcataatagatgaacttacactg

SEQ ID NO: 27400 - DNA, 116 bp, Homo sapiens
gtggtttatccttttcaaatggctattaagttgttaggacataaatatttattttatcttttgtacctaattaataagtagtacttaaaggtatttttttgggcctagggtaccat

SEQ ID NO: 27401 - DNA, 95 bp, Homo sapiens; identical to SEQ ID NO: 68

SEQ ID NO: 27402 - DNA, 93 bp, Homo sapiens; identical to SEQ ID NO: 69

SEQ ID NO: 27403 - DNA, 84 bp, Homo sapiens
gtatatatatatgtgtgtgtatatgtatgtgtatatatatatacacatactcatatatgcacacacatatatacacatatatac

SEQ ID NO: 27404 - DNA, 149 bp, Homo sapiens
atacatatatatatgtctgtgtatatatatatatgaacctactgtgtatattcagaaaattatgtgtgtatatatgtgtgtatatatgtgtatatatgtgtgtgcatatatgagtatgtgtatatatatatacacatacatatacacac

SEQ ID NO: 27405 - DNA, 100 bp, Homo sapiens
caggcatggtggtgcacacctgcagtcccagctactctggaggctgaggtggaaggatggcttgagcccaggatgttgaggctgcagtgaaccctgtttg

SEQ ID NO: 27406 - DNA, 86 bp, Homo sapiens
tgctcctctccatgttgtctttagaagtcattttgttttattgtattttgagacaatgtctcactctgtcaccaagctggagtgca

SEQ ID NO: 27407 - DNA, 58 bp, Homo sapiens
tgagatggagtctcactctgtcacccagggtggagtgcagtggtgagatctcggctca

SEQ ID NO: 27408 - DNA, 103 bp, Homo sapiens
tttgatatttttaaaaatgagatttaatattagcctgtagtatgtgtaaacattttattaatatattttagggttactagtgttttcttttgaaggtgtcaaa

SEQ ID NO: 27409 - DNA, 81 bp, Homo sapiens
tctgatacacttttcttgacttcctttggttttcttgagtttttttaagaatctattttgatttattaagagtgttttgga

SEQ ID NO: 27410 - DNA, 83 bp, Homo sapiens
gggcatgctttttactctgacagtctctgtcttgtaactggtgcatttaaactatttacagttaggaccaggtgtggtggctc

SEQ ID NO: 27411 - DNA, 101 bp, Homo sapiens
aggctgggattacaggtattagccactgtgctcagccttaatcctgtatatttttatatgatctcagggctatgtgttcctcctagtatccaatccaaact

SEQ ID NO: 27412 - DNA, 79 bp, Homo sapiens
ctcttaaggtttctagtagaaccgagcctcacattttaaatttatgtgatggaatgtgattctactatgtgtttgggag

SEQ ID NO: 27413 - DNA, 95 bp, Homo sapiens; identical to SEQ ID NO: 68

SEQ ID NO: 27414 - DNA, 93 bp, Homo sapiens; identical to SEQ ID NO: 69

SEQ ID NO: 27415 - DNA, 95 bp, Homo sapiens
gatcatgccaaggctgctggtgtagagaccacgttttgaatagaaagtttttgttcacgtgtgttaatttcttatctcactgggctttcattgtt

SEQ ID NO: 27416 - DNA, 113 bp, Homo sapiens
gactttggaggtttggctctgccacatcaccagtgtctagagagtgtccacacaatatgtatttagacaatctatgagtgaatctgtctcctaaaaatccaggcttctagttc

SEQ ID NO: 27417 - DNA, 73 bp, Homo sapiens
acctgcccatctcaggcagagacggtctctgcctcccaggcattccagactgttcctggccttggctcctggt

SEQ ID NO: 27418 - DNA, 118 bp, Homo sapiens
aggacagagtataaaagagacatttacatttatagaagaattgtcacatttttacactagagatttactagaattttcaaggatgagtagaatagtctttttctcgctctaccttcct

SEQ ID NO: 27419 - DNA, 87 bp, Homo sapiens
caaagtaggaattaggggacctcgactgactacctctgactctctgtgctatcttgggaaagtgagggaccttgtgtctgtgctttg

SEQ ID NO: 27420 - DNA, 118 bp, Homo sapiens
tttgtcagactctgtgtctattgggatgattatgtgggtttttgctttatttattaatatggattattatatagattaattttcatatgttgaaccaaccttgcagtcctgtgataaa

SEQ ID NO: 27421 - DNA, 56 bp, Homo sapiens
acatatatacatattgtatacatatatacatattgtatgtatacatgtgtatgtgt

SEQ ID NO: 27422 - DNA, 99 bp, Homo sapiens
gcatggtggtacatgtctgtagtcccagctacttggaaggctgaggtaggaggatgcttgagcccaggaagtggaggctacagtgagccaagaccatgc

SEQ ID NO: 27423 - DNA, 120 bp, Homo sapiens
gcttcccaagtagctgggattacaggtgtgagccactgtgccaggccctgattcttttttttattaagacataggctgggcacggtggctcatgcctataattccaaaactttgggaggc

SEQ ID NO: 27424 - DNA, 97 bp, Homo sapiens
gcagtaattttctattagactttcaggattggctggggactgtggtacattgcttctgttctctgtcactctgtttctgtgccagaagacacattgc

SEQ ID NO: 27425 - DNA, 75 bp, Homo sapiens
ggttcgcttggtcccagaatcccctagggattcacagacctgggtgtctgtgtgcctccctctgtgccatttgcc

SEQ ID NO: 27426 - DNA, 90 bp, Homo sapiens
tgagtggcagagctgggattcaaatccagattttttttttttttttttttttttttttttttttgagacagggtctcgctctgtcaccca

SEQ ID NO: 27427 - DNA, 116 bp, Homo sapiens
tccagctttgttctttttgcttaggattgtgttggctatgagggctgttttttggttccatatgaaatttaaagtagttttttctaattctgtgaagaaagtcaatggtagcttga

SEQ ID NO: 27428 - DNA, 68 bp, Homo sapiens
gcatgtgtgtatatatgtatgtgtatatatgtgtgtatatatgtatatatgtatgtatatatgcatgt

SEQ ID NO: 27429 - DNA, 118 bp, Homo sapiens
cagagttgatgaagcatcaactgggataataaatgtgaaaacaccatgaaatgaaaacatctatttaaattcaagaggttgttatttacagtctttaaatgatatttgcccagctctg

SEQ ID NO: 27430 - DNA, 97 bp, Homo sapiens
gagtctggggctattataaataaagctgctgtgaaaatttgtacacaagattttatgcatgtatgtttttatttgtcttcagaaaatagctaggctt

SEQ ID NO: 27431 - DNA, 81 bp, Homo sapiens
gaggaagctgacccagggctatggggaggggagaggtcaggaggacctctcacactctcccaccgtctggggagcttctcc

SEQ ID NO: 27432 - DNA, 71 bp, Homo sapiens
gtgtgggatagcccacagggcctctgagcacttcaccatccattctctagctgtctctgtctgtcccagac

SEQ ID NO: 27433 - DNA, 98 bp, Homo sapiens
gtctgtgcagaggtaaccattgttaatttttaaaggatagcctttcagtcatggatagatacattttgaaaattgcagtgtctgctctgatgcacaac

SEQ ID NO: 27434 - DNA, 80 bp, Homo sapiens
tgccccttcagtccagtgttcactggctgctgttcaatgaaaacatccaagtttctatggcaaaatgggctgaggcaggg

SEQ ID NO: 27435 - DNA, 75 bp, Homo sapiens
tctggcttctaaggagagacaatgcttgcttaaagtttttttgagatagactgtctctctgtcacccaggctgga

SEQ ID NO: 27436 - DNA, 75 bp, Homo sapiens
gtagtaggttgatgggctgaatacatcttggagtccttgggttccaaccactgtgtgtctctgtggcaccactac

SEQ ID NO: 27437 - DNA, 121 bp, Homo sapiens
tatatatatacacatgtatatatacgtacgtacgtatatatacgtgtatatatacgtacgtacgtatatatacgtgtatatatacgtacatgtgtatatgtatacatatatatatatacac

SEQ ID NO: 27438 - DNA, 87 bp, Homo sapiens
ctaggtaagtgggcaactctgacctgcagaaattttttttctttttttttttttgagacggagttttgctcttgttgcccagactag

SEQ ID NO: 27439 - DNA, 122 bp, Homo sapiens
catggtggtgaatcagtctcatgagatctgatggttttttgagatggagtctcactctgtcaccaggctggagtgcagtggtgcgatctcagctcactgcaacctctacctcctggttcaag

SEQ ID NO: 27440 - DNA, 95 bp, Homo sapiens
ggaggttagaaactcttggattcctgagacattttgattctgcaggtctaatggggtcggactctctttctgtctaagctctgatgataatctcc

SEQ ID NO: 27441 - DNA, 71 bp, Homo sapiens
ggattacagacgtgagccactgtgcctggcctgtttctttgcttttgaggcagagtctcactctgtcaccc

SEQ ID NO: 27442 - DNA, 173 bp, Homo sapiens
attccacaccgcttaaaactttctaacatatggtatcatttatttattcattatatttattattttttatctgtctccaaatgtaatgaaagtttaagagggcagggatttgttttttgttttgtttaatgatgtaccccaaatcctttgaacagtcctttttttgagacgga

SEQ ID NO: 27443 - DNA, 79 bp, Homo sapiens
tgggtcactcttggagaggaaggcagttctgagctcacacagtgcctgtcactcactgctgctcagcctagtggattca

SEQ ID NO: 27444 - DNA, 90 bp, Homo sapiens
cacctgcaaaactggggattacaagtggacatgagatttgggtgtggacacaaatccaaacactgtcaggtaaagaccagtgcataggtg

SEQ ID NO: 27445 - DNA, 85 bp, Homo sapiens
aacaacctagctggatgtggtggtgcatgcctgtagtccctactggggaggctgaggtaggaggatctcttgagcctgggaggtt

SEQ ID NO: 27446 - DNA, 85 bp, Homo sapiens
gggtacatagttcatagttttcatcaactttttttttttgttttttttgtgatggatgagagttgcacttctcactgtgttgccc

SEQ ID NO: 27447 - DNA, 99 bp, Homo sapiens
ggcgagggcgggggctgagccatatgtcattgtttatcttggtgtctgacagacctatgaggagtttgatgtctttggccagtcggttcctgcttggct

SEQ ID NO: 27448 - DNA, 95 bp, Homo sapiens; identical to SEQ ID NO: 68

SEQ ID NO: 27449 - DNA, 93 bp, Homo sapiens; identical to SEQ ID NO: 69

SEQ ID NO: 27450 - DNA, 102 bp, Homo sapiens
ttcatgtctttagaaaaggggaaaggctgtggctatacatgtgtttatatttataacaatgtgacttccgaaaagctcaactggcccaccattttgactgag

SEQ ID NO: 27451 - DNA, 95 bp, Homo sapiens; identical to SEQ ID NO: 68

SEQ ID NO: 27452 - DNA, 93 bp, Homo sapiens; identical to SEQ ID NO: 69

SEQ ID NO: 27453 - DNA, 75 bp, Homo sapiens
gtccaggtaattttcaaattttttgtagagacagggtctccctacgcttcccaggctggtcttgaatttctgggc

SEQ ID NO: 27454 - DNA, 93 bp, Homo sapiens; identical to SEQ ID NO: 69

SEQ ID NO: 27455 - DNA, 72 bp, Homo sapiens
gcatatgtgtgacagtgcatgtgtatgtgtttgtgggacaaagtgtgtgcagcactaggtcacgtcctgtgc

SEQ ID NO: 27456 - DNA, 91 bp, Homo sapiens
tttcccttatattttcttctagtatatttatagtttttggtcttacatttaagttttgaaactgttttggtgaatttttatataaggggag

SEQ ID NO: 27457 - DNA, 102 bp, Homo sapiens
tctagtctcctgcaattgatgtccgttaaactgagattttttatttacatatgtaaataaatggctcaggtaatgaaaaaacacagcattgtaatcacaaga

SEQ ID NO: 27458 - DNA, 80 bp, Homo sapiens
acattatggtaagttgtgtaattatttcattatgtatcacaatataatagtagaaataaagtgcacaacaaatgtaatgt

SEQ ID NO: 27459 - DNA, 69 bp, Homo sapiens
gtatatatacatctgatatacgtatgtatatacatatatatatatatatatatctcctttgatatatac

SEQ ID NO: 27460 - DNA, 94 bp, Homo sapiens
gagacatagacataatagtgatataatttcctctttttatttgtttattaatttttgtgagatggggtctcgctatgttgtccaggctggtctc

SEQ ID NO: 27461 - DNA, 87 bp, Homo sapiens
tggtccgagctagttgggaggctgaggtaggaggatcatttaagcctgataatttgcagctgcagtctcactacaaagcaaagatta

SEQ ID NO: 27462 - DNA, 85 bp, Homo sapiens
acatatatatttagctggaaatgtgatttactatgcataagttttatgtatatatgcatatatatattcagctggatgtatatgt

SEQ ID NO: 27463 - DNA, 74 bp, Homo sapiens
tatatctatctatatatacacatgtgtatatatatctatctatatatacacatgtgtatatctatttatatgta

SEQ ID NO: 27464 - DNA, 137 bp, Homo sapiens
gtatatctatttatatatacacatgtatatatctatttatatacacacatgtatatatctatttatatatacacatgtatatatctatctatatatacacatgtatatatctatctatatatacacatgtgtatata

SEQ ID NO: 27465 - DNA, 136 bp, Homo sapiens
tacacatgtgtatatatagatagatatatacatgtgtatatatagatagatatatacatgtgtatatataaatagatatatacatgtgtgtatataaatagatatatacatgtgtatatataaatagatatacaca

SEQ ID NO: 27466 - DNA, 85 bp, Homo sapiens
gggtttgagattctaggtagattagaaaatacgagcaaggaaataaagtgtttgctagtagaaggcaaaggaggcatccagaccc

SEQ ID NO: 27467 - DNA, 118 bp, Homo sapiens
cttctgcatatgtatatatataatatatatacacgtatatacgtatatatataatattatatgtatatatatatacgtatatacgtgtatatatatatatttattttttgagatgaag

SEQ ID NO: 27468 - DNA, 96 bp, Homo sapiens
ccctctacagatttttttttggatgggggaggtggaatattttaaagcaacctttttttttttttcaggaacccgttttaaaaagttacaacaggg

SEQ ID NO: 27469 - DNA, 81 bp, Homo sapiens
agagagttagctgtttcaaattgatccaaaaggagtttatttacttatttattttttatttttgagacggagtctctctct

SEQ ID NO: 27470 - DNA, 75 bp, Homo sapiens
ggcatttctcagcatctctattttggagctgcagctggttgcttctcagaataaacagagctgtgatattatgtt

SEQ ID NO: 27471 - DNA, 58 bp, Homo sapiens; identical to SEQ ID NO: 1215

SEQ ID NO: 27472 - DNA, 92 bp, Homo sapiens
cgttcaaaaccagcaatccatcctgcgttcccatgactcactctctctttggttttaggggtctgcaccatgtgatagggccttgttgaatg

SEQ ID NO: 27473 - DNA, 81 bp, Homo sapiens
gttgtctctctgactagagtgtgtgctctttagggaaaggcatgcttttctcatcttcataccctgtagcagggctgccac

SEQ ID NO: 27474 - DNA, 79 bp, Homo sapiens
accaattaaaagtaaaacaactgtctgtgtctgtctaacccaaggtcagacatggagcattgttttagctctaactggt

SEQ ID NO: 27475 - DNA, 86 bp, Homo sapiens
catttgtggcaaccctacaatgagcaagcctattggtgccatttttctaacagcacgtgctcactttgtgtctctgtcacattttg

SEQ ID NO: 27476 - DNA, 58 bp, Homo sapiens
tgaaattgagtctcgctctgtcacccaagctggagtgcagtggcgcggtctcagctca

SEQ ID NO: 27477 - DNA, 67 bp, Homo sapiens
tgacagttgagtgtcaacagaggggctcagcagggttggtgctgcctccctttccagacagatgtca

SEQ ID NO: 27478 - DNA, 87 bp, Homo sapiens
tttctttctcactgacgaaaccatgaaggataatacatttttgagtgtgtgtgtgtgtgtgtgtgtgtgtgtgtgtgttggaggaga

SEQ ID NO: 27479 - DNA, 94 bp, Homo sapiens
tatatacatacatatacatgtatttatattcagaatatatgtgtgcgtgtgcgtgtgtgtatatatgtgtgtatgtatatatctatctagatat

SEQ ID NO: 27480 - DNA, 58 bp, Homo sapiens; identical to SEQ ID NO: 87

SEQ ID NO: 27481 - DNA, 56 bp, Homo sapiens; identical to SEQ ID NO: 88

SEQ ID NO: 27482 - DNA, 108 bp, Homo sapiens
ctactttctttgtgtgtgttctggtacacttctttaaactttttttttacattaattaaaattttttttagagaagtgtctcactatgttgcccaggctggagtgtag

SEQ ID NO: 27483 - DNA, 100 bp, Homo sapiens
gctatattttgtgaggtgtcattacatggcctgattacacagcagtaagtgaccactgatctctaaataatgcagtaagtcccacctgacctagtatagt

SEQ ID NO: 27484 - DNA, 109 bp, Homo sapiens
aggtaactatgtcattatattttaaatgacttctgtttttgttcatattttaaatgaacaaataatcactttgcaggacatctttgaatgtggatggatattgttactt

SEQ ID NO: 27485 - DNA, 95 bp, Homo sapiens
tcatgtgtgttgtagttttccctatatagatcttgtatatattttttagacttatacagaatttatttcatttgggagagtgctaatgtaaatga

SEQ ID NO: 27486 - DNA, 68 bp, Homo sapiens
gttgttgagacagggtctcactgtcgctcaggctagagtgcagtggcatgatcctggctcactgcagc

SEQ ID NO: 27487 - DNA, 69 bp, Homo sapiens
gctgtctgatagactctcagtcacttacttggctaaacgagtaggtgcacaaagtgagttcaggctggc

SEQ ID NO: 27488 - DNA, 115 bp, Homo sapiens
tctccttgtgtcctctgcctgcagagactctccccactctaagccaccacggttctttccctacactcagcgccttgtgggaggaatgcagggtcggaggaagagaagagtggag

SEQ ID NO: 27489 - DNA, 88 bp, Homo sapiens
gcagaaggtcctgaggcctgccagaaatgacgcccagggcagcagggccacagtcactcactctcaggtctctgtaggttccttttgc

SEQ ID NO: 27490 - DNA, 116 bp, Homo sapiens
gctgggtttggtggcacacacctgtagtcccagctactcgggaggctgaggtgggaggatggtttgagcccgagagattgaggctgcagggagctatgattgaaccactgcactcc

SEQ ID NO: 27491 - DNA, 88 bp, Homo sapiens
gctcagggtatgtgacacacacactcacaggcaacagcaaacgtgtgcacccgtgtgttggagcctgcgtattcactaccctactggc

SEQ ID NO: 27492 - DNA, 109 bp, Homo sapiens
atggataaatagataatatatattactatgttaccatattcctgtattatatatactatgtatatattacataatacatggtacatatagtagattgtcttttatgcat

SEQ ID NO: 27493 - DNA, 132 bp, Homo sapiens
catgtgtgtatgtgtgcatttgtatatgtgtgaacatgtgtatatgcatgtctgtgtgtgtgtgtgcaagtgcatttgtatacgcgtgatatggtttggatatggttcccgcaaatctcatgttgaaatgta

SEQ ID NO: 27494 - DNA, 83 bp, Homo sapiens
ttgtttctatttttatttttttcagagagtcatgagtcttgccatgttgtcctggctggattcgaactcctgggctgaagcga

SEQ ID NO: 27495 - DNA, 112 bp, Homo sapiens
tagtctggctccatagttcattctctctcaacgcctacctgaaatgactgcttttctttttttttctttttttttttttttgagacggagtctggctctgttgcccaggctg

SEQ ID NO: 27496 - DNA, 111 bp, Homo sapiens
gacattggtgatggtgatgatgatggcaatgatgatgatgatgatattcctttttttctttttttttatttttttatccttcagccaactcacatcaatatattctttgtt

SEQ ID NO: 27497 - DNA, 81 bp, Homo sapiens
ggcgtctcgctctgtcgctcaggctggagtgcagtggcgcattctcggcttactgcaagctctgcctcccaggttcacgcc

SEQ ID NO: 27498 - DNA, 118 bp, Homo sapiens
tcctgagtagctgggattgcaggcacccaccaccacacctggctaattttcatatttttagtagaaatggagtttcaccatggtggccaggctggtcttgaactcctgacctcagtga

SEQ ID NO: 27499 - DNA, 95 bp, Homo sapiens; identical to SEQ ID NO: 68

SEQ ID NO: 27500 - DNA, 93 bp, Homo sapiens; identical to SEQ ID NO: 69

SEQ ID NO: 27501 - DNA, 102 bp, Homo sapiens
tgtgtttcagtaatgggaccagcttaatggcctatttctttctttctttcttttttttttttttgagatggtgtctcgctctgtcgcccaggctggagtgca

SEQ ID NO: 27502 - DNA, 114 bp, Homo sapiens
gtgctaaatcaggtaacagaactgagacacaggtgggtctgctgtttttttttttttttttttttttttgagacggagtctcacgctgtgtcccaggctagagtgcagtggtgc

SEQ ID NO: 27503 - DNA, 90 bp, Homo sapiens
taagacaagccattatgttcttaaaatggttgatgagtacacaggattcaccgtggtgttcttttttttgttttttgagatggagtcttg

SEQ ID NO: 27504 - DNA, 113 bp, Homo sapiens
atattttaacacaataaaaattgggagtgtgtgtatgtgtatatatatatgtctgtgtgtacacacacacatatatataattgggagtgtgtgtgtatatacagtatgtgtat

SEQ ID NO: 27505 - DNA, 74 bp, Homo sapiens
tcattcattcattcattcattcattcattattcattgtttattcatgcatgcatgtatgtatgtgagtgagtga

SEQ ID NO: 27506 - DNA, 62 bp, Homo sapiens
gggtttggagtgttggttggttggttggttggtttttgagacaggctctcactctgtcgccc

SEQ ID NO: 27507 - DNA, 101 bp, Homo sapiens
tgaagaggtccttcctgtcccttgtaagttggattcctaggtattttattttctttgaagcaattgtgaatgggagttcactcatgatttggctctctaca

SEQ ID NO: 27508 - DNA, 114 bp, Homo sapiens
gtgagccaccgcgcctggcccaacatttttttttaagtaaactatacaagagttttttgttttgttttttttttaaaaaaaaaaaaacagtgaaggccaggcacagtggctgac

SEQ ID NO: 27509 - DNA, 110 bp, Homo sapiens
ggtctttgggttatgaatctatctggcctatagcaagtactcttatgagataataatgttgtacacataagaataattttcctttagggtggcataaagtaacagagatt

SEQ ID NO: 27510 - DNA, 95 bp, Homo sapiens
cagtacttcattcctttccataactgaataatatatcattatatgtatatactatatttattcatcagttggtggacatgtggattgtttcactg

SEQ ID NO: 27511 - DNA, 58 bp, Homo sapiens; identical to SEQ ID NO: 1673

SEQ ID NO: 27512 - DNA, 118 bp, Homo sapiens
gtgattgcaggttcagccagcacttgagaacttagtccttttccatctctgtcactcacttacagggcaatgtgaatacatttaaccattaggtaaacgctctctgagcctcggtttc

SEQ ID NO: 27513 - DNA, 74 bp, Homo sapiens
gatggggtttcactgtgttagccaggatggttttttttcctttttttttttggaagacagggtctctctctgtc

SEQ ID NO: 27514 - DNA, 114 bp, Homo sapiens
gagccactgtgcctggctgggatttgctttgaaatcattttgtaaggactttttaattttttttttattgagatggagtcttgctctgttgcccaggctggagcgcaatggtgc

SEQ ID NO: 27515 - DNA, 95 bp, Homo sapiens; identical to SEQ ID NO: 68

SEQ ID NO: 27516 - DNA, 93 bp, Homo sapiens; identical to SEQ ID NO: 69

SEQ ID NO: 27517 - DNA, 111 bp, Homo sapiens
agcattgtgaactgaaacagacttaaattggcttaagtgcaaatctttttaattttttcagagggtctcgctctgtcacataggcttcagtgcagtggcacaatcatagct

SEQ ID NO: 27518 - DNA, 114 bp, Homo sapiens
gaacagaggttcaaacactgtctcaggtagttttcaccatttctctctgtggtaattttcttcttgtcatttctaaaaaatgtgaaaactttcttcatagatttgctcatgttc

SEQ ID NO: 27519 - DNA, 58 bp, Homo sapiens
tgagatggagtctcactctgtcacccaggctggagtgcagtggtatgatctcagctca

SEQ ID NO: 27520 - DNA, 79 bp, Homo sapiens
cagagggtgtacacacgtggtacacataatatcctaaggagatattactcacaatatcacagtgggtgtacaccctgtg

SEQ ID NO: 27521 - DNA, 137 bp, Homo sapiens
gtgatattactgataaaattctagggagatgttacttttaatatcacagtgggtgtacacacataatgtacacccactgtgatattacttgtaatacactagggagatattactcctaatatcacagtgggtgtaca

SEQ ID NO: 27522 - DNA, 126 bp, Homo sapiens
cacacatgttgtacacccactgtgatattaggagtaatatctccctagtgtattacaagtaatatcacagtgggtgtacattatgtgtgtacacccactgtgatattaaaagtaacatctccctag

SEQ ID NO: 27523 - DNA, 110 bp, Homo sapiens
gtgatattattcataatatcttagggagatattactcttaatatcacagtgggtgtacactctgtgatattaggagtaatatttccctagaatgtacacctgatatacat

SEQ ID NO: 27524 - DNA, 87 bp, Homo sapiens
gggatgtctggaattcatgcagtggagggaggtgggggctgaggctgttaaggttgtagacttgtgtggaaattgaacttttatccc

SEQ ID NO: 27525 - DNA, 70 bp, Homo sapiens
ctctgtctctgtctggctgagcacgtccaggtcttcctttgcaagctctgccaaaaaccaggctttaggg

SEQ ID NO: 27526 - DNA, 94 bp, Homo sapiens
cgccatggcatgatcttggctcacttcagtctctggctcctgggttcaagtgattctcctgccttagcctcccaagtagctgggattacaggtg

SEQ ID NO: 27527 - DNA, 106 bp, Homo sapiens
agtgggctctggagcagtctctgaaattagccccctaagttgtctggcacctggtcctggggtgattaggggagatggatcgtggctgggagtgtaagagctcagt

SEQ ID NO: 27528 - DNA, 118 bp, Homo sapiens
ttgcattcagcaaactccttgttccaaaaaatagatagtcagactctttttttttttttttttttttttttgaaatacagtctggctctgttgcccaggctggagtgcagtggtgcga

SEQ ID NO: 27529 - DNA, 80 bp, Homo sapiens
ctgtatggtcctatgagtgccgttaaccacagagctgtctctctcactgatggaattaataacttactggccagggacag

SEQ ID NO: 27530 - DNA, 85 bp, Homo sapiens
gggtgggcactatctaatcagctgccagtgtggccaggatataaagcaggcagaaaaacatgaaaaagctagattggcttagcct

SEQ ID NO: 27531 - DNA, 115 bp, Homo sapiens
ggtctgattcacatatttgtctcattttggatttctattatattaaattatatattagaaatctaatatatattatataacatattagaaattcaaaatgagactaataatggcc

SEQ ID NO: 27532 - DNA, 80 bp, Homo sapiens
gatggaagcaagaggcaaagataaataactaagggtccctaccttcaagtgaatctctctcagtgtctctctctttcctc

SEQ ID NO: 27533 - DNA, 95 bp, Homo sapiens; identical to SEQ ID NO: 68

SEQ ID NO: 27534 - DNA, 93 bp, Homo sapiens; identical to SEQ ID NO: 69

SEQ ID NO: 27535 - DNA, 82 bp, Homo sapiens
gctgactcactcagagtctaagtactgagcccttgcaaagtactaccttgggtcctcagtgactctgagcattaggtcggac

SEQ ID NO: 27536 - DNA, 116 bp, Homo sapiens
ccctctgcagaagctcggagactttattttatgacttgattttcagttgattgtgaggacagtgaccggtgacctcatgctattttgaaactcattgtgttgcctggcgctgaggg

SEQ ID NO: 27537 - DNA, 89 bp, Homo sapiens
ggccaacctggagtgaagtgattcataatgtaccattgtattttcaatataattattagtatagcatgaatcagccattctaagcagct

SEQ ID NO: 27538 - DNA, 104 bp, Homo sapiens
ctcatattgcagatggagtctgaaggcagtccgctggaaaattccctcttgcttggggacactagtgtttttgttctattcaggcattcagctgattggatgag

SEQ ID NO: 27539 - DNA, 123 bp, Homo sapiens
atatacatatgcacacatatatacatacatatatgtatttatatataaatatatatatatttatgtattaaatgtgtatgtatgatttaaacatatatgtgtgtatgtatatatttctgtata

SEQ ID NO: 27540 - DNA, 95 bp, Homo sapiens
gagacttccttcatgatgttgcagggagtccgtgaccacattgatgtctgcctctaggtcactgtcactgctacactaacatccaggcctgtttc

SEQ ID NO: 27541 - DNA, 98 bp, Homo sapiens
gactctgaggaaagctcagcagagaaatgaaaagaatttgggtccatgataatctctttgtttttgtttttttttttttttttttttgagacagagtc

SEQ ID NO: 27542 - DNA, 112 bp, Homo sapiens
tccaaagtttgtggtctgagggcattctttgcgtaatttttattcttttaaatttgtgagagtgtgttttatggctcagaatgtggctttccttgatgactgttttttgtga

SEQ ID NO: 27543 - DNA, 109 bp, Homo sapiens
gtgaccaaggtcttaccagctgataagggacagagtttaattttttttttcttttttttttttgagacagggttacactctgtcacccaggctggagtgcagtggtgcc

SEQ ID NO: 27544 - DNA, 86 bp, Homo sapiens
gtgcaattgctggatcatatggtaaaagcatgtttagtttttaaagaaactgccatgtgctttcccagagtggctggccagtttac

SEQ ID NO: 27545 - DNA, 101 bp, Homo sapiens
gacaatgtaccccactacacaccaggaagcaggaagtatagttttggctaagcagtcacttcccctcataacaccatgccctggaaggggaagcgtctgtc

SEQ ID NO: 27546 - DNA, 58 bp, Homo sapiens
ggctcacatctgtaattctagtactttgggaggccgaagtgggaggatctctggagcc

SEQ ID NO: 27547 - DNA, 66 bp, Homo sapiens
tatacacatacatgtatatatgtgtgtatatatgtatatacacatacatgtacgtgtgtgtgtgtg

SEQ ID NO: 27548 - DNA, 90 bp, Homo sapiens
ttgttttttttttgtttttttgtttttgtttgcaagggtggaggttgtatgctgattaccgcaagctaactcctaacaaataaagtgcaa

SEQ ID NO: 27549 - DNA, 92 bp, Homo sapiens
tgcattttctaagtcacagaagcctgtcaggtcacacagccacaaagtaaagagagagacccagacaggagaaaactcgtggaggaaaatca

SEQ ID NO: 27550 - DNA, 101 bp, Homo sapiens
atgtgtatatatacatatatgtatatatgtatatatacatatatgtatatatgtgcatgtgtacacatacatatatgtgtatatgtgtatatgtgtatata

SEQ ID NO: 27551 - DNA, 65 bp, Homo sapiens
tgagaccaagtctcactctgtcacccaagctgcaggctggagtacagtggtgcgatctcggctca

SEQ ID NO: 27552 - DNA, 74 bp, Homo sapiens
ttgttttttttgagatggactctcactctgtcgcccaggctggagtgccgtggctccatcttggttcaccacaa

SEQ ID NO: 27553 - DNA, 58 bp, Homo sapiens; identical to SEQ ID NO: 6359

SEQ ID NO: 27554 - DNA, 62 bp, Homo sapiens
cttgggcgtaaaactgaaggcagggggcatttgtgagtctctcctactctcagttgcccagg

SEQ ID NO: 27555 - DNA, 110 bp, Homo sapiens
cgctaatttgcactgtcagtttcagaaattcaaaaatatatttttttctattcacaattaaaaattaaattttgagtcaggagtttgagaccagcctgggcaacacagcg

SEQ ID NO: 27556 - DNA, 90 bp, Homo sapiens
tctatatatatagatatatatctatctatagatatatatgtatagatatctatctatatatatagatatatatgtatatatctattgata

SEQ ID NO: 27557 - DNA, 94 bp, Homo sapiens
ttcacctgttgaaggtcatatgagtggatttctttctttattttttttattttttttttttgagatggagtctcactctgtcacccaggctgga

SEQ ID NO: 27558 - DNA, 66 bp, Homo sapiens
atcttgaagcagaggcttggccatgctaatggaacttggcagtgggtctgtgtctgtccctcagat

SEQ ID NO: 27559 - DNA, 84 bp, Homo sapiens
ctagacagtgcccaacacataggaggcgctcagttattttttaataaatgagcattttaagtctgatgggttactgattctcag

SEQ ID NO: 27560 - DNA, 59 bp, Homo sapiens
ttgagacaaagtctcactcactctcttgcccaggctagagtgcagtggcaccatctcgg

SEQ ID NO: 27561 - DNA, 83 bp, Homo sapiens
agtgagacacagaggagaaagacttcagactgtggcatcagagccacagcacccagctgaatttgtttctttattaaatcatt

SEQ ID NO: 27562 - DNA, 105 bp, Homo sapiens
gggtaggtttagctcttgagaagagatggagaatgagacatatgttgagagattacagtcagcagtcccttttcttgtttcactttctccatggttataatatcc

SEQ ID NO: 27563 - DNA, 104 bp, Homo sapiens
cgttgagattctgcatttggttttgttgttgttgttgttttagagacagggtctctctttgtctcccaggctggagtgcagtggcacaattgtagctcacaacg

SEQ ID NO: 27564 - DNA, 88 bp, Homo sapiens
gggtgcatcacaccaacatggttgtatacatatgtatacaacatgtgtatacatatgtaactaacctgcatgttgtgcacatgtaccc

SEQ ID NO: 27565 - DNA, 58 bp, Homo sapiens; identical to SEQ ID NO: 884

SEQ ID NO: 27566 - DNA, 56 bp, Homo sapiens; identical to SEQ ID NO: 885

SEQ ID NO: 27567 - DNA, 66 bp, Homo sapiens
gttttgagatggagtctcactctgtcacccaggatggagtgcagtggtgcagtctccactcactgc

SEQ ID NO: 27568 - DNA, 87 bp, Homo sapiens
gacagagtgagactccgtctcaaaaaaacaaagaaaaaatatcaattcttttttttttttttttttgagacggagtctcactctgtc

SEQ ID NO: 27569 - DNA, 69 bp, Homo sapiens
gggcacagtgggtcatgtttgtaatcccagcgcttcgggaggctgaggtaagaggatgacttgagtccc

SEQ ID NO: 27570 - DNA, 58 bp, Homo sapiens
tgagtcagagtctcactccatcacccaggctggagtgcagtggcgtgatctcagctca

SEQ ID NO: 27571 - DNA, 69 bp, Homo sapiens
ttgcgacagtcgcactctgtcacccaggctggagttcagtggtgcaagctcagagtgcagcatttgcaa

SEQ ID NO: 27572 - DNA, 85 bp, Homo sapiens
gtgtcaatcttgatgttggcatctattatcttttctcattcaagttgagattttcttggtgtgtgttaagatgagcgatttttac

SEQ ID NO: 27573 - DNA, 89 bp, Homo sapiens
gctcccaatactgaacactcttttctcttttttctgacacagggtctcactctgtcacccagtctggagtgcagaggtgtgatcagagc

SEQ ID NO: 27574 - DNA, 98 bp, Homo sapiens
gtgttgttggattctagaattgcaaataagccaattaagattttttttttttttttacagaatcttgctctgtttcccaggctggagtgcagtagcac

SEQ ID NO: 27575 - DNA, 58 bp, Homo sapiens; identical to SEQ ID NO: 315

SEQ ID NO: 27576 - DNA, 98 bp, Homo sapiens
ctggcatgagagggtatatcattgtggttttgatttgtatacaaaaaagatttgtatttctctactgatcagtgatgttgagctttttttcatgtttg

SEQ ID NO: 27577 - DNA, 115 bp, Homo sapiens
ccattgttccttccctcccctcagtagtccccagcgtctactgttacttttttttttttctccttttgagacaggttctcactctgggtgtcactcaggctggagcacagtggca

SEQ ID NO: 27578 - DNA, 120 bp, Homo sapiens
gtaagacccccgcatcttccaaatatgtatacatatatatatatatgtatatgcatatgtgtatatatatatgtatatgcatatgtatatgtatatatatccggctgcagtggtgtgtgc

SEQ ID NO: 27579 - DNA, 80 bp, Homo sapiens
gtctctctctgtcactcaggatggagtgcagtggagtgatcacggctcactgcagcctccacctcctagtgagagatgac

SEQ ID NO: 27580 - DNA, 88 bp, Homo sapiens
caggtgtgagccaccacgcccagcccacagcactttgggaggctgaggtaggaggatcgcttgagtacagaaggttgaggctgcagtg

SEQ ID NO: 27581 - DNA, 95 bp, Homo sapiens; identical to SEQ ID NO: 68

SEQ ID NO: 27582 - DNA, 93 bp, Homo sapiens; identical to SEQ ID NO: 69

SEQ ID NO: 27583 - DNA, 120 bp, Homo sapiens
ttgttctttttgtttaggattgtcttggctacatgggctcttttttggttccatatgaaatttaaagtagttttatctaattcagtgaagaaagtcattggtagcttgatgggaatagca

SEQ ID NO: 27584 - DNA, 70 bp, Homo sapiens
ccccttgaggtttgagcagcggggcaccagagaagtgagccactctccctgtggcacaccctgtgagggg

SEQ ID NO: 27585 - DNA, 142 bp, Homo sapiens
ttctgcccacagttgctgtgcagttcctggatttgcattgccctgcagtctaagctggaagatatggaatgaaaagatgtcaggaaattcactgccctctgggttactttcaggatttgattttcttcccaaatatgcctgc

SEQ ID NO: 27586 - DNA, 119 bp, Homo sapiens
tgtcaactagacatagatggaggggtatgtaggtagctgttcacgtaagttggagtttcagagagaagtcagagtggagaaaataaacatgtatgtcttcaacaaagaaatagtttata

SEQ ID NO: 27587 - DNA, 98 bp, Homo sapiens
catattgtatatatcattctatacacaatatttcctgccaatatttttcttttataattgacaaatgtatgttgtatatatttatggtgtgcaatgtg

SEQ ID NO: 27588 - DNA, 105 bp, Homo sapiens
agcagaggttttgctttagtaaggagagggtaaatagatatggctggtagagtgtagactgtgaccagagcagcgattctcttggcttataagaggaaactgctg

SEQ ID NO: 27589 - DNA, 103 bp, Homo sapiens
gtttctatattttttcccttgaggatttgactgtggttttttttgtttttttttttttttagagagaagtctcgctctgttgcccaggctggagtgtggtggc

SEQ ID NO: 27590 - DNA, 108 bp, Homo sapiens
tccggttaagatccattgctggggagctattgcaatccttcagaagtaagaaaacactctgactctctgaattgctggagttctttccctgattacattttatctggg

SEQ ID NO: 27591 - DNA, 113 bp, Homo sapiens
ggatgcagtcttcctagtccatttcgttgaagccctggctcctgttgattatttttttatctgaggtgagacaggaaagctagaagggcttggaatgggtggaatgaccgtcc

SEQ ID NO: 27592 - DNA, 118 bp, Homo sapiens
gctagatcccagcttcaggactgaggctgaagctctcgtttcctctttttttttttttttttttttttttttgagatggagtttcactcttggagactgaggctctcatttcatcagc

SEQ ID NO: 27593 - DNA, 56 bp, Homo sapiens
gaggcagagtctcactctgtcacccaggctggagtgcagtggtgcgattttggctc

SEQ ID NO: 27594 - DNA, 101 bp, Homo sapiens
ttttttaaacaacaaattattcaatagttatgtgtgtgtatatatgtctatatgattatctgtatatacatgggcatgagtgaatgtgtctgtgagagaga

SEQ ID NO: 27595 - DNA, 95 bp, Homo sapiens; identical to SEQ ID NO: 68

SEQ ID NO: 27596 - DNA, 93 bp, Homo sapiens; identical to SEQ ID NO: 69

SEQ ID NO: 27597 - DNA, 76 bp, Homo sapiens
gcatgggcctgcaggaccagtgctaactgaagagtgtgagcagaggccatgccatcagtctgtgcagggtgatgca

SEQ ID NO: 27598 - DNA, 109 bp, Homo sapiens
gaaattgtttgttgttgttgctgcacagaataagagaaaaccacccttcaaaataatgattttttaattttctctcagctcatgaggcatccacttatcaagctttttc

SEQ ID NO: 27599 - DNA, 62 bp, Homo sapiens
ggagtctcactctgtcaccaggctccctgcaatttctacctcctgggttcaagtgagtctcc

SEQ ID NO: 27600 - DNA, 75 bp, Homo sapiens
gctggaaaacagggactcaggcgtggtgaggctccatccgcccctcagcttcactgacagtctgactcccccagc

SEQ ID NO: 27601 - DNA, 116 bp, Homo sapiens
agatgtgatatatatgtgtacatgtgtgtatatatatgtgtgtgtatatatacatatatatgtgtgtgtatatatacatatatatatctttctccccctacacacacatacacaca

SEQ ID NO: 27602 - DNA, 104 bp, Homo sapiens
cattttttacattttgtgtttaggtctcccgtgcattttaagttaatatttttacatggtgcaaggtgtatggattaaggtttgagaacagacagacaggaatg

SEQ ID NO: 27603 - DNA, 70 bp, Homo sapiens
caggtttggtggcatactcctgtagtctcagttactctggaggctgaggtaggaggatcacttgaacctg

SEQ ID NO: 27604 - DNA, 81 bp, Homo sapiens
gaaacagagtctcacactgtgtcgcccaggctgaaatgtagttgggtggtctcggctcactgtaacttctgcttcctgggt

SEQ ID NO: 27605 - DNA, 135 bp, Homo sapiens
aggcatcaagagataaagtaattaataaaggattatgctgtgatctgaaacacaagtacagtatttgtatttctgagctaagactaaagtccagatttctttcatttcggtgcttgttcgtttataccacactgc

SEQ ID NO: 27606 - DNA, 135 bp, Homo sapiens
tgtctctctatatatatctatatctatagatagacatatctatagatagatctatagatagacatatctatagatatatgtatatctatatatagggagagggtttagtgtatctatatatgtatctatagatat

SEQ ID NO: 27607 - DNA, 100 bp, Homo sapiens
atgtatattcatacatacatacatgtacatatgtatatacatacatatatgtatgaatatatatgtacatgtatgtatacatatatatacatacatatat

SEQ ID NO: 27608 - DNA, 127 bp, Homo sapiens
gcaatcccaccactatatatatatatatatatatatatatatatatatatatgtatgtatatatgtgtacatatgcatgtacatatattcatattcatgtacatgtatatatattcatacatatata

SEQ ID NO: 27609 - DNA, 110 bp, Homo sapiens
acattgtatattataaaatatatgtttaactgtcacatgcaagtatatttcagtttttaaaagctcaaggtgcatgctgatagtcactataaataaataaatacatatgt

SEQ ID NO: 27610 - DNA, 76 bp, Homo sapiens
tctgtctctctttctcactgtctgaagctgcctgcctcctccttctcccgcttcgtgctgagaaagtagtggcaga

SEQ ID NO: 27611 - DNA, 74 bp, Homo sapiens
gactctgtgagcggtgtaagttttcagaaaggcagttgtttttcttgacttgaagcttaaagcctcagaatgtc

SEQ ID NO: 27612 - DNA, 114 bp, Homo sapiens
caaccaattttggacaacattcgtcaagaagggatgcagaaatgtcacttggaatgtaatgaagtgaggaagtaatgttttcctggaacatgttgtccatggctacatgggatg

SEQ ID NO: 27613 - DNA, 82 bp, Homo sapiens
gagctaatggcacaggcttccgtgggatcctttggctcaaagtgactgagtgagtcagagtcttatgacgcttaagctgctc

SEQ ID NO: 27614 - DNA, 68 bp, Homo sapiens
gttttttgagacagcatctcgctctgtcactcaggctggagtgcagtggtacgattttgactcattgc

SEQ ID NO: 27615 - DNA, 140 bp, Homo sapiens
tatgtatatatgtatatatacgtgtgtatatatgtatatatgtatatatacgtgtgtatatatatgtatatatgtatatatacgtgtgtatatatacgtgtatatatgtgtatatatacgtgtgtatatgtatatatata

SEQ ID NO: 27616 - DNA, 76 bp, Homo sapiens
tagagtctggctctctccctggctgctaagcggcgctggggccatcagtgaggcggccggtccaggtccaggcctg

SEQ ID NO: 27617 - DNA, 114 bp, Homo sapiens
tttgggttaggtttcaggagctttacctttcagtagtttcaatgctgactgtttttttcttttaaaacaacagtcattaaaacactagaagaaatgcactgttcttaatacaga

SEQ ID NO: 27618 - DNA, 119 bp, Homo sapiens
aaagtcatcaggctaatcatggtcaagactgtggttaaggtctcattcactctctcccactaaccatccagtgagaaaccacaggtctgggccatctactctataacctctgatgcttt

SEQ ID NO: 27619 - DNA, 110 bp, Homo sapiens
tgaaattgtccagatttcctcttgcatcttttctctattcttgtgtatctgttcttctgaacagtttcagtggagaactactttggaagatgttgatgtgatttttttta

SEQ ID NO: 27620 - DNA, 75 bp, Homo sapiens
ccttatcttctaatgacttcagggataatgattttatatatacatataggattgttattgttgtgagagggaagg

SEQ ID NO: 27621 - DNA, 95 bp, Homo sapiens; identical to SEQ ID NO: 68

SEQ ID NO: 27622 - DNA, 93 bp, Homo sapiens; identical to SEQ ID NO: 69

SEQ ID NO: 27623 - DNA, 81 bp, Homo sapiens
gcaggatgggaagttgttctgggtgagtcagtgagtgagtgatggctgaaattgaaggcctaggacattaccatacactgc

SEQ ID NO: 27624 - DNA, 136 bp, Homo sapiens
gtgtgtatgtgtgtgtgtgtgtgtacgtatatatatatgtgtatatatgtgtgtgtatatatatgtatatatgtgtatatacgtatatacatatatacatatacacatacatatatgtgtatatatacatatatgt

SEQ ID NO: 27625 - DNA, 88 bp, Homo sapiens
atatatgtatgtgtatatgtatatatgtatatacgtatatacacatatatacatatatatacacacacatatatacacatatatatat

SEQ ID NO: 27626 - DNA, 62 bp, Homo sapiens
ctctctctctgtgtatgtgtgtgcacacacatgtgtatttgtatgcagctagagtttgagag

SEQ ID NO: 27627 - DNA, 95 bp, Homo sapiens; identical to SEQ ID NO: 68

SEQ ID NO: 27628 - DNA, 93 bp, Homo sapiens; identical to SEQ ID NO: 69

SEQ ID NO: 27629 - DNA, 79 bp, Homo sapiens
tatctgttcctcacctgactgagccgaaatacatttgtttgtttttaatctgagttcatggtgaaaatgggaacactta

SEQ ID NO: 27630 - DNA, 107 bp, Homo sapiens
ttgctttatatatttaagtgctatgatgttgggtgcctacatatttacaattttttttttgagatggagtcttgttctgtcacccaatctggagtgcagtggtgcaa

SEQ ID NO: 27631 - DNA, 60 bp, Homo sapiens
gttgcagtgagccaagatcccaccactgcactccggtctgtgggactctgtctcaaaaac

SEQ ID NO: 27632 - DNA, 95 bp, Homo sapiens
tatgtgtcagtcctaggagaaatatgtgaaattgttgtttttactaaattgagtcaattacgataagagcatttccttatcaaagaggacacatg

SEQ ID NO: 27633 - DNA, 99 bp, Homo sapiens
gtaaactatcttgttagagcagtcttgctacatgcctctcagaagacagtaagctgtctactagtaaactacagggcctgcaaattattggaaggttac

SEQ ID NO: 27634 - DNA, 95 bp, Homo sapiens; identical to SEQ ID NO: 68

SEQ ID NO: 27635 - DNA, 93 bp, Homo sapiens; identical to SEQ ID NO: 69

SEQ ID NO: 27636 - DNA, 118 bp, Homo sapiens
ggcaatccatccacctaggcctcccaaagtgctgagattacagatgtgagtcaccactcccggccccttttccatttgtagtctgttttgtctctgttgtttagtgtaggagaattcc

SEQ ID NO: 27637 - DNA, 93 bp, Homo sapiens
gctcctgacctagtgcttcaagttcacaaactgggcctttgttttgcttctgagacacagacccactctgtgtcccacttctggtgcttaagc

SEQ ID NO: 27638 - DNA, 146 bp, Homo sapiens
gtacatatatggtgtatatatatgtatacatgtatatatgtatgtgtatatatgcatatgtgtatgtatatatgtgtatatatgtatgtgtacatatatgtatgtatatatacacatatatacacacacatacatacacacatata

SEQ ID NO: 27639 - DNA, 90 bp, Homo sapiens
gtaactggaagtaaaccacaaatttatgtatttaattctaaccccaaatggaagctaacacgtacatggtatttgctatgtgctagttac

SEQ ID NO: 27640 - DNA, 118 bp, Homo sapiens
tgtggtgttgatagtgggggaataaagtctagctacatatgtgtgtgtgtatatatatatatacatgtgtgtgtgtgtgaattattaaattatcaaattgtacataaaaaattgcatc

SEQ ID NO: 27641 - DNA, 93 bp, Homo sapiens
cactgtgcctggctgaggtagatagttttttattttcttgcttttataatactaaacaaaataaaactaaaataatatagctatggtggggtg

SEQ ID NO: 27642 - DNA, 88 bp, Homo sapiens
gtagtcccctaccatctaccatgatttatctgtttttttttttttcaggggtcagaacggtgaattaaatggtggtggtggggattat

SEQ ID NO: 27643 - DNA, 81 bp, Homo sapiens
tgtgtatgtgtgtgtgcatgtgtatatgtgtatatatgtgtgtatacgtgtatatgtgtatgaacatatatatacatatat

SEQ ID NO: 27644 - DNA, 80 bp, Homo sapiens
gtttgtttttttaatgagacagagtctcgctctgtcacccacgctggagtgcagtggcgggatctcggctcaccgcaagc

SEQ ID NO: 27645 - DNA, 94 bp, Homo sapiens
gctgggattacaggcgtgagccaccgtgcccacccccttttttttttttttttttttttaatttttgaggcaagatttcactctgtcacccagt

SEQ ID NO: 27646 - DNA, 87 bp, Homo sapiens
caaaactgtggaggaattagagaaggagctctaccaatgagggctctgaagccaagcagagcttttttttttttttttttttttttg

SEQ ID NO: 27647 - DNA, 84 bp, Homo sapiens
ggacagagcagttttgttttatttatttatttttctttccttccttttttttttttttttttgagacagactctggctctgtct

SEQ ID NO: 27648 - DNA, 97 bp, Homo sapiens
actatattgaataggagtggtgagagtgggcatccttgtctcgttccagttctcaagggtaatgcttccagttttgcccattcattatgaaattagt

SEQ ID NO: 27649 - DNA, 131 bp, Homo sapiens
tgtgtgtgtgtgtatatatatatgtgtgaatatatatttatatgtgtgtgcgtacatatatgtatatatgtacacacacacatatatttatgtatatatgtatttgtgtgtgtatgtatgtgtgtgtgtat

SEQ ID NO: 27650 - DNA, 83 bp, Homo sapiens
ccaagaaatgtatcattttatgattgtgtggtatccatggtgtaaagataccgcattttctttatctgatcaaccattgttgg

SEQ ID NO: 27651 - DNA, 56 bp, Homo sapiens
tgagacagtctcgctctgtcacccaggctggagtgcggtggcgcgatctccgctca

SEQ ID NO: 27652 - DNA, 107 bp, Homo sapiens
gatacattttgtctcacttcttggcccttgataatgatgataatgataaaaatgtttattattgatattcttattattggtatccagggatatagataaaagatatc

SEQ ID NO: 27653 - DNA, 116 bp, Homo sapiens
ctgggcatatggtttgaaaattatcaatatagtctgtttaatgggtaacagtactgaaagtgttgtttaatttcttctggcaagactgattattgattttttttgatactgtctgg

SEQ ID NO: 27654 - DNA, 109 bp, Homo sapiens
gcactcttgttataaagaattatttcctgcaactagatcaccaaacattttctttattaatgtaggtgaacactaatgcatgaaatactatcgttagaacagatgtgac

SEQ ID NO: 27655 - DNA, 120 bp, Homo sapiens
cactttgactagttagagtcttttgtgattttatgtgaattttgtgactgtttttctatttctataaaaactgccactggaattttgataaggattgcattgaatctgtagagtgcttag

SEQ ID NO: 27656 - DNA, 70 bp, Homo sapiens
ttgttttgagacagagtctcacactgtcacccaggctggagtgcagtggcacgaccttggctcactgcaa

SEQ ID NO: 27657 - DNA, 114 bp, Homo sapiens
ctatctatctatcaatcatctatctctcatctatctattggttgcatcagcagattcagtagacgctgagcagtgtgggttgaaaagagaggtaggagatccttacctagccag

SEQ ID NO: 27658 - DNA, 59 bp, Homo sapiens
tatacatatgcacacacacacatatatatatagtgtgtgtgtttctgtgtgtgtgtata

SEQ ID NO: 27659 - DNA, 207 bp, Homo sapiens
tatatatatatatatatgtgtgtgtgtgtatatatatgtgtgtatatatatgtatgtatatatgtgtgtatatgtgtatatatgtatatatgtatatatatgcatatatatacatgtatatatatacacatatatacatgtatatatacgtatatatatacgtatatatacgtatatatatacgtatatatatatgtatatatatat

SEQ ID NO: 27660 - DNA, 174 bp, Homo sapiens
atatatacatatatatatacgtatatatatacgtatatatacgtatatatatacgtatatatacatgtatatatgtgtatatatatacatgtatatatatgcatatatatacatatatacatatatacacatatacacacatatatacatacatatatatacacacatatatat

SEQ ID NO: 27661 - DNA, 105 bp, Homo sapiens
acatgtatgcataaacattttcagatggacagaggtactagtttctattggataaatacctaggaattgaattctgggtcatcaggtaggttcatgtttacctgt

SEQ ID NO: 27662 - DNA, 78 bp, Homo sapiens
ggctctgcttctccatgctgaactttggcgagggtaagattgtgtctctgtgtgtgagttctgccccagtccagagct

SEQ ID NO: 27663 - DNA, 117 bp, Homo sapiens
tgtctatgtatatatatatatatatatatatatatatatatatgtatatgtatatatgtatatatatatgcatgcatgcatgcatgtatgtatttatgtatgcatgtatctatgtat

SEQ ID NO: 27664 - DNA, 108 bp, Homo sapiens
ggtatcacagtctgtcttgtgttactataaagaaatgcctgaggctgggtaatttgtaaagaaaagaagtttataggcttcagcagactatacaagaagcattgtgcc

SEQ ID NO: 27665 - DNA, 131 bp, Homo sapiens
ttatatatatgtgtatatatatttgtgtgtgtatatatatgtgtatacatgtgtgtatatatgtgtatatatgtgtgtatatatgtgtatatatgtgtgtgtatatatagtgtatatatacatatgtgtgt

SEQ ID NO: 27666 - DNA, 75 bp, Homo sapiens
aggagggtggaaggctgaggtggtaggatggcttgaggtcaagagttaccagtctgggcaacatagtgacctcct

SEQ ID NO: 27667 - DNA, 93 bp, Homo sapiens
cctctggtaggactgaagactaaggtcagcaatgtgggtggacagcatgcctgtgtgacactctgtgacaaactccagttaaacttctatagg

SEQ ID NO: 27668 - DNA, 62 bp, Homo sapiens
atatgtgtgtgtgtgtatatatatatatatagccatgtgtatatgtgcatgtgtatatgtat

SEQ ID NO: 27669 - DNA, 74 bp, Homo sapiens
gcatgtgtagcaaggtgagacaggagacagagggcagggccttttaggaaaccagtgccatctttcacacaggt

SEQ ID NO: 27670 - DNA, 118 bp, Homo sapiens
cagggcagtcagtttatggttaagcattaaataaatatttattgaaagaataaaagaatgaatggatctttctaagatggtttagataaagtgctttctgaatgccaggacagggcct

SEQ ID NO: 27671 - DNA, 77 bp, Homo sapiens
gtaattagggttaaagtcattgcaaaccatggggttaactaaacttctttgtcagtaatgtttttaattttaactac

SEQ ID NO: 27672 - DNA, 111 bp, Homo sapiens
tcagaaagttacattatatatatatgtgtgtgtatgtataatctatatatatgtataatctatatatagatatacacatacacaaatatggatgtataatttcatctctgg

SEQ ID NO: 27673 - DNA, 70 bp, Homo sapiens
ccagggcttagcttcaactttgctccaaaattggattggacactgggagcagagagaggccagcgagtgg

SEQ ID NO: 27674 - DNA, 105 bp, Homo sapiens
ccatgggcttttttttttgtttcctagagagactgccatttcagtgtgttggaataaagtatatatatttctctcatgccttagtacagaaagggtaggcccagg

SEQ ID NO: 27675 - DNA, 112 bp, Homo sapiens
aagtcttgtattaatatttttcttttataccttcatctgtctctgattctatatttttctaccattaggagaaatagcagggggtaggggagaggaaagaaaaaggcagctt

SEQ ID NO: 27676 - DNA, 95 bp, Homo sapiens; identical to SEQ ID NO: 68

SEQ ID NO: 27677 - DNA, 93 bp, Homo sapiens; identical to SEQ ID NO: 69

SEQ ID NO: 27678 - DNA, 127 bp, Homo sapiens
cacatgtcctctgtgcgtgagtccctgtgtgtgatgtgttctcggtgtgagttcatgggtgtgatggggtgtgctgtgtgagaacgtgtgtgtagtgtccacatgtcctctgtgcgtgagtccctgt

SEQ ID NO: 27679 - DNA, 95 bp, Homo sapiens
actcatgttctgctggttgtttttttgtttttgtttttgttttttttcctcatcagcaatttgagagctgaggactaaggtagagattgtgtagt

SEQ ID NO: 27680 - DNA, 86 bp, Homo sapiens
catttgtttgaaagaattttgcattttatttatttgtttggggttatctgatctccctttataggtaaagcttctttcagacagtg

SEQ ID NO: 27681 - DNA, 65 bp, Homo sapiens
ccagctcctagtgatagagtcagcaaaaaggataaattatcactgcctctctgtctctcggatgg

SEQ ID NO: 27682 - DNA, 71 bp, Homo sapiens
cgtgagccaccgcgcccagtcaagttttattctttttaaaaacagtactgtcaactggggaatggctcatg

SEQ ID NO: 27683 - DNA, 147 bp, Homo sapiens
atatatatattatatatataatatatatgtctgtgtatatatatttgtacatatatgtatgtgtatatatattcatatgtatatttatgcatatataaatatgtgtatgtgtatatatattaatatgtgtaatatatgtatgtgtat

SEQ ID NO: 27684 - DNA, 119 bp, Homo sapiens
ctaaccttgagtataaatgagctaaatgccccaattaaaagacacagagtggttagctggatgaagaaccaagacctgtctaggagcagcagcttatgcctgtaatctcaacactttgg

SEQ ID NO: 27685 - DNA, 110 bp, Homo sapiens
tgcttaggattatcttggctatatgggctctcttttggttccatatgaaatttaaagtagttttttctaattctgtgaagaaagtcaatggtagcttgatgggaatagca

SEQ ID NO: 27686 - DNA, 115 bp, Homo sapiens
cagattattaatattgtcatcaaatgatgttaaatgagaaatacaatgagttgaattcattggttatcttccacttaaagttttatatttgaggacaattcagcctatcaatctg

SEQ ID NO: 27687 - DNA, 80 bp, Homo sapiens
tgtagttataagtgacatatatgcagtatatatgtgtatatataaacacatgtatatataaatgtacatataaatataca

SEQ ID NO: 27688 - DNA, 140 bp, Homo sapiens
tacatatttatatgtgtatgtgtgtgtatatacacaccacatatatacaaaccatatatgtacatatatatgcatatatatacgtgtgtgtgtgtgtatgtatatatatatatatatatatatatatatatatatatata

SEQ ID NO: 27689 - DNA, 107 bp, Homo sapiens
ggagcagactgaatcactggaaatagctcaaaagtcaataagaatatgacaaagttcatgaaggtggatattggctagagttgtaatcacaaccttttattctgccc

SEQ ID NO: 27690 - DNA, 127 bp, Homo sapiens
cacatgtcctctgtgcgtgagtccctgtgtgtgatgtgttctcggtgtgagttcatgggtgtgacggggtgtgctgtgtgagaacgtgtgtgtagtgttcacatgtcctctgtgcgtgagtccctgt

SEQ ID NO: 27691 - DNA, 74 bp, Homo sapiens
ttggcagtgttggctcaaggtcatggtgctggcagggtcgagactggctggctctgtgcctgccaagactccaa

SEQ ID NO: 27692 - DNA, 95 bp, Homo sapiens; identical to SEQ ID NO: 6311

SEQ ID NO: 27693 - DNA, 67 bp, Homo sapiens
tctgtctctgtgtgtgtgtgtatatatatatatttataatatatacatctacacatatagatataga

SEQ ID NO: 27694 - DNA, 120 bp, Homo sapiens
agcagtttgtagttctccttgaagaggtccctcacatcccttgtaagttggattcctaggtattttattttctttgtagcaattgtgaatgggggttcactcatgatttggctctctgtt

SEQ ID NO: 27695 - DNA, 80 bp, Homo sapiens
gtgcactcctacatatatatgtgtatgtatatatatatctatgtgtgtatatatatgtctgagtgtgtgtgtgtgtgtgt

SEQ ID NO: 27696 - DNA, 111 bp, Homo sapiens
aaagtcacccagttgctgctctatgtgtacttcttgtgctactaagttctaaagtaattttctgttaagaacatatagcaaggacgcacacaagagtagagggtagagttt

SEQ ID NO: 27697 - DNA, 106 bp, Homo sapiens
tgctccactttcctgatgaacatcctctttaagaatgcttacatatatcaattaaagatttcatattctttttttaagagccatattatctaatgagagtgtagca

SEQ ID NO: 27698 - DNA, 113 bp, Homo sapiens
tacatatataaaactataagacatctatacataagatctataagatttatatataatatatatataagatgtatagatatatatgaagatatcgctctgtatctgtctatgta

SEQ ID NO: 27699 - DNA, 95 bp, Homo sapiens; identical to SEQ ID NO: 68

SEQ ID NO: 27700 - DNA, 93 bp, Homo sapiens; identical to SEQ ID NO: 69

SEQ ID NO: 27701 - DNA, 95 bp, Homo sapiens; identical to SEQ ID NO: 68

SEQ ID NO: 27702 - DNA, 93 bp, Homo sapiens; identical to SEQ ID NO: 69

SEQ ID NO: 27703 - DNA, 114 bp, Homo sapiens
aaccaatgggttactagcactttgatggcaggaaagttgtattaaatacttattttagtattataacacacaatacaatgtaatgcagagagtagctatgaaaaactatttgtt

SEQ ID NO: 27704 - DNA, 139 bp, Homo sapiens
atatctatcatgtatagatatagatatatatctatcatgtatagatatagatatctatcatgtatatatatatctatcatgtatagatatagatatatatctatcatgtatagatatatatatctatcgtgtatagata

SEQ ID NO: 27705 - DNA, 156 bp, Homo sapiens
cttccaatgtatacatatagatatataggtggatatatatctatatctatacattagaagatatatatctatacatctatacattatagatatatatctatatattatatcttagatatagatatatatctatcatgtatggatatagatatatat

SEQ ID NO: 27706 - DNA, 107 bp, Homo sapiens
gcactagtggaacatagcagctagtgagtgtgagagaatgtgagacagacagaagattctgtcctcaccttccttccctggctacaggctttcttcctgatacaggc

SEQ ID NO: 27707 - DNA, 63 bp, Homo sapiens
tatgcatatataatgtatgtatatatgcatataaatgtgtatgtatttatgtgtgtgtgtgta

SEQ ID NO: 27708 - DNA, 102 bp, Homo sapiens
atagtcactgcatgatttaacctttcttccctatgtacaccgtctgtcagaatctctgtcacacagtctagaggcagagaggaggccagtgagagaaactat

SEQ ID NO: 27709 - DNA, 107 bp, Homo sapiens
gggagtttgatggcaggttgaggctggtcctgaggattgtttgacttgattccttaagaggactcacagactctgtctaaccccaacacaaatactgctacattccc

SEQ ID NO: 27710 - DNA, 92 bp, Homo sapiens
tccagtagtttggagcaggttactttattctgaaatctttttttttttttttttttttggtgatggagtctcactctgtctcccaggctgga

SEQ ID NO: 27711 - DNA, 128 bp, Homo sapiens
agaaatgtccttgcatctatgcctggatggcacaggcatgtatgcatgggcttctctgtgtatgtgcaactcaatgtgttgtcttcatatggtatacaaaaggcaatgtacacgtcagtacatatgca

SEQ ID NO: 27712 - DNA, 82 bp, Homo sapiens
gaaatatagacactgttttctttttatattaaagtgtcagctgctaagttgatactataaagtagtgagggctttccatttc

SEQ ID NO: 27713 - DNA, 95 bp, Homo sapiens; identical to SEQ ID NO: 68

SEQ ID NO: 27714 - DNA, 93 bp, Homo sapiens; identical to SEQ ID NO: 69

SEQ ID NO: 27715 - DNA, 108 bp, Homo sapiens
ccatgcttctaaaggtgcttagagggaaatttttagatataaatgcctacttatttatttatttattttttgagagaagtcttgctctgtcaaccagcttggaatgca

SEQ ID NO: 27716 - DNA, 118 bp, Homo sapiens
taaatacttttcagcattatcctatcaattagggcagatatatatgtataattatattttatatatataaaatatacacatatgtcctaattgatgtgataatgcttaaaagtattta

SEQ ID NO: 27717 - DNA, 78 bp, Homo sapiens
cataagacccatgtttaccttggggtggagacttaatatttttttaatgtcagctttaggggtacaagtggttttttg

SEQ ID NO: 27718 - DNA, 81 bp, Homo sapiens
gtgttatatcactgtctgtcactgatatgtcaattaactcacctggaattaatgactggagtgtcaggcaggaggtgactc

SEQ ID NO: 27719 - DNA, 58 bp, Homo sapiens
tgagacagagtcgcactctgtcacccaggctggagtgcagtggtgcgatcttggctca

SEQ ID NO: 27720 - DNA, 93 bp, Homo sapiens
caggactcaaactccaaactgtttctctatagtaaaaagcagctgatatctctgttcagtttttttagatttagatgcttgaagtttgccctg

SEQ ID NO: 27721 - DNA, 96 bp, Homo sapiens
atatatgttatctatacatatacagatatagtatatatgtatatgtataaatactgtatatgtatatgtatttgtatttacatatgttgcatatat

SEQ ID NO: 27722 - DNA, 174 bp, Homo sapiens
tataatattttatatgttatgtatcatatattaaatatataaatatattgacatgatatatttaatatattaatatattatactttaatatattaatatattatactttaatgtattaatatattaaagtataatatattaatatattaaagtataatatattaagttttaggg

SEQ ID NO: 27723 - DNA, 171 bp, Homo sapiens
gtgaattttgatatatatctataagtacataaatacagttatatatctatgtatctattttgatatgtaactgtagatgtatgtatagctatatatctatatatacataactatttatatcaatatgtatttatatagagatatacatcattagatatatatagttcatag

SEQ ID NO: 27724 - DNA, 91 bp, Homo sapiens
tttcctagtcatctgtatcttttttctttaatatgatattatcctggcttgttgggtagtaggaaagaggaaaagagagagaaaaaggaga

SEQ ID NO: 27725 - DNA, 84 bp, Homo sapiens
ccgcctgtctgtccagctgtctgtctctgtcccaccactttctaggctgtgattgggtccagggattacagcggctctgggtgg

SEQ ID NO: 27726 - DNA, 67 bp, Homo sapiens
aggctctcttcagtgtcagtgacatctcggcatcttgctggtgcccactgacttgtaaggagagctt

SEQ ID NO: 27727 - DNA, 91 bp, Homo sapiens
cacttccctgccccactttcatatcagtgccagctactcaggagactgaggcaggaggatggcttgagcctgggaagtggaggttgcagtg

SEQ ID NO: 27728 - DNA, 71 bp, Homo sapiens
gtgtttgcgtgcatgtgtgtgtgtggtagatttgtagatatatatacacacacacactgtgcatcagtcat

SEQ ID NO: 27729 - DNA, 101 bp, Homo sapiens
ttgatagaagttagtgtaaattaataatatcagtaattgatatcaattttaataattgatattaattgatatcaaataaataataacactaatttttgcaa

SEQ ID NO: 27730 - DNA, 65 bp, Homo sapiens
tgatggatggatgcatgtatgcatgcattatggatggatggatgcatgtatgtatgtatgcatta

SEQ ID NO: 27731 - DNA, 116 bp, Homo sapiens
gagcatggcttttctggagggcaaaggactggaccaaggctcagccttttttttttttttttttttttaacactcccgagctttgtgttttagcttctgctcatctagtgttgctt

SEQ ID NO: 27732 - DNA, 86 bp, Homo sapiens
acttcctagatgcagacactgtcagtctccgtgtctttacttgtaaaatggggatttataatatcatagtttgcttataggtctgt

SEQ ID NO: 27733 - DNA, 79 bp, Homo sapiens
gaagctgcagatgtgcgcctgcatctgcacacatgtgcatacatgtgtgtgcctgtgtctgtgtgtgtctgtgtacttc

SEQ ID NO: 27734 - DNA, 95 bp, Homo sapiens
gtcctaaacctgccagtacttcagaatgtaattatctttgtagatagggtctttaatggggtaattaaattaaagtgaggtcactagggtggggc

SEQ ID NO: 27735 - DNA, 69 bp, Homo sapiens
agctgtgtgtgtctgcttgaaggtggaggggggtgactctctatttgactctcagcttcattcatagct

SEQ ID NO: 27736 - DNA, 101 bp, Homo sapiens
tcagatgcagctggccagcgaggcccctttctgttttctaaaatttattttactttatttttattttttgagatggagtctcgctctgtcactcaggctgg

SEQ ID NO: 27737 - DNA, 115 bp, Homo sapiens
ccaacagctcctgcttatgggttgagaagacggcaggtaccactcttcggacttccccctgagaggaatgatgtgaggcctcttgttaaaacctgctctgagctcttgctgctgg

SEQ ID NO: 27738 - DNA, 103 bp, Homo sapiens
ggttgattccatgtctttgttattgtgactagtgatcctcacttctttttttttttttttttaaagacggagtctcactctgtcgccaggctggagtgcaatt

SEQ ID NO: 27739 - DNA, 85 bp, Homo sapiens
gcatgtgtgtgtgcatgcgtgcatgcacgtgttggggtggggagagagggtatgtgcgtgtgtgcctgcgtgcgtgcacatgtgt

SEQ ID NO: 27740 - DNA, 89 bp, Homo sapiens
cttccattcataggaggtggagggagatgtgtccaacaggatggaatgttcatctatgtgtgtgtctgtgtccccctgatttgtggagg

SEQ ID NO: 27741 - DNA, 76 bp, Homo sapiens
tggcagagaaaggctgagtgggtgggcggagatgagacactcggtctctctcagtcacttggggcccctttcctcc

SEQ ID NO: 27742 - DNA, 90 bp, Homo sapiens
acaagatcatgccattgcactccagagtgagactctctctcaaaaaaaaaaaagtctttttctgcagcacatctcagatggtaattttgt

SEQ ID NO: 27743 - DNA, 56 bp, Homo sapiens
tgtgctgcagaaaaagacttttttttttttgagagagagtctcactctggagtgca

SEQ ID NO: 27744 - DNA, 74 bp, Homo sapiens
gtcaaaaatcagttgtccatatgtagatgtgtttatttctggacactctattctgttccactgatctgtttgtc

SEQ ID NO: 27745 - DNA, 58 bp, Homo sapiens; identical to SEQ ID NO: 1101

SEQ ID NO: 27746 - DNA, 56 bp, Homo sapiens; identical to SEQ ID NO: 1102

SEQ ID NO: 27747 - DNA, 58 bp, Homo sapiens
tgagacagggtctcactctgtgactcaggctggagtgcagtggtgtgatcttggctca

SEQ ID NO: 27748 - DNA, 144 bp, Homo sapiens
tatatatatgtatacatgcatatatatatgtgtatacacgtatatatatgtatttatatgtgcatatatgtaatttttaattaataaaagtagtacatatttttgggatacatgtgatattttgatacatgtatataaagtgta

SEQ ID NO: 27749 - DNA, 103 bp, Homo sapiens
ccagcatagcaagactcttgtctctaaaaacaaaattttttgattaacaaaagaaaaactcagttgaaagtggttgcctttagagaaggagaaatgggggtgg

SEQ ID NO: 27750 - DNA, 115 bp, Homo sapiens
tatgtacacacatatacatatatgtatgcatatgtatgtatatatgtatatatacatatatgtatatacatacctatgtattatgtatatatgcatatgtatatgtgtgtacata

SEQ ID NO: 27751 - DNA, 111 bp, Homo sapiens
tatgtacacacatatacatatgcatatatacataatacataggtatgtatatacatatatgtatatatacatatatacatacatatgcatacatatatgtatatgtgtgta

SEQ ID NO: 27752 - DNA, 78 bp, Homo sapiens
tggattagggctgccttatgacttcaaaagaaacatctgttactttatgattttttaaggtgtaagctctatttttca

SEQ ID NO: 27753 - DNA, 97 bp, Homo sapiens
ggaaggatttgtgtagtggtgagactagccaagtgttctttttttttttttttttttctgaagagatttgatggtgtagcctataacttgtacttct

SEQ ID NO: 27754 - DNA, 58 bp, Homo sapiens
tgagtcagagtctcactctgtcacccaggctggagtgcaatggagtgacctcggctca

SEQ ID NO: 27755 - DNA, 85 bp, Homo sapiens
tggttgaatcagatgaagttccaaggccttgttatatgtgaaatgcagattttttttttatgtcagggtcttgctctgtcaccca

SEQ ID NO: 27756 - DNA, 82 bp, Homo sapiens
gaagagggagtgaacagagtgagcacagggatctttatatatctgttatatcaagcttactaattgtattattcaaatcttc

SEQ ID NO: 27757 - DNA, 101 bp, Homo sapiens
caacagttttagataaaatgggatgtagcagctgtcttgagttttttttttttttttttttttaagattcaaactgatttttatctattttgagactgttg

SEQ ID NO: 27758 - DNA, 121 bp, Homo sapiens
gtttccaggaatttatccatttcctttagattttctagtttgtgtgcaaagagatgttcacagtagtttctgaggatcttttgtatttctgtgggattggctgtgatgttgcctttgtcat

SEQ ID NO: 27759 - DNA, 102 bp, Homo sapiens
agctttttcagagtggcttctttcatttagtaatgtgcctttaagggtcttcttcttcttttttttttttaatggcttgagagcgcctttctgtttatggct

SEQ ID NO: 27760 - DNA, 59 bp, Homo sapiens
ggcaggcgcctgtagtcccagccacttgggaggctgaggtagtagaatggcgtgaaccc

SEQ ID NO: 27761 - DNA, 84 bp, Homo sapiens
tcagctgatagggcaaggaggtatatgtgtgtgtgctgacttcttttttttgagactgagctcacactctgtcgcccaagctgg

SEQ ID NO: 27762 - DNA, 109 bp, Homo sapiens
gctggcattacaggcatgagccaccgcacccagccttgttttctggggttttgttgagatgaggtctcactctgtcacacaggctggagtgtagtggtgcgatcccagc

SEQ ID NO: 27763 - DNA, 82 bp, Homo sapiens
tttggttttggggtttttggggttttgtttttgtttttatttttgttttgagacagagtctcgctctgtcgcccaggctgga

SEQ ID NO: 27764 - DNA, 110 bp, Homo sapiens
gattgttttagctattctgagtccattgcatttctatatgaattttagaatcagtctgttaatttttgcaaagaaggcagctgggattttgatatggattgtattcaatc

SEQ ID NO: 27765 - DNA, 58 bp, Homo sapiens; identical to SEQ ID NO: 26188

SEQ ID NO: 27766 - DNA, 118 bp, Homo sapiens
aagtgatttagagaattcctggtccgacttagagacagaggttctaaagaaaaaataactttattgttttacaatttgtgtcttagtaaaataagggctatttgttttaaagccattt

SEQ ID NO: 27767 - DNA, 62 bp, Homo sapiens
cacttaccgtgaatagagtttgtggggctggaagttgctctgggtgagtctgtgtgtgagtg

SEQ ID NO: 27768 - DNA, 61 bp, Homo sapiens
ggcaggggctgatactgctctcttgtgattgaggacaaatgagcacagtcagcacactgcc

SEQ ID NO: 27769 - DNA, 115 bp, Homo sapiens
ttgtgccactgcactcagcctgggtgacagagtgagatcttgtcttttattttatttttatttttctgagatggagtttcgctcttgttgcccaggttggagtgcaatggtgcga

SEQ ID NO: 27770 - DNA, 103 bp, Homo sapiens
ctctgtcttttccctaggagcagtgtttatttacttatttattttttgagatggaattttgctcattgcccaggctggagtgcagtggcacgatctcggctca

SEQ ID NO: 27771 - DNA, 103 bp, Homo sapiens
cagttttgcacatgtgttagattacagattgatttcaaggttccagagtactgtttctgtacttgtctccttacaaccagagcatctgacaaagggtttgctg

SEQ ID NO: 27772 - DNA, 91 bp, Homo sapiens
gtatgtgtgcacacacatatatacatacatatgtatgtgtgcacacacatatatatacatatatatgtatgtatacacacacacacataca

SEQ ID NO: 27773 - DNA, 82 bp, Homo sapiens
gtgtgtgtatacatacatatatatgtatatatatgtgtgtgcacacatacatatgtatgtatatatgtgtgtgcacacatac

SEQ ID NO: 27774 - DNA, 110 bp, Homo sapiens
atacatatatgtgtatatatgtgtatacatacatatatgtgtatatatgtgtatacatacatatatgtgtatatatgtgtatacatacatatatgtgtatatatgtgtat

SEQ ID NO: 27775 - DNA, 110 bp, Homo sapiens; identical to SEQ ID NO: 27774

SEQ ID NO: 27776 - DNA, 70 bp, Homo sapiens
tacatatatgtgtatatatgtgtatacatacatatgtatatgtgtgtgtacacctatacatgtgtgtgta

SEQ ID NO: 27777 - DNA, 116 bp, Homo sapiens
tcagcaaatgttatttacataaaaagaatagtattagagaaggaattaagtgaaagtaaactaaaaatttttatttttcttattcttaattgatgttacagataattgtttgctga

SEQ ID NO: 27778 - DNA, 135 bp, Homo sapiens
tagtgtcagggggctatgcgtgtaagtataatttgtggtggcaggtagctggttattaagtagatttgattatatatttgctttatagtgtcagggctaagcatgtaagtatgattttgtggtggcaggtagctg

SEQ ID NO: 27779 - DNA, 88 bp, Homo sapiens
ggtacatagacaaatctatatatatatgtgttcacatgcatgcatgcacacacattcatatatccatgatgatgttgtcgcttcctcc

SEQ ID NO: 27780 - DNA, 72 bp, Homo sapiens
ggaacagtctcactctgactatgctcccacctcgccccccaaattggcatagcaccagacagagagggtttc

SEQ ID NO: 27781 - DNA, 211 bp, Homo sapiens
gtattccattgtatatgtgtatgtgtatatatgtatgtgtatatatatatgtgtatatatacgtgtatatatgtgtgtgtatatatgtgtatatatagtgtatatatatgagtatatgtatatatgtgtatatgtgtatatgtatatatgtgtatatatttacacatatatacactatatatgtatatgtgtgtatatatacacatatata

SEQ ID NO: 27782 - DNA, 110 bp, Homo sapiens
gtgtatatgtccagaagtgaacttgctgtgtcatatgatgattatatttctaaatattttgaggaatcaccatactattttccagcagcgactttgttttacattcccac

SEQ ID NO: 27783 - DNA, 102 bp, Homo sapiens
gaatatatgaatatatgttcatatattcatatatatgaatatatgtatatatgttcataaatattcatatatatgaatatatgtatatatgttcataaatat

SEQ ID NO: 27784 - DNA, 90 bp, Homo sapiens
atgagtgtttataaatatatttgtatacacatacactcaattatgagtaatgtgtatgtgtatatataaatatatgtgtgtaatccttat

SEQ ID NO: 27785 - DNA, 73 bp, Homo sapiens
acatatatatatatatacatgtatgtgtgtgtgtactatatatgtacaacatacatttaagtgtgatatatgt

SEQ ID NO: 27786 - DNA, 102 bp, Homo sapiens
ggcatggtggtgtgtgcctgtagtcctagctacttgggaggctgaggtggaaggatggcttcagcccaggaggtggaggttgcagctagcagagatagtgcc

SEQ ID NO: 27787 - DNA, 93 bp, Homo sapiens
gtgggatggttgggtcaaatggtaattgttttaagttctttgagaaatctccaaactgcttttcacagtggctgaactaatttacatccccac

SEQ ID NO: 27788 - DNA, 81 bp, Homo sapiens
gggagggggagattaaatcatttgtttttttgatggaagacagtgacttccattgataagagccagaaatcttcccctttc

SEQ ID NO: 27789 - DNA, 75 bp, Homo sapiens
tatagataagtttggttatctatattatagatgttacattatctatattatagataaatttggttcttatctata

SEQ ID NO: 27790 - DNA, 118 bp, Homo sapiens
gttggggatgtgttggtgataagtacagatgaaacaaaagcaacaacaacaataaaaattctgttttttttgttttgttttttttttttttttttgagttggactctcactctgtaac

SEQ ID NO: 27791 - DNA, 106 bp, Homo sapiens
gcagtctgttttcctcatagcctcatcagcatctgttgttttttattttgtaataagagccgttctgactggtgtgagatggtgtttcattgtggttttgatttgc

SEQ ID NO: 27792 - DNA, 104 bp, Homo sapiens
gctgggccttcgacctagacgcctcatatccttgattaactagaaagttcaagagatctagagtagtctgctgatacgaggcttccgaactggtagccaaaagt

SEQ ID NO: 27793 - DNA, 110 bp, Homo sapiens
gataatgtttttcaaatgttctacatatttggttatttttttctattttttctattaattccagggagagaatgtgggaattaatctctaagtataattgtgaatttgtc

SEQ ID NO: 27794 - DNA, 70 bp, Homo sapiens
ttgttttgagacagagtcgcactctgtcacccaggctggagtgcagtggtgcaaccttggctcactgcaa

SEQ ID NO: 27795 - DNA, 56 bp, Homo sapiens
tgagccagtctcactctgtcactcaggctggagggcagtggggtgatcttggctca

SEQ ID NO: 27796 - DNA, 88 bp, Homo sapiens
gctgggcatggtggtgcaccggaggtcccacctacttggcaggctgaggtgggaggatgacttgagcttgggcacttgaggctacagt

SEQ ID NO: 27797 - DNA, 97 bp, Homo sapiens
gctagttaatctgacggctcaaggatgcgtcaagcacctgggttctttcaatcttttggttatgcatccttggtatttaagcctgtcctaggctagt

SEQ ID NO: 27798 - DNA, 87 bp, Homo sapiens
gatgtttgcagacatttatcaatgtctaggaattgaagagttagtatttattttaatcttcatagtctgtgcttgtttgtattcatc

SEQ ID NO: 27799 - DNA, 106 bp, Homo sapiens
acagctttgcttaacttttaactaggtagtatagtagtgttattgttctaataattatcccattgccttgcaaataactgagagttgggacagataaaatagttgt

SEQ ID NO: 27800 - DNA, 95 bp, Homo sapiens; identical to SEQ ID NO: 68

SEQ ID NO: 27801 - DNA, 93 bp, Homo sapiens; identical to SEQ ID NO: 69

SEQ ID NO: 27802 - DNA, 70 bp, Homo sapiens
tttttttgagatggagtctcactctgtcactcaggctggagtacagcagtgggatctcagctcactgaaa

SEQ ID NO: 27803 - DNA, 120 bp, Homo sapiens
cagagccaaaaatgtttgtgattctatttatagctgtctagtggttgaacagactgggctgagaattcctggggtgaagtatttggtgcctgaagtctggaatgccagttttacacagct

SEQ ID NO: 27804 - DNA, 114 bp, Homo sapiens
tgtgtatcttcctttgtgaagtgtctgtttatgtcatttatctgtttttaaaaatttattttttgccttttatttgagatgaggtagaaggctttcacgtattatggattcaca

SEQ ID NO: 27805 - DNA, 107 bp, Homo sapiens
tgtacttgtaatatgatggagagaatcactcaagataattttttaaaaattttttaatgctttttttttgaaatggagtctcactctgtcacccaggctggagtgca

SEQ ID NO: 27806 - DNA, 78 bp, Homo sapiens
acattcattatatatgtaggtacatatatatgtatatatataatatacatttaaaaacctttatatatatgtgagtgt

SEQ ID NO: 27807 - DNA, 95 bp, Homo sapiens; identical to SEQ ID NO: 68

SEQ ID NO: 27808 - DNA, 93 bp, Homo sapiens; identical to SEQ ID NO: 69

SEQ ID NO: 27809 - DNA, 79 bp, Homo sapiens
gagtacacaatggaaagagaaggactggagtgactttgaagtggagaaacctgacagtcactccctcagccaggtgatc

SEQ ID NO: 27810 - DNA, 81 bp, Homo sapiens
gtctttgagcaaaatggttgagtataaatatgtgaatatttgttattttaacattttattcattcatttttttgcagaggc

SEQ ID NO: 27811 - DNA, 94 bp, Homo sapiens
ggcaccgacgagacagaccaagctgctgcagggaaaactattatttttatttgaatccatactctgaggttgctgcaagtgctgtcagtcagcc

SEQ ID NO: 27812 - DNA, 101 bp, Homo sapiens
gtctgtgagatcacctagggagtgagtgtagacagacaggacgtagaaaggcggatcctgagaatggcagtatttatagatctaggatggggtttgcaaac

SEQ ID NO: 27813 - DNA, 77 bp, Homo sapiens
agaaaaagagaagggatattttatacgtatgtataaaatatgtgtatatatgtatgtatatgttctgacctccttct

SEQ ID NO: 27814 - DNA, 92 bp, Homo sapiens
agtagattatttagatttgattttttttctgtttttagctttgattacttttaagttgtatagaaatgtaatcatactggatgtattctcct

SEQ ID NO: 27815 - DNA, 110 bp, Homo sapiens
gccagatatgacctggggcctgtacgttatggcaggtttaaggtagaaaaggaaacgtgacattttttgaaatagcttgccacttgcattaaattagatatatttctggc

SEQ ID NO: 27816 - DNA, 103 bp, Homo sapiens
tgccaaataatagctttatattatttacatgaatattttaaatttttaatctcttcttcttagggtttatgaaatacatgtgtatgtgtatatatttgtggca

SEQ ID NO: 27817 - DNA, 84 bp, Homo sapiens
gatgaggaggttgcttcttatagatgagcaaagaaagtggtttctttttttttttttttttttgagatggagtctcactctgtc

SEQ ID NO: 27818 - DNA, 88 bp, Homo sapiens
gcccttcatttgacagatgagacactggtgacttggcatacatggagggagggtgtgacacttgtgttctccctgtctgctccagggc

SEQ ID NO: 27819 - DNA, 69 bp, Homo sapiens
gggtctggctctgtcactcaggctggagtatagtcgtgtgttctcagctcattgcaacgtctgcctccc

SEQ ID NO: 27820 - DNA, 103 bp, Homo sapiens
tctggtcctggagggtgcgcttgtgaacatggcctttatttttcattttattttattttattttatttttgagacatggtctcactctgtcacccaggctaga

SEQ ID NO: 27821 - DNA, 68 bp, Homo sapiens
gtctgacctgagggaagaagggcagagtgaactcaatgagtcactgactctgtactttctccctggac

SEQ ID NO: 27822 - DNA, 96 bp, Homo sapiens
gtgtgggtgtagacagatgtgggtagtgtgtggtgtgatgagctgtgtacgtgtgccctcctgtgcgtctgtctgtgtgtgcatagcacatctgcc

SEQ ID NO: 27823 - DNA, 94 bp, Homo sapiens
gtgtgtgtatgtgtgtctgcgtgtgtgcgtgtgtgtatgtgtctgtgtgtgcatatatgtgtgtgtgcacatgcacgcttggggtcagccacgc

SEQ ID NO: 27824 - DNA, 119 bp, Homo sapiens
ctggctgtgtatctcagcccaggtgaattcgagacgttacataaaggccttcttactctttttcatgttgtcagattcagacggagctgtagaattttttttgaaatgcattttatcag

SEQ ID NO: 27825 - DNA, 111 bp, Homo sapiens
gctgggcatgatggcacatgcctgtagttccagctgcttgggaggctgaggttggaggatcacttgagcccaggaggttgaggctgcagtgagccaagatcatgccactgc

SEQ ID NO: 27826 - DNA, 109 bp, Homo sapiens
gtgaggtgagaagtctttagaggattttgagcaaaagagtaacatgatctgagttatgttttattttttgttattattaattttttgagacggagtcttgctctgtcac

SEQ ID NO: 27827 - DNA, 85 bp, Homo sapiens
tcatcacacaggaggtcactgtctctctccgtgagtgccagcatatcctcagctctagagcaactatgatgtcctgtgtttttga

SEQ ID NO: 27828 - DNA, 95 bp, Homo sapiens; identical to SEQ ID NO: 68

SEQ ID NO: 27829 - DNA, 93 bp, Homo sapiens; identical to SEQ ID NO: 69

SEQ ID NO: 27830 - DNA, 76 bp, Homo sapiens
gctgagagatcttgagggacttgtcctaaggtctaaataaaagccaggccaaattcaatctctctttctctctggc

SEQ ID NO: 27831 - DNA, 74 bp, Homo sapiens
tgttttcttgtcgttctctcactctcagaaacacgtaagaatctagatctggtttgggaactgccaggaaaaca

SEQ ID NO: 27832 - DNA, 70 bp, Homo sapiens
ttgttttgagatgagttcttactctgtcacccaggctggagtgtcgtggtacagtctcagctcactgcaa

SEQ ID NO: 27833 - DNA, 84 bp, Homo sapiens
attgtgctccatacatatgtaaaattatgtatcaatttttaagaaattgacaaacagtaattttacgtatttatagtgtacagt

SEQ ID NO: 27834 - DNA, 109 bp, Homo sapiens
gggcatggacttttctttgtaggaatgttccaaaccatacatttaatgtctttcatttatatggggctatatctatttcttcctaagtgagctttgatagtttgtgtct

SEQ ID NO: 27835 - DNA, 86 bp, Homo sapiens
aaagttttgattgctggtgggctaacaaggagacaggagtccagctcacatctgtctccctgtgctggctttaaggcaggaatttt

SEQ ID NO: 27836 - DNA, 116 bp, Homo sapiens
tcagtaatagtatatctctgtggattcactttggtttggtagctgaaaagtttattatttttatgcttggccaaagaatatgcatcttcagtggggagcatgccatgtgtgactga

SEQ ID NO: 27837 - DNA, 58 bp, Homo sapiens; identical to SEQ ID NO: 454

SEQ ID NO: 27838 - DNA, 113 bp, Homo sapiens
ggcctcctctctaccagaagccctgaggtcataggaggggagatttgctggaattccctctcactcactcagttgcatttcttttcttggccaaagggtttcttcccatggct

SEQ ID NO: 27839 - DNA, 94 bp, Homo sapiens
aggcttacaactacatgtatgcattatcttatttaatccttggaacacttaattccgatgatgaggaagaaggtagcattgttcccagaagcct

SEQ ID NO: 27840 - DNA, 118 bp, Homo sapiens
cttcacagagagagttgttttaggaatcgctttatgtatgtgtatatgttattatatatcgtatagattattacatatatcatatatgctacacctacgttgtatgtctatgtagaag

SEQ ID NO: 27841 - DNA, 118 bp, Homo sapiens
aggtttccaatgctaaaagcaccctagggccaatctagaattactgattttttttttttttttttttgagatgaagttttgttcttgtcacccaggctgcagtgcgatggcacgatct

SEQ ID NO: 27842 - DNA, 125 bp, Homo sapiens
ggagttttggaatggtaagtgaacattggcttcaactaaagttaccagctgcattagcctctgagaagagagtcagcctgtcctttgaagctttgaagccaggcattgccttctctctggctatg

SEQ ID NO: 27843 - DNA, 58 bp, Homo sapiens; identical to SEQ ID NO: 1265

SEQ ID NO: 27844 - DNA, 112 bp, Homo sapiens
tggggagtaataacatgagcggcctgcgtggttctgtgagtctgtgagtccctccccccgtgcccaacctcagccagtctctaaggttctgggtctagttcatggctccaca

SEQ ID NO: 27845 - DNA, 81 bp, Homo sapiens
tcagggtctcactctgtcacccaggctggggtgcagtggtaaaatcacagctcactgcagccttgacctcttgggctctgg

SEQ ID NO: 27846 - DNA, 162 bp, Homo sapiens
tgaacaaacttcaagtcttatctgtgctcctaaggctatgaatcttgactctctttctgtgatttataaagtgtcaggataactgctttgggggaaaagctagacttcatccagtcatcagttggaagcctgggtggctgcagactcagtgactcacagaag

SEQ ID NO: 27847 - DNA, 80 bp, Homo sapiens
gggacagagtgagatttcatctcaaaaaataaagtctgggatttttttttttttaagagacagggtctcactctgtcacc

SEQ ID NO: 27848 - DNA, 114 bp, Homo sapiens
gagcagtaagtactttctcacatagttccagtgagtcaatgttaacaatatatttatagtttatagggttttgattactgtctggaagtacaaaggaggaagacaaactagttt

SEQ ID NO: 27849 - DNA, 119 bp, Homo sapiens
gcatgaggttctctgtgggacattaggcagaggtcttgaatttgaatgattgtattttattttttattctttctttatttttttgagacagactctccctgtcgcctgggctgcagtgc

SEQ ID NO: 27850 - DNA, 58 bp, Homo sapiens; identical to SEQ ID NO: 5218

SEQ ID NO: 27851 - DNA, 57 bp, Homo sapiens
acagcatagaaatgtgattttgttcagcagaacagcagtggtccgtttctaagttgt

SEQ ID NO: 27852 - DNA, 120 bp, Homo sapiens
ccaggcatggtggtgcttgcttgtagcccctgttactcaggtggctgaggtaggaggatcacttgagcctgggagttcaagtctgcagtgatgggagttcaagtcagccatgatcatgcc

SEQ ID NO: 27853 - DNA, 58 bp, Homo sapiens
tgagacggagtctcgctctgtcacccacgccggagtgcagtggtgcgatctcagctca

SEQ ID NO: 27854 - DNA, 69 bp, Homo sapiens
gctgagcatcgtggcctgcacctgtggttccagctacttgggaggctgaggtaggaggatcacttgagc

SEQ ID NO: 27855 - DNA, 93 bp, Homo sapiens
gtgtgagattgtatatgccatatgataccagttttacatgaatatacataaatgtgtttataaaaatgtgtatgtaggtccacaatttcagat

SEQ ID NO: 27856 - DNA, 58 bp, Homo sapiens; identical to SEQ ID NO: 637

SEQ ID NO: 27857 - DNA, 73 bp, Homo sapiens
gggtctcactgtcactcaggctggagtgttgtggcacgatcacagctcactgcagccttggtctcctggactc

SEQ ID NO: 27858 - DNA, 109 bp, Homo sapiens
actcctcgagaagagcaactccaagacacataattgtgagattcaccaattgttatgtgtgtatttgatcctgtgattatgatgttagctggttattttcctcgttagt

SEQ ID NO: 27859 - DNA, 97 bp, Homo sapiens
ttggatctatacccagtagtgggattgttggatcatgtggtagttctattttaatttttaggaaccttcatattgtttcccacaatggctgtactaa

SEQ ID NO: 27860 - DNA, 118 bp, Homo sapiens
tgctactgatttttgtatgttgatttgtatcctgcaactttactgaatttgttgatcagttctaatagttttctggtggagtctaggtttttccaaatataagatcacgttatctgca

SEQ ID NO: 27861 - DNA, 112 bp, Homo sapiens; identical to SEQ ID NO: 3567

SEQ ID NO: 27862 - DNA, 101 bp, Homo sapiens
gatagagttgattctatttaaattatttttaaatgttgaattattaggtttttgtttttgatattttaagatattcttttgaggtagagttgcactctctc

SEQ ID NO: 27863 - DNA, 68 bp, Homo sapiens
atatatgtgtatatgtttatgtgtatgcatatatatgtatgtgtatatatacacatatatattaatat

SEQ ID NO: 27864 - DNA, 88 bp, Homo sapiens
tttttccttaagattttatggtttagatattctcttcattagttgttgctcatcagtggattctaaagaagaaaccagatgggagaaa

SEQ ID NO: 27865 - DNA, 100 bp, Homo sapiens
gctatctgtgaaactgctttttgatgtgtggattcatctcacagagttaaactttttttttgattcagcaggttgaaaagactctttttatagaaactgc

SEQ ID NO: 27866 - DNA, 108 bp, Homo sapiens
tggattataaagtatcatttgccttctgggtgtggagtgtagttctgaaagtgcttcttcttttgagaatggaaagctgccatggaaataaaatgtaaatcatttcca

SEQ ID NO: 27867 - DNA, 82 bp, Homo sapiens
tgtggatatatatgtatatgtacatatatatgtatatgtagatacatatgtatatgtacatatatgtatatatatatgcaca

SEQ ID NO: 27868 - DNA, 117 bp, Homo sapiens
gcagtgaagtgaggggataggatctgttttggaaatacttagcgtattgaggggaatgtactcagcaatgaggcagtggctacagaaagaccgtctagggggcctctggaacaaggc

SEQ ID NO: 27869 - DNA, 100 bp, Homo sapiens
gaaagtttcctatcattagtagtttgctgagggttttattatgaataagtatgtaattttttcatatgattttggcatcaattaaaatggtagtattttt

SEQ ID NO: 27870 - DNA, 177 bp, Homo sapiens
tgtatagttttatgtgtgtgtatatactgatactgtgtgtatatatacatatacatatatatgtatatgtgtatatatgtgtatatgtgtatatatatgtatatatatgtgtatatatatgtgtatatatatgtgtgtatatatacacacacacatacatagaagtatatatatatg

SEQ ID NO: 27871 - DNA, 61 bp, Homo sapiens
cacacacacacacacacacatcaatatagatagattaggggtttgtgtgtgtgtgtgtgtg

SEQ ID NO: 27872 - DNA, 90 bp, Homo sapiens
agtgagataatttggatgtgtttatgtgtgactatatatatatatatatatatatatatatatatatatatgaagatacttattgctcct

SEQ ID NO: 27873 - DNA, 116 bp, Homo sapiens
ttgagaattccagggagggcccgtataagaaacaataggaactagaattaggcatgatgtgagatcatcctgatttgcacgttatcggggggtttgcaggctgcaggacttttcag

SEQ ID NO: 27874 - DNA, 109 bp, Homo sapiens
gtgtgtatatatgtatatatgtatgtatatgtgtgtgtgtatatatatgtgtgtatatatgtgtgtgtatatatacgtgtgtgtgtgtatatatatatatatatggaga

SEQ ID NO: 27875 - DNA, 66 bp, Homo sapiens
tattttatgtaattgtgtgtatatatatgtgtgtatatatatatatacacacacacacaccaagta

SEQ ID NO: 27876 - DNA, 63 bp, Homo sapiens
gtggaactcaaggcagttcattctgattgatcagtcgatctgtctgtctgtctgtctgtctac

SEQ ID NO: 27877 - DNA, 91 bp, Homo sapiens
cagatacttgtgtgagtgcccagggattacttttttttttttttttttttttttttttttgagacggagtcttgctctctcacacaggctg

SEQ ID NO: 27878 - DNA, 113 bp, Homo sapiens
ttggctgtagtcatcctgttgtgctgtcaagtaccagatcttatgctaactatatttttgtatgttgatgttgatggatacttaggttgcttccaaatcttggctgttgtgaa

SEQ ID NO: 27879 - DNA, 101 bp, Homo sapiens
actgatgataatgtttggaaatggtatgtagtaatatataacaaaatataaaatgtatatatattatctttatatcatctattctatttgtatgtctctgt

SEQ ID NO: 27880 - DNA, 104 bp, Homo sapiens
tctgtgaaactgctttgtgatgtgtggtttcagctcacagaattaaaactttttttttattattcagctagttgaagcaatcattttgtagatttatttcagag

SEQ ID NO: 27881 - DNA, 137 bp, Homo sapiens
gttccagaagcctcaaggactgtcctgggcggactataaagccttaggctttggagcagtgtccctgtgtctctcgcaaaaggcccccataagtgaaaacagggcggcagggtggtgtgggcaggcagcagggtggc

SEQ ID NO: 27882 - DNA, 66 bp, Homo sapiens
cattgggaggctgaggtgggcagatcatgaggtcagaagactgagaccaccctggctaacatggtg

SEQ ID NO: 27883 - DNA, 110 bp, Homo sapiens
tgaagtggtttaagcacgtttctggaatcaagattgaatgcagacttggattggatattgaatattttttatttgtctgcttttctctccatagagagcttatagcttca

SEQ ID NO: 27884 - DNA, 117 bp, Homo sapiens
gagactactccatcccaccttttgcatctccttgaaatgtcttctttcacacactctccctgaaagaggagggcaagggagccaggacagaaagtgaggtggagaacagtagagctc

SEQ ID NO: 27885 - DNA, 95 bp, Homo sapiens
gggattgctgggtcaaatggtagttctgttgttagctctttgaggattttccaaactgcttttcacagtggctgaactaatttaccttcccacca

SEQ ID NO: 27886 - DNA, 61 bp, Homo sapiens
gccatctgtgacagcttcttgatctgtccccaggttggtggctgtgttcaacgggtgttgc

SEQ ID NO: 27887 - DNA, 61 bp, Homo sapiens
gggacggaggaggttagggaggcatctgggccccagggccctctctggctgtctcagtccc

SEQ ID NO: 27888 - DNA, 121 bp, Homo sapiens
tgttatgatgatatacacatgtattttaaatatattatatgttatgatatacacatatattttataatatatttaaaatacgtgtgtatatgataacatatatttttatacacatatgcat

SEQ ID NO: 27889 - DNA, 95 bp, Homo sapiens; identical to SEQ ID NO: 580

SEQ ID NO: 27890 - DNA, 93 bp, Homo sapiens; identical to SEQ ID NO: 69

SEQ ID NO: 27891 - DNA, 147 bp, Homo sapiens
ggcaggaaccagagtcaagaaagagggattaaccatgtagaaaagaaacacttccttttttttttttttgagatggagtcccactctgtctcccaggctggagtgcagtggtgcaaactcagctcactgcaatctccactttctggg

SEQ ID NO: 27892 - DNA, 87 bp, Homo sapiens
ttcatagagatatttgggaacaacattagctgttcactacacattcaaaaataatctgacagagaacagtgtgtgttcatctatgag

SEQ ID NO: 27893 - DNA, 106 bp, Homo sapiens
ttgcacattgattttgtatcctgaaacattactgaagtcatttataaagtctagaagtttcttgtacgagtctttagggtttaccaggtataagatcaataagcaa

SEQ ID NO: 27894 - DNA, 118 bp, Homo sapiens
agagaatgctataaaattatcttgctacaaatactgttggctttctgtctctctccctcatttggagacaaagaacgggtattgtcattaaaggcattaaaaagtggctcaaatctct

SEQ ID NO: 27895 - DNA, 83 bp, Homo sapiens
ccagcctgggcaacatagtgagaccctatgtccacaatttttttttttttttgagacggagtctcactctgtccccagtctgg

SEQ ID NO: 27896 - DNA, 70 bp, Homo sapiens
ttctctgggacaaatgcctaaaggtgcagttgctgggctatatggtaattgcatgtttagtctttaagaa

SEQ ID NO: 27897 - DNA, 90 bp, Homo sapiens
cactgtagattttgtatcctgcaactttactgaatttgtttatcagacttaatggttttttggtgaagttgttagcattttctatatgtg

SEQ ID NO: 27898 - DNA, 88 bp, Homo sapiens
tacatgtatagggcacttaccatgaatggagcttgtagaactgaaaggtgctctgggtgagtcagtgagtgagtgttgagtgaatgtg

SEQ ID NO: 27899 - DNA, 95 bp, Homo sapiens; identical to SEQ ID NO: 68

SEQ ID NO: 27900 - DNA, 93 bp, Homo sapiens; identical to SEQ ID NO: 69

SEQ ID NO: 27901 - DNA, 114 bp, Homo sapiens
ggtctatgatctattttgagttactttttggtgtaagatctgtgtctagattcattcttttttatgtagatgttcaggtgttccagcacaatttcttgaaaagattatttttcc

SEQ ID NO: 27902 - DNA, 107 bp, Homo sapiens
atatccttcgcccatttgttgatggggttgtttgtttttttcttgtaaatttgtttgagttcattgtagattctggatattagccctttgtcagatgagtaggttgt

SEQ ID NO: 27903 - DNA, 82 bp, Homo sapiens
ttccaaatgctctcagtgaatgaaccggcgggtctggttctctaaacttgtttactgaacagagtgtgcaggggactcgctg

SEQ ID NO: 27904 - DNA, 95 bp, Homo sapiens
tatggcggctgggcatgcaattgacacaccttcactgactgtctatgtgcagacaccctacaaggaacagttgtaatgatgatgaagccatcata

SEQ ID NO: 27905 - DNA, 65 bp, Homo sapiens
ttttgagacagtctctctctgtcgcccaggctggagtgcattggcagagatcagtggttttaaga

SEQ ID NO: 27906 - DNA, 73 bp, Homo sapiens
agcctgggtgacagagtgagccccccactttttttttttttttgagagggagtctcactctgtcagccaggct

SEQ ID NO: 27907 - DNA, 155 bp, Homo sapiens
ggatttcatatgcattcataaattataagacctaatttggtatgtatgtatgtatgtgcaccaactacatacatacatttattttattttatttttttgagatggagtctcactctgtcacccaggctggagtgcagtagcatgatttcagctca

SEQ ID NO: 27908 - DNA, 116 bp, Homo sapiens
atatatagtattatattaaataatattatatatactaaatatataataattatatagtatatgattatatggtaatatttagtgtataattacatatttagtatagatttgtatat

SEQ ID NO: 27909 - DNA, 82 bp, Homo sapiens
tgttgccgtgctcctgcagctgctcctgcttcctcagggaaggcttatatcagtgggatgtttgctgccagtgacctcaata

SEQ ID NO: 27910 - DNA, 110 bp, Homo sapiens
atgcaatctgcaattacagtattagtatttagttggtataatatgtatagtcatatatatatatatatatacaatttgtaactaactgtaactaactatatgcgtacaga

SEQ ID NO: 27911 - DNA, 85 bp, Homo sapiens
cctcggcctcccaaagtgttggattacaggcgtgagccactgtgcctggctcactgccaaggtgggcggatcacttgaggtcagg

SEQ ID NO: 27912 - DNA, 114 bp, Homo sapiens
cacaaccagagcatcaactagaattcacagtacttcatcaggttgtttttattcatttatattttagtttctgaccatatcctgcatgaaacatggttctctgatgtttgtgtg

SEQ ID NO: 27913 - DNA, 74 bp, Homo sapiens
ttggtatagagtataatgattcttgactcaaaaaaatatatattttttgagacagagtctcactctgtcactga

SEQ ID NO: 27914 - DNA, 58 bp, Homo sapiens; identical to SEQ ID NO: 637

SEQ ID NO: 27915 - DNA, 84 bp, Homo sapiens
ctatacaggctcttttttggctccatatgaaatttaaagtagttttttctatttctgtgacaaaagtcaatggtagcttgatgg

SEQ ID NO: 27916 - DNA, 58 bp, Homo sapiens; identical to SEQ ID NO: 454

SEQ ID NO: 27917 - DNA, 58 bp, Homo sapiens
caccatctgttacagcttcttgatctgtccccaggtgggtggctgtgttctatgggtg

SEQ ID NO: 27918 - DNA, 83 bp, Homo sapiens
gcatagtacagtatagtaagtgtagtatagtacaatgtagtccagcatagtacagtgtggtacagtacagtacagtacagtgc

SEQ ID NO: 27919 - DNA, 79 bp, Homo sapiens
gctagctgcagaacagcctccagagcctgcctggacacagtctagaaggaaaagttccctctgtccctgactgcctggc

SEQ ID NO: 27920 - DNA, 107 bp, Homo sapiens
aggtgatggctggaccgtgttctttacagttaagtcagatgacactgagcccattttgtcccacttgggggtatttctgtgagctgttttgaacaaaaacatggcct

SEQ ID NO: 27921 - DNA, 83 bp, Homo sapiens
gtgccagggggtggggggcctgaggtgtggcagctatgacagagtgtttgcaggtgccagggtgcctgtctccctgcaggcat

SEQ ID NO: 27922 - DNA, 58 bp, Homo sapiens
ggcacaggctgatgcactgaaggtgctctcatgcttcctctctgtgcctctctgtgcc

SEQ ID NO: 27923 - DNA, 69 bp, Homo sapiens
gctcatttggagaaggcactgagactgaaccccaggtagacagtcagtctttgtctcattccacactgc

SEQ ID NO: 27924 - DNA, 117 bp, Homo sapiens
cctccagctttgttcttttggcttaggattgtcttggctatattcttttttggttccatatgaaatttaaagtagttttttctaattctgtgaagaaagtcaatggtagcttgatgg

SEQ ID NO: 27925 - DNA, 84 bp, Homo sapiens
tctgatagtgacagacagaaactccgggtcagagaaagcccaggtcagctgcggtgggtgtcactctttctctgtatggtcaga

SEQ ID NO: 27926 - DNA, 85 bp, Homo sapiens
agtttagagcacagagtgaacattcatgtatgcaattcttttttttttctttttttgagacagagtttcactctttgcccaggct

SEQ ID NO: 27927 - DNA, 81 bp, Homo sapiens
gttcttttatattaatagatgtttcttgacgtcaagacatgtttcttgacattaagacgtgtttcttgatgttttttgaat

SEQ ID NO: 27928 - DNA, 57 bp, Homo sapiens
atatgcatgtgtatatgtatgtgtatatatagtatatatacatatatacatgcatat

SEQ ID NO: 27929 - DNA, 116 bp, Homo sapiens
ggacccaccttaatgatgttattttacctaaactatctcctttaaggctctgtcaaatacagtcacagcatgaggatctgggggttagggcttcaacatgtgcgtttttaggggac

SEQ ID NO: 27930 - DNA, 78 bp, Homo sapiens
tgggtgaatatcaaagggttagtcctcgtttattgttattttttttatttttgagacggagtctcactctgtcaccca

SEQ ID NO: 27931 - DNA, 64 bp, Homo sapiens
gtacactgttatggcagccctggagagctcatacagcatcccagtgaagacagtaagcagtgtc

SEQ ID NO: 27932 - DNA, 76 bp, Homo sapiens
aggaactgatgacaagcacatgccatggtgtcctgcacagtggagcggagcttggtgttttattttattttttcct

SEQ ID NO: 27933 - DNA, 196 bp, Homo sapiens
tgtgtgtgtgcatgtgtatgcatgtgcgtgtgtgcatgtgcatgtgtacctgtgtgtgcatgtgcaagagtatgtgtgtgagtgcatgcatatgcatgtgaacatgtgtatgtgtgtgcatgtgtatgtatgtgtgcatgtgcatgtgtatgtgtatgagtgcatgcgtgtgtgcattgggtcacacgttcaatgc

SEQ ID NO: 27934 - DNA, 80 bp, Homo sapiens
tcagttatacttcgtggcagccaggtatgtccaagagtgccacattggctctccatccttctctgtctcactctcgctgg

SEQ ID NO: 27935 - DNA, 93 bp, Homo sapiens
gtgtctccacactgtctatgacacccactgtgactcacttcatagcggtcttggttatcagatcaactattgtggaatcacagtgcttgtgtt

SEQ ID NO: 27936 - DNA, 82 bp, Homo sapiens
agatggagtaagttctgtgcattgtgtatagttggatgtatagtttttctttttcacctaaatgtactacttaattgcatct

SEQ ID NO: 27937 - DNA, 114 bp, Homo sapiens
gttctaggttatttgcagcagaatccttgctaatgtagtttgtttcatttttaataccctgagatgataatgatggtgctcatagcagtgataataatgactggattcctaagc

SEQ ID NO: 27938 - DNA, 112 bp, Homo sapiens
tgctttggctctgcaggctctgttttggttccatatgaattttagacttgtttttttctaattctgtgaagaatgatggtggtattttgatagggattgcattgaattggta

SEQ ID NO: 27939 - DNA, 92 bp, Homo sapiens
acacacatgtatatatgtgtgtatatatatgtgtgtatacatacatacatatacatagacacatatatatacacacaaatatacatgtgtgt

SEQ ID NO: 27940 - DNA, 61 bp, Homo sapiens
tgtgtgtatatatgtatatgtatacatatataaaatgtttgtgtgtatatatatacacaca

SEQ ID NO: 27941 - DNA, 66 bp, Homo sapiens
taagtgagaggtacaattctatacaaactactgtgctgggtagtttgagtcttttgcctcccctta

SEQ ID NO: 27942 - DNA, 58 bp, Homo sapiens; identical to SEQ ID NO: 1868

SEQ ID NO: 27943 - DNA, 107 bp, Homo sapiens
tggattctgtttcattgatctgaatgtatatatgtatatatattatatatacgtctatatatacatatatgtcaatatatatatatgactatccctttgcaatacca

SEQ ID NO: 27944 - DNA, 122 bp, Homo sapiens
gaaagctgcacaaagctcgcctgacttcacctcttgtttgcaatgttttcaaagactctcactctttctaatcactgttgctatgatcagagcgtcaggcagcatgtggttttccctctagc

SEQ ID NO: 27945 - DNA, 105 bp, Homo sapiens
ggcaatctaatgttaagacacagatatgaatagataaggcaaatatgcagaatgtttataattgtatatctaggtgaagtttatatgggtgttcattgggctgtt

SEQ ID NO: 27946 - DNA, 119 bp, Homo sapiens
gcatctgtttataatttgcataaatcatagtgatgaataatttgggctaggcaggaaacttaatctgagttcatcctgtttcctctaggtactgtgtaatctaaattagttagttatgt

SEQ ID NO: 27947 - DNA, 80 bp, Homo sapiens
gttgtattactattaacataacatacagttgagtgtatatatatatatacactctcctatagtgctaatgatgatagagc

SEQ ID NO: 27948 - DNA, 67 bp, Homo sapiens
gggtgtggtgaatgtgcctgtagtctcagctactcaggaggctgaggtaggaggatcacttgagccc

SEQ ID NO: 27949 - DNA, 89 bp, Homo sapiens
atatataatatatatgtgtgtatatatatatgtgtgtgtagcatatgtacatattatacatatgtgtgtgtatatatatatatatgtta

SEQ ID NO: 27950 - DNA, 105 bp, Homo sapiens
cttgcaggtgatgaattcatttattaactaaaggtgaagtagacgttacatggattttttttattattatactttgttttagggtacatgtgcacaatgtgcagg

SEQ ID NO: 27951 - DNA, 70 bp, Homo sapiens
gcagctcattgtctcactgcctctctgctgcaatctcctctgagcagcctgggtgagtacggtcttctgc

SEQ ID NO: 27952 - DNA, 58 bp, Homo sapiens
ccaatatgtgtgtgtgtgtgtgtgtgtgtgtatacacacacacatatgtatatatggg

SEQ ID NO: 27953 - DNA, 56 bp, Homo sapiens
tgagagggtctcactgtgtcacccaggctggagtgcagtggtgtgatcctggctca

SEQ ID NO: 27954 - DNA, 83 bp, Homo sapiens; identical to SEQ ID NO: 21323

SEQ ID NO: 27955 - DNA, 95 bp, Homo sapiens; identical to SEQ ID NO: 580

SEQ ID NO: 27956 - DNA, 93 bp, Homo sapiens; identical to SEQ ID NO: 69

SEQ ID NO: 27957 - DNA, 95 bp, Homo sapiens; identical to SEQ ID NO: 68

SEQ ID NO: 27958 - DNA, 93 bp, Homo sapiens; identical to SEQ ID NO: 69

SEQ ID NO: 27959 - DNA, 89 bp, Homo sapiens
ctagagaaatgatcattaatgcctttgttctgactcagtggatcttcatttttacatcagaggaagcaatcaggtatgcatttgtctag

SEQ ID NO: 27960 - DNA, 101 bp, Homo sapiens
tgttttctgaatctctagtatctgagtagacagttgtgagagagatcaatagaatttttctctcaaggtgttattattttctaaaggagaaatagaaaata

SEQ ID NO: 27961 - DNA, 124 bp, Homo sapiens
atatacatatatacacatatgtatatgtatgtatatatgtatacatatatatgtagatatgtatacgtatatatacgtagatatgtgtgtgtgtatctgtgtgtctatctatctatgtatctat

SEQ ID NO: 27962 - DNA, 97 bp, Homo sapiens
gtattccattccatatatacatatatgtgtatttatatatgtgtgtgtgtatacatatatgtgtgtatacatatatatgtgtgtatatatggaacac

SEQ ID NO: 27963 - DNA, 114 bp, Homo sapiens
cttcagcttgcagggcttcaggaaaaagacagttttgtttttagtgatttgaagtcagaagagtgagagcaaatgagaaatgctagtttggaaagtcatagtgagatattggag

SEQ ID NO: 27964 - DNA, 86 bp, Homo sapiens
acatatgtctgtctctctctcttatatataaacacataagtctgtctctttcgaataggcaagatgtttgaggagagaccttatgt

SEQ ID NO: 27965 - DNA, 117 bp, Homo sapiens
agtaacataaatatgtgtttatgtgcttactatataattaatttaaatgttttttaaaatgagaaattttaagacattttggcatatggtttgatatgaatacattcattagttatt

SEQ ID NO: 27966 - DNA, 121 bp, Homo sapiens
catgtggaagtttagtaatgggtatgaggtggcctattatgctattttcattgtttttgtataggcttgaaatttttcataatcgtagaactttttaacccaaacccttggctactgagtg

SEQ ID NO: 27967 - DNA, 126 bp, Homo sapiens
tatatgtgttctacctgtgtatatatctacgtatgtatatttatatatatatgtatgtatatgtatatgtgtgtatatacacacagaacacatatacacatatatgtgagtatatatatctatgta

SEQ ID NO: 27968 - DNA, 79 bp, Homo sapiens
atagaagaaatacattatatgtatatatatctgtatacatagatatatatactcacatatatgtgtatatgtgttctgt

SEQ ID NO: 27969 - DNA, 104 bp, Homo sapiens
ctaatttgggttccttaagatctcaaataaattttggaatgaatttttctatttcttgaaaaaatatcattgcagtttttataaggatcatgttgaatctgtag

SEQ ID NO: 27970 - DNA, 114 bp, Homo sapiens
aatatatagcaggggaggtgatagatgtgttacattactgtaaaaatcattacacaatgtgtatgtatatatatctatcaagtcatcatattatacaccttgaatatatatatt

SEQ ID NO: 27971 - DNA, 95 bp, Homo sapiens; identical to SEQ ID NO: 580

SEQ ID NO: 27972 - DNA, 93 bp, Homo sapiens; identical to SEQ ID NO: 69

SEQ ID NO: 27973 - DNA, 70 bp, Homo sapiens
ttttagtttttgagacagggtctcactctatcacttagaagtgcatggtgtgatcttagctcactgaaac

SEQ ID NO: 27974 - DNA, 130 bp, Homo sapiens
atattttattgcatatgtatatatacatatatatatgaatgtagtatatgtatatatacatatatatgaatgtagtatatgtatatatacatatatatatatgaatgtagtatatgtatactacactttc

SEQ ID NO: 27975 - DNA, 80 bp, Homo sapiens
ctttgaaacatatgtgtatgtgtataaatgtatatgtatctatatagaaatatacatatacatacacatatgtatatgag

SEQ ID NO: 27976 - DNA, 66 bp, Homo sapiens
acatatgtgtatgtatatgtatatttctatatagatacatatacatttatacacatacacatatgt

SEQ ID NO: 27977 - DNA, 67 bp, Homo sapiens
gcccttattggttaagatcacattaatggttttaatctattgatgtttgatcatatgcaaaagtggc

SEQ ID NO: 27978 - DNA, 177 bp, Homo sapiens
acatgtggcatatatatatgtatatatgtatatatgtatatatgtatatatgtatatatgtgtatatatacatgtatatgtgtatatatacgtgtatatatgtatatatatgtgtatatatacgtgtatatatgtatatatatgtgtgtgtatatatatatgtatatattctctgca

SEQ ID NO: 27979 - DNA, 69 bp, Homo sapiens
ttgtttttgagacagtcacactctgtcatccaggctggagtacagtggtgtgatctcagctcactgcaa

SEQ ID NO: 27980 - DNA, 95 bp, Homo sapiens; identical to SEQ ID NO: 68

SEQ ID NO: 27981 - DNA, 93 bp, Homo sapiens; identical to SEQ ID NO: 69

SEQ ID NO: 27982 - DNA, 134 bp, Homo sapiens
caagtatatagaaataagcacacacatgcacacagaattatacagatatatatacacacacacacacatacacacacatatatatatataatgtgattgattgtgtgcatatgtatttgtgtgtgtgtgtgtct

SEQ ID NO: 27983 - DNA, 201 bp, Homo sapiens
atatatatggatagatatatatggatatatagatatatatgtccatatatatctatatatgtatatggacatatatatagatatatatatgtccatatatatagatatatatatgtccatatatatagatatatatatgtccatatatatagatatatatatgtccatatatatagatatctatatatatgtccatatata

SEQ ID NO: 27984 - DNA, 92 bp, Homo sapiens
acagggtagtaggaatataataagctacaatgttgcaaagctctccattcttaccaaaacttgaagcttgttttgtttttaataaatgctgt

SEQ ID NO: 27985 - DNA, 113 bp, Homo sapiens
ttgccaaaattttactcttgataatgtacaattaaagataaacttggaagtacttttaaaagtatttttatctctttgtgcacacatcagatgataaatatggattagggcaa

SEQ ID NO: 27986 - DNA, 86 bp, Homo sapiens
agaaattttctggaggctgtcattggctaaagttcgttatttatttatttaagtcagttacaataaatgcttccaaattaagttct

SEQ ID NO: 27987 - DNA, 122 bp, Homo sapiens
gtctgacagctttgaagaggatagtcattctcctagcatggagtttgagatctgagagtggacagactgcctcctcaagtgggtccctgacccccaaggagcctaactgggagacatcaccc

SEQ ID NO: 27988 - DNA, 74 bp, Homo sapiens
gtgtgcatatgcacttgtgtctacatgtgtgccttgctgtgtgtgcacacatgtgtgtgtgtgcatgtgtacat

SEQ ID NO: 27989 - DNA, 68 bp, Homo sapiens
gttgcacactttaaaataactaaagaagtatgttagtgacctactcctttagttgtgatgtttgtgac

SEQ ID NO: 27990 - DNA, 82 bp, Homo sapiens
ctctgtttggcaggttctgtgttattgtcccacgtccaagaggaatgaggtacgctgacaccagagagtgagcaagatggag

SEQ ID NO: 27991 - DNA, 109 bp, Homo sapiens
cctaaatttatctaagctttggctttttttggacatataatgtttatatatcataaagtaaacaacgtatgtcaacacaaaagaaagaaagctgtgaagtaatttgagg

SEQ ID NO: 27992 - DNA, 161 bp, Homo sapiens
gtgattatatatacatatatatatacacgtatatatacgtatatatacgtgtatgtatatatatatacgtatatatacgtgtatatatatatatgtatatatacgtatatatacgtgtatatatatatgtatatatacgtgtatatatatatgtatatata

SEQ ID NO: 27993 - DNA, 147 bp, Homo sapiens
atatatatatacacgtatatatacatatatatatacacgtatatatacgtatatatacatatatatatatacacgtatatatacgtatatatatatacatacacgtatatatacgtatatatacgtgtatatatatatgtatatata

SEQ ID NO: 27994 - DNA, 90 bp, Homo sapiens
cattgcctgtgtgtgtgtgtctatgtgtgtgtgtatgtattttttaatatatttttatattataaatatatatacaaaattagagctgtg

SEQ ID NO: 27995 - DNA, 88 bp, Homo sapiens
ggcctcccaaagtgctggtgagtggtgacagcgtgctggcagccctggcagcactcgctcactctcagcctcagcacccactctggtc

SEQ ID NO: 27996 - DNA, 363 bp, Homo sapiens
gtgtgtgtgtatgtgtatacataatttgtatatgtatatatgtgtgtgtgtgtatgtatatatgtatatatgtgcatatgtgtatatgtgtatatataatgtgtatatgtatatatgtgtatgtgtgtttatatgtgtgtatgtatatgtgtatatatagtgttcatatgtatataggtgtgtatgtatatatgtgtatatgtatatgtgtatatgtatatatgtgtatgtatatgtgtatatataatgtatatatgtgtatatatgtgtgtatatataatgtgtatatgtgtgtgtgtatgtatatgtgtatatataatgtgtatatgaatatatgtgtgagtgtatgtacacatacatata

SEQ ID NO: 27997 - DNA, 116 bp, Homo sapiens
tcaattgcagaagcagaaaagtagtgtcatgttgatgtagaagataacacatatactatatgtatttatctttccctacaaattttcaatctgattattgggttcttagttattga

SEQ ID NO: 27998 - DNA, 69 bp, Homo sapiens
agcaggtatctgagactgtggtcacccagcaaaatggaacggactaaatgagtctctctcactctcgct

SEQ ID NO: 27999 - DNA, 99 bp, Homo sapiens
ggaggaaacttttattaagaacactggaatgatgaaatgacttgcagtatttttgcaagtaaagaagtcagttattctcaacttaaaaaaaattcttct

SEQ ID NO: 28000 - DNA, 58 bp, Homo sapiens; identical to SEQ ID NO: 637

SEQ ID NO: 28001 - DNA, 73 bp, Homo sapiens
tataaaaatgtatttgacacataaatgttgtatatatttataatgtacgacatgatgcttagatacatgtata

SEQ ID NO: 28002 - DNA, 56 bp, Homo sapiens
atatatacacacacacgtatatgtatatatatacatatacgtgtgtgtgtgtatat

SEQ ID NO: 28003 - DNA, 116 bp, Homo sapiens
tgatttaaattataggatgttgttactcatctcagaatgatctttgtaaatatttgttttttaaagttacataattttatttcaacagaggctttaataatatcctttaaaagtca

SEQ ID NO: 28004 - DNA, 103 bp, Homo sapiens
gaatttaaattttttattctttagaataaacatcctggagtgtgattgctgggttacatggtaattggatgtttggttttaaagacactgataaattgttttc

SEQ ID NO: 28005 - DNA, 119 bp, Homo sapiens
ctgagatgagcctgatgacatcatgactttgggcccctttctttcttccttccttcctttctttctttttttttttttttttgacggagtctctccctgtcgctgaggctggagtgcag

SEQ ID NO: 28006 - DNA, 119 bp, Homo sapiens
gcagtaggctttcatcttctaaattagagcttcaagtaaacaatcctgtttgaatcctgcagctactgcaactggaactgttttggcttaatgattcagttaagaggataagcctctgt

SEQ ID NO: 28007 - DNA, 95 bp, Homo sapiens
gtcattcagcagcaaacagattaaggacagagctgtgtgtgaacagagggccctgaatgcatacgtagagctgctcattctccaggcatgtggac

SEQ ID NO: 28008 - DNA, 120 bp, Homo sapiens
ttatcgtaagttttcatatatttttgctatgtgtctaggctttcttttttgttttattagtcagtttatataacccgttgccgacactacacaattttatttactggagatttacaataa

SEQ ID NO: 28009 - DNA, 86 bp, Homo sapiens
gcccagatatgagcaaagttctgtggcttttgacttacaccgaggttttaagcccagctctaaatttttttctttgtaaaatgggt

SEQ ID NO: 28010 - DNA, 102 bp, Homo sapiens
tctctcccaggtatctgcacattttgtggatcatatttgtgtcttctgatgtgaaaagaggattgttgtctgagtccagaaactgttaggctcatgggagga

SEQ ID NO: 28011 - DNA, 104 bp, Homo sapiens
catgactggaagagcttagaggtacctgaaaattggcatggttgttaaataaatcacagtgtctcttctctttacctttgcctttaaaataataatccaccatg

SEQ ID NO: 28012 - DNA, 144 bp, Homo sapiens
tgtgtgtgtatatatatatatatagtagtattccatggtgtgtgtgtgtgtatatatacatatatacgtatacgtatacacatatttgtatatatgtatacgtatatatgtatacgtatacatatatatgtgtatacatatgca

SEQ ID NO: 28013 - DNA, 78 bp, Homo sapiens
ttcaggagtgacacatgtatctactgtaaattctgacactaatgtgctcaccagtagtttcattgtatttcttttgaa

SEQ ID NO: 28014 - DNA, 119 bp, Homo sapiens
tgtttataaaaaattaaatgagaccaaaaagacacattgtcttccgcacagacactctctccctcagtgctcacaccggatggctgtgcttttcttccctccaaagatgtttattagca

SEQ ID NO: 28015 - DNA, 79 bp, Homo sapiens
tggatgattggagactgtgagcactgtctaattcagcagagttagaatggtgacacactctgtctctcaagtaacacca

SEQ ID NO: 28016 - DNA, 57 bp, Homo sapiens
tgagacaggtctcactctgtcacccagactggagtgcagaggcatgatcatggctca

SEQ ID NO: 28017 - DNA, 106 bp, Homo sapiens
tcattttgtgtatgtgtatatgggaggcagtgtgtatacctatgcttataatatattcatatatatacatctatacatacacatatatattatatacaaattctga

SEQ ID NO: 28018 - DNA, 101 bp, Homo sapiens
ttcctcaactgctgtctcatttccactttcatctcagcatctaattcatctagggcagacgtctgagatcagagtgagattaataggacacaggccaggaa

SEQ ID NO: 28019 - DNA, 87 bp, Homo sapiens
tacctaagtagtcattcaactttgttttctgggacaaatataaaagtgtgagaatactgagtggaaaccaatctgacttatagggta

SEQ ID NO: 28020 - DNA, 79 bp, Homo sapiens
tatgccagctgctgttattattcaaggctttgtattgctcttgggtttttatgaatgtattgaagtgtgcaggtgcatg

SEQ ID NO: 28021 - DNA, 137 bp, Homo sapiens
tatattaattattaacacatgtatacatatattattaataccaatgaataacattgtatatgttatttattaatgtatagtttttatgtgctataaacatataaaatgttatttatacccttaaatattgaaataca

SEQ ID NO: 28022 - DNA, 75 bp, Homo sapiens
gacagcaaactgttctctctttctctgtctctctctctttctgccatgtgaggacaaagtgagaaggcatctgtc

SEQ ID NO: 28023 - DNA, 68 bp, Homo sapiens
tgaccttttctttctgggaccaggattctaggctgcaagaaatgtctctcagaactgagaaggcttca

SEQ ID NO: 28024 - DNA, 215 bp, Homo sapiens
tgtgtgtatatatacaatctatataatactatatattatatgtgtgtatatatctatatataatatgtgtgttataggagtgtgtatatatatattcacacacacaaattatatctatatataatatgtgtgtatatatatacaatgtatagtactatatattatatagtgtgtatataggtacacattatatatatgtgtgatataattattgt

SEQ ID NO: 28025 - DNA, 72 bp, Homo sapiens
aatcattttttgttgtatatatttaaagtgtgcaacatgatattttgttatatgtaggcacaagaaatgatt

SEQ ID NO: 28026 - DNA, 76 bp, Homo sapiens
gtgtcagaggagacctgcttaaagagaagatttttaatttttatttttttttagagacagggtctcactctgttgc

SEQ ID NO: 28027 - DNA, 100 bp, Homo sapiens
aataaaatacatagagatggcttaatacaaagccatatcataaatgtttctttttgagagatcttcctgtatgctttgtggccagaaattgtatttaatt

SEQ ID NO: 28028 - DNA, 61 bp, Homo sapiens
agaatatgcttactacatgtagtcttatttaagggattttaatgtagtatgttcatgttct

SEQ ID NO: 28029 - DNA, 75 bp, Homo sapiens
agtgagaccctattctaaaaaaattgtaaaaatatgtatattaattttttttttgttttgagatagggtctcact

SEQ ID NO: 28030 - DNA, 80 bp, Homo sapiens
cttcttcctggattaattttataaaatttacagggacagtttcaagactgtcagtagagtcagtagaatgcaaggtgaag

SEQ ID NO: 28031 - DNA, 114 bp, Homo sapiens
gggggagctgaggacagaattctgacctctgtctttgttctaaatttcttcttgagatgcctagaagaagtcacacccgcaggccagagctcaatattcctttctgctgacccc

SEQ ID NO: 28032 - DNA, 61 bp, Homo sapiens
gccatctgtgacagcttcttgatctgtccccaggtggatggctgtgttcaacgggtgttgc

SEQ ID NO: 28033 - DNA, 95 bp, Homo sapiens; identical to SEQ ID NO: 580

SEQ ID NO: 28034 - DNA, 93 bp, Homo sapiens; identical to SEQ ID NO: 69

SEQ ID NO: 28035 - DNA, 109 bp, Homo sapiens
ccaaagcttagagtttacattagggttttctcttggtgttgtaagttctatggttttggcaagtgtagccattattatagtatcatatagagtagattcactgccctaa

SEQ ID NO: 28036 - DNA, 112 bp, Homo sapiens
ggattgtcttggctatacagtctcttttttggttccatatgaaatttaaagtagttttttccaattctatgaagaaagtcaatggtagcttgatgggaatagcattgaatct

SEQ ID NO: 28037 - DNA, 118 bp, Homo sapiens
gtcaagattttcattttgcacatgtttaatttatgaagtctgttaacacatttgtacagaactgtggagtatgcagttgtcagaaacttatgggagagattagtgctgaagatatgac

SEQ ID NO: 28038 - DNA, 96 bp, Homo sapiens
ttcatgggcacaatggaataaaatcgaccaaagaatcctataagggatatctgttttcctcagtgattctctgtgaaaccttctggttcttatgaa

SEQ ID NO: 28039 - DNA, 119 bp, Homo sapiens
ttcaccttctgtcatgattgtgaggcctccctagccacgtggaactgtgagtccattagatgtctttttctttataaattacctacccagtgtcaggtatgtctttatcagcgtgtgaa

SEQ ID NO: 28040 - DNA, 77 bp, Homo sapiens
ggagcgtggggctgtgagtagacagagggcagatacggccaaccctcaggatgctgcgtggctgcctcaaacattcc

SEQ ID NO: 28041 - DNA, 113 bp, Homo sapiens
ccaaaaggtgtcccatgcatccctcaaacaagaggtttttatgttgttttttaaataagccaatcatgcttcttccaagggaacatgaggtccatctacgccctctcttttgg

SEQ ID NO: 28042 - DNA, 89 bp, Homo sapiens
tgaggtggcaattaggactgttggtgtgagaaaataactttttttttttttttttttttttttgagacagagtcttactctgtcaccca

SEQ ID NO: 28043 - DNA, 117 bp, Homo sapiens
attgtggttttgatttgcatttctctaatgaccagtgatgatgagtttttttttttttcatgtttgttggctgcacagtcgctcggatcacagtccaatcaaattagaactcaggat

SEQ ID NO: 28044 - DNA, 91 bp, Homo sapiens
aggatcaactgacccttaagtgagtagagtgacaggagagtatattttcttaaggcctcccatagccgcttgaggaagacagaaggatttt

SEQ ID NO: 28045 - DNA, 113 bp, Homo sapiens
aagatgaagctctagagatctgctgtcccacatggcactccttgaattgtctgtctgtcattttattttcattttaagtctgtcagctcagcttgttctttgggtcagttctt

SEQ ID NO: 28046 - DNA, 81 bp, Homo sapiens
catcatctgtgacagcttcttgatctgtccccaggtgggtggctgtgtttgacaggtgttgctcatgacagttggggtcct

SEQ ID NO: 28047 - DNA, 80 bp, Homo sapiens
cacttgggttctaatgtcaaagcttatgttgctcatagagcaacaaagagaagagtttttgtttattttgttttcaggtg

SEQ ID NO: 28048 - DNA, 100 bp, Homo sapiens
tgtcgcaaaacttttctgataattgttcaaacaagggagttttaaaaattgttgtcccttgtgcttacaggttgattagagatgggggaaaatggtgaca

SEQ ID NO: 28049 - DNA, 58 bp, Homo sapiens; identical to SEQ ID NO: 687

SEQ ID NO: 28050 - DNA, 56 bp, Homo sapiens; identical to SEQ ID NO: 688

SEQ ID NO: 28051 - DNA, 192 bp, Homo sapiens
atactatatatatacaaagtatatgtatatacgtatatacatatatacatttgtatatacatatgtatatatgtatatacgtatatacatatatacatttgtatatacatatgtatatatgtatatacaatgtgtgtatgtgtgtgtattttatatatatatatatatatatatatatatatatatatatgc

SEQ ID NO: 28052 - DNA, 60 bp, Homo sapiens
tcctatcagtcagtgcttttcaagctgatttttaagctgtgaagcccatgattgatatga

SEQ ID NO: 28053 - DNA, 80 bp, Homo sapiens
aagcattagtatgttgaatacaatacattttagttcccccttctttcttgtatgtattaatatttaatgtgctgatgttt

SEQ ID NO: 28054 - DNA, 85 bp, Homo sapiens
catggtggagaggtgagagagctctctggggtctctttcataaggacattaatttcattcatgagagctccaccctcatgacctg

SEQ ID NO: 28055 - DNA, 78 bp, Homo sapiens
gtatatatatttatatatgctatatatatgatagtatatatactatatgtaagttatagtatatatatttatatatac

SEQ ID NO: 28056 - DNA, 117 bp, Homo sapiens
cctacagttggaggtctctgtggcatcttaaatgagggtttcatgcctctgagtgccagatgaaagtgtgcagaggaccaagatgaggacctgattgaaaagttggttgagacacaa

SEQ ID NO: 28057 - DNA, 87 bp, Homo sapiens
ggagataagatttctttcttaagtgtaagaatgattttttttaaaaaaaattattattatttttttgcggagatggggtcttgctgc

SEQ ID NO: 28058 - DNA, 111 bp, Homo sapiens
acattagacaggggaattgatgcaggaagtaaaactatgactttcaatataaatatatgtctatactgtgaagtacctttcttctcttgcctcagggctgttctgcgatgt

SEQ ID NO: 28059 - DNA, 62 bp, Homo sapiens
gtctgtgacagcttcttgatctgtccccaggtgggtggctctgttcgggtgttgctcatgac

SEQ ID NO: 28060 - DNA, 71 bp, Homo sapiens
gttgtttgagatagagtctcactctgtcacccaggctggagtgcaatggtgggatcttggctcactgcagc

SEQ ID NO: 28061 - DNA, 97 bp, Homo sapiens
agtagggaccagatcagccagatacttagaggccatggcaagaagtttgcatttaactccttttttttctcttttatttgtgagacagggtctctct

SEQ ID NO: 28062 - DNA, 87 bp, Homo sapiens
gaggaggactcatttttcatactgaagactcagagcagagtatccaatcacctctatgttgcgtgtgtgagagtgagttacccactc

SEQ ID NO: 28063 - DNA, 68 bp, Homo sapiens
gtgtagggttttagggcatttctagtttgcttgtaaagtagttttaaatgcttctagaatgacagcac

SEQ ID NO: 28064 - DNA, 165 bp, Homo sapiens
tacgtatatatatacacacatatgtatgtatatatatgtatgtatatatgtatatacgtatatatacatacgtgtgtatatatacgtatatatatacacacatatgtgtgtatatatatacatgtatatatatacacacatatgtgtgtatatatatacgcatat

SEQ ID NO: 28065 - DNA, 60 bp, Homo sapiens
tatacacacatatgtgtgtatatatatacatgtatatatatacacacatatgtgtgtata

SEQ ID NO: 28066 - DNA, 60 bp, Homo sapiens; identical to SEQ ID NO: 28065

SEQ ID NO: 28067 - DNA, 60 bp, Homo sapiens
tacacacacatatgtgtgtatatatatacatgtatatatatacacacatatgtgtgtgta

SEQ ID NO: 28068 - DNA, 60 bp, Homo sapiens; identical to SEQ ID NO: 28067

SEQ ID NO: 28069 - DNA, 79 bp, Homo sapiens
acacacacatatgtgtgtatatatatacatgtatatatatacacacatatgtgtgtgtatatatatacatgtatatata

SEQ ID NO: 28070 - DNA, 100 bp, Homo sapiens
cctccgcgctcaccctcttatcccatccactctgcctctgtcaggcctcaggcttggggggctcagacttggtggaccactgctcaggtgtgagttgagg

SEQ ID NO: 28071 - DNA, 101 bp, Homo sapiens
gttaagatgtccttccagtttgtggctttcctttttattattttcatttttattatgaatttttgagaagctttgtgacccaggctggagtgcattggtgc

SEQ ID NO: 28072 - DNA, 95 bp, Homo sapiens; identical to SEQ ID NO: 68

SEQ ID NO: 28073 - DNA, 93 bp, Homo sapiens; identical to SEQ ID NO: 69

SEQ ID NO: 28074 - DNA, 70 bp, Homo sapiens
tggataattgctcactgtctgtctctcattgctgagtcatgagagcagggactgacagaagtgtgtccaa

SEQ ID NO: 28075 - DNA, 113 bp, Homo sapiens
gttgccacagtcttcagaactagaaaaaggcaatagatggaggggtgccagtgggaaaaacactgtcattttctctgtcttgagtgattctattggtctggaatggtgcatac

SEQ ID NO: 28076 - DNA, 79 bp, Homo sapiens
tgaagtagtcatccctttcagatgtgaactttcagctcctctctctctctgtgttaaaatctgatcaaggatgacttca

SEQ ID NO: 28077 - DNA, 119 bp, Homo sapiens
gacgtacagggctgcaccttctcggttgcctcagtgggacagaaacttgtggtctctagacataagagagtgtgggctgaggggagctttaactgatcacggaggatggtctgttagtt

SEQ ID NO: 28078 - DNA, 90 bp, Homo sapiens
tctctctgcctcggtttccttatctgtcatgctttgctcatggagtggagtgagaagaaactgaactctagggtgcctggcagagagact

SEQ ID NO: 28079 - DNA, 69 bp, Homo sapiens
ttgtttgagacaaagtctcactctgtcacccaggctggagtgcagtggtgggatctcggctcactgcaa

SEQ ID NO: 28080 - DNA, 105 bp, Homo sapiens
ggatattcaggttcttttgtgattctatacaatttgtttatttttctatttccatgaataatatcactggtattttgataggaattacaatgaatctgtagattt

SEQ ID NO: 28081 - DNA, 86 bp, Homo sapiens
ttgtggactagaaccacaaacttctttttatttatgatgaacaaccatatgttcacctgagaagagcaagtgtggtgatttcacaa

SEQ ID NO: 28082 - DNA, 112 bp, Homo sapiens
tgtatatatatacatgtgtatatatacacatgtatatatgtatatacatatacacaagtgtatatgtatatatatatatacatgtgtatatatatatatatatatatatata

SEQ ID NO: 28083 - DNA, 111 bp, Homo sapiens
gatttttccacaattgtctggtttattttcatcatatgtatttttctttagtaacttatgtgtttagattctaataaagtggtaagtgctatgtttttgtggggagagggc

SEQ ID NO: 28084 - DNA, 58 bp, Homo sapiens
tgagactgagtctcgctctgtcacccagcctggagtgcagtggcatgatcttggctta

SEQ ID NO: 28085 - DNA, 83 bp, Homo sapiens
gctaatcctgagtgaatttgtgcgtgctctttgcctatagttattttcaaagagcaagagcatgtgcaggacaccagcctggc

SEQ ID NO: 28086 - DNA, 95 bp, Homo sapiens; identical to SEQ ID NO: 68

SEQ ID NO: 28087 - DNA, 93 bp, Homo sapiens; identical to SEQ ID NO: 69

SEQ ID NO: 28088 - DNA, 90 bp, Homo sapiens
ccttcatacacttaacttatcacagtctttttgtgagggagcaatttcacagatctcttttattgtgttgtaaggaatacggtaagaagg

SEQ ID NO: 28089 - DNA, 121 bp, Homo sapiens
ttttagagttagaatgtacctttgaagtaagcaagtctaaccaaccactgaatgcagaaagtgcatctccaactgtggttatttactcagtttgaatactttctatgattctagaaagctc

SEQ ID NO: 28090 - DNA, 91 bp, Homo sapiens
gaagccactgaggcctgaataggacaaaaggtggggtaagggagcattgttctctctgcctgactgctgtcaagccaggacatcggtcttc

SEQ ID NO: 28091 - DNA, 81 bp, Homo sapiens
tcccagactctctcagtgtaatctggttgagtggacagtaaaaatccatttgtctcctctgcaaggttttgattaatggga

SEQ ID NO: 28092 - DNA, 141 bp, Homo sapiens
cattttgtttaaagattcacacttttatcctgtgtgtgcctgaagtaaaagaaggtttctctctggcacacacagtctcttaaaggctgattctgtccccatatgtcttgtatttataagcatatgtgggtcatctgtctt

SEQ ID NO: 28093 - DNA, 95 bp, Homo sapiens; identical to SEQ ID NO: 68

SEQ ID NO: 28094 - DNA, 93 bp, Homo sapiens; identical to SEQ ID NO: 69

SEQ ID NO: 28095 - DNA, 76 bp, Homo sapiens
tgtggggacttcaacagtggactttattttttttaaattaattttttttgagatggagtctcactgtgtcaccagg

SEQ ID NO: 28096 - DNA, 58 bp, Homo sapiens
tgagacggagtctcactctgtcacccagcctggagggcaatggcgtgatctctgctca

SEQ ID NO: 28097 - DNA, 196 bp, Homo sapiens
tatacacacacacacgtatatatatatgtatatgtatatatatatacacgtgtatatatatatgtgtgtgtgtatatatatatatatacgtgtatatatatgtacatatatatacacgtatatatatgtatgtgtatatatatacgtatatatacgtgtatgtatatatatatatatatgtatgtatatatatata

SEQ ID NO: 28098 - DNA, 78 bp, Homo sapiens
tggcgctgatctgacaggagacagagttcaggcagtaatgcttgctcaactgctgttcacctcctgctgtgtggccca

SEQ ID NO: 28099 - DNA, 62 bp, Homo sapiens
atagatcccattggtggccacaggtcactcatctatgtgactgtgtaacacactggctctgt

SEQ ID NO: 28100 - DNA, 106 bp, Homo sapiens
tctgtggtaaggaaaagagacagacagagcaaggataggaatgggagttttcactgcataccatttatatttgattttatgtcaatgtattgcttactcaaaaaga

SEQ ID NO: 28101 - DNA, 100 bp, Homo sapiens
atgacagttgagagaaggctgaggtaattggacacttgattatatatataattgattatgtatataatcaatgcccagaattacacttagcaactgtggt

SEQ ID NO: 28102 - DNA, 68 bp, Homo sapiens
atatatgtgtatatatgtgtgtgtgtgtatatatatgtacacacacacacacacacacacacatatat

SEQ ID NO: 28103 - DNA, 93 bp, Homo sapiens
agtatccatcaataaaggactggataaagaaaatgtttatatatatatatatatatatatatatatatatttttcttttcagcatggaatact

SEQ ID NO: 28104 - DNA, 112 bp, Homo sapiens
cataatcaatgccctatgatgacagcaaaaagataccagtctgatgatatcactatttgttattgttattccaggtatccgtttctgttaccaattctggagcaggagtatg

SEQ ID NO: 28105 - DNA, 69 bp, Homo sapiens
ttgtttgtttgagacagtctcactgtcccccaggcgggagtacagtggtgcgatttcagctcatggcaa

SEQ ID NO: 28106 - DNA, 96 bp, Homo sapiens
caagagcaatagaattgaaataggaacattgttaatttatgttgggttaaaaatactttgcatatttaatgttaattttagctttagcttttgctc

SEQ ID NO: 28107 - DNA, 116 bp, Homo sapiens
gggttgtcttggcaatgcaggctcttttttggttccatatgaaatgtaaagtacttttttctaattctgtgaagaaagtcaatggtagcttgatggagatagcattgaatctataa

SEQ ID NO: 28108 - DNA, 95 bp, Homo sapiens; identical to SEQ ID NO: 68

SEQ ID NO: 28109 - DNA, 96 bp, Homo sapiens
aggcaatcccaagtaatcatgagatgaaacagagagagagagagacactgatactgaatctctctctctgtttcatctcatgagtacttgtaccct

SEQ ID NO: 28110 - DNA, 93 bp, Homo sapiens; identical to SEQ ID NO: 69

SEQ ID NO: 28111 - DNA, 115 bp, Homo sapiens
aggaggcagctaatgtgtcacgtcctaaaatctaattcatgagaaattatttttatttcaaatgagaagatcaatgcatagggaagaaaatgtcacattcagtttattactttct

SEQ ID NO: 28112 - DNA, 103 bp, Homo sapiens
gtagctttgattcagaagtttcaggcagagataaaagagcaaaactttttttctattttttctttatccagtctcaagaaacttctgaatttcctaaaagcgc

SEQ ID NO: 28113 - DNA, 84 bp, Homo sapiens
gaggcactgagcacaatgggcaaggtggccctggctcttcctccctcgccccaagggttctctgtctgtctctgtctctctgtc

SEQ ID NO: 28114 - DNA, 92 bp, Homo sapiens
cacaagggtgagtagaagcagagactgtgcagactcggtggatccagagatctgcactgtgaacctgctgacacctctgccctggaattgtg

SEQ ID NO: 28115 - DNA, 82 bp, Homo sapiens
gaagcagtagtttactctggccactctctctctcaggggtcctttccacagtcacagggctggctgggtgggtgctggcttc

SEQ ID NO: 28116 - DNA, 79 bp, Homo sapiens
actgagtgaggttttcaatttcagaaggtctgactaatatctttttttgtttgtttgttgagatggagtctcactctgt

SEQ ID NO: 28117 - DNA, 91 bp, Homo sapiens
ccagactctcctctgagaaactggagatggtgaggtttatttatttatttatttatttatttatttatttattttttctgtgagaggctgg

SEQ ID NO: 28118 - DNA, 58 bp, Homo sapiens; identical to SEQ ID NO: 1435

SEQ ID NO: 28119 - DNA, 76 bp, Homo sapiens
gcctccttatttcctgccttctatctacgggtcaggtgagactgactgaagagagtcaggtgtgtcttaagcaggt

SEQ ID NO: 28120 - DNA, 106 bp, Homo sapiens
ttggttttcatttctaagttcatccattctttagtcataatgagagaagagagacagatgctctcatatggttttatattgttttatactcagaaaagaaaagcaa

SEQ ID NO: 28121 - DNA, 87 bp, Homo sapiens
gataaatttttatcagattagatgacctatacttgtgagtttatttgttaaaggagctagcatcaacttttctggtacagatttatt

SEQ ID NO: 28122 - DNA, 68 bp, Homo sapiens
tgcatctctccctctgtgactcatgctttcagtgcattcataagatgatttataagtgggggaatgta

SEQ ID NO: 28123 - DNA, 101 bp, Homo sapiens
taagttaggtttctgttagcttatgtactaagttaggttgtagtttgttaagtaggaactcaaagtatgaagatagtctcaggctaatggcctcctgcttg

SEQ ID NO: 28124 - DNA, 112 bp, Homo sapiens
gacaattttgtatagagtttttgaaggtggtcagggattaagagacttccagatgtggaagtaggttgaaatccctttagtagaagcccggttatgtgtatgagactttgtt

SEQ ID NO: 28125 - DNA, 79 bp, Homo sapiens
ctctgaaaatttctttataaatgtaaatttcctttcaaaaggggaaatttatattaaatactttaggcagttgacaggg

SEQ ID NO: 28126 - DNA, 94 bp, Homo sapiens
gtgtgttgtgtctatacatatatatgtatatatgcatgtgggcatacacgtgtgtatacatggatagcacatatgtatgtatgtacacacatac

SEQ ID NO: 28127 - DNA, 110 bp, Homo sapiens
gttatcagtctattctctctggttgcttttagttctttttattttttgatattctataatttgggaataaagtatctaaatgtgttttggggtttcttggatctgaagat

SEQ ID NO: 28128 - DNA, 76 bp, Homo sapiens
acagactgtctgtgtctttcttaatagcctgtgaatatctgcagaacaagggctgaatcagatgcagaatatttgt

SEQ ID NO: 28129 - DNA, 113 bp, Homo sapiens
ttttctggaagctgatttgacagtgttgtataattatctataaagacagatacttcttaattttaattttaaacatgctgtcttgtatttaatgtccgttagttttctgaaag

SEQ ID NO: 28130 - DNA, 74 bp, Homo sapiens
tgtgtgtccacgtacatgtgtgtatctgtatgcctctgtgtgtatatctgtgtgtgcatgtgtgtgtctgcaca

SEQ ID NO: 28131 - DNA, 91 bp, Homo sapiens
gtgtacacatgcttgtcatattcatatatatagatagtatatccatactacatatgtatatatttgtttatatgatagacatgttaatcac

SEQ ID NO: 28132 - DNA, 98 bp, Homo sapiens
atacatatgtagtatggatatactatctatatatatgaatatgacaagcatgtgtacactatatatataaagttgttgtcctgctgctgcggctgtgt

SEQ ID NO: 28133 - DNA, 109 bp, Homo sapiens
ctgtgatcccagctactcgggaggctgcaggaggagaatcgctggaacctggaaggcacagattacagtgagctgagattgcaccattgcactccagcctgggtaacag

SEQ ID NO: 28134 - DNA, 115 bp, Homo sapiens
gtctgaaggcctgagaagccggagagccaatggtgtcactctcagtctgaggcaaaaggcctgaggaaatggggggccattgggcataagtcccagagcctgaaggccttcaaac

SEQ ID NO: 28135 - DNA, 95 bp, Homo sapiens; identical to SEQ ID NO: 68

SEQ ID NO: 28136 - DNA, 93 bp, Homo sapiens; identical to SEQ ID NO: 69

SEQ ID NO: 28137 - DNA, 96 bp, Homo sapiens
tccatctagtcaataggtaagctgagtttagattttgttgttattacgtttatcttatgaagcttagtttagcagaatatgaaattctaggttgga

SEQ ID NO: 28138 - DNA, 62 bp, Homo sapiens
gagtacatgtatacgtatacgtatacgtatatgtatatgtatatgtatatgtatatgtactc

SEQ ID NO: 28139 - DNA, 95 bp, Homo sapiens; identical to SEQ ID NO: 580

SEQ ID NO: 28140 - DNA, 93 bp, Homo sapiens; identical to SEQ ID NO: 69

SEQ ID NO: 28141 - DNA, 71 bp, Homo sapiens
ggcagagagagagagagagagactgctgatgtgaaatttcagccgccgttttcattcattttctaacagcc

SEQ ID NO: 28142 - DNA, 68 bp, Homo sapiens
tgttactgtctttgtctgtgttagtgaagtgttcagacatagaaaaatgaccagatagagcagggata

SEQ ID NO: 28143 - DNA, 76 bp, Homo sapiens
tgtatgcatatcatatgttatttatccattcatctaagtttgcctggatgtcttggccattgtgaatggtgctaca

SEQ ID NO: 28144 - DNA, 95 bp, Homo sapiens; identical to SEQ ID NO: 68

SEQ ID NO: 28145 - DNA, 93 bp, Homo sapiens; identical to SEQ ID NO: 69

SEQ ID NO: 28146 - DNA, 91 bp, Homo sapiens
gggtgagtcaggagactggggtgagtcagcagactggggtgagtcagcagactgcgtggggaagacagaccctcagtgtggccagccatcc

SEQ ID NO: 28147 - DNA, 115 bp, Homo sapiens
catagagtatgttcaggctacaaatcttgcaaatgctggcttttgtttgtgaatgaacacaagagattttgttccactctgcatttgtaacaaggttccagagcagccattcttg

SEQ ID NO: 28148 - DNA, 117 bp, Homo sapiens
cacccagagtgtgcatgagatgagaggtgaatctgccaacctcacttccagtgcctctgagtgcctctgtgagcctggtgcaggactgaccaggatcctgctggttaaagaaactta

SEQ ID NO: 28149 - DNA, 71 bp, Homo sapiens
tctgctggccagctgagaaactagggctgtcattttagtctgtgtctcagtttctttcttggtaaagttga

SEQ ID NO: 28150 - DNA, 92 bp, Homo sapiens
cctttagaactgaaagctgccaggatataaagatattttctttgctgattttgagaatttcttattctgaggcgctgagtagctctgcatgg

SEQ ID NO: 28151 - DNA, 115 bp, Homo sapiens
gtatagtcagtctctgtcagccctggtttcctcatttgtaacatgggataatggtattatttaatttttgatgttactaagagaattgaatggcataacaggcaaaaatggcttc

SEQ ID NO: 28152 - DNA, 98 bp, Homo sapiens
atatatgtatgtatgtatgtatgtgtgtatacaaaccccctcacaacacccctatattttatattgtattttatatatacatatatagtacatatata

SEQ ID NO: 28153 - DNA, 88 bp, Homo sapiens
gggtcacaagggggttgtccttgcagagtgaacacagagtggctacgggaggcagtctttgtagtattaagaggatgaggtgacccct

SEQ ID NO: 28154 - DNA, 80 bp, Homo sapiens
agggtgttaataacagagaaaactgagtgtggagtatatgagaactctccactatctttttttgttaaattggaaactct

SEQ ID NO: 28155 - DNA, 110 bp, Homo sapiens
tgggtcattgttcttgtgaaagctcccatatacaagtaaaacttacaaaataaaatatgtatgtttttctcctattaatctgccttatgtcagtttcatacttagaccca

SEQ ID NO: 28156 - DNA, 98 bp, Homo sapiens
atgggattatatatatttcattagatcatatatatcattatatcatatatcatatgattcatatatatgaatatgatatatacatatatttatctcat

SEQ ID NO: 28157 - DNA, 114 bp, Homo sapiens
ttatttttatttttattccattgtggtgagagaaagagcatattatttcaatttctttgaatgttttaagacttgttttttttggcctgacatatggtctatccttgagaatga

SEQ ID NO: 28158 - DNA, 71 bp, Homo sapiens
gcttctcaaatgtgatctctgtgctcatcctacagaggtgagagacacagtgactcattaaactcctaagc

SEQ ID NO: 28159 - DNA, 103 bp, Homo sapiens
tatttaggagtggaactgctgggacatatggtaagtgggtatttatttttataagaaacatcctccaaagttcctgtatccttttgcatttccaccaaaagtg

SEQ ID NO: 28160 - DNA, 74 bp, Homo sapiens
ggcatgaccactggggagttgttgagacacagatccgtggatgctccctctcagagactctgatccagcaggcc

SEQ ID NO: 28161 - DNA, 116 bp, Homo sapiens
ataataaagtaagctagataaatataaatatttatataaattatatttatatttttaaattatataagtctatataaattatataatatttatatttatctagcttacttaattat

SEQ ID NO: 28162 - DNA, 84 bp, Homo sapiens
aaggatgtatatgtgtacatatgttgatatatatacaaacacacgtacatgtatgtatatgtgtgtgtatactaacatgttctt

SEQ ID NO: 28163 - DNA, 110 bp, Homo sapiens
aactggaaataggaacatttgaaagctgatatgtgaattgttgctatattttaatatatctctaaacaattcataaagtttgtgacaaaagttgacacccccttacagtt

SEQ ID NO: 28164 - DNA, 77 bp, Homo sapiens
ttatatatgtgtgtgtatatatatgcatatgtggacatagctggtgaatatatatatattatctaatacatatataa

SEQ ID NO: 28165 - DNA, 82 bp, Homo sapiens
atacacacacatatataatgattttttttacatcctgaccaaatatcatgtttgtgtctctgtgtgtgtgtgctgtgtgtat

SEQ ID NO: 28166 - DNA, 68 bp, Homo sapiens
ttatgtgtatatgtgtgtgtgtatatatatatatatatatatatacacacacatacctatatatatga

SEQ ID NO: 28167 - DNA, 113 bp, Homo sapiens
tacaaataaagctgctatgaacaaatgggtatcagtttttgtgtggacctaaatttttatttttctgtgataaatgctgaggaattcatttgttgaatcaatcagtaagtgta

SEQ ID NO: 28168 - DNA, 95 bp, Homo sapiens; identical to SEQ ID NO: 68

SEQ ID NO: 28169 - DNA, 93 bp, Homo sapiens; identical to SEQ ID NO: 69

SEQ ID NO: 28170 - DNA, 85 bp, Homo sapiens
gctatatatgtatttgtatatacgtgtatatatatgtatatgtacatatatatttatgcatgtgtatatatttatgtgtgtatgt

SEQ ID NO: 28171 - DNA, 95 bp, Homo sapiens; identical to SEQ ID NO: 68

SEQ ID NO: 28172 - DNA, 93 bp, Homo sapiens; identical to SEQ ID NO: 69

SEQ ID NO: 28173 - DNA, 95 bp, Homo sapiens; identical to SEQ ID NO: 68

SEQ ID NO: 28174 - DNA, 93 bp, Homo sapiens; identical to SEQ ID NO: 69

SEQ ID NO: 28175 - DNA, 67 bp, Homo sapiens
atataataatacatcaacatatatatacatatatatgttgtgtgtatatatgtgtgtgtatgtatat

SEQ ID NO: 28176 - DNA, 109 bp, Homo sapiens
ctatgtttatatatgtatgcatatgtagaaatgtgtgtgtgtatatatatatatatatatagtgtgtgtgtgtgcaggtgtgtccacagatacatatatactatatatg

SEQ ID NO: 28177 - DNA, 80 bp, Homo sapiens
aggctctctgactgactccttcccagatcgtctcagcttagcggctgaagactgacgcgggctgatctcctcagaagcct

SEQ ID NO: 28178 - DNA, 72 bp, Homo sapiens
tccccctctgtgtgtgtctgtgtccttatctcctctccatataaggacacgtgggattgcagtcatgtggga

SEQ ID NO: 28179 - DNA, 112 bp, Homo sapiens
aggagtgtaaagaaaacaaatggacattttcctgaggcagctgagctatacaaaacacaggcatctttgtctccttcttgaaaacttccacaatgcgttctcctttcttcct

SEQ ID NO: 28180 - DNA, 105 bp, Homo sapiens
gcatggtggcatgtacctgtggtcccagctatttggcaggctgaggtaggaggatcgcttgagcctgggaggtggaggctacagtgagcctgattgcacgactgc

SEQ ID NO: 28181 - DNA, 131 bp, Homo sapiens
agatatatatatatgtctatatatgtatatatgtatatatatgtctatatgtctatatgtatatatgtctatatgtatatatgtgtgtgtgtacatatatatatatatatatatatatatatatatatata

SEQ ID NO: 28182 - DNA, 78 bp, Homo sapiens
gtttttgttgttttgagatggagtctcactctgtcacctagtctggagtgccgtggctcgatctcggctcacagtaac

SEQ ID NO: 28183 - DNA, 113 bp, Homo sapiens
ggcagcagggtagaggaaggaataaaaaaagggtagaaggctcacactgactgtctttctaggaagctccccaggagcttactaccaatattttgtttatatcctgtcaggtc

SEQ ID NO: 28184 - DNA, 76 bp, Homo sapiens
agcctgggccaatctgctggaatatgtggcgctctctcgctcactctctctcacatgcaaacatatggccccagct

SEQ ID NO: 28185 - DNA, 78 bp, Homo sapiens
gccacttctccaagcttgatctgactctgcctctgcctctgagctcagtgggcttgcaagagaaggtcaccagtgggc

SEQ ID NO: 28186 - DNA, 162 bp, Homo sapiens
atacatatacatatatatgtgtatatatatgtttatacatatagatatgtatgtgtgtatatatatgtttatacatatatatgtatgtgtatatatatgtttatacatatacatatgtatatatatgtttatacatatgtatgtgtgtatatatgcttatac

SEQ ID NO: 28187 - DNA, 104 bp, Homo sapiens
attcagaagtctccgttactaatggacagagtagtccactcctggaagatagtcttagagtgttgcacctgggatcattggtgtgatgcgacgaatcagtgaat

SEQ ID NO: 28188 - DNA, 107 bp, Homo sapiens
gatttgccttctctggacagtggacagttcatataaatggaatcatatgatgtatgatcttttgtgtctgacttcattcacttagtataatgtttttgaggttcatc

SEQ ID NO: 28189 - DNA, 113 bp, Homo sapiens
cacctgggaggattaagggggtggggcaatgagtagaaccaaagaatattcctttttatttttttttaatttatttttttctgagacaggggcttgctctgttgcccaggctg

SEQ ID NO: 28190 - DNA, 130 bp, Homo sapiens
tcctgtgatgtcctgaggtttcatttcagtgtgtttgtttgtttgaattagagagaagccagagaggtcatctagggggccacctggctggtcagactggtctcccaggggcactaccaaagtgagtctc

SEQ ID NO: 28191 - DNA, 99 bp, Homo sapiens
atgacatgattccattgtctttgtgctttgttatttctgacagaggtctgctgtcagactatagtcattttgtagtagatgagctatctttcatttcat

SEQ ID NO: 28192 - DNA, 83 bp, Homo sapiens
ggagtctcgctctgtcacacaggctggagtgcagtggtctgggctcactgcaacctccacctcccgtgttcaagcaattctcc

SEQ ID NO: 28193 - DNA, 76 bp, Homo sapiens
gtggtccttcctctgtgtatgtctgtgtcctaatttcttcttataaggacaccagttgtattggatgaggacccac

SEQ ID NO: 28194 - DNA, 95 bp, Homo sapiens; identical to SEQ ID NO: 68

SEQ ID NO: 28195 - DNA, 93 bp, Homo sapiens; identical to SEQ ID NO: 69

SEQ ID NO: 28196 - DNA, 100 bp, Homo sapiens
acagactgagagaggatattcaccatacctgtattagacaaaggacttgtataactttttttttttttttttttttgagacagggtctctttcattctgt

SEQ ID NO: 28197 - DNA, 95 bp, Homo sapiens; identical to SEQ ID NO: 68

SEQ ID NO: 28198 - DNA, 93 bp, Homo sapiens; identical to SEQ ID NO: 69

SEQ ID NO: 28199 - DNA, 58 bp, Homo sapiens
gttggcttctaatctgtctggcttaaaagctcttttgagtgatgacagataggtgaac

SEQ ID NO: 28200 - DNA, 91 bp, Homo sapiens
tgcagagcttcaaaacacagtttttaattttttgtgattccaagtcagccgagtgagagaaaatttggaaacattagtttggagatttgca

SEQ ID NO: 28201 - DNA, 99 bp, Homo sapiens; identical to SEQ ID NO: 3220

SEQ ID NO: 28202 - DNA, 61 bp, Homo sapiens
tttttttgagacggagtctcactctgtcaccaggctggagtgtgatctcggctcactggaa

SEQ ID NO: 28203 - DNA, 95 bp, Homo sapiens; identical to SEQ ID NO: 580

SEQ ID NO: 28204 - DNA, 93 bp, Homo sapiens; identical to SEQ ID NO: 69

SEQ ID NO: 28205 - DNA, 109 bp, Homo sapiens
ggaacaatacaagtactccctcatgttaattgctgtgaggattcaatgccatattgcttgaaaagttcttgcagtaatgcttatacatggggaaagattaataagtttt

SEQ ID NO: 28206 - DNA, 82 bp, Homo sapiens
agcattttatatcaattatcttttttctttgttacagggatcctgcaatagacagaagaaagataattccctgggaagtgct

SEQ ID NO: 28207 - DNA, 110 bp, Homo sapiens
tgaggtaactgtagattcagatgcagttgtaataatttgtttgtatgtgtgcatgtgtatatgtttatttagttctatacaattttatctgacgtacattggtgtattca

SEQ ID NO: 28208 - DNA, 116 bp, Homo sapiens
agaatcagaaactccatgtgtgggcccagcaatcttttaatatttattttttattcatttgttatgaattgacaataattgtgtatatttatggggtaatatgttatttttgatct

SEQ ID NO: 28209 - DNA, 91 bp, Homo sapiens
gttaaaagcagaactaagaggccatgtcaaggtgaggaggcagtcacgctctctgtgtccttggaaggtgtttcagaatttgtttttctgc

SEQ ID NO: 28210 - DNA, 129 bp, Homo sapiens
tgcctgagatatgtttatgtacttatatgttatgtgtacatgtatgtacccacataatattatgtatatatatatgcactaatatacatgtgcattacaaaaggtacataccccaaaacaatttttaag

SEQ ID NO: 28211 - DNA, 116 bp, Homo sapiens
aggatgttcttttcttccctgtgtaccactgtgggagtatagtctggaggccagtgctttaacttttttttaattatactttcttctggtactgctgggagccaagatggtatttt

SEQ ID NO: 28212 - DNA, 133 bp, Homo sapiens
cattgcttgagtgttagcttcctgccaggtactataacaaatgcatgtgaactttgttttcaagtgtttgtgttgttttgaaaggagactagcatgcaaactaatgatctcaatacacagtgctaccttctgc

SEQ ID NO: 28213 - DNA, 96 bp, Homo sapiens
ttgtgctataattaaggactaggtaggggaggaatgggtgggagaaaatgagaaaggtgagtttctctctctttcatagtcccaagattggcacag

SEQ ID NO: 28214 - DNA, 105 bp, Homo sapiens
gtgtgagaatgacttagttgctaccctacagttataattttctagcttagtttaatttaaattctgaatatgttattgtcaaaatgcaaggggttttgtttacac

SEQ ID NO: 28215 - DNA, 119 bp, Homo sapiens
ctttgaccgtctttacctaaagattaggttaaaatttgagtgagaacgcattctctctgcatgatttctctgctctacaaatgttttaactgcctctttgaaggtggagaagtcatggt

SEQ ID NO: 28216 - DNA, 98 bp, Homo sapiens
aagtgtttttgtatgtgtatgtgtgtatacatgtatgcatatatatatatatatatatatatatatatatatatatatatatacatatacacacattt

SEQ ID NO: 28217 - DNA, 65 bp, Homo sapiens
tgagcctatgtgtgtctctgtatgtgagatgggtctcctgaatacagcacactattgggtcttca

SEQ ID NO: 28218 - DNA, 74 bp, Homo sapiens
tttacattcagggttagcaatgatatgtcagattttgattctctcattgtgttgttagctggttggtatgtaga

SEQ ID NO: 28219 - DNA, 74 bp, Homo sapiens
tatttacagagcatttcctatgcaccaggcaatgtataaagcacattgcctattgtatgtaatgtatagaaata

SEQ ID NO: 28220 - DNA, 95 bp, Homo sapiens
atatatatgatatatatctatatatatcatatatatccatatatatgatatatatctatgtatatcatatatatccatatatatgatgtatcata

SEQ ID NO: 28221 - DNA, 114 bp, Homo sapiens
cttggctggaaagtgaaaaatggttttgttcatagctagaaggctgggcttgacttaatctctctcattctccctgtgtgctcaggacctttccacacactctctctagcagag

SEQ ID NO: 28222 - DNA, 313 bp, Homo sapiens
gtatacatatgtatatatgtgtatatatacatatatgtgtatatatatgtgtgtatatacatatatgtgtatatatgtgtgtatatacatatatgtgtatatatgtgtatatatacatatatgtgtatatatgtgtgtatatatacatatatgtgtatatatgtgtatatatgtgtgtatatatacatatatgtgtatatatgtgtatatatacatatgtgtgtatatatacatatatgtgtatatatgtgtatatatacatatatgtgtatatgtgtgtatatatacatatatgtgtatatatacatatatg

SEQ ID NO: 28223 - DNA, 77 bp, Homo sapiens
gtgtatatatacagctatatgtatatatatatacacaaaaattatatgtatatgtgtgtatatatatatatacttgc

SEQ ID NO: 28224 - DNA, 145 bp, Homo sapiens
ttatatacatatagaaagaatatatatattctttctatatgtatatagaatatatatattctttctatatgtatatagaatatatatattctttatatacataaagaatatatatattctttatatacatatagaatatatatat

SEQ ID NO: 28225 - DNA, 144 bp, Homo sapiens
tgtataaacacaacatatatatatataaagaatatatatatgtttttatatatatacatatataaagaatatgtatatgtttttatatatacaaagaatatgtatgtttttatatatacatatataaagaatatgtatgttttt

SEQ ID NO: 28226 - DNA, 66 bp, Homo sapiens
ccttgactgggaatttactttctgcctctaaaatgccatgagagtagagagagagaacagcaatgg

SEQ ID NO: 28227 - DNA, 104 bp, Homo sapiens
gtggcccccaattcatggtttctctctactctcctgatatatatatatatacttggacgtaaagataggaacaataggcactggggagtacaagaagagggagg

SEQ ID NO: 28228 - DNA, 118 bp, Homo sapiens
cagaactaggaatgactgaggtaagctgtgttgtggctttgcctgctgtgagtactgactgtccactcacgttacatgcagtaattggacatatgccttgaagtgaactccgctgctg

SEQ ID NO: 28229 - DNA, 112 bp, Homo sapiens
ctgatacataaagaaagttgtaggaggctggagagggatgaataaaaaactgtatttttatttctaggaaaaaagtagagttctttccaaactacctttctttttgtgttag

SEQ ID NO: 28230 - DNA, 77 bp, Homo sapiens
catgtaattgaaaagtccaagggtagagctgggttgagcataactggatcctctgtctgcctgtctgtatctgcgtg

SEQ ID NO: 28231 - DNA, 97 bp, Homo sapiens
gtttatatatctctctatatatagatgtatatatatctatagatatttatatatatctatatatagatatatatatagatatctatagatatctata

SEQ ID NO: 28232 - DNA, 76 bp, Homo sapiens
gtttattttgtatatatattgtatatgtatatgttgtatatatatgtactatatatggtgtatatatagtatatat

SEQ ID NO: 28233 - DNA, 81 bp, Homo sapiens
ttcctattcggccatcttgcctgggaatctgtaattatattttattgcatattcttcctaggctgggtgtgtgtgtgtgaa

SEQ ID NO: 28234 - DNA, 116 bp, Homo sapiens
agcccaatattttgaatatttatctaacaagccaactaaaaaaaagtaaattaaaatttacttttaatttataaaaatcaagtatattggttgtaagactgtggggtaactgggct

SEQ ID NO: 28235 - DNA, 106 bp, Homo sapiens
gctaaatagcatatagtagttctcttccgccttccctggcactgactcactgactctttaggagtggtcatggatctgaaagaaatgcttcttgtttctcctaagc

SEQ ID NO: 28236 - DNA, 113 bp, Homo sapiens
gagcgcgtgcagagacttggtagtgcataatggatatatatatatgtgtgtgtatatatatacatatatacatatatatatttttttgagatagagtttcgctcttgttgttc

SEQ ID NO: 28237 - DNA, 115 bp, Homo sapiens
cttcctcttcattatataaaaagtgggtctattcacaatggtcagactttatttatatttaaagaggttatagaaatggattggcaagttatggactgggagtgaaagaaggagg

SEQ ID NO: 28238 - DNA, 110 bp, Homo sapiens
attagtatataaacatgtaatgtatatattgataatacataatactagtaaatgtactttgtgtatatatttatattcaagtacattatttttgtatgtatttatctaat

SEQ ID NO: 28239 - DNA, 77 bp, Homo sapiens
gggtggtccctgaggtggcctgcacaggaagcccctgggttgggttttaatgtgctcactcacacactcactcactc

SEQ ID NO: 28240 - DNA, 69 bp, Homo sapiens
tctttatatatatgtgtgtgtatatatatatgaaacatatatatatgaaatacatatgtgatatataga

SEQ ID NO: 28241 - DNA, 85 bp, Homo sapiens
atatatatgtttctcatatataggtttcatatatatgtttctcatatataggtttcatatatatttctatatatcacatatgtat

SEQ ID NO: 28242 - DNA, 93 bp, Homo sapiens
gatttgtcctagaggatgaggttttagcccctgtcattgtcactctatcttatgtggggcttagaatctcatcaaatttttctttgatgcttc

SEQ ID NO: 28243 - DNA, 117 bp, Homo sapiens
caaaaacctttttgtgcaggttcaagtgcaagattagatactaatttgattctttatagtatagacagtctttaacacagcactgagatatgggcttatctagagagactgtttttg

SEQ ID NO: 28244 - DNA, 117 bp, Homo sapiens
ggcatttttaggacaaattggattgtggatataaaccttagtgttattagagaaaaaagttttttttttttccttttcataggaaaaattcatgttaattattcctctgcacctgcc

SEQ ID NO: 28245 - DNA, 166 bp, Homo sapiens
taatgttataaacatatgtatgtttaattatgacatttaatattatattgttacattagcattatatatttatataattaaacatttatatgtttaattataatgttacatgtttatataattaaacatatatgtttgattatagcattatatataatatgtaaca

SEQ ID NO: 28246 - DNA, 116 bp, Homo sapiens
gatttctatgtaactcacttaagaagtaagtcatgaaataacagtgcggtaattttgtgttttataattttttgttatctgatatttcaagctggcttcttacctgcaaaggtttt

SEQ ID NO: 28247 - DNA, 94 bp, Homo sapiens
gggatagcatacagcggtggcatgggcctggggatgacagactgagcagagagacctggttactgggggacaggctcagtggcagtgtggtcct

SEQ ID NO: 28248 - DNA, 115 bp, Homo sapiens
gaatgattttagtcttgtgctattgtttggagagaaactgtatttcattttttaaaagttgcctgcatttcttacataacttttccaaaagactaaagaagaagaaatgttattc

SEQ ID NO: 28249 - DNA, 86 bp, Homo sapiens
gtgtgtgtgtgtgtgtgtgtgtatatatatatgtgtgtgtgtgtgtgtgtatatatgtgtgtgtgtatatatatctgtatgtatat

SEQ ID NO: 28250 - DNA, 118 bp, Homo sapiens
catttgtgtatcttctttggagaaatacctgttcaagtctttttctcatttaaaaaaatatttatttttgttattttaatagctttggcggtacaagtggttttcagttacatggatg

SEQ ID NO: 28251 - DNA, 110 bp, Homo sapiens
ccagttttcattattgtttaaacaatttttaatggacaaataaacattatatatatttattgtatacaaaatgatgttttgaaaatatgtatttagacattgaggaatgg

SEQ ID NO: 28252 - DNA, 276 bp, Homo sapiens
gcagtgtatatatatatatatatatatatatatatatatatactgtgtgtgtgtatatatatactgtatatatatatatactgtatatatatatatactgtgtgtgtgtatatatatactgtatatatatatatactgtgtgtgtgtatatatatactgtatatatatatatactgtgtatatatatactgtatatatatactatatctatacatatatatactatatagtatatatagtatatatatactatatatactgtatatagtatatata

SEQ ID NO: 28253 - DNA, 101 bp, Homo sapiens
gtatatatagtatatatatactatatatactatatagtatatatatgtatagatatagtatatatatacagtatatatatacacagtatatatatatatac

SEQ ID NO: 28254 - DNA, 95 bp, Homo sapiens; identical to SEQ ID NO: 68

SEQ ID NO: 28255 - DNA, 93 bp, Homo sapiens; identical to SEQ ID NO: 69

SEQ ID NO: 28256 - DNA, 158 bp, Homo sapiens
gcagggagagaagagtggtaatcgcagtgggtcttatactttccggatcaagattagaggctctgctctccgtgttcacagcggaccttgatttaatgtcatacaattaaggcacgcggtgaatgccaagagcggagcctacggctgcacttgaagga

SEQ ID NO: 28257 - DNA, 88 bp, Homo sapiens
aaacattgattttttttttttttggtataagtatgtcccaaatattgaatgggatgtacttcactaaaaaaaaaaaagaaaaatgttt

SEQ ID NO: 28258 - DNA, 109 bp, Homo sapiens
aaaagacagcatgatgtagtagaaagagctcatatgcagaaaagcttggtgtgttactagcttgattactgatcaatagagagtttttgtttgattttgcctgtttttt

SEQ ID NO: 28259 - DNA, 98 bp, Homo sapiens
agacttagtctgtctgttactcagtccgcccacaaacaaatatttatttgtttctatagatattggagttaaaagtatgaacaagtcagacagagtct

SEQ ID NO: 28260 - DNA, 105 bp, Homo sapiens
gagaaggagaatctccttggcactggagttcctgtttcctgatacctgaggtctgttagagctgtctactctctctgccaggtttattttttccagtaaattctc

SEQ ID NO: 28261 - DNA, 102 bp, Homo sapiens
tgccatgtgacatcagcctgctaatgaacttaagaaagtttatgattttttagatctggattttttttttcatttttaaagtgggagtgacattctcttgca

SEQ ID NO: 28262 - DNA, 115 bp, Homo sapiens
ctctcagtggattcgcttttccagagctgttctcaagcaaagttgtcatttttgccaaactttgtttttactttttagactgttctgaaagagataaattgaaaaacacagagag

SEQ ID NO: 28263 - DNA, 115 bp, Homo sapiens
ttattttgattattgccactgttcttagaatgacatggcagataaagaagtactctcaataattttttatctgtattgcaaaatggaatagagattgtgccactagtagacttaa

SEQ ID NO: 28264 - DNA, 113 bp, Homo sapiens
acgagaatttaaaatgatggggctgtttgtgatctagaaaatagtgtgtatttttttctttcaaaagatagaaggttttatgcagatcagagcaaacttatatgtgaattagt

SEQ ID NO: 28265 - DNA, 95 bp, Homo sapiens; identical to SEQ ID NO: 580

SEQ ID NO: 28266 - DNA, 93 bp, Homo sapiens; identical to SEQ ID NO: 69

SEQ ID NO: 28267 - DNA, 98 bp, Homo sapiens
gaattaagtatttctatatatgactgatctatgactttgtttctaattttttttaggacattaaggcagttcatagtaatctgtatattatttgattc

SEQ ID NO: 28268 - DNA, 86 bp, Homo sapiens
ctaagtcttggtttctctctctctctctgtaaaagaggataatgataaaaatctgtttcagagggtggctgtagagattaaattag

SEQ ID NO: 28269 - DNA, 100 bp, Homo sapiens
atcttataaaaaccaaaggacatgataaagagagtgctttgtgcttaatgttttgagattttttttttttggcatggactttgcaacatcaaattaggat

SEQ ID NO: 28270 - DNA, 126 bp, Homo sapiens
aaatatgaagcttagtttgaaaggtatttatttttataaggtgctttatgtttatatattatatataagaatataaataaaatatatttatatgtactttttatacaatttatattttacaaggtg

SEQ ID NO: 28271 - DNA, 116 bp, Homo sapiens
ggtgatctcttttgtgtagagacaggaattgccctttttcagatgagagacaacagagatactggtttgttagtctttttgctttcctgtctgtctgtgcaaatgtatgtcttacc

SEQ ID NO: 28272 - DNA, 86 bp, Homo sapiens
gcggatgcattttgttggatgataattgatatatgtatgtatatttgcatacatatgtatcaatgtatagatatctatgtgtgtgt

SEQ ID NO: 28273 - DNA, 89 bp, Homo sapiens
gcagtccaaaatattgcagtaaactgacagccactctgtctcttccaagagaaaacaaattgagtgctttccgtcactgctgggacagc

SEQ ID NO: 28274 - DNA, 58 bp, Homo sapiens; identical to SEQ ID NO: 1673

SEQ ID NO: 28275 - DNA, 116 bp, Homo sapiens
gtgactgtttatgtctttgctcactttttaatggggctgtttgtttttttcttgtaaatttgtttaagttccttgtagattctggacattagactttcatcagatggatagattgc

SEQ ID NO: 28276 - DNA, 113 bp, Homo sapiens
tggtaaaatgttataccttgatgaagacttgaactgggaaggtaaaaaatttgaaaaatttttttttctctttctaaggtttttaaggatttggggattataaaagtttctca

SEQ ID NO: 28277 - DNA, 115 bp, Homo sapiens
tagtatattacatttattgatttatgtatgttgaaccatccttgcattacagtgattaattctatttgattatagtgaaggatcctttcaaagtgctgttgaatttggtttgcta

SEQ ID NO: 28278 - DNA, 81 bp, Homo sapiens
tgttgtacttgtagacctggtctggtgagaaagatcacagactcactggctctccctggactcaagatctcctagatgaca

SEQ ID NO: 28279 - DNA, 115 bp, Homo sapiens
atattcagaatggaaaggatataattgatggaacaaggagcaatccttattttattatttcttagaatagggacattttctaaatagtcatcatcttgcatttgttattgaatat

SEQ ID NO: 28280 - DNA, 94 bp, Homo sapiens
acttcttcaggaaagtatgaagacactctctttctgtctttgggggaagttggggtagaaaaatagaggtcactgtggttcatcaggaagaagt

SEQ ID NO: 28281 - DNA, 65 bp, Homo sapiens
tggatgtgtgaggccggaaagggcggtgctgggctgatttctcagtctctccctctccattccca

SEQ ID NO: 28282 - DNA, 76 bp, Homo sapiens
gttgtacaatgcttaatgtgtatatatgtatgtatatatacattatgcatccatatatacataagcattgtacaac

SEQ ID NO: 28283 - DNA, 70 bp, Homo sapiens
ttgtttaagtcactgagcacacaggcaaatctcttatgatgaattgccgtgagcgccaggagcaaaacag

SEQ ID NO: 28284 - DNA, 100 bp, Homo sapiens
tgccaagatggagttggttagatcatcagatgtctctcactgtcataattttctctgttatgatttttgcaaatgtgatttcacctgcatttccaaggca

SEQ ID NO: 28285 - DNA, 104 bp, Homo sapiens
ttgtagggagatagaaaagtgaacatatatattcatgtatatatatgaaaatcaggatatataatgaaatatgaaccatttatgtttgcctttcctctctatga

SEQ ID NO: 28286 - DNA, 79 bp, Homo sapiens
ttgtagggtgccaggcagatatcactgtgctgagggagacctaaagttagtgttagaatggcgtcgctggacccaacaa

SEQ ID NO: 28287 - DNA, 81 bp, Homo sapiens
atatatatatatatatatatatacacgatatatatacacacacacgtatatgataatatatgtatgtatgtatatgtgtat

SEQ ID NO: 28288 - DNA, 89 bp, Homo sapiens
ctcttatgttcttaggcctttagatttcaagagttaccctctttctctctctgaaatttttgactaaggaatgctggataccatgagag

SEQ ID NO: 28289 - DNA, 116 bp, Homo sapiens
cctgtttgcatgttgcttgtgacataagcaaatcatggcatagaattattattattattattattttttttttgagacggagtttcgctattgttgctcaggctggagtgcaatgg

SEQ ID NO: 28290 - DNA, 60 bp, Homo sapiens
tgacggggtgagcctggcattttcttttttttttttttgagacaggttctcactctgtca

SEQ ID NO: 28291 - DNA, 82 bp, Homo sapiens
ctgggcctttatgattctgcagacactttaatgagccaccctgagaacagggtggctctctctttgccagagaaggtctcag

SEQ ID NO: 28292 - DNA, 91 bp, Homo sapiens
gctatttctctctttttttttttttttttttttttgagacagagtctcgctctgtcacccaggatggagtgcagtggcgcgatcttgctca

SEQ ID NO: 28293 - DNA, 109 bp, Homo sapiens
tcagtgtggggttcagggctgggcacagtagctaacatctgtaatctcagtgctttgggaggctgaggtaggaggatcatttgtggccagaagtttgagaccagcctgg

SEQ ID NO: 28294 - DNA, 58 bp, Homo sapiens; identical to SEQ ID NO: 2442

SEQ ID NO: 28295 - DNA, 106 bp, Homo sapiens
atgtcattgtctgcttttggattttcagcatttgattgctatgtatctaggtatagttttctttgtgtttttttatgtttggagttcgtttaacctgctttgacat

SEQ ID NO: 28296 - DNA, 105 bp, Homo sapiens
tttcagaatatattttcaatatcttccagcatttttagttgttttcagtggtagagttgtgtttctaaactagtccattgttggaaatggaagtattcttagaga

SEQ ID NO: 28297 - DNA, 170 bp, Homo sapiens
atgtatatatgcatgtatatatacaatgtatatatgaatgtatatatacatgtatatatgaatgtatatatacatgtatatatgcatgcatatatacatgtatatatgcatgtatatatgcatgtatatatacaatgtatatatgtatgtatatatacaatgtatataca

SEQ ID NO: 28298 - DNA, 58 bp, Homo sapiens
gtgatgaagtctcactctgtcacccaggctggagtgcagtggtgtgatcttggctcac

SEQ ID NO: 28299 - DNA, 95 bp, Homo sapiens; identical to SEQ ID NO: 68

SEQ ID NO: 28300 - DNA, 93 bp, Homo sapiens; identical to SEQ ID NO: 69

SEQ ID NO: 28301 - DNA, 62 bp, Homo sapiens
gggaggtagatgcagaagctgggagaaagcctgactgtctctgactcactctgcagcctctc

SEQ ID NO: 28302 - DNA, 103 bp, Homo sapiens
gatgttataaatagtttattgcatatccattcaagaaatttaggctaagtttatatattttaccttctgaaaggagaaagcctgtgtgtttatttaaagcatt

SEQ ID NO: 28303 - DNA, 95 bp, Homo sapiens
cctaaaatcctttcttcaggctattagtgagtagtgagtgaacatatttgattttggctactcggtgtagaggctgtcaaaagctatacagtagg

SEQ ID NO: 28304 - DNA, 104 bp, Homo sapiens
gttcgagtagctgtggacacagctgtggggtgttttcaagtggtcagtgaagtaagtctgctcttgtaaaatacagacaagtacagtatcaaaatagcgcgaac

SEQ ID NO: 28305 - DNA, 140 bp, Homo sapiens
atatttattatatatgtatgtatatcatatgtatatatgtatgtgtatatatatatatcatatatatttgtgtatgtatatatatcatatatatttgtatatatgatatatgtatatatagcatatgtatatatttgtat

SEQ ID NO: 28306 - DNA, 77 bp, Homo sapiens
cttagccaggcatgatgactcaggcctgtagtcccagctacccaggaggctgaggtaggaggatcacttgagccagg

SEQ ID NO: 28307 - DNA, 107 bp, Homo sapiens
ggagcaggagaactttgtaaattggaaagaagtctgtttttataatttatttttatttttaaagcttaaatgtagatatttatacgtatacagggtgcctagaagcc

SEQ ID NO: 28308 - DNA, 103 bp, Homo sapiens
ctggctggggacataagctgctggtgtttttttgttttttgttttgttgttgttgttttttttttttttttgagacggagtctggctctgttgcccaggctgg

SEQ ID NO: 28309 - DNA, 72 bp, Homo sapiens
gtgcagtggtgcaatcttggccctacaaaaagttttttttttttttttgattagctaagtgtggtggtgcac

SEQ ID NO: 28310 - DNA, 67 bp, Homo sapiens
caaggatattcccacactctctgaggctgtctggtgaccccagcagacacagtgagtgtggaccttg

SEQ ID NO: 28311 - DNA, 58 bp, Homo sapiens
tgggtcagcaggagtttaactttattttttttgagatggagtctcgctctgtctccca

SEQ ID NO: 28312 - DNA, 116 bp, Homo sapiens
tatcattgttaggttttagaatatgacaacagtacttgttatcactggtaaagttcactggacattggttactaatagcaagagtttgacagttctgcagataacagcataagata

SEQ ID NO: 28313 - DNA, 72 bp, Homo sapiens
ccaggtgtagtggtgcgcgcctgtagtcccagctacttgggaggctgaggtaggaggatcacttgagcctgg

SEQ ID NO: 28314 - DNA, 81 bp, Homo sapiens
gagatggagtctcactctgtcacccaggctggagtctcactctgttgcccaggctggagtgcagtggcgcgacctcggctc

SEQ ID NO: 28315 - DNA, 58 bp, Homo sapiens
tgagacagagtctcactctgtcatccaggctggagagcagtggtgtgatcttggctca

SEQ ID NO: 28316 - DNA, 104 bp, Homo sapiens
cttcctgggcaattgaaaaaacgggttacctcaaatctatagacaatatatggcaatattttatttacttatttagagatagtctccctctgtcacccaggctg

SEQ ID NO: 28317 - DNA, 74 bp, Homo sapiens
gctcctgaagttaggcagagtgaccagagagggcagacagcagtcctctgtccctggtctcctgtagcaagagc

SEQ ID NO: 28318 - DNA, 103 bp, Homo sapiens
gcatgtatgtgtgtgtgcataccatttcatatggcaaaaaatacttttatatttgttactatatatgggataatccaatgggcatatctataacattaaatgc

SEQ ID NO: 28319 - DNA, 58 bp, Homo sapiens
tgagtcacagtctcactctgtcacccaggctggagtgcggtggtgcgatctcaactca

SEQ ID NO: 28320 - DNA, 72 bp, Homo sapiens
agcaggaggggtggggctggtcatttctttcttttcttttttttgagacagtctcactctgtcacccaggct

SEQ ID NO: 28321 - DNA, 87 bp, Homo sapiens
ctgcaactttactgaatttgtatatcagttctaacagatttttggtggaatctataggattttctatgtataagatcatgttgtcag

SEQ ID NO: 28322 - DNA, 81 bp, Homo sapiens
ggagaaggttcaggggcctgactaaactttggccaagcagagaatctttgtcagaagagggtgagcaagccccgcttctct

SEQ ID NO: 28323 - DNA, 121 bp, Homo sapiens
ctgaatgtgacaggaagtgagctggggactggcacactccatctccgggctctcagtcactcagtgtgtgctggagttccatgtcagcatctccactcctcacacctgcttggcaagggct

SEQ ID NO: 28324 - DNA, 65 bp, Homo sapiens
atacatattttatatgtgatatatgatacatgtttatatatgtatgtatacatatatgtgtgtat

SEQ ID NO: 28325 - DNA, 76 bp, Homo sapiens
tatgtatttatatatgtacatgagtatatagtatgtataaaggtatacacaatgtgtacatttatataaatatatg

SEQ ID NO: 28326 - DNA, 94 bp, Homo sapiens
atattcaagtacacacacacacaaacacattatatacatatattaatatatatagtgtgtgtgtatatatatgtgtgtgtgtgtatatatatat

SEQ ID NO: 28327 - DNA, 82 bp, Homo sapiens
ttctgtggctggatgcagtgatttgtgcctataatcccagcactttgggaggctgaggtagaaggatcacttcagcccagga

SEQ ID NO: 28328 - DNA, 66 bp, Homo sapiens
gctgaggaacagcatgagaaagtgaagggacagtgggacttcagcttccatgccctgtctctgagt

SEQ ID NO: 28329 - DNA, 94 bp, Homo sapiens
ggaacatagtatgatcttaataaatatttgtaaataaataataacttgacatttttgtttctttatggatggctgatatggtttggctgtgtcc

SEQ ID NO: 28330 - DNA, 114 bp, Homo sapiens
tatatatttttttatatatttaataaaatggagacactatatatatgtacatatatatatatgtacatatatatagtgtcttcgtttacttgtgctgctttaagaaaatatgtg

SEQ ID NO: 28331 - DNA, 69 bp, Homo sapiens
agtaaacgaagacactatatatatgtacatatatatatatgtacatatatatagtgtctccattttatt

SEQ ID NO: 28332 - DNA, 105 bp, Homo sapiens
tccaaatgtatgcttgtgtttagctatcttcttgctgttgacttctaattttgttgcattatggtgaggaaattgtggtctggacaatgtcaatcgtatagtgga

SEQ ID NO: 28333 - DNA, 64 bp, Homo sapiens
gtagtctcagctactcatgaggctgaggtaggaggatctgttgagcccaggagtttgaggttgc

SEQ ID NO: 28334 - DNA, 65 bp, Homo sapiens
tgtgtgtatatatatgtgtattgtatgcttatgtgtatgtatatatacacatatgtgtgtgtgca

SEQ ID NO: 28335 - DNA, 95 bp, Homo sapiens; identical to SEQ ID NO: 68

SEQ ID NO: 28336 - DNA, 93 bp, Homo sapiens; identical to SEQ ID NO: 69

SEQ ID NO: 28337 - DNA, 67 bp, Homo sapiens
ggacagacatctctctgatctctttctgtcagagtcttccctgacattcagagatctcagactgtcc

SEQ ID NO: 28338 - DNA, 113 bp, Homo sapiens
gagtaggtgggactacaggcacccaccaccacgccctgctaatttttttttttttttttggatttttagtagaggctgtgtttcactgtgttagccaggatggtctcaatctc

SEQ ID NO: 28339 - DNA, 128 bp, Homo sapiens
tacatgatgtaaatgccatattgctgagaaagtcatcttctaattttgtatctgagtgtgtgtgtgtgcatgtgcatgtgtgtgtgtgtgtatgtgtgtgtagtaacataacaaaaccaaaaacaaaa

SEQ ID NO: 28340 - DNA, 56 bp, Homo sapiens
gtatgtgcgcatgtgtgtatgtatgtatgcatgtatgcatgtatgtatgtatgtat

SEQ ID NO: 28341 - DNA, 119 bp, Homo sapiens
gtcagaagccttctggaattcatttgctggttcactggagacttcagagtgctgtaagctgaaactgcttcaacaactgctatggttcttgtagtgtcagatgtgactgtggtgatggc

SEQ ID NO: 28342 - DNA, 73 bp, Homo sapiens
ggagagggtctcactgtgtcacccaaactgaaatgcagtggcaagatcacagcttagtgcagactcaacctcc

SEQ ID NO: 28343 - DNA, 58 bp, Homo sapiens; identical to SEQ ID NO: 1409

SEQ ID NO: 28344 - DNA, 115 bp, Homo sapiens
tgtcctatctcagtatcacattttagtaattctagcaatatttcaaactttttcattattatctgttttgatgagctgtgatctttgacattactattgtaattgttttagggca

SEQ ID NO: 28345 - DNA, 66 bp, Homo sapiens
gggtattctttgtctctctgtctatttcttggctttttcctagaagtcagacggatataaatactc

SEQ ID NO: 28346 - DNA, 116 bp, Homo sapiens
gtttgctctgttttatgggtgagtggaattctattctatagatatatcacattttgtttatttattcaactgctgatatgtgttggagttatttctagcttttgagtatagtaaat

SEQ ID NO: 28347 - DNA, 97 bp, Homo sapiens; identical to SEQ ID NO: 1307

SEQ ID NO: 28348 - DNA, 88 bp, Homo sapiens; identical to SEQ ID NO: 1308

SEQ ID NO: 28349 - DNA, 81 bp, Homo sapiens; identical to SEQ ID NO: 1309

SEQ ID NO: 28350 - DNA, 77 bp, Homo sapiens; identical to SEQ ID NO: 1310

SEQ ID NO: 28351 - DNA, 95 bp, Homo sapiens; identical to SEQ ID NO: 68

SEQ ID NO: 28352 - DNA, 93 bp, Homo sapiens; identical to SEQ ID NO: 69

SEQ ID NO: 28353 - DNA, 113 bp, Homo sapiens
tgggtctcaaccttggctgcaccttggaatctcctggggagatgagacaataccaaggctctctctcactcagcgtgatgtttccaagttccatccacatgtagtaggcacca

SEQ ID NO: 28354 - DNA, 82 bp, Homo sapiens
gcgatagagtgtgctaagtaaaggtgagctttgatcattgttttttgtttgtttgttttgagatggagtctcactctgtcgc

SEQ ID NO: 28355 - DNA, 109 bp, Homo sapiens
ttcattgattcaatacctaaccttgatggcaagaattccagtctctccctgtctccctggagtttttatgaagcctaaagtcttatacggtcccaaattggaaaatgaa

SEQ ID NO: 28356 - DNA, 77 bp, Homo sapiens
ggggaaagccggcagtcacaggcctcacccagctcccacacaaaccgaagggtcggtctcactcccactgtgtcccc

SEQ ID NO: 28357 - DNA, 84 bp, Homo sapiens
ttccatatatatatatatccatatatattccatatatatatatatccatatatattccatatatatatatatatatatatggaa

SEQ ID NO: 28358 - DNA, 72 bp, Homo sapiens
agggtagcttaacagggaaggagacataagaaccatctttgtgtgccagtctccctcactgaattgccccct

SEQ ID NO: 28359 - DNA, 113 bp, Homo sapiens
ggattttcttggctattcaggctctgttttggtttcatatgaattttaaaatagtctttttctaattctgtgaagaatgtcaatggcaggttaacgggaatagcactgaatct

SEQ ID NO: 28360 - DNA, 89 bp, Homo sapiens
ctgggtagatgtatacgatcatggccactctcttgggcccaccagttggagttggagaaggagggctcctgaagtgaagtgctggccag

SEQ ID NO: 28361 - DNA, 74 bp, Homo sapiens
gtcaaagccagttgttgctgtcctatcaatgctgctattgtacggctgacagatgacggtgagcatagcttgat

SEQ ID NO: 28362 - DNA, 77 bp, Homo sapiens
gcttgatagtttaacagctgtactttaagagtttggtttggctttgctctctgtgtcagtgtgttactgcagttagc

SEQ ID NO: 28363 - DNA, 73 bp, Homo sapiens
gtgttgggttttttggtgggtttttttttgttttttttttttttgagacaaagtctcactctgtcacccacac

SEQ ID NO: 28364 - DNA, 118 bp, Homo sapiens
gggctgagggttgtttatggaatgtttgtgtgttgtcttggtgctgtgttgacactattgagtgtctttatttttttatttatttatttatttttagagacagggtctctctctgtcc

SEQ ID NO: 28365 - DNA, 58 bp, Homo sapiens
tgagacggcgtctccctctgtcactcaggcaggagtccagtggcgtgatctcggctca

SEQ ID NO: 28366 - DNA, 117 bp, Homo sapiens
tggagtttatctgtaacttgaggatagtctctcccctgtctctctctatgtcagcattgttgtgaggatcaaatgaagtagtgaatagtgatttgttttgaagcttacttaacttca

SEQ ID NO: 28367 - DNA, 95 bp, Homo sapiens
ctcagagaccattcactaagggggccagttaagagagtgaactgagagctgtgctccggagtcagtttcttttcccagctctcactgactctgag

SEQ ID NO: 28368 - DNA, 95 bp, Homo sapiens; identical to SEQ ID NO: 68

SEQ ID NO: 28369 - DNA, 93 bp, Homo sapiens; identical to SEQ ID NO: 69

SEQ ID NO: 28370 - DNA, 72 bp, Homo sapiens
acatgactgtatgcatacacacacacacacatatgtatgtatgtatgtatgtatgtatgtatgtatgaatgt

SEQ ID NO: 28371 - DNA, 65 bp, Homo sapiens
tgagacagggtctcactctgtcacccaggctggagtgcactggtgagatctcagctcactgtctc

SEQ ID NO: 28372 - DNA, 71 bp, Homo sapiens
gcttggatgacagagcaagaccctgtctctctttttttttcttgagatggagtctctctctgtcacccagc

SEQ ID NO: 28373 - DNA, 57 bp, Homo sapiens
tgagacggagtctcactctgtcaccaaactggagtgcagtggtgccatctcgtctca

SEQ ID NO: 28374 - DNA, 105 bp, Homo sapiens
gggcgacggagtgagactctgtctgaaaaaaaccactttattactattcttttctttctttctttctttcttttttttttgagatggagtctggctccgttgccc

SEQ ID NO: 28375 - DNA, 118 bp, Homo sapiens
cccaaagtgctgggattacagacatgtgccaccacgcccggccttaaatttttttttctttcatagagacaggccctcactctgtcacttagtctggaatgcagcagcatgattgcgg

SEQ ID NO: 28376 - DNA, 111 bp, Homo sapiens
agtttgagaccagcctggccaacacggtggtggatgcctgttaccccagctacttgggaggctgaggtagaaggatcacttgagcccaggaggtcgaggctgcagtaagct

SEQ ID NO: 28377 - DNA, 73 bp, Homo sapiens
gagatggagtctcactctgtcacccaagctggagtgcaatagcacaatctcggctcacagcaacctccgcctc

SEQ ID NO: 28378 - DNA, 110 bp, Homo sapiens
gggtcaaggaaaggggccactctttggtatttctgtatttatttatgtgattgcactaacttcagacaagaaactgacaaaagaggagttttttaaaaactccttgagtc

SEQ ID NO: 28379 - DNA, 67 bp, Homo sapiens
ggcatagagtgcaggaagggcagtgggcactgtgcccatggctgtctgtctctcagtgttcttcgcc

SEQ ID NO: 28380 - DNA, 69 bp, Homo sapiens
tgttttggggggctgacaggggatgctattacctacttcctagtaatactgtcaggttttcacaagaca

SEQ ID NO: 28381 - DNA, 79 bp, Homo sapiens
ctatttataagctctgtttatgaagttcaaaggaataaactttttttttcttagaagtatgagtagagcattcaaatag

SEQ ID NO: 28382 - DNA, 112 bp, Homo sapiens
gtatctcctttttcgagaaatgcctgctcatatatctttgttcattttttactttttcaatttttattttagacacagaggatacatgtgcaggtttgttacatggatgtat

SEQ ID NO: 28383 - DNA, 111 bp, Homo sapiens
aatggaatcacacaacaggagccactatgcccagtcttgttattttctctttttttgattatagttatcctcatgggtgtgacatggtatcttgtagttttgatttgcatt

SEQ ID NO: 28384 - DNA, 73 bp, Homo sapiens
ccaggcatagtggtgcacacctgtagtcccagctacttgggaggctgaggtaggaggatcacttgaacctagg

SEQ ID NO: 28385 - DNA, 79 bp, Homo sapiens
ctcatcaatgaggacacagtgtaatctcagcactttggaaagccaaggtgggaggatcgcttgaactcaggagtttgag

SEQ ID NO: 28386 - DNA, 65 bp, Homo sapiens
tgctcctgccttgttttgtctcctctctcctgcatgtaacaagtgagagtagagattttggagta

SEQ ID NO: 28387 - DNA, 93 bp, Homo sapiens
acctttgtcagtttggggctttatctgtttctttttttttctttttttttttttttttttttttgagatggagtctcactctgtcgcccaggt

SEQ ID NO: 28388 - DNA, 92 bp, Homo sapiens
tagaatacacattattattgtatattattcttttctgtagtgaaattaaagggagaggggaatatagttagaattgcaaatgatgtgatcta

SEQ ID NO: 28389 - DNA, 116 bp, Homo sapiens
ttctggatattagccctttgtcagatcaattaaaattaagacagaccaattaaatataattatatttaattgatcttaattttaattgatccagataacagttcaaaataatagga

SEQ ID NO: 28390 - DNA, 58 bp, Homo sapiens; identical to SEQ ID NO: 1725

SEQ ID NO: 28391 - DNA, 67 bp, Homo sapiens
gtatgccacattttgtttatccattcattcattgatgaatggattgatgaatggatatttgggttgc

SEQ ID NO: 28392 - DNA, 114 bp, Homo sapiens
acacttacctatgtaacaaacctgcacatcctgcacatgtacccctgaacttaaaataaatttttttaaaagctcaggaaatgatagtggtgatggttgtataattgtgaatgt

SEQ ID NO: 28393 - DNA, 73 bp, Homo sapiens; identical to SEQ ID NO: 16159

SEQ ID NO: 28394 - DNA, 80 bp, Homo sapiens
tcacagtcacacacacacatacatacgcatatgcaggaggttaatgtggggtgtgtgtatgtgtgcatgtgtgtgtgtga

SEQ ID NO: 28395 - DNA, 58 bp, Homo sapiens
tgagacagagtctcgctctgtcaccctcgctggagtgcagtggtgggatctcggctca

SEQ ID NO: 28396 - DNA, 95 bp, Homo sapiens
gcatgttattttcaagttttgaatcattaaatattttgtttcatactttgcttgaaagtatgaggcaaatagttaatttgtcatgaagaagctgc

SEQ ID NO: 28397 - DNA, 70 bp, Homo sapiens
tatgtgtatatatatatgtgtacatatacatgtacatgcatgtgtgtatatatatgtacatatacatgta

SEQ ID NO: 28398 - DNA, 99 bp, Homo sapiens
gggtgacaagttgaccagtggtttttttttttttttttttttgagactgagtctcactctgtcgcccaggctggagtgcagtggtgccatctcggctca

SEQ ID NO: 28399 - DNA, 98 bp, Homo sapiens
tggcaagcatccattttctgcacagtgagaaaggcgtcattaaatatgttcattttatatgtacattctaaaacttgctgaaatccaagatgaagccg

SEQ ID NO: 28400 - DNA, 118 bp, Homo sapiens
gatagctagatctaggagcttgcttagttagattcagtttccttttctttttttttttttttttttttttttggccaagactttatagatggggtatatccttgagcatctagttgtt

SEQ ID NO: 28401 - DNA, 87 bp, Homo sapiens
ttgctgggatttttttattttttagagacaatgtctcactctgtcacccaggctagagtgcagtggcatgatcttggctcacagcaa

SEQ ID NO: 28402 - DNA, 81 bp, Homo sapiens
gtaaatatgtgtagatatatatgtatgtatatatacacacatatatgtagatttatatatatgtagattcactgtgtttac

SEQ ID NO: 28403 - DNA, 112 bp, Homo sapiens
gctttgtgtgagtaatgtgtggtttgttttctaagcacatgtggagtaataatatatttctgaatatttactttttatagcttgatatcacattcatatttaggaatactgc

SEQ ID NO: 28404 - DNA, 84 bp, Homo sapiens
gtaaataccgtgtgtgtgtgtgtatatgtatatatatatatatatatatatatatatatatatatatatatatatgacatttgc

SEQ ID NO: 28405 - DNA, 103 bp, Homo sapiens
cctgttaactaaaataccaataaatccccaaatgatacactgaagggtgtctgcacaccagattgtgtatgatagggagttgagtgtgtgtaggggtgggagg

SEQ ID NO: 28406 - DNA, 75 bp, Homo sapiens
tactcaagtatagcgaacagattgtaaactcaaatgtcagctctgccactgactgtctgtgtgtgactctgggta

SEQ ID NO: 28407 - DNA, 82 bp, Homo sapiens
agccactgagaagttgttctgtgtctctgactttctcacgtttaatcagtcagcccagtgaacagacttcgatctagtgtct

SEQ ID NO: 28408 - DNA, 106 bp, Homo sapiens
gagccttcttcaaacagactttagaagttgaaagcactggaaatctattctttacattcacagtttttatttcatattttacagtttgttgagggacatatggctt

SEQ ID NO: 28409 - DNA, 114 bp, Homo sapiens
ctaatagccccagtttttagtatttgtgacctttggatataatttttaaatttatacaaactgaattgtctttgggatatgcttttatgaagaactggatgtggaaattgttag

SEQ ID NO: 28410 - DNA, 66 bp, Homo sapiens
tgatgtgtggatatggtatgaaacgtagtgctgaggtctgcagaggttataccaacatccacttca

SEQ ID NO: 28411 - DNA, 61 bp, Homo sapiens
gcaatcataatgatgatgatgataatgatcctcctccttatcatcattgtcacgtcattgt

SEQ ID NO: 28412 - DNA, 118 bp, Homo sapiens
tcaggaaaatgtgtgtatcttcatgtgtgaataaatacaggatcctaatattttcttttaaaatattcatggatgtttgaatagttcagattcatttttaggctttctttttcactgg

SEQ ID NO: 28413 - DNA, 103 bp, Homo sapiens
gggattacaggtgtgagccactgcttctgaagttttattttttttatgactgtcctagtagatgtgaagtgatatttcattgtggttttgatttgcatgtttc

SEQ ID NO: 28414 - DNA, 78 bp, Homo sapiens
gtgtatatatgtgtatgtgtgtgtatatatatatagtgtgtgtgtgtatatatatgtgtgtgtgtatatatatatata

SEQ ID NO: 28415 - DNA, 58 bp, Homo sapiens; identical to SEQ ID NO: 1215

SEQ ID NO: 28416 - DNA, 72 bp, Homo sapiens
tgtttgtatgtatctctctctatatatgtgtatatatatatacctatatagatacatagatatataactaca

SEQ ID NO: 28417 - DNA, 58 bp, Homo sapiens
tgagatggagtctcactctgtcacccaggctggagtgcagtggcgtgacctcggctca

SEQ ID NO: 28418 - DNA, 112 bp, Homo sapiens
atactatattatactagtatattattactagtagtattatatactagtatgtaatatagtatatatactagtataatactctagtatatagcatagtatacatactagtata

SEQ ID NO: 28419 - DNA, 90 bp, Homo sapiens
gtctagtaaacttcacagtcatatcaggtatgtatttttatagttctgtaatatgtatgtctctttgtctgtctgtggtttacttttgat

SEQ ID NO: 28420 - DNA, 58 bp, Homo sapiens
gcagacatttattgtctcacagttctggaggctagaagtctgagatcaaggtgtcagc

SEQ ID NO: 28421 - DNA, 56 bp, Homo sapiens
tatacatgtatatatatatatatatgtgtgtgtgtgtgtatgtgtgtgcgtgtgtg

SEQ ID NO: 28422 - DNA, 95 bp, Homo sapiens; identical to SEQ ID NO: 68

SEQ ID NO: 28423 - DNA, 93 bp, Homo sapiens; identical to SEQ ID NO: 69

SEQ ID NO: 28424 - DNA, 103 bp, Homo sapiens
aatatacaatgcaatgactgagtgtgaagcatgaacttaaaataattctatttttattttagattcaaggagtgcatgtgcaggtttgtgacaagggtatatt

SEQ ID NO: 28425 - DNA, 118 bp, Homo sapiens
tctgagttattcattcagttccagaaagacaagatatttaagctccccacatggttaatatgtatttcatatcgctgtgtgagaattgagttaatactttcctattgatcagtacagg

SEQ ID NO: 28426 - DNA, 91 bp, Homo sapiens
acagttctggagcctagaagtctgagatcaaggtgtcagcaggactatgactgctctgaaggcactctggagagatctgttccaggcctgt

SEQ ID NO: 28427 - DNA, 91 bp, Homo sapiens
gttcacacaacaggaagagtagagtggtcattgtttaaactgaggaagaaccagtttaggggaggcagctttaatttgagttgcttgacac

SEQ ID NO: 28428 - DNA, 127 bp, Homo sapiens
acaaactgctggaaaggagccagtgccctcctgacctgtggctcagtcacagcttagtctgtcactttctgagtagatgccgatcaaggctttggcatgagagactcgagaagagaaagctggactg

SEQ ID NO: 28429 - DNA, 95 bp, Homo sapiens; identical to SEQ ID NO: 68

SEQ ID NO: 28430 - DNA, 93 bp, Homo sapiens; identical to SEQ ID NO: 69

SEQ ID NO: 28431 - DNA, 65 bp, Homo sapiens
gtgggcctctctgtgtctctcatggccttcttataaggacactggtcattggatttagggcccat

SEQ ID NO: 28432 - DNA, 70 bp, Homo sapiens
gaacttcatctgcaagtgagaggcggagggcggcggcagcggcgatctctctgtctctgtgaagtcggtg

SEQ ID NO: 28433 - DNA, 123 bp, Homo sapiens
ggatgacaggtgtgaaccactgtgcttagcctatttttttttttttttgagacagtctcactctgtcgccgaggctggagtgcagtggtgcaatctcactcactgcaaactctgcctcctggt

SEQ ID NO: 28434 - DNA, 67 bp, Homo sapiens
tgagacagagtctcactctgtcatccaggctggagtacgctggtgtgaccttggagaactcggctca

SEQ ID NO: 28435 - DNA, 94 bp, Homo sapiens
ttataccgcagaggtgaccccaccactgtctcagtcagggttttatgaagaagccccattgagcaacagttctgaaacttcatcgtgggtatga

SEQ ID NO: 28436 - DNA, 83 bp, Homo sapiens
ggcactcccacttccacccctttgttcccacacttgtgtattctttctacacagtgtcatagagaggtgtctgaggacactcc

SEQ ID NO: 28437 - DNA, 58 bp, Homo sapiens
cactctctgcctcactgtgtggccagtcacttgcatctgtggcagagtccctgcggtg

SEQ ID NO: 28438 - DNA, 58 bp, Homo sapiens; identical to SEQ ID NO: 1101

SEQ ID NO: 28439 - DNA, 56 bp, Homo sapiens; identical to SEQ ID NO: 1102

SEQ ID NO: 28440 - DNA, 69 bp, Homo sapiens
cagtctttggccatggagtgcttgtcttctctttttttgagacagagtctcactctgtcgcccaggctg

SEQ ID NO: 28441 - DNA, 125 bp, Homo sapiens
tccaggaataactaacttgcttttgattttacaggctcataggcggaagggacttgccttgtctcagatgagactgtggacttggacttttgggttaatgctggaatgagttaagactttggagg

SEQ ID NO: 28442 - DNA, 58 bp, Homo sapiens
tgagatggactctcactctgtcacccaggctggagtgcagtggtgcaatctcgtctca

SEQ ID NO: 28443 - DNA, 106 bp, Homo sapiens
agaattccccattaccccacttcctctctgacaccaggtgtgtgtgtgtgcgtgcatgtatatgtatatatatgaaagttacaggtatggatgtaggaatgtttct

SEQ ID NO: 28444 - DNA, 80 bp, Homo sapiens
tccatgaagataatttccagatgaatgagccatggggtttggacagcaaactcattggctcactcattgcctctgcagga

SEQ ID NO: 28445 - DNA, 108 bp, Homo sapiens
atttttagcctcaaagaaaatggaggattacaaaatgttattttttaaatcaatgttattgaggtaaaatttacatttaatgaaatgtgcctattttaggctcagagt

SEQ ID NO: 28446 - DNA, 58 bp, Homo sapiens
tgagacgcagtctcactctgtcacccaggctggagtacagtggtgtgatcttgtctca

SEQ ID NO: 28447 - DNA, 83 bp, Homo sapiens
tgactccttctgttatgttgtctgctatgtgtgttctgcttgttgtatgtttcatttatagtaggctagtaacagagtgagca

SEQ ID NO: 28448 - DNA, 67 bp, Homo sapiens
gtgatagaggaggtggattttttttttaattatttttattttttgagatggagtcttactctgtcac

SEQ ID NO: 28449 - DNA, 118 bp, Homo sapiens
gctattatctctaaaacccttgagagtgtccagagttttttttttttttttttttttttttttacaaaaaaaaggtaaaaaattatctgcaggcaggcagtagtggagagtgaggggc

SEQ ID NO: 28450 - DNA, 92 bp, Homo sapiens
catggcggcagatggctgtagtccctgctactctggaggctgaggtggaaggatcacttgagcccaggagttggaggctgcagtgagctatg

SEQ ID NO: 28451 - DNA, 76 bp, Homo sapiens
ttttttttttctgagacagagcctcactccgtcactcacgctggagtggctgtggcatgatcttggctcactgaaa

SEQ ID NO: 28452 - DNA, 58 bp, Homo sapiens
tgagacagggtctcactctgtcacccatgctggagtagagtggcacaatcctggctca

SEQ ID NO: 28453 - DNA, 105 bp, Homo sapiens
gccaggcatggtggcacatgtctgtggtctcagctacttcggaagctgaggtaggaggatggtttgggtccaggaagttgaggctgcagtgagccatgactgtgc

SEQ ID NO: 28454 - DNA, 85 bp, Homo sapiens
gccccagcaaaatcccggtaacagaacttacaggcttatgaatttttttttaaacaggatcttgctctgttgcccaggctggagt

SEQ ID NO: 28455 - DNA, 129 bp, Homo sapiens
acagtagcacagactccaacatcatctgacttccttgcacagccaagaaggtgtggtggagtctgtttctctcactgtgcttctgtccccacaacttatgggtagacgtggaggcagagggttcaggag

SEQ ID NO: 28456 - DNA, 80 bp, Homo sapiens
tcttttcaaatgtgctacaaaggtaaccttcaatcaaggttgaattactgttatttttagagtagcagcatctgaaatga

SEQ ID NO: 28457 - DNA, 83 bp, Homo sapiens
tacaggtagagaaatcactaatgtactgcctagagtcaaagtatatatttgttttaggccggatgcggtggctcacacctgta

SEQ ID NO: 28458 - DNA, 58 bp, Homo sapiens
gcgatggagtctcactctgtcacttaggctggagtgcagtggtgcgatctcggctcgc

SEQ ID NO: 28459 - DNA, 80 bp, Homo sapiens
gttagctatggctgggttgatatcagggtgaatgggagactcttcctgttttttttaatatatctttgagccatgtgaat

SEQ ID NO: 28460 - DNA, 111 bp, Homo sapiens
gaactagtaaacactgatgaactgatgactgcactgatgttcaatattaatactttataaagaaaaggtataaagtagaacgtctgcatctaaagatcgcaaatggctttc

SEQ ID NO: 28461 - DNA, 105 bp, Homo sapiens
acagtgtaaaagtattcccttttcactacatccatgccaacatctattattttttgcttttttgattatggccattcttgcaggagtaaggtggtatcacattgt

SEQ ID NO: 28462 - DNA, 104 bp, Homo sapiens
ggagtgtttttatgtatgagacattgtctgcttattaaggcttgtctgtaatttcagttaaactgttgagtggacattgttgcttacagaagttagaagatacc

SEQ ID NO: 28463 - DNA, 62 bp, Homo sapiens
ctgtataatgaccagtgagggcgaccagaggtcacttttgtcactgtcttggttttggccag

SEQ ID NO: 28464 - DNA, 115 bp, Homo sapiens
ttggcccaatagcccaggaatgattaggggaaaggcaagactcctgttgggtgggttagctcagatctctttcactgtcattattttctcactgatataatttttgcaaagccag

SEQ ID NO: 28465 - DNA, 58 bp, Homo sapiens
tgagactgagtctccctctgtcacccaggctggagtgcagtggtgtgatcttggctta

SEQ ID NO: 28466 - DNA, 71 bp, Homo sapiens
ccagtagctatggaactcacagaagaaagtctacatagattctctctatctgtctgtctctgtctctctgg

SEQ ID NO: 28467 - DNA, 95 bp, Homo sapiens; identical to SEQ ID NO: 580

SEQ ID NO: 28468 - DNA, 93 bp, Homo sapiens; identical to SEQ ID NO: 69

SEQ ID NO: 28469 - DNA, 69 bp, Homo sapiens
tgatgtatgtgcatgtatatatatataaaacacatgcgtatttatatatatatatatatatataaagca

SEQ ID NO: 28470 - DNA, 146 bp, Homo sapiens
atatatgtgtgtgtgtgtgtgtgtgtgtgtgtatatgtatgtgtgtgtgtctgtgtatatatgtatgagtgtgtgtatatatgtgtgtatatgtatatgtgtgtgactgtatatatgtgtgagtatgcatatgtgtatgtgtatgt

SEQ ID NO: 28471 - DNA, 80 bp, Homo sapiens
acatatatatatgtatatgtgtatatatatgtatgtatatgtgtatatagaagtgtatatacgtatctatatgtgtgtgt

SEQ ID NO: 28472 - DNA, 73 bp, Homo sapiens
tgtgtatatatgtatacaaggtatatattttgtgtatatatacaagatatatattgtatatatcttatataga

SEQ ID NO: 28473 - DNA, 68 bp, Homo sapiens
tgttttgagactgagtctcaccctgtcacccaggctggaagacagtggcgcgatctcagctcactgca

SEQ ID NO: 28474 - DNA, 102 bp, Homo sapiens
atatatacatatatatgtatatatatgtgtgtatatatatgtgtatatatatgcgtgtatatatgtatatatatgtgtgtatatatgtatatatgtgtgtgt

SEQ ID NO: 28475 - DNA, 128 bp, Homo sapiens
cacacatatatatgtgtgtgtatatatatatgtgtgtgtatatatattaaactcccatatatatgtgtgtgtgtgtatatatatatgtgtgtgtgtatatatatatgtgtgtgtgtgtgtgtgtgtat

SEQ ID NO: 28476 - DNA, 84 bp, Homo sapiens
catatatttaaatacatgcataaatgtgtgcatttgtgtttacatatatgtgcacatatatatgcatgtttgtatctatgtatg

SEQ ID NO: 28477 - DNA, 95 bp, Homo sapiens; identical to SEQ ID NO: 580

SEQ ID NO: 28478 - DNA, 93 bp, Homo sapiens; identical to SEQ ID NO: 69

SEQ ID NO: 28479 - DNA, 75 bp, Homo sapiens
tatatatatatggttcctgtatatatatgtgtgtgtatgtgtatatatatatatatatggttccatatatgtata

SEQ ID NO: 28480 - DNA, 69 bp, Homo sapiens
gctcaaatctgtctctctgagctgaaggctggggcaggtcttataggcagagggtaataagacacgagc

SEQ ID NO: 28481 - DNA, 72 bp, Homo sapiens
atatatatgtgtatatatatgtgtatatacatagacacgtatatatgtatacatagatagacacgtatatat

SEQ ID NO: 28482 - DNA, 83 bp, Homo sapiens
agagcaaaactctgtctgaaaaacaaaatattaaaaattaaaaatatttatgtatttatttatttgagacagagtcttgctct

SEQ ID NO: 28483 - DNA, 56 bp, Homo sapiens
gagacggagtctcactctgtcacccaggctggagtgcggtggtgcgatctcggctc

SEQ ID NO: 28484 - DNA, 58 bp, Homo sapiens
tgagacagggtctcactctgtcacccaggttggcgtgcagtggtgcaatctcagctca

SEQ ID NO: 28485 - DNA, 66 bp, Homo sapiens
tgttttgagacagtctcactctgtcacccaggctggagtgcagtggcatgatctgggctcactgca

SEQ ID NO: 28486 - DNA, 95 bp, Homo sapiens; identical to SEQ ID NO: 580

SEQ ID NO: 28487 - DNA, 93 bp, Homo sapiens; identical to SEQ ID NO: 69

SEQ ID NO: 28488 - DNA, 95 bp, Homo sapiens
tctattcaaagaatatgaaatcagtatgttgcaggccttaggaatacttaaggctattaatatttgatttttgttttattatttttctgattgga

SEQ ID NO: 28489 - DNA, 82 bp, Homo sapiens
agaaagagtgagtttttgtaagttggagtgaatcagtaatattttattttaaaatcatacttactggtagcttgctcttttt

SEQ ID NO: 28490 - DNA, 98 bp, Homo sapiens
gtgttcatcaaggatactggcctgtgcacacacatacatatatatgtatatcaatatacatgtatgtaggtatgtatgccaaaatcttagatgaacac

SEQ ID NO: 28491 - DNA, 72 bp, Homo sapiens
gatctagaaaaagtttgtcatcttctcatagtgaaccagatatctgagagaagactgactgctgtttagttc

SEQ ID NO: 28492 - DNA, 95 bp, Homo sapiens; identical to SEQ ID NO: 68

SEQ ID NO: 28493 - DNA, 93 bp, Homo sapiens; identical to SEQ ID NO: 69

SEQ ID NO: 28494 - DNA, 135 bp, Homo sapiens
acaggagagaagggctgtcagggagcccacacctaggactccccaatccaggctgtgacactttctctgggactctgtaatttctggaatctccaagcttccaggtgccaccattttccctggtgccagctgtgg

SEQ ID NO: 28495 - DNA, 79 bp, Homo sapiens
tactatatatatatatatacacacacatatatatgtgtatatatacacatatatatgtgtatatatacacatgtggtgt

SEQ ID NO: 28496 - DNA, 75 bp, Homo sapiens
atataaatacatatgtgcatgtatttaaatatactaaatgtttatatttacatatatgcatgaatgtatctatat

SEQ ID NO: 28497 - DNA, 90 bp, Homo sapiens; identical to SEQ ID NO: 28419

SEQ ID NO: 28498 - DNA, 88 bp, Homo sapiens
tgtgtgtgtgtgtgtatacatatgtatatacgtgtatgtatgtatatatgtgtatgtgtatgtatatatgtgtgtatatatgtatata

SEQ ID NO: 28499 - DNA, 120 bp, Homo sapiens
ctggccagatactatattatactagtatattattactagtagtattatatactagtatgtaatatagtatatatactagtataatactctagtatatagtatagtatacatactagtata

SEQ ID NO: 28500 - DNA, 76 bp, Homo sapiens
actatatatatttgtgtgtataggtatgtataacatatatatgtatatgtatgtatacatacatatgtgtatgtgt

SEQ ID NO: 28501 - DNA, 80 bp, Homo sapiens
gtgtgtatgtgtgtatatgtgtgtatatatgtgtgtatatatatatacacacacacatacatatacacatacatatacac

SEQ ID NO: 28502 - DNA, 72 bp, Homo sapiens; identical to SEQ ID NO: 28416

SEQ ID NO: 28503 - DNA, 95 bp, Homo sapiens; identical to SEQ ID NO: 68

SEQ ID NO: 28504 - DNA, 93 bp, Homo sapiens; identical to SEQ ID NO: 69

SEQ ID NO: 28505 - DNA, 84 bp, Homo sapiens
atgtgtgtatatatatatatatggtgcatatatatgtggtatatatatggtgtatatatatgtggtatatatgtggtatatata

SEQ ID NO: 28506 - DNA, 95 bp, Homo sapiens; identical to SEQ ID NO: 68

SEQ ID NO: 28507 - DNA, 93 bp, Homo sapiens; identical to SEQ ID NO: 69

SEQ ID NO: 28508 - DNA, 146 bp, Homo sapiens
atatatgtatatatgtgtatatatgtatatatgtgtatatatgtatatatgtgtatatacatgtatatatatgtgtatatatatgtgtgtgtgtgtgtatatatatatatatatatatatatatatatatataaatttgacttaca

SEQ ID NO: 28509 - DNA, 95 bp, Homo sapiens; identical to SEQ ID NO: 68

SEQ ID NO: 28510 - DNA, 93 bp, Homo sapiens; identical to SEQ ID NO: 69

SEQ ID NO: 28511 - DNA, 103 bp, Homo sapiens; identical to SEQ ID NO: 28413

SEQ ID NO: 28512 - DNA, 119 bp, Homo sapiens
agttggctgtgtatatatatatatatatatatatatatatatatatatatatatgtgtgtgtgtatgtatatactgtatatatatatacaattggctatgtacatatacatatatgtat

SEQ ID NO: 28513 - DNA, 95 bp, Homo sapiens
ggggaaggtggggaggtagagtcatggaccttctgccccatattttcataagagctctccctgtctctttatctctctctgtcttagcctctctc

SEQ ID NO: 28514 - DNA, 111 bp, Homo sapiens
aatcagtgacaatccgttgtattttccttgcatctcaatttaaatctaaataaattaatattttacatttatattgttagctgcaattaagatataagaactcttctgatt

SEQ ID NO: 28515 - DNA, 80 bp, Homo sapiens
caggctaaggtagtagaaagaattcacgtgggctttggaagacaggcctgaattcaagttctgactactacttattactg

SEQ ID NO: 28516 - DNA, 83 bp, Homo sapiens
tctggctgggtgagagctgtttctttttttcttttcttttttttttccttgacatggagtcttgctctgtcactcagactaga

SEQ ID NO: 28517 - DNA, 88 bp, Homo sapiens
taccagaagaatatcttatgttgcatttagcccatgtagaacattatacatatatataatgttatatatttctttatgttttctggtg

SEQ ID NO: 28518 - DNA, 61 bp, Homo sapiens; identical to SEQ ID NO: 28411

SEQ ID NO: 28519 - DNA, 96 bp, Homo sapiens
tctggaatctgtccaggatattttgctagtaaaactaatgcagtgaaatgatacacattttttttttttggcatcatcttggtagtctatgcaggt

SEQ ID NO: 28520 - DNA, 94 bp, Homo sapiens
ggctattctaaatcactgaagtgaatttgtttttgactgagtgcttaaagctgaaacctcaaagaacagaagcacaaaggtgactctggatact

SEQ ID NO: 28521 - DNA, 98 bp, Homo sapiens
ggcattgcgggtgaattttaaaggccaagacagtcactctcagaatattatgaggtggccaagggatgattttaggtgtagattctcaagcaaaagcc

SEQ ID NO: 28522 - DNA, 112 bp, Homo sapiens
gctttcattttttgtctattatgaataatgttgttctgaacatttgtgtgtatatttttatgtgaacatatgttcttatttctcttgggtatatagccagaagtagaattgc

SEQ ID NO: 28523 - DNA, 79 bp, Homo sapiens
cttcttgattctttatatataaaaagtcactgaatatgtgttaacatatttctcagggctattgtaaaaatcaaagaag

SEQ ID NO: 28524 - DNA, 72 bp, Homo sapiens
gggaagctgatagtgtctctcagtctgaggccaagggcccaagagaccaggggggctgctgatgtgagtccc

SEQ ID NO: 28525 - DNA, 96 bp, Homo sapiens
tgttagtctcattttcctggcccaacggagttttttttcttttctttttttttttttttgagacagagtctcgctctgttgccaggctggagtgca

SEQ ID NO: 28526 - DNA, 86 bp, Homo sapiens
tatatatggcctccagcaatatgtatatatatgtgtgtgtatatatatatatgtacatatatataaattctgggggaaaatctata

SEQ ID NO: 28527 - DNA, 99 bp, Homo sapiens
gtctgacatagatatattctatttgtgtatatatatatatattatatatatataatatatatatatatatacacagatagtttagtgtctatttctaac

SEQ ID NO: 28528 - DNA, 104 bp, Homo sapiens
tatattttttcagcttctattgagttcaagatttttatttttcattctgaagtatgtgtctggtgaaaaattctcaagctagataggaaaatggataaaatatg

SEQ ID NO: 28529 - DNA, 77 bp, Homo sapiens
gactcatgcttttctcactttgtgtctctcaaaggctagcaatgattaagcatagtgaggaaagaatgttgaaagtc

SEQ ID NO: 28530 - DNA, 86 bp, Homo sapiens
catacataaatggatatataggtaagtatacagaattatagcgcatatttatggtatatatatgtatatatacacatttatgtgtg

SEQ ID NO: 28531 - DNA, 112 bp, Homo sapiens
atgcaagtataacagaatatttttatttcttctttttgggtatgttatcctatgttcttttctatattattttatctttttgaagagattatgaaattgtgtgtttgtgcat

SEQ ID NO: 28532 - DNA, 80 bp, Homo sapiens
ctccctcactctgtgactgtgaagaggaagcctgaggtgtagcaggcccaggtcccagaagtatggaaaaaatgaggtag

SEQ ID NO: 28533 - DNA, 105 bp, Homo sapiens
ctgataatggccattctaaatgtgatgaaatgatatctcattgtgattttttttaaataactaatgacattgaacattttttcatatatctgttggctctgtgag

SEQ ID NO: 28534 - DNA, 99 bp, Homo sapiens
gatcacatagggaggtatggatattttaacaatattaattctttaaatttattagaataaaatatttttcaatttatttatgtcttccttaatgtcttc

SEQ ID NO: 28535 - DNA, 114 bp, Homo sapiens
caaatctagtgtgtatatatgaggggtgtgtggctaggagttttgggacttattttatataaagatatatttattttcctggaacgtatttcttagaatgtattttagatcttg

SEQ ID NO: 28536 - DNA, 58 bp, Homo sapiens
tgatacagagtctcgctctgtctcccaggctggagtgcagtggcgcgatcttggctca

SEQ ID NO: 28537 - DNA, 105 bp, Homo sapiens
tttgttgacagtcctcatcatgaagatatatttaattttatcaaatgatttttctgcatttcttgagatgatcagatgatttttgtccttcattctgttgataaa

SEQ ID NO: 28538 - DNA, 96 bp, Homo sapiens
ttgcagtacttcacacttttttattattattaaatctgttatggtgatttgtgatcagtgatttagtgtcactaatacggaagggaagtgctggga

SEQ ID NO: 28539 - DNA, 95 bp, Homo sapiens; identical to SEQ ID NO: 68

SEQ ID NO: 28540 - DNA, 93 bp, Homo sapiens; identical to SEQ ID NO: 69

SEQ ID NO: 28541 - DNA, 82 bp, Homo sapiens
ttttttacatttagatacattttttacatttagataaatacatatagtatttatctaagttattatgtacttttgtgacaaa

SEQ ID NO: 28542 - DNA, 71 bp, Homo sapiens
gtatatatatatgtgtgtatatatatatgtgtgtgtgtatatatatgtgtgtgtatatatatgtgtgtgtg

SEQ ID NO: 28543 - DNA, 78 bp, Homo sapiens
tgtgtgtgtataaatatacataaatgtgtacgtgtgaatacacaaatgtatatatgtatgtgtgtatatgtacacaca

SEQ ID NO: 28544 - DNA, 95 bp, Homo sapiens; identical to SEQ ID NO: 68

SEQ ID NO: 28545 - DNA, 93 bp, Homo sapiens; identical to SEQ ID NO: 69

SEQ ID NO: 28546 - DNA, 107 bp, Homo sapiens
ccctttctcttcactgtttttatgtctctactggagcacacaggaatcattaaatctcctagattagtgtttttgatgatataaaagcaatggggcaggagaaaggg

SEQ ID NO: 28547 - DNA, 95 bp, Homo sapiens
tggatggacaacctgcatagagagtgttgtcacagtgcacagtgcctgggcattgcgaaaagtgacaaaaatccgtagctgtggagaagttacca

SEQ ID NO: 28548 - DNA, 94 bp, Homo sapiens
gcttaaatatatattatatatatatatgtatataagctgaaatatatagtatatataagctgacatatgtatatatgtatataacaatttaagt

SEQ ID NO: 28549 - DNA, 110 bp, Homo sapiens
ggagttattcttcatcaagataccttgcacattgtgaacactcagtttgtatttgtttatttattacataagtgacactttggcaagttatgctttgtctgatattatcc

SEQ ID NO: 28550 - DNA, 103 bp, Homo sapiens
gcatatacgtgtgtatgtgtatatgtatgtgtgtgtgtgtgtgtatatatatatatacatatatatatatatagtgtgtgtgtgtgtatatatatgtgtgtgt

SEQ ID NO: 28551 - DNA, 92 bp, Homo sapiens
ttgtttttgagatggagtctcactctgtcacccaggctggagtgcagtggtgggatctaggctcactacaacctctgcctcctgggttccag

SEQ ID NO: 28552 - DNA, 85 bp, Homo sapiens
tacatattatattggcaaatatttctctctctctctctctcagacacacagagagagagagagagtgtgtgtgtgcgtgtgtgta

SEQ ID NO: 28553 - DNA, 75 bp, Homo sapiens
gtatatttatatgtgtatgtgtctatacatatcttaaaaatatatatatagtaaaacacacacatataaatgcac

SEQ ID NO: 28554 - DNA, 96 bp, Homo sapiens
aagtactgtttaggatttctcttttttattaatttgaccaaattttggttttatacatctcaaaattatgtaagaaaatagattcagactgtactt

SEQ ID NO: 28555 - DNA, 58 bp, Homo sapiens
tgagacagggtctcactctgtcactcaggctggagtgcagtggtatgatcttgtctca

SEQ ID NO: 28556 - DNA, 76 bp, Homo sapiens
ggggatatgtatttatagatatagatatatctatttatagatatatctatttatagatatagatatagatatctcc

SEQ ID NO: 28557 - DNA, 109 bp, Homo sapiens
ctggctctgatgcttgcttggtctcatcatactatgtttttctatatttcagtacattttgtattttttcgtaaaaagctggtcttgatgtgctaagtaaaaggaacag

SEQ ID NO: 28558 - DNA, 84 bp, Homo sapiens
ggcctcactccctgtgtgactgtgtttgcagaaagaagctttagggaggtaattatggttacatgaggtcacatgggtggggcc

SEQ ID NO: 28559 - DNA, 81 bp, Homo sapiens
tgcatatgtgtgtatatatatgtgtgtgtgtgtatatatatatatatatatatatatatatatatatatatatatatgaca

SEQ ID NO: 28560 - DNA, 92 bp, Homo sapiens
gtcagtttcaggcttgaactccactaattctatacctttcactgcctctctcactgtaggtaattgtattagtctgttttcatgctgctgat

SEQ ID NO: 28561 - DNA, 105 bp, Homo sapiens
acagttaagggcaatttcagaatcactagctgctaaaattgttatttatacttttccatgggtagtacagctgcagcagctatttctctatattctgctgttgct

SEQ ID NO: 28562 - DNA, 132 bp, Homo sapiens
atatatttatatatgtgtatacatatatacatatacatatatgcatatataaatatatgtatacacatatatgcatataatatgtgtaatatattaatatatgtgtgtacatatatgtatatgatatgtgta

SEQ ID NO: 28563 - DNA, 79 bp, Homo sapiens
tatatgcatatatgtgtatacatatatttatatatgcatatatgtatatgtatatatgtatacacatatataaatatat

SEQ ID NO: 28564 - DNA, 97 bp, Homo sapiens
atctcttttgtcaagtccttctctcagtatctctaatagatatttgcttcaattatttaatgggaaagaataatgagaaaaacatgtaaggagagat

SEQ ID NO: 28565 - DNA, 114 bp, Homo sapiens
actagaaatccaagagcataacttccccaaattacttaaaaaccagggattttcctatttctgactgtgcttgttgtttgttcaaattttggggggttatttgttattttcagt

SEQ ID NO: 28566 - DNA, 137 bp, Homo sapiens
tccagctttgttctttttgcataggattgtcttggctatatgggctcttttttggttccatatgaaatttaaagtagttttttctaattctgtgatgaaagtcaatggtagcttgatggggatagcactgaatctat

SEQ ID NO: 28567 - DNA, 66 bp, Homo sapiens
tttggatatataatcaattgtagaattgctggattatatggtagttctatttttgattttttcaag

SEQ ID NO: 28568 - DNA, 113 bp, Homo sapiens
tgggtctcaaccttggctgcatcttggaatctcctggggagatgagacaataccaaggctctctctcactcagcgtgatgtttccaagttccatccacatgtagtaggcacca

SEQ ID NO: 28569 - DNA, 116 bp, Homo sapiens
gtttgtaggtatcaaggaaggaaataataaatttctaggtgtggaattgtatggaatactgacaggcaaagcaagatacacaagtgttttctatccttttgacaacctctgcttac

SEQ ID NO: 28570 - DNA, 88 bp, Homo sapiens
gtacttccttggtggttgagacatcctggaggttaaaagtgtgtgattgagacacacaactgagtgtgaagtgaaagtaggggagtgc

SEQ ID NO: 28571 - DNA, 92 bp, Homo sapiens
tggcatggacagagcccatggagaaggaggaggaaaaagagagtttggctttggttttttttttttttaagacagggtctctggctgtgtca

SEQ ID NO: 28572 - DNA, 84 bp, Homo sapiens
catttctctgcccaagcgtaaaggccaagggaatagatttagtctcttctgttctgtctgagtctgagcttcagagagctagtg

SEQ ID NO: 28573 - DNA, 76 bp, Homo sapiens
tttgcagaggagtttggggtgggaaactttattttcttataaaagaattaggtcccattggaatcactaatgcaaa

SEQ ID NO: 28574 - DNA, 113 bp, Homo sapiens
cttgtagaaagaagtctaatgtctatagaagttgaactcatttttaatttacttggatgattatatttttaaatactacctgagtatagctagataatagagtttttcataag

SEQ ID NO: 28575 - DNA, 77 bp, Homo sapiens
ggactgttcaactcacctggcagccactcccagagcccctggaactctggcccaaggctctctgactgactccgtcc

SEQ ID NO: 28576 - DNA, 82 bp, Homo sapiens
ctctgtgtccctgtgtcagtgctaggcattatgagaacacctcagatgaataaaacttggttctggcttcaaagagcaagag

SEQ ID NO: 28577 - DNA, 114 bp, Homo sapiens
ggtggcatgagctcacaaagggatctcctgatcttcgggtttcctgggcaggattgcacaatcactcactgcctctcttggctggggtagaggttcctttggctctgtgccact

SEQ ID NO: 28578 - DNA, 109 bp, Homo sapiens
cctctattatatttgactgtaagctcattgagggcctggactatgttttatcatttttttttccatttgcagggcctagcagagtgctttgcagatagcatgtaattgg

SEQ ID NO: 28579 - DNA, 73 bp, Homo sapiens
agccagcttcagtcagtcactgcctgtctggaagctccaggcaagcctatatgatagaatacagctccaggct

SEQ ID NO: 28580 - DNA, 100 bp, Homo sapiens
ggaattttgtcaagggatgattgtcatttttcttttttgatttgttaatatagtaaattatattgactgattttcaaatgtcaaaacaaccttgcattcc

SEQ ID NO: 28581 - DNA, 115 bp, Homo sapiens
ggaggattgaaaggcttggacatttggttttgaaagtacatattgtaagcttttatttttttcaaagttatacatacttgtagtttaaaagtcaactagttcaacaaggtctgct

SEQ ID NO: 28582 - DNA, 104 bp, Homo sapiens
ggaggatttaaaaatgtctagtaaatgatttcattttttaataatgtggaatatgcatataatacattataaatggtatcaattatgacagttataattttttc

SEQ ID NO: 28583 - DNA, 65 bp, Homo sapiens
gtattccctaatctctgggtcattcctgtcaaaacaggagtgtgactacacagtgaccaggatgc

SEQ ID NO: 28584 - DNA, 64 bp, Homo sapiens; identical to SEQ ID NO: 15176

SEQ ID NO: 28585 - DNA, 59 bp, Homo sapiens; identical to SEQ ID NO: 15177

SEQ ID NO: 28586 - DNA, 64 bp, Homo sapiens
tccatgagtgtgtatgtgtgcatatatagatatatctatatatgtaaaattgctggtcatagga

SEQ ID NO: 28587 - DNA, 138 bp, Homo sapiens
gtttatatatatatatatatgtgtgtgtgtgtgtatgtgtatatatatgtgtgtgtgtatatatgtatatatgtgtgtgtatatatatgtatatatgtgtgcgtatagatgtatatatgtgtgtatatacacacatat

SEQ ID NO: 28588 - DNA, 59 bp, Homo sapiens
tgagctgggagtctcactctgtcgcccaggctggattgtagtgttgccgtttcagctca

SEQ ID NO: 28589 - DNA, 73 bp, Homo sapiens
ggtttagggagaaaggcagagttgtgattttattttattttttgagatggagtctcactctgtcgcccaggct

SEQ ID NO: 28590 - DNA, 83 bp, Homo sapiens
gtttgttttttaatgggacagtgtctctctgtcactcaggctggagttcagtggcaggatcgtagctccctgtaacctcaaat

SEQ ID NO: 28591 - DNA, 114 bp, Homo sapiens
gcgtttattttatctttacaagcattggcagtaatggttgatttcacttctgattatgaagttagtaggaaataaagtacagggggtgtggggggtgtgtgtgtgtgtgtgcgt

SEQ ID NO: 28592 - DNA, 116 bp, Homo sapiens
ccagtcatccaagcactttgggaggccgaagtgggagtgagaggtgacagtgtgctggcagtcctcagagccctctcttgctctcggcgcttcctctgcctgggttcccactttgg

SEQ ID NO: 28593 - DNA, 98 bp, Homo sapiens
gccaccgtgcctggtcagcgtggggtttttttgtttttttttggttttttttgctttttttgagacacagtctcactctgtcgcccaggctggagggc

SEQ ID NO: 28594 - DNA, 84 bp, Homo sapiens
tgagataagagtctcgctctgtcacccaggctggagtgcagtggcgcagtcttggctcactgcaacttctgcctcctgggttca

SEQ ID NO: 28595 - DNA, 95 bp, Homo sapiens
tgttcaaatgattgtgttttctaaaatagaaatgaagttgttcttccaacctctgaattttatcattttatgttttggatcagaaacgtgtgaca

SEQ ID NO: 28596 - DNA, 56 bp, Homo sapiens; identical to SEQ ID NO: 10175

SEQ ID NO: 28597 - DNA, 115 bp, Homo sapiens
accatcaagtaagctctgtattgccgtttctactaagttcttgaaaatcttgtagaatattaaaatatgtttcaattatattagtaggttcttatcagtgcaaaggttaaaaggt

SEQ ID NO: 28598 - DNA, 58 bp, Homo sapiens; identical to SEQ ID NO: 2595

SEQ ID NO: 28599 - DNA, 114 bp, Homo sapiens
gccagtattttattgaggatctttgcattgatgttcatcaagaatattggcttgaagttttgtttttgtttttgttgtatctctgccaggttttgatatcaggatgatgctggc

SEQ ID NO: 28600 - DNA, 76 bp, Homo sapiens
aagggaaggtgactgggactgagctctggagcacttcaaatgcagtgctacatttctctgtctgtctctgtctctt

SEQ ID NO: 28601 - DNA, 85 bp, Homo sapiens
gaagggcatctttatatgtactggtttgccacttgtgtgtgtgtgtatatacatgtgtatatgtatatttgagaaatagcctttc

SEQ ID NO: 28602 - DNA, 84 bp, Homo sapiens
tgcttttgatccaatcctaggagcatagtttatttgatttcttaaatacccttttagtgctatgccactgttggattttaagca

SEQ ID NO: 28603 - DNA, 82 bp, Homo sapiens
ggtcaccctgtgtgtgtctctctgtttggcagagagactggaacaagcacaggcttgccaggaggagaggagccagggggcc

SEQ ID NO: 28604 - DNA, 89 bp, Homo sapiens
tctcagttctcatgtctctctgagaaatgtgttggcccaattccctatctgccactctgagtctcttgagtaaatgtgtgtaaatgaga

SEQ ID NO: 28605 - DNA, 78 bp, Homo sapiens
cacttctccaagaataagtgtgatttgagtttgaggaatgtaatctcaaatcgaaaattctgtttttgtagaactgtg

SEQ ID NO: 28606 - DNA, 70 bp, Homo sapiens
ttaaatatattgacagtagtcagtcagcttgtttttctcaacaagctgactactactggcaaatttttaa

SEQ ID NO: 28607 - DNA, 114 bp, Homo sapiens
gctgtatataacagatttgtgcattcttctctgcctagtgttatgctttcattagaaatgttatttttttaaaagcaaataggatgatgagtgaagaactgaaatatcttaagt

SEQ ID NO: 28608 - DNA, 94 bp, Homo sapiens
tgctcaaggacataatacaaaagttgtcatctttctcctgtatatttttctttagtgagaggttgacttgtgttaaactgtctttcttctagca

SEQ ID NO: 28609 - DNA, 70 bp, Homo sapiens
aagatgcaggacatcctgtattttttattttatttttattgctagataaaatgcaagagtcctgtatttt

SEQ ID NO: 28610 - DNA, 116 bp, Homo sapiens
gagcaacgtgggactcagggatgatgtcagatgtccaagatctcacagccagcaaagaagtagcaggggtgagctgggaactgaagatatttctgattccaaagtctacactgttt

SEQ ID NO: 28611 - DNA, 113 bp, Homo sapiens
gcggctacagggacattaatcactctcctatccaacctcagtcattcctttcctcaaactctgaggctgtagtttgtcctgttgaaagtgattatctttgttgttctgcctgc

SEQ ID NO: 28612 - DNA, 93 bp, Homo sapiens
tctgacagtgagtaacaggggcttctgttttagatgatgtgagggaagtcctttcaggacatttaagcagaaaccagagggaaaagctgcaga

SEQ ID NO: 28613 - DNA, 101 bp, Homo sapiens
tgatggaattgtgcatgtgagttaaaatgagtagccaactgtggtgggattccacatagatgttacttattttttttttaagacaaggtcacactctgtca

SEQ ID NO: 28614 - DNA, 119 bp, Homo sapiens
ctcccaaagtgctgggattacaggcctgagccaccgtgcctggctgacttgttttttttttttttcttttttttttttgggcggggggacggaggctcactctgttacccaggctggag

SEQ ID NO: 28615 - DNA, 122 bp, Homo sapiens
gcacacactgaaaagcaagatgtgtatatatatatatacatatacatatatatatatatatatatatatatatacacatatgtgtgtgtatatctatatatatatatcgcacgtgtgtcatg

SEQ ID NO: 28616 - DNA, 81 bp, Homo sapiens
tgggactgtccaactcacctggcagccactcccagagtccctggaactctggcccaaggctctctgactgactccttccca

SEQ ID NO: 28617 - DNA, 113 bp, Homo sapiens
gggctctatccttgacagagtcctcctttttaagttggaggctgagcttggtgaggttgtttttttttttttttttgagatggagtctcactctgtcgcccaggctggagtgc

SEQ ID NO: 28618 - DNA, 96 bp, Homo sapiens
tttgaacttctgccagtgtaattattttaatatgtttggtattatttgcatataccagactatttgtgagatttagttgccttttggatatttaga

SEQ ID NO: 28619 - DNA, 73 bp, Homo sapiens
tcagtctcagtgtctttgtcagtttgggctgccataacaaaatatccagatttctcaaagctctggaggctgg

SEQ ID NO: 28620 - DNA, 98 bp, Homo sapiens
ccagagacagagagacagagaaacagagtgagacagagtgagacagaagtaatacatatattctcacaggctgtgctgaacatttgactttcttatgg

SEQ ID NO: 28621 - DNA, 100 bp, Homo sapiens
gctaaaattggttgctgtaatagtcttgaaaagaaggtaattgattgtatttaaagcaacagtcttctgcattactgagaagtacatgagcacctgtggc

SEQ ID NO: 28622 - DNA, 81 bp, Homo sapiens
ctaattgaatggatttgcaatgtgagaaattagatacgacacgtaagttagatgaatcacagggcagcctcatcgaattgg

SEQ ID NO: 28623 - DNA, 90 bp, Homo sapiens
gcctgcatacatataggctagaaaaggctgcctaagactgggaggagaatgaattgggtctgggagttgagagtgtagatagtggtaggt

SEQ ID NO: 28624 - DNA, 95 bp, Homo sapiens
gtacatatatgtatgtgtgtgtgtatatatgtgtgtgtgtatatatatatatacacacacataattatatatacacacatgattaaaatgtgtat

SEQ ID NO: 28625 - DNA, 75 bp, Homo sapiens
gagaatatatatagtgtgtgtatatatatgtgtgtgtaaatatatacatatatatactacagaatgaatcatctc

SEQ ID NO: 28626 - DNA, 70 bp, Homo sapiens
tttagtatagactatggcagaggtagttagttgtttctttacatcattctctatttctgccattattaaa

SEQ ID NO: 28627 - DNA, 177 bp, Homo sapiens
atatatctgtgtgtatatatatatatacacacatatatgtgtatatatatacacatctgtatatatatacagatatatatgtatgtctgtatatatatgtatatacagatatatatgtatgtctgtatatatatgtatatacagatatatatgtatatatatacagatatatatata

SEQ ID NO: 28628 - DNA, 66 bp, Homo sapiens
tatatatacatatgtatgtatatatgtaagtatatatacacatatatggatatatatctatatata

SEQ ID NO: 28629 - DNA, 101 bp, Homo sapiens
tattcttgttgccaataagtccagcaagaagcaaaacattattttttaatcttttaaaaagagttttctgctatttgctccatttagtgtcgatgcaaata

SEQ ID NO: 28630 - DNA, 95 bp, Homo sapiens; identical to SEQ ID NO: 68

SEQ ID NO: 28631 - DNA, 93 bp, Homo sapiens; identical to SEQ ID NO: 69

SEQ ID NO: 28632 - DNA, 90 bp, Homo sapiens
tagagagttgcattttattggatggacaagtgactttgatgatgaaagattattgttatgttccttatgcatgctttgcaactactgcta

SEQ ID NO: 28633 - DNA, 76 bp, Homo sapiens
gtatcttgaaaccttactgattttgtttatcagttctatgggccttttggcagagtctttagggttttctaggtat

SEQ ID NO: 28634 - DNA, 84 bp, Homo sapiens
tatgtgtgtgtgtgtatatatacacatatatgtgtatatatatgtatatacgtgtgtatgtgtatatatatacacacatatata

SEQ ID NO: 28635 - DNA, 213 bp, Homo sapiens
tatgtatatatacattcatatgtgcatatgtatatacgtgtacatatacgtatgtatacatgtgtatatatgtatgtatatatgtatatatgtatacatgtgtataaatatttttatatatgtgcatacatatttatatatatgtgtgcatacatatatgtatatgcgtctatatatgtatatatgtatatgggtgtatatatgtatataaat

SEQ ID NO: 28636 - DNA, 74 bp, Homo sapiens
gggaccacagagagctctctcacactctgttataccttatgagggttcgaggagaagtgggtgatctgtaaccc

SEQ ID NO: 28637 - DNA, 86 bp, Homo sapiens
gatgttaatttgatcattttgttaggtagtgtctgctggtttctgaacaatagtcattattttaaaatttatgattaataaacatc

SEQ ID NO: 28638 - DNA, 114 bp, Homo sapiens
tacgtttctcttccatggtcacactgtgactcagagcaaaacttttttgataaatctttctttttttttttttgagacagtgtctctctctgtcacccaggctggagtgaagtg

SEQ ID NO: 28639 - DNA, 108 bp, Homo sapiens
agagaataccagaattaccatgtagaaaccctttcctgtagatatttatctctaagaagagtgaagacagagatcacaatgttgccgatatgggggtgagtgcactct

SEQ ID NO: 28640 - DNA, 95 bp, Homo sapiens; identical to SEQ ID NO: 68

SEQ ID NO: 28641 - DNA, 93 bp, Homo sapiens; identical to SEQ ID NO: 69

SEQ ID NO: 28642 - DNA, 105 bp, Homo sapiens
acattactaggaatcccatttgaagtctacagggcttagagaggagagagagctgacgtcttgctgtgaaagtgttttgaattcaaagtggagacagggtggtgt

SEQ ID NO: 28643 - DNA, 86 bp, Homo sapiens
taggaactatttacacaagactgtctgttgagtgggttctgtggaaaccagaccacccttcctatggatcatgtgccaaactccta

SEQ ID NO: 28644 - DNA, 95 bp, Homo sapiens; identical to SEQ ID NO: 68

SEQ ID NO: 28645 - DNA, 93 bp, Homo sapiens; identical to SEQ ID NO: 69

SEQ ID NO: 28646 - DNA, 95 bp, Homo sapiens; identical to SEQ ID NO: 68

SEQ ID NO: 28647 - DNA, 93 bp, Homo sapiens; identical to SEQ ID NO: 69

SEQ ID NO: 28648 - DNA, 87 bp, Homo sapiens
ataatatgtaataccatgtgaatgctatgtaaatagttgttattctgcaatattttatatttgtattatattttattgctgtgttat

SEQ ID NO: 28649 - DNA, 95 bp, Homo sapiens; identical to SEQ ID NO: 68

SEQ ID NO: 28650 - DNA, 93 bp, Homo sapiens; identical to SEQ ID NO: 69

SEQ ID NO: 28651 - DNA, 103 bp, Homo sapiens
tgagtggataaagaaaatgtgtgtatatattttatatatatatatatatatatatatatatatatatatatatatatatatatacaccatgggatactactca

SEQ ID NO: 28652 - DNA, 83 bp, Homo sapiens
cagatgcattttggaaaagagctttccctgcactttcttggattcatcctggacagttcagttgtctctctcttccacatctg

SEQ ID NO: 28653 - DNA, 133 bp, Homo sapiens
ttatattatatatacattatattatacatgccatatattatatataatactatatataatgtatgctgatactttatatataatatatgccatacattatataatgtattatatataatgtatggtatatatg

SEQ ID NO: 28654 - DNA, 73 bp, Homo sapiens
tgagcctaggactccagatgtgatttttttttctttttttttagatcgagtctcactctgtcgcccaggctgg

SEQ ID NO: 28655 - DNA, 93 bp, Homo sapiens
atataagttatatatgtgtttatatataaattacatatgatatgtattatatataattatatatttatataattacataattataatttatat

SEQ ID NO: 28656 - DNA, 90 bp, Homo sapiens
ggatgagactttaaatatagattttggatttgttatgtaaagtcatatttttagatgtaaagacccatgaactgtatgaaaagtgagtcc

SEQ ID NO: 28657 - DNA, 85 bp, Homo sapiens
ggcccagcctccttcctgtgctaataaggctttgcattgttcataaaattaggcactaattctgccaggtatagaggttatagtc

SEQ ID NO: 28658 - DNA, 106 bp, Homo sapiens
gcttattgctcatatcgtgtgtgtgtgtgtgtatatatatatatatgtgtgtgtatatgatatatatatgtgtatacacacacacacatatatatattcaaaaagc

SEQ ID NO: 28659 - DNA, 95 bp, Homo sapiens; identical to SEQ ID NO: 68

SEQ ID NO: 28660 - DNA, 93 bp, Homo sapiens; identical to SEQ ID NO: 69

SEQ ID NO: 28661 - DNA, 101 bp, Homo sapiens
ccatcaggaggaacctaagcctggctccacttactgctgactaaagtggtctgggtcctgggttcaattttagtggcagtcagaccacaaggactacagta

SEQ ID NO: 28662 - DNA, 113 bp, Homo sapiens
ggcacatcatatggtaaaagcaggagcaggagtgagagagaagtcagggaggtgccacacacttttaaatgactagatctcacgagagttcgctcacgatcacaaggacagcc

SEQ ID NO: 28663 - DNA, 113 bp, Homo sapiens
aagtgtatgtgtgtgtgcacccatgtatatatgtaatctctaagtgtatgtgtgtgtgtgtatatatatatttacacacacatacacatatatacacatgcacacatactctt

SEQ ID NO: 28664 - DNA, 112 bp, Homo sapiens
gaatgagaagagatgcaagatattttcatcttacagtttctttgcttttctacctaaaaacctgtatgtagagatttgtaaaaggaaagatatattttttctctgtacattt

SEQ ID NO: 28665 - DNA, 88 bp, Homo sapiens
gcactaagatgaggtgacatatggtagtatgttgtatacatagagtttctctcacttgcatcattattgcatttaccacattttttgc

SEQ ID NO: 28666 - DNA, 71 bp, Homo sapiens
ctccacagccttgtgaacagactttttttttttttttttgagacaggatttcactttcactgaggctggag

SEQ ID NO: 28667 - DNA, 83 bp, Homo sapiens
caaaaattcgctgggcatggtggcatgtgcctgtagtcacaccagaggctgaggtagtagaatcacttgagcccgggaagttg

SEQ ID NO: 28668 - DNA, 102 bp, Homo sapiens
cccactgagtctccttatcattgccttgggcatatctgtttatatttgattatatgctccttgaaggcagtgatcatcttcctcatcctaattcatagtggg

SEQ ID NO: 28669 - DNA, 94 bp, Homo sapiens
tgctgttttggttactgtagccttgtagtgtggtttgaagtcaggtagcgtgatgcctccagctttgttcttttggcttaggattgacttagca

SEQ ID NO: 28670 - DNA, 71 bp, Homo sapiens
cccagtctcaggtagttgtttatagcaatgtgagaacagactaatatagaaaattggtactgagaagtggg

SEQ ID NO: 28671 - DNA, 95 bp, Homo sapiens; identical to SEQ ID NO: 68

SEQ ID NO: 28672 - DNA, 93 bp, Homo sapiens; identical to SEQ ID NO: 69

SEQ ID NO: 28673 - DNA, 79 bp, Homo sapiens
ctgagacagagtctcactctgtcgcccatggctcactgcaacttctgcctcctgggttcaagtgattctcctgcctcag

SEQ ID NO: 28674 - DNA, 184 bp, Homo sapiens; identical to SEQ ID NO: 3161

SEQ ID NO: 28675 - DNA, 67 bp, Homo sapiens
gggtctcactctgtggctctggctggagtgattacagctcatggagcttcaaactgcaagtaggctc

SEQ ID NO: 28676 - DNA, 136 bp, Homo sapiens; identical to SEQ ID NO: 3160

SEQ ID NO: 28677 - DNA, 89 bp, Homo sapiens
agagtcatcaaaaagagtctccctcagtcttttacaattaaaaaaatgtcttaagaaacagaggggctgattgtgcctgaaatggcttt

SEQ ID NO: 28678 - DNA, 118 bp, Homo sapiens
tttctggagtacatttcatttaactgaaatcacaaataattttctaataagattctatttattttggattctacaggaataatttttttagtttgataagatgtaatgatgtcaggaa

SEQ ID NO: 28679 - DNA, 117 bp, Homo sapiens
tcctctatgttgcttataagctctgtgtgtgtgtgtgtgtatcaatatctctacatatatatttatatgtatccatgcatatctatagtaagctagagtgggatggggaagggagga

SEQ ID NO: 28680 - DNA, 102 bp, Homo sapiens
attgcttatttttataatttgttgctttctgaacctaggggaaaaagatctatttatatattttcccctcagaaacaataccaatttggtagatatctcaat

SEQ ID NO: 28681 - DNA, 71 bp, Homo sapiens
tcctgttttaggaagttaatacttaaaagaattattatttattttttctttttttcctttttgagacaggg

SEQ ID NO: 28682 - DNA, 76 bp, Homo sapiens
ggtcagagccacactctcttacagactaagagtttttaaggattcagggtgggagagtttaacagaggcttggact

SEQ ID NO: 28683 - DNA, 78 bp, Homo sapiens
ggagtgattttgtatttctgttaggaattgttctgttaggaattagccattcctttcttttagatgcgatctctctct

SEQ ID NO: 28684 - DNA, 86 bp, Homo sapiens
gacaggccacaatgctcagaacccagtgtccacatgtgagtcccacatgggacaccaacaggattgggtcatccagtagctctgtc

SEQ ID NO: 28685 - DNA, 61 bp, Homo sapiens
ctcagggtctgattcaccttcatgtatcgagcacttggacctgagtgtctcagtgcctgag

SEQ ID NO: 28686 - DNA, 69 bp, Homo sapiens
gtgtgtgtgtgtgtgtgttgggcgaggatgcggtgaccactcaacttctctgactctcacttactccat

SEQ ID NO: 28687 - DNA, 101 bp, Homo sapiens
ccatttaatcctgtctctggcttccctcttggactctgagtctctcaatatccttctttggtaagatgtgaggcagcatcacaagtggccaagagcccagg

SEQ ID NO: 28688 - DNA, 56 bp, Homo sapiens
tgagcagagattgcacgactgcactccagcctgggtgacacagtgactctgtctca

SEQ ID NO: 28689 - DNA, 74 bp, Homo sapiens
catatgtacatatatatgtatatatgcatatatatatatttgtctgtatatatatatgtatttgtgtgatgatg

SEQ ID NO: 28690 - DNA, 82 bp, Homo sapiens
gctcacacctggaatctcagcactttgggaggctgaatcaggcagattgcttgagctcagaagtttgagaccagtctggggc

SEQ ID NO: 28691 - DNA, 87 bp, Homo sapiens
gctggatggaagaaataagttctagtgttctatagcactgtagggtggctatagttaacaataatttattgtctattttcaaatagc

SEQ ID NO: 28692 - DNA, 106 bp, Homo sapiens
gtaagtgagtgtgtgtatgtgtgtgtatgtctgtgagtacatgtgtgagtttgagtgcatgtgcatgtattctggtcatagaggcacagctggagattccattaac

SEQ ID NO: 28693 - DNA, 111 bp, Homo sapiens
gttaggaggaataacttcaagagacctatggtacaaaatggtgactatagtaaataacaatttattgtatttttaaaatcatgtaaagagtagattttgtgttctccccac

SEQ ID NO: 28694 - DNA, 114 bp, Homo sapiens
gggctctcactggttttacattatggtgagttgtatcattatttcattatatattacagtgtaataattacagaaataatgtgcgcaataaatgtaatgtgtttgaatcatccc

SEQ ID NO: 28695 - DNA, 119 bp, Homo sapiens
gcccatttttaatagggttgcttgtcgtcttatcattgagctgtatgagtttttaaatatattctagaaacaagtcctttgccagatgtatgtattacaaacatgttctcccagtgggt

SEQ ID NO: 28696 - DNA, 80 bp, Homo sapiens
aaatacctcatgaatgcttgatagtgtcctcgcagtaatgagttctctctctgtgagttcacacgagatctggttgttta

SEQ ID NO: 28697 - DNA, 57 bp, Homo sapiens
tgggagtgtggtcattttgtagttgttaccttggctagactgaaccacattttccca

SEQ ID NO: 28698 - DNA, 87 bp, Homo sapiens
ctctagcttgggtgacagactgagactctgtttcaaaaaaaaaaaaaaaagtagtttccaagagtcaacagccaggtgctttgggag

SEQ ID NO: 28699 - DNA, 116 bp, Homo sapiens
catactctttactacatgaagattttatatatatatatatatatatacatatatatatatacatatatatatgtatatatatatatattttttttttttttttgagatagagtctg

SEQ ID NO: 28700 - DNA, 82 bp, Homo sapiens
ggtcaataagtatctgctttatcaccgggctgatgtgagtgaggactaggtggtggggcttccacagatgaacgttttgatt

SEQ ID NO: 28701 - DNA, 66 bp, Homo sapiens
gcagcaactgcctggctcagtccgtgtgtctgctctcaagaccccgactatgcccctgcaggctcc

SEQ ID NO: 28702 - DNA, 69 bp, Homo sapiens
ggcaagtaatggagctggtttctaacgatgacagtcagtctctgtctagactctgtgctcttaactgcc

SEQ ID NO: 28703 - DNA, 57 bp, Homo sapiens
cacagtcggtttatgaagagggtctctgaagagagtgagcctctgtaggagtctgtg

SEQ ID NO: 28704 - DNA, 95 bp, Homo sapiens; identical to SEQ ID NO: 68

SEQ ID NO: 28705 - DNA, 93 bp, Homo sapiens; identical to SEQ ID NO: 69

SEQ ID NO: 28706 - DNA, 85 bp, Homo sapiens
ggatctgcatgtgagtgctagaaagcatgctgccattccggttctcttcttggctcagtctgtcactcacacacaaaacacttcc

SEQ ID NO: 28707 - DNA, 114 bp, Homo sapiens
cattagccataaaatgtcttgatcattcttcctttatgtgaaaggtaatgttttcatttattttttttaacttttccagcatcccacagtatcaggacagtttgttgtacaatg

SEQ ID NO: 28708 - DNA, 78 bp, Homo sapiens
ggagctggaagacagtgacactgatggtcctggccctgcataggcctaggctaatgtctgtgtttgtgtctcagtttc

SEQ ID NO: 28709 - DNA, 111 bp, Homo sapiens
gatttttgtatcttgattttctatcctacaactttactgaatttgtttatcagttctaatagtttttttggtggagtctttaggtttttccaaatacaagatcatataatc

SEQ ID NO: 28710 - DNA, 66 bp, Homo sapiens
ttcttgtgagtcagagtctcactctgttgcccaggagtgcagtggcgagatctcaactcactggga

SEQ ID NO: 28711 - DNA, 78 bp, Homo sapiens
gcatccctggcataaataccacctgattatggtgtgttatctttttgatgtactgttagtggtttgctggtattttgt

SEQ ID NO: 28712 - DNA, 117 bp, Homo sapiens
tctatgaatttgactcccctggttatctcatgtaagtggaagtatacagtatttgttctttcgtgtctggcttatttaacttagcataacgtcttccaggttcatctatgttgtaga

SEQ ID NO: 28713 - DNA, 99 bp, Homo sapiens
tctaagctttagtttgaacaaggtgctctgtgtctgtatatgtgtgttcatatgtgtatttgaatacaactgcccttgcccaatccttctatcacaaga

SEQ ID NO: 28714 - DNA, 111 bp, Homo sapiens
ttggccatttgggttcttttgtggttccatatgaatttaagaattgtttttctatttctgtgaaaaatgtcctggaattttgatagggaatgcactgaatctatagatcaa

SEQ ID NO: 28715 - DNA, 119 bp, Homo sapiens
agatggtggtgtggctgcagggaacacttttatactgctggtgggagtgtaaactagtatagctgctatggaaaacagtgtggatattcctttaagaactaaatgtagaactaccattt

SEQ ID NO: 28716 - DNA, 95 bp, Homo sapiens; identical to SEQ ID NO: 68

SEQ ID NO: 28717 - DNA, 93 bp, Homo sapiens; identical to SEQ ID NO: 69

SEQ ID NO: 28718 - DNA, 95 bp, Homo sapiens; identical to SEQ ID NO: 68

SEQ ID NO: 28719 - DNA, 93 bp, Homo sapiens; identical to SEQ ID NO: 69

SEQ ID NO: 28720 - DNA, 102 bp, Homo sapiens
agtgtcatttgcagcacaaaagtttttgatttttatgaaggccaaattactttattttgtttcattttttggttgggcttttgtgtctgaaaagggttcgct

SEQ ID NO: 28721 - DNA, 118 bp, Homo sapiens
tgttgttgcatatgtatacatacatatttatatatacatatttatgtatatatgtatatatttgtatatatgtatatatttgtatatacatatatgtatgcatatatttgtatataca

SEQ ID NO: 28722 - DNA, 104 bp, Homo sapiens
gaagtatagataaatggtagatagatgatagatagctgtgtgtatgtatttatttttatatatatatatatatatttccttctgcaaaattgtattcaattttc

SEQ ID NO: 28723 - DNA, 95 bp, Homo sapiens; identical to SEQ ID NO: 68

SEQ ID NO: 28724 - DNA, 93 bp, Homo sapiens; identical to SEQ ID NO: 69

SEQ ID NO: 28725 - DNA, 118 bp, Homo sapiens
gtaagaaaactttaggtcttatcttaaaacagccaggaaaccttctctaacacacactctcagttaggagctcttgctatttataggatgttgtccatacttctagagtagtgcttat

SEQ ID NO: 28726 - DNA, 98 bp, Homo sapiens
acaactattactatactatgcttactatagtttaaactcaacaactatatatagatatatagtttaaactatagtaagtgtagtatagtaattgttgt

SEQ ID NO: 28727 - DNA, 110 bp, Homo sapiens
gaagaattactctaaaataaaaatgtctcaatattatgaaatcattatcaattataggtgagattttttaaatttaatttgacaggcttatgtatggagtataagttttc

SEQ ID NO: 28728 - DNA, 107 bp, Homo sapiens
taaagaggctaaaatcatactgggtatttggattatatttttccttttgaaaatttaaatttgaaaaaaaatacacatacctgagtgtgtgtttgtatgtatctttg

SEQ ID NO: 28729 - DNA, 114 bp, Homo sapiens
tggctttataatggatacaacctaagtttaatgatgtccttttgtttagagacagagtctggctctgtcacccaagctgaaggcaccattgtagctcactgcatccttgaacta

SEQ ID NO: 28730 - DNA, 117 bp, Homo sapiens
atgtgttaactttatgtcactgtcacattttggttaattcctgcaatatttcaaactttattattattatagctattatgattatttgtgaccagtgatctttgatgttactatcgt

SEQ ID NO: 28731 - DNA, 114 bp, Homo sapiens
ttcaatgtgagaattaaaagcaaaaatatgggtaaactccttagacaagtgactgagcacataataaaaacttggtaaaatttagctattctttctgttgattcttacatggaa

SEQ ID NO: 28732 - DNA, 132 bp, Homo sapiens
aatggtgctaaagtgtattatgactgtcagataaaatcaggcaaaattttgtggtgcttaaattaattttttcattgattttattgatcagtgcattgaacagtgtttattattcacaagttgtcttttatt

SEQ ID NO: 28733 - DNA, 80 bp, Homo sapiens
tataaatacatatatatatatatatatatatacataacgtgtaaatatatatacacgtatatatatgcatgtgtgtgtat

SEQ ID NO: 28734 - DNA, 96 bp, Homo sapiens
tgcctagagaacgttttgtcacataatttcatactttttgtttttatctcatctttgataaaatgtgtctgtgtgtccagtgtactttcctaggca

SEQ ID NO: 28735 - DNA, 87 bp, Homo sapiens
tttggtgatgatttctgatttttatttctagatatggactgtactattttaagtatttatatatttaaaattagaaatctgttcaaa

SEQ ID NO: 28736 - DNA, 58 bp, Homo sapiens
tgagacagggcctcactctgtcgctcaggcctgagtgcagtggtgcgatcttggctca

SEQ ID NO: 28737 - DNA, 91 bp, Homo sapiens
ctgagttgaaggcagtgctgaccagaatggtcaactgaaataggcagaagagaccctggtcagcactctcggacatgccttaccaagacag

SEQ ID NO: 28738 - DNA, 95 bp, Homo sapiens; identical to SEQ ID NO: 68

SEQ ID NO: 28739 - DNA, 93 bp, Homo sapiens; identical to SEQ ID NO: 69

SEQ ID NO: 28740 - DNA, 58 bp, Homo sapiens; identical to SEQ ID NO: 502

SEQ ID NO: 28741 - DNA, 74 bp, Homo sapiens
tgcagagtggttaataaatcttactcgggttctcttattcataattgagagatgagagagttaacttctcttca

SEQ ID NO: 28742 - DNA, 91 bp, Homo sapiens
ggcaacagagtcacacccagtctctaaataaataaatataaaataattaggtcaattttttttttttgagacggagtctcactctgtcgcc

SEQ ID NO: 28743 - DNA, 112 bp, Homo sapiens
tagacatgtgtgtatatctatatatacacacacacatatatgtatatatgtatatatgtatatgtctatatgtgtatgtctatatatgtgtatatgtatatgtatatatgta

SEQ ID NO: 28744 - DNA, 115 bp, Homo sapiens
gtatatagacatatacatatgtgtatatatgtgtatatatgtatatacatatgtatatatgtgtgtatagatgtgtgtatatctacatatatacatatacatatacacatatata

SEQ ID NO: 28745 - DNA, 93 bp, Homo sapiens
aaggcttatgtgtatatatgtatgtatgtgtgtatgtgtatatatatgtatatacatatatgttttatacatacatgtttttaatatatacac

SEQ ID NO: 28746 - DNA, 65 bp, Homo sapiens
ggtatggtggtgctgcctgtagttccagctactcgggaggctgaggtagaagaatcacttgaacc

SEQ ID NO: 28747 - DNA, 76 bp, Homo sapiens
aaagctttcggcttttaaccattgagagtgatgttagctgtgggcttgtcatataatccagaaagctgtaggcttt

SEQ ID NO: 28748 - DNA, 99 bp, Homo sapiens
ctcaaatgagatctttgtcttttgttgagtagctctgggtctgtttagctcaagcatggctcagagatgaatcagagctctacatagacataatttggg

SEQ ID NO: 28749 - DNA, 112 bp, Homo sapiens
ggattgtcttggcgatgcgggctctttttcggttccatatgaaatttaaagtagttttttccaattctgtgaagaaagtcattggtagcttgatggggatggcattgaatct

SEQ ID NO: 28750 - DNA, 95 bp, Homo sapiens; identical to SEQ ID NO: 68

SEQ ID NO: 28751 - DNA, 93 bp, Homo sapiens; identical to SEQ ID NO: 69

SEQ ID NO: 28752 - DNA, 118 bp, Homo sapiens
ccagctttgctctttttgcttaggattgtcttggctatgtgggttcttttttggttccatatgaagtgtaaagtagttttttccaattctatgaagaaagtcaatggtagcttgatgg

SEQ ID NO: 28753 - DNA, 108 bp, Homo sapiens
gatagtgaataagtctcatgagaactgatggttctataaaggggagtttccatgcacaggctctctctctttgtctgcagccatccatgtaagatgtgacttgctgtt

SEQ ID NO: 28754 - DNA, 104 bp, Homo sapiens
ctgccttttaattggaatgcgtagtctattaatatttaatataataataataattattattttttgagaaggagtctcgctgtgtcacccaggctggagtgcag

SEQ ID NO: 28755 - DNA, 95 bp, Homo sapiens; identical to SEQ ID NO: 68

SEQ ID NO: 28756 - DNA, 93 bp, Homo sapiens; identical to SEQ ID NO: 69

SEQ ID NO: 28757 - DNA, 89 bp, Homo sapiens
actcaaattgtgatagggtttacagaaacgcctagtggcttatgaagcatatgtgtgtctgagtgtctctgtgtatgttgcgtgtgtgt

SEQ ID NO: 28758 - DNA, 106 bp, Homo sapiens
ttaatatttctattaaaatttttttatgctttcttatcttaatgaccagcaagaggctagtgcaagtaggtggtattgttgagtatttgatagaaatttacattaa

SEQ ID NO: 28759 - DNA, 94 bp, Homo sapiens
gtggaattgctggatgatacattagttatatttttaattttttgagaaacctcttactctttttgactgtggctgtacaattttgcgtttccac

SEQ ID NO: 28760 - DNA, 82 bp, Homo sapiens
gtccttgaggaaggggggtgggtaaggggctgcaagtgaaggacccaaaatggagtctgtctggctctctcagctaagggat

SEQ ID NO: 28761 - DNA, 116 bp, Homo sapiens
ttttattgttgaggagcattccattatatgagtgctttatagtttttttttataatttcaacttttattttagattcgtggggcacatgttcaggtttgttgcaaagataatagag

SEQ ID NO: 28762 - DNA, 100 bp, Homo sapiens
ggcaaaacttatgatatgttattaaatggctttatatataaatatatggctttatatataaatatataaagccatttaataacatatcataagttttgcc

SEQ ID NO: 28763 - DNA, 86 bp, Homo sapiens
agttttagggtacatgtgcacatcgtgcaggtttgttacatatatatatatacatgtgccatgttggtgtgctgcacccattaact

SEQ ID NO: 28764 - DNA, 95 bp, Homo sapiens; identical to SEQ ID NO: 68

SEQ ID NO: 28765 - DNA, 93 bp, Homo sapiens; identical to SEQ ID NO: 69

SEQ ID NO: 28766 - DNA, 85 bp, Homo sapiens
gtggggaaaagattgagaaatcggatggctgccgtgtctgtgtggaaagaagtagacatgggagacttctcattttgttctgtac

SEQ ID NO: 28767 - DNA, 114 bp, Homo sapiens
gcttgtaaatttgctcaagttccttatagatgctggatattaggcctttgtcagaggtaaagttgtgaaaatgttctcccattctgtaggttgtctgtttgctttgttaatagt

SEQ ID NO: 28768 - DNA, 81 bp, Homo sapiens
ctggctcaggtctggaaattgattgaggacagtaattctctgtttttataattcaaattagtctttttccacttgagctgg

SEQ ID NO: 28769 - DNA, 78 bp, Homo sapiens
tagaactataatccacctggaattgattttataaaatgtttatttttgtgaacagtgtaaggtgggtgttacgtttta

SEQ ID NO: 28770 - DNA, 101 bp, Homo sapiens
tgtgtatgtatgtatatattgggttggtgcaaaagtaattgcggttttaaaggtaatggcagaaactgcatctacttttgcaccaaccatatacacacaca

SEQ ID NO: 28771 - DNA, 119 bp, Homo sapiens
tgttatgcattgtaatccttaaaaggtgggcttcacagtcctccaatcttagagttctttatttgattttctaaaaactgtgaagggactgggtggggaagaataaatagatgagaata

SEQ ID NO: 28772 - DNA, 118 bp, Homo sapiens
tatcatgaagtgtggatgaattttttcaaatgccttttctgcatctattgaggtgatcatgtttttttccttaattatgtttatgtgatgaagcccattaattggttcacatatggta

SEQ ID NO: 28773 - DNA, 75 bp, Homo sapiens
accagcaatgtgtgagagatccagctattccgcatcattttctaaagggattctttggttttcttactgttgagt

SEQ ID NO: 28774 - DNA, 72 bp, Homo sapiens
catgggaaaagtaagtatgtatgtatgataggtatgtatgtacagtatacatagggttcagtgctacccatg

SEQ ID NO: 28775 - DNA, 81 bp, Homo sapiens
atccagtaactttatacatatataaacatacatatacccatatatgtgggagtatgtttatatatgtttagaaagtgggat

SEQ ID NO: 28776 - DNA, 115 bp, Homo sapiens
gttactagaactgagctaatgaaaatgtcatcggaaagttaaagacaaaatttattttagataaatctgtattgtttacgcattcacaggactaagcgggtgatactttagtaac

SEQ ID NO: 28777 - DNA, 107 bp, Homo sapiens
cttctgaggtgttcctggagaggccaagaatgccaacctcgatgagaagctcagctgggtgcaggcttggttctccatgtgcctctccaaagaatccctctccaaag

SEQ ID NO: 28778 - DNA, 93 bp, Homo sapiens
cagagagatgctacagaggcactagctctgtgtgtgtgtgtgtctgctcacatacatacactaatagcttccatcctttctatgcactcattg

SEQ ID NO: 28779 - DNA, 65 bp, Homo sapiens
gagaggaagacagagaaagagtgagtgttctttactgaactcactctttctctgtctgagttttc

SEQ ID NO: 28780 - DNA, 102 bp, Homo sapiens
ataatagccattctaataggtgtgaggagatatcttattgttaatttttatttctctgattagtgatgttaagcattttttcattacctgttggccatttat

SEQ ID NO: 28781 - DNA, 87 bp, Homo sapiens
acacatatatatgtgtatatatatatatatacatatatgtgtgtgtgtgtatatacacatatatatgtgtatatatatataacctca

SEQ ID NO: 28782 - DNA, 60 bp, Homo sapiens
cctgggtccctgagtcactgcgtggacaaaccctcctgctgatcaggcgcaccacccagg

SEQ ID NO: 28783 - DNA, 76 bp, Homo sapiens
tgtggtattgaggaatagaaatggaatcaaaatacaatgtttcgtttttattttttaagatgggaagaatgccata

SEQ ID NO: 28784 - DNA, 74 bp, Homo sapiens
ggagtgcacatgacaatggggtgggggaagaaaatacaagaaaattctatttctatcaatttttatgtcattct

SEQ ID NO: 28785 - DNA, 95 bp, Homo sapiens
tttttttgagacaaagtctcactctgtcgctcaggctggagtgcagtggtgtgatctcggctcactgaaacctctgcctcctggattcaagcgat

SEQ ID NO: 28786 - DNA, 88 bp, Homo sapiens
ggtccatttgatccagtgcagatttcaggtcctgaatatatttgttaattttctgccttgatgatctgtctaatactgtcagtggggt

SEQ ID NO: 28787 - DNA, 111 bp, Homo sapiens
gtggcagtgttggtacaagggtgggatgctggtggaagtgggctggctggctctgtgcctgccatggctctgactgcaatggtggtccagtgggtgaaagagggatggagt

SEQ ID NO: 28788 - DNA, 58 bp, Homo sapiens
cataacctggaccaaaacagtcagactcactgtctcacactgtttgtggtaggctgtg

SEQ ID NO: 28789 - DNA, 104 bp, Homo sapiens
tcgtggactccagttcctgcctctttctctcacatgctctctcccacaaggagttgaaagctgcgggctgggtaaatgaggcaacactgcagtgagtcccatga

SEQ ID NO: 28790 - DNA, 70 bp, Homo sapiens
tgagaccccatctgttagtctctctctttttttttttttttgagacagagtctcaacgggaagagtctca

SEQ ID NO: 28791 - DNA, 58 bp, Homo sapiens
tgaaacagggtctcactctgtcaccccagttggagtacagtggcgtgatcttggctca

SEQ ID NO: 28792 - DNA, 58 bp, Homo sapiens; identical to SEQ ID NO: 6359

SEQ ID NO: 28793 - DNA, 83 bp, Homo sapiens
tgactgacgaatttggagaaagaactgagcctgctgacttagtcccttgctctctctctctgtcttccagactcattctgtca

SEQ ID NO: 28794 - DNA, 95 bp, Homo sapiens; identical to SEQ ID NO: 580

SEQ ID NO: 28795 - DNA, 93 bp, Homo sapiens; identical to SEQ ID NO: 69

SEQ ID NO: 28796 - DNA, 82 bp, Homo sapiens
cctcggacagacactgtcagtctaatcagaggccttgaattattaaagctctctagccacttagagctgcaggtcaccaagg

SEQ ID NO: 28797 - DNA, 66 bp, Homo sapiens
gtatatgtatatatatgtatatatgtgtatatgtgtatatacgtatatatatgtgtatatatgtat

SEQ ID NO: 28798 - DNA, 110 bp, Homo sapiens
aaggataactggatttcttaaaatgtgatacatatatatatatatatatatatatatatatatatatatatacacacacacacacatactatgaaatactgttcagcctt

SEQ ID NO: 28799 - DNA, 95 bp, Homo sapiens; identical to SEQ ID NO: 68

SEQ ID NO: 28800 - DNA, 93 bp, Homo sapiens; identical to SEQ ID NO: 69

SEQ ID NO: 28801 - DNA, 98 bp, Homo sapiens
tgatgcctctaaggagatcatctgctatttctcaaataatgtattattgctatttttgttaatcatattaatagcagttgatatttcttcactcgtca

SEQ ID NO: 28802 - DNA, 116 bp, Homo sapiens
atatttttcaagtgtcttgactattcttggccatttgcatttttatttaaaaatttaaataagcttgtaaaaagccattaaaatattctattgtaactttacttgatattaaatat

SEQ ID NO: 28803 - DNA, 65 bp, Homo sapiens
ggctaaggagaggactttgttgttgttgttgttgttgtttttgagacagagtctctctctgtccc

SEQ ID NO: 28804 - DNA, 62 bp, Homo sapiens
gtgagagagagagtctcactctgtcgcccaggctggagtgcagtgccacaatctcggctcac

SEQ ID NO: 28805 - DNA, 79 bp, Homo sapiens
tgagatgagtctcactctgtcacccaggctggagtgcagtggtgtgatctcagctcactgcaagttctgcctcctgggt

SEQ ID NO: 28806 - DNA, 95 bp, Homo sapiens; identical to SEQ ID NO: 68

SEQ ID NO: 28807 - DNA, 93 bp, Homo sapiens; identical to SEQ ID NO: 69

SEQ ID NO: 28808 - DNA, 111 bp, Homo sapiens
ggattgtcttggctatatgggtcttttttggttccatatgaaatttaaagtagttttttctaattctgtgaataaagtcaatggtagcttgatgggaatagcattgaatct

SEQ ID NO: 28809 - DNA, 60 bp, Homo sapiens
agtgacagtatctcactctgtcaccctggctggagtgtagtggtgagaacatagctcact

SEQ ID NO: 28810 - DNA, 116 bp, Homo sapiens
acaatagccaaggaagttagagacacagaatgtctggttcctttatagaaactaaagataatatctttttttttttttttttagactgagtctcgctctgtcgcccaggctggagt

SEQ ID NO: 28811 - DNA, 88 bp, Homo sapiens
gaaatgtggtaaagagtgcaattggatctgtgcaaatttgcttatatttttataaagctgaggttttcattccaacactgccactttc

SEQ ID NO: 28812 - DNA, 105 bp, Homo sapiens
agaactgagtttcagaaaggtgaaatgatttttttttttttaatggtcacggagctcgatagtgcttctgggaagggtgattcacagtctctcaagttttagttc

SEQ ID NO: 28813 - DNA, 64 bp, Homo sapiens
gccagtggcacagacactgacacagtaaacatttttttgctgttgttggacttgtgtgcactgc

SEQ ID NO: 28814 - DNA, 65 bp, Homo sapiens
tggaaaggggcctttgggaatgactttcaaacttcactttgacagtctctctgcctctatttcta

SEQ ID NO: 28815 - DNA, 81 bp, Homo sapiens
ggatagaattgaatggtggtcgctgataggaatagggcgtcctctagctcttatctctgtctcttactcttttctctttct

SEQ ID NO: 28816 - DNA, 61 bp, Homo sapiens
caggaggctgaggtagaaggatctgcttaagcctgaggaggtagagacttcagtgatcctg

SEQ ID NO: 28817 - DNA, 171 bp, Homo sapiens
gtgtgtgtgtgtgtgtgtgtgtgtgtgtgtgtgtatatatgtatatatatatgtgtatatatatgtatatgtgtgtatatatatgtgtatatatatgtatacgtgtgtatatatatgtgtatatatatgtatacatgtatacacacacacacacacacacatatatatatg

SEQ ID NO: 28818 - DNA, 85 bp, Homo sapiens
gaatttttatgaagtttctgccattaaggtacttttttgttttttaaaatttggagggtaatgactgggaatagcatagagattt

SEQ ID NO: 28819 - DNA, 83 bp, Homo sapiens
catgtgcatgtatatatgatatgtaaatatatgtatatatgtatttatatgtatatatatttatgtatgtacgtatacatgta

SEQ ID NO: 28820 - DNA, 97 bp, Homo sapiens
ctgtaagcataaaaccaaaaccaaagtcaattccaaagggcaaaaagtaagtgattttttttttatttatttctttttggtgggggtgggtgcatag

SEQ ID NO: 28821 - DNA, 103 bp, Homo sapiens
tgttttttcctgactttttaatgatcagcattctaactggtgtgagactgtatctcactgtggttttgatttgcatttctctgatggccagtgatgatgagca

SEQ ID NO: 28822 - DNA, 87 bp, Homo sapiens
gctgaggaagaattgagtgggaagatactgagaggtgacagcgtgctggcaaccctcgctcactctcagtgcctcctcggcctcagc

SEQ ID NO: 28823 - DNA, 95 bp, Homo sapiens
cacattgtaacagagtcccccagtaatcaagttgcaggaaggctgttataatagtctttctctgtctctgaattgcagcgggaaaggcagatgtg

SEQ ID NO: 28824 - DNA, 104 bp, Homo sapiens
ttgtaacagagtcccccagtaatcaagttgcaggaaggctgttataatagtctttctctgtctctgaattgcagcgggaaaggcagtttcttttctgtgaacaa

SEQ ID NO: 28825 - DNA, 109 bp, Homo sapiens
tggataaaagccattttaaccgggctgagataatacgtcattgtaattttgatttacatttttctgatgatcagtgatgttaagcatctcttcatatgcctgcttgcca

SEQ ID NO: 28826 - DNA, 99 bp, Homo sapiens
ggtattctgatagcattaacaataagtatgatgattttttgagtatctatatatgtatcaattatcgattactatgataatgctacattatgaaggacc

SEQ ID NO: 28827 - DNA, 110 bp, Homo sapiens
tttacttttatttactagatagatctataaaattttatcagtagtgcgatgactatcagtctctgagtgtcatatgcttatgagcttcaatctatgtggtaattgtagaa

SEQ ID NO: 28828 - DNA, 111 bp, Homo sapiens
taggtacattaattttaggcgtcagttgcttgatttgtgcctcaagatatttattttttcttgtggaggtaaaatgcacttttctagctttctgaaaaattgaagtgcttg

SEQ ID NO: 28829 - DNA, 91 bp, Homo sapiens
gttttgcagatgatggagttgtaaaacacagcaaagcttagtgatttccctgtgatcacacagccagctgtgatgacaccagaataaaagc

SEQ ID NO: 28830 - DNA, 61 bp, Homo sapiens
tctgtgttttgtgcatgtgcatgtgcatgcgtgcgcgtgcacacacacacacacacacaga

SEQ ID NO: 28831 - DNA, 117 bp, Homo sapiens
agagataatgtgactggtgatgataaaagaatttcaatgtcatttaaatatttattctttaaaggaaaaaagttgtcaatgaaatcaaacaaaatattactgtttgcaattgtttct

SEQ ID NO: 28832 - DNA, 85 bp, Homo sapiens
gacatgtaaggtggcagagaagagaggagagcacctgttaaaagcatcctatattggtctctctttctgagtgtgtcagtgtcat

SEQ ID NO: 28833 - DNA, 73 bp, Homo sapiens
gtttattgatttgcatatgtcgaaccagccttgtatcccagggatgaagctgacttgatagtggtggataagc

SEQ ID NO: 28834 - DNA, 75 bp, Homo sapiens
ggcctggtggctcacgtctgtagttccagctacttggaaggctgaggttggaggatcacttgagcccaggaggcc

SEQ ID NO: 28835 - DNA, 82 bp, Homo sapiens
gaataccagagctcagttttggtcatgtaacattttagatatttattaaacatctatgtgaagatacatgagtctggagttc

SEQ ID NO: 28836 - DNA, 64 bp, Homo sapiens
ggtgtgagaaatgagtcaggtcacttggccttagcattagagacctggatttgtttggcaaatc

SEQ ID NO: 28837 - DNA, 82 bp, Homo sapiens
gcttctccacttcagagcgtctgtgtctgtgcgtgcctaagcatttctcctgctccactgcctcctcagacccgaagtaagc

SEQ ID NO: 28838 - DNA, 79 bp, Homo sapiens
gtgagctgatggatgggtgattttatgcatttcttgtgctgttgggtctaagaggtagttggttcaaatcaaggctgac

SEQ ID NO: 28839 - DNA, 91 bp, Homo sapiens
gacactcagtaggtgctcagtcaatgcttattgaatgaataaatgaatgaatgattctgaagatttgtgacaggtgtgtacctactgtgtt

SEQ ID NO: 28840 - DNA, 66 bp, Homo sapiens
gttttgagacagggtctcactctgtcactcaggctggagtacaatggtacgatcttggctcactac

SEQ ID NO: 28841 - DNA, 95 bp, Homo sapiens; identical to SEQ ID NO: 68

SEQ ID NO: 28842 - DNA, 93 bp, Homo sapiens; identical to SEQ ID NO: 69

SEQ ID NO: 28843 - DNA, 70 bp, Homo sapiens
gacacatgactgtgtgtgtgtgtgtgtgtgtatacacacacacacacacacacacacaggattatttgtt

SEQ ID NO: 28844 - DNA, 112 bp, Homo sapiens
ggattttggtttgggcaacacataggcaatggtttctttttcttttctttctttctttctttttttttttttttgaaacagagttttgctcttgtcgcccaggctggagtgc

SEQ ID NO: 28845 - DNA, 101 bp, Homo sapiens
caattcttacccttgcttgttcattaaatctagatttggatacatgttagtctcctgatttacatgattttctcatcatgcatttttgggtttttttattg

SEQ ID NO: 28846 - DNA, 140 bp, Homo sapiens
gcataatatcatagggtgtgcaaccactatgatattagcaggaatatcaattttctgcataatatcacagtgggtgtacaaacactgtgatattagcagtaatatcgaatctatattctgcataatatcacaaggtgtac

SEQ ID NO: 28847 - DNA, 95 bp, Homo sapiens; identical to SEQ ID NO: 68

SEQ ID NO: 28848 - DNA, 93 bp, Homo sapiens; identical to SEQ ID NO: 69

SEQ ID NO: 28849 - DNA, 93 bp, Homo sapiens
caagcgtgttagacttgccatctaattttagttactagtgtatttattttttgtaataagcattaactaaatagaagcagtgtaacatggttg

SEQ ID NO: 28850 - DNA, 123 bp, Homo sapiens
gggagtgtgtgttgtggttactgctattgtttgcatatgacattatatctactttttttttttgagacagagtttcgttcttgtcatccaggctggagtgcattggcagcgatctcggctcac

SEQ ID NO: 28851 - DNA, 76 bp, Homo sapiens
cctagaaacttcactgaaaccctgttttgcatatatatatatatagtagagacggggtttcactatgttggccagg

SEQ ID NO: 28852 - DNA, 58 bp, Homo sapiens; identical to SEQ ID NO: 454

SEQ ID NO: 28853 - DNA, 83 bp, Homo sapiens
cagctcctgaccgcgagtgatctgcctgtctcggcctcccaaggtgccgggattgcagacggagtctctctcactcagtgctg

SEQ ID NO: 28854 - DNA, 77 bp, Homo sapiens
cacctggttatctttcactatgcattcattgtagtgtttgaaaagttgtttgtggtagtgatatgaagcctaaggtg

SEQ ID NO: 28855 - DNA, 116 bp, Homo sapiens
gaatagagaagatggactgcagtgactgaagtgtgacaatgactagactacttaatttgttgttttcttccaatttatgactcttcgtcacagactatttgtctttgatgctattt

SEQ ID NO: 28856 - DNA, 112 bp, Homo sapiens
agcatatgtatatatatatacacacacacacacacatatatatacatatataggctatatatgtatatatatctctgtgtgtgtatatgcatgtgtatgtattatatatgtt

SEQ ID NO: 28857 - DNA, 158 bp, Homo sapiens
gtatatatgtatatatgtgtgtatatacgtatatatgtatatatgtatatatgtatatatgtatatatgtatacatatatgtatatatgtatatatatgtatgtatatatgtatatatatatatatatatatatatatatatatatatatatatgtat

SEQ ID NO: 28858 - DNA, 62 bp, Homo sapiens
cccacacggtcacactcacagtaggcacccttcaatgcctttctggcgaagtgtggattggg

SEQ ID NO: 28859 - DNA, 68 bp, Homo sapiens
cattgtgtgtgtgtatatatatatgtgtgtgcgtgtgtatgtatgtgtatgtatgcatatatatactg

SEQ ID NO: 28860 - DNA, 105 bp, Homo sapiens
ggcaagaatccttcctaagtagcatttcatatctaggaggaggcacacaatgaccagctgtctctctttctgtgaggtagcagccatggatgacccttgcctaga

SEQ ID NO: 28861 - DNA, 70 bp, Homo sapiens
cctgagacagggtctcactctgtcacccacgccggcatgcagtggcacgatcttgactctgcttcccagg

SEQ ID NO: 28862 - DNA, 114 bp, Homo sapiens
cgacaagacaaaacaacagagcaagggcaatcctcagttggaactcactgaactgtcagaggagaggcaggagactttagcaaggaggctgagctttctgtggttggtaggtgg

SEQ ID NO: 28863 - DNA, 104 bp, Homo sapiens
ttctggccatctcttttatctttgtgtcgctcacttgtgatctaaaattccaaaaagtagggtcagattgggtgagacctagattgttaggggttgggagagaa

SEQ ID NO: 28864 - DNA, 95 bp, Homo sapiens; identical to SEQ ID NO: 68

SEQ ID NO: 28865 - DNA, 93 bp, Homo sapiens; identical to SEQ ID NO: 69

SEQ ID NO: 28866 - DNA, 101 bp, Homo sapiens
tacatcctcaggaacacttgttattttccatttaaaaaatttttttattattggcatctcagtagttgtgaagtggtatttcactgtggttctgatttgta

SEQ ID NO: 28867 - DNA, 79 bp, Homo sapiens
cagacctcagattaggggaaacaggactgaactctaactgctattattctttgttctgaatttcttcttcagaggcctg

SEQ ID NO: 28868 - DNA, 100 bp, Homo sapiens
gaagaggtccttcacgtcccttgtaagttggattcctaggtattttattctttttgaagcaactgtgaatgggagttcactcatgatttggctctctgtc

SEQ ID NO: 28869 - DNA, 115 bp, Homo sapiens
tttaaaaagaatgttgcaggtagtattctgtgtgaaggagtagtaggcccagttagattagctttatttctttttaaaaaagtaattgcaaaaacctgcaggatgagaatgtgag

SEQ ID NO: 28870 - DNA, 118 bp, Homo sapiens
tatatatatacatgtatatatgtatatatatgtatatatgtatgtgtatatatgtatgtacatatgtgtatatgtgtatatatgtatatacatatgtgtatatatgtatatatgtgta

SEQ ID NO: 28871 - DNA, 72 bp, Homo sapiens
ctgggcgcggtggctcacacttgtaattccagcactttgggaggctgaggtaggtggatcacttgaacccag

SEQ ID NO: 28872 - DNA, 110 bp, Homo sapiens
gcagaggtgcatgcctgtaaccctaactactcagggggctgaggtaggaggatcacttgagcccaggagtttgaggctatagttaagttatgatatgatcgcctcactgc

SEQ ID NO: 28873 - DNA, 72 bp, Homo sapiens
gggcaacatagcgagacccccatctctacaaataatttttttttttagagacacggtctcactctgtcactc

SEQ ID NO: 28874 - DNA, 105 bp, Homo sapiens
taggactttgggggaggtggaggacacaattcagttcttaagtatatattaaactttttaatgtggatagttggtcttccacaaaatagagaaccagagtaccta

SEQ ID NO: 28875 - DNA, 58 bp, Homo sapiens
tgagactgagtctcgctctgtcacccagactggagtgcagtggcatgatcttggctca

SEQ ID NO: 28876 - DNA, 103 bp, Homo sapiens
tataacctaatgaatgaatatatatatgtgtgtatatacatatatatattcattattcaatatattcattattttatatatatatatatatatatatatatat

SEQ ID NO: 28877 - DNA, 117 bp, Homo sapiens
gcaagcaatggggagtggcagtaaatacagataaatctgcagttgtcatcatcatcatcatcgtcatcatcatcatcattgtcactgctgctgctgctgccactcacctcctgctgt

SEQ ID NO: 28878 - DNA, 58 bp, Homo sapiens
tgagactgagtctcactctgtcgcccaagctggagtgcagtggcatgatctcggctca

SEQ ID NO: 28879 - DNA, 106 bp, Homo sapiens
gtatttttagtagagacggagtctcaccatgttgagtgttgacagagtcacactgtctcaaactcctgaactcaggtgagccacccgccttggcctcccaaagtgc

SEQ ID NO: 28880 - DNA, 111 bp, Homo sapiens
ccaccgcactccagtctgggcgacagaacgagaccctgtcttttttttttttttttttttttttaactaaagacacagcctcactctgtcacacagattggagtgcagtgg

SEQ ID NO: 28881 - DNA, 95 bp, Homo sapiens
gctgtgcagaagctctttaattaggtcccacttgtcagtttttatttttattacaactgcttttggagacttagccaaaaattctctgctaaggc

SEQ ID NO: 28882 - DNA, 58 bp, Homo sapiens
tgagtcggagtctcgctctgtcacccaggctggagtgcagtggcgcaatcttggctca

SEQ ID NO: 28883 - DNA, 116 bp, Homo sapiens
tgatctgtcacccaagctggagtgctgaggtgtgattgtaactcactgcgtcttctaattcttgaggttaagcagtcctcctgcctcagctttctgaggaactgggactacaggca

SEQ ID NO: 28884 - DNA, 72 bp, Homo sapiens
ctgggtgtagtggtgcacgcctgcattcccagctactcaggaggctgaggtgggaggttgacttgagcccag

SEQ ID NO: 28885 - DNA, 81 bp, Homo sapiens
ggcatgcctgtagtcccagctgcttgggaggctgaggtaggaggatcacttgagcccaggaggttgaggatgcagtgagcc

SEQ ID NO: 28886 - DNA, 80 bp, Homo sapiens
cttaggggaaaacacagatggttactgcagccctggatcagagccttccctccactcagtgaccctgtgtccctcagaag

SEQ ID NO: 28887 - DNA, 109 bp, Homo sapiens
gaaagagatcagaaaccatagagaggaagtgggagaaagttctgcccagaatctaaggtgaggtactaggtagtaaatgtaattctgagcctctcgtcttgcttttttc

SEQ ID NO: 28888 - DNA, 95 bp, Homo sapiens; identical to SEQ ID NO: 68

SEQ ID NO: 28889 - DNA, 93 bp, Homo sapiens; identical to SEQ ID NO: 69

SEQ ID NO: 28890 - DNA, 58 bp, Homo sapiens
tgagacagggtctcactctgtcacccaggctggagtgcagtggcacgatcttgactca

SEQ ID NO: 28891 - DNA, 95 bp, Homo sapiens; identical to SEQ ID NO: 68

SEQ ID NO: 28892 - DNA, 93 bp, Homo sapiens; identical to SEQ ID NO: 69

SEQ ID NO: 28893 - DNA, 118 bp, Homo sapiens
gtattatactttcaattttagtatccacatgttagttggaactttattaaaatataattgattttcttattatactttaagttctgggatacatgtgcagaacgtgcaggtttgttac

SEQ ID NO: 28894 - DNA, 82 bp, Homo sapiens
taattttggaagtagttctgtgcatattatacatatgtatataagcatatatatatatatgcacagaactacttaaaaatta

SEQ ID NO: 28895 - DNA, 95 bp, Homo sapiens; identical to SEQ ID NO: 68

SEQ ID NO: 28896 - DNA, 93 bp, Homo sapiens; identical to SEQ ID NO: 69

SEQ ID NO: 28897 - DNA, 100 bp, Homo sapiens
gttgtactttaaacttcacattagacatgaaggagaggtgttctctgctcattggtttctccagagatttcagctactttactgaactgatgtgaacaat

SEQ ID NO: 28898 - DNA, 111 bp, Homo sapiens
gagctatatatacacacatgtgtatatatgtatatatgagatatatatgtatatatacatataatacacatatataatacacatatatcatacatacatgtatatcagttt

SEQ ID NO: 28899 - DNA, 341 bp, Homo sapiens
acatatatatgtatatacgtgtgtgtgtatatatatgtatatatacatgtatatatgtatatgtgtgtatatatgtatatatacatgtatatatgtatatatgtgtatatatatgtatatatatgtatatatgtgtatatatgtatatatacgtatatatgtgtatatatgtatatatacatgtatatatgtatatatgtgtatatatacatatatgtatatatgtgtatatatacatatatgtatatatgtgtatatatacatatatgtatatatgtgtatatatacatatatatgtatatatgtgtatatatacatatatatgtatatatgtatatata

SEQ ID NO: 28900 - DNA, 95 bp, Homo sapiens; identical to SEQ ID NO: 68

SEQ ID NO: 28901 - DNA, 93 bp, Homo sapiens; identical to SEQ ID NO: 69

SEQ ID NO: 28902 - DNA, 114 bp, Homo sapiens
cttgataatatcctttgatacacaaatgtcttaattttgataaaggccaatttatctattttttcttttgtcatttagacttttgctgtcatatctaaaaattcttttgtcaag

SEQ ID NO: 28903 - DNA, 101 bp, Homo sapiens
ttgatattttatttgaaaatattcaaaaagtaccatcaaattaaatgtatattttacattgtaatctactttggtctttttttttttcatttcagtgtcaa

SEQ ID NO: 28904 - DNA, 71 bp, Homo sapiens
gggcgtgcaccttgtgatattattcataatattttttatattaccgctaatatcacagtggttgtacaccc

SEQ ID NO: 28905 - DNA, 104 bp, Homo sapiens
gtgtatttgtgtgtgtgtatacacacacacacatattgtgtatatatatatgtgtgtacacatactgtgtgtgtatatatatgtatatacacacatatatacac

SEQ ID NO: 28906 - DNA, 115 bp, Homo sapiens
ggtattactgctaatatcacagtgggtgtacaccctgtgatattatttataatatttttgatattacagctaataccatagtgtgtgtacaccctgtgatgatattcgtaagatc

SEQ ID NO: 28907 - DNA, 73 bp, Homo sapiens
ccatgtctgttcactccctgtcactggctgtggttccccagcccctgaggaagggagatgcattacttcatgg

SEQ ID NO: 28908 - DNA, 83 bp, Homo sapiens
ggctactctctgagagaagagacaatgctcattggtaaaagaccctttgctccatatagtccttgctctcttaggagagagtc

SEQ ID NO: 28909 - DNA, 163 bp, Homo sapiens
tatatatatatatacacacacacacacacgtatatatgtatatatatacgtatgtgtatatatacatatatacgtatgtatgtgtatatatacgtgtgtgtgtgcttgtgtgtgtgtgtgtgtatatatatatatatatatggaattggctcacacaatcatg

SEQ ID NO: 28910 - DNA, 96 bp, Homo sapiens
ctgttgaattattagaattccttgtatattctggctattagtctcctgtaggatgaatagtttgcaagtagtcaaatatttactcccgttcaacag

SEQ ID NO: 28911 - DNA, 58 bp, Homo sapiens; identical to SEQ ID NO: 47

SEQ ID NO: 28912 - DNA, 111 bp, Homo sapiens
gctaggcatggtggtgggcacttgtaatcccagctacttgggaggctgaggtagaagaatcacttgaacccgggaggcagaggttgcagtgagttgagattgtgccattgc

SEQ ID NO: 28913 - DNA, 115 bp, Homo sapiens
tttcatcttatttatttgtccatctaataattggatttatttttctactaatattatttttaaattacaaaagaattacatccggttgtcaaaagtgcagatattataagagaag

SEQ ID NO: 28914 - DNA, 102 bp, Homo sapiens
ctccgtctaaatatatatatatatatgtatgtgtatatatatatgtgtctatatatatgtgtgtatatatatatgtgtgtgtgtgtgtatatatatatggag

SEQ ID NO: 28915 - DNA, 56 bp, Homo sapiens
tgagactgagtcactctgtcacccaggctggagtgcagtggtgcgatcttggctca

SEQ ID NO: 28916 - DNA, 108 bp, Homo sapiens
gtcctatccctggccttgctgacatctgtaggtgatcaaggtgaaagcagaagacccttctgtctcctcattctctcagctgctgagcagccaaatatggggagctgc

SEQ ID NO: 28917 - DNA, 102 bp, Homo sapiens
tggtctctcttctccatgaaatcataagctgctagagatcacaggctaggtattttttatttctgtattctgggggcctgctacatcatgaatgcttgatca

SEQ ID NO: 28918 - DNA, 113 bp, Homo sapiens
gggagaacactgtcctttagatttgttgtctggacctccactggagtatgtagtcagtgtctttcagtgaatttgtccaacttttcagtgaatccaagaaacagtgctctttc

SEQ ID NO: 28919 - DNA, 85 bp, Homo sapiens
cttgtggacctagttggagagactgccttaccttgagaggtttttttttttttttttgagacagagtctctctctgtcacgcagg

SEQ ID NO: 28920 - DNA, 95 bp, Homo sapiens; identical to SEQ ID NO: 68

SEQ ID NO: 28921 - DNA, 93 bp, Homo sapiens; identical to SEQ ID NO: 69

SEQ ID NO: 28922 - DNA, 83 bp, Homo sapiens
ctccagtgaccttgtctctgtctctgagtactcctcaatcttgagcgctgaggagtctagggagtaggggaagaggacaggag

SEQ ID NO: 28923 - DNA, 108 bp, Homo sapiens
gctatcaaatgtaatttgaagtagttagatgggtgggatctgatgagtatttgatgttttctaaatcccaaactatctttttcaatgaagtcaatgcattttcaaagc

SEQ ID NO: 28924 - DNA, 104 bp, Homo sapiens
gagggtttgaaagaaacggggagtgggtgtagcaaatggtgcctactcagccaggtttcaagagcaccttatgtaaagcacctccactttaatcttttttatgc

SEQ ID NO: 28925 - DNA, 145 bp, Homo sapiens
tatatatatctcctattagttctgtgtgagtgtgtgtatatatatatatatatatcctattagttttgtatgtgtatatatacatatatatatcctattagtttttttttgtgtgtgtgtgtgtgtgtgtgtgtatcttattagt

SEQ ID NO: 28926 - DNA, 95 bp, Homo sapiens; identical to SEQ ID NO: 68

SEQ ID NO: 28927 - DNA, 93 bp, Homo sapiens; identical to SEQ ID NO: 69

SEQ ID NO: 28928 - DNA, 83 bp, Homo sapiens
gaggctggaagtctgagatctaggtgtaagcagggttggtttcttctgaggcctctcttcttgccttatagatggccatcttc

SEQ ID NO: 28929 - DNA, 85 bp, Homo sapiens
tgttttgtatgcttctctttcctaggccatatatatatatatttctggtcttactctgttgcccaggctggagtgcagcagcaca

SEQ ID NO: 28930 - DNA, 83 bp, Homo sapiens
attttctaaaacataccacattaaaataagaccatagacacgtttttctgtctataagtctttttattttgatggtagaaaat

SEQ ID NO: 28931 - DNA, 72 bp, Homo sapiens
gcggagggcgcctggctcggtcggtcgctccttccttggcgggccctcgccgacccacggtgctcagccagc

SEQ ID NO: 28932 - DNA, 120 bp, Homo sapiens
cctttccttcctcaggagaaaggcctctctctccgtgttcacagcggaccttgatttaaatgtccatacaattaaggcacgcggtgaatgccaagaatggggctggctgagcaccgtggg

SEQ ID NO: 28933 - DNA, 93 bp, Homo sapiens
atactcctgtggagaacagctgtatcaactagagtacagtgcttatagtgcagttactgttacctttagccgtatagagtgtactcttagtgt

SEQ ID NO: 28934 - DNA, 56 bp, Homo sapiens
ctgtcactcagcctgagtgtgtgatcctgacagggaagcaccaggaagcctggcag

SEQ ID NO: 28935 - DNA, 70 bp, Homo sapiens
aagtcaggagccagcccatggcagagttcctttcttggagaaaggaagctctctctctggctcacatctt

SEQ ID NO: 28936 - DNA, 110 bp, Homo sapiens
gttgatgtcctaactccagtatctcagaatgtcaccttatttgaaaatagagtttttgtagatgtaattagttaagatgaggtcatattggattagagtgggcccccaat

SEQ ID NO: 28937 - DNA, 58 bp, Homo sapiens; identical to SEQ ID NO: 21145

SEQ ID NO: 28938 - DNA, 89 bp, Homo sapiens
catgagcctaccatttctctgactctgtttctgacatcctcatgggtaaatccctaaagatggaacacagagatttcctgggcactatg

SEQ ID NO: 28939 - DNA, 84 bp, Homo sapiens
ctgggcaacagagtgagactctgtctcagaaaaaaaaaaaaagaacaaaaaaagttgagggagtctttttctaaaataacctag

SEQ ID NO: 28940 - DNA, 58 bp, Homo sapiens
tgagacagggtctcactctgtcacccaggctggggtacagtggtgtgatctcggctca

SEQ ID NO: 28941 - DNA, 92 bp, Homo sapiens
agagggtaggggttaataaagatgatgatgatgatgatgatgatgataatgatgatagtagttaatatctctatttttaaaatctgccttct

SEQ ID NO: 28942 - DNA, 62 bp, Homo sapiens
ccttgtccatgctagagggtgaggaaggaaagactagggactctctggctctgagactgtgg

SEQ ID NO: 28943 - DNA, 108 bp, Homo sapiens
gaggagtgatcaagtgtcaagtgcagtgggaggtctgagttcctgtttgggctctgtcactcagactctagggcataacacttgaccctttgaagctcacttttcctc

SEQ ID NO: 28944 - DNA, 87 bp, Homo sapiens
ccaaagtgctgggattataggtgagatccaccgtaccctgccattttgttttgtttgaagagactctcactctgttacccagcctgg

SEQ ID NO: 28945 - DNA, 58 bp, Homo sapiens
tgagatggagtctctctctgtcacccaggctggagtgcagtggagcgatctcagctca

SEQ ID NO: 28946 - DNA, 109 bp, Homo sapiens
cataatttctgtatttcaataagtgcttccaaaagagaattaacgtttataaaatagtatttttatactttgtattcacttatttagctatttattgagatcagctatg

SEQ ID NO: 28947 - DNA, 108 bp, Homo sapiens
cctgaccacagagtggaatgtctcaaaaaacaaacaaacaaaacaaaacaaaaagagaaaaaacaatataatttttttttttgagacagtctcactctgttgtccagg

SEQ ID NO: 28948 - DNA, 88 bp, Homo sapiens
agagtgaagctctgtctctcaataaataaataaataaaatgtaaattttttttttttttttttttttttggagacagagtctcactct

SEQ ID NO: 28949 - DNA, 82 bp, Homo sapiens
gcttggccaacatggcgaaaccctgtctctactttttttttttttttttttttgagacagagtcttgctctgtcacccaggc

SEQ ID NO: 28950 - DNA, 114 bp, Homo sapiens
agttgacaccgcagagtttctgttcccagagagtttaaaaatctttctaattacatccgaatttttttttttttttttttttttgagacggagtctcactctgttgcccaagct

SEQ ID NO: 28951 - DNA, 80 bp, Homo sapiens
cagcctctttgtcacccaggctcgtctttttttttttttttttttctttgagacagggtctccctgtgtctcccaggctg

SEQ ID NO: 28952 - DNA, 65 bp, Homo sapiens
ctcaagcacagaaattcccactgcaggcaatttctgcagtggaaatgaattttttttttcttcag

SEQ ID NO: 28953 - DNA, 74 bp, Homo sapiens
tccagcctcccagcctccctgtctcccacatacatttattacaagagtgttggcacagtggttatgggcttgga

SEQ ID NO: 28954 - DNA, 73 bp, Homo sapiens
agggaactttcacgtaatataaaggcatgcaggttgtactcttgtatagttgtgtgtacattggttgtttcct

SEQ ID NO: 28955 - DNA, 92 bp, Homo sapiens
gtccaatgtcactgtcagatgtcactgtagacagaagctctctacatgctttgagcccaagtgatcaggttaacctgagagagatactggat

SEQ ID NO: 28956 - DNA, 111 bp, Homo sapiens
ccagtctttgggcttccagttcagtactctttctgctctgccacactgtttctcagacatgtgcacagagagccccagggtgaggctgggcaggagagctctgcagagagg

SEQ ID NO: 28957 - DNA, 85 bp, Homo sapiens
gtgtgtgtatgtgtgtgtgtgtgtgtgtgtgcataagggtatacacattagatatgtatataatggtacacacacacacacatat

SEQ ID NO: 28958 - DNA, 76 bp, Homo sapiens
tcttcctggccagtgtcactttctctctgacagcggtttaagagcacttaatcaaaggtaacataggccagaatga

SEQ ID NO: 28959 - DNA, 101 bp, Homo sapiens
ggtagactgtttgacataatccttgatgggcactaatgctttcttaagaagttacatgagaatcttgatcaagtgtcttcaagtattttacagtcttatcc

SEQ ID NO: 28960 - DNA, 102 bp, Homo sapiens
ctagaatttgttaaatttttgtgggggagtggggaacattgcatgttggtctttttattttttttattttttgagatgttctcactctgtcacccaggctgg

SEQ ID NO: 28961 - DNA, 69 bp, Homo sapiens
ggtgtctggagccacatttctgtgtgtgtgtgcacgtgcacacttgtatacacagggtggtagggtgtc

SEQ ID NO: 28962 - DNA, 74 bp, Homo sapiens
atgtatgcacaggtgtgtgtggcttcgtggcagagttggatggcgcccacccactatgcctgtgcttcttacgt

SEQ ID NO: 28963 - DNA, 76 bp, Homo sapiens
gccttggcttcactcagtgtgtctctgtgagcatgtttcccctttttctatggacaccagctgaactggtcagggc

SEQ ID NO: 28964 - DNA, 108 bp, Homo sapiens
gaggggcacatgagagacttcagaggtgtcggtacgttctgtttcttaggttgggtagagactctgtgagtgcctgtcatattactctaaatccctttgatgtgcatc

SEQ ID NO: 28965 - DNA, 95 bp, Homo sapiens; identical to SEQ ID NO: 68

SEQ ID NO: 28966 - DNA, 93 bp, Homo sapiens; identical to SEQ ID NO: 69

SEQ ID NO: 28967 - DNA, 95 bp, Homo sapiens; identical to SEQ ID NO: 68

SEQ ID NO: 28968 - DNA, 93 bp, Homo sapiens; identical to SEQ ID NO: 69

SEQ ID NO: 28969 - DNA, 78 bp, Homo sapiens
ggccaatgaatgaatgaatgaattgaaacaactgggtctggaacaatgtatttatattattcatctagttctggggcc

SEQ ID NO: 28970 - DNA, 67 bp, Homo sapiens
gtctcagagtcacacagatctgggcttatactgtaactgtgctgcttactgtctgtgtgacttgggc

SEQ ID NO: 28971 - DNA, 95 bp, Homo sapiens
gtgtatactagcctatgtatatacacatttataactatatatgtaggcacgtgtgtgtgtgtatatatatgtatgtgtatacatctgtatctgta

SEQ ID NO: 28972 - DNA, 98 bp, Homo sapiens
tttgctggtatggcttattgaatattgtacaggtacttgaatgagtttttaaatatttatacagtaaaagagtacttgtttttaagtaaaacagcaaa

SEQ ID NO: 28973 - DNA, 110 bp, Homo sapiens
tcaattactattttcataaaaataatgagtggatagcttaatagaagatggttgaatttttttttttatttgtgagtgttgtaacacattatttcaatggaaatgtatga

SEQ ID NO: 28974 - DNA, 62 bp, Homo sapiens
ttgagacggagtctcactgtgtcacccaggctggagtgcggtggtgcgatctctgatctcgg

SEQ ID NO: 28975 - DNA, 95 bp, Homo sapiens; identical to SEQ ID NO: 68

SEQ ID NO: 28976 - DNA, 93 bp, Homo sapiens; identical to SEQ ID NO: 69

SEQ ID NO: 28977 - DNA, 67 bp, Homo sapiens
gtacataaatataaagtatataaaaaaggaaacttttttttttattatactttaagttttagggtac

SEQ ID NO: 28978 - DNA, 76 bp, Homo sapiens
agctgcaggctgacacagaactgacagtccacaaagcacaaggcccatgtgcagtcctgtggaaagaacctcggct

SEQ ID NO: 28979 - DNA, 116 bp, Homo sapiens
cgattttttgtaatagttttattaggactggtagaattcagctgtgaatctctctctttgggggattttgttcattggtaggtgtgtaatttctgattgaatcttgttacttgttg

SEQ ID NO: 28980 - DNA, 86 bp, Homo sapiens
gaggaggctgaagacagggctgcaatcccttctagcttgtaaagtttttgctgagaaatctgctgctaatctgataggttttcctt

SEQ ID NO: 28981 - DNA, 75 bp, Homo sapiens
aacgtgccactcacctgggccccggctccctggaaaacaccacagggacgctcgctctctgtgacagcaacagtt

SEQ ID NO: 28982 - DNA, 112 bp, Homo sapiens
caataaacttgttgcttaatcgtttctaagaagctgtgcgaaagtgagaaagcctcagtctctctgtttcagcttctccaaatgtgactaacagcagcaaccctgtctattg

SEQ ID NO: 28983 - DNA, 84 bp, Homo sapiens
cgaaatattgcccaagatatatggcatctgaaactctcacatactgtgttgttggtcagagtgtaaagtggtagcaacattttg

SEQ ID NO: 28984 - DNA, 85 bp, Homo sapiens
gagtactaatttgtcattctctctccatctgtctgtaaacagtcagttaaattggttattgatgagaagaaggtgaattatactt

SEQ ID NO: 28985 - DNA, 106 bp, Homo sapiens
tgactccctgtcaaatattgggttttggagttaagacaggactgatttttttttttttttttttttttttgagacagtctcactctgtcacccaggctggagttca

SEQ ID NO: 28986 - DNA, 130 bp, Homo sapiens
ggcaacagagtgagaacttgtctcttgaaatattaaaactttcttttttttgagacagagtctcactctgtcgcccagattggagtgcagtggtgccatcttgactcactgcaacctccacctcccgggt

SEQ ID NO: 28987 - DNA, 82 bp, Homo sapiens
tatttgggtgaggcactgtgtgattattgaacctcttaagcaagagaatatcttgatgatcatctagttccactctcattta

SEQ ID NO: 28988 - DNA, 110 bp, Homo sapiens
ggttccccagctaaccctaggctcagtaatttgctagaagggctaacagactcactgacagctgttatatgcgtggttatgaagggagaggatacatgttaaaatcaacc

SEQ ID NO: 28989 - DNA, 69 bp, Homo sapiens
tgtttgaggcctggagatagtgcctttatttgagacagggtctcactctgtcattcaggctggagtgca

SEQ ID NO: 28990 - DNA, 81 bp, Homo sapiens
tctctttttaaaaagaatcacatcctcctagataccctcaacacagtactgagaggcccctgggttctttatgaaaataga

SEQ ID NO: 28991 - DNA, 72 bp, Homo sapiens
ttgttttttgagacggagtctcactctgtcacccaggctggagtgcagcggtgtgatcttggctcactgcaa

SEQ ID NO: 28992 - DNA, 90 bp, Homo sapiens
gagagcatgtgattagaccaagggctgatgtaagtttttttttccttaaaaaaggcagcatcagttgtaatggtgaattcatgtcttctc

SEQ ID NO: 28993 - DNA, 59 bp, Homo sapiens; identical to SEQ ID NO: 23843

SEQ ID NO: 28994 - DNA, 95 bp, Homo sapiens; identical to SEQ ID NO: 68

SEQ ID NO: 28995 - DNA, 93 bp, Homo sapiens; identical to SEQ ID NO: 69

SEQ ID NO: 28996 - DNA, 204 bp, Homo sapiens
gtattccatcatatatatatgtgtgtgtgtgtatatatgtatgtatatatgtgtatatacacacgtgtatatatacacacatatacatgtgtatgtgtatgtatatacatatgtatatacgtatatacatacacatatatacatatgtatgtgtgtatatatacatatgtatatatgtatatgcatacacatatatacatatgt

SEQ ID NO: 28997 - DNA, 82 bp, Homo sapiens
tgatgtatgtatgtatatatgtatgtgtatatgtatatacacatacatatgtatatatgtgtatgcatatacatatatacat

SEQ ID NO: 28998 - DNA, 95 bp, Homo sapiens; identical to SEQ ID NO: 68

SEQ ID NO: 28999 - DNA, 93 bp, Homo sapiens; identical to SEQ ID NO: 69

SEQ ID NO: 29000 - DNA, 106 bp, Homo sapiens
ttctgtactcactttttaattctatatgtggagtacctgttgcctattatgtaaatataaatacatatatgtatgtgcttcataaaacaatatagaaatgacagaa

SEQ ID NO: 29001 - DNA, 106 bp, Homo sapiens
gcatggtggggcatgcctgtagtccaagctacttgggaggctgaggtaggaggatcacttgagcccaggaggcagaggttgcagtgagcccaggtcacaccactgc

SEQ ID NO: 29002 - DNA, 74 bp, Homo sapiens
cagagagtagacatgcagatagatttggtatttcaactcctggattgctgtctctgtctttatgtctctcggtg

SEQ ID NO: 29003 - DNA, 86 bp, Homo sapiens
gtaatttggtgtgtgtatatatgtatgtgtgtgtgtatatacatatatatacatatacatacatacatgtatatacatacacatac

SEQ ID NO: 29004 - DNA, 134 bp, Homo sapiens
tatgtatgtatgtgtgtgtatatatatatacacatacacactatatatatgtgtatataagtatgtgtgtatatatatgtgtgtgtatatatatatatacacacatgcacactatatatatactacctaggtgt

SEQ ID NO: 29005 - DNA, 60 bp, Homo sapiens
gtagtatatatatagtgtgcatgtgtgtatatatatatatacacacacatatatatacac

SEQ ID NO: 29006 - DNA, 63 bp, Homo sapiens
atgtgtgtatatatatatgtgtgtgtatatatatatatacacacacacatatatagcatatat

SEQ ID NO: 29007 - DNA, 92 bp, Homo sapiens
gcatatatatagggtatatatatgtgtgtatatgtatatatatgtgtgtatatgtatatatatacacacacgtatataggctatatatatgt

SEQ ID NO: 29008 - DNA, 57 bp, Homo sapiens
gatggaattgtgtgtgtgtgtatatatatatatgcacacaatggaatactactcatc

SEQ ID NO: 29009 - DNA, 93 bp, Homo sapiens
ctcagcaaaagtttagtgaatgaatcattttttattttcacagtagtttaaactgttgtaaagcagggtatttcacttttgctttattatgag

SEQ ID NO: 29010 - DNA, 118 bp, Homo sapiens
agagtttatttacctcagtgtttggaattttagcagttcatgaggacaaatagtctttttgttcatttcataatctcagctgtagagttgcccagagtgctcagataagtgtgtcttt

SEQ ID NO: 29011 - DNA, 102 bp, Homo sapiens; identical to SEQ ID NO: 4705

SEQ ID NO: 29012 - DNA, 95 bp, Homo sapiens; identical to SEQ ID NO: 580

SEQ ID NO: 29013 - DNA, 93 bp, Homo sapiens; identical to SEQ ID NO: 69

SEQ ID NO: 29014 - DNA, 56 bp, Homo sapiens
gagacagagtctcactctgtcacccaggctggagtgtagtggcgcgatctctgctc

SEQ ID NO: 29015 - DNA, 107 bp, Homo sapiens
caaccacaatggggaattagattacagctgtttgcttaaaaattgataactgattttgttgtttctttaatggaaatatttgtattgtgcattcttgttgttgtctg

SEQ ID NO: 29016 - DNA, 110 bp, Homo sapiens
tttgtttgattagcacatgagggcagggaagcattttaaccgtttttttttagattattaatttttgaattaaatgttttattattgtacacaattgctaatcaggcaaa

SEQ ID NO: 29017 - DNA, 80 bp, Homo sapiens
tcattttgtatgtttgcatgtgcatgtgcatgtgcatgtgtgtatgtgtgcctgtgtgcgtgtgtgtgcatgtaaaagga

SEQ ID NO: 29018 - DNA, 117 bp, Homo sapiens
gctttggctatacaagctcctttttggttccatatgaattttagaattgtgtttttctaattctgtgaagaatgatggtgttattttgataaggattgcattgaattgttagattgc

SEQ ID NO: 29019 - DNA, 95 bp, Homo sapiens
tatgtcaataaatgtgtcataagatatctataaatatttatgtgtgtatttatatacatatatatcttgggtaattataaacaattatcagcata

SEQ ID NO: 29020 - DNA, 80 bp, Homo sapiens
tatatacatgtatatatgtgtatatatatacatatacacgtatatatatacatatacatgtacatatatatatacatata

SEQ ID NO: 29021 - DNA, 71 bp, Homo sapiens
cttgattttcaatatatttttgaagaggattactaagaagaatattctttgagaatatattgtgctttgag

SEQ ID NO: 29022 - DNA, 110 bp, Homo sapiens
tatggtttttctataaacatttgttgaaattaccgtaggcatctgtacatatatatgtatatatatgcacttatgattagttgatttcactttttttggggaaatacata

SEQ ID NO: 29023 - DNA, 87 bp, Homo sapiens
agctctacagcattacagcattagctgctctgcagcttcgattgcagtagcaccaatagctgtctcactttctctctgtctcttgct

SEQ ID NO: 29024 - DNA, 67 bp, Homo sapiens
atgtatataatgatctacctatatatatatatatgtgtgtgtatatgtaatgattttgtgtgtgcat

SEQ ID NO: 29025 - DNA, 77 bp, Homo sapiens
gtcccttgtaagttggattcctaggtattttattctttttgaagcaattgcgaatgggagttcactcacgatttgac

SEQ ID NO: 29026 - DNA, 95 bp, Homo sapiens; identical to SEQ ID NO: 68

SEQ ID NO: 29027 - DNA, 93 bp, Homo sapiens; identical to SEQ ID NO: 69

SEQ ID NO: 29028 - DNA, 105 bp, Homo sapiens
gacattgaatattgttaaatgattttctgcatctattgagatgatatgatttttatgttttattctgttgatgtagtatatcacatttattgatttttatatgtc

SEQ ID NO: 29029 - DNA, 107 bp, Homo sapiens
tcaatgttaacatgtaatctgtatatatacatatatatacacacatatgtttatatatgtatatgtttatatatatttccatatacataatacaagaagttgtttga

SEQ ID NO: 29030 - DNA, 121 bp, Homo sapiens
gtatacgtgtatatgtatgtgtatatatgtatacccatatatacccatatatacacgtatatgtgtatatgtatttatatatgtatatattatgtatatgtaaatacatatatacatgtat

SEQ ID NO: 29031 - DNA, 86 bp, Homo sapiens
tgcaggcctatatatgtgtgtgtgtatgtatacatgtatatatgtatttatatatgcacatatacatacgtatgtatacatgtgta

SEQ ID NO: 29032 - DNA, 65 bp, Homo sapiens
acagctgacctctgaacaatgtggaggttagaagtgctgaccctcacacagtcagaaatctatgt

SEQ ID NO: 29033 - DNA, 95 bp, Homo sapiens; identical to SEQ ID NO: 68

SEQ ID NO: 29034 - DNA, 93 bp, Homo sapiens; identical to SEQ ID NO: 69

SEQ ID NO: 29035 - DNA, 102 bp, Homo sapiens
gtcacattttggtaagtcctgtaatgtttcaaaatcattatatttattatggaaatctatgatcagtgatctttaatgttactgttctaatcattttgtggc

SEQ ID NO: 29036 - DNA, 105 bp, Homo sapiens
tttcttcaatgttgtgtatatttctgagtactcataaccaccaactctccatttattttgtttatttattatgctgtacatgaggttcacccaacctggaagaga

SEQ ID NO: 29037 - DNA, 58 bp, Homo sapiens; identical to SEQ ID NO: 315

SEQ ID NO: 29038 - DNA, 113 bp, Homo sapiens
tgtacatggtagatggttgataaaggtctgttagaccctggctgctgaatgcatctttacaagtatgttgatatgtgtggcatgaggtccaactgaccacatttctgtggaca

SEQ ID NO: 29039 - DNA, 106 bp, Homo sapiens
gctccaatggtctcttagtggacgcagctagggtatgtatgtatgtatgtatgtatgtatgtatgtatgtatgtatgtttgcatgtgtctgtgtacagatttatgc

SEQ ID NO: 29040 - DNA, 113 bp, Homo sapiens
aactttacttagatatttcttctgccagctatcctagttgattgcttaaagttccttttattattattatactttaagttttagggtacatgtgcacaatgtgcaggttagtt

SEQ ID NO: 29041 - DNA, 81 bp, Homo sapiens
gggttgggggggggttgtttcattttgtttttaatccttcctgattatggaaggaagaatcagtatctccttcagtgacct

SEQ ID NO: 29042 - DNA, 90 bp, Homo sapiens
atagttagaaacattcttgcattttttattataataatcaattttttgtgtcaatatcatagtatttgaatagagaatgtttatagctat

SEQ ID NO: 29043 - DNA, 95 bp, Homo sapiens; identical to SEQ ID NO: 68

SEQ ID NO: 29044 - DNA, 93 bp, Homo sapiens; identical to SEQ ID NO: 69

SEQ ID NO: 29045 - DNA, 113 bp, Homo sapiens
tggtagtttgaaatatgccatggtagcagaatttgtagaaataagagtaaactcaggttttctttctttattttttatttttgacagccatttaaagatttcttactatgcca

SEQ ID NO: 29046 - DNA, 78 bp, Homo sapiens
atacacatatacacacacacacacactacatacacatgtatgtcatttatatctgtgtgtgtgtgtgtgtgtgtgtat

SEQ ID NO: 29047 - DNA, 60 bp, Homo sapiens
acacacacacacacacagatataaatgacatacatgtgtatgtagtgtgtgtgtgtgtgt

SEQ ID NO: 29048 - DNA, 118 bp, Homo sapiens
atatatgtatatcatatatatgtatatcatatatatgtatatcatatatatgtatatcatatatatgtatatcatatatatgtatatcatatatatgtatatgatatccctcagatgt

SEQ ID NO: 29049 - DNA, 152 bp, Homo sapiens
gcaaagactatgtgaaccagaaatgttataattggaggccagcaatctgttattattattattattattattattattgatggtgtctcactgtcactcaggctggagcatagtggcataatcttgactcattgctgcttcaaacacctggg

SEQ ID NO: 29050 - DNA, 83 bp, Homo sapiens
tattttggagaatagtggaactgaagggtcattagtaacaatgtttatttatttgaagaacttccagactgttttccaaagtg

SEQ ID NO: 29051 - DNA, 65 bp, Homo sapiens
gtgtgtgtgtatgtgtgtgtgtgtgtgtatatatataaataatacacacacgtacatacatgtac

SEQ ID NO: 29052 - DNA, 59 bp, Homo sapiens
ccccttggaatctactgtaagacagaagctggatagcctgtctcactgtctcagagggg

SEQ ID NO: 29053 - DNA, 95 bp, Homo sapiens; identical to SEQ ID NO: 68

SEQ ID NO: 29054 - DNA, 93 bp, Homo sapiens; identical to SEQ ID NO: 69

SEQ ID NO: 29055 - DNA, 60 bp, Homo sapiens
tatatatatatatatacatatatacacatacatatgtatatatgtatatctatgtatata

SEQ ID NO: 29056 - DNA, 79 bp, Homo sapiens
catatatgtgtgtgtgtctatatatatgtatatctatgtatatatacatagatatacatatatacatatgtatgtgtat

SEQ ID NO: 29057 - DNA, 120 bp, Homo sapiens
gaagtaactaacttgcttttgattttacaggctcataagtggaaaggatttgtcttgtcacagatgagactttggactctagacttttgggttaatgctgaaatgaattgagactttgag

SEQ ID NO: 29058 - DNA, 106 bp, Homo sapiens
acacttacaatgtgtatatacatatatacacacacattttatgtgtatatatatgcaaatgcacattgtatgtgtgtgtataaatgcaaatacacattgtgtgtgt

SEQ ID NO: 29059 - DNA, 146 bp, Homo sapiens
acatacacattgtgtgtgtgtatatatatatatatatatatatatatatacaatgtgaatgtgtgtatatatatatgtgtatatatagatacccatgtacaatgtgtatattgtatgtgtatatatacacacacacacaatgtgta

SEQ ID NO: 29060 - DNA, 97 bp, Homo sapiens
atgcctctgtgtatatgcctctgtatgtttacatatatgtatatttatatgtacatatatataataaacatgtttgtgtgtatatatacacacgcat

SEQ ID NO: 29061 - DNA, 103 bp, Homo sapiens
tcatgtatatacttgggagctccagggttgggggcatagatatgtataattgttatattgttatacactttgctgaatttagccctttgtcattatatagtga

SEQ ID NO: 29062 - DNA, 104 bp, Homo sapiens
tgccaacagaagagaagtagtgaatttgaagaacttccttgtaaacttgtgaatttcaagaacagcaggagagttgccacacactaccctagctgcctgaagca

SEQ ID NO: 29063 - DNA, 95 bp, Homo sapiens; identical to SEQ ID NO: 68

SEQ ID NO: 29064 - DNA, 93 bp, Homo sapiens; identical to SEQ ID NO: 69

SEQ ID NO: 29065 - DNA, 82 bp, Homo sapiens
atatatatatatatatgtgtgtgtgtgtatatatatatacgtttatatatgtgtatatatactatatacacacgtgtgtata

SEQ ID NO: 29066 - DNA, 105 bp, Homo sapiens
gtaaccactatcttgaactttgtgtttatcatttccttatttttctttgttttttattatgctttgagttctagggtacatgtgcacaacgtgcaggtttgttac

SEQ ID NO: 29067 - DNA, 120 bp, Homo sapiens
gagttcagaggatcctgattagaggttggtcaaagagtgagtctttgtcagtttctctgtgtctggtatgacctgctctccactttatttaattcggatttaaagaagactctcgtgctc

SEQ ID NO: 29068 - DNA, 89 bp, Homo sapiens
aaatccattgattatgtagaagagtttatatatttttctcatgactaaaatgggggcaataacttttttacaaagttgagggaggattt

SEQ ID NO: 29069 - DNA, 93 bp, Homo sapiens
acaatagagtgcactactatgtagagtagtgtttgtcatgtttgctttgtaattatgacagcttttgctcaatatgtttttagattctattgt

SEQ ID NO: 29070 - DNA, 107 bp, Homo sapiens
ggatgaagaaaatgtgacaaatgtgtgtgtgtgtgtatatatatatatatacacacacatattttatatatatatatataatatatacgcatacatactacacagcc

SEQ ID NO: 29071 - DNA, 85 bp, Homo sapiens
gccctttgtgggcagctctcattggtatggtacaagagttgtattcaatcactttgtcagaacaatgacagctgtgagaaggagc

SEQ ID NO: 29072 - DNA, 112 bp, Homo sapiens
tggatagagaaaatgtggtacatatatacaatggaattaaatttatattttatgactagatttgtagaaagatgaatagaattcagactggatgtactattttatggattca

SEQ ID NO: 29073 - DNA, 88 bp, Homo sapiens
ggatgccctttatttttttctcttatttgattgctctggctaggacttctagtacaacgtagaatagaagtggtgaatgcgggtatcc

SEQ ID NO: 29074 - DNA, 112 bp, Homo sapiens
gtgggaggggagtgagggagtgaagtgagagtttctgctagaagactcctgatatagttgatgtctggaagacttcgtaggggcacgtcatgtcataaatgacagctaacat

SEQ ID NO: 29075 - DNA, 114 bp, Homo sapiens
taggccattgtagtacttttgcttttccatgtaaattttagaattagcttgtctatatattttttaaaaaaatactttaagttctgggatacatgtgcagaatgtgcaggtttg

SEQ ID NO: 29076 - DNA, 95 bp, Homo sapiens; identical to SEQ ID NO: 68

SEQ ID NO: 29077 - DNA, 93 bp, Homo sapiens; identical to SEQ ID NO: 69

SEQ ID NO: 29078 - DNA, 117 bp, Homo sapiens
aaactacctcccaaatgcactaaggtcttagaaagtggaagtagttattgtttattattgttttaaataacatttttccactatcgtgagtcatatatcttataggtattttagttt

SEQ ID NO: 29079 - DNA, 66 bp, Homo sapiens
tatatatgtgcatatatgcatatgtatgtatatattatactcacacatgcatatacacattttata

SEQ ID NO: 29080 - DNA, 101 bp, Homo sapiens
ggtagaataatttatattcttctgggcatatagccagtaatgggattgctgagtcaaatcacagttctgtttttagctcttggaggaattgccacgctgct

SEQ ID NO: 29081 - DNA, 77 bp, Homo sapiens
tcccatattctcagacatgtcagtccttctctgactctttccttcactgaaagtcggtagcactgacattgtaggga

SEQ ID NO: 29082 - DNA, 103 bp, Homo sapiens
tgttttttcttttctcactggcattggatagtcttcacatgtgctctaattaagcaatatgttttttattgtttttaaccttgagatgtgttagaggcagaca

SEQ ID NO: 29083 - DNA, 73 bp, Homo sapiens
tctgtcacagtgactcacacctgtaatcccagcaccttgggaggctgaggcaggaggatcacttgaagccagg

SEQ ID NO: 29084 - DNA, 117 bp, Homo sapiens
ttcattgtttccatggctgtgtagtattccatggtttatctatatcacattttctttatctgatcatatattgatggacacgtaggttgattccgtggctttgcaattgtgaatagt

SEQ ID NO: 29085 - DNA, 126 bp, Homo sapiens
agtgaagtttggtgttgaaaaagatgtttaagtgttttgaagaaaaggcattttttttttttttcctttgagactgagtctcgctctgtcgcccaggctggagtgcagtggcgtgatctctgctca

SEQ ID NO: 29086 - DNA, 99 bp, Homo sapiens
gagacacacccttctgcagaagtaaatttgccttgctgagagaacctttgtcctttgtctcagtgctagttcttctttgcagcaccgagcatttgtttc

SEQ ID NO: 29087 - DNA, 95 bp, Homo sapiens; identical to SEQ ID NO: 68

SEQ ID NO: 29088 - DNA, 93 bp, Homo sapiens; identical to SEQ ID NO: 69

SEQ ID NO: 29089 - DNA, 109 bp, Homo sapiens
cttaagcttctttatacatatgactattggatgttaagtgaaggcatgtattattattattattttaaatacaagcctttattcacatagatcagctttgtagcttttg

SEQ ID NO: 29090 - DNA, 244 bp, Homo sapiens
tatagatagatttatatctatatatcctatagatagatttatatctatatatcctatagatagatttatatctatatatcctatagatagatttatatctatatatcctatagatagattatatctatatatcctatagatagatttatatctatatatcctatagatagatttatatctatatatcctatagatagatagatttatatctatatatcctatagatagatagatttatatctat

SEQ ID NO: 29091 - DNA, 112 bp, Homo sapiens
catagaattcattaaatctaggcagcagaaaataggttatttcaaagattttaataatatatttaataaattttacatgtatacctgttttgtgcatgtatttaaaactatg

SEQ ID NO: 29092 - DNA, 105 bp, Homo sapiens
atatatttatatgtatatatgcatgtgtttatacatacacgcatatacatatgtatgtatagatatatgtacatacacatatgtacatatgtatatatacatgtg

SEQ ID NO: 29093 - DNA, 114 bp, Homo sapiens
atcacattcttttgattgctatagctttgtaatatacttttgaatcaggaagtatgatgttttcaacttttttttttttcagaattgttttggctattcaagatcttttgtggt

SEQ ID NO: 29094 - DNA, 84 bp, Homo sapiens
ggaggctgcagtgagctgagatctgtctcactctgttgcccaggctggagtgcagtggcgcgatctcgactcactgcaacctcc

SEQ ID NO: 29095 - DNA, 75 bp, Homo sapiens
ggggcagtgacagaggtgagagaggtgacctgatgcagagaagacagaactcccctagccttggctgtcagcttc

SEQ ID NO: 29096 - DNA, 177 bp, Homo sapiens
gacatatatatatgtgtgtgtatatatatgtgtgtatatatatgcatatatatgtttgtatatatgtatatatgtgtgtatatatgtctgtatatatgtatatatgtgtgtgtgtgtgtgtgtgtgtgtgtatatatatatatatatatatatatatatatatataagctgggcatg

SEQ ID NO: 29097 - DNA, 93 bp, Homo sapiens
ccatgcctggcctgcagtatggttttgtttttcgttttgtgtttttttttttttttttttttgagacagagttccgctctgttgtcaggctgg

SEQ ID NO: 29098 - DNA, 124 bp, Homo sapiens
tacttacccaaatatatatgtatgtatgtatgtgtgtgtatatatatgtatacacatatgtatatatgtatatatatacacacacataaatatatatatatataaaaatgtatatatatatata

SEQ ID NO: 29099 - DNA, 58 bp, Homo sapiens
tgagacagagtctcgctctgtcgctcaggctggagtgcagtggcgcaatctctgctca

SEQ ID NO: 29100 - DNA, 101 bp, Homo sapiens
ccctagctggtcttatctgtgttttactgtctgctctttttcgctgcttgttgttagaagagaagtgatttccttgaaatgcataaggctagaaagggagc

SEQ ID NO: 29101 - DNA, 58 bp, Homo sapiens
tgagacggagtctcgctctctcacccaggctggagtgcagtggtgcgatctcagctca

SEQ ID NO: 29102 - DNA, 82 bp, Homo sapiens
tagagggagtgaagtgatggggagggaagtttcattctttatttttccagaatagcttcgtttggattattttattcttcta

SEQ ID NO: 29103 - DNA, 110 bp, Homo sapiens
tatatatatatacgtgtgtgtgtatatatatatacgtgtgtgtatatatatatatacgtgtgtgtatatatatatgtatatatatatatacacacacgtatatatatatg

SEQ ID NO: 29104 - DNA, 87 bp, Homo sapiens
tgtgcgtatgagtgtaaacggtgtacatgtagacatatatacatacatacacatgtgtttatatgtatatatacacacatacataca

SEQ ID NO: 29105 - DNA, 117 bp, Homo sapiens
gggattataggcgtgagccaccgcacctggccttttattttttttgagacagagtgtctctctgtcacacaaactggagtgcagtggtgtgatctcagctcactgcaacctcagcct

SEQ ID NO: 29106 - DNA, 70 bp, Homo sapiens
ctagatctcgatatctatctatagatatatctatatctatatgtatagatagatatctagatatatctag

SEQ ID NO: 29107 - DNA, 116 bp, Homo sapiens
tagtgagcattcaaaaaatattagctatctcttcccaaccatagaaacctaattctgatttttttttaacagagacatggtcttgctgtgttggtcaggatggtcttgaactcctg

SEQ ID NO: 29108 - DNA, 77 bp, Homo sapiens
cagcctagcatgctggctgctgtggccatacgggcagctccgggcactggcacagtcactggctccatgcgaggctg

SEQ ID NO: 29109 - DNA, 96 bp, Homo sapiens
aatcccacttgttgtattacctgatgtcttttatgtctttgcttatgaagcaaaagttacatagaaggctggaggagtattatctttcctgggatt

SEQ ID NO: 29110 - DNA, 95 bp, Homo sapiens; identical to SEQ ID NO: 68

SEQ ID NO: 29111 - DNA, 93 bp, Homo sapiens; identical to SEQ ID NO: 69

SEQ ID NO: 29112 - DNA, 105 bp, Homo sapiens
ggggaatctggatttttttaatatgctccacaggtgattcttatcaggtaactttgaaaagcactgattttgtatatgtgagagagaagtggtgaataattccct

SEQ ID NO: 29113 - DNA, 104 bp, Homo sapiens
agataaagggagtttgcctttcttgtttcctaggagacttttttttttaatagttccctggaaaagattcttcttgaggcattctcaatctaacttcctcttct

SEQ ID NO: 29114 - DNA, 91 bp, Homo sapiens
ctaaataaggttatggaaaagaaacagtatatagtcaagctcctttgagaatgaattttcattgttttttaatttatcgacaagtatttag

SEQ ID NO: 29115 - DNA, 115 bp, Homo sapiens
agttagcagctgtctgcttttcttcagggtttgtcttttttcaatttttttttttctgcagggggggaagaaagtttatttttcattcttgaagaagcctgactacagactgact

SEQ ID NO: 29116 - DNA, 81 bp, Homo sapiens
gcaggagtgtggggtggaaagagctctgggccagaagttagaagatctggtccctcactctttctgtcacttgtgcagtct

SEQ ID NO: 29117 - DNA, 115 bp, Homo sapiens
tacattttaaatcactgaagtctgggagatcatgctatacttatttttttaaattgtaaaatatagccaatatagctgattaattgtagagacttcaattgcattttattttgtg

SEQ ID NO: 29118 - DNA, 95 bp, Homo sapiens; identical to SEQ ID NO: 68

SEQ ID NO: 29119 - DNA, 93 bp, Homo sapiens; identical to SEQ ID NO: 69

SEQ ID NO: 29120 - DNA, 91 bp, Homo sapiens
tgtctgtatgtgtgtgtgtgtatatatatatgtgtatatacagagagagagagagaaatgtaatatatatacacacacatatatatatata

SEQ ID NO: 29121 - DNA, 95 bp, Homo sapiens
acacaatatatatatgtatatatatatgtgtatatatatgtatatatatatgtgtatatatgtatatatgtgtgtatatatgtatatatgtatat

SEQ ID NO: 29122 - DNA, 132 bp, Homo sapiens
gtggggtatgcacacttgtgtgccggctagggcaggatggtggtggcaaggtccacacttgtgtgtgtcagtggtaatggggaagtgcagtctgcatgcttacatgttggcaaagcagtggggagaagctac

SEQ ID NO: 29123 - DNA, 102 bp, Homo sapiens
aagtggttttcaaggatcaatggcattaaaagaagaatgttttggcaacccccaattttttttttatttttccaagtatgggccttgaagaaacaactactt

SEQ ID NO: 29124 - DNA, 120 bp, Homo sapiens
atggcattggaagttaattttttgggagcaattatgctgtcacactgtcactgtcaggaagatactttgggttgaaaaaatatagtctccaagtctttgctattgtgaatagtgctgcag

SEQ ID NO: 29125 - DNA, 88 bp, Homo sapiens
ccttctggttggcagaagctgcttcacttgttatcttgaaaaattttttttttttctgagatggagtctcgctctgtcaccaggctgg

SEQ ID NO: 29126 - DNA, 89 bp, Homo sapiens
ggagagcaggtgtcacaaggtaagagacatcagtggctgcaggacctcatgtggtgtcctcagatctttctctttcttgctccatctcc

SEQ ID NO: 29127 - DNA, 80 bp, Homo sapiens
cagtgtagtcagagaacacactctgtgatttcaattcttttaaattgaagtttccaggatatgatttgtgatttacattg

SEQ ID NO: 29128 - DNA, 89 bp, Homo sapiens
cctggattaaatatgtggaggactctgcactttcattagaaactttattatcttatttctaatgggactagtgtttctcacaagccagg

SEQ ID NO: 29129 - DNA, 101 bp, Homo sapiens
tatatataagatatatatctatatctatgtatgtatatatgcttatatatcatatataagcatatataccttatatataagcatatgtatccttatatata

SEQ ID NO: 29130 - DNA, 65 bp, Homo sapiens
cagagtctcgctctgtcacccaggctggaatgcagtggcacagtcttggttcactgcgacctctg

SEQ ID NO: 29131 - DNA, 76 bp, Homo sapiens
cccagtacttcctccctctgcccttttgcttagagatttttttctatttgtaaaacaagagaagtaggtgaatggg

SEQ ID NO: 29132 - DNA, 96 bp, Homo sapiens
aacttgtggcagaccaactgtcccaaaaagaacaattggaaatggattgtatatttttaaaagtctgtttgaaggcttcagtgagtttgttaagtt

SEQ ID NO: 29133 - DNA, 119 bp, Homo sapiens
tatgtacattcacgtgtgtgtgtatatatgtatgtacattcacgtgtgtatatatgtatattatatatacatgaatgtttgtatgcatgcatatatgtatatgtttgtgaatatacata

SEQ ID NO: 29134 - DNA, 58 bp, Homo sapiens
tgagacagagtctcactctgtcactcaggctggagcgcagtggtgtgatctctgctca

SEQ ID NO: 29135 - DNA, 112 bp, Homo sapiens
gccttggtcaaaatttcacagggaaagtagttgaaattttgtactttcgatgttttatattaattttgattattataattttttgattaattttccttggggatatcaggac

SEQ ID NO: 29136 - DNA, 98 bp, Homo sapiens
gggtggctgttttttttgtttctttctttttttttttttttgagacagagtctcgctctgtcacccaggctggagtgcagtggcgcgaccttggctca

SEQ ID NO: 29137 - DNA, 56 bp, Homo sapiens; identical to SEQ ID NO: 17015

SEQ ID NO: 29138 - DNA, 112 bp, Homo sapiens
gagtggattttcttcttgtcattgtgtcttccattaatgatattggatgattttatgcaatttttgtttcaatatttgctagaaagaagactgggacaatgagttctatctt

SEQ ID NO: 29139 - DNA, 96 bp, Homo sapiens
ataatatctattatatatggctgcaaatagacatatatattactccatttatatatatatataagtccatttgcagcaacatataatatatattat

SEQ ID NO: 29140 - DNA, 78 bp, Homo sapiens
gcaagtgcgcacaattattgatcttagagtgggctaatttgttctctgtgtctctgtcaatatacagtgtttggttgc

SEQ ID NO: 29141 - DNA, 86 bp, Homo sapiens
gtcaccagatacaagctgctctgggaagggcatgaccttcggcaaggttctgcatctgcatctgggagaagctgacagctggagac

SEQ ID NO: 29142 - DNA, 81 bp, Homo sapiens
tttggcctatgagttgcagtatgctaaccccttgccataaaggatgagtagagagggtccacactgaggggaaaggccagg

SEQ ID NO: 29143 - DNA, 58 bp, Homo sapiens
tgagacagagcctcactctgtcacccaggctggagtgcagaggtgtgatctctgctca

SEQ ID NO: 29144 - DNA, 110 bp, Homo sapiens
atcaaatgcttctccctgctttgcccatcagatggaggttgacatgtagacataaactcaacattcagtgcacaccatctgccggccagccctgtgctacatgaaatgat

SEQ ID NO: 29145 - DNA, 111 bp, Homo sapiens
gccaggcgtgatggtgggtgcctgtagtcccagccactcaggaggctgaggtagaagaatcatttgaacctgggaggcagaggtcgcagtgagccgagatcacgccattgc

SEQ ID NO: 29146 - DNA, 83 bp, Homo sapiens
aattagccaggcgtggtggcatgtgcctacagtcccagatacttggaggctgaggtaggaggatcacttgagctctggagatt

SEQ ID NO: 29147 - DNA, 96 bp, Homo sapiens
tccagcccaaaataatgttcttgaaatggcagtataaatgtttatttataaacatgtcaaatattctgttgtactgtatttttagaagagggagga

SEQ ID NO: 29148 - DNA, 76 bp, Homo sapiens
agctccagcactttgtgtctgggtgaactcagagcctcttgctccaggtttgtttcctcatcagaataatggagtt

SEQ ID NO: 29149 - DNA, 93 bp, Homo sapiens
tccactggtctgcaatgagttaagatttggtaaggaaaatacaattttttttgtttgttttattgagatggagtcttactctgtcacctagga

SEQ ID NO: 29150 - DNA, 76 bp, Homo sapiens
ggaggctgaggtaggaggatcacttgagcctgggaagtaaaggctgcagtgagctgttatcgtaccactgcacttc

SEQ ID NO: 29151 - DNA, 82 bp, Homo sapiens
atacaatggaaatagtaacaatacgtatattactgggctgccaaatggctagatctgtgtgtgtatgtgtgtctgtatgtgt

SEQ ID NO: 29152 - DNA, 96 bp, Homo sapiens
catccacctgcattcccagttatgagaggtcaactcctatgagctttgtatggttcagtggatatttctgtggctggaaggtgatgcatggtgatg

SEQ ID NO: 29153 - DNA, 71 bp, Homo sapiens
ctgctgcagtggagggtgtcctgtcccacttgagggaaagtggtcagagacagtgtctgtgtgggactcag

SEQ ID NO: 29154 - DNA, 76 bp, Homo sapiens
ggaggctgaggtaggaggatctcttgagcccagaaagtagaggctgtagtgagacctgtttgcaccactgcactcc

SEQ ID NO: 29155 - DNA, 87 bp, Homo sapiens
ggctgccaatttgtaagctctctgtagccagtagggacccactggacagtgtgaagacagagagatggtcagatattgcatagtgcc

SEQ ID NO: 29156 - DNA, 102 bp, Homo sapiens
tgctaagaatctgaggacattgttattaagatttgttttccattgtttgtttttgtttattgcaaatagctggggtggtcaatatagtccttaaagtcagcg

SEQ ID NO: 29157 - DNA, 100 bp, Homo sapiens
aggtatcaaggacaatgcctggatgtctagcttggggagttgtgtggacaatggtaacatgcttgaggccacctagttagtaaccagcagggtcaggcct

SEQ ID NO: 29158 - DNA, 86 bp, Homo sapiens
agtgcctttatctggaagacctgctgaaggacctgcctgaggccatgatgcagttaactttattttttaaatagaaggagtgcact

SEQ ID NO: 29159 - DNA, 84 bp, Homo sapiens
agcagttccctgcggtgtgcgtctctctctgggtctggagaagcacaaggactatgagaaaagcaggtgtcagggatgtctgct

SEQ ID NO: 29160 - DNA, 86 bp, Homo sapiens
gtctcactgtcgctgtctggctgcctcccttcaagtgattccctactagctcccctgaggccaagactgttcctttgatctgagac

SEQ ID NO: 29161 - DNA, 88 bp, Homo sapiens
atcatatatcatatggtatatatcatatatatgtgcatacaatatatagctcatatgtgtatatgtatatatgtctcatatatatgat

SEQ ID NO: 29162 - DNA, 96 bp, Homo sapiens
gtggtgctcttcctttgtaggtctgtgtgtctctgtcttcatgtggcattctccttttgttataaagacaccagtcacattggattaaggacccac

SEQ ID NO: 29163 - DNA, 92 bp, Homo sapiens
tctgtaatcattctttggactgacctgaaactgtggagggatctggccccaggaagcctctggaagaattcaggattgaatgattgaatgga

SEQ ID NO: 29164 - DNA, 81 bp, Homo sapiens
gagggcaaggcccaggcatgcgggaatatctgtgctgcctgaagagacagtggagatgcagctggaggcaggggagctctc

SEQ ID NO: 29165 - DNA, 94 bp, Homo sapiens
tgacagtaattaatggttcctagagaatggaatggcctcgcagagtcacccactctgagtacaattttcaaaccactctagaacttaactatca

SEQ ID NO: 29166 - DNA, 69 bp, Homo sapiens
tggtgggaagtgagagtgcacaggagctggacgctcccagctccaggaacatgctctattgtcctatca

SEQ ID NO: 29167 - DNA, 119 bp, Homo sapiens
ggtggtgatcgtggtggtgatggtagtggtggtttggtttggctttgattagaaagtttctatttttatatagtcaaatctatcacctttttcttttataagtttctgattttgatgtc

SEQ ID NO: 29168 - DNA, 111 bp, Homo sapiens
ctgatgtgtctttctgtttccatttcctagtccagggtctgcactgagtaggtggcagcatgatgtgtttatggggtgaatgattgtcagattacagagacttttcatcag

SEQ ID NO: 29169 - DNA, 92 bp, Homo sapiens
tatatatatagtgtgctatatatatagatagtgtgctctgtatatatatatatatagataatgtgctacatatatagtatactatatatata

SEQ ID NO: 29170 - DNA, 59 bp, Homo sapiens
tgagacggagtctcactctgtcacccaggctggagtgacagtggtgtgatttctgctca

SEQ ID NO: 29171 - DNA, 59 bp, Homo sapiens
ttgtctgtgagtgagtctctccctcaggggcccatagggaaagtgatggccataggcaa

SEQ ID NO: 29172 - DNA, 114 bp, Homo sapiens
cagggcttatgttggttttgtaataagaatttttaaagtttgtttttttttactttgcaaaagtgaaatgggtgagtcagactgttctgacacagggctgacagtgatgagtgt

SEQ ID NO: 29173 - DNA, 95 bp, Homo sapiens; identical to SEQ ID NO: 68

SEQ ID NO: 29174 - DNA, 93 bp, Homo sapiens; identical to SEQ ID NO: 69

SEQ ID NO: 29175 - DNA, 108 bp, Homo sapiens
cttttgattttgacaggtcattgtttatgatttggaaggtctcattggtaatgtacctgtgggatgcttaattatgaatatttaaaatatgagctttcagttcatggg

SEQ ID NO: 29176 - DNA, 95 bp, Homo sapiens; identical to SEQ ID NO: 68

SEQ ID NO: 29177 - DNA, 93 bp, Homo sapiens; identical to SEQ ID NO: 69

SEQ ID NO: 29178 - DNA, 99 bp, Homo sapiens
ggttgccattgattaaggacagtctctgtgtctcttacttcaaattctcaaaagaaagtttcttaactgacacgttggcttcctctgggcctggtgacc

SEQ ID NO: 29179 - DNA, 94 bp, Homo sapiens
tgggtgtttcaggcccattcactcagaatttttgtttttcttgatcacattgatataggtggataaaatatcagagcgtgagtcagaaggcccg

SEQ ID NO: 29180 - DNA, 113 bp, Homo sapiens
tttggaaacagattctgaaatggagaggagcgaggcactctggagcgaggcactctcagtctcttcctgactcctttcaggcctaccctccccgattcatatcttttaacagg

SEQ ID NO: 29181 - DNA, 101 bp, Homo sapiens
tgctatgcctttacatatgtgtgtatatgtattcgtctgtatatatatgtgtgtatatatatacacttagaatagatatagtttttacataaaagttagta

SEQ ID NO: 29182 - DNA, 58 bp, Homo sapiens; identical to SEQ ID NO: 11194

SEQ ID NO: 29183 - DNA, 117 bp, Homo sapiens
gtatatgtgtgttcattgaactcttacaacttttatgtaggtttcaacgtttcaaagtattttttaaaagttaccttttcaaatgaagtttgtggttcttagagaacatatgaatat

SEQ ID NO: 29184 - DNA, 64 bp, Homo sapiens
ggctgttcttgtgcaatgtgtgtgtgtgtgtatatatatatatacatgtttttgagatggagtc

SEQ ID NO: 29185 - DNA, 83 bp, Homo sapiens
tgtgctagtctgtactgagatgtgtaagtgtattaaacacttacaagtgtttaatacataacagattttgaagatgtagtaca

SEQ ID NO: 29186 - DNA, 109 bp, Homo sapiens
catttaaaaatttctgtgatagtctgaatggcaaatcattttgatgctttgtatttatagttacatagattttcatatgagccaaattttggatattaaaaggtaaatg

SEQ ID NO: 29187 - DNA, 113 bp, Homo sapiens
atgtagaatagtgccatacaatgtataggaaggcatcatttttattctttattttaataccgagtggaagttttgtttattttccattgtactgtgtgtcctgttatttatat

SEQ ID NO: 29188 - DNA, 120 bp, Homo sapiens
gctcccattctgcttgctctggtggagatattgcacattactaagttgcatgttgtcacggcctcaatgcaatttagtgtgtgtgatattttcacatgagtgcatgcacacgggtatggc

SEQ ID NO: 29189 - DNA, 102 bp, Homo sapiens
cttaacctttgatcttgtttcctcatgtgtaaaatggggataatttcttcaatctatctcacacagtcactgtgaggaacaaatgacataagacagatgaag

SEQ ID NO: 29190 - DNA, 119 bp, Homo sapiens
tttggagatagcattatttaaacagttcactataaaatgatatttaagttctcaattttttatattgtaaatggcaagtgaatatttttatatgtgtctgcacagtgtgcttctgtaaa

SEQ ID NO: 29191 - DNA, 110 bp, Homo sapiens
gataggctatgaaagataaaagctggtgaagaagagcagagattatcttgtttatagtttaggctagatggtacatgtaacattctttaccgctattatgttatagtatc

SEQ ID NO: 29192 - DNA, 90 bp, Homo sapiens
tccttgtggtggtttctcattcagactctctctcagttttcccaaggagaggtggggagagtaggtatcctgaggcccgttttacagggg

SEQ ID NO: 29193 - DNA, 123 bp, Homo sapiens
taagctgtgatgttcagtaggttaggtgtattaagtgcgttttttcttttctttttttttaagtcaaggtgtcactctgtcacccaggctagaggtacaatgcagcttattgcaaccttgaac

SEQ ID NO: 29194 - DNA, 93 bp, Homo sapiens
acagagtattgttgtgcccacaaatttgttttattttatttttaggctgaggggaaatggaacagctctgtttgttttcactattaactctgt

SEQ ID NO: 29195 - DNA, 75 bp, Homo sapiens
gcatctcctctgtctgcctgtctcccagtttctcttaggcttagcagatcctggatcaggtatttacagccacgc

SEQ ID NO: 29196 - DNA, 94 bp, Homo sapiens
gccagctgtggtagtgcatgcctgtagttccagctactcgggaggcagaggtaggaggatcacttgaatcagggaggcaaaggttgcagtgagc

SEQ ID NO: 29197 - DNA, 69 bp, Homo sapiens
gttgtttttgtttttgttttggggacagagtctcactctgtcgcccaggctggagtacagtggtgcgat

SEQ ID NO: 29198 - DNA, 113 bp, Homo sapiens
taggaagctgcagatagagttgtgctttctctgggaaatcatttttatatattttaagatggaaaatgttgataatctcaaggttcatgcacaatttgaatactgaattccta

SEQ ID NO: 29199 - DNA, 107 bp, Homo sapiens
ggcttgtctcaagctttcccattgcaatggaatcagtctgtggctcacactcaggctgctgagaccacctgcacagtgtgctcatgggaaaagtgcgagacgctgcc

SEQ ID NO: 29200 - DNA, 77 bp, Homo sapiens
agtgaattaatttgttttttaaaaattttgtatttgatttatttcaataggtttttggagaacaggtggtgtttact

SEQ ID NO: 29201 - DNA, 56 bp, Homo sapiens
gcgtgtgtgcgtgcatgcgtgtgtgcacatgcacacacacacacacacacacacac

SEQ ID NO: 29202 - DNA, 74 bp, Homo sapiens
ctttgactagctgagctccctttcacagtgaattttttttttttttgagacagagtctcagtctgttgtcacag

SEQ ID NO: 29203 - DNA, 58 bp, Homo sapiens; identical to SEQ ID NO: 3701

SEQ ID NO: 29204 - DNA, 73 bp, Homo sapiens
gtttgtttgagatggagtctcgctctgtcgctcaggctggagttcagtggcatgatttcagctcactgcaagc

SEQ ID NO: 29205 - DNA, 120 bp, Homo sapiens
agcatcacctgggaggtcgttaaaattcaaattcccaggccttatgcgagacttagagaatctgcatctccatgggtgggtcctggaatctgtgtcttaggaagttctcctggtggtcct

SEQ ID NO: 29206 - DNA, 95 bp, Homo sapiens; identical to SEQ ID NO: 68

SEQ ID NO: 29207 - DNA, 93 bp, Homo sapiens; identical to SEQ ID NO: 69

SEQ ID NO: 29208 - DNA, 101 bp, Homo sapiens
gctggtagtgtcttttctgaagtcggtttttattttgtttttcatctgaaggaaacagaacagtcaaagtacacttcaggttacaaagtacagcagctagc

SEQ ID NO: 29209 - DNA, 58 bp, Homo sapiens; identical to SEQ ID NO: 605

SEQ ID NO: 29210 - DNA, 89 bp, Homo sapiens
tttttttgagactgagtctcactctgtcacccaggctggagtgcagtagcgcgatctcggctcactgaaacctctgcctcctgggttca

SEQ ID NO: 29211 - DNA, 100 bp, Homo sapiens
ctgtgtttgaggtgccacagcacaaagctcactccaggcagacagaggaaagtgagcactgggcaggttgaggcaagtatgaatcatcctctgacatcag

SEQ ID NO: 29212 - DNA, 58 bp, Homo sapiens
tgagacggagtctcactctgtcacccaggctggagtgtggtggcatgatctccgctca

SEQ ID NO: 29213 - DNA, 73 bp, Homo sapiens
ctgtgttgggctgccaaagtgctaggattacaggcatgagccacctttcccagcctcaggtagttctttgtag

SEQ ID NO: 29214 - DNA, 95 bp, Homo sapiens; identical to SEQ ID NO: 68

SEQ ID NO: 29215 - DNA, 93 bp, Homo sapiens; identical to SEQ ID NO: 69

SEQ ID NO: 29216 - DNA, 107 bp, Homo sapiens
gtgatttagcattaagagtgatgttgactgttgcttttgatttttaaatttttttaaatatcatttgtgcatatgtttattatacaatttttaaaatgcttaaaaac

SEQ ID NO: 29217 - DNA, 115 bp, Homo sapiens
atatagatatatatagatatctatgtatatagatatatatagatatctatgtatatagatatatatagatatctatgtatatagatgtatgtagatatgtatatagattgcatgt

SEQ ID NO: 29218 - DNA, 58 bp, Homo sapiens
tgagtcagagtctcactctgtcacccaggctggagtgcagtggtgcgatctcggctca

SEQ ID NO: 29219 - DNA, 92 bp, Homo sapiens
tatgtggtacatgagtgtatacatgactatatactgtatgagtcagtcacactcatacatacacaaacagacatacagtacatttccacata

SEQ ID NO: 29220 - DNA, 84 bp, Homo sapiens
gtgggtgtatacatatacatctatgtatgtgtttttataaatatatatataaaaacacatacatagatgtatgtatacatatac

SEQ ID NO: 29221 - DNA, 112 bp, Homo sapiens
aggttagaagaaagatggagttggttaagtcagatctctttcactgtctcagttacaattgtgcaatggcagtttcagctgcattcagtgggatgggctgggcttaatacct

SEQ ID NO: 29222 - DNA, 116 bp, Homo sapiens
tgagggaagtgggctgcccacatctcttctctcccaagcccaggtgcagccttcacagtagacagtgaggcccctggtcacacagtcaggggaagaaatgcagctccttaccctca

SEQ ID NO: 29223 - DNA, 100 bp, Homo sapiens
agtgctgcaatttaatgaaatggcactatgaaaataaaataatatttgttcctagattattttattttcatagtgccatttcattaagttgtttatcatt

SEQ ID NO: 29224 - DNA, 95 bp, Homo sapiens; identical to SEQ ID NO: 68

SEQ ID NO: 29225 - DNA, 93 bp, Homo sapiens; identical to SEQ ID NO: 69

SEQ ID NO: 29226 - DNA, 107 bp, Homo sapiens
catgtgaaaagttttgcaatagaggttttccatgtcagcctgtctctctgtcacctatgccagaggctgaatggtcctctaaacaacggcagtaataccttctcatg

SEQ ID NO: 29227 - DNA, 108 bp, Homo sapiens
acatgtacgtatatatatatacacctatatacgtatatatgtacatatatatacgtatataggtgtatatatatatatgtgtgtgtatatatatatatatatatatat

SEQ ID NO: 29228 - DNA, 85 bp, Homo sapiens
catatatatatatgtatatacatgtacacatatacgtaagtgtacatatatgtatatatgtatatgtgtaatatatacgtatata

SEQ ID NO: 29229 - DNA, 66 bp, Homo sapiens
gtatatatatgtatacatatgtatgtgtgtatatatatataaatatatgtgtgtatatatctatat

SEQ ID NO: 29230 - DNA, 78 bp, Homo sapiens
gtgggcactttggttgtttccataccttggctattgtgaatgatgctgcaatgaacacgggaatgtagctatgtctac

SEQ ID NO: 29231 - DNA, 99 bp, Homo sapiens
ggtaatgttctttatttttatttttattttttttgagttggagtctcgctctgtcactcaggttggagtgcagtggtgtgatctcagctcattgcaacc

SEQ ID NO: 29232 - DNA, 89 bp, Homo sapiens
taggtttgtttgggttctgggaacagagtggaacatttggtcaaccaagtatcagatttttttctctttatttctggtaggtaaactta

SEQ ID NO: 29233 - DNA, 121 bp, Homo sapiens
tgagtgagactctgtccctcaataactgcactgatgatgagtgagacactgtccctcagtaactgcactgttgatgagtgagactctgtccctcaataactgcactgacgatgagtgagac

SEQ ID NO: 29234 - DNA, 118 bp, Homo sapiens
cagcctaggcgacagagtgaggccctgtctcaaaaaaaaaaatatatatatatatatatacatatatataaaattattattattttggagacagagtcttactctgtcacctgggctg

SEQ ID NO: 29235 - DNA, 100 bp, Homo sapiens
tttactggatgtttacattttaggaaggaaaatagttttgtttatttaaacaactgaatacttataaactgttgttcctggaagttatttattccataaa

SEQ ID NO: 29236 - DNA, 116 bp, Homo sapiens
ttcttgtctgcccctgcaactaaatagaagcaccttaacttagtaatcaaaaagctagataagggattctggtgtgatgacttgagcctatttagttttagcataactatgaagaa

SEQ ID NO: 29237 - DNA, 59 bp, Homo sapiens
gacagtgtctccctctgtcacccaggctggaatgcattggtatgatcagggctcactgc

SEQ ID NO: 29238 - DNA, 120 bp, Homo sapiens
tagctgggcatggtggcatgtgcctgtagtctcagctacttgggaggctgaggtggaaggatcacttgagcccaggagattgagtctgcagtgggctatgattatgccactacactccag

SEQ ID NO: 29239 - DNA, 110 bp, Homo sapiens
ctgtgcctgactcttgtttgctttatatagggtgtgactctgtgactgcctcagtttctcctagcctgattgttaatagtgtctcctttctcaaacgagtcctgctttag

SEQ ID NO: 29240 - DNA, 66 bp, Homo sapiens
attcaacaggatatatatatatatatatatatatcctgttgaatatatatatgtatcctgttgaat

SEQ ID NO: 29241 - DNA, 105 bp, Homo sapiens
ctccacctactacactgaaactccggtcttgacagtgactctgtggctcacaatcagccccaggattgcttgcttgcatggagccagtgacagactggagccagt

SEQ ID NO: 29242 - DNA, 64 bp, Homo sapiens
gagacaaggtctcactctgtcactctgttgcccaggctggagtgcagtggcatgatctcagctc

SEQ ID NO: 29243 - DNA, 93 bp, Homo sapiens
aggttgctgggaggaaattggaagattattgcaacatttactattgtaaaattgttgtgaaagtctccctctctctgaattgagcttgaacct

SEQ ID NO: 29244 - DNA, 58 bp, Homo sapiens
gtggtggagacaacaccaagtgagacaggctgtgtcacccagtctctgtctctgtcac

SEQ ID NO: 29245 - DNA, 94 bp, Homo sapiens
ttgggtggtggatatttcgtgtgtgtttaagtacaaatttataagctatatacttaatatttgtatatttcactgcatgaaagttacatctcaa

SEQ ID NO: 29246 - DNA, 83 bp, Homo sapiens
tgagacagggtcttgctctgtcttaatacatatttattgatttattgatttatttttgagatggagtctcactctgttgctca

SEQ ID NO: 29247 - DNA, 112 bp, Homo sapiens
ctgaggtacaaggatcacttgaacccaggaggctgaggtacaaggatcacttgagccctggaggttgaggttgcagttagctgtgatcacatcactgcacttcagcctgggc

SEQ ID NO: 29248 - DNA, 112 bp, Homo sapiens
gcaggcattaaagaaaatattcaatatgctgtcttcaaaaaaagtgttgatattttgttgttaagatgtccatataaaatgaaggcagtcagaatcattttattgaaactgt

SEQ ID NO: 29249 - DNA, 62 bp, Homo sapiens
cccattgtccaggctggagtgcagtgacacggtcacactcactgcagccttgacttcccggg

SEQ ID NO: 29250 - DNA, 116 bp, Homo sapiens
cagcctgggtgacagagtaagactctgatctcaaaaaaaaaaaattttttttcctttttttttttttttttttttttttttttagagatgagggtcttactctgtctctcaggctg

SEQ ID NO: 29251 - DNA, 80 bp, Homo sapiens
tatgtcattatatatttgtcaaaattcacagaaggtacaacacagagtgaaccctatggattttggttgataatgatatg

SEQ ID NO: 29252 - DNA, 74 bp, Homo sapiens
atggcactgtcacactcactttcttcagcagcagtatagattgtgcctagaagttttggatgtggctgggcggt

SEQ ID NO: 29253 - DNA, 91 bp, Homo sapiens
ctgagccttgcagtccccttcaggttagttgtcctcctcacacaaatcactcaaaaagtgaagtgagagacaagactgggtgggtggccag

SEQ ID NO: 29254 - DNA, 113 bp, Homo sapiens
ttccttgcagctctcccctccttcactctagcggagcccttgaccttttttttttttttttttttgagacagggtctcgctctgttgcccaggctggagtacagtggtatgaa

SEQ ID NO: 29255 - DNA, 103 bp, Homo sapiens
tttgaggtatttataagtattttaggtagctgcactgattttttttttttgagacagtgtcttactatgttgcctaggctggtcttgaactctaggcctcaag

SEQ ID NO: 29256 - DNA, 112 bp, Homo sapiens
ggttagttaattcctaaatatgttattgcttgagaggttattgtaaataaaattgttttgttaattttatttttgaactgttcattattagtgtatagaaatgcaactgatt

SEQ ID NO: 29257 - DNA, 108 bp, Homo sapiens
ttatggtgcatttaatttttaattgacgtagtttctaaatttttgatatgtttctgacagcacagtaagtttgtcttaaggaagaagagtagtcagtatgcactgtga

SEQ ID NO: 29258 - DNA, 88 bp, Homo sapiens
agatatctgaaaatgcttatagtagtaactataagatctgcagatcaggtagtaggaactattgattttgggccagtccaggtgctct

SEQ ID NO: 29259 - DNA, 58 bp, Homo sapiens
tgagacagagtctcactctgtcacccaggctggagtgcagtagtgtggtcttggctca

SEQ ID NO: 29260 - DNA, 99 bp, Homo sapiens
gaagcaagattaaagccaggtaaagggggagaataactgggcagggaggggtctgctactagtttgttttttgtttgtttgtttatttgtttgtttttg

SEQ ID NO: 29261 - DNA, 95 bp, Homo sapiens; identical to SEQ ID NO: 68

SEQ ID NO: 29262 - DNA, 93 bp, Homo sapiens; identical to SEQ ID NO: 69

SEQ ID NO: 29263 - DNA, 109 bp, Homo sapiens
ttagaaattgttaggatagtaaatgttaggtgtattttatcacaattttaaaaatttttaaagaaaagataaggccatttagcacattttgttcagcaagcgatactga

SEQ ID NO: 29264 - DNA, 117 bp, Homo sapiens
cagtggcagaatgaggttgaatgtatgaagccaaaacaaaacagaagagattagatagggatatatatatatattttgttccagagcttgattattttttctctttttgtagttctg

SEQ ID NO: 29265 - DNA, 69 bp, Homo sapiens
ctcagttttgctgtagaggtagaggatagggctcaatctctcactctttcactgcctctgagtactgag

SEQ ID NO: 29266 - DNA, 113 bp, Homo sapiens
ctacacacaggaatgaacaaggacggattaaaggttagaagcaggatggagtcggttagatctgatctctctcactgtcataatttcctcagttataattcttgcaaaggtgg

SEQ ID NO: 29267 - DNA, 100 bp, Homo sapiens
attgctacagtgactctcttcttggttcaggttctctttttttttttttttttagacggagtctggctctgtagcccaggatggagtgcagtggcgcaat

SEQ ID NO: 29268 - DNA, 92 bp, Homo sapiens
aggcaatttcatatatagttcaaccaatagctgaggccactgtaggtagactccccacccactgtgcctgagtctgagaaggaagaatgcct

SEQ ID NO: 29269 - DNA, 77 bp, Homo sapiens
gcagggcatggtggctcactctcagaggctgagacaggaggactgcttgaggccaggagttcaagactagcctgagc

SEQ ID NO: 29270 - DNA, 113 bp, Homo sapiens
attattcaaagatctgttgtattttttccaaataatttgtgattttctagatgtcattatttactgatttctagtttaattcaattatgctcagacaatagactttatatgat

SEQ ID NO: 29271 - DNA, 63 bp, Homo sapiens
gagacagagcctcactctgtcacccaccacccaggctggagtgcagtggtatagtctctgctc

SEQ ID NO: 29272 - DNA, 105 bp, Homo sapiens
tccagcctgggtgacagggcaagactctgtctcaaaaaagaaaaaaaaagaggtttttattttttgttttttgagacagggtctcgctctgtcacccaggctaga

SEQ ID NO: 29273 - DNA, 58 bp, Homo sapiens; identical to SEQ ID NO: 1190

SEQ ID NO: 29274 - DNA, 56 bp, Homo sapiens; identical to SEQ ID NO: 1191

SEQ ID NO: 29275 - DNA, 69 bp, Homo sapiens
ggtcttccctctgtgcgtctgtgtcttaatttcttcttacaaggacaccagtcttactgggttagggcc

SEQ ID NO: 29276 - DNA, 106 bp, Homo sapiens
gccgtctgcccttagttgactgcagggaatgggaaggagtggttctaggttcatttggacagcatggagggcaaagaacgtgtggtaaaagcttctcttcagtccc

SEQ ID NO: 29277 - DNA, 68 bp, Homo sapiens
gggcatggtggcatgagcctgtagccccagctactgaggaggctgaggtaggaggatcacttgagcct

SEQ ID NO: 29278 - DNA, 120 bp, Homo sapiens
ggagaaaactttgattcagagaaggaaggaagctgttcagggttacacagactgtctctgacttgggaagtcagtgatcaagctcgggtgtcttatccaactcaaattcagtgatgatct

SEQ ID NO: 29279 - DNA, 58 bp, Homo sapiens
ctggacctgaaatcccagctacttgggaggctgaggtggaaggatcatttgaggccag

SEQ ID NO: 29280 - DNA, 78 bp, Homo sapiens
ctgtactcagcctctctgagactgtttcctcccgtgtaaatagggataaaaatagtaaccgagaaggttgctgtgaag

SEQ ID NO: 29281 - DNA, 115 bp, Homo sapiens
atctgcaggtgataaaatgacatagaactgtacatacgtattgtcccaatgtcaatttcaatttttgatattgtactataattatgtaagatgtgttcattggggcacactaggt

SEQ ID NO: 29282 - DNA, 82 bp, Homo sapiens
cttttattctggttatcacagtggaatactgttattgtttacatgaatgttctttacagtaaactgtgagcttctgtagagg

SEQ ID NO: 29283 - DNA, 84 bp, Homo sapiens
catccttttcagctgccacctccttctgttggtgacttcactggaccactaaagctgctgacagaggagacagagcccaggatg

SEQ ID NO: 29284 - DNA, 87 bp, Homo sapiens
atttcccttctttccccagtggagtgttttattttttatttttccagtttaggggaaatgttaagatgatttgggggttgctgaaat

SEQ ID NO: 29285 - DNA, 107 bp, Homo sapiens
tgtgagtctttatgtttgaaacatatttaagtagcaggtagctgtttattgtttgttatttaattgacaatctctgctttttaattgtatcatttgtaccagttaca

SEQ ID NO: 29286 - DNA, 105 bp, Homo sapiens
attgttactatatttcaaagcctaagacaagtccagcttttttttttttttttttttgagatagagtctcaccctgtcacccaggctggaatgcagtggtacaat

SEQ ID NO: 29287 - DNA, 68 bp, Homo sapiens
gtggccctataagaagagagagagagagagatcttcatctctctctttctgtctccatgtacacccac

SEQ ID NO: 29288 - DNA, 58 bp, Homo sapiens
tgagacagggtctcactctgtcacccaagctggagtgcagtggcatgatcgtggctca

SEQ ID NO: 29289 - DNA, 88 bp, Homo sapiens
ggagatagagacacaaaaaccccttcaaaaaaatcaatgaatccaggagctggtgtttttttttttttttgagtcagtgtctcgctct

SEQ ID NO: 29290 - DNA, 75 bp, Homo sapiens
gcccttcctgatgcatattccggcgccatggtagtaacacaggggctcagtcactgagtatgtgtgatgaagagc

SEQ ID NO: 29291 - DNA, 93 bp, Homo sapiens
gcctcaggggtagccgtgggggttgtgtgggaggctaagggggccgggggccctagaattcactatgcacacagcctggcatgtccctgtggt

SEQ ID NO: 29292 - DNA, 97 bp, Homo sapiens
gaagctgcttgttctcaggtttgctgatttttagggaaatcaattgatttcttttcatgctgaatatcattatttcattattgaggattgttatttc

SEQ ID NO: 29293 - DNA, 80 bp, Homo sapiens
tcaacttccctctctggctgtgtctctgtctcccgctctgaacccggggatctgggctccaggctcccagagggccatga

SEQ ID NO: 29294 - DNA, 84 bp, Homo sapiens
acagaacctggaagcatcgagactgagtcccaattctgagccccacctcataatccccagcctcggtctctccctctgttctgt

SEQ ID NO: 29295 - DNA, 79 bp, Homo sapiens
aaactgcagctcaaagatgtaggctctgagttctgccatttgctcactggcagacctcagcctcactgtgtctcagttt

SEQ ID NO: 29296 - DNA, 109 bp, Homo sapiens
gattttcatgataacactaagatgtcattcgcctttgtcactctcactctggtgaatgttaagtggcatcttcccgaggctgcatggcgcgcaatattgtcagtggatt

SEQ ID NO: 29297 - DNA, 84 bp, Homo sapiens
ttgagacagagtctcactcactctcttgtccaggctggagtgcagtggtgctgtctcggctcactgcaacctctgcctctcagg

SEQ ID NO: 29298 - DNA, 110 bp, Homo sapiens
gcagctacttctctgcctgcttcccctgctgtgaaatgagtcgattgggactggatgtcttcagtggctgtgttgccagaagcctgggtgtgtaggcagtgagggcctgc

SEQ ID NO: 29299 - DNA, 83 bp, Homo sapiens
tcaggttgcacattggcagagtcagagctggaagggcaggagtggtgttgagtctgagctctcaccgtgcacatgggccctga

SEQ ID NO: 29300 - DNA, 73 bp, Homo sapiens
ctcagggccagagtggcgaagggagttggagaccccagtttgaatcccggctctgccactgactggctgtgtg

SEQ ID NO: 29301 - DNA, 104 bp, Homo sapiens
catgatactcccgtgaaagtaggttctgttgttagcaccattttatgtctttatttttaatttttgtgggtgcatagtaggtgtgtacatttgtgggatacatg

SEQ ID NO: 29302 - DNA, 130 bp, Homo sapiens
agcgtggcccagctgatccttatacacatccacagatatcatttgttgaatgtctttttttttgttttgaggtggagtctcgctctgtcgctcaggctggagtgcagtggcgcgatctcggctcactgca

SEQ ID NO: 29303 - DNA, 94 bp, Homo sapiens
ctgcccaggctggtgtacagtggaatgattacagctcagtgcggcctcaacctcctgggttcaagtaatcctcccaccttagcctcccgagtag

SEQ ID NO: 29304 - DNA, 112 bp, Homo sapiens
tctgcatctgtcacccccactacactgtgagtcccataaaggcagggaacatgtcatattctttttgtgtctagctcagcagtggcacatagtgggtgttcagtaaatcaga

SEQ ID NO: 29305 - DNA, 103 bp, Homo sapiens
tagatcttacatttaagtctctaatctattttgtgttgatttatatatatatatatatatatatatatatggtaaaatgaaggggcttagtttcaatcttctg

SEQ ID NO: 29306 - DNA, 118 bp, Homo sapiens
ttattgcttaggattgtcttggctacgcgggctctttttttattacatatgaaatttaaagtagttttttctagtgctgtgaagaaagtcaatggtagcttgatgggaatagcattga

SEQ ID NO: 29307 - DNA, 76 bp, Homo sapiens
aggggaagcaaacaagtccttcttcacatggcagcaggagagaaaagtgagtgcccacagaagggggaagccccct

SEQ ID NO: 29308 - DNA, 113 bp, Homo sapiens
ctttatgtgactggagattctgagaaggaattagatagtagagttattgtagagtaactactatatatttaattgtttgaatataccatagtttgtccattcttctatgcaag

SEQ ID NO: 29309 - DNA, 72 bp, Homo sapiens
ctgggtgtggtggtgcgtgcctgtagtcccagctactcaggaggctgaggtaggaggatcacttgaacccag

SEQ ID NO: 29310 - DNA, 94 bp, Homo sapiens
cagcaagaattgagagagattctggtatacgtgtttcgtttgcattccagactcacacactgtcaccagggcctgttttttgatatgcttgttg

SEQ ID NO: 29311 - DNA, 69 bp, Homo sapiens
gcactgactggtcaactctgtgagctgccagcactgtgactcacagtgtgacataggtgtttttagtgt

SEQ ID NO: 29312 - DNA, 112 bp, Homo sapiens
aggtacttctctggttcttatttggttttatttggagattctattctttagttttctaagtgtaactctgtaaccaattatcccaagtagtcccaaaagccaattttttcct

SEQ ID NO: 29313 - DNA, 109 bp, Homo sapiens
attgtagattcacatgccgttgtaagaaatatatcagagagatctgagagagctggtgtagtactggctttaccagtttctccaagttgtaacatcttacaaatacagt

SEQ ID NO: 29314 - DNA, 87 bp, Homo sapiens
agctctgctcctcctgctgtgtggcctctgcaaagtcactctccctctctggctttagtgcccaccacagtacaagaaggcgtggct

SEQ ID NO: 29315 - DNA, 77 bp, Homo sapiens
atatatacacacacacaaatatatacttatatatatagtgtgtgtgtgtatatatatatatgtgtgtgtgtatatat

SEQ ID NO: 29316 - DNA, 118 bp, Homo sapiens
tcaggataagttggaaggagagatggtttctaggtgctcagaatgacttatttttcttttgataagctctgagaagcactttcattggttgacatatttcctgaccccagccccttcc

SEQ ID NO: 29317 - DNA, 91 bp, Homo sapiens
ataggatgtctaaacatgctagtatataggaagctgccatttaaaaatatatatatatggtatagtattctgtagtttggatatattctgt

SEQ ID NO: 29318 - DNA, 93 bp, Homo sapiens
actggattattttacttggctttacagagtttattcatgttattgtatatggcaggatttatttctttttttaaggctgaataatattccggt

SEQ ID NO: 29319 - DNA, 75 bp, Homo sapiens
cttccatggagttggccaaacttacctgaccagtatgtgaaaaatttggttgaaaagtttggtcaattttggagg

SEQ ID NO: 29320 - DNA, 112 bp, Homo sapiens
gctgccataaagcctctatagtctttgattttatttatagaacataggaagaatgtatttatcataatttttaagagtcataggattttttggatgctaaatgagtattggc

SEQ ID NO: 29321 - DNA, 93 bp, Homo sapiens
gagagagctagttttccacaaagagaaagatatttttatttttatttttttgttttttgttgttttttttttaagatggagtctcgctctgtc

SEQ ID NO: 29322 - DNA, 111 bp, Homo sapiens
gggaagttttggggccattttttaaaaatatatatatatatttattcctttttctttcctctccttccagcattcccattatgtatatattggtccacttgatggtgtccc

SEQ ID NO: 29323 - DNA, 112 bp, Homo sapiens
gtcaactgtccctattggactctatgattcttttaacagtaatgaccttatttgtctttcttttattattattattattattattattattatttgggggggggcggtggac

SEQ ID NO: 29324 - DNA, 108 bp, Homo sapiens
tcagtctttgccctcaaggctttcaaatgattggaagacatcccctctaaacacacacacacacacacacatcatggaggataatctgcatcactgaaagtctactga

SEQ ID NO: 29325 - DNA, 95 bp, Homo sapiens; identical to SEQ ID NO: 580

SEQ ID NO: 29326 - DNA, 93 bp, Homo sapiens; identical to SEQ ID NO: 69

SEQ ID NO: 29327 - DNA, 99 bp, Homo sapiens
agaggtttttcacatcctttgtaagttggattcctagatactttattctcttttaagcaattgtgaatgggagttcactcatgatttgactctgtctct

SEQ ID NO: 29328 - DNA, 110 bp, Homo sapiens
catacttaatagactacagtgcggtgtaaatataacttttttaaattttattattattatactttaagttttagggtacatgtgcacaatgtgcaggtttgttacatatg

SEQ ID NO: 29329 - DNA, 81 bp, Homo sapiens
ttgtgtgtacacatatatatgtgtgtgcatgtgtatatccatgtatacatacacaaaattcttatatttatgtatatacaa

SEQ ID NO: 29330 - DNA, 80 bp, Homo sapiens
acacacatatatatgtgtacacacaattttgtatatgtatatatggatatacacatgcacacacacatatatatgtgcgt

SEQ ID NO: 29331 - DNA, 85 bp, Homo sapiens
gggttaatttgtagctgtatgttgaccactgggatcagggaataatttctgactcctctttcagtcagtatacttcataagatct

SEQ ID NO: 29332 - DNA, 113 bp, Homo sapiens
gcaaaagggaagacagattccagggaagtgaggagtgacttgtccaaggtgtcacagacagacagacagacattcaagtctcaccttttggttttcttgtttaactctaatgc

SEQ ID NO: 29333 - DNA, 58 bp, Homo sapiens
tgagtagtagtccattgtgtgtgtatatatatatatatacagtttctttatctactca

SEQ ID NO: 29334 - DNA, 95 bp, Homo sapiens; identical to SEQ ID NO: 68

SEQ ID NO: 29335 - DNA, 93 bp, Homo sapiens; identical to SEQ ID NO: 69

SEQ ID NO: 29336 - DNA, 58 bp, Homo sapiens
tgaggcagagtctcgctctgtcacccaggctggagtgcagtggtgtgatctgggctca

SEQ ID NO: 29337 - DNA, 96 bp, Homo sapiens
gcatgtaatatctggctcatagtagaatttgaggagtggttgcttgataatgctagatttccaaatctgagaacctgcatggctggaggaacttgc

SEQ ID NO: 29338 - DNA, 89 bp, Homo sapiens
gtgactttaggcaagtcactctccctctcagaaccagttttcacatctgaactttgtggtactgtagggattatttgcactaaagacac

SEQ ID NO: 29339 - DNA, 118 bp, Homo sapiens
cttctccccgctcctcacccaaccctccccttcctgagtgagacagaacagagtgcggagaagctcagtggtatggaatgactgcatgtagagaaggggaggaggagagataagaggg

SEQ ID NO: 29340 - DNA, 57 bp, Homo sapiens
tgagacagaatctcactctgtcacccagctggggtgcagcagcatgatctggactca

SEQ ID NO: 29341 - DNA, 70 bp, Homo sapiens
agtctatatatatatatgctatatatatgctatatatatatagctatatatacatatgctatatatatgc

SEQ ID NO: 29342 - DNA, 80 bp, Homo sapiens
ctcttactcagtctctctccttcttggggtctgtggggaataatacaggatgtctgagttaaaggtggctggcagaaggg

SEQ ID NO: 29343 - DNA, 112 bp, Homo sapiens
accaacaatgtaaaagtgtttcattttcactgcatccataccaacatctattactttttgttttttttattatggccattcttgctggagtgaggtagtattacattgtggt

SEQ ID NO: 29344 - DNA, 101 bp, Homo sapiens
tctgtctttaacctctagcaaaatgtctctgggacctgggaggcattcaatagatattttttgaatagctgaaggcatgaacattatgttaggtgcacaga

SEQ ID NO: 29345 - DNA, 115 bp, Homo sapiens
ggcggccagctgacctttctccaggctgttcttgggttgccagagcagcggaggtgtcagctgagagtggtcacagcctggggaggagaaggcagggagagaggctggggcaccc

SEQ ID NO: 29346 - DNA, 69 bp, Homo sapiens
tatatatatatatatatacacccatatatataattcatgtatatatgtgtgtgtgtgtatatatatata

SEQ ID NO: 29347 - DNA, 62 bp, Homo sapiens
cagataaaacaacctacacattcctgggataaatctcacatagtaggttgttttataatatg

SEQ ID NO: 29348 - DNA, 114 bp, Homo sapiens
tgtgatttatgaagaaagaagttagaaagcacagaggctatttccgttgccttagagttaaggatagaaatcaagtatcttgcttccagacttttagacttatcctgggtcaca

SEQ ID NO: 29349 - DNA, 123 bp, Homo sapiens
tcatcccctgtcattctctacttagggaggatagtgatagatgcaggaattagaaatataataagttttttgaatttttaattgcttcttttttatagagaaactgactatggaaggtgacag

SEQ ID NO: 29350 - DNA, 88 bp, Homo sapiens
gtttccacatctgacactgtagctctctctaatactcttatttcgtaggcatgttgtgaggctcaagtaaggtaccagaagtgggagc

SEQ ID NO: 29351 - DNA, 58 bp, Homo sapiens; identical to SEQ ID NO: 1409

SEQ ID NO: 29352 - DNA, 108 bp, Homo sapiens
gcattcattggaaataaggtatacatataatttgtatatatttttacatgtggaattatcatatagaagttaaatatatgcattatttgtgtgtgtgtctctgagtgt

SEQ ID NO: 29353 - DNA, 104 bp, Homo sapiens
tggcgtggtttggtttgctttgttgttttattttgtttttgttttatttttgtggccctggtcactgaaagacttagacaagagagttacctctaaccaatcta

SEQ ID NO: 29354 - DNA, 96 bp, Homo sapiens
tggaaggaggcacaaggaaaccatatgaggtgctggaaatattctatgattttatctgtgtagattcatatggaatcttgttacatgtccttatca

SEQ ID NO: 29355 - DNA, 71 bp, Homo sapiens
gtatgtatgtatgtatgtatgtatgtacgtacgtacgtatgtatgtatgtatgtatgtatgtatgtatgta

SEQ ID NO: 29356 - DNA, 95 bp, Homo sapiens; identical to SEQ ID NO: 68

SEQ ID NO: 29357 - DNA, 93 bp, Homo sapiens; identical to SEQ ID NO: 69

SEQ ID NO: 29358 - DNA, 60 bp, Homo sapiens
ggtttaggtggagactgggcatgctggttggtcggtcggtctgcctgtctctctctcact

SEQ ID NO: 29359 - DNA, 84 bp, Homo sapiens
ccctgctggtctctgagtctcactttttcaatctctaagtagagatttaagaggagtgctcagaagcaactagatcagcactgg

SEQ ID NO: 29360 - DNA, 83 bp, Homo sapiens
aagtcagggatctagagttaggaagaagcttgtcaagtttagtcaaactgagagaaacttcaaggccctcttggtcaaggctt

SEQ ID NO: 29361 - DNA, 77 bp, Homo sapiens
tcaattgtttttgagcccagaggcatggacaagagggtgtatgtctgtatgtctgtgtgtatgtgctggaggagtga

SEQ ID NO: 29362 - DNA, 95 bp, Homo sapiens
ggcaggggctggcagatagaaaatgccaaaagaatggtagtctcacccactctgtgatcctggcattgttccacattttataatctgagactggc

SEQ ID NO: 29363 - DNA, 95 bp, Homo sapiens
ttattgggtggaccacatactctagaaacagttaaaaattattttattttttaacactgtatggtttcctgagtttgagttatggttcccagtag

SEQ ID NO: 29364 - DNA, 87 bp, Homo sapiens
catagtacctactatacagaaagagtctcataaatggtagttatttaattttctacttctgatatcttctttatggcagaaactgtg

SEQ ID NO: 29365 - DNA, 93 bp, Homo sapiens
ggaaatggtgccagcatacacttgaaaactggctttgtttgtgtgaccagagacagagcttactgtcttcatttataaaatggagctaattct

SEQ ID NO: 29366 - DNA, 84 bp, Homo sapiens
ggtggtgacagagagagagagagagaattgacttcagggccccacagctgagttatttgaatctgtctctcggagtctgccatt

SEQ ID NO: 29367 - DNA, 83 bp, Homo sapiens
gtggcctatgcatggcattactgtagtgttatttgaggattgcaagtaaagatgaatgtatgctgaaaatgcttttgggtgat

SEQ ID NO: 29368 - DNA, 110 bp, Homo sapiens
gagatatgtataggtagatacagatatctatataggtatagatatagacagatcagtgtctgcattgatatttatatctatagatatcggtatttatagatggctatctc

SEQ ID NO: 29369 - DNA, 92 bp, Homo sapiens
ctttgttctttttacttaggattgctttggctctatgggctcttttttggttccatatgaaatttaaagtagttttgtctaattctgtggag

SEQ ID NO: 29370 - DNA, 93 bp, Homo sapiens
cggaatttctgtgactgcatcttctcagttccttcattctatgtatataattaatgggggcccagtgagatgtttgtgctgatacatcatctg

SEQ ID NO: 29371 - DNA, 85 bp, Homo sapiens
ggaaataattcttacaaattatgtgtgtatatatatatacatgtatatatgtacatatacataccttgactgaaattttaaatcc

SEQ ID NO: 29372 - DNA, 65 bp, Homo sapiens
gcttcagggtctctgggacactgcctgtggtctgaaccgcttgggtggtccatggaacgttttgc

SEQ ID NO: 29373 - DNA, 63 bp, Homo sapiens
atatatagtgtgtgtatgtatatacactcatatcagaatatatatatatatacacacatatat

SEQ ID NO: 29374 - DNA, 80 bp, Homo sapiens
tatttatatgtatatacaatgtatacatgtgtatatataaacatacgtacatacaatgcatacatgtatatatataaatg

SEQ ID NO: 29375 - DNA, 58 bp, Homo sapiens
tcttgtgaaagaaaacccctgtgttctcatctctcacagtggttttcttttaaaaaga

SEQ ID NO: 29376 - DNA, 90 bp, Homo sapiens
ggctagggatagtggctcatgcctgtaatctcagcactttggaaagccaagccaggtggactgcttgagcccagaagttctagaccagcc

SEQ ID NO: 29377 - DNA, 180 bp, Homo sapiens
acagataaatatatatatatatatatgtgtatgtctgtgtatatgtatatgtgtgtgtatatatgtgtgtatatatacacacacatatacatatatatgtatatatgtatatgtgtgtatatatgtatatatatacatatatacacacacatatacatatacacacatatatatgtatat

SEQ ID NO: 29378 - DNA, 88 bp, Homo sapiens
cgtaccttttaagtctttcactgtatatttatttacatatatatgtgtatgtatatacatgtacattaatataatttggagggtttgc

SEQ ID NO: 29379 - DNA, 70 bp, Homo sapiens
tttttttgagacagagtctcactctgtcacccaggctggagtgcagtggtgcgatctcggctcactgaaa

SEQ ID NO: 29380 - DNA, 58 bp, Homo sapiens; identical to SEQ ID NO: 637

SEQ ID NO: 29381 - DNA, 105 bp, Homo sapiens
ggatgtttttacagactctgtgaggcattgttataccatggtagtgattatgttgtaattgctactggcttgtttagtattgttttgagtctttttgtaccttcc

SEQ ID NO: 29382 - DNA, 111 bp, Homo sapiens
tacgtgtaaattacaactcgatacagatgattttaaaaataaggcactaaatctacttttttttctttttcttattttttattatttactttaagttctagggtacatgtg

SEQ ID NO: 29383 - DNA, 113 bp, Homo sapiens
tccaacctcagtgtgtcctagttatatgacttttgggaaaacatttaatatttatgaatttcaattttcttaattgtaaaaatggaaagggtaataacactgactacatagga

SEQ ID NO: 29384 - DNA, 78 bp, Homo sapiens
gtgggtgtgtctgtgagtgtgtgtatgtaattacatatacttcctgtgtatataacatacacacacatatatatctat

SEQ ID NO: 29385 - DNA, 111 bp, Homo sapiens
ttaaaaataaatatatttaatagagttatgtttcttcatcttttagccaaatatgtatatatatttggctaaaagatgaagaaacataactctattaaataagctttttga

SEQ ID NO: 29386 - DNA, 112 bp, Homo sapiens
gcatatgtataatatacaatatattatgtactatattatataacatgtataataattaaattatatataatatacattatatattatattgtgtgtagtatacaatgcatat

SEQ ID NO: 29387 - DNA, 115 bp, Homo sapiens
tgttgtcagtgagcagagtctctgacctacatttgaagtcttttttttttttttttttttttttgtaagaaagaaggtaaagttcactctgggcagaaagatgttcattgacaca

SEQ ID NO: 29388 - DNA, 98 bp, Homo sapiens
ttcctggcttatcatataacttcttggttcaattttttttgttcaaatctctgaaccaaaaggaactacctctggaaatgatgaagaagcaacaggaa

SEQ ID NO: 29389 - DNA, 75 bp, Homo sapiens
cctgcattccctgggcctcttgttccccttcctctcacagatagggtggcagagagcacactgggagaagtatgg

SEQ ID NO: 29390 - DNA, 80 bp, Homo sapiens
gctgtggtagttcttgaagcaaaagttcatgatatgtgtctccacacacttctctgtctgtctgagtgggagctacaagc

SEQ ID NO: 29391 - DNA, 58 bp, Homo sapiens; identical to SEQ ID NO: 20294

SEQ ID NO: 29392 - DNA, 95 bp, Homo sapiens
ccggtctctaagaaataccaaacttctctctgtctctctttcagtctccaaagtttggaacttcttagagactgggagagacagagacggtgggg

SEQ ID NO: 29393 - DNA, 88 bp, Homo sapiens
agctgagaccagataggattctattattattattaatattattattattattatttttgagatggaatctcactctgtcacccaggct

SEQ ID NO: 29394 - DNA, 100 bp, Homo sapiens
gttaaagtgaccataactaccattcctatcaagatgtttatctttatataaagactgccttctctgatgggcaggagggtgctatgcaagttatattaac

SEQ ID NO: 29395 - DNA, 84 bp, Homo sapiens
tagttttcagatagtaaggaaatgtgagctttaattaatttgtatttataaatatctacatttctttggtgtctgtatatgctg

SEQ ID NO: 29396 - DNA, 99 bp, Homo sapiens
aagaaatttatattcagacagaaaagtgagtttctcagtgtctcccactcatctagtgagtagcagaattgggccttaatctggattcccaagtttctt

SEQ ID NO: 29397 - DNA, 85 bp, Homo sapiens
ccttatttttgcttaaaaatgtttatatgtctatatgcataaatgctagatttatatttatataagcataagtaaatgtataagg

SEQ ID NO: 29398 - DNA, 68 bp, Homo sapiens
gctggtcacagtggagagacagcagtgatagattacctcttacggttgcgcttttccctgtgtaccgc

SEQ ID NO: 29399 - DNA, 77 bp, Homo sapiens
gtttattgttcagagaaagtcagcaaggtacagcttccgtcgctgagcacttgtgacagcctctctgcgactctagc

SEQ ID NO: 29400 - DNA, 84 bp, Homo sapiens
gagtgtttaagcagatgctggatgtgcctgggccggcaatcacaggttcagtgttgagattgagcactctgcctcttcccactc

SEQ ID NO: 29401 - DNA, 58 bp, Homo sapiens
cgtgcgtgtgtgtgtacatgtgtatattaatatatatatatatatacatatatgtatg

SEQ ID NO: 29402 - DNA, 80 bp, Homo sapiens
gtgggtccgtttgtgtctgcgcgtctctctgtgagtgtttgacactgtttgtttctctcggtgtgtaggcgagagcccac

SEQ ID NO: 29403 - DNA, 85 bp, Homo sapiens
gaattgtttgtagcctttatatttaattatatgatccacctagagtttaatttttgtggctcgtgtaaggtaaaggttgagattc

SEQ ID NO: 29404 - DNA, 106 bp, Homo sapiens
gtgctaggtccattgtttatctttctatatctgggtttcccattttcttagtttatattataagttgaaacccatgtatttaagactataaggtacaatttagtcc

SEQ ID NO: 29405 - DNA, 86 bp, Homo sapiens
ggctaatttttgtattttttctagagacagggttttgtcatgttgcccaggctagaaatattatttttaatacatggttatgagcc

SEQ ID NO: 29406 - DNA, 62 bp, Homo sapiens
ggttttggagtaggcaggtctttgccagttacacgctccagagctgtctgtctctgagagcc

SEQ ID NO: 29407 - DNA, 115 bp, Homo sapiens
tagcattgtcttggctatacaggctcttttttggttccatatgaaatttaaagtagttttttctaactctgggaggaaaatcaatggtagcttgatgggaatagctttgattcta

SEQ ID NO: 29408 - DNA, 130 bp, Homo sapiens
cattgaactcaggctattccagcccctttagaccttcttggggatgtctgcagtgcaatgcatacaagagtgtacaaaaccgtagcagataaagatgctgcttccaaattcttccccctgccttgcattg

SEQ ID NO: 29409 - DNA, 58 bp, Homo sapiens; identical to SEQ ID NO: 902

SEQ ID NO: 29410 - DNA, 65 bp, Homo sapiens
atagtaagtgcatgaggcttaatgctgaatttaaatttaaactcagtgtttgtctctgtggctgt

SEQ ID NO: 29411 - DNA, 97 bp, Homo sapiens
agctagagaaactgaggcaagaaatttacaataggcctgtctttcaaattttctagtacagaagaaagggaatttcttggatctgtgattctttact

SEQ ID NO: 29412 - DNA, 119 bp, Homo sapiens
tgtatatgataggccatgccaggactactccaacgactaactctaaaaaaatatgtatttttcttagggtcaccatcttggaggtttgaaataggttcaaggtctttccaatttttaca

SEQ ID NO: 29413 - DNA, 130 bp, Homo sapiens
gtgtatgtatgtatgtatgtgtgtatatatatatatacacacacatatatacatatatgtgtgtgtgtatgtatgtgtgtgtgtatatatatatgtatacgtatatatacacacacacatacatacacac

SEQ ID NO: 29414 - DNA, 109 bp, Homo sapiens
gactagaccagaatttcaaggacttgcagtcttccaggtgccaagttaacagatttttgtttttaaactatagggatttaggacttaatccacaggaaatgggtttggc

SEQ ID NO: 29415 - DNA, 95 bp, Homo sapiens; identical to SEQ ID NO: 68

SEQ ID NO: 29416 - DNA, 93 bp, Homo sapiens; identical to SEQ ID NO: 69

SEQ ID NO: 29417 - DNA, 72 bp, Homo sapiens
cttgggccggtccagcaggtgtctctccgtctctctggggccttggcactggctggattgctcttgccccag

SEQ ID NO: 29418 - DNA, 87 bp, Homo sapiens
agtggggaagaggcttcagtctctgactgcctctaaggtactggggtagttttggtgttgggatgctgtggtcagcctgttcttgct

SEQ ID NO: 29419 - DNA, 74 bp, Homo sapiens
gaatctaaagacaacatttctgcacacacaccagactatggaagccagtgtgtggaaatgcttctgctagattc

SEQ ID NO: 29420 - DNA, 58 bp, Homo sapiens; identical to SEQ ID NO: 2051

SEQ ID NO: 29421 - DNA, 85 bp, Homo sapiens
tccagacagaggagccggagggagcagagagatggaaggggcttattatcctccatctccttgcaccaggcatcactcagatggg

SEQ ID NO: 29422 - DNA, 107 bp, Homo sapiens
ccgagctggaggcagagctgggatcagcactcgtgtcttctcagcctgtgtctctccatctcagctgcatcgagaaccctggctgttctcagctctggctgcgttgg

SEQ ID NO: 29423 - DNA, 95 bp, Homo sapiens
acaaaggagccctgggcctggtcactctctgtctgtggcccccgaccccaccattgttttggctaaagaagagggcgaggccagggcgaccttgt

SEQ ID NO: 29424 - DNA, 105 bp, Homo sapiens
tctggcagatggccctgtggacttgctggtgtgctcccaggggtgagagagaactgagtgctcagggacatgcttaggacgtgcaaagggttttcctctgagaga

SEQ ID NO: 29425 - DNA, 95 bp, Homo sapiens; identical to SEQ ID NO: 68

SEQ ID NO: 29426 - DNA, 93 bp, Homo sapiens; identical to SEQ ID NO: 69

SEQ ID NO: 29427 - DNA, 78 bp, Homo sapiens
gcagagaactaaggcaaaggattccaggagctatctttgttcatgtggtgagctcactgatcaaactgtcttctttgt

SEQ ID NO: 29428 - DNA, 72 bp, Homo sapiens
ggtgacagagcgagactgtctcaaaaaaaaaaaaaaaagtttttttttgacagagggtctcactctgtcacc

SEQ ID NO: 29429 - DNA, 93 bp, Homo sapiens
gcagctcatgcaggtaatggttgttttctgtctcacactcttacttctggacctggagttgcaatagatatctctcttactcttcattgctgc

SEQ ID NO: 29430 - DNA, 114 bp, Homo sapiens
agtagctgggactgcaggtgtgtgcccccacacctggctaattttttgtattttaagtagagacagagttttaccatgttgcccaggcttcacactgccagttttcaaactgct

SEQ ID NO: 29431 - DNA, 58 bp, Homo sapiens
tgagacagggtcacactctgtcacccagcctggagtgcagtggcgtgattgtggctca

SEQ ID NO: 29432 - DNA, 85 bp, Homo sapiens
ggtgaatcacagaacttgactgtgagggctcatgtgaatttcatctcttttttttttttttgagacacagtctcgctctgtcgcc

SEQ ID NO: 29433 - DNA, 70 bp, Homo sapiens
cttgtgtgtagagcagtttctttctttttttttttttttttgagatggagttttgctcttgtcacccagg

SEQ ID NO: 29434 - DNA, 94 bp, Homo sapiens
tggataaatgttatttattgttagaaatgagagagagtttggcataaattctattcttatttttcatttttatagaggtaggcattgctgttca

SEQ ID NO: 29435 - DNA, 135 bp, Homo sapiens
tgtgtgtgtgtgtgtatatatatgtgtgtatacacacatatatacatacatacacacacacacacacacacacacacccatagtttttttgaaacagagtctcactctgtcacccaggctggagtgcagtggtgt

SEQ ID NO: 29436 - DNA, 116 bp, Homo sapiens
agggtgatatatatatatatatatatatatatatatatatatatatatgtatgtatattctgtatgtgtatatatatatgtatattctgtatgtgtatatatatgtgtgtgtgtgc

SEQ ID NO: 29437 - DNA, 71 bp, Homo sapiens
tcagtctcactctcactgcgcccccacaacagtaccaagtatatttccaggcagctggtgagcagagctga

SEQ ID NO: 29438 - DNA, 98 bp, Homo sapiens
ggctaacccaggtttgtagactggcctgagaccctaactcctgtacatggtatttttgtttttttggtttttgttttttgctgttaccggggctggcc

SEQ ID NO: 29439 - DNA, 116 bp, Homo sapiens
agaatttttaaggaaaggtgggcttgacagttttgttggtttttttttgcattttttttttaaatgcagactcagaaatctcaagaatgaggaagtaacaatgtgtttctatttct

SEQ ID NO: 29440 - DNA, 108 bp, Homo sapiens
ggaataaatgattatcttggatttagcaaagatttatttctttaaaaagaattttttttttttagagacaaagtttcactatgctgtttcactataatacactgtttc

SEQ ID NO: 29441 - DNA, 106 bp, Homo sapiens
gtagactttttcttccggtcattatttcctaaagcatacaacctaacaactatttatgtagttgtgttaggtattataagtaacctagagatgatttaaagtatac

SEQ ID NO: 29442 - DNA, 76 bp, Homo sapiens
ggtcggggcttcagtgagctgtgatcttttttttttttttttttttttttgagacagcctcactgtcacccaggct

SEQ ID NO: 29443 - DNA, 75 bp, Homo sapiens
gtgggggaaacagaccacagactcaggattttttttttttttttttgagatggagtctcactctgtcaccccggc

SEQ ID NO: 29444 - DNA, 110 bp, Homo sapiens
cagacggggacaatgcagtttagagaggtgatgtgacttgaccaaggccacagttgtgagtgaccaccagggcaggtctggaccccagagagtgcacagccttggtgctg

SEQ ID NO: 29445 - DNA, 87 bp, Homo sapiens
ggatgcctaaggatgcggagcaagttaagggcaggatccagctcatgccactcattaattcactcactctcgctcacttattcattc

SEQ ID NO: 29446 - DNA, 87 bp, Homo sapiens
ctgatcctcagcccctgaggtctgtgttttatattcttaggagaagccagatgagagtcaacaggctccaggagggaagcgggttgg

SEQ ID NO: 29447 - DNA, 107 bp, Homo sapiens
ccacaggttcctttcccttgggtgaggtgcagagaagagagactccacggaaaccgctgtattgggctgtccctcccacagaacgcttgagatgagagagcctgagg

SEQ ID NO: 29448 - DNA, 72 bp, Homo sapiens
caggcctcaagaggtaggtcacttgttcctggtcccacagccagcctgcctgcctgcctgcctgcctgcctg

SEQ ID NO: 29449 - DNA, 118 bp, Homo sapiens
aggacaggaaccttgtgagtccagttcacagccatatgcccagtgcatagaatagcactcaataaatgtgtgatgaacgaggtgcatgaagggagctgggctcaaagcccctgttctt

SEQ ID NO: 29450 - DNA, 155 bp, Homo sapiens
catatatatacatatatacccgtatatatatataatacgtatatgtatgtatatatataatatatatgtatatgtatgtatatatatgtgtatatatgggtatatatacgtatatatgtgtgtttatgtatatatatgtgtgtgtatatatacat

SEQ ID NO: 29451 - DNA, 59 bp, Homo sapiens
tctgaaacggcctcaggggaggttgccagctggtctccacagtctctgggtccctcaga

SEQ ID NO: 29452 - DNA, 85 bp, Homo sapiens
gcttccctcctgcaatactaactgagagagagagagacagacatggattattaaatctgtctcagagaggcagggctgggagagc

SEQ ID NO: 29453 - DNA, 127 bp, Homo sapiens
gctcagccctgtgatgtggggggaagcacaggctcccaggggtgagggcagaaggccacgtgtctccctgtctcacagcccagggcgttctgtgtgtatgggggcgtcacaactgggtcttggtgac

SEQ ID NO: 29454 - DNA, 119 bp, Homo sapiens
gggtggggctggctaaccctcgaatagtacaattttgactgtgtctacctgtgtgacaatctgtgtgtctgggtgagagtgtggggtgaggtagagctgtgagggaggctcatctgtgc

SEQ ID NO: 29455 - DNA, 82 bp, Homo sapiens
gttggtgcctccatctctgtctctggctctgcctatgggtagggcatccctaccttggtgtcaggcagggagtacaatcaac

SEQ ID NO: 29456 - DNA, 100 bp, Homo sapiens
tatatcatatacacacacacacacatatgtgtatatatatgtgtgtatatatatcatgtatatatatgtgtgtgtatatattgtgtatatatatgatgtg

SEQ ID NO: 29457 - DNA, 72 bp, Homo sapiens
atggtgttccattgtatatatgtatatgtatatatgtgtgtgtgtgtgtgtatatatatatacacacaccat

SEQ ID NO: 29458 - DNA, 113 bp, Homo sapiens
atatagtttatatattttttatattttttaatatatatttatatataaaacctatatataggttttatattatagtgatattatctcatatatatgagatatataagatatat

SEQ ID NO: 29459 - DNA, 98 bp, Homo sapiens
agattatatatatatatgtatatatgtatatatgtatatatatgtgtgtgtatatatatatctgtgtatatatgtatatgtatgtgtgtatatatata

SEQ ID NO: 29460 - DNA, 109 bp, Homo sapiens
tctttattatcaagtctgaattatgaggtccaacgctaagcactgcaagaattcagagagaggagagaaatcagtgtgctgacatcattgagaaaggcatgaaggaaga

SEQ ID NO: 29461 - DNA, 96 bp, Homo sapiens
ctggcctgggaaacagagtgagaccctgtctccaataaaaaaaaaaaagaaagaaagaaagaagaaagaggtcttaattatatggactcttgtcag

SEQ ID NO: 29462 - DNA, 58 bp, Homo sapiens; identical to SEQ ID NO: 3270

SEQ ID NO: 29463 - DNA, 59 bp, Homo sapiens
atgtgtgtgcatgtgctcgcatgtgtgtactctatacatgtgtgtgcatgtgtgtgtgt

SEQ ID NO: 29464 - DNA, 126 bp, Homo sapiens
tcaggctgagtgtcccgttcctgggcaggcatttggctgccctgaccaggctctctgagtggctgggtgggtgtttaaaactatcctcttggtgtgttggtttccagccagttctctttagaggtc

SEQ ID NO: 29465 - DNA, 95 bp, Homo sapiens; identical to SEQ ID NO: 68

SEQ ID NO: 29466 - DNA, 93 bp, Homo sapiens; identical to SEQ ID NO: 69

SEQ ID NO: 29467 - DNA, 119 bp, Homo sapiens
tgtgggttaaaatccttgcctctgattgcttgtgtgactaaactctgtactaaatacagaacctctctgagactcagtttcttcagctgtagcaatgggctagtgctatctatctcaca

SEQ ID NO: 29468 - DNA, 93 bp, Homo sapiens
tgctgtaaaatggacttttacagctgtcaaagtcaattgactttttaaatttttaaattgacgttaacagctgtaaaagtccattttacagca

SEQ ID NO: 29469 - DNA, 139 bp, Homo sapiens
atatatatgaccaattgtgtgtgtgtatatatatatggtatatacatatatatatatacaccaattgtgtatatatatatatggtatatatatatacacaccaattgtgtgtgtgtatatatatgtgtatgtgtgtgta

SEQ ID NO: 29470 - DNA, 70 bp, Homo sapiens
agactgagttaggatctcttgccccacagaggctggggagctgagagaggtgagagagatggcgtggtgt

SEQ ID NO: 29471 - DNA, 97 bp, Homo sapiens
tcaatgaattacaatggttatatatatatatatatgtgtatatatatatgtatatatatatacacatatatatatacatgtaaaccataatttatga

SEQ ID NO: 29472 - DNA, 85 bp, Homo sapiens
cagataaatcatctcatctctctgggtgtcaatttctccatctttaaaaaggggcaaatgatacccatttgatacagtgaatctg

SEQ ID NO: 29473 - DNA, 95 bp, Homo sapiens; identical to SEQ ID NO: 68

SEQ ID NO: 29474 - DNA, 93 bp, Homo sapiens; identical to SEQ ID NO: 69

SEQ ID NO: 29475 - DNA, 117 bp, Homo sapiens
cagtttaattgtggctatcagtgtgggaaactgagtcaaactaatttagagttgagtagtctggactttgttgtggctttagtgagatacagttcactactgacttcaaatgatatg

SEQ ID NO: 29476 - DNA, 60 bp, Homo sapiens
tatgtatatatgtgtgtgtgtgtgtatatatatatacacacacacacacacatatacata

SEQ ID NO: 29477 - DNA, 58 bp, Homo sapiens
tgagaccaagtctcgctctgtcaccccggctggagtgcagtggtgcaatcttggctca

SEQ ID NO: 29478 - DNA, 107 bp, Homo sapiens
atggattctctttaatatttaactgtatttaatatttaactgtatttaatatttaactgtatttaatttaaatacagttaaactgtatttctgatgttgcaagccat

SEQ ID NO: 29479 - DNA, 80 bp, Homo sapiens
cagaacttaaagtatgtgtgtatatatatatgtgtgtgtgtgtatacatatatatatatatatatataaagaaactgagt

SEQ ID NO: 29480 - DNA, 63 bp, Homo sapiens
cagagtgaacaggcaacctacagaatgggagaatttttttttttgtgatggtgtctcgctctg

SEQ ID NO: 29481 - DNA, 73 bp, Homo sapiens
ctgagcctcacaatctctctgagatgtagattttacttccccagttgtacagatgagaaaaactgaggctggg

SEQ ID NO: 29482 - DNA, 58 bp, Homo sapiens; identical to SEQ ID NO: 1409

SEQ ID NO: 29483 - DNA, 115 bp, Homo sapiens
atctgtgtctgtgtgggtggctggacctatgagagtgttttttttaacaaggaatgtttctttttttaaaaaattttactttaagttctgggatatatgtgcagaatgtgcaggt

SEQ ID NO: 29484 - DNA, 110 bp, Homo sapiens
cagtcccagttgagaagtcaatttatttgagaacacatggccatatgactgaagagaaagtgctcatccacacaaggcatgttctgcggatgtcacaccctcctggattg

SEQ ID NO: 29485 - DNA, 58 bp, Homo sapiens
tgaaacagagtctcgctctgtctcccaggctggagtgcagtggcgtgatcttggctca

SEQ ID NO: 29486 - DNA, 120 bp, Homo sapiens
ccactaatggactatattttttcggttgagaacttgtcgaacagaattttcttttttttttttaaccttcagtagggaaaaatgtttgtttaaagaatgagtaatggccaggcacggtgg

SEQ ID NO: 29487 - DNA, 149 bp, Homo sapiens
gtacatatatgtatatataatgtgtatgtttatatgtgtatatatacttatatgtatctatatatgtgtatatatatttatatgtatgtatatatgtatatatgtgcatatatgtatatatgtgtgtatatatatatatacacagtagg

SEQ ID NO: 29488 - DNA, 113 bp, Homo sapiens
tttgggagccagatctgaacaaataagtactcctatgtgtatatatatgtatgtatgtatcagtcacatatgtgttaattgctcaaggggccgttgctgagaaggctttagaa

SEQ ID NO: 29489 - DNA, 117 bp, Homo sapiens
gagccaccacgcccggcctctaaccttttattttcaatctatttgtgtctttggatgtcaagtgattctcttgtagacagcatttagttggagcatgtggattgtgtgtgtgtgttt

SEQ ID NO: 29490 - DNA, 58 bp, Homo sapiens
tgagacggagtctcgctctgtcacccacgctggcgtacagtggcgcagtctcggctca

SEQ ID NO: 29491 - DNA, 81 bp, Homo sapiens
tgtgaagctcacaggaaatgttctggaaattcatagaggagaattcggttttcattgtggggaatgttgtggggcatcata

SEQ ID NO: 29492 - DNA, 73 bp, Homo sapiens
gatagggatagagatacagattagacagagagcaggtgggcccctgccctgtctgtctgtctttctccactgc

SEQ ID NO: 29493 - DNA, 58 bp, Homo sapiens
tgagatagagtctcactctgtcgctcaggctggagtgcagtggtgcaatcttggctca

SEQ ID NO: 29494 - DNA, 82 bp, Homo sapiens
ttgattgagggggagaagtctgagatgctagatgtcatataatgcatggatagcattgcatgatttttttttttttttttga

SEQ ID NO: 29495 - DNA, 87 bp, Homo sapiens
ggaccccataggcaggctccagatgagtgggaggggatcagacaggcccccactctcccagcctctgtgcctttgctgtgctattcc

SEQ ID NO: 29496 - DNA, 72 bp, Homo sapiens
tttgttttgagacagggtctcactctgtcactcaggctggagtgcagtggtgtgatcttggctcatggcaaa

SEQ ID NO: 29497 - DNA, 58 bp, Homo sapiens
tgagacagggtctcactctgtcactcaggctggagtgcagtggtgtgatcttggctca

SEQ ID NO: 29498 - DNA, 103 bp, Homo sapiens
tgagtaggagtttgaaaggaagggtaagggtgaatgaggcattccaagcagacagaacagtatgagcaaagccccagagtcacgactttccaggaaatgctcg

SEQ ID NO: 29499 - DNA, 75 bp, Homo sapiens
cctgtcgttttcagcctgtcagtcagtcagtcctgcaagtgggggcatggtcagatgatgggcgagtcggagggg

SEQ ID NO: 29500 - DNA, 115 bp, Homo sapiens
ccatcacctaggtatgaagcccagcaggcatcagctctttttattattatttgtttttttatttttaatttttttttttttttgagctggagtctcgctctgtctcccaggctgg

SEQ ID NO: 29501 - DNA, 116 bp, Homo sapiens
tattagttctgtccctttagagaaccctgactataatacaggctccatatctatatatctatatctacatatatatctcctgttagttctgtccctctagagaaccctgactaata

SEQ ID NO: 29502 - DNA, 109 bp, Homo sapiens
cttccagttgcatccatgccactaggcttctggctcctgctttggggaggtctgtgacgctctgtcagtgctggctgcagaatagccagtgggaccgtgcagcaggaag

SEQ ID NO: 29503 - DNA, 109 bp, Homo sapiens
ggatcacagatgctgggctgaaataggacagctggctccgcctgcttcttcagtccctgtcccagcctgcctgtatcaccctcgtcccccagcactgctgtacatgtcc

SEQ ID NO: 29504 - DNA, 116 bp, Homo sapiens
aagacatgaatgtttatgtgtaaggaaaacatcagtattaagaaaatgggtttatttaattgatttattaaattggtttattgcagtttttatttacagagaacattgcttgtttt

SEQ ID NO: 29505 - DNA, 109 bp, Homo sapiens
gctttggcttccttttgtctgggtctggctttctatgtccccatatataatctgagtttttatatatctgtatagcactggctttctatcaaactgataatactaaagc

SEQ ID NO: 29506 - DNA, 94 bp, Homo sapiens
tgtacaagttgtttcgtatttttaatttataaaatgggattattaatgggtcccatcatagaggtttcataggaggaatgaaagaaatagtaca

SEQ ID NO: 29507 - DNA, 58 bp, Homo sapiens; identical to SEQ ID NO: 6639

SEQ ID NO: 29508 - DNA, 101 bp, Homo sapiens
gggggttgcttggctatttgcatttagaggaggcacttttttatttttgatttgcagagaaatagagaatgcttctatctgcgttggcttccctggccctt

SEQ ID NO: 29509 - DNA, 81 bp, Homo sapiens
tgttataaggcttcccaggtggtattctatgctttgtacttatatatacatattacctactacactgggaactttgtttca

SEQ ID NO: 29510 - DNA, 95 bp, Homo sapiens; identical to SEQ ID NO: 68

SEQ ID NO: 29511 - DNA, 93 bp, Homo sapiens; identical to SEQ ID NO: 69

SEQ ID NO: 29512 - DNA, 99 bp, Homo sapiens
ctcagacgctaaggtaagtcaatcactgtcactcattttgtgtgccttgatttgcgacataggagaaatactgggacaaaagctttagaattcactggg

SEQ ID NO: 29513 - DNA, 135 bp, Homo sapiens
gggatcaagctaagctctggcttagacgctggcagaggggattctccacatggtcagactagagtgcctgctccctggcagcaaagcccatggcagagcatcctaagagaggtggggagtcagcaggatggcggc

SEQ ID NO: 29514 - DNA, 99 bp, Homo sapiens
agtccatagaaacaagagtcattgggtttcagggtcaggtagaactttcttcccacctgggtcctctcctttgaccgtgtgacaagtggctggcccttc

SEQ ID NO: 29515 - DNA, 70 bp, Homo sapiens
tttttttgagacaaggtctcactctgtcacccaggctggggtgcagtggtacaatcttggctcactgaaa

SEQ ID NO: 29516 - DNA, 67 bp, Homo sapiens
ttgcatctgtatttgtttttgagacagggtcttgccctgtcacccaggctggagtgcagtggtgtaa

SEQ ID NO: 29517 - DNA, 58 bp, Homo sapiens
tgagatggagtctcactctgtcacccaggctggagtgcagtggggtggtctcagctca

SEQ ID NO: 29518 - DNA, 79 bp, Homo sapiens
ccaacaaaggtgttgggaggttgttggggaaccagtggacaaatgtctctctctgtcagccgtcctttagagaccgtgg

SEQ ID NO: 29519 - DNA, 79 bp, Homo sapiens
aggggacttgtcatttgtcagggaccatagaagtatacttactttaactgctcccagatgatggcacataaagttgcct

SEQ ID NO: 29520 - DNA, 78 bp, Homo sapiens
cttggattgacagagggactcacagtgtctctgccacaggaggagagatccactgtgcaagtcagggctggctccagg

SEQ ID NO: 29521 - DNA, 58 bp, Homo sapiens
tgagatggagtctctctctgtcacccaggctggagtgcagtagtgtgatctcagctca

SEQ ID NO: 29522 - DNA, 105 bp, Homo sapiens
ccaaaaatgggttttggaggcaggcatctggtttctttttctctttttctttctttcttttttttttttttttgagatggagtctctctctgtcgcccaggctgg

SEQ ID NO: 29523 - DNA, 86 bp, Homo sapiens
gggagcggggagtcagatgtggtatgaagacttctttgctgggcatcttagccaagaccctcagcctctctgagtctcagtctccc

SEQ ID NO: 29524 - DNA, 84 bp, Homo sapiens
ttccagagggtgaaatgacacatttcttctgggcggtttttttttcttttttgagacagtgtcactctgtcacctaggctggag

SEQ ID NO: 29525 - DNA, 135 bp, Homo sapiens
aagaggagctctttacagagaatgtaagatcacggttttgtactcgcctgggctttgtctctgtggctctcttagtttctttcagccattgttccgtggtcgtagctgtgcagggctggctttcttcctaatctg

SEQ ID NO: 29526 - DNA, 56 bp, Homo sapiens; identical to SEQ ID NO: 11815

SEQ ID NO: 29527 - DNA, 58 bp, Homo sapiens; identical to SEQ ID NO: 605

SEQ ID NO: 29528 - DNA, 118 bp, Homo sapiens
gcctctggccccaggtggggagtggcccttctgagcccctggcccccagtggggagtggtctctctgagtctctggccccaggtggtgagtggcccctctgagtctctggccccaggt

SEQ ID NO: 29529 - DNA, 58 bp, Homo sapiens
tgaggcggagtctcgctctgtcgctcaggctggagtgcagtggtgcgatcttggctca

SEQ ID NO: 29530 - DNA, 121 bp, Homo sapiens
ggtgcctatagtgtgccaggcattaggctagatttttttttttgagacggtgtctggctctgtcacccaggctggagtgcagtggtgcaatcttggctcactgcaagctccgcctcccggt

SEQ ID NO: 29531 - DNA, 58 bp, Homo sapiens; identical to SEQ ID NO: 285

SEQ ID NO: 29532 - DNA, 84 bp, Homo sapiens
gcccaggctggagtgcagtgatgcgagggttttttgtttttaagagacagactctcactcttgctctgtcacccaagctggagt

SEQ ID NO: 29533 - DNA, 80 bp, Homo sapiens
attcccttagagcaatgcaaaacagaattttgcctattctacgaataggcaaattttttttttttctcttgagatggagt

SEQ ID NO: 29534 - DNA, 90 bp, Homo sapiens
tgaagttagacatattagaagctttttagctgtgtggtttttttttttctctttttttaccagctggttgaggatcttggtgtagcttga

SEQ ID NO: 29535 - DNA, 133 bp, Homo sapiens
gtcccctgatctaggctcctgtgtgtcactacctgtgccccgatctaggctcctgtgtgtcactgtgtccctgatttaggcacctgtgtgtcactacctgtgtcccctgatctggatgcctatgtgtcactac

SEQ ID NO: 29536 - DNA, 60 bp, Homo sapiens
gatggtgagtgaggtttttgtttttgttttttttttgagacagagtctcactctgtcgtc

SEQ ID NO: 29537 - DNA, 58 bp, Homo sapiens; identical to SEQ ID NO: 1265

SEQ ID NO: 29538 - DNA, 73 bp, Homo sapiens
ttgtttttttgagatgcagtctcgctctgtcacccagcctggagtgcagtggcgcgatctcggctcactgcaa

SEQ ID NO: 29539 - DNA, 95 bp, Homo sapiens; identical to SEQ ID NO: 580

SEQ ID NO: 29540 - DNA, 93 bp, Homo sapiens; identical to SEQ ID NO: 69

SEQ ID NO: 29541 - DNA, 87 bp, Homo sapiens
aagagcgaagttggtggaagaagacagggagcagacacatgtgccctttgtgttttattctgattagttaattacccatttgctttt

SEQ ID NO: 29542 - DNA, 97 bp, Homo sapiens
atgctacatgcaatctctgtgtatactttttgtatatatgtatacatatttgtaaatatattggtatgcagtgatacagtatgtgtatattatgtac

SEQ ID NO: 29543 - DNA, 56 bp, Homo sapiens
atatatatatgtgtgtgtgtatatatgtgtatatatatgtatatatatgtgtgtgt

SEQ ID NO: 29544 - DNA, 90 bp, Homo sapiens
ctgagatgatctgttttcttacagtatcttacacttaaattatatttttgtgatttgattgtaatcagaagaattctatatctgtcttgg

SEQ ID NO: 29545 - DNA, 84 bp, Homo sapiens
ctccaacctgagtgacagagcgagactctatcttttttttttttttttttgatatggagtctcgctctgtcacccaggctggag

SEQ ID NO: 29546 - DNA, 74 bp, Homo sapiens
gcctgggtgacagagcgagactccatatcaaaaaaaaaaaaaaaaaagatagagtctcgctctgtcactcaggt

SEQ ID NO: 29547 - DNA, 117 bp, Homo sapiens
tgtttttttttgcttatgattgtcttagctatatgggctcttttttggttccatatgaaatttaaagtagttttttctaattctgtgtagaaagtcaatggtagcttgatggggata

SEQ ID NO: 29548 - DNA, 82 bp, Homo sapiens
gatgacatagtgagacaatattttaggtatattggagtaaatacttttttttttttttgagacagggtctggctctgtcatc

SEQ ID NO: 29549 - DNA, 106 bp, Homo sapiens
tcccccaaaggacacaagtacaggtaagaaaatgtagttttttgttttttttttttttttagacagggtctcactttctctcccaggctagagtgcagtggtggga

SEQ ID NO: 29550 - DNA, 88 bp, Homo sapiens
cagctccactgacactgggcttgtctctgactctctgtggcccagagaatgtgggtggcagtaagtgtccggcaggtctgagtcttgg

SEQ ID NO: 29551 - DNA, 58 bp, Homo sapiens; identical to SEQ ID NO: 11671

SEQ ID NO: 29552 - DNA, 72 bp, Homo sapiens
atatgtatatctacacacacacacacacacacacacacacgtgtgtgtgtgtgtgtctgagtatacccatgt

SEQ ID NO: 29553 - DNA, 106 bp, Homo sapiens
ccagcctgaccaacatggtgaaaccccgtttttactaaaaataaaaattaaaactttttatttattttattttttgagacggagtctcgctctgttgccaggctgg

SEQ ID NO: 29554 - DNA, 58 bp, Homo sapiens; identical to SEQ ID NO: 884

SEQ ID NO: 29555 - DNA, 56 bp, Homo sapiens; identical to SEQ ID NO: 885

SEQ ID NO: 29556 - DNA, 72 bp, Homo sapiens
attgtctgcccaagggcacccttggtccagtcctgtcctctgtggctctgtctgtgttctgggcttctcagt

SEQ ID NO: 29557 - DNA, 70 bp, Homo sapiens
ttctattgtggtgggaggtgccagaccatgaaagctgaatggggatactctttctcacacacacagagaa

SEQ ID NO: 29558 - DNA, 106 bp, Homo sapiens
gcgtggggagtagcaataagacttcaagatagagtggagcagagaagggtttatgtacttctcattgtcagtcacttgtactattttacttaattgtgtgccaggt

SEQ ID NO: 29559 - DNA, 141 bp, Homo sapiens
gaatctctataatatactgttaaaatgataaaaatgcagaacactaatgtttgttatcatttgtgtttttatttttattttttgagatggagtctcgctctgtggcccaggctggagtctcactctgtcacccaggatgga

SEQ ID NO: 29560 - DNA, 138 bp, Homo sapiens
tcaaatggcattactgcaagctgcatacagaacttgtttgctgaacagagaaaaatggtgacagaattcagtgggcacaaagatctctatgaacagtcttgctggtctctgaaaaatctgtgctgtttggtgccaagt

SEQ ID NO: 29561 - DNA, 95 bp, Homo sapiens; identical to SEQ ID NO: 68

SEQ ID NO: 29562 - DNA, 93 bp, Homo sapiens; identical to SEQ ID NO: 69

SEQ ID NO: 29563 - DNA, 94 bp, Homo sapiens
catgtttagaacatgttcctagttaccacaggcaggtttcatgatcattaatgaatacagatgggtgtgtaatctgggaacagtatccaaagtg

SEQ ID NO: 29564 - DNA, 76 bp, Homo sapiens
gaaaacagacacaagaaaggcaagtaacttgttgaaggccacacaggtagtaggtgttttttttgtttttgttttt

SEQ ID NO: 29565 - DNA, 108 bp, Homo sapiens
tcagtcagtgaggactgagtactgtcaatagtcatgtgagtgagcagagaggcaaaccctcccccaagtgactctcaagataactgcagcccactgtcacctgactga

SEQ ID NO: 29566 - DNA, 59 bp, Homo sapiens
ttgagacggagtctcactcactctgtcacccaggatggagtgcagtggcatgatctcag

SEQ ID NO: 29567 - DNA, 97 bp, Homo sapiens
tgctattagttatataatctattttattgttcatgttaaggaaaatgtaaatttaacaatagaactatgaagaattatagatacaatattgatagca

SEQ ID NO: 29568 - DNA, 119 bp, Homo sapiens
tcttaagaacttttattatactatgaaatcaattatttcttgggtgctcactgtgtattagtcattggggtgctgatacatgctccttaattaaaagcatttgtttagaagtttagaga

SEQ ID NO: 29569 - DNA, 60 bp, Homo sapiens
tatatgtgtatatatatgtgtgtgtatatgtgtgtatatatgtgtgtgtatatatatata

SEQ ID NO: 29570 - DNA, 69 bp, Homo sapiens
ctaggtcaggagagtgtgagctgagggcagaaagacctgggttcaaggtgtgacctcttgctgtcctag

SEQ ID NO: 29571 - DNA, 123 bp, Homo sapiens
aggcttcagactgacattctggctctgtgtgtatttggccaagtggcttcagtctccctgtctgtgaaatggagatgataattgcaccttccatgggaggccgctgtgagcatttcaagaggg

SEQ ID NO: 29572 - DNA, 91 bp, Homo sapiens
tatgtaaatcctttgtaaatgtatgctaattacttattattaattataatgtaaataagtaattaccgaataattttaaagtatttacatg

SEQ ID NO: 29573 - DNA, 81 bp, Homo sapiens
tccaaatctgggtagggtgagggttgactttttttttttttttttttttagatggaatctcactctgtctcccagtctgga

SEQ ID NO: 29574 - DNA, 107 bp, Homo sapiens
tcatgagtggattaatgccattattgtgggagtgggttagttatgatgggagttcagccccctctatctctctctgtctctcacataagcactttctcactatgtga

SEQ ID NO: 29575 - DNA, 72 bp, Homo sapiens
acacacacagatatacacgtatacatgttttaaaatataaattatatgtatatgtgtatatgtatacgtgtg

SEQ ID NO: 29576 - DNA, 113 bp, Homo sapiens
ctaattctatgccaataccatgttgttggattctagtggctttatagtatattttaatatctataaggcaaggcaagatatttccctttaaattttttttggccattcttaga

SEQ ID NO: 29577 - DNA, 108 bp, Homo sapiens
caggcagtgttgtctgccccgagaggctccctcggcaaggcaggatagtagtgtgtgtgtgtgtgtgtgtgtgtgtgcgtgcacacacaaacatgtatgtgcgcccac

SEQ ID NO: 29578 - DNA, 73 bp, Homo sapiens
gagtgtgagtgtgcaagagcatgtgcatgtgtgcacatgtgcacatgtgtatgcgaggccctgtaacagactc

SEQ ID NO: 29579 - DNA, 80 bp, Homo sapiens
tcagggtcttgaatactctcagatgatacagagctgatcataaggcttatgtggccagcttgggctcctctgttccctgg

SEQ ID NO: 29580 - DNA, 78 bp, Homo sapiens
ccatggacttcatctggagtaagatgacccagagcccagctcagggttctcagggtctatctctctgtgaagtccagg

SEQ ID NO: 29581 - DNA, 117 bp, Homo sapiens
tggtggtgcacgcctgtggtctcagctacttgggaggctgaggtaggaggatctcttgagcccggaaggttgaggctgcagtgagtcatgatcacaccactgcactccagcctgggc

SEQ ID NO: 29582 - DNA, 58 bp, Homo sapiens
tgagacagggtctccctctgtcactcaggctggagtgcagtggggcgatcttggctca

SEQ ID NO: 29583 - DNA, 85 bp, Homo sapiens
tggacccatagggggcacctcgtgggtgctcaggaattgctcattcatgcagtcacgcagcctcagtgcctccctgcatggccca

SEQ ID NO: 29584 - DNA, 58 bp, Homo sapiens
gggcatggtgttggggtgaggagggctccagacactcactcagagacatattctgccc

SEQ ID NO: 29585 - DNA, 107 bp, Homo sapiens
ggaccctgggaagggtgggggggtgtgatctgattggcattttattttattattattattttttttttttgagatggagtctcactctgtcgcccaggctggagtgc

SEQ ID NO: 29586 - DNA, 66 bp, Homo sapiens
cctgtctgtctgtctgtccctttataggtatgccccgcactggggaccaggcagattctaggctgg

SEQ ID NO: 29587 - DNA, 142 bp, Homo sapiens
ccagtctggatggaaagagggcagagatctccccaactttcttctttttttattttttttttttgagagggagtctcactctgtcacccaggctggagtgcagtggtgcaatctcagctcaccacaacctccacctcccaga

SEQ ID NO: 29588 - DNA, 58 bp, Homo sapiens
tgagacagggtctcactctgtcacccaggctggagtgtagtggtgtgatcacgtctca

SEQ ID NO: 29589 - DNA, 72 bp, Homo sapiens
gactcgggtgagctcaggcatggctttttttttttttttttttgagtgggagtctcgctctgtcacccgggc

SEQ ID NO: 29590 - DNA, 87 bp, Homo sapiens
tgggtgggcagcgaggatttagccagccactgttagagtgtctcagtttctctcttgcaggctctataaatgcatgttatccattta

SEQ ID NO: 29591 - DNA, 95 bp, Homo sapiens; identical to SEQ ID NO: 68

SEQ ID NO: 29592 - DNA, 93 bp, Homo sapiens; identical to SEQ ID NO: 69

SEQ ID NO: 29593 - DNA, 68 bp, Homo sapiens
aggacagaagtgaggcaccaggaggaggtgtctcggcctctggctggttcctctgtgttcctaagtcc

SEQ ID NO: 29594 - DNA, 101 bp, Homo sapiens
ctttattccaaagacagtaaggagccactgaaaggttttgagcaagacagtgttgagacttggttttattttttaaaggctacattagttattgagtggag

SEQ ID NO: 29595 - DNA, 111 bp, Homo sapiens
caggcgtgtggtgtgggtggtctccctgtgcctcggcctccatgtaggtagaacagctgctgagaggagtcagtgaggtaacacagtgttttcccagacctcaggcatctg

SEQ ID NO: 29596 - DNA, 68 bp, Homo sapiens
gttggttttgggaggagagggagagtctggcatctagtctcactctgtcattttcacccagaagttcc

SEQ ID NO: 29597 - DNA, 59 bp, Homo sapiens
cacagcttggccagatacggggactgtcccatattggtcagtcagtctgtctgcctgtg

SEQ ID NO: 29598 - DNA, 58 bp, Homo sapiens; identical to SEQ ID NO: 605

SEQ ID NO: 29599 - DNA, 112 bp, Homo sapiens
gcaatttctccaagagtctctagcaaacatgtggatgactggtagctgaaagacattctttttttttttttttttgcgacagtgtctcattctgtcactgaggctggagtgc

SEQ ID NO: 29600 - DNA, 58 bp, Homo sapiens
gagacagggtctctcactctgttgcccaggctggagtgcagaggtgcaatcccggctc

SEQ ID NO: 29601 - DNA, 111 bp, Homo sapiens
gtgaggaaaaagtctctctctctctacatatatatataatagatattaaatatataaatataaaatatatattatatatatattttttgagatgaagtcttgctctgttac

SEQ ID NO: 29602 - DNA, 117 bp, Homo sapiens
gtggcatgagcgaattttcgagggtgatggaattgttttcttttttctttttgagacagagtctcactctgtcacactaggctggagtgcagtggcatgatctcagctcactgcaac

SEQ ID NO: 29603 - DNA, 71 bp, Homo sapiens
tgaggacatgtgcctgtgccaggagtttgagcagagccttcggtctgtcactgtccctgtgtctgttctca

SEQ ID NO: 29604 - DNA, 82 bp, Homo sapiens
gctcctctgagcgggtggacagcacttggtacttttattttatttttgagatggactcttgctctgtcacccaggctggagt

SEQ ID NO: 29605 - DNA, 113 bp, Homo sapiens
ccaaagtgctgagattacaagtgtgagccactgtgactggcccaacatttttttttaattaaaaaattaaagccaggtgtagtggtgcatgcctgtagtcccagctactcagg

SEQ ID NO: 29606 - DNA, 58 bp, Homo sapiens; identical to SEQ ID NO: 1763

SEQ ID NO: 29607 - DNA, 91 bp, Homo sapiens
gacagcgagactccatctcaaaaataaataaataaataaataataattattttattttatttattttttggagatggagtctcactctgtc

SEQ ID NO: 29608 - DNA, 70 bp, Homo sapiens
gttgtttttgagatggagtctcactctgtcacccaggctggagtgcagtggtactatcttggcttactgc

SEQ ID NO: 29609 - DNA, 82 bp, Homo sapiens
acaggatggcaccctctgtgtgtcgctgccgcagggtcacccatgtctgctccagccgagaaatctggggaggccaaactgt

SEQ ID NO: 29610 - DNA, 121 bp, Homo sapiens
ctggagtttcttgtgccacatgtgattgtttctcgacgaattagcaataatgatttccttttttttttttttttttttttttttgagtcactgtctcgctctgtggcccaggctggagtgc

SEQ ID NO: 29611 - DNA, 108 bp, Homo sapiens
gtcattctggcaaggaattttaggttttatactcagggtattgctttgaaatcaagtttgtagttatgacaaagttggtggctctgtgtttagggaaggatttgtgac

SEQ ID NO: 29612 - DNA, 89 bp, Homo sapiens
ctggttgggacctgcagggatggcttctgtttttttctttttcttttttttttttttgacacagagtgtcgctctgtctctcaggctgg

SEQ ID NO: 29613 - DNA, 77 bp, Homo sapiens
acagggcaagagcctgtctctaatagcaataattatttatttattattttttcttttgagacagagtctcgctctgt

SEQ ID NO: 29614 - DNA, 78 bp, Homo sapiens
ggctgagagagagacagacagagtgggtcaggtctttctgaactcagatctgcctgggatactacactctctcctgcc

SEQ ID NO: 29615 - DNA, 69 bp, Homo sapiens
gagagagtgtagtatcccaggcagatctgagttcagaaagacctgacccactctgtctgtctctctctc

SEQ ID NO: 29616 - DNA, 71 bp, Homo sapiens
gggcgacagagcgagactgtctcaaaaaaaaaaaaaattaatttttgagacagagtctcactctgtccccc

SEQ ID NO: 29617 - DNA, 112 bp, Homo sapiens
gtgtgagccaccaagtccagcctgggatctgtaatttttacactatttcaaactttttttaacatgatacatggtaaaaaacacattttacactgcaactcagtactcacat

SEQ ID NO: 29618 - DNA, 58 bp, Homo sapiens; identical to SEQ ID NO: 2224

SEQ ID NO: 29619 - DNA, 56 bp, Homo sapiens; identical to SEQ ID NO: 335

SEQ ID NO: 29620 - DNA, 64 bp, Homo sapiens
tgcatgcatgcgtgtgtgtgcgtgcatgtgtgtgggtgtgcatgtgtgcgtgtgtgtgtgtgta

SEQ ID NO: 29621 - DNA, 83 bp, Homo sapiens
gggtgcgttgggggtgtgaggaaccccctgactcaggtggttgctgtgtgactctaggtgggtctctgcctctctctgggcct

SEQ ID NO: 29622 - DNA, 60 bp, Homo sapiens
ggaggcagagtctcgctctgtcacccaggctggagtgcagtggcgcaatctcggctctct

SEQ ID NO: 29623 - DNA, 77 bp, Homo sapiens
cggggcaacactgacagggcaccataaggaccctgccctggtctccaggggtctggccactctctctgtgaccctgt

SEQ ID NO: 29624 - DNA, 58 bp, Homo sapiens
tgagacagagtctcgcactgtcacccaggctggagtgcagtggcgcgatctcggctca

SEQ ID NO: 29625 - DNA, 113 bp, Homo sapiens
cttaggtttattgagtttccttctaggagttaattctttttcacaggttaacattttttttataaaagacctgtacaatggccctttgcataggaaatataatgaagactcag

SEQ ID NO: 29626 - DNA, 80 bp, Homo sapiens
ttgggtcaaagggcaaaacatgtgcaagattcttttttttttttttttttttgagatggagttttgctcttgtcacccag

SEQ ID NO: 29627 - DNA, 114 bp, Homo sapiens
cacccaaatagctgggattacacatgtgccaccatgcctggctaattttatatttttagtagagacagtttctccatgttggtcaggctggtcttgaaatcccaacctcaggtg

SEQ ID NO: 29628 - DNA, 76 bp, Homo sapiens
gacctggagccagtggcctatccctttttttttttttttttttcgttagactgggtctcactgtgtcacccaggtt

SEQ ID NO: 29629 - DNA, 133 bp, Homo sapiens
cacaaaagacaaacccatgtggcccagaacattaagggaggagagcaggtaaggcactcaggcactcactgtctcaggcaaggcaaaagctgggcggcactgggtagggtggggtggctcatgcctgtaatcc

SEQ ID NO: 29630 - DNA, 58 bp, Homo sapiens
ggagtcgagccagagactttttttttctttttttgagacggagtctcgctctgtctcc

SEQ ID NO: 29631 - DNA, 148 bp, Homo sapiens
gggccctgaactcaggggcttcgccactgattgtccaaacgcaattcttgtacgagtctgcggccaaccgagaattgtggctggacatctgtggctgagctccgggcgcaacaggggcgggggccccagggacagggctcagcgcggg

SEQ ID NO: 29632 - DNA, 98 bp, Homo sapiens
ccagccatatggcagggttttggattttctttttttcttttctcttcttttcttttttttttttttgagatgtagtcccactctgtcactcaggctgg

SEQ ID NO: 29633 - DNA, 66 bp, Homo sapiens
cctttcagctgggttctgagagccccaccctccactgcagctctcactcagcctgtctctgcaggg

SEQ ID NO: 29634 - DNA, 80 bp, Homo sapiens
tatatatacgtgtatatatgtacacatacgtgtatatacatgtatatatgtatacatacatatatatacatgtatatata

SEQ ID NO: 29635 - DNA, 60 bp, Homo sapiens
tatatatacatgtatatatatgtatgtatacatatatacatgtatatacacgtatgtgta

SEQ ID NO: 29636 - DNA, 149 bp, Homo sapiens
gacagaagctaagaaaccaaaaaaggagaaaactggctagagcaagaggctttttttttttttcctttttgagatggagtctcactctgtcacccaggctggagtgcagtggcatgatcttggctcactgtaacctctgcctcccgggt

SEQ ID NO: 29637 - DNA, 70 bp, Homo sapiens
gtacatctatgtatgtatgtgtgcatgttggtatgtgggtatatgtgcgcactggtatgtacatgtgtat

SEQ ID NO: 29638 - DNA, 118 bp, Homo sapiens
gaaagcacgcatgttcactgtaagaaatttgggaaccagagaatgtaaaaataaataaataagtaaatatttttagtcctgcttccctgtagtaatacttgtcaatgctctaactttc

SEQ ID NO: 29639 - DNA, 108 bp, Homo sapiens
tgtgtcctcattacccagacaatgcctggcaagtagatgctcaataagtaatttttttttttgaaatggagtctcgctctgtcacccgggctggagtgcagtggcaca

SEQ ID NO: 29640 - DNA, 62 bp, Homo sapiens
gcctggatgacagagtgagacttttttttttttttttgacagtctcgctctgtcgctcaggc

SEQ ID NO: 29641 - DNA, 110 bp, Homo sapiens
cctagactgcatgctcctctgtggcggcttcctgactccagatccaggcggtatctgtctgtctgtctgcattgctcagcccgctaaccctctgtccatctcactttggg

SEQ ID NO: 29642 - DNA, 88 bp, Homo sapiens
ccagcctgggcaatatagtgagccctcacctctacaaaaaaaaaaattttttttttgagacggagtctcgcactgtcacccaggctgg

SEQ ID NO: 29643 - DNA, 74 bp, Homo sapiens
gcctattgtactttttttttttttttttttgatacggagtcttactctgtcaccaggctagagtgcagtggcgc

SEQ ID NO: 29644 - DNA, 68 bp, Homo sapiens
gtttgggggatttttttggagggggttgttttgttttttgaggcagggtctcactctgtcacccaggc

SEQ ID NO: 29645 - DNA, 114 bp, Homo sapiens
gatccatgcattgttcagcattttttcagatagttgccagaaatttttatgtctttttttatttttttttgagacagagtctggctctgtcaccaggctggagtgcagtggctc

SEQ ID NO: 29646 - DNA, 58 bp, Homo sapiens
tgagacggagtctcgctctgtctcccaggctggagtgcagtggtgtgatcttggctca

SEQ ID NO: 29647 - DNA, 73 bp, Homo sapiens
catctctgtgtctgtgtctgtgagcttatgggtgtggtgaaggtaggttccaggaacttaggagggagggagg

SEQ ID NO: 29648 - DNA, 116 bp, Homo sapiens
ctacttgttagctgtggccttgggtgtgtgacttagcctttttttttttttttggtgtgggagggatgtggggagggacatggtcttgctttgtcactcaggctgcagtgcagtag

SEQ ID NO: 29649 - DNA, 56 bp, Homo sapiens; identical to SEQ ID NO: 7850

SEQ ID NO: 29650 - DNA, 93 bp, Homo sapiens
gtcaagtgcccttcccagcctggggagcaaagggtagcatctccatccccacagtcctttgcttttcttgctgtaggtccagggtagagtggc

SEQ ID NO: 29651 - DNA, 56 bp, Homo sapiens
tgagacagtctcactctgtcacccaggctggggtgcagtggcatgatcctgactca

SEQ ID NO: 29652 - DNA, 58 bp, Homo sapiens; identical to SEQ ID NO: 1101

SEQ ID NO: 29653 - DNA, 56 bp, Homo sapiens; identical to SEQ ID NO: 1102

SEQ ID NO: 29654 - DNA, 60 bp, Homo sapiens
atctatctatctatctatctatctatctatctagatagatagatagatatagatatagat

SEQ ID NO: 29655 - DNA, 118 bp, Homo sapiens
gatccatgtgctgagaagaatgtgtagtctacagccgtggggtgaaatgttctataaatatttattaggtccatttattctatagtacaggtatgttatatatttttctttgttgatt

SEQ ID NO: 29656 - DNA, 111 bp, Homo sapiens
gttgacgctggtgttctgggttgtactgggggtggtatggccctgccaggtcctgggccctgcctgcctgcctgtctaccattcattcatccattcattcattcagtcaat

SEQ ID NO: 29657 - DNA, 86 bp, Homo sapiens
gcccagtgctgtgagggtgagcttcatagtggagaggcccaggaaagagaagggactcacccactgtcacccagtgggactgtggc

SEQ ID NO: 29658 - DNA, 73 bp, Homo sapiens
ctgggattacaggcaaagacttggtgatctttttttttttttttttttgagagagtctcgctctgtcgcccag

SEQ ID NO: 29659 - DNA, 118 bp, Homo sapiens
gttaggcacctcctggctggggtggaacaagacttatggcctcagagagagtaagagcctcactctgtggctgtgatcttaacctccaactaacttagagacaaacgggtgctatgac

SEQ ID NO: 29660 - DNA, 58 bp, Homo sapiens; identical to SEQ ID NO: 315

SEQ ID NO: 29661 - DNA, 126 bp, Homo sapiens
ggagggagggcatggagagcagctagctaaaccatgggagctacttcatcgcacactcacgctctcactcaaggtagaaccggctgagcctgaaagggtcggttgtcaactcgagaggagaaagga

SEQ ID NO: 29662 - DNA, 59 bp, Homo sapiens
gagtctcggagtctcgctctgtcacccaggctggagtgcactgacggcgatctccactc

SEQ ID NO: 29663 - DNA, 70 bp, Homo sapiens
gtggtagtgagctgagatcgcactgctgcactccagcctaggcaacagagtgagactctgtcacacacac

SEQ ID NO: 29664 - DNA, 72 bp, Homo sapiens
ctgcctctctgagtctctgagccccaagaaggtattcagcctggtgctcgcatgaaggctcagtgaggtgag

SEQ ID NO: 29665 - DNA, 86 bp, Homo sapiens
ccagcctgggcgacatggtgagacctcatctcaaaaaaaagaaaaaatttttttgaggcagagtctcgctctgtcgctgaggctgg

SEQ ID NO: 29666 - DNA, 84 bp, Homo sapiens
tgagatctgacacagagctcggtgtttggaggtctgggttatgtccacctcccttgcgtctgtcacactgtgttatagttttca

SEQ ID NO: 29667 - DNA, 78 bp, Homo sapiens
cctagctaaactgtcagtaaagagtgtgagcaggctgggtgaggtgtctcatgcctgtaatcccagcagtttgggagg

SEQ ID NO: 29668 - DNA, 81 bp, Homo sapiens
aacctctcgagtaactggaactacaggcgcacgccaccgtgcccagctaatttttttgtatttttggtagagacgggggtt

SEQ ID NO: 29669 - DNA, 72 bp, Homo sapiens
tctgtgtgtgtctctctctgtgtgtgtgtctcctctataggaaagggtgaagccagagagagagaacccagg

SEQ ID NO: 29670 - DNA, 80 bp, Homo sapiens
ctcaccctcctaaagtgctgggattacaggcgtgagccactgcacacgacctaatctttgtatttttaatagagatggag

SEQ ID NO: 29671 - DNA, 92 bp, Homo sapiens
cttctctcacagacactcgctggctctctccatgccaagaactcagcccggtggcacggcaagcgagtaagtgctcttaagccagagaggag

SEQ ID NO: 29672 - DNA, 72 bp, Homo sapiens
taggtaggtaggtaggtagttagacataggtatctatctatctatctatctatctatctatctatctatcta

SEQ ID NO: 29673 - DNA, 79 bp, Homo sapiens
gcttttttagggtttgttagaggaggtcagggtgactcacaaaaatgtgagaaatgactgaccacatctcaggaagagc

SEQ ID NO: 29674 - DNA, 75 bp, Homo sapiens
aggttatacatgcatatgtatacatgtatatgtatatatgtatgcatatatgtgcatacatatatgtaaatgcct

SEQ ID NO: 29675 - DNA, 63 bp, Homo sapiens
acgggcgtccctcagtgtctctcaccaggccctccctgtgagtggaacacgtcctaaccctgt

SEQ ID NO: 29676 - DNA, 58 bp, Homo sapiens
tgagacagagtctcgctctgtcacccaagctggagtgcagtggtgcagtctcgactca

SEQ ID NO: 29677 - DNA, 120 bp, Homo sapiens
gccaccatactttacggcactttgacttggttgtctctggtcacactttctctctccatgtggctgcatcgtcttttggaggaaaagtctggggccagccagatgtttctctctgtaggc

SEQ ID NO: 29678 - DNA, 159 bp, Homo sapiens
tatatatatatatatatatatatatatacacacatgtgtatatatatatgtctatacatatatatgtatctatatatgtctatacatatatatgtatctatatatgtctatacatatatatgtatctatatatgtctatacatatatatgtagtatata

SEQ ID NO: 29679 - DNA, 58 bp, Homo sapiens
tgagacagagtctcactgtgtcacccaggctggagtgcagtggtgggatctcggctca

SEQ ID NO: 29680 - DNA, 76 bp, Homo sapiens
gaactctgtgtgtctgtctttcagggaagcccaggacgggcttcctggaaggctatgccccacgacagcctggttc

SEQ ID NO: 29681 - DNA, 88 bp, Homo sapiens
tgagggctgaacagggcacaggcagacaggctgtgtgagggaaggcggctgtggtctgacactgtcactcactcttgtcagcaaatca

SEQ ID NO: 29682 - DNA, 118 bp, Homo sapiens
ttttctagacaatgatggccctttcccagaaaataggaccctagagtcattcactgtgtgactcagaaaagcccctattagtgctcagatataggtcaaagtcattgtgctgtgaaaa

SEQ ID NO: 29683 - DNA, 58 bp, Homo sapiens
tgaggtggagtctcactctgtcactcaggctagagtgcagtggtgcgatcttggctca

SEQ ID NO: 29684 - DNA, 87 bp, Homo sapiens
ccatgtcaggggggaagatctggggcaagagttgactggatacatcacgcatgcagtgaccctgtctctgtccttcaccacggcagg

SEQ ID NO: 29685 - DNA, 95 bp, Homo sapiens; identical to SEQ ID NO: 580

SEQ ID NO: 29686 - DNA, 93 bp, Homo sapiens; identical to SEQ ID NO: 69

SEQ ID NO: 29687 - DNA, 116 bp, Homo sapiens
cttctctctgaacctcaaccttccctcctgtctagtgggttcgcagccagacagtcttttactcactgcttactgggtgccctctggagtctgggcaggtgccaggctctgagaag

SEQ ID NO: 29688 - DNA, 78 bp, Homo sapiens
tggagacctggggagtccggagcgtgtgggggggctcccgattctctctccctctctcggactcgccgtctgtctcca

SEQ ID NO: 29689 - DNA, 94 bp, Homo sapiens
tgtgtgtgtgtataatatgtgtgtgtatatgtatataatatgtatgtgtgtgtatgtctgtgtatatatgtatatatacataaacacatacata

SEQ ID NO: 29690 - DNA, 70 bp, Homo sapiens
gcagaccatgactgcctcccgcgagactggcacaatgtgcgcttgccagtggctgagttgaggaccatgc

SEQ ID NO: 29691 - DNA, 101 bp, Homo sapiens
tctagaactctgagatgtgagctggaactacttgtctcaaattcctttttttttttttttttttttttgagacagagtcttgctctgtcacccaggctaga

SEQ ID NO: 29692 - DNA, 77 bp, Homo sapiens
ctgtagcctcaggctctctgagtgtgtttcctcatcaggaaaacgagataccagcagcgcctgtcatgattagcaca

SEQ ID NO: 29693 - DNA, 102 bp, Homo sapiens
gctttccaggtgaacgtgctgaaaaaattttccagtttctttcaaaatgagttttttttttttttttgagatggagtctcgctctgtcacccaggctgaagt

SEQ ID NO: 29694 - DNA, 109 bp, Homo sapiens
atcactctgggcaacagagcaagacactttctcaaaatgaataaataaatatataaataaaatagaactttgaggagtggaaagaaggctggggacgtgctgtagtgat

SEQ ID NO: 29695 - DNA, 84 bp, Homo sapiens
gttgtcgagcaaatggtctctgctgtgatgggcagtgtccccctgacacacacacaggcacagtctgtcctgccttccttcaac

SEQ ID NO: 29696 - DNA, 66 bp, Homo sapiens
tgagtcagagtctctgtgtgtcacccaggctggagtgcaggagtgcagtgtggcgatctcggctca

SEQ ID NO: 29697 - DNA, 77 bp, Homo sapiens
ccttgtgaggtgctggatgatttttttttttttttttggaggggagggaaggagtctcactctgtcacccaggctgg

SEQ ID NO: 29698 - DNA, 58 bp, Homo sapiens; identical to SEQ ID NO: 20501

SEQ ID NO: 29699 - DNA, 58 bp, Homo sapiens; identical to SEQ ID NO: 7346

SEQ ID NO: 29700 - DNA, 115 bp, Homo sapiens
gagatcatactttctacaaattgaatcagcttacattcactgaggcttttgtttgtttgtttttttcgagacggagtctcactgttgcccagctggagtgcagtagtgcaatctc

SEQ ID NO: 29701 - DNA, 58 bp, Homo sapiens; identical to SEQ ID NO: 285

SEQ ID NO: 29702 - DNA, 66 bp, Homo sapiens
tagtcgggaggcagggcccggcctctctttctccctgtggtgtgtgtctccctgtgtctctgtctg

SEQ ID NO: 29703 - DNA, 71 bp, Homo sapiens
ttgtttgtgagacagggtctcacattctcactcaggctgaagtgcagtggtgtgatcttggctcactgcaa

SEQ ID NO: 29704 - DNA, 126 bp, Homo sapiens
aggcactgtcttgttgcatgtgtctcgttgcagcgtccagacctatgcatatcacgcctctgcctcactgactgtgagcccaagacaggagaagttcaacagtgggtaacagtacgtttgccgagg

SEQ ID NO: 29705 - DNA, 85 bp, Homo sapiens
tggcatgcacctgtggtcccagatactctggaggctgaggtgggaggatggtttgagcccgggaggcggaggctgcagtgtgccg

SEQ ID NO: 29706 - DNA, 71 bp, Homo sapiens
ctgcgatcttggtggcggtgtctctgtggctgtgtgaggacacccacctgagcattaccaagggctcgcag

SEQ ID NO: 29707 - DNA, 62 bp, Homo sapiens
gctacactggtgattttgatcttgaaatttcaaagtgtttctatcagttcaccagtccttgc

SEQ ID NO: 29708 - DNA, 65 bp, Homo sapiens
gcagtactcagttgaatactcgagaggaccctccgcaagggtccagagttctctctgtgtgaggc

SEQ ID NO: 29709 - DNA, 138 bp, Homo sapiens
ggtctaagaaatctttgtttaatccaagattatgaagattttctcctgtgttttcttcaatagttgattttatattgatgtctatggtccaattttgagtcagttttatatgtgcagggcaggagtcaaagttctcat

SEQ ID NO: 29710 - DNA, 68 bp, Homo sapiens
acagctagccagggccagagctgggacttaggcaggccagtccctctgactctgagcctgtgagctgt

SEQ ID NO: 29711 - DNA, 69 bp, Homo sapiens
ggcctggaggttaggttgattcttgttttttgtttttttgagacagagtcttgctctgtcacccaggct

SEQ ID NO: 29712 - DNA, 116 bp, Homo sapiens
ccactccactccagaatgggaaacacagccagactctttctctttcctttttttttttttttttttttttttttgagacagtgtctccctctgtcgcccaagctggagtgcagtgg

SEQ ID NO: 29713 - DNA, 81 bp, Homo sapiens
acgtttaacaaggttccccagtgtccctagaagtggctggaaggaccacagctttggaactgaactgattttcttgaatgt

SEQ ID NO: 29714 - DNA, 95 bp, Homo sapiens
ctcccaaagtgctgggattacaggcgtgagccactgcgtccgaccttaattttttttttaagacacggggtctcgctctgtcgcccaggctggag

SEQ ID NO: 29715 - DNA, 118 bp, Homo sapiens
gccctcacagcaaagccaggtatctgctgatgttctttttttttttttgcgactgggtctcactctgtcacccaggctgaagtgcagtggcgtgatcttggcttactgcagtgttggc

SEQ ID NO: 29716 - DNA, 88 bp, Homo sapiens
ctggcagccactcccagagcccctggaactctggcccaaggctgtctcactgactccttcccagatcttcttggcttagtggctgaag

SEQ ID NO: 29717 - DNA, 112 bp, Homo sapiens
gactcaccgttgtttacgtaacccattcagttgttcaagggagtctttcctctttttttttttttcaaatgattgaacatgggttgtaaaacaggattactttggttttgtc

SEQ ID NO: 29718 - DNA, 59 bp, Homo sapiens
gagtcactgtgtggagcagagcccctcctggactgggtctctgagtcactgtgtggagc

SEQ ID NO: 29719 - DNA, 117 bp, Homo sapiens
accctttgactagccattttgttgtaggcatcagagctcagactgaacttttttttttaaattttacttttaagttctaggatacatgtgcagaatgtgcaggtttgttacataggt

SEQ ID NO: 29720 - DNA, 57 bp, Homo sapiens
tgaggcggagtctcactctgtcacccagctggagtgcagtggcgtgatctcggctca

SEQ ID NO: 29721 - DNA, 123 bp, Homo sapiens
tgtccgtttttatgtatttattttatgtactcctgttattggcaggtagaagaggaaagtgtctctctcagtctgtctttgatgagggaaggaaaaatgtgattcagtgattgggcagaaaga

SEQ ID NO: 29722 - DNA, 149 bp, Homo sapiens
gtagtattccatcatatatatatatatatatatatatatatatatatatatatatatatatatgtatatatgtgtacatatatatacatacatatatgtgtacatatatatgtatatatgtatatatgtgtgtgtgtatatgtatgtat

SEQ ID NO: 29723 - DNA, 135 bp, Homo sapiens
tacatatacacacacacatatatacatatatacatatatatgtacacatatatgtatgtatatatatgtacacatatatacatatatatatatatatatatatatatatatatatatatatatatatatatgatg

SEQ ID NO: 29724 - DNA, 91 bp, Homo sapiens
gcgtgtctcctttctgcagaacttctctggactgcagtagatttaatgtcctagtcctcacactggctctcacagaaaggacatggtgtgc

SEQ ID NO: 29725 - DNA, 149 bp, Homo sapiens
tatatatataaaatgtgtatatatatatatatatataatgtatatatatataaaatgtgtatatataatgtatatatatataatgtatatatataatgtgtatatatacacacatatatacatatgtatatatgtatatacatatatgt

SEQ ID NO: 29726 - DNA, 58 bp, Homo sapiens; identical to SEQ ID NO: 9124

SEQ ID NO: 29727 - DNA, 102 bp, Homo sapiens
ggagcgcaaagggtgggtttcaatcatccatggactccctgaaatatatgctaagtgttgtgtgtgtgcagtcagttggtgagagcccctagtttttgttcc

SEQ ID NO: 29728 - DNA, 109 bp, Homo sapiens
ccaggctgggaggggaagagggtgagaggctgggcaaaaaatgaaaggtggggctttgcatttctttttgtttttttttgagacggagtctccctctgtcacccagagg

SEQ ID NO: 29729 - DNA, 114 bp, Homo sapiens
gtattgggggttagtcttgaggatgactgatggtttctaacaaaatctctgctgagtgactgtctcactcctgcttagaatatctctggtaaccttttgaagtagttttaatat

SEQ ID NO: 29730 - DNA, 110 bp, Homo sapiens
gaggggctctgttaggtatatatgtatatatatacacacacatatatatatggattttatatatatataggttatatatatgtatatatatttatgacagttatatcttc

SEQ ID NO: 29731 - DNA, 78 bp, Homo sapiens
cctggattttgtggggcccttttatttatttttatttaatttattttcttgagacagggtctcactctgtcacccagg

SEQ ID NO: 29732 - DNA, 101 bp, Homo sapiens
gcctcccacggtgctgggattacaggggtgagacaccgtgcctggcaattttttttttttttttggaacagggtctccctctgtcacccagactggagtgc

SEQ ID NO: 29733 - DNA, 142 bp, Homo sapiens
tcctaagccccgtgttaaggctgggatttcctacgtcctgaagaaagctgtcttgttttttttgtttgtttttttttttttgagagagtctcactctgtcactgaggctggagtgcagtggcactgtgtcggctcactgcaa

SEQ ID NO: 29734 - DNA, 62 bp, Homo sapiens
tgagatggagtctcactcactctgtcgcccaggctggagtgtagtggtatgatctcggctca

SEQ ID NO: 29735 - DNA, 132 bp, Homo sapiens
ctcctctgtgtcattgaccacgggtgactgtgaggagatgacccttcccctgtacccctgaccacagatgacagtgaggagatctccctcccgtgtccctgaccatgggtgacagtgagatgacccttcccc

SEQ ID NO: 29736 - DNA, 145 bp, Homo sapiens
tgggaagccactggttgtgctgagaaagacagaaatagacttgcttttttttttttttttttttttgagatgaagtctcactctgtcacccaggctggagtatagtggcaaaatctcagctcactgcaacctctgcctcccgggt

SEQ ID NO: 29737 - DNA, 95 bp, Homo sapiens; identical to SEQ ID NO: 68

SEQ ID NO: 29738 - DNA, 93 bp, Homo sapiens; identical to SEQ ID NO: 69

SEQ ID NO: 29739 - DNA, 76 bp, Homo sapiens
acatttctctctcactgtggtagaagctagttatatacctataattcaagttactgctgatagtgaacatgggtgt

SEQ ID NO: 29740 - DNA, 115 bp, Homo sapiens
ctgaagctggtgaggtggccagaggtcagattctagaaggctttgttgatcatattacagtttttttttttttttttttttgagcgagggtcttactctgtcacccaggctggag

SEQ ID NO: 29741 - DNA, 87 bp, Homo sapiens
tgctgagttgaccctgcagttctacaagagccctctgtgggttaaaactggtgtgacggtaggaatgtaaagaagtctgtgtcagca

SEQ ID NO: 29742 - DNA, 93 bp, Homo sapiens
ggctaaatgatgtcctgatagttctagtttcccagattaaaatcactgggagagttgacctctgtttgtctcactcattcacccctcctggcc

SEQ ID NO: 29743 - DNA, 69 bp, Homo sapiens
gcctcaggcacatgaatatgtatatattcatgtatgtatgaatatatacacctcttctcttgcctaggc

SEQ ID NO: 29744 - DNA, 64 bp, Homo sapiens
tattgagtcagagtctcgctctgtcacccaggccggagtgcagtggcgcgatctcggctcaatg

SEQ ID NO: 29745 - DNA, 78 bp, Homo sapiens
ctggaactacagttccacatatgttagactgtctggtattgtcctctaggtctcttagatttggttcttttcttccgg

SEQ ID NO: 29746 - DNA, 94 bp, Homo sapiens
tgggcagtaagcctcagcagacagcagagagagaggccaccctaggcaagggggcatgcctgtctcaagtcggcttctaagaggctcatgccca

SEQ ID NO: 29747 - DNA, 82 bp, Homo sapiens
gcacgtcacagatcaggaagcgtggccatggatgcatgcaactctgtgctcttcccaacaagctctctctctgtgtgcgtgc

SEQ ID NO: 29748 - DNA, 95 bp, Homo sapiens; identical to SEQ ID NO: 68

SEQ ID NO: 29749 - DNA, 93 bp, Homo sapiens; identical to SEQ ID NO: 69

SEQ ID NO: 29750 - DNA, 83 bp, Homo sapiens
ggcgttctccctgggtgtctgtgtctctgggtccaaatttccatcttcttataaggacacgagtcatcttggattgagggccc

SEQ ID NO: 29751 - DNA, 145 bp, Homo sapiens
ccaatacgtctgttgggtagtactactgtcatcccattttctttttttttttttttttttttttgggagacaaagtctcactctgtcacccgggctggagtgcagtgacgcgatcttggctcactgcaacctccgcctcctgggt

SEQ ID NO: 29752 - DNA, 75 bp, Homo sapiens
tatatatgtgtatatgtatgtatatatgtgtatatatatgcatgtatatgtgtgtgtatatatatgcatgtatat

SEQ ID NO: 29753 - DNA, 62 bp, Homo sapiens
cctgcgaggcaggtggagtttttttatttgtttagagaaggagtctcgctctgtctcccagg

SEQ ID NO: 29754 - DNA, 113 bp, Homo sapiens
ctccagcccaggtgacagagcgagactccattaaaaaaaaattaagtaaaacataaattttatttatttacttatttttgagacatagtctcactctggcacccttgctccag

SEQ ID NO: 29755 - DNA, 104 bp, Homo sapiens
ctgaggcaggagaatcacttgaacccgggagatagaggtcacagtgagctgagatcgtgccattgcactctagcctggggaacaagagtgaaactctgtctcag

SEQ ID NO: 29756 - DNA, 72 bp, Homo sapiens
gtcacacgcttgccaggtttatcagtcacctctacggcagacactcgccgagaacacatctgtgtgtgtgac

SEQ ID NO: 29757 - DNA, 99 bp, Homo sapiens
gatccacagccaacccttctcctgctgtctctggctgtcagtgagacccctctggaaagggcagaagcaggcaagccaggcagaagggggcccggggtc

SEQ ID NO: 29758 - DNA, 110 bp, Homo sapiens
gccccggcctcccctgcgtcccccaggctggcggcctcactctgtggctgtggggccttttcccttccagctcctggccctgttttcctgggtcttgtatgggcgggggc

SEQ ID NO: 29759 - DNA, 61 bp, Homo sapiens
gagccactccggccctctgtcatctttacagcctaggtgacagtagacacggagcaggccc

SEQ ID NO: 29760 - DNA, 68 bp, Homo sapiens
gtgtcgggtgccatggaggggtggcagctggggggcctcagtgtcactgtctccgtggggtcagacat

SEQ ID NO: 29761 - DNA, 78 bp, Homo sapiens
gggggctgagctcctgcatgtatgtgcgtgcatgcacacacacgctcacacacacacaccctgcacagcacagcttgc

SEQ ID NO: 29762 - DNA, 69 bp, Homo sapiens
gagcaaggcttctgcaggtaatgggtctgggttcaagccctggctctgcctgtctctgagcctcagttt

SEQ ID NO: 29763 - DNA, 93 bp, Homo sapiens
tgtgtgccaagaaggatgagcctgccactcactctctgtccttcgcttggctgctcacagggcaagggcagggctgggggcctcccatcctcc

SEQ ID NO: 29764 - DNA, 116 bp, Homo sapiens
gtcacacagaggaggcttggctcagctgctcggctcaaggcgggggatgctgtctgtcactgtctccccacagcaggccagtgctgggcaacatactggccgcctgctgctgcggc

SEQ ID NO: 29765 - DNA, 75 bp, Homo sapiens
gtgtggctgttgagtgggagcaggcctgggttgtccccacctggagcacctgctgtggggtctgcactggaatgt

SEQ ID NO: 29766 - DNA, 88 bp, Homo sapiens
tgtctcacagaagacagtgaggagtaagccaaaaagtcaaataactgaaagggaggtcttccttacccctccatagtccctgaagaca

SEQ ID NO: 29767 - DNA, 76 bp, Homo sapiens
tggctgtgacggtttcccagactttcctcgtcttggtttttattttttttgagacagagtctcgctctgtcaccca

SEQ ID NO: 29768 - DNA, 65 bp, Homo sapiens
gaccgcgtgcagggcttgggtgtgtgcacgctcactgttgcacacacacagagtcacaggctctc

SEQ ID NO: 29769 - DNA, 101 bp, Homo sapiens
ccagctccaccctacccaggctgagggaggcctgttggccctgagctgtggctcctgcctgcctgcctgcctgcctgctgccggaggaaagtggatggtgg

SEQ ID NO: 29770 - DNA, 137 bp, Homo sapiens
gagaaaggaccttagtagaaaaggccaatgaggctgcaaagcccggcacctggaaggtctctcgctctcagtctcgcccagctgcccctcactgagtgttggagtgatgccagaggggagccactgcaggtcttggc

SEQ ID NO: 29771 - DNA, 116 bp, Homo sapiens
ggactaatacactgtggcccacctgtagctgtggacaaggctgaggaccagggtcttgtctggctctgagtgtctacacagctaagggctgcaggtggggttgggctgtgtcttcc

SEQ ID NO: 29772 - DNA, 96 bp, Homo sapiens
cacacctcacctgtcaggttggaagtgacaccgtggccaggctctgtgtccctgtcactcttccacacccacctggctgctccgtgtgctctttta

SEQ ID NO: 29773 - DNA, 69 bp, Homo sapiens
ttgttggagtccctgtcttcagttcttccaggcacacacctggctgtggagctgcacgtgctctctcga

SEQ ID NO: 29774 - DNA, 113 bp, Homo sapiens
ggggacccacagaaccgccttgctgcaggcactgtctactgagctctcacctctcactgcctctctgagtccattcaatagatcaggcacggcagggcatggtggctcacgcc

SEQ ID NO: 29775 - DNA, 117 bp, Homo sapiens
gggtgtgaggacactcgggcaggtatgaggacacttggatgggtgtgaggacactcagatgggtatgaggacactcagatgagtgtgaggacactcgggcaggtatgaggacactcg

SEQ ID NO: 29776 - DNA, 95 bp, Homo sapiens; identical to SEQ ID NO: 68

SEQ ID NO: 29777 - DNA, 93 bp, Homo sapiens; identical to SEQ ID NO: 69

SEQ ID NO: 29778 - DNA, 128 bp, Homo sapiens
atatatatatgtgtacgtgtatatgagtgtatatgggtgtgcatatatatgtgagtatatgtgtatatatatatgagtatatataccatacacgtgtatatatatgagtatatatgtgtgcatatgtg

SEQ ID NO: 29779 - DNA, 134 bp, Homo sapiens
gtgtattaggtgtgtatacgtatctccagtaggctcttctcatatatatgtatatgagtgtatatatatatgtgtgtatgtgtgtatatatatgagcacctgtgtttacatatattagtatgtgtgtatatgag

SEQ ID NO: 29780 - DNA, 95 bp, Homo sapiens; identical to SEQ ID NO: 68

SEQ ID NO: 29781 - DNA, 93 bp, Homo sapiens; identical to SEQ ID NO: 69

SEQ ID NO: 29782 - DNA, 72 bp, Homo sapiens
gttttgtttgagacagtctcactcactccgttgcccaggctggagtgcaatggcgcgatctcggctcactgc

SEQ ID NO: 29783 - DNA, 57 bp, Homo sapiens
gagactcaggtgagagtctgcagcctgcattagcccggctgaggcacacgtgatctt

SEQ ID NO: 29784 - DNA, 76 bp, Homo sapiens
gcagtgtggcttctctctctctctcaagtcccacgggcaggtggcctgaggtagcccgaggtagtctctctagcta

SEQ ID NO: 29785 - DNA, 73 bp, Homo sapiens
ggtgccagctctgactgaccacactttgctctccaacttctggcccccagggctgtgacagaagagccacacc

SEQ ID NO: 29786 - DNA, 95 bp, Homo sapiens; identical to SEQ ID NO: 68

SEQ ID NO: 29787 - DNA, 93 bp, Homo sapiens; identical to SEQ ID NO: 69

SEQ ID NO: 29788 - DNA, 109 bp, Homo sapiens
tggttcaccactttcgtagccttactgattttctgtttagtcattctgttgattactaacagattctctaacagagaagtataagctttctaactataatggtgggtta

SEQ ID NO: 29789 - DNA, 84 bp, Homo sapiens
cccctggccacaaggaatgttctctctgtctgtcaatcggcccattgtggcgatttcccgtcagtggaatcctgggctgtgtgg

SEQ ID NO: 29790 - DNA, 116 bp, Homo sapiens
tgtgacacaagttgatgagtgctgttgaaaaaaagaaaacacatagccaagtcacagaattgagagtgcagtgtggaggtgatgggcagcttactgtattaaatagggttgtcagg

SEQ ID NO: 29791 - DNA, 347 bp, Homo sapiens
gccatatatatatgtatgtatgtgtatatatatatatgtgtgtgtgtgtgcatatatatatacatatatatgtgtgtgtgtgtatatatatatatgtgtatatatatgtgtatatatatatgtgtatatatatatgtgtgtatatatatatgtgtatatatatatgtgtatatatatgtgtgtatatatatatgtgtatatatatgtgtgtgtatatatatatgtgtatatatatgtgtgtatatatatatgtgtatatatatatgtgtgtgtgtatatatatatatatatatatatatatatatatatatatatatgtgtgtgtgtgtatatatatgacaaacaca

SEQ ID NO: 29792 - DNA, 69 bp, Homo sapiens
aggggccctgagtggtggggtcagtgttgggaaggaccgagggagactctctcacgctcacctgcccct

SEQ ID NO: 29793 - DNA, 60 bp, Homo sapiens
ctcagagctgactcagtctgtgcatctgtgggacaagatgctgaggctgagtggcctggg

SEQ ID NO: 29794 - DNA, 80 bp, Homo sapiens
agacagaccctctctctgcctggctgaccctttctcacatctcagggtcagggaacaagagggaggcttcaggtttgtct

SEQ ID NO: 29795 - DNA, 72 bp, Homo sapiens
gcccggttgtacccactcactgcctctctcctgcctgcacctgcagaggtgagcggtgacctcaacccgagt

SEQ ID NO: 29796 - DNA, 82 bp, Homo sapiens
gctgacggctgggtatcggatttcaatttcaacgtgttaggtttgcctgtaatgtttttgaatttgtgttttagacgctggc

SEQ ID NO: 29797 - DNA, 92 bp, Homo sapiens
cctaatggatgacagggtggagaatatgccagtattttatatttatttattatttattttgagacagagtctcgctctgtcgcccaggctgg

SEQ ID NO: 29798 - DNA, 58 bp, Homo sapiens
tgagacagagtctcgctctgtcacccaggatggagtgcagtggtgcagtcttgtctca

SEQ ID NO: 29799 - DNA, 63 bp, Homo sapiens
gtgccaggtggcaggtgaccaaagctgatgacgtcaaccagctgagtcagtttgtctctggcc

SEQ ID NO: 29800 - DNA, 87 bp, Homo sapiens
ctgtgtggccttggattccacttctcccggcctggccccagcctaagcccaggcctggacctgtgagagtccccatctcaaactcag

SEQ ID NO: 29801 - DNA, 98 bp, Homo sapiens
gtttctctctctctctgtctctccttctctgtgtctctctaggtcagaaggatggcaggccagacgcatggaagagggggcggaaggaccttcctaac

SEQ ID NO: 29802 - DNA, 103 bp, Homo sapiens
attgaggccctcaaagtcatctttggagaaagacacagaccacagactgtttctgtgattctggttttcttttccttaacattggcaaaataaacttctcaat

SEQ ID NO: 29803 - DNA, 66 bp, Homo sapiens
ttgcacacacacgctcgcacactcactgacttgcactctggtgagagcctgagcctgtgcgtgtga

SEQ ID NO: 29804 - DNA, 73 bp, Homo sapiens
ggggcttcagatcccactgctgagccggagacccagatgggtctcagactgacagtctcagactggcagcccc

SEQ ID NO: 29805 - DNA, 58 bp, Homo sapiens
cagtctgagactgtcagtctgagacccatctgggtctccggctcagcagtgggatctg

SEQ ID NO: 29806 - DNA, 112 bp, Homo sapiens
ttagggttgtcttggctatgagggctcttttttggttccatatgaaatttaaagtagtttttttaaaattctgtgaagaaagtcaatggtagtttgatggggatagcattga

SEQ ID NO: 29807 - DNA, 80 bp, Homo sapiens
cgggcggggtctctggcacctctgcctctgactcactggccaccaatggtgtcagcagagggagcgggagtccccggctg

SEQ ID NO: 29808 - DNA, 116 bp, Homo sapiens
acagtaccactgagttagatttcagccacagatgcttagctttttttttttgtcttttttttaaggaggaagcctttgttttgttttcctgagccctcactctgtttttgtgctgt

SEQ ID NO: 29809 - DNA, 65 bp, Homo sapiens
gttcggttccattgatctgtgtgtctgtgcttatgccagataccccccgtcaggattactgtagc

SEQ ID NO: 29810 - DNA, 91 bp, Homo sapiens
gcagcccccttgccagccagggcctagaggcgtgtggctccaggcgtcattgggccccccccgcccccagtggctgatgtagtgtttctgt

SEQ ID NO: 29811 - DNA, 86 bp, Homo sapiens
gcatcattaggtgattttgttgttctctgaacaccgcaggtgattttgtcgttctgtgaacaccacagaatgcacttaaacgatgc

SEQ ID NO: 29812 - DNA, 114 bp, Homo sapiens
agatatctattacattcatttggcacagtgttgacttcaggtcctgaatatctttgttaattaattttctgcctctctgatctgtctaatactgtcagttgggtgttgaagtct

SEQ ID NO: 29813 - DNA, 66 bp, Homo sapiens
ctcgctgagggtgtccctcactcagtggctccagggacaactgagggacatggatccagccaggag

SEQ ID NO: 29814 - DNA, 79 bp, Homo sapiens
cagaagtgtgtgtgcacagacgtgtgtgagcgtgcacacctgtgtgcagcgttcatgtatgtgtgcacgcgtgtaactg

SEQ ID NO: 29815 - DNA, 75 bp, Homo sapiens
gccgctcagcctctctgagtctgtgaagagcaagtacaatctccttcccagggttaccatggggcttgaggaggc

SEQ ID NO: 29816 - DNA, 92 bp, Homo sapiens
aacattgaccttgcaggtgggaagataatgtgcgtgacatgatgccaatgtcactggttcagttcattattattatttgttcaaggtgtgtt

SEQ ID NO: 29817 - DNA, 74 bp, Homo sapiens
ggcgacgggcgaaactctgtttcaaaaaaaagaaaaattattttcttcctgagacagtgtctcactctgttgct

SEQ ID NO: 29818 - DNA, 58 bp, Homo sapiens; identical to SEQ ID NO: 1763

SEQ ID NO: 29819 - DNA, 109 bp, Homo sapiens
gcgtgtgtgcactgaggagtgtgtgcactgaggcgtgtgtgcaccgaggagtgtgtgcactgagcagtgtgtgcaccgaggaatgtgtgcactgaggagtgtgtgcact

SEQ ID NO: 29820 - DNA, 155 bp, Homo sapiens
tgtctgtgggaggtgagatggcgcctcctctccttcctgacacgttcactctgtcagtgtctgtgggaggtgagacaacacctcctctccttcctgacactcactctgtcggtgtctgtgggaggtgagatggcgcctcctctccttcctgacac

SEQ ID NO: 29821 - DNA, 87 bp, Homo sapiens
agtgctgggattataggtgtgagccactgcgcgtggccgtgatgggttagggttggtcagtgctgtgtgtgtctgtgactcagtact

SEQ ID NO: 29822 - DNA, 83 bp, Homo sapiens
gctggcgacgggacattattacttttggtacgcgctgtgacacttcaaactcgtaccgtgagtaataatgcgccgtccacggc

SEQ ID NO: 29823 - DNA, 69 bp, Homo sapiens
cccaggctccccttgctctgtcttgctctgtgacacaatgtgtcacattgtgcagtgtcacaatctggg

SEQ ID NO: 29824 - DNA, 121 bp, Homo sapiens
ctgggtgtcgtgctgcacactcatcccagctactcgggaggctgaggtaggaggatcgattgagcccaggaggtcgaggctggagtgagccatgattgtgccacagccctccagcctgggc

SEQ ID NO: 29825 - DNA, 115 bp, Homo sapiens
gcctggcctcgctgcctgagttctggggctggggctgaggttcttttttttttttttttttaatatggagtctcactctgtcgcccaggctggagtgcagtggcgcgatctcggc

SEQ ID NO: 29826 - DNA, 73 bp, Homo sapiens
accagaagacaagagtgtgagctctctgtcacgcccagataagggctgcttgagggctccttggtctagtggt

SEQ ID NO: 29827 - DNA, 106 bp, Homo sapiens
caggtattatatatttagatatatcaaatatatatctatatatctatgagctatagatatctgaaatatctatatatctgtatgtaactacatatatatattcctg

SEQ ID NO: 29828 - DNA, 131 bp, Homo sapiens
ggcaccccaccaggactctgctcggcagtgtggggcgggcagaggccgccgtggcctctcactgtgcctctggcaatagcgtggtgctggccaaggtcaggactcaaccagtccagcagctgcaggagtcc

SEQ ID NO: 29829 - DNA, 102 bp, Homo sapiens
tgggtgacagagcgatattctgtccctgcaaaaaaaaaaaaaaaaaagtaatggaaattttttttttttttcctctgagacagagtctcgctctgtggccca

SEQ ID NO: 29830 - DNA, 77 bp, Homo sapiens
ctgccctgtaactcagtctctctccctgttaatagccctagtttttaataagaggaactgaatgtattaatgggtgg

SEQ ID NO: 29831 - DNA, 112 bp, Homo sapiens
atacgtacagaaagcaagagcagcccatgccgtccggccgcgcaccaggtctcagtctgtgtgtctggttcaggtgaccatggtgttcagttcagttcctcctgcctcgtgt

SEQ ID NO: 29832 - DNA, 90 bp, Homo sapiens
ccaggttcctggcctcttctccttcagcttcctgtggtggaaatttctgagcctggacagatgagagagagcacattagaacttggggcc

SEQ ID NO: 29833 - DNA, 117 bp, Homo sapiens
gcctcgaggctctgctgtcccttgccacccataggaggttggtctcagggtccctgaaacccaaggatgctcgagtccctgatggaagatggcagagtgtttgcacagagcctaagc

SEQ ID NO: 29834 - DNA, 94 bp, Homo sapiens
tactccccgcccactcggccttgtgctttttcttagtcatatttatatttatctgacaggtcaggaagccaggtgcttgtgtcacggaccagtg

SEQ ID NO: 29835 - DNA, 114 bp, Homo sapiens
ccctgaggctggaaaccactgtcatgttttcgtctaatgattgtgaagttttgtctttaacatactgggcttctatatttggggatttgtttgtatgtgacaggttttgctggg

SEQ ID NO: 29836 - DNA, 112 bp, Homo sapiens
gtcccaggcaggaacctggtggccggcaggtggtgggtgacatgacacggggacctcaccttctctcactgtctcctccacatccagcctccctcaggtccctccatgtgac

SEQ ID NO: 29837 - DNA, 87 bp, Homo sapiens
ccagggcatggcaggcaccctcaaaggcagacgtggggaggccctggtgggcagaccccagcctgctgacggggggcttctccctgg

SEQ ID NO: 29838 - DNA, 91 bp, Homo sapiens
ccaagcatgctgactcatgcctgtaatcccagtactttaggaggctgaggtagaaggatcacttgaggccaggagttcgagaccagcctgg

SEQ ID NO: 29839 - DNA, 70 bp, Homo sapiens
gggtgggcgcctggcggagccgaggtgcaggacgggccgccttgtgtctgtggctccgtgtgtgacaccc

SEQ ID NO: 29840 - DNA, 65 bp, Homo sapiens
gctttctgtctctgaaactgtgtgtgtcaaagacccataagttctgaacctcagagagggaatgc

SEQ ID NO: 29841 - DNA, 88 bp, Homo sapiens
tgagtcagagtctcactctgtctcccaggctggagtgcagtggtgtgatctcagctcactgcaacctctgtctcctgggttcaggtga

SEQ ID NO: 29842 - DNA, 68 bp, Homo sapiens
tctgtgtgtctgcctgtgtgtccgtgcatggtgtgccttgcagccgtcaccccagccagcatcccagg

SEQ ID NO: 29843 - DNA, 104 bp, Homo sapiens
gggacattgtgagaagcaaccagaagacaagagtgtgagctctctgtcacgcccagataagggccgcttgagggctccttggtctagcggtagtgccagtgcct

SEQ ID NO: 29844 - DNA, 99 bp, Homo sapiens
tatcttccagatgtgctgacccttttatcaatataaagtgtctgtctttaaatctagtaacattttttgttttaaagtcagttttgtctggcattggta

SEQ ID NO: 29845 - DNA, 117 bp, Homo sapiens
gcactggattgtactcaaggacttgattgactcgatttccgcatggtattcctcttttttttttttttttttgagacggagtcttgctctgtcacccaggctggagtgcagtggtgc

SEQ ID NO: 29846 - DNA, 111 bp, Homo sapiens
atcacacccttgcaactccatgaggttgagattggtagggcaggtacttttttttttttttttgagacggagtctcgctctgtcgcccaacctggagtgcagtggcacgat

SEQ ID NO: 29847 - DNA, 95 bp, Homo sapiens
tagttattgagagtagagtatgagatctacagtactgtcgaattttacattttcactttcagttctgttggtttttgcctcgtgttttgagacta

SEQ ID NO: 29848 - DNA, 124 bp, Homo sapiens
cctgggggatgcagaacaagcggtcactgtcagtcactcctgggggatggagaacaagcagtcactgtcagtcactcctgcagcagctcaccactcccatcaggacagtcacttcctcttgtac

SEQ ID NO: 29849 - DNA, 100 bp, Homo sapiens
tgtgacctgaggacagaagcccttgtgagtggcagagttgtggtggtgaccacgcagactgctgtgtttcccgtgcacttgcttttttccctcacttcca

SEQ ID NO: 29850 - DNA, 107 bp, Homo sapiens
ggattttccccatccctttaggagagtttcttttatgttaaagcagtggcttttagatctgtttttctttaaatcctggaacttaaaaaaagtcatggagtctgatt

SEQ ID NO: 29851 - DNA, 115 bp, Homo sapiens
ctgctcaaatgctttggggaggcttccttgatgccaattgtatgtttttatttactaaaggtattatatacccttcgcttctaggatggatctcaattctgatgggaatgtgtag

SEQ ID NO: 29852 - DNA, 90 bp, Homo sapiens
tagtgctgggattacaggtgtgagcgactgtgcccggcctggttttttctttttttttttggagacagtctcaccctgtcacccaggctg

SEQ ID NO: 29853 - DNA, 62 bp, Homo sapiens
accatcaagtccaagtgggggaataggagtctccactctcctgattctctctgctttctggt

SEQ ID NO: 29854 - DNA, 106 bp, Homo sapiens
ctgggactataggagtgcgccaccacaactggctaattttttgtattttcatagaagacagggttttaccatgttgtccaggctggtctcgaactcctgagcttag

SEQ ID NO: 29855 - DNA, 94 bp, Homo sapiens
cctggctcctgggcatctctgtgcctctgtctcccacatgttagaatggggatgacctcatggggtattaaagggccaccctagttgataaagg

SEQ ID NO: 29856 - DNA, 57 bp, Homo sapiens
gagacagtctcactgtcacccaggatggagtttagtggtgtgatggtgtgcaatctc

SEQ ID NO: 29857 - DNA, 74 bp, Homo sapiens
gctcactggggacgtttatgggtcctcctaggccccttacttgggagggactgtgtctgtgattctcaggaagt

SEQ ID NO: 29858 - DNA, 80 bp, Homo sapiens
agccagactgacccacactccgtccctcagctgcgagacagtcgaggccgggctgtttgtggtcgtgtcagaccctggct

SEQ ID NO: 29859 - DNA, 58 bp, Homo sapiens
tgagacagagtctcactctgtcgcccaggctggagcgcagtggtgcgatctctgctca

SEQ ID NO: 29860 - DNA, 96 bp, Homo sapiens
cacctcagcctctagagtaactggaactacatatgtgtgcaagtacaaccagttaactttttaatatttatgtagggacagtgtctggctacggtg

SEQ ID NO: 29861 - DNA, 95 bp, Homo sapiens; identical to SEQ ID NO: 68

SEQ ID NO: 29862 - DNA, 93 bp, Homo sapiens; identical to SEQ ID NO: 69

SEQ ID NO: 29863 - DNA, 110 bp, Homo sapiens
tgcttaggattgtcttggctataagggctcttttttagttccatatgaaatttaaagtagttttttctaattctgtgaagaaagtcagtggtagcttgatgggaataaca

SEQ ID NO: 29864 - DNA, 103 bp, Homo sapiens
gtgaaagccaggcagatgtgggggtttgggtattaggtctgtggtattgggtgcatgttacacagtggatgttcttattcctgctcatgcctgtggtgatcac

SEQ ID NO: 29865 - DNA, 87 bp, Homo sapiens
actgtgcctgagaaaaattgcataatcatagtatcttcttcccttggatggtgctattgtttgtaaagaactttctcagaaataagt

SEQ ID NO: 29866 - DNA, 107 bp, Homo sapiens
ctagaagattgaatttcagactgtaaatgtggtgtgcacatttgtctctgagtgagactttgcatcccagctgttgaaacatttgtgggaaggtgaaagttttgtgg

SEQ ID NO: 29867 - DNA, 83 bp, Homo sapiens
gtagtggcagggtttgagaagattgactccacttttgaaagaagttctattgtgggtaaaatactcttaaacacagcagctac

SEQ ID NO: 29868 - DNA, 106 bp, Homo sapiens
agcaacttcctgaagatggatttcaaggcttgacgttctgccagacacactgtctgactaacctttgtgtctcagaattagatctgtcccatctcccttaggtgct

SEQ ID NO: 29869 - DNA, 87 bp, Homo sapiens
gtgtgcatatgtatttatatgtgtgtgtatgtatgtatgtatatgtatgtgcatatatatgtgtatttatatgtgtgtgtgtgtata

SEQ ID NO: 29870 - DNA, 101 bp, Homo sapiens
tactattcactatgtagttgggtaaattagttttattttctaagattcagtttcctgagctctggagtaggcatgcactttatttggcaattgtgagggta

SEQ ID NO: 29871 - DNA, 98 bp, Homo sapiens
cattgctggtcctactgtttgcaggtgcttgggaaactttgtccctctcagtaactcagtttctgtatctgtcagggaagagaattggcctagaggac

SEQ ID NO: 29872 - DNA, 82 bp, Homo sapiens
cttggcatcagggagctagggagattcttcttgtgtgttttttttttttttttttttgacggagtctcgctctgttgcccag

SEQ ID NO: 29873 - DNA, 58 bp, Homo sapiens; identical to SEQ ID NO: 14767

SEQ ID NO: 29874 - DNA, 56 bp, Homo sapiens; identical to SEQ ID NO: 14768

SEQ ID NO: 29875 - DNA, 86 bp, Homo sapiens
tagaaaactgagacacacagtctgatacatttttgtgccatttctggacacaagaagcagactgtaaggtatcagttggttttcta

SEQ ID NO: 29876 - DNA, 84 bp, Homo sapiens
agaaaaccaactgataccttacagtctgcttcttgtgtccagaaatggcacaaaaatgtatcagactgtgtgtctcagttttct

SEQ ID NO: 29877 - DNA, 116 bp, Homo sapiens
ggggaggtgcaggggatggatgagaagccagctagagccctgggcagaggcaaagagagcagactgtgaggacatctgaatggcttcattttcacttcctcactctgcttttcctc

SEQ ID NO: 29878 - DNA, 108 bp, Homo sapiens
tgtatcctgtttttaaaagctaacaaatacagtgtttttatatgactatagacatcacgtttatagttttttattgatacacagtatcttacgtatttatggggtaca

SEQ ID NO: 29879 - DNA, 95 bp, Homo sapiens; identical to SEQ ID NO: 68

SEQ ID NO: 29880 - DNA, 93 bp, Homo sapiens; identical to SEQ ID NO: 69

SEQ ID NO: 29881 - DNA, 95 bp, Homo sapiens
gggtgtggtgcgtgcctgtagccccagctactagggaggctgaggtggaaggatcacttgatcctgggaggttgaggctacagtgagccatgaac

SEQ ID NO: 29882 - DNA, 95 bp, Homo sapiens
tctggtcccagctacttggaggctgaggtaggaggatcgcttgagcccaggaggtggaacctagagtaagccaagatcatgccactgcactccaa

SEQ ID NO: 29883 - DNA, 65 bp, Homo sapiens
gtgcaaggtgagatgatgtgatgatgtgcagtgtgtcagtgtcagtcacactgtcatctttgcat

SEQ ID NO: 29884 - DNA, 117 bp, Homo sapiens
gggatggtcgaggagagcttaggggctaaaaataaaatggagttgtttgggtcggatctctttcactgtctcagtcacaattttgtaatggtagtttcaaaagctgcctatcactcc

SEQ ID NO: 29885 - DNA, 190 bp, Homo sapiens
tgtatatatgtgtgtatatatgtgtgtatatatgtgtatatatgtgtgtatatatgtatatatgtgtatatatgtatacatgtgtatatatgtgtatatatatgtgtgtatatatgtgtatatatgtatatatatgtgtatatatatgtgtatatatatgtgtgtatatatatgtgtatatatatacata

SEQ ID NO: 29886 - DNA, 648 bp, Homo sapiens
tacatatatatgtgtacatatatgtatatacgtgtatatatgtgtatatatgtatatatatgtgtatatatgtatatatgtgtatatatgtatatatgtgtatatatgtatatatgtatatatgtatatatgtgtatatgtgtatatatgtatatatgtgtgtatatatgtgtatatatgtgtatatatgtatatgtgtgtatatatgtatatatgtgtatatatgtacatacatgtgtatatacgtatatatgtgtatatatgtatatatgtgtatatatgtatatatatgtgtatatatgtttatatatatgtgtatatatgtatatatgtatatgtgtatatatgtatatatgtatatatgtatatatgtatatatgtgtatatatgtatatatgtgtatatatatgtatatatgtgtatatatgtatatatgtgtatatatgtgtatatgtgtatatgtgtgtatatgtgtatatatgtgtatatgtgtatatgtgtatatatgtatatatgtgtatatatacgtatatatatgtgtatatatacgtatatatgtatatatacgtatatatgtatatatgtgtatatatgtatatatgtgtatatatgtatatatgtatatatgtgtatatatgtgcatatata

SEQ ID NO: 29887 - DNA, 85 bp, Homo sapiens
tcctgtctcagcctccatagtagctgggactacaggtgctcgccaccatgcccagctaattttcatatttttagtagagacaggg

SEQ ID NO: 29888 - DNA, 120 bp, Homo sapiens
tctcctctgtaaagttttgattagtgggaaaaagaattcgtgaggctagtcttaaactgtagtgaatctgttgtactttgtgctatgaatttgtctttccatatctttctgtcagaaaga

SEQ ID NO: 29889 - DNA, 64 bp, Homo sapiens
tgcctgtgtctgagtgtgtgtgtgcctgtgtgctgcaggcgggagaggctgctctggctcggcg

SEQ ID NO: 29890 - DNA, 116 bp, Homo sapiens
gtgacttgaaatgatttcatttgtcagcggctgtgtagtttgcattgtaatgaagaaagcaaactttaccacttcaaatacaagtagattatgtttcgtttgaccgtttttagtac

SEQ ID NO: 29891 - DNA, 76 bp, Homo sapiens
gggggaaaaaaaaacacttgtcactggaatgagggctccccagtctcttccagcctctcactgtttgtctgccctt

SEQ ID NO: 29892 - DNA, 58 bp, Homo sapiens
tgaggtggagtctcactctgtcacccaggctggagtacagtggcgtgacctcagctca

SEQ ID NO: 29893 - DNA, 90 bp, Homo sapiens
tcttgacattcttttgttgtttaattctttagaatcttaataaatgtttttttaatcctgagaaattaaacggtagtagacttgttaaga

SEQ ID NO: 29894 - DNA, 58 bp, Homo sapiens
tgagacagagtctcgctctgtcacccaggctggagtgcagtggcgtaatctctgctca

SEQ ID NO: 29895 - DNA, 116 bp, Homo sapiens
gtctatggaagtagaatgtacaggaaattggcttgaaatgttagtactgggatttttttttttttttttgtacctaggaattttaccaaaagcctgtttttcataaagtctcagat

SEQ ID NO: 29896 - DNA, 80 bp, Homo sapiens
ttttgaattcccaggtaagtatgtgcgtgtgtgtgtaagtccatgtgtgtgcacacacacacatgctgtctctttcaaaa

SEQ ID NO: 29897 - DNA, 92 bp, Homo sapiens
tgggggaaaaaaacaaaaaacaaaactccacttaattgaggacactgcactttttttttttttttgagatggagttttgctcttgtcgccca

SEQ ID NO: 29898 - DNA, 92 bp, Homo sapiens
tcacatgttcaaagtcagagaggaaatgggaagccagaatctaagcccagctggccactctctcagaaactcagtgctgctctgcacatgga

SEQ ID NO: 29899 - DNA, 75 bp, Homo sapiens
tgcagctcctgcttggacagacagaacagtgtctggagactcacattgtgaacttttgcttcaagaaccactgca

SEQ ID NO: 29900 - DNA, 96 bp, Homo sapiens
tattcaattctgtttggagtacagacttataggctttctctttttttttttttttgagacagagtctcgctgtgtcgcccaggctggagtgcagtg

SEQ ID NO: 29901 - DNA, 100 bp, Homo sapiens
ttgttgttgttgttgttgagacaaagtctcgctctgtcaccctggctcaagtacagtggcatgatctaggctcactgcaatctccgcctcccagcttcaa

SEQ ID NO: 29902 - DNA, 109 bp, Homo sapiens
cagattataccttgtttatataggcatatatttacctattacctatatataatatgtatatataagcaacaggctgtatatacctgtttattatatagggatatatttg

SEQ ID NO: 29903 - DNA, 81 bp, Homo sapiens
gctcagagtaaggtcatgtgctactcaaaaattacctctttatttgattatagtagtaatttagactgcattatactgagc

SEQ ID NO: 29904 - DNA, 98 bp, Homo sapiens
aagtttttctagttctgcattcacagtctggctgttatttgtgctttcaattcataattgttgttgactgaagacagaatgacttatgaggaagattt

SEQ ID NO: 29905 - DNA, 59 bp, Homo sapiens
gtataacactgagattagtgaaaggcccttcctgacagtcattgagtctcaggtaatac

SEQ ID NO: 29906 - DNA, 86 bp, Homo sapiens
tacattttttacttgccaattgataaattgtagttgtgtatatttacatggtacagagtgatcttatggcttatgaatacaatgtg

SEQ ID NO: 29907 - DNA, 95 bp, Homo sapiens; identical to SEQ ID NO: 68

SEQ ID NO: 29908 - DNA, 93 bp, Homo sapiens; identical to SEQ ID NO: 69

SEQ ID NO: 29909 - DNA, 85 bp, Homo sapiens
gggaatggaaaggaccaagatagaggtgagagtgagcactgtgctttggcggcgctccagtggttcttgatcacgatgccgtccc

SEQ ID NO: 29910 - DNA, 77 bp, Homo sapiens
gtgtgtgtgtgtgagtgtgtatatatattgtgtgtgtgtatatatatatatacgtatatgtacatatataatataca

SEQ ID NO: 29911 - DNA, 82 bp, Homo sapiens
agaggctgggtgggccacagaagaggaaattggactccaaacttctcttgtttctgtgcatctccatgtcaagcaattctct

SEQ ID NO: 29912 - DNA, 110 bp, Homo sapiens
gcccagggctcagagtagatgagtaaccagagctcagaagtgagagagctgggacttgaaccctctcactccaaactccatggtaatcatcttgtcagctgtcctgtggc

SEQ ID NO: 29913 - DNA, 58 bp, Homo sapiens
tgagacagagtctcactctgtcacccaggctggagtgcagtggcgagacctcagctca

SEQ ID NO: 29914 - DNA, 95 bp, Homo sapiens; identical to SEQ ID NO: 68

SEQ ID NO: 29915 - DNA, 93 bp, Homo sapiens; identical to SEQ ID NO: 69

SEQ ID NO: 29916 - DNA, 106 bp, Homo sapiens
tctgggaaaatttatatgcctgtgtgtgtccctttctccctgtttgtatttatatattcacacagttgtagaaacatttacactcatatataaacatatgcccaga

SEQ ID NO: 29917 - DNA, 92 bp, Homo sapiens
attctgtgagtagataactaattatttgagacccaaattctggtctcccagaatttggtacctcatttttttttttttttttgagacagagt

SEQ ID NO: 29918 - DNA, 102 bp, Homo sapiens
ctgccatctttctccccaggtttaaagaaagtttaacgaataggaaaaataaaagtattgattattttttaatttgtgcgttccctgtaggaagcctcgcag

SEQ ID NO: 29919 - DNA, 65 bp, Homo sapiens
gagcatcgtgattgtccaacgttccacctgataagggaaaacagttgacagaagataggatgctt

SEQ ID NO: 29920 - DNA, 87 bp, Homo sapiens
tctgttaggtggaaagtataattctttttcaattacatggattaattttttttttttttgagatggagtcttgctctgtcacccagg

SEQ ID NO: 29921 - DNA, 102 bp, Homo sapiens
gctctcactcttttgctctccctctcacactctatctctgaaaggtgtctatctggtcactgtagattggatgtgctgtgagtggtccctctagagtgaagt

SEQ ID NO: 29922 - DNA, 73 bp, Homo sapiens
gagacggtgtctcgctctgtctcccacgttggagtgcagtggcgcgatctggggtcagtgcaagctccgtctc

SEQ ID NO: 29923 - DNA, 115 bp, Homo sapiens
aagggttccaatttctctacaacctcacagcttattatttcctgttttttttttttgatggtaaccattcaaaaatggttgaggtgatatctcagtgtggttttgatttgccttt

SEQ ID NO: 29924 - DNA, 66 bp, Homo sapiens
agtggctgttctgatgagtcagagcacactctttgggggcatgttttgcttatggaacaagtgact

SEQ ID NO: 29925 - DNA, 64 bp, Homo sapiens
tcagtgtgctgtgtcactgtttgtcttggcctttttcggctgtgagcagcagcagcgtaaatga

SEQ ID NO: 29926 - DNA, 68 bp, Homo sapiens
agatttgagtgggacacatacacactcacacaggggcatgtaaactgtagtccctatgaggcaaatct

SEQ ID NO: 29927 - DNA, 68 bp, Homo sapiens
gaggttgcagttagctgagatcatgccactgcactccagcctggcgacacagtgagactgtctctctc

SEQ ID NO: 29928 - DNA, 198 bp, Homo sapiens
tatatatctataaataatagatatccataatagctagatgtctataagttatagatatataatatatattatatatattatatattatatatatattatatatatctgttatttatatatatctgttatttatagatatatatctatctattatagatatctattatttatagatatatatctattatagatatctat

SEQ ID NO: 29929 - DNA, 154 bp, Homo sapiens
tagatatatatctataaataacagatatatataaataacagatatatataatatatatataatatataatatatataatatatattatatatctataacttatagacatctagctattatggatatctattatttatagatatatatctatata

SEQ ID NO: 29930 - DNA, 92 bp, Homo sapiens
gtgagttgggacttggacagtgcaagttttttcatgcattcagaacagcactgcaatttaaagcttatggattgtttatttctggaacttat

SEQ ID NO: 29931 - DNA, 74 bp, Homo sapiens
atacagaacctgcagatacatatggtcaactgcttgtaactgttgactaaccgtgtgtgtgtgtgtgtgtgtgt

SEQ ID NO: 29932 - DNA, 95 bp, Homo sapiens; identical to SEQ ID NO: 68

SEQ ID NO: 29933 - DNA, 93 bp, Homo sapiens; identical to SEQ ID NO: 69

SEQ ID NO: 29934 - DNA, 95 bp, Homo sapiens; identical to SEQ ID NO: 68

SEQ ID NO: 29935 - DNA, 93 bp, Homo sapiens; identical to SEQ ID NO: 69

SEQ ID NO: 29936 - DNA, 95 bp, Homo sapiens; identical to SEQ ID NO: 68

SEQ ID NO: 29937 - DNA, 93 bp, Homo sapiens; identical to SEQ ID NO: 69

SEQ ID NO: 29938 - DNA, 89 bp, Homo sapiens
gtactcgataagattactgtatttatatatatatatatatatattatatatatatatatatataatttatttatttatttttttgatac

SEQ ID NO: 29939 - DNA, 98 bp, Homo sapiens
cttgctgtacgttctcccctagattttttaataaattacaaagctgacttttagatgttctatttatttaattttctcaggatgaaaatgttagtgag

SEQ ID NO: 29940 - DNA, 102 bp, Homo sapiens
taattactcacttgtccctataggtattcaaagagagactaaatgactgtattagtcagttctcacagtgctgataaagacatacccgagaatgggtagtta

SEQ ID NO: 29941 - DNA, 115 bp, Homo sapiens
tggatgactagtgaaaatattgttctgggatagagaaaaaaagctaggagaagcaaaataattttttttcaacttttttgtacatgttaagtttgagatgcctattagacatcca

SEQ ID NO: 29942 - DNA, 83 bp, Homo sapiens
gataggaatgcgtgtagtactgcgtgacatcatttaaatgaaagttgccctgtagtcttgtcatttttttgtgcatttctttc

SEQ ID NO: 29943 - DNA, 65 bp, Homo sapiens
gctcactattctgaataccacattttcgacccaggaagacagtgagaattcactgaacagtgagc

SEQ ID NO: 29944 - DNA, 63 bp, Homo sapiens
tgccttctgttcctgttcctgttccttctgtgcacagaactagagagagaggacagacaggca

SEQ ID NO: 29945 - DNA, 77 bp, Homo sapiens
cacagaatctctgtggcactgagtcagagttgtggtgatggtggctctggtctttgtagcctgcctctcttcgtgtg

SEQ ID NO: 29946 - DNA, 95 bp, Homo sapiens; identical to SEQ ID NO: 68

SEQ ID NO: 29947 - DNA, 93 bp, Homo sapiens; identical to SEQ ID NO: 69

SEQ ID NO: 29948 - DNA, 93 bp, Homo sapiens
actctgcctcacagcagtgagtgagcactctgactctccacctggataataagctttttaagagcagaggctgcacctcacttctttcagagt

SEQ ID NO: 29949 - DNA, 80 bp, Homo sapiens
gattgaagctcagcatggagcattagatataatcccttggtaggtcccttccaagtgagattttgttcttgagttcaatt

SEQ ID NO: 29950 - DNA, 120 bp, Homo sapiens
tgcttatgcctgcaaggagctcacagtggagatacagatatacacacagtcactctgtgatacttggacatggctgaaattcactgagattttggagggagaaaggaagaaaaggagagc

SEQ ID NO: 29951 - DNA, 94 bp, Homo sapiens
tgccaggcctctgtcatagtatggatcacataatttggaaacagctagcctagctgtctgtctctgtgacttaactgtgaactccttaagggca

SEQ ID NO: 29952 - DNA, 95 bp, Homo sapiens; identical to SEQ ID NO: 5211

SEQ ID NO: 29953 - DNA, 95 bp, Homo sapiens; identical to SEQ ID NO: 68

SEQ ID NO: 29954 - DNA, 93 bp, Homo sapiens; identical to SEQ ID NO: 69

SEQ ID NO: 29955 - DNA, 95 bp, Homo sapiens; identical to SEQ ID NO: 580

SEQ ID NO: 29956 - DNA, 93 bp, Homo sapiens; identical to SEQ ID NO: 69

SEQ ID NO: 29957 - DNA, 68 bp, Homo sapiens
atatgtgtgtgcatatatatatatatatactgtgtgtgcatatatatatactgtatgcatatatatat

SEQ ID NO: 29958 - DNA, 86 bp, Homo sapiens
gttctaatgtctagtccagggctttttctccaactggctttaaaaaagggagttagctagaaggttgtagggattaggagtggggc

SEQ ID NO: 29959 - DNA, 63 bp, Homo sapiens
ggagcaagcatccaagagtcctgtctcccaatggagtcagtactgaatgagctgactttctcc

SEQ ID NO: 29960 - DNA, 85 bp, Homo sapiens
gtagccatttcattcatcctttcatttttgtggccaccaagtatttggtgagctctgaaaagagagtgagcaccagaatggtttc

SEQ ID NO: 29961 - DNA, 88 bp, Homo sapiens
ctgggcagtagctgtactgcaggaactattttttaaaataaacttttttattttagaatagatttagatttatagaactattgcaaag

SEQ ID NO: 29962 - DNA, 125 bp, Homo sapiens
gaatggggccaggtgcagtggctcatgcctataatcccagcacttttagaggctgaggtaggaggatcacttgaggccaggagttcaagaccagcctgagcaaaacaggaagaccctgctgtgga

SEQ ID NO: 29963 - DNA, 116 bp, Homo sapiens
gagataagagtgtgacccaaggagtcctccaaaacgtgtccactacaagaatgttaaatttatacttttaaatgttatgaagtaaatgtcactggaggatttgttatgtttttctc

SEQ ID NO: 29964 - DNA, 111 bp, Homo sapiens
ggcatccagctagttcagcgtcactattatcagtcttatcagtgcctttctcagagcagggttggatggtacccactgtatggtagcaaaagagctcgagcttttggagct

SEQ ID NO: 29965 - DNA, 78 bp, Homo sapiens
attcatagggtgggtgggtgtgaatattatctgtatgccaaattgattatgatttttactatactacttcctgtggat

SEQ ID NO: 29966 - DNA, 114 bp, Homo sapiens
aggaagacaggaattaattggtcagtactttccagtggttttatgttgctgtcatgatattattttctttaaactgtatatttaactattgctgatgtaacggggtttctgcct

SEQ ID NO: 29967 - DNA, 80 bp, Homo sapiens
gggtctcactctgtcactgaggcttcagtgcagtggcactatcacagctcagctcattgcagccttgacctcctggactc

SEQ ID NO: 29968 - DNA, 106 bp, Homo sapiens
aactgagtcagtgtttgtggattattgtttttctaacgtaatggatataaaattatatgtctattcttttgaaaattagcacatcaaataaattctagctctagtt

SEQ ID NO: 29969 - DNA, 74 bp, Homo sapiens
ggaatttgtgcaatgatgtgtggcatttttacctcttgggtgaaaggtcaggtccatcatgtggccagaaagcc

SEQ ID NO: 29970 - DNA, 93 bp, Homo sapiens
tgctagaaaaaggaaggtcttgaatctggctttacagacattttcacttcaggtctagtgattctgttcttggctaaatcttcttgtgaggca

SEQ ID NO: 29971 - DNA, 100 bp, Homo sapiens
cagcttgtaccctgtcacctgagattcagatttagtagttctgaagtgggactcaaaatatatgctaacgtttttctaataggtgtaagagggtcaattg

SEQ ID NO: 29972 - DNA, 96 bp, Homo sapiens
ttcaagttcatttggtccaggcagttacattcagggactttatgaatactgactcactgtctcattcaaatggagcagtctggatgtggactggga

SEQ ID NO: 29973 - DNA, 115 bp, Homo sapiens
aagaaatggaatttttggactatgaatgctcctggccttaaaaaaagaatttttcattttaaagttcctaagcagagttcagtgcttactatcaagttggagtggttcttttctt

SEQ ID NO: 29974 - DNA, 80 bp, Homo sapiens
agtattgcagggaatgataagtagtctagtagtgccgaggtgctaaagtactgctgtagttactttgtaattctgtttgc

SEQ ID NO: 29975 - DNA, 95 bp, Homo sapiens
tcacctgagaggactgtgcctgacaatcactttgctgtttttttgtttatttaataaacattcatggagtgcttgtgtgcaaagcattgggttga

SEQ ID NO: 29976 - DNA, 69 bp, Homo sapiens
agtgtgcatgtgtgagtctcgctctgtcacccaggctggaggagtgtagtggtgcaatcttggctcact

SEQ ID NO: 29977 - DNA, 69 bp, Homo sapiens
gatcagtatctatctctctctcaggctgaagctggcatcagccagtctcacttgtgggataattaattc

SEQ ID NO: 29978 - DNA, 136 bp, Homo sapiens
taggtgtgagccactgtgcctggcctaggctcttcagtttatgttacaaactttttttttgagatgaggtctggctctgtcactcaggctggagtgcagtggtgcagtctctgccttcagggctcaagccatcctc

SEQ ID NO: 29979 - DNA, 68 bp, Homo sapiens
tgttaccatttatgtttttcattttagctgttgtgagaacaaactagaaggagaaaagaatggaagca

SEQ ID NO: 29980 - DNA, 66 bp, Homo sapiens
tatatatatacatgtatgtatatacatgtatatatgtatgtgtatatatatacgtgtatatatgta

SEQ ID NO: 29981 - DNA, 289 bp, Homo sapiens
atttatatatatatatgtatatatatatgtgtgtatatatatatgtatatatatatgtgtgtatatatatatgtatatatatatgtatgtgtatatatatgtgtgtatatataagtatatatatatgtgtatatatatgtatatatatgtgtgtatatatgtgtatatatatacacacaaatgtttatatatactatatatgtttatacatatgtttatatatatacatatataaatgtgtatatatatatatacatatatgtgtatatacgtgtatatatatacatat

SEQ ID NO: 29982 - DNA, 114 bp, Homo sapiens
ttttaaaattctggacctaaaattcagaatcaaaattttaatttttattaatgtctgatgacaaatgttattattattttctgaggtcaaggtttctcagtgtgacttttaaga

SEQ ID NO: 29983 - DNA, 74 bp, Homo sapiens
acacggaagttttattcttgtatatttagatttgtatgcttgtgagtaaaaatgtgcatttgtaaatactgtgt

SEQ ID NO: 29984 - DNA, 138 bp, Homo sapiens
tgggtttttgttgttgttgttgtttggttttgttgggttttttgtttttttgttttttttgagacagagtctcactctgtcacccaggctggagagcagtggtgcgatctcagctcactgaaacctctgcctcctggg

SEQ ID NO: 29985 - DNA, 98 bp, Homo sapiens
atccagctgacagccagacaatctctaaaactgtgagctaaataactggttgttgttttaagccactaatttggggactgtttgcaacacagcaagat

SEQ ID NO: 29986 - DNA, 78 bp, Homo sapiens
gacaggctctgtctctgaaagtagcttggtgagtgtaaaggcaccatgcagagcacagactggaaagagaaccctgtt

SEQ ID NO: 29987 - DNA, 98 bp, Homo sapiens
acacaagaagtaaatggcagagccagaatttgaacctgtatctgcctgactcacagtctgtgtttgtagttcttttctgctactctgcctccttgtgt

SEQ ID NO: 29988 - DNA, 95 bp, Homo sapiens
gccccagggcaggatatcattgattcaacacctaaatgttggcctcctggagcatacagcagagtgaagagagtgaagatttgatatggaggggc

SEQ ID NO: 29989 - DNA, 70 bp, Homo sapiens
tttcctgattattattattattattacggtgtttggtggtggtggtggtggtaaggatggagttaggggg

SEQ ID NO: 29990 - DNA, 117 bp, Homo sapiens
cactgtgactcatgttagagacagtggaagtgttgagacaggctgtagggtcaagtgtgtgagcagagtgacccacatgttcaggcactggtgccatgaatcaggtgggtaacagtg

SEQ ID NO: 29991 - DNA, 79 bp, Homo sapiens
gcttccctccctgtgtccctgtgttctcattgttcagctcccgcttataagtgagaacctgtggtgcttggttttctgt

SEQ ID NO: 29992 - DNA, 83 bp, Homo sapiens
tgtatgtatgtatgtatgtatgtgtgtatatatgtgtgtgtgtatgtatatatgtatacacacatatataatacatacatata

SEQ ID NO: 29993 - DNA, 119 bp, Homo sapiens
gtatttgcatataacctatgcacacacatatatatgtgtatatatatgtgtgtgtgtatatacatatgtatatatgtgtgtgtgtgtgtgcgtatatatatgtatgtatgtatatacat

SEQ ID NO: 29994 - DNA, 101 bp, Homo sapiens
gaggggatctcctgacctggggttgcaaagatctgtgggagaagcatgggtccccggatcgctcactcactcaccgcttccctgggtaggggacgctcctc

SEQ ID NO: 29995 - DNA, 102 bp, Homo sapiens
tcttttggacctaacaggtgtctctaaatcccctctttacaatagcaaacatttgcattgtaaagaagcatttgaggaaaaaaagaaagaaagtccaagaga

SEQ ID NO: 29996 - DNA, 95 bp, Homo sapiens; identical to SEQ ID NO: 68

SEQ ID NO: 29997 - DNA, 93 bp, Homo sapiens; identical to SEQ ID NO: 69

SEQ ID NO: 29998 - DNA, 117 bp, Homo sapiens
atggatctcggagctggcgctctggagtgagctactgacactctcacagtctcggcatctctgtaagattagaacagtaattctcacatcctaagttgtgagactttaaagactcat

SEQ ID NO: 29999 - DNA, 83 bp, Homo sapiens
gagatgagggtgtggggtcagtgggagaagactttctatttatttttgagacagggtctcgctatatggcccagactggtctc

SEQ ID NO: 30000 - DNA, 88 bp, Homo sapiens
actgggtcaaacattatatatatttggtatgttgatagatattgccaagatgtctaccaaaaaggctttaccagtttatgctcccagt

SEQ ID NO: 30001 - DNA, 72 bp, Homo sapiens
tcagcttcttaaagcatccccttcctttgcacttgaataaaagtgcatctggaactggataattcgctctga

SEQ ID NO: 30002 - DNA, 69 bp, Homo sapiens
cttggtggcttaagacaacagaaatttattatttcatgatttcatgatgccttgcagccaaaaaccaag

SEQ ID NO: 30003 - DNA, 58 bp, Homo sapiens; identical to SEQ ID NO: 3079

SEQ ID NO: 30004 - DNA, 95 bp, Homo sapiens; identical to SEQ ID NO: 68

SEQ ID NO: 30005 - DNA, 93 bp, Homo sapiens; identical to SEQ ID NO: 69

SEQ ID NO: 30006 - DNA, 71 bp, Homo sapiens
ggtctggaggctgagagattggtgatagagcaggggaaaaaatcattctgtcaccctctctgcttcttccc

SEQ ID NO: 30007 - DNA, 88 bp, Homo sapiens
ctcaaccttctaatatccttctctaaaatttgtattttttagcaaccatgtttattgcaaaaccttcttggggaagggggaaggtggg

SEQ ID NO: 30008 - DNA, 87 bp, Homo sapiens
gagatgtacatttctctgtattttatgttgtcatatacattatttgtttatgatcttatgatttctaataactgagatatacatttt

SEQ ID NO: 30009 - DNA, 118 bp, Homo sapiens
ggacttccagtactatgttgaatagaagtagtgagagtgggcattcttgtctgattccagttatcagagggaatgctttcaactattccccattcagtattatgttggctgtgggttt

SEQ ID NO: 30010 - DNA, 97 bp, Homo sapiens
caccgtggctcatgcctgtaatcccagcacttttggaggccaaggtgagtggatcacttgaagtcagaagtttgagaccagcctggccaacatggtg

SEQ ID NO: 30011 - DNA, 89 bp, Homo sapiens
gtgttgaagctttgggcatgacctagtaggtgactcttaggtgcagtggtcagttgtcaggctcttgctcagtcatgtggctcccatac

SEQ ID NO: 30012 - DNA, 58 bp, Homo sapiens; identical to SEQ ID NO: 637

SEQ ID NO: 30013 - DNA, 58 bp, Homo sapiens; identical to SEQ ID NO: 2248

SEQ ID NO: 30014 - DNA, 79 bp, Homo sapiens
ggctcagagaagagtgactgctgaatctataaactgccctcagctttgcaagaccagccatctgacttttctgtgagtt

SEQ ID NO: 30015 - DNA, 95 bp, Homo sapiens; identical to SEQ ID NO: 68

SEQ ID NO: 30016 - DNA, 93 bp, Homo sapiens; identical to SEQ ID NO: 69

SEQ ID NO: 30017 - DNA, 82 bp, Homo sapiens
catatatctatatatgaatatctagaacttgatatatacatacacatatatggctatcattttcttattttatggatatatg

SEQ ID NO: 30018 - DNA, 102 bp, Homo sapiens
ctgtaacttggaactggagaggaggcaagatgctggcatagctgttgaactgggaacctgctatgccaacatattgccatctttcctgtctgacagcagcca

SEQ ID NO: 30019 - DNA, 78 bp, Homo sapiens
tgtacttcatgtgtgtgggtgcattttatatttatatttatatatatatatatacacacacacacatacatatgtata

SEQ ID NO: 30020 - DNA, 106 bp, Homo sapiens
ccaatttaagaattttaggttcttaagtaatctgtgattttatttttaacctaaacattaaacagaagacagaggctattcttgagaatcttagaatctctttagg

SEQ ID NO: 30021 - DNA, 107 bp, Homo sapiens
ccagctttgttctttttcattaggattgtcttggctatatgggctcttttttggttccatatgaaatttaaagtagttttttctaattccgtgaagaacgtcaatgg

SEQ ID NO: 30022 - DNA, 98 bp, Homo sapiens
gatgtggtttgtctcaccctgccttatcacaaggttcttacccccgagtttggggtgaggttcaaggaagaatgagaatatgactcagatgccccatc

SEQ ID NO: 30023 - DNA, 133 bp, Homo sapiens
atgcatgtgtatttgtatcaacatatttatatatatcaacatatttatatatatcaacatatttatatatatcaatatgtttatattgatataatatacatagatatatagatatgtccatataaatacatat

SEQ ID NO: 30024 - DNA, 109 bp, Homo sapiens
ttaatacttgtaaagcacttggaacatggtaagtactgaatgtgttaattatgatgatgatgatgatggtatactagctactgcatgaggtgctgagaatagagattga

SEQ ID NO: 30025 - DNA, 110 bp, Homo sapiens
gtgtgtatgtgtgtgtgtgtgattctacatattctataaaagtctctctatagaatataaagaattcaagtaagtatatatacacacgtacatacttgaattctttatgt

SEQ ID NO: 30026 - DNA, 94 bp, Homo sapiens
cttagcagctggcagaacccccacactggctccctgactggtaaagtgatggctattacagtgggaaaggccagatggaagccattcgagctgc

SEQ ID NO: 30027 - DNA, 119 bp, Homo sapiens
ccaatctggcacagaaaaaaagggtcattaatgcttgctctacacctcacagaacagactgtgtagtatagcattttcataatgcaatttgcttttttcttctttagcttgactattgg

SEQ ID NO: 30028 - DNA, 87 bp, Homo sapiens
taaagttgtttcagcagtagtttaaggttggttactaatgcaacacctctttgcatgcaatggcccattaaattatcttcaacttta

SEQ ID NO: 30029 - DNA, 88 bp, Homo sapiens
gctggcacctgggctgattctctctagtgattatgtagttttgatgtggactggcattcttccctggagtttgagtacctccgtcagc

SEQ ID NO: 30030 - DNA, 108 bp, Homo sapiens
ctttaatttaagaaagggaccaataaaacctggacaatgcaggatgtgacccagtgctctgacactgacacagacaaacaggtgactcaacacccgaatgatagaaag

SEQ ID NO: 30031 - DNA, 109 bp, Homo sapiens
agtcaattagttatccatttgttgatctcatatattaactgagtgcatgttgttttataggcactgggctaattttgtagtaatgatattggacaagttagatatggct

SEQ ID NO: 30032 - DNA, 84 bp, Homo sapiens
tgtatattctcatttctacagttctcattcattctctctgtctctccatatatatatatatatgagaattgtagaaattgtaca

SEQ ID NO: 30033 - DNA, 103 bp, Homo sapiens
atgtgcaggtttatttattttagtttcagggttacatgtgcatgtttattattatattttagtttcagaagtacatgtgcagggatttaggtaaactggatat

SEQ ID NO: 30034 - DNA, 112 bp, Homo sapiens
tcccactttatccttccttttgctttgcagctgctcagtgaaggagagacttcgttgaagagtattgaatttggtgatgtgtaagagacctgggaagtagagtgccaatgga

SEQ ID NO: 30035 - DNA, 90 bp, Homo sapiens
gacaacggttttctatgtctgtgaggtattctggctgtgtcctaccattagatgattgcttcatcaggcaggttctctttccacagtgtc

SEQ ID NO: 30036 - DNA, 99 bp, Homo sapiens
ctatgggaagatgactatatggttcttgttttctagtctgttgataagatgaattattaattgattttaaaatgttgagccaaacctttattcctatgg

SEQ ID NO: 30037 - DNA, 89 bp, Homo sapiens
tagtccatttacattcaaggctagtattcatatgtgagactttaattctgtcttcatgttgctagttggttgttttgtagatttgattg

SEQ ID NO: 30038 - DNA, 107 bp, Homo sapiens
atttcttcctacacaagttaatcaagcgtggtggacgggatataataaaagtgaatctttattttttacttctgtgtccctttaacatttgttcagttgtgagagat

SEQ ID NO: 30039 - DNA, 118 bp, Homo sapiens
cttacttccatctttgcccctatttatattatatataatatattttgtatattatttatattatgtatatgctgtatatattatagagagagacagacacagagagagagattgtagg

SEQ ID NO: 30040 - DNA, 118 bp, Homo sapiens
ctctctgtgtctgtctctctctataatatatacagcatatacataatataaataatatacaaaatatattatatataatataaataggggcaaagatggaagtaagtagaccagttag

SEQ ID NO: 30041 - DNA, 115 bp, Homo sapiens
tatatacacacactcatatatatgtatataggtgtatgtacatatatgtgtgtgtgtgtatatatatatacatatgtatgtgtatatatacatacatatgtgtgtgtatatatat

SEQ ID NO: 30042 - DNA, 85 bp, Homo sapiens
atatatatatacacacacacacatatatgtacatacacctatatacatatatatgagtgtgtgtatatatatgtatgtgtatata

SEQ ID NO: 30043 - DNA, 94 bp, Homo sapiens
gtatatcagcatttctgtgtgaatatacttgtgtgtgtatatatatatgtatatgaaggcacagtgtataggagacaggcagagggatgagtgc

SEQ ID NO: 30044 - DNA, 71 bp, Homo sapiens
gtgtgtgcgtgtgtgtgtgtatgtgtatatattgttttatatatgtacacacacacacacatacacataca

SEQ ID NO: 30045 - DNA, 86 bp, Homo sapiens
tgcttactttgagtctctgtcacattctggtaattctcacactttttcattattattagatctgttatggagatctgtggtcagca

SEQ ID NO: 30046 - DNA, 105 bp, Homo sapiens
gaccaaatttctaagaaagcagaagaaggcaagtgcttctctgcctctgacagtgactcacttattgattgttaagccatcttgtagcttcatggacatgttgtt

SEQ ID NO: 30047 - DNA, 97 bp, Homo sapiens
tgtatatgtgtatattgtgtatatgtatatggaatatgtatattgtatattgaatatgcatattgtatatatgtatatataggatatattatatata

SEQ ID NO: 30048 - DNA, 117 bp, Homo sapiens
atggtattgatttttgaatgctgagtttatgtcctgcaactttactgaatttgtttatcagttctaacagttttttggtggagtatataggtttttccaaatataggatcataccat

SEQ ID NO: 30049 - DNA, 99 bp, Homo sapiens
catgtatatacatatatgtctgccctgtatgtatatatatatgtgtgtgtatatatatatgcatgtatatatatatatttactacagaagaatagcatg

SEQ ID NO: 30050 - DNA, 109 bp, Homo sapiens
tgtcttactttttttgtgtacttaatagagtgaaacttgaattttataagtttacatacattattttttatttcactctaatttcttgctagcaaaaagattagtggca

SEQ ID NO: 30051 - DNA, 67 bp, Homo sapiens
tattttataggggtttgtgtgtgtgtatgtgtagactacagagaacacacagtgatcatatagaata

SEQ ID NO: 30052 - DNA, 109 bp, Homo sapiens
ttgtatttcatctgttgtttctgccaagctggatattttgttgacttttattttatttatttatttttgagacaagttcttgctctgtcacacacaggctggagtgcag

SEQ ID NO: 30053 - DNA, 112 bp, Homo sapiens
ccagtggatgatttttaagtattgaaatacttacatttttctggaagcagtatttttgaaattttttttaagattctgaatcatagtattgaaatacttatatttttcttgg

SEQ ID NO: 30054 - DNA, 84 bp, Homo sapiens
tgtaaacctgtatgtttacaaatatatgtttgtatatgttcacacacatgtgaacatatatgtatatatgtttataggtttata

SEQ ID NO: 30055 - DNA, 95 bp, Homo sapiens
gaggctttgtgcaaggttcacttgactagtgaaacagatgaaggcaaaagttttctagaatgtttatatttaagttctgcctaaggggagctctt

SEQ ID NO: 30056 - DNA, 202 bp, Homo sapiens
tatgtacataaatatgtatataatgtatgtatatacatgtataatgtatataaatatgtatataacgtatgtatatacatgcataatgtatatgaatatgtatataagtataagcatgtatataagtgtatacatatacatatatgtatataatatgtatatatttgtatacataaatttatataaatacatatatatattt

SEQ ID NO: 30057 - DNA, 58 bp, Homo sapiens
tgagtcggtgtctcactctgttgcccagattggagtgcagtggcatgatttcggctca

SEQ ID NO: 30058 - DNA, 65 bp, Homo sapiens
tgagacggagtctgtctctgtcacccaggctcaagtctccagtgcagtggcgcgatcttggctca

SEQ ID NO: 30059 - DNA, 104 bp, Homo sapiens
cactttgggcagtatagacattttaacaatgttgattcttccagtccgtgagcatggaatgtttttcaatttatttgtgttgtgtctaagttctttcagcagtg

SEQ ID NO: 30060 - DNA, 102 bp, Homo sapiens
acatacacaattttttgtatctctgtgtatatatatatgtgtgtgtatatagatacatatacatatatatatatacagaagtggatttaaatgacataatgt

SEQ ID NO: 30061 - DNA, 117 bp, Homo sapiens
accagaaggggacatgagctttttttttttttaattgtaacaagtagtaaaataactggtttctttcattatatatactgaagagaagaaaatgctttcctgtggcatctgtttggt

SEQ ID NO: 30062 - DNA, 72 bp, Homo sapiens
gctctaccttagatgtggcaagttgagaatactaggattctaatcactcttacactgtctcatttgtagggc

SEQ ID NO: 30063 - DNA, 112 bp, Homo sapiens
aatagtttatctagtccttcttacatctcatcactctgacttcctctctgtctccttctacttttgaggacccttgtgattataatggggctacctagataatctccctatt

SEQ ID NO: 30064 - DNA, 113 bp, Homo sapiens
tatatatatatatatatatatatgtgtgtgtatatatatatatatataatacacgtattatacgtgtattatacgtatgtattactatacgtgtatatatgcatatatatgta

SEQ ID NO: 30065 - DNA, 85 bp, Homo sapiens
ttatatacatgcacatttatatacatatatacatctatgttatatatagcatatatatgttatatatgtatgctcatgtacataa

SEQ ID NO: 30066 - DNA, 115 bp, Homo sapiens
aggtctgcagaagcccccattgttggggagagacgtgtgggagcagatggtctggctggtcactcagtctggctgtcagatgctctctgtcaagttccctggggactgcagggtt

SEQ ID NO: 30067 - DNA, 76 bp, Homo sapiens
tgctcaagctcctgcagcagtgctactcaggggaagacagcccccactctccgtgtcacactttgtatcttgggca

SEQ ID NO: 30068 - DNA, 94 bp, Homo sapiens
tgcctctcaagttatcttcagtactttgaaagcagacagatttcccaaattcaagatacaacagtaggcaaaagttcctgagacactggaggca

SEQ ID NO: 30069 - DNA, 117 bp, Homo sapiens
cttcttctgcctcaattcgcttgtcaaatcgaataaaccctacaccccttgatatgcctatggtagatttgagtaaagatttggaaaagagggaacagaaggagaagggaaggagag

SEQ ID NO: 30070 - DNA, 66 bp, Homo sapiens
atttaagtggcttcagactgtgagctgagtgagatcttgctgtcttccagtcttggcaccttgaat

SEQ ID NO: 30071 - DNA, 86 bp, Homo sapiens
tggcaccctgatcctggacttgcagccttaagaactgggagaacttaattttattgtttataagctgcccagcctgtatggtgtta

SEQ ID NO: 30072 - DNA, 144 bp, Homo sapiens
gtatatatatgtgtgtatatatatatgtgtgtgtatatatatgtgtgtgtgtgtatatatatacatatatatacatatatatacatatatacatatatatacatatatacatatatacatatatacatacatatatatacatat

SEQ ID NO: 30073 - DNA, 87 bp, Homo sapiens
tctgttctatctctgttagtcaggattctccagagaaacagaaccaaagctgggggggagagagagagagagagagacatagacaga

SEQ ID NO: 30074 - DNA, 82 bp, Homo sapiens
tacatacatatatatatctctctatatatctatctatgtatatctctctatatatatatatctagatatatatatgtgtgtg

SEQ ID NO: 30075 - DNA, 80 bp, Homo sapiens
acacacatatatatatctagatatatatatatagagagatatacatagatagatatatagagagatatatatatgtatgt

SEQ ID NO: 30076 - DNA, 85 bp, Homo sapiens
gctaattctagcaatttgagagtgatgtgttatagttgttcacatgataattcaggtaattaggcacctcaggtctagaattagt

SEQ ID NO: 30077 - DNA, 70 bp, Homo sapiens
tgtgtgtatagcagtggattacatatattgtctagctgtatagttatatatttatctatctatgcatata

SEQ ID NO: 30078 - DNA, 94 bp, Homo sapiens
ggtcacagaagtgggtcttggcagggctacttagaggcatatcttttttttttttttttgagacacagtctcgctctgtcgcccaggctggagt

SEQ ID NO: 30079 - DNA, 65 bp, Homo sapiens
atgtatgagtatagatgcatacacatatatctttttgctgtgtatgtatgtatctatatatacat

SEQ ID NO: 30080 - DNA, 58 bp, Homo sapiens; identical to SEQ ID NO: 27519

SEQ ID NO: 30081 - DNA, 71 bp, Homo sapiens
gtatgtatatatgtatgtgtatatatgtatgtgtatatatatatgcgtgtgtatatatatgtatgtattac

SEQ ID NO: 30082 - DNA, 78 bp, Homo sapiens
tgctactgtctggcttaatgtgagagaattttttttaatgaaatgagaagtctgatcattttggactggatagtaggg

SEQ ID NO: 30083 - DNA, 115 bp, Homo sapiens
atcaattttttcttccttgcctagttataatgtacaaaagttgtacaatctttacagtctcactgtctgattctgatgacaaaagtatgttttggtaatggttaacttcattgat

SEQ ID NO: 30084 - DNA, 96 bp, Homo sapiens
acatatcattatactttgttcatatccatagaatgtacagcaacaagagtgaattcaaatgtaaactactatggaatttgggtgaaaatgatgtgt

SEQ ID NO: 30085 - DNA, 80 bp, Homo sapiens
tatgtatctatctatctttctgtagatatatatacagatatatgtatctatatatctatatatagatttatatatatata

SEQ ID NO: 30086 - DNA, 120 bp, Homo sapiens
tatttattggtatattaatcagtgttctcctaaaacacagaacagttgctatatatatatatatgtcatatctatatatagtgacccaggagagccaatgatgcagttctaacctgagta

SEQ ID NO: 30087 - DNA, 121 bp, Homo sapiens
gctgctcaaacctctaggagagcatacaggcaggcaggctgtggggtttggcaatgtctagaggtgaatgttgacagctcctgaagccccagtgggcatgtgttacagggtgctcttttag

SEQ ID NO: 30088 - DNA, 118 bp, Homo sapiens
cacctgtctgtggaacttcattgtggcagccttatcaaattaatacatgtatatttataggttaatatccatgcatatatttccttgatttgtcagccaagaggacctagaaactgtg

SEQ ID NO: 30089 - DNA, 118 bp, Homo sapiens
tatatgtatatttgtatatgtatatatatacacatatatatacatatatacgtatatatgtgtatatgtatatatgcgtatatatatgtatatgtatgtatatatgatggaatactac

SEQ ID NO: 30090 - DNA, 124 bp, Homo sapiens
gtatatatgtatacatgtatgtatatgaatatatgcatatatgttttatatgtatatatgtatacttatgtatacatatatattttatatgtaaatatgtacacatatataagtatataaatat

SEQ ID NO: 30091 - DNA, 118 bp, Homo sapiens
tgtccaacttgcccagcagccactcccagagccactggaactctggcccaagggtctctgactgactccttcccagatcttttttgcttagtggctgaagactgacactgcccaattg

SEQ ID NO: 30092 - DNA, 112 bp, Homo sapiens
gcgtattgaaactgctgatttttgcactttgattttgtgaaccacaacttttctgaatttgtttatcagttctaacagttttaaggtggatcgttcagggttttctatatgt

SEQ ID NO: 30093 - DNA, 119 bp, Homo sapiens
tatatatctatgtatatatatctatgtctatatacacacatatatctgtatatatatatctatgtgtatatatatgtatgtctatatacacgcatataataaaaatacatttataaata

SEQ ID NO: 30094 - DNA, 104 bp, Homo sapiens
gttgtttatggcatgaatgtatgtatgtgcatttataaaatctgcatgtaaatatttttacatgtatgtattaatgtaccaaatgtattcattttgtgtgaaac

SEQ ID NO: 30095 - DNA, 73 bp, Homo sapiens
atggacgtaatgtgtgtatatgtatatgtatgtatatatatacacacacatatatacacatatatacgtatat

SEQ ID NO: 30096 - DNA, 65 bp, Homo sapiens
acgtatatatgtgtatatatgtgtgtgtatatatatacatacatatacatatacacacattacgt

SEQ ID NO: 30097 - DNA, 90 bp, Homo sapiens
tacattagagagaaatggaatttgggggaaggtgacaataatttgtgttttattcatttttttcaacttttattttggattctgagggta

SEQ ID NO: 30098 - DNA, 114 bp, Homo sapiens
cctgttcaaatgtttataatatctgagaaccttctgacagccaaatattgaagaatccttttttttttttttttggccgggatgtgttattatttaagtaaacaagaaatgagg

SEQ ID NO: 30099 - DNA, 108 bp, Homo sapiens
tatgtgtgtgtgtgtatatatatgtatataatgtatatatatacacataatgtatatatatatacacataatgtatatatatatacacataatgtatatatatataca

SEQ ID NO: 30100 - DNA, 106 bp, Homo sapiens
tcttgctgctggaaccctcaaacacttaagtcatctaataaacattctactgtcttcagaggaattttctcagtgaaagggatttgggacacccctgtgaggaaga

SEQ ID NO: 30101 - DNA, 67 bp, Homo sapiens
tgttttgacatgaatatgtttatatgtatatacgtgtgtgtgtatatatatatatatacacaaaata

SEQ ID NO: 30102 - DNA, 144 bp, Homo sapiens
ctgccatgattgcaagtttcctgagacctccccagaatgcagaatggtgagtcaattaaaccttttttgtttatatattacccagtctcaggcagttctttatagtagtgtgataacagactagtacaggaaattggtactggg

SEQ ID NO: 30103 - DNA, 112 bp, Homo sapiens
tttggaaaggcagtatttacccaatgcctaaaccaccattgtattttggaagtaactaacttgtttttaattttaatggctcataggtggaaggaagtagctttgtctcaga

SEQ ID NO: 30104 - DNA, 110 bp, Homo sapiens
acatagcagtgggattgttggatcatatgctatctctattttagtttaatttaatttaatttagttttaggggtacatgtgcaagttggttctatggataaattgcatgt

SEQ ID NO: 30105 - DNA, 107 bp, Homo sapiens
agcctaagacattttgttagagcagcaggaatagattaagacattttgtttatctgtgaaataaaatttcacattaaatgatcttcgatatttagctttaaatggct

SEQ ID NO: 30106 - DNA, 99 bp, Homo sapiens
cgtatgatgtgtgtgtgtataatatgtgtgtatacatattatatatgtgtgtatatgtgtgtgtgtatatatatctatataacataggaacattatttg

SEQ ID NO: 30107 - DNA, 95 bp, Homo sapiens
ggctggagggaagtcttttgggctcacagaagagacagtggttagtgacaaaagtgtgcccaggtatgtggccagacttcagtctctcatcctgt

SEQ ID NO: 30108 - DNA, 104 bp, Homo sapiens
gtgcctgttgtgcttgtgaataagaacattgttatttgagtgaaagaatatttttattcaaatatgtttattcaaataacattgttatttgagccagagagtat

SEQ ID NO: 30109 - DNA, 237 bp, Homo sapiens
attatatataggagtatatgtgtgtatatgtatatacatctatatatacacatatatatgtatgtatatatagtatgtatatagtatgcatatgtatgtgtatatatagtatgtatatatagtatgtgtatatgtatatatatgtatatagtatgtatatatgtatatagtatgtatatatataaatacatgctcctatatagatacatatatatactcctatatgtatatataaac

SEQ ID NO: 30110 - DNA, 93 bp, Homo sapiens
atatacatactatatatacacatacatatgcatactatatacatactatatatacatacatatatatgtgtatatatagatgtatatacatat

SEQ ID NO: 30111 - DNA, 106 bp, Homo sapiens
agtatcatgtgggagtggatctgtggaatttttgtcattatatatatgttgtcatgtttaataaggttggagatcccaggagcatttctctttttgccatgtaact

SEQ ID NO: 30112 - DNA, 77 bp, Homo sapiens
tggctgtcatccacctgtgtgtctctgtctttacatcatcttcttataaagacactagttatattggattaaggcca

SEQ ID NO: 30113 - DNA, 92 bp, Homo sapiens
tatatgtgtgtgtatatatacatgtgtatatatggtgtatatatgtgtatatacatatatgtatatgtatatatacacgtgtatattatata

SEQ ID NO: 30114 - DNA, 105 bp, Homo sapiens
ttgattgtcacaagtcctgcattgtagttcagacatatttctctctttctattataattttgttttagccaaaggagagtctagatctgggactgtaataatgaa

SEQ ID NO: 30115 - DNA, 95 bp, Homo sapiens; identical to SEQ ID NO: 68

SEQ ID NO: 30116 - DNA, 93 bp, Homo sapiens; identical to SEQ ID NO: 69

SEQ ID NO: 30117 - DNA, 117 bp, Homo sapiens
gattttcaagcctctttctcagtgaggtgcagccaaggggctacattctgactaatggaatgtaaactaaaatggtatatacaactttgggaaatgtccttaagaggatagaggatc

SEQ ID NO: 30118 - DNA, 110 bp, Homo sapiens
tatttgtcctttagcactgataaattttgtatatgcatcaaagaacagaaaatattttttattatttttgctttgggttaatgtagtcatatgcagggcttgaccaaata

SEQ ID NO: 30119 - DNA, 90 bp, Homo sapiens
tatttggccatatatatacatatatatatacatacacatatatataatacacatatatatgtgctatatgtatgtatatatatgcaaata

SEQ ID NO: 30120 - DNA, 78 bp, Homo sapiens
catatatatacatacatatagcacatatatatgtgtattatatatatgtgtatgtatatatatatgtatatatatggc

SEQ ID NO: 30121 - DNA, 95 bp, Homo sapiens; identical to SEQ ID NO: 68

SEQ ID NO: 30122 - DNA, 93 bp, Homo sapiens; identical to SEQ ID NO: 69

SEQ ID NO: 30123 - DNA, 202 bp, Homo sapiens
atacatatatacatatatatgtgtatatatatgtatatatgtgtgtgtatatagatgtatatatgtgtatatagatgtatatatgtgtgtatatagatgtatatatgcgtatatatgtatatatgtgtatatatatatgtgtatatatgtgtatatgtgtgtatatatgtatatatgtgtgtatatatgtgtgtatatatat

SEQ ID NO: 30124 - DNA, 78 bp, Homo sapiens
tgtgtgtgaatatatgtatatatgtgtgtatatatatacacacatatatacacacatatatacatatatacacacata

SEQ ID NO: 30125 - DNA, 111 bp, Homo sapiens
atcatggcagagggggaagcaaacacatccttcttcacatggcagcaggagagagaagaatcagagccaagcaaagggggaagcttcttataaaatgatcagatatcatga

SEQ ID NO: 30126 - DNA, 87 bp, Homo sapiens
ctgtatccccacccaatcttatctcaaattgtaattctcacatgttgagagagatatctgctgggaggtgattggatcatgggggtg

SEQ ID NO: 30127 - DNA, 168 bp, Homo sapiens
tatatatacacatatatatgtatgtgtatatatacacatatatatgtatatatgtatatatgtgtatatatgtatatatgtgtatatatgtgtatatatgtatatatgtgtatatatgtgtgtgtatatatatgtaatgtatctgtgtatacatgtatatgtatggat

SEQ ID NO: 30128 - DNA, 88 bp, Homo sapiens
gtatgcatgcatatgagtatatatatatatatgtatatatatactcatatatatgaatgtgtatatatactcatatatgtatgtgtat

SEQ ID NO: 30129 - DNA, 62 bp, Homo sapiens
ttttatgtattgatatgtacgtgtgtgtatatatatacatgtatatatttgtctacacaaag

SEQ ID NO: 30130 - DNA, 107 bp, Homo sapiens
cattatggatttgatttgaatttctctgatgatcagtgatgattaaattttttttatatgtttgctggtcatttgtatgtccttctgagaagtgtctgttcatactg

SEQ ID NO: 30131 - DNA, 168 bp, Homo sapiens
gccaccacaaatggctactaatcatatggttttgagagatcttcttggtattgatttttattcttattgtgctgtggtctgagagtgtggttggtatgatttcattctttttaaattagctgagaattactttatggctgagcatgtggttgatctcagattgtgtgc

SEQ ID NO: 30132 - DNA, 112 bp, Homo sapiens
gcatttatttttcctatatctgtacatttagtgagatatcagatttctttttcttgttttttttgagacagggtgagatatcagatttcttatgattggaatctttaaatgt

SEQ ID NO: 30133 - DNA, 118 bp, Homo sapiens
actgtgtgtgttcttacctctgccttagtgatgatggaattacatagctattgtgagtcactgtgtgcctgtcctttatcactcattgtactgaggataaaatcataaattgttcaca

SEQ ID NO: 30134 - DNA, 108 bp, Homo sapiens
ggcctgactccttcattatcggtctctcagtggctctccatgtttctgtgtgtctctgtctttcttgttcacttctgaggcaggaggatcacttgagccaagcaggtc

SEQ ID NO: 30135 - DNA, 78 bp, Homo sapiens
atagagtgagaccctgtctctaaaaacaaaaaatttttttttttttttttttttttttgaggcagagtctcgctctgt

SEQ ID NO: 30136 - DNA, 115 bp, Homo sapiens
gtgtgtttagggctctggtattattgaggagtatttaatatatttgaatattattttctgtgatttgtgtatattcctgattctgtgataattctggatttctgtgtggcttaac

SEQ ID NO: 30137 - DNA, 120 bp, Homo sapiens
ccaggaacttgaagaactttgggctgaactgattctctatttgaaaagtgattttgttgttcattgaactattgattttttttttttgagacagagttttgctcttgttgcccaggctgg

SEQ ID NO: 30138 - DNA, 106 bp, Homo sapiens
tttactgattgcagttgcaccctccgaagtgaggtagtttgaaggcatctgaaatgtcctctttttttttttttttcgaagaagatgctctgtagtcttctgtaaa

SEQ ID NO: 30139 - DNA, 73 bp, Homo sapiens
aaaagggaaaaagaagtccttccactcatgactttcaaggaagaataggggagtcagggtctctgtctctttt

SEQ ID NO: 30140 - DNA, 93 bp, Homo sapiens
tcagttgagtagaataggatgggatatacctcattctttttttttttttttttttttttctgagatggtgtctccctctgtctcccaggctgg

SEQ ID NO: 30141 - DNA, 103 bp, Homo sapiens
gaataaataattcaggaataaaatttgtgttggttctaaattaattattcttcatcaactttttgaccttagaaccaacacaagttttattcttgaatcattc

SEQ ID NO: 30142 - DNA, 109 bp, Homo sapiens
gtgaaccatatttatatttacatatacgtgtatgtatgtgtacatgtgaaccatatttatatttacatatatgtgtatgtatgtgtgcatgtgttatatgtgtgtgtac

SEQ ID NO: 30143 - DNA, 109 bp, Homo sapiens
ggcaacagaacgagacttggtctcaaaaaatgaataaataaataaaaataaataaagtattttttttctttttttttttttttttgaaacggagtctcgctctgtcacc

SEQ ID NO: 30144 - DNA, 71 bp, Homo sapiens
atccgtgacggtgctttgagacaggtcgatcactgtgaaactctgtttcactttgtttatgtcactaggat

SEQ ID NO: 30145 - DNA, 60 bp, Homo sapiens
ttgagactgagtctcactctgtcgcccaggctggagtgcagtggtgcaatctcggctcaa

SEQ ID NO: 30146 - DNA, 92 bp, Homo sapiens
tctgttgcccaggctggagtgcagtagctcattacagtcttgattttttttttttttttgagatggagtctcactctgtcactgaggctgga

SEQ ID NO: 30147 - DNA, 88 bp, Homo sapiens
ggccttcatttagtgtcaagatgacagatagatgatatgtgttgccatttctctgtctgtgccactctttcaagtctgcgtggagtcc

SEQ ID NO: 30148 - DNA, 90 bp, Homo sapiens
aggggaacagtgtgcatgtgtaacagtagagattgagctgatttgtagctagtgtagtttatgttgggtttggagacatactgatccttt

SEQ ID NO: 30149 - DNA, 126 bp, Homo sapiens
ccaattttgttctttttgcttaggattgtcttggctatgtgggctcttttttggttccatatgaaatttaaagtagttttttccagttctatgaagaaagtcaatggtagcttgatggggatagca

SEQ ID NO: 30150 - DNA, 77 bp, Homo sapiens
ccatgtgtggctggaggctaccaaattagacaatgcagatgtacagtgcaatgtagcctcttcttctgccctcatgg

SEQ ID NO: 30151 - DNA, 82 bp, Homo sapiens
tctggttcttgggttggagtcatagaactgttttttttcttctttttttgagacagaatctctctctatcctccaggctgga

SEQ ID NO: 30152 - DNA, 112 bp, Homo sapiens
aagcctgtttaagtatctttaataactgagaagatttcaagttttataatatcagttctgtttatttatttctttataatctctgcattttgtgtcttgcctaagcaggctt

SEQ ID NO: 30153 - DNA, 95 bp, Homo sapiens
cagattatacgtgacttttaaaaggtatcacagtatttgattatatgtaactatttatagaaatacttggtggtattacatggtcagtatttctg

SEQ ID NO: 30154 - DNA, 89 bp, Homo sapiens
tgattttgtattctgcaactttactgaatttcttcatcaattctaatagttttttggtggagtcattaggttttctaaatataagatca

SEQ ID NO: 30155 - DNA, 120 bp, Homo sapiens
gaggaggatacatggtttgcaattacatgtctgactcaatttcatttcaaactttttttttaacttgttattggcatgtttgagagaatagagtgggtagaatcattaattatttgtctc

SEQ ID NO: 30156 - DNA, 63 bp, Homo sapiens
cacaaacacacataataatacttttaatattttattgcaggggtgtgagtgtgtgtgtctgtg

SEQ ID NO: 30157 - DNA, 89 bp, Homo sapiens
ctctatatatgtatatatcaatatgtatgtatatatgtatgtatatacattatacatacatgcatataggtagaaacattgaaaaagag

SEQ ID NO: 30158 - DNA, 116 bp, Homo sapiens
agcaagctaagactaattaattattgaaggaagaaagtagctttttataaatttaatgtagcctaagtgtacagtgtttataaagtccacagtagtgtgtagtaaagttctaggct

SEQ ID NO: 30159 - DNA, 88 bp, Homo sapiens
cacttaatctaaaatttatattctgaagtatgtgaaacctgatcctggtctctgtttctcactcagagttgaccacagggttcaagtg

SEQ ID NO: 30160 - DNA, 110 bp, Homo sapiens
tgcttaggattgtcttggctatacaggcttctttttggttccatatgaaatttaaagtagttttttctaattctgtgaagaatgtcaatggtagtttgatgggaatagca

SEQ ID NO: 30161 - DNA, 77 bp, Homo sapiens
ggttgactgcacagaggggtccccagtgtgcccttctccctgtggggcacctctgtctctgtctctgtgtgttggct

SEQ ID NO: 30162 - DNA, 78 bp, Homo sapiens
tgtaaatgattgagaagagtgatgggataaatgtagactcaatacatgttaattttattcctttttttattctttaca

SEQ ID NO: 30163 - DNA, 116 bp, Homo sapiens
acaggtttatatatgtgtgtatatatatgtatatacatatatgtgtatatatatgtatatacatatatgtgtatatatatgtatatatatatacttatatacatatgtgtgtgtgt

SEQ ID NO: 30164 - DNA, 210 bp, Homo sapiens
tatatatacaaaatatatatatttgattttgtatatatacaaaatatatatatttgattttgtatatatacaaaatatatatatttgattttgtatatatacaaaatatatatatttgattgtgtatatatactatatatgtatatacaatatatagtatatatgtatatgtatatacaatatagtatatatacatgtatagtatatatg

SEQ ID NO: 30165 - DNA, 95 bp, Homo sapiens; identical to SEQ ID NO: 68

SEQ ID NO: 30166 - DNA, 93 bp, Homo sapiens; identical to SEQ ID NO: 69

SEQ ID NO: 30167 - DNA, 118 bp, Homo sapiens
tatatatactatatatagtattttatactatatatactgtagtgtatatatactatatatagtattttatactatatatactatagtatatatatattctctatatatagagtatata

SEQ ID NO: 30168 - DNA, 97 bp, Homo sapiens
tggtcatagctgagattaagattatttgtcagaaaaacatgactatttcattagttaagttgctttgacagtatttgatttgatactctacatacca

SEQ ID NO: 30169 - DNA, 123 bp, Homo sapiens
tcagatggttgtagatgtgtggtcttcttttttatttttttgagatggagtctcactctgtcacccagactggagtgcagtggcaagatctcggctcactgcaaactccgcctccccctgggt

SEQ ID NO: 30170 - DNA, 77 bp, Homo sapiens
tcatgcacctgtgattagagcttcacggattcccagaagtcagtgtggagactttgttaaaaggcacaacagtatga

SEQ ID NO: 30171 - DNA, 95 bp, Homo sapiens; identical to SEQ ID NO: 580

SEQ ID NO: 30172 - DNA, 93 bp, Homo sapiens; identical to SEQ ID NO: 69

SEQ ID NO: 30173 - DNA, 88 bp, Homo sapiens
tgaggtaaagcagttcttgtattgaggtaatgcttattttacttaataagcggccccaaagtgcaagagtagtgatgatggtatgtca

SEQ ID NO: 30174 - DNA, 87 bp, Homo sapiens
acatgggtttgatcagctgtggtacgcttatgtatgaatttttttcaattaaatgcagatggtgttcatggaatgtaaaatccttgt

SEQ ID NO: 30175 - DNA, 105 bp, Homo sapiens
caggttggtttaacattcttgccacttatttcattttcagtgtttctatttgtgtcggccagcagtgatccgcaatagaaagcagttaccaagattactaacttg

SEQ ID NO: 30176 - DNA, 92 bp, Homo sapiens
ttcattcaaggatcctagggaatgtttatttttcattttaccttgaatacctcattatgattattatgtttatcactaggatatggaatgaa

SEQ ID NO: 30177 - DNA, 92 bp, Homo sapiens
gattttaaaaaacaaatgtataaaataattctaagtatacataaaggaataccctttatgtatatgtatatatagacgtaatttgtgaaatc

SEQ ID NO: 30178 - DNA, 95 bp, Homo sapiens; identical to SEQ ID NO: 68

SEQ ID NO: 30179 - DNA, 93 bp, Homo sapiens; identical to SEQ ID NO: 69

SEQ ID NO: 30180 - DNA, 96 bp, Homo sapiens
gtggctgatgctcctcctccggtgcacacttctgtttgtcttgtaattagaaacattcatagcgaaacacagtggcatttaaaagtatcagcgcat

SEQ ID NO: 30181 - DNA, 64 bp, Homo sapiens
ccgtgtgtgtgtgtgtgtgtgcgtccacacgtgtgtgtgtgtgtgcatgcacgtactcatgtgg

SEQ ID NO: 30182 - DNA, 111 bp, Homo sapiens
aagccatatcacactcctgcctccctgttgttagaaatgtttacaatatcaagtgtattaatatgatttatatttaaaatttctttaccactaggcctggtgtgatttctt

SEQ ID NO: 30183 - DNA, 58 bp, Homo sapiens
tgagacagggtctcactctgtcacccaggttggagtgcattggtgcaatcttggctca

SEQ ID NO: 30184 - DNA, 107 bp, Homo sapiens
ctgactaaacatatttgacctgattttgaaagttgtttctttttttataactgtaaataaaataagtgttcactttttaccaaatcttaggctagtgtttcagttgg

SEQ ID NO: 30185 - DNA, 58 bp, Homo sapiens
tgagatggagtctctcactgtcgctgaggctggagtgcagtggagtgatcttggctca

SEQ ID NO: 30186 - DNA, 90 bp, Homo sapiens
cacatttcacacacatatatatacacacacacattatagaaaaatgtgattggtatattctcattttatatatgtgatgtcactgatgtg

SEQ ID NO: 30187 - DNA, 84 bp, Homo sapiens
cttcatgatttgactcaggatcctgacaatgtgagtgaggacagacagtagttaattcatatttgggttttgtaggcatagaag

SEQ ID NO: 30188 - DNA, 99 bp, Homo sapiens
tctctctatatatatatatatatatatatatatatatgtatatatgatatcacatatacattgctgtatatatatgcatatatattcatatagatatga

SEQ ID NO: 30189 - DNA, 102 bp, Homo sapiens
tggtggaaggcatcatgtggtgaaagggcactcaagagactgaggaaagggatctcagccttttatgaggaatccgcatctaccataactaacccactccca

SEQ ID NO: 30190 - DNA, 107 bp, Homo sapiens
agtaacaggtttatttaatagtccaaaagctgctgggtattaacataaaaaagtatattttttattcagttgtcactttgaactgtgttctgtttcagcctgttcct

SEQ ID NO: 30191 - DNA, 123 bp, Homo sapiens
tatatacacacatatgtgtgtatatatacaaatatatatgtatgcatatatatacacacatatatatgtatatatgtgtatatatgtatatgtacatatatacatacatatatacacacatat

SEQ ID NO: 30192 - DNA, 63 bp, Homo sapiens
atgtgtatgtgtatagttttacaaatttatatattacaaatttgtatatatatatatacacat

SEQ ID NO: 30193 - DNA, 83 bp, Homo sapiens
gtatctaaatacatatatatagtatctatatacatatatagtgtatatgtgtgtatatatagtgtatatatgtatatatatac

SEQ ID NO: 30194 - DNA, 173 bp, Homo sapiens
atatgtacacacagactttatatatatatatataaacgtgtatatgtatgtatatatatatgtatgtatatatgtgtgtatatatatgtatatgtgtgtgtatatatatctatgtatatatgtatgtatgtatgtgtatatatatatgtgtgtgtgtgtgtatatatatatat

SEQ ID NO: 30195 - DNA, 85 bp, Homo sapiens
tagatagatagacagacagacagacagagatagaggtatgtccagccccctttgtatctaggtttggctttgtgtctaagttctg

SEQ ID NO: 30196 - DNA, 104 bp, Homo sapiens
tctctatcaaacattagatatgttcagattcttaaatggagacacagtaaggaaccactttggatgtatgtatgtatgtagagataaggtcttgctatgtttcc

SEQ ID NO: 30197 - DNA, 100 bp, Homo sapiens
tgagtggataaagaaaatgtggtgtgtgtgtgtgtatgcatatatacatgtacatatatatgtatatatacacacacacatacacatgggatactactcg

SEQ ID NO: 30198 - DNA, 111 bp, Homo sapiens
ttccctgacaaaatttgataaatccacagttaaggtgttaacacaaatatttatacattgtatttgaatatctgttactgttcaatcttattggttttgattacaggtgaa

SEQ ID NO: 30199 - DNA, 68 bp, Homo sapiens
tatatgtgtgtgtgtgtgtgtatgtgtacatatatatatgtaaatatacatatgtacatacatatata

SEQ ID NO: 30200 - DNA, 76 bp, Homo sapiens
tcttctttatatatactttatatatatatattctgtctatgtatatagacagcatatgcatacatagggagggaga

SEQ ID NO: 30201 - DNA, 101 bp, Homo sapiens
gtatatacctgtctgtttgtgtgtgtgtgtgtgtgtgtgtatatatataaagtaactatgtaagaggtgtgtgcatatatatgtatacacacacacacata

SEQ ID NO: 30202 - DNA, 61 bp, Homo sapiens
ttatatatatattatatataatatgtgtatataacatatgtatgtgtatgtatatatgtga

SEQ ID NO: 30203 - DNA, 74 bp, Homo sapiens
tatgtgtatgtgtatgtgtatgtgtatgtgtatgtatatgtgtatatgtatgtgtctgtatgtgtatgtgcata

SEQ ID NO: 30204 - DNA, 87 bp, Homo sapiens
tgtggcctcactcacaggctgagggctgctccatcgggcccccaaggagtcctgacacctggtagaactgaggctggagaaggaaca

SEQ ID NO: 30205 - DNA, 113 bp, Homo sapiens
gttgggatcatctagctagagggaggtttaattgtagatttatttatttatttatttatttatttatttatttatttatttatatggagtctctttctgtcacccagcctgga

SEQ ID NO: 30206 - DNA, 74 bp, Homo sapiens
gagactatttctttaattatatttgctattcccatggccaaccctggcctgagatatgtgaatgaggtcttctc

SEQ ID NO: 30207 - DNA, 95 bp, Homo sapiens
cattctaactggcatgagatagtatctcattctggttgtgatttgcatttctctaatgaccagtgatgatgagctttttttcatatgtttgttgg

SEQ ID NO: 30208 - DNA, 104 bp, Homo sapiens
ttatacaggctcttttttggttccatatgaaatttaaagtagttttttctaattctgtgaggaaagtcagtggtagcttgagggggatagcattgaatgtataa

SEQ ID NO: 30209 - DNA, 114 bp, Homo sapiens
agcatgagaaggcaggatttgtaggtgtgaatgagaaactaaatgctttttttttttctttcagaattgaacaagagcttattattcatctgaggtttgtgtgtctaacatact

SEQ ID NO: 30210 - DNA, 103 bp, Homo sapiens
gatatatgcatatatatgtgtgtagacatactatgtatatgtatgtgtgcatgtgtgtgtatatatatatagtatgtgtatactatgtgtgtgtgcatgtatc

SEQ ID NO: 30211 - DNA, 60 bp, Homo sapiens
atttggctggaacacacacacacacacattctttgagtgtgtgcatgtgtctacatagat

SEQ ID NO: 30212 - DNA, 103 bp, Homo sapiens
gggcatggtggcgtatgcctgtagtcccagctactcaggaggctgaggtagcaggatgccttcagccctggagttggaggtcgcagtgagccatgattgtgcc

SEQ ID NO: 30213 - DNA, 86 bp, Homo sapiens
gtggtggggaatggtggaatggagatgttttattttcttaagcgattgtttaatacttatgtttcaccatgtgcatgtgctgctat

SEQ ID NO: 30214 - DNA, 113 bp, Homo sapiens
aagtgtttatttttccccacagcctcaccatcatctgttattttttgattttttaataatagtcattttgacgggtgtgagttggtatctcatggtggttttgatttgcattt

SEQ ID NO: 30215 - DNA, 137 bp, Homo sapiens
tatatatatatatatatatatgcatatatatgtgtatatatgtatgcatatatgtacatatgtatgtatatatatgtcaatatattaagtcacacattggtgtgtgtgtgtgtatatatatacatttatgtatttat

SEQ ID NO: 30216 - DNA, 68 bp, Homo sapiens
atgtccattatgtatatatatattgtttactgatatcagtgacagataagtatattacagtggatcat

SEQ ID NO: 30217 - DNA, 110 bp, Homo sapiens
ttttttatgttgattttgtatcctgcaactttactgaatttgtttatctgttctaatagttttttggtggagtttagagttttccaaatataaggtcatatcatctgaaa

SEQ ID NO: 30218 - DNA, 84 bp, Homo sapiens
tacatacatgtatatatgttcatatacttacatgtgtgttcatatacatacacgtgtgctcatgtgttcatatacatgtgtgta

SEQ ID NO: 30219 - DNA, 83 bp, Homo sapiens
gggtgaggagtaatgtttcactgcagctagatttatttttttctttttaagtgctgtaatgacaatagctacaccattcactt

SEQ ID NO: 30220 - DNA, 83 bp, Homo sapiens
tatatataaatatatacacacacacacgttaggtaattatataaattacctcttgagtgtgtgtgtgtgtgtgtgtgtatgtg

SEQ ID NO: 30221 - DNA, 82 bp, Homo sapiens
gatcaaactcatctcacatatgaatatgtatatgtgtgtatgtatatgcatatatatatttaaatacacatgacctttgatt

SEQ ID NO: 30222 - DNA, 94 bp, Homo sapiens
gttacgtgaatttgctttctctctctctcaaaatatcttattgcagagtatcttcttattatgatgctgtgagatgatgaagtgttcttgtgac

SEQ ID NO: 30223 - DNA, 106 bp, Homo sapiens
ggattgttttctttatttcttttttggatagtttattagtgtacagaaacactactgattttgtatgctgattttgtatccttcaatgttattaaattcatgatct

SEQ ID NO: 30224 - DNA, 98 bp, Homo sapiens
tatatatacaccataatgtgtgtgtatatatatataccataatgtgtatgtgtgtgtatatatatatatatatatacaccataatgtgtgtatatata

SEQ ID NO: 30225 - DNA, 79 bp, Homo sapiens
ttgcattgcattgtgtatacacacatatatctgtatatctatataatatgaatatgtgtgcatatatagtgtattacaa

SEQ ID NO: 30226 - DNA, 80 bp, Homo sapiens
taagttactaggttgtagggttaagattgctgtttccttgctatcagccaggagccgtgcatagccgcctgtgttatttg

SEQ ID NO: 30227 - DNA, 72 bp, Homo sapiens
cctggcatagtggtgtgtacctgtggtcccagctacttgggaggctgaggttggaggatcacttgagcctgg

SEQ ID NO: 30228 - DNA, 57 bp, Homo sapiens
tattttacagtaatttatatatatatgtgtgtgtgtgtataagtatactgtaaaata

SEQ ID NO: 30229 - DNA, 117 bp, Homo sapiens
accatgctgttttggttactgtagccttatagtacagtttgcagtgagatgatatgatgtatcttactttattcattttgcttataattgttttggctatttggactcttttttggt

SEQ ID NO: 30230 - DNA, 123 bp, Homo sapiens
gtgtgtgtgtgtatatatatatatgtgtgtgtgtgtatatatgtgcatacatatatttaggatatatatttatatatagataaaaatatatctatgtatatatataaatatatatgtgtgtgt

SEQ ID NO: 30231 - DNA, 99 bp, Homo sapiens
tcagaagcttggaagcagattatccctaagtcaggcccatagataagaacacactgactgactgactgacgccttaattgcagctttgtaagatgctga

SEQ ID NO: 30232 - DNA, 111 bp, Homo sapiens
agcattataaattcttgttgtattgtgaactattattttataaataaatagttgtattaaaaattattttaaaataaaataatttttttaatttgtacaacctatagtgtt

SEQ ID NO: 30233 - DNA, 58 bp, Homo sapiens
tgagacggagtctcgctctgtcgctcaggctagagtgcagtggtgcagtctctgctca

SEQ ID NO: 30234 - DNA, 81 bp, Homo sapiens
acgtgtgtgtgaataagtgtgtacatgtgtgcataaatatgtttatatttgtgtggctgtgtaaccctaaagcatatatgt

SEQ ID NO: 30235 - DNA, 95 bp, Homo sapiens; identical to SEQ ID NO: 68

SEQ ID NO: 30236 - DNA, 93 bp, Homo sapiens; identical to SEQ ID NO: 69

SEQ ID NO: 30237 - DNA, 111 bp, Homo sapiens
gcttcctgaatttatctgcccatatgattctcatgcatttgatatttatgtttaaaagtgtttatatatgtatgtaaaaagggaaccatatgttttgagaatttgtaaagt

SEQ ID NO: 30238 - DNA, 70 bp, Homo sapiens
tatgaatgtatatgtatgtgtatatatatacacacacacacgtatgtatacacatgtacatgtattcatg

SEQ ID NO: 30239 - DNA, 103 bp, Homo sapiens
tgttcatgatgttaagatgtacgtactataaattgcagaattgagatttttttttttaagttctgggatacatgtgcaaaacgtgcaggtttgttacatagca

SEQ ID NO: 30240 - DNA, 92 bp, Homo sapiens
acatagacattggattctttatttttagatccatatgaatactgaataagatgatcaggaatctagaaaactagaggagaaagtgtgtgtgt

SEQ ID NO: 30241 - DNA, 79 bp, Homo sapiens
ccccttaaaagaatgcttatataaacctgcttgcatatgtaattttatatcagaagcagctttgcatttgggggagggg

SEQ ID NO: 30242 - DNA, 103 bp, Homo sapiens
aatgattatcttagaattttgaggtaatgtggtatttctgtacatttttattttaatttacactggttcttgacatgatgtcaaaaattctcatgatgtcatt

SEQ ID NO: 30243 - DNA, 65 bp, Homo sapiens
tattgcctgatagttgctagaatagtttagctttgcagctggtttcagtaaatgttaaggtaata

SEQ ID NO: 30244 - DNA, 59 bp, Homo sapiens
tatatatatatatatgtttgaggtatatatatatacctcacaatatatattgttgtata

SEQ ID NO: 30245 - DNA, 118 bp, Homo sapiens
atatatatatatatatatatatatatatacacatatacgtatatgtgtgtgtatatatatatatacacacacatatacgtatatgtgtatatatatacgtatgtgtatatatatatat

SEQ ID NO: 30246 - DNA, 93 bp, Homo sapiens
atacgtatatatatacacatatacgtatatgtgtgtgtatatatatatatacacacacatatacgtatatgtgtatatatatatatatatata

SEQ ID NO: 30247 - DNA, 140 bp, Homo sapiens
tatgtgtgtgtgtgtatatatatgtatatatgtgtgtatatataatatgcatatatgtatgtatatatgtatatatgtgtatatgtgtgtgtgtgtatatatatacatatatatatatatacacacacacacacacacac

SEQ ID NO: 30248 - DNA, 89 bp, Homo sapiens
atatatatatatgtgcgtgtatgtgtgtgtgtatatatatgtgaatacatacatatgcatgtgtatttatatatatgtacatatgcagg

SEQ ID NO: 30249 - DNA, 101 bp, Homo sapiens
ctcagatatatatatatatctgatatatatgtatgtatatgtgtgtatatatatatgtatatatatatgtatgtatgtatgtgtatatatatatatcagag

SEQ ID NO: 30250 - DNA, 65 bp, Homo sapiens
gtgtgtgtatatatatatatatatatatatatgatgtgtgtatgcatgtgtgtatgtatatatat

SEQ ID NO: 30251 - DNA, 119 bp, Homo sapiens
atatagtggatgtgtgtgtgtgtgtgtatatatatatacacacacatatatatacatatatatgtatatgtgtgtgtatatatgtatgtgtggctatacatatatttatacacatgtat

SEQ ID NO: 30252 - DNA, 60 bp, Homo sapiens
atacatatatacacacacatatacatatatatgtatatatatgtgtgtgtatatatatat

SEQ ID NO: 30253 - DNA, 118 bp, Homo sapiens
tctgcttttgacaattgcacagattttcttttgtttcctctgataatgtatgtatttcactttttttaagtatgtgtactttaacttctgggataaatgtgcagaatgtgcaggttag

SEQ ID NO: 30254 - DNA, 99 bp, Homo sapiens
cataacatataggtgtatatatatgtatgtgtatgtgtatacacataacatatatgtgtatatatatgtatgtgtatgtatatgtatatatatttttat

SEQ ID NO: 30255 - DNA, 115 bp, Homo sapiens
caaaaatatgttttattagctatatgggctcttttttggttccatatgaaatttaaagtagtttttttctaattctgtgaagaaagtcaatggtagcttgataggaatagctttg

SEQ ID NO: 30256 - DNA, 65 bp, Homo sapiens
atagcatacatatgcatatatattaatgtttataaacatatatgtgtgtatgtatatattgctat

SEQ ID NO: 30257 - DNA, 102 bp, Homo sapiens
actttatagtactttatatagtactatataaaaatatatatatagtactttatatagtactgtatataaatgtatatatttatatataaagtactatagagt

SEQ ID NO: 30258 - DNA, 58 bp, Homo sapiens
tgagactgagtctcacactctcacccgggctggagtgcaatggcgtgatctcggctca

SEQ ID NO: 30259 - DNA, 114 bp, Homo sapiens
aagcatataatagctgatgctgatgttatgccctctaagcattgtaatgaagttattatatgggataaattaaaatacttaaagagggttattataaaagctattgaaatgttt

SEQ ID NO: 30260 - DNA, 109 bp, Homo sapiens
tgcttttgtatagttctaagttttggagctatgctaatgttttgtgttatcaatataaataaataaaaacaacacacataggagaaaaattggggtacaaacagaagta

SEQ ID NO: 30261 - DNA, 93 bp, Homo sapiens
tagtccaactatatgtataaacatatatatagtcatttatatatataattggactacatatgtttatatatataattggactaatatatgttt

SEQ ID NO: 30262 - DNA, 72 bp, Homo sapiens
aacatatgtagtccaattatatatataaatgactatatatatgtttatacatatagttggactacatatgtt

SEQ ID NO: 30263 - DNA, 137 bp, Homo sapiens
atacatatgtatatatgtgtatatgtatatattccatacatacatacgtgtatatgtatatatgtatatatgtatatattccatacatacatatgtgtatatgtatatatgtatatattccgtatatacatatgtat

SEQ ID NO: 30264 - DNA, 100 bp, Homo sapiens
ggaggacttgttaaaacacagattgctggacctcacccacagagtttctgattcagcaagtccaggtggggcctgagaatttgcatttctaacagtcccc

SEQ ID NO: 30265 - DNA, 134 bp, Homo sapiens
atatgtatgtatatgtaagtatatgtgtacatatatacatacacacatatatacatacatattttatatatatagtgtgtgagtgtatatataggtatatatgtatatataggtatgtgtgtatttatgtgtgt

SEQ ID NO: 30266 - DNA, 95 bp, Homo sapiens
atacacacatacctatatatacatatatacctatatatacactcacacactatatatataaaatatgtatgtatatatgtgtgtatgtatatatg

SEQ ID NO: 30267 - DNA, 79 bp, Homo sapiens
gaacctcagtcacacctaagattcctatttatggggctgttgtctaatggaatctaaagatctgtgatttgaaaggctc

SEQ ID NO: 30268 - DNA, 111 bp, Homo sapiens
agggactggctggagtcacagcagaggaatataaattgagaatatttcattttaatatggacatatatcagttcccaaataatactcttataatttcttatgcctgtcttt

SEQ ID NO: 30269 - DNA, 118 bp, Homo sapiens
tgttttctataattatagattatattcataattgtataagtaatcatatataattgtatataattatatagtgcaaaaaattatctggaatttaattctttatatgttgtaagggaca

SEQ ID NO: 30270 - DNA, 109 bp, Homo sapiens
tctttgaaactgcttttctttggattttttttgcttttatattatttaattaccttgagggtttgactgtgatataaggtaggctgagttcactagctttgtttctgga

SEQ ID NO: 30271 - DNA, 115 bp, Homo sapiens
ctctgccaaggctgatgttgagagtatttctgaggctgtgttcttgaatttttataatttgagatcctacatttaaatctttaatttttatttttttcatttttttgagatggag

SEQ ID NO: 30272 - DNA, 119 bp, Homo sapiens
gaagtaactaacttgttttttattttataagctcataggcagaaggaactagtcttgtctcagaagagactgtggaccttggacttttgagttaatgctagaatgagttaacactttgg

SEQ ID NO: 30273 - DNA, 60 bp, Homo sapiens
ttgagacagggtctcactctgtcacccaggctggagtgcagtggtgtgatcttggctcaa

SEQ ID NO: 30274 - DNA, 58 bp, Homo sapiens; identical to SEQ ID NO: 6617

SEQ ID NO: 30275 - DNA, 56 bp, Homo sapiens; identical to SEQ ID NO: 6618

SEQ ID NO: 30276 - DNA, 62 bp, Homo sapiens
gtctctcagtatctgtgagggattggttccaggacgtcccacagataccaaaatctgaagat

SEQ ID NO: 30277 - DNA, 106 bp, Homo sapiens
tgaggatttgagacttttctttaggccataaaaggctatcaaaatgttttaaaagagtagtgacacattgtgatttgcctaatgagaaagattgtcttaaatatta

SEQ ID NO: 30278 - DNA, 116 bp, Homo sapiens
agcctagatacctatatagcctttgttcagagtggaaggggtagatggggaatatagtcaacactattttttaaatttaaatttttattggggtacatgtgcaggatgtgcaggtt

SEQ ID NO: 30279 - DNA, 108 bp, Homo sapiens
gctggggaaaagttctaaagtaggggattgagcatcatatttcagtgtctgttacactgagtcagattaagatcccttacattacatgcagaactattattttccaac

SEQ ID NO: 30280 - DNA, 130 bp, Homo sapiens
acatatatgtgtatatatatacacacatatatatacacatatatatgtgtatatatatacacatatatatgtatatatatatacacgtatatatatatacatatatatacgtgtatatatatatatgtat

SEQ ID NO: 30281 - DNA, 126 bp, Homo sapiens
ggaggttaacatttctaggaaaacgaatcgccagtgtcaaataccacagagtagtgagtaaggacaggaacagaggacaggccctgggattcacgatctgcacgtcactggtgacaacgtccaaga

SEQ ID NO: 30282 - DNA, 87 bp, Homo sapiens
ttgccctttcaccagactcagagtgccagtgggcagtgagcacacagcttttgcaccattgcattttcagcatgtagcatgtggcag

SEQ ID NO: 30283 - DNA, 115 bp, Homo sapiens
tttcctgatcttgatagttgtattgtaattattttaagaatattgtctttgcttgtaggaagtatactagagtaataaactagtcagcaatttactataaagtgattcaaggaaa

SEQ ID NO: 30284 - DNA, 110 bp, Homo sapiens
atatacatatatatatatgtatatatgtacatatacttatatatgtatatacgtatgtatatatatgtgtatgtatatgtgtgtgtgtgtgcatatatatatatatatat

SEQ ID NO: 30285 - DNA, 83 bp, Homo sapiens
gagggagaagactagaatggctacttggtagggaactaactctctctcccagtgttacactattcataatgttctataacctc

SEQ ID NO: 30286 - DNA, 58 bp, Homo sapiens
tgagacagagtctcactctgtcacccaggctggagtgcagtagtgcgatctcggctca

SEQ ID NO: 30287 - DNA, 64 bp, Homo sapiens
gccaatgtgtgtactcagtgtggtcaagggctcctcctgaccgccactggcctactatgagggc

SEQ ID NO: 30288 - DNA, 115 bp, Homo sapiens
gccaggtcacctctcttgagactcagggattcagtatctaccctcctgttcacagaacacagacaggatcatggggatgaatgaccatgtacacttgagttgtgaaatcctctgc

SEQ ID NO: 30289 - DNA, 117 bp, Homo sapiens
agtgctgggattacaggtgtgagccactgtgcctggcccatatttgtttcatttttaagaaagatagattacagatggctggtggtggtggtggctcacacctgtaatcccagcact

SEQ ID NO: 30290 - DNA, 145 bp, Homo sapiens
acacagatatatatatatatgtgtgtgtgtatatatacacatatatatgtatatatgtgtgtgtatatatacacatatatatgtatatatgtgtgtgtatatatacacatatatatgtatatatgtgtgtgtatatatatattca

SEQ ID NO: 30291 - DNA, 84 bp, Homo sapiens
gaagctgggtgtggtggtgtgtgtgtctctagtcccaggtacctggaaggctgaggtagaaggatcacgtgagcccagaagttc

SEQ ID NO: 30292 - DNA, 118 bp, Homo sapiens
tccaggagctcatgctctgagaagacactgtgaactgtgttttaaaatattttaatttattgatttatggagacagggtcccacgtattttccaggctgaccttgaacttctgggctc

SEQ ID NO: 30293 - DNA, 123 bp, Homo sapiens
gtgtaataaatgtatatatatatatatgtgtatgtatgtgtagatacatgtgtgtgtatatatatgtgtatatatatatgcatgtgtgtgtgtatatacatatatgtgtgtgtgtgtatatat

SEQ ID NO: 30294 - DNA, 155 bp, Homo sapiens
gggccgtggtccaactgaggatcctggaagttatgcctgtggggaccagctctctcagcatctctctgcctgagggccactcgcctgtcactgcctcacagtctctgaattgggtgacatttcagacccaatccctctgtggacgtttctaggtg

SEQ ID NO: 30295 - DNA, 109 bp, Homo sapiens
ctctcagttaagctacttcttgacattgctgtggaagtaatgtatttgcatattgtttgaatatacagcttttaacagtacatagctggaaccttagcttgattgatgg

SEQ ID NO: 30296 - DNA, 58 bp, Homo sapiens; identical to SEQ ID NO: 2633

SEQ ID NO: 30297 - DNA, 64 bp, Homo sapiens
tgtggaggtgtgtgggtggatgcgtgcgtctgggtggatgtgtgtgtctctgtgtgtctgtgtg

SEQ ID NO: 30298 - DNA, 58 bp, Homo sapiens
tgagacggagtctcacactgtcacttgggctagagtgctatggtgtggtctctgctca

SEQ ID NO: 30299 - DNA, 71 bp, Homo sapiens
gtgacagaatgagtctctgtctcaaaaaaaaagacaatcatgtagatttggacagagctttaagtttgcac

SEQ ID NO: 30300 - DNA, 75 bp, Homo sapiens
tacaaagctggtgttcctaaatgtttattggtttgatctgcagacacatgagagtcaggtgcacatagcactgtg

SEQ ID NO: 30301 - DNA, 100 bp, Homo sapiens
ggtggcatgtatctgtagtcctagctacttgggaggctgaggtggaaggatggcttgagcccaggaggcggaggttgcagtgagctgagatcatgctacc

SEQ ID NO: 30302 - DNA, 110 bp, Homo sapiens
aggcgtgagccaccacgcccggccataattaagactctagatttttttttttttaaagacaggatctcactttgttgcccagctggagtacagtggtgtgaacacagctt

SEQ ID NO: 30303 - DNA, 62 bp, Homo sapiens
atatatacacacacatatatacacgcatacacctgtgtgtatatatatgtatgtgtgtatat

SEQ ID NO: 30304 - DNA, 73 bp, Homo sapiens
cacccacttgcatcttcagagtaactattcttttttttttgagatggagtctgtctctctgtcgcccagggtg

SEQ ID NO: 30305 - DNA, 65 bp, Homo sapiens
cggggggtctctgggtctctgagccagtggagatagttggggggcagagagggaggggacacccg

SEQ ID NO: 30306 - DNA, 77 bp, Homo sapiens
gctgtccccttgaagggtcggtgccttatctgtcctgacagaagagacagtgttgcttctcacttggggctcgcagc

SEQ ID NO: 30307 - DNA, 117 bp, Homo sapiens
tgactctatagtagaaggctgagtcctgtacattatgttctaaagatagacaaaaatctagagattttcttctttcaaagtaaaagcagatgaggcctcccaccaccctctgagcca

SEQ ID NO: 30308 - DNA, 83 bp, Homo sapiens
tggtcctcctgattctgcaacaccacctcacccagctaattgtttgtatttttagtagagatggtgtttcacaatgttggcca

SEQ ID NO: 30309 - DNA, 97 bp, Homo sapiens
cttttcttcagggatttagatgaatagtaagttgatacaatgaaacagctatttttgttttaattcatgcatgaaatgtaaatctctaaagtaaaag

SEQ ID NO: 30310 - DNA, 74 bp, Homo sapiens
ctgatgacacaaacaaatggaaactgacatttgtatatatgtatatatacaaaattagccaggtgtggtggcag

SEQ ID NO: 30311 - DNA, 83 bp, Homo sapiens
ggtatatttgcatatacataatgagagatcttgggggtgggacccagcattaaacatgaaatatatgtttttttatatatacc

SEQ ID NO: 30312 - DNA, 58 bp, Homo sapiens
tgagacggagtctcgctctgtcaccctggctggagtgcagtggcgcgatctcgcctca

SEQ ID NO: 30313 - DNA, 74 bp, Homo sapiens
ccaaagtgctgggattcagaaaaactcttttttttttttggagacaagagtttcgcttttgttgcccaggctgg

SEQ ID NO: 30314 - DNA, 56 bp, Homo sapiens; identical to SEQ ID NO: 2604

SEQ ID NO: 30315 - DNA, 103 bp, Homo sapiens
tccacttatagtcaagaatgtagtatctttttctttctcagccatttatatatatatatatatggtagattagatttggtatcaccattaggggagaggtgga

SEQ ID NO: 30316 - DNA, 117 bp, Homo sapiens
caaagtgctgggattacaggtgtgagccactgtgcctggctgttttttttttttttttttaatagacaggacctcgggctgggcgtggtggctcatgcctgtaatcccagcactttg

SEQ ID NO: 30317 - DNA, 99 bp, Homo sapiens
gattacagaggtgcgccaccatgcccggctaatttttgaatttttaatacaggtagggtttcaccacgttggccaggctggtcttgaactcctgtcatc

SEQ ID NO: 30318 - DNA, 115 bp, Homo sapiens
agtcttctagttggctggcctgtgtgtttgttttctgtcccttttttttttttttttttttttttgagacagagtctcattctgtcacccaggctggagtgcaatggcgtgggct

SEQ ID NO: 30319 - DNA, 64 bp, Homo sapiens
gtagtctcagctagtctggaggctgaggtgggaagactgcctgagttcaggagctaaaggctat

SEQ ID NO: 30320 - DNA, 210 bp, Homo sapiens
gtatatatatgtatatatgagtatatatgtatatatgagtatatatgtatatatgagtatatatgagtatatatgtatatatgagtatatatgtatatatgagtatatatgagtatatatgtatatatgagtatatatgtatatatgagtatatatgagtatatatgtatatatgagtatatatgtatatatgagtatatataagtatat

SEQ ID NO: 30321 - DNA, 91 bp, Homo sapiens
ccaggtattttttttgtatttttagtaggaacacagtctcaccatgttggccaggttggtatttttatttttaaagacaataaatacaggg

SEQ ID NO: 30322 - DNA, 147 bp, Homo sapiens
gagaagtggaaacaggaattgaaaagccactaggaaccaaggatgtccatgtttcctgtcttttttttttttttgagttggagtctcacactgtcacccaggctggagtgcaatggcacgatcttggctcactgcaacctccacctc

SEQ ID NO: 30323 - DNA, 67 bp, Homo sapiens
ggagtctcactctgtcactaggctggagtgcagtggcgcgatcttggcttactgcaagtgattctcc

SEQ ID NO: 30324 - DNA, 119 bp, Homo sapiens
tagagataatctatatatgtgtgtatgtatatatatgtgtatatatgtgtgtatatatatgtgtgtgtgtatatgtgtatatatatgtgtgtgtatatataagcatggatgaaaaactg

SEQ ID NO: 30325 - DNA, 87 bp, Homo sapiens
gtatatatgtatatatgatagtgtgtgtgtgtgtatatatatgtatataagtatgtatatatgtgtcatatatatatatatatgatg

SEQ ID NO: 30326 - DNA, 103 bp, Homo sapiens
tgtgtgtaagtgtgcatgtgcatgtctgtgcagcacgcgtgtgtgagcatgtgtgcacgcgtgtgtgtgtgcaagtgcatgcacatgtctctcccactcacac

SEQ ID NO: 30327 - DNA, 88 bp, Homo sapiens
agggtctcactcctattgcccaggctggagtgcattggcgcgatttcagctcactgcagtctcagtctccctgggctcaggtgatcct

SEQ ID NO: 30328 - DNA, 82 bp, Homo sapiens
ggtcaaggctgtaggagctgtggtcttgcactgtactccagcctgggcaacagagcaagaccctgcctctgtctgtctgtct

SEQ ID NO: 30329 - DNA, 101 bp, Homo sapiens
tgaggcaggagaatcacttgaatctgggagttagagttcacagtgagctgagattgcgccactgcactccagcctgggcaacagagtgagactctgtctca

SEQ ID NO: 30330 - DNA, 171 bp, Homo sapiens
tatgtgttatgtatgtgttcatttgtgtatctatgtgtatatatatatgtgtgtgtatatatatgtgtatatatatgtatatatacacatatatacgtatatatgtatatatatacgtgtatatacatatatacgtatatatgtacatatatacgtatatatatacatata

SEQ ID NO: 30331 - DNA, 102 bp, Homo sapiens
ggtgtagtgttgcacacctgttaccccaactactcaggaggctgaggtaggagaatctattgaacctgggaggcagaggttgcagtgagccaagattgcacc

SEQ ID NO: 30332 - DNA, 62 bp, Homo sapiens
tgacatttgtctgggccagattgacgtgtggattcttgtctgaatcttggccccaaatctca

SEQ ID NO: 30333 - DNA, 77 bp, Homo sapiens
gagagtgactgcaggccctaggcttggctggatgcagcaaaatttgtttcagcagagccattctctctctctctctc

SEQ ID NO: 30334 - DNA, 86 bp, Homo sapiens
agcctgggcaacatagtaagataacatttctttaaaaattttttttttttttttttgagaccgagtctcactctgtcgcccaggct

SEQ ID NO: 30335 - DNA, 70 bp, Homo sapiens
gcactttggaaggctgaggttggaggatcacttgaggccaggagtttgagaccagcctgggtaacatagc

SEQ ID NO: 30336 - DNA, 67 bp, Homo sapiens
gtttttgagactgagtctctctctgtcaccctggctggagtgcagtggcacgatctcagctcactgc

SEQ ID NO: 30337 - DNA, 64 bp, Homo sapiens
gggccctctcagacccactcaccctcagattggctttcccatcagagtggcactgtcaggtccc

SEQ ID NO: 30338 - DNA, 101 bp, Homo sapiens
ttgccccgtttgttggtgtcaatgtatgtgactgtcactcactgcattattgtcatcgtggtgactgtcaacatccctgtgtgtcattgtcaacggtacaa

SEQ ID NO: 30339 - DNA, 71 bp, Homo sapiens
gtgactcactcagattcatattgggatctcagagctcacactcagactcacagtaggattctgatgttcac

SEQ ID NO: 30340 - DNA, 100 bp, Homo sapiens
ggtagtgctccatcctgcttgctgtcttgtctgtgactctcgctgcccactgcagggaagcatcaggtaagtgctaagcaatgtgccccaagtcactgtc

SEQ ID NO: 30341 - DNA, 73 bp, Homo sapiens
gaaggtctaggtctgtctccgtctctgtgaggtataagaccagactgcgggtatgagaggcagcctttccttt

SEQ ID NO: 30342 - DNA, 69 bp, Homo sapiens
ttgtttgagacggagtctcactctgtcacccaggctggagtgcagtggtgcgatctcagctcacagcaa

SEQ ID NO: 30343 - DNA, 58 bp, Homo sapiens; identical to SEQ ID NO: 2540

SEQ ID NO: 30344 - DNA, 122 bp, Homo sapiens
caccctctttctccctctcattcttgtcttcccttgtctgagccacatacagagagcagacagagagatccatgggtgctaggtggttttattggaagcactgcagtctgggagttcagaag

SEQ ID NO: 30345 - DNA, 95 bp, Homo sapiens; identical to SEQ ID NO: 68

SEQ ID NO: 30346 - DNA, 93 bp, Homo sapiens; identical to SEQ ID NO: 69

SEQ ID NO: 30347 - DNA, 97 bp, Homo sapiens
ttgtgtgtgtgcttttcttgagacagagtctcactctgtcacccaggctggagtgcagtggcacgatctcggctcactgagacctccacctcctggg

SEQ ID NO: 30348 - DNA, 93 bp, Homo sapiens
gatagtgtggagagggacttaggcttatgcataacatgtgttaatcttgtatagatgacaggttgtttgctgtttctgggtcctccacagttc

SEQ ID NO: 30349 - DNA, 95 bp, Homo sapiens; identical to SEQ ID NO: 68

SEQ ID NO: 30350 - DNA, 93 bp, Homo sapiens; identical to SEQ ID NO: 69

SEQ ID NO: 30351 - DNA, 91 bp, Homo sapiens
ttctgttgtctgattgctctagctaggaatttcagtactgtgttgaataacagttaaagtgagcttccttgtctcgttccagaacttagaa

SEQ ID NO: 30352 - DNA, 114 bp, Homo sapiens
agtgttcaggtacatggtatatggccagtgaactgacaaaggcattcttttctttctttttttattattatactttaagttctagggtacaagtgcacaatgtgcaggtttatt

SEQ ID NO: 30353 - DNA, 108 bp, Homo sapiens
tttagaacagtattttcatgcgcgtccatgtgaagagaccaccaaacaggctttgtgtgagcaacaaggttgtttatttcacctgggtgcaggcaggctgagtccgaa

SEQ ID NO: 30354 - DNA, 73 bp, Homo sapiens
tctcctgggcctatcagaaagtgactttttttttttttttgagacaaagtctcactctgtcacccaggctgga

SEQ ID NO: 30355 - DNA, 64 bp, Homo sapiens
tggtggctcatacctgtaatctcagcactttgggaggctgaggtaggaggatcacttgaaccca

SEQ ID NO: 30356 - DNA, 61 bp, Homo sapiens
gggcaaaagagtgcaccaacaaacttttttttttttgagacggagtctcgctctgttgccc

SEQ ID NO: 30357 - DNA, 110 bp, Homo sapiens
ggccttactaatggagttatagctggggatgaataggcccctggagaaaaatcttttttctttttgagaaaaatatttatccgtttctactcctgacacatttattggcc

SEQ ID NO: 30358 - DNA, 94 bp, Homo sapiens
ttccctgtatgctctgtctccttgaacatgggcctgtgagtagaaagagtgctggcaggctgatctcagaaagggagttcagaggcacaaagaa

SEQ ID NO: 30359 - DNA, 119 bp, Homo sapiens
cttgaaacgtgtgtatatttcactttctttctggttaagatctaggcatgtgtgtacttaacatattctttttatttactttttgattttctttggacagtgacttgaacctgctcagg

SEQ ID NO: 30360 - DNA, 114 bp, Homo sapiens
ccccaagctcctgcaagggacgattagctctccattctggtagccatgtgacaatgttgttggactgcaggctcagatcctattaaacagtgactggggttctctagtgagagt

SEQ ID NO: 30361 - DNA, 114 bp, Homo sapiens
gtgatgagcaaggacagcttaggggctaaaaacaaaatggagttggttgggtctgatctctttcactgtctcagtcacaattttgcaatgagagtttcaaaagttacttatcac

SEQ ID NO: 30362 - DNA, 89 bp, Homo sapiens
ccactcagcagcatgtgtggcttttagtggtgggagcaggcttgataagctagtccctagacctccaggaggcatgcagtgatgggtgg

SEQ ID NO: 30363 - DNA, 75 bp, Homo sapiens
atgtatatgtgtgtgtatatacacatgtgtgtatatatgtgtatatatatgtgcataatacacaaacacatacat

SEQ ID NO: 30364 - DNA, 117 bp, Homo sapiens
tcctaacacacagataaagacacttcaaacttgtaacactgaaaatgaaaaatatttatctttgtttttacatttttttgacgttgtttcagatcttagtgtgctgatactttggga

SEQ ID NO: 30365 - DNA, 68 bp, Homo sapiens
ccttcccagcctctctttgctactactgtccacagaagtgaaatgacagggagcaaactgtaagaagg

SEQ ID NO: 30366 - DNA, 64 bp, Homo sapiens
tctatgtgcatgtatagctatgtgcatgcatgcatgcatgtatgtatgtatgtgtgtgtgtgga

SEQ ID NO: 30367 - DNA, 139 bp, Homo sapiens
tatatatatgtatatgtgtatgtatatatgtgtatacatacatgtctatatatgtatgtgtatatatatacatacacatgtgtctacatatgtatgtgtgtgtgtatatatatatatatacatatatatatacaccatg

SEQ ID NO: 30368 - DNA, 82 bp, Homo sapiens
agagatggggtagagatggggagaaggagttcctgacagctgtccagcctgttccctggcctccctctctcactctgtcttt

SEQ ID NO: 30369 - DNA, 82 bp, Homo sapiens
ccccataaatctactaccaggtctgtgaaatcaggatctgtggcttgggcctcagtctctgccagtctgggtagttttgggg

SEQ ID NO: 30370 - DNA, 119 bp, Homo sapiens
cgagtgtgtgtctgactgagaatgacatagctgtttgcatgcctgagaatgagtctgtgactgtcacacttgaatatgggcagtggcagggcaggttttgtttatgccataatgttttc

SEQ ID NO: 30371 - DNA, 75 bp, Homo sapiens
agtgcatacctcacagatgaatgtttgctgaattaatcaatcagtaaatggatcatcccacctgggggaagcgct

SEQ ID NO: 30372 - DNA, 118 bp, Homo sapiens
gagtagaaactaatgaaatagagaatagaaaaactagagaaaattaacaaaaccacaagttggattttttttcttttctttctttttttttttttttttttgagacagggtctcactc

SEQ ID NO: 30373 - DNA, 59 bp, Homo sapiens
ggagtgagtgaacagacagcgccggagtgcacggtgggccggctctgctgatctacacc

SEQ ID NO: 30374 - DNA, 93 bp, Homo sapiens
tagtgcattttcttattaacttagtgaagagagtgtcctctagccttcctagggaacatagccatctggtaggtctaatttggaagtccattg

SEQ ID NO: 30375 - DNA, 97 bp, Homo sapiens
tttgcaagatacggtctgattataagacatgacactgattcagctcatctaaatggctaccggagaattcagtgacatgtcaaatcactattgcaaa

SEQ ID NO: 30376 - DNA, 109 bp, Homo sapiens
tcttggctatttgggctcttttttggttccatatgaattctaaaatagttttctttttctaattctgtgaagaatttcaatggtagctaaatgggaatagcattgaata

SEQ ID NO: 30377 - DNA, 93 bp, Homo sapiens
gggaatgacgcctctgccttcactttctctcagcttgcaaagtgcacaactcaagcctcttctgcagctgggaggcagggaaggaaaggcccc

SEQ ID NO: 30378 - DNA, 83 bp, Homo sapiens
tctagctgcttgccaaatgcaaaagtagattctgtttttttttttttttgagacggagtgtcactcttgtcgcccagactgga

SEQ ID NO: 30379 - DNA, 110 bp, Homo sapiens
ggcaggggctcttgttctcttcccttaccttcccccaaacatatggagtctctctctgtgtgttgagccgcctggagctggggtggagtgacacaagcatctctgtggcc

SEQ ID NO: 30380 - DNA, 80 bp, Homo sapiens
tatatatatgtgtgtgtgtgtgtgtgtgtgtatctatatatatctatttatatctacatctatatatctatgtgtgtgtg

SEQ ID NO: 30381 - DNA, 96 bp, Homo sapiens
ggtgcagtcagggtggacagtcccctgggctccctttatttattttttatttatttattttgagatggagtctcactctgtcacccaggctgcagt

SEQ ID NO: 30382 - DNA, 110 bp, Homo sapiens
tggaacatcctgatgtgagatggtcctaagattaacaggcagcagccatccatactctctctctctgtgtgttgagtattagaaccataggcccacatagctgattgcca

SEQ ID NO: 30383 - DNA, 118 bp, Homo sapiens
gtctctgtagtcaagagagagtcagttcagtcatttgggggggattttatttttagtttacaaaagcagtgggaatatccttccagattcagttttgtatttactcatgtaaagagac

SEQ ID NO: 30384 - DNA, 112 bp, Homo sapiens
tgggcttaataaattgtaactattatttcatgctattagacagcattagactattttatttttttagagacagggttttgctgtgttacccaggctggagtacagtggctga

SEQ ID NO: 30385 - DNA, 72 bp, Homo sapiens
ccagttgtggtggtgcatgcctatagtcccagctacctgggaggctgaggtaggaggatcacttgagcctgg

SEQ ID NO: 30386 - DNA, 141 bp, Homo sapiens
tatatatacatatatatttgaggtttgtaggactatttgtgctggtaggctaatttctagtctatatgtatatataatatatacatatgtataggtgtgtatataatatatacatatgtataggtgtgtatataatatata

SEQ ID NO: 30387 - DNA, 113 bp, Homo sapiens; identical to SEQ ID NO: 5035

SEQ ID NO: 30388 - DNA, 118 bp, Homo sapiens
gagtgagttctcatgagatctgatgttttaaaagtgtggcactcccactctctttctctcctgccaccatggaagatgtgctttgcttccccttcatcttctgccatgattgtaactt

SEQ ID NO: 30389 - DNA, 104 bp, Homo sapiens; identical to SEQ ID NO: 4710

SEQ ID NO: 30390 - DNA, 58 bp, Homo sapiens; identical to SEQ ID NO: 637

SEQ ID NO: 30391 - DNA, 74 bp, Homo sapiens
cccaatcttcctgtgtctgtctctgtgtccaagtttctctgttttataaggaaggcagtcatattggattaggg

SEQ ID NO: 30392 - DNA, 119 bp, Homo sapiens
ggaattgacccttgagtcccctctgtccgtaaggaaagcgtccacgaagccgttcaccattgtgtgcctctgtctgtgcctcctccacaggcacaggggtgcgtgcagggagccccacc

SEQ ID NO: 30393 - DNA, 130 bp, Homo sapiens
ccctgcccactagcctctctcctgaatctgcatcttcctcaagctgactgtctcttcctctctcagtctttacttatgtggtgatggtggtggtggggtgagtagggggtgttattgagtggtcaagttc

SEQ ID NO: 30394 - DNA, 79 bp, Homo sapiens
tgttttccctttcacttgactgtcactctcattgtcctcccggggccgggaacgcggggtgacaggcaaggggagccca

SEQ ID NO: 30395 - DNA, 64 bp, Homo sapiens
ggcctctgcagcacaagtgtttctgtgaaccccttattcacacagacactccgtgtgagactcc

SEQ ID NO: 30396 - DNA, 80 bp, Homo sapiens
tgatgtttcccatcctctctctgtatctctctggattcctgcagtggccctagggggaggtaaagaggcagagactgtca

SEQ ID NO: 30397 - DNA, 77 bp, Homo sapiens
ggataaaacctgaggacacagtgtgtgtgtgtctgtgtgtacacacaaatacacacgccagtgtcagaggcttgtct

SEQ ID NO: 30398 - DNA, 68 bp, Homo sapiens
aagcctctgacactggcgtgtgtatttgtgtgtacacacagacacacacacactgtgtcctcaggttt

SEQ ID NO: 30399 - DNA, 79 bp, Homo sapiens
ccggttccgccccgcaggccgctgctacggaggcgcccgctcgctgtctcgctctctggcggtgtctgcgtgtgttcgg

SEQ ID NO: 30400 - DNA, 127 bp, Homo sapiens
ttttggcagtgggtggaagattcttttaaaactgaatggctaaacctgtatggtaactattgaagtatgatcgaaatacttttattcatgatttttttaggccaaaaaatgctatgaaggtaagcca

SEQ ID NO: 30401 - DNA, 104 bp, Homo sapiens
tcatccctgttgttgggtattagcaatttgttcatttttttataatcaagcagtattccattgtatggatataacaatttgtttagctattcatctggtgatga

SEQ ID NO: 30402 - DNA, 119 bp, Homo sapiens
ttgggtgaatttttcaatttcgttttattctcatcatttgtatagagagcaaatatttatataatttatttgcttatgatagagaactatattcagatggtactgaagttatcacttaa

SEQ ID NO: 30403 - DNA, 167 bp, Homo sapiens
ccagggattggggagtgcgtattggtcagactgaagatgaaatcatacgggggttgaagtcgatttttttttttttttttttttttttggagatagagtctccctctgtcacccaggctagagtgtggtggcgcgttctcggcacactgcagcctctgcctcccggg

SEQ ID NO: 30404 - DNA, 118 bp, Homo sapiens
agggacacttttacacaaagctctgaggccacgtggggaagagtacagggcagagtgagctcagtgggaggagaggtctctgccagaatgccttccttggtgaggtcatgttggagct

SEQ ID NO: 30405 - DNA, 87 bp, Homo sapiens
gcttaacagtccagagcccagcttttctctctctttttttttttttttttttttgagagagtctcgctctgtcgcccaggctggagt

SEQ ID NO: 30406 - DNA, 101 bp, Homo sapiens
gacttcctatttacctctatgacagcacttagcacattacattataattgttgacatttgtgtcactagaatgtgtgctccttgaggtcacggtatgagtc

SEQ ID NO: 30407 - DNA, 108 bp, Homo sapiens
ggtctctttctcaagctcattcctggttattttcagtacttagctctttgcaaaaactgcgtaataagtgtcttagtgagagtgtgccttgtttatgtgctgaaaacc

SEQ ID NO: 30408 - DNA, 58 bp, Homo sapiens
tgagacagagtctccctctgtcacccaagctggagtgcagtggcacgatctcgtctca

SEQ ID NO: 30409 - DNA, 82 bp, Homo sapiens
accaggacaaagctcactgtttctctgtgacccttgagcctcaggattttatgtggggaaattaaaagagcactattctggt

SEQ ID NO: 30410 - DNA, 90 bp, Homo sapiens
tgtatatgtatatatgtgtgtatgtatatgtgtgtgtgtatatatacacacatacatacacacgcatacacacatatgcacacatatata

SEQ ID NO: 30411 - DNA, 76 bp, Homo sapiens
ggaggctgaggtaggaggatcacttgagcccaggaatttgaggctgtagtgagctatgattgtaccactgcactcc

SEQ ID NO: 30412 - DNA, 103 bp, Homo sapiens
cctggggaaggaaatgctggaactgggtttctgaaaggagatttttttttttttttttttttttttttttttttaaagacagggtctggctctgtcacccagg

SEQ ID NO: 30413 - DNA, 110 bp, Homo sapiens
cttgcttctgactttacaggatcatatgtggaagggacttgccttgtctcagatgagactctggacttggacttttgagttaatgctgaaatgagttaagactttggggg

SEQ ID NO: 30414 - DNA, 84 bp, Homo sapiens
gttgtgctcactggcacacttctgcagcacagcagcttctccagcatctgttcctgctttgattggtggccagaaacactcagc

SEQ ID NO: 30415 - DNA, 58 bp, Homo sapiens
tgagatggagtctcactctgtcacccaggctggagtgcagtgatgtgatctccgctca

SEQ ID NO: 30416 - DNA, 79 bp, Homo sapiens
ttgggttgcatgcgtactggactctgtgggtaatttttttttttttttgaaacagagtctcacttactctgtcacccag

SEQ ID NO: 30417 - DNA, 118 bp, Homo sapiens
tgcacccatgctgagaggcagaaatctctgttgtgaatatttgatacctcttgctttatttatttatttatttatttattgacacagattctcactctgtcacctaggctggagtgca

SEQ ID NO: 30418 - DNA, 117 bp, Homo sapiens
ctcccaaagtgttgggatgacaggcatgagccactgctcccagcctatttttatttttaaagacaggatcttggccaggtgtggtggctcacgcctgtaatcccatcactttgggag

SEQ ID NO: 30419 - DNA, 111 bp, Homo sapiens
tgcaaagccagcgatgtcatatctgtctgacccttcccccactgtccatctctctctttgaacacagacagggaaggttttctgctctcatagacttgtggttaaattgta

SEQ ID NO: 30420 - DNA, 104 bp, Homo sapiens
ttccagacactggaaatgttttagacatgtggatccctgtttttttgtttgtttgtttgtttgtttttttgagagagggtctcagtctgtcaccgaggctggag

SEQ ID NO: 30421 - DNA, 86 bp, Homo sapiens
aagacaatgcagccaatgaaatgtctctaggcagactgattttttttttaatgcaataggataattgtctttgcgctgtgtgtttt

SEQ ID NO: 30422 - DNA, 81 bp, Homo sapiens
gtcttccctctgcatattaagggctcagaccaggatccctaaccagcttcctctgagagcctgagtgcgtgaggctgggac

SEQ ID NO: 30423 - DNA, 104 bp, Homo sapiens
atggctcaactttctcactgtgcctctggggctatgtggagagactctgtctctctctcatagaatagagccctttaggtagaaacagtagtaactacaaccgt

SEQ ID NO: 30424 - DNA, 135 bp, Homo sapiens
gagagcagccctctgcccagcccactctaggggtccagccctctgatggagccgccggctgtgactctggctctctcgtggtgggccctctcctgaagccgcatcccacagacagcttggccactcccttgctcc

SEQ ID NO: 30425 - DNA, 93 bp, Homo sapiens
ggctttgaggttggacagactcactctctgcttcctactccaccaactggctgagtggccctgtgcaagtaagtcactgtgcctctcagggcc

SEQ ID NO: 30426 - DNA, 118 bp, Homo sapiens
gagacattgagaggggtgcgctgtccagcacagagggagacccccgggaggcatgagatctctgtctctcagtcccaaaggtcatctcagagcagcagcagcagcagcagacaagctt

SEQ ID NO: 30427 - DNA, 68 bp, Homo sapiens
caatgcagacagaggaggttgaacttgttgccgtaagcagtggacagactgaatctctgtctctgttg

SEQ ID NO: 30428 - DNA, 58 bp, Homo sapiens; identical to SEQ ID NO: 637

SEQ ID NO: 30429 - DNA, 72 bp, Homo sapiens
tgacaccgtggcgtgtgtgtgcacagagggaagagtcaaagggatggctggagtacacaggttaaggtgtgg

SEQ ID NO: 30430 - DNA, 58 bp, Homo sapiens; identical to SEQ ID NO: 1101

SEQ ID NO: 30431 - DNA, 56 bp, Homo sapiens; identical to SEQ ID NO: 1102

SEQ ID NO: 30432 - DNA, 69 bp, Homo sapiens
aagggctctgaccttgctgtgtctcagtctctttctctgtataacagcagatttggtctgaatgtcttt

SEQ ID NO: 30433 - DNA, 95 bp, Homo sapiens
ggggggttgaggtgcctctgttgtctggcaggtggagagatcccatgcacctgggtaagtaattaggcaacaagaatgggtgtgattttcttcct

SEQ ID NO: 30434 - DNA, 117 bp, Homo sapiens
cagtattgcagctacagtgtattctttatctctgttacttgcatttttattttcttcttttaaaatttattttattttatgcttttagagatgaggtctttctatgttgccaagctg

SEQ ID NO: 30435 - DNA, 114 bp, Homo sapiens
ggtcattcacagaacaaaatttttttctttaattttgatagcatctggtttatcaatttttacttttattgatgatgcttttgttgtaaagtttaaaatattctttgcctggcc

SEQ ID NO: 30436 - DNA, 117 bp, Homo sapiens
tgactctatagtagaaggctgagtcctgtacgttatgttctaaagatagacaaaaatctagagattttcttctttcaaagtaaaagcagatgaggcctcccaccaccctctgagcca

SEQ ID NO: 30437 - DNA, 58 bp, Homo sapiens
tgagagagagtctcgctctgtcacccaggctggagtgcaatggagcgatcttggctca

SEQ ID NO: 30438 - DNA, 104 bp, Homo sapiens
tctgatgctcactacagctctgtctccactcactgttcagatgaggaaactagagagagaatctgcttgtggccatcactgaaaatgcaggagctggcatttga

SEQ ID NO: 30439 - DNA, 76 bp, Homo sapiens
tgatggccacaagcagattctctctctagtttcctcatctgaacagtgagtggagacagagctgtagtgagcatca

SEQ ID NO: 30440 - DNA, 101 bp, Homo sapiens
ccagcctgggcaactgagtgagaccctgtctctaaaaataaatattttttttaaatttttttttttttttagacggagtctccctctgtcacccaggctgg

SEQ ID NO: 30441 - DNA, 110 bp, Homo sapiens
cttctgaccggagatctggagacagcgccagaaaactcacttttctttctttctttttttttttttttgagacggagtctggctctgtcgcccaggctggagtgcagtgg

SEQ ID NO: 30442 - DNA, 151 bp, Homo sapiens
atatatatatgtatacatatatgtatatgtatacacatatgtgtgtatatatgtatatgtatacacatatgtgtgtatatatgtatatatacacacatatgtatacatgtatatacacacatatatacatatatgtttacatatatacata

SEQ ID NO: 30443 - DNA, 123 bp, Homo sapiens
tgctcctatatgtgtatatatatatgtgtgtgtatatatgtatatatgtgtatatatatgtgtgtgtatatacgtatacatatatgtatacgtatatacatatgtatgtgtatatatgtatat

SEQ ID NO: 30444 - DNA, 94 bp, Homo sapiens
tctgtttttaaagagtttaaagtcaactgctttttatttattttttttcagaaatgaaaagtaggatgttttaaaaatacttcttagggccggg

SEQ ID NO: 30445 - DNA, 110 bp, Homo sapiens
gtccaatgtgtggttgatttcagagtatgtgccatgtggcaatgagaagaatgtatattttattgttttggggtggagtgttctgtagatgtctatcaggtccattggtc

SEQ ID NO: 30446 - DNA, 114 bp, Homo sapiens
acttgcaactggataggttgggaaattaagccctaaaatagttccttgaagatcagaatcactaacactcagaggctcacaaattggtttccgagccttggagttgtcacaagt

SEQ ID NO: 30447 - DNA, 117 bp, Homo sapiens
cttgcagcatagttcaatattttaaatcattatagtgccttttaaatatatttgtttttataataaatctttggcatgttatagttatttgatagaatattcttactgtgcctgagg

SEQ ID NO: 30448 - DNA, 117 bp, Homo sapiens
tgtatttctaattgtataacatgtatcaattatgtgcaactaattaattgtatataattattaattgtatataactcattaattgtattcaattgatatatactatacattaataca

SEQ ID NO: 30449 - DNA, 89 bp, Homo sapiens
cactagagtatatactgcgtgggcttgaatcctggctccatcctggataagttacatagcctctctctgcctcagtctactcataagtg

SEQ ID NO: 30450 - DNA, 62 bp, Homo sapiens
tgagacagactctcactcactctgtcactcagcctagagtgcagtggcgcaatcttgtctca

SEQ ID NO: 30451 - DNA, 65 bp, Homo sapiens
tatatacggtcagtgtgagtgtgtgtatatatatatatacacacacacacatatgtcagtacata

SEQ ID NO: 30452 - DNA, 107 bp, Homo sapiens
ctgtgtgtgtgtatgtactgtgtactaaatatatactatatgtgtgtgtgtgtgtgtatatatatatatatatatatatttagagagagtcagtgtgtacttaatag

SEQ ID NO: 30453 - DNA, 56 bp, Homo sapiens; identical to SEQ ID NO: 14768

SEQ ID NO: 30454 - DNA, 98 bp, Homo sapiens
cagtgtacttgtctgtgcaatggtcatcttcttcatgaatataattataacatgatataagaaatagtgagctcttacctatagataagcaaacattg

SEQ ID NO: 30455 - DNA, 81 bp, Homo sapiens
tgctctaaaaaataatgtgtgtgtacatgtgtgtatatatatatatatatatatatatatgcatacacatgtttgtgtgta

SEQ ID NO: 30456 - DNA, 62 bp, Homo sapiens
tgtcacacccctctgtctctgtctgaggccctggaaaagaaagtaacagagtgggtttaaca

SEQ ID NO: 30457 - DNA, 116 bp, Homo sapiens
catctggcaaaaggattaaatctcttgacaaaaagccaagtcgttggttgtttacttatatttattcaaacaaatctgtaggctcatagtttgtcactgatgtcatgcctttgagc

SEQ ID NO: 30458 - DNA, 83 bp, Homo sapiens
gatggtcatgtagctaatatctggatcatgccatatggcatatatggctaagatttttttttcaattagtaagacaagccttc

SEQ ID NO: 30459 - DNA, 62 bp, Homo sapiens; identical to SEQ ID NO: 30456

SEQ ID NO: 30460 - DNA, 73 bp, Homo sapiens
gagacagagtctcgctctgtcacccaggctggaatgcaatggtgcaatctcggctcactgcatcctctgtctc

SEQ ID NO: 30461 - DNA, 111 bp, Homo sapiens
ttttaaaagtcaaagggataggtaagtaaaaaattgaatgcaatatgtaggaaatgctgctttcttatttttatttttattttttatttatttatttatttatttttgaga

SEQ ID NO: 30462 - DNA, 110 bp, Homo sapiens; identical to SEQ ID NO: 30445

SEQ ID NO: 30463 - DNA, 115 bp, Homo sapiens
cttgcagcatagttcaatattttaaatcattatagtgccttttaaatatatgtttttataataaatctttggcatgttatagttatttgatagaatattcttactgtgcctgagg

SEQ ID NO: 30464 - DNA, 140 bp, Homo sapiens
ctcctaattgtgatgagtctacagagacccctgcttcgtgacccagcctcatagctgtcctgtcactttctgcttggccaccttgtctcttgcccattgctccttgggagttgaccagtgcttcaagggtaaaagcagaa

SEQ ID NO: 30465 - DNA, 62 bp, Homo sapiens
tgagacagactctcactcactctgtcactcaggctggagtgcagtggcgcaatcttgtctca

SEQ ID NO: 30466 - DNA, 62 bp, Homo sapiens
tgagacaagattgcgccactgcactccagcctgagtgacagagtgagtgagagtctgtctca

SEQ ID NO: 30467 - DNA, 93 bp, Homo sapiens
atggcccccaactgcatcatggtgctacaaaggacatgatttcattattttttatggctgcatagtattccatggtgtatatatatacaccat

SEQ ID NO: 30468 - DNA, 77 bp, Homo sapiens
tgtgtgtgtgtatgtactatgtactaaatatatactatatgtgtgtgtgtgtgtgtgtgtgtatatatatatatata

SEQ ID NO: 30469 - DNA, 58 bp, Homo sapiens; identical to SEQ ID NO: 502

SEQ ID NO: 30470 - DNA, 98 bp, Homo sapiens
cagtgtacttgtctgtgcagtggtcatcttcttcatgaatataattataacatgatataagaaatagtgagctcttacctatagataagcaaacattg

SEQ ID NO: 30471 - DNA, 81 bp, Homo sapiens
tttgggagaatgctttctttgtttctttctttctttctttcttttttttttttgagacagagacttgttctttcacccagg

SEQ ID NO: 30472 - DNA, 97 bp, Homo sapiens
tttttctatttgtttgaaatctggaaatttttaacattgtaatggtggttatatcattatttatgttaattttctcaatttctgatatgtgtcaaaa

SEQ ID NO: 30473 - DNA, 62 bp, Homo sapiens; identical to SEQ ID NO: 30456

SEQ ID NO: 30474 - DNA, 111 bp, Homo sapiens; identical to SEQ ID NO: 30461

SEQ ID NO: 30475 - DNA, 73 bp, Homo sapiens; identical to SEQ ID NO: 30460

SEQ ID NO: 30476 - DNA, 66 bp, Homo sapiens
cacccttgattattcaggcagtctacctgggggagttactgactcactgtgtgaataatcagagtg

SEQ ID NO: 30477 - DNA, 66 bp, Homo sapiens; identical to SEQ ID NO: 30476

SEQ ID NO: 30478 - DNA, 97 bp, Homo sapiens; identical to SEQ ID NO: 30472

SEQ ID NO: 30479 - DNA, 117 bp, Homo sapiens; identical to SEQ ID NO: 30447

SEQ ID NO: 30480 - DNA, 110 bp, Homo sapiens; identical to SEQ ID NO: 30445

SEQ ID NO: 30481 - DNA, 105 bp, Homo sapiens
ttcaggaaacttttcttctgtgatgacatgtggttttttgtttttttttttttttaaaaaaaacattggccgtagacttaaagcagaaagaatattggaaatgag

SEQ ID NO: 30482 - DNA, 94 bp, Homo sapiens; identical to SEQ ID NO: 30444

SEQ ID NO: 30483 - DNA, 105 bp, Homo sapiens; identical to SEQ ID NO: 4709

SEQ ID NO: 30484 - DNA, 97 bp, Homo sapiens; identical to SEQ ID NO: 30472

SEQ ID NO: 30485 - DNA, 118 bp, Homo sapiens
cattcagtgaaagtttcaaagcaaagagaatgaatgaatatatatatatatatatatatatatatatatatatatatatatggatgtttactttttggattacagttttcagattatg

SEQ ID NO: 30486 - DNA, 62 bp, Homo sapiens; identical to SEQ ID NO: 30456

SEQ ID NO: 30487 - DNA, 111 bp, Homo sapiens; identical to SEQ ID NO: 30461

SEQ ID NO: 30488 - DNA, 73 bp, Homo sapiens; identical to SEQ ID NO: 30460

SEQ ID NO: 30489 - DNA, 83 bp, Homo sapiens
tgtggccacctttgattattcaggcagtctacctgggggacttactgactcactgtgtgaataatcagagtgagaattgtaca

SEQ ID NO: 30490 - DNA, 84 bp, Homo sapiens
cccacctccaaaatagagtcacattcaggatgcccagggagatggtggcagtcatggagcaaaagggacctgtacttgggtggg

SEQ ID NO: 30491 - DNA, 58 bp, Homo sapiens
tgagaccgagtgtcactctgtcacccaggctggagtgcagtggcacaagttcggctta

SEQ ID NO: 30492 - DNA, 62 bp, Homo sapiens
ctgagatggagtctcactctgtcacccaggctggggtgcagagtgcaatggcgtgatcttgg

SEQ ID NO: 30493 - DNA, 66 bp, Homo sapiens; identical to SEQ ID NO: 30476

SEQ ID NO: 30494 - DNA, 101 bp, Homo sapiens
ggaatctctgatttgtctctggcactttcaagaatttgtatatttctttgtcatctgatgattcattaaaatgtatcaaggtgttggagatttttttttca

SEQ ID NO: 30495 - DNA, 111 bp, Homo sapiens; identical to SEQ ID NO: 30461

SEQ ID NO: 30496 - DNA, 62 bp, Homo sapiens; identical to SEQ ID NO: 30492

SEQ ID NO: 30497 - DNA, 58 bp, Homo sapiens; identical to SEQ ID NO: 30491

SEQ ID NO: 30498 - DNA, 66 bp, Homo sapiens; identical to SEQ ID NO: 30476

SEQ ID NO: 30499 - DNA, 73 bp, Homo sapiens; identical to SEQ ID NO: 30460

SEQ ID NO: 30500 - DNA, 58 bp, Homo sapiens
tgagaccgagtgtcactctgtcacccaggctggagtacagtggcacaagttcggctta

SEQ ID NO: 30501 - DNA, 66 bp, Homo sapiens; identical to SEQ ID NO: 30476

SEQ ID NO: 30502 - DNA, 79 bp, Homo sapiens
tagaagccatgtctgctttgtggttgtttactggaactttgaagcattggtctcacagctcaggtaggtggtgcttttg

SEQ ID NO: 30503 - DNA, 66 bp, Homo sapiens; identical to SEQ ID NO: 30476

SEQ ID NO: 30504 - DNA, 113 bp, Homo sapiens
gatgctgcatggtaaagttgcagagatcagatatcagccccaattttcttttttttatacaatggtgatgatgatgttgatattaataatcatcttaacatttactgagtatt

SEQ ID NO: 30505 - DNA, 105 bp, Homo sapiens
atttcactccattgtcaagagagagagatatatatatatatataaaatacatattaaattatgtgtgtgtatatgtatatcttttaagaccaattttattgagat

SEQ ID NO: 30506 - DNA, 97 bp, Homo sapiens; identical to SEQ ID NO: 30472

SEQ ID NO: 30507 - DNA, 98 bp, Homo sapiens; identical to SEQ ID NO: 30454

SEQ ID NO: 30508 - DNA, 93 bp, Homo sapiens; identical to SEQ ID NO: 30467

SEQ ID NO: 30509 - DNA, 62 bp, Homo sapiens; identical to SEQ ID NO: 30466

SEQ ID NO: 30510 - DNA, 62 bp, Homo sapiens; identical to SEQ ID NO: 30465

SEQ ID NO: 30511 - DNA, 78 bp, Homo sapiens; identical to SEQ ID NO: 8995

SEQ ID NO: 30512 - DNA, 58 bp, Homo sapiens; identical to SEQ ID NO: 47

SEQ ID NO: 30513 - DNA, 60 bp, Homo sapiens
actgtggcttggcctccctgcagttggtggcgacagagactgtagtgtggctggagcggt

SEQ ID NO: 30514 - DNA, 87 bp, Homo sapiens
catttctgtatatagatatgtgtacatatgtttatacatataaatatatagatatgtgtgtatgtacatatttctgtatgagtcatg

SEQ ID NO: 30515 - DNA, 58 bp, Homo sapiens; identical to SEQ ID NO: 30500

SEQ ID NO: 30516 - DNA, 76 bp, Homo sapiens; identical to SEQ ID NO: 25226

SEQ ID NO: 30517 - DNA, 61 bp, Homo sapiens
tgtgaatagtaaccaacacagccattgaaaatagtgagagtggctgggtcggtggctcaca

SEQ ID NO: 30518 - DNA, 91 bp, Homo sapiens
gagcacatagtaagttcttgttagttcattcattcattgaacagtgtttagaagtttgaacaagcttgaacaacttgccatcattttgctc

SEQ ID NO: 30519 - DNA, 72 bp, Homo sapiens
atgaggatgtgcatctccaagtgcttttccttccatgggtgtggagtaccaggggatactgtacatctttat

SEQ ID NO: 30520 - DNA, 60 bp, Homo sapiens
gcatatacatatacatatgcatatacatatatatgtatgtgtatatatatatgtgtgtgt

SEQ ID NO: 30521 - DNA, 85 bp, Homo sapiens
acattgatggacatgtggactatttggattcagaagacctggtttgagctcatctctgctgccaactgtctgtgtgaccttaagt

SEQ ID NO: 30522 - DNA, 125 bp, Homo sapiens
catatgtgtgtgtatatatatacatatgtgtgtatatataacatatatacatatgtgtgtatatatataatatatatacatatgtgtgtatatataacatatacatatgtgtgtatatacatata

SEQ ID NO: 30523 - DNA, 82 bp, Homo sapiens
atgtgtatatatatatgtgtgtgtgtatatatatgtgtgtatatatgtgtgtatatatgtgtgtatatatgtgtgtatatat

SEQ ID NO: 30524 - DNA, 92 bp, Homo sapiens
ggcagctgggaaggagatgtagcaggaaggtttctggctggactcttctccaaagttgcactgtcaagctgtctctctgaaatcaagctgct

SEQ ID NO: 30525 - DNA, 108 bp, Homo sapiens
tagaaacaaatgcgtgtgcatatatatatgtaaaatatacatatttatatgtgtgaaaatatgtgtgcatgtatgtgtgtgtgtgtgtgtaaaaccaatcaacttctg

SEQ ID NO: 30526 - DNA, 118 bp, Homo sapiens
ccagcaatgtataagcatgcccttttcaccacattcatgccaaaatctgtttctttgttttttttgactttttaataatggctattatgctgggaaaagatggtatctcactgtggct

SEQ ID NO: 30527 - DNA, 71 bp, Homo sapiens
gggtggctgtgggaatttctttttctttctttttttttttttttttgagtcagagtctcactccgtcgccc

SEQ ID NO: 30528 - DNA, 77 bp, Homo sapiens
cctatgattacaaaggtccgtgacagaagtatggggccatggggctctctctcagtcactatttctttgtggtaagg

SEQ ID NO: 30529 - DNA, 95 bp, Homo sapiens; identical to SEQ ID NO: 68

SEQ ID NO: 30530 - DNA, 93 bp, Homo sapiens; identical to SEQ ID NO: 69

SEQ ID NO: 30531 - DNA, 77 bp, Homo sapiens; identical to SEQ ID NO: 30528

SEQ ID NO: 30532 - DNA, 95 bp, Homo sapiens; identical to SEQ ID NO: 68

SEQ ID NO: 30533 - DNA, 93 bp, Homo sapiens; identical to SEQ ID NO: 69

SEQ ID NO: 30534 - DNA, 93 bp, Homo sapiens
aggtgagaggcacatctcaacacagctgactgatcagactcaggtgagtgggacctgctctcttctcttgctcctagcttggggacagtcgct

SEQ ID NO: 30535 - DNA, 99 bp, Homo sapiens
ttgggcacttagattgttttcacatttggctattaggaataatgttgttgtgaacatttcttgtacagtttttgtgtaaggacatgttttcaattccag

SEQ ID NO: 30536 - DNA, 106 bp, Homo sapiens
attgtaattgttctggagatcctgggatgcatagacagtgaatatctttttgttttttgagatggagtctcactctgtctcccaggctgcagtgcagtggtgcgat

SEQ ID NO: 30537 - DNA, 78 bp, Homo sapiens; identical to SEQ ID NO: 8995

SEQ ID NO: 30538 - DNA, 70 bp, Homo sapiens
gtgtatatatgtgtgtatatatatgtgtgtgtatatatatatgcatatatgtgtatatatatatatagat

SEQ ID NO: 30539 - DNA, 129 bp, Homo sapiens
ccagagatactacattttgagctggatgccagaccttgaaagaactctgcatttttcattttgagagaagtcagtgtgttttataatgggaggaagattaaagcaggtattttggcatcagaaggactg

SEQ ID NO: 30540 - DNA, 88 bp, Homo sapiens
atatacatatgtgtgtatatatatacatatgtgtatatataacctatatacatatgtgtgtatatataacctatatacatatgtgtgt

SEQ ID NO: 30541 - DNA, 83 bp, Homo sapiens
tgctgacaagtgagagtcacagagtagttacagagctgttctcggggatgtgtttggtactctctcaggattttcttccagca

SEQ ID NO: 30542 - DNA, 84 bp, Homo sapiens
ttcagtgtctcccagaagtgtgagattcttttttttttttttttttttttgagacagaatttcactcttgttgcccaggctgga

SEQ ID NO: 30543 - DNA, 78 bp, Homo sapiens; identical to SEQ ID NO: 8995

SEQ ID NO: 30544 - DNA, 106 bp, Homo sapiens; identical to SEQ ID NO: 30536

SEQ ID NO: 30545 - DNA, 93 bp, Homo sapiens; identical to SEQ ID NO: 30534

SEQ ID NO: 30546 - DNA, 81 bp, Homo sapiens
gacaggatgaaatgtttatgaaatagatcaatattgctcattgtgatattcatcattgaataattatatttttattttgtc

SEQ ID NO: 30547 - DNA, 95 bp, Homo sapiens; identical to SEQ ID NO: 68

SEQ ID NO: 30548 - DNA, 93 bp, Homo sapiens; identical to SEQ ID NO: 69

SEQ ID NO: 30549 - DNA, 78 bp, Homo sapiens
agtagggtgggagagagcaggctggaaagtagagctcagtagtctatgtctgtccatctgtctgtctgcctatctgct

SEQ ID NO: 30550 - DNA, 81 bp, Homo sapiens; identical to SEQ ID NO: 30546

SEQ ID NO: 30551 - DNA, 95 bp, Homo sapiens; identical to SEQ ID NO: 68

SEQ ID NO: 30552 - DNA, 93 bp, Homo sapiens; identical to SEQ ID NO: 69

SEQ ID NO: 30553 - DNA, 99 bp, Homo sapiens
gatggctaaagaactgtttctagtaattttatttgctttttttatgctgttttatagggcattgctcccaaaatagagttttctacaaggacagccatc

SEQ ID NO: 30554 - DNA, 113 bp, Homo sapiens
cttcaaacctgttatatgctttctggaatttactatgtctagaaatcttgaagaacacagtctttgtttttttttttgttttttctaggcagaggaagaaggttattttgaag

SEQ ID NO: 30555 - DNA, 97 bp, Homo sapiens
ggcacaagaattgcttaaacccagaaggcagagattacagtgagctgagatgtcgtcactgcactccaatctgggtgacagagcaatactctgtatc

SEQ ID NO: 30556 - DNA, 98 bp, Homo sapiens
gaggatgggaaaagggagggatactttgctgaaaggcagagatagtgatctcttactgtctctgagactgaagggtggtcctcaatttaatctttcct

SEQ ID NO: 30557 - DNA, 90 bp, Homo sapiens
agtttattattgttacaggggcttgacagtagtgagtcagcttttggagcgaagtgtgggctcttagcaagatggcatttcgagcactct

SEQ ID NO: 30558 - DNA, 114 bp, Homo sapiens
ttcaggtagatatgagactgaactgtcctttttcggttatcatggtaccgatgctgtatatctgaaaggtacagtactgtgataactgaagaatggtggtgccatcacattgag

SEQ ID NO: 30559 - DNA, 63 bp, Homo sapiens
gagtggagtctcactctgtcacccaggctgaactgcagtggtgtgatatctgagccttggctc

SEQ ID NO: 30560 - DNA, 75 bp, Homo sapiens
cagtaggcatagcagtaattatggtagcggaggtgaagtatgctcatgtgtctgtgtctatgtctgttcctactg

SEQ ID NO: 30561 - DNA, 126 bp, Homo sapiens
tgtgaatatttggtaaagatctagtagtgaaagttttgggttataaagtattttcatatttagttttttttaaaaaaactatcaaatgcttttccattttcactgtaccattttatatttactaga

SEQ ID NO: 30562 - DNA, 88 bp, Homo sapiens
gtaaccaatagtaagattactgaaccatatggtagttctatttttaatttttaagggacttccatagagtttttcatgctggatgtac

SEQ ID NO: 30563 - DNA, 76 bp, Homo sapiens
ggcagtcaagacctcagggtgtaaaaatggaatattgatatttattctgtatttattccaggaagatttcactgcc

SEQ ID NO: 30564 - DNA, 112 bp, Homo sapiens
tcttactgattgtacattatggtgagttgtataattatttcattatatattacaatgtaataataatagaaataaagtacaccataaatataatgcacttgaatcatcctga

SEQ ID NO: 30565 - DNA, 81 bp, Homo sapiens
atatatatgtatatatacatatgtgtgtatacatatatatatacatatgtgtatatatacatatgtatgtatatgtatatg

SEQ ID NO: 30566 - DNA, 103 bp, Homo sapiens
gttggacaactccagaagcaatctgatgtttgtttgcctgtatatttttgtttttctaggcaatgggggctaatctcactagtacttctgtagactgtctagc

SEQ ID NO: 30567 - DNA, 96 bp, Homo sapiens
atgacagaaacttggggtgacggtgggaagggaaagcagtgggagatagaggttatcttttttttttttttttccgacagagtctcactctgtcat

SEQ ID NO: 30568 - DNA, 70 bp, Homo sapiens
gcacaggggtcacgctcagagattttggaagcagacctctgtctaaatctctgtttcacctcctgccagc

SEQ ID NO: 30569 - DNA, 67 bp, Homo sapiens
tctctgttcttgtctgactgtctccttgtctgtcttaattcagaaagtcagtcttcaagctctgaga

SEQ ID NO: 30570 - DNA, 83 bp, Homo sapiens
agcctgggcaacatatcgagaccctgtctctacaaaaaaaattttttttttttgagatggagtctcgctctgtcactcatgct

SEQ ID NO: 30571 - DNA, 108 bp, Homo sapiens
tgagataggaagtggttccttctctttggtgttctggaagagtctgtattcaactgatattatttatttcttaaagagttggtagaatttaccagtgatgctgtctca

SEQ ID NO: 30572 - DNA, 64 bp, Homo sapiens
gggtgaatcagcatctgcatggccccagtctgagcgagtgtggggtatgtgtgtgagtgcgccc

SEQ ID NO: 30573 - DNA, 84 bp, Homo sapiens
cctggggtgtcttctgtaaggaatttctttgtatttgagaggcagctaaattaaagcaatagagaagttacagagcacagtagg

SEQ ID NO: 30574 - DNA, 95 bp, Homo sapiens; identical to SEQ ID NO: 4708

SEQ ID NO: 30575 - DNA, 61 bp, Homo sapiens
gtattacacatgtatgtgtgtatatatatgtatgtgtatatatacatatgtgtgtatatat

SEQ ID NO: 30576 - DNA, 102 bp, Homo sapiens
gatcactttgattcaggtaagcattaaactttttttttaagtcaacactgaaggcacaaagagaagtttttgtttgctgtgaaggcaaaagataatatggtc

SEQ ID NO: 30577 - DNA, 95 bp, Homo sapiens; identical to SEQ ID NO: 68

SEQ ID NO: 30578 - DNA, 93 bp, Homo sapiens; identical to SEQ ID NO: 69

SEQ ID NO: 30579 - DNA, 58 bp, Homo sapiens; identical to SEQ ID NO: 1215

SEQ ID NO: 30580 - DNA, 81 bp, Homo sapiens
tggtattttactgatctggaaatcactggaattgaaacagatttttaaactccagtgattatttttgtaaaataaatacta

SEQ ID NO: 30581 - DNA, 83 bp, Homo sapiens
gaaagactttggaggagacagagcaaggtagtggcatctgatttgcctttttttttttttttttttttaagacagagtctttc

SEQ ID NO: 30582 - DNA, 59 bp, Homo sapiens
gcctggctgtctccctctgtaacaccctctagtgacagagcctaactggagcagctggc

SEQ ID NO: 30583 - DNA, 58 bp, Homo sapiens
tgagacgaaatctctctctgtcacccaggctggagtgcagtggcgagatctcagctca

SEQ ID NO: 30584 - DNA, 58 bp, Homo sapiens
tgagactgagtctcgctctgtctcccaggctggagtgcagtggcgcaatctcggctca

SEQ ID NO: 30585 - DNA, 75 bp, Homo sapiens
ttcctcatacggttaaaacagagtgaactttttttttttttgagacagagtctggctctgttgcccaggctggag

SEQ ID NO: 30586 - DNA, 119 bp, Homo sapiens
tatttagagtaagcatggtaacttgtgaggtagtacataatttaattccctgactgggaaacttgtgaaattcttgatcccttgttctacttgacaaatgtgaatacctgtagtgtttg

SEQ ID NO: 30587 - DNA, 118 bp, Homo sapiens
gattgaaattacttaccaacatcacaataatacaggatgctatatttctctatatatttgctttacaacagagctttatagtattctatggcttttttggtactctcattttttaatc

SEQ ID NO: 30588 - DNA, 60 bp, Homo sapiens
gtgagatggagtctcactctgtcacccaggctggagtgcagtggtgcgatctcagctcac

SEQ ID NO: 30589 - DNA, 58 bp, Homo sapiens; identical to SEQ ID NO: 2051

SEQ ID NO: 30590 - DNA, 102 bp, Homo sapiens
cccactgagatgacccatagtaccccattccttgctgcaatgtaattatatttacttacaagtgtgctcctggtggtctttaactgaagggcactgactggg

SEQ ID NO: 30591 - DNA, 62 bp, Homo sapiens; identical to SEQ ID NO: 30492

SEQ ID NO: 30592 - DNA, 87 bp, Homo sapiens; identical to SEQ ID NO: 30514

SEQ ID NO: 30593 - DNA, 58 bp, Homo sapiens
tgagatggtgtctcactctgtcactcaggctagagtgcagtggtgggatctcagctca

SEQ ID NO: 30594 - DNA, 63 bp, Homo sapiens
ggcagtgcctcagtggggactgtgtgtgaaggctctgacctcacatttctcttctgcactgcc

SEQ ID NO: 30595 - DNA, 118 bp, Homo sapiens
tggaaaatcccctgggacagggaatgttaaagctccattttgtcactaaaagttgtccagatatttccttttatttttttgagatggagtctctctctgtcacccaggctggagtgca

SEQ ID NO: 30596 - DNA, 115 bp, Homo sapiens
acattatgccaagcattataattttactttctagaccaagaagatatttttatgttttttttggggcagacaagtgacaaagtgagatatttatgctttagaaaggttagttgta

SEQ ID NO: 30597 - DNA, 83 bp, Homo sapiens
gcaatatatgtatgtatatatgtgtgtgtgtatatatgtgtatacgtgtatatatgtgtgtatgtatatatgcatatatatgt

SEQ ID NO: 30598 - DNA, 67 bp, Homo sapiens
ttgtttgagacagtctctctctgtggtccaagctggagtgcagtggcgggatctcggctcacttcaa

SEQ ID NO: 30599 - DNA, 67 bp, Homo sapiens; identical to SEQ ID NO: 30598

SEQ ID NO: 30600 - DNA, 115 bp, Homo sapiens
gctgggattacagatgtgagccaccacacccagtctttttttttgagatggagtctcactctgtcacccaggctggagtgcaatggtgccaatcttagctcactgcagcccctgc

SEQ ID NO: 30601 - DNA, 83 bp, Homo sapiens; identical to SEQ ID NO: 30597

SEQ ID NO: 30602 - DNA, 118 bp, Homo sapiens; identical to SEQ ID NO: 30595

SEQ ID NO: 30603 - DNA, 63 bp, Homo sapiens; identical to SEQ ID NO: 30594

SEQ ID NO: 30604 - DNA, 58 bp, Homo sapiens; identical to SEQ ID NO: 30593

SEQ ID NO: 30605 - DNA, 91 bp, Homo sapiens
ctttaatgcttattaggtggcacaagtgttaggttgggtattttactaaatatttaatcattatatatgcacatatttatgggcatgtgag

SEQ ID NO: 30606 - DNA, 92 bp, Homo sapiens; identical to SEQ ID NO: 30524

SEQ ID NO: 30607 - DNA, 108 bp, Homo sapiens
tagaaacaaatgtgtgtgcatatatatatataaaatatacatatttatatgtgtgtaaatatatgtgcatgtgtgtgtgtgtgtgtatgtaaaaccaatcaacttctg

SEQ ID NO: 30608 - DNA, 102 bp, Homo sapiens; identical to SEQ ID NO: 30590

SEQ ID NO: 30609 - DNA, 119 bp, Homo sapiens
acccttcccagactctggtaatcatccttgtactctctttgtccatgggttcaattattttgatttttagatcccacaaataagtgacaacaagggatgtttgtctttctgtgcctggt

SEQ ID NO: 30610 - DNA, 105 bp, Homo sapiens
tagttctccttgaagaggtccttcacatcccttgtaagatggattcctaggtattttattttctttaaagcaattgtgaatgggacttcactcatgatttggctg

SEQ ID NO: 30611 - DNA, 95 bp, Homo sapiens; identical to SEQ ID NO: 68

SEQ ID NO: 30612 - DNA, 93 bp, Homo sapiens; identical to SEQ ID NO: 69

SEQ ID NO: 30613 - DNA, 77 bp, Homo sapiens; identical to SEQ ID NO: 30528

SEQ ID NO: 30614 - DNA, 71 bp, Homo sapiens; identical to SEQ ID NO: 30527

SEQ ID NO: 30615 - DNA, 74 bp, Homo sapiens
tggtcagtcactgtggctcacacctataatcccaataatttgggaagccaaggcatgaggatcagttgattcca

SEQ ID NO: 30616 - DNA, 56 bp, Homo sapiens
gagaccgagtcacactctgtcttccaggctggagtgcagtggcacgatcttggctc

SEQ ID NO: 30617 - DNA, 78 bp, Homo sapiens; identical to SEQ ID NO: 30549

SEQ ID NO: 30618 - DNA, 95 bp, Homo sapiens; identical to SEQ ID NO: 68

SEQ ID NO: 30619 - DNA, 93 bp, Homo sapiens; identical to SEQ ID NO: 69

SEQ ID NO: 30620 - DNA, 78 bp, Homo sapiens
agcagggtgggagagagcaggctggaaagtagagctcagtagtctatgtctgtccatctgtctgtctgcctatctgct

SEQ ID NO: 30621 - DNA, 94 bp, Homo sapiens; identical to SEQ ID NO: 30444

SEQ ID NO: 30622 - DNA, 77 bp, Homo sapiens; identical to SEQ ID NO: 30528

SEQ ID NO: 30623 - DNA, 66 bp, Homo sapiens
gggtggctgtgggaatttctttttcttttttttttttttttgagtcagagtctcactccgtcgccc

SEQ ID NO: 30624 - DNA, 56 bp, Homo sapiens
tgagacagagtctcactctgtcactcaggctggagtgcagtggtgaactcggctca

SEQ ID NO: 30625 - DNA, 78 bp, Homo sapiens; identical to SEQ ID NO: 8995

SEQ ID NO: 30626 - DNA, 92 bp, Homo sapiens
ggcagctgggaaggagacgtagcaggaaggtttctggctggactcttctccaaagttgcactgtcaagctgtctctctgaaatcaagctgct

SEQ ID NO: 30627 - DNA, 87 bp, Homo sapiens
atgtgtgtatatatatgtgtatatatgtgtgtgtgtatatatgtgtgtatatatatatgtggatatatatgtgtgtatatatatata

SEQ ID NO: 30628 - DNA, 58 bp, Homo sapiens
tgagatggagtctcactctgtcacccaggctggagtgcagtagtgtgatctcagctca

SEQ ID NO: 30629 - DNA, 58 bp, Homo sapiens; identical to SEQ ID NO: 1673

SEQ ID NO: 30630 - DNA, 95 bp, Homo sapiens; identical to SEQ ID NO: 68

SEQ ID NO: 30631 - DNA, 93 bp, Homo sapiens; identical to SEQ ID NO: 69

SEQ ID NO: 30632 - DNA, 65 bp, Homo sapiens
ttgatatggagtctcactctgtcactcaggctggagggcagtagtgcaatctgggcccactgcaa

SEQ ID NO: 30633 - DNA, 95 bp, Homo sapiens; identical to SEQ ID NO: 580

SEQ ID NO: 30634 - DNA, 93 bp, Homo sapiens; identical to SEQ ID NO: 69

SEQ ID NO: 30635 - DNA, 101 bp, Homo sapiens
gtgtcatatatatggtgtacacacatttgtgtttgtatatacatatatgtatgtatatattactatgtgtgtatatacatatacagacacatacacacata

SEQ ID NO: 30636 - DNA, 105 bp, Homo sapiens; identical to SEQ ID NO: 4709

SEQ ID NO: 30637 - DNA, 97 bp, Homo sapiens
gcactgtgcctgcctcaagatgtttctgactttttctttttcttttttttttttttttttgagatggagtcttgctctgtcacccaggctagagtgc

SEQ ID NO: 30638 - DNA, 96 bp, Homo sapiens
ggatgcacattactaaattttaatagttgtgaatatgttgttatgagtacttagaacaagtaataatggcttttgatgtatagtaagaaagcttcc

SEQ ID NO: 30639 - DNA, 118 bp, Homo sapiens
tctggaggcctaggaaagtgttattgaaagtattttaaatcttagtatcttatatttatcatttatagggtatagtagattaagaaatacttcacgtattttgagagattgggctgga

SEQ ID NO: 30640 - DNA, 95 bp, Homo sapiens; identical to SEQ ID NO: 68

SEQ ID NO: 30641 - DNA, 93 bp, Homo sapiens; identical to SEQ ID NO: 69

SEQ ID NO: 30642 - DNA, 118 bp, Homo sapiens
cctcatgctctttctttttttgcagcctggatatatattttttcagacagatacatatttatttattaaagatgcttattgaattgcattaaaatgttatttaggctgggcacggtgg

SEQ ID NO: 30643 - DNA, 118 bp, Homo sapiens; identical to SEQ ID NO: 4706

SEQ ID NO: 30644 - DNA, 58 bp, Homo sapiens
tgagagggagtctcactctgtcacccaggctggagtgcagtggtgggatcttggctca

SEQ ID NO: 30645 - DNA, 91 bp, Homo sapiens
tcagtgagttcatagagatctgattgttagaaacagcctgggactgcccccttgtctctcttactccctctctgaccatgtgacacactgg

SEQ ID NO: 30646 - DNA, 81 bp, Homo sapiens; identical to SEQ ID NO: 30546

SEQ ID NO: 30647 - DNA, 85 bp, Homo sapiens
agtgagaaagaacaaacaagaattgattatatcctttaaagagctttctcagaggcatcagctagtatcttgtttgcttctcatt

SEQ ID NO: 30648 - DNA, 89 bp, Homo sapiens
gtgatacatattgtttgtatgagatatatatatatgtgtatatatatatatatatatatatatacacccacacacagatagatgattgc

SEQ ID NO: 30649 - DNA, 78 bp, Homo sapiens; identical to SEQ ID NO: 30549

SEQ ID NO: 30650 - DNA, 56 bp, Homo sapiens; identical to SEQ ID NO: 30616

SEQ ID NO: 30651 - DNA, 58 bp, Homo sapiens
tgagacagagtctcactctgtcgcccaggctagggtgccatggtgcgatcttgactca

SEQ ID NO: 30652 - DNA, 74 bp, Homo sapiens; identical to SEQ ID NO: 30615

SEQ ID NO: 30653 - DNA, 58 bp, Homo sapiens; identical to SEQ ID NO: 30593

SEQ ID NO: 30654 - DNA, 63 bp, Homo sapiens; identical to SEQ ID NO: 30594

SEQ ID NO: 30655 - DNA, 56 bp, Homo sapiens; identical to SEQ ID NO: 30616

SEQ ID NO: 30656 - DNA, 74 bp, Homo sapiens; identical to SEQ ID NO: 30615

SEQ ID NO: 30657 - DNA, 76 bp, Homo sapiens; identical to SEQ ID NO: 4704

SEQ ID NO: 30658 - DNA, 77 bp, Homo sapiens
attctgggttggaattcttttctctctctctttttttttttttttttgagacggagtctcattctgtcacccaggat

SEQ ID NO: 30659 - DNA, 102 bp, Homo sapiens
gatttaaaattgtcagtgaaatagttgattgatcatttatatttctataaatatatggaaaataatctattttttaattttaagacattacaattttagatt

SEQ ID NO: 30660 - DNA, 118 bp, Homo sapiens; identical to SEQ ID NO: 4706

SEQ ID NO: 30661 - DNA, 105 bp, Homo sapiens
gtttagttttctgctttgtggttacaatattgttttttaaatattcaacatgaatacactttcttgtttggataacgtgtaaaacgtctgcaaggagggatagat

SEQ ID NO: 30662 - DNA, 87 bp, Homo sapiens
acaggtgagagaagagaatgagcaaagactctttgtagtggggatttttctcttttcactttcttatgctgcatgtgctctccctgt

SEQ ID NO: 30663 - DNA, 86 bp, Homo sapiens
tcccacttccgcctcccaagtagctgtgatggcagctgtgcgccgccacacccggctaatttttgtatttttttgtggagatgggg

SEQ ID NO: 30664 - DNA, 93 bp, Homo sapiens
cacccaatcagttgatgtggaagtaagttctatgcttatgctaactttcacttttccaaaggactttcttcttcagaccatcacctctgggtg

SEQ ID NO: 30665 - DNA, 90 bp, Homo sapiens
cttgtctcagtacttccaaaactctgtgcatgccatataactaagaatctgtttgttaagagtgaacacactttgggaggctgaggtggg

SEQ ID NO: 30666 - DNA, 58 bp, Homo sapiens
tgagactgagtcttactctgtcacttaggctggagtgcagtggcatgatctcggctca

SEQ ID NO: 30667 - DNA, 107 bp, Homo sapiens
catgggtgtacacatatggaaaacattatcaaactatttgaaatgtatacacgtttctatataaagttagatcttaaaatgttgttgatatggacaaaaacagcatg

SEQ ID NO: 30668 - DNA, 93 bp, Homo sapiens
gataaaccatttcccagatgaaagaacttaaagctagaataggaaaacctctgaatgtgagctttaaatgaatttcagaatgggaaaattgtc

SEQ ID NO: 30669 - DNA, 124 bp, Homo sapiens
ggttccctaaatgagctttgacctggccttcgaatacctggcctctctcctgtcacaactcagtgaccacacagaaagcagcaggtgagggtggttggaattaggaggacaccaactgaaatgc

SEQ ID NO: 30670 - DNA, 80 bp, Homo sapiens
tctctcagagtctcagtatttcatgatgctaggccttggtgcaggtctattttcagccagcatgctaagcactcagggga

SEQ ID NO: 30671 - DNA, 131 bp, Homo sapiens
tgaacttggatgagggttcctctttaaaaaggaggaaccctttttatatttatatcctatcacacacagagtcactcccctcaaagggagaggaggccctcttctcacctctgaggctgctcatggcagga

SEQ ID NO: 30672 - DNA, 82 bp, Homo sapiens
tttgagatgcagtctcgctctgtcacccaggctggagtgcagtggcacgatctcggatcactgcaagctctgcctcccgggt

SEQ ID NO: 30673 - DNA, 87 bp, Homo sapiens
ctttgagaggctgaggtaggaggatcacttgaggacaggagttcagaaccatcctgggcaacatagtgagtccctgtctctgtaaag

SEQ ID NO: 30674 - DNA, 118 bp, Homo sapiens
tcagggatttgagttcagtctgggcaacatggtgaaaccccatctcaattttttttttttttttggagacagggtctctcactcttttgcccaggctggagtgcactgatacaatctc

SEQ ID NO: 30675 - DNA, 75 bp, Homo sapiens
ttgccttctgtgcatctgtagctccaacaccatgtggaagccaccaagtcttggggcttgcaccctctgaagcaa

SEQ ID NO: 30676 - DNA, 88 bp, Homo sapiens
tacccatagatacacacacactcacatatttgtaggacacactttattttatatatatatatgtgtgtgtgtgtgtgtgtgtgtgtat

SEQ ID NO: 30677 - DNA, 72 bp, Homo sapiens
caggaggctgaggtagaaggatcactgggcctggagaggtcaaggctgcagtgagccataatctcacgactg

SEQ ID NO: 30678 - DNA, 88 bp, Homo sapiens; identical to SEQ ID NO: 1308

SEQ ID NO: 30679 - DNA, 81 bp, Homo sapiens; identical to SEQ ID NO: 1309

SEQ ID NO: 30680 - DNA, 77 bp, Homo sapiens; identical to SEQ ID NO: 1310

SEQ ID NO: 30681 - DNA, 123 bp, Homo sapiens
gccttaaggacattagccagttttgttttattttattttattgttgagacggagtctcgctctgtcacccaggctgtagtgcagtggtgcaatctcggctcactgcaacctccgcttcctggg

SEQ ID NO: 30682 - DNA, 118 bp, Homo sapiens
ggatgacagagttgctaccttcaaactttttcagagcagactattcactgtgaactcatggcgaccagtaagaacagcagggcatctgtgtgggagtgtggttgccctggtttcccgg

SEQ ID NO: 30683 - DNA, 58 bp, Homo sapiens
tgagacagggtctcactctctcgctaaggctggagtacagtggtgtgatctcggctca

SEQ ID NO: 30684 - DNA, 86 bp, Homo sapiens
catttcatcccagtgagcacacatgcagcaggtttactgaaaagctgccctgtacaatgtattattgtgtgattagtgttgaattg

SEQ ID NO: 30685 - DNA, 126 bp, Homo sapiens
gtagtgtgccctctttggaggatagccttccaagcctttttccgccaggggtttctgcagttttgtttatttgttttgttttgttttgtgacggagtcttgctctgtcacccaggctggagtgcag

SEQ ID NO: 30686 - DNA, 90 bp, Homo sapiens
gacttgcaattctctgatgattagtgatattgaacattttttcatatgtttcttggccacttgtatgtcttcttttgagaagtgtttgtt

SEQ ID NO: 30687 - DNA, 58 bp, Homo sapiens
tgagttggagtctcactctgtcacccaggctggagtgtagcggtgcaatctcagctca

SEQ ID NO: 30688 - DNA, 89 bp, Homo sapiens
cctcagttgaacattccttcaggaatgcccggggaccttgctgggggggttcaggaaggtgtctgactctctgggagtgtgtcttgagg

SEQ ID NO: 30689 - DNA, 61 bp, Homo sapiens
gagactgagtctcactctgtcacccaggctggagtgcagtggcacggtaagatctcggctc

SEQ ID NO: 30690 - DNA, 112 bp, Homo sapiens
cactaagtgctttatatacattatctcacttcattctaggagactgtgattgtcaccatctctcattgacagaagaaactgaggttcagtgaggttaaagaactgctaagtg

SEQ ID NO: 30691 - DNA, 114 bp, Homo sapiens
cccagctaggatccggagtaagctgatgaagaaaagattaatgatagaaagcatctattgaagtatctatttcctttaaaatgctcactctagaagatgtacctactttatggg

SEQ ID NO: 30692 - DNA, 98 bp, Homo sapiens
tgtctgtctatctatctatctatctatctatctatctatctatctctatctatctagataggtaaatagatataaatagatggatatgtaatcaaaca

SEQ ID NO: 30693 - DNA, 92 bp, Homo sapiens
gtcctggaatttagatgtttgtttcctgttccctattgcctttttttttttttttttttgtgatggagggagtctcactctgtcaaccaggc

SEQ ID NO: 30694 - DNA, 99 bp, Homo sapiens
cagttgaggatagatgtggggtttatttctggacttctcaattcgattctattgatctatgtttattcttatgccagtaccacagagtcctccttactg

SEQ ID NO: 30695 - DNA, 96 bp, Homo sapiens
gggccatggctgtgactaagtagcccggacactcagtagaactggcaaagcagactatctgtgtgtcagtgtactttattcatcagtcattgggtc

SEQ ID NO: 30696 - DNA, 105 bp, Homo sapiens
ttaaaaataaatatttcactttagacccaaatatgcatatatgtatatatataaatgggtatatatatttatacttgcatctaaagtgaaagatttatgttttaa

SEQ ID NO: 30697 - DNA, 66 bp, Homo sapiens
tgtcattatgcagtgtatgactgtatatgtatatatataaacatatatgtgtgcatgcataataca

SEQ ID NO: 30698 - DNA, 103 bp, Homo sapiens
tatatttatatgtgtgtgtgtgtatatatatgtgtgtatatatatgtgtatgtatatatatatatgtgtgtgtgtgtgtgtgtgtgtgtgtgtatatatatat

SEQ ID NO: 30699 - DNA, 80 bp, Homo sapiens
agtgtactcattttgtacttattcttgactgataaatgaagtcattcataagttaaaaggtagagaaaatgcagtacatt

SEQ ID NO: 30700 - DNA, 105 bp, Homo sapiens
tagttcttgtgcatagaggtgtccctaatagactctgagggttttttttttttttttgtacttccatggggtcagtggtaatgtcatctttgtcatttctgattg

SEQ ID NO: 30701 - DNA, 99 bp, Homo sapiens
gtaaagccagggaatcttgtatcttccaaagcctaatgtatgcaatgtaaagaaaagtgggtagaagtgaagagacatgggtttaagctttggctctgc

SEQ ID NO: 30702 - DNA, 109 bp, Homo sapiens
gctacagtctttcttcatgtgactcgtggacttccctttgtcatcctatgcctgagaatatatgaaggaggctgggaaggcaaagggacgttcaattgtcatcactggc

SEQ ID NO: 30703 - DNA, 102 bp, Homo sapiens
caggacagcatagggcaggggcggtgtctgtggcacagtagagtcttagcactctgggagttactgggaagagataaacctaccttgatggtgaggggattg

SEQ ID NO: 30704 - DNA, 80 bp, Homo sapiens
gtgggacaacagcttttcttgctttgggttatttctgttaatggaggagtccggcagcacagactaagtcactgtctctc

SEQ ID NO: 30705 - DNA, 102 bp, Homo sapiens
tattgccgagtcgagtgtgtgtattctgtgatcatagaggatggattttttttctttaatgatgtaaatgattaaaccagaggcacagtttgatttttagta

SEQ ID NO: 30706 - DNA, 107 bp, Homo sapiens
ctgatgatgaaaatgcagcaatcagatgagggccacacattaagtatgagagttctgagagaggacagcgcacttgaccaaaagctatttggttgctttgtcttcag

SEQ ID NO: 30707 - DNA, 83 bp, Homo sapiens
gttgcttttactttttatttctttcatttgcaaagccaaacgagggctggtaaagcaaaaatgaaaggattatagagaacaac

SEQ ID NO: 30708 - DNA, 83 bp, Homo sapiens
ctagtgatctcattcaagatacttagcacagtgcttttcatagaagaagcagtctgtgtcaggcagttgttattgtttcctag

SEQ ID NO: 30709 - DNA, 83 bp, Homo sapiens
tgcagtctcgctctctctctctcgatgcagtctcgctctgtcgcccaggctggagtgcagcggtgcagtcggggctcactgca

SEQ ID NO: 30710 - DNA, 114 bp, Homo sapiens
catgggctacacagcgggtatggctgctaacaatactgggtatctttctattgaggaaggctagtgatattgatggagctggctggttggttgtatttaattatttccttcatg

SEQ ID NO: 30711 - DNA, 103 bp, Homo sapiens
tttctgaaagttgttagattacttgcttgagagcctataaagtagaaatacatagtatttgaaatggcttttagagtctgtaaataaaaataaatttgagggg

SEQ ID NO: 30712 - DNA, 102 bp, Homo sapiens
gtactgcagctacgggcttactggcagctccagacaccagtgtccttgtgaacaaggctctggtagatttcaggcgagtttacacatccctagaggcagtac

SEQ ID NO: 30713 - DNA, 98 bp, Homo sapiens
agtggtttttgtgattggaagtttgggcaatcatcagtggtattagctagataagctttggtgccattctgccagtgcattttttcagtcctgccagt

SEQ ID NO: 30714 - DNA, 96 bp, Homo sapiens
tgactttacattatggtgagctgtgtaattatttcattatatattgcaatgtaataataatagaaaaaaagtgcacagtaaatgtaatgtgcttca

SEQ ID NO: 30715 - DNA, 72 bp, Homo sapiens
aagctgggtgacttcactctgaagtgttcaaggtattccttcttacacacactctcactggggtcaaagctt

SEQ ID NO: 30716 - DNA, 86 bp, Homo sapiens
ggaagggcatgctgaattagattgctggccccactctctcagtttctgagatgggaccagagaatttgtatttctaacaggttacc

SEQ ID NO: 30717 - DNA, 109 bp, Homo sapiens
ggcttgcaattagtgttacattagaattgtcacagctaagcaatttttttttaatactagaaggacttcagctgattttatgctacacgtatacactaaacatgcagct

SEQ ID NO: 30718 - DNA, 137 bp, Homo sapiens
gttttctgattccagcagctaattaatctttttttaaaatgaggttataaagtgctatactagcttgtatagttctgaaaaagaggttttagattggggttttaaaatgctcttcatcaggccgagtgcagtggctg

SEQ ID NO: 30719 - DNA, 75 bp, Homo sapiens
cacttgacattagagttgtgtgttttactttttctttttttagggaaagtacaaaggtcttaacaaatgtcagtg

SEQ ID NO: 30720 - DNA, 83 bp, Homo sapiens
catactgaattatgctaaaaatttatttgtaatttaaaatgcaaatttagaatttgaataaaagttcagtgtaatggagtatg

SEQ ID NO: 30721 - DNA, 58 bp, Homo sapiens
tgagacagagtctcgctctgtcacccaggctggagtgcagtagcgcgatcttggctca

SEQ ID NO: 30722 - DNA, 72 bp, Homo sapiens
aagattaggtaattcagaaatagattgccttgtgggcatactatctatttattatgtaaagtacttggtctt

SEQ ID NO: 30723 - DNA, 103 bp, Homo sapiens
atgggctggtaaatattgataccactatatcattaatttattgttttaatattttgataacaatatatcatatagttggcgtcatttttaattctaagtacat

SEQ ID NO: 30724 - DNA, 111 bp, Homo sapiens
agttgttcaacatgaagttagagaatgggaagctatgtatgacagtttttgttgttgttgttttttggttttttttgtagcattaagctctagtaacctgttgaattcact

SEQ ID NO: 30725 - DNA, 114 bp, Homo sapiens
ggagcatttctgacacaaatctgaaataaagcaacaaatgggttagaaaacttgagcattttctttttttcttttctttattattatttttttcttcagacagagtctggctct

SEQ ID NO: 30726 - DNA, 91 bp, Homo sapiens
gtattttggggggagaaattcttaattctaaaacatgtctgatccaagggtttcagataagaattgtgaatttgtactaccccagttttac

SEQ ID NO: 30727 - DNA, 117 bp, Homo sapiens
ggagaaaaggaaatgtccttatctctgaagacacagggacacagagaagaatctgaccagacaggccttgctaagttccccccagtttattaccactagattatatttcctttgccc

SEQ ID NO: 30728 - DNA, 83 bp, Homo sapiens
ttgggaggctgaggtaggaggatcatttgaggccaagagttcaagaccaacttggtcaacatagtgagaccccatctccacaa

SEQ ID NO: 30729 - DNA, 107 bp, Homo sapiens
gtgaatggtgcctgggacatcatatatgttcagtagtggtagctatcattattattattattattattattattattattattattgatggagtctggctctgtcac

SEQ ID NO: 30730 - DNA, 143 bp, Homo sapiens
tctgtgttttactgtctgctctttctggctgcttgtagttagaagagaagtgatttccttgaaatgcatgacactagaaagagagctggaacttaaagtggtggtgtttgtccaacatgacggtgctcctgctctgtcaagca

SEQ ID NO: 30731 - DNA, 85 bp, Homo sapiens
aagcatatatagtctcattaaaacttaatttgttgttttctatccatgggtcacatcagaggtgggtttttttgtgtgtgtgttt

SEQ ID NO: 30732 - DNA, 60 bp, Homo sapiens
gacatgtaggccatgtgaaaactgtgagcacagagctcacagctgttcacttcaacagtc

SEQ ID NO: 30733 - DNA, 78 bp, Homo sapiens
catgtctcctggtacacatgggcatatatttcttttagatatatacctaagagagaaattgctaggtcatgaggtatg

SEQ ID NO: 30734 - DNA, 117 bp, Homo sapiens
acatatatatgtgtgtgtatatatatgtgtgtatatatatgtgtatatatgtgtgtatatatgtatatacatgtgtagatatgtgtgtgtatatatatgtgaatatatatatatata

SEQ ID NO: 30735 - DNA, 83 bp, Homo sapiens
ttagaacccaggtgagagataacagtctgcactccagtaatggaagtgatggaatgataagagctttttcctggctaccctaa

SEQ ID NO: 30736 - DNA, 76 bp, Homo sapiens
tttcagatggagtctggctctgtcacccagtgcagtggagtgcagtggcgcgatctcagctcactgaaacctctga

SEQ ID NO: 30737 - DNA, 61 bp, Homo sapiens
ttgagatggagtctcactctgtcacccaggctggagtagagtgacacaatcttgatctcgg

SEQ ID NO: 30738 - DNA, 91 bp, Homo sapiens
gatggaatagttcttctgtttgcttcactcagtttacagtatgtgcaccaccatgtgtatgtatcctaaaaactgagcagaaacctccatt

SEQ ID NO: 30739 - DNA, 128 bp, Homo sapiens
tgcatacgtatgtatatatgtatgcagacatgtgctgtatacgtaagatatattatgtaatatataaatatatgttaaatatttttatatgtaatatattataaatatttaaatatataatatagtct

SEQ ID NO: 30740 - DNA, 73 bp, Homo sapiens
gaggcagagtctcgctctgtcacccaggccagaatgcagtagcactgtcgtgggtcactgcagtctttgcctc

SEQ ID NO: 30741 - DNA, 63 bp, Homo sapiens
gtgtatgtgcttgtatgtgtggtgtatgcactggcatgcacacacacacacacacacacacac

SEQ ID NO: 30742 - DNA, 123 bp, Homo sapiens
aaaaaaaaaaaagaaaaaaaaaaaaaacagggagagagagagaagacaaataaaaccctttctttcatttttgttttttcttttgttgttgttgttgtttttcttttgtttgttttttttttt

SEQ ID NO: 30743 - DNA, 116 bp, Homo sapiens
ggaatagcataatgcttttgagattcatctacattgttagatgtatcaacagtttttctttttattgttgaatagtaacctatggtatgtaagtttcataggttttttgtgtgtct

SEQ ID NO: 30744 - DNA, 57 bp, Homo sapiens
tgagatgagtctcgctctgtcacccaggctggagtgcggtggcgtgatcttggctca

SEQ ID NO: 30745 - DNA, 115 bp, Homo sapiens
tgcctccagctttgttctttatgcttaggattgtcttggctatgcaggatattttttggttccatatgaaatgtaaagtagtttttttcaagtctgtgaagaaagtcaatggtag

SEQ ID NO: 30746 - DNA, 115 bp, Homo sapiens
actcctgtatatatatgtacgcatgtgtgtgtgtatatacatatatatatatatatatatatatatatatatatatatatatacatacacacataaaatgtgtgtgtgggggtat

SEQ ID NO: 30747 - DNA, 110 bp, Homo sapiens
gggttgtatactgggttgtatacttagatcatctgacaatacagagtgagcacctctatgaagtcattgttcagaggatcaagcaaagaactcatgcaaatatacgattt

SEQ ID NO: 30748 - DNA, 116 bp, Homo sapiens
agttgaaatcttgattggcttaagtttgatgagcatctgattgaagcctaagatatatttttacatatttgtttaaattatatgaattttataagactaatgctagtccttcaatt

SEQ ID NO: 30749 - DNA, 101 bp, Homo sapiens
cctggcgggagagtacccagtgaagcagtgttggagcaatgtccaaaactcattttctctctcactgtgtgttctctgccatttctcaatatcctgctatg

SEQ ID NO: 30750 - DNA, 119 bp, Homo sapiens
gtgcctataacacatccgagaaggtcatctatttgaatttcgggatatgtgttttttctttgagacatgaaagagagctgatgactttaaaatcttcatttggattggtttattttcat

SEQ ID NO: 30751 - DNA, 73 bp, Homo sapiens
aatacatatattttgtatatatcatcattctctgaaaagttagacagtgagatatatcagtgtgtgatgtatt

SEQ ID NO: 30752 - DNA, 102 bp, Homo sapiens
ttttacttcttccttttcaatccgagcgccattttatttatttttcttgccagatcatgttgtataggatctgcagtaaaatgttgaatagaagtagtgaga

SEQ ID NO: 30753 - DNA, 111 bp, Homo sapiens
aactttatctgcagcctgatgtggggatgaggatattttttctatttatattatatttaatagagaaaacttaagtcagctgttccttaaatatttacatgcaaaatagtt

SEQ ID NO: 30754 - DNA, 117 bp, Homo sapiens
caatcaggagagggcgagcaaataggaatagaagttctaacttttggccagttttttttgtgtttgttttttttttggtttaaagctaggatttcactggacagccacccctgtctg

SEQ ID NO: 30755 - DNA, 223 bp, Homo sapiens
tgtgtgtatatatgtgtatatacacatatatagtgtgtatatatgtgtatatacacatgtgtgtgtatatatatgtgtatatacacatatatagtgtgtatatatgtgtatatacacatatatatgtatgtatatatgtgtatatacacatatatgtgtgtatatatgtgtatatatacatatatatgtgtgtatatatacatatatatgtgtgtatatatat

SEQ ID NO: 30756 - DNA, 150 bp, Homo sapiens
atacgtatatatacatatatgtgtgtatatgtatatacatatatgtgtgtatatgtatacacatatatgtgtgtatatatatgtatatacacatatgtgtgtgtatatatatgtatatacacatatgtgtgtgtatatatatgtatatac

SEQ ID NO: 30757 - DNA, 110 bp, Homo sapiens
ctaatgctgagagtggggtgttgaagtccagatattattgcactggagtctctctctctctttagatctagttaatatttgctttatcaatctgggtgctctggtgttgg

SEQ ID NO: 30758 - DNA, 112 bp, Homo sapiens
ccttcatttctgaaggatattttctcaagatatagaatctcaatttttattttttatgttgggatgcctgtgtttatattattgagttttaagagttctttttatatgctgg

SEQ ID NO: 30759 - DNA, 106 bp, Homo sapiens
acccccaactgagttatctgtaaaaccctagtatctccacccaaaggaaaaaatgattccctgaagagtgagagcactacgggtttcctgataacacatcaagggt

SEQ ID NO: 30760 - DNA, 104 bp, Homo sapiens
ggagtttgtgagcttgaaatatatgtgtatatatatatatgtgtgtgtgtgtgtgtgtatacacatgtgtgtatatatgtatatatactaatgcaaatggatct

SEQ ID NO: 30761 - DNA, 100 bp, Homo sapiens
cacttggcttgtggtacatgacagaagaaagtctggaatctttaaaaaagtccgtgaatggaagacaagaaatatttttgtagttgttccacaccaggtg

SEQ ID NO: 30762 - DNA, 81 bp, Homo sapiens
cattcattaatatatacacacaaatatacatatatatacaaatatacataatatatgcatatttgtgtatgttcatgaatg

SEQ ID NO: 30763 - DNA, 78 bp, Homo sapiens
tatatatgtgtgtgtatatatatgcagttaaatacatatttgtatatatatgtgtgtgtacatacacacacatgtata

SEQ ID NO: 30764 - DNA, 99 bp, Homo sapiens
aagactggagaactgagaggttggagccttgctttctaattctatttctttgaccgaattgctaagtgagctgattaacttcttcacttatttggactt

SEQ ID NO: 30765 - DNA, 95 bp, Homo sapiens; identical to SEQ ID NO: 6311

SEQ ID NO: 30766 - DNA, 118 bp, Homo sapiens
ggggtctgggggcggtagttgttgatagaagtttggagagacagaagagaatgaggtcagggcatttattctctgcctctctcccataaagtttgcctcagcttggctttctccctca

SEQ ID NO: 30767 - DNA, 95 bp, Homo sapiens; identical to SEQ ID NO: 68

SEQ ID NO: 30768 - DNA, 93 bp, Homo sapiens; identical to SEQ ID NO: 69

SEQ ID NO: 30769 - DNA, 85 bp, Homo sapiens
tttccaaaagtggaaaatgtctagatacaattacaaacaatgactctctcagtgtcttggtcctaatatattccactgaaggaaa

SEQ ID NO: 30770 - DNA, 74 bp, Homo sapiens
ctttttctatatatatgtatatgtatgtgtgtgtatatacatatatatgcatatatatatatatatagagagag

SEQ ID NO: 30771 - DNA, 103 bp, Homo sapiens
tatatatacacatatacatatatatgtgtatacacacacacatgtgtgtgtgtgtgtgtgtgtatatatatatatatatatatatatatatatatgtatagtg

SEQ ID NO: 30772 - DNA, 120 bp, Homo sapiens
gcttgcaacattttatttattacaaagaaaatgcatttctcttatatgtgtgtaattattaattattttaaaagtaaatgaagaggggtcttgcattttctgctttgacatgtaaagagc

SEQ ID NO: 30773 - DNA, 59 bp, Homo sapiens
gtttgtgtgtatatgtatatatgtgtgtttatacatatgtatatatgtgtatatattac

SEQ ID NO: 30774 - DNA, 112 bp, Homo sapiens
ggtataccttgattagctctgaagaatacatattttgctttgggaaaaacatctgcaatttattcaaagtaaaaaagtatggattatatttttgggaactggaggatattcc

SEQ ID NO: 30775 - DNA, 101 bp, Homo sapiens
tgttttgtttttaccagagttaatttaagaattaaatacagtaatatatcaattattggatttatatattattgtatgttgaaagggtgaaatgctgatca

SEQ ID NO: 30776 - DNA, 95 bp, Homo sapiens; identical to SEQ ID NO: 68

SEQ ID NO: 30777 - DNA, 93 bp, Homo sapiens; identical to SEQ ID NO: 69

SEQ ID NO: 30778 - DNA, 95 bp, Homo sapiens; identical to SEQ ID NO: 68

SEQ ID NO: 30779 - DNA, 93 bp, Homo sapiens; identical to SEQ ID NO: 69

SEQ ID NO: 30780 - DNA, 57 bp, Homo sapiens
gaactgtgttgcagtgtgggctgcagctctgtcacccacactctgtatcctatgttc

SEQ ID NO: 30781 - DNA, 74 bp, Homo sapiens
cactagggagttcaggtagacttgcttagaatttttttttaaagcatgctgctttcattcctttactcccagtg

SEQ ID NO: 30782 - DNA, 58 bp, Homo sapiens
agtgcatgtgtgtctatatgaatacatgtatatatgtatatagatatacttatgtact

SEQ ID NO: 30783 - DNA, 90 bp, Homo sapiens
ctagagcctaagacatagacaatgccctgacactttctgtctttatgtcagtcagtgtggattctgggcctctggtcgcactccctctag

SEQ ID NO: 30784 - DNA, 66 bp, Homo sapiens
aagtattatgtgctgtacatagttgtatgtactatatttttatatgactggcagcacagtaggctt

SEQ ID NO: 30785 - DNA, 113 bp, Homo sapiens
cctgttaagtctgagttttagataaatgatttttttatttagtattagtcattttttatattatttgggaaatatactaaaaaattatttacctgaaattaaaatttaactgg

SEQ ID NO: 30786 - DNA, 82 bp, Homo sapiens
gggctgactgattcaaaaagatagtgtcatttctttctttctttctttcttttttttgtgacaaggtctcactctgtcgccc

SEQ ID NO: 30787 - DNA, 104 bp, Homo sapiens
cattttcaagctaaaggctgctttttttttttttttttttttctggtagttttgagataagataaccggagttgaaggaggaaagtttccacattcttgttatg

SEQ ID NO: 30788 - DNA, 105 bp, Homo sapiens
tgagaattttatttgtcacattttctctgacctgtgcacaatgttgctatggatcttgttttattattttaattgctggtcattaagtgtaagataattttttta

SEQ ID NO: 30789 - DNA, 87 bp, Homo sapiens
gggcacaaaatgggagtgcttgatttcaggttttatttttttcatgaatgtccaaatctgtgtttctccctgccctcccagactgtg

SEQ ID NO: 30790 - DNA, 96 bp, Homo sapiens
gtcaccttgtactgtttctttggtcaggagtttgggagtgacttagctggtgattctacctctgagtctctcacaaagttgaaatcaaggtgtcag

SEQ ID NO: 30791 - DNA, 88 bp, Homo sapiens
ctatgtagtcacattgatatataatgatatgtttttaaaatttattttatgattgacagataattgtacatattcatgggctacatag

SEQ ID NO: 30792 - DNA, 81 bp, Homo sapiens
actgctcagtagtagagtttttcaggaactaagtcatttgcatatatgattttatttaatccttctaactctaggcagtag

SEQ ID NO: 30793 - DNA, 118 bp, Homo sapiens
cttcactcagtatgtttgttgttggtaacaatattgtagaaattattttatacatattataggagaaagctaacttgtacattaattttattagaaacaaagattttctgggtttaag

SEQ ID NO: 30794 - DNA, 109 bp, Homo sapiens
gactttctgagctgtggggccactgctgggggatgggagaggggtggtgtcagtgattcaagactgtctctctcaccctctttaatgtctctttcagcaatatgaagtt

SEQ ID NO: 30795 - DNA, 58 bp, Homo sapiens; identical to SEQ ID NO: 10482

SEQ ID NO: 30796 - DNA, 105 bp, Homo sapiens
tcttcactgcctttttacctccaccccaccccaatgaaggtcctgcaatgacacactgactctcaggctttcataatggagaatctggatgaaaagaagaaaaga

SEQ ID NO: 30797 - DNA, 72 bp, Homo sapiens
tccatttttacctgattcatttagaagttatataatctgtgaccatttctgaatctgtcaggttttctagga

SEQ ID NO: 30798 - DNA, 87 bp, Homo sapiens
ttgctggccttcagtatttgttcatctgtaaaatgggtaaaattatccactttgttggggttttttaattattagaaggctaagtaa

SEQ ID NO: 30799 - DNA, 75 bp, Homo sapiens
tgtgtgtatatatgtgtgtgtgtgtatatatatatataaaatatatattatatatatatattatatatatatata

SEQ ID NO: 30800 - DNA, 80 bp, Homo sapiens
ttgaagcagagttactggagtacatttcagaaagtaaatttattttttagtggagtgaggtaggacaggctctgtttcaa

SEQ ID NO: 30801 - DNA, 102 bp, Homo sapiens
gctatagtatggctaagaaacagaattttacattttatttaatttaattttaactaatttaagtctaaatgtgaaaaattggcacttgattccattactggc

SEQ ID NO: 30802 - DNA, 80 bp, Homo sapiens
ctctctctatatatataaatatacacaaacacatacacacatacgtgtatactcatgtgtgtctttgtgtagggggagag

SEQ ID NO: 30803 - DNA, 95 bp, Homo sapiens; identical to SEQ ID NO: 68

SEQ ID NO: 30804 - DNA, 93 bp, Homo sapiens; identical to SEQ ID NO: 69

SEQ ID NO: 30805 - DNA, 89 bp, Homo sapiens
ggtgggtcgccttctcttgtcaccacattgctttgtccaattctatggatggagggaaaaggcaatgtgacaagaggaggtgacccgcc

SEQ ID NO: 30806 - DNA, 105 bp, Homo sapiens
tgctgggattacaggcatgagccgccacgctaggccaaaaataggttttaacagtaacgtatttttttttttctgagatggagtttcactcttgttgcccaggca

SEQ ID NO: 30807 - DNA, 107 bp, Homo sapiens
ctgagctatacagaacttttttttttttttgagatggactctcactctgtcacccaggctggagtgcagtggcaccatctcagccaggttcaattcccctgcttcag

SEQ ID NO: 30808 - DNA, 73 bp, Homo sapiens
ctgggcatgggtgatatgtgcctgtagttccagctacttgggaggctgaggtagaaagatcacttgagcctag

SEQ ID NO: 30809 - DNA, 72 bp, Homo sapiens
cagctctcagtagagaggggccacaagggtggtctcccacttggtcgggtggtctctctctcagtgtggctg

SEQ ID NO: 30810 - DNA, 113 bp, Homo sapiens
taagaagattgcatggagcgggagttttggcagccgtcttttccacaagggcaaacttccctgggtgctgtgtgctggctcccatcagcttctgcaaaaactctccttgtctt

SEQ ID NO: 30811 - DNA, 106 bp, Homo sapiens
taggtgtgatggttaatactgagtgtcaacttgattggattgaagggtgcaaggtattgttcccgggtatgtctgtgagggtgatggcaaaggtgattcacatttg

SEQ ID NO: 30812 - DNA, 58 bp, Homo sapiens; identical to SEQ ID NO: 3818

SEQ ID NO: 30813 - DNA, 96 bp, Homo sapiens
cccagttactcggggaggctgaggtggaaggatcacttgaacctgggggcagaggttacagtgaaccgaaatcaccccactgcactccagcctggg

SEQ ID NO: 30814 - DNA, 123 bp, Homo sapiens
gcagcccagttctccacagtgtctggttagcaggcctgattaacttaagaatgtgtagtgtctaggttgtatagtttgtctgtgtctgatttttcctggggcttgagacatcacattagtaag

SEQ ID NO: 30815 - DNA, 90 bp, Homo sapiens
ttagttttcttttcttggtaacatatgcatattttaccagataatataattatatgcttatttattgttattcaagagaaagaaaactag

SEQ ID NO: 30816 - DNA, 83 bp, Homo sapiens
atgaaggaaatgaggtctcaatgtctggctttctgagaaacaagctccacgacactggcagagttcagcacctctatcttcat

SEQ ID NO: 30817 - DNA, 100 bp, Homo sapiens
tctaaaagtgagacacataatgatgctgctcattatttgtcctagaaactttttttttctttcaggagtgccttgcggaaattatgttctctggattgga

SEQ ID NO: 30818 - DNA, 78 bp, Homo sapiens
ggagtcagataggtcagccactgaagagtatctgtatgtgcacggtcaatattcgttggtgtgactctctttcactct

SEQ ID NO: 30819 - DNA, 101 bp, Homo sapiens
ctgtgagtctgtgtgtgtgccagggcagaggatagtggggagataaatatttttgtttttgtagtgttcccttgcaaaatggagctcagaagagccatcag

SEQ ID NO: 30820 - DNA, 73 bp, Homo sapiens
ggccttgacttaaatacgtatatatgtatatgtgtatttacatatgtatatgtatatatacatacactcagcc

SEQ ID NO: 30821 - DNA, 73 bp, Homo sapiens
tggcagcttcgaggattacaaataattcagtaggctcttagatatctgagtttctgtctcactctggctggca

SEQ ID NO: 30822 - DNA, 168 bp, Homo sapiens
gtgcctggccttaactcatatatatatatgtgtgtgcgtatgtgtatatatatatatatatatatgtgtatatatatatgtatatacatatatatatatgtgtatatatatatgtatatacatatatatatgtgtatatatatatgtatatacatatatatatatata

SEQ ID NO: 30823 - DNA, 95 bp, Homo sapiens
atatatatatatatatatatatatatatatatatgtatatgtatatgtgtgtgtgtatatatatacatatatgtgtgtgtgtgtatatatatata

SEQ ID NO: 30824 - DNA, 84 bp, Homo sapiens
tctccattgtaaatttttattgaagttgtttcttggaaagatttttgatttttaactaacagcttaagagtatagctttggagg

SEQ ID NO: 30825 - DNA, 63 bp, Homo sapiens
ggtctttgagcttcttggatgtataaatttgtgttctttatcaaatttgagaagtttttggcc

SEQ ID NO: 30826 - DNA, 79 bp, Homo sapiens
tgtacttgccagcactgcttgtggcactgcaagcctgtcatatgagaggaatctagtcaggtttttgctaagcactaca

SEQ ID NO: 30827 - DNA, 95 bp, Homo sapiens; identical to SEQ ID NO: 68

SEQ ID NO: 30828 - DNA, 93 bp, Homo sapiens; identical to SEQ ID NO: 69

SEQ ID NO: 30829 - DNA, 65 bp, Homo sapiens
ttgtgattgggtctcactctgtcacccaggttggagtgcagtggtgcagtctcggttcattgcaa

SEQ ID NO: 30830 - DNA, 101 bp, Homo sapiens
ggaggtaaataggttagataacgtcatggagatggggccctggtccaatggaatgagtgtctttctctgtctggcttatttcacttagcataacgttctcc

SEQ ID NO: 30831 - DNA, 91 bp, Homo sapiens
gttagtcagagtggcagagaggttaccactatacttcttgtttggaaatagaatgtattagtcagaatatgctgggctctgttgcagtaac

SEQ ID NO: 30832 - DNA, 79 bp, Homo sapiens
ggtgttcagagttccaggcccagctctgccagtcacagtctctctgtcccgtggcaagtcaatcctttctctggatctc

SEQ ID NO: 30833 - DNA, 118 bp, Homo sapiens
ctgtgtcatttaaattggggcatttagcccatttacattaaaggttaatattgttatgtgtgaatttgatcttgtcattatgatgttagctggttattttgcccattaattgatgcag

SEQ ID NO: 30834 - DNA, 112 bp, Homo sapiens
ggattgtcttggcaatgcatgctcttttttggttccatatgaaatttaaagtagttttttccaattctgtgaagaaagtcattggtagcttgatgaggatggcattgaatct

SEQ ID NO: 30835 - DNA, 70 bp, Homo sapiens
actttggagtagatggttatggattagcaaattgtatagcttgttaagttctatgaatctactccaaggt

SEQ ID NO: 30836 - DNA, 130 bp, Homo sapiens
tggcaagagagacaccccagctccccaagagggaatattctctctccctagctgtctctctctgtgagtctccccatttctctatttcacagtggaaggattttttttttccactgctgtggagtgagac

SEQ ID NO: 30837 - DNA, 66 bp, Homo sapiens
tctccgagaaatctcagtggacatatcaagtaggcaactgcgtatatgagtcagggattcaggaga

SEQ ID NO: 30838 - DNA, 115 bp, Homo sapiens
cgcacttttaaaaaaagtctaaacatctgaggaatgtgtctgtgcttgcagtgtccagccagcacagagactgcactcaagggatgtgggaacggctgattgaacgtgaactgcg

SEQ ID NO: 30839 - DNA, 123 bp, Homo sapiens
ccaggcctggtggtccacgcctgtaatcctagctacttgggaggctgaggtaggaggatcacttgagcccgggaggtggaggttgcagtgaatggtgatagtaccattgcattccagcctggg

SEQ ID NO: 30840 - DNA, 70 bp, Homo sapiens
agtgctgaggtggagaagctctggtccagaggataaaggcaaggttctctgtgtctcagtctgacatctc

SEQ ID NO: 30841 - DNA, 223 bp, Homo sapiens
tatatagtgtgtatatatacacatatatatagtgtgtgtatatatacacatatatatagtgtgtatatatatacatatatatagtgtgtgtatatatatacatatatatagtgtgtgtatatatatacatatatacacatactatatgtgtatatatgtatatatgtgtatatatgtatatatgtgtatatatgtatatatgtgtatatatgtatatatgtgt

SEQ ID NO: 30842 - DNA, 58 bp, Homo sapiens
tgagatggagtctcactctgtcacccaggctggagtgcaggggtgtgatctcggctta

SEQ ID NO: 30843 - DNA, 113 bp, Homo sapiens
gggagctgcctgaagaccacatgaaggcattggtctagagagagagagctcacactgggtttcacaaatccctagtcctaagaagatgcatcatgatgccattctgagagccc

SEQ ID NO: 30844 - DNA, 102 bp, Homo sapiens
tatcaggccctggctcgtagtccactgttgactttaagttgtactgtaaaccacgttccgctaagtattgtttaactgtcaagtggatggggaggcaagatg

SEQ ID NO: 30845 - DNA, 115 bp, Homo sapiens
ttaggattgtcttagctatacaggcccttttttggttccatatgaaatttaaagtagttttttctaattatgtgaagaaagtcaatggtggcttgatggggatagcattgaatct

SEQ ID NO: 30846 - DNA, 95 bp, Homo sapiens; identical to SEQ ID NO: 68

SEQ ID NO: 30847 - DNA, 93 bp, Homo sapiens; identical to SEQ ID NO: 69

SEQ ID NO: 30848 - DNA, 95 bp, Homo sapiens; identical to SEQ ID NO: 68

SEQ ID NO: 30849 - DNA, 93 bp, Homo sapiens; identical to SEQ ID NO: 69

SEQ ID NO: 30850 - DNA, 111 bp, Homo sapiens
tgacattttgactggtgtgagatggtgtctcactgtggttgtgatttgcatttctctaatgatcagtgatgcttagctttttttcatatctttgttggatgcataaatgtc

SEQ ID NO: 30851 - DNA, 99 bp, Homo sapiens
gtatagcaatatctatataggtagatagatatagatatatatatgatataattctatctgtatatatgtataattctacctgtatatttgtatttttac

SEQ ID NO: 30852 - DNA, 110 bp, Homo sapiens
acatacatatgtatatattgtgtatatatgcatatatttattatataaatacaataaacataaatttataaataaatgcatgcatatacagtatatacacatatatgtat

SEQ ID NO: 30853 - DNA, 95 bp, Homo sapiens; identical to SEQ ID NO: 68

SEQ ID NO: 30854 - DNA, 93 bp, Homo sapiens; identical to SEQ ID NO: 69

SEQ ID NO: 30855 - DNA, 94 bp, Homo sapiens
ggagttagaagtggggagatagacttcatcatagagagagatggatacatttttactgtttccctctgtatctctctggaacttaactgattcc

SEQ ID NO: 30856 - DNA, 120 bp, Homo sapiens
cactctcatgacttgtgcctgaagtcttcttggattttttctctttttttttttttctttttctttcgttttttgagatgaagtctcaccctgtcacccaggctggagtgcagtggcgtg

SEQ ID NO: 30857 - DNA, 79 bp, Homo sapiens
ggttacattctttaaagatggagatttgcttgagagattcaagtacagatgtctctgtctctaacacagaaatgtgctc

SEQ ID NO: 30858 - DNA, 75 bp, Homo sapiens
tccagtgcattgaaggactagaagaaaaggttgagtaagaaagaattttttctctctgtctgtcattgagctggg

SEQ ID NO: 30859 - DNA, 120 bp, Homo sapiens
gtctttattttctttctgcagtacctttgtataattcctatgcttattcatttttggctattacttagtttttgataaggtatacttactggagcttcatgtggtgagaagaataaagat

SEQ ID NO: 30860 - DNA, 104 bp, Homo sapiens
atcattgtgaagcagaactgttataatgcttggggtttgtaagcatacttaaaagaattatatatctatataaacctgttactaaagttcttcataaaggtgat

SEQ ID NO: 30861 - DNA, 88 bp, Homo sapiens
ttgctaacaggaatattttaaatatttcatacttttagatgaaatacagatagagtgtgagagagtgataaaatgattgtgtgagtag

SEQ ID NO: 30862 - DNA, 95 bp, Homo sapiens; identical to SEQ ID NO: 68

SEQ ID NO: 30863 - DNA, 93 bp, Homo sapiens; identical to SEQ ID NO: 69

SEQ ID NO: 30864 - DNA, 112 bp, Homo sapiens
tttgcagaatgttccagaatttagtttcatctcatgttttcttgtgatttatacattgtatgaggaagtaccatgaattgatgttgtgttcttagtacatcatttctgcagg

SEQ ID NO: 30865 - DNA, 137 bp, Homo sapiens
agtgtaagtaaacatcttactgctttgtacaagaaaataattcataagagtctagtattatttttatttatttattttttgagatggggtctcactctgtttgctcaggctggagtccagtggcgtgatctcagctc

SEQ ID NO: 30866 - DNA, 78 bp, Homo sapiens
ctgatctgggccttaggcatcagtatttttctaaaagctacagaggtgattttgatgtacagcaaggttgaggaccag

SEQ ID NO: 30867 - DNA, 95 bp, Homo sapiens; identical to SEQ ID NO: 68

SEQ ID NO: 30868 - DNA, 93 bp, Homo sapiens; identical to SEQ ID NO: 69

SEQ ID NO: 30869 - DNA, 81 bp, Homo sapiens
tttgcattgtaaatctgttagaaggcaggaatggcacagtctcactgtgtaataatatctcaaagcagagctatagtcaga

SEQ ID NO: 30870 - DNA, 114 bp, Homo sapiens
ggatttcctgatggaagcagacgctcacaacttgacataaactcagagaggagctctgtggtcagttcagagtctgatatttgaggttagaaattgtgtctctgccaatgcctc

SEQ ID NO: 30871 - DNA, 94 bp, Homo sapiens
tttctggagaactcaagatgctctttctagcttcagggactttgtgctggttactctctctgtctggaatgttcctccctgtgatctttggaaa

SEQ ID NO: 30872 - DNA, 86 bp, Homo sapiens
gtcatacggggtcctataagatctagtaggtccattagggatttatgtgcctgactggcttgtgtctgtgtctgagccccgtggat

SEQ ID NO: 30873 - DNA, 138 bp, Homo sapiens
atatatgtcatatatatgtgcatatatatatgtatttatctgtgtgtgtgtgtgtgtgtatatatatatatatatatatatatatatatatatatatatatatatatatatatatgtacacggatggatggatggatg

SEQ ID NO: 30874 - DNA, 91 bp, Homo sapiens
tatattttgtatacatgtaatttatgtatatgtaattttatgcaaaattacatatgtacaaaatatatatgtaattttatttacatatata

SEQ ID NO: 30875 - DNA, 77 bp, Homo sapiens; identical to SEQ ID NO: 1310

SEQ ID NO: 30876 - DNA, 121 bp, Homo sapiens
atatatatatatatgtgtgtgtgtatatatatatatacgtgtgtgtatatatatatatatatatatatatatacgtatatgtatatgtatatatgtgtatatatatacatgtatatataca

SEQ ID NO: 30877 - DNA, 63 bp, Homo sapiens
aggcaagtcttccaaatgagtgtcagctctcagcacagagtagacccatagtggatagctcct

SEQ ID NO: 30878 - DNA, 110 bp, Homo sapiens
tgcttcagattgtcttggctgtacgggctctcttttggttccatatgaaatttaaagtagttttttctaattctgtgaagaaagtcaatgatagattgatgggaatagca

SEQ ID NO: 30879 - DNA, 98 bp, Homo sapiens
ctgggaggaggagtttgcagtaagctgagatcttgccactgcactccatcctgggtgacagagtaagtctctgtttcacaaaaaatatttcctcgaag

SEQ ID NO: 30880 - DNA, 77 bp, Homo sapiens
tgtctatatatgtatatatatgttaactaatagatgctaatagatgacctctatatatatgtgtgtgtatataagca

SEQ ID NO: 30881 - DNA, 151 bp, Homo sapiens
acatatatatgtgtatatatatacacacacacatatgtatgtgtatatatgtgtatatatatacacacacatatgtatgtgtatatatatgtgtatatatatacacacacacgtatgtgtatatatatatatacacacacacacgtatata

SEQ ID NO: 30882 - DNA, 104 bp, Homo sapiens
tggcatatatatatatacatatatatatatgtatatatatacgtgtgtgtgtgtatatatatatatacacatacgtgtgtgtgtatatatatacacatatatat

SEQ ID NO: 30883 - DNA, 138 bp, Homo sapiens
gtgtgtatatatgtgtgtgtatatatacatatatgtgtatatgtgtgtatatatacatatgtgtgtatatatatacatatatgtgtatatatacacacatatatgtatatatatacgtgtatatatatatgtgtgtgt

SEQ ID NO: 30884 - DNA, 113 bp, Homo sapiens
tatatatatatgtatgtatacacacatatatgtgtgtgtgtatatatatatgtatatacacacacacgtgtgtgtgtatatgtatatatacacacatgtgtgtgtgtgtatac

SEQ ID NO: 30885 - DNA, 110 bp, Homo sapiens
ttgccctatctctagtttcctacagggaagttctcgatgcatctatagattatttattatttgaacagttgcataggagattattccacatgaaatcatttgtcaggcaa

SEQ ID NO: 30886 - DNA, 58 bp, Homo sapiens
tgagatggagtttcactctgtcgctcagactagagtgcagtggcgtgatctcagctca

SEQ ID NO: 30887 - DNA, 190 bp, Homo sapiens
acgtgtatgtgtatatatgtacgtgtatatgtatatatatacgtgtatatatacgtgtatatgtatatatatacatgtatatatgtatatatatagtgtatatatatacgtgtatatatgtgtatatatgtgtatatatacgtgtatatatacgtgtatatatacgtgtataaacacgtatatctacaca

SEQ ID NO: 30888 - DNA, 58 bp, Homo sapiens
gtgtgtatatatatacgtgtgtatatatgtatatatacacatgtgtgtgtgtatatat

SEQ ID NO: 30889 - DNA, 87 bp, Homo sapiens
tattgattagtctaattttaatattgttgtgtctcagggaacagagagacccagtgagagacagagatggggaaatgctggtcagtg

SEQ ID NO: 30890 - DNA, 114 bp, Homo sapiens
tgctgggattacaggcatgagccaccatgcctggcctatatatgactttttaatttttattttaaaaaattattttaggttcagggctacatgtgcaggtttgttatataagta

SEQ ID NO: 30891 - DNA, 115 bp, Homo sapiens
ttggcaatctattcttcatcaaaacaatggaagtctgtgtatatgtgcatatgtttgcatgtatgtatgtatgcatgtatgtatttatctagctatggttgcctggtgaagccag

SEQ ID NO: 30892 - DNA, 68 bp, Homo sapiens
gtgggcttgcatatatacacacacgtacacacattatacagtgtctgtgtgtgtgtgtgcatgtacac

SEQ ID NO: 30893 - DNA, 70 bp, Homo sapiens
atatatatgtatatgtatatgtatgcatgtgtgtatatacacacatatatatgtatatacacatacatat

SEQ ID NO: 30894 - DNA, 109 bp, Homo sapiens
tcaggagaaaagcacctggtagggaattgctgagtatattaccaacactgagtatatggtaactatagaaattacataaggcagagtttctccagcccagccttcctga

SEQ ID NO: 30895 - DNA, 77 bp, Homo sapiens
ggtactgcagaattgtgttttctagtttgtttatagtttttgtaaataagctaaatgtaccacacactcgtagtgcc

SEQ ID NO: 30896 - DNA, 74 bp, Homo sapiens
ttatacattatagtatatattataccacgtagtatatagtattatggtattagtatgtattatacatgctgtaa

SEQ ID NO: 30897 - DNA, 115 bp, Homo sapiens
tcctccttgtttgttaaaaacatgtttgtgcatgtatacacttgaacttagaaaatatctttattttcttttccgtttatcatgtgacataaggtttattgactttatatcagga

SEQ ID NO: 30898 - DNA, 58 bp, Homo sapiens
tgagatggagtctcactctgtcacccaggctggagtgcagtggtgggatctcagttca

SEQ ID NO: 30899 - DNA, 104 bp, Homo sapiens
ctggtttgcctgccccacccggttgtagttgaataaggttgctcagctgaaagtgattagtgtgtgatcaacctgaaaggcagcctccagcagttgtatcccag

SEQ ID NO: 30900 - DNA, 85 bp, Homo sapiens
cagggacctggcatggtggttcatacctataatcccagcactttggaaggttgaggtggtaggatcacttgaggccaggagtttg

SEQ ID NO: 30901 - DNA, 118 bp, Homo sapiens
actttttcctgctacaaacactacttcagtgaatattcttataaatgtttaatttcaattatatatacatttatttataggaacaatttctaggagcagcattgcaggttaaataggt

SEQ ID NO: 30902 - DNA, 105 bp, Homo sapiens
tcggattagggtggtgcttgcatttcaggctaaagatatatatattttttcaatgtagcaatgagaaggtacatgcttttgaatgaaaagaatgttctgattaga

SEQ ID NO: 30903 - DNA, 107 bp, Homo sapiens
cattgtgataggggagaactggagggagtgtgtgtctgtaaatgtgtgtgcatatgcatgtgtttgtgtttgtgagctctagccgagaattaccacctattattgtg

SEQ ID NO: 30904 - DNA, 116 bp, Homo sapiens
tgagagggtgtcattaggagtcaaaagatgagatagaatcctgtaattttttcatttagaattttgtgtatttggcattacttggattctttatttgtgctagatacctactttca

SEQ ID NO: 30905 - DNA, 78 bp, Homo sapiens
tcaatcttcgtgttcatacatacatgttacatatatatatgcatatatatgtttgtgtgtgtattcatctgtttgaag

SEQ ID NO: 30906 - DNA, 64 bp, Homo sapiens
gctgaaaatcttgtatcctaatgatgtatgtatcattgggatatatatatttaaaatttttagc

SEQ ID NO: 30907 - DNA, 74 bp, Homo sapiens
ggctcaatgacacttcatggatttctacagcggaggtttgaagagagtgagctgtcatgatgacttctggagcc

SEQ ID NO: 30908 - DNA, 58 bp, Homo sapiens
tgaggcagagtctcactctgtcacccaggctggagtgcagtggcacgatctctgctca

SEQ ID NO: 30909 - DNA, 95 bp, Homo sapiens
ggccaggtgcagtagctcatgtctgtaatcccagtgctttgagaccctgaggtagaaggatcattagaagccaagagttcaagaccagcctgggc

SEQ ID NO: 30910 - DNA, 90 bp, Homo sapiens
gggcggcagtattcagactaccacattcaattacctcatctttgtttttgttttttgtttttttggagatggagtcttgttctgttgccc

SEQ ID NO: 30911 - DNA, 112 bp, Homo sapiens
aggtggtggtgagaagagtgagggagaaaaagagtgttctccatcattttatatatttcagtgtggaaaactagtctttcagagattttcttcactatagctcatgaaactt

SEQ ID NO: 30912 - DNA, 86 bp, Homo sapiens
aactaaataatgtatgtcagccactttgaagagtgtcagcagatagcagccactcactagaggtgacttattattgctgtttagtt

SEQ ID NO: 30913 - DNA, 64 bp, Homo sapiens
gagtgtgtgtgtgtgtgtatatatatatgtgtgtgtgtgtatatatatatatatatatatattt

SEQ ID NO: 30914 - DNA, 98 bp, Homo sapiens
atgttctttacttcagatagcttgatttctgattcctcactggctcactccctgaatgtctccagtgaggatagggcagcttcccaggtacagcatat

SEQ ID NO: 30915 - DNA, 80 bp, Homo sapiens
gccactgttcagagggaagcccatagttggagggttgtctgttgtcaggctctgcctgagtctgtggctcttctttggct

SEQ ID NO: 30916 - DNA, 99 bp, Homo sapiens
aaatgaccaggagtatgattgctgagttgtatgatagttgcatgtttagttttttatgaagctgtcaagctgtagccgtaccgttttacatttccgtca

SEQ ID NO: 30917 - DNA, 107 bp, Homo sapiens
tcaggattctgaagatacgtttgtgtgtatatgtatactacatatatatgtttatatatatattgtgtgtgtacatatatatatatatatgtacagcttattactga

SEQ ID NO: 30918 - DNA, 89 bp, Homo sapiens
ggtatctgcagaaaaggaaacaaagagggcatgaaaggggagctttgcctgcctcactctttggctgtcatgttcatgggcttctcacc

SEQ ID NO: 30919 - DNA, 64 bp, Homo sapiens
ggagtacagattctttctcttttcttttctttttttttttttttttgagagggagtctgactct

SEQ ID NO: 30920 - DNA, 68 bp, Homo sapiens
tgtgtatgtgtgtgtatatatatgtatgtatttatatatacacgtatataagtatacacatatacata

SEQ ID NO: 30921 - DNA, 117 bp, Homo sapiens
agagacaaatgtatatgatagtttcaagactggcaactagtgctgataatttatttttttgctaaactaattatgcctatttttactactgtcattctggctatcagatatctttct

SEQ ID NO: 30922 - DNA, 110 bp, Homo sapiens
gctgtgcctgaggacatttctcttggcactgggtctaatttgtgagcattgatgactggtgagtggtgcttgtaggttagtcagagttgactcttgaaacacaggcacac

SEQ ID NO: 30923 - DNA, 119 bp, Homo sapiens
gcctccagctttgttctttttgcttaggattgtcttggctatatgggctcttttttggttccatatgaaatctaaagtagttttttctaattctgtgaagaaagtcaatggtagcttgg

SEQ ID NO: 30924 - DNA, 66 bp, Homo sapiens
atatgtgtgtatgtctctgtgtgtgtgtacatacacacttatacacatatatgcatacacatatat

SEQ ID NO: 30925 - DNA, 102 bp, Homo sapiens
tgtgtgtatacacatgcacataaatacacacacacacgatatgtcatgtatatatgtgtatatgtatatatgtgagtgtatgtgtgtatgtgcatacacaca

SEQ ID NO: 30926 - DNA, 116 bp, Homo sapiens
ggctattcccttatcatatgcattttctgttgccttaaggaagacctgtacaatttttgttattgaaatctgaatttttttccctcccaagcagatggaggatgtgtaaatgtgtc

SEQ ID NO: 30927 - DNA, 88 bp, Homo sapiens
cctgagtagctgggatcccaggcttgtgctaccacacccaactaaggtttggatttttagtagagacagtttcaccatgttgcccagg

SEQ ID NO: 30928 - DNA, 86 bp, Homo sapiens
ggtttctggtggtaatcttgcaaaagcagtttttgtatttgtgtttacactaatcattactctttctgttccaagtaacagaaacc

SEQ ID NO: 30929 - DNA, 73 bp, Homo sapiens
tgtgtgtgtggcggcggggggggggggcggtgccacacacactttctctcttgctccagcttcaccttccaca

SEQ ID NO: 30930 - DNA, 136 bp, Homo sapiens
gtatattataacgtaagtatagtgtaagtatattataccgtaagtatagtgtaagtatattatactatatttatagtatggtatattatactataatatatttatagtttagtatattgtactatattatactatg

SEQ ID NO: 30931 - DNA, 70 bp, Homo sapiens
tgtcaatccttgtctcagtctgtctctgggagaatcttaccaaagggaccatgagaaggaggattagaga

SEQ ID NO: 30932 - DNA, 67 bp, Homo sapiens
gaggcacagtctcactcggtcacccaggctgcagtgcagtagtgtgatcagagctcactgtgacctc

SEQ ID NO: 30933 - DNA, 58 bp, Homo sapiens
tgagacggagtctcgctctctcacccaggctggagtgcagtggcatgatctcggctca

SEQ ID NO: 30934 - DNA, 58 bp, Homo sapiens; identical to SEQ ID NO: 1763

SEQ ID NO: 30935 - DNA, 109 bp, Homo sapiens
ggccctgaaaaaaattagacattgttttggaacatcattgagtttgatcattttttttttttttttttttggtggagagttgttactaatctatgcaattgtcagggtt

SEQ ID NO: 30936 - DNA, 66 bp, Homo sapiens
atgccaagtcattaatgtatatatgtatatgtatgtgtgcatgtgtgcgtgtgtgtgtgtgtgtat

SEQ ID NO: 30937 - DNA, 88 bp, Homo sapiens
aatatattggcaatatattttcattgttattgttattaatagtatatattaacaataaataaatattaaaatatattaacaatatatt

SEQ ID NO: 30938 - DNA, 93 bp, Homo sapiens; identical to SEQ ID NO: 69

SEQ ID NO: 30939 - DNA, 107 bp, Homo sapiens
ctctatatatttatatcgatgtagatatctatatatctctatatataaatatagacataggtatctctctctatatttatatatctagagttagatatatctatatc

SEQ ID NO: 30940 - DNA, 143 bp, Homo sapiens
tatctatctatctatccatctatctatatctctgtgtatatagatagataagagatatagatatatctaactctagatatataaatatagagagagatacctatgtctatatttatatatagagatatatagatatctacatc

SEQ ID NO: 30941 - DNA, 115 bp, Homo sapiens
gaggtggcaaccacagataagtcttatcattttcatgacactaatcataagtttttattttttataaagcttctaagggtttgaagtggggtttgtttatagcaggtgacatctt

SEQ ID NO: 30942 - DNA, 58 bp, Homo sapiens
tgagacagtgtctcactctgttctccaggctggagtgcattggtgtgatcttggctca

SEQ ID NO: 30943 - DNA, 80 bp, Homo sapiens
gtcatctaccactgtgggttcttttaaagggcactgggtcatggtgacacagaagccagtgaccattcctgtggtgatgc

SEQ ID NO: 30944 - DNA, 123 bp, Homo sapiens
tcagggctcccactgattctacattgtggtaagttgtataattatttcattatgtattacaatgtaataataatagaaataaagtgcacaataaatgtgatgtgcttgagtcatcctgaaacc

SEQ ID NO: 30945 - DNA, 119 bp, Homo sapiens
gttatgaacaatgaactcattttttggctgatgtctttattcccactgattttttttttttagaattttcctaaggatagctgggagtgaggcctaagtatgatccatccctgtctgat

SEQ ID NO: 30946 - DNA, 74 bp, Homo sapiens
gagtaccagagatttttactattagcgatattcctggtgtagccgtgtcagggctgtcactctctctgtcactc

SEQ ID NO: 30947 - DNA, 75 bp, Homo sapiens
ctgcagcttctgagaacaggctgagcactgggtggcaagtccccgtttctgtgggcagcatgctctcagcctcag

SEQ ID NO: 30948 - DNA, 88 bp, Homo sapiens
ctgggttaaggtcagagatgtcagtgtggacttatgtttagctgaatatataatttctgtcttagctagatgtctcccttggccccag

SEQ ID NO: 30949 - DNA, 78 bp, Homo sapiens
gctggctgatttagcatctgatggagcactgaacacactcaccagtgagctatgcccatcatttctgtaaatgccagc

SEQ ID NO: 30950 - DNA, 81 bp, Homo sapiens
gtgcatggcatatagaagtatgcagtaattttaaattattaataattattcattactgagtaccttttaaaagctgtgtgt

SEQ ID NO: 30951 - DNA, 137 bp, Homo sapiens
atatatatatatatacgtgtatatatatacgtgtgtatatatacatatatatgtatacgtatatatatacgtatatatgtgtatatatatgtgtatatatacgtatacatatatacgtatatatgtatacatgtgtg

SEQ ID NO: 30952 - DNA, 98 bp, Homo sapiens
gcggtaattctttgtgaggggtatgtgtatatatgtatgtatgtatgtataacagatatatataactatgtggatgttcatttcaaaatccttactgt

SEQ ID NO: 30953 - DNA, 98 bp, Homo sapiens; identical to SEQ ID NO: 30952

SEQ ID NO: 30954 - DNA, 68 bp, Homo sapiens
agatatagatatagatatagatatctatataaatatatatagctatctatatatctatatctctctct

SEQ ID NO: 30955 - DNA, 230 bp, Homo sapiens
atatatgctatatatgcatatatgatatatatgtatatatctatatatcatatatgctatatgtatatatctatatctatatgtatatatacatatagatatgtatatatctatatatagctatatatgcatatatacatatatatctatgtatatacatatatctatatctatatatagatctatatatatcatatatgctatatgaatatatgcatatatgcatatat

SEQ ID NO: 30956 - DNA, 132 bp, Homo sapiens
tatagatctatatatagatatagatatatgtatatacatagatatatatgtatatatgcatatatagctatatatagatatatacatatctatatgtatatatacatatagatatagatatatacatatagc

SEQ ID NO: 30957 - DNA, 58 bp, Homo sapiens
tgagatggagtctcactctgtcactcagggtggagtgcagtggtgcgatctcggctca

SEQ ID NO: 30958 - DNA, 79 bp, Homo sapiens
ggacagcctggctctctgttcctctgcacagctacccagcttaagttataaaacagggcaacagaggtctataatgttc

SEQ ID NO: 30959 - DNA, 114 bp, Homo sapiens
tttatggagatgttcactatggtcaaatatcaggtaatttgtaaattactgttcacagtaattatttgtatatactaccataaggtttattatagagacacatactatcataag

SEQ ID NO: 30960 - DNA, 56 bp, Homo sapiens
gaggcagagtctcactgtgtcacccaggctggagtgcagtggtgtgatctcggctc

SEQ ID NO: 30961 - DNA, 58 bp, Homo sapiens
tgagacggagtctcgctctgtcgctcaggctggagtgcagtggcgcgatctgggctca

SEQ ID NO: 30962 - DNA, 116 bp, Homo sapiens
ttcattggatgttggcctagttctgtgtggaagactagtgattttgttgtttttagataactaaatcgacaacaaatcacagtctgccatatggcacaggccatgcctctacagga

SEQ ID NO: 30963 - DNA, 78 bp, Homo sapiens
cttggctggatatggtcatgcacgcctgtagtcccagctacctgggagcctgaggtaggaggatcatttgagtccagg

SEQ ID NO: 30964 - DNA, 75 bp, Homo sapiens
gagtctcagtctgtcactcaggctggagtgcagtagtgcaaacacggctcactgcagcctcaacctcctgggctc

SEQ ID NO: 30965 - DNA, 113 bp, Homo sapiens
gacaagattgaaagttttagttaactgggaactgaaaaactaaatagatttttttttttttttttttaaatacagggtcttactttttcacccaggctggagtgcagtggtgc

SEQ ID NO: 30966 - DNA, 110 bp, Homo sapiens
gagagagaacagatgaccattttgtttgtcaggctgggttggattggatgacttctgaaattgtttcccgtttcattagtatgaagaaacaaagatgttatcaactcctt

SEQ ID NO: 30967 - DNA, 86 bp, Homo sapiens
ggaatcagaagagctggattctagcaagttatattatttatattctgtgtgactgtgtgactctgggccaatcctgtctgagcttc

SEQ ID NO: 30968 - DNA, 98 bp, Homo sapiens
gtttagctaatgagaagaattagaactcatcaaaaaatgttggtttcaacagactttttgttgatctctactaagattctttgttcagaaatttggac

SEQ ID NO: 30969 - DNA, 58 bp, Homo sapiens
tggtttggctccaaacatacaaggggacgactctgtcagtgtctgagtggagtttcca

SEQ ID NO: 30970 - DNA, 69 bp, Homo sapiens
cacttatcatgcatggagcttgcaggactggaggttgccctgggtgagtcagtgagtgagtggtgagtg

SEQ ID NO: 30971 - DNA, 135 bp, Homo sapiens
ctgagttcagtgctagataggggaccccagatggggctctctcaggtacacatcccatcaggcacccactgtcactgtgatttggtggtcttgttagccatgcacagtataggttgtgctgtttgcttttttgag

SEQ ID NO: 30972 - DNA, 58 bp, Homo sapiens
tgagactgagtctccctctgtcaaccaggctggagtacagaggcacgatcttggctca

SEQ ID NO: 30973 - DNA, 102 bp, Homo sapiens
gccaggcatggtggtgcgcacctgtagtcttgctaatcaggaggctgaggtggaaggatcgcttgagcctaggaggtcagggctgcagtgagctgtgatggt

SEQ ID NO: 30974 - DNA, 78 bp, Homo sapiens
gaattactagacttggctgcacaatggtattatctggagcattaaaaatactagtagctgggccaggtgtggtggctc

SEQ ID NO: 30975 - DNA, 117 bp, Homo sapiens
ggtacaaagacactagccagcctgtacatctatatattattcatgcagatcattctttatatatagttaatggcatgcatgtggcctggattttgtggttggctaactattctgtcc

SEQ ID NO: 30976 - DNA, 117 bp, Homo sapiens
taatagcatagcctaatgtgtgcgcatgtgtgtatatatgtgtatatatgtatatgtgtatatatgtatatatgtgtatatacacacataatacacacacattaggctatgctgtta

SEQ ID NO: 30977 - DNA, 86 bp, Homo sapiens
taaagtatcatgttacatgtggtgaaatagaaatatgtattttttatatataaatactatttcaccacatgtaacatgatacttta

SEQ ID NO: 30978 - DNA, 58 bp, Homo sapiens
tgaggtggagtctcactctgtcacccaggctggagtgcactgccgggatctcgcctca

SEQ ID NO: 30979 - DNA, 78 bp, Homo sapiens
gccaaatggtgggtcctggctgctgatatcactctgtgtctgaatgctggcaaatgccagtgatttcacacccatggt

SEQ ID NO: 30980 - DNA, 118 bp, Homo sapiens; identical to SEQ ID NO: 4706

SEQ ID NO: 30981 - DNA, 58 bp, Homo sapiens
tgaaactgagtctcactctgtcacccaggctggagtgcagtggtgtgatctcagctca

SEQ ID NO: 30982 - DNA, 77 bp, Homo sapiens
tcaggctgttcaatccggggggcgcggactgagtatgttcccaagtctgggtctctcagtgttatttggctaaatga

SEQ ID NO: 30983 - DNA, 98 bp, Homo sapiens
gttgtttttttttttgagatggagtctcactcactctgtcgcccaggctggagtgcagtggcgcgatctcagttcactgcgacctccgcctcccgggc

SEQ ID NO: 30984 - DNA, 111 bp, Homo sapiens
gccaggtttgatggtgtgtgcctgtaattccagatactcgggaggctgaggtagaagaatcacttgaacccaggaggcagaggttgcagggagccaagatcatgccactgc

SEQ ID NO: 30985 - DNA, 87 bp, Homo sapiens
gtcactgtctgtaactctgcctctcagtgatttcagtggtggaaacaccagacaagctgtgtggaagtgtctaggaacaggcaggat

SEQ ID NO: 30986 - DNA, 74 bp, Homo sapiens
tgttctcatgggaagaggcatctgagagctctctctcgctctcgctcgctgtgacttccctccatgtgagggca

SEQ ID NO: 30987 - DNA, 115 bp, Homo sapiens
ggatatttttagatagatgctgagttagagaaaagagtagtaattgatttggggtgaatatttatatcttttcaacaccttatttgtaactttccatgcaatttttctattatct

SEQ ID NO: 30988 - DNA, 57 bp, Homo sapiens
ccagggtgagtggacctagcctggccttgactgggtggctgggtggctctatgctgg

SEQ ID NO: 30989 - DNA, 116 bp, Homo sapiens
tgatttcctcgttagttttggaactatgctatcataatctaaagcagatttcagtagatttattttttaaaagtctggtaactaacatgtggattatagttcaactgtggatatta

SEQ ID NO: 30990 - DNA, 69 bp, Homo sapiens
acttccatgagcatgaactcactgccacacttctttagctgtaaagtgagtttcttgttcagaggcagt

SEQ ID NO: 30991 - DNA, 86 bp, Homo sapiens
gtgattgttggaaattttcaggtagaagcttgtttgggataaaggagaagggcctcttctgcagcttctttctctaagttaatcac

SEQ ID NO: 30992 - DNA, 74 bp, Homo sapiens
ctcatcagacactcagctcactggctggtatttaattgggagcctggtggccagtgaaaacagtgtgggatgag

SEQ ID NO: 30993 - DNA, 77 bp, Homo sapiens
ggtgctgagaaaaatgtatattctgttgatctggggtgcagagttctgtatctgttaggtatgcttggtccagagct

SEQ ID NO: 30994 - DNA, 74 bp, Homo sapiens
ttaaaaaaatatatgtatacatgtatgtgtgtgtgtgtatatatatacatatatatatatatatatgattttgg

SEQ ID NO: 30995 - DNA, 81 bp, Homo sapiens
ctaaccatttttttgttttcaaggaaaagagacccttgggtcttttttattttatgtttaacaaaataggtaatggtttag

SEQ ID NO: 30996 - DNA, 98 bp, Homo sapiens
tttaggagctttacatagatatgattttctttttattttgcttggggttcccaaagtttcttaaatttggagcttcatgtcttctatcagttttggga

SEQ ID NO: 30997 - DNA, 84 bp, Homo sapiens
aatgcttgggactagaagtgttttagatatcagattttttttctttcttggaatatttgtattatatttgctggttcgagcatt

SEQ ID NO: 30998 - DNA, 101 bp, Homo sapiens
gtaagggcgatttcctaaagtacacataaaatctcaaattaaaatgaacagctactaaaagtttgtatattttactttggggctttagaaatgtctctaac

SEQ ID NO: 30999 - DNA, 85 bp, Homo sapiens
tctatgtagaaaggcataatagacattcaagttttttttttttttttaaatgattggacttgtggctggctgtattctacgtgga

SEQ ID NO: 31000 - DNA, 97 bp, Homo sapiens
gaccgtatataagtttcagtgcattctttgttccttccttaactagcagaacttttaaggagtggtagcaggttgttttgtttttttctaatgagtc

SEQ ID NO: 31001 - DNA, 100 bp, Homo sapiens
gtaggtggtggcttatttgttttgcaatttagttttgagcacatcttgttaggattttgaaagtatttgtattgtggcaaatagtatgttactgaagtgc

SEQ ID NO: 31002 - DNA, 58 bp, Homo sapiens
tgagacagactctcactctgtcacccaggctggagtgcagtggtgcgatctcggctca

SEQ ID NO: 31003 - DNA, 78 bp, Homo sapiens
ggctctctgactgactccttcccacatcttctcagcttagtggctgaagactgatgcaggccgatcgcctcagaagcc

SEQ ID NO: 31004 - DNA, 58 bp, Homo sapiens; identical to SEQ ID NO: 1391

SEQ ID NO: 31005 - DNA, 56 bp, Homo sapiens; identical to SEQ ID NO: 1392

SEQ ID NO: 31006 - DNA, 58 bp, Homo sapiens; identical to SEQ ID NO: 3701

SEQ ID NO: 31007 - DNA, 119 bp, Homo sapiens
agttttggtatgctgtgtttttgttttgtggcaaagcattttcttttttttttttttttttttgagagacagtctcgctctgtcgccccaggctggaatgcaatggcatgatcttggct

SEQ ID NO: 31008 - DNA, 108 bp, Homo sapiens
gtcattggtcctacttgagagtttcagagtgcttttgtaacatgaacatatttatttattttctggagacagagtctcactgtgtcacccaggctggagtacagtggc

SEQ ID NO: 31009 - DNA, 95 bp, Homo sapiens; identical to SEQ ID NO: 68

SEQ ID NO: 31010 - DNA, 93 bp, Homo sapiens; identical to SEQ ID NO: 69

SEQ ID NO: 31011 - DNA, 97 bp, Homo sapiens
ttgtgtaaacgtacctaaacaaagaaaaagtatagtgaaatttcttttattattattattattattatactttaagttttagggtacatgtgcacaa

SEQ ID NO: 31012 - DNA, 126 bp, Homo sapiens
acagcaggctgaggagagactgaagagagactgcattgacaggctaaaaagggtaacatccttatatatatatttgttggttagaatcctggttttagcctcaattttgttgttaattgagtatgc

SEQ ID NO: 31013 - DNA, 109 bp, Homo sapiens
ttgatgcctagttttactacactgtggtcagataagatacctgatatgatttttttttttttttgagacagtcttactctgtcacccagtgttgggaacaggcccccaa

SEQ ID NO: 31014 - DNA, 95 bp, Homo sapiens; identical to SEQ ID NO: 68

SEQ ID NO: 31015 - DNA, 93 bp, Homo sapiens; identical to SEQ ID NO: 69

SEQ ID NO: 31016 - DNA, 58 bp, Homo sapiens; identical to SEQ ID NO: 16809

SEQ ID NO: 31017 - DNA, 61 bp, Homo sapiens
ctggaggacattgttaagctcattttttttttttgagactgagtctcactctgtcacccag

SEQ ID NO: 31018 - DNA, 58 bp, Homo sapiens; identical to SEQ ID NO: 7074

SEQ ID NO: 31019 - DNA, 115 bp, Homo sapiens
ccacatggtgttcccattaacttgatggtgtgttctgactctgtttggttttcttggagtcaaggaagccggattcctatctaagctccaccaatacatatatggataatcttgg

SEQ ID NO: 31020 - DNA, 77 bp, Homo sapiens
ccctcagtttcagacatctctcaagcatatcaggcatacctgggcatggctgagaacagaggctgcacacacgaggg

SEQ ID NO: 31021 - DNA, 86 bp, Homo sapiens
aattcacatttctctgatgattagagattttgaacatttttcatatatctgtttgctatttctatttcttttgagaaatgtctgtt

SEQ ID NO: 31022 - DNA, 72 bp, Homo sapiens
gggctgcctgtctctttcagtgtttgattgacagtggagtagccagagacatgtgcaaaattttagaggcct

SEQ ID NO: 31023 - DNA, 95 bp, Homo sapiens; identical to SEQ ID NO: 68

SEQ ID NO: 31024 - DNA, 93 bp, Homo sapiens; identical to SEQ ID NO: 69

SEQ ID NO: 31025 - DNA, 78 bp, Homo sapiens
atgggagataaagtagtttaggggaggcatgttaaagaaggctatcaagacctgtcccccacactctctgtgtcctat

SEQ ID NO: 31026 - DNA, 74 bp, Homo sapiens
gggctgggtggcttctctaggggggctgtattttttttttttttgagttggagtctcactctgtcgctcaggct

SEQ ID NO: 31027 - DNA, 113 bp, Homo sapiens
caggctaaggctattcttttatattcctagtttttgtgaatttttatcagaatttgatgttgagttttgtcaaaaccattgagatgattgtatggtttttcttttttagtctg

SEQ ID NO: 31028 - DNA, 92 bp, Homo sapiens
gtgttatatttgagtacggagcctatgttttttcttttttcatggtatataaaatagagaggtccaggcacagtggctcacatctgtaatac

SEQ ID NO: 31029 - DNA, 90 bp, Homo sapiens
aaataccacacacacacacacacacacacacacacatatgtgtataaatatatatgtatgtggtatgtgtgtacatgtatatacgtattt

SEQ ID NO: 31030 - DNA, 76 bp, Homo sapiens
tgttcattcatgtacatttctatgtgtgtatataaatatgagtacatttttgtatatatacataaatgtatgagca

SEQ ID NO: 31031 - DNA, 77 bp, Homo sapiens
ttacttctgactctgtggaaagattttagagatgttagtaactttttttcttttctaaagtccctatggagaagtga

SEQ ID NO: 31032 - DNA, 113 bp, Homo sapiens
tggtttgtcttggctaaatgaagttatattcatgtctgtgtgtgcatctgcatgtgtgtgtgcgcacgtgagtgcacatacatctatgtttgctcatggagcatgaagagcca

SEQ ID NO: 31033 - DNA, 100 bp, Homo sapiens
atgtgtacaacatgattctatgtatgtaaaagacgatcttgacattatatatttctatattcatagttgtatctacatatgaatatttgtatctacatat

SEQ ID NO: 31034 - DNA, 87 bp, Homo sapiens
tcatcttagtccagataccagacatagagtgaagagattgttggataacttcaatctcactcaccatctgactgcggctgtagaaga

SEQ ID NO: 31035 - DNA, 85 bp, Homo sapiens
ggggcatagtgaatcctaaaacttcatttcttttcttttctttcttttttttttttttttgagatggagtctctctctgtggccc

SEQ ID NO: 31036 - DNA, 69 bp, Homo sapiens
acgttgcctctgtgtgtgtgtgtgtgcatgcacatgcatgtgcatgcatacataaagggacagggtaac

SEQ ID NO: 31037 - DNA, 75 bp, Homo sapiens
actttgttgtgagatctgagagagcaggggccagtctgttttgcttaccccagtgttctcagggcccaacacagt

SEQ ID NO: 31038 - DNA, 122 bp, Homo sapiens
caagctcagggctcccactggttctacattatggtgagttgtataattatttcattatatattacaatatataataatagacataaagtgcacaatacatgcaatgtgcttgaatcatcccc

SEQ ID NO: 31039 - DNA, 65 bp, Homo sapiens
ctgccagacatgtgagtgagctctcctgggtctttcttcccagtcgagccctcagaagactgcag

SEQ ID NO: 31040 - DNA, 81 bp, Homo sapiens
ccactgtgcctggccgatgagtgccttttttttttttttttttttttctgagacagagtctcactctgttgcccaggctgg

SEQ ID NO: 31041 - DNA, 109 bp, Homo sapiens
ccattgcactcctgcctaggtgacacagtgagacagtgtctcaaaaaaaacattttttttttttttagagataggctcttgctatattgctcaggctggagtgcagtgg

SEQ ID NO: 31042 - DNA, 60 bp, Homo sapiens
gtctgagacagtctcactcactctgttgcccaggctggagtacagtggcatgatctcggc

SEQ ID NO: 31043 - DNA, 64 bp, Homo sapiens
cccatgctgggtgcgaggagctgggagcggccacagtgccaggtctgagagagctcacagtggg

SEQ ID NO: 31044 - DNA, 103 bp, Homo sapiens
gttttcataaaagcctacatatataaaaatatatgtactacatatattatgtataaacatatggatgctacatatatcttatatacgtagactttatgaaaac

SEQ ID NO: 31045 - DNA, 95 bp, Homo sapiens
tcataaagtctacgtatataagatatatgtagcatccatatgtttatacataatatatgtagtacatatatttttatatatgtaggcttttatga

SEQ ID NO: 31046 - DNA, 116 bp, Homo sapiens
gtgagccaccgcacctggcctgtttgttttttttgttttttttttttttaataataacatctaagttattgttgagtataacctaatgaaactgctggttgatgtggtaggtatat

SEQ ID NO: 31047 - DNA, 85 bp, Homo sapiens
gttttatacccttccacctgtcttctcttcctgccacgcagtggtagctctatgtctgttgagacaggggaaggtgtgtggtaac

SEQ ID NO: 31048 - DNA, 73 bp, Homo sapiens
ttgtttgagaccgagtctcactcactctgttgcccaggctggagtgtagtggtgtgatcttggctgactgcaa

SEQ ID NO: 31049 - DNA, 81 bp, Homo sapiens
ctcacacatacttactcactgacactgggacactttagatacactgactcacctacagtgcacatgtttaggatgtgggag

SEQ ID NO: 31050 - DNA, 72 bp, Homo sapiens
tatatatatcactatatatgtatcactatatgtacacacgcacatatatatacatatatatatatatatata

SEQ ID NO: 31051 - DNA, 65 bp, Homo sapiens
ttgggaagtcacttcacactttgttcttggctaatgcatagcagaaggtgaagtatgttttccaa

SEQ ID NO: 31052 - DNA, 74 bp, Homo sapiens
gcagttacctcaggcgatgacagctatggggtgtgtgtgtctctgtgtgtatgtctctctgagtgtgtgtctgt

SEQ ID NO: 31053 - DNA, 58 bp, Homo sapiens
tgagacaggatctctctctgtcacccaggctggagtgcagtggtatgatcatggctca

SEQ ID NO: 31054 - DNA, 104 bp, Homo sapiens
gtgcctcagtcaaacaaaaaggtggatgaaggttgaatgtgctctctctgcctgactgcctttcagctggggcatcagtcttctcctgcctttggatttagact

SEQ ID NO: 31055 - DNA, 117 bp, Homo sapiens
ttcaagaaatgtttattcatgtcctttgcccacttttggaagggattattattattattattattttcttgctgatctgagttccttgtagattctggatactagacctttgttgga

SEQ ID NO: 31056 - DNA, 87 bp, Homo sapiens
caaggtcacattcctgtagaatatagaaatatgtgtagctttcagtttactgtctgcattttttgtttttaaagagaagaggtcttg

SEQ ID NO: 31057 - DNA, 70 bp, Homo sapiens
ggcctttcctctgtgtgtgtctgtgtcctaattgcctcttataaggacaccagtcatgttagattaggcc

SEQ ID NO: 31058 - DNA, 74 bp, Homo sapiens
atctcctatgtatctatctatctaaatatgtatgtgtatatatgtatacatatctagatagacagataagagat

SEQ ID NO: 31059 - DNA, 58 bp, Homo sapiens; identical to SEQ ID NO: 47

SEQ ID NO: 31060 - DNA, 58 bp, Homo sapiens; identical to SEQ ID NO: 1215

SEQ ID NO: 31061 - DNA, 78 bp, Homo sapiens
ccatgaagtgcccccgttgcaggagaggacgtgaggggttaacacctctctctctccctgacagctgaggcattctgg

SEQ ID NO: 31062 - DNA, 66 bp, Homo sapiens
tggaggcagggtctcactcactctatcacccaggctggagtgcagtggtatgatcacagctcacca

SEQ ID NO: 31063 - DNA, 116 bp, Homo sapiens
ctgctccaccctgactcattccgattacctgctctgtgataacatttttcccgccaaaccactcaccctgtcactctctttaaattagccagtcggaattagtttagcctatgcgg

SEQ ID NO: 31064 - DNA, 78 bp, Homo sapiens
ccctggaaacttggtgagcctctgtgactgcctcaatgaatagaatgcagtagaagtgaacctgtataagttccaagg

SEQ ID NO: 31065 - DNA, 108 bp, Homo sapiens
gctcctaatgacctgaatcttcctgtttcaaacctgcgattaagttttatatcaatatatgaatcttaaaagagtttggaactgtgggattgattaaagttgttgagt

SEQ ID NO: 31066 - DNA, 116 bp, Homo sapiens
gccctgcaccatgtttgtgtggatttgaaatgtgctggctggagcaaatgtgagagcacacagatgacagtgtggagggccagaagcagtggtggtcatctgacatctgtggttct

SEQ ID NO: 31067 - DNA, 63 bp, Homo sapiens
ggcagcagccattccagacctgctttggttgattttatgtctgtctgtgtgtgtgtgctagcc

SEQ ID NO: 31068 - DNA, 106 bp, Homo sapiens
ctgactacaagccctgctagcagacccacctgacttcagagtccatccagcagccacccaagctcagagtacagacagtggtcctgcccagctagagaattaacag

SEQ ID NO: 31069 - DNA, 103 bp, Homo sapiens
tacatgtggcttgccagttttcccagcaccgtttgttgaatagggtatgttttccccaatttatgtttttatatgcttgttgaagatcagctagctctaagta

SEQ ID NO: 31070 - DNA, 85 bp, Homo sapiens
ggggtggagggagggcggggggacgcgctgccttggatgctggatttcgggtttttggactcactcgctgactctcttccacttc

SEQ ID NO: 31071 - DNA, 101 bp, Homo sapiens
ccagttctcacttcctgatgcttggagccagacctgccttacacacacacacacaccccaccaccaccacccatgctctgagggtagagctgcaggactgg

SEQ ID NO: 31072 - DNA, 68 bp, Homo sapiens
atacagggtggattcttgtagctggcttctttcccttggcatcatacttgtgggatttatccatgtgt

SEQ ID NO: 31073 - DNA, 99 bp, Homo sapiens
acttttacctgatgctggtttcactgcaggtttcaatttcccactccaggtaaacggattctctgtgtatgtctgtgtctccagttttagagtggtggt

SEQ ID NO: 31074 - DNA, 86 bp, Homo sapiens
tttggagctctaagatttgactgcaccactggatttttgggtgggtgtctccctctctctgtgcagtcctggcttcttcctctaga

SEQ ID NO: 31075 - DNA, 133 bp, Homo sapiens
tatctaatctatatatagatatatttacacacatgtttgtgtgtatatatatgctatatatagatatagatgatctctctatatctctctatatctatatagagaatatatatatagagagaatatatatcta

SEQ ID NO: 31076 - DNA, 89 bp, Homo sapiens
tcagcagtaaagtagtgacagagcagaggctggaacgtaggtctcctgattgccagcacttagctgttccccttctttctctggctact

SEQ ID NO: 31077 - DNA, 115 bp, Homo sapiens
agtgtgctctgaggatggttttgagggactcttatgaggattatagtaaaataattttatgttatttattctcactatccagataccttttactctaaatttctgccagcatgct

SEQ ID NO: 31078 - DNA, 76 bp, Homo sapiens
ttttgttgtttttgagactgagtctcgctctgtcatccaggctggagcgcaatggtgtggtctcggttcactgaaa

SEQ ID NO: 31079 - DNA, 150 bp, Homo sapiens
gtgtatatatatgtgtgtatatatatgtgtatatacatgtgtgtgtatatatgtgtgtgtatatatatgtgtatatatatgtgtgtgtatatatatatgtgtatatatatatgtgtgtgtgtgtatatatatatataactattattatac

SEQ ID NO: 31080 - DNA, 58 bp, Homo sapiens; identical to SEQ ID NO: 1391

SEQ ID NO: 31081 - DNA, 56 bp, Homo sapiens; identical to SEQ ID NO: 1392

SEQ ID NO: 31082 - DNA, 72 bp, Homo sapiens
gcatgtctgcacatgcatgtgtatgtctgtgtgcatacatatgtacacctgtgtgagtgcatgtgcatctgc

SEQ ID NO: 31083 - DNA, 86 bp, Homo sapiens
gtgacaaaggcttatttcatttctaaaaaatagaagtttttcaggtgtttttttgttttttttgagacggagtctttttctgtcac

SEQ ID NO: 31084 - DNA, 81 bp, Homo sapiens
ggaacctgggttccagtcctggcttctccaagttgtgtgttcctgagggaagttactgagcctctctgggcctctgtttcc

SEQ ID NO: 31085 - DNA, 115 bp, Homo sapiens
gaaggaatttggagtcgggacggaagcatcttggatttaaatcatttcagactcattgagctgaggtaagtagtaaaagctaatgttgtggtcgtgggctttagaaagaaacttc

SEQ ID NO: 31086 - DNA, 92 bp, Homo sapiens
agtggagttggctgtgccttgagagtgtgcacatgcaggtgagtgatgcttctggagcatgaccttgtgcacacgggggctgtgtgctccct

SEQ ID NO: 31087 - DNA, 66 bp, Homo sapiens
tttgactggattgagggatgcctggatggctggtgaagcagtttctgggtgtgtctgtgagtcaga

SEQ ID NO: 31088 - DNA, 82 bp, Homo sapiens
cagccagaaggtaaaaaaaactaggttggcttaatttgttaccagccacaacactggattttttttttatctctgaaaactg

SEQ ID NO: 31089 - DNA, 88 bp, Homo sapiens
gatctgacttgttcatttgtgtaggggagagttggtggcacacatcctctctgtcactgtaagtatgttccaaatgtcacattaggtc

SEQ ID NO: 31090 - DNA, 77 bp, Homo sapiens
cagattgtctcatggtcctggaggcctggagtcagaaacccaggggtctgcggggccacactccctctgagactctg

SEQ ID NO: 31091 - DNA, 77 bp, Homo sapiens
gcctgtccttgtctttgaagtaggtacacagcacgatggactgatgagtgggtggacagatttgagataaagcaggt

SEQ ID NO: 31092 - DNA, 78 bp, Homo sapiens
taccatttttgccttctctcttcctccgccaccccttaatgtagatatatgtagagagagagaggagagagagttgta

SEQ ID NO: 31093 - DNA, 90 bp, Homo sapiens
gctttataattttgtgttaagcttcaaataatttaaatttttttatattgatatatgtggagaggaagcataactatcaaaattggaggt

SEQ ID NO: 31094 - DNA, 100 bp, Homo sapiens
aagccagttttgcttccgtttacaaatttgtttcaatattcttaatccataaattattattggattatcctttgaaacttttgtgacattttactagctt

SEQ ID NO: 31095 - DNA, 83 bp, Homo sapiens
tttgccccatctcagccagccacccacaggcaggcacaggtactcacactgtctgcctcacagtggggaagattaaggcaggc

SEQ ID NO: 31096 - DNA, 83 bp, Homo sapiens
aggcgcctgggtgtgtgtggactcagggaggtcacgttctgacgggctgactccctgaaactttccgcctggcactggtgcct

SEQ ID NO: 31097 - DNA, 91 bp, Homo sapiens
tgctttattcatgcaagtcctgatgaaggaagagtttctcagacttttcagcaaagaaatttttctttctttatgaaatgtttattaagca

SEQ ID NO: 31098 - DNA, 111 bp, Homo sapiens
tgaccctagtttagccaggcttttagaaaattgttgagaggatttatttttctttatctgtcaacaccccatccccctgttccacaaagctcaatctacagactgcggtca

SEQ ID NO: 31099 - DNA, 117 bp, Homo sapiens
gcgactgttttctaggtagaacatttaaatttcatagaatgaatatctatctgtatctatatagatatatatctcatactttggttaatgtttatatgaataaaacttgtatttaga

SEQ ID NO: 31100 - DNA, 95 bp, Homo sapiens; identical to SEQ ID NO: 68

SEQ ID NO: 31101 - DNA, 93 bp, Homo sapiens; identical to SEQ ID NO: 69

SEQ ID NO: 31102 - DNA, 85 bp, Homo sapiens
agagcgtgtttaatttttttggtttgtttgttttggagacagagtctttctctgtcacccaggctggagtgttgtggcatggtct

SEQ ID NO: 31103 - DNA, 95 bp, Homo sapiens
ccactgcaagctgagctgctaccacattatttctttttgtttcgaaaggcccactggttatgaatgcaggatggctgacagggaaggcaatgtgg

SEQ ID NO: 31104 - DNA, 89 bp, Homo sapiens
gcagtacatttatgggagattgattttgggtttattttattttattttttttgaggcatagtctccctctgtctcccaggatgcagtgc

SEQ ID NO: 31105 - DNA, 111 bp, Homo sapiens
gtgcctgcctttgcttctctgacattggccgtttgtctctaaggtaatcatgtgtggtagcgatggggagggagacaaaatgaacagaatcagtggcgacttcggttgtgc

SEQ ID NO: 31106 - DNA, 88 bp, Homo sapiens
tatgtgcatgtatgtgtgtatgcctatagatgtatataaacatatatgtttatataaacatatatgcatgaagttatacatggggata

SEQ ID NO: 31107 - DNA, 84 bp, Homo sapiens
ctgaaccaattatggagaaagaagaggtggttttcatggagttcctctgcctgaatgtcactcactctctctttaattgcttgg

SEQ ID NO: 31108 - DNA, 69 bp, Homo sapiens
ttgagatgagtcagagtctcactctgttgctaggctggagtgcagtggtgagatcttggctcactgcaa

SEQ ID NO: 31109 - DNA, 71 bp, Homo sapiens
aatggaagcttcaaagactcagggaggaccaggcagctgcctgggccctctgtgagtctgtgcttcacatt

SEQ ID NO: 31110 - DNA, 135 bp, Homo sapiens
atgtgcatgtgtgcatcattaagtaactatatgtgtatgtgtacatgtatatcattatgtatatatgtgtgtatatcattatgtatatgtgtgtatgtatatcatgtatatatgtatacacatcattatgtgtgt

SEQ ID NO: 31111 - DNA, 102 bp, Homo sapiens
cattatgtatgtgtacatatatatcattatgtatatacgtgtgtatatcattatgtatatgtgtgtatgtatatcatgtatatatgtatacatatcattatg

SEQ ID NO: 31112 - DNA, 100 bp, Homo sapiens
acacatatgtgtatgtgtatgtatatgtacacacatatgtgtatatgtatgtatatatacacatatgtgtatgtatgcatatatacacgtatgtgtgtat

SEQ ID NO: 31113 - DNA, 103 bp, Homo sapiens
tatatgcatgtgtgcatatgtacacgtgtgcatgccttctgtgcatgtgtgaatgcatgtgtgcatgtggatgtatatgtgtgcatgtctgcgcatgtgtgta

SEQ ID NO: 31114 - DNA, 126 bp, Homo sapiens
ttgtatgtttgcatgcatacatggtgtgtgtatatgtgtgtatctctgtgtggtgtatctgtgtttgtatatgtgtggcatgtgtgtgtctatgtgtgtagtgtgtgcatgtggtatgtggggatg

SEQ ID NO: 31115 - DNA, 76 bp, Homo sapiens
ggatgttatacagctgctaagagatgaaagtcaggtgactcggaagatcctgattctctggctgacgatgggcacc

SEQ ID NO: 31116 - DNA, 119 bp, Homo sapiens
gaagctagcaaatttggggatggtcttctttgcaataatagctgttacaggggtgctgactctcactgtatctcagaatgttgcggggagcaaacgaggccatgtgcgttagaagcttt

SEQ ID NO: 31117 - DNA, 126 bp, Homo sapiens
gagataggggaaagctggcagccacaggccttgccaagctcccaaaaggctggtctcactctcactgtgcccctccaacaacactgagtttatttccaggcacccagtgagcagggctgagaactt

SEQ ID NO: 31118 - DNA, 99 bp, Homo sapiens
atccagtctgtggtattctgttacagcaacaggaaatggacaagacatgtgtattagtctgctctcatgctgctaataaagacatacccaagactgggt

SEQ ID NO: 31119 - DNA, 97 bp, Homo sapiens
atacttgccagctctcataatcatgtgagccaattccatgaagtatgtattttaatatatatctaggatatattcacgtgtgtgtgcgtgcgtgtgt

SEQ ID NO: 31120 - DNA, 94 bp, Homo sapiens
agtgtggttcgattttatttttattttttagttgtggacaaggtctccattgtctaagccactgtgagaattcaggtaaatcatggcccatcct

SEQ ID NO: 31121 - DNA, 128 bp, Homo sapiens
ccttgtgggtgatgaaggtgtgttgcctcctgattgtgaccttggtttgtgacctgagtgtgcacatagtcaaactcactggactggaagcttgaagtggacacaatttactggacagaaatcatacc

SEQ ID NO: 31122 - DNA, 95 bp, Homo sapiens; identical to SEQ ID NO: 68

SEQ ID NO: 31123 - DNA, 93 bp, Homo sapiens; identical to SEQ ID NO: 69

SEQ ID NO: 31124 - DNA, 75 bp, Homo sapiens
gaggtttaattgcctcccagttctgcaggctgtacaggaagtgctgtatcagcatctgcttctggtgagggcctc

SEQ ID NO: 31125 - DNA, 88 bp, Homo sapiens
gagtttttcgtgtcatctgcttcttcttttttgagacggagtctcactctgtcacccagactggagtgcagtggcatgatctcggctc

SEQ ID NO: 31126 - DNA, 90 bp, Homo sapiens
tgatttccattgtaatccagatgccattgatgctgttaaagttgtttatttttaatttgtattgaggaatgagagcacacttgggattca

SEQ ID NO: 31127 - DNA, 110 bp, Homo sapiens
tacgacctcacacccattatgatggctattatttaaaagtcaaaagataacgaatgttaggaagtatgtgaagaaaaagggaaggcttgcatagtgctggtggaaatgta

SEQ ID NO: 31128 - DNA, 70 bp, Homo sapiens
aaaaaagaagaaagaaaagtgtacagattgctgccatgggcaaggagggcttggttcttttttttttttt

SEQ ID NO: 31129 - DNA, 58 bp, Homo sapiens
tgagacggagtctctctctgtcgcccagactggagtgcagtggcgcgatctcggctca

SEQ ID NO: 31130 - DNA, 119 bp, Homo sapiens
actctgtctggaattttttttttttttttttttttgacggagtctcactctgtcacccaggctggagtgcagtggtgtgatcttggctcactgcaacttctgcctcctgggttcaagtg

SEQ ID NO: 31131 - DNA, 104 bp, Homo sapiens
gagtaactgggactacaggcatgcaccaacatgttggctaatttttgtatttttttaaagtaaagatgggatttcaccgtgttgcccaggctggtctcaaactc

SEQ ID NO: 31132 - DNA, 99 bp, Homo sapiens
aggaaatgctgtgttgcctcgacagacttggggcttgagatactactcagcagccctgtcagagacgtcagtgagcacatcagtcttcttttttttcct

SEQ ID NO: 31133 - DNA, 74 bp, Homo sapiens
ggcttgcagagggctgtcttctctctgtgtcttcccaaaacagggagagagagagagcaagtgctagccttctg

SEQ ID NO: 31134 - DNA, 86 bp, Homo sapiens
tctggatgttgataactgtagattgtgagctgatattttactagtgatcccatggtcaaaatcactctctcagaatctaattcaga

SEQ ID NO: 31135 - DNA, 116 bp, Homo sapiens
tggacaattcaggtagcaaatcaccatacccttcaaagtttgttgttgatgctgtgttttttctttttgttttttatttgatggttgatggtgtttgcctcgttactgttagttta

SEQ ID NO: 31136 - DNA, 86 bp, Homo sapiens
acccttctccctggggaactctggaactgtttgcaaatgtaatctaattataagcctgacactctcccacccaggttggggcaggt

SEQ ID NO: 31137 - DNA, 86 bp, Homo sapiens
ttttgttgaatgtcctttaatttgggtttgtggtttttttttttttttttttttgcttagactcaggtaatggacactgggcagga

SEQ ID NO: 31138 - DNA, 94 bp, Homo sapiens
tagaagaacttctaagaagtgagagtggagacaggccaaagttgctgctctaggcagctccatgaattccaggacttctgagaaacaccctctg

SEQ ID NO: 31139 - DNA, 58 bp, Homo sapiens
tgagacagagtctcactctatcacccaggctggagtgtagtggcgtgatctcggctca

SEQ ID NO: 31140 - DNA, 80 bp, Homo sapiens
tctctctcaatctgtgtcactttaacaaatcagggaacatctttgtctttgttgttgttaagcgataaggcatagagaga

SEQ ID NO: 31141 - DNA, 116 bp, Homo sapiens
tgcactataactcatgcctgaacaaaccttatctaacatattttccctgtaggcatatcacagcctttttgtgcttggggatgttagacgtcacttcagcaccatgtgttgggtca

SEQ ID NO: 31142 - DNA, 79 bp, Homo sapiens
agtctcactctgtcacccaggctggagcgcagtggtgcactcttggctcaccctccatctcctgggctcaagtgactct

SEQ ID NO: 31143 - DNA, 96 bp, Homo sapiens
taaagtccaatttataagttattttttggagacactgtctcactctgttgcccaggctggagtgcagtggctcaatcacaacttactgcaacttta

SEQ ID NO: 31144 - DNA, 79 bp, Homo sapiens
cactggagaagctgaaggtctgtttgcgggagaagtttccgattttacccggagctgagtcaagttagagagcccagtg

SEQ ID NO: 31145 - DNA, 96 bp, Homo sapiens
gccagtgcttgttattttctgttttttggataggagacattctttttttttttgaaatggagtctcactctgtcacccaggctggagagcagtggt

SEQ ID NO: 31146 - DNA, 170 bp, Homo sapiens
atgtataagtgtatacatttatataatgtatatatttatacatgtataagtgtatacatttatacatgtatatgtgtctatatatgctcttttctgtatgtctatttttttttatactttaagttttagggtacatgtgcacaatgtgcaggttagttacatatgtatac

SEQ ID NO: 31147 - DNA, 94 bp, Homo sapiens
gcagtttatgtattttaaagttctgctcaatatctgctatatgtatgtatatatacatacagacacagagagagctatttcaagaagtagctgc

SEQ ID NO: 31148 - DNA, 69 bp, Homo sapiens
acagagtgagaccctgtcttaaaaaagaaaaaaaaaaaagagagagagagagacagagtctcactctgt

SEQ ID NO: 31149 - DNA, 106 bp, Homo sapiens
agagaaattgatcaacagaccttgaaaagtgtccggtgcaacaatgagggccttcactgtccctctttctgtcagcattttaatcacaactgtttaacaagtctct

SEQ ID NO: 31150 - DNA, 102 bp, Homo sapiens
ctgacattgggcaaggctcggtgggtggctcatgcctgtaaatcccagcactttgcagggctgaggtagaaggatcgcttgagcctgggagttcaaggtcag

SEQ ID NO: 31151 - DNA, 77 bp, Homo sapiens
cctgttgtggcatgggtcagaatttccttccggtttatttatttacttatgagatggagtctcactctgtcaccagg

SEQ ID NO: 31152 - DNA, 76 bp, Homo sapiens
ctggagagctctctgctctagctggcttccaaatcagacattggcactagcaggacaaagccaagggtgactctgg

SEQ ID NO: 31153 - DNA, 74 bp, Homo sapiens
ctgggccaagggccagcctgcctggggttccagttcttgctccattggtcagtctctctgagcctcagtttccc

SEQ ID NO: 31154 - DNA, 80 bp, Homo sapiens
ctgggcacgtagtttcgctggctcacgcctacaatcctagtactttgggaggctgaggtaggaggatcacttgaacccag

SEQ ID NO: 31155 - DNA, 77 bp, Homo sapiens
gacagccttctacctatccaacggctgacttctcattgtatcctcatacagcagaagacagaggtgagagagctctc

SEQ ID NO: 31156 - DNA, 86 bp, Homo sapiens
gtgtgtgcagaggcagagactgaccggaggcagcagtggtgaagggccacctgagcatctctgtgcctgtctccctcggcacaggc

SEQ ID NO: 31157 - DNA, 69 bp, Homo sapiens
ctccctggagaactgagaggcgccagtggggctcacttgtgtttttcagggttccctgccagacgggag

SEQ ID NO: 31158 - DNA, 109 bp, Homo sapiens
ggccaattttattttttgtgaggggtgtaaggtctgcgtctggaatcatttatctgcatgtggatgtgcagttgttccagcgccatttgttgaaaagatgatcttgtct

SEQ ID NO: 31159 - DNA, 88 bp, Homo sapiens
gttgttttgagaccgagtctcactctgtcacccaggctggagcgcagtggtgcagtggtgcagtggtgcgatcttggtttactgcaac

SEQ ID NO: 31160 - DNA, 113 bp, Homo sapiens
ctgaagagcctttctgggcacagttagtggctacagaggggtgccttgtgacatgtgagggtcactgccagactcagtggctgtccctgctgtttggctggggaagggtccag

SEQ ID NO: 31161 - DNA, 89 bp, Homo sapiens
aggctggtctcaaactcctggcctcaagcaatctgcctaccttggcctcccaaaatgttcggacagatgtgagccaccacacctagcct

SEQ ID NO: 31162 - DNA, 99 bp, Homo sapiens
acaaacccaaggaagagatggtgcagccgtgcaagcccctggtggatctgttgtgtctcactcaggttttgtattttctctgtgtcttcagtagtatgt

SEQ ID NO: 31163 - DNA, 80 bp, Homo sapiens
tgatgttagcttaactagagcatgaggagactagacctattaggtgtctgtctctgtgactcttgtagcttccctggtca

SEQ ID NO: 31164 - DNA, 68 bp, Homo sapiens
tgggatgtctctgtgtctgtgccctcacagcccacagctcagtatgggtagatactgttgacgttttg

SEQ ID NO: 31165 - DNA, 88 bp, Homo sapiens
agaattttcttaggtcagaaaacttacaatttgcagtaatcaaaagaagttagtaaattctatttgtgactctgcttatggaaattct

SEQ ID NO: 31166 - DNA, 114 bp, Homo sapiens
ctggaagaatgtgatgtggccacaggtgggacagacaggcattttactctaacagttgtgtgtttatttttatagttactgtgtatggtaagttacagtaatgttttatttcag

SEQ ID NO: 31167 - DNA, 58 bp, Homo sapiens; identical to SEQ ID NO: 5055

SEQ ID NO: 31168 - DNA, 83 bp, Homo sapiens
cctggtggggccactgccctgggtgcctcagtctctgtgtctggtaacagaggtgggcacaggcatgcagagctgggtggccc

SEQ ID NO: 31169 - DNA, 74 bp, Homo sapiens
cctagtatgagattttgttcttcaggtataagggatatgatgccagcttgtatatgaggatttctaaatctggg

SEQ ID NO: 31170 - DNA, 77 bp, Homo sapiens
tctgtgcacttaggggagagagagttcagtgattatgggaccctgcactgaactcagtgtttctctgtcacagcaga

SEQ ID NO: 31171 - DNA, 116 bp, Homo sapiens
gtcaatggtagcttgatgggcagtatggccattttctttctttattaaaaaattatttttattatattttaagttctgggatacatgtgcagaacatgcaggtttttaacatagat

SEQ ID NO: 31172 - DNA, 114 bp, Homo sapiens
tatctatatatagatataatgatatatctctatatatttatatgtaattatatgtatgatatgtttatatattatatgtctatatagatacagatctatctatctatatattga

SEQ ID NO: 31173 - DNA, 118 bp, Homo sapiens
gaggacatttattcgtttccccttttatacctagagtacagacttttttctttttaaagagaaaatgtttttatttcaaccttatttttgaagggtggtttcactgaatataggattc

SEQ ID NO: 31174 - DNA, 125 bp, Homo sapiens
ggcttctgttgatggtcttttcttattcaagttgagattttcctggttcgtggtttgactagtgattttctagtgtgttctgaacatattgagtattatgttatgagacccagattcttactgaa

SEQ ID NO: 31175 - DNA, 95 bp, Homo sapiens; identical to SEQ ID NO: 68

SEQ ID NO: 31176 - DNA, 93 bp, Homo sapiens; identical to SEQ ID NO: 69

SEQ ID NO: 31177 - DNA, 95 bp, Homo sapiens; identical to SEQ ID NO: 68

SEQ ID NO: 31178 - DNA, 93 bp, Homo sapiens; identical to SEQ ID NO: 69

SEQ ID NO: 31179 - DNA, 79 bp, Homo sapiens
ggtattttatttgttttagatttctctggttcagttgagtgcagtttccagctgattcaaaagtttaagaagtgatacc

SEQ ID NO: 31180 - DNA, 59 bp, Homo sapiens
gagacacggtctctcgctctttctccagggctggagtgcagtggcgtgggtcacggctc

SEQ ID NO: 31181 - DNA, 96 bp, Homo sapiens
ctctatcagagtgaggtagtagattgtatagttgtggggtagtgattttaccctgttcaggagataactatacaatctattgccttccctgaggag

SEQ ID NO: 31182 - DNA, 98 bp, Homo sapiens
ggagctgatgtggctcccaatctaccccctgataagacctcagtgtgtttcactgagagctccacctatcacctatgtcaagattgggacttcagccc

SEQ ID NO: 31183 - DNA, 88 bp, Homo sapiens
ggggatgtgccagggtgggggccactgttgagagtctgcacccagtaatggtcagggactcagtgacaatgactctggcagccctggc

SEQ ID NO: 31184 - DNA, 76 bp, Homo sapiens
ccagccttgccaacatagtgaaaccccatctctatttttttttttagatggagtctcgctctgtcacccaggctgg

SEQ ID NO: 31185 - DNA, 118 bp, Homo sapiens
gctggtgattaggggatgagtaataaaataaaatacatattgcattattattatttttttgggccttcacttatgttattttattttccaagacggagtctcacgctgtcacccaggc

SEQ ID NO: 31186 - DNA, 117 bp, Homo sapiens
agggtggctgttagcccgttagccttacgtaagactttgctgtgaaccttttaaagtttttaattcttctggcacagttaaaatacagtttgaggcctggtgcggtggctcacgcct

SEQ ID NO: 31187 - DNA, 82 bp, Homo sapiens
ccatcctttcctcataactcagtgagcagacatggagcatgggctgtgtgtctgggcactgcagaaacagacagaaggatgg

SEQ ID NO: 31188 - DNA, 79 bp, Homo sapiens
gggcctcactctcactcaggctggtgtgcagtggtgcaatctcagcttactgcaacctctgcctcccgggttcaagtga

SEQ ID NO: 31189 - DNA, 72 bp, Homo sapiens
gagaggcatggtctaccctgtgtcttcatactgcggctactgtgtgaagatcagactgaagacagtgccctc

SEQ ID NO: 31190 - DNA, 69 bp, Homo sapiens
ctaggggagagctagagctagtaactaggggagtgtgcccctttacttgccagactctcagtccctcag

SEQ ID NO: 31191 - DNA, 58 bp, Homo sapiens; identical to SEQ ID NO: 1673

SEQ ID NO: 31192 - DNA, 76 bp, Homo sapiens
ccaggtgcattggtggtgcctgcctgtgatcccacgtacttgggaggctgaggtaggaggatcacttgggcccagg

SEQ ID NO: 31193 - DNA, 114 bp, Homo sapiens
cctttgggaggctgaggcaggaggatcatttgaagccagaagtttgagaccactctgggttacaaagtgagaccccatctccagaccccatctcttaaaaaaaaaaaaaaaagg

SEQ ID NO: 31194 - DNA, 81 bp, Homo sapiens
ctatgggtctctgagccttcaaataaggactttatttggtcaaagctggttgagttgagtttctgttgtttacacccacag

SEQ ID NO: 31195 - DNA, 116 bp, Homo sapiens
ccggtgtgtacagtttcctaatttggaaggtttcacaactgtttttgttcaactgatggaggagagatttttttaagggcaaattcttcattaggaagactgtaaacaagtcctgg

SEQ ID NO: 31196 - DNA, 65 bp, Homo sapiens
ggtgctgtggtcacaatagtgagtgagttctcatgagctctggttatttaaaagtgtgtggcacc

SEQ ID NO: 31197 - DNA, 71 bp, Homo sapiens
tcctgagtagctgggattacagacactagccaccatactcggctaatttttgtatttttatagcgacaggg

SEQ ID NO: 31198 - DNA, 104 bp, Homo sapiens
gcggcacagttgtaggattttgaattaaaaataaaattatgctctttgagtggcattctgcaagagaagtgattttattgcttaagttccctcttgtattacgc

SEQ ID NO: 31199 - DNA, 96 bp, Homo sapiens
aggctaaaatgaaacacaggcttttaattgtttttcttatataaattaagctgaaaaagaaaaacttttaaaaatgctcctgtggctactgcttgc

SEQ ID NO: 31200 - DNA, 66 bp, Homo sapiens
cctggtgccctgagagccgaggccatgaagtcagctttgcgctggctggttccctcagtgcctggg

SEQ ID NO: 31201 - DNA, 118 bp, Homo sapiens
ggtggcgctgctctcaggtgctctggctgcttgggttcctggcatgctgatttgtgacttaagattaaaatcacattgccagggattaccacgcaaccacgaccttggctgctcctcc

SEQ ID NO: 31202 - DNA, 114 bp, Homo sapiens
cccagcgatgacctctctaacaaggtgcagagcttagctgattggtgaacagtgattggtttccgctttgttcacagtggctaagttctgcacctgaagagaaggtgagatggg

SEQ ID NO: 31203 - DNA, 110 bp, Homo sapiens
ggctgtcgattggacccgccctccggtgcctactgagctgatatcagttctcattttacacactggctcagttcagcaggaacaggagtcgagcccttgagcaaaaagcc

SEQ ID NO: 31204 - DNA, 93 bp, Homo sapiens
ttgaggctccttgtcactgagcaggaaagacaaggagaagtgttctgatttctcactcttcttgctttgtggcctcttgttagggactatcag

SEQ ID NO: 31205 - DNA, 117 bp, Homo sapiens
agacccagcttgaaaacagagccagcaaagggaaagtacccctgagagacagagagagacaatttctggaggtgagtatgggagcccttgggtacagctgtgtctgaaagctgtatt

SEQ ID NO: 31206 - DNA, 97 bp, Homo sapiens
cctgggcaaccagagtgagaccttatctcttttattttttattttttaaatttatttatttatttttttgagacggagtctcactctgtcgcccagg

SEQ ID NO: 31207 - DNA, 108 bp, Homo sapiens
tttgtattacttcatattgttgcatttttttttaagtcaaaagtgttttactgttatttacatatttatagaaaaaggaatgtagcaaatggctcagggtcatatgaa

SEQ ID NO: 31208 - DNA, 68 bp, Homo sapiens
ctggagatacagtgttactctttgtttttgtttttgttttttgagatggagtctcactctgtcaccag

SEQ ID NO: 31209 - DNA, 85 bp, Homo sapiens
cagtcagtgggagaaagcagctgacttatttttgtattatttctcacaaaagctgtggtacagtctgtctgtctccctatggctg

SEQ ID NO: 31210 - DNA, 88 bp, Homo sapiens
ctggagtcaatatatgtatatttttaatcaagaatgctgaagccccttagacttcagcctgatgggacagtgttcatattcattccgg

SEQ ID NO: 31211 - DNA, 103 bp, Homo sapiens
gtatgttttgttatggctttgtttaccagattcgagaagaatgtgttgaatcagtatatttcattttcaaatcaaccagtggcatgtagccaagataatttgc

SEQ ID NO: 31212 - DNA, 66 bp, Homo sapiens
ttattgacagagggtcttgtttttgttcattcaccagagtggaaaatcataggattcttgtaatga

SEQ ID NO: 31213 - DNA, 95 bp, Homo sapiens; identical to SEQ ID NO: 68

SEQ ID NO: 31214 - DNA, 93 bp, Homo sapiens; identical to SEQ ID NO: 69

SEQ ID NO: 31215 - DNA, 73 bp, Homo sapiens
ctgaggcagtctgtctctgtcacccaggctggagtgcagtggtgtgatcttggctcagtgtaacttctgcctc

SEQ ID NO: 31216 - DNA, 118 bp, Homo sapiens
tctgccagcttccgcgaccttgatctcagccaatcctgttttgggccccatcacagtctttctgtctgtggagctgggcaagcaggaggtttctcagggcccaagatggtttttcaga

SEQ ID NO: 31217 - DNA, 116 bp, Homo sapiens
atagatttgcattagaattgtaattgctctgtatatgttttaatgttttattataaaattcatacataaatattaatacattgatatgtagttatttaataatttaatgtatctat

SEQ ID NO: 31218 - DNA, 58 bp, Homo sapiens; identical to SEQ ID NO: 3357

SEQ ID NO: 31219 - DNA, 109 bp, Homo sapiens
gttctttatatcggcactattttttttcctctctgacttattcattcatgggtttctccaactgtctgagtctctgggaaatggtgtgtttgcccattaatcaaggaat

SEQ ID NO: 31220 - DNA, 72 bp, Homo sapiens
ttgttttttgagatggagtctcactctgtcacccaggctggagtgcagtggtgcaaactcggctcactgcaa

SEQ ID NO: 31221 - DNA, 82 bp, Homo sapiens
tgtattcactatgacaagcctgaagcatatgcggtagcaccctgactgcctgtcttgtgatcaacatgtgatggtggaaata

SEQ ID NO: 31222 - DNA, 96 bp, Homo sapiens
ctgtgaccaactctaagaaactatatctgtatttttataaattggtacaagtatcagactataaaagaagacttaatcccttgaattggatgacag

SEQ ID NO: 31223 - DNA, 75 bp, Homo sapiens
cacattcatgcatgtatacatatatattgtacacacatatgtgtatctatgtatatgtatttaaatttgtttgtg

SEQ ID NO: 31224 - DNA, 57 bp, Homo sapiens
caagagcatgcaaggtgctcacacaccgtgcaaggtgtgtgagactctgtgtgtgtg

SEQ ID NO: 31225 - DNA, 84 bp, Homo sapiens
ggaggctggaagtctgagatcaaggtgtcagcaggtttgaattctcccgaggcccatctccttggcttgcagacagccgccttc

SEQ ID NO: 31226 - DNA, 114 bp, Homo sapiens
gcattgttgcctctgctacgacacattgtaggcacgcaggtctaacccaagttttttattaatttatcagctcgggcttcccacagtgcctgagtagtgtgggcccccaactgc

SEQ ID NO: 31227 - DNA, 80 bp, Homo sapiens
tgagatgcagtctcgctctgtcacccaggctggagtgcagtggtgtgatcccggctcactgcaacctctttctgccaggt

SEQ ID NO: 31228 - DNA, 65 bp, Homo sapiens
agagcacaggagggaggacaaagaagaggcattgggcaggtctgcgtgtctccctctctgggtct

SEQ ID NO: 31229 - DNA, 107 bp, Homo sapiens
acaaatgctcagaattgcaattgttgggctgtatggaagttgcatgtttagtttcttaggaaactgcaaactcttttccacagttgctgtattcccctagcagtgta

SEQ ID NO: 31230 - DNA, 116 bp, Homo sapiens
gtggtttgctttcttctgtgtttggtgacctgtgattgtgagcattttgcttaaaaaaaatttttttttttgagatggagtctcactttgtctcccaggctggagtccagtggcac

SEQ ID NO: 31231 - DNA, 84 bp, Homo sapiens
ggcctcagcctctcaaagtgctgggattataggcgtaagctaccacgcccgacactttgttttttgttttttagagatggggtc

SEQ ID NO: 31232 - DNA, 106 bp, Homo sapiens
tggcaatgaagatttcactcctgtgtagctccttctgtctgactctgtgttaataattttagcaagcaagacttgagctatatgtggctactgaggatcacagcca

SEQ ID NO: 31233 - DNA, 89 bp, Homo sapiens
tgtatatatatgtatatgtgtatatatgtatatgtatgtatattgtgtatatatgtgtatatatgtatatatatgtatatatatgtata

SEQ ID NO: 31234 - DNA, 190 bp, Homo sapiens
tatatatatgcatatacgtatatatgtatatatgtatatatgtatatatatgtatatatgtatatatatgtatatatgtatatatacgtatatatgtatatatgtatatatacgtatatatgtatatatgtatatatacgtatatatgtatatatgtatatatgtgtatatacgtatatatgtatatgta

SEQ ID NO: 31235 - DNA, 81 bp, Homo sapiens
atatatatatatatatatgtgtgtgtgtgtgtgtatatatatacacatatatacatatatacatacatatatacatatata

SEQ ID NO: 31236 - DNA, 120 bp, Homo sapiens
gttgtatagctatgacatttattcaagttaatggatatatatatatatatatatatatatatatatatatatatattttttttttttttttttttttgagatggagtcttgctctgttgc

SEQ ID NO: 31237 - DNA, 58 bp, Homo sapiens; identical to SEQ ID NO: 2540

SEQ ID NO: 31238 - DNA, 119 bp, Homo sapiens
tgtatatgcacagatgtatgttgtgtacgtatatgttttatgtttacagtacaattttaaaattttttattggtacataattgtacatatttatgggttacatgtgatagttttataca

SEQ ID NO: 31239 - DNA, 60 bp, Homo sapiens
ttgagacagagtctcgctctgtcacccaggctggagtgcagtggtgtgatcttgactcaa

SEQ ID NO: 31240 - DNA, 82 bp, Homo sapiens
ggtgttactaaagtgaaactcacagtttatatataaagtgctaaatttttttttttgagacagagtttcgctcttgttgccc

SEQ ID NO: 31241 - DNA, 106 bp, Homo sapiens
tttggattggcaagtgaaggcagtgggtacaacacagcgggttgtttcagtagtcatttgcttgttaactaaagaaaaattcatggctgtgtctagtggctcatgc

SEQ ID NO: 31242 - DNA, 116 bp, Homo sapiens
tggtttaggaaagttaggctcttttcgtaatttccttttagaacgtatttttttctcttttgttgctttagaagaaaatggttttggagatctgccggcccaaggatgacaagcca

SEQ ID NO: 31243 - DNA, 119 bp, Homo sapiens
tctctagttctttcagtttttattttaggctattaatttgagatttttctaactttttgatatgggcatttagtgctataaatttccctcttaatactgccttagctgtgtctcagaga

SEQ ID NO: 31244 - DNA, 85 bp, Homo sapiens
acatttggtctaacaggttgagttgaggtcctgaatatatttgttaattttctgcctcaatgatctaatactgtcagtgggatgt

SEQ ID NO: 31245 - DNA, 112 bp, Homo sapiens
tcagtgatacggatatgacagtactggtgaggtgaggaagttgagctgagtgatgacacataggcaatatttcatttggtagtataagttctttttatatcaaaattactgg

SEQ ID NO: 31246 - DNA, 94 bp, Homo sapiens
tgttgaatagtagtggggagcttttttggagcaactgtaaataacattatgttttttatttcagtttccaattgtttttggctaatacgtaata

SEQ ID NO: 31247 - DNA, 96 bp, Homo sapiens
ctataattttttttttgagatggagtctcactctgtcacctaggcttgagtgcagtggcgtgatctcagctcactttaaaaagaaggaaattttgg

SEQ ID NO: 31248 - DNA, 76 bp, Homo sapiens; identical to SEQ ID NO: 31184

SEQ ID NO: 31249 - DNA, 108 bp, Homo sapiens
tctgaagctactacaaactcaagtcagtgagttgcttctgtaccagtttttttttttttttttttttgagatagagtcttgctcccaccttgaagtgcagtggtgtga

SEQ ID NO: 31250 - DNA, 88 bp, Homo sapiens; identical to SEQ ID NO: 31183

SEQ ID NO: 31251 - DNA, 108 bp, Homo sapiens
gctgtcttatctgtgtttcattgtctgcttttctggctgcttgttgttagaagtgattttcttgaaatgcatgaggctagaaagggagctggaacttaaagaggcagt

SEQ ID NO: 31252 - DNA, 58 bp, Homo sapiens; identical to SEQ ID NO: 87

SEQ ID NO: 31253 - DNA, 56 bp, Homo sapiens; identical to SEQ ID NO: 88

SEQ ID NO: 31254 - DNA, 80 bp, Homo sapiens
atatatatattactgattatatgtataacaaattgtatgtattactaatataatgttatatatatcagttatatatatat

SEQ ID NO: 31255 - DNA, 58 bp, Homo sapiens; identical to SEQ ID NO: 87

SEQ ID NO: 31256 - DNA, 56 bp, Homo sapiens; identical to SEQ ID NO: 88

SEQ ID NO: 31257 - DNA, 92 bp, Homo sapiens
aggttttccagttgagtgactgtgtttccactttaaggtctggcctacagagaagagagattgcagagctctttaaggatactggagctcct

SEQ ID NO: 31258 - DNA, 84 bp, Homo sapiens
gttgttgttgttttgagatggaatctcactctgtctcccaggctggagtgcagtggtgtgatctcagctcacggcaacctccgc

SEQ ID NO: 31259 - DNA, 86 bp, Homo sapiens
cttgggagggaatactactgtttaaggaatctttttaattttttttactttttttttttgagacagagtctttctctgtcaccaag

SEQ ID NO: 31260 - DNA, 93 bp, Homo sapiens
ggtttctgtcttgaagtgtctctgtctctcacatatcacatgccatgtcatgagagcactcaggcagcctatgaagagacccccacagagagg

SEQ ID NO: 31261 - DNA, 100 bp, Homo sapiens
gctgagacccatgtcagaataaactagagatccgtgtgataataaatgtgtgttgttttaagtcactctgtctgtggtagtttcttataactaatgtagc

SEQ ID NO: 31262 - DNA, 115 bp, Homo sapiens
gatctgcccgcctcggcctcccaaagtgctgggattacaggcgtgagccaccgtgcccggctggctgaatgcctcttaaccaatacagggagatgaggtgcactggttgggactc

SEQ ID NO: 31263 - DNA, 117 bp, Homo sapiens
aagcctcctgtttctggcccggaaccccagctagcactccagcgctgtcttgtggctctgaccacagagagcagagagggcagggtggcaaggggacagagatggggtggagtgctt

SEQ ID NO: 31264 - DNA, 99 bp, Homo sapiens
gcaggcttggagtgttgttactattttattttatttttgagacagggtctcactctgtcacccagactggagtgcagtggcaagaacatggcttactgc

SEQ ID NO: 31265 - DNA, 103 bp, Homo sapiens
cttgctgtctaccaccctcaattaggctgtgagttccttgaaggaaaagactctcatttgatttctctctctgtctccaattcttagcaaaggggttagtaag

SEQ ID NO: 31266 - DNA, 90 bp, Homo sapiens
gagcaaggatgggttaaaaaaaacaaaaacaaaatcaacaaaatcaacaaatgaatggtttttttttttttttgagacggagtcttgctc

SEQ ID NO: 31267 - DNA, 122 bp, Homo sapiens
atgaatgtatatatgtacatgtatatatatatatacatgtatatatacatatgtgtgtgtgtgtatatatatatatatacacgtacatatacatatatatatatggtgttccaaaaagtaca

SEQ ID NO: 31268 - DNA, 89 bp, Homo sapiens
atatatatatatgtatatgtacgtgtatatatatatatatacacacacacacatatgtatatatacatgtatatatatatatacatgta

SEQ ID NO: 31269 - DNA, 118 bp, Homo sapiens
ttggcagaagtttatggacttgccattcctcatgatttccgggctacagagtcatcattagcagagagaatcgtgagagaagagaacctggttgatagagctttggaaggatagccaa

SEQ ID NO: 31270 - DNA, 117 bp, Homo sapiens
acagctgcatgtgaatctaccattatctcaaaattcaaagtttaaaattaaaaaaagtttcttcaattttattttattttatttattttatttttttgagatggagtctcactctgt

SEQ ID NO: 31271 - DNA, 123 bp, Homo sapiens
gtctgttgacagacagacttttttttttttttttttccccctgagagtctcactctgtcacccaggcttgagtgcagtggtgcaatctcggctcactgcaacctctgcctcctgaattcaagc

SEQ ID NO: 31272 - DNA, 117 bp, Homo sapiens
agacatcattggtataccaggcagagatcctagacatcaagaaggcaccagttacaattatatttatttgtcagatgccttattaaaacagtactaactctgctggccatgaagttt

SEQ ID NO: 31273 - DNA, 117 bp, Homo sapiens
ggactgtgcagatgtttgggctgaggaagggagctggcctatgtttaattttttttttttttttttttgagacggagtctcgctctgttgccaggctggagtgcagtagcacaatct

SEQ ID NO: 31274 - DNA, 87 bp, Homo sapiens
cactttgggaggctgaggtaggaggatcacttgagcccaaggagttcgagaccagcctgggcaacatagtgagactctgcctctacc

SEQ ID NO: 31275 - DNA, 125 bp, Homo sapiens
acccttgggggccaggcttggtggctcaggtctgtaatcccagcactttgggaggctgaggtaggtggatcacttgagtccaggagtttgaaaccagcctgggcaacatagtgagaccccgcctc

SEQ ID NO: 31276 - DNA, 116 bp, Homo sapiens
gcctggaccacctcagccagactccctgtccctgttccccacccctacctctgcaattcttttttttttttttttttttttttttttgagacagagtctcgctttgttgcccaggc

SEQ ID NO: 31277 - DNA, 95 bp, Homo sapiens; identical to SEQ ID NO: 68

SEQ ID NO: 31278 - DNA, 93 bp, Homo sapiens; identical to SEQ ID NO: 69

SEQ ID NO: 31279 - DNA, 77 bp, Homo sapiens
agatcagatagttgtagatatgcggcgttatttctgagggctccgttctgttctatatctatatctatatctgatct

SEQ ID NO: 31280 - DNA, 74 bp, Homo sapiens
gtcacgtgcgtgtgtgtgtgtgtgtgtgtgcgcgcgcgcgcatgtgcatatgcatgtgcacgtgcacgcatgcg

SEQ ID NO: 31281 - DNA, 72 bp, Homo sapiens
tgattgtcactcacattcactctgggaggtggtttatcatcctcattctagagaggaggaaactgaaaatca

SEQ ID NO: 31282 - DNA, 117 bp, Homo sapiens
gggaaaaaagggggtcaattccctaaggacttttttttggccagagtcaagagggagagcacagttcccactaggactttaccatggagcaagggaagggcagtcctctcaaagcct

SEQ ID NO: 31283 - DNA, 163 bp, Homo sapiens
gctatatatatatagctatatatagagcaatatatatatatatattgctctatatatatagctatatatatactgctatatatattgctctatatatagagcaatatatatatatattgctctatatatagagcaatatatatatatatattgctctatatat

SEQ ID NO: 31284 - DNA, 168 bp, Homo sapiens
gctatatatatagagcaatatatatatatatattgctctatatatagagcaatatatatatatattgctctatatatagagcaatatatatagcagtatatatatagctatatatatagagcaatatatatatatatattgctctatatatagctatatatatatagc

SEQ ID NO: 31285 - DNA, 103 bp, Homo sapiens
ctgcatagtattccatggtgtgtatgtgccacattttcttttttattattattattattattattatactttaagttttagggtacatgtgcacattgtgcag

SEQ ID NO: 31286 - DNA, 58 bp, Homo sapiens; identical to SEQ ID NO: 47

SEQ ID NO: 31287 - DNA, 76 bp, Homo sapiens
gtctctctaccacactgtgtctatcctttgcctcccctccggtccaaggcctggcacatagtaggtcctcagagat

SEQ ID NO: 31288 - DNA, 87 bp, Homo sapiens
cacagttcatgggggccaccaatgtcacagacatctcaccatcaatcagggctatctgagtctgtgtctgtctcctatgagtggaac

SEQ ID NO: 31289 - DNA, 119 bp, Homo sapiens
gtcttttgtgggtgttttagtattagaaatggtgaccttagtgttttttcctgttctttttttttttttttttgagacggagtctcgctctgtcaccaggctggagtgcagtggcgtga

SEQ ID NO: 31290 - DNA, 56 bp, Homo sapiens
gagatggagtctcgctctgtcgctcaggctggagtgcagtggtgtgatctcggctc

SEQ ID NO: 31291 - DNA, 70 bp, Homo sapiens
tcagatgggggaccccagaattttattttttattttttgaggcaaagtctggctctgtcgcccaggctgg

SEQ ID NO: 31292 - DNA, 75 bp, Homo sapiens
ctaaactttcacttaggatctctgtcaattttagtcagtatattcctggtctgacagatgtgagtggagagttgg

SEQ ID NO: 31293 - DNA, 58 bp, Homo sapiens
tgagtcggagtctcactctgtcacccaggctggagtgcagtggtgggatctcagctca

SEQ ID NO: 31294 - DNA, 115 bp, Homo sapiens
tcctgatgccttttacagaccctggagccacaggagaaatcaattccagtcaaaggagttgtgaaacttttttttttaagtggagccagtattttaagattttccaagtcatgga

SEQ ID NO: 31295 - DNA, 91 bp, Homo sapiens
gcccagtgaaaggagccttgcttagggagccacgtgggtgtgtggggagcctctgttctgtgtctctctccttggccagccttcctagggt

SEQ ID NO: 31296 - DNA, 76 bp, Homo sapiens
gaaaaagggaaatgtagacgggattgtagtcagccaaccaacggtatatgcacagttatgtatacatctcctgttc

SEQ ID NO: 31297 - DNA, 113 bp, Homo sapiens
cattgtattttttagatttatccctgttgatacatgtggctctgatcttatattttcttttctttttttttgagacagagtctcgctcttgttgaccaggctggagtgcagtg

SEQ ID NO: 31298 - DNA, 70 bp, Homo sapiens
atgattatgacatacataatatatacatatatgtatatgtatatgtatatgtatgtgcttatatatttat

SEQ ID NO: 31299 - DNA, 73 bp, Homo sapiens
gagagtacaaagttagaggtggctgaggacaatttacaggaagtggtcttagctgtttttttttttttttctc

SEQ ID NO: 31300 - DNA, 95 bp, Homo sapiens
tcagtgagagcacatatttcatcttgccttgcgttactgtgagctctgtctgtctcccagtagactgagcttttcaaggttgagaatgtgtctga

SEQ ID NO: 31301 - DNA, 93 bp, Homo sapiens
gctggatgaggggtggacggggtctcactctgtcacccaaactggagtacagtggtgagatcacggctcactgcagcctcaacctccctgagc

SEQ ID NO: 31302 - DNA, 101 bp, Homo sapiens
tttggggaggtgagcagattttccatagtcttttttttttttttgaggcggagtctcgctctgtcacccaggctggagtgcaatggcgctatctctgctca

SEQ ID NO: 31303 - DNA, 119 bp, Homo sapiens
gagataaggagactgcatgagatagttttacagttgaaaaattaaatactaagttttagttatgacatttgtatgctgtagtttttgtgcatgtgggatttcagatgccagtatatctc

SEQ ID NO: 31304 - DNA, 72 bp, Homo sapiens
ggttctcactctcacagtcacttgctttagtaaccatgagaggtgctggtaagcgggctggaggatggaatc

SEQ ID NO: 31305 - DNA, 83 bp, Homo sapiens
cacagcctctctttcatagaacatcacacaagacagctgctgggatggctgacttgtgtatctgtctctcccaccagactgtg

SEQ ID NO: 31306 - DNA, 124 bp, Homo sapiens
gtgtaaagggtgaagactctgacttttttttttttttttttttttgagatggagtctcactctgtcacccaggctggagtacagtggcacgatctcagctcactgcagcctccgcctcccaggt

SEQ ID NO: 31307 - DNA, 102 bp, Homo sapiens
tgtacgttgattttgtattctgcaactttactgaatttgtttatcatttctaatagcattttggtggagtcattagttttttccaaatacaagatcataaca

SEQ ID NO: 31308 - DNA, 65 bp, Homo sapiens
tgatggcttactgaactgtctgtgcagagatgtgcccaggtcttcagatggaagtttgagcctca

SEQ ID NO: 31309 - DNA, 65 bp, Homo sapiens
atcatatatatgtacacacatgcattctctatatatagaatgcatatgtatacatgtgtgtagat

SEQ ID NO: 31310 - DNA, 97 bp, Homo sapiens; identical to SEQ ID NO: 1307

SEQ ID NO: 31311 - DNA, 88 bp, Homo sapiens; identical to SEQ ID NO: 1308

SEQ ID NO: 31312 - DNA, 81 bp, Homo sapiens; identical to SEQ ID NO: 1309

SEQ ID NO: 31313 - DNA, 77 bp, Homo sapiens; identical to SEQ ID NO: 1310

SEQ ID NO: 31314 - DNA, 105 bp, Homo sapiens
gttgtaaatatttagaagacaatatttgtaacacacatatatataaatatatatattcatatatatatgtgtgtatgctgtaaatattttctcccagtctacggc

SEQ ID NO: 31315 - DNA, 113 bp, Homo sapiens
tgtggtctttgtgactggcttcctttagcaatgccaagttttaatgcaaatatcagaatatttatatttcatggctcatctctggagggtgccttgagctatacagaagagac

SEQ ID NO: 31316 - DNA, 118 bp, Homo sapiens
tatagaatttctttgtatgttctatatgcaatgtatttgtcagagagatatatattatatatatacataatattcactatatatagatatattttatattttatatataaattttata

SEQ ID NO: 31317 - DNA, 95 bp, Homo sapiens; identical to SEQ ID NO: 68

SEQ ID NO: 31318 - DNA, 93 bp, Homo sapiens; identical to SEQ ID NO: 69

SEQ ID NO: 31319 - DNA, 69 bp, Homo sapiens
gtaggatgtatgaatacgtgtgtatgtatatttatgtatgtgtgtccacacaggcatacctgtttctgc

SEQ ID NO: 31320 - DNA, 113 bp, Homo sapiens
gaaaatcagctcttctttctctcagggtttgttgttgaaggttgtcttgttgttcttcttaatattattttctttagtaaccttcctggatgaattctgtaaagtctgtattc

SEQ ID NO: 31321 - DNA, 93 bp, Homo sapiens
atatatatgtgtgtgtgtgtatatattatacatatataaattatatatacacatatataatatatataatatatatacatataatatatatat

SEQ ID NO: 31322 - DNA, 112 bp, Homo sapiens
aacaccattaccagctgtaagagagaaaatgcccacctcctctctgagcctcagtctgttctgctgcacagtagggggataacgcgtactctgcctccatctgtatgttgtt

SEQ ID NO: 31323 - DNA, 85 bp, Homo sapiens
ggtcagcagggatggagaccgtcacccggggtcagcagggatggagactgtcaccctgagtcactgccctccactcccccatgcc

SEQ ID NO: 31324 - DNA, 81 bp, Homo sapiens
atgtatgtgtgtgtgtacatgtatatatatgtatatatacacacatatatgtgtatatatatgtatatgtgttacgtacat

SEQ ID NO: 31325 - DNA, 111 bp, Homo sapiens
gaatcacataactcaatgcaacagtatgggtattacggtagcttttttttttttttttttgagacggagtctccctctgtcacccaggctggagtgcagtggtgcgatctc

SEQ ID NO: 31326 - DNA, 107 bp, Homo sapiens
cttaccaactgtgtgacccttagcaagttactttatctctctgtgtgtcaattttcctcatccacaaatggggatcataatacctaaactcatagggttgttgtgag

SEQ ID NO: 31327 - DNA, 91 bp, Homo sapiens
tatctacacacacacgcacacacgtgtatatatacatacatgtttatgtatgtatatatgtgtgtatattttttttgtgtgtatgtatata

SEQ ID NO: 31328 - DNA, 106 bp, Homo sapiens
atatatatacacacacatattatatatatacgtatatatgtatatatacatatatacgtatatatatgtgtgtgtgtatatatatatatatatatatatatatata

SEQ ID NO: 31329 - DNA, 79 bp, Homo sapiens
ctgttttctatgttctagagcagtgtttttgatggactgtgttatcccctcatatgtgtggttctggctcaggaaatag

SEQ ID NO: 31330 - DNA, 99 bp, Homo sapiens
ggtgatagagttgatggtatctggtatcaacctgataatgaacatatttcttttttttattttatttatttatttgagacggagcctcactctgtcacc

SEQ ID NO: 31331 - DNA, 196 bp, Homo sapiens
tgtatgtatgtatatatgcatatatatatctgtatatatacatgcatgtatatatgtatatatgcatgcatatatgtatatatacagaacagatatatatatgcatgtatatgtacagatatacacgcatgtatatctgtatatatagatatatatgcatgcatatgtgtatatttacagatatatatggtgtata

SEQ ID NO: 31332 - DNA, 116 bp, Homo sapiens
cttagtttggctggattgggcacctgtagtcagcattcttaaagaaaaattctaaccccaaattttttttctttaagaatgctgactacaggtgcccagtctcttctggcttgtag

SEQ ID NO: 31333 - DNA, 96 bp, Homo sapiens
actctagtttttttgtttgtttgtttgttttttatgacggagtctggctctctggctctctgtcacccaggctggagtgcagtggtgccatctcgg

SEQ ID NO: 31334 - DNA, 95 bp, Homo sapiens; identical to SEQ ID NO: 68

SEQ ID NO: 31335 - DNA, 93 bp, Homo sapiens; identical to SEQ ID NO: 69

SEQ ID NO: 31336 - DNA, 117 bp, Homo sapiens
ctgtgttgaactcaatgttttggggtaaagaacccccaacacatttatttatttttcatgcacaaaaatgaagaaagagagctgatgattggggtaccttaaggcaggaagacttag

SEQ ID NO: 31337 - DNA, 95 bp, Homo sapiens; identical to SEQ ID NO: 68

SEQ ID NO: 31338 - DNA, 93 bp, Homo sapiens; identical to SEQ ID NO: 69

SEQ ID NO: 31339 - DNA, 95 bp, Homo sapiens; identical to SEQ ID NO: 68

SEQ ID NO: 31340 - DNA, 93 bp, Homo sapiens; identical to SEQ ID NO: 69

SEQ ID NO: 31341 - DNA, 81 bp, Homo sapiens
tctgttggaatactttcttggaaataaaagggagataaaattgtattatcttcttttctgtttttttttttttttggcaga

SEQ ID NO: 31342 - DNA, 76 bp, Homo sapiens
gtgtgtctctctctgccacccccttagcctgagccagggaggccaggcggtctgggtgtctggaggcagggtccac

SEQ ID NO: 31343 - DNA, 58 bp, Homo sapiens; identical to SEQ ID NO: 391

SEQ ID NO: 31344 - DNA, 103 bp, Homo sapiens
ggaagttccaagatggcttactagaagtagctagtgcacactgctctcacagagaacagagtggtgagtaaacaggctcttcaagtggatcatccaggaggcc

SEQ ID NO: 31345 - DNA, 112 bp, Homo sapiens
gtgaaatgtctgttcagttcctctgcccatttttaattggactgttcatttttattattaagttgtcagagttcattatatattctgggtagaagtcctttattagataagc

SEQ ID NO: 31346 - DNA, 95 bp, Homo sapiens; identical to SEQ ID NO: 68

SEQ ID NO: 31347 - DNA, 93 bp, Homo sapiens; identical to SEQ ID NO: 69

SEQ ID NO: 31348 - DNA, 69 bp, Homo sapiens
aacttacccagtctcaggcagttctttatactggtgtgaaaatggactaatgcaactggggattaagtt

SEQ ID NO: 31349 - DNA, 115 bp, Homo sapiens
gattgttttgctgtgcagaagcttttcagttaattaattcccatgtatttatctttgtttttgttgtatttgcttttgggttcttggttgtgaagtctttgccaaagccaatgtc

SEQ ID NO: 31350 - DNA, 71 bp, Homo sapiens
ctgggaccctctgtctgtgtccttggctccatggtctgaggtggcaagtcagacatgtgagttctggttcc

SEQ ID NO: 31351 - DNA, 58 bp, Homo sapiens; identical to SEQ ID NO: 1435

SEQ ID NO: 31352 - DNA, 88 bp, Homo sapiens
gtgtgtgtgtgtatatatgtatatgtgtgtgtgtgtatatatgtatatgtgtatatatatgtgtgtatatatatatacacacacacat

SEQ ID NO: 31353 - DNA, 71 bp, Homo sapiens
ggttttgaggccgagtctcactctgtcacccaggctggagtgcaatggtatgatctcggctcactgcaacc

SEQ ID NO: 31354 - DNA, 119 bp, Homo sapiens
atcaagcagtgtagaagtgttccctgatcactgcatccatgccaacatctactgttttttaattttttgattatggccattcatgcaggagtaaggtggtatcacattgtggttttgat

SEQ ID NO: 31355 - DNA, 95 bp, Homo sapiens; identical to SEQ ID NO: 68

SEQ ID NO: 31356 - DNA, 93 bp, Homo sapiens; identical to SEQ ID NO: 69

SEQ ID NO: 31357 - DNA, 113 bp, Homo sapiens
gatggcactactgcatcccagcctgggcaacagcaagaacccactttttttttttttttttttgagacagagtttggctcttggtgctcagactgaagtgcaacggtgtgatc

SEQ ID NO: 31358 - DNA, 85 bp, Homo sapiens
agcaagggggaaggtgctacaccctttttttttttttttttttttttttttttttgagatggagtctggctctgtctcccaggct

SEQ ID NO: 31359 - DNA, 121 bp, Homo sapiens
tgtatatatgtgtatatatgtgtatatatgtgtatatacatgtgcatatatatgtatatttgtgtgtatatgtgtgtatatatgtgtgtgtatatatatgtgtgtatatatgtatatgtgt

SEQ ID NO: 31360 - DNA, 82 bp, Homo sapiens
tgggttgaattttatttttttaatttagttggagtctcgctttgtcactcaggctggattgcagtggtgcgatttcggctca

SEQ ID NO: 31361 - DNA, 83 bp, Homo sapiens
gagagcctggcccacatagagctgttcctatttttatttttttaaaataaattatttgctctttgttgttgagacagggtctc

SEQ ID NO: 31362 - DNA, 95 bp, Homo sapiens; identical to SEQ ID NO: 68

SEQ ID NO: 31363 - DNA, 93 bp, Homo sapiens; identical to SEQ ID NO: 69

SEQ ID NO: 31364 - DNA, 118 bp, Homo sapiens
ccatatcacctctccattgtgacttgttcatttgtgccttcttgtctttcttttttttgtttttgtttttgtttttgaggcagggcctcactctgtcacgctggctggagtgcagtgg

SEQ ID NO: 31365 - DNA, 70 bp, Homo sapiens
tcccaaagtgctgggattacaggcatgagccaccatgcccggccagtagttctatttttaattttgagga

SEQ ID NO: 31366 - DNA, 118 bp, Homo sapiens
gctaagagttgttgagcaccttttcatatgtttgttgaccatctgaatttcttcttttgagaagtgtctaattcaggtcctttgcacatttttaaattgggttatttacatttttggt

SEQ ID NO: 31367 - DNA, 117 bp, Homo sapiens
aagatgctgaatgggaggagtataagactggcatcaagaaaggtatagaaattatttttatttaacatatgatttctaataaaatttcaagggccagagttcttgcagagttgtttt

SEQ ID NO: 31368 - DNA, 102 bp, Homo sapiens
ggtatggctgtgtgtgcctgtagtcctagctactctggaggctgaggtagtaggatcacttgagcccaggagtttgaggttacagtgagctatgattgtgcc

SEQ ID NO: 31369 - DNA, 93 bp, Homo sapiens
gagtagctgggattacaggcatgcaccaccatgtccagctaattcttgtatttttattagagacagggtttcaccatcttggccaggctagtc

SEQ ID NO: 31370 - DNA, 74 bp, Homo sapiens
gtatatatatatgtgtgtatatatatgtatatatatgtgtatatatgtatatatgtgtgtatatatgtatatat

SEQ ID NO: 31371 - DNA, 221 bp, Homo sapiens
tatatatgtatatatgtgtatatatgtatatatatgtgtatatatgtgtatatatgtgtatatatgtatatatatgtgtatatatgtgtgtatatatgtgtgtatatatgtgtatatatgtgtgtatatatgtatatatgtgtatatatgtgtgtatatatgcgtatatatgtgtgtatatatgtatatatatgtgtgtgtatatgtatatataattgtac

SEQ ID NO: 31372 - DNA, 71 bp, Homo sapiens
ctgtttggaaacgttctccgtgggtctgtcagtgtctcgggctcggcgcccgcggagcgtgtttccgacgg

SEQ ID NO: 31373 - DNA, 90 bp, Homo sapiens
gtgtgtgtgtgtacgatctatgtgttgggggtagctgtgtgtatctgtgagtgtgcatctgcatccatgtgtgtctgtgccggtgcatat

SEQ ID NO: 31374 - DNA, 58 bp, Homo sapiens; identical to SEQ ID NO: 6359

SEQ ID NO: 31375 - DNA, 85 bp, Homo sapiens
ggtgcattccctgacgctgacaccctcactgactcctgaagcaaactcagtgggtccaagaggattctagctggaacaggagccc

SEQ ID NO: 31376 - DNA, 96 bp, Homo sapiens
tgtgtgtgtgtggacacatctgtgattatgaaggtctaggtaagccttgtttcctagtataattgtatatctgtctgtgttctctgtataatcata

SEQ ID NO: 31377 - DNA, 68 bp, Homo sapiens
caagtctacagtctggtgtgttatgggggcctgtctacaggtttttgtgactgtctctgtgtgggttg

SEQ ID NO: 31378 - DNA, 102 bp, Homo sapiens
ctagtaaacaatgaaggtggattgcaagtcaatgagaagtcactgaatttttttttttttttttttttttgagactcggtctcactaagttgcccaggctgg

SEQ ID NO: 31379 - DNA, 85 bp, Homo sapiens
gcagacagccctgtctgtctgtctaactctctgcctcacaggttccctttctctgacagaaggatttggggctggaagcagggag

SEQ ID NO: 31380 - DNA, 82 bp, Homo sapiens
gaattccatctggttgtttggggaagtattttgggatttagcacaaaagagtatatattttttcatacaatgccagaaattc

SEQ ID NO: 31381 - DNA, 143 bp, Homo sapiens
caggctgcctgggccgagggagatctgtgtgagccagcaagggtgtgtgagtgtgtccgcgcatctctccctctgtcactggctcgcttgctctcctgctcacactttctgcttcaggagctgtttggcaggctctgggaggc

SEQ ID NO: 31382 - DNA, 79 bp, Homo sapiens
gggacccacaagagagtcacaaggctggctcacaaggtcactatgtgaccttcaacagacctcactctctctgtgcctc

SEQ ID NO: 31383 - DNA, 88 bp, Homo sapiens
agagaaatgaggatggcagttgtgttctcatggagtgactaggaatgtctgtgcgtgtgacagccccagtgcttgccttctgttctct

SEQ ID NO: 31384 - DNA, 121 bp, Homo sapiens
agcctggataacaaggcaagactctcttttttttttttttttgagatgaagtctcactctgtcacccaggctggagtgcagtggcacagtctcggctcactgaaagctctgcctcccgggt

SEQ ID NO: 31385 - DNA, 88 bp, Homo sapiens
gggatggtggggaaatgagaggcaggaaatgaaaatctagaaacccctgtaagaattcttgaactgttgtcattttcttgtcatgccc

SEQ ID NO: 31386 - DNA, 77 bp, Homo sapiens
actgggtgcgaaggactgcggattgttgtggaagcctgtgcccaacaggcctgtgacaccgtgtctgtgtgtgaggt

SEQ ID NO: 31387 - DNA, 92 bp, Homo sapiens
ctgcgggccctggggcttagagaggtgtgagacaaaagagaggtcaggacagctcatggcatcacctctctcatgcatatgcgggcatggag

SEQ ID NO: 31388 - DNA, 119 bp, Homo sapiens
gcaggtttgctgtgtcttatgtgactgcactgtgttttccaggcatcctgtgtgtctgtgggtcactgtgggtgtgtatcgggtttctgcagtgttggtctgtgtaactgagtgcctgc

SEQ ID NO: 31389 - DNA, 65 bp, Homo sapiens
gcctccctgcctccctgctagcctcacttgcctgaggctctgggtcagggggttggggttatggc

SEQ ID NO: 31390 - DNA, 89 bp, Homo sapiens
gctagcactgtgtgtttctgactgtggaggctgtgagcccatgaacttaatcattcatttactcctcttggtcctgatgtttggctggt

SEQ ID NO: 31391 - DNA, 95 bp, Homo sapiens
tgtatcttcacttgtttagcactgcagctactgtgcctctgacagtgcctggcactcagaaagcattcagtagatgtttgtggaaagaaagaaca

SEQ ID NO: 31392 - DNA, 75 bp, Homo sapiens
tccttggtgagcttgtaggctgtttagatggagtggtggacacagaattctggagagagtgggttcaagagaggg

SEQ ID NO: 31393 - DNA, 103 bp, Homo sapiens
agccaagattcagccaccctgggcaggccagagccctgtaggggagtcattctctctctttcacaggtatactgggtgcatgctgggtaggggctgtttggct

SEQ ID NO: 31394 - DNA, 70 bp, Homo sapiens
gccttttttgagaccaagtctcactctgtcgctcaggctggagtacaatggtgtgatcttggctcactgc

SEQ ID NO: 31395 - DNA, 75 bp, Homo sapiens
ctcagttcctggtacttactgggtgtttgacaaatagtagctatttttgaatatatgtttggggtaggaattgag

SEQ ID NO: 31396 - DNA, 117 bp, Homo sapiens
ttttgtatcacttgtgagaggctaacattagattgtccagatgaaagtgctacagttatacattggtatgtaatgaattttaatttggtctgtcattgtcctttttgtggtgcagag

SEQ ID NO: 31397 - DNA, 83 bp, Homo sapiens
tgtgtactgaatttgttattgtctggttctccaaacagaatgtaaaatctgtgagggcagggccctatctcattcattccgca

SEQ ID NO: 31398 - DNA, 80 bp, Homo sapiens
gtgtgggagggagattcatgtgggggcctgaggttgggtgggtttccaaccattccagagcctgtgtctcagtctcatgc

SEQ ID NO: 31399 - DNA, 99 bp, Homo sapiens
gctgggattacaggcgtgagccactgtgcctggccccatgtcttttttatgttttattttagagatggggttgctctgtcgctcaggcttgagtgcagt

SEQ ID NO: 31400 - DNA, 58 bp, Homo sapiens; identical to SEQ ID NO: 13985

SEQ ID NO: 31401 - DNA, 73 bp, Homo sapiens
ggctggccatggttcatgcctgtaatcctagcactttgggaggctgaggtagatggatcacttgagcccagcc

SEQ ID NO: 31402 - DNA, 254 bp, Homo sapiens
tatatacacacatgtgtacatatataaatataatgtatatatacgtgtacacatatatgaatatatatgtgtgtatatatatacgtatatatgtatatatatacgtatatacatgtatatatacgtgtgtatatatatgtgtatatacgtatgtgtatatacgtatatacacacgtatatatacatgtatatacatatatatatacagatcgcatgggtttatatatacacatatatgtatacatgtatatata

SEQ ID NO: 31403 - DNA, 85 bp, Homo sapiens
cttgggaggctgaggttggaggatcgcttgagcctgggaggtagaggctagagtgaaccactgcactccagcctgggcaactgag

SEQ ID NO: 31404 - DNA, 109 bp, Homo sapiens
agagcgaaattgtgtctcagaaaaaaaaaaaaacaaaccaaaaaaacccctgctaatcatgtctttctttttcttttttttttttttttttgagacggagtcttgctct

SEQ ID NO: 31405 - DNA, 129 bp, Homo sapiens
tctccaaatatagtcacattctgaggttctgtggatttcagacttcagtgtaagaattctgacagtacacacacagccattaacatcaggttttcgagaaacactgtttactgacatcgaaggaacttc

SEQ ID NO: 31406 - DNA, 117 bp, Homo sapiens
gcaagtcaggaccatgaaaaacctccttcctatgagcagagaacttaggagtccaccatttttttttttttttttttttttttttttggagacggagtctggctctggctctgttgc

SEQ ID NO: 31407 - DNA, 76 bp, Homo sapiens
agtgtaggagctgcctggagactgtgtgacgtcagtgctctagagagggagctcacactgggtcccacacccctcc

SEQ ID NO: 31408 - DNA, 115 bp, Homo sapiens
gttaagtgcctaccaggcctaggattctttcagtgtctgtgtgtgtgcctctcacccttccacacaccctcaggcgtcccacctgcagatcatccccttggtagcagcctcctgc

SEQ ID NO: 31409 - DNA, 85 bp, Homo sapiens
aggacgaggcgggaggattgcttgagcccaggaatttaagaccagcctgggcagcatatcgagacactctctctcgctctctcct

SEQ ID NO: 31410 - DNA, 125 bp, Homo sapiens
ggccaggcaatgatctcactgttctattacttctcctggcttcaaggcttgaatttttctttttgaaatgggtaaggagatggagtagccatgcctgccatataacagttctcttctctgagatc

SEQ ID NO: 31411 - DNA, 75 bp, Homo sapiens
ctccaaaatggggatgaatcttgacttttttttttttttttgagacgaagtctcgctctgtcacccagcctggag

SEQ ID NO: 31412 - DNA, 79 bp, Homo sapiens
ccagagaagcagagtgataagtgtgaggactggccctaccaatgaccagcccagaaacagaatgtcaccttctacatgg

SEQ ID NO: 31413 - DNA, 56 bp, Homo sapiens
tggggctgcgggaaaagtgtctcctcctcggagtgggctcttttctctctctccca

SEQ ID NO: 31414 - DNA, 75 bp, Homo sapiens
gggtctcactgtgtcactgaggctgaagtgcagtggtgcaatcataactcactgcagccttgactgcctggactc

SEQ ID NO: 31415 - DNA, 110 bp, Homo sapiens
gcctgcctcggcctcccaaagtactgggattgcagccatgagcctccacacccggcctaatttttgtatttttcatagaactggggtttcaccatattggccaggctggt

SEQ ID NO: 31416 - DNA, 89 bp, Homo sapiens
agatttgcaacctcaatcctaaggtttgagattgattctgccctccagtacagactgtagagagactggtatgcagatttgtccattcc

SEQ ID NO: 31417 - DNA, 80 bp, Homo sapiens
gactacctattgtatgattctatttttatgaaatgtccataatagacaaatctatagagacagaaaataggttggtggtt

SEQ ID NO: 31418 - DNA, 74 bp, Homo sapiens
ctggagaaagggacagtgagacagaagcagatttgagtggagtgaagtgactgtccaccggcacctgcccccag

SEQ ID NO: 31419 - DNA, 95 bp, Homo sapiens
tatgaatatgtataggtatatatgtatatgcataaacatacatatatttgtgtgtgtgtatatatattatatatacatatatatacaaaatcatg

SEQ ID NO: 31420 - DNA, 58 bp, Homo sapiens; identical to SEQ ID NO: 1725

SEQ ID NO: 31421 - DNA, 108 bp, Homo sapiens
tcagcctcctgagtagctggaaccgcaggtgcacaccaccacacctggataattttttttttttttttttggtagggatatgtgtctcgtgtttgttgcccaggctga

SEQ ID NO: 31422 - DNA, 58 bp, Homo sapiens; identical to SEQ ID NO: 1101

SEQ ID NO: 31423 - DNA, 56 bp, Homo sapiens; identical to SEQ ID NO: 1102

SEQ ID NO: 31424 - DNA, 76 bp, Homo sapiens
ttccacacgcaccaggcttcagaggagaagttgactagatagccagtgtctcattttgtttgtggtgggcatggga

SEQ ID NO: 31425 - DNA, 70 bp, Homo sapiens
cctcaatgactgtgtgacaacctctcagtctctgtgtggagaaaagtgcttgtggtttaggatcttgagg

SEQ ID NO: 31426 - DNA, 70 bp, Homo sapiens
ctttcagagcctcagtctctccatctgtcaaatgaagataataggggtgattgtgaggactaaatgacag

SEQ ID NO: 31427 - DNA, 76 bp, Homo sapiens
tggctaaaggagtagaggcgttgtctttttttttttttttttttttttttgagacagggtctcactctgtcaccca

SEQ ID NO: 31428 - DNA, 119 bp, Homo sapiens
atggctaatctcataactgcatgtcatatatgtgtataatatatgtatattcatatgtatgtctgtatgtctgtgtgttgtatatatatgtgtttatgtctgtacacattgtctgtagt

SEQ ID NO: 31429 - DNA, 78 bp, Homo sapiens
gccaccgcgcctggcctgtttgtttgtttttgagacagagtctcagtctgtcaaccaggctggatggagtgcagtggc

SEQ ID NO: 31430 - DNA, 78 bp, Homo sapiens
cagggagctttttttattttgagacagtctcgctctgtctcccaggctggagtgcagaggcgcgatctcagctcactg

SEQ ID NO: 31431 - DNA, 112 bp, Homo sapiens
gaggtgagaggatcacttgagcctgggaggtcaaggctgcagtaatttttgtatttttagtagagacagggtttcaccatgttggccaggatgatctcaatctcctgacctt

SEQ ID NO: 31432 - DNA, 57 bp, Homo sapiens
gacagtctcgctgtgtcactcaggctggagtgcagtgatgtgatatcggctcactgc

SEQ ID NO: 31433 - DNA, 116 bp, Homo sapiens
gttagttaagtgtaaaattttttcttttgtgggtacagggaagactttctcagttttatttatttattttgagagagtctcactctgttgcccaggctggagtgcagtggtgtaat

SEQ ID NO: 31434 - DNA, 58 bp, Homo sapiens
tgagacagagtctcactctgtcgcccaggctggggtgcagtggtgcgatctcggctca

SEQ ID NO: 31435 - DNA, 58 bp, Homo sapiens; identical to SEQ ID NO: 454

SEQ ID NO: 31436 - DNA, 96 bp, Homo sapiens
caaacgccaggttcttactaggctgtgctccaaagtcattgtctttttttttttttttaactgtgacaatgaagcatggttccattggcgaatttg

SEQ ID NO: 31437 - DNA, 105 bp, Homo sapiens
gcacccaagtagctgggattacaggtgcacaccaccatgcccggctaattttttgtatttagtaacacagtggtttgcaactatactcccagctacttgggaggc

SEQ ID NO: 31438 - DNA, 113 bp, Homo sapiens
agacatggtgactcacacacctgtaattccagcactttgggaggctgaggtaggaggatctcttgagcccaggaattccagactagcctggacaacacagggagaccgtgtct

SEQ ID NO: 31439 - DNA, 112 bp, Homo sapiens
ttgggactaacaggtgtacactaccatgcctggctagttaaaaaagatttttgttttgtaaagatgaggtctcattatgttgtccaggctggtcttgaactcctggcctcaa

SEQ ID NO: 31440 - DNA, 58 bp, Homo sapiens
tgagacagggtctcactgtgtcacccaggctggagtgcagtggtgtgatcatggctca

SEQ ID NO: 31441 - DNA, 60 bp, Homo sapiens
ccccacagtcactctcagacaccgggttatctggaatggaaggtagagggactccagggg

SEQ ID NO: 31442 - DNA, 69 bp, Homo sapiens
ggaagagctgactcagcacagagtggggagggcaaaggaaatcccacatctgtgtcctgcggcaaagcc

SEQ ID NO: 31443 - DNA, 107 bp, Homo sapiens
ataatattccactgtgtgtgtgtgtatattatatatataatatatatagtatatatattatacactgtatatgtgtgtgtgtatattgtatataaatacatatagtg

SEQ ID NO: 31444 - DNA, 62 bp, Homo sapiens
gggtggcctccctctgtgcctcagttgccatgaaatggtggagcccagtgatgaggccagcc

SEQ ID NO: 31445 - DNA, 83 bp, Homo sapiens
tgtgcttatcatgtgacctggtggttctacttctatttttttttctttttattatacttgaagttctagggtacatgtgcaca

SEQ ID NO: 31446 - DNA, 66 bp, Homo sapiens
ggagtggtcgactgtgtgtgtgtatatatatatatatgtacatgtgctacatttataaagacctcc

SEQ ID NO: 31447 - DNA, 118 bp, Homo sapiens
cttgatgtgaggggaagaatggccaaatgcctgaggtgatcattgtttcttaatttagaattcgtatatttattttaaaaaggacttgactgggtgtggtggctcccagcactttgag

SEQ ID NO: 31448 - DNA, 87 bp, Homo sapiens
gactatatgtgtgcgtgtgtgcatatacatatgtgtatgtatacatatacatgtatatgtgtatatatatgtatgtatgtctaatgc

SEQ ID NO: 31449 - DNA, 110 bp, Homo sapiens
cctgggcgacagagcgagactccatctcaaaaaaaaaaaaaggccaaaagatgaacttttttttttttttttttttttttttgagacggagtctcgctctgtggcccagg

SEQ ID NO: 31450 - DNA, 91 bp, Homo sapiens
gttcacagttcacgatagagttcatgctcctctgagaagctaatgctgctgctcatctgacaggagacagagctcaggtggtattgtgagc

SEQ ID NO: 31451 - DNA, 95 bp, Homo sapiens
ggatggaaaggagaggaatttgtgggaagatggagggtgtgctatatggatgtgaagttcttctgaatgtttttgaattcaattttcctccatcc

SEQ ID NO: 31452 - DNA, 75 bp, Homo sapiens
cacagatcctctctattgtgtctgggcccttgaccccgtcttctgcctcgctgactcagtggctgtccaactgtg

SEQ ID NO: 31453 - DNA, 76 bp, Homo sapiens
ttggcttacagacacatcacccagatctctgcttttattttcacatggcattctccctgtgtgtgtctgtctccaa

SEQ ID NO: 31454 - DNA, 95 bp, Homo sapiens
gcccccacatggccggtctgagagcaagtggagagtcacagtcacagtcacagtgcccaacgcctccacctggtcctgacgggtccccaggggac

SEQ ID NO: 31455 - DNA, 85 bp, Homo sapiens
gtgtatatatgtacatatatatgtgtgtatatatatgtatataaacacacatatatacacacatacacattatacatttatacac

SEQ ID NO: 31456 - DNA, 80 bp, Homo sapiens
tatgtacatatataagtacatatatatgtgtatatataagtacatatatatgtgtatatatgtacatatatatgtgtgta

SEQ ID NO: 31457 - DNA, 112 bp, Homo sapiens
gcccagggcctagcacagaataagtgctaagcaaaggtttgttgactgaaaaatgagtgaaataaatgcattgatgagaagaacctgctttagtgctctgtgcagcgagggt

SEQ ID NO: 31458 - DNA, 95 bp, Homo sapiens; identical to SEQ ID NO: 68

SEQ ID NO: 31459 - DNA, 93 bp, Homo sapiens; identical to SEQ ID NO: 69

SEQ ID NO: 31460 - DNA, 107 bp, Homo sapiens
ctgaaggatctgagaaggaaatcacatcctgtaatccagccatcagagaaatcactgagcagataaataggctgtgcccagctcctcctctccctacggcccctcag

SEQ ID NO: 31461 - DNA, 86 bp, Homo sapiens
gagagagagagagacatgtacctctaactatagtaatttggtcacattctctggctgttagaccagtgtgtgctctctgccatttc

SEQ ID NO: 31462 - DNA, 65 bp, Homo sapiens
gcaagtgaggctggttatgaaagcttttttttctttttttgttttgagacagagtctcactctgc

SEQ ID NO: 31463 - DNA, 86 bp, Homo sapiens
gagtgtgtgtgcacatgtgtgcctgtgtgtctctgtatgttccataaagtgcttggaacctggtgtacatgttcattaatgtgttc

SEQ ID NO: 31464 - DNA, 103 bp, Homo sapiens
caagtgctggaggatgtgtgatctacattctgggttctctagaagtataaaggagagagatcagtgtgagctggtgacgagggaaggcttccaggaggacttg

SEQ ID NO: 31465 - DNA, 79 bp, Homo sapiens
caatcagcttgatgtgattgaggatctactatgtacccagtactgtgactggttctctctgtgacagaggtattgattg

SEQ ID NO: 31466 - DNA, 99 bp, Homo sapiens
gtagacataggtaatcttagaagagagtcagaagcaaatatttttgagtttatattctatattgggtgctttactttcatgatattatttaatatccac

SEQ ID NO: 31467 - DNA, 89 bp, Homo sapiens
gtatttaggattgggtagaaggatgatttcttttcttatgcttgtaatatatctgtgagcacatcctacactcacggtggcttgattac

SEQ ID NO: 31468 - DNA, 88 bp, Homo sapiens
ggcagctgattgacttctctgtctctgtgcttcatccaatctacagagccagcccacagggaggccccttagaaaaatacctcatgcc

SEQ ID NO: 31469 - DNA, 95 bp, Homo sapiens; identical to SEQ ID NO: 68

SEQ ID NO: 31470 - DNA, 93 bp, Homo sapiens; identical to SEQ ID NO: 69

SEQ ID NO: 31471 - DNA, 109 bp, Homo sapiens
tttctaacagctacatccttgcattgtatgtccgtgtgtgtcagtgtgtgtttatcctcagcacctagaccagtgcctaaggcaatgtagggtacttaactgttaaaaa

SEQ ID NO: 31472 - DNA, 95 bp, Homo sapiens; identical to SEQ ID NO: 68

SEQ ID NO: 31473 - DNA, 93 bp, Homo sapiens; identical to SEQ ID NO: 69

SEQ ID NO: 31474 - DNA, 92 bp, Homo sapiens
tcagtctctctccctgagggtctctggccacctgatcaaatgagtagacactggaacaggagtctgggaaactcaccacacggagaaactga

SEQ ID NO: 31475 - DNA, 105 bp, Homo sapiens
gtttgcacagtggtcctactctgtagtcttgtgagtttcttgaggacagaaatcatttcttgtatctctgaatttctaagaccagcatgtaggcactcagtaaat

SEQ ID NO: 31476 - DNA, 168 bp, Homo sapiens
gcaaatatggttttatatatatatatatatatatatatatatatatatatatgtgtgtgtgtgtaactctcttgcatccaacttttattaccatatatatatggtgtgtatatatatatatatggtgtataaatatatggtgtatatatatggtgtatatatatggtg

SEQ ID NO: 31477 - DNA, 117 bp, Homo sapiens
gtggctgcatcactcccatttctgcctctgtctttgcctggccatcttccttgtgtgtgtgcctgtgtctctcatggcctttttagaaggatactagtcattggatttagggcccac

SEQ ID NO: 31478 - DNA, 94 bp, Homo sapiens
ccagcactgtccagtgaaggaaaggtatcttccctttttatttatttatttatttattttttgagagggagtctcgctgtgtcacccaggctgg

SEQ ID NO: 31479 - DNA, 84 bp, Homo sapiens
tatatatatatatttatatacacacatatatacatatatatgtgtatatatgtatatatgtgtgtatatatatatgtgtatata

SEQ ID NO: 31480 - DNA, 78 bp, Homo sapiens
tttggagaatgttcaaagtgaggtttgaagcaggagagtaatctaattttttgttttagaaagagcattctagccagg

SEQ ID NO: 31481 - DNA, 117 bp, Homo sapiens
tttctattgcagaaaagttaggcgttaagggcaaaaacagtatctatttccaacactagtcatattgatggctcttcatatggtggaggtctaagtttcaagttgtggtatgtgaag

SEQ ID NO: 31482 - DNA, 95 bp, Homo sapiens; identical to SEQ ID NO: 68

SEQ ID NO: 31483 - DNA, 93 bp, Homo sapiens; identical to SEQ ID NO: 69

SEQ ID NO: 31484 - DNA, 85 bp, Homo sapiens
agttatgaaacactatatatataattgtgtgtatatatataaaattatatatatatatgcaatttttatcatttaaagcataatt

SEQ ID NO: 31485 - DNA, 96 bp, Homo sapiens
tggggagggggcagacttttatcaactagagtacagtacttatatatagtttcttttacctttttttttttgagatggagtctctctctgtctcca

SEQ ID NO: 31486 - DNA, 126 bp, Homo sapiens
cagcctctcttgccccagggaacatgcataagtcacagtcttgccccataagactaaactgaactctgtgagcactgccctcctttatgtttttgttagtcctgctctaaatgtggctgtgatggc

SEQ ID NO: 31487 - DNA, 113 bp, Homo sapiens
cccagcattttgggaggcaaagaagggcagattacctgaggtcagaagtttgagaccagactggccaacgtggtgaaaccccatctttactaaaaatacaaaaattagctggg

SEQ ID NO: 31488 - DNA, 87 bp, Homo sapiens
gtaattacttgcctctcaggcatgatgaatagcagtagaatgtatttatttatttattttctgtatttaggaggtacaagtaagtgc

SEQ ID NO: 31489 - DNA, 95 bp, Homo sapiens; identical to SEQ ID NO: 68

SEQ ID NO: 31490 - DNA, 93 bp, Homo sapiens; identical to SEQ ID NO: 69

SEQ ID NO: 31491 - DNA, 180 bp, Homo sapiens
tatatacacacacatacgtgtgtatatgtatgtgtatatatacacacacatatgtttctgtatatgtatgtgtatatatatattatatataatctcccctgtatgtgtatatgtatgtatatgtgtgtatatatatatacacatatacaggagagattatatgtaatatatatatacaca

SEQ ID NO: 31492 - DNA, 127 bp, Homo sapiens
atatatatctcctgtgtgtatatatatattacatataatctctcctgtatatgtgtatatatatatacacacatatacatacatatacacatacaggggagattatatataatatatatatacacat

SEQ ID NO: 31493 - DNA, 68 bp, Homo sapiens
gcgggtgcaaaggcagaaagaaggcaaaaggaccgttctatctatctgtctgtctgtcatctacctgt

SEQ ID NO: 31494 - DNA, 110 bp, Homo sapiens
tctacataatcttaatgataataacatgggataggatgtttgtggctcctgatggaaatcatcacagattttgatgatcccatgcatattgttttacaagggcctggaga

SEQ ID NO: 31495 - DNA, 99 bp, Homo sapiens
cagtctcgggtatgtctttatcagtagtgtgaaagcagactaatatacctaacaataactcttcttgtattcatgcctttgtataaacccatcctactg

SEQ ID NO: 31496 - DNA, 167 bp, Homo sapiens
gtatatatagacatgtgtgtatatacagatatatgtgtgtgtatatagatatgtgtgtatatatatgtgtgtgtatttacaaatgtatgtgtgtctatatagatgtatgtgtatataaatctaggtatagatatatctatctgtatctagatatgtatctatataca

SEQ ID NO: 31497 - DNA, 74 bp, Homo sapiens
ttgggtcctcttgtgggttgactgaggcagctctctcagtttctcagtcccttactagagtgtaatgaatccaa

SEQ ID NO: 31498 - DNA, 78 bp, Homo sapiens
gaagagaagagttgcagccctttggggagctcagacctaggagctccctgagtgagggctgtgacacacactctcttt

SEQ ID NO: 31499 - DNA, 97 bp, Homo sapiens
caatgtaccacaggtacgtaagttaagaccgtaagttttgcatacaattttttttgtttcaatcctggttttgccacttactaactgtaggactttg

SEQ ID NO: 31500 - DNA, 116 bp, Homo sapiens
cgagctgttttatctgtgttttactgtgtgctctttctggctgcttgtagttagaagagaagtgattttcttgagacgcatgaggctagaaagggaactggaattgaaagtggccg

SEQ ID NO: 31501 - DNA, 62 bp, Homo sapiens
gtgtgtgtgtgtatgtgtgtgtgtagatagataaatcttcacacactcattctctcacatac

SEQ ID NO: 31502 - DNA, 109 bp, Homo sapiens
gcatttatcctttgtgttacaaataattcaattatatttattttaaaatgtacaattaagttgtacatttattattgtatcagtgaattgtttcatatatttataatgc

SEQ ID NO: 31503 - DNA, 101 bp, Homo sapiens
gtgtttgttctgttaaactgtttattttatttttaaattaatatagaataaaatttagcttatattggtttacagttttatgaattttagcatgcaaatat

SEQ ID NO: 31504 - DNA, 116 bp, Homo sapiens
aaacttatctctttctgaatggtgggatttaaatatgcttttattcttttattttgttgtttgattgcagcatataagagcatacaattatttacagcaagacaagaaatttgttt

SEQ ID NO: 31505 - DNA, 116 bp, Homo sapiens
ggagtttgctctaggcatagctatgctcaggacctcaagtaatttcattagagcttagtctgtttctctctgtgtaacttctgtcctatccttgggttgtgttctaagcaggtttc

SEQ ID NO: 31506 - DNA, 113 bp, Homo sapiens
gcctgggaaatgttgttttctggaatacaaagtgaaccgcgagggagtgggaaatggatttgagagaacacaggcaggtgactggcacagcacccctttcatggccagcccat

SEQ ID NO: 31507 - DNA, 132 bp, Homo sapiens
ttagactgtcccttaccagaagttgtaaaatggactttctcatatttcaatggctctctctctgcctgtgaagtaggcatgggaatccaacaacgaggtatagagaatctgacgttcacttgctagattctg

SEQ ID NO: 31508 - DNA, 85 bp, Homo sapiens
catgtacgcttacgtttggaagacaggtatgtgtatacatatatgcatatgtgtatatatatgtatggatatgtatgtgtgcatg

SEQ ID NO: 31509 - DNA, 94 bp, Homo sapiens
tgatatacatacatatatatgtatatatatgtgtgtttgtatgtgtatatatatatatatatatatatatatatatatatggtaatgtcagtca

SEQ ID NO: 31510 - DNA, 99 bp, Homo sapiens
ggttgtgttgggagtgaagccacctggctgacaaattcagaatacacaagaatgtgtgcatacatgagtgagccctggtgggtgtcatgaaggacagcc

SEQ ID NO: 31511 - DNA, 90 bp, Homo sapiens
gtgtgtgtgtgtgtgtgtatttatatatttgctatatttctccagaaattgtttaggcttatacagatgagtatgtatatgtatagacac

SEQ ID NO: 31512 - DNA, 58 bp, Homo sapiens
tgagacggagtctcgctctgtctcccaggctggagtgcagtggtgggatctcggctca

SEQ ID NO: 31513 - DNA, 58 bp, Homo sapiens; identical to SEQ ID NO: 9538

SEQ ID NO: 31514 - DNA, 95 bp, Homo sapiens; identical to SEQ ID NO: 68

SEQ ID NO: 31515 - DNA, 93 bp, Homo sapiens; identical to SEQ ID NO: 69

SEQ ID NO: 31516 - DNA, 110 bp, Homo sapiens
tttagctttcagtattcagtgttttcagcaacatttccttcctgttgtatttatttatttatctggagggaggggtaagtgttaagcttcttgcatactgacaacctaaa

SEQ ID NO: 31517 - DNA, 104 bp, Homo sapiens
caaatggtccgttttggctagagtgcagtaaaagtgagaacagagtgtggagttagcctgtagccaagtgttgaagggctttgaatgctaaagtgagaagtttg

SEQ ID NO: 31518 - DNA, 56 bp, Homo sapiens
gtgacatgaaagactcagtttttttttttttttgagactgagtctcactctgtcgc

SEQ ID NO: 31519 - DNA, 110 bp, Homo sapiens
gcagaatctctacaagccagaagacgttggaggcctatattcaccattcttttctatttttttttttttttctgagatggagtctcactctgtcgcccaggctggaatgc

SEQ ID NO: 31520 - DNA, 69 bp, Homo sapiens
attgccccttggttatgtgtgtgtgtgcatgtgcatgtgtgcacatgtgtgtatataaacagggacaat

SEQ ID NO: 31521 - DNA, 95 bp, Homo sapiens; identical to SEQ ID NO: 68

SEQ ID NO: 31522 - DNA, 93 bp, Homo sapiens; identical to SEQ ID NO: 69

SEQ ID NO: 31523 - DNA, 95 bp, Homo sapiens
ccatttttcctccagttaaactccctacctgagctgcaattcagaattatgtcagcacagcataggcacattggctgtctcaggttctgaaatgg

SEQ ID NO: 31524 - DNA, 106 bp, Homo sapiens
ggtaaagagtgagcttctttctgatactgagtgtgctgagggttctttacacagaatattgagtgaagtcattcagttcaactagtatttattatatctatactgt

SEQ ID NO: 31525 - DNA, 115 bp, Homo sapiens
ccagagggggctgaggcggcaggggcctggcatgtcagcaccaccctgagtgtgcacacacccagctgggtggtgacagcacccgggctcagccacaacattgctccaaagtcgg

SEQ ID NO: 31526 - DNA, 106 bp, Homo sapiens
atatatacatatgtatatatgtatatacatgaaaaacatatatgcatatatacatatatgtgtatacatattaatacatatatgtatatatgtatatcacagtttc

SEQ ID NO: 31527 - DNA, 86 bp, Homo sapiens
ctgtggaaggaacatagagttggatcaggctgaatttattgatttgggctcactcagtatgactgactctgcatttagtgttgcag

SEQ ID NO: 31528 - DNA, 108 bp, Homo sapiens
tcatttatttttaaatattcatatgtcctggctgcctactatctacagtgatgacactgtctcactcacagggaagttaggtggagatagatataaatacataagtga

SEQ ID NO: 31529 - DNA, 105 bp, Homo sapiens
tagaataaatatttttcaaggaaaaagagaaaccagttagggggttgccacagctggcctctctcaagctcgctctctctcttttcccctctttttttatctcta

SEQ ID NO: 31530 - DNA, 105 bp, Homo sapiens
gtcctagttaaacaagttagtgggctgcttttgaccagagggtaagttctgtttttctttaatacaggcatttataagaagtggctcaagctaagtttcacttac

SEQ ID NO: 31531 - DNA, 104 bp, Homo sapiens
tgaggggaattaaattagacctatgttagattacttgaaattttctcatagtattgagaatttgttcatcatttagcattttattctatcagtgatttagttta

SEQ ID NO: 31532 - DNA, 58 bp, Homo sapiens; identical to SEQ ID NO: 2051

SEQ ID NO: 31533 - DNA, 82 bp, Homo sapiens
agggaggatattggaaactgaagagtgtgtgctcatctacggtgagtggaaactcaaacccagtgttgcaaggtcttcacct

SEQ ID NO: 31534 - DNA, 89 bp, Homo sapiens
tgagagatctccacggagtgtgattggtggtggtaggtttagtaaaaagtcagcagccagacagtctctcactccaaagtctcctctca

SEQ ID NO: 31535 - DNA, 90 bp, Homo sapiens
gtagtccttctacctaacagtgcttcttcttgacagtaattttttttcttttctgggcaagagggtggcagggtgggtagtgttaattgc

SEQ ID NO: 31536 - DNA, 82 bp, Homo sapiens
gggcagagagttgagtgtgagctgcagaatttctatgtgacaacatagaatagtggtgaagttactcaacttttgtgggctt

SEQ ID NO: 31537 - DNA, 115 bp, Homo sapiens
tccagatgtccagtgaatgtttggttcaatttgtcaatcttgtctagagaatttgttcaggaaatttctgagtcaaggagttttgtaaggtactaggagacacttggtgactgga

SEQ ID NO: 31538 - DNA, 108 bp, Homo sapiens
ggggtttttttcttattatgtcagctattctttatgaattgcttttttggatagcaaaataaaaatttataattttagttttggggtaaatataaaaggaaaggctct

SEQ ID NO: 31539 - DNA, 95 bp, Homo sapiens; identical to SEQ ID NO: 68

SEQ ID NO: 31540 - DNA, 93 bp, Homo sapiens; identical to SEQ ID NO: 69

SEQ ID NO: 31541 - DNA, 114 bp, Homo sapiens
agcactttgggaggctgaggcgggcagatcacaaggtcacaagttagagaccactctggtcaatatggtgaaaccttgtctccgctaaaaatacaataattagccagatgtgct

SEQ ID NO: 31542 - DNA, 110 bp, Homo sapiens
agagttctttaataaactgatcctctcccacttgtacaagcatatgatttgaaaaaaatacacttctgttggtttgttttggagagatgtcactttgttcacaaagcttt

SEQ ID NO: 31543 - DNA, 105 bp, Homo sapiens
gccatcctaataagtgtgaggtgatgatcgattattgttttgctttgtatttctctcatgattagtgattttgaacatctcttcatatactcattgtggatttgt

SEQ ID NO: 31544 - DNA, 104 bp, Homo sapiens
ggagtgacaagcaatttttgttaaggtctgtatgtgtgcatgtgcatatgcttgtgtatctctgtgtgtatgcatgcgtatgttcaaagaaaatgagtttttcc

SEQ ID NO: 31545 - DNA, 119 bp, Homo sapiens
tcatgtggctgtgattgtgtattaaaaggtacttttgtcagagaagtgttattcttgatcttatctctggcatctccacaatgtcaaccttttatgctctctttctcatctttatggcc

SEQ ID NO: 31546 - DNA, 95 bp, Homo sapiens; identical to SEQ ID NO: 68

SEQ ID NO: 31547 - DNA, 93 bp, Homo sapiens; identical to SEQ ID NO: 69

SEQ ID NO: 31548 - DNA, 95 bp, Homo sapiens
agcagcccaaatcaaagtacacagtagagtgtgtgcattatgtcaagttggttggtggcccattttattgtgttattggtttcccgaatactgtt

SEQ ID NO: 31549 - DNA, 132 bp, Homo sapiens
catagacttgacacttgtgcctctcccagtgccctggctgctaattttacaggcatttatttgttaatttttctttcaagtggcaagtctctgagtctgtgcttaccaggcctgagaccacagccacttgga

SEQ ID NO: 31550 - DNA, 106 bp, Homo sapiens
ggggcaagagaggtcccctcacaagaatggtagtgagcggcacagaataaacttggagggaggatttttttttcttttgtttttttttgtgacagagtctcactct

SEQ ID NO: 31551 - DNA, 114 bp, Homo sapiens
atgtctctttagcttcttgttgactatgacagttagactttccttgtttttgtatttatttatttatttgagaaagagtctctatctgtcacccaggctgaagtgcagtggcat

SEQ ID NO: 31552 - DNA, 90 bp, Homo sapiens
ctggctttccttcctctagatttgttcatgtttactattatatatttatataacgcacgtcttactcttctagaggcatggggatcaagg

SEQ ID NO: 31553 - DNA, 70 bp, Homo sapiens
acatgtgtgtataaatatacattgtgtgtatatatatcacacacatatatgtatgcatgtatgtttatat

SEQ ID NO: 31554 - DNA, 97 bp, Homo sapiens
gccatatatattcatccccagagtagtgtttttgctgaaggatgtccaactttgccactgagatattagtttagtagaggattggtaggatggtggc

SEQ ID NO: 31555 - DNA, 151 bp, Homo sapiens
atacatatatacatatatatacatatgtgtgtgtatatatatacatatatatgtatacatatacatatatatgtgtatatatatatacatatatgtgtgtgtgtgtgtgtgtgtgtgtgtatatatatatatatatatatatatatatata

SEQ ID NO: 31556 - DNA, 221 bp, Homo sapiens
tatatatatatatatatatatatatatatatacacacacacacacacacacacacacatatatgtatatatatatacacatatatatgtatatgtatacatatatatgtatatatatacacacacatatgtatatatatgtatatatgtatatatgtatatgtgcatatatatgtatatgtgcatatatatgtatatatgtatatatatgtgtgtgtgtgt

SEQ ID NO: 31557 - DNA, 100 bp, Homo sapiens
tgagggatgagatggaggcagagatcatcagattactattttgaatgtaaaaatgtataacaactagcagctgaatcactgcacatttgcatcaacctca

SEQ ID NO: 31558 - DNA, 114 bp, Homo sapiens
aggactagagttgtcattggtaaagaagcaattggaagaaggggatatttcattatttttacatttgcagagtgtctgtttctttctcttgttccaccatgatctcaaattctg

SEQ ID NO: 31559 - DNA, 148 bp, Homo sapiens
atacacacatatatacacatatatgtgtatatatgtgtatatgtatatgtatatatacttatatgtgtatatatacatatatacatatatgtatatatgtgtgtatatgtgtgtatatatgtgtgtgtatatatatacatatatacat

SEQ ID NO: 31560 - DNA, 94 bp, Homo sapiens
gccactgggtgaggattctccctccctgatcagccttttaagattggaattttattttattttaagaagtgccagggtccttacacttttgagt

SEQ ID NO: 31561 - DNA, 91 bp, Homo sapiens
tgagacagagtctcactctgtctctctgttgcccaggctggagtgcagtggtgggatcttggctcactgtaagctccgcctcccaggttca

SEQ ID NO: 31562 - DNA, 63 bp, Homo sapiens
ttctgtgtctgtcactgtgtttgctgcagttcattcagtcgtgagcaggacaggcaagaagga

SEQ ID NO: 31563 - DNA, 125 bp, Homo sapiens
cagatgtgcagagaaacccagagagatcatgagaaagagagttgaggctgagagaacagtgacacctgggagctgtcattctggaggttcaggtcctgatgctgcagaggtgtggccctcagctc

SEQ ID NO: 31564 - DNA, 103 bp, Homo sapiens
atatatatttatatatatgtatatatattatatgtatatatacatatatacacatatgtattatatatgtatatatgtctgtatatatgtatatatgtgtata

SEQ ID NO: 31565 - DNA, 88 bp, Homo sapiens
gtcacatcttagctctatttgttgttttggtctactcttgtgggaatccaatgtatacatttttatttcatgaatagtgctgtgtgtc

SEQ ID NO: 31566 - DNA, 82 bp, Homo sapiens
gtgcatagagagcaaaatggcttctgtagtgtgatttactatgtagactcaccacaggtcagtcactgagtgcctctggcat

SEQ ID NO: 31567 - DNA, 95 bp, Homo sapiens; identical to SEQ ID NO: 68

SEQ ID NO: 31568 - DNA, 93 bp, Homo sapiens; identical to SEQ ID NO: 69

SEQ ID NO: 31569 - DNA, 115 bp, Homo sapiens
gcctccagctttgttctttttgcttaggattgtcttggctatatggggtcttctttgatttcatatgaaatgtaaagtagttttttctaactgtatgaagaatgtcaatggtagt

SEQ ID NO: 31570 - DNA, 95 bp, Homo sapiens; identical to SEQ ID NO: 68

SEQ ID NO: 31571 - DNA, 93 bp, Homo sapiens; identical to SEQ ID NO: 69

SEQ ID NO: 31572 - DNA, 58 bp, Homo sapiens; identical to SEQ ID NO: 16419

SEQ ID NO: 31573 - DNA, 102 bp, Homo sapiens
ctcttttgtttggatttcatgcaagtaagtatctgtgattctctctgtaaccacagcagcaccaaacgggatttatgaatgctttgtttcctgacttcagag

SEQ ID NO: 31574 - DNA, 109 bp, Homo sapiens
tgcaaaatggatttcagttgtgccttaaggaggttttatgtttcattattattaaaaatgtcaggaatattttgcctgctgggagcacagatttcccttctatttttca

SEQ ID NO: 31575 - DNA, 95 bp, Homo sapiens; identical to SEQ ID NO: 68

SEQ ID NO: 31576 - DNA, 93 bp, Homo sapiens; identical to SEQ ID NO: 69

SEQ ID NO: 31577 - DNA, 112 bp, Homo sapiens
tataaattatttttacatgtctcttagtgtgcagataaattttttttctttttttttttcttattttgagatggggtctcatctgttgcacaggctggagagtagtggtgtg

SEQ ID NO: 31578 - DNA, 79 bp, Homo sapiens
tgagacggagtctcactctgtcacccaggctggagtgcagtggtgtgatctcggctcactgcaacctctgctgcccagg

SEQ ID NO: 31579 - DNA, 58 bp, Homo sapiens; identical to SEQ ID NO: 87

SEQ ID NO: 31580 - DNA, 56 bp, Homo sapiens; identical to SEQ ID NO: 88

SEQ ID NO: 31581 - DNA, 94 bp, Homo sapiens
cactatatgatgagctatatttgtatatatgtatctatgtatgcatgggcatgtgcatatatttatgtgagtatatagatgtaaatatatggtg

SEQ ID NO: 31582 - DNA, 111 bp, Homo sapiens
ttgtttacaaactggtaagccaaaatattaaagctacacttggttgctctgttctgactgtgttaagaacacgggtctaggtgcactgattggtttctggtttagcaagca

SEQ ID NO: 31583 - DNA, 58 bp, Homo sapiens; identical to SEQ ID NO: 18119

SEQ ID NO: 31584 - DNA, 105 bp, Homo sapiens
tcttaactcttatatgtgtgtgtatatgtatatattaactcatgtatgtatatgagtgtgtgagtgtatatatatatatatatatatatatataattttttaaga

SEQ ID NO: 31585 - DNA, 72 bp, Homo sapiens
ccaggtgtggtggcacacgcctgtagtcccagctgctagggaggctgaggtaggaggatcacttgaacctgg

SEQ ID NO: 31586 - DNA, 87 bp, Homo sapiens
tgtgtgtgtgtgtgtgtctcaagtgttatatatatgtatatatctgtgggcgtatacacacacacacacacacacacacacacacac

SEQ ID NO: 31587 - DNA, 58 bp, Homo sapiens; identical to SEQ ID NO: 605

SEQ ID NO: 31588 - DNA, 77 bp, Homo sapiens
ccactccttggctgacagatcagcctgtgctctggggaaaggggcgaaggctcctctggagcagcctaaagggctgg

SEQ ID NO: 31589 - DNA, 82 bp, Homo sapiens
ggacacaggatctctctctgtctcccaggctggagtgccgtggcatgatcagggatcactgtagccttgacttcctgggttc

SEQ ID NO: 31590 - DNA, 75 bp, Homo sapiens
atacatacatatatgtgtatatgtgactatatggcatatatgtaagattatatatgtatatacctatgtatgtat

SEQ ID NO: 31591 - DNA, 79 bp, Homo sapiens
cattcaaggggcggaagatgtgtgtggcctggggaaagctcctgagccactctccctcagtttctttctctgtgaaatg

SEQ ID NO: 31592 - DNA, 83 bp, Homo sapiens
ctgggatcaatcggtttcctctaagttcagagacctgcctcgctcagactctgagacttgagcgttccataagaagtccccag

SEQ ID NO: 31593 - DNA, 71 bp, Homo sapiens
tacataatacatgtgtatttatataaaatatatattcttgtatttattatgtatgtatacatgtatatgta

SEQ ID NO: 31594 - DNA, 65 bp, Homo sapiens
taaatgtgtgtgtgtctgtgagtgggaggaagcagggcccagctgtaggatacaacacacagttg

SEQ ID NO: 31595 - DNA, 99 bp, Homo sapiens
ctgggacagtactagaaaagcactgtgcttatacaaggaacacaaattttttctttttttttttttttctttttgagacagtctcgctctgttacccag

SEQ ID NO: 31596 - DNA, 58 bp, Homo sapiens
tgagacggagtctcacactgtgtcccaggctggagtgcagtggtgcgaccttggctca

SEQ ID NO: 31597 - DNA, 76 bp, Homo sapiens
ctcctcgagatctgatggaagccctgctgctgaagacagagagctgtgtggagtcagcaatccttactcagaggag

SEQ ID NO: 31598 - DNA, 77 bp, Homo sapiens
cacactctcacactctttctggggaagcagtcagggatgttttgaggtgttttggtggagagtagagagagaatgtg

SEQ ID NO: 31599 - DNA, 95 bp, Homo sapiens; identical to SEQ ID NO: 68

SEQ ID NO: 31600 - DNA, 93 bp, Homo sapiens; identical to SEQ ID NO: 69

SEQ ID NO: 31601 - DNA, 86 bp, Homo sapiens
ttgttttgaggtggagtctgtctctgtcacccaggctggagtgcagtggcgggatctcagctcactgcaaccttcgcctcctaggt

SEQ ID NO: 31602 - DNA, 96 bp, Homo sapiens
ctgaacaggcccaaaggaaggacaaagacatgtcataatgttcttgtttttaaacacacattttctgtttttagagtccttcaagccttaattcag

SEQ ID NO: 31603 - DNA, 113 bp, Homo sapiens
tatatatgtgtgtgtgtgtgtgtgtatatatatatgtgtgtgtgtgtgtgtatatatatgtgtgtgtatatatatatagtatgtgtacatatgtatctatatatgtgtatgta

SEQ ID NO: 31604 - DNA, 58 bp, Homo sapiens; identical to SEQ ID NO: 2051

SEQ ID NO: 31605 - DNA, 92 bp, Homo sapiens
gggaagaaattaggatctttgtgcaatgccaaaaactgacccagagagagtcagaggatagagtgcagagattagaaaataatttttcaacc

SEQ ID NO: 31606 - DNA, 81 bp, Homo sapiens
ttatatatatacatgtatgtatgtgtatatatatgtatgtatgtgtacatataatatatatacatacacgtgtgtgtgtaa

SEQ ID NO: 31607 - DNA, 98 bp, Homo sapiens
agctttgttactgatggaacgtttaaaaaatttttataatgtacattttttatttttaaaaaatccataaaatcagatgttcccagagtcttaaagct

SEQ ID NO: 31608 - DNA, 74 bp, Homo sapiens
cacatgggtccctggggctctctctctctcacctgaccaggttgcagggaagacagggaaggggagtgtatgtg

SEQ ID NO: 31609 - DNA, 95 bp, Homo sapiens
ctctgtctctaaataaataaataagtaaatattaggttggtgcagaagttattgcacttctttcattactttttttttttttttttgagacagag

SEQ ID NO: 31610 - DNA, 114 bp, Homo sapiens
tatataatttatataatacatatatataatatataatttatataatatatacatatatattatatacgtatatattgtatacatatatattatatacgtatataatacatgtat

SEQ ID NO: 31611 - DNA, 105 bp, Homo sapiens
tctgcaaaatgagactaaggaaactgtctctgtctgtctcactgccagggctgctgggaggggcagtgactgagcaggcaggaccctctggagccattctgcaga

SEQ ID NO: 31612 - DNA, 116 bp, Homo sapiens
tgtacatagtagatgctcaacaaatgcttgtgcaattcatgtattttttttaattttattatactttaggttttagggtacatgtgcacaatgtgcaggttagttacatatgtaca

SEQ ID NO: 31613 - DNA, 67 bp, Homo sapiens
gttgctagagggctgagaattgaatttaagtttttacttaaagttttgatttttaacttgcagcaac

SEQ ID NO: 31614 - DNA, 115 bp, Homo sapiens
agcacttttgagcttccatctcccaaattctctagcacacagacacacacacacacacacacacaccactcctgcacattctctgtgtcactctgagataagggagataagtgtt

SEQ ID NO: 31615 - DNA, 95 bp, Homo sapiens; identical to SEQ ID NO: 68

SEQ ID NO: 31616 - DNA, 93 bp, Homo sapiens; identical to SEQ ID NO: 69

SEQ ID NO: 31617 - DNA, 123 bp, Homo sapiens
ggtccagccactgtgcacagtcaggcacaccagctgctggcagcagggcaggcagctccagtcactggctctctgtgaggctgcagctggacagggtgcactgcacgtagcttccatggctgg

SEQ ID NO: 31618 - DNA, 95 bp, Homo sapiens; identical to SEQ ID NO: 68

SEQ ID NO: 31619 - DNA, 93 bp, Homo sapiens; identical to SEQ ID NO: 69

SEQ ID NO: 31620 - DNA, 111 bp, Homo sapiens
agtatcatcattgcaattagcacgagtgctttgagagaaaaatgactggagagaaaggaggcaccctccatgacttgggttaatcagagaagacttcttggaatggggact

SEQ ID NO: 31621 - DNA, 95 bp, Homo sapiens; identical to SEQ ID NO: 68

SEQ ID NO: 31622 - DNA, 93 bp, Homo sapiens; identical to SEQ ID NO: 69

SEQ ID NO: 31623 - DNA, 116 bp, Homo sapiens
tggaccagacttgggatatgcaaaggagatgttgcatctgctgccttggctaagggtgtggaagaatagtgaagaagcagaggaattcagatatctctgcttcaagagtggattca

SEQ ID NO: 31624 - DNA, 87 bp, Homo sapiens
tgactatcaactctgcaactacaagctctgtgttcttttttttttttttttgagacagagtctcactgttgctcagggtgaagtgca

SEQ ID NO: 31625 - DNA, 75 bp, Homo sapiens
ctctctctctctctgtctcgatgggggcactgcctctgcagctagttcccagcccaaagagtcagggaggaggag

SEQ ID NO: 31626 - DNA, 124 bp, Homo sapiens
ttggagttttaaagggtgagtggaagagagggctatgtgtctgtgtaactgggctcaggtagcaggtttttttctttagccgctgcaaaacttccagttaaaacagtgagagattgttctattc

SEQ ID NO: 31627 - DNA, 77 bp, Homo sapiens
gcaggaaccgcagtgttcagaaatgtgcatgggatggatatctcccatctgatccactctctcactctgctctatgc

SEQ ID NO: 31628 - DNA, 95 bp, Homo sapiens; identical to SEQ ID NO: 68

SEQ ID NO: 31629 - DNA, 93 bp, Homo sapiens; identical to SEQ ID NO: 69

SEQ ID NO: 31630 - DNA, 95 bp, Homo sapiens; identical to SEQ ID NO: 68

SEQ ID NO: 31631 - DNA, 93 bp, Homo sapiens; identical to SEQ ID NO: 69

SEQ ID NO: 31632 - DNA, 95 bp, Homo sapiens; identical to SEQ ID NO: 68

SEQ ID NO: 31633 - DNA, 93 bp, Homo sapiens; identical to SEQ ID NO: 69

SEQ ID NO: 31634 - DNA, 58 bp, Homo sapiens
tgagacagagtctcactctgtcccccaggctggagtgcagtggtgtgatcttggctca

SEQ ID NO: 31635 - DNA, 97 bp, Homo sapiens
gctgtatcccctttgaaacctgcaggagaatctgacagtgcctcttcttagcttctggtagtttgtctggagcccttggcatttcttggcttatggc

SEQ ID NO: 31636 - DNA, 107 bp, Homo sapiens
tgtggggaacactgggagataaacattgaagacgtgtcactgtgtcactgagatatgtgaccatatgaccacactgtcccccaaatctcgctatccccaggtccaca

SEQ ID NO: 31637 - DNA, 63 bp, Homo sapiens
gcattatggtatgatatcatcatatatatatatatatgtgtgagtgtgatgtcatatatatgt

SEQ ID NO: 31638 - DNA, 104 bp, Homo sapiens
tggataaaaactgatacagatatatatatatatatatatatatatacctagatacttagaaatatataaatgtatgtatctgtgtgtgtgtgcgtgtgtgtgta

SEQ ID NO: 31639 - DNA, 118 bp, Homo sapiens
ttatttttttttctctgtccagaatatcatacggtgcacagcatattttttctttatatctgagttttggttgctgtgaaacagctatgaaatatcacagtgggctccaaaatgaaat

SEQ ID NO: 31640 - DNA, 58 bp, Homo sapiens; identical to SEQ ID NO: 14682

SEQ ID NO: 31641 - DNA, 93 bp, Homo sapiens
tccaatcatgttagccctttaaagcagaaaactttctgtgttggaggcagaagagattcagcagaaagggtagatgcagagatttgaacgtga

SEQ ID NO: 31642 - DNA, 70 bp, Homo sapiens
ggggaaatgttggacttaggtacacttcatagtttttatatatgctttatgtaagtttttcatagtcccc

SEQ ID NO: 31643 - DNA, 78 bp, Homo sapiens
tgtcacaaaaagagactgagcattcaggtctggagctgagggcaccagagaagcagttcaggagctattttgttgggg

SEQ ID NO: 31644 - DNA, 75 bp, Homo sapiens
cctgaagacagagaactttaatttttaactttttttttttttttttttgagatggagtcattctctgtctccagg

SEQ ID NO: 31645 - DNA, 117 bp, Homo sapiens
gcatctcatcacagcatttatcatttctcatagtctccattttctcaatcaatagattatttattttttattttttgaaatggagtctttctctgttgcccaggctggagtgcagtg

SEQ ID NO: 31646 - DNA, 108 bp, Homo sapiens
gcttagagcttcctggtagctaaggcaaaaaaggaaacatgattggttatataattctcattttcattttatttttttcttttgtctcataaaaggaagtgaatctgc

SEQ ID NO: 31647 - DNA, 89 bp, Homo sapiens
gtctctgtcctgaagccaatgccacacccctcccattcctctccttaggctgagctgggtgtgtggacagtgtggacaaggacaggagc

SEQ ID NO: 31648 - DNA, 148 bp, Homo sapiens
gtattccactgtgtgtgtgtatatatatatcatatatcatatatatgtgatatatatataacatgatatatatacatgatatatataacatgatatatatacatgtatatataatgacatatatacatacatgtatatatacatatat

SEQ ID NO: 31649 - DNA, 107 bp, Homo sapiens
tgctgggattacaggcgtgagccactgctcctggccatattttttatttttagagacaaagtctcgctatgttgcctaagctggtctcaaactcctagactcaagca

SEQ ID NO: 31650 - DNA, 91 bp, Homo sapiens
agctttactcctctttgcctcagaaaactctggtggtgattaattttatgtgtcagggttttttgttttttttttttgggggggggtggct

SEQ ID NO: 31651 - DNA, 78 bp, Homo sapiens
aggcctggcttgctcctgcctcagtgactctgtccatataatggaaactgtcaagctgtgctaaggcttgcttctcct

SEQ ID NO: 31652 - DNA, 96 bp, Homo sapiens
cctccacctttgcaccaggtagatggctgaggggcagaggggctttctctcactgtatctctctgcagctatcttcctgtgtgcccagtcccaggt

SEQ ID NO: 31653 - DNA, 66 bp, Homo sapiens
tacatatacatatatatacatatatacacatacacatgtatatgtgtgtatgtgtatatatgtata

SEQ ID NO: 31654 - DNA, 68 bp, Homo sapiens
gaggtgacaaaagacacagagctgcgcagtcaagttcccagcagcggctgctgctccaatgtgacctc

SEQ ID NO: 31655 - DNA, 84 bp, Homo sapiens
gggctctactgtctgcccactgcctgtcccgtcgtcagttctcatgctgaagtcccatgctgtttgcaagacttcctgaagccc

SEQ ID NO: 31656 - DNA, 111 bp, Homo sapiens
gcacccctcccattgtggatcctggaagtgttccccattatacctcctgcaagccaatctgtctcagtctgtttgttgtccagggaacctgtccactgaccacatgtctgc

SEQ ID NO: 31657 - DNA, 62 bp, Homo sapiens
cctggtgctatatttgggtgatgctgtcaaatggtcactgtgtcactctctggtaagccagg

SEQ ID NO: 31658 - DNA, 71 bp, Homo sapiens
gggggtctcactctgtcacccagactggagtgcaatggcactatctcagttcactgcagcctcaacctccc

SEQ ID NO: 31659 - DNA, 101 bp, Homo sapiens
gggctccatttcaccacaaaagcatctcctgccccccagcagaatctgtctggcactcacatttctgggggactggcactgttactgataatggttggccc

SEQ ID NO: 31660 - DNA, 76 bp, Homo sapiens
cagcctgggcaattcaggtgagttttgttgttgttgttgtttaataagacacggtctcactctgtcacccaggctg

SEQ ID NO: 31661 - DNA, 119 bp, Homo sapiens
aatggcagagttgagtagttgtgacaaaagctctaggccctgaaaagtgcaaaatatttattttactatgtggccctttacagcaaaggtgtgttgacccctcagataaatgggacatt

SEQ ID NO: 31662 - DNA, 76 bp, Homo sapiens
gagagtgtcagagatgtgtgacaactgagagaaggccctgctgggtccattcatcctcatcatcttcttcatcatc

SEQ ID NO: 31663 - DNA, 77 bp, Homo sapiens
gaagcttctggctgaggagactcagggcctatctttgctcctgtgcaatttgttgagtctctctgtgcctcagtttc

SEQ ID NO: 31664 - DNA, 102 bp, Homo sapiens
ggcaaaggcatgagggaaggaaagtcccaaagctgaatgtgtacatgctacagtctggtactcaaggctgacatggacttcctgcatccttagggtctgacc

SEQ ID NO: 31665 - DNA, 82 bp, Homo sapiens
attctgatccatttcctcatctatgaaatgaagattgtagtttttatttcatagagtcatgaagattgagttaatctctgaa

SEQ ID NO: 31666 - DNA, 96 bp, Homo sapiens
tctggaaaatcagaaactgtgaaggcgaatctcacctgaccgcaggcttctgtctgtggctctgtgtctccttccttaaatctgctgctttctgga

SEQ ID NO: 31667 - DNA, 58 bp, Homo sapiens
tgagatggagtctctctctgtcgctcaggctggagtgcagtggcgtgatctcggctca

SEQ ID NO: 31668 - DNA, 108 bp, Homo sapiens
gccttgattctgggttaattacattcttagatggcactggatgattacaggaaaaagatgagggtagcaactccagagcttagtgacttagaatgctacccacagggc

SEQ ID NO: 31669 - DNA, 87 bp, Homo sapiens
ggggcttcttggagctccgtatcaataaaagagaaaggcctcatgccggctgaggtagtctttctgtgtctgtctctaagaagctct

SEQ ID NO: 31670 - DNA, 91 bp, Homo sapiens
gggcctgcgtatatgttttgggctgggaagatttctttttatttaaatgtgaagacttatctagacaaaataagtaaataaacaggaaacc

SEQ ID NO: 31671 - DNA, 77 bp, Homo sapiens
tatgtatatagagaaccctataggcagacctgcagttgaattctcttgtgactgtctggttctctctcagtatcata

SEQ ID NO: 31672 - DNA, 63 bp, Homo sapiens
aggcagtggcctcagggggcatgatgtttggcctgggagctcagtccctgtgagtcactgttt

SEQ ID NO: 31673 - DNA, 95 bp, Homo sapiens
catgtcttttggtaaattatatacatatttcagttgtatatatatacatatatatgcatgggaatagagagtatgtggcaaggtcataggatatg

SEQ ID NO: 31674 - DNA, 58 bp, Homo sapiens; identical to SEQ ID NO: 47

SEQ ID NO: 31675 - DNA, 68 bp, Homo sapiens
cagagagctgagagtcagcagcgagctcttcacacagcaggagagtggtgttcccctctgctctgctg

SEQ ID NO: 31676 - DNA, 68 bp, Homo sapiens
tacttgtctctctgtggctcagtgtccttatctgtaaaataaggagactagaccatatgaaacttgta

SEQ ID NO: 31677 - DNA, 108 bp, Homo sapiens
ttgtaagtgaagtctgatgggagagcggagcacacatgtgaacagatgagatgcgtgcagtttgtgtgtttgctattcctgctgcccgtgcacacagagtgtttgcaa

SEQ ID NO: 31678 - DNA, 106 bp, Homo sapiens
cttagaaccaatgtgtgtgtgtatatatatatgtatatatacaatatatacacatatatatatatatatatatatatttttttttttttttttttttttttttgag

SEQ ID NO: 31679 - DNA, 115 bp, Homo sapiens
ctggtaaagattgcactgtaatacaattctgatagttgccaaagccctactgagtcactctaactctggatctgttgggcagttgagctgtaaaagaagtggatagcaagtccag

SEQ ID NO: 31680 - DNA, 75 bp, Homo sapiens
ttcccaggtgttatgagggctgtgtgaggtcatgtgtatgagggactcacacagtgcctgccacactgtaaggaa

SEQ ID NO: 31681 - DNA, 76 bp, Homo sapiens
gaccagtgcatatgggtctcactcactctttccaataactgtgtaatagtccacatgtatgcgccacaatctggtc

SEQ ID NO: 31682 - DNA, 116 bp, Homo sapiens
acagatatatatacgtgtgtgtgtgtatacatgtatatatacgtatgtgtatatatacgtttgtgtatgtataaacgtatgtgtgtgtatacatgtatgtgtgtgtgtgtgtgtgt

SEQ ID NO: 31683 - DNA, 71 bp, Homo sapiens
tgaggtggaggaaagactgctgcccgaagaattctttatttttttgagatggagtctctctctgtcaccca

SEQ ID NO: 31684 - DNA, 86 bp, Homo sapiens
ggagctattctgtgttttattattattatttttaggtgaaatgggagctgttgccgtgagaagagtgtatgtgtagagtgtggccc

SEQ ID NO: 31685 - DNA, 79 bp, Homo sapiens
actcaggatggtaaaatactgatataatgatgttatgataaaacatcattataaaaattcatttttatacatctaaagt

SEQ ID NO: 31686 - DNA, 98 bp, Homo sapiens
ggttagagtatggtcctggagtgcaagacttctgaattttagaagaacagttctagactgtaaagaggtccaaagtatgtaatgggaatgctttgccc

SEQ ID NO: 31687 - DNA, 71 bp, Homo sapiens
ttgtttttgagacagagtctcactctgtcacccaggctggggtgcaatggcgtgatctctgctcactgcaa

SEQ ID NO: 31688 - DNA, 95 bp, Homo sapiens; identical to SEQ ID NO: 68

SEQ ID NO: 31689 - DNA, 93 bp, Homo sapiens; identical to SEQ ID NO: 69

SEQ ID NO: 31690 - DNA, 103 bp, Homo sapiens
cacctccctggttagctgtattctaaggtattttattctttttgtagcaattgtgaatgggattgcctttctgatttggctttcagcttggctattgttggtg

SEQ ID NO: 31691 - DNA, 108 bp, Homo sapiens
ctgcctggggtatgggtgagtgaattcaggaaaaagagaaaaaatgggagggaggtctccctcattctctctgagcttaagagttcccttttccacatcatgggccag

SEQ ID NO: 31692 - DNA, 86 bp, Homo sapiens
atgtgtgtatatatatatacatttatatatatgtagttttatatatacaaaactacttgtacatatgtagatatatatatctgcat

SEQ ID NO: 31693 - DNA, 81 bp, Homo sapiens
tgagtcattttatccagttgaaatgttttggggtaataacccctaatttgatatttgccctgagacatcatagtgagctca

SEQ ID NO: 31694 - DNA, 64 bp, Homo sapiens
ttgacatggagtctctctctgtcaccaggctggagtgcagtggcgtgatcttggctccctgcaa

SEQ ID NO: 31695 - DNA, 81 bp, Homo sapiens
tggtgcctggcacatagcgctcagtacattgtagtaacgggctatgctgttttgagaagattgtgtggagagaggatatca

SEQ ID NO: 31696 - DNA, 110 bp, Homo sapiens
gagaaaactgcattttttaggagaattcatggggaaagaaaaaaaaagttgtcacaggagcatgttttttttttttttataattcataatttgcgaagtttgtagagctc

SEQ ID NO: 31697 - DNA, 112 bp, Homo sapiens
ctgtgacagcagagacagcattcaggagccctgcctcggggctgagatggctgtgtgtcttcagacaagtgattgagctctccaggcctcagttttctcttctgtgaaatgg

SEQ ID NO: 31698 - DNA, 83 bp, Homo sapiens
gtgggagttgtctggaggccacctgagatgttgggatgcctgggcctctctccctctctgtgtggtctcagtgcctctctctc

SEQ ID NO: 31699 - DNA, 69 bp, Homo sapiens
gggtagcagtggtggttcttctgggcatttaagggaactggtccctgtgtgcctctttctctgcctcac

SEQ ID NO: 31700 - DNA, 82 bp, Homo sapiens
gtctctctgagccagtgcatcaggatctgagcttcctaaaaacagttcccttctgctaagcactgccctgccacagagagac

SEQ ID NO: 31701 - DNA, 73 bp, Homo sapiens
ctgggcttggtggtgcgtgcctgtagtcccagctaacttgggaggctgaggtaggaggatcatttgaacctag

SEQ ID NO: 31702 - DNA, 115 bp, Homo sapiens
tggatctgagaacaggtgggagagcttcttatatgcaactgtgttttgagagaaaatacattttatatgtatattatacacaaaagtaggtggatcccatctaaggagagagcta

SEQ ID NO: 31703 - DNA, 81 bp, Homo sapiens
ctcctcccacgctctgtttctctctgaagatgacctggggacagcataatacaaagtggatggaatgggctgagaaaggag

SEQ ID NO: 31704 - DNA, 203 bp, Homo sapiens
tatatatgtgtatatatgtatatatacacatactatatatgtgtatatatgtatatatacacatactatatatgtgtatatatgtatatatacacatactatatatgtgtatatatgtatatatacacatactatatatgtatatatgtatatatatgtgtgtatatatgtatatatacacatacatatatgtatatatgtat

SEQ ID NO: 31705 - DNA, 99 bp, Homo sapiens
cacatgagattcagagttttgctttattaggcgtctgtgaagacaagagagtttgcagacacagtcccgtctggtggtgaactgctgcaaagttctgtg

SEQ ID NO: 31706 - DNA, 60 bp, Homo sapiens
tgggactggtcagatgtcacagagcagaagcacttctgcctactacaggccaaggcccca

SEQ ID NO: 31707 - DNA, 97 bp, Homo sapiens
atggacgctcaaaaatatcttggaaagcatctcgccatagctggtctgacacagacagactgaggctgtgggataagggccttccaagggcctctgt

SEQ ID NO: 31708 - DNA, 93 bp, Homo sapiens
gtgctgggattacaggtgtgagccacttagcccggctcaattatttttttttaaagcagcctgctgacatcaccctgactttggccttagcac

SEQ ID NO: 31709 - DNA, 69 bp, Homo sapiens
gggaatgggaattggatgtgaagcccttgaggctctgcatagtctcagcctcagtctctctcagctccc

SEQ ID NO: 31710 - DNA, 118 bp, Homo sapiens
atttatgcttccttctgtttgggaaagataaattaagtcttgtgcgctatagaggattttttttctttaagaaaaacgaatgttgatgcattttatagcccgagtgaggaacagagat

SEQ ID NO: 31711 - DNA, 60 bp, Homo sapiens
ttgagtcagagtctcactctgtcgcccatgctggagtgcaatggtgtgatctcggctcag

SEQ ID NO: 31712 - DNA, 70 bp, Homo sapiens
gggtagacagtcacggcttctgcactggataactgacgccttgcagagaagtgactgagctcacagaccc

SEQ ID NO: 31713 - DNA, 70 bp, Homo sapiens
gaggttacccagcagggcaggggtgcggccaggtctcctgcgtccgagaccctctctctcactggccctc

SEQ ID NO: 31714 - DNA, 84 bp, Homo sapiens
tgctggggtgtatgtctgtatgtatatgtgtgtatttatgagtatgtatgtatatgtatatatgtatctgtgtatgtctatgta

SEQ ID NO: 31715 - DNA, 82 bp, Homo sapiens
tccaacatctgtctctctgtctccgtgtgccgctgtcatgccacccagcccccagcacatgcctcagatgacagtgcctgga

SEQ ID NO: 31716 - DNA, 77 bp, Homo sapiens
ggccttcttccctctgtgtctgtgtccttgcctctttaaaaggatacctatagtcactgtgttacaggaaaggggtc

SEQ ID NO: 31717 - DNA, 58 bp, Homo sapiens
tgagacagtctctcactctgtctcccagcttggagtgcagtggtgtgatcttggctca

SEQ ID NO: 31718 - DNA, 102 bp, Homo sapiens
gagtgtggactctgcttctgctgtacttttttttttttttgtgggggggatggtttcactcccgttgccaggctgttgagtgcagtggcgcgatcctgactc

SEQ ID NO: 31719 - DNA, 107 bp, Homo sapiens
tagctaatctaacctgtggaaaacttgggtctaaggatacagctaagcctcttactcagcttttattttttttaaaaggtccatttgttcacgtgtagaaacagcta

SEQ ID NO: 31720 - DNA, 79 bp, Homo sapiens
ttcatgagtgaactgtgtgtgcgtgtgaatatgcacacctgtgcctatacatacacacacacacacagaggttcatgag

SEQ ID NO: 31721 - DNA, 92 bp, Homo sapiens
atagacagaagactgggaggaaaccaattgttcaccatggttgtttctgaagggtgagaatacaagtgattttcttttattttggctgctgt

SEQ ID NO: 31722 - DNA, 101 bp, Homo sapiens
gagaatcaacattcaatatatgtgatatatattgaatatatatattcccatcaatattatcaatattctatgtatatcatatatattgaatatatattctc

SEQ ID NO: 31723 - DNA, 95 bp, Homo sapiens; identical to SEQ ID NO: 68

SEQ ID NO: 31724 - DNA, 93 bp, Homo sapiens; identical to SEQ ID NO: 69

SEQ ID NO: 31725 - DNA, 94 bp, Homo sapiens
gaaaaatatatacagtgagattcagttagaagtgaaggtgggtaaaaatagctctctttctctctctctctgtcttcctgcagttatttttttc

SEQ ID NO: 31726 - DNA, 115 bp, Homo sapiens
ttacttctcttcagtccctgcctcttaacctcccagtgattttatcttatggtcctttacaaatcagtgaatctcagaaatcacgtccagggccagttattttatggaaaagtga

SEQ ID NO: 31727 - DNA, 112 bp, Homo sapiens
ccctccagctttgctcttaacagaaaacacatcctaatgcaatgtcgtaatgcaatgtttacaacattatagaaagtgacaagggggcttttgttgtttgcctgttcagggg

SEQ ID NO: 31728 - DNA, 143 bp, Homo sapiens
tgtgtatatatatggagatatatatgtgtatatatatggagatatatatatgtatatatggagatatatatgtatatatatgagatatgtatgtatatatggagttatatatgtacatatatgtgtatatatatggagatata

SEQ ID NO: 31729 - DNA, 89 bp, Homo sapiens
tcactgatttatttcttatctctttacttattatttattttaactttgaggtaaattaacaagtgatattgtagaagagatactagtga

SEQ ID NO: 31730 - DNA, 110 bp, Homo sapiens
cctacaaaaacacaaagcaggaagccaaatccaagccatcagatttcagggctggtagtctcactggctgagtggttcttctttgaatttcctaaagctgttaatatagg

SEQ ID NO: 31731 - DNA, 118 bp, Homo sapiens
atgtcttctttcgagaagtgtctattcatgtcatttgcctacttttaatgaggttttttttttcttgttgatttaagttccttaaagagtctggatatgagacctttgttggatgcat

SEQ ID NO: 31732 - DNA, 116 bp, Homo sapiens
atatatgtatatatttatcttgatattgatatagaaatatatatgtatatatttatattgatacataaatatatacgtgtatatatttatattgatacataaatatatacgtgtat

SEQ ID NO: 31733 - DNA, 62 bp, Homo sapiens
atataaacatatatgcatgtatgtttatattgatatataaacatatgcatgtatgtttatat

SEQ ID NO: 31734 - DNA, 93 bp, Homo sapiens
tgcacccatgggtcacatgcaatggttattttgagggaagtcttcagtgtttctgcctctctggctgcctcagacactgtggcttgtgtggca

SEQ ID NO: 31735 - DNA, 116 bp, Homo sapiens
tgtacttccctccacttaggcccgagagctgtgtgtacctctgacttcatggtgtttgcttgcctgtgacccagaagatagcatcatgtcatggacctgaaaccccagaaagtaca

SEQ ID NO: 31736 - DNA, 66 bp, Homo sapiens
aggccaggtggctgggtctgcacaactgggggccagactcagactcagactcagactctcaagtct

SEQ ID NO: 31737 - DNA, 101 bp, Homo sapiens
tcagcctctcagtatctgggactataggcacacaccactacaaatggctaattttttttatttttagtggagtcgaggtctcactatgttgcccaggctga

SEQ ID NO: 31738 - DNA, 96 bp, Homo sapiens
gggaaagaaggcggtgagtcgctgtcagcctgggtctctgaatgacagcccggaacagagccctcgttgatagcaagcaacattctcctttgtctc

SEQ ID NO: 31739 - DNA, 76 bp, Homo sapiens
gggaaggaaagtgggagctcattattagaagatattttattttattttttagagatggggtctggctttgttgccc

SEQ ID NO: 31740 - DNA, 84 bp, Homo sapiens
tgtggagggattcttttggctggctgcctgcatggctaatttccgtgccgacaccaaatcatcatccagaaagtgccctctgca

SEQ ID NO: 31741 - DNA, 76 bp, Homo sapiens
ggaaccagacaggccaaagagttgtactggacaggaccagagtactgacagatgacactgactgtcactatgttcc

SEQ ID NO: 31742 - DNA, 85 bp, Homo sapiens
ccggactggtctagtggggagcacagtggggatgaatgaatgccaccttcttccactctctgtctccctcagatcaagcttaagg

SEQ ID NO: 31743 - DNA, 89 bp, Homo sapiens
cctatatgacaggcacagtctgtatgctgtctcatgtaattctttttttttttgtttttgtgagacagagtctccctctgtcacctagg

SEQ ID NO: 31744 - DNA, 113 bp, Homo sapiens
agatctaaaatactcctagcattttagaaatttcccttgtgcttgtatttcattttatttttttgagatggagtcttgctctgtcaccaggctagagtgcagtggcgtgatct

SEQ ID NO: 31745 - DNA, 114 bp, Homo sapiens
ggccactgcccattgaggtgacctctttctaagtcccataagcctgtctgcctgcctctctaagagttcagccaagagcagctgctatcaggagcaccctctatcaccatggtc

SEQ ID NO: 31746 - DNA, 105 bp, Homo sapiens
tgcttactagcggtttaacctcgtactaggtgctcagtctctctgggactgaatcttctcatcttaacagcagggacactcacctcacgaggttgctggggtgca

SEQ ID NO: 31747 - DNA, 99 bp, Homo sapiens
taggtgacatttccacttttttcctgtctgtaaatatattacatagtcatttaaaaaattcacacaatgcagaataggataaagaagtaaaaacaccta

SEQ ID NO: 31748 - DNA, 110 bp, Homo sapiens
gggccactgatcacatcaatgaggcactcaacaggtctgtggggcctgaagtcttagagaacacaggctccacacagcccaattctagccctctctgtccttcacagccc

SEQ ID NO: 31749 - DNA, 116 bp, Homo sapiens
tcgaattgctacaaatacatacctgagactaggtcatttataagaaaagagttttttgttttttttttttagaaggagtctcaccgtgtctctcaggctggagtgtagtggtgtga

SEQ ID NO: 31750 - DNA, 72 bp, Homo sapiens
tctccttgactcccactctctatcattacctccccggaggtgaccctggagtgttagtgtcacgaaggcaga

SEQ ID NO: 31751 - DNA, 58 bp, Homo sapiens; identical to SEQ ID NO: 29624

SEQ ID NO: 31752 - DNA, 70 bp, Homo sapiens
ttgttttgagtcagagtctcactctgtcgcccaggctggagtgcaatggtgcgatcttggctcactgcaa

SEQ ID NO: 31753 - DNA, 65 bp, Homo sapiens
gctctgagtaaagaggatgtgtaatagagtatgttactatatttttcatatcccgatgccatagc

SEQ ID NO: 31754 - DNA, 79 bp, Homo sapiens
cagagctctctgagtctcagtgcctgctccatgactctgtgataatgagccagcggtgttagtacaaagtgagcatctg

SEQ ID NO: 31755 - DNA, 104 bp, Homo sapiens
agtgtgtgtgtttgtgtgtgtcttgggctgggggtgtgtcactggcttggcctacagcccgtccctctgtctctcagcccaggaggctggtgggcaggctcact

SEQ ID NO: 31756 - DNA, 73 bp, Homo sapiens
tcctcaccatctggatgaggcagctcagcatggtacatgactcagccacagtctcacagccactaagtgggga

SEQ ID NO: 31757 - DNA, 87 bp, Homo sapiens
agattgagtgtttttccatctccaggggagaacaaaatatctaaacaagattctacaagtgcctggtacagggtagacactcatgct

SEQ ID NO: 31758 - DNA, 91 bp, Homo sapiens
ccccctgcagggccttttggaaggtggcagatgggcatgaatgtcacactggctgtctctttgcctgtgctgtgcgtggggccgtctagcc

SEQ ID NO: 31759 - DNA, 87 bp, Homo sapiens
cccccagcagccctgcagagactgtgactctgtgtgtgatcagcagtgcatgaagaggcgagaggctctgcgggcaggctctggggg

SEQ ID NO: 31760 - DNA, 69 bp, Homo sapiens
gtcttgcttcagggctgcctctgagtcttggcgtgcatctgtgctcacacactcacagcctggctagat

SEQ ID NO: 31761 - DNA, 118 bp, Homo sapiens
tggggtagggcacagcccgtgcttctgagtgctcctgggcgaagccactggtcctcagacaacactttgagcagagaggccttagaaagccccaaacctggctgggcaccatttctca

SEQ ID NO: 31762 - DNA, 98 bp, Homo sapiens
tcccgtctggctgtacccgtctgcctctctgcctggctcagcactgtgactgtttatggtgttcccagcttagacgtgagagggaggagggccaggga

SEQ ID NO: 31763 - DNA, 117 bp, Homo sapiens
gtgggagacctttgttcagttcattcattttttaaatcaatgctatatatttttttaatgctcggaaacagtgttttgatgtgagtttattacttgaagaactgcaggactttgtac

SEQ ID NO: 31764 - DNA, 58 bp, Homo sapiens
tgagacagggtctcactctgtcacccaggctggagtgcagggatgcaatcttggctca

SEQ ID NO: 31765 - DNA, 117 bp, Homo sapiens
atatgtatgtatgtgtgtgcgtatatatgtgtacatatgtgtgtacatatatatgtgtatatatatgtgtgcgtacatatatgtgtatatatatgtgtgcgtacatatatatatgta

SEQ ID NO: 31766 - DNA, 76 bp, Homo sapiens
gcagataataagttgagaaatctgtcttcttagtctgaaagagacagaagaagaaatctttattttatttatttgt

SEQ ID NO: 31767 - DNA, 71 bp, Homo sapiens
cgctgcgcggtaggcggaggcctgtgagagcgcggcatcgtcagtcagtccgtccgtctgtccgtccgtcg

SEQ ID NO: 31768 - DNA, 110 bp, Homo sapiens
actgtctttagtgtttcttgcatggcaggtctacttgtgcaaattcttttttttttttttttttttttttgagacagggtctcgctgtgtcatccaggctagagtgcagt

SEQ ID NO: 31769 - DNA, 110 bp, Homo sapiens
tgagtattctgcatttttcaaattttctacaaaaacgattttaaaatcagactagacttattttaaaattttttaattagacaccattttgggacaggtgtggtggctca

SEQ ID NO: 31770 - DNA, 114 bp, Homo sapiens
ctgtacaatttgcaaagctctttcatttgtttctcagtagcaggaaatgtgtctttttattttagtatcttgagagtgaagcacaatgaatggcataatccaagtgttcaacag

SEQ ID NO: 31771 - DNA, 112 bp, Homo sapiens
cagggaccgatcttcaggcctggatggatgtacaggttcaggtgacggtacttgggctctctgtctctctgagtattggcctcctgaagaaaggctttctccacctagaagg

SEQ ID NO: 31772 - DNA, 115 bp, Homo sapiens
tctgccatgattgtgaggcctccccagccacgtggaaatgcgagtccattaaacctctttttctttataaattacctggtcttgggtatgtctgtattagcagcatgaaaacaga

SEQ ID NO: 31773 - DNA, 84 bp, Homo sapiens
cgatgcaattaaggtttgagtggatttatctatgctggagggcaacgttcacctatatgaagtaactaggcagtagctgcattg

SEQ ID NO: 31774 - DNA, 108 bp, Homo sapiens
atcaaatcaattgtagtgtttatttgttaatggtagcttgtaatgagattttatatatttcagtttaaaaatgtcttttcacacagataagcactatcaaatgctgat

SEQ ID NO: 31775 - DNA, 63 bp, Homo sapiens
tgagacagtctcactctgtcgccctgtcgccagactggagtgcagtggtgcaatctcggctca

SEQ ID NO: 31776 - DNA, 110 bp, Homo sapiens
catactagatatatatgtgtgtttgtatatgtgtgtgcacgaatggatgcctgagtcatatatatatgtgtatatatatgcatagatgtatatatgtatatctacatatg

SEQ ID NO: 31777 - DNA, 60 bp, Homo sapiens
acttggggacatagagagtgttctgtggtcataccacacacacatcctgtcactcacagt

SEQ ID NO: 31778 - DNA, 79 bp, Homo sapiens
gcgggaaagcagggtatgattacaatagtcaacaatgtgagctctgagggttgctgtggatcattgctgtgcttggagc

SEQ ID NO: 31779 - DNA, 58 bp, Homo sapiens; identical to SEQ ID NO: 14763

SEQ ID NO: 31780 - DNA, 58 bp, Homo sapiens; identical to SEQ ID NO: 27519

SEQ ID NO: 31781 - DNA, 58 bp, Homo sapiens; identical to SEQ ID NO: 884

SEQ ID NO: 31782 - DNA, 56 bp, Homo sapiens; identical to SEQ ID NO: 885

SEQ ID NO: 31783 - DNA, 66 bp, Homo sapiens
tagtgtgtgtagtgtgtgtacacacatatatatgtgtagtgtgtgtacatatatatatatgtactg

SEQ ID NO: 31784 - DNA, 98 bp, Homo sapiens
ccaagaacagatcatacttaagttatctttcttgtgttttgaaaagaagtttgctgaagttaataaacaatgggtatctggagtcctgattttcttgg

SEQ ID NO: 31785 - DNA, 100 bp, Homo sapiens
tgattcaagtgcactatatttattgtgtactttatttctattattattacattgtaatatataatgaagtaattatacaactcactataatgcagaatca

SEQ ID NO: 31786 - DNA, 80 bp, Homo sapiens
ttccattgtgtgactgtgtgactgtgtggtttaaagttttaatctctctgggcctcagttctcatatgtatcaaatggag

SEQ ID NO: 31787 - DNA, 95 bp, Homo sapiens; identical to SEQ ID NO: 580

SEQ ID NO: 31788 - DNA, 93 bp, Homo sapiens; identical to SEQ ID NO: 69

SEQ ID NO: 31789 - DNA, 95 bp, Homo sapiens; identical to SEQ ID NO: 580

SEQ ID NO: 31790 - DNA, 93 bp, Homo sapiens; identical to SEQ ID NO: 69

SEQ ID NO: 31791 - DNA, 58 bp, Homo sapiens; identical to SEQ ID NO: 22686

SEQ ID NO: 31792 - DNA, 58 bp, Homo sapiens
tgagacggagactctcactctgtcacccaggctggagtgcagtggtgatctcggctca

SEQ ID NO: 31793 - DNA, 79 bp, Homo sapiens
gtcactcagtcactcagagccgctgtttcccagctataaaaatgggaaaataccagtgctctccctttgggctgatgat

SEQ ID NO: 31794 - DNA, 58 bp, Homo sapiens; identical to SEQ ID NO: 454

SEQ ID NO: 31795 - DNA, 63 bp, Homo sapiens
tgtcagtctcattttctcattttttaaaaattaaaagaaaaagaaatgagggagggactgaga

SEQ ID NO: 31796 - DNA, 76 bp, Homo sapiens
gttcacagtccttggaggaacaccagcagaagctatatgcttgcttgataagatgtttgaagatagggatttgaac

SEQ ID NO: 31797 - DNA, 68 bp, Homo sapiens
gaatatatatgtgtgtgtatctgtgtgtatgattatatatacatacatataggcacacatatataatc

SEQ ID NO: 31798 - DNA, 62 bp, Homo sapiens
tatatatgtgtgcctatatgtatgtatatataatcatacacacagatacacacacatatata

SEQ ID NO: 31799 - DNA, 86 bp, Homo sapiens
tcttttgccttctcagaatgtcttgtttttgtttccagaatctctgtgagttgagagtcaagaatgagattttacctggggcatga

SEQ ID NO: 31800 - DNA, 58 bp, Homo sapiens
tgagatggagtctcgcactgtcgctcaggctggagtgcagtggtatgatctcggctca

SEQ ID NO: 31801 - DNA, 108 bp, Homo sapiens
cttttgtagatctgaccatgtctttattttgcattcattttatttttaattttagaataattttagtcttacaggaaatgtgcaaagagttatggggttttagagagg

SEQ ID NO: 31802 - DNA, 84 bp, Homo sapiens
ggctagtagaacatagaatacctgagagcagagagtctgcagtgcctgggactttgtggcttgagtacatgtggttctgtggct

SEQ ID NO: 31803 - DNA, 105 bp, Homo sapiens
ggacacgctgtcagctgaggacaggagaggggtcgaataggactgagagatgacagtcgagactcgctccccctgacttagaccttctcacgctgacttcatgcc

SEQ ID NO: 31804 - DNA, 79 bp, Homo sapiens
ggctcacactccacagctgaagaggagtttgttgtgtggtcccagacacatccctcctcccacatctgacaataaggcc

SEQ ID NO: 31805 - DNA, 74 bp, Homo sapiens
gcaataacatgggactgtgcggtcagattgtcagggtccctgtcccagtttgagcactcactcactgtgtgagc

SEQ ID NO: 31806 - DNA, 58 bp, Homo sapiens
tgagatggagtctcgctctgtcactcaggctggagtgcagtggtgcgatctctgctca

SEQ ID NO: 31807 - DNA, 91 bp, Homo sapiens
ttgttctgtttcctcttctgagaagagacagatgaggcgatgaggcaatgggagcctcattgctttggcttggagggagaaaatagagcag

SEQ ID NO: 31808 - DNA, 56 bp, Homo sapiens
cccaggctggagtacagtggcatgatctcagctcactgcagtctctgtctcccggg

SEQ ID NO: 31809 - DNA, 58 bp, Homo sapiens
tgagacaaggtctcactctgtcacccaggctagggtccagtggtatgatcttggttca

SEQ ID NO: 31810 - DNA, 56 bp, Homo sapiens
gagacaaggtctcactctgtcacttaggctggagtgcagtggtgtgatcatagctc

SEQ ID NO: 31811 - DNA, 115 bp, Homo sapiens
gtgctaattccctgactcagaacacgccaaggtgtctgtatgtcttctgtctcttttatttttattttttgagacggagtcttgctctgtcacccaggctggagtgcagtggcac

SEQ ID NO: 31812 - DNA, 71 bp, Homo sapiens
gataatggtcagtgtacaaagtgtaactaggaggctgtttgcctaaattaatttgtatattagcttttgtt

SEQ ID NO: 31813 - DNA, 98 bp, Homo sapiens
ctctagctcggttagcagagtacgcagcaccttggcaggtgtgacacacacactctgaatgaagaaatgcggctgacttggatgttgagtttctagag

SEQ ID NO: 31814 - DNA, 86 bp, Homo sapiens
gagaattgcttgaacccaagaggcagagattacagtgagctgagatcgcgtcattgcactccagcctgggcgacagagcgagactt

SEQ ID NO: 31815 - DNA, 76 bp, Homo sapiens
tcaaaaaaaaaaaaagaaaaagaaaaaagaaagtgctcccttgggttaattcctttttttttttttttttttttga

SEQ ID NO: 31816 - DNA, 58 bp, Homo sapiens
tgagacagagtctcactctgtcgcccaggctggagtgcagtggtgcgatctctgctca

SEQ ID NO: 31817 - DNA, 58 bp, Homo sapiens
tgagacagagtctcgctctgtcacccaggctggagtgcagtggcgccatctgagctca

SEQ ID NO: 31818 - DNA, 70 bp, Homo sapiens
gcagttgctgggttgtatgatagttgcatgtttagtttgatatggagctgacaaacttttctagagttgc

SEQ ID NO: 31819 - DNA, 94 bp, Homo sapiens
tacgatatgccttggtggtgtaggtttttcactgtttctggttttttttttttttttttagacacagtcttactctgtcacccaggctggagtg

SEQ ID NO: 31820 - DNA, 58 bp, Homo sapiens; identical to SEQ ID NO: 884

SEQ ID NO: 31821 - DNA, 56 bp, Homo sapiens; identical to SEQ ID NO: 885

SEQ ID NO: 31822 - DNA, 76 bp, Homo sapiens
gagtaattcctcagtctctccctgtcttttatgactttttgagtttttttgagacagggtctcacttttgttgctc

SEQ ID NO: 31823 - DNA, 83 bp, Homo sapiens
tggggtgggatcatgtgggtgagttggcacaatggcatcgaacatgcagaatgcctctctctctctatttgaatcaataccta

SEQ ID NO: 31824 - DNA, 81 bp, Homo sapiens
tgggagacaataaaagaaggaagatgaagcatttctccccagggagttagactgtcattctgtctgtctgaaaccttccca

SEQ ID NO: 31825 - DNA, 87 bp, Homo sapiens
ccttacacacaggggagattttatctcagttttttttttttttttttttttttttttttgagataaagtctcactctgtccctcagg

SEQ ID NO: 31826 - DNA, 107 bp, Homo sapiens
agtcagtctaatatgtaccaggcatgatcctaggtgacttgtgtacattatttcactttctttatgtatgtcacttaattcttttgccctatcagttaggaattact

SEQ ID NO: 31827 - DNA, 72 bp, Homo sapiens
gcccatgagatgacgccttgtgactcaggtacctcagccctgcgcctccgtctctgcgtctctgtattgggt

SEQ ID NO: 31828 - DNA, 80 bp, Homo sapiens
tgagccactctgactctgtcatacctctgaccttacctataaccaccttcaggggtgcaaacttgaactggactggccca

SEQ ID NO: 31829 - DNA, 81 bp, Homo sapiens
ccagcactttgggaggtgggggcgggcagatttttttttttttctttttgagacggagtctcactctgtcgcccaggctgg

SEQ ID NO: 31830 - DNA, 58 bp, Homo sapiens; identical to SEQ ID NO: 13590

SEQ ID NO: 31831 - DNA, 85 bp, Homo sapiens
ctccctggaatctgcaaataggttacatgatatggcagaagagactttgcagatgtgattaaggtgacaggtcacaaaatgggag

SEQ ID NO: 31832 - DNA, 95 bp, Homo sapiens; identical to SEQ ID NO: 580

SEQ ID NO: 31833 - DNA, 93 bp, Homo sapiens; identical to SEQ ID NO: 69

SEQ ID NO: 31834 - DNA, 104 bp, Homo sapiens
gatgaatattagtgtacaagtttctgtgtggacatatatatatatatatatatatgtatgtatatatatgtatgaagaaagtctgtattcactaccattcactc

SEQ ID NO: 31835 - DNA, 212 bp, Homo sapiens
gtatgtgtgtgtgtgtgtgcgtgtgtgtgtgtatatatatacgtatatatatacatatatatacacatatatatacacacgtatatatatacacatatatgcgtatatatacgtatatatatacacgtgtgtatatatgtacatatatatgtgtatatatacgtatatatatatacgtgtatatatatatgtgtgtgtatatatatatatac

SEQ ID NO: 31836 - DNA, 116 bp, Homo sapiens
tatgtatatagatatatgcgtgtatatatgtgtatatatatatgtatatagatatatgcatgtatatatacgtatatatatatgtatgtatagatagatatatgtatgtgtcacat

SEQ ID NO: 31837 - DNA, 112 bp, Homo sapiens
gtagatacaccttgctggagagcccatgcaccaaatgtactgtatttttgtatatatacttagaaagtagagtcacataacatttgcatttgatttctgtaaattcatctac

SEQ ID NO: 31838 - DNA, 128 bp, Homo sapiens
tgtggatgcaaatgggcatttctggactctctgctgactctcagccccatcactctctctatgactcatggggcagtgggcgagggtgggatttgcggaggttggtcttcatattctgtgatgtgctc

SEQ ID NO: 31839 - DNA, 120 bp, Homo sapiens
agcctgggccttttctggtggagtggaaagaattgagctagagatgtccagtaggctggacacttctctctggatctgatcttttggtgacagaatatactttggggagaagcaagttca

SEQ ID NO: 31840 - DNA, 76 bp, Homo sapiens
agctgacttctgtgtctttcacaaaggttgacttcagttcagaagttactttatgtagaagaaatcatggtcagtt

SEQ ID NO: 31841 - DNA, 111 bp, Homo sapiens
gaagttgacacataaaagtagccatagcactctggaagctattaagattgtctttttattctttttattctgcaatttcattgtgatatgtctagttgtggatttattttc

SEQ ID NO: 31842 - DNA, 113 bp, Homo sapiens
cctgaactcctctcatctcaggtgtcagagactggctggaaggatggcactatcactaatgtgtttatttatttagcaagaggtcttgagggctcttgaggactcagtacagg

SEQ ID NO: 31843 - DNA, 80 bp, Homo sapiens
acccctgaacttaaatttaaacacacacacacacacatatatatgtatgtatgtatatgtatatgtttaagttcagcagt

SEQ ID NO: 31844 - DNA, 94 bp, Homo sapiens
ttggaggctgtttcagacagtctgtcagcctaactaagctgtggtacataccaaacaacagtgagaggtgacagcgtgctggcagtcctcacag

SEQ ID NO: 31845 - DNA, 108 bp, Homo sapiens
ttactgggcatggtggcttgtgctgtggtccttgttgcctaggaggctgaggtggaaggatcacttgagcccaggaggttgaagctgcagtgagctatgatcctgtga

SEQ ID NO: 31846 - DNA, 74 bp, Homo sapiens
gcacagagtagacacagattaagcatcaattcatagttcaaaatggtgtttacacatctgtagtgtgtgtgtgt

SEQ ID NO: 31847 - DNA, 88 bp, Homo sapiens
aatgcctatatctgtgtgtgtgtgtgtatatatatatatatacacacatatacatacacatatatacacacacacacatatatgtatt

SEQ ID NO: 31848 - DNA, 57 bp, Homo sapiens
tgagaaaggtctctctctgtcacccaggctggagtgcagtggtgcgaccatagctca

SEQ ID NO: 31849 - DNA, 66 bp, Homo sapiens
agtatgtgtgtatatgtatatatatacacacatatatatatacatatttacaaatatgcacatact

SEQ ID NO: 31850 - DNA, 89 bp, Homo sapiens
gcctgatgcagactcttaaatgcacccaattgttaatggactagagaagccaatgtctgtgcccctgtgtgcctgtgtctgaatcaagt

SEQ ID NO: 31851 - DNA, 108 bp, Homo sapiens
gttgggcagctcttctgatcagaagctaagggactaagcattttatttatttattattttgagatggagtctctctctgtcacccaggctggagagcagtggcgcaat

SEQ ID NO: 31852 - DNA, 102 bp, Homo sapiens
cactagcggaacatttcaggtgacacccgtgcctgccttctctctctgtcagccctcactggcctgtggtcagggaagtcaggggtgtgaggtgtgccagtg

SEQ ID NO: 31853 - DNA, 81 bp, Homo sapiens
catgcaggggctctcctgggttggagtatccagacgacaggtgaagcaggctgttggctgggagctcaggtgtgactgctg

SEQ ID NO: 31854 - DNA, 131 bp, Homo sapiens
gtgactcggcaaaggggtgtccactctcatgttttcttttttattgacatggagtctcactctgtcacgctggctggagtgcagtggcgcgatctcagttcactgcaacctctgcctcccgggttcaagcg

SEQ ID NO: 31855 - DNA, 89 bp, Homo sapiens
gtacctgctgaaacctccaagagcctatgttgaagattcttttcttttgaggggattcatgtgtgcttctgttaggaaccagtggatac

SEQ ID NO: 31856 - DNA, 82 bp, Homo sapiens
gtgctgatgacactcatcccacatcatgtgtctggagaagcagaggccactctacagagacagaagagtgagagagcagcac

SEQ ID NO: 31857 - DNA, 114 bp, Homo sapiens
gaagaatacctttgggtagtacatttgaccctcactgaggcccagagacatcatttgtagtttctggaactggaagtggagcctcagacttgtgaccccagagctagcattttc

SEQ ID NO: 31858 - DNA, 82 bp, Homo sapiens
gcaaggtagaaacagaggcatggcaagagatgaaactccagaaagtcacatgggtgctcacatgtcactgtgatgccaaggc

SEQ ID NO: 31859 - DNA, 117 bp, Homo sapiens
cagtcctgatgtggcttcttctgccttctttttgtttcttaatcttaaaaaaaaatgtattttttatttcatttatttattttttgagacaagagtcttgctctgtcactcaggttg

SEQ ID NO: 31860 - DNA, 71 bp, Homo sapiens
gccctcagggagctgccttgaggaccgggtgggctgccctgcctgctctctcagactcactccgtaggggt

SEQ ID NO: 31861 - DNA, 121 bp, Homo sapiens
ccagggtccctattaggggtggagccagggtctctgttagggggcggagccagggtccctgttagggagtggagccagggtccctgttaggggtggagccagggtccctgttagtgggtgg

SEQ ID NO: 31862 - DNA, 58 bp, Homo sapiens
tgagagggtgtctcactctgtcacccaggctggggtgcagtggtgtgatctcggctca

SEQ ID NO: 31863 - DNA, 137 bp, Homo sapiens
acgtctaccctttgagtgtttccctgaccttagatgaagggaggccgtgaggatcggtcctgagagaactgagagagccccgcctcactgctcttctgggtcagtgggggggtggtgtctgagtgctttcactgtcc

SEQ ID NO: 31864 - DNA, 79 bp, Homo sapiens
cttgatctcctgaagggtagggacagggtcttggtcatccaggccaagcacagagcctgtcagtcagtcagtcagcagg

SEQ ID NO: 31865 - DNA, 88 bp, Homo sapiens
agctgggatcataggcatgcactaccacactcagctaattttttaaattttttatgtagagatgaggtctccttatgttgcccatgct

SEQ ID NO: 31866 - DNA, 96 bp, Homo sapiens
agtgaagttgcatgtgaattgtgtacacagtgctggccccaaggtccctgcatggtggctgtcactgtcactgtttacatcagtcgtgagattgct

SEQ ID NO: 31867 - DNA, 79 bp, Homo sapiens
cacagtgataaggtggcactgtggtgtgctggtgctgtcatgtggttaggctgtgacacggtgactcagtgacactgtg

SEQ ID NO: 31868 - DNA, 120 bp, Homo sapiens
gcatagttctatttttccataacttttttggaggtgtgaataacaagcctttctggatgtgaaatgatttgaaaggaaaatctcacattaataaaaaagctttgctgaatgtgatggcgc

SEQ ID NO: 31869 - DNA, 61 bp, Homo sapiens
tcccagccagcctgtatccctgtgccgtgaccccagagcacagagcctcagaggctgtgga

SEQ ID NO: 31870 - DNA, 114 bp, Homo sapiens
ctgaggaggcagcaggacagcctggggcagctgtggactctgtttcttttttcttttttttaaagaaggagtctcactctatcacccaggtggagtgcagtggcatgatctcgg

SEQ ID NO: 31871 - DNA, 118 bp, Homo sapiens
gtcctctgtggctccaacacccctctctgcccgtccctcagagggaacatctgggtgggtcccagtttggcccttctgcactggctgccaggaatgttctggtttttgtctcctggac

SEQ ID NO: 31872 - DNA, 67 bp, Homo sapiens
cccacgcactctctttgcctgtgggagggcaggatcccagctgccccagcggggaaggggtgtgggg

SEQ ID NO: 31873 - DNA, 78 bp, Homo sapiens
gctgctgagaccctggaagagacggaggatgaaattgtgttgccagatagtccatttgttgttctgagactcgcatgc

SEQ ID NO: 31874 - DNA, 81 bp, Homo sapiens
ggagtgcccctcactgtctcagcctctgtcctgtctgtggcatgtgcatcattctgaggagaaggctggattttgtgctct

SEQ ID NO: 31875 - DNA, 163 bp, Homo sapiens
gtataaatatatatatatatgtatatatgtatatatatatgtatatatatgtgtgtgtatatatatgtgtatatatatgtgtgtgtgtatatatatgtgtgtatatacatatatatgtgtatatatgtgtgtatatatatatgtacatatatatatatatata

SEQ ID NO: 31876 - DNA, 128 bp, Homo sapiens
gatgtttgtggatggatgagcttgcaggttcctgtcacctggcctcttctcattcaccattgtcttactctctctctggctgctgctccagttcacgactgagtgggtgcgactagagtagctctgac

SEQ ID NO: 31877 - DNA, 77 bp, Homo sapiens
agacacccaccaccatgcccagctaactttctgtatttttagtagagacagtttcagcatgtcggccaggctggtct

SEQ ID NO: 31878 - DNA, 118 bp, Homo sapiens
gtgtgtcacattttggtaattgttgtaatatttcagagcttttcattattattttatctgttatggtgattcatgatcattgatctttgatattactattgtaattgttttggcgtgc

SEQ ID NO: 31879 - DNA, 107 bp, Homo sapiens
tctttcattagtgtggttctccaatgtaagctattctgactttttaaaaatattagcctatgagagagagagagagagagagagagagagagagacagagagagaga

SEQ ID NO: 31880 - DNA, 93 bp, Homo sapiens
tgccagtgcaacacagtagtcactgtaatccatcaaagaaaaaataattaatttattttatgacgtatttatttggatgattacttactggta

SEQ ID NO: 31881 - DNA, 101 bp, Homo sapiens
cagcataggcttgatgcctatggtacctatccaggtgagctctgttctgtctctggggacacttaagattactggtgtaggtacttgcattgctgttgctg

SEQ ID NO: 31882 - DNA, 127 bp, Homo sapiens
atatgtgtgtatataatgtgtccctttatatatatgtatgtatgtatgtaacatgcacctgtatataaatatgtgtattgtatacatgtatatataggggcatgttatatatacacacacacacaca

SEQ ID NO: 31883 - DNA, 76 bp, Homo sapiens
gcctggcagtcactcacagtccctctggacctggagccagcggctatggcggacgaagaggcacctgttcccaggc

SEQ ID NO: 31884 - DNA, 96 bp, Homo sapiens
gctaggattacaggtgggagtcacctcatccggcctaatgattccttttttttttttttttttttttgagatggactctcactctgtcaccctggc

SEQ ID NO: 31885 - DNA, 59 bp, Homo sapiens
tgtcacctgctcactcctgagaagtgttttgtatcatctctctgaagtgagtgggcaca

SEQ ID NO: 31886 - DNA, 114 bp, Homo sapiens
cagccaatgggaggcactgatggaggattgaagggcagatggagtgagtcgggcatgtctctgcctccctctgtgcttcctgcagcatctctggcagtgattgaacctctgctg

SEQ ID NO: 31887 - DNA, 58 bp, Homo sapiens; identical to SEQ ID NO: 884

SEQ ID NO: 31888 - DNA, 56 bp, Homo sapiens; identical to SEQ ID NO: 885

SEQ ID NO: 31889 - DNA, 96 bp, Homo sapiens
ccacatacagtcagatttgaaggcctctgatgttgaatgatgttgaatgtttctaaatattttaatggttcttttcaggtcttgacttgtgtatgg

SEQ ID NO: 31890 - DNA, 116 bp, Homo sapiens
tggctgggttgggtacatcaaagttcgctggagctgagtccccagaggccattgtgtggctgtcagactcactcggagaaaagctgggctcattgtttattgctggtcaactgcca

SEQ ID NO: 31891 - DNA, 74 bp, Homo sapiens
gactctcccgctgtgtgtgtctgtgccctaattttcccttcttataaggacagcagtcatattgcgttagggtc

SEQ ID NO: 31892 - DNA, 64 bp, Homo sapiens
tcctggaggttgtattttgatgctggagacagtaggcagagaagacaattctgcagctgaagga

SEQ ID NO: 31893 - DNA, 88 bp, Homo sapiens
gtgtataggacacaaacttgtgtgctttgtcagatgccccagacggcctctgtctcactgtcatttgagctctgtgtcccacctgcac

SEQ ID NO: 31894 - DNA, 115 bp, Homo sapiens
cacggctctttcaacttctctgcttggtgattgggcagcctgaatttctaggacacttcattttttgttttttgagacaaggtcaagctctgtcacccagcctcgagtgcagtga

SEQ ID NO: 31895 - DNA, 77 bp, Homo sapiens
cacgtctctctcactctcagttccctgccgctgtacttgtgtgtgggtgagctaagaacactcagcgtgagatgcgt

SEQ ID NO: 31896 - DNA, 120 bp, Homo sapiens
gaagagagaacagagaaggcatctgaatcacagtggaagtttactcctatttttctagtaaatctttattttaaaatgactgtttccaatcctgtgtgtgttaccttctattttagtttc

SEQ ID NO: 31897 - DNA, 115 bp, Homo sapiens
caacattgtgtacctttgttttatagcacttacatttatttctatgaatatttccttaatgcctatattccttcctaaatcgtaagctgcacgagagcaggatcatttgtgtctg

SEQ ID NO: 31898 - DNA, 117 bp, Homo sapiens
cttgctcatttctctggggttttcccgtgtatacatgaggcatacatattaatacacttctgtttttcttctgttaatttgtcttttgttacagggagcctcagataagagttatga

SEQ ID NO: 31899 - DNA, 71 bp, Homo sapiens
atttctcttaaaaatgcatttggaattcttccagtaattcacagaagagtgtgaatgctttttgaggaagt

SEQ ID NO: 31900 - DNA, 134 bp, Homo sapiens
gagagagggcctccgtgttctcttgcctaggtggaggtgtagctgagctgggagcccccatcactcactctcagtgctttagcacgagcaggaaaagacagaggttgcctgcagtagatggctgaagactagag

SEQ ID NO: 31901 - DNA, 113 bp, Homo sapiens
ggtgtgtatgtgtgtgtatgtgggcacgtgcgtatatttgtgtgtgtgcatgtgcatgggtatgtatatggggtgcatgggtgtgcatgtgtatatatgcatgtgtgtatatc

SEQ ID NO: 31902 - DNA, 114 bp, Homo sapiens
tgtcagctgctaaattagcctcacctagcagtgccacctctgggtgactgtgtctgtgagacaataagctcctcattgctgagtcactctgggtcaggtattctgttactcaca

SEQ ID NO: 31903 - DNA, 58 bp, Homo sapiens
attgctgtaggggctgtctctctctcaggctgaggacctggggaggagtagatgcaat

SEQ ID NO: 31904 - DNA, 81 bp, Homo sapiens
tgagacagggtcagggtctcactgtgtctcccaggctggagtgcagtgcaagatcacagcagcctcgacctcctgggctca

SEQ ID NO: 31905 - DNA, 94 bp, Homo sapiens
cggtgtgtgagagctctgggttcaggaaataacacacaaaaaagatccactgtgggtctgtgtgagtgtgtctgcatgagcattaaaagcaaag

SEQ ID NO: 31906 - DNA, 62 bp, Homo sapiens
gctctgtggattgtactttgggtgggctctgactctggctcacccacagaatcacctggagc

SEQ ID NO: 31907 - DNA, 97 bp, Homo sapiens
gggggttcaagaccagcctgggtaacatagcaagacctcgtctctacagaatttttttttaaattagccaggtatggtggtgtgcacttgtagtccc

SEQ ID NO: 31908 - DNA, 114 bp, Homo sapiens
gaatgtgtattctgtggttgttggatgaaatgttctatatatatatatatatatatatatatatatatatatatatatacacacacacaataatagtagggaacttcaatattc

SEQ ID NO: 31909 - DNA, 109 bp, Homo sapiens
tgtatagtattccgttgcatgtgtatgtatgtgtgtgtatatatatatcaatagactatgagaaattgtgtgtatatatacacacatatgtgtatatatacattataca

SEQ ID NO: 31910 - DNA, 114 bp, Homo sapiens
tacctactgtagagcatggtgactatagttaataataaagcttttttatatttgaaaattactgggagtagtattaatacatcttaaatattctcaccaaaagtatgcaaggtg

SEQ ID NO: 31911 - DNA, 104 bp, Homo sapiens
tgtgtctatatatatatatacacatatgtgtatatatatacatatatacatatgtgtgtatatatatacgtgtatatatatgtgtgtgtgtatatatatacata

SEQ ID NO: 31912 - DNA, 133 bp, Homo sapiens
gatagtggcagtggagatggggcctgccattgagtcaccaccatcttaactgttctgtctggggctgtcactgagaagggcacagcaggagacaacttgctgttgtagtgcaaaatcagccatcaacaatgca

SEQ ID NO: 31913 - DNA, 70 bp, Homo sapiens
cagcctgggaaacatagcaagaccccatcttttttttttagacaaagtctctcgctctgtcaccaggctg

SEQ ID NO: 31914 - DNA, 68 bp, Homo sapiens
caggcaccatgagcatctccatctgcactctggggactgggagcatgaacagagcacatgcaagcctg

SEQ ID NO: 31915 - DNA, 95 bp, Homo sapiens
tgccatttctcgaagttatccggtgtgggctctccaacactgactttcatggaaagtcaaaacagtgagctcaccgcggacaaacagaaaaggta

SEQ ID NO: 31916 - DNA, 91 bp, Homo sapiens
gggttcaagaactatccacatgctcccatttctggcttctgcctctctctgtgacagctccttgccagaagtgcttgcagtgttccagccc

SEQ ID NO: 31917 - DNA, 113 bp, Homo sapiens
tagatatctttatgtatagatgtgcttgtatgtatgtgtctgtgtatgtgtgtatatatatacatatatacacataaatataaatataaatatacgtatgtatgtatatatat

SEQ ID NO: 31918 - DNA, 65 bp, Homo sapiens
ctggctcactggctgtgtctgcctgggtaagtgattgaggattctgaggctgcatccagagccag

SEQ ID NO: 31919 - DNA, 73 bp, Homo sapiens
agcctgtgcttgttctttctgcagttgaggaggattggtgctccttaaacaatgccagtgacaacatagtgct

SEQ ID NO: 31920 - DNA, 84 bp, Homo sapiens
gtatatgtatatgcatgtgtgtatatacatatatatgtgtgtgtatatatatatgtatgtatgtacacacacatttacatgtat

SEQ ID NO: 31921 - DNA, 106 bp, Homo sapiens
agaaaattcactggggagaatttcctggggaacatattttctttttgaaaattagaggtaatattgaaggagaggccatatgaaactcagggcagccccaggatct

SEQ ID NO: 31922 - DNA, 79 bp, Homo sapiens
cactgtcctcccaggaatgagactgtccgacactctcagacacttgggagacttgaggccatggctgggagggtgagtg

SEQ ID NO: 31923 - DNA, 68 bp, Homo sapiens
gctgtgttcccttatctcctctcagtatatactgcatgtgtctgagaggagacagagagaaattaagt

SEQ ID NO: 31924 - DNA, 83 bp, Homo sapiens
agtggggcaccttggaccagaaggcccaggaacaggaaccaaatgtgtctctgtctgcctgtctggttaggtgtgactctact

SEQ ID NO: 31925 - DNA, 88 bp, Homo sapiens
gctgtccgaccccctttcatgtcatgggtgacatcctgtgccaccaggctccattccactcatgactgtaggacacaaactctgcagc

SEQ ID NO: 31926 - DNA, 98 bp, Homo sapiens
tctgtatctgtgtgagtgtatatatatatgtctgtgtgcgtgtctgtgtctatacccatgtgtgtgtctgtgtgtgtctatatgtatatctgagtgga

SEQ ID NO: 31927 - DNA, 115 bp, Homo sapiens
cccaggagaggatgacgaattgagcactctactcttttttatttatttatttatttatttatttatttatttatttatttttgagacagggtctcactctgtcatacaggctggg

SEQ ID NO: 31928 - DNA, 79 bp, Homo sapiens
ctcctgctctaagaaggcaaagagttcctttctttttctttttttttagatggggtctcactctgttgccaggctggag

SEQ ID NO: 31929 - DNA, 58 bp, Homo sapiens
tgagatggagtctcactctgtcacccaggctggagtgcagtggggcgatctcatctca

SEQ ID NO: 31930 - DNA, 93 bp, Homo sapiens
tggatgtccagccatgagcatagtgaggaagagatagcccagtctgcccctgtctctctttgtgctgacctgctgtaggctgcgctatatcca

SEQ ID NO: 31931 - DNA, 112 bp, Homo sapiens
tcaatcactcacagaatgttctgctttgctttaggagtggctctgttcctgtctgactctcttattgggtagcactctccttaaggtcagaggcggagcaagtcatcgttga

SEQ ID NO: 31932 - DNA, 84 bp, Homo sapiens
acagatatatatatgtatatatgtaatatgtgtaacattatatataatgtatattttataatgtgtatatatatgtctatctgt

SEQ ID NO: 31933 - DNA, 69 bp, Homo sapiens
gatagagtgagaccctgtttgtctttatttttattattattattttttgagacagagtctcactctgtc

SEQ ID NO: 31934 - DNA, 71 bp, Homo sapiens
ttgtttttgaggtagagtctcactctgtcacccaggctggagtgcagtggtgtgatattggctcactgcaa

SEQ ID NO: 31935 - DNA, 107 bp, Homo sapiens
atttatttctcttgtctgattgctctggctaggacttccagtactacgttgaatagaagtgataccaggaaatcttaagagaattttcagtcatgttggaaatgggt

SEQ ID NO: 31936 - DNA, 77 bp, Homo sapiens
cagtggagaatgtcttgaccttgtgaccctgcctgtctgccaacctagccttctcacaggctttggacaaaccattg

SEQ ID NO: 31937 - DNA, 119 bp, Homo sapiens
cagattctctcagtaagatgatcgttctttcaaacagaactctaagaaagaaggcagattcttttttttttttttttggtgtccttcattttgttaaatgtgcatttttgatctatctg

SEQ ID NO: 31938 - DNA, 86 bp, Homo sapiens
tttacaaccaagaaaatctcagtctatgtctctcccctgccactgctgggagactggacaagttacatcattggatcccttgtaga

SEQ ID NO: 31939 - DNA, 83 bp, Homo sapiens
gacatgtttgttttgtgtaccactggattccagggaactctcaaagagcctggcccagagaagacactcagcaaacatttgtt

SEQ ID NO: 31940 - DNA, 81 bp, Homo sapiens
gttggacagagaaaaatcactgaaaattgactgagccacttggaggtgttagttgacttcatgtatttatttatatccagc

SEQ ID NO: 31941 - DNA, 85 bp, Homo sapiens
cagcctagtggggagtactgagccctgggctctccaaccctccaagccactccagtccccatctctcacactctctgcatctctg

SEQ ID NO: 31942 - DNA, 77 bp, Homo sapiens
tctatcttgataaagaacagtttttctgttccattaaaaaaaatcgttggagagctgtttttgatgttgagagaaga

SEQ ID NO: 31943 - DNA, 77 bp, Homo sapiens
agctcacgcagttcatcactgggagtgtgtttcaacggggcatgacaacatcccatgaaagagaaactgcatgtgct

SEQ ID NO: 31944 - DNA, 60 bp, Homo sapiens
actcctactttttttttgggggggggggaccgagtctccctctgtggcccaggctggagt

SEQ ID NO: 31945 - DNA, 58 bp, Homo sapiens
tgagactgagtctcgctctgtctcccatgctggagtgcagtggcatgatctcggctca

SEQ ID NO: 31946 - DNA, 103 bp, Homo sapiens
gttgaaggcttaaccccagtacctcagaatgtgactgtatttagagacacggcctttaagaaggtagttaagttaaaattaggtcattagggtaggcctcaat

SEQ ID NO: 31947 - DNA, 99 bp, Homo sapiens
gtgtccatgtgtgtatgtgtgcatgagcatgtgcatgtgtgcccatgtgtgcctgtgcacgtgtgcatggctgtttgcacatggactgcatgtgggcat

SEQ ID NO: 31948 - DNA, 81 bp, Homo sapiens
gttttgtgacactctgtggctcacgcctgtaatcccagcactttgggaggctgagacgggtggatcacaaggtcaggagat

SEQ ID NO: 31949 - DNA, 85 bp, Homo sapiens
cactttgggaggctgaggtaggtggatcacttgagctcaggagttcaagaccagcctgggcaacatggtgaaaccctgcctctac

SEQ ID NO: 31950 - DNA, 81 bp, Homo sapiens
gagctcacactcccactcacggccttctgctcctggtgaaattagcaacagaagatgcaagaggagggaggcaaagggctc

SEQ ID NO: 31951 - DNA, 90 bp, Homo sapiens
agggcacatagctagtaagctgtggaatagggggttaagctcatttgctctctctctctgattctggcagaagcttggctttgatgcttt

SEQ ID NO: 31952 - DNA, 111 bp, Homo sapiens
ttcaatgataggtaactcattgaataatttctgttatatccataaaatataatacattatattttatgtatataacaaacattaaaaacatgagttatttactgatatgga

SEQ ID NO: 31953 - DNA, 82 bp, Homo sapiens
gagaggcaagacctgaggctggatggtgcaggggtgctggggacacacagcctctcagcgcctctcactgtgtgtcctgtag

SEQ ID NO: 31954 - DNA, 111 bp, Homo sapiens
cctgtgcttgtaagtcccaactactcaagaggctgaggtaggaggatctcttgagcccaggaggttgaggttgtagtgagccatgatcatgccattgcactccagcctggg

SEQ ID NO: 31955 - DNA, 92 bp, Homo sapiens
atctattcctagggcaggcactgtctgtgagtgtggcctattccagaactgttggccttgcccccacctcattagatagccagcagagaaga

SEQ ID NO: 31956 - DNA, 82 bp, Homo sapiens
tcatttctctgtccctctctgacccaagcttctccctccagcctgctgtcagaagttgggatgagctggaaggaccatgagg

SEQ ID NO: 31957 - DNA, 107 bp, Homo sapiens
cattttaaatgttttgttttttatctttggctcatacactctgtgtgtgtgtgtatatgtatatgacagagagagagaaagggagaaagagagtgagaaagagagtg

SEQ ID NO: 31958 - DNA, 114 bp, Homo sapiens
ccaggcatggtggcgtgtgcctgtagtcccagctccttgggaggctgaggttggaggatcacttgagcccaggagttcagtgagatgtgatggcaccactgcactgtagcctgg

SEQ ID NO: 31959 - DNA, 72 bp, Homo sapiens
tgggagttgggctgggctgtgtggagatagaggggtgaggggcacccaatctcactctgtaagtcgctccca

SEQ ID NO: 31960 - DNA, 85 bp, Homo sapiens
tcttagattcatgcccacaaccgagacagaagagtgagttcttttgccaagagaaagagcagcctcctgtctatgtagcctgaga

SEQ ID NO: 31961 - DNA, 68 bp, Homo sapiens
tatatatatgtgtgtgtatatatatatatgtgtgtaaatatatatatatgtgcatatatatatatata

SEQ ID NO: 31962 - DNA, 68 bp, Homo sapiens
gcttctcctttgccagaccctcagtcccacagtcgatggtggctggctctctgcagcagagaggaggc

SEQ ID NO: 31963 - DNA, 89 bp, Homo sapiens
ggaggaagggaagggcagtggggagaggagggagcttagagcgaacccaaagatgctctctctgtatgtgacttcccaactgaccggcc

SEQ ID NO: 31964 - DNA, 75 bp, Homo sapiens
tgtacttttattgttcagtggaatgtaagcagtgagattacaaataaatgtaagttccactggatatgaagtgga

SEQ ID NO: 31965 - DNA, 69 bp, Homo sapiens
acagtcctcagcgtccctcagcttatagaggcatcaccccaatctctgtgtctgtcagcctgaggctgt

SEQ ID NO: 31966 - DNA, 76 bp, Homo sapiens
gagaggggtccacaggcggggaggctgcgaggaccatgcggctggctctcaccctgtctgtgccagtgcccagctc

SEQ ID NO: 31967 - DNA, 77 bp, Homo sapiens
ggtggtgactgttttcggcggcttctctgagaaagtgacgtctgagcatggttgtgagtgagatgacagtggccact

SEQ ID NO: 31968 - DNA, 110 bp, Homo sapiens
cagggcaggtcagtgttgtccggtttgattttaaggaacccctggcattgccaacagttgtgtttttcttaaagaaatccttgagccaggtccacatggctctagctttg

SEQ ID NO: 31969 - DNA, 117 bp, Homo sapiens
gattatcaccgaggagagatggacacccaggataaggaagtgatgagtctgagcacagcggtggcagagccaggctggtcccggtctgtgtcctcctgccgtgctctggtgtgtgtt

SEQ ID NO: 31970 - DNA, 75 bp, Homo sapiens
gaatgtaccccaggctccgtgagtgggtctcttggatgaagagagaagctcgctatctctggcctcgtcaccttc

SEQ ID NO: 31971 - DNA, 119 bp, Homo sapiens
tttaaatgtggggacatcagcagtggaatgtaagtaaggcaacctataggtatttttttttttttttttttactttatagttcctagtgtcttcttgttgagaaatttccttttttaaa

SEQ ID NO: 31972 - DNA, 58 bp, Homo sapiens
tgagactgagtctcactctgacgcccaggctggagtgcagtgacatgatctcggctca

SEQ ID NO: 31973 - DNA, 98 bp, Homo sapiens
gtctttagttttcagaggtctaattgtgatgtgccttagtgtggatttatttgaatttatttggtttggggtttgtctaacttcttgaatctatagat

SEQ ID NO: 31974 - DNA, 70 bp, Homo sapiens
ggccatcttcctccctctgtctgtgtgtctttctcctcctcataaggacaccagtcactgggttagggcc

SEQ ID NO: 31975 - DNA, 88 bp, Homo sapiens
cgtgagttcccaaagtccattgtgtcattcttacgccattgcatcctcactgctgtgagtgagaacatacgatgtttggttttccatg

SEQ ID NO: 31976 - DNA, 58 bp, Homo sapiens; identical to SEQ ID NO: 454

SEQ ID NO: 31977 - DNA, 79 bp, Homo sapiens
tgagacagagtctcgctctgtcacccaggctggagtgcagtggcgtgatctcagctcactgtaacctctacctcctggg

SEQ ID NO: 31978 - DNA, 116 bp, Homo sapiens
gctgcaggcgtacatctctgtgccaagatgcagagccttggccttgaggagtgattatgatgatgcctcttgcagaagaggaacccgtggctcagagaccccaattgccccgtagt

SEQ ID NO: 31979 - DNA, 79 bp, Homo sapiens
ctttcatccgtgggaagctctgtctctgtgcctctggaggttggagactctaacaatccgagatcttcctgggtgaggg

SEQ ID NO: 31980 - DNA, 76 bp, Homo sapiens
gtgtatgtgtgtgtatgcatgtgcatgtgtgtatatgtgtgtgtatacacacgtgtgtgtgtgcaaatgcatgtgt

SEQ ID NO: 31981 - DNA, 61 bp, Homo sapiens
ttctgtctcagcctctgagtgaggggacagctcccagtgccggaaagaacatggggcaggg

SEQ ID NO: 31982 - DNA, 63 bp, Homo sapiens
ccctgctgtctctgtgtgtgtccagtttctttgtgtaggaacacgagccagattgcattaggg

SEQ ID NO: 31983 - DNA, 115 bp, Homo sapiens
caagatgtgtgtgtgtgtctgtctgtgtatacatgggtatatatatacatatatgtgactgtatatatgtgtatacatgtatgtagacatatatgtatatgtatacacatagaca

SEQ ID NO: 31984 - DNA, 56 bp, Homo sapiens
gccagggtgtgcagggacaggatccgcatgtcactgtctttatgtctcactgtggc

SEQ ID NO: 31985 - DNA, 116 bp, Homo sapiens
ctagatgggtgcagaggcgctgctcgccacggagatgtgcggccagtgtgtgatggtgtgcgggtctctctgtctctccgtagagcagggaaaagctcttcacagccaactcctag

SEQ ID NO: 31986 - DNA, 84 bp, Homo sapiens
tgttctcatgacagtgagtgagttctcatgagatccggttgtttaaaagtgggttgctctctctcccactctgccatgtgaaga

SEQ ID NO: 31987 - DNA, 83 bp, Homo sapiens
gcaccgcgtcgggcctcccaccactcacccactgagtctgaccatccggggcaggatgagtgctgtggtttgaatatctgtgc

SEQ ID NO: 31988 - DNA, 70 bp, Homo sapiens
gtttttgagatggagtctcactctgtcacccaggctggagtgcagtggtgtgatctcagctcactgaaac

SEQ ID NO: 31989 - DNA, 58 bp, Homo sapiens; identical to SEQ ID NO: 1215

SEQ ID NO: 31990 - DNA, 82 bp, Homo sapiens
tgtactggtgatttggagtaggattaagtaagacattagttctaagggtttttttttaatatactttaagttttagggtaca

SEQ ID NO: 31991 - DNA, 101 bp, Homo sapiens
aaaatgtgtccattcactcactggtagatcacgtgctctatgggaccaggaaacattccagcataatatctggcaaatatttggtgcatgagaaatatttt

SEQ ID NO: 31992 - DNA, 95 bp, Homo sapiens; identical to SEQ ID NO: 68

SEQ ID NO: 31993 - DNA, 93 bp, Homo sapiens; identical to SEQ ID NO: 69

SEQ ID NO: 31994 - DNA, 74 bp, Homo sapiens
ctccagcctgggtgacatagtgagactctgtctcaaacaaaaaagagtttctttgctgtgagatacccacagag

SEQ ID NO: 31995 - DNA, 105 bp, Homo sapiens
atgagtgtagttctgacatgactatgggttgataattttatttatgttaacaagtaacatgaaaaggaaacagcaaatatttctgtcagaatttcaaatgttcat

SEQ ID NO: 31996 - DNA, 61 bp, Homo sapiens
ccactcactgtctgtctgagttttcagtggctgctgcaaccgatgaccacagactgagtgg

SEQ ID NO: 31997 - DNA, 82 bp, Homo sapiens
acttgcctcagtctctcactctgccttattcccctcggacgaattctttcctttgaggtgagaatggagactgcagccctgt

SEQ ID NO: 31998 - DNA, 68 bp, Homo sapiens
tccagcatgaactgtgatgctctggtctgggttctcagaagagagacaggaatagataaagtgctggg

SEQ ID NO: 31999 - DNA, 134 bp, Homo sapiens
gacttcatttccaatgcacgcacctgtctccctgtctacactgtggtctcctccagggcagggagcaggttgtattcatctcagtcgcctagcatctctcagcctggcacacagtaggcacttacaggtggtgt

SEQ ID NO: 32000 - DNA, 60 bp, Homo sapiens
ggctggagttcagtggcatgatctcagctccctgcagcctctgcctctgagtctcaggcc

SEQ ID NO: 32001 - DNA, 74 bp, Homo sapiens
catctcagggcactcacagctggtgaggggctgctcactttttggtgtctccctgtctgtctgcctccctggtg

SEQ ID NO: 32002 - DNA, 111 bp, Homo sapiens
cctttcagagtggtagctgtttcttttttctcttctatttttgtataaaagatttctatttttttgcatctaatggaggatatcaaacagttttaagctattctcttttgg

SEQ ID NO: 32003 - DNA, 93 bp, Homo sapiens
ttctctgtgacctctcctgcttctctctgcagccccgtagacagatgctgtgcgttagagaggagacactgaggagggaacattcacagagga

SEQ ID NO: 32004 - DNA, 58 bp, Homo sapiens
tgagatggagtctcactctaacactcaggctggagcgcaggggtgcgatctcagctca

SEQ ID NO: 32005 - DNA, 74 bp, Homo sapiens
gaagcaaaacagaagagtctgagttcagaacatttttgtctaatggaggggcacagggactcatgtcatgcttc

SEQ ID NO: 32006 - DNA, 68 bp, Homo sapiens
ctgggtgaacagtagttacggcgacaatggatttttttttggagacagagtctcgctctgtcacccag

SEQ ID NO: 32007 - DNA, 76 bp, Homo sapiens
cctgtctcagaatgggctgccaagctcccgctggctcattgagcaggctggagtcaggctctctgactgtgactgg

SEQ ID NO: 32008 - DNA, 91 bp, Homo sapiens
gtgtatatatgtgtgtacatgggcatgtgtgtatgtgtgtgcatgtgtgtttatgtagatatgtgtgtatatttgtatatgtaagtacatg

SEQ ID NO: 32009 - DNA, 62 bp, Homo sapiens
ctgtgtctgtgtctgtggctgtgtctgtgaacgctggagccgcctcagtgggagaacaacag

SEQ ID NO: 32010 - DNA, 73 bp, Homo sapiens
cttctcagttctctttgtctctcatcactgccaggaggaaaattacattgaagggcactggggagctggggag

SEQ ID NO: 32011 - DNA, 61 bp, Homo sapiens
gtgaccctctctgtcgctgtccctgccttgtgggtggtggtggagtgtttgtaggtgtggc

SEQ ID NO: 32012 - DNA, 69 bp, Homo sapiens
atcatgcaggtaagaatgtacattcctggagggcagaagccctctgtgtctgtctcattttctgctggt

SEQ ID NO: 32013 - DNA, 95 bp, Homo sapiens; identical to SEQ ID NO: 68

SEQ ID NO: 32014 - DNA, 93 bp, Homo sapiens; identical to SEQ ID NO: 69

SEQ ID NO: 32015 - DNA, 119 bp, Homo sapiens
gtggggatccttccaactcactgggtgattctctgagcagcacgtggggatctttccacactcactgggtgagtctctgagcagtgtcttggggatccttccacactcactgggtgagt

SEQ ID NO: 32016 - DNA, 83 bp, Homo sapiens
gtttagggaggaatgatatttcacagtaacttctattagtgctatatgaacacagagaacacagtgaccagtcctgcctggat

SEQ ID NO: 32017 - DNA, 77 bp, Homo sapiens
gggttgaatttcatcttcttcttcatgtagctggaatttgcagagcagaaggaaggaagtggagcatagaaagacct

SEQ ID NO: 32018 - DNA, 118 bp, Homo sapiens
gccgatccctgtgtcgtttccatccttcattttctggtgtgggataggccaggtctgagtgtctgagtgacttcctacgatgaggttaagggaaggtggtccacggtcctggaggagc

SEQ ID NO: 32019 - DNA, 86 bp, Homo sapiens
ttgagctgttgtctctgcctcttgctatacaagattctgataagtagtaacttgataaagatcatgagagaagggacagagcacaa

SEQ ID NO: 32020 - DNA, 91 bp, Homo sapiens
ccttggctgtgggagtgatgaggtcacactgagcagtgttgtctccacattcataagctgtgcctcagactctctgtgaaaacaaccaagg

SEQ ID NO: 32021 - DNA, 105 bp, Homo sapiens
tgtgagaccgatgccaatgtctgcagtgttgctctgtctgtggctctcgtctgaggacagccagtgggcaggaaaggtgaagggagcgagggcaaggggctcaca

SEQ ID NO: 32022 - DNA, 117 bp, Homo sapiens
ggaaaacttcaggccatcacagcttggaagcacacacttctgctagagatgtgtttatcttggtgggcagcttggggagaagcacttaaaagttgagaatgtggccttcaaaattcc

SEQ ID NO: 32023 - DNA, 81 bp, Homo sapiens
cgaggtggagctggaagatgaatgatggttggaacgcggtgtctggtggtgagacctctgcctctgactcactgtgcctgg

SEQ ID NO: 32024 - DNA, 68 bp, Homo sapiens
tgctgattagttgaggggagcttctgaggagtcgcatcatggctctgtcagtggctctgtcattagca

SEQ ID NO: 32025 - DNA, 88 bp, Homo sapiens
ttcctgcagcttcagtgtccctcagtgtgtgtgttggaggtaattaatcagcgctgtaataactgggctcaccacgacgctggtggag

SEQ ID NO: 32026 - DNA, 95 bp, Homo sapiens; identical to SEQ ID NO: 68

SEQ ID NO: 32027 - DNA, 93 bp, Homo sapiens; identical to SEQ ID NO: 69

SEQ ID NO: 32028 - DNA, 69 bp, Homo sapiens
gctggggcaccggcttgtgtgtgtgtgtcggggcaggagctgtctctgtgtgtgtgtctgtgtctctgt

SEQ ID NO: 32029 - DNA, 139 bp, Homo sapiens
tatatgtgtgtgcgcacatgtgcatgtgtgcatatgtgtgcatgcatgtgcatatgtgtgtatgtgtgcatgtgcatgtgtgtgcatgtctgcatgtgtatgtgtgtgcgtatgtgtgcatgtgagtgcatgtgcatgt

SEQ ID NO: 32030 - DNA, 66 bp, Homo sapiens
tgcatgtgtgaatgtgtgtgcatgtctgcgtgtgtgcatgtgtgtgcatgtgcatgtgtgtgtgca

SEQ ID NO: 32031 - DNA, 82 bp, Homo sapiens
gctcgctctactgagtttcctgttgtgatacattgtttcccatttgaaaatgcctttatcacaagcagattcttgaacgagc

SEQ ID NO: 32032 - DNA, 75 bp, Homo sapiens
ctgggccagtgtgatggctccacacctgtaatctcaacactttgggaggctgaggtaggaggatcacaagtccag

SEQ ID NO: 32033 - DNA, 99 bp, Homo sapiens
tctggcatacacattctctttttcattgtaatccttatgtgcaccgtacttggtaacatttttgttttaatagagatggagtctttctgtgttgccagg

SEQ ID NO: 32034 - DNA, 92 bp, Homo sapiens
atatatgtgtgtgtatatatatatatatgtgtgtgtgtatatatatatgtgtgtgtgtatatatatatgtgtgtgtatatatatgtgtatgt

SEQ ID NO: 32035 - DNA, 57 bp, Homo sapiens
gccccgccatcggaggaggtgctggctactgacactgtgtctctgtgcgtgtgtggc

SEQ ID NO: 32036 - DNA, 66 bp, Homo sapiens
ggaggctgaggtggaaggatctcttgagcccaggagtgagccgagatcgtaccactactgcactcc

SEQ ID NO: 32037 - DNA, 106 bp, Homo sapiens
gttgtgtgtgcagggatggccacgtgaagccctcacactcacccaggtgcgttgatgtcagttgtgagtgtgtgcagggatggccacgtgaagccctcagactagc

SEQ ID NO: 32038 - DNA, 101 bp, Homo sapiens
gtgtgtgcagggatggccacgtgaagccctcacactcacccaggtgcgttgatgtcagttgtgagtgtgtgcagggatggccacatgaagccctcagactc

SEQ ID NO: 32039 - DNA, 114 bp, Homo sapiens
tgcagtatgattccaatttatgtatttatgtatgtaagtaagtgtgtttttattgagacagtctcattctgtcacccaggctggagtgcagtggcatgatcatggcttactgca

SEQ ID NO: 32040 - DNA, 114 bp, Homo sapiens
tatgcctgtctgtgcgcatgcatgtctcacatcgtgtgtgtgtgtgtcagtgtgtgtgcatgcctgtgtatgcaggttcagctctatgcctgtctgtgtgcatccatgtcccac

SEQ ID NO: 32041 - DNA, 71 bp, Homo sapiens
tctgtctggtcactggattcttctctgctgcccccgggttggctgcatggagtggggtccgccttggtgga

SEQ ID NO: 32042 - DNA, 101 bp, Homo sapiens
ggcattgctgtggatcacgatagccaccctcagtctgtcacagtcaaacctgagctgtaaaacaccacttccagggaatgtcagaaaagctcagcagtgtc

SEQ ID NO: 32043 - DNA, 73 bp, Homo sapiens
tagatccagcacagggctctgctctcggccctccaaccacacctcggagagccccactctgtctgtgggtctg

SEQ ID NO: 32044 - DNA, 68 bp, Homo sapiens
gctgccaggcaagtgcaggcggaggacacccaggtgggaggtgtgtgtctgtgtgtgtgagggagagc

SEQ ID NO: 32045 - DNA, 98 bp, Homo sapiens
cacagtgtatgtatgtgtatacatagtgtgtatatgtagtatacatgtagtgtgtgtatatatatataaaatgtaaatatatacatagggagagcgtg

SEQ ID NO: 32046 - DNA, 113 bp, Homo sapiens
gtcacactgccatcttcgtcaagttgccttgtaaatcctacaagcctgccacagttactgactcaatgtctgctacgtgccagccaaggggaagggtggggaggcatataggc

SEQ ID NO: 32047 - DNA, 104 bp, Homo sapiens
cccagtggagctgctggggcctatctgtttttttgaacttctgataagttgcctggccggaaggggaagaaggggggcttgggctggggcgtggccacgctggg

SEQ ID NO: 32048 - DNA, 73 bp, Homo sapiens
gagaggactcctattagttttggattgcattgtgtatttttttattttttatttgagacggagtctcactctc

SEQ ID NO: 32049 - DNA, 69 bp, Homo sapiens
gcccagtctcagtgacaagacagggaggacaggcccgcctggcaccagcttggcatgagctaactgggc

SEQ ID NO: 32050 - DNA, 120 bp, Homo sapiens
ctatgctctctatggttttcttgatttgttataatctgactgggtatgagtttttatttttttgatgctgctagggattcactgggattcccaactttctggactttgggtatggaggac

SEQ ID NO: 32051 - DNA, 74 bp, Homo sapiens
gcaagtgtgtgagcaagtgcatgtgagtgcacgaatgagttcgtgtgtgagcaagtgcgtgtgtgcaccagtgt

SEQ ID NO: 32052 - DNA, 77 bp, Homo sapiens
gcctgtcctcagctgaaagcacagggcgtggtgcatccctcactgtgtctgtgtgagcctgtgggcaacacaagggc

SEQ ID NO: 32053 - DNA, 109 bp, Homo sapiens
ggggtccatggatctttctggaatgccattgggtgcgtgggcaccctgggaacgctgagggtcagggtccacggatctttctgaaatgccactgggcacgtgggcaccc

SEQ ID NO: 32054 - DNA, 66 bp, Homo sapiens
gcaaatcccactgtgcctcagacacaggcagacggcccgcatctgaggccacagcgtgatgagggt

SEQ ID NO: 32055 - DNA, 119 bp, Homo sapiens
gcctggctccgtggctggtctctgtggctccagttcctgcctggctccgtggctccgactcctgcctggctctgtggtgggtctctgcggctccggctcctgcctggctccgtggctgg

SEQ ID NO: 32056 - DNA, 113 bp, Homo sapiens
gcatgggggcacggctctgagtctgcactgtgtacacgtgtgtccgtgcatgtctgcgtgagtgtgtgcgtctgtgtacacgtgcgtgtctgtgtccgtgcatgtctgcgtgt

SEQ ID NO: 32057 - DNA, 116 bp, Homo sapiens
caggaagctgcgccattcacctctgccactctgcacacaacacacagtgctctctggctgatgctaagatgctcttcttgcactggtgttaaagtgtttggttatggtgtgccctg

SEQ ID NO: 32058 - DNA, 109 bp, Homo sapiens
ggctgtagcgttcagctctagcagggccacgtgcctctcttgtctgggtccagctctctgcgggaagtcagtcctgtgcgtcctctgtctgtccgtcttttgctctgcc

SEQ ID NO: 32059 - DNA, 75 bp, Homo sapiens
tgcttcggtcactgtgccgggcggcggaaaggaaacgggtccgagcctctctgtgtctgcggcactctctgtgca

SEQ ID NO: 32060 - DNA, 70 bp, Homo sapiens
ggccgatctgggtccaggcctctgtgccgactcacttgtcccacaccctggctctcaaaggccacccagg

SEQ ID NO: 32061 - DNA, 72 bp, Homo sapiens
tgtcacctggcagaggtgcctgagctgggcccggcgtggagggcataggcctcactctctgactgcctgaca

SEQ ID NO: 32062 - DNA, 79 bp, Homo sapiens
cctgcacccagccactggctctgttcagttgtttctaacatcgggcaaatgattaagaggccactcacgtgtggacagg

SEQ ID NO: 32063 - DNA, 95 bp, Homo sapiens
gcagctactccggaggctgaggtaggaggatctcttgagcccaggaggttgaggctgcagtgagctgtgatcgccccactgcactcagcctgggt

SEQ ID NO: 32064 - DNA, 123 bp, Homo sapiens
ggagagggccagctccaggctcacagacggcacccactgcctgtgtccctgcctgtgtccctgcatgtggagggtgaggcactctgggggcctctttctcaaggtccctgatcccatcaccac

SEQ ID NO: 32065 - DNA, 87 bp, Homo sapiens
tctgcatgtcggatgcaacggagcgtgggtgcatgccagcctgtgtgagtgtgcttgcctgtgtgcctccgtgtcagacgtgctgga

SEQ ID NO: 32066 - DNA, 117 bp, Homo sapiens
tcggatgcaatggagtgtgcgtgcatgctggcctgtgcgagtgtgcctgtgtgcctgtgtgtgtgtgagtccgtgtgcctgcgtgtcggatgcgatggagtgtgcgtgtatgctggc

SEQ ID NO: 32067 - DNA, 75 bp, Homo sapiens
ctctctgtcagggtctgtctcagggtcaggctgcagggacccagccagatcccagggcccctgactccacctgag

SEQ ID NO: 32068 - DNA, 71 bp, Homo sapiens
aggagagggtgtctgcctgcctgtgtggtctcgctctgtgtgggcagctgtgggtctggccagctgtccct

SEQ ID NO: 32069 - DNA, 73 bp, Homo sapiens
ggactgggcgatgccctagaatagcccagagcctccctgctgtctctgtctctctgtgtgtgtctctctgtct

SEQ ID NO: 32070 - DNA, 73 bp, Homo sapiens; identical to SEQ ID NO: 32069

SEQ ID NO: 32071 - DNA, 64 bp, Homo sapiens
gtccttaccactgatagtttgagaagccctgctgagacagcggtctcagtcactgactaaggat

SEQ ID NO: 32072 - DNA, 84 bp, Homo sapiens
tgtccgcccgtctctccctggctctgcctcactcatgctcacaggggcccagggggccggggaggggactcagcggcaggaaca

SEQ ID NO: 32073 - DNA, 109 bp, Homo sapiens
gcccctctcgggggatgtaagccccagacccctacctcgcactctgcctctgggtctgtctgcgcctgggcagcggccgggtccccgtggacaagtggaattcctgggt

SEQ ID NO: 32074 - DNA, 74 bp, Homo sapiens
gtgtctgtgcagctgcatgtgtacctctgtgtgtctgtgtatacctgtggatacctgtgtgcacctgtggatac

SEQ ID NO: 32075 - DNA, 90 bp, Homo sapiens
tggctagttagagagtcgccatgttgtcttttccttatgaatataaatatttcctttgtatggattcccagcagtgggactactggacca

SEQ ID NO: 32076 - DNA, 95 bp, Homo sapiens; identical to SEQ ID NO: 68

SEQ ID NO: 32077 - DNA, 93 bp, Homo sapiens; identical to SEQ ID NO: 69

SEQ ID NO: 32078 - DNA, 60 bp, Homo sapiens
ggccttctcctacactgacagaactgggagtctcacagtctgacagaactgggagaggct

SEQ ID NO: 32079 - DNA, 109 bp, Homo sapiens; identical to SEQ ID NO: 32073

SEQ ID NO: 32080 - DNA, 116 bp, Homo sapiens
tacagagcatgtgcattttgattttatctgtcctcaagctgaccctttgttcatttttatagtaaaaaacacattcctgggtggagatttaagatgctagtgaggcatgcaatgta

SEQ ID NO: 32081 - DNA, 83 bp, Homo sapiens
tggtatttcattgggattatttataattttaaagttgtaacattacaattttgctacaattttgaatgtaaataattgtacca

SEQ ID NO: 32082 - DNA, 85 bp, Homo sapiens
cttaggatcaattataatgatcaatatatgtatatataaggatatgtatatatatatatggatcaacataatgattgcacttagg

SEQ ID NO: 32083 - DNA, 125 bp, Homo sapiens
atgccacgtggtcaccgccagacagacagcacctttcctggggggctggctagttcaggacaatgatcccagcatgtggggaaagctcgcccgtgactcccacctcgcttggtcagacctctact

SEQ ID NO: 32084 - DNA, 86 bp, Homo sapiens
taggagggtggtcagagtgaaagccgtggacatggctgtgacttctgggacgggcacggcgaggcactctcacacacactgtactg

SEQ ID NO: 32085 - DNA, 70 bp, Homo sapiens
ggaccgagatagccctgcaggggcccgggattcacattcccactgtctctgtttcgctctgtctctgtct

SEQ ID NO: 32086 - DNA, 79 bp, Homo sapiens
gtgtggaacttggctttcaggggtgttttgtttcgtttcgttttgtcttttgagatggagtctcactctgtcaccaggc

SEQ ID NO: 32087 - DNA, 58 bp, Homo sapiens; identical to SEQ ID NO: 12142

SEQ ID NO: 32088 - DNA, 90 bp, Homo sapiens
gcccatccatcaactctcactctcattgacagagcagccaccttctgggctgttgccagtcaccatgacagcagaaaaaatgtgtgtggc

SEQ ID NO: 32089 - DNA, 84 bp, Homo sapiens
ctacatgtttaggtctggtgtgagttctaaggaatctgataaatgcctgcctttgtcactctggctgactcggatcccatgaag

SEQ ID NO: 32090 - DNA, 57 bp, Homo sapiens
tgagtcggagtctctgtctgtcacccaggctggagtgcaatgacggatctcagctca

SEQ ID NO: 32091 - DNA, 99 bp, Homo sapiens
ttttagccttctacctagaagtgagatgatgcagtatatgtgtctttctgtgtctgacatttttcacttagcgtaatatcctccaggtttgggaaaaag

SEQ ID NO: 32092 - DNA, 114 bp, Homo sapiens
tcaccagcaccctgcaagctccctgtgctcgtttcagtcactgtctccctccctccacaaacatagcccctgttctgacttctaccagcatagttgagttttctctgtttttga

SEQ ID NO: 32093 - DNA, 98 bp, Homo sapiens
gccccgctgcctcctggccctctgtactctctctggctctcaatctccctaaaggtttgtttaaagtagatagaacagaggggggactatgccaaggt

SEQ ID NO: 32094 - DNA, 62 bp, Homo sapiens
gtgtgtgtgtgtgtgtgtgtgtgtatgtgtgtgcatgtgagtatatatgtttatgtgcacac

SEQ ID NO: 32095 - DNA, 91 bp, Homo sapiens
gaaacgccctgttggaagtttcagacagaaatcacacaggctgctgcatgacggccatttatgatttctcagactttcctccagtgctttc

SEQ ID NO: 32096 - DNA, 113 bp, Homo sapiens
gcaggtaatgttgtaatttggtttatgaatcctctgtgggtcagttgtgcaaatgccagctttctctctctctcacaggtcccaggagagacctttcgacacctccagcttgc

SEQ ID NO: 32097 - DNA, 81 bp, Homo sapiens
tcctgggtgtcaggctctctgtcccactccagattcatggagaccatacaggaagcctctcttgactctgacctcccagga

SEQ ID NO: 32098 - DNA, 93 bp, Homo sapiens
gtccccaaggtggtgtttcctggcttgcatccctctgtgtgtctgtggccaccagtgcgccagcaacagagccctttgtggtcccacacttgg

SEQ ID NO: 32099 - DNA, 105 bp, Homo sapiens
tcatgtctttcactcaggccttgccccaagctcctagtaactgcaagtccaaatgctttatcagatttattctcctgcttgttccacaggtatgtgaaactcaga

SEQ ID NO: 32100 - DNA, 62 bp, Homo sapiens
ctgagacactgtctcgctctgtcaccaggctggagtgctggagtgcggtggtgcgatctcag

SEQ ID NO: 32101 - DNA, 88 bp, Homo sapiens
gggatccccctgtttcagtcactgtgtcaatacctttgtgatagtgccaggaggtgcatcccaatttgctgacattaacttggggtct

SEQ ID NO: 32102 - DNA, 85 bp, Homo sapiens
ggctgtaggctccctcaggctgcctgcctgtgtccctcaaccttgacagcaggttctggcagacaacctggcatctcttacagtc

SEQ ID NO: 32103 - DNA, 83 bp, Homo sapiens
atggaactcccaggaatctgaaagggtctgtgtcagttgttatttaatatttgaagaccatcttatatagctgagagttccat

SEQ ID NO: 32104 - DNA, 114 bp, Homo sapiens
ttagactttgaaaagtcaggggttatgatgtaaaactgaagaaaacaattgacaatataatttttttaaaagtcagcatttaagctaatagcagactgtctttacgtcttctaa

SEQ ID NO: 32105 - DNA, 95 bp, Homo sapiens; identical to SEQ ID NO: 68

SEQ ID NO: 32106 - DNA, 93 bp, Homo sapiens; identical to SEQ ID NO: 69

SEQ ID NO: 32107 - DNA, 97 bp, Homo sapiens
agggaagaaagaacttgattatttcagagaagagacagaggaaccttggtttccctcaaggtcttaagtctggagtacctgtcacttctgctgacct

SEQ ID NO: 32108 - DNA, 68 bp, Homo sapiens
tatatatatatatgtgcatgtgtgtgtgtgtgtatatatatgtgtgtgtgtgtatatatatatatgta

SEQ ID NO: 32109 - DNA, 65 bp, Homo sapiens
ttgcagaccctgggtcttgtcagaaggctgtgtccccaaggctcctctggatggtcctcctgcaa

SEQ ID NO: 32110 - DNA, 77 bp, Homo sapiens
gcttgtttctctgactgtgcctctgaatgataaaacaagcatgtttggggccatgaggacgcatttcaaagagtagc

SEQ ID NO: 32111 - DNA, 110 bp, Homo sapiens
gctgggaccacaggtgcatgccagcatggctggctaagtttctgtatttttttgtaaagacagggttttgccatgttacccagattggtcttgaacgcctgggcttaagc

SEQ ID NO: 32112 - DNA, 77 bp, Homo sapiens
aggttttttttgagacaaggtctcactctgtcacccaggctggagtgcagtggtgtgatctcagctctctgcagcct

SEQ ID NO: 32113 - DNA, 58 bp, Homo sapiens; identical to SEQ ID NO: 6617

SEQ ID NO: 32114 - DNA, 56 bp, Homo sapiens; identical to SEQ ID NO: 6618

SEQ ID NO: 32115 - DNA, 100 bp, Homo sapiens
gtttgttacacaggtaaactcaggtcacaggcaggttcgttacacaggtaaactcaggtcacaggcaggtttgttatgcaggtaaactcaggtcacaggc

SEQ ID NO: 32116 - DNA, 79 bp, Homo sapiens
cagtccaacctgggttcctcagagaagagactgtagtcctgggactgcatttcttttccgccctctccctatgtgactg

SEQ ID NO: 32117 - DNA, 56 bp, Homo sapiens
gggtgggggagctggacttggaattttttaagagatgaggtctcactctgtcaccc

SEQ ID NO: 32118 - DNA, 71 bp, Homo sapiens
agcttgcacttcgtggagctcttaggcgggctgttccacagttgtgtgtgtgtctgagtctcctgcttgct

SEQ ID NO: 32119 - DNA, 77 bp, Homo sapiens
caggaggtggagtttgcagtgagcagagattgtgccactgcactcaagcctgcgtgacacagtgagactctgtctca

SEQ ID NO: 32120 - DNA, 69 bp, Homo sapiens
ttttttgaaactgagtctcactctgtcgcccaggctggagtgcagtggtgtgatctcagtttactggaa

SEQ ID NO: 32121 - DNA, 109 bp, Homo sapiens
agtctcagtgacagagtgacatcttgcctctaatttttttttttttggagacatagtctccaaaaaaaaaaaaaaaaaaaagacatagtctcactttgttgcccaggct

SEQ ID NO: 32122 - DNA, 72 bp, Homo sapiens
ctgggcatggtgacacatgcctgtagtcccagttactcaggaggctgaggtaggaggatcacttgagcccag

SEQ ID NO: 32123 - DNA, 103 bp, Homo sapiens
gcatggtttacttatgccttagaccctcattatggagtgctgaatgcatactgtagacagatagcagagggtgccagtgaggtgagatggggcagcagcatgc

SEQ ID NO: 32124 - DNA, 69 bp, Homo sapiens
aagcagcaaggttagaaatggagagacgctcactccaactgtcactctaagtctaaagccctgttgctt

SEQ ID NO: 32125 - DNA, 88 bp, Homo sapiens
gctctaaaacatgccacatggagatttctttcttttttttttcttttttgctaggaatgttaagatctcagtggcaatggtgatgtgc

SEQ ID NO: 32126 - DNA, 100 bp, Homo sapiens
gtatatatgtatatatgtgggtatatatatgtgtgtatatatatgtgtgtatatatatgtgtgtatatatatgtgtgtgtatacatatatatatatatat

SEQ ID NO: 32127 - DNA, 92 bp, Homo sapiens
ggatttttttgtttgtgtgtagtgatgtctctgcaatgggatattttattttattttttgagacagtctctctgtcacccaggctggaatgc

SEQ ID NO: 32128 - DNA, 112 bp, Homo sapiens
tataagtaacatttgctattatcttagttgtttaattattaataatttatcctttataattaatcatattttattaatgattaggtgacgacattgattatagtttcttata

SEQ ID NO: 32129 - DNA, 116 bp, Homo sapiens
ggctacacacacacacacacacacacacacacatatgtgtgtatatatacatctgtacatatatatgtatttatacacacacactgtgatggttagttttatgtgtcaacgtggct

SEQ ID NO: 32130 - DNA, 114 bp, Homo sapiens
ggagctgtgaacaagcgactgcacttcagcctagacattagagtgagactctgtctctaaaaaaataaagtcttcaaagtccatgccaggcttggcacagtggctcacatctgt

SEQ ID NO: 32131 - DNA, 95 bp, Homo sapiens
agtgactgtggaatgcatttaggtaaaagtatagtaactatttactacagtagtaaggtaagtatagttgtatttaagtaagtatctacgttagt

SEQ ID NO: 32132 - DNA, 79 bp, Homo sapiens
tgtctcagctccagagtagctgggactacaggcacatgctaccatgcccagctaattttttgtatttttagcagagaca

SEQ ID NO: 32133 - DNA, 87 bp, Homo sapiens
tgaggcagtgtctcactctgtcacccaggctggagtgcagtggcacaatcttggctcactgcaacctctatctcctgggttcaaggg

SEQ ID NO: 32134 - DNA, 116 bp, Homo sapiens
cctgtttgttttgttttttggttttgttttgtttttttgagatggtgtctcactctgtcacccaggccagagtgcaatggcgcgatctcagctcactgcaacctctgtctcccagg

SEQ ID NO: 32135 - DNA, 72 bp, Homo sapiens
tgtctcttctaacagattggtactttttttttctaaatcagagaaaaaaagagctaccgatttgaagaaaca

SEQ ID NO: 32136 - DNA, 84 bp, Homo sapiens
cacataagtatagaagtttgtgtatgcagcgtatctgttatatatctgttctatttatatacacatacatttatatttatgctg

SEQ ID NO: 32137 - DNA, 102 bp, Homo sapiens
gcttgatagcccatttcttttcattgctgaatattattatatgatgtaccatgatttgcttatccagtcacctattgaagagtatcttggttgcttccaagt

SEQ ID NO: 32138 - DNA, 63 bp, Homo sapiens
ttgagacagggtctcactctgtcacccaggctggagtgcaatagtgtgatgatcatggctcaa

SEQ ID NO: 32139 - DNA, 105 bp, Homo sapiens
gagtattagcaaccaggaagattaaaccttttgatgttaatttgtgacagaaatcttttaattagttattttatcaagacttgagacactttctagctactgctc

SEQ ID NO: 32140 - DNA, 74 bp, Homo sapiens
gttttccctctgggaggctggagtctgagctgctgtggtctgtcacacagacactgcctccctaagtgactgac

SEQ ID NO: 32141 - DNA, 80 bp, Homo sapiens
ttttttgtgagacccagtctcactctgtcactctatcgcctaggttggagtgcagtggtgcgatcttggcttacagcaaa

SEQ ID NO: 32142 - DNA, 104 bp, Homo sapiens
tatatatatatatatgtatgtatgtgtatatatatatgtatgtgtgtatatatatatacatacacatacatatatatatgtatgtgtatgtgtatatatgtata

SEQ ID NO: 32143 - DNA, 107 bp, Homo sapiens
agtggttgatggctttggctcctttttctaaattttgtaagtaaatttttcaaaaaatatattttggtatatttatatacaggatgaactaaggtctcagcgattaa

SEQ ID NO: 32144 - DNA, 108 bp, Homo sapiens
tgagagtggaattgagtggtgtgaacgtgttgggtttcataagtctattctgtttgtttagtattaaactttttttttctcagtcacacacacacaatcgtgttctca

SEQ ID NO: 32145 - DNA, 97 bp, Homo sapiens
tatttgtttaggtcacagaaacattaagctaaaatgattttttttcattgtaatgatgaaaaagctttttaatgtttttgaaaagcgtatctgggta

SEQ ID NO: 32146 - DNA, 95 bp, Homo sapiens; identical to SEQ ID NO: 68

SEQ ID NO: 32147 - DNA, 93 bp, Homo sapiens; identical to SEQ ID NO: 69

SEQ ID NO: 32148 - DNA, 97 bp, Homo sapiens
cttatgaagcttagtttggctggatatgaaattctgggttgaaaatttttttctttaagaatgttgaatattggcccccactctcctggcttgtagg

SEQ ID NO: 32149 - DNA, 73 bp, Homo sapiens
cgatcctacatgaatggatttatctgtgttccagtaaagctgtatttatttataaaaacatccagtgggatgg

SEQ ID NO: 32150 - DNA, 100 bp, Homo sapiens
tacctctctgaagtgctctggagagactgggggcagatgggaggtggaattatatcacactgggtgtacatcagaatttctggagtcaaggagattggta

SEQ ID NO: 32151 - DNA, 76 bp, Homo sapiens
gcatagtggttcatgtactttgggaggctggggtagaaggatcagtttaacccaagagttcgagaccagattgtgc

SEQ ID NO: 32152 - DNA, 110 bp, Homo sapiens
gtttagaattttgtcaactgttatttctgcatcaattgaaataatcatatggtttttccatttcattttgttaatgtgatgtattacatcaattgatttcatatttgaac

SEQ ID NO: 32153 - DNA, 58 bp, Homo sapiens
tgagctggggtctcactctgtcacccaggctggagtgcagtggtgtgatctcatctca

SEQ ID NO: 32154 - DNA, 56 bp, Homo sapiens
gctttaattgagtaggttgctatgatggaaacattaaggtagcttacctaatgagc

SEQ ID NO: 32155 - DNA, 62 bp, Homo sapiens
tgagatggaatctcactcactctgtcgcccaggctagagtgcagtggcacgatctaggctca

SEQ ID NO: 32156 - DNA, 83 bp, Homo sapiens
aatttagctcagtttctgcccctctgtgactctctggaacacgtctgtaagatggtcagccagaaggaaagaaacggcaaatt

SEQ ID NO: 32157 - DNA, 101 bp, Homo sapiens
taggattggaaacatgtagtacctgtggactgaaccacatagatttttttttaaagtttgtgagtttatgacctttgtactttgtgcaagttgtagttgtg

SEQ ID NO: 32158 - DNA, 217 bp, Homo sapiens
atatatacgtatatatacatatatgtgtatatacatatatgtatatacacatatatgtatatatatgtgtatatacacatatgtgtatatatatgtgtatatacatatatgtgtatatatatgtgtatatacatatatgtgtatatatatgtgtatatacatatatgtgtatatatatgtgtatatacatatatgtgtatatatatatacacacaca

SEQ ID NO: 32159 - DNA, 187 bp, Homo sapiens
gtgtatgtttgtgtctatatgcatatatgtatatgtgtgtatatatacatatatgtatatgtgtgtatatatacatatatgtatatgtgtgtatatatacatatatgtatatgtgtgtatatatacatatatgtatatgtgtgtatatatacatatatgtatatatgtgtgtatatatacatatatg

SEQ ID NO: 32160 - DNA, 230 bp, Homo sapiens
atactatatatggtgtgtgtgtgtatatatatatactatatatggtgtgtgtgtatatatataccctatatatggtgtgtgtatatatatatatacacactatatatggtgtgtgtgtatatatatactatatatggtgtatatatatacacactatatatggtgtatatatatatatactatatatggtgtgtgtgtgtgtgtgtatatatatatatatatatatatat

SEQ ID NO: 32161 - DNA, 112 bp, Homo sapiens
tgtcttgacagagattaacgtttcttcataggcagggtcttgttttttattattttctttgtacacacaggacaccttgaatagagggtaaaggaaatcaatcacttggaca

SEQ ID NO: 32162 - DNA, 73 bp, Homo sapiens
gagatggagtctcactgggtcactcaggctggaatgcaacggcatgatcttgactcactgcaatttccacctc

SEQ ID NO: 32163 - DNA, 98 bp, Homo sapiens
taagaattcaaaacaacttttgccaatctgataagcatatctcatttttattttatagttccttaggtggagaaggtttttatatgttttgactcttg

SEQ ID NO: 32164 - DNA, 107 bp, Homo sapiens
gtgtgcttacttcactgcaaagtattttttggggttaggggtaaattttttttttttcagcttctagattcaaggggtacatgtgcaagtttgttacttaggtatat

SEQ ID NO: 32165 - DNA, 140 bp, Homo sapiens
acctgttaggagctgggctgcacagcaggaggttagtgagcaaggcttcatctatatttacagccactctctgccactcacattatgtctgagctctgccttctgtcaggtcacagtggcattagattcctataggagtg

SEQ ID NO: 32166 - DNA, 86 bp, Homo sapiens
gacctttgtctgattggtcctctgcttgttgggggaccagcccggtccacacacagcagagtcagcactggtcagtgggagaggtt

SEQ ID NO: 32167 - DNA, 118 bp, Homo sapiens
ataattagcctgcactggtattctgtttggcaaaggtctagagagagcaggcatgaattgcctgttgttataaaagtgttgttttgcacacaggagactaatttttcggttgtattgt

SEQ ID NO: 32168 - DNA, 115 bp, Homo sapiens
gtggataggtttgcactgttgagatcacatacttctttgacttttgttgttgttattttttattattatacttttaagttctagggtacatgtgcataatgtgcaggtttgttac

SEQ ID NO: 32169 - DNA, 77 bp, Homo sapiens
atatgtatataatgctatatattctgtacattatgtattatgtatatagtgtatatacatatatattatgtatatat

SEQ ID NO: 32170 - DNA, 95 bp, Homo sapiens; identical to SEQ ID NO: 68

SEQ ID NO: 32171 - DNA, 93 bp, Homo sapiens; identical to SEQ ID NO: 69

SEQ ID NO: 32172 - DNA, 152 bp, Homo sapiens
tcatctgtgtgtgtgtgtgtatatgtatatgtgtatgtctatatgtatatacatatatatgtatatacatatatatgtatacatatatatgtatacatatatatacagatgaatatatacagatgaatacatatatatattatacatatata

SEQ ID NO: 32173 - DNA, 58 bp, Homo sapiens
tgagtcagagtctcactctgtcacccaggctggagtgcagtggtacgacctcggctca

SEQ ID NO: 32174 - DNA, 74 bp, Homo sapiens
gtatgatatatatacacacatacatattatatatatacatgtatattactatgtatgtatgtatatgtatatac

SEQ ID NO: 32175 - DNA, 91 bp, Homo sapiens
tacatgtatccatcaaagagaaacctgctgttattggctgtagagtagttaatcaataattctgtttttctttatgatattgggtagggta

SEQ ID NO: 32176 - DNA, 103 bp, Homo sapiens
catgtgcttattggtattatttgtatttttcattttttattatactttaagttctggggtatatgtgcagaatgtgcaggtttgttacataggtacacacgtg

SEQ ID NO: 32177 - DNA, 79 bp, Homo sapiens
tcagatgattgggtgttgcagggggacggggcttttatttttggtttccaccgttttctgtgactgcatcttcttttga

SEQ ID NO: 32178 - DNA, 116 bp, Homo sapiens
ttatctataatctcctttagaacggaatcaatcgtgcaaatttggttctaggctgacagttgaaagtcaagactttgtaagtaaaatccttctgttctgtaggtatattattgtaa

SEQ ID NO: 32179 - DNA, 117 bp, Homo sapiens
ttagaggccatttaaatatctatatataaaggtacaatatgtaatatctgtttatcaatatataaaaacagatgtgtgtttgtgtgtttcaacggggaaatgaggaattgctggtag

SEQ ID NO: 32180 - DNA, 146 bp, Homo sapiens
atacatacacacacatatacatatacatgcatttacatatatgtatatgaaaatgcacatatatattttcatatatatagaaaatacgtatatatgtgtatatgtatatgtgtatgtgtatacatatatatatatatataaatatg

SEQ ID NO: 32181 - DNA, 112 bp, Homo sapiens
gattaaagactaaacatccagtaacataggtgtggattttctttcttttttttttttttttttttgagacagagtcactctgtcgcccaggctggagtgcagtggtgtgatc

SEQ ID NO: 32182 - DNA, 93 bp, Homo sapiens
gacagagcgagactccgtctcaaaaactaaataaataaaaataaaactttttttgtttgttttgttttgtttgagacagagtctcgctctgtc

SEQ ID NO: 32183 - DNA, 90 bp, Homo sapiens
ccacccatggagaggcagagtgtatagaatttctcattagactcattctctgattctcgtgtttactctagtttcttgtaatgtaggtgg

SEQ ID NO: 32184 - DNA, 95 bp, Homo sapiens; identical to SEQ ID NO: 68

SEQ ID NO: 32185 - DNA, 93 bp, Homo sapiens; identical to SEQ ID NO: 69

SEQ ID NO: 32186 - DNA, 67 bp, Homo sapiens
gagatggagtctcgctctgtcacacagactggagtgcagtggtgtgatctcggctgactgcaacctc

SEQ ID NO: 32187 - DNA, 148 bp, Homo sapiens
gtattccatatatatatgtgtatatatatatgtgtgtgtatatatatgtgtatatatgtgtatatacatatgtgtgtgtatatatatgtatatatgtgtgtatatatatgtgtgtgtatgtatatatatatatgtatatatatatcac

SEQ ID NO: 32188 - DNA, 111 bp, Homo sapiens
gattaaagactaaacatccagtaacataggtgtggattttctttctttttttttttttttttttgagacagagtcactctgtcgcccaggctggagtgcagtggtgtgatc

SEQ ID NO: 32189 - DNA, 90 bp, Homo sapiens; identical to SEQ ID NO: 32183

SEQ ID NO: 32190 - DNA, 95 bp, Homo sapiens
tgccagctctcatccccggggaccacttgagcatctttttttttttttttttttttgagacagagttttgctcttgttgcccaggctggagtgca

SEQ ID NO: 32191 - DNA, 83 bp, Homo sapiens
gtatatatatgtacatacatatgtatatgtatatatatacacacatatatgtatatgtatatatgtatacatatatatatgta

SEQ ID NO: 32192 - DNA, 58 bp, Homo sapiens; identical to SEQ ID NO: 22164

SEQ ID NO: 32193 - DNA, 83 bp, Homo sapiens
ggcttggtgctgactgttgacagggtgctcaccagggccccatcagggctcttcgtttgctcttctcacgggacagcacagcc

SEQ ID NO: 32194 - DNA, 85 bp, Homo sapiens
tgttcaacttcttgcagagaacagccacctcctctgtgactgaatgtcttcaacattgtgtggctctcacagtgcctgttgtaca

SEQ ID NO: 32195 - DNA, 71 bp, Homo sapiens
agttgaaaatcagccattctctctctgcctcaggccatttgtttgtgggagagcaatcgttgaaagaaact

SEQ ID NO: 32196 - DNA, 117 bp, Homo sapiens
gtaagcttgagggtaggtcaattgagatgacacagtctgaggaataaaaagaaaaaatattttctttaaatgtagagttgtgtagacctgcaagagaccacaaatgtacaagcatac

SEQ ID NO: 32197 - DNA, 89 bp, Homo sapiens
tgttaacgcttcaggtgaaggaaattatgggtttttgttttttttttttttgagacagagtctcattctgtcacctaggctggagtaca

SEQ ID NO: 32198 - DNA, 113 bp, Homo sapiens
gagttttttggatgcatgtatttaaattggggatatatgtatatattttatgcaaaatgacttcatattatttgcattgttcagtagcttattttcctgattaagttgaatac

SEQ ID NO: 32199 - DNA, 100 bp, Homo sapiens
ggttttaagcagaggtgtgatatcattagatttggttttgaaagatcatctcctgacagagcagagaatgcatgggaaacgcgcaagctgtgaataggct

SEQ ID NO: 32200 - DNA, 94 bp, Homo sapiens
ggccacgatgacatccaaagtgcatcttaagagggcgcttttcctggaagtttctaggaaacctctctttgtatttcattgttagaattgggcc

SEQ ID NO: 32201 - DNA, 114 bp, Homo sapiens
tttcatcaccagctcaaatcacttcattccccaccctcagagaacaatgactgctgagtcatttaatatttgaggcaaaaaaaggaacatgttataaccagcaaatctttgaaa

SEQ ID NO: 32202 - DNA, 58 bp, Homo sapiens
atgcatgtatatatgtatatatgtgtgtgtatatatatgtatacatgtgtgtgtgtgt

SEQ ID NO: 32203 - DNA, 91 bp, Homo sapiens
tgggattacagatgtgtgccaccacaccctgctaatttttgtatttttaaagtagagatggggtttcactgtgttggccaggctggtctcg

SEQ ID NO: 32204 - DNA, 81 bp, Homo sapiens
agtgctgggattagagaagtgagccttttttttttttttttttttttttttgagagggagtctcactctgtcgcccaggct

SEQ ID NO: 32205 - DNA, 166 bp, Homo sapiens
ttggtctaggagaaatgcaaatgattgctgtcttgtaggaaagattatcccctaagtcatctttttttttttctttttttgagatggagtctctctctctgttacccaggctggagtgcagtggcatgatcttggctcattgcagcctccgcctcccaggttcaag

SEQ ID NO: 32206 - DNA, 92 bp, Homo sapiens
gggtcttttagaatcaacaaagactttcagattccttctcatgtcgctcagcatggaagatgtttttatatctatatgaacacaaaaggcct

SEQ ID NO: 32207 - DNA, 74 bp, Homo sapiens
gtttgcacagacccactgattcactgtctgtgtagcacccgtcagcattcaggcactgaattggggattaaaac

SEQ ID NO: 32208 - DNA, 145 bp, Homo sapiens
gccctttgcaataccctccccctcctttttctgtgtggcagatgagaactgtattttttttttttttgagattcaatctcactctgtcacccagactggagtgcagtggcacaatcttggctcactgctatctctgcctcccggg

SEQ ID NO: 32209 - DNA, 106 bp, Homo sapiens
gagtaggttattacaggggacctggaagatacagggctagtgtatatttctgtatttttaaccagataaatgcagtgcttctcttctccacattcctttcctcctc

SEQ ID NO: 32210 - DNA, 90 bp, Homo sapiens
ggcattagactgtcctaaggagcatgtaacctagatccctcgcatgcagagttcacagtagagtttgtgctcctatgagaatctaatgcc

SEQ ID NO: 32211 - DNA, 58 bp, Homo sapiens; identical to SEQ ID NO: 6967

SEQ ID NO: 32212 - DNA, 103 bp, Homo sapiens
agctttccatggctctcttgtacttgctctgtgtctctatgtgattcctcctgccatgtcatgacacagcagtaaggtccttacatgaccccagcaccatgct

SEQ ID NO: 32213 - DNA, 85 bp, Homo sapiens
tgtttaaggaattcagtggtgaggtctgggaaatgacttgctgagcttgtcagctcactcactgacccactcaaattcctgaaca

SEQ ID NO: 32214 - DNA, 108 bp, Homo sapiens
gtagcttgttggagttagaaagggctttaggaatcacacagtctaactgtctccttttacaggccgggaagctatggttaagagaagctctgactcaccctcagccac

SEQ ID NO: 32215 - DNA, 120 bp, Homo sapiens
agtcgtctttggcaaatagcaagagatctatttaaagctgtcctttagatctttttttgttttttgagaaagaggcttgctgtcacctaggctggagtgcagtggcacagtctcagctca

SEQ ID NO: 32216 - DNA, 100 bp, Homo sapiens
gtctattcatttggggataataggggtactgggttgaatagtttacccccaaaatttatgtcagcctaaacctcagtatatgaatttatttggagataga

SEQ ID NO: 32217 - DNA, 75 bp, Homo sapiens
ggtgaggagaaaggttggttttgtttcttcattttactttttttttttcaagagacaggatctcactctgtcacc

SEQ ID NO: 32218 - DNA, 79 bp, Homo sapiens
tgagaccgagtctcgctctgtcacccaggctggagtgcagtggcacaatcttggcttactgcagcttctgcctcctggg

SEQ ID NO: 32219 - DNA, 60 bp, Homo sapiens
tatgtatatgcatacattagtgtatacatttatgtatatatataggtatgtgtatatata

SEQ ID NO: 32220 - DNA, 179 bp, Homo sapiens
tatagatatttatatattatgatgtttacatattatatgagcatatattatctattgtttatatataagtatatataatatattgtttgtatatttaactttatattatattgtttatatattgtaagtatattatacatattatatataagtatatatataagcatacataatgtata

SEQ ID NO: 32221 - DNA, 95 bp, Homo sapiens; identical to SEQ ID NO: 580

SEQ ID NO: 32222 - DNA, 93 bp, Homo sapiens; identical to SEQ ID NO: 69

SEQ ID NO: 32223 - DNA, 113 bp, Homo sapiens
ggtgcatagtggtccacatatgtgaaaagaagtctttttaggaaatctaaatatcatttttttttccaggacagagtctttttttgtcacctaggctggagtgcagtggtgcc

SEQ ID NO: 32224 - DNA, 110 bp, Homo sapiens
cttggaagttagaagcaagatggagtcgattaaattagatctctttcactgtctcagtcatacttttgcaaaggcggtttcaagatttagacctatttctgtgacccgag

SEQ ID NO: 32225 - DNA, 84 bp, Homo sapiens
gcatacagtatatatgtgtattcatgtattttgataccaaaatgagtgtttcatgtaaatatatatacaattatgtatgctgtg

SEQ ID NO: 32226 - DNA, 101 bp, Homo sapiens
cacatatatatgtgtgtgtatatatgtgtgtgtgtatatacatgtgtgtatatatatatatatatatatatatatatgtatataaaatataaaatgttgtg

SEQ ID NO: 32227 - DNA, 97 bp, Homo sapiens
cctttttggatggttcattgctaatgtaaagaaatgcaaccaatttttgtattttaactttacattttgttgaattcatgttttagttctaacaggg

SEQ ID NO: 32228 - DNA, 102 bp, Homo sapiens
tagtatggtagtatatatataccttatatatactgtatatatacttaattgtgtatatatatatgtacttaaatgaaggtatattagtctgttctcatgctg

SEQ ID NO: 32229 - DNA, 90 bp, Homo sapiens
gtatatgtatatactagcatatagtatatatgtagttttatatatataatatatgtatatatgtgcgtgtgtgtgtgtatatatatatac

SEQ ID NO: 32230 - DNA, 114 bp, Homo sapiens
gttttatatacatgtatgtataaaatacgtgtgtgtgtatatatatgtgtgtatatatatacatatatacacacatatatatacatatatacatatatatacacatatatatac

SEQ ID NO: 32231 - DNA, 103 bp, Homo sapiens
gaaaatttcagtttttcagtttccaagttaaagcctgagttatacacacaaaacagtgtgaaaactgtcaaagcttcttggttaattgaccttcataattttt

SEQ ID NO: 32232 - DNA, 106 bp, Homo sapiens
atactcactgagttttggaagaataaaaatgaaaaataataaaactgtcaaatatgtttgacagttttattatttttcatttttatttcaaaaactcagtgagtat

SEQ ID NO: 32233 - DNA, 58 bp, Homo sapiens
tgagaccgagtctcgctctgtcacccaggctggagtgcagtggtgtgatctcggctca

SEQ ID NO: 32234 - DNA, 58 bp, Homo sapiens; identical to SEQ ID NO: 30286

SEQ ID NO: 32235 - DNA, 118 bp, Homo sapiens
gtgctgggattacaggcgtgagccaccgtgcccggccttctttattattttaaaaatatttttaattttcataagtttaggggtggaaatggttttggttatatgatgaattgtacag

SEQ ID NO: 32236 - DNA, 138 bp, Homo sapiens
tgtcatatatatatatacgtatatacatatatgtacatatgtgtatatatatgtatatgtatatacatatacacatgtatatatgtgtatatatatgtgtatatgtatatgcatatacacatatatacatatatttat

SEQ ID NO: 32237 - DNA, 72 bp, Homo sapiens
tgtgtatatgcatatacatatacacatatatatacacatatatacatgtgtatatgtatatacatatacata

SEQ ID NO: 32238 - DNA, 71 bp, Homo sapiens
ttgtttttgagccagagtcttactctgtctcctaggctggagtgcagtggtgtgatctcagctcactgcaa

SEQ ID NO: 32239 - DNA, 104 bp, Homo sapiens
ccattatatacatatggaataatatatataagaaatatatataaatatatattccagtatatatataattatatataatgataaatatggaattctatatatgg

SEQ ID NO: 32240 - DNA, 182 bp, Homo sapiens
atatatatataatatatgtatatatacatattttatatacatgtatatattatatatgttatatatgtatatatacatattttatatatgtacatattttatataatatatgtatatgtctatatacatattttatatatgtatatattttatataacatatataggtggttagatatctat

SEQ ID NO: 32241 - DNA, 116 bp, Homo sapiens
tctaacacccaacacacatctgccatctgactgcacctgcgtctgtctctgcctgactttgtgaggcctgggacaatcggtgtcctaagaaacccagctcctctgggtgtgctaga

SEQ ID NO: 32242 - DNA, 100 bp, Homo sapiens
cccctggtgtttcagaaacaattccctgtcacagtctgtgccacacacatatacacaggctgttctattttttggggtgctcttctttgacacttggtgg

SEQ ID NO: 32243 - DNA, 119 bp, Homo sapiens
tgcttaggattgtcttggctatacagactcttttttggttccatatgaaatttaaagtagtttttttcttattctgtgaagaaagtcaatggtagccagatggggatagcatttaatct

SEQ ID NO: 32244 - DNA, 58 bp, Homo sapiens
tgaggtggagtctcactctgtcacccaggctggagggcagtggcgtgatctcagctca

SEQ ID NO: 32245 - DNA, 101 bp, Homo sapiens
ctctaccatgggtgtgttctgctgaaatactggggccatgctcactcttgctctcactcactgagtactggggtcctagagcagggatgtcactcacagag

SEQ ID NO: 32246 - DNA, 111 bp, Homo sapiens
taagaatgtatacattgtggctgaaggcatgaggatgtgtaatttttaaacaaaatgtgtttttattacatttttattaccaaagcttactattcaatgtactctgtcttg

SEQ ID NO: 32247 - DNA, 109 bp, Homo sapiens
ccttatttatacaactagttagtatagactgctgtgtagcaaatgaagtgtggggagatcgcagtgagaacagagtgaccatgctaggtggttgtgattcagaataggg

SEQ ID NO: 32248 - DNA, 63 bp, Homo sapiens
aggcacagactgtatctgtctcacatatttatgtgtccctagaatttagaacattctgtgtct

SEQ ID NO: 32249 - DNA, 121 bp, Homo sapiens
atatatgtgcacatatatattttttatatatgtgtatacatacatttattatatatgtgtacatatacatatataaaataaaatggctgatacacatatatgtgtatatatacacatatat

SEQ ID NO: 32250 - DNA, 157 bp, Homo sapiens
atatatgtatacatatatatgtgagtatacatatatacacatatatatgtatacatatatatgtgagtatatatatatacatatatatgtatgtgtatacatatatctgtgagtatatatatacatatatatgtgtgtatatacatatatatacgca

SEQ ID NO: 32251 - DNA, 58 bp, Homo sapiens
tgagatggagtctcgctctgtctcccaggctggagggcagaggcgcgatctctgctca

SEQ ID NO: 32252 - DNA, 85 bp, Homo sapiens
gagattacaggcacctgccatcatgcctaactaatttttatatttttagtagacagggtttcaccatgttggtcaggttgatctc

SEQ ID NO: 32253 - DNA, 216 bp, Homo sapiens
tacatatatgtattatataacacatatgtatatatgtattatataacacatatgtatatatgtattatataacgtatatgtatatattatataacgtatgtgtatatatgtattatataacgtatatgtatatatgtattatataacgtatatgtatatatgtattatacaacgtatatgtattatataacatatatgtgtgtgtatacatatatg

SEQ ID NO: 32254 - DNA, 119 bp, Homo sapiens
atatgggcatcttccttccagggctgtttctggacattttaaaaatggatttcaaatgataatttttaagtccttagaaaagaaagagagaaaatggggtgtagtggaacatgtctgta

SEQ ID NO: 32255 - DNA, 90 bp, Homo sapiens
cattgatctgggctacatatatatgtgtatatatatacacatatatatgtgtatgtgtatatatatatatgtgtatgtatatatgggatg

SEQ ID NO: 32256 - DNA, 89 bp, Homo sapiens
tgatgactgcccaaacattacaattgcattgtcacaaataatttgccttgcattttatttgtgtgtgtgcatttgcatgtgtaatctca

SEQ ID NO: 32257 - DNA, 95 bp, Homo sapiens
acttttatatatatgtgtatatatatatatgtgtgtgtgtgtgtatatatatgtgtgtgtatatatatgtgtgtgtatgtgtatatatatatata

SEQ ID NO: 32258 - DNA, 84 bp, Homo sapiens
tatatatatatatatacacacatatatatgtgtatatatacacatatacatacatatatatatgtgtgtatatatatatatatg

SEQ ID NO: 32259 - DNA, 93 bp, Homo sapiens
ccagtgcttgtatgatgtctttctggtcattttgtttatctgaagctcatctcggaaagagttttcaggaagaactcatggaaagaacattgg

SEQ ID NO: 32260 - DNA, 117 bp, Homo sapiens
catattgtggttgtacatgtgattgaagggatgcagtcaacatacatatatacatatgatatgtatatatgtgtgtctatgtatgtatatctatctatatcgtgctctatgtatatg

SEQ ID NO: 32261 - DNA, 63 bp, Homo sapiens
atatgattctgagtcatatccctataacaatgggtcatatccctatatgattctgggtcatat

SEQ ID NO: 32262 - DNA, 93 bp, Homo sapiens; identical to SEQ ID NO: 69

SEQ ID NO: 32263 - DNA, 85 bp, Homo sapiens
acccctgaagttgagagtgagctgagagagagtgaggaattcaaggatgacccctcttctaccccatgtcaccaaaggcaggagt

SEQ ID NO: 32264 - DNA, 112 bp, Homo sapiens
tccgagacttagactaacaaagcggccatatacatccattggcacaaattatagggttattatttacttatacatttttgggacagtgtatcgctctgttgcccaagctgga

SEQ ID NO: 32265 - DNA, 129 bp, Homo sapiens
atataggtatagctatgtgtgtgggggtgtgcatgtgtgtatacatatgtgtgtgtgtgcatgtacatgtatgtgtgtgcatggatatgtgtatgtgtgtgcatgtgttgtgtgtgtgttgtcacatat

SEQ ID NO: 32266 - DNA, 64 bp, Homo sapiens
tcagtccagtggaagagaggcccctatcaccggtgtcagtgggtctctctggccctgactggat

SEQ ID NO: 32267 - DNA, 58 bp, Homo sapiens
tgaggcggagtctcgctctgtcacccaggctggagtgcagtggtgtgatctctgctca

SEQ ID NO: 32268 - DNA, 131 bp, Homo sapiens
gcatatatgtgcacatgtgtgcatgcctgtggatgagcatgtatttctgtgtgtttgtgtatgtgtgcatgtgcatgtatgtgttacgcatgtgtatgcatgtgtgtgtgtctaagtgtgtctgattatgt

SEQ ID NO: 32269 - DNA, 96 bp, Homo sapiens
gaggcaggattgcttgagcccaggagttcaaggctgtagtgggctatgatggtaccactgcactccaacctggttgtcacggtgagattctgtctc

SEQ ID NO: 32270 - DNA, 90 bp, Homo sapiens
tggtatgtgcttgtgatctcagcttctcgggaggcagaggtagaagtatcacttaagcctgggagactgggatcacaccactgcactcca

SEQ ID NO: 32271 - DNA, 114 bp, Homo sapiens
ttcacagggcactttggtaaacatcctttcagacgtgtgcatgtgtgtatgtatgtatgtatatatacataggtacgtacttgcatctatgtaaaagaggaagagtgttaggaa

SEQ ID NO: 32272 - DNA, 58 bp, Homo sapiens
tgagatggagtctcactctgtctcccaggctggagtgcaggggcacgatctctgctca

SEQ ID NO: 32273 - DNA, 74 bp, Homo sapiens
gtcagctgtcgtcttaggtcaggtttcctcagatgcagactctgagaccctgagtctgagtagcgagtgggggc

SEQ ID NO: 32274 - DNA, 100 bp, Homo sapiens
tgtgttgtacattacagatatatatacatttacaagttgttatatatgtatattatatgtaacataataaatcatatatttgtattatctttctgacata

SEQ ID NO: 32275 - DNA, 189 bp, Homo sapiens
atagatatatatgcatatatacatacatatatagatatggatatatatacacatgtacatatttatgtatctatatatacatatatagatatatatctatatagagagacttatctatatatacatatatagatatatatctatatatgtatatctagatatagagacatatttatatatgcatatata

SEQ ID NO: 32276 - DNA, 249 bp, Homo sapiens
gcatatatatatatatgtaatatatatccatatatatgcatatatatgtaatatatatctatatatgcatatatatgtaatatatatctatatatgtaatatatatccatatatatgcatatatatgtaatatatatctatatatgtaatatatatgcatatatatgcatttatatgtaatatatatctatatgtaatatatatctatatatgtaatatatatccatatatatgcatatataaatatgt

SEQ ID NO: 32277 - DNA, 88 bp, Homo sapiens
gatatatattacatatatatgcatatatagatatatattacatatatatgcatatatatggatatatattacatatatatatatatgc

SEQ ID NO: 32278 - DNA, 92 bp, Homo sapiens
ttgtccaggaccgaataattcacacaacgtatggatatgtacattaaagagaacagaatgtgcaactgcaagtgtacagaatttggggacaa

SEQ ID NO: 32279 - DNA, 108 bp, Homo sapiens
gctgagattaaaggtgtgagccactacagcaggtgtatttgtttatttttgacacgtaaaaattttttatatttgccgggtgcggtggcttacgcctgtaattccagc

SEQ ID NO: 32280 - DNA, 119 bp, Homo sapiens
gccaggtatagtggtgcacacttgtagttccagctacttgggaggctgaggtagaaggttcacttgagcccaggaggtcaaggctgcagtgagtcatgatgacactactgtactccagc

SEQ ID NO: 32281 - DNA, 106 bp, Homo sapiens
gctgggactacagatgcctggcaccatgcctggctaattttcatagttttagtagagacagggtttcattatgttggccaggctggtctcgaactcctgacctagt

SEQ ID NO: 32282 - DNA, 61 bp, Homo sapiens
agctggacagaggagctcggttttttttttagagatggagtctcactctgtcacccaggct

SEQ ID NO: 32283 - DNA, 112 bp, Homo sapiens
agtagccaacagtggtagtgtgtgcctgcagtcccagctaccaggaggctgaggtgggaggatggtttgagcccaggagtttgcggctgcagtgagctatgatcgtgccact

SEQ ID NO: 32284 - DNA, 58 bp, Homo sapiens; identical to SEQ ID NO: 315

SEQ ID NO: 32285 - DNA, 77 bp, Homo sapiens
aggttttggcatgagattctctctcagtctgacttttcagtaggagaaaggaagctgatgaggaatccagttctcct

SEQ ID NO: 32286 - DNA, 82 bp, Homo sapiens
tatctctatatctgtatctatctatatctgtatatatatctacatctatatctatgtatatagatatacagatatagacata

SEQ ID NO: 32287 - DNA, 148 bp, Homo sapiens
tgggcaatatagtgagacctcatttctagttaaaaaaatttttttattatgaattttttttttttttttgagacggactctcactctgttgcccaggctggagtgcagtggtgcaatctcggctcactgcaatctccgcctcccaggt

SEQ ID NO: 32288 - DNA, 102 bp, Homo sapiens
gtgtgtgtatatatatataaagtatgtgtgtatgtgtgtatatatatataatgtgtgtgtttatatacacatacatatgtatgtatacatacacacatatat

SEQ ID NO: 32289 - DNA, 114 bp, Homo sapiens
ccaaagtgttgggattacaggcgtgagccaccttgccctgccagaattgttttatttatttatttacatttttatttattttctgacagagtctcactctgttgcccaggttgg

SEQ ID NO: 32290 - DNA, 96 bp, Homo sapiens
ctatagtgccctccttaaaggtactcctacttcgtatgtatgtatgtatgtatgtatgtatgtatgtattccatagcccagcaccttgcaacatag

SEQ ID NO: 32291 - DNA, 98 bp, Homo sapiens
tgtcattatttaagacctaggttttttttttttttggtacaccactaaagccttacctgtgtgccactcattgagacttcagtcactgtatcttgaca

SEQ ID NO: 32292 - DNA, 115 bp, Homo sapiens
gttgtatagttttaactcctatgttagtccttgatctatttttaagtcaatttatatatatgatgtgaggcgtcaaagaaaagtagagcctgacagtagttaaagcagtaaaagc

SEQ ID NO: 32293 - DNA, 82 bp, Homo sapiens
atagatgcaacagtagaaataaccttgtgtactcagtttacacacagttgtgtctgtgtgtgcatgtgtatgtatgaagagg

SEQ ID NO: 32294 - DNA, 78 bp, Homo sapiens
cttgtggggtcagtggcaattctgtatttcttttttttttttttttttttgagatggagtcttgctctgtcgcccagg

SEQ ID NO: 32295 - DNA, 83 bp, Homo sapiens
ctggtgacatgtactaattctgggcatagactcatccagcttggcctgggcagagggagtttacacagaaaaagagaaaccag

SEQ ID NO: 32296 - DNA, 115 bp, Homo sapiens
cataaaaattagccaggcgtggtggtgtgcacctgtactcccagctacttcgggggctgaggtaggtggatcacttgagaccaggaggcagaggttgcagtgagctgagattgtg

SEQ ID NO: 32297 - DNA, 288 bp, Homo sapiens
tgtacatatttatgtgtgtgtatataaatatgtacatatttatgtgtgtgtatataaatatgtacatatttatatgtgtgtatataaatatgtacatatttatatgtgtgtgtatataaatatgtacatatttatatgtgtgtgtatataaatatgtacatatttatatgtgtgtgtatataaatatgtacatatttatatgtgtgtgtatataaatatgtacatatttatatgtgtgtatataaatatgtacatatttatatgtgtgtatataaatatatttatata

SEQ ID NO: 32298 - DNA, 178 bp, Homo sapiens
aaatatacatatttatatgcgtatataaatatatacgtatttatatgcatatataaatatatacgtatttatatgtgtgtataaaatatgtacatatttatatgtgtgtatataaatatgtacatatttatgtgtgtgtatataaatatgtacatatttatgtgtgtgtatataaata

SEQ ID NO: 32299 - DNA, 117 bp, Homo sapiens
tacatatttatatacacacatataaatatgtacatattttatacacacatataaatacgtatatatttatatatgcatataaatacgtatatatttatatacgcatataaatatgta

SEQ ID NO: 32300 - DNA, 96 bp, Homo sapiens
gtactaatatgcttatataagtactatattaatacataagcttattagtacttatatattgatatagtacttattactatatatgtatatctgtat

SEQ ID NO: 32301 - DNA, 95 bp, Homo sapiens; identical to SEQ ID NO: 68

SEQ ID NO: 32302 - DNA, 93 bp, Homo sapiens; identical to SEQ ID NO: 69

SEQ ID NO: 32303 - DNA, 119 bp, Homo sapiens
acttgcaatttttgtgtgtgtgtgtgtgtgttttgcttcttaccatagtttttgctttttttttttttattatactttaagttttaggctacatgtgcacattgtgcaggttagttaca

SEQ ID NO: 32304 - DNA, 79 bp, Homo sapiens
ggcctgaatttgttgtcatggtctgccaactctcacacacagtgacttgcccaaccagatgatgacacagtttggggtc

SEQ ID NO: 32305 - DNA, 107 bp, Homo sapiens
acttactgtcacttttgaactgataggtgcagaatccccaattttgtctgtttgtttttattttttaacagagtctctgtctgtcaactaggctggagtgcagtggt

SEQ ID NO: 32306 - DNA, 106 bp, Homo sapiens
tcgatgctttaccttacactctgttttcactatcagtgacaggactgttaagtatttatttacttttagtctggtctagtgatttgctctataaacacaacctcga

SEQ ID NO: 32307 - DNA, 68 bp, Homo sapiens
ctgagctgagatctcaccagcttggagtgtagaccctgtctgagtccctgagtgagaccctgtctcag

SEQ ID NO: 32308 - DNA, 262 bp, Homo sapiens
cgtgtatgtgtgtatgtgtgtgtatatatatatgtgtgtgtgtgtgtgtgtgtgtatatatatatgtatatatatatatgtatatatatatgtatatatatgtatatatatatatgtatatatatatatgtgtatatatatgtatatatatatgtatatatatatatgtatatatatatgtatatatatatatgtatatatatatacgtatatatatatatgtatatatacatatgtatatatatatatatgtatatatatg

SEQ ID NO: 32309 - DNA, 106 bp, Homo sapiens
tcaagtgtttgtaatgattcatatcaactggttgtaatatgtgaaaaggctacagtatttttaaatatttctagggtgtgtggtgaactgtttttgaatactatgg

SEQ ID NO: 32310 - DNA, 82 bp, Homo sapiens
cactaaaatactgtttatttttctatttttaggatttttatttttaagcattctggtgatagagtttcatagtttttcagtg

SEQ ID NO: 32311 - DNA, 58 bp, Homo sapiens; identical to SEQ ID NO: 47

SEQ ID NO: 32312 - DNA, 110 bp, Homo sapiens
tcatgtaagtcaatttcttacaatagatctgtatatgtaaatgtgtatatttatatacatattgtacttttacatgtatgtgacacctatgaatggatggcttcttttgg

SEQ ID NO: 32313 - DNA, 112 bp, Homo sapiens
atctgcatatggagcattctctaagacagataatatgataggccacaaaactagtctcaatttttttttattatactttaagttttagggtacatgtgcacaacgtgcaggt

SEQ ID NO: 32314 - DNA, 115 bp, Homo sapiens
ggctttcccccatggcctggattgctaggttccccagtgggagtgcatatcctggaggcagttgtctccctctcacactctggggagtggctggctcatggtgtaggctgcagcc

SEQ ID NO: 32315 - DNA, 86 bp, Homo sapiens
aatgaaaggttgagttctgagattgatgaaggaggtccaggaaaactcaggagacctcaccctcttcccaggaattagatttggtt

SEQ ID NO: 32316 - DNA, 142 bp, Homo sapiens
taatagagaaaacaaattgaggaggggtgtttatgggaactctacttcccatttttcttttcttttttcttttttttttttttcttgagacagggtcttgctctgtcactcaggctggggtgcagtggtgtgatcatggctc

SEQ ID NO: 32317 - DNA, 86 bp, Homo sapiens
gtatgctggactttgagaatgctgccagtgctggattttgatgttttttttttaagtatgttggttcacttctggcatccagttac

SEQ ID NO: 32318 - DNA, 62 bp, Homo sapiens
gtcactgtgctctacttggagtctggctctctgtgtcatccccaggcagagagtttggtgac

SEQ ID NO: 32319 - DNA, 169 bp, Homo sapiens
tcatatatagatatatctatatatgatatatatagcaatagatatatatagatatatataatatatgattctatcatatattatattttatatatctatcatatattatattttatatatctatcatatattatgttatatataatatctatcatatattatgttatat

SEQ ID NO: 32320 - DNA, 58 bp, Homo sapiens; identical to SEQ ID NO: 1215

SEQ ID NO: 32321 - DNA, 81 bp, Homo sapiens
tatatatgcacattatatatatgtgtgcatatgcatctatatgtatatgcatacatatacatgtatatatgtgtgtatatg

SEQ ID NO: 32322 - DNA, 58 bp, Homo sapiens; identical to SEQ ID NO: 1725

SEQ ID NO: 32323 - DNA, 104 bp, Homo sapiens
ttgtgagaaacaaggctagataaggttttactgtaagttaactgatgacagtgaactctccctgacctttactcatagaatcattgtcattgatctaatttaca

SEQ ID NO: 32324 - DNA, 98 bp, Homo sapiens
atttatttatttgtttctttctccttctttcagtatatcaatatttatttgatatgctctaggctggaacagttgggaagtgtttaacctgaataaat

SEQ ID NO: 32325 - DNA, 110 bp, Homo sapiens
cacaggcttaaagaggtaaacaacatgttttttttttttgttttttttttcccccatttggatatgtgaaatgagagcctggaaaagaagtagcatcccttggccgggtg

SEQ ID NO: 32326 - DNA, 117 bp, Homo sapiens
tctcatcaagtaacaagtgggccaatgatttgcttaattgcttatatcataggttttttttttctaaaatacaaggtatttagtcaagcatttattacactctttctttgtgtgagg

SEQ ID NO: 32327 - DNA, 121 bp, Homo sapiens
atacatatatatatgtatgtgtatatacatatatatatgtatgtgtatatacatatatatatgtatgtgtgtatatatatatagatagatagtatgtgtatatatatgtgtgtgtgtgtat

SEQ ID NO: 32328 - DNA, 88 bp, Homo sapiens
acagacattattcaaagcagaaaaacaagggaagtatcttacagatggaattttttttttttttttttgagacagagtattgctctgt

SEQ ID NO: 32329 - DNA, 90 bp, Homo sapiens
agcttggggaagagtgagggtcagaggaaagagcactcaaaaggaagccaggaagctgaggctccctctctggctctgccacctcaagct

SEQ ID NO: 32330 - DNA, 104 bp, Homo sapiens
atgaggatttcacattgatgttcatccgggatattggcctgttttcttttttttttttgttgtgtctcttccaggttttggtatcaggatgatgttggcttcat

SEQ ID NO: 32331 - DNA, 110 bp, Homo sapiens
tcagccttccaagtagctgggactacaggtgtgtgccactgtgcctggctaattttttcatttttgttttgtagagatagggtgtcgctttgttgcccaagctggcctga

SEQ ID NO: 32332 - DNA, 145 bp, Homo sapiens
tgtatatgtgtatatgcatatgtgtatatgtgtatgtgcatatgtgtatatgtatatgtgtatatatgtatatgtatatgtgtatatatacatgtatatgtatatgtgtatatatacatgtatatgcatatgtatatgtatatat

SEQ ID NO: 32333 - DNA, 66 bp, Homo sapiens
tgtatatatgcacatgtatatatgtatatatgcacatgtatatatgtatatatgtatatgtatata

SEQ ID NO: 32334 - DNA, 214 bp, Homo sapiens
atacatacatacatacatacatatatatatgtgtgtgtatatatacatacatattatatatatgatatatatgtatatatatacacatatgtatacatgtacatatatatgtatatatacatatgtatatatgtacatgtatatatgtacatatacatatgtatatatacatatgtacatatgtatatatgcacatgtatatgtatatatgtat

SEQ ID NO: 32335 - DNA, 117 bp, Homo sapiens
atatgtacatgtatacatatgtgtatatatatacatatatatcatatatataatatgtatgtatatatacacacacatatatatatgtatgtatgtatgtatgtatgtatgtatgta

SEQ ID NO: 32336 - DNA, 80 bp, Homo sapiens
gtggaacacgccctaagtgactgtagacagactggattcatttctggtccctgtctctttccagctctgtggccttaagc

SEQ ID NO: 32337 - DNA, 71 bp, Homo sapiens
ccccctgcacttggtagatttctatgctgtgggaaactatagtgatttacttgatgccagaaaactggggg

SEQ ID NO: 32338 - DNA, 116 bp, Homo sapiens
gatctatttttaaaataccacagttcaatatttctagaatctgttctttcaaaatataatacatttattttatattctgtatctgatagttctaatattgggagtttatgtagatc

SEQ ID NO: 32339 - DNA, 110 bp, Homo sapiens
ggaacatctgaattatgcccttctagctttttaaaactttttaattttttaatttgagactgagtcaggctggaagtgaagtggcatgatctcagttcactgcaacctcc

SEQ ID NO: 32340 - DNA, 56 bp, Homo sapiens; identical to SEQ ID NO: 324

SEQ ID NO: 32341 - DNA, 108 bp, Homo sapiens
ggcataggaggattttagactggttagagggagaagttcctcagggggacgaattattgaatatctgtgtggctgttcttttattccaacatgattaactttgatgct

SEQ ID NO: 32342 - DNA, 149 bp, Homo sapiens
tgtggctgttttattaagattgcctggtagatacttggtgagcattttttttcttttttctcttttttttgagacagagtctcactctgtcgcccaggctggagtgcaatggcgcaatctctgctctctgcaacctccgcttcccgggc

SEQ ID NO: 32343 - DNA, 78 bp, Homo sapiens
gttgcttttttttggagccagggtctcactctgtcacccaggctggagcgcaatggtgtgatcttggctcactgtagc

SEQ ID NO: 32344 - DNA, 93 bp, Homo sapiens
gagctttttgttatgtttctttctttcttttttttgagacagagtctcgctctgtcttgtccaggctggagtgcagtggcatgatcttggctc

SEQ ID NO: 32345 - DNA, 202 bp, Homo sapiens
ttatatatactcaaggggtacatagggatggtttgatatatatatatgtatatatatggtatatggtataccatccctatgtatatatatataaaccacccctatgtgtgtgtatatatatgatatatggtataccatattatatatgtgtgtatatatggtatatggtataccatatatatatatatatatatatggtata

SEQ ID NO: 32346 - DNA, 119 bp, Homo sapiens
tgtgtatatatgtatgtatatatgtgtatatatatgtatgtgtatatatgtacatatatgtgtgtatatgtatatatatgtatatatgtgtatatatgtgtgtatatatatatgcacac

SEQ ID NO: 32347 - DNA, 201 bp, Homo sapiens
tatatctatatgtatgtatatatgtgtgtgtatatatatgtatatatgtatatgtatgtgtatatatatgtatatatgtatgtgtatatatatgtatatatgtatatgtatgtgtatatatacatgtatatatgtatatgtatgtgtatatatacatgtatatatgtatatgtatgtatatgtatatatgtatatgtgtgt

SEQ ID NO: 32348 - DNA, 103 bp, Homo sapiens
tgcaatctgtattgtgcatggagtggtcaggtttgtttcataagtgtgtatgtatatatttgctttttaattcaaaactgctatgatgtataaagcaaaagta

SEQ ID NO: 32349 - DNA, 106 bp, Homo sapiens
tcttaagaaaagaactcagataagacaagtaggtttcaaatttcaagactgggagggtcaacttttagtttatttttaaaaacctgtaaatatcagttctgtggga

SEQ ID NO: 32350 - DNA, 110 bp, Homo sapiens
actgctatcctagtggttgaagtctgaacacactcagtctctgtgacttttggtttaaatttctaattcccaggacagagagactgattggtccactatgggtaagttgt

SEQ ID NO: 32351 - DNA, 99 bp, Homo sapiens
agcctgggcaatacagtgagacttcatctctataaaaaagtaaaataaataataataaattttttttttgagatggagtctcgctctgtcacacaggct

SEQ ID NO: 32352 - DNA, 89 bp, Homo sapiens
gaactgtggaattctgcccattgatggaatagcttaagtttttttaaattgatttttaaactgtcaccagctagcagtctccacatatc

SEQ ID NO: 32353 - DNA, 70 bp, Homo sapiens
ttgttattgttgagagtctcgctctgtcacccaggctggagtgcagtggcatgatctcggctcgttgcaa

SEQ ID NO: 32354 - DNA, 69 bp, Homo sapiens
ttgtggttacatagtagatgtatatatatacatctactatgtatatatatacatctatggagttcatga

SEQ ID NO: 32355 - DNA, 58 bp, Homo sapiens
tgagacagagtctcgctctgtcgctcaggctggagtgcagtggagcgatctctgctca

SEQ ID NO: 32356 - DNA, 117 bp, Homo sapiens
gataaagcaaacgtagtgtgtgtgtgtgtgtgtgtgtgtaattatatatatacttagacatacatatatatatttagaaacacacacacatatacatgaatactattcagcttggtc

SEQ ID NO: 32357 - DNA, 114 bp, Homo sapiens
tatgtatgtgtgtgtgtgtatatgtctacacatatatacatatatatgtatatacatatacatatatatgtatatgtatatatgtgtgtatatatgtatatacacacatatata

SEQ ID NO: 32358 - DNA, 99 bp, Homo sapiens
gtgtgtgtgtgtatatatgtgtgtatatacatatatacacacatatatacatatacatatatatgtatatgtatatacatatatatgtatatatgtgta

SEQ ID NO: 32359 - DNA, 95 bp, Homo sapiens; identical to SEQ ID NO: 68

SEQ ID NO: 32360 - DNA, 93 bp, Homo sapiens; identical to SEQ ID NO: 69

SEQ ID NO: 32361 - DNA, 103 bp, Homo sapiens
gctgctgcctagttggggcatgaccaaggattttttaaatttgatcttctgtttagcaaaaagctatgggtctcagagttagaagaccccaatgaggaggagt

SEQ ID NO: 32362 - DNA, 79 bp, Homo sapiens
cccagtaactttatttttattctactttgctacacaggctactggagttaatgtcctataggtacttgaggatgctggg

SEQ ID NO: 32363 - DNA, 85 bp, Homo sapiens
gcttccttccagagcattgagaccacccagggtctgcttgtagcttgtttggcttaggatggcacactgcactggaagtcacagc

SEQ ID NO: 32364 - DNA, 58 bp, Homo sapiens; identical to SEQ ID NO: 1868

SEQ ID NO: 32365 - DNA, 99 bp, Homo sapiens
atctgagggcctgacttctcatgggccccagctgctttttttctgtataatttagattagaagttgactgcagtgaatgccatgctgtatctctcagat

SEQ ID NO: 32366 - DNA, 92 bp, Homo sapiens
gtgtgtatatacacatatagagagaggtatatataggtgtatatatatgtatatataggtatgtgtacctctatatacctatatatacatac

SEQ ID NO: 32367 - DNA, 111 bp, Homo sapiens
ggctatttgggctcttttttggttccatatgaatttcatgattttttttctagttctgtgaagaatgattgtggtattttgatggaaattgcattgaatttgtagattgct

SEQ ID NO: 32368 - DNA, 111 bp, Homo sapiens
catttgtgagactgctttttgtatttggccttttttaaaaaatttattttattattattatactttaagttttagggtacatgtgcacaatgtgcaggttagttacatatg

SEQ ID NO: 32369 - DNA, 119 bp, Homo sapiens
ttacaatcatggcagaaggtgaagggcaagcaaggaccctcttcacatggcagcaggagagagaacagtgagagaaggaggaacttgcccaacacttatgaaaccatcagatcttgtga

SEQ ID NO: 32370 - DNA, 62 bp, Homo sapiens
tcaggaggctgaggtaggaggatgacttgaactcaggagttcgatgctacagtgagtcttga

SEQ ID NO: 32371 - DNA, 117 bp, Homo sapiens
acatagaacctaatcccatattcttgccgcttactatttttcactgtgaatttttttttttaaatagtggaactcgaagtctctagatggtggggatcatgacttaggttttgatgt

SEQ ID NO: 32372 - DNA, 107 bp, Homo sapiens
gtgcacattactttccaaatctatgcatataaaataggtgatttttttttttttttttgagacggagtctcgcccagtcgactgctcaggctggagtgcagtggcgc

SEQ ID NO: 32373 - DNA, 85 bp, Homo sapiens
tgagactgagtctcactctgtcgcccaggctggagtgcagtggtgcgatctcaactcactacaacctccgcatccagggttcaag

SEQ ID NO: 32374 - DNA, 71 bp, Homo sapiens
ttgtttttgagccagagtgtcactctgtcacccagatgggagtgcagtggtgtaatctcggctcactgcaa

SEQ ID NO: 32375 - DNA, 73 bp, Homo sapiens
gtcatcctgtcttcccaatgtgagtctctccgtgtcactattggatacacaatcttgggcaaggtcaggaggc

SEQ ID NO: 32376 - DNA, 87 bp, Homo sapiens
ttttgcttttattacttatgtatgtatgtatgtatgtatgtatgtatgtatgtatgtatgtatgtatgtatgtattttgagacggag

SEQ ID NO: 32377 - DNA, 117 bp, Homo sapiens
cagtgctgaagctggaatggaagatgaagaattgttatactggaaacatcttttttttttttttggtttgtttgtttttggaaacagggtctctctctgcccttcaggctggagtgc

SEQ ID NO: 32378 - DNA, 101 bp, Homo sapiens
agccatactggcattttcttctctcttcctgagtatttatttatgtaatgacaagtcttgctctgttacccacgctggagtgcaggggtgccattgtagct

SEQ ID NO: 32379 - DNA, 69 bp, Homo sapiens
gccagtgcttctagtcgaggagcagggacctggcaggaaagccctgtcccaccctcactgtcactgtgt

SEQ ID NO: 32380 - DNA, 106 bp, Homo sapiens
ccataaatatttcagaatgcagtgctaaaagataaagatactccatttctttttttcttttttgagatggagttttgctcttgtcgcccaggctggggtgcagtgg

SEQ ID NO: 32381 - DNA, 102 bp, Homo sapiens
ctgtgcctgacttttttttctcttgccaggattcctttttttataaaaaaaaaaaaaaaaaaagaaagaaagaaagagaaagaaaaagaaagaaatgcatag

SEQ ID NO: 32382 - DNA, 71 bp, Homo sapiens
ggcttcccagtctcactcacggtcagtttccttagccctcataaaggcacttttgtgcgtggatagaagcc

SEQ ID NO: 32383 - DNA, 112 bp, Homo sapiens
tggttctttcactacctttggccttggataaattgctcaccctctctcaccctgttttctcatttcgtaagctcagagggtctataagtgccctttaagcagtgacagtcca

SEQ ID NO: 32384 - DNA, 112 bp, Homo sapiens
ggaatcaggacaggacatctggtctctaataagtttactttttcttttctttattttattttatttttatttttatttttatttttttgaggcagagtctcgttctgtcacc

SEQ ID NO: 32385 - DNA, 84 bp, Homo sapiens
gagtctcactccctcagtcagattgaattgcaatggcatgacctcggctcattgcaacctccacctcctgggttcaagagattc

SEQ ID NO: 32386 - DNA, 116 bp, Homo sapiens
cccgctttgcctccaaagtactgagattacaggcatgagccatgtgcccagccaagatttttttttttcttttgaggcaaggtctggctctgttgcccagactggagtgtagcagg

SEQ ID NO: 32387 - DNA, 114 bp, Homo sapiens
agtcatttatgagcctctcaattttctctgttagataagttagattcttttttttttttgagacagaatctcactctgtcgcccaggctggagtgcaatggcgcaatcttgact

SEQ ID NO: 32388 - DNA, 118 bp, Homo sapiens
acccctgagtgaacaaagaatgaaacttgaaccatcacccttatggggtcagaatattatttatttttaggatagagaataggggcaatgctatggatttagtttctgttccaggagt

SEQ ID NO: 32389 - DNA, 115 bp, Homo sapiens
atagttttagatattccttgcattttacatgtttactatttgcctgaaaggtattttttttttttaggcctactaagaaaacatctaatgaaaagaacaaggtactgtaaaaaat

SEQ ID NO: 32390 - DNA, 80 bp, Homo sapiens
cctgggctcaagtgttttttttgttttcatttttatttatttatttattttgagatggagttttgctcttgtcacccagg

SEQ ID NO: 32391 - DNA, 79 bp, Homo sapiens
ggctgtcccactctctgaatgtaaaagaccagatgctggagtacatgtagtcatttgtcctttgccttctggttcagtc

SEQ ID NO: 32392 - DNA, 65 bp, Homo sapiens
gcagctcagtgatatagagcttccaatgtagccataagctagaagtcaatatgttgtagagatgc

SEQ ID NO: 32393 - DNA, 83 bp, Homo sapiens
tgaaacggagtctcactctgtcacccagcaggctggagtgcagtggtgtgatctcgtctcactgcaacctccatctcctgggt

SEQ ID NO: 32394 - DNA, 58 bp, Homo sapiens
tgagacagagtctcactctgtcacccaggctggcgtgtagtagtgtgatctcggctca

SEQ ID NO: 32395 - DNA, 117 bp, Homo sapiens
tacggtgggcaggagggacatgtgtgattatgtgagatttggggattatgtttttttaataaataaatatttatctttatatatacagaggaatacatgttcatacatgtaattata

SEQ ID NO: 32396 - DNA, 153 bp, Homo sapiens
gtgtgtgtgtgtgtgtatgcccacatgcttgggggtgtataatttatatatgaatatacatacatacaaatatttatatatgaatatatgtacatacatacatccatatttgtatataaatctatgtggttatgtatgtttactaagtaatac

SEQ ID NO: 32397 - DNA, 97 bp, Homo sapiens
cctttctcacaaggagtgagtccaagtattttgtagtctttatatatgttttgtacatcataagcagtatatatgggtgtttccatgtgcaggaagg

SEQ ID NO: 32398 - DNA, 92 bp, Homo sapiens
catatatgtgtgtatatatgtgtatatatgtgtgtatatatatgtgtgtgtatatatatgtgtgtgtatatgtgtgtgtatatatatatatg

SEQ ID NO: 32399 - DNA, 58 bp, Homo sapiens
ctgtgcacagagtatcccaggatggctggaaaaggctggggctgtctgtgtctcacag

SEQ ID NO: 32400 - DNA, 90 bp, Homo sapiens
ttagccaggcatggtggcttgcgcctgtagtcccagcttctcaggaggctgaggtacaaggatggatcgagcctgaaaggtcgaggctga

SEQ ID NO: 32401 - DNA, 157 bp, Homo sapiens
tatatacatagatatcatatatagttatatatacatatgtagtttatacatagtttatatatagttatatatataaactgtatgtaatattagtatatactatataatatatagtatataatattaatatatactatataatatatagtatatacta

SEQ ID NO: 32402 - DNA, 119 bp, Homo sapiens
atatacaactatacatagtatatgtacctatatatacacgttatatatatgtgtgtgtatatatgtatatatatagtgtgttatgtatatagagataaaatgtgttatgtatgtgtgtg

SEQ ID NO: 32403 - DNA, 99 bp, Homo sapiens
catttatcctagagtctaagcctgcagtgaacaggctaccttcccagaggtcactgtcactcacctccaggtgttagaatactttggtggataactttg

SEQ ID NO: 32404 - DNA, 105 bp, Homo sapiens
gagagaagtacacttctattatgtttgaaccagtgatgtatagaagtatctgctattgcagtttagcctacaccataatcaatacacctagaaaatgttgctttc

SEQ ID NO: 32405 - DNA, 71 bp, Homo sapiens
gtctggaagtctgagatcaaggtgtcagcaaggttggtttcttctgtggccgctctccttggcttgcagat

SEQ ID NO: 32406 - DNA, 112 bp, Homo sapiens
tctactcctataacaacaacaaccgctgcagcaacattcagatacacccactgtgaggcaggtgtgttctctctctctctgtacagttgatgtctgaaaaatgtgagttagg

SEQ ID NO: 32407 - DNA, 117 bp, Homo sapiens
cctgggccctggcccaccatgaacaagagactccacagcatctgcctgtttggggagcagagacccacactctcagagaggcttggatgtggggtccagaatccaggactctgccag

SEQ ID NO: 32408 - DNA, 75 bp, Homo sapiens
tgtgcttgtgtatgtgtactctttctagatacgtagatatatgtatatagatatagatatatagatacatgcaca

SEQ ID NO: 32409 - DNA, 101 bp, Homo sapiens
aaatatgtatgtatgtgtgtgtatatatatatgtgtgtgtatataaatatgcatgtatacacatactttatatatgtatataaaatggaaatgctatattt

SEQ ID NO: 32410 - DNA, 85 bp, Homo sapiens
aacattgaactaaccttgcattcctggaataagtctcacttagtcatagtgtactgtttttcttaatgtgaggtaggactctgtt

SEQ ID NO: 32411 - DNA, 71 bp, Homo sapiens
atatatatgtatatatgtatgtgtgcatacatatatacacacacatatgtatgcatatatatatatacaca

SEQ ID NO: 32412 - DNA, 95 bp, Homo sapiens
gtcagcatatacgtgtgagatttatataaatgtcagtatatatgtgtgagatatatatatatacatatatgtgtatatatatcacaggtactgat

SEQ ID NO: 32413 - DNA, 57 bp, Homo sapiens
gagacagggtctcactgtgtcacccaggctggggtgcattgggtgggatcatggctc

SEQ ID NO: 32414 - DNA, 115 bp, Homo sapiens
ctaattcttcaggctgatgtcatagcattttatgaattctcttttagattctttgtatttaattttagtcccacagggaatcgttttcatagctatgtcatagctatggaaagag

SEQ ID NO: 32415 - DNA, 108 bp, Homo sapiens
ctattttgggtataggataagtagaccaatattattcagcaataatatttgtattttctatgagtgttattggaaatgatgattgtggtatattcatgactattatgg

SEQ ID NO: 32416 - DNA, 176 bp, Homo sapiens
gggtctcactctgtcgcccaggctggagtgtagtggtgtgatctcagctcactgcactctcagtctcctggggtcttgtgatcttcccacctctgcctaccaggctggagtgtagtagtgtgatctcagctcactacactctcagtctcctggggtcttatgatcttcccacctcc

SEQ ID NO: 32417 - DNA, 80 bp, Homo sapiens
ggtgcactgaagcactgtctcatcccacatactattctttattttattttatttttgagacagagtctcgctctgtcgcc

SEQ ID NO: 32418 - DNA, 58 bp, Homo sapiens; identical to SEQ ID NO: 1725

SEQ ID NO: 32419 - DNA, 150 bp, Homo sapiens
caccctgtctgtgcatgtgtatacatatatatgtctgtacatgtatatatgtttctgtatatatatatatatatatatatatatatgcatatgtgtgtatgtatatcagatatgtgtgtatgtaaatatgagcattaatatgtatttgtg

SEQ ID NO: 32420 - DNA, 104 bp, Homo sapiens
gtctttctgcctacctggctttgacagggtttttgcttttttttttttttttttttttttttgagatggagtctcactctgtcgccaggctagagtgcagtggc

SEQ ID NO: 32421 - DNA, 90 bp, Homo sapiens
agatacatttaatatgtaaagatatatattttaatgtataaatatatttttatatgtaagatatatatcttaacatgatggaatatatct

SEQ ID NO: 32422 - DNA, 58 bp, Homo sapiens; identical to SEQ ID NO: 1215

SEQ ID NO: 32423 - DNA, 98 bp, Homo sapiens
tattagctagagagttgattttatttttattcccgggatagtgccatactatctttatagtttttaatcttatggaatcattcctttcctgcataata

SEQ ID NO: 32424 - DNA, 107 bp, Homo sapiens
tccaggggttcaagaccatcatgataccccatctctgtaaaataaaatttttttctttttttttttttttttttgagatggagtctcactctgtcacccaggctgga

SEQ ID NO: 32425 - DNA, 113 bp, Homo sapiens
ggagtaataagcaaagaagaagctggatgcagttgagcaacctcagaggagacagatcactgtgaggagcccactttcaactgaactggcaccagctgttctcaaagtgctcc

SEQ ID NO: 32426 - DNA, 84 bp, Homo sapiens
ctcacacgtatcttctccagagtcactaactgactcctttacatagagacattcagtgcgtgactggggaatataagtaatggg

SEQ ID NO: 32427 - DNA, 115 bp, Homo sapiens
gttttacaggcagaatatatatatatatacatacatatatatatacatatgtatatatatgtgtgtatatatatgtgtgtatatatatatatttctttttttttttttttgagac

SEQ ID NO: 32428 - DNA, 68 bp, Homo sapiens
cagttgtcctttagcatctggctgggttaggccaatgaagaccccaacagatcagtgggagcagactg

SEQ ID NO: 32429 - DNA, 72 bp, Homo sapiens
tctgccctcctctgtgcatatatatatgtgtgtatgtgtgtgtgtgtgtgtgtgtgtgtgtgtatagataga

SEQ ID NO: 32430 - DNA, 74 bp, Homo sapiens
tgtggttttatttagagacagtgtctcactgtcacccagactggagtgcagtggcaagatcttggctcaccaca

SEQ ID NO: 32431 - DNA, 95 bp, Homo sapiens
ctgtataaacagcattgtctccattgcttcattgggtcacacactgggtcacacaatgatccaaaaaagcaacggaggcaatgccatttatacag

SEQ ID NO: 32432 - DNA, 90 bp, Homo sapiens
gtgctaagataacaggcgtgagccaccgcatccagcccccatcatttaatttaaagagtggctgatgtggtctcacatagctcttagcat

SEQ ID NO: 32433 - DNA, 73 bp, Homo sapiens
gaagtgtgtgttgtgttgcttttcagcagccgggaggagtaggctctgtcagcgtctcactgccactcacctc

SEQ ID NO: 32434 - DNA, 85 bp, Homo sapiens
tggaggctgaggtaggaggatcacttgagcccaggagtttgaggctgcagtgagctatgatagtcccactgcacttcagcctggg

SEQ ID NO: 32435 - DNA, 58 bp, Homo sapiens
tgagctggagtctcactctgtcacccaggctggagtgcagtggtgtgatctcacctca

SEQ ID NO: 32436 - DNA, 68 bp, Homo sapiens
atatatttatgtatgtatgcatgtgtatatatatatatatatatatatatatatatatatatatatat

SEQ ID NO: 32437 - DNA, 81 bp, Homo sapiens
ttccaagactggaatttctgacccttcaagaatgtgaggtgtacattaattccacttctctgggtctgacattccttggaa

SEQ ID NO: 32438 - DNA, 120 bp, Homo sapiens
tcagcctcccaggtaggtaggactacaggtgcatgccaccacgccagactaattttttaaatattttgcaggccgggcatgatggctcacatctgtaatcccagcactctgggaggctga

SEQ ID NO: 32439 - DNA, 70 bp, Homo sapiens
gtttttgagatggagtctccctctgtcactcaggctggagtgcaatggtgcgatcttgactcactgaaac

SEQ ID NO: 32440 - DNA, 130 bp, Homo sapiens
tatatagagagagagctatatatctctatatatagatatagatataatggtatgatctctctctctctctatatatatatatataaagagggagagacagggtctcaccgtgtgtgtgtgtgtgtgtgtg

SEQ ID NO: 32441 - DNA, 61 bp, Homo sapiens
ggtgagaccctgtctctccctctttatatatatatatatagagagagagagagatcatacc

SEQ ID NO: 32442 - DNA, 85 bp, Homo sapiens
ttctgctacagttagcgttcagtttagacactggcagtgggtagaccactccattattttattgtctgtacattttgtggtagaa

SEQ ID NO: 32443 - DNA, 145 bp, Homo sapiens
gggtggaacaggaaagttagaaccgatgttcttcctgtctgtctgtctgtctgtctacccatttatctctttatgtcattgtttttgtttctctggagagccctaactaacacagagagaaaaggctctgaagggagatgctgtg

SEQ ID NO: 32444 - DNA, 66 bp, Homo sapiens
ggaagtttagtctctctctctctggcttttatcatcccatgaaaagagggaagaatgacttctttc

SEQ ID NO: 32445 - DNA, 116 bp, Homo sapiens
cctcccaaagtgctgggattacaggcataagctaccatgcccagccctattttttttttttaaacgaaggtgccaggcacaatggctcacacctgtaattctagcactttaggagg

SEQ ID NO: 32446 - DNA, 96 bp, Homo sapiens
gacagccctggcattgcagacacactcactagctctgtcatcttgggatgcttccagcttttgtgttggtgaattgaggtaatcatttggactgtt

SEQ ID NO: 32447 - DNA, 58 bp, Homo sapiens; identical to SEQ ID NO: 605

SEQ ID NO: 32448 - DNA, 111 bp, Homo sapiens
agagccaaaagttggtcattgtttgcaggatgtcttattcaatgtgtatttttctatatgtacatgcataggtaagtctcagagactttctgctcaaagataggtgactct

SEQ ID NO: 32449 - DNA, 74 bp, Homo sapiens
cccattagcctctctccctgtgcctctgtaaaaacagcctggtcaatagatggtaagaggccccactgagtggg

SEQ ID NO: 32450 - DNA, 111 bp, Homo sapiens
gccagatgtggttgtacgtgcctgtggtcccagctacttgggaggctgaggtgggaggatggtttgagcccaggaggcaggggttgcagtgagctatgatcacatcactgc

SEQ ID NO: 32451 - DNA, 74 bp, Homo sapiens
gcagctggtgtgcctggatgtgtgcagtcgccagaccccatacttgctcactcacacactcctagccactctgc

SEQ ID NO: 32452 - DNA, 102 bp, Homo sapiens
tgtatgtcgatgttgtatcctgaaactttactgaatttgtttttcagttctgatagttttttggtggagtttttaggtttttccaaatataacattatatca

SEQ ID NO: 32453 - DNA, 115 bp, Homo sapiens
ctgggattacaggcgtgaaccactgtgcccagcccccataattacttttttctttttttttttttttttttttttttttttggtggaggggacagaatctcgctctgtctcccag

SEQ ID NO: 32454 - DNA, 81 bp, Homo sapiens
tagctcaatgatgatgtgacttgataggcagtgcttgaatactggaatcctgaaaggttatttttcacaaacttgaggcta

SEQ ID NO: 32455 - DNA, 56 bp, Homo sapiens
gagtcagggtctcactcactcacctaggctggagtgcagtggcgccatcatggctt

SEQ ID NO: 32456 - DNA, 97 bp, Homo sapiens
tggcactaagacccttgctctctttctctcactggatgatttagtaagccctactggtgctattctattgagtggaagtgagcggctacctttgccg

SEQ ID NO: 32457 - DNA, 110 bp, Homo sapiens
cttgggcatatttcttgggttgagaaggattggacttttttttttttttaaaggatttactttatggtagagaaaggtttaatactaaaaatttgattaatataacttag

SEQ ID NO: 32458 - DNA, 56 bp, Homo sapiens
catatatacaaatgtatgcatccatatatgtatgtgtgcatgtgtgtgtgtgtgtg

SEQ ID NO: 32459 - DNA, 91 bp, Homo sapiens
catatatggatatatatatccacccaacataaatataaatatatatatatacacatacgtttatattggatggataaatatatctgttttg

SEQ ID NO: 32460 - DNA, 104 bp, Homo sapiens
attccagagagataatgctgccaggagtccaacctttcaatacgttaatttatttgtgtatttattttgagatggagtctcactgtattgcccagggctggagt

SEQ ID NO: 32461 - DNA, 58 bp, Homo sapiens
gttctgacggtggggaggtggcaggtgacttctctgtgcctcacaatctgtccagggc

SEQ ID NO: 32462 - DNA, 68 bp, Homo sapiens
cagtcatggagggtgagagtaagatgtcctctctatctcctctctctctcaccaactctatagacatg

SEQ ID NO: 32463 - DNA, 106 bp, Homo sapiens
ccactaattctgtctctgtgaaattgcctgttgtggatatcttattttattttatttttttgaaacggtgtcttactctgtcactcaggctggagcagtggcatga

SEQ ID NO: 32464 - DNA, 58 bp, Homo sapiens
tgagacagagtctcactctgtcgcccaagctgaagtgcaatggcgtgatctctgctca

SEQ ID NO: 32465 - DNA, 103 bp, Homo sapiens
gtgctgggattataggcgtgaaacaccacgcccagtctttttctttttttaaaaaataataaattaggctgagggtgatggctcacatctgtaatctcagcac

SEQ ID NO: 32466 - DNA, 60 bp, Homo sapiens
ttgagagagagtctcacactgccactcaggctggagtgcaatggtgtgatctcagctcaa

SEQ ID NO: 32467 - DNA, 169 bp, Homo sapiens
ctgttggttcttggagaaattacaagacacgttttgatcagtaggagcttaatatttttaatttaatttaattctatttttacttttttagagacagtgtctctctctgttgcccaggctgaagtgcagtagtgtgatcatagctcactgtagcctcgaactcttgggc

SEQ ID NO: 32468 - DNA, 114 bp, Homo sapiens
atcagcccagggatcagggggcaggagtggggcttttgggagagagaagagtgtgagctttacagttacacagacctgcgttcatgtcccagctctgtgattttaggaaaggat

SEQ ID NO: 32469 - DNA, 112 bp, Homo sapiens
ggatctggggctttttgttgttgtcgttgttgagacggggtctcactctgtcacccagactggagtgccacggtgtgatctctgcttacttcaacctctgcctcctggattc

SEQ ID NO: 32470 - DNA, 84 bp, Homo sapiens
aggagacaccagagagtgcactcactctctctctgcacaaatacaaagaagagatcatgtgagcacacgatatggcagccacct

SEQ ID NO: 32471 - DNA, 75 bp, Homo sapiens
gggggagtcattagtagagaattgtgcccttaaatttatttttatagttggattctgctagttaatatctctctc

SEQ ID NO: 32472 - DNA, 118 bp, Homo sapiens
agatctctatttatacatatgttacatataatttatatgtaatatataatatgtattatactacatatttatattatatataatataatttatatgtaatatatgtaaatatagatct

SEQ ID NO: 32473 - DNA, 75 bp, Homo sapiens
tatgtgtatatgtgtgtgtatgtgtatatacgtgtgtatatatgtaaatatacatatatatgtgatatacatata

SEQ ID NO: 32474 - DNA, 72 bp, Homo sapiens
ttgttttttgagactgagtctcgctctgtctcccaggctggagtgcagtggtgcgatctcggctcacagcag

SEQ ID NO: 32475 - DNA, 78 bp, Homo sapiens
ttctgtcactgcctctgagacttgagttttttattttttttttttgagacagactcttgctcggttacgtggctggaa

SEQ ID NO: 32476 - DNA, 117 bp, Homo sapiens
ctcccaaagtgcttggattacaggtgtgagccaccatgcccggccttttttttgtttgttttttgttttttgggttttttttaaagtcatggtttcgctctgtctctgaggctggag

SEQ ID NO: 32477 - DNA, 96 bp, Homo sapiens
gtgtttcctcaacctcagcaaaataaacctctaagttgactgagatctgtctcagacactttttggtttacagaagtaaggaagaaggaattgcat

SEQ ID NO: 32478 - DNA, 100 bp, Homo sapiens
actcccagtctacagaaaaatgagctggaatttatttatttatttatttatttatttatttatttgagataaggtctggctctgctgtccaggctagagt

SEQ ID NO: 32479 - DNA, 80 bp, Homo sapiens
agtgtgtgtgtgtctttaagtgtgtgcctatgtgtgtttaattggttcttcatatatttagggtcagtcacacacacact

SEQ ID NO: 32480 - DNA, 108 bp, Homo sapiens
tgttggctggagggagctggctgggggcaatgaatggaggcgaggagataggctccagactctcagtctcattgtaggctgagccacactgctcttatctgcccaata

SEQ ID NO: 32481 - DNA, 58 bp, Homo sapiens; identical to SEQ ID NO: 1240

SEQ ID NO: 32482 - DNA, 58 bp, Homo sapiens; identical to SEQ ID NO: 1391

SEQ ID NO: 32483 - DNA, 56 bp, Homo sapiens; identical to SEQ ID NO: 1392

SEQ ID NO: 32484 - DNA, 73 bp, Homo sapiens
gtcaagtgagagtctgttttactggagtcaattcttttttttttttttttttgagacagagtctcactctgtc

SEQ ID NO: 32485 - DNA, 95 bp, Homo sapiens; identical to SEQ ID NO: 68

SEQ ID NO: 32486 - DNA, 93 bp, Homo sapiens; identical to SEQ ID NO: 69

SEQ ID NO: 32487 - DNA, 108 bp, Homo sapiens
acatgtttgttttttttttgtgtgtgtgtgtgtgtatgtttttttttttattattatattttaagttttagggtacatgtgcacgttgtgcaggttagttacatatgt

SEQ ID NO: 32488 - DNA, 67 bp, Homo sapiens
ctgtgagttatgtgtgtgtacatatgtgtgtgtgtatatatatatgtacatgcacgtacgtaaatgg

SEQ ID NO: 32489 - DNA, 58 bp, Homo sapiens
tgagacagagtctcgctctgtcgctcaggctggagcgcagtggcgcgatcttggctca

SEQ ID NO: 32490 - DNA, 71 bp, Homo sapiens
ccagctttaagattacagcaggtcagactccctaagaaacggtctctgaaactctgtgatttgcatgccgg

SEQ ID NO: 32491 - DNA, 129 bp, Homo sapiens
tttctgcatgttagtgtgtgcatgtatgtttatatgcatgtgtatatatgtgtgtgaggtaatgcatctgcatgtgtgtgcatgtatgcttatatgcatgtgtgagcatgtttgagatagtgtgtgcat

SEQ ID NO: 32492 - DNA, 63 bp, Homo sapiens
gataatacatagatgcatgtgtgtgtgatacacacacacacacacacacactggaatattatt

SEQ ID NO: 32493 - DNA, 109 bp, Homo sapiens
tcttggttttagtaattgtagtgctgtcatacagcatacattcaatatatatgcttatttttaatatgtcaatgaaatgttaacacactgcttctactgagcactggga

SEQ ID NO: 32494 - DNA, 95 bp, Homo sapiens; identical to SEQ ID NO: 580

SEQ ID NO: 32495 - DNA, 93 bp, Homo sapiens; identical to SEQ ID NO: 69

SEQ ID NO: 32496 - DNA, 69 bp, Homo sapiens
gtagtgaacgagcacagtgagggcagacagggacagacttgctgctcaccttgtgttcattatcactac

SEQ ID NO: 32497 - DNA, 94 bp, Homo sapiens
gaactctaaaaccatgtgtgtgcctgtgtgtgtctctatgcacacatatacacatgtgcttacacatacacaagtatacatcaacttattgttc

SEQ ID NO: 32498 - DNA, 109 bp, Homo sapiens
tcagcctcccaagtagctgggactacaagtgtgcaccaccatgctcagttattttttttttaagtttattttttgtacagacagagtctcactatgttgaccaggctgg

SEQ ID NO: 32499 - DNA, 73 bp, Homo sapiens
gtaacagcgtgaggtatgtcacaaagtggtatgttattatttttttttatgaggtggaatctcacactgtcac

SEQ ID NO: 32500 - DNA, 100 bp, Homo sapiens
tcccttctgcctatgagcctatacaaacaaaacaagttagttacttccaagatacaatgggggtatagacattgggtaaatactctcattccaaaaggga

SEQ ID NO: 32501 - DNA, 95 bp, Homo sapiens
gtgatcagaaaactcatcttaagattaaaaaaaaaggtgcagcacagggtttatttttattttttattttttgagacagagtctcactgtgtcac

SEQ ID NO: 32502 - DNA, 113 bp, Homo sapiens
tgggctgttgataatataaagttgcttaatctgaatggtggttacacagacattttcttcttgtgaaaacgtatcaagttgtataattacgtgttatcttatatacatgttta

SEQ ID NO: 32503 - DNA, 119 bp, Homo sapiens
tctgtcacccaggctggaatgcagtggtgtgatctcagctcactgcagcctctgtctccctggctcacacgatcctcctgcctcagcctcctgaatagctgggactacaggagtgtgcc

SEQ ID NO: 32504 - DNA, 83 bp, Homo sapiens
ggtaaacatttttctgagaccataacaagacagggcattcaaaagtagaatcttattctttttgtttcagaaatgtttgaacc

SEQ ID NO: 32505 - DNA, 91 bp, Homo sapiens
agcctgtgagtataatgttactgctttaggcaagtttttgtttttttttaacatgatactgcccattacatgtatattatatttgatggtt

SEQ ID NO: 32506 - DNA, 75 bp, Homo sapiens
ccagtaaccttccctcactttgtagttttcgggtgcctggtgtgtcctgggtaagagaagagtgacagcagctgg

SEQ ID NO: 32507 - DNA, 118 bp, Homo sapiens
cagaaagtgggttcttaacagacactgaatctgctggcaccttctttaaaacatttgtaatttcattttcatttttagagacggggtatcgctttgtcttgctttgtcacccaggctg

SEQ ID NO: 32508 - DNA, 61 bp, Homo sapiens
gtgactatcaggtgttgggaggcagttgtcacactgtctctctaaaatagtaattggtcac

SEQ ID NO: 32509 - DNA, 61 bp, Homo sapiens
cattggtaaccagaggatggagagagagtgtctctctttctgtggctctgtcttacgagtg

SEQ ID NO: 32510 - DNA, 100 bp, Homo sapiens
ataattgtacatttatatatatatttatatatatacatatagatctatataaatctatatctatatgtatatatagatgtatatgtatatgtatatgtgt

SEQ ID NO: 32511 - DNA, 113 bp, Homo sapiens
aaatctttcatagtgtttctgtgtatgctgtacagcctttaatacagaatttatttttaattaagtgcttggtgaagtgctataaatgtaacatcgaatgaaatgaattattt

SEQ ID NO: 32512 - DNA, 110 bp, Homo sapiens
ttgcaaatttaaattgcctataagacaagggcttcttcacttatctatagctttttttttttttttttttgtgatggagttttgctcttgtcgcccaggctggagtgcaa

SEQ ID NO: 32513 - DNA, 112 bp, Homo sapiens
aaacatgcatcctaagagtttctagaatgcagcagttggaatttttactttatttactttatatacttctaattctgacttttatatcgtaagacaattggtgtgtctgttt

SEQ ID NO: 32514 - DNA, 64 bp, Homo sapiens
tggcggctcaagtctgtaatccaagcactttgggaggctgaggtaggtggatcacttgaggcca

SEQ ID NO: 32515 - DNA, 77 bp, Homo sapiens
ggatggtgaggaggagtgggcaggatggagcttatgctgagcatttggtcatgcgtatttgtttttctgttgctacc

SEQ ID NO: 32516 - DNA, 103 bp, Homo sapiens
gtccattaggaatgtgtattttcttcccaatattttaatgtatatacaaatgtgtacatatttaaatatgtaaaggaatatatatattcctatataaatggat

SEQ ID NO: 32517 - DNA, 94 bp, Homo sapiens
gctgtttctggccagtgtgagactcctctgtgaacaatatttgtttttgagatcactgggctttctaatacattcccagagctacccccacagt

SEQ ID NO: 32518 - DNA, 80 bp, Homo sapiens
agtagagggtcctgaagaggcactagaagaggaagaagattttcttcctagttctgtgtatctctctctgcttcttcctc

SEQ ID NO: 32519 - DNA, 106 bp, Homo sapiens
atgtgtgtgtatatgtaaatacgtatatatgtatatatacatatatacgtaaatacgtatatatgtatatatacatatatatgtgtgtgtatatatatgcatatat

SEQ ID NO: 32520 - DNA, 92 bp, Homo sapiens
ctcgagccattcactgaaatgggtgatataatgctagatggttgttaagaaattaacatctagctgtctctaccccaatttcccagtttggg

SEQ ID NO: 32521 - DNA, 82 bp, Homo sapiens
gctattgggttccctaggacagaactctttattttattttattttatttttgagatggagtctcgctctgtcacccagtggc

SEQ ID NO: 32522 - DNA, 74 bp, Homo sapiens
attgaattgatgtctcccacccttgtagaggggctccctgtgtgtctctgtgtgtcttgaggcatgctttcaat

SEQ ID NO: 32523 - DNA, 98 bp, Homo sapiens
tcagacctaggttcatttgtgctactctcattggttatctagctcaattgaacttgatgatgtgaaatagttagcagcacaatccagatcttaactga

SEQ ID NO: 32524 - DNA, 64 bp, Homo sapiens
tatatgcacatatatatgtatgcagatgtgtgtatgaagctgtgtgtgtgtgtgtgtgtgtgtg

SEQ ID NO: 32525 - DNA, 95 bp, Homo sapiens
agaggtccttcacatcccttgtaagttggattcctaggtattttattttctttgaagcaaatgtgaatgggaattcactcacgatttggctctct

SEQ ID NO: 32526 - DNA, 113 bp, Homo sapiens
tccattatgttttcttcagcttataaataggattttaaattgtgcagaagaatttttatcttttttatcatttagttctgttttattgcatcatagaaaatgtgatttgtgga

SEQ ID NO: 32527 - DNA, 88 bp, Homo sapiens
gtctctcaatgtttttactatgttggatctggttgtgaattttattgtgtttatataattagatttaattgagcttagattggtggac

SEQ ID NO: 32528 - DNA, 132 bp, Homo sapiens
ccagaattttgggagactgaggcaagaggatttcttatttatttatttttttttaagacagagtctccctctgtctcccaggctggagtgcagtggcgtgatttctgctcactgcaagctccgcctcctggg

SEQ ID NO: 32529 - DNA, 110 bp, Homo sapiens
aattgtttgttttttaaatacacattctcaagattttggtgttgctttttctcaggatttttctctgggaacatgtttatcttttcctgtagctggaatgacactcaatt

SEQ ID NO: 32530 - DNA, 86 bp, Homo sapiens
gctcattcgtcccccacactccctgactgcctgggaatccccttggggttaatggagtgaacagtaatgggagtcgtagaccatgc

SEQ ID NO: 32531 - DNA, 58 bp, Homo sapiens
tgagacggagtctcactgtgtcactcaggctggagtgcagtggcacaatgttgtctca

SEQ ID NO: 32532 - DNA, 97 bp, Homo sapiens
aggtgttgaaatttaatggtcattgtggtggtattaagaggtggggtcttttttttctttgttaatatagctagtggtctattgatcatgttcatct

SEQ ID NO: 32533 - DNA, 79 bp, Homo sapiens
gcctctgacatggtgactcaagcctacagtcccagctacttgggaggctgaggtaggaggatcacttgagctcaagggt

SEQ ID NO: 32534 - DNA, 109 bp, Homo sapiens
tatatgtgtatatatatatacacacatatatatgtgtatatatatatacacacatatatatatgtgtgtatatatatatatatacatataattttatttgtttgtttgt

SEQ ID NO: 32535 - DNA, 66 bp, Homo sapiens
gcctggcatgtggtaggtgcttgtttactggtaccttttccactagactgtaagctccatgaaggc

SEQ ID NO: 32536 - DNA, 101 bp, Homo sapiens
tgtaggctattgatttaagggactgagaaaaaagtggggtaagggaggattcactctctttctgtcagactgtttttgagctgtgtcgttggtctcctgca

SEQ ID NO: 32537 - DNA, 98 bp, Homo sapiens
aaagtaagaaattgatattgctacactctgcatatataaatatataatatataatatataaatacatatgcagagtgtagcaatatcaatttctcttt

SEQ ID NO: 32538 - DNA, 60 bp, Homo sapiens
ctttctttttattgggtgggagagggggctgagtctcattctgtcacccaggctggagag

SEQ ID NO: 32539 - DNA, 91 bp, Homo sapiens
tgagttattcacagccaactaattttgcaaacaaaattataaaaacccttttaatttttttgttgtaaaacatgtagttgatgtgaactcg

SEQ ID NO: 32540 - DNA, 95 bp, Homo sapiens; identical to SEQ ID NO: 68

SEQ ID NO: 32541 - DNA, 93 bp, Homo sapiens; identical to SEQ ID NO: 69

SEQ ID NO: 32542 - DNA, 63 bp, Homo sapiens
tccaactctcacactctgtgattctaccacgagagttggaagacagggtaggggagagaagga

SEQ ID NO: 32543 - DNA, 108 bp, Homo sapiens
ggttccaggtgattccgatgtgctggttgagaaattgtgcttgctatgaagaacccctgttattcacagaacagagagaccaacacgcatattccaaaccttttctcc

SEQ ID NO: 32544 - DNA, 156 bp, Homo sapiens
gacattaagcttggtaaggacatgggctttgatggaggggaccacacctcattcatttctattattattattattatgagacagtgtctctctctgttgcccaggctggagtgcagtggtgcagtctcagctcactgcagccttgaatttctgggc

SEQ ID NO: 32545 - DNA, 73 bp, Homo sapiens
tcggcctcccaaagtgctgggattacagccatgagccactgtgcctggctgcttctttgctttttgaagctga

SEQ ID NO: 32546 - DNA, 101 bp, Homo sapiens
agttctgcttcacctgtttcctgcctgtctgtgtgtctctggaagccccaggtcaccaggacaaatttttctgaccccgtaggctattgccaagcttaatt

SEQ ID NO: 32547 - DNA, 58 bp, Homo sapiens; identical to SEQ ID NO: 1673

SEQ ID NO: 32548 - DNA, 84 bp, Homo sapiens
acatatatgtatatatgtatatacatgtatatatgtgtatatatgtatatatgtatatatctgtgtatatatgtatatatgtgt

SEQ ID NO: 32549 - DNA, 99 bp, Homo sapiens
gatattacacctttgagtggtttgacctcaactatttgtttttgtttttaagacaaagttggatacctttaggtaaaagtatacagttgtgtaactatc

SEQ ID NO: 32550 - DNA, 117 bp, Homo sapiens
catcacgccttactccaacatgaaagctttcaagtaatgatatctttagcagagatacaaatatgtttttattttcctaaagttgaaagtgtatttggaataagtcaggggatgatg

SEQ ID NO: 32551 - DNA, 80 bp, Homo sapiens
gtgactaatttgtgatgtctgctgtgatgtgtgagtgtatgtgtgtgcacacagcatcattcttgacacagatttgtcat

SEQ ID NO: 32552 - DNA, 85 bp, Homo sapiens
tgtttgatcgggaacaggctctcctcgtgccacctgtcaggggaatgcctttgccagagaagagggtctgctccctgctcccaca

SEQ ID NO: 32553 - DNA, 72 bp, Homo sapiens
ctgggtgtggtggctcatgcctgtaatgccaacactttaggaggctgaggtaggaggatcacttgagcctag

SEQ ID NO: 32554 - DNA, 89 bp, Homo sapiens
ccaggatgtgacatgagttttctgtgtctctggctcaccgtcaatttgagctccagggaaaaaataatcatctcagcaacacattctgg

SEQ ID NO: 32555 - DNA, 58 bp, Homo sapiens; identical to SEQ ID NO: 2051

SEQ ID NO: 32556 - DNA, 82 bp, Homo sapiens
cacatgtatatgcatgtatatgtgtaaatgtgtgtgtttagatacatatgtgtgtttatgtgtgtgtgtgtgtgtgtgtgtg

SEQ ID NO: 32557 - DNA, 67 bp, Homo sapiens
gggcgcagtggctcacacctttcattccagcactttgggggctgaggtaggtggatcacttgagctc

SEQ ID NO: 32558 - DNA, 62 bp, Homo sapiens
gttgcaggggaggggaagggatggatgcaaagaaataaatctctctgtctctctctcgaaac

SEQ ID NO: 32559 - DNA, 72 bp, Homo sapiens
gtgtgaaggtctggattcagttcactattcccagtataaaaggatgtgcagactgagcacagtggctcacac

SEQ ID NO: 32560 - DNA, 110 bp, Homo sapiens
gctgggtaacctttgctcctactgcaggaggtgagctgttatttatttatttattttgagacacagtctcactctgtcgccaggctggagtgaagtggtgcgatcgcagc

SEQ ID NO: 32561 - DNA, 105 bp, Homo sapiens
ggtgggccaggcgaggatgggagcagagagtgtcctgagtgtggtcaaagctagcaaatgcttaagagagcggttttgtttttggtttcctttcttggacttatc

SEQ ID NO: 32562 - DNA, 106 bp, Homo sapiens
atatgtataattttttgcatgtagattcttttttatttttcttccagcttttatgttttggttcgggggtacacgtggaagtttgttacatgggcaaattgcatgt

SEQ ID NO: 32563 - DNA, 73 bp, Homo sapiens
tatgtgtgtgtatatatataactttatatatatgtgtatgtgtgtatgtatgtctatatatatatatatgcat

SEQ ID NO: 32564 - DNA, 77 bp, Homo sapiens
gtgtttgtgtgtgtgtcagtgtatgtagtgtgtgcattagtgcatacattacagaagccagcctagcatttaaatcc

SEQ ID NO: 32565 - DNA, 74 bp, Homo sapiens
agtctcactctgtcacccaaggtggaatgcggtggtacaatcactactcactacacctttgacctccccaggct

SEQ ID NO: 32566 - DNA, 118 bp, Homo sapiens
gttcctttttatgtgtgaaaggactgttgtgatatttttggttttaatgtattcaaatagtatgaattgattttccaacaaaggcttggcagacctctgtcacagacaagtgaggtgc

SEQ ID NO: 32567 - DNA, 130 bp, Homo sapiens
agaaacatggaagtaaatatcagagcagacatttagggagaaagacgggaacagtggcacagagaggctgttcatttttatgataagtcttttagcattatgtctttatttttattctgaaatgcctgcc

SEQ ID NO: 32568 - DNA, 118 bp, Homo sapiens
cactgccaattaaccacatccacctagctgacgcagtttcatttttaaatatttatttatttatttatttatttagagatggggtcttgctttgtcacccaggctggagtgcagtggt

SEQ ID NO: 32569 - DNA, 117 bp, Homo sapiens
ctgctaagtctctgccaggatgtcacacaggatgtgcctgtccttaagtacaatcacatagtacgttgtttagttcattatgtggcatcattttatagggcatttgagtatttgaag

SEQ ID NO: 32570 - DNA, 62 bp, Homo sapiens
tgagtcagggtctcacactgtcacccaggctggctggagtgcagtggcatgatcatagctca

SEQ ID NO: 32571 - DNA, 67 bp, Homo sapiens
cagtgtctcactctgtcacctgggctggagtacagtggctccatcacagatgcagtacagatcactg

SEQ ID NO: 32572 - DNA, 107 bp, Homo sapiens
atctagggtcttaaacaagacttgaggcatcggtacctttattctacagatggtgcatgacaagtctggctctaggtgaagatgaaagcacatacctcctctgtttt

SEQ ID NO: 32573 - DNA, 74 bp, Homo sapiens
gtgtgtgtgtgtgtgtgtgtgtgtgtgtggcggagggagggggttgcatacttgtgtttcacctgcgtgcgtgc

SEQ ID NO: 32574 - DNA, 103 bp, Homo sapiens
gtggctcatgcctgtaattgcagactttgggaggctgaggtaggaggatcacttgagcccaggagtttgagaccagcctgggtaacatagtgagactctatct

SEQ ID NO: 32575 - DNA, 93 bp, Homo sapiens
gagtagctggaactacaggtgcgccaccacaaccagctcatatttttgtatttttagtagggacggggtttcaccatgttggccaggatggtc

SEQ ID NO: 32576 - DNA, 94 bp, Homo sapiens
ccagaaaggtaacatagtgagatcctcgtctttattttttttttaaattaatttattttttttgagatggagtctccctctgtcaccaggctgg

SEQ ID NO: 32577 - DNA, 118 bp, Homo sapiens
gcaccatttttgctaacattgtgtctctgtgtcacattttggtaattcttgcaatatctcaaactttattattattgttatttgagacagagtctcgctctgttgcccaggctggagt

SEQ ID NO: 32578 - DNA, 73 bp, Homo sapiens
agagcaagactctgtcttaaaaaaaaaaaaaaaaaaaaaaaagaaattttttgtggagacagagtctcactct

SEQ ID NO: 32579 - DNA, 85 bp, Homo sapiens
tgtgccgggctttataggcagatgttgattttatttttatttattttgacatggagtctcattctgtcaccgaggctagagtgca

SEQ ID NO: 32580 - DNA, 64 bp, Homo sapiens
tgggacagtgtctgtcactcactctgtcgcccaggctagagtgcagtggtgcgatcctggctca

SEQ ID NO: 32581 - DNA, 68 bp, Homo sapiens
tgtgaaggtactgatggcctttccctgttccccttgcagatgaagtgggagtccctcagtccctgaca

SEQ ID NO: 32582 - DNA, 71 bp, Homo sapiens
tagagagtgagtctcactgtgtcgcccaggctggagtgcagtggcacaatctcggctcactgcaacctctg

SEQ ID NO: 32583 - DNA, 105 bp, Homo sapiens
tcactgaataatggcctctagttccatccatcttgctataaaagacatgatttcattattttttatgcctgagtagtattctgtgacatgggccaggcacagtgg

SEQ ID NO: 32584 - DNA, 84 bp, Homo sapiens
cagcagcagagcagagcggtgcttttttttaattttaattttattttatttttgagatggagtctcgctctgtcacccaggctg

SEQ ID NO: 32585 - DNA, 104 bp, Homo sapiens
agcctgggcaacagagcaagactccatctcaaaaaaaaaaaaatttttttttctaattttttgatttttttagagatagggtctcacactttgtcacccaggtt

SEQ ID NO: 32586 - DNA, 56 bp, Homo sapiens
ttgagacagagtctggctgtgtctctggttcccgggttcacaccattctgcctcag

SEQ ID NO: 32587 - DNA, 86 bp, Homo sapiens
gctctggtagttctgagagctggttgttgaagagtgtggcacttcccctctctcttgctccctctctctccatgtgataccctggc

SEQ ID NO: 32588 - DNA, 97 bp, Homo sapiens
attccctgtgtccttggtacctgctcacagcagggggctggccttaaacctcactctgtgtgtctgtgggggggatgagaggagcagagtcaggaat

SEQ ID NO: 32589 - DNA, 77 bp, Homo sapiens
atgtgtaaattgtgtatgtgtatgtatatatgcatatatatatgcatgtatatatatacatatttatacacacacat

SEQ ID NO: 32590 - DNA, 98 bp, Homo sapiens
ttgaaaaaattttaaaatgtactttaaaatgtacattttaaaatatttttgtacattttaaaagtacatttaaaagtacattttaaaagtacatttaa

SEQ ID NO: 32591 - DNA, 58 bp, Homo sapiens
tgaggcggactctcactctgtcgcccaggatggagtacagtggtgtgatctcggctca

SEQ ID NO: 32592 - DNA, 83 bp, Homo sapiens
gagtttgagacaacatagccaggccctgtttctaaaaaacattttttttaattagcaggagctaggtgtggtggctcatactt

SEQ ID NO: 32593 - DNA, 67 bp, Homo sapiens
tgctagacaagaactacaggaagctggcatctttgccttcttcttcttttctctgtctctataagta

SEQ ID NO: 32594 - DNA, 90 bp, Homo sapiens
gcaccagagctctgcttctcaaactgcatctgcatcagtgtcattggagggctgggttttgagacagtaagtctggagtagggtgggagt

SEQ ID NO: 32595 - DNA, 72 bp, Homo sapiens
tggcttgaatggcagtgactttgggcctggcagtgtcctctgccagtctccttcactcacaatttcatttca

SEQ ID NO: 32596 - DNA, 69 bp, Homo sapiens
aagcagaatttgttctcttctctgtggctcagccttgaggtcctcagctgatagaagtagcttctgctt

SEQ ID NO: 32597 - DNA, 115 bp, Homo sapiens
cttgttctctgtgggggaagccaagcagcaggattatgtctcacactctccctatgaaaggtgagcaccaagtgggaggctaagaaaaccctgtcacgtttccttcatggccaag

SEQ ID NO: 32598 - DNA, 111 bp, Homo sapiens
atgaaacccgaaagtaagccagctttgtttcttgtttttatagtactatgtttcttgtttttatagtactatcagtgtctgcaaaacttggttttgaccctcttttttcat

SEQ ID NO: 32599 - DNA, 89 bp, Homo sapiens
ccgatgaactatcaaattgtcacacagttctctcactaggctcctaagtgtctgtgtcacagccagtggcaattttaagtggtccaagg

SEQ ID NO: 32600 - DNA, 98 bp, Homo sapiens
tcatgcttttatatactttttttatttgatcataattacaactccatgatgtgggttgtattgttctaattttataaatgaggaaatgaaagctctga

SEQ ID NO: 32601 - DNA, 72 bp, Homo sapiens
ccaggcgtggtggtgtgtgcctgtagtcccagctacttgggaggctgaggtaggaggatcacttgagcctgg

SEQ ID NO: 32602 - DNA, 121 bp, Homo sapiens
gctgttcttatgacagtgagtgagttctcacagggtctgatggtgtggcagttcccctgtcgctctctctgtctctcctgctgccttgtgaagacgtgcttgcttcccctttctgccatga

SEQ ID NO: 32603 - DNA, 145 bp, Homo sapiens
actgaacatgtgtgtatgtgtgtatatatatgtgtgtatatatgtatatatatgtgtgtatatatacacgcacatatgtatatgtgtgtgtgtgtgtgtgtatatatatatatatatatatatatatatatatatatatatatgc

SEQ ID NO: 32604 - DNA, 79 bp, Homo sapiens
ttcgttgggagaggtggtgtgtgcctgtagtttcagctactcaggaggctgaggtaggaggatcacttgagccagggag

SEQ ID NO: 32605 - DNA, 75 bp, Homo sapiens
gaatattgacagagttagactcataacagacgaccaggtccccactctggtatgagtctatctctgtcaatattc

SEQ ID NO: 32606 - DNA, 138 bp, Homo sapiens
tgagagagatgggacttcttattttaattaaataaataaattaattaattattttaagtagagacagagtctcgctctgtcacccaggctagagttcagtgatgccgtcatcgttaatggcagcattgaactcctggg

SEQ ID NO: 32607 - DNA, 78 bp, Homo sapiens
ccttgaattgactctacttgcatgaactatgcgctgttgttgacagtacactgtgtgcctgtctagtgttattctagg

SEQ ID NO: 32608 - DNA, 93 bp, Homo sapiens; identical to SEQ ID NO: 69

SEQ ID NO: 32609 - DNA, 58 bp, Homo sapiens; identical to SEQ ID NO: 7074

SEQ ID NO: 32610 - DNA, 95 bp, Homo sapiens; identical to SEQ ID NO: 6311

SEQ ID NO: 32611 - DNA, 104 bp, Homo sapiens
gggctgaaatgattcaaataacaggggctggacagctgagatcctcgggcacctctttctgtgtctctatgtctctccctggaatctctctccagcactgtgtt

SEQ ID NO: 32612 - DNA, 70 bp, Homo sapiens
gagtggtgagaaagggtatccttgtcttattctagttcttaaagggaatgcttccatttcttgcccattc

SEQ ID NO: 32613 - DNA, 94 bp, Homo sapiens
gtgtatatatatatatgtgcatgtgtatatatatatgtgtgtatatgtatgtgtgtatacatatatgtttgcatgtgtttgtgtgtgtgtatat

SEQ ID NO: 32614 - DNA, 73 bp, Homo sapiens
caaatgtccaagagtacaattgaattggttgagagattttagctcttaagtaaattaatgtattttttatttg

SEQ ID NO: 32615 - DNA, 65 bp, Homo sapiens
ctttcactggctgtctctcagaatgcatcaccacaggtgtggactggtcagtctagagggagggt

SEQ ID NO: 32616 - DNA, 85 bp, Homo sapiens
tctgtgtttgttgttgtggtgtgagagctgaggaaaaatagtttgagttgttccacatacacacacacacagagacatgaacaca

SEQ ID NO: 32617 - DNA, 58 bp, Homo sapiens
tgagacagagtctcactctgtcacccaggctggagtgcagtggtgccatctctgctca

SEQ ID NO: 32618 - DNA, 102 bp, Homo sapiens
tatagagcatgtatatataatatatattctacatattgcatataatgtaattatatatgcatacataatacatgtttatatattgcatatgcatcagttata

SEQ ID NO: 32619 - DNA, 95 bp, Homo sapiens
atattatatgtatttatatatggtatgtgtatatatataatatagtatgtatatattatatggtatataaaataaatatgtattatatataatat

SEQ ID NO: 32620 - DNA, 109 bp, Homo sapiens
atgttgaagcattctttcacctctgtggtaaatcccgctgggtcatgatgaatgatcttaatttgttgttgaattcagtttactagtattttcttgaggagttttacat

SEQ ID NO: 32621 - DNA, 94 bp, Homo sapiens
tgaaaaagatattgtaggaatatatatatgtatgtatacatatatgtatgtatatgtattcctataacgttcttataatgcaatattttcctca

SEQ ID NO: 32622 - DNA, 65 bp, Homo sapiens
ggggaatcatgcacactagtgtctgggcagacagggctgccaacattggtctcagcattaaaccc

SEQ ID NO: 32623 - DNA, 106 bp, Homo sapiens
tacatacgtcatatttgcatacacatatgtttaatgtatttgtgtgtactatatatgtgtgtatatatttatatatataaatttgtgcatgtgtaagtgcatataa

SEQ ID NO: 32624 - DNA, 102 bp, Homo sapiens
ggaacactggttgtacttagtttctaatgtgcctctcttggcttttcaatttaagtatatatattgcacatgcaggaattgtgaagaaatattgtgtgtacc

SEQ ID NO: 32625 - DNA, 99 bp, Homo sapiens
ggaggcattggagttcattgagtattagccatatcacacccacctttgactagagaagctttggttagtagcgactgaggatcccatgggaatgtctcc

SEQ ID NO: 32626 - DNA, 78 bp, Homo sapiens
ccaatgccaaggtgccatatttggggtagcctgtcctgaacgcatcactgcctgactccctctgacccttggtgttgg

SEQ ID NO: 32627 - DNA, 101 bp, Homo sapiens
gtttcattgctaccatttatttcatttatatgtaaacatacataagtatgtgtgtgtgtctctgtgtgtgtatgagcatgaatactggcatatgttgttgc

SEQ ID NO: 32628 - DNA, 58 bp, Homo sapiens
tgagacggactctcactctgtcccccaggctggagtgcagacgtgcgatcccagctca

SEQ ID NO: 32629 - DNA, 58 bp, Homo sapiens
tgagacagagtctcgctctgtcacccaggttggagtgcagtggcgcgatctctgctca

SEQ ID NO: 32630 - DNA, 58 bp, Homo sapiens; identical to SEQ ID NO: 8152

SEQ ID NO: 32631 - DNA, 67 bp, Homo sapiens
gggtgaagaaacttacagattcagattttattttatttttttgagatggagtctcactctgtcaccc

SEQ ID NO: 32632 - DNA, 58 bp, Homo sapiens; identical to SEQ ID NO: 29624

SEQ ID NO: 32633 - DNA, 93 bp, Homo sapiens
tagatgcaagactgattcttgtttctttataggaaaatttttgtcttgttttttttatatgaaactttttagaatcatgttttgatatattta

SEQ ID NO: 32634 - DNA, 80 bp, Homo sapiens
atgtggcaagaaagctagtaagttgcaaattcagggatggtcccaggattctgactctagagactgtcctttctacacat

SEQ ID NO: 32635 - DNA, 58 bp, Homo sapiens; identical to SEQ ID NO: 2442

SEQ ID NO: 32636 - DNA, 115 bp, Homo sapiens
tatgaaattgtgtgtaaaattgtgtgtatgcaattgtgtgtatatgatatagatacagaaatatatatgtatataaatataaatgtatacaataaacacatccatgtctcatgca

SEQ ID NO: 32637 - DNA, 58 bp, Homo sapiens
tgagacagggtctcactctgtcacccaggctggagtgcagttgtgcgatcttggctca

SEQ ID NO: 32638 - DNA, 110 bp, Homo sapiens
gaacatgagagttatgcagtgaattaaacttggtgctcaaaagaaagaaagtgtcattgactgtctccaaatgattcctttgcaccattctctcacatactcttgtgttc

SEQ ID NO: 32639 - DNA, 58 bp, Homo sapiens; identical to SEQ ID NO: 47

SEQ ID NO: 32640 - DNA, 96 bp, Homo sapiens
gtgcaatatataagtatatatgtgtgcaatatatatgtatatatatgtgcaatatgtatatgtgtgtgtatatatatatatttgtatttagtgcat

SEQ ID NO: 32641 - DNA, 117 bp, Homo sapiens
ggttttctcatttgtgtgcataaaggtgttcttctgaatcatcgtttagtgacattttattttagatttactacatatgtatgtatccataagaaactttttgtaaatgtgtccacc

SEQ ID NO: 32642 - DNA, 73 bp, Homo sapiens
atgcactgactgacactctgtatctaggtgctctggtggggacttggagaacgtttgtgtccacactctgtat

SEQ ID NO: 32643 - DNA, 95 bp, Homo sapiens; identical to SEQ ID NO: 68

SEQ ID NO: 32644 - DNA, 93 bp, Homo sapiens; identical to SEQ ID NO: 69

SEQ ID NO: 32645 - DNA, 69 bp, Homo sapiens
tttttttgaggcggagtctcactctgtcactaggctggagtgcagtggtgcgatcttggctcgctgaaa

SEQ ID NO: 32646 - DNA, 120 bp, Homo sapiens
catttactcttttttaggtcatacatattttttattataacatatatatgtatatacatataatatatgtgtatatatacacgtgtgtgtgtgtgtatcaaaaacaacagaagtttagtg

SEQ ID NO: 32647 - DNA, 97 bp, Homo sapiens
agcattttgtatctttttaatgtacatgatacttatatccttttttaaaattttactttaagttctgggatacatgtgcagaatatgcaggtttgtt

SEQ ID NO: 32648 - DNA, 114 bp, Homo sapiens
actgagacgctacagtatgaaattggttatgattttctcaaaatttatagtggatcttttatctttttttttttttgagacagtcttgctctgtcacccaggctgaagtgcagt

SEQ ID NO: 32649 - DNA, 117 bp, Homo sapiens
cagtcctgccacccagatactcatttccacctaccattccatgcatttgttttgaatatataagtatgtacataaaggtaggtactctcaagtccatcagggcttggctgtccactg

SEQ ID NO: 32650 - DNA, 98 bp, Homo sapiens
tcatatctaggcatcaggaaatctcagttcttagctcagtgtccccattcacaagaaacagagctcagggctccagaaaagctggtcaggaaaagtgg

SEQ ID NO: 32651 - DNA, 78 bp, Homo sapiens
ggaagacaataaaagaaggaagatgaagcgtttttccccagggagttaggctgtcagtgtgtctgtctgaaaccttcc

SEQ ID NO: 32652 - DNA, 58 bp, Homo sapiens
tgagacagagtctcccactgtcacccaggctggagtgcaatggcgtgatctcggctca

SEQ ID NO: 32653 - DNA, 104 bp, Homo sapiens
cagtagctactatttattgtctgcctttggtttaggtgttttacagtcactcactgtctatgttcttaaaacaacctggcaaagtagataaaagatgcttcctg

SEQ ID NO: 32654 - DNA, 72 bp, Homo sapiens
gctaatttggaaccacactgacaactgtcaaggtatgaaatgggacagagagcagtgtgtgcagatagaagc

SEQ ID NO: 32655 - DNA, 87 bp, Homo sapiens
cataaccaaaggtttgataccaaatgcagaagttgccaatggaagaaaatgccacttcaactgcatgtggaactgtggttttgaacc

SEQ ID NO: 32656 - DNA, 65 bp, Homo sapiens
gtgtggcagcatcactccagtcagcacgtggcatcctccctgtgtgcctgggtctgtgtccagac

SEQ ID NO: 32657 - DNA, 104 bp, Homo sapiens
tgagtatatgttcttgaacacagttttttgggttgtgtttttttttgagacaagagtctcactctgtcacccaggctggagcgctgtggtacaatctcggctca

SEQ ID NO: 32658 - DNA, 79 bp, Homo sapiens
gagaaaggaggtttgtcttgtacctgcggtatgtgggcggtgaaggttatgcagagtgaattgacagtgttcttggctc

SEQ ID NO: 32659 - DNA, 154 bp, Homo sapiens
tatgtgtatgtatatatgtgtatatatacacctatctgtgtgtatattgtgtatatatatgcaatatatatatacacatacacaggtattgatatctgtatatatgtgtatatatctatatatgtgtatatattgatatatatacacacacaca

SEQ ID NO: 32660 - DNA, 155 bp, Homo sapiens
cacatgatgtgtgtgtgtatatatatcaatatatacacatatatagatatatacacatatatacagatatcaatacctgtgtatgtgtatatatatattgcatatatatacacaatatacacacagataggtgtatatatacacatatatacata

SEQ ID NO: 32661 - DNA, 106 bp, Homo sapiens
ctgtctgctgatgagaccattgaagggattccttagatgtgatagtatttttttatcttgcttacatttccattttattctttcttgtagtttctttctgctgcag

SEQ ID NO: 32662 - DNA, 82 bp, Homo sapiens
ctcagtcctcaaatcacatcagagaacacacacaggggagaagccctatggatgtaatgagtgtgggaagtccttctctgag

SEQ ID NO: 32663 - DNA, 95 bp, Homo sapiens; identical to SEQ ID NO: 68

SEQ ID NO: 32664 - DNA, 93 bp, Homo sapiens; identical to SEQ ID NO: 69

SEQ ID NO: 32665 - DNA, 100 bp, Homo sapiens
tagtgacttcctgaggaatgtgtggaaggtcgcctttttgagtctttgactctctcaattttttaaaatcttctcatacgcttcattaataatttcactg

SEQ ID NO: 32666 - DNA, 95 bp, Homo sapiens; identical to SEQ ID NO: 68

SEQ ID NO: 32667 - DNA, 93 bp, Homo sapiens; identical to SEQ ID NO: 69

SEQ ID NO: 32668 - DNA, 78 bp, Homo sapiens
agcctggcatgtaggcaggcacctgtgatcccagctactcaggaggctgaggttggaggatcacttgagccccgggct

SEQ ID NO: 32669 - DNA, 118 bp, Homo sapiens
ctgcacccagcctcaacatgacttttggagggggcacaaacactcaaagcatattggatgtcacagtcactctccctatgttcaaggtaaggtcatgtagtctgtggcccaggtgtag

SEQ ID NO: 32670 - DNA, 109 bp, Homo sapiens
ggtctcgaactcctgacctcaggtgatctgcctgcctcagccccccaataatttttcatattttagtagagacagggtttgatcatgtttcccagggtggtctcgaact

SEQ ID NO: 32671 - DNA, 132 bp, Homo sapiens
gcatatgtgcatgtatgcatgtgtgtatggtctgtgtgtgtttgtatgtgtgtctgtgtgtctatgtgtacgcatgtgtgtctgtgagtctctctgtgtgtctgcctgcatatctacatgtgtgtatgtgtg

SEQ ID NO: 32672 - DNA, 95 bp, Homo sapiens
ggcttaattgtgaatttcatgtgatgtgtattttaccataattttttttttaggtagaatctcttgaaagttattgcaaatattccagttctgcc

SEQ ID NO: 32673 - DNA, 110 bp, Homo sapiens
cattaggttttgtgcttttctaaatgttatgttactagttagaagcatttttttttttagcttaaagaatttcttttagtaattcctgtaagagaggcctaatcatgatg

SEQ ID NO: 32674 - DNA, 95 bp, Homo sapiens; identical to SEQ ID NO: 68

SEQ ID NO: 32675 - DNA, 93 bp, Homo sapiens; identical to SEQ ID NO: 69

SEQ ID NO: 32676 - DNA, 94 bp, Homo sapiens
gttctttatagcagtggactaatacatatgtgtatatatatacatgcatgtatgtgtgtatgtatgtatctatttatctacctatctatattac

SEQ ID NO: 32677 - DNA, 93 bp, Homo sapiens
tataaattatatatacgtattgtatacatttgtatatatacatttgtatatatacacaaattatatatatatgaatatatatgaatatttata

SEQ ID NO: 32678 - DNA, 58 bp, Homo sapiens
tgagttggactctcactctgtcactcaggctggagtgcagtggtgtgatctcagctca

SEQ ID NO: 32679 - DNA, 82 bp, Homo sapiens; identical to SEQ ID NO: 2170

SEQ ID NO: 32680 - DNA, 68 bp, Homo sapiens; identical to SEQ ID NO: 2134

SEQ ID NO: 32681 - DNA, 58 bp, Homo sapiens; identical to SEQ ID NO: 2135

SEQ ID NO: 32682 - DNA, 56 bp, Homo sapiens; identical to SEQ ID NO: 2136

SEQ ID NO: 32683 - DNA, 86 bp, Homo sapiens; identical to SEQ ID NO: 2671

SEQ ID NO: 32684 - DNA, 77 bp, Homo sapiens
tcatagacattatctgatttttttttagccttcagcagaattttttttttttaaataaaattagataatgtctgtga

SEQ ID NO: 32685 - DNA, 62 bp, Homo sapiens
gtgtgtctgaatatatatatatgtgtgtgtgtatatatatatacatatatatatatacacac

SEQ ID NO: 32686 - DNA, 78 bp, Homo sapiens
gcaagctgcaagcagtcaggggcagagtcagctctcagtctccctgaatctctgccttgatgttgcctgacacgctgc

SEQ ID NO: 32687 - DNA, 129 bp, Homo sapiens
ggtcagggcttcgggacttgtttctcctaaatctttttttttttttttttttgagacagtctcgctctgtcacccaggctggagtgctgtggcgcgatctcggctcactgcaagctccgcctcccgggt

SEQ ID NO: 32688 - DNA, 98 bp, Homo sapiens
atatatgtgtatatatatacatatatgtgtatatatatatatgtatatatatacacatatatatatatacacatatatatatacgtatatatatatat

SEQ ID NO: 32689 - DNA, 91 bp, Homo sapiens
agccctgccccggacatgctctgactctgtctcagccttggcactagcctggctctttcttggcatcagccctgctctctgtggaccggct

SEQ ID NO: 32690 - DNA, 77 bp, Homo sapiens
gattacaggcgtgagtcactgtgcccggccaagattctgttttgatagaacacttgtgtctctctcaccttgtattt

SEQ ID NO: 32691 - DNA, 129 bp, Homo sapiens
atgtgtgtgtgtgtgtgtgtgtatatatatacgtatatatatatacgtatatatatacgtatatatatatacgtatatatatatacgtatatatacgtatatatatatacgtatatatatacacataca

SEQ ID NO: 32692 - DNA, 119 bp, Homo sapiens
atatgtatgtgtatatatatacgtatatatatatacgtatatatacgtatatatatatacgtatatatatatacgtatatatatacgtatatatatatacgtatatatatacacacaca

SEQ ID NO: 32693 - DNA, 115 bp, Homo sapiens
tgtattttgcatgcaagaggatacttttttttttctaaccaaggtaagaattctattttttacttttattttttttagagacaggattttgttctgttgcccaggctggaataca

SEQ ID NO: 32694 - DNA, 141 bp, Homo sapiens
cctgaaagggatgtgacagtcctgactcttatgtatttatttatttatttattttgagatggagtctccctctgtcacccagtctggagtgcagtggcatgatctcagctcactgcaacctcctcctcctgggttcaagtg

SEQ ID NO: 32695 - DNA, 62 bp, Homo sapiens
tcggactccagccagagtgcctctgttcagtagttttaacagtcgtatctgtctgggttaga

SEQ ID NO: 32696 - DNA, 85 bp, Homo sapiens
ggagtctcactctatcactcaggctgtttagtggtgcgatatcggctcactgcaacctctgcttcctagattcaagtgattctcc

SEQ ID NO: 32697 - DNA, 79 bp, Homo sapiens
tgcatataaatatatataaatattgtttatacatatacatgcgtgtatatatgtgtgcatatttgtatttttatgtaca

SEQ ID NO: 32698 - DNA, 87 bp, Homo sapiens
aagagaatgatataattattgggctcaatttgcacttggtttgctaattagtctttttgaagttcagtatttatatggtagtctctt

SEQ ID NO: 32699 - DNA, 80 bp, Homo sapiens
gtgacagagcacagtgccataagactcagaatttcttttttttttttttgatggggagagacagggtctcactctgtcac

SEQ ID NO: 32700 - DNA, 161 bp, Homo sapiens
tataaataaatatatatatatgtgtgtgtgtgtgcatatatatatgtatgtatgtgtgtatgtatatatatatatatctatatatatatatctatatatatatatctatatatatatatctatatatatatctatatatatatctatatatatatctatat

SEQ ID NO: 32701 - DNA, 71 bp, Homo sapiens
tacaggtgtgagtcactgtgcccggcaaagattctgttttgatagaacacttgtgtctctctcaccttgta

SEQ ID NO: 32702 - DNA, 104 bp, Homo sapiens
ttaggtgtcagaagaaagacgtcaccgggcctgagccatgtgatgtcagaagaaagacatcacaggggctagggatcagaccctgtgtgttctcctgcacatga

SEQ ID NO: 32703 - DNA, 75 bp, Homo sapiens
tgtatatgtgtatatacgtatatatgtatatgtgtatatacgtatatattgtatatgtatgtgtatatatatata

SEQ ID NO: 32704 - DNA, 92 bp, Homo sapiens
aggttttcttttatcatcagtgacagcttcttgatctgtccccaggtgggtggcagagtttgactggtattgctcatgacagttgaagtcct

SEQ ID NO: 32705 - DNA, 58 bp, Homo sapiens
tgagagagagtctcgctctgtcacccaggttggagtgcagtggtgtgatcttggctca

SEQ ID NO: 32706 - DNA, 129 bp, Homo sapiens
aaccattgtaattgatttatatgtgtgtgtgtatatatgtgtgcgtatatatgtatataatatatataaatatgtgtatctataagtgtgtttgtgtatatatatgtgtgtgtgtgcatatatatatac

SEQ ID NO: 32707 - DNA, 119 bp, Homo sapiens
gaggcaggctgcatagtggcttaagagcatgggctttggaattagacctaagataaattttcttttttaattatactttaagttctagggtacatgtgcacaatgtgcaggtttgttac

SEQ ID NO: 32708 - DNA, 72 bp, Homo sapiens
cctgtgtcctttcaactgtctctgttagtctttgagcatttctcactttctgacagaacaagaggatccagg

SEQ ID NO: 32709 - DNA, 111 bp, Homo sapiens
ggtgtggtgggtgcacacctgtagttccagctgcttgggaggctgaggtaggaggatcacttgagcttgggaggttgaggctgcagtgagccatgatagcaccactgcact

SEQ ID NO: 32710 - DNA, 77 bp, Homo sapiens
ttctaaaacataaaatctgtgtgtgtgtatgtgtgtgcacatgtgtgtgtatgtgtgcatgtgtatgtgttctaggg

SEQ ID NO: 32711 - DNA, 116 bp, Homo sapiens
tcttttgagaactgtctattcatgtccttagcccactttttgatggcattgtttgtttatttcttactgatttgtttgagttcgctgtagattctggatattagtcctctgtcaga

SEQ ID NO: 32712 - DNA, 92 bp, Homo sapiens
agaggggctccagctttgggaggtgggctgagttgggtgggggtgacccaggacgcagcagtcagtctgtccctccttcagcacgctcttct

SEQ ID NO: 32713 - DNA, 95 bp, Homo sapiens
aacttgtaagcatccattttttcctgagttattagcttttatttattagagcaggtttagatttagagaaaactggaatggaaagtactcaggtt

SEQ ID NO: 32714 - DNA, 84 bp, Homo sapiens
ttggcaggctgctcagcctctctgagcctctgtctccatctgtaagagggcaatagtggtctaggagggggcagtaaatggcag

SEQ ID NO: 32715 - DNA, 58 bp, Homo sapiens; identical to SEQ ID NO: 5218

SEQ ID NO: 32716 - DNA, 65 bp, Homo sapiens
gccagggtcactctctccatgtcacagttcgaggggcagggctgcagggggagaggcactggggc

SEQ ID NO: 32717 - DNA, 59 bp, Homo sapiens
tattgttgttgttgggggatggagtctcactctgtcacccaggctggagtgcaatagtg

SEQ ID NO: 32718 - DNA, 67 bp, Homo sapiens; identical to SEQ ID NO: 2427

SEQ ID NO: 32719 - DNA, 116 bp, Homo sapiens
ctggatattctactttgagtctttattttagtcttttaaaatgttatttttttctattgaaatagaaaacaaggaattagtttagattgggaaataaggtgcttggtgtttggata

SEQ ID NO: 32720 - DNA, 90 bp, Homo sapiens
gcaacaagtattactcaccaaagaaatgtttgtttagatttacctacaatcttttttttttttttttgagacggagtctcgctgtgttgc

SEQ ID NO: 32721 - DNA, 81 bp, Homo sapiens
ctgcagcctgggtgacagagcaagactctttttttttttttttttttgagatggagtctcactctgtcacccatgctggag

SEQ ID NO: 32722 - DNA, 77 bp, Homo sapiens
ctggcattacaggtgactgccgccatgcccagctaatttttgtatttttatcagtggggtttcaccatgttggccag

SEQ ID NO: 32723 - DNA, 114 bp, Homo sapiens
tatgtgttatacatattatacaaatatatgcacatttatacagatatatgtattatatatacatatatagatacatatatatatatacagatgtatgtattatgtatacatata

SEQ ID NO: 32724 - DNA, 88 bp, Homo sapiens
attgcacagacagtagttgtttgctctttggttacaggtgaattatctctatcctagttaggagtggaggactgaagtatgtctcaat

SEQ ID NO: 32725 - DNA, 70 bp, Homo sapiens
cacagccagactccctctctgggtgaagctttttccacactggccgcacagatagggtgtctctcctgtg

SEQ ID NO: 32726 - DNA, 75 bp, Homo sapiens
tctctgcatatctgtgtgtgtctatgtgtgtctgtgccctccaggccgggtaggggcaggaagagttgggagagg

SEQ ID NO: 32727 - DNA, 87 bp, Homo sapiens
acccttaggaatgaggtggcagagtcttggaccaggtgacagcagaggaagaggtaggtggttggattctggaccttttttgaaggt

SEQ ID NO: 32728 - DNA, 80 bp, Homo sapiens
accttcacactcacacaggcacactccagggccgtcttgcaaaggaagcaagttctggggaggatggaagatgggagggt

SEQ ID NO: 32729 - DNA, 63 bp, Homo sapiens
gggtctctgtgggactctgactccctcttcccccaggccactttcagaaacctgcaggggccc

SEQ ID NO: 32730 - DNA, 64 bp, Homo sapiens
agttgccttgcatgtctgtgttatctaccaggccagactgagttcacacagagcagagacaact

SEQ ID NO: 32731 - DNA, 89 bp, Homo sapiens
catgcacctgcctcagggggagggtggtgggtgggtggggtggcttgactcattttgtttttgtcaccctcttacttgaggggtgactg

SEQ ID NO: 32732 - DNA, 73 bp, Homo sapiens
cctggcatagtggctcacacttgcaatcccagtgctttgggaggctgaggtaggaggatcacttgagcccagg

SEQ ID NO: 32733 - DNA, 57 bp, Homo sapiens
caggatgtgggctctgaggcgagttagtttagctctgagcctcagtgtttctctctg

SEQ ID NO: 32734 - DNA, 138 bp, Homo sapiens
cagtgcacatgggttccaatttatccacacccttgctaagggttacttttcattaaaaaatatatatgtatataaaatagtagccctcttaatggtgtgaggtggtatcttgttttgatttgcatttgatgattagta

SEQ ID NO: 32735 - DNA, 67 bp, Homo sapiens
gtctgacagggagcatcggccgcttgttccatcctgtgcttgtctgcctgcctctctgtcatgagac

SEQ ID NO: 32736 - DNA, 122 bp, Homo sapiens
atgtgtgtgtgtatatacatatatgtgtgtatatatacatatatacatatatatgtgtgtgtatatacatatatgtgtgtattatatatacatatgtataatacacacatatatatacacac

SEQ ID NO: 32737 - DNA, 120 bp, Homo sapiens
ggtgctctgtacccacagctcttcaagacgtgtccagaaatgtcacagaagtgaatgagcaccctgttatgggaggtattcagacacaggttggacaaccacaggatggggaggtgcact

SEQ ID NO: 32738 - DNA, 117 bp, Homo sapiens
gatccagttgtattttacgaatttgtataatggtccatttccagaaccttgtaggttgattaccaaaggaatccaccaaggggaaaagtaccattcagatttgtttacacaaggttc

SEQ ID NO: 32739 - DNA, 63 bp, Homo sapiens
agggtccctgtgtgcctctcctcgtcactagggtgcccatgcgggagagcaggcaggaatgct

SEQ ID NO: 32740 - DNA, 93 bp, Homo sapiens; identical to SEQ ID NO: 69

SEQ ID NO: 32741 - DNA, 133 bp, Homo sapiens
gggcggtgctggcatattttgttcctgtgacaggggctgatgaggtcactgtgggaatcacagcaagtccaagtccatgaggcttagggagaaggctgtgcatcaccctcatgggccgggagctccaggaaca

SEQ ID NO: 32742 - DNA, 82 bp, Homo sapiens
ggggccctgccagtgatgtgggcagagaacaggtggcgtggagctcctgtctctgcctctgtcttagttggctcaaagtccc

SEQ ID NO: 32743 - DNA, 118 bp, Homo sapiens
gtgggtaggcatgtgtcccccaggagggtggcagcacatggtaggggctcagtctgtttatctctcccaaggccgtgtctccccacccgacctgcactctgggcctcagcttgatgcc

SEQ ID NO: 32744 - DNA, 75 bp, Homo sapiens
tatatgtatatatacgtgtgtgtgtataaatatatatacacatatgtgtgtgtgtgtataaatatatatatacac

SEQ ID NO: 32745 - DNA, 107 bp, Homo sapiens
tggagaacttccacaagccaaaggatccgggtggtgctgggtcgtttctctggctcactgactgtggggaatgaaagagcacccggacctgtctggagggaagtcca

SEQ ID NO: 32746 - DNA, 80 bp, Homo sapiens
ttagtagggctcctgttggctcctgtgtgctaagttgtctgcctctgttagtatcacactcagcagttagccttcactaa

SEQ ID NO: 32747 - DNA, 85 bp, Homo sapiens
gaaggagcgagtgttggctcaaatgtcacagactctcactgttctagctgagatttagtaaatctgcttcaataagtgtttcttc

SEQ ID NO: 32748 - DNA, 65 bp, Homo sapiens
ggtgaacactctctctgtgtgatgttcaagggctacctgcatatgcaggcagaggtgtcttcacc

SEQ ID NO: 32749 - DNA, 70 bp, Homo sapiens
tgtgtgttttattttgcatcttgcatgctgccaagcatcacgtatgtatagatgtaacacatggcacaca

SEQ ID NO: 32750 - DNA, 119 bp, Homo sapiens
gatactttgtatgctttcagtctttgcaaatgtattgaaacttgttttgtggcctaccatatggtttgttttggagaatgtttcatacgcacttgagaaaaatatatatttttgctgtc

SEQ ID NO: 32751 - DNA, 83 bp, Homo sapiens
agagagtgctgctgatggctgtggctgcaggacggagaaagacactccctctgacaccctagaatgtgagctacgcacgggct

SEQ ID NO: 32752 - DNA, 74 bp, Homo sapiens
cttgagttttatttctttgtctcatagtaattgctaggacctctagcagtagtatgttgaatagaaatggcaag

SEQ ID NO: 32753 - DNA, 119 bp, Homo sapiens
ggctgtgtcaatagggtagtgtggtgcctcctgtacctgtctcggcctcctacagtcctttttatttattttgttttttataatagagacagggtcttactatgctgcccagactggtt

SEQ ID NO: 32754 - DNA, 128 bp, Homo sapiens
tatttgtatgtgtgtatatatgtgtgtgtatgtatgtatataatatatataaatatgtgtgtgtatctatgagtgtgtgtgtgtatatatgtgtgtgtatatatatatatatacatggcagctcatgg

SEQ ID NO: 32755 - DNA, 96 bp, Homo sapiens
ggaggttgcagtgagccaagataaagtggaagcatttattatgtatttatatgccaggaattaatgtgaagcactttactatcttatccaatcttc

SEQ ID NO: 32756 - DNA, 72 bp, Homo sapiens
tgtatgtaaattgtatgtatataaatgtaagtttacattttacatacatatttacatgcatatttacataca

SEQ ID NO: 32757 - DNA, 155 bp, Homo sapiens
catacatatttacatgcatattcacatacaaaagtcatatacttttttatatatactccttaagtatacaattcaacttttgtatgtatgtaaatatgcatgtaaatatgtatgtaaaatgtaaacttacatttatatacatacaatttacatac

SEQ ID NO: 32758 - DNA, 108 bp, Homo sapiens
ggggaatccgaggctggcgtgggagtctggggccctctagcggtggtggtgcatcctcagctcagtgccactcactgtccctatttctctctgtccatttctctcctc

SEQ ID NO: 32759 - DNA, 103 bp, Homo sapiens
gagatcacgctgtgccactccatgagcacatcttcgaattcaccaaagaatctacatttattttctaactgaatgtgcatatgggcatgaggtacacggtctt

SEQ ID NO: 32760 - DNA, 119 bp, Homo sapiens
ggcacccccaggcacaaaccacagaactgggctcccgcatcttagatacgagctgctgtctcctactgtctctgtcgctctctgaggggcctcttaagctgctgcctggccccactgct

SEQ ID NO: 32761 - DNA, 118 bp, Homo sapiens
tagccgggagtggtggtgcacgcctgtagtctcacctacttgggaggttgaggtagaagaatctcttgaacccggttgcagtgagccaagattgcaccactgcactccagactgggtg

SEQ ID NO: 32762 - DNA, 92 bp, Homo sapiens
ggctggtaccaaaggctgggacttggcagagctgaaaagatcatcatcttcatcatccccaaacaggctcccaacacttggctctaacagct

SEQ ID NO: 32763 - DNA, 69 bp, Homo sapiens
tgggtgtgtttgtgtgtgtgcatgtgtgtaacatgtgtgtatatatatatgtatctaaatatagatata

SEQ ID NO: 32764 - DNA, 113 bp, Homo sapiens
ttccctgggacacctgcagcaggccccaggctgtcctcaaggctccaccactgtgtgggtgtgtcagggggacccagaccctagggccatgagcctgcctctccccttgtccc

SEQ ID NO: 32765 - DNA, 63 bp, Homo sapiens
gtttgagatggagtctcactcattctgtcacccaggctgaagtacagtggcgcggtctcagat

SEQ ID NO: 32766 - DNA, 88 bp, Homo sapiens
ttgaattgggagttatttagaaatatattgtttaatttccaaatatttgagaattttaaagatttatttctgttgatttctattttaa

SEQ ID NO: 32767 - DNA, 87 bp, Homo sapiens
ggagtatgtaaggtgggaggaactcagcagggcctgcttgttcagattcctctctcagtccctgtgtcttcccacataagatgctcc

SEQ ID NO: 32768 - DNA, 63 bp, Homo sapiens
ggggattaatgaagagactcttttttttttttttttttgagacggagtctcgctctgtcgccc

SEQ ID NO: 32769 - DNA, 78 bp, Homo sapiens
ccctgcagtgtgtgcatctgtcactgtctcccatcattcccagatgggacctctagttgcagaaaaacaagctcaggg

SEQ ID NO: 32770 - DNA, 84 bp, Homo sapiens
cagggatcatcagaatcaggcctaggcagagagctgagcagtactctcagtatgtctctgtgtcctggttgccacatatctctg

SEQ ID NO: 32771 - DNA, 119 bp, Homo sapiens
gccatgatcacaccactgcacttcagtctgagtaacaaagtgagaccctttatttatttattttgagacagagttttgctcttgtcacccagtctggagtgcaatgacgcgatctcagc

SEQ ID NO: 32772 - DNA, 75 bp, Homo sapiens
ctcctgacacccagccccaagaaggcttccttgaaacacacagtgaggttcttggttcttgagatgtcctgggag

SEQ ID NO: 32773 - DNA, 67 bp, Homo sapiens
gctgctcaaactgcatctccaggtgcttctggatggccacaccgagcacctccaggtccaccgcagc

SEQ ID NO: 32774 - DNA, 115 bp, Homo sapiens
atgtccccatggagtcatggcagtggtccctctaggatgggtccctctgaaatcagtctgactctcttcctctttcagcccttctagtgctgcctcccccagactcattctgcat

SEQ ID NO: 32775 - DNA, 76 bp, Homo sapiens
gcctcttggtccagcacccactgaggcaccagctctgagagagctcactggcttcacacaggtgcgacctgatggc

SEQ ID NO: 32776 - DNA, 107 bp, Homo sapiens
cagctctcttctgatagttcaatggatctgccacctacacagagaggtctggaagtcgctaactctctttgagtctcagattccatagtagtcaaatgaagggtttg

SEQ ID NO: 32777 - DNA, 82 bp, Homo sapiens
ctgggcttggtctctggtaaacctggtgaatggtgggttaacactccctccctcactcggtgttgctgggaggataagacag

SEQ ID NO: 32778 - DNA, 77 bp, Homo sapiens
gaaggctcagagacactgagtgacttgctagggtccaatggccagcaggctccagtcagagagcagttgggtctctc

SEQ ID NO: 32779 - DNA, 58 bp, Homo sapiens
tgagatggagtctcactctgtcacctaggctcgagtgcagtggtgggatctcagctca

SEQ ID NO: 32780 - DNA, 84 bp, Homo sapiens
cagggatcatcagaatcaggcctaggcagagagctgagcagtactctcagtatgtctctgtgtcctggttgccgcatatctctg

SEQ ID NO: 32781 - DNA, 119 bp, Homo sapiens; identical to SEQ ID NO: 32771

SEQ ID NO: 32782 - DNA, 58 bp, Homo sapiens
tgagacggagtctcactctgtctcctgggctggagtgcagtggtgtgatctctgctca

SEQ ID NO: 32783 - DNA, 78 bp, Homo sapiens; identical to SEQ ID NO: 32769

SEQ ID NO: 32784 - DNA, 61 bp, Homo sapiens
gggctggctctcaccgtctgtgttttctgtgctttagggagtacttcattgaagtcagctt

SEQ ID NO: 32785 - DNA, 97 bp, Homo sapiens
ttaattataggtccagggaataacttgagttaataaatcagagatgagtccaaagttctgtaaacaagtttcaacatttctgggcacctgagattaa

SEQ ID NO: 32786 - DNA, 68 bp, Homo sapiens
ctggctctgaccctgtctccctccttcactggccagggcaggaggaacaggcacagagcagcagccag

SEQ ID NO: 32787 - DNA, 58 bp, Homo sapiens
tgagaccgagtctcgctctgtcacccaggctggagtgcagtggcgctatctcggctca

SEQ ID NO: 32788 - DNA, 58 bp, Homo sapiens
tgagatggagtctcactctgtcacctaggctcgagtgcagtggcgggatctcagctca

SEQ ID NO: 32789 - DNA, 89 bp, Homo sapiens
gtgggtttggatatatcacatatttacaccttttgccatatatacatatacaaagttatttatatatgtgtccatgtgtttatgctcac

SEQ ID NO: 32790 - DNA, 77 bp, Homo sapiens; identical to SEQ ID NO: 32778

SEQ ID NO: 32791 - DNA, 80 bp, Homo sapiens
gtccttggcaatggcaaaaagatcatcttcttcgtcttcctcaaagagactggtctttttcacagccttggcctcctggc

SEQ ID NO: 32792 - DNA, 92 bp, Homo sapiens; identical to SEQ ID NO: 32762

SEQ ID NO: 32793 - DNA, 70 bp, Homo sapiens
tttttttgagtcagagtctcactctgtcacctatgctggagtgcagtggagtgatcttggctcactgaaa

SEQ ID NO: 32794 - DNA, 84 bp, Homo sapiens; identical to SEQ ID NO: 32780

SEQ ID NO: 32795 - DNA, 58 bp, Homo sapiens; identical to SEQ ID NO: 32779

SEQ ID NO: 32796 - DNA, 77 bp, Homo sapiens; identical to SEQ ID NO: 32778

SEQ ID NO: 32797 - DNA, 84 bp, Homo sapiens
atcattgatgcttgttatagattacttgcctcctttgttgtcctgttcctatctgagaacagagggtgctcaagacctcatgat

SEQ ID NO: 32798 - DNA, 147 bp, Homo sapiens
gtgagtgatgcagtgtgtgcacactggggtaatatgtgtgcacactgcagtgagtgatgtgtgtgcgcactggggtgagtgatgtgtgtgcacactggggtgagtgatgtgatgtgcacactggtgtgagtgatgtgtgcacacatt

SEQ ID NO: 32799 - DNA, 116 bp, Homo sapiens
ttcttgggcttccatttttattctgttaaatgccatttgcagagcagacatttttaattttaataatgcctgacctatgaatctttttttgagtgtgaatggatcatgcttttgga

SEQ ID NO: 32800 - DNA, 79 bp, Homo sapiens
gtgctaatagtactatagtttggtaagttgttaccattggggaactggggtacaaggatctctaggtattatttcttac

SEQ ID NO: 32801 - DNA, 112 bp, Homo sapiens
ctattttatagtaagaatacctgcatgggaatagctgtttttatactatatttatattacacagtataaatacagagagaatagctgaatttaggtatgtttataaatatag

SEQ ID NO: 32802 - DNA, 113 bp, Homo sapiens; identical to SEQ ID NO: 32764

SEQ ID NO: 32803 - DNA, 95 bp, Homo sapiens; identical to SEQ ID NO: 68

SEQ ID NO: 32804 - DNA, 93 bp, Homo sapiens; identical to SEQ ID NO: 69

SEQ ID NO: 32805 - DNA, 63 bp, Homo sapiens; identical to SEQ ID NO: 32765

SEQ ID NO: 32806 - DNA, 87 bp, Homo sapiens; identical to SEQ ID NO: 32767

SEQ ID NO: 32807 - DNA, 99 bp, Homo sapiens
gatttagttgtaggggattaatgaagagactcttttttttttttttttttttttttttttttgagacagagtctcgctctgtcgcccaggctggagtgc

SEQ ID NO: 32808 - DNA, 78 bp, Homo sapiens; identical to SEQ ID NO: 32769

SEQ ID NO: 32809 - DNA, 58 bp, Homo sapiens
tgagacagagtctctctctgtcacccaggctggggtgcaaaggcgagatctcggctca

SEQ ID NO: 32810 - DNA, 84 bp, Homo sapiens; identical to SEQ ID NO: 32770

SEQ ID NO: 32811 - DNA, 72 bp, Homo sapiens
gcctggctaattagatcacagtgattcttttttttttttttttgagacaaagtctcgctctgtcacccaggc

SEQ ID NO: 32812 - DNA, 119 bp, Homo sapiens; identical to SEQ ID NO: 32771

SEQ ID NO: 32813 - DNA, 77 bp, Homo sapiens; identical to SEQ ID NO: 32778

SEQ ID NO: 32814 - DNA, 58 bp, Homo sapiens; identical to SEQ ID NO: 32779

SEQ ID NO: 32815 - DNA, 84 bp, Homo sapiens; identical to SEQ ID NO: 32770

SEQ ID NO: 32816 - DNA, 88 bp, Homo sapiens; identical to SEQ ID NO: 32766

SEQ ID NO: 32817 - DNA, 105 bp, Homo sapiens
ccagtatgactgattgctctagcttggcaagaatatttgtttataatctcaaagatcaactgtgagaggcaatcaatcctttgtttggagttttctgtctttagg

SEQ ID NO: 32818 - DNA, 108 bp, Homo sapiens
cacactgataggtcttgactctttaacgaatttgccagtctgtgagtctgtgtcttttaatggaggcatttagtctgtttacccttaaggttaatattgttatgtgtg

SEQ ID NO: 32819 - DNA, 113 bp, Homo sapiens
ttgtcttggctatgtgggctctattttggttccatatgaaatttaaagtagtttcttctaattctgtgaagaaagtcaatggtactttgatggggatatcaatgaatctacaa

SEQ ID NO: 32820 - DNA, 93 bp, Homo sapiens
gtgaggggtagactgagggatcagaagagttcaaagggagaaaccaaaggcattttttttttttttttttgagacagagtctcgctctgtcac

SEQ ID NO: 32821 - DNA, 102 bp, Homo sapiens
ttgctgttgtgacacattgtttactatttatttatttattgagacaggatcttgctctgtggcatagactggagtgcagtgcatgattacagctcattgcag

SEQ ID NO: 32822 - DNA, 89 bp, Homo sapiens
gaagttttatagtctcagattttgtgtttaggtatatcattcattttgagtatatttttatatatggtgtgaggtatgaattgagattc

SEQ ID NO: 32823 - DNA, 109 bp, Homo sapiens
tgggggcacaggggtgaaaagggaacaggcctcatcttacttagagctttcagtgcaacaggaactggctgctcatgaataactttctgtcttcgttctgtccattcca

SEQ ID NO: 32824 - DNA, 115 bp, Homo sapiens
atgtgttttcatttttcttggctgtgtctggtggtgaaatttgtgggtcacatgataagtatatattttactttataagaaactgttaaattgtttatgaaaatggttgcatcat

SEQ ID NO: 32825 - DNA, 78 bp, Homo sapiens
ggaatctcagaagtgactctccacagtgccaatcctcgtctgaaaaaatgtgctgctgggagacaccaagagatggcc

SEQ ID NO: 32826 - DNA, 63 bp, Homo sapiens
tgggcaggaggtagaggtggggtccccatcacaagatgggcaccgactctctctgactgtcta

SEQ ID NO: 32827 - DNA, 80 bp, Homo sapiens
ttcatgcacactgacacagagagagagacaggaattatgttcactttctgtctctctctctccgtgtcagtgtgcatgaa

SEQ ID NO: 32828 - DNA, 68 bp, Homo sapiens
cacactgacacggagagagagagacagaaagtgaacataattcctgtctctctctctgtgtcagtgtg

SEQ ID NO: 32829 - DNA, 79 bp, Homo sapiens
ggagtgtgtctcactcagactgagatggaagaggcggcagcggtgacaccagagaaacggttcctgaggaggtgactcc

SEQ ID NO: 32830 - DNA, 80 bp, Homo sapiens
aaggtggtaattcccatcttgctcaagtcaaggcgctttttcccatcaaaagtgattttgatgcaattcctggccacctt

SEQ ID NO: 32831 - DNA, 75 bp, Homo sapiens
gggcatgcagcaggcaaggagtttctcacccacgcactcacagacctgaggaacattctgtccatgctcaggctc

SEQ ID NO: 32832 - DNA, 67 bp, Homo sapiens
gtgagcttgcacacacacacacaccctgatccaggtatgggatgtggatgtgtacccaagaacttac

SEQ ID NO: 32833 - DNA, 112 bp, Homo sapiens
agctttgttctttttgcttaggattgtcttggctatgtgggctctgttttttggttccatatgaaatttaaagtagttttttccaattctgtgaagaaagtcaatggtagct

SEQ ID NO: 32834 - DNA, 81 bp, Homo sapiens
aaggtgaggtttattttagttttattttctgccagtggaagtcccattgacccagcaccattgattgaagaaactgtcctt

SEQ ID NO: 32835 - DNA, 133 bp, Homo sapiens
atatgttatatatgtatatatatacatatgtaatatatatgtatatatacatatgtaatatatatgtgtatatatacatatgtaatatatatgtgtatatacacatgtaatatatgtatatatacatatatat

SEQ ID NO: 32836 - DNA, 89 bp, Homo sapiens
cctctcgatgtctgactgcgtctgtctctgccttgctaggttctcaactttttataggcccaggatgggggcgtggcaggccagagtgg

SEQ ID NO: 32837 - DNA, 107 bp, Homo sapiens
ggttttgatttgcatttttctaatgaccagtgatgatgagcttttttttttttctaagtttgttggccacataaatgtcttcttttgagaagtgtctgttcataacc

SEQ ID NO: 32838 - DNA, 129 bp, Homo sapiens
tgaaagactgtgaaaattatcagtatttatgtgtgtatgtatattttctagttcatctatatagatatatatcatagatggcatatatgatatatatattatatgtcagatcaattagaaaacatacat

SEQ ID NO: 32839 - DNA, 64 bp, Homo sapiens
gcctcattgcacacagagcatggctgggcaagttcccaaattgagtgtgtgcacagagtgaggt

SEQ ID NO: 32840 - DNA, 71 bp, Homo sapiens
gccaaagcctacgctgcaaggtggaatcttagggaggcccacagactgtcacactgagagggccagttggt

SEQ ID NO: 32841 - DNA, 124 bp, Homo sapiens
gactgaagtgacactgagcctgtcagctaaagatggccctgagctgtcccttggccactgtctgtgagtcattgagtaacgtgagtacatgtggcccggcccgcagtctcgtctgcatggaagg

SEQ ID NO: 32842 - DNA, 67 bp, Homo sapiens
tgatctggagtctggacctcagcctgggttccagctgtgtctcccactggctgtctgactctggaca

SEQ ID NO: 32843 - DNA, 74 bp, Homo sapiens
gggtctgcagagggcttcctgtcactgtctctcttgcactggttcttggcacagccccagcagcctcatcaccc

SEQ ID NO: 32844 - DNA, 72 bp, Homo sapiens
tgtgtcatgaactacagggtgatgcatacacatgagccgtgactgtcactgtgtcatcccagtattgactca

SEQ ID NO: 32845 - DNA, 58 bp, Homo sapiens
atatatatatatatatatatacacatacatatatgtgggtgtatatgtatatgtatat

SEQ ID NO: 32846 - DNA, 81 bp, Homo sapiens
ctgctttcactctgatgttcactggaacagtctgggcactaggtgtccatctgtgtaaggaacaaaccaggagaagagcag

SEQ ID NO: 32847 - DNA, 67 bp, Homo sapiens
ggcatgtaccaccacacccgtctaactttttgtatttttacaaaaagagatggggtttcatcatgtt

SEQ ID NO: 32848 - DNA, 98 bp, Homo sapiens
tgtatatgtatattttctagttcatctatatagatatatatcatagatggcatatatgatatatatatgtcagatcaattagaaaacatacatatata

SEQ ID NO: 32849 - DNA, 106 bp, Homo sapiens
atggtcatgttttcctgcctctgtgaatgcctggtaatcctttctttttttttttttggatgtcaaaaaagagagtttgccttactggatgctgaatattttccat

SEQ ID NO: 32850 - DNA, 115 bp, Homo sapiens
ctgctccctgttggtccttggagataaggcagagagcactgtcactcgctgagtgcctgggccctcatctcagaccggctgctgtccagatcctggccatgccactcagagtgat

SEQ ID NO: 32851 - DNA, 70 bp, Homo sapiens
acactgtctgtctgtgtgtggtctccagaaaggccagagcctgggtgactgcatggaaaagaacagatgt

SEQ ID NO: 32852 - DNA, 57 bp, Homo sapiens
gcaaggtgttttcatcttacacttcagctgaagagagaggtgacagaacgcagaggc

SEQ ID NO: 32853 - DNA, 119 bp, Homo sapiens
gcttgtgctatttcttgtattcattgatttgtgattgatttttttttatttttttattttttatttatttatttttgagacaaagtctcactctgtcgcccaggcggaagtgcagtggc

SEQ ID NO: 32854 - DNA, 90 bp, Homo sapiens
ccagcttgggcaacataatgagactcggtctctacaaaaaaaattttttttttttttttgagacggagtctcactctgtcaccagactgg

SEQ ID NO: 32855 - DNA, 195 bp, Homo sapiens
catatatatacgtatatgtgtatatatatacatgtatatatatacgtatatatgtacgtatatatgtatatatgtgtatatatatacacgtatatatacgtatatatgtatatatatgtgtatatatatacatgtatatacatatatatgtgtgtgtgtgtgtatatatatatatatatatatatatatatatat

SEQ ID NO: 32856 - DNA, 110 bp, Homo sapiens
cgtatatatacgtgtatatatatacacatatatacatatatacgtacatatatacgtatatatatacatgtatatatatacacatatacgtatatatatggagtttatat

SEQ ID NO: 32857 - DNA, 90 bp, Homo sapiens
ccagcttgggcaacatagtgagactcggtctctacaaaaaaaaaattttttttttttttgagacggagtctcactctgtcgccagactgg

SEQ ID NO: 32858 - DNA, 78 bp, Homo sapiens; identical to SEQ ID NO: 32769

SEQ ID NO: 32859 - DNA, 143 bp, Homo sapiens
cagcctgggcaacaaagggagaccctgtctcggaaaaaggaaaaaagttactaattctttttttttttttttttttttttttttttgagacagagtctcgctctgtcgcccaggctggagtgcagtggcgggatctcggctca

SEQ ID NO: 32860 - DNA, 72 bp, Homo sapiens
agtataaggtgaaagtggacttcactctttttttttttttttgagatggagtctcgctctgtcgctcaaact

SEQ ID NO: 32861 - DNA, 90 bp, Homo sapiens; identical to SEQ ID NO: 32857

SEQ ID NO: 32862 - DNA, 84 bp, Homo sapiens
tatgtgtacatatgtatgtgtgcatgtgtacgtatgtatgtgtgcatatgtacacatgtgcacatgtgtatatatgtacatatg

SEQ ID NO: 32863 - DNA, 58 bp, Homo sapiens; identical to SEQ ID NO: 32788

SEQ ID NO: 32864 - DNA, 106 bp, Homo sapiens
ccagccacttgtcttgtagaatgtgtcatgtgaatttgcttgattatttttctatgaatagattcagggtgagcagttttggcaagaatacaagcaggcagggttg

SEQ ID NO: 32865 - DNA, 80 bp, Homo sapiens; identical to SEQ ID NO: 32791

SEQ ID NO: 32866 - DNA, 92 bp, Homo sapiens; identical to SEQ ID NO: 32762

SEQ ID NO: 32867 - DNA, 70 bp, Homo sapiens; identical to SEQ ID NO: 32793

SEQ ID NO: 32868 - DNA, 116 bp, Homo sapiens
gtatatgtttctagatgttttatgcttacatacacgtgcacatatatatatatatatataaatgtatatgcccacatatatgtgaatgataaatacatttttcaattaatatgtat

SEQ ID NO: 32869 - DNA, 83 bp, Homo sapiens
caagtatctagtaaacatatttttgtttatatcaacaaacatgagtttgttgatatgaacataatgcaacgctataaaatttg

SEQ ID NO: 32870 - DNA, 86 bp, Homo sapiens
ggacttcattatctatgtatggatttttcatagctcctaacttttttttttattaggaaggaaatctgtgtggcatagatgatgcc

SEQ ID NO: 32871 - DNA, 121 bp, Homo sapiens
acagatgtatatatgtaacatatattatgtaatatgtgtaacatatactatattacatattatatattaatatatactatattacatatattgtgtattatatgccatatattatgtatat

SEQ ID NO: 32872 - DNA, 97 bp, Homo sapiens
cctgagctgtcttttctgtgttttactgtctgctctttctggctgcttgtagttagaagagaagtgatttccttgaaatgcatgaggctagaaaggg

SEQ ID NO: 32873 - DNA, 94 bp, Homo sapiens
ggatatgcagatatgatttatttcagtggtatgcttctctgtgagcctgtctcactgtggcagctctggaatttctgtttatggatgacattct

SEQ ID NO: 32874 - DNA, 72 bp, Homo sapiens
gtttttttgacacagggtctcactctgtcgcccagtttggagtacagaggtgcaacctctgctcactgaagc

SEQ ID NO: 32875 - DNA, 87 bp, Homo sapiens
actgttggccaggttggagtacaggggtatgatcatagctcactacagcaccaaactcctgggctctagcaatcttcctgcctcagt

SEQ ID NO: 32876 - DNA, 95 bp, Homo sapiens; identical to SEQ ID NO: 68

SEQ ID NO: 32877 - DNA, 93 bp, Homo sapiens; identical to SEQ ID NO: 69

SEQ ID NO: 32878 - DNA, 73 bp, Homo sapiens
agatatctatacatgtatatctatataaatatctacatgccgatatatatatctatgtgtgtatatgatatct

SEQ ID NO: 32879 - DNA, 72 bp, Homo sapiens
tacagatatagatatgtatatgtatttatatacatatataggtatattaatatttatatgtctatatctgta

SEQ ID NO: 32880 - DNA, 101 bp, Homo sapiens
tttgtatctgttttgggtatttgtattctgtgtcatgtatatgtgttatatatttaagatatatatttatgtaggtaggttaagtattcagtggtgtcaga

SEQ ID NO: 32881 - DNA, 109 bp, Homo sapiens
gggtcatggtgggcttctgccgggccagagatcggagaactgggctgtaaaccattgcagtcagtctcagtctataagcccacccttcatcccaagcccacctggtccc

SEQ ID NO: 32882 - DNA, 80 bp, Homo sapiens
gtttgtattttttttgagacagtgtctcgctctgtcacccaggttggagtgcagtggcccgatctctgctcactgcaagc

SEQ ID NO: 32883 - DNA, 82 bp, Homo sapiens
agcagccttctatatatatatatatatgtatacatatatacatatatctatacatatgtatacatatatatagaaggctgct

SEQ ID NO: 32884 - DNA, 93 bp, Homo sapiens
gaaatttttgactgcatggccaaaagccattcctaatttttttcttgataaataatccctagaatttgtttggaggagccatgtgtctagttc

SEQ ID NO: 32885 - DNA, 61 bp, Homo sapiens
ttttgttggggggggggagcggggggtggggacagagtctcgctctgtctcccaggccgga

SEQ ID NO: 32886 - DNA, 84 bp, Homo sapiens
gctttgatttgaactatttctgagcacacagtcagcatcaaatagttctgattgtgttgttcagcactgagtgagcatgtcagc

SEQ ID NO: 32887 - DNA, 92 bp, Homo sapiens
tgtggtattatgtgatgaaggagggagataaaaggtgtgggaagtgaggtgctagctatatcaaattctttttgtttcaaagacagtgcacg

SEQ ID NO: 32888 - DNA, 125 bp, Homo sapiens
agggagacggtggctctgacagtgcctggtgcttcctccatttcacactagggacacagtggctctgacagagcctggtgcttcctccatttcacactagggacacggtggctctgacggtgccc

SEQ ID NO: 32889 - DNA, 58 bp, Homo sapiens
tgaagcaaggtctcactctgtcacccaggatggagtgcagtggtgctatcttggctca

SEQ ID NO: 32890 - DNA, 85 bp, Homo sapiens
tcagtcaggatggaccaagtgttgccacagaaaaagaaaaactctttttttttttgacagggtattgctcttttgcccaggctgg

SEQ ID NO: 32891 - DNA, 95 bp, Homo sapiens; identical to SEQ ID NO: 68

SEQ ID NO: 32892 - DNA, 93 bp, Homo sapiens; identical to SEQ ID NO: 69

SEQ ID NO: 32893 - DNA, 98 bp, Homo sapiens
ctttaaatgtgttcatatatttgggacttaaagttatatgagaaataatttattttattttaaattgaaatagtcacaggtatacagcacaggtgcag

SEQ ID NO: 32894 - DNA, 109 bp, Homo sapiens
tagataactggattctggggaagagcatccaggcagagtgaacagagtgagccaagggtttttaagtgcctggtagattccaggagtagcaaagaggtcagagtgtcta

SEQ ID NO: 32895 - DNA, 126 bp, Homo sapiens
gatatatcagattatatatatatatcagatatatcagattatatatatatatcagatatatcagattatatatatatatcagatgatgtgtatatatatatatgtgatatatatatatatatatct

SEQ ID NO: 32896 - DNA, 101 bp, Homo sapiens
aatttttaagattaccatcagttgttctatatcttttatatatgtatatgcatatacatgtatatttaatattgtataatatgattataattatataaatt

SEQ ID NO: 32897 - DNA, 73 bp, Homo sapiens
tcctatgttcacactagatgtaagtgggtcataaaacatttacgtactaggatgaatagattttgagctggga

SEQ ID NO: 32898 - DNA, 79 bp, Homo sapiens
tttttttttctttttacttcctgttgaaaatccaaatcagaatatttttggattttaaacaaagtgaatgaaagtgaga

SEQ ID NO: 32899 - DNA, 79 bp, Homo sapiens
atttcacatatagatgtgtgtgtatatatatacatatgaatgtatatatacacactaacatacgaacacactgtgagat

SEQ ID NO: 32900 - DNA, 112 bp, Homo sapiens
acctagaaagcaaaacattgaaagtgtgttgttagccctcctctctgcccctgaatcaacagacagagctctgggaccttggcaatgactcagaggttggggctttctgagt

SEQ ID NO: 32901 - DNA, 86 bp, Homo sapiens
catatgtatttatgtatatatatgtgtgcatatcgtatatatgtatatacacatatatatgtatacacatgtatatatacacatat

SEQ ID NO: 32902 - DNA, 107 bp, Homo sapiens
ctatggatttaggtctgggggtggtgagactataaatatatataattatatttttcataaatgtgtatatttattctatactgttcacatgaatgtttttaaaatag

SEQ ID NO: 32903 - DNA, 113 bp, Homo sapiens
ggattgtcttgctatacaggctctttttttggttccatatgaaatttaaagtagtttttttctaattctttgaagaaagtcaatgataacttgatgggagtagcattgaatct

SEQ ID NO: 32904 - DNA, 104 bp, Homo sapiens
tacttttacatttgtagatgttttatcttaggagatagctgtcagattcaatcagcttttgaaatcggtttttgcagaagataacttaactttaatgtattgta

SEQ ID NO: 32905 - DNA, 92 bp, Homo sapiens
cagttgttaaggtcatacatgcaaacactgtaggactttgtttttatttttgtttgatttggagacaaggtctctctctgttacccaggctg

SEQ ID NO: 32906 - DNA, 116 bp, Homo sapiens
tgcctttcacttgctgacatcattgcccaccatttctttttttatgttttttaaaaaacttttaagttcaagggtacatgtgcaggtttgtcacataagtgaacatgtatcatagg

SEQ ID NO: 32907 - DNA, 120 bp, Homo sapiens
gtacatgtgaggtatgtatgtgtgtgcatatgtgtgcatatatatacgtgtgtgcatgtgtctatatgtatgtgtgtgtatgtatgtacgtgtgaggtgtgtatgtgtgtgcatgtgtat

SEQ ID NO: 32908 - DNA, 116 bp, Homo sapiens
cttcctaggtaagtggtttaaaaaaaatgcatgctgtgcatttgtggactctgtgtctctctcatgggctaattggtttacatgcagtttttgtggttagccacttaactctgaag

SEQ ID NO: 32909 - DNA, 120 bp, Homo sapiens
gagatgaggaaaagtgataacgtagggaattgttcacaaaactaacttttttctatttaaaagattacaatttactctgaagttaggatccttcaatttttgttgttgtaatctcatttc

SEQ ID NO: 32910 - DNA, 110 bp, Homo sapiens
gccttccaagtagttgggactataagtgtgcaccaccacgcccggctaatttttttatgtttagtacagacggggtttcaccattgttgtccaggctggtcttgaactgc

SEQ ID NO: 32911 - DNA, 58 bp, Homo sapiens; identical to SEQ ID NO: 18119

SEQ ID NO: 32912 - DNA, 99 bp, Homo sapiens
ttctcattgtgggttcaagactccagcaggagcagagcagaactttgtctaatgtaattatgtttttctgttttgacctgtcagggagctccctgaggg

SEQ ID NO: 32913 - DNA, 83 bp, Homo sapiens
ccagtattgtgagactgcagaaagttgcgttgcgctgtctgcctcttagcatcagctttctgcttgacttctcattctcttgg

SEQ ID NO: 32914 - DNA, 67 bp, Homo sapiens
tttggagacggagtctcgctctgtcactgggctggagtgcagtggcacggtcttggctcaattcaag

SEQ ID NO: 32915 - DNA, 72 bp, Homo sapiens
tatatataattgtatatattatatatacatatataattatatgtatgtgtatataatatgtaattatatatg

SEQ ID NO: 32916 - DNA, 78 bp, Homo sapiens
atgtatttaattgttcaatcatagcacatataattatacatattaaatatgtgctatagttgaatatattttatatat

SEQ ID NO: 32917 - DNA, 111 bp, Homo sapiens
agatgtatacattttagtagtttaaatttccttagaaaactatagattatacaattttgtatattgattatataattttgcaggaaatttctacagtcaatgtgttcatct

SEQ ID NO: 32918 - DNA, 102 bp, Homo sapiens
ggcgatgtaaggtagccattgagacattgagagcacagactttagtaacagactgtctctgtgtgaatcctggttctgcttcttattagctatgtgactttg

SEQ ID NO: 32919 - DNA, 103 bp, Homo sapiens
cctttctcatcatctatgaaggttaatattgaaggtcaagttgattggattgaaggatgtaaagtattgatcctgggtgtgtctgtgagagtattgccaaagg

SEQ ID NO: 32920 - DNA, 176 bp, Homo sapiens
atgtatgtatgtacatatatatatgtatgtacatatatatgtatgtatatatatgtacgtatatatgtatgtatatatatgtacgtatatatgtatgtatatatgtatatgtgtgtgtatatatatgtttgtgtatatatgtgtatatatatatgcatgtatatatatgtatgtat

SEQ ID NO: 32921 - DNA, 96 bp, Homo sapiens
agaggaattacatgaaagacagtcaagagagaggagaggatctagtttctgtagcccttggcttcccctaatcttgtgttgcaggttaaatcttct

SEQ ID NO: 32922 - DNA, 72 bp, Homo sapiens
agcaaatgcagagattgcaaaaatcagacactgcatctagtgtttttcattttgaaaatgtctgcaattgct

SEQ ID NO: 32923 - DNA, 69 bp, Homo sapiens
gtgtatatatacatacatacatatatatatgtgtgtgtatatatatatgtgtatgtgtatatgtgatac

SEQ ID NO: 32924 - DNA, 115 bp, Homo sapiens
aagtgtatacatttttttttctcctttttaatgctgatccccattttctaaaacactgccactcagtgactggttaggaagcacttttggatcaataaatgagagagtgctactt

SEQ ID NO: 32925 - DNA, 104 bp, Homo sapiens
ttttgtagatctggaggtctcgctatgttgtccaggctggcaaaatatctttttatattgcaatgaaaagttagcttgtatgtgggtgtaggagtgctataaga

SEQ ID NO: 32926 - DNA, 81 bp, Homo sapiens
gggtattggagtgatcagtttcaagtcccagtttctttttctttttttttcttttggagacaaggtctcactctgtcaccc

SEQ ID NO: 32927 - DNA, 57 bp, Homo sapiens
gtggctctctctgcctcagtctcctcaactgtagctgggggtaacagtgagacccgc

SEQ ID NO: 32928 - DNA, 97 bp, Homo sapiens
atggactcaatggcgaagtaaacttgatcttttttatttcaagctggacaatcaggctacaaattgggagattaacagtacacatttattagtctat

SEQ ID NO: 32929 - DNA, 58 bp, Homo sapiens
tgagactgagtctcactctgtcgcccaggctggagtgcagtggtgcgatctcggatca

SEQ ID NO: 32930 - DNA, 59 bp, Homo sapiens
gttggagtctcactctgtcacccaggctgaagtgcagtggcatgaacaagactcacagc

SEQ ID NO: 32931 - DNA, 80 bp, Homo sapiens
ggtgagatgcagggtagattgttgattatgtatttattaattatatgctgaataacacaacattaggccccatatccatc

SEQ ID NO: 32932 - DNA, 117 bp, Homo sapiens
ctgatgatgttgatggttatgtgggtgtcctctatgttagtctctatatttttatgtgtctgaaatgtttcatactaaaaataatatgggcgcatcatggaaggttagaaatcacag

SEQ ID NO: 32933 - DNA, 58 bp, Homo sapiens; identical to SEQ ID NO: 523

SEQ ID NO: 32934 - DNA, 113 bp, Homo sapiens
tgttattatcaaaatagagctcatggttgcgatcctgatttttgtatttttgtttattcatcttaaaataagtccagctagtgggatatgtggagcttgcattgaaagaagca

SEQ ID NO: 32935 - DNA, 83 bp, Homo sapiens
gtgattaagtagtagtagtagtattctcattttgtacttgagtgcattgtctgagaagagatagtatagctgaggctgaatcc

SEQ ID NO: 32936 - DNA, 76 bp, Homo sapiens
gtgtgtgtgtgtgtatatatatgtatgtgtgtgtgtatatatatatatatatatatatatatatatatatatatat

SEQ ID NO: 32937 - DNA, 101 bp, Homo sapiens
agtcactttttggaaatgtaaatatatatacacacacatatatatacacatatatgtttatttttctgtttgttatatatagatatcttacgaaaagtgct

SEQ ID NO: 32938 - DNA, 61 bp, Homo sapiens
agcttttgtgtaaatatacatatgtatgtatgaatgtatgtatgtatgtttgtatggaact

SEQ ID NO: 32939 - DNA, 81 bp, Homo sapiens
aggagtttgggttttccgtgggcagagacagggctctccaggaaacatgaaccctttctcactcactgagccacgtgccct

SEQ ID NO: 32940 - DNA, 122 bp, Homo sapiens
gttaacttttgggtctgtggatgtcttatcattggtaccttgctactagtttgaatatttcaatttaaactgacattttgcagcataaacttcatgataagattctgaaagtgggctgccca

SEQ ID NO: 32941 - DNA, 109 bp, Homo sapiens
tctatatttataaacatgggctgatattcactgtgtgtctgtgtgtctataatatgtacatatttagagagtgaaaaagattagcaaaataagcatttaaatgtgtaga

SEQ ID NO: 32942 - DNA, 83 bp, Homo sapiens
attctatcagtcactagcaatgtgatcctgagaagattacttagtctctctgtcccacagtgcctggtttataaactgggaat

SEQ ID NO: 32943 - DNA, 118 bp, Homo sapiens
aatgtaatcactatgcatattggatgtaatcactatgcatatgatatatatacatatatgcatatatatatgcatagtgattacatatatatatatatatgcatagtgattacattta

SEQ ID NO: 32944 - DNA, 99 bp, Homo sapiens
tgcatgaaaagaaaaccttcagagatggtagctttatcaaataaaggtttgttttgtatagttgaatgaactctggagtgggcagctctgggtgatgca

SEQ ID NO: 32945 - DNA, 95 bp, Homo sapiens; identical to SEQ ID NO: 68

SEQ ID NO: 32946 - DNA, 93 bp, Homo sapiens; identical to SEQ ID NO: 69

SEQ ID NO: 32947 - DNA, 113 bp, Homo sapiens
gggccaattaaacctcttttctttataaattacccagtctcaggtagttctttataatgatgcaacaatgaactactacagattgctttgtctatttgggttctttttggttc

SEQ ID NO: 32948 - DNA, 110 bp, Homo sapiens
tctgccttttcattctgggctctgctacttattacctcttccttgaatctatatttttaatctagagtttctaatagttgtgatgaggatcagatgagatataaggcaga

SEQ ID NO: 32949 - DNA, 90 bp, Homo sapiens
gagtttctcctgatatgtatttttttttttttttgagacagggtcttactctgtcacccagactgaagtgtagtggtgctatctcagctc

SEQ ID NO: 32950 - DNA, 80 bp, Homo sapiens
tttaaggatgctgtctcagagagccctttatttatgcaggcaagataagaatctatctgagatactctcacattcttaaa

SEQ ID NO: 32951 - DNA, 95 bp, Homo sapiens; identical to SEQ ID NO: 68

SEQ ID NO: 32952 - DNA, 93 bp, Homo sapiens; identical to SEQ ID NO: 69

SEQ ID NO: 32953 - DNA, 101 bp, Homo sapiens
atgctatatatatgtgtgtgtatatatatatacacacatatatgtgtgtatatatatacatatatatgtgtgtatatatatacacacatatatgagtgtat

SEQ ID NO: 32954 - DNA, 115 bp, Homo sapiens
atatatatatatgtgtatgtatgtgtgtatatatatatatatatatatatatatatacatacacacacatatacatatatatacatatatatatacacacacacatatatatata

SEQ ID NO: 32955 - DNA, 219 bp, Homo sapiens
atactatatatatatatatatgtatgtgtatatatatatatgtgtatgtgtatatatatatgtatgtgtatatatatgtgtgtgtatatatatgtatgtatgtgtatatatatatgtgtgtgtgtatatatatatgtatatatatgtatatgtgtgtgtatgtatatatatatatatatatatatatatatacacacatacatacacatatatatatat

SEQ ID NO: 32956 - DNA, 70 bp, Homo sapiens
ggccagatgcgatgggtggaggctgggtagaggtgaggagccagacagcctcactgaatgtgtggtggct

SEQ ID NO: 32957 - DNA, 95 bp, Homo sapiens; identical to SEQ ID NO: 68

SEQ ID NO: 32958 - DNA, 93 bp, Homo sapiens; identical to SEQ ID NO: 69

SEQ ID NO: 32959 - DNA, 116 bp, Homo sapiens
tgcttttgctgtatttcacaggttttggtaggtggcattatcattttcatttgtttcaaaataatatttgattttcatgttaatatctatattgaaccagtggtcactcaggagca

SEQ ID NO: 32960 - DNA, 100 bp, Homo sapiens
atggtgtcaggtatggtctgtaagtgtttgcataagttttgataaattgtaactttttataatagatttgtgcttaatttgtagtagcacatgataaaat

SEQ ID NO: 32961 - DNA, 115 bp, Homo sapiens
ggctagtctatagtttcaggcctgaaatagtacttccttcataattgcttgaaaagaacttagtcacgcagtcacacatacaatcaagtactgcctggaaatgttgtgacatgcc

SEQ ID NO: 32962 - DNA, 94 bp, Homo sapiens
ggttaggcattaggcatttcaaggcaggtaaaatatacagaatatttttatcaatatattgcctagaaattctagtattattcaaggtccagcc

SEQ ID NO: 32963 - DNA, 114 bp, Homo sapiens
gaattgattagagggagaaagcagacagtagtgatatcctagcagttcttaaatgtgcatacttgatttatatatttatatgggatgaaaattctatttgcccttttatgattc

SEQ ID NO: 32964 - DNA, 118 bp, Homo sapiens
gtgctacaatatcagcaacttactagcaaatttttcaggaaaaaaaaatacacacacacacacacagaggagagtatgtggtaaactgttaaagactggtagttctatgtaaatgtac

SEQ ID NO: 32965 - DNA, 70 bp, Homo sapiens
ggcctcagctggctacaggctttcactttggtatgaggacaatgccactctgcctctctgcctctgagcc

SEQ ID NO: 32966 - DNA, 73 bp, Homo sapiens
agactatttgttacctcttccatataagtatttatatgttttatttgtgtgggttagaaatgacaaatgagct

SEQ ID NO: 32967 - DNA, 127 bp, Homo sapiens
gtgtatgtgcatgtgtgtatgtgtgtatgtgcatgcgtgtgcgtgtatgtgtgtatgcgtgtgtgtgtgtgtgtgtgtgtgtgtgtgtggtggcctgcgctctgtacacacaaccgcccagcagaga

SEQ ID NO: 32968 - DNA, 103 bp, Homo sapiens
tctgtgccccagctgtcttatctgtgttttactctctgctctttctgtctgcttgtagtcagaagagaagtgatttccttgaaatgcatgaggctagaaaggg

SEQ ID NO: 32969 - DNA, 122 bp, Homo sapiens
catatcaagtaggtatgtgtatatatatgtatacatacatacatctcaagtatgtatgtgtatatgtgtgtgtatatatatatgtgtgtgtgtatatatatgtgtgtgtgtatatatatatg

SEQ ID NO: 32970 - DNA, 103 bp, Homo sapiens
agacttctttgttgcctaacatatagtctgtcagagagaacatgtattctgctgttgttgggtggaatgttctatgtatgtctgttaggtatagttgatttct

SEQ ID NO: 32971 - DNA, 99 bp, Homo sapiens
gtgtgtgtatacatgtatacccatatgtatatgtgtatacatatatacacgtacatacatatatatatgtatacatatatatgattatacagacacaca

SEQ ID NO: 32972 - DNA, 78 bp, Homo sapiens
tacctgagtgggtgtttacctgtgtgggtgtttacctgagtgggtgtttgcctgcgtgggtgtttgcctgcgtgggtg

SEQ ID NO: 32973 - DNA, 95 bp, Homo sapiens; identical to SEQ ID NO: 68

SEQ ID NO: 32974 - DNA, 93 bp, Homo sapiens; identical to SEQ ID NO: 69

SEQ ID NO: 32975 - DNA, 100 bp, Homo sapiens
ttactaaactgcctagacatgtttaaacattataaatgtaaactgttattgttgatgacaatgatgatggtgtaggtgatagtagtgttggtggtggtga

SEQ ID NO: 32976 - DNA, 123 bp, Homo sapiens
aacaggtagagagtttggttgggaggaaaggggagaatctgacaaaaataaaagagggaagaattttcttttttttttttttttttttttttttttttgagacggagtctcgctctgttgcca

SEQ ID NO: 32977 - DNA, 56 bp, Homo sapiens
tgagtcagagtctcactgtcacccaggctggagtgcagtggcacaatcttgactca

SEQ ID NO: 32978 - DNA, 104 bp, Homo sapiens
agattaaacatttattttaaacacaataatagtgtaactaaggtatataaaacatgttttagacactggctgttgtgtacagagaataaagataaatgttttct

SEQ ID NO: 32979 - DNA, 115 bp, Homo sapiens
gatttcttctcctttatgtagatactcagctgtggggttgctggatcaaattgtacttctatttttatttatttgagaaatctccattctgttttccatacaggttgaactaatt

SEQ ID NO: 32980 - DNA, 95 bp, Homo sapiens; identical to SEQ ID NO: 68

SEQ ID NO: 32981 - DNA, 93 bp, Homo sapiens; identical to SEQ ID NO: 69

SEQ ID NO: 32982 - DNA, 102 bp, Homo sapiens
ttgggcaacaacaaaagatgatatatttcctccttggaaaaaatatttttaaatttttgaattttttttcaggctcaatatttctatctttttgtagtgcag

SEQ ID NO: 32983 - DNA, 116 bp, Homo sapiens
gcactgattttcgcacgttgattttgtatcctgtgactttactaaatttgtttttcagttgtaaaagttttctagtggagtctagactttcctagatataagatcaggtcatctgc

SEQ ID NO: 32984 - DNA, 108 bp, Homo sapiens
tagtcactttttccatcttatttccattctccctggctatgttatgtatgtatatatgtataaagacatactgagagacaggactagctggatttcctaggcggacta

SEQ ID NO: 32985 - DNA, 102 bp, Homo sapiens
ttttgtatgttgattttgtatcctgcaactttactgaatttgtttatcagttctaacaatttttttggtggagtccaggtttttctaagtataagatcacgt

SEQ ID NO: 32986 - DNA, 117 bp, Homo sapiens
tcaaggactttgcttcctttttctgggaagggattgctctatctgtctctgtcaatattgagtattactcaaggactttgcttcctctttctgggaagggattagtgcaatttttgg

SEQ ID NO: 32987 - DNA, 58 bp, Homo sapiens; identical to SEQ ID NO: 23944

SEQ ID NO: 32988 - DNA, 248 bp, Homo sapiens
tgtatacaatattgtatatgtatatattatttacatatattatatacatatatacatatgtatatataattatatatacatatatatataattatatatacatatgtatatatgtatatattatatgtgtacatacatatgtatatattatatgtgtacacatatttattatatatgtgtataattatatatgtgtattatatgtatatttattatatatttatgtgtgtatataatacattacatat

SEQ ID NO: 32989 - DNA, 59 bp, Homo sapiens
tggttctgggtgcggctcgattttgtgaaataaaatgaagattgagagcacagaggcca

SEQ ID NO: 32990 - DNA, 150 bp, Homo sapiens
tatgcatatatatacacgtatatatatacacatatatgtatatatatacgtatatacgtatatatatacatatatatgtgtatatatatacacatatatacgtatatatatacacatatatatgtatatatatacacatatatatgtata

SEQ ID NO: 32991 - DNA, 135 bp, Homo sapiens
gtatatatatacatatatatgtgtatatatatacgtatatatgtgtatatatatacacatatatatgtatatatatacgtatatacgtatatatatacatatatgtgtatatatatacgtgtatatatatgcata

SEQ ID NO: 32992 - DNA, 88 bp, Homo sapiens
aactatcctttttactccatttcatgtgtctatttatatttttaggctataaccaggtgctgtgacctagagtagaaagaaggaagtt

SEQ ID NO: 32993 - DNA, 119 bp, Homo sapiens
attttcctggatagtcttaatacttgcagaggttcatctgtgtgtttgcattgaagagttagatatttattgtaaacttcttagtctgagaatgtttgtactgatacatcttgggaagt

SEQ ID NO: 32994 - DNA, 92 bp, Homo sapiens
attatgtaattaaatatttatacatataaaacattatatagtatatgatgtatagttatatatcatatttatataaatatatgtaacataat

SEQ ID NO: 32995 - DNA, 95 bp, Homo sapiens; identical to SEQ ID NO: 68

SEQ ID NO: 32996 - DNA, 93 bp, Homo sapiens; identical to SEQ ID NO: 69

SEQ ID NO: 32997 - DNA, 85 bp, Homo sapiens
acagagactctcagaaaaaaagttttctagaaaataagaacaggacattaatctttctttgttttttttgagacggagtctctgt

SEQ ID NO: 32998 - DNA, 96 bp, Homo sapiens
aaagagacattttgttttggagaaatgccatgtagctgtctactcaaggtagttcactttttgttttacatttttctatattaaaatgccctcttt

SEQ ID NO: 32999 - DNA, 79 bp, Homo sapiens
tgaacacttcacacaggtgagagagctcagtgcatggcagccatgttgcctggaacttgctctcatgtgtgaagtatca

SEQ ID NO: 33000 - DNA, 116 bp, Homo sapiens
ccatctggaacatttagcctcttccattagtgctgtaacagaagacagaatggagagctcacacccactcttcacgttacttccactcacagaacataggctacaattttacatgg

SEQ ID NO: 33001 - DNA, 98 bp, Homo sapiens
gctgtgtggagtttacatgctctctctatatctgtgtgggttttttcccccaggttctcctcccacttcccacagatgtgcatgttaggttcactggt

SEQ ID NO: 33002 - DNA, 95 bp, Homo sapiens; identical to SEQ ID NO: 68

SEQ ID NO: 33003 - DNA, 93 bp, Homo sapiens; identical to SEQ ID NO: 69

SEQ ID NO: 33004 - DNA, 128 bp, Homo sapiens
ctggctttctgttcccaagtcttttggtaccaggaggtcactgatgctaacaaatctggagggagagagaattcagtcaggtgagctggtcccacacctgaccatggctctgcctgaggtcaactgag

SEQ ID NO: 33005 - DNA, 60 bp, Homo sapiens
gtcagactctcatttagtctctcctagatctgggaaagacctagaaatgtaaggtcttgc

SEQ ID NO: 33006 - DNA, 81 bp, Homo sapiens
catccaggcatgaaaacatgtatgtacattaattgcatttgaaagttttgtgtgcatttgtgtgtgtgtgtgtgtgtgtgt

SEQ ID NO: 33007 - DNA, 110 bp, Homo sapiens
actctctatcatcatgaatgtaatttttttagcttctacatataagtgagaatatgcaatatttttatttatgtgtcaggcttatttcaccaaacgtaatgtccttcagt

SEQ ID NO: 33008 - DNA, 58 bp, Homo sapiens; identical to SEQ ID NO: 502

SEQ ID NO: 33009 - DNA, 139 bp, Homo sapiens
tgtgtagtattactttgtgtatatacatatatatatggtgtatatatatacacatatatacatatatatacatatatacatatgtgtatatatacatatgtacatatacatatgtgtgtgtatatacatatgtgtgtat

SEQ ID NO: 33010 - DNA, 82 bp, Homo sapiens
agaaaatgcgtgtgtgtgtatgtgtgcctctgtgtgtgtgtgagagagacagagagcgaatgttgaaaactgagtattttct

SEQ ID NO: 33011 - DNA, 116 bp, Homo sapiens
gtagttatgtagataagcaaaagtgcaaaactctgttctgttaaggcaaattaaaataaatattttaaaaatatgttttataagcacctaccgttttggacaaaaatctacactgc

SEQ ID NO: 33012 - DNA, 73 bp, Homo sapiens
gctattccctctgagggtgtgttctctgaatcactctcactgtgaaagatgctcatcctctctagatctgagc

SEQ ID NO: 33013 - DNA, 112 bp, Homo sapiens
tttctttgtttttgatgactttggcagttttgaagattactggtagataattcttagaatgttatttaatttaaatttgtctaactttgttttttcatcataagacaggaaa

SEQ ID NO: 33014 - DNA, 86 bp, Homo sapiens
agacagattaagtaacatgctgaaagtcacagattttttttttctaaagagaaatataatgattttgagcatgagatttagagtct

SEQ ID NO: 33015 - DNA, 88 bp, Homo sapiens
tgaatagttctctaggggaaggtgttcagagaggtttatttggcctgctaagcaagtctctgaggcactgtctttctggccctgttca

SEQ ID NO: 33016 - DNA, 92 bp, Homo sapiens
ctatatgttacaaaatatatatacacttgagttttagttcatttacctactgagttaagttgtagcttgttttgtaaaaacacaaagtgtag

SEQ ID NO: 33017 - DNA, 91 bp, Homo sapiens
ctctgtatatattctatatatatgctatatatatgctatatacatatatagagagtgctacatatatatatatatagaaagagagacagag

SEQ ID NO: 33018 - DNA, 63 bp, Homo sapiens
gcgaggtggtgtaactgcatcagaaactgacaaattatttttgaagtggttgcaccattttac

SEQ ID NO: 33019 - DNA, 74 bp, Homo sapiens
tgtgtataggcagatgtatgtatacataaatgtgtacacatacaaaattgtatatatgtatatctaaatacaca

SEQ ID NO: 33020 - DNA, 68 bp, Homo sapiens
tgcacatgtgtatatatatatacatatatgtgtttatacagatgtgtgcatatatgtgtatttgtgca

SEQ ID NO: 33021 - DNA, 81 bp, Homo sapiens
gcttggctgaactgcatatatatatatgtgtgtgtgtgtgtatatatatgtccatatatatgtgtgtatatatatataagt

SEQ ID NO: 33022 - DNA, 115 bp, Homo sapiens
tatgtccatatatatgtgtgtatatatatgtccatgtatatatgtatatatatgtccatatatatggatatatatacacacatatatatatggatgtatatatgtccatatatat

SEQ ID NO: 33023 - DNA, 133 bp, Homo sapiens
tatatgtgtccatatatatgtgtatatatgtccacatatatgtgtatatatatgtccatatatatgtgtatatatatgtccatatatatgtgtgtatatatgtccatatatatgtgtgtatatatgtccatat

SEQ ID NO: 33024 - DNA, 80 bp, Homo sapiens
tacacacacacacacacacatatatgtatatatgtgtgtgtatatatgtatatacatatatgtgtgtgtgtgtgtgtgta

SEQ ID NO: 33025 - DNA, 103 bp, Homo sapiens
aatagcttttgacctcaagcaagttcatccattctctcaatcactcacatattaattgagagcttactatgaatgaggcattgttctgaaaaatatagctgtt

SEQ ID NO: 33026 - DNA, 67 bp, Homo sapiens
agatggccatcttcttctcattttgtcctcacatggctgagagcagagagagaggtgcaagctatct

SEQ ID NO: 33027 - DNA, 58 bp, Homo sapiens
tgagatggagtctcgctctgtcgctcaggctggagtgcagtggcgtgatcttggctca

SEQ ID NO: 33028 - DNA, 115 bp, Homo sapiens
caaagcaattcagtaagtagtttcaagttggggtgaatgcagaaagtatttcaatattttgttactgtgtagtgtcgcctttcatctctagtaatacttattaaagtctactttg

SEQ ID NO: 33029 - DNA, 109 bp, Homo sapiens
ctgtgctccctcttcctcccctaactctttgaatgcgggtgtctactgcactcagtctgtcactgggtctgccttgtatcttgggtgcataggaggggaaaggggccag

SEQ ID NO: 33030 - DNA, 175 bp, Homo sapiens
aacaatatggaacatattaatacagaatatttattaatatagactaagtatatcattctacattaataatatattattctatattaatatatttatatatgttattaatatattattctatattaatatatttatatatgttatgaatatattaatatattattctatattaata

SEQ ID NO: 33031 - DNA, 73 bp, Homo sapiens
tgcaatgcaagtgactgaggtgacagagctgggtcccagcccacagctgcaaccttccaagccaaggcctgca

SEQ ID NO: 33032 - DNA, 58 bp, Homo sapiens; identical to SEQ ID NO: 2633

SEQ ID NO: 33033 - DNA, 77 bp, Homo sapiens
gtataatatgtatatgtatacacatacatatacagtatacatagtatatatgtgtgtgtatatatatgtgtgtatat

SEQ ID NO: 33034 - DNA, 158 bp, Homo sapiens
gtgtgtatatgtgtgtgtatatatatatgtgtgtatatatgtgtgtgtgtgtgtgtatatacgtatatatatatatacgtatatatatatacgtgtgtatatatatacgtgtgtatatatatacgtgtgtatatatatatatatatatatatatatat

SEQ ID NO: 33035 - DNA, 87 bp, Homo sapiens
atctttaagaatgtggtagtaggaagaatttttttctaaaagttaagcctacagatttaactaccagattacagaaaacttgggggt

SEQ ID NO: 33036 - DNA, 118 bp, Homo sapiens
gaagtgcttcctggcttgagtgaatacttttatggtgctggagttgagagataacacagttaactgttgaaattgggccattcccgtttcacaggctgccattggacctgtcaagtgc

SEQ ID NO: 33037 - DNA, 58 bp, Homo sapiens; identical to SEQ ID NO: 2263

SEQ ID NO: 33038 - DNA, 81 bp, Homo sapiens
tcataatatttcattattgttacatctgttgtgatgatctgtgatcagtaatgtttgatgtgactatcgtgattgttatgg

SEQ ID NO: 33039 - DNA, 117 bp, Homo sapiens
gcactgttgagaggccagttgatgttggtaatcataactttataaaattataattataatcataaatttataatttgtcctatgactttctccaacagtactcagcttcttgaatgc

SEQ ID NO: 33040 - DNA, 58 bp, Homo sapiens
tgagacagagcctcactctgtcacccagcctggagtgcagtggtgagatctccgctca

SEQ ID NO: 33041 - DNA, 65 bp, Homo sapiens
caggaattcaaggttgttgtgagctatgatggcaccagtgcattccagcttggagcaagatcctg

SEQ ID NO: 33042 - DNA, 133 bp, Homo sapiens
gtgtgtgtgtgtatatatatatgtgtgtgtgtgtatatatatatatatgtgtgtgtatatatatatgtgtgtgtgtatatatatgtgtgtgtatatatatatgtgtgtgtatatatatatacacatacaggta

SEQ ID NO: 33043 - DNA, 100 bp, Homo sapiens
attgcatatttcacataggtttctctagagtttatttgattatagttttaaaaattattaaaatattttgctttgggagagagattttcagaaatgcagt

SEQ ID NO: 33044 - DNA, 88 bp, Homo sapiens
gaaaaatatgtcagagtcagagggcaaaggtaattttgagtacagcacagtgtctgtctctcaatatgtcctctggaacatccttttc

SEQ ID NO: 33045 - DNA, 126 bp, Homo sapiens
ttatagatatacatatatacatatacgtatatgcgtgtatatacatatatatgtatatatacatatataatatatgcgtatatatacgtgtatacatgtatagatatagtgtagagagtgtgtgtg

SEQ ID NO: 33046 - DNA, 139 bp, Homo sapiens
gcatatattatatatgtatatatacatatatatgtatatacacgcatatacgtatatgtatatatgtatatctataaggatatatgcatacgtatatatgtagtataatgtgtgtgtgtgtgtgtgtgtatatatatat

SEQ ID NO: 33047 - DNA, 57 bp, Homo sapiens
ttgagacagagtctctcactctgttgtccaggctggagtgcagtggcatgatctcag

SEQ ID NO: 33048 - DNA, 79 bp, Homo sapiens
ggcacataagactgcttggagtgctgacctcctcactgctcagtcagtctccccaatgcagagtcccttttcatctgcc

SEQ ID NO: 33049 - DNA, 67 bp, Homo sapiens
ccttctcgtggagagggagagagcctggccagggactcaggctgactcactttcacctggtcggagg

SEQ ID NO: 33050 - DNA, 80 bp, Homo sapiens
agagcttagtggctttaaacatttatttattagcttacagttatgtaggtcagaaatgtgggtggactcaactgggtttt

SEQ ID NO: 33051 - DNA, 113 bp, Homo sapiens
gtatacttgtttctggttgttgaccagagctgctgttatctttcatatatatctttattactatgagctgttttctagcctctttgtacagctgactttttacaggagtatgc

SEQ ID NO: 33052 - DNA, 114 bp, Homo sapiens
gtattactgaaggtatactggagtattactgtttatctaacattaaagtcttttttaaattattattatactttaagttttagggtacatgtgcccaacgtgcaggttagttac

SEQ ID NO: 33053 - DNA, 108 bp, Homo sapiens
agcatctgattgcaaggccataactgtgaacacattttgttgttgactaagatactttcgaagttggtttattttggctttctcttacttacttgtgaactaattgct

SEQ ID NO: 33054 - DNA, 97 bp, Homo sapiens
tatttatgtatctatcatctgtctatctattgttattcatatttatatttatatctacaaatgtaagtagacaatgatagacagatataagtaaata

SEQ ID NO: 33055 - DNA, 104 bp, Homo sapiens
ggtggagtctttagtgtgtgtgtgtatatatatatatatatgttatatgccttttatttcatatatatatgcattatagatatatataatatgtgcattttatt

SEQ ID NO: 33056 - DNA, 98 bp, Homo sapiens
gggttggattcagcaccagtttcatgtttggcatctggaagttatagattctatagtactttgagagtggaggctgtgtcttataaaactaaatatcc

SEQ ID NO: 33057 - DNA, 75 bp, Homo sapiens
tagggcttcagcatatgaagtttgggggacagaaacactcagtctgtaacacttaacttcattctgtttgacctg

SEQ ID NO: 33058 - DNA, 64 bp, Homo sapiens; identical to SEQ ID NO: 24107

SEQ ID NO: 33059 - DNA, 118 bp, Homo sapiens
tgggcttggtcaagggtaggcaccaccaagagatctgagagcagagagagaggtgagagtattggctgtacacccattttgatgccttgtctctgggaacaaactaccttccttccca

SEQ ID NO: 33060 - DNA, 80 bp, Homo sapiens
gacagcctgggtttaatctccatacctgtattttttcattttttggatggaataaattgtacctacctcataaggttgtc

SEQ ID NO: 33061 - DNA, 116 bp, Homo sapiens
ggcgggtgggtgatcagatggaccctcaggagtgctgccaggcgagccaacaccctgctgctcatgtgtctgtgtgtctgcctcagcttctctgggctttccatctcttaagggct

SEQ ID NO: 33062 - DNA, 56 bp, Homo sapiens
gtggagatggagtctctctctgtcaccaggctggagtgcagtgaccctgtctcgat

SEQ ID NO: 33063 - DNA, 114 bp, Homo sapiens
tatagtattttatataacataccctaattgcttattatatatctgtataattattttatcatataagataatttcataagctaagatggtattttatatatttcatttattata

SEQ ID NO: 33064 - DNA, 72 bp, Homo sapiens
ttgttttttgagatggagtctcactctgtcactcaggctagagtccagtggtgcgatctcagctcactgcaa

SEQ ID NO: 33065 - DNA, 58 bp, Homo sapiens
tgagacggggtctcactctgtcacttaggcttgagttcagtggtgggatctcagctca

SEQ ID NO: 33066 - DNA, 118 bp, Homo sapiens
gtttgcttttcacaactattttcttggccaagggactaggtgttcttttttttttttcttttgagatagtcttgctttgtcacccaggctggagtgcagtggtgcaatctcagctcac

SEQ ID NO: 33067 - DNA, 89 bp, Homo sapiens
gccttcagtgagtcataatctttttgcctcagtgttgatggctgctgactgatcagagtgtggctgctgaagattggggtggctgtggc

SEQ ID NO: 33068 - DNA, 58 bp, Homo sapiens; identical to SEQ ID NO: 605

SEQ ID NO: 33069 - DNA, 61 bp, Homo sapiens
tggacagggtctcactcactctgttgcttaggatagagtgcagtggtataatctctgctca

SEQ ID NO: 33070 - DNA, 158 bp, Homo sapiens
atgtgtatatatatgtatatatatgtgtgtatatatatgtatttatgtgtgtgtatatatagtgtatatatgtatatatatgtatatatgtgtatatatgtatatatatgtgtatatatatgtgtatatatgtgtatatattcacacatacatatata

SEQ ID NO: 33071 - DNA, 98 bp, Homo sapiens
aaaattctctggtggacgccttcattatatctatttcattcaatgaccctgatatcaaacaattctctgagatagctaattgaccacctcagaatttt

SEQ ID NO: 33072 - DNA, 98 bp, Homo sapiens
tgtgcgtgtgtatatgtgtgcgtgcatgtgtgtgtgtatatgtatatatactttatatatacatacatacatatatagtatatatatacacacacata

SEQ ID NO: 33073 - DNA, 78 bp, Homo sapiens
gggatatcctgtcactagaaggaaaagagagtattttagacagtacttttttttttgacactggtctcactgtcaccc

SEQ ID NO: 33074 - DNA, 80 bp, Homo sapiens
cagatctgttacctttgtgcctgggtccctgtttgacttggaagcaaaatagggaaggggtgaggcagagggagtttctg

SEQ ID NO: 33075 - DNA, 118 bp, Homo sapiens
tccatcactcagacaaaaatcactattaacatatttttaggcatttcctttcagaattttttctatttaaatacatgagtgtgaatgtctgtgggtgtctatagacatgtctgtggat

SEQ ID NO: 33076 - DNA, 116 bp, Homo sapiens
ttctacatatctggcctagtgtcgagtggatttcatagcatatagaatagagtatatagatgtttgttgaatggctatatgcatgactggatacttgaacaaacctccaagtagag

SEQ ID NO: 33077 - DNA, 110 bp, Homo sapiens
ctctgatcagaccggcaccgcagtgtgggagagaagctgtgtgaagagtctgtcgtctgactttggcaagggttcctctgcacagtgttgtgtggcactgggggcagcag

SEQ ID NO: 33078 - DNA, 117 bp, Homo sapiens
atgtaattgagtacattagcctagtggctccttaacacataaattaggtactttgggaaataaactgattttgataatctgtagccacataatagaatgttgtcaagctctttgcgt

SEQ ID NO: 33079 - DNA, 95 bp, Homo sapiens; identical to SEQ ID NO: 68

SEQ ID NO: 33080 - DNA, 93 bp, Homo sapiens; identical to SEQ ID NO: 69

SEQ ID NO: 33081 - DNA, 100 bp, Homo sapiens
ctggctccatgcatgtgtgtgcctgagtgtgtgtgtgtgtttgtgtgcaagtgcatgtgtatggagagagaggtgcaatcatacaaaatatatagatgta

SEQ ID NO: 33082 - DNA, 107 bp, Homo sapiens
aagtatgagatgctgttgataaaggtgaaggtgatgaagagagtagtgataatgatgataacagctaacatttatcaggcacttactgtcgacaaaatactatgctt

SEQ ID NO: 33083 - DNA, 70 bp, Homo sapiens
tatatatatatatgtgtgtgtgtgtatatatatgtgtgtgtgtatatatatatgtgtgtgtgtatatata

SEQ ID NO: 33084 - DNA, 97 bp, Homo sapiens
actcaaagctctggccttagacaaatattgacggttataaatcaattttttttttgaaacggaatctcactctgtctcccaggctggagagcagtgg

SEQ ID NO: 33085 - DNA, 91 bp, Homo sapiens
tattacgtatggctgttgtaagaattgagtgtggtaacacttgaaagtgtaactcatactatgttgtgcaggagttgacctaagagtaatg

SEQ ID NO: 33086 - DNA, 101 bp, Homo sapiens
gtggtgactgcacagatgttctaatgtgcccctccatttctttcttttttttttatactttaagttctagggtacatgtgcacaatgtgcaggtttgttac

SEQ ID NO: 33087 - DNA, 88 bp, Homo sapiens
ggggttcagaggtgaatgataagattttgtctcattttattttattttattttatttatttttgagtcagagtctcactctgtcaccc

SEQ ID NO: 33088 - DNA, 113 bp, Homo sapiens
accctcaagtgttaagatgactgtggaaccccaagacaaatagagccagcagtattctgtgtggctctctgtgtggctctgggtgttttaaagcattttgcaaatgatttggt

SEQ ID NO: 33089 - DNA, 107 bp, Homo sapiens
tggctattcaggctttatttttggttccgtatgaattctttaaaaagttattttctaattctgtgaagaatgtcaatggtagtttaatgggaatagcactgaatcta

SEQ ID NO: 33090 - DNA, 79 bp, Homo sapiens
ttcctgcaatgagatagtcttatctggggggtgactggagacagtgacaaatcatcaggaattagattctcataaggag

SEQ ID NO: 33091 - DNA, 116 bp, Homo sapiens
agatctacttgctactttgtttttgtaaagggcctattgtttaattatataaaagtatgaaaaccactgctgaatatggtgccagttgatccagatggatgtggtctactaggtct

SEQ ID NO: 33092 - DNA, 58 bp, Homo sapiens
tgaggtggagtctcacactgtcacccaggctggagggcagtggtgcgaccatagctca

SEQ ID NO: 33093 - DNA, 101 bp, Homo sapiens
agcaaattagggttctgaaagttggttgtgtagtataaattaaaacacacacatacacacacacacacaccagacactgtctttgtaactctagtttagct

SEQ ID NO: 33094 - DNA, 87 bp, Homo sapiens
tagggagggagttacggaacagtgttacttttttttttttttttttttttttttttgagacggagtctcactctgtctcccagcctg

SEQ ID NO: 33095 - DNA, 117 bp, Homo sapiens
gttatgaattaatattttattttctaaaatttgatttttagcaatttttaattaatattttctaattttattgcattaagatcagagaaaatagtctgtaaggtattgattctttac

SEQ ID NO: 33096 - DNA, 66 bp, Homo sapiens
tctacatatatatgtatatatgtatatacatatatgtgtgtgtatatatgtatatgtgtgtataga

SEQ ID NO: 33097 - DNA, 63 bp, Homo sapiens
gagcagaggctctgagtgcctgggtgcctcgcccaagggcatgctctcagaaatgccatgctc

SEQ ID NO: 33098 - DNA, 97 bp, Homo sapiens
ggaggcagaggttgcagtgaactgggatggtgccactgcactccagcctgggtgacacagtgagactctgtctcaggaatagcgctgaccctgcgcc

SEQ ID NO: 33099 - DNA, 78 bp, Homo sapiens
cccagattcatctttcaccctctcacactctgcctgttggactcctggggtaaactgtgggagagtgaattcgctggg

SEQ ID NO: 33100 - DNA, 112 bp, Homo sapiens
ctttggaagttgagaggcagtatgtataatggtaagtctctctgtgcctcagtttcctcaactgtaaaatagggataataactgactatatactgtacttttgtttcataag

SEQ ID NO: 33101 - DNA, 106 bp, Homo sapiens
cattcccaccaacagtgtacaagggtttccttttcttttctttttttttttttttttttttttttaattgagacggagttttgctcttgttgcctaggctggagtg

SEQ ID NO: 33102 - DNA, 83 bp, Homo sapiens
tgtatgttttatttaaatatatacaaagatctagatctagatatatagatctatatatgtatatatgtaggtcaagttatgca

SEQ ID NO: 33103 - DNA, 59 bp, Homo sapiens
tgtggggtggtgtcatgagacagtggttctgggtgcagtctcgctctcactgccccagg

SEQ ID NO: 33104 - DNA, 86 bp, Homo sapiens
ttgggttccagactctgggttcatttgctctttttttttttttttttttttaagagacaaggtctcactctgtcacccaggctgga

SEQ ID NO: 33105 - DNA, 114 bp, Homo sapiens
tatgtgtcacaggtaagaatcccaggtcacaggtgcaagtttattaaattaaaaacaattttttttttttgcaactgacaatttctagttcatatctcattactctgatacgta

SEQ ID NO: 33106 - DNA, 106 bp, Homo sapiens
ctatatatagagtgaatggttattgctatataactatagttaaatatatttaagtgaatatatttaactatacagttatagtatgtaccattaagaactgtcttag

SEQ ID NO: 33107 - DNA, 119 bp, Homo sapiens
ttggcctctgcatggggctgtttgagtgtcctctctatctggtggctcacttctctcacagtgagaaatcctagagaaaatgggacactgcaacatcatttatgatcttcagaagttaa

SEQ ID NO: 33108 - DNA, 86 bp, Homo sapiens
cagactcagctagactcagacactcactgggacaacctgcctgtggatagaggctacccactttgggtctcctgagagctgttctg

SEQ ID NO: 33109 - DNA, 58 bp, Homo sapiens; identical to SEQ ID NO: 14767

SEQ ID NO: 33110 - DNA, 56 bp, Homo sapiens; identical to SEQ ID NO: 14768

SEQ ID NO: 33111 - DNA, 110 bp, Homo sapiens
cagctaatttttccatttttagtagagacggggtttcactttgtgggaccaggctggtttcaaactcctggcctcaagtgattggcccgccttgacctcccaaagtgctg

SEQ ID NO: 33112 - DNA, 110 bp, Homo sapiens
catgcgtgagtgtgcacatttgttcacatgcatgcacacatctgtgtgcatatttgtgtatgtgcatgtgcattttgtgtgtgtgcacatgtgtgtgttgcttccaataa

SEQ ID NO: 33113 - DNA, 105 bp, Homo sapiens
ggtgcctagcattttatagacttcagtaaggatttgttgaatgaatgaaagaatgaatgtatttcctatgcacgtccttggcttctgtggttttgctgctttgcc

SEQ ID NO: 33114 - DNA, 80 bp, Homo sapiens
tagtaggatttctgcaaacacagtcagcaatactgtcttttcccagaagaaagtgggcactgtgggtataaatttttctg

SEQ ID NO: 33115 - DNA, 78 bp, Homo sapiens
ttcatagagaatttttatttatccaaaggaactgagaaaagttcagtttggagataattactggagcttttttatgag

SEQ ID NO: 33116 - DNA, 107 bp, Homo sapiens
ggtaattttatcaatacaagctcagacaagtctggactctcaattttattataattattcattatatattgtggtttaaatttgtattgatttattgattctgtacc

SEQ ID NO: 33117 - DNA, 95 bp, Homo sapiens; identical to SEQ ID NO: 580

SEQ ID NO: 33118 - DNA, 93 bp, Homo sapiens; identical to SEQ ID NO: 69

SEQ ID NO: 33119 - DNA, 97 bp, Homo sapiens
gtgttatacatatatatatatgtgtgtatatatatatatgtgtgtgtgtatgtgtgtgtatatatatatatacacacacacacatatatgtatatat

SEQ ID NO: 33120 - DNA, 95 bp, Homo sapiens; identical to SEQ ID NO: 68

SEQ ID NO: 33121 - DNA, 93 bp, Homo sapiens; identical to SEQ ID NO: 69

SEQ ID NO: 33122 - DNA, 66 bp, Homo sapiens
tgagacagagtctcgctctctcgctccgtcacccaagctggagtgcagtggcacgatctcggctca

SEQ ID NO: 33123 - DNA, 60 bp, Homo sapiens
ggctcgaaatttaatagtttcagctactgaagaggctgaggtagaaggattgattgagcc

SEQ ID NO: 33124 - DNA, 117 bp, Homo sapiens
ttaacagtttttaatggtatgctatttccgctagataattaatggtttattgttggaaaaatatttgtatattgtttaatgatcttggaaatagagcccattattttaacctgttga

SEQ ID NO: 33125 - DNA, 93 bp, Homo sapiens
gtgtgtctgcatgtgtacacgtgtgtatgtgtatatgtgtgtatgtatatgtgtgtacgtgtgcatatgtgtatgtgtgtgtctggatagtac

SEQ ID NO: 33126 - DNA, 85 bp, Homo sapiens
acatatacgtgtatatatatatatgtatacacatgtacatgtatatacatacacgtattcatgtatatatatatacatatatata

SEQ ID NO: 33127 - DNA, 96 bp, Homo sapiens
gctttctggggcaatgagctattactgtgacagaaataaaaaatatattttttaaacctgtatccaaatagtttgtatgctattgatcttagatgc

SEQ ID NO: 33128 - DNA, 110 bp, Homo sapiens
ccttgacaattatttgaaaagtgccccttacaaatggttcagtagctcccaaacctgtctatgtaaaataatcaactgggaaggaggatttttggcagtagggctcaagg

SEQ ID NO: 33129 - DNA, 58 bp, Homo sapiens
tgagatggagtctcattctgtcactcaggctggagtgcaatggtgagatctcagctca

SEQ ID NO: 33130 - DNA, 58 bp, Homo sapiens
tgagacagggtctcactctgtcacccaggctggagtgcggtggtacgatcttggctca

SEQ ID NO: 33131 - DNA, 84 bp, Homo sapiens
atatatatatatatgtgtgtgtatatacacacacatatacgtgtatatgtgtatgtatatgtatatgtgtgaatatatataaac

SEQ ID NO: 33132 - DNA, 82 bp, Homo sapiens
ggaggttggtcaaggtaagaatagaagtaggaaatatgaggaagattcctgcctgttgtctagcacctggcctatactgtcc

SEQ ID NO: 33133 - DNA, 112 bp, Homo sapiens
tatgagattggactaagtttttttttggctggggagggcgttgttttgttttgtttttttaatacagggtctcactctgtcacccaggctggaggacagtggtgcactcata

SEQ ID NO: 33134 - DNA, 97 bp, Homo sapiens
agcaaaaatgtgtcattatctccagatgggtgagtataaagttttttcatattatagtttaatattatatggggatagggagggcatgccatttgtt

SEQ ID NO: 33135 - DNA, 120 bp, Homo sapiens
caatgatcacaccccaggccaagcatgagcctataatcccagggttttaggaggctgaggtggaaggatcacttgaggccgagagtttgagatcagcctgagcaacacggcaagaccctg

SEQ ID NO: 33136 - DNA, 82 bp, Homo sapiens
aatctaatgcctgatgatctgtcactgtctctcatcacccccagatgggaccatctagttgcagagaaacaagctcagggtt

SEQ ID NO: 33137 - DNA, 66 bp, Homo sapiens
aactaagcttcctcagcaaaggagaaattttttttttcaaagaagcaaatgctgagggagtttgtt

SEQ ID NO: 33138 - DNA, 86 bp, Homo sapiens
ggcagagaggcacagtgtggcctggccagggaaggtagcacttaattttttttttttgagtcagagtctcactctgtcaccaagct

SEQ ID NO: 33139 - DNA, 108 bp, Homo sapiens
ccagtactatattgaaaaggaacggtgagagtgggcattcttgtcttgttctagttctcaaggagaatgcttctagcttttggctgttcatcgtgatgttggttgtgg

SEQ ID NO: 33140 - DNA, 71 bp, Homo sapiens
ccctctgagggaagaagctcagttgttattatatttatttgacaattaaggaaattcaggctcaaagaggg

SEQ ID NO: 33141 - DNA, 95 bp, Homo sapiens; identical to SEQ ID NO: 68

SEQ ID NO: 33142 - DNA, 93 bp, Homo sapiens; identical to SEQ ID NO: 69

SEQ ID NO: 33143 - DNA, 110 bp, Homo sapiens
ccggcatctgctgactgattttctcttgagattatgttacattttattcgctcttcaagtgattttgttgtatacaattgacattgtgaatgttgttgtggagattctgg

SEQ ID NO: 33144 - DNA, 97 bp, Homo sapiens
ggcatctttcttatgatctgagctttggcagtgattaattctatatttttaagccaagtgctttctgggcctcagatttcatatctgttaaacggcc

SEQ ID NO: 33145 - DNA, 85 bp, Homo sapiens
tatatacatacatttttatatgtatatatgtatatataatacatgtgcatataaatctatgtatatatacatatatatatgtaca

SEQ ID NO: 33146 - DNA, 103 bp, Homo sapiens
gcatcatgatacaccaggtttattcaactttctataagaaatatgaaggcatgaatttttcattttttgatagtcctaatacacttgggagtacatgttctgc

SEQ ID NO: 33147 - DNA, 76 bp, Homo sapiens
ccttttgttctattcaggccctcaacaggttgggtggtgtccatcagcattgaagagggcaatcttccacattcgg

SEQ ID NO: 33148 - DNA, 89 bp, Homo sapiens
atatatgtatgtatataaatatatacacacagatgtatttgtgtgtatatatatgtgtacatatcaaatgcatatatgtgtgtgtatat

SEQ ID NO: 33149 - DNA, 95 bp, Homo sapiens; identical to SEQ ID NO: 68

SEQ ID NO: 33150 - DNA, 93 bp, Homo sapiens; identical to SEQ ID NO: 69

SEQ ID NO: 33151 - DNA, 95 bp, Homo sapiens; identical to SEQ ID NO: 580

SEQ ID NO: 33152 - DNA, 93 bp, Homo sapiens; identical to SEQ ID NO: 69

SEQ ID NO: 33153 - DNA, 83 bp, Homo sapiens
tatgatcagaatgaaaatgatatgcgatatagaaataaagtatattttatttgttttacatattcattttcatctctattatg

SEQ ID NO: 33154 - DNA, 118 bp, Homo sapiens
acttgtaaattctgtttagtgagatattgcagtttaattcataatttatatttttaattaaaatgtgttactcctttatgattctgtttatttcatgtatagataattcaatataggt

SEQ ID NO: 33155 - DNA, 115 bp, Homo sapiens
gtgaattcaccttggcctgacactctgttttggaagattattaattattaattcaatgtcattaataaatacaggtctgttcaatttgagtgtttcttcttgtgtgagttttggc

SEQ ID NO: 33156 - DNA, 94 bp, Homo sapiens
aaatactaacatgcattcaagtatgtatgcttgtgtatatatatatagtacttgtgtatatatatatataaaatgcttgtgcatgtgtgtgttt

SEQ ID NO: 33157 - DNA, 94 bp, Homo sapiens
atactcataacacatgagtgattttgtagatgagtaccaattatttcttagtctcatggtctcaggagagtctcttcatgttttaattgagtat

SEQ ID NO: 33158 - DNA, 116 bp, Homo sapiens
atcacatgtggtatggagcaagatttactaggattcttggtgttttttttttagtaaaatgtattaactcttgattcaaaatcctagatttggtaatgttctatgctaatgtagat

SEQ ID NO: 33159 - DNA, 89 bp, Homo sapiens
tgtatgtgtgtgtgtatgtgtgtatatgtgtatgtgtgtgtgtatatatatatatatacacccacacacacacacacacctacactcca

SEQ ID NO: 33160 - DNA, 112 bp, Homo sapiens
tagtgtctattgaagcagttgggagttcactgtaacttgtttgaaaatttttaatagtcttttcatcataatctgcacttctctactctcatcttccttcagtcatgccctg

SEQ ID NO: 33161 - DNA, 95 bp, Homo sapiens; identical to SEQ ID NO: 580

SEQ ID NO: 33162 - DNA, 93 bp, Homo sapiens; identical to SEQ ID NO: 69

SEQ ID NO: 33163 - DNA, 60 bp, Homo sapiens
agctgtagaatttgtttttaggcttacagagctcagttctgtcactgaaaattcacagct

SEQ ID NO: 33164 - DNA, 118 bp, Homo sapiens
tgatgagaaatcttcagtcatttaaattaccatgcctctttatagatgtggcattgttctctagcaggtttccatatctgtgtgtgtgtgtctgtgtgtgtatctttgttttttagca

SEQ ID NO: 33165 - DNA, 106 bp, Homo sapiens
gtgagtcctgagaattactgtgagtttaccttaaaatatatgtttttgttttgaaaacaaaaaagttatttgaggagcactaaaatagtctctctacagcttttgt

SEQ ID NO: 33166 - DNA, 107 bp, Homo sapiens
ggaaagacctgccccatgattcaataacctctcactgagtccctctcatgacacatgggaattacaggagctacagttcaagatgacatttgggtgcggatacagcc

SEQ ID NO: 33167 - DNA, 75 bp, Homo sapiens
ttcactctctgcctctctgcgacagcattggatccattttcagctttacagcattgagcatgtgggctgggtgag

SEQ ID NO: 33168 - DNA, 76 bp, Homo sapiens
ttcaagtgttagtatctctcttcctctcagtcactgcatgctctgaaaggggaatggatgactcataactcttggg

SEQ ID NO: 33169 - DNA, 116 bp, Homo sapiens
gtatttatggattgttttccaaattttagttaattttctatttatattttattgtgattccctgaaaattttaaagtagattattctgaatttggaattcagacattttatagatc

SEQ ID NO: 33170 - DNA, 113 bp, Homo sapiens
gtaaagactttactgtcattttgtcactttttaaaactgttttggagagtctttcttttttttattatgctttaagttttagggtacatgtgcacaatgtgcaggtctgttac

SEQ ID NO: 33171 - DNA, 104 bp, Homo sapiens
agtgagagcgagtgacagagcgcccacattcatataacttttattatagtatatttttataactgttctattttattattatgtattgttgttcatctctcact

SEQ ID NO: 33172 - DNA, 58 bp, Homo sapiens; identical to SEQ ID NO: 285

SEQ ID NO: 33173 - DNA, 107 bp, Homo sapiens
gtattttaaaggtattacctatctgaaatttatttccagcagaaattttttaattttttttttcaagaggtttttggggagcagatggtgtttggttacatgaatat

SEQ ID NO: 33174 - DNA, 69 bp, Homo sapiens
tcccaagtagctgagactacagatgtgtgccaccacgcctggctaacttttttgtatttttagtaggga

SEQ ID NO: 33175 - DNA, 119 bp, Homo sapiens
tggaaaagtgtctgttcatgtcctttgcctatttttatatggggttgtttgttttattttttcttgtagatttgcttaagttccttgtagatggtggatattagagcttagtcagatgc

SEQ ID NO: 33176 - DNA, 173 bp, Homo sapiens
atatctgtatatatatgtgtgtgtgtgtatatatgtgtgtatatatgtatatgtgtatatatgtatatttgtgtatattcgtatgtatatatgtgtatatatgtatatatgtgtatatatgtgcgtatatgtatatatgtgtatatatgtgtgcatatatgtatatatatata

SEQ ID NO: 33177 - DNA, 88 bp, Homo sapiens
agagcaaacattaaagggggtggtgacagcagatacagagaagtgtcccttaccaggtcccatgctatttccctgttttgtatggtct

SEQ ID NO: 33178 - DNA, 86 bp, Homo sapiens
cttgaaatgaaagtgtatatgtatgtgtatatattacagacacatatatatgtgtatacacatatatagggatatagtttattaag

SEQ ID NO: 33179 - DNA, 108 bp, Homo sapiens
attcagtattaacttggtcatttctggatcttttctacttaaattttaaaattattttttaaatttgcacagaaaagtcctgggatttttatgtacattgcattgaat

SEQ ID NO: 33180 - DNA, 93 bp, Homo sapiens
tctacaaatatacttaaaattagttgactcttctttggaatgtgaaactagtcacttaaagaaggcattaggtagctttgagatataattagg

SEQ ID NO: 33181 - DNA, 110 bp, Homo sapiens
caaatcaaattaatgggaaacttgcattaaaaaactgtaaagtgtattttatttttaaataccctctcagtgctatgaatttttaatacagtaaccctgaatttgtagtg

SEQ ID NO: 33182 - DNA, 80 bp, Homo sapiens
gaccgagtctcgctctgtcgctcaggctggatggagttcagtggcgtgatctccggtcactacaagctctgcctcccggg

SEQ ID NO: 33183 - DNA, 75 bp, Homo sapiens
ttgtttttttttgagatggagtctcactctgtcacccaggctggagtgcagtggtgcgatctcagttcactgcag

SEQ ID NO: 33184 - DNA, 58 bp, Homo sapiens
tgagacagagtctcactgtgtcgcccaggctggactgcagtggtgtgatctcagctca

SEQ ID NO: 33185 - DNA, 60 bp, Homo sapiens
tatatatatatacacgtatatatatatgtgtatatatatatatacgtgtatatatatata

SEQ ID NO: 33186 - DNA, 109 bp, Homo sapiens
gctgagcataatgacacacctgtcagcccagctccttgggaggctgaggtaggaggatcaattgagtcttgcaggttgaggctgcagtgagctgtgattgcactactgc

SEQ ID NO: 33187 - DNA, 114 bp, Homo sapiens
ttcagttctatagatgatgacagattgatgcataaggtttatagaaaaattgtagttgtctagcaggtttttatctcatatgtcttttatctcatatatctcaataggactgaa

SEQ ID NO: 33188 - DNA, 100 bp, Homo sapiens
atatgcatgtgtgtatatatgtatatacacatatgtagatatatgtatatctacatatatctatctatctatctatatatatatatgtctatatccatat

SEQ ID NO: 33189 - DNA, 66 bp, Homo sapiens
aagtgtgtgtgtgtctgtgtgtctgcgtgtagatatggggcattaaggcaggcaaacttagaacac

SEQ ID NO: 33190 - DNA, 83 bp, Homo sapiens
tatctttaagtacttaggattagaaaagaaattaagaactactggattaaaatttcttatttaattttaggtgtgtgctggta

SEQ ID NO: 33191 - DNA, 89 bp, Homo sapiens
gtgtttatcagtagttttaaatattgtgaaatagtattccattgtatggataccattattcgtttatttatttagctgctgatagatgc

SEQ ID NO: 33192 - DNA, 76 bp, Homo sapiens
gctgaggccttttaggtttcttgtgctttggctaggtatgccgttagcctctgtctctgactgaaagtgctgcagt

SEQ ID NO: 33193 - DNA, 69 bp, Homo sapiens
cctcagtgactgagtggctctctgctctggaatgaagcaggttggcacaactccacaagtcttatgtgg

SEQ ID NO: 33194 - DNA, 118 bp, Homo sapiens
tgcttaggattgtctaggctatacgggctcttttttggttccatatgaaatttaaagtagttttttctaattctatgaagaaagtcagtggtagcttgatggggatagcattaaatct

SEQ ID NO: 33195 - DNA, 91 bp, Homo sapiens
agggaatttattttaaagcctcataacaaccacgctggatttttaaatttatatctagcctaaatttttataggtagagtttaagttcctt

SEQ ID NO: 33196 - DNA, 115 bp, Homo sapiens
tatatatgtggatatacatatgtatatacatatatgtacatatagatgtatgtatatgcatatatatacatgtatgtatatgtacatatataatataggtatatgcatgtatata

SEQ ID NO: 33197 - DNA, 112 bp, Homo sapiens
catatatttacatgcatagacatatctatacatatatacatccataaatgcatatatatgtatatacatatatatgcatatatgtgtatacatgtacatgcataaatgtatg

SEQ ID NO: 33198 - DNA, 103 bp, Homo sapiens
aggctgaggctgccgtgagccatgatcatgccactgcactgtctcactctgttgctcaggctgagcgcggtggcgtgatcacggctcaatgcaacctcaacct

SEQ ID NO: 33199 - DNA, 75 bp, Homo sapiens
gagtctctctctgtcacccaggctggagtgcagtggtgtgatcacgactcactgcagcctcgacctcctaggctc

SEQ ID NO: 33200 - DNA, 131 bp, Homo sapiens
atatatatcattatatatctgatatctaatgatatatattatatatcattagatatcagatatataatgatatatattatatatatcattagatatcttatatatagtgatatatataatatatatcatta

SEQ ID NO: 33201 - DNA, 117 bp, Homo sapiens
cccgagctgtcttatttgtgttttactgtctgctctttctggctgcttgtagttcgaacagaagtgatttccttgaaatgcatgagactagaaagggaactggaatttaaagtggcg

SEQ ID NO: 33202 - DNA, 95 bp, Homo sapiens; identical to SEQ ID NO: 68

SEQ ID NO: 33203 - DNA, 93 bp, Homo sapiens; identical to SEQ ID NO: 69

SEQ ID NO: 33204 - DNA, 70 bp, Homo sapiens
ttgtttttggacacggtctcactctgtcacccaggctggagtacagtggtgtgatcttggctcactgcaa

SEQ ID NO: 33205 - DNA, 59 bp, Homo sapiens
tccagtgctagagtggagtagtgattttgacacagagtctctccgtcactcaggctgga

SEQ ID NO: 33206 - DNA, 91 bp, Homo sapiens
acaaaaaatgatgtgtgtgaggtaatacgtatgttcattagctcaatttagccattccacaatgtatatatatttcaaaacatcatgttgt

SEQ ID NO: 33207 - DNA, 101 bp, Homo sapiens
caagggctagaatctctgtttcatacacagagctgaactgggctgagcgacctgctctgctgacgtctgtttctgtcatgagagggaacctaggcctcttg

SEQ ID NO: 33208 - DNA, 66 bp, Homo sapiens
attgagatgagtctcactctgtcactgaagctggagtgaggtggcaagatcaggactcactgcaat

SEQ ID NO: 33209 - DNA, 84 bp, Homo sapiens
agtctcactctgtcactcaggctgaagtgcagtggtatgatctctgttcactacaacctccgcctccagggttcaagtgattct

SEQ ID NO: 33210 - DNA, 98 bp, Homo sapiens
ccagactgagcaacatagtgagatctcatttctgctaacaaattttttttttaagttagccagatgtggtggtgtgtgcctgtagtcccagttaatgg

SEQ ID NO: 33211 - DNA, 69 bp, Homo sapiens
gtatatttatatatagtagtactactatatatatttttatatatagtagcattatatatataaatatac

SEQ ID NO: 33212 - DNA, 63 bp, Homo sapiens
gaggctgagacaggagaatatgtatacgtgtatacatatatgtatatatttcctttcaggctt

SEQ ID NO: 33213 - DNA, 71 bp, Homo sapiens
gtgagccactgtgcctggcctcttttttttttttttttttttttaaagagagaggggtctcactctgtcac

SEQ ID NO: 33214 - DNA, 91 bp, Homo sapiens
acagagaattattggagataattcattttaagcagaaaatgagagtcagaattttttttttttttttttttgagatgaagtctcactctgt

SEQ ID NO: 33215 - DNA, 81 bp, Homo sapiens
ttctcctatgtgtctctgtgtgacattccttccttctgggtatagaggaaaacatctgtcacataaggaacgttaggagag

SEQ ID NO: 33216 - DNA, 58 bp, Homo sapiens
gtatgtatatatatgtgtgtgcatatatatatatatatatatatatatatatatatat

SEQ ID NO: 33217 - DNA, 110 bp, Homo sapiens
attggaaggccaggcatggtggctcacacttgtaatctcagcactttggaaagccaaggcaggcagaaggcttgaggccaggagtacgagaccagcctggccaacacagt

SEQ ID NO: 33218 - DNA, 58 bp, Homo sapiens; identical to SEQ ID NO: 12246

SEQ ID NO: 33219 - DNA, 119 bp, Homo sapiens
ttattttcttaaccatttctagagcatgttttaggtactctatatttgttgagtgaagacagtgaggcagaaggagtatgagtagaggacacgggctggatggaagaggtgctaagtag

SEQ ID NO: 33220 - DNA, 114 bp, Homo sapiens
gcctgggcaacagagcgagactcaatctcaaaaaaaaaaaattaaaaccctgaagtacccatttcttttttttttttttttttttaggacagggtctcactctgtcacccaggc

SEQ ID NO: 33221 - DNA, 120 bp, Homo sapiens
tataggcctggcactggtggctcatgcctgtaatccagcactttaggaggctgaggtggaaggatcacttgaggccaggagtttgagaccagcctaggcatatagtgagacctcacctct

SEQ ID NO: 33222 - DNA, 111 bp, Homo sapiens
gctaggcatggtggcatgcacctgtaatcccagctactcaggaggctgaggtggaaggatcacttgagcccgggaggtggcagttgcagtgaactgagattgtgccactgc

SEQ ID NO: 33223 - DNA, 58 bp, Homo sapiens
tgagacagagtctcactctgtcgcccagggtggagtagagtggtacgattttggctca

SEQ ID NO: 33224 - DNA, 58 bp, Homo sapiens; identical to SEQ ID NO: 6359

SEQ ID NO: 33225 - DNA, 58 bp, Homo sapiens; identical to SEQ ID NO: 1673

SEQ ID NO: 33226 - DNA, 119 bp, Homo sapiens
gatcacgccactgcactccagcctgggtgacagagcaagactatctcaaaaaaaaaaaaaaaatttttttttaagaaacagtctttctgtcacccaggctggagtgcagtggtgtgatc

SEQ ID NO: 33227 - DNA, 108 bp, Homo sapiens
ctttttatggctatgtagtatgcctgtaaaatatatatatatatatatatatatatatatatatatatatatatatatatatctcacagtttctttatccactgattg

SEQ ID NO: 33228 - DNA, 88 bp, Homo sapiens
ggttgaagatctttccagtaccacagttcttgggagtgttcactggctccactacagctaccctgctgggtctggcaggaaggcaatc

SEQ ID NO: 33229 - DNA, 58 bp, Homo sapiens
tgagctgtgattgtaccactgcactccagcctgggtgacagagtcaatcactgtctca

SEQ ID NO: 33230 - DNA, 96 bp, Homo sapiens
agcctcagcaacagagtgagactctgtcacacacacaaaaaaagtatttttgctttttttttttttgaaacagagtctcactctgttgcccaggct

SEQ ID NO: 33231 - DNA, 89 bp, Homo sapiens
cagcccgggcaacagtgcaagaccctatcaatcaataaatatattttttcttttttttgagacagagtctcgctctgtcacccaggctg

SEQ ID NO: 33232 - DNA, 132 bp, Homo sapiens
ggcatggtggctcagctaagagtactctgtcttttttatttttttatttttttgagacagagtctcgctctgtcacctaggctggagtacagtggcacgatctcagctcactgcaacctctgcctcctgggt

SEQ ID NO: 33233 - DNA, 75 bp, Homo sapiens
gggtctctctctgtcacccaggctgcagtgcagtaatgcaatcatggctcactgcagccttgacatcccaggctc

SEQ ID NO: 33234 - DNA, 115 bp, Homo sapiens
cattttaatttggagggggaacacagacattcagactctagcaataatttattaatttaagtctattgtttatttagaatatgtatttctatgattcataaacttcaaaaaaatg

SEQ ID NO: 33235 - DNA, 105 bp, Homo sapiens
tctaccagttagtttcccccagcatggtgtggaactggaagtgcatgtgggctcccgccggccccagcccacttcctcctctccagggagacaataaggggaagg

SEQ ID NO: 33236 - DNA, 111 bp, Homo sapiens
ttcagagataggatctcactctgttgcctaggctggaatgcagtggaatgatcacagctcactgcagcctcaacctcccaggcccaaggctggtcttgaactcctgagctc

SEQ ID NO: 33237 - DNA, 92 bp, Homo sapiens
agtgcttagggccattattaatgtgattatattgatctgtattcattcacatgaaaagaggtttgctataataacaatatttactgagtact

SEQ ID NO: 33238 - DNA, 89 bp, Homo sapiens
tctgtctcttaaaatatgtgtgtgtgtgcgcgcacgcgcacgtgcgtgcacatatatatattttttttttaagatttccacttggcaga

SEQ ID NO: 33239 - DNA, 58 bp, Homo sapiens
tgagacagagtctcactctgtgccccacgccggagtacagtggtgtgatcatggctca

SEQ ID NO: 33240 - DNA, 63 bp, Homo sapiens
tctggccatcagagtgaatagactgtggtctaccctgggtgtgttcgcttgtctctggctgga

SEQ ID NO: 33241 - DNA, 88 bp, Homo sapiens
ggacattgtcataatagctatgtggctcctgccttcattggtagttactgcatttgggaggcagcagaggaacctgctttgagtgttc

SEQ ID NO: 33242 - DNA, 64 bp, Homo sapiens
ggcccaccagcaggcagattggttggaacgctgccacgccgcctctcactgcctgtctgtggtc

SEQ ID NO: 33243 - DNA, 118 bp, Homo sapiens
actcaatcagtttgtcagtggctaaggtggggctctgtgttttgttcctatgattttatttttattttcatttttatttttttgacactaggtcttactctgtcacccaggctggagt

SEQ ID NO: 33244 - DNA, 74 bp, Homo sapiens
ctgggcaaaggtctctgtctgtgcctctgtttccccacctgtgaaacaatgaggttggcctgtttctcttccag

SEQ ID NO: 33245 - DNA, 70 bp, Homo sapiens
gctttataacagcagagagtgagatcagagcaaggggttttgttttctgccagcaagggtgttctggagt

SEQ ID NO: 33246 - DNA, 63 bp, Homo sapiens
ttggtcagtactgagtgtgggcagaggggccgcagccctgtccagccccacgatgttgactga

SEQ ID NO: 33247 - DNA, 92 bp, Homo sapiens
cattgcaggtttgtcaaagatcagatattgtagatgtgtggtgttatttctgaggcctctgttctgttctattggtctatatatctgttttg

SEQ ID NO: 33248 - DNA, 104 bp, Homo sapiens
tttggggttgtttgtttgtttgctttttgagacagtctcactgtgtcacccaggctggagtgcagtggcacaatcatgtctcaccacagacttgacctcccaga

SEQ ID NO: 33249 - DNA, 126 bp, Homo sapiens
gccgaggtagattagagctgaccttagagactccaagaacacatcacctgtcactccctctgtctgcctcctcaggccttctaccctgatgacttctattgcagagatgggtgaagagtagatggt

SEQ ID NO: 33250 - DNA, 79 bp, Homo sapiens
tctagggcccaggatatggtctatcttgatgaatgtttcatagaaggttgaaaagaatatccattctgctggttttgga

SEQ ID NO: 33251 - DNA, 77 bp, Homo sapiens
tggaaaccacatcctagaaactcactggtattggtccctgtttgcctctgcagatgaggtgctgggggtgggggcta

SEQ ID NO: 33252 - DNA, 76 bp, Homo sapiens
gtcctcacaccctctcagcctctttcttgtgcttgtcagtgcccaaagtccagagagggctgaggaggcagggggc

SEQ ID NO: 33253 - DNA, 67 bp, Homo sapiens
gagttcacgcagacaggcagacacacacacattcacatgtttgtgtgtgtgcatgtcttcaggtttc

SEQ ID NO: 33254 - DNA, 66 bp, Homo sapiens
gatccggtggttttaataaaatgggaggttccctgcacaggctctctctctttgtctgccactatc

SEQ ID NO: 33255 - DNA, 77 bp, Homo sapiens
ctccctgatgactggagattgtgttttgttttatttatttatttatgagacagagtctcactctgtcacccaggctg

SEQ ID NO: 33256 - DNA, 114 bp, Homo sapiens
cagaggatggctgggaaggagcaggtagcaggtatcagggctctttcagtctctctcacacccttgttgagggagctggccactgctcagactcctcttggccaggggctcctg

SEQ ID NO: 33257 - DNA, 111 bp, Homo sapiens
agaggatactgggctcagagaggttaagcagcttgcccaaggtcacacagctagtaagtagtaaagtagaaatttgaacctgtggctgtttggctccaaagcctatgctct

SEQ ID NO: 33258 - DNA, 87 bp, Homo sapiens
caggctggccggaacagcagggcccctgcatccctggagcacatgccgctgacaggctgtggctctgactgtgctgctgctggcctg

SEQ ID NO: 33259 - DNA, 101 bp, Homo sapiens
cagccatcaacaagagctgtcagtgtgtgccaggcaccctgttacccatttcacaggcctggttatatttcattcaccaacagttttatgaattaggcatg

SEQ ID NO: 33260 - DNA, 107 bp, Homo sapiens
ggctctgggcttataatttggtcagatgtctcaatgaacattcattccagtgggagccacagaaggtgccacaccaagtcttttggtgtcgtctccttggcacctgc

SEQ ID NO: 33261 - DNA, 75 bp, Homo sapiens
tcatggaaatgagagttctcccttggccctggatttgtgctccaggccctaggtgatttttttttttttttttgg

SEQ ID NO: 33262 - DNA, 95 bp, Homo sapiens; identical to SEQ ID NO: 68

SEQ ID NO: 33263 - DNA, 93 bp, Homo sapiens; identical to SEQ ID NO: 69

SEQ ID NO: 33264 - DNA, 82 bp, Homo sapiens
cagggcttggggctcacagacagcattctcttttttttatttttattttttgagatggagtctctgtctgtcacccagactg

SEQ ID NO: 33265 - DNA, 114 bp, Homo sapiens
gtcaacattctcacacccatacttctaattattgtattataccattcagtcccactctctcacggagctcgcatgggcagaattagagccagtggggagaagtggaagggaggc

SEQ ID NO: 33266 - DNA, 118 bp, Homo sapiens
gctcaaggtcctccaatgatgctgcagcacagctggccctgctctgtgtgtctgtgaattaggaccaggctttggtgtgtgtttccccaggcttgcttcgaagggaaggctcagtgtc

SEQ ID NO: 33267 - DNA, 90 bp, Homo sapiens
tcttcgttctgattcttttttttttttttttttgagacagagtcttgctctgtctcccaggctggagtgcagtggcgggatcttggctca

SEQ ID NO: 33268 - DNA, 58 bp, Homo sapiens; identical to SEQ ID NO: 4269

SEQ ID NO: 33269 - DNA, 103 bp, Homo sapiens
ttgctgtcagcaggaggaggctgaggcagaggaaaagagcactggacttggagtcggcgtgcctgcctgcctgcctctagcttcgcaatcttgtttgcagcga

SEQ ID NO: 33270 - DNA, 94 bp, Homo sapiens
gagtccctgcgcttctgtcagcctctctgtgcctcagtttcctcatctgtggattggggattataggggtgggggaaggagaaagcttggactc

SEQ ID NO: 33271 - DNA, 114 bp, Homo sapiens
gcagtcagagattgacccattggccctcctggtgtacccctctctgcgctcagggtctctggctctctcaggtggctgttcaaaccccacctcaccccagtgagtccccgaccc

SEQ ID NO: 33272 - DNA, 101 bp, Homo sapiens
aggcttcattctgtgttgtgtatgtgagcatgttagggtggacgtgtgttggtgtctgtctctgtatatgtctgtgtgtgtcagcgcctttgtgtgtgtct

SEQ ID NO: 33273 - DNA, 58 bp, Homo sapiens; identical to SEQ ID NO: 2051

SEQ ID NO: 33274 - DNA, 62 bp, Homo sapiens
gctgttcagtctctgacactcagtggcatggcctggtgtgtcagaggtgtttgaaccagagc

SEQ ID NO: 33275 - DNA, 83 bp, Homo sapiens
cagacacactcactcacagtctcatctgcgactgattttgtgcttcggtggcagaatcgaatggttgtgaccgagaatgaatg

SEQ ID NO: 33276 - DNA, 102 bp, Homo sapiens
agatcttggaccactgggttggcaaggtgtggagctggaggcagagcacagacttcctgttctgcagcccacacaagccccatcttaggtgtcccacagtct

SEQ ID NO: 33277 - DNA, 81 bp, Homo sapiens
cagtcctcagggattctgccctccctagaatttctatagcagagcatagaggctgagagtacagactctggagtcggattg

SEQ ID NO: 33278 - DNA, 103 bp, Homo sapiens
gggcggggacagtgacggctgaggacagtgcctgacatcttgcggggctccctctgtcccacatccaggtgcggagttattgccacagttatccaacctgcct

SEQ ID NO: 33279 - DNA, 95 bp, Homo sapiens
ctcaggtacatgtgtgagcctctctgagcctctgtttctgcccgtgggagatggggtgacaatgaagcaaccctcacaggcgtttcccacctgag

SEQ ID NO: 33280 - DNA, 89 bp, Homo sapiens
caggctggctgaagtagagaaagtctgtctggcaggctgctggctggctgcttcattgctgactgactctctcaccaattgccattctg

SEQ ID NO: 33281 - DNA, 83 bp, Homo sapiens
cggtctgtctggctgtctgtctgtatgtctgtcatgcaggtagctgtgagtcaggccgcaccccagccacccagccaggcagc

SEQ ID NO: 33282 - DNA, 82 bp, Homo sapiens
gtgagcaagagcaagtgcaagtatatgtgagtgtgtgagattgggagcacaaatgcatgtgagagtgcatgaatctgtgagc

SEQ ID NO: 33283 - DNA, 60 bp, Homo sapiens
agaacacagacagcacagcgcgtgaatgcaaaggcctctttgagttgtgctgatgtgtct

SEQ ID NO: 33284 - DNA, 90 bp, Homo sapiens
gcagaaaccctacaagccagaagagattgggggtcaatattcaacatttttttttttttgacatggagtctcgctctgtcaccaggctgc

SEQ ID NO: 33285 - DNA, 88 bp, Homo sapiens
cacggcggtgccagggagtagaaagagctgttggagtcaggcagctggtttcatatcccagctcttcttcttactgctggcgtgactg

SEQ ID NO: 33286 - DNA, 122 bp, Homo sapiens
gtcctagaggaatgcctagcaccgtatgatttattcattcattctgtctctctctctcaaaggtgaggtggtgaaactcagaggctgtggagtcagattgcttggactgggatcaagctcct

SEQ ID NO: 33287 - DNA, 66 bp, Homo sapiens
gctcaggcccagctctgccaggaactgtgtggcctcaggctagtcacaccctctgtgggcctcagt

SEQ ID NO: 33288 - DNA, 117 bp, Homo sapiens
caccttgtccccagccccatatacatatggtctcagatcagccagattttgggtggaagtaatgctcttgtctggggctctggactctgtatgtctaggacttggttcaggtatgtg

SEQ ID NO: 33289 - DNA, 87 bp, Homo sapiens
gctgctgaggtgatgttaactgtttttcattttctgagtctttgctgagactcaaaaaggggaaatgagccattaccaaccagcaac

SEQ ID NO: 33290 - DNA, 108 bp, Homo sapiens
ctgcttttgagcctagtgtggtgcagctggagctctgctgtgtgtgacagtgtcactgtctatgctgcaggcttccccccagcctgcccagagcctggcggacagtag

SEQ ID NO: 33291 - DNA, 88 bp, Homo sapiens
tgttaggggcatctgtccattctctgtcactcagtgatgggggtctgaaatgggaggaagtcaccagcatggctgaatgcacagggag

SEQ ID NO: 33292 - DNA, 58 bp, Homo sapiens; identical to SEQ ID NO: 29497

SEQ ID NO: 33293 - DNA, 90 bp, Homo sapiens
gcagaagttcaccagtcccctccttgtgaggaggctgcgggtcttctgggacacagaattcacagtggagaggaagctggaggactctgt

SEQ ID NO: 33294 - DNA, 91 bp, Homo sapiens
ccagcctgggcaacatagcgagagtgcatctctaccaaaagtgatttttttgattttttgggacagagtctcgctctgtcacccaggctgg

SEQ ID NO: 33295 - DNA, 68 bp, Homo sapiens
acacacatatatatgtatatacatatatatacacacatatatgtatgtatgtgtgtgtgtatatgtgt

SEQ ID NO: 33296 - DNA, 102 bp, Homo sapiens
gggcctgtgtttggactgtcagcctgtctgtctgcctgcctccctgccctggagtaggggaggggacacaccaaaggagacacagaccacaccatcaggccc

SEQ ID NO: 33297 - DNA, 114 bp, Homo sapiens
ggccatctcccagactggggcagggctaggagagagagcagagtttgggggtatgagcaactctgtccctctgagcctccctctccccatctgtaacatgggagtattcaggcc

SEQ ID NO: 33298 - DNA, 76 bp, Homo sapiens
ggtaccacaatgtgaggcttaaaagttttttgtttttttttttttggtgatgggaatctctctcgctctgtggtcc

SEQ ID NO: 33299 - DNA, 58 bp, Homo sapiens
tgagacagggtctcactctgtcacccaggttggagtgcaatggtgtgatcttggctca

SEQ ID NO: 33300 - DNA, 84 bp, Homo sapiens
tgggctgacagagaaaggtgtccaggaattttttgttttgttttgtttttttgtttttgaggcagagtctcactctgtggctca

SEQ ID NO: 33301 - DNA, 95 bp, Homo sapiens
tagtatgggtaaaactcagtggtgtattttattttattttattatttttgtttatttattttttgagatggagtctcactctgtcacccaggctg

SEQ ID NO: 33302 - DNA, 58 bp, Homo sapiens; identical to SEQ ID NO: 3380

SEQ ID NO: 33303 - DNA, 70 bp, Homo sapiens
ggtgtagggggtgaggtctctctgtcacactgtgctgcaaagaagcaggtggatcttgaccccataagcc

SEQ ID NO: 33304 - DNA, 58 bp, Homo sapiens
tgagacagggtctcactctgtcacccaggttggagtgcagtgatgcaatcctggctca

SEQ ID NO: 33305 - DNA, 117 bp, Homo sapiens
gccgagatccctgcatggtcagtcactggaagtcagaagcagcctggtcagactctgtgagtcagggtgtggccatggggcgtttgctataagttcttggtcatatctggtcagtag

SEQ ID NO: 33306 - DNA, 102 bp, Homo sapiens
tctttgcttagtttttattcttgtaatcactaggatgatgtctgtacacagtgagcgctcaggaagcattaattggatggagctgaattaaattgggaggga

SEQ ID NO: 33307 - DNA, 90 bp, Homo sapiens
agctgggtgcggtggctcatgactgtaatcccagcactttgggaggctgaggtagttggattattagggaccaggagcttgagaccagct

SEQ ID NO: 33308 - DNA, 58 bp, Homo sapiens; identical to SEQ ID NO: 454

SEQ ID NO: 33309 - DNA, 107 bp, Homo sapiens
ccacagacctcactagttcagtcactaaggatgtcagcctctgtcagccactgagtttataggtgtcagccctgctagccttgtgtccggaattggtgggttcttgg

SEQ ID NO: 33310 - DNA, 114 bp, Homo sapiens
gctctttcacaaaacaaagtttgacagcatctgcaaatccaaagatataagatttgaagtctttatttatttattttttagatggagttttgctcttgttgcccaggttggagt

SEQ ID NO: 33311 - DNA, 69 bp, Homo sapiens
tgagatggagtgtcactcactctgtcgcccagcaggctggagcacagtggtgtgatctcggctcactcc

SEQ ID NO: 33312 - DNA, 88 bp, Homo sapiens
ccagcctgggcaacatagtgagaccctgtctttaccaaaaaaaaatttttttttttgagacagagtcttgctctgtcacccaggccgg

SEQ ID NO: 33313 - DNA, 90 bp, Homo sapiens
accccagcctgtatgacaggcaagaccctgtctctttttttttttttttttttttgagatggagtctcgctctgtcacccaggttggagt

SEQ ID NO: 33314 - DNA, 118 bp, Homo sapiens
caaaactagtctgggcaacacagtgaggagactgtctccacaataaaaaaatttttttcttttttttttttttttttgagacagagtcttgctctgctgcccaggccggagtgcagtg

SEQ ID NO: 33315 - DNA, 62 bp, Homo sapiens
gagacagggtctctctgtcactcaggctggagcacagtggcatgatcaggagtccctgtagc

SEQ ID NO: 33316 - DNA, 58 bp, Homo sapiens
tgagttagagtctcgctctgtctcccaggctggagtgcagtggcatgatctcagctca

SEQ ID NO: 33317 - DNA, 91 bp, Homo sapiens
agatggagtcacgctgtcgtccatgctggagtgcagtggcgctatctctgctctctgcagtctctgtctcctgggttcaagtgattctgct

SEQ ID NO: 33318 - DNA, 67 bp, Homo sapiens
gggatagagcaagactgtgtttctttttttttttttttttttttgagacagagtctcactctgtccc

SEQ ID NO: 33319 - DNA, 81 bp, Homo sapiens
gttttaaatggtgcactgtcctgagtagtatggtgagatctcacaccatcctacactctcccactctgtcccacccaagac

SEQ ID NO: 33320 - DNA, 111 bp, Homo sapiens
gctcctttggataaatacagagaattgtggttggtagcaatatgtttatttttgtaagaaaacaccaaaccgtctaccaaagtggttgtactattttgtattccgaacagt

SEQ ID NO: 33321 - DNA, 58 bp, Homo sapiens; identical to SEQ ID NO: 2531

SEQ ID NO: 33322 - DNA, 88 bp, Homo sapiens
tctgtggtggcccccagtgtacttattttatttatttatttatttatttttatttattttgagatggagtctcactgtgtcacccagg

SEQ ID NO: 33323 - DNA, 112 bp, Homo sapiens
cattgtggttttgatttgcatttctctgatgattagtgatgctgagtattttttcatatatttgtagccatttgtgtgtcgtctttggaaaaatgtctattcagatcatttg

SEQ ID NO: 33324 - DNA, 96 bp, Homo sapiens
tgtagatgtgtgtgacagagagagtaggtatgtatgtgtttgtaacttttggtgtaaacagtatttaattttaatatctatcatttacacatcaca

SEQ ID NO: 33325 - DNA, 58 bp, Homo sapiens
tgagatggagtctcactctgtctcccaggatggagtgcactggtgtgatctcagctca

SEQ ID NO: 33326 - DNA, 60 bp, Homo sapiens
atatgtagatatagatctatatatatagatatctatatatgtagatctgtatagagatat

SEQ ID NO: 33327 - DNA, 99 bp, Homo sapiens
ccaggtggatatgggggtttggctttgtgagagtagtgagagctgagactagagaggtaagcagaagccatctcttggagagctttgtaagccatgtgg

SEQ ID NO: 33328 - DNA, 108 bp, Homo sapiens
cttttttacattgtcttcgctttcttgaagcacagcagttttagattttggcaaagttcaatttatttatttctttggcttcttggtgctttaggcgtcatatctaag

SEQ ID NO: 33329 - DNA, 117 bp, Homo sapiens
aagatagacaagtagggattctatcaaactaaagcttctgcagagtcagggaatcaatcaacagagtgaagagacaacctgcagaatgggagaaaatatttgcagaccctctatctt

SEQ ID NO: 33330 - DNA, 82 bp, Homo sapiens
tgcatcacaatttgtttatctgttgatggccagtttgattcttttcagctttgagccattacatgtaaaggtgttatgagca

SEQ ID NO: 33331 - DNA, 75 bp, Homo sapiens
tacactgctctctgttctctgtcactgagaacggaatagacttttcccaggatctgagggcaaagagtatccgta

SEQ ID NO: 33332 - DNA, 95 bp, Homo sapiens
tcatgaaggacagacttgtttggtagacttgtttatattttttaataatttaaagagtataagctaaactgacaaaacagtttctgtcactgtga

SEQ ID NO: 33333 - DNA, 95 bp, Homo sapiens; identical to SEQ ID NO: 68

SEQ ID NO: 33334 - DNA, 93 bp, Homo sapiens; identical to SEQ ID NO: 69

SEQ ID NO: 33335 - DNA, 92 bp, Homo sapiens
gttctgctgtgaatatatggatgtacgtgtgtgtacccatacatgcacacatagatacatttttatatatgcattttaaaacaaagtggagc

SEQ ID NO: 33336 - DNA, 58 bp, Homo sapiens; identical to SEQ ID NO: 1391

SEQ ID NO: 33337 - DNA, 56 bp, Homo sapiens; identical to SEQ ID NO: 1392

SEQ ID NO: 33338 - DNA, 83 bp, Homo sapiens
cttgtttctttttttttttgagacggagtctcgctctgtcacccgggctggagtgcagtggcgtgatctccgctcactgcaag

SEQ ID NO: 33339 - DNA, 73 bp, Homo sapiens
ggtgtaaagtgtgggaagtttctaaggagaaggacttttttttttttttgagacagagtctcgctctgtcacc

SEQ ID NO: 33340 - DNA, 58 bp, Homo sapiens; identical to SEQ ID NO: 637

SEQ ID NO: 33341 - DNA, 75 bp, Homo sapiens
aggggcataccaccgtgcctggctagtttttttgtatttttcgtagagatgagttgtcactgtgttgtgcagcct

SEQ ID NO: 33342 - DNA, 97 bp, Homo sapiens
gttgaaatgatattttgatctctctcacactctttcttgaggcagagtctggctctgtttgatggagtgcagtggtgtgatcatagctcactgcaac

SEQ ID NO: 33343 - DNA, 89 bp, Homo sapiens
caggtgtgcgccaccagacccagctaactttttaattttttgtagaaacagagtcttgccatgttgcccaggctggtctccaactcctg

SEQ ID NO: 33344 - DNA, 99 bp, Homo sapiens
atttgaatttcagatgcaaatgaataatttttttagtataagtaagtcccaagcaatatttggaggcatatctatactaaaaaagtatttgggtcaagt

SEQ ID NO: 33345 - DNA, 66 bp, Homo sapiens
ggtgacaaagcaagactccatcttaatatatatatataatttgagacggtgtctcgctctgtcacc

SEQ ID NO: 33346 - DNA, 99 bp, Homo sapiens
ggatggggcaggggtggggctgctgaggagaagcctaggatttccaagttttctctctgttaatctctgtccccatctcctctcttgcagtgcgcctcc

SEQ ID NO: 33347 - DNA, 110 bp, Homo sapiens
agactgaataatattccattgtagggatggatcacattttgtttatctgttcatcagttgatgggcatttagttggatgtttccattttttggctattgttaataaggct

SEQ ID NO: 33348 - DNA, 68 bp, Homo sapiens
tcactgtatcatttgtttgtttgtttgaaatagagtctcactttgtcactcagactagggtgcagtga

SEQ ID NO: 33349 - DNA, 112 bp, Homo sapiens
gctacttgggaacaaagcttgtttgtttgtttgagcagagtctcccactgtcacccaggctggagtgcagtggtgtgatctctgctgactgcaacctccgtctcccatgggc

SEQ ID NO: 33350 - DNA, 118 bp, Homo sapiens
agcctttcatgctctatttctaatctttccattctactctttttctaaatacacacacacacacacacacacacacacacacagagagacagagagagacagaaagagagtgagcgct

SEQ ID NO: 33351 - DNA, 113 bp, Homo sapiens
tgttaaatactcaggaatatgattgctgagtcatatggaatatttatctttaattttattaaaaatgccaaactgttttccagagtggctgtgtcattttcctatcagcaaca

SEQ ID NO: 33352 - DNA, 113 bp, Homo sapiens
gtataaagatatgaaataattttgcatctgttgcaattatgaggtaaatttagaatttttgaaactttattattgtaactaaattgttcattaagtccatttctttagtttgc

SEQ ID NO: 33353 - DNA, 102 bp, Homo sapiens
gcagccaggattctgatctggagtggggcgattctttttttttttttttttttttttgagatggagtctcgctctgtcacccaggctggagtgcagtggtgc

SEQ ID NO: 33354 - DNA, 83 bp, Homo sapiens
tgtgtgtgtgtgtgtgtctgtgtgtatatgtatgtgtgtgtatatatatatatttatattaggcatggtggtgcacacctgca

SEQ ID NO: 33355 - DNA, 200 bp, Homo sapiens
gtgtgtatatatacacatgtatgcatatttatgtgcttgtatatgtatatacatgtttgtatatgtatatacatatatttatatatgtatatacatgtttgtatatgtatatacatatatttgtatatacatgtttgtatatgtatatacatatatttatatatgtatatatatttatatatgtatgcatgtgtgtagac

SEQ ID NO: 33356 - DNA, 115 bp, Homo sapiens
tttaacctggcgacatggcaagattccgtctcaaaaaaaaaaaaagaaagaaagaaaaaactcctcggttttcattattttttgagacagaatctcactctgtccccaggctgga

SEQ ID NO: 33357 - DNA, 114 bp, Homo sapiens
atgccagtcacgattcttggatgttgacctcttgtgctgtttttgtagttcacaagccaaagctgcactaaataggattatggaaattagattaatggtccaggaatgaggcat

SEQ ID NO: 33358 - DNA, 58 bp, Homo sapiens
tgagacagggtctcactctgtcacccaggctggagtgcagtagcaagatcttgactca

SEQ ID NO: 33359 - DNA, 110 bp, Homo sapiens
tatataacatatattttgttttatatataagtatatttttatatatataacatatattttgttttatatataagtatattttatatagataacatatgtattgttatata

SEQ ID NO: 33360 - DNA, 107 bp, Homo sapiens
gtgactattaaatttggcattggaagtggaggacacttttcttttcttttttttttttttttgagacagagtctccctctgtggcccaggctagagtgcagtagcac

SEQ ID NO: 33361 - DNA, 96 bp, Homo sapiens
tgagacagagtcttcctctatcacccagcacccaggctggagtgtagtggcgtggtctctgctcactgcactctctgactcctggattcaagtgat

SEQ ID NO: 33362 - DNA, 116 bp, Homo sapiens
aagtggataatatacatgtgtttagttgagaattggctacagataagagacttctgattttgttcctctcctagctgtgtattttttttttttttttgaacactgtgattctgctt

SEQ ID NO: 33363 - DNA, 81 bp, Homo sapiens
tttcagtaggaaaaccatgggacacagagccaggacacccaagtggaagttctttctctgtcactgactggccttgtgaaa

SEQ ID NO: 33364 - DNA, 92 bp, Homo sapiens
cgcagattgctattattcacctactaaatatttgacataaaatatctatatgtttttaggtgacagaataatagaatgagcaggattctgtg

SEQ ID NO: 33365 - DNA, 84 bp, Homo sapiens
gtgtgtgtatatgtatatgtatgtatacagtctgtgtatgtatggtgtgtgtatatatatatatatacacacacagtctgtata

SEQ ID NO: 33366 - DNA, 144 bp, Homo sapiens
tgtatgtatggtgtgtgtatatatacacagtctgtatatgtatgtgtgtgtgtgtgtgtatatatatatatacagtctatgtgtgtatatatgtatatatatatacagtctatgtatgtatatatgtatatatgtaggtataca

SEQ ID NO: 33367 - DNA, 139 bp, Homo sapiens
atgtatgtatactgtctatgtatgtgtgcatgatatgtgtgtatatatacatacatagtctgtgtatgtatatatatatgtataccatctttgtatgtgtgatgtgtgtgtgtatatatatatacagtctgtatgtatg

SEQ ID NO: 33368 - DNA, 57 bp, Homo sapiens
atatgtatgtatgtatgtgtgtgtgtacatatatatagtctatacatatatacatat

SEQ ID NO: 33369 - DNA, 78 bp, Homo sapiens
gcacacaataaaagcaacacaatcatttccctgggtccagccaaggccttgatttctctgcgagcttttgtgggtggc

SEQ ID NO: 33370 - DNA, 91 bp, Homo sapiens
gtaatcccagctacttgggaggctgaggtggaaggatcacttgagcccagagtttgagtccagcctgggcaacatagtgagactctatctc

SEQ ID NO: 33371 - DNA, 56 bp, Homo sapiens
tgagagagtctcgctctgtcacccaggctggagtgcagtggcatgatctcggctca

SEQ ID NO: 33372 - DNA, 113 bp, Homo sapiens
ctgtttatgaaacatttggaaagttggacaatgcctgaatatttgattatcttaagtgctattagttcttttaggcataacaatattttaagataaaatgacataatgtgcag

SEQ ID NO: 33373 - DNA, 77 bp, Homo sapiens
gccctacagaaaagaatataatgtgcagatgtgttttatttattttttgagacacattttcactctgtcacccaggc

SEQ ID NO: 33374 - DNA, 81 bp, Homo sapiens
gggaaaagtgagagtgtagtgagtgagcatttggttcccacagccatgtaggatgctgctcacttcttttttgcacaaccc

SEQ ID NO: 33375 - DNA, 110 bp, Homo sapiens
ctgtcactcatgcttataataccagcactttgggaggctgaggtagtaggctcacttgaggccaggagttggagaccagcctgcgcaacatggtgagaccccatctctac

SEQ ID NO: 33376 - DNA, 95 bp, Homo sapiens
atccttctctgttggggtataaggttactagagcccttctgatgaactgagtcagtctctctaagaccctctggcatgaaagggtagaaaggacc

SEQ ID NO: 33377 - DNA, 77 bp, Homo sapiens
tcagtgcctctagttttccttctctttttttttatttttatttttttgagacagggtcccaggctggagggtagtgg

SEQ ID NO: 33378 - DNA, 97 bp, Homo sapiens
gagcgtcaaggagttcagtccattcctcccacagactgtctgagaggctcctgtagacaatgtgggatgatgagctgagaggagtctttggatgctc

SEQ ID NO: 33379 - DNA, 75 bp, Homo sapiens
accagcacaatatttggcccctagttgtctctgtttattcagagagcacacactgagtgtctaagttgtgtgagt

SEQ ID NO: 33380 - DNA, 85 bp, Homo sapiens
ggaattttataactttatttgaaaatatctttactttggctttcttgctgaaggctaagtatagtttagctgggtatagaattct

SEQ ID NO: 33381 - DNA, 118 bp, Homo sapiens
cagctcttggcccctgtgacattgtttccatagatttgcaatgaaacagttttatatttttcaaaatagagtgatctcctatgactggcattgatgtggttttcgccatggtcttctg

SEQ ID NO: 33382 - DNA, 101 bp, Homo sapiens
ggccctcttggtgactgggaattggacttggagagagggaccaaggtagctggtctctaggtctctcttagtctctctctggtcccactcctgcccacttc

SEQ ID NO: 33383 - DNA, 94 bp, Homo sapiens
tcattagaaaaggacaaataccgccaaatataggagtgaagaaagtagagaaataatatatatttcattattccaatatgtttatttctaatga

SEQ ID NO: 33384 - DNA, 131 bp, Homo sapiens
atagatatatagatctatatatctatgtacatagatatatagatctatatatctatatacatagatatatagatctatatatctatatacatagatatatagatctatatatctatgtacatagatatata

SEQ ID NO: 33385 - DNA, 216 bp, Homo sapiens
agatatatatatatatatacacatatacatacatacatacacacacacacacatatatgtgtatatatatatgtgtgtgtgtgtatatatatctatgtacatagatatatagatctatatatctatgtatatagatatatagatctatatatctatgtatatagatatatagatctatatatctatgtacatagatatatagatctatatatctat

SEQ ID NO: 33386 - DNA, 69 bp, Homo sapiens
acacgtgggcaactcgttctctctctctgtattatgtgcatgtaagagtgtgtgtgtgtgtgtgcgtgt

SEQ ID NO: 33387 - DNA, 95 bp, Homo sapiens
ggactttacatttttgcatgagggtatgatgtgtgcatgtgcatgcataagtgtgtgtgtctgtgtgtgcgtgcatgcgtatgtgtgcctgtgtg

SEQ ID NO: 33388 - DNA, 99 bp, Homo sapiens
gagtaaagtggtctgatttaaattaaaatagctggcaattattgagcacttattgtgtctcagtcactgttctaagtaccgtacataccatcttaactc

SEQ ID NO: 33389 - DNA, 102 bp, Homo sapiens
ggtgtggtggtgcacacctgtaatcccagctacttgggaggctgaggtggaaggatcacttgagcccaggaggttgaggctgcagtgagctatgattgcacc

SEQ ID NO: 33390 - DNA, 94 bp, Homo sapiens
gggctgtggtagtggcagcagaaaggagaagcccctgtagatgaaaaagtcccctctcagtgagtgactccctgggctaattgctgcattactc

SEQ ID NO: 33391 - DNA, 85 bp, Homo sapiens
tcaggttctaaaaagaaaaaaacaaagaatcacccagagaacttttctttcttttttttttgtttttttttttttgtgagacgga

SEQ ID NO: 33392 - DNA, 97 bp, Homo sapiens
gcctggcacataccctctgctctgccatgcttttctgaatctttaaaataagtttttcattaattttagcatacagtgaagggaagtaacctgtggc

SEQ ID NO: 33393 - DNA, 79 bp, Homo sapiens
gtgcctagtgggtctcttttgttatgagtggaatcatgtctccctgaaattcatgtattgaagtcctaacccctggtac

SEQ ID NO: 33394 - DNA, 82 bp, Homo sapiens
tttggtgggggctcagcagttttgtgttttatcaagccctccaggtggttctggtgctgactgaagtttgagacctactgga

SEQ ID NO: 33395 - DNA, 77 bp, Homo sapiens
tttgaattactcccattagtcagtcgctctgactttttcttagtgagggctggattgtttttgaaaggggaatcgaa

SEQ ID NO: 33396 - DNA, 76 bp, Homo sapiens
atgatgaggagtttaactcagtgtctgtcacacgcacatacatgcatatgtgtgcatgcacgcactgcctcgttgt

SEQ ID NO: 33397 - DNA, 78 bp, Homo sapiens
catgggtttggcatcccgagaatttcaatttttgatcttcatttggttgaaaaaaatcctcaggtaggtgaatctgtg

SEQ ID NO: 33398 - DNA, 116 bp, Homo sapiens
aaacttgtccaaaaaatgtagatatagcaagtttagagattaagatgtttatttgtataaaatagatgagcactttttgttcttaaactttctatatttatattttacataagttt

SEQ ID NO: 33399 - DNA, 95 bp, Homo sapiens; identical to SEQ ID NO: 68

SEQ ID NO: 33400 - DNA, 93 bp, Homo sapiens; identical to SEQ ID NO: 69

SEQ ID NO: 33401 - DNA, 74 bp, Homo sapiens
catgtgcacatgagcacatgggagaagtctaacggggttaacttctaactgatcgcatgtgtcagtgtcacatg

SEQ ID NO: 33402 - DNA, 58 bp, Homo sapiens; identical to SEQ ID NO: 6327

SEQ ID NO: 33403 - DNA, 58 bp, Homo sapiens
tgagacagagtctcacactgtcaccccggctggagtgcaatggcgtgatctctgctca

SEQ ID NO: 33404 - DNA, 113 bp, Homo sapiens
ggacaagacaggtgaagtgttggaccaatggaaaccctccaaccagagcacaggagactgtctgtgagtgggtgagttagaggttaaaaaggctatcacatgcagaagtttcc

SEQ ID NO: 33405 - DNA, 96 bp, Homo sapiens
catagctaagattgccaccaatattattacaaaatcaataaggagaacatatatctctgtgtttctgtgtttatgactgtggcaccctcagccatg

SEQ ID NO: 33406 - DNA, 119 bp, Homo sapiens
aggtgatgggtgtgttaattaatttgattgtgctaatcattacattttatgtatatatacttatatataatgtatatatacatacacaagcatatgtcgaattattacattgtacacct

SEQ ID NO: 33407 - DNA, 69 bp, Homo sapiens
tatttctggctgttttcacagttcactttgaattaaggagggagacctgtgagggcacagcaagtcgta

SEQ ID NO: 33408 - DNA, 73 bp, Homo sapiens
gagagggagcgtcactctgtggctcagactcaagcgcaatggcatgatcttggcttactgcaacctccacctc

SEQ ID NO: 33409 - DNA, 120 bp, Homo sapiens
cctgttggtttgtagttagtgaatgattaaggaaatgtgcgtgtgcctgtgtgtgcttgtatgttgtataggtgtgtctgcactgcccattcttgcatttctatcttttaactgttatgg

SEQ ID NO: 33410 - DNA, 90 bp, Homo sapiens
aatgcggccaatgatgatgatgatgatcatgcttattactactactactactgttgttttatttttcttctcattggcctttccagcatt

SEQ ID NO: 33411 - DNA, 92 bp, Homo sapiens
gccatcaaagtagtacattctagggacagataacacctggtaccacccactgtcagcagtgtctgtctgactggggcattctattgataggc

SEQ ID NO: 33412 - DNA, 64 bp, Homo sapiens
tgtgtgtgtgtgtgtgtgtgcatgtatatatgtaaatgtatatgtgtatgtatatgttaatgca

SEQ ID NO: 33413 - DNA, 93 bp, Homo sapiens
ggaatttcagtcctgtaatctctgagtgttttgcatgccagggtcacactttcactctctcagcaagttttagatgttgcaccactggtttct

SEQ ID NO: 33414 - DNA, 95 bp, Homo sapiens; identical to SEQ ID NO: 68

SEQ ID NO: 33415 - DNA, 93 bp, Homo sapiens; identical to SEQ ID NO: 69

SEQ ID NO: 33416 - DNA, 104 bp, Homo sapiens
tgtgaacatcagttgtctttcctattagtttcttttgaaggttatgtgtctttacactggctgctttcaagcccagaaagtgagttcagagtgatttgggcaca

SEQ ID NO: 33417 - DNA, 66 bp, Homo sapiens
ttgagcctatgtgtgtctctgtatgtcagatgggtttcctgaatacagcacactgatgggtcttga

SEQ ID NO: 33418 - DNA, 82 bp, Homo sapiens
tgtatatatgtgtatatatgtatatatatatgtgtgtatatatatacacacacatacatatatatatatatatatatacaca

SEQ ID NO: 33419 - DNA, 99 bp, Homo sapiens
gttactgcatttttttttttttagacagagtctcactctgtctcccaggctggagtgcagtggcacaatctcggctcactgcaacctctgactcctggg

SEQ ID NO: 33420 - DNA, 117 bp, Homo sapiens
tgtttgcaaaactatggagaaagcattcagtttctttagctacaaggtttatatatatatatatatcttttaccaggttaaggaagttctctttattctagctttttttggtaaata

SEQ ID NO: 33421 - DNA, 153 bp, Homo sapiens
tgtgtgtgtatgtgtgtgtatatatatatatatatgtatatatacgtatatatacatatatatgtatatatatgtatatatgcatatatatgtatatatatacacgtatatatatatgtgtgtgtatatatatatatgtatatatatatatac

SEQ ID NO: 33422 - DNA, 109 bp, Homo sapiens
ggacatgtgtgtgtatgtatatatgttatatggacatatatgtgtgtatatatgtgtgtgtttatatatacatgtataattatatatataatgaaaacagaatatgttc

SEQ ID NO: 33423 - DNA, 116 bp, Homo sapiens
ggagaggaagaggtaacctggtgttatttctggggagcttagggtttttcccctcccagggtgactctgtgcctctgaaatactggctttgactcaccaggcatcctatcccatct

SEQ ID NO: 33424 - DNA, 80 bp, Homo sapiens
gggtgcctagggtgcaaaattgaaggaggcgcctcacattctgggtgcctactctgattctctgtgactctgtggaactc

SEQ ID NO: 33425 - DNA, 102 bp, Homo sapiens
gccgtaagactttgagagttaacttgcacaaactttctggtgaaagtcttaaacagtcatatcagagagagcttaggtcagcttgggagttttgttcatggt

SEQ ID NO: 33426 - DNA, 94 bp, Homo sapiens
ggcatgatggaaaccacaggtgctgcagacccactgtccgtttctgtctggatggggaaggaaggcaggatgcagtgaagcctgtgccactgcc

SEQ ID NO: 33427 - DNA, 87 bp, Homo sapiens
accttaggcatgttacatggactttctgatccttggtttcatcacgtgtaaaatggagctatcaatagaagtctgaataattggggt

SEQ ID NO: 33428 - DNA, 109 bp, Homo sapiens
gagttatagtattttacgtttgctaaaatattcacctaccacagtaagaatttttgtttatctgatgcaacctgtttggtgttataggcagatgctaagttacaggctt

SEQ ID NO: 33429 - DNA, 68 bp, Homo sapiens
ttggagaggaagaggtgagtgtagagagtcgccagggatctctatgggctcatccaatcagtcttcag

SEQ ID NO: 33430 - DNA, 103 bp, Homo sapiens
ccaggtctttaacacctctctaaactttggcaatcagcctccgctctcaggctctgagtctttgttggggtgacaagatcgaggtggcgtttaaatgatctgg

SEQ ID NO: 33431 - DNA, 92 bp, Homo sapiens
gtggggctgaagtgttccagggttggaaagggttttattaggtcatttcatctctccctctgtctctgggcctattctaacccctcttactt

SEQ ID NO: 33432 - DNA, 86 bp, Homo sapiens
ccagggcaatttgggacaggggacaggttacctattttatatatatatacatatattagagatgaggtctggctctgttgcccagg

SEQ ID NO: 33433 - DNA, 90 bp, Homo sapiens
ggcacagcaagtcctggcaagtgggtcagcaaactcactctgactggctctatgaagtgctgcaggggcttcagagatgttataggggag

SEQ ID NO: 33434 - DNA, 114 bp, Homo sapiens
agtgtttctggatggtgtgtgatttcttggagcgattttgtgcatcaggaagtgaacttcctgcagccacattttgcacatcttgttccattacttgtctaacaggatgctcac

SEQ ID NO: 33435 - DNA, 135 bp, Homo sapiens
ctggtctgacagggcgctcaacctgtcctctttttttttttttttttttttttttttgagacagtgtctcgctctgtcacccaggctgcagtgcagtggcgcaatcttggctcactgcaagctttgcctcccggg

SEQ ID NO: 33436 - DNA, 83 bp, Homo sapiens
ggaagcttctgtttttgatgttctaagttagaagtaacatctctctcctctaactaatgagcttccccccaaccaaagcttct

SEQ ID NO: 33437 - DNA, 75 bp, Homo sapiens
ccaggccttctcccagctcactcttgagtgtctctgtcagagacagagtcagagactgaatggcgtatgggctgg

SEQ ID NO: 33438 - DNA, 71 bp, Homo sapiens
ttctgagcccgtgtcatgctacaatagtgaacccctatcctattctatgacagacatgagagtgctcagaa

SEQ ID NO: 33439 - DNA, 105 bp, Homo sapiens
tcccaggcctctgtgcctgttctaagcatgagccttggagaagagagaatgctcagtgccagctcatgtgtatcccatggacaaggactaataggaccctgagga

SEQ ID NO: 33440 - DNA, 79 bp, Homo sapiens
gagtgtgagaaatgggctaggcaacttggaacgaggctccctctgttcctgtagtctgcctctctgcctctctcagctt

SEQ ID NO: 33441 - DNA, 104 bp, Homo sapiens
atatgtgtgtgtgtgtatatacatatatattacttacatatgagtatatatatgtatgtatatgtgtatatatatgtatgtatgtgcctgcatgtacatactca

SEQ ID NO: 33442 - DNA, 97 bp, Homo sapiens
ggagctgaagggagcaatgggccagcactgaggttgagatctgattttgtcctttactagccttggagccttggtccatgttaactgtctgagcttc

SEQ ID NO: 33443 - DNA, 113 bp, Homo sapiens
ccaggttaggaagtgctgtgtaaaagactgtgtggatgtatgtggataatgatcagttttattattttatttatttttattgagatctagtcttgctctgttgcccaggctgg

SEQ ID NO: 33444 - DNA, 103 bp, Homo sapiens
agagttgccagaggtacatctccacagtctttttcattttttgctaaataccaaatggccagggggctaaagagatgtttggccaaagctgtgaccgaggctg

SEQ ID NO: 33445 - DNA, 60 bp, Homo sapiens
gttaggtgtgtgtgtgtgtgtgcgcactcgtgtgtgcatgtgcatgtggaaatacctacc

SEQ ID NO: 33446 - DNA, 70 bp, Homo sapiens
cacaggcaggcagagtgcagtgctctgatgtgtttcttggagcaggatgggtctgtactgtctgtgtctg

SEQ ID NO: 33447 - DNA, 69 bp, Homo sapiens
tgttttcaagacagggtctcactctggcactcaagctggagtgcagtggtacagtcctggcttgctgca

SEQ ID NO: 33448 - DNA, 130 bp, Homo sapiens
gtgaccgagcaagactctgtctcaaaaaaaagaaaaaaaaacttattttttgagacagagtctcactctgtcgcccaggctggattgcagtggggcaaacacagttcactgcagcctcaatttcttgggc

SEQ ID NO: 33449 - DNA, 96 bp, Homo sapiens
gcaccaccagcctaggcaacagagggagaccctctttaaaaaaaaattttttttttttttgagacagattctcactctgtcaccaggctggagtgc

SEQ ID NO: 33450 - DNA, 72 bp, Homo sapiens
gttgttagagatgggggtctctctctgtcacccaggctggagtgcagtagcaggatcacggctcactacagc

SEQ ID NO: 33451 - DNA, 71 bp, Homo sapiens
ttgtttttgagacagagtctctttctgtcacccaggctggagtgcagtggcgagatctgggctcactgcaa

SEQ ID NO: 33452 - DNA, 95 bp, Homo sapiens; identical to SEQ ID NO: 68

SEQ ID NO: 33453 - DNA, 93 bp, Homo sapiens; identical to SEQ ID NO: 69

SEQ ID NO: 33454 - DNA, 118 bp, Homo sapiens
ccagctttgttctttctacttaggattgtcttggctatgtgggcccttttttggttccatatgaaatttaaagtagttttttccagttctgtgaagaaagtcaatggtagcttgatgg

SEQ ID NO: 33455 - DNA, 115 bp, Homo sapiens
atggttaatttcacagagctgtgagtggaggctgttaaaatgttaatattatttaaattgttttacattttcgacagtttgagctgcaaatataaatgttttctgtgctttccat

SEQ ID NO: 33456 - DNA, 57 bp, Homo sapiens
acagtggagctggagagcagaaggccacacctgctgactctcacccagacacactgt

SEQ ID NO: 33457 - DNA, 118 bp, Homo sapiens
gtccttaaggagcataccttgtgtggtagtcaggtacatagactgttccaacacactgtagtgaatttcttgatggaaggtctgtgagcagagacccagaggagaatgatctggggat

SEQ ID NO: 33458 - DNA, 91 bp, Homo sapiens
accagcccagaccagctgaatctgcatttggaaaagagccccaagtggttcatgtgcctgataaagcttgagaagcattggtctgggtggt

SEQ ID NO: 33459 - DNA, 101 bp, Homo sapiens
tgggctggatgcccctggcagagcctgctctgagagtctgagagcctgtccccatgctcccacagatctccagaccccagctctccttgtggttctaccta

SEQ ID NO: 33460 - DNA, 70 bp, Homo sapiens
ggagagctggggtctggagatctgtgggagcatggggacaggctctcagactctcagagcaggctctgcc

SEQ ID NO: 33461 - DNA, 94 bp, Homo sapiens
ttcatatgttccaacctaatagcctctctgtgactctgtaaatggggttaatagcactaccactctcacaggattgttggggagattaaatgaa

SEQ ID NO: 33462 - DNA, 89 bp, Homo sapiens
gtgtccctgaccactgcgtctatgacactgtgcctgtgactgtgtgtccagtgccaccgtgtgtgtgggattgctgtgttcaagagcac

SEQ ID NO: 33463 - DNA, 65 bp, Homo sapiens
gcctcccaggccacactctgtccctctggtgggagaccaggtggagagaggagattgcctggagc

SEQ ID NO: 33464 - DNA, 138 bp, Homo sapiens
tcctatgtctctcttctttgtattttttccctccctctctcagtttcttggcctctcttcatctctctgtctctgggttaaaagttgtaggaaaaggataggaggtggggcccaagaggaatcccagatgaaactgag

SEQ ID NO: 33465 - DNA, 61 bp, Homo sapiens
agctggtaaggaggggttagtggggccagggctctgacaccagctctgtctctcactggct

SEQ ID NO: 33466 - DNA, 112 bp, Homo sapiens
gttggcagaggctgagtggtctcccaggtctcccacgcagtcagagatggagcaaagtgtcaccggctctgtctctctgctcagaacaccttggggttgctcctctgctgac

SEQ ID NO: 33467 - DNA, 102 bp, Homo sapiens
catgggagacccccatgcttatgcaatgaaataaattaaatgcggtcccatttcctcctctttattaatttattattgcatctgctaggactctttcccatg

SEQ ID NO: 33468 - DNA, 72 bp, Homo sapiens
tgctgacttgtcaatttgtagatcacttactcctagagtagtccacgtgaaacttaggctgaatggtcggca

SEQ ID NO: 33469 - DNA, 114 bp, Homo sapiens
tgcttaggactgtcttggctatacaggctcctttttggttccatatgaaatttaaagtagttttttctaattctgtgaaggaagtcaatggtagcttgatgtggatagcattga

SEQ ID NO: 33470 - DNA, 72 bp, Homo sapiens
aggagaaggtccaaggagatcagtgtgtgcagaggctgtgcttcatgccaggtgattgggataaggtctctt

SEQ ID NO: 33471 - DNA, 82 bp, Homo sapiens
gctcttacccaggaaaggagcacagagtgagaggagagaggcacaaaactctctgtccctctgtggctgagtgagacagtgc

SEQ ID NO: 33472 - DNA, 140 bp, Homo sapiens
atatgtacatatgtaggtatacagatggatgcatatgtgtatatgtatatatgtgtgcgtgcatgtgcatgtattttatatatatatgtatatgtatatatgaagaggcagagagagagagcgtgcatgcacactgggca

SEQ ID NO: 33473 - DNA, 93 bp, Homo sapiens
ggttgtcagggtcagcatgttctcagggtgtcccctgccaaccctacaatcagggccagcagtagagacagagcagtgatggatcccagtgcc

SEQ ID NO: 33474 - DNA, 76 bp, Homo sapiens
ctctggcctggtccctctctgtgaggctctgtgctaagcagcatgggagtgagggagatgtggagtcaagcaagag

SEQ ID NO: 33475 - DNA, 85 bp, Homo sapiens
ggatggcctgcacatgttgtctgttcgctcactttcccatctgtgtcccagagctgagtgagcacaccctcgtggagtgccatcc

SEQ ID NO: 33476 - DNA, 83 bp, Homo sapiens
tagcattggctacagttcatgatgaggcacctgaggctcagaaacctcggggcactcagtcatggtcactcagtcacttgcta

SEQ ID NO: 33477 - DNA, 59 bp, Homo sapiens
gcacacagggaagtgcggggggagcaccttgaccgcctgcctgccagcctctctgccgc

SEQ ID NO: 33478 - DNA, 114 bp, Homo sapiens
ctcagttttcctcctgtagctgggtgcctgtccgcaaggctggagaggcgctgctcagagccagcactgagggtggcaccaccacccctccttcttcctctggtgcccctgagt

SEQ ID NO: 33479 - DNA, 80 bp, Homo sapiens
gccaagtccctgcacctctctctgcctcagtttctccaatgggtcatgaggagggagaaggtttagtgggtgacaagtgc

SEQ ID NO: 33480 - DNA, 121 bp, Homo sapiens
gctgtgggcggtggggaggcaggaggccgactccagttctgccccagtcactgactcactgcatgaccccagatgagggcaaacgctgcctgtctctgggcctcagtttcctcctcagtga

SEQ ID NO: 33481 - DNA, 115 bp, Homo sapiens
cctgggcccctggccagcctgggaggtaaagattcaggaatgcaaaggggtccctgtctcaccctccctgtctgtggcctgtggtccatggagagagtgcttgggagaggctggg

SEQ ID NO: 33482 - DNA, 95 bp, Homo sapiens
ccactgtggggaccccagagccctcagattcctggtgacagcagctggtctgccccctgtctgccagcctctgagcctctgctaatacaccctgg

SEQ ID NO: 33483 - DNA, 166 bp, Homo sapiens
cagtccagatgtgtgagtgactggccaggcgcacccagacacccgcccagctggtgtcactctgtctgtccttgcgtaatcccctgcctgcctctgtctgtccctgtcagccctcctggttctctcgacagtgcccagactctctttttggctgcgaattcccggg

SEQ ID NO: 33484 - DNA, 73 bp, Homo sapiens
ctggggcccagaaagtgagagaaggacacagagggaagcgatgaaaccactgctcactctctgtatgcctcag

SEQ ID NO: 33485 - DNA, 100 bp, Homo sapiens
acacatacacacttattatatatacatgcatacggatgtgtatgtatgtatatgtgtgtgtgtgtatctatacatatatatgtatgtatctatgtacata

SEQ ID NO: 33486 - DNA, 107 bp, Homo sapiens
ggaagttattccaagggtccctgaggcacatctaggcagtttctgacagtcctggtctcacctgtgtctgtctgtctgtctgcagtgctttgatctggagtcatacc

SEQ ID NO: 33487 - DNA, 82 bp, Homo sapiens
atacacacatgcatacataaacatatatagtcacttcttagcccacacagatgaatatatgtatatgtatgtgtgtgtctat

SEQ ID NO: 33488 - DNA, 90 bp, Homo sapiens
ctgggctgcagggagcatctcgactctccgcactggaaagccgtggatccacctgtgagcagagtgtggacacaccctgataagaaccag

SEQ ID NO: 33489 - DNA, 103 bp, Homo sapiens
gaggccaggaggcagaggctgggctggagtcaggcgtggggaggggtcccgccactcactcactgtgtgaccttgaaaaagtctctccacctctctgggcctc

SEQ ID NO: 33490 - DNA, 83 bp, Homo sapiens
gtttgtttttgtttttttgagatggagtctcactctgtcacccaggctggagtccagtggcgccatttcagctcactgcaagc

SEQ ID NO: 33491 - DNA, 58 bp, Homo sapiens; identical to SEQ ID NO: 2758

SEQ ID NO: 33492 - DNA, 92 bp, Homo sapiens
ggtgccttgggcagaggagcttctcatggtgtctgtctctttctctggggaagtgggcttcagacacctttagaaccacatgcacaaagccc

SEQ ID NO: 33493 - DNA, 80 bp, Homo sapiens
tctgcctctctctgtcattatgcttggccggtactgctcatcctgatggcactgggcaggcagtgggctgcagaggcaga

SEQ ID NO: 33494 - DNA, 92 bp, Homo sapiens
gcactctggtctcgcccgccctgcctctcgggctctgcccagcttcctgagtcctgacagagcacagtgggggagatgttggcagaggtggc

SEQ ID NO: 33495 - DNA, 131 bp, Homo sapiens
cagagtgccagagaatctccactgtgtccttagctccacacagttaggacttctctgaagtctgcctctctctgtcattatgcttggctgggactgctcatcctgatggcactgggctgcagagggagagc

SEQ ID NO: 33496 - DNA, 119 bp, Homo sapiens
ggccaacatggcgaaaccccatctctactacaaaaaaaaaagggggttttatatgaccaaagtttttttttttttttttttttttttctgagatggagtctcactctgtcactcaggct

SEQ ID NO: 33497 - DNA, 92 bp, Homo sapiens; identical to SEQ ID NO: 33494

SEQ ID NO: 33498 - DNA, 80 bp, Homo sapiens
tatatatgcagatatctatatatgtatatctacataaatatctacatgccgatatatatatatatctatgtgtgtatatg

SEQ ID NO: 33499 - DNA, 94 bp, Homo sapiens
agaagaacttctaagaagtgagagtggagacagaggccaaagatgctgctctaggctgctccgtgaattccaggacttctgagaagcaccttct

SEQ ID NO: 33500 - DNA, 101 bp, Homo sapiens; identical to SEQ ID NO: 32880

SEQ ID NO: 33501 - DNA, 60 bp, Homo sapiens
tgaggcagagtctctcgctctgtcacccaggctggagtgcagtggcgcgatctcggctca

SEQ ID NO: 33502 - DNA, 89 bp, Homo sapiens
gccatggtgagagtagtgagtgagttctctattagttttcccaagagctggttttttaaaagagcccggtgcttccctctctctcttgc

SEQ ID NO: 33503 - DNA, 57 bp, Homo sapiens
ctgagtgcccaggtgaagctggggcggttctgtgcctctgtgtctctgtgcttgcgg

SEQ ID NO: 33504 - DNA, 58 bp, Homo sapiens; identical to SEQ ID NO: 2758

SEQ ID NO: 33505 - DNA, 92 bp, Homo sapiens; identical to SEQ ID NO: 33492

SEQ ID NO: 33506 - DNA, 80 bp, Homo sapiens; identical to SEQ ID NO: 33493

SEQ ID NO: 33507 - DNA, 92 bp, Homo sapiens; identical to SEQ ID NO: 33494

SEQ ID NO: 33508 - DNA, 131 bp, Homo sapiens; identical to SEQ ID NO: 33495

SEQ ID NO: 33509 - DNA, 92 bp, Homo sapiens; identical to SEQ ID NO: 33494

SEQ ID NO: 33510 - DNA, 80 bp, Homo sapiens; identical to SEQ ID NO: 33498

SEQ ID NO: 33511 - DNA, 94 bp, Homo sapiens; identical to SEQ ID NO: 33499

SEQ ID NO: 33512 - DNA, 101 bp, Homo sapiens; identical to SEQ ID NO: 32880

SEQ ID NO: 33513 - DNA, 60 bp, Homo sapiens; identical to SEQ ID NO: 33501

SEQ ID NO: 33514 - DNA, 89 bp, Homo sapiens; identical to SEQ ID NO: 33502

SEQ ID NO: 33515 - DNA, 110 bp, Homo sapiens
ttaagtgatacaatttggtcccaagtacgcatttctaaagaaaatatatttttcttatgaaaagttctataagatttgataaattgagatattccatttccatcacttga

SEQ ID NO: 33516 - DNA, 120 bp, Homo sapiens
cagtccactacactctcgcctgggtgccagagcaagttctctcctgtaaaaaaaattttatttatgtatttattttgaaatggagtctctcactctgtcagccaggctggagtgcactgg

SEQ ID NO: 33517 - DNA, 70 bp, Homo sapiens
tggttaaaatgaggctgagacctactgggctgcattcccaggtagtcagtcattctcagtcacaggatga

SEQ ID NO: 33518 - DNA, 173 bp, Homo sapiens
gggctttatttctttatatatatatagcttatatatatatatatagcttatatatagcttatatatatatatatatagcttatatatagcttatatatatatatatagcttatatatatagtttatatatatatatagtgtgtgtgtattttatatatatatatatatatata

SEQ ID NO: 33519 - DNA, 77 bp, Homo sapiens
aacattctgtgtctctctctaagtggtggtctggcttttattttgaaaccagttctaaagagaaagaacagtttgtt

SEQ ID NO: 33520 - DNA, 71 bp, Homo sapiens
gcagcatcagggaaggcactctgcagtctcccctccaggttctcagcgtgcctctatgcctgtgtgactgc

SEQ ID NO: 33521 - DNA, 56 bp, Homo sapiens
gagacagggtctcactctgtcgcacaagctggagtgcactggtgcgatctctgttc

SEQ ID NO: 33522 - DNA, 80 bp, Homo sapiens
aagtattttatttatatatataatgtgttacgtgtgtgtatatatatatacacacacattatatatataaatatagattt

SEQ ID NO: 33523 - DNA, 68 bp, Homo sapiens
ctgtagtcccagctactcgggaggctgaggtaggaggatggcttgagcctgggagtcagagactgcag

SEQ ID NO: 33524 - DNA, 58 bp, Homo sapiens
tgaggcagagtctcactctgtcacccaggctggagtgcaatggtgtgatctcggctca

SEQ ID NO: 33525 - DNA, 97 bp, Homo sapiens
cctagactttggtgacgtcttgtctctgtgtgactgtctatcattaaagataatggggtaaaggagcatgtcattaagtgggaaagagaggtcatta

SEQ ID NO: 33526 - DNA, 58 bp, Homo sapiens; identical to SEQ ID NO: 1391

SEQ ID NO: 33527 - DNA, 56 bp, Homo sapiens; identical to SEQ ID NO: 1392

SEQ ID NO: 33528 - DNA, 63 bp, Homo sapiens
gacagatgaccagcagcattccatcacctgggtgagaggtgacagcgtgctggcagccctctc

SEQ ID NO: 33529 - DNA, 88 bp, Homo sapiens
cccaccagcggaggccactctccctcagtctctctgtcccttctcatgggcacagacctgggacgggaacaccagactccactgtggg

SEQ ID NO: 33530 - DNA, 58 bp, Homo sapiens
tgagccggagtctcgctctgtcacccaggctggagtgcagtggcgcgatctcagctca

SEQ ID NO: 33531 - DNA, 89 bp, Homo sapiens
tcctcaacactcccttcagaggaggccaaggggaatcagacaaaaagcctcatccaggctgaagtcagtgttcactcaaggaattctct

SEQ ID NO: 33532 - DNA, 77 bp, Homo sapiens
ggggatgtgaggtcagtgtggggagagtgaggggcctcccagggcggctcccacatcctgcctgtcctggcagcctc

SEQ ID NO: 33533 - DNA, 64 bp, Homo sapiens
gcctgtgtgtatatatctgtgtgtgctgtgtgtctgtatgtgtgcttgtgtgcatatctgtggc

SEQ ID NO: 33534 - DNA, 88 bp, Homo sapiens
cacgtgactatggaagctaacccaggatgggccatcaggttggcgtgtgtctttctgtgtgtgttctctgtgtgtatctctgtctgtg

SEQ ID NO: 33535 - DNA, 107 bp, Homo sapiens
ggtgctgagttttcttctgggagatagttaagtctggaattaggacaatctcaggttagaagtctggctcctgggttccggttttggctctgccattggctcacact

SEQ ID NO: 33536 - DNA, 98 bp, Homo sapiens
tcaaacacggatgcctgtgttgtttctccagtggcctggcccagccctgatgcttctctcaggctctctgtctggtctggcacaaaatccttttatga

SEQ ID NO: 33537 - DNA, 95 bp, Homo sapiens; identical to SEQ ID NO: 68

SEQ ID NO: 33538 - DNA, 93 bp, Homo sapiens; identical to SEQ ID NO: 69

SEQ ID NO: 33539 - DNA, 81 bp, Homo sapiens
caagtatcctacatggtgaactaacaagtcctattgtatttcacagtgggagttgttacacaccattagttaagctatttg

SEQ ID NO: 33540 - DNA, 105 bp, Homo sapiens
tggtgggggggaaataagtagaaagataatttagctagagcttataaaagaagttagtattttagtttccaatgagctcattattttgcattttctccattgcca

SEQ ID NO: 33541 - DNA, 118 bp, Homo sapiens
ctgtttttgttgtccttcaagagttgtttggtttggtgtggagtagcagttctttaggtttgctttttttatttttcatttacaagtttaaactcttcgactgtagagtaaacttcag

SEQ ID NO: 33542 - DNA, 65 bp, Homo sapiens
gtgactgtgtgtgtgtatatatatgtatatacaatatacacatgcaacatatatatgcagtacgc

SEQ ID NO: 33543 - DNA, 78 bp, Homo sapiens
gtaagaatagatgtgtttcttgtgatactccccatataatgatgtgttctgtgagtgtcagtgagtcttcatccttac

SEQ ID NO: 33544 - DNA, 69 bp, Homo sapiens
gcttccctctctctgtcagacctgccagaatatctttgtcaaatctttaccatgagagccctggggagt

SEQ ID NO: 33545 - DNA, 117 bp, Homo sapiens
caggtctgtttttcttgttgatctgtgtagttgttctgaacactactgaatttggtgtattacaatctccaaatattcttgtagaacagtttaattatccattcaatgctgtcactg

SEQ ID NO: 33546 - DNA, 88 bp, Homo sapiens
tgtgtatatacttatacatgtatatgtatttatccatactgcatatgcataaatttatttacaatatatatgtattcatatatatgca

SEQ ID NO: 33547 - DNA, 75 bp, Homo sapiens
tggaacgggcagggagagaatccttttttttttttttttttttttttttgagacagagtctcaccctgtcaccca

SEQ ID NO: 33548 - DNA, 95 bp, Homo sapiens; identical to SEQ ID NO: 68

SEQ ID NO: 33549 - DNA, 93 bp, Homo sapiens; identical to SEQ ID NO: 69

SEQ ID NO: 33550 - DNA, 116 bp, Homo sapiens
tgttctttttgcttactattgtcttggctatacaaactcttttttggttccatatgaaatttaaagtagttttttctaattctgtgaagaaagacaatggtagcctgattgtaata

SEQ ID NO: 33551 - DNA, 117 bp, Homo sapiens
tcagtaatattattagccataattaatgtgtttttcttatctaaaaatgtaagtagtagcaactactttatgctgcttgggacacaataggagattcataaatgttaatttgattga

SEQ ID NO: 33552 - DNA, 111 bp, Homo sapiens
gtatatatgtatcatggactatatatatatatcatggactatatatatatcatggactctatatatatatatcatggactatatatataaaatcatggactatatatatat

SEQ ID NO: 33553 - DNA, 80 bp, Homo sapiens
tcatggactatatatatcatggactatatatatatcatggactatatatatatatcatggactatatatatatatcatgg

SEQ ID NO: 33554 - DNA, 119 bp, Homo sapiens
tgtggggcatgagaaacgtcaagttgctaagagttagtttcctctgtgactagtcattattgctctctgtctcactcactcacttgctcactctctttctttctttttctctctccata

SEQ ID NO: 33555 - DNA, 70 bp, Homo sapiens
attttgagcctctgtgtgtctctgtatgtgagatgggtctcttgaatacagcacactgatgggtcttgat

SEQ ID NO: 33556 - DNA, 95 bp, Homo sapiens; identical to SEQ ID NO: 68

SEQ ID NO: 33557 - DNA, 93 bp, Homo sapiens; identical to SEQ ID NO: 69

SEQ ID NO: 33558 - DNA, 80 bp, Homo sapiens
ggtagtggtgagaggtgacagtgtgctggcagcccttgctcgctctcggcgcctcctcggcctcggcacccactctagcc

SEQ ID NO: 33559 - DNA, 91 bp, Homo sapiens
gcatagcacatatacatataacagatatgtgttatatgcatgttaatgcatatatatacgtatgtgtatatatatgtgtgtatatatatgc

SEQ ID NO: 33560 - DNA, 89 bp, Homo sapiens
tccaaccgctggcaaccactgactttttcttttcttttcttttctttttttaagttgagacaaggtttggctctgttactcaggctgga

SEQ ID NO: 33561 - DNA, 105 bp, Homo sapiens
atatttatgtgtgtgtgtatatatatgtatgtatgtatgtttgtgctttgtgtatctgtatgtatttatacatatatgcatatgtagatatgcatacatttatgt

SEQ ID NO: 33562 - DNA, 98 bp, Homo sapiens
agcctcctaagtaatagggactataggagcatgccaccacgctcagacaaatttttttcatttttgtagagacggcatctcgctatgttgcctaggct

SEQ ID NO: 33563 - DNA, 105 bp, Homo sapiens
agtggtaatagtatgtgggagcagattgtaaagaagaatgtagataaatgattttgagtgtactggtgattattaatgtgattctattagtttcctgttgctgct

SEQ ID NO: 33564 - DNA, 91 bp, Homo sapiens
gttgcatgtaaactcctcaacatttctgtgatagaggtactgtgagatgttcctttcacagaagaaactgaggccaaaaaagtaatgtgac

SEQ ID NO: 33565 - DNA, 126 bp, Homo sapiens
tacatattacatatatattgtatatataacatatatgtatataagtgtatatatatgtatatatgtctgtgtttgtgtgtgcatgtgtatacatatgggtatatttgtgtatactatacatgtata

SEQ ID NO: 33566 - DNA, 103 bp, Homo sapiens
gttcaaatatacctaaaaatgctgacatatactggggcagggagaggagaactataaatctgtcattttctttttctgacagcagcaggttaatgtagtggac

SEQ ID NO: 33567 - DNA, 94 bp, Homo sapiens
gcaggctgagtgcattgaacaaaaggagattggaaggcatcagaagcaaagactctctccgactctccctgctctcctgtctgcacctgctcct

SEQ ID NO: 33568 - DNA, 105 bp, Homo sapiens
gctgctctatttgtatagagacaatcaatatattttttagaggcaggaaaagatctttttttttttgtcagatgaaatgttgctttctaaggatagtcaatcggt

SEQ ID NO: 33569 - DNA, 71 bp, Homo sapiens
ttgtttttgagactgagtctggctctgtcaccctggatggagtgcagtggcgcaatctcggctcactgcaa

SEQ ID NO: 33570 - DNA, 102 bp, Homo sapiens
attgaagacaggaagtagggagctgtgactggctgtactcgacttttccccaatacagttattcaatttctatatatgctaccctgacaggcttatttcaat

SEQ ID NO: 33571 - DNA, 97 bp, Homo sapiens
catgcagattgctattaatgtacagttctctccatttaatttgctgtggtttccaagactactatattttttattgagaatactaatagcctgtgtg

SEQ ID NO: 33572 - DNA, 80 bp, Homo sapiens
gattactacctctgtgagtctcagtttattagcatcctttatagataagctgtgcctgtaagaaaagaggggtagtaaac

SEQ ID NO: 33573 - DNA, 116 bp, Homo sapiens
gtatgtgttgtatttgaaagtctaaaataggaggccctttaagagaagtgtttatgatgttaaaatctcaagtcttttcatggaagtgtgtctgcgcaggtaaattggatgtatat

SEQ ID NO: 33574 - DNA, 81 bp, Homo sapiens
taaactaaatgcaaaatatatgaatattttaaaagagtgtggccattcttgaacaggtatttgtagtgtatttactgttta

SEQ ID NO: 33575 - DNA, 93 bp, Homo sapiens
tatgagctctgctacttactaaccagctatatagccttgggcaagttacttgacttctcatttagttcatgggtaaagtagaggaggatcata

SEQ ID NO: 33576 - DNA, 70 bp, Homo sapiens
gttttgagacggactctcgctctgtcacccaggctggagtgcagtggcgagatctcagctcactgaaagc

SEQ ID NO: 33577 - DNA, 75 bp, Homo sapiens
gttttcacagttcaaaattttgactaagacactgtgtcagtgtgtttggtacatgctgtgtttgagcctggaagc

SEQ ID NO: 33578 - DNA, 95 bp, Homo sapiens; identical to SEQ ID NO: 68

SEQ ID NO: 33579 - DNA, 93 bp, Homo sapiens; identical to SEQ ID NO: 69

SEQ ID NO: 33580 - DNA, 108 bp, Homo sapiens
caatacattgaaaagctgccatctcttattctcagttcacattggtgaagacagcagagtgtgataacagtagatgggatattttcatttaatcttttacatgtattg

SEQ ID NO: 33581 - DNA, 118 bp, Homo sapiens
tatagtactctctctatatagtactatatacatatatacatatatagtactatatacatatatacatatatagtactatatacatatacatatatagtactatatgtatagtactata

SEQ ID NO: 33582 - DNA, 70 bp, Homo sapiens
ggaagtctgagatcaaggtgacagcagggttgattttcctggaaattcactccttggcttgcagaagtcc

SEQ ID NO: 33583 - DNA, 64 bp, Homo sapiens
aacccaaaagcaagcaatggctctcgggatctgagacagtagagtctgagcttgaagatgggtt

SEQ ID NO: 33584 - DNA, 95 bp, Homo sapiens; identical to SEQ ID NO: 68

SEQ ID NO: 33585 - DNA, 93 bp, Homo sapiens; identical to SEQ ID NO: 69

SEQ ID NO: 33586 - DNA, 96 bp, Homo sapiens
gtctcttagtggtggaatttgggtggactgattattgctcagaattttttgtagttctcagtggaagttctttttttaaataacccactagtgacc

SEQ ID NO: 33587 - DNA, 116 bp, Homo sapiens
tagtaataatgtgcagatttgtgggacaaagctttttgaattaatgatccaaggatttatctctggctcctggatggtaatgaaagatcatgcaagtgtctcagtacaaccagcta

SEQ ID NO: 33588 - DNA, 118 bp, Homo sapiens
agctgtaaaaatcaagccctgacagtgggtgtttctcttggacagtctctgtatttgatgttctgacagcttttatgaggctttggaatgtgtcaatagataacactgtgaccccgag

SEQ ID NO: 33589 - DNA, 68 bp, Homo sapiens
cacctgcaatcctctctgtctgtctcactttccaagggaagagaaaaaagactgagggaatccaggtg

SEQ ID NO: 33590 - DNA, 79 bp, Homo sapiens
ggaatgactgttgtctgggtcactcagtgcctacaccagaaggatgggacaaaccactgccttagcagcagctctgtcc

SEQ ID NO: 33591 - DNA, 96 bp, Homo sapiens
agctctttcttacttgagacacagcaaaggaggtgagttcatctttactcacagatgctttatttgtttttaaaacaatggtagggactagatgct

SEQ ID NO: 33592 - DNA, 116 bp, Homo sapiens
tgttccctccccgattgctctggtgtgcatttagcatgactcaccaatacgcagagatcctctctggctgtgagagaggctacagacactttcagatccattgtagaaatgtgaca

SEQ ID NO: 33593 - DNA, 76 bp, Homo sapiens
caggagaggagagttttgtctaggatgtaaataacaagcaccacaaaatacccaagacaccctctgactctcactg

SEQ ID NO: 33594 - DNA, 99 bp, Homo sapiens
gttgtctgtagtttatatgagagaaataaacttctgtctcacttactgtgatatgaggcttttctcttatattcaaataaatttaaacttaaaagttgc

SEQ ID NO: 33595 - DNA, 110 bp, Homo sapiens
gtggtgctaccttaaagattaaaacatattaggcccttgatatatatttgtttaatgagtatacttggtcattttacaaatatatagctgttcttggtgttaataactac

SEQ ID NO: 33596 - DNA, 85 bp, Homo sapiens
cagtctatgtgcccctaggttgtatggtatagtctattactcctaggctataaacctgtatagcctgttactgcactgaatactg

SEQ ID NO: 33597 - DNA, 104 bp, Homo sapiens; identical to SEQ ID NO: 2711

SEQ ID NO: 33598 - DNA, 60 bp, Homo sapiens
tgtgtttatatatctgtgtgtgtgtatatatatagatatacatatatatgatatgtcaca

SEQ ID NO: 33599 - DNA, 110 bp, Homo sapiens
tttggaatacttctgtatgggagaattgtctcttcttcctatttatttaatcatttatttatatcagtatggaatcatggacatttatcttatgcaggttataatccaaa

SEQ ID NO: 33600 - DNA, 100 bp, Homo sapiens
gtctgaaggaacttgaccaaaaataatgtgctggaggtttttcaatcatttttattagattttcagggaattatttttagtaaggagagtgagatgggat

SEQ ID NO: 33601 - DNA, 75 bp, Homo sapiens
gcgaggaaccctggtgaacacctactgcaatgagctgcacactagcagcgaggatgaactagatgaactcctcgt

SEQ ID NO: 33602 - DNA, 113 bp, Homo sapiens
tgatggatagtttttctgttgatagatgtatggcctggaattttttttctcaatttattaactaatttttctacttttttggtcactatattagtctcctaggattgccatta

SEQ ID NO: 33603 - DNA, 114 bp, Homo sapiens
ctggaataaatgtcaaggagtgcaattgctgggtcatatggtagttgcatgtttagtttaagagactgctgaactgtttttcacaatggctgtactgtttttcattctcaccag

SEQ ID NO: 33604 - DNA, 82 bp, Homo sapiens
caaaggaggtggtggtatatcatctgtgatttatttgtctacagacaaggtaatgcatgtgtatataaatctatttaatttg

SEQ ID NO: 33605 - DNA, 72 bp, Homo sapiens
cctaggattgcaaaggtttgtggcagaagtatgagtcccaggggctctcactcactcaccttttcctcatgg

SEQ ID NO: 33606 - DNA, 95 bp, Homo sapiens
gtgtgtcatatgcacatgtgtgcatgtgtatatatgtatgttttatatgcacatgtgtataatcatttatatatttgtacatgacatatgttagc

SEQ ID NO: 33607 - DNA, 56 bp, Homo sapiens
gagaccgagtctcactctgtcactcaggctggagtgcagtggcatgatctcggctc

SEQ ID NO: 33608 - DNA, 60 bp, Homo sapiens
ctgagatggagtctcactctgtcacccaggctggagtgcagtggtgcgatctcggctgag

SEQ ID NO: 33609 - DNA, 113 bp, Homo sapiens
cttgcatgatgctgaaaatattccctaaggcttctatttaatatttttttttaatgttttttttttttgttattatactctaagttttagggtacatgtgcacattgtgcagg

SEQ ID NO: 33610 - DNA, 101 bp, Homo sapiens
tccaggcttgccaggaagcccaccactgtcagtatctcagattctaaacctttgaacttagtgctaggagtgagaaagcttccttcatggggtagattgga

SEQ ID NO: 33611 - DNA, 110 bp, Homo sapiens
aagtctgcctgaaaacaattctctgttatttcatttaactgattttgtagtacaaataagtgctttgaaatttatctttggttttcagtgagtttttcttcagcctcctt

SEQ ID NO: 33612 - DNA, 92 bp, Homo sapiens
tgctgagtcatgtggtagttgcatatttagttttataagacactgacaaactgttttgcagagtaattgtacctttcacattccaagcagca

SEQ ID NO: 33613 - DNA, 95 bp, Homo sapiens; identical to SEQ ID NO: 68

SEQ ID NO: 33614 - DNA, 93 bp, Homo sapiens; identical to SEQ ID NO: 69

SEQ ID NO: 33615 - DNA, 106 bp, Homo sapiens
tgaatttccatatacattttagattcaatttatcaattttaattttaaaaactttgtggtattttgattaagatgatgttgaatttattaatatgaggagaattta

SEQ ID NO: 33616 - DNA, 95 bp, Homo sapiens; identical to SEQ ID NO: 68

SEQ ID NO: 33617 - DNA, 93 bp, Homo sapiens; identical to SEQ ID NO: 69

SEQ ID NO: 33618 - DNA, 110 bp, Homo sapiens
gtttgctgtccttttaagaaaaaggtcacttcattcactgtcaggtaatgagccctagaggtagaggctgcccaatggtagtgtcttttttcttgagaagtatatcaaac

SEQ ID NO: 33619 - DNA, 118 bp, Homo sapiens
ccccactgctgcatgcccctatgcctctgtccccctgagaatgctgtcactgtctctgaccctcccctgtggctgtgaccccctcaggacatacctgctgggagcatcatctttaagg

SEQ ID NO: 33620 - DNA, 115 bp, Homo sapiens
ctgctgtgtggcctcaagcaaagcattccctccttgagaactcattttcttcatcttggcaaattaaagacttggagctctggttctctctgacggtagctggccaggacggtag

SEQ ID NO: 33621 - DNA, 136 bp, Homo sapiens
ggaggactcagggtggaaggggaagcaaacatgtccttcttcacatggcgacaggagagagaagaatgagagctgagtgaagggggaagccccttataaaaccatcagatcttttgagaacttactcactatcatg

SEQ ID NO: 33622 - DNA, 74 bp, Homo sapiens
ggaacacctgccagaactgagggagctgagactggaggggaacaagctctgctcagtaccatggacagcgttcc

SEQ ID NO: 33623 - DNA, 104 bp, Homo sapiens; identical to SEQ ID NO: 2711

SEQ ID NO: 33624 - DNA, 79 bp, Homo sapiens
tagtctggatgttgttaggaaggcattttgtagatgtgattaacatttacaattggcagactttaagtaaagcagatta

SEQ ID NO: 33625 - DNA, 112 bp, Homo sapiens
ctaccagttaccgggaggctgaggtggaaagcagtgagtcatgatttttttttttttttttttgtagagacaaggtctcactctgtttcccaggccggtctcaaatttgtgg

SEQ ID NO: 33626 - DNA, 117 bp, Homo sapiens
tgaggacttccagattcattacatcagttagaattgtacacatatatacttaaattgtatatatttaaggtgtataacatgatgtttttgatatgcatgtagatagtgaagtgatta

SEQ ID NO: 33627 - DNA, 94 bp, Homo sapiens
gcctggcccctcaccttgtactggtggtgcagggcatttgcctgaactctgactgaagatagtgtcctcccctgcctacacacatacaccacac

SEQ ID NO: 33628 - DNA, 87 bp, Homo sapiens
cagctcctccttcctgggcagccaccagcagctgagggacacgaaagaagtacagtgcctctgactgcctcccaggagcccatcctg

SEQ ID NO: 33629 - DNA, 82 bp, Homo sapiens
ggtggatgcggttctgccatttcttttcttttctttttttttttttttttttttttttgagatggagtctcgctctgtcacc

SEQ ID NO: 33630 - DNA, 105 bp, Homo sapiens
cctgaatggaatataagtctaactaagaaagaattacttctgtctgactgactgtctttaagaagtcatgagttttcttctgttgcagacttggactcagactgg

SEQ ID NO: 33631 - DNA, 136 bp, Homo sapiens
catatatgtgtgtatatatatgtatatatacattatgtatatatatgtatatatacagtatgtatatatatgtatatatacagtatgtatatatatgtatatatacagtatgtatatatatgtatatatacagtat

SEQ ID NO: 33632 - DNA, 81 bp, Homo sapiens
gagagagagagagagagagagagagagctgttaaaactcaatgttaagaaaacaacctttttttttttttttttttttttt

SEQ ID NO: 33633 - DNA, 95 bp, Homo sapiens; identical to SEQ ID NO: 68

SEQ ID NO: 33634 - DNA, 93 bp, Homo sapiens; identical to SEQ ID NO: 69

SEQ ID NO: 33635 - DNA, 168 bp, Homo sapiens
atgtgtatatgtatgtatgtatatacatatatatgtgtatatgtatgtatgtatatacatatatatgtgtatatatatgtatgtatatacatatatatgtgtatatatgtatgtgtatatatgtatatacacacacacacacacacatatatatatataatggaatac

SEQ ID NO: 33636 - DNA, 106 bp, Homo sapiens
atatatatatatttttttcaatatatatatgtgtgtatatatatgtgtatatattcatatatgtatatatatgtatgtatatatgtatatatgtatgtatgtatat

SEQ ID NO: 33637 - DNA, 85 bp, Homo sapiens
tatgattataatcatcatgatgatgatgtttacgacagtgatggtgacgatggtggagatgatgatgatgatgatgatggtcatg

SEQ ID NO: 33638 - DNA, 58 bp, Homo sapiens; identical to SEQ ID NO: 2626

SEQ ID NO: 33639 - DNA, 95 bp, Homo sapiens; identical to SEQ ID NO: 68

SEQ ID NO: 33640 - DNA, 93 bp, Homo sapiens; identical to SEQ ID NO: 69

SEQ ID NO: 33641 - DNA, 82 bp, Homo sapiens
aaggctgagggtctgccagatgcgatatcctctgctgggatggtcactgctcagtctgagtccatctgcattcctcttcctt

SEQ ID NO: 33642 - DNA, 82 bp, Homo sapiens
gcaggggctcataaaggctgagcatctgccagagcctgtatcctctgctgggatggtcactgctcagtctgagtccatctgc

SEQ ID NO: 33643 - DNA, 64 bp, Homo sapiens
atattcatatagtacacatagatgtgttaaatgtgtgtgtgtgtgtgtgtctgtgtgtgagtat

SEQ ID NO: 33644 - DNA, 84 bp, Homo sapiens
acagaggaagcactgcacagaactaactcatatatatatatatatatatattttttttttttttgagacggagtctcactctgt

SEQ ID NO: 33645 - DNA, 101 bp, Homo sapiens
ccaggtacagtgctgggcattttacatctatcaactcattttgatgtttatagaaactttgtgaggttggtattattgttgaaaccgttttaagggcctgg

SEQ ID NO: 33646 - DNA, 95 bp, Homo sapiens; identical to SEQ ID NO: 68

SEQ ID NO: 33647 - DNA, 93 bp, Homo sapiens; identical to SEQ ID NO: 69

SEQ ID NO: 33648 - DNA, 89 bp, Homo sapiens
aggatgtgtgtgtgtataatcatatatatatgattatattatatatacatatgattatatgtatatgtgattatacacacacataagct

SEQ ID NO: 33649 - DNA, 117 bp, Homo sapiens
tgtatgactcttgatcttttgaggtccctatttttaatcttttctactgaagaaaaccaaaatatttctttttaaagtactggcgattgttgaggcaaagaaggttaaagtgcagca

SEQ ID NO: 33650 - DNA, 115 bp, Homo sapiens
attgatttctatttttattgcactgtggtccaagagcatgcttggtataattttttaaatttattgatacttgctttatgactgaatatgtaattgaacctagaatacgttcagt

SEQ ID NO: 33651 - DNA, 109 bp, Homo sapiens
gctgttccattggtctatttgtctgtttttgtaccagtactgtgctgtttggttactatagccttatagtatagtttgaaatcaggtagtatgatgcctctggctttgt

SEQ ID NO: 33652 - DNA, 120 bp, Homo sapiens
ggaaggtgtttgagtcatggacatggatccctcatagcttggtgctgtcttcactgcagtgagtgagctctcatgaggtctagtcatttgaaagtgtgtggcacctccccctccatgctc

SEQ ID NO: 33653 - DNA, 93 bp, Homo sapiens
ttgtgctattagtatgggaggtaaataattgtatatgtatatatagtatacacatatatacatacatatttggctctatatgtatacacacaa

SEQ ID NO: 33654 - DNA, 95 bp, Homo sapiens; identical to SEQ ID NO: 68

SEQ ID NO: 33655 - DNA, 93 bp, Homo sapiens; identical to SEQ ID NO: 69

SEQ ID NO: 33656 - DNA, 97 bp, Homo sapiens
ccagtctggacaacaaagtgagatcccatctctatattatataattaaactttttttttttttttgaggtggaatcttgctgtgtcacccaggctgg

SEQ ID NO: 33657 - DNA, 69 bp, Homo sapiens
tgtacatatataatacacatgtattcatctatatattcatcccatgatatatgtgtatatatatgtata

SEQ ID NO: 33658 - DNA, 78 bp, Homo sapiens
atgagtaacactgaggagacagagcacagtatgcatggggagacagtgggtgatgtgtctgtaaagttatggcatcat

SEQ ID NO: 33659 - DNA, 93 bp, Homo sapiens
gtagagtttttctttcagagtgtacagttctatgcttttaaaattaatatacattatttttaaagcagctttacatttacagaaaaattgagc

SEQ ID NO: 33660 - DNA, 99 bp, Homo sapiens
actgtaacgtcttgtttaatagtcacctgcaatattctttttatttatcttgttttaaaaataagaaaaaaagagaaattattgagcaatcaggtcagt

SEQ ID NO: 33661 - DNA, 99 bp, Homo sapiens
gggctgtattagtttcttaggggtactgtgaacaaagtgtcacaaactgagtggtttagacaacatttattgtctcacagttctggaggctgaaagtct

SEQ ID NO: 33662 - DNA, 118 bp, Homo sapiens
atatatatggttgtatatatatgaatataatacatggttatatatatataaacatgtatgttatatatatatatatataaccatatatgtttatatatatatatatatatatatatat

SEQ ID NO: 33663 - DNA, 75 bp, Homo sapiens
tgagcactccagactgggcagcactatccaggagaatcatggataatatagaggtgtctctctccctgggtctca

SEQ ID NO: 33664 - DNA, 95 bp, Homo sapiens
tatatatacacacatatgtgtgtgtatatatatataatatacacacagatatacacatattaatacacatacatacacatatatatgtatatata

SEQ ID NO: 33665 - DNA, 111 bp, Homo sapiens
ggattgctttggttatttgggctctttttggttccatatgaattgtaaaatagttttttccaattctgtgaagaatgccattggtagttcaatagggatagcattgcatct

SEQ ID NO: 33666 - DNA, 78 bp, Homo sapiens
cataaattctgtctgtctttctgacataaagaggaaataaagacattctcagatgaaggaagaccaaaagaatatgtg

SEQ ID NO: 33667 - DNA, 76 bp, Homo sapiens
tgcaagtgaagtagagatttgcagaggtttcttaatttatttgattcaaaatgcagattttctaagattcagtgca

SEQ ID NO: 33668 - DNA, 65 bp, Homo sapiens
gacaccacagagagctccttgccagcctccgtgcgactctaccaccgagcctctctctgtgagtc

SEQ ID NO: 33669 - DNA, 58 bp, Homo sapiens
tgagacaaggtcttgctctgtcactcagacaggagtgcagtggcgtggtcatgactca

SEQ ID NO: 33670 - DNA, 71 bp, Homo sapiens
ccctcactctgtgcctgacctgggccgcgccctgagccaccgcgcaattgcccacatttcacagatggggg

SEQ ID NO: 33671 - DNA, 65 bp, Homo sapiens
ttgaggcagagtctcactcactcttgtcacccaggctggagtgcagtggtgtgatctcagctcgg

SEQ ID NO: 33672 - DNA, 71 bp, Homo sapiens
ggcctgacacatagtaggaaccccgtcaatgtaatttttttaaatgagacagggtctcactctctcaggct

SEQ ID NO: 33673 - DNA, 89 bp, Homo sapiens
gtttcttgaattagttttggtaagtttgttttgcaaggaattcgttcatttaatttgtaaaatttactggcttaaattattcataaaat

SEQ ID NO: 33674 - DNA, 95 bp, Homo sapiens
attgccaattttagctttcgtactttttatttttacatagggtcttttcatggctttcttttgcacaataagaagtacgttcagccagacgcaat

SEQ ID NO: 33675 - DNA, 58 bp, Homo sapiens
tgagacggagtctcactctgtcacccaggctcgagtgcagtggtgccatctctgctca

SEQ ID NO: 33676 - DNA, 74 bp, Homo sapiens
gggcaagcagtcagcagtcagtgagcagggcctcactgctgggatcttgttcctaactgggtgtcctgctgcct

SEQ ID NO: 33677 - DNA, 120 bp, Homo sapiens
atatatatatatatatggtgtgtgtatatataacatatatgtgtatatatacatatatacatacatatacatatatacgtttatatatatacatatatatacatttgtgtgtacacacac

SEQ ID NO: 33678 - DNA, 108 bp, Homo sapiens
acaaatgtatatatatgtatatatataaacgtatatatgtatatgtatgtatatatgtatatatacacatatatgttatatatacacacaccatatatatatatatat

SEQ ID NO: 33679 - DNA, 87 bp, Homo sapiens
tggcggcaggtctacgcaggattgtgattttgatgtagtgatgaacaaaaccaatattgcaagttatctgcagcaactctgctgtca

SEQ ID NO: 33680 - DNA, 80 bp, Homo sapiens
ggatgaaggagggcctggtggggtaagggcaggagcaaagctacggactgtccctctcacctcacagtcactctctcacc

SEQ ID NO: 33681 - DNA, 85 bp, Homo sapiens
ccaaagttctgggattacaggcgtgagccaccgcgcccagcctatttattttttgaggtggactctcactctgtcacccaggtgg

SEQ ID NO: 33682 - DNA, 78 bp, Homo sapiens
gctccatgaggccaggagggttagtctgtttcactcactttatatttttagcacctggaacagtgcctggcacagagt

SEQ ID NO: 33683 - DNA, 96 bp, Homo sapiens
gtccagactctctgctgcatgggtgatggcatttgtgactgtgttggtcactgtctcagtgatttccttcatctttttgtcccctgactcttgggc

SEQ ID NO: 33684 - DNA, 78 bp, Homo sapiens
tgctaaacacacatgtgacaggatcagggttcaggctcaggtctgagcctcaatctgacactctctgtggaatgggca

SEQ ID NO: 33685 - DNA, 85 bp, Homo sapiens
gatcaaagtagagttctgatttagatgtgtcagttcatagcatgatttctgaatggacatttgacacggaataattatacagatc

SEQ ID NO: 33686 - DNA, 76 bp, Homo sapiens
aggggtcagataatgtttggtagtcactgggttatcctgtggtttaaatcatttaatgtctgtagatttggcctct

SEQ ID NO: 33687 - DNA, 103 bp, Homo sapiens
gatttagtgagacagaaagtagaaagtatatttttacctttcaaattaaattatttttaaaaatgaatggttcaagaatttatatgctatgtttttctaaatc

SEQ ID NO: 33688 - DNA, 70 bp, Homo sapiens
gaggcagtctcactctgtcaccaggctggagtgcagtggtgcaatctcagctcatggcaacctctgcttc

SEQ ID NO: 33689 - DNA, 72 bp, Homo sapiens
ctgggcatagtggcatgcacctgtagtttcagctactcaggaggctgaggtaggaggatcaattgagcccag

SEQ ID NO: 33690 - DNA, 76 bp, Homo sapiens
gtttgtgttcacgtctggggtcaccgtaagccaggcaggatccagaccttccactgtgactctgaccctcacccac

SEQ ID NO: 33691 - DNA, 109 bp, Homo sapiens
gggtcatggtgggcttccgccgggccagggatcggagaactgggctgtaaaccagtgcagtcagtctcagtctataagcccacccttcatcccaagcccacctggtccc

SEQ ID NO: 33692 - DNA, 108 bp, Homo sapiens
gcttgagcccaggaggtggaggctacagtgaggttttttctttttcattttcttttcttttgtttttttttttaagacagagtctcactatgttgtccaggctggagt

SEQ ID NO: 33693 - DNA, 60 bp, Homo sapiens
tgtgtgtgtgtgtgtgtgtatatatatatatatatatatatacacacacacacacacaca

SEQ ID NO: 33694 - DNA, 60 bp, Homo sapiens; identical to SEQ ID NO: 33693

SEQ ID NO: 33695 - DNA, 89 bp, Homo sapiens; identical to SEQ ID NO: 33502

SEQ ID NO: 33696 - DNA, 109 bp, Homo sapiens; identical to SEQ ID NO: 33691

SEQ ID NO: 33697 - DNA, 116 bp, Homo sapiens
tgtaagacagtcaggggaagaggttggtttggtttaggatgcatgataagatatctcatgaagtatctatatactcaattttagaaaatggatcccattcttaaaaactggattca

SEQ ID NO: 33698 - DNA, 131 bp, Homo sapiens
ctgtatcttgacaatgtgataaatatatacatatgcttttaaagtaactgtgtatgtgtttatgtatatatgtgtctatacgggtatatacatctaatgtgtacatatgtgtatatacatctagtatgtat

SEQ ID NO: 33699 - DNA, 97 bp, Homo sapiens
ctaatgacttgaacccattaaaagaattcagaacaaagacaccactcaccccttttagagtgttctgttttccttgtggagtttcaagagtcatggg

SEQ ID NO: 33700 - DNA, 83 bp, Homo sapiens
ggcaacatagtgagaccccgtctcttgaaagcagggaattttttttttttttttttttgaggcagaatctcactctgtcagcc

SEQ ID NO: 33701 - DNA, 127 bp, Homo sapiens
ctgagttgtttttgctagctacatttcttgtgctcagtagctacatgtggcttgtgattactgtattaagacagcacagatacagaacattttcattattgcaaaagttctgttagacagtgctgtt

SEQ ID NO: 33702 - DNA, 89 bp, Homo sapiens
ggttttttttttgtttgtttgtttttgttttaaagttctgggatccacgtgcaggatgtgcaggtttgttacacaggtaaacatgagcc

SEQ ID NO: 33703 - DNA, 74 bp, Homo sapiens
ccgtgcccggccacaagctttatttcctttttttttttttttgagacggagtctggctctgtcgcccagtctgg

SEQ ID NO: 33704 - DNA, 85 bp, Homo sapiens
ctcacagtctcccctcacagtctctgagtgtcttctcacaaatacatacaaagaggaaaatagagactatggttgagaaaccgag

SEQ ID NO: 33705 - DNA, 68 bp, Homo sapiens
catatatgtatgtatatatgtacctatccatctaaataaatgtgtgggtatgtatgcatagatagatg

SEQ ID NO: 33706 - DNA, 65 bp, Homo sapiens
tgtgtctgcctctgtgtgtgggagaaggggacaagctgccgcgttagaatagagacgaggaggca

SEQ ID NO: 33707 - DNA, 198 bp, Homo sapiens
gtatatatatatatatacgtatgtatatatatatatatatacacgtatgtgtatatatatacgtatgtgtgtgtatatatatatatatatacacgtatgtgtatatatatatatatacacgtatgtgtatatatatatatacgtgtgtgtgtgtgtgtgtgtatatatatatatatatatatatatatatatatatat

SEQ ID NO: 33708 - DNA, 115 bp, Homo sapiens
ctgagtgtgggtgtggtgagtggatgagtaatttctaaaaatggaatgaaatcttgtataaaacatgtttcccagaaatctgcacaatctcttttttatacaaatattactctag

SEQ ID NO: 33709 - DNA, 126 bp, Homo sapiens
tcttgcaatgtctttgtttttgatatttgagtaatgctggcttcatgaattaggttggaaagtattgcctctagtacttcaattttctggaagaattgtgtaggattggtattatgtcttaaatat

SEQ ID NO: 33710 - DNA, 115 bp, Homo sapiens
tttacttagtgatagtgcatccatattatggaacatgacagctgttttaaaaaagaatgagacagatgtttgtgtccagatagggaagggtctgcaagatatattatgaagtgaa

SEQ ID NO: 33711 - DNA, 75 bp, Homo sapiens
ggtacatagtatgtgtgtgtgtgtatatatatatatatatatatatatatatatatatatatgtatgtgtgtgcc

SEQ ID NO: 33712 - DNA, 69 bp, Homo sapiens
cagtagcttccagattttttttttttttgagacagagtcttgctctgtcacccagactggagtgcagtg

SEQ ID NO: 33713 - DNA, 116 bp, Homo sapiens
tttataaatatgtagaagagaaggagatatatattcataccttcatatatatgaatatatatttcaaatatgtgaaagtatgaatatagttacacatttttcattacaaagataga

SEQ ID NO: 33714 - DNA, 107 bp, Homo sapiens
gactctatttaactttatttaacctacttttctgccgtcttttttaaaaattttattttggattcaggggtagatgtgcaggtttgttatatacgtaaacttgtgtc

SEQ ID NO: 33715 - DNA, 78 bp, Homo sapiens
aagtatcttctgtgtgtgtcagcttctggatgcaaacttttaggatctgtttttcaacacaccaccagaggagtactt

SEQ ID NO: 33716 - DNA, 66 bp, Homo sapiens
tgtgtgtgtgtgtgtgtgtgtgtgtattttaaatttaagagcaacatacatatagaaacatgtaca

SEQ ID NO: 33717 - DNA, 95 bp, Homo sapiens; identical to SEQ ID NO: 68

SEQ ID NO: 33718 - DNA, 93 bp, Homo sapiens; identical to SEQ ID NO: 69

SEQ ID NO: 33719 - DNA, 102 bp, Homo sapiens
atatatacacatatacacacatatatatgtatgtgtgtgtgtacatatatatatgtatgtgtgtatatatatatatgtgtgtgtgtgtgtgtgtgtgtgtat

SEQ ID NO: 33720 - DNA, 86 bp, Homo sapiens
gtgttgttcttcctgtgtgagtctgtctttgtgttcaaattgcttcctttaataaggacaccagtcatactggattagggtcccac

SEQ ID NO: 33721 - DNA, 106 bp, Homo sapiens
gtcctccagtatatatatacacatacacatatacatacatatacatacatatgtatgtatatgtgtatatatatatgtgtgtgtgtgcgtgtgtgtatgaagtgat

SEQ ID NO: 33722 - DNA, 70 bp, Homo sapiens
agggaccagctgacacaagagtgtatccagaatgataatcagtggacctacacttgtcagattttaacct

SEQ ID NO: 33723 - DNA, 97 bp, Homo sapiens
gtgctttgaattttggccattataatagatatgtaatgatattaatatcttaatattgtttcaatttgtatttatctaatgacatgatgttgagcat

SEQ ID NO: 33724 - DNA, 90 bp, Homo sapiens
aacagtgtggtctgcagtaccctttgcagtgcttggcccagattctccagatttgaaaacatttagcttgtaaagaatagattcactgtt

SEQ ID NO: 33725 - DNA, 80 bp, Homo sapiens
gtgctcttgttgtgttcactcctgcaggtcacctgctccccagcagggtgacagtgaagtgtgagtgcagtggactgcac

SEQ ID NO: 33726 - DNA, 104 bp, Homo sapiens
ctatactctggggaagatgacccgtgtcttgcagggttggaaggcagtgagctcactgcctggtactgaggatgatctaggttgtatgtaaaagccccatatgg

SEQ ID NO: 33727 - DNA, 58 bp, Homo sapiens
tgagatagagtcacactctgtcccacaggctggagtgcagtggtgtgatctcgactca

SEQ ID NO: 33728 - DNA, 148 bp, Homo sapiens
atatatatatgtgtatatatacgtatatatacgtatatacgtatatatatgtatatatgtgtatatatacgtatgtatgtatatacgtatatatacatatacgtatatgtatatgtatatatgtatatatacacatatatacatatat

SEQ ID NO: 33729 - DNA, 191 bp, Homo sapiens
atggaatatatatatatatatatatatgtatatatgtgtgtatatacgtatatatgtgtatatatacatatctgtatatatatgtatatatgtgtatatatacatatctgtatatatatgtatatatgtgtatatatacatatatacatatacatatacgtatatgtatatatacgtatatacatacatac

SEQ ID NO: 33730 - DNA, 104 bp, Homo sapiens
gcaatattcgatattctctctgctttcagcttctttacagtgttgccttgtggcatggagttcaagcagcattgtacagggctatcaaagcacagagagcttgc

SEQ ID NO: 33731 - DNA, 71 bp, Homo sapiens
ttgcaagactggtatgtgtgtgcacatgctcttatatgtgtgtgtctgtgtgtgtatctgtgtaaatgcaa

SEQ ID NO: 33732 - DNA, 95 bp, Homo sapiens; identical to SEQ ID NO: 68

SEQ ID NO: 33733 - DNA, 93 bp, Homo sapiens; identical to SEQ ID NO: 69

SEQ ID NO: 33734 - DNA, 98 bp, Homo sapiens
tgtgtgtatgtatatatgtgtgtgtgtatatatatgtgtgtacatgtgtgtatatatatacatatgtacatatctatacatacatatacatgtatata

SEQ ID NO: 33735 - DNA, 108 bp, Homo sapiens
tgcatattggttttgtatcctacaactttactgaatttgtttatcagttctaataggttttttgtggagtctttaggtttttccaaatacaagatcatatcatctgca

SEQ ID NO: 33736 - DNA, 85 bp, Homo sapiens
atatgtatctatatatataatagaaaccaggtggcatatatatctagatatctgtgtctatatctacatatatatagatacatat

SEQ ID NO: 33737 - DNA, 93 bp, Homo sapiens
tatttgctctttatttctcccacctggtttctattatatatcgatatatagatatatattgatatatatagctagattgatagatgtagatag

SEQ ID NO: 33738 - DNA, 63 bp, Homo sapiens
ggtttctattatatatagatatctagatatatattgatatatatagctagattgatagagatc

SEQ ID NO: 33739 - DNA, 88 bp, Homo sapiens
atagatagataggtagatagatagatagatagataaatagatctctatcaatctagctatatatatcaatatatatctagatatctat

SEQ ID NO: 33740 - DNA, 107 bp, Homo sapiens
cacctggtttctattaacatctatatatctatctatctatataatatgtatatctataatatagattctatatatatctataatagaaaccaggtgagatatataga

SEQ ID NO: 33741 - DNA, 84 bp, Homo sapiens
gtttctattatagatatatatagaatctatattatagatatacatattatatagatagatagatatatagatgttaatagaaac

SEQ ID NO: 33742 - DNA, 134 bp, Homo sapiens
cctggaaatgcctgagaaacattattgatctatcactttttttttttaagaaagggtttctctctgtcactcaggctggagtgcagtggtgcaatcatggctcactgcagctttggtctcccgggctcaagaga

SEQ ID NO: 33743 - DNA, 76 bp, Homo sapiens
ggcagacaaaaatcattatcttaaaacaaataaatttgattaattaatttattttgttttgagatggagtcttgct

SEQ ID NO: 33744 - DNA, 97 bp, Homo sapiens; identical to SEQ ID NO: 1307

SEQ ID NO: 33745 - DNA, 88 bp, Homo sapiens; identical to SEQ ID NO: 1308

SEQ ID NO: 33746 - DNA, 81 bp, Homo sapiens; identical to SEQ ID NO: 1309

SEQ ID NO: 33747 - DNA, 77 bp, Homo sapiens; identical to SEQ ID NO: 1310

SEQ ID NO: 33748 - DNA, 112 bp, Homo sapiens
tgtggaataacgtgaagataaaggcagtgtgtctcatctgcacttgcgtattttctatttggtacagtagtgtttgtgttcatttccctaagtatgtcttcctctttctaga

SEQ ID NO: 33749 - DNA, 117 bp, Homo sapiens
gactattggtaagggtgagtgagggcttagtggctgtgcttgaattctgtgcttgtctctcccactgactacctgtacaaccccaggcaagtcctttgatctctctgaacctcggtt

SEQ ID NO: 33750 - DNA, 88 bp, Homo sapiens
tgtaggggagatggtctgatgtctgatttcactatttgtttattaaaaagcagttgggagttatagactctatctctctaccccttca

SEQ ID NO: 33751 - DNA, 104 bp, Homo sapiens
gggccttttatttgggggtggggggcacagggtctcactctgtcacccagggtggattgcagtggtgtgatcatggttcactgcagcctcaaatacctgggctc

SEQ ID NO: 33752 - DNA, 73 bp, Homo sapiens
ggtatgttatatgagtgtgtgtgtgtatgagagacagagagagagacacacacacacagtcagtgtgtgtgct

SEQ ID NO: 33753 - DNA, 106 bp, Homo sapiens
tggtgccctgagcataagtttggtctacatgttggattatcaagtactgaaaaaaataattatttttcaaagacttcaattgtactaactgtgttctagggaaaca

SEQ ID NO: 33754 - DNA, 96 bp, Homo sapiens
gcattctgaaagtggggttggcatagttctagaatttttaaaaattttattgagaattgctttatgactgagcatgtgcttgattttacagtatgt

SEQ ID NO: 33755 - DNA, 114 bp, Homo sapiens
tttctttaaatacgcaagggcttttaaagaaattcagtgaaaaaatggataatatatgtattcatttatttgtatttctgatgctctttattccttcttgtagatctgaaggaa

SEQ ID NO: 33756 - DNA, 71 bp, Homo sapiens
ctgtgtgtgtctgtgtgtgatttatgtgtgtgtgtgtgtgcatgcacattaaagtttgagaggtactatag

SEQ ID NO: 33757 - DNA, 92 bp, Homo sapiens
ctgcagcattttgctaagacagatgtaaggatgcgtgggcctagtgggctagaaatggctccgtgtgtcagtcagtgaagacagtgaggtag

SEQ ID NO: 33758 - DNA, 58 bp, Homo sapiens
tatatatgtgtgtatatatatgtatatatgtgtgtatatatgtatacatatgtgtgtg

SEQ ID NO: 33759 - DNA, 58 bp, Homo sapiens; identical to SEQ ID NO: 2051

SEQ ID NO: 33760 - DNA, 110 bp, Homo sapiens
tgcagtcctggaggtgactgactcacactaggaaggactcactgtctgtttgtcattatcagcttcctaatcctttgttctctgttttctcactttcctcttcctatgca

SEQ ID NO: 33761 - DNA, 105 bp, Homo sapiens
attgagtgcaagctgttgacattggccaaggtgtacacttttaccattttatgtgtgtgtgtgtgtgtgtgtgtatcatgtcaatgatagcatctcacatttaat

SEQ ID NO: 33762 - DNA, 111 bp, Homo sapiens
agctccattaatacttattgaaggaaagaattctagagaagtaagaacatctggctcattattttttactatatttcagtgttgtcttcctgtaagtgttatagtgatgct

SEQ ID NO: 33763 - DNA, 93 bp, Homo sapiens
cactttccatgtggcacatactgtgcttcattcttgaatttttttttttttttttttgagatggagtctcactctgtcgcccaggctagagtg

SEQ ID NO: 33764 - DNA, 89 bp, Homo sapiens
aaatatgaccaatgtgtggtgaaggtgaataaggtgatagttcaattattttttcatttttagttgacacattgtaattatacatattt

SEQ ID NO: 33765 - DNA, 58 bp, Homo sapiens; identical to SEQ ID NO: 1847

SEQ ID NO: 33766 - DNA, 102 bp, Homo sapiens
agactgtgagctaagaatgttttttgtatttttatatagttaaaaaaaagaagaatcttttgtgatatgtgaaacttttattacattcatatttcattgtct

SEQ ID NO: 33767 - DNA, 103 bp, Homo sapiens
gccagatataaatggagacaaagtatttggtgcatattttaattttctatttatttgaaaactaaagttgtatggactaaactttgtttacataaagtaaggt

SEQ ID NO: 33768 - DNA, 87 bp, Homo sapiens
tatatatatatatatatatatatacacacacacatatatatatgtgtgtatatatatgtgtatatgtatatatgtgtgtgtgtgtat

SEQ ID NO: 33769 - DNA, 114 bp, Homo sapiens
atatatatatatatggatatatatgtgtatatatatgtatatccatatatatatatgtgtatatatatgtatatccatatatatatatgtatacacacacatatatatgtatac

SEQ ID NO: 33770 - DNA, 95 bp, Homo sapiens; identical to SEQ ID NO: 68

SEQ ID NO: 33771 - DNA, 93 bp, Homo sapiens; identical to SEQ ID NO: 69

SEQ ID NO: 33772 - DNA, 102 bp, Homo sapiens
ggcatgatctgttggatgagcataggtgtcagcaggcgggagtgggttttccacggaggtgcctgcctgcctgcctgccttggaggcgcgcagatttttgtc

SEQ ID NO: 33773 - DNA, 95 bp, Homo sapiens; identical to SEQ ID NO: 68

SEQ ID NO: 33774 - DNA, 93 bp, Homo sapiens; identical to SEQ ID NO: 69

SEQ ID NO: 33775 - DNA, 76 bp, Homo sapiens
ggtagatgtgcaggtatgcctccagatgggccttgctgcagcaagtgcagtcagtagacagtctcctgccatcacc

SEQ ID NO: 33776 - DNA, 58 bp, Homo sapiens; identical to SEQ ID NO: 4546

SEQ ID NO: 33777 - DNA, 89 bp, Homo sapiens
gaatgagggtgacttagtgtgaactggaagccatgaaagaaacactttctctgtcacagtctctcctttgttagaaaaaaaccccattc

SEQ ID NO: 33778 - DNA, 93 bp, Homo sapiens
tctagcctggatgacgaagaaagactctgtctcaaaaatttatttttaactttatttttagagatgaggtctcgctctctcacccaggctaga

SEQ ID NO: 33779 - DNA, 78 bp, Homo sapiens
ttctgattttttctgtgtgtctgtatctgtgtctaagtctacatttatatttatacacacacacagagtgagagagag

SEQ ID NO: 33780 - DNA, 113 bp, Homo sapiens
ggaagattggagggggatgagactagatgatgagcaaggaaaatactgattaattttttttttgtttccttatccttcctgtaattcactctgcctccagggttatttcatcc

SEQ ID NO: 33781 - DNA, 116 bp, Homo sapiens
tcctagcgctttgagaggctgaggcaggattatcgcttgaacctgagtgtgagacgagcctgagcagaaacccaactctaggaaaaatgtctaaaaattactcaggcatggtggtg

SEQ ID NO: 33782 - DNA, 95 bp, Homo sapiens; identical to SEQ ID NO: 580

SEQ ID NO: 33783 - DNA, 93 bp, Homo sapiens; identical to SEQ ID NO: 69

SEQ ID NO: 33784 - DNA, 112 bp, Homo sapiens
gtgcttttttgaagataccaagtggcccaagtagactttcacattctttttttttttaaatttttttgagatgtagtctcgctctgtggcccaggctggagtgcagtggcat

SEQ ID NO: 33785 - DNA, 93 bp, Homo sapiens
tgggagtgaggcccaagcaacagtattttttaaattctaatggctggctgtcattagaatctttaagagaatggatttacaggcaacctccta

SEQ ID NO: 33786 - DNA, 155 bp, Homo sapiens
atatatatatatacgtagatatatgtatatattatatatacatgtatatatgtatatattatatgtacatgtatatatgtatatattatacgtacatatatgtatatatattacatacatatatacgtatatatgtatatatgtgtatatatatg

SEQ ID NO: 33787 - DNA, 85 bp, Homo sapiens
ggggatggtatcaagacaaaagtaggtcaagaaaccattttttcccctttcttggtcctactatctgtctgactgactgttcacc

SEQ ID NO: 33788 - DNA, 58 bp, Homo sapiens
gagacagggtcactcgctctgtcacccaggttggagtgcagtggcatgatcttggctc

SEQ ID NO: 33789 - DNA, 88 bp, Homo sapiens
tgcttagctatcacaatgccttttttgagacagggtctcactctgtcacgcaggctggagtgcaatggtgtgatctcggctcactgca

SEQ ID NO: 33790 - DNA, 95 bp, Homo sapiens; identical to SEQ ID NO: 68

SEQ ID NO: 33791 - DNA, 93 bp, Homo sapiens; identical to SEQ ID NO: 69

SEQ ID NO: 33792 - DNA, 70 bp, Homo sapiens
catctgggtaatgctggagtaagttaatgttttttttttgagacagggcctcactctgtcacccaggctg

SEQ ID NO: 33793 - DNA, 58 bp, Homo sapiens; identical to SEQ ID NO: 21649

SEQ ID NO: 33794 - DNA, 58 bp, Homo sapiens; identical to SEQ ID NO: 9211

SEQ ID NO: 33795 - DNA, 69 bp, Homo sapiens
ggtgagggtgatttaggggatttttatttttatttttatttttgagagagtctcactgtcacccaggct

SEQ ID NO: 33796 - DNA, 67 bp, Homo sapiens
tctatatttgtatgtgtgcatctatgtatttatggttatatataatgtacgtgtgtgcatgtgtagg

SEQ ID NO: 33797 - DNA, 76 bp, Homo sapiens
gggattacagatgtgagctaccatgactggccacaattcttttttgttgttcagacagggtctcactctgtctccc

SEQ ID NO: 33798 - DNA, 106 bp, Homo sapiens
tgacaccctctgttcagctttttattcttagtgcggtgctgtcttttttttttttttttttttttttgagacggagtttcgctcttgttgcccaggctggagtgca

SEQ ID NO: 33799 - DNA, 116 bp, Homo sapiens
gtagttgcctaagcattagaaattgtgacttatctgtgtttggagatgtgatttctccttttttatttttatattttttgagacagagtcttgctctgttgcccaggctggagtgc

SEQ ID NO: 33800 - DNA, 69 bp, Homo sapiens
cagtgtgtgatcactacagagtagacattcaaataatgtctaaactaacagaacagtgaaaacagactg

SEQ ID NO: 33801 - DNA, 56 bp, Homo sapiens
ctttttctcaaaagaaaaatgtctcaaaagacattttttttttaattgagacagag

SEQ ID NO: 33802 - DNA, 79 bp, Homo sapiens
atatatatttgtatatattgcaatagatatatgtattacatatatgtgataactatctcagatatatacattatatata

SEQ ID NO: 33803 - DNA, 118 bp, Homo sapiens
attcgctgatggactaaaacaaaattatggttttgtatgtcttataggttatccattttttaatgtatttatttgacacattgcggggtttttttttgttttgtttttgagacagagt

SEQ ID NO: 33804 - DNA, 72 bp, Homo sapiens
catgagaggttgcttcttgtgtctctctgctctctgccatgtgagcactcagtgagaagacagccatctatg

SEQ ID NO: 33805 - DNA, 76 bp, Homo sapiens
tgggtgacagagtgagatcccatcttttttttttttttttttttttttttgagacagagtctctctctgtcaccca

SEQ ID NO: 33806 - DNA, 79 bp, Homo sapiens
gtgttatctcaggcagctttgtgcaggaagttgggtttatcacttcctcacagttgcagtttgtctaggacttagctac

SEQ ID NO: 33807 - DNA, 84 bp, Homo sapiens
tttgggaggctgaggtagaagaatcatttggggccaggagtttagaccagcctgggcaacatagtgagtccttgcctctacaaa

SEQ ID NO: 33808 - DNA, 70 bp, Homo sapiens
tttttttgagacagagtctcactctgtcacccaggctggagtgcagtggtgtgatctcggctcagtgaaa

SEQ ID NO: 33809 - DNA, 58 bp, Homo sapiens; identical to SEQ ID NO: 1435

SEQ ID NO: 33810 - DNA, 116 bp, Homo sapiens
tactaaaattaggactgacaagtgggatataaccattgaaagagaagaaattattattttattattttatttattttttttagacggaatctcactctgtcacccaggctggagta

SEQ ID NO: 33811 - DNA, 110 bp, Homo sapiens
attttaaatattttatgcaaatttccaagtaacttgtattctacatgaaaactttttgtttttctttaggaattcaggaaagacttggctgggcagttgtaggttggggt

SEQ ID NO: 33812 - DNA, 78 bp, Homo sapiens
gagcactgactttggagtcaggtagacctggggttaaatcttgactctgttactatatgacttcagactcaatgtctt

SEQ ID NO: 33813 - DNA, 57 bp, Homo sapiens
cacatatgtgtatgtgtgtatatatgtgtatatatgtatatatatgcgtatgtagtg

SEQ ID NO: 33814 - DNA, 58 bp, Homo sapiens; identical to SEQ ID NO: 1763

SEQ ID NO: 33815 - DNA, 119 bp, Homo sapiens
tggcaaagagcagtggcgcgaacctgtggttccagctacttgggaggctgaggtggaaggatcacttgagcccaggagatcgaggctgcagtgagccataattgtgccacttcattcca

SEQ ID NO: 33816 - DNA, 95 bp, Homo sapiens; identical to SEQ ID NO: 68

SEQ ID NO: 33817 - DNA, 93 bp, Homo sapiens; identical to SEQ ID NO: 69

SEQ ID NO: 33818 - DNA, 112 bp, Homo sapiens
gcggaatttgagctgcctctaatcacttggatgaagaatgctttgtattctagtgtggatgaggatgtaggaagtataatttggttcattatttttggaggaccatcttggc

SEQ ID NO: 33819 - DNA, 83 bp, Homo sapiens
gtgagatatagttcacctaggaaaagcaaagtaaatgcttatttatttatttttatttttttttttttgagacaaggtctcac

SEQ ID NO: 33820 - DNA, 102 bp, Homo sapiens
gaccagagcccagtgcagccagctctcaagggactaagatgggaaaccccagacaggaacaggatctctctttctctctctaatggcttctcagcttttctc

SEQ ID NO: 33821 - DNA, 106 bp, Homo sapiens
gtgtgtccttacagagagtctacgtgtttataagcaggatgtgtgtgcacatgcagaagtgactgtgctctctgcacgctgttccacacattgtttcacaaacccg

SEQ ID NO: 33822 - DNA, 96 bp, Homo sapiens
agaccttaaacaagataaggatgagaggaaccttgagttgcccaagataaaattttgtctcaaagtctctcactttgtttcatgtgtttaatctct

SEQ ID NO: 33823 - DNA, 75 bp, Homo sapiens
gcctaggcaaaagaacgagactgtctttttttttttttttttttttgagacagagtctcactctgtcgcccaggc

SEQ ID NO: 33824 - DNA, 99 bp, Homo sapiens
ggtcacctgctattttgttattttcacctgaccaattctgtgcctgcctgcctgcctgcctgctctgatggttcagtggagttccgatgctctgtctcc

SEQ ID NO: 33825 - DNA, 58 bp, Homo sapiens; identical to SEQ ID NO: 605

SEQ ID NO: 33826 - DNA, 79 bp, Homo sapiens
tgttgaagagaatgtatatgtgtgaatgagtatatggccatccaacacacacacgcacacacacactttctctctcaca

SEQ ID NO: 33827 - DNA, 113 bp, Homo sapiens
cactgtcaagtctctgtgtctgtcttcatggccttttgtttttctcgtttttttttttttttttttttttttgagagggaatctcactttgttgcccaggctggagtgcagtg

SEQ ID NO: 33828 - DNA, 89 bp, Homo sapiens
tcacatggtcttccctctgtgtgtctgtgtcctaatctccttttcttataaggactccagtaggactggattagggcctacccatgtga

SEQ ID NO: 33829 - DNA, 58 bp, Homo sapiens
tgagaccgagtctcactctgtcacccaggctggagtgcagtggtgcaatcttggctca

SEQ ID NO: 33830 - DNA, 108 bp, Homo sapiens
cttttggaatgggagtgtctatcctatgcctgtcccaccataatattttgaaaacaagtaacttgtttgctggagggggatttgcctcaggatgaattgtaccttgag

SEQ ID NO: 33831 - DNA, 81 bp, Homo sapiens
tgttgttgtttttgaaacaaggtctcactctgtcacccaggctggagtgcagtggtatgatcatggctcactgcagcctca

SEQ ID NO: 33832 - DNA, 80 bp, Homo sapiens
gggattctctgagtgctggaatgctaaagagctgggtgctgttaggtatctctctctttctgtctctatatcatcatccc

SEQ ID NO: 33833 - DNA, 112 bp, Homo sapiens
gtggggaaaagattgagaggttggatggttgccctgtctgtgtagaaagaggtagacatgggagacttctcattttgttctgtactaagaaaaattattctgccttgggatc

SEQ ID NO: 33834 - DNA, 75 bp, Homo sapiens
gtatatacatgtatatgtatgtatatgtatacatatatgtatatacgtatatatatgtgtgtatatatatataga

SEQ ID NO: 33835 - DNA, 81 bp, Homo sapiens
tgggcaacaacgtgagaccctacctctacaaaaaatatatatatatatttttgattagccaggtgtggtggcacgagccca

SEQ ID NO: 33836 - DNA, 79 bp, Homo sapiens
cagccctggaagagttcatggtgggatagtggaggcagacatgtctgtctctcacttatttcatcctcttcccaggctg

SEQ ID NO: 33837 - DNA, 121 bp, Homo sapiens
tggggaccttttggaagtcttgtgtttttctttgatatcaatagtctactatgattttttttttattagccggatgtcagtgagttaagagaaacatgatcagtcctgtcagcaaggaagg

SEQ ID NO: 33838 - DNA, 57 bp, Homo sapiens
ggctcaggcttgtaatctagcactttgggaggctgaggtaggtggatcacttgagcc

SEQ ID NO: 33839 - DNA, 122 bp, Homo sapiens
tgcagccaccctttccctcttcatcagagtcggagaattcatcctcacaggcaatttgttgtttatttttttgttttttgagatggagtctcgctctgtcacccaggctggagtgcagtggc

SEQ ID NO: 33840 - DNA, 85 bp, Homo sapiens
ctctctgagctcactgcttacaatttttttttattttgaagtaattttagatttacagaaaagttgcaaaagacagtacagagag

SEQ ID NO: 33841 - DNA, 108 bp, Homo sapiens
gagattgctgggtcgaatagtagttctattttaagttctttgagaagtctctaaactacttttcacagtggctgaactaatttacattctcaccaacaatgcagtgtt

SEQ ID NO: 33842 - DNA, 91 bp, Homo sapiens
gtggcagtgtatcagactgtcttcacagagatgacaaatgcagcaagttatgactgtaggtgtcctgaggtgacatctgggctctagcctc

SEQ ID NO: 33843 - DNA, 64 bp, Homo sapiens
gacatttacagaaatgtatgtatttatgtatcacaaatacataccatatgcattcttgtgtgtc

SEQ ID NO: 33844 - DNA, 58 bp, Homo sapiens
tacatgcgtgtacatatatgtgtaagtgcatatatacatatctatgtatatttatgta

SEQ ID NO: 33845 - DNA, 95 bp, Homo sapiens; identical to SEQ ID NO: 68

SEQ ID NO: 33846 - DNA, 93 bp, Homo sapiens; identical to SEQ ID NO: 69

SEQ ID NO: 33847 - DNA, 123 bp, Homo sapiens
tgtgccaggtactttgcatacattatctctactcactggtagcattgttgtccgcatatttatttatttaaagatggagttttgctcttgctgcccaggctggagtgcagtggtgcaatcttg

SEQ ID NO: 33848 - DNA, 68 bp, Homo sapiens
acgcagacatacagaaaaacatatggatacagaaatagatgtaaatgtgtgtggttatgtgtctgtgt

SEQ ID NO: 33849 - DNA, 58 bp, Homo sapiens
tgagatggagtctcattctgtcactcacgctggagtgcagtggggtgatctcggctca

SEQ ID NO: 33850 - DNA, 58 bp, Homo sapiens
tgagtcagagtctcactgtgtcttccaggctggagtacagtggcacgatcttggctca

SEQ ID NO: 33851 - DNA, 125 bp, Homo sapiens
agtctagtgtaggctgggtgcagtggctcatacataaacccagcactttgggaggctgaggtggaaggatcacttgagcccaggagttcaagatcagcctgggcaacatagtgaaaccttgtctc

SEQ ID NO: 33852 - DNA, 96 bp, Homo sapiens
tgggcaacagggagagactccgtctcataaaaaatagaaacgaaacctagtctctatattttattttattaagatagggtctcactctgtcgtcca

SEQ ID NO: 33853 - DNA, 93 bp, Homo sapiens
taggtaagtctctgaaattagcaagtgagtcaaggatcagagggttttttttttgtttttttgtttttttttttgagacagagtcttgctctg

SEQ ID NO: 33854 - DNA, 111 bp, Homo sapiens
gggaatttcttgttttctgtttaacagttaacaaatgaggtctttttttttttttaagtaagaaacaaggtatcgctctgttgctagactggagtgcagtgacgcgatctc

SEQ ID NO: 33855 - DNA, 76 bp, Homo sapiens
tatagtctcagctactcagggggctgaggtagaaggatcacttaagccccggagttcatggctgcagcgaactgtg

SEQ ID NO: 33856 - DNA, 83 bp, Homo sapiens
tacatatgcatttgtgtatatatgtgtatatatagatatgcatatatatagatatgcatatatgtagataagtgatacacata

SEQ ID NO: 33857 - DNA, 114 bp, Homo sapiens
gaacaactgtgtacactctgagactgtgtggtagaggtggagaggaatttctttttttaattattttttattatactttaagttttagggtacatgtgcacaacgtgcaggttt

SEQ ID NO: 33858 - DNA, 97 bp, Homo sapiens
ggtattacaggcatgcataaccatgcctggctaatttttctgtttttagtagagacagtttcaccatgttggccaggctggtctcaaatttctgacc

SEQ ID NO: 33859 - DNA, 110 bp, Homo sapiens
ctgttgttctgcccataatttcctatgcttgctttgcattgttacatttttttttgaaaatcagaaagcaaaatcaatataaagcagccatgtctggaggagaccaggag

SEQ ID NO: 33860 - DNA, 81 bp, Homo sapiens
tctgggtgtgtctgagagggtgtttcttttattatttttttatttatgtatttgagatggagcctcactttgtcacccaga

SEQ ID NO: 33861 - DNA, 95 bp, Homo sapiens; identical to SEQ ID NO: 68

SEQ ID NO: 33862 - DNA, 93 bp, Homo sapiens; identical to SEQ ID NO: 69

SEQ ID NO: 33863 - DNA, 95 bp, Homo sapiens; identical to SEQ ID NO: 68

SEQ ID NO: 33864 - DNA, 93 bp, Homo sapiens; identical to SEQ ID NO: 69

SEQ ID NO: 33865 - DNA, 72 bp, Homo sapiens
tctgttgattccagtttgggactataaagatttgtaacaggtcttagtgtctcacagtgtgtgtttttcaga

SEQ ID NO: 33866 - DNA, 82 bp, Homo sapiens
tgtcttttctttctttctctttcttggttgctctgtctatagcttccagtactatgtccggtgagagtgctgagagtggaca

SEQ ID NO: 33867 - DNA, 77 bp, Homo sapiens
tgtccagtatctcttttggctaactttaaaaaatagtatgttttttaaaatttagtgtatttagatatactggcaca

SEQ ID NO: 33868 - DNA, 95 bp, Homo sapiens
atacatatatacctacacatacatagacacacgtgtaatgatttttgtggcagttttatatatatatgtgtgtgtatgtgtatctatctatctat

SEQ ID NO: 33869 - DNA, 83 bp, Homo sapiens
taactcatttcccgtttgctctgagaaatgagtgctggcggtgaattacacatttttttttcttcaaaatgggaaatgggtta

SEQ ID NO: 33870 - DNA, 105 bp, Homo sapiens
ccaggacatggccactgtgtcctcctcacagaggagactgaggaccctggctgctaagaacgagtcctgagtcaagatctgaggtcaccacagtttatctcctgg

SEQ ID NO: 33871 - DNA, 88 bp, Homo sapiens
gagaggatatcttaaatgatgctcagagatgacctcagaaaatgacatttgcattttttttattttttagtttttgagatagggtctc

SEQ ID NO: 33872 - DNA, 103 bp, Homo sapiens
gtaaactatatggtatgttttgtatatgtatgtttatgtaggcgcgtatgtatttatataagtatgtacatgaatatacatatgtataggtatgtgtatttgc

SEQ ID NO: 33873 - DNA, 67 bp, Homo sapiens
gtgtgtgtgggggggggtgtttgctttttgtttttcttgagacagagtctcgctctgtcactcagac

SEQ ID NO: 33874 - DNA, 76 bp, Homo sapiens
cggggctactagatgacatagggaagtggaatctgaaagaccttaaatccatttctgctttgtctgtctcactctg

SEQ ID NO: 33875 - DNA, 118 bp, Homo sapiens
cttcatccttacctcatgggcctcattctcactgacaggattttaggctcccttggcctaaactttttttttttttttttttttgagacagagtcttgctttattgctgaggctggag

SEQ ID NO: 33876 - DNA, 101 bp, Homo sapiens
tgcatgcacattgtaccatctaagtccagaggacagtgaggactcagggttgagatcctaacgagttatgccagggcttcttggtcttactatgtgctgta

SEQ ID NO: 33877 - DNA, 109 bp, Homo sapiens
gggggagggggaggagtggaggaaaactgtgaagtcagagagcacagagtcaaaaggaagacgtgagctctgaacaaaataattaaacctccactgttatcagaaattc

SEQ ID NO: 33878 - DNA, 119 bp, Homo sapiens
ctctatatttggcaagtgtttgaattgagaagaaatttcaaaagtgagggtatatttcctagtatctttttttttttttttttttgagatggaatctcactctgtcgcccaggctggag

SEQ ID NO: 33879 - DNA, 83 bp, Homo sapiens
gcctggacctgcctggacctgtcctggtcttttttttttttttttttttttttgagacagtctcggttggttgcccaggctgg

SEQ ID NO: 33880 - DNA, 121 bp, Homo sapiens
atatataatgttcgatatgtagtgtatatatatatatatacacacatacactctgtatatatatacatatatacatatgtgtgtgtatatatatatagactctcatatctatatatgtata

SEQ ID NO: 33881 - DNA, 110 bp, Homo sapiens
tgttaaaaatgttataaagtgttgagaagttactgatgtagaaggttgaatattcttgccaagaatattcaagtaattagagtggtatgagacacgtaagagattagaca

SEQ ID NO: 33882 - DNA, 155 bp, Homo sapiens
aaatatatattaaatatacatttatttatatatataaatatgtattaaatatacatttatttatatataaatgtgtattaaatatacatttatttatatataaatgtgtattaaatatgcatttatttatatataaatgtgtattaaatatgcat

SEQ ID NO: 33883 - DNA, 95 bp, Homo sapiens
agaccaatgggaatattgtgtgttgtggatggaaagatttgaatactactatgttttcacattgagttcaatgtaacaaggccatttccgtgtct

SEQ ID NO: 33884 - DNA, 106 bp, Homo sapiens
gttaattttatgcagttatgacttaatactgcatctttatatttgtttaaatttctatcaactgtaagtggtgtcatgcatggtctgtaattgtgtaagctttgat

SEQ ID NO: 33885 - DNA, 70 bp, Homo sapiens
cagccctgggaagtctgctctgtcacttggccaaaggagatgccaaatcagagtggctgttctatggctg

SEQ ID NO: 33886 - DNA, 60 bp, Homo sapiens
ctgtaggctctgggtgaagacaggggtctaaccctgcaaccccttccccaaatgcttcag

SEQ ID NO: 33887 - DNA, 95 bp, Homo sapiens; identical to SEQ ID NO: 68

SEQ ID NO: 33888 - DNA, 93 bp, Homo sapiens; identical to SEQ ID NO: 69

SEQ ID NO: 33889 - DNA, 76 bp, Homo sapiens
gcagctccccggtatctactgaatcaagcctgagctttttgtcatggctcagtcactcagtctcaccctgagctcc

SEQ ID NO: 33890 - DNA, 58 bp, Homo sapiens
tcattgaccaataagtggaggggtctgtccttaggcaagtgtctctctttgtcagtga

SEQ ID NO: 33891 - DNA, 64 bp, Homo sapiens
tggaggcctgtcttctcccttctctccagtgagctgatagagctgatagagcacagagcctaca

SEQ ID NO: 33892 - DNA, 119 bp, Homo sapiens
gggaacagagtcttggggatagtgcagttggtgataggaggtggcagcggagtggaggggtctccctctgactggctggctgctgcctggctcgaagtctccccagctctgcagacccc

SEQ ID NO: 33893 - DNA, 73 bp, Homo sapiens
ccttggatttgcagatgctgggatgcaagagaaggtatttcaggtagaatgaacagtgtcagcaaaggtgagg

SEQ ID NO: 33894 - DNA, 84 bp, Homo sapiens
tttgattctgaatgatttgcttttctctctctatatatatatttgtatataggatagagacctaggagatgaatatggatggaa

SEQ ID NO: 33895 - DNA, 107 bp, Homo sapiens
tttttgtttttaaaatcaatttattttgaagttactttataaattttcttgtataatttgctttgtataagggatgatttcacttaggtaatgtttgaaaataaaga

SEQ ID NO: 33896 - DNA, 69 bp, Homo sapiens
cttcaaatggctttcacttagggctgtaactgtggttttcagagtggtagacttgagcaaggcaggaag

SEQ ID NO: 33897 - DNA, 108 bp, Homo sapiens
gccacactaaagtatccttggatctctctaattaattaaataatttatttaatttttatctaattaattaatttatttaattttagagacagggtctcactatgttgc

SEQ ID NO: 33898 - DNA, 118 bp, Homo sapiens; identical to SEQ ID NO: 1929

SEQ ID NO: 33899 - DNA, 119 bp, Homo sapiens; identical to SEQ ID NO: 1930

SEQ ID NO: 33900 - DNA, 117 bp, Homo sapiens; identical to SEQ ID NO: 1931

SEQ ID NO: 33901 - DNA, 86 bp, Homo sapiens
ggtttgtgacaaccatgcactgagcaaatctattggtacgtttttccaacagcatgtgatcactagtgtctctgtgtcacagtttc

SEQ ID NO: 33902 - DNA, 58 bp, Homo sapiens
tgagacagagtctcactctgttacccaggttggagtgcagtggtgtgatctcagctca

SEQ ID NO: 33903 - DNA, 75 bp, Homo sapiens
ggctgaggtaggaggatcatttgagtccaggagtttgagaccagcctgggcaacatatggagatcttgcctcccc

SEQ ID NO: 33904 - DNA, 69 bp, Homo sapiens
ttgttttgggaagagtctcactctgtcatccaggctggagtgcagtagtgcagtcttggctcactgcaa

SEQ ID NO: 33905 - DNA, 177 bp, Homo sapiens
atatatatgtgtatatatgtatgtatattcatatatatgtgtatatatgtatgtatattcatatatgtgtatatatgtatgtacattcatatatgtgtatatatgtgtatatatgtatatatgtatatattcatatatgtgtatatatgttcatatatgtgtgtatatatgtatata

SEQ ID NO: 33906 - DNA, 75 bp, Homo sapiens
cctgcaaagcctctaaggccagccgaggcagtccctggttgatacagggactctgtgcctgagtctcttgcagtg

SEQ ID NO: 33907 - DNA, 79 bp, Homo sapiens
tgagacagagtctcgctctgtcacccaggctggagtgcagtggcgagatctcgactcactgcaacctctgcctcctggg

SEQ ID NO: 33908 - DNA, 89 bp, Homo sapiens
gtggctcagagtctattcagtatagaaacaaggaaaagcaagtgtgggccaatccagaatttatatttttgaatagctttagacgtgac

SEQ ID NO: 33909 - DNA, 114 bp, Homo sapiens
tttatatgtgtgtgaatatgtgtgtatatgtatgtctatatgtcatattttatatgtgtgtaaatatgtgtgtatatgtgtatatatgttatatatattttatatgtgtgtgaa

SEQ ID NO: 33910 - DNA, 114 bp, Homo sapiens
cctcctagatgtcacaggagcagggtggagtgctttgaaatgagaatagtgagaggccagatctctcctccatttgaaaagcccatggccgctatttccctgtgcagtctgagg

SEQ ID NO: 33911 - DNA, 80 bp, Homo sapiens
agcaggcagtggacaggaggagaagctcctggatctgttgtacatctgggtaggtgtccatctgtctgtctctggctgct

SEQ ID NO: 33912 - DNA, 92 bp, Homo sapiens
cttcatggattttgtagactcagaactttccagctgacttctgttttacttgacctgtggttggcctggacttgtggtccagaaacatgaag

SEQ ID NO: 33913 - DNA, 58 bp, Homo sapiens
tgaggtggagactcactctgtcacccaggctggagtacagtggagtgatcttggctca

SEQ ID NO: 33914 - DNA, 119 bp, Homo sapiens
cttagctgtttgaccttggcctggttacactgtctgtctctgagcttctagtttctcatctgcaaaaacatgaggaatgggggtggttcgtgttggtcgtctcagagagtcctcctgag

SEQ ID NO: 33915 - DNA, 74 bp, Homo sapiens
ggttttttggtgactgagtctggctctgtcttccaggctggagtgcagaggcatgatcttggctcaatgcaacc

SEQ ID NO: 33916 - DNA, 132 bp, Homo sapiens
ggggttcaagcagtgttgtctcactcagaaattctttttttttttcttttttttgagacagagtctcactgtgtcccccaggctggagtgcagtggcgcgatctcggctcactgcaaggtctgcctcccggg

SEQ ID NO: 33917 - DNA, 116 bp, Homo sapiens
gagtgagagtccatctcaaaaaatatatgtgtgtgtgtgtgtgtgtgtgtgtgtgtgtatatatatacacacacacacacacacacacagccttattgatgtatgattcacatatc

SEQ ID NO: 33918 - DNA, 86 bp, Homo sapiens
gtatgtgtgtatacatatatacgtatatatacgtatatatgtatatatatacgtatatatatgtgtgtatatatgtatatatatat

SEQ ID NO: 33919 - DNA, 62 bp, Homo sapiens
ctgaaaggggcagcctcccagtcaacgaggtccagccccctcactggctgcctgtgacccag

SEQ ID NO: 33920 - DNA, 117 bp, Homo sapiens
cacaaatgatacacacaaggatccctcttagttttctcagacattttgttcatgctcactattttgaatatatttgaatgtgtaatttaggaaatctttgtaatctgttactctgtg

SEQ ID NO: 33921 - DNA, 113 bp, Homo sapiens
agctttttaatcacctgggtgcaggcggcctgggtctgaaaagagagtcagcaaagggtggtggcattatcgttagttcttgtaggtttgggataggtggtggagttaggagc

SEQ ID NO: 33922 - DNA, 58 bp, Homo sapiens
tgagacagggtctcactgtgccactcaggctagagtgcagtggtatgatcatggctca

SEQ ID NO: 33923 - DNA, 58 bp, Homo sapiens
tgagtcagagtctcgctctgtcacccaggctggagaccagtggcatgatcttggctca

SEQ ID NO: 33924 - DNA, 58 bp, Homo sapiens; identical to SEQ ID NO: 1391

SEQ ID NO: 33925 - DNA, 56 bp, Homo sapiens; identical to SEQ ID NO: 1392

SEQ ID NO: 33926 - DNA, 109 bp, Homo sapiens
tccagttccggcggatcctggcacttttcttcctagagtgcagatactgctcactggaggctgtctctgtggcactctgtgggttggccagtgcagagtggggctccag

SEQ ID NO: 33927 - DNA, 58 bp, Homo sapiens; identical to SEQ ID NO: 11671

SEQ ID NO: 33928 - DNA, 112 bp, Homo sapiens
tgctgtggtcatgtgctgtgatttcctggatgatggtggtgatggtgacggtgttgttattatttatttaacttatcatgtgccaggtattgttctcagcactttacataca

SEQ ID NO: 33929 - DNA, 95 bp, Homo sapiens
cttgggctgagttggcacacagagagttctatacaaatgtttgctattatctgctattattttaatatttgttctgagggtagagactgtccaag

SEQ ID NO: 33930 - DNA, 95 bp, Homo sapiens; identical to SEQ ID NO: 68

SEQ ID NO: 33931 - DNA, 93 bp, Homo sapiens; identical to SEQ ID NO: 69

SEQ ID NO: 33932 - DNA, 86 bp, Homo sapiens
tttccggtttgctgtttatgcttccagaaatttctatgtcatgtatatggagaaagagtgtgtgagagagacagagacatagggag

SEQ ID NO: 33933 - DNA, 117 bp, Homo sapiens
gggatttgggtcatgttctgggctggaagacaaaatgccttctcttgactctttttttatttttttgagaccgagtcttgctctgtcacccaggctggagtgcagtggtgcgatctt

SEQ ID NO: 33934 - DNA, 137 bp, Homo sapiens
tacatatatatacacgtatatatgtatatatacgtatatatacgtatgtatatgtatatatatacgtatatatacgcatgtatacgtatatatatacgtgtatatatgtgtgtgtgtgtatatatatatatatatat

SEQ ID NO: 33935 - DNA, 107 bp, Homo sapiens
tgcacattggtgaaagttttcaccattatgaatctgtacattaacttttttttaaatgttggctttagactcataccacatcaggtaggaatttgttaaaatgggca

SEQ ID NO: 33936 - DNA, 115 bp, Homo sapiens
agagtaaaatgcaatagaaaataccacaatacatcccttgtagaaacagaagtatgttagcacatatacttgctaaattgtgatgtaaaatgtatttcttaatgcggttcattct

SEQ ID NO: 33937 - DNA, 118 bp, Homo sapiens
gagaagagaaagtttcctaagggtatgctgacacctggctcacaagtagatttttattaattcattcattaacttgagcttttagtaaatacccattttgtgactggtactgatgctc

SEQ ID NO: 33938 - DNA, 92 bp, Homo sapiens
tggtgattcttgcaatatttggaatttttcattgttattatatctatcatgtgatgtatgaacagtgatctttgatattactattgtcatta

SEQ ID NO: 33939 - DNA, 110 bp, Homo sapiens
atttagcttgattataattatatatttattaatatataatatatttaatatataataaaaatataatataattatatattatatattttatataaataattgagctaaat

SEQ ID NO: 33940 - DNA, 80 bp, Homo sapiens
aagtgtgcattttatatatatatatgtatatgctgccatatagagattaaaggtgtgcatttttatataaaatgcatctt

SEQ ID NO: 33941 - DNA, 111 bp, Homo sapiens
ccttttattacatggttggattcaatttgctaaaataaaagatatatatatatagatatagatatatagatatatagatatttagtatttttacaactgtgttcatgaggg

SEQ ID NO: 33942 - DNA, 112 bp, Homo sapiens
tttactgcaaactgttttatcagcaaggtctttgtgaactatatctgtgctgacctcctgtctctttctgtgacttacaatgactaactgcctggaaatgtagcccagtaga

SEQ ID NO: 33943 - DNA, 96 bp, Homo sapiens
gcgggggggtgaggggaaaatagagtctctcactctgtcacccagctggagtgcagtggcgaggtctcggctcactgaaacctctgcctcccaggc

SEQ ID NO: 33944 - DNA, 79 bp, Homo sapiens
gcactgaagtcaaactgcctgagtttaaatattgactgccacttgttaggtgtgtaactcagtctgtgtgcctcagtgt

SEQ ID NO: 33945 - DNA, 98 bp, Homo sapiens
tcaaaagttaggaagctggaattctctttctgtgtatctgtgagtctctatcatatcacggatatatagaaagagaattccagcttcctaactttgga

SEQ ID NO: 33946 - DNA, 58 bp, Homo sapiens
tgagactgagtctcactctgttgctcaggctggagtacagtggtatgatctcagctca

SEQ ID NO: 33947 - DNA, 80 bp, Homo sapiens
gagtgagggggtcagagagttaagataatcagtacaatctcacctgtactaattctcttaactctctgactccctcactc

SEQ ID NO: 33948 - DNA, 58 bp, Homo sapiens
tgagactgagtctcactgtgtcacccaggctggagtgaagtggtgtgaactcagctca

SEQ ID NO: 33949 - DNA, 78 bp, Homo sapiens
gtatacatatatacatgtatacacacacatatatatgtatgtttatatatatttgtgtgtttgtgtatttgccagtac

SEQ ID NO: 33950 - DNA, 101 bp, Homo sapiens
gccagccatgaaaagatcagaggcccattgcaattggatgaaagaaagccagactgaaatctgtctgcaaaggtgcctttgcttcccatgaacaggtggac

SEQ ID NO: 33951 - DNA, 58 bp, Homo sapiens; identical to SEQ ID NO: 454

SEQ ID NO: 33952 - DNA, 128 bp, Homo sapiens
cacataagaacatatccacatcgttaagtcacacacacacacacacacacacacacacacactcacagtcttgtgtcttttaatgatgggggtatgttctgagaaatgtggtgttaggtgattttgtc

SEQ ID NO: 33953 - DNA, 89 bp, Homo sapiens
tttgttcaggatcagatgactgtaggtgtgtgacttttttctgggttctcaaatttgttctgtcagtctatgtgtctgttttgtacaag

SEQ ID NO: 33954 - DNA, 109 bp, Homo sapiens
aaattctgagtttgaatacttcctcaaacagaagtgaaatagttgtattggttaaaatcagtctacgagtttatgtgatttgtagggaagtgctaagtatcagtggttt

SEQ ID NO: 33955 - DNA, 70 bp, Homo sapiens
gtgtgtgtgtgtgtgtgtgtgtgctggtttatatatatttttgctagtttgcatatgtgtgtatatatat

SEQ ID NO: 33956 - DNA, 120 bp, Homo sapiens
atctcacaaactttattaaattgtgttttattttattcagttaaaatatttttaaatttttcttttgaattattcttgacccgtgagttatttagaattgtgttcctaatattgtgagat

SEQ ID NO: 33957 - DNA, 62 bp, Homo sapiens
atatatatatatatatacacacatacatatatatatgtatgtgtgtatatatatatgtatgt

SEQ ID NO: 33958 - DNA, 58 bp, Homo sapiens
tgagacagggtctcactctgtcacccaggctggagtgcagtggcatgatcttagctca

SEQ ID NO: 33959 - DNA, 81 bp, Homo sapiens
gcagtacttaatgttagcaataaataatagcaaataaagtcaatatttaatattattgttacgttagcatcaggtacatgc

SEQ ID NO: 33960 - DNA, 110 bp, Homo sapiens
tgtgaatagtgctgcaataaacatgtgtgtgcatgtatcttttatttatttattattattatactttaagttctatggtacatgtgcacaatgtgcaggtttgttacata

SEQ ID NO: 33961 - DNA, 114 bp, Homo sapiens
atgattaggcaaatggctggaatgtttacgcaaagacctggtcgctacaaatagatcacttgatatgtttagaagaaagaatttgagtaagttctagacttttttctccatcat

SEQ ID NO: 33962 - DNA, 74 bp, Homo sapiens
gcattacacaaataggcagaaaactagaggcagcattttggttgttgggtttttgttcttgtttttgtttttgc

SEQ ID NO: 33963 - DNA, 108 bp, Homo sapiens
gacggggaattccaggctgttgagtgggagagaagagactgggagcgctttcataatcagtggctccctggttgccattagaactgtggcttgaaagaattctttgtt

SEQ ID NO: 33964 - DNA, 85 bp, Homo sapiens
acacatttctgacacatggcaggtatgttctgacacatagctgatgtggggggggggatgtgactgacgtgtgtgaccagtgtgt

SEQ ID NO: 33965 - DNA, 108 bp, Homo sapiens
cctttacattcaaggtcaatatcgatatctaaggatttaattctgtcactgtgtgttagctggttgttctgtagacatgattgaatagttgctttatagtgtgagtgg

SEQ ID NO: 33966 - DNA, 93 bp, Homo sapiens
gcatctgtagcagtctgtaaggcctgttcagttgtttggtgcacacgtgtgtgccacacacacactcacaataggcttggcacctggctttgc

SEQ ID NO: 33967 - DNA, 73 bp, Homo sapiens
ggttctttacagatactgctttagaatatctttattttaatattcccaaatttagtgatgtttgaaaagagcc

SEQ ID NO: 33968 - DNA, 95 bp, Homo sapiens; identical to SEQ ID NO: 68

SEQ ID NO: 33969 - DNA, 93 bp, Homo sapiens; identical to SEQ ID NO: 69

SEQ ID NO: 33970 - DNA, 116 bp, Homo sapiens
tcctctagctttgttctttttgcttaggattgtcttggctatttttggttccatatgaaatttaaagtagtttttttctaattctgttaagaaagtcaatggtagcttgatgggga

SEQ ID NO: 33971 - DNA, 84 bp, Homo sapiens
atgtttgtctcacgaaacctgaagaacctcttgtcatctgaaagatctagaaagatatttgttctcagggtccaggacatatat

SEQ ID NO: 33972 - DNA, 82 bp, Homo sapiens
atgaaataaaaaataagttatatatatatttatgttcttaaaggacaagttatatatatataacttgtgtgtgtgtgtgtat

SEQ ID NO: 33973 - DNA, 100 bp, Homo sapiens
gagttccgggcagtgactggttatacaaagtccacaattttgataagttagaaaatctgctctgtgactcactgtgtgatcttagacaagttattgacct

SEQ ID NO: 33974 - DNA, 123 bp, Homo sapiens
gtatataggggtgtgtgtgtgtgcgtgtgtgtatatatatatacatatatatatgtgtgtatatatatatatacacacatatatatatgtgtgtatatatatatatatacataaagatatatt

SEQ ID NO: 33975 - DNA, 148 bp, Homo sapiens
gtatatatacatatatacatatatacgtatatatgtatgtgtatatatgtatatacctatgtatgtatatatacacatatatacgtatatatgtatatacctatgtatgtatatatacacatatatacgtatatatgtatatatatac

SEQ ID NO: 33976 - DNA, 123 bp, Homo sapiens
atacatatacatatatacacgtatatatacatatgtatatacacgtgtatatatgtatgtatatatacgtgtatatatgtatacgtatatatacacgtgtatatatgtatacgtatatataca

SEQ ID NO: 33977 - DNA, 133 bp, Homo sapiens
acgtgtatatatgtatgtatatatacgtgtatatatatgtatacgtatatatacgtgtatataaatgtatatatgtatatgtgtatatatacgtatatatacatgtatatatacgtatatatacacatataca

SEQ ID NO: 33978 - DNA, 236 bp, Homo sapiens
tgtgtgtatgtgtatatatatacatatatacgtgtatatatgtgtgtatatatgtatgtgtgtgtatatatatacatatacacacatatatacgtgtatatatgtgtgtatatatatacatatacacacatatatacgtgtatatatgtgtgtatatatgtgtgtgtatatatatatacatatacacacatatatatacatatatacacacactgaacatacatatatatatatac

SEQ ID NO: 33979 - DNA, 73 bp, Homo sapiens
tgtatgttcagtgtgtgtatatatgtatatatatgtgtgtatatgtatatatatatacacacacatatataca

SEQ ID NO: 33980 - DNA, 72 bp, Homo sapiens
tgtgtgtatatgtatatatatacacacatatatacacgtatatatgtgtgtatatgtatatatatacacaca

SEQ ID NO: 33981 - DNA, 65 bp, Homo sapiens
atacacacactgtgagaatgttccatatgtatatatatatgtatatgtatgttcagtgtgtgtgt

SEQ ID NO: 33982 - DNA, 117 bp, Homo sapiens
atagatataaaatatctatatatagattatagatcatatagatatagagtatataaaattatatatagattatacctgtataaaaatctttatatgtgtagaaaaatttgtgtgtgt

SEQ ID NO: 33983 - DNA, 84 bp, Homo sapiens
tatgtagaatttttatatctatgtaaaaatctgtgtaaaatctctatataaaatatttacatagatatagattatatctatata

SEQ ID NO: 33984 - DNA, 101 bp, Homo sapiens
ctggcctgaatcctgtgcaatataatccatatactgaggttgtatatatatttgtttatgtctgtacagtttcctgtttatgttgttctttttaaagacag

SEQ ID NO: 33985 - DNA, 100 bp, Homo sapiens; identical to SEQ ID NO: 29235

SEQ ID NO: 33986 - DNA, 95 bp, Homo sapiens; identical to SEQ ID NO: 68

SEQ ID NO: 33987 - DNA, 93 bp, Homo sapiens; identical to SEQ ID NO: 69

SEQ ID NO: 33988 - DNA, 96 bp, Homo sapiens
gggttaactggacttagacaacatcatgactcagacaatatcaggaaactctgtctttgtctcaatcttgcagtttgtctctgtgtttctctgccc

SEQ ID NO: 33989 - DNA, 89 bp, Homo sapiens
ttacttttatttatctcagctatccaacattatttgcctctaatataatattagaataggttttggaatgtaaaggtgaataaaaatag

SEQ ID NO: 33990 - DNA, 64 bp, Homo sapiens
ctggagacctcactcattcactctctgtgcacatgtacaaaggaaaggacatgtgaggacccag

SEQ ID NO: 33991 - DNA, 85 bp, Homo sapiens
ctgaagagttgttgccagtaatgaatgtgtgtatatatatatatatatatatatatatgtctaaactaacatggctgataatcag

SEQ ID NO: 33992 - DNA, 96 bp, Homo sapiens
aaagggctgatgggaagaagtatgtgaatgctgatattttcttctccttgaacgtatttttttgtatttgtctttgccttttcaattctgcctttt

SEQ ID NO: 33993 - DNA, 116 bp, Homo sapiens
ctgtccttgttcattcctgggtgtaggctgaactaactttgggagaaacttagtttatagtttaaaatgtaacctcccaatgggctcaccttgcctgctgcctagacagaattgat

SEQ ID NO: 33994 - DNA, 107 bp, Homo sapiens
ccagctttgttcttttggcttaggattgtcttggctatgtgggctcctttttggttccatatgaaatttaaagtagttttttccaattctgtgaagaaagtcactgg

SEQ ID NO: 33995 - DNA, 104 bp, Homo sapiens
ggctcctatttgaaatcacctgtttccttctgtcacctgttttacttctttaaatatatatgtttaagcagagtagacagaaggaaacaggtgattaggctgct

SEQ ID NO: 33996 - DNA, 77 bp, Homo sapiens
cttggatggacagagcagtgtgtggagactcacatagtgaatttttgctccaagaactactgcaggaacatactagg

SEQ ID NO: 33997 - DNA, 98 bp, Homo sapiens
catgtatatgtgtgtgtatatatatatgtgtgtatgcatgtatatatttatgttgttacgtgtgtgtatatatatatatgttgttacgcatatatatg

SEQ ID NO: 33998 - DNA, 80 bp, Homo sapiens
agaaagaattcttttttattttaaagctgaagttacattttgacaactctggctttaagtctgactgagaattcctatct

SEQ ID NO: 33999 - DNA, 113 bp, Homo sapiens
ttcttcttcagaattcacacagctttggaaaatgtttgtaaagattttttttatttttaatagatgggggtcttgctatgttgcccaagctggtcttgaactcctggggtgaa

SEQ ID NO: 34000 - DNA, 209 bp, Homo sapiens
tgtgttgttatatatatatgtgtatatatacgtatatatacatatgtgtatatatatgtatatatacatatgtgtatatatatgtatatatacatatgtgtatatatgtatatatacatatgtgtatatatatgtgtgtatatatatgtgtgtatatatgtatatatatatgtgtgtatatatgtatgtatgtatgcatgtatacacca

SEQ ID NO: 34001 - DNA, 94 bp, Homo sapiens
atatatccatttatatatacacatatgtacatatatacatatgtatatacaaaatatatatgtatatgtgtgtatatagtttaaaatcatatat

SEQ ID NO: 34002 - DNA, 112 bp, Homo sapiens
tataattatgaactattttaatgtgaggagttaagctgaggataaattattttaatggtataaattaattttattaattaaggcaatgcagattgagatgtttataattata

SEQ ID NO: 34003 - DNA, 63 bp, Homo sapiens
gtgcccttgtaagaagagacatgagagaaaagatctctctctctctctaccatgtgtgggcac

SEQ ID NO: 34004 - DNA, 79 bp, Homo sapiens
aagctttccctctgtctcactgggcagaatctgggcatattctcaggcctatgccagtcatggcaaggggaacagactt

SEQ ID NO: 34005 - DNA, 76 bp, Homo sapiens
ggaggcagaggtagaagaatcacttgaaccttggaggtggaggttgcagtgagccaagatcacgccactgcactcc

SEQ ID NO: 34006 - DNA, 58 bp, Homo sapiens
tgagacagggtctcactctgtcacccaggctggagtgcagtggtgtgatcattgctca

SEQ ID NO: 34007 - DNA, 125 bp, Homo sapiens
tctgggggctgtctcccagcctcagtgcctgctgtgtggccaggtggagccttgaggtagcacgttgtgttccaaagtccatttctaagtgtgctgtttggaacctagaatgcctactcccatgg

SEQ ID NO: 34008 - DNA, 117 bp, Homo sapiens
cttcaaataacctaaaacgtgtcctgcgttagttttggctttatttctatcaccatttgaaatttgtcatttaggagtagttaagacaaacgatgggcagcgtcaaggcaaaggaag

SEQ ID NO: 34009 - DNA, 80 bp, Homo sapiens
aaccattttctcagggtcttcttttagagaactgaaattaagacagtctctctcagtgatccctgggactcctcatggtt

SEQ ID NO: 34010 - DNA, 84 bp, Homo sapiens; identical to SEQ ID NO: 15839

SEQ ID NO: 34011 - DNA, 77 bp, Homo sapiens
gttgcgcctttttttttgtttttgtttttgagacggagtctcactctgtcacccaggctgaagtgaagtggtgtgat

SEQ ID NO: 34012 - DNA, 95 bp, Homo sapiens; identical to SEQ ID NO: 580

SEQ ID NO: 34013 - DNA, 93 bp, Homo sapiens; identical to SEQ ID NO: 69

SEQ ID NO: 34014 - DNA, 76 bp, Homo sapiens
cagccgctggccaggaaggggagtgagaagcctcaaatgaagctttgacattgtttttctttcttctggagtgctg

SEQ ID NO: 34015 - DNA, 86 bp, Homo sapiens
cagagtttctttatcctaatttcttattcagaataagcaactgaagtccctctctctgtgactttggggtagagataggacttctg

SEQ ID NO: 34016 - DNA, 96 bp, Homo sapiens
ttctcggatactttgcaaaatactgactctctatatatagtatataaggtatatatatatatatatggggtcaatattttgcaaagtatctgagaa

SEQ ID NO: 34017 - DNA, 116 bp, Homo sapiens
agtcattgagctgtgtaaaggagtagtagagtttgtgtgtgggggggtgtgtgtgcgtatatacacacacacacacacacacacatattcttttctagggcattttctaaatgagt

SEQ ID NO: 34018 - DNA, 95 bp, Homo sapiens; identical to SEQ ID NO: 68

SEQ ID NO: 34019 - DNA, 93 bp, Homo sapiens; identical to SEQ ID NO: 69

SEQ ID NO: 34020 - DNA, 86 bp, Homo sapiens
tcacatggtcttctctctgtatatgtctgtgtgcaaattttcttttcttgtgaaaacaccagtcatattagattagggtccagtga

SEQ ID NO: 34021 - DNA, 72 bp, Homo sapiens
ctgtacaactgagttagatgttgagattgtacatttattaaaagtgcctaggcagggctcagtggcttacag

SEQ ID NO: 34022 - DNA, 58 bp, Homo sapiens
tgagaccgaggctcactctgtcactcaggctggagtgcagtggtgtgatgttggctca

SEQ ID NO: 34023 - DNA, 82 bp, Homo sapiens
gtgtgtgtgtgtgtgtgtgtgtatatatgtgtgcatatatatgtgtgtgtgtatatatatataacacaacagaataccatgc

SEQ ID NO: 34024 - DNA, 83 bp, Homo sapiens
tgtttatgaaagcaatgtttagtgctatgaagtcatctattgtgcaccttgattttagcattgattattttatttcatattca

SEQ ID NO: 34025 - DNA, 250 bp, Homo sapiens
atatatatatgtgtgtgtgtgtgtgtatgtgtgtatatatatatgtgtatatatatgtatatatgtgtatatatatgtgtgtatatatatgtatatatatgtgtatatatatgtgtatatatatatgtgtatatatatatgtgtgtgtatatatatatatacgtgtgtatatatatatatatacgtgtgtgtgtgtatatatatatatatatatatatatatatatatatatatgtgtgtatatatatat

SEQ ID NO: 34026 - DNA, 107 bp, Homo sapiens
tcccaccactctctaaattaaagaacatctttaacattatttaatgtcagtcagtcagtcagtgttatgggagaaatttttagtggggagtgttttacagattgggg

SEQ ID NO: 34027 - DNA, 113 bp, Homo sapiens
agtgtggggtctagattcaaaagatatgggctctagttcttgctctgtcatttactcactatgtgtctttgtgaaagtaaattcaacttctctgagccttcgttccctaatct

SEQ ID NO: 34028 - DNA, 116 bp, Homo sapiens
agaagaatataattggtttacattaaagggtattgttgataagtgaagacttattcctgttattttgttatttttttctggttgttttgtgtatcctttgttgtttccttccttct

SEQ ID NO: 34029 - DNA, 64 bp, Homo sapiens
gtaatatagtaatgtgtgtatgtatgtatatgtatatatatatatacatatatttaaatagtac

SEQ ID NO: 34030 - DNA, 90 bp, Homo sapiens
ggggagttcctcctggtccaaactgcccagtctctccgacactgacaggggaaaatggctgactggagcagcagtgatggcagctgcccc

SEQ ID NO: 34031 - DNA, 95 bp, Homo sapiens; identical to SEQ ID NO: 68

SEQ ID NO: 34032 - DNA, 93 bp, Homo sapiens; identical to SEQ ID NO: 69

SEQ ID NO: 34033 - DNA, 75 bp, Homo sapiens
agatgtctgcatgacactagagctcttttttttttttttttttgagacagagtctcactctgtcacccaggctct

SEQ ID NO: 34034 - DNA, 148 bp, Homo sapiens
tatgcatatatatgtatgtgtgtaatatatatataaaatatatgtatgtgtacacatataaactatatatgtatgtatatatgtatgtgtgtatgtgcttgaatgtatgaatatgtgtgtgtaaatatgtatgtgtgtgtatatatgt

SEQ ID NO: 34035 - DNA, 119 bp, Homo sapiens
tgagattatatctcatagtggttttgatttgcatttccccgatgattagtgatgttaaacattttttttcatatatctgttggccatttgtaagtcttcttttgagaaatgtttattca

SEQ ID NO: 34036 - DNA, 119 bp, Homo sapiens
atatagaaatactactgacttgtatgttgattttgtatccttcaactttttttttattattattatactttaagttttagggtacatgtgcacaatgtgcaggttagttacatatgtat

SEQ ID NO: 34037 - DNA, 70 bp, Homo sapiens
acccactgtgaggattaatattgagtgtccacttgattggattgaaggatgcacagtattgttcctgggt

SEQ ID NO: 34038 - DNA, 119 bp, Homo sapiens
atgatccctccaacatgtctacttcctaatccctggaatctgtaaatatatttattaccttacatggcaaaagggaatttacagaagtgattaaggttaagggccttgagatggattat

SEQ ID NO: 34039 - DNA, 85 bp, Homo sapiens
ctaatccaatatgattgttatctggtgtctatataaaggggaaacttggagacagacacacagagagagaagattatgtgatgag

SEQ ID NO: 34040 - DNA, 238 bp, Homo sapiens
gtgtgtgtatatatgcatgtgtatatattttaagcattgcaatatattttatatatatgcatgtatatatatatgcatgtgtatatatgtgtatatatatgcatgtgtaaacatgtatatatgtgtatatatatgcatgtgtaaacatgtatatatgtgtgtgtatatatatgcatgtgtatatattttaagcattgcaatatatttatatttatatatatatatatatatttataga

SEQ ID NO: 34041 - DNA, 88 bp, Homo sapiens
tgtgtatatatgtttatatgcgtgtgtatatatgtatatgtgtgtatatatatgcatgtgtagatatgtatatatgtgtgtgtatata

SEQ ID NO: 34042 - DNA, 58 bp, Homo sapiens; identical to SEQ ID NO: 605

SEQ ID NO: 34043 - DNA, 96 bp, Homo sapiens
atatatatgtgtgtgtgtgtgtgtgtatatataatggtgtgtgtgtatccatctatctatctatctatgtatatatatatgtcacattttatttat

SEQ ID NO: 34044 - DNA, 86 bp, Homo sapiens
acatatttatacacacacacacacacatatacatgtgtgtatatatatacaagtgtgagtatatatatatatgtgtgtgtgtgtgt

SEQ ID NO: 34045 - DNA, 92 bp, Homo sapiens
gttacacagctgtaagtggtgaaagtgaactctgaatttgtttttcagattctagtacttacattcttatccactatgacatactggctcac

SEQ ID NO: 34046 - DNA, 107 bp, Homo sapiens
gtctgtgtgtgtgtaagttttgatacattttaatttttataatagatttatatatattttattgtagtaaatgataaaatagactagtatttacatgtattttaggc

SEQ ID NO: 34047 - DNA, 117 bp, Homo sapiens
gacttggcaatgcaggctcttttttggttccatatgaactttcaagtagttttttttgttgtttttttttttattatacttttaagttttagggtacatgtgcacattgtgcaggtt

SEQ ID NO: 34048 - DNA, 83 bp, Homo sapiens
atatgtgtgtgtgtgtatatgtatatatatatatatatatatatatatatatatatatatacatacatatacacacacacaga

SEQ ID NO: 34049 - DNA, 108 bp, Homo sapiens
tacatatctatctatatctatctatatatatctctctcataagatatatacatatatatatatagagagagagagttatggttgtggttatggttatatggctatgta

SEQ ID NO: 34050 - DNA, 64 bp, Homo sapiens
tctctctatatatatatatgtatatatcttatgagagagatatatatagatagatatagataga

SEQ ID NO: 34051 - DNA, 115 bp, Homo sapiens
gcatagtacctgaatatatatatatatatatatatatatatatatacacacacacacacacatatgcgtatatatgtatgtgtgtatatatatgtatgtgtattatatatgtata

SEQ ID NO: 34052 - DNA, 114 bp, Homo sapiens
gtaaatctagcacatttactgagtaggctgtgagtaaatgttgaatgaatacatgtatatacattcatcatgtatacatttattcactgagatttcatgagctgcaagttatac

SEQ ID NO: 34053 - DNA, 102 bp, Homo sapiens
cagacatagctttttaatgtatgtgatggaattagtatgtattcatgtaatacatataatttgtccataaatatttacatactattataaacgatttttctg

SEQ ID NO: 34054 - DNA, 89 bp, Homo sapiens
tagaaatagcagtccttttgaagtaccactgagtcaatatatttttaaagtttgacagcagctgttgctatttgcagggcctatttttg

SEQ ID NO: 34055 - DNA, 64 bp, Homo sapiens
gtggcattctctgggtatctctcactctgagacctgtctgggaagagtaaccctgagcagcagc

SEQ ID NO: 34056 - DNA, 85 bp, Homo sapiens
tgtgctatagtgattttgtgcttattaaattttataattttaaagacttttataaagcttaatgagcctaaacctaagatagcca

SEQ ID NO: 34057 - DNA, 97 bp, Homo sapiens
tatatatatacacacacacatatatgtatatgtatttgtactatacatatgtataggtatttttactatatacttgtatatgtgtttgtaatatata

SEQ ID NO: 34058 - DNA, 84 bp, Homo sapiens
gtgtatagtgttgataacatctgcagtagtggatagtaaggtcctaggactccacattgactcactactctctcactgatgcac

SEQ ID NO: 34059 - DNA, 76 bp, Homo sapiens
gccacatgcaagattagtgttagaagagaggaacacaggtgtcagaatcaaacattttttattttgctatgggggc

SEQ ID NO: 34060 - DNA, 116 bp, Homo sapiens
tgaccaactcgaggacttctgccatgctcggtcattggccaggagcagactgaagacagtgagacattgatcgacacgggactggattctgatggtgcagcagctggaggctgtca

SEQ ID NO: 34061 - DNA, 108 bp, Homo sapiens
cttctgcaaaactaaatttgccttgctgagaaattctttgtctcagtgctggttcttctttgcgacactgagcatttgtttccaacagaggcaaagaggccctggaag

SEQ ID NO: 34062 - DNA, 88 bp, Homo sapiens
ctggtgcacaccaccatgtgccatgcaccagtattttttttcttttaagagatggggtcttgctgtgtggcccagggtgttgctcttg

SEQ ID NO: 34063 - DNA, 95 bp, Homo sapiens; identical to SEQ ID NO: 68

SEQ ID NO: 34064 - DNA, 93 bp, Homo sapiens; identical to SEQ ID NO: 69

SEQ ID NO: 34065 - DNA, 118 bp, Homo sapiens
atggaacacttgatcacccaaggcaagaatcttcatgtcagacttgacattttgttcacctctcatattcagtcatttgtcaggctgatccattctttactggtcttttcaaatctat

SEQ ID NO: 34066 - DNA, 116 bp, Homo sapiens
agtataactattttgagagtcatacctatagttttgtgcgagcagtttattcattttttattgatgagtggaattcaattgtataagtatagggcagtttttaaatttgttcatct

SEQ ID NO: 34067 - DNA, 113 bp, Homo sapiens
atttaatgtaattatatattccatgtatacagaattttatattatgctatatatttattgtagtatatgtttatatttatttattatatatgggatcaaacagtatgttcaat

SEQ ID NO: 34068 - DNA, 91 bp, Homo sapiens
gctaactcttctgtgtagatgaagtaggtaaaaccagattaaatctgattttgtttatctgattaagtctgatgggcccagaagaaacagc

SEQ ID NO: 34069 - DNA, 78 bp, Homo sapiens
gacctccccatcccaccccagcactcctgtaaatctgtctcatgggaaagataacacaggagtgtgtgctcacaggtt

SEQ ID NO: 34070 - DNA, 112 bp, Homo sapiens
tcaggatgaatatgatggttaatattgaatgtcaacttgattagattgaaggatgcaaagtattgaagaatgcaacaattctattaagctggaagttaagattgccacctgg

SEQ ID NO: 34071 - DNA, 112 bp, Homo sapiens
caaactttatggattcagtggctcatgttaaattattttacagtagacatttatatatatatgtatataatactttaagtcttagggtacatgtgcacaacgtgcaggtttg

SEQ ID NO: 34072 - DNA, 93 bp, Homo sapiens
tcttggatttgatttgtgaatatatacgtatatgtgtgtatatatatctgtatatatgtatactatatatatatattttttttttttttgaga

SEQ ID NO: 34073 - DNA, 116 bp, Homo sapiens
actcacaatttaataaaagacagacacagaaacaaatatatatgtatatattcaactatatatttgtatataaatacatatatttgtttatatgcctctcttattaaattgtgagt

SEQ ID NO: 34074 - DNA, 64 bp, Homo sapiens
ccttcaggaatctatagaactaacaactggcctggttctgcaacttttagagattccctgaagg

SEQ ID NO: 34075 - DNA, 111 bp, Homo sapiens
gaaccatgtttttcagcttagcatagccatatctctcatttattacacaccgactgtgtgtcagagatgttgctctaattatttcagtgcattcccataaaaataaggtac

SEQ ID NO: 34076 - DNA, 75 bp, Homo sapiens
cagtgtctcagtctgtcactcaggctgcacatacctcagtaatggtttgcaactggtttcctggacattgaggca

SEQ ID NO: 34077 - DNA, 118 bp, Homo sapiens
ggctgtgtgcctggccctgtctttggcagggggctcggagctccagacaggtgagagagcagacacaggggtctggggcctggcagagtgtcctgggggcagggcgaggcgggcgggc

SEQ ID NO: 34078 - DNA, 67 bp, Homo sapiens
ctcagggactgactgtctcagggcatccagcaaactggatggtgcctgatgattcctgagatgcgtc

SEQ ID NO: 34079 - DNA, 103 bp, Homo sapiens
gcctcctaaagtgctgggattacaggtgtgagcgaggtttttttgtttgtttgttttttgtttttgtagatgaagtcttgctctgtcactcaggctggagtgc

SEQ ID NO: 34080 - DNA, 74 bp, Homo sapiens
gggagagactttgaaaactggcaaatgaagaatcttataagtctttaagatctgcctctgtctgtgtctttcct

SEQ ID NO: 34081 - DNA, 233 bp, Homo sapiens
atatatatatatatacatgtgtatatatatatatgtatatatatacatgtgtgtatatatatgtatatatacgtgtgtgtatatatgtatatatacgtgtgtgtatatgtgtatatatacgtgtgtgtatatgtgtatatatatacgtgtgtgtatatatgtatatatatacgtgtgtgtatatatgtatatatacatgtgtgtgtatatatgtatatatatacatatatatg

SEQ ID NO: 34082 - DNA, 94 bp, Homo sapiens
gcttgctacaaaggcttatggtagaaatgtgaaagatcactcacttggatttggtgcttttaatttttttacttataagtatttgacatttggc

SEQ ID NO: 34083 - DNA, 73 bp, Homo sapiens
gggagctcttatgcactgttgtggggaatgtaaattggtacggcctctatggaaaacggtatggagatttctc

SEQ ID NO: 34084 - DNA, 95 bp, Homo sapiens
gccacatgtgtggtcaaccatgtctgtgtgactgagtctcaataaaaactctgaacactgaggcttagatgagctcccctggttggcaacactgc

SEQ ID NO: 34085 - DNA, 99 bp, Homo sapiens
agggggctcccacaagcctctgacttgattgttttctatggtcttcggaataaaggagataagagattttgttgaatgtacagagaaataaagtcccct

SEQ ID NO: 34086 - DNA, 107 bp, Homo sapiens
accctccaactctagaaggggttgtggaaggtctgagaatttttttttttttttttttttttttgagacagtcttcctctgtcacccaggctggagtgcagtggcgt

SEQ ID NO: 34087 - DNA, 58 bp, Homo sapiens
ataggaaaatgtgagtcagtttctctctgaaggagagaaaaactgaaggttttcctgt

SEQ ID NO: 34088 - DNA, 80 bp, Homo sapiens
tgagtccaggacctagaaaatgttgagaatctgcatgaggaagtcctttgggggatgtctggatattgtttcttgactta

SEQ ID NO: 34089 - DNA, 65 bp, Homo sapiens
ggcagtgaatggagggcatggagttgaagaaagcttggcctccttgactctgtctctctcctgcc

SEQ ID NO: 34090 - DNA, 60 bp, Homo sapiens
tgtatctatatatctatatatgtatagacatatatccatacaaatagatatatagatata

SEQ ID NO: 34091 - DNA, 116 bp, Homo sapiens
ctttagtggcagaatctatcacttaatagttctgtaatctttaaaaaaattttattttaataggtttttgggagaacaggtagtgtttggttgcatgaataaattctttactgggg

SEQ ID NO: 34092 - DNA, 119 bp, Homo sapiens
aagtgagatagactcaaatgccaggtttagatgtcacagtttgtttataacttttttttcatttttttaaataataaaaaaaagtgtgtatcagatgtgggatttgaagtttataactt

SEQ ID NO: 34093 - DNA, 76 bp, Homo sapiens
ggaggctgaggtaattggatcacttgagcctgggaggtcaaggctgcagtgagtcgagattgcaccactgcactcc

SEQ ID NO: 34094 - DNA, 76 bp, Homo sapiens
ctccctccctcctgacggagtctcattctgtcaccttccttcctgacagagtctcattctgtcacccaggcctgag

SEQ ID NO: 34095 - DNA, 74 bp, Homo sapiens
ggtctttcctctgtaactgtctgtgtcttaatttcctcttgttataaggatactagttatattggattagggcc

SEQ ID NO: 34096 - DNA, 79 bp, Homo sapiens
aggctggaggtcagtggaatgatctctgctcactgcaacctctgcctcccgagttcaagtgattctcctgcctcagcct

SEQ ID NO: 34097 - DNA, 58 bp, Homo sapiens
tgagactgagtctggctctgtcacccaggctggagtgcagtggcgtgatcttggctca

SEQ ID NO: 34098 - DNA, 97 bp, Homo sapiens
acacacacacacacacacacacacacacatatatacacccacatatatatgtgtgtatatatatgtgtgtgtgtatatatatgtgtgtgtgtgtgtg

SEQ ID NO: 34099 - DNA, 125 bp, Homo sapiens
cacactaaccggagttagatgccagatgccagaattgttgtgacaggtgggtttttcttttcttttttttttagatggagttttgctcttgtctcccaggctggagtgcaatggcacgatgtcgg

SEQ ID NO: 34100 - DNA, 109 bp, Homo sapiens
acatttctaggctgggtgccatggctcatgcctgtcatctcagcactttggtaagccaaggtgggaggattgtttaaggccacgagtttaagaccagtcagggcaatgt

SEQ ID NO: 34101 - DNA, 109 bp, Homo sapiens
gatttctaagcttgggtgtgttaactcttaacatttatatatgcacttgtttatatttttatatgcatgtattttgctttaatcagatgttcacaaaagtctagaactc

SEQ ID NO: 34102 - DNA, 69 bp, Homo sapiens
ataggaggaagggagaagccagaataatttgtctgtctgtctgtatctggcagtgtctgtctctcttgt

SEQ ID NO: 34103 - DNA, 88 bp, Homo sapiens
cacccagcctcagagaaagacccaaatgccttgactaaaaacaattttttttttttgagagtcttgctctatctcccaggttggagtg

SEQ ID NO: 34104 - DNA, 116 bp, Homo sapiens
gattagatttttcttcttccatgtttgttgttgtcttagctgttgctgtttgtctagtgagtttgctgaactaattttatgcagtctatattctgtgaagagttgatactctgatt

SEQ ID NO: 34105 - DNA, 95 bp, Homo sapiens; identical to SEQ ID NO: 68

SEQ ID NO: 34106 - DNA, 93 bp, Homo sapiens; identical to SEQ ID NO: 69

SEQ ID NO: 34107 - DNA, 81 bp, Homo sapiens
tggctgtaggaaaggacttgaatggtttttaattatttaagtttaatctagccctccaagtcttcattcttatgtctgcta

SEQ ID NO: 34108 - DNA, 74 bp, Homo sapiens
tatcttcctgggtaactgagtgttttttttgtttttttgagacagagtctcactctgtcgcccaggctggggtg

SEQ ID NO: 34109 - DNA, 115 bp, Homo sapiens
gcttatggacttcactttttagagtagtaggagatcaaatgagagaagtgacagtggccagatcctttgccattgtaaggactttggatttcctttgagtgagggttttgagtct

SEQ ID NO: 34110 - DNA, 95 bp, Homo sapiens; identical to SEQ ID NO: 580

SEQ ID NO: 34111 - DNA, 93 bp, Homo sapiens; identical to SEQ ID NO: 69

SEQ ID NO: 34112 - DNA, 82 bp, Homo sapiens
ccagcctgggagacagagcaactccatctcaaaaaaaaaaaaaaattgtagagacaggttgtccctattttacccaggctgg

SEQ ID NO: 34113 - DNA, 77 bp, Homo sapiens
actcaagctgagcctcaattctttttttttttttttttttttgagacagagtctagctttgttgcccaggcttgagt

SEQ ID NO: 34114 - DNA, 84 bp, Homo sapiens
actcagagttaatattttaatattgaggttcttgatttttttaatgatcagctttcaaattatatttcagtatatactctgagt

SEQ ID NO: 34115 - DNA, 109 bp, Homo sapiens
gtgtgcgtttgtgtgcatgtgcacccatgtggaacggttgtgtgtctgtgtactgtgtacactgtgtgctcacacgtgtgtgtgtactcatgtgcccatatgtgcagct

SEQ ID NO: 34116 - DNA, 108 bp, Homo sapiens
agttatgagccaggaatcatagatggaaacctatacatatgtgtgtatttatatctattactacatcaaggaaaggtttcacacactggtatgaaactggaaataatt

SEQ ID NO: 34117 - DNA, 93 bp, Homo sapiens
tgcccattttccaatcagattatttgattatttactgtcgagttatttgagctccttagatattctgattattaatctcttgtcaaatgggta

SEQ ID NO: 34118 - DNA, 95 bp, Homo sapiens; identical to SEQ ID NO: 68

SEQ ID NO: 34119 - DNA, 93 bp, Homo sapiens; identical to SEQ ID NO: 69

SEQ ID NO: 34120 - DNA, 131 bp, Homo sapiens
tgtgagacggtatctgaatgtggttttgatttgcatttctctgatgattaggaatgtggagcattttttttatatgtttgttggccgcttgtatgtcttcttctgagaagtgtctgtttatgcctttttta

SEQ ID NO: 34121 - DNA, 136 bp, Homo sapiens
atatatatatatatatatatatatatatatgtgtgtgtgtgtgtgtgtgtgtatatgtgtgtatatatatgtgtatatatgtatacatatgtatatatgtgtatatatgtgtatatatgtatacatatgtatatat

SEQ ID NO: 34122 - DNA, 64 bp, Homo sapiens
tctgcagctgttggatgaaatgttttgtaaatatctcataggtccattttgtctacagtgcaga

SEQ ID NO: 34123 - DNA, 67 bp, Homo sapiens
tgttgtttttgagatggagtctcactctgtcacccaggctggagtggactgttttttatttatgata

SEQ ID NO: 34124 - DNA, 95 bp, Homo sapiens; identical to SEQ ID NO: 68

SEQ ID NO: 34125 - DNA, 93 bp, Homo sapiens; identical to SEQ ID NO: 69

SEQ ID NO: 34126 - DNA, 58 bp, Homo sapiens
tgagatggagtctcgctctgtcactcaggctggagtgcagtggcatgattccagctca

SEQ ID NO: 34127 - DNA, 64 bp, Homo sapiens
gtcttagtaagttgtatgtgtctagaaatatatctattttttctaggctacacagcttgttggc

SEQ ID NO: 34128 - DNA, 128 bp, Homo sapiens
atatacacatatatacacacaatctttatatacacatctatatatacatctatgtatatattatatatgtatatatagatgtgtacatatagatgtgtgtgtgtatatatatatagataggtgtatat

SEQ ID NO: 34129 - DNA, 112 bp, Homo sapiens
tatatatatatacacacacacatctatatgtacacatctatatatacatatataatatatacatagatgtatatatagatgtgtatataaagattgtgtgtatatatgtgta

SEQ ID NO: 34130 - DNA, 117 bp, Homo sapiens
tgcttaggattgtcttggctataccggctttttttttttttttggttccatatgaaatttaaagtagatttttctaattctgtgaataaagtcaatgctagcttgatagggatagca

SEQ ID NO: 34131 - DNA, 112 bp, Homo sapiens
ctgtctccccagagaaatcctgttccattgttttaaatatcatgtacaggcttaatatgtcttattattaattattattattattgagacaggatttcactctgtcacccag

SEQ ID NO: 34132 - DNA, 156 bp, Homo sapiens
tatatatacatgtgtgtgtatatatatacacgtgtatatatatacacgtgtatatatatgtgtatatatgtgtatatatatatgtatatatatgtgtatatatatatatgtatatatatgtgtgtgtatatatatatatatatatatttattatac

SEQ ID NO: 34133 - DNA, 127 bp, Homo sapiens
tatacacgtgtatatatatacacacacatgtatatatatacacacatgtgtatatatatacatgtatatatatacacgtatatatatacatgtgtatatatatatacacgtatatatatacatgtgt

SEQ ID NO: 34134 - DNA, 158 bp, Homo sapiens
catgtgagtatatgtatatatgcatatatacacatatacacgtatacgtatatatgcgtatatgtgtatatgtatatgtgtatatatgtatatgtgtatatatgcatatatacatatgtgtgtatgtatatatatcgtgtatatgtgtatatatgcac

SEQ ID NO: 34135 - DNA, 112 bp, Homo sapiens
agattgtagcaaagtcaaactgctcaattttttctttaatgttgacatattttttttttcaacacaaaaaaggggaagaggactcaacagtagtgaatactagttgcattct

SEQ ID NO: 34136 - DNA, 88 bp, Homo sapiens
gtaagtgcttgttcaggttgcactgatcatgctgatgaagggaagaatccactctcatttactcactgacatgcacaaacaagcctgc

SEQ ID NO: 34137 - DNA, 84 bp, Homo sapiens
ggggaagaagggttgtaggaatttttcaaaaaaggatgtttttgtatcattttttgaaacaagtcttttggagtctgatggccc

SEQ ID NO: 34138 - DNA, 114 bp, Homo sapiens
tgttgtatataataactagttgaaatatatatatatatatatatatatatatatatatatatatatactgcctatatatatatatttctctctggaatgattatttttatatca

SEQ ID NO: 34139 - DNA, 79 bp, Homo sapiens
ggccagatctcagcatgtagtttcatcccaactctacagaagtctggaaaatacagagagaacatggtgagtactggct

SEQ ID NO: 34140 - DNA, 98 bp, Homo sapiens
taggtatagaatcatgttgtcagtaaagagagataatttaatttttttttcctatttggttgccttttatttatttctcttgcctgatgttgtagcta

SEQ ID NO: 34141 - DNA, 83 bp, Homo sapiens
ggtgttctccttgtatgtgtgtctctgtgtctgaatttctactttatatgaagataccagacctactgcattgggagcttacc

SEQ ID NO: 34142 - DNA, 69 bp, Homo sapiens
tgtctgttgaatagagatgacactgaccagagagggaaacttacgtaggaggtgtgtctgggtcaggca

SEQ ID NO: 34143 - DNA, 136 bp, Homo sapiens
agtctttaattcattttgggtcaatatttatatatggtgtgagataagagtccaattttgttcttctgcatgtggatgtgcagtttttccaagatcatttattaaagactatcttttccccattgtgtgttcttga

SEQ ID NO: 34144 - DNA, 95 bp, Homo sapiens; identical to SEQ ID NO: 68

SEQ ID NO: 34145 - DNA, 93 bp, Homo sapiens; identical to SEQ ID NO: 69

SEQ ID NO: 34146 - DNA, 62 bp, Homo sapiens
ggagagagctctccctgtgtctctgtcccacaagggatcacacagtgagaaggcaactgtct

SEQ ID NO: 34147 - DNA, 93 bp, Homo sapiens
gcagtttaggaaagggcctaatttttctcctctgtgtaacactctgattcatgtgacaggggaagaaaggggtggtgtgggatgggtttctgt

SEQ ID NO: 34148 - DNA, 100 bp, Homo sapiens
catctggtgcttgctggcattccttgacttgtggttgtgcccatccagtctctgtctctgtggtcacattgcctcttctgggtgtgtcaaatctcctttg

SEQ ID NO: 34149 - DNA, 79 bp, Homo sapiens
tgagaagtacatgagttatcttgcggcaaagcagctagcacagtgcctggcaagctctcagtaaacactgtgctcttca

SEQ ID NO: 34150 - DNA, 93 bp, Homo sapiens; identical to SEQ ID NO: 69

SEQ ID NO: 34151 - DNA, 93 bp, Homo sapiens
tgttttgcttgtgacttatatttcttaattttttcagggtaagaatgtgctgaatatttaactttgaaacaatgtcagtgacattgtagaaca

SEQ ID NO: 34152 - DNA, 114 bp, Homo sapiens
ctgccttggcctcccaaagtgctggattacaggcgtgagccaccgtgcccagtcttttttttttttttttctgagacagggtcttgctctgtcacccagtcttgagtgcagtag

SEQ ID NO: 34153 - DNA, 128 bp, Homo sapiens
gctttttaaaaatagtgctggatgtgatggctcatgcctgtgatgccagcacatttggaggcagaggtaggaggatcgcttgaacccaggaggttgaggctgcaggtgaactatgattgtgccactgc

SEQ ID NO: 34154 - DNA, 58 bp, Homo sapiens; identical to SEQ ID NO: 1435

SEQ ID NO: 34155 - DNA, 75 bp, Homo sapiens
acagggaaaatgtgtatgtctatgtgtatacatgtatgtacatgtatatatatacatggatatacacatatatgt

SEQ ID NO: 34156 - DNA, 93 bp, Homo sapiens
gtcctgaggtacatgtgcaggatgtgcaggtttgtcatataggtaaatgtatgccatggtggttagctgcacaggtcaacctattacctagat

SEQ ID NO: 34157 - DNA, 77 bp, Homo sapiens
gttgttttgtttagagttggggtctcactctgtcactcaggctggagtgcagtggtatgatcctggctcactgcaac

SEQ ID NO: 34158 - DNA, 95 bp, Homo sapiens; identical to SEQ ID NO: 68

SEQ ID NO: 34159 - DNA, 93 bp, Homo sapiens; identical to SEQ ID NO: 69

SEQ ID NO: 34160 - DNA, 118 bp, Homo sapiens
aacaattgagattgtgaaagattctctctttcttgagagtaggaatttgaacacttcacatgaaaagagaatttgttcttaaggaagcatgagtatatttgtggtaagtaaatatgtt

SEQ ID NO: 34161 - DNA, 104 bp, Homo sapiens
tgtttaaaagtcatctaaagcttttattttaagacttgtctttatttttgtttgcaaagagaaagtatttaaattaaaatgttagattttaatgcttcaaaaca

SEQ ID NO: 34162 - DNA, 95 bp, Homo sapiens; identical to SEQ ID NO: 68

SEQ ID NO: 34163 - DNA, 93 bp, Homo sapiens; identical to SEQ ID NO: 69

SEQ ID NO: 34164 - DNA, 76 bp, Homo sapiens
ggactttcatccatatatatgaatgaatatatatgaatgaatccatatatatgaatgaatatatatgaatgaatcc

SEQ ID NO: 34165 - DNA, 98 bp, Homo sapiens
catatcagatgagcaataagcattacatctctcttattttttaattatttatttatttattttgagacagagtctcgctctgttgccagtctggagtg

SEQ ID NO: 34166 - DNA, 112 bp, Homo sapiens
gcactgaggaacatttgtggaatattcattgaatgaattttggatgcagtagaaccattttaaaacagttttatgttcctaaattcctacatgaatattttgcattaagagc

SEQ ID NO: 34167 - DNA, 78 bp, Homo sapiens
tatatctgtatctgtatatatgtatatgtatgtttatatgtatatgtatgtatatgtatttgtatatgtatgtatatg

SEQ ID NO: 34168 - DNA, 112 bp, Homo sapiens
gtatgtgtatatatgtatacgtatgtatatgtgtatgtatacgtatgtatatgtgtatgtatatgtatacatatgtatacgtatacatatgcatatgtatacgtatacatac

SEQ ID NO: 34169 - DNA, 69 bp, Homo sapiens
gttgtgcccatttgtggccagctcttctggaatgtgacaggagaaactgagctcatgctgtagcgcaac

SEQ ID NO: 34170 - DNA, 120 bp, Homo sapiens
agaacttcatagctgtttaatgtcaattttattcatcgccatatatatatatatatatatatatatatatatatatatatatatatacacatagatatattgagatggagtctggctctg

SEQ ID NO: 34171 - DNA, 113 bp, Homo sapiens
taatgtacttcatattctcagatgtgaaccttccaatattatttttatttatatctatttttagagggtgaccttggaaggctggaaattttttagaaacttgagttgcatta

SEQ ID NO: 34172 - DNA, 88 bp, Homo sapiens
gtgttcttatttccctagttccttgaagtgtgatggttaggttgtcaatttgtgatctttcatactttttgatataggcatttagcac

SEQ ID NO: 34173 - DNA, 86 bp, Homo sapiens
aattgctctagagaggagagtgaggactgctggtaggaagctgcagagaggcaagtttcagttcattctactctagcaattagagc

SEQ ID NO: 34174 - DNA, 112 bp, Homo sapiens
cctttactaggtcttttcctggagagtttgacaccttttaggatcagatgagagacattcaccatctcttcactctaggtagcagtcttcttctacaggacaagaatgttgg

SEQ ID NO: 34175 - DNA, 66 bp, Homo sapiens
atgtgtatgtgtatatatgtataactatgtataatatgtatattatacatacatacacatacatat

SEQ ID NO: 34176 - DNA, 86 bp, Homo sapiens
tagactttggtagcaggcagtgatccttcagaactctctttctttttttttttgagatggagttttgctcttgtcacccaggctgc

SEQ ID NO: 34177 - DNA, 113 bp, Homo sapiens
tctgtgggatgccatcagggcagctgagctgcaagatgtgtctctgtctctctgggcacagagggctgcacattctgcttgactgttgtccccagcacaggcagagccccagg

SEQ ID NO: 34178 - DNA, 84 bp, Homo sapiens
gtgctcggtttgtaggcagtgtcattagctgattgtactgtggtggttacaatcactaactccactgccatcaaaacaaggcac

SEQ ID NO: 34179 - DNA, 115 bp, Homo sapiens
ttgagactgcaattttttctatgagtctagttactaggcagtgtagttagctgattgctaatagtaccaatcactaaccacacggccaggtaaaaagatttgggaattcgtccaa

SEQ ID NO: 34180 - DNA, 72 bp, Homo sapiens
atgctaactcatttttagagtaaagattgaatgaagaaaccattctgtcactctgtgtgtgtgtgtgtgcat

SEQ ID NO: 34181 - DNA, 98 bp, Homo sapiens
tccctctttgctctattttcttctgcagcatgggagagttaatactagagagaagagtcagagtgctgaggcaggaaaaaagaaacaaatatgagggg

SEQ ID NO: 34182 - DNA, 103 bp, Homo sapiens
tgagcagctgggactacagatgcatgtcaccacatctggctaattattaatattttattttttgtagagatgaggtctcactctgttgttcaggctgggctca

SEQ ID NO: 34183 - DNA, 82 bp, Homo sapiens
gcccttgttatagagttagattcttttttattttattttattttttattttttgagacggagtctcgctctgtcacccaggc

SEQ ID NO: 34184 - DNA, 66 bp, Homo sapiens
tttttgagtcagagtctcgctctgtctcccagcctggagtgcagtggcgtgatcttggctcacaga

SEQ ID NO: 34185 - DNA, 72 bp, Homo sapiens
ccaggcgtggtggtgtgcacctgttgtcccagctacttaggaggctgaggtagtaggatcacttgagcctgg

SEQ ID NO: 34186 - DNA, 115 bp, Homo sapiens
cctcattttcagctttacattcacaccataaaaacattttgtaaaagtgaatcaagtcttgccatctgtctctctcacttttatcatgtttataatgaaaagaagagtcaagagg

SEQ ID NO: 34187 - DNA, 58 bp, Homo sapiens
tgagctagagtctcactctgtcacctaggctggaatgcagtggtgtgatcttggctca

SEQ ID NO: 34188 - DNA, 118 bp, Homo sapiens
caggggataaaggtaaaaaagaagacatttaattctttaaataaagtctctgcaatgtaaagtagtctgttggtgagtggtgagagttggaattttctgtggacctttaatagctctg

SEQ ID NO: 34189 - DNA, 58 bp, Homo sapiens
tatacacacatatacatatatatgtatggttatatatgtatgtatatatgtgtgtgta

SEQ ID NO: 34190 - DNA, 71 bp, Homo sapiens
tatatatgtatatgtatgtatgtatgtgtatattatgtatgtatatgtatgtatgtatatgtatgtgtata

SEQ ID NO: 34191 - DNA, 57 bp, Homo sapiens
gtgtctcactctgtctgtcacccagctgcccagactggagtgcagtggtgtgatcac

SEQ ID NO: 34192 - DNA, 78 bp, Homo sapiens
acatatatatatatatctccagacttaaacatatatatatgtgtgtgtatatatatatatgtgtgtgtatatatgtgt

SEQ ID NO: 34193 - DNA, 108 bp, Homo sapiens
ttctgtccccagtgagcaaaagagacttctgcttgttttaagagttttaatttttttacttagaattctgaagtcatgttttaagtgtcatttttctttgtatcagag

SEQ ID NO: 34194 - DNA, 91 bp, Homo sapiens
gcccaggtggcccagagttctagtcttcttcttcttattattattattatatatatatttttgagacagagtctcgctctgtcacccaggc

SEQ ID NO: 34195 - DNA, 58 bp, Homo sapiens; identical to SEQ ID NO: 2224

SEQ ID NO: 34196 - DNA, 56 bp, Homo sapiens; identical to SEQ ID NO: 335

SEQ ID NO: 34197 - DNA, 79 bp, Homo sapiens
tgagatggagtctcactctgtcacccaggttggagtgcagtggtgcgaactcggctcactgcaatgtctgcttcctggg

SEQ ID NO: 34198 - DNA, 91 bp, Homo sapiens
tttgagaggttactgtcagtgtctgtttcatatatatacatatacatgtatatatgtatctatatccaggcttggccagggttccctcaga

SEQ ID NO: 34199 - DNA, 103 bp, Homo sapiens
aatatacatatatatattgtctccagactttgtggtcacttgaattttatttctttaagattcacctactcgaagtcacataagcattttaaccatgtatatt

SEQ ID NO: 34200 - DNA, 69 bp, Homo sapiens
tgtgtctgtgagcagaacacagggagctgtgaagagggcttctgtgcactgcttatgaagccagataca

SEQ ID NO: 34201 - DNA, 118 bp, Homo sapiens
atggtaatgagagaaaattagaagcactgctccattgtcctagacagaacagacagaggtatttaagggccctttgtaatggattggtccaggaaggagagaaatgattctttatcat

SEQ ID NO: 34202 - DNA, 76 bp, Homo sapiens
cagagtcagtggtgttcattaaatgttaacaaaaaggggagcctatctgtgttcagagtgagcactgtctctggct

SEQ ID NO: 34203 - DNA, 117 bp, Homo sapiens
gggatgatggagagctgacccttttcttacctcggtgtgcaccgtctgtctctgtgggtgtcctcaaagctcccaggaccgtgccatgctagtagcagcttcagtccctctgggccc

SEQ ID NO: 34204 - DNA, 111 bp, Homo sapiens
tgtaaagatcaaatgaatggatgcctgtggaagtactttatagactgtaaagaggaatgtagattattatctacaggtaataataattgtctaactatttgcagattaaca

SEQ ID NO: 34205 - DNA, 95 bp, Homo sapiens; identical to SEQ ID NO: 68

SEQ ID NO: 34206 - DNA, 93 bp, Homo sapiens; identical to SEQ ID NO: 69

SEQ ID NO: 34207 - DNA, 67 bp, Homo sapiens
gagacttggagaccaagagagatgctgtatgtttattaccccagttatctctctctctgtaactttc

SEQ ID NO: 34208 - DNA, 115 bp, Homo sapiens
gaagctgattgcatttttggcttttcaagagattataataaacagctgttaggacaaaaatatttttttttaagtggcaaagaatctcttgggtttctagaacctgctgtgcttt

SEQ ID NO: 34209 - DNA, 67 bp, Homo sapiens
gcctttatttccactactgtgggctgtcactcactaagtgtcttctaaaggtggttttgaaatgggc

SEQ ID NO: 34210 - DNA, 77 bp, Homo sapiens
tgcctgcctctccatctgtccgtctgtctctctttcactgggtgggccaagggatgtgcagaatttaggagcagcca

SEQ ID NO: 34211 - DNA, 78 bp, Homo sapiens
ctcacaattgtatggtttaggaatttgggaagaaattggctgggccattcatctctgaatctcacagtgtcatgtggg

SEQ ID NO: 34212 - DNA, 115 bp, Homo sapiens
atttgtctaagtagaaatgatcttgtgggtaagtctaagagtttgagcatctccatgtgcattctcttccccaataattaaggaaaaactctgggatgaattctctgtaataggt

SEQ ID NO: 34213 - DNA, 62 bp, Homo sapiens
ggtgagtagaatgtggggcatcttttttttttttttttgagacagagtctcactctttcacc

SEQ ID NO: 34214 - DNA, 82 bp, Homo sapiens
actcgaggaccagtgttgtttttcatatagaatataggtatgttctgtgtgtgtgtgagtgcgtgtatgtgtgtgagtgagt

SEQ ID NO: 34215 - DNA, 118 bp, Homo sapiens
cattgttagcttcaagagggcaataagttatctcttctctttatttatttatttatttatttatttatttatttattgagacaaagtctcactctgtcgcctaggctgcagtgcagtg

SEQ ID NO: 34216 - DNA, 59 bp, Homo sapiens
cacacacatgcatataagtgtgtgtgtatatatacattatatatatgtgtatgtgtgtg

SEQ ID NO: 34217 - DNA, 94 bp, Homo sapiens
aatttccctcagcactgctttgactgtatctctctaattttttttatttttatttttcagagatagggtcttgctatgttgcccaggctagatt

SEQ ID NO: 34218 - DNA, 89 bp, Homo sapiens
ttgtttcatcattatgacctcagaactgaccacattgcctggtacacagtcagtgcttgttcattgtgattggtcaaatggataaacga

SEQ ID NO: 34219 - DNA, 83 bp, Homo sapiens
cctcttagacaaaactagcgggactcactctctgaaactgggagccccatcattaagtttgcccagctggccagtctgtaagg

SEQ ID NO: 34220 - DNA, 73 bp, Homo sapiens
gacaatgaggagacagatgagtgagggcaggtggcacgcacaagctcccggtttttaatctgtccaccatgtc

SEQ ID NO: 34221 - DNA, 81 bp, Homo sapiens
acctctctctttctttttttcttttgttccttctttccagaggaggaaacaagcctagaaacttgaagagcagactgaagt

SEQ ID NO: 34222 - DNA, 114 bp, Homo sapiens
tatttattctgcacttaaaaggtgccaggcagtgtaatagttgctgaataagaatgttttttatttcaaggtgtgaatctcgtgcctggtaatagtgtgccacagcaataaata

SEQ ID NO: 34223 - DNA, 93 bp, Homo sapiens
ggccctcttgagtgaccactgtggcatggagtaggctgagccctcagccttctgtgagttcatgctgagagatgagaagtcaagactaaggcc

SEQ ID NO: 34224 - DNA, 88 bp, Homo sapiens
actaaggaaactctatccctagagagaatgatagcaataatcattattgctaataataatttttttttgagatggagtctcactctgt

SEQ ID NO: 34225 - DNA, 86 bp, Homo sapiens
tgtaaactttctcccaggaggagggacttgggaacttgtgtctaacttcgttctccctgtctggctctctgtatttatgtttctca

SEQ ID NO: 34226 - DNA, 96 bp, Homo sapiens
ctcagaacttctaaacctaggaatgaccttgcctcttttttcttactggcgaaaaggtaggatgaggtggaaggttctatttgaagaagtcaagag

SEQ ID NO: 34227 - DNA, 77 bp, Homo sapiens
ttttattgggtattctgtctctatctcactctcttgtcctggggagtgagcttggaaccaaatttcccccagttgaa

SEQ ID NO: 34228 - DNA, 102 bp, Homo sapiens
cccctatcagtcagtcatggctatgggtgagggaggggacggtgcctgtaacttactgtgtctatcactctcacctacctgcctctactctgctgtacttgg

SEQ ID NO: 34229 - DNA, 66 bp, Homo sapiens; identical to SEQ ID NO: 474

SEQ ID NO: 34230 - DNA, 108 bp, Homo sapiens
ttatatttattatattgttaaaattgtatttttatatacatttataaaatgtataaaattgtatttttatgtatgtttataaaatgtacataacattgatacaggtaa

SEQ ID NO: 34231 - DNA, 86 bp, Homo sapiens
ttttgccgggtgtggtggtgtgcaaccgtagtcccaactacttgggaggctgaggttggaggatcacttgaacttgggaggcagag

SEQ ID NO: 34232 - DNA, 96 bp, Homo sapiens
aggttccatttgcttgctagtcactactctctctgacacctaaatgcctgacatctaaatgtcagagtgccctggggctcaacctttggatctcct

SEQ ID NO: 34233 - DNA, 58 bp, Homo sapiens; identical to SEQ ID NO: 1555

SEQ ID NO: 34234 - DNA, 112 bp, Homo sapiens
ggattgtcttggctatacagctcttgtttggttccatatgaaatttaaagtagtttttttctaattctgtgaagaaagtcaatggttgcttgatggggatagcattgaatct

SEQ ID NO: 34235 - DNA, 75 bp, Homo sapiens
ttctgtctccctgtgaccctggcatctttctcacctttaaggaaggccacaggcctggtccaagaatgagtagaa

SEQ ID NO: 34236 - DNA, 109 bp, Homo sapiens
atatggtttgagttcatatttttatacatgtgctttatatatctttttaatggacaaataaaaagttatatatagttatggtataaacatggtatttcaatatacgtat

SEQ ID NO: 34237 - DNA, 66 bp, Homo sapiens
tcgcatctccaagctccaagtggctgccattcggaggtgagtggctgctcagagcctgagaagaga

SEQ ID NO: 34238 - DNA, 180 bp, Homo sapiens
tgtgagattttatatatatgtatattatatatgtaacaaatgtatatgtatatatgtatattttatatatgtatattatatgtatattttttatatatgtgtattatatatgtatattatacatatgtatactttatatatatgtatattatgtatatgtatactttatatatatgtata

SEQ ID NO: 34239 - DNA, 95 bp, Homo sapiens; identical to SEQ ID NO: 68

SEQ ID NO: 34240 - DNA, 93 bp, Homo sapiens; identical to SEQ ID NO: 69

SEQ ID NO: 34241 - DNA, 116 bp, Homo sapiens
aaatgcatggggatgcattgaaagccacaagactagatggaatctcccacgctatgtgcatgtaggtagaaaagagaagaactccaaagactgagctctaatgcactccaacattt

SEQ ID NO: 34242 - DNA, 84 bp, Homo sapiens
agctttgaggacaccgcaggctgggtttcaaggaaggaagagcactcctggcctgactctctggctctctgtggttctgtggtt

SEQ ID NO: 34243 - DNA, 117 bp, Homo sapiens
ctggggctggaagggtaagaggggtcacacggggacaggggtaccgcagggacagtcatttcctcactctctcactgacttcatgtatttctcagagcttcccttttctgcccccag

SEQ ID NO: 34244 - DNA, 73 bp, Homo sapiens
gctggtgacagagctggatgaaatctggggacatttctttctgaccctctgtgactccatccgctgcaccggc

SEQ ID NO: 34245 - DNA, 100 bp, Homo sapiens
ggggctgggcagacggagctggggaccttatggaggtgagtccatatgtatttcaatatttgattaactcgcacagtcctactcctgcaatatcagccct

SEQ ID NO: 34246 - DNA, 71 bp, Homo sapiens
ccacatggtctgagaaatgcatgagtgatttaacgcacggatggtgtagtcattatgttcttgatgtgtgg

SEQ ID NO: 34247 - DNA, 68 bp, Homo sapiens
tgtgctcaatgcaactaggtccaggggcttgagtgcaaatctgtttctgcaactgcatttgggacaca

SEQ ID NO: 34248 - DNA, 112 bp, Homo sapiens
tgttatggggtgtgtactgttatctcttttttactgttttatttttaatttctgttgaggaaggtgagacttagagaaattgaataagccaaagtcacacaccaaatgaaca

SEQ ID NO: 34249 - DNA, 93 bp, Homo sapiens
cttttttggagcgttgacaactttaaaagaaatggcatgtttctttaaccttaagaacattttatttaaatttagtcactggtttggagaaag

SEQ ID NO: 34250 - DNA, 96 bp, Homo sapiens
gtttgataatttctatttatgtaattctagcaaattaagcttctacaagatgtagagaagtgtttttgttcaagaaaaacggaaatgggtacagac

SEQ ID NO: 34251 - DNA, 105 bp, Homo sapiens
ccaggcttctgaaggctcagatttagatttctacagttttttatttgtcttttcaaggattaatattagcagtagaactggttctgtataactaaggaaaaaagg

SEQ ID NO: 34252 - DNA, 86 bp, Homo sapiens
ccaggcagagctgcagtcaccccatggggctcactctacagcctgggtgagctgagggtgctcactctggactggatgggagctga

SEQ ID NO: 34253 - DNA, 64 bp, Homo sapiens
gggctaaatagcagcatttgaaatgacttctgccttgagattcaatctgctgctgtctgagtct

SEQ ID NO: 34254 - DNA, 115 bp, Homo sapiens
gtcaagttttattggctctcttatttgacatgatattaaacttttcaggctctatctcgactgaggtacaaggttgttaaaatgtggacagattggagcgctacaaaaatgtggc

SEQ ID NO: 34255 - DNA, 80 bp, Homo sapiens
ctgctgagtctgtctgtgactcagtgcagttcagccttaggcaatgctgcctaggtcccctcaggagccaggctcagtgg

SEQ ID NO: 34256 - DNA, 68 bp, Homo sapiens
atacatatatatgtgtatatatatatgtacgtatatatgtatgtatatatgtatacatatatgtgtat

SEQ ID NO: 34257 - DNA, 155 bp, Homo sapiens
ctgtccattgagtgtccagagtatacagtgagtgtccagtgagtgtagagtgtccagtgagtgtagagagtgtccagtgagtgtccagggagtgtccagtgagtgtacagtgtccagggagtgtccagtgactgtacagtgagtgtacagtgtcc

SEQ ID NO: 34258 - DNA, 78 bp, Homo sapiens
cttcctgtctatcttttctgagagaagagtgtgaaataaatacacgctttaaaattcagcatgagggaatcaggttag

SEQ ID NO: 34259 - DNA, 95 bp, Homo sapiens; identical to SEQ ID NO: 68

SEQ ID NO: 34260 - DNA, 93 bp, Homo sapiens; identical to SEQ ID NO: 69

SEQ ID NO: 34261 - DNA, 73 bp, Homo sapiens
ggtgcagactggcactctcacccacttggtcccagaaggcagatcagacagcgtgacttgtgcctggatgccc

SEQ ID NO: 34262 - DNA, 89 bp, Homo sapiens
tttactatgctaatatttattagtatctatattatagtatcatatatcatactatagtatagtatgtacatgatagtatagatagtaaa

SEQ ID NO: 34263 - DNA, 127 bp, Homo sapiens
catgggtttgagtgtgcatgtttatgaggtgtgcacatgtgtttgtgtgtgcttgaggactgtctgtttgtgtctatgtagatgtgtctgagatgatcacacacgtgtgtgtctgagaggtgcatgt

SEQ ID NO: 34264 - DNA, 111 bp, Homo sapiens
cagaaggttaatggagattatctctgggttgtacttgggaaataggtggtttgtttttttttttttaagtgtttactcttggtttccaagttttctgcaattagaatgatt

SEQ ID NO: 34265 - DNA, 82 bp, Homo sapiens
gcgcacatgtgtgtgcatgtgtgtacacatgcatgtctgtgtctgtatgtgtgtgtgcatgaatgtgcatatgcatgtctgt

SEQ ID NO: 34266 - DNA, 116 bp, Homo sapiens
ggtccacttcaaagacatcattggtatagctttaatgacttcctggatttttttttttttttagacaaagtctcacgctgtcacccaggctggagttcagtggcacgatcttgact

SEQ ID NO: 34267 - DNA, 98 bp, Homo sapiens
tatatatatatatacacacacgcatattttgtatctgtgtgtatatgtagattttttatatatatatatttatgtgtgtgtatgtatgtatatgtgta

SEQ ID NO: 34268 - DNA, 99 bp, Homo sapiens
atacacacagatacaaaatatgcgtgtgtgtatatatatatataatctccaagaatgtatatgtgtatatatacacaaaatatacatatgtgtgtgtgt

SEQ ID NO: 34269 - DNA, 111 bp, Homo sapiens
ggcgacagagggagactcgtctcaaaaaataaataaatatatagaaaatcctaccggcacttttttgtttttttgttttttttttttgtgatggtgtctcactctgtcacc

SEQ ID NO: 34270 - DNA, 68 bp, Homo sapiens
gggtgatgaatatgtttattacttaattatgatgataatttcataggtatatagatatgtcaaaaccc

SEQ ID NO: 34271 - DNA, 58 bp, Homo sapiens
tgagacatagtctcactctgtcacccaggctggggtgcaatggtgtgatcttggctca

SEQ ID NO: 34272 - DNA, 92 bp, Homo sapiens
ggatttcttcttgaggacctcagaaccgtgtcttttgttttatttttatttttttgagacagggtctcggtctgtctcccaggctggagtgc

SEQ ID NO: 34273 - DNA, 77 bp, Homo sapiens
ggaacaaccttgtggtacaggaacttaaggggtcagtacagatctgattatgatgttctgtatgggatggatgagcc

SEQ ID NO: 34274 - DNA, 108 bp, Homo sapiens
tctggttcctacttgattgtgagctccttagggccagaactgcgtcttatttatttttatattttagaacctagcactgtgcctggaatgtagagtaggttcactgga

SEQ ID NO: 34275 - DNA, 108 bp, Homo sapiens
gtctgaggataatcctctatgttgttatctgggcctgcagtgacagctcctgcctctgtgcctgcctctctggcctctaactccacatctgtgagtctgtcctcagtc

SEQ ID NO: 34276 - DNA, 115 bp, Homo sapiens
ggtgggccgacggcattctccctgacacctgggggtgtctctcagcctcagcctctgcctgcgcaggcttgcctggccacacagaaggtgggtggggttccagtctgcctttggc

SEQ ID NO: 34277 - DNA, 125 bp, Homo sapiens
gagtgacttctgaaaccaggccataaaagacagtgctccttttcttcttgggctctgtctgtctctctcagatcactcattctagggaaaagccatgccctggagacactcaagcagtcctatgg

SEQ ID NO: 34278 - DNA, 122 bp, Homo sapiens
gacagtttgagtattgcgagcaggcccgatggggaggctgtgaactgggactgggtgctgctctgtcactcgctgtctgattagtcttgggtaagtcactttttctctctggtccttagttt

SEQ ID NO: 34279 - DNA, 89 bp, Homo sapiens
gtgtgtatatatatacacacacacatgtatattttatattcttgcatacatatatgtatatatatgtgtgtgtgtatatatacacatat

SEQ ID NO: 34280 - DNA, 118 bp, Homo sapiens
gggctcttgccactcacctgcatggccacgacgttcgtttctaagtactctgaatatatttgtatataacttaggattagtatctgttggttgtcatcaatcttggtaagaaatgcct

SEQ ID NO: 34281 - DNA, 109 bp, Homo sapiens
aaacaatatagttttgcttgttttgaatgatacatgaatagaatcatattgattatattattttttgtctgtttcatccaacagtctgtgagatttatccatgttgttt

SEQ ID NO: 34282 - DNA, 58 bp, Homo sapiens; identical to SEQ ID NO: 1391

SEQ ID NO: 34283 - DNA, 56 bp, Homo sapiens; identical to SEQ ID NO: 1392

SEQ ID NO: 34284 - DNA, 78 bp, Homo sapiens
ggaattggcacagtgagaaccttatcttgataactctctttctttcttttttatagtcagggtctcactctgtcaccc

SEQ ID NO: 34285 - DNA, 117 bp, Homo sapiens
ttgggggccagtcatcatggggtctgtttgtcacacagaatatgacttttatttttatttttaattttttttgagggtacatagtaggtgtatatatttcataatatgacttctgaa

SEQ ID NO: 34286 - DNA, 76 bp, Homo sapiens
ggaggcttaactgggaaagtagttacttacgagatcgttcaggtagttggtagaattgctttatgagtgaggatcc

SEQ ID NO: 34287 - DNA, 75 bp, Homo sapiens
agcctaggcgacagagcaagactccgtctcaaaaaaaaaaaaaaaaagacagggtctcactctgtcacccaggct

SEQ ID NO: 34288 - DNA, 76 bp, Homo sapiens
tttatatgctcacaggcagatgaaagtgtccactctgccctgagaccctctcctttctgcttagtggtgttatgaa

SEQ ID NO: 34289 - DNA, 84 bp, Homo sapiens
aatgtatgaactctaaacttcacaggtagaaaatcatccagtttaaactttttttatatgaggaaactagagttcaaatgcgtt

SEQ ID NO: 34290 - DNA, 113 bp, Homo sapiens
cttcactagttggatgattgggaacaaagagtagatagattttgtatgcattttttttccttttttaaaatattggggcagggtcttactctgtcacccaggctagagtgcag

SEQ ID NO: 34291 - DNA, 58 bp, Homo sapiens; identical to SEQ ID NO: 7309

SEQ ID NO: 34292 - DNA, 81 bp, Homo sapiens
ggaagatgaggggcagaacttcactgtgaacaaaagttgtctttctttttttgagacaaggtctcactctgtcacccagcc

SEQ ID NO: 34293 - DNA, 86 bp, Homo sapiens
gagtcttgctctgtcgcccaggctggagtgcagtggtgcgatcttggctcactgcagtctcagtctcctgggttcaagcgattctc

SEQ ID NO: 34294 - DNA, 75 bp, Homo sapiens
gttttttttttgagaccgagtttcactctgtcactcagactggagtgcagtggtgtgaacttggcttattgaagc

SEQ ID NO: 34295 - DNA, 58 bp, Homo sapiens; identical to SEQ ID NO: 2224

SEQ ID NO: 34296 - DNA, 56 bp, Homo sapiens; identical to SEQ ID NO: 335

SEQ ID NO: 34297 - DNA, 77 bp, Homo sapiens
tgatggagtctcactctgtctcccaggctggagtgcagtggtgtgatctcggctcactgcaaactctgtctcctggg

SEQ ID NO: 34298 - DNA, 84 bp, Homo sapiens
ctcatcaagtgagttaaggaactcagagttgtgactggcacactgtcagtgtcccacgaatgttaacttacgttatgtaatgag

SEQ ID NO: 34299 - DNA, 66 bp, Homo sapiens
gctgtcactctcagtgaccgtgacaccatgctgggagcccacggtgcgccagtcggaggtgagggt

SEQ ID NO: 34300 - DNA, 64 bp, Homo sapiens
ggggccttgtgagtatagtgtgtggacacccaatccatgtgcccaggctccacttacatgctct

SEQ ID NO: 34301 - DNA, 102 bp, Homo sapiens
tcctcatttatggggagattaagattttgggattaaagtggaaaggtagagattttgttgtttccattctacttgcttattttgatctcgtacccaaaagga

SEQ ID NO: 34302 - DNA, 58 bp, Homo sapiens; identical to SEQ ID NO: 1101

SEQ ID NO: 34303 - DNA, 56 bp, Homo sapiens; identical to SEQ ID NO: 1102

SEQ ID NO: 34304 - DNA, 83 bp, Homo sapiens
gatagggagtctcactctgtctcccagctgaaatgcagtcatgcgatctcggctcactgctggattcaagcgattctcctgtc

SEQ ID NO: 34305 - DNA, 70 bp, Homo sapiens
cttttaaatatttatagttacttttcctttcctggaaaggtgggaggaaaggggctacagggaagaaaag

SEQ ID NO: 34306 - DNA, 92 bp, Homo sapiens
ccgttctgcttcctggagtgttcttccactaggtacccatgtggcacactcactcactaccttcaggactctcaggaatgtcaccttttcgg

SEQ ID NO: 34307 - DNA, 107 bp, Homo sapiens
cagcctctaataaccacagtttcactctctacttctgtgagctcaactttttttttttttttttagctcccccatatgagtgagagcatgtggtatttatctttctg

SEQ ID NO: 34308 - DNA, 65 bp, Homo sapiens
ctccactctctctggctctcatggagtcctccatgatcatgctagttggatttctgcacttggag

SEQ ID NO: 34309 - DNA, 89 bp, Homo sapiens
ccttgctctgagcactcagctctccctcctctctgccactcagtggctctgtggcctcgggagcgttacttggcttctcagagtcttgg

SEQ ID NO: 34310 - DNA, 76 bp, Homo sapiens
ggaggctgaggtaggaggatggcttgagcccaggaggttgaggttgtagtgagccgtgattgtgccactgcactcc

SEQ ID NO: 34311 - DNA, 58 bp, Homo sapiens; identical to SEQ ID NO: 285

SEQ ID NO: 34312 - DNA, 58 bp, Homo sapiens; identical to SEQ ID NO: 2758

SEQ ID NO: 34313 - DNA, 67 bp, Homo sapiens
gcggaatctggtctcctaagtgccactcggaaccagagtgagctctcagggacctcacctagtttgc

SEQ ID NO: 34314 - DNA, 101 bp, Homo sapiens
gggaggatagagtggagcgtttattttaccagctatcaagatttatttatatatttatttatttagtcagttagttatgatggagtctcgctctctcaccc

SEQ ID NO: 34315 - DNA, 95 bp, Homo sapiens
atgatctgggagaggaactgggtggtggtaggaaagagcttttgtttttcattttatatcttcctgcatagtttatttttttttgccaggtacat

SEQ ID NO: 34316 - DNA, 76 bp, Homo sapiens
ggaggctgaggtaggaggatggctcggacccgggaagtagaggttgcagtgagccaagatcttgccactgcactcc

SEQ ID NO: 34317 - DNA, 82 bp, Homo sapiens
ggagagggaggcagggcagaagtggcgggggtgggggacagtcctttcaaacactgcagctctgtttttctctctgtgtccc

SEQ ID NO: 34318 - DNA, 104 bp, Homo sapiens
tgcatttttttgtatgtgagcctttgtgtcagtggctcctccatgtgactctgtggctgtgtgcgtgctgagtgcacacatgaagtggtgtaaatagaaatgcc

SEQ ID NO: 34319 - DNA, 85 bp, Homo sapiens
tgtttggtaccatctcttcttgtgctgggtcttctggtagggcactgggctttgtcagtagagtctgaggactatgttctttaca

SEQ ID NO: 34320 - DNA, 78 bp, Homo sapiens
gccttctgttcaattacgacatggggagaagcccagaacctggaatgctgatttcatattttgtagttgatgaggagc

SEQ ID NO: 34321 - DNA, 102 bp, Homo sapiens
aagtctttgaaaatgacactaatctctaccattctctctaggatgcaatattattttttatttactgtcttggcagggagtcatggaaagttacaagggctt

SEQ ID NO: 34322 - DNA, 103 bp, Homo sapiens
tgtgtatgtgtgtgtgtaagggtgggttggggtgagcaaagtttggggctatttcccaatgagtattttaatatttcaataacttttatataatatttatata

SEQ ID NO: 34323 - DNA, 79 bp, Homo sapiens
aggaagacagggttgaaagcattatttgttttttttgaacaaattgcaatttttcttttttcagtccaggtgttctcct

SEQ ID NO: 34324 - DNA, 109 bp, Homo sapiens
cagtattatgattcctttctgttgtattaaacttttggtcaaatcagaatttcttattctgagtttatttcaaaagtcagagtcaagtgagacgatttgataatttttg

SEQ ID NO: 34325 - DNA, 71 bp, Homo sapiens
agcctgggcaacatagtgagtctttacagaaaattttaaaatttgccagtgctcactctgtcactcaggct

SEQ ID NO: 34326 - DNA, 88 bp, Homo sapiens
gcttagctctgaggtaaagtgatccatgcggttcttcttcttttttttgttttgagatggactctcgctctgtcacccaggcttgagt

SEQ ID NO: 34327 - DNA, 112 bp, Homo sapiens
gtgaggacaatgggcgggcaatggtatgtggactctttttttgtttttgtttttcttttattattatactttaagttttagggtacatgtgcacattgtgcaggttagttac

SEQ ID NO: 34328 - DNA, 63 bp, Homo sapiens
gcaagttctggcagagctagaattggaacccaggtcccctgtctgactctttctgagacttgt

SEQ ID NO: 34329 - DNA, 130 bp, Homo sapiens
attctgtctggggaggactaagggagacccacaatagtgtgtcatttgtaatgagtctttttttttttttttttgagactgagtctcactctgtcgctaggctggagtgcagtggcgtgatctcagctca

SEQ ID NO: 34330 - DNA, 75 bp, Homo sapiens
gcccattatgcagactggctttgttctgggggaacacctcattatattgcgcaggctggtctcaaactcctgggc

SEQ ID NO: 34331 - DNA, 86 bp, Homo sapiens
catgggggtctcacagtgaacaccaatctctacaaaaaaaatttttttttaattagtagggtatggtggcttgtgcctgtggtccc

SEQ ID NO: 34332 - DNA, 85 bp, Homo sapiens
ttccacttgttcattgctgatagtttcttagtttttataagtgtaatgtggtaatgcaagatataagcagtgggggaaagtggag

SEQ ID NO: 34333 - DNA, 62 bp, Homo sapiens
tgagatggactctcactcactctgttgcccaggctagagtgcaatggtgtgatctcgactca

SEQ ID NO: 34334 - DNA, 81 bp, Homo sapiens
agtgttgggattacaggtgtgagccaccgtgctagacctcaatcttttttagtatatttacaagcctgtggaaccatcact

SEQ ID NO: 34335 - DNA, 114 bp, Homo sapiens
cctgattgtgacagagtgaagcatgaaaaaaaattgtaaaaaaaggaaaatgtatagttttgctttctttctttttttttttttttttgagacaagttttgctctgtcaccagg

SEQ ID NO: 34336 - DNA, 108 bp, Homo sapiens
gcctggcatggtacacacttatagtcccagctgctcaggaggctgaggtggaaggatcacttgagttcaggagtttgagactacagtgagcgacaattatgccactgc

SEQ ID NO: 34337 - DNA, 89 bp, Homo sapiens
tggctgaaagggagcgtgataacaagggtgggggtggggccaagaagcagccaccatgtgtgggtgcctctgtgcgtgcagtcatcttt

SEQ ID NO: 34338 - DNA, 138 bp, Homo sapiens
ggaggggatggtcacactgggtgccacagggctttcttgcctctcaggagccacagttgtgggtcacacactcactcctaatgctgagcagacccattctccaacctgggtctttccttctggctctgggggaatgag

SEQ ID NO: 34339 - DNA, 68 bp, Homo sapiens
gacattattcctgaggtgagaggtctgtgtgcccctgtgtgtccctctcagcctccctgatttctgtc

SEQ ID NO: 34340 - DNA, 84 bp, Homo sapiens
tctccataggtctctgactcacacaatcagccccggccccagcactctgcttcctcactgatttgtcacaagtgcttctggaga

SEQ ID NO: 34341 - DNA, 81 bp, Homo sapiens
ggaatttggtttcagaagagacagagggctgctctctccttctgagaaggatagtgtcccttgaagtctaggagtctggag

SEQ ID NO: 34342 - DNA, 97 bp, Homo sapiens
acatatatatatatgtgtgtgtgtgcatacacctatacatatataggggtgtgtgtgtgtatatatatatgtgtgtgtgtgtgtgtgacaagataca

SEQ ID NO: 34343 - DNA, 89 bp, Homo sapiens
cctcaccgagccctctgtgtgactctgtccctggcctgtctttccagctccaggtcagttttctctttctccaccaggtctacctgagg

SEQ ID NO: 34344 - DNA, 116 bp, Homo sapiens
aggcagccaaggacagaattctgggaaataaagcatttaaaggacagatacagcaagaggagctgatgaaggaggaatgaaaattatgaggtagccagatgtagtggcacaggtct

SEQ ID NO: 34345 - DNA, 108 bp, Homo sapiens
tcatgcagtcatgcagtgggtctggggtgaagcctgaaattctgcatttttttttttttttgagacagagtctcgctgtgtcacccaggctggagtgcagtggcgtga

SEQ ID NO: 34346 - DNA, 107 bp, Homo sapiens
cactgtggttttgatttgcatttctctaatgatatatacatctcttcctgtgcttattgattatttgtatattttttctttggataaatgtcaattcaagttctgtg

SEQ ID NO: 34347 - DNA, 61 bp, Homo sapiens
cttagatgagggtctcactctgtcacccaggctggagtgcagtggtgtaatctcagcttag

SEQ ID NO: 34348 - DNA, 90 bp, Homo sapiens
gccacagaaactcattaagttacttagggtctcaggtaatgaaaggacataagtgagactttttgttttttaaatcagtgttactgaggt

SEQ ID NO: 34349 - DNA, 95 bp, Homo sapiens
aggcgtgagccactgcaccggcttgctttatatataaattttaagaaaacataagacatcaatcaatatatgtaagatgtacattggttcagtct

SEQ ID NO: 34350 - DNA, 96 bp, Homo sapiens
gcactccagcctgggccacatggcaagaccttgtccctatttccttttttttttttttgagatggagttttgctcttgtcgctcaggctggagtgc

SEQ ID NO: 34351 - DNA, 58 bp, Homo sapiens
tgagatggagtctcactctgtcactcaggctagagtgcagtggtgcaatcttggctca

SEQ ID NO: 34352 - DNA, 84 bp, Homo sapiens
cacaggcctgtagcctcaactacttgggaggctgaggtggaaggatcacttgagcctgggaggaagaggttgcagtgagccgtg

SEQ ID NO: 34353 - DNA, 72 bp, Homo sapiens
ctgggcatagtgtcaagtgcctattgtcccagctactcaggaggctgaggtaggaggatcacttgagcccag

SEQ ID NO: 34354 - DNA, 72 bp, Homo sapiens
ggggagtggaaaacagctaaagaaggattgcagtggccagccaagcttgtgtcactgtctgtgtttctccct

SEQ ID NO: 34355 - DNA, 83 bp, Homo sapiens
ctcttccctggagcctccatttctactctcagctgatgatgtcacttcctgtctcactgagaaaatagaagccactgggagag

SEQ ID NO: 34356 - DNA, 60 bp, Homo sapiens
gagactgggtctcactctctcacccaggttggatgatggtggtggtgaggatcacagctc

SEQ ID NO: 34357 - DNA, 58 bp, Homo sapiens; identical to SEQ ID NO: 15746

SEQ ID NO: 34358 - DNA, 58 bp, Homo sapiens
tgagatggagtctcactctgtcacccaggctggagtacagtggtgtgatctcggctca

SEQ ID NO: 34359 - DNA, 76 bp, Homo sapiens
gccactaaatggaccagatgtgatttttttttttttttaaataagagtcattctgagagaagtctggcacatgggc

SEQ ID NO: 34360 - DNA, 79 bp, Homo sapiens
ggcgggggcctggaggccggactgagaggcatccattttgtctagagcctctcactgtcaccctcccactgttcttgct

SEQ ID NO: 34361 - DNA, 77 bp, Homo sapiens
cccatccgtctccggtgggctcttctgctgccggttgtacaggaagaagacagtgagcacagcaactaggatgagga

SEQ ID NO: 34362 - DNA, 56 bp, Homo sapiens
tgtgcacctgtccctctgtccgactgtccaatttagtgggcatggacaaatgcacg

SEQ ID NO: 34363 - DNA, 81 bp, Homo sapiens
gggacagactgagggttgtgtgtgcatgtgtatgcctgggcgtgtgtgtgtgacacacaacagagttatcagactatgtac

SEQ ID NO: 34364 - DNA, 78 bp, Homo sapiens
aggcacaggcccatggatgcaagtgagtcagggtgttggagtcagtgtgcaagaccatctgcagggtcaggggtgttt

SEQ ID NO: 34365 - DNA, 57 bp, Homo sapiens
gtgtctgtctgtctgtctcctagttctagttagaactaggagagcaggtaagggtat

SEQ ID NO: 34366 - DNA, 77 bp, Homo sapiens
acccaaggcttccccagctggatggcatcagtgagctcccttgctctctggcttctgtctgtgtcaggccagtgggt

SEQ ID NO: 34367 - DNA, 120 bp, Homo sapiens
ctctggtctcacacgctgggtgactgaatttgagataagcatctcatggtgtccctctgttaacatcttctacatcgtacttgtatcccatcttcacttactagctgtgtgatttggggc

SEQ ID NO: 34368 - DNA, 82 bp, Homo sapiens
gagattcccccattgtggcaaacacagagggggctggtggtcgccggggcgtccctcactccctgtgtttgaaatgggtttc

SEQ ID NO: 34369 - DNA, 77 bp, Homo sapiens
ttgtccacatcccatgggtcactgcccctctgtcagaaagggtgggcaccactgctggctccggagggtgaggtcag

SEQ ID NO: 34370 - DNA, 66 bp, Homo sapiens
tgcttagcaggtgtttatcctgggggtgaacaaatgagccactcaccctctgtgcctgagtaggca

SEQ ID NO: 34371 - DNA, 113 bp, Homo sapiens
ttcccgcggatccaccagaggccctacttgctagaactgagctcactctctctcgcacaaatatgcacacagatacagagaagccagtgcacagggaggttgtagacagggag

SEQ ID NO: 34372 - DNA, 106 bp, Homo sapiens
tgaagcataagtcggagctgaataaatatccatcttccccctctcattccagtgagtctctcgctgagtggctgggttgggagagggtagtctgagaaatgtggca

SEQ ID NO: 34373 - DNA, 77 bp, Homo sapiens
ggcatttcagggagggcctgcttagctcctcgaggccacctggctctggtgtctgggtccctccttccctggtggcc

SEQ ID NO: 34374 - DNA, 103 bp, Homo sapiens
ggccgtgaagtgtattttgacacagcttctccatgtgctctgcttccccctctcattgactcactctggctcttgctgtctgctgcattcttaccttcctgcc

SEQ ID NO: 34375 - DNA, 94 bp, Homo sapiens
gtgatccttccaggtactaataagacattagtctagcagcaaaagaaattccttgaaggcgaagaccgtgtctgtagttctatggtgcccccgc

SEQ ID NO: 34376 - DNA, 72 bp, Homo sapiens
catgaagatcactggactcagagtcaggaggtctaggcttctggccctggctctgccactgtgtgactcatg

SEQ ID NO: 34377 - DNA, 77 bp, Homo sapiens
tttctggcacgtcctggagagccactcagtgccaacatctcactgccagtctgcctctcactcagccctgccaggaa

SEQ ID NO: 34378 - DNA, 56 bp, Homo sapiens
gagacaaggtctcactctgtcactcaggctggagtgcagtgatgcggtcatggctc

SEQ ID NO: 34379 - DNA, 76 bp, Homo sapiens
gggctgagaatacagtagcagagatggagctggcaagacatctagagactccatcactgactcattcttctgaacc

SEQ ID NO: 34380 - DNA, 58 bp, Homo sapiens
tgaggcagagtctcactctgtcacccaggctggagtgcagtggtgcgatcttggctca

SEQ ID NO: 34381 - DNA, 69 bp, Homo sapiens
tcagtgtctgtgcctgtgactttgcaggatatagcccccctcctggctgctttcacaggctggcattga

SEQ ID NO: 34382 - DNA, 85 bp, Homo sapiens
gtccagaaggtggtgtggccaatgggagtagcatgggcttttagccaaacctcagctctgtctctctctggctgtgtctttgggc

SEQ ID NO: 34383 - DNA, 112 bp, Homo sapiens
gtggagaggttgagtggagatgagggaggtggtgaggctgctgaggtgaggaggctgaggtaggaggatcgaatgagccccagagatcaaggctgcagtgaaccgagatcat

SEQ ID NO: 34384 - DNA, 58 bp, Homo sapiens
gctgtctctgagcctctgtctttctaggacccctgggtagagcagccagggaccaagc

SEQ ID NO: 34385 - DNA, 58 bp, Homo sapiens
tgacacagagtctcgcactgtcacccaggctggagtgcagtgacgcgatcttggctca

SEQ ID NO: 34386 - DNA, 112 bp, Homo sapiens
attatggggttgggaggattaaacctgataatctagttaggtgccttacctcagtgtctcacactgagcctaccttggggtatattagtgtccttctcatttcttccatggt

SEQ ID NO: 34387 - DNA, 60 bp, Homo sapiens
tgtatgtatgtatgtacatgtatatatatatatgtgtatgtgtgtgtctgtctacataca

SEQ ID NO: 34388 - DNA, 93 bp, Homo sapiens
gcaatggtttgagagtgttcctgtctggcaactctcattctctctgtgaggataaaaggtactacggactacatttttctacatacccattgc

SEQ ID NO: 34389 - DNA, 74 bp, Homo sapiens
tgtttttgttttgagatggagtctcactctgtcacccaggctggagtgcagtggcgcaatctcggctcactgca

SEQ ID NO: 34390 - DNA, 68 bp, Homo sapiens
agccttgtgctgctcacattgttctagtttctgtaggttacagaaaacagtcagctcacacactggct

SEQ ID NO: 34391 - DNA, 93 bp, Homo sapiens
gcattcttttctattttttgttttattttttctagagagagggtctcactgtcactcaggctgaagtacagtagcacgaagataggtcaccgc

SEQ ID NO: 34392 - DNA, 97 bp, Homo sapiens
gacatgggtctctaatgatactaaaagacagaggagcaaaagagaaatttttttctttttttttttctttttttttgagatggagtctcactctgtc

SEQ ID NO: 34393 - DNA, 115 bp, Homo sapiens
cagactgcgggacaaaaactctgtttctcatgatggtggttgaaatggtctattaactgagaagtttgagaccacagcttagtcatcgtggtcaggtaactccgttcgctttttg

SEQ ID NO: 34394 - DNA, 62 bp, Homo sapiens
gtggtggtaccagtgtgtactcccgccagcactgtgtgtgagtgcctgcctgtttcctcctc

SEQ ID NO: 34395 - DNA, 75 bp, Homo sapiens
gacaggtagactcagggcagcatgcagagggcattcattctggagtcaatctgcctgtcactgcctctcttgatc

SEQ ID NO: 34396 - DNA, 82 bp, Homo sapiens
aagagaatatcacttggagtcagaaaatctgggtaccaggcttgcttctgcctctcactgtgtggctctgggtgagttcctt

SEQ ID NO: 34397 - DNA, 80 bp, Homo sapiens
agaagaagttgaaaagtttagattgtggacttggtgaggggtgtgaccgtcactgaacacagtctggatcaatgatttct

SEQ ID NO: 34398 - DNA, 119 bp, Homo sapiens
acagaggaaaaaacacaataaatattgaatgaacatctatgtttgtgagtaaagagattcagatcagctgtgtcacattacatagtcattttattcaaatgtctcaaagcctaaaatgt

SEQ ID NO: 34399 - DNA, 90 bp, Homo sapiens
gatgccatttatccattttggctttgttgcaattgctttcagtgttttagtcatgaagtctttgaccatgcctatgtcctgaatggtatt

SEQ ID NO: 34400 - DNA, 95 bp, Homo sapiens; identical to SEQ ID NO: 68

SEQ ID NO: 34401 - DNA, 93 bp, Homo sapiens; identical to SEQ ID NO: 69

SEQ ID NO: 34402 - DNA, 74 bp, Homo sapiens
ggagaccaagtctcactctgtcacccaggctggagtgcagtggtgcaatctgggctcactgtctcctgggttca

SEQ ID NO: 34403 - DNA, 111 bp, Homo sapiens
agccattgatctagcaaatagagatcctgacttcctatttttaaatttttattgtttttagtgatttcctttctagatggtgtcttgagctctctgttaattgacttggct

SEQ ID NO: 34404 - DNA, 95 bp, Homo sapiens; identical to SEQ ID NO: 68

SEQ ID NO: 34405 - DNA, 93 bp, Homo sapiens; identical to SEQ ID NO: 69

SEQ ID NO: 34406 - DNA, 68 bp, Homo sapiens
tgtgcttgtgtgagactgcacatgtgtctatgtacatgtgagattcatttgttgttgcggcaagcata

SEQ ID NO: 34407 - DNA, 102 bp, Homo sapiens
gcaactatgccatggcatggcgagagacaggagacagagaccaccaggaaccagatttgctcattgtttaaaccactctccatgatctatatatatatatgc

SEQ ID NO: 34408 - DNA, 68 bp, Homo sapiens
gctactctgtctcagtctcccagtggtcaggaaaaattatgacaggggtggagaggagatggaagggc

SEQ ID NO: 34409 - DNA, 107 bp, Homo sapiens
tgattgctctagctccatagtaagccttaaaccaactagtatcatcttataacctttttctttatttttgagattgatatggctagtcttggttctttgcattttca

SEQ ID NO: 34410 - DNA, 115 bp, Homo sapiens
ctatacctaaactgaaatctagaatgctccaaaatttgaagctttttgagtgctgacatgatgctgtaaggaagtgttcattggagtcttctggattttggattttgggatttgg

SEQ ID NO: 34411 - DNA, 118 bp, Homo sapiens
gtatatatacataagtgtatatacataagtgcgtatatatacataagtgtatatatatataagtgcgtatatatacataagtgtatataaataagtgcgtatatatacatatatacat

SEQ ID NO: 34412 - DNA, 83 bp, Homo sapiens
atgcttttttgtgtgtgtcatgtctgtttgtttttcaattaagagaggaaagcattaggcagatggaatgtacatgtgaggat

SEQ ID NO: 34413 - DNA, 71 bp, Homo sapiens
cattgtttaaagagaacagggccattatttaaggaaagtgtgggtggctccctgtgtgtctttaacatatg

SEQ ID NO: 34414 - DNA, 69 bp, Homo sapiens
ccttgcaccctgcctcgctgcctccctgtgtgatctacggaggaaactggggaccatagggccgtctgg

SEQ ID NO: 34415 - DNA, 105 bp, Homo sapiens
cattgttgcgctcctctcagtccctgagaccctaacttgtgatgtttaccgtttaaatccacgggttaggctcttgggagctgcgagtcgtgcttttgcatcctg

SEQ ID NO: 34416 - DNA, 110 bp, Homo sapiens
gcttctcaaaggcagccacttcatgctgctatgtcgaaagggccattattattattatattttaatggtaaaagagaaaaggagagaggttgagcgagcgagagagaagc

SEQ ID NO: 34417 - DNA, 81 bp, Homo sapiens
gatcatagaggagggtggctaggggccacatagagggctgcccctccctgtgagcctctgggtgtgactgaggctgtggtc

SEQ ID NO: 34418 - DNA, 156 bp, Homo sapiens
acttgtaatttccctgcttaagaaatggtagttttccagccattgtgactgcatgctcccaggttgaggtagtaggttgtatagtttagaattacatcaagggagataactgtacagcctcctagctttccttgggtcttgcactaaacaacatgg

SEQ ID NO: 34419 - DNA, 104 bp, Homo sapiens
gagagaagatattgaggcctgttgccacaaacccgtagatccgaacttgtggtattagtccgcacaagcttgtatctataggtatgtgtctgttaggcaatctc

SEQ ID NO: 34420 - DNA, 110 bp, Homo sapiens
ggcaaacatagtagtgcacaccggtggtcccagctactcgggaggctgaggtggaaggatcacttgagcccaggagatggaggttgcagtgagctgatttgtgccactgc

SEQ ID NO: 34421 - DNA, 105 bp, Homo sapiens
ctagaatccaagtgccctgtttctatatgtatatatatttgatatacctatgaaattgtatattattagtaggaagagaaggcactctggagtccaaatgtctgg

SEQ ID NO: 34422 - DNA, 95 bp, Homo sapiens; identical to SEQ ID NO: 68

SEQ ID NO: 34423 - DNA, 93 bp, Homo sapiens; identical to SEQ ID NO: 69

SEQ ID NO: 34424 - DNA, 96 bp, Homo sapiens
gacattttaaatacttgtgaatttttatttctgttatgtaaaactttgacaaaagtcgaacatagggatattagaatgaataatatgagaagtgtc

SEQ ID NO: 34425 - DNA, 65 bp, Homo sapiens
atcccagcagttcaaggctgatggcagtttgcatcgcttgacagacacactgcctctgttggggt

SEQ ID NO: 34426 - DNA, 108 bp, Homo sapiens
gcccgtgtattttctgcaatagatttctttttttttttttttgtattagaaaatagcaatatatatatttttagaggaagagtgttctagacagaagacaaagcgagt

SEQ ID NO: 34427 - DNA, 93 bp, Homo sapiens
tgttactcaggaataactggatacagaagagagtctggagatgtcagggccatgtcaagtcagatgagatgtaactcctttcccagagcagca

SEQ ID NO: 34428 - DNA, 96 bp, Homo sapiens
cacttaatatcaagaggttcaatttcatggttacatctcctgtcagtcctgttctacagaagacagtcaccactgagctcctcagagatgtaagtg

SEQ ID NO: 34429 - DNA, 95 bp, Homo sapiens; identical to SEQ ID NO: 68

SEQ ID NO: 34430 - DNA, 93 bp, Homo sapiens; identical to SEQ ID NO: 69

SEQ ID NO: 34431 - DNA, 71 bp, Homo sapiens
tttgacttgtgaatttcatgctgtggagccttgtcacagtgtgggggaatttcattattcatgcagtcaaa

SEQ ID NO: 34432 - DNA, 142 bp, Homo sapiens
tgcctccagctttgttctttttgcttaggattgtcttggctatttgggctcttttttggttccatatgaaatgtaaagtagttttttctaattctgtgaaaaaaaaagtcaatggtagcttgatgagaatagcaatgaatct

SEQ ID NO: 34433 - DNA, 81 bp, Homo sapiens
gtgacacaggggactctggttaaaagactgtctatctctctactttttttttttttttgagacagggtctcattctgtcac

SEQ ID NO: 34434 - DNA, 58 bp, Homo sapiens; identical to SEQ ID NO: 1868

SEQ ID NO: 34435 - DNA, 113 bp, Homo sapiens
cattgtaagtctatcagctttatatgttgggagtttttttgttttttgttttgtttgtttgttttgaaacggagtctctccctgtcacccaggctggagtgtagtgtcacgat

SEQ ID NO: 34436 - DNA, 64 bp, Homo sapiens
acaagcgtgagttttggagggagcatagcgctatgtgtctctcactggctctccatgcgtatgt

SEQ ID NO: 34437 - DNA, 116 bp, Homo sapiens
ggcaatgggtagtggactcttggattgactgtcagtaatggagggattttagatttttttctttttttctttttttttttttttttatgtttttcgagacagagtctggctctgtc

SEQ ID NO: 34438 - DNA, 110 bp, Homo sapiens
gtacatggacacgtgttgtgtgcatttgagcatgtgtatcggtgtgtggctgtgtgagtgcctatataagtatatgatcatgtgtgtgttactgtgtgtgttgcatgagc

SEQ ID NO: 34439 - DNA, 87 bp, Homo sapiens
acaaggtggtcacaggagtgagagagggcatggcaggggagatgaagcttatccatttatattttctcactaagggaaaatttttgt

SEQ ID NO: 34440 - DNA, 62 bp, Homo sapiens
tgttgttgttgttgttttgagacagagtctcactctgtcacacaggctggagtgcagcagca

SEQ ID NO: 34441 - DNA, 112 bp, Homo sapiens
ttgcttctaactggaaacaagacatagagcagaaaacgtaagaaaaaattaacatttaaaaaaatttttttttcagacagagtcttgctctgtctcccagactggagtgcag

SEQ ID NO: 34442 - DNA, 111 bp, Homo sapiens
gtgtgggcctagactaatgtgtgtgtttgtgtctcagtttttaacaaaaaagtttaaaaaataaaaatttttttttttttttgagacagagtctcgctctttcgcccaggc

SEQ ID NO: 34443 - DNA, 94 bp, Homo sapiens
ccagtcactgatcttagcacgctctatacatttatttatttatttatttaatttatttttttgagatggagtcttgctctgtcacccaggctgg

SEQ ID NO: 34444 - DNA, 119 bp, Homo sapiens
ctcttcctcctaaattgctgagattacaggcatggaccaccatacctggccagcattgcatttttttttttttgagatggagtctcgctctgtcacccagactggagtgcagtggccag

SEQ ID NO: 34445 - DNA, 65 bp, Homo sapiens
caccatcaggaaaggcaggctgagagttacgctgcttgactctgcctcggtctatcccacaggtg

SEQ ID NO: 34446 - DNA, 71 bp, Homo sapiens
cacagatggggaagagctaggatcacagcccttctcctggatgtggtacttgtttgttctaaatatttgtg

SEQ ID NO: 34447 - DNA, 93 bp, Homo sapiens
cttgggtgaaagttagatgtgtgaaattgctaatgagaaaattatccagtgaaacttttttttttttgagacagtcttgctctgttgcccagg

SEQ ID NO: 34448 - DNA, 140 bp, Homo sapiens
ggtgtgagacactgtgcctggccctgttttttattttatttttatttatttatttttttttgagacagggtctcactctgtggctcaggctggagggccagtggtgtgatctccgctcactgcaacctccacctcccagg

SEQ ID NO: 34449 - DNA, 126 bp, Homo sapiens
ggcaatacatgaaagatgagcttgacggagttcacgctggtctttgttctctgtctgtctgtcttgttaagtgccagatctgagggcaggccaatttggcgccaggggagagagagagagagagag

SEQ ID NO: 34450 - DNA, 59 bp, Homo sapiens
ggtaaccactctgtgtctctccctctgggcccagggatgggtgaggcagggagctcacc

SEQ ID NO: 34451 - DNA, 89 bp, Homo sapiens
catccatagccactggaagacatgagcctaagacatctgaggtgtccctaacagctcagtctctctctctctttttgtgtgtgtgtgtg

SEQ ID NO: 34452 - DNA, 112 bp, Homo sapiens
gatatatatacttgcatatacatatatacttatatttaatatatattgatgtgtattagatatatacatatatttattagaaaacgtttatgtttctgcatgtatatattcc

SEQ ID NO: 34453 - DNA, 110 bp, Homo sapiens
gccagacatggtggtatgcacctgttgtcctagctcctcaggaggctgaggtggaaggatcacttgagccaggaggttgaggtttcagtgagccataatcacaccactgc

SEQ ID NO: 34454 - DNA, 95 bp, Homo sapiens
tacctagaaactgttgtggggtaagcaggcctggcagaggccaccgcctgtcactcacacaaactgggtggtgggatttggacgttttcctctgc

SEQ ID NO: 34455 - DNA, 76 bp, Homo sapiens
aggggctggaggggctgtggggagtcatagagagactgcagaaattctctccttctctcagcctcactggctgcct

SEQ ID NO: 34456 - DNA, 112 bp, Homo sapiens
cctttgggatgacttaaaaagggttctttgttgggagtcaagtgacagagcagacctggccgcagggagttgttctgcttctgctttacctctcaggaccattcccaggagg

SEQ ID NO: 34457 - DNA, 106 bp, Homo sapiens
tcatctatccatccttcctctttattggtagaagaaacagtggagagtagccacttctggttctagcacttctcttttgttaagatagggtttggatttagtatga

SEQ ID NO: 34458 - DNA, 61 bp, Homo sapiens
gggagagagagagacgggtaggcaagtagacagacatacacacacatactctctctctctc

SEQ ID NO: 34459 - DNA, 89 bp, Homo sapiens
tgatttttggctgtcactctcagtcacttttgcaagtaccttaagttccctgaagtactcttggccttgttctgagagttttaaaatca

SEQ ID NO: 34460 - DNA, 85 bp, Homo sapiens
tggatggagcagtatttttatttagattgaactttcgctgtactctttatgatagttctgatcacagaaaatgattactcctcca

SEQ ID NO: 34461 - DNA, 86 bp, Homo sapiens; identical to SEQ ID NO: 2169

SEQ ID NO: 34462 - DNA, 81 bp, Homo sapiens
cagagcaggaggaagagagagatgggggaggtgctacacaaacacgctttttttttttttttgagacagactctcgctctg

SEQ ID NO: 34463 - DNA, 114 bp, Homo sapiens
gaggaatttatcagctggagatctggacttctatctatatgtatatgtgtgtgtgtgtacatatataaatatatatatatgcagaaaggttgctagaaaatggaggaatttatc

SEQ ID NO: 34464 - DNA, 118 bp, Homo sapiens
ttgccatattgtattggtttttctatctgtattattttttattgtattattttaatttttctctaaatattttcaatttacagatgcagaagggtggactgtatatgcaatatcccaa

SEQ ID NO: 34465 - DNA, 117 bp, Homo sapiens
atctgtgaaaaacacctaaatactcctggagaatgttatgacacacatttttcttttttttaagaaacaaggtctcactaggttgcccataccggagtgtagtggctattcacaggt

SEQ ID NO: 34466 - DNA, 115 bp, Homo sapiens
attgtcttggctatatgggctcttttttggttccatatgaaatttaaagtagttttttctaattctgtgaagaaagtcaatggtagcttgatggcagtatggccattttcacaat

SEQ ID NO: 34467 - DNA, 131 bp, Homo sapiens
ccagcattgcctcttcgttgtactgagcaagactttcttttatttttttttcgagatggagtctcactcagtcactcaggctggagtgcagtggcgtgatcttggctcactgcaaccactgtctcccgggt

SEQ ID NO: 34468 - DNA, 58 bp, Homo sapiens
tgagactgagtctcgctctgtcacccaggctggagtgcagtggcgctatctcggctca

SEQ ID NO: 34469 - DNA, 98 bp, Homo sapiens; identical to SEQ ID NO: 1311

SEQ ID NO: 34470 - DNA, 86 bp, Homo sapiens
agcaaaaaggtaagggaaggagtagctgtgaaggccttggatggcatgttaagaagtttgtcctggagagaagttatctttgtgct

SEQ ID NO: 34471 - DNA, 87 bp, Homo sapiens
atatatatacaaatttatatacatatatacaatataaaaacatcaccacttacatatgtgtgtatatatgtatgtatgtatgtatgt

SEQ ID NO: 34472 - DNA, 114 bp, Homo sapiens
gtcttatctgtgttttactgtctgctctttctggcttcttgtagttagaagagaagtgatttccttgaaatccatgaggctagaaagggagctggaacttaaagtgactgagat

SEQ ID NO: 34473 - DNA, 101 bp, Homo sapiens
tgttatttatatgagcttcttactatactggcatcttttttttttttttttttttttgagatggagtcttgccctgtcgtccaggctggtgtgcaatggca

SEQ ID NO: 34474 - DNA, 84 bp, Homo sapiens
gctaaagtggtgctggtctctgctgtatttgacttcctacaacttgaaaaaggggaagtcagtgtcactcagtatcatgatagc

SEQ ID NO: 34475 - DNA, 112 bp, Homo sapiens
ggtttcagttcttcacatccttaccaacacgtggttttattatttttaaaaaattatagccatctttgtgtgtgtgaggtcatattttactgtggttttgatttgaatttcc

SEQ ID NO: 34476 - DNA, 96 bp, Homo sapiens
gtgaagcatctctttggttggaattttaaagtggagcaatgagtgctatcttgtctcactgctcttgctcctgccaaagacatgctgtgctgtcac

SEQ ID NO: 34477 - DNA, 116 bp, Homo sapiens
tgctgggatttcgtgattgcattgaatctataaatctgttggaaggaacttaaatcttagcaatgttgtgtctttctagtcatgaatatagaatagctctttatgtagatctttca

SEQ ID NO: 34478 - DNA, 95 bp, Homo sapiens; identical to SEQ ID NO: 580

SEQ ID NO: 34479 - DNA, 93 bp, Homo sapiens; identical to SEQ ID NO: 69

SEQ ID NO: 34480 - DNA, 104 bp, Homo sapiens
tcatatgaattttaaactagtttcttctagttctgtgaagaatgccagtggtagtagtttcataggaataggattgaatctataaattgctttgggaagtgtgg

SEQ ID NO: 34481 - DNA, 92 bp, Homo sapiens
tatgtatatatgtgtatacatgtatatttgtgtatatatgtatatatgtgtatatatgtgtgtgtatatgtatatatgattccacttacatg

SEQ ID NO: 34482 - DNA, 100 bp, Homo sapiens
atacatatacacatatatgtacatgtatatatgtatatatgtgtatatatacgtatatgtgtatatatacatatatgtgtatatgtgtatatatgtgtgt

SEQ ID NO: 34483 - DNA, 84 bp, Homo sapiens
gtgtatatatgtatatatatgcaaaaggatgtatacatgtatacacatatatacatccttttgcatatatatacatatatacac

SEQ ID NO: 34484 - DNA, 117 bp, Homo sapiens
aagtgacattactgaacaatgggcctttgagggtggacttcgctatgtctttttttttctttttttgagaaggagtcttgtactgtcgcccaggctggagtgcagtggcgtgatctt

SEQ ID NO: 34485 - DNA, 90 bp, Homo sapiens
ctttccatttttcagcagtgcctccctcagggtgtctctgtgttagattcaccctcagattggccttttatggtggtggaggaaggaagg

SEQ ID NO: 34486 - DNA, 86 bp, Homo sapiens
tctgaggggtggacgtcagtcagtttcagtgtggccacccccactgtgggggggttctgaagcaggctgacccgctttgacttaga

SEQ ID NO: 34487 - DNA, 71 bp, Homo sapiens
gtcacactgtctgtctcactgtcacactgcctggagccagggaaaggcagtctcccaatagatagaaagac

SEQ ID NO: 34488 - DNA, 84 bp, Homo sapiens
gctgaagaacttagagcatccaacacaggagaaagatgaaggccggaacactcagcaagtctctctcactccatgttcttctgc

SEQ ID NO: 34489 - DNA, 57 bp, Homo sapiens
tgagaccgagtctctctctctcacccaggctggagtgcagtgggcgatctcggctca

SEQ ID NO: 34490 - DNA, 70 bp, Homo sapiens
tatatatatacatatacatatatgtatatgtaaatctatacatatacatatatgtatatgtaaatctata

SEQ ID NO: 34491 - DNA, 106 bp, Homo sapiens
gcattgtgatccgaaagcatggttggtttgatttttgtttttttgtgtttttttgaatttgctgaggattgttttatggctgattgtgtggttgattttagagtgt

SEQ ID NO: 34492 - DNA, 86 bp, Homo sapiens
ctgaagctgccctgtatcctgatttcctgccaggatgatcaaaattgatttctaccaggaggataatccagccagggctgttctgg

SEQ ID NO: 34493 - DNA, 92 bp, Homo sapiens
atatgtgcatatatatgtgtgtgttgtgtgtgttatgcgtgtatatatatgtgttatgtgtgtatatatatatgtgtgtgtgtgtcatatgt

SEQ ID NO: 34494 - DNA, 116 bp, Homo sapiens
ccaggccaggtgggaggactgtctgccttgttccccaagtctcagcctccctgtttcagaggccacagggaggaaaggacatctgggtggcacacaggaaatcacggccagccagg

SEQ ID NO: 34495 - DNA, 57 bp, Homo sapiens
ctgagtttctcagtactgagtgaggaaactgaaattcaggctggtctggaaccttag

SEQ ID NO: 34496 - DNA, 84 bp, Homo sapiens
tcctcgttcctggccacgcagaccctcgataggccctgccaccatgtccctctcactctgcgtgtgcagccacaggatgctgag

SEQ ID NO: 34497 - DNA, 97 bp, Homo sapiens
ggtgccgagctccactgaggagacagagcagagtgtcatatgggggatgcagatatgacacctgagctgaccctagaaggatgagtaggggttaacc

SEQ ID NO: 34498 - DNA, 71 bp, Homo sapiens
ctctcagagccagagagcagagtgagggctcaggagcggcctttgctggattcctgtggttgaaggatgag

SEQ ID NO: 34499 - DNA, 62 bp, Homo sapiens
ttcacagctggatctttgtctgggtggtggtcagcatcccagagagccaagagcagagtgag

SEQ ID NO: 34500 - DNA, 99 bp, Homo sapiens
ggaaatgtcaattcctcataccactgtggtattatggtcctccctccaccatcaaatgcctctctcagtgtgcctctcttgtaggatcgtggcctttcc

SEQ ID NO: 34501 - DNA, 103 bp, Homo sapiens
caccctcatcctgagcggagaggcgccacagtgtcctcaggtttacatccacggaaggtaactgagagaggagacagagcttttcccccaggagctgagcctg

SEQ ID NO: 34502 - DNA, 111 bp, Homo sapiens
gccaggcatggtggtgggcacctgtagtcccagctatttgtgggcctgaggtaggaggatcatttgagcccaggaggtcaaggctgcagtgagccctgattgtgccactgc

SEQ ID NO: 34503 - DNA, 95 bp, Homo sapiens; identical to SEQ ID NO: 68

SEQ ID NO: 34504 - DNA, 93 bp, Homo sapiens; identical to SEQ ID NO: 69

SEQ ID NO: 34505 - DNA, 82 bp, Homo sapiens
aaaagagggaggattgaaagagtatcttagaaggtctaaaaagactttatgcatatgatctccttttttttttttttttttt

SEQ ID NO: 34506 - DNA, 110 bp, Homo sapiens
tctagagccacctcttccttggccccaggctgtcagacagcctctgttctggtgtatctgaccagaagccccatagtcctggctgtctgcctccagagaggggccctggg

SEQ ID NO: 34507 - DNA, 116 bp, Homo sapiens
gttgagtctccctgcctgccaggaaagaattaagtgtctccccagttcctcctgctcaggctgaggttctaagatgtattaatgcctggaaccaggcccaagggcagaacattgat

SEQ ID NO: 34508 - DNA, 58 bp, Homo sapiens; identical to SEQ ID NO: 17746

SEQ ID NO: 34509 - DNA, 82 bp, Homo sapiens
catcgtgtcttcatgttcatggtctttcttggctctcttggctccagggtgggtgactgagatcttggtgatagcacagatg

SEQ ID NO: 34510 - DNA, 119 bp, Homo sapiens
gggtactctcagagttccacgaatgagagtttcaggagaaggcagtgaacacacttggtatcacacaggctgccttctttcattctgcactttctccctggaagactttattcttaccc

SEQ ID NO: 34511 - DNA, 76 bp, Homo sapiens
cagttacggtggagaggaggatatgctatttctttttttttttttttaagacagtctccctctgtcacccatgctg

SEQ ID NO: 34512 - DNA, 75 bp, Homo sapiens
actgaggagggcttctgggccagtgagagggaagaggtgaccctgagctgtctggctgcctccaacccacctagt

SEQ ID NO: 34513 - DNA, 79 bp, Homo sapiens
gacagaaaggagtttttgttccatccataagtagaaatacttttttttttttttttttgagacagaatctcactctgtc

SEQ ID NO: 34514 - DNA, 94 bp, Homo sapiens
tgacagttactggctttttacagtatcagaataaaagtaattagaattttttattttactgtagtttggtatctgttcagtgagtaattgtaca

SEQ ID NO: 34515 - DNA, 96 bp, Homo sapiens
tgagcctcttcacttctcaggagtgagaagccactgagctccttccatgttccaggagagtaaggccttttcctctccagagaaggttctggctta

SEQ ID NO: 34516 - DNA, 96 bp, Homo sapiens
gtctcctggccctgagtgccgtgtctgctcacatggacggcagctcgggccagacagccagagaagacagagaggtgaggggacatgtagaaaagg

SEQ ID NO: 34517 - DNA, 76 bp, Homo sapiens
gtggaaattggcaagcactacatatcagtcctcccatttctgaaagctggttgtcagatgtttgtcagcacactac

SEQ ID NO: 34518 - DNA, 112 bp, Homo sapiens
atcatccctggggctgtgctgcaggtgctgtgcataatctttttttttttttttgtgagacagtctcactctgtggtccagactggagttcagtggcgtgatcttggctcac

SEQ ID NO: 34519 - DNA, 83 bp, Homo sapiens
tgtgtacgtggtgatgtgtgtgttatagtgggtgcacacttgtgtgtgtgcagagctgtgtgtacacatttgtggtgtgtgta

SEQ ID NO: 34520 - DNA, 58 bp, Homo sapiens; identical to SEQ ID NO: 454

SEQ ID NO: 34521 - DNA, 69 bp, Homo sapiens
gctgcccctgagctgggcagggccaggctgatggaagcccttcccacctctctgtctctctgctgcagc

SEQ ID NO: 34522 - DNA, 66 bp, Homo sapiens
gacagaatgcgagaggctctaggaaggtcttttttttttttttttgagaccgagtctcactctgtc

SEQ ID NO: 34523 - DNA, 69 bp, Homo sapiens
cttgagggcagaaaatgtgtcttactctacttttttttttttagatggagtctcactctgtcactcagg

SEQ ID NO: 34524 - DNA, 89 bp, Homo sapiens
gtctccttgggcagtgtgtatctgtttcctctttgtccccagcagagaatagaaactgactgtcattctctctgcctctcctgaaagac

SEQ ID NO: 34525 - DNA, 101 bp, Homo sapiens
tgcaaattcctgggctgtgctcatagaaattccagttcagttgtctggggcatgttccttgcatttgcattgttatcaagcacatcagcccgtggaaggca

SEQ ID NO: 34526 - DNA, 111 bp, Homo sapiens
tggatgtctactcagaagtggaactgctgcatcagatggtggtcctatttttaattttttaaggaaccttcattgtgttatccatagcagttgcaccattttacaacacca

SEQ ID NO: 34527 - DNA, 90 bp, Homo sapiens
ctagcaaagtgcctgtcacagagtaagcactcagcgccgtgaatgaaggaatggggtgagggaacgactgtgtgcagagagtcatgtgag

SEQ ID NO: 34528 - DNA, 74 bp, Homo sapiens
ggttggtgcaaaagtaattgcaggttttgctgttacttttaatggcaaaaattgtgattatttttgcaccaatc

SEQ ID NO: 34529 - DNA, 83 bp, Homo sapiens
gtgctctccttgccttggttcctctgtgtgagtcactgccagtgacctgagttgtccacccagcatctgccgtggccatgcac

SEQ ID NO: 34530 - DNA, 110 bp, Homo sapiens
ggctcatgcaggcattgggaaaagcatgaatcagaaatgagagtacatttttcacgttgagctagtaccttgtctgcttatgttgccattcatacagccagtaataagcc

SEQ ID NO: 34531 - DNA, 112 bp, Homo sapiens
ttgtagttgctgtatcttattacctttcagacagatgatgtccaaatataatgttgagggagattttttgttattattatttgttagagggatgatgggcaatgacttacag

SEQ ID NO: 34532 - DNA, 115 bp, Homo sapiens
tccgggggtgtctgtttgctgttgatgtcaacctggcagaaagccctgttctctgactgtcacagatagaggaggaaggagtgcctggggacatgcggtggcaggagaggatgga

SEQ ID NO: 34533 - DNA, 110 bp, Homo sapiens
atgtaatggcaaatgaaaagagttgtgcacattttaaaaatacacttgagagttttattattattttattatttttaaaataaaatatttttgagcatttgtgattatgt

SEQ ID NO: 34534 - DNA, 58 bp, Homo sapiens
gggggagatcagtgtgtgtggaaatgtgtatgcacagtcctctctctctctctctctc

SEQ ID NO: 34535 - DNA, 106 bp, Homo sapiens
ggaagccaaggcttacgtttgaattttgtttgcatatctagaaaatagaattgttttttttttttttttctaattgttggcagaaatgaggtgagttgaaattttc

SEQ ID NO: 34536 - DNA, 92 bp, Homo sapiens
ttggtcactctagcatgatgcatgtgtgtgtgcatgtgtatgtgtttatgcatacaatgcgaagtctcatgcgtatgttgggaagtggtcaa

SEQ ID NO: 34537 - DNA, 68 bp, Homo sapiens
aagatcatgctcctttgaagagcatggtaggaagactaccattttttttcaatataatagaggatctt

SEQ ID NO: 34538 - DNA, 67 bp, Homo sapiens
tgtgtgtgtatgtatatgtgtgtgtgcctgtatatacataccatatatacatgtatatatatagata

SEQ ID NO: 34539 - DNA, 95 bp, Homo sapiens; identical to SEQ ID NO: 68

SEQ ID NO: 34540 - DNA, 93 bp, Homo sapiens; identical to SEQ ID NO: 69

SEQ ID NO: 34541 - DNA, 56 bp, Homo sapiens
gagtcggagtctcgctctgtcgctcaggctggagtacagtggcacgatctcggctc

SEQ ID NO: 34542 - DNA, 110 bp, Homo sapiens
atttttgacaactgccaaagcagaaaacaaaggtatcaaaggacataaaacatgttattttcttgttatgcctttaatttttgtatttatgagcttgttcatttgaaaat

SEQ ID NO: 34543 - DNA, 81 bp, Homo sapiens
cagagttcagagtgagcagaccaatgattaatgggtaataaaggactcgcattggaactcattctcttaaatcatcctctg

SEQ ID NO: 34544 - DNA, 79 bp, Homo sapiens
tgcaggcaactgagctgtgggaattgtcattttcatattctgtttcaggagcataagtctcccagcacaacagcctgca

SEQ ID NO: 34545 - DNA, 81 bp, Homo sapiens
tccccctcccctcaagagtgtgagcagtgatggcaaccaaatgggtgagccacacccctgtttcacatcctgcaaggggga

SEQ ID NO: 34546 - DNA, 92 bp, Homo sapiens
tacattatttttatcatatatacatattttatatatgcatatataaaattttaatatatacattttatgtatatatgatgaaaatccatgtg

SEQ ID NO: 34547 - DNA, 104 bp, Homo sapiens
tttcctccctctttccccacctcatctcatccttccttctttctgtaaattatgttgtttaatatgtaaagaactttgataaatgctgggctgggagggggaaa

SEQ ID NO: 34548 - DNA, 83 bp, Homo sapiens
tatgcgtgtacatatatgtgtgcgtatatatatgtttatgtatgaaagtgtatgtgtgcatatatatagtatgtttatgtata

SEQ ID NO: 34549 - DNA, 108 bp, Homo sapiens
attggatttgatttattattagtttggtatggatttatacctgtgtctcactgtgtcagtgagagatattcgtctgtatttttctcttcttgtaatgatttgtccggt

SEQ ID NO: 34550 - DNA, 95 bp, Homo sapiens; identical to SEQ ID NO: 68

SEQ ID NO: 34551 - DNA, 93 bp, Homo sapiens; identical to SEQ ID NO: 69

SEQ ID NO: 34552 - DNA, 58 bp, Homo sapiens; identical to SEQ ID NO: 16534

SEQ ID NO: 34553 - DNA, 58 bp, Homo sapiens
tgagatggagtctctctctgtcacccaagctggagtgtagtggtgggatcacagctca

SEQ ID NO: 34554 - DNA, 93 bp, Homo sapiens
gcaatgttgttacacttcttttcctcttcattttttttttttttttgaggggagggaagagtggtagagagaaatggtgtttcaagagcttgc

SEQ ID NO: 34555 - DNA, 95 bp, Homo sapiens; identical to SEQ ID NO: 68

SEQ ID NO: 34556 - DNA, 93 bp, Homo sapiens; identical to SEQ ID NO: 69

SEQ ID NO: 34557 - DNA, 135 bp, Homo sapiens
gtgtatatatgtgtgtatatatgtatatatgtgtatatatgtgtatatatatgtatatatgtgtatatatatgtgtatatatgtatatatgtgtatatatgtgtatatgtatatatgtatatacacacacacaca

SEQ ID NO: 34558 - DNA, 107 bp, Homo sapiens
gatccattctgaattgctagactgatccctcagccaggaaatgaaggcatgaagcctttatttatttatgtctactatagtcagttacacagctagaattttgtatc

SEQ ID NO: 34559 - DNA, 163 bp, Homo sapiens
gatgggatggaattatttcaaaagaaacatgacagaagaacagagattttttttgtttgtttgtttctttctttctttttgagacggtgtctcgctctgtcacccaggctggagtgcagtggcgcgatctcggctcactgcaagctctgcctcccgggttcac

SEQ ID NO: 34560 - DNA, 104 bp, Homo sapiens; identical to SEQ ID NO: 2711

SEQ ID NO: 34561 - DNA, 110 bp, Homo sapiens
tggatgaagaggctccagagatcctaaagctgtactctggacatagcttagtggcaagcacagggaaaagtgtacagaggaagacaataggctggaatcggaggcttcca

SEQ ID NO: 34562 - DNA, 88 bp, Homo sapiens
aaaagcagacaaagtttaggaatgaatttaaactactgacttacgtgttgtcaggagtctatttctattcctcaattttactcctttt

SEQ ID NO: 34563 - DNA, 120 bp, Homo sapiens
tatgtatttatatgtatatatacacatatgcatacatgtatatatgtatatatgtatatgtacatatatgcatactatatgtgtatatatacacatatgcatactatatatgtatacata

SEQ ID NO: 34564 - DNA, 117 bp, Homo sapiens
tccatgatttctgtctggtgaatgtacatggggttttattgttgttcgttttttgttttttctttaactatgtctagcctactaccccacctaaaagtcaacagagagagctctggg

SEQ ID NO: 34565 - DNA, 89 bp, Homo sapiens
aagcagaaagaggagtcaattttatgtgtgcatatatgtgtatatatatatacgtgtgtattgtgatggtgaatcctgagtgtcagctt

SEQ ID NO: 34566 - DNA, 77 bp, Homo sapiens
tctttttttctttaaattaaactcttctcagagtgctactaatacaaactggcatgagatagagaaaggaaggaagg

SEQ ID NO: 34567 - DNA, 70 bp, Homo sapiens
ggaattacaatgtgaatgtgcatgtgcatgtgcatgtgcgtgtgcgtgcatgtgtgtgtgtgtgattgca

SEQ ID NO: 34568 - DNA, 99 bp, Homo sapiens
ggcatgtgacgtggcaggccctgggcgccgggcacagggcgcgcgctgcggcagcctctgcgtgtcactgtgtgcctgaggcttccatggtgaggtgct

SEQ ID NO: 34569 - DNA, 58 bp, Homo sapiens
tgagatggagtctcgctctgtcgctcaggctggagtgcggtggcgtgatctcggctca

SEQ ID NO: 34570 - DNA, 83 bp, Homo sapiens
ctatgttactgtttatgtatcattactttaaaatgatagatttttatcattattttagaatgatagattttagatatacgtag

SEQ ID NO: 34571 - DNA, 127 bp, Homo sapiens
acaacaaaatcagctgggcatggtggtgcacacccgtggtctcaggtactttttttttttttttttttttttgagacggagtcttgctctgtcacccaggctggagtgcagtggtgcgatcttggct

SEQ ID NO: 34572 - DNA, 102 bp, Homo sapiens
aatctagtaagtggttgatctggagttgaacccaggctgagtggcccttgactcacactcagtgtctgagcaactccacaaaaatggaatgcttaaatgatt

SEQ ID NO: 34573 - DNA, 58 bp, Homo sapiens; identical to SEQ ID NO: 16534

SEQ ID NO: 34574 - DNA, 70 bp, Homo sapiens
cagggccttgtctcagtctctgacctcggggaaacctaaactaagaaagtcgataccagaagcagccctg

SEQ ID NO: 34575 - DNA, 107 bp, Homo sapiens
gtatatttaacatgagcacagtgttcatccctgttgtagcatatgtcagaattttttctttttaaaggctgaggctgaataatatttcattttgcctgtttgtatac

SEQ ID NO: 34576 - DNA, 63 bp, Homo sapiens
cttggacagacagaacagtgtgtggagaacaccatgatctttaccatgatcttttgctccaag

SEQ ID NO: 34577 - DNA, 95 bp, Homo sapiens; identical to SEQ ID NO: 68

SEQ ID NO: 34578 - DNA, 93 bp, Homo sapiens; identical to SEQ ID NO: 69

SEQ ID NO: 34579 - DNA, 82 bp, Homo sapiens
tgtatatgtacttgtatatatatatgtatatgtgtgtatatatacacacacatatatatataaataaatagagacacagaca

SEQ ID NO: 34580 - DNA, 76 bp, Homo sapiens
tatatattttatatagtataaatatatattatacatacatatgtatatatgtacttttatatgtataatttatata

SEQ ID NO: 34581 - DNA, 112 bp, Homo sapiens
gtgggaaggaagaaatgggaacagagaagtgagtagagggagaagttgagtgtgatgcagtctctttttttttttttttttttttttttttgagtccgtctcactttgtcac

SEQ ID NO: 34582 - DNA, 106 bp, Homo sapiens
ctgggattacaggcgtgaaccaccgtgcccggccgcagattgttaataggatctatatttgattttagtggacatgtgagggcctgaaggttggttcttgtgctag

SEQ ID NO: 34583 - DNA, 106 bp, Homo sapiens
gttgtctcttctctatgtgaagaagtgctgctctgccttctcattatttatttatttatttttttttttgagatggagtctcgctctgtcgcacaggctggagtgc

SEQ ID NO: 34584 - DNA, 95 bp, Homo sapiens; identical to SEQ ID NO: 68

SEQ ID NO: 34585 - DNA, 93 bp, Homo sapiens; identical to SEQ ID NO: 69

SEQ ID NO: 34586 - DNA, 93 bp, Homo sapiens
tttcaaagcacagaattttaaagtatctatttttaaactgcaggatctcttctgcctacttaataagatgggtaccagaacaaggttttgaaa

SEQ ID NO: 34587 - DNA, 97 bp, Homo sapiens
agcagaatttctgggtaggagagccctggcgaatgtcaggctgcctctgtgccaagataggattagggttctctgcatcttggttacatcaattgct

SEQ ID NO: 34588 - DNA, 102 bp, Homo sapiens
tatacatatataattgacatctacatatataattgacatatatatacaaataaaaattgtatatatttaaggtgtgtaatgtaatgatttgatataagtata

SEQ ID NO: 34589 - DNA, 107 bp, Homo sapiens
gctcttagaaagttccttctgagaatagcatggggaattgagaccagagtgaggacagaaaggagtcagggtctgtgtggtgtggagggagctgcaatgatttgggc

SEQ ID NO: 34590 - DNA, 109 bp, Homo sapiens
gaaattctccaggcagtgagctgggggtacttgcagggctgatctcacttgtctttctctcagggatcacagtcttgcactgcctgttgtccaatgtctgaaaactttc

SEQ ID NO: 34591 - DNA, 72 bp, Homo sapiens
acacacacacacatatacacgtatacatatatatacatatatacgtgtatatatacatatgtgtgtgtgtgt

SEQ ID NO: 34592 - DNA, 88 bp, Homo sapiens
catggcctggatggctccttctgagttgacgggggactgaaagagatgttgtcctagtcactgtaaacagagagcacagcagagaatg

SEQ ID NO: 34593 - DNA, 58 bp, Homo sapiens; identical to SEQ ID NO: 637

SEQ ID NO: 34594 - DNA, 118 bp, Homo sapiens
ccaaggctgggacaaggagtcctgtttttttgtttgtttgtttttttgtttttttctttctcaaactccaatagcaaggaagtggaaaaaagattagacttttggcccggcgcggtgg

SEQ ID NO: 34595 - DNA, 82 bp, Homo sapiens
gtctttccaaatcagtcaccctctctctcagggtttttataaggttgcattgtttagaaggaggggacacaatcaggatgac

SEQ ID NO: 34596 - DNA, 100 bp, Homo sapiens
actgtcacctcaggaaagtaatattgtgcatatatatgtgtgtgtatatatatatgtgtgtgtgtatatatatgtgtatatattctgctgttaaatcagt

SEQ ID NO: 34597 - DNA, 92 bp, Homo sapiens
tttctcactggcttatgtttttaccataatgttttcacagttcatctgtgttataccttgtaaagttttgaaatggttttgccagtcagaga

SEQ ID NO: 34598 - DNA, 118 bp, Homo sapiens
ctgatttgtgtacattaattttgtatcctgaaacttcactgaattcatttatcagatctaggagcttttcaaatgaatcttgagggttttctaggtataagtttgtatcatcagcaaa

SEQ ID NO: 34599 - DNA, 90 bp, Homo sapiens
ttccacttctgtgactctgtgaggctaactctgtttctatttttttttttttttttgagacgaagtctcattctgtcgcctaggctggag

SEQ ID NO: 34600 - DNA, 78 bp, Homo sapiens
gcatacgtgtgtgtgtgcatgtgcatgcacatgtgtataggggcatgcgtgtgcatgtgcacacagaaatatgtaggc

SEQ ID NO: 34601 - DNA, 147 bp, Homo sapiens
ctgtctgtctgtctgtctctacatctctcatctcaccagtctgagagaacagaatcagcctacagcaggcaacttgggactgttttcattttttttaatttatttttattattttgagacagagtctcactctgttgcctaggctgg

SEQ ID NO: 34602 - DNA, 88 bp, Homo sapiens
gctggtaggaggaggctgaggtaggaggatcacttgagcctgggagggtaatctacagtgacccgtgatcacgccactgcattccagc

SEQ ID NO: 34603 - DNA, 77 bp, Homo sapiens
gctcaccctccctctcacccagccacattcagggtcatttgctgtagctcaggtggctgcggctagggtggggttgc

SEQ ID NO: 34604 - DNA, 65 bp, Homo sapiens
ccttggggaggcggtgggacaggagagggcatggaagtcctgcctcccacactggctctctctgg

SEQ ID NO: 34605 - DNA, 175 bp, Homo sapiens
acacactatatatatacacagtatatatgtgtgtgtatatatatatagacactatatatgtgtgtatgtatatatatatatagacactatatatgtgtgtatatatatatagcgtgtatatgtgtgtatatatatatgtatgtgtgtatatatatatatgtgtgtgtatatatat

SEQ ID NO: 34606 - DNA, 135 bp, Homo sapiens
atatatatatacacacatatacacgctatatatatatacacacatatatagtgtctatatatatatatacatacacacatatatagtgtctatatatatatacacacacatatatactgtgtatatatatagtgt

SEQ ID NO: 34607 - DNA, 79 bp, Homo sapiens
tcatatataacattttataatatttttgagtgtaatttacttagagtaaaatgcacatgttgtaagtgtatatatatgg

SEQ ID NO: 34608 - DNA, 85 bp, Homo sapiens
gatgcaggcacatgtttgagcatgcgtgcacacacacacacacacacacacacacacacacaagctctcacacatgcctacactc

SEQ ID NO: 34609 - DNA, 81 bp, Homo sapiens
ggagcttctgtgagacatgtgattttcttccttggtcccaaaatgctatgaattggtagagaatctgaagtcttcatctcc

SEQ ID NO: 34610 - DNA, 120 bp, Homo sapiens
ggtactgtgagtctgttattgctggcccatgaaacataagcacagagacagagacacacacacatacacacatgctctctcttttttcataaggacccagatatagatgaaatttccagt

SEQ ID NO: 34611 - DNA, 60 bp, Homo sapiens
gtgtgtgtctctgtctctgtgcttatgtttcatgggccagcaataacagactcacagtac

SEQ ID NO: 34612 - DNA, 86 bp, Homo sapiens
gctgtgtcaatatggatctctgggcaggaattcagtgtggagaccggcaggcctgtctctgtttctgtccctggaccctcctcagc

SEQ ID NO: 34613 - DNA, 76 bp, Homo sapiens
tgcagtggcctcctttgcctgaatgtagctctgcaggtgacaaccgcagagagtcagaacactctgggcaacagca

SEQ ID NO: 34614 - DNA, 78 bp, Homo sapiens
tgagagagtctctctctgtcgcccaggctggagcgcagtggcgtgatctcggctcactgcagcctctgcctcctgggt

SEQ ID NO: 34615 - DNA, 124 bp, Homo sapiens
gctaggggaggcagttccctgaccccttgcacttcccgggtgaggtgacgccccaccctgctttggctctctctctgtgggctgcactcactgtctaactagtcccagtgagagaagccaggta

SEQ ID NO: 34616 - DNA, 114 bp, Homo sapiens
gttcagtgttcatggtgacttgacagaactacagcacataagaattaactgtatttgttgatgaatgttaaagttcgtgcagggcaccctgggggcacagaggagggaatgggc

SEQ ID NO: 34617 - DNA, 63 bp, Homo sapiens
tgcttttatgtgagactgagctcagagggggcacatccatctctgaggaagccaaagtgagca

SEQ ID NO: 34618 - DNA, 95 bp, Homo sapiens; identical to SEQ ID NO: 68

SEQ ID NO: 34619 - DNA, 93 bp, Homo sapiens; identical to SEQ ID NO: 69

SEQ ID NO: 34620 - DNA, 119 bp, Homo sapiens
aggtgtggggccaggcttaggaaagcctgtgtagtatggagaactggaatctatatatgtctattgttttcttttactgaaaatccgcattaacagctttccctagggggtcttcactt

SEQ ID NO: 34621 - DNA, 94 bp, Homo sapiens
tctggcaatttctcttaggaattgtccccatatattttgttttttaaatctttgggactattgtggggtcattgagaaaagagaataaactagg

SEQ ID NO: 34622 - DNA, 229 bp, Homo sapiens
cactgtatatatatacactgcatatatctgtatatatatacactgtatatatctgtatatatatgcagtgtatatatatgtatatatatacacggtatatatatgtatatatatgcagtgtatatatatgtatatatatacacggtatatatatgtatatatgtatatatacatatatgtatatatatgtatatatgtatatatacacatatatgtatatatacatata

SEQ ID NO: 34623 - DNA, 123 bp, Homo sapiens
tgcttaggattgtcttggctattcaggctctttttttggttccatatgaaatttaaagtagttttttctaattctgtgaagaaagtcaatggtagcttgatggggatagcattgaatctacaa

SEQ ID NO: 34624 - DNA, 90 bp, Homo sapiens
ggataataatctctaaagaaacagatggatgcatatatgcaaactatttatatgtttgtatattcctatctgtaaagtgtttgtatattc

SEQ ID NO: 34625 - DNA, 112 bp, Homo sapiens
ggagatagagtgtgggaggctgagacagccctgtgggtgattctgggatgccaggcagagctgggtctcactctgtctctgaattctgcccctaactccccacagtggggcc

SEQ ID NO: 34626 - DNA, 62 bp, Homo sapiens
tgaaagtccctctgagcctccctcccagcctgagctggttgtgaatcaggggttgtctggca

SEQ ID NO: 34627 - DNA, 73 bp, Homo sapiens
ttattttacatggtcactactagggacacctccagcaaagaggtgagtctgtctgtgactggattgtaagtaa

SEQ ID NO: 34628 - DNA, 80 bp, Homo sapiens
agctcagaggttaactggctgacaaccctctttgctgacaccagccatgagtgagtgtctctcagtccctgccctgtgct

SEQ ID NO: 34629 - DNA, 83 bp, Homo sapiens
catagccttgaagagatagagttgggctgctttggatattcatgattttgggctgtctcattttctctctctgccctaatatg

SEQ ID NO: 34630 - DNA, 131 bp, Homo sapiens
catgcctgtgtctgtgtctgtgagtgcctgtgtgtgtgtgcatatgtttgcataggcatgtgtgcctctgtgtctgtgtgtgagatcatgcctatgtctatgtgagtgcctgtgtgtgtgtgtgtgtgtgt

SEQ ID NO: 34631 - DNA, 91 bp, Homo sapiens
ggagagcaacgtggggtgagcagccttcaccacgaggacgtcctgacgacagtgactctctctggctctgccaacctgaccacagcgatcc

SEQ ID NO: 34632 - DNA, 115 bp, Homo sapiens
ggattgtcttggctatacaggctcttttttggttccatatgaaatttaaagtagtttttttctaaattctatgaagaaagtcaaatggtagtttgatggggatagcattgaatct

SEQ ID NO: 34633 - DNA, 91 bp, Homo sapiens
gagtttgaagtgaggttctgagcttagctggttgtttaatttgaggcaagttgtttaacctcattgagactcaggttacttatctataaat

SEQ ID NO: 34634 - DNA, 114 bp, Homo sapiens
gccaccgataaggcctgacacaaatgacgtgcaatagctatcctgtgaatgattaaatgaatgaatgaatgaatggtacctctgttggatgaatcagtgtggcctgtttttggc

SEQ ID NO: 34635 - DNA, 103 bp, Homo sapiens
gtaatgattgctttgccaaacatcacatgctcagtcccctggctgctgagactgaattttgtctctcagactctgacattgagttagcaagtgaaaaaattac

SEQ ID NO: 34636 - DNA, 91 bp, Homo sapiens
caggagcccttccagagaccctccaaacacgagatggtcatgggggccccgtcagtccctctctcagtgaaggctgtctcactagctcttg

SEQ ID NO: 34637 - DNA, 57 bp, Homo sapiens
agtccgctgggctacacagatgggtaagccatgtctcatctctgtctctcagggtct

SEQ ID NO: 34638 - DNA, 108 bp, Homo sapiens
tcagaaactacctgggcttggattctgactctaacactctctctctgttttctgatccataaatatgagaatgatagccacagtatctacctcaaagtgtcattctga

SEQ ID NO: 34639 - DNA, 56 bp, Homo sapiens; identical to SEQ ID NO: 324

SEQ ID NO: 34640 - DNA, 104 bp, Homo sapiens
tagagattcattcaggttgtgtggattaattgtttctttttattgctgagtaatcttctgtggtatggatatagtttaacctttcgcccgctgaaggacatctg

SEQ ID NO: 34641 - DNA, 78 bp, Homo sapiens
gagatggagtctcactctgtcacccaggctggagtgcagtggcgggatctcagctcactgcaacttctgcctcctggg

SEQ ID NO: 34642 - DNA, 112 bp, Homo sapiens
tgtgtggttgatcttagagtatgtgccatatacagataagaagaaagtatattctgttgtcattctgttgttgtggagtgttctgtagatgtcaattaaattcaaccggtca

SEQ ID NO: 34643 - DNA, 82 bp, Homo sapiens
tttttctgtctctctcagtaaaatgcaatgatggtggtgcttgggcagatgaacatggtaaactgagagaggctttgagaaa

SEQ ID NO: 34644 - DNA, 116 bp, Homo sapiens
ttcctgaatgcaaaaaaaacacccatatgcactccattaagaaagtttcatggatatgatatgatttttcaatgaggtttctgggttttttttgtttttttttttttgagatggag

SEQ ID NO: 34645 - DNA, 70 bp, Homo sapiens
catttgacgtacatagtcactgcatgtatatatatatatatgtgtgtgtgtgtgtgtgtgtgtcaaggtg

SEQ ID NO: 34646 - DNA, 113 bp, Homo sapiens
agagattatagtctatagagtaagttatgccttacatatgaatgaatgaatgaatgaatgaatgaatgaatgaatttgacaaagaaggtttttgacagacaacggtagtctct

SEQ ID NO: 34647 - DNA, 111 bp, Homo sapiens
gcattttcagttgtttctatccttttagaaataaatggctaattttatttcttaaaattttgcttttttttttctttccaatatagcgggaaaggggcaggtgtgggaggc

SEQ ID NO: 34648 - DNA, 75 bp, Homo sapiens
cctcatgacaagtgagtcagctctcagcaaccagaattacaagtggactgagctgggtgacggtggagcatgagg

SEQ ID NO: 34649 - DNA, 117 bp, Homo sapiens
catcaagctggatatgtatacatcatatatatatatagtctgtatatatgctctctctctctctgtatatatatatatatatatatatagtctgtatatatgctctttagctttctg

SEQ ID NO: 34650 - DNA, 94 bp, Homo sapiens
gttaatctttctaagcctccatttccttatttgtaaacatgactagggtggatattctgtagagtggatagatgtaaggaacggctgagataac

SEQ ID NO: 34651 - DNA, 84 bp, Homo sapiens
tttgttatgttcagaatttgtagttcagaaaaacctctctaaaagggagagatgttgtaactggatcacaaagaaggtgtcaga

SEQ ID NO: 34652 - DNA, 87 bp, Homo sapiens
ggctgcacacagtggctcacgtctgtaatcccagcacttcgggaggctgaggtggaaggatctcttgagctcagtttgagaccagtc

SEQ ID NO: 34653 - DNA, 85 bp, Homo sapiens
cttaccctgttgaaccttccttagccatcaaactgggaccatagtacaaactttgtgaggctgagtgaagattcagtggaataag

SEQ ID NO: 34654 - DNA, 77 bp, Homo sapiens
ggggatttgggactctgttcaagctcactccacaactgaaaaagcaggagcagagtcagtgtctcagtatcatccct

SEQ ID NO: 34655 - DNA, 70 bp, Homo sapiens
gagtgctgttgagacaatgccatttgtccactttggaaacttgtgcacacacacatgctctcacacactc

SEQ ID NO: 34656 - DNA, 196 bp, Homo sapiens
tatatgtgtgtgtgtgtgtgtgtgtgtgtatggtacatatatatacatgtgtatatgtagtatatatatagtgtatatatacacatatgtgtctatacatgtatatatacgtgtgtctatatatacatgtatatatatacactatatacatgtgtctatatatacatgtgtatatactatatacgtgtgtctatat

SEQ ID NO: 34657 - DNA, 81 bp, Homo sapiens
atttctcctcttggccaactaaaaagaagccagcccacctaggatctgacttttttttatgttattcagaaatggagggat

SEQ ID NO: 34658 - DNA, 93 bp, Homo sapiens
gtgtatctatacctatatctgtatgtctatgtcctagtatatatctatatctataggttagatatacatccagagatgtttgagagattgcac

SEQ ID NO: 34659 - DNA, 102 bp, Homo sapiens
tctacttcaggttattattatgatgatgatttcccttctggaatatgtatcaaactgtatatctttatttattgggaaaacaacaaaataatattgaaggga

SEQ ID NO: 34660 - DNA, 80 bp, Homo sapiens
cgaggggtggggcgcactagatggcattgtggtgagttctctctctttcagtagttccagacgtgaccaagcctaccttg

SEQ ID NO: 34661 - DNA, 80 bp, Homo sapiens
atatacacacacgtgtatatatgtgtatatatatacacacacgtgtatatatgtgtatatatatacacacacgtgtatat

SEQ ID NO: 34662 - DNA, 80 bp, Homo sapiens; identical to SEQ ID NO: 34661

SEQ ID NO: 34663 - DNA, 80 bp, Homo sapiens; identical to SEQ ID NO: 34661

SEQ ID NO: 34664 - DNA, 80 bp, Homo sapiens; identical to SEQ ID NO: 34661

SEQ ID NO: 34665 - DNA, 80 bp, Homo sapiens; identical to SEQ ID NO: 34661

SEQ ID NO: 34666 - DNA, 136 bp, Homo sapiens
gtgtgtgcatgtgtgcatgtaggatgtatatgtatgtataaatatgtatgtgtgtgtatatgtatatgtgtgtgcatgtataaaaaaatatatatatatatatatgtatatacacacacacacacattttcctcat

SEQ ID NO: 34667 - DNA, 117 bp, Homo sapiens
agatggtatctcattgtggttttgatttgcatttctctgatggccagtgatggtgagcatttttttatgtgtttttttggctgcataaatgtcttcttttgagaatgagaagtgtct

SEQ ID NO: 34668 - DNA, 108 bp, Homo sapiens
atatatatatatatatgtgtatgtatatatatatacatacacatatatatgtgtgtatatatatatacacacacatatatatatgtgtatatatatatatatatttat

SEQ ID NO: 34669 - DNA, 80 bp, Homo sapiens
tatatatatatatatacacatatatatatgtgtgtgtatatatatatacacacatatatatgtgtatgtatatatatata

SEQ ID NO: 34670 - DNA, 114 bp, Homo sapiens
gcgtcaccctgcctcggccactggccagccaccctgccaccctgcctctgtctgtcccttttgcagggtgggggcaggagagggggtgggctctaagccgctgctgtatggcgt

SEQ ID NO: 34671 - DNA, 77 bp, Homo sapiens
tctgcttgagacagatctgggttggggtctggagtggtaagtggccccccagtctttctctgtctcttcatagccgg

SEQ ID NO: 34672 - DNA, 108 bp, Homo sapiens
gaggaattgggagagaaatggggaaatgttgcaggctcagggactaggaatgatcaagagaattgagagtgcacatatgatctctagagcatcttctcatcatccatc

SEQ ID NO: 34673 - DNA, 110 bp, Homo sapiens
ttgattttctgtagttttactatgatgtgcctgggtttctttatatttatcttgctttacatttatcctaatagagattcttgagtttgtggtttgctgccttttatcag

SEQ ID NO: 34674 - DNA, 106 bp, Homo sapiens
gtgtcttgaacctcttactggcatttcttatatggtgtatttctaagtgaatatattcttttttatagagaattggcgttatgtcctatgagagaaaagagtccac

SEQ ID NO: 34675 - DNA, 95 bp, Homo sapiens; identical to SEQ ID NO: 68

SEQ ID NO: 34676 - DNA, 93 bp, Homo sapiens; identical to SEQ ID NO: 69

SEQ ID NO: 34677 - DNA, 67 bp, Homo sapiens
cctgggctgtctgtgtctgagtgactcaggctgtgggcctgagtgactatatcgtctggaccccagg

SEQ ID NO: 34678 - DNA, 65 bp, Homo sapiens
gaattttctggatgacatgtctgtttgtttttttaaatggacatcttagtctatttagaaatttc

SEQ ID NO: 34679 - DNA, 90 bp, Homo sapiens
gtggtttgtgagttcccacagtctctctgacattgcattgcatgtggcaggtggtactcatggacggctgaggtgggactcatggtgaac

SEQ ID NO: 34680 - DNA, 95 bp, Homo sapiens; identical to SEQ ID NO: 68

SEQ ID NO: 34681 - DNA, 93 bp, Homo sapiens; identical to SEQ ID NO: 69

SEQ ID NO: 34682 - DNA, 110 bp, Homo sapiens
ggagcagccgtgtgcaggtggagatcctagcgacaggaggaagtgcctgcctgcgtgcgtgcgtgcctgcgtgcgtgcgtgcctgcgtacgtgcgtgcgtgcgtgcgcac

SEQ ID NO: 34683 - DNA, 108 bp, Homo sapiens
cctcgcaggggcaaatggagcgggggccccagcccacatggaactgctattcctgcctctgtgtcgcactgtgtctgtcctcctggcctctgtgtgcataggtaggaa

SEQ ID NO: 34684 - DNA, 76 bp, Homo sapiens
gaaggcagatgatggctgagatgttggagaggggattcttgaagagtccttccaaatctcagattctctgactctc

SEQ ID NO: 34685 - DNA, 68 bp, Homo sapiens
ggcaccatctactggacatttgatgtcttgcagccaactcaggacacatctgtctctgtaagtgtgcc

SEQ ID NO: 34686 - DNA, 70 bp, Homo sapiens
cagctcatgtgtgtggagcacctgctgtattctagctacttgcttgtttggttctgtcacactgatgctg

SEQ ID NO: 34687 - DNA, 126 bp, Homo sapiens
gtgagtgtgcagctcccccaagctcatgtcacaagtgattatgcggctccctcaagctcatgtcacaagtgagtgtgcagctcccctaagctcatgtcacaagtgagtgtgcagctcccctaagct

SEQ ID NO: 34688 - DNA, 63 bp, Homo sapiens
agctcatctcacaagtgagtgtgcagctccccctaagctcatgtcacaagtgagtatgtagct

SEQ ID NO: 34689 - DNA, 62 bp, Homo sapiens
agctcatctcacaagtgagtgtgctgctcccctaagctcatctcacaagtgagtgtgcagct

SEQ ID NO: 34690 - DNA, 115 bp, Homo sapiens
gcctcccccaagctcacctcactagtgagtgtgcccctcccccaagctcatctcacaagtgagtgtgcagctcccccaagctcatctcactagtgagtgtgcagctcccccaagc

SEQ ID NO: 34691 - DNA, 68 bp, Homo sapiens
cggggcagatgaattgggaacacagagcaggcggagcacactcattgcctctgttgtttgctgcttgg

SEQ ID NO: 34692 - DNA, 109 bp, Homo sapiens
tgtatctgtgggttctgcatctgtggattcaaccaaccatggattaaaaattttttttgtaaaaaattcacatctagagtggagggactggggatagttaatgggtaca

SEQ ID NO: 34693 - DNA, 97 bp, Homo sapiens
gcttggtttgttcctgatcgtagaggaaaagttttcagtctttcaccagtgaatatgatgttgactgtgggctttctgtatggggcctttactatgt

SEQ ID NO: 34694 - DNA, 113 bp, Homo sapiens
gtgtgcctctgaaaatgtcgtccagattaccctatcctgctgaacgccaggcatctctgtcacactcagagtgaagcgcaggttctgggaatgacctcgaaaggcctctccac

SEQ ID NO: 34695 - DNA, 70 bp, Homo sapiens
gtgatggcatctgtctctatctgtgtgtgcgtatagagctgtcggcagagatacagagagaactgcctgc

SEQ ID NO: 34696 - DNA, 78 bp, Homo sapiens
tgcatatatgtgtgcatgtgtgtgcatctgcatgtgtgtgtgcgcacatgtgtgcacgcgtaggcatgtgtgtgtgca

SEQ ID NO: 34697 - DNA, 58 bp, Homo sapiens; identical to SEQ ID NO: 1265

SEQ ID NO: 34698 - DNA, 87 bp, Homo sapiens
cttctcagagagttgaatggggtcaggggatagaatctatattttttagttatgggcacttacccatattcaaaaagatttgaggag

SEQ ID NO: 34699 - DNA, 107 bp, Homo sapiens
ggaacggaggagggtgggggaggagggtggggaacggaggagggtggggaccaagcagaccacactcactgagtccctggcgtgtgccactcactgatatcaaagcc

SEQ ID NO: 34700 - DNA, 77 bp, Homo sapiens
agactgtatagtactagcatatatgtgtatatatatatagatatatatatatagatgtatgttagaattgagagtct

SEQ ID NO: 34701 - DNA, 85 bp, Homo sapiens
tcatgcacctgtgtctgtgtgtgtgtatgcgtgagtgttctaaatgccattcatttcatacacctgtgtctgtgtgtgtgcgtga

SEQ ID NO: 34702 - DNA, 74 bp, Homo sapiens
tatgcctgagtgatattcacatatatatattcatatatatctgtgatgtgtgtatgtgcctctctctctctata

SEQ ID NO: 34703 - DNA, 83 bp, Homo sapiens
atatatgtgtgtgtatatgtatactattttatatatatctactatattatataggtgtgtgtgtgtatatatatatatataga

SEQ ID NO: 34704 - DNA, 141 bp, Homo sapiens
gatagaagattcggagctcagaactgttttctccccttcctctcagggtagaggatttctctctctctctctctctcgctctgtctctctcaacaatgagtctttaccagtaccttgagggtgacaagatttgagagaggg

SEQ ID NO: 34705 - DNA, 72 bp, Homo sapiens
atgtatgtgtgtatatatgtgtgtgtatatatatgtatgtgtgtgtatatatatgtgtgtatatatgtacgt

SEQ ID NO: 34706 - DNA, 90 bp, Homo sapiens
cttgcctcaacccgtggactctgctcttgctgagacagggagcaccctccgtctgcatcagcagctgccctcctgtcacctgagtgggag

SEQ ID NO: 34707 - DNA, 120 bp, Homo sapiens
ggaggcatgaactcacctccttcaggaggcacgcttctccccggagcttgctctcactgtctctgggcttctctggggggaactgcagcctggtaatgcagggggatggggaccagcccc

SEQ ID NO: 34708 - DNA, 96 bp, Homo sapiens
gagccaccaagctgggagttcccgtggtcaccgtgtgcatgggcttgaccccatgttcgtgtctctcactgtgtctgtgccatgctgccatggttc

SEQ ID NO: 34709 - DNA, 86 bp, Homo sapiens
aatgatcaccattctaactggtgtgagatggcatctcactgtggttgtgatttgcatttctctgatggccagtgatgatgagcatt

SEQ ID NO: 34710 - DNA, 95 bp, Homo sapiens; identical to SEQ ID NO: 68

SEQ ID NO: 34711 - DNA, 93 bp, Homo sapiens; identical to SEQ ID NO: 69

SEQ ID NO: 34712 - DNA, 93 bp, Homo sapiens
taatatatatttgaatgtatatgtattcataaatgaacatatatattaataatgtgttcattatttatataatatatattcatatatacatta

SEQ ID NO: 34713 - DNA, 67 bp, Homo sapiens
ctgggcttcgctctttgaccagtgaagtgtgagcagagttcacatctgtctgggtgaaagcttccag

SEQ ID NO: 34714 - DNA, 162 bp, Homo sapiens
ccacgaggtacacgcatgtgtgtgcatgtccatgtgcaggtttgtgtgcgcctgcatatctgtgtgtctgtgtgcgtgtgtgtgtgtggtgcgtctgcatgtgcaggtgtgtgcgtgcgtgcctgcctgtgcgtgcaaacgtgtgtgcgcatgtgtgtggtc

SEQ ID NO: 34715 - DNA, 88 bp, Homo sapiens
ttgggagcccagatgcttctgtttgaatcccaactctgtcacttactctgtgaccttgggaacattactgaacctctctgtgcctcag

SEQ ID NO: 34716 - DNA, 93 bp, Homo sapiens
cgagtctagttagcctccatgagctttgttacaataccttcaacctaaggagagaaggttgataagtttgcaaatctaaggactagatccttg

SEQ ID NO: 34717 - DNA, 115 bp, Homo sapiens
gtttgaccagatgttttaagagtgcatgctattcatccaagatgagctatctaactatgctctgtttctctgactctggctgccatgcctcataattggcatcactccttcagac

SEQ ID NO: 34718 - DNA, 113 bp, Homo sapiens
tagtgttcatatttcattttatattttaagaaaaccttcattattttgtcttttttttttttttttgagacagagtcttgcttttctgaccaggctagtgtgcagtggcacta

SEQ ID NO: 34719 - DNA, 78 bp, Homo sapiens
tgctatttgggctcttttttggtttcacatgaattttaaaatagtttttttctagttctgtgaagagtctcagtggta

SEQ ID NO: 34720 - DNA, 109 bp, Homo sapiens
gggtgtggctcagacaaggcagccgtggcctgagactttatgatttttttttgcaaggctaaccagaagtttatcagcagtgtcatgtcagccttgagttttatttccc

SEQ ID NO: 34721 - DNA, 98 bp, Homo sapiens
tgtggtggtgcgtaactgtagtcccagctatgtgagaggctgaggtaggaggatcacttgagcccaggagttagaggctgcagtgagctgcgaccgca

SEQ ID NO: 34722 - DNA, 104 bp, Homo sapiens
agagatttactcatctaggagcactgagctagttgtttgtatagctgggactagaatctagcttttattactaaagagtttatgtttaatctgtctaggtcttt

SEQ ID NO: 34723 - DNA, 115 bp, Homo sapiens
cagtttatcagtaacttatatggtcaccctacttaatctttcagttctttttttccttatctgtagagagagagcagtgcctggtatatagtaaatgtcatgtaagtgcttgctg

SEQ ID NO: 34724 - DNA, 86 bp, Homo sapiens
gaggctggggaatgagcagcaactgatagcattttgaaggaggatcaagtctggaatctcactatgcttctctcatctccttcctt

SEQ ID NO: 34725 - DNA, 118 bp, Homo sapiens
gagcatgtgtgtcttttaaagctctgtcatttatcggctgtgagaacatggccaaaatactcagcctctctgagcctcagttttctcgccagtaaaatgggtctgattacacattctt

SEQ ID NO: 34726 - DNA, 86 bp, Homo sapiens
tttgaaacagggtctcactctgtcacccaggctgagtgcagatgtgtgatcatggctcactgcagcctcgacctccctggctcaag

SEQ ID NO: 34727 - DNA, 82 bp, Homo sapiens
gagagagagatcacagtgcccagacagaacagcacgagtaccccagtgttctgcctttcagtccaggactgtgcccctcctc

SEQ ID NO: 34728 - DNA, 74 bp, Homo sapiens
ttggtcttggagaaggtggaaggaagaatgatgtgccttagaaaggagatctgaccctctttctctgagactgg

SEQ ID NO: 34729 - DNA, 113 bp, Homo sapiens
tctgggcatgggggtacttgcctgtagtcccagctacttgggaggctgaggtaggaggatcacttgggcccaggaggtccaggctgaagtgattgtgccattgcactccagcc

SEQ ID NO: 34730 - DNA, 120 bp, Homo sapiens
atggtctcatttatatgaattaagattatgcttttgctccttcagggcacacttgagtgattttctagtagtgttttgctcaaatgccaagtgttataaatttgtagactgccagactgt

SEQ ID NO: 34731 - DNA, 112 bp, Homo sapiens
gtgtaacagagcacgtgaaaaggctttgtaaattataaaatgccatataaatgtgaatttttatgatagcgatgataattagggatcttttttaggacagctcctgatatat

SEQ ID NO: 34732 - DNA, 87 bp, Homo sapiens
ggcggcccatctgtctgtccgtctgtccgtccctggcccgagcactgactgggctaggctgggccggacaagggagaggggagtgcc

SEQ ID NO: 34733 - DNA, 115 bp, Homo sapiens
ttcgaatggaagacttgtgtctttgtcagataggaagaacgtaaaaaaatttttaaatttaaaagaatttaaaacccaggcagaattccatcaggcaatgaaaagactggttgaa

SEQ ID NO: 34734 - DNA, 95 bp, Homo sapiens; identical to SEQ ID NO: 68

SEQ ID NO: 34735 - DNA, 93 bp, Homo sapiens; identical to SEQ ID NO: 69

SEQ ID NO: 34736 - DNA, 105 bp, Homo sapiens
acaagcttaagccactgcatctggccaaagaactaaaattctttttttttcttttttaattatactttaagttctaaggtacatgtgcacaatgtgcaggtttgt

SEQ ID NO: 34737 - DNA, 85 bp, Homo sapiens
gcctgtgaggcaatggtagaagttactgttgctcctggttctaattgaataatttactgtaaatagcctccatttcctccagtgc

SEQ ID NO: 34738 - DNA, 71 bp, Homo sapiens
atatatatgtgtacatatatatgtatatatatgtgtacatatatatatatatgtatatatatatatgagac

SEQ ID NO: 34739 - DNA, 227 bp, Homo sapiens
acacacatatatacacacacatacgtgtgtgcgcataaaataataaacatattttatatatatacatatatatgtgtgtgtatgagagtgtgtatatatgtgtacatatatatgtatatatatgtgtacatatatatgtatatatatgtgtacatatatatatgtatatatatgtgtacatatatatatgtatatatatgtgtacatatatatgtatatatatgtgt

SEQ ID NO: 34740 - DNA, 95 bp, Homo sapiens; identical to SEQ ID NO: 68

SEQ ID NO: 34741 - DNA, 93 bp, Homo sapiens; identical to SEQ ID NO: 69

SEQ ID NO: 34742 - DNA, 75 bp, Homo sapiens
gagtccgtgtgaagagaccaccaaacaggctttgtgtgagcaacatggttgtttatttcacctgggtgcaggtgg

SEQ ID NO: 34743 - DNA, 82 bp, Homo sapiens
caggcgtgagccactgtgcccagcccttggctactttttatatttttagtacagacagggtttcatcatgtcggccagtctg

SEQ ID NO: 34744 - DNA, 88 bp, Homo sapiens
tagaagagaagagctgagtcattcagactccttggttcatggcatgttggttaccccatcagtccgtgtgactccctctacccttgta

SEQ ID NO: 34745 - DNA, 109 bp, Homo sapiens
tgttaagagaaggaaagcttgccagaatctttttagtctgcatttgaatttttttctttcaagtgttgaatgaaatactaactctgaaactcttcttagaatctaaaca

SEQ ID NO: 34746 - DNA, 82 bp, Homo sapiens
ggtgagtctcatgagacatcttaggcttgttcagttcatgagcatcatgttcacagatgacacaaagctcagagtaattgct

SEQ ID NO: 34747 - DNA, 73 bp, Homo sapiens
gatgtctgtggcaggcaggctctataaaggcccctagtgatcactgcctcctggaatctgtgccctagtaatc

SEQ ID NO: 34748 - DNA, 68 bp, Homo sapiens
ttgtagagacggagtctcgctctgtcgctcagcctggagtgcagtggcgtgatctcggtttgctgcaa

SEQ ID NO: 34749 - DNA, 90 bp, Homo sapiens
gcaactcctctgggtgtctcactctgtctatctatatatatatatatgggaaatgactagtttgaacatttccagaaataactgaactgc

SEQ ID NO: 34750 - DNA, 65 bp, Homo sapiens
agccacagggtgttactgagactgggaccagtcctctgtctctctggcactcagtcctgtgtgct

SEQ ID NO: 34751 - DNA, 88 bp, Homo sapiens
gctgctctaatacttggtcaaccatttctgagtgcctgacaaaccttactctcactcactgacagttgaaaagctctcgtttggcagc

SEQ ID NO: 34752 - DNA, 108 bp, Homo sapiens
tctgttttgagactgtttatttttgctcctcaaattttggctaggtgggcaaattcagtgtagtgtagagattttgtagtagagaaattgaaagtgtttagaaacaga

SEQ ID NO: 34753 - DNA, 70 bp, Homo sapiens
gactcactccctgtcagccactgccacatgcctgccgtgggcagcattggaggacagggggtactctgtc

SEQ ID NO: 34754 - DNA, 112 bp, Homo sapiens
ggctctggtattgagtgcatgtaagcttatttatttatttatttatttatttatttatttatttatttatttatttatttttgagatggagtttcactctgttgcccaggct

SEQ ID NO: 34755 - DNA, 69 bp, Homo sapiens
ggtcaggtgttgagattggattctagtttattttttatgaatcagataaagatttctgtgcatgagacc

SEQ ID NO: 34756 - DNA, 81 bp, Homo sapiens
cagtaagaccattccaggcttggcattgtatgtcctggcttgggtagggacttcatgcttctaggttggattgtttacctg

SEQ ID NO: 34757 - DNA, 70 bp, Homo sapiens; identical to SEQ ID NO: 34753

SEQ ID NO: 34758 - DNA, 86 bp, Homo sapiens
acgacaatcatttcttagttgagaggggaaaggggaaaaatcgagaggttggacttttctttcttttttattttttgagttggagt

SEQ ID NO: 34759 - DNA, 71 bp, Homo sapiens
gaagaggggcttctccagagctggtcactgttgtgggaaacttggactcagtctcactgagaccttccttc

SEQ ID NO: 34760 - DNA, 60 bp, Homo sapiens
gttggtctcactttctgtctcacacatgcaatcctgtgtaagagggaatgtggaacccac

SEQ ID NO: 34761 - DNA, 70 bp, Homo sapiens
caatttgggaggctgaggtaggtggatcacttgaacccaggagttcgaggccagcctgggcaccatggtg

SEQ ID NO: 34762 - DNA, 97 bp, Homo sapiens
agcccaggagttcaaggctaacaagaccccatatcttttttttttttttttttttgaggcagggtctttttgtcacccaggctttgtcacccaggct

SEQ ID NO: 34763 - DNA, 84 bp, Homo sapiens
ctttgctgcatgagtgagacctgaggctgagtagaggaagggaccctcacctctcggacacactcactcagaattcagcctgag

SEQ ID NO: 34764 - DNA, 58 bp, Homo sapiens
ttgttggcaagtgaggttggggaggacaactggtctgcctctgtctctgtgtttgcag

SEQ ID NO: 34765 - DNA, 73 bp, Homo sapiens
gcagggagggatgcagacagcagagagagagctcagtgaatcacttttctctgctagtgatggtttctgatgc

SEQ ID NO: 34766 - DNA, 104 bp, Homo sapiens
cctagaagcaccaagcacacaggcctggaagtcagtctttctctgtcagtagggtcaaggccaccaggtgacaggacttctgtgcactgtgcaaagctgcgagg

SEQ ID NO: 34767 - DNA, 89 bp, Homo sapiens
ggatatgtggtgtgtccaaggtcacagaacttagtgagagggcagcaccctgagtccaacccagatctgtttgaccccaaaggccatgc

SEQ ID NO: 34768 - DNA, 105 bp, Homo sapiens
cccccacccccacccacctcaccatttgctatcactgccacctatgtggtcagctgaggttgtgtgcacttaaggagttggctaggatacagaggggagctgggt

SEQ ID NO: 34769 - DNA, 95 bp, Homo sapiens; identical to SEQ ID NO: 68

SEQ ID NO: 34770 - DNA, 93 bp, Homo sapiens; identical to SEQ ID NO: 69

SEQ ID NO: 34771 - DNA, 79 bp, Homo sapiens
gcgtgtacacctactgtgatattaaaagttatatatctccctagggtattgtgaataatatcacagtgggtgtacacac

SEQ ID NO: 34772 - DNA, 112 bp, Homo sapiens
tttgtaatcttatagggagatattactgtaaatatcacagtgggtgtacactatgtatactatgtatacacccactgtgatgttatttgtaatatcttagagatattacaga

SEQ ID NO: 34773 - DNA, 116 bp, Homo sapiens
ccctgtgatattatttgtaatatttttggaaaaatgactcaatatcacagtgggtgtacacactgtgatattattcatcatatcctagaagtagattactcctattgtcacagcgg

SEQ ID NO: 34774 - DNA, 82 bp, Homo sapiens
ttgctttataaaagtcattaagttgtacatttatgcttgatgtagttttctgtataatatttatgtcttttatatattgcag

SEQ ID NO: 34775 - DNA, 58 bp, Homo sapiens
tgagatagagtctcattctgtcactcaggctggagtgcagtggtgtgatcctgggtca

SEQ ID NO: 34776 - DNA, 81 bp, Homo sapiens
ggggtctaactctgtcaccctcactgcagtgagccaagatcatgccactgcactcctgcctgggtggcagagtgagactct

SEQ ID NO: 34777 - DNA, 86 bp, Homo sapiens
tttcttttttgagacagtctcactccgtcacccaggctggagtgcagtggcgtgatctcagctcactgaaacttttgccttctggg

SEQ ID NO: 34778 - DNA, 73 bp, Homo sapiens
gagacagagtctcagtctgtcacctaagctggagtacagtggtgcaatctcaactcactgcaacctctgcctc

SEQ ID NO: 34779 - DNA, 67 bp, Homo sapiens
ccctagtgtctctctgtgtgtcctaatctcctcttcttatgaggacatcagtcggattgaattaggg

SEQ ID NO: 34780 - DNA, 87 bp, Homo sapiens
taaggcaatctggctctctgtgtctcaaatttgaaatttgggaattttttttttttttttgagacgcagtctcgctctgtcaccttg

SEQ ID NO: 34781 - DNA, 76 bp, Homo sapiens
ctcaagtgcccctgggtttcctggaggaggcaggtgtggtgagacagctgacagacaggagaagggatgctctgag

SEQ ID NO: 34782 - DNA, 58 bp, Homo sapiens
taggaagaaagaaaacaggggccccagggttgggtgcatctgtctgtctgtctttctg

SEQ ID NO: 34783 - DNA, 312 bp, Homo sapiens
tgtatatatacacacacgtatgtatatatatatatacacacacacacatatatagtgtatatatacacatatatatacgtatatatatacactatatatgtatatacatatatgtatatgtgtatatatgtgtatatatacatgtatatgtgtatatatgtgtatatatatacatgtatatgtgtatatatatacatgtatatgtgtatatatatacatgtatatgtgtatatatatacatgtatatgtgtatatatatacatgtatatgtgtatatatatatacatgtatatgtgtatatatgttttgtat

SEQ ID NO: 34784 - DNA, 90 bp, Homo sapiens
atatatacacatatacatgtatatatatatacacatatacatgtatatatatacacatatacatgtatatatatacacatatacatgtat

SEQ ID NO: 34785 - DNA, 63 bp, Homo sapiens
gctctgaactgtgaggacagggatccaggctttcaccctctctctgtccctagctgccagtgc

SEQ ID NO: 34786 - DNA, 62 bp, Homo sapiens
cacgctgtgggatctccagggagctttggcctagactgtctctctctgtgattccctgtgtg

SEQ ID NO: 34787 - DNA, 59 bp, Homo sapiens
tgagcttcctaggccaggggtcatgtctctctctttgacagtgcctggattggtgctca

SEQ ID NO: 34788 - DNA, 58 bp, Homo sapiens
tgagacagagtctcactctgtcgcccaggctggagtgtagtggtgtgatttcggctca

SEQ ID NO: 34789 - DNA, 100 bp, Homo sapiens
gagcagtctgccacctgggcccctctctacgtcagtccctccctgtggtgggcaggaggggggctggcaggcctggggcccctcagcagcctggaagctc

SEQ ID NO: 34790 - DNA, 58 bp, Homo sapiens; identical to SEQ ID NO: 1762

SEQ ID NO: 34791 - DNA, 83 bp, Homo sapiens
gtgcacatggcatgtgaagtgtgtgtgttctgtaggtgaggggtgcacagcatgggaggtatacgcatgtgtgaggtgtgcat

SEQ ID NO: 34792 - DNA, 71 bp, Homo sapiens
ttaaaaacattcgatgagaggctgtgcaatatttgtttttatattgcacagggtcatttttgtgtagttgg

SEQ ID NO: 34793 - DNA, 89 bp, Homo sapiens
ttgtccaagagtacagaggaatctgggcctgcctggagagcactggggattcttgactggctggcccagggcacctgtgcttggggcaa

SEQ ID NO: 34794 - DNA, 95 bp, Homo sapiens
tgcttctgacagggacacaggttcttgtgttttttttgttttttttttttttttgagacagagttacgctcttgttgcccaggctggagggtgca

SEQ ID NO: 34795 - DNA, 119 bp, Homo sapiens
cttactgattgtttgccttggcgccaagcactgttcatgtatggtatttttttttctatttagtcatcacaaccaccatatgaagtgggtactattgtttgctatgttttacaagtgag

SEQ ID NO: 34796 - DNA, 62 bp, Homo sapiens
catttactatgaatggagctttcaggactggaagttgttctgggtgagtcagtgagtgagtg

SEQ ID NO: 34797 - DNA, 79 bp, Homo sapiens
gagctaaggccagaattaagactcagaccatttctctgacaccctcagtgtcatggaggctgagcaagatatttagttc

SEQ ID NO: 34798 - DNA, 99 bp, Homo sapiens
tatatgtgtgtgtgtatatatatgtgtgtatatatattttatatatattttaatatataaaatatatatattatatataatatatatataatatatata

SEQ ID NO: 34799 - DNA, 109 bp, Homo sapiens
ttgtggttgttttctacaagggctgagttgcaaacacatctgtctttgcaggccatttgctctctgtcattgtgtctgttttttatcactgtgtaataaatcaccacaa

SEQ ID NO: 34800 - DNA, 73 bp, Homo sapiens
ggacacccagtcagctgccggacactcaggtaaggaggtactggagccaaactgtctgagtgactgggtctgc

SEQ ID NO: 34801 - DNA, 89 bp, Homo sapiens
caggtgtgcgcaaccatgcctggctaattttcatattttttgtagagaccaggtttctccatgttttccaggctggtcttgaactcctg

SEQ ID NO: 34802 - DNA, 70 bp, Homo sapiens
taagctccttgcagagaagttagaggctgcagcccctcctcctcttgccctctctctgcctgtgtgctta

SEQ ID NO: 34803 - DNA, 111 bp, Homo sapiens
gtaaggatggctgggcctggtaggctagaaagggctcagcatgtcagtcactgaagacagtgaggtaagaggtgggacttgattctggagccagggacttagacatcagac

SEQ ID NO: 34804 - DNA, 90 bp, Homo sapiens
cagcctcaggattgggaaaggggagagatgtaaaggagggggtaatcattttggcctcaccctggtttgatgtgcttctaactgatgctg

SEQ ID NO: 34805 - DNA, 111 bp, Homo sapiens
ccctataccagttcctggggacacaaagctcagtgaccctgtgtccctgtctggggggagaagtgtgtggctcacagcccagtttccctgagagcagaggagcaggaagct

SEQ ID NO: 34806 - DNA, 114 bp, Homo sapiens
gccaggtgtggtggcacatgcctgtagtcccagcttctccagaggctgaggtggtaggatcacttgacccgggaagttgaggctgcagtgagccatgatcatgcactgtaaggt

SEQ ID NO: 34807 - DNA, 80 bp, Homo sapiens
cagctgtcagtcactgtgtgtggcctaattatgaagattttaaaatacaacttgaggccaggtgcggtggctcacacctg

SEQ ID NO: 34808 - DNA, 58 bp, Homo sapiens
tgaaacagggtctcactctgtcacccaggctggagtacagtggtgggatcttggctca

SEQ ID NO: 34809 - DNA, 82 bp, Homo sapiens
acttcaccaggtaatgacaaactcgtggggtttttttgtttttttttgagacagagtttcattccatggcccaggctggagt

SEQ ID NO: 34810 - DNA, 98 bp, Homo sapiens
acagagttgtttaatgttttataaattgagtgtatatttcttatatgttattgtatatgaaatatttcacaatagaacattttaaaaatacattttgt

SEQ ID NO: 34811 - DNA, 221 bp, Homo sapiens
gcaaaatatatatatatatatgtatatatatatacgtatatatatgtatatatatatacgtatatatatgtatatatatacgtatatatatgcatatatatacgtatatatatacgtatatatatacgtatatatatatgtgtgtgtatatatatatgtgtgtgtatatatatatatatatatatatatatatatatatatatgtgtgtatatatatatat

SEQ ID NO: 34812 - DNA, 94 bp, Homo sapiens
ccagcctgggcgacacagcgagatccccatttctacaaaaaaaatttttttttttttctttggagatggagtctcgctgtgtctcccaggctgg

SEQ ID NO: 34813 - DNA, 110 bp, Homo sapiens
gtaattcctttgcctttatcacagggtattaccatgtaattccaataaatattatttatttttttatttttttgagatggagtctcgctgtgtcacccaggctggagtgc

SEQ ID NO: 34814 - DNA, 57 bp, Homo sapiens
tgagactgagtctcactctgtcacccaggctggagtgcagtggccgatctcagctca

SEQ ID NO: 34815 - DNA, 70 bp, Homo sapiens
gcagacagacagacagacagacctcttctctatggagcggtttagggactcggtcctgtcgatgagctgc

SEQ ID NO: 34816 - DNA, 172 bp, Homo sapiens
cagggcgacaagagtgaaacgctgtctcaaaaaaaaaaaagtaatttcttcttgttctgctgttttttcttttattttttttgtttttgtttttgagacagagtctcactctgtcacctgggctgcagtgcagtggcgaaatttctgctcactgcaacctccgcctcctggg

SEQ ID NO: 34817 - DNA, 75 bp, Homo sapiens
ctgggtgtgtctgtctctttccctgtgagtatacttggaactaggtatatctgggtgtgccagatacattctcag

SEQ ID NO: 34818 - DNA, 109 bp, Homo sapiens
tatatcatatgatgttatattggatgaatataggatatgtatatcatatatgtatgtatatatgatatacatatcctattatacctatatataaaatatatataatata

SEQ ID NO: 34819 - DNA, 81 bp, Homo sapiens
agtcacttaacctctctgtgcctcagtggctccccatgtaagacatgggcaatcatgtcaacctgcagcacagttgtgact

SEQ ID NO: 34820 - DNA, 119 bp, Homo sapiens
ccagagcgggctccgggcgccggcgagcaggcgggcaggctggcgggaggatgcgcgcgcgagtgtgcgtgtgtctgcgtgtgtccctgcttgtgtctgtgccagtgtgtatgcgacgg

SEQ ID NO: 34821 - DNA, 107 bp, Homo sapiens
gaaacactactgatttttataatgtgtagctttactgaatttgtttatcagttccagtggatttttggtggagtatttcagtttgctttatataaggtcatgtcatc

SEQ ID NO: 34822 - DNA, 109 bp, Homo sapiens
cacaatgaacatacttcatgatcaatcacatgtaatactttttttattatttcaatagatttagggggaacaggtggtgtttggttacatgaataagtttttaatggtg

SEQ ID NO: 34823 - DNA, 119 bp, Homo sapiens
gaagtgtctgtttatatatatcctttgcccactttttgatgaggttgtttgtttttttcttataaatttgtttaactttggccaggtgtgttggctcatgcttgtaatcccagtacttt

SEQ ID NO: 34824 - DNA, 95 bp, Homo sapiens; identical to SEQ ID NO: 68

SEQ ID NO: 34825 - DNA, 93 bp, Homo sapiens; identical to SEQ ID NO: 69

SEQ ID NO: 34826 - DNA, 82 bp, Homo sapiens
catgcacctgggatgtctctctgtgtgtctgtatgtgttgtagggtcacgcatctgggatgatgttgctccttatgtgtgtg

SEQ ID NO: 34827 - DNA, 80 bp, Homo sapiens
ctcaactatggggcagtgacctagagtctgaaaagtctgctgaaatgcttgctctgtatgactgtctggtatcagttggg

SEQ ID NO: 34828 - DNA, 107 bp, Homo sapiens
cctggaggcaagggcttcttctgcaggaatgcaaggtagtggtagtaggtagttctgcaatgcctgtgacctaagcatctgcagggtctctagaaaatgctttcagg

SEQ ID NO: 34829 - DNA, 70 bp, Homo sapiens
ccccactcactgtcactgtgtcatgtctcctggaggcaggaagagaaaagtctaggcagaatatgtgggg

SEQ ID NO: 34830 - DNA, 84 bp, Homo sapiens
ggcgtgggtaagtagacagtgagtagagaccggttcccaaacttcacagggcattcgtctcacttggattcatcttcctgttcc

SEQ ID NO: 34831 - DNA, 117 bp, Homo sapiens
gcgatagtgaactcttgtaagatctggttgtttaaaagtgtgtggcacctcgctcactctctcttgctctgcttccaccatgtgaagtgcctggtcctgctttgccttcccttctgc

SEQ ID NO: 34832 - DNA, 58 bp, Homo sapiens
tgagatggagactcactctgtcactcaggctggagtgcagtggtgctatctcagctca

SEQ ID NO: 34833 - DNA, 87 bp, Homo sapiens
gaaggcctggcctgtgacttgtctggcacctggaatcctaaattggcatttaacagggaatgaagttttactgcaggaagggacttc

SEQ ID NO: 34834 - DNA, 69 bp, Homo sapiens
cttctcatcactcccagtcactctctaagcactcagccttgctcttgggtggtgggtggagtcctgaag

SEQ ID NO: 34835 - DNA, 128 bp, Homo sapiens
gcccgaggaagaggatggcagcctggctttcccacctggccaagctgacttcctgaatcgggcactcactcactcactcgttcactcagctaatacggctgatggttgcaggaaaggtgggaggtggg

SEQ ID NO: 34836 - DNA, 113 bp, Homo sapiens
ggattgtcttggctgtacgggctcttttttggttccttatgaaatttaaagtagtttttttctaattctgtgaagaaagtcaatggtagcttgatggggatagcataaagtct

SEQ ID NO: 34837 - DNA, 58 bp, Homo sapiens
tgagatggagtctcgctctgtcgctcaggctggagtgcagtggcaggatctcagctca

SEQ ID NO: 34838 - DNA, 105 bp, Homo sapiens
tctctctgaacattcatctgtaatcacatctctctctgactgtctacagtggggaaagtttctccacttttatggattcgcatgaatagattatgctcacctgga

SEQ ID NO: 34839 - DNA, 86 bp, Homo sapiens
atgtctgtgtgcaaacatgtgtgcacccaatgagatgtgcttttcaaagacactgtcatgcaatgtacacaacactgtgcagacat

SEQ ID NO: 34840 - DNA, 71 bp, Homo sapiens
gcgcagcagtgagaatggactgagtgccactgatgtgtgtgctccatggctccgtggctccgtggctccgt

SEQ ID NO: 34841 - DNA, 102 bp, Homo sapiens
ggctcagagggtcccatgcccacacagcctcactcactgctagcagagcagtctgagatcgaactgcaaggcagtagcgaggctgggggaggggcacccgcc

SEQ ID NO: 34842 - DNA, 67 bp, Homo sapiens
aagcaacgtcctgagtgtctcactcacaggcaccccctacagagtgagggatggggccagggcttgt

SEQ ID NO: 34843 - DNA, 118 bp, Homo sapiens
tgcctgtgtccaactatatgaggcatcagtctgtagttgcttttctgtctccttcactgtctgtgagctcctggagagcagggagcatgtcatatgcctcctggcacaggacatagca

SEQ ID NO: 34844 - DNA, 56 bp, Homo sapiens
tctctctctgtgtgtatgtgtgtgtccctaccatgcacacacacagtctagtaaga

SEQ ID NO: 34845 - DNA, 89 bp, Homo sapiens
tggccactgtatggggaggagtgggagctataggcatggtagttttcattccttagaagctgtctcactgtctctcttgttaggtacta

SEQ ID NO: 34846 - DNA, 58 bp, Homo sapiens
tgagacagggtctcactctgtcacccaggctggagtgcagtgttacgatcttggctca

SEQ ID NO: 34847 - DNA, 90 bp, Homo sapiens
ggcactatgtggttgggatattaggtaacctttttcctgtgcaagtacagacaaaagagagtgtcctatcttggcgttcgttcatcggcc

SEQ ID NO: 34848 - DNA, 78 bp, Homo sapiens
agcctcacactctgtgattctcatgtaccactgagaacatttggaagcagaagtggaacatgctacaggtgtgtggct

SEQ ID NO: 34849 - DNA, 81 bp, Homo sapiens
tcctctctgagactgtgagtccctgggaagcagagtctgtgtctcaattctgcctgtcacgacaaccagtccagtgctgga

SEQ ID NO: 34850 - DNA, 79 bp, Homo sapiens
ttgtattttagagaaaggatatatagcagaaccataagttcacacattggttttgaaatgtatccatatttagagacaa

SEQ ID NO: 34851 - DNA, 94 bp, Homo sapiens
cggggtctgcaagcccaggaaagaggcctcaggaggaacccgccccgcggcaccttgacctcggactctctctctcacgctgtggtactttctg

SEQ ID NO: 34852 - DNA, 119 bp, Homo sapiens
aggatctggatgttcaaggcaatccctgctataagaaatcttagttattgagccaggtgtttattattttatttattttttaagtatgttgggatgtgttaggactaatgctggggact

SEQ ID NO: 34853 - DNA, 84 bp, Homo sapiens
catgcctctgccactgtctgtcactgtgcccacctgtctctggggttgggccccaattatcaacagcagcctagagaaagcatg

SEQ ID NO: 34854 - DNA, 85 bp, Homo sapiens
ctgcttctgtgacagctactgcttctgtctccactctacagcctggatgaggacatgctcagggctgcagaatcacagaggctag

SEQ ID NO: 34855 - DNA, 72 bp, Homo sapiens
gctgagaatgctgcccttgagcaccggctttggccttcaccccatcactaactcactgcttgaattctcagc

SEQ ID NO: 34856 - DNA, 109 bp, Homo sapiens
cccacaagagggagggcaactttgctgatagcctgaagatgtatttctatgaatatttattgatttattttccaggcttagcaggggagctgcaaataaatttagtggg

SEQ ID NO: 34857 - DNA, 113 bp, Homo sapiens
agattcaaagtttagaaaaatgctccttccttatcagttggcaggtgacaaatcacagtgagattacttttggcaaggaggatattttcccataacaatctagaagacagagt

SEQ ID NO: 34858 - DNA, 58 bp, Homo sapiens; identical to SEQ ID NO: 1435

SEQ ID NO: 34859 - DNA, 116 bp, Homo sapiens
tcaggtgtttggggtttataaggtactgtgtggttaacatgcaagtttttcattgattttctatgaatattttaactttatcttttctagacattgcttaccaacctggacaatga

SEQ ID NO: 34860 - DNA, 81 bp, Homo sapiens
agttactcgacctctctctgcctcagtttcatcaaatacaaaacaaggataataactgcacttgggcagggcacggtggct

SEQ ID NO: 34861 - DNA, 93 bp, Homo sapiens
ttcacaaatatgcacaagcttttgacatcttcagtagagttttacatctgctctattttgattcatgtgataggcactgaaaatatatgtgaa

SEQ ID NO: 34862 - DNA, 99 bp, Homo sapiens
tagcctaatgcgtgggtggacatctcagttggcgagtgaggatcagtgaggggccagctgagtctctctctccatgtgtgttcacctttcagtggtcta

SEQ ID NO: 34863 - DNA, 92 bp, Homo sapiens
gtatcacaaagcttcgggtactgaggctgaggccagccactgtccctgtgcctcacaccccactcccttaattactcagatgttttgtcagc

SEQ ID NO: 34864 - DNA, 104 bp, Homo sapiens
gtgatttaggatgtctgggttcaatcctgctaaaccctagctcactctgtgacactcggcaagtttcctttcacttggtctcagtttccttatgtgatgctagg

SEQ ID NO: 34865 - DNA, 109 bp, Homo sapiens
gttgtagacttgagcaacttgtaggttagctaacctccatatgccttagtatatttatctataaaagtaagataggccagacatggtggctcacacctataatctcagc

SEQ ID NO: 34866 - DNA, 97 bp, Homo sapiens
tcacctggcagccactcccagagcccctggaactctggcccaaggctctctgactgactccttcccagatcttcttggcttggcggctgaagactga

SEQ ID NO: 34867 - DNA, 108 bp, Homo sapiens
ggagaagtagggcagctatgtcagaaagtctttctggtctatacctctgtcactgactgtatgtatgtctgggtcaagtaactctctctggatctgttttccttctct

SEQ ID NO: 34868 - DNA, 58 bp, Homo sapiens
tgagatggagtctcgctctgtcactcaggctggagtgcagtggtgcgatctccgctca

SEQ ID NO: 34869 - DNA, 66 bp, Homo sapiens
ggcaccctccactctgtgagtctctggttctctgccatgacccccagggccatagagcagtgtggc

SEQ ID NO: 34870 - DNA, 112 bp, Homo sapiens
gaattctatggcactaaatttatctgggcccagtctttatttttaattaaataggccgattgtggcagaattcagttaatagggctggaggtaatttttggagttttgattt

SEQ ID NO: 34871 - DNA, 116 bp, Homo sapiens
atcactttgcttttctaggtatgcatatggcgaacggatgagattagtaattttttttttttttttttgagatggagtctcgctctgttgcccaggctggagtgcagtggcgtgat

SEQ ID NO: 34872 - DNA, 187 bp, Homo sapiens
tatatatacacacgtacatatatatgtgtatatatatacatatctatatatacacatgtacatatgtgtgtatatatatctatatatacacatgtacatatatgtgtgtatatatatctatatatacacatgtacatatatgtgtgtatatatacatatctatctatatacatatatgtatgtatat

SEQ ID NO: 34873 - DNA, 120 bp, Homo sapiens
tatatgtacatgtgtatatatagatatatatacacacatatatgtacatgtgtatatatagatatatatacacacatatgtacatgtgtatatatagatatgtatatatatacacatata

SEQ ID NO: 34874 - DNA, 78 bp, Homo sapiens
gctaggggaagactgttcactatctgactcaccacttgccaatctgaagagtgagagctgatggaaacagccgtaggc

SEQ ID NO: 34875 - DNA, 84 bp, Homo sapiens
cctttaacatggtgaataccttagaatgcaaagcacaaaataaagatcgaagttaactttgtatggatatctacctgttggagg

SEQ ID NO: 34876 - DNA, 72 bp, Homo sapiens
gcctcagagtgagatattgactcaataacttttttttttttttgagatgaagtctctctctgtcacccaggc

SEQ ID NO: 34877 - DNA, 83 bp, Homo sapiens
gagagctggaagccagactctcagactcactgtcgtgcacctgaagccagggggtctgggacagtgtcaggcaccaagttctc

SEQ ID NO: 34878 - DNA, 89 bp, Homo sapiens
ggaagagaatgcctctctcatctcatcttgtgaagggacagtcaaggggcattggctggctcggtggatgagtcagggtaatcactgac

SEQ ID NO: 34879 - DNA, 88 bp, Homo sapiens
tcagggtagtaacacaattcaatttctctgttttaaaaatatcactctggctgtagtgaagagaattgattggagcagagtacgctga

SEQ ID NO: 34880 - DNA, 76 bp, Homo sapiens
catatgtcaggctcctgggttgatattcctccaaggctggactcagctggggctatcaactagagcactccatgtg

SEQ ID NO: 34881 - DNA, 111 bp, Homo sapiens
ttaggattgtcttgtccatgcgggctgttttttggttccatatgaaatttaaagtagttttttctaattctgtgaagaaagtcaatgatagcttgatggggatagcactga

SEQ ID NO: 34882 - DNA, 96 bp, Homo sapiens
ggtgccatattgtaaggcaaggttagcttaaatagatctgttaccttttaatggctgttatgttatgtaaactagcttaggcttacgccaagtact

SEQ ID NO: 34883 - DNA, 59 bp, Homo sapiens
gagacacattggtgggaagagagaaaggaccatgactctttgtctcactgtaagtgctc

SEQ ID NO: 34884 - DNA, 82 bp, Homo sapiens
cactaggggatctcagacagtgactacatcacattgtgagacagaacagtgtgtttaaagctcgctgatggttctcttcatg

SEQ ID NO: 34885 - DNA, 76 bp, Homo sapiens
gctctcactgcactaattggattaaacagcagtaatagataattctgtatgaacaacaggaagtgaaggagagagc

SEQ ID NO: 34886 - DNA, 119 bp, Homo sapiens
tgaaaaagtatttttttttggatggaatggaaatatttcctcagtagattttgataatagtttcattatattgatcttctgttataatttctaacattcatctttctcaacaaatattt

SEQ ID NO: 34887 - DNA, 58 bp, Homo sapiens
tgagaccgagtctcgctctgtcacccaggctggagtgcaatggcgcgatctcggctca

SEQ ID NO: 34888 - DNA, 111 bp, Homo sapiens
gcatacatgttgaactggtttcaggacaaaagtatttcttatgcacccactgtgtgtcagtcagggaagagaataccaaataccaaataccacatgttctcacttgtaagt

SEQ ID NO: 34889 - DNA, 106 bp, Homo sapiens
gcaatgaatttgaatatgcttcttggactgttgagtatttctttataagctggaactttaaaaaattttattatagattcagaaggcatatgtgtaggtttattac

SEQ ID NO: 34890 - DNA, 62 bp, Homo sapiens
agattcagcctcaaaaaggaaggacattctttttttttttttttttttttgaggcggagtct

SEQ ID NO: 34891 - DNA, 72 bp, Homo sapiens
agggtttgaggtgaacagaaggatgggtgtgtggcctcatcagtctctgtttctctgtttgcctctgtctct

SEQ ID NO: 34892 - DNA, 70 bp, Homo sapiens
ttgttttgagatggagtctcactctgtcacccaggctggagtgcagtggtgcgatctcagctcacagcaa

SEQ ID NO: 34893 - DNA, 58 bp, Homo sapiens; identical to SEQ ID NO: 2051

SEQ ID NO: 34894 - DNA, 103 bp, Homo sapiens
ccatatgtttgcaatttaagcaaggttagggctattttcattgtttttattgtttctgaaacagggtctggttctgttgcccagtttggagtacagtggtgtg

SEQ ID NO: 34895 - DNA, 113 bp, Homo sapiens
actaaaatgcactgcttcacagagcataggtttttgtatttgtttgactgaactcagtgatcataggacattatttattttccctaagtgaaaaactggctgatgtttttggt

SEQ ID NO: 34896 - DNA, 67 bp, Homo sapiens
gaatatccacttaattcctgggctctgtcactaagtgactgtcacttgaattctgtgtatgatgttc

SEQ ID NO: 34897 - DNA, 109 bp, Homo sapiens
aagcctaacccagaacaagggtctaagtcttgtcaattccatgaaggttgagagaagtaagaaagctgcagaagaggttgaaactatcagaccttggttcaggaggttt

SEQ ID NO: 34898 - DNA, 132 bp, Homo sapiens
tacacacacacatatatgtatgtatatatatagtcatccaggaatttcctttatttatatatacatatatgtgtgtgtgtgtatatatatatataaatatatatgtatatgtgtatatatatgtatatgtat

SEQ ID NO: 34899 - DNA, 95 bp, Homo sapiens; identical to SEQ ID NO: 68

SEQ ID NO: 34900 - DNA, 93 bp, Homo sapiens; identical to SEQ ID NO: 69

SEQ ID NO: 34901 - DNA, 109 bp, Homo sapiens
ctgcagtcctgctcagtaaggaggaagatcagggacttgtgttaaaaaaaaaaaaaaaaaaaaaaaaaaaaaaaagtagtcttgtcactttattgtagagcagctgtgg

SEQ ID NO: 34902 - DNA, 119 bp, Homo sapiens
gccacatgcatgatgcttgttacagaggctcttggctatttctctgcatgtccatctgctaaaatggcaaaatgccctcttggtctatatttgaattcttgcccatagccatggttgcc

SEQ ID NO: 34903 - DNA, 112 bp, Homo sapiens
tgggttttcatggtcttgggcacctccgtccctgtagctctgcagagtatagtccccctcctggctactttccccctgcatgggctggcattgagtgtctgcagcttttcca

SEQ ID NO: 34904 - DNA, 71 bp, Homo sapiens
tttggttttgagtcacacagtctgtgggttccccctgctggctctttaagtattaggactcacaagctaaa

SEQ ID NO: 34905 - DNA, 108 bp, Homo sapiens
ttagagatctatagttgaaaagggaggataattttagaaagtttttgaataattatggatattcttctctgatttgcccccaaattcaacgaataataggttctttaa

SEQ ID NO: 34906 - DNA, 60 bp, Homo sapiens
ttgtatgtatatatatgtgtgtgtatatacattatatatgcatatatatgtatttgtcag

SEQ ID NO: 34907 - DNA, 85 bp, Homo sapiens
cggtggggtaaggggacggatgtaaaggaggctgaaccaagggaagcccatgatccactcctgagtctctgcctctcactcactg

SEQ ID NO: 34908 - DNA, 119 bp, Homo sapiens
gcagtctttaattgaaaggatgagtaagaataacacattatacattgatatatacaatttattgtatttattatgcacatttataatggtgtcttgcctgttttttcattctctattgc

SEQ ID NO: 34909 - DNA, 100 bp, Homo sapiens
gaagttttgtttttctaggactagacatattttttttttaactggggcagaaaatgctttgggtttttcatgtttaatcacagaatttggagaaaacttt

SEQ ID NO: 34910 - DNA, 77 bp, Homo sapiens
gtcttattggaggtgaggaagctgaagtatgggtagggccagtatttttttgttttttccttttatttccagctgac

SEQ ID NO: 34911 - DNA, 95 bp, Homo sapiens; identical to SEQ ID NO: 580

SEQ ID NO: 34912 - DNA, 93 bp, Homo sapiens; identical to SEQ ID NO: 69

SEQ ID NO: 34913 - DNA, 72 bp, Homo sapiens
tgtgtgtgcaactgtgtgtgtgtgtgtgtgcgcgctcatgtgcactcacaggcatgcacatgtgcatatgta

SEQ ID NO: 34914 - DNA, 118 bp, Homo sapiens
gatatttatttgatgtattgatttattttatatatatactctatatgtatttatatatactatatatatagtatgtgcatatatatagtatatgtgtgtatatatatacatctatatc

SEQ ID NO: 34915 - DNA, 166 bp, Homo sapiens
tatatatttgaatatatatatatgctatatatatatattcgaatatatatatgtgctatatatatatttgaatatatatatgtgctatatatatatttgaatatatatatgctatatatatattcgaatatatatgctatatatatattcgaatatatatatatgc

SEQ ID NO: 34916 - DNA, 117 bp, Homo sapiens
agctttattttgtagaatgtgtagataactcatatatgtatttgtatttttattcaaatctctgtatctatatctacatatatatctatgtttatctatctgtatctatattgggtt

SEQ ID NO: 34917 - DNA, 95 bp, Homo sapiens; identical to SEQ ID NO: 68

SEQ ID NO: 34918 - DNA, 93 bp, Homo sapiens; identical to SEQ ID NO: 69

SEQ ID NO: 34919 - DNA, 73 bp, Homo sapiens
atatatgtgtgtgtgtgtgtgtatatatatatataatatatgtgtgtgtgtatgtatatatatacacgtgtat

SEQ ID NO: 34920 - DNA, 95 bp, Homo sapiens; identical to SEQ ID NO: 68

SEQ ID NO: 34921 - DNA, 93 bp, Homo sapiens; identical to SEQ ID NO: 69

SEQ ID NO: 34922 - DNA, 103 bp, Homo sapiens
caagactcaacaattctattaagtgcaaggtggaatcttctcattgtgactttgcccgcatgacagatgatactgagcacttattatgtgtttacagattttg

SEQ ID NO: 34923 - DNA, 85 bp, Homo sapiens
gatagtgggcctgttacatattttcttttttggtgtggggtggaggaggggtaaacagggtctcactctgtcacccaggctggag

SEQ ID NO: 34924 - DNA, 95 bp, Homo sapiens; identical to SEQ ID NO: 68

SEQ ID NO: 34925 - DNA, 93 bp, Homo sapiens; identical to SEQ ID NO: 69

SEQ ID NO: 34926 - DNA, 119 bp, Homo sapiens
tatatatgtatgtatatacatatatgtgtatgtacatatatgtgtgtatatatgtatgtacttatatgtgtgtatatatgtatatacatacatgtgtgtatatacatatatgtatgtat

SEQ ID NO: 34927 - DNA, 140 bp, Homo sapiens
tacatatatttatatatgcacatatataatattcatatatacacatacacatatacatatatgtgtatatatatgtatatgtaatatacatatatacggttatacatatatacatatgtgtatatatgtgtgtgtgtata

SEQ ID NO: 34928 - DNA, 58 bp, Homo sapiens; identical to SEQ ID NO: 502

SEQ ID NO: 34929 - DNA, 95 bp, Homo sapiens
agcaaagagctgagtaaccatgtatatgatatttaagaacaattttggaaatctaatgaatataatgaagttggttggttggtcctaatgttgct

SEQ ID NO: 34930 - DNA, 93 bp, Homo sapiens
gaatctaatgccaatactgatctgacaagaggctgagctcaggaggtaatgcttgcttgcccactgctcatctcctgctgtgtggctgggttc

SEQ ID NO: 34931 - DNA, 58 bp, Homo sapiens
tgagacagggtctcactctgtcacccaggctggagtgcagtggtgtgatctctgctca

SEQ ID NO: 34932 - DNA, 75 bp, Homo sapiens
gctttagtgaacagacagtgctcactgccttagaggatcttatcttctaattgcagtagtgtctttgtcatttgc

SEQ ID NO: 34933 - DNA, 113 bp, Homo sapiens
tatatatatatatatatatatatatatatatatatatatgccttgtggatatgtatatgtatgtgtgtatatatatatatatatatatattcccatatggcttatatttatat

SEQ ID NO: 34934 - DNA, 112 bp, Homo sapiens
taataatatttttgcttatagacatctatgtttagtttatatttataatacttttttgtcagatatatatgaatatacatatatgtctgtaggtgtgtattcttattcatag

SEQ ID NO: 34935 - DNA, 91 bp, Homo sapiens
tgtatatatgtgtatatgtgtttgtatatatacacacacgtatgtatttgtaatatatacattatatatattccatatacatatatatata

SEQ ID NO: 34936 - DNA, 82 bp, Homo sapiens
tatatatggtatacagtggtgtatatatgtgtgtgtgtgtgtatatatatatatatggtatacagtggtgtatatatgtgtg

SEQ ID NO: 34937 - DNA, 67 bp, Homo sapiens
gagatctgatgattttatgagtgtctggcatttcccctgctgacactcattctctctcctgctgctc

SEQ ID NO: 34938 - DNA, 95 bp, Homo sapiens; identical to SEQ ID NO: 68

SEQ ID NO: 34939 - DNA, 93 bp, Homo sapiens; identical to SEQ ID NO: 69

SEQ ID NO: 34940 - DNA, 74 bp, Homo sapiens
aagtagggttggacatgcaggatttattagaaatgttaaattatttctattttatgttgtacttctctttgctt

SEQ ID NO: 34941 - DNA, 61 bp, Homo sapiens
gttcaggaatgtagtgagctatgatcgtgcctgtcagtggccactgcactacagcctggac

SEQ ID NO: 34942 - DNA, 83 bp, Homo sapiens
gtgtgtgtgtggacactgtgtgagtgcatgtgtgtatagccgcactgtgtgtgtgtgtgtggatgctgtgtctgtgagaatgc

SEQ ID NO: 34943 - DNA, 107 bp, Homo sapiens
cctaaaattcaggttccatatgaattttagatgtgattttctaattctttgaaaaatgacattgataatttgataggaatggtgctgaatctgtaaattgctttggg

SEQ ID NO: 34944 - DNA, 104 bp, Homo sapiens
gggtttgtcataaacgtctcctattatattgatttatgttcttccaatatttagtttattgatagtttttaatgtgaagggatgttaaattttatcaaaggcct

SEQ ID NO: 34945 - DNA, 109 bp, Homo sapiens
gattcctaggtattttattctctttgaagcaattgtgaatgggagttcactcatgatgtggctctctgtttgtctgttatttgtgtataagaagaatgcttgtggtttt

SEQ ID NO: 34946 - DNA, 95 bp, Homo sapiens; identical to SEQ ID NO: 68

SEQ ID NO: 34947 - DNA, 93 bp, Homo sapiens; identical to SEQ ID NO: 69

SEQ ID NO: 34948 - DNA, 117 bp, Homo sapiens
actgtgggtgtgtgtgtgcatggtttttataaaacggtagggtagagacagaaagagacagacagaaagagagagaggttctgcccatgtataccctgtgctaaaacttccaatagt

SEQ ID NO: 34949 - DNA, 103 bp, Homo sapiens
gaatctcttggcacaaaaatttaggacccaatttagtccttcttctataattatttatcattataggaccacaactaaaccaaaatttttagtgcatagcttc

SEQ ID NO: 34950 - DNA, 97 bp, Homo sapiens
attgctgggtcaaatggtagttctattttaagttccttgtgaaatctccaggctgcttttcacagtggctgaactaatttacatttccaccagcagt

SEQ ID NO: 34951 - DNA, 132 bp, Homo sapiens
tgtgtgtgtgtgtgtgtgtgtgtatatctatacatacatacatatatatatacacacatacatatatatgtgtatagatatatatacacatacatatatatatacatatgtgtatacatatacacacacata

SEQ ID NO: 34952 - DNA, 101 bp, Homo sapiens
tctgaatgcatctgaaaaagagtctttgttatttctgagaaaattatatatttttcttagaatttatttagaaaattaaactcttcaggtgtcttagtaga

SEQ ID NO: 34953 - DNA, 112 bp, Homo sapiens
acaggtatatatatatatatgtgtatatgtatacatgtatatatgtatatatgtatatatgtatatatgtatatatgtatatatatgtatatatgtatatatgtataaatgt

SEQ ID NO: 34954 - DNA, 125 bp, Homo sapiens
tgtgtgtgtatatatgtgtgtatatatgtatgtacatatatatgtgtgtatatatgtatgtacatatatgtttgcatatatatacatatatacacatatatgtacatatatacatatatacacat

SEQ ID NO: 34955 - DNA, 82 bp, Homo sapiens
attttcagtacattggatttgagtgtttctaggaccactgagctcagtttttctttgtattgaaatccaatgtattctagat

SEQ ID NO: 34956 - DNA, 118 bp, Homo sapiens
agttgtaatatcatggagcacttatttaagttctctcatatatatatatatatattcttgcatatatatgcatatacatgagagaatttaaattccactcactgacatattcttgact

SEQ ID NO: 34957 - DNA, 75 bp, Homo sapiens
gggcacagctttctgtgtcagtctctctggtggagatctaaacttcatcagggctgtgcacagaaggtgatgcct

SEQ ID NO: 34958 - DNA, 117 bp, Homo sapiens
cccagacaatgccacggatgggtttctcattgtaatcttttaaaatattctgactttttaaatttattcagactggggaaaatagagcaaactggtttggggccctttagtattggg

SEQ ID NO: 34959 - DNA, 112 bp, Homo sapiens
tatatatatattctctctacagatatataaagaatatattctttatatatatattctccctacagatatataaagaatatattctttataaatatgtgtgtgtgtatgtata

SEQ ID NO: 34960 - DNA, 95 bp, Homo sapiens
ggctgaggccaggaagccaagtggtctcactcagtgggtcccactcccatggagcccagcaagctaagaaccactggcttcaaattctcactgcc

SEQ ID NO: 34961 - DNA, 119 bp, Homo sapiens
ttgtagtgatatgtaacaagtgctcaaagattgtgggagaaatatatgtgattatatatgtatatacccatatatacatatatagttactctgttgcacaaagagggttaaagctggaa

SEQ ID NO: 34962 - DNA, 118 bp, Homo sapiens
tgttgtacacgtactatatatgagtgtatatatacatatacgtacatatgtgtatatatgtatgtatacatatatgtatgtgtatatacatgtatatatgcatatatatgtgtttata

SEQ ID NO: 34963 - DNA, 109 bp, Homo sapiens
atatatacgtgtgtatatatatacgtgtgtatatatatatacgtgtgtatatatatgtgtgtatatatatacgtgtatatatgtgtgtgtatatatatacgtgtatata

SEQ ID NO: 34964 - DNA, 95 bp, Homo sapiens; identical to SEQ ID NO: 580

SEQ ID NO: 34965 - DNA, 93 bp, Homo sapiens; identical to SEQ ID NO: 69

SEQ ID NO: 34966 - DNA, 58 bp, Homo sapiens
tgagacagagtctcactctgttacccaggctggagtgcagtggtgtgatctcatctca

SEQ ID NO: 34967 - DNA, 114 bp, Homo sapiens
ggaatcaaaccaggggctatagtaaggatcatgcagatgaatgaaatgattggaatagtcattttgtttaactgacttcatttaatttcctagagtcctgacaaaaatgagatc

SEQ ID NO: 34968 - DNA, 83 bp, Homo sapiens
atatatatctgataagactatatatatatctgatatatatagactatatatatcagatacatatgtagtctgaggctgtatat

SEQ ID NO: 34969 - DNA, 100 bp, Homo sapiens
gattgtcatgatgtaactttttttgtttttttttaagaatcagtatggacattatgtggtgaatagactgcgggggcaaaggtgtcacagaatgacaatt

SEQ ID NO: 34970 - DNA, 91 bp, Homo sapiens
tggtgacagaagagagaagaatgagagctgattgagggaggaaggcccttataaaaccatcagatctcatgagaactcactcctatcagca

SEQ ID NO: 34971 - DNA, 112 bp, Homo sapiens
gtagggcagactttgaagaggtgtatgagaagctgttgactttggctaactccatctctgtggatctgcatgcaaatgtctgattgtggaattggggccattgttcatcagc

SEQ ID NO: 34972 - DNA, 117 bp, Homo sapiens
acaaactgtcaaatcacttcagatatagtagagatattatttttcaagcaatgtaaatatctaactatgttgtcttgagtgaatatttcattgcttctgtttattctgcatacatgt

SEQ ID NO: 34973 - DNA, 104 bp, Homo sapiens
ctatgtatatatatgtgtatgtatatgtatatatatgtgtatatatatgtgtatatatatgtgtgcatatatgtgtatatatgtgtgtgtatatatatatatgg

SEQ ID NO: 34974 - DNA, 77 bp, Homo sapiens
tggagagaggagggtacttatcaggaagctgaatgcttgcagaaatccttagatctgagattctctcacactctcca

SEQ ID NO: 34975 - DNA, 74 bp, Homo sapiens
cctgggccaagtcaggctgtgtgtctgtgtgtgtacgtgcgtgggcatttgtgcacagcctaagcacccccagg

SEQ ID NO: 34976 - DNA, 99 bp, Homo sapiens
tacttatagatttctatacttgtataatgatgttaatagatacagataaagtaatttattttaaaatattggtcatgcaattatgggggctggcaagta

SEQ ID NO: 34977 - DNA, 105 bp, Homo sapiens
ctgttgtaacattttctctcatgattagtgcaacacttacttttttaatttagaaaaagtgtatagttcaatagtgcataggttttgagaatttagtttttacag

SEQ ID NO: 34978 - DNA, 90 bp, Homo sapiens
tgagacagggtctcactctgtcacccagtctagagtgcaatgtccctatcttggctcaacctcctggactcaagtgatcctcctgcctca

SEQ ID NO: 34979 - DNA, 100 bp, Homo sapiens
ttgctttatgactttttgctaatgacttattacttgctgtttattttatgtttattttagactatggaagtgatgttaggcaaaaagcaaatttgagcaa

SEQ ID NO: 34980 - DNA, 81 bp, Homo sapiens
gtgtatatagtgtatatatatagtgtgtatatatatatagtgtgtatatatatatatagtgtgtatatatatagtgtatat

SEQ ID NO: 34981 - DNA, 65 bp, Homo sapiens
taatcatagacataatacatatgtatatatttatatacgctaatgtgttgatgtctaaatgatta

SEQ ID NO: 34982 - DNA, 62 bp, Homo sapiens
atgtgtatatatgtatgcatatacgtatacatataaatacgtatatttatatatgtacacat

SEQ ID NO: 34983 - DNA, 101 bp, Homo sapiens
tatgtatatatgtatatgcatatatgtatatatgtgtatacaatctcaatatctttttctctgtatacatatatgtatacgtatgtatatatgtatacata

SEQ ID NO: 34984 - DNA, 72 bp, Homo sapiens
atacatatgtatatatgtatatatgtgtttatatgtatatgtatgtatatgtatatgtgtatatatgtgtat

SEQ ID NO: 34985 - DNA, 99 bp, Homo sapiens
ccaggaatggtatcctgataaattcaaaccagccagtctgctgtgttaatacgtaactaactctcagactctgtgatttgactgcagaataatacttgg

SEQ ID NO: 34986 - DNA, 94 bp, Homo sapiens
ctttagtgttcagaggtttcaatgtactgtaccaaggtggtgcattatttttatttatcatgcctacactttgttgtgattcctgaatctgagg

SEQ ID NO: 34987 - DNA, 98 bp, Homo sapiens
tgcaaatatatattacaaaaccatatgtaatgatgctatatatgtatataaacatatgtgtgcatataacgttatatataggcacgtatacatatgca

SEQ ID NO: 34988 - DNA, 99 bp, Homo sapiens
ccacaggctgggtggcttagacagcagacatgtatttctcacaattctggaggatagaagtctgagatcaaggtgtcagcaaggctgctttccctgagg

SEQ ID NO: 34989 - DNA, 109 bp, Homo sapiens
atgaatggaatgattacaggagtgtgaatagcgttaggagaaaaaaggtgtgacaaatcttcatttttttttcttaatattagtacttggtgggtctgtctttatttgt

SEQ ID NO: 34990 - DNA, 133 bp, Homo sapiens
gtatatacgtatacgtatgtatatgtgtatatatacgtatatatacatgtacgtatatatataaacatatacatatatatgtgtacgtgtatatatatatataatatacatatatatgtatacgtatatatat

SEQ ID NO: 34991 - DNA, 103 bp, Homo sapiens
atacatatgtatatgcatgtatatgtatatacatatatatgtacatacatatgtatatgaatgtatatgtatatacatatatatgtacatacatatgtatatg

SEQ ID NO: 34992 - DNA, 121 bp, Homo sapiens
gcatatatgtacatgtatatatacatatatgtacatgtatatatacatacacgtacatgtatatatgtatatatgtatatgtatatacacgtatatgtatatgtatatgtatgtatatgta

SEQ ID NO: 34993 - DNA, 89 bp, Homo sapiens
gcctgggtgacagagtgagagactccctcttaaaaaaaaaaaaaaaaaaaaaaaaaaaaagagggagctaaacattgagcacacatggc

SEQ ID NO: 34994 - DNA, 93 bp, Homo sapiens
ggtggagttgatggatcagataattctgtttttaatttttgaaggaacaccaaactgtttaacacagaggctgtaccattttgcattcccact

SEQ ID NO: 34995 - DNA, 95 bp, Homo sapiens; identical to SEQ ID NO: 68

SEQ ID NO: 34996 - DNA, 93 bp, Homo sapiens; identical to SEQ ID NO: 69

SEQ ID NO: 34997 - DNA, 118 bp, Homo sapiens
tctagaaaattaggaatgtggttcatgaaataattttgtagacaatttaatcctttgtgaattatttaaggaagttgtgtacttaatactttgtggagtactcaataaggcttcagga

SEQ ID NO: 34998 - DNA, 81 bp, Homo sapiens
aatctatacatatatatgatgtatggatagggtctgggtttccccacaccatggattcatatatatatatatatgcagatt

SEQ ID NO: 34999 - DNA, 74 bp, Homo sapiens; identical to SEQ ID NO: 34389

SEQ ID NO: 35000 - DNA, 120 bp, Homo sapiens
ccaatggaacgagcatttgaccagcagcttcatgggggaggcgctttctctctgggtctctgtggggaagggaaagaccttccttaaggagcactggacgcccagcacctgccttggagg

SEQ ID NO: 35001 - DNA, 71 bp, Homo sapiens
tttttcaattactgtctctgtctgtgtcatgtgattatttattttgaacagatgagagtattattgaaaaa

SEQ ID NO: 35002 - DNA, 93 bp, Homo sapiens
agggtggggtcaaaatttattttgcataattaactcagatgagaagagtctttttgttaattttagtttaagtgtgaagaagaacctctccct

SEQ ID NO: 35003 - DNA, 68 bp, Homo sapiens
gtgtatatgtacatatacacacatatagaatatatatattctatatatgtatatatgtacatatatac

SEQ ID NO: 35004 - DNA, 132 bp, Homo sapiens
tatatatacacacacacctatatatatatacacacctatatatatacacacctataaatatatatatatacgtgtgtgtatatatatatgtatatatacacagatgtatttatatatatacaggtgtgtata

SEQ ID NO: 35005 - DNA, 95 bp, Homo sapiens; identical to SEQ ID NO: 68

SEQ ID NO: 35006 - DNA, 93 bp, Homo sapiens; identical to SEQ ID NO: 69

SEQ ID NO: 35007 - DNA, 124 bp, Homo sapiens
tcttctaacctgagggttgcaaatatccatgagagaagagtgggtccccaaggtcacacattcactcactgcttccctgagagtaggaggctcccctggctctgtgtcactcaggggtgggtag

SEQ ID NO: 35008 - DNA, 100 bp, Homo sapiens
taagctacttaagattacagaaatgagggaattacactgaaggaacatatttttcagttatgacagtctcacagtcactgtaaatcttgtcaattgttta

SEQ ID NO: 35009 - DNA, 113 bp, Homo sapiens
ctattatctgatagcacaatagggtgactatagtcaatactgatttacttgtacattttaaagagtataattggattgcttgtaacacaaaggataaatgcgtgaggtgatgg

SEQ ID NO: 35010 - DNA, 61 bp, Homo sapiens
tggctcacatttgtaatctcagcactttgggaggctgaggtaggaggatggtttgaggcca

SEQ ID NO: 35011 - DNA, 81 bp, Homo sapiens
gtgtgtgtgtgtgtgtgtgtctgtatatatgtgtgtgtgtctgtgtgtgtatatatatatatatatatatacacacaacat

SEQ ID NO: 35012 - DNA, 130 bp, Homo sapiens
tacatacttctgtgagtgtctgtatatatacatgtatatacatgtttcaatgtttgattttatagatttgtgtgtatgtctgtatacatatttgtatatacatatatacgtgtatacatatatacacaca

SEQ ID NO: 35013 - DNA, 84 bp, Homo sapiens
cagagtgttctcaccaacgagccataacttgaagcagatagagtgaggagagagtgagatgcctgggaaggtgtgtacactctg

SEQ ID NO: 35014 - DNA, 93 bp, Homo sapiens
cctgctacaccttgagtgagtcacttagtctcagtttctttatttgtaaaatgggaatcataagagtaccttcctcagagggttgttaggagg

SEQ ID NO: 35015 - DNA, 77 bp, Homo sapiens
aggtcaggttggaagctgaggtggggctagggccaccccacacaggcctgtctcacaggctgtcacccactgggcct

SEQ ID NO: 35016 - DNA, 90 bp, Homo sapiens
agaccgaaaacagcatactacactgagtaaggagacagactgactcagtcccattcttctttaataacctcagtcagtggctcttggcct

SEQ ID NO: 35017 - DNA, 112 bp, Homo sapiens
agtagcctggtgtctttcatcaacggcctccagatagatacctgtagaacacttcaaaatagtgatatagatgttttcacgtggtccaattgagagaagaattagtggtact

SEQ ID NO: 35018 - DNA, 115 bp, Homo sapiens
tgtgaagacaagctgaagcctgtaaaaagttaacatagagaagagagagtcctcagggaaatgctttctctctttttttttctttttttttcccagtcttaaagaggctttcata

SEQ ID NO: 35019 - DNA, 120 bp, Homo sapiens
ctccaaaggcctggtggggcacgtaggatgtagtggaaagaacacagagtgcagagactgaagatccaagttgcagacctcccacttgctttttatttgacctcatgcaagttccttgag

SEQ ID NO: 35020 - DNA, 58 bp, Homo sapiens
tgagacagagtctcactctgtcacccaggttggagtgcagtggtgcgatctcggctca

SEQ ID NO: 35021 - DNA, 89 bp, Homo sapiens
ttgatacaacttggggaattacttgagctttgatttttttttttttttttgagacggagtcttgctctgtctcccaggctggagttcaa

SEQ ID NO: 35022 - DNA, 101 bp, Homo sapiens
gcactctatttttttatgttataaaaacacatacctacatatatctctctatatatatgtatttatacatatgtatgtgaaatagcatcttaattttgtgc

SEQ ID NO: 35023 - DNA, 69 bp, Homo sapiens
ctctgtcagtctgtctcttctgagggtaaggaaaaataacaattcagggtaaagagaagaggggcaggg

SEQ ID NO: 35024 - DNA, 78 bp, Homo sapiens
agcacttgagtcattttgaaaatctgttcttcagatctgaattacatgaaagatttcattgtggttttgaatagtgct

SEQ ID NO: 35025 - DNA, 82 bp, Homo sapiens
gtccaccctgtggtctcagagagaagggcccggcttgctcctttgcagggggtggtgtctctctctctgtcttgggcgaggc

SEQ ID NO: 35026 - DNA, 83 bp, Homo sapiens
agttttattagagctgttttcatgtgaggggagatgaattttataattcgcactctcttcaagtgtctggttttgaagttgct

SEQ ID NO: 35027 - DNA, 97 bp, Homo sapiens
tgtatgtatgtatgtatgtacgtgtgtgtgtgtatatatatatacgcacacacgcgcacacacacacacacacacacatatatatatatatatatat

SEQ ID NO: 35028 - DNA, 70 bp, Homo sapiens
cagccccaccctgggaggctccctgtgtccctctgctctactgctggggtgacgtcagctgcttcggctg

SEQ ID NO: 35029 - DNA, 100 bp, Homo sapiens
tccatgaagttcaagggaatctgtatttatattaattactttattgacatagagtaaagtaatttttaatgtgctgacagattttttttaaagatttggg

SEQ ID NO: 35030 - DNA, 114 bp, Homo sapiens
gttgatgagaatgtaaattagttcagccactgtggaaagcagttttgatatttttttttaaatatggaatctcactcttttgcccagggtggagtgcagtagcatggtcttggc

SEQ ID NO: 35031 - DNA, 109 bp, Homo sapiens
caatttctccttcatgttttgagtgctgttttatgtttcaatttcatatttattgtaatatgaaccctcagccactaggacatccaacatccctagaatggcagagttg

SEQ ID NO: 35032 - DNA, 110 bp, Homo sapiens
tgcttaggattgtcttggctatacgggctgttttttggttccatatgaaatttaaagtagttttttctaattctatgaagaaagtcaatggtagcttgatggggatagca

SEQ ID NO: 35033 - DNA, 73 bp, Homo sapiens
tgagttatttcagaacttcttgcccccaaactgtatttttaattattgactggtagcattttggaataactta

SEQ ID NO: 35034 - DNA, 95 bp, Homo sapiens; identical to SEQ ID NO: 580

SEQ ID NO: 35035 - DNA, 93 bp, Homo sapiens; identical to SEQ ID NO: 69

SEQ ID NO: 35036 - DNA, 103 bp, Homo sapiens
aatacaatctatttccttcaaaggtggggtggagaatgaggggtggggtttgggccacatatttttatgtttacattttatttcagattggaaaatttgtatt

SEQ ID NO: 35037 - DNA, 95 bp, Homo sapiens; identical to SEQ ID NO: 68

SEQ ID NO: 35038 - DNA, 93 bp, Homo sapiens; identical to SEQ ID NO: 69

SEQ ID NO: 35039 - DNA, 93 bp, Homo sapiens
tccagcaggcactgattgcctattatggtccttatcattgctataattatttatttaattgcatgtggtccccaatagactctaacctctggg

SEQ ID NO: 35040 - DNA, 97 bp, Homo sapiens
actcacgctgggaattgaccttctttatttcagaagcaaataactatatttgattattgaaatctgaaggaagagggtgggaccaataacagtgggt

SEQ ID NO: 35041 - DNA, 95 bp, Homo sapiens; identical to SEQ ID NO: 68

SEQ ID NO: 35042 - DNA, 93 bp, Homo sapiens; identical to SEQ ID NO: 69

SEQ ID NO: 35043 - DNA, 68 bp, Homo sapiens
ggacagagacaaggttgaggatttggtctgcagcctctgagcggacacactcaccctcagtgcctgcc

SEQ ID NO: 35044 - DNA, 95 bp, Homo sapiens; identical to SEQ ID NO: 580

SEQ ID NO: 35045 - DNA, 93 bp, Homo sapiens; identical to SEQ ID NO: 69

SEQ ID NO: 35046 - DNA, 84 bp, Homo sapiens
cttttagttgtctgatgtgtttcaaactttttttaaaaagccaagtgacttatttaagaagatttgattgtcagaaaataaaag

SEQ ID NO: 35047 - DNA, 114 bp, Homo sapiens
cctctgtgatgaacctgattcagcaactgcttgatatagtaattcttttttcttttattaataaactttaagttctgggatacatgtgcagaatgtgcaggtttgttacatagg

SEQ ID NO: 35048 - DNA, 110 bp, Homo sapiens
tctgtttcaccattttgtgactggtccttactatggcacttggtacagagaagacactcagtacctgagtgggtgaagccaaatccaagtggcaaatgggagggaagagg

SEQ ID NO: 35049 - DNA, 76 bp, Homo sapiens
ttccacattttcaagtaccagctttgcaaaagggcatattttttctttaaaaagtgggtgtatggagagtatggaa

SEQ ID NO: 35050 - DNA, 106 bp, Homo sapiens
atttaattctgattatttctttcttatatttgaacttagatatatttttgcttatatgttaaaatgtatcatcatttctatgggccatatgaaataacagatgagt

SEQ ID NO: 35051 - DNA, 78 bp, Homo sapiens
ggcgtgagccactgtgcctggccctttttttttttttttttttttttttttgacaggatctggctctctggctctgtc

SEQ ID NO: 35052 - DNA, 88 bp, Homo sapiens
attgcaggcaatggggagatatggaagaattttattttattttattttattttgagatggagtctccctctgtctcccaggctggagt

SEQ ID NO: 35053 - DNA, 116 bp, Homo sapiens
ccattgtcacgagtttccatgtttgctccaagttctcagatttctgtttttcaagtttaatttgcccgggacattgcaggaagagaaaccgtgggggcatgattaaaagcatatgg

SEQ ID NO: 35054 - DNA, 110 bp, Homo sapiens
gcatttctatgggcctttcatcttgtgctcatctcccctcatggtttttttttatatatactttaaattctagggtacatgtgcacaacgtgcaggtttgttgcatatgt

SEQ ID NO: 35055 - DNA, 67 bp, Homo sapiens
ggtgttcaccagtcacactctctctctggccacaggcaggagtagtggaaggcgtgggtgggacacc

SEQ ID NO: 35056 - DNA, 61 bp, Homo sapiens
cccagcctgggtgcctgtcaggcactccagggagctactgagtaggcacccagataagggg

SEQ ID NO: 35057 - DNA, 113 bp, Homo sapiens
tatatatacacacatagcatatatattccatttacatatgcattatatatttatatatgccatatctatattccacacatatatatggagtgtgattgtgtgtgtgtgttata

SEQ ID NO: 35058 - DNA, 115 bp, Homo sapiens
gatagtagtttttgctggtgtgtaatgaggtaagctttcacttttaaacgtatgttggagagaacaaagtcaggagagagagctatgcatagtttggcagtagtaaaagcctatc

SEQ ID NO: 35059 - DNA, 93 bp, Homo sapiens
ctcataaaattttaagatattctattgacttgatgttgccttttactaaaaaggatgaaaagttattatgctatgtcttaaggctgacttgag

SEQ ID NO: 35060 - DNA, 59 bp, Homo sapiens
atatgtatatatgtatactttatatatttacatatgtgtatgtatatatgtatgtgtgt

SEQ ID NO: 35061 - DNA, 135 bp, Homo sapiens
tatatatagacatgtatatataatacacatgtttatgtatatataatatacatgtttatgtatatataatatacatgtttatgtatatataatagatataatgtttgtatatatttacatgtatatgttatatat

SEQ ID NO: 35062 - DNA, 96 bp, Homo sapiens
gcaggcacagtgggagtgagactggccctttggtttgcatgggagctgggtgaggcctatgactgccagctttccactacttccttgataacctgc

SEQ ID NO: 35063 - DNA, 105 bp, Homo sapiens
agctgagaaggtaaattcatttgtgtgtgtgtgtgcatgtgcatgtgcacatgtgtgtatgtgtgtgtgtgtctagggagtgtggaaattgaaattatgttggct

SEQ ID NO: 35064 - DNA, 95 bp, Homo sapiens; identical to SEQ ID NO: 68

SEQ ID NO: 35065 - DNA, 93 bp, Homo sapiens; identical to SEQ ID NO: 69

SEQ ID NO: 35066 - DNA, 126 bp, Homo sapiens
tatacatacatatatatgcaatatatatacatacatatatatgcatatatatacatacatatatgtatatatatacacatatgtatgtatatatacacatacatatatatgcatatatatatgcat

SEQ ID NO: 35067 - DNA, 85 bp, Homo sapiens
tagagttaggttggaatttggtatcttatcgctgcaaagaatctgttttgtcagtcttaagatatctgtttttgtagtaacactg

SEQ ID NO: 35068 - DNA, 161 bp, Homo sapiens
atatatacataaatatgtagatattacaaatattgttatatattttatatatttataaatattgtattatatataaatttttatatattgctatatatttatatatttataaatatatatacataaatgtatatttatgtgtatgtgtatatatatatata

SEQ ID NO: 35069 - DNA, 101 bp, Homo sapiens
ttctgctgaggttctgagatggagagtattttccttgagcagtaaagagaacttaaatgtttctttttcataaaatgccctccattagtctaccacaagaa

SEQ ID NO: 35070 - DNA, 99 bp, Homo sapiens
tatatatatacacacatatacatacatatgtatatatatatatactacatacatatgtgcttcacacatatatacataatgtatatgtacatatatata

SEQ ID NO: 35071 - DNA, 116 bp, Homo sapiens
atatcatggttatattataatatatatacacacataatatataataatatatacgtaatatataataatgtatatataatgaatatatgttgtaatatatactatatatcagatat

SEQ ID NO: 35072 - DNA, 60 bp, Homo sapiens
tgtatagagacagagagagagagattgagagtctgtctctgttgctctgattggagtgca

SEQ ID NO: 35073 - DNA, 135 bp, Homo sapiens
gtggaagagacttgccttgtctcagatgtgaccttggacttttttttttttttttttttttttattatactttaagttttagggtacatgtgcacattgtgcaggttagttacatatgtatacatgtgccatgct

SEQ ID NO: 35074 - DNA, 249 bp, Homo sapiens
cgtgtatgtatgtatgtgtgtgtgtgcatatgtatatgtatatatatgtgcatatgtatatatatgtatatatgtatatatatgtgtatatatacgtacatatatatgtgtatatatacgtacatatatatgtgtgtatatatatgtgtacacatatatatgtatatatatgtgtacacatatatatgtatatatatgtgtacacatatatatgtatacacatatatatatgtgtatatatatatatat

SEQ ID NO: 35075 - DNA, 129 bp, Homo sapiens
gcatatgtgttagtacatatatatgtacacatatatgtacgtatgctatgtgtatatatatatgtatatacatatatgtacatatatacatacacatgctatgtgtgtatatgtacacacatgctatat

SEQ ID NO: 35076 - DNA, 73 bp, Homo sapiens
ccagcctaggaaatacagtgagaccccatctttttttttttcttaaagacagtctcactgtcacccaggctgg

SEQ ID NO: 35077 - DNA, 165 bp, Homo sapiens
gtgcatatatatatatacgtatatatatgtgtgtatatatatgtgtatatacacacatatatatgtgtgtatatatatgtgtatatgtgtatatgtatgtgtatatatgtgtatatatatgtgtatatatacacatatatgtatacacatatatgtagacatata

SEQ ID NO: 35078 - DNA, 80 bp, Homo sapiens
ttttctttagtcctctaaacaccgtcaatgtaaggcagcatgtagcatgttttctattgatgcttagtgattacagaaaa

SEQ ID NO: 35079 - DNA, 93 bp, Homo sapiens; identical to SEQ ID NO: 69

SEQ ID NO: 35080 - DNA, 115 bp, Homo sapiens
ctgtagtttatcttatcaataattaaagcatttccagctgtttcccagccaactctgagaattacttttttttttatggcaagacagggagagttttggtcttgctcttgctcag

SEQ ID NO: 35081 - DNA, 123 bp, Homo sapiens
aggtgagatttggtggtatgtgatttaggggagaagggctgaggtgccatgaggtgagatctctttttcatgtagtgttcctgtctcttctctgtacctgtgatctgccacttctcctttaag

SEQ ID NO: 35082 - DNA, 60 bp, Homo sapiens
gtgtgtgtatatgtatatatatctgtagatatacacacatatagatatagatacacacac

SEQ ID NO: 35083 - DNA, 107 bp, Homo sapiens
aggcatatatatacatatatacatatatatgtgtgtatatatatatatgtgtgtgtatatatatatatatgtgtgtatatatatatatgtgtgtgtatatatatact

SEQ ID NO: 35084 - DNA, 84 bp, Homo sapiens
caggtatattttgtaaaggaagaacttgtgtgccatgttttgaaaaaatatgtgtgcatttgtatattttttttcacctgcctg

SEQ ID NO: 35085 - DNA, 58 bp, Homo sapiens
aagtgtgtgtgtatatgtatgtgtgtgtgtgtgcatatatatctatatatatatattt

SEQ ID NO: 35086 - DNA, 114 bp, Homo sapiens
agcagatactggcaacagttgagctcactccaaaagcaacaggaggtggctatgaaatttttttttattatactttaagttttagggtacatgtgcacaacgtgcaggtttgtt

SEQ ID NO: 35087 - DNA, 118 bp, Homo sapiens
tttatgtcctttgcccactttttaatgggattgttgttattttttgaggaaagtagttttattattttacttgaagttctgggatacatgtgcagaaagtgcaggtttgttacatagg

SEQ ID NO: 35088 - DNA, 95 bp, Homo sapiens; identical to SEQ ID NO: 68

SEQ ID NO: 35089 - DNA, 93 bp, Homo sapiens; identical to SEQ ID NO: 69

SEQ ID NO: 35090 - DNA, 106 bp, Homo sapiens
tatatatatttgttttataaatatctgtgtatatatgtgtatacatacatatatttatgtgtgtgtatatatacacatataagttacacttatataaatatatgta

SEQ ID NO: 35091 - DNA, 107 bp, Homo sapiens
gctcctgacttatgtgaaactggaaagcagaagtctcttatcattttgtatttatgcattttgattgttgatctgtatgcttgaccagcaacattgagtattccagc

SEQ ID NO: 35092 - DNA, 70 bp, Homo sapiens
tatctatatacatatgtaagtttatatatgtataaacctgcacatatataagtatatatgtatatagata

SEQ ID NO: 35093 - DNA, 107 bp, Homo sapiens
tcccatgatgtctggatgctgagctggaaagactctgactctctgggtgacttgctggctggcatcatctggagcctctttccctcatatgtctggaggagctggga

SEQ ID NO: 35094 - DNA, 58 bp, Homo sapiens
tgagatggagtctcactctgtcacccaggctggagtgccgtggtgcgatctcggctca

SEQ ID NO: 35095 - DNA, 107 bp, Homo sapiens
gtggccagccttcatgttttcccaggtgaaagttgtactctttttttttttttttttttttttgtgagtctcactttgtccctgaggctgaagtgcagttgtgtcat

SEQ ID NO: 35096 - DNA, 119 bp, Homo sapiens
cccaaagtgctgggatttacagatgtgagccaccacacccggcctggaaatttttttttttttcaagaatgctgagggccaggtggggtggctcatacctgtaatcccagcactttggg

SEQ ID NO: 35097 - DNA, 74 bp, Homo sapiens
tatgtgtttgtgtatgtgtgtgtgtttgtgtataactttttatatatatagtttagcatagtgcctggcacata

SEQ ID NO: 35098 - DNA, 107 bp, Homo sapiens
agtttatgaccttaatttggtatctgcagtttataaactttagctggtaattcaacctatttctatgaatttatttactgagactctacatgaatgaggtctttgct

SEQ ID NO: 35099 - DNA, 81 bp, Homo sapiens
gagcctttttccatcccaggaacttctgctccaagaatgagtttttgagattgatgttccatgtagaagggaatgagtctt

SEQ ID NO: 35100 - DNA, 70 bp, Homo sapiens
gctcacttgctcgctccctcactggctcagtcttgcatggacaatcctgtggaatgcaagagcacagggc

SEQ ID NO: 35101 - DNA, 68 bp, Homo sapiens
caaaccatatcacaggcagattcctgggaaaagtaaatgttctggaattgaccttggattttggtttg

SEQ ID NO: 35102 - DNA, 111 bp, Homo sapiens
tatatatatatatatatatgcgtgtgtgtgtgtgtgtataaatatatatatatacacacatatatgtgtataaatatatatatatacacacgtgcatatatatatatattt

SEQ ID NO: 35103 - DNA, 107 bp, Homo sapiens
ggggctgtgccaatgccccccagcagcctctgaggtgcctggagtgcctgtgggcagtgtcactctgtgtcccccactggctcattgggtgatgggacgccagcctc

SEQ ID NO: 35104 - DNA, 90 bp, Homo sapiens
gccctagctctaccaggtctctcgcactctctgacccggagtctggatggacaccctgagtgtggcccacctgtgcagctcctgctgggc

SEQ ID NO: 35105 - DNA, 99 bp, Homo sapiens
tgaatgaatatgctataatttatttgtctatatttgtatatcatatatgtatacaagtacatatatataatatgtaactatattttagtgtgtttatca

SEQ ID NO: 35106 - DNA, 112 bp, Homo sapiens
agagcatttcctctgggcataagggccttctacctgtgatggggatctatatttatatctatagttatatcaatatctataccatctagatctgtttctatgtctaagcttt

SEQ ID NO: 35107 - DNA, 76 bp, Homo sapiens
atatgtatgtgtgtgtgtatgtatatatgtgtacatatatgtgtgtatatatatgtgtatatatatgtatacatat

SEQ ID NO: 35108 - DNA, 116 bp, Homo sapiens
ttattaaggcctttacatacatcatctcatgtgattctaaaaatgatactctgagactctgagttagggcttattatcagtcctcttttacagatatgataactgagctttagtga

SEQ ID NO: 35109 - DNA, 103 bp, Homo sapiens
gctaactttgttaaaactaagaatgacttttttttttttccttttccccaaagaaatggaattgatgagaaagctgtgcgttttatttttaacacaagatggc

SEQ ID NO: 35110 - DNA, 89 bp, Homo sapiens
agggctcttttttggttccatatgaaatttaaagtagttttttctacttctgtgaagaaagtcagtggtagcttgatggggagagcact

SEQ ID NO: 35111 - DNA, 83 bp, Homo sapiens
ggttggttttaatatcttctctctggtattctacagtttcagcacaatatatctgggagaagatttctttttatttatcatcc

SEQ ID NO: 35112 - DNA, 95 bp, Homo sapiens; identical to SEQ ID NO: 68

SEQ ID NO: 35113 - DNA, 93 bp, Homo sapiens; identical to SEQ ID NO: 69

SEQ ID NO: 35114 - DNA, 105 bp, Homo sapiens
atttctgaagcaaaatgagttctgtaaactagactcacattgagcatgaacttgcaatgccaatgccaatgccaatgcgaaactatggaacagggagccagagat

SEQ ID NO: 35115 - DNA, 102 bp, Homo sapiens
gccagtgtgtggctgatcaccaaggtacctaagagtgtctgcttttgctgagtgacctccccttgcttgctggctcacggcacttgctggcacctggtgctc

SEQ ID NO: 35116 - DNA, 126 bp, Homo sapiens
atattccattgcacacacacacacatatatatatatgtatattcatttatccctatatatgtatgtatatatatgtgtgtatatatatgtgtgtgtgtgtgtatatatatgtatatatatatatat

SEQ ID NO: 35117 - DNA, 130 bp, Homo sapiens
gccaaaccaatcatatgtatatatgcatatgtgtatattaaagcatatacgttcatatttatatgtatatattacatatatatgtgttttgccttttttgtactttatataaatgatatactatacatgt

SEQ ID NO: 35118 - DNA, 84 bp, Homo sapiens
agcatatctatatctatatgtatctaggtagatatagatatatatctacctagatatatatatataatttttcttccctgtgct

SEQ ID NO: 35119 - DNA, 97 bp, Homo sapiens
ttaatagctgtgtagtatagaaaagagtttaaatgtgtattcaatttaaccagtttactaaattatttataatttttttttcctgcacaggttttag

SEQ ID NO: 35120 - DNA, 95 bp, Homo sapiens; identical to SEQ ID NO: 68

SEQ ID NO: 35121 - DNA, 93 bp, Homo sapiens; identical to SEQ ID NO: 69

SEQ ID NO: 35122 - DNA, 79 bp, Homo sapiens
ctgttatgaataagactgttaatctattcttctatgaatcttttcgtggatgtgtgattttcatttttattgatcatgg

SEQ ID NO: 35123 - DNA, 73 bp, Homo sapiens
ctgcagcggtgtggtaggtgcttgtgttgaggagccacagcacatcggcaactcttagaagcacactctgcag

SEQ ID NO: 35124 - DNA, 97 bp, Homo sapiens
gttaacttatggtgataacagtgttaaagatgatagtgtgctgtcaggtaacatatttttctacggacactgtatcctcttcttaaaaagggttgat

SEQ ID NO: 35125 - DNA, 70 bp, Homo sapiens
gtcctgagcaggcctgctgcctgaaggctcgctccggctctctggctctgtctgcctgtctctctctgac

SEQ ID NO: 35126 - DNA, 131 bp, Homo sapiens
ctttgttctttggcttaggattgtcttggcaaagtaggctcttttttggttccatatgaactgtaaagtagttttttccaattctgtgaagaaagtcactggtagcttgatggggatggcattggatctat

SEQ ID NO: 35127 - DNA, 67 bp, Homo sapiens
ggtgcctgtctgtctgtctgtggtgcctgtctgtgacagttgcaccgtgttgggcggaactacgacc

SEQ ID NO: 35128 - DNA, 119 bp, Homo sapiens
ctctcaaagtatttggattacaggtgttagatactgcatccagccagttttattcattttaaattaaaaggagaagccaggcgctgtggttcacacctgtaatcccagcacactgggag

SEQ ID NO: 35129 - DNA, 103 bp, Homo sapiens
gccacaccccacccccaccccaacattgttcagtactcagcacaatgaatcattttcaagttgactcattgtgaactgtatcccagctgttggaatgtctggc

SEQ ID NO: 35130 - DNA, 126 bp, Homo sapiens
acacacacacatatatatgtatatatatacatatatacgtatatatatatgtgtgtatatatatatatgtgtgtgtatatatatatatatgtgtgtgtgtatatatatatatatatacacaccaca

SEQ ID NO: 35131 - DNA, 122 bp, Homo sapiens
gttttggctcgttttcaggactgtcatctgttgaacatctcccagctcatttgaaggaagtgacagaagagagtgagatttcaaatcagggaaattggcgacaggctctgctcaaattggcc

SEQ ID NO: 35132 - DNA, 87 bp, Homo sapiens
tttaatctcttcccaacactagtcattatcaagtttttgctgttatcaacttggatatttctcactgtgggggaaaaagaggttaga

SEQ ID NO: 35133 - DNA, 83 bp, Homo sapiens
gcccctgatggtgaggcagccaggagggacccaggcagccggtctccctctgtgcgtccctctgggcccctggtgactgcagg

SEQ ID NO: 35134 - DNA, 67 bp, Homo sapiens
tgtttcttgtgtcagagtctcactctgtcatccaggctggagtacagtggcactgtcacagctcaca

SEQ ID NO: 35135 - DNA, 76 bp, Homo sapiens
ctctatctgacacttttcctgctttgtcctgtgtttgctagtcatggaactgagtgaaaagagtgagcagatggtg

SEQ ID NO: 35136 - DNA, 106 bp, Homo sapiens
gcctgccttgaattagcagaagcaacaggaatccagagggaattgacttttttttctttttttccctggtctccactgtgattctctgattcaaatttgcggtggc

SEQ ID NO: 35137 - DNA, 117 bp, Homo sapiens
tcactgtgcagagagggagaactaagatggatcctggcagactcctgaagttgaaaagacagaagtgagtgtccagagagaccaagtcagccgtggttctaaagagagagtactgga

SEQ ID NO: 35138 - DNA, 113 bp, Homo sapiens
tgattggcctggtgttgggtcataaacccactcttgaactaatcactgtagccagaaatcagagtacactgattggtcaagcctgagtcatgtgttcaacctcaagccaatca

SEQ ID NO: 35139 - DNA, 90 bp, Homo sapiens
ccatggtgccagtcattgtcacactctgtcatatggaaagtagcccaaggcagatccacaagcaagacagagctgagaactggaccatgg

SEQ ID NO: 35140 - DNA, 88 bp, Homo sapiens
cttcaaggcccagtcacactcaccctctgcctgatggagagacctcccaacataactccaatcgcattgtgaccccggtgccttctag

SEQ ID NO: 35141 - DNA, 59 bp, Homo sapiens
ctgggattacaggcgtgagctgtttgttttttgagacaggggctcactctgtcactcag

SEQ ID NO: 35142 - DNA, 97 bp, Homo sapiens
cgtgtggtggttagcagtccagacctccgcagtcccagggcctggatgtaatcccagcactgtcactttttgtctgtgattgtggacaaatcacttg

SEQ ID NO: 35143 - DNA, 114 bp, Homo sapiens
cttcatactttgtgaaagagtggctaatcaaatttctctcatagactttatttatttatttatttatttatttatttttgagatggagtttcactcttatcacccaggctggag

SEQ ID NO: 35144 - DNA, 72 bp, Homo sapiens
gaagaggcgattcaaggtagaggacactatcagggggccctctgtgcctgtctctgccctaatttcctcttt

SEQ ID NO: 35145 - DNA, 70 bp, Homo sapiens
gtgtgtgtgtgtgtgtgtgtgtgtgtcgcagggggcagggttgtgtacatgtttatatgtgtatatatac

SEQ ID NO: 35146 - DNA, 72 bp, Homo sapiens
tcctggaatctctctgtctctgagctgatatacaagtgtcttcaggtgcgaaaggcagagaggaggccagga

SEQ ID NO: 35147 - DNA, 114 bp, Homo sapiens
gggcgtgatttgaaagtggttaactggatccaacctgttttttttttttttttttttttttttggtagagagaactgacccaaagagactgggtgaattaatgtcaagcagctt

SEQ ID NO: 35148 - DNA, 76 bp, Homo sapiens
cttccacgtcttctgacttcctgttgagctgggccagtggagagcctaggcaggagatgggaggaagaagagagtg

SEQ ID NO: 35149 - DNA, 90 bp, Homo sapiens
agttttaaagtctttatttttatagcacttttctttttctttttgacttaggaagcagaaattcattatgaagagcagattggtaaaatt

SEQ ID NO: 35150 - DNA, 64 bp, Homo sapiens
tgagacacagtctcgctctgtcacccagatccagcctggagtgcagtggtgcaattttggctca

SEQ ID NO: 35151 - DNA, 69 bp, Homo sapiens
ctgggtgtggtgatgcatgcctgtagtcccagctacttggaaggctgaggtaggaggatcacttgccag

SEQ ID NO: 35152 - DNA, 139 bp, Homo sapiens
catatatatgtgtatatatatatatctccatatatatgtgtatatatatatatctccatatatgtgtatatatatatctccatatatatgtgtgtgtatatatctccatatatatgtgtgtgtatatatctccatatat

SEQ ID NO: 35153 - DNA, 112 bp, Homo sapiens
gttttctcaaatgtcagacgattcccagctgtctgtttatatttataagtaatgcattagtcaatattataaaaaacaaaagcagggggactgttctagattaaaggacaac

SEQ ID NO: 35154 - DNA, 96 bp, Homo sapiens
gcttgtggtgtccttgagactgtcttttatttatttatttatttatttgcttttatttttattttttgagatggagtctcactctgtcgcccaggc

SEQ ID NO: 35155 - DNA, 58 bp, Homo sapiens; identical to SEQ ID NO: 16930

SEQ ID NO: 35156 - DNA, 66 bp, Homo sapiens
tgatgatgatgatgatgatgatgatgatgattattattattattattattattattattattatta

SEQ ID NO: 35157 - DNA, 58 bp, Homo sapiens
gatgatgatgatgatgatgatgatgattattattattattattattattattattatt

SEQ ID NO: 35158 - DNA, 114 bp, Homo sapiens; identical to SEQ ID NO: 35143

SEQ ID NO: 35159 - DNA, 58 bp, Homo sapiens
tgagccagagtctcactctgtcacccaggctggagtgcagtggtgtgatctcggctca

SEQ ID NO: 35160 - DNA, 95 bp, Homo sapiens; identical to SEQ ID NO: 68

SEQ ID NO: 35161 - DNA, 93 bp, Homo sapiens; identical to SEQ ID NO: 69

SEQ ID NO: 35162 - DNA, 69 bp, Homo sapiens
tagcttgctttagacggaatgcgattttttttttttttgagacggagtctcgctctgtcacccaggcta

SEQ ID NO: 35163 - DNA, 78 bp, Homo sapiens
gcctctggactttaccagtttgtgttaaggttgatagttttcttttttaaatgcttaaattatactatgtttagaggc

SEQ ID NO: 35164 - DNA, 58 bp, Homo sapiens
tgagacggagtctcactctctcacccaggctggagtgcagtggcgtgatctctgctca

SEQ ID NO: 35165 - DNA, 73 bp, Homo sapiens
ctgggcgacagaacgagactccgtctcaaaaaaaaaaaaaaaaaaaaagagagtgtctcactctgtcactcag

SEQ ID NO: 35166 - DNA, 115 bp, Homo sapiens
aagtgctgggattacaggcatgagccactgcgcctgcccgcttccattacttttttaatttaaaaaatatttaattggccaggtgcagtggctcacacccataatcccagcactt

SEQ ID NO: 35167 - DNA, 58 bp, Homo sapiens; identical to SEQ ID NO: 2263

SEQ ID NO: 35168 - DNA, 86 bp, Homo sapiens
ggtgctctttctctcagtctcttagaatcgcatattgtcaggcattgtcacacatgtgattctaagacagcgagagaaagagctct

SEQ ID NO: 35169 - DNA, 80 bp, Homo sapiens
tggggggcaggcgggagagagactatatttttgtttgttttaatttttgagatggagtctcagtctcactctgtcaccca

SEQ ID NO: 35170 - DNA, 118 bp, Homo sapiens
ggactctgtcattcatatgtatgtatgtgtgcatatgtatatatgtgtgtatatatgtgtgtatatatgtgtgtgtatatatcatatatgtgtgtatatataatatatcaacatatcc

SEQ ID NO: 35171 - DNA, 74 bp, Homo sapiens
tgggtatgaggagaacctgtgactttttcttttttcttttttggaggggggacagggtctcactctgccaccca

SEQ ID NO: 35172 - DNA, 74 bp, Homo sapiens
gacatgtctgtgcctgtcactgaccctggggtatcagtttacccttcactgttatagcaggtattaattatgtc

SEQ ID NO: 35173 - DNA, 96 bp, Homo sapiens
tggtctcacagggctctccaccctgagtcactgtctgtctgccctgattaccccagggccaggtaccagacaactcaggacagcccttgtgcccca

SEQ ID NO: 35174 - DNA, 118 bp, Homo sapiens
ccagctttgttcttttggcttaggattgtcttggctatgtgggctcttttttggttccatatgaaatttaaagtagttttttccaattctgtgaagaaagtcagtggtagcttgatgg

SEQ ID NO: 35175 - DNA, 70 bp, Homo sapiens
ggctgagactcagactcactccttgtacacattttacttaggaaggcggggaggggcgtgaagttaagcc

SEQ ID NO: 35176 - DNA, 72 bp, Homo sapiens
tcatcatgaaataccaaccaaatatatgtatatatgcatatataatggtgtatgatatatattgcatgatga

SEQ ID NO: 35177 - DNA, 103 bp, Homo sapiens
agcagccaggtaagtgtgggttcagatctctgcgtctgtcccgctgtgccaagtgctgggcagacgcgggcagagactggacagcggcacggtgcctgctgct

SEQ ID NO: 35178 - DNA, 85 bp, Homo sapiens
tgtatagcttctggggattagcaggtaaactttttttttttttttttgagacggagtcttgctctgtcgcccaggctggagtgca

SEQ ID NO: 35179 - DNA, 143 bp, Homo sapiens
catatatacatgtatatatgtatatatacatatatagatgtatatatacacatatatacatgtatatatgtgtatatatacatatatgtacatatatacgtgtgtatgtatatatgtatgtacatgtatacgtgtatgtatgt

SEQ ID NO: 35180 - DNA, 96 bp, Homo sapiens
tctgtgggaactctaatgtatatagctggtcagtcacaagcacagtcacactctgtgattgcgactggcagctgaagtagggggcagtcttgtggg

SEQ ID NO: 35181 - DNA, 74 bp, Homo sapiens; identical to SEQ ID NO: 26614

SEQ ID NO: 35182 - DNA, 74 bp, Homo sapiens
ggccagatggtcctgagaagttgtcatgcttgcctaggcaatgatgctaagaagacactgaagagacacaggcc

SEQ ID NO: 35183 - DNA, 70 bp, Homo sapiens
gtcccgagcaagaggcaggcccagaagagccagcagctcttctctgtgtctgtgacacttttgaggagat

SEQ ID NO: 35184 - DNA, 86 bp, Homo sapiens
tctcacctccaggatgtcagtggtggggatctccatggattctgttcctccgtagtacagatactgcatcatcatctgtggtggga

SEQ ID NO: 35185 - DNA, 61 bp, Homo sapiens
tgctgaggatggcagagcaaaaggcagaaagagcctggctctctcgcagtctcacccagca

SEQ ID NO: 35186 - DNA, 58 bp, Homo sapiens; identical to SEQ ID NO: 3368

SEQ ID NO: 35187 - DNA, 64 bp, Homo sapiens; identical to SEQ ID NO: 15176

SEQ ID NO: 35188 - DNA, 59 bp, Homo sapiens; identical to SEQ ID NO: 15177

SEQ ID NO: 35189 - DNA, 86 bp, Homo sapiens
ccactatccctttaccctttgtataaaatctaacattgtaggagactgctagcctattagagtacagagagagaagaaagacctgg

SEQ ID NO: 35190 - DNA, 90 bp, Homo sapiens
ggagttgggtctgggagtgagacagcagacaaagtgcattctaaccatgtacacgcagctgccgggggattgtttaaaccagattctgcc

SEQ ID NO: 35191 - DNA, 83 bp, Homo sapiens
tagctattgtgactgaagaactgagtcttaaattttaattaattaattatttttgagatggggtctcactgtcactcaggctg

SEQ ID NO: 35192 - DNA, 95 bp, Homo sapiens
caatgttgaatagaagtggtaagagtgggcattcttgtcttgttccagttctcaggaggaatgctttcaacttttccccattcagtataatgttg

SEQ ID NO: 35193 - DNA, 84 bp, Homo sapiens
tacagtatagttagtatactacagtacagtgcagtatagttagtatagtatagtgcagtatagttagtatagtatagtacagta

SEQ ID NO: 35194 - DNA, 82 bp, Homo sapiens
agatgggtcaacttgcatggagcttaactgtgaggcccagggcaagtcacttagcctctctgtatctcagtttcttcatgta

SEQ ID NO: 35195 - DNA, 82 bp, Homo sapiens
catcagcagcacacggagacttcagccactcaccacagagcaaaagtctctctctggctgtctctctccgtggtagctcatg

SEQ ID NO: 35196 - DNA, 66 bp, Homo sapiens
gtctgtctctatctgtctctgtctctcttaaaaacaagattattgacagggcgtggtggtgcggac

SEQ ID NO: 35197 - DNA, 137 bp, Homo sapiens
tgagtgttacacaggcatttgtaatcatatatacttttgtacacttgaaatatatatatttgtgtgtgtgtgtgtgtgtgtgtcagagtctcactctgtctcccaggctggagtgcagtggtgtgatcttggctcat

SEQ ID NO: 35198 - DNA, 58 bp, Homo sapiens
ccacccactctctgactgtcttggaaaacacaaattctcttggtgcggggggcggggg

SEQ ID NO: 35199 - DNA, 95 bp, Homo sapiens; identical to SEQ ID NO: 68

SEQ ID NO: 35200 - DNA, 93 bp, Homo sapiens; identical to SEQ ID NO: 69

SEQ ID NO: 35201 - DNA, 66 bp, Homo sapiens
ccctgtgtctctgtgactcggtgtgtcctctcctcttttataaggacaccagtcattgacttaggg

SEQ ID NO: 35202 - DNA, 180 bp, Homo sapiens
atatgtatatgtatacactgttatgtgtatatatgtatatatacacatatatgtacatatgtatacatgtatatacatatatatgtatatatacacatacatatgtatatatacacatacatatatacatatatatgcatatacatatgtgtgtgtgtgtgtgtgtgtatatatatatat

SEQ ID NO: 35203 - DNA, 110 bp, Homo sapiens
acacacacatatgtatatgcatatatatgtatatatgtatgtgtatatatacatatgtatgtgtatatatacatatatatgtatatacatgtatacatatgtacatatat

SEQ ID NO: 35204 - DNA, 79 bp, Homo sapiens
agcacaaattgcagcacatagttaggcacgcttgaggcaaagatgtcagccttttgtgtccctgtgtcagtcattggct

SEQ ID NO: 35205 - DNA, 72 bp, Homo sapiens; identical to SEQ ID NO: 9782

SEQ ID NO: 35206 - DNA, 183 bp, Homo sapiens
tatgtatatacctatatatgtgtatatatatacctttatatgtatagttatatgtatatatatacacctatatatgtatagttatatatacatgtataactatacatatataatatacatatatagttatataggtatatatatacatatatagttatacatgtatacctatacatatatagg

SEQ ID NO: 35207 - DNA, 113 bp, Homo sapiens
tatacatgtataactatatatgtatatatatacctatataactatatatgtatattatatatgtatagttatacatgtatatataactatacatatataggtgtatatatata

SEQ ID NO: 35208 - DNA, 105 bp, Homo sapiens
acctgttttttaattgggttgttttgctgaggttgaattgtatgtatacacaattatatatatttattatatatataggatacctcagattacatgactaatggt

SEQ ID NO: 35209 - DNA, 108 bp, Homo sapiens
gtattctctgatggtagtttgtatttctgtgggatcggtggtgatatcccctttatcattttttattttataatgaaataattatacaactcaccataatgtagaatc

SEQ ID NO: 35210 - DNA, 75 bp, Homo sapiens
tctagtttggtgttcatatcggagggttttatttatttattttgagacggaatctctctctgtcatcaggctgga

SEQ ID NO: 35211 - DNA, 64 bp, Homo sapiens
gtatgtatgtatgtgcgcgtgtgtgtatgtatgtatgcatgcatgtatgtatgtatgtatgtat

SEQ ID NO: 35212 - DNA, 95 bp, Homo sapiens; identical to SEQ ID NO: 68

SEQ ID NO: 35213 - DNA, 93 bp, Homo sapiens; identical to SEQ ID NO: 69

SEQ ID NO: 35214 - DNA, 124 bp, Homo sapiens
gagatcttgggatgttgtcaccttgcagctttataagcttgtggtctcaaagtctcacagtctcatgggctcacagcttcccagtcttgtagtcacaggagtgcaggaagctgggggaaggagg

SEQ ID NO: 35215 - DNA, 67 bp, Homo sapiens
gactgggaactgtgtgtgctcacagggcactccatgaaagccttatacacagcacattcagaaagtc

SEQ ID NO: 35216 - DNA, 95 bp, Homo sapiens; identical to SEQ ID NO: 68

SEQ ID NO: 35217 - DNA, 93 bp, Homo sapiens; identical to SEQ ID NO: 69

SEQ ID NO: 35218 - DNA, 96 bp, Homo sapiens
ctgagccagtatgagccactgcagcatgccgctgcctctctgcctctgactgtggcagttgcacaggaaagcttgtggttaataacaatggctaag

SEQ ID NO: 35219 - DNA, 105 bp, Homo sapiens; identical to SEQ ID NO: 16187

SEQ ID NO: 35220 - DNA, 79 bp, Homo sapiens
tcctgtgtcacaggcactgtgtttgatgattataagcattatttcatttaatcctcatactcatcctatgatacagaga

SEQ ID NO: 35221 - DNA, 82 bp, Homo sapiens
tgtatgtgtgcatgcacaagtgtgtgtgtgacagcgagcgagcgaggcagatacacacacgtgcgcgcgcgcacacacacac

SEQ ID NO: 35222 - DNA, 75 bp, Homo sapiens
tccaggcatggtggcccgtgcctgtcatcctagatacttaggaggctgaggtaggaggatcacttgagcccagga

SEQ ID NO: 35223 - DNA, 58 bp, Homo sapiens; identical to SEQ ID NO: 1673

SEQ ID NO: 35224 - DNA, 66 bp, Homo sapiens
tgagacagattctcactctgtcacccaggctggaatgcagtggtgcagtggcgtgatcttgtctca

SEQ ID NO: 35225 - DNA, 73 bp, Homo sapiens
ccaaacgacggagtggttccatcaaatgtacttttttttttttttgagatggagtctcactccgtcagtcagg

SEQ ID NO: 35226 - DNA, 72 bp, Homo sapiens
ggccatcttccctctgtgagtgtctgtgtaccccctcttattacaaagacaccagtcatgggaattagggcc

SEQ ID NO: 35227 - DNA, 86 bp, Homo sapiens
gtgtgtatttatattatatatgttatatattatatatacatatattacactatatagtatatagcatgtatacatatattacacat

SEQ ID NO: 35228 - DNA, 78 bp, Homo sapiens
atatatatgtatatatatatgtgtatacatatgtatgtatacgtatgtatgtatgtatacatatgtatacgtatgtat

SEQ ID NO: 35229 - DNA, 112 bp, Homo sapiens
cggaacaccccagcagagctggaactgaactggttgttgcctggctccctggttcccacccagcgtgacagtgtgatgggcagtgtgacagccgtggctgctgtggtgtctg

SEQ ID NO: 35230 - DNA, 71 bp, Homo sapiens
tctgggtcgctatgcatgcatgtgtgtgtatgtgtgtgtatacatacatgttatatatatatatacttgga

SEQ ID NO: 35231 - DNA, 137 bp, Homo sapiens
ggcaaaatagttatgcagcaaaagcccactgggccagctgtatctctcattgtgtctccacagctctgtttctgtctgcatctgctctacaataaacaagatacatcagaggcttgaggggaggagaggcttgaagg

SEQ ID NO: 35232 - DNA, 75 bp, Homo sapiens
ggaagcaagagacaactttctcaggcgctactggaaaccgagtgcagagagaagagtctgagagtccaaatttgc

SEQ ID NO: 35233 - DNA, 95 bp, Homo sapiens; identical to SEQ ID NO: 68

SEQ ID NO: 35234 - DNA, 93 bp, Homo sapiens; identical to SEQ ID NO: 69

SEQ ID NO: 35235 - DNA, 108 bp, Homo sapiens
tggaggagaagatcaagctgtgtgaaggcaagtacaagacagccctggtagactggggcctctgtgactcagtctttgatgtctggacggctgagatgcttctgtcca

SEQ ID NO: 35236 - DNA, 95 bp, Homo sapiens; identical to SEQ ID NO: 68

SEQ ID NO: 35237 - DNA, 93 bp, Homo sapiens; identical to SEQ ID NO: 69

SEQ ID NO: 35238 - DNA, 125 bp, Homo sapiens
tgtatgtatacatatacatgtatatatacgtgtatacacgtatatatacatatatacatgtatatatgcatgtatacacgtatatatacatatatacatttatgtatgtataatacatgtatata

SEQ ID NO: 35239 - DNA, 58 bp, Homo sapiens
ataaatgtatatatgtatatatacgtgtatacatgcatatatacatgtatatatgtat

SEQ ID NO: 35240 - DNA, 95 bp, Homo sapiens; identical to SEQ ID NO: 68

SEQ ID NO: 35241 - DNA, 93 bp, Homo sapiens; identical to SEQ ID NO: 69

SEQ ID NO: 35242 - DNA, 66 bp, Homo sapiens
tggctctcagaatctctgtgtctcctgtgaacagatttatggagaacctgggaattatcaaagcca

SEQ ID NO: 35243 - DNA, 87 bp, Homo sapiens
caactatgggttttgcaatcaaaagaacagtgtccaagacccaatgatacccaggacaccaaaccctttttgcagccacattggttg

SEQ ID NO: 35244 - DNA, 104 bp, Homo sapiens
atatatagatgtacctctatggatgtacctatgcctacatatacatgtatcaatctacatatatttatcaatttgtatatcgatacaataatatatctatatat

SEQ ID NO: 35245 - DNA, 95 bp, Homo sapiens; identical to SEQ ID NO: 68

SEQ ID NO: 35246 - DNA, 93 bp, Homo sapiens; identical to SEQ ID NO: 69

SEQ ID NO: 35247 - DNA, 73 bp, Homo sapiens
gctctcagaagcagtcagagcggttgggatgtgaacagaaaggctcacaacctctctgactgcttctgagagc

SEQ ID NO: 35248 - DNA, 85 bp, Homo sapiens
tctctgtctctctctgcatctctctctctctctcacacacacacacacacacacagagagagagagagaaagagagagagagaga

SEQ ID NO: 35249 - DNA, 114 bp, Homo sapiens
gcaccaacatctactcagcttctggtgaggcctcagaaagcttacaataatggcagaaagtagagagggagcaggcatgttacacggtgagagagggagcaagagagagagagg

SEQ ID NO: 35250 - DNA, 108 bp, Homo sapiens
atggaagtggctctatggggagttggaaaggggatctgaagttagccatgtctatccgtagtctctaacactcagtttcttctctgctcactgctcagccacttgtat

SEQ ID NO: 35251 - DNA, 117 bp, Homo sapiens
gatgcattatatatatatgtcttccagcctgggaaacagagtgagagcctgtctcaaaattttatatatatatataattttctcactctgtctcctaggcttgaatgtattggtgca

SEQ ID NO: 35252 - DNA, 58 bp, Homo sapiens
tgatacggtgtctcgctctgtcacccaggctggagtgcagtggcgcgatatcggctca

SEQ ID NO: 35253 - DNA, 110 bp, Homo sapiens
tttgctctaacttttttcctacagtaattatcatcttatataatattatataatctacttatatgttatgtgatgttgttactgtctgtgttactctgctagaatgcaaa

SEQ ID NO: 35254 - DNA, 164 bp, Homo sapiens
acataaatatatcgtgtatatatacatatatgtatatatgtatatatatacatatgtgtatatatgtgtatatatacatatgtgtatatatgtgtatatatacatatgtgtgtatatgtgtatatatacatatgtgtgtatatgtgtatatatacatatatgtg

SEQ ID NO: 35255 - DNA, 351 bp, Homo sapiens
gtatatatacgtatatgtgtatgtatgtgtatatatgtgtgtatatacatatgtgtatgtatgtgtatatatgtgtatatatacatatacgtgtatatatgtgtatatatacatatgtgtgtatatatgtgtatatatacatatgtgtgtatatatgtgtatatatacatatgtgtgtatatatgtgtatatatacatatgtgtgtatatatgtgtatatatacatatgtgtgtatatatgtgtatatatacatatgtgtgtatatacgtatatatacatatgtgtatgtatgtgtatatacatatatacaaatatgtgtatgtatgtgtatatatacatatatgtgtata

SEQ ID NO: 35256 - DNA, 81 bp, Homo sapiens
tgtacatatatgtatgtctatgtatatgtatatatgtatgtgtatatatacatgtatatatggatatatatcatatgtata

SEQ ID NO: 35257 - DNA, 186 bp, Homo sapiens
atatatgtatatgtatcatcgtgtgtgtgtacatatatatatgtgtacatctatacatacatatacttatgtgtgtatgtatgtgtatatatgtgtgtgcatatatatacttgtatatatataatttccagaatgtataatactgtatgcacataattccagaatgtatatattcacatatataca

SEQ ID NO: 35258 - DNA, 87 bp, Homo sapiens
tcataatctagaattgggatcaaattgtgatgtacattaaaacattatttgaccttgtttattattatttgatcttgtcaagaatga

SEQ ID NO: 35259 - DNA, 88 bp, Homo sapiens
tcagaatagagctatgaattgattctgtttttattcttcttttacaaatgaagaaactgaagacagagtgaccaaatcatttgtctga

SEQ ID NO: 35260 - DNA, 77 bp, Homo sapiens
agtttttgtgcatgtagtacagctaccaaaagtaacgcctgtcactgtgggtctctgtgtaactctaaacaagagct

SEQ ID NO: 35261 - DNA, 82 bp, Homo sapiens
tgctcagctttggtcacagactcacttcagaacttattaccgtgaccactgcagtggagttctgtatctctcagtctgagta

SEQ ID NO: 35262 - DNA, 117 bp, Homo sapiens
gggttagacttcaatatatgaattttggagaaacaaaaacattcagaccatagaatctaattttattataaatgtgtgtgtatgtgtgtgtttctttatatgtgtgctttgctacct

SEQ ID NO: 35263 - DNA, 125 bp, Homo sapiens
gtatattttaaccttggtgagatatatatatatatatatatatatatatatatatatatatatagcaatagtgtgtgtatatatatataacaataatgtatatatgtatatgtcatttttgccaa

SEQ ID NO: 35264 - DNA, 104 bp, Homo sapiens
tatatgtatttgtatacgtgtgcatatatacatatatgtatatacgatgtcatatataatatttatataaaatatgtattgcatatttatatatatatcatata

SEQ ID NO: 35265 - DNA, 86 bp, Homo sapiens
ctgtcatacagtgaatataacattcattttgttgttattatgataatgaagcatcagctacttggatgtaatatttatgcagacag

SEQ ID NO: 35266 - DNA, 58 bp, Homo sapiens
tgagccagagtctcgctctgtcacccaggctggagtgcagtggcacgatcttggctca

SEQ ID NO: 35267 - DNA, 122 bp, Homo sapiens
atatatctatatgtatgaatgtatgtatatgtgtatatcatatatatgaatgtatctgtatatatatgatatatacatctatatgatatatacacccatatatatatgcatgtatatatatg

SEQ ID NO: 35268 - DNA, 87 bp, Homo sapiens
agggtctttgcacagagggcagctgcggtggaatgtagccataagtgcacatcttccaaggctgtctatctctctctgagtatctct

SEQ ID NO: 35269 - DNA, 82 bp, Homo sapiens
ccatatgtatatatatgtgtatatatacacattcatgtatgtatatgtgtattgtgtatgcatacacacatatgtatatggg

SEQ ID NO: 35270 - DNA, 115 bp, Homo sapiens
ttttagtatgtggctgtccttgaacttttcccatatgtatgtatgtataattatattaattatatgaatgtgtccccttcaaaattcaggtgttgccaaattgatagtattaaga

SEQ ID NO: 35271 - DNA, 77 bp, Homo sapiens
ggattttttgggacttactctctttgtagttcacataggtttttaaatctgtggagcctcagctgtccccttggtct

SEQ ID NO: 35272 - DNA, 174 bp, Homo sapiens
tgtcaatatcaacttggtctctgagtttgatagtccttaaaatatttatttttatcagtgctcagttacctgagtaaatggcaatatgtctgtccagtgtagaaatgtatagatgatagttttatatactcactgagatattatatcatctggccttcagtggacccacctatt

SEQ ID NO: 35273 - DNA, 78 bp, Homo sapiens
tttatatatgtatatatgcatatatatagatatgtatataatacatattatatgtagatgtatatagatatgtataga

SEQ ID NO: 35274 - DNA, 74 bp, Homo sapiens
gcctgcctgcctgcctgccagtgagatttctggtcattacctaggccagagatcaacacaaggcagccaggggc

SEQ ID NO: 35275 - DNA, 94 bp, Homo sapiens
gatgcattctattctagggaaaagatttaacaatccacgaatataaatttttatttactggttgttaaatactgttttagaaatagtggacatt

SEQ ID NO: 35276 - DNA, 120 bp, Homo sapiens
ttggcctcccaaagtgccgggattacagacgtgagccaccgcacccggccaagttttttaatttttaaaaatcagtggagtgtggtggcacctgcgtatagtcccagcttggaaggctga

SEQ ID NO: 35277 - DNA, 113 bp, Homo sapiens
tgatatgtatgtttaatgtataaaaaggtaagaaatatacatatatatatatacatgtgtatatatatgtgtgtgtgcttaacagctaagttatgcatgggagaaaaatgtca

SEQ ID NO: 35278 - DNA, 67 bp, Homo sapiens
atatttcatatatataaaatacatatgtatataaaatacatgtgtatatatttatatgtgtgtgtat

SEQ ID NO: 35279 - DNA, 106 bp, Homo sapiens
cctaaaacaggcaaggacacagaattcagagaagctttttttcttttttttctttccccccaatgaaaattgcattcttttacctttgcctttgtttgtgacaagg

SEQ ID NO: 35280 - DNA, 105 bp, Homo sapiens
gtgtcaaatatatatatgtaaatttgtgtatttatgtatatgtaatttatgtatggatttatatacatgtatatggaaacaaatttacatataaaatgtttatat

SEQ ID NO: 35281 - DNA, 72 bp, Homo sapiens
ggtgtatttgagaattcatgttgttaatattgtagaatatttttacttgataattgattctcagataacact

SEQ ID NO: 35282 - DNA, 107 bp, Homo sapiens
ccagctttgttctttttgctttggactgccttggttatgtgggctcctttttggttccatatgaaatttaaagtagttttttccaattctgtgaagaaagtcaatgg

SEQ ID NO: 35283 - DNA, 100 bp, Homo sapiens
gtagctgggactacaggcacacaccacgatgcctggttgattttttttatttgtatttttgacacagacagagtctcactaggttgccaagtctgggttc

SEQ ID NO: 35284 - DNA, 75 bp, Homo sapiens
atgtatatttatatgtattctgaatatcatatatgacataatatatgtatacttattttatatatgaatatacgt

SEQ ID NO: 35285 - DNA, 57 bp, Homo sapiens
gaggctgagtctctctctgtcgcccaggctggagtgcagtggtgtgactgcagcctc

SEQ ID NO: 35286 - DNA, 83 bp, Homo sapiens
ttgtgtctgtgtgtgtgcatgtgcatgtgtgtatgaattagtagaagttcctaaattttgtagcaggacagatacagggatag

SEQ ID NO: 35287 - DNA, 59 bp, Homo sapiens
tgagacggagtctcgctctgtctcccaggctggagtgcagtggcgccgatctctgctca

SEQ ID NO: 35288 - DNA, 95 bp, Homo sapiens; identical to SEQ ID NO: 68

SEQ ID NO: 35289 - DNA, 93 bp, Homo sapiens; identical to SEQ ID NO: 69

SEQ ID NO: 35290 - DNA, 78 bp, Homo sapiens
gcactgtgaggtgaagggcaaagcaggcaaagataacatctgtgctctgttctctctcaaagtcagctactgcactgc

SEQ ID NO: 35291 - DNA, 116 bp, Homo sapiens
tctttctcttagagtaaggttttgttttattacaatgtatatattatatattttatatattttatatatgttttattaaaatatatataactgtgctagagaacagaatttcattc

SEQ ID NO: 35292 - DNA, 87 bp, Homo sapiens
aggtgttgggattacaggcatgagccaaagtgcccagctgaaataaataatgttatcttcagtctctgtctgatagttccaatattt

SEQ ID NO: 35293 - DNA, 65 bp, Homo sapiens
atagggtcagattttcccattctgcagaataatttttttttctttgagacggagtctggctctgt

SEQ ID NO: 35294 - DNA, 82 bp, Homo sapiens
tatatatatatgtatatatgcacacacacacatatatatgtatatatgcatatgtatatgtgtgtgtatatatatgtgtgtg

SEQ ID NO: 35295 - DNA, 57 bp, Homo sapiens
tgagactgagtctcactctgtcgccaggctggagtgcagtggcgtgatctcagctca

SEQ ID NO: 35296 - DNA, 58 bp, Homo sapiens; identical to SEQ ID NO: 1215

SEQ ID NO: 35297 - DNA, 110 bp, Homo sapiens
tgtgtgtgtgtgtatgtagatagataaagattcatatatatatatgtatatctatatatagattcatatatatatatgaatcccacatatatatgatacacacacatata

SEQ ID NO: 35298 - DNA, 115 bp, Homo sapiens
tgcaaattagtccagccactgtggaaagcagtttggagattttttttttttttcttttttttttttttttttttttgagatggagtttcactcttgttgcccaggctggagtgca

SEQ ID NO: 35299 - DNA, 157 bp, Homo sapiens
tatgtaaagatacatatgtatgcatttgtgtgtgtatgtatgtgtatataaatatgtgtgtatatatgtgtgtatatatgtgtgtctatatatgtgtgtgtgtatatatacacacacacacacacacacacacacacacacacacacacatatctgg

SEQ ID NO: 35300 - DNA, 83 bp, Homo sapiens
gtgtgtctgtctgtgtgtctgtttctgtataggagactaaatgtatatctgtatgaaaaagagtataatggtcaggtgagcac

SEQ ID NO: 35301 - DNA, 89 bp, Homo sapiens
tggtagtgaataagtctcatgagatctgatggttttataaggggaaatacccttcacttgactctcattctctctcttgcctgctgcca

SEQ ID NO: 35302 - DNA, 81 bp, Homo sapiens
ggaggttagaaatctgagatcaaggtgtcagcaggattggtttcctctgagactttttgccctggtttatggatggccttc

SEQ ID NO: 35303 - DNA, 111 bp, Homo sapiens
cagtttataccactagtttagtgtgagtgagattcttgttcattttttaattttccagttgacaacatactacatggatcacaatacgcactaaataagtgctgatcgact

SEQ ID NO: 35304 - DNA, 118 bp, Homo sapiens
tgcttaggattatcttggctatctgggctcttttttggttccatatgaaatttgaagtggttttttttttttttttaattctatgaagaaagtgaatggtagtttgatgggaatagca

SEQ ID NO: 35305 - DNA, 58 bp, Homo sapiens
tgagatgaattctcactctgtcactcaggctggagtacagtggtatgatctcatctca

SEQ ID NO: 35306 - DNA, 109 bp, Homo sapiens
gtaggatttctctactcaacttcattatgattaaaatatcactagaattggtgaaatatatatatattttctaagtgactttttttttttttttgagacggagtcttac

SEQ ID NO: 35307 - DNA, 72 bp, Homo sapiens
gctgctaagtctgtgattacttgtactcagtatagaaatactgatgcagtgagagaacagtcaatgcacagc

SEQ ID NO: 35308 - DNA, 58 bp, Homo sapiens; identical to SEQ ID NO: 2595

SEQ ID NO: 35309 - DNA, 111 bp, Homo sapiens
caaattgtatgtgctttgcttcatgccatttgcatacttgtgcatgtgtatatatgaatgtgtgtgtgcatgtccatgtgtgttgtatgtaggagagggaattgaaaggtg

SEQ ID NO: 35310 - DNA, 95 bp, Homo sapiens; identical to SEQ ID NO: 68

SEQ ID NO: 35311 - DNA, 93 bp, Homo sapiens; identical to SEQ ID NO: 69

SEQ ID NO: 35312 - DNA, 65 bp, Homo sapiens
ggtggcagagcaagacctgtctctcttttttttttttttttgagatggagtctcactctgtcacc

SEQ ID NO: 35313 - DNA, 96 bp, Homo sapiens
ggtaaactatagcaaatatgtatatgtatatatgtgtatgtattatatatatacaacatataaatatatacatatatctatttgatttagtttacc

SEQ ID NO: 35314 - DNA, 62 bp, Homo sapiens
agacagggtctcactctgtcactctgttgcccaggctggagtgtagcggtgggatcttggct

SEQ ID NO: 35315 - DNA, 93 bp, Homo sapiens
gataggttaacccatagttccttttcctttcaatctttccttatcaatcagtaaggctgaaagtagagagtgtggatagaatgtgtgcctatc

SEQ ID NO: 35316 - DNA, 65 bp, Homo sapiens
aatagagcttgactggtttatttaaaaatgtaacaatatttttaaaaggccttaggagctttatt

SEQ ID NO: 35317 - DNA, 101 bp, Homo sapiens
gatagggaaggatttcttgaacaagaaacaaaaagcaaaaagcatcaattttttttttttttttttttttttttttttttgagatggagtctcactctgtc

SEQ ID NO: 35318 - DNA, 95 bp, Homo sapiens; identical to SEQ ID NO: 580

SEQ ID NO: 35319 - DNA, 93 bp, Homo sapiens; identical to SEQ ID NO: 69

SEQ ID NO: 35320 - DNA, 107 bp, Homo sapiens
gaaatatattaaccacatttaacatatgctctgtatctatatctatctgtatgtccatgcagattttaaatatagattctatgtctatgtagaaagatatatatttt

SEQ ID NO: 35321 - DNA, 80 bp, Homo sapiens
tgtaggcaatttttttctgttcaatagtgtggttcatttgacttccttctccactgtggaagaagctagttttgcttgca

SEQ ID NO: 35322 - DNA, 86 bp, Homo sapiens
acagttggccaaattccttaatatttgaagtttttttttatttttttaaattatactttaagttttagggtacatgtgcacagtgt

SEQ ID NO: 35323 - DNA, 113 bp, Homo sapiens
atatgatatgtatgtatgtatgtatgtgtgtgtgtatatatattatacaatcaacatatacgattatatatttgtataatatatgcatatacaaaatatataggtatatatat

SEQ ID NO: 35324 - DNA, 85 bp, Homo sapiens
gtgtgtatatgtatatataaacatggtgtacacaatatatatatattcactgtatatatattcactgtatatatatatatacaca

SEQ ID NO: 35325 - DNA, 96 bp, Homo sapiens
ataagcagaatgtgtgtgtgtatatatatatatacagtgaatatatatacagtgaatatatatatattgtgtacaccatgtttatatatacatata

SEQ ID NO: 35326 - DNA, 78 bp, Homo sapiens
ttgagtcagagtctcactctgtcacccaggctggagtgtagtgatgcctcctgggctcaggtgaatctcatgcctcag

SEQ ID NO: 35327 - DNA, 74 bp, Homo sapiens
gaagggggcgtatggcacatacccttgggcagaatctctctcactgtgactttgtgcttctgcttattctcttc

SEQ ID NO: 35328 - DNA, 109 bp, Homo sapiens
ggctcccactggttctacattatggtgagttgtataacatttcatatatattacaatgtgataataatagaaataaagtgcatcacaatacatgtaatgctcttgagtc

SEQ ID NO: 35329 - DNA, 117 bp, Homo sapiens
gctttctaaaggtagatcactggccagagtttctgagttatgagagctgctatcaagatttttttttttttttttttttttgagaaagagcctcgctctgttgccaggctgcagtgc

SEQ ID NO: 35330 - DNA, 58 bp, Homo sapiens
tgagacgcaatctcgctctgtcactcaggctggagtgcagtggtgcgatctcggctca

SEQ ID NO: 35331 - DNA, 67 bp, Homo sapiens
gctgctgtggaatgtagtttggtgattcctcaaggaaattaaaacagaacctaccatccaacccagc

SEQ ID NO: 35332 - DNA, 80 bp, Homo sapiens
tgttaatagtgagagttaatattgactggctctctcactagctgtgtgtttctgggaaagttatgtaacctcactaagca

SEQ ID NO: 35333 - DNA, 106 bp, Homo sapiens
actccaacacaactggaaattcccatcctatgcaagtgtggtgagagaggtcaggcagcctctcttgaagcacctccaaggagggtaaattccctggtcagtgagt

SEQ ID NO: 35334 - DNA, 57 bp, Homo sapiens
tatgtgtgtgtgtgtctcactcacccaggctggagtgcagtggcatgatcatacata

SEQ ID NO: 35335 - DNA, 92 bp, Homo sapiens
tatgtgtgtgtgtatatgtatatatatacacgtatatatttgtatatatttgtatatatacgtatatatatatgcacacacacacacacata

SEQ ID NO: 35336 - DNA, 114 bp, Homo sapiens
tctcactggtttggttattttgaggctttttataagtatgagtataagccaactgagtcattatatttatatgatcattaaactaggagtctctaagggtgaatagctgtgaga

SEQ ID NO: 35337 - DNA, 111 bp, Homo sapiens
tcaaatatttactgagtgatagtctatgggtaaacaggatgtactaggtagaaaagatcttaaacctcctagaaaactctacttagagtatattacaggtgaatatgttga

SEQ ID NO: 35338 - DNA, 68 bp, Homo sapiens
gctgaacagagagccgtatctctgtcacacaccctgagaggcaagctggggaactctcctgtttcagt

SEQ ID NO: 35339 - DNA, 112 bp, Homo sapiens
gccattgatatataattataaaataaatatatttacatatatatttatatgtatgcatatgtaaatatatatgtagtacatttgccttatattttagagtccatgaagtggc

SEQ ID NO: 35340 - DNA, 94 bp, Homo sapiens
gttttgcaagattgggagaacttggtgaaaggtacatgagatctctctgtactatttcatacagccacatgtgaatctacaattatgtcaagat

SEQ ID NO: 35341 - DNA, 95 bp, Homo sapiens; identical to SEQ ID NO: 68

SEQ ID NO: 35342 - DNA, 93 bp, Homo sapiens; identical to SEQ ID NO: 69

SEQ ID NO: 35343 - DNA, 120 bp, Homo sapiens
gtgtgtgtatatatgtatgtgtgtatatctgtatgtgcatatatctgtatgtgtatatgtgtgtatatatattcatgtatgtgtgtatatgtgtgtatttatgtgtgtatgtatgtgtat

SEQ ID NO: 35344 - DNA, 71 bp, Homo sapiens
gtatatactatgtatatatgtatgtatatatgtttatatgtgtgtgtatatgtgtgtatgcatgtgtgtat

SEQ ID NO: 35345 - DNA, 93 bp, Homo sapiens
ggacaaagcttctggaggaagtgagaggtgacagtgtgctggcagcccttgcagccctcgctcactctcggtgcctcctcggcctcagtgtcc

SEQ ID NO: 35346 - DNA, 84 bp, Homo sapiens
caaggattttagcttggagcctgaatttttaatgtttcaataaatttgggaggaaatttctgtgcatccaggtgagttgcagtg

SEQ ID NO: 35347 - DNA, 110 bp, Homo sapiens
acttccaatactatgttgaatagaagtgatgaaagtgggcattcttgtctcgttctagtgctcagggggaatgctttcaacttttacttgtccagtataatgttggatgt

SEQ ID NO: 35348 - DNA, 110 bp, Homo sapiens
gtatgcatagaaattaggcagataaagaggtgaaagggtgagtttggtctatatttcattatagtaataaaatctaactactgacatgtatattgtttaataatgtatac

SEQ ID NO: 35349 - DNA, 97 bp, Homo sapiens
acacacatatatacacactcataattatacacatgtattcattatatatgagtgtgtgtgtgtatgtgtatatatatatatatatatatgtcagtgc

SEQ ID NO: 35350 - DNA, 119 bp, Homo sapiens
tctccccatgtgtggggtgagtgtcccgtgtctgtccacccgtgaggtgtgtctctgtgtctgtctccccacatgtggggtgagtgtcccttgtctgaggcttgcccggtgctctcccc

SEQ ID NO: 35351 - DNA, 113 bp, Homo sapiens
ggattttcttggctatacgggctcttttttggttccatatgaaatttaaagtagtttttttctaattatgtgaagaatgtcaatggtaatttaatgagagtagcattgaatct

SEQ ID NO: 35352 - DNA, 83 bp, Homo sapiens
tctccccatgtgtggggtgagtgtcccgtgtctgtccacccgtgaggtgtgtccctgtgtctgtctccccacgtgtggggtga

SEQ ID NO: 35353 - DNA, 75 bp, Homo sapiens
cccacgtgtggggtgagtgtcccgtgtctgtccacccgtgaggcgtgtcgctgtgtctgtctccccacgtgtggg

SEQ ID NO: 35354 - DNA, 86 bp, Homo sapiens
agctgcaaataaagaccttgaagaaagtcttggccctctgaaaacatccagaagtctactgactttcttcaaattacactgcagtt

SEQ ID NO: 35355 - DNA, 132 bp, Homo sapiens
gctacgtaacatttcatggtgtatatatatatgtgtgtgtgtgtatatatatatgtgtgtatatatatatatggcaatatacataatgtgacatatatatgcaatgctatatatatgtgtgtgtgcatgtgt

SEQ ID NO: 35356 - DNA, 95 bp, Homo sapiens; identical to SEQ ID NO: 68

SEQ ID NO: 35357 - DNA, 93 bp, Homo sapiens; identical to SEQ ID NO: 69

SEQ ID NO: 35358 - DNA, 106 bp, Homo sapiens
cagagagcccaggttctagtctgttagctttccgtagtaatgattttttctgttttcaaataaaaatgccaagctgagtggctggtttcccctttgggctataatg

SEQ ID NO: 35359 - DNA, 90 bp, Homo sapiens
cctatagagttatttgttcgacttccatattctgattattaatattttgtcagaaggatagtttataagtattttctcctattctgtggg

SEQ ID NO: 35360 - DNA, 93 bp, Homo sapiens
gattattcccatctttcagtcgtacaaattgtgttatggagaagttagattacttgtcagagaccacacagactgtaaaggtggaacttagtc

SEQ ID NO: 35361 - DNA, 100 bp, Homo sapiens
tggattattcccatctttcagttgtacaaattgtgtcatggagaagttaaattacttgtcagagaccacacagcctgtaaaggtggaacttagtagtcta

SEQ ID NO: 35362 - DNA, 61 bp, Homo sapiens
gtgtgtgtatatatatatacaaagagaacatgtatgtgtatgtgtgtgtgtatacacacac

SEQ ID NO: 35363 - DNA, 99 bp, Homo sapiens
tcttcacattcccaaatgctggtttgaggatttttaatttatttttgagcatagtgctgtagatttttgagattcaagattgttttgggggagtggagg

SEQ ID NO: 35364 - DNA, 84 bp, Homo sapiens
gaagcatccagcatgggagaaaaatgtaggctgggaggctaggcctgtctctgtctttcacatttttctgcctgctttatattc

SEQ ID NO: 35365 - DNA, 115 bp, Homo sapiens
tctcttacatacagatgtgaaacagtttgcttatgaggtggagtgatttaataataattattattatattattattactattataacattactataattacagttgagttagagg

SEQ ID NO: 35366 - DNA, 73 bp, Homo sapiens
gggagaagccaggatttctgattttgtagatgatagttcatgtctagacccagactcctttgcttctttgccc

SEQ ID NO: 35367 - DNA, 73 bp, Homo sapiens
ggtacacatcttgagttatatatcactgctgtgtgtgacacatagctagttgatattgaatggagattatact

SEQ ID NO: 35368 - DNA, 110 bp, Homo sapiens
gtatcccattttactctatttcaaatattgcttcaataagaatattttcctcaattcttatatatgtatataagcatatgtttgaaatagattactgaaattgaagttgc

SEQ ID NO: 35369 - DNA, 113 bp, Homo sapiens
gtagctctgctgagatttgaacacagaacatatgacctcctccttttcctttttttttttattattatactttaagttttagggtacatgtgcacaatgtgcagcttagttac

SEQ ID NO: 35370 - DNA, 84 bp, Homo sapiens
caaagatcagatggttgtaggtgtaaggctttatttctaggttatctaacctgttccattggtctgtctgtctgtctgaatttg

SEQ ID NO: 35371 - DNA, 217 bp, Homo sapiens
tatatgtatatatgtgtatatatacatgtatatatgtgtatatatacatatatgtatatatgtatatatatacatgtatatatgtgtatatatatatatgtatatatgtatatatatacatgtatatatgtgtatatatacatatatgtatatatatacatgtatatatgtgtatatatacatatatgtatatatgtatatatatacatatatacat

SEQ ID NO: 35372 - DNA, 74 bp, Homo sapiens
gagggcaggagccccaggaggcagggtagcccgtcctaagcaggacatggtatctctcacaggctcacactctc

SEQ ID NO: 35373 - DNA, 104 bp, Homo sapiens
cctgcctggctgtgtgtgtcagggggtggctacacctgtctggctgtgtgtgtcaggggggctacacctatctggctgtgtgagtcgggggggggctacacctg

SEQ ID NO: 35374 - DNA, 92 bp, Homo sapiens
gagcgccttcccctgctccacagcgcccagtcccatagaccacccaagggcagaggagtgtgagcacatggagcgggactggcaggcagctc

SEQ ID NO: 35375 - DNA, 81 bp, Homo sapiens
gacaggttgctgtagattgtgagtccaagttctatttttatatatggtgcggccacagtccatttgcatatttagtctgtc

SEQ ID NO: 35376 - DNA, 95 bp, Homo sapiens; identical to SEQ ID NO: 68

SEQ ID NO: 35377 - DNA, 93 bp, Homo sapiens; identical to SEQ ID NO: 69

SEQ ID NO: 35378 - DNA, 95 bp, Homo sapiens; identical to SEQ ID NO: 68

SEQ ID NO: 35379 - DNA, 93 bp, Homo sapiens; identical to SEQ ID NO: 69

SEQ ID NO: 35380 - DNA, 75 bp, Homo sapiens
agtctctcactctgtctaatgccccttagccgaattctttcctctgaggaggcaaaaatggagttgctgcagact

SEQ ID NO: 35381 - DNA, 95 bp, Homo sapiens
gatctttgtgaggtggcaagtgcttaatataagatgatgatgatgattattattattctttcatagtaccagttcttgccttcattcatttagtc

SEQ ID NO: 35382 - DNA, 81 bp, Homo sapiens
gccactttgtgttagcactgtctgtgcctctctggttataacctcattttcctaagtggcccaatgctcactttcagtggt

SEQ ID NO: 35383 - DNA, 112 bp, Homo sapiens
tgaaccagaatcctctaaatatagttttcacatagctacattgaatgccattttgttataatttatttaatcattcaagtgttattaagcatttaggttgttctgtttttca

SEQ ID NO: 35384 - DNA, 68 bp, Homo sapiens
gagacagggtctcactctgtcacccagcctggagtctgggctagggtagagtggcaccatcatagctc

SEQ ID NO: 35385 - DNA, 115 bp, Homo sapiens
tgtgatggtgggacttctggttgcttctcagcaacatattaggtgacttgtcagatgagagtgaagaggtacagagaatgttggagatttgatgagagaggaaaggctgaaaaca

SEQ ID NO: 35386 - DNA, 88 bp, Homo sapiens
gcccttcgcgaatctttttgcggtctgggcttgctgtacataactcaatagccggaagcccttaccccaaaaagcatttgcggagggc

SEQ ID NO: 35387 - DNA, 115 bp, Homo sapiens
gcctgagacaacacagcctgtttagtagctgagctgattcttaatacaggactttttttttttttttttttgagatggagttttgctcttgttgcccaggctggagtgcaatggc

SEQ ID NO: 35388 - DNA, 103 bp, Homo sapiens
tagagcccttgcatttccatatatattttaggatcagccactttgggttttttattttttaaaaaagctacctggtattttgattgggattgctttgagtcta

SEQ ID NO: 35389 - DNA, 77 bp, Homo sapiens
agcctaggtgacagattgaaactccgtctcaaaaaaaaaaaaaaaaagagacgtgggctcactctgtcactcaggct

SEQ ID NO: 35390 - DNA, 101 bp, Homo sapiens
gacctaagacacacacttgggtagttttctggaatttgcttttttttttttttaactcagcatcatgtttctgagaattattcctgtcattgactctggtt

SEQ ID NO: 35391 - DNA, 84 bp, Homo sapiens
tgttaagggcagccagagagaagtgtctgtccacacagggaagcccaacagactaacagcggatctctctgcagaaaccctaca

SEQ ID NO: 35392 - DNA, 66 bp, Homo sapiens
cttccttggcagtggaagtagcttgtcctcctaagtctgaggagactagtcattctttgcttgaag

SEQ ID NO: 35393 - DNA, 58 bp, Homo sapiens; identical to SEQ ID NO: 1435

SEQ ID NO: 35394 - DNA, 58 bp, Homo sapiens
tgagtcagagtctcgctctgtcactcaggctggagtgcaatggtgtgatcttggctca

SEQ ID NO: 35395 - DNA, 118 bp, Homo sapiens
tcagatcaaggtagtgatgtttttgctgatataatcatcttaaaagctgtctggatctcttgtgaatgtttttagggtttacactgtctatcacacaaagtcacacacacaaatctga

SEQ ID NO: 35396 - DNA, 83 bp, Homo sapiens
tctcaggactccctttgtgtcactctcagatactacagtactgtagctatttggcctgtgaggcaaaagaaggcattatgaga

SEQ ID NO: 35397 - DNA, 118 bp, Homo sapiens
gattctgcaatccctatcatacttgccatacccagaaggaagaatctgaattaggtgagagtactgagacaccagaggaggctggtgtgtggcaagaagaaggaaggctggaagagtt

SEQ ID NO: 35398 - DNA, 65 bp, Homo sapiens
gttgttgttgtgagactgagtctcactctgtcgcccaggttggagtgcagtgtcacaatctcggc

SEQ ID NO: 35399 - DNA, 66 bp, Homo sapiens
gaggacatagctttggtgacacatgaattcactgtttgaagctcacttgtctctgtctctgtcctc

SEQ ID NO: 35400 - DNA, 83 bp, Homo sapiens
acacacacgtatacatacacaacatatatatgcttagaatattcacaacatatatatgtatatgtgtatatatacatgtatgt

SEQ ID NO: 35401 - DNA, 129 bp, Homo sapiens
cctgtgtgtgtctgggtattcagggacacctctctgtgcctgtgtgtgtctgggtacacagggacatctcactgcctgtgtgtgtctgggtgtgaggaacacccacccgtgcctgtgtgtgtctgtgtc

SEQ ID NO: 35402 - DNA, 115 bp, Homo sapiens
gaatggtggtgaagatcctggccatgaatggtgtaatctacatgtgagtcccggctctgccactcactcactgtgactttagacaaatcacctaacatcctggatgtcctcattt

SEQ ID NO: 35403 - DNA, 73 bp, Homo sapiens
agtacagaggtatgtagtttggggctggtatgacattccagactgtcacatccccagctgcttctatgttgct

SEQ ID NO: 35404 - DNA, 115 bp, Homo sapiens
ggagtttggattttgttcccattgtgatggagagctattgaagagtttaacgtgattgggtttatttttttattttattttactattattattttttgaggcggagtcttgctct

SEQ ID NO: 35405 - DNA, 109 bp, Homo sapiens
gcctgggatcttcgctgttggccaagaacccatggggaggcaagatagggtagtccaggctgtctctgtttctgactcctgcccaggccttgcacgtgaggtccttggt

SEQ ID NO: 35406 - DNA, 78 bp, Homo sapiens
gttgaggctgcagtgagctgtgtttacaccattgcactccagccttggtgacagagcagagtgaggtcctgtctcaac

SEQ ID NO: 35407 - DNA, 112 bp, Homo sapiens
aacagacatttccatcgtcacagatctggaggccagaagtctgagatcaaggtgtgagcagggtttgtttcttctgctgcctctctccttggcttgtagacagttgtctcca

SEQ ID NO: 35408 - DNA, 121 bp, Homo sapiens
ggccttcaaagagtgggactcttccctttgttttttttctttcagactgggtctcactttgtcactcaggctggggtgcagtggtgccatcatagctcactgcagcctcagtctcctaggc

SEQ ID NO: 35409 - DNA, 68 bp, Homo sapiens
tgttttgagatggagtctctctctgtcacctaggctggagggcagggttgagatcttggctcactgca

SEQ ID NO: 35410 - DNA, 92 bp, Homo sapiens
tcacctgcagcagagctgcagggtcagaagacttcggttctctctctgtctcttactagccagctctgtggctgtgtgatatgggccgagtc

SEQ ID NO: 35411 - DNA, 66 bp, Homo sapiens
cagaagccagtgtgactgtctgcctgtgttgtaacgaggggctttaaggcaaacacacaggctggg

SEQ ID NO: 35412 - DNA, 82 bp, Homo sapiens
gtagcctgcagacacagcctgtcactgtcactacctgtcccaaacctcaggggtgagccatggctgtgaatgcactttctat

SEQ ID NO: 35413 - DNA, 117 bp, Homo sapiens
gttgcctgctgccatgtttgtacagcctgcagaacagtaagccaatcaaacctctttttatttatttattttactttaagttctgggatacttgtgcagaatgtgcaggtttgttac

SEQ ID NO: 35414 - DNA, 69 bp, Homo sapiens
gagccacatctgattcttctgtgtctctcacacacatgcacagggacaacccagaagactatctggttc

SEQ ID NO: 35415 - DNA, 81 bp, Homo sapiens
ccagggagaggtagtagcaagtgcaagcgttttgaggagcccccacattagcagcttaaacaacttactttctctctctgg

SEQ ID NO: 35416 - DNA, 76 bp, Homo sapiens
tatatatgttatatattatatgtttatattatatatactatatatagtattacatataatgtatatattatatata

SEQ ID NO: 35417 - DNA, 60 bp, Homo sapiens
gtgagacagagtctcgctctgtcacccaggctggagtgcagtggtgagagctcaactcat

SEQ ID NO: 35418 - DNA, 89 bp, Homo sapiens
gccatgtgtatcatgcactaaatttatttatttttgagacagagtctcgctctgtcacccaagccggagttcagtggcatggtcatggc

SEQ ID NO: 35419 - DNA, 58 bp, Homo sapiens
tgagacagggtctcactctgtctcccaggcaggagtacagtggtgcgatctcagctca

SEQ ID NO: 35420 - DNA, 122 bp, Homo sapiens
tctccagagcacctgaagctgcatcatcctccatgagccccaagaccacaggggattgctcagagaagggtgtgagctttctggagtggttcaaaggaggcgtgtcagacagacttgaaagg

SEQ ID NO: 35421 - DNA, 70 bp, Homo sapiens
tcatggaattgatgattcactagcaccttttgttaattctagcagaaaacagtgctgcatcctttccaga

SEQ ID NO: 35422 - DNA, 61 bp, Homo sapiens
ggtgaaaagagagtgagcaaagatgacctcaatgggtcactgggccagatttcgcagcacc

SEQ ID NO: 35423 - DNA, 86 bp, Homo sapiens
cagagggaaattgctttgggagaatgagtattcttttttattttttactttttttgagatggagtctcactctgtcacccaggctg

SEQ ID NO: 35424 - DNA, 99 bp, Homo sapiens
tcatcacgtgaccttcttcctgtgtgtctgtctctgtatcgcttctcctccttgtcataaatagaccagtcatataggattagggctcatcctaattga

SEQ ID NO: 35425 - DNA, 112 bp, Homo sapiens
gcattacctgggtgatagtgtggagtactgggaaggtgagtggccctgtggacagactgactgacagacagacttgatgcctgtacccaccacttactgagggatcttgggc

SEQ ID NO: 35426 - DNA, 88 bp, Homo sapiens
ttttgtgactacctgctggagagatttgggttttagatttgttatttataaaataaaaataaatcctaccagcaggtttgttgtgagg

SEQ ID NO: 35427 - DNA, 58 bp, Homo sapiens; identical to SEQ ID NO: 1190

SEQ ID NO: 35428 - DNA, 56 bp, Homo sapiens; identical to SEQ ID NO: 1191

SEQ ID NO: 35429 - DNA, 95 bp, Homo sapiens
atgtttgtcccctacctcctcagagagaggacagagggcacacttcacaagtgactcagccttcctgcaaggaggtgatgcggtgacttttacgt

SEQ ID NO: 35430 - DNA, 116 bp, Homo sapiens
gactcaatcatgggctgcagcccgggtatacagatgtctctgcttctatcttattttttttttttttgagatggagtttcactctgtcacccaggctggagtgcagtggtgtgatc

SEQ ID NO: 35431 - DNA, 112 bp, Homo sapiens
ttctcctggcaggaggccaaagaccttaagtaattgatgtgtcttgacctgaacctcaatctcaagagactcattaagctgatccatctctaaggatattctgctgtttgaa

SEQ ID NO: 35432 - DNA, 122 bp, Homo sapiens
gcagctttgggggaccgtccagggatggctgtcctaggcccctccatataagagctcactattctcacactctgcctggagggcctctgagctctgagccaggcagagtagagtgggaagac

SEQ ID NO: 35433 - DNA, 114 bp, Homo sapiens
gagatcacagtcctagctttctgttgtcaagtgtctgcaaacttttttttttttttttgagaaagggtctcactctgtcacccaggctggaaagcagtggtgtgaacatggctc

SEQ ID NO: 35434 - DNA, 74 bp, Homo sapiens
gcagtggctcactctctgtcactttgggaggccgaggcaggcagatcacctgaggtcaagagttcgagaccagc

SEQ ID NO: 35435 - DNA, 65 bp, Homo sapiens
ggcacattaagttagaatctcttgtgtcatttggggcagtgactctgagactctcatcttgtgtc

SEQ ID NO: 35436 - DNA, 96 bp, Homo sapiens
aggggattggtctggctgcttctaccattttccagcagcctgtaaataaaaaacatttacaggctctctgagtgtgtgaaaggttttaccgccctt

SEQ ID NO: 35437 - DNA, 110 bp, Homo sapiens
catgctgtgggaagggtaaaggtgtggttgacctgaggaatgagattgagctcagagcttcagctctctcccccatccaggcccagctgtacttccctgaccctcacttg

SEQ ID NO: 35438 - DNA, 76 bp, Homo sapiens
gtttgtttttagagacaaggtctcactctgtcacccaggctggagtgcagtggtgtgattacaactcacagcaggc

SEQ ID NO: 35439 - DNA, 79 bp, Homo sapiens
gccatggccctgcgtattcctgacagtgtgtggggggagtgtagcgcctcacctgacactgagcagacacagaccaggt

SEQ ID NO: 35440 - DNA, 92 bp, Homo sapiens
tagtctgagagcacatgggagggatacctgcctattttttttttttttttttttttttttgcaatggagtttcgctcccatcgcacaggctg

SEQ ID NO: 35441 - DNA, 58 bp, Homo sapiens
tgagatggagtctcactctgtcacccaggctggagtgcagtggcgtgattttggctca

SEQ ID NO: 35442 - DNA, 100 bp, Homo sapiens
ttcctctggctttgtctgttaggtctaatagtgtctggaaaagaatgcaataatttttttccagagacgttactaacactatacgcaaaagctggaagaa

SEQ ID NO: 35443 - DNA, 117 bp, Homo sapiens
tgtttgtgagaactaacatagatttggtttatttgtaactttttattctttaatcttttttctgttagggaccttactgaatagaaaattgcaactatctatgttaagacatttcat

SEQ ID NO: 35444 - DNA, 87 bp, Homo sapiens
cctggtttgtgactccttagctagtgatcactttgtttttgttttgttttgttttttttgagacagagtctcactctgtcgcctagg

SEQ ID NO: 35445 - DNA, 67 bp, Homo sapiens
agaggtacaggattccaagtgggaactgcagactcgttagtctgccactcactggctctgtgactct

SEQ ID NO: 35446 - DNA, 56 bp, Homo sapiens
tgacagagtctcgctctgtcacccaggctggagtgcaatggtgcgatctctgctca

SEQ ID NO: 35447 - DNA, 93 bp, Homo sapiens
cccaccatggtgttgatactgcctatttccctctctgtctctctcattcgtccgcgattgactggagggtcaagtgtgttttcttcatctggg

SEQ ID NO: 35448 - DNA, 132 bp, Homo sapiens
gatggggtttcactctgttagccaggatagtattattattatttttgagacagagtctcactctgtcacccaggctggagtgcagtggcttgatctcgactcactgcaacctctgcctcctgtgttcaagtg

SEQ ID NO: 35449 - DNA, 111 bp, Homo sapiens
ggactctgaatggaaaagaagtttgatcactgacacctagggctctgaagcgtgtgtggccacatggaaaagtcgaaggatgcgctgtcgaatctcctttgtcttcactcc

SEQ ID NO: 35450 - DNA, 125 bp, Homo sapiens
gagaccctgtctctacagcaaaaaaattttttgtttttgtttttgagatagggtctcactgtgtgtgtcacccaggctggagtgcactatcatgatcatggctcactgcagccttgactcaggtg

SEQ ID NO: 35451 - DNA, 56 bp, Homo sapiens
gaattctcacagtctccctctgtgccaaacgctgtcaggggagggaatgacaattc

SEQ ID NO: 35452 - DNA, 73 bp, Homo sapiens
catggtgagaggtctgagaggagagggagggccccagcatcctcctcatctacactgagacctcctccccttg

SEQ ID NO: 35453 - DNA, 99 bp, Homo sapiens
agcctgcactgtctttgttttctgaggcctctgcttttcttttttttttttttctttttttttttttttgagacagagtcttgcactgtcacccaggct

SEQ ID NO: 35454 - DNA, 60 bp, Homo sapiens
ttgagacaggatcttgctctgtcactcagactggagtgcagtgatgtgatctctgctcaa

SEQ ID NO: 35455 - DNA, 83 bp, Homo sapiens
gtttgtttgttttgagatgcagtctcactctgtcacccagtctggagtgcagtagtgcgatctcagctcactgcaacctctgc

SEQ ID NO: 35456 - DNA, 58 bp, Homo sapiens; identical to SEQ ID NO: 8510

SEQ ID NO: 35457 - DNA, 95 bp, Homo sapiens; identical to SEQ ID NO: 68

SEQ ID NO: 35458 - DNA, 93 bp, Homo sapiens; identical to SEQ ID NO: 69

SEQ ID NO: 35459 - DNA, 108 bp, Homo sapiens
gcctgggcaacagagtgagacttactctcaaaaaaaaaaaaaaaaaaaattcttttatttatttatttttttttttgtagagtctgggtctcactgtgttgcccaggc

SEQ ID NO: 35460 - DNA, 72 bp, Homo sapiens
ggcgtgagccactgcgcccggacctgttttttggttttttttgagacagtgtctcgctctgtcgctcaggct

SEQ ID NO: 35461 - DNA, 72 bp, Homo sapiens
ttgctttttgagactgagtctcactctgtcgccctggctggagtgcagtggtgcaatctcggctcactgcaa

SEQ ID NO: 35462 - DNA, 120 bp, Homo sapiens
gggtggtagctgtggaaatgcagagaaatggagtcatccacccagcttatatttactgagtgcttcctgaatgcaagttgttagggatgtagcagtatctgtgttcacattagctcacct

SEQ ID NO: 35463 - DNA, 142 bp, Homo sapiens
ggtgtcagactcagactctcagttaatcttttctagatctggacaagggagggctcagagaaagcctggctgcatccatgcagtgtttttttgtttgtttgtttttggtttttttttttttgagatggagtctctctctgtc

SEQ ID NO: 35464 - DNA, 120 bp, Homo sapiens
tcttgggccactgggaagtttccaggttcttcttatcccaaggcgtgaggaagaagtttgtgatctcagtcgtctgtcttgggtcccagacctccctgtgcagcttttcctaagaacgcc

SEQ ID NO: 35465 - DNA, 58 bp, Homo sapiens; identical to SEQ ID NO: 2531

SEQ ID NO: 35466 - DNA, 101 bp, Homo sapiens
agtcccatttcaatgagctggttgtggtggcttgtgcctgtagtcccagctacacaggaggctgaggtaggaggatcacttgagctcaggagttggaggct

SEQ ID NO: 35467 - DNA, 56 bp, Homo sapiens; identical to SEQ ID NO: 14407

SEQ ID NO: 35468 - DNA, 82 bp, Homo sapiens
gcaccagatcccaggaagtgtgattgaaccagatgtcacgcaggtgagcgtctgtgtctgtcactgttcttggatttagagc

SEQ ID NO: 35469 - DNA, 58 bp, Homo sapiens
tgagacaatgtctggcactgtcactcaggctggagtgcagtggcactatcacggctca

SEQ ID NO: 35470 - DNA, 83 bp, Homo sapiens
ttaaccagggatggtggcatgtgcctgtagtcccagctacttggaaggctgaggtagcaggatcacttgagcccggaggttga

SEQ ID NO: 35471 - DNA, 80 bp, Homo sapiens
aatggtagaagttatcttcctcactgcctgcctctgagagatgagtccagtggcaagaagaaattggaaattttaccatt

SEQ ID NO: 35472 - DNA, 66 bp, Homo sapiens
tgagacagagtcttactctgtcactctgttgcccatgctagagtgcagtagtgcgatcttgggtca

SEQ ID NO: 35473 - DNA, 66 bp, Homo sapiens
tgagatggagtctcgctgtctcgctctgttgcccgggctggagtgcagttgtgtgatctcggctca

SEQ ID NO: 35474 - DNA, 86 bp, Homo sapiens
gcaaattgcttaatctctctaagtctcagtttctcatctgtaaaatgcaagtgacactgacacttctcagggttaaagtcaagtgt

SEQ ID NO: 35475 - DNA, 86 bp, Homo sapiens
gggaagtggagagagatttagaaaaatatgagagagcaaaagaaaactttttttgttttttttttgacagggtctctctctgtctc

SEQ ID NO: 35476 - DNA, 92 bp, Homo sapiens
gggtctggctgtgtcccttgggcctgctcagagaggaagcgatttccttctagggtctgtgagtcagtcagtgctggggacagctgagaccc

SEQ ID NO: 35477 - DNA, 76 bp, Homo sapiens
gcagacagcactgggtaaaggcaagaagattttttttttttgaaacagagtctcacacttgctcaggctggagtgc

SEQ ID NO: 35478 - DNA, 138 bp, Homo sapiens
tggaggcaacatagtgagattccatctcaatttaaaaagagattttttttttttgagatggagtctcactctgtcacccaggctggagtgcagtggtgtgatcttggctcactgcaacctccgcctcccaggttcaag

SEQ ID NO: 35479 - DNA, 58 bp, Homo sapiens; identical to SEQ ID NO: 2442

SEQ ID NO: 35480 - DNA, 57 bp, Homo sapiens
tgagaagagtctcgctctgtcacccaggctggagtgcagtggcgcgatctcggctca

SEQ ID NO: 35481 - DNA, 78 bp, Homo sapiens
gggtgacagactgagactctgtctcaaaacaaacaaacaaaaacaaagaatgactccagggttttggcctggtggctc

SEQ ID NO: 35482 - DNA, 111 bp, Homo sapiens
tgtatcccactatgggtaaactgagtacttttgttccaaagtcattgaaataatatatatatatttttttttagagacggagtcttactctgtcacccaggctggagtgca

SEQ ID NO: 35483 - DNA, 112 bp, Homo sapiens
tgacaagaatgtttctgttaggaggtcttctctacagattacaaatctatcagaggatcttctgtctggatgtcttctgtttcagtgtcccttttagctatatcatttggca

SEQ ID NO: 35484 - DNA, 145 bp, Homo sapiens
tagctaacggacacaggtgggatttaactcaggtctgatttaaaaatcccatgcttttttgagacggactctcgctctgtcacccaggctggagtgcagtggcgcaatcttggctcactgcaacttctgcctccccggttcatgc

SEQ ID NO: 35485 - DNA, 104 bp, Homo sapiens
ggtaattatctctgtggcatttcactttgtggaagatttctgttattgttacaaaatgtgacggttaagaataatttacggggcaagaacacaggcttcacgcc

SEQ ID NO: 35486 - DNA, 58 bp, Homo sapiens; identical to SEQ ID NO: 454

SEQ ID NO: 35487 - DNA, 101 bp, Homo sapiens
cacccagtgtgtgggcatttggggaggaaataggaaaagagattttttaaattattttattttttgaaacaaggtcttgctctgtcagccagactggagtg

SEQ ID NO: 35488 - DNA, 90 bp, Homo sapiens
ctgggattgctgaattcaaagggcatgtctttttttttttttttttttctctgtttgtttttttagacaggctctctctcagttgtccag

SEQ ID NO: 35489 - DNA, 65 bp, Homo sapiens
ctcgcctgcgcacacagtgagcacacacgcgcccgtgcactgtttacgctcgcctgcgcagtgag

SEQ ID NO: 35490 - DNA, 118 bp, Homo sapiens
gtgagcacacacgcgctcgtgcacttacactcgcctgcgcacacagtgagcacacacgcgcccgtgcactgtttaaactcgcctgcgcagtgagcacacacgcgcccgtgcagtttac

SEQ ID NO: 35491 - DNA, 116 bp, Homo sapiens
tgcctcagcctctctaagtgctggcattacaggtgtgagccaccccacccaacttttttttttttttttttgagatggagtttcgctcttgttacccaggctggagtgcaatggca

SEQ ID NO: 35492 - DNA, 66 bp, Homo sapiens
acagagtgagaccccatctctctctctcttttttttttttttttctgagacagactctcgctctgt

SEQ ID NO: 35493 - DNA, 69 bp, Homo sapiens
tgtttttgagatggagtctcactctgtcacccaagctggagtgtagtggtgcgatctcggctcactgca

SEQ ID NO: 35494 - DNA, 61 bp, Homo sapiens
tagagacggactcggactctggctctgttgcccaggctagagtacagtggagcaatctctg

SEQ ID NO: 35495 - DNA, 113 bp, Homo sapiens
gttttgctgaatgctttagtgttgctaacattatttctcccaaaaatatgatttaagattatttttgtttgtgagagaatgttgatgtatatacactttgaccagtgcaaaat

SEQ ID NO: 35496 - DNA, 112 bp, Homo sapiens
ctgagtgacagagtgagaccctgtctgaaaaaaaaaagaaagttgacatgaaattattttttatttttatttttttattttttccaagacggagtctcgctctgtcgcccag

SEQ ID NO: 35497 - DNA, 95 bp, Homo sapiens
gcgtgagccactgtgcccaactgtttttgtttttgagacggagtctcgctctgtcgcccaggctggagtgcagtggcgcaatctcggctcactgc

SEQ ID NO: 35498 - DNA, 99 bp, Homo sapiens
gcatgatgctgagaaccaaacagtagtgaaatacatcaactttgaacagtatgggtcacttaattctgtcatcctacctcaccccaagcaatttcatgc

SEQ ID NO: 35499 - DNA, 117 bp, Homo sapiens
actgcagcttgggtaacagagcaagacctgtctctaaaaataaaaataaataagtttgttttttattttattttatttttttttgagatagagtcgctctgttgcccaggctggagt

SEQ ID NO: 35500 - DNA, 107 bp, Homo sapiens
tgattccctgcatgtgtcagtagtgtgatgtaaggcctaaaatcaatttttttttttttttgagatggagtctggctctgtcgcccaggctggagtgcagtggtgca

SEQ ID NO: 35501 - DNA, 95 bp, Homo sapiens
atatatgcgatgttaacatatatgtttatatgtatacatacatgcacatgcatgtattcacatatacatatatacataaagacacacacatatat

SEQ ID NO: 35502 - DNA, 114 bp, Homo sapiens
tgggtgtggtggcatgtacctgtagttccagctacttgggaggctgaggtaagaggatgccttgagcctgggaggcagaggttgcagtgagctgagaatgtgccactgcactta

SEQ ID NO: 35503 - DNA, 58 bp, Homo sapiens
tgagtcagagtctcgctctgtcacccaggctggagtgcagtggtgcgatctcggctca

SEQ ID NO: 35504 - DNA, 75 bp, Homo sapiens
agacatgggacttgagttaggcttttattattattattattttttgagacggagtctcactctgtcacccagtct

SEQ ID NO: 35505 - DNA, 75 bp, Homo sapiens
ttctaagagacagtgactccctctgtcacccaggctggagtacagtggtgtgatcatagatcactgtaagttgaa

SEQ ID NO: 35506 - DNA, 122 bp, Homo sapiens
agtgattcatgatgttctaggtttttagtaacgttttactcaggttggcattttatgtgtctgtgtctgtatgtgtgtgtgtatgttcagaagcgtggcaatctgtgaacacttcagcgtga

SEQ ID NO: 35507 - DNA, 126 bp, Homo sapiens
atatatgtgtatatacgtacgtgtatatatgtgtatatacatatgtgtatatatgtacgtatatatatgtgtatatatgtgtgtatatatgtacgtgtatatatgcgtgtatatatgtacgtgtat

SEQ ID NO: 35508 - DNA, 91 bp, Homo sapiens
gatctcattcattttatggctgaatagtactccattgtgtatatatagcacattttctttatctatttgtctgttgatgaatgcttaggtt

SEQ ID NO: 35509 - DNA, 103 bp, Homo sapiens
tgcagtggactgagacagacattgaatcctgctgtgcctgtggggactgaagaagagtagtgatgttcttgttatcgtttgtctgaaactgcagtctgctgca

SEQ ID NO: 35510 - DNA, 66 bp, Homo sapiens
gggtggggccacagggaccagtctcctactgcataagcctggagactctgtctgtgagtgctagcc

SEQ ID NO: 35511 - DNA, 95 bp, Homo sapiens; identical to SEQ ID NO: 68

SEQ ID NO: 35512 - DNA, 93 bp, Homo sapiens; identical to SEQ ID NO: 69

SEQ ID NO: 35513 - DNA, 67 bp, Homo sapiens
cttccgttcttaggctctctgcctctgagcctcagggcttcttgggcacagactttctaacaggaag

SEQ ID NO: 35514 - DNA, 115 bp, Homo sapiens
aactctgtgagatgaatgcacacacccaaagttgtttctcagaaagattctctctagtttctttttttattattatactttaagttttagggtacatgtgcacaatgtgcaggtt

SEQ ID NO: 35515 - DNA, 97 bp, Homo sapiens
ctctcttcttgtagaatctgcaaagggatatttgtgagtgctttgaggtctatggttgaaaagaaatatcttcacagaaaaactagacagaagggtg

SEQ ID NO: 35516 - DNA, 114 bp, Homo sapiens
gagagggtagctaattttaagagaggagtgagaagaaaacattgggaagtattactatttgctagactagagtttttgctagattatttttatattcaaatatttctgctttcc

SEQ ID NO: 35517 - DNA, 83 bp, Homo sapiens
cataaaaagaagacagaagcattctgagaaacttctctgtgatgtgtgcattgttctcacagtgctgaacctttcttttgatg

SEQ ID NO: 35518 - DNA, 95 bp, Homo sapiens; identical to SEQ ID NO: 68

SEQ ID NO: 35519 - DNA, 93 bp, Homo sapiens; identical to SEQ ID NO: 69

SEQ ID NO: 35520 - DNA, 95 bp, Homo sapiens; identical to SEQ ID NO: 68

SEQ ID NO: 35521 - DNA, 93 bp, Homo sapiens; identical to SEQ ID NO: 69

SEQ ID NO: 35522 - DNA, 81 bp, Homo sapiens
agctcctgactgcgagtgatctgcccgcctgggcctctcgaggtgccgggattgccagcggagtctctctcactcagtgct

SEQ ID NO: 35523 - DNA, 125 bp, Homo sapiens
gggtgtgtacacctattgatactatttgtaatatcctaaggaaatattactttaaaaatcacagtgggtgtacatcatgtgtgtacaccctgtgatattattcacaatatcccagggaggtataa

SEQ ID NO: 35524 - DNA, 74 bp, Homo sapiens
gttggagcacagcaaacagagcaggctcttgtccacttcacagaacatctcctttgtctctctgtgcgtcccac

SEQ ID NO: 35525 - DNA, 89 bp, Homo sapiens
tcaaaagaaaaagaaaagttagcaagtgataatatttaatgaaataattgtagtatttaaaatatttcttttttttttttttcttttga

SEQ ID NO: 35526 - DNA, 58 bp, Homo sapiens
tgagatagtctctcactctgtctcccaggttggagtgcaatggtgagatcacggctca

SEQ ID NO: 35527 - DNA, 71 bp, Homo sapiens
gtgtgtgtgtatatatataatatatgtgtgtgtatatatgtgtatatgtatgtgtgtgtgtatatatatat

SEQ ID NO: 35528 - DNA, 95 bp, Homo sapiens; identical to SEQ ID NO: 68

SEQ ID NO: 35529 - DNA, 93 bp, Homo sapiens; identical to SEQ ID NO: 69

SEQ ID NO: 35530 - DNA, 90 bp, Homo sapiens
cttgttcctgctctctctgtgccacactgtgttatctgttgtttcaatcccagaacatcaacagtgtggagcatttagtaaatactcaag

SEQ ID NO: 35531 - DNA, 70 bp, Homo sapiens
atatatatatatataatctattatatgtgtatgtgtgtatatatatatgatctattatatgtgtatgtat

SEQ ID NO: 35532 - DNA, 62 bp, Homo sapiens
ctctaactactctgctcatgtttatatattcaagtatgtgagtgtgagacagagagagagag

SEQ ID NO: 35533 - DNA, 83 bp, Homo sapiens
tttatatatatatatacagatatatatatatatatatacagatatatatatatatatatatacagatatagatgatagataga

SEQ ID NO: 35534 - DNA, 112 bp, Homo sapiens
ggattgtcttggctatatgggctcttatttggttccatatgaaatttaaagtagttttttctaactctgtgaagaaagtcaatggtagcttgatggggatagcattgaatct

SEQ ID NO: 35535 - DNA, 172 bp, Homo sapiens
gtgtatatacacatatgtgtatatacatatatatgtatatgtatgtgtgtgtatatgtatatatgtgtgtatgtatatatgtatatgtacatatatatgtgtatatatgtgtatatatacatatatgtgtgtgtatatatatatacatacatacatatatatatatatatat

SEQ ID NO: 35536 - DNA, 127 bp, Homo sapiens
atatatacacatatgtatatatacacacatatatgtatatatacacatatatatgtgtatatatgtatgtatatatgtgtgtatatctatacacacacatatatatatacacacacatatatataca

SEQ ID NO: 35537 - DNA, 85 bp, Homo sapiens
gttgctttctggataatgtccaggttttagcatgggaattggagtcctgagaaagcctggcactctttctctctatcaaagtgac

SEQ ID NO: 35538 - DNA, 79 bp, Homo sapiens
caggccagactagtaaggaaagtaaaaaaagagtaaaatactcttcatcgatctatctgtctctctgtctgtctgtctg

SEQ ID NO: 35539 - DNA, 95 bp, Homo sapiens; identical to SEQ ID NO: 68

SEQ ID NO: 35540 - DNA, 93 bp, Homo sapiens; identical to SEQ ID NO: 69

SEQ ID NO: 35541 - DNA, 95 bp, Homo sapiens; identical to SEQ ID NO: 68

SEQ ID NO: 35542 - DNA, 93 bp, Homo sapiens; identical to SEQ ID NO: 69

SEQ ID NO: 35543 - DNA, 58 bp, Homo sapiens
acccaagctggagtgcagtggcggtatgtcaagtcactgcagtctctgtctcctgggt

SEQ ID NO: 35544 - DNA, 115 bp, Homo sapiens
tcatctagtcagtagtgtctgctaaaaagcctaaagactctctttgtgtatgaatttttcatttttgttacagaggaaatagtttgttctgctttaatgagcactgtcaagaaga

SEQ ID NO: 35545 - DNA, 113 bp, Homo sapiens
tatgatttgggactgctacctcaggaaagggttttaaagacaaatttcccttgaatgattatttgtttttcaatcctgtgataaaatatttggtattagaaagctcaattgta

SEQ ID NO: 35546 - DNA, 78 bp, Homo sapiens
ctgggtgcagtggtgtgtgcctgtaatccctgctccagctatttgggaggctgaggtaggaggatcacttgagcccag

SEQ ID NO: 35547 - DNA, 89 bp, Homo sapiens
gacttgctaatctcgtatagtcacagccctcttctgacctgtatctggttatatgtgaagcagaggctgtgttgagatgtagtgagatc

SEQ ID NO: 35548 - DNA, 64 bp, Homo sapiens
gctctgacattctgtgactctgaacagcttaggggctgttaagagatacagactgacatttagt

SEQ ID NO: 35549 - DNA, 85 bp, Homo sapiens
tggaattgctgaacaaagcatttgtcagaaaatatctctatttttaagtgatgaatgactgcagtgtgattaaagcaagactcca

SEQ ID NO: 35550 - DNA, 106 bp, Homo sapiens
taatttgggaaataaattagctttagcgaattttactttaaattttttatttagggcacataccttaataatttaattgtgaaagctatgcatttgcctttaattg

SEQ ID NO: 35551 - DNA, 110 bp, Homo sapiens
tgcttaggattgtcttggctatgcgggctcttttttggttccatatgaaatttaaagtagttttttccaattgtgtcaagaaagtcaatggtagcttgatagggatagca

SEQ ID NO: 35552 - DNA, 98 bp, Homo sapiens; identical to SEQ ID NO: 1311

SEQ ID NO: 35553 - DNA, 89 bp, Homo sapiens; identical to SEQ ID NO: 35547

SEQ ID NO: 35554 - DNA, 84 bp, Homo sapiens
cagaaagaagctttctgagaaactgcttcatgatgtgagcattcatctcacagagttgaacatttctctggattcatcagtttg

SEQ ID NO: 35555 - DNA, 108 bp, Homo sapiens
ttcatctcacagagttaaatctttcttttcattcattagtttggaaatactgtttttgtagatctgtgaagggacctttgggagggccttaatgcctgtggtgaagaa

SEQ ID NO: 35556 - DNA, 96 bp, Homo sapiens
tgtgtgtgtatatatatatatacacacacacacacatatgtatatatatatgtatatgtgtgtgtgtctgtgtggttgtatataggtatgtgtgta

SEQ ID NO: 35557 - DNA, 108 bp, Homo sapiens
atatatatacaaacacatacatacacacatacctatatacaaccacacagacacacacacatatacatatatatatacatatgtgtgtgtgtgtgtatatatatatat

SEQ ID NO: 35558 - DNA, 95 bp, Homo sapiens; identical to SEQ ID NO: 68

SEQ ID NO: 35559 - DNA, 93 bp, Homo sapiens; identical to SEQ ID NO: 69

SEQ ID NO: 35560 - DNA, 59 bp, Homo sapiens
tggagatggagtctcactctgacacccaggctggagtgcaggggatgatctcggctcta

SEQ ID NO: 35561 - DNA, 108 bp, Homo sapiens
gttaaatctttcttttattgcaccattttggaagcactgttgtttttttttttgattctgtgaatggacatttgggagctcattgggagcaatggagaaaaagttaat

SEQ ID NO: 35562 - DNA, 119 bp, Homo sapiens
aaatgatatttaagccagaatgaatgggaagctgttgtgggaagtcagggacactgaacagagtcaccagctggaatcacggcagaggaacataaattgtgaagttttcatggacattt

SEQ ID NO: 35563 - DNA, 66 bp, Homo sapiens
cagacaagtttgttggggatccttgggcccgagtttgtaaagctcctgggtctctgtgtgtgtctg

SEQ ID NO: 35564 - DNA, 116 bp, Homo sapiens
agtgacccggaatctgcagtgctagtctcccggaactatcactctttcacagtctgctttggaaggactgggcttagtatgaaaagttaggactgagaagaatttgaaaggcggct

SEQ ID NO: 35565 - DNA, 57 bp, Homo sapiens
ctctgtctcactgtgtcttagccagttccttacagcttgccctgatgggagatagag

SEQ ID NO: 35566 - DNA, 93 bp, Homo sapiens
cagatacatacacacactattatatattaagtatatataatagtgtgtattatatatattaaatatatataatagtgtatgggtatgtatctg

SEQ ID NO: 35567 - DNA, 89 bp, Homo sapiens
aaggaaaaacagcggtatgtaattctggggtccttctctaaaatgagggtgacctattagcttgaaatgtctgcttagtgaaaagcctt

SEQ ID NO: 35568 - DNA, 59 bp, Homo sapiens; identical to SEQ ID NO: 35560

SEQ ID NO: 35569 - DNA, 104 bp, Homo sapiens
ggggttggtttgctctttcttctctagtgccactagctgtgaggttgttaatttgaaatatttctaactttttgatgtgggcatttaatgcaatgaacttccct

SEQ ID NO: 35570 - DNA, 79 bp, Homo sapiens
agttggttgatttcatggtagacacaggtagaagtcccttctgattattactgtctttcttgttgaaataagcacaact

SEQ ID NO: 35571 - DNA, 95 bp, Homo sapiens; identical to SEQ ID NO: 580

SEQ ID NO: 35572 - DNA, 93 bp, Homo sapiens; identical to SEQ ID NO: 69

SEQ ID NO: 35573 - DNA, 87 bp, Homo sapiens
cagggcctagtggagctgtgagaagaatgtcaccatcctccagaccctagaatggtagatccactaacagcttgcgctatgcacctg

SEQ ID NO: 35574 - DNA, 95 bp, Homo sapiens; identical to SEQ ID NO: 68

SEQ ID NO: 35575 - DNA, 93 bp, Homo sapiens; identical to SEQ ID NO: 69

SEQ ID NO: 35576 - DNA, 95 bp, Homo sapiens; identical to SEQ ID NO: 68

SEQ ID NO: 35577 - DNA, 93 bp, Homo sapiens; identical to SEQ ID NO: 69

SEQ ID NO: 35578 - DNA, 77 bp, Homo sapiens
atctgtgtatatatacatgcatgtatatatgcatatatatattcaaattgcatatatacacatgtgtatacatagat

SEQ ID NO: 35579 - DNA, 95 bp, Homo sapiens; identical to SEQ ID NO: 68

SEQ ID NO: 35580 - DNA, 93 bp, Homo sapiens; identical to SEQ ID NO: 69

SEQ ID NO: 35581 - DNA, 69 bp, Homo sapiens
tacatacatatatatgtatataatatatgtatgtacatgtatatgtacatgtatacgtacatgtatgta

SEQ ID NO: 35582 - DNA, 93 bp, Homo sapiens
ctagcccaatggttcagaggaccatagatacagaggcagagctactcaatcgttatgtaggtctatgagttcccgttagacccgttagactag

SEQ ID NO: 35583 - DNA, 93 bp, Homo sapiens
caatacatatacagctatacatatgattccacttgtacatatactcatgtgtgtatgtgcatgtgtattcataaaatcagtttctctgtgttg

SEQ ID NO: 35584 - DNA, 118 bp, Homo sapiens
ggatatatgaggaatatatatgtgtatctgtgtgtgtgtatatatatattcctcaaatgtatccatatatatatatatatataccaacatccagatacacatatatattcatatattt

SEQ ID NO: 35585 - DNA, 109 bp, Homo sapiens
gtctcaggagcaagaatcagctgtgggggaccacacagttattattgtctttataattgaataataacagtgtatcttgtccagaataatttgtgtgttccttcaagat

SEQ ID NO: 35586 - DNA, 68 bp, Homo sapiens
gacttgaagtgagactgacatgggttcacatctgtatgtgaactatcagtcactctcagttacatgtt

SEQ ID NO: 35587 - DNA, 87 bp, Homo sapiens
tttatatgtgtgcatatgtttgtgtgtatatatatgtgtatatatatatatatatatatatatatataaaattgcttttactataga

SEQ ID NO: 35588 - DNA, 60 bp, Homo sapiens
tgcttctcactgtgtatacgtgtgtgtatgtgtgtatatatatatgtgtgtgtgtgtgta

SEQ ID NO: 35589 - DNA, 58 bp, Homo sapiens
tgagacagagtctcactctgtcactcaggctggagtgcagtggtgcaatcttgactca

SEQ ID NO: 35590 - DNA, 115 bp, Homo sapiens
ctttaagcaaaattatgtatagtgaaaccaatttattcctcatcaacgttataagtaaacaactttgaacaaaacagtggtgttggaggacctactgtacattgtttccataaag

SEQ ID NO: 35591 - DNA, 107 bp, Homo sapiens
tcgctatttcctatcatgctccattttagcttatatgtgtatatatatgtgtgtatgtttacgtgtatgtgtatatgtagcgtgtgtgtatgtatatctcatagtga

SEQ ID NO: 35592 - DNA, 116 bp, Homo sapiens
atgtggttatgatgacataatatttatagatgaatttattataaatagtgcatgtaaatactgtatttcatgtactgttaattttattatagaatattttgtagaaataagtatgt

SEQ ID NO: 35593 - DNA, 112 bp, Homo sapiens
atgtattttacttatttccatgctcaatagagagaccaaggcagcatatattttattatttattaattttatcattgtctctatttgtgtatgtgtttgagtgtctatatat

SEQ ID NO: 35594 - DNA, 63 bp, Homo sapiens
tttatctatatatatgtgtgtgtgtgtgtatatatatatatatgtatatatatatatgatgga

SEQ ID NO: 35595 - DNA, 110 bp, Homo sapiens
cacattgtaatccaatgtgctatatatatgtacaaatatatatctatatatatatatacagactatatatggaatgtacaaatatatatagcactttgaattacaatgtg

SEQ ID NO: 35596 - DNA, 100 bp, Homo sapiens
tgtgtatatatacaagtgtatatgtgtgtgtatatatatacagaagtatatatatgtgtatatatgtatatatgtgtataaacatacatatacataaaca

SEQ ID NO: 35597 - DNA, 102 bp, Homo sapiens
atgtggatgagctttaatattctggaaattttatgtaaatttaattatacaatactcctgacagtttttatttatcataatggtttcaaggcttatctatat

SEQ ID NO: 35598 - DNA, 57 bp, Homo sapiens
gccgcagccagactgcatgtgttcaaatcctgactctgacagacactggctgtgtgc

SEQ ID NO: 35599 - DNA, 118 bp, Homo sapiens
ccacccggcagtgcctccaggcgcagggcagcccctgcccaccgcacactgcgctgccccagacccactgtgcgtgtgacagcggctgatctgtgcctgggcagcgcgaccctcctgg

SEQ ID NO: 35600 - DNA, 109 bp, Homo sapiens
tcaaagccagtttctttgggatgttgggcagcatggtgagtatgactagtgaattccatgatcatggacacattgctgcacttctttatctgtgaagtgagtttcttga

SEQ ID NO: 35601 - DNA, 107 bp, Homo sapiens
tagccatggtggactcaaatgcatgaggaatagaaatgttgatcacactattttcagtacttaatttgatattctttcttctggtagtcctaatgtcctccatgctg

SEQ ID NO: 35602 - DNA, 79 bp, Homo sapiens
ggagaatctatccagacagtagacagagacaaggcttcattggagtggagctgggggcctttgtgcatggaagagctcc

SEQ ID NO: 35603 - DNA, 74 bp, Homo sapiens
ctatatatatatgtctatacatatgtgtgtatatacatatacacacacctatatgtatattctcatacttatag

SEQ ID NO: 35604 - DNA, 69 bp, Homo sapiens
tctaagaccatgtatatatgtgtgtacatatgtatgtgtacatatatatatgcaaagactgattataga

SEQ ID NO: 35605 - DNA, 115 bp, Homo sapiens
gagtaaggcagagacacaggatggcagttacagtgaactctgaagggtgagagcagaggccagaatggcatgtgtcagaatatctgtaacatatcaatcaaggtgcaaattgctc

SEQ ID NO: 35606 - DNA, 74 bp, Homo sapiens
ggtccttgggcaaagttctgtgggtggagccctcaccagggaccccacccttctctacacatcacttcccaacc

SEQ ID NO: 35607 - DNA, 113 bp, Homo sapiens
ttggcatgcaaaagataatcaaaaatggtaatttttaaagagaaaaaagtgacatttttctttatgatttttttctttatgattccatttatcactatatatggcagttctaa

SEQ ID NO: 35608 - DNA, 116 bp, Homo sapiens
gtgtttacagctcctgtgggccccgcggacatgtgttacactgtactctttttttttatactttaagttctagggtacatgtgcacaatgtgcaggtttgttacatatgtatacat

SEQ ID NO: 35609 - DNA, 116 bp, Homo sapiens
tttatgtcctatgagtttaagaatgtagacagggagaggttaattatttcattttagaaggaagaaactgtgcttctgagaggttaagatcttcccacgttctcacagaaagtaag

SEQ ID NO: 35610 - DNA, 97 bp, Homo sapiens
agtttgatttttatgtagacacacacacacacatacatacatactaaatgtgtgtatttacactgatgtggtttggctctgtgtacccactcaaatt

SEQ ID NO: 35611 - DNA, 58 bp, Homo sapiens; identical to SEQ ID NO: 2051

SEQ ID NO: 35612 - DNA, 95 bp, Homo sapiens; identical to SEQ ID NO: 68

SEQ ID NO: 35613 - DNA, 93 bp, Homo sapiens; identical to SEQ ID NO: 69

SEQ ID NO: 35614 - DNA, 89 bp, Homo sapiens
gggaaagtggagatgatggagtaggggtgtgagatgagagtgagcagcaggcttgccctgagtcacctactgtatgatcgagagcgcct

SEQ ID NO: 35615 - DNA, 87 bp, Homo sapiens
gctttcctgcttgaaaaggaatcaaatgaaatatctctacctttgggtccatggatatttaacatttttctcttcaagaaaaagagc

SEQ ID NO: 35616 - DNA, 86 bp, Homo sapiens
attcctccccagctttcagtccatgtgcttcttctttttttttttttttttgagatggagtcttgctctgttgcccaggctggagt

SEQ ID NO: 35617 - DNA, 104 bp, Homo sapiens
ttagaacagggcttagaagtcagataaatctaggttttattcatggtcctgccactttttaattttttaatttgtatttttttcatggccctgccactttctaa

SEQ ID NO: 35618 - DNA, 56 bp, Homo sapiens; identical to SEQ ID NO: 885

SEQ ID NO: 35619 - DNA, 62 bp, Homo sapiens
ttttgcactttctcactgtctctgccaccccaaatggtggcacaaacagtgtttttgcaaaa

SEQ ID NO: 35620 - DNA, 109 bp, Homo sapiens
gtgtgtgtatatatatgtatatatgttttatatatatatgtatatatatgtgtatgtatacacccacgtatatatgtatatgtgtatatacatatgtgtatgtgtatat

SEQ ID NO: 35621 - DNA, 77 bp, Homo sapiens
ctctctttctctgaatctcacattttgcctctgtgaagtaggggtggtacctggtggagatgatgcggagatgaggg

SEQ ID NO: 35622 - DNA, 99 bp, Homo sapiens
aggctataaattagaaggatttttaagtgtagactgtgaggtcagatgacctggcttcataacccagctctgtgtgatccttagaaaattactgagcct

SEQ ID NO: 35623 - DNA, 111 bp, Homo sapiens
gttgacctgtcaaaaatggataagatgcaaagggtttttgtctggtagagatgtgaatgagatgataatgataaccccaaaggtaatggtcttgatgcagggcaggtgagc

SEQ ID NO: 35624 - DNA, 58 bp, Homo sapiens
tgagagggagtctcacactgtcacccaggctggagtgcagtggcgcgatctcagctca

SEQ ID NO: 35625 - DNA, 69 bp, Homo sapiens
gctgtacagttctttacctagcatttcttgtgatgtaaatatgaaaaaatgctatgtaaagaaatcagt

SEQ ID NO: 35626 - DNA, 87 bp, Homo sapiens
ccagcccgggcaacatagggagacgctgtctctatttttttttttttttttttttgagacggagtcttgctctgtcacccaggctgg

SEQ ID NO: 35627 - DNA, 105 bp, Homo sapiens
gtgtgaatgaagggaaggaaggaggaccagagagcaattttcatgatgtgtacagattttgaagaattgtttttgacatggataactttctgacttcatacagat

SEQ ID NO: 35628 - DNA, 58 bp, Homo sapiens
tgaggcagagtctcactctgtcgcccagactggagtgcagtggtgagatcttggctca

SEQ ID NO: 35629 - DNA, 178 bp, Homo sapiens
gtgtgtgtgtgtgtatatatatacgtatatatatgtatatgtgtatatatatatacgtatatatgtatatgtgtatatacgtatatgtatatgtatatatacgtatatatgtgtatatatacgtatatatgtatatatgtatatgtgtgtgtgtgtatatatatacacatatatatat

SEQ ID NO: 35630 - DNA, 99 bp, Homo sapiens
cacaatcaaatcatctacaaatgacagttttatttatgtttgtcaatattatttttgactaataaatcataattgtatacatttatggagcatgatgtg

SEQ ID NO: 35631 - DNA, 93 bp, Homo sapiens
tgtggtggtgatatgcatgcatacatattttttaaattcattcagctatacatgtaagatgaatgtattttactgtatgtaaattatacctca

SEQ ID NO: 35632 - DNA, 82 bp, Homo sapiens
gactacccttgagtttgttcaacagcatgtggtatgttagaaggaaatctcaccagcgttacggcaagattgggggttagtt

SEQ ID NO: 35633 - DNA, 112 bp, Homo sapiens
gtttctttgctgtgcaaattttttttagtttaactccatttctctatttttgtttttaatgcctgagattttgaggtcttattttaaaaatttttgcccagcccaatgttac

SEQ ID NO: 35634 - DNA, 63 bp, Homo sapiens
ggagtccctgactctctcagatatcccagccctgattgctgttgggatctggccgtcctctcc

SEQ ID NO: 35635 - DNA, 95 bp, Homo sapiens; identical to SEQ ID NO: 68

SEQ ID NO: 35636 - DNA, 93 bp, Homo sapiens; identical to SEQ ID NO: 69

SEQ ID NO: 35637 - DNA, 83 bp, Homo sapiens
atgcgtaaatatgcatatttacacatataaatacatatgtacatatatataattatgtgtggaataagcatgtaactatacat

SEQ ID NO: 35638 - DNA, 101 bp, Homo sapiens
gctatgcaggctctattttggttccatatgaaatttaaagtagttttttctaattctatgaagaaagtcaatggtagcttgatggggatagcattgaatgc

SEQ ID NO: 35639 - DNA, 102 bp, Homo sapiens
ctgtacactctgaacactatcatttaaagttacttgaatgaactatttcgtttttattattattatactttaagttctggtgtacatgtgcagaatgtgcag

SEQ ID NO: 35640 - DNA, 115 bp, Homo sapiens
tgtttttggaaagaggaagagaattgagaaaatcatcacagaggaatgagtttttgagaactaaattttttttattttttttattttttttattttttttttattttttgagaca

SEQ ID NO: 35641 - DNA, 102 bp, Homo sapiens
ttgtaatcttatagggagatattactttaaatatcacagtgggtgtacacacatgatgtacacccacggtgatattatttgtaatatcttagagagatataa

SEQ ID NO: 35642 - DNA, 69 bp, Homo sapiens
gtacaaacactgtgatattttttgtaatatcttagggagatattaatttcaatattatagtaagtgtac

SEQ ID NO: 35643 - DNA, 130 bp, Homo sapiens
ataggtgtacaccctgtgatattttttgtaatatcccagggggacgttactgctaatatcacagtgggtgtacactctgtgatattatttgtaatatcctagggagatatgactcctaatattactgtgg

SEQ ID NO: 35644 - DNA, 87 bp, Homo sapiens
cacagggtgtacaccctctgtgaaattaggagtactatctttccaggatattacgaataatattacagagggtgtacattcactgtg

SEQ ID NO: 35645 - DNA, 105 bp, Homo sapiens
atcagctttgaagtcttgttggtttcatgtgtgaaattttgcaggatcacaggtatatgtgaatgtgcaaaagcatgtgtagtcttgagaggtcatgagtatgat

SEQ ID NO: 35646 - DNA, 115 bp, Homo sapiens
gtatgtatatgtatacatatacatacatatatatgtgtatatgtatatatgtatatatgtatgtgtatatatatatacacatatttgtgagtgtatgtatatatacatatacatg

SEQ ID NO: 35647 - DNA, 144 bp, Homo sapiens
taaaatatgtgtatttgtgtgtgtgtgtgtatatatatatacacacacacatatatgtatatatttacatatattttatagtttacatgaatatatatatgtgtgtatatatatatatacacacacacatatatatatgtatat

SEQ ID NO: 35648 - DNA, 110 bp, Homo sapiens
gctttaattttacataccaaatttttaacaaattgagcatcaactatatatgtatgtgtgtgtatatatatatattctgttgtaattaacatgttaaataaatattaggc

SEQ ID NO: 35649 - DNA, 95 bp, Homo sapiens; identical to SEQ ID NO: 68

SEQ ID NO: 35650 - DNA, 93 bp, Homo sapiens; identical to SEQ ID NO: 69

SEQ ID NO: 35651 - DNA, 92 bp, Homo sapiens
gacacactgtatgcctctaatgatttgtagtgtgctatttcttaggttgggaagagatacatggatgtttagtatatgaaatatagggtgtc

SEQ ID NO: 35652 - DNA, 71 bp, Homo sapiens
ctgagagggagggcagaggattacaggttacagctttatgcaaagactctctttctctttctcagtctcag

SEQ ID NO: 35653 - DNA, 93 bp, Homo sapiens
ctactgtttatagtaattagttatgcagctatggaaaattaataccgtagtatagacttaccataggctaggtatattaatgacaaagagtgg

SEQ ID NO: 35654 - DNA, 111 bp, Homo sapiens
ggaaggcaagagaaggtcaaagagattctgtttcctgtgtatgaaaacctatatgtatatatatttcataacactacaaacattaacaggactttggaagaagttgattcc

SEQ ID NO: 35655 - DNA, 132 bp, Homo sapiens
cctcagtggcagggactttatcttttttattttattttattttttgagatggagtctcgctctgtcacacaggctggagtgcagtggtgcaatcttggatcactgcaacctctgcctcctggattcaagtga

SEQ ID NO: 35656 - DNA, 196 bp, Homo sapiens
tctggaaactgagtgaagttcaaccccccacctaaagagattagtggagcaaatactgtctggttatgttcagctgtctgggttaggacagctcagtatggcatcagggtttttttttttttaataaatttttaagttttagcctacttttagatttatggaaaagttgcaaagatagtacagagagttcctgtct

SEQ ID NO: 35657 - DNA, 126 bp, Homo sapiens
gaggaaatagatggtttggagctcctcaaaagccccatcttcagagaattgtcattttttttttttacttttcctgaaatgctggttatttgacttgactctgaatgtgctcaagaggaatagacc

SEQ ID NO: 35658 - DNA, 144 bp, Homo sapiens
gcgtgagccaccgtgtacccagcctgtttttcagacggagttttgcttttttttttttttttttttgagacagagtctcgctctgtcacccaggctggagtgcagtggtgtgatctcagctcactgcaagctccgcctcccggg

SEQ ID NO: 35659 - DNA, 95 bp, Homo sapiens; identical to SEQ ID NO: 68

SEQ ID NO: 35660 - DNA, 93 bp, Homo sapiens; identical to SEQ ID NO: 69

SEQ ID NO: 35661 - DNA, 81 bp, Homo sapiens
tccatatgaatagatatatagatatagtattttccagaatatcatatgaaaagactatatctatatatctattaatatgga

SEQ ID NO: 35662 - DNA, 99 bp, Homo sapiens
gtgagactggttctgaaactggtgacttctgtctctgggagcagtctgatctccagtgatccatgctacagtctggacagggtcaaggtgacttcttgc

SEQ ID NO: 35663 - DNA, 79 bp, Homo sapiens
ttgtagacagagtctcgctcactcagtgctcaatgctgcccaggctggtgtgcagtggcgtgatctcggctcgctacaa

SEQ ID NO: 35664 - DNA, 95 bp, Homo sapiens; identical to SEQ ID NO: 68

SEQ ID NO: 35665 - DNA, 93 bp, Homo sapiens; identical to SEQ ID NO: 69

SEQ ID NO: 35666 - DNA, 102 bp, Homo sapiens
atgtattgaatgttttccatgaaattaggggaatttgggagccattatttctttaattttttttctggtactccccatttttatgggactcccattatacat

SEQ ID NO: 35667 - DNA, 81 bp, Homo sapiens
atgtatatgtatgtgtgtgtgtatatatatgtagttataatatgtatatatatgtgtatatatatacacatatatatacat

SEQ ID NO: 35668 - DNA, 85 bp, Homo sapiens
agatctggagactggaagtctgagatcaaggtgtcagcagggtgggctccttctggggctgtgaaggactccattccagacctcc

SEQ ID NO: 35669 - DNA, 87 bp, Homo sapiens
catctcagcctcctgagtagctgggactacaggtgtgcaccaccacgcccagctaattttttaatttttagcagagctctcgatatg

SEQ ID NO: 35670 - DNA, 82 bp, Homo sapiens
tccctccttctccacatatatatgtctctttatatatacgtatgtgtgtatatagaccatgtatatagtagacatagataga

SEQ ID NO: 35671 - DNA, 92 bp, Homo sapiens
ttgattttaaacttggagtatcccttgggatctcttaaaatttttagattttaaaaatagattcaggggttacatatgcaggtttggtacag

SEQ ID NO: 35672 - DNA, 90 bp, Homo sapiens
ctgtcttatctgtattttactgtctgctctttctggctgttgtagttagaagagaagtgatttccttgaaatgcatgaggctagaaaggg

SEQ ID NO: 35673 - DNA, 118 bp, Homo sapiens
tgcctacttcgtagggctcttgagaatttttatttttagttttatttatttatttttttaaatagcatttctaatagaatctaaacattgattggtctgacaggtcttctgtgtggca

SEQ ID NO: 35674 - DNA, 124 bp, Homo sapiens
ggacatgctctgaaacctagacctggtttgaagccccagccaggttgctggtttgctgtgtcactcaggctgtgtctccggcccatgctgggcctccctttcatgagcccctccagctctgggt

SEQ ID NO: 35675 - DNA, 61 bp, Homo sapiens
gtggtacaagcctgttgtcccagctactcggaaggctgaggtaggaggatggtttgagccc

SEQ ID NO: 35676 - DNA, 97 bp, Homo sapiens
ggaaggtgggtggctgatgggtgccgggctggtgttgatccacacttgtcaggtggctctgagaccagccttgactccaggctccaccacttccgcc

SEQ ID NO: 35677 - DNA, 119 bp, Homo sapiens
gacttgaagagcctgtgacacccggttgggctgagtttactttgtcaagaaactgaagctgtcacaggctcagtcacacagtgctgtcctagcctgcagaggtgactggctgctgtgac

SEQ ID NO: 35678 - DNA, 112 bp, Homo sapiens
cagggatagtaacagtaacgaccacagacggttgctaggattcagtgcaatgatgtatggaaaatgcctggcacagtgcaagtgtgtggaaggggaggaagaggcgcctttg

SEQ ID NO: 35679 - DNA, 95 bp, Homo sapiens; identical to SEQ ID NO: 68

SEQ ID NO: 35680 - DNA, 93 bp, Homo sapiens; identical to SEQ ID NO: 69

SEQ ID NO: 35681 - DNA, 76 bp, Homo sapiens
ggctaatttttttactatgtatgtgtgtatgtatgtatgtatgcatgtatgtgtgtgtgtatgtagagatggggtc

SEQ ID NO: 35682 - DNA, 77 bp, Homo sapiens
gtggccaagctttccaggcccacagagcggcccatctctcctcctcactctgttggtctctgcctctgttacgctgc

SEQ ID NO: 35683 - DNA, 72 bp, Homo sapiens
gcaagtgacttgggggctctgtatcttttttttttttttttctgacacagggtctacctctgtcactcaggc

SEQ ID NO: 35684 - DNA, 66 bp, Homo sapiens
gtgtgtgtgtgtgtatgtatgtatgtgtgtgtgtgtatatatatatatatatatatatatatatat

SEQ ID NO: 35685 - DNA, 83 bp, Homo sapiens
agtggtggcttctcagttcagtgagtaaagttgggactttttaaatttttatttgtattcattttttgagatagggtctcact

SEQ ID NO: 35686 - DNA, 58 bp, Homo sapiens
taggtaacactggtggaggtatccatggaatgggtgcctcagtctcagtgtctgtctg

SEQ ID NO: 35687 - DNA, 58 bp, Homo sapiens
tgagatggagtctcactctgtcacccaggttggagtgcagtgtcgaggtttcagctca

SEQ ID NO: 35688 - DNA, 76 bp, Homo sapiens
ggaggctgtggcaggaggatagcttgagcccaggaggtcaagactgtagtgagctatgtttgtaccactgtactcc

SEQ ID NO: 35689 - DNA, 93 bp, Homo sapiens
gagcagacattaggctaacaccatacatggcttgtcctgctgaattccatagcagtctgatgaagttgcttgtattgttgtcttcattttgcc

SEQ ID NO: 35690 - DNA, 114 bp, Homo sapiens
gagagctgatggcttagttccagagtaagtccaaaggcttgagaactgagagagctgatgtagttcttgtctcaaggccagcaggcttgagactcaggaagagccagtgttccc

SEQ ID NO: 35691 - DNA, 116 bp, Homo sapiens
ctcctgagagcctcccccatgagtgagaggatccctccaccttgccagtagagagaatggagacagggtaggaaggagactcccctccactccaggaagaacaaaggctttagggg

SEQ ID NO: 35692 - DNA, 57 bp, Homo sapiens
tgttgcagaaggaggccaccagccatgttagaaagaatggctgtgcagccttagaca

SEQ ID NO: 35693 - DNA, 76 bp, Homo sapiens
ggctacgtctgtcagtctgtctgtccggtgctccagctcaggggtgaagcctcggaccttctctgggggagttgcc

SEQ ID NO: 35694 - DNA, 78 bp, Homo sapiens
gactacgcagaggagctctcagagttaattcaacctactacaggaggggaatggaaagagggtctctgtatgccagtc

SEQ ID NO: 35695 - DNA, 122 bp, Homo sapiens
cacctcctccattacactgtagttcccaagaagaccctggcctccatctgcctctctcccagcctgtgggggaataggccaggaggctctgggcaacatagagactggaaaggagaggggag

SEQ ID NO: 35696 - DNA, 73 bp, Homo sapiens
cctgtggagtcctgtggaggagagaagcaggtcttccggtgcctcagtttctctccctctgtgacttgggagg

SEQ ID NO: 35697 - DNA, 83 bp, Homo sapiens
ggggaggtcgtgccgcctgtttctctctgtgtgtgagtttgcaggttcccagaggcagagactgggctttgcgacagctcccc

SEQ ID NO: 35698 - DNA, 74 bp, Homo sapiens
ggggcctgcagagaaggctgggagcccttgaggacgtgtgtcacccctgggactctctgagcctctgtgtcccc

SEQ ID NO: 35699 - DNA, 81 bp, Homo sapiens
gcctcttttcaggtggcagctattgatgacttttttttttttttgagacagggtctcactctgtcacccagactggagtgc

SEQ ID NO: 35700 - DNA, 58 bp, Homo sapiens
tgagacagagtctcgctctgtctcccaggctggagtgcagtggtgagatctcggctca

SEQ ID NO: 35701 - DNA, 210 bp, Homo sapiens
acatacacatatatatgtatatatacaaatatatgtatatatgcacacaatatatattgtgtgtatatatatacatatgtgtgtgtgtgtgtgtgtgtgtgtgtgtgtgtatatttactcaggccaggcacagtggctcatacttgtaattccagcattttgggaggctgaggtaggaggatcacttgagcccaggagtttgaggatgca

SEQ ID NO: 35702 - DNA, 94 bp, Homo sapiens
aatatatatatatacatatatgtatatatataaaatacatattatatgtacacatatatgtatatatatatgtgcgtgtgtatatatgtatgtt

SEQ ID NO: 35703 - DNA, 92 bp, Homo sapiens
ggctgggaccagcgcggccatggggatggagatgtcacagtcacaggctctgtggctctgaggaccaattcctgtggcttgcttttgtggcc

SEQ ID NO: 35704 - DNA, 104 bp, Homo sapiens
gctccagatcaaggagtgggggtggagaaagaagatggggaggaagtctgtttttttgttttgttttgttttttgtttttgtttttgtttttttgagatggagt

SEQ ID NO: 35705 - DNA, 108 bp, Homo sapiens
agccgggtgtggtggtgcacgcctgtaatctcagctacttggtaggctgaggtaggagaatgtcttggaggttgcagtgagctgagattgcaccattgcactccagct

SEQ ID NO: 35706 - DNA, 58 bp, Homo sapiens
tgagtcggagtctcgctctgtcacccaggctggagtgcagtggtgtgatctcggctca

SEQ ID NO: 35707 - DNA, 86 bp, Homo sapiens
agcatctgttgttcaggtttgtatacatgtattcgaatatatatttatgtcaggtatgtttatgcaaattagaatatatagacgtt

SEQ ID NO: 35708 - DNA, 102 bp, Homo sapiens
cccagaaagctaagcgagggagatggggaggtgagcaaggagggtggtttactttctcacactctcttgctctgtgcttattctttcggtgttgagtttggg

SEQ ID NO: 35709 - DNA, 88 bp, Homo sapiens
tcatgggtgaaaacattttatatatatatatatgaaagacatatatatgtttataacacatatgtatatgaaatgcatacatatatga

SEQ ID NO: 35710 - DNA, 68 bp, Homo sapiens
gggcgtggtggctcatgcctgtaatctcaacactttgggaggctgaggtaggaggatcacttgagccc

SEQ ID NO: 35711 - DNA, 68 bp, Homo sapiens
cctgggtgacagacagagtgagacctgatttttttttttttagacagagtctcactctgtcacccagg

SEQ ID NO: 35712 - DNA, 118 bp, Homo sapiens
atatatatatatatatgtgtatatatgtgtatatatgtatatatgtgtatatatgtgtatatatgtatatatgtgtgtatatatgtatatatgtgcatatatgtgtacatatatgcat

SEQ ID NO: 35713 - DNA, 117 bp, Homo sapiens
tctgtttctatgaatctggctactgtaaataccatgcataagtggaatcatactatgtttgtttttgtgactggattatttcatatagcataatgtactctagttcatctatataga

SEQ ID NO: 35714 - DNA, 66 bp, Homo sapiens
tctcaagaaatcagaggttttccaggggcctctctgcctggctgcctctgagttgctgtcctgagg

SEQ ID NO: 35715 - DNA, 98 bp, Homo sapiens
aggagcagattggcttcaacagtgtaggggcttgtcagtgttttcccatgtagggaaaaactgaacattcagagcactgttcagaggaaatcactcct

SEQ ID NO: 35716 - DNA, 95 bp, Homo sapiens
caatgcaggctcttttttggttccaaatgaaatttaaagtagttttttccaattgtgtgaagaaagtcattggtagcttgatggggatggcattg

SEQ ID NO: 35717 - DNA, 73 bp, Homo sapiens
ttttggccaaatcatcactctcactgtctcaatttttacaatttaagagttggtggattgatggggcacaaga

SEQ ID NO: 35718 - DNA, 91 bp, Homo sapiens
catgtcatacttgtgtccctgtgtctgtctgtacgtcttccatgcttgtgctggtttgagtattgacttacatctgagccttgtatgtatg

SEQ ID NO: 35719 - DNA, 77 bp, Homo sapiens
agcctgggagacctggctcgagtcttgcacatctttcttttttttttgagacagagtctcgctctgtcacccaggct

SEQ ID NO: 35720 - DNA, 58 bp, Homo sapiens; identical to SEQ ID NO: 1911

SEQ ID NO: 35721 - DNA, 129 bp, Homo sapiens
gtggtagagtgggacttcaagtagcctttttatttttgagatggcgtctcagagtctcgctctgtcacccaggctggagtgcagtggccgatctcggctcactgcaagctccgcctcccgggttcacgc

SEQ ID NO: 35722 - DNA, 84 bp, Homo sapiens
ctggcagatggagatagcagaagccaactcttttttttttttttttttttttgagactgagtctggctctgtcgcccaggctgg

SEQ ID NO: 35723 - DNA, 80 bp, Homo sapiens
gagagttgaagtgacttatcaagggtgcatccgagcttttccacaatccttgcagtcactcactgagtcacttctgctcc

SEQ ID NO: 35724 - DNA, 116 bp, Homo sapiens
ttttaagtggtagaggcagagttttgaacccagtgggtgtcactttttttttttaatttaaaatttttttggtagaactgggtcaggaaaatgttttaaattttatttatttgaga

SEQ ID NO: 35725 - DNA, 83 bp, Homo sapiens
ggaggcatgagacaagtctcgaggtggtaacaccagagggcgcccaacccctccagggacacacactcacttgctctcttcct

SEQ ID NO: 35726 - DNA, 107 bp, Homo sapiens
ggtgatgaggatatagcaggttttgttgttgttgttgttgtttttgagacagagtctcgctctgtcacccaggccggagtgcaacaccataatctcggctcactgcc

SEQ ID NO: 35727 - DNA, 117 bp, Homo sapiens
gcttttgtgttttcacaagtgtgtgcacacctgtgaagggcatctgtgtctatcagtgtatgactgtcagcatatgtgtgtttaggaggtgcatgactgaatgtgtatatattatgt

SEQ ID NO: 35728 - DNA, 85 bp, Homo sapiens
gacagagtgacgtgtctcaataaataaataagcccaaatatactaaagtaactttttgttttttgagacagagtctcactctgtt

SEQ ID NO: 35729 - DNA, 79 bp, Homo sapiens
ctgggattacagacgtgagccactcgcaccaggccctttttttttttttttttggatggagtcttgctctgttacccag

SEQ ID NO: 35730 - DNA, 58 bp, Homo sapiens; identical to SEQ ID NO: 1409

SEQ ID NO: 35731 - DNA, 94 bp, Homo sapiens
ggtgagttattcatttattgtttttgtttttctgagagacggagtcttgctctgtcactgaggctgaagtgcagtggcatgatctcggctcact

SEQ ID NO: 35732 - DNA, 71 bp, Homo sapiens
tggggtcagaagctgtctttgagatggtccaacatgacacagtatctcactcacagatcctcatggctcca

SEQ ID NO: 35733 - DNA, 133 bp, Homo sapiens
ctccaagggtgtgagcttggacgtttattttaattttattttattactttttttgagaagcagtctcactctgtcacccaggctggagtgcaatggcacaatctcggctcactgcaacctacgcctcccgggt

SEQ ID NO: 35734 - DNA, 96 bp, Homo sapiens
ttgacaagctgggaggagagctgtctgtctgcctgtctgtcttccaagtggaagcttggggtggagcaggcaggtagaggctgcctcacttgtcag

SEQ ID NO: 35735 - DNA, 97 bp, Homo sapiens
ctgccccaccctccgccacctcttcctctgcctctccatgctgtggtaggcccagaaagacagacagactgagacaaaaggctggctggggcaggag

SEQ ID NO: 35736 - DNA, 95 bp, Homo sapiens
cctgccccagccagccttttgtctcagtctgtctgtctttctgggcctaccacagcatggagaggcagaggaagaggtggcggagggtggggcag

SEQ ID NO: 35737 - DNA, 66 bp, Homo sapiens; identical to SEQ ID NO: 10138

SEQ ID NO: 35738 - DNA, 79 bp, Homo sapiens
gtcactgagtcacttcctgctataataataataataattattattattattattttgagatggagtctcactctgtcgc

SEQ ID NO: 35739 - DNA, 81 bp, Homo sapiens
ctcatgatatggctctctgtgtgtctgttattggtatataggaatgcttgtgattttcgcacactgattttgtatcctgag

SEQ ID NO: 35740 - DNA, 98 bp, Homo sapiens
tcctcctttgagctatttgaaactatatatattattgttaactaaagtaatcctacagtggtatagaatactatgtgcatattttgattggaggagga

SEQ ID NO: 35741 - DNA, 95 bp, Homo sapiens; identical to SEQ ID NO: 68

SEQ ID NO: 35742 - DNA, 93 bp, Homo sapiens; identical to SEQ ID NO: 69

SEQ ID NO: 35743 - DNA, 123 bp, Homo sapiens
tgttctttttgcttaagattgtcctagctatacgggctcttttttggttccatatgaaatttaaagtagttttttctaattctatgaagacagccactggtagcttgatgggaatagcattga

SEQ ID NO: 35744 - DNA, 68 bp, Homo sapiens
tttgagcctgtgtgtgtctctgcatgtgagatgggtctcctgagtacagcacactgatgggtcttgaa

SEQ ID NO: 35745 - DNA, 95 bp, Homo sapiens; identical to SEQ ID NO: 580

SEQ ID NO: 35746 - DNA, 93 bp, Homo sapiens; identical to SEQ ID NO: 69

SEQ ID NO: 35747 - DNA, 56 bp, Homo sapiens
gagaccaagtctcgctctgtcacccaggctggagtgcaaacgcgcgatcttggctc

SEQ ID NO: 35748 - DNA, 109 bp, Homo sapiens
gtcactgagcttttgataagttgtgtcactattattgttcagttcaaagaatttttaaatttctgtcttgatttcattgttgaccaaatatcattgaggagtagatgac

SEQ ID NO: 35749 - DNA, 91 bp, Homo sapiens
agtggattctccctcagagccttccaagagtgagtggctctaccatactgattttgtacttctgccctcttggactttgacagaatacact

SEQ ID NO: 35750 - DNA, 108 bp, Homo sapiens
catgggcacatgctgagttctgggggtctggctctctcagacactgtgggaaggaaccacggtgctgggttatgaccctggaggctccccagcctcagctgccgcatg

SEQ ID NO: 35751 - DNA, 58 bp, Homo sapiens
tgagatggtgtctcactctgtcacccaggctggagtgcagaggtgtgatctcggctca

SEQ ID NO: 35752 - DNA, 80 bp, Homo sapiens
ggagtctcactctgtcacccaggctggcggatcacaaggtcaggagatcgcgaccatcatggctaacatggtgaaacccc

SEQ ID NO: 35753 - DNA, 114 bp, Homo sapiens
ggcacgtaggtggattggaatgcttcctgcatagccttgagtgaaagaaaaacattctttttgttttgtttcaacccttgggttaaaaagtattctgaaagcatcctcactgtc

SEQ ID NO: 35754 - DNA, 88 bp, Homo sapiens
ctgtttcccagagtgaaggttttgttttatttatttatttttatttttatttttattttttgagacggagtctcgctctgtcacccag

SEQ ID NO: 35755 - DNA, 283 bp, Homo sapiens
tatatgtgtatatgtgtgtatatatgtgtatatatgtgtgtatatgtgtgtatatatatgtgtgtatatatgtgtgtatatatatgtgtatatatgtgtatatatgtgtatatatgtgtgtgtatatatatgtgtgtatatatgtgtatatatgtgtatatatatgtgtgtatatatgtgtgtatatatgtgtgtatatatgtgtgtatatatgtgtgtatatatatgtgtgcatatatatgtgtgtatatatatgtgtatatatgtgtgtatatgtgtgtgt

SEQ ID NO: 35756 - DNA, 108 bp, Homo sapiens
agccctcagtactgttcccccttcccagtatgatttttttttggttttgttttgctttttttctggcacagcaacaggaaaagataagggaggtgacatctgggtgct

SEQ ID NO: 35757 - DNA, 56 bp, Homo sapiens
ggtgcaggtgtctgtagtcagagtgatgaccacgtgctatgactgacagctccacc

SEQ ID NO: 35758 - DNA, 99 bp, Homo sapiens
agcctgggcaacagtgtgagtctctgtctcaaaaaaaaaaaaaaagatgatttttgcaattaaaatttttttgttttgcaatgggatcactggcctgct

SEQ ID NO: 35759 - DNA, 110 bp, Homo sapiens
ctccagcctgggcagcaagaacgaaactctgtctcatatctcattttttatttttatttttattttttatttttttcagacagagtctcactctgtcgcccaggttggag

SEQ ID NO: 35760 - DNA, 114 bp, Homo sapiens
agtcacaggaagtggggctccttaggccagctccatctcacgtagtgtactgattatgttgagcttatggcacagctgagaggagagtccaaactttttgaacactttttgact

SEQ ID NO: 35761 - DNA, 67 bp, Homo sapiens
tctaggattaaatatgattttttcattgatagaatgctctatcagtgataaaggctcttaatctaga

SEQ ID NO: 35762 - DNA, 81 bp, Homo sapiens
ggccccttggggcctctgggctgttgtgtaaacttcctctaaggctgaagtttcacagtccctgagtcccactatggggtc

SEQ ID NO: 35763 - DNA, 93 bp, Homo sapiens
gctagcatgtgtgcctgtagtcatagcttgggaggctgaggtaggaggatcacttgagcccgggcggttaaggctgcagtgagccatgattgc

SEQ ID NO: 35764 - DNA, 128 bp, Homo sapiens
ggcagagctggactgacggctttgtggctgccaccttcctgcgcacagccctgtctgtctcagtctgtccgatcggctgcccctcgccaccatgcagctgacacgggggcaaagtgaggctggcagcc

SEQ ID NO: 35765 - DNA, 69 bp, Homo sapiens
atctactgaagtctgcagactgggaaggcttctcggaggaggtggcatttgagctgaggcttgaaggat

SEQ ID NO: 35766 - DNA, 75 bp, Homo sapiens
ccagcctgcttaactttgttttttgggatttttttttttttttaagttggagtctcactctgtcgcccaggctgg

SEQ ID NO: 35767 - DNA, 95 bp, Homo sapiens
gcgggacctgggggtggggaggaagatagcacgcctcaccagaggaatctctaattgcctgggtgcctgcttgcctttttattcccttgttgtgt

SEQ ID NO: 35768 - DNA, 75 bp, Homo sapiens
ggaatacaccagccccagagcatagcaggccctcagtcaatatctcctggctggctggctggctgactgtgttcc

SEQ ID NO: 35769 - DNA, 69 bp, Homo sapiens
gaacactcagtatctgtctggccctctcaagatcactgaggactttcccagacagccgacatggtcttc

SEQ ID NO: 35770 - DNA, 79 bp, Homo sapiens
agagagagagagagagagagagagagagagtaggatgctgggatttcctgatcttcctcttgtttgtctgtgtctgtct

SEQ ID NO: 35771 - DNA, 79 bp, Homo sapiens
ggcagcgagtgggagctggaccaggggccagggccacaggaggctcggtctctgtctccgaggaaccctttggactgtc

SEQ ID NO: 35772 - DNA, 83 bp, Homo sapiens
gggaaccaggcttgtcagtgacactccctttttttttttttttttttttttggtgagacggagtctcgctgtgtctgtcgcct

SEQ ID NO: 35773 - DNA, 94 bp, Homo sapiens
ggtgagatggggttggcctgtgacgtgcttcaaagacctactatgtttttttgttttttgttttttgtttttgagacagtctcactctgtcacc

SEQ ID NO: 35774 - DNA, 101 bp, Homo sapiens
gtgtgagtgcacactgccatgtgggtttgtggtcacacaggtgtgagtgcacactgccatgtgggtttgtggtcacacaggtgtgagtgcacactgccatg

SEQ ID NO: 35775 - DNA, 116 bp, Homo sapiens
acactgccatgtgggttcatgatcacaggtgtgagtgcacactgccatgtgggttcctggtcacacatgtgtgagtgcacactgccacgtgggttcgtggtcacaggtgtttgtgt

SEQ ID NO: 35776 - DNA, 112 bp, Homo sapiens
gtctgctagatttaagaattgctatgtgctagtgactcctgtgtgcctccttttattttttttctaaacagggcctcactatgttgcccaggctggccttgaactcctggac

SEQ ID NO: 35777 - DNA, 106 bp, Homo sapiens
attggacaagcttgttctaggatttgttcatttcacctaagttactaatttgccggtgtaccatttatatttatttgaaagagctccttacactctagctgctgat

SEQ ID NO: 35778 - DNA, 76 bp, Homo sapiens
gaggaaggggaaggagcacagactctagagtcaggcagagcaggagaccactgggactcagtcactcattcacctc

SEQ ID NO: 35779 - DNA, 75 bp, Homo sapiens
gaggcactcagatgcacacgtgtgcacctactcagctcccagaggttcacacttgtgtgtgtgttcagttgcacc

SEQ ID NO: 35780 - DNA, 87 bp, Homo sapiens
gccccctgaactttggtgaatgtgtatgttgaagaggctgggtttctcctgctcactctcagtctctggctttcttctggatggggc

SEQ ID NO: 35781 - DNA, 81 bp, Homo sapiens
ggctctagacagaagggaggcatggctgggaagatatattcttttttctctgagacagagtctcgctctgtcgctcaagct

SEQ ID NO: 35782 - DNA, 58 bp, Homo sapiens; identical to SEQ ID NO: 2248

SEQ ID NO: 35783 - DNA, 129 bp, Homo sapiens
gtgcctgtgtaggtgtgtgtctgggtgggtgccaccgagcgcgtgtatcattgtcagagtgtctgtgtcactggcaagggtaagcgggagggagcagctggacctgggtagtgactgagcctggaagga

SEQ ID NO: 35784 - DNA, 79 bp, Homo sapiens
aggctggagtacagtgctatgatcacagctcactgcagccttgacctcctgtgctcaagcaatcctcctacttcagcct

SEQ ID NO: 35785 - DNA, 115 bp, Homo sapiens
gaggcctttgcgctgccgcttgaggaaagacagagtgtagtcactaggggtggacactttctgcttcttcatctgcacttgcgactgtgccgtgagttgcagcttgatggcgctc

SEQ ID NO: 35786 - DNA, 58 bp, Homo sapiens; identical to SEQ ID NO: 1725

SEQ ID NO: 35787 - DNA, 58 bp, Homo sapiens
tgagactgagtctcgctctgtcacccaggctggagtgcactggcgcgatctcggctta

SEQ ID NO: 35788 - DNA, 102 bp, Homo sapiens
ccagctttcaactttgtgtattctattttagctttatctattttcttttttcttttcttttttttttttttagacagagtctcgcattgttgcccaggctgg

SEQ ID NO: 35789 - DNA, 86 bp, Homo sapiens
gtgtctgtgtgtgtctgtatgtgtctgtgtaggtgttagagcccattccagcacgaggtggacctcagacacctgtttcaagccat

SEQ ID NO: 35790 - DNA, 60 bp, Homo sapiens
tgagacactctgtctcgctctgttgcccaggctggagtacagtggcgagatcttggctca

SEQ ID NO: 35791 - DNA, 58 bp, Homo sapiens
tgagacattgtctcactctgtcaccccggctggagtgcggtggtgcgatcatgactca

SEQ ID NO: 35792 - DNA, 78 bp, Homo sapiens
tctatatatatatatatgtgtgtgtgtatatgtatatctatatatctatatatatacacacacatatatatagataga

SEQ ID NO: 35793 - DNA, 75 bp, Homo sapiens
ctgggcatagttttaagtgctttatgtccattctcatttcttttttttttgagatggagtctcgctctgtcccag

SEQ ID NO: 35794 - DNA, 72 bp, Homo sapiens
ctaggtgtggtggtgtgtgcctatagtcccagctacttgagaggctgaggtaggaggatcacttgggcccag

SEQ ID NO: 35795 - DNA, 111 bp, Homo sapiens
ttcaggagcctgaggtgggaggatcgctggagcccaggagtgtgagctcacagtgagctctgatagcgccatcctgccactgtattccagcctggacaacagtgagactct

SEQ ID NO: 35796 - DNA, 109 bp, Homo sapiens
gccatttctaagggatttggggcttcaattgaaaatttatatgtattgatataatacatatgagtcaacatggagttgaattttaaaatatcaatccaacttgaaaggc

SEQ ID NO: 35797 - DNA, 60 bp, Homo sapiens
ggcagaaaaggagaggcaaggttaacaagagagctctgtgtctgactctcactttttgcc

SEQ ID NO: 35798 - DNA, 71 bp, Homo sapiens
ttgtttttgagatggagtctcactctgtcacccaagctggagtgcagtggtgtgatctcagctcactacaa

SEQ ID NO: 35799 - DNA, 76 bp, Homo sapiens
acaatatgtgtccctctgtgtctggcttatgtcacttggcataatgtgacataggttgatcgatgctgtagcatat

SEQ ID NO: 35800 - DNA, 61 bp, Homo sapiens
cgccctaagggcaagaggtctttatttattttgagacagggtctgtctgtcactcagggtg

SEQ ID NO: 35801 - DNA, 98 bp, Homo sapiens
agtgtggatgccttttatttctttttcttgcctaattgctctggctagaatgttcagtgctatgttgaatggaaatagtgaaagcaagcatccttgct

SEQ ID NO: 35802 - DNA, 93 bp, Homo sapiens
ccagcctgggtaacatggtgaggcctcatttcttttttgtctttttttttttttttttttggagatggagtctcactctgtcacccaggctgg

SEQ ID NO: 35803 - DNA, 82 bp, Homo sapiens
agcctgaggcctggcgtgctggggccgccgttgacctcccaatccccttccagctgggtccctgtatgccagccacactgct

SEQ ID NO: 35804 - DNA, 67 bp, Homo sapiens
gttgttgttgagtctcactctgtcacccaggctggagtgcagtggcagaatctcggctcactgcaac

SEQ ID NO: 35805 - DNA, 76 bp, Homo sapiens
ggagggagttagggtagggggctgaggaacagctcaaagcctctctgtctcagcctctccttgggaatctccctct

SEQ ID NO: 35806 - DNA, 104 bp, Homo sapiens
gcccattgcctctctgtggcctggggcatgtcactccatctctctgacactccatttcctcttttgtccccaggggggaaataaggtggtgggtgaggaaaggc

SEQ ID NO: 35807 - DNA, 64 bp, Homo sapiens
ctaggcatggtggctcatacccagcactttgggaggctgaggtagaaggatcacttgagctcag

SEQ ID NO: 35808 - DNA, 110 bp, Homo sapiens
atgtttggctgagtgcaggggctcatatttgtaattccagcactttgggaggctgaggtggtaggatcgcttgcgcccaggagttcaaagctgcagtgagccatgatcat

SEQ ID NO: 35809 - DNA, 118 bp, Homo sapiens
agattgcgccactgcactctagcctgtgcaacacagtgaaactcagtttttgtttttgttttttttttgagacggagtctcgctctgtcacccaggtgggagtgcagtggcgcaatct

SEQ ID NO: 35810 - DNA, 57 bp, Homo sapiens
ggcccaagagtgggacagagggggataccaggcacctgtcactctctctgtgcggcc

SEQ ID NO: 35811 - DNA, 76 bp, Homo sapiens
tggtgtgggacagggagaggtggatgctaggcaggcaagaatccctgccagtctctgcctctgtctccaaaggcca

SEQ ID NO: 35812 - DNA, 57 bp, Homo sapiens
tgagacgggtctcactctctcacccaggctggagggcagtggtgcgatctcggctca

SEQ ID NO: 35813 - DNA, 58 bp, Homo sapiens; identical to SEQ ID NO: 315

SEQ ID NO: 35814 - DNA, 69 bp, Homo sapiens
gggacacctggagtgtcctagcatgtgaaaccccctaaggcttcccatctctcacactctgcgtgtctc

SEQ ID NO: 35815 - DNA, 74 bp, Homo sapiens
gcacttatgggtgaatgtgctgactttttttttttttttttttttgagacagagtctcactctgtcgcccaggc

SEQ ID NO: 35816 - DNA, 97 bp, Homo sapiens
gggaggcagggatgaggttggggaagaaggagagaaaaaggcttggctgcatgcatcccgctcactctctgggtctcccgcttccaggcttcctgct

SEQ ID NO: 35817 - DNA, 70 bp, Homo sapiens
ggaggctgtggttggaggatcacttgagcttgagagtctgaggctcagtgagctttaatcgcaccactcc

SEQ ID NO: 35818 - DNA, 107 bp, Homo sapiens
gcgtgtctggagtttgttccttctgatgtttggatgtgttctgaatttcttccttctggtggggttcatggtctcgatggctcaggagtgaagctgcggaccttcgc

SEQ ID NO: 35819 - DNA, 72 bp, Homo sapiens
cctggctctgctctgtcacactctgccttcctctcctgggcttgctttctgggcatgagcatccctgtcagg

SEQ ID NO: 35820 - DNA, 136 bp, Homo sapiens
gcctagaggacaaagtgagaccttgtctcaaaaataaaaaaaattttttttttgagatggagtctcactctgtcacccaggccggactgcagtggcactatctcgactcgctgcaagctctgcctcccgggttcac

SEQ ID NO: 35821 - DNA, 79 bp, Homo sapiens
gccccatgcactgcctggcactctctctcatgctgtcaggcttacgaagatgcattcccatgcaggcagatgcacatgc

SEQ ID NO: 35822 - DNA, 106 bp, Homo sapiens
aaaaactgggcccatatgaatgattcagactcatctgggagcagtctgggaccaaccatgattctcaatacctttgagtttatcagtcaataacgaaccacttttt

SEQ ID NO: 35823 - DNA, 77 bp, Homo sapiens
ctgggattacaggcgtgagccactgcgcttggccattattattattttttgagacagtgtctcactctgttgcccag

SEQ ID NO: 35824 - DNA, 68 bp, Homo sapiens
tgttttgagatggagtctcactctgtcacccaggctggagtgcagtggtgcgatcttggctcactgca

SEQ ID NO: 35825 - DNA, 58 bp, Homo sapiens; identical to SEQ ID NO: 2595

SEQ ID NO: 35826 - DNA, 58 bp, Homo sapiens; identical to SEQ ID NO: 2758

SEQ ID NO: 35827 - DNA, 107 bp, Homo sapiens
acaactggagagaagacttaggctacagttggctactaaatgtgattgagcatgagcaaatgattcaattttaattatgtacttgatgtgcagtacttcctctttgt

SEQ ID NO: 35828 - DNA, 92 bp, Homo sapiens
gctgggattacaggcatgagccaccgtgctcagccaggaaaaagacattcttttttttttttttgaaatggagtctcactctgtctcccagc

SEQ ID NO: 35829 - DNA, 58 bp, Homo sapiens; identical to SEQ ID NO: 3701

SEQ ID NO: 35830 - DNA, 91 bp, Homo sapiens
ccaccgcgcctggctatgaatttttaattttgaggaagaagatacctatttttatacatctgtattcttgaaaaggagctgggaggattgg

SEQ ID NO: 35831 - DNA, 72 bp, Homo sapiens
gaggaaaacagggtgaaggatctttgggtgatggtggttgcttttctctcactcactcactactgtttcccc

SEQ ID NO: 35832 - DNA, 157 bp, Homo sapiens
gcctgggtgatagagtgagactccatctcaaaaaaaaaaaaaaaaagatgaaactgccttatttatttatttattttttgagatggagtctcgctctgtcactccagcccaggcaacaagagtgaaactccatctcaaaaaaaaaaaaaaaaatggg

SEQ ID NO: 35833 - DNA, 86 bp, Homo sapiens
gcgggagggggcaggccaggcctggtggggccagtgaagggggtcatccccttcccacctggcatgaaacgcctgtgttgtgctgc

SEQ ID NO: 35834 - DNA, 66 bp, Homo sapiens
ttgagattgagtctcactctgtcgcccacgcttggagtgcagtggcgtgatctgagctcaccgcag

SEQ ID NO: 35835 - DNA, 92 bp, Homo sapiens
ttcaaatcctggttcagcctctcactgtgtctgacctacttaactagtaataacagaagccattccacagggttgtatgaggattaaatgaa

SEQ ID NO: 35836 - DNA, 58 bp, Homo sapiens
tgagacggagtctcactctgtcactcaggctagagtacagtggcgagatctcggctca

SEQ ID NO: 35837 - DNA, 58 bp, Homo sapiens; identical to SEQ ID NO: 31440

SEQ ID NO: 35838 - DNA, 76 bp, Homo sapiens
cctaatctgctttgggcagagtgtggtgagtcctagagacccctctaggtctctcactctcagtagccccagaagg

SEQ ID NO: 35839 - DNA, 75 bp, Homo sapiens
gggtctcactctgtcgctgaggctggagtgcagtggcaagaacattgctcactgtagcctcaacctcctgggctc

SEQ ID NO: 35840 - DNA, 58 bp, Homo sapiens
tgagacagggtctccctctgtcactcaggctggagtgcagtggcatgatcatgggtca

SEQ ID NO: 35841 - DNA, 73 bp, Homo sapiens
ccagtctgttttccgaagtggttctaccattttatttttttgagatggagtattgctctgtcacccaggctgg

SEQ ID NO: 35842 - DNA, 58 bp, Homo sapiens
tgagacggagtctcactctgtcactcaggctggagtgcagtggtgcgatctcggctca

SEQ ID NO: 35843 - DNA, 73 bp, Homo sapiens
ggagtgaaactcttctgtatgaggaaactttttgtttttgtttttgtttttttttgagacggagtctcactct

SEQ ID NO: 35844 - DNA, 116 bp, Homo sapiens
tcttgccactgcactccagcctggtgacaaagtgagcccccatctctaagaaaaaatatttttttttttgagacggagtcttactctgtcacccaggatagagtgcagtggtgcga

SEQ ID NO: 35845 - DNA, 81 bp, Homo sapiens
actgttttcctgaaatctctgtttctctctgtggtttctcccatatttctaccggagagggcaacgaaagctcatgatagt

SEQ ID NO: 35846 - DNA, 69 bp, Homo sapiens
gggtgtcctgttgattgaggggagacagcatgctggcagtcctcacagccctcactcgctcgctcactc

SEQ ID NO: 35847 - DNA, 117 bp, Homo sapiens
gtgaattaatttccacattgctctagagaaaggtatctttctctagagttttacttgttccttaactaatttggttgaaagatatatttctctagagcaatgtggaacttaattcat

SEQ ID NO: 35848 - DNA, 100 bp, Homo sapiens
gggctccttctttctctatcttgtggaatagtgtcaaaaggattggtaccaattcttctttgactgtctggtaaaattctgctgtgaatccttctggtcc

SEQ ID NO: 35849 - DNA, 202 bp, Homo sapiens
gtatgtatatatataccatagcgtgtatatatatcatagtatgtatatatatgccatagcgtgtatatatatatatatagacaccatagtgtgtatatatacaccatagtgtgtgtgtatatatatatcatagtgtatatatatatatatgtaccatagtatatatatacacagtactgtgtgtgtgtatatatatatcata

SEQ ID NO: 35850 - DNA, 112 bp, Homo sapiens
ggcaaagtggagggatggggacatagaagctgtcggtgatcaaacaacaaaaatagagtctctctgtctatgacacctaagatgcctgctgtggctatttctgttcaaagcc

SEQ ID NO: 35851 - DNA, 126 bp, Homo sapiens
cagaacagacactgacatggatgcccggcaggactgcccatgtgtgctagctgtgtgtcactgtgtgtgcccatctgtggtcagggagcatcctggagctgaacatgggcccacccgctgccttct

SEQ ID NO: 35852 - DNA, 82 bp, Homo sapiens
ggtccatgcacttgaagggttaaagacatactgagaatcagtgtaaatgttgacagtctcaccctcactgagttctaaggcc

SEQ ID NO: 35853 - DNA, 206 bp, Homo sapiens
cactgtgtgtgtgtgcatatatatatatatatatatatgtatatatgtatatatacatatgtgtatatatgtatatatacatatgtgtatatatgtatatatacatatgtgtatatatgtatatatacatatgtgtatatatgtgtatatatatgtatatatatgtatatatatacatatgtgtatatatatatatgtatatatat

SEQ ID NO: 35854 - DNA, 115 bp, Homo sapiens
ggctgcagccgcgtgtgacccatgggagacaatgcagggcgggaagaaggggaggccagcgtctctccctcactctgcctcctggggtttccgccgcagctgcttctctggggcc

SEQ ID NO: 35855 - DNA, 111 bp, Homo sapiens
atgtatatgtatacagtgcctggcctcatgatcactgagtccactgcagctttttatttttttttccatacagggtctcactctgtcacccaggctgagtacagtggcata

SEQ ID NO: 35856 - DNA, 113 bp, Homo sapiens
tgggtctcaaccttggctgcaccttggaatctcctggggagatgagacgataccaaggctctctctcactcagcatgttgtttccaaggtccatccacatgcagtaggcacca

SEQ ID NO: 35857 - DNA, 121 bp, Homo sapiens
ccaggacctattagaagccccacttctttcctgtgtttctgctgccattgccccagtctctgaccctgacactcaatcactctataaacacagcaggtactaggggtggctctgggctctg

SEQ ID NO: 35858 - DNA, 75 bp, Homo sapiens
ggggcatctgtctgggactctgtcagtgcctctcacctggcgaggggcttgtggcgggggtaggggggaagtccc

SEQ ID NO: 35859 - DNA, 97 bp, Homo sapiens
atagtgcttagaattgactttggacttgtgtttttgttgtcaacagacaaataaggttttccggtcagtgggtcagtggttcctaggttaaaattat

SEQ ID NO: 35860 - DNA, 66 bp, Homo sapiens
acagtgagtgctgtccacagacagacccggtgctgtgccatgtgtgtgactcacagcctctcctgt

SEQ ID NO: 35861 - DNA, 96 bp, Homo sapiens
ctctttagatttctgcagggtggcaggttgcatgaggaagctctggaggtctcagttgattgtgagctcccatgggcctcctgtaaaagggcagcc

SEQ ID NO: 35862 - DNA, 60 bp, Homo sapiens
ttgagatggagtctcactctgtcacccaggctggagtgcagtggcaagatctcggctcaa

SEQ ID NO: 35863 - DNA, 82 bp, Homo sapiens
agagtctcactctgtcgctcaggctggagtgcagtggcgcgatctcggctcctctccgccccatgggttcaagtgattctct

SEQ ID NO: 35864 - DNA, 75 bp, Homo sapiens
gtgtccccaagcaagtcactgtccctgcctctctgtacagtgggaggcctggatctctctgctctgggaagacac

SEQ ID NO: 35865 - DNA, 261 bp, Homo sapiens
atatatatatatatattctggtatatatatatatattctggtttatatatatatattctggtatatatatatattctggtatatatatattctggtatatatatatgtgtatatatatgtatatatatgtatatatatatgtgtatatatgtatatatgtatatatatatgtgtgtgtatatatgtatatatgtgtatatgtgtatatatatgtgtatatatatgtatatatgtatatatatatgtgtatatatatatatc

SEQ ID NO: 35866 - DNA, 104 bp, Homo sapiens
gtgacagaatgagactctgtctcaaataaataaataaataaataaataaacctttttttttttttttttttttttttttttgagacagagtctcactctgttgc

SEQ ID NO: 35867 - DNA, 60 bp, Homo sapiens
cgtgtgtctgtagtcccagctactcaggaggctgaggtaggaggatcatttgggcatagg

SEQ ID NO: 35868 - DNA, 71 bp, Homo sapiens
gtccactgacaaactcactcactcaccgctgcagccctcgggggcaggagtagttagttagcactgtggac

SEQ ID NO: 35869 - DNA, 103 bp, Homo sapiens
ccagaagtttgagactagcctgggcaacatggcaagacctcatctgtatatttttttaaatcagacaggtgtggtggtgcatgcctatagtcccagctactgg

SEQ ID NO: 35870 - DNA, 128 bp, Homo sapiens
tcacgggtaaaccctgctgcgactccacctgggtccagggggcggggagtgtcaccatctctctctcgaatttgcatgagcccaagttgtttttcagaaaaagggtgtgactctgaaaatgaacccgt

SEQ ID NO: 35871 - DNA, 117 bp, Homo sapiens
ttctgctactgtgacgcccccccacttcaattcctcggttggtctttttatcttttttttttttttttttgagatggagtctcactctgtggcccaggctggagtgcagtggcggga

SEQ ID NO: 35872 - DNA, 158 bp, Homo sapiens
tcaagcctgggcgacagagtaagaccctgtctcaaaaaaaaaggtttcgattttaaattattattattatttgagatggactctcactctgtcacccaggctggagtgcaatggcacgatcttggctcactgcaacctccgcctcccaggttcaagtg

SEQ ID NO: 35873 - DNA, 78 bp, Homo sapiens
gaggcatttttggccaggttgtcctcccttgagctacctttctgtggaacaaggttgaaatgtatgcctgcctgtctc

SEQ ID NO: 35874 - DNA, 89 bp, Homo sapiens
agcttcatctgggtagtgggcaagaaaagataaatccactgggcggtgacactgtcagggacactgtctctcccattcctgcattggct

SEQ ID NO: 35875 - DNA, 89 bp, Homo sapiens
tactttctcctgtgttatcttctagggattttattttattttattttatttttgagatggagtctctctctgtcccccaggatggagtg

SEQ ID NO: 35876 - DNA, 111 bp, Homo sapiens
gtgtgtgctcttcttttcactactcactgtgccgtctgtgcctgccactcactctgtcctttccttcacaggtactgtgactgctttgccagtggggacttttgcaacaac

SEQ ID NO: 35877 - DNA, 109 bp, Homo sapiens
gcatctctagaaatattgtgacagtgtgcaggatgtgctgtgattatttaaatttgcttatctttccctatgcaaattctctccacctttgtcgcttttcaggatctgc

SEQ ID NO: 35878 - DNA, 58 bp, Homo sapiens; identical to SEQ ID NO: 8152

SEQ ID NO: 35879 - DNA, 110 bp, Homo sapiens
ctgggccttagcttttacttttcttggcgtgaataaatgcagtactgattattattattattattatttaaatttctgcctcatgatagcaagtgagtaaatgcccctag

SEQ ID NO: 35880 - DNA, 67 bp, Homo sapiens
cagatcccttagtgtagactgtgtgctccgagaaagggtggggccgactaagactagtggtgatctg

SEQ ID NO: 35881 - DNA, 60 bp, Homo sapiens
gtgacccagagtctcgctctgtcacccaggctggagtgcagtggcgtgatcttggcttgc

SEQ ID NO: 35882 - DNA, 62 bp, Homo sapiens
gacctgagcagagtttgagattttttttttctgagatggagtctcactctgtcgctcaggcc

SEQ ID NO: 35883 - DNA, 104 bp, Homo sapiens
gctgaagatagcatggttaaggacagaggtgagggagctctgcatttcttttttttttttttttgagatggagtctcactctgtcccccaggctggagtgcagt

SEQ ID NO: 35884 - DNA, 97 bp, Homo sapiens
gggcagtagtttcaaggttgaagtgtgacaagggatgggagaatagctcatgagttttttttgttttttttgttttttttttttgagacaagttctc

SEQ ID NO: 35885 - DNA, 94 bp, Homo sapiens
gccactgctcccggcctagagtggtttctttggtttctttttttgttttttgagatggagtctcactctgtcgcccaggctggagtgcagtggc

SEQ ID NO: 35886 - DNA, 85 bp, Homo sapiens
ggcctttctggactgtatagccttgaaggggaggtggccagagccactgagtctctccccttcttctctgggtctgggaaatgct

SEQ ID NO: 35887 - DNA, 91 bp, Homo sapiens
gatatttgcatgtgattatctgtgcatacggtgatgcgggcgtgcgtattaatgtacgtgtgtatgtgcatgatgatgtgtattgtatcca

SEQ ID NO: 35888 - DNA, 101 bp, Homo sapiens
tcctgtgctcagccctgagcgaggcgctggggaaggggagcgagaagggcctctgtctctgtccctctgggcgttacatgactccaggagttgggtattga

SEQ ID NO: 35889 - DNA, 94 bp, Homo sapiens
gtttttatttattgtctagaatgcaagcccacaagggcaggccatctgtctgtcttgctctctgtcttgctcatttgagaacagtacctggaac

SEQ ID NO: 35890 - DNA, 94 bp, Homo sapiens
ctacccttgactatcttacagtcacagagaaagacaaataattttaatataatttgttaagagctgtgatggaggtaagtacaagatgctgtag

SEQ ID NO: 35891 - DNA, 58 bp, Homo sapiens
tgagctggagtctcactctgtcacccaggctggagtacagtggtgtgatcttggctca

SEQ ID NO: 35892 - DNA, 94 bp, Homo sapiens
acccaggtccaggctctgggactctcagactctgccggtcccctgccctgggccaggtcctgggttgggtatggagagctgagagcccagagcc

SEQ ID NO: 35893 - DNA, 62 bp, Homo sapiens
atccctctgtgtgtgtctgtgtcctcatctccttttattaaaaggacacagtcatatgggat

SEQ ID NO: 35894 - DNA, 95 bp, Homo sapiens
tattttgttaagtttcccatcagagattgtttattggctttgattataaccgcagttattttttagataattactggggaatatttctcaaaata

SEQ ID NO: 35895 - DNA, 112 bp, Homo sapiens
gggcctgccttagggccgaggtaagagcatgcaggtattgggaaatctgacttggagtcacacactccctctctgggcctcatgctgtctctgtggaaggagctgctggtct

SEQ ID NO: 35896 - DNA, 90 bp, Homo sapiens
cacagacatgggtacattggaggatcattaatctgcttaccacagtggcataaattaatcattttttttctaatgttcattgattctgtg

SEQ ID NO: 35897 - DNA, 76 bp, Homo sapiens
ccatgctgcgttctcatcccagctcacaacccacagcattccaggaggcttcagtgtgagctcagaggtcagcagg

SEQ ID NO: 35898 - DNA, 61 bp, Homo sapiens
tgactgggtctcactctgtcacccaggctgccaggctggagtacagtggtgtgacagctca

SEQ ID NO: 35899 - DNA, 77 bp, Homo sapiens
gtctgtctggctcagtgcttcccaaaagcggctgcatttcagaatcgcctggaagctttaaacaaacccagatggat

SEQ ID NO: 35900 - DNA, 118 bp, Homo sapiens
gtctatgtaaaaagggaaccaaaaaccagttgtgaattcttcacactctctgtttctctaccaagccacgtggaagaggttgcaatgactgtgtcacaacctggtgaaccttctaggc

SEQ ID NO: 35901 - DNA, 90 bp, Homo sapiens
cccagacatgccctgggcaggtgggcagtctctgtcctggtccgggtttgcccctcagacacactcacacttcccagggaggcccctggg

SEQ ID NO: 35902 - DNA, 81 bp, Homo sapiens
acatggccttctcctctgtgtgtctgtgtgtccagatttccctcttcttatgaggacaccagtcactggatttagcctcgt

SEQ ID NO: 35903 - DNA, 85 bp, Homo sapiens
ctcggtctcaaaatattaaattccaggggatacacagtttgtacgttttttgttttttgtttttcggtttttttttgagatggag

SEQ ID NO: 35904 - DNA, 78 bp, Homo sapiens
gcctggctctccctcactctgggtgagaccttgggcagattctgaccctcagtcttctcatttgtgggaaatcttagc

SEQ ID NO: 35905 - DNA, 69 bp, Homo sapiens
ggaaggggacacagccaggtttgatgagcccagactctccattaaacgctgcgctcaggggccccagct

SEQ ID NO: 35906 - DNA, 116 bp, Homo sapiens
gctggatagatgaatggatggatggatggatggtaattgatagttgttgacaactcattttgttctaggcactattgcaagccctttactcatgtcattccctttaatactcacgt

SEQ ID NO: 35907 - DNA, 112 bp, Homo sapiens
gaggccagggtgaggcgagggaggtgctggtgctgcaggtcccacgacactcactctcagggtcatgggcacctaagacgagatgccaacatccatgctgtacccaggcatc

SEQ ID NO: 35908 - DNA, 129 bp, Homo sapiens
acaggcttcagagggcttccagcaagggagggacatgagaaagttctggcgttggagagagaactctgactgcactgtggtcaccaggttggagtggacaggattgggtttggcagtgacggtgtgtag

SEQ ID NO: 35909 - DNA, 82 bp, Homo sapiens
ggcggtccctttcttctagcatggagaccatcaactgttcaaaatgtgaatctgcatctggctgtgaaggggagccggaacc

SEQ ID NO: 35910 - DNA, 123 bp, Homo sapiens
gtgagggcgaatgaggggtcctcagccagtggttactgtggaggaggaggcgatgtgatgtctcagtgtctgacttggacaactggatgctgatgtccactgcgtgagagcttatgaggagtt

SEQ ID NO: 35911 - DNA, 85 bp, Homo sapiens
ctgtgtgtgacgctgtctgtctccctgttctgcagttgcctcaacctctctgtattagggtgggctaaacatctggaacaaatgg

SEQ ID NO: 35912 - DNA, 67 bp, Homo sapiens
gagacagcgtctctctctgtcgcccaggctggactgtaatggtgcgatcacaggacactgcagtctc

SEQ ID NO: 35913 - DNA, 93 bp, Homo sapiens
gacacagcaagacccggtctcaaaataaataaataaataaaccattcctctctctcttttttttttttttttgagacggagtctcgctctgtc

SEQ ID NO: 35914 - DNA, 76 bp, Homo sapiens
ggttcagggtctctcagtgtctggggagtttgttaattgcagacacctggtccccatgcacagcactcctgcttcc

SEQ ID NO: 35915 - DNA, 76 bp, Homo sapiens
gcagggggagactcaacagctggaggcaggagtccacaatggtgctgggggcctgtctctgtctctcactcccttc

SEQ ID NO: 35916 - DNA, 71 bp, Homo sapiens
tttgattgagacgaaatctcgctctgtcactcaggctggagtgcagtggcgcgatcttggctcactgcaaa

SEQ ID NO: 35917 - DNA, 56 bp, Homo sapiens; identical to SEQ ID NO: 2604

SEQ ID NO: 35918 - DNA, 88 bp, Homo sapiens
ggatgggtgagtgggtgggtggctgactgaatctgtgacttggggtaagggtggggaccaaagttgggcagtgtgctcagacctctct

SEQ ID NO: 35919 - DNA, 60 bp, Homo sapiens
ctgtgggggaggatgggggcagggacaagtgtggggcgtgttcctctctctgtctcagag

SEQ ID NO: 35920 - DNA, 80 bp, Homo sapiens
ctggtgtccttgtaagaagagacttgagagttggtcgctgtctgtctctctgtctctccaccatgggagggctcaaccag

SEQ ID NO: 35921 - DNA, 70 bp, Homo sapiens
gcactggggtttcgctgtgccaccttggccaggctgcataacctgtctgagccactgtctctccatgtgc

SEQ ID NO: 35922 - DNA, 115 bp, Homo sapiens
gaaagacgcttaaggctgcacccagaactgagcaccagtccgcttcaaacctctctcggtcactgggtgacaatggccgacgcactcagcctcactgcagcctcagggtcttgtc

SEQ ID NO: 35923 - DNA, 83 bp, Homo sapiens
gcttggattacaggcatgagccactgtgaccagcctctttttttttttttttttgaaacagtgtctcactctgtcaccccagc

SEQ ID NO: 35924 - DNA, 65 bp, Homo sapiens
gtctgtaattcctgcactttgtgagactgaggtagaaggatgacttgagctcaggagtttaagac

SEQ ID NO: 35925 - DNA, 109 bp, Homo sapiens
ggttgtagagcaacgacaaccttatcatcatagaacagccaactgctttgagagaagtgagtgtggtggttggcaaggtgagtggatgagtgttgatattgcggctgcc

SEQ ID NO: 35926 - DNA, 74 bp, Homo sapiens
tggtccctctctgtgtgtctgtgtcctcatctcctcttcctatagggacactggtcatatcagattagggccca

SEQ ID NO: 35927 - DNA, 97 bp, Homo sapiens
ggatgggagggtaggttttttttttttttttaatttccttttctttgctggagaagtggaggggaaaggaaatgaatgaggaactggcttagaatct

SEQ ID NO: 35928 - DNA, 117 bp, Homo sapiens
cagctgagacctggggacctgggcgtgggggctgcaggaagtcggggcaggctgccactgcctcagcctcactctctctgtggcctcaaaccccaacgccactcacctgcacttctt

SEQ ID NO: 35929 - DNA, 92 bp, Homo sapiens
cggatgctgttgatcacgtgcaggcgttgttccagcccttcctggagtcgctctgtgtgtgtgcctgtccggagagggaagcaatgggaggg

SEQ ID NO: 35930 - DNA, 90 bp, Homo sapiens
tggtagtgggctgatggagaggtacttgctagattagtattgctgcctgcaattagaccagcacagtggctgaacctaatgtcccttcca

SEQ ID NO: 35931 - DNA, 88 bp, Homo sapiens
atgaagtctgtccctgtgactgtgtgtctggacagctcctcttctggggagagtcctctgtggcaggtgcagtcagcatagggacaga

SEQ ID NO: 35932 - DNA, 117 bp, Homo sapiens
catctccatggtaggcctgtgtgttgctaatgcagaaagatgtctccaataggttgtagattgaaaagtgattagttggaaaagatttttgctaatgtatatttattcataatgatg

SEQ ID NO: 35933 - DNA, 79 bp, Homo sapiens
ttagagtttcagaagacagtgtggcctcagaagatctgcaaggatttgaggactgggcacttgtctgagtcctttctga

SEQ ID NO: 35934 - DNA, 63 bp, Homo sapiens
ccttgagccctgggtctgtctgtgggtcacggctcactgcgggagacaccgctgggctccagg

SEQ ID NO: 35935 - DNA, 103 bp, Homo sapiens
ctgatttttcaggaggggtgtgacggctggtgtatattctcagctctggtgtagttgaggagattgatgtttgctttggctctgcattgcttttgtagatgag

SEQ ID NO: 35936 - DNA, 91 bp, Homo sapiens
atgtgtcatttatatgtatgtatgtatgtatgtgtgcatatgtatatatatgtgtgtatatcatatgtcacatgaatatatatgtgtgtat

SEQ ID NO: 35937 - DNA, 117 bp, Homo sapiens
gcaatgctgccagtcctatagataggtttttggctaaatgagcttaagtttttcatttttactctaacatatgcatttaaggctataaattttccactgatttggctgcatgcagta

SEQ ID NO: 35938 - DNA, 58 bp, Homo sapiens; identical to SEQ ID NO: 285

SEQ ID NO: 35939 - DNA, 60 bp, Homo sapiens
gtatgtatgtatgtgcgtgtgtgtgtatgtatgtatgcatgcatgtatgtatgtatgtat

SEQ ID NO: 35940 - DNA, 137 bp, Homo sapiens
gtgtatatatacgtatatatatatatacatgtatatatacgtatatatatgtatatatatatatacgtatatatacatgtatatatatacgtatatatatgtgtatatatatacgtatatatatatgtatatatata

SEQ ID NO: 35941 - DNA, 88 bp, Homo sapiens
tctcactctctctcatggtctctctctctcatagtctctctcacggtcagggcagaaagagagagagtccatctggagcagactcgga

SEQ ID NO: 35942 - DNA, 63 bp, Homo sapiens
tggacgtggcttgacaaccactgttagccaagagggtcactcagtgtctgtttgccctgtcca

SEQ ID NO: 35943 - DNA, 119 bp, Homo sapiens
atggttatttgccttgtgacaaatctgtaatttacttgaaattcatggtaaatttcattttatttatgaatgttcaagtgaaaattttataattcgttacgtagaggtgattaacacat

SEQ ID NO: 35944 - DNA, 73 bp, Homo sapiens
gtctgtttgtgggagaagttcctgacttcacctggagctgagtcaagttagagagctgagctgagagacatac

SEQ ID NO: 35945 - DNA, 140 bp, Homo sapiens
cacaaggtgtacactcactctgatattggaaggaatatctccctaggatataagctatcacatcacagagtgtacacacatggtgtacacccactgtgttattagaagcaatatctccctatgatattatgaaaaatatc

SEQ ID NO: 35946 - DNA, 100 bp, Homo sapiens
gcatggcatgtacccctgtggtcctagctacttggggggctgaggtagaaggatggcttgagccccaaagtttgaggttacaatgaactatgattacatc

SEQ ID NO: 35947 - DNA, 80 bp, Homo sapiens
gtgtgtgtatatacatgtgtgtgtatatatatgtgtgtgtatatatatatctatatatgtatttatgtatatatctatat

SEQ ID NO: 35948 - DNA, 125 bp, Homo sapiens
gggcgaacatgaggatcatgtaaggtagctttctgtcagcacagatgggtttatgtttcctcagtccctctttctgtgtggtattttcttctttagaggaagaaccacatacttttttgtgaaag

SEQ ID NO: 35949 - DNA, 73 bp, Homo sapiens
cttggtaagggctgcttcagtggaatggcaagggcctggaggcagaagccagattgaagtgagtgagttcaag

SEQ ID NO: 35950 - DNA, 91 bp, Homo sapiens
atctctgcccttcttcactccgtctgtgtctttctccatgtgtagtgccggtgggatgagcttggcatgagggggaagccagtgcaggggt

SEQ ID NO: 35951 - DNA, 92 bp, Homo sapiens
acctgtggcaagtaaagaatgtcactctctgacagacccaggagccccaaatcatcttgggttctcaagaggaattcacccaactcataggt

SEQ ID NO: 35952 - DNA, 114 bp, Homo sapiens
caatcacatggctgttgcccctccctcaggccttgtctacctctgactgtggctctctggcaggaatagatggacatggcctggcagatgatgcagctgctccttctggctttg

SEQ ID NO: 35953 - DNA, 85 bp, Homo sapiens
ccagcctgggcaatatagtgagaccctgtctctctctttttttgcgggggcgggggacggagtcttgctgtgttgcccaggctgg

SEQ ID NO: 35954 - DNA, 74 bp, Homo sapiens
ccaacagttcaccttcttggttgttgagtttccgcattacagaaataaggaagcaggcccaaaggagagcctgg

SEQ ID NO: 35955 - DNA, 116 bp, Homo sapiens
acatgtgcagaatgtgcagctttgttacaattgtatcattcttttttttattttattattattatactttaagttttagggtacatgtgcacaatgtgcaggttagttacatatgt

SEQ ID NO: 35956 - DNA, 109 bp, Homo sapiens
tgatggttgcactaatctcgcatttcccccagcaaggcattattgctctttgtttataatttaaatagggaggaaggtttagtgcttttgctcgaccctttcaaccaca

SEQ ID NO: 35957 - DNA, 114 bp, Homo sapiens
gcccaggaattcaagaccagcctgggcaacatagtgagaccctgtctcttaaaatttttttttttttttgagacagagtctcgctctgtcgcccaggctagagtgcagtggcgc

SEQ ID NO: 35958 - DNA, 83 bp, Homo sapiens
gacagagtggagctgagcgtggacacagggaaggtgcatggctgctcatatgtggtcatcctgccactctctctctcaatgtt

SEQ ID NO: 35959 - DNA, 71 bp, Homo sapiens
ggtggctgattggaacctattttgaagaggattctttttttttttttgagacagagtctcactctgtcgcc

SEQ ID NO: 35960 - DNA, 111 bp, Homo sapiens
ccttgtgattctgtcaatggatgcaaatacaagtggatttcttttcttttcttttttttttttttttttggagatggagtctcactctgtcaccagggtggagtgcagtgg

SEQ ID NO: 35961 - DNA, 79 bp, Homo sapiens
agcagcagctgagagagtggacagagagccagactgatgacctatgtgagtccagccattcaggttcttagttgttcct

SEQ ID NO: 35962 - DNA, 74 bp, Homo sapiens
atgattcctgcatcagagcctctctccgtctctccagcttagtagagcagggtggggcctggggtggggatggt

SEQ ID NO: 35963 - DNA, 117 bp, Homo sapiens
cttgggaggcactgggactggctcaggtgtattctacagtgcacgtgtctccagtgtggctcggaggctggagacgcggccctgttggagtaacaactgaagccggagtctgcgaag

SEQ ID NO: 35964 - DNA, 63 bp, Homo sapiens
gctgtgtgtgacttgctctctctctgacctgggctagagcataaacacgtgtcacatacttgc

SEQ ID NO: 35965 - DNA, 106 bp, Homo sapiens
gcaatcccaaggacaggtagcttggggcggaggagagcatgctgtcacccatcctgatgaggggagagatgtctggtgctaggagcagtggtggccggaggagggc

SEQ ID NO: 35966 - DNA, 74 bp, Homo sapiens
aaatgagttaggaatagctgtgaggagccccagctactcagggcctcagaagatatttatttctgtatttattt

SEQ ID NO: 35967 - DNA, 66 bp, Homo sapiens
tgtgtgagcatgtgagtgtccttttttttagtttagttttgagacagggtctcacactctcaccca

SEQ ID NO: 35968 - DNA, 80 bp, Homo sapiens
acaggaacttctcagtagctgcttggtgcccacttggcttgtcaccggggacacagagcagacactgactgagtccctgt

SEQ ID NO: 35969 - DNA, 76 bp, Homo sapiens
ggtggaggcaacagcaggaggaaaggcctggcatcatgaccacaccccaggcagaccctgtcactgcctcccagcc

SEQ ID NO: 35970 - DNA, 70 bp, Homo sapiens
cctgagagcagggacaggtctcctatccttttttcttttttttttgagaagcctcactctgtctctcagg

SEQ ID NO: 35971 - DNA, 72 bp, Homo sapiens
cggtgtccctgagccctccccagagtccccaccagttccaggaggtggaaactgtactgagtcaggacactg

SEQ ID NO: 35972 - DNA, 96 bp, Homo sapiens
gagagaggaccacttgagtcccagatttcaaggctgtagtgtgctatgattgcaccactgtactccagtctgggcaacagagcaagatcctatctt

SEQ ID NO: 35973 - DNA, 77 bp, Homo sapiens
gggcagagcaaggcctctgtgtgtctgtgcctgggggagggcagctgtgggccagatctgggcctggggctttgctt

SEQ ID NO: 35974 - DNA, 56 bp, Homo sapiens
gaggcagggtctcactctgtcactcaggctggagtgcagtggtgtaatcatggctc

SEQ ID NO: 35975 - DNA, 243 bp, Homo sapiens
gtgatatatatatatatatacacacatatatacgtatatatacatatgtatatatatatatcacgtatatatacacgtatatatacacgtatatatgtatatatacgtatatatacacatatatatgtatatgtgtatatatgtgtatatacatgtatacgtgtatatatatgtatatatgtgtgtatatatgtatatatgtgtatatatatgtgtgtgtatatatatatgtatatatatatg

SEQ ID NO: 35976 - DNA, 115 bp, Homo sapiens
ctgtgaaagatattttttattcctagttaagaattagttaattctttactcagtagacagtcaggagttatgaaagtttttaaactggggagcaacatgatgaggtcattcacag

SEQ ID NO: 35977 - DNA, 79 bp, Homo sapiens
gggatgttttggaaactgggtgatgaagacatgaggatacattctattgttgtctttacatatgtatttgaaattttcc

SEQ ID NO: 35978 - DNA, 105 bp, Homo sapiens
ccagccatgcttcctgtacagcctgcagaaccatgggtcaattaaactgtttttctttataaattacccagtctcaggtagttcattatagcaatgtgagaatgg

SEQ ID NO: 35979 - DNA, 118 bp, Homo sapiens
ctgggttagagaacctaatcatttgtaggacttcgatgtgttggcccaggttacttttatttgtattcttatattcaagttattagcaagtttattattgtgtctctgtcatactcag

SEQ ID NO: 35980 - DNA, 59 bp, Homo sapiens
acgtaggctccctcatgtgtaggcagaaaatgctgtcttctctgtgggtgagcaaaggt

SEQ ID NO: 35981 - DNA, 111 bp, Homo sapiens
tctatttcccataggaagccatcagttaaaaagtcagtctcttctgtcacagaccacagtgaggagacatgatgactaaatgcaatgtggtaccctgaattggatcttgga

SEQ ID NO: 35982 - DNA, 98 bp, Homo sapiens
tccaattcagggtaccacattgcatttagtcatcatgtctcctcactgtggtctgtgacagaagagactgactttttaactgatggcttcctatggga

SEQ ID NO: 35983 - DNA, 109 bp, Homo sapiens
tccggagtagctaggattacaggtgcctgccaccatgcccagctaatttttgtatttttcatagaaacggggtttcaccatgttggccaggctggtcttgaactcctga

SEQ ID NO: 35984 - DNA, 118 bp, Homo sapiens
acagtgtaaaaaacagcaccttctactgactttggtaatttgataaatatacatttaagtatatgtggttgactaatctaaagatttaaaaaggccaggtgcagtggctcacgtctgt

SEQ ID NO: 35985 - DNA, 113 bp, Homo sapiens
gtgagtgtcgtggggcactataaagggcatgattctggccatcaggtgaacctggactcactctgactcaccctgacagcctggataacctggaacaagtcctcacttctcac

SEQ ID NO: 35986 - DNA, 90 bp, Homo sapiens
gcatcagctgccctgtggcccccaccctcccctttgccccagagctgctgctctgtcaccctgagttcagtcacagtcagcgtgggctgc

SEQ ID NO: 35987 - DNA, 117 bp, Homo sapiens
ccagccacacagggagtcgaggggagtgtagagttccacccacccagccagtcacacacacacacatacactggaagctgggcattctcactctcacgtacacacccaggggcttgg

SEQ ID NO: 35988 - DNA, 134 bp, Homo sapiens
tgagagagtgagaccctgcctcaaaaaaaaaaaaaaaatcatcatcatcttttttttttttttttttttttgagacggagtctcgctctgtcacccaggctggagtgtggagtgcagtagtgcaatctcggctc

SEQ ID NO: 35989 - DNA, 91 bp, Homo sapiens
tgcacgtctctaaatcctgagccacacactgcctctcagccactcagaggaagctgatgcccagggttgtgtagcttgagagggtcagatg

SEQ ID NO: 35990 - DNA, 67 bp, Homo sapiens
ggggcccactcccctgagaatggcctttctgagcctaggaggctgtcagatgggtgtgagcaaaccc

SEQ ID NO: 35991 - DNA, 108 bp, Homo sapiens
cctggaggcagccctggagtgtgggaggaggactgaggtctggctccaggtcaggagtatgactctggagccaagccaccagcattcaaacttggctccatctcctgg

SEQ ID NO: 35992 - DNA, 74 bp, Homo sapiens
gctgcaggctatgcagtgagggaaggagagtctgtcccagcctgaccttgtctgtctctgtatcagtccacggc

SEQ ID NO: 35993 - DNA, 75 bp, Homo sapiens
ggggaatggggcaggggcaggaccagggtgagatggatgctatgctaagcagggtccgtctgtctgtccatctcc

SEQ ID NO: 35994 - DNA, 74 bp, Homo sapiens
gtggagcagggaggagacaaggttgggccctggagcaacccaccagggttcagactctggctctgtcacttcgc

SEQ ID NO: 35995 - DNA, 119 bp, Homo sapiens
tactccatcctgggtaatagaacaagaccctgtctcttaaaaaataaacaaataattgttttattttatttttattattatttttagatggagtctcactctgtcaccaggctggagtg

SEQ ID NO: 35996 - DNA, 74 bp, Homo sapiens
atatctatatatagatatatatcgatatagatatcgatatatagatagatatcgatatatagatatatagatat

SEQ ID NO: 35997 - DNA, 146 bp, Homo sapiens
tatatatcgatatctatctatatatcgatatctatatcgatatatatctatatatagatatctatatcgatatctatctatctatatatagatagatatagatatgtatcgctatagatatatagatatagatatatatagatata

SEQ ID NO: 35998 - DNA, 115 bp, Homo sapiens
aggtagcccgtagaccatacgtatacagttattgcaggggttcagagaaaggaggaaaggctcactgtgtctgtgtatgtatctttagtttttagggtctttttaaaggttgttt

SEQ ID NO: 35999 - DNA, 116 bp, Homo sapiens
acagttgaaaatgcatagcttgcatttatttccactcatattttattgtgtattaaagatgtttgaagggaggctagaaatgcaaaagagagaactatgttgtgtaagacaactgt

SEQ ID NO: 36000 - DNA, 118 bp, Homo sapiens
tgatggatggatggatggatggatggatggatggatggatggatggatggatggcagagtctcactctgtcacacaggctggaatgcagtactgtaatcatggctcactgtagcctca

SEQ ID NO: 36001 - DNA, 102 bp, Homo sapiens
aagatgggaggattgcttgagcccaggagtttgaggttacagtgagttatgatcacagcattgtactctggcttgggcgacagagtgagatgctctctcttc

SEQ ID NO: 36002 - DNA, 58 bp, Homo sapiens; identical to SEQ ID NO: 315

SEQ ID NO: 36003 - DNA, 88 bp, Homo sapiens
ggagtctcactgtgtcgcccaggctggagtgcagttgcgcgatctcagctcactgcaagctctgcctcctgggttcattccattctcc

SEQ ID NO: 36004 - DNA, 112 bp, Homo sapiens
gatgtcactattggtggaagctggatgaagggtacatgggactctatgtactatttattcttatgtttatttttttctatgtactatttttgcagctttcttcaagtatatt

SEQ ID NO: 36005 - DNA, 94 bp, Homo sapiens
gccattgtaagttatcttttgtggtctttttttttttttgatacagggtctcacctcactctgtcaggctggagtacagtaacataatcatggc

SEQ ID NO: 36006 - DNA, 58 bp, Homo sapiens
tgagacagagtctcgctctgtcacccaggctggagtgcagtggtgtgattttggctca

SEQ ID NO: 36007 - DNA, 58 bp, Homo sapiens
tgagacagagtctcactgtgtcgcccagactgtagtacagtggtgcactctcagctca

SEQ ID NO: 36008 - DNA, 105 bp, Homo sapiens
tttcaacattttctggatatcttttagttgtaaatttcttgttcagtttcactgagggcagataatacgttctatatgatttcaaacatttgaaatttgttgaga

SEQ ID NO: 36009 - DNA, 117 bp, Homo sapiens
ttgagacaaggctgggcagccatagccagaccctgtttctattttgttttattattatttatttatttatttatttttgagacagagtctcgctctgtcgcccaggctggagtgcag

SEQ ID NO: 36010 - DNA, 81 bp, Homo sapiens
ccaacctctgtaccaaagtgggttattttatgtgtctatttattttttagagacaaggtctcactctgtcacctaggctgg

SEQ ID NO: 36011 - DNA, 106 bp, Homo sapiens
tgggcgacagtgagaccctgtctcaaaaaaataaattaaaaataaataaataaatggcattttaaaattattattattttgagacagagtctcactctgtcactca

SEQ ID NO: 36012 - DNA, 118 bp, Homo sapiens
gggaacatgcttctgtgctaaagcatcaggcaaagagaaaatagaatcttttttttttaagagaaagggtcatactctgtcagccaggctggagtgcaatggcacaatcatagctcct

SEQ ID NO: 36013 - DNA, 77 bp, Homo sapiens
ctcccaaagtgctgggattacaggcgtgatattctttttttttgagatggagtctcactctgtcacccaggctggag

SEQ ID NO: 36014 - DNA, 78 bp, Homo sapiens
ggctggggtaataatgttgttgacagagttcttttttttgttttttttgagacggagtctcgctctgtcacccagact

SEQ ID NO: 36015 - DNA, 89 bp, Homo sapiens
gataagacagtggctatgatgactgagttaggccaaatcccagggccattgcctgagcctcagtctctcagttattcccccagtctctc

SEQ ID NO: 36016 - DNA, 91 bp, Homo sapiens
ggaagaaagaggcctaaggagctgagtgcctgagtccctgtcctggctttgtgggaaagggcaggtaagggttcagatcctctgtgcttcc

SEQ ID NO: 36017 - DNA, 112 bp, Homo sapiens
atttggagctaacctcaaaccctagtaaagacctgagagaaatcagagtgtaaagggaattgactgacctttctctctgcctgtgctcctgttggtgagtgctgctgtgagt

SEQ ID NO: 36018 - DNA, 91 bp, Homo sapiens
tccaaacgagttccacaggagactttttctttctttctttcttttttttttgttttttgagatggagtctcactctgtcacccaggctgga

SEQ ID NO: 36019 - DNA, 124 bp, Homo sapiens
cagcatttgttaatactgtagtgaaaagcatgtaggaattattattagaagacttgtgattgtgttctgactgcaatattcacaagctatttctgtataagccatggttgtctgtaaagtaggc

SEQ ID NO: 36020 - DNA, 95 bp, Homo sapiens
tttggcatatgacaaaggtgtcattttaatcagtgagaaagaagacttttttttttttttttgagacaaagtctcactctgtgtcccaggctaga

SEQ ID NO: 36021 - DNA, 66 bp, Homo sapiens
ggcatggtagcatgtccctatagtcccagccactggagaggctgaggtgggaggatgaattgagcc

SEQ ID NO: 36022 - DNA, 95 bp, Homo sapiens
cactcacccatggttctgcaagttctctaattttctgagcctctgagtcactgacgaagtcatggtagagagcaatgtagggctccaggtggatg

SEQ ID NO: 36023 - DNA, 58 bp, Homo sapiens
tgagacggagtctcactctgtcacccaggctggagtacagtggtgtgatctctgctca

SEQ ID NO: 36024 - DNA, 94 bp, Homo sapiens
tctatgtgtatgtatgtgtatatatatatatatatgtatgtacgtgtatatatacacacatatagatgtacatatatacacatacatgtgtata

SEQ ID NO: 36025 - DNA, 72 bp, Homo sapiens
gtatgtatatatatctaatgagtatatatgtgtatatacacattatgcatatatgtatgtatatatacgtat

SEQ ID NO: 36026 - DNA, 88 bp, Homo sapiens
gagcttaggacatctgtgaatctcagtgtttctctttccagccccctggagatgaataccctactttgagaaaacagtagctgggttc

SEQ ID NO: 36027 - DNA, 81 bp, Homo sapiens
cagggtctcactctgtcacccaggctccaggctggagtgcagtggtgatgatcttggctcattgcagccttcacttcctgg

SEQ ID NO: 36028 - DNA, 116 bp, Homo sapiens
catttattgagagagagagagagagagagagagagttttgaagcaacaatgtacccttagtaaagctgctatgcaaaattacccctcagtcctattctaagcttacagttcagttg

SEQ ID NO: 36029 - DNA, 88 bp, Homo sapiens
ccagcctggccaatatagcgagaccctgtctctattttttttttttttttttttttgagatggagtgtcgctctgtcacccaggatgg

SEQ ID NO: 36030 - DNA, 117 bp, Homo sapiens
gaaacataacatttagaagttttcacagacacatttcaggctcctcacaatatatttatttattaaccttgaggggtttatagtcccaggtctgagaaactctaatctaatcatttc

SEQ ID NO: 36031 - DNA, 95 bp, Homo sapiens; identical to SEQ ID NO: 580

SEQ ID NO: 36032 - DNA, 93 bp, Homo sapiens; identical to SEQ ID NO: 69

SEQ ID NO: 36033 - DNA, 103 bp, Homo sapiens
tgggcaacatagtgagactctgtctctattttcactataattttaaatttaaaacaatgaaaaagaaaaggaaaagaaaataaagtctctgtgaattgtccca

SEQ ID NO: 36034 - DNA, 70 bp, Homo sapiens
ggaatggggtattttttgacaaaatgaagaaattattcttcagattttgttgtaaaaaataaactatttt

SEQ ID NO: 36035 - DNA, 140 bp, Homo sapiens
cagagaacagaggccgagagctgaggctcggctgggagccacaactccaggcccagctctgccactgtgggtctgagagggacagagagaacgctactttttgaaaaacgactcttatacccaggccctgtattggagct

SEQ ID NO: 36036 - DNA, 76 bp, Homo sapiens
ccctaagtcagaacatgacaatcagcacacagtctctgtatgtctgtcaatgagttcatcatctgttactggaggg

SEQ ID NO: 36037 - DNA, 98 bp, Homo sapiens
gaggtgcagaacggcccagtcagagatccagagagaagtcagcctggagccggacttcaggccttcacttaggtgctccccactgcctcatgcacacc

SEQ ID NO: 36038 - DNA, 95 bp, Homo sapiens; identical to SEQ ID NO: 68

SEQ ID NO: 36039 - DNA, 93 bp, Homo sapiens; identical to SEQ ID NO: 69

SEQ ID NO: 36040 - DNA, 115 bp, Homo sapiens
gggcacagtggctcacatcccagcactttcggaggctgaggtagaaggatcatttgaacccaggagttcgagaccagcctgggcaatatagtgtgttgtgggaagtcagggaccc

SEQ ID NO: 36041 - DNA, 130 bp, Homo sapiens
agcatatgtggcatgggctgggactgcccctgggcttcactgtccagccttggactccacggctgctctctgctctctctgaccttgacttcccttggggatggtcgcctgggaacctctgactgcagtc

SEQ ID NO: 36042 - DNA, 119 bp, Homo sapiens
tccaggctcacaccactgaggaaggctgtcatcaatctctctcctgcctccagtctttctcacactagtgagtgtgaactccctggatgtctgcagcttaaaggggtttactctaggcc

SEQ ID NO: 36043 - DNA, 111 bp, Homo sapiens
tgcacctcagggtggcctggcaaggttgtcgcttttgctccattttttttttttttttttttttttttttgaggtggagtctcactctgttgcccaggctggctcactgca

SEQ ID NO: 36044 - DNA, 91 bp, Homo sapiens
actgggtcttcattttgtcatctgtggaatgggtataacgacactaactctctcacaggataactgggcaggttgaggtgcttcacccagt

SEQ ID NO: 36045 - DNA, 82 bp, Homo sapiens
ttgcttattgtctactcttgtctttccaaatctttgggttatgtaaaagagaaagatgtgagagtggagttatagggagcaa

SEQ ID NO: 36046 - DNA, 107 bp, Homo sapiens
taaggaagtttaaggaccaccagtggaaaattctcagtctatgtgtctcttttaaaaaaattttgtggatacatagtaggtgtttatggggtacgtgaaatgttttg

SEQ ID NO: 36047 - DNA, 103 bp, Homo sapiens
ggtctgggctgagccggcggggacaggggcagggtgtactcagatgaatgaggcacagtctgtgcctctcacagccagatggcagaggcagacacagaaatcc

SEQ ID NO: 36048 - DNA, 70 bp, Homo sapiens
gggggctggcgcaggatctgggaagccatctgaatctcaggcagtctcactctctctgcacctctcctcc

SEQ ID NO: 36049 - DNA, 78 bp, Homo sapiens
ttgttattattttttgagatggagtctcactctgtcacgcaggctggagtgaagtggctcaatctcagctcactgcaa

SEQ ID NO: 36050 - DNA, 61 bp, Homo sapiens
gtgctatatatatatatacacacatatatatgtatatatgtgtatatgtgtatatctatac

SEQ ID NO: 36051 - DNA, 56 bp, Homo sapiens
tgagacagtctcgctctgtcacccaggctggagtgcagtggcgagatcttggctca

SEQ ID NO: 36052 - DNA, 103 bp, Homo sapiens
agtgggctttaagaacccaagcactgattaggaaaatgacaacctgctgctgacacatccagcattttttttttttttttagacagggtctggctctctcact

SEQ ID NO: 36053 - DNA, 83 bp, Homo sapiens
tctatcccaggcactgagctagacactggggctggagggcttttttacagtcctctgtggctctctggcagtcttgggctggg

SEQ ID NO: 36054 - DNA, 70 bp, Homo sapiens
atcctaagactctgactatgtgactctcactttcactggtgatgtcagcctgggttagccctcatgggat

SEQ ID NO: 36055 - DNA, 70 bp, Homo sapiens
tcagaaattgagccactgtcgcccagattatttagggtttcctaaataatctgcctcactgaatcactga

SEQ ID NO: 36056 - DNA, 133 bp, Homo sapiens
gattgggaaattcagagggattgagtggcgagggccatctgtcctgcctctaataatgctcactgaccctctgagtgccttatccagggggttcccatcatgtagcagttcaatcctccatctcccacttcag

SEQ ID NO: 36057 - DNA, 132 bp, Homo sapiens
gcgtgtgtatgtgtatgtatgtatgtgtgtgtgtatatatatatatacacgtatatatatatatacacgtatatatatatatatatatatatatacgtgtatatatatatgtgtgtgtgtgtgtatgtatat

SEQ ID NO: 36058 - DNA, 130 bp, Homo sapiens
atgagcacatgtacggggcccatggaggcagcagcaagggaacagagccctggaatcacactgtctctgtccatgttctgccaggggccctgtggtgccgttggcctgggcttcgctgttcccctcctgc

SEQ ID NO: 36059 - DNA, 63 bp, Homo sapiens
gtgtacagccattgcacttctttttttacatttattactggctgagtgcagtggctcatacat

SEQ ID NO: 36060 - DNA, 129 bp, Homo sapiens
atatatatatatatatatatatatatgtgtgtatatatatatatatatatatgtgtgtgtatatatatatatatacacacacacatatatatacacatatatatatatacacacacatgtatatgtgta

SEQ ID NO: 36061 - DNA, 105 bp, Homo sapiens
ttgggtatgtggaagagctggtgggaagtaaggatggtatatagagaagttagactgtagagggctttgaacacaatgatgggatgtttttgtacattatcctag

SEQ ID NO: 36062 - DNA, 89 bp, Homo sapiens
gctgggattacaggtgtgagccactgcgcctggcctcaccctttttattaaccatattgctaggtgcttgtattgtattcattttcagt

SEQ ID NO: 36063 - DNA, 101 bp, Homo sapiens
tgtttagagcctggattttcttctttttttcttttttttgagacagagtctcgctctgtcgcccaggctggagtgcagaagcgtgatctcggctcactgca

SEQ ID NO: 36064 - DNA, 86 bp, Homo sapiens
ggtgcatctgggttgagtcttgcctgtgacagattataacggattaggctctggctgtcacagggcctgactcaaacccaagcact

SEQ ID NO: 36065 - DNA, 115 bp, Homo sapiens
gctcacaggggcgaggacacaggggcagtgttgctgcacggaatgcaggcagacatcactctccctcacacagtgtaggctgtccccatctcccctggcacctcagtccctttgc

SEQ ID NO: 36066 - DNA, 103 bp, Homo sapiens
gggcatggcagcacacacctgtagtcccagctactcaggaggctgaggtaggaggatcccttgagcataggagttagagactacagtgagccatgatcatgcc

SEQ ID NO: 36067 - DNA, 57 bp, Homo sapiens
tgagatggagtctcactctgtctccaggctggagtacagtggtgcaatctcagctca

SEQ ID NO: 36068 - DNA, 58 bp, Homo sapiens
tgagacagagtctccctctgacacccaggctggagtgcagtggcatagtctcagctca

SEQ ID NO: 36069 - DNA, 95 bp, Homo sapiens
tctgagcctcagtttccccctaccccccagcccagtgacataggacaacagtacccacatcactggattgttgtaaggatgaactgaggcaaaga

SEQ ID NO: 36070 - DNA, 131 bp, Homo sapiens
ttcaatcttttctacttcctctctcttttttggggggggagggggtggtttttttttttattttgaatcagggtctaactcactctgtcacccacgttggtatgcagtggcatgatcttggctcactgtag

SEQ ID NO: 36071 - DNA, 75 bp, Homo sapiens
atttggtgcctttctctgcaaaatagaccctgagagagccagatgagtctgagcagactagatgggcatgcagat

SEQ ID NO: 36072 - DNA, 79 bp, Homo sapiens
ggtgtggccgggtctcacacactctcttcctgggacaaaactggggaaggcgggtggtgcaggacccctccttagcacc

SEQ ID NO: 36073 - DNA, 104 bp, Homo sapiens
tgtaattatttctgtgtcttcctgtattatgtatgtaattatttatgtgttacatatacatatgtgcatatattaagaaacatggcagggcacagtggcttgca

SEQ ID NO: 36074 - DNA, 133 bp, Homo sapiens
agtgcggctcatgcctgtaatcccagcactttgggaggccaggcgggcagatcacttgaggtcagaagtttgagaccagtctgaccgacatggcaaaactctgtctctactaaaaatgcaaaattagccgggc

SEQ ID NO: 36075 - DNA, 114 bp, Homo sapiens
atgaaaattatgagccaggaaccgtggatgaaaacatatatatatatattatatatatattatatatataaaatatcacaatactggattcctctgaacctctataaaattcat

SEQ ID NO: 36076 - DNA, 68 bp, Homo sapiens
gggcgtggtggtacactcctttagtcccagctactcaggaggctgaggtaggaggatcacttgagccc

SEQ ID NO: 36077 - DNA, 132 bp, Homo sapiens
gcagggaggaaggctgtttgaggagacctggcagctgccccggctccgggttgggctgtgatgagtgtgtccactggccggggtggacaagccagcgctctacacagcaccctttgtgtgttggagtggggc

SEQ ID NO: 36078 - DNA, 83 bp, Homo sapiens
ctggaaaacctcctttattttaggcatgatcctaggctctgtagatacagaatcaggaactcattgtctgaggaaggggacag

SEQ ID NO: 36079 - DNA, 68 bp, Homo sapiens
gtctttgctttgctgcctgtctccaaattccagctcagaatttggtacagagaaggcagacagtagac

SEQ ID NO: 36080 - DNA, 96 bp, Homo sapiens
agactcagtgtgactggagagagtgaaggaggggcaagtggaaggacatcccccaacctaacatatttttcttttttatagcagttatcaccttct

SEQ ID NO: 36081 - DNA, 62 bp, Homo sapiens
gtgcaagagtgtagaatacagaaggcactcaacatatgtctctctgtatctctctctatcac

SEQ ID NO: 36082 - DNA, 67 bp, Homo sapiens
tcatggaaggctccttgctggggaacttaagggaagtccttcaatctctctgagcctcagtctatga

SEQ ID NO: 36083 - DNA, 93 bp, Homo sapiens
gccgacagggaggcggggtcattggggtctgtctctggctgtgctgctgaatgcaccgcacctgggcgtgggccccccaggctagcttcaggt

SEQ ID NO: 36084 - DNA, 66 bp, Homo sapiens
agcccctctcactctgtccctcagtcaggcctcacctgcactcagagaggcagggcatggggggct

SEQ ID NO: 36085 - DNA, 80 bp, Homo sapiens
agaacagtgtctggcaattggtagatgctcaataaatacttattgcatgtatgtatgaatgaatgaacaaacattgtttt

SEQ ID NO: 36086 - DNA, 104 bp, Homo sapiens
atcattagtggtcatacaaatttaaggattttttttttatttctgtgaaaaattacattggaagtttgagagggattatgttgaatctgtagattgctttgggt

SEQ ID NO: 36087 - DNA, 57 bp, Homo sapiens
ttgagacagagtctccctctgtcacccaggttggagtgcagtggaaggcgatctcag

SEQ ID NO: 36088 - DNA, 83 bp, Homo sapiens
agaggtacatactgtctggctgtcccactctgagtgtagttaacactgatcagtggttccaggggtgtcagccggatctctct

SEQ ID NO: 36089 - DNA, 75 bp, Homo sapiens
ccacaaatgaagtctctctctctctgtactgaacttcctggagctgggagaggggtgacataagttcccctgtgg

SEQ ID NO: 36090 - DNA, 58 bp, Homo sapiens; identical to SEQ ID NO: 2224

SEQ ID NO: 36091 - DNA, 56 bp, Homo sapiens; identical to SEQ ID NO: 335

SEQ ID NO: 36092 - DNA, 95 bp, Homo sapiens; identical to SEQ ID NO: 68

SEQ ID NO: 36093 - DNA, 93 bp, Homo sapiens; identical to SEQ ID NO: 69

SEQ ID NO: 36094 - DNA, 63 bp, Homo sapiens
ttgagacggagtctcgctctctcgctctgtctcccaggctggagtgcaatgactcgatctcgg

SEQ ID NO: 36095 - DNA, 80 bp, Homo sapiens
gtgtcttctactgttaacttttatagaatattcaatgtatcattacagagtgattctgctaggggtggtggagaaagcac

SEQ ID NO: 36096 - DNA, 97 bp, Homo sapiens
ccacctcaaccttctaaagcagtgggattacaggagtaagccttttttttttttaaagacaaggtttatgctctgtctccaggctagagttgagtgg

SEQ ID NO: 36097 - DNA, 86 bp, Homo sapiens
ggcatccttgaaaaagtagaagaggaggagcaggacatttcattctctttgtttttctgtcttctatttttattttagagacagtc

SEQ ID NO: 36098 - DNA, 95 bp, Homo sapiens
taacccaattaagtaggtattaaattattcccattttatgactgaggaaactgaggacacatagagaggtatggtaatttgcctaaggtaagtta

SEQ ID NO: 36099 - DNA, 119 bp, Homo sapiens
ctgcagcatctggcctaggaactctcttttctttattttatttatttatttatttatttatttatttatttatttatttattttttgagacagagtctcgctctgtggccaggctggag

SEQ ID NO: 36100 - DNA, 95 bp, Homo sapiens; identical to SEQ ID NO: 68

SEQ ID NO: 36101 - DNA, 93 bp, Homo sapiens; identical to SEQ ID NO: 69

SEQ ID NO: 36102 - DNA, 58 bp, Homo sapiens
tgagacagggtctcactctgtcacccaggctggagtgcagtggtacgatcttggctca

SEQ ID NO: 36103 - DNA, 104 bp, Homo sapiens
ggagcgagagtctgtctcaaaaaaaaaaaaaaagaatttggaggactgttgggaaggcatggttgtatttatttgtttatttttttgagacggagtctcactct

SEQ ID NO: 36104 - DNA, 95 bp, Homo sapiens; identical to SEQ ID NO: 68

SEQ ID NO: 36105 - DNA, 93 bp, Homo sapiens; identical to SEQ ID NO: 69

SEQ ID NO: 36106 - DNA, 122 bp, Homo sapiens
ggctcttgggtggttcgtgttcaggcagcaaaactgttggtaagttatactttttatgtatgtatgtatgcatgtatatatttattttcttttctgtagaaatgaggactgtgtggcccagg

SEQ ID NO: 36107 - DNA, 92 bp, Homo sapiens
ggaacctggaacctgggaggcagaggctgcagtgagctgagattgcgccactgcattccagcctctgtctctgggtgacagagtaagactcc

SEQ ID NO: 36108 - DNA, 99 bp, Homo sapiens
tctgagtctattctgccactgtgaaactagcccatgggtattgatgttgtaagttgaaaagaattatttgggtcaggtgcagtgtgcagtggctcatga

SEQ ID NO: 36109 - DNA, 59 bp, Homo sapiens
gtctctatatatgtatgtatgtatatatatatgtgtgtgtgtatatgtatgtctgagat

SEQ ID NO: 36110 - DNA, 68 bp, Homo sapiens
ggaaaagtgaggagtcagaggacacagccatagacggtagtcaaaagccttggattctgggcccttcc

SEQ ID NO: 36111 - DNA, 74 bp, Homo sapiens
tcatttgtctctctgtctgtctgtgcccaggctggagtgcagtggcacaatcatggcctcccagtttcaagtga

SEQ ID NO: 36112 - DNA, 82 bp, Homo sapiens
tctctcagcatttctagtgggtatccttggcaggcttaaagcagagtcaggagggtgagagctcagagagaggctaaggtga

SEQ ID NO: 36113 - DNA, 85 bp, Homo sapiens
gaatcttattttctcacatgtttctggaatttttcttttttttttaatttaagttccagggtacatgtgcaggatgtgcaggttt

SEQ ID NO: 36114 - DNA, 58 bp, Homo sapiens
tgagactgagtctcactgtgtcgcccaggctggaatgcagtggtgtgatctcagctca

SEQ ID NO: 36115 - DNA, 105 bp, Homo sapiens
gtcttgagaataagttcttatatactgatttttgctgtatgctgttttatgttatttttattttggccattagcaaagcaaaaatgtatatatttatatttagat

SEQ ID NO: 36116 - DNA, 65 bp, Homo sapiens
gtatctgtgacattaaaatgtttctgtatatatttttacctcggacgtttatgtgttacaggtat

SEQ ID NO: 36117 - DNA, 111 bp, Homo sapiens
atagctttgactgtgagcttttcaatttagggattgtcttatttaattttgtaactattaatacaaaataaagacagttatctattggaaaggggtttctatcaattctat

SEQ ID NO: 36118 - DNA, 72 bp, Homo sapiens
ccaggcacagtggtgcatgcctatagtcccagctacttgggaggctgaggtaggaggatcaattgggcctgg

SEQ ID NO: 36119 - DNA, 96 bp, Homo sapiens
gccacccactgagttcatcctactggtgtgagtgactgtgtccctgtcaccactgggttccatgttaccatcccattcaagaacctcgtgtttgcc

SEQ ID NO: 36120 - DNA, 116 bp, Homo sapiens
tggaaaaatcgtttaccctctctggatctcgattgtctcatgtgtaaaagaggggcttcagtgaactttctttgctgaagggcaggggacttaagagagtctgagctgtgttgcta

SEQ ID NO: 36121 - DNA, 95 bp, Homo sapiens; identical to SEQ ID NO: 68

SEQ ID NO: 36122 - DNA, 93 bp, Homo sapiens; identical to SEQ ID NO: 69

SEQ ID NO: 36123 - DNA, 137 bp, Homo sapiens
atatataaatatatacatacatatacatatgtatgtgtgtgtgtctatatatatatatacacgtgtatgtctatgtgtatgtatgtgtgtctatatatatatatatatatatatatatatatatatttgtagagaca

SEQ ID NO: 36124 - DNA, 64 bp, Homo sapiens
tcatgctgaagagcactgacctcagaggttggactctcagcctcactgtttgctagctgtgtga

SEQ ID NO: 36125 - DNA, 89 bp, Homo sapiens
agccctggtgactgcctggctttgggagtgaaggcacagcaattctcagcgtctctcccagcctcagtgtaagcgtgtggcctgcggct

SEQ ID NO: 36126 - DNA, 74 bp, Homo sapiens
gacccaaacacagactgactgtgcctgtggcaagttgcttactggcatctacatggtttttgtttgtggggatc

SEQ ID NO: 36127 - DNA, 80 bp, Homo sapiens
gtacatctatatacatatataacattatttgtgatatatatcatatatatttaatattcagtgtatgtatatgcatgtat

SEQ ID NO: 36128 - DNA, 72 bp, Homo sapiens
tcttcatcctccagaaagtggtgaagtaggaaagtgtgccctttcacacacacactgaccaaggaccgaaga

SEQ ID NO: 36129 - DNA, 102 bp, Homo sapiens
gctaggaaagcacagtacagaactgggtgcagggggaggtgggaagtcaggaatgatcactgtcctctctctgtctcggtttcctcctctgaagtcctttgt

SEQ ID NO: 36130 - DNA, 107 bp, Homo sapiens
tgtgtttgaattctgcaaagttttttcaggtatcaaaactaggaacttttttaaattttactttaagttctggtatacatgtgcagaatgtgcagttttgttacata

SEQ ID NO: 36131 - DNA, 68 bp, Homo sapiens
gagtacccttgtttccaaaggagaaaattgaggcagttttctcactgtctgacacaaagtgggtgctt

SEQ ID NO: 36132 - DNA, 95 bp, Homo sapiens; identical to SEQ ID NO: 580

SEQ ID NO: 36133 - DNA, 93 bp, Homo sapiens; identical to SEQ ID NO: 69

SEQ ID NO: 36134 - DNA, 161 bp, Homo sapiens
caaatatatatatatatatacacatatatatgtgtatatatatgtatatgtatgtgtatatatatgtatatgtatgtgtgtgtatatatatacacatatgtatatatatgtatatgtatgtgtatatatgtatatgtatatgtgtgtgtgtgtgtgtgtgt

SEQ ID NO: 36135 - DNA, 111 bp, Homo sapiens
tggagaaagttccatgtgctgttgaatagaatgtgtattctgtggttgttggatgaaatgttctgtatataactattaagtccatttgttccaaggtatagtttaaatcca

SEQ ID NO: 36136 - DNA, 64 bp, Homo sapiens
atatatatacacacacatatatatatgtatatctaaacatatatatgtatgtgtatatatgtat

SEQ ID NO: 36137 - DNA, 72 bp, Homo sapiens
gaaactcactcacagactctgcaggattcatagaccccagcttatgaaccctagagtagagagtttcagtga

SEQ ID NO: 36138 - DNA, 72 bp, Homo sapiens
gctgtctagtgggtaatttctgacctgagccatggagactggaccttttgtgtggaaagttcactgggaagt

SEQ ID NO: 36139 - DNA, 68 bp, Homo sapiens
tctgtcagatgtgtcactctctgtgaggggctggcctctcacagacctggggttccacgggctgcagg

SEQ ID NO: 36140 - DNA, 116 bp, Homo sapiens
gctcagcacctcagcccctgtgtctctggctccagcaacacatgccacatggaattaccactgtcggtgtgtctgccactcccaaacccctgacgcagggtcctgccttagccagc

SEQ ID NO: 36141 - DNA, 56 bp, Homo sapiens
gagacagggtctcactctgtcacccaggctggagtgcagtggtgagatcatagctc

SEQ ID NO: 36142 - DNA, 64 bp, Homo sapiens
tggttctgagggtccagacacccagcatgtcatcccagctctgaaactctctctctcagaacta

SEQ ID NO: 36143 - DNA, 98 bp, Homo sapiens
ggaggcaaagatttgaggaggcatagggaatgtattgaagtgtgaataagtagacctcagtgagtttcccttctgtgtcaccaaccagctatgtaacc

SEQ ID NO: 36144 - DNA, 60 bp, Homo sapiens
tatgtgtgcatgtgtgtgtatatatatatatatatatatatatatatatatgtacacata

SEQ ID NO: 36145 - DNA, 115 bp, Homo sapiens
ttgtcctctttaacacctttgcaattgacagtgcaatttctttttttcttttttttttttttttttctgaggtggagtctggctctgtcgcccaggctggagtgcagtggcacga

SEQ ID NO: 36146 - DNA, 102 bp, Homo sapiens
tttgtcatgggtctctggtgacaaacattggtcatattggtgagttatatggttcttcacttctcatttgtcaccttttgtcatgagccaagttatggtgaa

SEQ ID NO: 36147 - DNA, 100 bp, Homo sapiens
tgtgagaaaacccctgatacactggcttaagacagttacatagtttttgaatatagtaaaatcaaaggtaggtgtctggggctggtgtgggagatccata

SEQ ID NO: 36148 - DNA, 108 bp, Homo sapiens
gcaaaatctaagggaaagtactaaaagccagttctcagaatccaaggttgattatatatatatcagtctggttgagatggcttggacctctcacttgttttttcatgc

SEQ ID NO: 36149 - DNA, 110 bp, Homo sapiens
ggaacttctagtgtaagaggcttctgactggaattacttcactcagtctctctgaatcattcagttttatcagtcaggatgagctaggttttgttgcagtaacaacttcc

SEQ ID NO: 36150 - DNA, 66 bp, Homo sapiens
ggtcagaggctcacacctgtaatcccagcactttgggaggctgaggtacgtggatcacttgagacc

SEQ ID NO: 36151 - DNA, 98 bp, Homo sapiens
gaggttagcactttatctctgactgagacactgagtgacccgctagaacagccaggcatatttcaggtcattaatcacacaggaaagctggtcatctc

SEQ ID NO: 36152 - DNA, 82 bp, Homo sapiens
atccagtatatatatatatatggatccagtatatacaatatatatataagatccaactatatatatgtatatatatgtagat

SEQ ID NO: 36153 - DNA, 97 bp, Homo sapiens
agctatatctatttaagatatctatatattttttagatataggtatctatatctatatctaaaaaattatgtagtatccacaaataatgaaattgct

SEQ ID NO: 36154 - DNA, 112 bp, Homo sapiens
ggagtaaaagtaatgaatgtgtgtcaggttttgtggaagaagggaattatttatacttatattaaatagttaggaaagtccagggagcttggacaggcatgtggtggtatcc

SEQ ID NO: 36155 - DNA, 95 bp, Homo sapiens
ggctgtcgttacgaggagaaatatagctgtgggatatgtatgtctataagtgtggatatacacatacactcactctcttacacaaacgcacacac

SEQ ID NO: 36156 - DNA, 98 bp, Homo sapiens
atatgtgggtggtgggtttatagttatttattttaatgcttcagtatatatagacatacaagtatatgtatgaagtatatataaatgtatctacatat

SEQ ID NO: 36157 - DNA, 57 bp, Homo sapiens
gtatatgtgtatatataaataacacacacacatgtgtgtgtatatatatatgtgtac

SEQ ID NO: 36158 - DNA, 64 bp, Homo sapiens
cttcctgctcctgactcagtctgtccctcccctccagggctgagactagggtgaggctagaaag

SEQ ID NO: 36159 - DNA, 108 bp, Homo sapiens
cagaacctaactcagcctgcataggagtctaagacacttttacctaaattttactcccactctccttcactcaaactcagacttgtatctcaggctgatggctctctg

SEQ ID NO: 36160 - DNA, 98 bp, Homo sapiens
ggttgggagagcgatgactatctgatggtttctatacaaataattagataactgattatctgatgtgaatctatcagtagaatctgtacatcattgcc

SEQ ID NO: 36161 - DNA, 108 bp, Homo sapiens
atgtagacacacacacacacagatatatatgcatgtatatacatatgtatatatatgtgtatatatgtatacgtgtgtgtgtgtgtgtttatgtatatatatatatat

SEQ ID NO: 36162 - DNA, 80 bp, Homo sapiens
ttgatttcttattcagattgtatgctggttagcatgtatagatgctactgacttttgtgtgaactgaatttgtttatcag

SEQ ID NO: 36163 - DNA, 133 bp, Homo sapiens
aagattcatgtgtgtgtatatatatatatatgaagattggatatatatgaagattcatgtgtgtgtgtatatatatatatatatgaagattggatgtatatgaagattcatgtgtgtgtgtatatatatatat

SEQ ID NO: 36164 - DNA, 139 bp, Homo sapiens
atatatatacacacacacatacatgaatctttgtatatatctaatcttcatatatatccaatcttcatatatatatatgtgtatatatatatgtatgtgtgtatatacatatatgtttgtgtgtgtgtgtgtgtgtgtg

SEQ ID NO: 36165 - DNA, 78 bp, Homo sapiens
ctgtcaggcttcctcttacacttttttattataatcatgaactatgatgaagatgatgttgaagatggagctatgcag

SEQ ID NO: 36166 - DNA, 69 bp, Homo sapiens
gagatttccttgaggccagtagtgagaggtgacagcctgctggcagccctcgctctctctgggtgtctc

SEQ ID NO: 36167 - DNA, 103 bp, Homo sapiens
gaggtctaagtcagtggttcctaccttttcaagttagaagaccatttaaatatatgttttttccttattcccacttggtggtagttgtatctatgaaaacttc

SEQ ID NO: 36168 - DNA, 101 bp, Homo sapiens
tggggcaggagaatggcgtgaacccgtgaggcagagattgcagtgagcagagagagcgccactgcacttcagcctgggtgacagagcgagactccgtctca

SEQ ID NO: 36169 - DNA, 112 bp, Homo sapiens
ttctggggtagttaaacccatccacacagggaggggtaaattgaaccacgtgaaaatagcatctttttttatataaagttcatctgcccctgctgtttattgcccacctgaa

SEQ ID NO: 36170 - DNA, 140 bp, Homo sapiens
ctctataattctcatcatcctgatacctgtaggcctttgagtgtttactttgtttttttgttttttttaaattattatactttaagttctggggtatatgtgcagaatgtgcaggtttgttacataggtatacacgtgcc

SEQ ID NO: 36171 - DNA, 84 bp, Homo sapiens
ggcacttcctgagctatacgttgattggtgagactgtctgtctgtccgtctacctatctatatgtatatttcagtgaaaatgcc

SEQ ID NO: 36172 - DNA, 101 bp, Homo sapiens
ctttgtcatatgcggttatctctctctgctctaggtaatggaattatatttaattttagttcctttcctagtgtttattttttattgcaaataatacattg

SEQ ID NO: 36173 - DNA, 59 bp, Homo sapiens
gtgtatgtatatgtatgtatatgtgtgttgtgtgtatatgtatgtatatatacatatat

SEQ ID NO: 36174 - DNA, 108 bp, Homo sapiens
atatatgtatatatacatatgtatatatagatatatgtatatatacatacatatatacatatgtatatatagatatatacatatatacatatgtatatatagatatat

SEQ ID NO: 36175 - DNA, 76 bp, Homo sapiens
atagatacgtagatagaaacatagatagatagatagtcatcatctactctgtctatatctgtctgcctatctatct

SEQ ID NO: 36176 - DNA, 95 bp, Homo sapiens; identical to SEQ ID NO: 580

SEQ ID NO: 36177 - DNA, 93 bp, Homo sapiens; identical to SEQ ID NO: 69

SEQ ID NO: 36178 - DNA, 137 bp, Homo sapiens
tccttgtggtgatggaaaatgttctgtatactgactatatcaatattaatatcctggttgttatattgtagtacagttttgctagatgttgcctttgggagaaactggataaagggtacatgggatttctgtattac

SEQ ID NO: 36179 - DNA, 94 bp, Homo sapiens
tccagtggcattgtagaagaaaataaggcatttaggttttaggtcaggtgtgagttgaagaggttgtaggtttttaagaacacaggctaaggga

SEQ ID NO: 36180 - DNA, 112 bp, Homo sapiens
ccttcacagcctctggtagccatcattatatcctctatatccatgagttcattttttttttaagctcacacatatgaatgagaatatgtgatatttatctttttgtgccagg

SEQ ID NO: 36181 - DNA, 107 bp, Homo sapiens
tatgcatacatatatgtgcatatatatgcataaatatgttatatataaacatatgttatatatgtatatacatatatgtgtatatatgtacagatatctatgtcata

SEQ ID NO: 36182 - DNA, 115 bp, Homo sapiens
taagtttcctataaccatttatatatgtgaatatatatatatatatatagtgtatgtatatatacatttatatacatgtatgtatattatgtgtgtctgtgtgagtatctgcttg

SEQ ID NO: 36183 - DNA, 104 bp, Homo sapiens
atttaacttattttcttaggtatctcacagcaattttgatcagaaatagatcatactatttttttgattgaacagatgggaaaactagggctctgaggttaaat

SEQ ID NO: 36184 - DNA, 85 bp, Homo sapiens
cagatggacatcagtttaaattctgattttgatattgtggatgtaattaaatgtcaaaaactctgagtactggatccaatatctg

SEQ ID NO: 36185 - DNA, 116 bp, Homo sapiens
ttatgttttagttgctatgtgtattcatgtctattatttctattacttgtgtgagcatatgtttttatttatatagagtaaatatatagaaatgaaattggtaagttgcatagtaa

SEQ ID NO: 36186 - DNA, 95 bp, Homo sapiens; identical to SEQ ID NO: 68

SEQ ID NO: 36187 - DNA, 93 bp, Homo sapiens; identical to SEQ ID NO: 69

SEQ ID NO: 36188 - DNA, 102 bp, Homo sapiens
ggtctggaagaggttacatgagaaactatttgtatatgtgtgcatatgcatgtatatataagtactatttcttttacaactttctcaatatcttccatgatt

SEQ ID NO: 36189 - DNA, 66 bp, Homo sapiens
tcttggtatcagtctttctctgtcacagcctgaaagttatttcacacagagagagaaatgctagga

SEQ ID NO: 36190 - DNA, 73 bp, Homo sapiens
tatacacacacgcaatatgtatatatatgaatgtgtgtatataccacatatggtatgtatgcatgtgtgtata

SEQ ID NO: 36191 - DNA, 129 bp, Homo sapiens
tacacgcatatgtgtacgtgtatgtgtatatatacatatatgtatatgtatatatcacatatacatatgtgtgtatatatatacatatacatacatgtatacagtatttatatatacatacacatatat

SEQ ID NO: 36192 - DNA, 104 bp, Homo sapiens
atgtgtgtatatatatatatacacatactatatatatagtgtgtgtgtatatatatatatttactatatatatatatagtgtgtgtgtgtgtatctacatatat

SEQ ID NO: 36193 - DNA, 84 bp, Homo sapiens
ttttttttacctctatcaggccatataacctacactgccctctgtaagggttttctaggtgtgtgtctgtctctgtaaattgaa

SEQ ID NO: 36194 - DNA, 114 bp, Homo sapiens
tttgatgtgcactttgaacagtgtttaaaaccaaactttttaatgattgtataatacttcattaaatttatatcagagtttgcttcactgttttcccagggctgagtaattaag

SEQ ID NO: 36195 - DNA, 123 bp, Homo sapiens
atatatatatatgtgtatatatatgtgtatatatatgtgtatatatatgtgtgtatatatatgtgtatatatatatatgtgtatatatatgtgtatatatatgtgtatatacatatatatagg

SEQ ID NO: 36196 - DNA, 96 bp, Homo sapiens
tgtgtttatttttgtgggtggtgtaagagaaggattcaattatatatttttgcatgtagatatccagtttcccaacaccatttattgatgagacca

SEQ ID NO: 36197 - DNA, 94 bp, Homo sapiens
gggccttcccctcaggtgacttctcaggtatctggggcaagcagggcaggggcaggacagtcaagaatgagaggacacacagggtactgggtct

SEQ ID NO: 36198 - DNA, 111 bp, Homo sapiens
taagcgggattacttttgtgtgtgtgtgtgtgtgtgtgttttgcaagtgtttataatttttttaactttcattttaagttcaggggtacatgtgcaggatgtgctggtttg

SEQ ID NO: 36199 - DNA, 106 bp, Homo sapiens
ttcatgtagttcaaccaaacatgttggttcacacctgtaattccagcactttgagaggctgaggtaggaggatcacttgagaccaggagtttgagactagcatgag

SEQ ID NO: 36200 - DNA, 111 bp, Homo sapiens
atcattcttttcacacaagattctgtacataaaaagaagcatatgaaactatttctatttttctttctatgctattttaagtgttgataaagtgttggggggaaatatggt

SEQ ID NO: 36201 - DNA, 73 bp, Homo sapiens
gcagttagcatgcctggctgtgcgcagtggctggacctcaagctcactcgctcactcacacaccccctgctgc

SEQ ID NO: 36202 - DNA, 71 bp, Homo sapiens
gagaagtgtttaggaggaggtccttgaatgggggccagaagctctctcagtgtctcttccagccctgactc

SEQ ID NO: 36203 - DNA, 74 bp, Homo sapiens
tgccatttaaatttttgtttgtttgtttttgagacagggtcttgctctgtcacccagactggagtgcagtggca

SEQ ID NO: 36204 - DNA, 111 bp, Homo sapiens
gacattttggctatttcccatcttttgggatgcttatgttatgatactgcaatgaatattctttgtatatatctttgcatgtgtatttctgtaggataaattaaaaatgtt

SEQ ID NO: 36205 - DNA, 72 bp, Homo sapiens
tatttgatatatatgtatatatatgtgtgtgtgtatatatatatatgcatatatacacatatatatatatat

SEQ ID NO: 36206 - DNA, 88 bp, Homo sapiens
atgcctatccctaaagctaagaccatgtgacatttgcttttgtagctggtctccttcactgggtctctgagtgggaatggaactgcat

SEQ ID NO: 36207 - DNA, 117 bp, Homo sapiens
tgctgggattacaggcatgagccactgtgcttggcacaaaaatgactttatctgaaatatttttctttgatttaaaaaaatggctaggcacagtagctcatgtctataatcccagca

SEQ ID NO: 36208 - DNA, 95 bp, Homo sapiens; identical to SEQ ID NO: 68

SEQ ID NO: 36209 - DNA, 93 bp, Homo sapiens; identical to SEQ ID NO: 69

SEQ ID NO: 36210 - DNA, 78 bp, Homo sapiens
agcctcccgagtagctgggattacaggcatgtgccaccatgtccaagtaatgtttgtatttttagtagagaaggggtt

SEQ ID NO: 36211 - DNA, 86 bp, Homo sapiens
ggaggagtaaagatgcaactttgtggtcaggaacgaaggctagctgcctgctgactctgtgactgtgactataagcatgacacccc

SEQ ID NO: 36212 - DNA, 90 bp, Homo sapiens
ggctttactcctcttggcattgttttgtatttgcatgaaaatgtgtaattttttttttttgcatgacaagtcattggtgatgttgaagtt

SEQ ID NO: 36213 - DNA, 58 bp, Homo sapiens
tgagatagagtctcgctctgtcacccaggctggagtgcagtggcgagatctcggctca

SEQ ID NO: 36214 - DNA, 95 bp, Homo sapiens; identical to SEQ ID NO: 68

SEQ ID NO: 36215 - DNA, 93 bp, Homo sapiens; identical to SEQ ID NO: 69

SEQ ID NO: 36216 - DNA, 105 bp, Homo sapiens
atatatatatatatatatgtgtgtgtgtgtttatatacacatatatatgtttatatacacatatatatgtgtgtttatatacacatatatatgtgtgtttatata

SEQ ID NO: 36217 - DNA, 80 bp, Homo sapiens
tgtgttactgtttgtgaagagcttccttttttttttttttcttttgagacagggccttgctctgtcacccaggcaacaca

SEQ ID NO: 36218 - DNA, 110 bp, Homo sapiens
gtgtctctgaagctctttgccactgccttcccactgcgtctctctttagcccccagtttactgaaagaagtcagtgtggttacctattcggtgaaaagaacttgtgccac

SEQ ID NO: 36219 - DNA, 110 bp, Homo sapiens
tgtggctatatgagaatgcactttatatatgtacttggttattattatttactcattaggtaagccagccagtcagtcagtcagtaaaggcactcattccttgagtcaca

SEQ ID NO: 36220 - DNA, 78 bp, Homo sapiens
ttagccctttgtcagatgagtagattgcaaaaatttttttttttttaaggcagcgtctcactctgacacccaggctgg

SEQ ID NO: 36221 - DNA, 71 bp, Homo sapiens
tatataaaagatgttgctgaggttataatcagtctgactttaggcagcagcaaaattttttcttttgtata

SEQ ID NO: 36222 - DNA, 116 bp, Homo sapiens
ccttcaacagaggtatttacgcgttgactattgcataatgaaaacggattataaatatctttatatgaagatgtctatgatatgaaactggttaatttttgcacatatttccaagg

SEQ ID NO: 36223 - DNA, 58 bp, Homo sapiens
tgagacagagtctcgctctgtcacccaggctggagtgcagtggcacaatctctgctca

SEQ ID NO: 36224 - DNA, 77 bp, Homo sapiens
tcagtgtgtgtgtatatatatatatgtgtatgtatatgtgtttatatacatatacatacatatacaatacctggcac

SEQ ID NO: 36225 - DNA, 59 bp, Homo sapiens
gtattgtatatgtatgtatatgtatataaacacatatacatacacatatatatatatac

SEQ ID NO: 36226 - DNA, 95 bp, Homo sapiens
ctggtacataagaggtgctcactgtcagctaatttcatattatgttttaagtatggaatgtatagaagacataatttggtcactcacaatatcag

SEQ ID NO: 36227 - DNA, 106 bp, Homo sapiens
tctgtgaggaaaggcccggcttccacctgaggctcccgcatgacactggctggctctgtcattctggcgacagcctcatcttgccctggtctctttatttctaaga

SEQ ID NO: 36228 - DNA, 91 bp, Homo sapiens
atgtcaagaagaggttggtgctggggctacagttagaaagtttgggacagataaaatctttttgatagtttaagcaactaaatcttgtcat

SEQ ID NO: 36229 - DNA, 113 bp, Homo sapiens
ttctgcagtttaaatattagattggtgcaaaagtaatcacggtttttatcattttttttaaaaaaatggaaaaaaccactattacttttgcaccaacttaatagatatcagaa

SEQ ID NO: 36230 - DNA, 99 bp, Homo sapiens
ctagttccagagatactgtgtctatctttcaaggctgtatactatacaaatatctttgaaaacatagcccagaacaaagacagtcagtgcttctgctag

SEQ ID NO: 36231 - DNA, 148 bp, Homo sapiens
tatttatatacctgtttgtatgtatgtatgtaagtatgtagtgacaacatgaatgtatactgcatgtatatgaatatatatacacacatatcatctatatctatatatatttcgtaacatacacatattccttttctgtttcagtgca

SEQ ID NO: 36232 - DNA, 90 bp, Homo sapiens
ctatttgcttcctatattcatttttttttttttttttacctttctggaatagaggagagatgagagagcaatcatgggaaaagtacttag

SEQ ID NO: 36233 - DNA, 106 bp, Homo sapiens
gatatatatatcctttagagagagagatatatatatcctttatatatatatctctttagatatatatatcctttatatatatatatatcgctttagatatatatat

SEQ ID NO: 36234 - DNA, 147 bp, Homo sapiens
tatatatgaatacatatatacatatatatgaatatatatatacatatatatgaatatatatacacatatatgaatatatatatgagagaatatatatttctatacatgtttatatatgtttttatgtgtacatacatatgtatatgt

SEQ ID NO: 36235 - DNA, 135 bp, Homo sapiens
aaacatacatatagatatactcagacatatatgtttatacatatataaacatgtatagaatatacatgtatatataagcatgtttacacatatataaaacatatttatatgtatgtttgtatataaacatataca

SEQ ID NO: 36236 - DNA, 114 bp, Homo sapiens
acatacatataaatatgttttatatatgtgtaaacatgcttatatatacatgtatattctatacatgtttatatatgtataaacatatatgtctgagtatatctatatgtatgt

SEQ ID NO: 36237 - DNA, 60 bp, Homo sapiens
gtgagaaagagtctcgctctgtcacccaggctggagtgcagtggtgtgatcttggctcac

SEQ ID NO: 36238 - DNA, 79 bp, Homo sapiens
tgtttctaacacagcctgctaaccaggacccctcagtcctccagtggaagggtagtctgctgcatgtttcttaggacca

SEQ ID NO: 36239 - DNA, 72 bp, Homo sapiens
atatacacacacacacacacacgcgtgcgtatatatacatatatacgtatgcatgtgtgtgtgtgtgtatat

SEQ ID NO: 36240 - DNA, 96 bp, Homo sapiens
taatggcggaatgagatccgtatgttgtctccctggtgtgctaaccctgtgttaactcaagggtgtattagactgaaaacagatggactgctgttg

SEQ ID NO: 36241 - DNA, 105 bp, Homo sapiens
atatatatataatatatatgtgtatatacataatgtatatatatgtgtatatatacataatgtgtatatatatgtgtgtgtgtgtgtatatatatatatgaatta

SEQ ID NO: 36242 - DNA, 91 bp, Homo sapiens
tggccttttcactgaactgggcagtggaagatttgagtttttgaatatttccctggactcggccatcttctaccttccagtggttcagcca

SEQ ID NO: 36243 - DNA, 105 bp, Homo sapiens
tactagggaacctattttttgttttgaaaacgaatcaataggaagaataaaacatttaccttgttggttctatacaatttcaaattcaaggttaccaaataagtg

SEQ ID NO: 36244 - DNA, 72 bp, Homo sapiens
gctcggattgtagagtgattttttttttatcaggttatctccattgtctaagagatcatgacaatgccaggc

SEQ ID NO: 36245 - DNA, 92 bp, Homo sapiens
tcccaggtgatggagattgagaagtgaggtattgtgggtagtttatttttttctttgcttagctttattgagttttcagaatagatttgggg

SEQ ID NO: 36246 - DNA, 73 bp, Homo sapiens
tttgtatttgtatatttacatacacttgtagggagaggtgtggggtgtgggtgtgtgtctgtgcatgtgtgaa

SEQ ID NO: 36247 - DNA, 93 bp, Homo sapiens
aatgcatatatatgtgtatatatatatagaatgcatatatatgtgtatatatatgtgtatatatatatgtatgtattaaagccatgtacatat

SEQ ID NO: 36248 - DNA, 105 bp, Homo sapiens
gagggctctgtttgcagtgaggtttcacaaaacaagttacctgtatttttctttttacatctggcttgcaaagccactcttgcagacatttcaaaaaattctctc

SEQ ID NO: 36249 - DNA, 94 bp, Homo sapiens
gcttcatttcctaggtgtgagttgagagagaccagatgcagtatttatctgggatttggattttgctgaagagttgcacctgaagaatcacagt

SEQ ID NO: 36250 - DNA, 103 bp, Homo sapiens
tgatagcataaaggcggaagcctctagaaatgatcctgttgtgtgctctttgctaagaatattggattacagttttaaggggagtgtgcctaaagatgagtca

SEQ ID NO: 36251 - DNA, 82 bp, Homo sapiens
aaacagtaagagtacaagcagtgatcaaattatgttttctgattttgttattcatgctttaaaagttgtactgttattgttt

SEQ ID NO: 36252 - DNA, 115 bp, Homo sapiens
acacgcatatgcatatgtgtgtgtgtgtatatatatgtgtatatatatatacacgcatatgtatatgtgtgtgtgtgtatacatgtatttatatatacacgcgtacatatatata

SEQ ID NO: 36253 - DNA, 133 bp, Homo sapiens
tatatatatatatatatataatatatatacagacacacatacatgcatgtgtgtgtataaatatgtgtgtgtatatgtgtataaatatacatatatatgtgtgtatatgtgtgtgcatttatgtgtgtgtgtg

SEQ ID NO: 36254 - DNA, 114 bp, Homo sapiens
tagggagtaggcactctgttctttgttagggtctatagcttctttatctttgtatctttttttgtggtgcacttcttgtatttatcctgccaatgacactggttctaattcttg

SEQ ID NO: 36255 - DNA, 87 bp, Homo sapiens
atatatatgtatatgtatatgtatacgtatatgtatatgtgtatatatatgtgtatatatgtgtatatatatgtgtgtatatacata

SEQ ID NO: 36256 - DNA, 109 bp, Homo sapiens
ctgcgttcttggtgtgggggtagaacccaaagttctatattttgttttctatatgattctgaagtgtatccaggtttgggatctagagtctagactatgtgaacagtgg

SEQ ID NO: 36257 - DNA, 86 bp, Homo sapiens
taggttaaaagagagagagattggactgaataggggctctctcagctctcacctagaagtcaatttttttgttttaatggatccta

SEQ ID NO: 36258 - DNA, 73 bp, Homo sapiens
cgtgtggccacgtgtgatggtgtgaggcgtctgtggcaacgtgggctgttgtctgtcacagtgtgtgtgaccg

SEQ ID NO: 36259 - DNA, 92 bp, Homo sapiens
gatagagtcatttgaaaaataacatttttatttaaaaatttaaatgcaactaggcatttgtgagatgttcttgttttaaatgacttactgtc

SEQ ID NO: 36260 - DNA, 95 bp, Homo sapiens; identical to SEQ ID NO: 68

SEQ ID NO: 36261 - DNA, 93 bp, Homo sapiens; identical to SEQ ID NO: 69

SEQ ID NO: 36262 - DNA, 58 bp, Homo sapiens; identical to SEQ ID NO: 1673

SEQ ID NO: 36263 - DNA, 96 bp, Homo sapiens
tgtgggctcttttttggttccatatgaaatttattttttttccagttctgggaagaaaatcaatggtagcttgatggggatagcactgaatctata

SEQ ID NO: 36264 - DNA, 60 bp, Homo sapiens
gtgtgtgtgtttgtgtgtgtgtgtatatatatgtatacacacacatatatgtatacacac

SEQ ID NO: 36265 - DNA, 95 bp, Homo sapiens; identical to SEQ ID NO: 68

SEQ ID NO: 36266 - DNA, 93 bp, Homo sapiens; identical to SEQ ID NO: 69

SEQ ID NO: 36267 - DNA, 112 bp, Homo sapiens
ggattgtcttggctatgggagctcttttatggttgcatatgaaatttaaagtatttttttccaattctgtgaagaaagtcagtggtaacttgatggggatagcatggaatcc

SEQ ID NO: 36268 - DNA, 74 bp, Homo sapiens
gaaagccagtagcgataggccccacccagcttttacccagttggtgaggcctgtctcactcccactgtgccatc

SEQ ID NO: 36269 - DNA, 104 bp, Homo sapiens
ggtattcttggatttgggtagctcataaaatttggctgcattggaacatatttatatttatttgtggccaaaattatttaaaagagctctattttagaattact

SEQ ID NO: 36270 - DNA, 77 bp, Homo sapiens
tcctgccttagacacctgagtagctgggactacagccactatgcccagctaactttttattttttgtagagacggga

SEQ ID NO: 36271 - DNA, 92 bp, Homo sapiens
atgctcaggtaaacaatttgcctgtatgtatatataatatatataaaatacatatatacatgttatatataagtccatttgtttacaagtat

SEQ ID NO: 36272 - DNA, 112 bp, Homo sapiens
agtgtggtggcacatgcctgtagttgcagctcctctgggagggctgaggtaggaggatcacttgagcccaggaggttgaggctgcagtgagccatgattgtgccactgaact

SEQ ID NO: 36273 - DNA, 102 bp, Homo sapiens
gggcatggtggtgtgcacctgtagtccaagctttcaggaggctgagctaggaggatggtttcagccgtgggaggcagagattgcagtgagccaagaatgcgc

SEQ ID NO: 36274 - DNA, 96 bp, Homo sapiens
ctcattatagtgcctgacacatcatgctatttaagtattagcttttgttattgttactcttttttttttttgatactgtctggctctgccactgag

SEQ ID NO: 36275 - DNA, 71 bp, Homo sapiens
ttgtttgtttgagacagtctcactccgtcacccaggctggagtgcagtggcgcgatctctgctcattacaa

SEQ ID NO: 36276 - DNA, 88 bp, Homo sapiens
atccaggtcagaagcactctgtctttctgtgttaagtgatgtgaaaagactaacatcccctttatgcttaggctagtttgacttggat

SEQ ID NO: 36277 - DNA, 66 bp, Homo sapiens
gtccccaacattttctgcatgaggaactgttttcctggaagacaatttttccccagactgggtggc

SEQ ID NO: 36278 - DNA, 100 bp, Homo sapiens
agagctaaactccatctcaaaacaaacaaaaaattgcttgtcatccagcatctgctctgtttttgttttgttttttttttttgagacagggtcttgctct

SEQ ID NO: 36279 - DNA, 114 bp, Homo sapiens
ggtgagccactaacttctcaacaggtgtctgtttttgctttttcatcttttttttgtttttttgagacagcatttttctctgtcaccctggctggagttctgtggcatgatcat

SEQ ID NO: 36280 - DNA, 76 bp, Homo sapiens
agagtgtttaactgttttttgacttgaggcaaatgattattttatttgtaattttaaaaaatggtaaaactgctct

SEQ ID NO: 36281 - DNA, 56 bp, Homo sapiens; identical to SEQ ID NO: 14407

SEQ ID NO: 36282 - DNA, 76 bp, Homo sapiens
gggctttatttatttatttagagacacagttttgctctttcgcccaacctggagtgaagcgacgtgatctctgctc

SEQ ID NO: 36283 - DNA, 92 bp, Homo sapiens
tatatatatatatatatatatacacacacacacacacacacgtgtatacatgtgtgcgtgtatgtgtgtgtgtgtgtatatatatatatata

SEQ ID NO: 36284 - DNA, 94 bp, Homo sapiens
tcaacactgtagaaggttcgagtgggaaggatctgaggtttgttgtgaggagcctcagtggctgcctaaaagagagctaggaatacagtggggg

SEQ ID NO: 36285 - DNA, 81 bp, Homo sapiens
aggctgaggtaggaggatgggttgcccccaggagttcaagtctgtagtgcatacctgtgaatagccatcgtactccagcct

SEQ ID NO: 36286 - DNA, 100 bp, Homo sapiens
tgtgtgtatatatatatgcatatgtgtatgtgtatatatgtgtatatatatgtgtatgtgtatatatgtgtatatatatgtgtgtgtatatatatataca

SEQ ID NO: 36287 - DNA, 58 bp, Homo sapiens
tgagacagagtctcgctctgtcacccaggctggagtgcagtggtgggatcttggctca

SEQ ID NO: 36288 - DNA, 86 bp, Homo sapiens
gtttttttgagacagagtctcactctgtcgcccaggctggagtgcagtggtgcgatcttggctcactgaaacctctgcctcctggg

SEQ ID NO: 36289 - DNA, 58 bp, Homo sapiens; identical to SEQ ID NO: 2263

SEQ ID NO: 36290 - DNA, 63 bp, Homo sapiens
gtcttgtgttcttgctcactgtctgagtcacagagggtgtaagcttccctgagagcagaagtc

SEQ ID NO: 36291 - DNA, 87 bp, Homo sapiens
tggggagggcaggatgacagcagcaggatgccagggagcagtgacacccacactgtttcagcagggtctggaatttcatccttaacg

SEQ ID NO: 36292 - DNA, 109 bp, Homo sapiens
gggaacctgaactagaagctgcttcatgttggctttggaaggctctgggttcttggtgtcagtgtctctctcagggtcattatgagcaacaaacacttcagtcaaaacc

SEQ ID NO: 36293 - DNA, 96 bp, Homo sapiens
cctagcaagggcatcctcatgggttacacgtgtgtagagagtgagctctatgatggcaccacatggtgaatgctgaataatgataatcttgcaagg

SEQ ID NO: 36294 - DNA, 95 bp, Homo sapiens; identical to SEQ ID NO: 68

SEQ ID NO: 36295 - DNA, 93 bp, Homo sapiens; identical to SEQ ID NO: 69

SEQ ID NO: 36296 - DNA, 95 bp, Homo sapiens; identical to SEQ ID NO: 68

SEQ ID NO: 36297 - DNA, 93 bp, Homo sapiens; identical to SEQ ID NO: 69

SEQ ID NO: 36298 - DNA, 98 bp, Homo sapiens
tgattgggggcaggatgtatgagacaattgagtgagcagagctgatgggaatcaaagcccacctctgggcatgtgatctcaacatcttctattgggca

SEQ ID NO: 36299 - DNA, 110 bp, Homo sapiens
gataatgagacagaatggcattgtctctgagtatagtcatccattgcttttgtagctctatgtgcagaaattgagcaatagacatgtaccctgtaagagacctcatcttc

SEQ ID NO: 36300 - DNA, 81 bp, Homo sapiens
agtgatcctcccacctcagcctctcagacactgttattgttcttatatgacagatgagaaaaccgaggcataaggttagct

SEQ ID NO: 36301 - DNA, 82 bp, Homo sapiens
tatatgtgtatatatgtatatatacgtgtatatgtgtgtatatagacacatatacatgtatatatacatgtgtatatgtata

SEQ ID NO: 36302 - DNA, 165 bp, Homo sapiens
tatgtatatatacgtgtatatgtgtatatatgtatatatgtatatatacgtgtatatgtgtatatatgtatatatatgtgtatgtgtatatatgtatatgtgtatatatgtatgtgtatatgtgtgtatatatacacgcatacatgtatatatatattatatatg

SEQ ID NO: 36303 - DNA, 98 bp, Homo sapiens
tgtgtatatacgtatatatacgtgtatgtgtatatgtgtatatatatgtttatatgtgtatatatgtatatatacatgtatgtgtatatatgtatata

SEQ ID NO: 36304 - DNA, 114 bp, Homo sapiens
ggtaggctagtctaagctgtgatgttaggtagattaggtgcatttaaatgcattttcaatgatattttaaatttgcagtgggtttatcaggatgttactccaagatgctcctcc

SEQ ID NO: 36305 - DNA, 75 bp, Homo sapiens
atcaagactctgtcaggagccaaggtggctagctctaggctccattctctttggctctgtgtctctgtctccgat

SEQ ID NO: 36306 - DNA, 95 bp, Homo sapiens; identical to SEQ ID NO: 580

SEQ ID NO: 36307 - DNA, 93 bp, Homo sapiens; identical to SEQ ID NO: 69

SEQ ID NO: 36308 - DNA, 63 bp, Homo sapiens
tggatatttttcttcttgtctgtgttacaaagtagttttgtgaacacagtgaggtaatgtcca

SEQ ID NO: 36309 - DNA, 77 bp, Homo sapiens
accatcatgggctatacagtgtgtgtaatggctgcagtcacatctcaaggccattctctcagtgtctcagtcttggt

SEQ ID NO: 36310 - DNA, 64 bp, Homo sapiens
gggcaacaaagtgagaccccgtttcttttttttttttttgagacagagtctcgctctgtcaccc

SEQ ID NO: 36311 - DNA, 87 bp, Homo sapiens
tgagatagggtctcactctgtcgctcaggctggagtgcagtggtatgatcttggctcacaacctctgctttcagggctcaagggagc

SEQ ID NO: 36312 - DNA, 58 bp, Homo sapiens; identical to SEQ ID NO: 1673

SEQ ID NO: 36313 - DNA, 58 bp, Homo sapiens; identical to SEQ ID NO: 16809

SEQ ID NO: 36314 - DNA, 95 bp, Homo sapiens; identical to SEQ ID NO: 68

SEQ ID NO: 36315 - DNA, 93 bp, Homo sapiens; identical to SEQ ID NO: 69

SEQ ID NO: 36316 - DNA, 95 bp, Homo sapiens
tttggtgttttttttcctctcagtgtgcctgtgtctggggcttttatggcctcagaatagggaagtgcttgctgattggtttgtgagtatgcaaa

SEQ ID NO: 36317 - DNA, 110 bp, Homo sapiens
tgtgggttgtctcctttttttttgagacaggatctcgctctgtcactcaggctggagtgcagtggcgcaaccttggctcactgcaaccttcacctcccagggtcaagcag

SEQ ID NO: 36318 - DNA, 112 bp, Homo sapiens
tttgctcattaggcagaaatgtgccaacatttgaaaagtatgtacactctaaatatttaattatatatttgcaaatcaccttggtataatttttttttttttttgagacaga

SEQ ID NO: 36319 - DNA, 66 bp, Homo sapiens
ccaaagtgctgggataagaggcgtgggccaccacgctcggcccagtaattatttttttttttttgg

SEQ ID NO: 36320 - DNA, 110 bp, Homo sapiens
tgtattgagcatctatgatggtgctagtcacactattaggctttatgtatgttacattatatataaatccttatggcatatgtaataggtagtattatattgtttctaca

SEQ ID NO: 36321 - DNA, 95 bp, Homo sapiens; identical to SEQ ID NO: 68

SEQ ID NO: 36322 - DNA, 93 bp, Homo sapiens; identical to SEQ ID NO: 69

SEQ ID NO: 36323 - DNA, 95 bp, Homo sapiens; identical to SEQ ID NO: 68

SEQ ID NO: 36324 - DNA, 93 bp, Homo sapiens; identical to SEQ ID NO: 69

SEQ ID NO: 36325 - DNA, 82 bp, Homo sapiens
ctttgggaagcttcctctggaaactgtatgtaggatgatttgaaaattatctgtgtatatagataacagtagaagtcaaaag

SEQ ID NO: 36326 - DNA, 120 bp, Homo sapiens
acatggtcattcctctgtgtgtgtatatgttctaatctcctttttttttttttttaattgcaactttttttttagattcgggggatacatatgcaggtttgttacaggggtatattgtgt

SEQ ID NO: 36327 - DNA, 74 bp, Homo sapiens
gtctcagatcatttggagatgtcatcttcttgtttattataaatctatgtgatgttcccaggaggccttgaggc

SEQ ID NO: 36328 - DNA, 94 bp, Homo sapiens
ggtttacgatcaaaggctgtcctgagcctccagcgagctctaagttcctgggcctgggctcaggtactctgtctctctgtctgcccatcagtac

SEQ ID NO: 36329 - DNA, 111 bp, Homo sapiens
tgagtcaatcctgtggtaagcaagtctattggcaccatttttccaacagcatatgctcacttgtgtctctgtgtcacatttagaagtcttataatatttcaggtttattca

SEQ ID NO: 36330 - DNA, 86 bp, Homo sapiens
cattctctcttggtctctgtcatttgggaagtgtggtttttattttttatttcttatccctaatggtgagtaattcaagaggtgtg

SEQ ID NO: 36331 - DNA, 56 bp, Homo sapiens
gtctgcttctctctgagtctcaggattttttgttctatgtctcatgagagattgac

SEQ ID NO: 36332 - DNA, 58 bp, Homo sapiens; identical to SEQ ID NO: 1240

SEQ ID NO: 36333 - DNA, 58 bp, Homo sapiens
gctctgagagctacacagggtagaccacagccccaggtaccctgtatggctcacaagc

SEQ ID NO: 36334 - DNA, 72 bp, Homo sapiens
gcccacagaaactgtaaagtaaaaatgtatgttgcttttagacactacgtttttgggcagtttttatgtagc

SEQ ID NO: 36335 - DNA, 58 bp, Homo sapiens; identical to SEQ ID NO: 5055

SEQ ID NO: 36336 - DNA, 90 bp, Homo sapiens
ctgggatgagaagaattttgtagccagaaaaatgtttcgaactcatagtttaaatatatttctaatgaaaaaggtcattctgatgcccag

SEQ ID NO: 36337 - DNA, 116 bp, Homo sapiens
ggctcttcaacttatgcttagagatgatgatggacatgacgtgctctcttctcatagtgactgtaacattttaccccagttcatgtcctgtgtagtcttctctctgatcacatgcc

SEQ ID NO: 36338 - DNA, 119 bp, Homo sapiens
ggttggtaggtttctttattactcattcaattttggaagtcattattggtctattcagggttttaattcctttctgattcaatcttggcagattgtgtgtttccaggaatttattcatt

SEQ ID NO: 36339 - DNA, 75 bp, Homo sapiens
tatttaagtggaaggcaagatgggggatgggttagcttagctctctttcactctcatagttttctcactggtata

SEQ ID NO: 36340 - DNA, 80 bp, Homo sapiens
gagaaaaaagactaaaggggaagaatagcaagtaaaacagaactccacttgctagatctctccctctgtcgcgctctttc

SEQ ID NO: 36341 - DNA, 74 bp, Homo sapiens
agacatatgtatctatatatgtaagatatatagtttcttatctatatatcttacatatatagacacacatgtct

SEQ ID NO: 36342 - DNA, 107 bp, Homo sapiens
ttatataaccaaaccagtggtttggttattttatatatactccttaatttatataattaaatataatatacttctgatttggttgtataaccaaaccagcggtctgg

SEQ ID NO: 36343 - DNA, 115 bp, Homo sapiens
gtcagaagctcaaccaatgggacacccaggtctcaggattttatatatgtgtgtaaatatgtatatatatagtcttggtgattctagtgtgtagccaactttgagaaccactgtc

SEQ ID NO: 36344 - DNA, 82 bp, Homo sapiens
tgtgaaatcaggttccagggtgcaaggcctatgctattccagatcaggagaagccagtagtgaactgaatttgatgtttgca

SEQ ID NO: 36345 - DNA, 94 bp, Homo sapiens
gtcctaggatggcaggcattatctcctctggtttaatgtcttgtggctccagggatgcttccacgtcatatgcatgctttaaataggagaggct

SEQ ID NO: 36346 - DNA, 58 bp, Homo sapiens
tgctttcctgtctcgctgtcactctggaaggcgggggtgaggggtaggaggagagaca

SEQ ID NO: 36347 - DNA, 82 bp, Homo sapiens
tgtgtatgtataaatttgtgtgtgtgtgtatatacatatgtgtgtgtgtatatatatatatacacatatgatatttactaca

SEQ ID NO: 36348 - DNA, 99 bp, Homo sapiens
ggtattccaggaataagagagattgtgtgaaatttagagatgtaaaaaagcctagtgtatttgatctacatatcctttgttatggctggagcatgtgct

SEQ ID NO: 36349 - DNA, 117 bp, Homo sapiens
tagctgggcatggtggcacatgcctgtagtctcagctacttggaacttgggaggctgaggtaggaggatcacttgagccctggaagcagagattgcaatgagccaatatgctgctgc

SEQ ID NO: 36350 - DNA, 67 bp, Homo sapiens
atgatgtccaatagaacaaaagataggaagggaggattcactctctctgtttgatttgggacaccat

SEQ ID NO: 36351 - DNA, 97 bp, Homo sapiens
aatgttgtcaaagggactaggattagttgggattgtatttagtttaatttttaattagtgttaccccaaataaattctgtactaatgaggcaatatt

SEQ ID NO: 36352 - DNA, 71 bp, Homo sapiens
taatggaatatatatatgtgtgtgtatatatatatgtatacacattctatttatatatatatattctatta

SEQ ID NO: 36353 - DNA, 85 bp, Homo sapiens; identical to SEQ ID NO: 35537

SEQ ID NO: 36354 - DNA, 185 bp, Homo sapiens
atatacatatacatatatatgtatatacacatatatgtatatatacacacatatatgtgtatatatgtatgtgtatatatgtgtgtgtatatgtatgtatatatgtatatatgtgtgtatatatatgtatgtatgtatgtgtatatatatatatacacacatatatatatatacacatacataca

SEQ ID NO: 36355 - DNA, 114 bp, Homo sapiens
tacattgctgcagcatactgtttacatgtttcagtcccacttactactacttttttttttttaatttaagttttagggtacatgtgcacaatgtgcaggttagttacatatgta

SEQ ID NO: 36356 - DNA, 119 bp, Homo sapiens
gtatatatacatatacacgtgtatatgtatatatgtgtgtatatatatatattttatatacatataatatatatattttatatacatatatatattttatatacatataatatatatat

SEQ ID NO: 36357 - DNA, 112 bp, Homo sapiens
ttcttgatttgattctcagcttggttgctgttggtgtatagcagagctactgatttgtgtacattaattttgtataacgaaactttgctgaattcatttatcaattctagga

SEQ ID NO: 36358 - DNA, 117 bp, Homo sapiens
ggtgtgaccttagattgtctatttgtgctttttcagactttttgatgttaaaggttgtaaaccttcctcttagcatcacctttgctgaattccagaggttttgataggtcgtgtcac

SEQ ID NO: 36359 - DNA, 95 bp, Homo sapiens; identical to SEQ ID NO: 68

SEQ ID NO: 36360 - DNA, 93 bp, Homo sapiens; identical to SEQ ID NO: 69

SEQ ID NO: 36361 - DNA, 78 bp, Homo sapiens
tgtatatatacacatatatacacacatatatgtatatatacacatatatatgtatgtgtatatatgtgtatatatgca

SEQ ID NO: 36362 - DNA, 104 bp, Homo sapiens
atatatacacatatatacacatacatatatatgtgtatatatacatatatgtgtgtatatatgtgtatatatacatatatatgtgtgtatatatgtgtatatat

SEQ ID NO: 36363 - DNA, 100 bp, Homo sapiens
gctagtattttactgaagaattttgcatcaatatttatcagacatactggtctgtagttttcttttttatattttgatgtatctttaacaaaaaactggc

SEQ ID NO: 36364 - DNA, 78 bp, Homo sapiens
ccaaaatgcattctcagtagaagcctcattctgtcattctctgaattacaatggtgctgactgaccctgcagaagagg

SEQ ID NO: 36365 - DNA, 95 bp, Homo sapiens; identical to SEQ ID NO: 68

SEQ ID NO: 36366 - DNA, 93 bp, Homo sapiens; identical to SEQ ID NO: 69

SEQ ID NO: 36367 - DNA, 85 bp, Homo sapiens
acacgaatgtgtgtatgtatatacatatatgtggaccatgaacgtgtatatatgtatatgtgtgtgtgtgtgtgtgtgtgtgtgt

SEQ ID NO: 36368 - DNA, 121 bp, Homo sapiens
ttcctcttcttcataaatatatgaatatgtatgtgtatctgggtgttggtatatatatatatatatatggatatatttgaggaatatatatatacacacacacagatacacgtatatattc

SEQ ID NO: 36369 - DNA, 110 bp, Homo sapiens
atgtctacatctgcatagttggtttcagggcatatgcaaaatgtttttttttcttcaatagaaaactctccttgtattatttgtttttaagatcatcaacaggtagacat

SEQ ID NO: 36370 - DNA, 80 bp, Homo sapiens
agaatacagctattagagcaataacgaagaatggataaatacagtcagctttttgtttttgttttgtttagttttgtttt

SEQ ID NO: 36371 - DNA, 86 bp, Homo sapiens
tcacaggactgtacgcactgtgatattattcacaataccctagtgggacattaataataatatcacagtgtgtgtactctttgtgg

SEQ ID NO: 36372 - DNA, 68 bp, Homo sapiens
taaagccgggagactctctgtgtgagatttttatttttgttacagaagaaatagtttgctgtgcttta

SEQ ID NO: 36373 - DNA, 68 bp, Homo sapiens; identical to SEQ ID NO: 36372

SEQ ID NO: 36374 - DNA, 86 bp, Homo sapiens; identical to SEQ ID NO: 36371

SEQ ID NO: 36375 - DNA, 80 bp, Homo sapiens; identical to SEQ ID NO: 36370

SEQ ID NO: 36376 - DNA, 108 bp, Homo sapiens
tgcactgtgtatggtttgaggtaggggtcagtattcagttatgtctatttgaatatttaattgatccagcattgtcctgatccccttgtaaatttcactgtagaacag

SEQ ID NO: 36377 - DNA, 123 bp, Homo sapiens
ttcctcttcttcataaatatatgaatatgtatgtgtatctgggtgttggtatatatatatatatatatatggatatatttgaggaatatatatatacacacacacagatacacgtatatattc

SEQ ID NO: 36378 - DNA, 85 bp, Homo sapiens; identical to SEQ ID NO: 36367

SEQ ID NO: 36379 - DNA, 95 bp, Homo sapiens; identical to SEQ ID NO: 68

SEQ ID NO: 36380 - DNA, 93 bp, Homo sapiens; identical to SEQ ID NO: 69

SEQ ID NO: 36381 - DNA, 95 bp, Homo sapiens; identical to SEQ ID NO: 68

SEQ ID NO: 36382 - DNA, 93 bp, Homo sapiens; identical to SEQ ID NO: 69

SEQ ID NO: 36383 - DNA, 89 bp, Homo sapiens
tagggtagagtctctctttcactgtattttgctgagtgggaggtgggatctcctcaggccaataaattgtaaagacagactcttctcta

SEQ ID NO: 36384 - DNA, 70 bp, Homo sapiens
gattattcagtcactctgtcagtctcctcatttgcaaaatggggatgacagaagaaggattgtgatgatt

SEQ ID NO: 36385 - DNA, 73 bp, Homo sapiens
ttgaaagtatatatctatatatagatctatatatacctatctatatctatatatagataagatatattttgga

SEQ ID NO: 36386 - DNA, 72 bp, Homo sapiens
tgtatacgtatataatatatacatatattatgtatacgtatataatatatacatattatgtatacgtatata

SEQ ID NO: 36387 - DNA, 113 bp, Homo sapiens
tgattaacttgttaatcttctttaccatgctgtgaggtgggtttttttattcttatattacagatgaggaaactgactttatgacattggttaagtagcttatccagagttca

SEQ ID NO: 36388 - DNA, 113 bp, Homo sapiens
gtcatgccagcccgtgcagcagtttttagaaagctcactttgtttgtttattcatttagctaaacttagtagagcttttctatctatggcaagctcagtcttaatccagtgac

SEQ ID NO: 36389 - DNA, 74 bp, Homo sapiens
atgaatggtttagcactatccacttggtactgtcccttcacagtagtgagtgagttctcattagatctggtcat

SEQ ID NO: 36390 - DNA, 84 bp, Homo sapiens
ggttggggaagttcacctggatgatatcttgaagtgttttccaacttggttccattctctctgtctctttcaggtaccccaatc

SEQ ID NO: 36391 - DNA, 95 bp, Homo sapiens; identical to SEQ ID NO: 68

SEQ ID NO: 36392 - DNA, 93 bp, Homo sapiens; identical to SEQ ID NO: 69

SEQ ID NO: 36393 - DNA, 78 bp, Homo sapiens
gagacagagtctcactctgtcacccaggctggagtgcagtggtgcgatctcggctcactgaaacctctgcctcccggg

SEQ ID NO: 36394 - DNA, 58 bp, Homo sapiens; identical to SEQ ID NO: 637

SEQ ID NO: 36395 - DNA, 116 bp, Homo sapiens
tatgccagcaccatgcgttgtataaagcctgcagccatgagccaattaaacctcttttttttttaataaatgacccagtctcaggttgttctttatggcaatgcaagaatggtcta

SEQ ID NO: 36396 - DNA, 106 bp, Homo sapiens
tcaaatgctttttctgcagctattgatatgatcatgtttttctttatttagtctactaatatagtggaaacgaatgattagctttcaaatgttgaattagcattga

SEQ ID NO: 36397 - DNA, 86 bp, Homo sapiens
cttgctagtgttcaatgcatttcttatgatttttttctgaatccattatggactaaaggaagtgaaggaatgtcaaagctagcaag

SEQ ID NO: 36398 - DNA, 80 bp, Homo sapiens
gtatgtattgtatagttgtatatacatatctgtgtacatatacacagacatatatgcagcatatatgcaagtgtatatac

SEQ ID NO: 36399 - DNA, 80 bp, Homo sapiens
tacactggataatatatatgtgtgtgtatgcatgtgtgtgtatatatgtatgtatgtatgtatgtattatatatactgta

SEQ ID NO: 36400 - DNA, 82 bp, Homo sapiens
ggagtcattccagctgagggtgcagatgtcatggagtagacatataccatgtcttctgtgatcttcctgaattcctgagtct

SEQ ID NO: 36401 - DNA, 99 bp, Homo sapiens
cacatgtacacaaatagtattgctatcatgaaatgtttatatatttaattataaaaatattgtcagaatgcaaaaattaaccaggtgtggtggcatgtg

SEQ ID NO: 36402 - DNA, 101 bp, Homo sapiens
ctgcctctgggccagtggccagcctgctgtctgagtctgtgcctcggttccccttacccacacagtcttttttattccagtggagcttgtacccagggtgg

SEQ ID NO: 36403 - DNA, 95 bp, Homo sapiens; identical to SEQ ID NO: 68

SEQ ID NO: 36404 - DNA, 93 bp, Homo sapiens; identical to SEQ ID NO: 69

SEQ ID NO: 36405 - DNA, 75 bp, Homo sapiens
tatgtaaaagaaaactcttaagatatagataatatattatatattatctatatcttaagagttttctcatacata

SEQ ID NO: 36406 - DNA, 139 bp, Homo sapiens
atacacacacacatatatatactctgtatacatgtatatgtgtgtatatctatatatatatatatatacacacgtgtgtgtacagatgtgtgtgtatatatattgtttaacagtgaggatatattctgaaaaatgcgta

SEQ ID NO: 36407 - DNA, 188 bp, Homo sapiens
acacacatatatatacacaccacatacacacacgtgtatatatgtatatatatgtgcatatatatgtgcgtgtatatatatgtgtgtgtatgtgtatatatatatgtgtgtatatatatataatatatatgtgtgtgtatatatatatataatatatatatgtgtgtatatatatataatatatatat

SEQ ID NO: 36408 - DNA, 102 bp, Homo sapiens
tgtatgtgtgtatatataaacatatatgtatatatacgcatatatacatctatatacatagatgtatatatgcgtatatatacatatatatacgcatctata

SEQ ID NO: 36409 - DNA, 145 bp, Homo sapiens
tatagatgtatatatgcgtatatacacctatatgtatatataggtctatatatagatgcgtatatatatgtatatatacgcatatatacatctatgtatatagatgtatatatgcgtatatatacatatatgtttatatatacac

SEQ ID NO: 36410 - DNA, 178 bp, Homo sapiens
gtatatgtgggtatatatacatatatacatgtatatatacatatatgtatgtatatgtgtatatatacatatatgtatgtatatgtgtgtatatacatatatgtatgtatatatgtgtgtgtatatgtatatagatgtatacgtgtgtatatgtgtatatatgtgtgtatacatatat

SEQ ID NO: 36411 - DNA, 68 bp, Homo sapiens
tatctatatatctatatctatatctatatatatctccatatatgtatgtatagatagatgtatgtata

SEQ ID NO: 36412 - DNA, 109 bp, Homo sapiens
tatcactatttttgtcttagaaattagttttgcattattctactttgatattagtatatatacatatatatattagtacatcttataagcagaagataaatttttggta

SEQ ID NO: 36413 - DNA, 134 bp, Homo sapiens
tgtaagatatatatatatatatatatatatatatatatatatatatatatgcttatatatatttatatctatatatgcttatatatatgcttatatatatttatatctgtatatgcatatatatgcttatctat

SEQ ID NO: 36414 - DNA, 88 bp, Homo sapiens
agtaggtgctcaataatagcagctaagtccttgattgttaatagatagtaatagttttgagatttagtagtacttatcagcatcctct

SEQ ID NO: 36415 - DNA, 113 bp, Homo sapiens
atatgaataattgtcttctctattaattgggaataaattgaagacaaaattttattttatccttaattgcttcagtatatattttctataaacagagacaatgatgttcgtat

SEQ ID NO: 36416 - DNA, 58 bp, Homo sapiens
tgagactgagtctcgctctgtcacccaggctggagtgcagtggcgagatctcggctca

SEQ ID NO: 36417 - DNA, 56 bp, Homo sapiens; identical to SEQ ID NO: 16925

SEQ ID NO: 36418 - DNA, 75 bp, Homo sapiens
gtctcagtctcagtctctttttacagggaattcaaacttagacagtaactgtagtgatagatatgggagtggggc

SEQ ID NO: 36419 - DNA, 95 bp, Homo sapiens; identical to SEQ ID NO: 68

SEQ ID NO: 36420 - DNA, 93 bp, Homo sapiens; identical to SEQ ID NO: 69

SEQ ID NO: 36421 - DNA, 87 bp, Homo sapiens
attcttatttgaggtgtcccagtaagaaaatattttatttatttatttttttgagatggagtctcactctgtcgcccaggttggagt

SEQ ID NO: 36422 - DNA, 85 bp, Homo sapiens
tacatctctgtgtgtatatatctgtatatatctatttatatataaatatgtatatgcttgtatatactcatgatgtatacacaga

SEQ ID NO: 36423 - DNA, 95 bp, Homo sapiens; identical to SEQ ID NO: 68

SEQ ID NO: 36424 - DNA, 93 bp, Homo sapiens; identical to SEQ ID NO: 69

SEQ ID NO: 36425 - DNA, 96 bp, Homo sapiens
atattatgctgaacagaagtggtgaaagttggtatccttttgttgttccagttatcatatggaatgaattcaacttttccccattcggtataatat

SEQ ID NO: 36426 - DNA, 90 bp, Homo sapiens
gatgagttcagaaaaatatatatatgtgtgtatatatatatatatgtgtgtgtgtgtgtatatatacacatattttttggctggttttca

SEQ ID NO: 36427 - DNA, 112 bp, Homo sapiens
gggtttcagagctggttgctaagtaggtgttggtgaatacagattttgaagtagaagacttccatctgcctttaaaacttttcaaaaaattatgcattccttatccttgccc

SEQ ID NO: 36428 - DNA, 78 bp, Homo sapiens
ctggataagttatctttgtgagtttttattttattccttttgatgagaatagtgaagccacaaagccagcttcattag

SEQ ID NO: 36429 - DNA, 115 bp, Homo sapiens
ccctctgggactaagagcatacttatttactgtttgctacaaaatggtgagtgcctgagttctggtgttccctggctacagtgaaatctggttatgtgcacagcatccatgtggg

SEQ ID NO: 36430 - DNA, 109 bp, Homo sapiens
tatatatgtatatatatgtgtatatatgtatatatatgtgtatatatgtgtatatacatgtgtgtatatatatgtgtatatatatatgtatgtgtgtgtatatgtgtat

SEQ ID NO: 36431 - DNA, 99 bp, Homo sapiens
gttttagttcaagtgctgagtctagttccagcatcgtgtatttcatgacagatgagtgagaactgggaaagttcaattagtaatagccactactgagac

SEQ ID NO: 36432 - DNA, 81 bp, Homo sapiens
gagacaaagtgaatgatcagagaagtgagtgtagagtctaaaaagtatctggattcaaatctttgttccacaacttgtccc

SEQ ID NO: 36433 - DNA, 87 bp, Homo sapiens
tgcaagaacaagtagtgttcagatttatttttctattgttccattaacataggaaaacatctataaataaagctattcattcttgca

SEQ ID NO: 36434 - DNA, 111 bp, Homo sapiens
cttagaacagtgtctgacatgtagcaagagatcaataaatgttaaatattgcaaggcagtaataaatatatttatttcagtctgatgagatggtcagcattttaacttaag

SEQ ID NO: 36435 - DNA, 89 bp, Homo sapiens
agatttttcacactaagctagttgccatgatgtcaatgtatgtttttaaatactttgacctggtcatgcatgtagagtggacctgattt

SEQ ID NO: 36436 - DNA, 104 bp, Homo sapiens
tgactaggtatttttccttggcctactgtatgtgtatgtatatgtatatgtatatgtgtgcatgtgtgtgtgtattagtatctgaacacttgaagtcaaagtca

SEQ ID NO: 36437 - DNA, 95 bp, Homo sapiens
atatgtctactctattttataataggctcaatcacactgtatatgttatatatatctataacatgtacgtattgtaaatgttatggtaatcatat

SEQ ID NO: 36438 - DNA, 63 bp, Homo sapiens
ttgagataggatctcactctgtcactcaggctggagtgcagtggcgccaagtcctgtgctcag

SEQ ID NO: 36439 - DNA, 116 bp, Homo sapiens
caggatcagcttggtcttttttgaaacctagagcatttatcacacatgacattttgttgattttttaagtctatgtgatcaatattttggacctctgaaatctatttttgattgtg

SEQ ID NO: 36440 - DNA, 71 bp, Homo sapiens
tttccccgagatgagagtgtcggtaaaaactgctgcttaaaacagcgtgactccctctctctccctggaga

SEQ ID NO: 36441 - DNA, 96 bp, Homo sapiens
tatatgtgtgtgtgtatatgtacacatatatgtgtgtgtatatatatgtgtatgtatatatatacatatatgtgtatatatatacatacacatata

SEQ ID NO: 36442 - DNA, 79 bp, Homo sapiens
gagcctaaaaggcagtggttgcaatgagctgatatcgtgccactgcactccagcctgggcaacacagtctctctctctc

SEQ ID NO: 36443 - DNA, 85 bp, Homo sapiens
aaacactagtacaagcattctcagaatgtcatttttatatatacttgattagaaatggcaagaggattgcctgtgtttatactgg

SEQ ID NO: 36444 - DNA, 98 bp, Homo sapiens
ctgttttttttttgaggtggagtctcacactgtcacccaggctggagtgcagtggcgcgatccacccaggttggagtgcagtggcgtgatctcggctc

SEQ ID NO: 36445 - DNA, 93 bp, Homo sapiens
tcagccaggcatggtggtggtgcacgcttgtagtcccagtgactccggaggctgaggtggtaggatcacttgaggtgggaggttgagtgcgcc

SEQ ID NO: 36446 - DNA, 88 bp, Homo sapiens
atttttggaaggaaaggaaaagaaagaagggctagctatgtagatgcaacagcagctcagtgtctatctctgattcctttccaaaggt

SEQ ID NO: 36447 - DNA, 83 bp, Homo sapiens
cagggaatgtaagtcaggggtctggtggagagggggttagggaaacactgaagttccttttgaaaactcttttgcttcatctg

SEQ ID NO: 36448 - DNA, 75 bp, Homo sapiens
ggtctcttcttcagccagctgaacgtggttccattcccattggagttgatacacattcagcatgacagagtcacc

SEQ ID NO: 36449 - DNA, 78 bp, Homo sapiens
tgcccaggaggtgagagagcacagagtggtggaaagagtgaaggagcagctttcagtgcctcattacactccttggca

SEQ ID NO: 36450 - DNA, 125 bp, Homo sapiens
ttttcctggttcacatagctcagaacagaaaaaaaggggatcttctatttggtttctggatgatttcacaacatgtctgtagtgcagtggtgatggttcattcaggagagggagttgcctcccct

SEQ ID NO: 36451 - DNA, 65 bp, Homo sapiens
ggctgtgaagaataatgggtggacaggtatcaacactctgtctgagactcagcctcatcttggcc

SEQ ID NO: 36452 - DNA, 71 bp, Homo sapiens
gggtctaaagggtgggtcttgaatttctttttttttttttttttttgagacagagtctcgctctgtcgccc

SEQ ID NO: 36453 - DNA, 118 bp, Homo sapiens
gaaagaactgatctgggtgatgattaaatgcatgtgtgtgtgtgtatatatatatattaagctatatacttatatacttagaatttgtgcactttactgtctttaaattacttttttt

SEQ ID NO: 36454 - DNA, 57 bp, Homo sapiens
ccatcggaagcagcggatggagcctctgtacagtctcaatgtgtctgtctctgatgg

SEQ ID NO: 36455 - DNA, 58 bp, Homo sapiens; identical to SEQ ID NO: 605

SEQ ID NO: 36456 - DNA, 94 bp, Homo sapiens
ccaggtagtccctcctctcaaacacaggggggttgtcattaatgtccagaacggtgatggtgacagtagtgagagaggacagggactgtccagg

SEQ ID NO: 36457 - DNA, 106 bp, Homo sapiens
gcagttattccaattagccttactcgcctcagtttttttttttgtttttttttttttttttgagacagagtctcgctgtgtcgcccaggctggagtgcagtggtgc

SEQ ID NO: 36458 - DNA, 93 bp, Homo sapiens
atctatagtgactgtaatgcaggcttcagatggttacgatgaaataaaatcatttggaatgaaaagcacaatgcactgaggagtcaccgagat

SEQ ID NO: 36459 - DNA, 119 bp, Homo sapiens
agtttggcagagtgattgcttcttagagagtcagaaaatatagaaagggatgctcttaagattttttctttttttttttttttttttttctgagagagtctcgctctgtcacccaggct

SEQ ID NO: 36460 - DNA, 88 bp, Homo sapiens
ccattgtttgagactatattgtagtagacatggactatgaatagtctaatgtttatttaaataaattttcaggatattcttgaaatgg

SEQ ID NO: 36461 - DNA, 95 bp, Homo sapiens; identical to SEQ ID NO: 68

SEQ ID NO: 36462 - DNA, 93 bp, Homo sapiens; identical to SEQ ID NO: 69

SEQ ID NO: 36463 - DNA, 113 bp, Homo sapiens
tggcttcacagtattccgttatgtatatgtaccacgttttctttttttttttttttttttttttttttattatactctaagttttagggtacatgtgcacattgtgcaggtta

SEQ ID NO: 36464 - DNA, 82 bp, Homo sapiens
cactgagattgctagaacagagatgagactgggctcaggacaactgattcttatgcctctgagactctcttcttcagtgatc

SEQ ID NO: 36465 - DNA, 84 bp, Homo sapiens
tatatatacgtatatatataattatatatacgtatatatataattatatatacgtgtatatacacgtatatatatgtatatata

SEQ ID NO: 36466 - DNA, 89 bp, Homo sapiens
gggtattgacttaggtagagttctgaatttggagtgggaagacagctttaatttcttgttttttgcttgacttcctgactgtgttatcc

SEQ ID NO: 36467 - DNA, 69 bp, Homo sapiens
ttgtttttgagactgagtctcactctgtgccaggcaggagtgcagtaccacgatctcagctcattgcaa

SEQ ID NO: 36468 - DNA, 77 bp, Homo sapiens
cagagcgagactcagtctcaaaaaaaaatttatttttattattattataatttttttgagatgggagtctcactctg

SEQ ID NO: 36469 - DNA, 91 bp, Homo sapiens
cagcctgggtcacatagcgagaccccatctgtataaaaaactttatttatttatttttttgagacagagtctcactctgtcgcccaggctg

SEQ ID NO: 36470 - DNA, 95 bp, Homo sapiens; identical to SEQ ID NO: 68

SEQ ID NO: 36471 - DNA, 93 bp, Homo sapiens; identical to SEQ ID NO: 69

SEQ ID NO: 36472 - DNA, 88 bp, Homo sapiens
gctgggaccacaggtgtttgtgaccatgtctgcttaattaattaattaattttttttttttgagatggagtctcactctgtcaccagc

SEQ ID NO: 36473 - DNA, 115 bp, Homo sapiens
gaggggtcaggggcaagattggagtaagtctgagggagggtggcagcaggcagacagaaggcagtgagagcaactcttctccagactgcagtaaacaagagcacagggaagactc

SEQ ID NO: 36474 - DNA, 129 bp, Homo sapiens
atatatgtatatacatacatacatcaaatatatatgtatatacatgtgtgtatatatatgtgtatatatacacacacgtatatatgtgtatatatacctatatgtatatatgtgtgtatacatgtatat

SEQ ID NO: 36475 - DNA, 164 bp, Homo sapiens
tatatatacacacacatcaaatatatatgtatatacatatatatttgatgtgtgtatatatatacacctataggtatataggtatataggtgtgtatatatacacacatgtatacatgtgtatatatgtatatatacctatatgtttatatatgtgtgtatata

SEQ ID NO: 36476 - DNA, 80 bp, Homo sapiens
tataggtgtatatatatacacacatcaaatatatatgtatatacatatatatttgatgtgtgtgtatatatatgtgtgtg

SEQ ID NO: 36477 - DNA, 102 bp, Homo sapiens
gcctgggtaacaagggaaactctatttcaaaaaaaaaaaaagttagggtttcttcttgttttgttttttttttgagacggagtctcactctgtcacccaggc

SEQ ID NO: 36478 - DNA, 76 bp, Homo sapiens
tgaatgattttgcgggtgtgcctctttttttaacttttattttagattaaggagttacatgtgcaggtttgttaca

SEQ ID NO: 36479 - DNA, 88 bp, Homo sapiens
agcatgcctaatatgtgtatatatttatgtgtggtgcacacaatgttccaccactgaaaatatataaaagagctctaattagttggct

SEQ ID NO: 36480 - DNA, 81 bp, Homo sapiens
cagggcacagtggcaggagggctcaccaacaggctggcagttctgatttctcatgttatgctgtccctgtgtctgtgtgtc

SEQ ID NO: 36481 - DNA, 116 bp, Homo sapiens
tagaattgtccttgctatatgggctcttttttggctccatatgaactttaaagtagtttttttctaattctgtgaaaaaagtcaatggtagcttgatggggatagcattgaatcta

SEQ ID NO: 36482 - DNA, 101 bp, Homo sapiens
tcataatacatttgctgtgtaaatgaatgttttaatgaatgaatgaaagaaactgattttattatattttaaggcagttatcagcaggcaaatgaattaga

SEQ ID NO: 36483 - DNA, 86 bp, Homo sapiens
gaggaagtcaaattgtatatatatattgtgtgtgtatatgtatatatactatatatacaatctaaatatacaatcatgtcttcttc

SEQ ID NO: 36484 - DNA, 95 bp, Homo sapiens; identical to SEQ ID NO: 68

SEQ ID NO: 36485 - DNA, 93 bp, Homo sapiens; identical to SEQ ID NO: 69

SEQ ID NO: 36486 - DNA, 62 bp, Homo sapiens
ccaacgagacactctgtggctgtccctgaactaatcatggtggcccagggtaggctggctgg

SEQ ID NO: 36487 - DNA, 62 bp, Homo sapiens
ggagtgaggagtgtgcccagagtgggagagcacacctgtcccactctcattctctgtgcttc

SEQ ID NO: 36488 - DNA, 111 bp, Homo sapiens
agtttgattgtcctttagtattccttgtaaggcagttctgctagtaacaaactcactcagtctttatttatctagaacatcttgcctttagttttgagggatcgttttgct

SEQ ID NO: 36489 - DNA, 102 bp, Homo sapiens
acaaagtgagactctgtctcaaaaaaacccccaaaaaacaaagatgcaaagcaaaaagtgtttatatatttatttattgggggagacagagtctcactctgt

SEQ ID NO: 36490 - DNA, 118 bp, Homo sapiens
tggtaggccctcaatcaacgttagctgaaatcaactgtgactaaatgttttcagctcaagaatttctatttgattattttggtgcagttttcagtcagttctacgtaaaaaatctcca

SEQ ID NO: 36491 - DNA, 86 bp, Homo sapiens
gagctgggcctgactcagtggctcacacctttaatcccagcactttgggaggccaaggcaggtggatcacctgaggtcaggagttc

SEQ ID NO: 36492 - DNA, 87 bp, Homo sapiens
atggaattccaagacaatctaatgttggtttaatgcaaacctggagacaagagtgagtgaactaaactaattgtgttgtaatcccat

SEQ ID NO: 36493 - DNA, 95 bp, Homo sapiens; identical to SEQ ID NO: 68

SEQ ID NO: 36494 - DNA, 93 bp, Homo sapiens; identical to SEQ ID NO: 69

SEQ ID NO: 36495 - DNA, 118 bp, Homo sapiens
gagcagtggtttgtagttcttgaagtggtccttcacatcccttgtaagttgtattcctaggtattttattatttttgtagcaattgtgaataggagttcactcatgatttggctgttt

SEQ ID NO: 36496 - DNA, 124 bp, Homo sapiens
gagatgcctgctgactcatgtgttccccactgggcggctgtaagctcctagaccagtagagactgtgtctgtcagtcttacacctataaccacagttctgggtacatgataggcactcagtagg

SEQ ID NO: 36497 - DNA, 95 bp, Homo sapiens; identical to SEQ ID NO: 68

SEQ ID NO: 36498 - DNA, 93 bp, Homo sapiens; identical to SEQ ID NO: 69

SEQ ID NO: 36499 - DNA, 99 bp, Homo sapiens
ggcatataattaggggcagcatccagaagttatatttatattttgactcatataaaaaatctattgtagcatcttctgaggcctgtattgatgtttgcc

SEQ ID NO: 36500 - DNA, 57 bp, Homo sapiens
ttgagatggagtctctcgctctgtcgccgaggctggagtgcagtggcacgatctcag

SEQ ID NO: 36501 - DNA, 58 bp, Homo sapiens; identical to SEQ ID NO: 1847

SEQ ID NO: 36502 - DNA, 119 bp, Homo sapiens
ctcagcctcccaagtagctgggactacaggtgcacgccgccctgcctggataattttttgtattttcagtaggggacagggtttcaccttgttgcccagactggtttcgatctcctgag

SEQ ID NO: 36503 - DNA, 88 bp, Homo sapiens
attgtatttactgtgagactattgtcattgaatagttcacgccaatagaaattggtcactcagtgactttctcacacattatgtcagt

SEQ ID NO: 36504 - DNA, 72 bp, Homo sapiens
ctctctctttctttctctctgtagagagatatctatctatatctatctatatatatagagagagagcgagag

SEQ ID NO: 36505 - DNA, 87 bp, Homo sapiens
gggcaatgaacaatagattgtgggtgtcattgattgtacacaatttttgattttttaaccaacagtccattccatacttatctgtcc

SEQ ID NO: 36506 - DNA, 100 bp, Homo sapiens
ctcttcttttctttgggaaatgtcagattcatcttctttctgggcagaagttgctgaggacagaagttagtctgtaatccttcagggtgttacacaagag

SEQ ID NO: 36507 - DNA, 112 bp, Homo sapiens
caagcagaaaggccagtcttagagatatacaactgaaaagataaagtgtctcacgggtcacaccctcactccgtcattcaacaaatatttactgaagattaacttgtgctgg

SEQ ID NO: 36508 - DNA, 80 bp, Homo sapiens
ccaggtcacaggagcttcgatcaggaatggacccaaaacactacacatctgtcactgagtcagtgcttcctgcaggctgg

SEQ ID NO: 36509 - DNA, 71 bp, Homo sapiens
ttatttttgagacagggtctcactctgtcactcaggctggagtgcagtggagcgatcttgactcactataa

SEQ ID NO: 36510 - DNA, 108 bp, Homo sapiens
gcagcaatcctgagggcagagaacagatttttcaacattctttttttcctttttttttttttaaatctagtcttgcagatctgttccttgttgattgatgattgcttc

SEQ ID NO: 36511 - DNA, 69 bp, Homo sapiens
cggccgcggctgggaagggaggccatgctgggccagaagagctcggcactcttgtcagtctgtgtgctg

SEQ ID NO: 36512 - DNA, 81 bp, Homo sapiens
gtgctttccctcgccatttgcaaggctgagctgaatcaggatttatttcaatggctctgtcacagtctcagatggcagcat

SEQ ID NO: 36513 - DNA, 100 bp, Homo sapiens
tatgttcattttcattgcagcatttttcacaatagccaagatatggtgtcaacctgtgtctctcagtggatgaatgaatggataaagaaactgtggcata

SEQ ID NO: 36514 - DNA, 76 bp, Homo sapiens
tgggggggaggtgctacacacttttatttatttatttatttatttatttataggtggagtctcactctgtcaccca

SEQ ID NO: 36515 - DNA, 84 bp, Homo sapiens
gcttggagcctgggagagaagagagtcagatgatgacacttttatcctagggctgctcatctttctcagcaacttgggtcctgc

SEQ ID NO: 36516 - DNA, 107 bp, Homo sapiens
gcccaacctgtaacatggagctcagtggaaagcacatggaatgtggactgagacatgactgtgttcaaaccctggctctgtcgctaagtggttacttggtttggggc

SEQ ID NO: 36517 - DNA, 103 bp, Homo sapiens
tatatggtgtgtagttaaatagtgggtagtaaagcaaaagaaagcagttttatttttattttgttttgttttgttttgttttagccattaagtaagccaaatg

SEQ ID NO: 36518 - DNA, 73 bp, Homo sapiens
ggttttgtgagatgaggtctcactctgtcacctgggctggagtgcagtggtgcgatcatagcttactttaacc

SEQ ID NO: 36519 - DNA, 112 bp, Homo sapiens
tttttgcttaggatcatcttggctatatgggctttttttggttccatatgaaatttaaagtagtttctttcaattctgtgaagaaagtcaatggtagccatttaagtgagga

SEQ ID NO: 36520 - DNA, 67 bp, Homo sapiens
cctggggaacagagtgagactccgtctcaaaaaaaaaaaagacaggtgtctcactctgtcacccagg

SEQ ID NO: 36521 - DNA, 92 bp, Homo sapiens
cccaggtactacatcgaaggccttgggtgaacttctgagacttgctggcttcagatgagactcagcacattaccaggtgtggtggctatggg

SEQ ID NO: 36522 - DNA, 120 bp, Homo sapiens
catggtatgttctgttatgtatagcagcaagtgaaataaaaatacttagcccaaatatttatttatttatttattgagatggagtttcgctctgttgcccaggctggagtgcagtggtgc

SEQ ID NO: 36523 - DNA, 118 bp, Homo sapiens
tgcattttgcttaaaataaatgttagggtttcatgagcagtagaattagaaaatatttttggttttatttttctgtattgaaatatttaaaatttattttcaaaaaaacagaggtgca

SEQ ID NO: 36524 - DNA, 58 bp, Homo sapiens
tgagatggagtctcactctgtcacctaggctggagtgcagtggtgtgatctcagctca

SEQ ID NO: 36525 - DNA, 95 bp, Homo sapiens; identical to SEQ ID NO: 68

SEQ ID NO: 36526 - DNA, 93 bp, Homo sapiens; identical to SEQ ID NO: 69

SEQ ID NO: 36527 - DNA, 58 bp, Homo sapiens
tgagatggagtctcgctctgtcgctcaggctggagtgcagtgtcgtgacctcagctca

SEQ ID NO: 36528 - DNA, 78 bp, Homo sapiens
atgctcactggaacattgtaggatagctgtgactatactgttttatagacagagaagagactgagtcccagagagtgt

SEQ ID NO: 36529 - DNA, 249 bp, Homo sapiens
atatatacatacatatacgtatatttgtatgttgagtatatatacaaatactcaccatataaatatatacatatatgtataatatatacaaagtatatatactcaagtatatatacaagtatatatacaaagtgtatattatatatactttgtatatactcaagtatatatactttgtatatattatacatatatgtatgtatttatatgttgagtatatatactcaacatataaatactcaacatata

SEQ ID NO: 36530 - DNA, 119 bp, Homo sapiens
atatgtgtatatgtatacatatatacaaagtatatatactcaacatataaatatataaatatatgtataatatatacaaagtatatatacgcaacatataaatatatgtatatacatat

SEQ ID NO: 36531 - DNA, 134 bp, Homo sapiens
tatacatatacacatatttatatgttgagtatatatactttgtatatattatatatgtatataattatatgttgagtatttatattacatgtatttatatatttatgtttagtatttatatatacttgagtata

SEQ ID NO: 36532 - DNA, 93 bp, Homo sapiens
tatatttattatacatatatgtatatatttatatgttgagtatttatactcaacatataaatatatgtatatacatatatgtatatatttata

SEQ ID NO: 36533 - DNA, 92 bp, Homo sapiens
cgtttgatatagactagaccagagcatacagtggcaagggagagatctggagaaagcaggattgtagagggctttgctaagtctggtaaagg

SEQ ID NO: 36534 - DNA, 99 bp, Homo sapiens
tttgaaaagggtcactggggcccataagcatatgtgacagtggttggatttagttagccctcactgtccctgtctatctgtcccccgaatatctgtaga

SEQ ID NO: 36535 - DNA, 110 bp, Homo sapiens
gatggggtttggattctcttcaaggctggtgcggagtaggggatctaggaacctttctctctctctcagaaatgagcctgtgacctggaatagcatccaaagtatccttc

SEQ ID NO: 36536 - DNA, 74 bp, Homo sapiens
aggtaaagaacaaaaaagagaaggctgtggacctcgaagtcatatttttctctttgatattgttacttgatcct

SEQ ID NO: 36537 - DNA, 89 bp, Homo sapiens
gatatttttcatttcagactggtaatgtgctgatgtcgtaacaaggtttgagggaggcacatttcacacttgagtatgaaaacccaatc

SEQ ID NO: 36538 - DNA, 70 bp, Homo sapiens
ggtggacagtgttctctggattgaagcatggaatctaaatatggtgtctcatagagtctactgacatacc

SEQ ID NO: 36539 - DNA, 87 bp, Homo sapiens
gctgatgaactgtctgtgtcagtgttatatatttagtgggcttattattatttttgcaatgcattggcacagctcaattttaaatgc

SEQ ID NO: 36540 - DNA, 58 bp, Homo sapiens; identical to SEQ ID NO: 11136

SEQ ID NO: 36541 - DNA, 90 bp, Homo sapiens
gtgttatattttagggatttggaggaagagacataatatgcttgtaaaaagtggagtgttgtgattattttcatgtcttaggaatttcac

SEQ ID NO: 36542 - DNA, 113 bp, Homo sapiens
attttattgtctgccatttgatacaagagtagagttggtgaaatattggattcttaagaagtttataatcctaatatttccagaatgttaagatattgatgtagacataaaat

SEQ ID NO: 36543 - DNA, 111 bp, Homo sapiens
ctaagataggtttcagtttgcttacctactcagtgaggttgtagcttgttacataaaaacgcaaagtacaagacagcctcaagttaatggcctcctgcttatttaatttag

SEQ ID NO: 36544 - DNA, 119 bp, Homo sapiens
ttttgattaatacagaaagttataaatggtgaacctaaaaccctgtgattgtaagaatgtctaggatcatttgttttctgtttatagcttgtatgtgggaagaagtatagtgatgagaa

SEQ ID NO: 36545 - DNA, 95 bp, Homo sapiens
tttacataggaattttaaaggtagaggcggtagtcttatatttcattatttggaaaggaaacttctgtctaatgcctcatttaagattcagtgga

SEQ ID NO: 36546 - DNA, 95 bp, Homo sapiens; identical to SEQ ID NO: 68

SEQ ID NO: 36547 - DNA, 93 bp, Homo sapiens; identical to SEQ ID NO: 69

SEQ ID NO: 36548 - DNA, 63 bp, Homo sapiens
tgttttgagatggagtctcactctgccactcaggctggagtgcagtggcgcgatctcagctca

SEQ ID NO: 36549 - DNA, 77 bp, Homo sapiens
gtccattctcatgtatgtatgtatgtatgtatgtatgtatgtatgtatgtatgacaaagatataccagagactgggc

SEQ ID NO: 36550 - DNA, 101 bp, Homo sapiens
cctgctcctaggagtgtgtcaatgattccaggtatccatctagatatttttaattagatactttctgtggacctgcccattgcatatcatcctgtagctgg

SEQ ID NO: 36551 - DNA, 95 bp, Homo sapiens; identical to SEQ ID NO: 68

SEQ ID NO: 36552 - DNA, 93 bp, Homo sapiens; identical to SEQ ID NO: 69

SEQ ID NO: 36553 - DNA, 83 bp, Homo sapiens
ggctctctgatcagcaggcggtgaagccagccaggtgagttaccccagaccccaggcaggttcagagatgctgttcaggagcc

SEQ ID NO: 36554 - DNA, 75 bp, Homo sapiens
tggcgttatgagccagggaccatggatgaaaacctatatatatttatctatgtatatctctgtctcataatatca

SEQ ID NO: 36555 - DNA, 113 bp, Homo sapiens
ttatcataataaaaaaccactgatatgttcaagaacatacatgatatatcattttataagaatttcttcttatgagtaatattatgagttcttatgaataatattaatgatga

SEQ ID NO: 36556 - DNA, 98 bp, Homo sapiens
gttcatagaagtcatcagctctgttaacttgatttgcaattggattgttaaatacaactgattgtcatgttgatttggtgttacttggtttttcaggc

SEQ ID NO: 36557 - DNA, 106 bp, Homo sapiens
tggtattgctgttacgcttctctttgcatcagatgaccagatctcacatcccagactgtcactgactcactgaggaaagtcactctcagctttagtttcccctcca

SEQ ID NO: 36558 - DNA, 88 bp, Homo sapiens
atacttaaaaatctcacatatatgtatatatgtatatatatgagatacatatatgtatatatgtgtgtatatgtatgtgtatgtatat

SEQ ID NO: 36559 - DNA, 90 bp, Homo sapiens
tgctcattactgtgtagtttttgttttcctatggtctactgaacaacttattaagtgatacacacagagacactcacacagtctgtggca

SEQ ID NO: 36560 - DNA, 96 bp, Homo sapiens
tgctcagtgagtttctagtttcttgagaaatgttcacttgtgatttagtactacagaactacttcaggcaaattgaataagagagcttaaagagta

SEQ ID NO: 36561 - DNA, 92 bp, Homo sapiens
atacatacatattagcatatataggtacaagtatatacatatatatgtgtgtatatatgtatatgtgtgtgtatatatgtatatgtgtgtgt

SEQ ID NO: 36562 - DNA, 102 bp, Homo sapiens
tacggctgagtagtattctatgctatatatatatatcaatgtgatatatgtgatatatatatcaatgtgatatatgtgatatatatgatatatatcaatgtg

SEQ ID NO: 36563 - DNA, 129 bp, Homo sapiens
atgtatacatcatattatatgatgtatacattatattgtatgtatacatcatattgtatgtatacatcatattatatgtatgtatacattatatataatatatgtatacatacatatgtatgtatatac

SEQ ID NO: 36564 - DNA, 97 bp, Homo sapiens
gtttatgcatatgaaatatatgtgtatatattatatatacatatataaatatgtatatattatatatacatatataaatatgtatatatacatatat

SEQ ID NO: 36565 - DNA, 116 bp, Homo sapiens
gcggcccccagatgtaatattcacctctcacaatcacaaatgttttttgttttttgttttttaagttccaggatacatgtgcagaatgtgcaggtttgttacataggtaaatgtgc

SEQ ID NO: 36566 - DNA, 66 bp, Homo sapiens
tgagatggagtctcactctgtcacctaggctggagtgcagtggtgttgagaggtgacaacgtgccg

SEQ ID NO: 36567 - DNA, 108 bp, Homo sapiens
gctgacctcataagatgtgttagagaggagtcccttcttttcaatttttttgaataatttcagtagaaatggtaggaggtcttctttgtgcctctggtagaattcagc

SEQ ID NO: 36568 - DNA, 84 bp, Homo sapiens
attatatatgtatatgatacatatattgtagttatatatacatatattgttaactacaatatattgtagttatatatatatagt

SEQ ID NO: 36569 - DNA, 60 bp, Homo sapiens
tgagacagagtctcactctctttcccaggctgggaagggcagtggtgtgatcctggctca

SEQ ID NO: 36570 - DNA, 59 bp, Homo sapiens
atatatataatattcatatatgcatatgcctgtatgtgtatatatgtatatatgtgtgt

SEQ ID NO: 36571 - DNA, 117 bp, Homo sapiens
tatatatacatatatactacatatatacgtatatatactatatatacatatatactacatatatacttatatatactatatatgcatatatacttatacatatatggaaattatatg

SEQ ID NO: 36572 - DNA, 69 bp, Homo sapiens
ataaatagcataatagagtatagtgtgtgtatgtatatatatacatactctctctctatatatatttgt

SEQ ID NO: 36573 - DNA, 148 bp, Homo sapiens
atatgtgtgtgtatatatatgtgtgtgttccatatatatatgtgttccatatatatatatgtgtgttccatatatatatgtgtgtgttccatatatatatatacatatatatatgtgttccatatatatatatacatatatatatgtg

SEQ ID NO: 36574 - DNA, 110 bp, Homo sapiens
tgaggagacaaggaaagtgagatgaagaagtaggaagatttaatatcagaatttattttattttattttatttatttattttttgagatggcgtgtcactctgtcactca

SEQ ID NO: 36575 - DNA, 106 bp, Homo sapiens
tggtagttcatttggctctggttgatttgaatgctgttattgattttattttgatggacagaaaatctgtaatatataaacaactaaaatagctctgttagctcca

SEQ ID NO: 36576 - DNA, 58 bp, Homo sapiens
tgagcagagatcactccactgcattccagccgggatgacacagggacactctgtctca

SEQ ID NO: 36577 - DNA, 59 bp, Homo sapiens
atgtgtgtgtgtgtgtatatatatagtgtgtgtatatatatatatacacattcatacat

SEQ ID NO: 36578 - DNA, 95 bp, Homo sapiens; identical to SEQ ID NO: 68

SEQ ID NO: 36579 - DNA, 93 bp, Homo sapiens; identical to SEQ ID NO: 69

SEQ ID NO: 36580 - DNA, 95 bp, Homo sapiens; identical to SEQ ID NO: 68

SEQ ID NO: 36581 - DNA, 93 bp, Homo sapiens; identical to SEQ ID NO: 69

SEQ ID NO: 36582 - DNA, 87 bp, Homo sapiens
tcgccaggactcagagataaggcatggagagtgaagggaggatgctcactttctctttctgtcacactctgagttttcactgaaaga

SEQ ID NO: 36583 - DNA, 100 bp, Homo sapiens
ctttccccaggaaataaagatttgcttacagagattttgttgatgagtgctactgagaacactatttgtaagagagtgaatcaatcaggattgggtagag

SEQ ID NO: 36584 - DNA, 79 bp, Homo sapiens
gatataatgtacgtatttctgtctctatctatagatatctatatctatatctatatatagagtctattatacatgtgtc

SEQ ID NO: 36585 - DNA, 90 bp, Homo sapiens
tctttttatttacagatatatgtgtatatatatgtgtgtgtatatatgcatacatatgtatgtgtgtgtgtgtgtgtgtggatagataga

SEQ ID NO: 36586 - DNA, 92 bp, Homo sapiens
atgtgggctcttttctggttccatatggattttaaagtagtttttttgcaattctgtgaagaaagtcagtggtagcttgatggggatagcat

SEQ ID NO: 36587 - DNA, 78 bp, Homo sapiens
cctgtgctttgagctaatcatttcttcaatatctgtctctaccatcccagtttcagatgagagtgagctccccacagg

SEQ ID NO: 36588 - DNA, 81 bp, Homo sapiens
ctaagaagctggtaagtgcttccatcttctcatgagatctaggtttttgtgaatcaagatgtaagtgcaactacatctgag

SEQ ID NO: 36589 - DNA, 81 bp, Homo sapiens
gggacaacttagatgttttgcagtaaacatttatttttctttttgaaagacaggcttactgtgacattggcacagtgtctc

SEQ ID NO: 36590 - DNA, 110 bp, Homo sapiens
ctgttacagtgtgttactgttctgaatactgcagggattagaacacaatggtaagtatttatatatctaaatatgcataaacgtagaaaaggtaatacattgtgcaacag

SEQ ID NO: 36591 - DNA, 112 bp, Homo sapiens
gatagttttgcattttacattttagtctgtaatccatcttgagttactttttttttttttttttcagacggattctcactctgttggcaggctggagtgcagtggcgtgatc

SEQ ID NO: 36592 - DNA, 72 bp, Homo sapiens
cagtcaccagaaagaggtacaaagcaggccactcagatgatggcaatactctgtttcttaatctgtgtgctg

SEQ ID NO: 36593 - DNA, 84 bp, Homo sapiens
tgctttgtagcctctaatttgtgtaggcagtacctcagtgaatcacactggctggctgtcactcattctcagaagaccacagca

SEQ ID NO: 36594 - DNA, 87 bp, Homo sapiens
ttccaccatagtgaagtttttaaaagtatttgtcacccccttagaaaaattcaagataaaattttacttcttcattatggatgtgaa

SEQ ID NO: 36595 - DNA, 112 bp, Homo sapiens
acattgatattaaatttgtattaaaataacatatctcaatttgttattttaattcatgttaagatacatggaaggagacatgttattttaatacaaattgtaatttgtatta

SEQ ID NO: 36596 - DNA, 103 bp, Homo sapiens
tgctatactatgtgtctaaaactgtgtattaaaaagtggctagatattaaattctagtctagacaattttttaaatttttgacagttctcacttccagtagta

SEQ ID NO: 36597 - DNA, 98 bp, Homo sapiens
cctgtctatgaaaaattgacctcaataatcagaacttcctctctttgtaaatcaatgttagatttacccagttctgcattgttgtgtcgtgatccagg

SEQ ID NO: 36598 - DNA, 102 bp, Homo sapiens
tggtaattttgtcctggcctatccatatgtttcactgtaccctgcatttacattgtatttgataattttgagactgatggagtgcaaacaatccagttgcta

SEQ ID NO: 36599 - DNA, 67 bp, Homo sapiens
tccttttgaatatttatacttcttaattggaaactttaaaatgtttttggtctaggaggtgtgagga

SEQ ID NO: 36600 - DNA, 97 bp, Homo sapiens
catgacattttcttgtgctgtttcattttatccttagaattctgttttacttcttgagattttctttgagggacagtatacaggtgggaaagtcatg

SEQ ID NO: 36601 - DNA, 107 bp, Homo sapiens
ctgattttccatttgtatgtgcatttcttcccaacttcaagttcagtggcagctcactggcagcttggagttagccttggtgggagtatttagaccatgaatattag

SEQ ID NO: 36602 - DNA, 89 bp, Homo sapiens
gttcttatgtatataatgcctttatatatgtgtatatgtatatgtatatacacacatgcgtgcacacatatatatatatatgattttac

SEQ ID NO: 36603 - DNA, 94 bp, Homo sapiens
agctgacaactctgtctatatgattcaaaacattttgaaatttactgatagttttttgttttgttttgttcttgagacagggtcttgctttgtc

SEQ ID NO: 36604 - DNA, 85 bp, Homo sapiens
tgagctacggggctatgtctgtctttctcactattatatctgcctatcacagaaatttggtatatgatagatgtacaggtgctca

SEQ ID NO: 36605 - DNA, 141 bp, Homo sapiens
tataattagctgctataaaatacataattatttatatacatatacattatatgcataaatatatgcacatatgtatgtatatatgtgtgggagatatatatatatatatatatatatatatatatatatatatttccaagc

SEQ ID NO: 36606 - DNA, 95 bp, Homo sapiens; identical to SEQ ID NO: 68

SEQ ID NO: 36607 - DNA, 93 bp, Homo sapiens; identical to SEQ ID NO: 69

SEQ ID NO: 36608 - DNA, 84 bp, Homo sapiens
ttctgttccaatccatctccgttcttgcccaatactgactgtggaaagtacaaagtggagtgacagagaagagactgggcagag

SEQ ID NO: 36609 - DNA, 202 bp, Homo sapiens
aggaacatatattcttactatgtacatataatctctttatatatatatatattccctatatataaaatatttatatatattccctatatagaggttatatgtacttatatatatttcctataagtatatacatatatatatttcctatatatgtgtgtatatgtatttcctatatatagaagacatatataagtatatataa

SEQ ID NO: 36610 - DNA, 72 bp, Homo sapiens
agcaggggcgatgggtttgaaaaacagtttttaattatttttgaacagagactgtggagctggtactgtgct

SEQ ID NO: 36611 - DNA, 83 bp, Homo sapiens
cccccatttccaatatggcaacatgtaaatttttctttttaagggttgaaatttttcacattgcatactggttttgatggggg

SEQ ID NO: 36612 - DNA, 95 bp, Homo sapiens; identical to SEQ ID NO: 580

SEQ ID NO: 36613 - DNA, 93 bp, Homo sapiens; identical to SEQ ID NO: 69

SEQ ID NO: 36614 - DNA, 99 bp, Homo sapiens
attgttttaatctctaaagttttgaaagtatttgataagtatgattgtatagcacattcatatgtattatactttctatttgaaatagaataaaataat

SEQ ID NO: 36615 - DNA, 93 bp, Homo sapiens
atatatatatatgtatatgtatgtgtatatatgtgtgtatatatatgtgtgtgtgtgtgtgtatatatatatacacacatatatacacacaca

SEQ ID NO: 36616 - DNA, 109 bp, Homo sapiens
gtatctctttgtggttttgatttgcgtttctctaatgaccagcaatgatgagattttcttcatatgtttgtcggctgcataaatgtcttcttttgcaaagtgtctgtgc

SEQ ID NO: 36617 - DNA, 119 bp, Homo sapiens
gggcacccctttggttggccttccagtggattccctgagccccagggtccatcttaactgtagtatgtgagcagacaaaacctatggcagggacattgtggaggctcattaccgggcct

SEQ ID NO: 36618 - DNA, 119 bp, Homo sapiens
tttctaacagacccctggcgggcagaggactaattctcttttttcacattctttctgtgtttttcacagatgagagagagagcagtcctgaggaggctcaaggcaggcgctgagaggag

SEQ ID NO: 36619 - DNA, 112 bp, Homo sapiens
ctgagcatggaaagaaaagcagtatgtttatacatgaactcaatatttattattattataataggtcaaaagaaatttctcatatgatcatgctgtaattacttctacacag

SEQ ID NO: 36620 - DNA, 113 bp, Homo sapiens
agtaccagcctggagccagggagactcgctgggtggctagatccaggagagacaacaatcactgcagttcggctcacagggagtcacatccataggaaaagagggagagtact

SEQ ID NO: 36621 - DNA, 107 bp, Homo sapiens
gctatacactccctgtagccagaattcagcatctgaatcgttctttgctatctgcatttaatttttaatatttggatcatgtttcttgtgggagtgagtgtatatgt

SEQ ID NO: 36622 - DNA, 132 bp, Homo sapiens
gtgggttgtgaagactctgagaaaagtgtagtatctgggctggtgtgcactgttcctcatgacacagtctctcacagcttcccttggctaggggagggaattctccgaccccctatgcttcctgggtgaggc

SEQ ID NO: 36623 - DNA, 100 bp, Homo sapiens
tggactggattatggttagacaagtgtatttacttcatagtaattcattcagctattactatatgtttatgatttgtacacttgtctgtatgcagattta

SEQ ID NO: 36624 - DNA, 77 bp, Homo sapiens
gatgtctgcagaatgtgtgacagggtagattatttatatttctacctaggaagtttaaacgtctggagttgggcatc

SEQ ID NO: 36625 - DNA, 118 bp, Homo sapiens
aatggaggcagttgtatgtgtgcatatgtgtgtatatatatatatatatatatatatatatatatatatatatatatatatccaggctgtgtgtatatatgtatatatgacccttgtt

SEQ ID NO: 36626 - DNA, 95 bp, Homo sapiens; identical to SEQ ID NO: 68

SEQ ID NO: 36627 - DNA, 93 bp, Homo sapiens; identical to SEQ ID NO: 69

SEQ ID NO: 36628 - DNA, 95 bp, Homo sapiens; identical to SEQ ID NO: 68

SEQ ID NO: 36629 - DNA, 93 bp, Homo sapiens; identical to SEQ ID NO: 69

SEQ ID NO: 36630 - DNA, 95 bp, Homo sapiens; identical to SEQ ID NO: 68

SEQ ID NO: 36631 - DNA, 93 bp, Homo sapiens; identical to SEQ ID NO: 69

SEQ ID NO: 36632 - DNA, 145 bp, Homo sapiens
tgtggcttcattggtgggattttgatttaataaagagagaggctttttttttttttttttttttttgagacggactctccctctgtcgcccaggctggagtgcagtggcgcaatctcggctcactgcaagctccacttcctgggt

SEQ ID NO: 36633 - DNA, 73 bp, Homo sapiens
gagagagagtctcgctctgtcacccaggctggagtgcaatggcacgatctcagctcactgcaacctctgtctc

SEQ ID NO: 36634 - DNA, 95 bp, Homo sapiens; identical to SEQ ID NO: 68

SEQ ID NO: 36635 - DNA, 93 bp, Homo sapiens; identical to SEQ ID NO: 69

SEQ ID NO: 36636 - DNA, 75 bp, Homo sapiens
ttgttttgttttgagacagtgtctcgctctgtcacccagactggagttaaatggcacgatctcagcacactgcaa

SEQ ID NO: 36637 - DNA, 70 bp, Homo sapiens
tttttttgaggtagggtctcactctgtcactcaggctggagtgcagtggtgcaatcatagctcactaaag

SEQ ID NO: 36638 - DNA, 142 bp, Homo sapiens
ccagaataggttcggagagactccctcaactatatatttatctatctatttattttctttattttatttattattattattttttgagttggagtctcactctgtcacccaggctggagtgcagtggcttgatcttggctca

SEQ ID NO: 36639 - DNA, 95 bp, Homo sapiens; identical to SEQ ID NO: 68

SEQ ID NO: 36640 - DNA, 93 bp, Homo sapiens; identical to SEQ ID NO: 69

SEQ ID NO: 36641 - DNA, 95 bp, Homo sapiens; identical to SEQ ID NO: 68

SEQ ID NO: 36642 - DNA, 93 bp, Homo sapiens; identical to SEQ ID NO: 69

SEQ ID NO: 36643 - DNA, 85 bp, Homo sapiens
aagcacattcatattctgtcttacagtgtagtgtaattgttgtttactttaacctatcgcagacagtgtagtgtgattgttgttt

SEQ ID NO: 36644 - DNA, 82 bp, Homo sapiens
acaagatattttaaaatgtaggctcgatcaaatttttgtttttaaaggatgcatgagcctggccaacatggtgaaaccttgt

SEQ ID NO: 36645 - DNA, 60 bp, Homo sapiens
cggggtggacactgtcattctctctcatcgattgattgattgagacgaagtctcactctg

SEQ ID NO: 36646 - DNA, 71 bp, Homo sapiens
gtagagtgcattgtcaaagcacaaagcaatactttttttgttttgtttttttgagacagtctcactctgtc

SEQ ID NO: 36647 - DNA, 94 bp, Homo sapiens
tagttactttttttcatcacagtttcttgatctgtagaatggggataataatggtatctccattataagattattgtgaggattagatgagctg

SEQ ID NO: 36648 - DNA, 58 bp, Homo sapiens; identical to SEQ ID NO: 30628

SEQ ID NO: 36649 - DNA, 119 bp, Homo sapiens
tagaagagaagggcaataagatgttgactactgtgggtgttatgactgcagacagaaacaaaagaagtattttgtaattggtcatagcttttcacagacttcttaccacctttaagcta

SEQ ID NO: 36650 - DNA, 74 bp, Homo sapiens
cctgctgatggacagggatgagtaatactcttttttttttttcttgagacagagtctcactctgtcacccaggc

SEQ ID NO: 36651 - DNA, 89 bp, Homo sapiens
tttttctcgctctctgtatttctgtctcattccaggaaccaggctaagagagtaactccttcatgagacgtacctgggaaagagcaaga

SEQ ID NO: 36652 - DNA, 85 bp, Homo sapiens
ggatttgattcttctaagtgattgtttgtttttaaaaattcaagtttttgaaaataatcatttatatataaccaagaattagtcc

SEQ ID NO: 36653 - DNA, 86 bp, Homo sapiens
ggatgtttatttgctttgtagtttttgacagatttaatttatatttgaattatctgaggaaaaacttcaatatgtaattcacattc

SEQ ID NO: 36654 - DNA, 79 bp, Homo sapiens
gggttgtttactatagaaatctgagaaggaattttaagttttcttatatcttttgataatttatataagtgagcaatct

SEQ ID NO: 36655 - DNA, 58 bp, Homo sapiens
tgagacagggtctcactctgtcaccctagctggggtgcagtggtgggatcttggctca

SEQ ID NO: 36656 - DNA, 104 bp, Homo sapiens
ggtaatagcttcatttacattttcaataatctctcattaaatcagtatattttattaattatctgaggggttttggatgtaacaatgaaacaaagtgtacggcc

SEQ ID NO: 36657 - DNA, 95 bp, Homo sapiens; identical to SEQ ID NO: 68

SEQ ID NO: 36658 - DNA, 93 bp, Homo sapiens; identical to SEQ ID NO: 69

SEQ ID NO: 36659 - DNA, 113 bp, Homo sapiens
agaattctttttggattaacattttatacttttgaaatttcagagttctggggtatgttcacagctgctctgattcttcagacatgtataagttaaaagtgcctctcttttct

SEQ ID NO: 36660 - DNA, 58 bp, Homo sapiens
tgagttggagtctcactctgtcacccaggctggagtgcagtggtgtgatctaggctca

SEQ ID NO: 36661 - DNA, 107 bp, Homo sapiens
ctggagatcacctgttaaactgttacttttctgggccccacgctggattctgactcagtcactctgggatgggacccaggagtctgcatgtttaacaagcaccccag

SEQ ID NO: 36662 - DNA, 113 bp, Homo sapiens
tggatatagaggggactccaaacccaagagatgagattggaagaggggcctatgaagacaagtctttttttttttttttttttttttgagacggagtcttgctctgtcaccca

SEQ ID NO: 36663 - DNA, 88 bp, Homo sapiens
gatgaagaagtcacatcagtgtcagctgagaccttgaaaaattccttgaggaagtattggaggtggatcagtgagctggttcttcatt

SEQ ID NO: 36664 - DNA, 111 bp, Homo sapiens
acttgtaacccgggaaggtcagggtcaatgatttcaagtctcctctttggattggcaggaagtgggatgtgagcacaggatggggctccgatgtggtttctgggggtgggt

SEQ ID NO: 36665 - DNA, 58 bp, Homo sapiens
tgagacggagtctctctctgtcactcaggctggagtgcagtggcgcgatctcggctca

SEQ ID NO: 36666 - DNA, 107 bp, Homo sapiens
gaattattagatcatagtgccatgtttgcagataaggaatttacccagtgctcacaggtaattattcttttgttttttttttgcacatactgtcttgctgataagtc

SEQ ID NO: 36667 - DNA, 81 bp, Homo sapiens
tctcatacgtctctggtctctctctctcatttgtgagcaaacaagagttctcaaaggaagtggtacctgaacgacgtggga

SEQ ID NO: 36668 - DNA, 95 bp, Homo sapiens; identical to SEQ ID NO: 68

SEQ ID NO: 36669 - DNA, 93 bp, Homo sapiens; identical to SEQ ID NO: 69

SEQ ID NO: 36670 - DNA, 142 bp, Homo sapiens
atatatagatgtatatatacatgtatatacatatatagatgtatatatacatgtatatatagatgtatattacatgtatatatgtatatacatatatacatatatacatgtatatacacctatatatatgtatatatataca

SEQ ID NO: 36671 - DNA, 75 bp, Homo sapiens
tatatataggtgtatatacatgtatatatgtatatatgtatatacatatatacatgtaatatacatctatatata

SEQ ID NO: 36672 - DNA, 116 bp, Homo sapiens
gggttcagggacaaagagatcacacaggatgcaacgggacagagagaacagagggtcctttcgagaagaacacccgctgactgcaccactccttgtgctggtgtctgtttgcactc

SEQ ID NO: 36673 - DNA, 78 bp, Homo sapiens
ctacttatcctctctgtgtctcagttcctcctccgggaggaggaggaataaacaactgggatacacaactataggaag

SEQ ID NO: 36674 - DNA, 120 bp, Homo sapiens
ctactacttaatgtatatagcagtgagtgagcagactgactcagctattcttttattttttattttaacaggttttggggagcaggtggtgtttggttacatggataagttttttagtgg

SEQ ID NO: 36675 - DNA, 85 bp, Homo sapiens
tttcctatatcagaacactctggagctgaaccatacttcagattagactttatcttcattcagcatcaggatctgtagggggaga

SEQ ID NO: 36676 - DNA, 68 bp, Homo sapiens
gaggagacatgaggcatccagagcgcagagtttacagctctctgtctgtggctcagcctgtctgattc

SEQ ID NO: 36677 - DNA, 116 bp, Homo sapiens
ccttctgccagtagtgtgaggcctcccgagccactggaactgtaagtccattaaacctctttttctttataaattacccagtcttgggtatgactttatcagctgtgtgagaacgg

SEQ ID NO: 36678 - DNA, 114 bp, Homo sapiens
tgcttaggattctcttggctgcatgagctcttttttagttccatatgaaatttaaagtagttttttctaattctgtgaagaaagttaatggtagcttaatgggaatagcattga

SEQ ID NO: 36679 - DNA, 191 bp, Homo sapiens
ggcagggagaggcatattgcagtgtcagtgaacgactaagattggccaggaatctctatgacacactgacagaccaaggcaggttccctatcttcccaaatttatatatatatatgtatatgtatacatatatatatatatatattttttttttttcttggtgagatggagatttactcttgttgcccagg

SEQ ID NO: 36680 - DNA, 99 bp, Homo sapiens
tgtacacatttacatatgcaatatgtatatatatacacttgtatatgtatatatacaagtatgtgtatatatacatatgtatgtatatatatgtataca

SEQ ID NO: 36681 - DNA, 106 bp, Homo sapiens
tacatatgtatatatacacatacttgtatatatacatatacaagtgtatatatatacatattgcatatgtaaatgtgtacaagtatgtgtatatatacatatagta

SEQ ID NO: 36682 - DNA, 67 bp, Homo sapiens
gagacagtctcgctgtgtcacacccaggctggaatgcagtggtgtgatctcagctcactgcaacctc

SEQ ID NO: 36683 - DNA, 90 bp, Homo sapiens
ccaaatagctgggcatggtggtgtgtgcctgtagtcccagctactcaggaggctgaggtagaagaatcacttgagtccaggatttcaagg

SEQ ID NO: 36684 - DNA, 106 bp, Homo sapiens
acagaatacatattttttgaaggatgcatgaaacatttataatttaaaaaaatttttaatttctattttaagttatggggtactcgtgcaggatgtgcaggtttgt

SEQ ID NO: 36685 - DNA, 84 bp, Homo sapiens
tatatatatatatgtgtatatatatgtatatatatgtgtatatatatgtgtgtatatatacgtgtgtgtgtgtgtgtgtgtgtg

SEQ ID NO: 36686 - DNA, 82 bp, Homo sapiens
ttgtgtgagtcaggaattcagacagagcacagtaaggatgacttgcttctgcttcatgatgtctgaggcattcactgggcag

SEQ ID NO: 36687 - DNA, 113 bp, Homo sapiens
accagcagtgtagaagtgttcccttttcaccgcatccctgccaacatctattattttttgatttttttgattatggccattcttgcaggagtaaagttgcatcacattgtggt

SEQ ID NO: 36688 - DNA, 85 bp, Homo sapiens
cacatagtcccacttcttcatgtatttttcttcatggcatctttcaatctttatgtataaaaattcatgagggcagggcgcggtg

SEQ ID NO: 36689 - DNA, 76 bp, Homo sapiens
ctggtgtggcactgcttcctcaattacacagatgagtctctgagaacttgatgaaagctacagatgccttccccag

SEQ ID NO: 36690 - DNA, 69 bp, Homo sapiens
aattgtcttgaaagaactgtgtgagcacacatgcacatgtgtgtggacacatttagtcatgggggaatt

SEQ ID NO: 36691 - DNA, 103 bp, Homo sapiens
tgggttagacagatctctatctgtaataataataactatagttttctctgattacagggtaatttatatgaatttttgaagcttactggatggagaggatcca

SEQ ID NO: 36692 - DNA, 71 bp, Homo sapiens
ggcctgattgatgtcaatgaatatttattcttaatgttttaaaaaaatatgatgtgcctgtcactcaggcc

SEQ ID NO: 36693 - DNA, 73 bp, Homo sapiens
ggagtagtataaatgtcatgtgcattattagttagtcagatgagtaattgtatttgtcatggattgcttctcc

SEQ ID NO: 36694 - DNA, 84 bp, Homo sapiens
gtgggtggttgggggtcaggggtatagattgtttttcttttctttttttttgaaacaggatctcactctgtcactcaggctggc

SEQ ID NO: 36695 - DNA, 90 bp, Homo sapiens
ccctggaagatgctcacactcagtcagtctggagggtggcacctacaagtgtattttaaactgagatgtcttgtgtgaggcactgagggg

SEQ ID NO: 36696 - DNA, 58 bp, Homo sapiens; identical to SEQ ID NO: 902

SEQ ID NO: 36697 - DNA, 116 bp, Homo sapiens
gaaattacagaaatatcagccacgaatagcagtgtttaatggaaaatgtaagatttacttttaaattttttttttctttgctaacattatgggcaatgtaaatatgtttgtatttc

SEQ ID NO: 36698 - DNA, 127 bp, Homo sapiens
tatatatgtatatatacacatgtatatatacacgtgtgcatatatgtgcacacatatgtatatgtgtatatgtatatatgtatatgtgtatatatatgtaagtatatatgtgtatatatacacacac

SEQ ID NO: 36699 - DNA, 118 bp, Homo sapiens
ctagcctctcaaagcactgggattacaggtgtgagccaccgtatcagcttatttgaagtttttttttttctttttgagacggtgtctcattctgtcacccaggctggagtccagtggt

SEQ ID NO: 36700 - DNA, 98 bp, Homo sapiens
catcacgtggtgttctccctgtgtgtctgtctcttcttttttttttttctttttgagacaaggtctggctctgtcatccaggttggagtgcaatggtg

SEQ ID NO: 36701 - DNA, 88 bp, Homo sapiens
gcttgggggctgaaaacaaaatggaattgtttgggtcagatctctttcactgtctcagtcacaattttgcaatgacagtttcaaaagc

SEQ ID NO: 36702 - DNA, 62 bp, Homo sapiens
tgttgtccagtgtagggaccagccccacagggtcggtgggtctctccctgtgtgcggcgacg

SEQ ID NO: 36703 - DNA, 200 bp, Homo sapiens
tgaggcaggagaattgcttgaactcaggaggcggagattgcagtgaactgagatcacacagtgcactccagcctgggcaacagagcaagactccatttcaaaaactaaataaataaataaataaatataaatttatttgtcaacaagtgtttgtatattactttttttttttttttttgagatggagtttcactcttgtt

SEQ ID NO: 36704 - DNA, 110 bp, Homo sapiens
cggctgagacagagaagagtatgtccaacagaaacaaaaagatccatgaatttattttatttatttatttttttttttggagacagggtcttactctgatgcccaggctg

SEQ ID NO: 36705 - DNA, 90 bp, Homo sapiens
ggcctgttacactgcaggaagtttttttattattatttatttatttatgtattttattttttgagacagtcttgctctgtcacccaggct

SEQ ID NO: 36706 - DNA, 108 bp, Homo sapiens
gaaaatatatattgaaaatatgttttctactgcaaagagctgcccaaaacaagtatatatatttgttttgggcagctctttgcagcagaaaatgtattcttgagtttc

SEQ ID NO: 36707 - DNA, 77 bp, Homo sapiens
gtctgggagttctaatatgtgcatcccaatgaggttcttagacctcagggccagatctcacactgactctctttgac

SEQ ID NO: 36708 - DNA, 75 bp, Homo sapiens
ggcctgtagctgcatcacttgaatctctgcctctgtcttccatggccctcttccctgtgtgtgtctctgtgggtc

SEQ ID NO: 36709 - DNA, 91 bp, Homo sapiens
ctctacagcttctttccccatctcctaaaatccaacccttttgtgctccatgtgggcaaagttgagtgggactgtggttacaagttgagag

SEQ ID NO: 36710 - DNA, 73 bp, Homo sapiens
tgtagtggctgtaaaggtagtatcatggtgatcataatttgcatttatctgatgactgatgatagtgactata

SEQ ID NO: 36711 - DNA, 104 bp, Homo sapiens
tattctctttgtaggcgagatctgagaggcaaaatgttgattgatttttcatttttcaagattaactttaaacagatggcttagctgaagctgtaagagcagta

SEQ ID NO: 36712 - DNA, 113 bp, Homo sapiens
agtctatttctaggtgtgtctgtatgtgtgtatgtgtgtctgatagtactgtggatcttagtatgtttatataaatatacatatctgctcaacaagttctgggatattcaact

SEQ ID NO: 36713 - DNA, 105 bp, Homo sapiens
aagataactgtagaatattgattgagacaattttttggatatgttatgaaatggaaaaaagcaggatgcaaagcagtatgtccaatatgagcctatttttgtctt

SEQ ID NO: 36714 - DNA, 64 bp, Homo sapiens
actccactcactctgtcccactgtgtcccaccccttgcaggaaggtgagtacaggtgagtgggt

SEQ ID NO: 36715 - DNA, 118 bp, Homo sapiens
tctctacatatatatgtgtatatttatgaatatgtagtttcattatgtatatgtagagagatatatattattatatgtagatatatatagtattatatatgtgtatatgtatatattg

SEQ ID NO: 36716 - DNA, 99 bp, Homo sapiens
tagctaggattataggtatgtgccaccacatccagctaatttaaaaataatttttgtttttttggtagagatggaggtctcattatgttgtccacgctg

SEQ ID NO: 36717 - DNA, 79 bp, Homo sapiens
acaagtaatggattttagaaatatttttgcttttataatagagatgcagaaaatgttctttctaaaattaataacttgt

SEQ ID NO: 36718 - DNA, 69 bp, Homo sapiens
ggacatcagcacattaatatatgtgtgtgcacacatatatatatgtttatctgtgttgatctgtgatcc

SEQ ID NO: 36719 - DNA, 58 bp, Homo sapiens
tgagactgagtctggctctgtctcccaggctggagtgcagtggcacagtctcagctca

SEQ ID NO: 36720 - DNA, 96 bp, Homo sapiens
aaagtggtggatgaggtaagatagcaacatagaaaatttgtatttgattctttctcgaactttcttttgttgttattttggcccactttccatttt

SEQ ID NO: 36721 - DNA, 88 bp, Homo sapiens
ttttagctccatatggtggaaagggatttttttttcttttataatttttttttagagacaaggtctcactctgtcacccaggctagaa

SEQ ID NO: 36722 - DNA, 118 bp, Homo sapiens
ctgttgtgtgttgcacgctgtgccccttcttccctgagcggaggtggagctgtgtggctgtgtgagtggcacatgagtgctctccccttgagctttgggtacagcctgatgctggcag

SEQ ID NO: 36723 - DNA, 86 bp, Homo sapiens
ttattatcataaaacagaagacggttctgttcacactgagagcactctgtgagcagagactgatcttagcattttacaggtattaa

SEQ ID NO: 36724 - DNA, 76 bp, Homo sapiens
tggttgacatccattagtagattatgaaatccagtgggtcacaaccacaatttttgtttataaatggaatagacta

SEQ ID NO: 36725 - DNA, 137 bp, Homo sapiens
atatgcgtgtgagtctgtgtgtgtttctgtgtttgtgtgtacacataaagacacacacacatatttcttggagtagtgagataagagactgcgctcattgaatgtagctttagcaaggctcacttagacccgagagg

SEQ ID NO: 36726 - DNA, 86 bp, Homo sapiens
cgtgggaggagatgctacagtggagagtgagcagagcccagggctgggagggctgtgcagagcttcttcaggccactgttctcagg

SEQ ID NO: 36727 - DNA, 95 bp, Homo sapiens
ctgggctcttgttaatggtaattccaaagcttcccctgggtctctgtgaagctcgggatagaatatgttttttttttttatttccagtaggctag

SEQ ID NO: 36728 - DNA, 84 bp, Homo sapiens
acagagcacaatgaagactccgcttttgaattttaaaatgatgctaaattttttttttttttttgagacggagtctcactctgt

SEQ ID NO: 36729 - DNA, 98 bp, Homo sapiens
aatggggtaatgtattttcttgctattgagttgttttagttctttatatattaatatttactgttggttgatatagtttgaaaatattttctcccatt

SEQ ID NO: 36730 - DNA, 59 bp, Homo sapiens
tgcatatatgaatatattttatatatgtacacatacatatatatgtgtttgtgtttgca

SEQ ID NO: 36731 - DNA, 95 bp, Homo sapiens; identical to SEQ ID NO: 68

SEQ ID NO: 36732 - DNA, 93 bp, Homo sapiens; identical to SEQ ID NO: 69

SEQ ID NO: 36733 - DNA, 115 bp, Homo sapiens
tgtcaaaggctccgatttctctcagggcatagtatttttcattaacttgagggcatagtattttttattataatcatcttaaccagagtatggctaaatatgaatttggatgata

SEQ ID NO: 36734 - DNA, 95 bp, Homo sapiens; identical to SEQ ID NO: 68

SEQ ID NO: 36735 - DNA, 93 bp, Homo sapiens; identical to SEQ ID NO: 69

SEQ ID NO: 36736 - DNA, 58 bp, Homo sapiens
aactcagtctctgcctctgagtggaggactttctctgccacagtccactggctgagtt

SEQ ID NO: 36737 - DNA, 82 bp, Homo sapiens
atatatatatgtatatgtatgtatatatgtgtatatgtgtatatttgtacatatgtgtacatatacatatacatatatatgt

SEQ ID NO: 36738 - DNA, 115 bp, Homo sapiens
gatgctttgttatttgtttatccttgtactgatgtctgtgcatttgaaagagcagactctctttcagtctttacagactggtttcggtaggttaaaagcttctcctgttagtgtc

SEQ ID NO: 36739 - DNA, 119 bp, Homo sapiens
tcaaagtgctgggattacaggagtgagccaccccacctggcctctcattcactctgtcagtacagagattggtccctatggccagagtccactcatcacctgctctctgtctgctatga

SEQ ID NO: 36740 - DNA, 109 bp, Homo sapiens
accgctcccatgacacctgccaacaattctgccaacaattctttcttttttttttttaactttaagttctgggatacatgtgcagaacgtgcaggtttattacataggt

SEQ ID NO: 36741 - DNA, 58 bp, Homo sapiens
tgagacagagtctcactctgtcacccaggctggagtgcagtagtgcgatcttggctca

SEQ ID NO: 36742 - DNA, 75 bp, Homo sapiens
gcacaggaggaggctgggtccctggatgacacgtggagggttgtctgatcaaggacccctgaattggactgtgac

SEQ ID NO: 36743 - DNA, 119 bp, Homo sapiens
ggaacattaaaataacttatgaaagtactgttgctggtacagagttctgatattcttcttgttttggctcacaggaaaaatggaggctgcttccagcatttttaaaggtaattgtttca

SEQ ID NO: 36744 - DNA, 75 bp, Homo sapiens
caatgtttaaagaagaggcatatgtggttcttattattttggaacaacaatgtgcttttttttttttttgagaca

SEQ ID NO: 36745 - DNA, 95 bp, Homo sapiens; identical to SEQ ID NO: 68

SEQ ID NO: 36746 - DNA, 93 bp, Homo sapiens; identical to SEQ ID NO: 69

SEQ ID NO: 36747 - DNA, 97 bp, Homo sapiens
acatatatatggttttatatacatatatatatatggttatctatctatatggatatatggatatatctttctatgagtgtgtgtgtgtatatatata

SEQ ID NO: 36748 - DNA, 117 bp, Homo sapiens
ctggacacagtggcacacacctgtagtcctagctacttgggaggctgaggtggaaggatcatttgagcccaggagttatgggttacactgagctatgattgtgccactgcactccag

SEQ ID NO: 36749 - DNA, 95 bp, Homo sapiens; identical to SEQ ID NO: 68

SEQ ID NO: 36750 - DNA, 93 bp, Homo sapiens; identical to SEQ ID NO: 69

SEQ ID NO: 36751 - DNA, 90 bp, Homo sapiens
ctctccagccaaagttagtgcaactgcaactgctccttctattcattaagttggtctcctttgctttgctagtttgcttcctgctgagag

SEQ ID NO: 36752 - DNA, 100 bp, Homo sapiens
ctgtggtgtgtatatgtatgtgtgtatatatgtgtgtgtgtgtatatatatatatatatacacacacacacatacatgtacacacacacacacacaatgg

SEQ ID NO: 36753 - DNA, 58 bp, Homo sapiens; identical to SEQ ID NO: 6617

SEQ ID NO: 36754 - DNA, 56 bp, Homo sapiens; identical to SEQ ID NO: 6618

SEQ ID NO: 36755 - DNA, 110 bp, Homo sapiens
ccagctacacctcccttaaggtcatcaacttcacagccaggtttgttgacatcaaaagatctaataacaataagccggggctctgaagtaaagtctcttgggggtactgg

SEQ ID NO: 36756 - DNA, 77 bp, Homo sapiens
gctgggtcagctgaagtcccctgagaaatgtcagtgtccacacaaatgcatgtttctgattggctcgtctacttggc

SEQ ID NO: 36757 - DNA, 95 bp, Homo sapiens
gtgtgtatgtacgtgtgtgtatatatacatgtgtgtatatacgtgtgtatatatacgtgtgtatatatatgtatgtgtgtatatatatatatatg

SEQ ID NO: 36758 - DNA, 85 bp, Homo sapiens
gcaaattattaaaaagcacacatagcttggaaagctcagactgtggacagaattttagctttcttttgttatcttgctgtagggc

SEQ ID NO: 36759 - DNA, 95 bp, Homo sapiens
ggctttctatttctgcttctgtcttaatttttattatttagagaaacagtctctttcttcagataatttaaggagaagacaagaagtggaaaaac

SEQ ID NO: 36760 - DNA, 98 bp, Homo sapiens
cagctgtataaacagtttcttcagcacaaggcaagatactttttcttttatttgtcaagattttgctatgctgcttcagtcaagtctttttatagttg

SEQ ID NO: 36761 - DNA, 76 bp, Homo sapiens
ggagaagcagacaagagatcacagtatcttgtaccagccaagtacatactgtttttttgtttttgtttgtttgttt

SEQ ID NO: 36762 - DNA, 58 bp, Homo sapiens
tgagctggagtctcactctgtcacccaggctggagtggagtggcatgaactcagctca

SEQ ID NO: 36763 - DNA, 88 bp, Homo sapiens
aagtctgaggctgtgtgtgtgtttctatatatttatacaaaattgatatgaagaatggggctaggtttatggagcagctgctaggctt

SEQ ID NO: 36764 - DNA, 73 bp, Homo sapiens
tccatagagaaaatagaaagataatcagcctctctctcctagtgtggttgatcataatttgtttttatatgga

SEQ ID NO: 36765 - DNA, 99 bp, Homo sapiens
ggtgacagtgagactctgtctctaaaaaataaaaaaattattatcttctgatggctttttcttttttttattttttagatgaagtctcgctctgtcacc

SEQ ID NO: 36766 - DNA, 155 bp, Homo sapiens
gcaatttgaaaccagcctggggaacatggtgaaatcccatctctgcaaaaaaattttattttatttatttattttttgagacagagtctcactctgtcatccaggctggagtgcagtggtgtgatctcggctcactgcagcctctgcctcctgga

SEQ ID NO: 36767 - DNA, 68 bp, Homo sapiens
ttgttttgagacagtctcactctgtcacccaggctggagtgcagtggtgtgatctcggctcactgcaa

SEQ ID NO: 36768 - DNA, 136 bp, Homo sapiens
ataaatatgtaattatatatatatttatttttatgtgtgtatgtatatacatatatacacacatgtatatatgtataaacatgtttgtatatatttacatgtgtgtacacgtgtgtgtcttctatatatgcataag

SEQ ID NO: 36769 - DNA, 85 bp, Homo sapiens
gtatgtatctttcttctgtgtcattcactcaatttattctgtttataaggagtagattcaggaatgggtcagaacatttttatac

SEQ ID NO: 36770 - DNA, 104 bp, Homo sapiens
acatgtgtgacctgggtaggatatttaacttttctaagattgtttctttatttttaaatggagataatactatcttagtctgttgtgtgctgctataacacagt

SEQ ID NO: 36771 - DNA, 116 bp, Homo sapiens
atacatagatcatggcttgttctttttaaaaattctatttatttatttattttgatattgacaaattataattgtatatatttatgggttgcaaagtgatgctatggtatatgtat

SEQ ID NO: 36772 - DNA, 120 bp, Homo sapiens
aatttgcctgctggtacaggcctttggctggaaaaaatattggtatttggaattgaggggaaatttttttttattatactttaagttttagggtacatgtgcacaacgtgcaggttagtt

SEQ ID NO: 36773 - DNA, 69 bp, Homo sapiens
ggttcatagatgactgtcttctcactgggtccttacgtggtggaaagggtaagacagttctgtggggcc

SEQ ID NO: 36774 - DNA, 117 bp, Homo sapiens
tcgttctgtagttggttgagtctgtggatgtagaactcgtgaatgcagagggccagctgtatttatataattgttatatcctcttgctgaattgacctctttataattacataatga

SEQ ID NO: 36775 - DNA, 90 bp, Homo sapiens
tgtgatagaggctctggggtgggtgtatcttcaggtgtggcaggaagtccacgcagctgagctcagtgagcacagaggcgaatggttgta

SEQ ID NO: 36776 - DNA, 83 bp, Homo sapiens
tgagaactcacatgtctgggacatttgctgagcaccaagtcatgttccaaagatttcctatgtattgatgtgtgtgattctca

SEQ ID NO: 36777 - DNA, 117 bp, Homo sapiens
gcactccagcctgggtgacagagctgagactgcacctcaaaaaaaaaaaagaaagaaagaaagaaagaaagaacatacaggttctgtcctggcttagatgctcttcctggatgtagc

SEQ ID NO: 36778 - DNA, 75 bp, Homo sapiens
acaccgtggcccctctgagggagagctagagttttcttttttctctttttttttcttcagagagtctcactctgt

SEQ ID NO: 36779 - DNA, 117 bp, Homo sapiens
tggtggtgatgataatagtagtgaccgtgatgataatagtagtgacaatgatgatgatggtggtgatagtaacaatggtgtagtgacggtgatgatgactgtggtgatgacgctcta

SEQ ID NO: 36780 - DNA, 86 bp, Homo sapiens
acctctggccccaagggcattggaaatgtgattgtctattgtagtgtctaactcacagtgtctttgaggaggataaaagtcagggt

SEQ ID NO: 36781 - DNA, 122 bp, Homo sapiens
gctcttgggtgctgtgtttgggtactgatgctggtggtcttgtctttaggtccctgagtgatgtgtgggaccactggagggggcaagtttgctattggtggtggccctggggcaggaagctt

SEQ ID NO: 36782 - DNA, 88 bp, Homo sapiens
atccacacacagcctcacacacagagtgacagacccatgaagttcttcctggttgctctggggtggggcttcagctatttttgtggat

SEQ ID NO: 36783 - DNA, 68 bp, Homo sapiens
gcagaagagagggctctctctctctctgtaccaaggcagagagcctgattagccttgtgctcttctgc

SEQ ID NO: 36784 - DNA, 89 bp, Homo sapiens
aggagcgccagccacagatctcactcactctcactgttgtttgcaactttgggcaagtcaagtaacttctctgctggatcactgcttct

SEQ ID NO: 36785 - DNA, 108 bp, Homo sapiens
ggggggggggtaaaagggataatttcttatatgcaaatatttatatatcttatgtgcaaatatttaaaataaatagaaatttttataatcttattttggcctcttttt

SEQ ID NO: 36786 - DNA, 98 bp, Homo sapiens
taaagtccccctcataataaaactgaatatattaatctgcaaaattctttaaaccttaagattattttgttttgttttgttttgagacggagtctttg

SEQ ID NO: 36787 - DNA, 98 bp, Homo sapiens
ctacaagtctgcaccttcaactctcattctgaaaattcctgaatatttatttaatttcaagataaaaatcagcatggtgtttctaggttgactcctag

SEQ ID NO: 36788 - DNA, 73 bp, Homo sapiens
gtttattgacttgcttatgttgaaccagccttgaatcccagggatgcagccgacttgatcatggtggataagc

SEQ ID NO: 36789 - DNA, 119 bp, Homo sapiens
tgtcctttttgcttaggattgtcttggctatacgggctcttttctggttccatatgaaatctaaagtagttgtttctaattctgtgaagaaagtcaatagtagcttgatggggatagca

SEQ ID NO: 36790 - DNA, 70 bp, Homo sapiens
atacatatgtgtgtatatatatgtgtgtatacatatgtgtatatatacgtatatatacacatatatgtgt

SEQ ID NO: 36791 - DNA, 112 bp, Homo sapiens
tccatcactactgatgatgatgatgattagatgagtactatgctaagtgtttgtttttgtttttttaatccatgatctcattttatcttcaaaacatcccagtgaggtagga

SEQ ID NO: 36792 - DNA, 115 bp, Homo sapiens
ttgtgtccttgaatcttcataacacttctgagggcttagggctttttatactgattttgttgataaggttactgaggctcagagaacttaagaaaatttactcatgcccacacaa

SEQ ID NO: 36793 - DNA, 76 bp, Homo sapiens
gccttggccatgctgagagtctggctgtgttctctgtgagtgacaggagggacttgcaccatcgctggccagaggc

SEQ ID NO: 36794 - DNA, 172 bp, Homo sapiens
actgtgatatatatatatatatatgtgtgtatatatatatatgtgtgtatatatatatgtgtgtctatatatatatgtgtgtgtatatatatatatgtgtgtatatatatatgtgtgtgtatatatatgtaagtttcttgtgtgtacatatacatatatgtacacacacaca

SEQ ID NO: 36795 - DNA, 92 bp, Homo sapiens
acacactctcagcatgggaccaggcacacattaggtgctcaatccacttatcggcacttactgtgtctctgtgactgtgctgagcaatttgt

SEQ ID NO: 36796 - DNA, 58 bp, Homo sapiens; identical to SEQ ID NO: 1435

SEQ ID NO: 36797 - DNA, 95 bp, Homo sapiens; identical to SEQ ID NO: 68

SEQ ID NO: 36798 - DNA, 93 bp, Homo sapiens; identical to SEQ ID NO: 69

SEQ ID NO: 36799 - DNA, 114 bp, Homo sapiens
ggggctggcagccaggcctgtggctggaacatctgcagacactgtgtggtttccaggttcccgagtctgtcagagcctggggatacagggatctggaggtgtctctggagccat

SEQ ID NO: 36800 - DNA, 76 bp, Homo sapiens
tgagctctgagtgagcagggcagtgtctgtcttattcactgaatagcactagggcctggcacttagtccacgctca

SEQ ID NO: 36801 - DNA, 58 bp, Homo sapiens
tgagatagagtctcactctgtcaccgaggctggagtgcagtggtgggatctcggctca

SEQ ID NO: 36802 - DNA, 88 bp, Homo sapiens
atatatacacatatatacatcgtatatcatatatgtgagatatatatatgtgtgtatatatctcatatatatatatatatatatatat

SEQ ID NO: 36803 - DNA, 118 bp, Homo sapiens
tatatatatatatatgagatatatacacacatatatatatctcacatatatgatatacgatgtatatatgtgtatatatatgatgtgtgtgtatatgatgtatatatatgatgtatgt

SEQ ID NO: 36804 - DNA, 114 bp, Homo sapiens
ggcagggaggagagggtagggtgttttttggagggggcaaacagaagagatggagcacattctctctttttttttttttttttttttttgagacagagtctcgccctgtcaccc

SEQ ID NO: 36805 - DNA, 110 bp, Homo sapiens
ggcaggatttgaagtgggtctgtctgcctctcgctagatgaatgaatgaatgaatgaatgaatgaatgaatgtaaggggctgctaatccacgggactcctcaggtcagcc

SEQ ID NO: 36806 - DNA, 65 bp, Homo sapiens
ggcctttactgtcactgtatctgtgtcacccacgcctggaatatagtagatgctcagtaaatgcc

SEQ ID NO: 36807 - DNA, 111 bp, Homo sapiens
caggggacttccaggaggtgtggcttccttgggcttcccggtcactcagtccctgggaggggcagggacagcagctgtggaagctccaaggagcatgcccaaggccctctg

SEQ ID NO: 36808 - DNA, 191 bp, Homo sapiens
tgcctccaggcctgtgggttgagtggtctgtgcttccgtggctgctggtggagtggtctgtgcctctgtggctgccagtggagtggtctgtgcctccgtggccgtcagtcgagttgtctgtgcctctgtggctgccagtggagtggtctgtgcctccgtgggcactggttgagtggtctgtgcctccgtgg

SEQ ID NO: 36809 - DNA, 138 bp, Homo sapiens
ccagcttgaaggcaggcaggagtaattcctttttttttttttttttttttttgagatggagtctctcactctgtcgcccaggctggaatgcagtggcacgatcttggctaactgcagcctccaccccctgggttcaag

SEQ ID NO: 36810 - DNA, 57 bp, Homo sapiens
tgagatggagtctcactctgtcacccaggctggagtgcagtgtgcgatttcagctca

SEQ ID NO: 36811 - DNA, 114 bp, Homo sapiens
ggctggagggcaggacaaggcaggagggcaacagggctctgtctctctctctttcaaacagataagagacaaggtcctactatgttgcccaggctggtctcgaactcctgggct

SEQ ID NO: 36812 - DNA, 100 bp, Homo sapiens
ttatacgcttaccttaatcctcctgtctccctccatctctgtcaagctccgaggctcagaaatatggaggcaaagagtggaggggaaaggatgtgtgtgg

SEQ ID NO: 36813 - DNA, 58 bp, Homo sapiens; identical to SEQ ID NO: 1265

SEQ ID NO: 36814 - DNA, 74 bp, Homo sapiens
tagggaagacgagacaaagcctcctagtatctggcacagagcaaggggcttaatatttatgaatcttttcttta

SEQ ID NO: 36815 - DNA, 63 bp, Homo sapiens
gggacactcaccctctctgagtcttgcctgttaaatggctggttcagatagggtgtgtgaatc

SEQ ID NO: 36816 - DNA, 70 bp, Homo sapiens
agcttgggtaacatagcgagaccccgtcttttatttttttgagacggagtctcactctgtcacccaggct

SEQ ID NO: 36817 - DNA, 78 bp, Homo sapiens
ggtctactacaggaagctactcaggaggctgaggtggaaggatcacttgagcttgggaggttgaggctgcagtgagcc

SEQ ID NO: 36818 - DNA, 102 bp, Homo sapiens
gtgcctgagctatcttatctgtgttttactgtctgctctttctggctgcttactgttagaagagaagtgatttccttgaaatgcatgaggttagaaagggac

SEQ ID NO: 36819 - DNA, 58 bp, Homo sapiens
tatatatatatatacacatatatatatacgtatatatatatgtgtatatatatatatg

SEQ ID NO: 36820 - DNA, 111 bp, Homo sapiens
ttgtgccactgcactccagcctgggtgacagagcaagatctttttttttaattttttattttttgagatggggtcttactctgtcacccaggctagagtgtagtggcatga

SEQ ID NO: 36821 - DNA, 112 bp, Homo sapiens
cgaatgactttactgcctgctgatgagcaaagcccagattattgtttcgttactatagtgattttctacttccgtcaatctttctgtgcttattagctcttgttgttttttg

SEQ ID NO: 36822 - DNA, 58 bp, Homo sapiens; identical to SEQ ID NO: 27519

SEQ ID NO: 36823 - DNA, 58 bp, Homo sapiens
tgagacagactctcgctctgtcgcccaggctggagtgcagtggcgtgatctcgactca

SEQ ID NO: 36824 - DNA, 258 bp, Homo sapiens
acacgtgtgtatatatgtgtatatgtgtatatatacacacacgtgtgtatatatgtgtatatatgtatatatacacacatgtgtgtgtatatgtatatatacacgtacatgtatgtgtgtatatatgtatatatacacacgtgtgtatatgtatatatgtatatatacacacgtgtgtatatgtatatatgtatatatacacacatgtgtgtatatgtatatatgtatatatacacacatgtgtgtatatgtacatat

SEQ ID NO: 36825 - DNA, 58 bp, Homo sapiens
tatatacacagatatgtgtgtgtatatatacatatacacacagatatgtgtgtgtata

SEQ ID NO: 36826 - DNA, 89 bp, Homo sapiens
ggagtctcgcttcttcgcccaggctggagtgcagtggggcaatctcagctcactgactcactctgcctcccgggttcaagtgatcctcc

SEQ ID NO: 36827 - DNA, 85 bp, Homo sapiens
atgtgtgtgtgcaaaaatgtgtgtgcatgtgcatgtgtgttcacgtgtccacgtgcgtgtgtgtgtgtgtgtgtgtgtaggtata

SEQ ID NO: 36828 - DNA, 115 bp, Homo sapiens
cccaccaatggctgtcattgacatcatcatattctctctctgtctctctgggaaattgaaacttttttcccaattaagtggttatgaagctgcagccagcagctagcaggtgagg

SEQ ID NO: 36829 - DNA, 122 bp, Homo sapiens
gtagtaggtcacctggggtgaaatcagaaccataaaatgcaaggcttaggaatctttattttttaataagtgcctcaggtgattttatggtcaagcaaatgaggacacctgtactaggtgat

SEQ ID NO: 36830 - DNA, 58 bp, Homo sapiens
catcacacacacacacacacgcatatatatatatatgcgtgtgtgtgtgtgtgttatg

SEQ ID NO: 36831 - DNA, 58 bp, Homo sapiens; identical to SEQ ID NO: 6359

SEQ ID NO: 36832 - DNA, 75 bp, Homo sapiens
gggctacaggcgtgtaccaccacatgcagctaattttcatattttttgtagagatggggttttgccatgttgccc

SEQ ID NO: 36833 - DNA, 57 bp, Homo sapiens
tgagtcagagtctcgctctgtcacccaggctggagtgcagtggctgatctcggctca

SEQ ID NO: 36834 - DNA, 99 bp, Homo sapiens
gatgcgggaggatcgcttgagcccaggaggttgaggctgtagtgagctatgatggcaccattgcactccagcctgggtgacagagcaagaccctgtctc

SEQ ID NO: 36835 - DNA, 105 bp, Homo sapiens
ccaggcattgtggtgtatgtttgtagtcctggcttcttgggaggctgaggttggaggatcacttgagcctgggaggttgaggctgcagtgagctgtgatcacgtc

SEQ ID NO: 36836 - DNA, 58 bp, Homo sapiens
tgagatggagtctcactctgtctcccaggcgggagtgcagtggtgtgatctcggctta

SEQ ID NO: 36837 - DNA, 131 bp, Homo sapiens
gggagatcaaggacttgatgacaactgcggaagacaagagctgtcctccccttgctctctggctctgactcctcctctgactttcctgtttgtttgtcccacagagaacgccaagggtgagaccttggagc

SEQ ID NO: 36838 - DNA, 85 bp, Homo sapiens
gacagagtagctgctatggttgcactgatgtcgtctctgtcagtgaggagtccttttatttatttttagacagtctcactctgtt

SEQ ID NO: 36839 - DNA, 112 bp, Homo sapiens
atcagactgtgtgtgacacttcccctaggagcctggacagtcaatgtgacactatctgtctctgtgacatcatccgggtggcctgtgtgtgtctccgtgacaccagccagat

SEQ ID NO: 36840 - DNA, 105 bp, Homo sapiens
gagacagagtctcgctttgttgcccaagctggagtgcagtggtgcgatctcagttcactgcaatctctgtctctgtttcccaagttaaagcgattctcctgcctc

SEQ ID NO: 36841 - DNA, 87 bp, Homo sapiens
gagaattaagagaagggagtagagtcaggctgactgggctactagccatatgactcagccgctctgtgcctcagtttcccccatctt

SEQ ID NO: 36842 - DNA, 70 bp, Homo sapiens
cagagctgtgagagatctcagtgggttcaggagctgccagcagtttgctgaggctgtcacagcctctctg

SEQ ID NO: 36843 - DNA, 81 bp, Homo sapiens
tcccgagcatgactggctgtttggcactgctggttttgggttagtacacagctacagtaaccagaacagcagggcatggga

SEQ ID NO: 36844 - DNA, 80 bp, Homo sapiens
tcttccctcctggaagccacagaacaaacaaggtgggaactagtttatttgtttttctacgtgcgtattgggtgggaagg

SEQ ID NO: 36845 - DNA, 91 bp, Homo sapiens
gtgtgtgtatctgtttctctgcctctcagtgtctttgttcccggacctgtctgcacagcaccatggggagcacagagaagcaaatgctgcc

SEQ ID NO: 36846 - DNA, 89 bp, Homo sapiens
agcatagatgtgtagcctcactgcctgttctattagaaaatactgactttcaaattttttaaatagtatagtgaccctacttttatgtt

SEQ ID NO: 36847 - DNA, 83 bp, Homo sapiens
tgtaaatatgggatgtgcacatgaggatcaattgtgtatttatatttacatgtggtatactcacttgtacacacatatttaca

SEQ ID NO: 36848 - DNA, 140 bp, Homo sapiens
actgttgctctgttgactttctagactgtcatcggaaatgttttttttttttttttgagacggactctcactctgtcatccaggctggagtgcagtggcgtgatctcagctcactgtaacctccgcctcccgggttcaag

SEQ ID NO: 36849 - DNA, 85 bp, Homo sapiens
ttggggctggctcacacacacagaaacacgtgcttatcctcttcatctggataaacttgattctttcttgtgttgctgttcctgg

SEQ ID NO: 36850 - DNA, 135 bp, Homo sapiens
tgtgcccgcagtatggtattgatagtgtttttttctttttcttttttttttttttttttgagacagtcttactctgtcacccaggctggagtgcagtggtgcgatcttggctcactgcaagctccgcctcccggg

SEQ ID NO: 36851 - DNA, 102 bp, Homo sapiens
gtcctgcttctcgatttgaccccaccctcactcactgacagtgtctgtttcagctcctccgtcacctctgttgtggttgtgtgtggtgagatcatagctgat

SEQ ID NO: 36852 - DNA, 75 bp, Homo sapiens
acggtaagctaaggttactttatttttttaaaaaaatattttacataaatttagagtagcctaagtgtacactgt

SEQ ID NO: 36853 - DNA, 88 bp, Homo sapiens
aaaaaaagaaagaaagaaaaggacatgtataattttttataatgaaaaaaattccagttcatgctttctttttttttttttttttttt

SEQ ID NO: 36854 - DNA, 82 bp, Homo sapiens
tgcctaagcgcctgctgcagtcctgctcctggctttgactccattctaagtcagtcacagtgtctccttcagctctttggta

SEQ ID NO: 36855 - DNA, 58 bp, Homo sapiens
tgagactgagtctcactctgccacccaggctggagtgcagtggtgcgatctcagctca

SEQ ID NO: 36856 - DNA, 137 bp, Homo sapiens
atatatagatcgatagatatagatctatatatagatatgtagatatatagagctatatagatatatctatatatagatatgtagatatatagatctatatatagatatgtagatatatctatagataaatatctata

SEQ ID NO: 36857 - DNA, 98 bp, Homo sapiens
atatagatctatatatctacatatctatatatagatatatctatatagctctatatatctacatatctatatatagatctatatctatcgatctatat

SEQ ID NO: 36858 - DNA, 56 bp, Homo sapiens; identical to SEQ ID NO: 324

SEQ ID NO: 36859 - DNA, 82 bp, Homo sapiens
tgtggtacttctatttttagttttttaagaaatctccaaaatacaggtagtttcttaaattgcgtgtaaaatagtgattgca

SEQ ID NO: 36860 - DNA, 117 bp, Homo sapiens
tcttgggtatgtcaaacttcaggtgccagcagggcatctttgtggaagtgttgtgtataaagtgaggaactatgagtttgcggctggcaaggcaagttggggccagaaaatctgaga

SEQ ID NO: 36861 - DNA, 58 bp, Homo sapiens
tgagatggactctcgctctgtcacccaagctggagtgcagtggtgcgatctcagctca

SEQ ID NO: 36862 - DNA, 56 bp, Homo sapiens
gagacagagtctcactctgtcacccaggctggagtgcagtggtgggatcctggctc

SEQ ID NO: 36863 - DNA, 69 bp, Homo sapiens
cttctcattgactcacacacgcactcagtgctttattgagcacctagtgtgtgtcagttgctgggcaag

SEQ ID NO: 36864 - DNA, 81 bp, Homo sapiens
tctctctcaccctgtctgactggtctcctgctggtctctgtcattggccacattcaaccagaagacagaaggtaagggaga

SEQ ID NO: 36865 - DNA, 76 bp, Homo sapiens
tatgtgtgtatatatgtatgtgtatatgtatgtatacatgtgtgtatacatatatgcatataggtatatatatgta

SEQ ID NO: 36866 - DNA, 74 bp, Homo sapiens
gcagaggcaggaggattgcttgagctcaggagtcccagaccagcctaggcaacacagtgagactctgtctctgc

SEQ ID NO: 36867 - DNA, 58 bp, Homo sapiens
tgagacagagtcacactctgtggcccaggctggagtgcagtggtgtgatctctgttca

SEQ ID NO: 36868 - DNA, 86 bp, Homo sapiens
gcctgaattgtgataagtcctttttcctgtatagttggcctttttttttttttttttttggaggagtctcactctgtcactcaggc

SEQ ID NO: 36869 - DNA, 66 bp, Homo sapiens
tttcagttggagtctcactctgtcacccaggctggagtgcagtggtgcaatctctgctcactgaaa

SEQ ID NO: 36870 - DNA, 66 bp, Homo sapiens
cccttgggtagaagactgaagacagtgaggttccaacctccctagttcagacattagccccctggg

SEQ ID NO: 36871 - DNA, 76 bp, Homo sapiens
cctgagtcactgaagtcactgaactcagctggaaccggcagctccaagctgaactgactgcttcagctcacccagg

SEQ ID NO: 36872 - DNA, 58 bp, Homo sapiens
tgagacgaagtctcgctctgtcgctcaggctggagtgcagtggcatgattttggctca

SEQ ID NO: 36873 - DNA, 138 bp, Homo sapiens
cttgctctggtttgcacagctgcttgatggaggggccaggctttgaaccctcgcattttgactgtagagtctgtgctttcatcaggaggatctgcagaggctaaacgtggaaggggccggtgtttggtccctgagagt

SEQ ID NO: 36874 - DNA, 83 bp, Homo sapiens
ctgtcccaggccaggttatcattagtgctcacctcattcttttttttttttgagatggagtcttactctgttgcctgggctag

SEQ ID NO: 36875 - DNA, 73 bp, Homo sapiens
cagaggggtgcaggggatgttcatgtgaggacaagacaatatctgtctgtctctctgtctctctatctgtctg

SEQ ID NO: 36876 - DNA, 110 bp, Homo sapiens
gcaggcccctgggacatgggcctggccctcactctcctccccaacctttttttttttttttttttttttgaggcagagtctcgctttgtctgtcgcccaggatggagtgc

SEQ ID NO: 36877 - DNA, 83 bp, Homo sapiens
tgaagtgtctgagaggccaatggggagggatttatttacttttttagtaactttttttttcctgtacttttcggtatacctta

SEQ ID NO: 36878 - DNA, 58 bp, Homo sapiens; identical to SEQ ID NO: 1435

SEQ ID NO: 36879 - DNA, 58 bp, Homo sapiens
tgagacggagtctcgctctgtcacccacgctggagtgcagtggcgcgatcttggctca

SEQ ID NO: 36880 - DNA, 83 bp, Homo sapiens
gggttgtacatggcgagtttctgttcttttttttttttttctttttttttttttttttgagacagactcttgctctgtcaccc

SEQ ID NO: 36881 - DNA, 78 bp, Homo sapiens
ctctggcaccctcttttcatatatgtgtgtgtatatatatatatatatatatatatatatggggagagagagagagag

SEQ ID NO: 36882 - DNA, 117 bp, Homo sapiens
gagtgctaggattacagatgtgagccacctcagccagcccctagattttttttttttttttaataaatggaatcaaacagcgtgtaacagaggtgttcaatcttttggcttccctgg

SEQ ID NO: 36883 - DNA, 112 bp, Homo sapiens
catcacagcatttctactttaggagaaatgaaaatctaaggccacatgaaaaaaaattttattttttattttttgagactcactctttcactcaggctggggtgcagtggtg

SEQ ID NO: 36884 - DNA, 107 bp, Homo sapiens
gagtgtggtggtggtggtggtgttttaagacagggtctcgctctgtcactcaggctggagtccagtggcatgatcctggctcactgcagcctcgacttcctgggctt

SEQ ID NO: 36885 - DNA, 96 bp, Homo sapiens
tgagagattaggggacttgcccaaagcaatatttgtaggattttattacacctctccctttatttatttttttagagtcaaggtctccctctgtca

SEQ ID NO: 36886 - DNA, 75 bp, Homo sapiens
catcatggaggcaaggagctgttttgttttattttgttttgtttgagacaggatctctctctgtcacccaggctg

SEQ ID NO: 36887 - DNA, 112 bp, Homo sapiens
ctgaggtcacatagctggtaagtgataaaggccattctctctctctttttctttttttgcaacagagttttgctcttgtcactcaggctggagtgctatggcgggatctcag

SEQ ID NO: 36888 - DNA, 58 bp, Homo sapiens; identical to SEQ ID NO: 3818

SEQ ID NO: 36889 - DNA, 58 bp, Homo sapiens; identical to SEQ ID NO: 1101

SEQ ID NO: 36890 - DNA, 56 bp, Homo sapiens; identical to SEQ ID NO: 1102

SEQ ID NO: 36891 - DNA, 114 bp, Homo sapiens
gaaggcaagggtggaggcagtggcaatggagagaagtgaattggttcttaagatattctagagaaagtcaagaaactttctgtccagtgatctttatgttcttccctgctgcct

SEQ ID NO: 36892 - DNA, 112 bp, Homo sapiens
gaaacagagcgcgatcccatctcaagaaaaaaaaaaatagtatagtacagtaattctagtgtatatatatatatactttttttttttttgagacagagtcttgctctgtctc

SEQ ID NO: 36893 - DNA, 69 bp, Homo sapiens
gtttttgagatggagtctcactctgtcacccaggctggagtgcagtggtgtgatcttgatcctggctca

SEQ ID NO: 36894 - DNA, 146 bp, Homo sapiens
ttctttacaagaaacgatgggttgtagcatattcccatcttccatgttactgcccattacttttctttttttgttgttttttgagatggagtctcactctgtcacccaggctggagtgcagtggtgcggtcttggctcactgcaac

SEQ ID NO: 36895 - DNA, 83 bp, Homo sapiens
cactggagacctgggcagagtcagtgtaacttttgagggaagcatcaggaggtatataatgtctggctgtctgtctctcagtg

SEQ ID NO: 36896 - DNA, 107 bp, Homo sapiens
tgaactccagcctggtgacagagcaagactccatctcaaaaaaaaaaaaaaaattttttttttttttgtagagactgagtctctctttttcgcctaggctggtctca

SEQ ID NO: 36897 - DNA, 56 bp, Homo sapiens
gagacagggtctcactctgtcacccaggctggagtgcagtggtgtgatcactgctc

SEQ ID NO: 36898 - DNA, 100 bp, Homo sapiens
gctaggatatagaaagctggaaagtgtcaaagataaattataaaatcatcctttttttttttttttttttttgagatggagtctcgctctgtcaccaggc

SEQ ID NO: 36899 - DNA, 80 bp, Homo sapiens
gcgaggccctcccgtctaccccaatcccgttctgaaccagggccaggtcagagagcagagagaggtgcgggagggtaggc

SEQ ID NO: 36900 - DNA, 98 bp, Homo sapiens
tcatggaatagagtggtggagctgtggttgagatgctctatttaattaattttaatgacattttgagatccagtgctgctcattgaatttgcctgtga

SEQ ID NO: 36901 - DNA, 112 bp, Homo sapiens
ggctattctgggtcttttatggttccatataaattttagtattgttttttctatttctatgaagaatgtcattgatattttgatagggattgcatgaaatctgtagattgct

SEQ ID NO: 36902 - DNA, 106 bp, Homo sapiens
gaattggtccatttcatctcttatcaaatttgtgagcatggaagtattcctaatatttattattcttttaatgtttatgggatcagtagtgatgggcccctctttc

SEQ ID NO: 36903 - DNA, 76 bp, Homo sapiens
atgtggctagtgtgattgaggaattgaattttaaattttatttaattttaattaattttaatttaattagccacat

SEQ ID NO: 36904 - DNA, 112 bp, Homo sapiens
cagtgcacagtgccctggtttccacattcatgccaacatttgttgctgtttttttgttttttaagtaatagccatcctaatgggtataaagtggtatctcattgtgcttttg

SEQ ID NO: 36905 - DNA, 112 bp, Homo sapiens
gccaggtgttcaagaacctgtctctaccaaaaaaaaatatatatatatataaaatacattttatatatatatatatattttttttttttttgagatggagtctcactctgtc

SEQ ID NO: 36906 - DNA, 58 bp, Homo sapiens; identical to SEQ ID NO: 1763

SEQ ID NO: 36907 - DNA, 58 bp, Homo sapiens; identical to SEQ ID NO: 2051

SEQ ID NO: 36908 - DNA, 72 bp, Homo sapiens
tctccaccctgagagaaattactgtgctgaccaagcttgaggtggtcagcatagtaattctctcaatgcaga

SEQ ID NO: 36909 - DNA, 112 bp, Homo sapiens
gaggctgaggtgggaggaatgcttgagcccagagtggggagtttgcagtgagtgagcagagatagtagcaccactacactccagcctgggccatagagcaacacaatgtctc

SEQ ID NO: 36910 - DNA, 71 bp, Homo sapiens
tgacagagcaagactctgtctcaaaaaaaataaaataaaataaataatagagacagggtctctctctgtca

SEQ ID NO: 36911 - DNA, 171 bp, Homo sapiens
atatatatatataaatgtccaacaagtatacgaaaaaagacatatatatatgtctttatatatatatatgtctttatatatatatgtctttatatatatatgtctttatatatatatatatatatatatatatgtctttatatatctatgtttttatatgcatataaagat

SEQ ID NO: 36912 - DNA, 90 bp, Homo sapiens
cacacaggctcagagggagtagtgtgtatatgcacatgaacatacgtgtcagtgtatatatgtatatatacaaggttgtgggtttgtttg

SEQ ID NO: 36913 - DNA, 58 bp, Homo sapiens
tgagacagggtctcactgtgtcactcaggctggagtgcagtggaatgatcttggctca

SEQ ID NO: 36914 - DNA, 102 bp, Homo sapiens
acttcctcagtcatgttttacttgttgataaaggaaagtgatctgaagaaactcttaacaagtatttttcttattaagaagtcaacaaagtctgagtgtggt

SEQ ID NO: 36915 - DNA, 120 bp, Homo sapiens
cagagggctgtcactcaataagatctgtccgctcttctgtaggtgtggggtgttacaatttatttttttaatctgaagtgtcttgaagagtatggagtaatgagtcctaggcaggtgctg

SEQ ID NO: 36916 - DNA, 124 bp, Homo sapiens
ggagtctcactttgtcaccctggctggagtgcagtggcatgatcttgccacactggaacctctgcctcctgggttcattcaggtgcttctcccacctcagcctcccaagtagctgagactacag

SEQ ID NO: 36917 - DNA, 97 bp, Homo sapiens
gactccttgggctcaagccagtgtcagagtgagtttctcttttttttttttttgagacggagtcttgctctgtcacccaggctagagtgcagtgagc

SEQ ID NO: 36918 - DNA, 106 bp, Homo sapiens
ccatttatatttgtgacatttttccttttaaataaatgtctttacatttttaaaagtgaattgatttaaggggaaaaaagagttcactaaacaatagtatgggtgg

SEQ ID NO: 36919 - DNA, 72 bp, Homo sapiens
ttgttttttgagctggagtctcactctgtcacctaggctggagtgccatggtgcgatccccactcactgcaa

SEQ ID NO: 36920 - DNA, 117 bp, Homo sapiens
gcttggacaaaggctggttggattcaggttgctgtgggcatagctgagctcattcacttactcactcacccattcactcactcacctgttcatttattccccagatacttacaaagt

SEQ ID NO: 36921 - DNA, 95 bp, Homo sapiens; identical to SEQ ID NO: 68

SEQ ID NO: 36922 - DNA, 93 bp, Homo sapiens; identical to SEQ ID NO: 69

SEQ ID NO: 36923 - DNA, 115 bp, Homo sapiens
tatgtatatatttatcaatgcatagatacataatatgcatatatttgtttatcaatgcatataatatgtatatatttacatatgtatgtgtgcttatatattcatatccatatct

SEQ ID NO: 36924 - DNA, 104 bp, Homo sapiens
ctctttctttcatctctgtcaaagctaaaaccaggcaggtttcatgtgtctaaagttttattatttgatacaagaacttgctgcttccctgctaaaggaaagag

SEQ ID NO: 36925 - DNA, 117 bp, Homo sapiens
tacaaaaattagccaggtgtggtgacacatgcctgtcgtcccagctacctggtaggctgaggtaggaggatcacttgagtccaggaggtcaaggctgaagtgagccataatcacagc

SEQ ID NO: 36926 - DNA, 104 bp, Homo sapiens
acataatgtttttgagatttgcccatgtggtcacgtgcatcagtggtttatttctttttattactcagtagcattcccatggatgaatatatccgaatttatgt

SEQ ID NO: 36927 - DNA, 109 bp, Homo sapiens
gcaatagatgagggttctagatgcttcatgtcctcgctaagtcttgtcattgtgttgttgttgatagtcactttaatagacatgtagtactgctacccatttagaaagc

SEQ ID NO: 36928 - DNA, 113 bp, Homo sapiens
gcttaatatatgtcagctactgttgttgttgttatttttctcactctggggctctctctttcagaaaggcttgcaatttgagggtaaccaatggcaggcagacatggataggt

SEQ ID NO: 36929 - DNA, 85 bp, Homo sapiens
catgcaattcagggtggtcagttgtctctcccactttcccacgctggggatcatgatggaaggatacaggctattatggaagctg

SEQ ID NO: 36930 - DNA, 100 bp, Homo sapiens
gatgaggatttctcccaatcaaatattcctcagaaaacaaaaaatcagttccttcttttttgttttttttttaatttttgagatggagtctctctctgtc

SEQ ID NO: 36931 - DNA, 111 bp, Homo sapiens
cacttcatgccatgctaagcatatagtgagtatcactgaagtgtaagctgttattatgcatgacttgacactcaatgtgcttacttttgctagatatatgtgtggggagtg

SEQ ID NO: 36932 - DNA, 127 bp, Homo sapiens
atatatgtatatatacatgtatatacatatacaccactatatatagtatatgcactgtgtgtatatacactatatgtatataatatataacgtatactgtatattgtatattttatattatatatac

SEQ ID NO: 36933 - DNA, 66 bp, Homo sapiens
catgtatgtttctgtggatgtggatctccatggagcatggagtctccagtatgctctagctatgtg

SEQ ID NO: 36934 - DNA, 73 bp, Homo sapiens
gtgggtcactgtatgtctctgagcctcagtttccccaatggtaaaattgaagctgaaacagtacagacctcat

SEQ ID NO: 36935 - DNA, 117 bp, Homo sapiens
gcctggtgaatggagcttgaggatagctaggatcatcaccaaagtagatttattttttttcaatgccagtaatatgtagagtgaatcccaacttttcctaccaaaagcattcaaggt

SEQ ID NO: 36936 - DNA, 95 bp, Homo sapiens
tagcatgcatgtcccaactccctctgtctgtgtctgtggcagacaaagtaagccaatatgggcatgctctcctgctagcaaccgagctcagaggg

SEQ ID NO: 36937 - DNA, 60 bp, Homo sapiens
tgagccgagattgtgccactgcactccagcctgggtgacagtgagactctgtctgtctca

SEQ ID NO: 36938 - DNA, 60 bp, Homo sapiens
tgagacagacagagtctcactgtcacccaggctggagtgcagtggcacaatctcggctca

SEQ ID NO: 36939 - DNA, 196 bp, Homo sapiens
gcatatatatgtatatatatatatgtgtatatatatatgtgtatagatgtgtatatatatgtgtatatatgtgtatatatgtatatatgtgtatatatgtatatatgtgtatatatatgtgcatatatgtgtatatatgtatatatgtgtatatatatgtgtatatgtgtgtgtgtatatatatgtatatatatat

SEQ ID NO: 36940 - DNA, 108 bp, Homo sapiens
gtgtggtggtgtgtgcttgtagtcccagcaactcaggaggctgaggtaggaggatcagttgagcctgggagatggagtttgcagtgagccgagatcacactgctgcac

SEQ ID NO: 36941 - DNA, 100 bp, Homo sapiens
gacagtgaatgagttctcacgtctggttgtttgacagagtgtagcatttcccccttcactctctgtctcctgctccaccgtggaaagacatgcttgcttc

SEQ ID NO: 36942 - DNA, 98 bp, Homo sapiens
ggaggccagaagccctaaagtcaaggtgctgggttcattctggagggttcggggggaatccttttccttgccttcttccagctcctagaggctgctcc

SEQ ID NO: 36943 - DNA, 87 bp, Homo sapiens
tggtgaaatctgagtgagttcagtgggttgtatcaatgccaactttctgattgtgatattgtactatagttacgcaagatgttacca

SEQ ID NO: 36944 - DNA, 102 bp, Homo sapiens
cctggtgctgggggcggggccgagcagcttcagcaacagcatctccaataagtgggacctgtgtgctgggggcggggccgagcagcttcagctgcggctggg

SEQ ID NO: 36945 - DNA, 69 bp, Homo sapiens
gcctccactgcatcactcagtcactcagccagtttttattgagcacctgagatgtgccagctgtgtggc

SEQ ID NO: 36946 - DNA, 78 bp, Homo sapiens
atggggaggaggataggcattggttaagagcttgcacttggatttgggctctgtcacttactctgtcagtttcttcat

SEQ ID NO: 36947 - DNA, 76 bp, Homo sapiens
ggagggagggagggagggaagaaagtgacttggcaattgataaatgtcaatctttttttttttttttttttttttt

SEQ ID NO: 36948 - DNA, 136 bp, Homo sapiens
tgatgctggggcctgggatgaaggatgtggcactatggaggactttggccttgactgtaaaactgtttttttctttattagagacaaggtcttgcactgtcacccaggctggggtgtcatggcgtgatcactgttc

SEQ ID NO: 36949 - DNA, 88 bp, Homo sapiens
agctgggcaacagagtgagaccccccccaatctctacaaaaaaaattttttttttttaagacagaggtctcactctgtcacccaggct

SEQ ID NO: 36950 - DNA, 83 bp, Homo sapiens
tctgtctggctggctctctccctggccccctcaacaaagctctcttgtcaagctggccaggacgagaatattgatgagacaga

SEQ ID NO: 36951 - DNA, 90 bp, Homo sapiens
gggcaagatcagggagggcttcttgaagtaggcagagactcagcacacagctcagactttgacaagaagcagactagctgcatttagtgc

SEQ ID NO: 36952 - DNA, 102 bp, Homo sapiens
ccctaagacacttaggaatcattgtctgtctctgcgtctctggccgcctctgtctctctccatctctaggtgtcagggaacctgtgactgaagtctccgagt

SEQ ID NO: 36953 - DNA, 81 bp, Homo sapiens
ttcagactagacacagaatcacattggggtggagaaacaggtctgtggcctcagagagtgatttttattgttcttgctgga

SEQ ID NO: 36954 - DNA, 115 bp, Homo sapiens
tttacttgtttaaacaatttttgtttatgtggttttgaattttatttaaaaatataagtaaatgaattatatgactaataatgtaaagaaccatcagcagtagtttggaagtaaa

SEQ ID NO: 36955 - DNA, 70 bp, Homo sapiens
aggctcagggacactgtctgagtctccagggaggactcctgacttttatgacttagtgaccctccagctt

SEQ ID NO: 36956 - DNA, 73 bp, Homo sapiens
tctgggcatgatgacatgtgctgtagtattagctactggggaggctgaggtaggaggatcatttgagcccagg

SEQ ID NO: 36957 - DNA, 81 bp, Homo sapiens
taactcaccgctgttctgtggtttgtaggttgcccctaccaaccatagtcaacctataaaccacagaacagaggtgagtta

SEQ ID NO: 36958 - DNA, 75 bp, Homo sapiens
cactcttggccattttgagataggtcaactatttttattcttaaagatggttttcaggaactggattgaggagtg

SEQ ID NO: 36959 - DNA, 107 bp, Homo sapiens
cacatacacatagtccccgaggcacaggctggcaattgagccatttctttctttctttttttagacagggtctggctctgtcaccaaggctagaatgcaatgatgtg

SEQ ID NO: 36960 - DNA, 119 bp, Homo sapiens
gatgtgaggaactgtttaatttatcatgctaattttttttagttgtatttttgttttataggtcctgtgaaatttatgctttaaagaggttctgttttgatgtgttcaggattcatttc

SEQ ID NO: 36961 - DNA, 59 bp, Homo sapiens
aggcctggtctgacagcagcaggggcccagcccctctgaactgtcactctgacacgcct

SEQ ID NO: 36962 - DNA, 88 bp, Homo sapiens
ggtatcattggtgtataaaagttggacacatttaatatgtatatatatatcttgatgagtttggccctagggatccacctgtgataac

SEQ ID NO: 36963 - DNA, 78 bp, Homo sapiens
gagattacaggcgtaagccactgtgcccaacatgtatatatttttaaatacacacacagatgcatatgcttctatctc

SEQ ID NO: 36964 - DNA, 93 bp, Homo sapiens
gtggaaggattctctgtcttctgttcaggcatgggaagtaatttggtttctgtctgtctgtctgcttctgtataggatcttgtctatttccac

SEQ ID NO: 36965 - DNA, 116 bp, Homo sapiens
tctatgccagcaagtatttgtgcaatatatatatatatatatatatatatatatatatatatatatatatatatatatatatatatatatatagtacttgtgctgatcttggctga

SEQ ID NO: 36966 - DNA, 68 bp, Homo sapiens
gctgtgagtcagatgttagctgctgctgttctcaaaggcagcttgccccagttctggactttcaaagt

SEQ ID NO: 36967 - DNA, 72 bp, Homo sapiens
ggtcctagagtggagactttttctttttcttttcttttttttttttaaaagacagggtctcactctgtcacc

SEQ ID NO: 36968 - DNA, 113 bp, Homo sapiens
tgcaagaaataccctggttagaggccagaagtcggctttggaatttattttatttttattatcattttttttgaggcagattattgctctgtcacccaggctggagtggtgca

SEQ ID NO: 36969 - DNA, 60 bp, Homo sapiens
ggagacagggtctcactctgtcgctcaggctggagtgcagtggcacgatctcaggtctct

SEQ ID NO: 36970 - DNA, 80 bp, Homo sapiens
gtatgaattcatatgttaatatatacatgtatttatatatatgtatagtatatatgtttatatgaatgtgtgatgaatat

SEQ ID NO: 36971 - DNA, 73 bp, Homo sapiens
ggtggctctgagctggggaaatgcactgctggggacaaagatgggaggcagatttctcactcttcatgctact

SEQ ID NO: 36972 - DNA, 84 bp, Homo sapiens
gtgtgtgtgtgtgtgtgtgtgtgtgtgtataaacacacatgggtatgtgtgtatatatatatacacacacacatatatatgcac

SEQ ID NO: 36973 - DNA, 157 bp, Homo sapiens
tacatatatgtgtgtatatatgtatatatacgtgtatatatgtgtgtatatatgtgtatatatgtatatatgtgtatatatatgtgtatatatgtatatatatgtgtatatatatgtgtgtgtgtatatatatgtgtgtgtgtatatatatatatat

SEQ ID NO: 36974 - DNA, 95 bp, Homo sapiens; identical to SEQ ID NO: 68

SEQ ID NO: 36975 - DNA, 93 bp, Homo sapiens; identical to SEQ ID NO: 69

SEQ ID NO: 36976 - DNA, 58 bp, Homo sapiens; identical to SEQ ID NO: 1409

SEQ ID NO: 36977 - DNA, 92 bp, Homo sapiens
gtttgttattgtgcagaggtgcacatttctcgacgggatcctacaatttatctccgattctcagaagtgtgtgagcccaaataaattaagac

SEQ ID NO: 36978 - DNA, 58 bp, Homo sapiens
tgagtcagggtctcacactgtcacccacgttggagtgcagtggcacgatctcagctca

SEQ ID NO: 36979 - DNA, 58 bp, Homo sapiens; identical to SEQ ID NO: 36223

SEQ ID NO: 36980 - DNA, 56 bp, Homo sapiens
gagacagagtctcgctctgtcacccaggctggagtgcagtggtgagatctcgactc

SEQ ID NO: 36981 - DNA, 86 bp, Homo sapiens
gaaagattaagtggtttatccccaaacaagtgtcagagctgagagagtccaacccagttttgtttttggccattccagaatctttc

SEQ ID NO: 36982 - DNA, 72 bp, Homo sapiens
cttgccaggtgattcttgagtgtttttggtttggtttttggagacgaagtctcactctgtcacccaggctgg

SEQ ID NO: 36983 - DNA, 129 bp, Homo sapiens
tgtgtgtgtgtgtgtgtgtgtatgctcacatatataggtgtatatatatatatgctcacatatatatgtgtatatatatatgctcacatatatgtgtatatatatatgctcacatatatatgtgtgtat

SEQ ID NO: 36984 - DNA, 111 bp, Homo sapiens
ttatctgttgtacacttgggttattttgttattttattttattttattttattattttattttttgagatagagtctcactctgtcacccaggcttggagtgcagtggtga

SEQ ID NO: 36985 - DNA, 58 bp, Homo sapiens
tgagacaaggtctcactctgtcactcaggctggagtgcagtggcatgatcttggctca

SEQ ID NO: 36986 - DNA, 60 bp, Homo sapiens
tgtgtgcatgtgtgtatatatatatatgtatgtgtgtgtgtgtatacacacatatatata

SEQ ID NO: 36987 - DNA, 105 bp, Homo sapiens
tgcttgcctaatcacggagttaacacataaggttgctctgagaattcactgagaagattcacataaaatgcagcctcctaaccaaaagtataggcaacaaaagca

SEQ ID NO: 36988 - DNA, 84 bp, Homo sapiens
tgtgagtccattaaacttctatttgtttataaattacctatctcaggtacctctttatcagcaatgtgaaaatggactaataca

SEQ ID NO: 36989 - DNA, 113 bp, Homo sapiens
gcttatgtttcttacagtcatgtcccttgactgatatactgctttttccatattttctggaatgaatatatgtttcttttatacttgggtgggggcagggtgtggagtaaagt

SEQ ID NO: 36990 - DNA, 88 bp, Homo sapiens
tgctgtgtgtggctggggttggagatgagtctacagagagtcctataactacattcttaccattttcctctcccagtttcttgatgta

SEQ ID NO: 36991 - DNA, 58 bp, Homo sapiens; identical to SEQ ID NO: 47

SEQ ID NO: 36992 - DNA, 91 bp, Homo sapiens
aaaaagttgttgttgagaaatacacacatatagttgttgataaaggacattatatatatatgtgtgtatatatatacatcatgtccttttt

SEQ ID NO: 36993 - DNA, 108 bp, Homo sapiens
atgcttactaaagtaccaaatgttgcatgaaatactttgcatgtattttttattttaagttcaggggtacatgtgcaggatgtgcaggtttgttacataggtaaatgt

SEQ ID NO: 36994 - DNA, 95 bp, Homo sapiens; identical to SEQ ID NO: 68

SEQ ID NO: 36995 - DNA, 93 bp, Homo sapiens; identical to SEQ ID NO: 69

SEQ ID NO: 36996 - DNA, 113 bp, Homo sapiens
aaatgttgccacatgttacatatatttttgcataactgtctctatcagtcagggtccaggctacagacagatagcaaaccagttattttaagagagtgatgtggtttggattt

SEQ ID NO: 36997 - DNA, 115 bp, Homo sapiens
tcctacttaaaagggagaaatgggaatttccaggacaaaagccaattatctgacatttgagagtgaggaaaattgtgctaggtgggattttgcaggtccgttggaagttgaagga

SEQ ID NO: 36998 - DNA, 73 bp, Homo sapiens
gactgggcattggaatcagacacaccagcctttaagcactaccacaggctctctgtctctctgagccacagtt

SEQ ID NO: 36999 - DNA, 73 bp, Homo sapiens
ctgcctgtctcctgagctaataggccctgttgaggtaactgacaccctctgtctggctggaggaagacaggag

SEQ ID NO: 37000 - DNA, 81 bp, Homo sapiens
cttgagacattcacctttggagctttgagcccatggtagagggaacacagagagagatgacagagagcagagatgtccaag

SEQ ID NO: 37001 - DNA, 78 bp, Homo sapiens
ggcttagttggcaaatatatctcttctttggtgagcttttgggtttcttaggagtgagaacagagtttgcatgaagcc

SEQ ID NO: 37002 - DNA, 79 bp, Homo sapiens
ctcacttactcctcacagctctgtgtgagctctatgttaccattctttatttgatgagatcacacagcaaataagtgag

SEQ ID NO: 37003 - DNA, 78 bp, Homo sapiens
ttccttctgagtccccagagtccattgtatctttctttttttttgagatggagtctcactctgtcacccaggctggag

SEQ ID NO: 37004 - DNA, 92 bp, Homo sapiens
acacacatatatacaaatatatatgtgtgtgtatatgttatatatgtgtgtctgtgtgtgtatatattatatatatgtgtgtgtgtgtgtat

SEQ ID NO: 37005 - DNA, 91 bp, Homo sapiens
atgattaaaggcatgaaatgtctactgtcccacttgaagtcacatgattcatcactgggttcaggtgataccaggacactacatccatcat

SEQ ID NO: 37006 - DNA, 69 bp, Homo sapiens
gcaatgtcttgggagattatttatagaatgatattgatatgcattctgtctatctctcagaaatggcat

SEQ ID NO: 37007 - DNA, 108 bp, Homo sapiens
ttgttagttactattcaggttgtgatattaatcagattttgtagttgtgattactaattaggaaatcctgtattcaaatgataatttgattcaaatagtatcttataa

SEQ ID NO: 37008 - DNA, 60 bp, Homo sapiens
ctagcatatagtatctatatataatatctataatcttagcatatagatagtatatgctag

SEQ ID NO: 37009 - DNA, 87 bp, Homo sapiens
atgagagatgaaataatttttgtttgtatctatatatgtgtgtgggtacacatatatgtacatatctgtaaaacatcctcatttgtc

SEQ ID NO: 37010 - DNA, 68 bp, Homo sapiens
ccgaaggctctctgactgactccttctcagcttagcggctgaagactgacactgcgcgatcgcctcgg

SEQ ID NO: 37011 - DNA, 104 bp, Homo sapiens
tgtaaagttttcacagcagaaactgctgtatttatattaaatatattttaatgaagaagttaatatgtatggttatgattatcgcagtggtgaggcggctttca

SEQ ID NO: 37012 - DNA, 115 bp, Homo sapiens
gcaagacatttaaatttgcttgtcttcattcttgtctgtactatggaaattatgtctttattttatggtacaacatgaagtgaatgtgaaaagcagctagatttaactgttgtgt

SEQ ID NO: 37013 - DNA, 124 bp, Homo sapiens
agtagcagaatccttttagcaggctttaatgttaagcatgagattaccattatttgtaacattttttaaatagggacattttactgtttcttacattgctgcttatttatgttatttggcattt

SEQ ID NO: 37014 - DNA, 118 bp, Homo sapiens
tcggtctcccaaagtgctgggattacaggcgtgagggatcctttttttttttaaagtaaggcccaactggccagacgaggtggctcacgcctgtaatcccagcactttgggaggccga

SEQ ID NO: 37015 - DNA, 88 bp, Homo sapiens
ggaaaatgatccagataattgtggtattacaaatttgtttataaattatccagataattgtggtattacaaatttgtttttatttttt

SEQ ID NO: 37016 - DNA, 116 bp, Homo sapiens
ccacccaaagtgctgggattataggcatgagccaccacgtccggcctacagttttttttttttttaaatttgctgggtgtgctggcacatgcctgtagttccagctactcaggagg

SEQ ID NO: 37017 - DNA, 92 bp, Homo sapiens
tcagcctgggcaacatactgagacatcatctctacaatttttttttttttttttttttttgagacagagtctcgctctgtttcccaggctgg

SEQ ID NO: 37018 - DNA, 73 bp, Homo sapiens
gacttcctgggccagtgtctctgagtcagtcggaccaagcaaatggccagtagacatgtgttcaagtgcagtt

SEQ ID NO: 37019 - DNA, 100 bp, Homo sapiens
ggataacacccattttgcagaggaggagatggatattcagagaggtgaatatatatattttttgacatggtgtcttgctctgttgcccagggtgtagtgc

SEQ ID NO: 37020 - DNA, 83 bp, Homo sapiens
gagatggagtctcgctctgtccctgaggcactgccactgcagtggcgtgaccttggctcacggctcacggcaacctccacctc

SEQ ID NO: 37021 - DNA, 118 bp, Homo sapiens
agtgggcactgcagagtggtaaatcctgaaatactttctttattttttttgagacagagtctcagtctgtcatctaggctggagtggagtggcgtgatcttggctcactgcaacctct

SEQ ID NO: 37022 - DNA, 129 bp, Homo sapiens
tatatatatatatatatatatgtatatatatatgtatatgtatatatatatgtatatatatatgtatatgtatatatatatgtatatgtatatgtatatgtgtgtgtatatatatatatatatatatat

SEQ ID NO: 37023 - DNA, 85 bp, Homo sapiens
ggctggctgtgtgtgtgtcacccactcagacgcccacagggaccaggtggcggaaatgagcgaatgacccaggcgcatactaaac

SEQ ID NO: 37024 - DNA, 58 bp, Homo sapiens
tgagatggagtctcactctgtcacccaggctggagtgcagtggagtgatctcagctca

SEQ ID NO: 37025 - DNA, 75 bp, Homo sapiens
agcaaagggatgggggagactgtggagatttttttttttttttttgagacagagtctccctctgtcacccaggct

SEQ ID NO: 37026 - DNA, 91 bp, Homo sapiens
ccagtctgggcaacatagcaagacccctttcttctctaccaatttttttttttttttttgagatgaagtctcactctgtcacccaggctgg

SEQ ID NO: 37027 - DNA, 78 bp, Homo sapiens
agctatactcagcctcttcgtgtggcttgggcttcctcacagcatggcagccggattctgacacagtgactgagagct

SEQ ID NO: 37028 - DNA, 95 bp, Homo sapiens
gcagagggggaagagaagggggtgatgaaaaagtgggagagaaggaaggacctctctctccctgacactcttaagtctggcagtccttaatttgc

SEQ ID NO: 37029 - DNA, 84 bp, Homo sapiens
gggtctcactctgtcactcaggctggaatgcagtggcatgatcgtagctcactgcagcctcgaactcctgggctcaagtgatcc

SEQ ID NO: 37030 - DNA, 81 bp, Homo sapiens
gatgctgtctgtctatctgtctgtgccagagtgtctgagcactgggcaatcatgaagcacagatagggatagaccaatgtc

SEQ ID NO: 37031 - DNA, 96 bp, Homo sapiens
agggtttatttgaacgagaaaggaaatgtgcatatgctccaggatgtctgtgtatccaaagacacacgcacacactctctctctcacacacactct

SEQ ID NO: 37032 - DNA, 141 bp, Homo sapiens
gagaccctgactctgacaaaattaagataaaattgtgaaaagtcttcttcctcttcttcctttttttttttttttttttttcttgagacagggtctccctctgtcacccaggctggagtgcagtggtgtgatctcagctta

SEQ ID NO: 37033 - DNA, 86 bp, Homo sapiens
gcattttctaggatacttgtacatttttttcattttgaaacaatttcaaacttatggaaaagttgcaggtgtagtagcacaagagc

SEQ ID NO: 37034 - DNA, 70 bp, Homo sapiens
cacttcgggaggctgaggtaggtggatcacttgaggccaggagttcgagacctgcccggccaacatggtg

SEQ ID NO: 37035 - DNA, 79 bp, Homo sapiens
tcacagcccccagagcgaacttagaggggcttttttttttttttttgagacagagtctcactctgtcgctcaggctgga

SEQ ID NO: 37036 - DNA, 129 bp, Homo sapiens
gggcaacagagtaagactctctctgtctcttttttttttttttttgagatggagtctcactctgtctcccaggctggagtcaagtggcgcgatctcggctcactgcaagctctgcctcctgggttcaca

SEQ ID NO: 37037 - DNA, 99 bp, Homo sapiens
ggagcaagactatctcaaaagagaaaaaagaaaaagagaaaaaaagaatttccacctacttttttttttttttttttttttgagacagagtctcactct

SEQ ID NO: 37038 - DNA, 56 bp, Homo sapiens
agactgagagtctcactgtgtcgcccaggctgaagtgcagtgacgtgatctcggct

SEQ ID NO: 37039 - DNA, 77 bp, Homo sapiens
ggcagcatgttctctgcacaaagaaaatcagaagggattttctgttttttttttttgagacggagtctcactctgtc

SEQ ID NO: 37040 - DNA, 133 bp, Homo sapiens
gagggagtctggcagctttctagggggtgggagaggggatgggcactccaggtagagagaagatcctgtgcagagtcctcaggtaggagtgtgcttaacgtgtttgaggcactgcttggcatgcaccttcctc

SEQ ID NO: 37041 - DNA, 131 bp, Homo sapiens
ttgcaaactccattaagacccaccccacattgtcgttcctttttctgaatccaagttttgtttttgtttttgttttctgagacagagtctcgctctgtggtccaggctggagtgcagtggtgtgatcgtgg

SEQ ID NO: 37042 - DNA, 117 bp, Homo sapiens
atccacactgcttctgggtcagtgagtctctccttatcctttctttaaattttatttttatttatttatttttgttttttgagatgagatctcattctgcggcctgggctggagggt

SEQ ID NO: 37043 - DNA, 118 bp, Homo sapiens
cgtggtgtgcacacctgtaggcccagctgctcaggaggctgaggtgggagaatcacttgagaagactagagattatctacttgaacccgggaagcagaggtttcagtgagccgagatg

SEQ ID NO: 37044 - DNA, 87 bp, Homo sapiens
ctgggggctgaggtgggattagatgtgataatgatgatgataattatgatgatgctatcatgtattgggggctcacccaggtgccag

SEQ ID NO: 37045 - DNA, 76 bp, Homo sapiens
ggagtttagctctgagtgtagaatgtcagcacaattcacatattgtctgataactggattcagctggcagaagttt

SEQ ID NO: 37046 - DNA, 65 bp, Homo sapiens
tctctctgtgcgtgtctctgtgtccaagtttcccctttttatagggacatcagtcatatgggagg

SEQ ID NO: 37047 - DNA, 66 bp, Homo sapiens
aagtagacagtagatagataggtagatagatagacatagagatgtctcctattgcttctgtctctt

SEQ ID NO: 37048 - DNA, 104 bp, Homo sapiens
ccagcttctctcccaagcttccaaacttcaagttattgagtcactctgtctctgcatggaaggagtgatgaaggagtggagaagggccaggagtgggatgctgg

SEQ ID NO: 37049 - DNA, 118 bp, Homo sapiens
tgcttaggattgtcttggctataagggctcttttttggttccatatgaaatttaaagtagttttttctaattctgagaagaaagtcaatggtagcttgatgggaatagcattgaatct

SEQ ID NO: 37050 - DNA, 87 bp, Homo sapiens
acacagccataagtggtggggagtcagatttggagcccaagtcatccgactccagcgttgactctcttactcactgggctaatgtgt

SEQ ID NO: 37051 - DNA, 119 bp, Homo sapiens
ggagtggatgatttcttattgcaattttgatttgtgttttcctgatgactagtgatattgaacatttttcgtataacttttagccatttatatgtctgcttttgagaaatgtctatcca

SEQ ID NO: 37052 - DNA, 111 bp, Homo sapiens
aggctcagagatgttaagagagttgcccaaggtcactcagcttgaagtgactgtgctgagcctcaataccagtccgcttgatccctgatcccaaccctcttaattttgctg

SEQ ID NO: 37053 - DNA, 117 bp, Homo sapiens
gcattagtccctgctgtagctgggtcaagccctcctcctctctcagactcagtttttccttacttaaaagttgagatgatcagaccgaggttcctgccagtttctacattactatgc

SEQ ID NO: 37054 - DNA, 68 bp, Homo sapiens
gtataccatatgactgtgtgtgtgtacgtgtatgagtgcacacagacacacacacagacggtgtgtac

SEQ ID NO: 37055 - DNA, 118 bp, Homo sapiens
ggtagacatcactagtattttctgattgggtgtgcatgatctttttgtttttatttatttatttattttgagacagagtcccgctctgtcatccaggctggagtgcgatggcactatc

SEQ ID NO: 37056 - DNA, 90 bp, Homo sapiens
ccttctggagagaagcacacagatctcagtgagctaatgtggacgtcactgtcatccatggcggggtcaacctgggtgtggctgggaagg

SEQ ID NO: 37057 - DNA, 58 bp, Homo sapiens
tgagacagggtctcgctctgtcactcaggctggagtgccacagcgcgatctctgctca

SEQ ID NO: 37058 - DNA, 58 bp, Homo sapiens
tgagacggagtctcgctctgtcgctcagcctagagtgcagtggcgtgatctcggctca

SEQ ID NO: 37059 - DNA, 92 bp, Homo sapiens
ctttgcagataaaaatgtgatcttgttactctctgtctcacaccacagtaccacagtgtagcatgaaccacagcttcttgtcacctgcaagg

SEQ ID NO: 37060 - DNA, 58 bp, Homo sapiens
tgagacaaggtctcactctgtcacccaggctggagtgcagtggtgtgatctcggctca

SEQ ID NO: 37061 - DNA, 58 bp, Homo sapiens; identical to SEQ ID NO: 1265

SEQ ID NO: 37062 - DNA, 97 bp, Homo sapiens
gatatgtttgcttttctttatgagaaactatatatgtgtgtatatatatgtgtatatatatgatttttttttttttgagacagagtctcgctgtgtc

SEQ ID NO: 37063 - DNA, 123 bp, Homo sapiens
tgtcttgcaactagtatcttaattgtcaaattgtatggaaatttaaatactttaggttcaaaataatatttaaatataattatacatacaattctgtgtgcaattgtaagatataattattgc

SEQ ID NO: 37064 - DNA, 80 bp, Homo sapiens
catctctcagactctcagtgccggcccctctcggggacccttcccctctccccgctgtccctgaccttttctgggacctg

SEQ ID NO: 37065 - DNA, 65 bp, Homo sapiens
cagagttaagagtgcaggctgtgaggccaggcgcggtggctcacacctgtaatcccagcactttg

SEQ ID NO: 37066 - DNA, 74 bp, Homo sapiens
ggtttttttgagacagagtctggctctgtcacccagactggagtgcagtggcatgatctcgactcacagcaact

SEQ ID NO: 37067 - DNA, 94 bp, Homo sapiens
atatatgtaggcatatattaatatatataaatatacgtataaatctcataatatatgtatgcttgtgtgtgtttatatatgtgtgtatatatgt

SEQ ID NO: 37068 - DNA, 58 bp, Homo sapiens
tgagacagagtctcgcactgtcacccaggctggagtgcagtggcgccatctcagctca

SEQ ID NO: 37069 - DNA, 88 bp, Homo sapiens
atatgtacatacatgtgtatatatatgtatatataacgtatatatatatgttagggtgatatgtgtgtatatatatgtatgtgtgtgt

SEQ ID NO: 37070 - DNA, 95 bp, Homo sapiens
gcatcacacatttgattatgcagttactgcctgtctctctcactagaatgaaagttccataagacagacggaaacctgtctatcttgtttgctgc

SEQ ID NO: 37071 - DNA, 114 bp, Homo sapiens
gactgggccatgagttagtttcaaaagtgaaatgtcagggtccctgtttccctctacagaagctagaaatgcaggctctttgaccttgaagctgctagactctgagtcaccgtc

SEQ ID NO: 37072 - DNA, 108 bp, Homo sapiens
attgtgattcagtccctcccatccacagatgtccaagagcggtccctcataaacccactgtgtgtgagtctctgcctcagagtctgcttcccaggggaatacatagtc

SEQ ID NO: 37073 - DNA, 84 bp, Homo sapiens
aggaatctggaagacattgcacagaagatacaagggcacatttgtgattatgtatttctgtgaagcttctcctttccttcttcc

SEQ ID NO: 37074 - DNA, 84 bp, Homo sapiens
gtgcatgtttatgtatgtatatatgtatatacatgtgggtctgtgtctgtgtgtgtgtctgtatgtgtgcatgtgcatttgtgc

SEQ ID NO: 37075 - DNA, 87 bp, Homo sapiens
gtgtatgtatatgtgtatgtgtctgcatatgtatatgtgtgtgtctgtgtgtgtatgtttgtaagttgtatatgtatgtatatgtgt

SEQ ID NO: 37076 - DNA, 79 bp, Homo sapiens
taaacagacagtaaatgaaacaaatgggcagaggggtgtgtgtctgtaggtttctgtgtgtctgtttgtgtgtgtctgt

SEQ ID NO: 37077 - DNA, 117 bp, Homo sapiens
ctgtgtcttttaattggagcatttagcccatttacatttagggttaatattgttatgtgtgaatttgatcttgtcattatgatgttagctggttattttgctcattagttgatgcag

SEQ ID NO: 37078 - DNA, 80 bp, Homo sapiens
ctgctcagttttctctctgacaatggccaggtcagccccaccctcctgattacagtgtaagcagagagggcaactggcag

SEQ ID NO: 37079 - DNA, 70 bp, Homo sapiens
gacttgctgagggcagggaccaggtccctggtttgctgggtctctgtttctgactctcggaatgagggtt

SEQ ID NO: 37080 - DNA, 98 bp, Homo sapiens
gctgtgaggataagtgagagaaaagtgtttgaggcagagggaacagcaagtgcaaaggccctgaggtagaaggatgcttggtgtatttgagaaatagc

SEQ ID NO: 37081 - DNA, 114 bp, Homo sapiens
actatcctgctcctgttcaagcatttggattgggggaaagacagtgtacctcatcagaggagtctgagctctcagccccagagaatgaattgatggaagccaaccatggaaagt

SEQ ID NO: 37082 - DNA, 115 bp, Homo sapiens
ctaggacttcctaaacttctttttgctgtatgcatgtatttatttatttttcaatttcattttattttattaagttctgggatacatgtgcaggatgtgcaggtttgttacatag

SEQ ID NO: 37083 - DNA, 73 bp, Homo sapiens
caggaacagacgacactggtctccagcctcacttgcaaagattgcctctggagacccactcactgtgactctg

SEQ ID NO: 37084 - DNA, 106 bp, Homo sapiens
actaatttgctttcctgaatgtggaacttttgatgtgctgtttttttttaattttaattttaaatttgtacattccgggctacatttgcaggatgtgcaggtttgt

SEQ ID NO: 37085 - DNA, 113 bp, Homo sapiens
ttgggttgcaattgttgatggacagaaggaggggaaaacaccactatgtgtcaggcactgtcacatactttacataatttttgcctcatttggtacctaaaacagttatttga

SEQ ID NO: 37086 - DNA, 85 bp, Homo sapiens
tattaccaacatatatacatatacataggtatacatgtttatatatgtatacatgtttatacatgtatataattttgatgtaata

SEQ ID NO: 37087 - DNA, 111 bp, Homo sapiens
tctttatcaaagttgttgtggccattgtagatattttgcatttcatatgaattttagaatcagtttgacaatttctaccaaaaataaagccaactgggattttgattggga

SEQ ID NO: 37088 - DNA, 95 bp, Homo sapiens
attggcatgttgtatagcacataagtctagtgggtattgtttatataatatacattgtcaatctatgtatttattataacagttctttggccgat

SEQ ID NO: 37089 - DNA, 79 bp, Homo sapiens
tgagatggagtctcgctctgtcgctcaggctggagtgcaatggcgtgatctcggctcactgcaacttctgcctcctgag

SEQ ID NO: 37090 - DNA, 58 bp, Homo sapiens; identical to SEQ ID NO: 10913

SEQ ID NO: 37091 - DNA, 116 bp, Homo sapiens
gctgaggcattagggtccagggcccagggtgattaaaaagctactattttattttattttttaaaatagagacagtgtctcactttgtcacccaggctggagtgcagtgctatggt

SEQ ID NO: 37092 - DNA, 109 bp, Homo sapiens
cccagtatggcctgtactactgggctggcccatcacaggcattcagaacagtgggaatgaatgaatgaatgaatgaatgaataagcagagtgtaatggggcacactggg

SEQ ID NO: 37093 - DNA, 70 bp, Homo sapiens
tgtatgtatgcatacatgtgtgtatatatgtatgtatgtactatatatataatatgtgtgtatatttaca

SEQ ID NO: 37094 - DNA, 58 bp, Homo sapiens; identical to SEQ ID NO: 1265

SEQ ID NO: 37095 - DNA, 109 bp, Homo sapiens
tgtgtcaggtcatagcatagtatcttggattttatcaaattagaagagagaacatttatttttttaaatgcagggaataagaggtgaaaatgctgaacagggttacaca

SEQ ID NO: 37096 - DNA, 58 bp, Homo sapiens; identical to SEQ ID NO: 1265

SEQ ID NO: 37097 - DNA, 58 bp, Homo sapiens
tgagttggagtctcactctgtcacccaggctggagtgcagtggtgtgatctcggctca

SEQ ID NO: 37098 - DNA, 102 bp, Homo sapiens
tcttctctgattctgtgctcatgccaaacttgttaaatatttaaatatcatccttgtttctagtacttagagtggtgtctggcacattgttggagctcaaga

SEQ ID NO: 37099 - DNA, 118 bp, Homo sapiens
tttatggttgaatagtactccattgttgtatctgtaccacattttctttcttttttttttcccttcaacttttaagttctggggtacatgtgcaggatgtgcaggtttgttacatagg

SEQ ID NO: 37100 - DNA, 88 bp, Homo sapiens
cagctggaaggggtcttcagagactgtttatattttatttatttatttatttatttattttgagacagagtctctgtcacccaggctg

SEQ ID NO: 37101 - DNA, 73 bp, Homo sapiens
cagcctgggcgacagagcaagattgtgttcttttttttttttgagacggagtctcactctgtcacccaggctg

SEQ ID NO: 37102 - DNA, 58 bp, Homo sapiens
tgagacagagtctcactgtgtcacccaggctggagtgcaatggtgagatcttggctca

SEQ ID NO: 37103 - DNA, 70 bp, Homo sapiens
gtgtgtgtatatatgtgtgtgtatgtatatatgtgtgtatatgtgtgtatgtatatatatgtacagatgt

SEQ ID NO: 37104 - DNA, 67 bp, Homo sapiens
gcgggggggtcagagtctctctctgtcacccaggctggagtgcagaggcatgatcatggctcactgc

SEQ ID NO: 37105 - DNA, 108 bp, Homo sapiens
gtttttgagacagaatcttgctctattgcccaggttggagtgcaatggtgctatctccgttcactctctctgcctctcaggctcaagtgattctcccacctcagccac

SEQ ID NO: 37106 - DNA, 111 bp, Homo sapiens
tcagttactgtactgtgtgaccacaggcaaactgcttaattctctgtgtctcaggttcttcccttacatttaggagaaagtagtacctacctcataaggttgtatgactga

SEQ ID NO: 37107 - DNA, 77 bp, Homo sapiens
gattattaagtctcagtgaaggatacatgggggtgcatcacatcctctctgctttttttttttattgagacggggtc

SEQ ID NO: 37108 - DNA, 89 bp, Homo sapiens
gcctaattcagtagccggtgtgagtagaccctcagcacatagcagctgactgtccctatttgcgctggggcaacatgaagagcagaggc

SEQ ID NO: 37109 - DNA, 58 bp, Homo sapiens
tgagacaaggtctcactctgtcacccaggctggagtgcagtggtgtgatcatagctca

SEQ ID NO: 37110 - DNA, 70 bp, Homo sapiens
ttgttttgagacagagtctcgctctgtcacccaggctggagtgcagtggcgtgatcttggcttactgcaa

SEQ ID NO: 37111 - DNA, 117 bp, Homo sapiens
gagtttgagatgggttgtctaggctgatgggatgcagagcaagacttttttttttttttttgagacggagtcttactctgtcacccaggctggagtgcaatggtgtgatcttggctc

SEQ ID NO: 37112 - DNA, 83 bp, Homo sapiens
atgtgtgtgtatatatatatgtgtgtatatatatacacacacatatatgtatatatatatgcgtatgtatatatacacacaca

SEQ ID NO: 37113 - DNA, 56 bp, Homo sapiens
gagacagagtctcactctgtcgcctaggctggagagcagtggtgagatcttggctc

SEQ ID NO: 37114 - DNA, 90 bp, Homo sapiens
ttgagacagagtctcattcactctgtggcccagtctcattcactctgagtgcagtgggcttcccaggttcaagagattctcctgcctcag

SEQ ID NO: 37115 - DNA, 162 bp, Homo sapiens
tataattatatatattacatatatttataatatataattatatattttatatatttaatatatataattatatattttatatacttataatatatataattatatattttatatatttataatatatataattatatacattatatatatgtgtattatata

SEQ ID NO: 37116 - DNA, 111 bp, Homo sapiens
acagagtgagaccctgtctctagaaaaacaaacaagttggccaggcacagtggctcacatctgtaattcaagcactttgggaggccaaggtgggcagatcacttgaagcca

SEQ ID NO: 37117 - DNA, 102 bp, Homo sapiens
acaaaagcgaaactccatctcaaataataataataataataatttattatttttaaaaattctttttatttattatttttttgagatggagtcttactctgt

SEQ ID NO: 37118 - DNA, 113 bp, Homo sapiens
aggtcatgccactgcactccatcctgggcaacagagtgagaccctatctttttttttttttttgagacggagtctcactctgtcacccaggctggagtgcagtggcacaatct

SEQ ID NO: 37119 - DNA, 103 bp, Homo sapiens
gtgacttgtcttaagctaggtggtacagtatggcaatcagaaacctcacattttttttttttgagacagtctggttctgtcacccaggctggagtgcagtggc

SEQ ID NO: 37120 - DNA, 88 bp, Homo sapiens
gcctttttagttgtctgtgaatggtgtgagggcagggttgagtcttactgttgtatcccgagcaccagtgcccagcacagagccaggc

SEQ ID NO: 37121 - DNA, 56 bp, Homo sapiens
tgagagagtctcgctctgtctcccaggctggagtgcagtggtgcgatctcggctca

SEQ ID NO: 37122 - DNA, 69 bp, Homo sapiens
ttgtttttgagacagtctcactgtgtcgcccaggctagagtgcagtggcacaatctcagatcactgcaa

SEQ ID NO: 37123 - DNA, 85 bp, Homo sapiens
cccagagtgctgggattacaggcatgagccacggcgcgcagccagtggcagctgtgtctatatctgtctgtccgcacacactggg

SEQ ID NO: 37124 - DNA, 89 bp, Homo sapiens
aggttagaaagtgacaggagtgagggtggagggcaagagttccctccaggtcctctgatttcccctgaccttgttctaacttctctgcc

SEQ ID NO: 37125 - DNA, 111 bp, Homo sapiens
gccaggcacggtggggcgcgcctgtagttccagctacttgggaggctgaggtaggaggatcctttgagcccacaagtttcaggttgcaatgagccatgatcgtgccactgc

SEQ ID NO: 37126 - DNA, 99 bp, Homo sapiens
agctatttggaaatgaaagtgaaattctttttattttacttggaaatccttatatccaaggaagaaacccaagattgccctcacagcaggtccaaagct

SEQ ID NO: 37127 - DNA, 89 bp, Homo sapiens
ggctacaactttgtagaagttggtattgattacctgaaattattttttacctttagagtactgatttagatgcttgttagagttgagcc

SEQ ID NO: 37128 - DNA, 97 bp, Homo sapiens
gtacagagtatatattgatctgttttttagagctgtttggattttctaagtaaaattcaaaggaaatcttctcaacatgtctacattttacctgtat

SEQ ID NO: 37129 - DNA, 112 bp, Homo sapiens
cattgtaattttttaagttatgtagactattaatataatttcaatataatgaagagacttaaaatttttcattatgaacagatgttaggtgtggtaaacttgggagccagtg

SEQ ID NO: 37130 - DNA, 58 bp, Homo sapiens; identical to SEQ ID NO: 884

SEQ ID NO: 37131 - DNA, 56 bp, Homo sapiens; identical to SEQ ID NO: 885

SEQ ID NO: 37132 - DNA, 88 bp, Homo sapiens
gcaaggtgagactgagttgggatgagtgtgacacttgcctcaggtgcaaatttatttttttattttttgagctatgttctcactttgt

SEQ ID NO: 37133 - DNA, 60 bp, Homo sapiens
ggacagaaaagagatgggcccctttggagcatctttggggctcggtctctctctgactcc

SEQ ID NO: 37134 - DNA, 118 bp, Homo sapiens
aagagtgagaatgaaaaaaccagcacatgtgggggaaggctggggaagggatttgattatatatttaagtgactgaattcagttctctctcatttcctggacaatagttctgtttttt

SEQ ID NO: 37135 - DNA, 82 bp, Homo sapiens
tggtactgacatgctcacagcgtctgtgggaggaaagatggaacaccagccacgtagagaagagagtgaggtgtcgtcatca

SEQ ID NO: 37136 - DNA, 78 bp, Homo sapiens
ataaagagatatctagaagacactcccattgcctatgggaatgacttgggctgggatcttttttatttatttatttat

SEQ ID NO: 37137 - DNA, 58 bp, Homo sapiens
tgagagagggtctcactctgtcgcacaggctggagcacagtggtgtgatcttggctca

SEQ ID NO: 37138 - DNA, 81 bp, Homo sapiens
ccacgtcctcatgtcggtctgagggattttttttttttttttaatttttgagaaggagtctcgctctgtcacccaggctgg

SEQ ID NO: 37139 - DNA, 73 bp, Homo sapiens
ttgtttttttgagccagagtctcgctctgtcacccaaactggagtgcaatggcatgatctcggctcactgcaa

SEQ ID NO: 37140 - DNA, 113 bp, Homo sapiens
agactccttctcaaaagaaaaaaaaaattgaggtgaaattcacataatataagcttaaccattttattttattttgttttattttatttatttatttttttgagacagagtct

SEQ ID NO: 37141 - DNA, 105 bp, Homo sapiens
gtcattcatccctttgcctggcttggtgaatctgaaatttttttttttttttttttttttttttttttttgagtctcgctgtcgcccaggctgcagtgcagtggc

SEQ ID NO: 37142 - DNA, 58 bp, Homo sapiens; identical to SEQ ID NO: 2276

SEQ ID NO: 37143 - DNA, 90 bp, Homo sapiens
gccttggcctcccaaagtgttaggattactggtatgagccactgtgcttggctaacgttaattttattttatttttttttgagatgaggt

SEQ ID NO: 37144 - DNA, 119 bp, Homo sapiens
gtgggtaggatttccgcttatcttgttctggttctgttctggccactgtctgtctgtctgaaagagggtcagccctgagtttgcgtgaggagagggggagggagaaacgcaatatccca

SEQ ID NO: 37145 - DNA, 118 bp, Homo sapiens
ggatgcccttgtcggggtttctggaggtgggggtggggagaagcagtagagagtgagctgaagccatccatgactctttcctccctgtcttccacccatagaagtacccagaggttct

SEQ ID NO: 37146 - DNA, 114 bp, Homo sapiens
tgcaaagctttgtgactctagtgaagatttgagtcttcaatgatttcttttatttatttatttatttatttttttagagatgaagtctcactctgttgcccaggctggagtgca

SEQ ID NO: 37147 - DNA, 116 bp, Homo sapiens
gcatcctgggaacagcctgtcaaacacagtgtggctctgtgaggccccagagaagctggagaaattgtagttctgatcaccccaggagtcacgctgcagtcactttcctagactgc

SEQ ID NO: 37148 - DNA, 94 bp, Homo sapiens
acaaagccagtagggtgagatttcaaattccaaattccccaatttttttttttttttttgagagggactctcgctctgtcgctcaggctggagt

SEQ ID NO: 37149 - DNA, 78 bp, Homo sapiens
tatatatatatatacacacacacacacatatatatacatatatatgtgtatatatgtgtgtgtgtatatatatatata

SEQ ID NO: 37150 - DNA, 58 bp, Homo sapiens
tatatacacacacacatatatacacatatatatgtatatatatgtgtgtgtgtgtgta

SEQ ID NO: 37151 - DNA, 129 bp, Homo sapiens
ctgttccctgtctgggcttggctgggcctggcagatctggcctgggcatggctggggatgctggcttctgtctctgtctgggtgtggccacagggccctggtgagggctgcccacctcaggaatgggga

SEQ ID NO: 37152 - DNA, 58 bp, Homo sapiens; identical to SEQ ID NO: 14455

SEQ ID NO: 37153 - DNA, 95 bp, Homo sapiens
ggttcagcaaggtgtgggcagagagtgactgttgtctgtgaccacaaagtagggccacaaagcttcaaagcagttgcatcctcctttcattttgc

SEQ ID NO: 37154 - DNA, 85 bp, Homo sapiens
cctccctgggcggtggggggggggggtgtcacttatttattatttatatttttgagacagagtctcactctgtcacccaggctgg

SEQ ID NO: 37155 - DNA, 58 bp, Homo sapiens; identical to SEQ ID NO: 2540

SEQ ID NO: 37156 - DNA, 96 bp, Homo sapiens
ggtgacagaacaaagaccctgtctctcaaatatatatatgtgtgtgtatatatatatatatccttcttttttgagatgcagtcttgctctgtcttc

SEQ ID NO: 37157 - DNA, 86 bp, Homo sapiens
tatagtaagttcagtaaagttgcagaatataaaatatacaaaaattagttgtatatttttgtatacaactggctgaaagatttgta

SEQ ID NO: 37158 - DNA, 113 bp, Homo sapiens
ccaccgcacccggccgagaacagatttttcaaaaaaagaccaataaggaattgctcaaacagattttttttttttttttgagacggtctcttgctctgtcactcgggaggtgg

SEQ ID NO: 37159 - DNA, 104 bp, Homo sapiens
ttgagacaagagtcttgatctgttgcccaggctagagtgcagtggcctgatcacggctcactgcagtctcagtctcctgggctcaaaagatcctccagcctcag

SEQ ID NO: 37160 - DNA, 116 bp, Homo sapiens
ggcagtcatcagaccccttggagttagcttcttgatgtgtctgatggggataatattggtgcctggctcccaggatggctgtcaggatgaaatcagatgatacatggaactcactc

SEQ ID NO: 37161 - DNA, 113 bp, Homo sapiens
gggcatggtggcccacatctgtggtcccagccacttgggaggctgaggtaggaggatcacttgagcctgggagggggaggctgcagtgagccatgatcctgccactgcactcc

SEQ ID NO: 37162 - DNA, 70 bp, Homo sapiens
ctggaagggacagagtgtttttgtttgtttcttttttccccctgagacagggtctcactctgtcacccag

SEQ ID NO: 37163 - DNA, 73 bp, Homo sapiens
gaggcagagtctcgctctgacacccagactggagtgcaatggcatgatcttggctcactgcgagctctgcctc

SEQ ID NO: 37164 - DNA, 67 bp, Homo sapiens
gctgattcaaaggaggagatgagagactagtattggtttctcatctgtctgtctgtctgttgtcagt

SEQ ID NO: 37165 - DNA, 64 bp, Homo sapiens
gcatagtgatttgtgcctgtggtcccagctatttgggaggctgaggtaggaggatcacttgagc

SEQ ID NO: 37166 - DNA, 78 bp, Homo sapiens
ctgggattacaggcatgagccactgtgtccggccaaatttttttttttttgagacagagtttcactcttggtgcccag

SEQ ID NO: 37167 - DNA, 101 bp, Homo sapiens
gatgggggagggcaattctgagcagaatgaagcagtacagtgttgatggggggacctcggttattttattttttttttttgagacagagtctcactctatc

SEQ ID NO: 37168 - DNA, 72 bp, Homo sapiens
ctcctgccttggtttcccacagtgctgagagtatcgacgtgatgggctctcactctgtcacccaggctggag

SEQ ID NO: 37169 - DNA, 116 bp, Homo sapiens
gagagagagtgggtacagctgtaacacgttgggtctgagtcagtttttggttatttttttgagacacagtctcactctgttgcccaggctggagtgcagtggtggaatctctgctc

SEQ ID NO: 37170 - DNA, 82 bp, Homo sapiens
ctgcgctccagcctggtgacagaatgagactgcctaaaaaaaaaaaaaagagtctcgctctgtcacccaggttggagtacag

SEQ ID NO: 37171 - DNA, 81 bp, Homo sapiens
ctgggcagcatggtgagaccccatctctcttttctttcttttttttttttttttgaggcagagtcccactgtgtcacccag

SEQ ID NO: 37172 - DNA, 116 bp, Homo sapiens
ggtgtgagccactgtgcctggccttaaggttttttggttttggttttgttttttttttttttgagacagagtctcgctctgtggcccaggctggagtgcagtggcatgatctcggc

SEQ ID NO: 37173 - DNA, 79 bp, Homo sapiens
tgacagagcaagactccgtctcaaaaaaaaaaaagaaaacattatttattatcttttgagacagggtctcactctgtca

SEQ ID NO: 37174 - DNA, 58 bp, Homo sapiens; identical to SEQ ID NO: 9327

SEQ ID NO: 37175 - DNA, 72 bp, Homo sapiens
ctgggcatggtggcacgtgcctgtagtctgaaccagtctggaggctgaggtaggaggatcactcgagcccag

SEQ ID NO: 37176 - DNA, 84 bp, Homo sapiens
acagagtttacagacaaattgtctctcagaaatccacaagttctccacataattatttttttttgagacggggggtctctctgt

SEQ ID NO: 37177 - DNA, 70 bp, Homo sapiens
acatggtgaaactctgtctccttttttttttttttttttttttttttttggagacagagtctcgctctgt

SEQ ID NO: 37178 - DNA, 118 bp, Homo sapiens
ttgggctcaaaccctcccgcctcagcttgccgagtacttgggactacaatcgcccagctaatttttatatttttttgtagtgtctgggtctcgctctgttgcccagggtggtctccaa

SEQ ID NO: 37179 - DNA, 113 bp, Homo sapiens
tactttcagcatatatcacagtacgaaatcatttatatatatatatatatatatatatatatatatatatatatatatatatatattttgtttgtttgtttgttttctgagta

SEQ ID NO: 37180 - DNA, 84 bp, Homo sapiens
tttggtctctggcagccttgcaccctttttatttttatttttattttttttgagacagggtcttgctctgtcacccaggctgga

SEQ ID NO: 37181 - DNA, 57 bp, Homo sapiens
tgagtcgagtctcactctgtctcccaagctggagcacagtggcatgatcttggctca

SEQ ID NO: 37182 - DNA, 88 bp, Homo sapiens
tgggggaggttttgcgtgtgtggagacagagtgcacaggaccgtccgtactttctgctccattttgctgtgaatctaacactgcccca

SEQ ID NO: 37183 - DNA, 79 bp, Homo sapiens
gggattacaggcgtgagccaccgtgcccggctttttttttttttttttttttttttggtggagtctcactctgtcaccc

SEQ ID NO: 37184 - DNA, 59 bp, Homo sapiens
gagactgagtctcactctgtcgcccaggctggagtgcagtggtgggatgacctcggctc

SEQ ID NO: 37185 - DNA, 82 bp, Homo sapiens
gatttgttttattccttttctttgtgttatagataactttgaatttaattttatctggagaggaaaaggtgaaaatcaaatt

SEQ ID NO: 37186 - DNA, 78 bp, Homo sapiens
tgtatatgtgtatgtgaatatatgtatatgaatgtgcaatcatatgtatatgtctgtatatgtgtatatttacacata

SEQ ID NO: 37187 - DNA, 106 bp, Homo sapiens
caggggaagccgactctctccatgcctgagtgcatggcatttcagagccagctctctgggtttggggttcagctggcatgaggtctggtccaggcaggctgacctg

SEQ ID NO: 37188 - DNA, 75 bp, Homo sapiens
gccctcaggggaaggtgggcagcagagttatccagcctgcgggtctctctctggctgtcctccaccctaggaagc

SEQ ID NO: 37189 - DNA, 82 bp, Homo sapiens
cttctgtgtgattatgtagcatatgattaggtagatttaaaatttttttaaagaatacctatttactaagtgctaccaggag

SEQ ID NO: 37190 - DNA, 116 bp, Homo sapiens
gctccagcctgggtgacagtgcgagactccatctcaaaaaaaaaaaaaaaaaaaaaaaccctaatttttttttttttttttgagacagagtctcgctctgtcgcccaggctggagt

SEQ ID NO: 37191 - DNA, 73 bp, Homo sapiens
ccatctgaagtgggagaggatctacatcttttgtttgtttttagacaaggtctcactctgtcacccaggctgg

SEQ ID NO: 37192 - DNA, 104 bp, Homo sapiens
gagtctttagacttaaacataggttttattatgtatcagtaacttttttttttttttattagagagaggatttttgctgtgttgcctaggctggtctcaaactc

SEQ ID NO: 37193 - DNA, 130 bp, Homo sapiens
cctgggtgacaaagtgagaccctgtctcaaaaaataaaaaaatttattttattattattattttaatttttttttgagactctgtcactcactctatcactcaggctggagtgcagtggcaccatctcag

SEQ ID NO: 37194 - DNA, 58 bp, Homo sapiens
tgagatggagtctcgctctgtcactcaggctggagtgcagtggtgcgatcgcagctca

SEQ ID NO: 37195 - DNA, 60 bp, Homo sapiens
ggaacagggggctggtcttgaactcttttttttttgagaccaagtctcactctgtcaccc

SEQ ID NO: 37196 - DNA, 105 bp, Homo sapiens
ccagacacactgcttgctctttctcctggaactagaatgaaggcgaagtctgagtgcagagagagttctgggcatcaaggaggggtgataggcagtattgaaggg

SEQ ID NO: 37197 - DNA, 95 bp, Homo sapiens
agagagactccatctcaaaaaaaaaaaaagagaaaaaagaaaaaaaagatcattttgtttatttatttttatttttcttgagacggagtctctct

SEQ ID NO: 37198 - DNA, 58 bp, Homo sapiens; identical to SEQ ID NO: 637

SEQ ID NO: 37199 - DNA, 58 bp, Homo sapiens; identical to SEQ ID NO: 884

SEQ ID NO: 37200 - DNA, 56 bp, Homo sapiens; identical to SEQ ID NO: 885

SEQ ID NO: 37201 - DNA, 81 bp, Homo sapiens
cacctcagctctccaagtagctgggactacattttttgttttttaaagacagggtcttgctttgttacctggactggagtg

SEQ ID NO: 37202 - DNA, 101 bp, Homo sapiens
acatgttcctgggattgtcagtgtatttcccaagaaaaaacaagagtagtgatctcttggaatgaaaacaagatagatgattaaggaaattaggaatgtgt

SEQ ID NO: 37203 - DNA, 95 bp, Homo sapiens
ccacacagctgggacaacaggcgtgcactaccacatccagctaattattattttttttttttgagacggagttttgctcttgttgcccagggtgg

SEQ ID NO: 37204 - DNA, 80 bp, Homo sapiens
gtggcgtgtggtgaggaggaggcgctcaggggcctgtctggatgcagagcctccctgtgtcgctgtctcactggactcac

SEQ ID NO: 37205 - DNA, 91 bp, Homo sapiens
gaggctcccaagccgtctcagttctcaaagccccttgtgtctcagtgattttttttttaaattgggcaggctctgaagccagaccagcctc

SEQ ID NO: 37206 - DNA, 107 bp, Homo sapiens
tgaaaggtatcttactgaagccattgttttttgttttttgtgttttttttacgagttgaattactttaaaaaattgaacatggtagctttgtttaaaggacctttta

SEQ ID NO: 37207 - DNA, 115 bp, Homo sapiens
tattagtcttcatatatttctggtttttttgttttttttttttttttagtttataaaaagaaaggttttggactgtggaaaaatagctgaatctggtgtgatttcagactcagtg

SEQ ID NO: 37208 - DNA, 72 bp, Homo sapiens
agagaaatagaaccaataggacatagctagctagctggatggctgtctgtctgtctgtgtatctatctatct

SEQ ID NO: 37209 - DNA, 75 bp, Homo sapiens
acgtgagactaggggggcacgactggagaaatgttgggcctttattgcgctctgtgtgtctgtctgtctgaatgt

SEQ ID NO: 37210 - DNA, 74 bp, Homo sapiens
tttgttttttgagatggagtctcactctgtcacccaggctggagagcagtggtgggatctcagctcactgcaag

SEQ ID NO: 37211 - DNA, 87 bp, Homo sapiens
gagtttaaaaattttatgttttacatttaagcacacaattcattatgagttaatttttgtaaaggtgtgagacataggtcaaggctc

SEQ ID NO: 37212 - DNA, 57 bp, Homo sapiens
cctgttcctgtctgtccgtctcacccagaaggaggagagggccacggctgggctagg

SEQ ID NO: 37213 - DNA, 116 bp, Homo sapiens
agtgcacttacttttggtctttgctcaaatatgtgctatatatatgtgtgtgcatttatgtttgtatattatatatatttttattttacatagctataatcaaatgtacatgcact

SEQ ID NO: 37214 - DNA, 85 bp, Homo sapiens
gcattggctgccagtttggtcactgggctgtcacctgccctcagagatggtccatagatgatgtgacaaaagacagagcccaggc

SEQ ID NO: 37215 - DNA, 58 bp, Homo sapiens; identical to SEQ ID NO: 36524

SEQ ID NO: 37216 - DNA, 105 bp, Homo sapiens
tgggtattatggggttgaaatcaaggcgttagcagggctgctccttctggaggctctaggagagaatttgttgttgtttgagacagggtctggctttgttgccca

SEQ ID NO: 37217 - DNA, 68 bp, Homo sapiens
gttgtctgagactctgagaatgtgggcgccaatcaaccatctcccagtctccctgaaagagagacggc

SEQ ID NO: 37218 - DNA, 76 bp, Homo sapiens
ggcagggccaggaggctctgtttctaaaggcttttttttttttttttttttttttgagacagagtctctctctgtc

SEQ ID NO: 37219 - DNA, 117 bp, Homo sapiens
cgggcacagtgggcagtgaggccagtgcgtgcgcaggggccccgggcacagtggacagtgaggccagtgcgtgcgcaggggccccgggcacagtggacagtgaggccagtgcgtgcg

SEQ ID NO: 37220 - DNA, 73 bp, Homo sapiens
gttctcattcttcttagtcaggtagtaatagaggacgcactcagccactgtctgtgggacagagaaagaggac

SEQ ID NO: 37221 - DNA, 73 bp, Homo sapiens
gcccgcctctcagccccagcgctggaggaaggagtctgctcccctctctgcctgagtctctgtgtgtgtgtgt

SEQ ID NO: 37222 - DNA, 89 bp, Homo sapiens
ggcctggtgtaggtggtaccccgaaatctgggctttaagcacaccctgtctgtgctctcagcctcagtctctctgtttgcaaactggtc

SEQ ID NO: 37223 - DNA, 115 bp, Homo sapiens
cctgtcctggttggacacttcctggctgtgtgaccttgggcaagtcacttactgtctctgagcctcagttttcccatctggcaaatggaagttgcatctttccccacctcatagg

SEQ ID NO: 37224 - DNA, 109 bp, Homo sapiens
gggtgagatgggaaggacgcagacgggggcagatgacttgagtgcaaagttcactggctgtgtgacctcgggcaagatgcggaacctctctgtgcctcagtttcctcat

SEQ ID NO: 37225 - DNA, 68 bp, Homo sapiens
gtcatcttcccaagtcggaccccaaaaccgtgctcagttctcacccagggtctgaccttggttaagac

SEQ ID NO: 37226 - DNA, 134 bp, Homo sapiens
ggatgaatgcacagctggagctggaggcatgaactcagatttccctcccatctccctgggctccctctcagcctctctgcctgcttcttgggcatcttcccaccctcgaaaggtggcacccccagggctcaggt

SEQ ID NO: 37227 - DNA, 102 bp, Homo sapiens
cagagatattttgtgcatataacgggatacatgtatgtacatatatgtgtttgtatgcatacatgtatgtacatatatgtgtttgtatgcatacatgtactg

SEQ ID NO: 37228 - DNA, 87 bp, Homo sapiens
ctgtcccatgcccagctttagccattaggtccttacttgaggggaggcctccacactccctgcctgcctgactggctgggcgtccag

SEQ ID NO: 37229 - DNA, 67 bp, Homo sapiens
tatcactttttttttttttgagacagagtctcactcactctgtcgcccaggctggagagcagtggtg

SEQ ID NO: 37230 - DNA, 135 bp, Homo sapiens
gggtgacagtgagaccctgtatctaaaaaattaaattaaaaaaaaaatttttttttgaaacagaatctcactctgtcacccaggctggagtgcagtgttgcgatctcagctcactgccatgtctgcctcccgggt

SEQ ID NO: 37231 - DNA, 97 bp, Homo sapiens
cctccctctcctgtaaaaacctctctctctggctctgcttctggggccctggatctaggtcaggagggctgtgatttaaaacaaggtgccagggagg

SEQ ID NO: 37232 - DNA, 82 bp, Homo sapiens
ggagccggctgtcttgtatgcatcagtccctgggggtccttcaaaccaccccccaaggaaggcactgtggtaagcaggttct

SEQ ID NO: 37233 - DNA, 108 bp, Homo sapiens
ttgtgccactgtactccaacctgggcaacaaagtgaaatcccatctcttttttttttttttgagacggagtctggctctgtcgcccaggctggagtgcagtggtgcga

SEQ ID NO: 37234 - DNA, 119 bp, Homo sapiens
ggtgggattgccatccctgaaacaagtgaatgtgaagagaatttttatttatatttttaattaaacatattatttaaaatttttttttaatttttttttttttgacacggaatctcgct

SEQ ID NO: 37235 - DNA, 60 bp, Homo sapiens
aaccctgtgtctggctcactgcttccagatctctggaatctggtgccatctattggagtt

SEQ ID NO: 37236 - DNA, 58 bp, Homo sapiens
tgagaccaagtctcactctgtcacccaggctggagtgcagtggcatgatcttggctca

SEQ ID NO: 37237 - DNA, 110 bp, Homo sapiens
gccagtgtggtggcgcacgcgtgcaaccctagctactcaggaggctgaggtggaaggatggcttgaactggggaggtggagattgcagtgaactgtgatcacgacactgc

SEQ ID NO: 37238 - DNA, 114 bp, Homo sapiens
gctggtagaggcagacatctgatgaatgcaaagacttttatttgtccagatgacagaagaatgtgaagaaactggtcatttgaaatctagctccatcatgctctccttatcgcc

SEQ ID NO: 37239 - DNA, 91 bp, Homo sapiens
ccatatcaggcagcgtctgcctgtctgcctggcagtctctggaagcttcagttgctgctgtttgtgggctgggtggcggttgcctgtttgg

SEQ ID NO: 37240 - DNA, 98 bp, Homo sapiens
cagccccgtgagatacatagtattcttttttctctttttcgtttttgtttttttttttttttttttggagatggagtctcactgtgtcacccaggctg

SEQ ID NO: 37241 - DNA, 119 bp, Homo sapiens
cctcctcctcctcctcctccccccggcgctcgctcgctcgctcactctctcgctggctcgaggggcggccggcagatggcgatggcagaggcggcggcggcggcggcggcgcgaccggg

SEQ ID NO: 37242 - DNA, 65 bp, Homo sapiens
gaccagagcagctggggcgggcatggccggggctgctgggcctctctgtctgtctccatgtggtc

SEQ ID NO: 37243 - DNA, 102 bp, Homo sapiens
ctgctttctgtggattatctcagaatcctcgcactgatctgtatttttcattttatagagggatctatgtggaggtgctgagttgtcaaaggacactggcag

SEQ ID NO: 37244 - DNA, 102 bp, Homo sapiens
agggaggaatgcccagtgtttcactccaaagcaaagatgtcagaatttatttatttttattttgtcagtttattttgtttatatgtaagccactgtttccct

SEQ ID NO: 37245 - DNA, 67 bp, Homo sapiens
gcatgtgtgggtctgaccctgactctgagaatctcctccttccatcagactcacaggctccaaatgc

SEQ ID NO: 37246 - DNA, 65 bp, Homo sapiens
ggaagagagtttgtaatgttctgacaggactttttaaaggtcacagaacagtcagagtttttttc

SEQ ID NO: 37247 - DNA, 96 bp, Homo sapiens
gtaaagtggggtaatgacagtagctgctctgggcattgctctttctgtctcagtgtctatctgggctgctctgctcatgtccgttgcctgcttggc

SEQ ID NO: 37248 - DNA, 112 bp, Homo sapiens
caccttctgccgtgattgtgaggcctccccagacatgtggaactgtgagtcccttaaacctctttttctttataaattacccagtctcaggtatgtctttgttagcagtgtg

SEQ ID NO: 37249 - DNA, 78 bp, Homo sapiens
ggccaaggagaggctgctagttaaggaatcacagctggtgaaaggcagagcatgtttcccactcagtctctctgtgcc

SEQ ID NO: 37250 - DNA, 63 bp, Homo sapiens
tggggagggagacttttttttttttttttttttttttgagacggagtctcgctctgtcaccca

SEQ ID NO: 37251 - DNA, 72 bp, Homo sapiens
cacacacacacacacacacgggtatatgtatgtatatgcgtttatatacatctgggtgtgggttatatggtg

SEQ ID NO: 37252 - DNA, 88 bp, Homo sapiens
gctttgcgttattactttacatatatgtgtatgtatatatgaataaaaatatatatacacacacatatatgtgtgtgtgtatgtctgc

SEQ ID NO: 37253 - DNA, 106 bp, Homo sapiens
tgtttaaaaaaaagatggaaacacccattgttggcaaagatgtggaggaaacataatttttagattttgttggcagggctgtaaaatactatcatcattttggata

SEQ ID NO: 37254 - DNA, 65 bp, Homo sapiens
atgccacacaggttgaggtttttgtgcgtgtgtgcgcatatgtgtgtgactgtgtgtgtgtgcat

SEQ ID NO: 37255 - DNA, 72 bp, Homo sapiens
agagagatatatatgcacacacgtatgtatgtatatatgtgtatatatatgtgtgtatatctatatctctct

SEQ ID NO: 37256 - DNA, 56 bp, Homo sapiens
gagacaaggtctcactctgtcacccacgctggagtgcagtggtgtgatcacagctc

SEQ ID NO: 37257 - DNA, 58 bp, Homo sapiens
ggtgcctgccaccatgtctggctaattttttatattttagtcgagacagggtttcacc

SEQ ID NO: 37258 - DNA, 91 bp, Homo sapiens
ctcctttccttagaatgtaagttcaaagaaagcagggatcttatccactgctgtaatcctggaacttttttttttttttttggagatggag

SEQ ID NO: 37259 - DNA, 79 bp, Homo sapiens
agagtggacattccctgaaagtgattttataaatgtaagcattacttttttttttttttttgagatggtgtctcactct

SEQ ID NO: 37260 - DNA, 105 bp, Homo sapiens
tactttattttataacaatttgtaatttcacacacacaatctgagtgtaagaagcatgtctgctttattcagtgtgttgattctgcacctgtaaagaaaatggta

SEQ ID NO: 37261 - DNA, 112 bp, Homo sapiens
ttgccataaatctcgtgtgtgtgtatgtatatatatttacacaggcatatgtgtgtatatatatttatatatacacacgtatgtgtgtagtatttatgtgtacacatgcatg

SEQ ID NO: 37262 - DNA, 100 bp, Homo sapiens
gcagtagctgccgcaagctcagtcattttgtcactggctgttttcttgtgctgaaggcagatgaggcaggttaggcggcagatgaggcaggttaggcagc

SEQ ID NO: 37263 - DNA, 95 bp, Homo sapiens; identical to SEQ ID NO: 68

SEQ ID NO: 37264 - DNA, 93 bp, Homo sapiens; identical to SEQ ID NO: 69

SEQ ID NO: 37265 - DNA, 83 bp, Homo sapiens
tatatgtatatatatgtgtgtgtgtgtatatatatatatatatacacacacacacacacatatatatatacatatatacatac

SEQ ID NO: 37266 - DNA, 80 bp, Homo sapiens
ccgaccccacactctcactctgtttgcgtattcagggctccagtggagttcttaggaaaaagggttaggcaggggcttgg

SEQ ID NO: 37267 - DNA, 117 bp, Homo sapiens
gttcagccatccctagctttttctcgccttctcaatgtgagtcgggcacctgtcctctgtgcctgcctcactgcgtgggacacgtggccaggcctgcaagtgctggtggagctgttc

SEQ ID NO: 37268 - DNA, 207 bp, Homo sapiens
gggtgtttgtgtgtgggtgtgtatatatatgtatgtgtgtgtatatatgtatgtatatgtatatatttgtatgtatgcatgtgtgtatatgtatatatgtgtatatatgtgtgtatgtgcacataagtatgtatgtgtgtgagtatatgcatgtgcatatgtgtatgcatgtgtatatatgcatgtatatatgtatgtgtatgtgta

SEQ ID NO: 37269 - DNA, 139 bp, Homo sapiens
ggttgacttttcaaaagcctaaaggcgggaaagcacagatgtgttaggaaaatagtagggagactctgtgactctggctctcctacctacagagcttgttaattctgttcagccaagtggtagattctggctgtattcc

SEQ ID NO: 37270 - DNA, 58 bp, Homo sapiens
tgagatggagtctcactctgtcactcaggctggagtgcagtggcatgatttggactca

SEQ ID NO: 37271 - DNA, 105 bp, Homo sapiens
tatggtgtggttgagacagtatctcaggtgccttctaactccctgtgtgtcagcctctgtgagaaagggcacagtttggttgcagctgtactataggaggatgga

SEQ ID NO: 37272 - DNA, 215 bp, Homo sapiens
gctatatatatatatgtgtatatatatgtatatatgtatatatatgtatatatgtatatatatgtatatgtgtatatatatgtatatatatgtatatatgtgtatatatgtatatatgtatatatacgtgtatatatacgtatatatatacgtgtatatatatacgtatataatatatatatacgtatatatatacgtatatatatatatatgta

SEQ ID NO: 37273 - DNA, 78 bp, Homo sapiens
gtgctgttcttttatgtgtgtgtgcgtgtgtcctactatatataaaggattatatatatatatatatatatatagtat

SEQ ID NO: 37274 - DNA, 118 bp, Homo sapiens
actgcctttggcagcctcttctgcagcagggtgtggctctgtgactgggtcctaagatttttttttttttttttttttgagacggagtctcactctgtcgctcaggctggagtttagt

SEQ ID NO: 37275 - DNA, 85 bp, Homo sapiens
aaattatctgggcgtggtggtgtacatctgtagtcccagctacgtgggaggctgaggtaggaggatcacttgagcccaggggttt

SEQ ID NO: 37276 - DNA, 77 bp, Homo sapiens
atttgaaatatgtacagaaaatatgtatatatgtatacacatatatatgtatatgtgtactgtataggaaaacaaat

SEQ ID NO: 37277 - DNA, 86 bp, Homo sapiens
gttattcaccgtcagtctatggtggatgtcacacagtcggaagggaaagaaggtgacactagtgagtgagggtggcctggtgtagc

SEQ ID NO: 37278 - DNA, 64 bp, Homo sapiens
tatgtgcactgtgtgtatataggtatgtgtattgtgtatatctgtgtgtatatctgtgtgtata

SEQ ID NO: 37279 - DNA, 81 bp, Homo sapiens
gagtgagcctgtttctttgtgagtcaggggctgtgggctgtctaccctcagcccattcagcacagaagacagtgagcaatc

SEQ ID NO: 37280 - DNA, 84 bp, Homo sapiens
atatatgtatgtattgaaattacatgcatatacacatatgtatatatgtatgtctgtgtgtgtgtgtgtgtatatatatatata

SEQ ID NO: 37281 - DNA, 70 bp, Homo sapiens
atatacacacacgtatacatatatacatatatacatatgtatatgtgtgtgtatatttatgtatgcatac

SEQ ID NO: 37282 - DNA, 117 bp, Homo sapiens
ccagtttgttcttttggcttaggattgtcttggcaatgtgggctcttttttggttccatatgaactgtaaagtagttttttccaattctgtgaagaaagtcattggtagcttgatgg

SEQ ID NO: 37283 - DNA, 109 bp, Homo sapiens
gtcaggatggtaaatataaggtgtggctgtcagtctccctctgtttctgtgcttgatgaaggcagagggaaggacaatagtgcatttgagccttccttttgaaaccgac

SEQ ID NO: 37284 - DNA, 91 bp, Homo sapiens
gttttctcagtcatctctgtgtctctctctggtaatggtccaggacttatgtctatgtattatgtgacagcttagacagtgctgaggattc

SEQ ID NO: 37285 - DNA, 68 bp, Homo sapiens
tttttttgagacagtctcgctctgtcacccaggctggagtgcagtggcgcgatctcagctcactgaaa

SEQ ID NO: 37286 - DNA, 71 bp, Homo sapiens
tgtatctgcatctgtatctgcatgtagacaagatggatatccatctgtctatatcttgacatacatataca

SEQ ID NO: 37287 - DNA, 106 bp, Homo sapiens
tattatatatacagtatggtataatagtatatatacacatgctgtatgtatatatatatactatcagtgtgtgcatatatatactataccatatatctacatagtg

SEQ ID NO: 37288 - DNA, 75 bp, Homo sapiens
gtggagacagtttagcattgtgctcggaacccgtgtttgggctgacttacttggttcaatactaggctttcccac

SEQ ID NO: 37289 - DNA, 77 bp, Homo sapiens
ttgtatttttttgtgagacagggtctcactctgtcacccaggctggagtgcagtggtgtaacctctgctcactacaa

SEQ ID NO: 37290 - DNA, 67 bp, Homo sapiens
cccacactcgctcactcacatgctccctccctcaaggggctgagcacaattggctgagtaaatgggg

SEQ ID NO: 37291 - DNA, 142 bp, Homo sapiens
agtatacaaacatgatttgagaggggggaattgataagggtcaggataatttccctttcctgtaattttttttttttttttttttttgtgactgagtctggctctgtcacccaggctggagtgccagatctcagtggcgaga

SEQ ID NO: 37292 - DNA, 58 bp, Homo sapiens
tgagtcagagtctcactctgtcacccaggctggagtgcagtggcaggatcttggctca

SEQ ID NO: 37293 - DNA, 116 bp, Homo sapiens
acatttctcttgggtaacaagtaggtttttgttagtggatgaattttcaatgtatatttataatctgccaaaattcatgatactgacaagagaactcacaatatattctgagctgt

SEQ ID NO: 37294 - DNA, 79 bp, Homo sapiens
tatataagatatatataagtatatatgtatatatgtaagatatatgtacataagcatatatgtatatatataagatgta

SEQ ID NO: 37295 - DNA, 111 bp, Homo sapiens
gagaagtcacctcaaaccaggctctacctggttgattcagttcttcttctttttttttttgagagggagtctcgctctgtcacccaggctggagtacagtggcatgatctc

SEQ ID NO: 37296 - DNA, 67 bp, Homo sapiens
cctggtttaagcacactgcccggctgtggaggtggtgcctgcacactgtctcagtgtgtaagccatg

SEQ ID NO: 37297 - DNA, 110 bp, Homo sapiens
acaaaaagggagccaaaccaagaaggaagaaagtgtttttcgcatccattccagtgaagatagtgtgcaaacagaaatcagttcttttagcatggaaacttcccctctgt

SEQ ID NO: 37298 - DNA, 74 bp, Homo sapiens
agtcagttcatctctctcagtgtgtctgagtctggggcttttataggcacgggataggggagtgtgtgctaact

SEQ ID NO: 37299 - DNA, 67 bp, Homo sapiens
tgggaaagcttgctctcactctgtctcacgtccctgtgaggacacagcaagaaggctgccatccgca

SEQ ID NO: 37300 - DNA, 69 bp, Homo sapiens
cactcggcctggtgggctgtgcttggctcctgttaccagcctcaatttcacacccactgtggctcagtg

SEQ ID NO: 37301 - DNA, 112 bp, Homo sapiens
cagaatagatggcagctgcctctttccagacttttaaaggtgtcagactctctcttagaatctctgttagatccaggaaaggcctggaaagggaggcctggctgcgttactg

SEQ ID NO: 37302 - DNA, 73 bp, Homo sapiens
gggctgagaagggaagaaaaaatggggagtgcctgttaatggcctcagagtttctttttttcttttttaaatc

SEQ ID NO: 37303 - DNA, 78 bp, Homo sapiens
gctgcagtggaaacttcagatccaggtgcatggattggaagccatgtgtggagtgagtgtagacagttaccactcagc

SEQ ID NO: 37304 - DNA, 67 bp, Homo sapiens
tacgtatgtatgcatgcatgtgtatacatgtatgtatgtatatacatgtatgtatgtatgtatatat

SEQ ID NO: 37305 - DNA, 95 bp, Homo sapiens; identical to SEQ ID NO: 68

SEQ ID NO: 37306 - DNA, 93 bp, Homo sapiens; identical to SEQ ID NO: 69

SEQ ID NO: 37307 - DNA, 95 bp, Homo sapiens; identical to SEQ ID NO: 68

SEQ ID NO: 37308 - DNA, 93 bp, Homo sapiens; identical to SEQ ID NO: 69

SEQ ID NO: 37309 - DNA, 63 bp, Homo sapiens
tgagtcttctctctgtgtcaggtgctgttttaaggtctgagatgcagagggggcacagtctca

SEQ ID NO: 37310 - DNA, 80 bp, Homo sapiens
cagaaaaaagaaaaaatgcactctgatgatgaagggactgagtcaaattcacaaccagggtctttttttttttttttttg

SEQ ID NO: 37311 - DNA, 76 bp, Homo sapiens
ttgatgctgcagcctttgtttgtttattttttggagacagggtctcactttgtcacccagactggctggagtacag

SEQ ID NO: 37312 - DNA, 101 bp, Homo sapiens
ggattaatttggatttttttattttagattcaggaagtgcatgtgcaggtttgtttcctggttacattttctgatgctgaggtttgggtcatgaatgatcc

SEQ ID NO: 37313 - DNA, 98 bp, Homo sapiens
gtctacctagagaacttgagaggcagaaatatgaggggaatgaagtgtgcagggagactgaaacatgcgtatgtgtgactctggagctagaataagac

SEQ ID NO: 37314 - DNA, 101 bp, Homo sapiens
ttcgagtagctgggattacaggcactcaccaccatgctgggctaatttttatatatttagtacagacaggattttgccatgttggccaggctggtctcgaa

SEQ ID NO: 37315 - DNA, 62 bp, Homo sapiens
tctgtatatgtgtatacatgcatgtatatacatgcacatgtatgtatatatgtatatacaga

SEQ ID NO: 37316 - DNA, 107 bp, Homo sapiens
caagctccaggagggtttgaattgtgagaagtgagacacgacactgggggcaggaatctgtctggagccacactgtcgtaatcctctcttgactctgctcttgcttg

SEQ ID NO: 37317 - DNA, 93 bp, Homo sapiens
tgtaacttatttttatgtattgcagtaatctaggtgagagaagacagggacttggatcaggatagcagcagcagaggtgtaagtgagtgtgca

SEQ ID NO: 37318 - DNA, 79 bp, Homo sapiens
ccccatgtctcaacgcagtgaagagagatgcttagcatagggactggcttctcaatctcaatatcatcagcgtttgggg

SEQ ID NO: 37319 - DNA, 147 bp, Homo sapiens
gggctcagttttcagaccctctgatttttaaggtaaaataagaaaacagattctaaataaaatttcttttttttttttttttttttttttgagacagagtctcgctctgcctcccaggctggagtacagtggcgtgatctcggctca

SEQ ID NO: 37320 - DNA, 75 bp, Homo sapiens
tgcatttcagatataaatgtacacacatatgtgtatgtatttatataatatgtgtgcatttatgtgtgtgtatat

SEQ ID NO: 37321 - DNA, 79 bp, Homo sapiens
gactgtgttctaggtccagaaggtgtcgccgagtagactacaaagctttggctctgtctctgtgaattattgcattgtc

SEQ ID NO: 37322 - DNA, 115 bp, Homo sapiens
gcaggaggttcaggctgtccaggggcaaggggtgtagacatgctggactggaagctgcatgcaggcaggctgaggctggctcaggcagacatatgttcttcagccttgtttttgt

SEQ ID NO: 37323 - DNA, 103 bp, Homo sapiens
tggcagtctggggcccaccatggaccacaatgatgcgcttctgcacctctcccactgtgcctggcacaaatctggtgcctggtgaatgcttgatggatggaca

SEQ ID NO: 37324 - DNA, 120 bp, Homo sapiens
cgcgtgcgtgcaggtgtgtgtgcctgtgtgcgtgcatgtgggtgcttgtgcctgtatgtgtgtgtgcctgtgtgagtgcctgcgtgcgtgcatgtgggtgggtgtgcctgtatgtgggtg

SEQ ID NO: 37325 - DNA, 84 bp, Homo sapiens
tttgtgtatgtgtgagtgtgtgcatatgggtacatgtgcctatgtgtgtgtgagtgcctgtgtgtgtgcctgtgtatgtgtgag

SEQ ID NO: 37326 - DNA, 81 bp, Homo sapiens
gtgtttctagtggatgctggaatcattatttgccaaaagcttctaatttttttgggattccggactgtctgtctgtcacat

SEQ ID NO: 37327 - DNA, 83 bp, Homo sapiens
ggtctcactctgtcacacaggctggagtgcagtgggcatgagcatggctcactgcagcctcaagctcctgggctcaggagatc

SEQ ID NO: 37328 - DNA, 82 bp, Homo sapiens
gtgggaagcaggagagcaggaatttgacccaagagagtctgctctgaagaccatgtttcttcttgtttcttctttttttcac

SEQ ID NO: 37329 - DNA, 94 bp, Homo sapiens
gcttcttcctgaaagtctggcatcggagtaaagtgacttttttttttttttgagatggagtctcactctgtcgcccaggctggagtgaagtggc

SEQ ID NO: 37330 - DNA, 97 bp, Homo sapiens
tgacagagcaagatgtctcaaaaaaataaataaataaataaaagaggctttttctttttttttctttttttttttgagaccaagtctcactctgtca

SEQ ID NO: 37331 - DNA, 77 bp, Homo sapiens
agtggttcagtggctcacgcctgtaatcccagcactttgggaggctgaggtggtaggatcatttgaggtcaggagtt

SEQ ID NO: 37332 - DNA, 241 bp, Homo sapiens
tgtgtatatatctctatatacgcacatgtatgtgtatatatctctacgcacatgtatgtgtatatatctatatatacgcacatgtatgtgtatatatctatatatgtgtatatatacatatatgcatatcttatattgtgtgtatatagtgtgtatatatgtatacttacaaatacatatatgtatatatacatatgtgtatttatatatacacacacacatatgtatatatagtttgtgt

SEQ ID NO: 37333 - DNA, 61 bp, Homo sapiens
tcatccctcagtgactgtgtctctggttcctaccaggtccaaatgccaacaggaggggcga

SEQ ID NO: 37334 - DNA, 95 bp, Homo sapiens; identical to SEQ ID NO: 68

SEQ ID NO: 37335 - DNA, 93 bp, Homo sapiens; identical to SEQ ID NO: 69

SEQ ID NO: 37336 - DNA, 104 bp, Homo sapiens
atattctatgtactcaaagcatacaacatgataatttgatattatatatacattgtgtagttattttcaatatatctctgtactgtgtcggttggggggagtat

SEQ ID NO: 37337 - DNA, 78 bp, Homo sapiens
gattcgagagagagaggctgttctttcctggacgctctcagacgctcagtgattcagaactcgtttttgtttcaagtc

SEQ ID NO: 37338 - DNA, 95 bp, Homo sapiens; identical to SEQ ID NO: 68

SEQ ID NO: 37339 - DNA, 93 bp, Homo sapiens; identical to SEQ ID NO: 69

SEQ ID NO: 37340 - DNA, 87 bp, Homo sapiens
gtatggtgactgcacctgctaatggcagtttccattgtattcatcagagtataatcaagagacagaatctgcatcagtcatttgtac

SEQ ID NO: 37341 - DNA, 74 bp, Homo sapiens
tatatgtgtgtgtgtgtgtgtgcatgttcatatagatgtatatatgtgtgtgcatgttcatatatatgtatgtg

SEQ ID NO: 37342 - DNA, 77 bp, Homo sapiens
gagctgtagagagagtgcagaatcagcgcccaggagccagtcccaggccaccacctgatcttcatcttctttagctc

SEQ ID NO: 37343 - DNA, 82 bp, Homo sapiens
agatgtgctgcctctctccacatgcaacctacgttccaaatgtaaatttgtatgtgtgcatctggttggggaaatctaaatc

SEQ ID NO: 37344 - DNA, 111 bp, Homo sapiens
tatatctatatactaatctatatatctagatatatttctatatagatatatctataacatactgctatagatatatctatattgatacattgatatgtacatatggctata

SEQ ID NO: 37345 - DNA, 120 bp, Homo sapiens
ctgcctcacacggttagggtgaggattaaatgagttgatgtacctaaaccacacctttttctttttcttttctttttttttaaggcagcgtctcgctctgtcacccaggctggagtgcag

SEQ ID NO: 37346 - DNA, 107 bp, Homo sapiens
gaatatgatgtatgtgcacatatatgtatagatagataagtatcttgtacagtactgtttttgttagtgtggggcatctgtcaccataggtgtgtaagacagtgttc

SEQ ID NO: 37347 - DNA, 58 bp, Homo sapiens
acacatataacatattatacacatataacatattgtgtgtgtgtgtgtctgtatgtgt

SEQ ID NO: 37348 - DNA, 72 bp, Homo sapiens
tgtgtgcatgtacgtatatgcgtgtgtgtatatacattatatatatacctacatatacatatatgtagtata

SEQ ID NO: 37349 - DNA, 95 bp, Homo sapiens; identical to SEQ ID NO: 68

SEQ ID NO: 37350 - DNA, 93 bp, Homo sapiens; identical to SEQ ID NO: 69

SEQ ID NO: 37351 - DNA, 118 bp, Homo sapiens
gttttgttattcctggaatgataccactcagtcaagatactgctgaaacttacttagatttttttaacttttatttcttttgcacatctttgcactggtattttgggggccgctctac

SEQ ID NO: 37352 - DNA, 56 bp, Homo sapiens
atgtaagtatgtgtgtgtgtgtatatatatatatacacacacacacatgcatatat

SEQ ID NO: 37353 - DNA, 75 bp, Homo sapiens
ggcagaattatggcttgaggttgggggtgataataataataattattattttttgagacaaagtctcgctctgtc

SEQ ID NO: 37354 - DNA, 68 bp, Homo sapiens
gggctcacacatgtgactttgttgtttattcagtgaataggcatgaggatttgtgctgttgggggccc

SEQ ID NO: 37355 - DNA, 113 bp, Homo sapiens
gggactttactgagaaatggctgatcctagatctgagtggaaagatacaggagatctatctatctatctatctatctatgatatataatagatataggatgagcctggagcct

SEQ ID NO: 37356 - DNA, 97 bp, Homo sapiens
tccatttttggattgttcattgctagtgtgtagagatttttttgagttttacatgttgatatttttgtcctgcaaacttgctgagctgatttgtgga

SEQ ID NO: 37357 - DNA, 67 bp, Homo sapiens
gtgcccaccgaagctccagactcctggaaggaaagcaggtgttcagtgtgagctgtgtggtgtgcac

SEQ ID NO: 37358 - DNA, 76 bp, Homo sapiens
aatgaacaaggacagcttggaggttagaagcacgatggagttaggtcagatctctttcactgtctcagttatcatt

SEQ ID NO: 37359 - DNA, 59 bp, Homo sapiens
ttgggatggagtctcactcactctgttgcccaggctggagtgcagtggcgcaatcttgg

SEQ ID NO: 37360 - DNA, 95 bp, Homo sapiens; identical to SEQ ID NO: 68

SEQ ID NO: 37361 - DNA, 93 bp, Homo sapiens; identical to SEQ ID NO: 69

SEQ ID NO: 37362 - DNA, 68 bp, Homo sapiens
cggcctgagaacgtggcacagagtcactgggcaaagcacccaacggctctggctgacttcacatgctg

SEQ ID NO: 37363 - DNA, 75 bp, Homo sapiens
ttggcctcacaagactgtgagcagagcgcctggctgagcctgcccagacgcctgacccacagagctatgagctaa

SEQ ID NO: 37364 - DNA, 69 bp, Homo sapiens
ggacgatgtctctctctgtgtccatgatccccacccccagggcatggtgggccctgagaaagggaggcc

SEQ ID NO: 37365 - DNA, 186 bp, Homo sapiens
atatacacatatatgtgtatgtgtatatatgtatatatgtatatatatacacatgtatgtgtgtatatatgtatatatgtatatatatacacatgtatgtgtgtatatatgtatatatacacatatatgtgtatatatgtatatacacatatatgtgtatatatatattgcccaatttgtttgtac

SEQ ID NO: 37366 - DNA, 113 bp, Homo sapiens
gtgatctgtgatccatcccgtactttacatggagagttcaatatatacatacatacatatatatgtgtgtattttttttttttttttttggagacagggtctcactctgtcac

SEQ ID NO: 37367 - DNA, 86 bp, Homo sapiens
atgtatttgtatatatgtgtgtatatatatctgtgtgtatctgtgtatatatgtgtgtatgtatatatatctgtgtgtatctacat

SEQ ID NO: 37368 - DNA, 89 bp, Homo sapiens
gcagtgggcggaggtgagacgtgagtgagctgaggaggttggctggagcgagatcctgagggtttctcttcgtctccacggcctggtgt

SEQ ID NO: 37369 - DNA, 84 bp, Homo sapiens
gtatatatacatatatagtatatactgtatatatacatatacagtacatactgtgtgtatatatatacatatacagtatatact

SEQ ID NO: 37370 - DNA, 58 bp, Homo sapiens
tgagtcagagtcacactctgtcacccaggctggagtgcagtggtgggatctcggctca

SEQ ID NO: 37371 - DNA, 116 bp, Homo sapiens
gctcactaggcttctattgagatgatcgtgtaatgtagctcctgatatgtttaattatattgattaatttttaaatgtcaagttaatcttacatttctggggtaatgcctacttgc

SEQ ID NO: 37372 - DNA, 123 bp, Homo sapiens
gtgtcagttagagattctttttcttttattttttctttcctttttgagatggagtctcactctgtcacccaggctggagtacggtggcacaatctcggctcactgcaaccccgcctaccgggt

SEQ ID NO: 37373 - DNA, 73 bp, Homo sapiens
ggccagcattttccagttttcctcagcctgcaggactctctgctgtctgtcgctgtgactgaaggtggtggcc

SEQ ID NO: 37374 - DNA, 62 bp, Homo sapiens
tgtgtggactgtgtgcatgtgcatgtgcatgtgtgtgtatgcgtgtgcatgtatgctgtgta

SEQ ID NO: 37375 - DNA, 120 bp, Homo sapiens
ccccaggctttaccaggtgccccctcagagcctccaggatgggcctgcaactctgtccctcacaccctggggagcttgcaccccattctgtgccagcaaaagaaggtatctcaggccagg

SEQ ID NO: 37376 - DNA, 61 bp, Homo sapiens
ccgtgggaggaggcgtcagagacaggcccttgcctgtcactgtctgtgtttcctgatacgg

SEQ ID NO: 37377 - DNA, 60 bp, Homo sapiens
ttgagacagggtctcactctgtcacccaggctggagtgcagtggtgtgatcttagctcaa

SEQ ID NO: 37378 - DNA, 73 bp, Homo sapiens
gagacagctctggggtgggccctgggcgtggctatgatcccagcctcccagtatccatgtcctgggtggtctt

SEQ ID NO: 37379 - DNA, 96 bp, Homo sapiens
gggtgtgagtgacaggcccgccctgctgtctgggtgtgagtgacaggcccgccctgctgtctgggtgtgacaggcccgccctgctgtctgggtgtg

SEQ ID NO: 37380 - DNA, 97 bp, Homo sapiens
tgcctgaaagttcgagcctgagagttcacacagaggactttatcctggaactggactccttgctgactctgtacacggcctcagaatttttcagaca

SEQ ID NO: 37381 - DNA, 72 bp, Homo sapiens
taaggatgaagatggtgatgaggatgaggaggataaaaattgcagccccgttactcactcactgtgtccttg

SEQ ID NO: 37382 - DNA, 114 bp, Homo sapiens
gaaaaatctcaacaaaggagctacagaatgctttccccagactgtctgtctgacaccaggtaaggagagttgacacacaggtaaggaaagaataagtaatcatggagataggtc

SEQ ID NO: 37383 - DNA, 108 bp, Homo sapiens
gcctgggcagcagagcgaggctctgtctcaaaaaaaaaaaaaaaagaaagaaagaaaaaagtattagccaagatatgcggaaagaggattcgtgtatgctgtttgtgt

SEQ ID NO: 37384 - DNA, 116 bp, Homo sapiens
gaggactgtgagtgacagagggacaggagcccagggatgcactgtgtctgtctgtctgtgcaggagcccagagacctcaggcagccccaggcttccaagctagcatttgtgctcat

SEQ ID NO: 37385 - DNA, 71 bp, Homo sapiens
gcatgggtgcattcatatgcacacgtgtcttgtgtacatgcatgtgtgcctgtgtgtgagtgtgcgcctgt

SEQ ID NO: 37386 - DNA, 85 bp, Homo sapiens
gtagttgagggtggtcctgggacatgcttgtatattttagaggtgcagagtgtagaatttagaagtaaaaggccatcgtgattgc

SEQ ID NO: 37387 - DNA, 81 bp, Homo sapiens
ctgctccttcaggaataatcatgtgagactcccatcaaaggaacttcccagtgccagtctcactgtcttattccagagcag

SEQ ID NO: 37388 - DNA, 77 bp, Homo sapiens
tggtgatgatagtggtgatgattatattgatggtggtgataattatgttgatgatgatgatcatgacagtatcagca

SEQ ID NO: 37389 - DNA, 81 bp, Homo sapiens
cattgagaagtgggagtgcggctcacaaatccactcagcctgggaggggtggggaggctgacacacactgactgtctcatg

SEQ ID NO: 37390 - DNA, 58 bp, Homo sapiens
tgagatggagtctcactctgtcacccaggctggagtgcagcggtgtggtttcggctca

SEQ ID NO: 37391 - DNA, 93 bp, Homo sapiens
ctgttggcaatacaggtgcccagggtggggaggaagcctcaggattggggtctgtggggtctgtctgcctgcctgcctgcctgcctgaagcag

SEQ ID NO: 37392 - DNA, 71 bp, Homo sapiens
gtcttccagtgtcttcaaacaaggaactcagccagctgattgagagtgcctgtgttcaggagggtggggac

SEQ ID NO: 37393 - DNA, 88 bp, Homo sapiens
tcaatttctttaatgggtatggaaataatcaaattatctagttcatattgggttgaattgtgataatttgtgcttttgaagaaactgg

SEQ ID NO: 37394 - DNA, 118 bp, Homo sapiens
gtaaattgtcacatgagagatagcaggccctgaaagaaatctaagtattttacccaaaaatctgtttatttatttctggaatggccctgcacagctgtctcttgtgggggaaatttgc

SEQ ID NO: 37395 - DNA, 93 bp, Homo sapiens
gtgctgggattataggtgtcagccaccacagctgactgataatttacttttatatagtatatctcaactgatggctgtttaccttcccttcat

SEQ ID NO: 37396 - DNA, 60 bp, Homo sapiens
tgagacagggtctctcgctctgtcacctaggctggagtccagtagcgtgatcttggctca

SEQ ID NO: 37397 - DNA, 93 bp, Homo sapiens
atggtggtgtgcactggtagtcccagctactagggaggctgaggtaggaggatcgcttgagtctgggagttggaggctgcagtgagctatgat

SEQ ID NO: 37398 - DNA, 88 bp, Homo sapiens
agagtttgttttggaagctgaatgagttctggagctggatggtggtgacggttatacaacaattttttttttttttgagacagagtct

SEQ ID NO: 37399 - DNA, 58 bp, Homo sapiens; identical to SEQ ID NO: 1725

SEQ ID NO: 37400 - DNA, 58 bp, Homo sapiens; identical to SEQ ID NO: 315

SEQ ID NO: 37401 - DNA, 127 bp, Homo sapiens
cctgtggggcagaagggaggccaagggcatttttttgttttttttggggcagtctcactctgtcacccaggctggagtgcagtggcgcaatctcggctcactgcaacctctgcttcctgggttcaag

SEQ ID NO: 37402 - DNA, 60 bp, Homo sapiens
tctcgtcacacacctgcggcccacgggcttctgctcagctgtcgctgtgtcagtgacaga

SEQ ID NO: 37403 - DNA, 93 bp, Homo sapiens
ccagcctggccaacatggtgaaaccctatttctttttctttttttttttttttttttttttgagacagagtctcgctctgtcgcccaggctgg

SEQ ID NO: 37404 - DNA, 113 bp, Homo sapiens
caggcactgctgctgttgttactcaatatattattattcacatctcacatgttttaaatgtttctttttacttactgaatgtttaataaggtagcaacagcctaccttccttg

SEQ ID NO: 37405 - DNA, 94 bp, Homo sapiens
cgtccctcacaggcacagtcagacacactggatcaggtgaccccactcttcccccagccacgtgctgatgtgctcccctccttgtggggagatg

SEQ ID NO: 37406 - DNA, 113 bp, Homo sapiens
gttcaggtagtttgccaagtgcatgaatttttgtgtggtgggggcggggtgggggtggggacagtctcactcactctgtcgcccaggctggagtgcagtggcgtgatctcagc

SEQ ID NO: 37407 - DNA, 100 bp, Homo sapiens
aatctggccccctgtggtgacagcagagagacagcacgcaggacacacgaagtgcgcatggacaaggatctgcatctcacactcatcattgccgctgatt

SEQ ID NO: 37408 - DNA, 118 bp, Homo sapiens
ggggtgtgaggtagggatcaagattacttccattaagttttgaatttcaattattacatttttcatttttagaggttctatttggttcatttattatctgcttagcctctgatactct

SEQ ID NO: 37409 - DNA, 74 bp, Homo sapiens
ctcagtgtgggcagggggtagggtgggagcgaggtcactgcagctccagcctgtgtctgtctgtctgcaggggg

SEQ ID NO: 37410 - DNA, 87 bp, Homo sapiens
agggtctctccttctccttcggggtcagggtctctctctccttcgggctcagggtctctgtctctttcgggctcagggtctttccct

SEQ ID NO: 37411 - DNA, 81 bp, Homo sapiens
gtggcttcggggcggcgggcaggcgggcgggcggtctgacgaggcctcatgtgtcccactctctccctgcgcgggagccac

SEQ ID NO: 37412 - DNA, 84 bp, Homo sapiens
ggctttttaagccacatggatgtttacttttgataaaactagagccattaaaaaatgcggtgtgcgtcccccaggctgtgagtc

SEQ ID NO: 37413 - DNA, 129 bp, Homo sapiens
gcagacagcctgttgtgggacttcccagcctccatcatctggttcccctaacagaccctgctcacttctctctctgtgtcatgttggctctgtctctctggagacccctgactaacacagttgtgctgg

SEQ ID NO: 37414 - DNA, 74 bp, Homo sapiens
tgggcgaggccctgagctccgtgccgcacggccccatgctgggcgaggccctgagctctctgtgtctcagtttg

SEQ ID NO: 37415 - DNA, 64 bp, Homo sapiens
gcacctcactgtctccctgtgactgccaagggctacccgggggcacctggacgggggtgagggc

SEQ ID NO: 37416 - DNA, 117 bp, Homo sapiens
agtgctgggattacaggcgtgagccaccgtgtccagctgcaattttttaaaattttaatatatatttgtttttattttattttatttgagacaaggtctcgctctgttgcccaggct

SEQ ID NO: 37417 - DNA, 64 bp, Homo sapiens
tgtctctagtaacgcacgcacacagaactgtttatttctgtgtctgtctgtctgcatggatgca

SEQ ID NO: 37418 - DNA, 79 bp, Homo sapiens
ctcttgatgtaggttggttagtcttagggtccttctcccagctctagagccttttgactcttttaacaaccagagggag

SEQ ID NO: 37419 - DNA, 97 bp, Homo sapiens
cctggttaggcttttttgggagttgggtaagtgcagcacttggtatgtgttaagcacctctgagtgctgttactgtcaccagcggcatcatccaggc

SEQ ID NO: 37420 - DNA, 58 bp, Homo sapiens; identical to SEQ ID NO: 1725

SEQ ID NO: 37421 - DNA, 58 bp, Homo sapiens
tgagatggagtctcactctgtcacccaggctggagtgcaggggcgtgatctcagctca

SEQ ID NO: 37422 - DNA, 78 bp, Homo sapiens
ggtggccctgtctgggcataacagaaggctcgcacttgtcttctggtcacttctcactgtgtcccctcagctcctatc

SEQ ID NO: 37423 - DNA, 116 bp, Homo sapiens
gtcagtgacacacatgctctcgaggaccagccacgtgggcttctcttttttttgttgttttttgttttttgagatggagttttgtgcttgtctcccaggctggagtgcagtggcac

SEQ ID NO: 37424 - DNA, 56 bp, Homo sapiens
gagttagagtctcgctctgtcacccaggctggagtgtagtggtgtgatcttggctc

SEQ ID NO: 37425 - DNA, 58 bp, Homo sapiens
tgagacggagtctcgctctgtcgctcaggctggagtgcagtggtgcgatctcggctca

SEQ ID NO: 37426 - DNA, 128 bp, Homo sapiens
ggcaacatagcaagaccccatctctctttttttttttttttttgagatggagtctcactctgtcacccaggctggagtacagtggtgcgatctcagctcactacaacctccgcctcccaggttcaagg

SEQ ID NO: 37427 - DNA, 58 bp, Homo sapiens
tgagatggagtctcactctgtcacccaggctggagtacagtggtgcgatctcagctca

SEQ ID NO: 37428 - DNA, 115 bp, Homo sapiens
tgtgtgggcatagtggtgcacgcctgtagtcccagttactcaggaggctgaggtggaaggatggtttgagcacaggagtttgaggctgtagttggccatgactatgccactgcac

SEQ ID NO: 37429 - DNA, 111 bp, Homo sapiens
gtgccactggccacagaggttcctgacaagaaaagtgacacctcaaagatcccataacattttttttttaagagtttcgctcttgtcgcccaggctggagtgcaatggcgc

SEQ ID NO: 37430 - DNA, 111 bp, Homo sapiens
gctgggcaaggtggcataggcctgtagttccagctacttgggaggctgaggtaggaggatcacttgagtctgggaggttgaggcagcagttagccatgattgcaccactgc

SEQ ID NO: 37431 - DNA, 95 bp, Homo sapiens
ggagtgtgactgctgggtcatatggtaagaatatatttagttttgtaagtaactgccaaaatgtcttccaaagtgattgtaccattttgcattcc

SEQ ID NO: 37432 - DNA, 69 bp, Homo sapiens
cacacacacacacttttttttttttttgacagtctcactttgtcacctaggcaggagtgcagtggtgtg

SEQ ID NO: 37433 - DNA, 92 bp, Homo sapiens
ctggtacttagcacatgcttggcacacatgtgttctcaataatgcttgtgaatgaatgaatgtatgtatgaagcagaatgttatggtattgg

SEQ ID NO: 37434 - DNA, 122 bp, Homo sapiens
tcatgcacatgtacccatgagatttcccatctggggggacatgtgagtctctgtgtgtgaatatcatgtttgtcttctctgagccttttggagaaacagaaattcatgagattctgttacat

SEQ ID NO: 37435 - DNA, 95 bp, Homo sapiens; identical to SEQ ID NO: 68

SEQ ID NO: 37436 - DNA, 93 bp, Homo sapiens; identical to SEQ ID NO: 69

SEQ ID NO: 37437 - DNA, 117 bp, Homo sapiens
taggctgtttcccatttttctttcttataaataatgatatacttaaatttttggatgaaattatgattatttcattaggatatattcttagaagtgaaataactgggtgaaaggctg

SEQ ID NO: 37438 - DNA, 69 bp, Homo sapiens
tacagaggaccccgggtcagaaccacctgctaagctgcctgcaaattcctgaccctcagtcactgtgtg

SEQ ID NO: 37439 - DNA, 115 bp, Homo sapiens
tggggtctggggtcagattggaggaagcccacagggaggtggaggctgctaaagtcacagaagtttgctgtttgaccattgggctctccagggtatctggctgcaaacgatttca

SEQ ID NO: 37440 - DNA, 77 bp, Homo sapiens
ttcaaggcttttggatttcttgcttgtgaaagtgtatcactcagtcacagagtgcataatccaaaaatgtcattgag

SEQ ID NO: 37441 - DNA, 78 bp, Homo sapiens
cacattttagtaaagacgctagaggagcaaaagattgcttctgccactcacagtgtctcccaattttacttctgggtg

SEQ ID NO: 37442 - DNA, 84 bp, Homo sapiens
tggcatagggaggactcttcttgatgtttctgtggcaatagtgaccatatttatttatttaaaagacagggtctcactgtgtca

SEQ ID NO: 37443 - DNA, 89 bp, Homo sapiens
gggaaggaatcctaaagggcactgaactgctggcgctgctgtctgtgaggcactgagtgagtcacttcatccctctgggcctctggttc

SEQ ID NO: 37444 - DNA, 84 bp, Homo sapiens
gcaaagccatgctccctgccgctcactgtgtggaagagccagcttcgtgcacgtgtgtgtgtgtgtgtgtgtgtgtgtgtgtgt

SEQ ID NO: 37445 - DNA, 139 bp, Homo sapiens
accatgcaaagccattttggagaccctgatgaggaagcaggtgttccccatcctcgcaggcagtctctgtgaggctgtgactcagtggtgctctgagccatctcagggcctttgttctcgccccctttttccccctcac

SEQ ID NO: 37446 - DNA, 58 bp, Homo sapiens; identical to SEQ ID NO: 2595

SEQ ID NO: 37447 - DNA, 76 bp, Homo sapiens
ctgaaaacagtgaagatagagagagggtccttgcaaaaaatgcaattgtgagctctctttattttttattttttgg

SEQ ID NO: 37448 - DNA, 58 bp, Homo sapiens
tgagacaaggtctcactctgtcacccaggctggagtgcagtggtgtgattttggctca

SEQ ID NO: 37449 - DNA, 60 bp, Homo sapiens
tatatatgcatgtatacatgtatgtatatatgtacacatacatatgcacatgcacatata

SEQ ID NO: 37450 - DNA, 171 bp, Homo sapiens
agtttcttttgctgtgcagcagttctttagtttaggtcccacttgtcaatttttgtttttgttgcaattgcttttggggacttagccaaaaattatttgccttaggctttgttttttttttttttttgagacagagtctggctctgttgcccaggctggagtgcagtgggg

SEQ ID NO: 37451 - DNA, 71 bp, Homo sapiens
ttaaagagggttcactcccttcctctaggcccctgaaacctgaactggagagaggagtgagagagctttga

SEQ ID NO: 37452 - DNA, 71 bp, Homo sapiens
gtttgatttaatatggggagctactcttttttttttttttttgagacggagtctccctctgtcgctcaggc

SEQ ID NO: 37453 - DNA, 78 bp, Homo sapiens
atatatatgcatatataaatatatagatgcctatatataaatatatgtatgcatatatatgtgtgtgtgtatatatat

SEQ ID NO: 37454 - DNA, 72 bp, Homo sapiens
gttgttttgagacagagtctcactctgtcgccctggctggagtgcagtggtgtgatctctgctcactgcagc

SEQ ID NO: 37455 - DNA, 70 bp, Homo sapiens
agctagggtgtcagtagctgctgcctggtctcttttttttgagacagggcctcactctgtcactcaggct

SEQ ID NO: 37456 - DNA, 86 bp, Homo sapiens
agccgggatgccaggtgagactctgggccttcttctttttttttttttttttttttgagatggagtctcactctgtcacccaggtt

SEQ ID NO: 37457 - DNA, 86 bp, Homo sapiens
ggacttgcctcccacagtctctcacactatgctgcccttaggttttttggacaagagttcagcatctgagttgaggaaacaagttc

SEQ ID NO: 37458 - DNA, 119 bp, Homo sapiens
gcttccttgctcctcagcttgcagacagcctactgtgggatctttttttttttttttttttttttgagacagagtctggctctgttgcccaggctggagtgcagtggcatgatctcggc

SEQ ID NO: 37459 - DNA, 76 bp, Homo sapiens
gtttgttgtgctggtaggaactgcaaattaatgtttttcattaaatgtaagggtttttcaccagttatagcttcac

SEQ ID NO: 37460 - DNA, 99 bp, Homo sapiens
gttatgatgctaggttgttaagttaagatatttctaactttttgatgtgggcatttagtgttggaaatttctctcttaacactcccttagctgtgttcc

SEQ ID NO: 37461 - DNA, 98 bp, Homo sapiens
tttccttaggataattctcagaagtagagttataagctgattggtatatgcattcttaaagcttgtgacatatttttaccaaattgctcttcaggaag

SEQ ID NO: 37462 - DNA, 97 bp, Homo sapiens
agtccagcctgggcaaggtagtgagaccccatctatcttttttttttttttttttttttctgagacgtgagtctcgctctgtcacccaggctggagt

SEQ ID NO: 37463 - DNA, 103 bp, Homo sapiens
ggggtcaaaaggcccagagcataccccagtggagagttcagagaagtgggagaggtcacctttttgtcgtatttgcactgtcgtagtctctggattgtatctc

SEQ ID NO: 37464 - DNA, 69 bp, Homo sapiens
ctctttttaatagtatctcactctgacactcaggctggagtgcagtggtgtgatcctggatcactggag

SEQ ID NO: 37465 - DNA, 68 bp, Homo sapiens
tctctggccccagactccctgacagcctcagaggggttgaggcatcagggccacactgtggctggggg

SEQ ID NO: 37466 - DNA, 82 bp, Homo sapiens
ccagggtaaagacagggaatagtatacgtaaccaataaaattttttttttttttgagacggagtctccctctgtcacccagg

SEQ ID NO: 37467 - DNA, 69 bp, Homo sapiens
gctggctcagagaacctgggtaacggaaaggagaggcagcttttcccactcactgtctctgacacaagc

SEQ ID NO: 37468 - DNA, 87 bp, Homo sapiens
aagtgtgtatatatatgaatgtgtgtttatacatacagacagagattttatatatatttatacacacatgcatatatacacatattt

SEQ ID NO: 37469 - DNA, 83 bp, Homo sapiens
gcttgagaataagtaaataagtggctaacatgctgtgctagttacaagtactgtagtctgcttgttctgctgatttacaaagt

SEQ ID NO: 37470 - DNA, 96 bp, Homo sapiens
gaaggctaaattatagtgggagaattgctctgtatgaattgtaaattttttttttctttgaggcagagtctcattctttcacccaggctggcgtgc

SEQ ID NO: 37471 - DNA, 117 bp, Homo sapiens
tttatttctaatgtgtattagtttgaatggcccaaaagttactgtaaaataatttttttacaatgaaggagtttcattttatagaggagcaaatgcaaacgtactaaaagaaaggaa

SEQ ID NO: 37472 - DNA, 113 bp, Homo sapiens
ctgcctctattaaattgtgtgtctgtgatataggttcttttttttaaggtgaagtgagtttgttgatgtgtaccctaatctaatatgactgcaggtcttataaggaggggtgg

SEQ ID NO: 37473 - DNA, 95 bp, Homo sapiens; identical to SEQ ID NO: 580

SEQ ID NO: 37474 - DNA, 93 bp, Homo sapiens; identical to SEQ ID NO: 69

SEQ ID NO: 37475 - DNA, 111 bp, Homo sapiens
ctgagaggaacacagaacactactattaatctgtttaatttgcaaatctaatgtaatcaaaaggaagacattagtgttaaaattgttgttgtctggtggtatctttcttgg

SEQ ID NO: 37476 - DNA, 93 bp, Homo sapiens
taatttctcttatactggtatatgtttcaatatatacaaattttctcttatatttgtatatgtttaaacatatacctatatgtttataagtta

SEQ ID NO: 37477 - DNA, 58 bp, Homo sapiens
tgagactgagtctcactctgtcgcccaggctggagtgcagtagtgaaatctcggctca

SEQ ID NO: 37478 - DNA, 139 bp, Homo sapiens
ctggatgacagagcaagaccctgtctcgaaaataaataaagaatttttttttttttttttgagacagagtctcactctgtcacccaggctggagtgcagtggcgcgatctcggctcactgcaagctctgcctcccaggt

SEQ ID NO: 37479 - DNA, 114 bp, Homo sapiens
cattgttcccattaaaatggaaaccccgtggggagaggaaatgcatctgtggaatgtagagtggatttctttcacatatgggcactcagtaaacattattaatgaatgataatg

SEQ ID NO: 37480 - DNA, 74 bp, Homo sapiens
tttgttttttgagatggactctcactctgtctccaaggctggagtgcagtgacgcaatctcgtctcactacaaa

SEQ ID NO: 37481 - DNA, 95 bp, Homo sapiens; identical to SEQ ID NO: 68

SEQ ID NO: 37482 - DNA, 93 bp, Homo sapiens; identical to SEQ ID NO: 69

SEQ ID NO: 37483 - DNA, 93 bp, Homo sapiens
gtgagcaaaggaggatggagctgtaggggatctttatttttatttaaatagaagttttttctcccttggggttttgtttatctgtccatacac

SEQ ID NO: 37484 - DNA, 142 bp, Homo sapiens
gtgacagattgagatcctgcctcaaaagtaaaaataaaataaaataaaagtaatttttttttttgaggcagggtctcactctgtcacccaggctggaatgcagtggcaggctcatgcctcactgcagcctggatctcctggg

SEQ ID NO: 37485 - DNA, 105 bp, Homo sapiens
acacattcatcaccccagattatatatatgtttatatatatgtgtgtgtatatatacatatatatgtatgtatatatatttgtgtgtgtgtgtgtgtggtgagaa

SEQ ID NO: 37486 - DNA, 83 bp, Homo sapiens
ttgggtcagtatgatagaaaggtactcttttaagtctcattttatttttattttttgagatagggtctcgctctgttgcccag

SEQ ID NO: 37487 - DNA, 114 bp, Homo sapiens
tatgctacagaaaaatggcagactaagcatatacatttgtttcattttttgaaaaattttacttgaagttctgggatacatgtgctcaatgtgcaggtttgttacataggtata

SEQ ID NO: 37488 - DNA, 110 bp, Homo sapiens
ctacactcacctgacaaaataaaagtgatttctttttctgtggtttaaagaatttttttttttttttggatacatagtcatagatttttggagtcagatggggactgtag

SEQ ID NO: 37489 - DNA, 78 bp, Homo sapiens
ggtttgcaccatctgccatacatttgcttaatcattcatttctatcatagatgtatagcagcattggaattgttaacc

SEQ ID NO: 37490 - DNA, 101 bp, Homo sapiens
tcctgagtagctgggactgcaggtgcaccaccacccttgggtaagtatttttatttcttagagatgggggggtctcactaagtttcccaggctggtcttga

SEQ ID NO: 37491 - DNA, 76 bp, Homo sapiens
atacatattacatgtatgtatgtgatgtgtgtgcacttatatacatatacattatatgtatatatgtgatgtgtgt

SEQ ID NO: 37492 - DNA, 69 bp, Homo sapiens
aggcgtctggagaatgcgggtgttattagatgacttctaaggatctccctgctctgtctctgtgtgtct

SEQ ID NO: 37493 - DNA, 101 bp, Homo sapiens
gccaaagacaggcctgggtgcctgctaatggtcactgtggctgtgactgcccccaggacaggctgacacggtaactagagccagacttcccaggagctgct

SEQ ID NO: 37494 - DNA, 116 bp, Homo sapiens
aaagtgcactgaatttggatggcttccttttgaggtgcaggtactaagaataattacagtctgtctgtgtgactgcccttatcctgtaaaaggaaaaatgccaagcaaggttcttt

SEQ ID NO: 37495 - DNA, 99 bp, Homo sapiens
actttaggtagaagactaagcaaagaaatcacatgacaggccaagaagaacacaggtcagtctgtttatgtctctttgatgaaaacacttctggaaagt

SEQ ID NO: 37496 - DNA, 119 bp, Homo sapiens
ggagaattgaagttatgcgcatatatatatatatatatatatatatatatatatatatgtatgtactttatgtatatatatgtgtgtgtatatatatatatgcactttattcagagccc

SEQ ID NO: 37497 - DNA, 58 bp, Homo sapiens; identical to SEQ ID NO: 1763

SEQ ID NO: 37498 - DNA, 119 bp, Homo sapiens
tagtcatatagtaattaagattgcatatgatggcatgatttctatatttttaactatgattatatgctttagaaatgagtaaattagacactatagtgtgcatctttacatatatacta

SEQ ID NO: 37499 - DNA, 75 bp, Homo sapiens
gaagaatatggatacataaatatacacatatgcatgtatatatgtatatgtgtgtgtgcgtatgtttagtttttc

SEQ ID NO: 37500 - DNA, 95 bp, Homo sapiens; identical to SEQ ID NO: 68

SEQ ID NO: 37501 - DNA, 93 bp, Homo sapiens; identical to SEQ ID NO: 69

SEQ ID NO: 37502 - DNA, 68 bp, Homo sapiens
gttgttgttttcctcttggttctttagggtgttttacatagacactcagactgtctggaaataatgac

SEQ ID NO: 37503 - DNA, 108 bp, Homo sapiens
tctttattcctgtggaatatcaatttttctagctactagcttttatagttttatgtatactgatttatgattttctagcctaaaaatgtggactccacaggttgaaga

SEQ ID NO: 37504 - DNA, 104 bp, Homo sapiens
ggtactcagctcagtattccagggaagactctgcaggtctctggaacttcctctctgtgtcactctccaatctccagtactctaccctgtgaactctagcagcc

SEQ ID NO: 37505 - DNA, 141 bp, Homo sapiens
gtccctcatgctggggtgcagtgtcagagttctggcctcggggccagggccttttggatgtgacagccaccctctgtgtgttagtgagatgtgcttgggcagaaaaagcctcagaatgtgactgcaccagaagttccggct

SEQ ID NO: 37506 - DNA, 65 bp, Homo sapiens
ccctgagtgcctgcctctctggaaagcatggtggttcatttctccttcaagaggaagacaaaggg

SEQ ID NO: 37507 - DNA, 119 bp, Homo sapiens
ctattctttgccgagaagggtgagggtatgagatcagcagaaaattacattctttattcttttttttttcttttttttttttttctgagatagagtttcgctcttgttgcccaggctgg

SEQ ID NO: 37508 - DNA, 95 bp, Homo sapiens; identical to SEQ ID NO: 68

SEQ ID NO: 37509 - DNA, 93 bp, Homo sapiens; identical to SEQ ID NO: 69

SEQ ID NO: 37510 - DNA, 58 bp, Homo sapiens
tgagacagagtctcgctctgtcacccaggctggagtgccgtggcgagatctcggctca

SEQ ID NO: 37511 - DNA, 99 bp, Homo sapiens
atggctgaatagtactccattttatatatatatatatatatatatatatatatatatatatatatatatatatatatatggcacattttcttcatccat

SEQ ID NO: 37512 - DNA, 95 bp, Homo sapiens; identical to SEQ ID NO: 68

SEQ ID NO: 37513 - DNA, 93 bp, Homo sapiens; identical to SEQ ID NO: 69

SEQ ID NO: 37514 - DNA, 88 bp, Homo sapiens
tttctgatgttggagctgagagatgacacagagtagagcaggagttgattgggcaaatatgctagtatttgtgccgataggccagaga

SEQ ID NO: 37515 - DNA, 112 bp, Homo sapiens
tatgttctaattcataagctataaaagctatagagtgggtccatgaatgtttatttatgtctttaaattgtatgtatccattcttttgtattagcatttattttacaatata

SEQ ID NO: 37516 - DNA, 80 bp, Homo sapiens
ggggaaaggacagtctcttcagtaaatggtgctgggaaatgcacatccatatacagaagaatgaaactagaccctgcctc

SEQ ID NO: 37517 - DNA, 86 bp, Homo sapiens
atatgtattcttgatatagatgaacagaataaatatttaccatctatttttctatttattctgtttatatgttgatgtaggcatat

SEQ ID NO: 37518 - DNA, 82 bp, Homo sapiens
gggcgaattccactcactcagaccctctgtgcttcacccctctcaggatggggagtatgcaggtgagtgggtgcagaagccc

SEQ ID NO: 37519 - DNA, 80 bp, Homo sapiens
tttaagtagctcagagaaaattatttatacataactttataaaattacctgtatatataattttctctgagcttcttaaa

SEQ ID NO: 37520 - DNA, 115 bp, Homo sapiens
gtttaagattgttttggttatatgggctctttttggttccatatgaattttaaagtagtatttttctaattctgtgaagaaagtcaatggtagcttgatggggacagcattgaat

SEQ ID NO: 37521 - DNA, 85 bp, Homo sapiens
gcatatatagatacatgcacacacatatacatatatgtgtgtatatatataataggtataggtatgtggatgtatgtatatatgc

SEQ ID NO: 37522 - DNA, 95 bp, Homo sapiens; identical to SEQ ID NO: 68

SEQ ID NO: 37523 - DNA, 93 bp, Homo sapiens; identical to SEQ ID NO: 69

SEQ ID NO: 37524 - DNA, 61 bp, Homo sapiens
ggtggcatgtctgactgcacagtggctggaccccacactcactgtcacaccccttgccact

SEQ ID NO: 37525 - DNA, 64 bp, Homo sapiens
gtgcagggaaactggaacagggcacgtgagtgagacgcctccctgacaccctgtatccctgcat

SEQ ID NO: 37526 - DNA, 90 bp, Homo sapiens
tttgtagacttcattcaaattgcttagagatagttatgtaggaagaaaatgtttttatatgtttgctaagcttttgaagctgtaaacaaa

SEQ ID NO: 37527 - DNA, 71 bp, Homo sapiens
tatacatatatgtatatgtgtatatatgcacacatatgtatatatgtacatgtgtatatatatgtatatat

SEQ ID NO: 37528 - DNA, 75 bp, Homo sapiens
tgcagagacagtactgagagcagaatgtgtgctctgatactttccagacacattctgtcttaatttgtaactgca

SEQ ID NO: 37529 - DNA, 102 bp, Homo sapiens
gaagtttttaagtgtgccatatatatatatgtgtgtatatatatatatatgtatatatatatatatgcatgtatgtatatatgtatgtgtgtgtgagatttc

SEQ ID NO: 37530 - DNA, 94 bp, Homo sapiens
gctcaaggaggcctgcctgcctgcctgcctgcctctgtagactccatctctgggggcagggcacagacaaacaaaaggcagcagtaacctctgc

SEQ ID NO: 37531 - DNA, 102 bp, Homo sapiens
ctagtatcatggtggatagaactggtgaaagtgggcattcttctctcattccagttcttagaaggaatgtgttcaacttttccctattcagtatgatgttgg

SEQ ID NO: 37532 - DNA, 66 bp, Homo sapiens
tgcttatgcatatatacatactttatacatgtacacaggtataatttgtatgtatgtatgtttgca

SEQ ID NO: 37533 - DNA, 100 bp, Homo sapiens
tatatatatgtgtgtgtgtgtgtgtgtatatatatgtatatatgtatacatatatatacatatacatatatatacatatacacatatacacatatatata

SEQ ID NO: 37534 - DNA, 135 bp, Homo sapiens
atgtatgcatacatgtatacgtgtatatacatgtatatacgtatatatgtatgcatgtatatatgtatatgtatacgtgtatatacatatatgtatatgtgtgtatacatatatatactacatatatgtatatat

SEQ ID NO: 37535 - DNA, 80 bp, Homo sapiens
gtatatatgtatgtatatatgtgtttatacacgtataaatacacacatacatatacacacatgtatacttacatgtatac

SEQ ID NO: 37536 - DNA, 113 bp, Homo sapiens
gcatggtggctcggctgtggcatctggcttcctgattgggactgactgtcggcgtcctccctgactcacgcagactcacagagagcaatccaggatcacccaccacccagtgc

SEQ ID NO: 37537 - DNA, 117 bp, Homo sapiens
tatgtaatatatatacacacacacataaatgtggagaccatatatatatatatgtgtgtgtatatatatatatataaatgtgtagatatatatctccacatttagtgtgcgtgtgtg

SEQ ID NO: 37538 - DNA, 117 bp, Homo sapiens
gtgtggcagaaaaagatgactattgtgtctctcagcttcagaataattttatttcattaatattacaaattttggcagattgagttttatagattagtctattatttactaatacat

SEQ ID NO: 37539 - DNA, 107 bp, Homo sapiens
tcagcatcagcttggaagaaaaatgtcaatatgaatatctttgctatttttctagtactaaaaatgatcagatgtgacaagaatttttttttctagcaaagtggtga

SEQ ID NO: 37540 - DNA, 106 bp, Homo sapiens
gtgtctgtcttgtttactgttatatccttgaatagtaggtattccctaaatatctgtggaatgatgtatggctagttcagtgtgggaagtaagctagtattaatat

SEQ ID NO: 37541 - DNA, 86 bp, Homo sapiens
ctggggtattttcacatgagttcaactgagcctctgatggctgaggaagaaagttgcattgtcttatctgaaagctctgcctccag

SEQ ID NO: 37542 - DNA, 154 bp, Homo sapiens
tatatatatcagcagatatatggatatagctacctatataaagctttattatataaattttatatttaataacataaagctttattatatattatatatagctttatatatatcgctttatatatattttatataattacaataaggccgtatg

SEQ ID NO: 37543 - DNA, 75 bp, Homo sapiens
gctggtactgggggctgtctgcacagagtcctgtgatgtgaactgtctgtgggtctctcagccatggataccagc

SEQ ID NO: 37544 - DNA, 98 bp, Homo sapiens
ttggcatatattgagaaagtttctatcttgtgacttggctgtaaaaagcaggcaagtttgtagcagcatatgaaattccttttctaaatgtgttctaa

SEQ ID NO: 37545 - DNA, 115 bp, Homo sapiens
ttgtattggagaaatggacctagaatattcatagagaaatcttgtctggcccgtggatactctctgggcaaataaggcagaagttctaaattcggctacatttgtagaattgcaa

SEQ ID NO: 37546 - DNA, 103 bp, Homo sapiens
cttcagtgcatacaagttgtattttaattatatgcttaaaatgtaattgtatatattttgagtttggttatcataatgcctatagtattttctagtgctgcag

SEQ ID NO: 37547 - DNA, 76 bp, Homo sapiens
atatatataactatatatacttcatatatatacttcatatatagttatatatgtggttatatatagttttatatat

SEQ ID NO: 37548 - DNA, 111 bp, Homo sapiens
gacgtatagcatcttccaggcattttctgttgtgcatgtatagcttggttatccaatgtaaatattccataggtagttgcaaataaggcaagagtgctcagagggcaagtc

SEQ ID NO: 37549 - DNA, 58 bp, Homo sapiens
tgagacagggtcactctctgtcactcaggctggagtgcagtgctgtgatcttggttca

SEQ ID NO: 37550 - DNA, 91 bp, Homo sapiens
cagagaacagccagcactgaacttttcaataatgcccatgtacctgtcactggctcactcattatttgtttagtgaagggagtgtcctctg

SEQ ID NO: 37551 - DNA, 62 bp, Homo sapiens
tgagacagagtctcactcactctgttggccaggctggagtgcagtggcgtgatcttgtctca

SEQ ID NO: 37552 - DNA, 114 bp, Homo sapiens
tgctgatactttactgctattgctgtgagtaatgaactctccatctctgactgagagtcttgtgtcttctgcagcatccatgaaactatagcagataaacttaagttgcaagta

SEQ ID NO: 37553 - DNA, 101 bp, Homo sapiens
ctttatatggaatcattgtttttaatcttcgcaataagtctcagagggagttctttctatgtttattgtatgaatgaagaaactgtagttcacaggttggg

SEQ ID NO: 37554 - DNA, 95 bp, Homo sapiens
ctccatctgcagcttttccatccctttcagggcaggcaagaggctgtgactacacagtcagctgaggctgaggaggacaaggggaagcagagggg

SEQ ID NO: 37555 - DNA, 118 bp, Homo sapiens
tggtctccagcctgatgtcatatattttatatctatctatctatatctatatctatatctatatagatagatagatagagagatatatatatatatatgacagctaaggatcactggg

SEQ ID NO: 37556 - DNA, 75 bp, Homo sapiens
tgtttaacttttatgtttatatatatatatatatatatatatatacatatatatatatttagatgaagtagaaca

SEQ ID NO: 37557 - DNA, 58 bp, Homo sapiens
tgagacagggtctcactctgtcacccaggatggagtgcagtggtgcaatctcggctca

SEQ ID NO: 37558 - DNA, 109 bp, Homo sapiens
gaggaaatacactgtggttgtgaggctggcctgccactctggaagtctgacaccagactgacgtcacatcagaacatgtcattgcagccgcaaattaaggcagctcctc

SEQ ID NO: 37559 - DNA, 100 bp, Homo sapiens
cattgggaatgctgggttcctgagggacaagattgtgtttatatttcatttcatgtcaggtgtggaatattttggggcctgaggccttggctgtacagtg

SEQ ID NO: 37560 - DNA, 98 bp, Homo sapiens
tctttaatgtctatctgatattatttctaagtaattgaattctattaagtcagggaggtaattactaaaaccatggatggtatcagggagaagaagga

SEQ ID NO: 37561 - DNA, 92 bp, Homo sapiens
cttccagaaacgtcctcacagacagtctcagaaataatgttttttggttattttgtttgtttttgagtctcgctctgttgcccacgctgaag

SEQ ID NO: 37562 - DNA, 106 bp, Homo sapiens
ggactggggctggaaggaaaattgaaggacacagagaagagacttaggagacttgggaggagagaattttttttttttttttttttttttttttttgagacagtct

SEQ ID NO: 37563 - DNA, 165 bp, Homo sapiens
acatatatatgtgtatatatatatatgtgtctgtgtatatatatatacacgtgtgtatatatatgtgtatatgtatgtgtgtatatatgtgtatatatgtgtgtgtgtatatatgtgtgtatatatgtgtgtatatatacacacacacacacatacacacacaca

SEQ ID NO: 37564 - DNA, 97 bp, Homo sapiens
tgggtttatcaggcataatcccattgtaagtcaaggagcatttgtattcacaatccatagctcacatgtatacagtgtgtgccaagtaccaggccca

SEQ ID NO: 37565 - DNA, 118 bp, Homo sapiens
tagaaaggatttaaaaatcatgtaatactttagggtcattatgaacatcaatcatcatagtactgtggctgcacatgagtgatggctaatagagagttctggtttggaaaattggctg

SEQ ID NO: 37566 - DNA, 73 bp, Homo sapiens
cccagggtaggccgtcttggtaggaataccatagaaacgatgctgtgtttctctcagtgtgtcccattctggg

SEQ ID NO: 37567 - DNA, 115 bp, Homo sapiens
gcctccagctttgttctttttgcttaggattttattggctatatgggctcttttttggttccatatgaaatgtaaggtagttttttctaattctgtaaagacagtcaatggtagc

SEQ ID NO: 37568 - DNA, 111 bp, Homo sapiens
ggcctgggctttctcacagcatggtggccaggttccaaggacaaatgtctcaatagagagagaagagacagccaggtggaagctgcttcaccttttgtgacctagcctgtc

SEQ ID NO: 37569 - DNA, 119 bp, Homo sapiens
tgcttagaattgtcttggctatacaggcttatttttggttccatatgaaatttaaagtagttttttctaattctgtgaagaaagtcaatggtagcttgatgggaatagcattgactcta

SEQ ID NO: 37570 - DNA, 95 bp, Homo sapiens
taacacctccttcacaggggtgttatgcggatttctgcctgtgtggtaacgaggttcagtagcctgcttggaatttcccagtggacaaggtgtta

SEQ ID NO: 37571 - DNA, 117 bp, Homo sapiens
gactggttacagggggcacatattgtttgctgaagtgtgtgtatgtgcatgtgcatgtgtgtacctgtatgtgcatttatgatttgtgtgtgtgcatgtgtgattttcccctggcag

SEQ ID NO: 37572 - DNA, 111 bp, Homo sapiens
atactatgtgtatatatagtatacatatataatactatatatatactatgtgtatacatagtatacatatataatactatgtatatatatactatgtgtacacatagtata

SEQ ID NO: 37573 - DNA, 80 bp, Homo sapiens
tttagggacaggatattgctgtgtcactgtcactcaggctgaagtgcagtggcatgatcatagctcactgtaaccttgaa

SEQ ID NO: 37574 - DNA, 56 bp, Homo sapiens
ttgagacaaagtctcactctgtcacccaggctggagtgcagtggctgtgatctcgg

SEQ ID NO: 37575 - DNA, 108 bp, Homo sapiens
tgattttactgtattgttcatgctgcgagcaaaatgggtgtctgctaagtttttattttaaaatgcatatttctgtctttaccttgtagccttgcaatgcgtaattca

SEQ ID NO: 37576 - DNA, 103 bp, Homo sapiens
atatgcatatcacattaatttcacttactttcctaaaaaatttatttattatcatagaaggtagtttaaatgtacatggaatagtttatatgtatatgtatat

SEQ ID NO: 37577 - DNA, 95 bp, Homo sapiens; identical to SEQ ID NO: 580

SEQ ID NO: 37578 - DNA, 93 bp, Homo sapiens; identical to SEQ ID NO: 69

SEQ ID NO: 37579 - DNA, 110 bp, Homo sapiens
tgcttaggattgtcttggctatgcgggctcttttttggttccatatgaaatttaaagtagttttttccaattctgtgaggaaagtcaacggtagcttgataaggatagca

SEQ ID NO: 37580 - DNA, 68 bp, Homo sapiens
ctgctctggctctgtctgactgggctgtttccacggatgctcccacccctgaacaaggccctgagcag

SEQ ID NO: 37581 - DNA, 86 bp, Homo sapiens
gctgagcatgtagcccagtctctcagtgtcacttcatgttatgtatttggaggaactgtaatgggagatcaatggccatgggaagc

SEQ ID NO: 37582 - DNA, 91 bp, Homo sapiens
tatatatatgtgtgtgtgtgtatatatatatgtgtgtgtatatatatatacacacactatgtatatgtgtgtgtatatatatatatttgca

SEQ ID NO: 37583 - DNA, 58 bp, Homo sapiens; identical to SEQ ID NO: 17746

SEQ ID NO: 37584 - DNA, 97 bp, Homo sapiens
taagcacatctaaatgtgccattgaaaatagatattgtagcaaaaaatactctgtaaaatatatttgttttgaattatgcatattttgatgtattta

SEQ ID NO: 37585 - DNA, 94 bp, Homo sapiens
agtctaggtgtctgtttttgaaccagtactatgctgtttggttactgtggccttgcagtatagtttgatatcaggtaatgggatgcctctcact

SEQ ID NO: 37586 - DNA, 87 bp, Homo sapiens
ttctcccaaacatacagtctctctctctattctgagccaactaaatctaggtttggagtggcgtaagcacctctgtggcatccagaa

SEQ ID NO: 37587 - DNA, 95 bp, Homo sapiens; identical to SEQ ID NO: 68

SEQ ID NO: 37588 - DNA, 93 bp, Homo sapiens; identical to SEQ ID NO: 69

SEQ ID NO: 37589 - DNA, 136 bp, Homo sapiens
catatatatatgtgtgtgtgtacatatatatgtgtatatatgtgtgtagatatatgtgtgtgtacatatatatgtgtatatatgtgtgtatatatatatgtgtgtgtacatatatatgtgtgtgtatatatatatg

SEQ ID NO: 37590 - DNA, 82 bp, Homo sapiens
ttggtttggagaagcagcatcacctgatttttgtcttcattcccatgaggcattatccctgtgtgtgtgtctctgtgaccaa

SEQ ID NO: 37591 - DNA, 96 bp, Homo sapiens
gagagggtaaaagtgcttagtaaatttctatatctattgaaagaaagtatcaagatataaacagatatactaggaaatactactgattttcctgtc

SEQ ID NO: 37592 - DNA, 95 bp, Homo sapiens; identical to SEQ ID NO: 68

SEQ ID NO: 37593 - DNA, 93 bp, Homo sapiens; identical to SEQ ID NO: 69

SEQ ID NO: 37594 - DNA, 111 bp, Homo sapiens
aattaactcaggagcttaagtgtttctagaaacctgacagttaatgtaggcccatggagactgagatgactgtgatgatttcaggagagatttacccagctccagctgatt

SEQ ID NO: 37595 - DNA, 106 bp, Homo sapiens
gaatgagtagttgctctgaggatcaggactggggatgagagagaggcggcggactgtttttttttttcctttatttattttttttgatacagagtctcactctgtc

SEQ ID NO: 37596 - DNA, 76 bp, Homo sapiens
tattgggtctcttagatcatgtgaggaataatatagcattgtatgtatatttttcttactggtttagaatttaata

SEQ ID NO: 37597 - DNA, 108 bp, Homo sapiens
atttcttccagcagtgttttttaattctcattgtagagattgttcaccttcctggttagctgtatttctatatatgttattatttttttggctactgtgaataggaat

SEQ ID NO: 37598 - DNA, 106 bp, Homo sapiens
ggccaatggagagctattataggagactggagggagacagaagagtgagttcagagtgtacattcccctgctgcctccctccctgtgtggtcaccttgaattggct

SEQ ID NO: 37599 - DNA, 94 bp, Homo sapiens
attagttttatgagaatcaagggaagatagtgataatctggagatcattacatgatttttaatattagtctgccacttgatagtactgactaat

SEQ ID NO: 37600 - DNA, 95 bp, Homo sapiens; identical to SEQ ID NO: 580

SEQ ID NO: 37601 - DNA, 93 bp, Homo sapiens; identical to SEQ ID NO: 69

SEQ ID NO: 37602 - DNA, 114 bp, Homo sapiens
tgtttactcacctaaaggcccgaatggtggtgagtccttctgctgtttctgagaagtgacagagcagagggagctgggtactatcgtcaagttcctggaggtccctagtagaga

SEQ ID NO: 37603 - DNA, 109 bp, Homo sapiens
atactttaagttctagggtacatgtgcacaatgtgcaggtttgttacatatatatatatgtgtcatgttggtgtgctgcacccattaacttgtcatttacattaggtat

SEQ ID NO: 37604 - DNA, 120 bp, Homo sapiens
gtgtgtatataatgtgtatatatatgtgtgtatatatacatgtgtatatatatataatgtgtatatatgtgtgtatatatagacatgtgtatgtatatataatgtgtatatatgtgtgta

SEQ ID NO: 37605 - DNA, 77 bp, Homo sapiens
gacagtgtgagaacatagagtgcacgtctgggacaaagaaagctttgagaaggaagtgacttctaaactgacacttc

SEQ ID NO: 37606 - DNA, 77 bp, Homo sapiens
tatgtctgaataatatttcattctatatgtatgtgaaatgtatttacatacatatataatgtatgtaagtatacatg

SEQ ID NO: 37607 - DNA, 58 bp, Homo sapiens
tgagacagggtctcactctgtcacccagcctggagtacagaggcacgatcttggctca

SEQ ID NO: 37608 - DNA, 97 bp, Homo sapiens
ggaagcagaacaatgacatgtagggattaaagagaaagaattctggaggcatcatttaaactcttttttttttttgagacagattctcactgtgtcc

SEQ ID NO: 37609 - DNA, 97 bp, Homo sapiens
ctgtgtacttcggagtaggtgaaacactttgcatatgttatcttatgtaatctgcatagcgaatgaatgaagtggacatttctacccagttttacag

SEQ ID NO: 37610 - DNA, 61 bp, Homo sapiens
tgagtctgtcagtctgactttcttgtgaatgagaatggtcaggtagctctgacaggcctca

SEQ ID NO: 37611 - DNA, 119 bp, Homo sapiens
ttttcctcaaaagttactgtggccacaaacaccgtttgctgatataatggtttgtgcattttcaaatgttgccaggattgcaagagaatgtttatagccctttgaattagggaggcaaa

SEQ ID NO: 37612 - DNA, 95 bp, Homo sapiens; identical to SEQ ID NO: 68

SEQ ID NO: 37613 - DNA, 93 bp, Homo sapiens; identical to SEQ ID NO: 69

SEQ ID NO: 37614 - DNA, 110 bp, Homo sapiens
gactggaatttaggggtatttgtgtatttatgtgtttctcttgggtaatatataaatatatgtgtgtatatataatatttgggttaaagtatatgactatttagaatctt

SEQ ID NO: 37615 - DNA, 75 bp, Homo sapiens
acatttaggttcttactgtcttcaatgtctagctctgtggaggctgacaatacagagagagcaaaaactaagtgt

SEQ ID NO: 37616 - DNA, 99 bp, Homo sapiens
tcttttaaggaacagaagtttttaattttgatgaagtgatgaagtccaatttatcattttttaattttgtggttcatgctttttgtgttccacctaaga

SEQ ID NO: 37617 - DNA, 83 bp, Homo sapiens
gtatgcattaggccatgtgtgtttctttttctgaactttagttatctgagggggtaagcacacgtatgcttcagcatgtatac

SEQ ID NO: 37618 - DNA, 92 bp, Homo sapiens
ggctgcttgtgaatttgtcagaagaatatgaatgctccacttgcgctgcattcagcttttttttttttgttcgtttgttttttgaatcagcc

SEQ ID NO: 37619 - DNA, 92 bp, Homo sapiens
gcaaattgatctacctttgtgccagtagtcagcctcacattcccagaatcacagtgagtgactgactcaatggagtcatagaagatatttgc

SEQ ID NO: 37620 - DNA, 58 bp, Homo sapiens; identical to SEQ ID NO: 27519

SEQ ID NO: 37621 - DNA, 95 bp, Homo sapiens; identical to SEQ ID NO: 68

SEQ ID NO: 37622 - DNA, 93 bp, Homo sapiens; identical to SEQ ID NO: 69

SEQ ID NO: 37623 - DNA, 132 bp, Homo sapiens
tatatatgtatgtatatatgtatatatatgtgtatatatgtatatatgtatatatatgtgtatatatgtatatatgtgtatgtgtgtgtgtatgtatatatgcatatatgtatatatatgtgtgtatatata

SEQ ID NO: 37624 - DNA, 56 bp, Homo sapiens
tgtgtgtgtctgtatatatatatatacacatgtgtgtgtctatatagacacacata

SEQ ID NO: 37625 - DNA, 91 bp, Homo sapiens
tctaggtctgtctgtgtctctctatatcactgctattgttcattctcaattctatgaaacgagagaatgtggtgacataccagagaccgga

SEQ ID NO: 37626 - DNA, 76 bp, Homo sapiens
tatagaatattctatatttctataggatattctatatttctatagaatattctatatttctatagaatattctata

SEQ ID NO: 37627 - DNA, 100 bp, Homo sapiens
gagcagccagctggatcccgtactcactcactcacttgctccctcctgcaaggggctaagcacagtgggccaagtagatggggtgccctgccgtgagttc

SEQ ID NO: 37628 - DNA, 96 bp, Homo sapiens
agcggaccccaggatgcctgtgaccccgaggcctcacagggtgcctgtgaccctgaagccccagagggggtcttatagtgctcttttagttctgct

SEQ ID NO: 37629 - DNA, 102 bp, Homo sapiens
cctgatactttacatagttcttttataggatttgtcacaatttgtatttatgtattgacataattattgattagtggctctctcctatcttgtaagggcagg

SEQ ID NO: 37630 - DNA, 104 bp, Homo sapiens
gtatcgttatgtatatatgtgtatacatacatgtatttatatatccatatacatatgtgtatatatatacatgtatatatacacatatgtatacatatatatat

SEQ ID NO: 37631 - DNA, 66 bp, Homo sapiens
caatcctctctcactgggtccctcccacaacacatgggaattatgggagctacaagatgagatttg

SEQ ID NO: 37632 - DNA, 114 bp, Homo sapiens
tctgaagagggtgtagccaggtataacaagatgtctggggatgctttacatttcattttatatgaaattaaagccaaagaatggtcagatgtttgtgactttgctaggaaaaga

SEQ ID NO: 37633 - DNA, 64 bp, Homo sapiens
ctaggcttgagattttcttcatgcccagtcaactgatcataggaaattctccataaagccatag

SEQ ID NO: 37634 - DNA, 79 bp, Homo sapiens
ggtgaatgtaagaaataacagtttggtacaagtttctatagaaaatatattttgcattgttatttcacatactttcacc

SEQ ID NO: 37635 - DNA, 96 bp, Homo sapiens
cagtaaaatgagattatacaggtaagccctgattcaattttttttttttttttttttttttttttgagatggagtctggctctgtcgctcaggctg

SEQ ID NO: 37636 - DNA, 65 bp, Homo sapiens
gtttctctcactgtctcagttactctgcctcttagaatgaggctgtggtctgaagaggagaacac

SEQ ID NO: 37637 - DNA, 84 bp, Homo sapiens
tttcttcatgtcagtgacattctgtgtgtgagggctccgttagcatacaatctaacagaagctgtgtacagctgattggggaaa

SEQ ID NO: 37638 - DNA, 112 bp, Homo sapiens
ctaatcaaaaacaggtttatgtatttctgggttttggctaacatctcaactttagattttcttgttctcagccatatcactttctggaatgcttagaagctgtgcaaattgg

SEQ ID NO: 37639 - DNA, 82 bp, Homo sapiens
tttagttgctggtggagactgagaaagttgaggaagttgttttctgatcacctcattttttttttttcctatcagaactagg

SEQ ID NO: 37640 - DNA, 109 bp, Homo sapiens
ttaagactgagatatatgtgtgtgtttgtatatatatacacacatatatatttatacatgtatatatgtatatgtgtatatatatacacatacatatatttctatttga

SEQ ID NO: 37641 - DNA, 70 bp, Homo sapiens
gtatgtgtatatatatacacatatacatatatacatgtataaatatatatgtgtgtatatatatacaaac

SEQ ID NO: 37642 - DNA, 90 bp, Homo sapiens
aaaatgaggaactggataataaaatcttgaaaatgccatctagacctatggatggttctttgattatttttattttattttattcatttt

SEQ ID NO: 37643 - DNA, 114 bp, Homo sapiens
cagtagcacagtggatatgctgttatagatatggatctatggatttttttctatttaaatggaatttcagattggagatactatagtgtgatcagttaacctcacgttaatatg

SEQ ID NO: 37644 - DNA, 87 bp, Homo sapiens
ttgaccacagggtttcttgagtgtggtagaatagagtttgaaatgatctaaatgatgaagctttcaacactttcacttgggggtcaa

SEQ ID NO: 37645 - DNA, 82 bp, Homo sapiens
cacattgtaagtgctcaataaatatttctaaatgaataaatcaaaatggaaatgtttctatgtctacagcactctaaatgtg

SEQ ID NO: 37646 - DNA, 115 bp, Homo sapiens
gtttcagacaaacgaatgacatcatttagagctagatatggaacacagaacacagagtgaaaaaaaaaatctgagttgccattggcttggctctagattggtttgtgataaaggc

SEQ ID NO: 37647 - DNA, 64 bp, Homo sapiens
ctatctgtctgtctgtctgtctgtctggccagccagccagccagccagccagccagccagccag

SEQ ID NO: 37648 - DNA, 98 bp, Homo sapiens
ggagaaaaattattctggtagaaagattagatgtatatttgaatattcacatgagtaaattttacatctagggatttagcctagaaggagacctctcc

SEQ ID NO: 37649 - DNA, 60 bp, Homo sapiens
tgtgtgtgtgtgcatgtgttataaataaacacatttataacacactgacacagacacaca

SEQ ID NO: 37650 - DNA, 115 bp, Homo sapiens
gtgatcttatcattagtgtaaggcttgggaaattaggggggctaaagttgttttaatgctcgctctctctcactgtttcttgtattgctctatatttcctgagaatctcattcac

SEQ ID NO: 37651 - DNA, 68 bp, Homo sapiens
ttcagccatgtgagcatgcatgtgtgatgcacaaactcactcacacaagtgtgtgtgtatagcctgaa

SEQ ID NO: 37652 - DNA, 104 bp, Homo sapiens
ttgttttgctttgagacagggtattactctgtgggccaggatggagtgtgtcttactctgtcacccaggatggagtgcacgatcacagctcactgcaacctcaa

SEQ ID NO: 37653 - DNA, 97 bp, Homo sapiens
gcctcagggtccttcactcctatgggtcctttcccaggtatggggagacgctgtaggcagtgtgctcagatgctcacgtgtttttctgtttgtttgg

SEQ ID NO: 37654 - DNA, 128 bp, Homo sapiens
gctagaggggactggagtgggagaaatgtccttctcccaacaggaataaggctctggtagaatagacttttgttatggaaaaggctctgagtgtgctatttcacagtgattacctatctactaccttg

SEQ ID NO: 37655 - DNA, 58 bp, Homo sapiens
tgagtcagagtctcgctctgtcacccatgctggagtgcagtggctcgatctcggctca

SEQ ID NO: 37656 - DNA, 71 bp, Homo sapiens
tcaatggatcggatgaggcccactcactttctcacattatggagggtgatctgcttttctcagtctactga

SEQ ID NO: 37657 - DNA, 119 bp, Homo sapiens
cagcttgccctgtcctaaatatgtttgcaattggaaagatatttttgaagctcagtaatttttgttttattaaagaaaaatatcaaccaagtacagaaggttcgacgacaagttgcaag

SEQ ID NO: 37658 - DNA, 68 bp, Homo sapiens
gtgtttgtctctctgtccatctgtcactcctttttaaggtacctggagatgacctagaggcttgccac

SEQ ID NO: 37659 - DNA, 83 bp, Homo sapiens
agagtttgtttttttgacacggaatctcactctgtcacccattctggagtgcagtggtgagatcttggctcactgaaacctct

SEQ ID NO: 37660 - DNA, 88 bp, Homo sapiens
tattttggttccactgtctgtctgtctgtttacgtgctcatccacatcaatgtctgtattgaactgcaagctttagagagccagggtg

SEQ ID NO: 37661 - DNA, 94 bp, Homo sapiens
gtctcaatccctttctacatgggcatctctgcagggctgcctcactgtttggcagttggcttcccccaggatgaatgctccaagggaaggagac

SEQ ID NO: 37662 - DNA, 74 bp, Homo sapiens
caccctgccaggtctctgtctgacagtggctcacgcttttccacagcccctgtcaggtggcctctcccaaagtg

SEQ ID NO: 37663 - DNA, 90 bp, Homo sapiens
gttctatgaacctcagttgcattttccatggtttttaaaattatttttaattttgtagagactgggtctctgttacccaggctgtagagc

SEQ ID NO: 37664 - DNA, 114 bp, Homo sapiens
gatagaattcagctgtgaatccatctggttctggactttttttttattggtaatttttttttaattaccatttcagtcttgctgcttgccattgatctgttcagagcttctatt

SEQ ID NO: 37665 - DNA, 119 bp, Homo sapiens
atgtatatgatatatgtattccatatatatgatatatgtattccatatatatgattatatatgatatatatattccatatatatgatgtggtatatatatgaatgatgtgtatatatat

SEQ ID NO: 37666 - DNA, 58 bp, Homo sapiens; identical to SEQ ID NO: 19989

SEQ ID NO: 37667 - DNA, 89 bp, Homo sapiens
gcagagcagctctcacagccgctgtttccagggagcgtggagcttcagtatcactcactctgacactggcaccagggagtctgcactgc

SEQ ID NO: 37668 - DNA, 86 bp, Homo sapiens
tacttttcagtggtagtattgagtatgtgtgtcagtgtcttgcatttatacacatcattatttatttattacagctgtctatagta

SEQ ID NO: 37669 - DNA, 100 bp, Homo sapiens
gaaagaggggcacctgggatttgaacacgtatctctaacaagagttttcaaactttttgttaagctatggaatcttttccaataggaaaaccttctgttc

SEQ ID NO: 37670 - DNA, 117 bp, Homo sapiens
ctgtaaatttgttcatgtctggaatttgattgaggggacataattctttatttttataattaaaattagtttttgtccactcggcctagaagcttttgcttatacaaattactatag

SEQ ID NO: 37671 - DNA, 113 bp, Homo sapiens
taacgtggctgtatttggatgataagattataggtggttgttaattttcatacattcatttatttatttcatacattcatttatttatcaaacttctaaataagcatatgtta

SEQ ID NO: 37672 - DNA, 95 bp, Homo sapiens; identical to SEQ ID NO: 580

SEQ ID NO: 37673 - DNA, 93 bp, Homo sapiens; identical to SEQ ID NO: 69

SEQ ID NO: 37674 - DNA, 109 bp, Homo sapiens
tggctcaaggcaaagtcctcggagtcatcttcctggctctctcacactctgcatcagcaaatccttctgcgccatcttcaaaatgagtcctgactttggccacttccca

SEQ ID NO: 37675 - DNA, 95 bp, Homo sapiens; identical to SEQ ID NO: 68

SEQ ID NO: 37676 - DNA, 93 bp, Homo sapiens; identical to SEQ ID NO: 69

SEQ ID NO: 37677 - DNA, 100 bp, Homo sapiens
atgtagttgagcagttttgagtgagtttcttaatcctgagtctagtttgattgcactgtggtctgagagatagttccttataatttctgttcttttacat

SEQ ID NO: 37678 - DNA, 118 bp, Homo sapiens
agatattctctgtgttacctgagcggtgtatctgctgacagtgctacatcataaaataagatttgtgatattgttggagatataagatggtgagtgatgatcacagagtacagcatct

SEQ ID NO: 37679 - DNA, 75 bp, Homo sapiens
agcagctgatcaattacaggcaagagagagagctgacccagtttcttttgcctcataggacttcagtcagttgtt

SEQ ID NO: 37680 - DNA, 96 bp, Homo sapiens
tgcctagagttttcattgtacctttttttttttttttttgagacagagtcttgctctgttgtctaagctggagggcagtgatctcagctcattgca

SEQ ID NO: 37681 - DNA, 73 bp, Homo sapiens
cacctgcagtcttagctactctggaggctgaggtaggaggatcatttgagcctgggaagttaagactgaagtg

SEQ ID NO: 37682 - DNA, 57 bp, Homo sapiens
gagatggtgccactgtactccatcctgggtgacagagtgagtgagtgagactgtgtc

SEQ ID NO: 37683 - DNA, 77 bp, Homo sapiens
tgctgagggtgagaagtcagtgaggattgggcgggtcccacaacatcaaagcctcaccatggactgttcaccttgca

SEQ ID NO: 37684 - DNA, 109 bp, Homo sapiens
tctctctccccctagtacagtgtgctctccatgcaaacaggagctttgtgtgttttactctctgctatatcctcattcatggaggggcatgcagtttggctttgaatga

SEQ ID NO: 37685 - DNA, 80 bp, Homo sapiens
ttccagatcaactgaacttgagagaatttgttgttaacagatccatcttaacaagaaatactaaaggaagttatttggga

SEQ ID NO: 37686 - DNA, 93 bp, Homo sapiens
ctgtggtctcaagctcctcagcctcccaagtactacgcccctctaattgtttaatttttttttgtagagatgaggtcttgctatgttgcccag

SEQ ID NO: 37687 - DNA, 130 bp, Homo sapiens
actccagcctggatgacacagcgagactccgtctcaaaaaaaaaaaaaaaaaaagacagactctcactctgacacccaggctggagttcagtggtgtgatcatagcttactggagcctcaaactcctggg

SEQ ID NO: 37688 - DNA, 91 bp, Homo sapiens
tcatttggatgaagaattagtggtttagcctttgaaatgaataccttgaatcatttcttctgattttctagtagtttattatctcaaatga

SEQ ID NO: 37689 - DNA, 90 bp, Homo sapiens
cttcctctgtgtggcagaactcggccgctctgcctggctccctgtttccgcaccgagaggcctagacgaagcatgtggtttccaaggcag

SEQ ID NO: 37690 - DNA, 72 bp, Homo sapiens
ccaggtgtggtggtacatgcctgcagtcccagctactagggaggctgaggtagaagaatcacttgaacccgg

SEQ ID NO: 37691 - DNA, 75 bp, Homo sapiens
gtggggggtcagaaagtgagagaagagtgtgccctgtggccattcccttacttaatacttactgaagcatcctgc

SEQ ID NO: 37692 - DNA, 112 bp, Homo sapiens
gccctgtcagtatgtatatgtatatgtgtgtatttataatatatatataactatatagagatctatatgtatgtatgtatctgcatctatgtatctatgtattttccagtcc

SEQ ID NO: 37693 - DNA, 94 bp, Homo sapiens
ctgtgtctcaaacttctgtggatgtcactctgtgtctcaaacttctgtggatgtgactcagagtcataaagatgtttctcaaggagacccccag

SEQ ID NO: 37694 - DNA, 92 bp, Homo sapiens
tgtgctgcagatcaaaggagaggtttttacataggtaccatctgtccctgtctgcctgagagaggccctgtttaaccttttgtttcagcata

SEQ ID NO: 37695 - DNA, 95 bp, Homo sapiens
ctgtatttgttcatgtggaatgtaaagttggaagtaataataatacatatttacatagtgctttaactttgagcattttgatgtagcactgacag

SEQ ID NO: 37696 - DNA, 58 bp, Homo sapiens; identical to SEQ ID NO: 23944

SEQ ID NO: 37697 - DNA, 94 bp, Homo sapiens
ggccaggctcttgtaggtgagaggtgacagtgtgctggcagccctagctcgctctcagcgcccactctggctgcgcttgaggagcccttcagcc

SEQ ID NO: 37698 - DNA, 117 bp, Homo sapiens
gaatgcaaaatggtgccaccactttggaaaaataagctggcagtttcttataaaattagtcattataatactatgtgaaaaaagccaatctcaaaaggtggcatgacattttctttc

SEQ ID NO: 37699 - DNA, 96 bp, Homo sapiens
gtgcttgcagttcctgaaaaagagggatgggagttggaaatcagcaaaatacttttttatttttggatcctctcctttttataaaatctgcagtac

SEQ ID NO: 37700 - DNA, 102 bp, Homo sapiens
gttatgtgagcactttctctggatgataaattatcttctatgtgcatgtgcatgtgttgtgtatgttgacaggtcacacatcagaaactgccacttcatagc

SEQ ID NO: 37701 - DNA, 76 bp, Homo sapiens
gacctgtacttttcagctctctttatagatctattttatctgtagactgtgagctctcaaggacaagcaccaggtc

SEQ ID NO: 37702 - DNA, 64 bp, Homo sapiens
ggactgggagaatggaggcaagaaaagggcatagtttgactccctctgtgtctcttcccagttc

SEQ ID NO: 37703 - DNA, 63 bp, Homo sapiens
cattgggggaaactgcgtgagggtacaggggacctctctgtactatctctgtaactctctgtg

SEQ ID NO: 37704 - DNA, 80 bp, Homo sapiens
gatgttgtattgtaaggggccggctgcagctctgctccagctgtcattgtggagctgacagagctcattgtggacagatc

SEQ ID NO: 37705 - DNA, 118 bp, Homo sapiens
tagcctcccgagtagttgggactacagatgcggatcaccatgcccagctaagtttttgtattttttatagagacaaggttttgctgtgttgccaggctggtctcaggctcctgggctg

SEQ ID NO: 37706 - DNA, 82 bp, Homo sapiens
gcctctgcggctctgacaggagactgagctcagtagcaatgctcacctgcctgctgctcacctcctgctgtgcggcccaggt

SEQ ID NO: 37707 - DNA, 74 bp, Homo sapiens
tccttgtgcacacagtgcatttgccagctggccgagactctggctctcagtggctgtggaggtgttaacttgga

SEQ ID NO: 37708 - DNA, 94 bp, Homo sapiens
gcatactgtatcctagcctctttatctcatttttggctggctccaagtatgaccagtcagcagtgagaagaaagtttgctgagataaccaaggc

SEQ ID NO: 37709 - DNA, 74 bp, Homo sapiens
cgagtttggcagtacagtctgtgctgagagagaagctcagccgtaagaataatagactagtagattcactcttg

SEQ ID NO: 37710 - DNA, 82 bp, Homo sapiens
ccaccagttgcttcttttagttagcatggaatttttctgtttcattaattaattaatagcaattgtcattttgaagttgtgg

SEQ ID NO: 37711 - DNA, 90 bp, Homo sapiens
tgtatgtgtgaatacacacatagtaaatatgtgcgtgtatatatatgtaaatatatatataaaatgtatgtatgtgtgaatacacatata

SEQ ID NO: 37712 - DNA, 103 bp, Homo sapiens
cttagaatagtgcctgatatgcagtaggtacttaataaatattgtgtaatcaatgggtgaatgagagaagagtctgtgcactttcaggaggctgtaggataag

SEQ ID NO: 37713 - DNA, 70 bp, Homo sapiens
gtgacagagagagagagagagggaggagagactgtatcactcacctctgtgtctctgaacttatcttcat

SEQ ID NO: 37714 - DNA, 114 bp, Homo sapiens
gctgagcatggtggtgcatgcctgtagtcccagctactcaggaggctgaggtggaaggatcacttgagccccaggcatctaggagtttgaggctgcagtgagctatgatcttgc

SEQ ID NO: 37715 - DNA, 73 bp, Homo sapiens
acacgagaacaggctcttgggggctcagtcacgttaattcagagctttgaagtaaaagcttgtaaacttgtgt

SEQ ID NO: 37716 - DNA, 56 bp, Homo sapiens
gctcacacctgtggtcccagctactcaggaggctgaggtaggaggatcacttgagc

SEQ ID NO: 37717 - DNA, 111 bp, Homo sapiens
gatagtgtccagcacaggatgtgtactcaaggaatgtatttttatttttagctattttttattttgttattttattttagattcaggggctacaaggtgctggtttgttac

SEQ ID NO: 37718 - DNA, 123 bp, Homo sapiens
catgtagatgttaatgctctgtgggtttttatcttttattatttgtcacataataattgtatatctatatgggtacagagttgatatttccatgaatatatacaattagtgatgatcaaataa

SEQ ID NO: 37719 - DNA, 110 bp, Homo sapiens
ggtctcaactctagtttaatggatgatatgtgaattgctggcaaaaatattaagtattagtattttattaatagattttatatattcaccaaaaaacttagtaatagtcc

SEQ ID NO: 37720 - DNA, 102 bp, Homo sapiens
gttccaatttctccatgtcttcaccaacatttgttatcttttttatttttataatagctatcctaacaggtgtgaggtgatatctcactggttttggtttgc

SEQ ID NO: 37721 - DNA, 93 bp, Homo sapiens
ttgtcaagctagccttgaataggagactaaagaagttctaaccaggatttcagaaaaaaatgtctttttatttttaagtgtgagcaatggcaa

SEQ ID NO: 37722 - DNA, 58 bp, Homo sapiens
gtgccatgagatgtgtctgtgtgaggccaccctgcctcacccatggccagcatgtgac

SEQ ID NO: 37723 - DNA, 116 bp, Homo sapiens
ccttgaatgtaacttgattaaattctccaattaaaagagtggctgaatcaatttttttttaaaagacctaaccattttttgcctagaagagaatgagactcagttcacttgtaagg

SEQ ID NO: 37724 - DNA, 97 bp, Homo sapiens
ccttaacttgttggtataggagttattataggttgtagactatagaaggtagattacttaaccataattttttttgtattatactttaagttctggg

SEQ ID NO: 37725 - DNA, 116 bp, Homo sapiens
gaccccaaggattttaggagttatgagctaggaactggcagtgaaaatcagtatatatgtatatatcataatactggaggccatcctctggtttttgaccatggatttctcacatc

SEQ ID NO: 37726 - DNA, 100 bp, Homo sapiens
gtttattctttctccttaggataaaagtttacacaccaaagttacagtgttacaatactctgtatttttctgtgtacttactattaccagagagttttgc

SEQ ID NO: 37727 - DNA, 94 bp, Homo sapiens
ggtatatatccaggagtgggatggctggatcctatggtagttctatttttgatttttgaggaacctccaaacccttctccacagtggctgtact

SEQ ID NO: 37728 - DNA, 103 bp, Homo sapiens
gctgtctatctcatttcttaggtctattagtaattgttttataaatttgggatctcccaaatttatatatttatgattctgatacttccctgttggacaaagc

SEQ ID NO: 37729 - DNA, 86 bp, Homo sapiens
gcactcaaactgcaactgctattatatctttttttttttttttttttgagatctagtttccgctcttgttgcccaggctggagtgc

SEQ ID NO: 37730 - DNA, 114 bp, Homo sapiens
ccaaagtgctgggattacagatgtgagccaccacagccgtctccaagttttttttgtttttttttttgtttgttttttttttgagacggagtctcgctctgtcgcccaggctgg

SEQ ID NO: 37731 - DNA, 119 bp, Homo sapiens
atttccctcttaatactgctgaagcagcatctcccagattttgatatgtcgtgtttcattttttttaacttttattttaggttcatgggtacatgtgcaggtttgttatacgggtaaat

SEQ ID NO: 37732 - DNA, 81 bp, Homo sapiens
catagagaaaagagatttatatctagttgcttgtgtctcaaatttggggtgtcaagtaacttatttatatttttagctgtg

SEQ ID NO: 37733 - DNA, 82 bp, Homo sapiens
tgtgcagcataatcattataattccctcactgagtgcattttatatctctcgtaatgtaagatagaagagggtgtgctcaca

SEQ ID NO: 37734 - DNA, 101 bp, Homo sapiens
gcacttggaacagtgattggaacgtagtatgtatctgataaatgtttatcattattttgttacctttattttggaaacatattccaatgtgtcccaggttc

SEQ ID NO: 37735 - DNA, 119 bp, Homo sapiens
ttccttgaaagaagaaagtgctaagtgcccagtgaatatttattgaattaaattaaaaaatttaatatgtataaatattttctaggtatgacattggcatgatgtgttcttatgatgaa

SEQ ID NO: 37736 - DNA, 70 bp, Homo sapiens
gtagacatagagcacaatcaggacaatagtctgaactcctgggttctggtcactgctcttctctgtctac

SEQ ID NO: 37737 - DNA, 58 bp, Homo sapiens
tgaggcagagtctcactctgtggcccaggatggagagcagtggtgtgatctcggctca

SEQ ID NO: 37738 - DNA, 68 bp, Homo sapiens
tctcttactcctctctggaatgtagtcaggcagcgtttagtaactatatccagagatgaagtcattga

SEQ ID NO: 37739 - DNA, 174 bp, Homo sapiens
tatatcgatatctatctagatagatatctatatatcgatatctatatctatctagatagatatctatatatctatatctatctagatagatatctatatatctatatctatctatacagatatctatctatctagatagatagatagatatctagatagatggacagatagata

SEQ ID NO: 37740 - DNA, 112 bp, Homo sapiens
tgatttttatatgttgacttggtatcttgcaactttactgaatttgtttatcagttctaacagtttcttggtggagtgtttagcttttcaagatataagatcatatcatatg

SEQ ID NO: 37741 - DNA, 108 bp, Homo sapiens
ttctattagtgctgagtgtgttctggatactcaaatgtctttttatttgaattgaatagagaaagattgaggggttctagaattaaaaacaacttcaactacatagaa

SEQ ID NO: 37742 - DNA, 95 bp, Homo sapiens; identical to SEQ ID NO: 68

SEQ ID NO: 37743 - DNA, 93 bp, Homo sapiens; identical to SEQ ID NO: 69

SEQ ID NO: 37744 - DNA, 103 bp, Homo sapiens
tggcagtgatcaaggggtttgatgacaacaaactatacatacgtgtatatgtatgtatatattatgtgtgtttatgaaaaaaatttctgccttcactgtgcca

SEQ ID NO: 37745 - DNA, 112 bp, Homo sapiens
tattgtaattacaattattaggctgaatcatataaagtagctaattttcaaactttttaatctacagaaatggcagcttaataattcaaacttttataatttaatcacaata

SEQ ID NO: 37746 - DNA, 71 bp, Homo sapiens
gggtgatttgactggctccctctagccctgatgaacccatgccaggctgaagcagccagttctccttcctc

SEQ ID NO: 37747 - DNA, 85 bp, Homo sapiens
ctctacaaagggctgaacagcagaaaatgtttttttttttttttttttttgagaccaagttttgctcttgttgcccaggctggag

SEQ ID NO: 37748 - DNA, 58 bp, Homo sapiens; identical to SEQ ID NO: 1101

SEQ ID NO: 37749 - DNA, 56 bp, Homo sapiens; identical to SEQ ID NO: 1102

SEQ ID NO: 37750 - DNA, 95 bp, Homo sapiens; identical to SEQ ID NO: 68

SEQ ID NO: 37751 - DNA, 93 bp, Homo sapiens; identical to SEQ ID NO: 69

SEQ ID NO: 37752 - DNA, 95 bp, Homo sapiens; identical to SEQ ID NO: 68

SEQ ID NO: 37753 - DNA, 93 bp, Homo sapiens; identical to SEQ ID NO: 69

SEQ ID NO: 37754 - DNA, 71 bp, Homo sapiens
tcaagcacacagactctttctctgtgccatgtagccactactgaggaaaaggggaggagtggtgttactga

SEQ ID NO: 37755 - DNA, 116 bp, Homo sapiens
gttgctttagcaggaaaaaggaaaaggcatggtgtttctgtaacatttatatttatctgtaaatactaatgtgtgagccatgtatgaatcttatttcagtgctgttgaataccaac

SEQ ID NO: 37756 - DNA, 103 bp, Homo sapiens
ggccaaggtgacaggatgccagggcccttctcactctgacatcttcaaacttctttttttttttttttttcttgagacagagcctcactctgtcacccaggct

SEQ ID NO: 37757 - DNA, 113 bp, Homo sapiens
aagtgttcccttttgaccacaatcttgccagcatctattattttttgactttttaataatggccattttgattggtgtaagatggtatctcattgtggttttcatttgcattt

SEQ ID NO: 37758 - DNA, 58 bp, Homo sapiens; identical to SEQ ID NO: 6327

SEQ ID NO: 37759 - DNA, 89 bp, Homo sapiens
cagaaggatgtgacaactgactgtggactcttccctttggttcagtccaaaaatatttttatgtcatcattgtagtcatgtctcctctg

SEQ ID NO: 37760 - DNA, 77 bp, Homo sapiens
gtgagcaacattttgaggggtctttcttctctctgagtgtgtcagtcagaaaaacatcctgctcaggatctgctagc

SEQ ID NO: 37761 - DNA, 98 bp, Homo sapiens
agttgatgggtgcaaaatggtatctcactgtggttctagtttctttttcaaggaatcctgatgacactaagcacagtttcatttgtttactatcaact

SEQ ID NO: 37762 - DNA, 100 bp, Homo sapiens
tgaaagtgatcttggcaatccttagttgcagttggtatcagaagtgagagtggtctttgatatcccagaatatgcactaagtgaatatattcacatttta

SEQ ID NO: 37763 - DNA, 87 bp, Homo sapiens
ctcaggctatgtccttacagcagggataagagtgaagggacttccagaaagcagttcagacacaccactgtgaggtcagagcactag

SEQ ID NO: 37764 - DNA, 117 bp, Homo sapiens
agatgttatgcctttgttctcagggattatcatttttatttttagccagctttatttttttaatatgtaaaactttctacaaatgaaaaggcatgatctaatttataggttatattt

SEQ ID NO: 37765 - DNA, 78 bp, Homo sapiens
gcctggcatggtgccatgtgcctgtagtcccagctacttgggaggctgaggtaggaggatcacttgagcctgggaggc

SEQ ID NO: 37766 - DNA, 78 bp, Homo sapiens
gaaaacaaagttcaggtggatttaagaaacttgctcatggtcccagagctagtaagttgtacatttgggtttgtagtc

SEQ ID NO: 37767 - DNA, 95 bp, Homo sapiens
gttttcgttctctgcataggactttttattatgtgtaaaaaatgtctttattctgtttctttacactagaaagtgagctatttgagagcaaggac

SEQ ID NO: 37768 - DNA, 103 bp, Homo sapiens
tgtgtgtgtgaatatatgtatgtgtatatatgtctgtatatgtatatgtatgtatatgtatgcatacatatacatacacatgtatgtgtatgtgtacgtatat

SEQ ID NO: 37769 - DNA, 105 bp, Homo sapiens
gactttatatatatatatgtacacatacatatgtatgtatatatgtgtgtacatgtgaataggtctatatatacacatacatacgtatgtatacatgtgtgtatg

SEQ ID NO: 37770 - DNA, 112 bp, Homo sapiens
agatgccaggtagcgtaagtaagacaactattgctctcaaagttattgatggtgggaagacagatgagtgactgcaatgctgtgttacaaatgcaactacagggtaagctct

SEQ ID NO: 37771 - DNA, 98 bp, Homo sapiens
gcgccatcagtggtgaaggagagacacctgcttccaccatcacgcttgtgtgaatacagctttgtgtgtctctgtcatttacatccacgtgctgctgc

SEQ ID NO: 37772 - DNA, 105 bp, Homo sapiens
ctgcctgatatggtttggttctgtgtcccccaaatctcatgtcaaattgtaattctcaatgttgggggaggggcctggtgggaggtgattggatcatgggggcgg

SEQ ID NO: 37773 - DNA, 107 bp, Homo sapiens
caggatgatcagtcatgagcgccagtgcttacggtttgtgttttgttttgtttttttttttttaagcaaactaatcactctggaagacaccactctgtctgtttttg

SEQ ID NO: 37774 - DNA, 85 bp, Homo sapiens
atgctcagtgcgttttgctgagtttgctgagggaagactgttttctgttctctctcacacacacagagtggatgaggatgaggat

SEQ ID NO: 37775 - DNA, 83 bp, Homo sapiens
atatagacattatatatatggggattatatatattaagaaaatatatttatatatagtcaaacatatatgtgtgtgtgtatat

SEQ ID NO: 37776 - DNA, 100 bp, Homo sapiens
aggaggagaccaaggcacagagaggttaaggaagctgcccagtgtcacacagactgagattgtcaccgctctgcctgactgctgctggggtgacgctgct

SEQ ID NO: 37777 - DNA, 75 bp, Homo sapiens
atgaccttgacagtggtgaggagtgctgctcggtcactctgcaggacggtttttcactctggctctgtctggcat

SEQ ID NO: 37778 - DNA, 75 bp, Homo sapiens
tgtgtatatgtatatacatacacatattgtaggtatatatgtgtatacatgtatgtatgtatatacatatatata

SEQ ID NO: 37779 - DNA, 75 bp, Homo sapiens
cagagcaaggccctgtttaaaaataataataaatttttaaaaaatatatgtgttttgagacagagtctcactctg

SEQ ID NO: 37780 - DNA, 89 bp, Homo sapiens
gtatatgtgtaaatgtgtaaattgtggagtgagccatagtagtttattaatttttgtgtgctcattgtgtggttaaataaaatgtatac

SEQ ID NO: 37781 - DNA, 108 bp, Homo sapiens
ggctcacagttttggaggctgggaagtccaagatctgagagccagctttgttgggttctggtgaatgctctcttctggattgtggacttcagacttcttgctgtgccc

SEQ ID NO: 37782 - DNA, 101 bp, Homo sapiens
gacaggagtgagacttcatctcaaaaaaacaaaacaaaaaccatgaaattctttttttttttttttttttttttttttttgagacggagtctcactctgtc

SEQ ID NO: 37783 - DNA, 104 bp, Homo sapiens
atagacaaaaaaaggaaagttgtcagagataggcccccaggagtgattttttttttttcttctggaatgcctagaatcttattgcttctgcttctcatgtgtat

SEQ ID NO: 37784 - DNA, 68 bp, Homo sapiens
aggcatagtggtgcacacctacagtccaagctacttgggaggctgaggtaggaggatcacttgagcct

SEQ ID NO: 37785 - DNA, 58 bp, Homo sapiens
tgagatggagtctcactctgtcacccaggctggagtgtagtggtgcgatctcagctca

SEQ ID NO: 37786 - DNA, 117 bp, Homo sapiens
gctcaggtaaaattcaactttgtcaggttacaaatcatgcatttcctatttctcaaattgtatttcagataaaagagtgaaatgtaggctttaacacgacttgaggcacttctgggt

SEQ ID NO: 37787 - DNA, 58 bp, Homo sapiens; identical to SEQ ID NO: 1435

SEQ ID NO: 37788 - DNA, 88 bp, Homo sapiens
gccctttttcagtctggagagtatgtgattctttttctttttcttttttttgagacggagtctcgctcagtcacccaggctggagtgc

SEQ ID NO: 37789 - DNA, 75 bp, Homo sapiens
gtgactctagagtctgtgctgtcaatcactggatatacccattgttaaaactgattataggccaggtggagtggc

SEQ ID NO: 37790 - DNA, 80 bp, Homo sapiens
tttgttttttttttgtgagacggagtctcgctctgtcacccagactggagtgcagtggcgtgatctcggcttactgcaag

SEQ ID NO: 37791 - DNA, 111 bp, Homo sapiens
tgatgtttttgctttatattttttttaggctatgtttatatgtttacaacctatgtatatatgtttataacctatgaatatatcttaataaacctatgtgcataagtttca

SEQ ID NO: 37792 - DNA, 115 bp, Homo sapiens
caccactgcactccagcctgggcaacagagtagtaatctctttttttttttttttttttttttttttttttgagaaggagtctcgctctgtcacccgggtgggagtgcagtggtg

SEQ ID NO: 37793 - DNA, 110 bp, Homo sapiens
ttataagtaatctagagatgatttaaagtgtgtaggaggatgtgagtaggtcatatgcaaatactatgtaattttacataagagacttaagcatccgtggattttggtaa

SEQ ID NO: 37794 - DNA, 59 bp, Homo sapiens
tggagccctgtctgtgtgactgtcagggagaactggcctgccacagatatgaggtctca

SEQ ID NO: 37795 - DNA, 79 bp, Homo sapiens
ctggcacaactgctgtgacatttcagcttttttttttttttttttttgagaaggagtctggctctgtcgcccaggctgg

SEQ ID NO: 37796 - DNA, 72 bp, Homo sapiens
ctgggcatggtggtgtatgcctgtagtcccagctactcgggaggctgaggtagaaggatcacttgaacccag

SEQ ID NO: 37797 - DNA, 58 bp, Homo sapiens
tgagacagagtctcactctctcgcccaggctggagggcagtggcgcgatcttggctca

SEQ ID NO: 37798 - DNA, 116 bp, Homo sapiens
atatatatatatatatatatatatatatgtatgtatatatatgtgtatatatgtatatatgtgcatatatatgtatatatatgtgtagatatatgtgtatatgtgtatatgtgtat

SEQ ID NO: 37799 - DNA, 58 bp, Homo sapiens; identical to SEQ ID NO: 6359

SEQ ID NO: 37800 - DNA, 76 bp, Homo sapiens
gtgggctggcatggggcatgggatggtcaggctgggatggctggatctgactagctccctctcagtctctgccgac

SEQ ID NO: 37801 - DNA, 94 bp, Homo sapiens
gagactgtaagaaacactttggtttttactggatacattaaatgtgctcactttgtgtgtctgtgtcacattttggtaattcttgcaatatttc

SEQ ID NO: 37802 - DNA, 98 bp, Homo sapiens
aatagagtggatcaaaacataatatgaatatatttcttccacatccatgaggatgcaacagaatatattaattttagttttacagaaacattactgtt

SEQ ID NO: 37803 - DNA, 58 bp, Homo sapiens
tgagatggagtctcactctgtcacccaggctggagtgcagtagtgtgctctcggctca

SEQ ID NO: 37804 - DNA, 66 bp, Homo sapiens
gagatggagtctcactctgtcgcacaggctggagtgcagtggtgtgatctcggcaagctccccctc

SEQ ID NO: 37805 - DNA, 118 bp, Homo sapiens
ggggtacctgcacctggtgcaagagcaagaccctgacccgtcctgcatgtccagtgtccacagactgaggacactgggctttgtgtgactgtgagggcacctgacgcagccttgccct

SEQ ID NO: 37806 - DNA, 85 bp, Homo sapiens
caggaggctgaggtaggaggatcaatcgcttgagcctgggagttcaaggctgcagcgagctatgataccactgcacacctgcctg

SEQ ID NO: 37807 - DNA, 110 bp, Homo sapiens
tgcttaggattgtcttggctatatgagttcttttttggttccatatgaaatttaaagtagttttttctaattctgtgaagaaagtcagtggtagtttgatggggatagca

SEQ ID NO: 37808 - DNA, 102 bp, Homo sapiens
ggtgtggtggtgtgcacctgcagtcctagctacttgggaggctgaggtggaaggatctcttgaacctgggaggcagaggttgcagtgagccaagattgtgcc

SEQ ID NO: 37809 - DNA, 112 bp, Homo sapiens
ctatctatatggtatatgtatggaattctgaggagagaacagagactggacaatgcaagctcacttgtctgtttttgtgtccatggcattttaagcatggctggttaagtgg

SEQ ID NO: 37810 - DNA, 70 bp, Homo sapiens
cctagcctctctgtgcctcagtctccccatgtgacaacggagactgtgccagtttcaagagcctcccagg

SEQ ID NO: 37811 - DNA, 131 bp, Homo sapiens
agccgacatgcttcgggtctgcagcccaacggtagtcccgttctcaccttgtcggttctcactttgtctgtgtctcagagcatggggtggggacctgcactgttcccaggtccatggacgaatgtgagagc

SEQ ID NO: 37812 - DNA, 103 bp, Homo sapiens
ttctctcaggggaattctaccccagtgagatcacagtcaggagaaactgaagagaggctgtgccaccttcactggcatcgctgggtgtggccctctgagtgga

SEQ ID NO: 37813 - DNA, 66 bp, Homo sapiens
gggggcgggggtgagtcaagttcattcttttttttttttttgagacggagtctcactctgtcaccc

SEQ ID NO: 37814 - DNA, 87 bp, Homo sapiens
gcatttcctagatgagctggaagatgaggccaaagctgtctgaacccaagctctggcaagggcgtcagcacctcaatctggatgggc

SEQ ID NO: 37815 - DNA, 73 bp, Homo sapiens
attggagaattctttagtatatttagtatattttttagtatatttgtatttcatgattggagaattctttagt

SEQ ID NO: 37816 - DNA, 89 bp, Homo sapiens
cattcgtttacaagtttttgtgtgaatgtgtattttttttttttttttgagatggagtctcgctctgtcacacaggctggaatgcagtg

SEQ ID NO: 37817 - DNA, 106 bp, Homo sapiens
atgggagatatatatatatatacacacacacacacatacgtttatatatagacacctacatatatatatatatgtgtgtgtatgtgtatgtgtgcctatatactat

SEQ ID NO: 37818 - DNA, 58 bp, Homo sapiens
tgagatagtgtctcactctgtcacccaggctggagtacagtggtgagatcttagctca

SEQ ID NO: 37819 - DNA, 90 bp, Homo sapiens
tccagagaagttatctgaatataagacagaagcaggatttgaaatggtgtctctcagactctgagattcatattcagatgctacctagga

SEQ ID NO: 37820 - DNA, 110 bp, Homo sapiens
acattgatatatttgatatattggggtttgttttatctggtctagatattttaattggtttaaaacatttattttttgattaacaccctcttgtctctggaatacaatgt

SEQ ID NO: 37821 - DNA, 58 bp, Homo sapiens; identical to SEQ ID NO: 1725

SEQ ID NO: 37822 - DNA, 107 bp, Homo sapiens
gctttgttcttcttgcttagaattgtcttggttatatgagctcattttggttccatatgaaatttaaagaagtttttgctaattctgggaagaaagtcaacagtagc

SEQ ID NO: 37823 - DNA, 90 bp, Homo sapiens
tggaaagagactacatggaaaaaactttataactgtgactcagtctgtgaggttgactatagccaatcatcaaaaaatggtctttatcta

SEQ ID NO: 37824 - DNA, 113 bp, Homo sapiens
gttttataggtgaagtgtgtttcttgtaggcagcagttcattgggtcttaattttttttttaaatccattcagccattctatgccttttcattgaagatcttagcccatttac

SEQ ID NO: 37825 - DNA, 76 bp, Homo sapiens
gaatgtgtattctgcagttgttggaaagaatgttttgtaaatatctatcaagtctatttgttgtagagtacacttc

SEQ ID NO: 37826 - DNA, 67 bp, Homo sapiens
gcatcactcccaacttagctctttttatatttaaagttacctgctggcacatttgggggtggggtgc

SEQ ID NO: 37827 - DNA, 60 bp, Homo sapiens
ttccaagtgtatatatgtgtgtgtgtatatatatatgtatatacatatgtatatttagaa

SEQ ID NO: 37828 - DNA, 112 bp, Homo sapiens
agcatctttttatatgcttatttgccatctgtatatctttttttaaattatactttaagttctaggatacatgtgcagaatgtgcaggtttgttatataggtataccgtgct

SEQ ID NO: 37829 - DNA, 63 bp, Homo sapiens
atacatacatatatgtatttatatatacaaatttgtatatatgtaatgtatgtgtgtgtgtat

SEQ ID NO: 37830 - DNA, 120 bp, Homo sapiens
agaggcaacatgtgaaaggattttaggactacagatgtggtgattgtgtgaaggaagagagcacagtagttacatggcttcagactcccatatatctaggttggaatcctgactctgtgt

SEQ ID NO: 37831 - DNA, 98 bp, Homo sapiens
aggtaaggtggcattgcattgtggttttgatttgcatttcccgcatcattagtgatgttgagcatttttatttatgtttgttggccatttgtatatct

SEQ ID NO: 37832 - DNA, 68 bp, Homo sapiens
tgttttgagacagactgtcactgtgtcaaccaggctggagcacagtggcgcgcttacagctcactgca

SEQ ID NO: 37833 - DNA, 107 bp, Homo sapiens
ttgtcagtcatgtagtgtgtgtgtattatctttatatatgccatatattatatgtatattatttataatatatagataaaatatacattgtatatagaaacagacaa

SEQ ID NO: 37834 - DNA, 107 bp, Homo sapiens
ggatatagcttcagataaaaactagaaagaaggtttctgagaaactgcttcatgatgtgtgcattcatctcacagacttaaacttcttttttgatggagtagtttgc

SEQ ID NO: 37835 - DNA, 113 bp, Homo sapiens
tgtgcattcatctcacagagttaaacctctcttttcattaagtagtttggaaacatttttttttttatattttgtgaaggggtattttgtagaggattgaggccagtggtgaa

SEQ ID NO: 37836 - DNA, 93 bp, Homo sapiens; identical to SEQ ID NO: 69

SEQ ID NO: 37837 - DNA, 95 bp, Homo sapiens; identical to SEQ ID NO: 68

SEQ ID NO: 37838 - DNA, 93 bp, Homo sapiens; identical to SEQ ID NO: 69

SEQ ID NO: 37839 - DNA, 82 bp, Homo sapiens
taggcccctctttcgtaactcaggttcatccagactgtgtcagtctctggatctataaccttcaatgattccttatggctta

SEQ ID NO: 37840 - DNA, 63 bp, Homo sapiens
tgcgtagttgctcatgtgtacatacaaatagtcacttgtgtgtgtgtaagcagagtaaaagta

SEQ ID NO: 37841 - DNA, 151 bp, Homo sapiens
tatatatatatatatatatatatatatatatatatatatatatgtatacatatgtgtatatatgtatatatacacatatatatacgtgtatatgtatatatatgtatatatatatacacgtatatatatacctgtatatatacacgtatat

SEQ ID NO: 37842 - DNA, 154 bp, Homo sapiens
atatatatgcatatatacgtgtatatatacaggtatatatatacgtgtatatatatatacatatatatacatatacacgtatatatatgtgtatatatacatatatacacatatgtatacatatatatatatatatatatatatatatatatat

SEQ ID NO: 37843 - DNA, 108 bp, Homo sapiens
cacctcaacagattgtatcctcacccctatctgaccttattgttgctcacactctgtgtcccagaataaaattccgagacaaaggaggagtgcctccctgatgacctg

SEQ ID NO: 37844 - DNA, 101 bp, Homo sapiens
gtatgttattgtatgtatgtggatatattaagttgtatatacacatattaaatatatatacatatattatattttatacatatacatttgtttcctcatgc

SEQ ID NO: 37845 - DNA, 117 bp, Homo sapiens
ccaatgtgctaggattacaggagtgagccactgtacccaacctatatttgtatatacattaaattgtatatgttaggcctggcgcggtggctcacatgtggaattccagcaccttgg

SEQ ID NO: 37846 - DNA, 97 bp, Homo sapiens
acagtgttatataaccctttggaaagaaatcaagtgtgtaatgcataaacattatatttggtttgacttgtttttgtctaagacagggtctcactgt

SEQ ID NO: 37847 - DNA, 117 bp, Homo sapiens
ccaaagtgctaggattacaggagtgagccactgcacccaacctatatttgtatatacattaaattgtatatgttaggccgggcatggtggctcatgcctgtaattccagcattttgg

SEQ ID NO: 37848 - DNA, 108 bp, Homo sapiens
agagttgaacctttcttttgatagagcagttttgaaacactctttttgtagaatctgcaagtggatgtgtggagtgctttgaggcttatggtggaaaaggtaatatct

SEQ ID NO: 37849 - DNA, 68 bp, Homo sapiens
attctcagaaactgctttgtgatgtgtgcattcaaatctgtgagttgagagagtagttttgagagagt

SEQ ID NO: 37850 - DNA, 69 bp, Homo sapiens
gcccttggagtattatggtgaaaaaggaaatattttttcttttttttattatactttaagttttagggt

SEQ ID NO: 37851 - DNA, 94 bp, Homo sapiens
gtatgtgtattactcatatatatgctatatattatgtgtatattaattataatatatagataaaatatacattatatgtagaaacagactatac

SEQ ID NO: 37852 - DNA, 90 bp, Homo sapiens
agctaggtatcactgcctgtgtctatggcagtgccctgaagatgcctaatttcttctggtctgtgaagctaagcagggtggggcctggtt

SEQ ID NO: 37853 - DNA, 113 bp, Homo sapiens
gaaatccaaggggatcactgagctctgaggcttatgggagaagagagagaggtctaagactttttgtgtataaatttatgggttacatgtttactctgtgtctggcttgtttc

SEQ ID NO: 37854 - DNA, 117 bp, Homo sapiens
tgctagctagatattagtttgttattaacaaaattttggtcattatattcctatcacaaaattatatttgtatttagtaggtggccattattatgtattgttatcttattgtaggca

SEQ ID NO: 37855 - DNA, 72 bp, Homo sapiens
tggatagatacccagtgatggaattgccatgtcaaatggtagttctatttttaattatttgaaacatttcca

SEQ ID NO: 37856 - DNA, 87 bp, Homo sapiens
ctttttgagttgcctgagtaattagggtacctgaagtgtatttatatatatatgtcaggatttgtttattcattttagccagtgaag

SEQ ID NO: 37857 - DNA, 109 bp, Homo sapiens
tctttggtggtctaaagcctcactgacatgtgtctgcttatggatttctttttatttattcttcttgggattcttgaatatgtgtcttggtatctttcatcactttaga

SEQ ID NO: 37858 - DNA, 107 bp, Homo sapiens
tctgcagtgactgagtgataaacttatcctttaagattagttggccttcaaaagagtcaggtgagagagaggtatgtttcctcaatgccccccttagtctctccaga

SEQ ID NO: 37859 - DNA, 62 bp, Homo sapiens
tgagttggagtctcactctgtctgtcacccaggctggagtgtagtggtgtgatctcagctca

SEQ ID NO: 37860 - DNA, 119 bp, Homo sapiens
ttttcaacaagttaaaccacaatgctaaaatcattcctatacttctcactatttctttttttttctttttttgagatgggtggggatgaatatttaaagctcactttaacaattgaaaa

SEQ ID NO: 37861 - DNA, 95 bp, Homo sapiens; identical to SEQ ID NO: 68

SEQ ID NO: 37862 - DNA, 93 bp, Homo sapiens; identical to SEQ ID NO: 69

SEQ ID NO: 37863 - DNA, 90 bp, Homo sapiens
tctattgattggaatagtttcagaaggaatgctaccagttcctcctcatgcctctggtagaattcagctgtgaatccatctggtcctgga

SEQ ID NO: 37864 - DNA, 73 bp, Homo sapiens
ggtccatctgtctcactcattgattgtcccttgcactcagtgtacaccgatgtgagtgaggtgctatgtggcc

SEQ ID NO: 37865 - DNA, 102 bp, Homo sapiens
gagccttccactggaaaaagaggaaatgtttttatttataacaaaatgatataattattctaccatgctgattgaaggcatatccctccctttctttggctc

SEQ ID NO: 37866 - DNA, 84 bp, Homo sapiens
ggaagagtagctcttgtttcaatttttagagagcagttaccagggagttctttttttttttttgagacagagtctcactctgtc

SEQ ID NO: 37867 - DNA, 81 bp, Homo sapiens
gtgagctgtctaaacattgaaagctgtgtggcactattagaacccgaagcatagcattactttctgtgtagccatagccat

SEQ ID NO: 37868 - DNA, 91 bp, Homo sapiens
tcaggaatctcctctgtcttgtatctccttacagcattactttatttttataagtaatactgaggaaaaatattgaggaagaaatgtctga

SEQ ID NO: 37869 - DNA, 111 bp, Homo sapiens
acccttgctagcagggacaataggattacttttaggaaggtctagtttaggttttttttttttttgacattttaaaaaattttattattattctgctttaagttttagggt

SEQ ID NO: 37870 - DNA, 87 bp, Homo sapiens
ctgggacgtcatgacctttcaatgtgcagattactaacaagttagttttttctgtatagattttgatctttctgggaacagtcccag

SEQ ID NO: 37871 - DNA, 93 bp, Homo sapiens
ctgattttcttggttattttcctgtgattttgaaaatatgtagtagacatatttgcatgtgatagacactgagtaagctgagaaaaagtttag

SEQ ID NO: 37872 - DNA, 107 bp, Homo sapiens
tggatggtttattgtgagggttaaatgacattacatgaaattacatgaaaacccagttgtgattttcatgttatttcatgtcatgttattaacctcagtgccaggca

SEQ ID NO: 37873 - DNA, 117 bp, Homo sapiens
atatatatgtacatatatatatacacacatatatatgtacatatatatatacacatatatatgtacatatatatatatacacatatatatgtacatatatatatatatgtatattta

SEQ ID NO: 37874 - DNA, 203 bp, Homo sapiens
atatacatatatatatatatgtacatatatatgtgtatatatatatatgtacatatatatgtgtatatatatatgtacatatatatgtgtgtatatatatatgtacatatatatgtgtgtatatatgtacatatatatgtgtatatatatatgtacatatatatgtgtatatatatatgtacatatatatgtgtatatatatg

SEQ ID NO: 37875 - DNA, 115 bp, Homo sapiens
tgctgagactacagcgtgagccacggcgcccagcctgcattttttttttttaacaaaaatgagaatgattttaaggagggtaagaagctgtggaattgtgttgttgaatgtagca

SEQ ID NO: 37876 - DNA, 118 bp, Homo sapiens
cacatacagtatctggcatgaagttaagagcttctgctattattggctgcaaagagaagtcagagagaagagtgagcacagttcagaacatcaggcagtaatttagtaaagtgtagtg

SEQ ID NO: 37877 - DNA, 89 bp, Homo sapiens
cctctagatagaaaatacttcaatttaatagtagaaagcatccatgttgccttttctgtgaaaatctgatttttttttaatcagagagg

SEQ ID NO: 37878 - DNA, 117 bp, Homo sapiens
agcttcttggatgtgtagatttatatctatacacacacatatatatgtgtgtgagtgtgtgtatatatatatatgtgtgtgtgtatatatatataaaatttacaaatttggatagtt

SEQ ID NO: 37879 - DNA, 114 bp, Homo sapiens
gctgtagtacagagtatgtgatcatggaagtatctcacttttctagttctcagtttcttcatctgtaaaataggaagattagatttcctaaattccacagggttgttgtgaggc

SEQ ID NO: 37880 - DNA, 91 bp, Homo sapiens
cttgaataggatgggtgcagtggctcatgcctataatcccagcactttgggaggctgaggtaggaggatcatttatggccaggagttcaag

SEQ ID NO: 37881 - DNA, 128 bp, Homo sapiens
atagatgtatatatgtacttatgtgtatatgtatatgtgtgtacatatatacacatatacacatacatatatgtatgtgtatatatgtatataagtatgtatatatgtgtatatatgtgtatatgtgt

SEQ ID NO: 37882 - DNA, 89 bp, Homo sapiens
tatatgtacatacaggtatatatacaggtatatatacaggtatatatgtatgtatatatacataccggtatatatacatgtatatatac

SEQ ID NO: 37883 - DNA, 230 bp, Homo sapiens
tatatatacgtatgtatatacgtatgtatatatacatacaggtatatatataggtatatatacatatgtatgtatgtatgtatatataaatacaggtatataaacatatgtatatatacatatatatgtatgtatatatacatacaggtatatatacatgtatatatacatatgtatatatgtatgtacatatacatataggtatatatacatgtatatatacatatgta

SEQ ID NO: 37884 - DNA, 137 bp, Homo sapiens
gcatgcatatatgtatatacgtatatacaggcatatatgtatatatgtctgaatatatgtatatgtgtatatatgtgcttccatgtatatgtgtatatgtatatatgtatatatatgtgtgtttagatatatacaca

SEQ ID NO: 37885 - DNA, 95 bp, Homo sapiens; identical to SEQ ID NO: 68

SEQ ID NO: 37886 - DNA, 93 bp, Homo sapiens; identical to SEQ ID NO: 69

SEQ ID NO: 37887 - DNA, 95 bp, Homo sapiens; identical to SEQ ID NO: 68

SEQ ID NO: 37888 - DNA, 93 bp, Homo sapiens; identical to SEQ ID NO: 69

SEQ ID NO: 37889 - DNA, 127 bp, Homo sapiens
tctacatctatatatggttacatattcatatctatctttatctctgtatctttatatctatatatatggacatgtaactatgtgtgtatacatagacatatataaatataaatatgtaactatatat

SEQ ID NO: 37890 - DNA, 112 bp, Homo sapiens
tatagtgtctgatatagaatattttaatccatttgacttttaaaattatacttttttatgttactgcttaaatagaagtcattatggtagattattctctttagtatctgta

SEQ ID NO: 37891 - DNA, 117 bp, Homo sapiens
acattcctatactgattctgtgttagttgtatttttatttcagtgtgtttttgttttattcatttatatgtagatatatacttgacattttaatagtactaacatacggttctatgt

SEQ ID NO: 37892 - DNA, 58 bp, Homo sapiens; identical to SEQ ID NO: 10128

SEQ ID NO: 37893 - DNA, 66 bp, Homo sapiens
atatgtatacatgtatgtatatgtgtgtatatatgtatacatatatgtatgtatatgtgtatatat

SEQ ID NO: 37894 - DNA, 95 bp, Homo sapiens; identical to SEQ ID NO: 68

SEQ ID NO: 37895 - DNA, 93 bp, Homo sapiens; identical to SEQ ID NO: 69

SEQ ID NO: 37896 - DNA, 106 bp, Homo sapiens
gactacccatggtagttttccttcttgtccagaattgatagtcctcacagaatatattattattattatttactattattatgggatgtgaatgccaatggcagtc

SEQ ID NO: 37897 - DNA, 151 bp, Homo sapiens
tatatatgtgtatatgtatgtatatatgtatatatgtgtatatatgtatatatgtgtatatatatgtatatatgcatatatgtgtatttatttttatatgtgtgtgtatatataggtgtgtatatatatacacacacatatacacaatgga

SEQ ID NO: 37898 - DNA, 118 bp, Homo sapiens
gctcctaattttcaaatagttaatcagctaaaatacagttttggggggaggtgctcaaattttttttttttccactactccccactttctttctttttggttgtttttgaaggcagga

SEQ ID NO: 37899 - DNA, 91 bp, Homo sapiens
gttttattacacttggcctgattatttgtatacagtgcagcaagaataattattttttttgcataggtttttaaattggctttgatggaac

SEQ ID NO: 37900 - DNA, 64 bp, Homo sapiens
tactatatacttacatataacatgtattatatatgtatgcatgtatatatgtaagtttattgta

SEQ ID NO: 37901 - DNA, 82 bp, Homo sapiens
tgtacataatttttgtgcacattgagaatgtctgtatcatagattcctaacagtacattgtgaggtcaaaaaagtatgtaca

SEQ ID NO: 37902 - DNA, 92 bp, Homo sapiens
gattccttctcatatcccaaggcctgttaacatgaggaccctgaggctcaaatttgaatctttctttttgttattcactccttgggggattc

SEQ ID NO: 37903 - DNA, 92 bp, Homo sapiens
ggactttctctgagaacaaatcacagtaaacttgctcagggaatgatatgtttcatgggcaaagtgtggattcactctcaaaattaaagtcc

SEQ ID NO: 37904 - DNA, 84 bp, Homo sapiens
tccctctggtgtgacagaggtacctacaggagatataaatcattgtttatatttataagtaggactgtgtgatacaacttgggg

SEQ ID NO: 37905 - DNA, 58 bp, Homo sapiens; identical to SEQ ID NO: 29624

SEQ ID NO: 37906 - DNA, 111 bp, Homo sapiens
gaaacaacaagctggaattcagagtcctaaagtttgaattctacatattttctacttgtctaggtggatttagaatttttggtgctttaacctgtgacttgccgtattttc

SEQ ID NO: 37907 - DNA, 112 bp, Homo sapiens
ccaaaacctgaagactaaagttgaacattgtctactaaacaaagaaaatccagtttattttttatttttttttttattttgagacagagtctcaccctgtcacccaggctgg

SEQ ID NO: 37908 - DNA, 93 bp, Homo sapiens
gatagttaggtagacagataaagagtatatatatatatatatatatatatatatatatatatatatatacactatactttctccctctctctc

SEQ ID NO: 37909 - DNA, 77 bp, Homo sapiens
gcttagagcagagtagagggcacctcactgaggttttctaaagatctatgaatttgagacccttatgattctggagc

SEQ ID NO: 37910 - DNA, 93 bp, Homo sapiens
aggctttttaaaaatcgagataattgaatgcatctgtccatctatgacatgctaaacatgtgcatttgatattctgattcaattaagatgctt

SEQ ID NO: 37911 - DNA, 95 bp, Homo sapiens; identical to SEQ ID NO: 68

SEQ ID NO: 37912 - DNA, 93 bp, Homo sapiens; identical to SEQ ID NO: 69

SEQ ID NO: 37913 - DNA, 58 bp, Homo sapiens
tgaggcagagtctcactctgtcacccaggctggtgtgcagtggtgcgatcttgtctca

SEQ ID NO: 37914 - DNA, 95 bp, Homo sapiens; identical to SEQ ID NO: 68

SEQ ID NO: 37915 - DNA, 93 bp, Homo sapiens; identical to SEQ ID NO: 69

SEQ ID NO: 37916 - DNA, 98 bp, Homo sapiens
gctggaaatcttgttcaccagttttgtgatagcattatctttatttggtattaccaatgctaaaattatatatttttatggagagccaatttctatgc

SEQ ID NO: 37917 - DNA, 95 bp, Homo sapiens; identical to SEQ ID NO: 580

SEQ ID NO: 37918 - DNA, 93 bp, Homo sapiens; identical to SEQ ID NO: 69

SEQ ID NO: 37919 - DNA, 111 bp, Homo sapiens
aggtgtggtggcacatacctgtagtcccagctacttggatggctgaggtgggaggatggtttgagcccaggaggtggaggttgcagtgtgttaagatcatgcctttgcact

SEQ ID NO: 37920 - DNA, 120 bp, Homo sapiens
agcagtggtttgtagttcttgaggaggtccttcacatcccttgtaagttgtatttctaggtattttattctttttgtagcaattgtgaatgggagtttgctcatgatttggctctttgtt

SEQ ID NO: 37921 - DNA, 97 bp, Homo sapiens; identical to SEQ ID NO: 1307

SEQ ID NO: 37922 - DNA, 88 bp, Homo sapiens; identical to SEQ ID NO: 1308

SEQ ID NO: 37923 - DNA, 81 bp, Homo sapiens; identical to SEQ ID NO: 1309

SEQ ID NO: 37924 - DNA, 77 bp, Homo sapiens; identical to SEQ ID NO: 1310

SEQ ID NO: 37925 - DNA, 178 bp, Homo sapiens
gtatatatatatatatacacacagcgtatatatatatatatatacaccctgtgtgtatatatatatatacacacagagtgtgtatatatatatatatacactgtgtgtgtatatatatatatacacactgtgtgtatatatatatatacacagtgtgtgtatatatatatatacacac

SEQ ID NO: 37926 - DNA, 112 bp, Homo sapiens
gcattaccactgatgttattatttgttagtatcacagttcatatttttataattatccattagactaatatgatcttaataattgagtgcctataacataacatgagtgtgc

SEQ ID NO: 37927 - DNA, 79 bp, Homo sapiens
ttgcaagtaggtggtatagtaatttcctttagttccccacgatctgtccaaagttactattttactttgtttcttgtaa

SEQ ID NO: 37928 - DNA, 71 bp, Homo sapiens
ctgtgtgtgtctgggtctaatctctctctgtctcttataaggacacatgtgattccattcagataagccag

SEQ ID NO: 37929 - DNA, 92 bp, Homo sapiens
ggtgccctatgaagactctatgaagaatggaactgtactgaaactttaacacagtttagtttatctatttttttttttttatggctagcact

SEQ ID NO: 37930 - DNA, 95 bp, Homo sapiens
gctgccagtctttgcacttctgtgaattttcatgtggtggtcaccaaggggagcccctctctggctgtgagagccacaggagcttgggtggctgt

SEQ ID NO: 37931 - DNA, 95 bp, Homo sapiens
tcacacacaatgaatcttccttctctttctggtggaaagaatcgaaagtttttttttttttccaccactggatggccatttacatagtgtagtga

SEQ ID NO: 37932 - DNA, 70 bp, Homo sapiens
gaagctcagtgagtgtctctcttctgcagggatttctgtctccagagtggaatggggacaatcttgcttc

SEQ ID NO: 37933 - DNA, 58 bp, Homo sapiens
gagtggggaaggctgaggtgggtagaggagtgaaactctcccacagtgcctttcactc

SEQ ID NO: 37934 - DNA, 106 bp, Homo sapiens
tgccaccacacctagtcaaccctagataaaggtctctctctcttttttttttttttttttttgagacggagtcttgttctgtcgcccaggctggagtgcagtggca

SEQ ID NO: 37935 - DNA, 92 bp, Homo sapiens
atgtgagccactgtgcctgtctgtgtatgtgtgtatgcatgtgtgtatatgtatgtatatatacacacagcagtggggttgctggatcatat

SEQ ID NO: 37936 - DNA, 75 bp, Homo sapiens
gggtctctgagatcctgctgtcagtctcctttttttatttttaattttttgagacagggtctcactctgttgccc

SEQ ID NO: 37937 - DNA, 80 bp, Homo sapiens
tgagacagagtctcactctgtcacccagggctggagtgcagtggtgcgatctgggctcactgcagcctctgcctccctgg

SEQ ID NO: 37938 - DNA, 58 bp, Homo sapiens; identical to SEQ ID NO: 1868

SEQ ID NO: 37939 - DNA, 95 bp, Homo sapiens
tgtttaaggtgatttatgttaaattacgccttctctatctgagagtttatatttttcattagagctggaaaattatagtgttatctctttgaata

SEQ ID NO: 37940 - DNA, 90 bp, Homo sapiens
gggcgacagagggagactccgtctcaaaaaataaaaaaattgtcttaataatcttttttttttttgagacagagtctcgctctgtcaccc

SEQ ID NO: 37941 - DNA, 106 bp, Homo sapiens
tgtttacctcctttcacagttcaaatagggtaaattttagtctctgtttctcagtggctggataaaggcagaatttgacaggcaatttgaggggatttgtgtaata

SEQ ID NO: 37942 - DNA, 83 bp, Homo sapiens
atatatatgtgtgtgtgtgtgtatgtgtgtgtgtgtagagtctcactttatatagatagatacatagatagatctctatatat

SEQ ID NO: 37943 - DNA, 83 bp, Homo sapiens
cagaagtctaacaactgacagcactacttgttttatctatcctaaggggcaggtatgacaagagtgactgatcacatggtctg

SEQ ID NO: 37944 - DNA, 93 bp, Homo sapiens
tatatactatatgtatatatgtactatatacatatatataatatgtgtatatatatgtatatatgtatatatatactatatgtatatagtaga

SEQ ID NO: 37945 - DNA, 74 bp, Homo sapiens
tctttttttttcttttgactgagaaggtagttttattattttaatcctaccacttttctagaagaaaataaaga

SEQ ID NO: 37946 - DNA, 96 bp, Homo sapiens
gtagctggggcagaggggctactttttatttatttatttatttatttatttatttatttatttattttgagacagagtctctcgctctgtcaccag

SEQ ID NO: 37947 - DNA, 66 bp, Homo sapiens
catacaaccaagcaatccctggctagaccaggttgaagcctggctctggcactgactggctgtgtg

SEQ ID NO: 37948 - DNA, 97 bp, Homo sapiens
gtggtttgtttgtgtgtatatatatatatgtacatgtatatatgtgcatagtttgtgtatatatatatgtacatgtatatgtgtgtacatatctaca

SEQ ID NO: 37949 - DNA, 95 bp, Homo sapiens
cagaagcagtggaagatgggagaaaaagtgagatacatatatttttttaatagaaggagaagatgtttctgaggtcaggcccacccctgcagctg

SEQ ID NO: 37950 - DNA, 78 bp, Homo sapiens
ttctttgtgggagagcagtgttttcattcatgagaaaactttttttttaaagatgataacgttgtcttaaatagagag

SEQ ID NO: 37951 - DNA, 93 bp, Homo sapiens
agggattgggattgtcctaatagttacttttctttaaaaaaggaaacaattttttgaaaatttttattagagatgagcttctcaagttcccct

SEQ ID NO: 37952 - DNA, 109 bp, Homo sapiens
tttgccaaaagaaaattctaaaaatatcatgtctatagaaaaatgtgtgtagctgaagtatttttcttttaataaagtgactgaattattgctagagttttgtggtaga

SEQ ID NO: 37953 - DNA, 110 bp, Homo sapiens
gatggactattggatttaatgtggcagttgttacataattttatatattaacatattgctatatgtttattaatatataatctttgaatgcacacattttttctctcatc

SEQ ID NO: 37954 - DNA, 81 bp, Homo sapiens
gcttttatatatgtgtgtgtgtatttatatgtatatgtgcattatatatgtagctagatatatgtagatgtatttatatgc

SEQ ID NO: 37955 - DNA, 99 bp, Homo sapiens
ggtcagagcatgtctgaaggaaatatcacacacacactcatacacatgagcatatacacacacatgcctttgggtgttcgtggatcagacttagtgacc

SEQ ID NO: 37956 - DNA, 95 bp, Homo sapiens; identical to SEQ ID NO: 68

SEQ ID NO: 37957 - DNA, 93 bp, Homo sapiens; identical to SEQ ID NO: 69

SEQ ID NO: 37958 - DNA, 95 bp, Homo sapiens; identical to SEQ ID NO: 68

SEQ ID NO: 37959 - DNA, 93 bp, Homo sapiens; identical to SEQ ID NO: 69

SEQ ID NO: 37960 - DNA, 58 bp, Homo sapiens
tgagaccgagtctcgctctgtcacccaggctggagtgcagtgatgtgatctcggctca

SEQ ID NO: 37961 - DNA, 120 bp, Homo sapiens
actcgagttctgactgttgggatctgcaattgtcctctgactagggctggtttaaatgctctgtctgtgtgtgggtgccagctgagttaggtccggtatttctttctgctttaacaggac

SEQ ID NO: 37962 - DNA, 76 bp, Homo sapiens
atgtatatatacatatatcttatatacatcatatatatatatatatttatgtatctgtttatgtgtatgcatacat

SEQ ID NO: 37963 - DNA, 109 bp, Homo sapiens
gttagttttctgccttgatgatctttctaatacagtcagtgggctgttgaagtctccctctgttactgtgtggttatctaaatctctttctaggtctccaagaacttgc

SEQ ID NO: 37964 - DNA, 74 bp, Homo sapiens
tttctttctttcttttcttttttagttttaaggagcagggagtttaataggcaagaaagaaagaaagaaggggg

SEQ ID NO: 37965 - DNA, 106 bp, Homo sapiens
ctgctgttggaccttcaagaatgcatagaagtaagacaaataataaatggaaggaacacattttattttttaatttttatgttagtttcagggggtacatgtgcag

SEQ ID NO: 37966 - DNA, 112 bp, Homo sapiens
ctaagagggatacatttctgacatggccaaaaacatgactattttaatcacagatatatgaatatttgtaaatctgagtgtgtatttatgttattaataagatccatcttgg

SEQ ID NO: 37967 - DNA, 87 bp, Homo sapiens
tctgctgaggagaaggtgctgattctgggcatagttttgcatgtagccattttatgagtaacttctttttttttacaaggtggcaga

SEQ ID NO: 37968 - DNA, 95 bp, Homo sapiens; identical to SEQ ID NO: 68

SEQ ID NO: 37969 - DNA, 93 bp, Homo sapiens; identical to SEQ ID NO: 69

SEQ ID NO: 37970 - DNA, 111 bp, Homo sapiens
agtcttgtcagaacctagtttcacaataatttttaattatatacttttgggcttcaagtatattttattattcatttattcttgagaaatgaaaggaagtctgacatttct

SEQ ID NO: 37971 - DNA, 70 bp, Homo sapiens
ttgttttttgagacggagtctcactgtcactcaggctggagtgcaatggtgcgatctcggctcactgcaa

SEQ ID NO: 37972 - DNA, 95 bp, Homo sapiens; identical to SEQ ID NO: 68

SEQ ID NO: 37973 - DNA, 93 bp, Homo sapiens; identical to SEQ ID NO: 69

SEQ ID NO: 37974 - DNA, 95 bp, Homo sapiens; identical to SEQ ID NO: 68

SEQ ID NO: 37975 - DNA, 93 bp, Homo sapiens; identical to SEQ ID NO: 69

SEQ ID NO: 37976 - DNA, 88 bp, Homo sapiens
catacttgcagtcttgatgagaatcactgaatgctgcattttcttgatacagtatttttatgtgtcttcatgttagagtggcaatttg

SEQ ID NO: 37977 - DNA, 58 bp, Homo sapiens
tgagacagggtctcactctgtctcccaggcgggagtgcggtggtgggatctcggctca

SEQ ID NO: 37978 - DNA, 87 bp, Homo sapiens
ttggggtccctatacttgtctatttcttgacctgagtggtgggtacttgacacttattagaaaaggaagactatgggccaatttcaa

SEQ ID NO: 37979 - DNA, 114 bp, Homo sapiens
gtataattattttgatacattgttggagttgactgttaatatttttatatatatgtttgtgagggatattggtctgtagtttttctttcttgtgatgtctttatgtagttttgc

SEQ ID NO: 37980 - DNA, 118 bp, Homo sapiens
tatatgtgtgcatatatatacacacacacatatatgcataggtatatatatatgcacacatatatatgtatatatatacgtgtatatatacatatgtatacatatatatgtatatgtg

SEQ ID NO: 37981 - DNA, 97 bp, Homo sapiens
cttaaagattatttccagaagaaaaaatctgattttcttgaactatccagtaagaataagagagttatggtgtctttgtataatagtttactgtgag

SEQ ID NO: 37982 - DNA, 98 bp, Homo sapiens
aaactttatcatagtatgtctgtataggaaaaatatatatatacatatatatatgtatatatatatgcaaaaatagatttctgtgctgtctgaggttt

SEQ ID NO: 37983 - DNA, 77 bp, Homo sapiens
atagatacaactgtatttctttatgtgtgcatatatgtgggtacgtgtgtgaatatatagtatatatgtgtgtgtat

SEQ ID NO: 37984 - DNA, 116 bp, Homo sapiens
ctttgcttaggattgtcttggctatgtgggctcttttttggttccatatgaaatttaaactagttttttctaattctgtgaagaaagtcaattgtagcttgatggggatagcattg

SEQ ID NO: 37985 - DNA, 104 bp, Homo sapiens
tttttctgaatattaatgctattacatggatgcatgcctttatttatttatttatattgattgtagattcaggcttgtgtacagagctctgcttcacaggaaag

SEQ ID NO: 37986 - DNA, 105 bp, Homo sapiens
tatgtgtgtgtgtgtgtgtatgtgtgtgcgtgtgtatatatatatatacatatatatatacatatatatatacatatatatatatatgtatatatatatatatac

SEQ ID NO: 37987 - DNA, 90 bp, Homo sapiens
gtttttaaagattttctttatctgagaatgtttttctttcatatttattcctgaagggtattttcaacagatagagaattctgggatgac

SEQ ID NO: 37988 - DNA, 91 bp, Homo sapiens
catatatacatatgtgtatatgtatacacgtatgtatgtatattttcaacatatatacatatgtgtatatatatatacatacatatatatg

SEQ ID NO: 37989 - DNA, 78 bp, Homo sapiens
ttaaggatttatatttttagattaggaccccctggataatccagtatagtctccccatctgaagaccctttgccttaa

SEQ ID NO: 37990 - DNA, 108 bp, Homo sapiens
tgctacaaaatagcctgctgggatttttattgagattttcttgaatctttatatcaatatgaagataattgatatcttaacaataagaactatatgtatctgtgagca

SEQ ID NO: 37991 - DNA, 118 bp, Homo sapiens
tgcttaggattgtcttggctatacgggctcttttctggttccatatgaaatttaaagtagttttttctaattctgtgaagaaagtcaatggtagcttgatgggaatagcattgaatct

SEQ ID NO: 37992 - DNA, 116 bp, Homo sapiens
catggccattcttgtggatctgcaggtggtagctgttcctggctgtggctgtgtacaggtggatcaggccaccccagctggagccgagcagtggggaggcattgggataggctctg

SEQ ID NO: 37993 - DNA, 95 bp, Homo sapiens; identical to SEQ ID NO: 68

SEQ ID NO: 37994 - DNA, 93 bp, Homo sapiens; identical to SEQ ID NO: 69

SEQ ID NO: 37995 - DNA, 114 bp, Homo sapiens
ttttggagtcatgtgttaccagagcataatgtagtctctccttgtctttgaacattatatatatttggaacaagcatagaaaaaacttacaatgatggggcattgactagaaaa

SEQ ID NO: 37996 - DNA, 91 bp, Homo sapiens
aatggtttgaatctatgtgtgtgtgtgtatatatatatatatatgtatatatatatatatacacacatatacacacatatcagataacatt

SEQ ID NO: 37997 - DNA, 104 bp, Homo sapiens
ttctggctgatgagtatgtgaggattattgtactattctgtttttatgtgcatttgaaatgttttatagtacttgggggttgctggcaagatggtcaaacagga

SEQ ID NO: 37998 - DNA, 99 bp, Homo sapiens
aggcattagattctcataggagcttggactctattgtgaattgcacaactgcacattggaaggatctaggttgtatactctgcatgagaatctaatcct

SEQ ID NO: 37999 - DNA, 58 bp, Homo sapiens; identical to SEQ ID NO: 6359

SEQ ID NO: 38000 - DNA, 123 bp, Homo sapiens
ggtttagtggctgacatcactgtgattctttaccccgtggttgaaagatggctgctctagcaccaggcatcatattcatttttcaagtcaggaataaaagagaggacacaggttgcttcccac

SEQ ID NO: 38001 - DNA, 115 bp, Homo sapiens
cacctagcaccttgtgccatgtcccctagaattgattgaatgacacaagcttctcagcctctctgagcctgtttcttcagtcctgtgtggttgctgggaggatgcgaggtggtat

SEQ ID NO: 38002 - DNA, 100 bp, Homo sapiens
gtaccacattttctttatccagtcatccactgatgtacatttaggttgatttcatatctttgtgctattgtgaatactgttacgataaacatatgagtgc

SEQ ID NO: 38003 - DNA, 97 bp, Homo sapiens
atgagaataaagaacacagactttggtatctggcagagctactagcttcaaaccttaactatgccatgtacaactagccatgtgcctttgtgtgtat

SEQ ID NO: 38004 - DNA, 108 bp, Homo sapiens
cagagatgagcctctaagccctgcagaacagagagaatttctttttttttaaggaataagggaagtcgagcatgttaaaaggcagagagaaggtaatggtgatggctg

SEQ ID NO: 38005 - DNA, 85 bp, Homo sapiens
tgtggtggctaaaatagttatctggaaatatctgtctgtctctctgagaccatatagtttccaggctcagcatttagtttcctca

SEQ ID NO: 38006 - DNA, 56 bp, Homo sapiens; identical to SEQ ID NO: 324

SEQ ID NO: 38007 - DNA, 116 bp, Homo sapiens
gtatttttctctctggatcttgctctttgtgcgttttgatacatcgggaattgcatatgaaatgaaaaatttcacagagtagatgacgtgctggggaagagaagaagaaaaatgtc

SEQ ID NO: 38008 - DNA, 63 bp, Homo sapiens
gggagaggattcctcatgagtggcttggtgccattctcacaggagtgagtgagttctcattct

SEQ ID NO: 38009 - DNA, 71 bp, Homo sapiens
gctgggtggagtggctcatacctgtaatcctaatgttttgggaggctgaggtaggaggatcacttgagggc

SEQ ID NO: 38010 - DNA, 107 bp, Homo sapiens
ggatatagctggagacattcacaggggctccatattaagaaggtggggaattaagactaattttaaatttttttcttgttcagcatctgaagtttcctaaactgtct

SEQ ID NO: 38011 - DNA, 61 bp, Homo sapiens
aagaaatgatactggctagttgtctagcagtctctgccacactgcctgtgtcatggtgctt

SEQ ID NO: 38012 - DNA, 120 bp, Homo sapiens
ctcactgtgtgggcatcttactgcactgagtatgaatcttgggtttaaagatatgttttttttttaacaacatgattcttaaattgaagccaactacttcatcaggtgcccagtggggtg

SEQ ID NO: 38013 - DNA, 64 bp, Homo sapiens
ggtagccatggaagcaaattctccagcactgtttggaagctgctttggaatgttgtgtggctcc

SEQ ID NO: 38014 - DNA, 88 bp, Homo sapiens
ggccaaaaggcactgtctgtgtgtctcaagaaaagcaaggagaccagcatggctggagaagaataagctggcagggggttggagggtt

SEQ ID NO: 38015 - DNA, 181 bp, Homo sapiens
ctcaaagtactgggatttcggacatgagccacaacacctggccgttgctttgtgttttgtttgtttgtttgtttttgtttgttgttgttgttttgagacagggtctcactgtatcactcaggctgaagtgcagtggcaagatcccagcttgctgcaacctcgacctcctgggctcaagtga

SEQ ID NO: 38016 - DNA, 90 bp, Homo sapiens
tgcatatatatgtatatatatgtgtatatatgtatacatatgtgtatatatgtatacatatatacgcatatgtgtatacatatatgtgta

SEQ ID NO: 38017 - DNA, 129 bp, Homo sapiens
atatgtgtatatatacatagatgtgtacacacatacatgtatacacacatatgtgtgcatatgcatgtatatatgtgtatacatgtatacacacatatatatgtgtatataatatatgtgtgtatacat

SEQ ID NO: 38018 - DNA, 118 bp, Homo sapiens
gtttttatgttgctgctctcaagatttcctccttatccttaacctatgccatgatgtgtctgtgaatctctctgcatttattcacttggagttcactgagggtccaagacatatagat

SEQ ID NO: 38019 - DNA, 80 bp, Homo sapiens
atcatgagaatcatttttcacttttttttttggagacagagtcttactctgtcatccagggtggagtaaagtggcgtgat

SEQ ID NO: 38020 - DNA, 107 bp, Homo sapiens
tatatatacacatatatacatatacatgtgtgtatatatatacatatacatgtgtgtatatatatacacacacatatgtgtgtgtatgtgtatatatgtatatacat

SEQ ID NO: 38021 - DNA, 113 bp, Homo sapiens
gggctcccattgattctacattatggtgagttgtataattatttcattatatggtacaatgagtaataatggaaataaagtgtacaataaatgtaatgcgcttgaatcatccc

SEQ ID NO: 38022 - DNA, 96 bp, Homo sapiens
atatgtaaaatgatctgtatgggtagtttactgagtttcttgtttttacactagataaagtgttgcctattgtcagaataaattaagattacatgt

SEQ ID NO: 38023 - DNA, 64 bp, Homo sapiens
catatacatatatgtgtatatatatatgaatatacatgtacatgtgtatacatatatgtatatg

SEQ ID NO: 38024 - DNA, 64 bp, Homo sapiens
gtatatgtatacatgtatattcatatacatatatgtatacacatgtacatgtatattcatatat

SEQ ID NO: 38025 - DNA, 93 bp, Homo sapiens
tcaacaagaagatattataacctataatatacaatatatatgttatatattataggttgttatatattacaggttataatatcttcttgttga

SEQ ID NO: 38026 - DNA, 98 bp, Homo sapiens
caggtgatccacccgccttggcctcccaaaatcattattattttttgagacagggtctcactctgtgcaatggttggagtgcaatggtgtgatctctg

SEQ ID NO: 38027 - DNA, 101 bp, Homo sapiens
cagaactaaagccggacatagtgggccattcttgtaatcccagcaacttgagaggctgaggtaggaggatcatttcagcccaggagtttgagataggtctg

SEQ ID NO: 38028 - DNA, 132 bp, Homo sapiens
gtttttaaaggaagaatctatgcagctgaggcttattgcaggaaatacttcatttgtatgtaaatattattgtaaataaataggaggctgtatatttttgaagttgttgatctgcactgaaatagaagtctc

SEQ ID NO: 38029 - DNA, 85 bp, Homo sapiens
tccatgtagttgtgcggttttgagtgagtttcttttttttttttttttttttgaggcggagtctcactctatcaccctgtctgga

SEQ ID NO: 38030 - DNA, 95 bp, Homo sapiens; identical to SEQ ID NO: 68

SEQ ID NO: 38031 - DNA, 93 bp, Homo sapiens; identical to SEQ ID NO: 69

SEQ ID NO: 38032 - DNA, 84 bp, Homo sapiens
ttttattctctttgtagcaattatgaataggagttcactcatgatttggctctctgtttgtctgtctgttattggtggatagga

SEQ ID NO: 38033 - DNA, 115 bp, Homo sapiens
agtattaaaataaaggtattttttaatgatcctgttttggaaaattgtaaggatctgaaatttttaattttttaaaacaatggagcacttcaataaaacttctattttctttact

SEQ ID NO: 38034 - DNA, 95 bp, Homo sapiens; identical to SEQ ID NO: 68

SEQ ID NO: 38035 - DNA, 93 bp, Homo sapiens; identical to SEQ ID NO: 69

SEQ ID NO: 38036 - DNA, 111 bp, Homo sapiens
ggtttcaatcttgtgtggtgactgttgggacttatttactggatatttaatttttcatttgaaaaactattgtagaggtctatgaagacggtccctccctccctccctccc

SEQ ID NO: 38037 - DNA, 84 bp, Homo sapiens
ataaatgtatctatgtatatctgtatatgtataaacatgtatatatgtatatacacacagacacatacatagccatatatatat

SEQ ID NO: 38038 - DNA, 112 bp, Homo sapiens
gtcatttcacacagagtgagttctaaggtataacacatcttctttttttgttttttttttttttttttgagatggagtttcacttttgttgcccaggctggagtgtaatgac

SEQ ID NO: 38039 - DNA, 104 bp, Homo sapiens
tttctaggtgaggaaactgaggctcagtgaagttagtgacctgtctgaggatgcaaacccaggcacccacaatggcaaccactgcagtgttctgctactggaaa

SEQ ID NO: 38040 - DNA, 68 bp, Homo sapiens
atagagtggggaaatccactttctttctttctttttttttttttttgagagatggagtctcactctgt

SEQ ID NO: 38041 - DNA, 166 bp, Homo sapiens
atatattaaaaatatatacaaatatatataaaaattgtgtatatataagtaaacatatatgtatatattatttatatatgtatgtatatattatatatagtgtacatgtatgtatgtgtgtgtatatatatattatgtgcatatatatatatacgatgtagtgctg

SEQ ID NO: 38042 - DNA, 64 bp, Homo sapiens
gcttcagaggacttgattgagatccactcacggaagtgaccactctctgtcaccttctctgtgt

SEQ ID NO: 38043 - DNA, 69 bp, Homo sapiens
aggagagcaaaatgtaagacagggagagaaatcagggctctctccctgtctcacatttaatgtaggcct

SEQ ID NO: 38044 - DNA, 82 bp, Homo sapiens
aagtccggggcatgaggattcacacctgtaatcttagcactttgggaggctgaggtaggaggatcacttgagcctgggagtt

SEQ ID NO: 38045 - DNA, 111 bp, Homo sapiens
gctgggtgtggtagtgcacgcctgtagtcccagctacttgggagcctgaggtagtaggatcgcttgagcccaggaggttgaggctgcagtgagccgtgcttgcgccactgc

SEQ ID NO: 38046 - DNA, 95 bp, Homo sapiens
tagaaggattaatgagcattcattactgattagtttgaaaatttatctttttagacttattaacatatatgtaatgaaatcagtattttcttttg

SEQ ID NO: 38047 - DNA, 112 bp, Homo sapiens
acacatgtggtttgttgttgactgaaatgttatacagcacattactctgtgtgtgtgtatctatatttaaatgttatgtgctgcataacatttcagtatacatatagtgtgt

SEQ ID NO: 38048 - DNA, 73 bp, Homo sapiens
ttttaggtcaatattatatatatattgacatgtatatatcaatatgtcagtgtcatatatatgtgaaataaga

SEQ ID NO: 38049 - DNA, 81 bp, Homo sapiens
gatcttgttgggtttagttctgattttgaaggaggaaattacaggatgtttcttttgacaggattggaatcacagaaggtt

SEQ ID NO: 38050 - DNA, 105 bp, Homo sapiens
ttagtgcaaaggactgattactcataacttgcaagaggcagtcaggctgatggggactgttatcttatatatatatattgctaattagaaaatctttgagactaa

SEQ ID NO: 38051 - DNA, 81 bp, Homo sapiens
ggagtctgacattcactctgagtaaaatgagagccattggagtgctcaattatgtcactcagattttgacaggatcactct

SEQ ID NO: 38052 - DNA, 74 bp, Homo sapiens
gaggtaatactgtgtgggactttgcagagagaagatgattgcgaccctcccagagctcccactctgtgtctctc

SEQ ID NO: 38053 - DNA, 65 bp, Homo sapiens
tttgattttataggctcatatgcagaagggactttccttgtctcagatgagactgtggacttgga

SEQ ID NO: 38054 - DNA, 83 bp, Homo sapiens
gagctcctatctagcttgtgactaagcaacctctgccctgctcagatcacagtctcagtcctggtagtggctcacatccaagc

SEQ ID NO: 38055 - DNA, 110 bp, Homo sapiens
tgtatatttggtttatttgttaagctgactggtgggtgtacggggtttgatgttattgtgtatatctttatgtatctaaaatgtttccaaataaaaaataaaagtatgca

SEQ ID NO: 38056 - DNA, 140 bp, Homo sapiens
atatatacatatatgtatatatacacatatatacacatacatatatatgtgtatatatacatatattgtgtgtgtgtgtgtgtgtgtgtgtgtgtgtgtgtgtgtatatatatatatatatatatatatatatatatata

SEQ ID NO: 38057 - DNA, 151 bp, Homo sapiens
acaatatatgtatatatacacatatatatgtatgtgtatatatgtgtatatatacatatatgtatatatttacacatatgtgtatgtgtatatatgtatatatttacacacacacgtgtgtatatgtatatatttacacacacacgtgtgt

SEQ ID NO: 38058 - DNA, 100 bp, Homo sapiens
tatgtgtatatatttacacgtgtgtatatgcatatatgtatatatttacacctgtgtatatacatatatgtatatatttacacctgtgtttatacatata

SEQ ID NO: 38059 - DNA, 195 bp, Homo sapiens
atatatacatatatgtgtatatacacatgtgttaatatatacatatatgtatatatacacatatgtgtaaatatatacatatatacacacatgtgtaaatatatacatgtatatatacacacatatgtgtaaatatatatgtataaacacaggtgtaaatatatacatatatgtatatacacaggtgtaaatata

SEQ ID NO: 38060 - DNA, 95 bp, Homo sapiens
tgtatatacacatatgtgtaaatatatacacgtgtgtatatacacatgtgtatacatatgtgtaaatatatacatatatgtgtatatacacatat

SEQ ID NO: 38061 - DNA, 106 bp, Homo sapiens
ccttgtagaggtctttcgcctcctttcttaggtatatttgtaagtattttattttatttttttgttgcagctattgtaaaaggggttgatttgattctgtgcttgg

SEQ ID NO: 38062 - DNA, 84 bp, Homo sapiens
gggggcatcctagaaaacctgagaaaagtggtggccaaattcctgaccctgcctctgtccctcagtgctttctgtccagaccct

SEQ ID NO: 38063 - DNA, 109 bp, Homo sapiens
gggaactggtctgacaggtccccaggctgtctggctctgtgcctgtctctccagcccagctctgacattcagtgacagggagtgagggtggggcaggccacagtgctgg

SEQ ID NO: 38064 - DNA, 81 bp, Homo sapiens
cagtgggaagagattgagcagagaggcaggtatcctcctctggactctacctcctggctctgcatggtttaaggccctctg

SEQ ID NO: 38065 - DNA, 69 bp, Homo sapiens
ctctgggactctctctgcctctttcagcagcataaggcagtaaaatcaaagagccagagacactcagag

SEQ ID NO: 38066 - DNA, 68 bp, Homo sapiens
agaaaatacagtatatgtgtgtgtgtgtgtatatatatatatatacacacacatatactgtccttttt

SEQ ID NO: 38067 - DNA, 119 bp, Homo sapiens
ccagctttgttctttttgcttaggattgtcttggctatgtgggctcttttttggttccatatgaaatttaaagtagtatttttccaattctgtgaagaaagtcaatggaagtttgatgg

SEQ ID NO: 38068 - DNA, 119 bp, Homo sapiens
cttccttactgtgtggccttggatatgtcacttcctctctgattacctcagaggagactgagaagagactgaggccatcagagaggaagtgacatgtccaaggccacgcagtaagggag

SEQ ID NO: 38069 - DNA, 140 bp, Homo sapiens
gggcagcggccttgctggctcccgcgcgcaggacttctctgctggccggggctgcgaggcccgcctctgtctgtgtgtctgtccgtctgtctgtccgtccgggtggtgcgccaggctgcagtcggagcaggcagtggcgg

SEQ ID NO: 38070 - DNA, 70 bp, Homo sapiens
tttgggttgatggagatctgggagcttcacctgtagagctcttgaggctctctgacaatctgtctccaaa

SEQ ID NO: 38071 - DNA, 94 bp, Homo sapiens
tgagggcctgcactgactccctggctctctggttcccaggggcctcgggcagagccaggctcagaggggcagacactcaccggagcgccacgag

SEQ ID NO: 38072 - DNA, 79 bp, Homo sapiens
gcctgtgctgcccaccctgctgacctcccctgggccctactagctgtggctctcagggtctctggaacactggctcagc

SEQ ID NO: 38073 - DNA, 58 bp, Homo sapiens
tgagacaaagtctcactctgtcacccaggttggagtgcagtggtgtgatcttggctca

SEQ ID NO: 38074 - DNA, 79 bp, Homo sapiens
gcaaatgattgtatttctctcactcactgtgggctagcccacagtggatacacatgagaagcctaaaacaacatggagc

SEQ ID NO: 38075 - DNA, 84 bp, Homo sapiens
actttggtctgactggtatctccatctcccttgattttttttttttttttgagacggagtttcgctcgtcgcccaggctggagt

SEQ ID NO: 38076 - DNA, 106 bp, Homo sapiens
gacagagtgagactccgcctcaaaaaaaaaaaaataaagcaaaagactatatatacatatatatatatatattttttttttttttgagatggagtctcactctgtc

SEQ ID NO: 38077 - DNA, 222 bp, Homo sapiens
gtgagatatatatacatatatatacgtatatatatatgtatatatatgtgtatatatatacgtatatatgtatatatatgtgtatatatatacgtatatatacttatatatgtatgtatatgtgtatatatacgtatatatacttatatatgtatgtatatgtgtatatatacatatatacgtatatatatacacatatacatatatatatatatatatata

SEQ ID NO: 38078 - DNA, 95 bp, Homo sapiens; identical to SEQ ID NO: 580

SEQ ID NO: 38079 - DNA, 93 bp, Homo sapiens; identical to SEQ ID NO: 69

SEQ ID NO: 38080 - DNA, 95 bp, Homo sapiens; identical to SEQ ID NO: 580

SEQ ID NO: 38081 - DNA, 93 bp, Homo sapiens; identical to SEQ ID NO: 69

SEQ ID NO: 38082 - DNA, 116 bp, Homo sapiens
tgtacttcatgtgcttgaaattaaatggatagcctttgaatttccaggacagttctttttttttaaatgaacttcttctaaccttcaggtatattctgtttctataatgaggtcca

SEQ ID NO: 38083 - DNA, 56 bp, Homo sapiens
tgagatggtctcactctgtcactcaggctggagtgcagtggcatgatcacggctca

SEQ ID NO: 38084 - DNA, 105 bp, Homo sapiens
tgtttgcccacgttttgatggggttgtttgttttttttcttgtaaatttgtttgagttcattgtagattctggatatcagccctttgtcagatgagtaggttgca

SEQ ID NO: 38085 - DNA, 75 bp, Homo sapiens
gcttttgtctcttttattgtcctaattgtactggttagaatctatagtacaatgtttaatagaagtggtgagagc

SEQ ID NO: 38086 - DNA, 109 bp, Homo sapiens
tttgtattttgaatgggtgagtgtgcatgtgcatgtgtgtgcttgcatatatgtgcatgtatgtgtgcatatgcatgtacatatgcataaggaaagatgaaggtaagag

SEQ ID NO: 38087 - DNA, 64 bp, Homo sapiens
gcaggagcttctgtccagtggagttggggggtgccactcactcagcaagtggatgtgttcttgt

SEQ ID NO: 38088 - DNA, 109 bp, Homo sapiens
tatctcaaaaaaaaaatatatatatatatatatatatatacgtatatatatatatacatgtatatatatatacgtatatatacatgtatatatgtatatgtgaaagata

SEQ ID NO: 38089 - DNA, 99 bp, Homo sapiens
cattaatggccagtctgggcaacatagcgagacctcatctcttttatttttattttttaagatagagtctcactctgtcacccaggctggagtgcagtg

SEQ ID NO: 38090 - DNA, 58 bp, Homo sapiens
tgagttggagtctcactgtgtctcccaggccggagtgcagtggagtgattttggctca

SEQ ID NO: 38091 - DNA, 92 bp, Homo sapiens
actctaggctgggagacgaattgagacccagtttttgttttgttttttgttttttttgagatggagtctcgctctgtcacccaggctagagt

SEQ ID NO: 38092 - DNA, 92 bp, Homo sapiens
gagacatatacatatatgcatgcagagatatatatagtgtgatatatattgatatatctatatctctaaatatagcatgagtgtatgttttg

SEQ ID NO: 38093 - DNA, 72 bp, Homo sapiens
gtaggaacacctgtgtgtcctgtgtgatcactgtgactgtgtgtgtcagtgtggcaaggtatgcaggcctgc

SEQ ID NO: 38094 - DNA, 74 bp, Homo sapiens
gaggatgaggaagttggttgagaggttcacagttgcctgggtaacgtgggccaactttcctgacttttccactc

SEQ ID NO: 38095 - DNA, 57 bp, Homo sapiens
ctgtgtgtgcagacactgtgcacacaggtgggcctgtgcacagggtctggcattcag

SEQ ID NO: 38096 - DNA, 112 bp, Homo sapiens
gatgtttgcgttctctctaaaggtttgtgttagggagcagagacctggttttgttgagttgtttctcagtctgtcagtctctgccccacaacctttctggttgttccccatc

SEQ ID NO: 38097 - DNA, 102 bp, Homo sapiens
gtgattgattggatatgggttgtgaggtaaagtaaggaatggaggttattttgtaggtttctcatttattttatttatctatctatctatctatttatttat

SEQ ID NO: 38098 - DNA, 80 bp, Homo sapiens
tgatacggagtctcactctgtcacccaggctggagtgcagtggtgaaatctcggctcactgcaacctctgctacctgggt

SEQ ID NO: 38099 - DNA, 58 bp, Homo sapiens
tgagccagagtctcgctctgtcacccaggctgtagtgcaatggtgagatcttggctca

SEQ ID NO: 38100 - DNA, 90 bp, Homo sapiens
ggagttttgctcttgttgctcaggctggagtgcagtggcacactgtctggctcactgcaatctctgcctcctgggttcaagcgattctcc

SEQ ID NO: 38101 - DNA, 77 bp, Homo sapiens
ctgggcaatacagtaagactccatctctacaaaaattgttttttaattaggtgggcatggtgcacctgtagtcccag

SEQ ID NO: 38102 - DNA, 116 bp, Homo sapiens
gatgggaggatcaattgaggccaggagttcgagaccagcctagtcaacatagcgagactccatctatctatctatctatctgtctgtctgtctgtctgtctatctatctatctatc

SEQ ID NO: 38103 - DNA, 102 bp, Homo sapiens
gtcataatcattcatctccgtttttcctctagtgatgaaggctcgtggacggaccacggttcactcggtctaggagtcacgctgttgatcaggttgtcagac

SEQ ID NO: 38104 - DNA, 82 bp, Homo sapiens
caggtcactgtgggtgtgacagccactggctccagaagctcagtcctggcggcagctgtcaaaccaacacccacatagcctg

SEQ ID NO: 38105 - DNA, 58 bp, Homo sapiens
tgagacagagtctcgcactgtcacccaggctggagtgcagtggcgcgatctcagctca

SEQ ID NO: 38106 - DNA, 136 bp, Homo sapiens
gtggtactctgtgagacacagctatgtttcaaggtcgaagaattttttttttttttttgagatggagtctcactctgtcacccaggctggaatgcagtggcccaatctcggctcactgcaacctctgcctcttggg

SEQ ID NO: 38107 - DNA, 88 bp, Homo sapiens
agcctctgcttcactggaatgttgtgaggcctaaatgagaagcatagagcctggcctgtggacatgtttttagtattggtggggagct

SEQ ID NO: 38108 - DNA, 75 bp, Homo sapiens
ttctttatcattcctcccagatacatcctgactgcctgtatcactcaggatagttggaggggattcggtgcagaa

SEQ ID NO: 38109 - DNA, 67 bp, Homo sapiens
attgatttttgagacagtctcgctgtgtcacttaggctggagtgcagtggcgggatctcggctcagt

SEQ ID NO: 38110 - DNA, 115 bp, Homo sapiens
gtctcaaaaaagaaaaaaaaaaagatattcctgatgcaggctggctctgtctgtggctcaactggacattgtcagtaaattcagggggttttctttctttttttttttttgagat

SEQ ID NO: 38111 - DNA, 92 bp, Homo sapiens
gggggtggggctgagggggacacctgggctgccatagtcagtgtcacactgcctgggcctctgacctctctctctctctcctcacttctccc

SEQ ID NO: 38112 - DNA, 66 bp, Homo sapiens
gtgtatgtgtgtatgtgcatgtgtatatgtgtgtgcatatgtgtatgtatgtgcttgtgtgtatat

SEQ ID NO: 38113 - DNA, 64 bp, Homo sapiens
gtgtatgtatgtgcatgtgtatatgtgcatatctctgcatgtttgtgtatgtgcatgtgtatgt

SEQ ID NO: 38114 - DNA, 64 bp, Homo sapiens; identical to SEQ ID NO: 38113

SEQ ID NO: 38115 - DNA, 82 bp, Homo sapiens
ggttctactggcttggaattggggagaggctgaggagttctctccaggaatttttctctctctctctgtcatcagtattgcc

SEQ ID NO: 38116 - DNA, 118 bp, Homo sapiens
gagagagagactgttagattgagcatgttctttgctgttctcacgaaactgagaatgttgatgatgatgattacggttaggataacagtaacagctaatatttattgaacacttgctt

SEQ ID NO: 38117 - DNA, 79 bp, Homo sapiens
ggaattgaagagttggtgaggaggaggagttggaaggctccctttccctggtgactatctctctctctgactctactcc

SEQ ID NO: 38118 - DNA, 58 bp, Homo sapiens; identical to SEQ ID NO: 605

SEQ ID NO: 38119 - DNA, 91 bp, Homo sapiens
gcaatcctgaaggagtgatctctggtcctcaccgttccccagcacctctcattcctggctctctcggtgtctcaggctctctttcttgtgc

SEQ ID NO: 38120 - DNA, 80 bp, Homo sapiens
tgagcctcccaaagtgttaggattacaggcatgagccaccatggctcgccgaattttttttatttttagagatcgtctca

SEQ ID NO: 38121 - DNA, 64 bp, Homo sapiens
agatggacaatctgtttttttgtttttgttttgtttgagacaaacaaaacagtgtgtccactct

SEQ ID NO: 38122 - DNA, 86 bp, Homo sapiens
gctgtctctgtctctgcctcagacccatgcctactcctttggcactggtcactcagcagtagaatagtagtatagtagtagacggc

SEQ ID NO: 38123 - DNA, 82 bp, Homo sapiens
atatatgatatatatatacatgtatatatatatacatatatatacgtgtgtgtgtgtgtgtgtgtatatatatatatatatt

SEQ ID NO: 38124 - DNA, 79 bp, Homo sapiens
tgagatggagtctcactctgtctccccggctggagtgcagtggtgaaatctcggctcactgtttcctctgctcctgggg

SEQ ID NO: 38125 - DNA, 89 bp, Homo sapiens
gtatctctaagcatgtgtggacaagagtgtgtcttttttttttttttttttgagttggagttttgctcttgtcacccaggctggagtgc

SEQ ID NO: 38126 - DNA, 110 bp, Homo sapiens
aaggtaaacttacaaagctatgacatgcagaaacaagaactatttctttgtatttaaaacagtgtttagaggctgggcagagtggttcatatttgtaatcctagcacctt

SEQ ID NO: 38127 - DNA, 110 bp, Homo sapiens
gcatctttgggaagagcattcatgggaagccactgaagtattgtaagcaggagtggatgacatctgtgtttgttggagatcgccttagaggagaatagtttcaggttgct

SEQ ID NO: 38128 - DNA, 76 bp, Homo sapiens
ggtgataatttagtctgaccataaaaaagcctgagaatttttttttttttttctgagtcagggtcactctgtcacc

SEQ ID NO: 38129 - DNA, 118 bp, Homo sapiens
gacacagcaagactctgtctcaaaaaaaaaaaaaaaaaaggtaacattctcactactgtctttttatttattttttattattatttttattatttttgagacagagtctcgctctgtc

SEQ ID NO: 38130 - DNA, 89 bp, Homo sapiens
agagtctcactctgtcgcccaggctggagtgcagtggtgcaatctcggctcactgcaacctctgtctgtctccctgtttgagtaattct

SEQ ID NO: 38131 - DNA, 122 bp, Homo sapiens
atgatctcagaaatgagtgttcatctttggagactgagaatggagattcagagaagtgaatgaggtcatcaggtagacttttattaatagcaacttctattaggatcttgctcatactcagt

SEQ ID NO: 38132 - DNA, 117 bp, Homo sapiens
gtcatatcatttgtccatccatttaccagagtctcaagtgttttccttctttttttttttttttttttaaagacagggtgttgctctgtgaccctggctggagtgcagtggtgtgat

SEQ ID NO: 38133 - DNA, 85 bp, Homo sapiens
tgatgagtatgtatatgtgtatatatatgtgtgtatacgtatatatgggtgtgtgtatatatctgtatatatataataattatta

SEQ ID NO: 38134 - DNA, 91 bp, Homo sapiens
gagatggggtctcgctctgtcactcagactggagtgcagtggtgcgatctgggctcactgcaacctccgcttcctgggttcaagcgattct

SEQ ID NO: 38135 - DNA, 79 bp, Homo sapiens
tatatgttatttatgagatacatataaagatgtgtatatgtgtatacatgtgtgtttatgtatatatagatgatattta

SEQ ID NO: 38136 - DNA, 102 bp, Homo sapiens
tggtcaaggcctgcttccttaagcatttgtaagaggaacagaatgtttatttttctatcagaaaagatattttacttctataaatgtagccttgaaattcca

SEQ ID NO: 38137 - DNA, 98 bp, Homo sapiens
attcccctttgatatcctatgacttaaatcctgagatataaggttgaatcctattaacacttcttatgttagatgataggtaaatggacgtggggaat

SEQ ID NO: 38138 - DNA, 102 bp, Homo sapiens
ggcatggtggtatgcacctgtagtcccagctactcgggaggctgaggtggaaggatcacttgagcctaggaggcagaagttgcagtgagccaagatcatgct

SEQ ID NO: 38139 - DNA, 87 bp, Homo sapiens
tacatatttccttgatgagtactttttgctttttttttttaaagaatacatttttaggagtaaaattgctagatcaaagaatatgta

SEQ ID NO: 38140 - DNA, 118 bp, Homo sapiens
cagaaagatgtacacagagtgcctactttatgccaggaacacagatgggaatttctatataagttttctatctgcttatgatctagaagtccagcactcaggtctctgcaaggaagta

SEQ ID NO: 38141 - DNA, 111 bp, Homo sapiens
gattgcgccactgcaccccagcctgggtgacagagtgagactctgtctcaaaaaaaaaaaaaagagatggggtctcaccctgtcacccaggctggagtgaagtacacaatc

SEQ ID NO: 38142 - DNA, 118 bp, Homo sapiens
gggtgacagggtgagaccccatctcttttttttttttttgagacagagtctcactctgtcacccaggctggggtgcagtggcgcaatctcggctcactgcaacctccatctcccgggt

SEQ ID NO: 38143 - DNA, 93 bp, Homo sapiens
acagagtgagactctgtctcaaaaaaaaaaaaaaagttgaaggagtagtaaattcataatttttttttttttttagacagagtctcgctctgt

SEQ ID NO: 38144 - DNA, 58 bp, Homo sapiens
tgagacagagtctcactctgtcgcccaggctgttgtgcggtggtgtgatctcggctca

SEQ ID NO: 38145 - DNA, 58 bp, Homo sapiens
tgagaccgagtctcgctctgtcacccaggctggagtgcaatggcgtgatcttggctca

SEQ ID NO: 38146 - DNA, 74 bp, Homo sapiens
gctgggtttggtgatgcatgcctgtagtctcagttactcaggaggctgaggtaggaggatcacttgagcccagc

SEQ ID NO: 38147 - DNA, 102 bp, Homo sapiens
cttgttgcatgcattggctgcttcattcctccagtatagtttatttcatttatagatgtgtaagaatcctgtatggaaatgttgaaacagctgcatcttagg

SEQ ID NO: 38148 - DNA, 58 bp, Homo sapiens; identical to SEQ ID NO: 2595

SEQ ID NO: 38149 - DNA, 73 bp, Homo sapiens
caggagttcaagaccattctaggcaacaaattttttttttaataaattagccaggcatggttgtgtgcgcctg

SEQ ID NO: 38150 - DNA, 74 bp, Homo sapiens
cacttgtatagggcactatcatgagtggagcttgcaggagtggaagcttctctgggtgagtcagtgagtgagtg

SEQ ID NO: 38151 - DNA, 70 bp, Homo sapiens
ggagacactagactgtgagctcagatgaaatgattccacagtgcatgagcttcaccaccctactgtctcc

SEQ ID NO: 38152 - DNA, 58 bp, Homo sapiens
tgagtcagagtctcgctctgtcacccaggctggagtgcagtggcgcgatctctgctca

SEQ ID NO: 38153 - DNA, 87 bp, Homo sapiens
gcctctggactatgttatcaagtgagagaatggactctgtcctttgttgaaatgaaggactctctttctctgaaagtatgtacaggc

SEQ ID NO: 38154 - DNA, 86 bp, Homo sapiens
ctgggattaaattggagtttcaaatgtgatgaaaagtagaatgataacattctgtaattttcctactgctctgcaccaaattccag

SEQ ID NO: 38155 - DNA, 88 bp, Homo sapiens
gggaagcaagacttgtgtggtatctcacccagctttggacagactcaacaatacctggggtggggggaaccacaaaagaatgatgcct

SEQ ID NO: 38156 - DNA, 135 bp, Homo sapiens
ctgtgttggaatcccagttgtactgtccacttaggtgtatgaccttgggcaagttatgtactctcactgtgcctctgtgtcacccttaaatgggaataaccaattgggataatgcagataaagcacttagcacag

SEQ ID NO: 38157 - DNA, 95 bp, Homo sapiens; identical to SEQ ID NO: 68

SEQ ID NO: 38158 - DNA, 93 bp, Homo sapiens; identical to SEQ ID NO: 69

SEQ ID NO: 38159 - DNA, 109 bp, Homo sapiens
gcatttttctttcattttagtgagcaacaaccctgtaaacaagtagggcttaatttattatatatttagctccttgtttcaggattaattcctcaattaaggataatgc

SEQ ID NO: 38160 - DNA, 109 bp, Homo sapiens
ttcaattgttcttttttattgctgagtagtattgtatgtaactgttccaatgcatatacattgtatataacagtttgtcaacctgttcgtctgttgaagaacatttgga

SEQ ID NO: 38161 - DNA, 85 bp, Homo sapiens
gaaaatagatttctgtgttggacaggaagaaagttgcattaaaattttaaagtttttttgttttcaatcagtggaagtctttttc

SEQ ID NO: 38162 - DNA, 117 bp, Homo sapiens
gcattgtttagtattcagttgcattttccaactgtagagtttctgcttgattgtttataattatttcagtctctttgttaaatttatctgatagaatgctgaattccttctctgtgt

SEQ ID NO: 38163 - DNA, 98 bp, Homo sapiens
tgacgcagcacttggcatcatacctggctctatctatctgtatctatatctatatattttgagatatggtcttgttctgctgctcatgctggagtgca

SEQ ID NO: 38164 - DNA, 60 bp, Homo sapiens
ggacagttgctctcactctctctatgtatggccagcttctggctgagtcagggtctgtcc

SEQ ID NO: 38165 - DNA, 58 bp, Homo sapiens
tgagacagaatctcactctgtctcccaggctggagtacagtggtgtgatctcagctca

SEQ ID NO: 38166 - DNA, 103 bp, Homo sapiens
ggaaagaaagatactctctgaaatcatatttttgcttagcacaccatttctccataacagaggagagagagcagacatggacagaaatggtgcctctgaagcc

SEQ ID NO: 38167 - DNA, 96 bp, Homo sapiens
gttctctgtggctccatgaggctgatttcaattgggtatgggaaagacattccaataatctgtgatgagactgagctgtcactggagacagagtcc

SEQ ID NO: 38168 - DNA, 78 bp, Homo sapiens
gggctgcctggtgaggttggcaggttggggctgggaggtgcccctttctcacgctctctgccactctttcatccgccc

SEQ ID NO: 38169 - DNA, 66 bp, Homo sapiens
actctggtgggccctgcttgctcactgctcactgtgtggggcaggggacaacaaggttttcacaga

SEQ ID NO: 38170 - DNA, 73 bp, Homo sapiens
gggctctgtctgggtgtctccctctgtctctccaaggacaggagccatctggagggaagggcctggatggcct

SEQ ID NO: 38171 - DNA, 101 bp, Homo sapiens
gtaatgtttaccatggatattacaaataatatcacagtgggtgtacacacataaggtacacccactgtggtattatttgtactttcttagagagatgtaac

SEQ ID NO: 38172 - DNA, 131 bp, Homo sapiens
gctctctgccctggaaaggacagtaaaggaagggagcctgtcttgtctctgtcggtcctggaaagattggagctgggggcgtccttggataatgtctagaccagcctcccactgtggagtccagattggcc

SEQ ID NO: 38173 - DNA, 65 bp, Homo sapiens
ggtcccagaaacaggggtcctgtcatgcccactctccatgccaccctctgtgcctggctgtgacc

SEQ ID NO: 38174 - DNA, 82 bp, Homo sapiens
gctgtgccacttagcagcttagtgacctgggcagattacgctgcctctctgtgtctctgttcccttctctgataaccacagt

SEQ ID NO: 38175 - DNA, 104 bp, Homo sapiens
ttattggaagctattctgacatcactttccagactgtctcactgtcttgggaccaggcatgggaggcaggggtgggaatcttcttgtgattgtgggtggtggct

SEQ ID NO: 38176 - DNA, 114 bp, Homo sapiens
gctgtcttatctgtgttttactgcccgctctttctgtctgcttgtagttagaagagaagtgatttccttgaaatgcatgaggctagaaagggagctggaacttaaagtggtggt

SEQ ID NO: 38177 - DNA, 95 bp, Homo sapiens; identical to SEQ ID NO: 68

SEQ ID NO: 38178 - DNA, 93 bp, Homo sapiens; identical to SEQ ID NO: 69

SEQ ID NO: 38179 - DNA, 59 bp, Homo sapiens
tctgtctgtctgtgtgtctgtgtgcctcgcccatcagactgggatctcaggcaggcaga

SEQ ID NO: 38180 - DNA, 59 bp, Homo sapiens; identical to SEQ ID NO: 38179

SEQ ID NO: 38181 - DNA, 58 bp, Homo sapiens; identical to SEQ ID NO: 315

SEQ ID NO: 38182 - DNA, 88 bp, Homo sapiens
cgcagtgcaaaaagcaactgagacaagagagcgtgcaggagtgtttcaattcatgccagtcattgaatcaggtcctgttccacatgtg

SEQ ID NO: 38183 - DNA, 104 bp, Homo sapiens
ggccctgagggttgtggatcccagaggtggcaaggttaaagggcatttgggttccagacctggctctgtctctaagtcactgcctcattttgccctcagtttcc

SEQ ID NO: 38184 - DNA, 65 bp, Homo sapiens
ctggacacagtttgtgcatgtccatctgctgaagcctccagccagtacatgcacacgctttctgg

SEQ ID NO: 38185 - DNA, 88 bp, Homo sapiens
ccaggggagaagaatatgtgaggaagggggtctgagggagaatttaaatttgccacactcaaagtctctctctttaaatagctcctgg

SEQ ID NO: 38186 - DNA, 83 bp, Homo sapiens
aggtggagtcagaacaggaattcagagctcccgattctccccataggggtctgtcctctgtcactctctgctcctgccttgat

SEQ ID NO: 38187 - DNA, 96 bp, Homo sapiens
tctgggtgcttcccaggctgtatgtgaaactgcattaccatgtgaggtgagtcactcatagcaggccaggcaggaagcagccttgtgaagcccaga

SEQ ID NO: 38188 - DNA, 113 bp, Homo sapiens
aggtgcggtggtgtgtagctgtagtcccagctattcaggaggctgaggtgggaggatggtttgagcctggaaagttgaggctgcagtgagtaaagattgtgccactgcactct

SEQ ID NO: 38189 - DNA, 112 bp, Homo sapiens
gagtgagctaccgagcctggcccaaacaatttgggagtttgataagttttttttttttttttttgagacagtctcactttgttgccaggctggagtgcagtggcatgatctc

SEQ ID NO: 38190 - DNA, 58 bp, Homo sapiens; identical to SEQ ID NO: 6359

SEQ ID NO: 38191 - DNA, 85 bp, Homo sapiens
tgtgtctgtcctctcgcagtctctgtctctgtctctgtggccctggccaacggtggtggagtttcaggttctggggactgaacca

SEQ ID NO: 38192 - DNA, 75 bp, Homo sapiens
acagagtggtgggtagcaggtcttttctttagctgagctgcgtgctctctagagtctctctgtctcattttctgt

SEQ ID NO: 38193 - DNA, 110 bp, Homo sapiens
ccgcactccagcctggcgagagagtgagactatgtctcaaaaaaaaaaaaaaaaaaaattttttttttttttgagagacagtctctctctgctgcccaggctggtcttgg

SEQ ID NO: 38194 - DNA, 87 bp, Homo sapiens
ggaggtgcccaagcagtgagctcggtgaggggtggggtggtcaggatccactgtggctgtgagtccctcccatcctgtggcactcgc

SEQ ID NO: 38195 - DNA, 99 bp, Homo sapiens
aggaggcagatatattcagattcaactcaaattcactaaatgcttatttacttatttatttattattattttttgagaccgagtctcactctgtcgcct

SEQ ID NO: 38196 - DNA, 127 bp, Homo sapiens
ggaaagagtgttggtgttggctggggtgtcaataaagctgtgcttggggtcgctggcttgtgtctctgtgtctgcctctcacaattctggaatccctggccctctctttaccccactacagctcact

SEQ ID NO: 38197 - DNA, 58 bp, Homo sapiens; identical to SEQ ID NO: 1673

SEQ ID NO: 38198 - DNA, 175 bp, Homo sapiens
atatgtatatatacacgtatatatgtatatatacgtatatatgtatacatacacgtatacatgtatatatgtatgtatatatgtgtgtatatatgcatgtatacgtgtgtatgtatatatgtgtatgtatatatacgtatatagacgtattatacacatatacgtatatatatac

SEQ ID NO: 38199 - DNA, 88 bp, Homo sapiens
gtatgtatagagagagcatatatatatatatatttatgtatatatacagtcatatagatatatatatgctttttctgtatacacatac

SEQ ID NO: 38200 - DNA, 84 bp, Homo sapiens
tgggtgatacagcaaaacttattctctaaaataataaataaatattttttttttttttgagatggagtctcgctctgtcaccca

SEQ ID NO: 38201 - DNA, 64 bp, Homo sapiens
gttgagagtctgtctatgttgaagcagataatgcccccatcagacacagacactcactctcggc

SEQ ID NO: 38202 - DNA, 81 bp, Homo sapiens
ctaatatatgtgttttatatacgtacgtgtatatatatgtgtgtatatatatgtattactgtataacatatcaaatattag

SEQ ID NO: 38203 - DNA, 77 bp, Homo sapiens
gggaaggcagggctcacagccactcagggccagattcctccctgcttctgggtctctgacactgttcctctgtcacc

SEQ ID NO: 38204 - DNA, 78 bp, Homo sapiens
acttctactctctccctctcaaactttcatcatcccctgtcacaggggatatggaatgagatttgatatgtaattagt

SEQ ID NO: 38205 - DNA, 116 bp, Homo sapiens
ttcagatgatgggtgttctaggttcattttcttctcttctgatttaaatgattattattattattttatttatttatttttttgagatggagtctggctctgtcgcccaggctgga

SEQ ID NO: 38206 - DNA, 79 bp, Homo sapiens
actccagcctgggcaacaagagcgaagctcttttttttttttttgagacagagtctcactctgtcgcccaggctagagt

SEQ ID NO: 38207 - DNA, 62 bp, Homo sapiens
ggcctagagtagagtacaagattcttttttttttgtcagagtctcactctgtcactctggct

SEQ ID NO: 38208 - DNA, 107 bp, Homo sapiens
ccagcctgggcaacatagtgagagcccattactacaaaaataatttttattttatttatttatttatttattttgagacagagttttcactctgtcactcaggctgg

SEQ ID NO: 38209 - DNA, 107 bp, Homo sapiens
agaaggggctgaagacttgagagctgaaatgacttctgcggctcactcagtgagtgaatggcagggccacctcaaaaactcaattctccactctcccagtttctttt

SEQ ID NO: 38210 - DNA, 117 bp, Homo sapiens
gcccacgagttcaagaccagtccgggcaacatagcaagatcccttctctaaacaaaaattttttttttttttgagatggagtctcactctgtcgcccaggctggagctcagtggtgc

SEQ ID NO: 38211 - DNA, 82 bp, Homo sapiens
gcacagacagattgattgccatgactaagagagaaggggagttacaaaccccctcctccctctgttactcactctctgatgc

SEQ ID NO: 38212 - DNA, 90 bp, Homo sapiens
ggagctgaaaaggaggaggtcattcttagatagagtaaatgacttttttttttctttttagagacagggtctcactctgccactcagcct

SEQ ID NO: 38213 - DNA, 95 bp, Homo sapiens
tggtgtgcacctatagtcccagctacttgggaggctgaggtaggaggatcacttgaacccaggagtccaggttgcagtgagctatgatcacacca

SEQ ID NO: 38214 - DNA, 66 bp, Homo sapiens
cttctgtctctctcagactaattgcttcctgaactaggaagggtgtccaaacagagacctaggaag

SEQ ID NO: 38215 - DNA, 94 bp, Homo sapiens
gtatatatatatgtatatgtgtgtatatatgtatatgtgtgtatatatatgtatatgtgtacatatatatgtatatgtatatatatttccacac

SEQ ID NO: 38216 - DNA, 67 bp, Homo sapiens
gatgcttgctctgactcagtgtttctgtcaaacccaaggcagtggaagtatggagtctgcaaaaatc

SEQ ID NO: 38217 - DNA, 93 bp, Homo sapiens
agtcgttgtaactgaagtccatgtggtcctgagagtacagcagaagattggtctccagtctctctctgtccctatagattagttactgtgatt

SEQ ID NO: 38218 - DNA, 95 bp, Homo sapiens; identical to SEQ ID NO: 68

SEQ ID NO: 38219 - DNA, 93 bp, Homo sapiens; identical to SEQ ID NO: 69

SEQ ID NO: 38220 - DNA, 95 bp, Homo sapiens
ttttggacccggtctagcgaggggggaaaatttgggaaggcgagatgacgcgttatccgtcttagtctctctctctctgagcacgtgatccaaag

SEQ ID NO: 38221 - DNA, 132 bp, Homo sapiens
gccctgctcgctcagctgatctgtggcttaggtagtttcatgttgttgggattgagttttgaactcggcaacaagaaactgcctgagttacatcagtcggttttcgtcgagggccccaacccacctctccca

SEQ ID NO: 38222 - DNA, 100 bp, Homo sapiens
tgtagtgatgatggcattataatataagccacaatgataaaattaaaatattttgtattatattttataataatagtttatcacatgccatttcattata

SEQ ID NO: 38223 - DNA, 66 bp, Homo sapiens
cagggaacaggtctgtctgtctgtctctggtcagtagagaattttggtcaggctctagtaaccctg

SEQ ID NO: 38224 - DNA, 87 bp, Homo sapiens
gtcagactgtgctctctccattccccaggactccacagaaccatctggtactgctagtgctgggtgaacagtgagagcagagtccac

SEQ ID NO: 38225 - DNA, 98 bp, Homo sapiens
gcacgattagcatttgaggtgaagttctgttatacactcaggctgtggctctctgaaagtcagtgcatcacagaactttgtctcgaaagctttctagc

SEQ ID NO: 38226 - DNA, 58 bp, Homo sapiens; identical to SEQ ID NO: 1673

SEQ ID NO: 38227 - DNA, 109 bp, Homo sapiens
gaggacctgtttagcagtttgaaagggtgagagacacgagagccaaactgatcttccttgaatagtttttagcccctccaatatcctttttcagtctccacaagtgttc

SEQ ID NO: 38228 - DNA, 113 bp, Homo sapiens
attaaaatttgatctagtagtaggttcgtcacatgggtattcaatatattattatattcttgtgtatttatttgaattatttcacaaactagattaattgtaatcagttttaa

SEQ ID NO: 38229 - DNA, 58 bp, Homo sapiens; identical to SEQ ID NO: 1101

SEQ ID NO: 38230 - DNA, 56 bp, Homo sapiens; identical to SEQ ID NO: 1102

SEQ ID NO: 38231 - DNA, 56 bp, Homo sapiens; identical to SEQ ID NO: 7986

SEQ ID NO: 38232 - DNA, 58 bp, Homo sapiens
tgagacagagtctcactctgtcgcccaggctggagtgcaatggtgcgacctctgctca

SEQ ID NO: 38233 - DNA, 95 bp, Homo sapiens; identical to SEQ ID NO: 68

SEQ ID NO: 38234 - DNA, 93 bp, Homo sapiens; identical to SEQ ID NO: 69

SEQ ID NO: 38235 - DNA, 115 bp, Homo sapiens
ccagttctgcttaaggtgctctatgacagtctcatggattttctttcttttttttttttttttaagacacggggtctctgcacaatcatagttcactgcagccttgaactcctgg

SEQ ID NO: 38236 - DNA, 97 bp, Homo sapiens
tcacctggcagccactcccagagcccctggaactctggcccaaggctctctgactgactccttcccagatcttcttggctcagtggctgaagactga

SEQ ID NO: 38237 - DNA, 74 bp, Homo sapiens
gtgtgtctgtctgtgagtgtgggtgaagtactgctgtaatcagattcaacccccatgcagccacagtaatacac

SEQ ID NO: 38238 - DNA, 99 bp, Homo sapiens
tggagagtgggaactggaagatggaagataggggtggaaagataagttttatgctatatttttgtttcttaaatattttaagtcaagtccctaccttga

SEQ ID NO: 38239 - DNA, 112 bp, Homo sapiens
atgtactgaagtgtatgtgtttaaatatacatgtcttcaaatatatatatttatggatatatatatatttatggatatatagataaacatacatctatgtaccttcatatat

SEQ ID NO: 38240 - DNA, 95 bp, Homo sapiens; identical to SEQ ID NO: 68

SEQ ID NO: 38241 - DNA, 93 bp, Homo sapiens; identical to SEQ ID NO: 69

SEQ ID NO: 38242 - DNA, 83 bp, Homo sapiens
gattaggtcccatttgtcaattttttattttgttgcaattgcttttggcattttgtaatgaaatcattgccagggcctatgtc

SEQ ID NO: 38243 - DNA, 95 bp, Homo sapiens; identical to SEQ ID NO: 68

SEQ ID NO: 38244 - DNA, 93 bp, Homo sapiens; identical to SEQ ID NO: 69

SEQ ID NO: 38245 - DNA, 76 bp, Homo sapiens
attgttttgctttattttgttttgttttgagacagagtctcactctgtcacccaggctagagtgcagtggaacaat

SEQ ID NO: 38246 - DNA, 84 bp, Homo sapiens
tcaaatcaccggcctcgctgggactcagtttctctattagaggggtgtgactcgccctctgtctgtgtcacagggttggtgtga

SEQ ID NO: 38247 - DNA, 66 bp, Homo sapiens
tagccatagatgtatgggcttatttctggattccatcccagaaaaagtctatttcattttttgtta

SEQ ID NO: 38248 - DNA, 74 bp, Homo sapiens
ctctatgtttatcatatctcttctatatatacatatatgtgtatatataatctagagagaagaagaacaaagag

SEQ ID NO: 38249 - DNA, 92 bp, Homo sapiens
agaagattgagagagccttaggatttgcttttattagattgcgtcaaaatgttgtatgtatatttttcatttcctgtgctcttaaaatttct

SEQ ID NO: 38250 - DNA, 75 bp, Homo sapiens
tgaacaaggacagcctggaggttagaagcaagatggacttggctaggtcggatctctttcactgtctcagttgca

SEQ ID NO: 38251 - DNA, 95 bp, Homo sapiens; identical to SEQ ID NO: 68

SEQ ID NO: 38252 - DNA, 93 bp, Homo sapiens; identical to SEQ ID NO: 69

SEQ ID NO: 38253 - DNA, 73 bp, Homo sapiens
ctaggcatggtagtgcatgcctgtggtcccagctaatcaggaggctggggttgaaggatcactagaggccagg

SEQ ID NO: 38254 - DNA, 87 bp, Homo sapiens
cctattggaagtcttttgaggttctatacacattttaagatttttttttctatttctgtgaagaatgtcattggtgttttgatatgg

SEQ ID NO: 38255 - DNA, 111 bp, Homo sapiens
gaggtgatagctcatgtggttttgatttgcatttttctgatgattagtgatgttgaacatttttttttcatatacctgttgtcatttgtatgtcttcctttgagaaatttc

SEQ ID NO: 38256 - DNA, 79 bp, Homo sapiens
tccttgtttgttatttatgtatttttgagacagggtctcactttgtcatccaggctggagtgcagtgacacaatcagga

SEQ ID NO: 38257 - DNA, 58 bp, Homo sapiens
tgagtcagagtctcactctgttgctcaggctagagtgcagtggtgcaatcctggctca

SEQ ID NO: 38258 - DNA, 95 bp, Homo sapiens
tctgactacaaagacccagaggagatggttgtatttttttttttttaaattaagaaatagagatggggttgcctaggctggtcttgaactccagg

SEQ ID NO: 38259 - DNA, 88 bp, Homo sapiens
gccatgtgacttgaatatcccctccaaaactcatgtcgaaatttcattttcaatataacagtattgagagaggagacctttcaggggc

SEQ ID NO: 38260 - DNA, 100 bp, Homo sapiens
ggcataggggtgtgtgtgtatgtgtgcatgtgcatgtgcatgtgagcacacatgtatcagtatctgccaaatctctgcatatgggcagcatgcctcaagc

SEQ ID NO: 38261 - DNA, 58 bp, Homo sapiens
gtatatatgtatgtatacgtatatatgtgtatatatgtatgtatatgtatatatgtat

SEQ ID NO: 38262 - DNA, 113 bp, Homo sapiens
tgggtcttgtgtttggaatgatgtatagggccaagaggtttgctgtgtgatactgagcatctcactgtctctctcaacctattttctcatctaccaagtggggctaagaccca

SEQ ID NO: 38263 - DNA, 108 bp, Homo sapiens
ccaattctggatcaggttgatgtcacaggagctttccttatttttattttactttaattatttttagagacagtgtcttactgtgttgctcagcttggagtacagtgg

SEQ ID NO: 38264 - DNA, 119 bp, Homo sapiens
ggaagtgagagtgaataaactgagtagagaaacactgttttcccacctacttcttaattatttatttatttaagtagagatggggtctcattctgttgctcaggctggtctcaaactcc

SEQ ID NO: 38265 - DNA, 65 bp, Homo sapiens
ttttggcggggggggggggggggttgtttttttgagacagtctcactctgtcacccaggctggag

SEQ ID NO: 38266 - DNA, 119 bp, Homo sapiens
agccacggtgcctggcccaacattacttttaaaattaattctctagtttgacttcacatttagttcttcagtccaactggagttcacatttgtaattaatgttaggtagaaatctggtt

SEQ ID NO: 38267 - DNA, 79 bp, Homo sapiens
gtatcagtgtgagaaagatcaagattcttaaaaaaaatttttttttttttttttttgagacaaagtctcgctctgtcac

SEQ ID NO: 38268 - DNA, 66 bp, Homo sapiens
tactgagtacagcagtctctcagctctgcacttttactcaagacctgcactgtctgtctctcagta

SEQ ID NO: 38269 - DNA, 92 bp, Homo sapiens
gtgcagtattaagagacagtaaaagatttttgcttactttttttttttttttttttttgtgattgagtcttgctctgtcaccctggctggac

SEQ ID NO: 38270 - DNA, 169 bp, Homo sapiens
atatatatatatatatatatatttatatatacacatattatttgtgtgtgtgtatatatacatatatatgtgcatatatatacacactatatatagtatatatatatacacacacatatatatgtatgtgtatatatatgtatgtgtgtgtgtgtatatatgaataaag

SEQ ID NO: 38271 - DNA, 83 bp, Homo sapiens
tgtatatatatgcacatatatatgtatatatacacacacacaaataatatgtgtatatataaatatatatatatatatatata

SEQ ID NO: 38272 - DNA, 78 bp, Homo sapiens
tgtgtgttgtgtatatgtatgcatgtgtgatgtctgtgtatgtttttgtgtgtgcatgtgcatgtgtgtagtatgcat

SEQ ID NO: 38273 - DNA, 65 bp, Homo sapiens
gtgcgcgctcgtgtacgcatgagcacacaacatgtgtctatgtgtgtctgtgtgtgagtgtgcat

SEQ ID NO: 38274 - DNA, 73 bp, Homo sapiens
agtgggggcagtttgggtaaactgagttttctttttttttttgagacggagtttcaccctttttgcccaggct

SEQ ID NO: 38275 - DNA, 103 bp, Homo sapiens
tcatccagggaaagagacagtgactgacccccaggtgctcctactacgtgtaagcgataggtgtctggatccaggttaggtacaggcagatggttccgggtga

SEQ ID NO: 38276 - DNA, 102 bp, Homo sapiens
cactctgtccatctctctcctttcaattggcagaacagatggagcacagcttctctagcttgcattccaggaaagttcttgcaaggagcagagttcaaggtg

SEQ ID NO: 38277 - DNA, 87 bp, Homo sapiens
tgagttggagtctcactctgtcacccaggctggagtgcagtggtgcgatctcggctcactgcaacctgccgggttcaagtgattctc

SEQ ID NO: 38278 - DNA, 66 bp, Homo sapiens
ttggcagtggttaagagtgtgagcaccagaaccaaacagctgggctctgacactgactccctccaa

SEQ ID NO: 38279 - DNA, 119 bp, Homo sapiens
ctctggggaacaaccctgcgtttccactcttgatatctaaggtcctcatgatgcattgtagtggcatagtccaggggaaggatgacaaggggacaagcagacaagggcctgggcgctag

SEQ ID NO: 38280 - DNA, 78 bp, Homo sapiens
ggttgtcaggtgtattgatgtcaaacccagctgaaagcacatgctcattgctgagtgaagacacaatgctgtacaact

SEQ ID NO: 38281 - DNA, 116 bp, Homo sapiens
gcccggctgggcagaggggcgcttccctctgttataagaagtgagaacacagtctgctcggattttgcatcaaaacttatccacagagtgattttctctggcctcaattcctgggc

SEQ ID NO: 38282 - DNA, 69 bp, Homo sapiens
ttccttactttaggaggccatgtgtattgtccttgtttgacagactactgagtgtgcagaagtaaggaa

SEQ ID NO: 38283 - DNA, 94 bp, Homo sapiens
tccagcctgagcaacatagcaagatcccatctctttgaaaaaaaattttttttttttttttgagatgcagtcttgctctgtcacccaggctgga

SEQ ID NO: 38284 - DNA, 117 bp, Homo sapiens
tgcttcattgttctgccagacagccctttatcccttaatccttgttggcctatatttttgtttatttacaggacttaggttggataggaaaggaatgccttttttaacagaaaagta

SEQ ID NO: 38285 - DNA, 100 bp, Homo sapiens
catctttcctgataagtgaagtatgtatttcaaaataaaataatcctaccttttatgttttattttattttattttatttatttatttatttttgagatg

SEQ ID NO: 38286 - DNA, 71 bp, Homo sapiens
tgtctctctttctttctttcttttttgatacagagtcttgctctgtcacccagaatgaagacagtggggca

SEQ ID NO: 38287 - DNA, 109 bp, Homo sapiens
aagctggggttacctcttcaagaaccttgaatttgtgtggcagacactctgtgtttctgtagtcataacatttggagcagttgtggggctgggaacttagagctttgct

SEQ ID NO: 38288 - DNA, 68 bp, Homo sapiens
taaggtggaaccttttttttcttttgttttagactccattcagaagagagaagaggggagtgacttta

SEQ ID NO: 38289 - DNA, 58 bp, Homo sapiens
tgagacagagtctcgctctgtcacccaggctggagtgcagtggcgtgatcttgactca

SEQ ID NO: 38290 - DNA, 56 bp, Homo sapiens; identical to SEQ ID NO: 324

SEQ ID NO: 38291 - DNA, 95 bp, Homo sapiens; identical to SEQ ID NO: 580

SEQ ID NO: 38292 - DNA, 93 bp, Homo sapiens; identical to SEQ ID NO: 69

SEQ ID NO: 38293 - DNA, 116 bp, Homo sapiens
gttgaaagagcagagagatgaagccaggataaaaaatggtgcagaaagacagtgatcagagaggaaagtgaggactttctgccaaaatgcctgagggcttccctgcctacctcagc

SEQ ID NO: 38294 - DNA, 106 bp, Homo sapiens
tactttgttgtgaataactgtcataagtcatctctaaaactgtattttttatctagttattatatatgactagctatatgtctagttttttaaataatacaaagta

SEQ ID NO: 38295 - DNA, 56 bp, Homo sapiens
gggtggacttgtggatttgttttttttttttgagacggagtctcgctcagtcaccc

SEQ ID NO: 38296 - DNA, 60 bp, Homo sapiens
ggagctgcagatctttgaggggccctaaatctgccttggtccctccctctctgacagtct

SEQ ID NO: 38297 - DNA, 116 bp, Homo sapiens
tcgcttcagacctccatccccactgagtctgctgtgcctggacagcctcactggcacactgaccaacgtggcgattggagccatccaggctggcaaattcaatgtagtcctcgcgg

SEQ ID NO: 38298 - DNA, 56 bp, Homo sapiens
gagacagggtctctctctgtcatgcaggctggagtgcagtggtgtgatcttgtctc

SEQ ID NO: 38299 - DNA, 117 bp, Homo sapiens
ccagactgggcaacaagagcgagactccgtctcaataaataaataaataaaaattattttattttttatttagttatttatttttgagatggagtctctctctgtcgcccaggctgg

SEQ ID NO: 38300 - DNA, 109 bp, Homo sapiens
ggcaaatacaagaagagctgaattgtttctgtcacctaaggctcagctaagtgactctctgtcactagggaggaatggggtgggcagaccttcagccacttcaggggcc

SEQ ID NO: 38301 - DNA, 112 bp, Homo sapiens
cctgagtagctgggactacaggtgtgtgccaccatgcctgacaaaaatttttttttttttttaaacaagagactcagcatagtggctcatgcctgtaattccagcactttgg

SEQ ID NO: 38302 - DNA, 111 bp, Homo sapiens
ttgcatagggcatgaatctctggtagcctccatcctaatctttattttattttatttttttgagactaggtctcactctggttaactaggtgcaatctcggctcactgcag

SEQ ID NO: 38303 - DNA, 95 bp, Homo sapiens; identical to SEQ ID NO: 68

SEQ ID NO: 38304 - DNA, 93 bp, Homo sapiens; identical to SEQ ID NO: 69

SEQ ID NO: 38305 - DNA, 189 bp, Homo sapiens
tttgtaaatatatatatatatgtatgtgtatatgcatgtgtgtgtatatgtgtatatatatgtgtgtgtgtgtatatatataaatatatatataaatatatatatatacaaatatatatatatatattcttgctctgtcacctaggctggagtgcagcgacataatcatggcttactgtagccttgagc

SEQ ID NO: 38306 - DNA, 58 bp, Homo sapiens; identical to SEQ ID NO: 315

SEQ ID NO: 38307 - DNA, 88 bp, Homo sapiens
gggcgagagaggtgtttgggtcttgaaacaaggtaattaagttattatcattattattattttgagacagagtctccctctgtcgccc

SEQ ID NO: 38308 - DNA, 81 bp, Homo sapiens
tcagccagcttgactgttccaccacttgtcaccagaatgttctctggcttcagatctcggtgaacgatgcaattggcatga

SEQ ID NO: 38309 - DNA, 112 bp, Homo sapiens
ggacagaaagctcccatagaggctgtggctggattcaagtaatccaggataggctgtttccatctgtgaggcctattcttgattacttgtttctggaggcagctgatggtcc

SEQ ID NO: 38310 - DNA, 117 bp, Homo sapiens
ctgactgccttccctggggccctccattggattctgcctgaggaagtgctcagtgtgtgtctgtcaatgtaaagagcactcaaatctaaacagaccaggctccagcctgcagcccag

SEQ ID NO: 38311 - DNA, 84 bp, Homo sapiens
tgggaggtgtaggggcactctcaaggtctcttctggaaaactttttttttttctaagacaagagtctcattctgttgcccaagc

SEQ ID NO: 38312 - DNA, 115 bp, Homo sapiens
tagtgtgaatgtacttcatgtcactaaactgtacacttaaaaatggttaaaatggtacattttattttattatttttatttatttatttatttactgagacggagtctcgctctg

SEQ ID NO: 38313 - DNA, 77 bp, Homo sapiens
tgagagagtctcactctgtcacccaggctggagggcagtggtgcagtctcggctcactgcacctccatctcctgggt

SEQ ID NO: 38314 - DNA, 72 bp, Homo sapiens
atggcagctattactattaggatcccttgtgtctttcttattcttatagggtcctgctcagtgtgctgttgt

SEQ ID NO: 38315 - DNA, 101 bp, Homo sapiens
agtttgattataatatgtctcaatgtggctatctttgagttcatcatacttggagtttgttgagcttcttggatgtttatattcatgtcttttatcaaact

SEQ ID NO: 38316 - DNA, 129 bp, Homo sapiens
tatatatgtgtgtgtgtgtatatatatgtgtgtatatatatgtgtgtgtgtatatatatatgtgtaggtgtgtatatatgtgtgtgtgtgtgtgccatatatatatatatatatatatatatatatata

SEQ ID NO: 38317 - DNA, 95 bp, Homo sapiens; identical to SEQ ID NO: 68

SEQ ID NO: 38318 - DNA, 93 bp, Homo sapiens; identical to SEQ ID NO: 69

SEQ ID NO: 38319 - DNA, 89 bp, Homo sapiens
agagccatatagatataaatgcatatctatgtatatagatttatatgcatttgtacacataaacacatgcacattatttatattgttct

SEQ ID NO: 38320 - DNA, 111 bp, Homo sapiens
taggttgataggttgattgttacatgagattcagaaggttaagattcagcaaatagaaagtagagatgtatgaaagtaactttctggaaaaagagcttttcctaaaacctg

SEQ ID NO: 38321 - DNA, 111 bp, Homo sapiens
gttcaagtacaagccattgaagaattttaagcatgttagtgatatgatttaatttctatttttagacgattgttccattggccatgttgattataagaggcaagagtggac

SEQ ID NO: 38322 - DNA, 224 bp, Homo sapiens
atatacatatacacatatatacatatgtatatacatacatatatacatatacatacatgtgtatatgtatatatacatacatgtgtgtatatgtgtatatatatgtgtgtgtatatgtatatatgtatatgtgtatatatacacacatatatattcccaaataacgccttgtgtgtatatatgtatatatgtatatgtgtatatatacacacacatatatatat

SEQ ID NO: 38323 - DNA, 74 bp, Homo sapiens
tatatacatatacacatgtatgtatatgtatatatgtatgtatatacatatgtatatatgtgtatatgtatata

SEQ ID NO: 38324 - DNA, 64 bp, Homo sapiens
gctggcatcttgttcagatcagctccacaggatacaaggagcaagagcatgtacatgtgcaggc

SEQ ID NO: 38325 - DNA, 67 bp, Homo sapiens
tagatatatatgatatatctagatatatgatatctatatctatatctatatatgatatatatatcta

SEQ ID NO: 38326 - DNA, 69 bp, Homo sapiens
gtgggtctctgtctctgtatgttcatgtggccttctataaatataccagtcactggatttagggcccac

SEQ ID NO: 38327 - DNA, 108 bp, Homo sapiens
gaaatttagagttgaatttacagttcaggtacctcttatactgcttcttatggtatgcaaagtagtgtcctttttaagttttagccttggattcttaacctaagtttt

SEQ ID NO: 38328 - DNA, 110 bp, Homo sapiens
gcacacacacgccatggaatatatatgtgtgtgtgtgtgtatatatatatatatatatatatatatatatatatacacacacacatatattctaattggtcttgaggtgt

SEQ ID NO: 38329 - DNA, 108 bp, Homo sapiens
acacctcaagaccaattagaatatatgtgtgtgtgtatatatatatatatatatatatatatatatatatacacacacacacacatatatattccatggcgtgtgtgt

SEQ ID NO: 38330 - DNA, 74 bp, Homo sapiens
tatatgtattatgtatatatgtgtatatattgtgtatatatacaatatatagatgtatattatatatagatgta

SEQ ID NO: 38331 - DNA, 74 bp, Homo sapiens; identical to SEQ ID NO: 38330

SEQ ID NO: 38332 - DNA, 74 bp, Homo sapiens
tctgcaaactgaagcagagacatgcagcagagaattttttttttttgaggcagggtctcactgtgtcacccaga

SEQ ID NO: 38333 - DNA, 98 bp, Homo sapiens
ggtacacatacattgattagaattaacagaagccacttggatttacaaacccataggttttaaaggttttttttaaattttttttggcttgtgggacc

SEQ ID NO: 38334 - DNA, 109 bp, Homo sapiens
gatatttctttctcagaagtgtttatgccttttatttttctttgttgtcttactacactgtacagactgtccagaaaaatgctaaataaaactgataaaagcagatatc

SEQ ID NO: 38335 - DNA, 115 bp, Homo sapiens
gatggtatctgaaaacataaaaatttcccacttaaattttattcttatttatttacttttgtagacaaataagttctttagtggtgatttctgagattttgatgcttccatcacc

SEQ ID NO: 38336 - DNA, 97 bp, Homo sapiens
tccagtttttggcttttgtgaataattctgctatgaatatgattttatctgttttcaattcatttgagtatatataatcagaagtaaaattgctgga

SEQ ID NO: 38337 - DNA, 138 bp, Homo sapiens
tatatatatatatgtgtatatatatgtgtatatatgtgtatatatgtgtgtatatatatatatatatgtatatatatatatatacacatgtgtatatatatacatatatgtgtgtgtgtgcatgtgtgtgtgtgtgtg

SEQ ID NO: 38338 - DNA, 72 bp, Homo sapiens
ggatattatgaacaatatcacagtgggtgtacacacatggtgtacacccactgtgatattagatgtaatacc

SEQ ID NO: 38339 - DNA, 89 bp, Homo sapiens
atcacaatgagtgtacaccctgtgatattattcataatgtcctagggagatattactcttaatatcacagtgggtgtacaacctgtgat

SEQ ID NO: 38340 - DNA, 93 bp, Homo sapiens
tggttgagtttgtggtagtttacaattgtctttcagaaattatttattttctatagaagccagtttgtgaattaaaatatcatcagactacca

SEQ ID NO: 38341 - DNA, 73 bp, Homo sapiens
agctgactcactccatgtctcacatttgggtcacaatgatgcaagaagtgagctcccatggccttaaacagct

SEQ ID NO: 38342 - DNA, 350 bp, Homo sapiens
tatatatatatatgtgtgtgtgtgtatatatatatgtgtatatatatgtgtatatatgtatatatgtatatataatgtgtatatgtatatatgtgtatatatatgtgtatatgtatatatgtatatatgtgtatatatatgtgtatatgtatatatgtatatatgtgtatatatatgtgtatatgtatatatgtgtatatatgtatatatgtacatatgtatatatacatatatgtatatatgtatatatccatatatgtatatatgtgtatatatgtatatatgtgtatatatccatatatccgtatatatatgtgtatatatccatatatccgtatatatgtgtatat

SEQ ID NO: 38343 - DNA, 108 bp, Homo sapiens
atggatatatacacatatatacatatatacacatatatacatatatggatatatacatatatacatatatgtatatatacatatgtacatatatacatatatacacat

SEQ ID NO: 38344 - DNA, 77 bp, Homo sapiens
tatatatcgcatatatccgtatatatatgtgtatatatgcatatatacgtatatatatgtgtatatatgcatatata

SEQ ID NO: 38345 - DNA, 139 bp, Homo sapiens
tatatgtgtatatatgcatatatacgtatatatacatatatacgtatatatatgtgtatatatgcatatatacgtatatatatgtgtatatatgcatatatacgtatatatatgtgtatatatatgtgtatatatatat

SEQ ID NO: 38346 - DNA, 95 bp, Homo sapiens; identical to SEQ ID NO: 68

SEQ ID NO: 38347 - DNA, 93 bp, Homo sapiens; identical to SEQ ID NO: 69

SEQ ID NO: 38348 - DNA, 72 bp, Homo sapiens
gtgtgtatatatgtatgtgtatttgtatatgtgattacttgcatgtttatttacatacatttatatgcatac

SEQ ID NO: 38349 - DNA, 69 bp, Homo sapiens
gggggcacggaggaggggtggcatcagtgattcaagactatctctctcactctttttaatgcctcctcc

SEQ ID NO: 38350 - DNA, 79 bp, Homo sapiens
atcttatgagctagatacttttattattttgtagcaggggaaactgaggcagaggaaagttaaatagcttgcccaagat

SEQ ID NO: 38351 - DNA, 95 bp, Homo sapiens; identical to SEQ ID NO: 68

SEQ ID NO: 38352 - DNA, 93 bp, Homo sapiens; identical to SEQ ID NO: 69

SEQ ID NO: 38353 - DNA, 104 bp, Homo sapiens
gcatgtgtgcatttcatgcaaagatgcctgtagaaatacagtttctttttttttattattatactttaagttctggggtacatgtgcagaatgtgcaggtttgt

SEQ ID NO: 38354 - DNA, 79 bp, Homo sapiens
ggcattgatgttcatcaagaatattggcctgaagtttttttgttgtatctctgccaggttttgatatcacaatgatgct

SEQ ID NO: 38355 - DNA, 104 bp, Homo sapiens
tggatatatgggctctcttttggttccatatgaaatttaaagtagttttttctaattctgtgaggaaggtcaatggtagcttaatggggatagcactgaatcta

SEQ ID NO: 38356 - DNA, 58 bp, Homo sapiens
tgagccagagtctcgctctgtcacccaggctggagtgcagtggtatgaaattggctca

SEQ ID NO: 38357 - DNA, 137 bp, Homo sapiens
tctgtctctctctctctacattatacatgtgtatatatgtgtgtgtatatatacacatatatataactttatatatatgtatagtgtgtcaaaggcacagacaaaatatatatatctgtatatatgcaatatatata

SEQ ID NO: 38358 - DNA, 87 bp, Homo sapiens
ctcattttccgttgagacttcctgttctccagtaattgcttggtggggcaagaggcttcagttccaagtcagcaaatgggatctgag

SEQ ID NO: 38359 - DNA, 65 bp, Homo sapiens
agctgtatttgtgtgtatgtacatgtgtgtttgttacatgtgtatatatatttgtgaaaactgtt

SEQ ID NO: 38360 - DNA, 91 bp, Homo sapiens
gttgtgaatattatcacatggaaattaaaaaagatgtcttgacagaagatacagagagggtcagacagcttattttagccatgtgatcagc

SEQ ID NO: 38361 - DNA, 70 bp, Homo sapiens
acagtctgtgtgtgagtgtgtgtgtgcatggatgctggagcatgtgtgaaggcaccgatgcccagactgt

SEQ ID NO: 38362 - DNA, 101 bp, Homo sapiens
actggttagagtgctatagatatgtcagctggttaaagttgtttgataatgttccaactttctacatttttattgatattctgtctagtttttctatcagt

SEQ ID NO: 38363 - DNA, 102 bp, Homo sapiens
tttgaaagctcattatttattgattcaatttcttaatagatatagcctaattagattgtctatttcttattgtgtgagttttggtgggccctgtctttcaga

SEQ ID NO: 38364 - DNA, 118 bp, Homo sapiens
tatgtagctgtgaaggcaatcatatagtttttcttctttagtctgagaatacggtaaaatatattgatttttagatattgaaataatcttatgttgggatattccttacttggtcata

SEQ ID NO: 38365 - DNA, 84 bp, Homo sapiens
tgtacgtatatgtatgtgtatatatgtgtatatgtatacatttgtgtatatatgtgtgtatatatatatatacacacacacaca

SEQ ID NO: 38366 - DNA, 168 bp, Homo sapiens
accatgtgtctctgtgtgtgtgtgtgtgttaattcaaccatgtgtctatgtgtgtgtatatatgtatatatatgtacaaccatgtgtctgtgtgtgtatatatgtgtatatatgcatatatgtatgtatatatgtatatgtatatatgtatgtatatgtatatgtata

SEQ ID NO: 38367 - DNA, 75 bp, Homo sapiens
gcctctaaatcttcatgtaatatatatgtgcgtgtgtgtgtatgtgtgcatgtgtatgtgaattagaagaaaggc

SEQ ID NO: 38368 - DNA, 89 bp, Homo sapiens
cactaggaagcacccacagagttcacacaacctgtgttttaagtttcgtaagataccaggctgtgtgtgtgtgtgtgtgtgtgtgtgtg

SEQ ID NO: 38369 - DNA, 116 bp, Homo sapiens
gaatacaatttatcccatgataggatgcacaataattatgatggagtttcaagtcaataatactgatttagttctcctgataggaaagattcagttctatgggagagattctggtc

SEQ ID NO: 38370 - DNA, 58 bp, Homo sapiens
tgagccagagtctcgctctgtcacccaggctggagtgcagtgttacgatctcggttca

SEQ ID NO: 38371 - DNA, 114 bp, Homo sapiens
tatatatacataaatgctttatatatatatgtgtgtgtgtgtatgtatatgtatatgtatatatatgtacatatatacgtatacatatatacatatatacgtatatatatacat

SEQ ID NO: 38372 - DNA, 87 bp, Homo sapiens
gctatcagagcgggaaagtagaggagggcatcttaggaagggtaagaaaggttcttttttttttgaaatggagactcgctctgtcgc

SEQ ID NO: 38373 - DNA, 85 bp, Homo sapiens
atgtatggtttaatatacatataagtggatacaggtatatatgtgtatatattatgtatccatatatgtaatttattgatatata

SEQ ID NO: 38374 - DNA, 102 bp, Homo sapiens
gtgcacaggtggagcattttggcactgcatatatactctaacgtgtatgtctttttatatatactatatgtagcctgccagagctattttcactctgggaac

SEQ ID NO: 38375 - DNA, 95 bp, Homo sapiens
tatacatatacatatatgtatatgtgtgtgtgtgtatatatatatatatacacacacacacacacatatatatgtatatatatacacacatacac

SEQ ID NO: 38376 - DNA, 74 bp, Homo sapiens
atatacatatatatgtgtgtgtgtgtgtgtatatatatatatatacacacacacacatatacatatatgtatat

SEQ ID NO: 38377 - DNA, 65 bp, Homo sapiens
gtgtgtgtgtgtatatatatatatatataaatgaagtgtatatatgtgtgtgtgtgtatatatat

SEQ ID NO: 38378 - DNA, 132 bp, Homo sapiens
atggaaggcatatatatatacatatatatatatgtatttatatatgtatatatatgtatatatatacacacacatatatgtgtgtgtatacatgtatttgtgtatatatgcttgtatatatatgtatatatg

SEQ ID NO: 38379 - DNA, 110 bp, Homo sapiens
gaaaatgtgctttgttcactttctgtctaatgtggtgaaatgcatgatagatttttgaatgtctatttgtaattctcagattatatccaatttgttcataataaattttc

SEQ ID NO: 38380 - DNA, 120 bp, Homo sapiens
agagagagctgtcacaacatgacctattttcatttaaaactaactaaacatcactggagacagtgagcaaaatgagttgtaatgtcctgtggagagggtcagtgtttgtgggcttttttt

SEQ ID NO: 38381 - DNA, 95 bp, Homo sapiens; identical to SEQ ID NO: 68

SEQ ID NO: 38382 - DNA, 93 bp, Homo sapiens; identical to SEQ ID NO: 69

SEQ ID NO: 38383 - DNA, 100 bp, Homo sapiens
gaagaggtccttcacgtcccttctaagttggattcctaagtattttattttctttgaagcaattgtgaatgggagttcactcatgatttgggtctctgtc

SEQ ID NO: 38384 - DNA, 58 bp, Homo sapiens
tgagacggagtctcgcactgtcactcaggctggactgcagtggtgtgatctcggctca

SEQ ID NO: 38385 - DNA, 85 bp, Homo sapiens
actaagtgtaaggcttttgtgcctgctggcatcactgcagtgatggcttcaatttttttttcttgtaatagtccttacactgagt

SEQ ID NO: 38386 - DNA, 87 bp, Homo sapiens
gtgctcttttttggttccatatgaaatttaaagtaattttttctaattctttgaagaaagtcaatggtagcttgatgggaatagcac

SEQ ID NO: 38387 - DNA, 95 bp, Homo sapiens; identical to SEQ ID NO: 68

SEQ ID NO: 38388 - DNA, 93 bp, Homo sapiens; identical to SEQ ID NO: 69

SEQ ID NO: 38389 - DNA, 84 bp, Homo sapiens
gacaggggaggagttggggacattgagactgttggaacgtcttggaaacaatgacccactcagtgtctgaattcattttctgtc

SEQ ID NO: 38390 - DNA, 95 bp, Homo sapiens; identical to SEQ ID NO: 68

SEQ ID NO: 38391 - DNA, 93 bp, Homo sapiens; identical to SEQ ID NO: 69

SEQ ID NO: 38392 - DNA, 141 bp, Homo sapiens
tgggtgacagagcaaaactccgtctcaaaaaaatttttaaaaaaaaaagaaatttttttttttgagacggagtctcgctctgtcgctcaggctggagtgcagtggtgcaatctcagctcactgcaacctccgcctcctggg

SEQ ID NO: 38393 - DNA, 90 bp, Homo sapiens
atggcctggagtttgaactgtgccgctgctttgctgctgtcaccctggcaggctgcctcagagcctctgcagactcctactcctatccat

SEQ ID NO: 38394 - DNA, 107 bp, Homo sapiens
aatatcaacttttatgatgatgcaataatatattaatttttttccttgagggttcacctaattatagtaggacataaatctttatatgcatttatttagttgatgtt

SEQ ID NO: 38395 - DNA, 118 bp, Homo sapiens
aagccaactgggcctagaattctcatagtgggaaggttgttaactaaaaattcaatttatttgatagatatgagctatttgagttatccaattcttcttgagtgaggtttagtagttt

SEQ ID NO: 38396 - DNA, 69 bp, Homo sapiens
cagatgagctgagccggccacatctttacactgcacacgtgtgtctcagtgtgtggcaaatagctgctg

SEQ ID NO: 38397 - DNA, 95 bp, Homo sapiens; identical to SEQ ID NO: 68

SEQ ID NO: 38398 - DNA, 93 bp, Homo sapiens; identical to SEQ ID NO: 69

SEQ ID NO: 38399 - DNA, 115 bp, Homo sapiens
taggtttgtcttggcaatgcaggctcttttttggttccatatgaaatttaaagtagttttttccaattctgcgaagaaagtcattggtagcttgatgcagatggcattgaatcta

SEQ ID NO: 38400 - DNA, 100 bp, Homo sapiens
atcatcacttaacagcagctaattatagtgctgcataatatcttattttcatctgtatgtttacatagtttttaattagctgtagttataattttttgat

SEQ ID NO: 38401 - DNA, 68 bp, Homo sapiens
tgaaccatatgaaaatgcaatttttgtagttcaaaaatggctgaatcttggcaatttcatgtggttca

SEQ ID NO: 38402 - DNA, 100 bp, Homo sapiens
gttttaatttctctctgtgtatttgatttttatttttagatttcacatgtgagatcatacagtacagaagtcttcttacatacaaatgaaatgataaaac

SEQ ID NO: 38403 - DNA, 101 bp, Homo sapiens
tctggaggaaatttgaaaaccgaagtccaacagatttgagtggtgtatattttttcttttatcctcttttcattgttcttggctgacaagttgcctctggg

SEQ ID NO: 38404 - DNA, 94 bp, Homo sapiens
caaaaaattagcagggtgaggtgatgtgcacctgtagtcccagccagctacttgggaggctgaggtagaagaatcatctgagcctgggaagttg

SEQ ID NO: 38405 - DNA, 90 bp, Homo sapiens
gtattttacatgggtgtcatttaaagcatatgtatgtatgtatgtatgtatgcatgtgcatatatgtatagatacagagattatattgtt

SEQ ID NO: 38406 - DNA, 56 bp, Homo sapiens
tgagccagtctcactctgtcacccaggctggagtgcaatggtgcaatctcggctca

SEQ ID NO: 38407 - DNA, 66 bp, Homo sapiens
ggtaagtatatatatatgtgtgtgtgtataaatatatatatgtgtgtgtgtgtatatatatatatc

SEQ ID NO: 38408 - DNA, 86 bp, Homo sapiens
cacagaggccacttggccagtggtacaggaccttactcctcacttgcagtgctgagcagagtttgtgtctctgtgtctctgccagg

SEQ ID NO: 38409 - DNA, 76 bp, Homo sapiens
ggaacactcagtgaagagggagagcagaggagaacacgggttttccgactgcaactctggctctgtctgtgcttcc

SEQ ID NO: 38410 - DNA, 122 bp, Homo sapiens
cactcatctgtgtttcctggtgcttagctcaccgagttctctgttgtgctgaagattatgtatttatttatttatttttgagacggagtcttgctctgttgcccaggctggagtgcagtgag

SEQ ID NO: 38411 - DNA, 87 bp, Homo sapiens
ttgtttgttgtttagagacaggctctcactcactctgttgcccaggctggagtgcagtggcatgatcttggctcaccgcagcctcaa

SEQ ID NO: 38412 - DNA, 110 bp, Homo sapiens
caaagtgctgggattacaggcgtgagccaccgtgcctggctgtgattattttttattataagaactaacggccgggcgcggtggctcacgcctgtaatcccagcactttg

SEQ ID NO: 38413 - DNA, 75 bp, Homo sapiens
gtaaagtgctagaagttgttttactttgtgggtggttcttggatgatttcatttgtattaactttcggcctttgc

SEQ ID NO: 38414 - DNA, 56 bp, Homo sapiens
gagacggagtctcgctctgtcaccctggctggagtgccgtggcgtgatctcggctc

SEQ ID NO: 38415 - DNA, 85 bp, Homo sapiens
tatggtttgttggaccagccattgattggcttcaacagttttgttactggtctgggacaagatagtgagctggcatcagaatata

SEQ ID NO: 38416 - DNA, 125 bp, Homo sapiens
ctccgcgtggtcccgtgcctccccgacaccatggccctggctgaggtagtagtttgtgctgttggtcgggttgtgacattgcccgctgtggagataactgcgcaagctactgccttgctagtgct

SEQ ID NO: 38417 - DNA, 116 bp, Homo sapiens
ttgatatcttttcagaacttttccacaacacagatgtgtgtatttttaaaaattttgtttttaacaaaaataagatcacgctgtaaatgttttgcaaggttttgttttgttttcaa

SEQ ID NO: 38418 - DNA, 110 bp, Homo sapiens
atgagggagtatggggataaaagccaacccactgaggcttctcacgaggaccaaacagtgcctctcagtgcctctttggccatgggtttctgtctgcagagtctcatcat

SEQ ID NO: 38419 - DNA, 74 bp, Homo sapiens
ggggatcacaattcgacctgagatttggcagaggacacaaatccaaaccgtatcagtcagtgtctgtcttcccc

SEQ ID NO: 38420 - DNA, 86 bp, Homo sapiens
ctcagaaagctctgaagaagctctcagcaaaggacggggagtcattgacactctgtctgccagcagatgatgtgctttagagagag

SEQ ID NO: 38421 - DNA, 71 bp, Homo sapiens
agcacactcagggattctgtcccctgcctcaggctgagtcccgcagtcaaactctgtccctctgtgaggct

SEQ ID NO: 38422 - DNA, 94 bp, Homo sapiens
gtgctgtgggccacattatcaaattgtgattaagtgaatacattgggatgcttatgtctatttatattaatcagtttaagatgtgcctattcat

SEQ ID NO: 38423 - DNA, 118 bp, Homo sapiens
tgctttgatcccaattacatatactgacacatgaggcagagcaagatggttgaatagaaacctacaccatttatggtctggcgcagtggttcatgcctgtaatcctagcactctggga

SEQ ID NO: 38424 - DNA, 117 bp, Homo sapiens
ggtaacctcacacggtggaaagaaggtgacagagctttctggggtcccttttttttttttttttttttgagatggaatctcactctgtcactcaggctggagtgtagtggcatgatc

SEQ ID NO: 38425 - DNA, 104 bp, Homo sapiens
ctaagatcacaagccagtaagtggtagtacttgagttcagacccaggcagtctggctccagggttcatagtctaattattatacatactgcctgcaagttttag

SEQ ID NO: 38426 - DNA, 101 bp, Homo sapiens
ggtttaacacgttgttgtcaccatcttgaatttctttatcattttatggttgaacgtatgttgtataaatgaagtctaatgggacaacagatcatatgact

SEQ ID NO: 38427 - DNA, 109 bp, Homo sapiens
tgtatatatacataaatagacacaaatacagatggtatcttatattttttagtattttttctaaaacacaatggtattactgtgagtgttctgtttatctattggtgca

SEQ ID NO: 38428 - DNA, 72 bp, Homo sapiens
tcaaatgctgtgttgtctgtcagttaccagtggccgctggctgactagaaaataaaaccaacatgccaatga

SEQ ID NO: 38429 - DNA, 95 bp, Homo sapiens; identical to SEQ ID NO: 580

SEQ ID NO: 38430 - DNA, 93 bp, Homo sapiens; identical to SEQ ID NO: 69

SEQ ID NO: 38431 - DNA, 93 bp, Homo sapiens
ctgcctgcaaggcagccggctctccctgacagggtcagcagctttactcactctctctgggtgtgagccccatgcacagtatcagcaggacag

SEQ ID NO: 38432 - DNA, 147 bp, Homo sapiens
tgtatacatatatacacgtgtatatatgtatatacatatgtatacacgtgtatatatgtatatacatatgtatacacgtgtatatatgtatatacatatgtatacacgtgtatatatgtatatacatatgtatacatgtatgcatat

SEQ ID NO: 38433 - DNA, 68 bp, Homo sapiens
tatacatgtatatacatacatatatacacgtgtatacatatgtatacatgtatatacatacatatata

SEQ ID NO: 38434 - DNA, 91 bp, Homo sapiens
tatatatatatatacacatatatatacacacacatgtatatatgcatttatatatacacatgtatatatgtgtatatgtatatatacatgt

SEQ ID NO: 38435 - DNA, 95 bp, Homo sapiens; identical to SEQ ID NO: 580

SEQ ID NO: 38436 - DNA, 93 bp, Homo sapiens; identical to SEQ ID NO: 69

SEQ ID NO: 38437 - DNA, 101 bp, Homo sapiens; identical to SEQ ID NO: 24700

SEQ ID NO: 38438 - DNA, 72 bp, Homo sapiens
tttaagtggatagttaagttccatctctagcctccaggctagataaaggtagtttagcgaaggccattttga

SEQ ID NO: 38439 - DNA, 58 bp, Homo sapiens
tgagatagtgtctcactctgtcacccaggccggagtgcagtagtgcaatcacggctca

SEQ ID NO: 38440 - DNA, 117 bp, Homo sapiens
tgtgtctttatatacatatgtgtgtatatatataatacacacatatatgtatatatatatacacatatatgtgtatttatatatatatatccatatatatatatatatatatatgtg

SEQ ID NO: 38441 - DNA, 62 bp, Homo sapiens
tgagacagagtctcactctctctctcgcccacgctggagtgcagtggtgggatcttggctca

SEQ ID NO: 38442 - DNA, 75 bp, Homo sapiens
tgctctctctcagttcccatatggtttttctttttcaatatgaaatttggagtggggtaagggcagggacgagca

SEQ ID NO: 38443 - DNA, 72 bp, Homo sapiens
gcaacatactgaacattcaaagcagactttgtatgccgtggcaaaaccacagtctgtctggacagtagtagt

SEQ ID NO: 38444 - DNA, 99 bp, Homo sapiens
gccggtttagctgttggcttatgtagtggtttttttttttttttttttttttttaaatcataccaggaagtacactccatgagaccaggagccctgtgt

SEQ ID NO: 38445 - DNA, 114 bp, Homo sapiens
ccgagtagctgggattacaggcgcccataaccacgcccagctaattttcatatttttagtagagatggagtttcactatgtgggtcatgctggtgtcgaactcctggcctcagg

SEQ ID NO: 38446 - DNA, 60 bp, Homo sapiens
ttgagacagggtctcactctgtcacccaggctggagtgcagtggtgtgatctcggctcag

SEQ ID NO: 38447 - DNA, 58 bp, Homo sapiens; identical to SEQ ID NO: 5055

SEQ ID NO: 38448 - DNA, 89 bp, Homo sapiens
ttttgtttttctccttccttccatgatgaacaggttaattggcacaggccgagttctctctgtctctctggattattaagggtacaaag

SEQ ID NO: 38449 - DNA, 107 bp, Homo sapiens
tgagccaccatgcctggtctcttcctgtggattttaagaaatagaactcattttgttctaattttaatggaaggatgcacaagaaactagtaatatttgttgtctca

SEQ ID NO: 38450 - DNA, 84 bp, Homo sapiens
gctggagttacaggtgtgaaccaccgcgccctgcctgtttgtttattttttaaatagacacagggtctcactctgttgcccagt

SEQ ID NO: 38451 - DNA, 66 bp, Homo sapiens
tgccaggtgtgcctgtggtcccagctacttgagaggctgaggtaggaggatcacttgagcctggga

SEQ ID NO: 38452 - DNA, 68 bp, Homo sapiens
tagacacagctggaactgggggcttgagtgtcccaggactcagtccctgtctccttctctgatgtttg

SEQ ID NO: 38453 - DNA, 119 bp, Homo sapiens
gtgaaatgtattgagttgaaccaaaaagaacataattacgagctgatagctgctgagttctgtgtcagattctctgtgtgtttcatctcattgttcttaaagccgaatgtcattgtcac

SEQ ID NO: 38454 - DNA, 114 bp, Homo sapiens
tacaatagaactactggggttgaattttaagcaggacttggacgaccatctttactttcactcagactctgtctgttctgccatttgtaattttacacctaacctgttattgta

SEQ ID NO: 38455 - DNA, 101 bp, Homo sapiens
gcagaaccagaggtaggagcattatgaaagataagagaagacagtctcaagagaggagattggatggcgttgtttggatgctaaacagtcaaggtggatgt

SEQ ID NO: 38456 - DNA, 112 bp, Homo sapiens
tagtggggcatggtggcttgcacctgtagtcccagctgcatgggaggctgaggtaggaggatcacttgagcccaagaggcagaggttgcagtaagccgagattgcaccactg

SEQ ID NO: 38457 - DNA, 105 bp, Homo sapiens
tcctgcctcagcctcccgagttgctgggactacaggcgtgcgccaccacacccaactaatgtttgtatttttagtagagacggagtttcaccatgttggctagga

SEQ ID NO: 38458 - DNA, 113 bp, Homo sapiens
tcagccactggtgagagtaaagtgggaaatcccctcttttacttaatatttgatttattttattattctattttatttttgagacagtatctcactctgttacccaggctaga

SEQ ID NO: 38459 - DNA, 100 bp, Homo sapiens
gcttaactgacttgctttagctgagcatttaggcatctctagagctctaggactatcagagcctcagtctgtggctcagctgtggcagttcttccactgc

SEQ ID NO: 38460 - DNA, 69 bp, Homo sapiens
ctgagtctccctctgtcacggtaggtcgtgcctggatggagcctgtgatgctctgggggtcttacttag

SEQ ID NO: 38461 - DNA, 112 bp, Homo sapiens
tgcaggataacagtaattctagtctcatctgccgcagagatagttgtttttttttttcttttgaggcgagctctcactctgtcacccagactggagtgcactggcacaagca

SEQ ID NO: 38462 - DNA, 80 bp, Homo sapiens
ttgggtttattttattttattttatttttagacagagtctcactctgtctccaggctggagtgcagtgacgtaatcttgg

SEQ ID NO: 38463 - DNA, 116 bp, Homo sapiens
ccattaggcatccagaaagggggctgatggaaatggattcttcttcttcttcttcttcttttttttttttttttgagacagagtctcagtctgtcgcccaggctggagtgcaatgg

SEQ ID NO: 38464 - DNA, 90 bp, Homo sapiens
atcatcaagaacataaagaattattcaactggtgtgatgtcatgacttgtgaatttcatgctgagaccaaataagtttgtttatgatggt

SEQ ID NO: 38465 - DNA, 99 bp, Homo sapiens
tctcttctgaggagccagccttacagagcggtagaaagaagtcttcttataaacagggacttggttgttttgttcactgctatatctctagaagttaga

SEQ ID NO: 38466 - DNA, 79 bp, Homo sapiens
tgactggcagcggagtctctgtctgcctctgttttggtctttttatttcatctggcccacagtctctccctgccagcca

SEQ ID NO: 38467 - DNA, 85 bp, Homo sapiens
tgattgacttaatggtatgagttctgtctctctctgtagggtgtaggtttcttgaggacagcaatcctactgaagtcctaaatca

SEQ ID NO: 38468 - DNA, 68 bp, Homo sapiens
ggttgggggataggagtgaaagagagacatttcactgtttactctttgatactttttgaattttgacc

SEQ ID NO: 38469 - DNA, 126 bp, Homo sapiens
cacatgtatcccagaacatacatatatatatgtgtatatatatatgtatatatatacacatgtatatgtgtgtgtgtgtatatatatgtgtgtatatatatgtgtgtatatatatatatatgcatg

SEQ ID NO: 38470 - DNA, 106 bp, Homo sapiens
ctaggattacaggtgtgagccactagtgcccagcttgaatttttctttattttggaacatatttgaaagttgccaaagccacttctgagcaaatttgtgtctctgg

SEQ ID NO: 38471 - DNA, 58 bp, Homo sapiens; identical to SEQ ID NO: 605

SEQ ID NO: 38472 - DNA, 67 bp, Homo sapiens
acacacatattttatatatatgtgtgtatatatacactatatacacatattttatatgtatgtgtgt

SEQ ID NO: 38473 - DNA, 100 bp, Homo sapiens
tggatgactatatatacatacatacatatatatgtatatatatacatatatatgtatatatatatacatatatatatgtgtgtgtgtatatatatagaca

SEQ ID NO: 38474 - DNA, 117 bp, Homo sapiens
atttctcaacataaggtatttcagcttctgttacaatgtgatataatgaaaagatcagtgtctttttatttataagcaaagctgaacgagatgagctggtatctttttctgtgaaat

SEQ ID NO: 38475 - DNA, 60 bp, Homo sapiens
ttgagacagagtctcactctgtcgcccaggctggagtgcagtggtgtgatctctgctcaa

SEQ ID NO: 38476 - DNA, 58 bp, Homo sapiens; identical to SEQ ID NO: 14879

SEQ ID NO: 38477 - DNA, 84 bp, Homo sapiens
gagaatattaactagagagttgttttattttagtttttctatgattccctaaaatatctctgctccttctgggaaattgttctc

SEQ ID NO: 38478 - DNA, 89 bp, Homo sapiens
ctgggattacaagcgtgagccaccgtgccctgcaagcccagctaatttttgtattttttgtagagatggagtttcaccatgttccccag

SEQ ID NO: 38479 - DNA, 104 bp, Homo sapiens
cagctgtggtgcaaatcttcaaatgacgttgagttgagcagtcctttcaaattactctccctcactgtcagtttagaagatttgggaataattgtataaagctg

SEQ ID NO: 38480 - DNA, 88 bp, Homo sapiens
gctcacattgccttcgaagatgtagagctttcctctcagactctctgtacctggcagggaacagtgcctcattttcaagggcccgagt

SEQ ID NO: 38481 - DNA, 66 bp, Homo sapiens
ggtcagagtgtgacagaagagaggcagctctacaccccttgcttgcaattctgagcattctgtagc

SEQ ID NO: 38482 - DNA, 85 bp, Homo sapiens
ggatatctatttgttatttgttgttgttgcttgcaagacacaagtaagacagcagtgattaatataacagcagaaaaagagatcc

SEQ ID NO: 38483 - DNA, 82 bp, Homo sapiens
tatatacatatatgtgagtatatgtatatgtgtatacaaatatgcacatatatttgtatatgtatatgtatatacacatata

SEQ ID NO: 38484 - DNA, 88 bp, Homo sapiens
atgtgaaatatatatatataaatgtatatgtgtgtatatatgtatatatgtgtgtatatatgtatatacgtatatatacacatatata

SEQ ID NO: 38485 - DNA, 62 bp, Homo sapiens
ttgagatggagtctcactctgtcacccaggctggagtgcagagtgcaatggcacgatctcag

SEQ ID NO: 38486 - DNA, 119 bp, Homo sapiens
atgaatttattgactgtttaaactgtaggcattagctccccaactcacatcacagaaatctgaaagcagaactcttgtttcctgggaggatggaaaaacagaacagaaatggagcttat

SEQ ID NO: 38487 - DNA, 117 bp, Homo sapiens
ccagatttgttgcttagcagagtcacctctaaggaaaaaaataaactctcacagtctgtgcaaatgaagacatttatttatttaggagatggggtcttgcactgtcaaccagactgg

SEQ ID NO: 38488 - DNA, 106 bp, Homo sapiens
cttcccatcttgacactggtagagagagagattgagagattgaagggggagaaatcagttctgattttctagtttctaaacactgcagaagaacaaagtagagaag

SEQ ID NO: 38489 - DNA, 58 bp, Homo sapiens
tgagacagagtctcactctgtcgcccaggctggagtgcagtggcgcgatctctgctca

SEQ ID NO: 38490 - DNA, 87 bp, Homo sapiens
aggatgcaaagacaaagagtacatatatatttatatatgtagtgtactgtatatatgcatgtatgtatgtatgtatgtatgtatctt

SEQ ID NO: 38491 - DNA, 111 bp, Homo sapiens
agctgcgaccaacaacagcaaagaacagtcctataaaatttatctcccacaaaaataaactatatatataaaaattttatgatgttcttactgttccattggccacaagct

SEQ ID NO: 38492 - DNA, 107 bp, Homo sapiens
ccagctttgttctttttggttaggattgtcttgtctatatgggctcttttttggttccatatgaaatttaaagtagttttttctaattctgtgaagaaagtcaatgg

SEQ ID NO: 38493 - DNA, 81 bp, Homo sapiens
gagcttgctagcctggtgttgggagtggaatggaggcgttgtttgctgttctggttcagtctcagtctcagataggtgctc

SEQ ID NO: 38494 - DNA, 86 bp, Homo sapiens
gttgtttttccctcagcgggataaggctttcttttttttttttttttcctgaggaaagaaaaagagagaatggtggggaagttgac

SEQ ID NO: 38495 - DNA, 109 bp, Homo sapiens
gcataaatctaaagggttctgtgctctgtgagaggcagttttgtggagaagacaatcattctctctgtctctcagttggatctgttttggaccccagggggtgagttgc

SEQ ID NO: 38496 - DNA, 119 bp, Homo sapiens
tgtgtatatataatgtatacatatttatgtgtatatatgtgtatatataatatatacatatttatgtgtatatgtgtatatataatatatacatatttatgtgtatatataatatatac

SEQ ID NO: 38497 - DNA, 107 bp, Homo sapiens
tatataacatatacatatatgtgtatatataatatacatatatgtgtatatataatatatacatatgtgtatatataatatagacacatatgtgtatatataatata

SEQ ID NO: 38498 - DNA, 89 bp, Homo sapiens
tggatgacaggcatgagccaacgccctagccttttttttttttaactttatttatttatttattttggcagggtctcactctgtcacca

SEQ ID NO: 38499 - DNA, 87 bp, Homo sapiens
gacattgagataaatctataagaagagaagaaatcaaggagcatgtaatttttttttttttttttttgagaggagtctcgctctgtc

SEQ ID NO: 38500 - DNA, 109 bp, Homo sapiens
gagatttataaatatttgagaaattaagagctttctgttctcagtgatctgtcagagatgagactgagaactactaaggatgctgtgatttatacatttgtcttaactc

SEQ ID NO: 38501 - DNA, 83 bp, Homo sapiens
tgagagagggtctcactctgtcacccgggctaggagctcactgcagcctccagctcccagactctggaaatcctcccacctca

SEQ ID NO: 38502 - DNA, 118 bp, Homo sapiens
ttaatagctgaaaatctctgataatgaattagagtgtgtagtaaacatgagaattagttatattatcttatttttaaaattcaagactaagaacttcagagaatgaagagtctattaa

SEQ ID NO: 38503 - DNA, 112 bp, Homo sapiens
cctcagtccctaaaacagtccctgacgcatagtagtgtccagtgtgtgtgcacacacacacacacatgcacacacaatgatggaatgagcgtgtgaagagggtcgtctcagg

SEQ ID NO: 38504 - DNA, 58 bp, Homo sapiens
tgagatagactctcactctgtcacccaggctggggtgcagtggtgtgatcctggatca

SEQ ID NO: 38505 - DNA, 77 bp, Homo sapiens
agaagctgtggatgctctctctcacaccctctaaattaatgatggcagaggatctggcatccttttcctaagcttct

SEQ ID NO: 38506 - DNA, 72 bp, Homo sapiens
tgtcccaaactgaagagtgagaccaccctactccactgcttctgcaggtttccttctccagtgatgggttca

SEQ ID NO: 38507 - DNA, 119 bp, Homo sapiens
gtggcttgaatctcacttgggtctctaagtgggtgtgggatggtaataagatgcatttgtaatcatatgtacctgtagtgctcaggtagatggtgtaggtaatcacagtgctcttttcc

SEQ ID NO: 38508 - DNA, 83 bp, Homo sapiens
tgtcaataggttccataatagagtctcattctgtcagtgtttcacctagcaatcagctcttctatgtggattaccctttggca

SEQ ID NO: 38509 - DNA, 82 bp, Homo sapiens
gtatatatgtatatgtatgtgtgtgtgtgtgtatatatatatatatatatatatatatatatatatatatatatatatatat

SEQ ID NO: 38510 - DNA, 63 bp, Homo sapiens
gtctggatagagtgaggtttttttttttttttccgagacggagtctcgctgtgtcacccaggc

SEQ ID NO: 38511 - DNA, 74 bp, Homo sapiens
atgtgtgtatctatgtatctgtatatatgtgtatgtgtttatatatatatatgcgtgtgtgtatatatatgtat

SEQ ID NO: 38512 - DNA, 106 bp, Homo sapiens
tggacatggtggtgcattcctgcagtcctagctactaagggggctgaggtaagaggatcacttgggcccagggaggtcaaggttgcagtgagtcatgatcacgcca

SEQ ID NO: 38513 - DNA, 82 bp, Homo sapiens
gttctttcaactgacatgtagttttctggtgcatttatttttaattaaaagcaccttagaaaaatgggtgtttttaaagtgc

SEQ ID NO: 38514 - DNA, 88 bp, Homo sapiens
ggtatcatcatcatcttcttcatcttcatcattctcagttcaagatcatactgggccaagagacaggaactgatgggcagtggatgcc

SEQ ID NO: 38515 - DNA, 99 bp, Homo sapiens
gtccaaattacgtagtctctgtgccttatttatttatttatttaacctataaatgaatgatagaaataatacccccttccacagggttgttgtgtggat

SEQ ID NO: 38516 - DNA, 62 bp, Homo sapiens
gacactctgactgtctccattgcctaagggccttggagtctaaagagcagtgccagagaatc

SEQ ID NO: 38517 - DNA, 70 bp, Homo sapiens
gggtgctgtgagccgccgttcccggcctttttttttttttttttagagataaggtctggctctgtcaccc

SEQ ID NO: 38518 - DNA, 100 bp, Homo sapiens
ggtactgtcaacattgctgctgctctggggctgggggctgctatcactccttctctgtctttgatgcttctcccagtcagggttaatattgagtgctggc

SEQ ID NO: 38519 - DNA, 107 bp, Homo sapiens
gtgtggtggcctatgcctgtagtccagtgactcaagaggctgaggtggaaggatcacttgagcccaggagtttgaggctgcagtgagctaggatggcaacactgcac

SEQ ID NO: 38520 - DNA, 79 bp, Homo sapiens
gcagattaagaagtatcatcaagtgcaattacgttgatttgtaattagagtactttattgatgatattccccaaagtgc

SEQ ID NO: 38521 - DNA, 108 bp, Homo sapiens
gatcaggtgtggagttgttaaatatttggtctaattcttgtttatttctataagtcattttattgaaaagcagcctgttttgaaagatgtgtttttctgccctggatc

SEQ ID NO: 38522 - DNA, 70 bp, Homo sapiens
cacccatgcctgagcagctactctgctaagactctatgtagctctgtctgtcagactgaaggctctggtg

SEQ ID NO: 38523 - DNA, 68 bp, Homo sapiens
gtttgggttttgggtttgttttttttgttttttttttttgagacggagtctcactctgtcacccaggc

SEQ ID NO: 38524 - DNA, 82 bp, Homo sapiens
ggtacagtgtgaccctctcagagtctctgggactcctaaagaggcctccaagttagggtcactgggagagggaacctgtgac

SEQ ID NO: 38525 - DNA, 98 bp, Homo sapiens
acaaaaagacaggatcttggcccctcatggacacagcatatagaaaaagactcagtgtgtctgtctgtggcttgggcagaatcattctagaagtttgt

SEQ ID NO: 38526 - DNA, 97 bp, Homo sapiens; identical to SEQ ID NO: 1307

SEQ ID NO: 38527 - DNA, 88 bp, Homo sapiens; identical to SEQ ID NO: 1308

SEQ ID NO: 38528 - DNA, 81 bp, Homo sapiens; identical to SEQ ID NO: 1309

SEQ ID NO: 38529 - DNA, 77 bp, Homo sapiens; identical to SEQ ID NO: 1310

SEQ ID NO: 38530 - DNA, 99 bp, Homo sapiens
tattttccatgagactccagaaaaggttgtaaagttgtttcattcaggggtctttgaaaaaaatagcagctcattcctttgccagttgaatgttgagtg

SEQ ID NO: 38531 - DNA, 141 bp, Homo sapiens
acagctacactgtgtgtgtatatatatatatacacacatatatttgtatatacatttgtatatacatttgtatatgtgtatatatgtatatacaaatatatgtatatatgtatacatatatgtatatatatacacaaatac

SEQ ID NO: 38532 - DNA, 95 bp, Homo sapiens; identical to SEQ ID NO: 68

SEQ ID NO: 38533 - DNA, 93 bp, Homo sapiens; identical to SEQ ID NO: 69

SEQ ID NO: 38534 - DNA, 95 bp, Homo sapiens; identical to SEQ ID NO: 68

SEQ ID NO: 38535 - DNA, 93 bp, Homo sapiens; identical to SEQ ID NO: 69

SEQ ID NO: 38536 - DNA, 93 bp, Homo sapiens; identical to SEQ ID NO: 69

SEQ ID NO: 38537 - DNA, 110 bp, Homo sapiens
gtttggagcacttggggaaaaaagaccgtattggaagactctttgttaatgtgtgaggtgagatagtagtgacagtcttgatcctatgggttctgaaaagttctttgagc

SEQ ID NO: 38538 - DNA, 108 bp, Homo sapiens
tccttcgcttatgaagcttagtttggtcagatatgaaattctaagttggaaatttttttctgttaaaaatgttgaatactggctcccactctcttctggcttgtaggg

SEQ ID NO: 38539 - DNA, 106 bp, Homo sapiens
ctcttgatatatagaaatgctgctgatttttatattttggttttgtatcctgtaactttactgagtttgtttatcagttctaacagcttttctgtgatgtccttag

SEQ ID NO: 38540 - DNA, 77 bp, Homo sapiens
ggggagacgggatggggcacatgtctatgtataaattttttttctatttgctcaatgtccagacccttagtcttttc

SEQ ID NO: 38541 - DNA, 112 bp, Homo sapiens
gacatccatgtgtgtgtgtgtatatatgtatatatataaaatgttgcatatatatgtatatatatagtatacacacatatataatatatatacacacacatatatagttgtt

SEQ ID NO: 38542 - DNA, 56 bp, Homo sapiens
gagacagggtctcactgtgtcacccaggctggagtgcagtggcacgacctcggctc

SEQ ID NO: 38543 - DNA, 109 bp, Homo sapiens
atgtagattgctttatttatgtataaataacacataatgtaaatctggaaggctagatttttataatattttttgttggcagttaatagcggagtagggatgattacat

SEQ ID NO: 38544 - DNA, 162 bp, Homo sapiens
gcatttggtgaatgatagtttgtcctggaggcatttctatattttcctttagtctttttgttgttgttgtttgagatgcagtctcactcactctgtcactcaggctggagtgcagtggcacaatcttggctcactgcaacctccgcctccgagttcaagtga

SEQ ID NO: 38545 - DNA, 139 bp, Homo sapiens
gagtgctgtttcagtggagtgggagcacgaaaggggagcaagtggagaaggtgagaactgagctttttttttttttttttttttgagacagtctcgctctgtcgcccaggctggagtgcagtggcgtgatcctggctca

SEQ ID NO: 38546 - DNA, 79 bp, Homo sapiens
acctgcctcggcctcccaaagtgctgggattacaggcgtgagccactgtgcccggcctttgtttttttgttgttgttgt

SEQ ID NO: 38547 - DNA, 94 bp, Homo sapiens
gtgtggtcatgcacatctacagctactctggaggctgaggtggaaggatctcttgagcccaggagttggaggctgcagttagctgtgatcgtgc

SEQ ID NO: 38548 - DNA, 87 bp, Homo sapiens
gtacaacctggcaaaaccgtatatatatacagctgtctctaggggtgcatacaaatatatatatatgttttggatcaggtcaggtgc

SEQ ID NO: 38549 - DNA, 80 bp, Homo sapiens
tgagatggagtctcactctgtcacccaggctggagtgcagtggtgcgatctcggatcactgcaacctctgcttcccgggt

SEQ ID NO: 38550 - DNA, 130 bp, Homo sapiens
agtccctgatggcaactgcatgctccccagtctgtgggactcctgatttaaagagctagatctgaacttctgcagaaacctgctcaacatttgcccattggttgctgtgaaattcctctcctgggctctt

SEQ ID NO: 38551 - DNA, 58 bp, Homo sapiens
tgagactgagtctcgctctgtcacccaggctggagtgcagcggtgcgatctcggctta

SEQ ID NO: 38552 - DNA, 84 bp, Homo sapiens
ggaaggtgacagggagcagagtcacaactgttcaataatggacatatgagtgacatctaaatctttatttttctgttataagcc

SEQ ID NO: 38553 - DNA, 95 bp, Homo sapiens; identical to SEQ ID NO: 68

SEQ ID NO: 38554 - DNA, 93 bp, Homo sapiens; identical to SEQ ID NO: 69

SEQ ID NO: 38555 - DNA, 171 bp, Homo sapiens
ataaatatgtgtatatatatatatacacacatatatatatgtgtatatatatatatatacacatatatatgtgtatatatatgtatacacatatatatatgtgtatatatatgtatatacatatgtatatatgtgtatatatatgtatatacatatgtatatatgtgtata

SEQ ID NO: 38556 - DNA, 64 bp, Homo sapiens
ctagtggtttcttatgacagttctgagtgtgttgtattgacaggctctgttctgtcttcactgg

SEQ ID NO: 38557 - DNA, 71 bp, Homo sapiens
gagagtcttgagggaggcctttcgggtgcagcctgcctgggtctaaacttgtgccactctccctgactctc

SEQ ID NO: 38558 - DNA, 58 bp, Homo sapiens
tgagacagggtctcactctgtcacccaggctggagtgcagtagtacgaccatagttca

SEQ ID NO: 38559 - DNA, 138 bp, Homo sapiens
atgctacatatattttaatatataatatatatgctatatatattttaatatataatatatatgctatatatattttaatatataatatatatgctatatatattttagtatcaaatgtacctatacatatgtatgtgt

SEQ ID NO: 38560 - DNA, 95 bp, Homo sapiens; identical to SEQ ID NO: 580

SEQ ID NO: 38561 - DNA, 93 bp, Homo sapiens; identical to SEQ ID NO: 69

SEQ ID NO: 38562 - DNA, 110 bp, Homo sapiens
ccaggtgtggtggtgtctggcctatagccccaactgctctggaggctgaggtggaaggatcacttgagcccaggagttcaaggctatagtgtactatacccatgcctgtg

SEQ ID NO: 38563 - DNA, 108 bp, Homo sapiens
cagtcgcggtagcatgttcctgtagtcccagctactggggaggctgaggtagtaggatcacttgaacccaggagcttgaggctgcagtgaactatattgtgccactgt

SEQ ID NO: 38564 - DNA, 77 bp, Homo sapiens
gggtctttgaagtttagcagtctttttgttgttcaaaaatacactatgacattaaaaagacgtgggtcttctgaccc

SEQ ID NO: 38565 - DNA, 89 bp, Homo sapiens
ggctttgaaatatatgaaggcaaggtatggctattttcttcaatatagtagtttgcatatttttacctttttaatattttttattggcc

SEQ ID NO: 38566 - DNA, 67 bp, Homo sapiens
atgtgtgtgtgtatatatgtatatgtgtatgtgtaaatatacaccatactgtgttgcataaatatat

SEQ ID NO: 38567 - DNA, 95 bp, Homo sapiens; identical to SEQ ID NO: 68

SEQ ID NO: 38568 - DNA, 93 bp, Homo sapiens; identical to SEQ ID NO: 69

SEQ ID NO: 38569 - DNA, 95 bp, Homo sapiens; identical to SEQ ID NO: 68

SEQ ID NO: 38570 - DNA, 93 bp, Homo sapiens; identical to SEQ ID NO: 69

SEQ ID NO: 38571 - DNA, 103 bp, Homo sapiens
tggatatggatatgtgtgtggaaggatatggatatatatatatccatatatagtttgtttatatatatatccatatagtttttatatatatagtttatttcta

SEQ ID NO: 38572 - DNA, 69 bp, Homo sapiens
tgtttttgagatggagactcactctgtcaccctggctggagtgcagtggtgtgatctcggctcactgca

SEQ ID NO: 38573 - DNA, 88 bp, Homo sapiens
ggagtagctctggctttgagctgagcttgatcagggctgtccaactgcatcttcaggacctggtttctcactctctcagatctgcttt

SEQ ID NO: 38574 - DNA, 90 bp, Homo sapiens
gacctttcaactctgggggctttgctttggggaattattgggttgatcatacagtgactagactgtgagctcctagaggctagaattctc

SEQ ID NO: 38575 - DNA, 87 bp, Homo sapiens
tatatatgtatacgtgtgtatatatatgtatgtgtgtatatacatacacacatgtgtatatatgtgtgtatatacatatacacatgt

SEQ ID NO: 38576 - DNA, 70 bp, Homo sapiens
gtgtgtgtgtgtgtatatatatatttagtatatatatatatatttagtatatgtatacacacatacatat

SEQ ID NO: 38577 - DNA, 134 bp, Homo sapiens
gtacgtattgaatccagtcctttttacacatatgcaaagacatcactcaacaattttttttttttttttttttttttgagactgagtctcgctctgtcgcccaggctggagtgcagtggcgctatctcggctca

SEQ ID NO: 38578 - DNA, 97 bp, Homo sapiens; identical to SEQ ID NO: 1307

SEQ ID NO: 38579 - DNA, 88 bp, Homo sapiens; identical to SEQ ID NO: 1308

SEQ ID NO: 38580 - DNA, 81 bp, Homo sapiens; identical to SEQ ID NO: 1309

SEQ ID NO: 38581 - DNA, 77 bp, Homo sapiens; identical to SEQ ID NO: 1310

SEQ ID NO: 38582 - DNA, 66 bp, Homo sapiens
ttacttgtcactgtttctctctctggaggtctaagcacctccaggagggctcaaagtgctgagtga

SEQ ID NO: 38583 - DNA, 80 bp, Homo sapiens
gggtgtgtcagtgtgtgtgtgtatgagtatacccggtgatgagtatgtgtatgagtatacccagtgatgaaaaggcatcc

SEQ ID NO: 38584 - DNA, 71 bp, Homo sapiens
tgggaggcttttagagttctctgctcttaggtctgctcctgctctgcagcagaatctctgagccactacca

SEQ ID NO: 38585 - DNA, 102 bp, Homo sapiens
tgcctctgcacctctcactgcacaagtcagaatgtgtgcatgtgcatgtaaacatacatataaattctgttttcaactcagcagcgagagggatcatttgca

SEQ ID NO: 38586 - DNA, 108 bp, Homo sapiens
gctttcccccatcaactttagttcacacagaaaaatcagagaaaagtggcaaattgttactttctttttcatgtgagttctctcagtgggtgccaaaacatcagaagc

SEQ ID NO: 38587 - DNA, 102 bp, Homo sapiens
tgagagccccagctggtgcagggaggggaggggatggagggtaggcagcgccggctgccagtctccctgcctccctggctgttcagggtgggagccggctca

SEQ ID NO: 38588 - DNA, 56 bp, Homo sapiens
gtgtgtgtatatatatgtatgtgtatgtaagtctggatatatatatatacacacac

SEQ ID NO: 38589 - DNA, 113 bp, Homo sapiens
aatgcagagatttaccaacataagaaactgtggtttatggcataactattattttattaatacttgcaagactacttttttctactaagccatgttggatgtatatctccatt

SEQ ID NO: 38590 - DNA, 86 bp, Homo sapiens
gggcgggggccctcgtcttacccagcagtgtttgggtgcggttgggagtctctaatactgccgggtaatgatggaggcccctgtcc

SEQ ID NO: 38591 - DNA, 156 bp, Homo sapiens
gttctctgtcggccggccctgggtccatcttccagtacagtgttggatggtctaattgtgaagctcctaacactgtctggtaaagatggctcccgggtgggttctctcggcagtaaccttcagggagccctgaagaccatggaggactactgacca

SEQ ID NO: 38592 - DNA, 58 bp, Homo sapiens
tgagacagagtctcactctgtcgcccagattggagtgcagtggtgcgatcttggctca

SEQ ID NO: 38593 - DNA, 78 bp, Homo sapiens
gcttcttattgcaagtcagctagcaaggagacaggagtacagctcagatctgtctccctgtgctggcttgatgggagt

SEQ ID NO: 38594 - DNA, 83 bp, Homo sapiens
gcacccggccgacaggtgtaactttttttttttttttttttttttttgagacagagtctcactctgtcaccaggctggagtgc

SEQ ID NO: 38595 - DNA, 75 bp, Homo sapiens
gactatctggatgaaattcttgatgatgctcctcagaatggtggagattgggggaatgattaagacatctttgtc

SEQ ID NO: 38596 - DNA, 75 bp, Homo sapiens
gtccagacattgatagtgtgtccaggtttgtcattgtatttcaatatttattggaccatcttcagtatgctgcac

SEQ ID NO: 38597 - DNA, 89 bp, Homo sapiens
gccagattgagagatgagtcagaggacagtggggcccgggcagagggacagaacctgcgggtgctggcaatcagccttttgatctgagt

SEQ ID NO: 38598 - DNA, 95 bp, Homo sapiens; identical to SEQ ID NO: 68

SEQ ID NO: 38599 - DNA, 93 bp, Homo sapiens; identical to SEQ ID NO: 69

SEQ ID NO: 38600 - DNA, 95 bp, Homo sapiens; identical to SEQ ID NO: 68

SEQ ID NO: 38601 - DNA, 93 bp, Homo sapiens; identical to SEQ ID NO: 69

SEQ ID NO: 38602 - DNA, 102 bp, Homo sapiens
atcctgggatctcttgatagaataagagaatactgctaaatcctaaaaagtttttatatttatctggatatgcagtagtatggagaaagggatccattgggt

SEQ ID NO: 38603 - DNA, 97 bp, Homo sapiens
tatgtatacccacacactatatatacatatatgtgtatatatacatacgtatgtgtatatatacgtatgtgtgtatatatacgtgtgtatatatata

SEQ ID NO: 38604 - DNA, 107 bp, Homo sapiens
agcctgtggatttatctaaagaaataagttggagtgaatttaagtgtcttttttttttttaattacattactgacttgtgttttcttgagcgggagacaaaggggct

SEQ ID NO: 38605 - DNA, 109 bp, Homo sapiens
gtgtggttttgatttgcatttctctaaaaattagtgatgttgagtgcattttcatatgcttatatatttgtatatcatctttggagaaacatctattcaagttctgtgc

SEQ ID NO: 38606 - DNA, 81 bp, Homo sapiens
gcaagagagagctctgatgactcttccttttcttttttcctttgttctttttttttttgagatggagtctcactctgttgc

SEQ ID NO: 38607 - DNA, 70 bp, Homo sapiens
gttgtagaaaaggagtctcgctctgtcgctcaggctggagtgcagtggcgcgatctcggctcattgcagc

SEQ ID NO: 38608 - DNA, 131 bp, Homo sapiens
ccagcatggtgggtgtgagtggtaagggaaggagaagaaataaggagtcctcaggcctctcactttctgtctatgaaatggaaattggtaggtgtggataggttggtctcttccagttgtgggccatggat

SEQ ID NO: 38609 - DNA, 107 bp, Homo sapiens
tgtgtcataccacctatgtcaaatggaagttgctaagcagattttttttttttttttttttgagacagaatctgactctgtcacccaggctggagtgcagtggcacg

SEQ ID NO: 38610 - DNA, 103 bp, Homo sapiens
tacagattaatatttcatatgtattcagcatgttccatttcagcctcaaaaagtttttttttttccaaatgaggaggcatttgtgcagttgtttgcatctgta

SEQ ID NO: 38611 - DNA, 92 bp, Homo sapiens
gctaagaacttaagatattaatagccaggaagagtttatttatttctaaaatatttttaccttggttattgtttccattgtttttgaaatgc

SEQ ID NO: 38612 - DNA, 92 bp, Homo sapiens
tccttaatggataactatacttaaatgatgttctcttgtctttctgtcacaaacatcgttctagacattgggtatggcttgacttttcagga

SEQ ID NO: 38613 - DNA, 73 bp, Homo sapiens
attcgggaactgctgagctagatgattatatatctatatctatctacacctacaagctctacagttctttgat

SEQ ID NO: 38614 - DNA, 111 bp, Homo sapiens
ccctccagtgtcatgagggataaagtcataagtttaagatttttaaaaatagccaattttataaaaaattatttattattaaaatgattatatcactttcatattggctgg

SEQ ID NO: 38615 - DNA, 92 bp, Homo sapiens
tctgtgtgaaaattttcacttttgccaagaactatagtgtttttcatgataaaaatcagtttcttggtgagaaatagaatttgaaacattga

SEQ ID NO: 38616 - DNA, 98 bp, Homo sapiens
gcagacggcaaggagtaggtacaagggactgtgggggaatttatcttaaacaaggttgtttacttatattgaccaggaactgacctttgatcatctgc

SEQ ID NO: 38617 - DNA, 58 bp, Homo sapiens
tgagactgagtctcactctgtcacccaggctggagtgcagtggtgcaatcttggctca

SEQ ID NO: 38618 - DNA, 113 bp, Homo sapiens
gtgatgtgagaagatgccattgtctgtaatttaaagcaaacaagcaagaaaaactttcatgagctggcaggttgttttgatttacaatgttgtgatgttctactacatttagc

SEQ ID NO: 38619 - DNA, 58 bp, Homo sapiens
tgagacaagatctcactctgtcactcaggctggagtgtagtagtatgatcacggctca

SEQ ID NO: 38620 - DNA, 84 bp, Homo sapiens
cctatgccttacttttgtgaccggaattatttttttttagttcacctaatgagagtaataaaaatcacacagaaggcgcatggg

SEQ ID NO: 38621 - DNA, 97 bp, Homo sapiens
actccgttgataatctcttttgctgtgcagaaactctttagtttaataaggtttcacttgtcaatttctatttttgttgcaattgatttttaggagt

SEQ ID NO: 38622 - DNA, 106 bp, Homo sapiens
gctatcttcctgatgctgagttctcatgagatctggtcatttaaaagtgtatgacacctccccctgactcactctctcttgctcctacttttgccgggtgatatgt

SEQ ID NO: 38623 - DNA, 114 bp, Homo sapiens
aggttttctgttggtctgctttgagtaattgttgtcgtttgctggtatcaggctggctcactgtatccctgcagctggtgaacagtactcaatagcatgtgccaatgatggtct

SEQ ID NO: 38624 - DNA, 89 bp, Homo sapiens
atccttcaaggaatcagaggaaatgacttaaacatttttatttatttattttttgagatggagtctcactctgtctcccaggctggggt

SEQ ID NO: 38625 - DNA, 116 bp, Homo sapiens
atagaaatcattctaccataaagtcacatgcacacatattctgaatattgtttaatattattcaatcaatattctgaatatgtgtgcatgtgactttatggtagaatgatttctat

SEQ ID NO: 38626 - DNA, 103 bp, Homo sapiens
ctgttttcaatttgttttggtatatactcagaaaagaaaatgctagatcatattgtaatttcatttttaattttttgagaaactgccatactgtttttaacag

SEQ ID NO: 38627 - DNA, 139 bp, Homo sapiens
tattcatactttcacatgtgtttgtgtatatatatatctgtacaaacatgtttgtatagttgtgcttattttatacatttatattttaatatatgaatacataatgctcatttatataaattagtttatatatgtatgc

SEQ ID NO: 38628 - DNA, 188 bp, Homo sapiens
atactaatagtataataggattagtataggtatactaatactagtacaattatatacaattacatagtattagtatactagcaatattagtatactagtactattagtatgctaatactaatagtactgatatactagtactattagtatgctaatactaatagtgctgatatactagtactattagt

SEQ ID NO: 38629 - DNA, 138 bp, Homo sapiens
acacacacacacacacgtatataagtatatatgtatatgtagatatatacatatgtatttatataggtatatatgcatgtgtatatatacttttttgaatatatatatatatatatatatatacttttttgaataatg

SEQ ID NO: 38630 - DNA, 104 bp, Homo sapiens
atgagataagaggaacttctttttaggggagacaaaaatgttttgtaactggaaacttggaatatacttttttttttaagaaaggaaatacctactcatttcat

SEQ ID NO: 38631 - DNA, 96 bp, Homo sapiens
tgtgctacttctccaagagcaattacagcaaatagtatcatgccaacaggagctgttgaaagttatattgttgatctgtggttggagaacagcata

SEQ ID NO: 38632 - DNA, 98 bp, Homo sapiens; identical to SEQ ID NO: 1311

SEQ ID NO: 38633 - DNA, 99 bp, Homo sapiens
ttgtcattaaatgatgatgttggtgtttgagatctaaaatgattaattttattcattttaatactttatgttataatacagtcatgatgatgatgacag

SEQ ID NO: 38634 - DNA, 78 bp, Homo sapiens
ttgaggctattttgaaaagtggtgttatgtatattctagtatatatattttaagctattttattataatgtgccttgg

SEQ ID NO: 38635 - DNA, 73 bp, Homo sapiens
tggtgtctgggtgataaaagtaagtgatgccctagtatgtgagcagtcactccctctgtcactcatttttcca

SEQ ID NO: 38636 - DNA, 113 bp, Homo sapiens
tatcaatatgtcaaacacttcagtgacaatttattgtgtaatatcagtgcaccaggtattacagaattttgtttttttttttcttattggttaatgtaagacattatatgatg

SEQ ID NO: 38637 - DNA, 56 bp, Homo sapiens; identical to SEQ ID NO: 3386

SEQ ID NO: 38638 - DNA, 81 bp, Homo sapiens
ggtgaaaatctttgtgattctgggttaagcaaagaatttttttttctttttttttttgagacggagtctcactctgtcacc

SEQ ID NO: 38639 - DNA, 95 bp, Homo sapiens
atatatatgtatctcgtaatatatacatggtagtatatatatattaccatgtaatactatatatatataaccatgtaatactatatatatatata

SEQ ID NO: 38640 - DNA, 116 bp, Homo sapiens
catgatgcctctttctacttaggattgtctcagctatgtgggctcttttttggttctatatgaaatgtaaagtagttttttctaattctgtgaagaaagtcaatggtagctttatg

SEQ ID NO: 38641 - DNA, 114 bp, Homo sapiens
tctaaattcaaaatttttgcttgctctataaacatgaatctttgtactttaaatatttttgctttacaagctgaaaatgatgttgagatttatcagtagagggtgctggagaga

SEQ ID NO: 38642 - DNA, 56 bp, Homo sapiens
tttatatgtacataaagatgtgtgtgtatttatgtgtatctttatgtatatataaa

SEQ ID NO: 38643 - DNA, 88 bp, Homo sapiens
gtgaatgtatatgtatatgtgtgtatatatgcatatgtatatgtatgtatatatgtatttgtgtgtgcttgtgtgtctatttatttac

SEQ ID NO: 38644 - DNA, 90 bp, Homo sapiens
gggcgagttccaggctggacagcattcaccataagctgactgagaagcccttgggccttaagtgaacactgtgagcactggtggttgcct

SEQ ID NO: 38645 - DNA, 115 bp, Homo sapiens
tttgattagtgttagcacgatgtatctttctccttccctttacttttaatatatatgtgttttatatttaaagtgggtttcttgtaggtaacatggagttgaatcctattttaaa

SEQ ID NO: 38646 - DNA, 100 bp, Homo sapiens
tttggcagtaaggattcgctgaaagatggggtgatgttagaggatatagtttcaaaatatctttgtcttttattactctaagtaagtcattcttaacaaa

SEQ ID NO: 38647 - DNA, 89 bp, Homo sapiens
atatatatatgaatatatgtatatactcatatatatgaattttcattcatatatatgaatatatatacacactatatatatgtgtatat

SEQ ID NO: 38648 - DNA, 109 bp, Homo sapiens
tcataggtatagtagctatgaaatatggagttataaatatgtagacatttttaaaaaatgtgtatttttttcactttaccatttttcatggcagattacatagttaagg

SEQ ID NO: 38649 - DNA, 95 bp, Homo sapiens
tgagtttttaaagtatgattgtgaactcataaatatgcaattatatatatttatatacatatgcatacatatgtagtcattttttttaatgctca

SEQ ID NO: 38650 - DNA, 118 bp, Homo sapiens
caggtcaggatggcagaaagatactcagtcccagatgtcattactgagctaccatacaattctaagactctgtgactctgacttcttggtgaaggagacaaataaatgcattctactg

SEQ ID NO: 38651 - DNA, 81 bp, Homo sapiens
ctgccagcctcggcctcccgaggtgctgggattgcagacggagtctcgctcactcagtcctcaatgttgcccaggctggag

SEQ ID NO: 38652 - DNA, 237 bp, Homo sapiens
atatatatatttgagaaataagtgtataaatatatatatttgagaaatatatgtataaatatatatattttagaaatatatgtatatatatatttgagaaatatatgtataaatatatatattttagaaatatatgtatatatatatttgagaaatatatgtataaatatatatatttgagaaatatatgtataaatatacatatttgagaaatatacgcataaatatatatatttc

SEQ ID NO: 38653 - DNA, 87 bp, Homo sapiens
agacaatgcatacttgtttgtatttctctgtctttctatctcagaagagagagagagaaagcaatacaaacaagtatgtatctctct

SEQ ID NO: 38654 - DNA, 83 bp, Homo sapiens
ttttctttattcatctgtcagtgtgcagttagtttgtttctatatttgactattgtacataatgctgcaatgaagatagaagg

SEQ ID NO: 38655 - DNA, 100 bp, Homo sapiens
tctatctatctatcctcttgtgtttgtatgggatatatatatatatatatatatatatatatatatatatatatataaaatcaggaaatgtgtgaatagg

SEQ ID NO: 38656 - DNA, 79 bp, Homo sapiens
ctactctattgctgagctacttagtctcaggcagaattggaggaactgagattacacagagaagagacaatggaagtag

SEQ ID NO: 38657 - DNA, 87 bp, Homo sapiens
ctgaaagcaaatattatgtgtgtatcagtctttcactgggaaaataaactttggaagctggttaccactgtacagtgttttgaacag

SEQ ID NO: 38658 - DNA, 61 bp, Homo sapiens
ctttggacaaaggcacagaccacagactgtttctgtgattctgtgctttttttctcctagg

SEQ ID NO: 38659 - DNA, 90 bp, Homo sapiens
gtatttgcttctgtggttcaatgtcaggctcttaaaactaaaagttttattttttcaaaggaatttgcataaataggcaatggcagatac

SEQ ID NO: 38660 - DNA, 71 bp, Homo sapiens
gttgtttgagacggagtctcactctgtcaccccggctggggtgcactggtgcaatcttgtttcactgcaac

SEQ ID NO: 38661 - DNA, 72 bp, Homo sapiens
tatatgtgtatatatgtatatgtatgtatatatatacatgtgtatacatagatatacacatgtatatatatg

SEQ ID NO: 38662 - DNA, 61 bp, Homo sapiens
tacttactgtaactggagcttgcaggcctgaagttgttgtgtgtgagtcagtgagtgagtg

SEQ ID NO: 38663 - DNA, 73 bp, Homo sapiens
atctgtatatatgtatatatatctgtatatatacacatatgtgtatatatgtatatatactgtatatctagat

SEQ ID NO: 38664 - DNA, 113 bp, Homo sapiens
atatatctatatatacatatgtgtatatacacatatgtatatatgtatctagatatacagtatatatacatatatacacatatgtgtatatatacagatatatatacatatat

SEQ ID NO: 38665 - DNA, 98 bp, Homo sapiens
ataaaagtagttttatatcttttatagtttttataaaagatataaaactagttttatatcttttatagtttttataaaagatatacaagtagttttat

SEQ ID NO: 38666 - DNA, 65 bp, Homo sapiens
agtgaggtgacacatgtctgtagtcccagctcctagggaggctgaggtaagaggatcacttgact

SEQ ID NO: 38667 - DNA, 75 bp, Homo sapiens
gttgtttggctggatatgaaattctagactgaaaatttttttctttaagaatgttaaatattgggccagcacgat

SEQ ID NO: 38668 - DNA, 82 bp, Homo sapiens
tgtaccccataaatatataaacctatgtatagatgtatacacataggtgtatatatatatatacatagatgtatggtgtaca

SEQ ID NO: 38669 - DNA, 78 bp, Homo sapiens
tgcctcagtctctccctctgccttatgccccttggttgaattatttcttctgagagggcaagaagtgaggttgttgca

SEQ ID NO: 38670 - DNA, 85 bp, Homo sapiens
tctgcctggctttcatttcattcattctttattattattattattattttttgagatggtgtctctctctgtgggccaggctgga

SEQ ID NO: 38671 - DNA, 58 bp, Homo sapiens
tgagacagggtctcactctgtcacccaggctggagtgcagtggtgcaaccttggctta

SEQ ID NO: 38672 - DNA, 60 bp, Homo sapiens
tctctgtctctctctctacatacatacatatgcacacacacacagagagagagagagaga

SEQ ID NO: 38673 - DNA, 95 bp, Homo sapiens; identical to SEQ ID NO: 68

SEQ ID NO: 38674 - DNA, 93 bp, Homo sapiens; identical to SEQ ID NO: 69

SEQ ID NO: 38675 - DNA, 81 bp, Homo sapiens
cccagcattcagaggatcaaaagtttgtaacatttatttatttattcagtaaacagttattgatcttcactatgggctggg

SEQ ID NO: 38676 - DNA, 102 bp, Homo sapiens
gtatatatatacgtatatatacatatatacgtatatacatatatatacacgtatatatatatgtatatatatacacgtatatatatatatgtatatatatac

SEQ ID NO: 38677 - DNA, 184 bp, Homo sapiens
tatgtatatgtatatatgtacatgtatatatgtacatatatgtatatgtatatgtgtacgtatatgtatatatgtacatatatgtatatgtatatgtacatatatgtatatatgtacatatatgtatatatatgtatatatgtacatatatgtatatgtatatatgtacatatatgtatatata

SEQ ID NO: 38678 - DNA, 95 bp, Homo sapiens
gtatgtatgcacttgtgtgtttgtgtgtgttgtgtgtgatatgtatgtgtgtgtatgtgtaatgcctgtatgtgcatgtacttgtgtgtgtgtgc

SEQ ID NO: 38679 - DNA, 77 bp, Homo sapiens
caagtgatgactgggagggctgatagggggtaacgcggacagcctctctctctgacagcagattgtcagcattcttg

SEQ ID NO: 38680 - DNA, 109 bp, Homo sapiens
gagaaattacagctttgattaatgtaatcaaataaattagtttattttaaaaaatgagataatgaaatggtcccattgataatggctcattatcgactggtgttttctt

SEQ ID NO: 38681 - DNA, 58 bp, Homo sapiens
tgagactgagtctcactctgtcaccaaggctggagggcagtggtgtgattttggctca

SEQ ID NO: 38682 - DNA, 122 bp, Homo sapiens
tgtagtagtgagataaccttctctcttccctctgtaataactgagtctgttgaaataaactgacagtagattgacaggagaaaaggtatacaagtttattacatgcacagtgacattacagg

SEQ ID NO: 38683 - DNA, 88 bp, Homo sapiens
tttatatatatatatgtgtgtgtgtgtgtgtgtgtgtgtatatgcgtatatatatatgtgtgtatatatatgtatgtgtatatataga

SEQ ID NO: 38684 - DNA, 106 bp, Homo sapiens
gtgaacagttggaagatatagtttctgcctttgaagaaaaatcactttttttttctttttttttttctgagatggagtttcgctcttgttgtccagactggagtgc

SEQ ID NO: 38685 - DNA, 117 bp, Homo sapiens
gagacactctgctttgattcagtctattgctggggtgtaagtcaagtctccagggggactagagattttcatgtactttgctctccattccagaaactaaatgggactgagtgtctc

SEQ ID NO: 38686 - DNA, 94 bp, Homo sapiens
cctgtcaaggcgtctaaactggctccctctgtggctgtgtctctatcccacttttggggagcttgtttggaggttctagcaggggagcgcagtt

SEQ ID NO: 38687 - DNA, 87 bp, Homo sapiens
gccaccgtgcctggctgagaacagtgcatttttttatttttttattttttgagatggagtatagttctattgcccaggctggagtgc

SEQ ID NO: 38688 - DNA, 71 bp, Homo sapiens
gagatggagtctctgtcactctgttgcccaggctggagtgcagtggagtgatctcgactcactgtaatctc

SEQ ID NO: 38689 - DNA, 80 bp, Homo sapiens
tgcactccatttcccacgttgttcactcactcactccctctcatgaggagtggagagtagcaggctgagtaaatgaggca

SEQ ID NO: 38690 - DNA, 94 bp, Homo sapiens
gaccatgttcttcctaatgttgctgaatttgtatattttgttaatgtcttttgcatataacatacagcttacaggaactggaagataactggtt

SEQ ID NO: 38691 - DNA, 104 bp, Homo sapiens
tgttttatttgctctttttaaggggtgactttttagttaaataattttattacttaatatctctctcaggaaagtcgttgccccaagaagagccagtgatcaca

SEQ ID NO: 38692 - DNA, 111 bp, Homo sapiens
gctgggtgtggtggttcacacctgtaatcccagtgacacaagaggctgaggtgagaggatcacttgagcccaggagttggaagctgcagggaaccaggactgcatcactgc

SEQ ID NO: 38693 - DNA, 99 bp, Homo sapiens
gagtgtgcagtgtcaaccccttgcctgaatcagcatctccaagactttcactggtggatgatagggatgaggtataggtggaaagtcaagcatttgctt

SEQ ID NO: 38694 - DNA, 114 bp, Homo sapiens
gtttatgtttcatatacacatagcccgaaggtacttttatacaatgttttttatgttttatgcacctgtcacatgaggtcgtgtgtagtatcttccatgtgtggtatcatgtgc

SEQ ID NO: 38695 - DNA, 121 bp, Homo sapiens
ggatgcaacttggtgatgcacttgatgatgggtgttcatggtgctcttttttttttaaaaaaaaaaaaagactgagtctcactctgtcgcccaggctggagtgcagtgtcacagtctcggc

SEQ ID NO: 38696 - DNA, 90 bp, Homo sapiens
gttcctttcttctgggcactcgggcaggttatatctctcagcttcttgcagatggctgtgtctctgtgcctgagtaccagctgatggaat

SEQ ID NO: 38697 - DNA, 58 bp, Homo sapiens; identical to SEQ ID NO: 315

SEQ ID NO: 38698 - DNA, 118 bp, Homo sapiens
gactagagctgctataaacatccatgtgcaggttttgcatagacttaaattttcttgttttctttcttttttaatactttaagttctagggtacatgtgcacaatgtgcaggtttgtt

SEQ ID NO: 38699 - DNA, 98 bp, Homo sapiens
gcagtgtgaagagatcacatggtgagagaggaagaaaacaggcaggcaggttcagcctcttttttttttttaatttttactttttgtgggtacatagt

SEQ ID NO: 38700 - DNA, 65 bp, Homo sapiens
ggttctgcagagtgtggaagatggcactgaccgccctctcaaaccctcacactgtctgcaaagtc

SEQ ID NO: 38701 - DNA, 95 bp, Homo sapiens; identical to SEQ ID NO: 68

SEQ ID NO: 38702 - DNA, 93 bp, Homo sapiens; identical to SEQ ID NO: 69

SEQ ID NO: 38703 - DNA, 100 bp, Homo sapiens
atatatgtatgtgtatatatatccacatatatagttatatattatatataacatatatattatatataacatatgtgtatgtgtatatgtatgtgtatat

SEQ ID NO: 38704 - DNA, 105 bp, Homo sapiens
atttttcccttttggaatgtaagtgtctatcctatgcctgcttcaccattgtattttggaagcatatgtaatgttagtttcacaggttcacagctggagagaaat

SEQ ID NO: 38705 - DNA, 100 bp, Homo sapiens
atattagtctctaattgtttacaaagtaagaaagtttgattttataaaaagagaacttaggctaattcaaaactttgtataccaattggggtggtagtat

SEQ ID NO: 38706 - DNA, 95 bp, Homo sapiens
gctgttaattattgtcaatttttttgtttttgatttttgagataggctctcactctgtcacataggcgggaggattgcagtggctccatcgcagc

SEQ ID NO: 38707 - DNA, 78 bp, Homo sapiens
ttcctggctatcactgatgttcattcaatgcccaagagctcctcagtcagcttgtgatgaatgttgtcaggcctggaa

SEQ ID NO: 38708 - DNA, 108 bp, Homo sapiens
gctataggggtttgagatagaataaacacattgacccattttgtacactccactgtaatgaagaatgattatgctaattgatgtaggttcttgatcagggctttgggc

SEQ ID NO: 38709 - DNA, 118 bp, Homo sapiens
tgtatcataccattgacaatcttaataactcaacagttgctaaatccttctatatatgcttaattttttaggatacattagcggaagtggaattgttagatgacagtacattcataca

SEQ ID NO: 38710 - DNA, 80 bp, Homo sapiens
gaaaacttccgctttctctgcctctgtctcacagcaggaaggctggattacagtgctggcagtaaagcaccacaggtttc

SEQ ID NO: 38711 - DNA, 71 bp, Homo sapiens
acatatacgtgtgtgtgtgtgtgtgtgtatatatatatgttcacacatacaccatgtatatatgtgtgtgt

SEQ ID NO: 38712 - DNA, 61 bp, Homo sapiens
gtatattatatacgtgcatatatacagacatgtttaggtataagtatgtatatatgtatac

SEQ ID NO: 38713 - DNA, 80 bp, Homo sapiens
tgagtgagccaatatatgtgtctgtatatctatgtatatagttatatgtagatatatatgtgtacatattgttttgaaca

SEQ ID NO: 38714 - DNA, 62 bp, Homo sapiens
tagtctcagctacttggaaggttgaggtggtaggatcacttgagcctgtcaggttgaggctg

SEQ ID NO: 38715 - DNA, 100 bp, Homo sapiens
gtatctgtggacatggggctagaaaggaagataccatgtcacattaagatattttctttggtatttatctacttcttaatcccccattttactaaaatac

SEQ ID NO: 38716 - DNA, 107 bp, Homo sapiens
cttactgaggtttcgatagttctctgattttctgcaaccccaagcttcaacactattgttattgttgaacttttattgctcatggttgctgtaggggcctcagtgag

SEQ ID NO: 38717 - DNA, 79 bp, Homo sapiens
taatttatatgaatttttaacctgcaatgtgactgtatttggaaacaggacttttacagaggtaattcaggttaaatta

SEQ ID NO: 38718 - DNA, 112 bp, Homo sapiens
tgtttgagccatgatttacctagttagatctgcagtttctaaagatcactttaataacagagtagagagaggacagactgaaggagataggatggaatctggaagcttagca

SEQ ID NO: 38719 - DNA, 111 bp, Homo sapiens
ttttttctctcttgggttcagagtagctcagttctgattcctcagattaatgtttttatctatatctgagtcttctgggtgcaaaactggaaccaaccaactgaggtcaga

SEQ ID NO: 38720 - DNA, 58 bp, Homo sapiens
tgaggcggagtctcactgtgtcacccaggctggagcgcagtggtgcaatctcggctca

SEQ ID NO: 38721 - DNA, 82 bp, Homo sapiens
tatgtttgtgtctatatgtgtgtatatgagatatatgaacacatatgtaaaattctatatatatattatacatacacacata

SEQ ID NO: 38722 - DNA, 71 bp, Homo sapiens
gttgtttgagatggagtctcactctgtcacccaggctggagtgcagtagtgcgatctcagctcactgcaac

SEQ ID NO: 38723 - DNA, 115 bp, Homo sapiens
tcagcctctggagtagttgagactacaggcatagggcaccacttccagctaattgttttattttttacagagatggggccttgccatgttgtccagactggtcttgaactcctgg

SEQ ID NO: 38724 - DNA, 95 bp, Homo sapiens; identical to SEQ ID NO: 68

SEQ ID NO: 38725 - DNA, 93 bp, Homo sapiens; identical to SEQ ID NO: 69

SEQ ID NO: 38726 - DNA, 123 bp, Homo sapiens
cataagtacatatgtgtgcatatatatacatatatgtgtgtatacatataaatatatgtgtgtttatatgtatatatacacatatatgcacacctgtatacatgcatacatatacatgtgtat

SEQ ID NO: 38727 - DNA, 96 bp, Homo sapiens
tctggccaattctctgaattccatttttatttatttatttatttatttatttatttatttatttatttagagatggagtctcactctgttgccagg

SEQ ID NO: 38728 - DNA, 102 bp, Homo sapiens
tatatagagagaacatatatatgtgtgtgtgtgtgaatctatatatgtgtgtatatatgtgtgtgtatatacatatatatatatataggttctgtgtgtgtg

SEQ ID NO: 38729 - DNA, 97 bp, Homo sapiens
tgggttttttactgtatatatgtactggggaacaatctgataacacagaaatcactgaggacataaaattatttcatcacagtaaccaggagaccta

SEQ ID NO: 38730 - DNA, 75 bp, Homo sapiens
ctggaaataagctcactgtgagtgctggatcccttctgagcactgagattacacactgtgctaacatgtttgcag

SEQ ID NO: 38731 - DNA, 58 bp, Homo sapiens; identical to SEQ ID NO: 637

SEQ ID NO: 38732 - DNA, 106 bp, Homo sapiens
aatcaggttctatgcactgcttttggagtctgaagaactaggtaaattccctggatctgctacttagtctctgttatttagtgcaagtaatttaatttccctgatt

SEQ ID NO: 38733 - DNA, 86 bp, Homo sapiens
gagaaaaatctcaaaatatttatacatatacaaaatatatatacaaatatatattatatgtatatatatttttgagatggagtctc

SEQ ID NO: 38734 - DNA, 81 bp, Homo sapiens
tatacactgtttttacatatatatatgtgtgtatatacatatgtgtgtgtatatatgtgtgtgtgtgtatgtgcgtgtgta

SEQ ID NO: 38735 - DNA, 83 bp, Homo sapiens
aagccaagcccttagatccttcttcgcctactcttgcaaaggaagagatgtgacttaggagactctgcagtgagctaaagctt

SEQ ID NO: 38736 - DNA, 84 bp, Homo sapiens
acctacatatctattaatatgtatataaacatgtatatttaaatacatgtatgtttatcctatgtactagaatagttagtaggt

SEQ ID NO: 38737 - DNA, 99 bp, Homo sapiens
gtcagcttatgaattctattctatgcattgcattaaatgtttatattcattattgaattgtattctattgcaattatgatagagtttaccataattgat

SEQ ID NO: 38738 - DNA, 164 bp, Homo sapiens
tatatctatatctctatatctatatctatatctatatagatatatctatatctatatctatatagatatatctatatctctatatctatatctatatagattatatctatatctatatggatatatctatatagatatatctatatctatatctatatggatat

SEQ ID NO: 38739 - DNA, 58 bp, Homo sapiens
tgagacagagtctcactctgtcacccaggctggagtgcaatggcgtgatctctgctca

SEQ ID NO: 38740 - DNA, 107 bp, Homo sapiens
cagtttgacatcctcttttccaatgtggatgctctttatttctttattttgcctgattgttctggctaagacctccagtactatgttgaatggaagtggtaaaactg

SEQ ID NO: 38741 - DNA, 116 bp, Homo sapiens
catgtgggctagtcatgtattttctgctgtcttttcatttatttatttattttagtagctctaggggtttggttaaatggatgaattgtatagtagtaacgtctgggcttttagtg

SEQ ID NO: 38742 - DNA, 90 bp, Homo sapiens
gggagtggggggatactatgatgacagttcagggagagcactgacacccacaaaacctcccctgtgtgaatgcatagtgttattactgct

SEQ ID NO: 38743 - DNA, 135 bp, Homo sapiens
cagggtgtacacccactgtgatattaggaataatatcttagggagaaattactcctaatatcacaatggctgtacattctgtgatattattcataatatcatagggagatattactcttaatatcacagggtgtg

SEQ ID NO: 38744 - DNA, 188 bp, Homo sapiens
tgtacacgctgggaaattattcgtaatatcttaaggagatatttgttctaatatcacagtgggtgtacactctgggatactattcgtaatatcctggagagatattactgctaatatcacagtgggtgtacttccaaagatattattcataatattctgtggagatattactcctaataccacagcag

SEQ ID NO: 38745 - DNA, 110 bp, Homo sapiens
ctggctggtccaaagatcatactctccagggacctagtacttcataataatgattcattatttattctagccccaggacatttcaaatgagtgtttcaaaccactgctgg

SEQ ID NO: 38746 - DNA, 62 bp, Homo sapiens
gctgagcagagtgagaggtgacagcgtgctggcagccctcgcagccctcactcgctctcagt

SEQ ID NO: 38747 - DNA, 92 bp, Homo sapiens
tagatgtagtgggcagtcacagtttttgaactacatttatataatttattgtacataaatgcagttgaacttacttggctgtttaaaatctg

SEQ ID NO: 38748 - DNA, 97 bp, Homo sapiens
gcatagtggtgtgcacttgtagtcccaactgcttgggaggctgaggtgggaggatggtttgagcccaggatttgaggctgcagtgagctatgattgc

SEQ ID NO: 38749 - DNA, 101 bp, Homo sapiens
gcaatgtaggagtgatagtttttttttgcatcctcaccagaatttggtgttttcactaattttttaaattttaaaaaaattttagtcattctcataggtgt

SEQ ID NO: 38750 - DNA, 83 bp, Homo sapiens
tgagccaggctttgtggtatgcacctgtaatcccagctacatgggaggctgaggtagaaggatcgcttgagtccaggagttca

SEQ ID NO: 38751 - DNA, 115 bp, Homo sapiens
cagtggacgtgtctgaaattgtcttaccatattccttttgatataatcatctatttttgtatttgtcttctgtactagatggtgtcttgaactttctatttctagctgtttactg

SEQ ID NO: 38752 - DNA, 100 bp, Homo sapiens
tggaactctcattgttggtgatgtaaattggtacaattgctttgtaaagatgtttggtattttcttataaaagtcagtgtatacctgctgagaaattcca

SEQ ID NO: 38753 - DNA, 63 bp, Homo sapiens
gctgaggctgggggactgatagaagataattactctggctctgtcagtgcctcaatttttagt

SEQ ID NO: 38754 - DNA, 80 bp, Homo sapiens
ttgaaatggggtctcactctgtcactcaggcaggaatgcagtggcagaatctcggctcactgcaacctctgcaccctgag

SEQ ID NO: 38755 - DNA, 72 bp, Homo sapiens
cggggtctcactcactctgtcgcccaggctggagtgcagtggcatgatctggagtgcagtggcatgatctcg

SEQ ID NO: 38756 - DNA, 88 bp, Homo sapiens
tgatattccattgtaggaatacaatacattttgtttattcatttatcaatcaatgaacatttgggttgttttcactttggggctatta

SEQ ID NO: 38757 - DNA, 95 bp, Homo sapiens; identical to SEQ ID NO: 68

SEQ ID NO: 38758 - DNA, 93 bp, Homo sapiens; identical to SEQ ID NO: 69

SEQ ID NO: 38759 - DNA, 127 bp, Homo sapiens
gcccacctcgacctcccgaaattctgggattacaggcatctcactttattattttattttttattttttgagatggagtctcgctctgtcacccagtctggagtgtagtggcgcgatctcagctcaa

SEQ ID NO: 38760 - DNA, 97 bp, Homo sapiens
acatggacagtaaataatgtgctcaatgttgcgtcagtcactattttatttatagaatagtgattttgatcttattggaatgataaactgctcatgt

SEQ ID NO: 38761 - DNA, 95 bp, Homo sapiens; identical to SEQ ID NO: 580

SEQ ID NO: 38762 - DNA, 93 bp, Homo sapiens; identical to SEQ ID NO: 69

SEQ ID NO: 38763 - DNA, 117 bp, Homo sapiens
ggatgttgtgaggattgggaataacatagctatgtgctcaaactattgttataaatattatcaaagtatattattattattactgactactctgtgagttccaaattagcatagccc

SEQ ID NO: 38764 - DNA, 95 bp, Homo sapiens; identical to SEQ ID NO: 68

SEQ ID NO: 38765 - DNA, 93 bp, Homo sapiens; identical to SEQ ID NO: 69

SEQ ID NO: 38766 - DNA, 99 bp, Homo sapiens
gctttggctaggacttccagtactatgttgaatgagagtgatgagagtgggcatccttgtcttgttccacttctcagtggaattgggtccagcttttgc

SEQ ID NO: 38767 - DNA, 58 bp, Homo sapiens; identical to SEQ ID NO: 315

SEQ ID NO: 38768 - DNA, 85 bp, Homo sapiens
ccagatctaggagacattaaatgagagtatgacgcttttttattttattttttgagttggaatcttgctctgtcgcccaggctgg

SEQ ID NO: 38769 - DNA, 108 bp, Homo sapiens
actcagctagattaggaactccatgatggcaaggattcaagcacagttataggtgtgaactatatttgttttgttttaattcctggggattctgcatatcttttgagt

SEQ ID NO: 38770 - DNA, 58 bp, Homo sapiens; identical to SEQ ID NO: 391

SEQ ID NO: 38771 - DNA, 78 bp, Homo sapiens
ccattcattcatcattcaacacactgagcattgatcatatgatcactgttctaggcacttgaggacagaggaaggaat

SEQ ID NO: 38772 - DNA, 123 bp, Homo sapiens
gttactattttcaagtgattgcttatgtatgtgtgtgtatatatatatatatgcatgtatctatatatgtatgtatatatatagttatatatatatatataaaactgattatggttacatgta

SEQ ID NO: 38773 - DNA, 85 bp, Homo sapiens
ggatattaatcccttgttggatgaatagtttgcaaatattttctcccattttgcagattgtctattcattctgttgattgtttcc

SEQ ID NO: 38774 - DNA, 71 bp, Homo sapiens
cagaagagaggagacagcaatggtgtggctagcaaaccttagtgactgacagtgtcactctcccacctctg

SEQ ID NO: 38775 - DNA, 86 bp, Homo sapiens
ttggaaagaatttttctgtaaatctattagaaaaatttacatgaagtgtatatcattttttttgtaggtattatgaaactttccaa

SEQ ID NO: 38776 - DNA, 64 bp, Homo sapiens
ggtggcggtgtgcctctgtagtcccagctactcaggaggctgaggtaagaggatcacttgagct

SEQ ID NO: 38777 - DNA, 91 bp, Homo sapiens
ttgctgtatcaaatctgcaacaaattagctgtgtggtcatcggtatgttcccacctctgtgactcagtgtctttgtgtgtagagtgcccaa

SEQ ID NO: 38778 - DNA, 123 bp, Homo sapiens
gtgtaggtgagaatgttggagaactagaatttttttttctttttttgagacggagtctcactctgtcacccaggctggaatgcagtggcactatctcgtctcactgtaatctctgcctcccag

SEQ ID NO: 38779 - DNA, 92 bp, Homo sapiens
gcacttgctgctagttaaagccccagctttttctctgaagtatgacatgcaaatagtagagtgagagctgagataggaaaagaggcatagca

SEQ ID NO: 38780 - DNA, 107 bp, Homo sapiens
cctttactgaaagaaaaccttctttgtcatgataatacattgtatattttacatataactttgtttgaatctttaaaattcttagagggtttgctttcatgtcatgg

SEQ ID NO: 38781 - DNA, 68 bp, Homo sapiens
gaggcaagaggattgcttgaggccacgagttagagataagcctgggcatcacagtcagtctctgtctc

SEQ ID NO: 38782 - DNA, 108 bp, Homo sapiens
atattgatttaggtatatttaattagttcattttaaagattgtggtagtttattgtatattacaatttacccactttcctctttgctgaatttttcctttgttagtat

SEQ ID NO: 38783 - DNA, 93 bp, Homo sapiens
attgcattgtaatcagataatcagacaacattgagtgcagtattcccacttggagatattcaccgagtttttatttatgttacagtatgtaat

SEQ ID NO: 38784 - DNA, 106 bp, Homo sapiens
acatatgcatgtatccatgcatgtgtacatatttatatgcttatgtatatgtatgtatacatatatatatacatgtgtgcgtttgtgtgtgtgtgtgtgtgtgtat

SEQ ID NO: 38785 - DNA, 86 bp, Homo sapiens
agaagtgaaacattaaaatgcttggtaatggtgagccagggaattctctgtgttattcactgattaaagccttcgagttcactttt

SEQ ID NO: 38786 - DNA, 95 bp, Homo sapiens; identical to SEQ ID NO: 580

SEQ ID NO: 38787 - DNA, 93 bp, Homo sapiens; identical to SEQ ID NO: 69

SEQ ID NO: 38788 - DNA, 78 bp, Homo sapiens
aatctggagtttacagttgggtgaatatttatatctgtattcacaggcataaacattaaccggatcaagatctagatt

SEQ ID NO: 38789 - DNA, 116 bp, Homo sapiens
tgttctttttgtttagtattgtcttggctatgcgggctctttattggttccatatgaaatttaaagtagttttttctaattctgtgaagaaagtcaatggtagtttgatgggaata

SEQ ID NO: 38790 - DNA, 95 bp, Homo sapiens; identical to SEQ ID NO: 68

SEQ ID NO: 38791 - DNA, 93 bp, Homo sapiens; identical to SEQ ID NO: 69

SEQ ID NO: 38792 - DNA, 58 bp, Homo sapiens; identical to SEQ ID NO: 1409

SEQ ID NO: 38793 - DNA, 97 bp, Homo sapiens
ctggtagctaggtcaaatggcagcagggagaggtggtaggatgaatatgaatattttccttctaatattctgcctgtttttgtttactagttactgg

SEQ ID NO: 38794 - DNA, 97 bp, Homo sapiens
gatgatgttttatttttacataatttcataaaatatgtatatgaatgtacatagatgtgtcatatatatgtgtgtatgtatatgtgtgaacattatc

SEQ ID NO: 38795 - DNA, 107 bp, Homo sapiens
ggtaatttactataaaggattgttggcataattttctgatcaaaaaataatgaaaattattttttgttgtagggtgtttgtttttttgcagctatttaagtagtacc

SEQ ID NO: 38796 - DNA, 100 bp, Homo sapiens
ggatttggaaaataatcttgtgagctgtctcttttcctttactttttttttttttaatatcagagagttggccgggcgcggtggctcacgcctgtaatcc

SEQ ID NO: 38797 - DNA, 95 bp, Homo sapiens; identical to SEQ ID NO: 68

SEQ ID NO: 38798 - DNA, 93 bp, Homo sapiens; identical to SEQ ID NO: 69

SEQ ID NO: 38799 - DNA, 89 bp, Homo sapiens
gaagtaataggatgtgtatatgtacatatatatacgtatatatgtatatatacgtatatatatgtatatatgttcacaccaagactatc

SEQ ID NO: 38800 - DNA, 112 bp, Homo sapiens
tagagaggaagaatctgttattctataaaactggaaataaaaagacaatgtaatcaagttcatatttattttttatttttatttatttgtattttgagacagggtctctctg

SEQ ID NO: 38801 - DNA, 197 bp, Homo sapiens
ataaatatgtgtgtgtgtgtgtatctgtgtatatatatgtgtatatatgtatatatgtgtatacatatgtatgcatatgtgtgtatatatatgtatgcatatgtgtgtatatatatgtatgcatatgtgtgtgtgtatgtatgtatatatatatatatacatacatacatacacacacacatatacatacatagtgc

SEQ ID NO: 38802 - DNA, 116 bp, Homo sapiens
cagaatgggcaattcctatataatgttcatgattgtctgttgaaaagtttatttgaattttttaaatcttattttctttatagattacattctacatatattaaatgtgctttttg

SEQ ID NO: 38803 - DNA, 108 bp, Homo sapiens
atgttgcctttgaagtcatttttaagtatatatacatatatatatgtatttagggtataaaacatgatgttttgatatgtgtacattgtggaatggttaagtcaatat

SEQ ID NO: 38804 - DNA, 66 bp, Homo sapiens
ctcccttcctcttgctccaaatgaatactttctaagaaagtatttcaagtggaaggagaaagaggg

SEQ ID NO: 38805 - DNA, 88 bp, Homo sapiens
tatgttgaatagaagagatgagagacagcacccttgtctggtgccagttttcaagggaaatgttttcagcttttgcccattcagtatg

SEQ ID NO: 38806 - DNA, 86 bp, Homo sapiens
tattgggaatagcatagcaatgaagatgtgagtgcatgtgtctttttggtacaatgatttatttttctttgaatatatacccagta

SEQ ID NO: 38807 - DNA, 86 bp, Homo sapiens
gattgccctttatttctttctcttatcctattgctctggctatgacttcggtagtatgttgaatagaagtggtgaaaatgggcatc

SEQ ID NO: 38808 - DNA, 95 bp, Homo sapiens
gtaggacctagaagcatacagatagaggaaatgatagttacttgacttttctcatctatctatctatctatctatctatctatctatctatctat

SEQ ID NO: 38809 - DNA, 95 bp, Homo sapiens; identical to SEQ ID NO: 68

SEQ ID NO: 38810 - DNA, 93 bp, Homo sapiens; identical to SEQ ID NO: 69

SEQ ID NO: 38811 - DNA, 87 bp, Homo sapiens
gagttttgctcttgtcacccaggttggagtgcaatggtgcgatctcggctcactgcaacttctgcctcctggcttcaatcgattctc

SEQ ID NO: 38812 - DNA, 96 bp, Homo sapiens
tctctgaggcttgggactgtatttttttttctatagtcaacaaatctcccatgattttgtttctttgtagatgaattggggtagaggtagcagaga

SEQ ID NO: 38813 - DNA, 88 bp, Homo sapiens
ttgtgtacctcttgtctgggtctgagactgacggtcagcaaggccaggagtccaaaagaagagcttgacacatagttgagatgcatag

SEQ ID NO: 38814 - DNA, 120 bp, Homo sapiens
tatatgtatgtatatatacatatatatgtatatatgtgtgtatgtatatatacatatatgtatatatgtgtatgtatgcatgtgtgtatatatatacctatacacacatatatatgtatg

SEQ ID NO: 38815 - DNA, 74 bp, Homo sapiens
catttcgtttggttttcacataagccatcctgactagaacataaattgttcttgtgtggaaaccattacctatg

SEQ ID NO: 38816 - DNA, 127 bp, Homo sapiens
tgccacatattgtctgtgtttgtgtgcatgtttttatataaattttgacttttattatagatttgtatatattttatggtagtaaatggtaaacaatatgtatatattttatgcattcaagatagac

SEQ ID NO: 38817 - DNA, 95 bp, Homo sapiens
cttgcactttggttcactctctctctctgcctcagcatgcacaaagaagagggcatgtgagcacacagtaagatggcagcttcccacaaggcaag

SEQ ID NO: 38818 - DNA, 114 bp, Homo sapiens
tcattcttttttatggctgagtagtattccatggtatgtatgtatgtatttatgtgtatacatatatgtatgtgtatatatatatcacattttctttatccacccattgattga

SEQ ID NO: 38819 - DNA, 71 bp, Homo sapiens
cggcctgaaaactctgctctgtcacttggccaaaggagatgccaaatcagagtggctgttcagcagcaccg

SEQ ID NO: 38820 - DNA, 95 bp, Homo sapiens; identical to SEQ ID NO: 580

SEQ ID NO: 38821 - DNA, 93 bp, Homo sapiens; identical to SEQ ID NO: 69

SEQ ID NO: 38822 - DNA, 56 bp, Homo sapiens
ttctgctgctgtctcactttcttgcatttcaggtacagtgagtcagtctctcagaa

SEQ ID NO: 38823 - DNA, 56 bp, Homo sapiens
tgagacagggtctcactctgtcacccagaccggagtgcaggtgtgatctcggctta

SEQ ID NO: 38824 - DNA, 90 bp, Homo sapiens
tgcacccaggtttccaggtgaaagttggatttcaaaagaattttttttttttttgagacactctcactctgttgcccacgctggagtgca

SEQ ID NO: 38825 - DNA, 119 bp, Homo sapiens
acacccaggcaagcgtgacttcagagcctgcaacctttatctttgtgttatgagagttattttttctttgttaacaaatttctgggataatgttgaattctgaggcagaatgatgtgtt

SEQ ID NO: 38826 - DNA, 107 bp, Homo sapiens
atgctcagaattttcaaaaagtatagagtgagattgtgtgtgtgcatgtgcacgtgtgagtgtggtgtgtgtgcatattcacgagtatgttggggacaggtgaggat

SEQ ID NO: 38827 - DNA, 78 bp, Homo sapiens
gtgtgattttgtggttctgatttgcttgttagtgaacttccaagtgacttggaaaataccatccagttgggattagac

SEQ ID NO: 38828 - DNA, 108 bp, Homo sapiens
gtttttatggctatgagggcatgagggatggaaaggagtcaagtgattttcaagtttctggcttgagtaatttgttcatttgtgcttctgtttatggttttaaggaac

SEQ ID NO: 38829 - DNA, 58 bp, Homo sapiens; identical to SEQ ID NO: 28395

SEQ ID NO: 38830 - DNA, 62 bp, Homo sapiens
tgacacatacatagcttcagtgaaaattgactgttgtcataagtcactgagattttgtgtca

SEQ ID NO: 38831 - DNA, 80 bp, Homo sapiens
tccggaactcagtttctctctgtctacctctggatttccatgtgcagacactttaggcactaagaaaagctgaggttgga

SEQ ID NO: 38832 - DNA, 79 bp, Homo sapiens
gtatagatacctatatatgtgtatatatatacttgtgtatacagcttaagtatatatatacacatatatcattttatat

SEQ ID NO: 38833 - DNA, 85 bp, Homo sapiens
agcctacatctttctcccatgctgggtgcttcctgccttcgaacatcagacttcaagttattcagctttgggactcagactggct

SEQ ID NO: 38834 - DNA, 73 bp, Homo sapiens
gtagctcaacttcaaggtcttattgacaattcagttacacctgagaggtagtaccttgtgtggttggtgcttc

SEQ ID NO: 38835 - DNA, 67 bp, Homo sapiens
gagacaggatctctctctgtcacccagactggagtgccactggagtgcagtgatgtgattatagctc

SEQ ID NO: 38836 - DNA, 62 bp, Homo sapiens
atgcatatgcacacatgcatgtacatatatgtatatatgtatatatatgtaggcatatacat

SEQ ID NO: 38837 - DNA, 106 bp, Homo sapiens
gcacttttcacgggtgagttctatgatgtttgtattgctttttctcttcactgatcatcagttaagaaaacaactgtctagaagtagtgtttaccagcagaagggc

SEQ ID NO: 38838 - DNA, 99 bp, Homo sapiens
agattgtcatctgcacctctgccttaggtaatactgggtgtgtgtgtgtgtgtgtgtgcgcacgtgtgtgtgcctttgcatgtgtttgaaatatattct

SEQ ID NO: 38839 - DNA, 105 bp, Homo sapiens
ctctgacacaatattggagagccaaaaggaaaggacattttgggttgaaattttttcttttaaaaatgtgtccttgagttctattaacaatagctgaagcctggg

SEQ ID NO: 38840 - DNA, 91 bp, Homo sapiens
cccagatactacatcaagggcattgtgtgagtctctgagacttcattacttcagttgagactcagcacattcctacctgtggtggctgtgg

SEQ ID NO: 38841 - DNA, 118 bp, Homo sapiens
atatagtttatataaactatatgtattatatatagtttatacatactatatagtatatatagtttatatatactatatagtatatatacagcatatgtatagtttatatatactatat

SEQ ID NO: 38842 - DNA, 65 bp, Homo sapiens
tctagatatacatatagctatattttttgatatacatatatatagtctgtgtgtatatatataga

SEQ ID NO: 38843 - DNA, 87 bp, Homo sapiens
gtattatatatctatataaaacatgtattatatatataatatattttatatatatatatatattatatgtatatatgtatctgacac

SEQ ID NO: 38844 - DNA, 83 bp, Homo sapiens
caggaggtcaaggctgcagtgtgccatgttcccaccactgccctccagcctgggcaatagcagactctgtctctctctctctg

SEQ ID NO: 38845 - DNA, 99 bp, Homo sapiens
gcagctgagtgtgacccatgggagacagtgcagggtgggaagaaggggaggccagcgtctctccctcactctgcctcctggggtttccacagcagctgc

SEQ ID NO: 38846 - DNA, 130 bp, Homo sapiens
atccatatatatacagatatagttagatatatatgtctatatatatgtttattatctatatccatatatgtctattatacatatgtctatatatgtgtatatatatgtgtgtgtgtatatatatgtctat

SEQ ID NO: 38847 - DNA, 95 bp, Homo sapiens; identical to SEQ ID NO: 68

SEQ ID NO: 38848 - DNA, 93 bp, Homo sapiens; identical to SEQ ID NO: 69

SEQ ID NO: 38849 - DNA, 96 bp, Homo sapiens
tggcagatattatttgtctttagctatacagtggttgattatacagacagtgatgattagcattgtatatatgtatgtataaagtaatctctccca

SEQ ID NO: 38850 - DNA, 84 bp, Homo sapiens
ttacaggcatgagacaccgtgcccggctggtggtgagttttaaaatctcccagtgtctccgtgtctcagtgtttctacctgtag

SEQ ID NO: 38851 - DNA, 110 bp, Homo sapiens
tacagtgttgttctttttgcttaggattgtcttggctatgtggactcttttttggttccatatgaaatttaaagtagttttttctaattctgggaagaaaatcaatggta

SEQ ID NO: 38852 - DNA, 86 bp, Homo sapiens
tctggaaacatgttagaaatgccaaatcccagtctctagctcagaacaactgagtcagaatcttgtattttaataaaattttcagg

SEQ ID NO: 38853 - DNA, 115 bp, Homo sapiens
agatgaagtaagtttccggtagttagcatatagttgggtcttgtgtttttgttattattttcggttttaaaaaaaattctgccactctatatcttctaattagggactttcattt

SEQ ID NO: 38854 - DNA, 74 bp, Homo sapiens
tatatatgcatgtatacaagtatatatatacacatatatacatgtatatatatacttgtatacatgcatatata

SEQ ID NO: 38855 - DNA, 70 bp, Homo sapiens
tatatgcatgtatacaagtatatatatacatgtatatatgtgtatatatatacttgtatacatgcatata

SEQ ID NO: 38856 - DNA, 74 bp, Homo sapiens
gtgtatatatgtatatatgtgcatgtatatatatacatatatatatacatgcacatatatacgtatgcatatgc

SEQ ID NO: 38857 - DNA, 98 bp, Homo sapiens
ccgcaatgcattatcctttttatacattgttggattagatttgctaatactatattaagaatgtttgtaactatgttgatgaggatatagttctgtgg

SEQ ID NO: 38858 - DNA, 143 bp, Homo sapiens
gagttatctaaaaaaagcatgtgggtgtaactctagaaattgctcttgtctaatctcactgagaagtgattttgttgtggtcatcttagtcatccactgatttctctctcttagttgttaccaagctatttctaaaaggagtt

SEQ ID NO: 38859 - DNA, 56 bp, Homo sapiens
gttgactgtacttgaatctacattcaaagaatgtagatttaatttgtaaatgcaac

SEQ ID NO: 38860 - DNA, 90 bp, Homo sapiens
gcagatggagctatggggtaggtgaaagtatagagtgttctgaattgacagaaatatatgttttttttttaccagtatgccaagtaatgc

SEQ ID NO: 38861 - DNA, 76 bp, Homo sapiens
ggccttcttacctgtgtctctgtgactcggcgtgtcctctccttttttataaggacaccagtcattgacttaggcc

SEQ ID NO: 38862 - DNA, 97 bp, Homo sapiens
agcattagtttctgaatttgtgcttctttatgatgtatgattatatatttgtgcttatacattttaataaagagtgtgttttgatgtaaacagtgct

SEQ ID NO: 38863 - DNA, 111 bp, Homo sapiens
attaagtttaatatgtattaatagtaagtttaatatttatatttatataataatattataaaggtaaccgatattacatttaaggttaatattgttatgtatgaatttgat

SEQ ID NO: 38864 - DNA, 109 bp, Homo sapiens
tctgaaaatgaacttcatttactaacagtattggatacttgcataatatatatggaaaatatatataaattataaagcacaatactgttatgaagttagattattatga

SEQ ID NO: 38865 - DNA, 118 bp, Homo sapiens
gatgatgtacatgtatacagtgcctggcctcatgatcaccgagtccactgcaactttttatttttttttccatacagggtctcactctgtcacccaggctgagtacagtggcataatc

SEQ ID NO: 38866 - DNA, 103 bp, Homo sapiens
tttacatttttgtcctcaattttttgtatactattataaatgatgttataattttagatttttcatttatgatagattatcaaaagagaaaatcgtatgtaaa

SEQ ID NO: 38867 - DNA, 100 bp, Homo sapiens
ggttgtatgcagtagcaagcatgtactagaatgataaaaaccaaggggcttaccacaagatctctctatctctgtctctagctttgtctgcatactggct

SEQ ID NO: 38868 - DNA, 106 bp, Homo sapiens
gaatacatatgtatgtatatataactgaatgtgtaggtatattatatatattacatatatataataaatataactgtatatgtatgtgtgaatatgtgtatttacc

SEQ ID NO: 38869 - DNA, 113 bp, Homo sapiens
caggagatattacaattatatgtatatgtgtatgtatatatatatgtgtgtgtgtatatacatatttttatatatatatatatatatatatatgcatttttttttcttttttg

SEQ ID NO: 38870 - DNA, 116 bp, Homo sapiens
gtagagaagagttcgcattaggttaatagtaaaactggatatttttttctctttaaaagtgaagtgagatactaaaaatgaatatttattatatgtaatggcacatcattttctgc

SEQ ID NO: 38871 - DNA, 114 bp, Homo sapiens
gtatattttcccagaaaatataaagtgggaatgtttttatttatttatttattatttttgcagttgcaagatttaatagagtgaaaacagagctcccatgcaatgggaggggac

SEQ ID NO: 38872 - DNA, 78 bp, Homo sapiens
gcttgagacagcagacagtcatcactgcatggtttctgtgggtcaggaatccaggcgtgactcagctgggttcagtgc

SEQ ID NO: 38873 - DNA, 72 bp, Homo sapiens
gaagtaggtggtatagtatagagacttccagatcaggttttgaagtcaatttcactgtttgaagcctggttc

SEQ ID NO: 38874 - DNA, 90 bp, Homo sapiens
tgtcttcacattatcagaagagtttttgaagaagggggttgtattttactgatctgtttattctgaggagtcttatcgaatgtgttgata

SEQ ID NO: 38875 - DNA, 106 bp, Homo sapiens
cttaaatagaagacctcaaactatgaaaatcctacaaaagctaatgattttatttaatctaatttttaacttttgtgggtacatagtaggtatatatatatttatg

SEQ ID NO: 38876 - DNA, 92 bp, Homo sapiens
ttaacacgaatttctacagatcttattttatttagtttatatctgcatcctccaccaggatataaattccatgaaggtaggaatcttgttga

SEQ ID NO: 38877 - DNA, 117 bp, Homo sapiens
tatacaattttatagttatgtgcattaatataagtgaacataaataatagtatatattaataatacatatgctattataaggtaacataaatgcatatattatctatattatgtatg

SEQ ID NO: 38878 - DNA, 103 bp, Homo sapiens
ctgagatgtttagtgttttcttatttttttagttaatttatgttctatatatccgcattaatgtgaatttctagaagtgtgaatttaaactgtttcaactcag

SEQ ID NO: 38879 - DNA, 70 bp, Homo sapiens
tatatatgtatatatgtgtatatatgtatatatgtgtgtgtatatatgtatatatgtgtatatatatgta

SEQ ID NO: 38880 - DNA, 74 bp, Homo sapiens
gtgtgtgtctctctctatatatatatgtaatgtgttcatacacacatatatatgtgtgtggcagtaatatttat

SEQ ID NO: 38881 - DNA, 60 bp, Homo sapiens
ctgtgcacctgtagtcccagctactcaggaagctgaggtaggaggatctattgagctcag

SEQ ID NO: 38882 - DNA, 87 bp, Homo sapiens
gcaggggccagatgggaaatggagtgtcctttcattatgagaccacagtgagagactttttttttttttccagagtctcgttcttgc

SEQ ID NO: 38883 - DNA, 95 bp, Homo sapiens; identical to SEQ ID NO: 68

SEQ ID NO: 38884 - DNA, 93 bp, Homo sapiens; identical to SEQ ID NO: 69

SEQ ID NO: 38885 - DNA, 98 bp, Homo sapiens
cttgatccagggaatgagtatttcaatttaacattttaggtagggggaagaaagctttttttttttcttataaattgaagtctaaagttggaaacaag

SEQ ID NO: 38886 - DNA, 92 bp, Homo sapiens
ttttgggtatattttcagcaacaccccactctactggtaacaatttactgtattagtctgttttcacagtgttgataaagacatacccaaga

SEQ ID NO: 38887 - DNA, 104 bp, Homo sapiens
acatatatgtgtatatatatatatgtatatacatatatgtatatatgtgtatatatatatgtatatacatatatgtatatatgtgtatatatgtatatctcata

SEQ ID NO: 38888 - DNA, 80 bp, Homo sapiens
tagaaatttattttactttacattttagctgctttggttagtccttatcaggggaagcttgtcagtaggaatgatttctg

SEQ ID NO: 38889 - DNA, 111 bp, Homo sapiens
ctgctaggtcatgcaggctgtcagggaagtgggggaaagctggcagtcagtgaagggctggtctcactctcactgtgcccctacaacagcactgagtctatttccaggcag

SEQ ID NO: 38890 - DNA, 102 bp, Homo sapiens
gaaaatcacagcacattagagatctttgtgcatccttttagatactttaaatttattaaaagtgtactagaggaggccatctctctcaaaacagaatttttc

SEQ ID NO: 38891 - DNA, 105 bp, Homo sapiens
atactaaagaaacatttggcaatttgcactttcactgtctctttttttttatactttaagttctggggtacatgtgcagaaagtgcaggtttgttacataggtat

SEQ ID NO: 38892 - DNA, 65 bp, Homo sapiens
gagactctggaaaataatcccagaaaattatttgtttttctttgtttgttttgagacggagtctc

SEQ ID NO: 38893 - DNA, 78 bp, Homo sapiens
tgtgtgtgtttatgtgtataaatgtatacatatatgtatatgtgtatatgtatatatgtatacacacatacatatata

SEQ ID NO: 38894 - DNA, 74 bp, Homo sapiens
gttgttgttgttgagacagtctcattctgtcacccaggctagggtgcagtggtgccatctcagctcactgcaac

SEQ ID NO: 38895 - DNA, 99 bp, Homo sapiens
tcagaatgttgctgatctcagatctgtctgtggtaagaaaacatatttttatatatgtttaatacaaagacatttagaagattgagtgatcaaatttga

SEQ ID NO: 38896 - DNA, 110 bp, Homo sapiens
gctatcttatctgtgttttactatctgccctttctgcttgtagttaggacagaagtgatttccttgaaatgcatgaggctagaaagggagctggaacttaaagtggtggt

SEQ ID NO: 38897 - DNA, 94 bp, Homo sapiens
ctcttgcaattttgcaactgtcagcaaaggtagtcttgagttttcaaatttttatttaagaagcttttggatgataggaaaggcagttaaagag

SEQ ID NO: 38898 - DNA, 84 bp, Homo sapiens
tctatgtgatatatatttatatataatttaaaatttatgtatgtatggatatatgtacatatatatgtatgtatatctcaaaga

SEQ ID NO: 38899 - DNA, 104 bp, Homo sapiens
atgacagcttgatttatgagagaaaggaatcagacaagagagagtgctggcaaaagacatgagactagcaagacagaagtcgcagtctttcataactcaatcat

SEQ ID NO: 38900 - DNA, 89 bp, Homo sapiens
gataaagaatagagtagtgattaagagcacagagcacagagtctgcagacacactgagtttgtttcaaatcccagctcttttcattatt

SEQ ID NO: 38901 - DNA, 70 bp, Homo sapiens
gctgctttgcctctgctgtccattagggtaagtgtgcccaccttgcctttgacagttgagtgtcaccagt

SEQ ID NO: 38902 - DNA, 113 bp, Homo sapiens
tagctggaagagaaagtgggccaagataatttgtctttataaaattggcaggttttttttttttttttatagaattgcaagttagcttgatgttgatggatatgatccagttg

SEQ ID NO: 38903 - DNA, 95 bp, Homo sapiens; identical to SEQ ID NO: 68

SEQ ID NO: 38904 - DNA, 93 bp, Homo sapiens; identical to SEQ ID NO: 69

SEQ ID NO: 38905 - DNA, 122 bp, Homo sapiens
atgtggattatatatctatatatgtttagtatataacatgtatgtaattatatgtttattatgtatagtacatagtttatatatagtatatattcttatacactttatatgtagtacatata

SEQ ID NO: 38906 - DNA, 107 bp, Homo sapiens
ctgatgccaagagatagggaaaagggaatggcagggatgggatggggaaaggaactgtctggatatgttatgtaaatgtctttgtaaagacctattgttggggtgag

SEQ ID NO: 38907 - DNA, 95 bp, Homo sapiens; identical to SEQ ID NO: 68

SEQ ID NO: 38908 - DNA, 93 bp, Homo sapiens; identical to SEQ ID NO: 69

SEQ ID NO: 38909 - DNA, 92 bp, Homo sapiens
tctaatatgagtttgttcatatgtgtgtatatttatatgtatctatatatgtacatactgcatgtataaactttttataaaatacaattagg

SEQ ID NO: 38910 - DNA, 114 bp, Homo sapiens
acatcatgttgtacactatatattatatatggtatacaactatatatatttgtttggtgagctttggtgtcaaggcatgtactgatgtgccttgacaccatacctcaccaaata

SEQ ID NO: 38911 - DNA, 109 bp, Homo sapiens
gggagaggtcaagcactaacaaaattaaagtgaagggaaaaggatagtttcttgctggtatctatatttttctttttctttttttttattattgtttttgcctccttct

SEQ ID NO: 38912 - DNA, 109 bp, Homo sapiens
ttgtgtataatatatatgtatatgtacacacatgaacacacatgaatatatactttatgtatatattaggtatctctatgcatatgtaccacatatatatgctatgcaa

SEQ ID NO: 38913 - DNA, 144 bp, Homo sapiens
acacatatattcatatatatgtgtgtgtatatatacacatatattcatatatgtgtctgtatatatgtgtgtatatatgtgtatatatatgtatatatacacatatatacgtgtgtgtgtatatatatgtgtgtgcgtatatat

SEQ ID NO: 38914 - DNA, 95 bp, Homo sapiens; identical to SEQ ID NO: 68

SEQ ID NO: 38915 - DNA, 93 bp, Homo sapiens; identical to SEQ ID NO: 69

SEQ ID NO: 38916 - DNA, 76 bp, Homo sapiens
gcaggtgtgagccaccgcatccggtctcgaacagaaattcctttttttttttttttgagatggagtctcactctgt

SEQ ID NO: 38917 - DNA, 97 bp, Homo sapiens
gtcattattctctctggttttgctattgttattatgttgctatatttaaatttaatgaagcatttattctcaatcaagaagaccattgagatgatac

SEQ ID NO: 38918 - DNA, 125 bp, Homo sapiens
cctaggcttctgtgtttagtggctccaccatttcctccctgtatctgatagatccatgagggaagagagtgagaacagaggattgcaagggaagtttcatgagccagattgagaggtctggaggc

SEQ ID NO: 38919 - DNA, 95 bp, Homo sapiens
tgaaccctgcctaaatagcaaaattaatatttattgtttcaagctactaagtttgaggtggtttgttatattgccatagatatttagaagagtca

SEQ ID NO: 38920 - DNA, 113 bp, Homo sapiens
gattcaggatgatagttaaactctgcctgggtttcctgtctttgggcagaagtatggaaattctctcaagacagtgagctggggaaattgaagcgctcacattatctgttttc

SEQ ID NO: 38921 - DNA, 107 bp, Homo sapiens
ccccattcctagttctgccagtttgaataactactatatcaggcacattgtgattatatttctttatgtcagtggtattcaaaaggggatgagtttgctttctgggg

SEQ ID NO: 38922 - DNA, 59 bp, Homo sapiens
tatatgtatatatatgtattctaagttacttcacttagaatagtatatatatacacata

SEQ ID NO: 38923 - DNA, 82 bp, Homo sapiens
catacacatatttatatacacatatgtatatatacacatatatgtatatacgtatatatgtgtatatatgtatatatgtatg

SEQ ID NO: 38924 - DNA, 85 bp, Homo sapiens
gtataggtatactatacacgtgtataggtatacatacacatatgtatacatgtatgtatacctatacacgtataggtatacatac

SEQ ID NO: 38925 - DNA, 95 bp, Homo sapiens; identical to SEQ ID NO: 68

SEQ ID NO: 38926 - DNA, 93 bp, Homo sapiens; identical to SEQ ID NO: 69

SEQ ID NO: 38927 - DNA, 95 bp, Homo sapiens; identical to SEQ ID NO: 68

SEQ ID NO: 38928 - DNA, 93 bp, Homo sapiens; identical to SEQ ID NO: 69

SEQ ID NO: 38929 - DNA, 95 bp, Homo sapiens; identical to SEQ ID NO: 68

SEQ ID NO: 38930 - DNA, 93 bp, Homo sapiens; identical to SEQ ID NO: 69

SEQ ID NO: 38931 - DNA, 102 bp, Homo sapiens
agttgcatggtacttacagagagtctaagtggcgcttgcttgaacaggagactgtcagagtgcacactgtgcagaggctctgatttctgtgtccagggcact

SEQ ID NO: 38932 - DNA, 109 bp, Homo sapiens
gctattaatttgagttatctggataggtttaatcatattctctgtatatatggataattattttcatattattgaggttaggcgtgggttggatactctttagttttgt

SEQ ID NO: 38933 - DNA, 95 bp, Homo sapiens; identical to SEQ ID NO: 68

SEQ ID NO: 38934 - DNA, 93 bp, Homo sapiens; identical to SEQ ID NO: 69

SEQ ID NO: 38935 - DNA, 95 bp, Homo sapiens; identical to SEQ ID NO: 68

SEQ ID NO: 38936 - DNA, 93 bp, Homo sapiens; identical to SEQ ID NO: 69

SEQ ID NO: 38937 - DNA, 104 bp, Homo sapiens
gtgtgctggacatggtgactcgtgcctttaattgcagctagtcagaaggctgagaccagagactggcctaagcaacagcagagtgagaccctatctccacacac

SEQ ID NO: 38938 - DNA, 92 bp, Homo sapiens
atgttctcctgtgtgtatgtacatctatatatgtatatgtgcatacatgcattcatatatatgtatgtatatatacacacacacacatacat

SEQ ID NO: 38939 - DNA, 109 bp, Homo sapiens
atgttcattatggtaagctttgtctaaaggaacacatagatgacagcattagcgaactgtgtttctatatgtgtgatttaggaaaaaggcaattggtttaaatgggggt

SEQ ID NO: 38940 - DNA, 116 bp, Homo sapiens
agaatgatatatggatgtgtatttgtaaataaggatattcttaggtgaaacgtgcttttaattttatttattactattatcttatttactgatattgttattgttattatcatttt

SEQ ID NO: 38941 - DNA, 97 bp, Homo sapiens
agatgtaattttaattgatgttatattgtatatttaaaatataagaggggtttaatctatgttttatcatacagctgtaaaaattaatagttactct

SEQ ID NO: 38942 - DNA, 58 bp, Homo sapiens; identical to SEQ ID NO: 1847

SEQ ID NO: 38943 - DNA, 117 bp, Homo sapiens
atgtaatgtatccgtatgtatgtgtatataagtatgaatacgtatgtgtgtgtatgtagatatatttatatatataatgtatatgtaaatatgcacaggtgtaaatatatgttacat

SEQ ID NO: 38944 - DNA, 103 bp, Homo sapiens
cagtgagttatttgattacctgaaaccctaaagagacagagggaatgtgtgtatgtctgtgtgtgtgtgaaagggctggagggggcaatggggaatgtcactg

SEQ ID NO: 38945 - DNA, 110 bp, Homo sapiens
gcctgggcaacatggcaagaccttgtctctacaaaaaaaaaaaaaaaaaaaaaaaaaaaaaaaaaaaattgttttttttttgaaacagagtctcgctctgtcacccaggc

SEQ ID NO: 38946 - DNA, 81 bp, Homo sapiens
agggtctcactctgtcaccctggctgaagtggcatgatcatggctcaccgcagcctcagcctcccgggctcagatgatcct

SEQ ID NO: 38947 - DNA, 96 bp, Homo sapiens
tactttaatatggaattaatgccacagatatgggagtatattcatttatatatatatatatatatgcatgttagtagcttgtttcttaatgaagta

SEQ ID NO: 38948 - DNA, 129 bp, Homo sapiens
ccaaatctgctggcatgttgatcttggacttcccacccactagaacaataagcaatagatttattttgtttacaagctactcagtctaaggtattttgttatagcagcagggacatactaagtcacaca

SEQ ID NO: 38949 - DNA, 75 bp, Homo sapiens
ctgaacgtattttgaataagaagtcacactatgaaccagggtttacagaagagtgtgactaaaggttgagtttag

SEQ ID NO: 38950 - DNA, 58 bp, Homo sapiens; identical to SEQ ID NO: 33299

SEQ ID NO: 38951 - DNA, 86 bp, Homo sapiens
tagtgttgttgagaatgtttttcttttataaagaaaagaggtttaattagcctctgtgggctataaagaaagcacggcagcatctg

SEQ ID NO: 38952 - DNA, 95 bp, Homo sapiens; identical to SEQ ID NO: 68

SEQ ID NO: 38953 - DNA, 93 bp, Homo sapiens; identical to SEQ ID NO: 69

SEQ ID NO: 38954 - DNA, 79 bp, Homo sapiens
aaacagccaaagcaagagaaagagatgaagagagggggagcctcacacttttttttttgtttttgttttgtttttgttt

SEQ ID NO: 38955 - DNA, 123 bp, Homo sapiens
atatacatatcatatatgtacatattatatgtatatatcatatatgtacatattatatatgtatatacaatatatgtacatattatacatgtatatataatatacgtatattatatacatata

SEQ ID NO: 38956 - DNA, 111 bp, Homo sapiens
tatattatgcatataatatattatatattatattatatatataatatattagatatattacattatatacgtataatatattatatataatatattatacactataatata

SEQ ID NO: 38957 - DNA, 246 bp, Homo sapiens
atattatatgtatataacttgatatattacatattatatgtatataacttgatatattacatattatatgtatataacttaatatattacatagtatatgtatataatataatatattatattatatgtatataatataatatgttatatattatatgtatataatatatgtatataatattatatatattatatattatatatgtgtatatatgtacatattatatataatatacatatataata

SEQ ID NO: 38958 - DNA, 78 bp, Homo sapiens
tatataagcatatataagtgtgtatgtatatatatactttatatatatttcatatatatccttatatatgtgtgtgta

SEQ ID NO: 38959 - DNA, 113 bp, Homo sapiens
cacatatgtgtgtgtatatatatgtgtgtgtatatatatacatgtatatatacatatatatgtgtgcatatatatatgtgtatatatacacacacatatacatatatcccaca

SEQ ID NO: 38960 - DNA, 107 bp, Homo sapiens
tgtgggatatatgtatatgtgtgtgtatatatacacatatatatatgcacacatatatatgtatatatacatgtatatatatacacacacatatatatacacacaca

SEQ ID NO: 38961 - DNA, 192 bp, Homo sapiens
tatatatgtatacatgtgtgtgtatatatatataattgcctatgtgtgatatatgtatatgtgtgtatgtatacatgtgtgtatatatgtgcatatatatgtatgtgtatatatatgtgtatatgtatgtatatgtatatatatgtgtataatacatatacatacaggctaaatgtatatatatacacatat

SEQ ID NO: 38962 - DNA, 112 bp, Homo sapiens
acttgacagtaatctggcaggtgaggactttggctggttttatatatatttttaataagcaaaatcataatgtaaaattgatatagcaattcacagctactttatttcaggt

SEQ ID NO: 38963 - DNA, 115 bp, Homo sapiens
gtctggaatatgtctattttggtgaatgctttatgtgcacttataaacaatatatttattattgaaattgttgggtggagtgttctaaaatctcaattaggattatgtgtcagat

SEQ ID NO: 38964 - DNA, 128 bp, Homo sapiens; identical to SEQ ID NO: 12949

SEQ ID NO: 38965 - DNA, 95 bp, Homo sapiens; identical to SEQ ID NO: 12950

SEQ ID NO: 38966 - DNA, 93 bp, Homo sapiens; identical to SEQ ID NO: 12951

SEQ ID NO: 38967 - DNA, 80 bp, Homo sapiens
atatatttatatgtgtatatatgtgcatgtatatatatgtgtgtgtatatatgtgcatatatgtatgcctatatatgtat

SEQ ID NO: 38968 - DNA, 142 bp, Homo sapiens
gtcattttctttactgtaattgtttgctttgcccacacatcatttctggctgggtcactgagtcacagacagctttcttgaggatggctctctgcaggaatggctcagactgcaccatccaaaaagatgaagggcaccctgc

SEQ ID NO: 38969 - DNA, 130 bp, Homo sapiens
gcacagcttttctgatgtgtcctttgagctttgaggtttccttctccccaagacacatgtgagagagctgaggcaagcaatgtcagagtcttttcaagattctacattgtgctcctcttgccctatatca

SEQ ID NO: 38970 - DNA, 104 bp, Homo sapiens; identical to SEQ ID NO: 2711

SEQ ID NO: 38971 - DNA, 92 bp, Homo sapiens
gctcagtgccctgtacttggtagactctttttctttcttttttttttgtagggggagggggcagggtctcactctgtcgcccaggttggagt

SEQ ID NO: 38972 - DNA, 100 bp, Homo sapiens
gcctccctagtagctgagattatagacatatgccaaaatatcaagctatttttttttaagttttgtaaatatgaggtctcactgtgctgtctgggctggt

SEQ ID NO: 38973 - DNA, 115 bp, Homo sapiens
ggatttttttcttcatcttttgaggtgggtcattttattttatttttaatattcctttttaggtaaattacattgattttctaaagtgaaaaccttttatttctggggtgaattc

SEQ ID NO: 38974 - DNA, 73 bp, Homo sapiens
agtgactgtagtgagagagatgagggcaagatggaactgatgatggctagcaggtcttggctaagatgtcact

SEQ ID NO: 38975 - DNA, 86 bp, Homo sapiens
acctctgctgatctgacaggagagagagctcaggccataatgctggctctctcgcctgctgttcacctcctgctcttcagcctggt

SEQ ID NO: 38976 - DNA, 101 bp, Homo sapiens
aaacagctattttgaattctctgtctgaaaggtcacatatctctgtctctccaggactggcccctggtgacatatttcatttgtttggtatggtcatgttt

SEQ ID NO: 38977 - DNA, 197 bp, Homo sapiens
tatgtgtgtgtgtgtgtgtgtgtatatatatatgtatatatatgtatatataaatacgtatatgtgtatatatatatgtatatatatgtatatataaatacgtatatatgtatatatgtatatagaaatacgtatgtatgtgtgtgtatatatgaatatgtgtgtgtgtgtgtatatatatatatatatatattttc

SEQ ID NO: 38978 - DNA, 58 bp, Homo sapiens; identical to SEQ ID NO: 5218

SEQ ID NO: 38979 - DNA, 109 bp, Homo sapiens
tttggactctgcagttcatctgcattagggaggaccccatgctcagtatctctgtggctcttgaaggctcatagaggtacctccttgatggtcttggataagatctgga

SEQ ID NO: 38980 - DNA, 78 bp, Homo sapiens
taagtaaagtttctaactatactccttccttgctggggttgaataccacagaggaaagagttgtgaatatcttattta

SEQ ID NO: 38981 - DNA, 62 bp, Homo sapiens
gttgtgtcctacttggaaggctgaggtggaaggatcacttgagtctgggaggtggaggctgc

SEQ ID NO: 38982 - DNA, 119 bp, Homo sapiens
agtgatgtgcactttggtccccagcagcagtagtggcatttgagttgggtgacagtagagcctgtcctcagagtgtgtgtgcagcatcactgctgctggggtgggtttggattgctttc

SEQ ID NO: 38983 - DNA, 89 bp, Homo sapiens
ctttttctgtgagattttcaaggacaggaactgtgacttatgcgtctaggtgtcacagcctctcacataagatccaaaatcagaacaag

SEQ ID NO: 38984 - DNA, 76 bp, Homo sapiens
atatataggatatatatactatagtatatatgtatatatataggatatatatactatagtatatatgtatatatat

SEQ ID NO: 38985 - DNA, 106 bp, Homo sapiens
attcataaatgtgatattgcttgatgctgtaaatatctctatttgattatcaacatatagtctaggagataaactgtatgcttattagtttgtgacattcatggat

SEQ ID NO: 38986 - DNA, 82 bp, Homo sapiens
gtcctaatgtatatgtatatacatttttgtgtatataagccctaatacttatatacataaaaaacaggtgcatctggaggac

SEQ ID NO: 38987 - DNA, 105 bp, Homo sapiens
gtttcttttcattgattgcttcctttggtgtgcagaagctttttagtttgatatagttccatttatatatttttgcttgtgtggcctgagcttttgatgtgaaat

SEQ ID NO: 38988 - DNA, 110 bp, Homo sapiens
tcattttattggaattatatctatacatatatatgtataagtttataaatatataaattaacattattatatataataagcacatacatataggctgtacaattcaatga

SEQ ID NO: 38989 - DNA, 97 bp, Homo sapiens
gccattttttcccatcagagagagaacactggggccaagccataacacagaaaaaaatgagctgcctctttttcaggcttttgtgggtcaaattggt

SEQ ID NO: 38990 - DNA, 90 bp, Homo sapiens
cccagtacagctgccacttcacagttatctctctgtgaccactgagtaggcacagataagagagggcttcaaggctgcagcagctctggg

SEQ ID NO: 38991 - DNA, 68 bp, Homo sapiens
gtatatttaataggtgtgtatatgatatgtgtttgtatgtacacatatgtatatatgtatgtatatgc

SEQ ID NO: 38992 - DNA, 59 bp, Homo sapiens
aatggcagagtatatatatgtgtgtgtatatacatatatatatatatatatttgtagtt

SEQ ID NO: 38993 - DNA, 117 bp, Homo sapiens
tgctgtgtaagtattgtttcttatatatatatatgtacatatatatgtgtgtatatatatatatatacgtatatatatatatgcacaacatgcaggtttgttacatatgtatacatg

SEQ ID NO: 38994 - DNA, 78 bp, Homo sapiens
ccaggcattgtgaagttaccttgttggatgctgaatagttctgtatttctaaatgtgtacttttgagctttgtcctgg

SEQ ID NO: 38995 - DNA, 131 bp, Homo sapiens
tatatcttgtttctgtatatatctgtatatgcatatacagtgtgtgtatacatatatgtgtatatatatgtgtgtgtgtgtatatatatatatacccatacacgtatatgtgtgtgtgtgtatatatatat

SEQ ID NO: 38996 - DNA, 93 bp, Homo sapiens; identical to SEQ ID NO: 69

SEQ ID NO: 38997 - DNA, 62 bp, Homo sapiens
tatctatatatatatacacacatctatacacatatatatgtgtgtgtatatatatatatata

SEQ ID NO: 38998 - DNA, 219 bp, Homo sapiens
atatatatatatatgtatgtgtgtatgtatatatatatgcatatatatacgtgtatatatgtgtgtatgtatatatatatgcatatatatacgtgtatatatgtgtgtatatatatacgtgtgtatatatgtatatatgtgtatatatgtgtgaatatatgtatatatgtgcatatatatgtatatatgtgtatatatatacgtatatatatatatata

SEQ ID NO: 38999 - DNA, 113 bp, Homo sapiens
ttatcatttttacctgtgctttcatagtatgaaatttttgcaatttgattttatttaatatgtttgtgaagtttgtgcacattgacaggattgacactaggtgatttgtgtaa

SEQ ID NO: 39000 - DNA, 112 bp, Homo sapiens
tagcaggatttcctcctttttatgattgaataatattttattgtgtttatatatatatatttatataccacattttctatatccattcatacattgatggagatttaggttg

SEQ ID NO: 39001 - DNA, 94 bp, Homo sapiens
gagagaggaatgactatatatatatatgaatgactatatatatatatgaatgactatatatgtatatatatatatatataggaatggctatttt

SEQ ID NO: 39002 - DNA, 81 bp, Homo sapiens
gtgtgtgtgtgtgtgtgtgtatatatatatgtgtatgtgtgtgtgtatatatatatgtatatatatgtatatatatatatg

SEQ ID NO: 39003 - DNA, 76 bp, Homo sapiens
gacatatatatatatcctagtatactaagacatatatatatatatgtcttagtatactaggatatatatatatctt

SEQ ID NO: 39004 - DNA, 111 bp, Homo sapiens
tgcttaggattgtcttggctatgcatgtgatttttttggtaccatatgaaatttaaagtagttttttctaattcggtgaagaaagtcaatggtagcttgatgggggtggca

SEQ ID NO: 39005 - DNA, 118 bp, Homo sapiens
ttgagagcattacagatggaccatgttgctgtgttgaaattccaatcagtttctttttgttttaaaagagatggttaactcattttacaggtaattaaggacatcattttttgatcag

SEQ ID NO: 39006 - DNA, 110 bp, Homo sapiens
gtcttctgtgtgtgtgtgtgcgtgtgtgcacgtgcatgtgtgtatgtatgtatatttggaccgaattttatatatatatatgtgtatacacacacacacacacacacaca

SEQ ID NO: 39007 - DNA, 115 bp, Homo sapiens
gatccaagtcccaagaaagtaacataaagaagcacataggcagagttaaaattttttctgttaaaattctgacaatattgcttcgttttcttctgaggtttagtgctgtggagtc

SEQ ID NO: 39008 - DNA, 102 bp, Homo sapiens
ggaaactcatgctcagcttttcaccattagagaactttgtttgtaattgtgaaatcaatttattagtttttttgttgaagaataattgcatgaaaagtcacc

SEQ ID NO: 39009 - DNA, 102 bp, Homo sapiens
gaaaggttgctctgggagaggaatagtagacagaccattaggtgaccagccagcagtcatctctctgtttctgtgattttcctgttattaagcagcacactc

SEQ ID NO: 39010 - DNA, 70 bp, Homo sapiens
gggtacacgtgcacaacgtgcaggtttgttacatatatatatatatgtgtcatgttggtgtgctgcaccc

SEQ ID NO: 39011 - DNA, 91 bp, Homo sapiens
aatgaggtaatgatgcaaggagttcggccacgtccctggaccataataggagtcaggtcatgctgttagctagttgtacatgtgtcttatt

SEQ ID NO: 39012 - DNA, 108 bp, Homo sapiens
tgtgttttatatgtatatacatatattccttatataatatctaagtgtgtgtatatgggtgtgtatatatatatatatatatatatacagacacacatatacacacac

SEQ ID NO: 39013 - DNA, 94 bp, Homo sapiens
ttatatgtgtgtgtatgggtacatatgtgtgtgtatatgtgtgtctgtatatatatatatatatatatatacacacccatatacacacacttag

SEQ ID NO: 39014 - DNA, 107 bp, Homo sapiens
ggtatttgagagagagagacagacaaaccacattcatataacctttattacattatattgttataattgttctatgttattagttactgttaatatcttattgtgcc

SEQ ID NO: 39015 - DNA, 58 bp, Homo sapiens
tgaaacagagtctcgctctgtcacccaggctggagtgcagtggcgcaatctcggttca

SEQ ID NO: 39016 - DNA, 73 bp, Homo sapiens
gtctatatatatgtgtatgtgtgtatatatgtatatatacacatgtttgtgtatgtgtgcgtgtgtgtgtata

SEQ ID NO: 39017 - DNA, 104 bp, Homo sapiens
cacatattgattttgtatcctgtaactttactgaatttgtttatcagttctaagagttttttggtggagtctaggtttttctatatataagatcatgtcctgtg

SEQ ID NO: 39018 - DNA, 107 bp, Homo sapiens
gagaacatcctgttgattggtctctgactcttaatactctgatatttttgtctaattgcaatgaaaagatctaagtaaggcttaggacagaaaacagagcagttctc

SEQ ID NO: 39019 - DNA, 66 bp, Homo sapiens
tgtatatgcacatacatatatcaatatatgtatatatgcatatatgtatgtgtgtggaaatgtata

SEQ ID NO: 39020 - DNA, 90 bp, Homo sapiens
cagtgtgagatacgtgtgtgtgtatttgtatgtgtatatatatgtgtgtgcatatatatgtatatgtatatgtatatatgatgaagtctc

SEQ ID NO: 39021 - DNA, 69 bp, Homo sapiens
ggggtgtgtgtgtgtgtgtgtgtgtgtattttagggatggggtctcactctttcactcactgcagcctc

SEQ ID NO: 39022 - DNA, 82 bp, Homo sapiens
gcttatatgtgtactttgtgtatatgtgtatatgtgtactttgtgtatatgtgtatatatatactttgtttctctaattggt

SEQ ID NO: 39023 - DNA, 103 bp, Homo sapiens
aatggagagtgaatctggagggacaaatcaaaaatatctagcaccaatagttttctgttagctttgcttcttccctccacatttggttagctcactggccatt

SEQ ID NO: 39024 - DNA, 116 bp, Homo sapiens
tcagtcaatgagtggataaagaaactgtggcatgtgtgtgtgtgtatatatatatatatatatatatatatatatatatatatatatatataccatagaatactactcagctatga

SEQ ID NO: 39025 - DNA, 71 bp, Homo sapiens
tttgttttgagactgagtctcgctctgtcacccagcctggagtgcagtggccgatcttggcttactacaag

SEQ ID NO: 39026 - DNA, 95 bp, Homo sapiens; identical to SEQ ID NO: 68

SEQ ID NO: 39027 - DNA, 93 bp, Homo sapiens; identical to SEQ ID NO: 69

SEQ ID NO: 39028 - DNA, 84 bp, Homo sapiens
gagaccatgagataccgaggaaaaaacagctgtctttttattttgaggcctgcgtgcctttctctctactctttctgtctcatg

SEQ ID NO: 39029 - DNA, 80 bp, Homo sapiens
tgggaagcttggtgcgattctcacggtggtcagtgggttcttactctcacaagattgtgagaagtgccatcttgctctca

SEQ ID NO: 39030 - DNA, 62 bp, Homo sapiens
aatacacacacgcatatatatgtgtgtgtatatatatacatatatatgtgtgtgtatgtatt

SEQ ID NO: 39031 - DNA, 95 bp, Homo sapiens
cagggaagataacagctaacaatctcagtccacataggaaaatctttaaatttttctagaattgcagctggaatgatggcttgctgctgcctctg

SEQ ID NO: 39032 - DNA, 111 bp, Homo sapiens
tacctggtggctttggcactgttccctactgtgtctgtgacatcacccatttattttgtgaacatcctacagacacatttcatgaaatgggccaagggaaagaagaaggta

SEQ ID NO: 39033 - DNA, 64 bp, Homo sapiens
ctcctctcccctgtgtacaggtggctggccatgagagtgagctcacagtgcatggtgaatggag

SEQ ID NO: 39034 - DNA, 113 bp, Homo sapiens
gctaaaacatttaggattcatttctatctcctctcattctttaagtttagagaaaagattttttctatatttgcataggggagaaatctggtattttattcaaattaaatagt

SEQ ID NO: 39035 - DNA, 58 bp, Homo sapiens; identical to SEQ ID NO: 7217

SEQ ID NO: 39036 - DNA, 57 bp, Homo sapiens
ctgagacagagtctcgctctgtcacccaggctggagtgcagagtggtgtgatctcag

SEQ ID NO: 39037 - DNA, 111 bp, Homo sapiens
aaatacttgattgtgagggattttgataactttgaagtctggataatcagaaaattatttttcttttgattactatgttgaaaagtttttccaacataatgtaaaatattt

SEQ ID NO: 39038 - DNA, 115 bp, Homo sapiens
tgggtactgctactagtttggatattatgcactatattctgttcatttagtgttttttttttttttaatgtttttgagacagagtcttgctttgttgccttggagtgcagtgaca

SEQ ID NO: 39039 - DNA, 58 bp, Homo sapiens
tgaggcacagtctcactctgtcacccaggctggggtacaatggtgtgatcttggctca

SEQ ID NO: 39040 - DNA, 105 bp, Homo sapiens
tagcttgtggttttaaaggcaaattgatctgcatttaaaaaatttttttctttctttcttttttttttttttttttgatgcagtcttgctctgtcacccaggctg

SEQ ID NO: 39041 - DNA, 98 bp, Homo sapiens
agcctgagacaaattagcttttattttattttattttattttggagacagggtctcgctctctcacccaggctggagtacagaagcatgatctcggct

SEQ ID NO: 39042 - DNA, 73 bp, Homo sapiens
ggaagggatggggacccaggagatggaaagccagggagctcagtctttgtctgtcatctgcctcattcttttt

SEQ ID NO: 39043 - DNA, 101 bp, Homo sapiens
ggtgtgtaaatgggacacagatttataaacagttaatttataatcatatatggcaaattaacctgtatgtcactaatgtgccaccaatcataagacatgcc

SEQ ID NO: 39044 - DNA, 96 bp, Homo sapiens
gttagcatatatatatatttttttgagtaagcacatttatatattttttgaagtaagcgtatttttgtgcttcttatatatatatataacgcttac

SEQ ID NO: 39045 - DNA, 80 bp, Homo sapiens
gtcttttatttctttttcttgcctaattgctctggttagaacccctagtactaggttgaatagaagtggagagaatgggc

SEQ ID NO: 39046 - DNA, 96 bp, Homo sapiens
agcttgtggaatgaaacagtttatgatgtatttttttttaggtgaaggcagtgtaaataaaatgttctcatttattgtttttcatacctaaaagct

SEQ ID NO: 39047 - DNA, 99 bp, Homo sapiens
gtctagattataatatggggtagcatgggataatgcattttataattttatactagatgtatttgatccttaaccagaaatctaccaaattttttagac

SEQ ID NO: 39048 - DNA, 82 bp, Homo sapiens
gttaagggagaatgaacaagatgggagcgaggagaaagcgtgtgtgcgttcgtgtgtggctgtctgtctgtctgtctgcggc

SEQ ID NO: 39049 - DNA, 68 bp, Homo sapiens
gagagacaaatggctagttgggaagagtgggactggcttagtctgtcagactggctgtctgtctgctc

SEQ ID NO: 39050 - DNA, 68 bp, Homo sapiens
ggccagagcctgacccagctcctaattcttttttttttttttttgagacggagtctcgctctgtcgcc

SEQ ID NO: 39051 - DNA, 89 bp, Homo sapiens
tggtttggtagtgggtaaaagagctctaaagtctagatttggggtcagataaccttggtttatagtctctctctctctctcaccaacta

SEQ ID NO: 39052 - DNA, 95 bp, Homo sapiens; identical to SEQ ID NO: 68

SEQ ID NO: 39053 - DNA, 93 bp, Homo sapiens; identical to SEQ ID NO: 69

SEQ ID NO: 39054 - DNA, 86 bp, Homo sapiens
gagtctcgctctgtcgctcagtctgaagtgcagtggtgcgatctcggctcactgcaacctctgcctcctgggttcaagcgattctc

SEQ ID NO: 39055 - DNA, 115 bp, Homo sapiens
gtgacggttgcacagatttgtgagtacactaaaagccattgaactatacactttattattttttatttttattttaagttctggggtacatgtgcaggatgtgcaggtttgttac

SEQ ID NO: 39056 - DNA, 72 bp, Homo sapiens
ctgggcgtggtggcatgtgcctgtagtttcaactacttgggaggctgaggtaggaggatcacttgagcccag

SEQ ID NO: 39057 - DNA, 69 bp, Homo sapiens
agccttggtgtccagtgtccagagtttttctctttttttgagacagagtctctctctgtcacccaggct

SEQ ID NO: 39058 - DNA, 87 bp, Homo sapiens
tgttatatatgtaaaaatacctgtatatgtaaatatgtctatatttatagatatatgtacatatttcatataactttaaatataaca

SEQ ID NO: 39059 - DNA, 80 bp, Homo sapiens
ctggaggctgaggtggaaggatcatttgaacataggaggttgaggcttcagtgagccgtgattgtaccactgcactccag

SEQ ID NO: 39060 - DNA, 86 bp, Homo sapiens
tccttgttaatatggcattcaaacagaacacagtgagctcaacagacaggtcagctggctgctgtacagttattcataacagagga

SEQ ID NO: 39061 - DNA, 91 bp, Homo sapiens
agcagagtcttaggtggcagtgcctaagtctgggaggaagtgagaagtataacagaagacagagagctgccaggttgtctagactatggct

SEQ ID NO: 39062 - DNA, 75 bp, Homo sapiens
tcactctgtcactcagactggaatgcggggcgccatcccggctcactgcaacctccatctcctaggctcaggtga

SEQ ID NO: 39063 - DNA, 112 bp, Homo sapiens
agaccaggaggtgggcctgagcaacccaatttgtgtagggcagagagaagacactgatctctgaatcctccagccacaatggggaagggctgagttggcctcatgccagtct

SEQ ID NO: 39064 - DNA, 98 bp, Homo sapiens
cctcctgagtaactgggactatagataggcaccaccatgcctggatgattttttgattttctgtagaggtgggggtctcactatggttcccaggctgg

SEQ ID NO: 39065 - DNA, 104 bp, Homo sapiens
cattcttgatatgatcagtggatttctttttttaatgtatgtatgtatgtatgtatgtatgtatttttgagatggagtcttcctctgttgcccaggcgggagtg

SEQ ID NO: 39066 - DNA, 95 bp, Homo sapiens; identical to SEQ ID NO: 6311

SEQ ID NO: 39067 - DNA, 58 bp, Homo sapiens
tgagatgaggtctcactctgtcacccaggcaggagtgcagtggtgtgatctcagctca

SEQ ID NO: 39068 - DNA, 101 bp, Homo sapiens
gctcgctctctctctctctgtgtgtgtgtatatataatatatattatatatattatatatatttatatatatatatatatatttttgatactgagtcttgc

SEQ ID NO: 39069 - DNA, 56 bp, Homo sapiens; identical to SEQ ID NO: 17910

SEQ ID NO: 39070 - DNA, 77 bp, Homo sapiens
cacttgggtggcctgtgctctttttttttttttggcggggagagagagtctcgctctgtcacccaggctggagtgca

SEQ ID NO: 39071 - DNA, 82 bp, Homo sapiens
caggtccccctataaatatgggtctgtgataatctgagtaatggcccccaaaagatgtctgtgtctcagtccctggaacctg

SEQ ID NO: 39072 - DNA, 80 bp, Homo sapiens
gggccaccatgcccggctactgtttgtatgtatgtatgtatgtatgtatttagtagagacagtgttttgccatgttgccc

SEQ ID NO: 39073 - DNA, 59 bp, Homo sapiens
gacagggtctcactctgtcacccaggctggagtgcagtgacatgatcatgactcatgtc

SEQ ID NO: 39074 - DNA, 58 bp, Homo sapiens; identical to SEQ ID NO: 605

SEQ ID NO: 39075 - DNA, 76 bp, Homo sapiens
gaagctgaattttctttaacatatatacatatatgtatgtatgtatatgtatatatatggtgaagaaataggtttc

SEQ ID NO: 39076 - DNA, 58 bp, Homo sapiens
tgagactgagtctcactctgtcgcccaggctggagtgcagtggtgtgatctcggctca

SEQ ID NO: 39077 - DNA, 122 bp, Homo sapiens
ttatacatattatactatatatattatatatatataatactatataaaactatatataatatactatatattatgtataatatatgtgatatatactatgtgatgtataatatactatgtat

SEQ ID NO: 39078 - DNA, 70 bp, Homo sapiens
acccccgcctcagttagggtggacacagctgagacatacagggtgtctccctctgtctgaggtgccgggt

SEQ ID NO: 39079 - DNA, 58 bp, Homo sapiens; identical to SEQ ID NO: 3380

SEQ ID NO: 39080 - DNA, 58 bp, Homo sapiens; identical to SEQ ID NO: 1215

SEQ ID NO: 39081 - DNA, 73 bp, Homo sapiens
gttttttgagacaagagtctcgctctgtcacccaggctggattgcagtggcgctatctctgctcactggaagc

SEQ ID NO: 39082 - DNA, 90 bp, Homo sapiens
tgggactacaggtgcaagctaccatactcagataatttttaaatttattgtagagatggggtcttgctatgtttctctggctggtctcca

SEQ ID NO: 39083 - DNA, 58 bp, Homo sapiens
tgagagagagtctcactctgtcacccaggctggagtgcagtggtgcgatgtcggctca

SEQ ID NO: 39084 - DNA, 107 bp, Homo sapiens
ggagtttggttttgtttgggtttgttctaggtatggtcccagggatcccagatcaaaccaggcccctgggcctatcctagaaccaacctaagctcgcgcatcattcc

SEQ ID NO: 39085 - DNA, 99 bp, Homo sapiens
cacccagactggagggcagtgggacgatctttttttttttttttttttttttttttttttttgagacagagttttgctcttactgcccaggctggagtg

SEQ ID NO: 39086 - DNA, 62 bp, Homo sapiens
agtgagccagtatcgcgccactgcactccagcttgggtgacagacagagactctgtctcatt

SEQ ID NO: 39087 - DNA, 124 bp, Homo sapiens
gcactatatatatatatatatatatatatatatatatatatatatatatgtatatatgtgtatatatgtatatatgtgtatatatatgtgtatatatgtatatatgtgtgtatatatgtatata

SEQ ID NO: 39088 - DNA, 78 bp, Homo sapiens
gtgtatatatgtgtgtatatatgtatatatgtgtgtttatgtgtatatatgtgtatgtgtgtatatatatgtgtatat

SEQ ID NO: 39089 - DNA, 78 bp, Homo sapiens
gtgagccaccgtgtgcagtctgattttttttttttttttttgagatggagtctcactgtgtcacacaggctggaatgc

SEQ ID NO: 39090 - DNA, 68 bp, Homo sapiens
tcagcctgggcaacatagtgagacctcattttttttgagacagggtctcactctgtcacccaggctgg

SEQ ID NO: 39091 - DNA, 74 bp, Homo sapiens
aagggtcaaggggagagaaagaagaaaaattcagaacgaatcacaattaccatctctctttctctctctctctt

SEQ ID NO: 39092 - DNA, 108 bp, Homo sapiens
ccttttcatctttgattatgttttattaactccacataaggctcataatgtttataaatattagtgagatatatttgggtcttgccaacccctgtcattaagaaaagg

SEQ ID NO: 39093 - DNA, 81 bp, Homo sapiens
ggctggaatcagtacaatgtagaaatgttcagagataaagttctctttgtttctttctatatttccatttacttctcagtc

SEQ ID NO: 39094 - DNA, 93 bp, Homo sapiens
ctggggccacaggcaggggccaccacacccagctatttttttgtatttttcgcagaagcagggtttcgccatgttgcccaggctggtctccag

SEQ ID NO: 39095 - DNA, 85 bp, Homo sapiens
gaggtaagagtctcacactgtcactcaggctggagtgcagtggcacaatctgggctcactgcaacctctgtctcccgagttcaag

SEQ ID NO: 39096 - DNA, 109 bp, Homo sapiens
tacatatatatatataaaacatacatgtatgtgtgtgtgtatatatacatgtatatatatatatacacgtgtgtgtgtatatgtgtgtgtgtatatatatatatctcac

SEQ ID NO: 39097 - DNA, 96 bp, Homo sapiens
ggggggtgcctcccccgcctgcgatgggggtcctaagagccaggggggaaagaggggctttctctcagtctctgcctcgcggggggtgcatccccc

SEQ ID NO: 39098 - DNA, 110 bp, Homo sapiens
gcctcactccctgctcagagattagatactccattttttttgtttgtttgagacagagtctcactctgtcgcccaggctagagtgcagtgtgcagtggggtgatctgggc

SEQ ID NO: 39099 - DNA, 112 bp, Homo sapiens
gtgttaagactctctgtttttctgtctatacatatatatatatatatatatatatatatatatatatatatatatatatatatatagatagatagttagtttaggtttacat

SEQ ID NO: 39100 - DNA, 88 bp, Homo sapiens; identical to SEQ ID NO: 1308

SEQ ID NO: 39101 - DNA, 81 bp, Homo sapiens; identical to SEQ ID NO: 1309

SEQ ID NO: 39102 - DNA, 77 bp, Homo sapiens; identical to SEQ ID NO: 1310

SEQ ID NO: 39103 - DNA, 58 bp, Homo sapiens
tgaggcagggtctcactctgtcacccaggctggggtacagtggtgtgatctcagctca

SEQ ID NO: 39104 - DNA, 58 bp, Homo sapiens
tgagacggagtctcactctgtcacccaggctggagtgcagtggtgcaatctcatctca

SEQ ID NO: 39105 - DNA, 85 bp, Homo sapiens; identical to SEQ ID NO: 37774

SEQ ID NO: 39106 - DNA, 58 bp, Homo sapiens; identical to SEQ ID NO: 8774

SEQ ID NO: 39107 - DNA, 59 bp, Homo sapiens
ctgagacagagtctcactcactctgttgcccaggctggagtgcagtggtgcaatctcag

SEQ ID NO: 39108 - DNA, 71 bp, Homo sapiens
tcccaaacattgcattggaggacatacttatgcttacaaagtatttgttcttccttgtatgatgttggtga

SEQ ID NO: 39109 - DNA, 106 bp, Homo sapiens
tgtgtatatatatgtgtatacatatatgtgtgtatatatgtgtgtgtgtgtgtgtgtatatatatatgtgtgtatgtgtgtgtgtgtgtatatatatatatatata

SEQ ID NO: 39110 - DNA, 110 bp, Homo sapiens
agtggctagcacaagtggatggcacacaataggcaataaatatttgttgttgataatgaatattgtattttgtggctgttgtgggcaggaacgaagaagagagcatcact

SEQ ID NO: 39111 - DNA, 58 bp, Homo sapiens
tgagaccgagtctcgctctgtcagccaggctggagtgcagtggtgcgatctcagctca

SEQ ID NO: 39112 - DNA, 82 bp, Homo sapiens
cagtgattgcctgcctgcctgtctgagacttcacatgtttcataagaatgctctgatcagccaggtacagtggttcagactg

SEQ ID NO: 39113 - DNA, 63 bp, Homo sapiens
cttggtgacacagttttctttcttttttatttttttgagacagagtctcactctgtcaccagg

SEQ ID NO: 39114 - DNA, 94 bp, Homo sapiens
ccagcctgggcaacaaagtgagaccctgtttctttttctcttttttttttttttttttttttgagacagaatctcactctgtcacccaggctgg

SEQ ID NO: 39115 - DNA, 74 bp, Homo sapiens
gtgtgcacatgtggacatctctgtgtgcatgtggacaggtgtgtatgtgtatacttgtgtgtgtgtgtgcatgt

SEQ ID NO: 39116 - DNA, 109 bp, Homo sapiens
gaaggtagttttataacctgatgtaacagtaaggatctttttcagagattttatttattaacaagctaacaagtctttcactccttaacatcagacagatggacccttc

SEQ ID NO: 39117 - DNA, 87 bp, Homo sapiens
cttgtttttgtagttctggtacaaaatagatattcagtgaataattttttattgttttatttttaacattgggggtgcagggaggag

SEQ ID NO: 39118 - DNA, 95 bp, Homo sapiens; identical to SEQ ID NO: 68

SEQ ID NO: 39119 - DNA, 93 bp, Homo sapiens; identical to SEQ ID NO: 69

SEQ ID NO: 39120 - DNA, 66 bp, Homo sapiens
ggtagccccagagggcctaaataaaggcaagcatctgcctctgtgcctgtctctcagtgatctgcc

SEQ ID NO: 39121 - DNA, 56 bp, Homo sapiens
cggtgtctcactctgtcacccaggttggcgtgcagtggcagaatctcagctcaccg

SEQ ID NO: 39122 - DNA, 88 bp, Homo sapiens
ggagtcttgctctgtcacccaggctggagtgcagtggcgcaatctcagctcactgcagtctctgtctccagggttcaagcgattctcc

SEQ ID NO: 39123 - DNA, 90 bp, Homo sapiens
gggaaaaagatatttgttactttgaatgatgttaaatttaagatactctggtagatggtattattgttcaaaatagtaggtgcttctccc

SEQ ID NO: 39124 - DNA, 112 bp, Homo sapiens
caagggtttgaagacctctctgtgccagaaaccaggggacaggtaccaaatatgtatttttattataccacaccatccctgcacatttttactaacagattcaatttctttg

SEQ ID NO: 39125 - DNA, 92 bp, Homo sapiens
ctcttgctggctgaacccctgtgagactttcacctttaatttttttttttctttttttgagacggagtctcactctgtcagccaggctggag

SEQ ID NO: 39126 - DNA, 58 bp, Homo sapiens
tgagactaagtctcactctgtcacccaggctggagtgcagtggtgtgatctcggctca

SEQ ID NO: 39127 - DNA, 71 bp, Homo sapiens
catgcttcatagagattacagagagcacaaggatgttgtctgtactatattttgcctgtagtttcagcgtg

SEQ ID NO: 39128 - DNA, 175 bp, Homo sapiens
gtgtgggtgcgtgtgtgcgtgtttatatatatatgtgtgtgtgtgtgtgtatacacacatatatgtgtgtatatatatgtgtgtgtgtatatatatatatacacacacacatatgtgtgtgtatatatatgtgtgtgtatatatatatacacacacacatatatatacatacaca

SEQ ID NO: 39129 - DNA, 102 bp, Homo sapiens
agtctggcagaacttttgggaattctggtgtggatacagaactcatgttctcactgtctgacttagttcaggatctgtctgaaagtttttcttctcccagct

SEQ ID NO: 39130 - DNA, 77 bp, Homo sapiens
ggcagggatgtcctattgcttgggcatcccttatacagtacaagtgtataagggatgatttgagagacattctggtt

SEQ ID NO: 39131 - DNA, 114 bp, Homo sapiens
atacatatatatatgtataatatgtgtatacatatatgtgtgtacatatgtgttatatatgtatatacatatatgtgtgtatatatgtattatgtatgtatatgtatatatata

SEQ ID NO: 39132 - DNA, 83 bp, Homo sapiens
aagggataggttgaactgtagattcgtttctttcccagaagacaatgaggacaagggttcttttgcacattgatctacctctt

SEQ ID NO: 39133 - DNA, 58 bp, Homo sapiens; identical to SEQ ID NO: 1101

SEQ ID NO: 39134 - DNA, 56 bp, Homo sapiens; identical to SEQ ID NO: 1102

SEQ ID NO: 39135 - DNA, 57 bp, Homo sapiens
ggctctctctctctctttttctcaaggtgttgccagaagaatgagagctttggagcc

SEQ ID NO: 39136 - DNA, 116 bp, Homo sapiens
cttttgcgtggattatgggctttaggattttgaggattattttaccatatccaaatttgattattttttcatgggttatcctccagaaaatcaagggcattagctcacagcaatag

SEQ ID NO: 39137 - DNA, 110 bp, Homo sapiens
catttgtgagatgtcaactctaatcatttttattgactttgctttccagagacagacagacagtctgggaggcaagaccaatagataagagaaaggcaatcttataaatg

SEQ ID NO: 39138 - DNA, 98 bp, Homo sapiens
gataaattcactctagtgctttatggctttttattcctatgtgatagtaataaagtctcatgtagggatggaagccatgaaatacattgtgaaaaatc

SEQ ID NO: 39139 - DNA, 110 bp, Homo sapiens
ttatcttattctcccaccctgcagctagagagatcctcccgagaaccaaagctgatcacagttctctctgtctctgaatcttaagtggctctctattgcacacaagataa

SEQ ID NO: 39140 - DNA, 102 bp, Homo sapiens
cgtagagagtccatggaggccttacagggttgcagcattgacgggtggtgcgtctgtcactcgctcagtccctgtggccctcctccggcgcggacctcctcg

SEQ ID NO: 39141 - DNA, 106 bp, Homo sapiens
ctaatacatgctcttgtttatttaagatggtttatatttagtttattttgttcggagccaaataaacttgatgagcacagtcatttgcaagtcatccatatgttag

SEQ ID NO: 39142 - DNA, 63 bp, Homo sapiens
gctgtgttagtctgtcaggctgtctgtcaacaaactctaatagacagatggcttataaacagc

SEQ ID NO: 39143 - DNA, 64 bp, Homo sapiens
catccgctctctctcatcctctgtgtgaagctcccaatagcagaggctgaagacagaaaggtcg

SEQ ID NO: 39144 - DNA, 80 bp, Homo sapiens
ctctgtctgtgtgtgtgtccgagacctcgatctccttggccatgagactaagaatcttggtatttaccccagacaacgag

SEQ ID NO: 39145 - DNA, 74 bp, Homo sapiens
agcaatgtatttttcttcttctttccgactccatcaaaattgttcttggaaagaggagtagtgatatagttgtt

SEQ ID NO: 39146 - DNA, 74 bp, Homo sapiens
actctattttcctgacaatggaggaaatagcaaggcttatttctaaggactgttgtgagggaggacaaaggagt

SEQ ID NO: 39147 - DNA, 110 bp, Homo sapiens
gcttacaaaagtgtctgaatttgatggaacttacattgagaagtaaaatttatatttatattttatcttttctattttttccatgaactttctgaagtcctctcataggc

SEQ ID NO: 39148 - DNA, 100 bp, Homo sapiens
tctatttcttgtcctctgtggaaataaaagtggctttatttatttattgttttttaaatttattattattttttatatccataggttattgggaaatagg

SEQ ID NO: 39149 - DNA, 95 bp, Homo sapiens
catctctgtttcactgttgagtgaagtgttctgaattaattttgttaaattattaatagttcatgattggaaaacattcagcattggaatttatg

SEQ ID NO: 39150 - DNA, 111 bp, Homo sapiens
ggtttgccagtattttattgatgcctcaatgttcagcagggatactggcctgaaattttatatttttgttgtgtctctgccaggttttgatatcaggatgatgctggcttc

SEQ ID NO: 39151 - DNA, 113 bp, Homo sapiens
gagtcagaagatcgtggctgttgtttgtaacatgttgtcagcttaacttctgttcaatgtttttatatttgaagcaggataactaaataatatgtgctgatggcccttccctt

SEQ ID NO: 39152 - DNA, 111 bp, Homo sapiens
tccatctatttgtctgtctgtctatctatctatctatctatctatctatctatctatcagcgagactataagagagagagaaatagaggagagagagatttatgttaagga

SEQ ID NO: 39153 - DNA, 71 bp, Homo sapiens
aggtgccaggaagtttggaccctggggagggaaagccactggcttactctgtgtcacactctctgttacct

SEQ ID NO: 39154 - DNA, 76 bp, Homo sapiens
tattattcacaaggagacaccgtctgtgtttgtctcatgggccaaacaggggaatggaggaatgattggagtggtg

SEQ ID NO: 39155 - DNA, 57 bp, Homo sapiens
tgcagagagagtctcactctgtcgcccaggctggagtgcagtggcaggctcactgca

SEQ ID NO: 39156 - DNA, 95 bp, Homo sapiens; identical to SEQ ID NO: 68

SEQ ID NO: 39157 - DNA, 93 bp, Homo sapiens; identical to SEQ ID NO: 69

SEQ ID NO: 39158 - DNA, 86 bp, Homo sapiens
tcacctgggcaacgtagtgagacttcatctctttctctctttccctctctttctgagacagagtctcactctgccacccaggctga

SEQ ID NO: 39159 - DNA, 58 bp, Homo sapiens
tgagactgagtctcgctctgtcacccaggctggagtgcaatggggtaatctcagctca

SEQ ID NO: 39160 - DNA, 116 bp, Homo sapiens
tcagcctcttgaataactgggactgcaagtgtggaccaccatgtctggctaatgttttttatttttagcagaaatgaggtcttgctatgttgccaaggctagtcttgaactcctga

SEQ ID NO: 39161 - DNA, 64 bp, Homo sapiens
gttgtgggggagggtgtagattgaagggggcttgccaagcctcagacagactctgcctcaaagc

SEQ ID NO: 39162 - DNA, 85 bp, Homo sapiens
ccagcctgggcagcatagtgagacccccatctcaaatttttttttttttttttgagacagagtctggctctgtcgcccaggctgg

SEQ ID NO: 39163 - DNA, 74 bp, Homo sapiens
tgggtctcagggacaaaaggtggaaagtgaagggggacactggctttctctctccatcacaccctgagtatttg

SEQ ID NO: 39164 - DNA, 120 bp, Homo sapiens
tatagtgtgctttatgtttttttctttatttttttttgagatggagtctcactctgtcacccaggctggagtgcagtggcgcgatcttggctcactgtaacctctgcctcctgggttcag

SEQ ID NO: 39165 - DNA, 111 bp, Homo sapiens
cattctttgtatttcctattgatatgttggcttgtttcctgaaatatttgatgatttttaaaaatttggttgacctcaataacgggattcataaggaaaaattaaagattg

SEQ ID NO: 39166 - DNA, 133 bp, Homo sapiens
tggcagaaggtgaaaaggagccagcgtgtcatgtggcaagagagatgctaggctttttttttttttttttttgtgaggtggagtttcgctcttgtcacccaggctggagtgcaatggtgtgatctcagctcac

SEQ ID NO: 39167 - DNA, 93 bp, Homo sapiens
tttcattccatggtttgagtgtttgcatcttaggatatttttctttttttcaggggcagtgaggggacagacagtagacagttgggataggga

SEQ ID NO: 39168 - DNA, 89 bp, Homo sapiens
gctcaaaaactgggtcttgcaatgactggctttcttctgattttcaaggttgagtgactggcagtctgcctgggcacacgtcaaagagc

SEQ ID NO: 39169 - DNA, 58 bp, Homo sapiens; identical to SEQ ID NO: 2595

SEQ ID NO: 39170 - DNA, 81 bp, Homo sapiens
ggttttactgctgtttttgaaacaatcaatatgaaatttgaacccatattttcaactgttgtttcacatacagcttgtgcc

SEQ ID NO: 39171 - DNA, 109 bp, Homo sapiens
tgcttaggattgtcttggctccacaggctcttttttggttccatatgaattgtaaagtagtttttccaattctgtgaagaaagtcagtggcaacttgatggggatagca

SEQ ID NO: 39172 - DNA, 68 bp, Homo sapiens
tgtgtatatattttagtaaatgaagttttatcatatatatataacttcatttactaaaagaggtgacg

SEQ ID NO: 39173 - DNA, 81 bp, Homo sapiens
gtgtgtgtgtgtgtgtgtatgtgcgcacgtgtgtgtgtgtacgtgcatgtgtgtgtgtgtgagagagagagagagacagac

SEQ ID NO: 39174 - DNA, 97 bp, Homo sapiens
tcacatgaaaatcaagcatgctgagataactgagggtaatattttggtgaccatcctcccagactgtttcactctgtgaatgtgtgtggacatgtga

SEQ ID NO: 39175 - DNA, 116 bp, Homo sapiens
ttgtcaagtctgaaaacctcacagtggaaggtggtgctgggggcaggggagctgactcatgtgcctggctgcctctgtccctctccatataaatgtagtctcaattgagttgataa

SEQ ID NO: 39176 - DNA, 118 bp, Homo sapiens
tatgttgagtttcaggcattggcaggacttttttttttccatgcatatattttgactttatttttaagtttaggggtgcatgtacaggatgtgcaggtttgttacataagtaaacgtg

SEQ ID NO: 39177 - DNA, 115 bp, Homo sapiens
tgtgtatctatgtttatgtatatttgttttgctttgttttgtttttttttttaaatcttactttaagttctgggatacatgtgcagaaagtgcaggtttgtttcataggtagaca

SEQ ID NO: 39178 - DNA, 106 bp, Homo sapiens
tggattaatgggctatcatgggagtgggactggtggctttataagaagaggaagagagacctgagagagcacattcagccccctcaccatgtgaggccctgcacca

SEQ ID NO: 39179 - DNA, 110 bp, Homo sapiens
tccaccttttggctgttgtgaaaaatgcttctataatatgggtttggaaatatctctttgattctgtttttaattcttttggatgcataccaagcagtaaagttgctgga

SEQ ID NO: 39180 - DNA, 82 bp, Homo sapiens
gtgtgtgtatatgtgtgtgtatatatatatatacacatgtaaacatgttttatgtatatataacatgtttatatatatacat

SEQ ID NO: 39181 - DNA, 116 bp, Homo sapiens
gctccccttccaccctccgcgctctagtagtccccagtgtctattgttaccatcttttaaaaaagttttattttattttaagttctgggatacatgtgcaggatgtgcaggtttgt

SEQ ID NO: 39182 - DNA, 117 bp, Homo sapiens; identical to SEQ ID NO: 1931

SEQ ID NO: 39183 - DNA, 85 bp, Homo sapiens
ccattttgtcttagtctctcactgtttcctattgaagtatactttgtgtaaaaagtatttagcagtgtgttggacacacagaagg

SEQ ID NO: 39184 - DNA, 82 bp, Homo sapiens
ggccagtctcactcacactgtgccctcccaatagaaccgagtttattttcaggcagccgttgagcagagtggagaacttgcc

SEQ ID NO: 39185 - DNA, 125 bp, Homo sapiens
taggattttcttttagttctgtgaagaatgatggtggtattttgatgggaattgtactgaatttgtagattgctattggccgtatggtcattttcacaatattgattctacccatccatgaccat

SEQ ID NO: 39186 - DNA, 82 bp, Homo sapiens
tgccatttatatatctaaatgtattttccaagtttgtcatattaagatattattgttaatatttttaggtgtcatgatggta

SEQ ID NO: 39187 - DNA, 104 bp, Homo sapiens
atgatgcctttccttatcttagctaggagatcagttttcaatcagtttttcttattgagatgacagattgactctcaactctgaggtgaaggactacagcttat

SEQ ID NO: 39188 - DNA, 86 bp, Homo sapiens
agccggatgtgctggtgtgcacctgtagtcccagctactcaggaggctgaggtaggaggatcatttgagcccaggaggtggaggtt

SEQ ID NO: 39189 - DNA, 87 bp, Homo sapiens
catctttcagggggctgtatgcatatgcatacatgaaaattatatatatgtatgtatataggagtggcagcttgggttagaaagatg

SEQ ID NO: 39190 - DNA, 106 bp, Homo sapiens
acccaattatatgacactggaagataaaactgccctaatctgcatattttttttttttaagttggggaggaagttagtatacttccagtggaagacctgagagggt

SEQ ID NO: 39191 - DNA, 75 bp, Homo sapiens
gtcactagagaatttgatgttggtcgacacattgccagtggtggcaatgggctagcttggaagatttttaatggc

SEQ ID NO: 39192 - DNA, 94 bp, Homo sapiens
gaggagacaggatgaggaactttatttatttatttatttatttatttatttatttatttatttatttttgagacggagtctcactctgtcgccc

SEQ ID NO: 39193 - DNA, 74 bp, Homo sapiens
gtcagatgtgagattctcctactcatttatttatttaatttatttatttatttgagacagagtctcactctgtc

SEQ ID NO: 39194 - DNA, 103 bp, Homo sapiens
catatatctaatgtgtgtgtctctctctctatatatatataatatatataatgtgtgtgtatatatgtatatacacagagagaaaaaacacaaaatagcaatg

SEQ ID NO: 39195 - DNA, 77 bp, Homo sapiens
agcctgggtgacaaagagagattctgtctcaaaaaaaaaaaaaaaaatagacagggtctcgctctgacacacaggct

SEQ ID NO: 39196 - DNA, 108 bp, Homo sapiens
gagatgcagaggtgaataagaaatatctggccagtcacagtggctcactcccataatcccaacatttaaggaggccaaggtggaaggattgcttaagaccaggagttc

SEQ ID NO: 39197 - DNA, 90 bp, Homo sapiens
cagtctgtgtgacaaagtgagatgctgtctctttttttttttttttttttttttttttgagatggaatctcactcttgttgcccaggctg

SEQ ID NO: 39198 - DNA, 61 bp, Homo sapiens
ctgcagaagtaaattgccttgctgagaaatcctttgtctcagtgctggttcttctttgcag

SEQ ID NO: 39199 - DNA, 62 bp, Homo sapiens
gtttatacacgtatgtatatatgtgtatatatgtatgtatgtatatatagtggtgtgtgtac

SEQ ID NO: 39200 - DNA, 101 bp, Homo sapiens
actacccttgagtccaggctttaattgtccaattaggtagattactgatgccactccctggtactcaacctgaaacactgaatcctaaatccggggtgagt

SEQ ID NO: 39201 - DNA, 85 bp, Homo sapiens
atatatgtatgtatatatatgtatgtatgtatatgtatgtatacacacatatatacatgcatacatatatatatatatactatat

SEQ ID NO: 39202 - DNA, 135 bp, Homo sapiens
acaaaacagaaactgagttgtttggtataggtaggggtagaaggtgagccttgcccgctcagttgtctctttgtctgctccatggcccctgaaactcctcaaaagggctgtagggttccagagaacagagattga

SEQ ID NO: 39203 - DNA, 98 bp, Homo sapiens
tgcagagactgcagccactcctcccactaggggataaggcccagggagatccaggttctgtccctgagtctctggctggagttattggagttcctgta

SEQ ID NO: 39204 - DNA, 113 bp, Homo sapiens
ttctgtggtatcagttgtaatgtctcctttttcatatctgattttatttatttgggtcttctctcttaataatcaatgaaatttagataacactataattaacaacagcagaa

SEQ ID NO: 39205 - DNA, 58 bp, Homo sapiens
tgagacagggtctcactctgtcactcaggctggagtgcagtggtgcaatcttggctca

SEQ ID NO: 39206 - DNA, 76 bp, Homo sapiens
aggttgtgaacagaggtagagaaatggaaagatatggaattttttttcccttttttttttttttgagacagagcct

SEQ ID NO: 39207 - DNA, 114 bp, Homo sapiens
tttcatttggatcaagagctttgttcatttggtgtttgagatatcttaaacagtcgcatgtttatttatttatttatttcgagaccaagtcttgctctgttgcccaggctggag

SEQ ID NO: 39208 - DNA, 89 bp, Homo sapiens
gcactagagaaaaatgctcagatgacagagtggtcattttctacaggagtgacataagaaggtataaaatttgagcaaagtctcgaggt

SEQ ID NO: 39209 - DNA, 64 bp, Homo sapiens
agtcagtgagtcagtgagtcagtggagcgtgaatgcgaaggcctaggacattactgtcactact

SEQ ID NO: 39210 - DNA, 117 bp, Homo sapiens
gagctggacggcctttggattcttggattctcccctgggtccgtcagcatctccatgtgcttccaggaagccatgaccaagactccctctcctctaagaccctcagacttcctgctc

SEQ ID NO: 39211 - DNA, 102 bp, Homo sapiens
tgaatatatatatatgtgtatatgtatatacgtgtgtgtgtatatatatatatatatatacacacacacacacattgaatatatatactggatatatattta

SEQ ID NO: 39212 - DNA, 87 bp, Homo sapiens
catgtgtgcctccaaatccccagttgtatgggatcagggcccaccctgatgacctcacacaattttttgattttatagagagacatg

SEQ ID NO: 39213 - DNA, 78 bp, Homo sapiens
ctcacagtatgtctctgtcccagtcactctttcacttcccgtgggcagggggactggcaggtattggacatgtgtgag

SEQ ID NO: 39214 - DNA, 65 bp, Homo sapiens
ccctgtgtgtctctgtctttatggggctatcttcttgtaaggacactagtcgtattaaagcaggg

SEQ ID NO: 39215 - DNA, 58 bp, Homo sapiens
tgagacagggtctcacactgtcacccaggctggagtgcagtggcataatcttggctta

SEQ ID NO: 39216 - DNA, 101 bp, Homo sapiens
tccagaggtatgatgtgatggttaatactgagtgtcagcttgattggattgaagggtgcaatattgatcctgggtgtgtctgtgagggtgttgccaaagga

SEQ ID NO: 39217 - DNA, 99 bp, Homo sapiens
agttaagcgacttggccaaggtcacacagactaaatcatcaattgtgcatgagcctgagtctgtctgactctatagagtccatagtctttctcttaact

SEQ ID NO: 39218 - DNA, 95 bp, Homo sapiens
gtgtatatatgtgtgcatgtatatgtttgtatatacatatacgtgtgtttatgtgtgtatgtgtatatgtgtgtatatatgtgtggacgtatgtg

SEQ ID NO: 39219 - DNA, 65 bp, Homo sapiens
cagtactaaggaagagagaagacagtgcagatgctgactggcttttcttaaagcctaaagaactg

SEQ ID NO: 39220 - DNA, 99 bp, Homo sapiens
gctttgtctatttgggctctttcttggtgacatatgaattatagaatagtttttttctaattctgtgaaaaatgacactactagttcgataggaatagt

SEQ ID NO: 39221 - DNA, 84 bp, Homo sapiens
ggagtgaagaggtgtcaatggtgatggaccataattctatccaggaaaaattaattgtcattatttatgataagtcctcattcc

SEQ ID NO: 39222 - DNA, 58 bp, Homo sapiens; identical to SEQ ID NO: 2237

SEQ ID NO: 39223 - DNA, 79 bp, Homo sapiens
gtaccttctttcttattttattaatgaccatgagtgaatctctcagtctgtgtcattggtgaactgagtgttctgtcac

SEQ ID NO: 39224 - DNA, 83 bp, Homo sapiens
gtttgatactatgcatacatatatacacacatatacatttatatgtctatgtgtgtatatataaatatgtttacttattatac

SEQ ID NO: 39225 - DNA, 68 bp, Homo sapiens
atatgtgtatatatgtatatatgtgtgtatatatgtatatatatgtgtgtgtatatatgtatatatat

SEQ ID NO: 39226 - DNA, 108 bp, Homo sapiens
tctatgtgtgtgtatatatacacaaacatatatatacacacgtttttatatatacatatataagtgcatatgtgtgtatatgtatatgtgtatatacatatatataga

SEQ ID NO: 39227 - DNA, 111 bp, Homo sapiens
aggggtttttctgatgcatttatcttgatgtttactgttgccataggaattacttattgatttttatgaaaacacatatggaagagagaactaaggcaatagaattcaact

SEQ ID NO: 39228 - DNA, 85 bp, Homo sapiens
tatgtgtatgtgtaatgtgtatatatgtgatatacatataacctgttatatgtttatatgtatgtgtatataacatgtatatata

SEQ ID NO: 39229 - DNA, 102 bp, Homo sapiens
accatgcctcaatgaggtaagtgtctctctctctgttattctgattttacaggtgaaactgagttttggagaagataagtgccttgtctgaggtcacatggt

SEQ ID NO: 39230 - DNA, 117 bp, Homo sapiens
atatttatatacatttatatataaattatatgaatatataaaacacatatgtatatatgtttatgtgtgtataatatacgtgtgtgtctgtatacacacgtgtacatatgtgtgtgt

SEQ ID NO: 39231 - DNA, 121 bp, Homo sapiens
tatatatacatatatatatgcacatgtgtatatatatgtgtatatacatgcacgtgtgtgtatatatatgtgtgtatatatatgtatgtgtgtgtatatagttacacatatatgagtacac

SEQ ID NO: 39232 - DNA, 78 bp, Homo sapiens
gtttgtaaagcataagaaaagtatatgtggcaaatgcaggagtctgaagctgcattttattttattatttttgcagat

SEQ ID NO: 39233 - DNA, 243 bp, Homo sapiens
atgtgtatatgtatatatacatatatgcgtacatgtgtatatgtatatatacatatatgcgtatatgtgtatatgtatatatacatatacgcatatatgtgtatatgtgtatatgtgtatatacatatatgcgtatatgtgtatatgtgtatatatgtatatgtgtaaatatacatgtgtatatgtgtatatatacatatgtgtgtgtatatgcgtatatatgcacatatagacataggcatg

SEQ ID NO: 39234 - DNA, 79 bp, Homo sapiens
ttctatctgcctcactcattctctggacagtttattaatgccagtgagctcttgtttgggtatgagaggcatcatagaa

SEQ ID NO: 39235 - DNA, 117 bp, Homo sapiens
aatcaaaaacaatggcttcatgaagtccctgatagtccatttgctatctatatattttttatgtttagaaatcaacagagtaaattgattataaataactaagccaaataaatgatt

SEQ ID NO: 39236 - DNA, 70 bp, Homo sapiens
atgatcacatggcagatcccacagaactaggtaaatccgcctgtgtgcctgtctctgtctctgtgttcat

SEQ ID NO: 39237 - DNA, 80 bp, Homo sapiens
tgtgactgtgtatgttttatatatgtatacacacatatatatatacatgtatgtatatgtataattcagagcaggaaaca

SEQ ID NO: 39238 - DNA, 116 bp, Homo sapiens
ggtcttcatgaatgtgtctgattaccagggctggttggaaaaaatgtatatttttatcgtttgaaactcatgctttttcttggtttaattaaacacaggcagttttttggaggatt

SEQ ID NO: 39239 - DNA, 97 bp, Homo sapiens
gtgggtagggaaatctcagcttgtgccttttctatgctaatgtgacccacagactgactcacatggggtgggagcaaaggttaagtgcaccttccat

SEQ ID NO: 39240 - DNA, 92 bp, Homo sapiens
aatgtgttatatttggcactggtgtgcattcatttgtctgagaattctacagtcagaagacactttgcataccactgtggtctaacttcgtt

SEQ ID NO: 39241 - DNA, 70 bp, Homo sapiens
tgtgaaagtatatgcatataaatatatacatatatttgtgtgtgtgcatatatgtgtgtgtgtgttcaca

SEQ ID NO: 39242 - DNA, 85 bp, Homo sapiens
cacaaacatatatacatgtttgtacatatatgtttgtatatcctatgtatatatgcatatatgtatacatgtttgtatgtgtgtg

SEQ ID NO: 39243 - DNA, 86 bp, Homo sapiens
gtatttgagctctcactgcctgtcagtctctggatgtacaaaggatctgcagtaaggaagaagagaggcacataagagatcattgc

SEQ ID NO: 39244 - DNA, 92 bp, Homo sapiens
agaagtatctacagatatgaatatctgtttgtgtgtatatatatatatatatatatgcattttatagattaaaatcatactttacatgttct

SEQ ID NO: 39245 - DNA, 115 bp, Homo sapiens
gctgatttatgctaaaatatatgaaataattattgctcatttgtatgatgaaaagttttaatttcaacatttcaacatatatttttgattttgtctagttaggtcagaaattagc

SEQ ID NO: 39246 - DNA, 96 bp, Homo sapiens
tatatatatgacatatatatctatatatacatatatcgtataatatagatatatatacatatatctagatatatgtatatatctatatgatatata

SEQ ID NO: 39247 - DNA, 104 bp, Homo sapiens
gctcgatttctgtataatcatgtccaacatattttcagattttttttttttttttggtggggggaagtcagtagggattgttgagactgattaaaaatacaagc

SEQ ID NO: 39248 - DNA, 96 bp, Homo sapiens
tgccatgtgccaggccttagttttaagtaatttgcatttattaatttataatctgcagatgattccaaaactatcctcagtccaggtcccagggta

SEQ ID NO: 39249 - DNA, 89 bp, Homo sapiens
tgcattgaaatatattttgggtaggtagattcactttttttttttgagatggagtctcgctctgtcacccaggccggaatgcagtggca

SEQ ID NO: 39250 - DNA, 113 bp, Homo sapiens
ggaatgagaacaatgttgtcttaagaacttcttaagataatttacaaagagtctccctctgtgtcaattatcttaataatttctagttaatttctgtattgtctgcttttttc

SEQ ID NO: 39251 - DNA, 113 bp, Homo sapiens
ggatttggttaattagaatttggggtattttaggctacactaatgattttgttttttcatcgataacacaaaaatattaggtaaatatttaaaatatgttagttttcaagttc

SEQ ID NO: 39252 - DNA, 74 bp, Homo sapiens
agaaggagaaagagacagactatttatttattctgttttaagaagaaatacgtttgctttctcttttttttttt

SEQ ID NO: 39253 - DNA, 58 bp, Homo sapiens
tgagacggagtctcactctgtctcccaggctggagtgcagtggtgagaactcggctca

SEQ ID NO: 39254 - DNA, 77 bp, Homo sapiens
ggcatctgagcagacatgtggcagtcttctgatgtgctaatatttgtatgcctgcatgactctgattctcacatgcc

SEQ ID NO: 39255 - DNA, 116 bp, Homo sapiens
tgtgatctgccatgtgaatcataggttataatctctatgcaaagtaattttgcagtttattattataaaatttacttaactgtctgtgtattgttttctagtttatgtggcataca

SEQ ID NO: 39256 - DNA, 119 bp, Homo sapiens
ggtgtggctgatggaggccccagcttcccccttggtggtcactggtcagttttcactctgtctcttatgcagtgtattaaccccagggggcattgctctctgcagcagacagtggaaac

SEQ ID NO: 39257 - DNA, 91 bp, Homo sapiens
gtttttcttgtttttgttttttgttttttttgttttggggatggagtcttgctctctcacccagtctagagtgcaatggcatgatcttggc

SEQ ID NO: 39258 - DNA, 89 bp, Homo sapiens
catatgtgcctatgtatatatgtacctatgtacctatgcatgtatgtacatatgtacctatgtatatatgtatgttgttagctataggt

SEQ ID NO: 39259 - DNA, 115 bp, Homo sapiens
gaaatgtgtactgggaacaatactctttatctagctagagattgggatttttattattttatctatggatatctgtctatctagatatcatgtatgtatgtatctatctactttc

SEQ ID NO: 39260 - DNA, 65 bp, Homo sapiens
tgtttttgttttgttggctttgagatagagtctcactctgtcatccaggctggcatgcagtggca

SEQ ID NO: 39261 - DNA, 83 bp, Homo sapiens
ctcatccatgagtcaaggctcctagaatgaagacccctgtacttccacttgtttggggctgtgagttgagactgtggtctgag

SEQ ID NO: 39262 - DNA, 100 bp, Homo sapiens
ttggctacatgtttatgcttactaatgtttatcaatattaagtttttactttaaaggtaaaaacaggtcttgggatgaaatagttgtgaatattccccaa

SEQ ID NO: 39263 - DNA, 100 bp, Homo sapiens
ctgctttgaaagttaacctttccactaactgaaagcagaaggacccagggtgtttcatgctgaggtagtaggatgaataaaggcaaatatgcataagcag

SEQ ID NO: 39264 - DNA, 81 bp, Homo sapiens
tgctgggggagagaaatgaagcattcctgttttaggactgagctaccctttcatttttctattttttttttaaccatagca

SEQ ID NO: 39265 - DNA, 67 bp, Homo sapiens
gcttccccctcaggtaacttttttttcagtgcatgtgcactgagaagacggtgagctctgtgctggc

SEQ ID NO: 39266 - DNA, 88 bp, Homo sapiens
gtgacaggagagagaaaaatgagagctgagtgaagggggaagccccatataaaaccatcggatctcatgagaacttattcactatcac

SEQ ID NO: 39267 - DNA, 73 bp, Homo sapiens
gtgtatgcctctctctgtgtgcgtgtggatgtattaggacatgctcttatctaagtataaggcaggtacacac

SEQ ID NO: 39268 - DNA, 108 bp, Homo sapiens
tagtttttacaatagcattgaacacaaagatagattgtaaatagtgatttctttatttttagaaaaatgacaaaatttatctttgtgtctgtgatcaataatttatta

SEQ ID NO: 39269 - DNA, 111 bp, Homo sapiens
ggcatctttctttgagcattgagaacttttccttcacacagtatctgtctctgtcattttgggtggaaacaatatgaggaggaatagcacaatattcttcaaggcgatttc

SEQ ID NO: 39270 - DNA, 104 bp, Homo sapiens
ctaatacactgtttaaactggtaaatgttcaacaaatatatatatatatgtatatgtgtgtatatatctatatacatgttgattttattcaaatgcatgattag

SEQ ID NO: 39271 - DNA, 94 bp, Homo sapiens
gcctggcctgaggtttcatttcttcaactattcctaccatcatcttttttttttttttttttttttgagatggagtctcgctcagtcaccaggc

SEQ ID NO: 39272 - DNA, 69 bp, Homo sapiens
gcacatatataaatatatttttacacgtatgtatatataaatacatatgtagtctattgaaatgtgtgc

SEQ ID NO: 39273 - DNA, 114 bp, Homo sapiens
cgcagggcattctgaaggtagaggtgcaggactaggagaggcagtgaatgtgagtgtgagtgagacacagacacagtatctctcctaaggctttctctgaagtcatggtgtgtg

SEQ ID NO: 39274 - DNA, 78 bp, Homo sapiens
agccagacagaagtgacattggagtgatgtggccggggccagtgaaggtcattggccttcattccacctctggaagct

SEQ ID NO: 39275 - DNA, 95 bp, Homo sapiens; identical to SEQ ID NO: 68

SEQ ID NO: 39276 - DNA, 93 bp, Homo sapiens; identical to SEQ ID NO: 69

SEQ ID NO: 39277 - DNA, 115 bp, Homo sapiens
gtatgtataaatgtataaatgcaaaatatgcatatgtgtatatgtatatatatgtgaatatacatgtgtatatacatacacatatatgtgtatatgtgtatacatatatacatat

SEQ ID NO: 39278 - DNA, 80 bp, Homo sapiens
atatatgtgtatatgtatatatgtatacacatatacacatatatgtgtatgtatatacacatgtatattcacatatatat

SEQ ID NO: 39279 - DNA, 108 bp, Homo sapiens
acatttaggaaatcaatgaaacataattcagggagaggtaaatttttataattttaattattcaaaattagctttcttgtggattaggtttgtttaaaaactgcttgt

SEQ ID NO: 39280 - DNA, 98 bp, Homo sapiens
gtgtgtgtgtatatatatatgtatgtatgtatgtatatgtgtgtatgtgtgtatgtatgtatatgtgtgtgtgtatatatatatatgtgtgtgtgtgt

SEQ ID NO: 39281 - DNA, 104 bp, Homo sapiens
gatgtcagaaatgtggagtaaagcctgagttatttatatttagcagaatttgaagagtcaacaatcacagctttctaactcaggtgtattgtcttttctgtatc

SEQ ID NO: 39282 - DNA, 99 bp, Homo sapiens
tcctagaagagtttgagactacggtttttaagggttttcgagcaggccgaagtgtgaagattgttgactggttgaagggtgcagggcgaagccatagga

SEQ ID NO: 39283 - DNA, 199 bp, Homo sapiens
atatatatatgtgtatatatatgtgtatatatgtatatatgtgtatatatatgtgtatatatgtatatatgtgtatatatgtatatatgtgtatatgtgtatatatgtgtatatatgtacatatgtgtgtatatatgtatatatgtgtatatatatgtatatatgtgtgtatatgtaaatgtgtgtatatatatatata

SEQ ID NO: 39284 - DNA, 56 bp, Homo sapiens
gagtctctccctgtcacccaggctggagtgcaacggtggcatgatgatctcggctc

SEQ ID NO: 39285 - DNA, 91 bp, Homo sapiens
cagagagggaccagtgtggagattattctttgagagcctttttttttttttttttttgtagatgaggtctctctctgttttcccaggctgg

SEQ ID NO: 39286 - DNA, 83 bp, Homo sapiens
tagtattctagcttatgcaatgtttataaaaacactagtattagaattagtgacatgatatagtttcagtgctgagaatatta

SEQ ID NO: 39287 - DNA, 62 bp, Homo sapiens
tatatacatatatatatgcatatatatgtatatatatgtgtgtgtgtgtatgtatgtatata

SEQ ID NO: 39288 - DNA, 111 bp, Homo sapiens
tgttcattgtttagatgtatttatgtatagatacatatgctgtatatacaatatagatattgtatatatttgtgtacgtgtgtgtatataaaactgaggtttagaaaacaa

SEQ ID NO: 39289 - DNA, 95 bp, Homo sapiens; identical to SEQ ID NO: 68

SEQ ID NO: 39290 - DNA, 93 bp, Homo sapiens; identical to SEQ ID NO: 69

SEQ ID NO: 39291 - DNA, 172 bp, Homo sapiens
tattaaattggcacccgatgttgtagtggtccagcaagtgcaactgcatctggttgcagtgatgtacaaggaggttggattcagtggttagattggcacccgatgttgtagtggtccagcaagtgcaactgtatctggctgcagggatgtactagcaaggctggattcactg

SEQ ID NO: 39292 - DNA, 87 bp, Homo sapiens
gggatgggagtgggtttgtttcctaggctgctacaacagagaactgtgaatggagtagcttaaaataacagaaatctattctctccc

SEQ ID NO: 39293 - DNA, 80 bp, Homo sapiens
tgtgtcagtgacttgcacttggcagtgagtgcgtgggcgtacgagcatgcacaccacacagtgcacacaggggtgacgca

SEQ ID NO: 39294 - DNA, 114 bp, Homo sapiens
ggttgagttacattttaaaattattattaaagtatatatgtgtgtgtgtgtgtgtgtgtgtgtatatatatatacatatatgtctttaaagttatgttaagtgttccatgtact

SEQ ID NO: 39295 - DNA, 105 bp, Homo sapiens
ggtccctgacaccggcctgcccaccagctatctgtctctgagtgaacgctgtgaatccccgtaaaacagaagagtctctcagctgagtgctgccagtttctgacc

SEQ ID NO: 39296 - DNA, 107 bp, Homo sapiens
gtgtgtatacatatatatatgtgtgtgtgtatatatgtgtgtatatatatgtgtgtgacacacgtatatttatacagtaaatatatacatatgtatatgtatcacac

SEQ ID NO: 39297 - DNA, 69 bp, Homo sapiens
gaaagaagtgagtgagctcagagaccttttttttttgtaggaagtctagatgagacatttatttttttc

SEQ ID NO: 39298 - DNA, 68 bp, Homo sapiens
acggctaaaaagtaccagggattagatgaaaggccaggtctttctcactcccacactgatgtggttgt

SEQ ID NO: 39299 - DNA, 65 bp, Homo sapiens
tatctaacatggctagcatgtacagcctagagaggcatgtgcaatgcaaatgaaatgttaagata

SEQ ID NO: 39300 - DNA, 106 bp, Homo sapiens
caagagtggaagtcgggtggggaatggtgtctcttcgcctcgctcagtgtttgccacctggacagagtgattgggaagtcaccgagctttccaccccaccacgttg

SEQ ID NO: 39301 - DNA, 104 bp, Homo sapiens
gtgtaattatttttgagaatattcatgttgtagcatgtgtcaatatatttttttttattgctatatggtatagcgttgtatggatatagcaaatttgtttattc

SEQ ID NO: 39302 - DNA, 89 bp, Homo sapiens
tctgtaaggcaaaataaaggctgttgtacaggtactgatgtatcacagtgtctctgtcacaattactcagctttgtgcttgtagcatga

SEQ ID NO: 39303 - DNA, 117 bp, Homo sapiens
tatagtttagagatggagtaactcagtagcgttttctgcactattttgaaatatatatgtatttttgaaatagatgtgtgtgatttctactttgtatacagtcattgctgaaagatg

SEQ ID NO: 39304 - DNA, 75 bp, Homo sapiens
tcttcttaccttgcctgatttgcccctcttgaaatctgctggtttagagctcagagagaagacagaggtagagga

SEQ ID NO: 39305 - DNA, 116 bp, Homo sapiens
aggacatgattccctgcgccttaattgatgacgctcctctttttaaaaatgccatcgctcacacacttagtgtcaggcattttgccgaggacataggcatgcggggaccttgtcct

SEQ ID NO: 39306 - DNA, 119 bp, Homo sapiens
taggcttattttataaaataaggtcattgcattctattgcatttgacctgttcacagaactacctgaaagcaagctgaatgcaaatgtcattgccttcatttattgtaaataaggttta

SEQ ID NO: 39307 - DNA, 143 bp, Homo sapiens
tttatatatatatgtgtgtgtgtgcatatatatatgtgtatatatatacgtatatatgtgtgtgtatatatatacgtacatatgtgtatatatgtataaatatgtgtatatgtgtgtatacgtatatgtgtgtatatatatat

SEQ ID NO: 39308 - DNA, 61 bp, Homo sapiens
tggctcacatttgtaatcccagcactttgggaggctgaggtagaaggattacttgaggcca

SEQ ID NO: 39309 - DNA, 81 bp, Homo sapiens
cctgcctgcctcagttccctcactctcagctaggacatgaatcccaagttggtgggcagggggtgcaagggtggcagcagg

SEQ ID NO: 39310 - DNA, 102 bp, Homo sapiens
ggtttctgtttctgtctctatctcttctcattctatgaatttatttatttataatctgtttattataatgtttatctcagagagagattaggaactttagcc

SEQ ID NO: 39311 - DNA, 110 bp, Homo sapiens
aaaaaaaattataaaatccactttgaccaagctcttattaaatcgatagtagtgatattgatgtggtaaaagttttaagcatgaaaagaagtgatggtctgatttttttt

SEQ ID NO: 39312 - DNA, 112 bp, Homo sapiens
ggcgcccagtggtggcagtgtctgcaaagcctaaagttttaattttatttgattttaattaatttaactttattttattttactttttttgagagagtctcactctgtcgcc

SEQ ID NO: 39313 - DNA, 114 bp, Homo sapiens
agtctcttatttgtgaaatcttgggatctaccaacactctgaaaattgaagttttttttttttttttttttttttttaagatggagtcccactctgtcacccaggctggagtgc

SEQ ID NO: 39314 - DNA, 84 bp, Homo sapiens
tttgaaaagctcattggtcttgagttgttctatctttttaaatcaatgatggattatgttacttaagataggagtgaaattaaa

SEQ ID NO: 39315 - DNA, 112 bp, Homo sapiens
gagcacatagcctggatcccttgcatgtgtagttcacagtagagtttgtgctcttatgagaatctaatgctgctgctgatctgacaggagggaagctcaggcggtcatgctt

SEQ ID NO: 39316 - DNA, 113 bp, Homo sapiens
gattctttctctggttttatggtagttttgtttgttcagcggcagtatttttaggtgtaatatatatatttttgcagatattagagcatttacttcataaaacagaacaggtc

SEQ ID NO: 39317 - DNA, 76 bp, Homo sapiens
gtccttctgtgaatcatgagtactggtttctatactatgagctataggtatcagaatttatatttatcagattgat

SEQ ID NO: 39318 - DNA, 91 bp, Homo sapiens
ttgtttgtttttgaaactgggtctcactctgtcacccaggctggagtgcagtggtgtgatcgcagttcactgcagcctcaacctccctggg

SEQ ID NO: 39319 - DNA, 96 bp, Homo sapiens
atggcagtgataagaatgtcaattgctggagagagttcggggctttgccaccttggtagctctatgcaaatgttatgtattatttaccactgttgt

SEQ ID NO: 39320 - DNA, 60 bp, Homo sapiens
gagaccgagtctcgctctgtcacccaggctggttggagtacagtggcgcgatcttggctc

SEQ ID NO: 39321 - DNA, 110 bp, Homo sapiens
tagaagtttcttagtttgaggtcttagatttaagtctttaatccatttttatatgattttttatatggtgagcgatgggggtctgagtttcattcttctgtatatggcta

SEQ ID NO: 39322 - DNA, 100 bp, Homo sapiens
gagttcagtgcccaccactatagtctcttgtctcctttaatattagttagtttatcaaacactagtgagactggttctccagtgagtagcacatcagctc

SEQ ID NO: 39323 - DNA, 56 bp, Homo sapiens
gagtcagggtctctctgtgtctcccaggctggagtgcagtggtgtgatctccactc

SEQ ID NO: 39324 - DNA, 88 bp, Homo sapiens
atgtttataatatgcatacatatatacatttatgctgttaaggaaaacaaaacaaatattttatatatgtgtatgcataaaatgacat

SEQ ID NO: 39325 - DNA, 102 bp, Homo sapiens
tggtggaaggcaaagattaagcaggcatatcttacatggctggagaaagaagacagagaggtgggaggtgctctgctcccatgatccaatcacctctcacca

SEQ ID NO: 39326 - DNA, 95 bp, Homo sapiens; identical to SEQ ID NO: 68

SEQ ID NO: 39327 - DNA, 93 bp, Homo sapiens; identical to SEQ ID NO: 69

SEQ ID NO: 39328 - DNA, 95 bp, Homo sapiens; identical to SEQ ID NO: 68

SEQ ID NO: 39329 - DNA, 93 bp, Homo sapiens; identical to SEQ ID NO: 69

SEQ ID NO: 39330 - DNA, 80 bp, Homo sapiens
gctcagacttccaggactgtattgaataacagcggtgtatgtgggcatttttgtcatgttccaggtcttagaggaaaggc

SEQ ID NO: 39331 - DNA, 95 bp, Homo sapiens
tctgctagcgtggagaaatcttggatctcacagtgcactttttaatttgaattttaacattgtgtcattgcatggattttatcttttgaggcagg

SEQ ID NO: 39332 - DNA, 95 bp, Homo sapiens
ctggagttcttgtgttggttctttctcatctctgcatgttgtcattcctttacctacagtgtagattgagtgcacccaatagacttcttttctag

SEQ ID NO: 39333 - DNA, 76 bp, Homo sapiens
tgtatatgtatatgtatatgtatatgtatacgtatacgtatatatgtatatatgtatatatacatatatatgtata

SEQ ID NO: 39334 - DNA, 65 bp, Homo sapiens
tgtgtgtgtgtgtgtgtgtgtgatagaagggtccctggtctatctctcactacatttcttatgca

SEQ ID NO: 39335 - DNA, 95 bp, Homo sapiens; identical to SEQ ID NO: 68

SEQ ID NO: 39336 - DNA, 93 bp, Homo sapiens; identical to SEQ ID NO: 69

SEQ ID NO: 39337 - DNA, 119 bp, Homo sapiens
gtatatgtgtgtatatataggtacagatacacatgtacatatatgtacctatgtatatatgatatatatgtatatatacttacatatacctgtgtgtatttatacatgcacatatatat

SEQ ID NO: 39338 - DNA, 80 bp, Homo sapiens
aatgtccaggtgggtgggcagggttactggtggacaacttccacacagcaactatttttgttctttaatacctagacatt

SEQ ID NO: 39339 - DNA, 100 bp, Homo sapiens
tcctgagacctgaaatggcaatatctggttagactccagtgaaacagaaaaaaaatatatatttttttagatggagtctcgccctgtcactcaggctgga

SEQ ID NO: 39340 - DNA, 95 bp, Homo sapiens; identical to SEQ ID NO: 68

SEQ ID NO: 39341 - DNA, 93 bp, Homo sapiens; identical to SEQ ID NO: 69

SEQ ID NO: 39342 - DNA, 56 bp, Homo sapiens
tgagacagtctcactctgtcacccaggctggagtgcagtggtgtgatcttggctca

SEQ ID NO: 39343 - DNA, 71 bp, Homo sapiens
cctttagctcacagttactgatgcatgtatattttattttgattcatgtatctagtgagttgctatgaagg

SEQ ID NO: 39344 - DNA, 94 bp, Homo sapiens
gtgcagaggttcttacaacctgatggagttattttaatgatgaatgcacatggtctttattattattaatatgacaggtggagaataacagtat

SEQ ID NO: 39345 - DNA, 116 bp, Homo sapiens
tatataaatatatacatatgtttacatagtgtatatataatatataaatatatacatgtgtttatatgcatatatataatatatacatatgtttatatgcgtatatataatatata

SEQ ID NO: 39346 - DNA, 152 bp, Homo sapiens
ataaatgcaaatataaaatataaatatatgtatataaatgtagaatatgcatataatatgtatataaaaacatatttgtatacatatacgtatatatgtatatatgcatatatacatatatttgtatatatacatatatacatatatatgta

SEQ ID NO: 39347 - DNA, 73 bp, Homo sapiens
ctttcaaaattatcagaaatatggggtccagattccctggagtctctctccaactctctgatatcttgagcag

SEQ ID NO: 39348 - DNA, 95 bp, Homo sapiens
gtatgatcatatatatgatatgtatgatgtatagatatatgatgtgtgtgtgtgtgtacatatatatatatatgatggaatactactctggcata

SEQ ID NO: 39349 - DNA, 62 bp, Homo sapiens
tgagatggggtctcactcactgtgtcacccaggctggagtgcagtggtgcgatatttgctca

SEQ ID NO: 39350 - DNA, 125 bp, Homo sapiens
gggctggtactgggggttatctgcacagagtcctgtgatgtgaacggtctgtgggtctctcagtcatggataccagcacctgttctggtggaagtggcaggatggtgaaatggactctgtaagtg

SEQ ID NO: 39351 - DNA, 96 bp, Homo sapiens
gatgtgtctatctatctatgtgtgtatacgcgtatctatctatctatatatatgcgtatacatatatatgcgtatacacacatacatatatatatc

SEQ ID NO: 39352 - DNA, 145 bp, Homo sapiens
atatacatatacacacatatatagtataggatatatatatatagtgtgtatatatatatatacttataggatatatatatatagtgtgtatatatatatactaataggatatatatatacactaataggatatatatatacacta

SEQ ID NO: 39353 - DNA, 92 bp, Homo sapiens
agaaggggcaatgctttctggaaagttttgtgcccacagacacacacacacacacacagaacataccagacagtgaagggttgactctgtct

SEQ ID NO: 39354 - DNA, 112 bp, Homo sapiens
ttgtgttccctaccagggaacgtgtatggatggggctgatggtattttatttttctttaagctataatgtattctgcatcattacaatactgttgactggaaatgaaaacaa

SEQ ID NO: 39355 - DNA, 73 bp, Homo sapiens
cataagttagtttttattattcatcagagaccttgcattctattcagatgtgatgtcttttgatgaacttatg

SEQ ID NO: 39356 - DNA, 113 bp, Homo sapiens
gtctgtctgtctatctgtctatctatctatctatctatctatctatctatctatctatctatctatctatctattttaaaaagaaggagataaacagatctcccaagacagat

SEQ ID NO: 39357 - DNA, 116 bp, Homo sapiens
agctcggtgtggtagagtctatctaaatgcagaatactttgatggaggttactggctgggtcactgccactgagtctctatcaggagctgggacagggtggctcccatgcctggtt

SEQ ID NO: 39358 - DNA, 111 bp, Homo sapiens
ttttcagcctttttggatatggtctcgatttctttgcaaaacatatttattttttcatcccaagaaaatatttgtcttgcagaagtgcactggaaatacttaggttgttga

SEQ ID NO: 39359 - DNA, 98 bp, Homo sapiens
tgtgtaacaggttcagcctgggcggtgacacagtgatgagtcagcgggtgcattcggtcactgctctctgtgtctctaagacaggtgcttgttctata

SEQ ID NO: 39360 - DNA, 58 bp, Homo sapiens
tgagacggagtctcactctatcactcagtctggagtgcagtggtgtgatctcggctca

SEQ ID NO: 39361 - DNA, 111 bp, Homo sapiens
gccgggcatggtagcaggtgcctgcagtctcggctacttgggaggctgaggtagaagaatcacttgaactcaggaggtggaggttgcagtgagccaagatcgtgccactgc

SEQ ID NO: 39362 - DNA, 117 bp, Homo sapiens
aggaaggggagagctttgaccacaacctttgatttcagatcatagatttatttttaatacatggaaagtggaaattctaatcttctgagttggaaggtgacccatacttccctttct

SEQ ID NO: 39363 - DNA, 122 bp, Homo sapiens
tgtatgtatgtatgtatgtatatgtatattagttctcccatatatagttctcatatatatacatatatatgtatacatgcatatacatatatatacagttatgtatatatatgggaactata

SEQ ID NO: 39364 - DNA, 94 bp, Homo sapiens
ctattagttttatatatatataatctcctatgatatatagacatatatatctataaatatatataggagtatatatatgtgtatctcctattag

SEQ ID NO: 39365 - DNA, 64 bp, Homo sapiens
ggagtagagtgtttctacttgtgtactctatgggtacatacacataatagagtgtttctactcc

SEQ ID NO: 39366 - DNA, 96 bp, Homo sapiens
tcttgcagggatccaagtgaagagagtgagcccaggcctagttgtgttaagaggtgaattaatgagactagaggatggtcactggggtccgaagga

SEQ ID NO: 39367 - DNA, 123 bp, Homo sapiens
tatatatatatatatatatatatatatatatatatatatatatatatatataaatatatatatatatatacatatacacatatatatatgtatatatgtatatatgtatgtatatatgtatat

SEQ ID NO: 39368 - DNA, 69 bp, Homo sapiens
atgtatgtatgtatgtatgtatatatgtatacaatctgtatatagatatatatacacacatatgtgtgt

SEQ ID NO: 39369 - DNA, 72 bp, Homo sapiens
gttttgggttgagacagtctctctctgtcactcaggctggagtgcagtgatggcatgatctcagctcactgc

SEQ ID NO: 39370 - DNA, 96 bp, Homo sapiens
gccccttgacttttctgtctctcttcctcagtctgacttacctgtaaacttcaaccttgaacaggttatttcactgttgacgtatgctcaaggggt

SEQ ID NO: 39371 - DNA, 139 bp, Homo sapiens
ctatatatatgtgtgtgtgtatatatgtaactatatatatctgtgcgtgtgtatatatatagttatattatatatatatagttatgtaactatatatatataatataactatatatatacacacgcacacatatatata

SEQ ID NO: 39372 - DNA, 131 bp, Homo sapiens
gtatgatgttctgtgttgaataacagaaactgaaaaacggcttccatcaaatagaggtttatttatcaatttttgtgagtacacagtaggtgtatacatttatggggtatgtgagatattttggtacagtc

SEQ ID NO: 39373 - DNA, 98 bp, Homo sapiens
tatatatactatatagataatatagtatatatatatatatagtgtatatatacactatatatatcgtgtatacatatactatctatatagtatatatg

SEQ ID NO: 39374 - DNA, 83 bp, Homo sapiens
gctctttgttggttccatatgaaatttaaagtagttttttctaattctatgaagaaagtcaatggtaccttgatggagatagc

SEQ ID NO: 39375 - DNA, 72 bp, Homo sapiens
ctggagtgccatggtgtccacgtcctcccttggccactgcctgctgctgggtggatccctgagtggctctgg

SEQ ID NO: 39376 - DNA, 101 bp, Homo sapiens
gggggcagggtgtgaagcgagaatggagagagaagtttgagggctctccagggtggagggcctggggaaaactcatctgcagaccccctcaccctcacccc

SEQ ID NO: 39377 - DNA, 94 bp, Homo sapiens
cctcctattcatgatctcccctgatatactctctctttctcctaacgtgtgttagagagagacagagagacagacagatggagacagatagagg

SEQ ID NO: 39378 - DNA, 117 bp, Homo sapiens
ccactaagaagggctatatattcaggtgcagcaaagagccaaagtcacacacacacacacagaaatacacaaggctgctggtcacttattgcaccctgagatgtgctcttctgaagg

SEQ ID NO: 39379 - DNA, 110 bp, Homo sapiens
tgtgaataagcctggctaccagcatgcatcacagaaccgagtgtgcacagactccggcctgcccgcctcatagtccctgtgacgtctggctgatgagagctggctgtata

SEQ ID NO: 39380 - DNA, 111 bp, Homo sapiens
ttgaagggttttactttcattttttaactgacaaaaattgtatatatttatggtatacatcatgatgttttatatatataacttgtgggatgactaagtcaagctatttaa

SEQ ID NO: 39381 - DNA, 90 bp, Homo sapiens
tgatggtggttgggctcaaggagttggccttgtggaatttcggaaagagttctgcagtcacccactgactgtgacccatccttgacatca

SEQ ID NO: 39382 - DNA, 334 bp, Homo sapiens
atatatatatatatgtatatatatatatatgtgtatatatatgtatatatatgtatatacatatgtgtatatatatgtgtgtatatatatgtatatacatatgtgtatatatgcgtatatatgtatatatatgcgtatatatgtgtatatatgtatatatgtgtatatatgtatatatatgtatgtatgtatatatgtgtatatatatgtatatatgtgtgtgtatatatgtatatatatgtgtgtatatatatgtatatatatgtgtgtatatatatgtatgtatatgtgtgtgtatatatacacatacatacatatacatatatatatatat

SEQ ID NO: 39383 - DNA, 90 bp, Homo sapiens
atatatatatatatatatgtatatgtatgtatgtgtatatatacacacacatatacatacatatatatacacacatatatatacatatat

SEQ ID NO: 39384 - DNA, 82 bp, Homo sapiens
ggtctcactctgtcactgaggctggattgcagtgttactatcttggctcactgcaacctcagcctccgcagtagctgggatt

SEQ ID NO: 39385 - DNA, 107 bp, Homo sapiens
gtacttatagttatctgtatatgtaatacatacttataattatatgtttatatgatacatacatataattatatgtataatacatacatacttataattatatgtat

SEQ ID NO: 39386 - DNA, 116 bp, Homo sapiens
agaatgtgtccgtccactttcctaactctcattgctgttcatactacactggtgtcgctctctacagtttatcacgggaagcagtgagggcatgatttgtgcagcaggaagcatct

SEQ ID NO: 39387 - DNA, 84 bp, Homo sapiens
gggaggatcacctgagcccaggaggcagaggttgtagtgagctatgatcacaccactgcactccagcctgggtgagatcttctc

SEQ ID NO: 39388 - DNA, 58 bp, Homo sapiens; identical to SEQ ID NO: 20439

SEQ ID NO: 39389 - DNA, 107 bp, Homo sapiens
tgggatgatgcagtaagagggcccttgccagatgctggcaccttgatcttggtttccagcctccagcatagtgagcaaatacgtttctattcattataaattaccca

SEQ ID NO: 39390 - DNA, 72 bp, Homo sapiens
ctgggcgtggtggcacgcgcctgtagtcccagctacactggaggctgaggtagaagaatcacttgaacccgg

SEQ ID NO: 39391 - DNA, 87 bp, Homo sapiens
tatacatgtatgtacgtatatgcgtctgtgtatatttatggtatatggtgtgtatatatgtgtatatatgtatatgctatatgtata

SEQ ID NO: 39392 - DNA, 120 bp, Homo sapiens
tgctatgctttagtagagactggtggcattgtgcctctgccttagagatctatagaactttgaacttcagagagatgatttagggtatctggcagaagaaattcctaagcagcaaagcat

SEQ ID NO: 39393 - DNA, 72 bp, Homo sapiens
tgcagagtgctgtgtgactgtgtcttgcttgtcaggcagatgatatgtgacaacaagcagcattgttctgca

SEQ ID NO: 39394 - DNA, 104 bp, Homo sapiens
ctatttcagatttcaggttttttgatttggcatgctcaatctgtatttatatctatgtgtgtgtgtggaaatgtatacaacaaatgaaattacctctaggatag

SEQ ID NO: 39395 - DNA, 80 bp, Homo sapiens
ttattctctgtgtgtctctgtgtcttcagagataagaatgtttcttttctttgggtatagggtgtgtacttcttgaatga

SEQ ID NO: 39396 - DNA, 95 bp, Homo sapiens; identical to SEQ ID NO: 68

SEQ ID NO: 39397 - DNA, 93 bp, Homo sapiens; identical to SEQ ID NO: 69

SEQ ID NO: 39398 - DNA, 62 bp, Homo sapiens
tactttctgtctctgtgactttgagtcctctatggacctcatctgtctggagtcatacagta

SEQ ID NO: 39399 - DNA, 86 bp, Homo sapiens
tgtattatgaatttttttttttttgagatggtgtctcactctgtcgcccaggctggagttcagtggcacagtctcagttcactgca

SEQ ID NO: 39400 - DNA, 91 bp, Homo sapiens
tgtcatagaccatttctggaatagttatgtttgatatgatagggatggtaaccctaatatattaataattgatctttccagctccttggca

SEQ ID NO: 39401 - DNA, 92 bp, Homo sapiens
tagggggatgtatatgtatatatgtatatgtagatatatatatatctcccctttatatatatataacatgtatatataataaactcccctta

SEQ ID NO: 39402 - DNA, 283 bp, Homo sapiens
agatacatatatatatacatataaaggggagatatatatctatatatagatatatatagatatgtatctatatatatagatatatagatatgtatctatatatagatatatatagatatatatctatatatatagatatatatatgtctatatatatctatatatatagatgtctatatatctatatatatagatatatatatctatatatagatatatagacatctatatatatagatatatagacatctatatatatagatatatatatagatatatatat

SEQ ID NO: 39403 - DNA, 69 bp, Homo sapiens
gaccttctgtgctggggctctgtgcgtggtttgttggctgttactcacgcactcagagttcacagagtc

SEQ ID NO: 39404 - DNA, 89 bp, Homo sapiens
actgctttaaggtcccatctgctgattctttattgtgaggatgggttacgtcttcatgattctttttatttctagtgactttgaattgt

SEQ ID NO: 39405 - DNA, 100 bp, Homo sapiens
agatatatgaatacacatatgtatatagatatatatgtatgtgtatataaacatgtgtatatatgagtgtgtctatacacatgtatgtatccacatgtct

SEQ ID NO: 39406 - DNA, 60 bp, Homo sapiens
caaatgtgtgtgtatgtatatgtatatatatgtacatacatatgtatatatacacatatg

SEQ ID NO: 39407 - DNA, 78 bp, Homo sapiens
ggctcttgcctctgtctctgtgtaactgctgactgtaccttgaagtgcaccctttatcagagatagatgctatcagtc

SEQ ID NO: 39408 - DNA, 83 bp, Homo sapiens
ggttttcatcctgacttcatggctgatgctggctgacccaggagcctggctccctccctctaggccatgtggcactgtgaccc

SEQ ID NO: 39409 - DNA, 86 bp, Homo sapiens
gcatatgcctgcgtgtgtgtgcatgtgcatgtgtgcaggtgtgtgcatgtgcgtgtgtggatgtgcgtgtatgtgcatgtgtgtgc

SEQ ID NO: 39410 - DNA, 80 bp, Homo sapiens
gccatggcggggggcgggggtgtgtgtctcgagcccgtggtgacagactcagactgaccctctcccctgaagcccacggt

SEQ ID NO: 39411 - DNA, 99 bp, Homo sapiens
gtggacagacagagaggcctggtgggctttggcatggctgacccctcattgcctagtgtgtggctgtgtcactgcctgctgcctagagagtgtgagaac

SEQ ID NO: 39412 - DNA, 73 bp, Homo sapiens
ccatggacactggcacactgtgagtcagctctgctttctggaatctgccacagtgagggtatttgcaccatgg

SEQ ID NO: 39413 - DNA, 113 bp, Homo sapiens
gtgtgtgtgtctctgtgtgagtgtgtatgtctgtgtgtgtgtgtgtgtgtgtgtgagtgagcacacatgcatgtccaggaaactaagtgctgagagagcagagatgtccttac

SEQ ID NO: 39414 - DNA, 109 bp, Homo sapiens
gcactctctaagactctccgagttgaaatccttatggaagagctggaaaatatatttttttcaaaagcatctttgttatttacagcaatttagcaagtttaagaagtgc

SEQ ID NO: 39415 - DNA, 85 bp, Homo sapiens
gctgcattagcctcagagaagagagtcagcctggcctttgaagcttgaagacaggcattgatttctcctctctagctatgaaagt

SEQ ID NO: 39416 - DNA, 114 bp, Homo sapiens
gtgacctccttcctctgtgtctgtgtcttcacatgacctccttcctctgtgtctctgtctgcttatgaggacccctggcatgttggattagggcccagccgacttcagggtgac

SEQ ID NO: 39417 - DNA, 86 bp, Homo sapiens
gtatgtatgggcacacatgtgtgtttgtatatatgtacatgtgcttgtgtgcatgtatgcatgtgcatatgtgtgcgtgtgcttat

SEQ ID NO: 39418 - DNA, 92 bp, Homo sapiens
tttaaaacacctttttattttaaggggagaaaaggacattttgctctcacaacagagagtgaccttttgttgtctgaaagctctgtattaaa

SEQ ID NO: 39419 - DNA, 86 bp, Homo sapiens
ggcctggggctcagaggtattcagtggctcactcactgccacaccgtcacgtggcctgttgcagccctgacaccgtgccccaggcc

SEQ ID NO: 39420 - DNA, 113 bp, Homo sapiens
agactgtgtaatcagggatctcatgtggtcaggacagaggagagagagtggtcaaatcaatgacactttatatgttttgtcttctctgggtcagcattgctctgccaaggttt

SEQ ID NO: 39421 - DNA, 88 bp, Homo sapiens
gtgtgtgtgcatgttcacatgtgtgtgcacatggatggggcactgtctgtgcctgtgtgcatgcctgtgtgccagcctgctctgacat

SEQ ID NO: 39422 - DNA, 77 bp, Homo sapiens
gctgtgttgtgcgtgcgtctctctgggtggccttggccgggcttctctctctgtgagacaggcgcatctctcagggc

SEQ ID NO: 39423 - DNA, 104 bp, Homo sapiens
ctccatccctctgtcaaccctgttctgagtcacaagagacactgcaaaccccccttgtgggagctgactcaggctcgggctgggctcaaggcagtggggtgggg

SEQ ID NO: 39424 - DNA, 76 bp, Homo sapiens
gccgacctgctggtgctcacagatgctactgaggtcaccaggcctcaaaatgtgttctgagagcagcagcatcggc

SEQ ID NO: 39425 - DNA, 60 bp, Homo sapiens
tcacacactcgctctgtgagccacgtgatcatgggagcggctccctgcagaggtgtctga

SEQ ID NO: 39426 - DNA, 94 bp, Homo sapiens
cagcgcgccccttccgtgtggccgcatgccacccgcgccgcgcccaggtaagcaggtccgtgggtcgctgggtccatgcgtgggtccgtggctg

SEQ ID NO: 39427 - DNA, 92 bp, Homo sapiens
gcagcttttggaaaaatgttgaaactggggcggcttctctgggtgactctgacgctctcattgcttcacgtttaatttttgtgtcctgctgt

SEQ ID NO: 39428 - DNA, 96 bp, Homo sapiens
gtgtctgtgtgatgtgtctgtgtgatgtgtgtacatgtctgtgtctatgtctgtgtgtttttgtacacacgcacacacacacacacgaatgggcac

SEQ ID NO: 39429 - DNA, 59 bp, Homo sapiens
caggtggctcacatctgttcttctagtactttgggaggccgaggtgggagagttgtctg

SEQ ID NO: 39430 - DNA, 117 bp, Homo sapiens
ttagtagatctagggcttttaaagaagggcttttcttatctgtctctttttttttctcttaatatgaagcataaaggtagagaagcttttaaattctatcctattggattttattaa

SEQ ID NO: 39431 - DNA, 64 bp, Homo sapiens
gacagaactctgaccgtcactgcctcactccagtgccaggcgcaaagaagtcagcaggtccgtc

SEQ ID NO: 39432 - DNA, 104 bp, Homo sapiens
ggttggttacagcggagaatctgaaagatgtatggttgtgcataaatttttgtttttacagaaaacacaactgcacagtcattctcccgtctttgcctttgcca

SEQ ID NO: 39433 - DNA, 80 bp, Homo sapiens
ggcctgtccctgactgtgtccctgggtcccaccctgagcctgttcctgtgcctgcccctgggcctctatctgggtctgcc

SEQ ID NO: 39434 - DNA, 58 bp, Homo sapiens; identical to SEQ ID NO: 37425

SEQ ID NO: 39435 - DNA, 71 bp, Homo sapiens
gagcaacatactgagatgccatctctattataaaaaagaaattttttttttgagatggagtctcgctctgt

SEQ ID NO: 39436 - DNA, 65 bp, Homo sapiens
ggctccggaactgcggattgtatgtggcggtgcccagcctctgtgtgtgtctgtggtctgaagcc

SEQ ID NO: 39437 - DNA, 66 bp, Homo sapiens
ggcagacgccacaggcgctgtacactcaggctacactaaactgagacagtgtctcactgtgttgtc

SEQ ID NO: 39438 - DNA, 106 bp, Homo sapiens
tttcagtccacttgttctctcctgcgattgcggaaacttagaaatctgctctttggttagggtcctgcgggtctctgaggccttgaccgtcctcggtccgtttctg

SEQ ID NO: 39439 - DNA, 112 bp, Homo sapiens
ggctctgcaggtgaacggttctgcaggtgagcggctctgcaggtgagcggctctgcatgtgagtgcctctgtgactggctcgcaagcagcatttgtgcacacttgactggcc

SEQ ID NO: 39440 - DNA, 84 bp, Homo sapiens
atgacatctgaccgtaaagagatggatttaggtagaaggaagaattctttaacacagaatatgggtctctgagggaaatgttat

SEQ ID NO: 39441 - DNA, 119 bp, Homo sapiens
gacctcctccatccaagagggctcttggcttcacttaggagagattcacacacacacaccgacagtggaggaagcgttgatcaggagtgattcacacatgagccaacagtggaggaggc

SEQ ID NO: 39442 - DNA, 102 bp, Homo sapiens
gccatgtggaactgtgagtccattaaacctctttttctttataaattacccagtctcgtttaggtctttcttagcagtgtgagaatggactaatacactggc

SEQ ID NO: 39443 - DNA, 98 bp, Homo sapiens
cagttgtgcggattagaaggatgggtcgagcgaaagaactttggaagctttaaagtgattttcttcatctttaagtcttttttccttctgcctctttg

SEQ ID NO: 39444 - DNA, 86 bp, Homo sapiens
gggcttctagcagagcagacagcaaggctgccctgcgggtccacctgtctctctagatcagtctgtctgtgtgtgctgctgtgtcc

SEQ ID NO: 39445 - DNA, 77 bp, Homo sapiens
ccttgcgctgtcccatagggtctggagctggtgctgagctgggcgtgtctcagaccctctgagtttgcagacaaagg

SEQ ID NO: 39446 - DNA, 116 bp, Homo sapiens
gctgactgtgcttagagtcctggctcctgggggagagacccccgctgctgactgtacttagagtcctcgctcctgggggagaaatccccactgctgactgtgcgtagagtcctcgc

SEQ ID NO: 39447 - DNA, 124 bp, Homo sapiens
cccccgctgctgactgtgcttagagtcctggctcctgggggagagacccccgctgctgactgtacttagagtcctcgctcctgggggagaaatcgccactgctgactgtgcgtagagtcctcgc

SEQ ID NO: 39448 - DNA, 84 bp, Homo sapiens
tatcagtgtgtctatgtgtatgtgtgcatgtgggtgcgcatgtgtgtgtcagtgtctgtatgtgtgcatgtgggtatgcttgtg

SEQ ID NO: 39449 - DNA, 84 bp, Homo sapiens
cccagtcgagaaccactctgtcaatctaatgggtgagagttcacactgagcacctaggttggttctgagggagattgttttggg

SEQ ID NO: 39450 - DNA, 76 bp, Homo sapiens
ttgtttgtttgttgagatggagtctcactctgtcacccaggctggagtgcagtggcgcgatcttggctcactgcaa

SEQ ID NO: 39451 - DNA, 59 bp, Homo sapiens
tccagtgagcaattctttttgagtgtcatgacagtgctcaaaaagtttgggcttctgga

SEQ ID NO: 39452 - DNA, 87 bp, Homo sapiens
tttttgacaaaaatgtgaatatgtactaattacttccatttataggaagattagtgtattagttcattctcgcattgctgtaaagaa

SEQ ID NO: 39453 - DNA, 75 bp, Homo sapiens
caaaacaaaacaaaacaaaaagatagagtagtaggttagcaaaattttacattctatctttttttgttgtttttg

SEQ ID NO: 39454 - DNA, 112 bp, Homo sapiens
ccagagctaatccttgagccgaaagagcttcctggtgaagcctcgcactctctgtaacagggcgtggggggaccgagacatgcgggctccagattagaccatctttacctgg

SEQ ID NO: 39455 - DNA, 82 bp, Homo sapiens
ccatttatgagtacttcactttttttcttctttaattataagcttaataagcttgtaaggtttaaaaatttgaagtatatgg

SEQ ID NO: 39456 - DNA, 58 bp, Homo sapiens; identical to SEQ ID NO: 605

SEQ ID NO: 39457 - DNA, 86 bp, Homo sapiens
tggcaaacctgcatcaagcacgtgtattggcgccgttttttccaacagtatgtgctcatttcatgtctctgtgtcagcatttgtta

SEQ ID NO: 39458 - DNA, 112 bp, Homo sapiens
atatatatatatgtacatatatatatgtatgtgtatatatgtatgtatgtatgtgtatatgtatgtatgtgtatgtatatgtacacatacatacatatatatacatgcatac

SEQ ID NO: 39459 - DNA, 56 bp, Homo sapiens
cagagagtctgtctgtcacccacactggagtgcagtggtgtcatcacagctcactg

SEQ ID NO: 39460 - DNA, 56 bp, Homo sapiens
cagtgagctgtgatgacaccactgcactccagtgtgggtgacagacagactctctg

SEQ ID NO: 39461 - DNA, 62 bp, Homo sapiens
atatatatatgtgtgtgtatatatatgtgtatatgtgtatatatacacacacacttatgtat

SEQ ID NO: 39462 - DNA, 110 bp, Homo sapiens
ggtgctcctaacagaccctgggctcatccctgtgtgccccctgcacccagtactgggcccagcacacagtgggcacacagggggagtgtccgcgggcagatgaagcctcc

SEQ ID NO: 39463 - DNA, 113 bp, Homo sapiens
tgtccattttttaatttactggtcagttttatttggccactcttgtgtcactcttttttttttttttgagatggagtctcactctgttgccctggctggtgtgcagtggtgca

SEQ ID NO: 39464 - DNA, 91 bp, Homo sapiens
tcctgaagtaaaggagtcaattgcaaaggaagatataaatttatctttatttgcatacgacataatcctatatatataaatactctaagga

SEQ ID NO: 39465 - DNA, 110 bp, Homo sapiens
tgtttctggctctgtattctgtcccattaatctgtcccattaaagtctattttttttaaattatactttaagttttagggtacatgtgcacaatgtgcaggttagttaca

SEQ ID NO: 39466 - DNA, 112 bp, Homo sapiens
tatatatatatgtgtatatatgtatatatgtatgtatgtatatatacatgtgtgtatgtatatatgtgtatatatgtatgtgcgtatgtgtatatgtgtatgtatatatatg

SEQ ID NO: 39467 - DNA, 90 bp, Homo sapiens
gcagcagaatgaggccctgtctcaaaaaaaaaaaaaaaaaaaaaaaaacaaatcattttattttattttgagacagggtctcattctctc

SEQ ID NO: 39468 - DNA, 89 bp, Homo sapiens
ccagcttgggcaacatagtgagaggcccatctctctctcttttttttttttttttttgagacagaatctcactctgtcgctgaggctgg

SEQ ID NO: 39469 - DNA, 70 bp, Homo sapiens
ttgttttgagacatgatctcgctctgtcactcaggctggagtgcagtggcatgatctcagctcattgcag

SEQ ID NO: 39470 - DNA, 58 bp, Homo sapiens; identical to SEQ ID NO: 14893

SEQ ID NO: 39471 - DNA, 56 bp, Homo sapiens; identical to SEQ ID NO: 14894

SEQ ID NO: 39472 - DNA, 62 bp, Homo sapiens
atatatatgagcatgtgtatatatatgtaaacatatatgtatatatcctttagcatatatat

SEQ ID NO: 39473 - DNA, 106 bp, Homo sapiens
tcaatagcccaactctctcttgtgtgtatgaatgcatgtatgtatgtgtttgtatatgcatagatacatgtataactgtattccttgatatcgcatggtgcattga

SEQ ID NO: 39474 - DNA, 59 bp, Homo sapiens
tgtgtatgcatgagtgtatgttatgtgtatatatgtatatatacacttacgtgtatata

SEQ ID NO: 39475 - DNA, 111 bp, Homo sapiens
ctcaatacaaatggtctccagcgtataagtgatgagcatttctaaagaatagaagttagttttttggatcttgtagaaataatgttgtatatggacttgggaggctgagac

SEQ ID NO: 39476 - DNA, 94 bp, Homo sapiens
gggagacagagtaagaccctgtttaaaaaaaaaaaaaaaaaagactgcttttttgtttttgttttttttgagacggagtctcactctgtcgccc

SEQ ID NO: 39477 - DNA, 75 bp, Homo sapiens
ggcaagagaatgacagtagtcagattgcagtcactatatacctagggattggcagtgggatgcatttgaatggcc

SEQ ID NO: 39478 - DNA, 111 bp, Homo sapiens
gcctcccagagtgctgggattacaagtgtgtgagccattgttcttgtcctttttttttttctttttttttcctcgaggcaatgtctcagtgtgcctcccaggctggagcgc

SEQ ID NO: 39479 - DNA, 94 bp, Homo sapiens
ctgggcaacatagcgaaactccatgtccatgtaaaaaaacttttttttttttttttttttttttttgagatggagtttggctcttgtctcccag

SEQ ID NO: 39480 - DNA, 107 bp, Homo sapiens
ctccagcctgggcagcagagcgagactgtctcaaaaaaatttttttcatactgtttatttttaatttttttatgtgtcagcatcccactctgtttcccagactagag

SEQ ID NO: 39481 - DNA, 58 bp, Homo sapiens; identical to SEQ ID NO: 31512

SEQ ID NO: 39482 - DNA, 112 bp, Homo sapiens
agttggtctatcattgtatttgaaagacattaattaggagtttttgttctactattttagaattttgctgactaatattcctttgactagtttgaataacattggatcaact

SEQ ID NO: 39483 - DNA, 116 bp, Homo sapiens
gcagaggttgcaagtgtgtgatttggtggcctggatgtgactgtctgactcccacagtgtttaaccaggtaggcattcattcattcattcattcagcacatatttatcgagaacct

SEQ ID NO: 39484 - DNA, 121 bp, Homo sapiens
gtgctagaggtggcaccagggcagaacctagggcacctgtttgtcactctcagtcactgccacctaatggaactaaaaatcgtgtcacagggttgcctgaagggaggatggtaatgtgttc

SEQ ID NO: 39485 - DNA, 187 bp, Homo sapiens
atatatatatatatatatatatatatatatatatatatatatacacatacatatatatatatatcagtgtgtatatatatatatatcagtgtgtatatatatatatcagtgtgtatatatatcagtgtgtatatatatctgtgtatatatatatcagtgtgtgtatatatatatctgtgtgtatata

SEQ ID NO: 39486 - DNA, 76 bp, Homo sapiens
ggctcacttcctcagtgcctcactgcacaaacctctaggggagcatacagataggcaggctggggggctccgaccc

SEQ ID NO: 39487 - DNA, 75 bp, Homo sapiens
gcatttgaaatgtatatagatttgtatatatacttaagcatttgaaatgtatagaaatttatacatttgaaatgt

SEQ ID NO: 39488 - DNA, 94 bp, Homo sapiens
gcaattatgaataatactgtgatgaaagtgcaagtgcatctgtctttctggtagaacaatttgttttcttttggatacccagtaatgggattgc

SEQ ID NO: 39489 - DNA, 107 bp, Homo sapiens
ggcatggtggcgggcacctgtaatcccagctactcgagaggctgagacatgagagtcacttgagcctgggtggcggagattgcagtgagctgagatcacaccattgc

SEQ ID NO: 39490 - DNA, 77 bp, Homo sapiens
accttgagtaaatagcttaaagtagatacaaaggaatgtagagtagtttatttaaatagcttgtttactcatgtggt

SEQ ID NO: 39491 - DNA, 90 bp, Homo sapiens
cagctacatgggaggctgaggtaggaggatcccttgagcctagaaggtcaaggctgcattgatctgtctgtgtcactgcactccaggctg

SEQ ID NO: 39492 - DNA, 105 bp, Homo sapiens
gtctaaaaaaaaaaaataatggatagacagatgtagatatgaattaatacatatacccacatgtatatatgtatatttgtctttggaaatattttaaacgtggac

SEQ ID NO: 39493 - DNA, 108 bp, Homo sapiens
gggatggtggtgcatgcctgtagtcccaggctcttaggaggctgaggtaggaggatcacttgaacccaggaaacagaggttgcagtgagacaggatctcactctgttg

SEQ ID NO: 39494 - DNA, 117 bp, Homo sapiens
gcagtttcctttgccttacctacggaggttctaatttaggaggccatgtttctttctttttttttttttttgagacagagtctcaccctgtcagccaggagtgcagtggcgcaatgc

SEQ ID NO: 39495 - DNA, 58 bp, Homo sapiens; identical to SEQ ID NO: 276

SEQ ID NO: 39496 - DNA, 119 bp, Homo sapiens
tgtttttaaagataagctgggcacagtggcttgcacctatagtcccagctactcgggaggctgaggtgggaggatggtttgagcccaggagattgaggttgcagtgagctatgattaca

SEQ ID NO: 39497 - DNA, 81 bp, Homo sapiens
ttgtctctggagttccttgcgagactcgaaatacacgattctgtgattctatttcagtctggttgagttctttagttgcaa

SEQ ID NO: 39498 - DNA, 93 bp, Homo sapiens
tgctggtaggaatgtaaaatggtgtagttgctttggaaaacagtctggcagttcctcaaaagcttaaatatagagttaccatttgacccagca

SEQ ID NO: 39499 - DNA, 94 bp, Homo sapiens
gcgtcaatgaacacatattttgtattttatatgtattagatcctgtattcttacaataaagcaagctagagaacagaaaatgctggccaggcgc

SEQ ID NO: 39500 - DNA, 93 bp, Homo sapiens
cctagtcccagagttagcctggaggtgagctgaggttaaagccaggttccctgactcccacagttcttccccttaaatgtttctagttttagg

SEQ ID NO: 39501 - DNA, 68 bp, Homo sapiens
gaaaaagtagaaacggagcactctggccctatcgtgtctgcgtgggcctctgtctgtgtctgcctgtc

SEQ ID NO: 39502 - DNA, 111 bp, Homo sapiens
gcctgggcgacagagcgagactccgcctcaaaaaaaaatggatttttaaaatttgttattattttattattactatttttttgagacggagtctcactctgtcgcccaggc

SEQ ID NO: 39503 - DNA, 79 bp, Homo sapiens
tatctgtgtgtgtgtgtctgaatttgggctgagacttgctttccttataagctggtagtgagatacgggagaataggta

SEQ ID NO: 39504 - DNA, 71 bp, Homo sapiens
gttgtttgagtcagagtctcactctgttgcccaggctggagtgcagtggggtgatctcggctcaccgcaac

SEQ ID NO: 39505 - DNA, 67 bp, Homo sapiens
ggcccccagagaccctcacttctttggccatgtgaggacacagtgaggagagggctgtctaggaacc

SEQ ID NO: 39506 - DNA, 77 bp, Homo sapiens
ctgacgcagcatctcaatcaatttctgggaaatatagggaacttgccaagtgagcattgaagtgaggctgccgttgg

SEQ ID NO: 39507 - DNA, 70 bp, Homo sapiens
ttctcagcctctgtgtggctggcttttaaagctaagaaaagccagtaggaatgtagaaatccagtgagaa

SEQ ID NO: 39508 - DNA, 238 bp, Homo sapiens
tatgtatatgtgcatacatacgtgtatacgcacatatatgtatatgtgtatacgtatatgtatatgtatatgtgtatacgtatatgtgtatatgtatatgtgtatacgtatacgtatatgtatatgtgtatacgtatacgtatatgtatatgtatatgtgtatatgtgtatatgtatatgtgtatgtgtatatgtgtatacatatatgtatatgtgtatgtgtatatgtgtatacata

SEQ ID NO: 39509 - DNA, 110 bp, Homo sapiens
ctcaatacaaatggtctccagtgtataaatgatgagcatttctaaagaatagaagtaagttttttggatcttggtagaaataatgttgtatatggacttgggaggctgag

SEQ ID NO: 39510 - DNA, 80 bp, Homo sapiens
gctttcacagcctggctgtttggcacaagagggctaggtttcaggctgtcttggctttcaacatgccttcctcactaagc

SEQ ID NO: 39511 - DNA, 78 bp, Homo sapiens
gcagttgtatttttttagtctttttaattatatcagcaaaattaggcagtacaggaaagactagaatgtaacatctgc

SEQ ID NO: 39512 - DNA, 58 bp, Homo sapiens; identical to SEQ ID NO: 879

SEQ ID NO: 39513 - DNA, 97 bp, Homo sapiens
agtaaaatacaatatagttcacagttgacaacagtgatatcagtgatattttatttgttattgttcactcgttaattgcatgaatatttcatttact

SEQ ID NO: 39514 - DNA, 82 bp, Homo sapiens
ccatcaggcccgcaattcggccacacagatatattctaaatgattgctttttagtgtggtagaagattgtttagtgccatgg

SEQ ID NO: 39515 - DNA, 119 bp, Homo sapiens
ttaaataatgaaatacacacatatatacacatacatttgtatttcatatatatgtattgaatatatgtatatatgtattgaatacatgtgtaaatatatatgtgtatttcattatttga

SEQ ID NO: 39516 - DNA, 90 bp, Homo sapiens
tctgttgaagattttggcctagtgcatttcttctatttatgtatatgtccttaaattagagagagtgtagacaagctaggcctcagaaga

SEQ ID NO: 39517 - DNA, 78 bp, Homo sapiens
ggtgatatatgtgtgtgtgtatctgtgtctgtgtgtatgtgagcatatatatatttttatatgtgcactcatctgacc

SEQ ID NO: 39518 - DNA, 112 bp, Homo sapiens
gaagttaactccttccaacagtctagttgcccaaactggcgcttatttttttttttttaagtaaggaaaaaactcaagagtccacccaattgggactgtgttagttgacttc

SEQ ID NO: 39519 - DNA, 79 bp, Homo sapiens
tttaaatgtctgaacataaacattaactagtactgatataattattgtatttaaatatgtctatgttctaatgtttaga

SEQ ID NO: 39520 - DNA, 91 bp, Homo sapiens
cattgtcttcaaatccaggtggatacgtcccacaagtcgaaacaaggtgctttgagaggatgtgcaactggaggtgaatttggggatagtg

SEQ ID NO: 39521 - DNA, 67 bp, Homo sapiens
ggctgggggagccctgcagggaagatgaggcatcaggggactgaagtctgccagcagggatcgggct

SEQ ID NO: 39522 - DNA, 95 bp, Homo sapiens; identical to SEQ ID NO: 68

SEQ ID NO: 39523 - DNA, 93 bp, Homo sapiens; identical to SEQ ID NO: 69

SEQ ID NO: 39524 - DNA, 64 bp, Homo sapiens
ggtataaggaagggattcagtttcaattttttttttttttgagatggagtctcactctgttgcc

SEQ ID NO: 39525 - DNA, 76 bp, Homo sapiens
tatatgtgtatatacatacaaatatgcatatgtgtaaatttaaaaatgtgtgtatatgtctgtatatatatatgtg

SEQ ID NO: 39526 - DNA, 84 bp, Homo sapiens
gagatagtaatgcctatgtcatagcttgttgtattttataaggtataaggaatgcctggtacatagtaattactaatacttctc

SEQ ID NO: 39527 - DNA, 72 bp, Homo sapiens
gtacgtatctacataggtatctgtgaatgtatgtatctacatatgtatctacgtatgtatgtatgtatgtat

SEQ ID NO: 39528 - DNA, 85 bp, Homo sapiens
agtgctattattgatgtcagtacagactgtgcaacgaacaaccaccagaggtaccgtttgcaattgatgtctatatgatggtgct

SEQ ID NO: 39529 - DNA, 82 bp, Homo sapiens
catgtttttttgtttctgtttttgttttttttgagacagtctcgctctgtctcccaggctggagtgcagtggcacaatcgtg

SEQ ID NO: 39530 - DNA, 65 bp, Homo sapiens
ggaaaatgaagagtagaacagcccatggattcattctgtggctgtctgtgtctctaagtgctttc

SEQ ID NO: 39531 - DNA, 96 bp, Homo sapiens
gtactgtgtgtgtgtgtctgtgtatatactattttatatgtataaaatatatttatatatgtatatttatatatatttatatatatgaaatagtat

SEQ ID NO: 39532 - DNA, 75 bp, Homo sapiens
gtcttactggtctaaagttttagagacgttgctatagtttctatgtttttgaaatcttaggaacaggtatttgac

SEQ ID NO: 39533 - DNA, 95 bp, Homo sapiens; identical to SEQ ID NO: 68

SEQ ID NO: 39534 - DNA, 93 bp, Homo sapiens; identical to SEQ ID NO: 69

SEQ ID NO: 39535 - DNA, 95 bp, Homo sapiens; identical to SEQ ID NO: 68

SEQ ID NO: 39536 - DNA, 93 bp, Homo sapiens; identical to SEQ ID NO: 69

SEQ ID NO: 39537 - DNA, 85 bp, Homo sapiens
tataggcagtggggttttaaaatctcccactattattgtgcaggagtctaactctctgtgtgggtctcttaagaacttgtttata

SEQ ID NO: 39538 - DNA, 68 bp, Homo sapiens
tacatagtgaatatatgtgtgtgcatgtatatataaatttatatatgcatacttatatattttatgta

SEQ ID NO: 39539 - DNA, 93 bp, Homo sapiens
agcactgggataataggcgtgagccactgcactcagccaaaatctctttttttttttttttttttgagacagtctcgctctgtcacccaggct

SEQ ID NO: 39540 - DNA, 102 bp, Homo sapiens
tgcctggcccacacacttgaactagggctcctcagtctcagaggctgaggccagtttctctctctgcctgtggcccctcagattccagcatagggccaggca

SEQ ID NO: 39541 - DNA, 101 bp, Homo sapiens
gcatgtgtgtgccgtgtgtgatgaatgtgtgtatggtgtatgtgatgaatgtgtgtgatgagtgtgtggtgtgcatgtgatgagtgtgtgaacatgtgtgt

SEQ ID NO: 39542 - DNA, 61 bp, Homo sapiens
caccatctgtaacagcttcttgatctgtccccagatgggtggctgtatttgacaggtgttg

SEQ ID NO: 39543 - DNA, 85 bp, Homo sapiens
gggaggcggctgaggtaggaggatcacttgaatccaggagaagggggggaggttgcagtgagccgaggttgcaccactgcactcc

SEQ ID NO: 39544 - DNA, 115 bp, Homo sapiens
gttttgttgtctccatcagcaatttaaagcaacagcaagatgaatccttgtaaaggcacacactcgctctctgggttctgttgaagttctagtttgtcatgggtacttgttgagc

SEQ ID NO: 39545 - DNA, 102 bp, Homo sapiens
ctcccctttatatatatctatatctatatatctatatctgtatctatatagctatatatatagagttttgaacagtatatatatatatagagagagagagag

SEQ ID NO: 39546 - DNA, 81 bp, Homo sapiens
tctctctctatatatatatatactgttcaaaactctatatatatagctatatagatacagatatagatatatagatataga

SEQ ID NO: 39547 - DNA, 89 bp, Homo sapiens
gcccagtttgctttttgtcttttttttttttttgagacggagtcttgctctgtcacccaggctagagaatacagtggtgtggtcttggc

SEQ ID NO: 39548 - DNA, 95 bp, Homo sapiens
gtggagcctgatgatgtgactgagttggggcaatctcatgataaaacttttttttttttttgagacagagtctccctctgtcgcccaggctgtat

SEQ ID NO: 39549 - DNA, 113 bp, Homo sapiens
agattatcttggcttatacgggctcttttttggttccatatgaaatttaaagtagttttttctaattatttgaagaaaatcaatggtagcttgatggagacagcattgaatct

SEQ ID NO: 39550 - DNA, 77 bp, Homo sapiens
ggtagctggaagagcatcatctctgggtgtgtctgcgagggcgcttctggagagattagcatgggaaccagcagact

SEQ ID NO: 39551 - DNA, 83 bp, Homo sapiens
taaacttttatttgatttgggctttttgatggtactggtgctggtagaagagcacagaaagcaatggattgaattgtagttta

SEQ ID NO: 39552 - DNA, 106 bp, Homo sapiens
tgtgtgagcgtatatacatacatgtgtgtatacacatacacgtgtgtatatatgtatatacatacacttgtgtatatacacatacacgtgtatgtgtatatacaca

SEQ ID NO: 39553 - DNA, 56 bp, Homo sapiens
gagacatggtctcactctgtgactcaggctggagtgcagaggcatgagcatgtctc

SEQ ID NO: 39554 - DNA, 99 bp, Homo sapiens
gcccttggactccttcccattgagaagttactgtcctttctgcatcactttttgttgtactctatgcctggagagaaaatctcatggtctacaaagggc

SEQ ID NO: 39555 - DNA, 70 bp, Homo sapiens
accaggactttgcctctctctgtctctagggggctattgtttttggagggcggaggagggaaaggttggt

SEQ ID NO: 39556 - DNA, 71 bp, Homo sapiens
gcaactgaagaggctgaggtagcaggatgacctgagctcagggggttgaggctgcagtgagccacagttgt

SEQ ID NO: 39557 - DNA, 104 bp, Homo sapiens
gtccaagtttggtaagtcaatttttaaatttctgtcatactgaatagaaattttatttttctagtaagacagattgaatatcccttatccaaaatgcttgagac

SEQ ID NO: 39558 - DNA, 114 bp, Homo sapiens
ggatcgtgattttttgctgtatttgtgaaatcttttcctaacacatggttacaatgtttttcttctatgtgttcttacagaagttttgtatagctaggttttacatttaggtct

SEQ ID NO: 39559 - DNA, 92 bp, Homo sapiens
ctgaggatggcacaagagaaaggcactgggctctaaaactgtgaggttaacagaagctgctttagctattatcttgcaaatggcaaccccag

SEQ ID NO: 39560 - DNA, 86 bp, Homo sapiens
caccctatgtatggaatcaaaggaagagctagtggcttctggttcctggccagatttctgtctgtttctgctttaaataggctgtg

SEQ ID NO: 39561 - DNA, 162 bp, Homo sapiens
atatatattatacatgtttatatattgcatatttaaacatgtatgtttatatattgcatatttaaacatgtatgtttatatattgcatatttaaacatgtatgtttatatattataaatgatatatattatataatatatgtgatatattttatatatacat

SEQ ID NO: 39562 - DNA, 73 bp, Homo sapiens
cacaggaggactgaggccatgagtctgaaagaagagactgctcagtgacagattgttggctttgccaagggtg

SEQ ID NO: 39563 - DNA, 78 bp, Homo sapiens
cctgccttcggggcagtcgggcgcagggacccaggccgcagctcccacccacgctcactcactgctccggtcccaggc

SEQ ID NO: 39564 - DNA, 80 bp, Homo sapiens
atctgtctgcctcactctttgtcccatgggcagcaaaggcccagcttgggtcatggaccagatgaggaataagcccagat

SEQ ID NO: 39565 - DNA, 58 bp, Homo sapiens
tgagacatgatctcgctctgtcactcaggctggagtgcagtggcacgatctcggctca

SEQ ID NO: 39566 - DNA, 110 bp, Homo sapiens
agccctcaataccccatatatatattcaggattggaaatgtcacagtggattgtaatgatgagtgttatttctttctagacagtgatctctgacgccagggtgtgaagct

SEQ ID NO: 39567 - DNA, 57 bp, Homo sapiens
tgagtcagggtctcactctgtcacccaggctggagtgcagtagcagatctcagctca

SEQ ID NO: 39568 - DNA, 129 bp, Homo sapiens
gcagccaggaagctcgaactgggtggaacccactgcagctcagggaggcctgcctgcctgcctgcctctgtagactccacccctgggggcagggcatagccaaacaaaaggcagcagaatcctctgcag

SEQ ID NO: 39569 - DNA, 107 bp, Homo sapiens
cccctgcctcaagggttattttaaagactaaatgagtgaatatacagagcacagtgcctggctggtattaagcattacatagtctttcaaaaaagctgggcagctgg

SEQ ID NO: 39570 - DNA, 115 bp, Homo sapiens
gcccagccagccactgtctttttaagagacattagatgccaccagtggaatgatgatagcagaatgaacaaatgtggagaactcatgatctttgtagagtcagatgcacctgtcc

SEQ ID NO: 39571 - DNA, 71 bp, Homo sapiens
gtgcagacaatactaccaattttaagaaaaaaaaaattttttttttttttgagatgaagtcttgctgtcac

SEQ ID NO: 39572 - DNA, 68 bp, Homo sapiens
ataagtacagatgtatctatatatagatgtatctatatatctatctatatagatgtatctatatctat

SEQ ID NO: 39573 - DNA, 69 bp, Homo sapiens
gttaggtgtgacaaaggtatgataattgtcccccgccccgtggacggagtctcactctgtcacccaggc

SEQ ID NO: 39574 - DNA, 80 bp, Homo sapiens
ggcactgaggctctctgtcactgactaaggaggtaaacttaaaaaacttgcttctcagtgcatcagtttcctcatctgtc

SEQ ID NO: 39575 - DNA, 64 bp, Homo sapiens
tattctgcatttgggtgtttttgggagggagatggagtctcactctgacacccaggctggagta

SEQ ID NO: 39576 - DNA, 58 bp, Homo sapiens; identical to SEQ ID NO: 28315

SEQ ID NO: 39577 - DNA, 57 bp, Homo sapiens
tgagacatgatctcgctctgtcactcaggctggagtgcagtgcacgatctgggctca

SEQ ID NO: 39578 - DNA, 58 bp, Homo sapiens
tgagatgtagtctcgctctgtcactcaggctggagtgcagtggtatgatttcggctca

SEQ ID NO: 39579 - DNA, 107 bp, Homo sapiens
tcttcaagtctcaacaagaactgaataagaattttaattatttttgatatatactcagaagtgaattactagattctatgataattctatgtttaattttttgaaga

SEQ ID NO: 39580 - DNA, 95 bp, Homo sapiens
ttgtctacaattatatatgtatgtgcatgtatatgtgtgtatatatatatacatacacatacatacacacatgtacatatatataattgcagcaa

SEQ ID NO: 39581 - DNA, 73 bp, Homo sapiens
aggtaggaaggattatatgaaaagagaggagactgtggggacacagcccgcttttctgtttgtttgcctgctt

SEQ ID NO: 39582 - DNA, 61 bp, Homo sapiens
cctgtctctctctgtgagttggggctttcaagagtaccattagcacaaaagacggacaagg

SEQ ID NO: 39583 - DNA, 75 bp, Homo sapiens
gacagtacatcagtgtgcatggctgtgtttcaataaaactttatttataaaaacaagtggtgagctggatttgtc

SEQ ID NO: 39584 - DNA, 113 bp, Homo sapiens
aggtgatctcgctcgtattcccatgcactctcttgctctctttatctctctctctgtaaaggaaggtaaggctgaaaagtaagctgttctgaggctcgtgatgtgtattatct

SEQ ID NO: 39585 - DNA, 76 bp, Homo sapiens
caatattgaggttgtagggagtgtccagatacccggcatgcttgactgtctctccctctcccatgactccagtttg

SEQ ID NO: 39586 - DNA, 75 bp, Homo sapiens
cttgaggttgctgtctagatgaaaccccggggatatttggaattctctgtagttgtgatcttgtgcagtttggag

SEQ ID NO: 39587 - DNA, 77 bp, Homo sapiens
gcctgcttgtctctcctagtagtgtaataggtttcaagcttgtggacttactgacactctgacttagaacaggaggc

SEQ ID NO: 39588 - DNA, 77 bp, Homo sapiens
tgggtgacagagcaagactccatctcaaaaaaaaaaaaaaattttttttttgtagagttgtctcactgtgtcaccca

SEQ ID NO: 39589 - DNA, 113 bp, Homo sapiens
acaggtttggtgagatcacatctctccatatgcactttggataaatttctttatttatagagacttttttggagcctatacatttgacccctgctgacctcaccgctgtagcc

SEQ ID NO: 39590 - DNA, 138 bp, Homo sapiens
ctaggaaaaggccactttttaaaatgactgtttgaagaatgcttctagtgatttttataaaccactttttgtagttcactaaacagtaggtttttggcaagtgaacctggttatgtgaagttctagaattaaactagt

SEQ ID NO: 39591 - DNA, 68 bp, Homo sapiens
tctctctgtgtgtgtgcattgtgtgtctctgtgtgtgtacgtgattgcctgcacatatttttgggggg

SEQ ID NO: 39592 - DNA, 78 bp, Homo sapiens
gtaatctccacttgattgtgttgtgtaattcttgttatatgttgatgaattgcacttactaatgtcaggtttttttgc

SEQ ID NO: 39593 - DNA, 84 bp, Homo sapiens
tgcctcagactccggtagtgctccctctgtatgggctgcgtagacacactttctctctcagatcaggagccactggctggtgca

SEQ ID NO: 39594 - DNA, 74 bp, Homo sapiens
atatatatatacacagtgtatatataatgtgtatatatatatacacagtgtatatataatgtgtatatatatat

SEQ ID NO: 39595 - DNA, 74 bp, Homo sapiens; identical to SEQ ID NO: 39594

SEQ ID NO: 39596 - DNA, 74 bp, Homo sapiens; identical to SEQ ID NO: 39594

SEQ ID NO: 39597 - DNA, 59 bp, Homo sapiens
ttgagacacagtctcactcactctgtcgcccaggctggagtgcagtggtgtgatctcag

SEQ ID NO: 39598 - DNA, 62 bp, Homo sapiens
cgaaagtatatgtgtgtgtgtgtgtatatatatatatatacacacacatatatatatgagag

SEQ ID NO: 39599 - DNA, 116 bp, Homo sapiens
agcaatcaatattgtcaggctttttgattttagctatttgtatggatatgaaatgttatggttttaatttgaatgtccataatgattgatgatgtcaggtattgccttggtctgtt

SEQ ID NO: 39600 - DNA, 97 bp, Homo sapiens
caaagaagtaagtgccaattgtgttgtatttcctagaagctgtttttcattttatatgtaagcttctcactgcaagatttggcaaatacagtatttg

SEQ ID NO: 39601 - DNA, 80 bp, Homo sapiens
gcggcgggagcggcggggcggccaggcgggctctcgtcctctcacacgcgcactcacgcctcacgctctcacacacacgc

SEQ ID NO: 39602 - DNA, 104 bp, Homo sapiens
tcattctttatggataaatatactccactctatgcatatctatatatatatctatatagatatatatatagatatcacattttgtttatccattcatctgttga

SEQ ID NO: 39603 - DNA, 58 bp, Homo sapiens
tgagacagggtctcactctgtcaccccggctggagtgcagtggtgcgatcttggctca

SEQ ID NO: 39604 - DNA, 82 bp, Homo sapiens
cacttaatagactacagtatagtgtaagcataatttcttttttttagagatggggtctcactgtgttgcctaggctggagtg

SEQ ID NO: 39605 - DNA, 82 bp, Homo sapiens
atgtatacatgcatatgtatatatttatatacacatgtatacatgcatatgtatatatttatgtacatatgtatacatgcat

SEQ ID NO: 39606 - DNA, 89 bp, Homo sapiens
cgtgtgtgtatgtgtgtgtccatgcgtgtgtgtgtttgagacaaggtctcactctgtcacccaggatggagtgcattggcacgaacacg

SEQ ID NO: 39607 - DNA, 88 bp, Homo sapiens
ctatgtgtatgtgtgtgcgtgtatttatacgtgtatatatacgtgtgtgtgtatatatatataaagaaagcgaagcacgtgaagagag

SEQ ID NO: 39608 - DNA, 89 bp, Homo sapiens
tttgggaggctgaggcaggaggatcacttgaggccagagtttgagaccagcctgggcagcacagtgagactctgtgtctctctactaaa

SEQ ID NO: 39609 - DNA, 113 bp, Homo sapiens
ccaatggcattaaattcttctaattaatattgtgaaatctaggtatatagcgctgactcaggcactctctataaaccaagattttgaattctgagttaaatttttctgcgtgg

SEQ ID NO: 39610 - DNA, 129 bp, Homo sapiens
aggacatcttggttgctcccacgttttggcgaatttggattctggatgtattttgaggggagagttgacaggatttcctgacagcttggatgttttgtgagcagtgactccaaggagaatgccaagtac

SEQ ID NO: 39611 - DNA, 102 bp, Homo sapiens
ggcaactgtgagagagattcttcttctcaaaagaatctagtcacctttaataaaaaatgctaacttctttttttttttgagacagagtgtcactctgttgcc

SEQ ID NO: 39612 - DNA, 69 bp, Homo sapiens
tggcagtgtgggcttcttatttaaaaaatttattttttactttttttgagacaaggtctcactctgtca

SEQ ID NO: 39613 - DNA, 78 bp, Homo sapiens
gtgtgtatatgacggatatatatgtgtatatatatgatggattatatatatgtatatacatgttggagatatatatat

SEQ ID NO: 39614 - DNA, 77 bp, Homo sapiens
atatgtgtatgtatatgtatatgtgcatatatataaaatatatgtatatgtgcgcatatatatatatatatatatat

SEQ ID NO: 39615 - DNA, 109 bp, Homo sapiens
tctcttcactgattttgaaatggtgattgataggggacttctatttttttttttttttttttttttgacagtctcactcttttgcccaggctggagtgcagtggtgtga

SEQ ID NO: 39616 - DNA, 56 bp, Homo sapiens
gagactgagtctccctctgtcacccaggctggggtacagtggcgtgatcttggctc

SEQ ID NO: 39617 - DNA, 105 bp, Homo sapiens
gtgaaagtagtattccactgtagaatatatcacaatttatttttctgttctcctcttgatggcagtttgagttgtacataatttttgtgggtctcgctgtgttgc

SEQ ID NO: 39618 - DNA, 88 bp, Homo sapiens
ccaacctgggcaacatagtgagatcccatctctaaaaaaaaaaaatttttttttttgagacagagtctcactctgtcacccaggctgg

SEQ ID NO: 39619 - DNA, 100 bp, Homo sapiens
gatgatgctgcaatcttgagatagaaagctgaaaatttagacatgtttccatgttgcagtctttttttcttcttttttttcttgagatggagtctcactc

SEQ ID NO: 39620 - DNA, 115 bp, Homo sapiens
caattaatcatatatgtgtatatgtgtatatatatatgtgtacatctatgtatatgtgtatatatatatctgtatgtgtatatgtatatacatatatgcatatattttaaagttg

SEQ ID NO: 39621 - DNA, 82 bp, Homo sapiens
gtttctgggtttcaatcagagactaagttgttcacttttttttttttttttttgagacagggtctctctgtcacccaggcac

SEQ ID NO: 39622 - DNA, 92 bp, Homo sapiens
tgtttagaagagaaatgagactcactctgtgtggctggagaggaagacttcaaaaggggcccagggaggcagattttcattcaatataaata

SEQ ID NO: 39623 - DNA, 92 bp, Homo sapiens
ggctttcttactggtgtttatctgggacacacacatacacacagcctcttcttctgccatctcctagttctgacactcagccctgagcagcc

SEQ ID NO: 39624 - DNA, 88 bp, Homo sapiens
gttccatcacaccgtgtgtgtctcagtcacaagaagtaaagcaaagcagaaatacagcatgggcttgagcacaaaagaactggggaac

SEQ ID NO: 39625 - DNA, 114 bp, Homo sapiens
tcctagtgggaggtgtctgggtcatgggggtgaacccctcatgaatggctttctgtcattctgaaagaagtgagtgagttttgatctcgtgagactgggttagttatcacagga

SEQ ID NO: 39626 - DNA, 128 bp, Homo sapiens
tgtatatgtatgtgtgtgtgtatatatatgtgtgtgtgtgtatatatatatacagggtgtgtatatatatatatatatatacagggtgtgtgtatatatatatatatacagggtgtgtatatatgtgt

SEQ ID NO: 39627 - DNA, 120 bp, Homo sapiens
ccgcctcagcctcccaaagtgctgggattacaggtgtgagccaccgtgcctcgcccatttttttttttttctttttctgagaccgagtctcaccctgtcacccaggctggagtgcggtgg

SEQ ID NO: 39628 - DNA, 105 bp, Homo sapiens
tcaggtgtggtggcatgctcctgtagtcgcagctacccgggaggctgaggtaggaggatcgcttgagcctgggaggtgaaggttgccgtgagctgagattgcacc

SEQ ID NO: 39629 - DNA, 61 bp, Homo sapiens
catctaagattctagctgagcctgtgcctacctggctgggctcttctctctgtctcagttg

SEQ ID NO: 39630 - DNA, 118 bp, Homo sapiens
gttttccaggtttgctattatgtcatcagcaaatagagagagttttaattttatttttttcccttttatgtttaattgttttctctactctaattgtattgagtagtacctacagaac

SEQ ID NO: 39631 - DNA, 71 bp, Homo sapiens
gagtgactttataagaaaattgagacccatcaatgtgtctttttttgagacagggtctcactctgtcaccc

SEQ ID NO: 39632 - DNA, 98 bp, Homo sapiens
gtaggaagtctgataggcctgttgaatgaattgatgaatgtacaaattaatttgttatccatcaggtagtgtagcatgcaattatagtcccctcctat

SEQ ID NO: 39633 - DNA, 82 bp, Homo sapiens
tgcttctgggactcttgcgtgctctcttctgttagtagctttgacagcaagacccacacattctcacacaagacccagggca

SEQ ID NO: 39634 - DNA, 105 bp, Homo sapiens
atggtggtacatgcctgtagttccagctactcaggaggctgaggtggaaggatcacttgagcccaggagttcaagtccagcctggagaacatagcaagaccccgt

SEQ ID NO: 39635 - DNA, 58 bp, Homo sapiens; identical to SEQ ID NO: 605

SEQ ID NO: 39636 - DNA, 71 bp, Homo sapiens
gagggggtagaaggagggagggtagggggagagttgggattctctcactcactctctcgttctcttttctt

SEQ ID NO: 39637 - DNA, 99 bp, Homo sapiens
tgaatagagtttgttatacattttatgtatatgtgtgtgtatatatgagatgtgtatatatatatatcatactatgtcataatttataatgtcaaactc

SEQ ID NO: 39638 - DNA, 91 bp, Homo sapiens
atagattttttaaatagactatatatagtcatatatatcatatatatatgatatatatatatatatataggacctctgattgaatatttat

SEQ ID NO: 39639 - DNA, 102 bp, Homo sapiens
atattataatatattttatatgttctagagatataatatatagatacataatatatctagatttttatgtattctaaacatatgtttatatattatatatgt

SEQ ID NO: 39640 - DNA, 64 bp, Homo sapiens
tggcttttctggcatgaacagctacagtgctaaggtgcacacttgtctgtctgcctgtttgcca

SEQ ID NO: 39641 - DNA, 85 bp, Homo sapiens
ctgttagttcatgttagctcagtcggcatcatgggtgcttttgaaaactcatagtttctctgtctggttaacaagcatctcacag

SEQ ID NO: 39642 - DNA, 97 bp, Homo sapiens
gtctctccctgctctgatctcagagttggggccaagccctgacactgtcactgcctggcagggtgtgcacacgctgggggcaatgctgacgtgccag

SEQ ID NO: 39643 - DNA, 121 bp, Homo sapiens
ccacattcctcttagccatggcgctgagcacagagtcattactcaatccaggaagttgtcatttttttttttttttagatggagtctccctctgtcaccaggctggagcgcagtggtgcga

SEQ ID NO: 39644 - DNA, 80 bp, Homo sapiens
ctttgcttgtctttaatgtatacatttatacattcagtttacaaacttaatttgtaaatgtgtataactgtaagcataag

SEQ ID NO: 39645 - DNA, 132 bp, Homo sapiens
ttggccatagggaattatgagaatgatgtcaaaggatgactgttttactttttgttttttgttttttgttttgagacggagtctcgctgactcccaggctggagtacggtggcgcgatcttggctcactgca

SEQ ID NO: 39646 - DNA, 120 bp, Homo sapiens
atgattagatcatatttcccttccacaatttgtgcttagagttgtatcacattactcttatcagagccattttgacaatcatctactaagcagaaattggtataattgaggtcttttcat

SEQ ID NO: 39647 - DNA, 92 bp, Homo sapiens
acttgcaatactttgattttatcattttatgtgatgacttgtgtgatggttaatattgagtgtcaacctgattggattgaaggatgcaaagt

SEQ ID NO: 39648 - DNA, 72 bp, Homo sapiens
aggcgggatgaggtggtgttggagggatgggccatgctagtgactcactcactctgacatccttagcaacct

SEQ ID NO: 39649 - DNA, 123 bp, Homo sapiens
gtatgtatgtatgtatgtatttaagacagaggctcgctatgtatgtatgtatgtatgtatgtatgtatttaagacagaggctcgctctgtcacccaggatgtatgtatgtatgtacgtattta

SEQ ID NO: 39650 - DNA, 75 bp, Homo sapiens
tggcactgccctttcctctctggctgtgtgactgtggtcagcgcttgtcccggctgatggggagggttctggcca

SEQ ID NO: 39651 - DNA, 85 bp, Homo sapiens
ttgtgtgtatatatgtatgtgtgcatgtgtacacgtgtgtttcagacacacacacacatacgcacacatatctgtggggctccag

SEQ ID NO: 39652 - DNA, 58 bp, Homo sapiens
tgagccagagtctcactctgtcatccaggctggagttcagtagtgtgatcttggctca

SEQ ID NO: 39653 - DNA, 104 bp, Homo sapiens
gctttttgggcattgctttggggacctcaagtgaactgggtcattgtttcaatgaactgggtcagtgtttcagtctgtctgagctttagtcatgtacaagaagc

SEQ ID NO: 39654 - DNA, 95 bp, Homo sapiens; identical to SEQ ID NO: 68

SEQ ID NO: 39655 - DNA, 93 bp, Homo sapiens; identical to SEQ ID NO: 69

SEQ ID NO: 39656 - DNA, 81 bp, Homo sapiens
atctgggcagggtctctgttggcaagctctgcctctctacagcagaatgatgcaattcttccaccagatgacctttcaggt

SEQ ID NO: 39657 - DNA, 84 bp, Homo sapiens
gtttcactcatcctcagagctcaaggtcctgggtactttccatttctttatgttaggtatctactttggttaacatgggtcaac

SEQ ID NO: 39658 - DNA, 95 bp, Homo sapiens; identical to SEQ ID NO: 68

SEQ ID NO: 39659 - DNA, 93 bp, Homo sapiens; identical to SEQ ID NO: 69

SEQ ID NO: 39660 - DNA, 80 bp, Homo sapiens
ggctatctgggcttttttttagttccatatgaaatttaaagtagttttttctaattctgtgaagaaagtcaatggtagct

SEQ ID NO: 39661 - DNA, 131 bp, Homo sapiens
gtgtgtgtatatatatatatatatatatatatatatacgtatatatatatatatatacgtatatatatatatgtatatatatatatacgtatatatatatatatacacgtatatatatatatatatatata

SEQ ID NO: 39662 - DNA, 99 bp, Homo sapiens
gctgaaaacagaccacagctcctgttcaagccatgctggtggcctaaaaacacctagctatgctttgaaaagtacagttgtgaggactgctatatcagt

SEQ ID NO: 39663 - DNA, 186 bp, Homo sapiens
gtgtatacgtatacatatgtgtgtatatatgtatacacatatgtgtatgtatatacgtatatatgtatatgtatatatacatatatgtatgtatatatgtgtatatgtgtatatgtatatatacatacatatgtgtgtatatgtatatacatacatatgtgtgtatatgtatatacatacatatgt

SEQ ID NO: 39664 - DNA, 139 bp, Homo sapiens
tatatgtttgtgtgtgtatgtgtatatatatgtgtatgtgtacatatacgtatgtgtatatgtatgtgtatatatgtatgtgtatatatacacatacatacatacacatacatgtatgtgtatatatacacatacatac

SEQ ID NO: 39665 - DNA, 95 bp, Homo sapiens; identical to SEQ ID NO: 68

SEQ ID NO: 39666 - DNA, 93 bp, Homo sapiens; identical to SEQ ID NO: 69

SEQ ID NO: 39667 - DNA, 60 bp, Homo sapiens
ttgagacagagtctcactctgtcacccaggccggagtgcagtggtgcgatctcagctcaa

SEQ ID NO: 39668 - DNA, 58 bp, Homo sapiens; identical to SEQ ID NO: 10

SEQ ID NO: 39669 - DNA, 92 bp, Homo sapiens
tgagagtttaacttctatctgtctcactgtctcttgagcctcacaggaggaacaagatggaggtaggggggcgggtgtgggtgacactgtca

SEQ ID NO: 39670 - DNA, 95 bp, Homo sapiens; identical to SEQ ID NO: 580

SEQ ID NO: 39671 - DNA, 93 bp, Homo sapiens; identical to SEQ ID NO: 69

SEQ ID NO: 39672 - DNA, 115 bp, Homo sapiens
tcacatggcattctccctgtgtgtgtctgagtccaaatctcccttttttttttttttttttttttttttttttgagacggagtcttgctctgtcgcccaggctggagtgcagtgg

SEQ ID NO: 39673 - DNA, 117 bp, Homo sapiens
caggtaatttaatttaacaaagagctttaggactagttgtaatcacctagcaattactcataaaattgtttttaatttcatctatgttccttgagagccactgtgttgatgattctg

SEQ ID NO: 39674 - DNA, 99 bp, Homo sapiens
gtcttagatatataacatatatgcaatgtctcatatatatatatatatatatatatatatatatatatatacacgttatatatgatatgtataaaatgc

SEQ ID NO: 39675 - DNA, 107 bp, Homo sapiens
tgtgggcaacatggcaagacccccatctctaaaaacattatttttttttttaaaaaaaaaaaaaaggacagtagtgtgtgaggtgggcctggtggctcatgcctata

SEQ ID NO: 39676 - DNA, 65 bp, Homo sapiens
ttactagctgggtgatttggggcaaggggctgaacctctctgtgcctcagttttctcatctgtaa

SEQ ID NO: 39677 - DNA, 91 bp, Homo sapiens
tagctcccaagcagaggccagagcctttgggaacccatgccctgcaaccctgttgggtctcacagtctcaggctctccgtcctgggaggtg

SEQ ID NO: 39678 - DNA, 81 bp, Homo sapiens
ctcttgtttgcgttttcttgttgatctgtctttctcagtctaatttgcagatcccagctggaggatctaggagaatagggg

SEQ ID NO: 39679 - DNA, 135 bp, Homo sapiens
gccttaggcaccagcaagtaatttatctgaatggggttccatgctgtggttatggacagacgccctgactcactgtgacccatacggagatgagtggctggctgtgcagtggcaaccacagcattcctgcatccc

SEQ ID NO: 39680 - DNA, 79 bp, Homo sapiens
ggtgacaatcaggtgtggcatttatttgttttatttatttattatttatttatttgagacggaatctcactctgtcacc

SEQ ID NO: 39681 - DNA, 113 bp, Homo sapiens
gcactactataatttacaagtatccttaaactaccaacatagtaacagtgtgtaactcacacacactttattgttaacaaagcctgaagagcactgtcctaggtgagagtgac

SEQ ID NO: 39682 - DNA, 95 bp, Homo sapiens; identical to SEQ ID NO: 68

SEQ ID NO: 39683 - DNA, 93 bp, Homo sapiens; identical to SEQ ID NO: 69

SEQ ID NO: 39684 - DNA, 116 bp, Homo sapiens
agaattcaggtggacaaataaagctgtgaaagtgtaagaagtttgaagtctacagttacttattttatttcttagcaggtattttgcagagaatgtttgaatctatcatgtaatct

SEQ ID NO: 39685 - DNA, 71 bp, Homo sapiens
ccttttcttttgctcaacactgggtctctctgtttgagagcagacctgggttagaagagcaatgcctgagg

SEQ ID NO: 39686 - DNA, 84 bp, Homo sapiens
ggcactaagggaatgcagagtagtgacaataatgatgaacatttattgtgtttttactgagtgttgtgcactttcctcagtgct

SEQ ID NO: 39687 - DNA, 64 bp, Homo sapiens
ctctgtggcccaggctggaatgtagtagtgccgtcatagctcgctgcagccttgaatcccgggg

SEQ ID NO: 39688 - DNA, 96 bp, Homo sapiens
tcacaaggctgagattctgaatgagaagacaatttgggaattttattttattttattttatttatttatttattgagacggagtctcactctgtgg

SEQ ID NO: 39689 - DNA, 94 bp, Homo sapiens
gagcagtggggagggataaggtgagagaagagagaggtcttacaggcactgtaaggattttactctgagtcaatgacaagccacagattgactt

SEQ ID NO: 39690 - DNA, 82 bp, Homo sapiens
gatgttggtattttgataagaattgcattgactctgtagattgctttgagcagtgtagtcattttcatgatattgattcttc

SEQ ID NO: 39691 - DNA, 104 bp, Homo sapiens
gacagagcgagactccgtctcaaaaaaaaaaaaaaaggacactctcactcttggagccctgatttttttttttttttttttttgaaacggagtctcgctctgtc

SEQ ID NO: 39692 - DNA, 74 bp, Homo sapiens
catcttggactttgcagcctccagaactgtaagaaacaaatttttattgtttataagccaccaagtctaaggtg

SEQ ID NO: 39693 - DNA, 109 bp, Homo sapiens
gcaggaagcggagcttcggggtcctaggcatgtcctctcactctctctcattgcccctagcaatgaagaggtgcgtgtctccgagatacgaggtgctcttctctctagc

SEQ ID NO: 39694 - DNA, 64 bp, Homo sapiens
ctgtgtgtgtacacgagtgtgtgtgcccaggtctgtgtgggtgactctgtgtgtgtgtgcacag

SEQ ID NO: 39695 - DNA, 117 bp, Homo sapiens
ggaattgagttttatattaaaagatgactgggaagtgttcatgtgctcatgatttttttttttttttttaagtgtgcaatactttccccggcatttaaagttagagaattttccgtc

SEQ ID NO: 39696 - DNA, 80 bp, Homo sapiens
gacagagtgacactcctatttctatatatatatatatatatatatatatatatatatatagaaataattttgttatgttg

SEQ ID NO: 39697 - DNA, 116 bp, Homo sapiens
gccatgtatatattcatttgtcctctcatcagtccttctctgtctcagaaattcttttttatttttattttttgagatggagtcttgttctgttgcccaggatggagtgcagtggc

SEQ ID NO: 39698 - DNA, 68 bp, Homo sapiens
gtgtgtgcgtgtgtgtgtgtgtctatgtatttatctcttcaaatggcacacacagacttgtgtgtgac

SEQ ID NO: 39699 - DNA, 95 bp, Homo sapiens; identical to SEQ ID NO: 68

SEQ ID NO: 39700 - DNA, 93 bp, Homo sapiens; identical to SEQ ID NO: 69

SEQ ID NO: 39701 - DNA, 107 bp, Homo sapiens
tctcaactttaagcatcatgacatatatgcatacgtatatatacacacatatatgtatatgtatatgtatatgtgtgtatgtatgtatatatatatagagagagagt

SEQ ID NO: 39702 - DNA, 89 bp, Homo sapiens
ggagaaaagtttagacaaagaacatgagcctcagaggtgcaggaactttacctttgtgactttgttaatgtcactttgtttatttcttc

SEQ ID NO: 39703 - DNA, 114 bp, Homo sapiens
gtgtgtatataccatatatagtgtattataccatatataaaatagggatttttctttttaaaattaatataaatggcttatatatggcatgtatatatgtgtgtatatgcacac

SEQ ID NO: 39704 - DNA, 105 bp, Homo sapiens
tagagcaattatccttgcatgcatctgccttggaggtggctctgtgatttaatagagaatctcagtctttctctggctctgtgcttgaaaaagtctagttatttg

SEQ ID NO: 39705 - DNA, 117 bp, Homo sapiens
tgttctctctctttccctgtgtaggcagtgtttgtgcctctctctgtgtaggcagtgtcaagacaagatggaggccaaaagtaagatggacacttatattgagtgcataagaaaaca

SEQ ID NO: 39706 - DNA, 115 bp, Homo sapiens
tgcaagctccacctgcagggttcacaccattctcctgcctcagcctccccagtaagtttttttctttttttttttttgagatggagtctggctctgtcgcccaggctggagtgca

SEQ ID NO: 39707 - DNA, 86 bp, Homo sapiens
agccaggcatcgcagtgcatgcctgtggttccagctgcccaggaggctgaggtaggaggatccgttgagcaccactggtcgaggct

SEQ ID NO: 39708 - DNA, 94 bp, Homo sapiens
tgccggtctcagtttttaattgtgtcagggcctcatgcacgcgggcacacacacacactcaggccagatcttgttgaaagctgcgatgtcgaca

SEQ ID NO: 39709 - DNA, 109 bp, Homo sapiens
gtaggtctacagtttttcatctgtaaaatgagtgcactgaatttgatgttctctatttctttcagatccacaattcattgattctttgattctccactgtgctcactgc

SEQ ID NO: 39710 - DNA, 77 bp, Homo sapiens
tgcttcactctctccaaggtattcagtctggggagaccagagacaaaaatggttttgagagaacatagactgaagta

SEQ ID NO: 39711 - DNA, 102 bp, Homo sapiens
tctgggcatggtggcatgtacctgtggtctcagctatttgggaggcagaggtagaaggatcacctgagcccagggaggttgaggctgcaatgagccgtgacc

SEQ ID NO: 39712 - DNA, 77 bp, Homo sapiens
tgtctctctctctcagaatatcatccgacatcttgaatacttacaatgttagagacatgctgattgagatgtgggca

SEQ ID NO: 39713 - DNA, 59 bp, Homo sapiens
tggggcagaaaaggttttgtttttgttttttttgagacagagtctcattctgtcaccca

SEQ ID NO: 39714 - DNA, 58 bp, Homo sapiens; identical to SEQ ID NO: 9124

SEQ ID NO: 39715 - DNA, 112 bp, Homo sapiens
tttgatagtagttgggtagtagatagtgcaaggttaaaatctctgagcctcactctgtcttgagtattcttccctcaggtatttgcatggtttatcatcattctttttcagg

SEQ ID NO: 39716 - DNA, 67 bp, Homo sapiens
acaacaaatatacaggtacagatgagtgtatatatatatatatgtgtgtgtctgtgtgtgtgtgtgt

SEQ ID NO: 39717 - DNA, 77 bp, Homo sapiens
ctcagcacagagcctgcacacagaaggtgctccggtgggatctgccactgagcacaggtgatacagcttgagctggg

SEQ ID NO: 39718 - DNA, 59 bp, Homo sapiens
gtgtgtgtgtgtgtgtatatatatagtttcttcatatatatatatatatatatatatat

SEQ ID NO: 39719 - DNA, 95 bp, Homo sapiens; identical to SEQ ID NO: 68

SEQ ID NO: 39720 - DNA, 93 bp, Homo sapiens; identical to SEQ ID NO: 69

SEQ ID NO: 39721 - DNA, 106 bp, Homo sapiens
gaagctagttggaaggtctgctattcaatcactctaacatgtttatttatttcaaaaactgtaaatgacttatgtatttgattatagtgactttgcagtgtgtttt

SEQ ID NO: 39722 - DNA, 59 bp, Homo sapiens
gtgtccttgtaagaagagataccagagagctccctctctctctctgcatgtgaggacac

SEQ ID NO: 39723 - DNA, 113 bp, Homo sapiens
aagtgacctctctgtggcaggcattctagcagagcagaagttatttttatctttagagtttcttgtaaagtcttctgcttcatgttggcttaaactatagctttctgtttctt

SEQ ID NO: 39724 - DNA, 56 bp, Homo sapiens; identical to SEQ ID NO: 1102

SEQ ID NO: 39725 - DNA, 82 bp, Homo sapiens
gtgtgtgtgtatatatatacgtgtatatatatatgtgtgtatatatatgtgtatatatgtgtgtatatatatacatacacac

SEQ ID NO: 39726 - DNA, 113 bp, Homo sapiens
aaacaggatggaaatatttgccaaatacttgccatgtatatattttctttgaataaagctagtaagaaggaagaggagcatggttttgaattgttttgtattactctctgttt

SEQ ID NO: 39727 - DNA, 116 bp, Homo sapiens
ggattattttctaattctgtgaaaaatgatgttggtattttaatagtaacagtactgaatctgtagattgctttgggaagtatggtcattttttatgatattgattcttccaatcc

SEQ ID NO: 39728 - DNA, 71 bp, Homo sapiens
gtttgtttgagacggagtctcactgtctcccaggctggagtgcagtggcacaatctctgctcattgcaagc

SEQ ID NO: 39729 - DNA, 99 bp, Homo sapiens
ggtgattccaacacttcccactccaaaagttctatttatttaaatgttactcaggcatttgtgggtaaatatggagaaggtggtagtagttggcctacc

SEQ ID NO: 39730 - DNA, 81 bp, Homo sapiens
tatcactgtcactatctcatttgtgatattgcactatagttatgcaagacattacaattgggagaaactgggataagggta

SEQ ID NO: 39731 - DNA, 93 bp, Homo sapiens
atttatatgatgcaaatatatatatattcttgatgtatttatgtgattatatgtgttatgtgtctatacatatatatttgacattgtagaagt

SEQ ID NO: 39732 - DNA, 58 bp, Homo sapiens
tgagagagagtctcactctgtcactcaggctggagtgcagcggtgcgatctcggctca

SEQ ID NO: 39733 - DNA, 118 bp, Homo sapiens
gtctgtgtatatgtaggcatgtgtgtatatataagcatgggcatgtttatatgcatgtttatatgcatatacacataggtgtgtatgtgtgtacatatgagtgtgcatgtacatacac

SEQ ID NO: 39734 - DNA, 70 bp, Homo sapiens
actatatatgtatgtatatagtacactatatatgtatgtatatagtacactatgtatgtatgtatatagt

SEQ ID NO: 39735 - DNA, 116 bp, Homo sapiens
ccaggtgggtgaacacaccaaggtgctcggaaggtggtgcacccaagagggtaaggaggctctctctgtgtgactccctcgctctgtatcttgccatgtgcattgcttccatttgg

SEQ ID NO: 39736 - DNA, 77 bp, Homo sapiens
cagctatgatgtgccagccattctgttattctatttctgtttctaggaatagataaaagaagaggccatgattcctg

SEQ ID NO: 39737 - DNA, 59 bp, Homo sapiens
tattgcagactgtgtgtgtgtgtgtatatatatatatacataagtaatagactgtagta

SEQ ID NO: 39738 - DNA, 77 bp, Homo sapiens
atatatatacttccatatgtgtgtatatatatactctttagtcttttatatatacatacatatatatatatatatgt

SEQ ID NO: 39739 - DNA, 95 bp, Homo sapiens; identical to SEQ ID NO: 68

SEQ ID NO: 39740 - DNA, 93 bp, Homo sapiens; identical to SEQ ID NO: 69

SEQ ID NO: 39741 - DNA, 113 bp, Homo sapiens
tggggctaaaaataaaattgtcatcatcctcatgaattaccactgtgtcaaatactgagtggttttgaatttataggttctatttgagaggttattatttttagttaagccca

SEQ ID NO: 39742 - DNA, 116 bp, Homo sapiens
atctattggaatttggatttgaaatgcattgaatttatgggttattttagagagtctagacattttttatttaatcttggtgaagaggtacaatattttaaacagaattctaaggt

SEQ ID NO: 39743 - DNA, 101 bp, Homo sapiens
gttttcctctctccgatttatgctctgcacaccattgttcttttattttaaagtagcttactagaatttctggagtacaagcatttcagagaatggttggc

SEQ ID NO: 39744 - DNA, 58 bp, Homo sapiens; identical to SEQ ID NO: 315

SEQ ID NO: 39745 - DNA, 83 bp, Homo sapiens
gcaggccttttgggttttgaagcagagtggtaccttcttccaaaaatatttattcttttctttagaaatagcccttggcttgc

SEQ ID NO: 39746 - DNA, 116 bp, Homo sapiens
gtggaaagggcttggctggacatttctgggtaggcttgcagacaatgggacccactgtcagacagacttgggccccaactccacttaacccttgatctctaaatgcccccacagtc

SEQ ID NO: 39747 - DNA, 95 bp, Homo sapiens; identical to SEQ ID NO: 68

SEQ ID NO: 39748 - DNA, 93 bp, Homo sapiens; identical to SEQ ID NO: 69

SEQ ID NO: 39749 - DNA, 81 bp, Homo sapiens
cacgcctggctggtatatagtactttttttttttaatcatactttaagttctagggtacatgtgcacactgtgcaggtttg

SEQ ID NO: 39750 - DNA, 65 bp, Homo sapiens
ctcactctatctctcaggctggagggcagtgacgcaatcacagctcagccttcagagtagttggg

SEQ ID NO: 39751 - DNA, 68 bp, Homo sapiens
ggcagttaccacgaatggcacttgcaggacgagagaagttgctctgggtgagtcagtgagtgactgct

SEQ ID NO: 39752 - DNA, 140 bp, Homo sapiens
tcttgaggggaccactttgattgacaatcccatgttagattgggttcccagactctgagatgtaaagttgtttgcagaatgtttactggggagtgctctcgggagaagcactgtaaggaattgagaaaagcagaattggg

SEQ ID NO: 39753 - DNA, 87 bp, Homo sapiens
tgtatgtgcgtgtgtgtgtgtgtgtgcctgtgtgtgcatgcatccatgtatgtgtgtgtgcatgtgtgtatacatgcatgtgtgtgt

SEQ ID NO: 39754 - DNA, 87 bp, Homo sapiens
gcagaggttagtgaagacagaaagcagagcccctgcctccaggtgagcctgcaccttctcataacttacaaccgctacatcctctac

SEQ ID NO: 39755 - DNA, 104 bp, Homo sapiens
tgtattataacacaggacttataagtccccatttttcttgtagtttttagtttttattttttttagagatgggggtcttgctatgttgtccaggctggagtgca

SEQ ID NO: 39756 - DNA, 95 bp, Homo sapiens
gttaatacttaataaactccccattatatatgtatagtattattaagtattattaataatactatatatattaatttagtttattaagtattaac

SEQ ID NO: 39757 - DNA, 58 bp, Homo sapiens; identical to SEQ ID NO: 1847

SEQ ID NO: 39758 - DNA, 115 bp, Homo sapiens
ttgttttaattctgcttcaattccacaaataatgagtttatttttttattttactttctctcaaaaagtggattcattttttgtctggaaatgttagataaactctttaaaatgg

SEQ ID NO: 39759 - DNA, 120 bp, Homo sapiens
tccagctcttggctcatctaagatttgtgaatttaatccttgcaaaaagtcttccaaaaattagctacttgtttgttttgtttttttgagatggagtctcactgtgtcacccaggctgga

SEQ ID NO: 39760 - DNA, 83 bp, Homo sapiens
gagatggagtctcactctgtcacccaggctggagtgcagtggctggagtgcaacctccacctcccaggttcaagtgattctcc

SEQ ID NO: 39761 - DNA, 104 bp, Homo sapiens
agaaaagctacataataatagaagatacccaatatgtatatttttaaatctccagattaaaaaatatattttatgtggtgaatattaattttgtatgcattttt

SEQ ID NO: 39762 - DNA, 87 bp, Homo sapiens
actcctgggcccctctgcatgtctgagtggctgctctgctgagactccacacagctctttgtgtcagactgaaggccctgctggagt

SEQ ID NO: 39763 - DNA, 72 bp, Homo sapiens
ctgggctcagtggctcatgcctgtaatcacaacactttgggaggctgaggtaggaggatcacttgaggccag

SEQ ID NO: 39764 - DNA, 73 bp, Homo sapiens
atattataatcattatgctatctttggtaagaattttctatttattatcaaggaaggcattcctttatgatat

SEQ ID NO: 39765 - DNA, 95 bp, Homo sapiens; identical to SEQ ID NO: 68

SEQ ID NO: 39766 - DNA, 93 bp, Homo sapiens; identical to SEQ ID NO: 69

SEQ ID NO: 39767 - DNA, 96 bp, Homo sapiens
gataggtttgttggtgattactagtgaagcaaaacagggcatgttttgtgctcctgtagttttattttatttattaatgactggatattacccttc

SEQ ID NO: 39768 - DNA, 93 bp, Homo sapiens
cttgctgttcttataaaggtctagagtttttcttgaattaacagcctctgggttgttgtaaacctctgattgctttccaaagaactgaaaaag

SEQ ID NO: 39769 - DNA, 109 bp, Homo sapiens
aatatacagatgacctccaacttgtgatggttcaacttatgttattttttacataaaaagagtttatgggtatgtaaccccatcataagttgaggagcacctgaatatt

SEQ ID NO: 39770 - DNA, 98 bp, Homo sapiens
tgtgctcagaagagaaaaaataatatgtgtacataagtagatatattttattttatttatttatttatttattattatactttaagttttagggtaca

SEQ ID NO: 39771 - DNA, 102 bp, Homo sapiens
ttgcttcattcatgaggaacaaagctcaggctctctgctcaacaatgtcttaacacaaactgtctgagcagacagcgttcatttgtccttcatgaactgcaa

SEQ ID NO: 39772 - DNA, 106 bp, Homo sapiens
tgaggcacaagacatgtgagcaaagccactgtagattctgccgcccagtcaagctgccccactgtcactgtgtggcttagaggttagctgtcctttttgagcctta

SEQ ID NO: 39773 - DNA, 128 bp, Homo sapiens
tatatatgtatatgtgtgtgtatatatgtatacatttatgtgtgtgtatgtgtgtgtatatatatgtatatatttatgtgtatgtatatatgtatatatttatatgtgtgtgtgtatgtatacatata

SEQ ID NO: 39774 - DNA, 75 bp, Homo sapiens
ggagtctcactctgtcacccaggctggagtgcagtgacactgcaacctctgcctcccagatttaagtgattctcc

SEQ ID NO: 39775 - DNA, 82 bp, Homo sapiens
gttagctgggcatggtggcacctgcctatagttccagttacttgggaggctgaggtaggaggatcgcttgagcccaggaggc

SEQ ID NO: 39776 - DNA, 91 bp, Homo sapiens
tagtattctgcacatgaatatttatttttctggagtagggtccatacctctcattaaattcccatgaaggagcatattcaccagaaaacta

SEQ ID NO: 39777 - DNA, 63 bp, Homo sapiens
tcaagaggggctctgtcaaatgcactgttgaaattctcagactgtctgacagcattcctctga

SEQ ID NO: 39778 - DNA, 95 bp, Homo sapiens; identical to SEQ ID NO: 68

SEQ ID NO: 39779 - DNA, 93 bp, Homo sapiens; identical to SEQ ID NO: 69

SEQ ID NO: 39780 - DNA, 121 bp, Homo sapiens
tatatatatatatatatagaagatatatataataatcgtctaatatatatatgtctatatatgtgtgtgtgtgtgtatatatatatatatatatatatatatatatatatatatatatatt

SEQ ID NO: 39781 - DNA, 98 bp, Homo sapiens
gcaaagagttcattgaacagtactttttttgatgtttttagactgagataaggaaataaacgttttggaaatgctgcacaatctagaaaagattttgc

SEQ ID NO: 39782 - DNA, 58 bp, Homo sapiens; identical to SEQ ID NO: 605

SEQ ID NO: 39783 - DNA, 97 bp, Homo sapiens
gggccaccacagtgccctgagaggattgtgtggacacagggctatgagatagccctgctttgaccttctagctgtgctgtagggctagatggggcct

SEQ ID NO: 39784 - DNA, 116 bp, Homo sapiens
ctggaacttgtcctgtttcacctaattattctcttaatataatttttaaaattctaataattgttaagaagtatctaagagagaataaagtgtttagagaagtagctgtgtttcag

SEQ ID NO: 39785 - DNA, 97 bp, Homo sapiens; identical to SEQ ID NO: 1307

SEQ ID NO: 39786 - DNA, 88 bp, Homo sapiens; identical to SEQ ID NO: 1308

SEQ ID NO: 39787 - DNA, 81 bp, Homo sapiens; identical to SEQ ID NO: 1309

SEQ ID NO: 39788 - DNA, 77 bp, Homo sapiens; identical to SEQ ID NO: 1310

SEQ ID NO: 39789 - DNA, 99 bp, Homo sapiens
agtcatgttccagcggcagaattcagcagccacagaaattttaagaagtgactacattctttatttttagttgatgaagaacgttagagggatatgatt

SEQ ID NO: 39790 - DNA, 105 bp, Homo sapiens
agtattagaaaactggtgggaagaattataatcttggggagctccctctatccctgaagctcttcaggagaaacacaaactcttctgtctagtggttccagaact

SEQ ID NO: 39791 - DNA, 115 bp, Homo sapiens
catttcttcaaaaaaaaattgggattttgatagagactgcatcgaatctgtagatcatttttattttttgttgccatcttaataatattgtcttccaattcatgcatatgagatg

SEQ ID NO: 39792 - DNA, 95 bp, Homo sapiens
attgtgaatagtactgctatgaacatatgtacatatacttttttgtatatatacaagtatatgtacatatacttgttcgaatacctgtttttaat

SEQ ID NO: 39793 - DNA, 116 bp, Homo sapiens
gtatgttttgtcttggcaggttattttccttgtagataagctttctttaatatttatttattctttcagtgaaccatatttagtgcatgcaaggttggactgagacaaatgtgtac

SEQ ID NO: 39794 - DNA, 82 bp, Homo sapiens
gtgtctgctttattaaatggttgttgagtgctaaatacgtgtgcacacgcgtgcatgcacacacacacacacatgcacacac

SEQ ID NO: 39795 - DNA, 95 bp, Homo sapiens
tgggtttcccgtggtcctgctaatcctcagtgtgaacacagcggccgagcctgccaatgctctctgtttctctcacaggcggcacagcgaactca

SEQ ID NO: 39796 - DNA, 98 bp, Homo sapiens
attcttgattatgcttcccctctgaaagtctttacatatttttcattatctttaggaactcagtgttgtaaagaagtctgaggaagcaggccaagtgt

SEQ ID NO: 39797 - DNA, 112 bp, Homo sapiens
agtggtttctttatgtgtatatatatatatatttatatttatatttatatatatatctgtgaagggggaaatatatatatatatgtacaatagtttctttagggaagtggct

SEQ ID NO: 39798 - DNA, 113 bp, Homo sapiens
atgtcctggaggtttatccatgctgtagcatgtgacaggatttctttatttttttaaggctgtataacattctgttattgcgtgtatataccatattttctttatccattcat

SEQ ID NO: 39799 - DNA, 64 bp, Homo sapiens
agagtgagaagtttgagtggagaaataaagtcttttttatttttttgagacagagtttcactct

SEQ ID NO: 39800 - DNA, 73 bp, Homo sapiens
gcaggacatgaaagctaaaaaagaaaacacctcaagagcttttggttttacttttttggtttttgttttttgt

SEQ ID NO: 39801 - DNA, 83 bp, Homo sapiens
gaagatgtacatttaatttttttctaagagttttaaagctggcacctccagcttttgtcttggaaagtactgataagatcttc

SEQ ID NO: 39802 - DNA, 115 bp, Homo sapiens
agcttctggaatatttaaggttgggagataccaaatcaatgacacttcagtgtgtgctcatttgataaggttttttttttttcccattctgccatattcttagttaccagaaagc

SEQ ID NO: 39803 - DNA, 79 bp, Homo sapiens
ccatggtaagcacagtgtctctgttctgctgctacagagcaaatcagccacaaatacagagactgggatgactgcctgg

SEQ ID NO: 39804 - DNA, 120 bp, Homo sapiens
gtgaaaacagatcagaggccattgctcgttaccatcctgcccactcctcttccacccatgcagaaactgcatgtgcttgtgtgagtgaatatgtgtgaatgtgtgcttttatgttctcat

SEQ ID NO: 39805 - DNA, 71 bp, Homo sapiens
ctcccactcccagtctttttgcttgttatgagttgagagagatgatatgtgagagacatgagagtctggag

SEQ ID NO: 39806 - DNA, 118 bp, Homo sapiens
aggagagttgcctggttgtgcaggatagtcaaagtgtctagggatctgtctgacttttttttttttttgagacggagtctagctttgtcacccaggctggaatgcagtggctctatct

SEQ ID NO: 39807 - DNA, 116 bp, Homo sapiens
caggaaacacacagtggttagcttctctctgcaggcaggttgtctttttgtctctcagagtctggctgagtctaggggtttaagggctttagaggggagcaagtgtgtgctgattg

SEQ ID NO: 39808 - DNA, 108 bp, Homo sapiens
aggctttctagtttgtgtgcatagaggtgttcacagtagtctctgagggcattttttgtatttctttgagattagtggtaacattccctttgtcattcctgattgtct

SEQ ID NO: 39809 - DNA, 72 bp, Homo sapiens
tgaatctatatagctgtcttctctctatgtacttagaaaatggtcagagtatatagtgagctgttcagatca

SEQ ID NO: 39810 - DNA, 96 bp, Homo sapiens
tccatttttaaattatagaaaaagaagagtggagtcataattatagcaaagatgtaaatctgcaactccatgttttttctttaatgtgggtctgga

SEQ ID NO: 39811 - DNA, 97 bp, Homo sapiens
cctttattggcacatagagatttctggactctaaaaaagggttttaatgtactttttttttttaagggacagaatttcactctgtcacccaggctgg

SEQ ID NO: 39812 - DNA, 85 bp, Homo sapiens
cagctgataaaggcagaacagtcttaaccagctgtgcctaccctaatttttcacatctgtctgtctgtctttcttatctgtgctg

SEQ ID NO: 39813 - DNA, 136 bp, Homo sapiens
tatatatatatatatatacgtatatatacatatatacgtatatatatacatatatacgtatatataagtgtgtgtgtgtgtgtatatatatatatatatatatatatatatatatatatacgcatatatatatata

SEQ ID NO: 39814 - DNA, 97 bp, Homo sapiens; identical to SEQ ID NO: 1307

SEQ ID NO: 39815 - DNA, 88 bp, Homo sapiens; identical to SEQ ID NO: 1308

SEQ ID NO: 39816 - DNA, 81 bp, Homo sapiens; identical to SEQ ID NO: 1309

SEQ ID NO: 39817 - DNA, 77 bp, Homo sapiens; identical to SEQ ID NO: 1310

SEQ ID NO: 39818 - DNA, 133 bp, Homo sapiens
acacatattttatatatatacatatatacatacacacatacacgtgtatgtatgtatatatatacacgtgtatatatgtatatacatatatacatacatatatacatacatacatatatataaagtgtgtgta

SEQ ID NO: 39819 - DNA, 106 bp, Homo sapiens
gtgtgtgtagtactaccaatcatccatggaactttatatatatatatatatatatatatatatatatatatatatatagttctgtgtgtgtgtgaactacatatat

SEQ ID NO: 39820 - DNA, 96 bp, Homo sapiens
tgtagttcacacacacacagaactatatatatatatatatatatatatatatatatatatatatataaagttccatggatgattggtagtactaca

SEQ ID NO: 39821 - DNA, 58 bp, Homo sapiens
tgagatggagtctcactctgtcacccaggctggagtgcagtgatgcgatctctgctca

SEQ ID NO: 39822 - DNA, 102 bp, Homo sapiens
gtatatacacatacacatgcatatatagaaaagtgtttaaacaatagtttatatatatatgaatactattgtttatatatgtatgtgtacatatatatatac

SEQ ID NO: 39823 - DNA, 84 bp, Homo sapiens
gtatcaatgaaacaatatatcaaaattacaggctatagagagtttttttttctctgtagtatattttgacaaattctattgatc

SEQ ID NO: 39824 - DNA, 60 bp, Homo sapiens
gagctctttcagccctactgccctgtgaggacacagtgagaagagggttgtttatgagcc

SEQ ID NO: 39825 - DNA, 78 bp, Homo sapiens
gtattgtgcttagcctcaaacctacagtccccaaaaggcagactctctgaggctctgcacctttgttttgcccagtac

SEQ ID NO: 39826 - DNA, 75 bp, Homo sapiens
aatgtacactgaattttcagagtgagaagaaaatgaatcaatttttctttatatcctgaactttcactgctcatt

SEQ ID NO: 39827 - DNA, 68 bp, Homo sapiens
tgttttgagatggagtctcactctgtcacccaggctggagtgcagtagcacgatccccactcactgca

SEQ ID NO: 39828 - DNA, 71 bp, Homo sapiens
atatatgtatatacatatacatatgtatatgtatatatgaaatgtgtatatgtttatgtatgtatatgtat

SEQ ID NO: 39829 - DNA, 71 bp, Homo sapiens
tagattctgcatctctggggtcattttgtcatttcctctcagaaatgacagatcaaagagatcattctcta

SEQ ID NO: 39830 - DNA, 89 bp, Homo sapiens
atcattcacgtgcaactctgtctcactcaggatgtggtgacccttctcctgaatagtgaagccggtgttgaggatctcaggtggctggt

SEQ ID NO: 39831 - DNA, 93 bp, Homo sapiens
agtattttcatagaaattatatatatatgattgtatacatacacaatttaaaaagtatgtatacttttataatatatgtacaatatgcatatt

SEQ ID NO: 39832 - DNA, 95 bp, Homo sapiens
cagaagagattaaaccacacttacttatttttttctttttagagcattactggcttttgattggggaaagtggaaggtgcctatctatcttcctg

SEQ ID NO: 39833 - DNA, 73 bp, Homo sapiens
gggaatactaagcttgtctgtgtatgctggcatcctgggaactctgaggtcagtgtgcagacttgcagagctc

SEQ ID NO: 39834 - DNA, 86 bp, Homo sapiens
tagggatattcaacatgtatataaatatatgcacacctacacaatgtgtgggcgtgtatatacactttatacattatatgtactta

SEQ ID NO: 39835 - DNA, 113 bp, Homo sapiens
aagtgcttactgaatctcttttgctttatttctttgtgcctagtacacagtagtcatatttatttattaaatgactaaatgtcttgacacacaatgggtacattaggctactt

SEQ ID NO: 39836 - DNA, 118 bp, Homo sapiens
gacaacttcttatcacagtggttttgttgcatagaagtttttatatttttaaattattctttttaatttctataggatctgtagcataggatctaatgcctgtaggatctatagtgtc

SEQ ID NO: 39837 - DNA, 58 bp, Homo sapiens; identical to SEQ ID NO: 637

SEQ ID NO: 39838 - DNA, 82 bp, Homo sapiens
tgtgtatactaacctgtgcctatgtgtgtctatatatatatatacacacatatatatatgtatatatatatatgatgtatag

SEQ ID NO: 39839 - DNA, 114 bp, Homo sapiens
tggtgccatattccgtgtcagataaaaatcaccagttacttatatatttttttcaagtaagaaaatgaaatgggggtcggggtgattgtttcagacaagcaggagtagaaatta

SEQ ID NO: 39840 - DNA, 117 bp, Homo sapiens
agggttatttgtgatgaggcagctgactttgccaagagaaagttatgagaggagaaagagagcacgctgttttatgatttaatctctgagttatgtgcataccatcatttctgcttt

SEQ ID NO: 39841 - DNA, 110 bp, Homo sapiens
gtatatgatacacatatatacatgtatatatgcatatgtgggtatgtgtaaaatatacatatatgtatatatatgtgcgcatgtgggtatgtgtagacagacacatatat

SEQ ID NO: 39842 - DNA, 60 bp, Homo sapiens
gtgagacagtctctcactctgtcacccaggctggagtgcagtggtgtgatctcagctcac

SEQ ID NO: 39843 - DNA, 92 bp, Homo sapiens
gtatctattaagagagtctctctctctgccagttttgtgctaaggcccattcctggccgttggagaggtgagatggcaggcttgaaagacgt

SEQ ID NO: 39844 - DNA, 106 bp, Homo sapiens
tctttgttcttaatggcacataaaccattgttggacagtgacagtgacacactgtcactgtcatgaacagcaggagtgagtactggtgcatgcaagggatcaaagg

SEQ ID NO: 39845 - DNA, 83 bp, Homo sapiens
gtttctaactcagaggattgttgtgagaatcaagtgaaagcccatattcactctgattcaacaaacatttacagagtagtcac

SEQ ID NO: 39846 - DNA, 114 bp, Homo sapiens
gcatctgctttaggttatcttaagctacctgttgtccagtgtcttgaaatgattatttcatagttttttcagattttcggttgtttcagatagaagggtacctctagtccctgt

SEQ ID NO: 39847 - DNA, 98 bp, Homo sapiens
gagaactgattgtgtgtgtgtgttgtatgtgtatatatgtatatgtgtgtatgtgcataaatatatatatagttaacacttaacaaataaggtgaatc

SEQ ID NO: 39848 - DNA, 111 bp, Homo sapiens
aagaagctaaataatgttaaacaattaataatgatgataatgctctaaaatgttggattattctcactttgttattgtcagttgtttcccaacaaaatttatttgcctctt

SEQ ID NO: 39849 - DNA, 58 bp, Homo sapiens
tgagacggagtctcactctgtcaccccggctggagtgcagtggcgagatctcagctca

SEQ ID NO: 39850 - DNA, 56 bp, Homo sapiens
gagatagagtctccctctgtcacccaggctggagtgcagtggtacgatctcggctc

SEQ ID NO: 39851 - DNA, 95 bp, Homo sapiens; identical to SEQ ID NO: 68

SEQ ID NO: 39852 - DNA, 93 bp, Homo sapiens; identical to SEQ ID NO: 69

SEQ ID NO: 39853 - DNA, 58 bp, Homo sapiens; identical to SEQ ID NO: 1673

SEQ ID NO: 39854 - DNA, 71 bp, Homo sapiens
ctcagagagtttcactgactttgcctataaccctacggtcagttaacggcagatgtgaaagctaaactgag

SEQ ID NO: 39855 - DNA, 116 bp, Homo sapiens
cagaggtggagtattaacacagcttctgtggctcccaaagggtggaatgcagactccagacagaccactctttggaaaggtgtagacagctgtgcagtagccccactctagatctg

SEQ ID NO: 39856 - DNA, 71 bp, Homo sapiens
ttgtttttgagacagggtctcactctgtcacccaggctggagtgcagtggtgggatcttggctcactgcaa

SEQ ID NO: 39857 - DNA, 76 bp, Homo sapiens
ggtgtgtggaatgaagactggacatgttgttctgtgctttggaactaggtggtctggacctcaatccctctatgcc

SEQ ID NO: 39858 - DNA, 72 bp, Homo sapiens
gaaatgtgtagacaccacagactcaaattctgagaattctttatttttggagtcagtgtctcactctgtttc

SEQ ID NO: 39859 - DNA, 64 bp, Homo sapiens
cacacacacacactcacatatacatatatacatatatatgtgtatatatatgtatgtgtgtatg

SEQ ID NO: 39860 - DNA, 104 bp, Homo sapiens
gcaggacagagagagtgactagtattgtcctaattttgtagttgagaaattcaggttacagtttactttactaggaaagggcagattctgggtttagttggagc

SEQ ID NO: 39861 - DNA, 79 bp, Homo sapiens
tcagagctaccaagataagggttttatagatttatatacatatataatctttcttcttagctacatcttggaaggctga

SEQ ID NO: 39862 - DNA, 99 bp, Homo sapiens
catcacactatgattgagtgggttaaagctttctttttttttttttttttttttttttgaggcagagtctagctttgtcacccaggctggagtgcagtg

SEQ ID NO: 39863 - DNA, 71 bp, Homo sapiens
cctggaatgttcaatttgagactttttactttattttattttggagatggagtctcgctctgtcacccagg

SEQ ID NO: 39864 - DNA, 100 bp, Homo sapiens
gtggtggtatgcccctgtagtcctaacttctagggaggctgaggtaggaggatcgcttgagcccaagaatttgagctatagttaggtgtgatggcaccac

SEQ ID NO: 39865 - DNA, 70 bp, Homo sapiens
tcttatgttagaacagactctgctaaaggtaaaaacaccttgagggcaagttaggagggtctggctagga

SEQ ID NO: 39866 - DNA, 80 bp, Homo sapiens
cttattatttggttatgcaggtgtgtgtgtgttgtataaacattatatatatttcacttggatatattccacttgatagg

SEQ ID NO: 39867 - DNA, 60 bp, Homo sapiens
ttgagacagggtctcactgtgtctcccacgctggagtgcagtggcgtgatcttggctcaa

SEQ ID NO: 39868 - DNA, 108 bp, Homo sapiens
tgggtaggtttggctctagaagaactgtcagttgaggcatccttttttttttttttcctacagtatggctaataatggcagtttttaaaattgaagctaaaacaccta

SEQ ID NO: 39869 - DNA, 119 bp, Homo sapiens
gtgagatggtatctcattgtggttttgatttgcatttttctgatgattaatatgataggcattttttcatatttttttttggccacttgtatgtcttcttttgagaagtgactgttcat

SEQ ID NO: 39870 - DNA, 116 bp, Homo sapiens
tctctcacacacacagacacacacacacacacacacaaatccatccttactctctctctctatctgagatgggtggatggatggatattgtgagagtaatgtgagaggtgagtaga

SEQ ID NO: 39871 - DNA, 97 bp, Homo sapiens
tattgaatagtaagggattgtgatacatatatatgtaatatatatatatatatatatatatatatataaaatgggatactaatgcaagcattcagtg

SEQ ID NO: 39872 - DNA, 79 bp, Homo sapiens
cttgctgagaacaaagtgaggagagagggattcactaagttgcactgagtatgtgatttcttggcctgttcttagcagg

SEQ ID NO: 39873 - DNA, 85 bp, Homo sapiens
ggggattgccaaggtccatggcagaagtgtgagtccccaggagccttcactcactcacactttccctgctgtagggagcctcccc

SEQ ID NO: 39874 - DNA, 77 bp, Homo sapiens
ggaaactctctctgaaccgaaactgtttaaattagttcattaaatttttaagacagggtctctgtcagtgagactcc

SEQ ID NO: 39875 - DNA, 56 bp, Homo sapiens; identical to SEQ ID NO: 324

SEQ ID NO: 39876 - DNA, 109 bp, Homo sapiens
ccaggctggagtgcagtggcatgatctcggctcactacaacctgcacacacacacacacacacacccaggttgaagtgattcacctgcctcagcctcctgagtagctgg

SEQ ID NO: 39877 - DNA, 58 bp, Homo sapiens; identical to SEQ ID NO: 13985

SEQ ID NO: 39878 - DNA, 81 bp, Homo sapiens
ctgttccaattttggtatacgtgctgctgaagtgagcaccagaccttattttgtagtaggtagataagtaaattggttaag

SEQ ID NO: 39879 - DNA, 103 bp, Homo sapiens
tgaaggcaaatcagagatcagagaaaatacttagtgactgtgagtgttcatcaatgacatttatgaatatttattttgcgctgagctctgtgatttatactca

SEQ ID NO: 39880 - DNA, 58 bp, Homo sapiens; identical to SEQ ID NO: 1101

SEQ ID NO: 39881 - DNA, 56 bp, Homo sapiens; identical to SEQ ID NO: 1102

SEQ ID NO: 39882 - DNA, 67 bp, Homo sapiens
atatatatgcgtatatatagaggtgtatatatattttatatatatacatatatatacgtgtatatat

SEQ ID NO: 39883 - DNA, 92 bp, Homo sapiens
gtatttcagtgagtctaagtattctttgtgtgaaagtaataaaattatatttctttttcagaaagtctgtaacatagactttttactaatgc

SEQ ID NO: 39884 - DNA, 115 bp, Homo sapiens
gactcaggagaatgcctgtgctaccaacctgttccgccagcccaagtgttgccgcccacgtgaggcatgttgtctgggtcctccttcccgtgtttgggggagcttacatcttcac

SEQ ID NO: 39885 - DNA, 95 bp, Homo sapiens; identical to SEQ ID NO: 68

SEQ ID NO: 39886 - DNA, 93 bp, Homo sapiens; identical to SEQ ID NO: 69

SEQ ID NO: 39887 - DNA, 113 bp, Homo sapiens
ggattgctttggctattcaggctctttttttggttccatatgaattgtaaaatagttttttctaattctatgaagaatgccaatggtagtttgataggaatagtattgaatct

SEQ ID NO: 39888 - DNA, 107 bp, Homo sapiens
ttcctgttctgttctttggctttttacaacaagcatgtggtatgcaggtaaaaaatattttcattttgaagcaaatcacatggagacaacagtaaacagagtaggaa

SEQ ID NO: 39889 - DNA, 88 bp, Homo sapiens
gctgggattacaggcgcctgtcaccatgactagctaatttttttgtattttagtagagacagggtttcgccatgtacaattcactggc

SEQ ID NO: 39890 - DNA, 95 bp, Homo sapiens
gactgggtggcagagtgagaccctgtctctccctctttaaaaaaaaaaaaaaaagagagagagtgagacagaggtcaatttattgggatttggtt

SEQ ID NO: 39891 - DNA, 82 bp, Homo sapiens
tatatagttatacatatagttatatatagttatatatatagttatatatagctacatatagagttacatatatagttatata

SEQ ID NO: 39892 - DNA, 72 bp, Homo sapiens
aaattaggagtcaggctctgtgacttactggctgggctgggctaggtcacttacttctctgattcttagttt

SEQ ID NO: 39893 - DNA, 84 bp, Homo sapiens
tgattgaagctgatggagcttcttggattttgtgaatttataattttcatcaaatttagggaaattgtggccattacttcctca

SEQ ID NO: 39894 - DNA, 95 bp, Homo sapiens
gtctccaataagacagttaagttgagttaatatttactttgaatttcaataagaattttactctacagcttgctctaagactgtcttcctggaac

SEQ ID NO: 39895 - DNA, 95 bp, Homo sapiens; identical to SEQ ID NO: 68

SEQ ID NO: 39896 - DNA, 93 bp, Homo sapiens; identical to SEQ ID NO: 69

SEQ ID NO: 39897 - DNA, 113 bp, Homo sapiens
cacctttgtagtacaacatttttggcagtggaaaccttttctctaataaaatcttttttttttttttttgagacaagatctcactctgtcacccaggctggagtgcagtggtg

SEQ ID NO: 39898 - DNA, 93 bp, Homo sapiens
tgtgtgagcattgtctgaattttgaacaaataaagtgtgtgtggttttttttttttttaaagaccttgtcaaaattcagacaaggttcacaga

SEQ ID NO: 39899 - DNA, 88 bp, Homo sapiens
ataaatgtatatgtgtatgtatgtatatatacacatatatgtgtatatgtatatatctgtgtgtatatatatctattaagcacctagc

SEQ ID NO: 39900 - DNA, 98 bp, Homo sapiens
tggatatactttttgttaaatgagagcaattttctctgtatgctttgtctatgcatggctgtgcagggcccaaatgacttcactgacacctgtttcca

SEQ ID NO: 39901 - DNA, 100 bp, Homo sapiens
agtgtttaggaggattatataattatttgatcagaaaagaactggtctctgtctgtgactgtcttaaatatttaggtagtttgttattctcttaggaatt

SEQ ID NO: 39902 - DNA, 95 bp, Homo sapiens; identical to SEQ ID NO: 68

SEQ ID NO: 39903 - DNA, 93 bp, Homo sapiens; identical to SEQ ID NO: 69

SEQ ID NO: 39904 - DNA, 88 bp, Homo sapiens
tactgagctggggatgattaaaataaaagtgacattgaccaggtaaaattccattttaggtgactgtcgctgtcacacagttctagtg

SEQ ID NO: 39905 - DNA, 83 bp, Homo sapiens
accttggcttaaattagtttattatgtttatttgtcagttttctgagaggtcagtacttgggaaaggctgattttcacaaggt

SEQ ID NO: 39906 - DNA, 67 bp, Homo sapiens
ggaacctggggcttgtagggccccatcccggtgagacacagcatggctccctgtgtcccagatctcc

SEQ ID NO: 39907 - DNA, 90 bp, Homo sapiens
agagtgaaaagatgagtgaatttgatgtttggagataaggggtctagtcctgtctcttgaataatcatttcatacctttgataaggctct

SEQ ID NO: 39908 - DNA, 108 bp, Homo sapiens
taacaccttgcattagtgcggtacatttgttacaattgatgggccaatattgatacattattattaattaaagcccttagtttacattaagcttcactgtttgtgttg

SEQ ID NO: 39909 - DNA, 92 bp, Homo sapiens
gggtaacaataacatttcctcgttcagttagccagttacctccagaaatgaaagtaactgaaactggaactggaactgcagtgatgttattt

SEQ ID NO: 39910 - DNA, 108 bp, Homo sapiens
cagctttgttctttttgcttaggattgtcttggctatatgggttcttttttggttccatatgaaatttaaagtagttttttctaattctgtgaagaaagtcaatggtg

SEQ ID NO: 39911 - DNA, 78 bp, Homo sapiens
tatttgatctctctcagtgtttctcaacgtgtagtctgcagaccaccaactggtgaatcattgggctgaggccacatg

SEQ ID NO: 39912 - DNA, 97 bp, Homo sapiens; identical to SEQ ID NO: 1307

SEQ ID NO: 39913 - DNA, 88 bp, Homo sapiens; identical to SEQ ID NO: 1308

SEQ ID NO: 39914 - DNA, 81 bp, Homo sapiens; identical to SEQ ID NO: 1309

SEQ ID NO: 39915 - DNA, 77 bp, Homo sapiens; identical to SEQ ID NO: 1310

SEQ ID NO: 39916 - DNA, 85 bp, Homo sapiens
aaatctctgcttagactcctcacagatcaaagagaggagcattgtttcctcatgatgtaatagtgaggctgattgggtgaaattt

SEQ ID NO: 39917 - DNA, 113 bp, Homo sapiens
tccattttaatctttatctcccatggaattctttctcaaatgtttgattattcttatatgtatttggatatgctgctgaatgaggtatgtaggagcttgtcttctgtgtggag

SEQ ID NO: 39918 - DNA, 58 bp, Homo sapiens
tgagaccaggtctcactctgtcacccatattggagtgcagtggcatgatcttggctca

SEQ ID NO: 39919 - DNA, 72 bp, Homo sapiens
gagtctcactgtgtcactcaggctggagtgcagtggtgcccaggctggagttcagtggcacgatcttggctc

SEQ ID NO: 39920 - DNA, 87 bp, Homo sapiens
gaagtaggtatgtgtttgtatggtgagagtgagggaagagagagaccctctcacattgttttatattttatactcagtacctgtttt

SEQ ID NO: 39921 - DNA, 84 bp, Homo sapiens
cacctatatatatatatatacacacatatatgtgcgtatgcgtatatgtgtgtatatatatgtgtgtgtgtgtatatatatatg

SEQ ID NO: 39922 - DNA, 112 bp, Homo sapiens
gctgtgcatttcttctcattactccctatgcccttctcgttagtctcactgtctccctctgtgggcaggtaggtgagtggtatttcagaaggggaaagcaaggtgaggcggc

SEQ ID NO: 39923 - DNA, 95 bp, Homo sapiens; identical to SEQ ID NO: 68

SEQ ID NO: 39924 - DNA, 93 bp, Homo sapiens; identical to SEQ ID NO: 69

SEQ ID NO: 39925 - DNA, 106 bp, Homo sapiens
gcttctgtgtcttctatttcaccttttgatgtaaaaagcctaattttaatatatttaaatgttaaggctccaccccaaagcaaacatgggatggatggatgtttgc

SEQ ID NO: 39926 - DNA, 84 bp, Homo sapiens
tgggatgttgctggagagatgacagtgagcatcttcatcatgctccagggagcagttggctgcatgactctagttgttgtttca

SEQ ID NO: 39927 - DNA, 83 bp, Homo sapiens
ggcaatagctgtgtttttgttgaagagtgccagacctcatcctggcatactgaatttaaagatgtatatttatggcaattgtt

SEQ ID NO: 39928 - DNA, 72 bp, Homo sapiens
gcagtctcatcaatggagtgtgagggggagtgaggatgccttctgcacagtccctcagtctctgcctgctgc

SEQ ID NO: 39929 - DNA, 70 bp, Homo sapiens
tgggttagttattgtgagagcgggctcctgataaaaagataaggtcagtccccactctctctctgtctca

SEQ ID NO: 39930 - DNA, 105 bp, Homo sapiens
tgtatttacatatgtatatatgtgtgcatttacatatttatatgtttatgcatatatgtgtatatatgtttatatatgtgtgtgtgtgcatgtgtatgtttatat

SEQ ID NO: 39931 - DNA, 58 bp, Homo sapiens
tgagacggagtctcactctgtcacccaggctggagtgcaatggtgagatcttggctca

SEQ ID NO: 39932 - DNA, 107 bp, Homo sapiens
ttaagttggttggttctcttaatctatccataacggtttctactttggacagtgtactcacagagaacagagatggtgcctgttgatttgatccatgcaatgcttaa

SEQ ID NO: 39933 - DNA, 89 bp, Homo sapiens
agagaaaagcagtgtttagcagaacattttggagttcaatgttcttttatattctaaaatgaattaatgctactatataatttctctct

SEQ ID NO: 39934 - DNA, 95 bp, Homo sapiens
tgagccaccgcctcttttactatttcttaaatcttgcacctgctcactgaaaacacaggagtgtgaggacatggtgtctgactgggcgggtatca

SEQ ID NO: 39935 - DNA, 94 bp, Homo sapiens
agtgatagctttagttctttttcgcttaaaaatattttattttgctttaagccagttagacagtgatttcgtgagggagactaagctagatact

SEQ ID NO: 39936 - DNA, 95 bp, Homo sapiens
gtatatacgtatatacacatatatacatatgtatatatgtatacattacacgtatgtatgtatatatacatatgtatatgtatatatgtgtgtac

SEQ ID NO: 39937 - DNA, 124 bp, Homo sapiens
cacacacacacacatacatacacgcatatatgtgtatatatgtatatatgtgtgtgtgtatatatgtatatatgtgtatatatacatatgtatacacatgtatgtacacacatatatacatata

SEQ ID NO: 39938 - DNA, 91 bp, Homo sapiens
ggcagcatgaccctagagaagagcagagacacacttttattttattttattgttttttattgctctttctcttcctgttctacagctgact

SEQ ID NO: 39939 - DNA, 93 bp, Homo sapiens
gtgtcacatatgaagcctctgaagcattacaagaaatatttatgggaaatttctatatttgttaatgtaattagaaaggtgtctaagtgattc

SEQ ID NO: 39940 - DNA, 102 bp, Homo sapiens
agcacagtatctaacatgtaataagtgttgaataaacagttttacaattactgtttatttttatcataattatttatagtggatagtttctaattaagtgct

SEQ ID NO: 39941 - DNA, 80 bp, Homo sapiens
ctgaccattggttgtgcatcagtcattcactcatttattgaatgaatttatttatttattgagcacctactttgtgtcag

SEQ ID NO: 39942 - DNA, 65 bp, Homo sapiens
acttactatatgtgtgtgtgcatatatatatatatatatatatctgcacgtgtgtgtgtgtgtgt

SEQ ID NO: 39943 - DNA, 82 bp, Homo sapiens
agctagataggaggtatataagctagttttctacagtgctgtagggtgactataacaatttattgtatattttcaaatagct

SEQ ID NO: 39944 - DNA, 73 bp, Homo sapiens
gatatatggaaatgtcttcctaggagagttgaagaaaactctttttttttttgagacagagtctcactgtgtc

SEQ ID NO: 39945 - DNA, 95 bp, Homo sapiens; identical to SEQ ID NO: 68

SEQ ID NO: 39946 - DNA, 93 bp, Homo sapiens; identical to SEQ ID NO: 69

SEQ ID NO: 39947 - DNA, 94 bp, Homo sapiens
gtgggaaaaagtatgcatatgtgtgtatgtatgtaatgtatgtatatatgtgtgtatatgcatatacatgcacagacatatgtatacacaacac

SEQ ID NO: 39948 - DNA, 83 bp, Homo sapiens
gtcgatgtaggatgtttagtagtatccctggcctctactgcttctagatgccagtagcactcctttccagcagttacaatgac

SEQ ID NO: 39949 - DNA, 98 bp, Homo sapiens; identical to SEQ ID NO: 1311

SEQ ID NO: 39950 - DNA, 83 bp, Homo sapiens
gtctgggcatgttagctccctggctgcctgcctggcagacattactgccacacagggccagggggacactgggttgagtgggc

SEQ ID NO: 39951 - DNA, 71 bp, Homo sapiens
gtactgtgtgacatacagtcctccatttcattctcataaggtgaatgaagaaactgaggtcacacagctac

SEQ ID NO: 39952 - DNA, 114 bp, Homo sapiens
cagtgtcgctgttctgagacgtgcaaactttatcttagattctttctattatttttatttatttattttttttgagacggagtcttgctctgtcacccaggctggagtgcagtg

SEQ ID NO: 39953 - DNA, 76 bp, Homo sapiens
atttccttcctcagttcttacccatgagcacgggggctgtgtctgactgtgtgtattggctgaggacacaggaggt

SEQ ID NO: 39954 - DNA, 73 bp, Homo sapiens
tgtggagttctttgttccttgcggtgggttcgtggtctcgctgacttcaggagtaaagctgcagaccttcaca

SEQ ID NO: 39955 - DNA, 111 bp, Homo sapiens
aggtatctggggggaaaaagaggcctagtgagcacagtgatccctgttggtgatcagtggaatgatgagtgcgtagcaggagttaatttgtccatgagtatacagagactt

SEQ ID NO: 39956 - DNA, 58 bp, Homo sapiens
tgagatggagtctcactctgtcacccaggctggagggcagtggtgtgatctcggctca

SEQ ID NO: 39957 - DNA, 76 bp, Homo sapiens
agatatatgtatatataggtgggtatatatacatatataggtgtgtgtgtatctatatctatatctatatgtgtct

SEQ ID NO: 39958 - DNA, 58 bp, Homo sapiens
tgagaccgagtctcactctgtctcccaggctggggtgcagtggaacgatttcggctca

SEQ ID NO: 39959 - DNA, 117 bp, Homo sapiens
ttatttgtaatgtgttcctttttattggtgagtagtttcatttataccacagtttggttttcttgctcttactgatcaacatttgagctgcttacagtatttaactattatgaataa

SEQ ID NO: 39960 - DNA, 116 bp, Homo sapiens
ctgggattacaggtgtgagccacggcacctggccctaaaactgtgtatttttaaatttgacatctaaaatttttatcataagggccaggcatagtggcttatgcctgtaatcccag

SEQ ID NO: 39961 - DNA, 71 bp, Homo sapiens
ttgtttttgagacagggtctcactctgtcacccaggctggagtgcaatggtgagatcatggctccctgcag

SEQ ID NO: 39962 - DNA, 74 bp, Homo sapiens
gacctggtgaaggagtgactgggaagcagatcaaaggaggaccctagtgtatcactcctctctcactctgtcac

SEQ ID NO: 39963 - DNA, 119 bp, Homo sapiens
cattgcactccagcctgggtgacacagtgagactccgtctcaaaaaaataaaatttattttattttattttattttttgagaaagagtctcgctctgtcacccaggctggagtgcagtg

SEQ ID NO: 39964 - DNA, 72 bp, Homo sapiens
agtgacactagtaatgctgagggagaaggaactactattttttttttccagacagggtctcactctgtcact

SEQ ID NO: 39965 - DNA, 109 bp, Homo sapiens
ggtggacatggtacttattctgtgtgaagagaaacggtcagggagatttcccatttgagctgaatctttttttttttttttttttgagatggagtctcgctctgtcacc

SEQ ID NO: 39966 - DNA, 106 bp, Homo sapiens
tggagctttgagcactccagcctgggtggcagcaggagaccttgtctctttattatttatttgagacacggtctcgctctgtcacccaggctggagtagagtgaca

SEQ ID NO: 39967 - DNA, 152 bp, Homo sapiens
tatacatatatatttatatatacgtatatatacgtacatatatttatatgtatacgtatatatacgtatatatatttatatatgtataaatatttatatacatacgtatatatatacttacatatatttatatatgtatatatatttatata

SEQ ID NO: 39968 - DNA, 71 bp, Homo sapiens
acctcagcagagacactgactccctcagttggaacccagggtgtctgggaggtgatgtcgctggtgcaggt

SEQ ID NO: 39969 - DNA, 70 bp, Homo sapiens
ggcatgagccaccacacccaggctttttttttttttctttttttctgagacagagtctggctctgttgcc

SEQ ID NO: 39970 - DNA, 77 bp, Homo sapiens
ggctgaggtaggaggatggattgagctcaggagatagaggctgcagtgagctatgatcacaccactgcacttcagcc

SEQ ID NO: 39971 - DNA, 75 bp, Homo sapiens
tccaaggccatgtagacacacaatgcggtgtgcctgtcactgtacaaagtagtgtgtctgctctgtggccatggg

SEQ ID NO: 39972 - DNA, 106 bp, Homo sapiens
aacaatggcggcagagagacagaatacaaatcacttatgtgtgaattagctttatttatatttgaatgttcgtgggttgggggatgtctttctactttttactgtt

SEQ ID NO: 39973 - DNA, 95 bp, Homo sapiens; identical to SEQ ID NO: 68

SEQ ID NO: 39974 - DNA, 93 bp, Homo sapiens; identical to SEQ ID NO: 69

SEQ ID NO: 39975 - DNA, 111 bp, Homo sapiens
tgtggctctctcactggttttgttgttgcagttgctgttgcttgagacagggtctcactctgtcacccaggctggagtgcaatggcacaatcatgattcactgcagcctcg

SEQ ID NO: 39976 - DNA, 113 bp, Homo sapiens
ctgagtcccggacccagtgggaacatggtgagcctatatcagtactgagtcctggcaccaggctgcattcagctctttcagtctgtgatgctgtcatgcagttgaaataagga

SEQ ID NO: 39977 - DNA, 130 bp, Homo sapiens
cctcagctttcagtgagtgccaggcagtggagtgcaaacaagaccatttccctcagtctctgcctgtctctgtctctgaggaccacttgcacagattagggttccaaatggtgcccccacttctttccac

SEQ ID NO: 39978 - DNA, 86 bp, Homo sapiens
cagacaaacagacaagccaggatgtgtgtatgacatattaattttcagcctgtttctgtcactctccctgagcttatgaggtctgt

SEQ ID NO: 39979 - DNA, 111 bp, Homo sapiens
acttctttttcacgtaaacattgtacattttagtttatttgtgattctgaatactgttttatttgtatttagattgtcatttgtcacttccgttaatgtgggaagattagt

SEQ ID NO: 39980 - DNA, 102 bp, Homo sapiens
gtcagagatgagattaagatcttgtcttctgaaactaataaaatgctctttatatgattttatactgttttgggtattttggatatagggtctcactctgtc

SEQ ID NO: 39981 - DNA, 116 bp, Homo sapiens
tccagcttcgttctttttgcttaggattgtcttggctatgtgggctcttttttggttccatatgaaatttaaagtagttttttctaattcttggaagaaagtcagtggtagcttga

SEQ ID NO: 39982 - DNA, 91 bp, Homo sapiens
tgtttagatgctgtatatatacatatatatttatacatatatagttctgtgtgtgtatatatgtaattgtatatgtgtttgtatctatata

SEQ ID NO: 39983 - DNA, 110 bp, Homo sapiens
gcactggaggcaggtgtatggtgaggcactactaggctgagggtctctaagacaatctctagctccagcctagataccagactactgctgccgtataattgactctaggt

SEQ ID NO: 39984 - DNA, 117 bp, Homo sapiens
tcccaaagtgctgggttacaggtgtgagtcactgtgcccagtccatatttattgtttaattatttgtacttatctgccaggcacagtggctcacatctgtaattctgcactctggga

SEQ ID NO: 39985 - DNA, 79 bp, Homo sapiens
tatgtaacttgtctctgtctcagtcttcccatgtataaatgagggtatgactgggctcctagtggggactaagatcatg

SEQ ID NO: 39986 - DNA, 70 bp, Homo sapiens
tgttttttgagacagggtctccctctgtcactcaggctggagtgcagaggtgcaatcttagctcactgca

SEQ ID NO: 39987 - DNA, 60 bp, Homo sapiens
tatttacatgtatgtatgtatgtatgtatgtatgcatgcatgtatgtatgcatgtatgta

SEQ ID NO: 39988 - DNA, 117 bp, Homo sapiens
gtgaacctaaaggtattgcttgctctgttttatttcattgcataactaataaagtttattttatatatatatttaattttaagttctgggatacatgtgcaggatgtgcaggtttgt

SEQ ID NO: 39989 - DNA, 88 bp, Homo sapiens
ggtttctttttttttttttttttgagttggagtctcactctgtcacccagcctggagtgcagtggtgtgatctcagctcactgcaacc

SEQ ID NO: 39990 - DNA, 117 bp, Homo sapiens
ggggaattgagtttggactgtgtgacatagagtatagtttttgttcccaggatttttatttctataatctgggaggcaggtgttgactctccatcataccttgcagggtttttcttc

SEQ ID NO: 39991 - DNA, 106 bp, Homo sapiens
aggcggtgattggttttggggggcgggtggagagacacagtctcactctgttgcccaggctggagtgcaatggtgcgatctcggctcgctgcaacctcaaccacct

SEQ ID NO: 39992 - DNA, 105 bp, Homo sapiens
ttttagcatgtgactatgcttgcttttctaggtttaaacattctaataattgcccaggaattttttttaactttagaaacttcaatggagtcaactctgctggga

SEQ ID NO: 39993 - DNA, 119 bp, Homo sapiens
ccatgtcctccctccagctctctctctcaatagacagataaatggatctatctatctatctatctatctatctatctatctatctatctatctacagtcatgagttgctttatgacagg

SEQ ID NO: 39994 - DNA, 90 bp, Homo sapiens
gcacaaatttatatatgtgtgtgtatatatgtgtatatatatacacatgcatatatgtgtgtgtatatatacatatacatatatatgtgt

SEQ ID NO: 39995 - DNA, 101 bp, Homo sapiens
tatattttatatatatatatatatatacgcactgtatatatatatatagacagtgtgtatatatatacagtgtgtgtatatatagagtgtgtatatatata

SEQ ID NO: 39996 - DNA, 100 bp, Homo sapiens
tctttatatagatctatatatagagagaggtgatagatacagatagatagctagattctatctatatatatctcttctgagctttgttaatctatagtga

SEQ ID NO: 39997 - DNA, 116 bp, Homo sapiens
gtaatgaataaaggaagcctaaggaaacaaagtttgatgaggtctttggtcttgcagagtctctgtcagttactcaaaacctttgccagcctcctgaggcctcctcatctcatctc

SEQ ID NO: 39998 - DNA, 95 bp, Homo sapiens; identical to SEQ ID NO: 68

SEQ ID NO: 39999 - DNA, 93 bp, Homo sapiens; identical to SEQ ID NO: 69

SEQ ID NO: 40000 - DNA, 74 bp, Homo sapiens
tatacacacacatatatacacatatatatatacacacacatatgtgtatatatatgtgtatatatagttgtata

SEQ ID NO: 40001 - DNA, 83 bp, Homo sapiens
ttttttttgagacagagtctcactctgtctgccaggctggagtgcagtggcatgatctgaatgaggctttttagtgaaaggag

SEQ ID NO: 40002 - DNA, 61 bp, Homo sapiens
gagcttactagtctctagttgtgggccactctagaaagtgaccacaggtatggcagttctc

SEQ ID NO: 40003 - DNA, 68 bp, Homo sapiens
tcttgtctgtctccctgggtgtatgcctcatggactataatgagtgaagcaactagggcaagtaaaga

SEQ ID NO: 40004 - DNA, 110 bp, Homo sapiens
tcctttgttggatcctactgaactgtcaaatacaatctaaaagtatgagatgaagtccagtttatcattttatttcttttatggcttatgtttgtggtgtcatatcagga

SEQ ID NO: 40005 - DNA, 111 bp, Homo sapiens
tagcatattgtttttgaggttcataatgttgtaccatggctaaataatatttcattttctgaatatataccagatgtactttatttattcttcagttggacatgtgggctg

SEQ ID NO: 40006 - DNA, 67 bp, Homo sapiens
ttctttggcttaggacttcacagagcccttattttgttatagtactctgtgaatctctgtggaagga

SEQ ID NO: 40007 - DNA, 70 bp, Homo sapiens
ggtctctgtcattctcacaggggatccaggctcaaggaacaactgatctctctggagtattgcagtagcc

SEQ ID NO: 40008 - DNA, 97 bp, Homo sapiens
cagagcctgaatcttcttaagatgatctgagtggttatgatcagaatgctggtagaaagatggaaagtaaagatcattctaatgagattttagatgg

SEQ ID NO: 40009 - DNA, 80 bp, Homo sapiens
tgtatatatacaatatattatataaatatatatttaaatattatatatagtatgtgtataatatatattgtatatgtata

SEQ ID NO: 40010 - DNA, 112 bp, Homo sapiens
cagtggatctcaggcagagtagattttccctaattcagtcatgtatttatttatttttactctgaacaacttatagaaagaattaaagtattctagtttgcagaggccactg

SEQ ID NO: 40011 - DNA, 107 bp, Homo sapiens
gtttgatgggatgggggagaatggttaggcaactgttggccagagggaaaaaactttattttttaaaggagtttagggtgtctgtattattttttacatcggcaaat

SEQ ID NO: 40012 - DNA, 95 bp, Homo sapiens; identical to SEQ ID NO: 68

SEQ ID NO: 40013 - DNA, 93 bp, Homo sapiens; identical to SEQ ID NO: 69

SEQ ID NO: 40014 - DNA, 96 bp, Homo sapiens
gaggcattctgcaatagtaaatgtgaacagtgctctctggcacagtactgaaaaatttttttttttacatattactagtcaaaggtttgaagtctc

SEQ ID NO: 40015 - DNA, 108 bp, Homo sapiens
aggcccatgatcagtaaatactccagcagtatccatgcaaaacagctaacatagtgtgaagcaatgtaagcatgtatgtgaaatatgggtccacactagatctggctt

SEQ ID NO: 40016 - DNA, 58 bp, Homo sapiens; identical to SEQ ID NO: 27519

SEQ ID NO: 40017 - DNA, 67 bp, Homo sapiens
tggtgagagaagactgaatgctcttctcataagactgggagcaaggcaagggtgttcgctctcacca

SEQ ID NO: 40018 - DNA, 95 bp, Homo sapiens; identical to SEQ ID NO: 68

SEQ ID NO: 40019 - DNA, 93 bp, Homo sapiens; identical to SEQ ID NO: 69

SEQ ID NO: 40020 - DNA, 109 bp, Homo sapiens
ggccaccacatcatgggagctcactggggaaagagcagtgggtctcagtgtctgtccacttaatttctcggtttccagcacagcacccagccctcatctctgcccagtg

SEQ ID NO: 40021 - DNA, 102 bp, Homo sapiens
gaagtgcagaggctggttaggcttagggttggtatgagtggcttaatccagtggcctgactctgtttctgtgattctcgtggctcagcttcctctgctgact

SEQ ID NO: 40022 - DNA, 82 bp, Homo sapiens
gctcagggcgcaaggcgggagccagtgctggacaggacaccatcccattgcagggcgcactctcactcactcgcactgagac

SEQ ID NO: 40023 - DNA, 124 bp, Homo sapiens
gtagaatcagttaattttgtataactagcactttaaaaagccaggtgtgaaaatgtttcaaactattagataaaataatattgaacacacttggtggtggtggtaaggaggctatggtgactgg

SEQ ID NO: 40024 - DNA, 109 bp, Homo sapiens
ttcaaactctacagaaaaatatgaagtaagaaataattggcaatatgatacaaatgctctcatgtgtctctgtatcatcctttatttatttggtgttcttgtagttgga

SEQ ID NO: 40025 - DNA, 58 bp, Homo sapiens; identical to SEQ ID NO: 1435

SEQ ID NO: 40026 - DNA, 94 bp, Homo sapiens
cctgggcaacttattaatctctctgtctctgtttcaacatcttttttttttttttttttttttttgagacagagttttgatcttgttgcccagg

SEQ ID NO: 40027 - DNA, 109 bp, Homo sapiens
tttcagtggatgcctgctctgtttgattggtagtggctgctagaagctcagagtgaacagagtctgggtctgggctcgctcagtgggacagaatggcatggggcaggaa

SEQ ID NO: 40028 - DNA, 92 bp, Homo sapiens
acattcatgatttttgacactgcaacttctttctcctggtttggcatgagtccgttaaatctatcaaagtgtgctgtgttaaacagaaatgt

SEQ ID NO: 40029 - DNA, 99 bp, Homo sapiens
tgcgggctcttttttgattccatacgaattttagaattgtttttctaattctgtgaagaattatggtggtatttttatggagattaaattgaatttgta

SEQ ID NO: 40030 - DNA, 95 bp, Homo sapiens; identical to SEQ ID NO: 580

SEQ ID NO: 40031 - DNA, 93 bp, Homo sapiens; identical to SEQ ID NO: 69

SEQ ID NO: 40032 - DNA, 107 bp, Homo sapiens
tcatggacttgatttgctagtactttgttgaggattttatatctatattcataagggatattggtctgtggttttcttgcaatgtctctgtctggtttagttttaga

SEQ ID NO: 40033 - DNA, 115 bp, Homo sapiens
ggagaagggagaggatacgtcatcacatgtagaggaggggccccagtggcgcagacacagtcagtcattatgccagcacacaggttgcatgtaatgataatgatgctatagctcc

SEQ ID NO: 40034 - DNA, 200 bp, Homo sapiens
atatgtatatatatatacacacatatataaaatatatatgtatatataatatatatgtgtatatataatatatatgtatatataatatatgtgtatatataatatatatgtatataatatatatgtgtatatattatatatatgtatatatattatatatgtgtatatattatatatatgtgtgtatatgtatatacaca

SEQ ID NO: 40035 - DNA, 110 bp, Homo sapiens
ggagtaacaacagacatgagatgctgtaaacgttgtagttctaaacatcgatacttgtatttattatgtttatacaataggggtttgcattcagtgttgaatgttacttc

SEQ ID NO: 40036 - DNA, 109 bp, Homo sapiens
agttttaagggcacaggaagggtgctgatttggacctcatacagaacaactttagtgacactagaatgtgagctttgtgagggcaggatgttggtgtgttttgctcact

SEQ ID NO: 40037 - DNA, 90 bp, Homo sapiens
tttgagacagcagggtctcactgtctcgctgggtggactgcagtggcacatagccacagctcactgtaggcttgacgccctaagctcaag

SEQ ID NO: 40038 - DNA, 83 bp, Homo sapiens
ctgggactaactacaggcgcacaccattatgactggctaatctttttatttttaaggaaatggagtctcgccatgttgcccag

SEQ ID NO: 40039 - DNA, 109 bp, Homo sapiens
gtgactgacttcaggcattactgcatcctggagggtagtgctttttaaaaaaaattttttttaaattttaagttctggaatacatgtgcagaatgtgcaggtttgtgac

SEQ ID NO: 40040 - DNA, 58 bp, Homo sapiens; identical to SEQ ID NO: 1868

SEQ ID NO: 40041 - DNA, 79 bp, Homo sapiens
ctggccattgcactccagcctgggtgacaaagtgagactccgtctcagtcagtcagtattagctgagtgtggtggtggg

SEQ ID NO: 40042 - DNA, 76 bp, Homo sapiens
gatggtgtgtcagaagtttgctccttctggtgggttcgtggtctcactggcctcaggagtgaagctgcagaccttc

SEQ ID NO: 40043 - DNA, 87 bp, Homo sapiens
tgagatggagtctcactctgtcacccaggctggagtgcagtggcgggacctcggctcactgcaactctcgggttaaagtgattctcc

SEQ ID NO: 40044 - DNA, 58 bp, Homo sapiens; identical to SEQ ID NO: 1673

SEQ ID NO: 40045 - DNA, 58 bp, Homo sapiens
tgagactgagtctcactctgtcacccaggctggtgtgcagtggtgtgatctcagctca

SEQ ID NO: 40046 - DNA, 74 bp, Homo sapiens
gctgtatgatataaatgaatgaatgaatgtgtgtgtgtgtacacacacatatatctccattcaaaagctatagc

SEQ ID NO: 40047 - DNA, 71 bp, Homo sapiens
gttgttgttgagacagtctcactgtgtcgcctagtctggagtgcagtggcatgatctcggctcattacaac

SEQ ID NO: 40048 - DNA, 83 bp, Homo sapiens
ccttggagtaaagtagcagcacataatggtttgtggattttgaaaaggtgcaggccatattgtgctgcctcaaaaatacaagg

SEQ ID NO: 40049 - DNA, 96 bp, Homo sapiens
tggaggggtcagtctgttgggagttttttagggacaggagcttaaagtagttgatttctttagttgacttaaagagcttaaagtagttgacatcca

SEQ ID NO: 40050 - DNA, 84 bp, Homo sapiens
tcaccttgtccacccttccactcctcactactccagggttccacagacctgagagtagggactgtggtgaagaatgactggcag

SEQ ID NO: 40051 - DNA, 63 bp, Homo sapiens
tatatatctgtgtatatgttacatgtgtatatatatatgtatatacatatatatgggtgtgtg

SEQ ID NO: 40052 - DNA, 84 bp, Homo sapiens
agactgtggtacttaaaagattctttttataatgccaaactctttgtgcaatgtatgtatatattttttaaaagaccatagtct

SEQ ID NO: 40053 - DNA, 92 bp, Homo sapiens
ttcacatcccaactctgtttataaaaatgtgacattggtcaagttacttgatttctctgtctcagtgtctttatcaataaagtgggaatgaa

SEQ ID NO: 40054 - DNA, 89 bp, Homo sapiens
ttttgtgtgttgtttttgaatcctgcaactttactgaatttgtttatcagttctttctgtggagtctttaggatttactttatataaga

SEQ ID NO: 40055 - DNA, 63 bp, Homo sapiens
ctgtcagactataacagtcaggtggttgaggccaatgttgacagttataatgcatgttgacag

SEQ ID NO: 40056 - DNA, 95 bp, Homo sapiens; identical to SEQ ID NO: 68

SEQ ID NO: 40057 - DNA, 93 bp, Homo sapiens; identical to SEQ ID NO: 69

SEQ ID NO: 40058 - DNA, 56 bp, Homo sapiens
gcatgtgcaagtgtgtgtgtgtggatccacatccacacacacacacacacacatgt

SEQ ID NO: 40059 - DNA, 115 bp, Homo sapiens
gtggcatgtatcaggactccctttcctgtttatagctgaatgatatttcatcgtatggatatactatgttttctttatgcattcatcagttgacggacatttgggttgtttccac

SEQ ID NO: 40060 - DNA, 75 bp, Homo sapiens
tctgtaagagttgactgagataggagtgagctgaagctcagccaagttcccctgagtcactgccactgtcacaga

SEQ ID NO: 40061 - DNA, 94 bp, Homo sapiens
ggaggcagactactcttaaaagtaggaaaaaaaaaggcagaggagcagaccgacttttttttttttttttttttttgagagggagtctagctct

SEQ ID NO: 40062 - DNA, 58 bp, Homo sapiens
tgagactgagtctcactccgtgtcccaggctggagtgcagtgatgtgatctcggctca

SEQ ID NO: 40063 - DNA, 164 bp, Homo sapiens
actgcatgggttcacttatgtgcggagttttctgtcttttctttttctttttcttatttatgtatttttttttttttttttgaagtctcactctgtcgctcaggcgggagtgcagtggtgcgatcttggctcacgtcaacctctgcctcccatattcaagcgat

SEQ ID NO: 40064 - DNA, 112 bp, Homo sapiens
ctgaacacctttgcctggctgtgtccctgggtccctttgcctggctgtgtgtaagcatcacccttggagacacctgcaggactgacagtggccaacaagtgccaagcctggt

SEQ ID NO: 40065 - DNA, 102 bp, Homo sapiens
tacaacatgtacacacacatatatacactatatactcgtatcaacatttctaaatctatccatgtatctatcagtatttatctatgtgtgtggttttttgta

SEQ ID NO: 40066 - DNA, 95 bp, Homo sapiens; identical to SEQ ID NO: 68

SEQ ID NO: 40067 - DNA, 93 bp, Homo sapiens; identical to SEQ ID NO: 69

SEQ ID NO: 40068 - DNA, 62 bp, Homo sapiens
ggtgagacggagtctcactctgtcacccaggctggagtgcagtagcgtgatctcggctcact

SEQ ID NO: 40069 - DNA, 77 bp, Homo sapiens
ggtattaatttgtaggggaaatgtgtcacagagttcttgatatcaggcacactgagtcactcaactaacaatgtgct

SEQ ID NO: 40070 - DNA, 92 bp, Homo sapiens
gagaggtttcagtgatttgcagagtagtgatgatgatcatgatcatgagaacatttatgtactgcttacgtaggccaggtactgtcctaagc

SEQ ID NO: 40071 - DNA, 110 bp, Homo sapiens
agataaattgtattgcataacagttggagatagtgttttttatatatatgttttaaaaaacataaaatatgtgacttgttttcatgtgttttgttcagaccaagaattct

SEQ ID NO: 40072 - DNA, 119 bp, Homo sapiens
gtatcactctgagttttagttctctctttggttctggctcatagaaatttttttatttgtatctcccatgagcctagtattgtattaagaagaatgacaaaaacaacacgaagtgtcac

SEQ ID NO: 40073 - DNA, 117 bp, Homo sapiens
tggcatcataccataaattctggtatattgtgttttcattttttttattattatattttaagttctagggtacatgtgcacaatgtgcagatttgttacatatgtatacttgtgcca

SEQ ID NO: 40074 - DNA, 76 bp, Homo sapiens
cagtccttgggatgcttcatttgttctttcttccaatgggatttctgagggtagaagactgtgtccacagaagctg

SEQ ID NO: 40075 - DNA, 152 bp, Homo sapiens
tgtgtgtatatatatatatacacacacacacactttgtatacatatacttttatatagatatatagaaaaaatatatatatagaagtgtgtgtgtgtgtgtgtgtgtatatatatgtatatagaaaagcacatatatccttttctatatata

SEQ ID NO: 40076 - DNA, 70 bp, Homo sapiens
cacacacacttctatatatatattttttctatatatctatataaaagtatatgtatacaaagtgtgtgtg

SEQ ID NO: 40077 - DNA, 66 bp, Homo sapiens
agtgacctccccacagcgtggcggagacagcggcatctcagctcctctctgtccctgtgtgtctct

SEQ ID NO: 40078 - DNA, 62 bp, Homo sapiens
taagacagggtctcgctctgtctgtcgcccaggcgggagtacagtggcgtgatcttggctta

SEQ ID NO: 40079 - DNA, 115 bp, Homo sapiens
ccagttctctcttattttcagctttacagacaagaacaatttaaatctaaagaatttagtagattccttcagtgtcacaaagctgtttcatgaaagaatcaagattataacctgg

SEQ ID NO: 40080 - DNA, 119 bp, Homo sapiens
tgctaggattataggcgtgagccactgtgcctgcctaattttattttttaattgaaaaattttgattttacatattcataggatacacagtgatgtttcaatacatatgaagtatagca

SEQ ID NO: 40081 - DNA, 95 bp, Homo sapiens; identical to SEQ ID NO: 68

SEQ ID NO: 40082 - DNA, 93 bp, Homo sapiens; identical to SEQ ID NO: 69

SEQ ID NO: 40083 - DNA, 58 bp, Homo sapiens; identical to SEQ ID NO: 2595

SEQ ID NO: 40084 - DNA, 77 bp, Homo sapiens
gtatgtgatatcagagtctggttctcagcaataattttttttttttttgagatggagtctggctctgtcatccaggc

SEQ ID NO: 40085 - DNA, 113 bp, Homo sapiens
ctcaatacagatggtctccagagtgtaagtgatgagcatttctaatgaatagaagttagttttttggactttgatagaaataatgttgtatatgcacttaggaggctgagatg

SEQ ID NO: 40086 - DNA, 61 bp, Homo sapiens
tggatctgtctgtctgtctatctatctatctatctggatagatagatctccagctggtcta

SEQ ID NO: 40087 - DNA, 99 bp, Homo sapiens
gctctccagcctaggtgacagagcgagacattggctcaacaaaaaaaaaaaaaaagaaagaaaaaagaaaaaacaatgtctttagtttgctgagagagt

SEQ ID NO: 40088 - DNA, 95 bp, Homo sapiens; identical to SEQ ID NO: 68

SEQ ID NO: 40089 - DNA, 93 bp, Homo sapiens; identical to SEQ ID NO: 69

SEQ ID NO: 40090 - DNA, 108 bp, Homo sapiens
gtgctatagaatatatctatatagatacatatatgtacataaagatatgtatatatctatatatgcacatatagatatatgtatatagatatgttcatacatatacac

SEQ ID NO: 40091 - DNA, 192 bp, Homo sapiens
atatatacagtgtatacatattatatatatatgtgtgtgtgtatatatgtgtatatgtgtatatatgtgtatgtgtgtatatatatgtgtgcatatatgtgtgcatatatgtgtgtatatatgtgtgcatatatatgtgtatatatatgtgtgtatatatatgtgtgtatatatatacatatatgagtacat

SEQ ID NO: 40092 - DNA, 108 bp, Homo sapiens
agtagtgttgcatttaaaattatgttttctgagttgttgttgctggtatatagaaatgcaatctttttttgtatatcaattctgcattcggaaaacttgttgcactct

SEQ ID NO: 40093 - DNA, 108 bp, Homo sapiens; identical to SEQ ID NO: 40090

SEQ ID NO: 40094 - DNA, 85 bp, Homo sapiens
ggaagttgcatttttttaattatactttaagttctggggtatatgcgcagaatgtgaagttttgttacataggtgtacacatgcc

SEQ ID NO: 40095 - DNA, 58 bp, Homo sapiens
tgagacagggtctcgctctgtcacacaggctggagtgcagtggcgtgatcttggctca

SEQ ID NO: 40096 - DNA, 70 bp, Homo sapiens
ttgttttgagatggagtctcgctctgtcgctcaggctggagtgcagtggtgtgatcctggctcactgcaa

SEQ ID NO: 40097 - DNA, 99 bp, Homo sapiens
tggttctcctgcctcagcctcctgagtagctgggaatataggtgcgtgccacatttttttgtatttttagacgagacagggttggccaggctagtctca

SEQ ID NO: 40098 - DNA, 72 bp, Homo sapiens
tcattttgtgtgttctgtgtgtcactctgggagacctgctttacctgataagaagcagaacgcagctgttga

SEQ ID NO: 40099 - DNA, 82 bp, Homo sapiens
gttctatctctcaaaaatgttaagaaatatatatatatgtttatatatatgttaatttctttacatttttgagagatagaac

SEQ ID NO: 40100 - DNA, 73 bp, Homo sapiens
tggaaactactgatttacatgttgtctttgctggcagcagtgtgaaaggcagtttgaaaccttatgtgctcca

SEQ ID NO: 40101 - DNA, 95 bp, Homo sapiens; identical to SEQ ID NO: 68

SEQ ID NO: 40102 - DNA, 93 bp, Homo sapiens; identical to SEQ ID NO: 69

SEQ ID NO: 40103 - DNA, 130 bp, Homo sapiens
tatatgtatgtgtgtgtatatatatatacatatatatacacatatatatgtatatatatgtatatatatgtatgtatgtatgtgtgtatatatatatatatatatatatatatatatatatatatataca

SEQ ID NO: 40104 - DNA, 214 bp, Homo sapiens
gtgtatatatatgtgtatatatgtgtgtatatatacatgtgtatatatgtgtatatgtatacacatgtatatatacgtgtatatatgtgtatatatgtgtgtatgtatgtgtatatatgtgtatatatatgtgtgtatatatatatgtgtatgtatatatgtaaaaaaagctatatgtatgtgtgtgtgtatatatgtgtatatatgtgtgtat

SEQ ID NO: 40105 - DNA, 104 bp, Homo sapiens
ctgaaggtgatatttcattgtggttttgatttgcattccctggatgattagtgatattgagcatctttttgtatactttttggccgcttgtgtgtcttttttgg

SEQ ID NO: 40106 - DNA, 95 bp, Homo sapiens; identical to SEQ ID NO: 68

SEQ ID NO: 40107 - DNA, 93 bp, Homo sapiens; identical to SEQ ID NO: 69

SEQ ID NO: 40108 - DNA, 94 bp, Homo sapiens
ctggaacatttggaaaatgaatacattgttgcaaaaactcacattgttggccataatgtttgtgataatgttgttgacttaccagatgtcctgg

SEQ ID NO: 40109 - DNA, 95 bp, Homo sapiens; identical to SEQ ID NO: 580

SEQ ID NO: 40110 - DNA, 93 bp, Homo sapiens; identical to SEQ ID NO: 69

SEQ ID NO: 40111 - DNA, 94 bp, Homo sapiens
ttcattaagatttgttaggttagtgatattcagtatttgctgagtctctcagtgagacactgaatttattggatatcttttcatcttctttgaa

SEQ ID NO: 40112 - DNA, 89 bp, Homo sapiens
tatgttttggtaaaatttttcataaaggagtaaattagtatattcttttaaaatgtattacttcaattggatatttctgccaaagcatg

SEQ ID NO: 40113 - DNA, 64 bp, Homo sapiens
cagggcacactgatgcaagagatgggttcccaaggccttgggcatctctgcctctttgactctg

SEQ ID NO: 40114 - DNA, 58 bp, Homo sapiens
tgagacagagtctcactctgtcacccaggctggagtgcagtggggagatcttggctca

SEQ ID NO: 40115 - DNA, 61 bp, Homo sapiens
tacgtatgtatgtatgtatgtacttatgttttatgtatgtatgtatgtatgtatgtatgta

SEQ ID NO: 40116 - DNA, 115 bp, Homo sapiens
atggctggaagaatgaatgactaccagtggtttaagtgtggaaataatgtcatttgaaagcttatttatttatttgacactacattcaagagccactaattctttactaaatcat

SEQ ID NO: 40117 - DNA, 76 bp, Homo sapiens
gattacttataagcagagagacataattgtgtctatctatctatccatcttgtgtctgtctgtctgtctgtctgtc

SEQ ID NO: 40118 - DNA, 64 bp, Homo sapiens
gaggtgtttttctcagacaaaacatgaatattttttgtcttaattgtctagagaaatatatctc

SEQ ID NO: 40119 - DNA, 97 bp, Homo sapiens
aaaaatatatttccctagatcattcatttttgttttgatacttgagagaaatacaaacttctctttcatttaagataggatatgattgaatattttt

SEQ ID NO: 40120 - DNA, 96 bp, Homo sapiens
cattttcttgtgtgataacagtttatgtaaatgtccagcagtccttaattgctgtttatttttataagtgttaagccatatttacaaaagtcagtg

SEQ ID NO: 40121 - DNA, 60 bp, Homo sapiens
agtgagacatgatcacacccttgcactccagcctgtgtgacagtgagactcagtctctct

SEQ ID NO: 40122 - DNA, 92 bp, Homo sapiens
ccatagataattaaaatgattatgaaaataacagaaatgcattgacttaagtataaatgtatttttcatttcacaatcttgatccactatgg

SEQ ID NO: 40123 - DNA, 76 bp, Homo sapiens
atgtgtatctatgtatatatgtatgtatatgtgcatatatagacacatgtacacacgtatgtacatatatacacat

SEQ ID NO: 40124 - DNA, 104 bp, Homo sapiens
ttcacatgcctgcggtactgaatggtcatattgtttctttttatagtagttaaatgcatgatcttggactagttaaatgtatgatcttggactcaggctctgag

SEQ ID NO: 40125 - DNA, 79 bp, Homo sapiens
tgggaatggggtagtgagtgggtaatctgtgagtctcactgtctatacaggttaaataaatttatgtgccttttctcca

SEQ ID NO: 40126 - DNA, 83 bp, Homo sapiens
tatatattcataagtgtgcatgcatataagtattcatctgtttaagatatatgtgtgtgtgtgtgtgtgtgtgtgtgtgtgtg

SEQ ID NO: 40127 - DNA, 101 bp, Homo sapiens
tatgcacaatgcagatatatttgtctatatatgtttatgaatgtatatcacacaaactcatcagatatgtacacatgtatacctgtgcatttatatgtata

SEQ ID NO: 40128 - DNA, 99 bp, Homo sapiens
agacaggcgcacacacacacacacacacgtgtttaaagtagaggagaaattggaacattcccactcccactgtgtgtgtgtgtttgtgcagagaggttt

SEQ ID NO: 40129 - DNA, 90 bp, Homo sapiens
gttgcaagtgacataagcccatcatactacctgcatttgtttttatatattgcatagcaggttacaatgaacttggtggcttaaagcaac

SEQ ID NO: 40130 - DNA, 72 bp, Homo sapiens
gtatgtgtgtgtgtgtatatctatatctatatagatatagatatagatatagatatagatatagatatatat

SEQ ID NO: 40131 - DNA, 79 bp, Homo sapiens
atatgtatatatgtgtatatgtgtgtatatatatgtgtatatatgtgtgtgtatatatatgtgtgtgtatatatatatg

SEQ ID NO: 40132 - DNA, 102 bp, Homo sapiens
acactttatattagtttattaagctagctccattatttctaagatcactagtgattttatagaggagttggagaaaaggccagaggtggattaagaaaatgt

SEQ ID NO: 40133 - DNA, 90 bp, Homo sapiens
acttacatacttacacacacacacaaagtctatgaatactgaggatagaaggtgttcatagatttcgtgtgtgtgtgtaagtatgtaagt

SEQ ID NO: 40134 - DNA, 99 bp, Homo sapiens
ccaggaataaagcctacttgatggtggtgaattaatttaatttataaagaaattctttataattaactcactaaggaaagaggtttaattgattcatgg

SEQ ID NO: 40135 - DNA, 126 bp, Homo sapiens
atatatatatgtgtgtatatatatatgtcatatataggagtggatatgactttatatatatatatatatatatatatatatatatatatatatatatatatataaaatacatatatgtgttcactc

SEQ ID NO: 40136 - DNA, 68 bp, Homo sapiens
gtagtcctgacatgtgtctgagtctagctgagtctggggtttttatggactcagaatggaggaagtgc

SEQ ID NO: 40137 - DNA, 72 bp, Homo sapiens
ttgttttttgagacagagtctcactctgtcacccaggctggagtgcagaggtgcgatctcagctcactgcaa

SEQ ID NO: 40138 - DNA, 106 bp, Homo sapiens
atatatatttatatttatataaacgtgcataaacatatgtagggatcaaggaagataaatatacatttaattatatatgcatgtatatatatgtatgtatgtgtat

SEQ ID NO: 40139 - DNA, 102 bp, Homo sapiens
tcagaatgtacttgttaatactcctacggattactattatttataattttttgttatgaaaaatataaatatcagagaagctgaacacagttgcattcttga

SEQ ID NO: 40140 - DNA, 87 bp, Homo sapiens
gagtgtgcagtcatttaattggtatgatattgtaaaggtaaaatacatttagaataattataattttgaatgttattgataacactc

SEQ ID NO: 40141 - DNA, 118 bp, Homo sapiens
ggtgaaacctagtagttgtaatgtgtttaaaaagactatatatatatatatatatatatatatatatatatatatatatgcagtcaaaacagtaacaagtttcagtaggacatttgcc

SEQ ID NO: 40142 - DNA, 89 bp, Homo sapiens
aatagagcaaaattatactcttgttagcaatgttgagatgattcatttatctgcttttttgcttatttgaatatcattttgtgaatatt

SEQ ID NO: 40143 - DNA, 117 bp, Homo sapiens
ctcacggagatgtgatgatactctcaagcctctctttattttgcatgtggtagttatttgtatccttgaaatgattagggaaggttagttctgggtaagatctctgattcacgtgag

SEQ ID NO: 40144 - DNA, 68 bp, Homo sapiens
tgtgtgtgtatatatatgtgtgtgtttatatatacacacatatatacacacatatatatacacacaca

SEQ ID NO: 40145 - DNA, 56 bp, Homo sapiens
gtgtgtgtgtgtgtgtgtgtctatgtatgtatatgtatatatatacacacacatat

SEQ ID NO: 40146 - DNA, 58 bp, Homo sapiens
gggtatggtattatacaataggtgacttcctgggggttacactagagtgtgtccaccc

SEQ ID NO: 40147 - DNA, 106 bp, Homo sapiens
cattttttacggcagaattatatccatgtatatgacattttctttatctgttcatcctttgatgaacatttaggttgattccatatcttggctactgtgaacagtg

SEQ ID NO: 40148 - DNA, 107 bp, Homo sapiens
tgtatgcagggattataagggaggtcaagaatgattattttttattcagaaagcttacggagtaattgaaatcatagagaaaaatgtttttattatatcctgcatca

SEQ ID NO: 40149 - DNA, 111 bp, Homo sapiens
caatttttcaagagggctttaaacttttatttttattttttacttttaatttttgtgagtacacagtaggtatatatatttataaggtgcatgagttgttttgagagaatg

SEQ ID NO: 40150 - DNA, 56 bp, Homo sapiens
tatataaatatatgtatgtgtgtgtatgtatatatatatatatatatatatatata

SEQ ID NO: 40151 - DNA, 94 bp, Homo sapiens
tggtgtcagggtaatgctggtcttttagaataagttggggaaaattccctaccatttattattatttttttaagcttcagtagacttgatatta

SEQ ID NO: 40152 - DNA, 115 bp, Homo sapiens
cctcaattgcagcttgtttttgacttcacaggctcataggtagaagggaattgtcttgtctcagatgagactgtggacttttaagttaaagccggaatgcgtcaagagtttgggg

SEQ ID NO: 40153 - DNA, 90 bp, Homo sapiens
atacatatgtgtatacatctacatatttatacatatatgtgcatatacatatatgtgtatatatgacagatttaaaatttacatatgtgt

SEQ ID NO: 40154 - DNA, 112 bp, Homo sapiens
tctccttcctccaagtgcatcactgagtttttttgaagccttcatactttttttatgtagttgtttattgctttaaacttctctcagtactgattttgctgtatcctggaga

SEQ ID NO: 40155 - DNA, 118 bp, Homo sapiens
tgcaagataatatgttaaaagtgtgtgtgtgggggggcttatttttgttttattttgttttttagttaaacccaaagcactcagagaataattgtttccagatatttgtgttcttgca

SEQ ID NO: 40156 - DNA, 58 bp, Homo sapiens; identical to SEQ ID NO: 315

SEQ ID NO: 40157 - DNA, 109 bp, Homo sapiens
gcttagaactgtcttggctatacgggctctttctttggttccttatgaaatttaaagtagttttttctaattctgtgaaggaagtcaatggtagcttggtgggaatagc

SEQ ID NO: 40158 - DNA, 92 bp, Homo sapiens
tgtatatgtgtgtgtttgtgtatatatccaatagtgtacacatgttattacacatgtgtttatgtacatatatatgtatacactaaattgga

SEQ ID NO: 40159 - DNA, 97 bp, Homo sapiens
tacctttctctttctatgacctctgccaatagtcaaaaaactcaaatctctctgtcactatgactatgtgggcaagttgatggatacagtgtaggtg

SEQ ID NO: 40160 - DNA, 80 bp, Homo sapiens
gtggttttcactttgggttgcaggcatctagacaaagggaccacagtgatgctggaaaactcagagatgacagtgaccat

SEQ ID NO: 40161 - DNA, 72 bp, Homo sapiens
acacacatataaaaatatatatgtatgtgtatatatatacacatatacacatgtgtatttatgtatttgtgt

SEQ ID NO: 40162 - DNA, 112 bp, Homo sapiens
tgtgtacacattatttaactctggcttatgaatgagaacatgtaacacttgtctttcttttttcttttttttaagacagtctcactcatccagactagaatgcagtggccca

SEQ ID NO: 40163 - DNA, 106 bp, Homo sapiens
atttcttcttaatgttaatctctttaatatgatcatggtgatagttctctaaattcaagtttatttatctgtttatatgatagggagaagacaggtaaaaaggaat

SEQ ID NO: 40164 - DNA, 56 bp, Homo sapiens
cagtgtctcgctctgtcacccaggctggagtgcagtggtgtgatatcggcttactg

SEQ ID NO: 40165 - DNA, 110 bp, Homo sapiens
gaagagggcatggtacatgtttatatatgcatttaaatttatttctctgtagaaacagatgaaaatatttatttttggtaaattaaatatgaaaatgaaattacctgttt

SEQ ID NO: 40166 - DNA, 118 bp, Homo sapiens
ggctcggttttctcttgattttctagttctttgtggtgcattgttaaattgtttatttaaagtttttcttcttttttgatataggcacttagagctgtaaaatcccttgttattactg

SEQ ID NO: 40167 - DNA, 137 bp, Homo sapiens
acacacatatatatgtatgtatatatacacatatatatgtgtatatatacacacatatatatgtgtgtatatatatatatatacacatatatatgtgtatatatatacacacatatatatgtatatgtattcatgca

SEQ ID NO: 40168 - DNA, 101 bp, Homo sapiens
ctcaatttttaacctgctgccctctgttgtttacagtttttcatgttggaaaaacttttctttgaacatttgtaccacagtagagggtaatagggattgag

SEQ ID NO: 40169 - DNA, 94 bp, Homo sapiens
ttatgtctctacttattgtcagtgcatgtaaacataaaaatattgtaattttatatttttatgtttttgcttggtttttaagtggggtatataa

SEQ ID NO: 40170 - DNA, 84 bp, Homo sapiens
tcagtctctatggttatatatttttctgtaatagtgtttatgagctcaaaaataaggtcagtcaagataggaccagaaggctga

SEQ ID NO: 40171 - DNA, 113 bp, Homo sapiens
tattcactgaagatatttgtgatttctttcctcttatgtctgattatattaaatttcattattcttttatatggaagacatattttaggacttaatgatgtcacaaagagtag

SEQ ID NO: 40172 - DNA, 75 bp, Homo sapiens
taccattatttaaattccatgtagagaaatgaatatataagttagtttctgtacaaaagaaactaaattatggta

SEQ ID NO: 40173 - DNA, 86 bp, Homo sapiens
acctatatatctctatatgtacatatcatatatatatatatatatatatatatatatatatatatatgtcacaggatcccttgggt

SEQ ID NO: 40174 - DNA, 135 bp, Homo sapiens
gcattatcttaaaatgtttgaattatagtactatatttagtactattatatgtaaaaatgactatatataaatataaataattatagtattatatatttagtatagatatatgtaaagtgcacagtgtgctatga

SEQ ID NO: 40175 - DNA, 90 bp, Homo sapiens
atatttatatatgtacatatatatgtgtatatatgtacatatatgtgtatatatgcatatgtgtgtatctatatatatatatttctgtgc

SEQ ID NO: 40176 - DNA, 56 bp, Homo sapiens
gagtcagagtctcgctctgtcacccaggctggagtgcagtggcgagatctcggctc

SEQ ID NO: 40177 - DNA, 91 bp, Homo sapiens
gccagcagtgatacccaggtagtatcatgacctgagacttgctggcttcagatgagactcagcacattattatctgtggttgctagggggc

SEQ ID NO: 40178 - DNA, 72 bp, Homo sapiens
atttatatataccttatgtattaggttaatatatgtaagtttatatatgctcatatgtaggtatgtataaat

SEQ ID NO: 40179 - DNA, 95 bp, Homo sapiens
ctgggattacaggtgtgagctcccagacccagactgtttttcttttcttttcttttttttctttttttcagttggagtctcactctgtcactcag

SEQ ID NO: 40180 - DNA, 95 bp, Homo sapiens; identical to SEQ ID NO: 68

SEQ ID NO: 40181 - DNA, 93 bp, Homo sapiens; identical to SEQ ID NO: 69

SEQ ID NO: 40182 - DNA, 79 bp, Homo sapiens
ctgctgctattagattaaatattttatatatatatatatatatatatgtgtgttaagtctatttagtctaaagtgtggt

SEQ ID NO: 40183 - DNA, 75 bp, Homo sapiens
gtgtgaggactgaagcctctgggtgcatcgccaaccaatttaagcggcgtctggagtctgtcagtgtctgtctac

SEQ ID NO: 40184 - DNA, 91 bp, Homo sapiens
tgtgtgtgtgtgtgtgtgtgtgtatatacataggtgtgtatatatatatgtatacacacacatatatgtatatatgtatacctatacacac

SEQ ID NO: 40185 - DNA, 95 bp, Homo sapiens; identical to SEQ ID NO: 68

SEQ ID NO: 40186 - DNA, 93 bp, Homo sapiens; identical to SEQ ID NO: 69

SEQ ID NO: 40187 - DNA, 95 bp, Homo sapiens; identical to SEQ ID NO: 68

SEQ ID NO: 40188 - DNA, 93 bp, Homo sapiens; identical to SEQ ID NO: 69

SEQ ID NO: 40189 - DNA, 80 bp, Homo sapiens
tgtttgtataaatagctaaagatacttgcagtctcacgtctcaagaagagactgattgatagttgttatttataattaca

SEQ ID NO: 40190 - DNA, 92 bp, Homo sapiens
tgctagctgagactaggaaagctctctgtttgtggaagtaggttattttgatatggccacttacatgtccttaagttcctctgagaggagta

SEQ ID NO: 40191 - DNA, 113 bp, Homo sapiens
cacatgaccatttaaatgtgcaaatgtaagaagattcaatgtgtttacatcaaatgacatattttattgatttattgcagattcagtgcatatgagccaaattgttgagtgtg

SEQ ID NO: 40192 - DNA, 66 bp, Homo sapiens
tatatatatatgtacatatatatacagtttgatatataagtgtgtgtgtgtgtgtgtgtgtgtgtg

SEQ ID NO: 40193 - DNA, 113 bp, Homo sapiens
attattattgttactttaattgacataaaattgtatgtatttactgtgaacaatgtattgttttgaagtatatacatattcttgaatgactaactctaggtaatttaggtaat

SEQ ID NO: 40194 - DNA, 125 bp, Homo sapiens
ttgacatgaaattgatccagtaagttgatgatcactccatactaagcgtcactgtgaatagagaatttgttgtttcatggttgacatcaatgtgattaatgacatcaatatgattcattgtttta

SEQ ID NO: 40195 - DNA, 103 bp, Homo sapiens
ttctaatttagagaaagctaattttgtgcagcagcaaaatagaaaccattgaagtttatctcagaagtgattatgttgtattgaaaaagcttctgaagtagag

SEQ ID NO: 40196 - DNA, 113 bp, Homo sapiens
aagtcaggtacttctttccaagtgaggatattgtacaaccaaattttctaattcatttctgatgataaaattatgtactcttctttgcaatggaagtaaaagtacacttgctt

SEQ ID NO: 40197 - DNA, 102 bp, Homo sapiens
tatgtctataaatataaagttatatggctatatatatctatatgtttctctatatacagatatatatatcaatgtaaatagataaataaataaatagatgta

SEQ ID NO: 40198 - DNA, 82 bp, Homo sapiens
gaggaaacaggcacacaggtgattcatctatcagatgtatcagacactgtctctgaatttactgtgattagtatgttttttt

SEQ ID NO: 40199 - DNA, 95 bp, Homo sapiens; identical to SEQ ID NO: 68

SEQ ID NO: 40200 - DNA, 93 bp, Homo sapiens; identical to SEQ ID NO: 69

SEQ ID NO: 40201 - DNA, 120 bp, Homo sapiens
ggttactcactgaagcagaacaaaggaggacacattgtgtctgaaacagggactattacacaaggcagtgagctctctacagactgtgtgggcctttattccgtggtaaagaagtgttcc

SEQ ID NO: 40202 - DNA, 81 bp, Homo sapiens
atgtgacaatcctgcatagagcaagtctattggtacaatttttccaacatcttgtattcactttgtgtctctgtgtcacat

SEQ ID NO: 40203 - DNA, 79 bp, Homo sapiens
tgtacatatgtgcgtgtgtatatatgtgtgtacatgtgtgtaagtgtatattatatgtgtgtgtatgtgtgtgtgtaca

SEQ ID NO: 40204 - DNA, 97 bp, Homo sapiens
gaaagtagggaagagaatagaggtgaggagggtgtgaaacagaagtttatggggtttttttgttttgtttttcaatttttggctttttgttgttttt

SEQ ID NO: 40205 - DNA, 116 bp, Homo sapiens
agattttttttgtgtatgttaaaaagtgttggtatctctcacagtgtgaagagagctattggtagtttttttttttgtttccatattttctgtcataataaccataaaatcaatct

SEQ ID NO: 40206 - DNA, 58 bp, Homo sapiens
tgagatggagtctcactctgtcacccaggctggagcacagtggtgtgatttcagctca

SEQ ID NO: 40207 - DNA, 60 bp, Homo sapiens
tatatatacacacacacatacacacacatatatgtgtgtgtatatgtgtgtgcatgtgtg

SEQ ID NO: 40208 - DNA, 95 bp, Homo sapiens; identical to SEQ ID NO: 68

SEQ ID NO: 40209 - DNA, 93 bp, Homo sapiens; identical to SEQ ID NO: 69

SEQ ID NO: 40210 - DNA, 101 bp, Homo sapiens
gccagtgcaaatttttcttactgcatccttatcttctctgtcactcacaaccactggctcagggaggatttggcaggtggttgacaaatggaagttctggc

SEQ ID NO: 40211 - DNA, 97 bp, Homo sapiens
tccagaaagatttgcctccgcagagccatgagtttatattttaagaggagatgagacttgagactgtggagatactcttggattgtaaatatgctgg

SEQ ID NO: 40212 - DNA, 112 bp, Homo sapiens
ttcgtgtcatatgttatgtatatatgtgtgtgtgtgagagtgcatatatatatatatacatatatatatatgaatgcctcttattaaaacaaaacaccatcttcattgtata

SEQ ID NO: 40213 - DNA, 95 bp, Homo sapiens
acactctcattctctctctggttcttattctgtctgtctgtctcacaaactaacgcatactggcagggatacatgccagtctggggataggatgt

SEQ ID NO: 40214 - DNA, 100 bp, Homo sapiens
cattcctggtctgtttttgtttgtttgtttttttacttaattgttctttgctagaggactagtgaccagacacacacactcaaacttcatcgctgggatg

SEQ ID NO: 40215 - DNA, 111 bp, Homo sapiens
gtttggattttcgctgttattcatctctgtttgctcaaggcacaaactacttttttcctatttttttttttcttggctcatggttgatgtagtaaaaggcaaagactggat

SEQ ID NO: 40216 - DNA, 99 bp, Homo sapiens
atatatacacataggtatatatgggtgtatatatatatgcataggtatatatgtgtgtatatatatatgtgtgtctatatatacatatatattttctgc

SEQ ID NO: 40217 - DNA, 85 bp, Homo sapiens
ctccgggaaagtctctgtctctctgggtctgtttctatcactgaaggggtcaagattaaaagtcaagatagtcagaacctgtgag

SEQ ID NO: 40218 - DNA, 89 bp, Homo sapiens
gccagaaaggccagtctcactcccactgtctccccccaacagcactgagtttatttccagacagcccttgagcaggactgagtacttgc

SEQ ID NO: 40219 - DNA, 66 bp, Homo sapiens
gtcctcaggagtaatggaaaggggctaggagtgagttcccacaccctgacactctgacaaggggac

SEQ ID NO: 40220 - DNA, 58 bp, Homo sapiens
acggtcaccctgagtgactctctgtgaacagggcatttggtttctgcaggcttgccgt

SEQ ID NO: 40221 - DNA, 110 bp, Homo sapiens
gcttatctagctccttccaaattgtaacctaggtcagtttgaggtcagaggccaagtgtgtctttatctctctgtattcccagcacgtcatataggtcagagttcatagc

SEQ ID NO: 40222 - DNA, 101 bp, Homo sapiens
gatctggatcacctttatctgttttgagtatttggaatcatcattgattaatatcatattttttattagtctttgtgagccatatatttcagtgtctgatc

SEQ ID NO: 40223 - DNA, 111 bp, Homo sapiens
tgtatatacatatatacacatgtatatacatatatgtgaatatatgtatatatgtgtacatatgtatatacacttatatgtgtatatatatacacacatgtatacacatat

SEQ ID NO: 40224 - DNA, 59 bp, Homo sapiens
gaagagatgaggcacaccagaggctggagaacctctgagaggctgtgtctcaattgttt

SEQ ID NO: 40225 - DNA, 95 bp, Homo sapiens; identical to SEQ ID NO: 68

SEQ ID NO: 40226 - DNA, 93 bp, Homo sapiens; identical to SEQ ID NO: 69

SEQ ID NO: 40227 - DNA, 71 bp, Homo sapiens
catagaaaaaggttctcttgttcattatttttgaataaactaatctgcaacatagagggctttttcctgtg

SEQ ID NO: 40228 - DNA, 98 bp, Homo sapiens
gtactagggagaaaaataatgcagtgaagaggtgtaatggttaatattgagtgtcaacttgtttggattgaaggatgcaaagtattgttcctgggtat

SEQ ID NO: 40229 - DNA, 93 bp, Homo sapiens
tgacttcctctagtttctgtgcaggccaatgtttggttttctagctatagctgttaaccatttgtgggtcatgaaatcaatttagtggattca

SEQ ID NO: 40230 - DNA, 129 bp, Homo sapiens
cttacaaggaacagtgaagactggtgggcctacctctatggcataggcattctcagagaagagacagtgtgcaggaggcagatacacccacaggtgtctaccttgtttacatgtggggatctttggaga

SEQ ID NO: 40231 - DNA, 58 bp, Homo sapiens
tgaggtagagtctcactctgtctcccaggctggagtgcagtggtgcaattttgcctca

SEQ ID NO: 40232 - DNA, 58 bp, Homo sapiens; identical to SEQ ID NO: 2540

SEQ ID NO: 40233 - DNA, 96 bp, Homo sapiens
gcaagctctaaaacatgatttacagcacttaggaaacttttatttttttttcctgagcaaaccctttctgctgttgtctggaagcctggaatttgc

SEQ ID NO: 40234 - DNA, 65 bp, Homo sapiens
gtgtctctctcagtgtgtctaggtccggggcttttatgggctcagaatgggagagtacatgctga

SEQ ID NO: 40235 - DNA, 95 bp, Homo sapiens; identical to SEQ ID NO: 68

SEQ ID NO: 40236 - DNA, 93 bp, Homo sapiens; identical to SEQ ID NO: 69

SEQ ID NO: 40237 - DNA, 101 bp, Homo sapiens
gttcataaagatggagccttcatgaatgggaatagtgcccctgtgaaagagaccagagagagctcttacccctgttggttatgtgaggttacatatggaac

SEQ ID NO: 40238 - DNA, 58 bp, Homo sapiens
tgagatggagtctcactctgtcacccaggctggagtgcagtggtgcgatcttagctca

SEQ ID NO: 40239 - DNA, 68 bp, Homo sapiens
agactgaagtctgtcaacacacctggacagaaccactgtcttctctgtgggcccacaaggctttgtct

SEQ ID NO: 40240 - DNA, 89 bp, Homo sapiens
gccacgcactgacattctaagtcactcacacacagaactagattttgttttcctgtgtgtgctaagctagtcaaagggtctgtgttggc

SEQ ID NO: 40241 - DNA, 116 bp, Homo sapiens
tcttcaaggagcataagttcttaattttgattaagtgcaatttataaatttgtttttatgaataacaaatttataaattgcacttcatctaaattatactggtgttagatctaaga

SEQ ID NO: 40242 - DNA, 74 bp, Homo sapiens
gacattatgacttgtcttgctctctcatggatctctctctctctgggagaagccagctgccaggtcatgaggtt

SEQ ID NO: 40243 - DNA, 95 bp, Homo sapiens; identical to SEQ ID NO: 580

SEQ ID NO: 40244 - DNA, 93 bp, Homo sapiens; identical to SEQ ID NO: 69

SEQ ID NO: 40245 - DNA, 95 bp, Homo sapiens; identical to SEQ ID NO: 68

SEQ ID NO: 40246 - DNA, 93 bp, Homo sapiens; identical to SEQ ID NO: 69

SEQ ID NO: 40247 - DNA, 95 bp, Homo sapiens; identical to SEQ ID NO: 580

SEQ ID NO: 40248 - DNA, 93 bp, Homo sapiens; identical to SEQ ID NO: 69

SEQ ID NO: 40249 - DNA, 83 bp, Homo sapiens
tttgctaatgtaaccatacaagtataatttaaaaacttgtttttaaacaagtaagtattatacttaaaatggcagaaagcaaa

SEQ ID NO: 40250 - DNA, 66 bp, Homo sapiens
ttgagcctgtgtgtgtctttgcacatgagatggatctcctgaatacagaacactgacaggtcttga

SEQ ID NO: 40251 - DNA, 96 bp, Homo sapiens
gtatgtgtatatatgtatgtatgtgtatatatatgtatgtatgtgtgtatacatatacacacacacacacacacatatatatgtgtatatatatac

SEQ ID NO: 40252 - DNA, 74 bp, Homo sapiens
atatgtatacatgtatgtgtgtatacatatatatgtatacatgtatgtgtgtatacatatatatgtatacatgt

SEQ ID NO: 40253 - DNA, 74 bp, Homo sapiens; identical to SEQ ID NO: 40252

SEQ ID NO: 40254 - DNA, 74 bp, Homo sapiens; identical to SEQ ID NO: 40252

SEQ ID NO: 40255 - DNA, 114 bp, Homo sapiens
gtatatatgtatgtgtgtatacatatatatgtatatatgtatgtgtgtatacatatatatgtatatatgtatgtgtgtatacatatatatatgtatatatgtatgtgtgtatac

SEQ ID NO: 40256 - DNA, 106 bp, Homo sapiens
atatatatatatatatatatatatgtatatatatatatgtatatatatgcctatgtgtatatgtatatgtatatatgtatatatgtttgtgtgtgtgtgtgtatat

SEQ ID NO: 40257 - DNA, 125 bp, Homo sapiens
gtaactcaggtgaaaatgcaaaatttgttgggaagacggagagatcacttctgaaattgttgttctgcctacagtaggcctttgctacttgattctacacaagtgcctgtgttcagggcgtggac

SEQ ID NO: 40258 - DNA, 102 bp, Homo sapiens
tcagttaatttctaaatatttatttcaatgttattttaagtaaaattgttttttaattttcttttcagattgttcattgttagtgtctagaaatgcaactga

SEQ ID NO: 40259 - DNA, 97 bp, Homo sapiens
agaaaattggcagaaaagtgtgtgtatatgtatgtatatgtgtatatatatacacagacacatacatacatacacatacactatatttaaattttct

SEQ ID NO: 40260 - DNA, 94 bp, Homo sapiens
gcagctttggtgtcttgagagtgttaaagtaggtatttaaattgtaaataacaaagtttattttgaaataatttttaacttatagaaaagttgc

SEQ ID NO: 40261 - DNA, 60 bp, Homo sapiens
tatgtatgcatatatatatatatgtatgcatatatatatatatatatatatatatatata

SEQ ID NO: 40262 - DNA, 78 bp, Homo sapiens
ggaagttcatgtgtacatatctatgaaaatctttgactatcaattaattttttattgatatgtaatatttgaactttt

SEQ ID NO: 40263 - DNA, 75 bp, Homo sapiens
gagggttggtgtgggggaatgaggtcaggccattaatgggtataggctttgggggctctctctctctctctctaa

SEQ ID NO: 40264 - DNA, 105 bp, Homo sapiens
tgtacatatctatgtctctctctctatatatatatatatgtgtatgtgtctatatatacatatatatgtccttatgtatatatgtatatatatatatagagagag

SEQ ID NO: 40265 - DNA, 57 bp, Homo sapiens
tgtatgtgtgtgtctgtgtgtgtatacatatatacacatacacatattatatataca

SEQ ID NO: 40266 - DNA, 112 bp, Homo sapiens
gtagtgtcgtaaggtaatctgtatactttttagttaaatctctatagtagtgtcataaaataatctctatattttttagttaaaaagtatacataaacaaatgaaaatttat

SEQ ID NO: 40267 - DNA, 110 bp, Homo sapiens
tacaagtgttttggtctttcttatctttaattttcaagtgccagggtggttctcattatgtatttgtgatatctagttaaagataatgtcaacaaaccaaaaggaacgtg

SEQ ID NO: 40268 - DNA, 80 bp, Homo sapiens
tttgtgtatatatgtgtatatatatgtgtgtgtatatatctatatatgtactttggttatatatattatatatatataaa

SEQ ID NO: 40269 - DNA, 121 bp, Homo sapiens
atatatatattatatatatgtgtgtatatatatgtgtgtgtatatatatgtatatgtatatatatgtatatatgtatatatgtatatatacacatatacacgtatatatgtgtatatatat

SEQ ID NO: 40270 - DNA, 90 bp, Homo sapiens
tgccatgtgcttgaatctggtctcatggaagagcatgttctttggtggtctttggccacattctctctttctgtctttcaatagctggta

SEQ ID NO: 40271 - DNA, 85 bp, Homo sapiens
tagatagatagatagatagatagatagatagataaagtggctatattcagctccctacttgtttagctctctctctctctctcta

SEQ ID NO: 40272 - DNA, 73 bp, Homo sapiens
ttcttaaaatcttatatatatatatatatatatatatatatatatatatatatatgtagagagagagagagag

SEQ ID NO: 40273 - DNA, 112 bp, Homo sapiens
gcatagattggaatttgtaccatgtgctattattgcctcaaacaaaatctttattctttttttaacctttattttaagtttagtggtacatgtgcaggtttgtaatataggt

SEQ ID NO: 40274 - DNA, 95 bp, Homo sapiens; identical to SEQ ID NO: 68

SEQ ID NO: 40275 - DNA, 93 bp, Homo sapiens; identical to SEQ ID NO: 69

SEQ ID NO: 40276 - DNA, 92 bp, Homo sapiens
tgtgtgtgtgtgtatgtgtacatgtgtgtgtatatgtatgtgtatatataacatacgtataacacacatatatatacatacacacacatata

SEQ ID NO: 40277 - DNA, 106 bp, Homo sapiens
agctcagcccctggatatgtagaataggtgcataaaagaaagtgtaaaatataacattttctgtctgtgtctgtgcatttctcttctgtccttttccagttgagtt

SEQ ID NO: 40278 - DNA, 61 bp, Homo sapiens
gcatgtgtgtatgtgtgttaatgtatatacatatatatatatatatatatactcacacagc

SEQ ID NO: 40279 - DNA, 113 bp, Homo sapiens
ggctattctggcacattttttcttcccatttgaattttaggatcattttttctaattgtgtgaaaaatgatattgacattttgataggaattacattaaatctgtagattgct

SEQ ID NO: 40280 - DNA, 127 bp, Homo sapiens
tgggttacatcatctgggctccattgctctctggctttctgttatatgtacaatgcaagttactgacagatcagagagagaggaaggtcagccattccttcccattctcttcatgttttagcactgc

SEQ ID NO: 40281 - DNA, 78 bp, Homo sapiens
ctgaaatgaaaaggaaagaattcagaagataattatcttgattatccttttctttttttccttttttttttttttcag

SEQ ID NO: 40282 - DNA, 107 bp, Homo sapiens
tgaaaggacattgaatgaaaaaattaatgagcatgaacaattaaacctatcagtgagatgttatgagctgttctatgtgggcataaagggagtcatatgtgctttca

SEQ ID NO: 40283 - DNA, 118 bp, Homo sapiens
tgaaaggtttgtgacaataactgcttcacacatttaataagacccattaaagaacattatatgttttttaaaagggtcatcaatgaggtcatagtagtttattgttgcagtttattta

SEQ ID NO: 40284 - DNA, 141 bp, Homo sapiens
gtatagacagattccccatcttgccaggcatcccaggatcagagtgtgtgaagctcctgggtctctgtgtgcctgagtggctgctctgcttatactccacattgcttcacatatcagactcaaggcccagatggtgtgggc

SEQ ID NO: 40285 - DNA, 108 bp, Homo sapiens
tggtccttgttcttctgagtgtagcatcgttttaactgtacttaaactgtctgctattgtaacatttgtaataaaattctgctggacaaagtttgaattaagtatcca

SEQ ID NO: 40286 - DNA, 119 bp, Homo sapiens
gggagttaaatgttaacatatcatgttggcaatgtacattaaggtatatatatatatatatatatatatatatatatacacacacacacacacgcacatattttatgttgagagctgcc

SEQ ID NO: 40287 - DNA, 56 bp, Homo sapiens
gagatggggtttcactctgtcactcaggctggagtgcagtggtgtgatcacagctc

SEQ ID NO: 40288 - DNA, 103 bp, Homo sapiens
gagcctggaagatggcatagccttcttaggttatatatccagaaaaaggttgagctactttttttctttgtattgatagtagtaggatagtggtatctggctt

SEQ ID NO: 40289 - DNA, 110 bp, Homo sapiens
attgtgtatatatatatatagacaaatatattgtgtatatatataaacaccaatatattgtgtatatatatatacacaatatattgtgtgtgtatatatatatatataca

SEQ ID NO: 40290 - DNA, 114 bp, Homo sapiens
gagaaactgtatatgtatatgtgttttcaactgtatatatatatacacacatacacacacacacacatatatatacatatatacataacacatatacatatgcagttgtttctc

SEQ ID NO: 40291 - DNA, 94 bp, Homo sapiens
aaatataattttttctatgagtcttgtatgtgtgcatgtatttatgtatgtacatgtctgcatgtatgtatgtatctatcatatagctatattt

SEQ ID NO: 40292 - DNA, 79 bp, Homo sapiens
tctctttctctcacatgcacatacactgtagacagatacttagatatttgctatgtgtgtgtatatatatatatagaga

SEQ ID NO: 40293 - DNA, 95 bp, Homo sapiens
ggcctctgatattcttaaattttatatactatatataggagtgccttttctttcctctcctatttgtgattttatggaatttttaatgtggagcc

SEQ ID NO: 40294 - DNA, 90 bp, Homo sapiens
tggacatccagaggtacccaggctttctctctttttttgttgtttttttgttttttgtttatttgagaaggagtctggctctgtcgccca

SEQ ID NO: 40295 - DNA, 119 bp, Homo sapiens
ggtcaacattagtcaattagtagttaggttttgggggagtcaaaagttatatgtatattttcaactgtacaggacatttgtacccataggccccatgttattcaagggctaattctatc

SEQ ID NO: 40296 - DNA, 109 bp, Homo sapiens
tcctgaggactcaactacagtggttgttatttcccttctggatctagccactcagcagagttaccacactcggggttggtactggggaatgtctgcaaagagttctgtg

SEQ ID NO: 40297 - DNA, 96 bp, Homo sapiens
ttacttgctgatttgtttgagttgcttgtagattctgaatattggttctttgttggatgtatagattaacaagatattctcccactctgcaggtgg

SEQ ID NO: 40298 - DNA, 103 bp, Homo sapiens
gagaacaaagtgttgtttgttataaagacttgttcaaatgaaaggtctcctttctactgtttttgttgaaaagtccctttaatagaaaatccacttatccctc

SEQ ID NO: 40299 - DNA, 101 bp, Homo sapiens
gattgaatccaaatgtagaagtatgtatataaatttgaaagtcaaatatatatatttgactttacaaaattaaaatattttatttattaaaggatattatc

SEQ ID NO: 40300 - DNA, 87 bp, Homo sapiens
ggttctctgagagcatttggacatactgtgtacctgaagatacataaggggtacattgttgtatagtttccagttcttaagcaagct

SEQ ID NO: 40301 - DNA, 109 bp, Homo sapiens
atttctattttatgaaaagatgtatatatatatatatatatatatatttcaactatttgttgctcattcctatatatatgtgtgtgtgttttctgactattccagaagt

SEQ ID NO: 40302 - DNA, 113 bp, Homo sapiens
agaccttgagaagctctacccctgtggctctgcagggaacagccccacagctgctttcacagtctggtattgagcacctgtggcttttccaggtgtaagctgtcagtggatct

SEQ ID NO: 40303 - DNA, 67 bp, Homo sapiens
tctggtaaagtgtctgaagctgttctcagggcctttccttcacacagtctcccacactctccccagg

SEQ ID NO: 40304 - DNA, 179 bp, Homo sapiens
tatatatatatatactgatgagtatatatatatatactgagtatatatatatatactgatgagtatatatatatatactgatgagtatatatatatatactgatgagtatatatatatatatactgatgagtatatatatatagatgagtatatatatactgatgagtatatatatata

SEQ ID NO: 40305 - DNA, 122 bp, Homo sapiens
cattagaatgtttgaataaatattgaagaagccatctgggttgagacccccttttttttttattttttttttgaggtaaggtcttactcttttatccaggctggagagcagtggtgcaaaca

SEQ ID NO: 40306 - DNA, 111 bp, Homo sapiens
gctagagtgagttaagactttgggggactattgggaaggcatgattggttttgaaatgtaaaaaagacatgagatattagaggggccagggtcagaatgatacggtcttgc

SEQ ID NO: 40307 - DNA, 106 bp, Homo sapiens
tgtatacagtttaggtgctattcatatgtatatctgtatttatttacatatgtaagaatatgcatatgtataatatattcatatttatggtatttttattcatata

SEQ ID NO: 40308 - DNA, 109 bp, Homo sapiens
tcttgatcaatttgatttcggtaatgaatatatatatgtgtgtgtatatatatgatatacatatatatatatatatatatatatatatatagagacagagagagagaga

SEQ ID NO: 40309 - DNA, 97 bp, Homo sapiens
tatatatatattatatatatattatatgtaatataacatatattatatatgttttatgttatatatgttatatatgtatatgtatatgtaacatata

SEQ ID NO: 40310 - DNA, 110 bp, Homo sapiens
gcactggaggcaggtgtatggtgaggcactactaggctgagggtctctaagagaatctctagctccagcctagataccagactactgctgccgtataattgactctaggt

SEQ ID NO: 40311 - DNA, 80 bp, Homo sapiens
atgtgtgggacacatatgtacactacatatatatgtgtatgtatatatatgtgtgcatgtgtatatgtgtatatatgcat

SEQ ID NO: 40312 - DNA, 76 bp, Homo sapiens
taaggttcgtgccttcataagatgacatcagagagctaccttgctctctttcctctgtgtctcaggcagttcttta

SEQ ID NO: 40313 - DNA, 71 bp, Homo sapiens
tatatatatatatatatataaattgtatgtgtgtgtatatatatatgcacgtatatgtatgtgtgtgtata

SEQ ID NO: 40314 - DNA, 119 bp, Homo sapiens
tttttataggtgaatatatatatatgtgtatatatatgcatatacatatatatatgcatatatttatatgtgtgagtgtgtatatatatatatatctgggcgggtattttatttaaaaa

SEQ ID NO: 40315 - DNA, 84 bp, Homo sapiens
ttttcagatgtgtgagtggagagttgacagtcagagctgaggatcttagttaaagcaatgcctcaaagtgtacacgtcgggaga

SEQ ID NO: 40316 - DNA, 166 bp, Homo sapiens
atatgtgcatatatatatatatatatatatatatataggcctctctatatagtatagtgtatatatatagtatagtgtatatatatatagtatagtgtatatatatatagtatagtgtatatatactataatatgtgcatatatatatatatatatatatagtata

SEQ ID NO: 40317 - DNA, 102 bp, Homo sapiens
ctgcatttactgagacattctgttctgtttattacagtgttctaagcattatatatatatatgacagtgttctaagcattatatatatgctcagggaaaaag

SEQ ID NO: 40318 - DNA, 111 bp, Homo sapiens
atgaaagtcaaagaagtttaattaatggcagtcattttgtagaaaggtgtagagtttagatttatttttaaatacaaaattgctatttagaaaactgattttgttcttcat

SEQ ID NO: 40319 - DNA, 89 bp, Homo sapiens
aaaacaaacaaacaaacaaaaaaaccatcctttagttaagagtagtaaatctctctagagttttatttatttatttgtttgtttgtttt

SEQ ID NO: 40320 - DNA, 56 bp, Homo sapiens
tgtctctctgtttatatgtctgtctctttctcagatagatagatagacagatgata

SEQ ID NO: 40321 - DNA, 68 bp, Homo sapiens
ggggtagtttgtgtgccaggattctaagtttttattttgtgaccatggcatacatcaagacaagctcc

SEQ ID NO: 40322 - DNA, 129 bp, Homo sapiens
tctatctatagtatatatacttactgtagtatatatactacttagtgtagtatatatatatacttagaataatgatattctaataccaatattagcttagaatattaccttattctaagtgtgtgtgta

SEQ ID NO: 40323 - DNA, 115 bp, Homo sapiens
acttttatttttatgaagattatctctcatattgttcattaaatatatttatgtattttactcataacataatatgaatttaaggatagggagcatctattctgaaaataattgt

SEQ ID NO: 40324 - DNA, 117 bp, Homo sapiens
tagatatcatatatctatatgtagaaatcatatatctatctatatatagatatcatatatctatctatatatagatatcatatatctatatgtagaaatcatatatctatctatata

SEQ ID NO: 40325 - DNA, 71 bp, Homo sapiens
gttcaacatgttcagtgaacagtcttagaaacaaagtggcttgttctcactgactcacactgtggttgggc

SEQ ID NO: 40326 - DNA, 99 bp, Homo sapiens
tcataaaaattctgtaaaaaggcattttaaagatataatactgaatttcatgatcagaagggcatgtattgttatttgagcctgtcagatgattaatga

SEQ ID NO: 40327 - DNA, 70 bp, Homo sapiens
agcatggctggctgtgtgtagtgagtgtccagacaccacgttcactcactcacacaccacttgcctctct

SEQ ID NO: 40328 - DNA, 65 bp, Homo sapiens
ttgaggtggagtctcactctgtcacccaggctggagtggagtggtatgatcttggctcacttcaa

SEQ ID NO: 40329 - DNA, 111 bp, Homo sapiens
ctgggactacaggagcacaaaaccatgcctgattattattattattattattattattattattattattattttatctttgtggagccagtgtctctctctgtttcccag

SEQ ID NO: 40330 - DNA, 115 bp, Homo sapiens
tttttgtatgttgattttgtaagctgcaactttagagaatttgtttatcattttaaagaatttttggtagattctttaggtttttctaggtataagatcatgtcatctgcaaaga

SEQ ID NO: 40331 - DNA, 100 bp, Homo sapiens
actgattttactaaggtcgtaacattatgtatatattcttttttctcagcagttatttgggactgttttcagagtatttgttaagactttttatagcagt

SEQ ID NO: 40332 - DNA, 87 bp, Homo sapiens
acatatatctatgtatgtatatatatatatatatatatacccacatatctatgtatgtgtatatatatatacacatatagatgatgt

SEQ ID NO: 40333 - DNA, 122 bp, Homo sapiens
tatatgtgtgtgtatatgtacatacatatatttaaaaacagggaatgttttgtatatatgtatgtgtgtataaatgtgtacatatatataaatatagacatatatgtatattctgtgtcctt

SEQ ID NO: 40334 - DNA, 115 bp, Homo sapiens
gctacccaggtggaccttgtccaaattgcagatttgtgtgcaaaattaatatatttttaagccaacaagggtttagttgatttgtttcacagcagtagataattataccataagc

SEQ ID NO: 40335 - DNA, 101 bp, Homo sapiens
tcttcaagtgtcttcctgtgtctcaatagtctttgatgttctgaacagagagtagagtgtgtggatatttttctgaggatgagacatttaaggagaacctt

SEQ ID NO: 40336 - DNA, 109 bp, Homo sapiens
ctgtgtctgagagattctggtacgttgtgtcgttgttctcattggtttcaaataatttatttatgtttgccttaatttcgttatttacctagtagtcattcaggagcag

SEQ ID NO: 40337 - DNA, 61 bp, Homo sapiens
gtgtatatggatcttgtatatgcacatatatctgtgtatatatatatgtattcaaatacat

SEQ ID NO: 40338 - DNA, 108 bp, Homo sapiens
taataaaagtatccttaaaaatctgaagtaaaattttatatatatatatagatctatagatctatatatatatatatcagaaattgagtactcatattgaaggtttct

SEQ ID NO: 40339 - DNA, 111 bp, Homo sapiens
atttttgtatgttgattttgtgttctgcaaccttactgaatttgtttatcagttctgatgaaatcgttagggttttctaaatatatgattatatcacctgcagacaaaaat

SEQ ID NO: 40340 - DNA, 118 bp, Homo sapiens
ctttgtgcctctggcaattgtctccatagttccatttttaattattattatatttcttagagtgatcataatgtatgatctttgatgttactattgtagttgttttgggatgtcatag

SEQ ID NO: 40341 - DNA, 105 bp, Homo sapiens
agcatagtgcatctgttttacactaaacatataaactatataatatagttatgtatataattatattataatcagatgttggtgtcaaaatatatggtactgtct

SEQ ID NO: 40342 - DNA, 61 bp, Homo sapiens
tggggatgtgctgagtctcaccttaaagcagagagtctcagagactcactcaaatccctca

SEQ ID NO: 40343 - DNA, 90 bp, Homo sapiens
tatatgtatatatgtgtatatatatacgtatatgtgtgtatatatatatacacacacacatatatatatatatatatatatatatatata

SEQ ID NO: 40344 - DNA, 117 bp, Homo sapiens
gttatttaaatgtttgatggtatttactatatacagtatatagtatgtatatattatataaagatatatatccacatatatatgccagtaattttgtactatttaaatgttgatggc

SEQ ID NO: 40345 - DNA, 116 bp, Homo sapiens
tttatagcagagagaaggttgaatattttggaagatcatattatatggagcttctacttttgttttatatatctatcttgtaagtactttttaaaataatgctgtttgcttatgaa

SEQ ID NO: 40346 - DNA, 91 bp, Homo sapiens
ttagtagcactgtaatagtcacaaactaggggaaaaaactcaacagtttattagagtaaatttttcttttaaatgtggtatagtatactag

SEQ ID NO: 40347 - DNA, 70 bp, Homo sapiens
gcatgtgtatatatatatatatgtgtgtgtgtgtatgtatatctatgtgtgtatatatgtgtgtgtgtgt

SEQ ID NO: 40348 - DNA, 102 bp, Homo sapiens
ctctatattagatatatagatatgctagatatattagatatatattagatattttatatatatataatctagcgtatcgatatatattatctacatatttag

SEQ ID NO: 40349 - DNA, 115 bp, Homo sapiens
tatgtagaaatagtagatatctaatatataactatatatttatttgatatatattagatatgtatgcaataaatagatatgttagatatatatggatatctattacagctatgta

SEQ ID NO: 40350 - DNA, 108 bp, Homo sapiens
gtttgttattgattattgatcacctccaatatgctggcaactgtcactgtcactttcacatgtctcaattgcctggatgacagatgtgatcttataaacaataaaaat

SEQ ID NO: 40351 - DNA, 69 bp, Homo sapiens
taatattgtcaacttgattggactgaaggatacaaagtattgttcctgtgtgtgtctgtgacagtgttg

SEQ ID NO: 40352 - DNA, 89 bp, Homo sapiens
gaatcttcttatcctagacactaggcatgtgagtgattgtcttcctcactcaatcagtcacatatctagtgtctagaatgagaagactc

SEQ ID NO: 40353 - DNA, 79 bp, Homo sapiens
acatatatgtgtgtgtgtgtgtatatatatatgtgtgtgtgtgtatatatatatatgtatacacacacaaaatgtatgt

SEQ ID NO: 40354 - DNA, 58 bp, Homo sapiens
tgagccggagtctcgctctgtcactcaggctggagtgcagtgccatgatcttggctta

SEQ ID NO: 40355 - DNA, 116 bp, Homo sapiens
catagcaaaatgaaagattctttccaaatcttctagtattcaaactaaacaagaaagaattaggctgtgatacttggaagaaagaacggggaaagagtcaaactgaataggctatg

SEQ ID NO: 40356 - DNA, 84 bp, Homo sapiens
gcaggtgtggagtgagagaaaagtctatagctcttcgtctctgtcactcagtagctatacttgtctctccactgactcatctgt

SEQ ID NO: 40357 - DNA, 85 bp, Homo sapiens
cagttctgaaggctgaaagtctgagatcaaggtgacagtatcgttgggttctggtgagggttctcttttagtgtgcagaatgctg

SEQ ID NO: 40358 - DNA, 87 bp, Homo sapiens
gcagcactacaatgttatatatttatatgagcctacaatttgcttttcagcggttccttcatgaatatgtaaatgtgtataaactgc

SEQ ID NO: 40359 - DNA, 74 bp, Homo sapiens
ttcttcacagcaaaggaaagtctgtttcctttgttgtctaacaaagtgaagagacagtccactgaatgagagaa

SEQ ID NO: 40360 - DNA, 101 bp, Homo sapiens
taaatactgtgatatcatatatattgtatatatacatatgtgtatgtgactatacacattatatatatttatatttaaaagttgtttctcattcgtgtttg

SEQ ID NO: 40361 - DNA, 95 bp, Homo sapiens; identical to SEQ ID NO: 68

SEQ ID NO: 40362 - DNA, 93 bp, Homo sapiens; identical to SEQ ID NO: 69

SEQ ID NO: 40363 - DNA, 70 bp, Homo sapiens
gctgccttcaggaccctatatttgtcttttatctttgaaagtttttgattataatatgtcttgaggtagc

SEQ ID NO: 40364 - DNA, 95 bp, Homo sapiens; identical to SEQ ID NO: 68

SEQ ID NO: 40365 - DNA, 93 bp, Homo sapiens; identical to SEQ ID NO: 69

SEQ ID NO: 40366 - DNA, 108 bp, Homo sapiens
atatgtatgtgtgtgtgtatatatatatatgtgtgtgtgtatatatatatgtgtgtgtgcatatatatatatatatatatatatatatatatatatatatatatatca

SEQ ID NO: 40367 - DNA, 98 bp, Homo sapiens
tagatgttacttcacatgtcagtttgaatttaatttctcagtggctatgtttgtcattttatatgtaaagaaactggacagagagaagatgcgatcta

SEQ ID NO: 40368 - DNA, 111 bp, Homo sapiens
tgtgtgtgtatatatatgtgttatgtgtgtgtatatatataatatatatatataatgtgtgtgtgtatatatatatacacacacacgtaatgtaagtagattatatatata

SEQ ID NO: 40369 - DNA, 94 bp, Homo sapiens
ggagttattccccaaatatgtatgcatgtatttaagtatgtaaataacatatatgtgtgtgtatatgtgtcatttactagccttggggttttcc

SEQ ID NO: 40370 - DNA, 95 bp, Homo sapiens
atacataaatatacatatgtaactgtatataaatgtatatgatttttggccttaacttcatatatatgtacataaatgtatgtatatatgtgtgt

SEQ ID NO: 40371 - DNA, 95 bp, Homo sapiens; identical to SEQ ID NO: 580

SEQ ID NO: 40372 - DNA, 93 bp, Homo sapiens; identical to SEQ ID NO: 69

SEQ ID NO: 40373 - DNA, 95 bp, Homo sapiens; identical to SEQ ID NO: 580

SEQ ID NO: 40374 - DNA, 93 bp, Homo sapiens; identical to SEQ ID NO: 69

SEQ ID NO: 40375 - DNA, 94 bp, Homo sapiens
cctggtacttagtgagtgtcagtggatgctttatcatcatcatgatcatcatcctgatcatcatcatcatctaccacaccatcatgaagacagg

SEQ ID NO: 40376 - DNA, 85 bp, Homo sapiens
agaaagtcaaactgcatatccaagtggaagtaagggaggttcacatccagctttgttcttgggggaggcggttgtgatgagttct

SEQ ID NO: 40377 - DNA, 105 bp, Homo sapiens
tgtgagagagatacacacacacacacacacacgtatatatgtatatgtatatatgtgtgtatatgtgtatatatatacgtgtgtgtgtgtgtgtattccttcata

SEQ ID NO: 40378 - DNA, 117 bp, Homo sapiens
gtatatatattatgtatcataatatatagtatattatatatcatatatatttatcatatatattatatatacacatgcacacacacacacatatatacatgctacatagtgttatac

SEQ ID NO: 40379 - DNA, 111 bp, Homo sapiens
tggaaagaaaatctattattcaatgctcacatttgttttcatcctgtactattggttttagaatataatttttttgagataagggtgttgtggtcttgttaatctgctcca

SEQ ID NO: 40380 - DNA, 78 bp, Homo sapiens
ggagaatggaaccgtggattgggactccgtactcgctttgtatctaggatgtgtctcagtcacacacacttgacctcc

SEQ ID NO: 40381 - DNA, 127 bp, Homo sapiens
tttcaagtaattagagtagcttgtgtaaaggcacaatactgttaagaaaatgtgtatttatatcatattaaataatttcaatgtggccaatacataggaggcatagtagtgagggatggaagatact

SEQ ID NO: 40382 - DNA, 71 bp, Homo sapiens
agattaccatctttggaaagccatagtgaattttatttattattggttttcatataagaccaaggaagtct

SEQ ID NO: 40383 - DNA, 103 bp, Homo sapiens
gttaggattaaaaatgggaggagggacagtaagtttctgatgatacacactctctgacatatcatcgttcaattttccagtttttccaaaacaacattctagc

SEQ ID NO: 40384 - DNA, 150 bp, Homo sapiens
catttctataatttattgatataaacatattcactatatatgtgggtatgtgtatatatttatttaatatgtgaatatgtatatatcatatatacttatatatgatatatacttatttatatatatgtaatatatatatatttacccaca

SEQ ID NO: 40385 - DNA, 89 bp, Homo sapiens
tatacacatatacatatatacgtatatatatgtatacatacatatacatatatatgtatatgtgtatatgtgtatatatatatgtaatg

SEQ ID NO: 40386 - DNA, 118 bp, Homo sapiens
gtgggtatgtggtagaagtgagtgggtgcatgtgggtataaaattatatacatatttatgtgtatatataaaactttttgtaatagtggtacttttatctcaatatctaaatgcctat

SEQ ID NO: 40387 - DNA, 104 bp, Homo sapiens
gtcttaattgatttatactgcatgtgtgtgtgtgtgtatatatatatatatgcacacttgtatatatacgtgcacatatacaaattagcatcttgtcataagat

SEQ ID NO: 40388 - DNA, 99 bp, Homo sapiens
cacaagtcctttaacagatatatgtatggagaaggtttatcactggctgtgacttgtcttttcatttattttaaaattgtatcttttgaaaagcaggtg

SEQ ID NO: 40389 - DNA, 100 bp, Homo sapiens
ggtttgatttgcgcttccctatgattagtgattttgaacatcattttagatgcttattggccattgctgtgtcttctttagggacacgtctactcgagtc

SEQ ID NO: 40390 - DNA, 82 bp, Homo sapiens
gatggtgtccactcagactgatggtgagtctgcctctctcagtcccctgactcaaatgttagtctcatttggcaacaccctc

SEQ ID NO: 40391 - DNA, 100 bp, Homo sapiens
tggggggctgtaggcaggtgaaagatggttttattcagcagcttccttacactgtctgtctctgtcttagttgcctgctcttgttctgcagctccttcca

SEQ ID NO: 40392 - DNA, 89 bp, Homo sapiens
acagggtaggaatgaatggaagtatgttggagagggcaatgtgtctttttgtcttctctttcataatatatattgagcatctactttgt

SEQ ID NO: 40393 - DNA, 100 bp, Homo sapiens
gcatgaagattggttttatatcttgagataaaagctgaaaggcagaaaactatctgaattttttttttatgtttcactgagcggattcttttttcactgc

SEQ ID NO: 40394 - DNA, 109 bp, Homo sapiens
tgaaaggaggtagttttgcagcttggagcaaggtgcccactgaagttagactcccactctcactgggacatggaaacaaggtgctatcttccttgatgtttacctttca

SEQ ID NO: 40395 - DNA, 135 bp, Homo sapiens
tatatatacacatatatatacgtgtatatatatacatatatatgtgtatatatatacagatatatatatgtgtatatatacagatatatatacgtgtatatatacacacatatatatgtgtgtgtatatatatat

SEQ ID NO: 40396 - DNA, 69 bp, Homo sapiens
atgtgtgcatatatatatatatagatatatgctgtagatatatggcatatgtagtatatatgtatacat

SEQ ID NO: 40397 - DNA, 95 bp, Homo sapiens; identical to SEQ ID NO: 68

SEQ ID NO: 40398 - DNA, 93 bp, Homo sapiens; identical to SEQ ID NO: 69

SEQ ID NO: 40399 - DNA, 119 bp, Homo sapiens
agattgagttggaatataagagacacatgtttgtatgtatttttggtggtataaatatttatgtattttgacactatgtttttcatgctatatcaccttatatttactgtacttattct

SEQ ID NO: 40400 - DNA, 108 bp, Homo sapiens
gcagtgtattctctgctactaatactatgcaaggaatttttcatttaggagttttttttttttttggttgtttgtttgtttgtgttttcagacagagtctcgcactgt

SEQ ID NO: 40401 - DNA, 111 bp, Homo sapiens
gccttttaattggggcatttagtccatttacatttaaggttaatattgttatgtgtgaatttgatcttgtcattatgatgctaactggttatcttgcccattcgttgatgc

SEQ ID NO: 40402 - DNA, 98 bp, Homo sapiens
aaacaaaacattatactatatatgtaatatatataaaatatatattatatatattaaaaaatatatatatattatatatatatatgttgttgttgttt

SEQ ID NO: 40403 - DNA, 58 bp, Homo sapiens; identical to SEQ ID NO: 3380

SEQ ID NO: 40404 - DNA, 88 bp, Homo sapiens
gtatgtgtaaatgtatatgtatgtatagacatacatgtgtgtgtgtatatatatgtatgtatatacatacatgtacatttacacatac

SEQ ID NO: 40405 - DNA, 98 bp, Homo sapiens
tctcaaaggagaaactgattctcagtcatgataaagagattatttcccctgtatgtggtttttttttgtttttttgtttttttgttttttttttgaga

SEQ ID NO: 40406 - DNA, 105 bp, Homo sapiens
gtaatacttaatttttgtattttatttaattaatagaatttccatacaatgtaggttgtattgttctattttatagataaagactcaaaagtcataatctattat

SEQ ID NO: 40407 - DNA, 93 bp, Homo sapiens
tagagcttcattgtatatgtctgtctgtatataatatgtatatatgtgtgtacatgtatttattttaaaatagtttatatagaagaagatcta

SEQ ID NO: 40408 - DNA, 64 bp, Homo sapiens
gtaaatacatgcatgttaaaatataggtgtgtagtagcaggcatgtaaacatgtatgtgtttat

SEQ ID NO: 40409 - DNA, 71 bp, Homo sapiens
gacattttgcttgtttacgatttttttcaattttaaataagaaagtgggaacaattgtgtacaagtttgtt

SEQ ID NO: 40410 - DNA, 118 bp, Homo sapiens
gatataactagatttttttctatagtgatcaagtatgtatcaatgtttaaatattttaaaaatgtatactctgtacatggaattttcatcatttttactagaaagaactgtttatatc

SEQ ID NO: 40411 - DNA, 60 bp, Homo sapiens
gagaggctggggtagctatacatacatatatgtatgtatgtatgtttgtctctctctctc

SEQ ID NO: 40412 - DNA, 91 bp, Homo sapiens
aagattagttggccttcaatagagtcaggtgacagggaggtatgcttccttaatgcctcccttactctctccagaaaggcagtaggatttt

SEQ ID NO: 40413 - DNA, 68 bp, Homo sapiens
gtatgtgtatgtatatgtatgtatacatatatgtatgtgtatgtatatgtatgtatacatatatgtat

SEQ ID NO: 40414 - DNA, 68 bp, Homo sapiens
atgtatatgtatacatatatgtatatgtatatgtatacatatatgtatatgtatgtatacgtatgtgt

SEQ ID NO: 40415 - DNA, 81 bp, Homo sapiens
aggcttgcacaggtacctgtggggagtttgaatcccccaggggcctctcactcactcacactttcctgtgttagggagctt

SEQ ID NO: 40416 - DNA, 109 bp, Homo sapiens
ctattgatgctcatttggattgcaaccatatgcatattgtatttttatatgcaacattggataatataaaaatacttagcaaatgtgcatacaatttagcttttgatgg

SEQ ID NO: 40417 - DNA, 117 bp, Homo sapiens
gaggtgaattacaaggcatttaactagctaaaggctcatattctgttgctccttatgatatcactcttgctgttggtcagaattgaacctagcagtccgattttagtgactgagctc

SEQ ID NO: 40418 - DNA, 116 bp, Homo sapiens
actcattttcatatggtaaaagaatgtgaggaatgttttaggaaaatcacaacttttgatttttttttcttcctggaatactccaacagtatctgttaattgatcaagtgttgagt

SEQ ID NO: 40419 - DNA, 128 bp, Homo sapiens
acataatatatctgtatatataatgtgtgtatatacacatataatgtataaatacgttatgtatatctatgtatttatgtacttgtataatgtatatatattatatgcttgtgtttgtgtatgtgtgt

SEQ ID NO: 40420 - DNA, 112 bp, Homo sapiens
ggagggcatgaaagaagcaaggatgagttctgtatttgttgctttttctcagagaggacagagagcagcaaggattgaccaggggctggtgacttagcaattaagtatcccc

SEQ ID NO: 40421 - DNA, 86 bp, Homo sapiens
tccactgtggcctgagagagtacttgatgtaattttaatttttttttttttttgagatggagtctcactctgtcacccaggctgga

SEQ ID NO: 40422 - DNA, 92 bp, Homo sapiens
gtatatgtacatatacatgtacacatatgtgtatatatgtgtatacatacatatgtgtatatatgtgtataaatatatatgtatacacatat

SEQ ID NO: 40423 - DNA, 58 bp, Homo sapiens
tgagatagagtctcactctgtcactcaggccggagtgcagtggtgtgatcttggctca

SEQ ID NO: 40424 - DNA, 114 bp, Homo sapiens
atctatttcttcatgttttgatagcctgtattcccaatgagtctggaaagcataccatttttaatggttttattttttaatcttataaagcagcaaattaacatgaaaaatgat

SEQ ID NO: 40425 - DNA, 65 bp, Homo sapiens
cctgccagtctagtgactttcttgctgtctggtttcctcgtgcaaggagttcaaagtgactgagg

SEQ ID NO: 40426 - DNA, 58 bp, Homo sapiens; identical to SEQ ID NO: 4224

SEQ ID NO: 40427 - DNA, 95 bp, Homo sapiens
tttgtaatacgtgcacaatgatgaaattgcctaaggatgaatttctcagattgtatttcatttttaaggaacgcatgactgtatatgttcacaag

SEQ ID NO: 40428 - DNA, 70 bp, Homo sapiens
tatatatatatatatgcatacacacatatatgtgtacacatacatgtatgtatttatatgtgtttatata

SEQ ID NO: 40429 - DNA, 68 bp, Homo sapiens
gatacatgtttagagaagacagagattctgctgtttggccttctctgctccacctctccccatgtctc

SEQ ID NO: 40430 - DNA, 58 bp, Homo sapiens
tgagatggagtctcactctgtcacccaggctggagtgcagtggtgtgatcttagctca

SEQ ID NO: 40431 - DNA, 116 bp, Homo sapiens
ttatgcctgtgccatgctattttggttaatattgcgttgtagtatagctctttttatttatttatttttgaaataggggcttgctgtgtcaccaaggctagagtgcagtgatgtga

SEQ ID NO: 40432 - DNA, 118 bp, Homo sapiens
tctgaaacttttgtactaaggatacctatatatgtataaatatctatgtgtatattgcccatattattatagatatttatatgtttctatttttatctgtgtattttactctaagagt

SEQ ID NO: 40433 - DNA, 91 bp, Homo sapiens
ctatagactctgatgacactagtgaattgagctctttggtatctatatcaacaatgtaccaaagacagtgtggacacgagtgtcactatag

SEQ ID NO: 40434 - DNA, 99 bp, Homo sapiens
ggagtttggattctgattggaactggattgaacttcaatggcctattgcacggctaagaaagtaaagatctaagataaatattaggaaatctaggtttc

SEQ ID NO: 40435 - DNA, 118 bp, Homo sapiens
tatatatatatacatatatatatgtaagtcctatatatatgtgtgtgtgtgtatatatatatatatatatacacatacacacacacaggtatatatatatgtatgcaatatataagta

SEQ ID NO: 40436 - DNA, 115 bp, Homo sapiens
tatatcgtctatcccagctgtacactctgtacctgtgtgtgtgtgtatatatacatatatatgtatacatatatatacacatatatacatacaagtatacatatatacacatatg

SEQ ID NO: 40437 - DNA, 162 bp, Homo sapiens
cacacacatatacacgtgtgtgtatatatatgtgtatacatgtatacacatatacacatacatacacatatatgtacatatgtgtatatatgtatacttgtatgtatatatgtgtatatatatgtatacatatatatgtatatatacacacacacacaggta

SEQ ID NO: 40438 - DNA, 112 bp, Homo sapiens
ttgtctgttgtagggtagtgctctgattttgaatgtagcataataatcaatatatatataaattatgactttgaatttacgattatgagcttgctgaattaacatcatgcaa

SEQ ID NO: 40439 - DNA, 78 bp, Homo sapiens
aagtaatattctcttctgtctctatagaaacagtctttctgtctctaacacatcatcagaggagaatacttgttactt

SEQ ID NO: 40440 - DNA, 103 bp, Homo sapiens
gttgtatatgcatatgaggaagatagagaaggttttcctataatagttatctatttatattatagacaaattcatgtttatctccaatatcgctgacatcaac

SEQ ID NO: 40441 - DNA, 103 bp, Homo sapiens
cagggttcatgatgttgtgctcctattcctcaatgattgaaaattttttcatatgttttgtccagttttctaggttaaggtgaaaggtttcatctattccctg

SEQ ID NO: 40442 - DNA, 82 bp, Homo sapiens
tgtagccttgtaatgtagtttgaagtaaagtagcatgatgcctccagctttgttctttttgcttaggattttcttggctata

SEQ ID NO: 40443 - DNA, 111 bp, Homo sapiens
gttaggcgtggtggcaggcatgtgtaatcccagctacttgggaggctgaggtaggaggatcactggaacctgggaggtggaagttgcattgagctgagactgcgccattgc

SEQ ID NO: 40444 - DNA, 123 bp, Homo sapiens
gatgcccagaaaccattgtctgcctttctgcagggtgctagtaaagaataggcagtacctgagagaagatagaaaggacgtatctgcatttagaaaaaggggatttctttcttttttctctta

SEQ ID NO: 40445 - DNA, 101 bp, Homo sapiens
acatatcctgggtactgcatttcctgtagctagaagtttgattatatctatttctagattctgtttttagctaggaattatgaggtgacactgaggtgtgt

SEQ ID NO: 40446 - DNA, 58 bp, Homo sapiens
tgagacagagtctcactctgtcacccaggttggagtgcaatagcgtgatctcggctca

SEQ ID NO: 40447 - DNA, 89 bp, Homo sapiens
ttatgtttcagtcaccaaatgtgtatttgtgccatactgcacaccagaagctgtataatcacagaatattgacaggtgactttttatag

SEQ ID NO: 40448 - DNA, 64 bp, Homo sapiens
tctctgtctctctctcactatatctatgtgtgtgtatatatatatagagagagagagacagaga

SEQ ID NO: 40449 - DNA, 64 bp, Homo sapiens
tctctgtctctctctctctatatatatatacacacacatagatatagtgagagagagacagaga

SEQ ID NO: 40450 - DNA, 115 bp, Homo sapiens
gtgtgtctttttaaaaatctttgttcttccttagccagtggatacagagaatacgctttttaattttttcttaatagttcacatttaaggtatacaacatgatgttttgatgtac

SEQ ID NO: 40451 - DNA, 102 bp, Homo sapiens
tttagaaagtaaaggaataacaaaatggctacttcatagacagagcagactgagggctgctggttgcctatttttatgtttatttcttgattacatgctaaa

SEQ ID NO: 40452 - DNA, 92 bp, Homo sapiens
ggaacattatgtactaaaacatgtattttcttgaatcatgtatatatttttataattcagatttgaggtgatactagtggatatgatattgc

SEQ ID NO: 40453 - DNA, 68 bp, Homo sapiens
acctaggtgctgtctggggacagcatgaagcctttgctgttattctgtctcctattacatattttggt

SEQ ID NO: 40454 - DNA, 82 bp, Homo sapiens
gactttgttttttttgagaaggagtctcactctgtcacccagtctggagtgcaatggtgtgatctccgcttactgcaacatc

SEQ ID NO: 40455 - DNA, 93 bp, Homo sapiens
gccctcttcctaggtttagacagcagacttctttctgtatcctcacatagtgaagaaagagagctttcgtgtatctgtctgtattttaagggc

SEQ ID NO: 40456 - DNA, 57 bp, Homo sapiens
tctctctatatatatatatgtgtgtatatatgcatatactgtctatatatagagaga

SEQ ID NO: 40457 - DNA, 86 bp, Homo sapiens
tttatagatgcaaacaggtacatgtgtgtatatatatatatgcatatagacatatatatgcatatatagacatgtatatctataaa

SEQ ID NO: 40458 - DNA, 90 bp, Homo sapiens
tatatatatgtgtgtatatgaatacatgtatgtttatagatatacatgtctatatatgcatatatatgtctatatgcatatatatatata

SEQ ID NO: 40459 - DNA, 116 bp, Homo sapiens
tgtttatatatatatatacacagacactgtgtgtatatatatatatatatatacacagacactgtgtgtgtatatatatatatatataaactatgtgtgtgtatgtagtgtattca

SEQ ID NO: 40460 - DNA, 105 bp, Homo sapiens
agatttgagtattggtgcttatacaagacttcaatttcatgaactatcattataaaatattttttgtaaataggctggagtctatatatctacatatttacatct

SEQ ID NO: 40461 - DNA, 98 bp, Homo sapiens
cccaacttctaagaatttgaatgaatatcagaatagctgtggaatgaccacaatatttggagtaaatattttatttaattttgtgtaggcattaaggg

SEQ ID NO: 40462 - DNA, 115 bp, Homo sapiens
agaaacccctacatttatatttctctgaggtgctatgcacaaatacaaattgggggaaattaatattttttctatatttgtgttagctactcatcatataaatatcttcatttct

SEQ ID NO: 40463 - DNA, 115 bp, Homo sapiens
taattgtacagtggaaaagatgagtcagtagcaaataattactatatgattttatcatttcttgaataagagaaaatatggtagttatgggaccactttagctttccatcagttg

SEQ ID NO: 40464 - DNA, 84 bp, Homo sapiens
gcccttccgctttccacctgtttatttgggtaagaagttatttctatttatttaaagaaaagcactgtggctgggcgcagtggc

SEQ ID NO: 40465 - DNA, 88 bp, Homo sapiens
aggtagatatggatatatctatctatatctatctgtctatatagactccatatatggagagatagatatatgatatatctatctatct

SEQ ID NO: 40466 - DNA, 86 bp, Homo sapiens
tatatgtatgtgtatatatagatgcagttatcatatatttatatgtatgtctaatatgcatatgcatatatttatacatgcatgta

SEQ ID NO: 40467 - DNA, 73 bp, Homo sapiens
agtctcaaatcatatatatatatataaacataaaaatatatgtgtgtgcatatatatatgtatatatgagact

SEQ ID NO: 40468 - DNA, 77 bp, Homo sapiens
gtgtttatgtaagtctttctctctctgtgccactggggtggggtggagaaaaagagaaatgacccttgttgaaatac

SEQ ID NO: 40469 - DNA, 116 bp, Homo sapiens
aggcacagttttacattgtaaattttctcctgagaagttgaaatgtttaatgcatttaaactattacaaatgctaatattacaaaagaggttgtttagatattgttgctgtttact

SEQ ID NO: 40470 - DNA, 101 bp, Homo sapiens
tatttttcagagcccattaattgttccccgagactgaaagttgtctttttatttacataaaagacatatctcgttctcattggaaatactctgcattaata

SEQ ID NO: 40471 - DNA, 117 bp, Homo sapiens
ttcattgcacagcaaattactgaaacaaaagagaagaaaatgaggactagtccttttttattattcatatgacttggtgattattttagttcttttgaaatagtggctgcaaatgaa

SEQ ID NO: 40472 - DNA, 65 bp, Homo sapiens
tgaaagcataaaagtttgagataaagacaagtgtttgtttatttttgtctttaacttggctttca

SEQ ID NO: 40473 - DNA, 73 bp, Homo sapiens
acttgggaggctgaggtaggaggttgcagtgagccgagattgcaccactgcactccagcttaggcgacagagt

SEQ ID NO: 40474 - DNA, 228 bp, Homo sapiens
tatatatatatgtatataaatatatatatgtgtatatatacgtatatacgtatatatacacatatatacgtatatacgtatatatgtgtatatatacgtatatacgtatatatatacacatatatacgtatatacgtatatatgtgtatatatatacgtatatacgtatatatgtgtatatatgtgtatatatgtatatatgtgtatatatgtatatatatatattca

SEQ ID NO: 40475 - DNA, 68 bp, Homo sapiens
gggagagaggaacattcttttcattaagagaatttttttttttttttgagatgaagtctctctctgtc

SEQ ID NO: 40476 - DNA, 118 bp, Homo sapiens
gaactgatcattaccatttaaaatcctgagggctgtgggactggggaggagagaaagaatttttcttttgatttaacagggctctgaagtactggttttaagggggaggtgttttgtt

SEQ ID NO: 40477 - DNA, 67 bp, Homo sapiens
gactacatgatttatcattatggagagagctgtgctaaaatctctctctgtgtggattagtctagtc

SEQ ID NO: 40478 - DNA, 119 bp, Homo sapiens
atgttatgccacagattttatatatatatatatatatatatatatatatatatatgacacttgaagatagtatatatgtgtgatatatatgtgtataatatagatatgcagtatgatat

SEQ ID NO: 40479 - DNA, 78 bp, Homo sapiens
cgttcaggaaaatggatggaagtagagtttgaggactgaagcccagctccaggtgctgactgtcattgtcactgaatg

SEQ ID NO: 40480 - DNA, 89 bp, Homo sapiens
ctagacccatctgtgaactgtgtctctcaggaatgggtggatgcccttccttaaatggcgaaggctcagggtccaggttcagggtctag

SEQ ID NO: 40481 - DNA, 76 bp, Homo sapiens
tccagacagtgcttggctgtgttgtgtttttcttggttactctgataccaaaatgcagtgagcagaagtgtttgga

SEQ ID NO: 40482 - DNA, 109 bp, Homo sapiens
gctcagtgatagtgatttaagacttctgacctctagaactgtgagaaagtaagtttctgttcttttttttttttttttctgagacggagtctttctctgtcacctaggc

SEQ ID NO: 40483 - DNA, 120 bp, Homo sapiens
acatatatacatatatatatgtactcacatatgtacatgtatatgaatatgtgtatacatatatatgtatatatgtatgtggggtggttggggtgtgtgtgtgtgtgtgtgtgcatgtgt

SEQ ID NO: 40484 - DNA, 85 bp, Homo sapiens
gagggggttggctatttttaatctatcagaagaatggcatagacaacaacagttctgagagagcacaggatggagcagcaaactc

SEQ ID NO: 40485 - DNA, 88 bp, Homo sapiens
tgttctgaaattctcacagaagtcagtgagcagatgaacctcttcaccaaatctgtttgacaactactttctgtgatgtcatgaggca

SEQ ID NO: 40486 - DNA, 84 bp, Homo sapiens
gggttgggtgtgagagatgagaaattatttaattggtgcaatgaattttttttttttagacggtctcactctgtcacccaggct

SEQ ID NO: 40487 - DNA, 95 bp, Homo sapiens; identical to SEQ ID NO: 68

SEQ ID NO: 40488 - DNA, 93 bp, Homo sapiens; identical to SEQ ID NO: 69

SEQ ID NO: 40489 - DNA, 102 bp, Homo sapiens
tgcagacatgttaaaagtatatatatgtatgtgtgtacatatatatgtatgtatgcatgtatgtgtgtacatatatatgtatgtatgcatgtatatgtgtgt

SEQ ID NO: 40490 - DNA, 79 bp, Homo sapiens
agcaggattgatgagagccaagttgagatggtggctgacttcactgtctctcatctagacttctgctaatgtcaatgcc

SEQ ID NO: 40491 - DNA, 113 bp, Homo sapiens
ccacaaagttttttttttaagcaatgtaaataaaatgcaaattgaagctgtatttattttaatagttttaaagtaagaattcgcatttgtaacatagctttttaaaactgagg

SEQ ID NO: 40492 - DNA, 74 bp, Homo sapiens
gaacaccctaagatttctggaaattgtttctaattttaattagaaatgagtttccagattggacattaggtttc

SEQ ID NO: 40493 - DNA, 58 bp, Homo sapiens; identical to SEQ ID NO: 2276

SEQ ID NO: 40494 - DNA, 76 bp, Homo sapiens
gacagtgaggatcctctgaagaatgtaaaactaggaaaataatttttttttttttgagacggagtctcgctctgtc

SEQ ID NO: 40495 - DNA, 72 bp, Homo sapiens
ctcttttagttattttatgcatgtatgtatgtatgtgtgtacgtatatatctgtatatttaatagagacggg

SEQ ID NO: 40496 - DNA, 111 bp, Homo sapiens
cactgcctggagcagagtaggatcagaaaggcagatcagagagtgctgacaggctttaagtattcagctgtatcttgtggttttcatctgaccctatttcccattaatgtg

SEQ ID NO: 40497 - DNA, 86 bp, Homo sapiens
ggagtgggagcagtgctgtgacgcagaggaggagaaataagagcttgacttttttttttttttttttgacacttaggtcttcttct

SEQ ID NO: 40498 - DNA, 79 bp, Homo sapiens
ggtgctgtacttccgtattaagagctgctatatgtttttttaaaaattttaatggctctagagctgacagtactaagcc

SEQ ID NO: 40499 - DNA, 175 bp, Homo sapiens
tataaaaatatatatgtatatatgtgtatatatatgtatatatatgtgtatatatatgtgtatatatatatgtatatatatgtgtatatatatgtgtatatatatgtgtatatatatgtgtatatatatgtatatatatgtgtatatatatgtgtatatatatgtgtatatatat

SEQ ID NO: 40500 - DNA, 124 bp, Homo sapiens
tatattctatatatattctgtatatatattctatatatattctgtatatatattctatatatattctgtatatatattctgtatatattctgtatatatattctgtatatattctgtatatata

SEQ ID NO: 40501 - DNA, 113 bp, Homo sapiens
tgtgtgtgtatacatgtgtatgtgtgtgtatacatgtgtatatgtgtgtatacatgtgtgtgtatatatgtgtatatatatgtgtgtgtatatatatatatgtaggctatgta

SEQ ID NO: 40502 - DNA, 78 bp, Homo sapiens
aagaatattatggctcaagaacagagggagttaaagtaaataatattttttacttttacccagagttgtcatattctt

SEQ ID NO: 40503 - DNA, 95 bp, Homo sapiens
gccgatgctggagagttgtctccttctgatggatcaatgtcaacagtttgttagttgcactgttagaagatacagaggacaggttttggccaggc

SEQ ID NO: 40504 - DNA, 92 bp, Homo sapiens
gagcatgcagcatcctctgattcagcagagaagtgccaggtcacccacctactacagagggacacagtcgctgactcagaaaactcatgctc

SEQ ID NO: 40505 - DNA, 109 bp, Homo sapiens
tatgggctgatgaatgaaatgtaaggtttgcatgggcatttggaatcaaaagatctaaaaggatgttgctaacaccagatgtactagcaggcacagttctaaccatagg

SEQ ID NO: 40506 - DNA, 58 bp, Homo sapiens
tgagccagagtctcactctgttacccaggttggagtgtggtggcacaatcatggctca

SEQ ID NO: 40507 - DNA, 117 bp, Homo sapiens
aatgagtcaatgatatatatatatatctcacattttcttgtatatatatatatatatatatatatatatacacacacacacacgaaatatatatgtatatgtatgtatttatttctt

SEQ ID NO: 40508 - DNA, 115 bp, Homo sapiens
ggaatcaacatgacgactaatcagtgtttttgctgccaagatgagtgttttttttttcaaaaatcctcattaatattatattaagcaggatttcagtgatcttatgatagcttcc

SEQ ID NO: 40509 - DNA, 94 bp, Homo sapiens
ttgttggtaaatcatcttggtgaacagctaacagaatctggctagagatagcagaggaattttgtgtgggcatgtgcattagtttactttccaa

SEQ ID NO: 40510 - DNA, 76 bp, Homo sapiens
gagatatgccacagtctgtctctgaatttcttgcccagctaggttgaggtgcagtgtctcccttctggtacatttc

SEQ ID NO: 40511 - DNA, 78 bp, Homo sapiens
gctgggggatagcagagaacaagattttttttttatttttttttattttttgagacagtctcgctctgtcacccaggc

SEQ ID NO: 40512 - DNA, 100 bp, Homo sapiens
tggttatcaggtagcaaaatagaggaacaactgactgagcacaggggaaaccactgtggggattcagaattttctgtacttattgctacaatgaactcta

SEQ ID NO: 40513 - DNA, 152 bp, Homo sapiens
atgtgtgtgtgtatatatatgtgtgtgtgtgtatatatatatatatatatatatatatatatatgtacacatacatatatgtgtgtgtatatatatatatacacacgtatgtgtgtgtgtgtgtgtgtgtgtgtttgttgaatgaagtgtat

SEQ ID NO: 40514 - DNA, 85 bp, Homo sapiens
gaccagataattaattttttattatacaacacataggcagactaatatgtatattatatgctgtgtattgataaattagatggtc

SEQ ID NO: 40515 - DNA, 103 bp, Homo sapiens
ggttttgatttccatttctctaatgatcagtgatattgaactttttttcaatatgtttgctggtgacattatctattcttttgagaagtgtctgttcatgtcc

SEQ ID NO: 40516 - DNA, 113 bp, Homo sapiens
gactatttttataaattgacatatatatgtcatatgtatgtgtgtatatatatatatatacacacacacgtatatatgtatgtatgtatgtatatattcctgttggagtggtt

SEQ ID NO: 40517 - DNA, 71 bp, Homo sapiens
ttgtggtgagctgagattgtgccactggactccagcctgggggtgacagtgagactctgtctcaaaaacaa

SEQ ID NO: 40518 - DNA, 81 bp, Homo sapiens
aaagagatttgaaggtgcccctctctctgacccagtgctaattggaaaagcattgcggaggtgtggggcaaggattttttt

SEQ ID NO: 40519 - DNA, 69 bp, Homo sapiens
acatctctctctctctctctgtatacatagatatgtgtgtgtgtatatggtgtgtgtgtgtgtagatgt

SEQ ID NO: 40520 - DNA, 141 bp, Homo sapiens
atacatgccaatatgtatgtgcatatgaattagatacagagtagtatacagtgtgtatatatatatatacatgtgtgtgtgtgtgtgtgtgtgtaagaatcagatacagagtaatatacatatatgcagattgtatgtatg

SEQ ID NO: 40521 - DNA, 112 bp, Homo sapiens
tgtttagtttcttgtagataatcttttatatatatatatatatatatatatatatatatatatatatatttgtatttcttaattcttaaaaagatcttggaaatagtagaca

SEQ ID NO: 40522 - DNA, 58 bp, Homo sapiens
tgtgtgtgtgtgtgtgtgtctcctatcgcccaggctggagtgcaatggcacaatcacg

SEQ ID NO: 40523 - DNA, 62 bp, Homo sapiens
tttgagttgaggtctcactctgtcacccaggcgggactgcagtggcatcatcatagctcaaa

SEQ ID NO: 40524 - DNA, 56 bp, Homo sapiens
tgagatggagtctcactctgtcacccaggctggagtgcaggggagatcttggctca

SEQ ID NO: 40525 - DNA, 102 bp, Homo sapiens
gagaggtggagtttcattgttgctgttgttactagtgtttttgttgaataacccattctttaggaagcacataatgaaattaactctgactccctccttctt

SEQ ID NO: 40526 - DNA, 94 bp, Homo sapiens
aggatgtcccaggaagttctctatttgtcaatgtcagtctgtaagagcaactgcttgaataagtactgtgagagtcctccaagactcaaagcct

SEQ ID NO: 40527 - DNA, 75 bp, Homo sapiens
gtgactttctttatctctgattctgtctctctcaaatttaggagtacagaggagcagaatgatgacaaaagtgac

SEQ ID NO: 40528 - DNA, 104 bp, Homo sapiens
atatatgtgtgtgtatatccatgtgtatatatatatgtgtatatatgtatacatgtgcatatgtgtgtatatgtatgtatacatatgtgtagacatgtgtatat

SEQ ID NO: 40529 - DNA, 58 bp, Homo sapiens; identical to SEQ ID NO: 637

SEQ ID NO: 40530 - DNA, 95 bp, Homo sapiens; identical to SEQ ID NO: 68

SEQ ID NO: 40531 - DNA, 93 bp, Homo sapiens; identical to SEQ ID NO: 69

SEQ ID NO: 40532 - DNA, 91 bp, Homo sapiens
atggatgtagtgtgtgtgcacagatatgcatgtgtgtatatatgtatatttatatgtatacatgcatgtgtgtgtatatatgtatatgcgt

SEQ ID NO: 40533 - DNA, 110 bp, Homo sapiens
gttgggcatggtggcggatgcctgtgatcccagttactccgaggctgaggtagaagaatcacttggacccgggaggcggaggttgcagtgagccaagattatgccactgc

SEQ ID NO: 40534 - DNA, 78 bp, Homo sapiens
ctgtgtctgactgatacactctctatgtttaagtgttaagtattaagccagcttttatagatgtgtgccttagcacag

SEQ ID NO: 40535 - DNA, 175 bp, Homo sapiens
atgtgtgtgtgtatttagtctgtgtatgtgtgtgtatacatatatatttggtgtgtgtatatatacatatatttagttttatatatatatatatttagtgcatgtatatatatatacacacagcctatatatatacacacacagcctatatatatatatatatatatacacacac

SEQ ID NO: 40536 - DNA, 106 bp, Homo sapiens
gccaatttactccagcctgggcaacatagtgagatcccatcattaaatttttatttatttatttaaacagagtcttactctgtcacccaagctggagtgtggtggt

SEQ ID NO: 40537 - DNA, 107 bp, Homo sapiens
tttttgctggccacacaaaatgattggggtgtctgagcttgcagctctttgaagtaaagtgtagtgatttagaacaacttttagattgtcatctatggttagaagga

SEQ ID NO: 40538 - DNA, 109 bp, Homo sapiens
gctaataggcatcataatttcagcttgcttctgcttttcattctactgtgtatacagtagatgtggtctaatgcacaagccatggctatgcattataggcccatatagt

SEQ ID NO: 40539 - DNA, 94 bp, Homo sapiens
gagggtaagaggtaaaaatatgttttattatttagtagacaaaactatttagatctatgtatatttgtaaaacatactttttgttcttaaactc

SEQ ID NO: 40540 - DNA, 105 bp, Homo sapiens
tatgtatatacttatatgtgtatatatacatatatatacacattaggtatatatgtatatatacatatatacacattaggtatatatgtatatatacatatatac

SEQ ID NO: 40541 - DNA, 95 bp, Homo sapiens; identical to SEQ ID NO: 580

SEQ ID NO: 40542 - DNA, 93 bp, Homo sapiens; identical to SEQ ID NO: 69

SEQ ID NO: 40543 - DNA, 95 bp, Homo sapiens; identical to SEQ ID NO: 68

SEQ ID NO: 40544 - DNA, 93 bp, Homo sapiens; identical to SEQ ID NO: 69

SEQ ID NO: 40545 - DNA, 117 bp, Homo sapiens
agcttgtacatacattgcataccccagctttttctttattttattttatttattttttttgaattgtattattattatattttaagttttagggtacatgtgcacgatgtgcaggtt

SEQ ID NO: 40546 - DNA, 103 bp, Homo sapiens
ggctttgtattccttagaggcttaaagtgtttttatttttctttgtatttcatttttggagcagagttgttgctcagtaagtattttaaagaatgagtgggct

SEQ ID NO: 40547 - DNA, 71 bp, Homo sapiens
ttgtttttgagacagggtctcactctgtcacccaggctggaggccagtagtgggatcttggttcaccgcaa

SEQ ID NO: 40548 - DNA, 70 bp, Homo sapiens
gagatggagtctcactctgtcacccaggctggagtgcagtggcgcagtctggacagtgaaaccccgtctc

SEQ ID NO: 40549 - DNA, 62 bp, Homo sapiens
gtgtgtgtgtgtgtgtgtgtacaggccactgaccagtactgtttatatatatatatgcacac

SEQ ID NO: 40550 - DNA, 85 bp, Homo sapiens
gaccagtactgtttttatatatgtgtgtgtgtgtatataaagtatacgtatatgtgtgcatatatatatataaacagtactggtc

SEQ ID NO: 40551 - DNA, 86 bp, Homo sapiens
ggtggctccacatctgtaattacagcactttgggaggcctaggcaggcagatcacttgaagtcagtagttagagaccagcctggcc

SEQ ID NO: 40552 - DNA, 97 bp, Homo sapiens
tctggcataaccttgtgcttagagtggaagttgggttgtaggatgttttctttttcaatgctcttgttccactctcagctttaggcttttgctcaga

SEQ ID NO: 40553 - DNA, 94 bp, Homo sapiens
tcatttagttcaccttgtatctctcactgtgtcaaatggcatatggcacagtagagaagcaacaaatatcaaatggatgaacgaataaaaatga

SEQ ID NO: 40554 - DNA, 85 bp, Homo sapiens
tgtgtgtgtgtgtatgtgcgtgtgtgtatatatgtatatacatatacacacacacacatatatacacatacgtatatacacacac

SEQ ID NO: 40555 - DNA, 62 bp, Homo sapiens
tgtgtatatatgtgtgtgtgtgtatatgtatatacatatatacacacacgcacatacacaca

SEQ ID NO: 40556 - DNA, 95 bp, Homo sapiens; identical to SEQ ID NO: 68

SEQ ID NO: 40557 - DNA, 93 bp, Homo sapiens; identical to SEQ ID NO: 69

SEQ ID NO: 40558 - DNA, 75 bp, Homo sapiens
tgtgtgtctgtgtgtgcatgtgcatgtttggattctcttcctcacaagtcacgtgttgcttaggaggaaaacata

SEQ ID NO: 40559 - DNA, 81 bp, Homo sapiens
cacattgcatatgtatatagacacatctatacttacatatgtaaatttgtatgtatgtgtaaatatgtgcttgcatatgtg

SEQ ID NO: 40560 - DNA, 162 bp, Homo sapiens
gtgtgtgtgtatatatatatatgtgtgtgtgtatatatatatacgtatatatatacatatgtgtatacatatgtgtgtatatatgtatatatgtatatatatgtgtgtgtatatatgtatatatacgtatatatatatatgtatatacgtatatatatatat

SEQ ID NO: 40561 - DNA, 75 bp, Homo sapiens
tcgctctgggtctgaatatgtgtgtgtatatatatacatatatacatatatatacatatatagcgagcattccca

SEQ ID NO: 40562 - DNA, 118 bp, Homo sapiens
atggcttaaacaacaggtatttattgccgcatagttgtggaagatagaagtctgagatcaaggtgttagcagggtctattccttcttcaggctgtgaggcagaatctgttccatgcca

SEQ ID NO: 40563 - DNA, 90 bp, Homo sapiens
gtatgttgtggacattgctatgggacaagtagataatatctttttttttaaattataccttaagttttagggtacatgtgcacaacatgc

SEQ ID NO: 40564 - DNA, 113 bp, Homo sapiens
taggtctgggaatccaggggtaaaaacaattagaagtggctgctttcttcatagaactaatatgtcattttctttatttgttatcaaatccatggagatgcctgattgattta

SEQ ID NO: 40565 - DNA, 79 bp, Homo sapiens
taaaatattgagttgtaagagtttttaaatatatatatatatatatatgatagaagctctttatcagatatgtgttttg

SEQ ID NO: 40566 - DNA, 117 bp, Homo sapiens
ctcagtctctgagtagctgggattacacgtgtgtaccaccacgctcggctaattttttgtatttttagtagagacagggttttgccatgttgcctaggctggtctcaaactcctgag

SEQ ID NO: 40567 - DNA, 59 bp, Homo sapiens
taggggttcggggtgggagagtttatcagaggctgggactctccttctgtgtctctctg

SEQ ID NO: 40568 - DNA, 116 bp, Homo sapiens
atgtctagtatgtatgtttcttatgttttaaaatgcctctgctcattttgttcttgtgctaatgcagagcaacaacagagggtgaacatcaggtgtgctcttttacatacggtagg

SEQ ID NO: 40569 - DNA, 115 bp, Homo sapiens
gtgaaaaaaatcttacccttccttaaggcagtacatcactgcagagacgctctatttttgtgttttgaaatggagctctgcagtttattgtaaaactgctggttctgttgtttac

SEQ ID NO: 40570 - DNA, 107 bp, Homo sapiens
ctctgtctctgctgttggcacgtttctgcccttgtgcctcatgcagtcttctgtcactcacagaatctgcaggtggccctcctgcagatgtggccagagtatcagag

SEQ ID NO: 40571 - DNA, 80 bp, Homo sapiens
atagtctcaatagtgtgtgtgtgcatatgtgtgtgcacaagtgactttatgtatatatgtatatacacacttagatctgt

SEQ ID NO: 40572 - DNA, 77 bp, Homo sapiens
tctggaagacttgggtttttgtatggctacctgtactaaattgcaaggtttttagggatgaaaccaggtctgcttga

SEQ ID NO: 40573 - DNA, 75 bp, Homo sapiens
ggccttccaaactgctgctattacaggtatgagccaccatgcccagcctgtatctgcatctgcatctttcttgcc

SEQ ID NO: 40574 - DNA, 115 bp, Homo sapiens
gggttgcagacaggggtcaggaagcagcccagtaaatggtctgtatctccaagctgagaggtgagagagatcatttttattttgtcgttgctaatgatatccagttgagtgaccc

SEQ ID NO: 40575 - DNA, 76 bp, Homo sapiens
gtagtatttgctgtaaaactttcatgtatctattaatatttgtagcaccatatgataggggagagcaaaatactac

SEQ ID NO: 40576 - DNA, 100 bp, Homo sapiens
tccacactcttaaattcactgctgtcatcgcaggtgctgtctgttagactatttgtttttaaagtacttgaggtgcagacttcgaccacctcactgtgga

SEQ ID NO: 40577 - DNA, 58 bp, Homo sapiens; identical to SEQ ID NO: 9124

SEQ ID NO: 40578 - DNA, 136 bp, Homo sapiens
ctgatgttactagtcaggtgtgctctcttccacgctgctgttaccctgtctctcccctgtgggtgtgtctgtgcctctcctgactgtgagcagaaagcattcatgtttggatcttccagtgtagctcagtgcctgg

SEQ ID NO: 40579 - DNA, 111 bp, Homo sapiens
caattattgtaatgcataattttagaaccactttcacgtgtatctcatttaaccatatttttatatgtgtactaggtggctgtagaagtctttggccttgtccaacaattg

SEQ ID NO: 40580 - DNA, 94 bp, Homo sapiens
tatggagtacctactacgtacctaatgttgtaccacattatattatatttttgcataatgtttcttaaagtcaggagtagtaggaagttttgta

SEQ ID NO: 40581 - DNA, 66 bp, Homo sapiens
aaagagctataatctgtgtgggtatgtatttatatatgtatatatatatgtacatagtggcacttt

SEQ ID NO: 40582 - DNA, 83 bp, Homo sapiens
tgttgatactttttagaaactaaaaatttagtagtatgttaataattatacttactagtaattggcttttacctgtgttaaca

SEQ ID NO: 40583 - DNA, 79 bp, Homo sapiens
tgtgacaaccctgagttgagcaagtctgttggcatcatttttctaaccgcctgtgctcactttgtgtctctgtgtcaca

SEQ ID NO: 40584 - DNA, 85 bp, Homo sapiens
tctattgaacatctagacagaaggaagagaggagtcgtaactatgattcctgaatagcttcactttgagttaaagaaacaataga

SEQ ID NO: 40585 - DNA, 81 bp, Homo sapiens
gtattgtacctaaatatggtgtgtgtgtgtgtgtgcatgcgcacgcacacacgtctgtgtctctgtgtgtgtgtatcctgc

SEQ ID NO: 40586 - DNA, 87 bp, Homo sapiens
tgtttgaagaaagagtccattttttttttttttaaatcctaaaaaccacttgtacagagaaaagagaatgaactctggagtcaaaga

SEQ ID NO: 40587 - DNA, 75 bp, Homo sapiens
gcattcgaccttacagaacattcaaaagcaacagtattggtaggttgtttgctgagtgtgtgtgtgtgtgtgtgt

SEQ ID NO: 40588 - DNA, 97 bp, Homo sapiens
agctgagaactggaggcctcttggggtatggcatgctctctctctatgtcactctctctgcatctttctctcttgagactttctgtttctctttgct

SEQ ID NO: 40589 - DNA, 84 bp, Homo sapiens
aatacagatgcagatggttatatatagacatttgtaggtatgtgtatataaatatctatatcagttaccatacatatatgtatt

SEQ ID NO: 40590 - DNA, 103 bp, Homo sapiens
gtttctatgtatatatacatataaaacctatgtatatattttctatatatatacatataaaacatatgtacatatattttctatgtatatatacatataaaac

SEQ ID NO: 40591 - DNA, 93 bp, Homo sapiens
attgctactatcgaatggtagttctaagttctttgaaaaatctccaaactgcttttcacagtggctgaactaatttacattctcaccagcaat

SEQ ID NO: 40592 - DNA, 93 bp, Homo sapiens
agtacttaatgggtacaatgtatattttttgtatgacagttgcactaaaagcccagacttcactgctatgcaatgtatccatgtaacagagct

SEQ ID NO: 40593 - DNA, 158 bp, Homo sapiens
aagatggcacatatatatatatatatatatatatatatatatatatatatatatgtatatatatatgtgtgtattttatgtatatatatatatatacacgtgtatatatatatatacacgtgtatatatatatatatatatacacgtgtatatatata

SEQ ID NO: 40594 - DNA, 75 bp, Homo sapiens
agaattgtgctatcttgtgaggcagactgtcttctctgaagctactctctctctctcagaaggcttatcaattct

SEQ ID NO: 40595 - DNA, 106 bp, Homo sapiens
tagatcaggacgtctgcctgactgcagaggctggcatggaatgtttagatgtgagttcaagtttacgaccagacagcctgataccctgagtctgtgatgtggtcta

SEQ ID NO: 40596 - DNA, 102 bp, Homo sapiens
acagagactctttttctctccttttactttctcccaaacagagtctctctttctgtgctgagctgtctggagctgtaggaggagtgacacaagcacccctgt

SEQ ID NO: 40597 - DNA, 68 bp, Homo sapiens
tatatatgtatatatgtgtgtatatatatgtctatatgtgtatatatatgtaaaaaaatacatatata

SEQ ID NO: 40598 - DNA, 111 bp, Homo sapiens
aatgccagtaaaaaagcttctttttattgttgttcttaaaagataactcttcacattgttcttctatttaaataaaacgacatggaagagagagatggcttatctggcatt

SEQ ID NO: 40599 - DNA, 92 bp, Homo sapiens
atttgcctttacaattcaagtaaatttggggttaagacattgaaattatttttatatcacccattgccagtgaagttttgctagaggtaagt

SEQ ID NO: 40600 - DNA, 82 bp, Homo sapiens
gtttgttctactcacggcaaatttataaaggcatgtaagtctctatttgtatattatatttgccattttaagtagaatagat

SEQ ID NO: 40601 - DNA, 113 bp, Homo sapiens
tgcagagagcttattaattgacttgtctggggttcaacaacctgacactgacaaacataaatatttgttttacaagttgactggacttcagatattagcctgagaggtcggca

SEQ ID NO: 40602 - DNA, 82 bp, Homo sapiens
gcaggtaatacgtgtaatgtgtgtgtatatatatatgtgtgtacatgtgtgagtatatgtgcatgtgtgtggggttaatggt

SEQ ID NO: 40603 - DNA, 95 bp, Homo sapiens; identical to SEQ ID NO: 68

SEQ ID NO: 40604 - DNA, 93 bp, Homo sapiens; identical to SEQ ID NO: 69

SEQ ID NO: 40605 - DNA, 72 bp, Homo sapiens
gttgttgtttttatattttgagacagacactgtcacccaggctggagtgcagtggcatgatctcagcacaat

SEQ ID NO: 40606 - DNA, 110 bp, Homo sapiens
tgagagttgtttttttgttgttttcctgagacagggtctcactctgtcaccctatatcctgagtgacagagtgagaccctgtctcaggaaaacaacaacagcaacaatca

SEQ ID NO: 40607 - DNA, 101 bp, Homo sapiens
gctgataaaattcattatatggatataacacattttgtttatctgtcagcagatggacatttgggtcatttccattttttggctattgtgaataatacggc

SEQ ID NO: 40608 - DNA, 72 bp, Homo sapiens
gctgaataagattcttgtgtgtgtgtgtgtgtgtatatatatatatatatacaaaaaaagaaggaaatctgc

SEQ ID NO: 40609 - DNA, 94 bp, Homo sapiens
agatgagaaaactaaggcttggagaagatttacacttgacacatttaaagccatgtgtgactcaagaatgtgagcttttgccctgtgctcatct

SEQ ID NO: 40610 - DNA, 82 bp, Homo sapiens
gtgtgtgtgtatatatgtgtgtgtgtatatttatacagacatgtattttatatataatttatacatatatttatacagacat

SEQ ID NO: 40611 - DNA, 196 bp, Homo sapiens
atatgtatatgtgtatatatgtatatatatacgtatatgtgtatgtatatatatatacgtatatgtgtatatatgtatatatatacgtatatgtgtatatatgtatatatatacgtatatgtgtatatatgtatatgtatacgtatatgtgtatatatgtatatgtatatatatacgtgtatgtgtatatatatgt

SEQ ID NO: 40612 - DNA, 105 bp, Homo sapiens
ttaagtagaagttcttgttatgtcctcaaattatttcataattattaaaatccttcttttggggttttaacttattagtttaagggtacaggtctttgaacttgg

SEQ ID NO: 40613 - DNA, 99 bp, Homo sapiens
cccagcaatgaagggcagagtctgaaatatccatagttgggctgtgagagacagcacagtgtgagtaattgccaagacttagtaccatgccactctggg

SEQ ID NO: 40614 - DNA, 81 bp, Homo sapiens
gatttgcctccctctctgccactggacattgctgctgtgtttctgacatgacggccatccgtgacacagaggcaggaaatc

SEQ ID NO: 40615 - DNA, 122 bp, Homo sapiens
cagcgtcccgagtagctgggaccacagttgtgtgccaccacacccggctaatattttttcaattattatttgtaccagtggggtcttaatatgttgtccaggctggccttgaactcctgggc

SEQ ID NO: 40616 - DNA, 70 bp, Homo sapiens
aggggaatggaatagacagttgaaagggaaccatttcctttaaattctatgtatatatctctgttgccct

SEQ ID NO: 40617 - DNA, 69 bp, Homo sapiens
gtttctaaatatatatatgtgtgtgtgtatatatatgtgtatacatatacacatatatatttagttcac

SEQ ID NO: 40618 - DNA, 106 bp, Homo sapiens
ccagagaaacagaaccaataggatctgtgtatgtatgtatatatgtatggtcaatagatccatctgtataggtatttattatcggaattggcttatctgattatgg

SEQ ID NO: 40619 - DNA, 135 bp, Homo sapiens
aggctggttgctgcagattgtaggtcagagctcgatttcttatatgttctgaccattctcagtttgtatatgtcagtctctcatagggccacagagaccttactccagtgaggaccagcaaagtctcaggcagag

SEQ ID NO: 40620 - DNA, 111 bp, Homo sapiens
acattttggtaagtcgcacaatattcccaatgttgtcattatttttatatctgttacggtaatctgtgatcagtgatgtttggtgttactgttgtaattgttttggggtgt

SEQ ID NO: 40621 - DNA, 58 bp, Homo sapiens
tgagactgagtctgtctctgtcacccaggctggagtatggtggcgtgatctcagctca

SEQ ID NO: 40622 - DNA, 87 bp, Homo sapiens
gtatatattatatatatataagtatgtatatgttatatataagtatgtatatattatatatatatgtatgtgtgtgtgtgtgtatat

SEQ ID NO: 40623 - DNA, 108 bp, Homo sapiens
cccatacgctttaaatcctctctagattacttcaaatacctaatacaatgtaaatgctatgtattgtagtctgttttgtgtagctataaaggaatacctgagcctggg

SEQ ID NO: 40624 - DNA, 108 bp, Homo sapiens
tttttggaatgctattaactgctgattcaacttatttaataaatgtagtcttatttagattgcctatttatttttgtgtgagttttagtgaattgtatctttcgaagg

SEQ ID NO: 40625 - DNA, 94 bp, Homo sapiens
tccagttgtggaaatgtcttgagtataaaaatacacatatactttttttttttttttttttgagacagagtttcactctatcactctggctgga

SEQ ID NO: 40626 - DNA, 118 bp, Homo sapiens
ggttgaatttattagtgaaacagtctgtggtcctgagcctttttttttttttttttttttgggggggggtgagatttttgattactgattttgattactgatttgattttttcaggcc

SEQ ID NO: 40627 - DNA, 78 bp, Homo sapiens
cagagcaaagattggtctctccaaaagaagaaatactttttttttttttttttttttttgagacagagtcttgctctg

SEQ ID NO: 40628 - DNA, 80 bp, Homo sapiens
ggaggccaaggcaggaagattacttgagcccaggagttcaagaccagcctgggcaacatagtgagactcactcagtctct

SEQ ID NO: 40629 - DNA, 61 bp, Homo sapiens
cttcatcctgagactgaagagggtttgcacaggagtgcatgttcagtttaggacctagaag

SEQ ID NO: 40630 - DNA, 77 bp, Homo sapiens
tcaagtagcaacacgcgggagttagttggtgaccttccagttaacctctactgggctctctctgtggcactgcttga

SEQ ID NO: 40631 - DNA, 311 bp, Homo sapiens
tatatatatatgtatatatacacgtatatatacgtgtatatacgtgtatatatacacatatatgtgtatatatgtatatatacgtgtatatatgcatacatacatatatatgtatgcatatatatgtgtatatatgtatatatacatatatatgtatgcatatatacgtgtatatatgtatatatacatatatatgtatgcatatatacgtgtatatatgtatatatacatacatatgtatgtgtatatatatgtgtatatatacacacacacacatatgtgtatatatatatatatatatatatacgaca

SEQ ID NO: 40632 - DNA, 172 bp, Homo sapiens
tatatatacacatatgtgtgtgtgtgtatatatacacatatatatacacatacatatgtatgtatatatacatatatacacgtatatatgcatacatatatatgtatatatacatatatacacgtatatatgcatacatatatatgtatatatacatatatacacatatata

SEQ ID NO: 40633 - DNA, 82 bp, Homo sapiens
ccagacacaccaggacatggcttgatgtgcatctgatgttcagatttcacactgtatgtctgtgatctttctgactgtctgg

SEQ ID NO: 40634 - DNA, 86 bp, Homo sapiens
agacagaaggagagtgtaggccaggaataggtaggggaatgcctatgtatatctatctatctatctatctgtctatctatctatct

SEQ ID NO: 40635 - DNA, 95 bp, Homo sapiens
tcaacctaagagagtatttttttattaatagattatcttaagcattagctgaagtgtttgttagttttccattttaaaatatttctccctgttga

SEQ ID NO: 40636 - DNA, 89 bp, Homo sapiens
atatacatatatatgcatgcatatatatatgcatatatatgtatatatgcatatatatacatatatatgcatgcatatatatatatata

SEQ ID NO: 40637 - DNA, 100 bp, Homo sapiens
atggatttagtttggtattcgaggtaacagaataagtctaccatttttttttcaaagtgatggatttttttgtttattttcaatgttaggcattatttat

SEQ ID NO: 40638 - DNA, 89 bp, Homo sapiens
ttgtgtgtgtacatatatgtactattttcatagcggcctttctagtattacatgaacaataatgtatatatgtatttgtacacacacaa

SEQ ID NO: 40639 - DNA, 113 bp, Homo sapiens
ccttcccatttttgcagtgttatttaggacactggtctatatatatatatatgtgtgtcactggaaatcatttccagtgtccaagttatcaggactgtatcatgatgtaaagg

SEQ ID NO: 40640 - DNA, 58 bp, Homo sapiens; identical to SEQ ID NO: 87

SEQ ID NO: 40641 - DNA, 56 bp, Homo sapiens; identical to SEQ ID NO: 88

SEQ ID NO: 40642 - DNA, 77 bp, Homo sapiens
tgtctacaacttgaactatgtgactgaaggccaatttcttaaactgtgtcacattttgtttatctgtaaagtgggca

SEQ ID NO: 40643 - DNA, 67 bp, Homo sapiens
ccagcccaatatgttgaattttcatgtagcatgctgtatgttgagagagaacagactttggagttgg

SEQ ID NO: 40644 - DNA, 81 bp, Homo sapiens
gcattgattggatttagaaagggggtagcggggtgatatgacccaatttgtacttttttatacttttaagttcaggggtgc

SEQ ID NO: 40645 - DNA, 102 bp, Homo sapiens
tgacatgaattataaatgtatttattttcctgtgatttttattattaaagtttagtttttaaaaacagttaccgaaatctataaatatattgattcatgtga

SEQ ID NO: 40646 - DNA, 136 bp, Homo sapiens
gtataagtatacatgtatatgtataagtatatatacctatacatatacttatatatgtatatttatacatatacatatatgtatgcttgtatatgtacgtgtatacatatatatgtttatgtataagtgcatatgt

SEQ ID NO: 40647 - DNA, 113 bp, Homo sapiens
ttgctttatatatctgggtgcttcactggagcatgttttataacttaaatagttaaatatttttaaaatgtgatataattttacatgcttttaatggtgcttatgtaatacaa

SEQ ID NO: 40648 - DNA, 95 bp, Homo sapiens; identical to SEQ ID NO: 68

SEQ ID NO: 40649 - DNA, 93 bp, Homo sapiens; identical to SEQ ID NO: 69

SEQ ID NO: 40650 - DNA, 137 bp, Homo sapiens
atcatagcagacaggagtggtgaattgggaaatttatttcagagctaaagttttgcttaagtttctttttatatagttcctaatatgtgatagataagattattagtttggaattttaaatatcctgtagagaatca

SEQ ID NO: 40651 - DNA, 111 bp, Homo sapiens
ttagtaacggtggacgaatctaacttagttgtgtgcatgtgtatttcaaatatatacatatattttaaaaagccagtgtgacagcaacttgttacgccacagaatttctaa

SEQ ID NO: 40652 - DNA, 87 bp, Homo sapiens
gttaggtatttgctgtctttccagaatatttttttttaactcacaaagaaagaacagatttggagtaggtagcacacaatgtcaaac

SEQ ID NO: 40653 - DNA, 97 bp, Homo sapiens
atatgtgtgtgtgtgttatatatgtatatatacatatgtgtgtgtgtatatatatatacgtgtgtgtgtgtatatatatatatatacacacacacac

SEQ ID NO: 40654 - DNA, 115 bp, Homo sapiens
gtgttaagctcaaggtgactatgcagataaatcaggtatatgattcatatcttcccagactgaaatatattattttatatttatcttagtatgcttattgtttgtgctaagatac

SEQ ID NO: 40655 - DNA, 100 bp, Homo sapiens
caggtaattgattatactgttggtttggcaactgtgtatctatatttatctatctacataagaaaaacagagatatatagacagattaatgttttatctg

SEQ ID NO: 40656 - DNA, 113 bp, Homo sapiens
agttaatgtcatcttggaattctaggcttcattctgtagaaattatgaaccaatgagaaaaatttttcatagttttttcatagtcagaggtgggttcttttggaagtttaatt

SEQ ID NO: 40657 - DNA, 68 bp, Homo sapiens
gtctctcagctttccttgaagtaacatgaggataagcacctcatgtactcagtagaaagtgagtagac

SEQ ID NO: 40658 - DNA, 86 bp, Homo sapiens
tgcctgtacatgagtacatatttattgctgtatttccaaaatgtatatatattatctagctcattagatattgtactcaataggta

SEQ ID NO: 40659 - DNA, 111 bp, Homo sapiens
gagaaaaagaaataccacagactcagatttctagtccaagccttgttttttttatttttaaattgagcatacttctttatttgtaattctgagctgtggacagatttgatc

SEQ ID NO: 40660 - DNA, 78 bp, Homo sapiens
ggtgaatatttcagaaccctcaaagcacaagtcctttgaatttatttatttagctttgtggagttttgtgctttcagc

SEQ ID NO: 40661 - DNA, 110 bp, Homo sapiens
ttgctctgagttttagaatatatgcatgtgacatatcagagtctattggtaacaatattttttcattttgaatgtgtgcatgtgtatgtatgtgtgcgtgtgaagtgtgg

SEQ ID NO: 40662 - DNA, 87 bp, Homo sapiens
cttcccatcatggccagaactagtttttcaggtttgctttggaatgcccttggccaagatgagggatacattcagtctgttggggag

SEQ ID NO: 40663 - DNA, 106 bp, Homo sapiens
atctgaatttctcagtggagacacctgaatccaattcaaactctaagttattttttcttaattcaagagtttattaaatttgcttgtctacatattgctgtcagat

SEQ ID NO: 40664 - DNA, 70 bp, Homo sapiens
caatattattgggttcattggatattggagagagcacacatctctgtgactgatggttctgttgatgttg

SEQ ID NO: 40665 - DNA, 105 bp, Homo sapiens
gaacccaccatcatattctctgcctaagtcctactgattttatttctctatagtttagagaagctatgtctctggtttgggacagtatgttaatgtagtaaagtc

SEQ ID NO: 40666 - DNA, 108 bp, Homo sapiens
gttatcttaatatagatgtagatgtatgctcatataaattgtcatatataaggtatgtaaaattctttgtatatacacatatttccttgctctgtcaactgagacggc

SEQ ID NO: 40667 - DNA, 114 bp, Homo sapiens
ggtaatacactggacatttagtaactagttagaacagatgagtatttcttcttcagaaaatagataagaaaaactctctcacatccaacactgaggcttgtctagaacaatgct

SEQ ID NO: 40668 - DNA, 118 bp, Homo sapiens
gcacagaaaaagtatatatgactgctttgcatgtccagtcagataatgaaggcacactgtcagactgtctcagcacatatatctaaggcactcaatacttctatttatgctctgctgt

SEQ ID NO: 40669 - DNA, 85 bp, Homo sapiens
gagagctattgctcagtagggtgactatagttaatggatatatattgtattctttaaaaatgcagagtggatgctgagtgctctc

SEQ ID NO: 40670 - DNA, 95 bp, Homo sapiens; identical to SEQ ID NO: 68

SEQ ID NO: 40671 - DNA, 93 bp, Homo sapiens; identical to SEQ ID NO: 69

SEQ ID NO: 40672 - DNA, 60 bp, Homo sapiens
gtgtgtttgtgtggttttcattgctgtgtcgcattttcactgactctcacacaaacacac

SEQ ID NO: 40673 - DNA, 78 bp, Homo sapiens
tatatatatgtatatatgtatatgtatgtatgtgtatatatatacacatatgtatgtgtatatatatacatatgtgtg

SEQ ID NO: 40674 - DNA, 94 bp, Homo sapiens
caatttggctgagggcccagacagaacaaaaaggcagaaggaaggtgagttctctctctgtcttctggagctgggacaccctctcctgcccttg

SEQ ID NO: 40675 - DNA, 58 bp, Homo sapiens
gatatccatctatgtatgtatgtttgcatgtatgcacacatatgtatatagatatatt

SEQ ID NO: 40676 - DNA, 107 bp, Homo sapiens
gagtaaaattggaataagcaaaacatgttttctgattttgttcatatctctaaagaccctttttacacaaaattataactgaaaatatgttcttatttcatgttatc

SEQ ID NO: 40677 - DNA, 123 bp, Homo sapiens
tagtgtagtctttagaattttctacatagaagatcatgccatcttcaaatggggaaaatttaacttttaatttttccatttgggtgtcttttattgttttcatttatctaattactctggctg

SEQ ID NO: 40678 - DNA, 139 bp, Homo sapiens
gtcattgatgttacctctgtttataagaagatactaagctaataatgtttcattttttaaaaagtgagttctgtttttcttcatttgtagatgagaaaatattgggatatgttctttgagaaaaatgtgtctttattgc

SEQ ID NO: 40679 - DNA, 107 bp, Homo sapiens
tgcccctaatgtttataataagaagtaaatagaattagactctgtcactgtgataattttgattatttcagatagaggagattctactgtatgagaagcaaggtcca

SEQ ID NO: 40680 - DNA, 104 bp, Homo sapiens
tgagctgccagttccagatagagtccacgaccagagtgagaacttccatcttccatcttacccactctctctctcaattggttccttctgaatgatgcctttca

SEQ ID NO: 40681 - DNA, 112 bp, Homo sapiens
tagaactttctatgatgatagaaatattctgtagtcacactggctaacatagcaatgcaaagatgtttcaagttgtgcattagaaaagtttctacaaaacaagagatttctg

SEQ ID NO: 40682 - DNA, 98 bp, Homo sapiens
taaatatatgtgtgtggatatatacacatacatatatatgtatatgtacatatatctataaatgtatgtttatgtatacatatatttacatatattta

SEQ ID NO: 40683 - DNA, 95 bp, Homo sapiens; identical to SEQ ID NO: 68

SEQ ID NO: 40684 - DNA, 93 bp, Homo sapiens; identical to SEQ ID NO: 69

SEQ ID NO: 40685 - DNA, 82 bp, Homo sapiens
tgagttgaaggtcactcttgtgttcacatttggaattcctggttgcagagtgtgtatctgtgtgtgtcactttatggactca

SEQ ID NO: 40686 - DNA, 112 bp, Homo sapiens
tttgtgtgtctgagttttaagtaaaacacatctatattttatgtataaatatttagggtttgtttgtattaaattttatagtcctgtattttaactatattttgatcacaaa

SEQ ID NO: 40687 - DNA, 79 bp, Homo sapiens
tacatatatatgtatatatgtaaatgtatatgtatacgtatgagtttacatatatatgtatatatagcatatatatgta

SEQ ID NO: 40688 - DNA, 176 bp, Homo sapiens
tacatatatgtatatatgtgtatatacacatgtgtgtttacatatatgtatatatgtgtatgtatatatgtatatacgtgtatgtatatatgtgtatgtatatatgtatatacatatatgtatacatgtgtacatatgtatatgtttaatatgtatatgtatacatgtaaacatat

SEQ ID NO: 40689 - DNA, 154 bp, Homo sapiens
gtgtgtatatatacacacacatagatatgtaaacacatatatgtgtgtttacacatatatgtatatatacatatgtgtgtttacatataggtatatatgtatatatacatatgtgtgtttacatataggtatatatgtgtatatacacacgtgt

SEQ ID NO: 40690 - DNA, 145 bp, Homo sapiens
gtgtgtatacatacatatatgtatatgtgtgtgtatacatacatatatgtatatatatgtgtgtgtatatatgtatttatatgtgtaaatactatatatgtaaaatatatagtattaaatattaaatactatatatgcaatacat

SEQ ID NO: 40691 - DNA, 101 bp, Homo sapiens
gtgtaaagtggttcagtgtatctatgccttctgaatggactctgtctttcttgttgtgaatcacactcagaagctatactggtattataactctcgtacat

SEQ ID NO: 40692 - DNA, 114 bp, Homo sapiens
agtatttgaactaatagcataaatgatgatataaactatatatgtacatatgtatctacacatatatatatgtatatatacacacatattattaatgatttagataaggttact

SEQ ID NO: 40693 - DNA, 233 bp, Homo sapiens
tatatatagactctattaaatgacaatatatatactgtgttaaataactatatataaatataatatagtcatttatgtatatatagtcatttaatatagtctatatatagtctctctatatatatacatatatatagactatatatatgtgtatatatatagactatatatatgtgtatatatatagactatatatatgtgtatatatatagactatatgtgtgtatatatat

SEQ ID NO: 40694 - DNA, 109 bp, Homo sapiens
tatatatagactatattaaatgactatatatacataaatgactatattatatttatatatagttatttaacacagtatatatattgtcatttaatagagtctatatata

SEQ ID NO: 40695 - DNA, 77 bp, Homo sapiens
agtggaggatacccatatatctagtgtcaaaagcattgggtgactgtgtgacagtagagagtgggaaagaaaccact

SEQ ID NO: 40696 - DNA, 80 bp, Homo sapiens
ggcagaggtagatttagaaatgtgtcttacagaagaatatttttatattcactgtatcatattgcctttctatcttttac

SEQ ID NO: 40697 - DNA, 70 bp, Homo sapiens
atccacatacaaatgcataattaagtaaatatgtatctatacacatttgcgtgtgtctctgtgtgtgtgt

SEQ ID NO: 40698 - DNA, 114 bp, Homo sapiens
ctccagacccacaaggatcttttgaatttcagagtagaatcatgattaatatatttatttttatctgattttagtctttagaaatctatggaaatctctcctgtcgatatgggg

SEQ ID NO: 40699 - DNA, 108 bp, Homo sapiens
gatacgtctggaaactaatgagagtgactttgaaatttggtggtattccagggaggaatactttatttgaatttcatataacaaggcattattgaaaatagttgtgtt

SEQ ID NO: 40700 - DNA, 167 bp, Homo sapiens
caaatatatatgtgtataaatcccaaataatgtgtgtgtatatatagatatttgggagtttatatatatatatatacacacacacattatttgggagttatacacatatatgtatgtgtattatctatgtataaacacatatatattatatatatatatatctccta

SEQ ID NO: 40701 - DNA, 82 bp, Homo sapiens
tgtgtgtgtgtatatatatatctgtgtgtgtgtgtatatatatgtgtgtgtatatatagataatacacatatatatgtgtat

SEQ ID NO: 40702 - DNA, 100 bp, Homo sapiens
gtatatggatatgtgtatacatgtatatgtatatagatgtgtgtatatatgtgtatgtatatatgtatattgtatgtatatgcataagcatatatgtata

SEQ ID NO: 40703 - DNA, 79 bp, Homo sapiens
ggattctgccactgtctctttcagtgacttttatgatacattgcaccatcaaaaaggaagtgcggagatagtcagatct

SEQ ID NO: 40704 - DNA, 101 bp, Homo sapiens
gtgtgtgtgtgcatttgtatgtgttcatgtggagtgtatgtatatgtatatatgtgtattaaatatatatcatgtgtgcatatataaatgtgtataaatat

SEQ ID NO: 40705 - DNA, 86 bp, Homo sapiens
gccatatgttctctgacacaattattcagctctgtggttgtagcatgaaaacaaccataaacaatatgtaaatgaaggtatgtggc

SEQ ID NO: 40706 - DNA, 72 bp, Homo sapiens
tgggcaacagagtgagactctgtctcaaagagaaaaaaaagggtttctgtgagactcaattactaatgctca

SEQ ID NO: 40707 - DNA, 63 bp, Homo sapiens
gaggtagaaggtacagtgtgacctgagagctgctgccagggaacctagactatctaaaaactc

SEQ ID NO: 40708 - DNA, 70 bp, Homo sapiens
tggtccctgtctctggctctgaaacaccacattttgctgggatgaatatagagtgggagcagtaggctca

SEQ ID NO: 40709 - DNA, 95 bp, Homo sapiens; identical to SEQ ID NO: 68

SEQ ID NO: 40710 - DNA, 93 bp, Homo sapiens; identical to SEQ ID NO: 69

SEQ ID NO: 40711 - DNA, 56 bp, Homo sapiens
ttgtgtgtgtctgtgtgtgtgtatacatgtatatatatacatatatgaatacatag

SEQ ID NO: 40712 - DNA, 77 bp, Homo sapiens
tgaggatctgagatttgagagaggccagaagtggaattatatggtttggctgtgtccccacccaaatctcatcttga

SEQ ID NO: 40713 - DNA, 107 bp, Homo sapiens
ggtatatatatattttatatatatgtttctccaatgatatatacatatatataagtatatgtgtatcataggaatagaaatgatatatttaggaatatgtaaaatac

SEQ ID NO: 40714 - DNA, 104 bp, Homo sapiens
ttctcagactctaattcattacctacctcaactctcattttgtaacatgtatttatttatatctaaaggatattgttggggaggaaagaaaaacatcttgggag

SEQ ID NO: 40715 - DNA, 96 bp, Homo sapiens
tctgtaaatggccacacagtaaatatgtttaaaaacaaacaggcaatagactggattttgttcacagaacatagtctactgactgctacttacaga

SEQ ID NO: 40716 - DNA, 71 bp, Homo sapiens
atatgaatatgtacatgtataagtatatacatatatgaatatatgtgtgtattatacacatatacacatat

SEQ ID NO: 40717 - DNA, 97 bp, Homo sapiens; identical to SEQ ID NO: 1307

SEQ ID NO: 40718 - DNA, 88 bp, Homo sapiens; identical to SEQ ID NO: 1308

SEQ ID NO: 40719 - DNA, 81 bp, Homo sapiens; identical to SEQ ID NO: 1309

SEQ ID NO: 40720 - DNA, 77 bp, Homo sapiens; identical to SEQ ID NO: 1310

SEQ ID NO: 40721 - DNA, 95 bp, Homo sapiens; identical to SEQ ID NO: 68

SEQ ID NO: 40722 - DNA, 93 bp, Homo sapiens; identical to SEQ ID NO: 69

SEQ ID NO: 40723 - DNA, 79 bp, Homo sapiens
caaacacaacacagaaatatttatgaggtccagctcagcaaaagctctctcggtctctgtgtctctgtcttgctctttg

SEQ ID NO: 40724 - DNA, 72 bp, Homo sapiens
catgtatgtatgaatgtatatgtatgtgtgtatatatacacataaatatgtatgcatttgtgtatatacctg

SEQ ID NO: 40725 - DNA, 73 bp, Homo sapiens
catatgtatatgtataaatatatatatatattgatatatatgtatatctctatgtataatatatatacatatg

SEQ ID NO: 40726 - DNA, 111 bp, Homo sapiens
cagaattatatgtgttctcacaccacttttaaatatgtatgtaggtatgtatttatttattattgacaaatagaaactatatatatttatggtgtacaacatgatgttttg

SEQ ID NO: 40727 - DNA, 115 bp, Homo sapiens
tgttcatatctttatgtccatgtgtacccatttttgtttttattttataatttcaacttttattatagattaaagggtatatgtgaaggtttgttacatgggtatattgagtgca

SEQ ID NO: 40728 - DNA, 111 bp, Homo sapiens
gttatattttataattatgtatttgtgtaaatattacacatgtatattttatgtatatacatatatacacacacacatatatatatattcacacacacatacaagtataac

SEQ ID NO: 40729 - DNA, 116 bp, Homo sapiens
ttatagttatacttgtatgtgtgtgtgaatatatatatatgtgtgtgtgtatatatgtatatacataaaatatacatgtgtaatatttacacaaatacataattataaaatataac

SEQ ID NO: 40730 - DNA, 71 bp, Homo sapiens
ttgtttttgagacagagtctcactctgtcgcccaggctcgagtgcagcagtgtgattttggctcactgcaa

SEQ ID NO: 40731 - DNA, 118 bp, Homo sapiens
gggagagcatatactttgtagtttcataagagctgcctgtttttgtttttgatttgattttttctggatcagttcaaaattgaataaacatttctttgaaaaactcaatgctgttccc

SEQ ID NO: 40732 - DNA, 131 bp, Homo sapiens
tgtatattcatatgtatattcatacatatatatacacacatttgagtatataattaaaatgtatgtatgtatgtgtgtgtgtgaatacatatatatatacacaccacattttctttattcgtacattaatg

SEQ ID NO: 40733 - DNA, 101 bp, Homo sapiens
ggagttaaattcggaaagtgtgtgagtagctagatagaacatagtaagcactcaataaatttgctaatgttgtcaaggctcaacttttctgatatgtttcc

SEQ ID NO: 40734 - DNA, 80 bp, Homo sapiens
gccccactgatctaaaaagagaaaatatcgggaaatatatttattatgtcacttgaaattttcttttttagtaatggggt

SEQ ID NO: 40735 - DNA, 109 bp, Homo sapiens
ttagtgctgtattaatatatgttcaatatttttgacactaaagagtgtgcacctggtactccaaacatattatatagtgtaaaaatatctacaatgtaatcataattga

SEQ ID NO: 40736 - DNA, 87 bp, Homo sapiens
tcaatttctaattgaaatttctaattgaaattgaatttcaatttctaatttctaactgaaatttctaattgaaattgaatttcaatt

SEQ ID NO: 40737 - DNA, 90 bp, Homo sapiens
taccattgatgggcacctgggttgattctatgtatttgttattgtgaatagtgcagtgatgaacatacgagtccatgtgtcttgttggta

SEQ ID NO: 40738 - DNA, 106 bp, Homo sapiens
aaggtattcctttcaagtttctctcctcttgatataagtagcatatgaaaagtaacaaagtatatgttttcattctccaagagtgaattgaatgatttgaaacctt

SEQ ID NO: 40739 - DNA, 105 bp, Homo sapiens
tttctacttgtgtctggtacactagtatgtaagagcataaatttattaatcttttaataaatttatatttatgtccttactgtcagcatgaaccattactaggaa

SEQ ID NO: 40740 - DNA, 88 bp, Homo sapiens
tacaggtttagacatagatatgtgtatatatatgtatatgtatgtatatatatgtctatatatgtgtatatgtgtatttatatgtcta

SEQ ID NO: 40741 - DNA, 95 bp, Homo sapiens
acaaaaatgattgcaagtagtctgtgatccgtgtaggaaaatatggcttatgtaatgtaattcagtatgtggatttttacttattcaatttttgt

SEQ ID NO: 40742 - DNA, 117 bp, Homo sapiens
cagatatatatgtgtttatgtatgtgtgtgtatatatatatgcgtgtgtgtgtgtatatatatatatacacacacacacacatacgcatatatatatataaacatgcatataggctg

SEQ ID NO: 40743 - DNA, 68 bp, Homo sapiens
tatatatatatgcgtatgtgtgtgtgtgtgtatatatatatatacacacacacacgcatatatatata

SEQ ID NO: 40744 - DNA, 95 bp, Homo sapiens
gtattaaagtgatacctaatacagaatattcactctatgaatgttttatgaattgaatgcatagatgaatgtgctgctaagtatcaggcagatac

SEQ ID NO: 40745 - DNA, 101 bp, Homo sapiens
gtgtaggtgtgtgtttggatataagtgtatgcatatatatatatgtatttacatgtgtgtgcatgatatatgcatatatatttcacccaagcatctagaac

SEQ ID NO: 40746 - DNA, 81 bp, Homo sapiens
cataaatagcactatataatgccaatatatatgtatgtgtgtgtgtgtgtgtatgtttgtgtgtgtgtgtgtgtgtgtgtg

SEQ ID NO: 40747 - DNA, 94 bp, Homo sapiens
tggcttgctcaatgacttactgtggaatccatccaaatgttgagaggaatctttgctgtggtttcctgggtcccagtttcttctgagagagtta

SEQ ID NO: 40748 - DNA, 74 bp, Homo sapiens
tacatacatacagatgtatagatgtatgtacaggtatagatgtatatacatacatatatatctgtatgtatgta

SEQ ID NO: 40749 - DNA, 116 bp, Homo sapiens
gatgtgcagggtgactgtggcccggggggtaagctgcagcagaggagagagtgagcaggctggtgtatggctgcaagggttgccctgctggagctctcagctgatcaagtactgtc

SEQ ID NO: 40750 - DNA, 111 bp, Homo sapiens
caacgtgtaagtattcctttttgctctatagcctcaccagcatctgttatttttgactttttaataatagcttttctgactggtgtgagatgggatttcattgtgcttttg

SEQ ID NO: 40751 - DNA, 284 bp, Homo sapiens
agtatatactatatattaatatattatatataattctatataatatattaatatataattctatattatatattaacatattatataattctatatattatatgttaatatataatatataattctatataatatattaatatattatataagtatatatattatatattaatatataatatatatataatatataagtatatatattatatattaatatataatatataatatataattctatattacatattatatatttgtgtgtgtgtatatatatatat

SEQ ID NO: 40752 - DNA, 200 bp, Homo sapiens
tgctatatatatgtatatatatatgtgtacatatatatgtatatatatatgtgtacatatatatgtatatatatatgtgtacatatatatgtatatatatgtgtacatatatatgtatatatatgtgtacatatatatgtatatatatgtgtacatatatatgtatatatatgtgtacatatatatgtatatatatatgt

SEQ ID NO: 40753 - DNA, 82 bp, Homo sapiens
ttctttttttttgagatggagtctcactctgtcacccaggctggagtgcagtggtgcgatctcggctcttgaagcgtatgaa

SEQ ID NO: 40754 - DNA, 119 bp, Homo sapiens
gaatagtaagaagttcactgcaattgatctcttggtaaaaagaattgtttatatttttatagacatcaaataaatggccaacatgatatattttgtgttcaagtgagactgtctcattc

SEQ ID NO: 40755 - DNA, 86 bp, Homo sapiens
gcctcagcctctcaaagttctaggattactggtttgagccaccatgcaaagtcaatgtttttatttatagaaggagaaggttaggc

SEQ ID NO: 40756 - DNA, 83 bp, Homo sapiens
aaatgagctggctgcagtggcatgcctgcagtcctaactactgtggaggctgaggaagtaggatcacttgcacccaggagttt

SEQ ID NO: 40757 - DNA, 109 bp, Homo sapiens
gactaaagaacatctgctttacatttggaccaaggttttatatgtatatatatatatacacacacatataaccttggtccaaacctatctgtctgtctgtctgtctgtc

SEQ ID NO: 40758 - DNA, 95 bp, Homo sapiens; identical to SEQ ID NO: 68

SEQ ID NO: 40759 - DNA, 93 bp, Homo sapiens; identical to SEQ ID NO: 69

SEQ ID NO: 40760 - DNA, 95 bp, Homo sapiens; identical to SEQ ID NO: 580

SEQ ID NO: 40761 - DNA, 93 bp, Homo sapiens; identical to SEQ ID NO: 69

SEQ ID NO: 40762 - DNA, 166 bp, Homo sapiens
atatatacacacactgtattatatacatatataatatgtatataatatatgtatatatttctatatgtatatatgtatatatttgtatatttgtatacatatactatatgtatatattatatacatatattatatacatatatgtatgtgtatataatacatatat

SEQ ID NO: 40763 - DNA, 74 bp, Homo sapiens
tatatatattttttcacattatatatatatgtagtcacatattatatatatgtgtgtgtgtatatatatatata

SEQ ID NO: 40764 - DNA, 93 bp, Homo sapiens
gaatctcagaatggtaaatgatctggcacctccctcttttttttttttttttctttgagatggagtcttgctctgtcacccagtctggagtgc

SEQ ID NO: 40765 - DNA, 133 bp, Homo sapiens
tatatacacacatatatgtgtgtatatatacatatatacacacatatgtgtgtatatacatatatacatatatatacatacgtatatgtacatatatacgtatatgtatgtatacatgtatttgtgtgtgtgt

SEQ ID NO: 40766 - DNA, 109 bp, Homo sapiens
aacttgaggtatctcaattaaatatgtagacatatatggtacatatatttatttatttttatagtagatgtcttcttgtttatactctgaaagttgagatatctcagtt

SEQ ID NO: 40767 - DNA, 97 bp, Homo sapiens; identical to SEQ ID NO: 1307

SEQ ID NO: 40768 - DNA, 88 bp, Homo sapiens; identical to SEQ ID NO: 1308

SEQ ID NO: 40769 - DNA, 81 bp, Homo sapiens; identical to SEQ ID NO: 1309

SEQ ID NO: 40770 - DNA, 77 bp, Homo sapiens; identical to SEQ ID NO: 1310

SEQ ID NO: 40771 - DNA, 70 bp, Homo sapiens
catatgagtatatatgtatgtatatgtgtgtgtgtatacatatatatatatgtatgtatatgtgtgtgtg

SEQ ID NO: 40772 - DNA, 102 bp, Homo sapiens
gacctcatcctatcagttgaagatcagaacagaacaaaaaggctaagcaagaagggactccctgtgactgcctgactgcctgactgagctggctcattggtc

SEQ ID NO: 40773 - DNA, 83 bp, Homo sapiens
tacatagatgtcatatttatccatattatatgtatatattttatatacatatacatatattcatgaatatgcatatatatgta

SEQ ID NO: 40774 - DNA, 97 bp, Homo sapiens
gtgtacataatatatagggatatttaaacatatgtgtgtgtatacatataatgtgtatatatttaatgtgtagatatccctatatatgtatgtgtgt

SEQ ID NO: 40775 - DNA, 79 bp, Homo sapiens
gatagctctacggagaagaaagtgaagaggagaattctacatttatatttatttttttaccatttttctgtgtgctatt

SEQ ID NO: 40776 - DNA, 84 bp, Homo sapiens
tacaatagacaataaattattgtatatttacaatagacaataaattattgtatttttacaatatacaatagttgccctattgtg

SEQ ID NO: 40777 - DNA, 98 bp, Homo sapiens
aataactgttctctacatatatgtgtgtgtgtgcgcacgtgcgtgcatatattgtgtgtgtgtgtatatatatatatgtaaccctgaagatatttatt

SEQ ID NO: 40778 - DNA, 67 bp, Homo sapiens
gcttgaagggataaagggagtgaatggtgttgccagaacatgactgtttatttttttttcctagagc

SEQ ID NO: 40779 - DNA, 80 bp, Homo sapiens
tgtctcattatctcactcatttaaaatctggaatttaaaaaggtggatgccaggggctagagaggtttgatggggagacg

SEQ ID NO: 40780 - DNA, 102 bp, Homo sapiens
ttgggggatttgaaactcgtggatttgtgggcaaggagtcactatatatatatatgactatatatatatgtgtgtgtatacaaacatcatgttttcgcttgg

SEQ ID NO: 40781 - DNA, 119 bp, Homo sapiens
attttgtttggttgtcatgtctccttaggcctctcttggctatgatagttttttcatactttcattgtttttgataacatagagagtgttgaggagtgttggttagggatttacagaat

SEQ ID NO: 40782 - DNA, 94 bp, Homo sapiens
gcaagttaactagattttctcctatgttgtcctctaagtattatataattttatgttttacatgcaggtctgtgagaaattttgagttaattgc

SEQ ID NO: 40783 - DNA, 57 bp, Homo sapiens
ttgagacggtgtctctcgctctgtcgccaaggctggagtgcagtggcgcgatcttgg

SEQ ID NO: 40784 - DNA, 111 bp, Homo sapiens
tagtatttctgtgatgactaaatatttttgtgatgaacagtgtattttaatatttagtatctagtatatttatagttcaagtgttataaaaatatttcatatcatatacta

SEQ ID NO: 40785 - DNA, 93 bp, Homo sapiens
tacgtctgcctcatgttatgcagtgaatgaatatgagaatgtttattatagtcttagaagagtattcttaaaactgcataaatgtaagatgta

SEQ ID NO: 40786 - DNA, 69 bp, Homo sapiens
ttgtttttgacggactctcactctgtcgcccaggctggagtgcagtggtgccatctcggttcaaggcaa

SEQ ID NO: 40787 - DNA, 99 bp, Homo sapiens
catatatgtgtgtgtttgtgtgtgtgtgtgtgtgtgtgtgtatatatatatatatatctccatatatgtacatttaatatataacttaatatatatatg

SEQ ID NO: 40788 - DNA, 58 bp, Homo sapiens
tgagatggagtctcactctgtctcccaggctggagtgcagtggtgagatttctgttca

SEQ ID NO: 40789 - DNA, 69 bp, Homo sapiens
agattttatgtgtgtatctatatgtgtatgtgtatgtgtgtatgtatgtatgtatatatgtgtctgtct

SEQ ID NO: 40790 - DNA, 97 bp, Homo sapiens; identical to SEQ ID NO: 1307

SEQ ID NO: 40791 - DNA, 88 bp, Homo sapiens; identical to SEQ ID NO: 1308

SEQ ID NO: 40792 - DNA, 81 bp, Homo sapiens; identical to SEQ ID NO: 1309

SEQ ID NO: 40793 - DNA, 77 bp, Homo sapiens; identical to SEQ ID NO: 1310

SEQ ID NO: 40794 - DNA, 143 bp, Homo sapiens
cttttacctatgtgcttgatatattatatatatgtgtgtgtgtatatacatatatatatatatatatatatagagagagagagagagagagagagagagggagagagagatcctcgttgtaaatgccttttttactttctttc

SEQ ID NO: 40795 - DNA, 104 bp, Homo sapiens
tttaaattaacaacagcttccatattacgaatttatatatatgtatgtatgtgtgtgtatatatgtatatgtaaatatatatatactgtagtgtttaatttgaa

SEQ ID NO: 40796 - DNA, 66 bp, Homo sapiens
gagggatttgcttcttgagagtgagcactgaaggcaatcagcattgtcttgcatagcaaatgcctc

SEQ ID NO: 40797 - DNA, 106 bp, Homo sapiens
ctacttgagaggaagtactgatatatatgcaacaggaggaattagtaacaacacaaacaccatctcgttctgttaaaatatagtctaggactattctgttatttag

SEQ ID NO: 40798 - DNA, 108 bp, Homo sapiens
atgtatatataaaatatgtgtatacataatatatgtatatataaaatatatttatatataatacatatgtatatatatgtgtgtatatatatacaattgtgtatatat

SEQ ID NO: 40799 - DNA, 97 bp, Homo sapiens
atataagtatttgtgcatctatatgtatagatttatatacatatatatgtacatgtacatatatatctatatattatatataactaaacatacatgc

SEQ ID NO: 40800 - DNA, 200 bp, Homo sapiens
atatatatacacacatatatgtatatatatgtatatacacatatatgtatatgtatatatgtatacacatatatgtatatgtatatatgtatatacacatatatgtatatgtatatatgtatatacacatatatgtatatgtatatatgtatatacacatatatgtatgtgtatatatatgtatatatatgtatatatgt

SEQ ID NO: 40801 - DNA, 72 bp, Homo sapiens
gcagacagagtctcgctcactcagtgctcaatgtcgcccaggctggagtgcagtggcgtgatctccgctcgc

SEQ ID NO: 40802 - DNA, 85 bp, Homo sapiens
gtgtgtgtgtgtgtgtgtgtatatatattgtgtgtgtatatatttatatatatatataaatatatacacacacagacacacacac

SEQ ID NO: 40803 - DNA, 73 bp, Homo sapiens
gtgtgtgtgtctgtgtgtgtatatatttatatatatatataaatatatacacacacaatatatatacacacac

SEQ ID NO: 40804 - DNA, 65 bp, Homo sapiens
gagaaagtactgcccagaagctaaagtgtagatcaaacgcataatggctgaggtagtagtttctt

SEQ ID NO: 40805 - DNA, 94 bp, Homo sapiens
atgtatatatgtatacatgtatatatatacgtatacatatatacgtatatatgtatacgtatatatatacatgtatacatatatatatatatgt

SEQ ID NO: 40806 - DNA, 133 bp, Homo sapiens
tatatatgtgtatatgtgtatacatatatacgtatatgtatacatatatgtatacatatatatgtgtatatatgtatatatgtgtatatatatacatatatatacatatatttgtatatatgtgtatatatac

SEQ ID NO: 40807 - DNA, 102 bp, Homo sapiens
atatgtgtgtatatatgtgtacatatatatgtgtatatatgtatacatatatatgtgtatatatgtatacatatatatgtgtatatatgtatacatatatat

SEQ ID NO: 40808 - DNA, 103 bp, Homo sapiens
tatatgtatatatgtgtatatacacatatatacgtatatatgtgtatatatatacacatatatacgtatatatgtgtatatatatacacatatatattttgta

SEQ ID NO: 40809 - DNA, 108 bp, Homo sapiens
aggagtgcatcttccccaaaaggaaaataatctggttgttggttgtataatgtaatatgttcagctaattttcaataacaaccggccaaggagagaggtgcatcaact

SEQ ID NO: 40810 - DNA, 96 bp, Homo sapiens
atgaagaatttatacatatgtgtgtatatattacatatatatgaatacatatatgtgtgtatatgtatattatatataaccaattaaatatttcat

SEQ ID NO: 40811 - DNA, 58 bp, Homo sapiens
tgaggcggagtctcgctctgtcacccaggctggactgcagtggcgcgatctctgctca

SEQ ID NO: 40812 - DNA, 58 bp, Homo sapiens
gacacatagaggtgtgtatatatgtatatgtatatacatatgcacacacatatgtatc

SEQ ID NO: 40813 - DNA, 95 bp, Homo sapiens
atctgaatttatgaaaagtgaagagtatttttaaataggctataaagatttttatctttataaccatttgataagaaatttttgtttatttggat

SEQ ID NO: 40814 - DNA, 103 bp, Homo sapiens
tggagtagttttatacttgtcagaaaggagattgattagctttctgaatcttcagagtggcagttcattattttattggtttctagtataagcgagatatcca

SEQ ID NO: 40815 - DNA, 114 bp, Homo sapiens
cattgggttgttacagttctagccttctctatctagtacctgaaagcaagttgttatttttcaaggttgccagagagctggaaagggggcaggggaactggactgcaatagatg

SEQ ID NO: 40816 - DNA, 110 bp, Homo sapiens
ttgcatatgtgaaacaaaataagtgaaactttgctaatgtacattttcttaatttttatttttagttctggggtacatgtgcaggatgtgcaggtttgttacataggtaa

SEQ ID NO: 40817 - DNA, 158 bp, Homo sapiens
tatatatgtgtatatatgtatgtatgtgtatatacgtatgtgtatatatatacatatatgtgtgtgtatgtatatatatatacacatatatatgtgtgtgtgtgtgtgtgtgtgtgtatatatatatatatatatatatatatatatatatattctgt

SEQ ID NO: 40818 - DNA, 84 bp, Homo sapiens
gcatatatatatatatgtatgtgtgtgtgtgtatatatatgtatgtgtatatatatacacacatatatatgtatatatatgtgt

SEQ ID NO: 40819 - DNA, 117 bp, Homo sapiens
gttttatcccaactattttgtattttcatatatatgtatatattatatattttatatatattatatatttcatgtatatattatatatatatatatagagttcttggtattctgaac

SEQ ID NO: 40820 - DNA, 122 bp, Homo sapiens
gaatagactaaaaaatgtggtgtatatatatgtgtgtgtgtgtctgtgtatgtttgtgtacgtattatatatatacatgtttgtatatatacaatgggatactattcagctataaaaaacat

SEQ ID NO: 40821 - DNA, 87 bp, Homo sapiens
tgcattgactatgactgaaaaagtgggacaactttttttttttttttttgagatggagtctcgctctgtcacccaggctgaagtgca

SEQ ID NO: 40822 - DNA, 116 bp, Homo sapiens
gtggaggttagaagcaagatggagttggttagttcagatctctttcactgtctcagttacaattttgcaatggaggtttcagaatttcatgtcctatttatacttctcccctaaat

SEQ ID NO: 40823 - DNA, 115 bp, Homo sapiens
tggcaaaagaaaaggtatgcagaagtatcagaatttctatataaactctcaggtttatatttttatatcactgatggtgcaagaaactcagttttcatatacctagtactaacca

SEQ ID NO: 40824 - DNA, 108 bp, Homo sapiens
caagaattgcaagataatcatctgtgttgtcttaagcccactaaaattgtaattatttttacagtagcaatagaaaactaacacatatgagtattatttgcatttttg

SEQ ID NO: 40825 - DNA, 96 bp, Homo sapiens
cattacaggaaagtaattatgagtactgattttgttatataggttggattataagcagtgaatactaaagctcatgaaaactttcaggaaatagtg

SEQ ID NO: 40826 - DNA, 63 bp, Homo sapiens
tgaaatacatatatatcacatatatattatattatatatgtatgtgtgtgtgtgtgtatatca

SEQ ID NO: 40827 - DNA, 120 bp, Homo sapiens
tatatatattttttccttatatatgtgcatatatatgtataaatatgtatatatgtatatacatatatacatatgttgagaggatgtgtttatatatatatgtgtgtgtaaatatatgtg

SEQ ID NO: 40828 - DNA, 161 bp, Homo sapiens
tatatattgtgtgtgcatatatgtgtgtgtgtgcatatatgtgtgtgtttgtatatatatatatatatacatacatatatatacatatatatgtgtatatatatatatacacatatatatatatacatatatatatatatgtatatatatatatatacaca

SEQ ID NO: 40829 - DNA, 64 bp, Homo sapiens
ctgtttgtgtgtgtgtgtgcacacatgtgtgtgtataaaacaaaccagcattaatcaccagcag

SEQ ID NO: 40830 - DNA, 66 bp, Homo sapiens
gcatacatacatacatacattatgtatacatatatccatgcagtgtgtgtatgtgtctgtgtgtgt

SEQ ID NO: 40831 - DNA, 113 bp, Homo sapiens
gtttcttatattggaatatatatgattcccacagcaaaaaaaaatctagtattttttgaatatttcaaatattcaaacttaagtactctgtggatatagagggtacgaggggc

SEQ ID NO: 40832 - DNA, 117 bp, Homo sapiens
tgttcaagctctccttattccctttgtgatctgtctactaaaaacaattctgtaattctacacttcagtttttgtagattatgttcaacaaatgggattagctagtgactggggata

SEQ ID NO: 40833 - DNA, 58 bp, Homo sapiens; identical to SEQ ID NO: 1215

SEQ ID NO: 40834 - DNA, 112 bp, Homo sapiens
gatttgtttatatgtacattaatcttgtgagttaaaaaattgctttttttttattttaccatttaaatacataaaaaagagaacactatttgattgtgtacatagccaaatt

SEQ ID NO: 40835 - DNA, 80 bp, Homo sapiens
tctctctctctgtgtgtatatgtgtgtatatatatatacatgcatacatatattctatatatataaacagagaacaaaga

SEQ ID NO: 40836 - DNA, 76 bp, Homo sapiens
ggaggctgaggtaggaggatcagttgggtctaggagttcgaggctgcagagacctatgatcacgcctctgctctcc

SEQ ID NO: 40837 - DNA, 113 bp, Homo sapiens
gactaacacaaagatacttggaggtaaaagaaatctgggaaatttttattgtttttgattatttttaatgtttatattggagagtcccaagagataagtgtaaggtgttaatc

SEQ ID NO: 40838 - DNA, 116 bp, Homo sapiens
ctgttcttattcatttcattcatccaggctgcaattctctctctctctctgtatatgttgtgccatattgaagtagttagagatgtcagccaaaatggggagtagaaaatatgcag

SEQ ID NO: 40839 - DNA, 122 bp, Homo sapiens
actatatatgtgtgtatatgtgtgtatatatacacacatatatatgactatatatagtatgtgtatatatatacatatatatgacatatatatgtgtgtgtgtgtgtgtgtatatatcctat

SEQ ID NO: 40840 - DNA, 106 bp, Homo sapiens
acatatacacacacatatatatatacaaatgtagacatatatatgtgtacatatatgtgtgtatatatgtctatatatgtatatatgtgtgtatgtatgtatacat

SEQ ID NO: 40841 - DNA, 78 bp, Homo sapiens
atcctagagattggcaggctttgggcaagaaattttgggaattttgtagggttgaaagtattatataatttttaggat

SEQ ID NO: 40842 - DNA, 99 bp, Homo sapiens
ggggtggtatcaactatagtccataaacattctggacttccctcaatttgagtctatatttatgtttatgctgctctctctttcaattgaaactatctc

SEQ ID NO: 40843 - DNA, 97 bp, Homo sapiens
ttggcaaggattccaatcaacagtagacaatttgtagttaaattttaacagtcaaaagttatttacaaatattctactgtatggagggtcagtgtca

SEQ ID NO: 40844 - DNA, 73 bp, Homo sapiens
atgtatacatatatgtgtggtttatatatacacgtgtgtgtatatatatatacatacacatatatgtatatat

SEQ ID NO: 40845 - DNA, 87 bp, Homo sapiens
tagatagtgtaataggctagaagcatgcatatatatatatatgtatatatatatatgtgtatgtgtgtgtgtgtatacacatatgta

SEQ ID NO: 40846 - DNA, 58 bp, Homo sapiens
tgagttggagtctcactctgtcacccacgctggagtgcagtggtaaaatctcagctca

SEQ ID NO: 40847 - DNA, 112 bp, Homo sapiens
ttggtgattttccacagactctctggaaaatctcaaagacagttttatgtggaaaatatatctttattttaggaattgctttgaggaagagaaaaatgttaaaagttgtcag

SEQ ID NO: 40848 - DNA, 117 bp, Homo sapiens
gtgtaattcatgtataaaatttttctgccataattattatttaatgaatatattaaaatatattactagattttgttggagatatatgtgtgtagatatgtgtatacatgtatacat

SEQ ID NO: 40849 - DNA, 94 bp, Homo sapiens
acagtgtcatgtagagcagtgtaagattgtatttgtaaatttatctttaaattgcagatatggctttgctagctctttgtagagatgaaattgt

SEQ ID NO: 40850 - DNA, 66 bp, Homo sapiens
gaccttggctttagatgtgttttagtagatctcaaaggagaaaggctactggaggaggttcaggtt

SEQ ID NO: 40851 - DNA, 79 bp, Homo sapiens
accaatcccccactgtatatatgtatgtacacatgtttacatgtatatatgtatatacatctgtaagtgtgtatgtggt

SEQ ID NO: 40852 - DNA, 108 bp, Homo sapiens
agtacttcattatatcatctatgctccatcctcagagcccattcagaagctctcagaggctcactttctatcaagctctggattgacattggctgttgtgagagtatt

SEQ ID NO: 40853 - DNA, 97 bp, Homo sapiens
cgtgagccaccgtgcccggcataggattcttaattattgattatttacattcatctacgacttgttcatgtttcaccatatgctattgtggttcatg

SEQ ID NO: 40854 - DNA, 99 bp, Homo sapiens
ggttcactgtgggttctgagaggatgagctgttttccacacatcacagaaattagatacaaaagaagatggtcctggtccctttctacctgtccagtcc

SEQ ID NO: 40855 - DNA, 106 bp, Homo sapiens
ggagtagagttggaagattggagaattatacatcactggctctctgagactcttaaatctcatgtgaacagcctgggttttaaacttaagtctagccagccactct

SEQ ID NO: 40856 - DNA, 94 bp, Homo sapiens
gatgtagtgtttggtagcacaattggggaaatatagttaacagtaatgtattttatatttcaaaatagctagaaaagattttaaataccccatc

SEQ ID NO: 40857 - DNA, 130 bp, Homo sapiens
ttggggttgtggcaggtcctgaggctgataatgcgtatgtctgcagagcaccagatttaccacacacactcagagtctgaattccctggtcatagttggtaatgccaggccatgtaaaatgtccatcctc

SEQ ID NO: 40858 - DNA, 95 bp, Homo sapiens; identical to SEQ ID NO: 580

SEQ ID NO: 40859 - DNA, 93 bp, Homo sapiens; identical to SEQ ID NO: 69

SEQ ID NO: 40860 - DNA, 114 bp, Homo sapiens
ggactagggaggcctgaggagaggaagggagataggggaactgctggtcgtcgggcagtcagaacacacacagcatgtattgactaatttttttgtcttatactggcacagttt

SEQ ID NO: 40861 - DNA, 58 bp, Homo sapiens
tgagactgagtctcgctctgtcacccaggctggagtgcagtggcgcgatctcgactca

SEQ ID NO: 40862 - DNA, 119 bp, Homo sapiens
gctttgttctttttcttagggttgtcttagctatatgggctcttttttggttccatatgaaatttaaagtagttttttctaactctgaagaaagccaatggtagcttgacaggaatagc

SEQ ID NO: 40863 - DNA, 81 bp, Homo sapiens
aatcaatgacagagcatatatatatatatatatatatatatatatatatatatatatatatatatgtggtcccataagatt

SEQ ID NO: 40864 - DNA, 83 bp, Homo sapiens
ctggtaattctgtgtgacctcacagggcacaggggagattctgggtttctcaaggtctgtatggggtcacaaggtgtgaccag

SEQ ID NO: 40865 - DNA, 87 bp, Homo sapiens
actgtggcttggaggagtgaatctcagggtactatttttatatattaaagtggtgtgtttcccctcatatatttcttgttgctcagt

SEQ ID NO: 40866 - DNA, 89 bp, Homo sapiens
ctaattatagtcacagaatcctcagttttaactggtctgttccaacagaagtatccctgagctaggaggatgatttgagctatttacag

SEQ ID NO: 40867 - DNA, 94 bp, Homo sapiens
gtgtatatatgtgcttatatatgtgtgtgtatatatatgtgtatatgtgtttatgtgtgcatatatgtatgtgtatatgggtatgtgtgtatat

SEQ ID NO: 40868 - DNA, 67 bp, Homo sapiens
tatatatatacgtatatatatgtgtgtgtgttttatatatatatatgtatatatatgtgtgtgtgtg

SEQ ID NO: 40869 - DNA, 118 bp, Homo sapiens
gccaagttgggctttaaagtgcagggcctgctgatgttgagtgctttttgttctaaggtgcatctagtgcagatagtgaagtagattagcatctactgccctaagtgctccttctggc

SEQ ID NO: 40870 - DNA, 82 bp, Homo sapiens
gcagtcctctgttagttttgcatagttgcactacaagaagaatgtagttgtgcaaatctatgcaaaactgatggtggcctgc

SEQ ID NO: 40871 - DNA, 105 bp, Homo sapiens
ctgatgtgacagcttctgtagcactaaagtgcttatagtgcaggtagtgtttagttatctactgcattatgagcacttaaagtactgctagctgtagaactccag

SEQ ID NO: 40872 - DNA, 99 bp, Homo sapiens
actgaacactgttctatggttagttttgcaggtttgcatccagctgtgtgatattctgctgtgcaaatccatgcaaaactgactgtggtagtgaaaagt

SEQ ID NO: 40873 - DNA, 107 bp, Homo sapiens
gggaaactcaaacccctttctacacaggttgggatcggttgcaatgctgtgtttctgtatggtattgcacttgtcccggcctgttgagtttggtggggattgtgacc

SEQ ID NO: 40874 - DNA, 86 bp, Homo sapiens
tatatattatatatattcatattatatgtatgtgtgtgtgtgtatatatatatatgtgtgtatatatgtgtgtgtatatatatgta

SEQ ID NO: 40875 - DNA, 116 bp, Homo sapiens
ctgcattttgaaatatcaagaacacaggttaagcaatcacacaagaaacacagcttacttctcaggcttcatgctttgtgaaggtgttgcagcctttctttgagtattctgattag

SEQ ID NO: 40876 - DNA, 111 bp, Homo sapiens
accatattcaatcatgttaaatgttgtagatcatatataaatacaaaaagaaagaaaattatttattaagcatgtggtatgtttggtttactcaatttgggattgaggggt

SEQ ID NO: 40877 - DNA, 74 bp, Homo sapiens
tatgcaaagcaggtaggctttaaatggctaaaaatatatttatttgagctatatttaaagcaactggatgtata

SEQ ID NO: 40878 - DNA, 70 bp, Homo sapiens
ttatatcattttattttatttttgagacagggtctcattctgtcacccagactggagtgcagtggtgtga

SEQ ID NO: 40879 - DNA, 98 bp, Homo sapiens
ctgctctatgaagcatctactgaaactctcactggctgtttttgggtcaccttcctaccctagagccacatgtggggtcagctgagctaatgtgtcag

SEQ ID NO: 40880 - DNA, 101 bp, Homo sapiens
caggaagaggaccctgaagagagtctggaagggccagctgttagttttgataagtaaactagctgtttcacagtctttcttccaggagcaagtatttcctg

SEQ ID NO: 40881 - DNA, 116 bp, Homo sapiens
gctgacttttctaggtcatggttagttatatgatttttaaatatttatatttctgtggcttttttttgggggggggtcggtgggacagagtctcgctctgtcacccaggctggagt

SEQ ID NO: 40882 - DNA, 104 bp, Homo sapiens
atatacacacatgtatatacatatacacacatatatgtatatatgtgtatatatgtatatatgtgtatatgtgtatatatgcatatatgcatatacgtgtgtat

SEQ ID NO: 40883 - DNA, 110 bp, Homo sapiens
attaaagagataacttgaagcctgtgatgatattatctttctccagagaatattttattttgatcctttggagtttaccagaaatattagcaagtccatatccatttgat

SEQ ID NO: 40884 - DNA, 91 bp, Homo sapiens
ggatccatgaatgtcacacacacacagaaactgcacaatggagacaatgatgtgccgatctgtataagaatgtgtgaaatgctactgattc

SEQ ID NO: 40885 - DNA, 76 bp, Homo sapiens
gtgttactatatttttgtatttatgtattacagaattttaagtgaatacaaatatacagaaaatatagtataacac

SEQ ID NO: 40886 - DNA, 108 bp, Homo sapiens
gagagatactacttaataggatgttttgtggtaataaatgtgtttatatttcatttcttcatgttattgaacatttttttcctccaataacatttctgtttgttctcc

SEQ ID NO: 40887 - DNA, 95 bp, Homo sapiens; identical to SEQ ID NO: 68

SEQ ID NO: 40888 - DNA, 93 bp, Homo sapiens; identical to SEQ ID NO: 69

SEQ ID NO: 40889 - DNA, 90 bp, Homo sapiens
gctcccagttgctttggtattcttgaagattttattttacttttatttttattttgaaatggagtctcactctgtcacccaggctggagt

SEQ ID NO: 40890 - DNA, 70 bp, Homo sapiens
tttttttgagacagagtctcactctttcacccaggctggagtgtagtggtgtgatcttggctcactggaa

SEQ ID NO: 40891 - DNA, 116 bp, Homo sapiens
ttatttattctgcctgcgagtcatcgagattttccttctgttgctgattttttttttttcctagtaagtttttggaagttaaagtcaaatgactggatggtaaaggagtggcataa

SEQ ID NO: 40892 - DNA, 121 bp, Homo sapiens
tacgaaaaatacatatacaacatgtacatatatatgcacaacatatatatatatgtatctgttatatatgtatatatttttatatatgtatgttgtatatatatacgttgtatatgtatgt

SEQ ID NO: 40893 - DNA, 83 bp, Homo sapiens; identical to SEQ ID NO: 25547

SEQ ID NO: 40894 - DNA, 298 bp, Homo sapiens
atatatatatatacacgtgtatatatatacgtatatatgtatatatatacatatatgtatatatacgtatatatatacacgtgtatatatacgtatatatacatgtatatatgtatatatgtgtatatatgtgtatataggtatatatgtgtgtatatatgtatatatgtatatatatatgtgtatataggtatatatgtatatatgtgtatgtatatgtatatgtgtatatatgtatatatgcgtatatattatatatgcgtatatgtatatatgcatatatgtatatatgcatata

SEQ ID NO: 40895 - DNA, 114 bp, Homo sapiens
catgtatatatacgtatatatacacgtgtatatatatacgtatatatacatatatgtatatatatacatatatacgtatatatatacacgtgtatatatatatattttcagatg

SEQ ID NO: 40896 - DNA, 84 bp, Homo sapiens
tgtctcactctgtcactctgccctatgcccctcagttgaattctttcttctgaggaggcaagcaagaattgaggttgtgggaga

SEQ ID NO: 40897 - DNA, 213 bp, Homo sapiens
gtgatcataagatttaatctgtttatacagacacatactgtatgtatctttatatataaaaagatgcatatgtatacatatatatctgtataaacatatatctctttatatgaatatatatacagaaatatgtatatttagtgtattagttttactggattgcatacaatgaaatatattttttcatatttctctctatatattttaaatata

SEQ ID NO: 40898 - DNA, 81 bp, Homo sapiens
cttacatatgctatgtgtgtgtgtgttctttttttattatactttaagttttagggtacatgtgcacattgtgcaggttag

SEQ ID NO: 40899 - DNA, 84 bp, Homo sapiens
tttatatatatttacatatatatgtttagatatttacatatatgtttacagatagttagatgtatatgtttacatatatataaa

SEQ ID NO: 40900 - DNA, 89 bp, Homo sapiens
gtgcatatatatgtatatatacatgtatgtgtgtatatatttatatatatacatgtatgtgtgtatatgtttatatatacacatatata

SEQ ID NO: 40901 - DNA, 114 bp, Homo sapiens
gtctcacagttcattaggcagtcttcaaatgtccagtatgacagtgcaagatatttgttgtttatatgcatatttcccccactggctttgagaaacttgagggattgttgtagc

SEQ ID NO: 40902 - DNA, 95 bp, Homo sapiens; identical to SEQ ID NO: 68

SEQ ID NO: 40903 - DNA, 93 bp, Homo sapiens; identical to SEQ ID NO: 69

SEQ ID NO: 40904 - DNA, 104 bp, Homo sapiens
tatatatacacacattgagtatatatatatacactcatatatttacacactaagagtgtgtgtgtatatatatgtaagtatatatatgtgtgtgtgtatatgta

SEQ ID NO: 40905 - DNA, 106 bp, Homo sapiens
ttcatacattgtaatttttgcatgttgcattaataattgggaagaaaattagagattatctagtttaattactcaattttaaagttgcagaaactaggaactggaa

SEQ ID NO: 40906 - DNA, 100 bp, Homo sapiens
gcaatgctttgcaattttcagtgtagaagaattgtacatttttggtaaagaatactactgtttatataacattgaaaaaagttttgactaaaagtattgc

SEQ ID NO: 40907 - DNA, 84 bp, Homo sapiens
agttgtattccatctggaatttgtttctaaatattatgcaagattaggatccaaatttattttcttccagatggatagtcaatt

SEQ ID NO: 40908 - DNA, 109 bp, Homo sapiens
gcttcctgtattgttccaggaaccatattcagtattttttgtatatataactgccatttatttatatgttttatagataatactgatcaggatttccaaaatacgaagt

SEQ ID NO: 40909 - DNA, 119 bp, Homo sapiens
ggacaagaacgtatacattgttaatttgctcgttcatttataaaatctattcactgccagctctgtgtcaggtattgtgctggagagtgaatatacagtgtgtacttacagccttttcc

SEQ ID NO: 40910 - DNA, 79 bp, Homo sapiens
tgccatatggcagcttggctcttccaagcagtgcagccctgtgaaggaatgtattgaagtgagatgaccagccccggca

SEQ ID NO: 40911 - DNA, 58 bp, Homo sapiens
tgagacagtgtctcactgtgtcatccaggctggaatgcagtggtgcactcatagctca

SEQ ID NO: 40912 - DNA, 114 bp, Homo sapiens
ctcagcctctcaactagctgggactactggcatgcactactgctctcaggtagttttttattttttgcagagacagggtcttgctgtatttcccagtctgggaaactcctgggc

SEQ ID NO: 40913 - DNA, 113 bp, Homo sapiens
gttgaaatgggtagcctttagggagaatagggtaaattacaatatttataagtatataaatatacataagttacatcgtaagtggcctactttaaagtaagtcccatataagc

SEQ ID NO: 40914 - DNA, 67 bp, Homo sapiens
aggatgataataattccagtattgcaggctggattcactcactctgtgatattgttattaacatcct

SEQ ID NO: 40915 - DNA, 58 bp, Homo sapiens
tgagacagagtctcactctttctcccaggctggagtgcagtggcgtgatctctgctca

SEQ ID NO: 40916 - DNA, 75 bp, Homo sapiens
attacaactgataccacagaaatacaaaagatcatctcagatcattttttgtatttctgtggtatcagttgtaat

SEQ ID NO: 40917 - DNA, 107 bp, Homo sapiens
gaaggggattcctctaatctatgttgctttgaaaatcagatacatcaaagatcattatttgtataaaatttcctgagtaactgcagagtgagtatcattgagacttc

SEQ ID NO: 40918 - DNA, 106 bp, Homo sapiens
gatacctctattgtctctactcttggcctcattcctattctttttttttttttttttgagacagagtctggctctgtggcccaggctggagtgcagtggtgtgatc

SEQ ID NO: 40919 - DNA, 106 bp, Homo sapiens
gtcgttttttttgtgtgtgtgtttttgttttgttttgttttgtttgtaaaacttctctagtgattatgatgagcagcctgctttgaggagcaaagacacataagac

SEQ ID NO: 40920 - DNA, 81 bp, Homo sapiens
aggtaatttttcattttttgtagagacagcgtcttgctatgttgcctgtgctggtctctaactcctgaatggaagtgatct

SEQ ID NO: 40921 - DNA, 75 bp, Homo sapiens
tatacatatatataaaatacatatatatatacatatatgtgtgtgtatatatatgtgtgtgtgtatatatatata

SEQ ID NO: 40922 - DNA, 66 bp, Homo sapiens
tatatgtatgtatgtatatatgtatacacacagaatgtatgtatatatgtatacacacagaatgta

SEQ ID NO: 40923 - DNA, 95 bp, Homo sapiens; identical to SEQ ID NO: 68

SEQ ID NO: 40924 - DNA, 93 bp, Homo sapiens; identical to SEQ ID NO: 69

SEQ ID NO: 40925 - DNA, 101 bp, Homo sapiens
cttaagctcctagtggaagaatactgaacaaatttattcttgtaaaactcatgcttccttagaatttatttgtatagtttctgggagatgggaggtggtag

SEQ ID NO: 40926 - DNA, 95 bp, Homo sapiens; identical to SEQ ID NO: 68

SEQ ID NO: 40927 - DNA, 93 bp, Homo sapiens; identical to SEQ ID NO: 69

SEQ ID NO: 40928 - DNA, 101 bp, Homo sapiens
gcttcactcagacgagttagagtgttggttgagtgccactggctgtaagtgcaatgttaatctctctttctctctctctctctctctgtctctgtgtgtgt

SEQ ID NO: 40929 - DNA, 91 bp, Homo sapiens
gtatacaatgacattttacacacacacacacacaaatatgtatatacacatatatgtatgtgtatgtgtgtaaaatgtcatatgtgtgtat

SEQ ID NO: 40930 - DNA, 132 bp, Homo sapiens
tccttccatagtggactctgagattctttttttttttttttttttttttgagatggagtctcactctgtcaccccggctggagtgtagtggcaccatctcggctcactgcaacctccacctccctggtttca

SEQ ID NO: 40931 - DNA, 78 bp, Homo sapiens
tatatatatacaggcacacgtaattatatatatttatacacacatctatatgtatgtacctgtgtatgtgtgtatata

SEQ ID NO: 40932 - DNA, 95 bp, Homo sapiens
agacattaacagaggacatgcatcagttttctttcaaagtttttaataatccatttgaggttcttggaagggattggcattaaatttgtttgtct

SEQ ID NO: 40933 - DNA, 56 bp, Homo sapiens
tttatatataagtacacatatgtatatttatgtatgtatgtgtttatgtgtataaa

SEQ ID NO: 40934 - DNA, 101 bp, Homo sapiens
acatgagctaaaacatgagctgagatcgggtctcactctgtcgctcaggctggagtgcagtggtgattacagcttattgcagcatctatgtccttggctca

SEQ ID NO: 40935 - DNA, 137 bp, Homo sapiens
tgtgtgtatatatatgtgtgtatatatatacatatacatgtatatatacacatatacatacatacatatatatgtgtgtgtgtgtgtgtgtatgtatatatatatatatatatatatatatatatatatatatatat

SEQ ID NO: 40936 - DNA, 58 bp, Homo sapiens
tgagatggagtctcactctgtcactcaggctggagtgtagtggtgtgatctcagctca

SEQ ID NO: 40937 - DNA, 73 bp, Homo sapiens
aggaatttgaggttgcagtgtgttatgattgtgccactgtacttctgggtgacacactgaaactctgtctctt

SEQ ID NO: 40938 - DNA, 95 bp, Homo sapiens
tgtagttacattttaaatttttgtgtgctttttaaagatgttgaattgtttcatttgatttttctttattattggtacacacattttgtggtaca

SEQ ID NO: 40939 - DNA, 106 bp, Homo sapiens
tatatatacatatatacacgtatatatcacacatatatatatgtatatatatacatatatatacgtatatatatgtgtgatatatacgtatatatatgtgtgtgtg

SEQ ID NO: 40940 - DNA, 114 bp, Homo sapiens
acatatatatacgtatatatcacacatatatatacgtatatatatgtatatatatacatatatatatgtgtgatatatacgtgtatatatgtatatatatacacgtatatatat

SEQ ID NO: 40941 - DNA, 58 bp, Homo sapiens
tgaggctgagactcactctgtctctcaggctggagtgcagtggtgtgatctcggctca

SEQ ID NO: 40942 - DNA, 60 bp, Homo sapiens
tgcgcccagccctgtgacacactcagtggctggggcttgagtgtgttgttggctggctca

SEQ ID NO: 40943 - DNA, 84 bp, Homo sapiens
aagagattctcagtgtgatagaagacctcctcatagactgcatctaatgaccatattcttttttttacattgatggtatctttt

SEQ ID NO: 40944 - DNA, 112 bp, Homo sapiens
caaactgattgtgctcctgtcaaaggtggctcaagttctgttcaaacacctgtttctatctttatgaatattaaaagcctctgtgattttttttctggaagcaatgattttg

SEQ ID NO: 40945 - DNA, 81 bp, Homo sapiens
tcctcccagtcagttctgagaagctagagagcacagtgggaatatctgatatctcagtagaacatgagggggtgagaggga

SEQ ID NO: 40946 - DNA, 65 bp, Homo sapiens
aaagaggaatgtgtgtgtgtgtgtatatatatatatatgctcctcgcacacgactttcactcttt

SEQ ID NO: 40947 - DNA, 95 bp, Homo sapiens; identical to SEQ ID NO: 68

SEQ ID NO: 40948 - DNA, 93 bp, Homo sapiens; identical to SEQ ID NO: 69

SEQ ID NO: 40949 - DNA, 57 bp, Homo sapiens
tgagacagatctcactctgtcacccaggctggagtgcagtggtgtgatttctgctca

SEQ ID NO: 40950 - DNA, 79 bp, Homo sapiens
atcactgtgtgaggatggcagtggtagaaaagtctggaaggatcgtcaccaaatgttaatggggttgtcacagagtggt

SEQ ID NO: 40951 - DNA, 120 bp, Homo sapiens
tattctctgatctcattttataatttgactcaaaagctttttccattttgacagatcaaagagaccaattcagagtctgaaatggaaaattgggttgattatgttaatgataggtgagta

SEQ ID NO: 40952 - DNA, 82 bp, Homo sapiens
tacagaaagtcaaaagctagctagatagtgatgcaagaagcttgtatacattaactgtcttagtgtcagctggctaactgtg

SEQ ID NO: 40953 - DNA, 82 bp, Homo sapiens
ctgcactccagcctgagtgacagagtaacactctgtctcaaaaaaaaaagagttttgctctgtcacccagactggagtgcag

SEQ ID NO: 40954 - DNA, 101 bp, Homo sapiens
agaattataggcatgagccattgtgcccaaccaatatttgtttatttaaaggatgaatctacagatatggtctgggttttcgtgtgtttgtttgttttttt

SEQ ID NO: 40955 - DNA, 72 bp, Homo sapiens
gttgttttgagacagggtctcactctgtcacccaggctggactgcagtggcctgatctctgctcactgcaac

SEQ ID NO: 40956 - DNA, 116 bp, Homo sapiens
gggtatataacagagatgggtgtactgtaaagtaggtagggcagatagaattcaccctattttattttatttgttttattttattaatttatttattttgagacacagtcttactc

SEQ ID NO: 40957 - DNA, 110 bp, Homo sapiens
gttgctctaggtttactttatccagaggatgggaggttgtttttttttttttttttttttttttttttcaaggtctggctcagttgcctcaggttggagtgcagtgcagc

SEQ ID NO: 40958 - DNA, 63 bp, Homo sapiens
gaagacctgagaatggtctgtcaatgtctgtgtctcgggtcaatcagaacttctttggtcttc

SEQ ID NO: 40959 - DNA, 58 bp, Homo sapiens
tgagatcaagtctcactctgtcacccagcctggagtacagtggtgtgatttcggctca

SEQ ID NO: 40960 - DNA, 85 bp, Homo sapiens
ggtctgtgtttcttctcagcagcgaagtttctgtttcttttttttttttttttttgagacggagtcttgctctgtcacccaggct

SEQ ID NO: 40961 - DNA, 87 bp, Homo sapiens
cttagctgacactggctgtgattatttttttatttttatttttttggtaggggagagaatggggtgggtgttgtcataaaagctaag

SEQ ID NO: 40962 - DNA, 98 bp, Homo sapiens
gcctgggcgacaagagtgaaactctgtctcaaaaaacaaaatatgtattttttttttggcttttggattaaatatttgattagttgttgcattccagc

SEQ ID NO: 40963 - DNA, 70 bp, Homo sapiens
tacagtgttgtggtcttagttttaaaacagaacttttgtttttatttaaagctatttttatttcactgta

SEQ ID NO: 40964 - DNA, 98 bp, Homo sapiens
acctataggaaaggcaggagaaatgattaattttgttatttttttttaaaaccgattttcaaaataatgagtgattctccagcattttcctgtggagt

SEQ ID NO: 40965 - DNA, 58 bp, Homo sapiens
tgaggtggggtctcactctgtcactcaggctggagtgcagtggtgtgatctcagctca

SEQ ID NO: 40966 - DNA, 76 bp, Homo sapiens
ccaggtgtggtggcaggtgcctgtaatcccagctactcaggaggctgaggtaggaggatcacttgaacccaggagg

SEQ ID NO: 40967 - DNA, 106 bp, Homo sapiens
caagtagctgggactacaggtgcgggccaccacagctggctaatttttctaattttttgtagaggtggggttttgccatgttgcccagactagtctcgaactcttg

SEQ ID NO: 40968 - DNA, 83 bp, Homo sapiens
gcctgctctgacacttgattgttgtgtgagtccaggcaacttaaccactctcagcttaagtgtcctcggagtaaaacagaggt

SEQ ID NO: 40969 - DNA, 76 bp, Homo sapiens
gggtctctctgtcactcaggctggagtgcagtggagtgatcatagctcactcaagcctcaagggctcaggtgatcc

SEQ ID NO: 40970 - DNA, 77 bp, Homo sapiens
ccatgtagttatgtatatatatttgacagtttattcacttgatagataacttctaagtatttcaacatagcttatgg

SEQ ID NO: 40971 - DNA, 80 bp, Homo sapiens
ggagtctcactctgtcacccaggctgagtgcagcggcacaatcttggctcactcagcctcccgggttcaagcgattctcc

SEQ ID NO: 40972 - DNA, 122 bp, Homo sapiens
gttgtttgataatgctgaactttgtaacatttctctctttttttgagatggagtctcgctctgtcgctcaggctggagtgcagtggcacaatctcggctcactgcaaccaccgcctcctggg

SEQ ID NO: 40973 - DNA, 67 bp, Homo sapiens
cagggcagaagacttctcaaaagggtggattttatttatttattttttgagacagagtctcgctctg

SEQ ID NO: 40974 - DNA, 108 bp, Homo sapiens
tgtgtgtatgtggctatatttgtgggtatacatgtttgcataattttatctatatagatggatttgtatgtacatggatgtgtgtgtatgatctataaccagcaccca

SEQ ID NO: 40975 - DNA, 88 bp, Homo sapiens
acacagacagacagacacacacacgcacgcatcctaatgggttttttcccccatggggtgtgcgtgtgtgtgtgtgtgtgtgtgtgtg

SEQ ID NO: 40976 - DNA, 79 bp, Homo sapiens
acacacacacacacacacacacgcacaccccatgggggaaaaaacccattaggatgcgtgcgtgtgtgtgtctgtctgt

SEQ ID NO: 40977 - DNA, 86 bp, Homo sapiens
tgagacggagtctcgctctgtcgctgtcgcccaggctggagtgcagtggcacgatcttggctcactgaaagctctgcctcccgggt

SEQ ID NO: 40978 - DNA, 95 bp, Homo sapiens; identical to SEQ ID NO: 68

SEQ ID NO: 40979 - DNA, 93 bp, Homo sapiens; identical to SEQ ID NO: 69

SEQ ID NO: 40980 - DNA, 106 bp, Homo sapiens
gccaaccaagaggcagcagccaggcagcccagctttgctaagggtctctctcagtgtgctgaggctgcggaaaggctgcagcctgcaggcacttggcacacaccct

SEQ ID NO: 40981 - DNA, 109 bp, Homo sapiens
atgctgagttgtgtctggtgtcttcagctcatgaacaccgtcctctgtgtgtgtcagtcacatcaggggaattgtgacagaaaaaaggcagaccagtgcactgcagtgt

SEQ ID NO: 40982 - DNA, 95 bp, Homo sapiens; identical to SEQ ID NO: 68

SEQ ID NO: 40983 - DNA, 93 bp, Homo sapiens; identical to SEQ ID NO: 69

SEQ ID NO: 40984 - DNA, 115 bp, Homo sapiens
tgttaacttgagatctttctagcgttttgatgtgggcatttagtgctataaatttttttattaacactgctttagttgcatccagagattctggtacattgtctctttgttctca

SEQ ID NO: 40985 - DNA, 114 bp, Homo sapiens
ttgcatggattatctttttccattcctttacttccagtttatatatctctttacaagtgagatgagtttctttaaggcagtgtatggatgggtcttgttttttaatccattcag

SEQ ID NO: 40986 - DNA, 117 bp, Homo sapiens
tataattatttggtatgtaagggagaagggaaatgactataaaatattatatctttattctttgagaccatgagttttggtgtctttctaaatgttccttgattatctttaaaggtg

SEQ ID NO: 40987 - DNA, 92 bp, Homo sapiens
atctttaagtaggttcttcataaatgtccattcttattttgtaaacgtttgtttttgtttataaatgtgaagacatttatcaccctaaagat

SEQ ID NO: 40988 - DNA, 64 bp, Homo sapiens
cttgaatattggctgtagactgctggtaaagtgtgactcagtgactctatggccaattttcaag

SEQ ID NO: 40989 - DNA, 114 bp, Homo sapiens
gtattctccgtgtacattgtggaacaattatggtgaaggtgagattttgtatatatgatattagattactttactttaaaaaggagcaaccacagagtacgtcttgatagttac

SEQ ID NO: 40990 - DNA, 86 bp, Homo sapiens
tatgtatataggtgtgcatgcatatgcatatacatgtgtatatatttatatacatgtatgtgtttatgtgtatagttagatacata

SEQ ID NO: 40991 - DNA, 100 bp, Homo sapiens
cagaggaaaggcttttgggctttggaattaggtagaattgtattaaaattctggctgtgggattaattgtatgagccccaattgtttgttgaactctctg

SEQ ID NO: 40992 - DNA, 58 bp, Homo sapiens; identical to SEQ ID NO: 2221

SEQ ID NO: 40993 - DNA, 132 bp, Homo sapiens
gaacatgcatatcccacaactcaaattgtttgccattccacaaataactatgaaagtgcatgagtactgattttggggtttcaaataaatcttagtatgcaggacacattttcaaatgtggaatctgaataa

SEQ ID NO: 40994 - DNA, 82 bp, Homo sapiens
gttgttgtttgtttgtttgttttttgttttagagacaaggtctcactctgtctcccaggctggagcgcagtggagcaatctc

SEQ ID NO: 40995 - DNA, 118 bp, Homo sapiens
cctccctccaaatgatgaattgtctgggaaatgggtatagtcagatctttttttgtgtttaataacaacaacaaaaagctacccaacctctaggtgtatgtcttcaggaacagacagg

SEQ ID NO: 40996 - DNA, 141 bp, Homo sapiens
tgattttgagatgaatatatatatgtgacatatatatttatatgtgaacatatatgtatgcatgtatatatgttacatttaaatatatatttatgtcatatttatatatgtcacatttgtttatatatgtgtgtttgtcgc

SEQ ID NO: 40997 - DNA, 117 bp, Homo sapiens
gtagtcatgtgtgtttgcatgttgtattagtctgatttcacattggaaagaaacatatatatttcctttttttgaaagctactcagattattctaatgcaaagtcaggtttgagtac

SEQ ID NO: 40998 - DNA, 85 bp, Homo sapiens
atatactatatgtgtgtacatatgtgtatatatatatacacatacacacatatgtatatatgtatatgtacacatatatatacac

SEQ ID NO: 40999 - DNA, 119 bp, Homo sapiens
gtatgagacatatacatatgtataagatgttgtgacagctaacgattttggagatatatatctatatctatatatctatgtctatatgtctatatctatctatatctatatatctatat

SEQ ID NO: 41000 - DNA, 115 bp, Homo sapiens
atcctacagaagctctgggctgtgaatacaagtatcctcttttcatgggtgaacaaagtgagctcagcagttaaagaacttacctgtgagcatctaatcagaaggtctgcctgat

SEQ ID NO: 41001 - DNA, 56 bp, Homo sapiens
gagacggggtctcactctgtcactcaggctggagtgcagtggtgtgatctaggctc

SEQ ID NO: 41002 - DNA, 104 bp, Homo sapiens
gcttaaattgcttactagtgacacctgaacctatttaacatagattagagatttgtatttcttcttttgtaaattatattctaggttctctaggtgctttgtgc

SEQ ID NO: 41003 - DNA, 80 bp, Homo sapiens
gttgaagtggcttttctctggtgggtaaactcttttttttttttttttttttgagacggagtctcgctctgtcgctcagc

SEQ ID NO: 41004 - DNA, 96 bp, Homo sapiens
gggccccactatgtagctggttttgatggaaagacatttgttctgacacggtagctctcagtcactctctccttcagaacatagtagcaaatgcct

SEQ ID NO: 41005 - DNA, 58 bp, Homo sapiens
tgagtcagagtctcactctgtcgcccgggctggagtgcagtagcgtgatcttgactca

SEQ ID NO: 41006 - DNA, 117 bp, Homo sapiens
cctgcagccagctaagtggtgtgactcatagctctcagtttttggtagacagctgaagccagagaacattcagagctgtagacaaacacttaaattaggtgtcctggtagagcaagg

SEQ ID NO: 41007 - DNA, 89 bp, Homo sapiens
tgcttccaagccatggaatatgcaaaggagatgggatgtcactcccataatgatgtcccatcactatatatatatatgacttgcaagta

SEQ ID NO: 41008 - DNA, 102 bp, Homo sapiens
gaacttgagtgactgttttaggcaacttattgtgctgcgtgttgcattatttaattatttcatgagagtgtgtcttgttgctctagagaggttatgagtctc

SEQ ID NO: 41009 - DNA, 56 bp, Homo sapiens
gagtctcactctgtcaccaggctggagtacagtggtgtgtggcatgaccttggctc

SEQ ID NO: 41010 - DNA, 100 bp, Homo sapiens
gagacgagggttgcaggcaaagctgcagcaaaaactggagtagaaaaagcacaattctcattttgttttgctgtggaaaagggacctgctaacagagttc

SEQ ID NO: 41011 - DNA, 107 bp, Homo sapiens
tatataatatgtgtactatatattatatgcatactgtatatgatatgtatatatcatatattatatacaacacatatgtgtatatatgtatatattacatattatgt

SEQ ID NO: 41012 - DNA, 68 bp, Homo sapiens
tggggaactgaaagttggggtgacttttttttttttttttttaagaaggagtctccctctgtcaccca

SEQ ID NO: 41013 - DNA, 114 bp, Homo sapiens
taaggctcaaatgtttgtggtctgaagacattagatgaaaaattccagaaataaacaatttatatgttttaaatcagtgaccctcaacctttttggcaccagggacaggttttg

SEQ ID NO: 41014 - DNA, 58 bp, Homo sapiens; identical to SEQ ID NO: 10482

SEQ ID NO: 41015 - DNA, 84 bp, Homo sapiens
tctcaactcccagagcgaggtcaggggcatgcatgtgttagtgagtgtgaacatatgtgtgactgtgtgtctctgagtgtgaga

SEQ ID NO: 41016 - DNA, 95 bp, Homo sapiens; identical to SEQ ID NO: 68

SEQ ID NO: 41017 - DNA, 93 bp, Homo sapiens; identical to SEQ ID NO: 69

SEQ ID NO: 41018 - DNA, 106 bp, Homo sapiens
attctataatttcttttcatatacagcttgtgagtattctatttttttttttttttttgagatggaatctcactctgttgcacaggttggagtgaagtggtacaat

SEQ ID NO: 41019 - DNA, 58 bp, Homo sapiens; identical to SEQ ID NO: 2224

SEQ ID NO: 41020 - DNA, 56 bp, Homo sapiens; identical to SEQ ID NO: 335

SEQ ID NO: 41021 - DNA, 101 bp, Homo sapiens
ttgtttttgtttttgtgttttagtgtcagattttgaaaattctttatatattacagatataaagtcgttgtcagatacatgatttgcaaatactttctcag

SEQ ID NO: 41022 - DNA, 90 bp, Homo sapiens
tggtgaaagcaggagcaaggcggcggggaggtgtcacacacttttaaatgaccagatcgtgtgtgaacttagagagctcacttatcacca

SEQ ID NO: 41023 - DNA, 167 bp, Homo sapiens
gcctaggcaacatggtgaaaccttgtctctactaaaaatacaaaaaattatttatttttaaaattttttctttttttttctttttttgaggcagagtctcgctctgtcacccaggctggagtgcagtggtgcgatctcggctcactctgcaagcaccgcctcctggg

SEQ ID NO: 41024 - DNA, 58 bp, Homo sapiens
gtgtgtctctctcacagccagtccccttagcgccctggctctctgaggcttgacatat

SEQ ID NO: 41025 - DNA, 117 bp, Homo sapiens
ggatgaacctttgctttaccataaataaccctcatcacatggcattttttcttcttcaaaaaccttgatttgtagccgggaaaaagtgattttgtgaagatatggagctctccatct

SEQ ID NO: 41026 - DNA, 115 bp, Homo sapiens
aaagcatcagggaactctaaaaacaggggaccaaaaagcaagtagagtgaagagtgtgtgggcagctttataaagcaagtgctcgtgggccagctggatttgtccccattgtttt

SEQ ID NO: 41027 - DNA, 102 bp, Homo sapiens
agcacaaacacttgaagcttcagagagctagtagaatgatgagaaaagtatttaattcatttttattctatgatggctcactggtgcttctataaagatgct

SEQ ID NO: 41028 - DNA, 68 bp, Homo sapiens
tgggtgtctctgactctgtggaggtggttaaagaccctggactaccctcccttggttgtgtgacctca

SEQ ID NO: 41029 - DNA, 84 bp, Homo sapiens
ctgctgtgactgcagccccagttcatgctggcgtcttgcagccccgccagctcctgtacctctctgggcctgactcaacggcag

SEQ ID NO: 41030 - DNA, 83 bp, Homo sapiens
gcaatacatgactgtgtgtctgtaggccatatatattaatatatatatagtcatttgagatcagtctatatacagtgttttgt

SEQ ID NO: 41031 - DNA, 76 bp, Homo sapiens
tatatatataaaaagagagagagtatatatataaaaaattgtatgtgcgctctctgtctctctctctatatatatg

SEQ ID NO: 41032 - DNA, 56 bp, Homo sapiens; identical to SEQ ID NO: 88

SEQ ID NO: 41033 - DNA, 95 bp, Homo sapiens
catttgtgaggcctggatgagtgagaaggagagacttagccatgtattatggtagtttatgtatttcttttcatagtgtctgagaaatgctatat

SEQ ID NO: 41034 - DNA, 88 bp, Homo sapiens
tgcgtatatatacattgtatatatatgcatatatatactatgtatatatacattatatatgcatatatatacaatgtatatatacaca

SEQ ID NO: 41035 - DNA, 106 bp, Homo sapiens
cactgttcagtctccagaacatagtaatcctctatttgttttttaatttttaattttttttttaagagacaagtttttactctgttatccaggctggagtgcagtg

SEQ ID NO: 41036 - DNA, 102 bp, Homo sapiens
tcttacctggccttattgcgttagattattgtattatatttcatttctttttttttttttttttttgagatggagtcttgctctgtcgcccaggctggaggg

SEQ ID NO: 41037 - DNA, 98 bp, Homo sapiens
gatgtcaattgtctatgtaacgaccacgatgatgtccattgtctatgtgttgactacatgatgatgatcatcatcaaggtgatgacagcgttgacgtc

SEQ ID NO: 41038 - DNA, 115 bp, Homo sapiens
ggctatgacagagacctgaagtaacagtgagttaaacaggaaagtaaaagtttatttctttttacttgaaaccccaagctcataagaggcttctgttccacagttatgagaggcc

SEQ ID NO: 41039 - DNA, 76 bp, Homo sapiens
taaaaggatgaaaaaaggtttactactagttttaaccttcgtggtgaacttttggagaactttttttttttttttg

SEQ ID NO: 41040 - DNA, 99 bp, Homo sapiens
cactctgcctctggcctcacatggtcctcttcctgtgtgtctctgtctaaattcccttcttagaacactagtgataaagcatcagggccaagcctagtg

SEQ ID NO: 41041 - DNA, 83 bp, Homo sapiens
tctgggataagaataggccaacagaaagaaccaggcttccatggctggaggaattctgtcagtgtctctatcactatttcaga

SEQ ID NO: 41042 - DNA, 117 bp, Homo sapiens
gtcctcccctcccccatgggtccagcctaatgggttccaacctttcttttattattattttttatttattttttgagacaggctctcattctgtcacccagtctggagtgcagtggc

SEQ ID NO: 41043 - DNA, 64 bp, Homo sapiens
cagggtctggctctgtcactcaggctgaagtacagtggcctgatattggctcgtggcaaccttg

SEQ ID NO: 41044 - DNA, 97 bp, Homo sapiens
tacacatatattctccaagataaatagatatagatatctgttttgataaaacactttatttttctaagtattatggctcctgaatctgctatgtgta

SEQ ID NO: 41045 - DNA, 84 bp, Homo sapiens
gtctattttattcttgacacatggccatatttgcagtgagattaagtatgggagtagccatgtgactcagcagagtgaggagac

SEQ ID NO: 41046 - DNA, 109 bp, Homo sapiens
ctgtcagactataagacgagacacacattctcagaagattcatgacattcccaacagatcttttttttttttttttttttttgagatggagtctcgctttgtcgcccag

SEQ ID NO: 41047 - DNA, 125 bp, Homo sapiens
ctctgaccccactgtgagctggtagcactttgcagactggttattttgagtggcactggtagagaggagagagagacctggcaggtgaaggcttgggggagcatattgcaagatgggcccagatc

SEQ ID NO: 41048 - DNA, 58 bp, Homo sapiens
tgagacggagtctcactctgtcacccaggctggagtgaagtggtgtgatcttggctca

SEQ ID NO: 41049 - DNA, 100 bp, Homo sapiens
atgttgcagttcaaagtctattgccaattatcttttccctgacactcccactgatagttgacagggagcattgagggacagactcataactttgcagcat

SEQ ID NO: 41050 - DNA, 95 bp, Homo sapiens
ggtagatgggctccccaagggcaagagatccaggagagagtaaagacacaggactagctgtgtcttttatgatctgctcttgggagtcacattcc

SEQ ID NO: 41051 - DNA, 67 bp, Homo sapiens
gagacagagtctcactgtgtcgcccaggctggagtgcagcggcacaatctcgacttactgtaacctc

SEQ ID NO: 41052 - DNA, 96 bp, Homo sapiens
gtgtgtgtctgtgtgagtgtgcgaatatatagtgtgtgcacacacctgtgaggatgggtgtgtgtagtgtgtgtgcacgtgtgagtgggtatgtgt

SEQ ID NO: 41053 - DNA, 87 bp, Homo sapiens
ttgccagataagccctggatgtcatcacaagagttgttttaagagagaggcagaggaagatgtgaggacacacagaggagaaggtga

SEQ ID NO: 41054 - DNA, 64 bp, Homo sapiens
ccatcagtccctctgtctcacataaagacttatggggatcacgtttctcagaggggagatgagg

SEQ ID NO: 41055 - DNA, 106 bp, Homo sapiens
agattatttaaatgctcttcaagtatagtgttttcaaaagtatgtttataattttgtacacatatgatgtaaatatttatgctattaagtgtgacatgaataattt

SEQ ID NO: 41056 - DNA, 62 bp, Homo sapiens
atatatatatatatgtgtatatatatatatgtatgtatatatacacacatacatatatatat

SEQ ID NO: 41057 - DNA, 79 bp, Homo sapiens
tatatatacacacacatatatgtatgtaatatatgtatatattatatatttgcatataaattatatatgtgtatacata

SEQ ID NO: 41058 - DNA, 116 bp, Homo sapiens
ccagcctaggcaacagaccgagaccctgcctcaaaaaaataaaaaataattctttttttttttttttttttttctaatttttttgagatagagtctcactctgtcgcccaggctgg

SEQ ID NO: 41059 - DNA, 95 bp, Homo sapiens
ggggtgtggtaggagacactggatctttctgtggctctgtctatggctcaaaagctgtctcctagagcctgaggacacgcagcctactccagcct

SEQ ID NO: 41060 - DNA, 90 bp, Homo sapiens
acccagaaagcaaactcagtcagtacctaattctctctcttttttttttttttttgagacagggtctcactgtgtcgcccaggctggagt

SEQ ID NO: 41061 - DNA, 129 bp, Homo sapiens
cctgattcttgttctcttcactgaggattttgcatatgtttatattactggctatgatattatgtagtactcattgaaacactctttaggaagttttattgtacaatatggtgaagcataatgcaggat

SEQ ID NO: 41062 - DNA, 72 bp, Homo sapiens
ttgttttttgagactgagtctctctctgtcacccaggctggagtgcaatggcgcgatctcggctcactgcaa

SEQ ID NO: 41063 - DNA, 93 bp, Homo sapiens
ttagttgcttaagtaggacttactttttttatatgaaaagaagtggcatagaacttttcttatataagaaaacagtggtccctaggcttttaa

SEQ ID NO: 41064 - DNA, 72 bp, Homo sapiens
gcccagatactgttcaaagctgttgtgcgctatgatggcacctatgactagccactacacttcagcatgggc

SEQ ID NO: 41065 - DNA, 90 bp, Homo sapiens
gatctgtacatttctgattgctttgttttgttttggagacagggtctcactctgtcacccaggctggaaagcagtggtgggatccagctc

SEQ ID NO: 41066 - DNA, 85 bp, Homo sapiens
gttgagaggtagatggatgattagatggatgaccaacgtagaaatgccagtgtcaaaacctaggaatcaaccctccgttcttaac

SEQ ID NO: 41067 - DNA, 66 bp, Homo sapiens
ggctcggtggctcgtgcctataaactcagccctttgggaggctgaggtaggaggatcacttgagcc

SEQ ID NO: 41068 - DNA, 115 bp, Homo sapiens
tcagcctgggcaacatggcgagaccctgtctctacaaaaaaaaaaaaaatttacattattattattattattattattattttgagatggtgtctcgctctgtcacccaggctgg

SEQ ID NO: 41069 - DNA, 78 bp, Homo sapiens
tctgtgtttgagggttttattgtttttgagtttgtttgttgtttttttttcaaacagggtctctctctgccacacagg

SEQ ID NO: 41070 - DNA, 132 bp, Homo sapiens
gaggatgcagtgagccatatttttgttttggttttttcttttttttgagacagggtctcgctctgtcgctcaggctggagtgcagttgcgcgatctccgcttaagtgaatcttgtgcctcagcctcctgagt

SEQ ID NO: 41071 - DNA, 63 bp, Homo sapiens
tgtcggccagcgaggccgggagcaggtggccttcatctgcaactgtgtctctctcagcctcca

SEQ ID NO: 41072 - DNA, 90 bp, Homo sapiens
gtagttggggggtgggaacggcttcatacaggagttgatgcacagttatccagctcctatatgatgcctttcttcatccccttcaaccac

SEQ ID NO: 41073 - DNA, 139 bp, Homo sapiens
caggttcccaaggcgcggtggagggacactcgtaaaaggtctcgctgtgatcactgtctccagcctgctgaagctcagagggctctgattcagaaagatcatcggatccgtctgagcttggctggtcggaagtctcatc

SEQ ID NO: 41074 - DNA, 115 bp, Homo sapiens
cctcggtggtgttggatgagccctcggaggactccatttgttttgatgatggattcttatgctccatcatcgtctcaaatgagtcttcagagggttctatcatttcgtcggatgg

SEQ ID NO: 41075 - DNA, 87 bp, Homo sapiens
ccctgggaagatgtctgggagggaggcgagcatcagcttttattgcccctcacactctctctggcatttgtgttgtcctctgttggg

SEQ ID NO: 41076 - DNA, 87 bp, Homo sapiens
gtgcggtacttgaagaaatggtttaccgtcccacatacattttgaatatgtatgtgggatggtaaaccgcttcttggtatccagccc

SEQ ID NO: 41077 - DNA, 100 bp, Homo sapiens
ggctgctgcttggtacttggagagaggtggtccgtggcgcgttcgctttatttatggcgcacattacacggtcgacctctttgcagtatctaatcccgcc

SEQ ID NO: 41078 - DNA, 115 bp, Homo sapiens
gtctgcgctagcgtgtggtacttgaagataggttatccgtgttgccttcgctttatttgtgacgaatcatacacggttgacctatttttcagtaccaaatcccgccttggagggc

SEQ ID NO: 41079 - DNA, 82 bp, Homo sapiens
ccaatttccttactctgtctctctctctgccaccactgagagagagagagagagagagagagagagagagagagggagaggg

SEQ ID NO: 41080 - DNA, 111 bp, Homo sapiens
cctggggaattaatcggattgctactggccttgagtcgcatagcctttgacttcacatcctcagagaagtcacagaccagggctgtgaaattggttcatttctctttctgg

SEQ ID NO: 41081 - DNA, 95 bp, Homo sapiens; identical to SEQ ID NO: 68

SEQ ID NO: 41082 - DNA, 93 bp, Homo sapiens; identical to SEQ ID NO: 69

SEQ ID NO: 41083 - DNA, 107 bp, Homo sapiens
ggccctgcgagtgccggcggaatgtgcagattcgctgaccccaagactgtctccctgtgtgtcttggaggtgggtgctgagctctgtcagggactgtgccctcggct

SEQ ID NO: 41084 - DNA, 70 bp, Homo sapiens
caggatcaaaagtgacagatgactgtcaggtgctagcctgggcagacacattgagtcaagacctcatctg

SEQ ID NO: 41085 - DNA, 68 bp, Homo sapiens
gaagcagcaggagcacttgtctgtctctctctgggatccaggtggaggacaagtctcccctgacaatc

SEQ ID NO: 41086 - DNA, 113 bp, Homo sapiens
gccacttttatacctgtctattgatgtatggactttattttttatttatttatttttattattattatgctttaagttttagggtacatgtgcacaatgtgcaggttagttac

SEQ ID NO: 41087 - DNA, 73 bp, Homo sapiens
tatgggtgtgaagcttggtggttacccaagagactttcccctctctctccctgcctgagctgtcttatctgtg

SEQ ID NO: 41088 - DNA, 81 bp, Homo sapiens
gtggccctctccctgtgtgcgtgtctgtgtccaaatttccccttttggataaagacatcggtcaggtggactaggacccac

SEQ ID NO: 41089 - DNA, 58 bp, Homo sapiens; identical to SEQ ID NO: 1215

SEQ ID NO: 41090 - DNA, 65 bp, Homo sapiens
ggaggctggcagcttgcgggaggggccggagcggtctggcactggtttctctctgtctcacctcc

SEQ ID NO: 41091 - DNA, 58 bp, Homo sapiens; identical to SEQ ID NO: 36223

SEQ ID NO: 41092 - DNA, 92 bp, Homo sapiens
cacgggatgggaggggccagggctgtgggttttggcagggggggtctcatctgccatctgtctgtctcagatgccccttttcttttcccgtg

SEQ ID NO: 41093 - DNA, 81 bp, Homo sapiens
taggtctgtctgtctggttatctatctgatcaatcaatttatttagagatgggtcacattatgttgtccaggctggacttg

SEQ ID NO: 41094 - DNA, 91 bp, Homo sapiens
ggtcctcacacctgtaatctcagcactgcaggaggctgaggtagaaggatcgcctgagcccaggaggttgaggctgcagtgtgctgtgatc

SEQ ID NO: 41095 - DNA, 93 bp, Homo sapiens
ccgctctcctcagtctgcggtgggctagcggacggtccggcttccggcggccgtttctgtctcttgctggctgtctcgctgagtcgcggccgc

SEQ ID NO: 41096 - DNA, 98 bp, Homo sapiens
ctcaggctggatgtcatggcgcacgcctgtaatcctggcactttgggaggctgaggtagcaggatcacttgtgtccaagagttcaagaccagcctggg

SEQ ID NO: 41097 - DNA, 81 bp, Homo sapiens
attttgaggtagagtctcactctgtcacccaggctggtgcagtggcacaatcatggctcatcgtaagctctgcctccaggt

SEQ ID NO: 41098 - DNA, 67 bp, Homo sapiens
ggtataaaacccagaatgttgtgtctgcgctctcgcgtcagactctcgctcagtcgtgggttctgcc

SEQ ID NO: 41099 - DNA, 92 bp, Homo sapiens
acacacacacacgtgtatatatacatatatgtgtatatatatatacgtatgtgtatgtatatatatatgtgtgtgtgtgtgtatatatatat

SEQ ID NO: 41100 - DNA, 58 bp, Homo sapiens; identical to SEQ ID NO: 1868

SEQ ID NO: 41101 - DNA, 134 bp, Homo sapiens
cacaacaaaattagccgggtgtggttgtgggcacctgtagtcccagctactcgggaggctgaggtaggagaatgttgtgaacctgggaggtggagcttgcactgagccaagatcacaccactgcactccagcct

SEQ ID NO: 41102 - DNA, 75 bp, Homo sapiens
ttattgcaagtcgactcacaaggagtcaggagttcagctcaaatctgtctctctgtgctggctttaaggcagtaa

SEQ ID NO: 41103 - DNA, 80 bp, Homo sapiens
cagtaggtgcatctgaatctgggggtcactgcatctgcatgtggtatcccctctacgaggacctgcaggtgaagcctgtg

SEQ ID NO: 41104 - DNA, 108 bp, Homo sapiens
aagtgaccagaatgggctgaaggggacacccatgataccagtaacactctgcttcttgatctggaagcaggtttcattggcatgttcacttcaccaacttgtatactt

SEQ ID NO: 41105 - DNA, 120 bp, Homo sapiens
gaagtgagagagaaaggcatcaaatgagctcgtttctgatgctctctctctctctcttttatcaaatgagctcgtttctgaggctctctgtctctctatcaaatgagctcgtttctgatg

SEQ ID NO: 41106 - DNA, 91 bp, Homo sapiens
gttgttgttgttgagaaagagtctcgctctgtcacccaggctggagtgcagtggcatgatctcggcttactgcaacctccacctcccaggt

SEQ ID NO: 41107 - DNA, 95 bp, Homo sapiens
ggcagcctgggcaggatacatgtgagtgcctacctgggctggggtggcctgaccctctctgggcctcacagctttgtctgcctcatggtactgtc

SEQ ID NO: 41108 - DNA, 115 bp, Homo sapiens
gatttgacattttatgtagggtgcagggaccccaaatgatttctatcttcattattctatttatttattttttgggatcagtttcgctctgtcacccagactggagtgtagtggc

SEQ ID NO: 41109 - DNA, 79 bp, Homo sapiens
gcctgtctcggcctcccaaagtgctgggattacaggcgtgaaaatgctactgatgacagtgcagagagtcctgagatgc

SEQ ID NO: 41110 - DNA, 88 bp, Homo sapiens
tcatgcaactagcaagtgccagagctgggccagaagcacctaaaaccgtagcccaccttacagcctctgtcactctctcggatgctga

SEQ ID NO: 41111 - DNA, 85 bp, Homo sapiens
gtgtgtgtgtgtgtgtgtttgtacagactgtctcactctgccacccaggctggagtgcagtggtgcagtcataacttactgtaac

SEQ ID NO: 41112 - DNA, 58 bp, Homo sapiens; identical to SEQ ID NO: 3385

SEQ ID NO: 41113 - DNA, 56 bp, Homo sapiens; identical to SEQ ID NO: 3386

SEQ ID NO: 41114 - DNA, 68 bp, Homo sapiens
ggtgtagggaaggggtccaatttcttttttttttttttttttttgagacggagtctcgctctgtcacc

SEQ ID NO: 41115 - DNA, 56 bp, Homo sapiens; identical to SEQ ID NO: 7850

SEQ ID NO: 41116 - DNA, 82 bp, Homo sapiens
cattttcatgcaaacgtttgtgccacaactcacgtctctttcccgttgcagttgagtgcacacttgtcagagtgtgtcaatg

SEQ ID NO: 41117 - DNA, 114 bp, Homo sapiens
gaacctctcacggcccaactgcttcagcgcaggcttcagcatctagaggctgtctcagtctcttggtccctgtgtctgtctccgctatggctggcggccctcctgtgttggttt

SEQ ID NO: 41118 - DNA, 88 bp, Homo sapiens
aagttgatcggccgagcatttattttgttgttctcattcctcaatattggtgaaattacaataaggttcttgtggtgctgattttctt

SEQ ID NO: 41119 - DNA, 114 bp, Homo sapiens
ccgctcacatgcgtgtctggccactgagggctccaatctagcatttctttttttttttttttttttttttttggagatggagtctccctctgtcactaggctggagtgcagtgg

SEQ ID NO: 41120 - DNA, 92 bp, Homo sapiens
cccgctttggggctattaaggagtgctgaagttgttttggttttttttttttttttgagacagagtctcgctcgctctgttgtccaggctgg

SEQ ID NO: 41121 - DNA, 81 bp, Homo sapiens
ccagatggggaggctcagtctgtgcctctggcgctgccgcatctgctgaggcctggcctggagctgagggcacggaaggcc

SEQ ID NO: 41122 - DNA, 114 bp, Homo sapiens
ggccagcttcacccagcctggggggcctctgcggcctaggcctatgctctgggaccagggctcatattcgggagtggaggcttagcccttggctgcctgaagttctggtgggcc

SEQ ID NO: 41123 - DNA, 113 bp, Homo sapiens
ctctgttgttccaccatccctgatcccacagtaaaatcctgtcaccctcactgcctggtttctgcccctgttgggggtgaatgagcagcttgtcctgggtttggggcagagag

SEQ ID NO: 41124 - DNA, 69 bp, Homo sapiens
gcagacagaggactccgagggtggacgtcacagtggctgtgaccctggctgtctggctttcctctctgc

SEQ ID NO: 41125 - DNA, 97 bp, Homo sapiens
ccagaccagtatggcagttgtggcttggccaagtttctttctttctttcttttctttttttttttttgacaaagtctcactctgtcacccaggctgg

SEQ ID NO: 41126 - DNA, 58 bp, Homo sapiens; identical to SEQ ID NO: 5055

SEQ ID NO: 41127 - DNA, 70 bp, Homo sapiens
ttgttttgagacggagtctcgctctgtcactcaggctggagtgcagtggcgcgatctctactcactgcaa

SEQ ID NO: 41128 - DNA, 58 bp, Homo sapiens
gtgactgagtctcgcactgtctcccaggctggagtgcagtagtgcgatctcagctcac

SEQ ID NO: 41129 - DNA, 76 bp, Homo sapiens
gtcatattcattttatacatataaatatgtatgtacattatatatatgcatattttatgtataaaatgagtatcat

SEQ ID NO: 41130 - DNA, 93 bp, Homo sapiens
aaaaaaaaaaaaaaaaaaaaaaaagaattcagagagggaacacatttttaatcttcaaatacttgtctttttttttttttttttttttttttt

SEQ ID NO: 41131 - DNA, 74 bp, Homo sapiens
cagtgccaggctcactgcttgccataggcagccctgccctctggatctcatatctgcagttctgaccttgcctg

SEQ ID NO: 41132 - DNA, 71 bp, Homo sapiens
tctgacctgggtgcggagccctttttttttttttttttgagacggagtctggctctgtcacccaggctgga

SEQ ID NO: 41133 - DNA, 102 bp, Homo sapiens
tatctggtttttaagggtctgagcttagcttgtgcatgcaaggttttgggtttttttattttttttttgagcacagcttttcaccttttaatttgttgggta

SEQ ID NO: 41134 - DNA, 69 bp, Homo sapiens
ttgtctgagacagggtctcactctgtcacccaggctgaagtgcagtggcatgatcttggctcattacaa

SEQ ID NO: 41135 - DNA, 74 bp, Homo sapiens
tcctctgtctgtggctctgtgtcctggctgagaaaggcagcgctgccttcagggaactgggcccattgctggga

SEQ ID NO: 41136 - DNA, 87 bp, Homo sapiens
agggggagtgggtgtggagggtggtagacgtagaagggagcttccagttctgtggatgtcacagtctctcatttacaaatctgccct

SEQ ID NO: 41137 - DNA, 126 bp, Homo sapiens
tctaagcctccgtggtagtcacctgagtgtcttcttttttttttttttgagatggagtctcactctgtcacccaggctggagtgcagtggcacaatctcggttcactgcaacctccgccccccggg

SEQ ID NO: 41138 - DNA, 92 bp, Homo sapiens
actgtaacaagtaattttaagactagagattgagtttcttttttttttttttgaggcagagtctcactctgtcgcccaggctggagtgcagt

SEQ ID NO: 41139 - DNA, 127 bp, Homo sapiens
ggaaacacagtgagacttaattgctacattttttttttttttttttttgagacagagtctcactgtgtcgcccaggctggagtgcagtggcgcaatctcggctcactgcaagctccacctcccgggt

SEQ ID NO: 41140 - DNA, 91 bp, Homo sapiens
agtgaaggtgatagggaaggacttttaggtagaaggattttattttattttttatttttttgagatggagtctcgctctgtcacccaggct

SEQ ID NO: 41141 - DNA, 96 bp, Homo sapiens
ccaagtcctttgggggcatcttgagactcttttttaattttaattttattttgttttatttttgagatggagtctcgctctgtcacccaggctgga

SEQ ID NO: 41142 - DNA, 58 bp, Homo sapiens; identical to SEQ ID NO: 1673

SEQ ID NO: 41143 - DNA, 79 bp, Homo sapiens
tctccctcagtaacatagcaagaccccatcttttttttttttttcaagatggagtctcgctctgtcacccaggccagag

SEQ ID NO: 41144 - DNA, 96 bp, Homo sapiens
atgtatgtgtgtgtgtatatatgtgtgtattatatatgtgtgtatatttatatatacatatataatacatatacatatgcgtatatatacttatgt

SEQ ID NO: 41145 - DNA, 86 bp, Homo sapiens
tggtaaatgggtatgaccacttattctgaagggtagtttgcagtatcatttttttgaggcaaggtctctctctgtcacccaggcta

SEQ ID NO: 41146 - DNA, 74 bp, Homo sapiens
ttgttttgttttgacacggagtctcactctgtcgctgggctggagtgcaacgacgtgatctcggctcactgcaa

SEQ ID NO: 41147 - DNA, 118 bp, Homo sapiens
ctgggtggcagagtaagattctgtctccaaaaaaaaaaagaaataatctcttaaaaatttttattattattatctttttttttttttttttttgagacagtctcgctctgttgtccag

SEQ ID NO: 41148 - DNA, 119 bp, Homo sapiens
ctcactgtgtgcacttgggcacattacctaacctctctgaacctcagttttttttctgtttaatagaaatgataccagccgggtgaggtggctcatgcctgtaatccttgcattttggg

SEQ ID NO: 41149 - DNA, 116 bp, Homo sapiens
actaatcaaaatatttcataggcacagtgttactctgatttctatgtcattaatttttattttattattattacactttaagttttagggtacatgtgcacaatgtgcaggttagt

SEQ ID NO: 41150 - DNA, 131 bp, Homo sapiens
gagggtcctgagaatgagccaggtggcagctgtccctgtttttttgtttgtttttttgagttggagtctcactctgtcacccagcctggagtgcagtggtgccatctcagctcactgcaacctctgcctcc

SEQ ID NO: 41151 - DNA, 69 bp, Homo sapiens
ctgtgactatttttttttttttgagacagagtttcactctgtcacccagactagagtgcagtggcacag

SEQ ID NO: 41152 - DNA, 101 bp, Homo sapiens
cacccacaggtaccggggattgggatgtggacatctttttaatttttatgtatttatttaattttttgagacagtctcattctgtcacccaggctggagtg

SEQ ID NO: 41153 - DNA, 81 bp, Homo sapiens
gtgtgtgtctgtgtgtgtctctgtagggtgtgcgtgtcgaggtcccctgggagtccaccccagtggctcccaagcatgcac

SEQ ID NO: 41154 - DNA, 106 bp, Homo sapiens
gcctacatgactgtggggtcccatccactgtgtgactctgagtccctgggctaggggcaggaagagcccgtgggcagggtcatggcccaggacagcatgctcgggc

SEQ ID NO: 41155 - DNA, 72 bp, Homo sapiens
cagtttagccaactctgagactcactctgtgccagacggaggcaaagtgtggggctcacaggctccaaactg

SEQ ID NO: 41156 - DNA, 103 bp, Homo sapiens
atgggtgtgtgtgggggcagctgggtggtgggggacccaggaggtcacactgcagccatcctgcctctcactctctcggtccaggcactccccacaactccat

SEQ ID NO: 41157 - DNA, 97 bp, Homo sapiens
gttaccaggaaggcctttcccattctgcaggtctgggcatgtcgtgagtgggccagcactcacactgcctcacagtgaagggcacacagctggggac

SEQ ID NO: 41158 - DNA, 65 bp, Homo sapiens
ctgcctctgagaccctgtgaccctcagagtgtggggcatggggggcagagggtccagaaaagcag

SEQ ID NO: 41159 - DNA, 86 bp, Homo sapiens
gcatccggtttcctgcctggctccctgcctggctccccagttagacttcaacgtccaggccgggtgtggccaggggtcagccatgc

SEQ ID NO: 41160 - DNA, 132 bp, Homo sapiens
gcagcccggccctgagccccgagtcctgtcaccatccccccagtgccgagcccccagggcagccgcactcactctgtctttcctgcctcatggggataagtgatgggcagaagagccagggcgagtgtgtgc

SEQ ID NO: 41161 - DNA, 92 bp, Homo sapiens
ccaccctggccaggagtgggactgaaagcttccacgacagctctagcagtcagctgagtgtgagcacagtgtggcagagctgggcaggctgg

SEQ ID NO: 41162 - DNA, 106 bp, Homo sapiens
tgttttttgggggggggtttgagataggggtctcgctctgtcactcaggctggagtgcagtggcatgatcttggctcactgcaaccttgcctcctgggttcaagca

SEQ ID NO: 41163 - DNA, 103 bp, Homo sapiens
cataaattgtggtaatgaactgaagaaatatttcttacagcaactgcttttgtacttttgtttgataaaagtaggtgtgtgaggctttgtttttgcctttatg

SEQ ID NO: 41164 - DNA, 79 bp, Homo sapiens
ggcttttctttggactgtgcagagtgtgcactcccaggcctgctgagtgacccttttccacgcagattcagagagggct

SEQ ID NO: 41165 - DNA, 88 bp, Homo sapiens
gccatatcatatcccactgcatgaatagaccacactgtttctccattcaccagtggatagacacttgggttatttccagtttggaggc

SEQ ID NO: 41166 - DNA, 105 bp, Homo sapiens
ccctcgcctggcccagtgtgcatcacacaacctggatggcagtgccaccctccctggatggctgctggctggcagcttgaatgtcacaccaaggctggaggaagg

SEQ ID NO: 41167 - DNA, 133 bp, Homo sapiens
catgggaggccgtgggcgctgggttttcacgaccctgaaacttgagcctgccctcgctctctctgagcctgtcatccagcagggagcagaggaaggctgcagagctgggaggggcaccctctgtctcagggtc

SEQ ID NO: 41168 - DNA, 98 bp, Homo sapiens
gccaggctgaggccccgggctccccatgtggtccctctccagactggagacagtctggacaccagggctcctggtggtgctgtatcctcaggccaggc

SEQ ID NO: 41169 - DNA, 99 bp, Homo sapiens
ccgcccccagctgggcgactgttctagttggacctctgtgaccccccaggtcgcagctgtcactcagactctcactttgcccttggtgctggtgggtgg

SEQ ID NO: 41170 - DNA, 75 bp, Homo sapiens
ttgagactgggtctcactcactctgtggtccgggctggagtgcagtggtgcagtcgatgctccttgcagcctcaa

SEQ ID NO: 41171 - DNA, 76 bp, Homo sapiens
gacagcttcagtatcctcagtatgggggctggcttcccccagagtgagtgagtggagagagtgagctgaaagctgc

SEQ ID NO: 41172 - DNA, 111 bp, Homo sapiens
gctgggtgtggtggtgcacacctgtggtcccggctgttcaggaggctgaggtggaaggatcacttgagcctgggaggtggaggctgcagtgagtcatggctgtaccactgc

SEQ ID NO: 41173 - DNA, 80 bp, Homo sapiens
ttgatcccggaagatcgaggctgcagtcccagccactcaggaggctgaggtgggaggatgacttgatcccggaagatcaa

SEQ ID NO: 41174 - DNA, 121 bp, Homo sapiens
actcgtgggagaaggtggggagcccggaccttgttcactgctcttttctctgtctctgagtccctggggctggactgatactggcagtgattatgaccattctgcccgtggtctcagcctc

SEQ ID NO: 41175 - DNA, 64 bp, Homo sapiens
tgactattgactaggaccagagctcagttattgactgttgactgggacaagggctcagtggtca

SEQ ID NO: 41176 - DNA, 81 bp, Homo sapiens
ctcccccgtactcacgggagaaggtggggagcccggaccttgtgtgctgctcttttctctgtctctgagtccctggggctg

SEQ ID NO: 41177 - DNA, 117 bp, Homo sapiens
tccacccccgtgtccacctggatcaaagaccccaccgctgtctctgtccctcactcagggcctgctgaggggcgggtgctttggagcagactcaggtttaggggccaccattgtggg

SEQ ID NO: 41178 - DNA, 77 bp, Homo sapiens
gctgggcctgccgggggcacagcactctcaaatgcccacaatgggggctccgtggctctgtgactccgtggctccgt

SEQ ID NO: 41179 - DNA, 82 bp, Homo sapiens
gggctcactgtgggtctctctgttcacaggggtcctgtcccaggtgcagctgcaggagtcgggcccaggactggtgaagcct

SEQ ID NO: 41180 - DNA, 75 bp, Homo sapiens
ctcactgtgtctctcgcacagtaatacacagccgtgtcctcggctctcaggctgttcatttgcagatacagtgag

SEQ ID NO: 41181 - DNA, 115 bp, Homo sapiens
tagtatctttgtattagtgtgaatgtgtgcttgtatgtattatgtacatatatatatattttttgttatgtgttatggctacaaggtacaaaattgactttaaaataaataacta

SEQ ID NO: 41182 - DNA, 67 bp, Homo sapiens
tttatatacatatatatgtgtgtgtgcatatatatatatatatatatatagtgtgtgtgtgtgtaaa

SEQ ID NO: 41183 - DNA, 84 bp, Homo sapiens
ccaggggcctgtcacacacagtgaatgtcgtagctggcgaaggtgtatccagagctttgcaggagaccttcactgaggccatgg

SEQ ID NO: 41184 - DNA, 84 bp, Homo sapiens
gggagactgtgccctgcaaaagttttttaaaacttttcatttgaaaagttttaaaaaagttctgtcacaggggcagaacttccc

SEQ ID NO: 41185 - DNA, 100 bp, Homo sapiens
ctgcagcactgcctctgccctgcatggaggtttccatctgggctcacagaggatttctctctcagtgtctctagggctataggaagaggtcatgccctag

SEQ ID NO: 41186 - DNA, 162 bp, Homo sapiens
gagatgaagacgccgcggtgtgtctgtgtgtctgtaacccacagagatgaagacgccgcggtgtgtctgtgtgtctctaacccacagggatgaaggcgccgcggtgtgtctgtgtgtctctaacccacagggatgaagatgccgcggtgtgtctgtgtgtct

SEQ ID NO: 41187 - DNA, 119 bp, Homo sapiens
atttgggcttcatttcaggggcagtttttgaactttgtcctgaccccaaaatgttatttattttactaaatggggtctagctacgttttcaggttggccttgaaatcctgggctcaagt

SEQ ID NO: 41188 - DNA, 75 bp, Homo sapiens; identical to SEQ ID NO: 41180

SEQ ID NO: 41189 - DNA, 102 bp, Homo sapiens
gattcttgtacattaagtttgtatcctgagactctaccaaagttgtttatctattttagaattattttggcagagtctttagaattttctatgtgtagaatt

SEQ ID NO: 41190 - DNA, 115 bp, Homo sapiens
ccagctttgttctttttccttaggattgtctaggctatatgggctcttttttggttccatatgaaatttaaagtagtttttttctaattctgtgaagaaagtcaatggtagcttg

SEQ ID NO: 41191 - DNA, 115 bp, Homo sapiens
cttaatttgcttatgaattctaatagtttgtgagaaggctttagttttctttttttaatataagatctttttgtctgctcacaggaaatctgacttccacaattccaaatttgag

SEQ ID NO: 41192 - DNA, 91 bp, Homo sapiens
cacacacacacacacacacacagtgcctatattccccacagtaatgggagggatatgtgcctcactctctgtgtctaccacattggttgtg

SEQ ID NO: 41193 - DNA, 108 bp, Homo sapiens
cagacatggagatatgggaggtgcctctgagcccagggctcactgtgggtctctctgttcacagtggtcctgtcccaggtgcagctgcaggagtcgggcccaggactg

SEQ ID NO: 41194 - DNA, 87 bp, Homo sapiens
atggagggcactgtcattgttcacagaagacagagtcaatcccactcacaaccttctgggaatgtttaaaaaatggcatccctacat

SEQ ID NO: 41195 - DNA, 57 bp, Homo sapiens
gacatggagatatgggaggtgcctctgatcccagggctcactgtgtgtctctctgtt

SEQ ID NO: 41196 - DNA, 87 bp, Homo sapiens
atggagggcactgtcattgttcacagaagacagagtcaatcccactcacaaccttctgggaatgtttaaaaaatggcatcgctacat

SEQ ID NO: 41197 - DNA, 80 bp, Homo sapiens
acatggggacacgtgtgcttgtcagaagaaagagtccacgtggggacatgtttgcttgtctgagagaagagtccatatgt

SEQ ID NO: 41198 - DNA, 75 bp, Homo sapiens
ctcactgtgtctctcgcacagtaatacacagccgtgtcctcgtctctcaggctgttcatttgcagatacagtgag

SEQ ID NO: 41199 - DNA, 82 bp, Homo sapiens; identical to SEQ ID NO: 41179

SEQ ID NO: 41200 - DNA, 82 bp, Homo sapiens; identical to SEQ ID NO: 41179

SEQ ID NO: 41201 - DNA, 77 bp, Homo sapiens
agcttaaagtacagttgtgtgatcatagctcaccttaaatttgagctcctgactcacacaacctttccatcttagct

SEQ ID NO: 41202 - DNA, 82 bp, Homo sapiens
ggggcttcttcagaggaggaatgtggttgttatgtgatgctctcagggcaccaatatatctatatttatctcagaagacctc

SEQ ID NO: 41203 - DNA, 101 bp, Homo sapiens
tagagggatgtctcctggaattgagaattgaatatatatatatatatatatatatatatattccaagataaatcttggtgaacattataaaattgactcta

SEQ ID NO: 41204 - DNA, 107 bp, Homo sapiens
caagttgtcattgtgagtgaatcctgggaaccctgtgctgatattaattctatatttatggatattctctagcatccaggaatattgtcaaataacctatcgagttg

SEQ ID NO: 41205 - DNA, 88 bp, Homo sapiens
atatgtctgggcattaactgtgtctgcaggtgcattagttttagccactggagggctgcctgtgtcactctctgccattcctccatat

SEQ ID NO: 41206 - DNA, 141 bp, Homo sapiens
tgcagtggtgtacaagggggaaagacttcctcttcttcaagtttttcacatgcaccagggatatctgactgttgagacagagctgaagactttctctgctgagctcagcactgtaactgcctctactaaaagaagtttccc

SEQ ID NO: 41207 - DNA, 95 bp, Homo sapiens; identical to SEQ ID NO: 68

SEQ ID NO: 41208 - DNA, 93 bp, Homo sapiens; identical to SEQ ID NO: 69

SEQ ID NO: 41209 - DNA, 95 bp, Homo sapiens; identical to SEQ ID NO: 6311

SEQ ID NO: 41210 - DNA, 103 bp, Homo sapiens
tagtggctcttttctcacagctccactagtcagtgcctcagtggggactgtgtgtgaaggctctgacctcacatttctcttctgcactgccctaacatggagt

SEQ ID NO: 41211 - DNA, 58 bp, Homo sapiens; identical to SEQ ID NO: 1409

SEQ ID NO: 41212 - DNA, 86 bp, Homo sapiens
ataaatataaatgtatattccaaatataaatctatattcaaacaaagaatgtggaagttatatttgaatatatatttggaagttat

SEQ ID NO: 41213 - DNA, 86 bp, Homo sapiens
cacataggattccagaacattgtgtgttggtctgaatgtctgtccctcacatgggattccagaacacacctgctgggttccgagtg

SEQ ID NO: 41214 - DNA, 82 bp, Homo sapiens
cccattagcagtgttctgaaaccctttgggagggagaaacactcacactctcataacagtgttctggaatcctatgtgaggg

SEQ ID NO: 41215 - DNA, 80 bp, Homo sapiens
aatgaatagaatggatagatgctagtttatagtcaattaatttgttaaatatttaatggtatctttttattttatttatt

SEQ ID NO: 41216 - DNA, 58 bp, Homo sapiens
gtgatggagtctcacactgtcacccaggctggagtgcagtggagcaatcttggctcac

SEQ ID NO: 41217 - DNA, 95 bp, Homo sapiens
ggtagtagggtgtctgtttagttcatttttgaaagtaggaccaataggatttctttttatttatttattttttgagacagagtctccctgtcacc

SEQ ID NO: 41218 - DNA, 106 bp, Homo sapiens
aacctcagtatagtgctatgtccttttaaaagtactttgaattatgctatcttcttttttttattatactttaagttctagggtacatgtgcacaatgtgcaggtt

SEQ ID NO: 41219 - DNA, 69 bp, Homo sapiens
tgtgtgtgtgtgtgtgtgtgtgtgtgtgtgtgtccacatatatctcagcatacaataactcataagagc

SEQ ID NO: 41220 - DNA, 112 bp, Homo sapiens
ccaggccaggtttgctgtgctgggcgggaacgtgggagaagtcaccctctgtctgtggcccccgtgggtgcctctgccacccggtccagagacagcagggactctggggagg

SEQ ID NO: 41221 - DNA, 112 bp, Homo sapiens
ggctgctaaggaagtgatgtgggggagccaggtgtctctcgctgtctgtgagtctatgggaaaaaggagaatactgaaaggcactaagtttactgccacgtttagaggagct

SEQ ID NO: 41222 - DNA, 69 bp, Homo sapiens; identical to SEQ ID NO: 41219

SEQ ID NO: 41223 - DNA, 105 bp, Homo sapiens
catgactttttaatgcttgccattctaactggtgtgagatgctacctcattgtggttgtgatttgcatttctctgatggccagtgatgatgagcattttttcatg

SEQ ID NO: 41224 - DNA, 106 bp, Homo sapiens; identical to SEQ ID NO: 41218

SEQ ID NO: 41225 - DNA, 95 bp, Homo sapiens; identical to SEQ ID NO: 68

SEQ ID NO: 41226 - DNA, 93 bp, Homo sapiens; identical to SEQ ID NO: 69

SEQ ID NO: 41227 - DNA, 119 bp, Homo sapiens
gctactgacttttatatgttgattttgtaacctgcaactttactaaatttgtttatcagttctaatagtgttttggtggagtttttaggtctttcctaatataagatcacatcatctgc

SEQ ID NO: 41228 - DNA, 83 bp, Homo sapiens
caaattgtttcttctcggccttgatctcaataattaaagcattttaaagtcaggattgaacagggcattgaagagacagcttg

SEQ ID NO: 41229 - DNA, 117 bp, Homo sapiens
gctgggacttaattcattttacctagaggaatgtccaccttatgaatatatatatttggtctctggatccataatgagcatgatgtgagcactgctggtataacaaaagagcttagc

SEQ ID NO: 41230 - DNA, 58 bp, Homo sapiens; identical to SEQ ID NO: 1265

SEQ ID NO: 41231 - DNA, 58 bp, Homo sapiens; identical to SEQ ID NO: 884

SEQ ID NO: 41232 - DNA, 56 bp, Homo sapiens; identical to SEQ ID NO: 885

SEQ ID NO: 41233 - DNA, 69 bp, Homo sapiens
tgatctttgtggctatacagatgcagaggtgccaacagcttctagcttgttttgttctcagccacttca

SEQ ID NO: 41234 - DNA, 115 bp, Homo sapiens
taagtctatttgtattactcagttcgaaatgttatttttaaattttatttttccataagttattggggcacaggtggtattttgttacatgagtaagttcttcagtagagatttg

SEQ ID NO: 41235 - DNA, 224 bp, Homo sapiens
acattcaattttatatatatatatgtgtgtatatatatatgtgtatatatatgtgtgtatatatgtgtatatatatgtgtgtatatatatgtatatatatgtgtgtatatatatgtgtatatatatgtgtgtatatatatatgtatatatatatgtgtgtgtatatatatgtatatatatatgtgtgtgtatatatatgtatatatatatatatatatatatgc

SEQ ID NO: 41236 - DNA, 113 bp, Homo sapiens
aaattagaatatgcaaaaatattgtaaaattttggaagtgttgtattattgtaaaaagttttactacttttttatacttactttttttacttacacttttttgtatttaattt

SEQ ID NO: 41237 - DNA, 112 bp, Homo sapiens
tagatttctctctatatatataaatatgtgcataatatatgtaatatatatataatgtaagattttatatactatgacatatattaagacataatacaatatataagatcta

SEQ ID NO: 41238 - DNA, 77 bp, Homo sapiens
tcctcacgtttagggagttagtattggaactttggctgatgcaacagtttgagtcactgtctctctgtgctgtggga

SEQ ID NO: 41239 - DNA, 72 bp, Homo sapiens
ccagcctgggcaacctacgagactcttttttttttttttttgagacggagtcttgctctgttgccaggctgg

SEQ ID NO: 41240 - DNA, 58 bp, Homo sapiens
tgagactgagtctcgctctgtcacccaggctggagtgcaatggtgcgatctcatctca

SEQ ID NO: 41241 - DNA, 116 bp, Homo sapiens
actaattgagaggtggcacaatcatagccatgaactctgattttcttaagtaaaaaaccttttttttttttttttgtttttgagatagagtctggctctgtcacctaggctggagt

SEQ ID NO: 41242 - DNA, 123 bp, Homo sapiens
ggagtctcactatgtagctcaggctggttttaaactcctgggctcaagtgatcctcctgcctcagcctctgagagtcactgggattgcaggctaccacatctggctctagcagggaggtcctt

SEQ ID NO: 41243 - DNA, 79 bp, Homo sapiens
caaagtctgcctgtaaatcaagggaaagtatggggaaggtgtcactctttttttttttttgagacacagtctcactttg

SEQ ID NO: 41244 - DNA, 110 bp, Homo sapiens
tggagaaaatggaagaccaaagattatggtgataaggggagtagatattttattttattttttgagatagggtctcactctgtcactcagactggagtgcagtggctcca

SEQ ID NO: 41245 - DNA, 81 bp, Homo sapiens
tggatgccctttgcccactctggctctgacactctgtgccagggctgcccctctacatgggtgtccaccatttgggcctgg

SEQ ID NO: 41246 - DNA, 120 bp, Homo sapiens
agctattctgggtctttgttttctcttctggtgagggatgatatgagtactcaatttgaagtaggcagcatttactttttcttacacattaaagaaaactctcccagagtttaaatagtt

SEQ ID NO: 41247 - DNA, 101 bp, Homo sapiens
gcccagcagccactcccagagcccctggaattctggcccaaggctctctgactgactccttcccagatcttcttggcttagtggctgaagactgacgtggc

SEQ ID NO: 41248 - DNA, 73 bp, Homo sapiens
cacaggaatttaggagtatgggggaaggggtataggtgagaactttgtctctttctgtgtatctgtgtttctg

SEQ ID NO: 41249 - DNA, 110 bp, Homo sapiens
actaaagtgaagattatagacaaaagatctctttcagctctcacattctgtattttttttatacattactgtgtgggttcatgtgtgattttgtatatgtgcatattggt

SEQ ID NO: 41250 - DNA, 76 bp, Homo sapiens
gtctcacgctctgtctcactctacgtgctgacttgggatagtcacactcttcctccaaagtgagaaggggagggac

SEQ ID NO: 41251 - DNA, 113 bp, Homo sapiens
ctggtgtgctactccgacctccctgtaatcagttgcagaaataaactcccgtctttcccagtctgtctgtctgcatctcattaccggaccacaagaacaagcagcaggaccag

SEQ ID NO: 41252 - DNA, 113 bp, Homo sapiens
gccaggaggacattattttagtagctggacagcacagctgtgggttgggggtcaggatgaaggatctttagaagcaaaagtggtgctggagatgagaaatgccactagatggc

SEQ ID NO: 41253 - DNA, 111 bp, Homo sapiens
tgggcatggtagtacgcacctatagtcctagctatttgaggggtgaggtaggaggatcgcttgagcccaaacgttcaaggctacagtgagctatggtggtgccactgtact

SEQ ID NO: 41254 - DNA, 109 bp, Homo sapiens
gtatgtatgtatatatgtgtgcgtatgtatatacacaatatatatgtatttataacagatacatatatgttatggaggtgtgtgtatgtgtatatatatgtgtgtgtat

SEQ ID NO: 41255 - DNA, 147 bp, Homo sapiens
gcccaggatttgagagactgtagtgtgtgatgtgattatccactgcactccaggctgggcaacataatgagaccccatctttttttttttttttttttttgagacagtctcgctctgtttcccaggctggagtgcagtggtgccatc

SEQ ID NO: 41256 - DNA, 79 bp, Homo sapiens
gcccaaatggaataacaaaaagtgttgacattcttcttttttttgagacagtgtctcactctgttgtccaggctggagt

SEQ ID NO: 41257 - DNA, 97 bp, Homo sapiens
tggatttgcctattcttgatttttcatatttttattaatttttaaaagcaaatattggtagctaatacagagtgccaggaataggactaaaaattca

SEQ ID NO: 41258 - DNA, 86 bp, Homo sapiens
tctggggcagagatacatgagctaggcatacagcagagtaaaaaatgtctagcctctcattcagtgagtctgtcattttcccaaga

SEQ ID NO: 41259 - DNA, 109 bp, Homo sapiens
cagcctgggcaacaagagcaaaactctgtctcaaataaataaataattttttttttctttttttttttttttttttggggggatggagtctcactctgtctccaggctg

SEQ ID NO: 41260 - DNA, 78 bp, Homo sapiens
cagcaggttgaaggactgaatgaaaataagtaactacatctgcatcattatcactgccactctcttcagctactgctg

SEQ ID NO: 41261 - DNA, 112 bp, Homo sapiens
aagtatatatatatatatgtgtatatatatatatatatatatgtatatgtgtgtatatatatatatatatatatatatatatatatatatatatgtatatgtatatatattt

SEQ ID NO: 41262 - DNA, 113 bp, Homo sapiens
tttgaatccccagcactactagcatagtgcctggcatgtaataatttctcaatatgtacttctgaataaattaatagttgaaactgccacacatgttaaatgctgtgggcaga

SEQ ID NO: 41263 - DNA, 91 bp, Homo sapiens
gaacgtatttgtgtcctttgatgtctcagaatggctggggattgtgtggtaagttctctctcagatttcggagctccacagatttatgttt

SEQ ID NO: 41264 - DNA, 116 bp, Homo sapiens
ttttaatattggctgagttagcatgaaaacctggcaaagtattttctcggtatttaattaatttttgttctactggggtaagcagttttataaaccaatcagtctttttattaaag

SEQ ID NO: 41265 - DNA, 106 bp, Homo sapiens
tctttatcttttcccaaatttgagtgtcgtgggaagggctctgtttgactcagtgtgagttaggtggcttttccttggactaatcagtggtggccatgggtacagg

SEQ ID NO: 41266 - DNA, 89 bp, Homo sapiens
aaaacagttattgaatgagtgtgtgcctctcattgctaattttttacttattcattgctaatgtaaggatacaatttattgattgtttt

SEQ ID NO: 41267 - DNA, 79 bp, Homo sapiens
gcatctgtcatttttttactttttcatagttgccattctgactggtgtgagatggcatctcactgtgattttgatttgc

SEQ ID NO: 41268 - DNA, 65 bp, Homo sapiens
tctgtcttctctgtctgactgctgtcttttttcacaggggtttggagccaacagaaggaggtgga

SEQ ID NO: 41269 - DNA, 78 bp, Homo sapiens
tctataggtctgatacggggtcaggagtctgctttttttagtgagttgtctaatgattttgatcattagatctggaga

SEQ ID NO: 41270 - DNA, 68 bp, Homo sapiens
tgactcaggttggtagcaagtgaacaatcaaaacatgaatgtatatttgtaatcaaagccatgattca

SEQ ID NO: 41271 - DNA, 113 bp, Homo sapiens
ttttgtgttgttaaaaaaatcagtagttcaatagcacagtatggtgactatagttatcaataatttattgtatatttcaaaatagctagatttggaatgttgtcaacacaagg

SEQ ID NO: 41272 - DNA, 79 bp, Homo sapiens
ccctagcgtctgcctgtgtgcgcgtgcgtgcacacacacatgcacacacacggacacagacacacactcagaaaaaggg

SEQ ID NO: 41273 - DNA, 106 bp, Homo sapiens
agattttggtacttgatcttctaagccaatctttttggcatgtcaaaatatttttcctttcactactgaatttgatggtcatggctttcaagattttgtattttct

SEQ ID NO: 41274 - DNA, 70 bp, Homo sapiens
cttctggtctaatagctcctctctttgcctgctgggctattggcacagagagttcagagtgacctaaaag

SEQ ID NO: 41275 - DNA, 57 bp, Homo sapiens
tatactgtatgtatatgattatatatactctgtgtatgtaatcgtgtattacatata

SEQ ID NO: 41276 - DNA, 66 bp, Homo sapiens
ctgggcagcaccaccagaccctgtctcctgccgagttctcagtggctctgtgtggctgcatcccag

SEQ ID NO: 41277 - DNA, 117 bp, Homo sapiens
ctgtgtcttttagttgtagcatttagcccatttacatttaaggttaatattgttatgtgtgaatttgatcttgtcattatgatgttagctggttattttgctcattagttgatgcag

SEQ ID NO: 41278 - DNA, 69 bp, Homo sapiens
gtgctgattgatcactctgtgtctgtttctccaacgtcctcaggggaaagaacagttatctattagtac

SEQ ID NO: 41279 - DNA, 103 bp, Homo sapiens
acgctgttggcttagtaaaaggaagagctatagatcactttattttattttattttttgagatggagtctcactgtgtcacccaggctggagtgcagtggcgt

SEQ ID NO: 41280 - DNA, 66 bp, Homo sapiens
ctgtggctcatggcctgtaatcccagcactttgggaggctgaggttggaggatcacttgagcccag

SEQ ID NO: 41281 - DNA, 94 bp, Homo sapiens
ttggcagtccccaccccctcacactgtctcagggtctctaccctcaacaagattagattccttttagccagaaagagtagtgagaggctgccaa

SEQ ID NO: 41282 - DNA, 62 bp, Homo sapiens
gagacaaggtctcactctgtcacccaggctggagtgggtgagactttttgagactctgtctc

SEQ ID NO: 41283 - DNA, 58 bp, Homo sapiens; identical to SEQ ID NO: 38489

SEQ ID NO: 41284 - DNA, 64 bp, Homo sapiens
gcatcccttcttgactgctctagggaggttcttctgacctctgagtgtcagtcagtcagcctgt

SEQ ID NO: 41285 - DNA, 87 bp, Homo sapiens
acagacaagaaatcaggagcccttgcactccacgtggcctgcctccctgggcaagtcatttgcctggctctctgtttccttatctgt

SEQ ID NO: 41286 - DNA, 88 bp, Homo sapiens
cctcgagttaaaggagtgcaagggctttgttttattttttaaatttttacttttttttttgagacaaggtctcactctgtcacccagg

SEQ ID NO: 41287 - DNA, 73 bp, Homo sapiens
ccaggactgctggcagagttttgtttttttgtttgttttttgagacggagtctcactctgtcacccaggctgg

SEQ ID NO: 41288 - DNA, 83 bp, Homo sapiens
gctgggaaagcaggggcactcaggaacagtgatgaggccagtatcatggccccactctcactgcctcaccctctgcccccagt

SEQ ID NO: 41289 - DNA, 112 bp, Homo sapiens
tcctctagccctcaggccccattttctggagagactctgtgtctgtgtgtgcgtgtattggcttgtgcccgaggctggagtggctcaggaggttggggagactgtggtggga

SEQ ID NO: 41290 - DNA, 114 bp, Homo sapiens
gttttgttttgtacctcatatgtgagataagaagtccagaatgaattgtttcttagggtatttttttgttttgttttgttttttacctcatatgtgagacaggaagtccagaat

SEQ ID NO: 41291 - DNA, 61 bp, Homo sapiens
tgttcttgtggctctttgtttagattcccttgaggaaacagaagtatgagagcccagggca

SEQ ID NO: 41292 - DNA, 102 bp, Homo sapiens
cctctctctggagctgttcacttctagcaggcgctgatagtcttgaggccggaaacgctgtagatacacaatcagcttggctggtgctgtctcctgtgcagg

SEQ ID NO: 41293 - DNA, 72 bp, Homo sapiens
gggactgcctcagaccctgcctctcacaaactctcacaagaggaggctgtgtcttgtctgcctccagctccc

SEQ ID NO: 41294 - DNA, 95 bp, Homo sapiens
ctgaagtcttgatcggctggaggagctacttccaagaggggtcacttacgtggctgtgcctcagtttctctctggctgttatcaggagacctcag

SEQ ID NO: 41295 - DNA, 133 bp, Homo sapiens
tagggtaacattttaattacagaaagtaatttcattattattgatgagaaacagccaatagtattgttagtttttgtttaaacatgaaatgcctgcagctctggatctgtatctcttctgaatgtatttactt

SEQ ID NO: 41296 - DNA, 104 bp, Homo sapiens
ggttgctcactacatgtgggtatattgaatggactctggctgctgtggtgtttcacactcagtctcccgctcatcagttgcctaaggaccccaagcacacacat

SEQ ID NO: 41297 - DNA, 81 bp, Homo sapiens
gcccatggattaggagtaattttgacttccaagtctttttttttttttttttgagactgagtctcactctgtctcccaggc

SEQ ID NO: 41298 - DNA, 70 bp, Homo sapiens
tcagaaatggaggtaggcttgggtttttgttttgttttgagacagaatctcactctgtctcacaggctgg

SEQ ID NO: 41299 - DNA, 97 bp, Homo sapiens
ggggcagaatggtgggagatgagacagagcagattggggccagatcccttgagtatgggcaataacagtttgtgctgtgctaatacattctgatttc

SEQ ID NO: 41300 - DNA, 116 bp, Homo sapiens
tgcttatgatttccttggctatactggctcttttttggttccatatgaaatttaaagtagttttttccaattctgtgaggaaagtcagtggtagcttgatggggatagcattgagt

SEQ ID NO: 41301 - DNA, 95 bp, Homo sapiens; identical to SEQ ID NO: 68

SEQ ID NO: 41302 - DNA, 93 bp, Homo sapiens; identical to SEQ ID NO: 69

SEQ ID NO: 41303 - DNA, 95 bp, Homo sapiens; identical to SEQ ID NO: 68

SEQ ID NO: 41304 - DNA, 93 bp, Homo sapiens; identical to SEQ ID NO: 69

SEQ ID NO: 41305 - DNA, 86 bp, Homo sapiens
gccgttggggcggggaggacaactgtgtatcaacagactgattttttttttttttttgagacggagtctccctctgtctcccaggc

SEQ ID NO: 41306 - DNA, 73 bp, Homo sapiens
gggccagacacagtgactcacacctgtaatcttagcattttgggaggcctaggtgggaggatcacttgagccc

SEQ ID NO: 41307 - DNA, 81 bp, Homo sapiens
aaagagagagggggagaaaataggaaataatatagtgctaggtaaggatattgttttatgatttttttttttttttttttt

SEQ ID NO: 41308 - DNA, 63 bp, Homo sapiens
ggactcagagatgtgagggtgctcaccatggcagagatgacccgggagacattgactgggtct

SEQ ID NO: 41309 - DNA, 81 bp, Homo sapiens
tgtcaagggaggaggcagggggttagcaaagcctcagagtgaatggaatgaggccagctgtctctctgtctctggctggca

SEQ ID NO: 41310 - DNA, 60 bp, Homo sapiens
ggcctctctcctgtctcactctctgcccatccaaatgcaagacccagaagggaggaagcc

SEQ ID NO: 41311 - DNA, 58 bp, Homo sapiens; identical to SEQ ID NO: 1215

SEQ ID NO: 41312 - DNA, 70 bp, Homo sapiens
cctaggtgtgggatggctaacaggtaacaggagtgacacggtctctgcctctttgcagcccacagtcagg

SEQ ID NO: 41313 - DNA, 95 bp, Homo sapiens; identical to SEQ ID NO: 68

SEQ ID NO: 41314 - DNA, 93 bp, Homo sapiens; identical to SEQ ID NO: 69

SEQ ID NO: 41315 - DNA, 113 bp, Homo sapiens
gagcaatgagaagttgatttgttagtttgtttggagtattcctatgaactcgtgaatttttatatattcaagagtgttccaaaaacttgcattcatcattatttttgatgctc

SEQ ID NO: 41316 - DNA, 99 bp, Homo sapiens
cactgggacttaccatcttttgttgctttctgaagctgagccactctgtgagtgagcccaagctagccagatggatgatgagaaacacatggcccagtg

SEQ ID NO: 41317 - DNA, 69 bp, Homo sapiens
cgtgtctttctcacagacagactgggaggtgtagccttctgccctttcttacatgagtattaagatacg

SEQ ID NO: 41318 - DNA, 95 bp, Homo sapiens; identical to SEQ ID NO: 580

SEQ ID NO: 41319 - DNA, 93 bp, Homo sapiens; identical to SEQ ID NO: 69

SEQ ID NO: 41320 - DNA, 118 bp, Homo sapiens
taatatatatatctatatgtgtgtatatatatatgtgtgtatatatgtgtgtgtgtatatatatgtatatacacacatacacatacacacatacatacacacaaaggggagtttatta

SEQ ID NO: 41321 - DNA, 84 bp, Homo sapiens
gatctagattttcaggttccccagtggggatgtgtgttcagagacagagtttctctctcacacattttgggaactcagtttttc

SEQ ID NO: 41322 - DNA, 87 bp, Homo sapiens
ctcagtaagattttctaatttttttgtagctatcctctcctatctgagaggatctccagggatcattctagaagtttcttttctgag

SEQ ID NO: 41323 - DNA, 119 bp, Homo sapiens
aggcttgtaaacttggggatgacatgactatatctttttttttttttttttttttttttttttttttttttttttaggtgaagtctttctccgtctcccaggctggagtgcagtggttt

SEQ ID NO: 41324 - DNA, 117 bp, Homo sapiens
ctatccatttatttgctatctcatgtgtatgtgtatatatatgtgtgtgtgtatatatatatatatatacacacacacatatatatatttgtatggttactgcaattgggaatagta

SEQ ID NO: 41325 - DNA, 95 bp, Homo sapiens; identical to SEQ ID NO: 6311

SEQ ID NO: 41326 - DNA, 73 bp, Homo sapiens
gtttcgtgtgaatctttttaatgaattgagtgtcctatattctttgttttattataaagtgttcagatgaggc

SEQ ID NO: 41327 - DNA, 200 bp, Homo sapiens
gtatatatatacatatatatgtgtgtgtatatatatacatatatatgtgtgtgtatatatatacatatatgtgtgtgtatatgtgtatatatgtatatgtgtatatatgtatgtatatatgtgtatacatgtatatatgtatgtatatatgtgtatatatgtatgtatatatgtatatatgtgtatatatatgtatgtat

SEQ ID NO: 41328 - DNA, 95 bp, Homo sapiens; identical to SEQ ID NO: 68

SEQ ID NO: 41329 - DNA, 93 bp, Homo sapiens; identical to SEQ ID NO: 69

SEQ ID NO: 41330 - DNA, 112 bp, Homo sapiens
gtgtggttcactgaacatggcaatgtgggaaaggctgctggattcttttttttttttttaattttattgtaagttccaggatacatgtgcagaatgtgcaggtttgttacat

SEQ ID NO: 41331 - DNA, 105 bp, Homo sapiens
gcaccagtcagaaaacttgagtcctagtccaaatgcgactctatctaggagcatatgatttcagaagccttggcagtgttaatttgattacagatgagtctgggc

SEQ ID NO: 41332 - DNA, 131 bp, Homo sapiens
atgtatcatatatatatatatatatatgtatcatatatatatgatgtatcatatatgtgtatatatatgtatcatatatatgtatcatatatatatgatatatcatatatatgtatatgtatgtatcatat

SEQ ID NO: 41333 - DNA, 80 bp, Homo sapiens
gggctgttttttgtcactcagtgtgtcacggtataattttacctatcattatttcagctgaaggtggcatttagcagttc

SEQ ID NO: 41334 - DNA, 88 bp, Homo sapiens
catagataacaccatttttaagagtcagttaactttgtagtactttatatttattagagaggcaactgaagtggtgagactagctgtg

SEQ ID NO: 41335 - DNA, 95 bp, Homo sapiens; identical to SEQ ID NO: 68

SEQ ID NO: 41336 - DNA, 93 bp, Homo sapiens; identical to SEQ ID NO: 69

SEQ ID NO: 41337 - DNA, 82 bp, Homo sapiens
gctttctccattggcactggctgaattctgccctctgttgcttccagctgttacagggcagcactgggttccaatgcaaagt

SEQ ID NO: 41338 - DNA, 84 bp, Homo sapiens
ttccatcactttattttcagtctctgtgtgtctttacagatgaaatacatttcttataggcaacagatatttggggaggaggag

SEQ ID NO: 41339 - DNA, 91 bp, Homo sapiens
atgctcaatatatatgaatattttcttaatacacatgtatgtatatgtatattatttactaaaatacatgtgtatgcatatatacgtgcat

SEQ ID NO: 41340 - DNA, 94 bp, Homo sapiens
atatatacatatgtatatgtatatatatatatgtgtgtgtatatatatatacacacacatatctcatatatatacacatacatatatatcatat

SEQ ID NO: 41341 - DNA, 79 bp, Homo sapiens
tatatgtatgtgtatatatatgagatatgtgtgtgtatatatatatacacacacatatatatatatacatatacatatg

SEQ ID NO: 41342 - DNA, 58 bp, Homo sapiens; identical to SEQ ID NO: 1305

SEQ ID NO: 41343 - DNA, 58 bp, Homo sapiens
tgagactgagtctctctctgtcgcccaggctggagtgcagtggcgtgatctcggctca

SEQ ID NO: 41344 - DNA, 91 bp, Homo sapiens
atggcttaaagcaaattctatatttttgtctttcttttgataatgcacaggacaaaaggatacagattgatgagaatttttctttatccat

SEQ ID NO: 41345 - DNA, 95 bp, Homo sapiens; identical to SEQ ID NO: 68

SEQ ID NO: 41346 - DNA, 93 bp, Homo sapiens; identical to SEQ ID NO: 69

SEQ ID NO: 41347 - DNA, 103 bp, Homo sapiens
atattaactgagcacactcccaaccccaataacataggctttttatttttttgtaaggaataaggggagaatgaatattgggtggctaccaagcagtctgtgt

SEQ ID NO: 41348 - DNA, 95 bp, Homo sapiens; identical to SEQ ID NO: 68

SEQ ID NO: 41349 - DNA, 93 bp, Homo sapiens; identical to SEQ ID NO: 69

SEQ ID NO: 41350 - DNA, 94 bp, Homo sapiens
ttgtgtatataaactacttagacactagagagacatcagtgacaaagcccagctttgccttgataggctctatgttttgatggaagatagacaa

SEQ ID NO: 41351 - DNA, 96 bp, Homo sapiens
tgtgtatctcatctgtccagtgcattagttgtgtggccctagagaaaattcattttatttcattttgagtgcacacaagatgcagtgtattacata

SEQ ID NO: 41352 - DNA, 61 bp, Homo sapiens
aatgtgtgtgtctgtgtgtgtgtatatatatatacacataccacctgataaggtatacatt

SEQ ID NO: 41353 - DNA, 95 bp, Homo sapiens; identical to SEQ ID NO: 68

SEQ ID NO: 41354 - DNA, 93 bp, Homo sapiens; identical to SEQ ID NO: 69

SEQ ID NO: 41355 - DNA, 115 bp, Homo sapiens
cacaggttgtgatcttttattaagcgtggcacatatggctgtggcattgtacacagttgtataattttatatcaaagtcatgtgcaagcccaaatctaaaatatacacttgtgaa

SEQ ID NO: 41356 - DNA, 86 bp, Homo sapiens
ggcttccagatggacactctctccctgtgtcctcacacattctttcctctgttcctgcacagggttttggtgtttccctgagtgtc

SEQ ID NO: 41357 - DNA, 116 bp, Homo sapiens
tttatggccaagtaatatgccattgtatagatataccacatttatttatctatttgtacattgatgaacatttgggttgtttctatcttttggctattataaataactgctataaa

SEQ ID NO: 41358 - DNA, 117 bp, Homo sapiens
cccttaggctcacataatacttcagatacctctaaattaagtgtgcatgtcttgtcattttaaactgggatgtgcatatgtttggtcatttggacagatgtttgacttgtcagatgg

SEQ ID NO: 41359 - DNA, 112 bp, Homo sapiens
aattctccctttttgtagtgtgtatatatatatatatatatatatatatatgtatgtgtatatataaaacatatatgtatatatatttgcatatatacaaacatgtagaatt

SEQ ID NO: 41360 - DNA, 112 bp, Homo sapiens
agtgtagctgtatcatgtttagtggatttatgactatattattgtctgtacttgaagattaagtaacgtttaaggaaatgtatgttggtgccaagttgataagggttggact

SEQ ID NO: 41361 - DNA, 78 bp, Homo sapiens
tctgttgttcagagaagaaagtgactataatagggtaagctactaaggcacaattttctcatactagtagacaacaga

SEQ ID NO: 41362 - DNA, 100 bp, Homo sapiens
atacatatatactataaaccacaatatttatatatacacatacacacatacagcactatatgtgtatttgtatagatagatatatatagtttatgtgtgt

SEQ ID NO: 41363 - DNA, 87 bp, Homo sapiens
tatatatgtgtttgtgtatatatgtatatgtatatacacaccactatatatacatatacacacacatatactactacactatatata

SEQ ID NO: 41364 - DNA, 115 bp, Homo sapiens
ctcctgccattagctgctgtttgttctattttctcattattgtatctttttcttgaccttgagagaagtgactgtggaaagcctggaatgaactgaaagatgttatatctgggag

SEQ ID NO: 41365 - DNA, 105 bp, Homo sapiens
gctgtaaaggctacagttacacaacagattttaaattctcttgtgaaagttatgatagaattgactgaacaaagaagtatctgtgcagctgctggcacttgtggc

SEQ ID NO: 41366 - DNA, 95 bp, Homo sapiens
taatagtttatttggccttatgtatttttttttttaagacagggtcttgctctgtcacccagactggagtgcagtggtgtgatcatggctcattg

SEQ ID NO: 41367 - DNA, 116 bp, Homo sapiens
tgctggttcatatgagatctggtagtttaaaagtgtgtggcacataccccctccatcctttgtttttgttttgttttatttttttttagactggatctcactctttcactcagaca

SEQ ID NO: 41368 - DNA, 89 bp, Homo sapiens
tcctctgtagatgaagcatgcaggcttgattgtagagaaaaaagcttgatagcagtgaggatgcaggatgtttggtataatactgtgga

SEQ ID NO: 41369 - DNA, 65 bp, Homo sapiens
tagctatatgtgtgtgtatatatgtgtgtatgtttaaatatatgtatatacatttagcatagcta

SEQ ID NO: 41370 - DNA, 107 bp, Homo sapiens
agcagttaaccaaggactttattatattttgatgtctatctatatattaatgtatattcaaatttaatctgattgtttcagtgtgtgttgaagttctgtaacttgct

SEQ ID NO: 41371 - DNA, 127 bp, Homo sapiens
ccatcatgctctgtacattgattagttgaaattatagttaaaggaagagatttccctttccatttatttttttcatttgtatgtattagtatggggtaatggaatcttattttttccctatagtttt

SEQ ID NO: 41372 - DNA, 58 bp, Homo sapiens; identical to SEQ ID NO: 7309

SEQ ID NO: 41373 - DNA, 94 bp, Homo sapiens
tctatataatttctatttatctgtgtgtgtgtatatatatatgtgtgtatatgtgtgtgtatatacatatatatatcaatgaggatttacaaga

SEQ ID NO: 41374 - DNA, 69 bp, Homo sapiens
tatatatctatatatatgtgtatatatagattccataaatctatatatgtatgtgtgtatatatatgta

SEQ ID NO: 41375 - DNA, 87 bp, Homo sapiens
tacagttatattatatatgtgtgtatatatacataaatgtatatacaaatatttatatatatgtatatacccatatgatatcaggta

SEQ ID NO: 41376 - DNA, 95 bp, Homo sapiens; identical to SEQ ID NO: 580

SEQ ID NO: 41377 - DNA, 93 bp, Homo sapiens; identical to SEQ ID NO: 69

SEQ ID NO: 41378 - DNA, 100 bp, Homo sapiens
ttacagatctaaatttctatatctgtaaaataaagaaggttgattttatgtgatttcaaaaaatatatctttttttgacagtcatagaagttttatgtaa

SEQ ID NO: 41379 - DNA, 79 bp, Homo sapiens
cccactagctaatgtaattagcttgtttgctaaaaagtctgcttttagcatgtttacaaatgtattagtctgctagggg

SEQ ID NO: 41380 - DNA, 86 bp, Homo sapiens
cttttgttccacaagagagagtggagatagtggtgactaatcccaaatgaagcttcttgacactctccctagtcccttcacagaag

SEQ ID NO: 41381 - DNA, 85 bp, Homo sapiens
actgaataagaggtttgcctacatcaagctagggcatttttttttctattaaaagtagccaagatgagaaaatttgctgttcagt

SEQ ID NO: 41382 - DNA, 85 bp, Homo sapiens
gggcatttatagctttctatgtcactgaattattttttaatttttagaacaattttagtttagtgaaaagttatgaagatagttc

SEQ ID NO: 41383 - DNA, 77 bp, Homo sapiens
aggatatgtaaatatatacgtgtgtgtgtatatatatgtatatcttgtatacacacatgcatataattattatttct

SEQ ID NO: 41384 - DNA, 58 bp, Homo sapiens
tgagacagagtctctctctgttacccaggctggagtgcagtggcgagatcttggctca

SEQ ID NO: 41385 - DNA, 95 bp, Homo sapiens; identical to SEQ ID NO: 68

SEQ ID NO: 41386 - DNA, 93 bp, Homo sapiens; identical to SEQ ID NO: 69

SEQ ID NO: 41387 - DNA, 95 bp, Homo sapiens; identical to SEQ ID NO: 68

SEQ ID NO: 41388 - DNA, 93 bp, Homo sapiens; identical to SEQ ID NO: 69

SEQ ID NO: 41389 - DNA, 95 bp, Homo sapiens; identical to SEQ ID NO: 68

SEQ ID NO: 41390 - DNA, 93 bp, Homo sapiens; identical to SEQ ID NO: 69

SEQ ID NO: 41391 - DNA, 92 bp, Homo sapiens
cggccatcttggctccaaaatccaggtattccaaagttaattttttaaatactttgggaagaatctaccagtgtttccaaagctgtgagtcg

SEQ ID NO: 41392 - DNA, 78 bp, Homo sapiens
tatatgtatgtgtgtgtgtgtatatatatacataaatgtatatgtatgtgtatatatatatacacacacacacatata

SEQ ID NO: 41393 - DNA, 68 bp, Homo sapiens
acgtgtgtatgtatgtatgtatatatttatatagagatatatgtatgtgtgcatgcatcgatatatgt

SEQ ID NO: 41394 - DNA, 83 bp, Homo sapiens
caatttttttttaatcagccaggtatggtgggctgcacctgtggtgccagctaatcaggaggctgaggtaggaggatcagttg

SEQ ID NO: 41395 - DNA, 74 bp, Homo sapiens
cgtgtgtgtgttgtatataaagtgtgtgtgtgtatatacatatacacacatatgtgtataaatatatgtatatg

SEQ ID NO: 41396 - DNA, 81 bp, Homo sapiens
gactgatagaccgtgtgtgtgtgtgtgtgtgtgtgtcttgagcactttcttactttctgacactacaaggttctctcagtt

SEQ ID NO: 41397 - DNA, 176 bp, Homo sapiens
tatacatatatatgtgtatatacacatatatgtgtatatgtgtatatatgtatgtgtatatatgtattgtgtatatgtatatatgtgtgtatatgtgtatatatgtatgtgtatatgtgtatatatgtgtatatatatgtgtatatgtgtatatatgtgtacatgtgtatatgtgt

SEQ ID NO: 41398 - DNA, 74 bp, Homo sapiens
ctaggactttttgtctctgcatggaaatctgaatatatttatatgttggagtgacatctctacaggaagcctag

SEQ ID NO: 41399 - DNA, 278 bp, Homo sapiens
tatatatatatatatacacatatatgtgtatatatatgtatatgtgtatatacgtgtatatacgtatatacgtgtatatatacgtgtatgtgtatatatgtatatgtgtatatatacgtatatgtatatatacatgtatatgtatatgtctgtatatatgtatgtatgtctacatacatatgtgtgtatatatgtatatacatatgtgtgtatatatacatatatacatatatacatgtgtgtatatatacatatatacatgtgtgtatatatacata

SEQ ID NO: 41400 - DNA, 140 bp, Homo sapiens
acgtatatgtatatacactacatacatatatacatatatgtatatatgtatacatgtatgtatatatgtatatatacatatatgtatacacatgtatacacacaatgtgcacacatgcatacacatatatgtgtacatac

SEQ ID NO: 41401 - DNA, 106 bp, Homo sapiens
atatgtatacatacatatatacgtatgtgtgtgtatatatatacatgtatatgtgtgtatgtatatgtgtgtatgtatatacatgtatatgtgtgtgtatatatat

SEQ ID NO: 41402 - DNA, 109 bp, Homo sapiens
ctgcatgatctgttctctgcaggtgctggaaaaggtcagagaaaatcatcatcataaagtgaagtgattttcttctttatgagctcctgatgtaaacagactgatgagc

SEQ ID NO: 41403 - DNA, 66 bp, Homo sapiens
gatatgtgtgtatgcgtatgtgtatgtgtatgtgtgtgcagacacaacacacagggtgcttatatc

SEQ ID NO: 41404 - DNA, 86 bp, Homo sapiens
atatataaattaatacacatacatgtttatatgtacatttatatgtacatacatatacatacatgtttatatgtacatttatatgt

SEQ ID NO: 41405 - DNA, 98 bp, Homo sapiens
cattatatgtaaacagcataagttttgggtatgtcatatgtaagtggaacatattattttatattatgttccctttcctacaggttgtttcaataatg

SEQ ID NO: 41406 - DNA, 86 bp, Homo sapiens
tgtatatgtgtgtgtataaatgtatgcatatcactattcagttccttgtttgattatatgtgtatatatatacacatatatatata

SEQ ID NO: 41407 - DNA, 118 bp, Homo sapiens
ctggtgtcctaacaattcctctattcaaactgaaaagggatatattctctttgttgcaaagtattaaatttgtcccttgagattagtgtgtaggcagttttaaaggatgaaacaggat

SEQ ID NO: 41408 - DNA, 98 bp, Homo sapiens
tgcctgccaattcttggttatctcttttcatgtgtaaatgaggttctaggttgaacagtattggtatctgagacagagtttcaagatatctccagaca

SEQ ID NO: 41409 - DNA, 93 bp, Homo sapiens
ctaacatcttcctatctatgtctggcatagggagatagaaaataaatattttatgggccagtggaatgatgaatggatggatggatggattag

SEQ ID NO: 41410 - DNA, 85 bp, Homo sapiens
tatgggttataacctagaatttatcagttaatgtttataaattactccacatattgctgattaattttgttttatatgacctgta

SEQ ID NO: 41411 - DNA, 77 bp, Homo sapiens
ggatgaagaaaatgtatatatacacacatatatatgtgcgtatatatatgtatatatgtaccacattttctttatcc

SEQ ID NO: 41412 - DNA, 81 bp, Homo sapiens
ccacacagtctcactgaatatcttcttattatgtcactgagatttgaagcaaatataggatgatgcagtgaaaacaagtgg

SEQ ID NO: 41413 - DNA, 275 bp, Homo sapiens
atatatatgtgtgtgtatatgtatgtatatatgtatatatattttcatcatatatatgtatatatatatattccatcatatatatgtatacatatattccatcatatatatgtatacatatattccatcatatatatgtatacatatattccatcatatatatgtatatatattccatcatatatatgtatatatatattccatcatatatgtatatatatattccatcatatatatgtatatatatattccatcatatatatgtatatatatat

SEQ ID NO: 41414 - DNA, 76 bp, Homo sapiens
gattgcttttttatatatgaaattgaaattggttgaattcaacaaatagcaatttcattgtataggaagataagtc

SEQ ID NO: 41415 - DNA, 102 bp, Homo sapiens
attgattaatatttataaaatattcaaaatgcaaattctcatttatgattcaaatatgaaaatatttatatcaagattagcatttgctattttgagttcaat

SEQ ID NO: 41416 - DNA, 62 bp, Homo sapiens
tatatgtgtgtatatgtatatatttgtatatacatacatatgtgtatgtatacatacatata

SEQ ID NO: 41417 - DNA, 91 bp, Homo sapiens
agagatgtcccttcttctgaggatgaaggtagaatggcaatgtagataaaattctcattttagatgttttggtaagaatggggaaagcttt

SEQ ID NO: 41418 - DNA, 89 bp, Homo sapiens
ggaggcaagtgagagaaaaggtgccaggctctttttaacaaccggttctcccaggaactaagaagagtgagagctcactcattccctcc

SEQ ID NO: 41419 - DNA, 82 bp, Homo sapiens
ggtctcttagtgtttccatatgaattgtaggaattttttttctatttctgtgaagaatgtgattggcattttgatagggatc

SEQ ID NO: 41420 - DNA, 104 bp, Homo sapiens
ccttagctgtgtcccagagattctggtatgttgtatctttgtttggaactatttttaatattcttcagtgcaacctgctggaatgactaatagctgcaattagg

SEQ ID NO: 41421 - DNA, 87 bp, Homo sapiens
cttccttttcaagagtatttgagtattctgggtctcttgaatttctatatgaattttaggatctgctcatcaatttctgccaggaag

SEQ ID NO: 41422 - DNA, 95 bp, Homo sapiens; identical to SEQ ID NO: 68

SEQ ID NO: 41423 - DNA, 93 bp, Homo sapiens; identical to SEQ ID NO: 69

SEQ ID NO: 41424 - DNA, 94 bp, Homo sapiens
atccaagaaagacctccccaattaacttttagagttgaaattcaggagactgtgtctcagactctttcaggtaaagtgaacaaatattttggat

SEQ ID NO: 41425 - DNA, 82 bp, Homo sapiens
tatgttttagttgtatcacagtgagaacagagtgagtggaattagattctatcacttgaaattccctgtagtgcagaacatg

SEQ ID NO: 41426 - DNA, 95 bp, Homo sapiens; identical to SEQ ID NO: 68

SEQ ID NO: 41427 - DNA, 93 bp, Homo sapiens; identical to SEQ ID NO: 69

SEQ ID NO: 41428 - DNA, 101 bp, Homo sapiens
agaagctgaagcaggatgtaaagaattgaattcacttaaatgcatccagatcagtctgtggacacttggtgaatttttttgaggttttgttttccgttttt

SEQ ID NO: 41429 - DNA, 105 bp, Homo sapiens
agtacattgattttgtaacctgagactttactgaatttgtttatcacatctaggcctctttttgtggcgtctttaggattttctaggtatgcgatcatattgtct

SEQ ID NO: 41430 - DNA, 88 bp, Homo sapiens
cataaggcacagtgatagatgacagaagtgacactgcctattcagaaggtagtggtatacttttcaataactactgctggaaatattg

SEQ ID NO: 41431 - DNA, 98 bp, Homo sapiens
gctttctcctctctgcgtctgcctgtcccactgtgcctctccctcataaggatgcatgtgatggtatttagggctcatctgcataattcaggataagc

SEQ ID NO: 41432 - DNA, 56 bp, Homo sapiens
gagccagggtctgtctctgtcacccaggctggagtgcagtggcaccatcatagctc

SEQ ID NO: 41433 - DNA, 114 bp, Homo sapiens
ccggctgccgccattacaatccctcctccatctgcccgtctcactcactcactttaggggaagggggggcctcggcgggaggggtggggggagagttgggaaggggataggcgg

SEQ ID NO: 41434 - DNA, 58 bp, Homo sapiens
tgagacggagtctcactgtgtcacccaggctggagtgcagtggcgtaatctctgctca

SEQ ID NO: 41435 - DNA, 115 bp, Homo sapiens
tatagtaaagtgcattttgcttaactccggatagtaggattaggggcaatatttattctatattgttacttggttttaaatttcccagattttaagagatatgttactttttgtg

SEQ ID NO: 41436 - DNA, 113 bp, Homo sapiens
gtgtcaggtttgggggcagacatgacagtatattctttattttaaaagatacgttttctataattttttttttttttgagatagagtctcgctctgttgccaggctggagtgc

SEQ ID NO: 41437 - DNA, 76 bp, Homo sapiens
ggaggctgaggtaggaggatcacttgagcccaggagatccagggtgtagtgagccatgatcgcacctctgcactcc

SEQ ID NO: 41438 - DNA, 62 bp, Homo sapiens
ttgagacagagcctcactctgtctcccggggtggagtacagagtgtagtggcacgatctcgg

SEQ ID NO: 41439 - DNA, 58 bp, Homo sapiens; identical to SEQ ID NO: 884

SEQ ID NO: 41440 - DNA, 56 bp, Homo sapiens; identical to SEQ ID NO: 885

SEQ ID NO: 41441 - DNA, 58 bp, Homo sapiens; identical to SEQ ID NO: 315

SEQ ID NO: 41442 - DNA, 60 bp, Homo sapiens
gggcgacagagtgagactccagcttttttttttttgagacagagtctcgctctgtcaccc

SEQ ID NO: 41443 - DNA, 58 bp, Homo sapiens
tgagatggagtctcactctgtcacccaggctggagtgcaatggtgagatctcggctca

SEQ ID NO: 41444 - DNA, 113 bp, Homo sapiens
actgtggatcttgtgccagctgaagcaggtggttgcaatgtgcccaactactcttcagagaagaaactgaggccaaggaggccgacttgcccaagctaacaaaatctgtcagt

SEQ ID NO: 41445 - DNA, 106 bp, Homo sapiens
ctcctgtgctgaagtttggaatggctggtcagatcccatactcactcacacacacatcctctcctgccaggggctgagcatgtagtcacagcagcagcagcaggag

SEQ ID NO: 41446 - DNA, 77 bp, Homo sapiens
agggaagattctggctttttatatttgggggttttttgtttttgtttatttttaaagaggcagcctgtttctttcct

SEQ ID NO: 41447 - DNA, 92 bp, Homo sapiens
tatgtgtaaaaatgctgtctgcttatggttttaatatttaaaatattaaaatatttttttaaaatgaaactagccagacacagtggctcata

SEQ ID NO: 41448 - DNA, 108 bp, Homo sapiens
ccaagtagctgggactatagacatgtgctaccacacccaactaactttttacttttttgtagaaagatttcggtgtgttgacctggctggtctcaaatgcctggcctc

SEQ ID NO: 41449 - DNA, 136 bp, Homo sapiens
tccagctttgttctttttgcttagaattgtcttggctatgtgggctcttttttggttccatatgaaatttaaagtagttttttctaattctgtgaagaaagtcaatggtagcttgatgggaatagcattgaatcta

SEQ ID NO: 41450 - DNA, 73 bp, Homo sapiens
tcacagagcaatccttttttttgagtcagagtctcactcactctgttgcccaggaagaagtgcagtggtgtga

SEQ ID NO: 41451 - DNA, 113 bp, Homo sapiens
ggattgtcttgtctatatgggctctttttttgttccatatgaaatgtaaagtaggttttttctaattctttgaagaaagtcaatggtagctggatgggaatagcattcaatct

SEQ ID NO: 41452 - DNA, 111 bp, Homo sapiens
ttgctaactttgagaaattgaaagatcaatatggctagagagcagtgagtgaagagaaggttatcattcatttactgttgtttcatgatctgtcttcctataaaacggtaa

SEQ ID NO: 41453 - DNA, 95 bp, Homo sapiens; identical to SEQ ID NO: 68

SEQ ID NO: 41454 - DNA, 93 bp, Homo sapiens; identical to SEQ ID NO: 69

SEQ ID NO: 41455 - DNA, 95 bp, Homo sapiens
gtttattgatttgcatatgttggaccagccttgtatcccagggatgaatccaacttgatcatggtggataagctttttgatgtgctgctggattc

SEQ ID NO: 41456 - DNA, 99 bp, Homo sapiens
ctcctaactgggaagacaagcatgcctcctacatatggcatttctggccatttgtgtctgtgacagtctctcagcccaggagtggtgcaggacctgcca

SEQ ID NO: 41457 - DNA, 98 bp, Homo sapiens
ttctctgactaggagacgatgtgctcacactcccacactcagcttcacactttctgttgtgacgtgggtttgggcatctgcttccctgacccagagga

SEQ ID NO: 41458 - DNA, 57 bp, Homo sapiens
ttgtgagacaaggtctcactctgtcacccaagatagggtatggtggcatgctcacag

SEQ ID NO: 41459 - DNA, 211 bp, Homo sapiens
atatattatatatatatttttcatatatatgtatatatatgtgtgtatatatgtatatatatgtatatatgtatatatgtgtatatatacgtatatatgtgtatatatatgtatatatgtgtatatatgtatatatgtgtgtatatatgtatatgtgtgtatatatgtatatatgtgtgtatatatacatatatatatgaaagaaggcatg

SEQ ID NO: 41460 - DNA, 95 bp, Homo sapiens; identical to SEQ ID NO: 68

SEQ ID NO: 41461 - DNA, 93 bp, Homo sapiens; identical to SEQ ID NO: 69

SEQ ID NO: 41462 - DNA, 89 bp, Homo sapiens
atttgtagttagaccattgaagataaagaagacacaaggcttctcactgtctttttatttatatctgtgtgggactctatttggcaaat

SEQ ID NO: 41463 - DNA, 92 bp, Homo sapiens
taactttggaaaacagtttttgattatatattacaaggtgaaagaattgcacacaatgttctttagttaatagcttgtttttcacagggtta

SEQ ID NO: 41464 - DNA, 77 bp, Homo sapiens
ggcttctacttctcattttctagttttcaaacatgtaattctattattacctgttgtatgtgaggctgtgggcagcc

SEQ ID NO: 41465 - DNA, 66 bp, Homo sapiens
ggcttctatgtgcctcctgccttctgctctgtgtgactcagagaagacagagtggaggactctgcc

SEQ ID NO: 41466 - DNA, 113 bp, Homo sapiens
ataggactgcagacttacttagaaacctagtttctcacatatagaatcattgcatcgcaaataatttttattttacagaagagcttctaagtgtattctgacttgtttactat

SEQ ID NO: 41467 - DNA, 68 bp, Homo sapiens
gtgctttgacagaactgacagtagaaactgtatcttagcttacttgaatcagtgctgtagaaaagcac

SEQ ID NO: 41468 - DNA, 109 bp, Homo sapiens
tagatagacatacacaaacatggtatatctcatacatattttatatataatttatgttgtaaacagtgtatatatatgtgtgtatcatgtgacatatatatgctgtgta

SEQ ID NO: 41469 - DNA, 81 bp, Homo sapiens
gctgtgtgtttgaaagtgtaggtcaatgaggatgattgcattcagaatttcatgatctgtgtagtggaacaaattgaaagc

SEQ ID NO: 41470 - DNA, 96 bp, Homo sapiens
atcatttcttggtggtggggacatccaaaagcctctctttagcattatttttgtataataatctggggaggagggagattcacggctagaggggat

SEQ ID NO: 41471 - DNA, 110 bp, Homo sapiens
ccaaatgaaaaactctgagtttctccaactgatgtgtttcattcactcactgtcttactggtcttcattgtagcacatattggagaaatatggtactgagcatactttgg

SEQ ID NO: 41472 - DNA, 83 bp, Homo sapiens
tttccgtctctgtgtcactgagactgttagcgcccacctcataaggtcatggtgcagacagcatgagataagctgagtgggag

SEQ ID NO: 41473 - DNA, 75 bp, Homo sapiens
cctctgggagcctttgactgtgtgggctgtcccctgactcccccgctcttccccagactcactgtctcccactgg

SEQ ID NO: 41474 - DNA, 81 bp, Homo sapiens
atggcattacatgtgcatttgtctatttctctctgctagaatgtaagctctggtggaggtatggctttgttatgtttacat

SEQ ID NO: 41475 - DNA, 58 bp, Homo sapiens; identical to SEQ ID NO: 1725

SEQ ID NO: 41476 - DNA, 93 bp, Homo sapiens
tccctccaatagcaagcccctctgtggctctctgcctgtggtccaccttcccactgtgaaccatgctggcaaggagctggggttatgaaggga

SEQ ID NO: 41477 - DNA, 107 bp, Homo sapiens
ttcgatgtacatagtgttataatggctaatgagtatgatgttatatttaccagtgccatgatcatcttcatcatcatcatccatttatattaacagtgtacacagaa

SEQ ID NO: 41478 - DNA, 79 bp, Homo sapiens
cagaggggctgtaccattttgcgttcccatcaagtgttattctgcactgttgtcagcacttaggattgtcagccttctg

SEQ ID NO: 41479 - DNA, 90 bp, Homo sapiens
gcagcagattttttacaatatatctttttgaatggaggtggtattttctgtcagtctacagtgttcaaatttttgttgtgaatttgatgc

SEQ ID NO: 41480 - DNA, 116 bp, Homo sapiens
tggatattagcgtgaagtcaataagcatttaattctggagagaactctgtgaggagagaggaagcttcatggagctcattcaggagatcttgacttagatttgggaagctcgttca

SEQ ID NO: 41481 - DNA, 104 bp, Homo sapiens
cttgcctgacgtgggactagttctgagtctttttttatataacgttgttggaaaatacaattgccgtgtgtaatattgagaagaactgcctctctaccctcaag

SEQ ID NO: 41482 - DNA, 71 bp, Homo sapiens
ttgaggtggagtctcactctgtcacccagactggagtgcagtgacacagtcttggctctctgcaacctcgg

SEQ ID NO: 41483 - DNA, 150 bp, Homo sapiens
tatatatatacgtagaatatattttatatatatatacacgtagaatatatatattttatatatatatacatagaatatatatattttatatatatagaatatatatattttatatataatatatatatttatatatatgatatatatata

SEQ ID NO: 41484 - DNA, 103 bp, Homo sapiens
agaactctggtgtgtgttatgccacctacactgaggggacttgctgttattttcaatgagagcaaatcttcagattttatgagagtagcaggcaatcagatct

SEQ ID NO: 41485 - DNA, 100 bp, Homo sapiens
tgaggaaatggaggcacagagagcttaggtaacttgcctttttgaacccagttggtctggctgaagagtgtgaggtcttaagacgtgctttaccaactca

SEQ ID NO: 41486 - DNA, 115 bp, Homo sapiens
ttgggaagaaagcagaattgtgttgaccttgtttgaaattttttttttttctttttttgaaatagggtctcactctgtcacccagactggagtgcagtggtgcgatcttggctca

SEQ ID NO: 41487 - DNA, 60 bp, Homo sapiens
tgagacagaatctcactgtgtctcccaggctggagtgcagtggggggtgctctgggctca

SEQ ID NO: 41488 - DNA, 110 bp, Homo sapiens
aagtacttttaacagaatgtaaactccatgaagacagaactttgtgtccattttttggttgttcattggtgtgtcttcaatgcctagtaccttgtcgttcaatagtattt

SEQ ID NO: 41489 - DNA, 76 bp, Homo sapiens
atcactcagtttctctgactctgtttcctcttctgtgaaatggggataacagtggtgctgggggaacggaatagat

SEQ ID NO: 41490 - DNA, 89 bp, Homo sapiens
acaaaaagccacatcacatctgccttgggtctatttctctctgatatttttagtctagagaaacattgaggtggtttccctgcttttgt

SEQ ID NO: 41491 - DNA, 113 bp, Homo sapiens
gagagcaggatctggatgaaaaaggaaaaaaaaaacccctacatttatttacattattttttcagggcatatttttggctctttacttcttatttttggcttatcttgttctc

SEQ ID NO: 41492 - DNA, 75 bp, Homo sapiens
atgtgatatttgttgcactttagtgtttactagatttaggtctcctgtgacacatttgagaggcagctatgacat

SEQ ID NO: 41493 - DNA, 64 bp, Homo sapiens
tgtatatgtatatatgtatacatgtattatatattctctaaatgtgtatctatatacatatata

SEQ ID NO: 41494 - DNA, 95 bp, Homo sapiens; identical to SEQ ID NO: 68

SEQ ID NO: 41495 - DNA, 93 bp, Homo sapiens; identical to SEQ ID NO: 69

SEQ ID NO: 41496 - DNA, 116 bp, Homo sapiens
gtccagtttctgtcatgacttccaaacccagtttggatcagaaaattgctcagagaactcagagagctcaaaacacaaatccatggagctttggaatccaagagagaagttatgat

SEQ ID NO: 41497 - DNA, 109 bp, Homo sapiens
tctgtttgttatttttaggtactctgaggaaatcaccagcccaggaacaatatttatgtttatttcttggcttgaggattcctgtgtcccatgtgtatatacatttagg

SEQ ID NO: 41498 - DNA, 75 bp, Homo sapiens
gaaagagcaagtgacttgatgggtggattggctggtatgtctgttagtctgtgcatctgtctgtctctgtctttc

SEQ ID NO: 41499 - DNA, 114 bp, Homo sapiens
gaactatccaatatgagaactgtatgtatgtatgtgtgcgtgtgtgtatatatatatatatatatatatatatatacacacacgcacacatatacatatgtatatacatggttc

SEQ ID NO: 41500 - DNA, 92 bp, Homo sapiens
acagagcaagacttcgtctggaaaagaaagaaatacctagaaagtttttttttgttttgttttttgttttttgagacagtctctcgctctgt

SEQ ID NO: 41501 - DNA, 114 bp, Homo sapiens
gcactccagcctgggcaacaagagcaaaactccatctcaaaaaaagaaaaaaaagaaaaaacaattttttttttttttgaaacggagtctcgctctttcgcccaggccgaaggc

SEQ ID NO: 41502 - DNA, 58 bp, Homo sapiens; identical to SEQ ID NO: 4279

SEQ ID NO: 41503 - DNA, 77 bp, Homo sapiens
gtatatagctctatatatgtatatatacatatatgggcatatgtgtgtatatatgtgtgtgtatatgtatagtatac

SEQ ID NO: 41504 - DNA, 60 bp, Homo sapiens
tgaggcagagtctcgctctgtcgctcaggctggagtggagcggggcgcaatctcggctca

SEQ ID NO: 41505 - DNA, 83 bp, Homo sapiens
tataaaaatatacgtgtgagtatatttatatatgtgtgtatataaacatacgtatataaaatatatacataaatgtatgtata

SEQ ID NO: 41506 - DNA, 60 bp, Homo sapiens
gtatgtatgtatgtgtatgtgtgtatatatacatatatacatatacacacacacacacac

SEQ ID NO: 41507 - DNA, 82 bp, Homo sapiens
atttcagtgtcttcattggggaacatgcactttattttattttttttgagacagagtctcagtctgtcacccaggctggagt

SEQ ID NO: 41508 - DNA, 110 bp, Homo sapiens
attgggtccacctgggtaatacaggctactctctctatctcaaagttcttttttctttctttcttttttttttgaaacagagtctctgtgttgccaggctggagtgcagt

SEQ ID NO: 41509 - DNA, 56 bp, Homo sapiens; identical to SEQ ID NO: 14407

SEQ ID NO: 41510 - DNA, 109 bp, Homo sapiens
ttggaaaattggataatgcttcatgcttttttagaagtagattctgtatttaatactttatagattttcctcttctaaattgaaattggggtcattttggctttttcaa

SEQ ID NO: 41511 - DNA, 116 bp, Homo sapiens
ataaaaggacatataaaaggcttttttaaggctacgatttatgctaatactttatttatatctgtgaataagccactattagcaaaattgtacccagtgttttattttttatttat

SEQ ID NO: 41512 - DNA, 110 bp, Homo sapiens
ctgggtgcaggactagatttgttatttcaaaaagaaaatgacactaaataggaactatggagaaaatttatttatttattttgagatggcgtttcactcttgttgcccag

SEQ ID NO: 41513 - DNA, 101 bp, Homo sapiens
aaaagagcatcttgatgccaacttgatgtatatatttaaatgccattgttatagttaatggaatgtatacataatagaggcttttgaatcttgaatctttt

SEQ ID NO: 41514 - DNA, 91 bp, Homo sapiens
ctctgcgtctgtcttcatgtggcctttgtgtgtgtgtatctctgtgtgccatctcttcctcttataaggctacaagttatgggatttagag

SEQ ID NO: 41515 - DNA, 120 bp, Homo sapiens
cattctagagagcttttgttttttgttttgttttaagcgagacagtctctctctgttgctcaggctggagtgcagtggcgcaatcgctgctcactgcaacctctgcctcccaggtcccag

SEQ ID NO: 41516 - DNA, 108 bp, Homo sapiens
gacagagcaagactctgtcttaaaaaaaaaaaaaaaaaaaaaaagatacgcacaatttcttttttctttttttttttttgagattttgagacagagtctcgctctgtc

SEQ ID NO: 41517 - DNA, 107 bp, Homo sapiens
gagtgtcagcagcactgggtttgaatctgagccttgccacagattacttggtgaccataatctcagtttcttcttctctcaaacaggtgagtatgctgtacccactt

SEQ ID NO: 41518 - DNA, 96 bp, Homo sapiens
tcaagtagctgggagtacaggtatacaccaccatgctcagataactttttatttttagtagagatgacatcttggtgtttcccaggctggtcttga

SEQ ID NO: 41519 - DNA, 130 bp, Homo sapiens
ttctctctctttttaatgtaattcttctttttctgtctcttaccagaaggaatgtaattctttttttaattagaaggtgaggatgatggttgcattgttggagaggaaaacagaataatgtggggaagga

SEQ ID NO: 41520 - DNA, 213 bp, Homo sapiens
atgtatatatatatgtgtatatatatgtgtgtgtgtgtatatatagtatacatatatgtatatgtatatatgtacatatatacacacatatgtatatgtatatatatgtatatatacacacacatatatacacatatatgtgtatatgtatatgtatatatacatatacatatatatgtatatatgtacatatatacatatacatatatatgt

SEQ ID NO: 41521 - DNA, 71 bp, Homo sapiens
ggccaggcctttgtccacacagcaggcgccaaggaagagctctgtgcctctgtggggctggcatcaatgcc

SEQ ID NO: 41522 - DNA, 79 bp, Homo sapiens
cagcctgtggaactgtgagtcaattaaacctcttctttttttttttttgagatggagtctcactctgtcacccaggctg

SEQ ID NO: 41523 - DNA, 83 bp, Homo sapiens
ggcatatgcctgtggtcctggctactcaggaggctgaggtggtaggatcacttgagcctgggagatcagtgctacagtgagcc

SEQ ID NO: 41524 - DNA, 86 bp, Homo sapiens
gttgtttgtttgttttttgagatggagtctcactcactctgttgctggggctggagtgcagtggtgcaatctcagttcacttcaac

SEQ ID NO: 41525 - DNA, 103 bp, Homo sapiens
gtctgagaagagttatgagcatctctatttttttatttttatttttgtgggtatatagtaggtataaatatttagggggctcatgagatattttgatacagac

SEQ ID NO: 41526 - DNA, 64 bp, Homo sapiens
ccagtaaataagctaagaaatgtttatatttacatttatgtagacataacttggctgataatgg

SEQ ID NO: 41527 - DNA, 106 bp, Homo sapiens
tccagcctgtgtgatgagagcgaaactccgtctcaaaaaaaaaattttaattcttttttgtttgttttttaaaagacagggcctcactcagtcacccagacttgga

SEQ ID NO: 41528 - DNA, 58 bp, Homo sapiens; identical to SEQ ID NO: 2540

SEQ ID NO: 41529 - DNA, 117 bp, Homo sapiens
gcctcccaaagtgctgggattacaggagtgagccaccacgcctggccatctactaaatttttttttaattagctgggctttttggcacctgcctgtgttaccaactgcatgggaggc

SEQ ID NO: 41530 - DNA, 89 bp, Homo sapiens
gtgctttggttacccatgcatctatacatactatttttgtatatgtatccaaaaataatatatagtattgtttggcctgtttaaagtgc

SEQ ID NO: 41531 - DNA, 130 bp, Homo sapiens
tgtgtatgtatatatatacacacacatatatatgtgtgtgtatatatatacacatatgtgtgtgtatatatatacatatatatgtgtatgtgtgtatatatatatatacacatatatatgtgtgtgtgtg

SEQ ID NO: 41532 - DNA, 67 bp, Homo sapiens
tggctcactctctctctgggcatcagcaggcctaccatgttaagccatattgagctgagtcgagcca

SEQ ID NO: 41533 - DNA, 79 bp, Homo sapiens
gagacagactgactctcccagattaatttttttaaaaggctaggggagaactctgggtggccgggtcaggtggctgctc

SEQ ID NO: 41534 - DNA, 85 bp, Homo sapiens
tcgtagccttggaggtggcttggtcattctctcagacaatcactcagaaaatcgttttgactaatcaccttcgtactggctctga

SEQ ID NO: 41535 - DNA, 81 bp, Homo sapiens
tgcattgatgcacgtgcacggcgccaccagttcccgaaagcattttcagagcttaatgcagtgccaggctcggtgtttgca

SEQ ID NO: 41536 - DNA, 85 bp, Homo sapiens
ccagttccagcagaaaggcaagatttaatttgtggttaaataattttatttttcagcatattttttcccactgtgttggagttgg

SEQ ID NO: 41537 - DNA, 75 bp, Homo sapiens
ggtcaataattgtttggtggttcactcctgtaatctcagcactttgggaggctgaggtaggaggatcacttgacc

SEQ ID NO: 41538 - DNA, 106 bp, Homo sapiens
ctcaataaacatttgctgctttaaggtagagataacagaaatgagaaagcacacactagttatctgtgaatttctcagtaaagtaggatggttattatctgctgag

SEQ ID NO: 41539 - DNA, 93 bp, Homo sapiens
cccccacttctggaaataatcattttgattattaattttttccctttaatctcttattgactattaatatgattgttttatccaccgtgggtg

SEQ ID NO: 41540 - DNA, 105 bp, Homo sapiens
gtcactgagtgtatgctgtagggctggcactagacttggtcacatgttctctctgtctcactagcttagctgttaagtttaggtccatagtaagggctgagtgat

SEQ ID NO: 41541 - DNA, 78 bp, Homo sapiens
agaatgctattgctgtaggcaacaggcaatgaggggactgatgtgtggcttcttgattatggaaaaattaagtattct

SEQ ID NO: 41542 - DNA, 70 bp, Homo sapiens
ggggagtgtgtctgttgattttattaggcttgtaaaagcttgaaaacaatttcacgagacgattttccct

SEQ ID NO: 41543 - DNA, 116 bp, Homo sapiens
gtgaatacctttgaaccatcatcttgttgcaattccgtttttccctaccattatgaatggatgtatgtatctataatggatgatgtaatgggcaagagcatgtgctttggagtcat

SEQ ID NO: 41544 - DNA, 112 bp, Homo sapiens
gcaggtatggggagtagtcaactaacatgtgctcttggtttctttgattatattttaagtttctgcaaagtgcttcagcttatgtgttagcagatattccatgtgacattgc

SEQ ID NO: 41545 - DNA, 119 bp, Homo sapiens
tggacatttcacagtttattagcaactctatcgcaaaccaatctttctatttatttaatacttggtccaacattttcatgagggaggggtatgttacagctcttgactgtgggttttca

SEQ ID NO: 41546 - DNA, 110 bp, Homo sapiens
gcatttgctgtgtcctctgtggggatggcttctctggctccctgtgtggctgattcttcctccattcccacgtggactaaccatccgtctcctcgcagccctattaatgc

SEQ ID NO: 41547 - DNA, 77 bp, Homo sapiens
tgctttgagagagaacagcagggaagggtccaactgcagacagaaggttgagacttgttattttcttcttttaagta

SEQ ID NO: 41548 - DNA, 79 bp, Homo sapiens
tgtagtcatagctccttgggaggctgaggtaggaggatcacttgagcccagttcaagtctgcaatgagctctgattgca

SEQ ID NO: 41549 - DNA, 106 bp, Homo sapiens
aactgaccatatatgtgcaggattctctttttttattattttattttattttattattattatactttaagttttagggtacatgtgcacaatgtgcaggttagtt

SEQ ID NO: 41550 - DNA, 115 bp, Homo sapiens
caggtgatttctgcatttcctactgaggtacctggttcatctcattgggactgactggacagtgggtgcagcccatggaggtgagctgaagcagggtgggatgttgcctcatctg

SEQ ID NO: 41551 - DNA, 95 bp, Homo sapiens; identical to SEQ ID NO: 68

SEQ ID NO: 41552 - DNA, 93 bp, Homo sapiens; identical to SEQ ID NO: 69

SEQ ID NO: 41553 - DNA, 94 bp, Homo sapiens
atacatatgtacatgcacatatataaacaatatatgtgtatatacatatataaactataatgtgtatgtatatatgtatctgtactatatatgt

SEQ ID NO: 41554 - DNA, 92 bp, Homo sapiens
gatgtgtgaatattttaaagtccagatataagcagctggaggctgcatgtagaaaggattttttttttttttaagatggagtctcactctgt

SEQ ID NO: 41555 - DNA, 111 bp, Homo sapiens
cttagcctgagatttagaagattttcttctatgtttttgtctgaaagttttattgttttacatttaagtccatgagacagattgaggtgggttttttttcttgtggttttg

SEQ ID NO: 41556 - DNA, 99 bp, Homo sapiens
ttgctcttctagatcagcttctctatttagataaatatatttatcaatttatgttttatcgtaaatatttatctttagagtatgataattcaagggtgg

SEQ ID NO: 41557 - DNA, 71 bp, Homo sapiens
caatgtatttgattatatatgtctgtgtgtgcgtgcgcgcgcgcgcgtgtgtgtgtaagtgaatggcagtg

SEQ ID NO: 41558 - DNA, 95 bp, Homo sapiens; identical to SEQ ID NO: 68

SEQ ID NO: 41559 - DNA, 93 bp, Homo sapiens; identical to SEQ ID NO: 69

SEQ ID NO: 41560 - DNA, 56 bp, Homo sapiens
atatatatgtgtgtgtgtgtgtatatatatatatacacacacatacaaatgtatat

SEQ ID NO: 41561 - DNA, 135 bp, Homo sapiens
tggagtgcatttattatcacaagagtaggtttgtcataaaagcgagtttggctgtctcttgctccctctcagtgtgatgtcttcctcatttcctccatgttatgatacagtaagaaggccctcgccagatgtggc

SEQ ID NO: 41562 - DNA, 95 bp, Homo sapiens; identical to SEQ ID NO: 580

SEQ ID NO: 41563 - DNA, 93 bp, Homo sapiens; identical to SEQ ID NO: 69

SEQ ID NO: 41564 - DNA, 113 bp, Homo sapiens
ggctatttatggtttgcttgtttgtttaattgtggcaaaacatatgtaaaatttatcatttttgtaatatgcatgcagttcagtggcattgagtaaaatcatgttgtatgacc

SEQ ID NO: 41565 - DNA, 97 bp, Homo sapiens; identical to SEQ ID NO: 1307

SEQ ID NO: 41566 - DNA, 88 bp, Homo sapiens; identical to SEQ ID NO: 1308

SEQ ID NO: 41567 - DNA, 81 bp, Homo sapiens; identical to SEQ ID NO: 1309

SEQ ID NO: 41568 - DNA, 77 bp, Homo sapiens; identical to SEQ ID NO: 1310

SEQ ID NO: 41569 - DNA, 114 bp, Homo sapiens
aattcttttggataaatacaatttatttggataagaaataggattgttggatcatgtaatacttttatttttaatttttggatttttttctaagtgaaagtccagtgaagagtt

SEQ ID NO: 41570 - DNA, 105 bp, Homo sapiens
tggttgatgttacatgtgttctttcagccttcagaaagtagagattaagcctatgatatgtaatttcattttatataagtgtgattgacataacaatatttacca

SEQ ID NO: 41571 - DNA, 82 bp, Homo sapiens
ttctgactttgggctaacgggtgttgactttgattgattgtcagagttatatacctctgagtatatatattttaagtttgag

SEQ ID NO: 41572 - DNA, 80 bp, Homo sapiens
gcatactgaaatcaggcattgaggtttccatggctcagacagagactcagagactgacaatacgctgaaattaagaatgc

SEQ ID NO: 41573 - DNA, 109 bp, Homo sapiens
tcattttatatgattagaagcataattttaccatggaaatgaatgtatagcaggtttttgttatatttattattatgattttttttgttatgactgatttattagatgg

SEQ ID NO: 41574 - DNA, 93 bp, Homo sapiens
gaaatatgtcacaaaggtttgattggtatagtgctttccctttgaaagtttttcttttaataagcagaaacattctctctgtgacgttgcttc

SEQ ID NO: 41575 - DNA, 97 bp, Homo sapiens
gtttttaaaattcattctgtcaatatatatcttttaaatgaagcatgtaatccatttacattcaaggttaatattgatatgtgagttttgtttttgc

SEQ ID NO: 41576 - DNA, 58 bp, Homo sapiens
tgagacagagtctcgctctgtcacccaggctggagggcagtgacgtgatctcagctca

SEQ ID NO: 41577 - DNA, 95 bp, Homo sapiens
agaggtccttcacatcccttgtaagttggattcctaggtattttattttctttgtagcagttgtgcatgggagttcacttatgatttggctctct

SEQ ID NO: 41578 - DNA, 113 bp, Homo sapiens
aggttttgtttaaattatttttaaaagcagaattatatgtaggtcaaaagctaaatgacattatttttgaaatacattttctgtcttatcccttgatatgtagtttcattcct

SEQ ID NO: 41579 - DNA, 58 bp, Homo sapiens; identical to SEQ ID NO: 1409

SEQ ID NO: 41580 - DNA, 58 bp, Homo sapiens; identical to SEQ ID NO: 1673

SEQ ID NO: 41581 - DNA, 95 bp, Homo sapiens
caaaggctattttctttcattaatgtatttcataagaatcccacaaatttcatttcaatttttatgtaaatgcacatattgaaagaaatcttttg

SEQ ID NO: 41582 - DNA, 79 bp, Homo sapiens
ttaaggagaaatctctccttttcaattttttttttttttttggaatactttgaggaggacgggtgctggttcttcttga

SEQ ID NO: 41583 - DNA, 119 bp, Homo sapiens
gcctcccatctgccatgatggaatgcaatctctttatttactattattattattattttcaattttttattttaagttcagaggtacatgtgcaggatgtgcaggtttgttacagaggt

SEQ ID NO: 41584 - DNA, 118 bp, Homo sapiens
gtggagattatagtctgaataataaatggaggaatatatatatgtacatatatatctgcatatatattcatatatatacacacacacatatatatattcagacagtgataagtgctat

SEQ ID NO: 41585 - DNA, 98 bp, Homo sapiens
gagcctcacctatcagtgtgattgtactttttttttttttttgaaacggagtctagctctgtcacccacgctggagtgcagtggcacgatctcggctc

SEQ ID NO: 41586 - DNA, 117 bp, Homo sapiens
ttatggtatatttatttgtagttaactagtgtcttggcctaaatgcttgttggatgttttctttaagttaaaaatttgccaggatgtgtctatttattaactttatttggagcatga

SEQ ID NO: 41587 - DNA, 110 bp, Homo sapiens
ccatgtatcttagttgaaatttttctgacttggttacatacaccgttttctcagggtgtgtggctctgactgcctccccggagaaacttgtttaactgtgtatctaatgg

SEQ ID NO: 41588 - DNA, 119 bp, Homo sapiens
gtcattattataattcatagttccttttgaaagcatataataacatcatgacccatcacagaataaagataggaaagtctatgttagtatttgccatgttagaaatgtttgataatgat

SEQ ID NO: 41589 - DNA, 87 bp, Homo sapiens
cctgggtgacagagcgagactcttgtctcaaaaaaaaaaaaattgtttttttctttttcgagacagaatctcgctctgtctcccagg

SEQ ID NO: 41590 - DNA, 138 bp, Homo sapiens
cctgggagacagagcgagattctgtctcgaaaaagaaaaaaacaatttttttttttttgagacaagagtctcgctctgtcacccaggatggagtgcagtggcgcgatctcggttcactgcaagctccgcctcccaggt

SEQ ID NO: 41591 - DNA, 112 bp, Homo sapiens
cccccaaaatgatgagattagaggcatgagccacagtgtctggcctatttatttatttttaattttactttattttattttagacagtgtctcactctgtcatcctggctgg

SEQ ID NO: 41592 - DNA, 112 bp, Homo sapiens
tttggcttcatatcccttatgtttggcttggtaatcattttatgagttggataagattcatagtttttttaaatgatgaggcatcaggcaaacagtgttatgagtagccagg

SEQ ID NO: 41593 - DNA, 118 bp, Homo sapiens
tcccaaactgtttggattacaagcatgagccactgagcccggctcctttccagtatttaaatatgtttagatctggccaggcacagtggctcatgcctgtaatcccaactactaggga

SEQ ID NO: 41594 - DNA, 67 bp, Homo sapiens
gaggctgaggcaggagaatcacttgaacccaggaggcagaggttgcagtgagtctcacactctgtcc

SEQ ID NO: 41595 - DNA, 95 bp, Homo sapiens
gagcatcatgatttacagacacttattctagctgaacttgtttttttgttttttttttttttaagagacaagtctctgggttagtgtggtggctc

SEQ ID NO: 41596 - DNA, 116 bp, Homo sapiens
gctccttaggtggagccatggttgatggacagtcagcttttgccaatgagaccctcagtaaggctcctggcatgaatgctatagaccaagggatggcagcactgaagttgggtagc

SEQ ID NO: 41597 - DNA, 116 bp, Homo sapiens
tctaggtactgaatatgtgtggctttgagggttcattattattattattattattattattattattattattatttttgagacggactctcgctctgtcgcccaggctggagtgc

SEQ ID NO: 41598 - DNA, 66 bp, Homo sapiens
tccagcctgggtgacagactcagtccctgtttcaaacaaagaagtcttccagcccatggacgtgga

SEQ ID NO: 41599 - DNA, 97 bp, Homo sapiens
gctgaagagtaaagctttcagtctatgtgtctttacaggtgatgtgattttcttgtaggcagtatatagtttggttctggtttttaattcactcagc

SEQ ID NO: 41600 - DNA, 89 bp, Homo sapiens
gggcaccatgtagtggagctgtgagaagaaagtcaccatcctgcagaccccagaatggtagatccactgacagcatgcaatgtgtgcct

SEQ ID NO: 41601 - DNA, 81 bp, Homo sapiens
atttgtgcatgtgtatatgtatgtgtgtggcaaatatatatttatttttgcatctataaatatgcatatatattcacaaat

SEQ ID NO: 41602 - DNA, 95 bp, Homo sapiens; identical to SEQ ID NO: 68

SEQ ID NO: 41603 - DNA, 93 bp, Homo sapiens; identical to SEQ ID NO: 69

SEQ ID NO: 41604 - DNA, 95 bp, Homo sapiens; identical to SEQ ID NO: 68

SEQ ID NO: 41605 - DNA, 93 bp, Homo sapiens; identical to SEQ ID NO: 69

SEQ ID NO: 41606 - DNA, 69 bp, Homo sapiens
tctcactcttcctctctcgctcattttgagggaaaccggctgtatgatgagggctgtcctagagagaga

SEQ ID NO: 41607 - DNA, 76 bp, Homo sapiens
gagagagaaacctttcattgccttgtcttttacaatcctttggaatgtaaagaactggctctaaggagtttcatcc

SEQ ID NO: 41608 - DNA, 95 bp, Homo sapiens; identical to SEQ ID NO: 68

SEQ ID NO: 41609 - DNA, 93 bp, Homo sapiens; identical to SEQ ID NO: 69

SEQ ID NO: 41610 - DNA, 92 bp, Homo sapiens
ttgtgtattgattttgtaccctgagactttactgaatttgtttatcagttacaacagtttttggtggagtcttcagggttttctatgcataa

SEQ ID NO: 41611 - DNA, 90 bp, Homo sapiens
caaagtggggagatatatatatatatatgtgtgtgtgtgtgtatatatataatatcacatttatatatcatatatcacattttctttttg

SEQ ID NO: 41612 - DNA, 124 bp, Homo sapiens
atgtatgcatatatgtatatatgtgtatatatgtatatatgtgtatatatttgtgtgtacatatgtatatatgtgtgtatatatgtatatatgtgtatatgtgtgtgtgtatatatatgtatac

SEQ ID NO: 41613 - DNA, 58 bp, Homo sapiens; identical to SEQ ID NO: 3701

SEQ ID NO: 41614 - DNA, 58 bp, Homo sapiens
tgagactgagtctctctctgtcgcccaggctggagtgcagtggcgggatcttggctca

SEQ ID NO: 41615 - DNA, 95 bp, Homo sapiens; identical to SEQ ID NO: 68

SEQ ID NO: 41616 - DNA, 93 bp, Homo sapiens; identical to SEQ ID NO: 69

SEQ ID NO: 41617 - DNA, 103 bp, Homo sapiens
tgcacattctgcacatatatcccagaacttaaagtattttatatatacatatgtgtatatatatgtatatataaatgtctgtgtatatatatgtgtgtgtgta

SEQ ID NO: 41618 - DNA, 85 bp, Homo sapiens
ggtatctggtgagagtcacagagaaaactaatgacgaagtaggatgaaaactttttcttcatttgtatgtcattttcactgagcc

SEQ ID NO: 41619 - DNA, 59 bp, Homo sapiens
ggaccatacagctagactgcttgggttgaaatcccagctctgtcaatatctgtgtgacc

SEQ ID NO: 41620 - DNA, 161 bp, Homo sapiens
tacatatgtatgtagtgtatatacatatataattaataattatatatactacatatacactacatacacatatgtagtatgtaatgtatgtatatatacattatatatgtaatatatgtacacatatatacatatgtatgtttatgtgtatatacatatat

SEQ ID NO: 41621 - DNA, 92 bp, Homo sapiens
ggtgacagggtttggcaatgagtttttatttttattttcggttaattaattaattatttgttttagagacaaggtctctctctgtcaccctg

SEQ ID NO: 41622 - DNA, 91 bp, Homo sapiens
aattgtgagagaggtatgtagcttttttttctttatagctaagctattttacttaggaataaaatgggaagcaggtttgtctgacacagtt

SEQ ID NO: 41623 - DNA, 107 bp, Homo sapiens
tttgcatatgttgagccatccttgaatccctgtaataaatttcaattgatcatgatgatgatctttttaaatgtattgctgaattaggtttgctagtattttgttga

SEQ ID NO: 41624 - DNA, 102 bp, Homo sapiens
gtgtgtgtgtgtgtgtgtgtgtgtgtgtatatatagtacatatatttgtatatacactatatatgtgtatatatacgtgtgtgtgtgtatatatatatatat

SEQ ID NO: 41625 - DNA, 95 bp, Homo sapiens; identical to SEQ ID NO: 68

SEQ ID NO: 41626 - DNA, 93 bp, Homo sapiens; identical to SEQ ID NO: 69

SEQ ID NO: 41627 - DNA, 92 bp, Homo sapiens
gcatagcagattccttaaacagctgtattgggaatagcataagatacaattttatttattgtagaacagctgtttagattttaatggctatc

SEQ ID NO: 41628 - DNA, 105 bp, Homo sapiens
ataaaagctgtatgttctaccacagctagtatcacactgatgaggaaaaactttttaaatttttttgtcaatgatattttgtagacatcagtatacagctcttat

SEQ ID NO: 41629 - DNA, 95 bp, Homo sapiens
ggaacttataatggaagatggcagacaatatgtatatctgtatatgaatatatggataaacaaattgtacatctatatattttatttatatatcc

SEQ ID NO: 41630 - DNA, 76 bp, Homo sapiens
gcataggcacaggaggtgaaggaggtagactaaaacacagagaagtttgagttcacagcatttcatgtgtatttgt

SEQ ID NO: 41631 - DNA, 112 bp, Homo sapiens
aagaatgatttgtttgagagatgaagtacgttgcatagataagactatggtttgtttaaaagtatattaatttctgtaactatgtaacagagcatcccaaatttagcagctt

SEQ ID NO: 41632 - DNA, 110 bp, Homo sapiens
tgcttagtattgtcttggctatacaggctcttttttggttccatatgaaatttaaagtagttttttctaattctgtgaagaaagtcaatggtagcttgatgggtatagca

SEQ ID NO: 41633 - DNA, 88 bp, Homo sapiens
cagaagaaattttgaagcaactgtggtctatcgatctaacaggaaacttaatgagagttcacagtgtgctcactagatgattcttctg

SEQ ID NO: 41634 - DNA, 95 bp, Homo sapiens; identical to SEQ ID NO: 68

SEQ ID NO: 41635 - DNA, 93 bp, Homo sapiens; identical to SEQ ID NO: 69

SEQ ID NO: 41636 - DNA, 96 bp, Homo sapiens
tgagccttataatttgagacagtgactcactctgtcatccaagctggagtacagtcatgcaatcatgggtcattggggtcttaaatcctgagttca

SEQ ID NO: 41637 - DNA, 69 bp, Homo sapiens
tgtgtatatataacctatatatatgaatatgtatatatatatgcatgtgtgtatatatatatatacaca

SEQ ID NO: 41638 - DNA, 70 bp, Homo sapiens
gtatatatatatacacacacgtatatatacatatatatatgtatatatacgtgtgtgtatatatatatac

SEQ ID NO: 41639 - DNA, 70 bp, Homo sapiens; identical to SEQ ID NO: 41638

SEQ ID NO: 41640 - DNA, 99 bp, Homo sapiens
gtatatatatatacacacacgtatatatacatatatatatgtatatatacgtgtgtgtatatatatatacacatatatgtgggtatatatatgtgtata

SEQ ID NO: 41641 - DNA, 60 bp, Homo sapiens
gcatgtgtatgtgtgcatgtgcatgtgcctgtgtgtgtgtgtgtgcatgtgtgtgtgtgt

SEQ ID NO: 41642 - DNA, 149 bp, Homo sapiens
atatatacgtatatatttgagaaaatatatacgtatatatttgagaaaatatgtatgtatatatttgagaaatatgtatgtatatatttgagaaaaaatatatatgcatatatttgagaaaatatatgcatatatattctgctttggta

SEQ ID NO: 41643 - DNA, 99 bp, Homo sapiens
tttcaagattgctatggtctgaataaggtgtctcattaaaattcatatttttgaatttaatacccaatgagataatattaagacatagagtctttggga

SEQ ID NO: 41644 - DNA, 103 bp, Homo sapiens
gatagtagccattgggaagcatgctgtttgagcatctgaagctgcactgcaagtgggagtagcaaggcagagactctgggagaggctgatagatgggggcatc

SEQ ID NO: 41645 - DNA, 67 bp, Homo sapiens
gacacctactgaaacacattttgtacttctgatttacaaaagtatacagtgataaattagtggtgtt

SEQ ID NO: 41646 - DNA, 96 bp, Homo sapiens
ttaaagtctatgctcttagcatctagctggacttgataataatggttgtgaaaatcttctttaatattttagttttggatgtcaggtagattttaa

SEQ ID NO: 41647 - DNA, 97 bp, Homo sapiens; identical to SEQ ID NO: 1307

SEQ ID NO: 41648 - DNA, 88 bp, Homo sapiens; identical to SEQ ID NO: 1308

SEQ ID NO: 41649 - DNA, 81 bp, Homo sapiens; identical to SEQ ID NO: 1309

SEQ ID NO: 41650 - DNA, 77 bp, Homo sapiens; identical to SEQ ID NO: 1310

SEQ ID NO: 41651 - DNA, 105 bp, Homo sapiens
aggattttcatatcaatgttcagtaggaacactggcctgtgtttaatttaattaatttatttatttactgctgtgtctgtctggttttggtatcagggtaatact

SEQ ID NO: 41652 - DNA, 76 bp, Homo sapiens
atatttatatgaatatatatgtattctgcatatataatcatatatatgtattctgcatatataatcatatatatgt

SEQ ID NO: 41653 - DNA, 58 bp, Homo sapiens; identical to SEQ ID NO: 1847

SEQ ID NO: 41654 - DNA, 82 bp, Homo sapiens
ggctccaatgtaataagagtgatttcaggtggaagagctgtaagacacagtctctttctgatgagaaatacttggagaagcc

SEQ ID NO: 41655 - DNA, 80 bp, Homo sapiens
atgtgtatatatacacacacatatatatatgtgtatacatacacacatatacatacacacatatgtgtatatatatatat

SEQ ID NO: 41656 - DNA, 64 bp, Homo sapiens
tatatatgcatatacactggttagtatgtaaatatatttacatgcaaatatgtgtgtatatata

SEQ ID NO: 41657 - DNA, 96 bp, Homo sapiens
agctcataatgagtgtttgtgttccaggactagagagcagatatattaatttttataacaggtactttttttttttggaggaaacaacaatgggct

SEQ ID NO: 41658 - DNA, 83 bp, Homo sapiens
tatatatacatatagatagatagatgtcacatgtatgtatacctttatgtatctatatatctatttgtctctaggtatatgta

SEQ ID NO: 41659 - DNA, 58 bp, Homo sapiens
atatatgtatgtatacatgtgtgtatatatgtatatacacatatatatatatatatat

SEQ ID NO: 41660 - DNA, 116 bp, Homo sapiens
attgtgactgtttgtcctgcttttctcagattttcttccgccatctgtgacagcttcttgatctgtccccaggtaggtggctgtgtttgatgggtgttgctcgtgacagttggggt

SEQ ID NO: 41661 - DNA, 81 bp, Homo sapiens
tgtatatgtatatacgtgtgtatatgtatatatgcgtatatgtatgcatgtgtgtgtatatatatgtatatatgagatgca

SEQ ID NO: 41662 - DNA, 113 bp, Homo sapiens
tctctctcttcctctctctcaatccctcaatatatatttatagatagataaatagatatatattcaaatattagataaatatatattgaaaaagaaagagagacagagtgaga

SEQ ID NO: 41663 - DNA, 83 bp, Homo sapiens
gcaatgtgggtatgggtagtacaaagtgtatacagagccataaatatatttactgtatatatatgtattatgtcaggcagtgc

SEQ ID NO: 41664 - DNA, 95 bp, Homo sapiens; identical to SEQ ID NO: 68

SEQ ID NO: 41665 - DNA, 93 bp, Homo sapiens; identical to SEQ ID NO: 69

SEQ ID NO: 41666 - DNA, 114 bp, Homo sapiens
gtggtattttaagaatttttatagacatgtttgcatcattactggcctgagaatattaattctttttcaatcaactattaatgatggggatataggttaagttttccataacac

SEQ ID NO: 41667 - DNA, 111 bp, Homo sapiens
acatacatacattcatatatatacacacatatatacacgtacacaaatacattcatattataaatgtatgtgtatataaatctatgtgtatatataagtgtgtttgtctat

SEQ ID NO: 41668 - DNA, 119 bp, Homo sapiens
ttctagttttatttcattttggtcagtgatgatacttgatattatttcaatgtctttaaatattttaagacttgtgacctaatgtatgctctatccttgagaatgatctatgtgctgag

SEQ ID NO: 41669 - DNA, 115 bp, Homo sapiens
gacaggagtactttttgcaggaaatctttattaattaaagtgttgaggttttttttttattattattattatactttaagttttagggtacatgtgcacaatgtgcaggtttgtt

SEQ ID NO: 41670 - DNA, 80 bp, Homo sapiens
tgtatatatgtgcatatgtatatatattcacatatatgtacacatataagcatatatatatgtatatacacatatataca

SEQ ID NO: 41671 - DNA, 64 bp, Homo sapiens
gtgtgtgtatatatatatgtatacttatgtgaagatatatgtatatgaagatacagacacacac

SEQ ID NO: 41672 - DNA, 161 bp, Homo sapiens
cctcatacacaaagatacatatatatctttgtatatatgtgtatatacaaagatgtatatatgtatatataaggatgtatatatgtgtacatgcaaagatgtatatatgtatatacaaagatatatttgtatatatgtgtatcattgtacatatatataca

SEQ ID NO: 41673 - DNA, 78 bp, Homo sapiens
tttgtttttgttttgagatggaacctctctctgtcactcaggctggagtgcaatggtgcaatctcagctcactgcaaa

SEQ ID NO: 41674 - DNA, 164 bp, Homo sapiens
atgcaaatgtgtatatatgtatatatgtgtatatatgtatatatgtgtatacatgtatatatgtatatgtgtatatatgtatatgtgtacatatatatgtatatatgtatatgtgtgtatgtatatgtgtatacatatgtgtatatatatatacacatttgcat

SEQ ID NO: 41675 - DNA, 95 bp, Homo sapiens; identical to SEQ ID NO: 68

SEQ ID NO: 41676 - DNA, 93 bp, Homo sapiens; identical to SEQ ID NO: 69

SEQ ID NO: 41677 - DNA, 95 bp, Homo sapiens
agagagttgcctgatacaagattaggctaaaagttgtatagattaattattaatataaataatataatataaatattgcttaatctttagcctct

SEQ ID NO: 41678 - DNA, 79 bp, Homo sapiens
cttagctgagaagagacccattgtggatagctcctgtccacatacaggttgtcccaatgtctctgtgtgtctggctgag

SEQ ID NO: 41679 - DNA, 116 bp, Homo sapiens
atatagatatagatagatatagatatagatagatatatatctatatctatctatatctatatctatatctatctatatctatatatatagatagatatagatatatatatatagat

SEQ ID NO: 41680 - DNA, 76 bp, Homo sapiens
caagctatttttttggtttcatatgaaatttaaagtagttttttctatttctgtgaagaaagttaatggtagcttg

SEQ ID NO: 41681 - DNA, 101 bp, Homo sapiens
gagctgggccataatgctccccaaaatttatgtatttcttttaagctatgagggctgatggagagacacaagtgaaggctgggtcaggtaggtctgtgctc

SEQ ID NO: 41682 - DNA, 95 bp, Homo sapiens; identical to SEQ ID NO: 68

SEQ ID NO: 41683 - DNA, 93 bp, Homo sapiens; identical to SEQ ID NO: 69

SEQ ID NO: 41684 - DNA, 78 bp, Homo sapiens
tgggcagagtctcactctgtcacccaggctggagtgcagtggtgtgatctcagctcactgtaacctctgcctcctggg

SEQ ID NO: 41685 - DNA, 110 bp, Homo sapiens
gggaggcaggacaagattgcagcttcaactcggacagacagaatagtgtgtggagacccacatcatgaattttagctccagaatgactgcaggaataaatcagaaaaccc

SEQ ID NO: 41686 - DNA, 110 bp, Homo sapiens
ctatccctaatactcttatggtagttttccagaatctatagaagattctatttcaatctgctataggctaatggcaagcaaccaagtttgagttatatattaaatgatag

SEQ ID NO: 41687 - DNA, 104 bp, Homo sapiens
ggcatgattctgagtgacgtactcttttttttttttttttttttttttgagatggagtttcgctctgtcatccaggctggagtgcagtggcttgatctccgctc

SEQ ID NO: 41688 - DNA, 112 bp, Homo sapiens
ctggcagtaaggctcaagtaagtttgaccttcatgtggtgaatagttcctttgttatgaagaatgttttggggaatattgtacaatggttactcttcctggtctccttccag

SEQ ID NO: 41689 - DNA, 58 bp, Homo sapiens; identical to SEQ ID NO: 315

SEQ ID NO: 41690 - DNA, 126 bp, Homo sapiens
tacatgtatgtatatgtgtgtgtatatatatatactcacacacaaaaatgtatatatatgtaaataaaataaatttataggagtatttgtgtatggggtggatatatatgtgtattaattatttat

SEQ ID NO: 41691 - DNA, 80 bp, Homo sapiens
attacatgttgagacaagagacagagggtaggtgctcttttaaaccaccagctctcaggttaactctttcaggaagtaat

SEQ ID NO: 41692 - DNA, 113 bp, Homo sapiens
tgtttgatagaattcagcagtgaagccaccaggtcttgggcttttcattgaaggaagacattttcttattctgataatttcatagattatgcaaattgcttttctatcagata

SEQ ID NO: 41693 - DNA, 119 bp, Homo sapiens
tttctttactattcttgaattttttcccaattgaatttattgtcagtttgtcatttactaatcttttattttatttggtatcccaacaaattgaggagtcagtttaggaaatattgaaa

SEQ ID NO: 41694 - DNA, 126 bp, Homo sapiens
acatataggatggagatatatatatgtatatacacatatacatatatatgtgtatatgtacatatatgtatatatgtatatatatgtgtatatgtacatatatgtatatatgtatatatgtgtgta

SEQ ID NO: 41695 - DNA, 116 bp, Homo sapiens
gcctcccaaatagctgggattacaggtgcatgccaccacgcccggctaatttttttgtattttagcacaggcatggtttcaccgtgttgcccaggctggtcttgaactcctgaggt

SEQ ID NO: 41696 - DNA, 79 bp, Homo sapiens
gtagctacagccacagtggtgatatttcagtttatatttatgttctctgagaaaatctccctgatggtagaatgtatac

SEQ ID NO: 41697 - DNA, 124 bp, Homo sapiens
gctgtctcatctgtgttttactgtctgctctttctggctgtttgtaataagagaagtgatttccttgaaatgcatgacgctagaaagggagctggaacttaaataggcagtgtttgtccaaggt

SEQ ID NO: 41698 - DNA, 134 bp, Homo sapiens
tatgaataatatttcattatatatgtgtatagtatatgtacatatatgtatgtgtatatattatatatgtatgtatataatatatattatatgtatatatgtatgtgtgtgtgtatattacatatacaaatata

SEQ ID NO: 41699 - DNA, 95 bp, Homo sapiens; identical to SEQ ID NO: 68

SEQ ID NO: 41700 - DNA, 93 bp, Homo sapiens; identical to SEQ ID NO: 69

SEQ ID NO: 41701 - DNA, 81 bp, Homo sapiens
gggggtccagaggtaggtgaaatatggctttatttagtagccctcttacgctgtctgtctgtccctgtctctgtggctgcc

SEQ ID NO: 41702 - DNA, 81 bp, Homo sapiens
ggggttaagaagagacagtgagaagagacagagaaataacagaggtgatttcatcattctactcagtgtgtctatgacctc

SEQ ID NO: 41703 - DNA, 80 bp, Homo sapiens
gatttttgtgactgaagcgtttgaaaccaaaagaagctttctttttccttttttgttttttgttttcagatacaaaagtc

SEQ ID NO: 41704 - DNA, 104 bp, Homo sapiens
ggctgataaataccttgtatgtttgctatactattgtgttagtaacataattttatttttatgtaacactaacaataaatagataaaagcaaaattgggaggcc

SEQ ID NO: 41705 - DNA, 105 bp, Homo sapiens
gaatatatactgagttattagcaggtaaaattatagatagctgcaacaggatggaaaaatatttataattgttgaagctggattttgaatgcattatatatattt

SEQ ID NO: 41706 - DNA, 77 bp, Homo sapiens
gtgcgtgtgtgtgtgtacacagtgtatatatgtgtgtgtacatagtgtatatatgtgtgtgtacacagtgtatatat

SEQ ID NO: 41707 - DNA, 112 bp, Homo sapiens
cagggttttattttatttatgtttacacactaaagtgtcatttaactagttaagaattgtattcttttttattttaaaggttatttgtgtgtatcattgtggtaatgttctg

SEQ ID NO: 41708 - DNA, 99 bp, Homo sapiens
gtagtgtatatctgtagtcccagctacttgggaggctgaggtaggaggatcacttgagcccgggaggtcgaggctgcagtgagccattgcactccagcc

SEQ ID NO: 41709 - DNA, 78 bp, Homo sapiens
ttgctgtccacctactgggcggatgttctggcctgagtcaaccctctgtcccactctgtcacccaggttggaatgcaa

SEQ ID NO: 41710 - DNA, 115 bp, Homo sapiens
ctcttaatgttaccaaagcatgtttgcattctgaaaaagccagactatttatattttatagataacagtctgaagtttagaatgtagaatgtcacttttattttcagggtctaca

SEQ ID NO: 41711 - DNA, 104 bp, Homo sapiens
ggagatggcttgattttcccagttcctacttttgagtgtggtatgtcaaatctctctctctctctctaagtagtggctactttgaaaatatattggcctactct

SEQ ID NO: 41712 - DNA, 120 bp, Homo sapiens
tagctggaggtggtggtgcatgcctgtagttccagctactcgggaggctgaggtaggaggatcacttgagcccaggagttggaggctacagtgagctgcgatcatgctactagacttcag

SEQ ID NO: 41713 - DNA, 87 bp, Homo sapiens
tttccttgttgattttctgtctggaagatttgtcaaatcctgaaagtggggtcttgaagtctccagccattattttattggggtaga

SEQ ID NO: 41714 - DNA, 74 bp, Homo sapiens
ttgtttgttttgagatggagtctcactctgtcacccaggctggagtgcagtggcgccatctcagctcactgcaa

SEQ ID NO: 41715 - DNA, 95 bp, Homo sapiens; identical to SEQ ID NO: 68

SEQ ID NO: 41716 - DNA, 93 bp, Homo sapiens; identical to SEQ ID NO: 69

SEQ ID NO: 41717 - DNA, 97 bp, Homo sapiens; identical to SEQ ID NO: 1307

SEQ ID NO: 41718 - DNA, 88 bp, Homo sapiens; identical to SEQ ID NO: 1308

SEQ ID NO: 41719 - DNA, 81 bp, Homo sapiens; identical to SEQ ID NO: 1309

SEQ ID NO: 41720 - DNA, 77 bp, Homo sapiens; identical to SEQ ID NO: 1310

SEQ ID NO: 41721 - DNA, 91 bp, Homo sapiens
gtgttgaatacaaatggtgaaagtgggcattcttgtcttgttccagttctcaaggaaaatagttcaagcttttgcccattcagtatgacgc

SEQ ID NO: 41722 - DNA, 115 bp, Homo sapiens
tcccagccacggccttcagctaccccacctgcccatattctacagatggagctctgatctctctgtgaatggagtgtccagggagaggggtaggccacaaccttggttgtttgga

SEQ ID NO: 41723 - DNA, 95 bp, Homo sapiens; identical to SEQ ID NO: 68

SEQ ID NO: 41724 - DNA, 93 bp, Homo sapiens; identical to SEQ ID NO: 69

SEQ ID NO: 41725 - DNA, 107 bp, Homo sapiens
agtctatctttttttctgcttcatttttcactttttatataataagttgattgtaatcagtctgtgtggtgagtgggtggaaaggagcttcagtgacttaaggatgg

SEQ ID NO: 41726 - DNA, 113 bp, Homo sapiens
tccagagtagctgggactacaggcacatgctaccatgcttggctaatttttttttaatcttttatagagtcagggtctcgctgtgttgcacaggttggtctcaaactcatgga

SEQ ID NO: 41727 - DNA, 69 bp, Homo sapiens
tgaggcagtgtctcgctctgtcacacaggcttgactgcagtggtgtgatcatggctcactgcagtctca

SEQ ID NO: 41728 - DNA, 62 bp, Homo sapiens
atatagctatctatatatagctatctatctatatatatatagctatatatagatagctatat

SEQ ID NO: 41729 - DNA, 95 bp, Homo sapiens; identical to SEQ ID NO: 68

SEQ ID NO: 41730 - DNA, 93 bp, Homo sapiens; identical to SEQ ID NO: 69

SEQ ID NO: 41731 - DNA, 111 bp, Homo sapiens
gttttctaaaaacataaccagactctctctatatatagagttcaaattatatataaaaataaatatataattatatatatgaaggacaaatttgggtgacaaaaaggaaac

SEQ ID NO: 41732 - DNA, 120 bp, Homo sapiens
ctcatcctactgtcaaatacaatttatgtgagctttgagaagtcattaaaattctgtcattttctatatgtgacttctggtaaatcatctgagtttttctagtatgtatgcaaaatgagg

SEQ ID NO: 41733 - DNA, 76 bp, Homo sapiens
tgtagaattataagagataaagaccacatagtgctggagctgtcagtggatactgtctctgtctgtcattcataca

SEQ ID NO: 41734 - DNA, 116 bp, Homo sapiens
tctttttatatgtttatatatatgtgtgtgtatatatatacatatataaacatgtatatatatagtgtatatatacatatgtactatatatacactcaatatatttataagttaga

SEQ ID NO: 41735 - DNA, 62 bp, Homo sapiens
tgtgtgtgtgtgtgtgtgtaagtggctgctaatgacaaaatttgcacacacacacacacaca

SEQ ID NO: 41736 - DNA, 91 bp, Homo sapiens
tcagactgttcaactcacctggcagccactcccagagcccgtggaactctggcccaaggctctctgactgactccttggcttagcggctga

SEQ ID NO: 41737 - DNA, 120 bp, Homo sapiens
ggctcacgacacagctctagatagctttggcttttgttgactctcagacctggacagatcagagcaatcttgtctgtgtgaaagagccagtctgatctgagtgcacctctgtctaccagc

SEQ ID NO: 41738 - DNA, 112 bp, Homo sapiens
tacagaatcttaacaactctcattatgttgtaaataataagctaattaattagttttatatatttatataaattaaatagacgagagttactgattaagagatatttttgtg

SEQ ID NO: 41739 - DNA, 147 bp, Homo sapiens
ttacatagtgtgtgtgtgtgagattctgtgtgtctcaatattgagatctttatatccatatacctgtatgtgtgattaaaatgtgtgtgtgtatatatatatataatatatacattttaatcttgcagatatttaaatactttatga

SEQ ID NO: 41740 - DNA, 95 bp, Homo sapiens; identical to SEQ ID NO: 68

SEQ ID NO: 41741 - DNA, 93 bp, Homo sapiens; identical to SEQ ID NO: 69

SEQ ID NO: 41742 - DNA, 95 bp, Homo sapiens; identical to SEQ ID NO: 68

SEQ ID NO: 41743 - DNA, 93 bp, Homo sapiens; identical to SEQ ID NO: 69

SEQ ID NO: 41744 - DNA, 70 bp, Homo sapiens
tgtatgtatatatatatatgtgtgtgcatatatgtgtatatatgtgtgtgtgtgtgtatatatatatata

SEQ ID NO: 41745 - DNA, 92 bp, Homo sapiens
tggtattttgcagagaaaaagtttttagttttgataaggtccaatttatttatttttcctttatggattgtgcttttttgatgtaaagtcta

SEQ ID NO: 41746 - DNA, 76 bp, Homo sapiens
ttcaaaaagtagattttttttcaagcttcccgaagtggataagcttgaagactgaaagaaaatctatcttaatgaa

SEQ ID NO: 41747 - DNA, 114 bp, Homo sapiens
caagatactcaaagctaaatgcaagttgaaagtagtttgctatataagttaaaaactttttgaaaaggtcagttgagaatttggcaaattaacaaatgcatttttctattcttg

SEQ ID NO: 41748 - DNA, 179 bp, Homo sapiens
gtatatgtatgtctgtatgtatgtgtgtgtatacatttttatgttatatatatacacacacatatacatacatatgtgtatatatacacatatatgtacatgaaatataattttcattttatatgtatatgtgtatatgcacacatatgtagaatttgtgtacatattatacatatata

SEQ ID NO: 41749 - DNA, 104 bp, Homo sapiens
tatacatatatgtatatataaaacatgtgtatatataaaatattaaaatatatatgtattttaacttatatgtacacatatgtatatgtgtatacatatgtata

SEQ ID NO: 41750 - DNA, 75 bp, Homo sapiens
gtgttggatttgattaaggtttgcccaaggtttgaaagattgagctttcaggatcttaagaaacagctccaacac

SEQ ID NO: 41751 - DNA, 115 bp, Homo sapiens
atcatagtatgtatagagcttactgaacaaaactgaaacaactttcttttttctctttttttttctgagatggagtttcattcttgttgcccaggctggggtgcagtggcgtgat

SEQ ID NO: 41752 - DNA, 111 bp, Homo sapiens
gcaaatgaaaattacttatgatggaagcaaaacataatcaaatgtatagagataaacacttgtgattttgtgaatgtagattgtggtggttttagttatctgttattttgc

SEQ ID NO: 41753 - DNA, 95 bp, Homo sapiens; identical to SEQ ID NO: 6311

SEQ ID NO: 41754 - DNA, 60 bp, Homo sapiens
ttatgtgtgtgatatatatatatatatatagtgtgtgtgtgtgtatatatacacacataa

SEQ ID NO: 41755 - DNA, 58 bp, Homo sapiens
tgagacagagtctcactctgtcccccaggttggagtgcagtggtgtgatcttggctca

SEQ ID NO: 41756 - DNA, 85 bp, Homo sapiens
ggtgattataattcgagatgagatttgtgtgggcatgggggaaactatgttcagccactcagaagacactcagaagcgatttacc

SEQ ID NO: 41757 - DNA, 65 bp, Homo sapiens
atgagatttgagtgaggacacagccaaaccatatcattccacccctggcctctctcaaatctcat

SEQ ID NO: 41758 - DNA, 95 bp, Homo sapiens
gaaggatgctgatctaaatattacagggactatatagacaaaaattgtattttttcactgtggttgttgtctatgctgttcagtttttctccttt

SEQ ID NO: 41759 - DNA, 101 bp, Homo sapiens
gcaaaagaggaaggagatttcagagagagaaaacagtgtgctcaaaggcaaatctgaaatatgcctttgtaatatgccagtgtctattgtgtttctgaaat

SEQ ID NO: 41760 - DNA, 62 bp, Homo sapiens
atgtaatcttacataaatacatataggtgtgtacagatgtatgtatttgtgtcagattatat

SEQ ID NO: 41761 - DNA, 79 bp, Homo sapiens
gtgtgtgtgtgtttatatatatatgtatgtattttacatatatacatgtatatttatgtatgtgtgggtatgtatacac

SEQ ID NO: 41762 - DNA, 115 bp, Homo sapiens
tgtgacgtgtgtatatatatgtgtgtgtatatgtaaaatatatatatacacatatacacaatatatattttacatatatatatatatataatcacattttaaaattcagtcaaca

SEQ ID NO: 41763 - DNA, 115 bp, Homo sapiens
ctcctacatgttccatagagatcaattcagcctggtggccgcaacttgacttggactctgccactctcagtgtgaatgctgggccaacctctgctctttaaattaaacaagggag

SEQ ID NO: 41764 - DNA, 114 bp, Homo sapiens
tttttattcatgtggtttatatttggaatattattattgggcagtaaaattattagttactatttatgattgtctagttagtagtatctaacacaatgctaggtgcggtataga

SEQ ID NO: 41765 - DNA, 118 bp, Homo sapiens
aagagaagtgaaagaacagaaaagcaggagtgggtacagggaggagttgagtgaggctacagtgcctgtgacagcctctgtgtactccatggagagttctggaggtgggatggctctt

SEQ ID NO: 41766 - DNA, 117 bp, Homo sapiens
ggaggcagttctgctactgagctgatgattgtaatgaaagtgggggtctttttcatttagttttgtttttatattgatgtggttattagtcatgtagccaggaatagaattgttttt

SEQ ID NO: 41767 - DNA, 83 bp, Homo sapiens
aggtatataatatctatatgtatatatatctgtatatctctctatatagagatatatgtatatatgtatatacatatgtatct

SEQ ID NO: 41768 - DNA, 95 bp, Homo sapiens
tttcatatatatacatgtgtgtgcatgtgcatgtgtatgtatattatatatacaaatgagcacatacatatatatatcgcctcatatatatgaag

SEQ ID NO: 41769 - DNA, 83 bp, Homo sapiens
catttgacttacagaaactatactgacgtgagaagcccctgaaattttgtggggtttatctctgtctctctggctcatctatg

SEQ ID NO: 41770 - DNA, 58 bp, Homo sapiens
tgagacagagtctcactctgtcacccaggctggagtgcagtggtgcgatctggactca

SEQ ID NO: 41771 - DNA, 110 bp, Homo sapiens
cttgtgtattccctgctcatctttggattaggccatttctccaaggaatcttgatttattttattggagaacagttttagaaacaaagacctggtagttgagtgtgtcag

SEQ ID NO: 41772 - DNA, 103 bp, Homo sapiens
tggatctctcatcctctgacaattcattgaggaagaattttaggctctaatctaatcattttattttttctatgagagtgctaagtaagtggaaaagagacta

SEQ ID NO: 41773 - DNA, 117 bp, Homo sapiens
tcattcttttatggccaagtaatatttcactgtgtctatgtaccatatttttcttcaatttttattttagattcagggtttacatttgcaggtttgttacctgggtatattgcatga

SEQ ID NO: 41774 - DNA, 62 bp, Homo sapiens
gtgtgtgtatgtgtgtgtatatatatgtgtgtgtatatatgtgtatatctatatacacacac

SEQ ID NO: 41775 - DNA, 82 bp, Homo sapiens
accatcatgaaaaagtaaggcatgaagacagtgtctgacgggtcagtgtcattgttcttgtatatcaaaatttataggtggt

SEQ ID NO: 41776 - DNA, 82 bp, Homo sapiens
tttactagagtaattaccaagctcttattatgcagaaaacattactgaagcagagagaagattgtgtacaaattctggtgaa

SEQ ID NO: 41777 - DNA, 89 bp, Homo sapiens
agggtttggaccaccagtagtcctgtctgaactgcattgtagtatttcattaaatttaatcacagggtgctatggtttgaatgtctcct

SEQ ID NO: 41778 - DNA, 96 bp, Homo sapiens
tcttgcctgattgctcgggcttctaggacattggtactatgttgaatagatgtggtaaaagtgggcatccttgacttgttccagttctcaggagga

SEQ ID NO: 41779 - DNA, 116 bp, Homo sapiens
actaatttctgtacattgattttgtatcctgagactttactgaatttgtttatcagatctaacagccttttggatgagtctttagggttttctaaatatatgattatatcattagt

SEQ ID NO: 41780 - DNA, 95 bp, Homo sapiens; identical to SEQ ID NO: 68

SEQ ID NO: 41781 - DNA, 93 bp, Homo sapiens; identical to SEQ ID NO: 69

SEQ ID NO: 41782 - DNA, 92 bp, Homo sapiens
tcattttaaaattagggtatagcatgaaaattaaggatagaaactttagactttttatcattttcattgtaacactgtatattttaagatga

SEQ ID NO: 41783 - DNA, 68 bp, Homo sapiens
cacatatgtaagtatatatatatgtgtgtatatatatatatactcatatatatatacttatatatatg

SEQ ID NO: 41784 - DNA, 93 bp, Homo sapiens
tatgtacatatgtatatatgcatacgtatacatatatatacacacatatatgtgtatatatgtgtatatatattatatacatgatagtagata

SEQ ID NO: 41785 - DNA, 138 bp, Homo sapiens
tctagaaatgataaatatttcccagaatgaacaatggcaaataataggatttgtaatgattgcatcacagaacaaagtgagccattagttcaaaatggtgttatgggttcttggaatcattagtctgtcttatagcta

SEQ ID NO: 41786 - DNA, 80 bp, Homo sapiens
tcaggcttgctgagtataaatctaaacttgtcagacttagctagttagaaactgtttttttgtacttctgttagtcatga

SEQ ID NO: 41787 - DNA, 108 bp, Homo sapiens
aatatggcattgtggttttgatttgtatgtcttggtgactggtgactctgagcatcttgttttatgctcactggtcatttgcatatcatctttggagaaatgtctatt

SEQ ID NO: 41788 - DNA, 114 bp, Homo sapiens
tagaattgtcttggctatgcgggctcttttttgctaccatatgaaatttaaagtagttttttccacttctgtgaagaaagtcagtgtagcttgatggggatagccttgaatcta

SEQ ID NO: 41789 - DNA, 112 bp, Homo sapiens
aagaagtgaacaataattggccaagaattcaagaaggcttagtagactttgcttgttcatatataaagttagatgcttgagtgccttaggttttcttttccatgctcttttt

SEQ ID NO: 41790 - DNA, 63 bp, Homo sapiens
tggggatgaagatggaattaaggctctgccggagaagcagtagttcacactctttctctcaca

SEQ ID NO: 41791 - DNA, 92 bp, Homo sapiens
tacattatattgcatatatattatttgtgtgtttgtgtgtgtatatatatatatatacgtgtatatatatatatatagtctgtgtgtgtgta

SEQ ID NO: 41792 - DNA, 107 bp, Homo sapiens
aaattgaagccacatttagagcatatagttgccaacacaatgacattttgtttatgtgaatgatgtaagtggagatacatatgttcttttttttaatgtttcatttt

SEQ ID NO: 41793 - DNA, 123 bp, Homo sapiens
caggaaagatcatgtgcttgccagagagaggtgcatgtataacagtagaaatggtaagaaaagtagtctattttagcaaaattactctaatgctcacctgtaagattctctttcctgtatatg

SEQ ID NO: 41794 - DNA, 58 bp, Homo sapiens; identical to SEQ ID NO: 1101

SEQ ID NO: 41795 - DNA, 56 bp, Homo sapiens; identical to SEQ ID NO: 1102

SEQ ID NO: 41796 - DNA, 97 bp, Homo sapiens
ctcttgcatcatttggcttttggtttaaaagatgagggcaatgttgtaagtttttttttccttttgaagacacccagccaagaagtgaagccatgag

SEQ ID NO: 41797 - DNA, 106 bp, Homo sapiens
aagttgtttgtttgtttgtttttaaaatgtttgtgtttaaaatgtttcttctactattttagatattttataatcagagagttttgggaactcaggtatgcaactt

SEQ ID NO: 41798 - DNA, 76 bp, Homo sapiens
tatgtttaaatatatatgtgtatatataatggcatatatatgtctgtatgtgtatctacatgtatatagatacatg

SEQ ID NO: 41799 - DNA, 113 bp, Homo sapiens
ggattgtctgggttatacgggctgcttttttggttccatatgaaatttaaagtagtttcttctaattctgtgaagatattcaatggtagcttgatggggatagcattgaatct

SEQ ID NO: 41800 - DNA, 115 bp, Homo sapiens
caaacaggcttatatttgcatgaattctagaaatgtcagatatattttaaaatctttctttctttttttattatactttaagttctgggatatatgtgcagaatgtgcaggtttg

SEQ ID NO: 41801 - DNA, 95 bp, Homo sapiens; identical to SEQ ID NO: 68

SEQ ID NO: 41802 - DNA, 93 bp, Homo sapiens; identical to SEQ ID NO: 69

SEQ ID NO: 41803 - DNA, 92 bp, Homo sapiens
gtgtgtgtgtgtctatgtctgtctgtgtgtgtggcagtgggcaacaggggagtgtgatccaccagacaggccctgattaaaatcatcttcac

SEQ ID NO: 41804 - DNA, 81 bp, Homo sapiens
tctggtgtgaaatacagtcagtgaaatactctttttaaattttttttttttttgagatggagtctcactctgtcacccagg

SEQ ID NO: 41805 - DNA, 93 bp, Homo sapiens
gctttcaaaatattcctgggatggttaatactgagtgtcaacttgagtggattgaaggatgcgaagtattgatcctggtgtgtctgtgagggt

SEQ ID NO: 41806 - DNA, 60 bp, Homo sapiens
gtgtgtgtgtgtgtgtgtgtgtatgtatgtgtgtgcatgcctgtgtgcacacatgcatgt

SEQ ID NO: 41807 - DNA, 76 bp, Homo sapiens
tcattttgagtctgagttctgtatttgttgctgaaatacaggggcagtgaatctacacgctgagaacccagagtgg

SEQ ID NO: 41808 - DNA, 188 bp, Homo sapiens
tatatacctatatataggtgtatatatatatatacctatatatgtgtgtgtatatatatatacctatatatatgtgtgtgtatatgtatacctatatatgtgtatatatatacccatatatgtgtatatatatacctatatatgtgtatatatatacctatatatatgaatatatatatacccccata

SEQ ID NO: 41809 - DNA, 91 bp, Homo sapiens
ttgttgttgttgttgttgttttgagacagagtctcagtctctcaccaaggctggagttcagtggcgcaaacacaacttactgcaacctcaa

SEQ ID NO: 41810 - DNA, 64 bp, Homo sapiens
agactgggtgtcttaaactatatatatatatatatatatatatatatatcttgagacagagtct

SEQ ID NO: 41811 - DNA, 66 bp, Homo sapiens
acaaagtgagacctgtatctacaaaaaatgtcaaatttttttttttgagacagagtctcactctgt

SEQ ID NO: 41812 - DNA, 104 bp, Homo sapiens
tgacagagctagactctgtctccaaaaaaaaaaaaaaaaaaagtatatacatatccacatatttttatttctttctctttttttgacagagtctcgctctgtca

SEQ ID NO: 41813 - DNA, 100 bp, Homo sapiens
acagagcgagactctgtcaaaaaaagagaaagaaataaaaatatgtggatatgtatatactttttttttttttttttttggagacagagtctagctctgt

SEQ ID NO: 41814 - DNA, 119 bp, Homo sapiens
gataatctctgtagtcatatataatgtagcaagtatttatgttcatctgtcttgcatgtcattttctaaatgtcatacagataatatactctgtactttttatcttgcaggtattaatc

SEQ ID NO: 41815 - DNA, 96 bp, Homo sapiens
agtatatatatgtgtatatatatatatgtatatatatgtgtatatatgtgtgtatatatatgtgtgtgtgtgtgtatatatatatatatatatatt

SEQ ID NO: 41816 - DNA, 72 bp, Homo sapiens
ctgtgtcctgcacatgcatgtgtgtgtacacacatagacacacactcactcaacgtcatgtgtagcaaacag

SEQ ID NO: 41817 - DNA, 58 bp, Homo sapiens; identical to SEQ ID NO: 1409

SEQ ID NO: 41818 - DNA, 78 bp, Homo sapiens
tcccaggctgcctgcctgcctcacttacctgctcagggtggggcttgagggtggcccctgggaagagtaagaactggc

SEQ ID NO: 41819 - DNA, 85 bp, Homo sapiens
gaagagaaaccagaagagggaggtgaggatggagcctctaagggcaagaatgcattcttttttttttttttgaaattttgttttc

SEQ ID NO: 41820 - DNA, 84 bp, Homo sapiens
tggaagggatccctggggagaaaacctcactattgtcccaaaattctgcatgactggagtgagtctctcagagtctctttttca

SEQ ID NO: 41821 - DNA, 102 bp, Homo sapiens
cctctaagtggaactggataagtattgagaataatgtgggaggttacatactcctcttttaacattatttatttattttttttagtgggttgttattagagg

SEQ ID NO: 41822 - DNA, 58 bp, Homo sapiens
tgagactgagtctcactgtgtcgcccagcctggagtgcagtggtgtgatctcagctca

SEQ ID NO: 41823 - DNA, 102 bp, Homo sapiens
tgaataaaagtaagttgtaagcttcatgctttaggtgttttaaactttttaaatatgtttggaaaatgtggcctggcacagtggctcacacttgtaatttca

SEQ ID NO: 41824 - DNA, 72 bp, Homo sapiens
gagacagggtctcactctgtcacccaggctcactgcagacctggggtcaagcaaccctcccacctcagtctc

SEQ ID NO: 41825 - DNA, 60 bp, Homo sapiens
ttgagacagggtctcactctgtcacccaggctggagtgcagtggtgtgatcacagctcaa

SEQ ID NO: 41826 - DNA, 58 bp, Homo sapiens; identical to SEQ ID NO: 2531

SEQ ID NO: 41827 - DNA, 78 bp, Homo sapiens
ttgagacggagtctcactctgtcacccagcctggagtgcagtggtgcgatctgggttcaagtgattctcctgcctcag

SEQ ID NO: 41828 - DNA, 58 bp, Homo sapiens
tgagactgagtctcactctgtcgctcaggctagagtgcagtggtatgatcttggctca

SEQ ID NO: 41829 - DNA, 120 bp, Homo sapiens
tgaactgggtgcggtggtgtgtgcctgtggtcctggctactcaggaggctgaggtggaaggatcacttgagctggggaggtcgaggctgcagtgagtcaagatcatgccactgtactcca

SEQ ID NO: 41830 - DNA, 106 bp, Homo sapiens
ggtcagatgatattgtagaaaaatgaataggttgttgtttaaggtgaaggatttattttattattttggaggaatactgtttaaatgcatattttttacaaggacc

SEQ ID NO: 41831 - DNA, 59 bp, Homo sapiens
gttgagatggagtctcacactctgtcgcccaggctggagtgcagtggcgcaatctcagc

SEQ ID NO: 41832 - DNA, 116 bp, Homo sapiens
tgagagccttagagtatttcagtgattgaaaattactagctaatataattttcttttttttttgtattagtcgggaaaaactatggatttgtatggaatactgtggtggcggatca

SEQ ID NO: 41833 - DNA, 77 bp, Homo sapiens
gccctgaaggtgacagtagaaagtctgcctacctaggtgcagaggaaaggccctgctttctgtgttcactcgcgggc

SEQ ID NO: 41834 - DNA, 97 bp, Homo sapiens; identical to SEQ ID NO: 1307

SEQ ID NO: 41835 - DNA, 88 bp, Homo sapiens; identical to SEQ ID NO: 1308

SEQ ID NO: 41836 - DNA, 81 bp, Homo sapiens; identical to SEQ ID NO: 1309

SEQ ID NO: 41837 - DNA, 77 bp, Homo sapiens; identical to SEQ ID NO: 1310

SEQ ID NO: 41838 - DNA, 75 bp, Homo sapiens
taaaatttctatctggaaaggaggcagtgcttcaccagtgatttacttcatctcttatatccaggttttgtttta

SEQ ID NO: 41839 - DNA, 95 bp, Homo sapiens; identical to SEQ ID NO: 68

SEQ ID NO: 41840 - DNA, 93 bp, Homo sapiens; identical to SEQ ID NO: 69

SEQ ID NO: 41841 - DNA, 62 bp, Homo sapiens
ctgagtctcgctcactcagtgctcaatgttgcccaggctggagtgcagtggcgtgatctcgg

SEQ ID NO: 41842 - DNA, 117 bp, Homo sapiens
ccaaagagtctctgtgtctttattccagtattaagttataaatttcattattaattaataatttccaaatgaaatttgtaacttaatactggaataaagacaccctgaaattattgg

SEQ ID NO: 41843 - DNA, 56 bp, Homo sapiens
atatatatatgtgtgtatatatatgtgtatatatatatatatatatatatatatat

SEQ ID NO: 41844 - DNA, 86 bp, Homo sapiens
atatatatacacacatatatatatgtgtgtatatatatacatatatgtgtatatatatacacacatatatgtgtgtatatatatat

SEQ ID NO: 41845 - DNA, 83 bp, Homo sapiens
attgtgaatagagtaccactcttttaaaattcttattattaaaaaaaattttttaaaggcagggtctcactctgtggcacaat

SEQ ID NO: 41846 - DNA, 99 bp, Homo sapiens
ttctactgcttaaattatcaaccatgcaagagaggtatacaattgtcttagcttcctgtctgtatcactctgtgtactgtggctatggtagctttggaa

SEQ ID NO: 41847 - DNA, 94 bp, Homo sapiens
tgcaccttctataactccattttttaaagtgtttttgtctttttttaaacaagagaaagtagacagatgcatgttgggaaatgctaactgtgca

SEQ ID NO: 41848 - DNA, 62 bp, Homo sapiens; identical to SEQ ID NO: 41841

SEQ ID NO: 41849 - DNA, 72 bp, Homo sapiens
aatagcagttgcagaggcatgtgggttgctgcctcttcagttaagctcacagtgactcagtgactgtgtatt

SEQ ID NO: 41850 - DNA, 116 bp, Homo sapiens
gtgattttgaggtttctttctgccatgtctggcagttgatgttgactgtaggcagagagcacagtaggctgctgaccgatgtgtagcatcgccagcatggcagcctcagaagagcc

SEQ ID NO: 41851 - DNA, 95 bp, Homo sapiens; identical to SEQ ID NO: 68

SEQ ID NO: 41852 - DNA, 93 bp, Homo sapiens; identical to SEQ ID NO: 69

SEQ ID NO: 41853 - DNA, 110 bp, Homo sapiens
tctgacctcagcctccagggtagctgagactacagttgtgcactgcccggctaattttttaaattttttgtacagacagtgtctctctatgttgtccaggctggtcttga

SEQ ID NO: 41854 - DNA, 59 bp, Homo sapiens
gagaagagagtgtctcgctctgtcacccaggctggagggcagtggcgcgatctcggctc

SEQ ID NO: 41855 - DNA, 130 bp, Homo sapiens
tattttagtatatattatctaatattagtatatataccaatctaattaatgtatataaatatcaattttatgttgtgtgtatatatacatcatttagtagtatataatatagcatatgttagtatatata

SEQ ID NO: 41856 - DNA, 91 bp, Homo sapiens
tctctacttgcttttcagacagtggagagagagcagtgaacaagacagaccaggcccctattttcatggagtttaaaaggctaatgaggga

SEQ ID NO: 41857 - DNA, 110 bp, Homo sapiens
tgaccaactagtgcctaacacagtgcctgcccatagtggtcatttaataaatggatgaatgaatgaatgaatgaatgatgcaaatgagagatgctgagtgcctagggtta

SEQ ID NO: 41858 - DNA, 56 bp, Homo sapiens
agagtctcactctgtcaccaggctggagagcagtggtgcgaacagggtgttatttt

SEQ ID NO: 41859 - DNA, 84 bp, Homo sapiens
gatgcatccatgttgtagcatatgacaggaattctttctttttttatgactgaataatattcctttacatgcatataacacatc

SEQ ID NO: 41860 - DNA, 95 bp, Homo sapiens; identical to SEQ ID NO: 580

SEQ ID NO: 41861 - DNA, 93 bp, Homo sapiens; identical to SEQ ID NO: 69

SEQ ID NO: 41862 - DNA, 79 bp, Homo sapiens
ttggcttctgtttctggtcaggccaataaatctccttcctcatcccattttactgcttatgactagagacagaaactaa

SEQ ID NO: 41863 - DNA, 80 bp, Homo sapiens
gggcagaggcaggcaacactgttgcagattctcacacattctctgtgtgagaattcaagaagtgtggttgagtcttgtct

SEQ ID NO: 41864 - DNA, 108 bp, Homo sapiens
tgttacacctcttgcataatagataagatgtatattttttacatatataagaacacatcagtatatgtctgtatacgtcagtatgtctctgtgtattagaagataaca

SEQ ID NO: 41865 - DNA, 138 bp, Homo sapiens
gacaacaagagcaagactctgtctcaaaaaaaaaatgtgttttttttttttttgagacagagtctcgctctgtcacccaggttggagtgcagtggcgtgatctcggctcactgtaagctacgcctcctgggttcatgc

SEQ ID NO: 41866 - DNA, 58 bp, Homo sapiens
tgagacagagtctcgctctgtcacccaggttggagtgcagtggcgtgatctcggctca

SEQ ID NO: 41867 - DNA, 98 bp, Homo sapiens
caatggaccaagatatgttgtgggttgtcgtcgacaggtaatactttatatttgtatagtgcctgatgattgacaaagcagtttcatgtaagttattg

SEQ ID NO: 41868 - DNA, 58 bp, Homo sapiens; identical to SEQ ID NO: 2442

SEQ ID NO: 41869 - DNA, 106 bp, Homo sapiens
gaatgctccaaaagctaagacttttgagggctgacatgatgctgaaaggatatgctcattttggatttttatgttagggacactcaactggtataatggaatattc

SEQ ID NO: 41870 - DNA, 77 bp, Homo sapiens
ggaggctgaggtggaaggatcacttgagtctaggagtcctaggctgcaagtgagctatgattgcaccactgcactcc

SEQ ID NO: 41871 - DNA, 102 bp, Homo sapiens
gggcttgtcaacaacagacttgttctcttggcatcatctataactgattatatttttctttatactggttgctagctcagagccaaatttgtggtggaaccc

SEQ ID NO: 41872 - DNA, 61 bp, Homo sapiens
ggggaccataggtaggtgagatatggctttattcagcagctctcttacactgtctgtctct

SEQ ID NO: 41873 - DNA, 117 bp, Homo sapiens
gctgagctgtgtcctggcacccccctgtccacttgcaagaccaacatctctgactgtttctctgggtgtgagtgtgcctgtacagtgtcagcagggaaattataccttttacagaca

SEQ ID NO: 41874 - DNA, 60 bp, Homo sapiens
tgagactgagtctccctctgtctcttcccggctggagtgcagtggtgggatctcggttca

SEQ ID NO: 41875 - DNA, 97 bp, Homo sapiens
taagctggtaaggcccctaggtatgagacagtgtaagacaatgttagaaaacaactttgttgtaataaggctttcaattggtatgggatacagcttg

SEQ ID NO: 41876 - DNA, 100 bp, Homo sapiens
gaagattgagtattatccaagagacacagatgggatgatttaggcacaaacaacttttattttgttacttctgtgcactctcttggacatacctgccttc

SEQ ID NO: 41877 - DNA, 114 bp, Homo sapiens
ctaaaatattgcttttagtatgatatctattatttaatattttggcttgaaaatgtttttatttttaacctttgtgggtatatagtggatgtatatatttatgtgatatatgag

SEQ ID NO: 41878 - DNA, 89 bp, Homo sapiens
ttacaaatagtactggtattggcatatgtgcagacagaataaccgaatgtcacagtatagagaggccagaacagatcactaatgtgtag

SEQ ID NO: 41879 - DNA, 118 bp, Homo sapiens
agtgtatatgggttcccttttctcttcagccttaccagcatctgttatttttgtctttttagtaatagccattctgattggtgtgagatggtatctcattgtggttttgatttgcatt

SEQ ID NO: 41880 - DNA, 95 bp, Homo sapiens; identical to SEQ ID NO: 68

SEQ ID NO: 41881 - DNA, 93 bp, Homo sapiens; identical to SEQ ID NO: 69

SEQ ID NO: 41882 - DNA, 116 bp, Homo sapiens
tgtggacagaagagttagggaagatatatagatagatatgtatgtatgtatgtatctagatacatatctatatatatatgtgtgtgtgtgtgtatatatataatggtgaaagaaca

SEQ ID NO: 41883 - DNA, 107 bp, Homo sapiens
tctcactgtggttttgatttgcatttccctaataattagtgattttgaatatttttttttcaatttcaatagtttttgggatacaggtggtttttggttacatgaga

SEQ ID NO: 41884 - DNA, 83 bp, Homo sapiens
tgatatatatgtcatatgtatatatgaatatcttatatatatcagatatcagatatatcatatatatatataaatattattcg

SEQ ID NO: 41885 - DNA, 79 bp, Homo sapiens
tcaagtctattgatatacacttacagacagattcttctcttttttttgagacagagtctcactctgtcacgaggctgga

SEQ ID NO: 41886 - DNA, 95 bp, Homo sapiens; identical to SEQ ID NO: 68

SEQ ID NO: 41887 - DNA, 93 bp, Homo sapiens; identical to SEQ ID NO: 69

SEQ ID NO: 41888 - DNA, 70 bp, Homo sapiens
accataggttttcactgtagattctgtggacccccagcctatggattctgtcagatggcaaatctatggt

SEQ ID NO: 41889 - DNA, 92 bp, Homo sapiens
gagtggagcaggaatgggctctgagacctaaggtggttttgattatatatttttggtttattttcaggaagctcagggagtttctgtgactt

SEQ ID NO: 41890 - DNA, 106 bp, Homo sapiens
gagtgtgtgagaaatgagattgatagttgagatagctgagagtggagacagagtttttctggcatttatttttccttggatcattcaatttcactcttatgtgttc

SEQ ID NO: 41891 - DNA, 99 bp, Homo sapiens
gtcccagctactcgggaggctgaggtaggaggatggcttgagcctgcgaggcggaagctgcagcgagccgagatcatgccattgcactccagtctgggc

SEQ ID NO: 41892 - DNA, 75 bp, Homo sapiens
tgggtagagactggaagagttctgaggtactttgtcatgaatgtagccttaaggatgaattctggttagggctca

SEQ ID NO: 41893 - DNA, 88 bp, Homo sapiens
agtattcccattgctttgtacagagtttaccatttaacaaatacttgtgaaatgaataaatgtatcttaaaagtattgaggaatcact

SEQ ID NO: 41894 - DNA, 87 bp, Homo sapiens
ccatatatatatatgtatacatgtgtttatttatatatatattattataatatataaaaaatatatactgtatgtatatatatgttg

SEQ ID NO: 41895 - DNA, 72 bp, Homo sapiens
gcgcctggccccaactggcttattttctgtcaaactcagtgtttgatagaaacagtctagtatgtcaggttc

SEQ ID NO: 41896 - DNA, 105 bp, Homo sapiens
gacatgtttgaagaacttcaggtgagagctcccacatgtagctgcagtaaaaaggccctgagtgtccctgtgtctgagagtcacctctacctgccaaatctgatc

SEQ ID NO: 41897 - DNA, 116 bp, Homo sapiens
tttctatctctgtccttacttgggcaaagactacatcctgtctgtatttatttgtattagctagtggatattcaataaacatttgtagaaaccaaggaaaagaaagaagataggaa

SEQ ID NO: 41898 - DNA, 89 bp, Homo sapiens
ggtttaaaaggatgcagtctgtccctctcagtgggttaggtttctccaaggaggccaaacctatagtgcccacacattggtccttagcc

SEQ ID NO: 41899 - DNA, 112 bp, Homo sapiens
agatggtgaaacagtaaccactcatgctttggggactagcatgctgaagggaggctctgagaacatcctgtttgctggcattaatagtcctgaggtttgctgtttccgatct

SEQ ID NO: 41900 - DNA, 62 bp, Homo sapiens
gagtcctggtggtacagactcggttcgtaaggaggcagaagagagtgatgtctgcagggctc

SEQ ID NO: 41901 - DNA, 84 bp, Homo sapiens
gttctgagaggcagccacagcttgacattatgacagtgaccacacagtgactcccttttgatcaggctcagctgctcaactgac

SEQ ID NO: 41902 - DNA, 94 bp, Homo sapiens
agtgctgggattacaggcgtgagccaccgcaccgggctttttttttttttttttttttttttttgagtcggagtctcactctgtcgcccaggct

SEQ ID NO: 41903 - DNA, 81 bp, Homo sapiens
cagtgggtctctgacagtcacacccatttactttgtagacaaagtccctggaagcagtgatggcaatcaggtggcctggtg

SEQ ID NO: 41904 - DNA, 62 bp, Homo sapiens
ggtgagaccgagtctcactctgtctcccaggctggagtgcagtggtgtgatctcggctcacc

SEQ ID NO: 41905 - DNA, 58 bp, Homo sapiens
tgaggcggagtctcactctgtcacccaggctggagtgcggtggtgtgattttggctca

SEQ ID NO: 41906 - DNA, 58 bp, Homo sapiens
tgagacagggtctcactctgtcacccaggctggagtgcagtggtgagatcatggctca

SEQ ID NO: 41907 - DNA, 108 bp, Homo sapiens
gagaaagaagtcccgaagaagcatcagtatctattcaagttagtagttatcttgagaaggctgcctaaaaactgtgattctactcctgcagaaggtgatttatatctt

SEQ ID NO: 41908 - DNA, 87 bp, Homo sapiens
gacaaagtgagaccctttctcaataaaaaaaaaaattattttagcaatcatattttttttttttttgagacagagtctcactctgtc

SEQ ID NO: 41909 - DNA, 115 bp, Homo sapiens
taaaaagcccaagtaagagtcctaatcgttagtcatgcagtttagtctttttgtagatttgagcattcaagaaaggacgcaggtgattcattaagcttagtacttggggtttttg

SEQ ID NO: 41910 - DNA, 115 bp, Homo sapiens
ttcaagagcacaggaggtcgagactgtagtgagttctgagctttgccatttgtgtgagatgtttgctgcatctggcctgcccacttagaaactgtcttcttccttactttctgga

SEQ ID NO: 41911 - DNA, 58 bp, Homo sapiens; identical to SEQ ID NO: 87

SEQ ID NO: 41912 - DNA, 56 bp, Homo sapiens; identical to SEQ ID NO: 88

SEQ ID NO: 41913 - DNA, 99 bp, Homo sapiens
cagtccctgccatatcagtgattatctagacatggtgattttaccttgggcaagtcacttcctctctcggtctcagctgaaatgttaactgaggggctg

SEQ ID NO: 41914 - DNA, 58 bp, Homo sapiens; identical to SEQ ID NO: 315

SEQ ID NO: 41915 - DNA, 58 bp, Homo sapiens; identical to SEQ ID NO: 315

SEQ ID NO: 41916 - DNA, 90 bp, Homo sapiens
gggtgtctctggttcaggcagtgagtagtgtaagtaacgagcgattgaaggcaaaatggctcgctgcctgtttccgtacaaaagcagccc

SEQ ID NO: 41917 - DNA, 109 bp, Homo sapiens
cagtcttttgttattacaactagtgcttcaatgaacagttttgtgcaaatgtcattttgtatttctgctcatgtatttttggtacagattcttagaaacagaattactg

SEQ ID NO: 41918 - DNA, 93 bp, Homo sapiens
gtttagaacagtgcttctcaaactatctgtaggaaggaatgaattttgttttattttttcctaatctgttgcagactgacacttttagtagat

SEQ ID NO: 41919 - DNA, 94 bp, Homo sapiens
aaaggcacatagtaaatgttgagtgaataaatgaatggttcttggggctctcagaactgctagtttattattatttatttatttatttgttttt

SEQ ID NO: 41920 - DNA, 98 bp, Homo sapiens
tcaacattatcatgtcatgtttgccagtttatttaaagaaatatatataaatttatgtatttaatgtatatttcaactgccagaggtcactggtttga

SEQ ID NO: 41921 - DNA, 76 bp, Homo sapiens
ggagatgcggtaacagttcctggacagcagtcgccatctgccttggtggggtctgtctgcctctgtgtgatgctcc

SEQ ID NO: 41922 - DNA, 118 bp, Homo sapiens
tttctaagtttaatttcattgtggtctgagaggagatattgtatgatttttattctttttaatttgttaaaaattaaatgggtctgccttggtgaatgttccatggaatcttgagaag

SEQ ID NO: 41923 - DNA, 80 bp, Homo sapiens
ttttagaggagtcaagttatatgtgtgtgtgtgtgtgtatatatatatatatatatatatttttttttttttttttgaga

SEQ ID NO: 41924 - DNA, 92 bp, Homo sapiens
tatctaggtttgtatgtgtggttttttttgttttgttttgtttttacttattacaaagctaccttaagaaatcagataaataaggctgggtg

SEQ ID NO: 41925 - DNA, 112 bp, Homo sapiens
gtatttattacatagtttatatacaatatacacatacatgtttatataaatatgtaatatatgatatatattaatgtatttgtataagtatataatagtatgacattaatat

SEQ ID NO: 41926 - DNA, 87 bp, Homo sapiens
caggcgtgtgccaccatgcctggctaactttttatttttagtaggacgcagtttcaccatgttggccaggctggtctcaaactcttg

SEQ ID NO: 41927 - DNA, 113 bp, Homo sapiens
gcctatgcccaggaatgaacaagggtagattggaggttagaaacaagatggagtcggttaggtcagatctctctcactgtcataattttctcagttataatttttgcaaaggc

SEQ ID NO: 41928 - DNA, 56 bp, Homo sapiens
agagagagagagggcccacgtgctaccaggacacctgccacaccctctctgtgtct

SEQ ID NO: 41929 - DNA, 116 bp, Homo sapiens
gattgcttggccaagaaggaatagtgcttgtcattaccagctactaacaagtcaatctttatttgtctcttcaataagctggtcaggctaagagccctgttcaatctgccacactc

SEQ ID NO: 41930 - DNA, 95 bp, Homo sapiens; identical to SEQ ID NO: 68

SEQ ID NO: 41931 - DNA, 93 bp, Homo sapiens; identical to SEQ ID NO: 69

SEQ ID NO: 41932 - DNA, 95 bp, Homo sapiens; identical to SEQ ID NO: 68

SEQ ID NO: 41933 - DNA, 93 bp, Homo sapiens; identical to SEQ ID NO: 69

SEQ ID NO: 41934 - DNA, 68 bp, Homo sapiens
ggagctagaattattcttgttcatttgaggcttccagcttggaatttgaagataaatgagtcagttcc

SEQ ID NO: 41935 - DNA, 145 bp, Homo sapiens
ccttctttgtccttctgtttttgtgtgtgtgtgtgtgcgtttttctttctttctttttcttctttgagacagggtctcactctctcacccaggctggagtgcagtggcgtgatctcggctcactgcaacctccgcctcccagggt

SEQ ID NO: 41936 - DNA, 106 bp, Homo sapiens
gttttaacttctcctttgtggttctatatcaatttttgattcagtttttctatttctgtaaaaattgccgttgggattttgatagggattgcattgaatatgtagc

SEQ ID NO: 41937 - DNA, 61 bp, Homo sapiens
cagtgccaaggtgtgtgagtctgtgtctgtgtgtataacactggctttcatacaggagctg

SEQ ID NO: 41938 - DNA, 79 bp, Homo sapiens
gatagtcagggaggctgactggctggtgttgaatttggtcccaagagcttcttcatcatcctccttcagcttgaatatc

SEQ ID NO: 41939 - DNA, 104 bp, Homo sapiens
tgggcacgtgaccgagctggggctaatgagatgaactgtgacgtttactaggtaaatgtttttcattcttaaaaatagaccagaacagtctccttctgtgtgta

SEQ ID NO: 41940 - DNA, 95 bp, Homo sapiens
cctatggtggtggagcttgccagagttcagtttctgtctgctgggatggacaattcccctctggctagggctcatctaaatgttccctctgtggg

SEQ ID NO: 41941 - DNA, 111 bp, Homo sapiens
ggattggtccattgcaaaagtctcccctccccaacagacacacactctcacatacacattttgctctgaggttggtgggaaagaagcttgctttgctatctgggcccattc

SEQ ID NO: 41942 - DNA, 220 bp, Homo sapiens
atataaagatatgtatgtatgtgtgtatatgtgtgtgtatatatatatatacacacatatatgtatatatatacatatatatacatatatatgtatatatatacatatatacatatatatgtatatatatacacatatatgtgtatatatatacatatatatgtatgtgtatatatatacatatatatatatgtgtgtgtatatatatatatatatatat

SEQ ID NO: 41943 - DNA, 73 bp, Homo sapiens
tattgtttagatatatattgtgtatatataatattatatatgctatatatgcacaatgtatatctaaacaata

SEQ ID NO: 41944 - DNA, 119 bp, Homo sapiens
acacattaaatatagtcacagtaaagattatctgaaaaatgaaaggatgagcagaagattttttattttcatatagacagttatatcaggtttttctttcttggtttgtacttttgtgt

SEQ ID NO: 41945 - DNA, 80 bp, Homo sapiens
cctggcaactgctagtctgttctccatgtctatgaatttgttatttcaatgacgttgtatgaatagaagtatgcagcagg

SEQ ID NO: 41946 - DNA, 106 bp, Homo sapiens
gaaatatcaactgaaacacttcttttggtgctgattttagatgctttttttttttttaagatagggtctcactttgtcacccaggctgaagtgcagtggtgtgatc

SEQ ID NO: 41947 - DNA, 57 bp, Homo sapiens
ttgagaccgagtctctcgctctgtcgcccaggctgaagtgcagtggcgcgatctcga

SEQ ID NO: 41948 - DNA, 92 bp, Homo sapiens
ttcactcatctgtggggagagacctagagttttgttttttttttttttttttttagacgtagctttgctctgtcaccaggctggagtgagtg

SEQ ID NO: 41949 - DNA, 82 bp, Homo sapiens
gccaggggagcaaagcgtaggtgtgtgcgtgtgcgtgtgcgcgcgcgcgtgtctctgtgtctgcgtgtgtgctcgcaagcgc

SEQ ID NO: 41950 - DNA, 95 bp, Homo sapiens; identical to SEQ ID NO: 68

SEQ ID NO: 41951 - DNA, 93 bp, Homo sapiens; identical to SEQ ID NO: 69

SEQ ID NO: 41952 - DNA, 160 bp, Homo sapiens
agatataaatatatatattttagacactatatgtattttagacagatatataaaaaatatatattttagaaaagatatatatatattttacacagatatacatatgtatatattttagacagatatatatatttgtgtgtatatatatatatgtgtgtat

SEQ ID NO: 41953 - DNA, 67 bp, Homo sapiens
agagagaccagagctttctctctctctgcatgtgcataatgcacccaggaagaaagtgtggccctct

SEQ ID NO: 41954 - DNA, 105 bp, Homo sapiens
gccatcctttatatatatatatatatatatatatataatattaatatatataaaaatatatgtatatgtgtggtgtgtgtgtatatatatacatatgtgtgtgta

SEQ ID NO: 41955 - DNA, 108 bp, Homo sapiens
cagggataaactctgtttggttatggtgtatgatcctttcagtgtgctattgaattcagtttgctattttttttttttacatctttattcatcagggatattggcctg

SEQ ID NO: 41956 - DNA, 118 bp, Homo sapiens
gctgtggctattcaggattttttctggttccataagaattttagtgttttttttttttctatttctgtgaaaaatgcctttggaattttgattgggaatgcattgaattgctttgagt

SEQ ID NO: 41957 - DNA, 65 bp, Homo sapiens
tatatatatgtgtgtgtatatatacgtatatatgtgtgtgtgtatatatatacttaatgaatata

SEQ ID NO: 41958 - DNA, 117 bp, Homo sapiens
gcagttaagttaaattaatctgaaatctatgctatgtaaatgcaaattcaaagttaattatattttttcccaaaaagctacatttgcatttacagatacagggctcaactcaactgt

SEQ ID NO: 41959 - DNA, 81 bp, Homo sapiens
agcagggagtcaggacacaggggcccagaatcctgtcccagtttggccccactatgtgcccctgcatgtcattccactgct

SEQ ID NO: 41960 - DNA, 56 bp, Homo sapiens
gagatagtgtctcgctctgtcacccaggttggggtacagtggcatgatcatggctc

SEQ ID NO: 41961 - DNA, 68 bp, Homo sapiens
gtctgtgtgtgtatgtgtgagtattttaatttgttttttgagacagagtctcgctctgtcacccaggc

SEQ ID NO: 41962 - DNA, 78 bp, Homo sapiens
gagaaatatctttttttgcttgaatacttttggaaatatatttttctcaattttttttcaggcagagtgttgtttttc

SEQ ID NO: 41963 - DNA, 89 bp, Homo sapiens
atttccagccctggaaactttgctctgtaatcagccaaaggatatacgaaatcagagtggctgttcagcagctccaagctataggagat

SEQ ID NO: 41964 - DNA, 115 bp, Homo sapiens
gtcttactaatgtgagagttttagtacacatgacagttcaatttatgattattgatgaattcattttatatttgtagcatagtggtcattaatctagtgactttcacattttagc

SEQ ID NO: 41965 - DNA, 104 bp, Homo sapiens
gctttcataccattctagagaaaatagattctggtgctatgggacaaattctatttccagtcttacacactaactctattcttcccttgttcagtcatgagagc

SEQ ID NO: 41966 - DNA, 119 bp, Homo sapiens
gtttgtttaatgttatgagcagccaccaatttgtggtgtctctgtatatttttgtaaagattctcatttttatgcttgaagtatttggtgaaaagatgtggttgaccataatttgcaac

SEQ ID NO: 41967 - DNA, 92 bp, Homo sapiens
gcaacattcttctaaaataaacatgcagttcttgctccttttgaaatcactttcaggataatctgtgtgttaggattttctaaggttgtggt

SEQ ID NO: 41968 - DNA, 95 bp, Homo sapiens; identical to SEQ ID NO: 68

SEQ ID NO: 41969 - DNA, 93 bp, Homo sapiens; identical to SEQ ID NO: 69

SEQ ID NO: 41970 - DNA, 89 bp, Homo sapiens
cagatgtgtgccaccatgcctggctaatttttgtatttttatcagagatggggtttcaccatgttggccaggcttgtctcaaactcctg

SEQ ID NO: 41971 - DNA, 58 bp, Homo sapiens
tgagacagagtctcgctctgtcacccaggctggagtgcagtggcgctatctcctctca

SEQ ID NO: 41972 - DNA, 60 bp, Homo sapiens
ctgtgtgtatactgtatgtatatatttatactgtatatgtgtgtatatacatacacacag

SEQ ID NO: 41973 - DNA, 82 bp, Homo sapiens
gagccattgcacctggccattattttattctttaatttaaagatagggaattaaggcttaaaagaggctaagtaatgtgttc

SEQ ID NO: 41974 - DNA, 114 bp, Homo sapiens
tgcttaggactgtcttggctatatgggctctttttaggttccatatgaaatttaaagtagttttttctaattctgtgaagaaagtcattggtagcttgatggggatagcactga

SEQ ID NO: 41975 - DNA, 81 bp, Homo sapiens
aaggcaggaggcaggaggaagaagtatggggagacgcaaagcaagcatctccatgttttctttctttatttcttttttctt

SEQ ID NO: 41976 - DNA, 69 bp, Homo sapiens
gggagaaaagagaacctgctctcggtaagcatttatcttactgggtttctgtcagtgtctcagtctttc

SEQ ID NO: 41977 - DNA, 116 bp, Homo sapiens
gattgcatcctgaacattgtcagtgttatagtgcatagtttctaagtccttttgtaatccttagaagaatgttgatgtttttgctttagcagtcaatcagtgcggttaggctgtga

SEQ ID NO: 41978 - DNA, 70 bp, Homo sapiens
gtctcagtctctcactgtccaggttccaaagaggtgtcatggtaccaggatactggggtatattgggcac

SEQ ID NO: 41979 - DNA, 79 bp, Homo sapiens
tgtgcatgtgtatgtgtgtgtgtgtatgtgtgtatagatatatctatatacatatatgtatatactatataaatgtata

SEQ ID NO: 41980 - DNA, 71 bp, Homo sapiens
tatctataaacacgtatgagtatacatagatatatacatttatatagtatatacatatatgtatatagata

SEQ ID NO: 41981 - DNA, 104 bp, Homo sapiens
ccccgtaaaacatgtgatggcctttcctcagaagacactgtggactgatcaaatgtgaccctctgcttctgattttctgagcttctctcataggactctcgggg

SEQ ID NO: 41982 - DNA, 115 bp, Homo sapiens
gtgagctacaggatcaagtgaattccaaggagggaagtttcttgagtgaagatagtctccactttcttgccacccactcacctcttaacctcctgtagcctgattgtgtttttat

SEQ ID NO: 41983 - DNA, 69 bp, Homo sapiens
tctgagggacagcaaatccatgtggtacatagagttcacataagattgagacttaaagtgtcccttgga

SEQ ID NO: 41984 - DNA, 107 bp, Homo sapiens
tattatgttgcagcaattgaattttgacaggtatataaagagttaaatatatttattaaaagattctatgtgtactgtaggcaatgggatgggagttgcaacagata

SEQ ID NO: 41985 - DNA, 115 bp, Homo sapiens
gctggttggttattttgcagacttgttaatgtagttgcttcagagtgtcattggtctgtgtatgtcagtgtgtttttgtagtggctggtaatggtttttcctttccattttcagt

SEQ ID NO: 41986 - DNA, 107 bp, Homo sapiens
accattgtattttcagtgcccagtagaatattgacactcaataaatatttttctaatgaatggatgaatgttatgaggtccaataagataatgggcaagaaagtggt

SEQ ID NO: 41987 - DNA, 71 bp, Homo sapiens
ccacagaaacgcaaatgcctgcctctcactatctctccaaatggcgcccaggaggctttgctcctccgtgg

SEQ ID NO: 41988 - DNA, 144 bp, Homo sapiens
tatatctagatatatctatatatagatatatctatatctatatatatagatatatagatatctagatatatctatatatagatatctagatatatagatatatctatatagatagatatctatacatctatatatctatatatc

SEQ ID NO: 41989 - DNA, 129 bp, Homo sapiens
tatagatatatagatgtatagatatctatctatatagatatatctatatatctagatatctatatatagatatatctagatatctatatatctatatatatagatatagatatatctatatatagatat

SEQ ID NO: 41990 - DNA, 242 bp, Homo sapiens
tatctatatctatatatagatatatatatctgtatatacatatatatctagatatatatagatatatatctgtgtatacatatatctatatatagatgtatgtatctgtatatagatatgtctatagatatatctataatatctgtatatagatatatctatagatatatctgtatatagatatatatatacacacatatatagatatatatctctatatgcacatatatatatctctatac

SEQ ID NO: 41991 - DNA, 58 bp, Homo sapiens; identical to SEQ ID NO: 5571

SEQ ID NO: 41992 - DNA, 58 bp, Homo sapiens; identical to SEQ ID NO: 315

SEQ ID NO: 41993 - DNA, 80 bp, Homo sapiens
ggtccttgagggtgaagcatgcagggccataaccaggagccttgggtcctactctggctctgtcagtcactggctactcc

SEQ ID NO: 41994 - DNA, 112 bp, Homo sapiens
gattacccaaactgaacctaaaatcaaagagtgtgtctttttctctgtgcaattgcaaagcaccaaaagacaggtgaagagatttcattcaaggtgtcaaacatgtgtgatt

SEQ ID NO: 41995 - DNA, 67 bp, Homo sapiens
gtttgacggaggaaattaatcttgaatttttttctttttttggagatgagatcttcctctgtcaccc

SEQ ID NO: 41996 - DNA, 74 bp, Homo sapiens
tatatgtatgtgtatgtatatgtacatatatgtgtatttttatatgtgtgtatatgtatctataggtatatata

SEQ ID NO: 41997 - DNA, 77 bp, Homo sapiens
gccagagtgcaattactgagtcacaggataattatatgtttcattatagaaactatccaacttttttgcaaagtggc

SEQ ID NO: 41998 - DNA, 110 bp, Homo sapiens
gccaagcccaaagccagtggatgagtaagcaggatgaaggttgtatagttgtttgttcacatcctcaccctcctttctatcactttcttatcataagcctagggagtggt

SEQ ID NO: 41999 - DNA, 92 bp, Homo sapiens
tgaaaaacaaatctgctctttaaaagccatcagagtttttgttgttgctttggagctagatggaccttgggcttaagtcagcttgttcttca

SEQ ID NO: 42000 - DNA, 79 bp, Homo sapiens
tctgtccatctgtctgtccgtgtgtgtgcctccgtggctctccttcgctctgtgggacgacagaaccatctgctgcaga

SEQ ID NO: 42001 - DNA, 104 bp, Homo sapiens
tatatagatagatatatagatagatatatagatagatatagatagatagatagatagatatagatatatctatatatatatatatatatatagatatatatata

SEQ ID NO: 42002 - DNA, 84 bp, Homo sapiens
gaaatggacaaagtggagatgggcgagagtggacagaggcttccagggaaattgttattttgttctttactaaaggtctgtatc

SEQ ID NO: 42003 - DNA, 117 bp, Homo sapiens
gtcacctctcaagatggcatctcattgtggttttgatttgcatttctctgatgagtggtaatgttaattttttcatatgcttgttggccacatgtatgtcttcttttgagaagtgtc

SEQ ID NO: 42004 - DNA, 88 bp, Homo sapiens
tgtcttcccttactttacagagtctctctctctctctctgtgatgagatgcctggagctgggagaggggtgacacaagcactctgtgg

SEQ ID NO: 42005 - DNA, 128 bp, Homo sapiens
atgatatatatatacacatatatatcacagtttatatacacatatatgtatatatgtgtatatatatacatatatgtatatatgtgtatatatatatatatggtgtatatatacatatatatgtgtat

SEQ ID NO: 42006 - DNA, 70 bp, Homo sapiens
catatgatcataatcatttctatatgattataatcataaccatatagaaatatgatatgtgatatatatg

SEQ ID NO: 42007 - DNA, 83 bp, Homo sapiens
tgtatatgtatatatgtgtatatatatgcatatgtgtatatatgtatatatatgtgtatatatgtgtgtatatatatatggca

SEQ ID NO: 42008 - DNA, 139 bp, Homo sapiens
tatatatatgtatatatatgtgtgtatatatatgtatatatgtgtatatatgtgtatatacgtatatatatgtgtatatatgtatatatgtgtatatatgtatatatatatgtgtatatatgtatatgtatatatgtgt

SEQ ID NO: 42009 - DNA, 95 bp, Homo sapiens; identical to SEQ ID NO: 68

SEQ ID NO: 42010 - DNA, 93 bp, Homo sapiens; identical to SEQ ID NO: 69

SEQ ID NO: 42011 - DNA, 128 bp, Homo sapiens
actatgtgtgtgtgtgtgtgtgtagtgtatatatatatacatatatatatgtatatatatatatgtatatatatatacatatatatatgtatatatatatatgtatatatatatacactacacacacg

SEQ ID NO: 42012 - DNA, 108 bp, Homo sapiens
gtgagcaactcttgttttaataacagtatgaatgcagggacttaacaatatttgattatattcaatccattgtaatttttatcatggttgaagctcagattgtctcat

SEQ ID NO: 42013 - DNA, 85 bp, Homo sapiens
tacttctatcaattcctcagactcattctctgtccagttttgttcccttgctggcaaggagttgtgatcctttagaggaaaagtg

SEQ ID NO: 42014 - DNA, 156 bp, Homo sapiens
gcacatagtgtgtgtgtgtgtatatatatatgtatatatgtatatataagtatatatgtatatatgtatatataagtatatatgtatatatgtatatgtgtatatacatgtatatatatgtatacatatatgtgtgtatatatatatatatattta

SEQ ID NO: 42015 - DNA, 109 bp, Homo sapiens
ggaaagctcaacactaggaaggaggattttctccttatgtaactggctcattcactcccagactgagtgtaggcatgaggaaatcttttgcttggccatcaaagccgcc

SEQ ID NO: 42016 - DNA, 112 bp, Homo sapiens
ccttctgttttgaagagtaagactgcattatcaaccagtctctctttcactgatattggttggaagaggaattgaattgtttgctaagatggtccaaagcttcccagattgg

SEQ ID NO: 42017 - DNA, 97 bp, Homo sapiens
gactgcaattttaaagagtgtctgattatttatatttggagacaaaatcttgtaaaactctccgaataaagtgtgaaataattctataaattcagtt

SEQ ID NO: 42018 - DNA, 95 bp, Homo sapiens
atatatatatatatggggtgtatgtgtatatatatatatgtgctatatatacacacaccatatatatatacacacaccatatatatatgtgctat

SEQ ID NO: 42019 - DNA, 58 bp, Homo sapiens
tgagacatggtctcactctgtcacccaggctggaggacagggacatgattatggctca

SEQ ID NO: 42020 - DNA, 104 bp, Homo sapiens
gtaaatatatcagttctataagcaggatttgagtaattacagtgaattttatttttaatgtatatgtttctcttcaggcgctatgaactgaaaaatatgttttc

SEQ ID NO: 42021 - DNA, 118 bp, Homo sapiens
tccagcctgggtgacagagcaagaccctgtctcaaaaaaaaggaaaacctaaatttaaaatattttcttctttttttttttttctgagacagagtctcgctctgttgtccaggctgga

SEQ ID NO: 42022 - DNA, 81 bp, Homo sapiens
aaatatatatatatatatataaaataggtatatatatacatatgtgtgtatatatatgtctgtgtgtgtatgtatatattt

SEQ ID NO: 42023 - DNA, 58 bp, Homo sapiens; identical to SEQ ID NO: 1725

SEQ ID NO: 42024 - DNA, 94 bp, Homo sapiens
gttacaaccacatcagtgatttgtgatgtgtcaaacagcagtgtgaagtgatgacagtcacattcagtgtgtgttgcaaccactcaactctgct

SEQ ID NO: 42025 - DNA, 95 bp, Homo sapiens; identical to SEQ ID NO: 68

SEQ ID NO: 42026 - DNA, 93 bp, Homo sapiens; identical to SEQ ID NO: 69

SEQ ID NO: 42027 - DNA, 89 bp, Homo sapiens
aagcacttatcaaatacctattgttcataaatattttatttaaccaataaatataaatatttattgagcatctgtattagttagggttt

SEQ ID NO: 42028 - DNA, 119 bp, Homo sapiens
tcaatgaaacgggtgggtggaactcaaccataatgatacaaagaactatttattcttttattgaaaaaaagggtgactggagactggatcacactgtgggaacttgctgagaattttgg

SEQ ID NO: 42029 - DNA, 99 bp, Homo sapiens
tgttaatgctggtcagttgagtctaaactccaaaagggagaggatataatgaggcatgtctgactccctctttgcgtcatggctttcactagtttttca

SEQ ID NO: 42030 - DNA, 76 bp, Homo sapiens
tgtgtgtgtgtgtgtctgtctgtatatgaaatatatatctatttgttttacacacacacacacacacacacacaca

SEQ ID NO: 42031 - DNA, 114 bp, Homo sapiens
tgacaactacttttattgtctttataatgcccggtaatacccgtgactttatttttaaatatattttttaatttttagttctggggtacatgtgcaggatgtgcaggtttgtta

SEQ ID NO: 42032 - DNA, 118 bp, Homo sapiens
gcagcccctcaagtagctgggactgtaggcatgcagcaccacctccagctaattttttactttttgtagagatggggtcttgctatgttgcccaggctggtctcatacttccgggctc

SEQ ID NO: 42033 - DNA, 124 bp, Homo sapiens
tttgaggattggggtgtcctgactgcagacttggatttactcttgagttcaaggctgatcagtcacacaaactcagtgatattcaggtatcctcaagcacagtgggaagtcatgcataggtaca

SEQ ID NO: 42034 - DNA, 96 bp, Homo sapiens
agagcaagactccgtgtgagaaaaaaaaaaaaaaaaaaaacctcaggaaataaatgcacattggtttttttgtttttcaaaacggaatcttgctct

SEQ ID NO: 42035 - DNA, 112 bp, Homo sapiens
cctggagacattcttttaatttattgaagcttagttctgttggagatcaattctatcagattttgtttttctgagtctttatttaaccatttttgaaggatatttttcctgg

SEQ ID NO: 42036 - DNA, 58 bp, Homo sapiens; identical to SEQ ID NO: 12594

SEQ ID NO: 42037 - DNA, 90 bp, Homo sapiens
ctgaaattatcctgccaggagccttctgttactaatcataagcaaggggaccactttcccagtctcagtctctgtagcaggaaacttcag

SEQ ID NO: 42038 - DNA, 59 bp, Homo sapiens
acaaatatgcatgtgtacgtgtgtatatatatgtatatatacacatacacacaatttgt

SEQ ID NO: 42039 - DNA, 76 bp, Homo sapiens
tggggtggagggaggagtggttgtttcaggactaaaatattttggtaaacacaatctttttttttgttacagccca

SEQ ID NO: 42040 - DNA, 95 bp, Homo sapiens; identical to SEQ ID NO: 68

SEQ ID NO: 42041 - DNA, 93 bp, Homo sapiens; identical to SEQ ID NO: 69

SEQ ID NO: 42042 - DNA, 117 bp, Homo sapiens
ccaggaaaatgcaagtcaaaatcacagtgagatatcatctcatgcctgttagaatggtggttgttattattattattattattttgagacggagtctcactctgttgcccaggctgg

SEQ ID NO: 42043 - DNA, 208 bp, Homo sapiens
cataattatatatatatacacatagatatatagatacatctatatacctatatataaatatgtatatatgtgtatatagatatatctctatgtatatatgtgtatatatacatatgtatgtatagatatatatagatgtttatatatatataaatatgtatatagatgtttatatatatctatataaatatatatattaccacattac

SEQ ID NO: 42044 - DNA, 95 bp, Homo sapiens; identical to SEQ ID NO: 68

SEQ ID NO: 42045 - DNA, 93 bp, Homo sapiens; identical to SEQ ID NO: 69

SEQ ID NO: 42046 - DNA, 121 bp, Homo sapiens
tgtgtgcatgtgtctgtgtgtgtagagtatgtatatacctatacagagtcaatagatatattcatataaatttatatatattttatgcatgtgtatatatttataatttgtatgtatatat

SEQ ID NO: 42047 - DNA, 106 bp, Homo sapiens
tggatataagccattttaactgaggtgagatgatatttcattgtatttttgatttgcatttctctgatcaatgatgttaagcaccttttcatgtgcctgtttgcca

SEQ ID NO: 42048 - DNA, 96 bp, Homo sapiens
ccactctcctatatctaggttttgtatatatttacttatgttactttatattaggtagatgttaaaacaccgaaatctgaatttttattagagtgg

SEQ ID NO: 42049 - DNA, 69 bp, Homo sapiens
tagtgtctcgctctgtcacccaggctggagtgcttcccaaagtgctggcattataggcgtgagccactg

SEQ ID NO: 42050 - DNA, 90 bp, Homo sapiens
ggcgaaggcttttgcttcctgcacactgtgattctctgtatctacctgtctgtctctctggttttcaaggcagcagtttgccctttgacc

SEQ ID NO: 42051 - DNA, 102 bp, Homo sapiens
cagcctgagttcagattctgtgactgatttattttatttatttagggtttttttttttttttttttttttgagatggagtttcactcttgtcacccaggctg

SEQ ID NO: 42052 - DNA, 91 bp, Homo sapiens
gtttaaatttgatgttttctgagtttctctctgcttcaaatgtctaagaatgttgaaattagcagggaaaaaggaaaatataagtgtgaac

SEQ ID NO: 42053 - DNA, 63 bp, Homo sapiens
gctctctcactctctcacacacaggcactgcagggatgccatgtgagcacacagtgagaaggt

SEQ ID NO: 42054 - DNA, 117 bp, Homo sapiens
tttggaacctgttggatattagttagcagttctcactgatgaatacctgtggtaatttttatttatttatttatttatttttctgagactgagtcttgctctgtcacccaggctgga

SEQ ID NO: 42055 - DNA, 118 bp, Homo sapiens
tatatttatatttatatttatggctattatatgtatatgtatgtatgtgtatatatatgtccattatatatatataatatatataatatattcctagaatatatatagaatatatata

SEQ ID NO: 42056 - DNA, 77 bp, Homo sapiens
ggaggccgaggtgggcggatcacgaggtcaggagattgagaccatcctggctaacactgtgaaactctgtctctact

SEQ ID NO: 42057 - DNA, 74 bp, Homo sapiens
ggtcttccctctgtgtatatctgtgtccgaatttcctcttattgtaaggatactagtcgtactagattaggacc

SEQ ID NO: 42058 - DNA, 74 bp, Homo sapiens
tttttttgagactgagtctcgctctgtcacccaggctggagtgcagtgagtggtgtgatctcagctcactggaa

SEQ ID NO: 42059 - DNA, 118 bp, Homo sapiens
ctccctagcttctccaggattctccaggaaccatgctttccaaaaggcagtgtgtcactgtgtcttaaagggagatgtgcatggttctgtgaatcttctttcttcacaagcccatgag

SEQ ID NO: 42060 - DNA, 128 bp, Homo sapiens
cattttacttctaattaacctgaaacttttaagagcctattctgctgtcattttttgtttttgttttggatagaggggtgagaagaacaatcaggtagtttaggtagggtggattgaggggtagatag

SEQ ID NO: 42061 - DNA, 77 bp, Homo sapiens
ggagagggtgtggtggaatcagaaagagatgaagactgaatttttttttttttttgagacgtagtctcgctctgtcc

SEQ ID NO: 42062 - DNA, 96 bp, Homo sapiens
tctggaccaatgccatagacttttagtgtctcttggcagagatgccaaataaacagttggatgtatggttttggggtcaggagagaatctggggtt

SEQ ID NO: 42063 - DNA, 95 bp, Homo sapiens; identical to SEQ ID NO: 68

SEQ ID NO: 42064 - DNA, 93 bp, Homo sapiens; identical to SEQ ID NO: 69

SEQ ID NO: 42065 - DNA, 70 bp, Homo sapiens
tagttagaggaagaagttcagtgcagggggtggagaaacctgtctgtctgtctgtctgtctatctatcta

SEQ ID NO: 42066 - DNA, 93 bp, Homo sapiens
aggaccagaaatggctactgtcagaagtgagtgagaaacaaagcctggggaaaggatgtaggatcacaggtaagtcaaacagcagttagtcct

SEQ ID NO: 42067 - DNA, 115 bp, Homo sapiens
cctgactttttaatgatcaccattctaactggtgtgagatggtatctcattgtggttgtgatttgcatttctctgatggccagtgatgatgagcattttttcatgtgtctgttgg

SEQ ID NO: 42068 - DNA, 73 bp, Homo sapiens
gctactctctttgtatatctgagcagtcttatttcttgtgtagataattgctcagttaaaaggggaagggagc

SEQ ID NO: 42069 - DNA, 59 bp, Homo sapiens
tgatactgagtctccctctgtcacccagggctggagtgcagtggtacgacctcagctca

SEQ ID NO: 42070 - DNA, 87 bp, Homo sapiens
gcatttgggtattgtggtgggagtgttttctttttcttttttatttttttgagatggagtcttgctctgtcacccagacttgagtgc

SEQ ID NO: 42071 - DNA, 58 bp, Homo sapiens
tgagacaaggtctcactctgtctcccaggctggagtgcagtggtgcgatcatgactca

SEQ ID NO: 42072 - DNA, 58 bp, Homo sapiens
tgagacacagtctcactctgtcacccaggctggagtgcagtggtgagatcatggctca

SEQ ID NO: 42073 - DNA, 58 bp, Homo sapiens
tgagagggagtctcactctgtcacccaggctggagtgcagtggtgcaatctcggctca

SEQ ID NO: 42074 - DNA, 105 bp, Homo sapiens
aattgcttctaactgttccaaattaagacatctggtgacttagggaaatttggtttctctgtttggttaaccagctggttgttctggaaaggaaaaaggcagtta

SEQ ID NO: 42075 - DNA, 82 bp, Homo sapiens
ttgttttgtttttgagacaaggtctcactctgtcacccaggctggggtgcagtggcttgatcatggctcactgtagcatcaa

SEQ ID NO: 42076 - DNA, 120 bp, Homo sapiens
agagcgagaccctgtctcaaaaaagaaaaaaaagaaaaaaacttctctcttgtcttcagttttctttttttgtttctttttttcttttttttttttttttttgagacggagtctcactct

SEQ ID NO: 42077 - DNA, 126 bp, Homo sapiens
tatatatggatatatgtgtggatatatatgtgcatatatatggatatatatatgtggatgtatatatggatatatatatgtggatgtatatatggatatatatggatgtatatatggatatatatg

SEQ ID NO: 42078 - DNA, 116 bp, Homo sapiens
ttgttgtatgttatctttattttattttttcccaaatatgtattttttcccttgagacagggtctcactctgtcacccaggctgaagtgcagtggcatgatcatggctcatggcag

SEQ ID NO: 42079 - DNA, 93 bp, Homo sapiens
ggtgtaataagcatctaaccagccaaagataatttgcttttatttatcataactgagtaatctgaattggttagagaagcaaaaatattacct

SEQ ID NO: 42080 - DNA, 67 bp, Homo sapiens
atatataatgtatatactggagatcatatatatacatatatatgatctccagtatatatgtgtatgt

SEQ ID NO: 42081 - DNA, 209 bp, Homo sapiens
catgccagcatacatatatatacatatacatatatatatgtatatacgtgtgtgtgtatatatatatgtgtgtatatatatgtgtatatatgtgtatatatgtatatacatatgtatatagacgtgtgtgtgtgtgtacatgtgtgtgtgtgtgtgtgtgtgtgtgtgtgtgtgtgtgtgtatatatatatatatatatatatatgtat

SEQ ID NO: 42082 - DNA, 86 bp, Homo sapiens
ctatatatttacatatctacatctatatctgtttatatatatctagatagatagatagatagatagatagatagatagatggatag

SEQ ID NO: 42083 - DNA, 116 bp, Homo sapiens
agatttcaagtttcctggataaatgataataggtattaagtgaaactatgattttctaagtataaatgaatcatttctaagagtcctttaaatttgtcttggattacaggttgttt

SEQ ID NO: 42084 - DNA, 73 bp, Homo sapiens
aaattgtgtgtccgtgtgtgtgtgtgtatgtgtgtgcatgcgtgcagatgcgcacacacggggtatgcaattt

SEQ ID NO: 42085 - DNA, 83 bp, Homo sapiens
ggacacacacacaccctgtcactcacattctcacctgtctcctggggctcaccgggtagtgaactgtgagcctgtttgcgtcc

SEQ ID NO: 42086 - DNA, 116 bp, Homo sapiens
gttcagagtttggtaaagccgggcgtgttttccaccaatgtttctttttatttgctaataaaaagtaaagtcatagaatgaattatttagaaaataaagtctgccaagctattcac

SEQ ID NO: 42087 - DNA, 126 bp, Homo sapiens
acttgcttttacttcagatttcatatgaagcttttgccttagagatgtaacactagagagaaagcacagacttggaacgaggtgatatcgagtccccctgatccagctatttgctgcctagacgtc

SEQ ID NO: 42088 - DNA, 73 bp, Homo sapiens
ggccttgttactgcaagatcttaactataaaactaacttcaaggttaagaatggttttcagaagtccaaggcc

SEQ ID NO: 42089 - DNA, 116 bp, Homo sapiens
tgtgtcaaattttgataacactttgcaatatttctaactttttcattatatctattacagtgatctgtaatcagtgatttttgatgttactattgtaattgttttggggtgccaca

SEQ ID NO: 42090 - DNA, 58 bp, Homo sapiens; identical to SEQ ID NO: 19783

SEQ ID NO: 42091 - DNA, 87 bp, Homo sapiens
tgaaaatgagaaaagagactagtctcattatagatttttttttttattcttattttattttatttgagacaaggtctcgctctgtca

SEQ ID NO: 42092 - DNA, 102 bp, Homo sapiens
gtaggataaacagaaagcaagggtgaggcatttcgagtatttatatagatgtgtatgtaaataattgaggagggtacacagcagcttggctggaaatgtaac

SEQ ID NO: 42093 - DNA, 82 bp, Homo sapiens
gcagtcaggctgagtgtgtgcctgtggtggaatgagcccttcaggccgagtctcaggcagttgccacaagcagcctgtatgt

SEQ ID NO: 42094 - DNA, 235 bp, Homo sapiens
atatatatatatatatatatatatatatatatatatatatatacttgtaaatatatatatatatatttgcaagctgtatatatatatatatatatgcaagctgtatatatatatatatatatatgcaagctgtatatatatatatatgcaagctgtatatatatatatatatatgcaagctgtatatatatatatatgcaagctgtatatatatatatatgcaagctgtatatat

SEQ ID NO: 42095 - DNA, 183 bp, Homo sapiens
gcttgcatatatatatatatacagcttgcatatatatatatatatatacagcttgcatatatatatatatacagcttgcatatatatatatatatatatacagcttgcatatatatatatatatatacagcttgcaaatatatatatatatatttacaagtatatatatatatatatatatat

SEQ ID NO: 42096 - DNA, 57 bp, Homo sapiens
tatgcaagctgtatatatatatatgcaagctgtatatatatatatgcaagctgtata

SEQ ID NO: 42097 - DNA, 81 bp, Homo sapiens
ctgaagctctctctgtgtctctaggggtgggaaggcagtgtctgtggttatccacctccattcagagccaagtgagttcag

SEQ ID NO: 42098 - DNA, 84 bp, Homo sapiens
ttctggcctcctgaactgagtgagaacacatttgctgttttaagccacccagtgtgtggtcatttgttaaggcagccctaggaa

SEQ ID NO: 42099 - DNA, 70 bp, Homo sapiens
gaaaagctgggcagtcggggagagccagggacaaactgaaacctatctctgtccctcactgcctgttttc

SEQ ID NO: 42100 - DNA, 82 bp, Homo sapiens
gagacttccccctccttctgggtgcccctagggaaatctgattaaaagatttttgtttatctagaaaagtgggtgatatttt

SEQ ID NO: 42101 - DNA, 58 bp, Homo sapiens; identical to SEQ ID NO: 2540

SEQ ID NO: 42102 - DNA, 87 bp, Homo sapiens
gcacatgcctgtagtcctagctactcaggaggctgaggtagaaggatcacttgagtctgggaggcagaggttgcaggcagagagtgc

SEQ ID NO: 42103 - DNA, 56 bp, Homo sapiens
gagacatgatctcactctgtcactcatgctggagtacagtgctgtgatcatagctc

SEQ ID NO: 42104 - DNA, 111 bp, Homo sapiens
gccgggtgtggtggtggacgcctgtaattccagctactagggaggctgaggtaggagaatgacttgaatctgagaggcagaggttgcagtaagccgagatcacaccattgc

SEQ ID NO: 42105 - DNA, 96 bp, Homo sapiens
ggtcccaatgcaaaataaaaatgcgaggccctttgtttgaaaagtattaagaatttcaagatagcaacagcagagcatgaaaccaagcatggggcc

SEQ ID NO: 42106 - DNA, 94 bp, Homo sapiens
ccgggcgtcgtggcgggcgcctgtagtcccagctactcgggaggctgaggtaggagaatgtcatgaacctgggaggtggagcttgcagtgagcc

SEQ ID NO: 42107 - DNA, 60 bp, Homo sapiens
tgagacggagtctctcactgtgtcacccaggctggagtacagtggtgtgatctcggctca

SEQ ID NO: 42108 - DNA, 116 bp, Homo sapiens
tgatgataatcgaatgaggctttttttttccctttctgctataggaaaaaaagaaaaaaatatatttttcttttcttttctttttttctgagatggaatttcactcttgtcactca

SEQ ID NO: 42109 - DNA, 77 bp, Homo sapiens
taatgactacattttataatactatataaacatgcaagtttgatctttgtatagtttagtaaaagctatggtcatta

SEQ ID NO: 42110 - DNA, 58 bp, Homo sapiens
tgagacagaatctcactctgtcactcaggctggggtgcagtggtgggatctcagctca

SEQ ID NO: 42111 - DNA, 89 bp, Homo sapiens
taaaggaaagaaagagtactaagaaaaggatggtcttggaatgggaaagaaacatcacaatttctttttcttttttttttttttttttg

SEQ ID NO: 42112 - DNA, 58 bp, Homo sapiens
tgagacggagtctcactctgtcacccaggctggagtgtagtggtgtgatctccgctca

SEQ ID NO: 42113 - DNA, 116 bp, Homo sapiens
tgcattccatttcaaatggcaaaatgttgagtagactgtaataattgttgtatatagatataattatccctagattaactactaaaaatgctctataggccaggcacggtggagca

SEQ ID NO: 42114 - DNA, 59 bp, Homo sapiens
tgaaacaagagtctcgctctgtcacccaggctggagtgtagtggcgtgatcttggctca

SEQ ID NO: 42115 - DNA, 71 bp, Homo sapiens
gctttggtgctgggagtctggcgatagctgtgtgatccagcaagtagctcagcctctctcagtctcagggt

SEQ ID NO: 42116 - DNA, 75 bp, Homo sapiens
tgggattaagacctgagtgaggagacaaagggatctgaagacgtggttcttgtattcacagggtttgcgatctca

SEQ ID NO: 42117 - DNA, 95 bp, Homo sapiens; identical to SEQ ID NO: 580

SEQ ID NO: 42118 - DNA, 93 bp, Homo sapiens; identical to SEQ ID NO: 69

SEQ ID NO: 42119 - DNA, 107 bp, Homo sapiens
aggtatttattataaaggtatttatatgtgtatatatatatacacatatgagtgtgtgtgcgtatatatatatatatatatatatatatatatatataaaggtattt

SEQ ID NO: 42120 - DNA, 142 bp, Homo sapiens
tgtgagctaataagatatatatatacatgtatatatgtatatatgtgtgtgtatatatatatgtgtatatatatacacacatgtgtatatatatgtatgtatgcatatatatacatatacatatatatatatatatatatat

SEQ ID NO: 42121 - DNA, 97 bp, Homo sapiens
agcagtaccagtgtggatagactatactactcttgtgactcagtttctctctcattggggtaataaagctctgttaattgatacttagacaaaggct

SEQ ID NO: 42122 - DNA, 97 bp, Homo sapiens
tatgacaggattttattctttcttatggctgaataatattctattataatatagaatattacatgtatataatatggaataatattaatatggaata

SEQ ID NO: 42123 - DNA, 111 bp, Homo sapiens
aacatgagtttttgcagggacgagccacatccaaaccatagcactcttattttataaatttttgttaaaacttcgttgtgatttgaattgtctctctctgaaggatgtgtt

SEQ ID NO: 42124 - DNA, 99 bp, Homo sapiens
ctcagacttctagaatgtaagctccatgcagaagggatctttgtctctgtcacagatacatcctatgtgtttagaagagtctctgggatatggtgtgag

SEQ ID NO: 42125 - DNA, 110 bp, Homo sapiens
aactatcctttgcaaatcacatacaagccaagagttccttgagggtaaggacaattatttattgtttgttattgcttcaggatctaatgtgatgatgtttgtcaatagtt

SEQ ID NO: 42126 - DNA, 110 bp, Homo sapiens
agcctgctttctactttcaccagtggagtctttctgtctgggccaatctcagttctcagtctctgtccagaattttcaaatgctcccaggaaataaaataggagatggtt

SEQ ID NO: 42127 - DNA, 57 bp, Homo sapiens
tgagccagagtctcactctgtcaccaggctggagtgcagtggtgcgatctctgttca

SEQ ID NO: 42128 - DNA, 116 bp, Homo sapiens
attttatctcataacattggttgatgatgttcatgggtcacaggaatttttacgaaattttaaaattatttaaaaatatgtgactaaataattctagctacacactgaggtaagat

SEQ ID NO: 42129 - DNA, 81 bp, Homo sapiens
ggctttgtgtgtgtttgcacatatgtatgtatgtgtatatatacatatacaaacacatgtgcatataaaatttatcttgct

SEQ ID NO: 42130 - DNA, 80 bp, Homo sapiens
agggtataaaataaagactggtaagataaagggctggaagcaggcctttatcccatgttaagaagtttggtttttatcct

SEQ ID NO: 42131 - DNA, 106 bp, Homo sapiens
cagtttgtcaattcagttttcagctccagaatttctgcttgattgattttaattatttcagtctcttagttaaatttatctgatatgattctgagttcattctctg

SEQ ID NO: 42132 - DNA, 93 bp, Homo sapiens
acacgggctaaggcattgtttctgggaatattaagtgagcaaattattattgtttattttttgtttttttttgagacagagtcttgtctctgt

SEQ ID NO: 42133 - DNA, 101 bp, Homo sapiens
tataggctcttttttggttccatatgaactttaaagtagtttttttctaattctgtgaaaaatgtcaagggtagtttaatgggaacagcattgaatctata

SEQ ID NO: 42134 - DNA, 179 bp, Homo sapiens
agatctatatctagatatcgatatatagatatatagagatatttatctagatatctatatatacatatatatctatatatatctagatatcgatatctagatatatatctatatatctatatatatctgtatatctatatatagatatatatatagatctgtacatatagatatctata

SEQ ID NO: 42135 - DNA, 95 bp, Homo sapiens; identical to SEQ ID NO: 68

SEQ ID NO: 42136 - DNA, 93 bp, Homo sapiens; identical to SEQ ID NO: 69

SEQ ID NO: 42137 - DNA, 83 bp, Homo sapiens
tgctaagtgcctacatgtttaacattgtttttattttttgtagattgaaaaatgaacaaaaatgagtttgtagtatcttagta

SEQ ID NO: 42138 - DNA, 117 bp, Homo sapiens
gtttgaatctggagattgcagttttcacttgattaccaatgcatgactgtgtgtgctcaaactgacacgctctatcaaaatggagattataggaatatgccattgctatctaaaaac

SEQ ID NO: 42139 - DNA, 83 bp, Homo sapiens
gcaagtatagagaactgaaagagtctggctttttttttttttttaagagacaaggtctcactctgtcatccagactagagtgc

SEQ ID NO: 42140 - DNA, 61 bp, Homo sapiens
tgagacagagtctcactctgtcacccagcaggctggagtgcagtggtgtgatctcagctca

SEQ ID NO: 42141 - DNA, 78 bp, Homo sapiens
ttaaagggaatgttatctcagtcagtctctcattaaccatgtaattagactgctgaaaataattaacattccttttga

SEQ ID NO: 42142 - DNA, 98 bp, Homo sapiens
agcctgggcgagagagcgagactctgtctccaataaataaataaataaataaaaataaaagagaaagtggagagagtggacactggcctgtgtgggct

SEQ ID NO: 42143 - DNA, 56 bp, Homo sapiens
gatagagaagacccactcttttttttttttttttcaagacagggtctggctctgtc

SEQ ID NO: 42144 - DNA, 102 bp, Homo sapiens
tagctagaccagaacaccagcaggaaccaaagcgacttgcactcagcaagctcagggctggcaggctcgctgtgtggctctgcttctcgttcaatctgttta

SEQ ID NO: 42145 - DNA, 74 bp, Homo sapiens
attagcaattcagaagtttcagatatatatatatatatatatatatatctccttactgatcacaattgcctagt

SEQ ID NO: 42146 - DNA, 81 bp, Homo sapiens
tggcatggcatttggtgaaatatctcttaaatctttttttctttttcttttttaagagagtctccctctgtcatccaggcc

SEQ ID NO: 42147 - DNA, 102 bp, Homo sapiens
tgttcccaagcagacagccttatacctggcagctctagtgcctctctcagtgactgaaggacctgatctagctgctgggagagggtggtgtggctggcaaca

SEQ ID NO: 42148 - DNA, 70 bp, Homo sapiens
ttgtttagagtcagtgtctcactctgttgcccaggctggagtacagtggtgccatatcggctcactgcaa

SEQ ID NO: 42149 - DNA, 109 bp, Homo sapiens
tttgcatatgttctcctgaggaacaggatagttataacttaaacttgcatttatatatttctgattaagttgttaactatggttctagatagaagaataaagaagtaaa

SEQ ID NO: 42150 - DNA, 106 bp, Homo sapiens
tagcctggaccttctgtagctttttgtgttctgaatggtggtgtctttttttttttttttttttatactttaagttttagggtacatgtgcacattgtgcaggtta

SEQ ID NO: 42151 - DNA, 95 bp, Homo sapiens; identical to SEQ ID NO: 580

SEQ ID NO: 42152 - DNA, 93 bp, Homo sapiens; identical to SEQ ID NO: 69

SEQ ID NO: 42153 - DNA, 100 bp, Homo sapiens
tgggatcaccttacatattttcagttggagaaaacctggagatttatttttcttttggtatcaatttctagaaacctgtcgtatgactaagagtttccca

SEQ ID NO: 42154 - DNA, 61 bp, Homo sapiens
tgagacagagtctcactctgtcgcccaggctggagtgctggagtgcagtggcatgatctcg

SEQ ID NO: 42155 - DNA, 128 bp, Homo sapiens
gtatttttatatatattacaaatacctattagagatatgtattagtaaatgtcatatacatatttatatatatatacatgtaaatatataggtatttgtgtgtatatgacactatatgaatacaaatc

SEQ ID NO: 42156 - DNA, 90 bp, Homo sapiens
atatatatatatatatacgtatatatatatatacacacgtatatagatgtgtgtgtgtatatatatatacacgtatatatacgtgtgtgt

SEQ ID NO: 42157 - DNA, 181 bp, Homo sapiens
atatatatatacgtgtgtatatatatatatacgtgtgtgtatatatatatatacgtgtgtgtatatatatatacgtgtgtgtatatatatatacacacacgtatatatacgtgtatatatatatacacacacacatctatatacgtgtgtatatatatatatacgtatatatatatatata

SEQ ID NO: 42158 - DNA, 86 bp, Homo sapiens
gtgtgtttatgtatgtgtgtttatgtatatgtgtgcatacaatgtgtgtatgtgtgtgcatgtatatatatgtgtgtacatgcatg

SEQ ID NO: 42159 - DNA, 56 bp, Homo sapiens
gagacaaggtctcactctgtcacccaggctggagtgcagtggtgggatcatagctc

SEQ ID NO: 42160 - DNA, 70 bp, Homo sapiens
aggagcggctggacttgtgtgtctctacttcaccttgatgctggagaacacagtgttcagtgtagctctt

SEQ ID NO: 42161 - DNA, 86 bp, Homo sapiens
ggtgatcctcccaccacagcatctcaagtagctgggaatgcaggcccagctagcttctgtatttgttgtagagatgggtttttgcc

SEQ ID NO: 42162 - DNA, 58 bp, Homo sapiens
tgagactgggtctcactctgtcacccaagctgggatacagtgatgggattttggatca

SEQ ID NO: 42163 - DNA, 58 bp, Homo sapiens; identical to SEQ ID NO: 315

SEQ ID NO: 42164 - DNA, 60 bp, Homo sapiens
ttgagacagggtctcactctgtcacccaggctggagtacagtggtgcgatctcggctcag

SEQ ID NO: 42165 - DNA, 58 bp, Homo sapiens; identical to SEQ ID NO: 9924

SEQ ID NO: 42166 - DNA, 104 bp, Homo sapiens
ggggtggaaagtgggggtcccagagagcatgaggtagtaggaagaatgtgatgtttaatcacagtgtgatgctttgaggcatgggccaagtcactttcttcttc

SEQ ID NO: 42167 - DNA, 116 bp, Homo sapiens
atgatcatttagtgtttttcttgatggccacagttttgttttgtgttgtttcccccctactttttttttttttttgagacagtctctctctgttgcccaggctggagtgcgatcgt

SEQ ID NO: 42168 - DNA, 139 bp, Homo sapiens
tgcactccagcctgagtaacagagcgagactctgtctcaaaaaaaaaaaaaaaagagagatgaggtctcactctgtcactcagctggagtgcagtggcagccttgacctcctgggctcgagtgatcctcctgcctcagc

SEQ ID NO: 42169 - DNA, 68 bp, Homo sapiens
gagtgacagagtgagacctcatctctcttttttttttttttttgagacagagtctcgctctgttactc

SEQ ID NO: 42170 - DNA, 80 bp, Homo sapiens
tatatacatatatacgtatatatgtgtgtatatatacatatgtatatatacacacatatatgtatgtatatatgtatgta

SEQ ID NO: 42171 - DNA, 81 bp, Homo sapiens
gttgcccaagccaagtagtcagcaggagcttcatggctgttagctggagcggaaggctggctgcctggttgccacagcaac

SEQ ID NO: 42172 - DNA, 116 bp, Homo sapiens
ccagcctcacgtgagcactgctttttccattgatccgacactctcacccacactgtcaccactaatcctgggagacaggtcagggtcaaggaagaaagtgatgcacagagaggtgg

SEQ ID NO: 42173 - DNA, 74 bp, Homo sapiens
accagtatgaagttacagaaggactgtggcttccatcttaggtgtgctctctcagtctctctgagactgttggt

SEQ ID NO: 42174 - DNA, 116 bp, Homo sapiens
ccatccctgggcacctgtttttaatttgctgacaatacagaagccttgcttgaaatgtatagaattgtgtgcagaaaatgccaaaaccctaacacaggacctagaggagagcctgg

SEQ ID NO: 42175 - DNA, 56 bp, Homo sapiens; identical to SEQ ID NO: 324

SEQ ID NO: 42176 - DNA, 112 bp, Homo sapiens
gagggggtgggtttgttataaaagaataagtttggcccctcttgctctctcaccctctctttgcctgtcaaccatgggatgatgcaacaagaaggtccttgccagatgccag

SEQ ID NO: 42177 - DNA, 91 bp, Homo sapiens
gccactgctctcggccccaaagtgactctgaactctgttttcccatcccctctgatcactttctctcaccacgtgggtcatttgtggtggc

SEQ ID NO: 42178 - DNA, 72 bp, Homo sapiens
ctgagtcgtttccatccctttacgtgtctcagtttctctctcgagaggtctatgaccttggagagggctcag

SEQ ID NO: 42179 - DNA, 93 bp, Homo sapiens
ctgaagatccctgtttctctgtgccttcatctatatttggaattgtcagactttttaattttttccaaatgaaaacagtgaagcagatcgcag

SEQ ID NO: 42180 - DNA, 135 bp, Homo sapiens
tatgtgtgtatgtatatgtgtatgtatatgtgtgcgtgtatgtgtgtgcgtgtatgtatgtgtatatgtatatgtgtatgtatgagtgtgtatatgtgtgtgtatgtgtgtgtgtatgtgtgtgtatgtgtgtat

SEQ ID NO: 42181 - DNA, 58 bp, Homo sapiens; identical to SEQ ID NO: 17921

SEQ ID NO: 42182 - DNA, 108 bp, Homo sapiens
tggagtaatgggcaggttaaaaagaaaaaacagtctcatactctcactgccaaaagagagttagaaaaatactcacattctttttacttgtagtttaacctttttcca

SEQ ID NO: 42183 - DNA, 107 bp, Homo sapiens
gcctttgccttggaactctcatggctccctggcaggaggggctgagcaggaaggtccctgactgcctccctcattgcttgagagaactgagttccttccttgggggc

SEQ ID NO: 42184 - DNA, 58 bp, Homo sapiens
tgagacagagtctcgctctgtcacccagggtggagtgcaatggcgtgatctcagctca

SEQ ID NO: 42185 - DNA, 90 bp, Homo sapiens
cttgcagaggggtaggggaatttcaagggaaagggggagatgcctggggttgtcacacactctgtctttcatcctctattgacatgttgg

SEQ ID NO: 42186 - DNA, 58 bp, Homo sapiens
tgagacagagtgtcactctgtcacccaggctggagtgcagtggcgtgatctcggctca

SEQ ID NO: 42187 - DNA, 71 bp, Homo sapiens
gtgtatacatatatatgtatatatatgcatgaggtttggacatgtgtgtgtgtgtgtgtgtgtgtgtgtgt

SEQ ID NO: 42188 - DNA, 77 bp, Homo sapiens
gtagcagaaagagagaacagagtttgcagtggcacttaagtgtgtctgcctagaagagacttgggtcacttctgctc

SEQ ID NO: 42189 - DNA, 77 bp, Homo sapiens
tcagttagtgtctttggtttagaaggttattaaggttgttaaattcttttaattctctgacaaaggatattttttga

SEQ ID NO: 42190 - DNA, 132 bp, Homo sapiens
gtatttttcttgggctttccaagatcctggtaaggtgttaacatttcagtttaagatgtggatttcttttgtttttgaaagtccatgggaacatttaaatttacaatgcagttaattggttgtttcctacca

SEQ ID NO: 42191 - DNA, 108 bp, Homo sapiens
tatgtgtgtgtgtatgtatatatatatatttatatatgtgtgtatatatatgtgtgtatatgtgtgtgtatatatatgtgtatgtatatatatataaaattatatata

SEQ ID NO: 42192 - DNA, 175 bp, Homo sapiens
gtatgtatgtatagtatatatacagtatatatatgtatgtatagtatatatacagtatatatacagtatatatgtatgtatagtatatatacagtatatatatgtatgtatagtatatatacagtatatatatgtatgtatagtatatatacagtatatatatgtatatatagta

SEQ ID NO: 42193 - DNA, 98 bp, Homo sapiens
tgcatatctctgctctggcccattacttgttgattttaaagtttagacctgatagcagtattattgctttaattttcaagttcttgctgcaagttgca

SEQ ID NO: 42194 - DNA, 75 bp, Homo sapiens
ctgtatatgtgtatgtatatgtatatatatacacaaaattgagcactgtaatacatatacacatacattgtatgg

SEQ ID NO: 42195 - DNA, 56 bp, Homo sapiens
atgtatgtgtatatgtattacagtgctcaattttgtgtatatatatacatatacat

SEQ ID NO: 42196 - DNA, 137 bp, Homo sapiens
tgtatacattgtatgtgtatgtatacatgtatgtatacgttgtatatgtgtgtatacatgtatgtatatgtatatgtatacaatgtacacgtatgtatagaatgtacatatatgtaatacatatacaattacatata

SEQ ID NO: 42197 - DNA, 57 bp, Homo sapiens
acagtgtgtcactctttcactcagctggagtgcagtggtaggatcatgactcactgt

SEQ ID NO: 42198 - DNA, 95 bp, Homo sapiens; identical to SEQ ID NO: 68

SEQ ID NO: 42199 - DNA, 93 bp, Homo sapiens; identical to SEQ ID NO: 69

SEQ ID NO: 42200 - DNA, 95 bp, Homo sapiens; identical to SEQ ID NO: 68

SEQ ID NO: 42201 - DNA, 93 bp, Homo sapiens; identical to SEQ ID NO: 69

SEQ ID NO: 42202 - DNA, 89 bp, Homo sapiens
atccctagtagtcagagcagtgacaggtcagaaaaaggcagctgaggtccaatagttatgtctgtgtattgctcattctacttactgat

SEQ ID NO: 42203 - DNA, 118 bp, Homo sapiens
tcagcctcccaaagtgctgggattacaggcatgagccaccgcgcccagccagaaaacatttttttttaattagctgggtgtggtgcatgcctgtagttccagctactcggatggctga

SEQ ID NO: 42204 - DNA, 59 bp, Homo sapiens
tgagacggagtgtctccctctgtcacccggctggagtgcagtggtgtgatcttggctca

SEQ ID NO: 42205 - DNA, 59 bp, Homo sapiens
tgtctatctctgtctctatatctgtatttcctatatggagagagggagcgagataggca

SEQ ID NO: 42206 - DNA, 78 bp, Homo sapiens
ggtggggatgaggataaaagcagacaggatgaatcttgtttgaggccattcttcactgcttgaatcctctatttcatc

SEQ ID NO: 42207 - DNA, 98 bp, Homo sapiens
tgggtttgcatttccctgatgactaatgatattgaacatctatcttctcatgagtttgttgtccatttgtgtatcttctttggagaaatgtccactca

SEQ ID NO: 42208 - DNA, 95 bp, Homo sapiens; identical to SEQ ID NO: 68

SEQ ID NO: 42209 - DNA, 93 bp, Homo sapiens; identical to SEQ ID NO: 69

SEQ ID NO: 42210 - DNA, 84 bp, Homo sapiens
tagagaaacacacgcacacatacaggtacatatgtatgtatgtatgtatgtatgtatgtactatgtggtatggaaactttttta

SEQ ID NO: 42211 - DNA, 95 bp, Homo sapiens; identical to SEQ ID NO: 68

SEQ ID NO: 42212 - DNA, 93 bp, Homo sapiens; identical to SEQ ID NO: 69

SEQ ID NO: 42213 - DNA, 104 bp, Homo sapiens
aggaatttgtaagtcaaatggatacaaatattccagtgtatttgggagtaatatttattttagtaaattaatacactgaggttctggatgatatgctaatctct

SEQ ID NO: 42214 - DNA, 114 bp, Homo sapiens
ttgaactcctatagatttgggtaacaagggatacctgtaattcttaactcagacattagcatttttttttttaagagacaggggtctcgctctgtcacccaggctggagtgcag

SEQ ID NO: 42215 - DNA, 153 bp, Homo sapiens
tgtgtgtatatttatgtatacgtatatatatgtatttatatgtatatgtatatatgtatgtatatgtatatatgtgtatatacatatatatgtgcatatgtatacacacacacatatatatgtatatatatgtatacatacatatactgtgtg

SEQ ID NO: 42216 - DNA, 114 bp, Homo sapiens
tatgtatgtatgtgtagaagtatacataatatataatgtatataaaatatataaatgttatttgtatattatatatacatacatatatgcatgtatatgttcacataaaaaata

SEQ ID NO: 42217 - DNA, 74 bp, Homo sapiens
agcattcagtataaaccagagataaggacatatgtacttacgtgtgtctgtgagtgtgtgtgtgtctgagtgtt

SEQ ID NO: 42218 - DNA, 125 bp, Homo sapiens
agggtctacaggaagtggttgctcccataagctgtgtaggcagatgttcctgtgagtgcttctctctgtctcagaaaagggagtcagggcaggagatgttcctgccatgccttccaaatggcaga

SEQ ID NO: 42219 - DNA, 79 bp, Homo sapiens
gggcacaagaggggaggtggcttccaagtagaggggtaggggagagtctgctctgagtcactcaccttctcttgagccc

SEQ ID NO: 42220 - DNA, 97 bp, Homo sapiens
gctcagcctctcaactaattacaggtgtgagccaccatgcccagctaattttttatttttagctgagatggggtttcaccatgttggccaggctggt

SEQ ID NO: 42221 - DNA, 81 bp, Homo sapiens
tcagcccccgaggtagctagctgagattacaggtgagcaccaccacaccggctaattttatttttttgttgcctaggctgg

SEQ ID NO: 42222 - DNA, 104 bp, Homo sapiens
gagagtcctggtatacgtgtatctctgtaattctgccaacttttgattttctatttttttctttaattggcttattgcatatatgtactactgaaagccatctc

SEQ ID NO: 42223 - DNA, 84 bp, Homo sapiens
ggccaatgggtgtgatgctgagggctctattcattcttattttatatatattttgagacagaatctcactctgtcacccaggct

SEQ ID NO: 42224 - DNA, 95 bp, Homo sapiens; identical to SEQ ID NO: 68

SEQ ID NO: 42225 - DNA, 93 bp, Homo sapiens; identical to SEQ ID NO: 69

SEQ ID NO: 42226 - DNA, 91 bp, Homo sapiens
aaaaactggaaaaacacacaaataaaaaatcttatatttatgagtgataagattactggtaaatttttttatttctgtttttctggttttt

SEQ ID NO: 42227 - DNA, 89 bp, Homo sapiens
agaatgccttttatttctctttcttgcctaaatgctctggtggaacttcctgtactaggttgaatagaagtgatgaaagcatgcattct

SEQ ID NO: 42228 - DNA, 85 bp, Homo sapiens
acacatgatatgtgtatatacatatgtgtatatacatatatatcatgtgtgtatatacatatatgtatatacatatatcatgtgt

SEQ ID NO: 42229 - DNA, 67 bp, Homo sapiens
tgtatatatgtgtgtatatatgtgtgtgtgtgtacatatatatatatatatatatatatatatatat

SEQ ID NO: 42230 - DNA, 77 bp, Homo sapiens
agttatgtttatgtttatacttaatagactagtatgctgtaatatgctagtctattcatgtatatatgtaatatact

SEQ ID NO: 42231 - DNA, 98 bp, Homo sapiens
ctgtattttggaagagtttgggaaatctggtattacttctttaaatgtttagtaaaagtcagtagtaaagacatctgggcctgggcttttcttcacag

SEQ ID NO: 42232 - DNA, 95 bp, Homo sapiens
tcatttagctgtggtgcttcagagtggggctcctgagctgtatcacctaggctcacactctgcctctcttctctattagctctgcaagtaagtga

SEQ ID NO: 42233 - DNA, 66 bp, Homo sapiens
gcagtaactactgcctggctgcctcaaggcccaagggttctttagtcagtttgtggtgaatgctgc

SEQ ID NO: 42234 - DNA, 72 bp, Homo sapiens
agcatatatatagcatatatgtatatatgatatatatgtacatatatatatatatatatatatatatcctat

SEQ ID NO: 42235 - DNA, 98 bp, Homo sapiens
gtagagcaaggagtttgatctgtaactgactgaacaatcaatggagatacctcttacctttggaccagttgctattacaattatgattcccattttgc

SEQ ID NO: 42236 - DNA, 81 bp, Homo sapiens
tgtatcctgcaactttactgaatttgtttattaaactattagatgatagtttaatgataaatgtttaaggtggcagatata

SEQ ID NO: 42237 - DNA, 107 bp, Homo sapiens
ggccttataaaaaagcaaaatatcactgcgattattttcaaggttgcatagtattacaaaaatgcccagcttaaagtaaaatgtatgtactggttcttttggaggtc

SEQ ID NO: 42238 - DNA, 108 bp, Homo sapiens
ggccttttctgctttaggtagccagacagaactgttccttgcaaccagtgactgtctaattcagtcacttaatgttttgtagctttgttcagttactgggcacaaccc

SEQ ID NO: 42239 - DNA, 104 bp, Homo sapiens
actgactcactgtgttaatgtattaatatgttgtatcaatatattaatattgaattaatatgttgtatcagtatattaatattgaattaatatgctgtatcagt

SEQ ID NO: 42240 - DNA, 119 bp, Homo sapiens
aggagccactcactgcacctggcctggagagtagagatttttaaatttaaaattttttttttttattttttagatggagtcgctctctgtcaccaggctggaatgcaatggtgctatct

SEQ ID NO: 42241 - DNA, 127 bp, Homo sapiens
gagcagacttagctgacctcactttgctttgggcttgctttcctacagacattgacagtgagagttgtttttgctcaccacactgggaatatgtattgcttaggagacacatggcagttaaggcaaa

SEQ ID NO: 42242 - DNA, 73 bp, Homo sapiens
ccagctcaatttcttgaaaagatgtttctttttcaattgaattgctttgatatctttgttgaaattgatttgg

SEQ ID NO: 42243 - DNA, 111 bp, Homo sapiens
tatttaaatatacttagcatacttactaaagtatattagtaaattaatatatttactgaagtatattagtaaattaatatatttactaaatatactaagtatatttaaata

SEQ ID NO: 42244 - DNA, 117 bp, Homo sapiens
gctcacttattctaacatactatgattgcaacttgatgataagtgattttcttgaagacacatgactaataacttgtttgatagaaatagataacttgttagaggcaaagttagagc

SEQ ID NO: 42245 - DNA, 122 bp, Homo sapiens
ctttccaaagatgatattgatgaggaatgcatgagcatgtcccagtgcatccaagactctgtcactctcagaagctctgggaagctgcttgtcaccactttctcagcaacacagtgaaagtc

SEQ ID NO: 42246 - DNA, 70 bp, Homo sapiens
tgcccagttccaccctgttaggcacttattatacgatcaaaacgtgtgtgtgtcactgagtgtgctggca

SEQ ID NO: 42247 - DNA, 78 bp, Homo sapiens
tcctaacgtgaagtgctgtgatgtttctgccctgcctaaggaacgtatcaagctctctcagtgtttcagtgttggaga

SEQ ID NO: 42248 - DNA, 89 bp, Homo sapiens
gtctgggagacagagagagatcttgtttctaagaaaatatatatatatgtaaaatataaagcagatgatgtcactctcatgctctcaac

SEQ ID NO: 42249 - DNA, 83 bp, Homo sapiens
aaggctgtgggcaagcctcctgtgctggggtgtgtgaagctgctgcactcacagcctcagttcagctgttttgcccatgcttt

SEQ ID NO: 42250 - DNA, 61 bp, Homo sapiens
ttgagacagagtctcgctctgtcacccaggctggagtgcagtggcatgatctcgatctcgg

SEQ ID NO: 42251 - DNA, 108 bp, Homo sapiens
acaaggccacatagatccttagcaaatcacgtaagactctctgtgcctcagtttgccaatctgtaaagtggggtgtgtgagggggtgggtataaaatcatggagttgt

SEQ ID NO: 42252 - DNA, 104 bp, Homo sapiens
agcatcatctatgcaagggagctgcaggcaagtgagaggtggggacggtgatctgtcaatgtctctctctcccctggggcttccccaccccatctttggatgct

SEQ ID NO: 42253 - DNA, 58 bp, Homo sapiens; identical to SEQ ID NO: 11136

SEQ ID NO: 42254 - DNA, 114 bp, Homo sapiens
gagggcggggcatctcttcaattgttcagactttgcagtgtgatgctcttgtttttatgtctattgaatgaaacaccttagaggagaatgggcagagggaacagagaagctttc

SEQ ID NO: 42255 - DNA, 108 bp, Homo sapiens
gtccttagaggaaggaaagctggcactgttgcgtggagggggatattaagacaatctcagcctctcacagcctctcagcctaggttacccaccattgccccaggggat

SEQ ID NO: 42256 - DNA, 58 bp, Homo sapiens; identical to SEQ ID NO: 315

SEQ ID NO: 42257 - DNA, 110 bp, Homo sapiens
cagagtgagaccttgtctcttaaaaaaaaaaaaaaaaaaaaaaaaaaagatttgcattatagcttatctttttttttttttttttttttttgagatggagtctcactctg

SEQ ID NO: 42258 - DNA, 56 bp, Homo sapiens
cccacactcactcactcgcttgcacactgcctcttgcaaggggtttgagtgtgtgg

SEQ ID NO: 42259 - DNA, 91 bp, Homo sapiens
ggctaaggtaggaggatagcttgaggttgaaagttggataccaacctgcgcaacataacaagactttgcctctacaaaaaataaattagcc

SEQ ID NO: 42260 - DNA, 89 bp, Homo sapiens
ctgcttctcactgtgtgtgtacttgggcaggtcgggtcacctccttaagccacaacttgctcacttgagactcatacagcaggtggtag

SEQ ID NO: 42261 - DNA, 73 bp, Homo sapiens
cttccctcagcacacagtcagtcactcagtcattcaacagacattcactgagtacctaactgtgtcaggtaag

SEQ ID NO: 42262 - DNA, 118 bp, Homo sapiens
gattgaagttgccctggatgtatacttcagttagcagttacaggtggatttttgttttttattttaaaaagttttcttcatttcattttggtttttagagacagggtctctctctatc

SEQ ID NO: 42263 - DNA, 62 bp, Homo sapiens
gtgtgtgtgtgtgtgtatgtgtatatatatatctatatgtatgcatgtgtgtgtatatatat

SEQ ID NO: 42264 - DNA, 87 bp, Homo sapiens
gcaggggtgtttgttttgagacagggtctcactctgtcgctctggctggaatgcagtggtgtgatcatggctcactgcaacctccgc

SEQ ID NO: 42265 - DNA, 95 bp, Homo sapiens
ttacatttccattaacagtgtatgagattgagatatacagctttgccagcatgttattattttaaaatatttgcaaatttgataggaaatagtaa

SEQ ID NO: 42266 - DNA, 123 bp, Homo sapiens
atatatggatatctatagatatatggatgtgtatatatatatggatatctatagatatatggatgtatatatatatggatatccatatatatatatggatatccatatatatatatggatatc

SEQ ID NO: 42267 - DNA, 86 bp, Homo sapiens
gagactgagctagatatagagtgtgggcctctgattcaaggtctcacactgaacgcccactctctctctctttgctacccagtctt

SEQ ID NO: 42268 - DNA, 79 bp, Homo sapiens
ggtttggtcctgccttactctgaataaggaaccagtgtgtcactgactcaaaaactgactagctgcaggacagagaacc

SEQ ID NO: 42269 - DNA, 95 bp, Homo sapiens
ctagttggggtaaaggggattaaattttcaggaggtggaaactgcattcttttttttttttttgagacggagtctcacactgtcactcaggctgg

SEQ ID NO: 42270 - DNA, 98 bp, Homo sapiens
gcactgcagcctgggagacacagtgactctgtctgaaaaaaaaaaaaaaaaaaattgttttagggacagtcttgctctgatgcccagagctggagtgc

SEQ ID NO: 42271 - DNA, 57 bp, Homo sapiens
tgagatgagtctcactctgtcacccaggctggagtacagtagcgtgatctcagctca

SEQ ID NO: 42272 - DNA, 95 bp, Homo sapiens
ttgttgttgttgctttttgagacaaagtctcactctgtctccgcccaggctggagtgcagtggtgcgatctcggctcaaggagttgaacctccaa

SEQ ID NO: 42273 - DNA, 93 bp, Homo sapiens
gcttgggtgacagagattctctctctctcttcatatatctatatatatatatagactgtgaggagggcaaagtgaggcttcctggttggccgc

SEQ ID NO: 42274 - DNA, 66 bp, Homo sapiens
gctttgaagtcagagtctgagttgaacctcatccttgagccactcactagctctgtgacttcaggc

SEQ ID NO: 42275 - DNA, 85 bp, Homo sapiens
gagcacttactaaacggaaagcgctgtgtgaaatgtgattcagtcattattttattttcacaacagcctgatgaggtcagtactc

SEQ ID NO: 42276 - DNA, 137 bp, Homo sapiens
gacagagtgagaccttgtgttgaaaaaaaaaaattttttttttttttttgagatggagtctcactctgtcactgaggctggagtgcactggtgtgatcttggctcactgcaacctgcacctcccaggttcaagtgat

SEQ ID NO: 42277 - DNA, 90 bp, Homo sapiens
gaatacacctctgaaaaggagtgtactcacaagtattctcatttttcaatgagagtcagtcagtgagtcattaaggaaggtacggtattc

SEQ ID NO: 42278 - DNA, 60 bp, Homo sapiens
cgcagtggctcacacctgtaatctcagcactttcggaggctgaggtaggaggatcacttg

SEQ ID NO: 42279 - DNA, 58 bp, Homo sapiens; identical to SEQ ID NO: 2224

SEQ ID NO: 42280 - DNA, 56 bp, Homo sapiens; identical to SEQ ID NO: 335

SEQ ID NO: 42281 - DNA, 71 bp, Homo sapiens
ttgttttgagacaggggtctcactctgtcacccagtctggagtacaatggtgtgatcttggctcactgcaa

SEQ ID NO: 42282 - DNA, 95 bp, Homo sapiens
ctgagccttaggctgggctgcacagagcgcgctgcaataaaccgcgggcgaagtgctgagtgggtgcagagtgtgaagcccttaagtcacgccag

SEQ ID NO: 42283 - DNA, 58 bp, Homo sapiens
tgagatggagtctcactctgtcacccaggctggagtgcagtgtcgtgatctcggctca

SEQ ID NO: 42284 - DNA, 57 bp, Homo sapiens
ggctcttgctgggaaaactcagggggacgctcactcactgagtgcctattgagtgcc

SEQ ID NO: 42285 - DNA, 85 bp, Homo sapiens
gccatttgcggtagcacttgtcacagttaccatcttaattttgttaatattattattcaggtattgtttgtgttctgcattaggc

SEQ ID NO: 42286 - DNA, 82 bp, Homo sapiens
cttcatctctctgtgtgtcagtctccttatctgttaaataggactaataataatagggctgtgaagactaaatgagatgagg

SEQ ID NO: 42287 - DNA, 102 bp, Homo sapiens
gctaggattacaggcgtgagtcattgcaccctccctgttttgtttttgtggtttttttttgttttttttttttgagacagggtctcactctgtcacccaggc

SEQ ID NO: 42288 - DNA, 58 bp, Homo sapiens; identical to SEQ ID NO: 2248

SEQ ID NO: 42289 - DNA, 73 bp, Homo sapiens
gtgttgtatgaggctgcttgggacccagaggggtgtattcgtctgtctgtgtctatctgtctgcagatgacac

SEQ ID NO: 42290 - DNA, 58 bp, Homo sapiens
taggtgtgtgctaggagcaggggttgctgggcaagtcactctgcctctcacactcttg

SEQ ID NO: 42291 - DNA, 82 bp, Homo sapiens
tttgtgtggtgtgggaggttgtgaactggtgcccacatgccagctccttcactctgcctctctgggaaataggctgtacaaa

SEQ ID NO: 42292 - DNA, 81 bp, Homo sapiens
tgtgtgacaaagggagaccctgtctctctccttttttttttttttttttttttttgagacagagtcacgctctgtcaccca

SEQ ID NO: 42293 - DNA, 111 bp, Homo sapiens
gccaggagtttgagaccagctgggcaacatagtgagaccctatctctactaaattttttttttttttggagatggggtctcattctgtcacccagactggagtgcattggc

SEQ ID NO: 42294 - DNA, 101 bp, Homo sapiens
tcctgagtagctgggattacaggtgcccactaccatgtccagctaatttttttatttttagcagacatggggtttcaccatgttggccaggctggtcttga

SEQ ID NO: 42295 - DNA, 70 bp, Homo sapiens
gttgcagtgagccgagatttcaccactgcactccagcctgagcgacagagtgagactctctctcagaaac

SEQ ID NO: 42296 - DNA, 88 bp, Homo sapiens
ctgtgcttctagataagggattggcaagctttcttttttattttttcttgagacggagtctcagtctgtcacccaggctggagtgcag

SEQ ID NO: 42297 - DNA, 100 bp, Homo sapiens
tgccttctgtggcactggcgctgagctgttgaccacctgctgcaccctactgtgaggttctgtgactcactcactgccatgttgtgccccactcaggaca

SEQ ID NO: 42298 - DNA, 94 bp, Homo sapiens
atgcagttttccaatcaatatttgtttttctgcattctgttattctctctttaaactggggagaggggcaggtagagaaagatgggctatgcat

SEQ ID NO: 42299 - DNA, 87 bp, Homo sapiens
gtgtacatgtacacatgcacatatacatatatacacatatatgtgtgtgtatatgtatgtgtgtatatatgtgtatatatgtatatg

SEQ ID NO: 42300 - DNA, 103 bp, Homo sapiens
tgggcaacagagtgagactccatccttaaaaaaaaaaaaaaaagaaagaaagaaacagaatttttttttttttttttgagatggagtctcgctctgtcaccca

SEQ ID NO: 42301 - DNA, 114 bp, Homo sapiens
tttccccaagaccaacagttgtatatctatctatctatctatctatctatctatctatctggggcatggattcagtgctgtttagtcttgaacaactgttttgtgtttgggaaa

SEQ ID NO: 42302 - DNA, 93 bp, Homo sapiens
agtggctcactattgcttattgatagtttaaatttctcaacatgctttgttgtgctcttcatgatctgtttctgagctatacgtgtggtcact

SEQ ID NO: 42303 - DNA, 66 bp, Homo sapiens
tagaggcagggtctctctcactctgtcgtccaggctggagtgcagtgaaatgatcatggcttactg

SEQ ID NO: 42304 - DNA, 74 bp, Homo sapiens
tatatgtatacgtatgtgtatatgtatgtatatatacacacgtatgtcatattttgtaagtatgtatatgtata

SEQ ID NO: 42305 - DNA, 97 bp, Homo sapiens
cactaaacttttaactacttgagagcagggactttattttttatttttatttttttgagacaaggtctcgctctgttggccaggctggagtagagtg

SEQ ID NO: 42306 - DNA, 73 bp, Homo sapiens
ttgtttttttgagatggagtctcactctgtcacccaggctggagtgcagcagcatgatctcatctcattgcaa

SEQ ID NO: 42307 - DNA, 58 bp, Homo sapiens
tgagacacggtctcactctgtcacccaggctggagtgcagtggtgcaatcatggctca

SEQ ID NO: 42308 - DNA, 110 bp, Homo sapiens
aatgcaaaagagttccaatgtcttcacatccttaccaacacttttttttttaataatagccatcctaaataggtgtggagtggtatctgacagtggttttgatttgtatt

SEQ ID NO: 42309 - DNA, 111 bp, Homo sapiens
gtttgtgctatctgatttttttcctggatgccaggtaagagctcaggatagagaaagctgtctcactggctctctgccctcatgaaaaggcagagggtctattgagctgtt

SEQ ID NO: 42310 - DNA, 58 bp, Homo sapiens; identical to SEQ ID NO: 87

SEQ ID NO: 42311 - DNA, 56 bp, Homo sapiens; identical to SEQ ID NO: 88

SEQ ID NO: 42312 - DNA, 69 bp, Homo sapiens
gagcagagttaggaaattatgtatttatgtacatatacacttgtacatctgtatttctatatctgtctc

SEQ ID NO: 42313 - DNA, 103 bp, Homo sapiens
tccctgtgttctagaagagagttttggcggccatctttttagagtctatttttttgttttctgagagtattgagaaatttaaaaatccttcttgaagcaagga

SEQ ID NO: 42314 - DNA, 120 bp, Homo sapiens
ggctgtgtgataccaagtctctgcaatttgttctcttgtttatgatgtagggtatgacagatttttataaatatatcatgtacgcttgaggcgttttgtctaattattgggtacacggtc

SEQ ID NO: 42315 - DNA, 86 bp, Homo sapiens
ggggtgcttttctgtttgtgacacagagaaaaaaaaagacactgggggccttttttttttttttttttgagacggagtctcactct

SEQ ID NO: 42316 - DNA, 74 bp, Homo sapiens
tttctgatagacagaacacagactgcaacttggaaggttccagggaagcaagatctgggctctcttactagaaa

SEQ ID NO: 42317 - DNA, 130 bp, Homo sapiens
tcacccaaaccaggttccaacagtttttttttttttcttttttttgagacagactcactctgtggctcaggctggagtgcggtggcactatttctgcttactgcaacctctgcttcctggattcaggtga

SEQ ID NO: 42318 - DNA, 73 bp, Homo sapiens
ggctgcaagggtctcacattttatatgaagtggcataatttttttttttgaaacggagtctcgctctgtagcc

SEQ ID NO: 42319 - DNA, 65 bp, Homo sapiens
gtgggtggatgaacgtgtgtgtgcctgggcaggtatctgtgggcactgtgtgtctgtctgtgcat

SEQ ID NO: 42320 - DNA, 72 bp, Homo sapiens
gggtgccaattcagtctcactcactgctctgtctcaagcacagagaacagagtctgctgcataaaggcatcc

SEQ ID NO: 42321 - DNA, 114 bp, Homo sapiens
agtggtagaaggcctggttccagtccctgttttttgttagcttgttgacatatttatttatttaggaaacactttaatagtactgattctgtgccaggccttgttctgagagct

SEQ ID NO: 42322 - DNA, 102 bp, Homo sapiens
ttatgtctctgtgtcacattttggtcattctcacaatattgcaaatgtttcattattattatatctgttgtggtgatctttgatcagtggcctttggtataa

SEQ ID NO: 42323 - DNA, 62 bp, Homo sapiens
tggacacctgttgaacatttccatatttctgtcctgtgggagtcacagattcagcatgtcca

SEQ ID NO: 42324 - DNA, 78 bp, Homo sapiens
tgtggatggaaagcatgtctgagtcagtgcctctgtcaggagacagatggaagcggccacatgacccctggtcccaca

SEQ ID NO: 42325 - DNA, 78 bp, Homo sapiens
ccattgatccacccaccctcttactcactcactcattcaacaaacatgagtggattgagtgtggtgccagacaatagg

SEQ ID NO: 42326 - DNA, 82 bp, Homo sapiens
gggctgtgcctagtgacttgcttctaatggatagaatagatcaaagtgcggcatgtcacttctgagattagggcaaaagccc

SEQ ID NO: 42327 - DNA, 75 bp, Homo sapiens
ggctgaataatattccattgtgtgtgtgtatatgtatatatatgtatacactatattttgcatatccattcatct

SEQ ID NO: 42328 - DNA, 93 bp, Homo sapiens
taatcaccaggatatggtcaaatttgaactcattccttccctcctagcaggtgtgaggtgatattgtggttctgatttgcatttccctgatta

SEQ ID NO: 42329 - DNA, 88 bp, Homo sapiens
gtctggagcttgggttacatctctctttctctctgctagtttgggctcagcaaaggcagaggaaggggaatcactcactgccacatac

SEQ ID NO: 42330 - DNA, 64 bp, Homo sapiens
gagagaaccaatgatcgagctcactcagttcataacagagagagcagacattgcagttcagctc

SEQ ID NO: 42331 - DNA, 58 bp, Homo sapiens
tgagacagggtctcactctgtcacccaggctggagtgcagtggtgtgatcttggttca

SEQ ID NO: 42332 - DNA, 58 bp, Homo sapiens; identical to SEQ ID NO: 315

SEQ ID NO: 42333 - DNA, 73 bp, Homo sapiens
ggagaaaccttcacagtagagaccttggggtgtgtgctttgggactccctcagtctctcactgtgctgtgtcc

SEQ ID NO: 42334 - DNA, 58 bp, Homo sapiens
tgagaccgagtctcgctctgtcacccaggctggagtacagtggcgcgatcttggctca

SEQ ID NO: 42335 - DNA, 68 bp, Homo sapiens
ctgtggtcctagctactcaggaggctgaggtggaaggatcacttgagcccaagagttagaggttacag

SEQ ID NO: 42336 - DNA, 109 bp, Homo sapiens
ccattccatcttcaaagcctgcaatgccggtcgagtctttgccacatagaatcactgtgacactgactcttttgcctccctcttgtacgtttggggacccttgtgatgg

SEQ ID NO: 42337 - DNA, 62 bp, Homo sapiens
tagacagtctttctctctccttgccagagagagagagagagagagagagagagaaaggtctg

SEQ ID NO: 42338 - DNA, 67 bp, Homo sapiens
gactgctctgacagtcagggagttctttctcaaattgaactggactctgcctttctgtcactctgtc

SEQ ID NO: 42339 - DNA, 108 bp, Homo sapiens
tgctttggttttctggttttgtctccctaagttttcagcagtgtatcattttttttttctagcaaaaaagcttacattataaaaaagggagagatcatttctgaagta

SEQ ID NO: 42340 - DNA, 118 bp, Homo sapiens
gagagtaaaaaagagttggtcaacagacagcaggtggtctgtgaggcaatcatgactggtgagagatctcactgtccagacgtggtgatctggtaagtttcagttctttgatactgtc

SEQ ID NO: 42341 - DNA, 106 bp, Homo sapiens
gcctgtctcccccaattacagtgttaagttacccgagggcagaaaccttgccatgtctgcctgtgtgtccctcagtgcttagtgcagtagctggcatatggcaagc

SEQ ID NO: 42342 - DNA, 83 bp, Homo sapiens
ggaccctcagatgaatcacagagaccacacatggagacccatctccctgttttgtaatctccatgcattcgtagccaatctcc

SEQ ID NO: 42343 - DNA, 73 bp, Homo sapiens
ggttgggttaggtgaggtcctttctttctttcttttttttttttgagacggagtctcactctgtcacccaggc

SEQ ID NO: 42344 - DNA, 133 bp, Homo sapiens
gaaactgctgagccagaaaggatttgtctgtggggcaggagagccccaaggctgagtcatgactggctccaggttcattcagcccctcagagcccactgaggcctctgcgtgtggcgggagaaagcagcgctc

SEQ ID NO: 42345 - DNA, 118 bp, Homo sapiens
cctccagcaggggtgtgtggcgtgggtgtgtgcgggtgtggcagggtctgtctgtatgtctgatgcctgtccatcaccggtgtatattttcgcggctgtgtctgtcttttgtgtatgg

SEQ ID NO: 42346 - DNA, 69 bp, Homo sapiens
ttgtctgaggtggagtctcgctctgtctcccaggttggagtgcagtggtgtgatctcagctcactgcaa

SEQ ID NO: 42347 - DNA, 118 bp, Homo sapiens
aaagccaggcagcccccagaggcagccccacccgagctggagaggtctgctgggcttctctgggtctctcagggaggacggacttggtgtgcttttggcaagtcaaaggccctgcttt

SEQ ID NO: 42348 - DNA, 115 bp, Homo sapiens
gctttgtctcataatcgtggccgtctgggccccttttcacaagctctgtctgcctctcacatgggcttggcagggagggaggctggctggggtgcttgggtttgggtatactgac

SEQ ID NO: 42349 - DNA, 81 bp, Homo sapiens
gtgtatctagggggcaactgtgtgtgtgtgtgtgtgcacccatgagcacacgcacgcatgcttatgtccctatagaggctc

SEQ ID NO: 42350 - DNA, 58 bp, Homo sapiens
tgagacagagtctcccactgtcacccaggttggagtgcagtggtgcaatctcagctca

SEQ ID NO: 42351 - DNA, 138 bp, Homo sapiens
gggcaacatggtgaaaccccatctctactatatatatatatatatattagctgggtgtggtagcatgtgcctgtagtcccagctactctggaggctgaggtaggaggatcgcttgagcctgggaggttgaggctacag

SEQ ID NO: 42352 - DNA, 105 bp, Homo sapiens
ggagagccagtctgtacctttctgatgttgactctctctggctctgatctagagaagaagaggcgggtgctgtagcagaagagtgaccccagacgcagcagctcc

SEQ ID NO: 42353 - DNA, 97 bp, Homo sapiens
catcttgttatgatgaagtctataattgtttgtttttattggccatgaatcaagtattggtactcgcagacaggttatggtctctgtcctcaaggtg

SEQ ID NO: 42354 - DNA, 118 bp, Homo sapiens
gaaattccagtctagcctgctcgggtggctctgtccttttcttctcagttgactctctttgtgtctcctctggagtctctggtttggtcatctttggtggctgaagatctgtctcttc

SEQ ID NO: 42355 - DNA, 106 bp, Homo sapiens
tgacctcctagaagttaccctgtgtcttagagcataatcaggttttttttttttttttttttttttttgagactgagtcttgctctgtcacccaggctggagtgca

SEQ ID NO: 42356 - DNA, 116 bp, Homo sapiens
tcagcctcctgagtagctgggactacaggtgtgtccctccacatccagctaattttttttttaatttgtacagatgaggtctcattatgttgtccaggctggtctcaaactcctga

SEQ ID NO: 42357 - DNA, 58 bp, Homo sapiens; identical to SEQ ID NO: 6639

SEQ ID NO: 42358 - DNA, 91 bp, Homo sapiens
cctgggagcgcaggcatgcaccaccacacctggctaattttttttattttttattttgtagagatgggggggtctcactgtgtgtcccagg

SEQ ID NO: 42359 - DNA, 120 bp, Homo sapiens
ctctcttaccctgtttcccttttttgccagatgatgatttttttatttttattttgtactttactggatgactgtgaagcgatgagtattgggttggggtaggtgtgttgattttgagag

SEQ ID NO: 42360 - DNA, 58 bp, Homo sapiens; identical to SEQ ID NO: 3385

SEQ ID NO: 42361 - DNA, 56 bp, Homo sapiens; identical to SEQ ID NO: 3386

SEQ ID NO: 42362 - DNA, 91 bp, Homo sapiens
ggtttttctgagtcttatagttttatattttacgtttagggctatgctccttttgagttaattgtataaggtatgaggtttaggtcgggtc

SEQ ID NO: 42363 - DNA, 58 bp, Homo sapiens
tgagacagaatctcactctgtcacccaggctggagtgcagtggaaagatcttgtctca

SEQ ID NO: 42364 - DNA, 71 bp, Homo sapiens
gggtaacatagtaagaccctgtctctacaaaacaaaatttttttttcccagacagtctcactctgtcgccc

SEQ ID NO: 42365 - DNA, 102 bp, Homo sapiens
ccttacagtgctgcaaggaaaaaagggtttcagtgaagtgtgtgtgaactctatgtactcacatcacaccctaaaaaagcccacagaaaaatacagcccagg

SEQ ID NO: 42366 - DNA, 114 bp, Homo sapiens
gtaggtttctgaaattgggaaatgtgagttctacaactttcctcttcttaaatttttattataaaaattttcagggctgggtgcagtggcttacatcactttgggatgccaggc

SEQ ID NO: 42367 - DNA, 71 bp, Homo sapiens
ccaggtctttgtgtgtgagtcctttttttttttttttttgagacatggtctcactctgtcactcaggctgg

SEQ ID NO: 42368 - DNA, 90 bp, Homo sapiens
actcaggaggctgaggtgggaggatggtttgagcccgggaggaggagactgcagtgagctgagatcgtgccaccacactccagcctgggt

SEQ ID NO: 42369 - DNA, 68 bp, Homo sapiens
gaaatcagggagactcaggtctcaatcccacctctgctaagctgtgtgaccttctctctctgagactc

SEQ ID NO: 42370 - DNA, 103 bp, Homo sapiens
gtgtatatatccagaaatgggactgctggatcatatggtaatactatttttaatttttttgaggaacctccatactttctatagcagctgcaccattttacac

SEQ ID NO: 42371 - DNA, 58 bp, Homo sapiens; identical to SEQ ID NO: 1725

SEQ ID NO: 42372 - DNA, 77 bp, Homo sapiens
ggaaagagaacagagagagccctcccagcagccccagacatgattgctgggcaggcttattttctcttgtctgcgcc

SEQ ID NO: 42373 - DNA, 94 bp, Homo sapiens
cagggcttggtcaggagaatggagcaggagctggcacaacaaatagaactccctctgtgtgcctgagtggctcctcatgccaaagcaggtgctg

SEQ ID NO: 42374 - DNA, 91 bp, Homo sapiens
cctatgccttttctctctgtatctctcaatgcctgacacaaagtacgtgcttacaggaggaggtggaaaaatgggaagaagaagagcaagg

SEQ ID NO: 42375 - DNA, 74 bp, Homo sapiens
gctctgtggactgtgaatgcagattagaattaaaagatgtgcttaccacactgtctctgtctctgtcccagagc

SEQ ID NO: 42376 - DNA, 58 bp, Homo sapiens
gagtcttgctctgtcgctctgtcacccaggtgggagtacagtggcgcaatcttggctc

SEQ ID NO: 42377 - DNA, 109 bp, Homo sapiens
ataaatgctccaaaagtatagtcataaagaactacagagctgagggtactataatgtgtctctctcagtcattattcttttatgaaaactttggaataaagctatttgt

SEQ ID NO: 42378 - DNA, 76 bp, Homo sapiens
ggttatcagaacatgtttgtatttcattattaagctggtaaaaagaaccatggatatatggacatgttctggatcc

SEQ ID NO: 42379 - DNA, 61 bp, Homo sapiens
ggcttgtgtgtgtgtgtgcgcgcacgcacacacgcgcgcacacacacacgcacacacagcc

SEQ ID NO: 42380 - DNA, 87 bp, Homo sapiens
atgtatagatgtgtgtatatgtatgtgtctgtgtgcatatatatatatatatatatatatatgcacacacacataggcatgaagtgc

SEQ ID NO: 42381 - DNA, 119 bp, Homo sapiens
aactttgtgttgggcagaacagtgaaaggggcagggaggaagagataaagaagaaagggacttttttttttttaaattatacttcaagttctagggtacatgtgcacaatgtgcaggtt

SEQ ID NO: 42382 - DNA, 114 bp, Homo sapiens
tggcatggatgcggtgaacagggggaagttctacactgctggagggaatgtatactagtgtggagattccttaaagaattaaaagtagaacaacattttgacccagcaatgcca

SEQ ID NO: 42383 - DNA, 96 bp, Homo sapiens
gttatatatatatgtatctacatatatatagttatctatatatatagctgtatatatagttatctatatatagctatatatagagttatatatata

SEQ ID NO: 42384 - DNA, 157 bp, Homo sapiens
ctatatatatagctatctatagataactatatagctatatatagataactatatatatagctatatagataaccatatatatagctatatatatataactctatatatagctatatatagataactatatatacagctatatatatagataactata

SEQ ID NO: 42385 - DNA, 106 bp, Homo sapiens
gtagcagactacagatatacatgtgtgtatatgtgtatatatatatgtagcatactacatatgtatacatgtgcacatgtacatatttatctgtgtatatgtatac

SEQ ID NO: 42386 - DNA, 83 bp, Homo sapiens
tgatcctgtttgttttctctcttgcatgctgtccttggagatcagaggattgatgtttgagtaagaaatgcagaataggacca

SEQ ID NO: 42387 - DNA, 76 bp, Homo sapiens
tagcttagatggctctagttctttattaatagatatatgagactctggggtaataggttgctagatccatatgcta

SEQ ID NO: 42388 - DNA, 100 bp, Homo sapiens
gcatctcccaggggaaatctgagagttaaatttattattttacttatttatttattttttttgagatggagttttgctcttgtcacccaggctggagtgc

SEQ ID NO: 42389 - DNA, 92 bp, Homo sapiens
tcttgcctgaaaattctcagtgcctcactctctctcttcaagctttacaccaggaagatttatgagaacagcgggcaaatccacaggtagga

SEQ ID NO: 42390 - DNA, 94 bp, Homo sapiens
atatatatatattatatatatgtgtgtgtgtgtgtgcatgtatgtatatatatatgtgtgtatatatgtatatatgtgtatatatgtatatatg

SEQ ID NO: 42391 - DNA, 92 bp, Homo sapiens
tgtgtatacatatacgcacacatgtgtatatacatatacacacacatgtgtgtgtatatatatatacatatgtgtgcgtatatgtatacaca

SEQ ID NO: 42392 - DNA, 82 bp, Homo sapiens
gaatggagtgaggcactgtgggactcagtctgtcatcttccaagagaagacccagcctagttttaatacctccacttcactc

SEQ ID NO: 42393 - DNA, 96 bp, Homo sapiens
tcttttgatttggagaaggttcagagggggaaaaaaagtgcaaagtaattaaataaaagcctgacccagtctctcactgattgcttttcctgaaga

SEQ ID NO: 42394 - DNA, 119 bp, Homo sapiens
atgtatgtgtatatgtatgtgtatgtatacacgcgtgtgtatatatatgtatatatacacatatatgtgtattgtgtgtatgtgtatatatatgtgtgtgtatatatatgtgtgtatat

SEQ ID NO: 42395 - DNA, 120 bp, Homo sapiens
atacgtgtgtgtgtatgtgtgtgtatatatatgtgtgtgtgtgtgtgtgtatgtgtgcatatatatatatatatatatatatatatatatatatatatatatatatatatatatatatca

SEQ ID NO: 42396 - DNA, 125 bp, Homo sapiens
gtgtgtgtgtatatatatatatgtatatatatatatgtgtgtgtatatatatatgtatatatatatacatatatatgtatgtatgtatgtgtatatatatatgtatgtatgtatgtatatgtatg

SEQ ID NO: 42397 - DNA, 106 bp, Homo sapiens
ccagtgaactatctgggtctagtgttttctgttttggaatgtaattaactattgatttgcttttaaaaatagatataggcaaattcagattgcttttctcttctgg

SEQ ID NO: 42398 - DNA, 103 bp, Homo sapiens
atgtaaataaaggattatcaggtcaagcagtgctaagtaaagatgtgtgttattcacatttctggcatgtaggaaagattgactctggataagcctgtgacat

SEQ ID NO: 42399 - DNA, 106 bp, Homo sapiens
gatgtgacttgatatccatgtgattttaacttgtctgtgtgatttttttttaaaaaaagaattgttgagatatattttttaaagtccatttggatattctgttttc

SEQ ID NO: 42400 - DNA, 66 bp, Homo sapiens
ggcagatactagacactgaataaatatatatatatatatattttcagtgtctactatgtacatggc

SEQ ID NO: 42401 - DNA, 90 bp, Homo sapiens
tcaagccaggatatagtgattttcttcttatatcacagtttgaggagagaactccactggaggtatgaacagatttcctagcctgtatga

SEQ ID NO: 42402 - DNA, 105 bp, Homo sapiens
tatatacacatatacacgtgtttatatatatatacacatacacatatacatgtttatatatgtgtgtgtttatatatgtgtgtgtgtatataaacacatatatat

SEQ ID NO: 42403 - DNA, 58 bp, Homo sapiens
tgaggtggagtctcactctgtcacccaggttggagtgcagtggcatgatctcggctca

SEQ ID NO: 42404 - DNA, 82 bp, Homo sapiens
gcatgattaagacagaggaatgttgtctcctagagggtatgggccagatagagaagatgtggctctgaactgcttagtttgt

SEQ ID NO: 42405 - DNA, 107 bp, Homo sapiens
ccaggtactgtaattactcacctgatttttttttattcatatgagggtgctttcttgtgtggatagttgttaagtttggtgttcatgcagtaagggacaatcactgg

SEQ ID NO: 42406 - DNA, 95 bp, Homo sapiens; identical to SEQ ID NO: 580

SEQ ID NO: 42407 - DNA, 93 bp, Homo sapiens; identical to SEQ ID NO: 69

SEQ ID NO: 42408 - DNA, 71 bp, Homo sapiens
gctcttggtcctgagtcttggaaaatgcctgcagcttttccaggtgtctttccctctcagtgtctttaagc

SEQ ID NO: 42409 - DNA, 81 bp, Homo sapiens
tgatacatgttacatttatatatatattatatatacttatatgtgtgcgtctgtaatatataaatatgtatacatatatca

SEQ ID NO: 42410 - DNA, 62 bp, Homo sapiens
tacatgtgtatgtatgtatagatgtgtgtgtatatttatctttactagtatatatatatgta

SEQ ID NO: 42411 - DNA, 117 bp, Homo sapiens
gaggactaaaaatattgagcttttcttagctacttatcaggtatgaaaaaaattttggaagtttttttatatatgtgataatggacttcttcaccgtttaacaattgtagagttttt

SEQ ID NO: 42412 - DNA, 72 bp, Homo sapiens
ggttgcagcgagctgagatcacaccactgcaccccagcctgggtgacagagtgagactctgtctctgtctcc

SEQ ID NO: 42413 - DNA, 111 bp, Homo sapiens
cagcctctggtaaccatccttgtactctttatctccatgagatcaattgtttttatttttagatcccacaaataagtgagaacatgtgatgtttgcctctctgtgttggct

SEQ ID NO: 42414 - DNA, 115 bp, Homo sapiens
ggttcaagcagttctcctgcctcagcctcccgagtagttgggattacaggcaccagccatcatgcccggctaattttttgtattttaggagagacgaggtttcaccatgtttgcc

SEQ ID NO: 42415 - DNA, 131 bp, Homo sapiens
tgatttgagtattatgtaaagtatctagcacagtgcctggcaccctgcaagtgctcagcatttgttgtttattttttattaattatgcagattagtgttgtctaatacaaatacagtgtgagccactcagg

SEQ ID NO: 42416 - DNA, 91 bp, Homo sapiens
ccataggagcattttgagcataggtgtgtcacagtctgactcaaagtttcacaggaacatgccggctgttgtgttgaaaataaactgtagg

SEQ ID NO: 42417 - DNA, 95 bp, Homo sapiens; identical to SEQ ID NO: 5211

SEQ ID NO: 42418 - DNA, 119 bp, Homo sapiens
tagtggctaagtttctgggggatgaaaggttatattcagatcttcaactccagtattttttttttttattctggaggcattgatgatgtcgctctgttgtcttctagtttatactgtta

SEQ ID NO: 42419 - DNA, 94 bp, Homo sapiens
tttgtatgtatgtatgctcagtgtgtattgggcactttgtatgtatgtatgtatgtatgctcagtatgtattgggcactttgggaggatacaga

SEQ ID NO: 42420 - DNA, 133 bp, Homo sapiens
ggcggtgggtgcgggtggaggtatgctccgagcatgcttgaacaggactcactgccgtctgcctgcctgtctgccactccgtcctcttgtctgggtgggaagggccaagatgaaaaaaaaatgtgcaggttac

SEQ ID NO: 42421 - DNA, 111 bp, Homo sapiens
ccagcctgggcgacggccacggagggagactccatctatatatatatttgtttgtttatttatttatttatatttatataaaatggagtctcactctgtcacccaggctgg

SEQ ID NO: 42422 - DNA, 117 bp, Homo sapiens
gtgagctgaaatttagattggcagtatgaagatcatcactggccttgatgagctgtctttttgatgtagtgtatggaagccaattaagactagattgcagagtgaattgaagtgcat

SEQ ID NO: 42423 - DNA, 80 bp, Homo sapiens
caggacagcacagagatctcagagtattctgtgtgtgtttgattttatatattttggtaccatgagatactgttgttttg

SEQ ID NO: 42424 - DNA, 78 bp, Homo sapiens
gagagagagagagagagagagagagagagatcagcattctagctatgtttaccttttttgtcttggattctttccttc

SEQ ID NO: 42425 - DNA, 77 bp, Homo sapiens
ggtctcactctgtcactcaggctggagtgcagtggcacgatcatagttcactgcagccttgaactcaggtgatctcc

SEQ ID NO: 42426 - DNA, 99 bp, Homo sapiens
caatactgtgttgaataggagtggtaagagagggcattcttgtcttgtgccagtttcaaagggaatgcttccagcttttgcccattcagtatgatattg

SEQ ID NO: 42427 - DNA, 86 bp, Homo sapiens
gagagatgcagaaagcatatcacaggatgatttgaagtcggttgctctggggcagctcttctcacgtgttagcatcagcatccctt

SEQ ID NO: 42428 - DNA, 90 bp, Homo sapiens
cacaaacacatccattactcatcacacacttcaaatttcagaacttggattccaagtgagaacagtgagtggagaggggcgattcttgtg

SEQ ID NO: 42429 - DNA, 58 bp, Homo sapiens; identical to SEQ ID NO: 38739

SEQ ID NO: 42430 - DNA, 71 bp, Homo sapiens
catatatttaatgaatataattttatgtatgtgtatgtatacatacatgtacatgtatgtggaaatgtgtg

SEQ ID NO: 42431 - DNA, 95 bp, Homo sapiens
gcctttgtctcttcataaattctgggagtaaaactgttgtccttttgagagtgaccacacagtctgagacgccttggaaagatgttctgcaaggc

SEQ ID NO: 42432 - DNA, 95 bp, Homo sapiens; identical to SEQ ID NO: 68

SEQ ID NO: 42433 - DNA, 93 bp, Homo sapiens; identical to SEQ ID NO: 69

SEQ ID NO: 42434 - DNA, 96 bp, Homo sapiens
agaatctaatacctgatgatctgtcactgtctctcatcacccccagatgggaccatcaagttgcagaaaaacaagctcagggctctcactgattct

SEQ ID NO: 42435 - DNA, 75 bp, Homo sapiens
aagctagaaggaaaggcagtacagctgagcctcaaggacaactagaactactgtcactgtctctcatctctgctt

SEQ ID NO: 42436 - DNA, 90 bp, Homo sapiens
tcaatgtttatatatccatgtatgcctatatatatttacttaaatatgtgtgtatatatatatatgtgtatgtgtaccaaataacataga

SEQ ID NO: 42437 - DNA, 108 bp, Homo sapiens
gttattattaagttacatccactggagtataattatctgttgtataatactttttatacatgggtctctagaaatttgccacttcagtagtgctgactgagactttgc

SEQ ID NO: 42438 - DNA, 85 bp, Homo sapiens
gctggaagacatgtcaaactgaccagtccattttctgtctattgacagacaggcttaggaaatagtttgtaatcaagattccagt

SEQ ID NO: 42439 - DNA, 100 bp, Homo sapiens
gtgtgcatgagagggtgtctctggatgggattagctggttttttttttttttttttttttgctttttttttcgttttgagacagggtctcactctgtcac

SEQ ID NO: 42440 - DNA, 77 bp, Homo sapiens
gtatgtgtgtgttgtgtgtatgtgtatatacgtatatatgtatatgtatatacacatacacacacacatatgggggc

SEQ ID NO: 42441 - DNA, 95 bp, Homo sapiens; identical to SEQ ID NO: 68

SEQ ID NO: 42442 - DNA, 93 bp, Homo sapiens; identical to SEQ ID NO: 69

SEQ ID NO: 42443 - DNA, 84 bp, Homo sapiens
gccacataattgattatttatttacatttatgtgatgcatttcagaacttcttattgctggtcacattggagcaataatgtggt

SEQ ID NO: 42444 - DNA, 105 bp, Homo sapiens
atgtttaaaaccactgtctgttgtttcaaggtactctaggtgttttttttttttttatactttaagttttagggtacatgtgcacaacgtgcaggtttgttacat

SEQ ID NO: 42445 - DNA, 84 bp, Homo sapiens
ttctcaggtttattatatatatatcagtcattattatactaaatttcctcggtataactgagtatagatgttggaaccagagga

SEQ ID NO: 42446 - DNA, 88 bp, Homo sapiens
atatatataaatatatatatatgtatgtgtgtatatatatacacacacatatatgtacatatatatgtgtatatgtatatatgtatgt

SEQ ID NO: 42447 - DNA, 71 bp, Homo sapiens; identical to SEQ ID NO: 618

SEQ ID NO: 42448 - DNA, 70 bp, Homo sapiens
atatatatatatgtacatatatatgtgtgtatatatatgtatgtatacatgtatatgcatgtatatatat

SEQ ID NO: 42449 - DNA, 96 bp, Homo sapiens
tttgggtgtagttgtaggtcatggattttactgaattctaatgtatgaatatatcatattttagttctttaattacatgacttatgggcatttgaa

SEQ ID NO: 42450 - DNA, 74 bp, Homo sapiens
attatatatacatacatgtatacatatgcatacatacataagtgtgtatatgtatatgtgtgtatatatataat

SEQ ID NO: 42451 - DNA, 81 bp, Homo sapiens
tatatatatatattatatatatacacacatatacatatacacacttatgtatgtatgcatatgtatacatgtatgtatata

SEQ ID NO: 42452 - DNA, 58 bp, Homo sapiens; identical to SEQ ID NO: 23832

SEQ ID NO: 42453 - DNA, 58 bp, Homo sapiens; identical to SEQ ID NO: 902

SEQ ID NO: 42454 - DNA, 79 bp, Homo sapiens
gaggaattttttatgatttttaaaaatttccttaggttttggggaaacaggtggtgtttggttcatgagtaagttcttc

SEQ ID NO: 42455 - DNA, 63 bp, Homo sapiens
gagtgagtgagtgagtgatagtgagaggtgacagcgtgctggcagtcctcacagacctcgctc

SEQ ID NO: 42456 - DNA, 63 bp, Homo sapiens
gagggagcgaggtctgtgaggactgccagcacgctgtcacctctcactatcactcactcactc

SEQ ID NO: 42457 - DNA, 115 bp, Homo sapiens
ggcctcctgagtagctgggactacaggtgtgtgcctccacttctggcttttttttttttttttttttttttttggtagagatggggatttacaatgttgtctagggtggtctgga

SEQ ID NO: 42458 - DNA, 110 bp, Homo sapiens
aatttaacaaaatatacacattttatgtgtgtaagtgtatatgtatatatatatttcatagatactcatgtatatgtgcatatatatatgtgtgtgtttatatataaatt

SEQ ID NO: 42459 - DNA, 72 bp, Homo sapiens
catgtgtttatatgcatatatacgtgtgtgtatatatatacatatatatatatgtatatatatgtacacatg

SEQ ID NO: 42460 - DNA, 108 bp, Homo sapiens
aaactcataaagatgtcaatttttttaatacagtgaatgacccatttcccagattttatgtgtgtctgtgtgtgtgtctgtgagtgtgtgtgcattgtgtgtgtgttt

SEQ ID NO: 42461 - DNA, 111 bp, Homo sapiens
gataggttttgtgcaagtttttatccaactgggctagaggattttttgtttgtttgttttttgtttttttatactctaagttctagggtacatgtgcacaatgtgcaggtt

SEQ ID NO: 42462 - DNA, 100 bp, Homo sapiens
gtaagatacttaaatatgctgtacctctcaaaaaatatcagaaattaggttcctaagtgctatttgtatttatatgtaaggacagtgagttacatcttat

SEQ ID NO: 42463 - DNA, 104 bp, Homo sapiens
tagctttagtgatttgaatcttctttttatttattgatttttcttgagcagtctagctaaatttgctcaatttgttgatctttataagaatcaaattttagcta

SEQ ID NO: 42464 - DNA, 74 bp, Homo sapiens
agtcttgagtctgaagacagtctggaggcagaaatcccatcttccggaactcctaagtcttttctcttaaggtt

SEQ ID NO: 42465 - DNA, 87 bp, Homo sapiens
caagttaaagtggcacttaaatacacacacatatgtatgtgtgtatatatatgtgtatatgtatatattaggtaagcagtatgcttg

SEQ ID NO: 42466 - DNA, 89 bp, Homo sapiens
gtatacatgtatatatatacacatgcacacacatatgtatatacatgtagatgcttatgtatgtatgtatatatgtatacatgtatata

SEQ ID NO: 42467 - DNA, 109 bp, Homo sapiens
agggcagtggaactattctgtatgctattctacatgtggatatatttcattatatattttccaaaacccacagtatataaaatactaagaataaattctaatgtaaact

SEQ ID NO: 42468 - DNA, 58 bp, Homo sapiens
tgagtcagagtctcgctctgtcacccaggctggagtgcaatggcgcgatcttggctca

SEQ ID NO: 42469 - DNA, 105 bp, Homo sapiens
cagtggttgtatattcatttgggtatagagttgggaaatggaaaatcactttaattttatgaatatttgccatataccctagtatatgtgtttgcaataatattg

SEQ ID NO: 42470 - DNA, 100 bp, Homo sapiens
atacagatggtgtattagcttgaatctgggataatggtgatgattgaatttatttttttgtaagatttgctgctatgcttatgagtgctgacatttgtgt

SEQ ID NO: 42471 - DNA, 95 bp, Homo sapiens
tgactcaattactgttacaataaatattttctaagcaaattatttgtattttaaactgtgcctggcagaaatgtgaattgtaacaatatgactca

SEQ ID NO: 42472 - DNA, 104 bp, Homo sapiens
gtcatttattttgtttcatggaatcattgcaacaatccaagaaggtagaaattattatctatattttgatacaaggcaactgaagtctatagatgttaagtgtc

SEQ ID NO: 42473 - DNA, 84 bp, Homo sapiens
aagcaaagtcacagaagagagtctggagattggtcacgggcagagggagtgagcaagagcaaacagaaagccttcgtggtgttt

SEQ ID NO: 42474 - DNA, 97 bp, Homo sapiens
atggacagaaatagcagtagcacattttttttttttctagaggtaagaacatggcctaaaagaggatgtattcaactcacaggctttattctgccat

SEQ ID NO: 42475 - DNA, 78 bp, Homo sapiens
tgtgatatatatatatatctatatgatatatatgatatcatatatatgacatatatatcatatatgatatatgatata

SEQ ID NO: 42476 - DNA, 182 bp, Homo sapiens
acacagatatatatgtatatatgtgtatatatacagatatatgtgtgtgtatatatgtatatgtgtacatatacagatatatatgtgcatatatatacacatatatttatatatgtatatacacatatatacacattatatatataaatatatattttatatatatacacacacatatatat

SEQ ID NO: 42477 - DNA, 163 bp, Homo sapiens
gtatatatgtatatatatgtgtatatatacagatatatatgtgtgtgtatatatgtatatgtgtatatatacagatatatatgtgcatatatatacacatatatttatatatgtatatacacatatatatatcttatatatatacacatatatatttatatat

SEQ ID NO: 42478 - DNA, 170 bp, Homo sapiens
tgtatatatacacatatacatatatacacacacatatatatctgtatatatacacatatatatacatatatacatatgtgtgtgtatatatatacacatatatgtatatgtatatacatatgtgtatatatatacacatatatgtatatgtatatacatatgtatatata

SEQ ID NO: 42479 - DNA, 92 bp, Homo sapiens
tatatatacatatatatgtgtatatacatatatgtatatatacatatatgtatatacacatatgtatatatacatatgtgtatatatacata

SEQ ID NO: 42480 - DNA, 80 bp, Homo sapiens
catatgtatatatacatatgtgtatatacatatatgtatatatacatatatgtatatacacatatatatgtatatatatg

SEQ ID NO: 42481 - DNA, 119 bp, Homo sapiens
ctcagcctcttcaactgtcagaagaaagtcagcatgtaccaatctattttaaatttagtttattccaactatattgagaagaatgaaaggttgatttttggtctttgttgggttagaag

SEQ ID NO: 42482 - DNA, 69 bp, Homo sapiens
tgtctcagccactcagtctgaagaattttgttatgtcagctcgagcagattgatgcggctattgagata

SEQ ID NO: 42483 - DNA, 114 bp, Homo sapiens
agaatatccagttaaacaatcagccatttatttgttcattattagatgctttattttgaaagttctcattttgtttatgagtgttatttgttgctgatgttttgtttttgttct

SEQ ID NO: 42484 - DNA, 101 bp, Homo sapiens
tagaaaggagtctagtatggtggttgagaatgtgtctctgtcagtaactggctgtgtagctcagggcatattacttaacctgtgcgtccctcatttttcta

SEQ ID NO: 42485 - DNA, 117 bp, Homo sapiens
ataaagaaaacatatgagaaacttggctttgagaggtttatatttcatacttgcaaaatgtttttctttttgatcttgaaattagtgaagttttccagggcactgtctttactttat

SEQ ID NO: 42486 - DNA, 67 bp, Homo sapiens
tctcacagaaataaaggaggggtttgggggatctcctctttttctttttttttttttttttttgaga

SEQ ID NO: 42487 - DNA, 58 bp, Homo sapiens; identical to SEQ ID NO: 13297

SEQ ID NO: 42488 - DNA, 107 bp, Homo sapiens
gtggacttagtgtccgatagaggaagtgaggaggaatgcaaacagatagtatagaattcgaatttttgttttaaaaaatcttcttttcaatttggcattgatttcac

SEQ ID NO: 42489 - DNA, 81 bp, Homo sapiens
gtattgatggaggttttcacatccgagctgggtagtataacacattgtacttgtcagaagatggagagaacagacacacac

SEQ ID NO: 42490 - DNA, 119 bp, Homo sapiens
tcaggttttctttatctagatggcaaagtgtgacagagtgacgattttcaaattctttttctttttttatttgagatgaagtctcgctctgtcgcccaggctggagtgcagtggcgtga

SEQ ID NO: 42491 - DNA, 80 bp, Homo sapiens
gtttgagagctatggttataaactaaggctcctaaagtttttataatcatgggagttctcagtttattttctttttaaac

SEQ ID NO: 42492 - DNA, 82 bp, Homo sapiens
ttagtacatcacctgacacagagtaggtgctcaataaatgattattgttttaaacttttctactttgctagtggtgtgctag

SEQ ID NO: 42493 - DNA, 165 bp, Homo sapiens
acacacacacacacgtgtgtatatatatatgtatacatatgtgtgtatatatgtatatatgtgtatatatgtatatgtgtatatgtgtatatatatatgtgtatatatgtatatgtgtgtatatgtgtatatatatgtgtatatatgtatatatgtgtgtgtgtg

SEQ ID NO: 42494 - DNA, 83 bp, Homo sapiens
tgtgtgtatgtatgtgctatatatatatagtatctatatagtatatatatatagtatatatatatagcacatacatacacaca

SEQ ID NO: 42495 - DNA, 71 bp, Homo sapiens
agacaggttttatatatatgtgtatacatatatatacctgtgtgtgtatatatatatgtgtgtgtgtgtgt

SEQ ID NO: 42496 - DNA, 58 bp, Homo sapiens
tgagacacagtctcgctctgtcacccaggctggagtgcagtggcacgaacttgtctca

SEQ ID NO: 42497 - DNA, 68 bp, Homo sapiens
ttgttagagatgagtgtcactccgtcactcaggctagagtgaagtggcagggtcatagctcatggcag

SEQ ID NO: 42498 - DNA, 83 bp, Homo sapiens
ggttgataatggtcactgtgatgtcacttctatgaaaatattcaatgttctaaatatttactgactcagtgactctttcgacc

SEQ ID NO: 42499 - DNA, 78 bp, Homo sapiens
gaatggcagtgtttgattatatttctctattatgtgtttaagataatggcctaaatgcacatcagatgttgaccattt

SEQ ID NO: 42500 - DNA, 70 bp, Homo sapiens
tatgtatgtatgtatgtatgtagtatgtatgtatgtacgtatgtatgtatgtatgtatgtatgtatgtat

SEQ ID NO: 42501 - DNA, 81 bp, Homo sapiens
ggcttctatgatattattaaggcgttgcttctgtctttctcacagggtctgtaattgtgctgttattttttcaaggaagct

SEQ ID NO: 42502 - DNA, 109 bp, Homo sapiens
ttctctaccgtttgcctctgtccttacgtggtgttctgccctcatgtgtctctgtgtgggagtgtattatcttcttcttgtagggacacctgtcataatgcattaagaa

SEQ ID NO: 42503 - DNA, 85 bp, Homo sapiens
tatgtaacatagatatatgtatatatatctatatgtacatgtatctatgtatatatatctatatgtatatatatctatatatata

SEQ ID NO: 42504 - DNA, 83 bp, Homo sapiens
cttaaccaccagagagaagagactgagggttgtcaccatggccggactgacttttcatctgttctgctgagggcagctttaag

SEQ ID NO: 42505 - DNA, 90 bp, Homo sapiens
ggtttatgaagaagggttttgctgtgaattttgacaaatgattttttttgtttttgtttttgtttttagacagagtctttctctgtcacc

SEQ ID NO: 42506 - DNA, 85 bp, Homo sapiens
gtgtgtgtgtgtgtgtgtgtgtgtgtgtgtgtatatatacatttatatttgtgtatacacacatgtgagcgtgcgcacacacaca

SEQ ID NO: 42507 - DNA, 81 bp, Homo sapiens
ggatatatataaaaatatatgatatatataaatatatatggagatatatatttatatatatcacctattagttctgtgtct

SEQ ID NO: 42508 - DNA, 78 bp, Homo sapiens
ctccaggacccattgataggtgatctctttttttttttttttttgagacggagtctcactctgtcacccaagctggag

SEQ ID NO: 42509 - DNA, 108 bp, Homo sapiens
gaataaatgtcaccatggaaaagtgactttaattgtgattccaaaactatatttaaatttttgtaattttcataaggttaaagtcaatgtagacagtgtcatttactc

SEQ ID NO: 42510 - DNA, 81 bp, Homo sapiens
gcttctatgtgcgtgtattggtctgtgttaatgtatttaaatacaagtttatttgattagaacactaaacgtttaggaagc

SEQ ID NO: 42511 - DNA, 121 bp, Homo sapiens
caatgtgctgagtgtatatttacagatcacgtctacacatactgttaaattgaatttattttttgaagattgacagtattctttgaaagggtatatgttctttacatttcatataggctac

SEQ ID NO: 42512 - DNA, 83 bp, Homo sapiens
tctttttgtctaacatcttattctttgaataagaaaagaaattttcttattcaaattcaaaatgggttataaggcagcaaaga

SEQ ID NO: 42513 - DNA, 197 bp, Homo sapiens
tactggtatatatatatatatgtgtgtgtgtatatatatatatatatatatgtgtgtgtgtatatatatatatgtgtgtgtgtgtgtatatatatatgtgtgtatatatatatgtgtgtgtgtgtgtatatatatatatatatatacacacacacacatacacacacatacatacacaccagtatatatatatatac

SEQ ID NO: 42514 - DNA, 102 bp, Homo sapiens
atatataaacatacatatattcatataaattcaaacatattttattatatatgtatacatgtgtatatatggatatatataatgtgtgtgtgtatatatata

SEQ ID NO: 42515 - DNA, 104 bp, Homo sapiens
tatatggatatatatatccatatatatatggatttatatggatatatatatccatatatatatggatttatatggatatatatatccatatatatggatttata

SEQ ID NO: 42516 - DNA, 155 bp, Homo sapiens
tatatataaatacctttatatatatatatatacacacacacatatgtatatataaatatatgaaggtatatatatatacacctttatatggatttatatatccatatatatggatatataaatccatatatatggatttatatatctatatatgg

SEQ ID NO: 42517 - DNA, 95 bp, Homo sapiens; identical to SEQ ID NO: 68

SEQ ID NO: 42518 - DNA, 93 bp, Homo sapiens; identical to SEQ ID NO: 69

SEQ ID NO: 42519 - DNA, 94 bp, Homo sapiens
gtctataaactggctcaagtctggaaattgattgagggtctatgattctctatttttatgattcaagttagacttgtgttcacttgatctagac

SEQ ID NO: 42520 - DNA, 91 bp, Homo sapiens
gtctatatctatatatctatatttatctatctactgatctatctctctatcatctataagtagatagatatcagtagatatatagattgat

SEQ ID NO: 42521 - DNA, 114 bp, Homo sapiens
aacaatactgagctttccaattcatgaatgcagtgtattgctatatttatttaagtcttctttaatatctatcaacagagtttatactgacagagttgtcagggtacagttgtt

SEQ ID NO: 42522 - DNA, 110 bp, Homo sapiens
atacatatatatatatatatacacacacacacacacacatatatatatgtgtgtatatatatatatgtgtgtgtgtgtgtatatatatatgtgtgtatatatatatatat

SEQ ID NO: 42523 - DNA, 110 bp, Homo sapiens
tgtatgcacagaaagcattgtgcagaattctttaaagaaataagtctatgtatatatatatatatggactcaaccctggagtaaattataagctaaatgtgaaaaataca

SEQ ID NO: 42524 - DNA, 95 bp, Homo sapiens; identical to SEQ ID NO: 68

SEQ ID NO: 42525 - DNA, 93 bp, Homo sapiens; identical to SEQ ID NO: 69

SEQ ID NO: 42526 - DNA, 95 bp, Homo sapiens
ctaatatatctcaatgtttatgtatgaacgtatgaatgtatatatgagtgtatgtatgtatgtatgtatgtatgtatgtatctaaagatatttag

SEQ ID NO: 42527 - DNA, 103 bp, Homo sapiens
gttcttgtagtcttgtagtacattgcagatatttcagagaagagagagaactctggtcaaagcagaattatctgtaattttaatataaattatgtttaagagc

SEQ ID NO: 42528 - DNA, 80 bp, Homo sapiens
catgtgtgtatgtgtgtgtctgtgtgtatatacgtatatacatatatatgtgtgtatacacacacatatatgtgtatgtg

SEQ ID NO: 42529 - DNA, 94 bp, Homo sapiens
ttgtgacaagtattaagtgacaagttttccaggattggctggctgacgatagaaggattggggtttggggagaagtgacaaatacctgtaatag

SEQ ID NO: 42530 - DNA, 221 bp, Homo sapiens
taaacatatgggagatatatatatatatatatatatacacaaaaatgcacatatgtttatgggaatatatatatttatatatataaatatatgtttatgggaatatatatatttatatataaatatatatttatgggaatatatatatttatatatataaatatatgtttatgggaatatatatatttatatatataaatatatgtttatgggaatatata

SEQ ID NO: 42531 - DNA, 58 bp, Homo sapiens
tgagatagagtctcgctctgtcacccaggctggagtgcaatagcgcgatctcggctca

SEQ ID NO: 42532 - DNA, 107 bp, Homo sapiens
gtcaaaatctatacagtcgtatgtgtaattatatacacacacgtgtgtgtgcacacatatacacacacacgcgtgtgtgcacacatatacacccttcttcctttgac

SEQ ID NO: 42533 - DNA, 102 bp, Homo sapiens
gggcgttgaagggattgttcttaaattaatatatgtttaacttttggagaaacttccaaagagttttcaatattaatagcatcattttatactccctccagc

SEQ ID NO: 42534 - DNA, 115 bp, Homo sapiens
tggctttcctggttcttcagtttgcagacaccgagcagatgatgggacttttttgcttttatttttttgagacggagtcttgctcagttgcccaggctggagtgcagtggcgcta

SEQ ID NO: 42535 - DNA, 68 bp, Homo sapiens
atacacaaatatatattcaaatatatacatatatgcatgtatgtgtgtatgtatatatgtatgtgtat

SEQ ID NO: 42536 - DNA, 110 bp, Homo sapiens
ttcctaataaggtctgtattgctttttgatagttaatacatattattgtattgcaggatagcaatgtagtgtgataactttgaaaaccagggcatttcttgtttacggaa

SEQ ID NO: 42537 - DNA, 69 bp, Homo sapiens
ctattgttttatatatatatatatatattttatatggggtgtgtgtgtgtgtgcatgtgaatatgatag

SEQ ID NO: 42538 - DNA, 111 bp, Homo sapiens
gcaagacttgctggcctagtggttcctgagtgagaaaggtgccccaaatctcagaacattgagaggactgagacaccatggttcatgagccagtgtggaagtgggacaagc

SEQ ID NO: 42539 - DNA, 108 bp, Homo sapiens
tcacacacagctattaactggaaacacgatttaggtcagtaaagtcaatattttgttttcatttactcatgaccacaattttctgtcagtaagtaataatgtggttga

SEQ ID NO: 42540 - DNA, 79 bp, Homo sapiens
ccatgttaagtgtttttcatcttgggaaatgtgtgactgtctacagtcccttcattatggtttgaaatgcacttgatgg

SEQ ID NO: 42541 - DNA, 89 bp, Homo sapiens
ctttcactctggaatccttcctgaggttttgatttttataattttgatatttttgaagctatagaccaggaattttgtagagtgttaag

SEQ ID NO: 42542 - DNA, 105 bp, Homo sapiens
ggctggacttcagtgggaccctctcctcctcttcatatgctctcagaccctctctatgtggtctgttcagcagattaggagactctgcattatgattcaagagcc

SEQ ID NO: 42543 - DNA, 84 bp, Homo sapiens
gcaagtatatatatatataatatacatatatgtgtctagcaagtatatatatatatgtctagcaagtatatatatatgtctagc

SEQ ID NO: 42544 - DNA, 85 bp, Homo sapiens
gtttattatatgtatacaatatatatgacatatacacacatggatatatcgtatatatgtatatatacatgtacatataatatgc

SEQ ID NO: 42545 - DNA, 58 bp, Homo sapiens
tgagacggagtctcgctctgtcgctcaggctggagtgcagtgatgcgatctcggctca

SEQ ID NO: 42546 - DNA, 249 bp, Homo sapiens
taatttatatatgtatataatttatatatgtaatttatatatgtatataatttatatacgtatataatttatatatataatttatatacgtatataatttatatatataagccagtaggatatatgaatatatgtatgaatatatagatatgtgtgtacgtatatatgtatatatacatcatatatacatgatatatatcatatatacatatatgtatgtatatatgtatgtatatgtgtgaatagata

SEQ ID NO: 42547 - DNA, 84 bp, Homo sapiens
gatcaggtttcagtctttcagtgagtctgagttgggtcatttccttccctcatgtagaagactagggaaggctggagttggatc

SEQ ID NO: 42548 - DNA, 120 bp, Homo sapiens
ctcatgcaaaaatgaagaaaagggcatgtattcccagaagactgtttttattttttgatcatgactaagatagattcagagatgggagaaaaggtagattcatggatgagggagtgtgtg

SEQ ID NO: 42549 - DNA, 80 bp, Homo sapiens
gtgtatatgtatgtatgtatatatatgtatgtatgtatgtatatatacatatatgtgtgtgtatacacatatatatacac

SEQ ID NO: 42550 - DNA, 95 bp, Homo sapiens; identical to SEQ ID NO: 68

SEQ ID NO: 42551 - DNA, 93 bp, Homo sapiens; identical to SEQ ID NO: 69

SEQ ID NO: 42552 - DNA, 58 bp, Homo sapiens; identical to SEQ ID NO: 902

SEQ ID NO: 42553 - DNA, 112 bp, Homo sapiens
atcatccatattatatatgtatgtgtatatgtgtgcatgattaccatattatatatgtatatgtgtgtgtatgattatatgattatatatgtatgtgttatatatgtattat

SEQ ID NO: 42554 - DNA, 95 bp, Homo sapiens; identical to SEQ ID NO: 68

SEQ ID NO: 42555 - DNA, 93 bp, Homo sapiens; identical to SEQ ID NO: 69

SEQ ID NO: 42556 - DNA, 94 bp, Homo sapiens
gagttgattcttgtgtagagggggtgagaaaacggtcaatttttttttctttctttcttttttttttttttgagacggagtctgactctcgccc

SEQ ID NO: 42557 - DNA, 255 bp, Homo sapiens
atacatatatatatatgtatatacatatatatatgtgtatatatatatgtatatacatatatatatgtgtatatatatatgtatatacatatatatatgtgtatatatatatgtatatatatatgtatatacatatatatatgtgtatatatatatgtatatacatatatatatgtgtatatatatgtatatacatatatatatgtatatatatatgtatatacatatatatatgtatatacatatatatatgta

SEQ ID NO: 42558 - DNA, 74 bp, Homo sapiens
gttaacttttccaactcactgtgatactgcttcttcatgttcccagagaggagtgtgttagagtgtgggttagc

SEQ ID NO: 42559 - DNA, 105 bp, Homo sapiens
ccttttaatttggattttgtcatcctcctccttctctttccatttgtaagcacatgcttgcaggttgaaaagttgaggattctgacccaattctcgtttgattgg

SEQ ID NO: 42560 - DNA, 96 bp, Homo sapiens
cttttgagtcaatgctgaaacgagttaaggttttgggggaccgttgggaaggcatggttttgaaatgtaaaattgtatcagttttgaaatgtgaag

SEQ ID NO: 42561 - DNA, 130 bp, Homo sapiens
gatagtgagtcttcaggagctctgatagttttataagtgtttagtagttcctctcttactcactttgtctctctcctgccaccttgtgaagaaggtgactgcttcccctcctgccatgattataagtttc

SEQ ID NO: 42562 - DNA, 81 bp, Homo sapiens
ctccaacaagagaccctggaagtgggatcaggctactttggcaaggaagtctggttaccaggttgctagagggttctggag

SEQ ID NO: 42563 - DNA, 79 bp, Homo sapiens
cttctgagaaatgaagtctgaaattctttttaatttttctggagtatatatattattttcagacagtaggtcttagagg

SEQ ID NO: 42564 - DNA, 110 bp, Homo sapiens
tgactcacagtactcatacagagcttaaacattagctcttactagtgtttttttaaatttttttagtagaagctaatatttaacaactgttactgacaccctgtgtgtca

SEQ ID NO: 42565 - DNA, 64 bp, Homo sapiens
tctgctcatgtatctccctagtttatttgttgttttatttaggctcagggggtacatatgcagg

SEQ ID NO: 42566 - DNA, 80 bp, Homo sapiens
cacacacacacaaatgtatcttgtgtatatatatatctatatgagagatatatgtatatatgtacatatgtatgtgtgtg

SEQ ID NO: 42567 - DNA, 75 bp, Homo sapiens
agcttctggtggccattggcattgcttgatttgtggccatatcactccagtctccgcctctatggtcacattgct

SEQ ID NO: 42568 - DNA, 85 bp, Homo sapiens
agggtggtgctagcctcataaaatgagtttggaggtattcccacttctatttttataaaagtttaagaaggactggtgctatcct

SEQ ID NO: 42569 - DNA, 81 bp, Homo sapiens
tgtagagatggggttttgccatgttgtccaggctggtctcaaactcctgggctcaagtgatctgtctgcctcagtctctca

SEQ ID NO: 42570 - DNA, 98 bp, Homo sapiens
acagcacctttaaaactgtaaagcactatacataaattgtcattgtaaagattgaatctaatgatgtgagtaaatgcttggcacagtttgtggtgtgt

SEQ ID NO: 42571 - DNA, 94 bp, Homo sapiens
gtttagcttagttggtagttttgagcacagaaagtactcattttattttttatttttgagacggagtcttgctctattgcccaggctacagtgc

SEQ ID NO: 42572 - DNA, 104 bp, Homo sapiens
tttcagcctaagcaggaagtgtttagtctgtatgcctgtgtctggatatatctgtctctttctgtctaggtgaggcttacagaggaaaggtgacttgcctgaaa

SEQ ID NO: 42573 - DNA, 103 bp, Homo sapiens
gactagtctgctatgccgttagggcagatgtggctttaaaatttttttttattttatgttattttaagttccgggatacatgtgcaggatgtgcaggtttgtc

SEQ ID NO: 42574 - DNA, 113 bp, Homo sapiens
ggattgacttggctgtacgggctctattttggttccatatgatgtcttaagtagtttttttctaattctttgaagaatatcagtggtagtttaatgggaatagcattgaatct

SEQ ID NO: 42575 - DNA, 111 bp, Homo sapiens
tttagaaatacagggcttgcagtgaatatcattatacatttgtcattttgtacatgtatgaatatctctgataaatgtttagcagtagtcaaaggatgtgtgcattttaaa

SEQ ID NO: 42576 - DNA, 58 bp, Homo sapiens; identical to SEQ ID NO: 2217

SEQ ID NO: 42577 - DNA, 100 bp, Homo sapiens
tatatgtgtaggatgtagaatgtcagctgtatgaaaagagtgaccatatctgtcatgtaactgttatattcccagcatcagaaacagtacctgccgtatg

SEQ ID NO: 42578 - DNA, 104 bp, Homo sapiens
tggagacatctgtttatagcaagctccagattcatattgaataaattaatacatgtatttaattatggcaaatgaatccctcaagcaacgttaagaagtctgca

SEQ ID NO: 42579 - DNA, 109 bp, Homo sapiens
gttctgcgtactgtgagaaagctgttttttgtttgtttgtttttaatttctcaaattacagataaagaaacagattttaagagtgtttctctctctgtctgcctgatgc

SEQ ID NO: 42580 - DNA, 80 bp, Homo sapiens
cagagctgagctgccctcacagttgattctgagcaccttgctgggtacagggtgggcacaaggtgtcagcttctcttctg

SEQ ID NO: 42581 - DNA, 76 bp, Homo sapiens
catctatctatatgtatatatatctatatatgtatatacgtatatatatgtgcatatatgtatatatgtgtatgtg

SEQ ID NO: 42582 - DNA, 79 bp, Homo sapiens
ggaggctagaagtctgagatcaaggtgtcagcaggtgctttctgagtcatctctccttggcttgcagatggccgccttc

SEQ ID NO: 42583 - DNA, 83 bp, Homo sapiens
ggactgtcctaacaaagtctcacagactgagtggcttaaataacagaaatttatcttctcacagttctggaggctggaagtcc

SEQ ID NO: 42584 - DNA, 94 bp, Homo sapiens
gtgctgagggacaatgtagcgtggaggagtttgtcttggaccttagacttttttctttttaagattctcaggattgcgttatcccatttagaac

SEQ ID NO: 42585 - DNA, 117 bp, Homo sapiens
ctggagtgtggtttttaaatgatgtttcatatttcagagaaatgtatatgtttttaaatttttttttttaaataaacttccattcttagatggcattgcaggaaaagtacagaccag

SEQ ID NO: 42586 - DNA, 95 bp, Homo sapiens
tacagctatgagtgctacaaagaattatgcagcagagtaaagatcaagcatggctgaggtactactttattaatcctttctagtactttactgta

SEQ ID NO: 42587 - DNA, 69 bp, Homo sapiens
gaggctaagttcccagaggccaggggctactctataaagctctctctgaacacagggagcacaggcctc

SEQ ID NO: 42588 - DNA, 116 bp, Homo sapiens
gatgatagtgaagaagatgtgttactataggctagtttctttgtgagagatttaattatgtttataagagatgttttaaaaatcctggccgggcatggtggctcactcctgtaatc

SEQ ID NO: 42589 - DNA, 103 bp, Homo sapiens
tatataggtctattcatggaatgcatatgtataagtaaatatctatgtctttatatatatgggtgtgtataaataatgtcatttgattctgggacactttata

SEQ ID NO: 42590 - DNA, 58 bp, Homo sapiens; identical to SEQ ID NO: 1215

SEQ ID NO: 42591 - DNA, 87 bp, Homo sapiens
ggagtcaccagcccctgtaattgtgcaagccagttctttaaaagagatctctataaatgtctgtacatctgctggttctgtttctct

SEQ ID NO: 42592 - DNA, 79 bp, Homo sapiens
agtgagactttggaaaatgtgtattaaaaaaaagctccccagatgaatctttttttttttttccagacggagtctcgct

SEQ ID NO: 42593 - DNA, 68 bp, Homo sapiens
tgggtttagagagagatttttggttttgtttttgttttttttgagacggagtcttgctctgtcaccca

SEQ ID NO: 42594 - DNA, 100 bp, Homo sapiens
tgattctacattatggcaagttgcataattatttcattatgtattgcaatataataataatagaaataaagtgcacaataaatgtaatgtgcttgaatca

SEQ ID NO: 42595 - DNA, 57 bp, Homo sapiens
ctacatgttgagggaggcggagcctatagcagcctgagtccctgaatgactgtgtgg

SEQ ID NO: 42596 - DNA, 119 bp, Homo sapiens
tagtgggctcttagtgtttgcctggtgaatgagtaactggactcaggaatccatttctttttttttttttttttgagacggagtctcactttgtcacccaggctggagtgcagtggcgc

SEQ ID NO: 42597 - DNA, 64 bp, Homo sapiens
ggaagagctgcattgttcctgtgtctagggttaaagaacagagactgctgacagtgggttctcc

SEQ ID NO: 42598 - DNA, 58 bp, Homo sapiens
gctgccttgccctctttctaccttgtgaggacacagtgagaagtcagcaggctgcagc

SEQ ID NO: 42599 - DNA, 111 bp, Homo sapiens
gaagacagatactcacctggtaatggcctgagatctgactgaagcctgagaggtgactcagccacaagacactcagggttcattagaattgtctagtcccaggtctgcttc

SEQ ID NO: 42600 - DNA, 77 bp, Homo sapiens
gtgcaactgctagatcatatggcaactatatttagttttataagaagctgccaaattgtcttccaaagtggctgtac

SEQ ID NO: 42601 - DNA, 117 bp, Homo sapiens
gccaggtgtggtggtgcaggcctgtagtcccagctacttggcgggctgaggtaggaggatcacttgagcccaggagattgaggttgaggctgcagtgaaccatgatcatgccactgc

SEQ ID NO: 42602 - DNA, 125 bp, Homo sapiens
gcaatgatagtgtgtagacaactaacagtgtacctcctggaaaaataaaatattgtctgagcgtctctctctctggaattgttttggaaggtactctgtgagcagttaatgtcttgctcaattgt

SEQ ID NO: 42603 - DNA, 121 bp, Homo sapiens
cttggtaatgagagagaaatcaattaagggggacaattccatccccagtgcaatgtgttttctttttttttttttggagaccgagtctcactctgtcgcccaggatggagtgcagtggcat

SEQ ID NO: 42604 - DNA, 97 bp, Homo sapiens
ggaacgtttaccactcagatccccagtaattacccttcagagattcacactcagtcgctctggggtagggtccaactactgctgttataaacaaacc

SEQ ID NO: 42605 - DNA, 82 bp, Homo sapiens
tcatggggaaaggatgggctgattcattaggatttatttttccacaaagggaacagagactgaagacagacacctcccatga

SEQ ID NO: 42606 - DNA, 68 bp, Homo sapiens
ttctcacttctggcgacagctccacctccagctcagcatagagcagactgagctcacagaggtcagag

SEQ ID NO: 42607 - DNA, 119 bp, Homo sapiens
cccaggacttgtaaaaatctagacaaaatgctgcagtttcttttcttgccaaggcagaacacagaatttgatcttctgttttacagggcccgggcaacagttggaggttatcatttgct

SEQ ID NO: 42608 - DNA, 113 bp, Homo sapiens
attcccaaaggtttcaaggcggctaagctggaacatgcttaaattagtcctaaatccaatctttttttttttttttaaacaatggagtctcgctctgtcaccgagattggagt

SEQ ID NO: 42609 - DNA, 63 bp, Homo sapiens
cctcattcctcacatgtctgtcagtcagctgggtgttggctgattcaggctgagcttgactgg

SEQ ID NO: 42610 - DNA, 65 bp, Homo sapiens
atctggattcaagcagttctcatgcctcagcctcccgagtagctgggaacaggcttcatccgggt

SEQ ID NO: 42611 - DNA, 88 bp, Homo sapiens
gccttgcctggctgtctgactgtgtcacatgcaataatgacagtcactgtttgttgtctgctactatgtgccaagcaccaggcaaagc

SEQ ID NO: 42612 - DNA, 72 bp, Homo sapiens
caggactgtctctgttgcagtggctctctctggctctccagggccctggcgctccacagtggctgactcctg

SEQ ID NO: 42613 - DNA, 119 bp, Homo sapiens
ccagtctcctgtgggcttctcagagtggtactggtttgcagtctatttatattttgatttaaaagaaaaatatttttgaaaacactaccgctgccaccctgcttccctctgatcaatgg

SEQ ID NO: 42614 - DNA, 80 bp, Homo sapiens
ctaaaggcatatttttgtattatttttgcataagtgtataaatttacatttattcgtgtgctatgttaaaaagcctttag

SEQ ID NO: 42615 - DNA, 104 bp, Homo sapiens
tcagataatctcaaaggcctcaaattgctctgtgattctgtcagtctgtgggtataaggtgatggcccaaaatgtctgaatagcttacagaggtttttattgct

SEQ ID NO: 42616 - DNA, 115 bp, Homo sapiens
ggcttgtggttacatgcaactaggatcttgcaaataaagcagtaacatgaatcattttttttttcatggctagccggttctgcattatccagaccaattgaaaagacagacagcc

SEQ ID NO: 42617 - DNA, 113 bp, Homo sapiens
tatatatatgtgtgtgtgtttcagtcagtcaggcatactttttttcattgtatttcttcttgtaagaagcagttgaggtagcttcgacaattaaatgcacattagactagata

SEQ ID NO: 42618 - DNA, 109 bp, Homo sapiens
gtattcctctgtggtgaaatgtctgttcaaaacttttgccctgttttcaattggattgttgtcttctcatttagttgttgaaaagtctgttcttttcacgttggattgc

SEQ ID NO: 42619 - DNA, 58 bp, Homo sapiens; identical to SEQ ID NO: 37109

SEQ ID NO: 42620 - DNA, 83 bp, Homo sapiens
gtgccatgtcggctgtcattctgtgtctctctgccccttgcaagccgcatagggcctggaacattgtgggagcttaaatgaac

SEQ ID NO: 42621 - DNA, 56 bp, Homo sapiens
gagtggaatcacggcaggcgaatctgcggtgtgaggctctgactgtggctctgctc

SEQ ID NO: 42622 - DNA, 97 bp, Homo sapiens
ctttcagagcagctatcacagttgcagtgttgcatttttgtttataattatttgattaatgtctatctgtcacactagattgtaagctctgtgagag

SEQ ID NO: 42623 - DNA, 111 bp, Homo sapiens
taaattggtttccaaattagaacacattttattttatattattttagatcttcccatcagtgaagactctgaggtttatgtgtgataggttctataagaaaaattgattta

SEQ ID NO: 42624 - DNA, 58 bp, Homo sapiens
tgagactgagtctcactctgtcgcccaggctggagtgcagtggtgtgatctcagctca

SEQ ID NO: 42625 - DNA, 106 bp, Homo sapiens
tggcaaggcctagtgtaaaatgaaaatgcgggtgccttgttcatgaattactaataatttcagaacagtgacagcagagcattacaccaaacatggggctcttcta

SEQ ID NO: 42626 - DNA, 113 bp, Homo sapiens
ggtatttaaagtaatgtagagatgatttaaggtatgtaggaggatgtatagattatatgcaaatactatgccaatttatataagggacttgagcatccacagattttggtatc

SEQ ID NO: 42627 - DNA, 83 bp, Homo sapiens
gtcagagagaatctgtctgaagaacaaagatgctgttaccttcattctttttttgtttttttgagtcaggttctcactctgtc

SEQ ID NO: 42628 - DNA, 71 bp, Homo sapiens
gtgggtacatagtagatgacccttttcatgctttttttttttttgagacagagtctcactctgtcacccat

SEQ ID NO: 42629 - DNA, 69 bp, Homo sapiens
ttgtgtgagatggagtctcactctgtcacccaggctggagtgcagtggtgagattttggctcactgcaa

SEQ ID NO: 42630 - DNA, 58 bp, Homo sapiens
tgagatggagtctcactctgtcacccaggctggagtgcagcggcgcaatctccactca

SEQ ID NO: 42631 - DNA, 79 bp, Homo sapiens
ggctggctgccccagaggaggctacagcatgtaataggaggtcttctcctgtagctctgtgaacactgtgagccagctc

SEQ ID NO: 42632 - DNA, 74 bp, Homo sapiens
gtttgttttgagatggagtctcactctgtcacccaggctggagtgcagtggtgcgatctcggctcactgcaagc

SEQ ID NO: 42633 - DNA, 58 bp, Homo sapiens; identical to SEQ ID NO: 1265

SEQ ID NO: 42634 - DNA, 101 bp, Homo sapiens
ctcagataggtgtggaaggagattttgtctgatgaaaaagcttcttaatttttttttttttttttttgagacagggtctggctctgttgtccaggctggag

SEQ ID NO: 42635 - DNA, 74 bp, Homo sapiens
gcaggtaatgagcatcactgtctctgtcacagtgccgttcaggtctgaggatttggtaggagggttaagcgtgc

SEQ ID NO: 42636 - DNA, 74 bp, Homo sapiens
cactctctgtccatgtctcactgactgttttattggccccagtgcccagcccagagtctgacacgtagagggtg

SEQ ID NO: 42637 - DNA, 84 bp, Homo sapiens
ggtgaatatttcttgcatttgggggttcctatcagttccgaacctaaaaccagtttcactgtgaatctgtgtgagaagttagct

SEQ ID NO: 42638 - DNA, 81 bp, Homo sapiens
tctggcaaatgtcaccctgctttgaacagttgatctttatagaatagagagattctctgcttctgtcagtgacatggcaga

SEQ ID NO: 42639 - DNA, 58 bp, Homo sapiens
tgagacagggtctcactctgtcacccaggctggagtgcagtggcaggcccacagctca

SEQ ID NO: 42640 - DNA, 95 bp, Homo sapiens; identical to SEQ ID NO: 68

SEQ ID NO: 42641 - DNA, 93 bp, Homo sapiens; identical to SEQ ID NO: 69

SEQ ID NO: 42642 - DNA, 109 bp, Homo sapiens
tgatattggcaatgggttttcataaatggctctcattatttttatgtgtgttccatcactacctagtttattgagactttttaatatgaagggatgttgaattttatca

SEQ ID NO: 42643 - DNA, 95 bp, Homo sapiens; identical to SEQ ID NO: 68

SEQ ID NO: 42644 - DNA, 93 bp, Homo sapiens; identical to SEQ ID NO: 69

SEQ ID NO: 42645 - DNA, 87 bp, Homo sapiens
caagtgttaccacagaagagacagaggagacctgggtgcattccagttgacttatccagttctgaagtctgttagcttcttcacttg

SEQ ID NO: 42646 - DNA, 99 bp, Homo sapiens
cttgttaagttcatgttaagaaaaggatagtacttatctgtgtgttttttttctttaatacagctttaggtcttttcttggcacacatgaacaggcagg

SEQ ID NO: 42647 - DNA, 78 bp, Homo sapiens
gaggcagagatactgtgaggagagacagagaaacaatttcaaacttttctaactttccctccacggactgctttgcct

SEQ ID NO: 42648 - DNA, 107 bp, Homo sapiens
ggcatggtggcatgtgcttgtagtctcagatactcagaaggctgaggtaggaggatcccttgagcccaggagttcaaggctgcagtgagctgtgattataccatggc

SEQ ID NO: 42649 - DNA, 69 bp, Homo sapiens
tgtatgtgtatatgtgtatgaatgtgtatatatgtatgtatgtgtatatgtatatatgtatatatatat

SEQ ID NO: 42650 - DNA, 86 bp, Homo sapiens
ccaggtgattcatgggcacagctacttttgggaacagctgtcctggacaacttcctggagtcctgtctgtgtttgtgtctccctgg

SEQ ID NO: 42651 - DNA, 103 bp, Homo sapiens
tccctcctgaaaactccgagtggcctctctgtgtctctggctcaggaaagaagtgagagaagccctatctctgagcaggctgagggctgcaggcaggtagggg

SEQ ID NO: 42652 - DNA, 108 bp, Homo sapiens
ggataaagagatggctttgagtttctgagatatatatggtgctgtttatctaaagtaaacaagttttctgtaaatattttaaggctttgcaggccagctgtagtctct

SEQ ID NO: 42653 - DNA, 101 bp, Homo sapiens
tgagctgttaggaatttgtcacactgagatttttgttgtttttgagacagggtctcactctgtcacccaggctggagtgcagtggcgcgatcattagctca

SEQ ID NO: 42654 - DNA, 80 bp, Homo sapiens
agaaaagctgactgaagaaacagaggcaaacaatagctgaaaatctgtgggcctgttgctgtggtgggtcggcgacgtct

SEQ ID NO: 42655 - DNA, 80 bp, Homo sapiens
gatggactcaaggtgacctcacaagtgcctccctctcctgctaaggccacctgccagggtcactgtgtcactcagattcc

SEQ ID NO: 42656 - DNA, 58 bp, Homo sapiens; identical to SEQ ID NO: 1265

SEQ ID NO: 42657 - DNA, 110 bp, Homo sapiens
gcactaagtacttactctgggccagacagggtgctttattttatttttgtttatttatttattttttgagacagactctcaccctgtcttccaggctggagtgtagtggc

SEQ ID NO: 42658 - DNA, 86 bp, Homo sapiens
atatatacgtatatatacgtgtgtgtatatatatatacacacacgtatatatacatatatatgtgtatatatatatatacacacac

SEQ ID NO: 42659 - DNA, 103 bp, Homo sapiens
tgtgacctttggtgaattatttaacctctctgtgcctctgtgtcttcacctttacatgagaccactaggggtagggtaggtatattcggttcctagggctgca

SEQ ID NO: 42660 - DNA, 58 bp, Homo sapiens; identical to SEQ ID NO: 2595

SEQ ID NO: 42661 - DNA, 134 bp, Homo sapiens
acctgggaggcggaggttgcagtgggccaagatcatagcactgcactccagtccgggtgacagacagagactctgtctcaaaaaaaaaaaaaaaaagtgccagagagctgtcctgtcccttctgccatgtgaag

SEQ ID NO: 42662 - DNA, 114 bp, Homo sapiens
tgcccagctcacccagcagccagtcctagagcccctaaagctctggcccaaggctctctgactgactccttcccagatctgcttggcttagtggctgaagactgacgctgcccg

SEQ ID NO: 42663 - DNA, 58 bp, Homo sapiens; identical to SEQ ID NO: 2237

SEQ ID NO: 42664 - DNA, 93 bp, Homo sapiens
tattaccagcagacagtagacttttctttccattcattcattctttttttttggtggggcacaaggtcttgctctgtcacccagactggagta

SEQ ID NO: 42665 - DNA, 109 bp, Homo sapiens
tgggctgggaggctaggacatgggtgtgtggcttttggtggaattaatgatttaactcaacagtcactgactgagtgcccgtcatgtccaggcactgcaccagggtcca

SEQ ID NO: 42666 - DNA, 111 bp, Homo sapiens
gcagggcgtagtgttgcttgcctgtagttgcggctactcaggaggctgaggtggtaggttcatttgagcccggaaggtcgaggctgcggtgagttgtgatctcgccattgc

SEQ ID NO: 42667 - DNA, 112 bp, Homo sapiens
ctccagtggcagtgctcgtgtccctcggggggctgccccagaacccagatggcctgtctgtctgtctgtcttttgtgtcagggtcctctgaggagccagcagtgtgctgagg

SEQ ID NO: 42668 - DNA, 58 bp, Homo sapiens
ctgagacagagtctcactctgtcacccaggttggagtgcagaggcatcgtgatctcag

SEQ ID NO: 42669 - DNA, 84 bp, Homo sapiens
ggacttggatggagaattacttatatttatgtatcaatttaaggaaaacccatggtttgatcatgaatcctcttagccaggaac

SEQ ID NO: 42670 - DNA, 63 bp, Homo sapiens
agggcattggcacagatctgctttcaccctgagtctctctaggtgtctctgtgtccatgcctt

SEQ ID NO: 42671 - DNA, 80 bp, Homo sapiens
ggatgctgagccctgtgtgcccgggtgtgggctgggcaggggccttgcctgcctgcctgcctgccacagggcctactttc

SEQ ID NO: 42672 - DNA, 72 bp, Homo sapiens
gggtatgacatgactacagatgggatttttaaatttttatttttcagagatgggggtctcactgtgtcaccc

SEQ ID NO: 42673 - DNA, 81 bp, Homo sapiens
ctgggtcagagggcacaggcattttactttttcatactttttgtgtgtatgtgtgagacagagtctccctctgtcgcctag

SEQ ID NO: 42674 - DNA, 121 bp, Homo sapiens
attgtagacctgagccaccccgcctggcttccctgccatctttaacgagaatctgattagtttttttctttaacaaggtagagaaaacggatggatggagagtggaaaagacgatgggtgg

SEQ ID NO: 42675 - DNA, 111 bp, Homo sapiens
ggcaagagccagtgtgcccagccatctaatttctgatctggtttctttcctttttctttcttttttttttttttgatacctagtcttgttctgtctgtctcacaggctgcc

SEQ ID NO: 42676 - DNA, 56 bp, Homo sapiens; identical to SEQ ID NO: 324

SEQ ID NO: 42677 - DNA, 115 bp, Homo sapiens
gaatgaatcggtgttttaagtgtgaagaattttaaagcaagccaagtaattgtataaaatttaaattttatgatcatgtctggacctttttacacttaacacaatggaaatgttc

SEQ ID NO: 42678 - DNA, 70 bp, Homo sapiens
gcctcgaatgcagaaataggcaggtacttttttttttttttgagatggagtctagctctgtcactcaggc

SEQ ID NO: 42679 - DNA, 104 bp, Homo sapiens
ggattttctctggtgtctgttttttgctctagtgtgtgttttttccgagaagtgtgtgtatgtctctgtggaatacacgacagatgctggggaggccctggtcc

SEQ ID NO: 42680 - DNA, 76 bp, Homo sapiens
tcactctgtcactcaggctgaagtgtggtggcacaatcatagctcactgtagcttcaaactcctgggctcaagtga

SEQ ID NO: 42681 - DNA, 73 bp, Homo sapiens
gaaacagtgatgtaattatctgtcactacggctaattttcttatttttttgtagagacaggtctcactgtgtc

SEQ ID NO: 42682 - DNA, 226 bp, Homo sapiens
tatatatatatggatatgtggatatatggatatatatatatggatatatggatatatatatatggatatatggatatgtatatatatggatatatggatatatatatggatatatggatatatatatggatatatggagatatatatctatatatatccatatatatagatatatatggatatatggagatatatatctatatatatccatatatatagatatata

SEQ ID NO: 42683 - DNA, 136 bp, Homo sapiens
agatctaacaggagagagatatatatctatatatatggatatatatagatatatatctccatatatccatatatatctatatatatggatatatatagatatatatctccatatatccatatatatatccatatat

SEQ ID NO: 42684 - DNA, 119 bp, Homo sapiens
ggggttcagaggtgctcttctttggagtgaggatattttgagctgctcacatgtgaattcatagtttattcatatagttcagctcgatttttcacaatgatgagactttcatggttcct

SEQ ID NO: 42685 - DNA, 87 bp, Homo sapiens
ttgagacagtggctcactctgtcaatcaggctggagtgcaatggcaccatcatagcccaccacagcctcttgaacgccttggctcaa

SEQ ID NO: 42686 - DNA, 115 bp, Homo sapiens
ctgggataagagaaacagaaaagacttggcctctatcctttaacacttagattctaatattattattatttttttaatttatttttttgagacggagtcttgctctgtctcccag

SEQ ID NO: 42687 - DNA, 73 bp, Homo sapiens
agcttgactttttgaccatgtgggggtattctctctcagtctctgccatccacagggtggaaattttcaggtt

SEQ ID NO: 42688 - DNA, 98 bp, Homo sapiens
gtgttccagggcttctgaatttagagctgtgtgcctttggaatgtttttataaatcttttaacagagcctttaggataaattcctgccctctgagcat

SEQ ID NO: 42689 - DNA, 66 bp, Homo sapiens
ggcatggtggcccacacctgtagtcccagctacatcagaggctgaggtaggaggatcacttgagcc

SEQ ID NO: 42690 - DNA, 83 bp, Homo sapiens
cagcacctgcttctgctgggtgagtgatgaggtctttctagcaaaagggctctctctgtctctctcatgatcaagggtcactg

SEQ ID NO: 42691 - DNA, 77 bp, Homo sapiens
cctgcactcattcatgggatgtgtactgagcacttactacgtgtcaggctctctgtttcatagttgagatgcaaagg

SEQ ID NO: 42692 - DNA, 120 bp, Homo sapiens
gcatttgtgtgtatgtgtctggctgggtctgtctatatgtctggttgtgtctgtgtgtctatgtgtctggctgtgactatgtctgtgggtgtgtgtgtctggctgtgtgtgtgcctgtgt

SEQ ID NO: 42693 - DNA, 83 bp, Homo sapiens
cacaaagagcactgaactgagagtccagagcctgggttcaagccccaggtccaccacaatcagtaccagccctgccctgtctg

SEQ ID NO: 42694 - DNA, 117 bp, Homo sapiens
gagaaggtgaaggtctgtttgcaggagaagtttctgactttacctggagctgagtcaagttagagagctgagcgaaatacaggggtagaagaagcagcagaaaggccctgggagctc

SEQ ID NO: 42695 - DNA, 57 bp, Homo sapiens
ggccacagctctaaggatttcaaccagggcccctggtcagagatcatgctgttagcc

SEQ ID NO: 42696 - DNA, 110 bp, Homo sapiens
ttggagatgaggcctagtcgggggtgtttcggtcatgggggtgcttggcactgtcctcacagtaatgagttagctctcactctattagttcccgcaagatctgactgcag

SEQ ID NO: 42697 - DNA, 118 bp, Homo sapiens
ctactattattttaagtttttgtttccatctgtatattgctaatgtatagaaatacaatgtatttttatgtattgaccttgtatgctatgaccttgtaaaacttatttattagtttgg

SEQ ID NO: 42698 - DNA, 78 bp, Homo sapiens
gtgcaggtcttagggcacagggtttctttctttttttttttttttttgagacggagtctctgtctgtcacccaggcac

SEQ ID NO: 42699 - DNA, 76 bp, Homo sapiens
ctacctcagagagtgcagagagtgcagtaatgactctctgaatgacagagaagtcagtgtgcttctgtgttggtag

SEQ ID NO: 42700 - DNA, 110 bp, Homo sapiens
gccaaggaccacacgtagttccacagctctcagcataaatgtgtgtgagtgtcacttcctcactctatcacaggcatcagacagtgggaccatgtgtagcacagccttgc

SEQ ID NO: 42701 - DNA, 115 bp, Homo sapiens
tctctctctatgtgtgtgtgtgtatatatatacatatatacgtatacacatatataatatattatatatttttatatatatattatatatatatatatatatatatagagagaga

SEQ ID NO: 42702 - DNA, 110 bp, Homo sapiens
caggaacactgaggccccaagagaagctcgttcatgtacttgctgactcactcactgaaccaatattcagcagtcagggcaacagggactggcagcctgggccctgcctg

SEQ ID NO: 42703 - DNA, 69 bp, Homo sapiens
taccaggcccttatttgtttttacatttatattttatataaatgagatacatgcatgtgggtttgtgtg

SEQ ID NO: 42704 - DNA, 78 bp, Homo sapiens
ttccaggcttttacattgtggagttttcctttctttttttttttgagatggagtctcactctgtcgcccaggctggag

SEQ ID NO: 42705 - DNA, 190 bp, Homo sapiens
acacatatatataattgcaggtcccatgtgtgtgcatgtatatatatatatatatatatatatatatatatatatatatatatgtatgtgcgtgtgtgcatgggatggatatgtgtatatatatatgtgtgtgtatatatataggtatatatatatatgtatatatatgtatacatatatatatatgacc

SEQ ID NO: 42706 - DNA, 61 bp, Homo sapiens
gagatgtgtctgagacactcaccgagagctacagagctggtggttgtcatagatatctttc

SEQ ID NO: 42707 - DNA, 64 bp, Homo sapiens
gccttcacagatgagggagggtctcaggtctgtctggcactctgttaccctgtttgtagatggc

SEQ ID NO: 42708 - DNA, 92 bp, Homo sapiens
cctaacactcattttccctccctcattgctctctgatttctttttggggcacctccttagagtgcagtcttgataggggaccaagtcctggg

SEQ ID NO: 42709 - DNA, 80 bp, Homo sapiens
gttgaagcacacgcagcttagaagtggcagagactggctttgaactcaggactcctacctcccaggccggtgcacccaac

SEQ ID NO: 42710 - DNA, 92 bp, Homo sapiens
gtcattgtgtctccttagggtcctctggtctgtgacagtctctcagtcttcccttatcgttaatgatcttgacccttttgaggagtgctgtc

SEQ ID NO: 42711 - DNA, 71 bp, Homo sapiens
gtgtgtgtgtgtgtgtgtatatatatatatatatgtgtgtgtgtgtgtgtgtgtgtgtatatacacacacc

SEQ ID NO: 42712 - DNA, 71 bp, Homo sapiens
ctacagatatgtgctataatcttaatggattcaaagtattccattatatagtcatagcataatttatgtag

SEQ ID NO: 42713 - DNA, 88 bp, Homo sapiens
ctgtgtggactacttgtttctttatttttgagacagcgtctcgctctgtcactcaggtggagtaaaatagcaggatcatagctcacag

SEQ ID NO: 42714 - DNA, 58 bp, Homo sapiens; identical to SEQ ID NO: 1763

SEQ ID NO: 42715 - DNA, 119 bp, Homo sapiens
gataataattgggtgtgagctagtgtggtccataaaagctcactttctcagtgtgtctcttcctggagttctctccggggccttgctgtgagagaacacgccccaggcaggaaacagac

SEQ ID NO: 42716 - DNA, 81 bp, Homo sapiens
ctggaagtctgagatcaaggtgtcagctgggctggtttctgttgaggcctctctccttggcttgcagacgtctgtcttctc

SEQ ID NO: 42717 - DNA, 76 bp, Homo sapiens
ggcaaagtgagttgagagaggtgagacaggggaaggcccctctgaagcgttaagcctcatgaagctccagggtgct

SEQ ID NO: 42718 - DNA, 63 bp, Homo sapiens
caggcccagagagggggagtgatttgcccagagccacactgcctggctctcttgaagggcctg

SEQ ID NO: 42719 - DNA, 102 bp, Homo sapiens
atatatatatacacacatacacacaatatatcataatgtattatgtatattacattacatatattacattgtatataatactgtgtgtgtgtatatatatat

SEQ ID NO: 42720 - DNA, 109 bp, Homo sapiens
tatgacttcaggtcaaatggtgctgacaggttgagtaggatgaagggtgaaaactgttggatttggcacagtgatggtcacgagtcatgaaagcagtttgggaggagca

SEQ ID NO: 42721 - DNA, 87 bp, Homo sapiens
gagaggctgacaggctaagctgaagacctcaggaaagtagagtggaatttcccgtggtctttttttttttttttgaggcagtgtctc

SEQ ID NO: 42722 - DNA, 117 bp, Homo sapiens
ttgtaaccccaatgcaattgctatttatctctatcattttctgttgcaaatatatattttgatattctcaacctcactccctgatgggcaggtgtgtggctgtcagtggggttggag

SEQ ID NO: 42723 - DNA, 115 bp, Homo sapiens
taatataaaataagtatgtgtgtgtatatatatatgtgtatatatatatgtgtgtgtgtgtatatatgtctacaaacacacatatatacttatatatgttatatataaacacata

SEQ ID NO: 42724 - DNA, 69 bp, Homo sapiens
ggagctgcatttgttttctaaagaattattaaaacaatccaatgatgtagagctcagatgtactgctct

SEQ ID NO: 42725 - DNA, 57 bp, Homo sapiens
gtgacagttgagagggagctgattcccagagaagtttagcccctcggccaaggtcac

SEQ ID NO: 42726 - DNA, 113 bp, Homo sapiens
gctgtctgtggctcactgaggaaacaaagatagttgcacaggactttgaatttttttttttctgtagccacagcagcctggagtggggacagatcatgagagtcggagtcctg

SEQ ID NO: 42727 - DNA, 85 bp, Homo sapiens
tcctctggcctcagctctgtgactgtctgtgcctgcttcctgggagctgacacctgatatttgcagcatctgctttttccaagga

SEQ ID NO: 42728 - DNA, 99 bp, Homo sapiens
tggcttgacatgtgtatctgttcatgtcaaggtttataaatatatatttttaataaatgtgctctattttttagcatgaaccaaatacttggagaggca

SEQ ID NO: 42729 - DNA, 132 bp, Homo sapiens
gtatatatatgtacatatatatgtacatatacatgtatatgtatatacatgtattgtatatgtgtacatatatgtatgatgtattcagtgctttaaaatatgtatatgtatatgtgtacatatatgtgtatg

SEQ ID NO: 42730 - DNA, 102 bp, Homo sapiens
gtatcctttcttgagttaagaaagtttctttctattcaatattttttaagacttgttgaattgtattaaattatttttttctgcatctatagagagggttac

SEQ ID NO: 42731 - DNA, 79 bp, Homo sapiens
atatacatatatgtatatatatacacatatatacacatatatatgtgtatatatatgtgtatatgtatgtatatatata

SEQ ID NO: 42732 - DNA, 113 bp, Homo sapiens
ctagctaaagagtcagacttttttttttttttttgagatggagtctcactctgtcacccaggctggagtgcagtggtgcgatcttggcttactgcaacctctgcttcctaggt

SEQ ID NO: 42733 - DNA, 78 bp, Homo sapiens
catatacatatatgtgtatgtgtgtgtatatatatatgtatatatatatatatatatatatatatatatatgcctgtg

SEQ ID NO: 42734 - DNA, 105 bp, Homo sapiens
gagttacactgtctggttatgtctgcagaaaaacccttcttttatttctgctactggtagtttgtatttatttttttctttggtcagtctagttaggtgtttatt

SEQ ID NO: 42735 - DNA, 72 bp, Homo sapiens
ggatctagcagagtgaagacggtgtccacccaagggcatgaggaaagggtgccgtcaacaagccacttgacc

SEQ ID NO: 42736 - DNA, 78 bp, Homo sapiens
ctggggatgggacttggggttacagattcagagagctgtgttagaaccacttgggtctctgcctgtctctcccaccag

SEQ ID NO: 42737 - DNA, 92 bp, Homo sapiens
ccttcattacttttgacctccttaagacttcagagagaatgtccgtcaagttcttttctccatcaagttctttaagttccttgaaaggaagg

SEQ ID NO: 42738 - DNA, 87 bp, Homo sapiens
gctgctttctcatatgtcccgggttgctgatttctctctttctctctaggttctgaagttagactttaggcatgggccaaagtcagc

SEQ ID NO: 42739 - DNA, 75 bp, Homo sapiens
tgtaaatatatatacatatatttgtatatggtgtatatatatgtggtgtatatgtgtatgtggtgtgtatgtata

SEQ ID NO: 42740 - DNA, 118 bp, Homo sapiens
atgtgtgtgtgaatatatatacgtgtgtgtgaatatatatcatatatgatatatatattcatatatatcatatatgatatatatattcatatatatcatatattctatatagcatata

SEQ ID NO: 42741 - DNA, 93 bp, Homo sapiens
acttgcagcaattgtgtgtgcgtggtttcttctcgttctttttattatttttaatagagacagggtctcactatgtttgttgcccaggctagt

SEQ ID NO: 42742 - DNA, 131 bp, Homo sapiens
gcagtatttggtcttgtttgaggaatcctccataaattctataatttttcctttatttatttatttttttttttgagacagggcctctctctgtcgcccaggctggagtacagtggtgcgatctctgctca

SEQ ID NO: 42743 - DNA, 125 bp, Homo sapiens
cctggcagctgcgtaggaacagactggagatggagcagggtggagttggggaggacagtgagaagacactgcgtaattcggatgagaaacactgcccctgatcagaagtagagagcttgggacag

SEQ ID NO: 42744 - DNA, 91 bp, Homo sapiens
cactgtagggaaccatgtgtggttagctcagttggagtctttatttatttttgagacaggaactcactgttgcccaggctggaatgcagtg

SEQ ID NO: 42745 - DNA, 67 bp, Homo sapiens
gggcatgtgccaccaagcccagctaatttttatttttcatagagatgggtgtcttgctgtgttgccc

SEQ ID NO: 42746 - DNA, 99 bp, Homo sapiens
gaggagggcctggactccagagaagggaccccctttcacagtgcactctgtgtctgtgtggatctgatttcatgtctagtgaccactatttttatcctc

SEQ ID NO: 42747 - DNA, 102 bp, Homo sapiens
gccctatatggttgtgcacgtggcttactgcacaaggcagtgattagaggttgaaatctagtctgcactttgcttgccaagccatgcaccttggaacagggc

SEQ ID NO: 42748 - DNA, 88 bp, Homo sapiens
gaagcacctattatgtaacaggctgtgtgtttagaccacagggctacagagatgggtgtgagttcacagccagcaggagaggagagtc

SEQ ID NO: 42749 - DNA, 74 bp, Homo sapiens
ggcgtggtgactgatgtgtgcctgtagtctcagctactcaggaggctgaggcaggaggatcacttgagcccagg

SEQ ID NO: 42750 - DNA, 95 bp, Homo sapiens; identical to SEQ ID NO: 68

SEQ ID NO: 42751 - DNA, 93 bp, Homo sapiens; identical to SEQ ID NO: 69

SEQ ID NO: 42752 - DNA, 93 bp, Homo sapiens
gccaattccttacatctcagtctctcaactttctccatataggtatagagatacagacagagagagagagagagaaagagaaagagagaaagc

SEQ ID NO: 42753 - DNA, 120 bp, Homo sapiens
tgcgtatgtgtgcatgtgtacacgtgggtaccgtgtgtatactgcatgtgtgtatgtgtgtgtactgtgtgtgtatatatgcatatgcatacatgtgggtactatgtgtgtgtactgtat

SEQ ID NO: 42754 - DNA, 132 bp, Homo sapiens
gtatgtgtgtatatgtgtgcgtgtgtgcaagtgtgtgctatacatgtatctgtgtactatatatgtatatgtgtgtactgcatgtgtggatatgtgtgtctgtgtgtatttatgtgtactatgtgtgtgtac

SEQ ID NO: 42755 - DNA, 83 bp, Homo sapiens
caggacctctgtttctctgtctctgaaatgggtatatgaacgcttgtcttgctgtatctacagggctttgaggtgatgtgctg

SEQ ID NO: 42756 - DNA, 116 bp, Homo sapiens
tgttcccaaggttttgttgttgttgttgttgtttgagatggagtctcactctttcactcaggctggagtgcagtggtgtgatctcagctcactacaacctccacctcctgggttta

SEQ ID NO: 42757 - DNA, 79 bp, Homo sapiens
tttgtcttagttcctctctctctgtctgactgctgatcgttcagtttctgccaagcaggagagaagagcctgaaatgaa

SEQ ID NO: 42758 - DNA, 97 bp, Homo sapiens
taagtcctggtgataatgtctacccttttgagtacctttatttatttatttatttatttattttggagacaggttctcactctgtcacccaggcttg

SEQ ID NO: 42759 - DNA, 77 bp, Homo sapiens
aggcatagctgggctgcagggggtggaggactcctcattctgtcactgccactcacagggcctggagagctgtgtct

SEQ ID NO: 42760 - DNA, 80 bp, Homo sapiens
ttccttgctgtgagatcattgtgaagactggaaatactgcgtgaagtgcctggtctaaaacagaggcttcatacatggga

SEQ ID NO: 42761 - DNA, 113 bp, Homo sapiens
tgtgcttttaaattgtgtttccagtgttaggacagaagttaagttagggatcatgctctcagactgacactctggttaccaaaggcttgaacatactaatttctatttgtata

SEQ ID NO: 42762 - DNA, 108 bp, Homo sapiens
gtgaggcaattaaacctctttcctttataaattactcagtctcaggcagttctttatacagcagcatgagaatggactaatataatgtgacaaggtttaaagtctcac

SEQ ID NO: 42763 - DNA, 69 bp, Homo sapiens
tggcacaggtagctttctatgacttttccatttatttttaaataaatgaatagaaggagacctgagcca

SEQ ID NO: 42764 - DNA, 85 bp, Homo sapiens
tcttactgttaaatttgcgtatgtatatatgtgtgtgtatacatatatatatgtatatcaagtgttcaaatatttaaaaataaga

SEQ ID NO: 42765 - DNA, 121 bp, Homo sapiens
ggttgtccatttattcatgcatttgcttgaactcagaggtccccagatgacactccctcactgggtgtcatgctgtcttccaatgggccactgtcatgtcctttaaaatgctggtaccttg

SEQ ID NO: 42766 - DNA, 94 bp, Homo sapiens
tcagagacatttagagagagtgatttgtaatgtctcagacactgttaaatgtgtttgacatatcattatatttattctactaagatgatgatgg

SEQ ID NO: 42767 - DNA, 108 bp, Homo sapiens
tgtactgcttgatgtaaagggaggaaaaagtaactttttaatttatctctgccctatccaaacaagggccaggaaagattacatgttttcctgtgattcagttctaca

SEQ ID NO: 42768 - DNA, 100 bp, Homo sapiens
tcttcaaagtcagcaacatcatttctctctgacccttcttcatggtcctctctccctctgactctgaactcagccaggaatggttcgtggatttcaagga

SEQ ID NO: 42769 - DNA, 71 bp, Homo sapiens
ttgtggccaagcatttacagagatgtttatttgatttttcctaaaatatcagtctgcattgtgtgccacaa

SEQ ID NO: 42770 - DNA, 69 bp, Homo sapiens
gcattctcatgacacactcacttcctctgaggatccctccagcatcttcagggtgaggtcaccaggtgc

SEQ ID NO: 42771 - DNA, 90 bp, Homo sapiens
agcaattttgcctaatgtcagaagaaagtgagcccaggtcattgggccccaaatccaatgctttctatttgaactgctttcaaacttgct

SEQ ID NO: 42772 - DNA, 94 bp, Homo sapiens
gtgcatatgagcaaggggtagagggatggggggatgagtgaaagtggtactaatctctctctctctctccccaagtcatttttgtcgtttccac

SEQ ID NO: 42773 - DNA, 105 bp, Homo sapiens
gtaaatatatacatctatacatatgtaaatatatacatctatacaatggggataagtataaatatttttatatgtgtatatttatatgtgtgtatatatagatgc

SEQ ID NO: 42774 - DNA, 124 bp, Homo sapiens
tgtatagatgtatatatttacatatgtatagatgtatatatttacatatctttatgtgtgtatagacgtatatatttacatatatttatgtatgtatagatgtatatatttacatatatatgta

SEQ ID NO: 42775 - DNA, 118 bp, Homo sapiens
taagacaaagctctcaaatgtggattctttcttggaaagactcttaaaatgttttcagaacattttttttcctttttattttagatgaattcactggatttcaaagcaaagattcttg

SEQ ID NO: 42776 - DNA, 98 bp, Homo sapiens
tatatataaatataatttgcttatatatatgtgttttttatatatgcaaattatatttatatataagcaaccatatttatatataagcaaatacgtat

SEQ ID NO: 42777 - DNA, 82 bp, Homo sapiens
gagttgatgttgcagtgtggagtctgaagacagtctagaggcagaattctctctctttttcaggtgactcatctgctttctc

SEQ ID NO: 42778 - DNA, 116 bp, Homo sapiens
aatcacgaacctgctgacagctcagggattgcagttgcaattttttttctatatgtagatggatcttttcttaaatataagtgtgagaaaaagctgttccctgagggtttatgatt

SEQ ID NO: 42779 - DNA, 111 bp, Homo sapiens
aggctcccatttggacacctgcaggattgatgcaattattcactaagtcctttgccttgactgaactgattctgcacattttatttgctctaggtttccaaatgggaccct

SEQ ID NO: 42780 - DNA, 95 bp, Homo sapiens
agatatggatatggatattcaacatgaatatatatggatatattcatatacatggatatataaatatatatatatgttcatctctctctctctct

SEQ ID NO: 42781 - DNA, 101 bp, Homo sapiens
ggccaggagcaaatcttacctgttcagtgtggggaagctgtgctagtaggttctcaactcacctttgccaaatgctccactgaatggtagatgaaccagcc

SEQ ID NO: 42782 - DNA, 93 bp, Homo sapiens
ccctggatcttaaatgagcccctggagctcagcagcaggttcctgggagtctggctggctgagtgcttggctgggatgagtgggagcagctgc

SEQ ID NO: 42783 - DNA, 89 bp, Homo sapiens
agcagcctttcctgggaggctgagaggcccctgctgaaaagctgctctgagcacgggtctcactctcagcctctgctcaagcgcttgct

SEQ ID NO: 42784 - DNA, 61 bp, Homo sapiens
ggggacggacgctcactcagtggctctccctgcaggtatcgctgatgtcagtgactgcccc

SEQ ID NO: 42785 - DNA, 111 bp, Homo sapiens
gaagagggaacttgaagaaggctgactttaggcaggataattgagaaaagcctttcttttttttgttttttgttgttgttgttgttttttgagatgaagtctcactctgtc

SEQ ID NO: 42786 - DNA, 56 bp, Homo sapiens
gcgctcgcgcgcgcgcgtgcatgcatgtgtgtgtgtgtatgtgtctgtgtgtgtgt

SEQ ID NO: 42787 - DNA, 116 bp, Homo sapiens
gagtgggtcactgtgccagagccagggccacagaaatgcttggtcccaaagattttttttttttttttttttttgagacagagtctgcccaggctggagtgcagtggcgccatctc

SEQ ID NO: 42788 - DNA, 87 bp, Homo sapiens
gcaaaatgtgcatgtcagaactcagtgacctccgtgaatcacgctgcgttcccggtgtcttcttatggtaatgaagtgcacttctgt

SEQ ID NO: 42789 - DNA, 71 bp, Homo sapiens
ctctgctgtgcaggcccctgacttccaatttgaagccgcaagccaggtatggaaatcagagcaataaagag

SEQ ID NO: 42790 - DNA, 112 bp, Homo sapiens
acatgtgaacctttcttgtgtaaacttcttgttttttcgaatttatttttattattattatactttaagttcttgggtacatgtgcacaatgtgcaggtttgttacatatgt

SEQ ID NO: 42791 - DNA, 117 bp, Homo sapiens
ccttggacatgtcacccactctcactgaactgagtgaggtttttgttttttgtttttttgttttgagaaagggtctcactctgtcatccaggctggagtgcagtggcacaatcacag

SEQ ID NO: 42792 - DNA, 75 bp, Homo sapiens
gtttggggtataatgagaggattttctatatttatttgtaatggacttagaaactctcacattgtatttctcagc

SEQ ID NO: 42793 - DNA, 91 bp, Homo sapiens
tctacctggaattgatatggcctgaacactgtttttgaatattttttgcttcatttgagtccttacgagcttgcagtccactccaggtgga

SEQ ID NO: 42794 - DNA, 73 bp, Homo sapiens
gctagcggtgtcccctctctagggcaacccccacctgcttggtgaaggactccctctgacagacactgagggc

SEQ ID NO: 42795 - DNA, 81 bp, Homo sapiens
tctgggtgagtcagtgagtgagtggtgagtgtgaaggcctaggacattactgcacgctaatgtagacttataaaaaccaga

SEQ ID NO: 42796 - DNA, 105 bp, Homo sapiens
tactgccctgtctgggtcctggggctttagaggcacaagagagagagcactgatttgggattcaaactgagcagtagccaattcctaatctgtcccctattagct

SEQ ID NO: 42797 - DNA, 80 bp, Homo sapiens
gtctgtctactccactgactgcaggatccttgaagctagtacctgctcccaggcctacacacagaagggagtgaacatac

SEQ ID NO: 42798 - DNA, 107 bp, Homo sapiens
acttccctgttcatgttgagattttggcctcctcccatgaatcataaatgttcttttttttttttttcctttgagacagggtctcgctctgttgaccaggctggagt

SEQ ID NO: 42799 - DNA, 60 bp, Homo sapiens
tgtggtttcaagttacacatgcacacatgtatgtgtgtgtctctgtaacttgaaatttca

SEQ ID NO: 42800 - DNA, 68 bp, Homo sapiens
acagtgtgtgtgtgtgtgggtgtgtgtttgtatgtaagacacaggctctcactatgttgtccaggctg

SEQ ID NO: 42801 - DNA, 90 bp, Homo sapiens
tgggctcaaggtgaggggtgctatctgtgattgagggacatggttaatggaattgtctcacacagaaatcgcacccgtcaccttggccta

SEQ ID NO: 42802 - DNA, 116 bp, Homo sapiens
ctggacctgtctcctcagtctccatctgtaaggcatctgctctgacagcctctgtggctgggagcccatggaggtggggtcttccctaggggcctatggagaagaaggggcagcag

SEQ ID NO: 42803 - DNA, 96 bp, Homo sapiens
gtctctgtatgctggtggggccagaagcccggctgcctctgtgcctggctgccatgctcagtctttcttgggcctgggctggggacctggctgggg

SEQ ID NO: 42804 - DNA, 85 bp, Homo sapiens
gtggggaaaagattgagaaatcggatggttgccgtgtctgtgtagaaagaggtagacatgggagacttctcattttgttctgtac

SEQ ID NO: 42805 - DNA, 103 bp, Homo sapiens
gcctctgaccagcctgaaatactgaagatgggactttattttttatttatttatatttttgagatagagtctcactctgtcgctcaggctggagtacagtggt

SEQ ID NO: 42806 - DNA, 92 bp, Homo sapiens
ccatgcctgcctgcctgcctggctctatttccttaagtttttttttttttttttttttttgagaaggagtcttgctgtgtcacccaggctgg

SEQ ID NO: 42807 - DNA, 93 bp, Homo sapiens
ttacatttgtgctcattttatcacagtccctcttcatgttaaaaccatttataaaatctatggttttatatctggtggattgcacataggtag

SEQ ID NO: 42808 - DNA, 56 bp, Homo sapiens; identical to SEQ ID NO: 2604

SEQ ID NO: 42809 - DNA, 65 bp, Homo sapiens
ttcagcctctgaggcccagagggcaccccctggcaaagaggggtcactcccactgagtggctgag

SEQ ID NO: 42810 - DNA, 58 bp, Homo sapiens; identical to SEQ ID NO: 1305

SEQ ID NO: 42811 - DNA, 86 bp, Homo sapiens
gtgttttcgagccaatgacttgctgtgattctatgggtaagctcctctacctctctgagtctcagattcttgagctggaaaaggac

SEQ ID NO: 42812 - DNA, 85 bp, Homo sapiens
tggaacatgatgggtcccaaaaggtgtcaagaaatccttgctctaaagaagtcattttcttgtcctctgggaacttgccagtcca

SEQ ID NO: 42813 - DNA, 107 bp, Homo sapiens
gctgaaaggaagcccttgggagcaacagcctggtgtcagatcttctctctgcctctctctatgtgtgaccctgagcaactgctttaccctctaacaagtttctcagc

SEQ ID NO: 42814 - DNA, 104 bp, Homo sapiens
gtttgtgtgtatatgtgtgtgtatgtgtatgtgtatatatatatatatatatatatatatatatatatatatatatatacacacacacacatatacggatatat

SEQ ID NO: 42815 - DNA, 86 bp, Homo sapiens
caaccaccaactgtagtgtgtgtgtttctcccgagtgtgtgtgtgtgtgtctcccaagggaacagagcactgctgagttcaggttg

SEQ ID NO: 42816 - DNA, 76 bp, Homo sapiens
cggttggaaccttaagaggcttgtgacagtggctatattctaaccagtgtgcaagtattttaattttttacaactg

SEQ ID NO: 42817 - DNA, 112 bp, Homo sapiens
ggactgtgctagctctgtgggctcatttttggttccatatgaaatttaaagtagttttttccaattctgtgcacaaggtcaatggtagcttgatggggatagcattgagtct

SEQ ID NO: 42818 - DNA, 88 bp, Homo sapiens; identical to SEQ ID NO: 3816

SEQ ID NO: 42819 - DNA, 84 bp, Homo sapiens
tgtatgtatgtatgtatgtatgtatgtatgtatatatgtgtgtatatatatatacacatatacacacatatatgtatatatata

SEQ ID NO: 42820 - DNA, 78 bp, Homo sapiens; identical to SEQ ID NO: 22393

SEQ ID NO: 42821 - DNA, 95 bp, Homo sapiens; identical to SEQ ID NO: 68

SEQ ID NO: 42822 - DNA, 93 bp, Homo sapiens; identical to SEQ ID NO: 69

SEQ ID NO: 42823 - DNA, 95 bp, Homo sapiens
agcatatatatatagtatatagcatgtctatacttatactatatacatacatgtagtgtgtatgtatatatgtatatatagtatatatatatact

SEQ ID NO: 42824 - DNA, 71 bp, Homo sapiens
tatatggtgtgtgtatgcaaatatatatgtaaatattcatatatgtgtacatgtgtacatacatacatatg

SEQ ID NO: 42825 - DNA, 87 bp, Homo sapiens
gcaatttctgacactctcaggatgtgggttttcacattgtgtctctcacacagtaatacatggccgtgtcctcagatctcaggctgc

SEQ ID NO: 42826 - DNA, 62 bp, Homo sapiens
gaagacaccgtggtgtgtctgtgtgtctgtaacccacagggatgaagatgccgcggtgtgtc

SEQ ID NO: 42827 - DNA, 130 bp, Homo sapiens
ctggcttggctggctggctgtcttggctttctagctggcatggctggcttggctggctgactgggtgcctggctggcttggctggcttgggtggcttggctggctaggctgggtggctgtctggcttggc

SEQ ID NO: 42828 - DNA, 116 bp, Homo sapiens
atgtatttatattacgtgtagctgtatataaatatttttgtacttatatgctgtgtacttatattctatatattataaaacattttataaaattatacatgtataaaatgttacat

SEQ ID NO: 42829 - DNA, 126 bp, Homo sapiens
gggaaagagtgatgccccatccgttttctgagaaacagcagaggcgtatggccagtggggtgtctctctctttccctgaggccgaaaagtcagggaatttttcttccccacccctaggagctctgt

SEQ ID NO: 42830 - DNA, 92 bp, Homo sapiens; identical to SEQ ID NO: 19005

SEQ ID NO: 42831 - DNA, 63 bp, Homo sapiens
agagtaagaccctgtctagaaaaaaaaaagtttgttttttgttttgagacacagtctcgctct

SEQ ID NO: 42832 - DNA, 81 bp, Homo sapiens
atcactgtaatgtgctcaccttgggtcaaagagaaaattggcaaactttttctttttaaagacaggctggtttgcagtggt

SEQ ID NO: 42833 - DNA, 62 bp, Homo sapiens
tgggtgaccaagaaaggctttttttttttttttcttgagacggagtctcactctgtcaccca

SEQ ID NO: 42834 - DNA, 103 bp, Homo sapiens
ctgggcaacagagtgtgatcttgtctcaaaaataaataaaataaatacatttttaaaaagtatatatttttttaagagacaggggtctcagtatgttgcccag

SEQ ID NO: 42835 - DNA, 73 bp, Homo sapiens
gcttcacagtgtgattttgttttattttattttatgtatttatttatttagagagggagtctcgctctgaagc

SEQ ID NO: 42836 - DNA, 101 bp, Homo sapiens
ggtttcccactagcttagcagccctttgatgcttttaacgtaattttgttattgtcttatccaaaattcttgcttgttttcagagggaaagcgggtctgcc

SEQ ID NO: 42837 - DNA, 97 bp, Homo sapiens
gggaagccctgctgcctgagagacatgagacagaggacagaaacatgtttactttgttgaatgtgtttaattgttttagatgtatggggggtatctt

SEQ ID NO: 42838 - DNA, 135 bp, Homo sapiens
gttagggtcagggcttcgggacttgtttctcctaaatcttttttttttttttttgagacagtctcgctctgtcacccaggctggagtgctgtggcgtgatctcggctcactgcaagctccgcctcccgggttcac

SEQ ID NO: 42839 - DNA, 110 bp, Homo sapiens
cggcaggcagcatcacgtctgattcaactgcgttatcaggtaatgcaggcctgttctgcctgtgtgcgtgagtgcgtgggtgccatgtgggattgtgtgtgttgatgtgg

SEQ ID NO: 42840 - DNA, 62 bp, Homo sapiens; identical to SEQ ID NO: 5241

SEQ ID NO: 42841 - DNA, 95 bp, Homo sapiens; identical to SEQ ID NO: 68

SEQ ID NO: 42842 - DNA, 93 bp, Homo sapiens; identical to SEQ ID NO: 69

SEQ ID NO: 42843 - DNA, 85 bp, Homo sapiens
gtctgaggaaatgagttggactttgaaatgcatagatgtatgtatgtatttatatactttggcccagcaagtcattctgtgggac

SEQ ID NO: 42844 - DNA, 109 bp, Homo sapiens
ttggtggatgccagtgccaaatttaaagagcttggtgagtcaataattgtatcaatgttattttatagtttgcctttaattatatgttgtggaaacttgcaaatgccaa

SEQ ID NO: 42845 - DNA, 100 bp, Homo sapiens
catgttcttctgttagttacattaatctgctggttagatctagaggtttggttggatttgaattcagtctcgttggggcggtgttatgtctggggtcatg

SEQ ID NO: 42846 - DNA, 96 bp, Homo sapiens
tcatttagcatctgcctttctggctttttactttatctttttattattgtttttagtttaatgagattatggttagagagaaagatgggtgcatga

SEQ ID NO: 42847 - DNA, 115 bp, Homo sapiens
tacatagtatatgtatatgtgtaaatatatgtatatgtgtacatatatgtatgtaatatgtgtatgtaaatattatgtaaatatgtatgtaaatatatatgtaaatatgtatgtg

SEQ ID NO: 42848 - DNA, 114 bp, Homo sapiens
ggattgtcttcgctttacagtctcttttttggttccatatgaaatgtaaagtagttttttttctaattctgagaagaaagtcaatggtagcttgatggggatagcattaaatcc

SEQ ID NO: 42849 - DNA, 71 bp, Homo sapiens
agatggggtctcactctgttgctcagactggggtgcagtgccacgatctgagctcactgcaaaatccttct

SEQ ID NO: 42850 - DNA, 88 bp, Homo sapiens
gagaaactaatgcctgatgatctgtcactgtctcactttgcccccagatgagaccatctagttgcagaaaaataagctcagagtttcc

SEQ ID NO: 42851 - DNA, 79 bp, Homo sapiens
atttatgagcatttcacctaattttttttcttctttaattagaagcttaaagaaaagtttgtagaatgtactcataagt

SEQ ID NO: 42852 - DNA, 114 bp, Homo sapiens
ggctctagggttacagccagcatctttaacttagtatagcctacctttattttgtttatttatttatttatttatttttgagaaagagtcttgctctgtcacccaggctggagt

SEQ ID NO: 42853 - DNA, 96 bp, Homo sapiens
tgttcagcattcactgagttcccctgactgtatgagaagagagtagaactcttctgatcatcagtcttatttctgctctgtgcaaatgcttgtaca

SEQ ID NO: 42854 - DNA, 130 bp, Homo sapiens; identical to SEQ ID NO: 42827

SEQ ID NO: 42855 - DNA, 116 bp, Homo sapiens; identical to SEQ ID NO: 42828

SEQ ID NO: 42856 - DNA, 126 bp, Homo sapiens; identical to SEQ ID NO: 42829

SEQ ID NO: 42857 - DNA, 119 bp, Homo sapiens
gctactgacttttatatgttgattttgtatcctgcaactttactaaatttgtttatcagttctaatagtgttttggtggagtttttaggtctttcctaatacaagatcacatcatctgc

SEQ ID NO: 42858 - DNA, 95 bp, Homo sapiens; identical to SEQ ID NO: 68

SEQ ID NO: 42859 - DNA, 93 bp, Homo sapiens; identical to SEQ ID NO: 69

SEQ ID NO: 42860 - DNA, 91 bp, Homo sapiens
cttctatttacttctggactaaaaagtatgcttctgaatagggttctgtctttttcacagtagaatttttgttttagaactagaaaggaag

SEQ ID NO: 42861 - DNA, 118 bp, Homo sapiens
tttatatatatatatatatgtgtgtgtgtgtgtgtgtgtatatatatatgtgtgtgtgtatatatatatatgagatctccaaaccatctaaatatccaaagcatatatatatatatat

SEQ ID NO: 42862 - DNA, 82 bp, Homo sapiens; identical to SEQ ID NO: 41179

SEQ ID NO: 42863 - DNA, 108 bp, Homo sapiens
gggatccagacatgaagataggggaggctgcctctgatcccagggctcactgtgggtctctctgttcacaggggtcctgtcccaggtgcagctgcaggagtcgggccc

SEQ ID NO: 42864 - DNA, 74 bp, Homo sapiens
gtgtgtgtgtgtgtgtgtgcacgtgcatgtgtgtgtgcacatgtgtgtatgtctgtatgcacacatattttcac

SEQ ID NO: 42865 - DNA, 104 bp, Homo sapiens
gggtgacagagcaagactccgtctaaaaaaaaaaaaaaaaagtttagaaaacaatatacataatatgaattttttttcctaagacagaatttcgcttgttgccc

SEQ ID NO: 42866 - DNA, 108 bp, Homo sapiens
gctgggagtgtgatgagactgtagtcccggctactcaggaggctgaggtagaagaatctcttgagctcaggagggcaaggctgcagtaagccccattcacattatagc

SEQ ID NO: 42867 - DNA, 116 bp, Homo sapiens
tacatagtatatgtatatgtgtaaatatatgtatatgtgtacatatatgtatgtaatatgtgtatgtaaatattatgtaaatatgtatgtatgtaaatatatatgtaaatatgtat

SEQ ID NO: 42868 - DNA, 139 bp, Homo sapiens
cataattatacatagtataattatacatagtatatgtatatgtgtaaatatatgtatatgtgtacatatatgtatgtaatatgtgtatgtaaatattatgtaaatatgtatgtatgtaaatatatatgtaaatatgtat

SEQ ID NO: 42869 - DNA, 96 bp, Homo sapiens; identical to SEQ ID NO: 42846

SEQ ID NO: 42870 - DNA, 199 bp, Homo sapiens
actattttatatatatatatatatatatatggtgtgtgtttctgtgtgtgtgtgtatatatgctctctatggtgtgtgtgtatatatatgctctctctatatatggtgtatgtgtgtgtgtatatatatatatgtggcctgtatggtatatatatgtctctatggtgtgtttgtatatatatctatatatatatatatg

SEQ ID NO: 42871 - DNA, 109 bp, Homo sapiens
agagcctggtattgctgagattgatctagattaggggttgacaattttttttttttcctggtaacagtgagagggtaggctttgtaggtcaagaggcaaaattgggcct

SEQ ID NO: 42872 - DNA, 89 bp, Homo sapiens
tgctgtaactgcaacagagcagtctccccagaaattatgctgatagggccagtttcttttctgaggtttgttgtgtgtctaggcatgta

SEQ ID NO: 42873 - DNA, 113 bp, Homo sapiens
gggatattgagagagactggcacactctgagcagctcttcagaacaaaagtgttgagagtggacagagggaggacacagatgctggactgaagggggagtatgctgggagccc

SEQ ID NO: 42874 - DNA, 69 bp, Homo sapiens
gtctgtctgcatgtctctgtgcacctgcatctgcgtgagtccatgtatggagatgtgttatctgcagat

SEQ ID NO: 42875 - DNA, 84 bp, Homo sapiens
tccacctggaggtggctgctattacaattgaggtttctttttttttttttttagataaagtctcgctctgtcacccaggctgga

SEQ ID NO: 42876 - DNA, 94 bp, Homo sapiens
tttgcgtttttttttgagattgagtctcgctctgtcacccaggatggagtgcagtggcgcgatcttggatcactgcaagctctgcctcccgggt

SEQ ID NO: 42877 - DNA, 289 bp, Homo sapiens
cacagactatatatatatatatataatctgtatatatatatgtatacatatatatgtatgtatgtatgcatgtatatgtacatacatatatgtatatatgtatgtgtatatatgtatacatatatataatctgtataatatatgtatatatgtatatgtgtatatgtgtatatatacgtatatatatatgtatatatgtgtatatgtatatgtacacatatatacatatatatatacgtatatacgtatatatatgcatatatatatataaaatatatctacatatata

SEQ ID NO: 42878 - DNA, 100 bp, Homo sapiens
gataaaagatagcatataccattgtgcactttgttttttgacctggggtggggtctcactctgtcactgaggctggagtacagtggtgtgatcttggctc

SEQ ID NO: 42879 - DNA, 58 bp, Homo sapiens
tgagatagggtctcactttgtcactcaggctggagtgcagtagtatgatcttggctca

SEQ ID NO: 42880 - DNA, 85 bp, Homo sapiens; identical to SEQ ID NO: 42843

SEQ ID NO: 42881 - DNA, 109 bp, Homo sapiens; identical to SEQ ID NO: 42844

SEQ ID NO: 42882 - DNA, 100 bp, Homo sapiens; identical to SEQ ID NO: 42845

SEQ ID NO: 42883 - DNA, 108 bp, Homo sapiens
actccaaatggttgaaaacagatatacaggtggggtttgacatgtctttttcttggtgtgtttctgcttccatgtttaaatttctcgtgtaaggcttttttttagggt

SEQ ID NO: 42884 - DNA, 96 bp, Homo sapiens; identical to SEQ ID NO: 42846

SEQ ID NO: 42885 - DNA, 116 bp, Homo sapiens; identical to SEQ ID NO: 42867

SEQ ID NO: 42886 - DNA, 114 bp, Homo sapiens; identical to SEQ ID NO: 42848

SEQ ID NO: 42887 - DNA, 96 bp, Homo sapiens; identical to SEQ ID NO: 42846

SEQ ID NO: 42888 - DNA, 116 bp, Homo sapiens; identical to SEQ ID NO: 42867

SEQ ID NO: 42889 - DNA, 82 bp, Homo sapiens
acttatctgtgagactggtgctaactccaactcttttttttttttttgagatggagtctcactctgtcgcccagggtggagt

SEQ ID NO: 42890 - DNA, 56 bp, Homo sapiens
atctgagaagatgctggggtttgtgggagctgtcttcactctcagtatctttggat

SEQ ID NO: 42891 - DNA, 86 bp, Homo sapiens
acacacatattctcctgtatttatatatagatatgtacacacacttacatattaaagtatgtttatacacattgggttgggtgtgt

SEQ ID NO: 42892 - DNA, 75 bp, Homo sapiens
tatatgtgcgtgtaaatggtactgttatattttatattatacatattttatgtaccatttacacacacacatata

SEQ ID NO: 42893 - DNA, 100 bp, Homo sapiens
tatacacatatatgtgcatatatatgtatatatattatacacacatatgtgcatatatatgtatatattatacacacatatgtgcatatatgtgtatata

SEQ ID NO: 42894 - DNA, 110 bp, Homo sapiens
gcatgtatgtatgtatatataaattacgcatgtatacatatatgtgtgtaatatatatacatatatatgcacatcatcccatctgggccttcatatatatgtatatgtgt

SEQ ID NO: 42895 - DNA, 61 bp, Homo sapiens
caccatctgtgacagcttcttgatctgtccccagataggtggctgtgtttgacagatgttg

SEQ ID NO: 42896 - DNA, 58 bp, Homo sapiens; identical to SEQ ID NO: 42073

SEQ ID NO: 42897 - DNA, 104 bp, Homo sapiens
tggaaaaatatataaactaaattgtggtgatataaatggaaatggaattactggagtaatttctgtttttctacatctgtgttctctcaattatttatattcta

SEQ ID NO: 42898 - DNA, 71 bp, Homo sapiens
atgttggtgcaaatgagattttattcttcttttatggatgaacaatatttcattgtatatatgcaccacat

SEQ ID NO: 42899 - DNA, 76 bp, Homo sapiens
agtgacatcatattagcacagttttgtgtctgaaatttatttttttttaactcagcacacagagctcattgtcact

SEQ ID NO: 42900 - DNA, 70 bp, Homo sapiens
tggcactgagccgagatcgcgccactgcactccaacctgggtgacagagcgagactctgtctcacacaca

SEQ ID NO: 42901 - DNA, 90 bp, Homo sapiens
ctgcctgacactgggccagtagtcctcatgaaaatatcagctatctatgaaagtatgttttttctatttcactggcacagtctctatcag

SEQ ID NO: 42902 - DNA, 96 bp, Homo sapiens
gcccttccacattgctaagctcgggaataaagtgactttcttttttttttttggagaaggagtctctctctctccccagtagttgggattacaggc

SEQ ID NO: 42903 - DNA, 58 bp, Homo sapiens; identical to SEQ ID NO: 6617

SEQ ID NO: 42904 - DNA, 56 bp, Homo sapiens; identical to SEQ ID NO: 6618

SEQ ID NO: 42905 - DNA, 99 bp, Homo sapiens
ttgtctgatgtcttctcataattagactagggatatggattaaattcaatgttttcaatatttatatttatttaggtttaaagagaagagactaaacaa

SEQ ID NO: 42906 - DNA, 106 bp, Homo sapiens
acccacaaatcagtgacaacatgtgatatttgtctttctgtgcctggtttatttcactgaagatagtcatctccagttttatccctgttgttgcaaatgactgggt

SEQ ID NO: 42907 - DNA, 78 bp, Homo sapiens
taagtttgttaatttctagtatatagaagtatgtatttctatatactgagcttgtgtactggaactgtattgaactta

SEQ ID NO: 42908 - DNA, 92 bp, Homo sapiens
tccacattgctaagctcgggaataaagtgactttcttttttttttttttttttttggagacggagtctcgctctgtcccccagtagctggga

SEQ ID NO: 42909 - DNA, 132 bp, Homo sapiens
atatatatgtatacgtatacgtatacgtatacatatatatgtatatatatacgtatacatatacatatatatacatatatatgtatatgtatacgtatacatatatatatacgtacacatatatatatatac

SEQ ID NO: 42910 - DNA, 159 bp, Homo sapiens
tatatatatatgtgtacgtatatatatatgtatacgtatacatatacatatatatgtatatatatgtatatgtatacgtatatatatacatatatatgtatacgtatacgtatacgtatacatatatatgtatacgtatatgtatacgtatacatatat

SEQ ID NO: 42911 - DNA, 101 bp, Homo sapiens
cgccctgcttccggaaaggagatccagaaggaaaaagaaaagatgttgggacctttttttttttcttcttttcctagccacatcctttgggggttgggatg

SEQ ID NO: 42912 - DNA, 58 bp, Homo sapiens; identical to SEQ ID NO: 6617

SEQ ID NO: 42913 - DNA, 56 bp, Homo sapiens; identical to SEQ ID NO: 6618

SEQ ID NO: 42914 - DNA, 162 bp, Homo sapiens
tatatctatatatatagatacatatgtctatatatatagatatatatgtctattatatagatatatatgtctatatagagatatatgtctatatatagatatatgtgtctattatatagatatatatgtctattatatagatatatatgtctaaatatagat

SEQ ID NO: 42915 - DNA, 117 bp, Homo sapiens
cagaaaaatccacctctttatttttcttgtcaaatgggaatagatgctttttttgaatataaaatcttccttgtgtttgtgaggcaaaataacattagatggcaactgattattctg

SEQ ID NO: 42916 - DNA, 102 bp, Homo sapiens
tgacttatgagttggaaaatgcatttataaattttttcatagtaatataacaagaatttaatgtcactatgcaatcgttggaagcactccaatcagaagtta

SEQ ID NO: 42917 - DNA, 89 bp, Homo sapiens
atatatatatgttacatacatatatatgttatatatatatgttacatacatatatatgttacatatatatgttacatacatatatatgt

SEQ ID NO: 42918 - DNA, 74 bp, Homo sapiens
gttgttattagagacttggtctcactctgtcacccaggctggagtgcagtggtgagatcatggctccctgcagc

SEQ ID NO: 42919 - DNA, 89 bp, Homo sapiens
acagtgtctgtcaaagagcagcatttattttaattttgactaagaataatttgtccttttttgttgtttttttttgagacagagtctgt

SEQ ID NO: 42920 - DNA, 99 bp, Homo sapiens
tttatatatgagcattcatgcatatgtatatgtgtgtgtgtatatatatatatatacacacacacacccatatacatgcacacacactcaaactataaa

SEQ ID NO: 42921 - DNA, 58 bp, Homo sapiens; identical to SEQ ID NO: 1391

SEQ ID NO: 42922 - DNA, 56 bp, Homo sapiens; identical to SEQ ID NO: 1392

SEQ ID NO: 42923 - DNA, 58 bp, Homo sapiens; identical to SEQ ID NO: 3701

SEQ ID NO: 42924 - DNA, 64 bp, Homo sapiens
acatatgtatgtatttatctatctatctatatagatagatatatagatatgtgtttacgtgtgt

SEQ ID NO: 42925 - DNA, 104 bp, Homo sapiens
taggtatggaaggtagtagataaatgaccacagcttgcttcatatcactgagtgactcactcattcttgttggctctgtttcaatgaactagttgccaagccta

SEQ ID NO: 42926 - DNA, 128 bp, Homo sapiens
gcctggcatgagcacacactcctcctcacagggcatctgatgttgtgaccagacactctctctggctgccctctcaggtgaggcacatgtggtggaaaaccaactacaaccagcactggagggcacca

SEQ ID NO: 42927 - DNA, 91 bp, Homo sapiens
tggcagggtcttgggaccaagcaaaggagtgggcaccatgtcactgcagataggccatgtgtgactggctctgtgtctgggagatatgtgg

SEQ ID NO: 42928 - DNA, 115 bp, Homo sapiens
cactggagtcctggttgatgtggtgatatggtgttgggaggagaagtgttcttttttttttttttaggtagcctttttttattattattatactttaagttttagggtacatgtg

SEQ ID NO: 42929 - DNA, 108 bp, Homo sapiens
gggaggggagagccaaggtgcacattagaaggagattacagtactcttccagtgcacagtggatgtgttgtgattccagagttctatgtatgtatgactgtgtagccc

SEQ ID NO: 42930 - DNA, 69 bp, Homo sapiens
catctcagtccatggtggaagacagaacaaactcaggggtttgatgttaatcatgttgagcttgaggtg

SEQ ID NO: 42931 - DNA, 93 bp, Homo sapiens
gttttgtgtggacatatgtttttatttttcatttttctggtgtacatacatgagagtagaattgatgggtcatatgaaaactctataattaac

SEQ ID NO: 42932 - DNA, 60 bp, Homo sapiens
tgaggcagagtctcactctgtggcccaggctagagtacagtggtgcaatctcatggctca

SEQ ID NO: 42933 - DNA, 94 bp, Homo sapiens
ccaaaaacctctgcacttgttcagtacagatgcattaaaatttttttgttttttgctctgcagttagttgaatccaggaatgcagaacccatgg

SEQ ID NO: 42934 - DNA, 105 bp, Homo sapiens
cggtatatgtgacatacattatgtaaatatgtattatattgcgtgtgtgtatatatatgtatatatgcacaaatacatttttaaaaataatgataaaataaactg

SEQ ID NO: 42935 - DNA, 94 bp, Homo sapiens
tgacaacatatgtgcatcattaatgcattaaataatctggaagctggtttcatagctgctgcaattttggaatagtgagcacacatgtgtgtca

SEQ ID NO: 42936 - DNA, 120 bp, Homo sapiens
ggtgatgggaacagctgagccatagggcaggtgcccagagatgcagctttgaacaggcgtagctgctggggaggaggttgctgggcacttctgcacatatgtaaagctgtgcatcctccc

SEQ ID NO: 42937 - DNA, 131 bp, Homo sapiens
gtgccgacagagttggtttacttgaggcctctctcctgggcttgcaggtggtcgtccctctgtgtatgtctgtgttctgatctcttctttaaggacaccagtcctgttggatcagggtccatctcagtcac

SEQ ID NO: 42938 - DNA, 93 bp, Homo sapiens
catgtacagagagtgcagcaccagcactctgatcttttttttttttttttctttttgagacggagttttgctcttgttgcccaggctggagtg

SEQ ID NO: 42939 - DNA, 58 bp, Homo sapiens
tgagactgagtctcgcactgtctcccaggctggagtgcagtggcgggatctcagctca

SEQ ID NO: 42940 - DNA, 119 bp, Homo sapiens
atgtcattatatgacatgactctgtgtgtgtgtatatatatatatatatatatatgagtgtatatatatatatatatatgagtgtatatatatatagggcatgtatatatacatgtaat

SEQ ID NO: 42941 - DNA, 114 bp, Homo sapiens
agacacacagattatgtgttaccacaatatgtgatatatgtatatagctatatatgtatatataacatatactgtatgaattgtgtgtgtatatataacgtatatgttatgacg

SEQ ID NO: 42942 - DNA, 56 bp, Homo sapiens
gagacggagtctcgctctgtcgctcagcctggagtgcagtggtgcgatctcggctc

SEQ ID NO: 42943 - DNA, 108 bp, Homo sapiens
ctgcagtgtttttggagatgaatctagcttcaataaagcaatgtacaaggttccttttttattaaatttaaattagctggagagtttaaataaatcaccactgaaaag

SEQ ID NO: 42944 - DNA, 88 bp, Homo sapiens
aacgtcgtgaaagagcagactgtagacagtgtctttaagagctgtaacacttactgagaaggtctgtgatttcattcttgaagtcgtt

SEQ ID NO: 42945 - DNA, 94 bp, Homo sapiens
ctttggccccctgcttctaacaccgtgtgatctgtgccatgtcagtgtgtctctctgagcaatagtttcctaatttagaagcaactccctagag

SEQ ID NO: 42946 - DNA, 110 bp, Homo sapiens
caactgcaattttaatgtttttttctgtacattatttaatgctaacttggagtgaaattgcttagaaagtattgaatttgtgtatccggcaagcacaagaatttcctttg

SEQ ID NO: 42947 - DNA, 139 bp, Homo sapiens
tagtttctatatatagtttctatatatagtttctatatatagtttctatatatagtttctatatatagtttctatatatagggtctatatatatagtttctatatatagtttctagaaactatatatagaaactatata

SEQ ID NO: 42948 - DNA, 97 bp, Homo sapiens
tcaccaatgtcactccctcccatcccccagccgcagcggcatgatgcagagagcatttttgtgtggttgtgagagagggagagcacagcaattgtga

SEQ ID NO: 42949 - DNA, 189 bp, Homo sapiens
gtatatatatttgtgtgtatatacatatttgtgtatatatatacatatttgtgtatatatacatatttgtgtgtatatatacatatttgtatatatatacatatttgtgtatatatatacatatttgtgtatatatgtatttgtgtgtgtatgtatgtatatatatatatatatatatatatatataaa

SEQ ID NO: 42950 - DNA, 112 bp, Homo sapiens
agattgtcttggctatacgggctcttttttggttccatatgaaatttaaagtagttttttctaattctgtggagaaagttaatggtagcttgatgggaatagcattgaatct

SEQ ID NO: 42951 - DNA, 58 bp, Homo sapiens; identical to SEQ ID NO: 315

SEQ ID NO: 42952 - DNA, 103 bp, Homo sapiens
cactctgtcatggtggtggtggtaggattccaaaatgtgttgagtggaatgttcacatccgagaattaacactgggactcatgggcaagaaggcagacaggtg

SEQ ID NO: 42953 - DNA, 112 bp, Homo sapiens
catatctatctatctatctatctatctatctatctatctatagatatatctatctatagatatatctatctatctatagatagacagatatgtatgatatatatgacagata

SEQ ID NO: 42954 - DNA, 75 bp, Homo sapiens
ttgtttttttttgagatggagtctcacactgtcaccctgggtggggagcagtggctcgatctcagctccctgcaa

SEQ ID NO: 42955 - DNA, 107 bp, Homo sapiens
ggtgttttgtcaactgtgtttaatgtgaaagagattatctttgtatttttacatgcttcttgatgatttgtaaggcttcacttagaacacatgtggattaagtagcc

SEQ ID NO: 42956 - DNA, 102 bp, Homo sapiens
gcaaatagtgtaaaccaggggtcagaatttttttttctgtaaagaaccagggaataagtattttgggttttgcagaccagttgatttctgtcacaattatgc

SEQ ID NO: 42957 - DNA, 84 bp, Homo sapiens
gtgctaaggtacgtttgacgacctgggattacttgaagtactatatttattttagtaagaccagtaaacaaaagtacatagtat

SEQ ID NO: 42958 - DNA, 109 bp, Homo sapiens
cattgcctctgttgtgagtccaccaacctgccactctgttcctctaagcacttaaattcagagaacacagaaaccagtcacttgggcagccccacaaaaagtcggaatg

SEQ ID NO: 42959 - DNA, 104 bp, Homo sapiens
acatgggaattaaacatataaatgtgcgtgtgtgtgcgtgtgtgtgcgcctgtatgtgtgcgtgtgatgcatgtgtgcacacgtacgtgtgtgcctgtgtgtgt

SEQ ID NO: 42960 - DNA, 58 bp, Homo sapiens
tgaggcagggtctctctgtgtcacccaggctggagcacagaggtgcaatcttggctca

SEQ ID NO: 42961 - DNA, 115 bp, Homo sapiens
gtgttgagcacataaatgttagtatctatattatttggccaacagatctttaaaacattttttcattcttaatttttgtgggtacacagtaggtgtatatatttatggggtacat

SEQ ID NO: 42962 - DNA, 82 bp, Homo sapiens
gtgccttttatttctttcttttgccttcttacactggctagatcttctagtactgtgatgaatgagagttgagagtgggcat

SEQ ID NO: 42963 - DNA, 70 bp, Homo sapiens
gtgtctgagtttttagcttcttcagttccaaatctggaatgaaacgaaaagcaaagaaagcccaagatac

SEQ ID NO: 42964 - DNA, 95 bp, Homo sapiens; identical to SEQ ID NO: 68

SEQ ID NO: 42965 - DNA, 93 bp, Homo sapiens; identical to SEQ ID NO: 69

SEQ ID NO: 42966 - DNA, 58 bp, Homo sapiens
ctgtctgtccatctgtctcactctgtcaccaggctggagtgcagtggtgcagtctcag

SEQ ID NO: 42967 - DNA, 73 bp, Homo sapiens
ttgttttttgagaagggggtctcactctgtcactcaggctggagtgcagtggtgtgatctcagctcactgcaa

SEQ ID NO: 42968 - DNA, 60 bp, Homo sapiens
tatatgtatatacatagatgtgtgtgtatatatatatatacacacacggatatatatata

SEQ ID NO: 42969 - DNA, 161 bp, Homo sapiens
gtttggatatataaacatatatgtttatatatgtttggatgtataaacatatatgtttatatatgtttggatgtataaacatatatgtttatatatgtttggatgtataaacatatatgtttatatatgtttatattatatacatttacatataaacatgt

SEQ ID NO: 42970 - DNA, 76 bp, Homo sapiens
aaacacacacacacacacacatatataaaacacagaattcatatacatatgtatgtgtacgtgtatatgtgtgttt

SEQ ID NO: 42971 - DNA, 86 bp, Homo sapiens
ggatagatggatagacaagtaaaacagaattgagagtctagaaataaacccttatactactgatttatttatttatttatttattt

SEQ ID NO: 42972 - DNA, 86 bp, Homo sapiens
ggtggtgggtgtgacaggtcagattcaagtgagtgtccagaaaccttggcagctctctttttgatgagtcaccctttgttaacacc

SEQ ID NO: 42973 - DNA, 138 bp, Homo sapiens
tatatgtgtgtgcatatatattaatatatgtgtgtatatgtagataatgtatatgatacatatgtgcatatatttatatatgtgtatatgcatacatatttacatgtatatgtatcatatacatatgtatacatgtat

SEQ ID NO: 42974 - DNA, 107 bp, Homo sapiens
tatatgtgtgtgtacatatatgtgcatatgtatatatgtgtgtatatattaatatgcatgtgtgaatatagatacatatacatatgtatatgatacatacacatgta

SEQ ID NO: 42975 - DNA, 100 bp, Homo sapiens
gctccagctgtcttatctgtgttttactgtctctctttctggctgcttgctgttagaagagaagtgatttccttgaaattcatgaggctaaaaatggagc

SEQ ID NO: 42976 - DNA, 109 bp, Homo sapiens
tatctgtaggtatcatatacatacatatgcgtaagtatgtgtaaacatatacatatatatgtatatatacacacatgcctgcatatatatgtgtgtagataggtagata

SEQ ID NO: 42977 - DNA, 74 bp, Homo sapiens
acatatatatgcaggcatgtgtgtatatatacatatatatgtatatgtttacacatacttacgcatatgtatgt

SEQ ID NO: 42978 - DNA, 88 bp, Homo sapiens
ggcatgttgtggggtcacttgtctgtgtcctgaggagccacgtaagtctggaaaacactggcatgctctgggcaggaactggccttcc

SEQ ID NO: 42979 - DNA, 94 bp, Homo sapiens
cctgtacttcctccatatgcacccccacgtactctccctcactctcagcctcgagaaaggtgagcgatactggtctgtcatgaaggttacctgg

SEQ ID NO: 42980 - DNA, 81 bp, Homo sapiens
gtgcccatcagaaccactccaggccctcccagcatttcccataaactgacagggttagtgtgtgattctctgtgtctgcac

SEQ ID NO: 42981 - DNA, 98 bp, Homo sapiens
tgcgatgttcattgtgtatctttttgggtattggtgtctggctctgtgactccatacagaaccctcaatgcatggtgaggaaatgcatgaacgaagca

SEQ ID NO: 42982 - DNA, 83 bp, Homo sapiens
tgtgagaaattatgtttgtggcataagtcatcagtttatgatgttttgttacagcagcatgaatggactcacacaggaacata

SEQ ID NO: 42983 - DNA, 76 bp, Homo sapiens
gtgcaattgttggctggtagttgcaattttagtttttttttaaaaactgtcaaactgctttccagagtggctgtac

SEQ ID NO: 42984 - DNA, 77 bp, Homo sapiens
tgggatgggtggaagcagatgtggggaagggctggtcctggctgaggcactcactcactgtgtctgcttcagtctca

SEQ ID NO: 42985 - DNA, 100 bp, Homo sapiens; identical to SEQ ID NO: 42845

SEQ ID NO: 42986 - DNA, 63 bp, Homo sapiens
ccatgtgctctctgtgcctcagtttccttgcttgtgagatgagaggctgcagaggctgtttgg

SEQ ID NO: 42987 - DNA, 108 bp, Homo sapiens; identical to SEQ ID NO: 42883

SEQ ID NO: 42988 - DNA, 85 bp, Homo sapiens
gcatctgcctttctggctttttactttatctttttattattgtttttagtttaatgagattatggttagagagaaagatggatgc

SEQ ID NO: 42989 - DNA, 106 bp, Homo sapiens
tacatagtataagtatatgtgtaaatatatgtatatgtgtacatatatgtatgtaatatgtgtatgtaaatattatgtaaatatgtatgtatgtaagtatatatgt

SEQ ID NO: 42990 - DNA, 134 bp, Homo sapiens
gtacccatgattatacatagtataattatacatagtatatgtatatgtgtaaatatatgtatatgtgtacatatatgtatgtaatatgtgtatgtaaatattatgtaaatatgtatgtatgtaagtatatatgt

SEQ ID NO: 42991 - DNA, 85 bp, Homo sapiens; identical to SEQ ID NO: 42988

SEQ ID NO: 42992 - DNA, 108 bp, Homo sapiens; identical to SEQ ID NO: 42883

SEQ ID NO: 42993 - DNA, 100 bp, Homo sapiens; identical to SEQ ID NO: 42845

SEQ ID NO: 42994 - DNA, 109 bp, Homo sapiens; identical to SEQ ID NO: 42844

SEQ ID NO: 42995 - DNA, 58 bp, Homo sapiens; identical to SEQ ID NO: 454

SEQ ID NO: 42996 - DNA, 67 bp, Homo sapiens
ggaaagagatctgtgccaggagacggcgagtcttgtcatctcaatgagtctcagtgtctcagtgtcc

SEQ ID NO: 42997 - DNA, 108 bp, Homo sapiens
tatatatgtatatgtatatatgtatgtgtatatgtatatatacatatatacgtatatatgtatgtatacgtatatacgtatatatgtatatatatgcatatatatata

SEQ ID NO: 42998 - DNA, 74 bp, Homo sapiens
tatatgcatatatatacatatatacgtatatacgtatacatacatatatacgtatatatgtatatatacatata

SEQ ID NO: 42999 - DNA, 85 bp, Homo sapiens
gtggggaaaagattgagaggttggatggttgccgtgtctgtgtagagggaggtagacatgggagacttctcattttgttctgtac

SEQ ID NO: 43000 - DNA, 72 bp, Homo sapiens
ccatggtgggagtgtggaccgagcggagaagaggggcatggactgaccgcagggacactctgacactcacgg

SEQ ID NO: 43001 - DNA, 77 bp, Homo sapiens
tctcccagagtataatttttttttctgttatcttaacttgacccttgacagaatgaaagtttttaattttgaggagg

SEQ ID NO: 43002 - DNA, 127 bp, Homo sapiens
cctcatcacccacctgtgctgggtgtccccaagaccaccacaggctgggtggtttggaggactgacaggactcagtgagctcacagctgagatttatttcagcagatggctccagagcagaatcagc

SEQ ID NO: 43003 - DNA, 93 bp, Homo sapiens
acacctttcccaggggccatttacgttgaaatctgaagaagcccaaggctccctggctccctcattccattagtgagtgctctgcggacgtgt

SEQ ID NO: 43004 - DNA, 105 bp, Homo sapiens
ttgtggcctgctttgaacaatggaatgcggcggtagtgacactgtctgagtcctggagccccggcctcggaggctgacacctctacttctgtcctctggccacgg

SEQ ID NO: 43005 - DNA, 58 bp, Homo sapiens; identical to SEQ ID NO: 2595

SEQ ID NO: 43006 - DNA, 96 bp, Homo sapiens
gcattgatgtgttctcttatctcttatgaaatgtataaatgtatgtgtattatatatatatttatttatttattttagacggagtctcactcttgc

SEQ ID NO: 43007 - DNA, 112 bp, Homo sapiens
acatcagtcactccggcagggactgtacagctctccttcatctcgctctgtgtgtctgtaagcgcagaatgatgaaaagaaggagctgcagcagggctccggatggccttgt

SEQ ID NO: 43008 - DNA, 82 bp, Homo sapiens
tttgagagatactgtgctactgaatctgtgaatttatatttttcattcgttctggaaattttgtagctaatatctcttcaga

SEQ ID NO: 43009 - DNA, 81 bp, Homo sapiens
tgtatatatatacacacacacacacatattgtatatatatacatatatatgtgtgtatatatatgtgtatatatatatgca

SEQ ID NO: 43010 - DNA, 80 bp, Homo sapiens
tcccatagttgtgctgtccagctggttccggagcactgatgtgtggctggtgctgattgcgatgtgctgctgtatgtgga

SEQ ID NO: 43011 - DNA, 91 bp, Homo sapiens
cttagttcatattctgtatttatatatgataatacgtgcttttaaaaggcttttttccatatcatagtcaatagatactttgtgacttaag

SEQ ID NO: 43012 - DNA, 110 bp, Homo sapiens
caccagatgccaaaacatgatagagagagcgagggggttggagagagaggcagagaaaaacagagagagaagagactgaccgcttatctgtatggagtggctctgtggtg

SEQ ID NO: 43013 - DNA, 59 bp, Homo sapiens
atgtgacccactggtgtggtgttaggttggacatatgacactctttctgtgggtcacat

SEQ ID NO: 43014 - DNA, 112 bp, Homo sapiens
tgaagtgtatcattgggaaaccagttagtagatgagaggaagtgtctttttttattttttgagagacagtctcgctctgtcacccaggctggagagcagtggtatgatctca

SEQ ID NO: 43015 - DNA, 114 bp, Homo sapiens
gattttttgatattgatcttgtatcctgaaacttggctgaactcatttattagttctaatattaatttttttcttagaccccttaggattttgtaaagacaggattagataatc

SEQ ID NO: 43016 - DNA, 96 bp, Homo sapiens
tgtatatatgatatatatgtgtatatatgtatatatgtgtatatacagtatatatatgtgtgtgtgtatatatatatgtatatatataattgttat

SEQ ID NO: 43017 - DNA, 58 bp, Homo sapiens
tgagccagagtctcgctctgtctcccaggccggagtgcagtggtgcgatcttggctca

SEQ ID NO: 43018 - DNA, 92 bp, Homo sapiens
gtggggtttcggggcgggacgaagattggctggaaggaaggggctttgttgagtccctcggtcactcactgtcgccctacctgctgcttcat

SEQ ID NO: 43019 - DNA, 90 bp, Homo sapiens
gtcacttagagggaacgttcaaacagaatcacactcaccgtctctctcagaggcattagcagagtggatgctgtcagaaagatcagggac

SEQ ID NO: 43020 - DNA, 58 bp, Homo sapiens; identical to SEQ ID NO: 2224

SEQ ID NO: 43021 - DNA, 56 bp, Homo sapiens; identical to SEQ ID NO: 335

SEQ ID NO: 43022 - DNA, 110 bp, Homo sapiens
ttgagtaagtttcactgactgcatatctagtctctggaaagtcagcactcccacagttgtctatttcttctatagtacttcatttgcattcaatttgaatttcacttcaa

SEQ ID NO: 43023 - DNA, 103 bp, Homo sapiens
tttctctctacaaaatttataaggctgatgtagtagattgttaagaggaaggtttcttacatttgtaactctccctttgtatatttcgaatgtttgagagggg

SEQ ID NO: 43024 - DNA, 67 bp, Homo sapiens; identical to SEQ ID NO: 42996

SEQ ID NO: 43025 - DNA, 90 bp, Homo sapiens
gagcactgcgggtggctgacaatgggccctctttgctgatggggacactgagacactgagactcattgagatgacaagactcgccgtctc

SEQ ID NO: 43026 - DNA, 61 bp, Homo sapiens
gttgagacagagtctcactcactctgtcgcccaggctggagtgcagtggcgcgatctcggc

SEQ ID NO: 43027 - DNA, 67 bp, Homo sapiens; identical to SEQ ID NO: 42996

SEQ ID NO: 43028 - DNA, 100 bp, Homo sapiens
gagtaggagggaaggggagctaggctggaggaggaaggtggggtgagacgacctcacacactcaccctcacactctcagtagttctgggatgttctgctt

SEQ ID NO: 43029 - DNA, 65 bp, Homo sapiens
gtgtgcatgtgtgtgtgtgtttatatatgttcacagaatgtatatatgtgtatatatatgtatat

SEQ ID NO: 43030 - DNA, 88 bp, Homo sapiens
tccatatgaatattagaacagtttttctaattctgtgaaaaattgcactggtaatttgatagaaataatgctgaatctatagtatgga

SEQ ID NO: 43031 - DNA, 115 bp, Homo sapiens
gtgtcttttgaatgagtgttggattgtgtcatatttttctgaggatatctatatgattatatgatttttctttagcctattgatataattattatattaattgattttcagatat

SEQ ID NO: 43032 - DNA, 202 bp, Homo sapiens
tgtatatatgtgtgtatatatgcatcatatatatgtatatacatgcatcatatatatgtatatacatacatcatatatatgtgtatatatacatcatatatatgtatatatacacattgtatatatgtgtgtatatatacatcatatatatatgtatatatacacatcatatatatgtgtatatagacaatagtttcttgat

SEQ ID NO: 43033 - DNA, 141 bp, Homo sapiens
tgtctatatacacatatatatgatgtgtatatatacatatatatatgatgtatatatacacacatatatacaatgtgtatatatacatatatatgatgtatatatacacatatatatgatgtatgtatatacatatatatg

SEQ ID NO: 43034 - DNA, 58 bp, Homo sapiens
tgagacagagtctcactgtgtcgcccaggctggagtgcgatggcgggatctcggctca

SEQ ID NO: 43035 - DNA, 61 bp, Homo sapiens; identical to SEQ ID NO: 43026

SEQ ID NO: 43036 - DNA, 114 bp, Homo sapiens
tggaagggctttgaggcagagggaaagagatctgtgccaggagaccgcaagtcttgtcatctcagtgagtctcagtgtctcagtgtccccatcagcaaagagggcccgttgtca

SEQ ID NO: 43037 - DNA, 77 bp, Homo sapiens
gccactgttgtatgattctatttatatgaaatgcccaggataggcaaatctacagagatagaagttagatcagaggt

SEQ ID NO: 43038 - DNA, 103 bp, Homo sapiens
atcttttatgtttaaaaatgtgcatatactgcctgttcaagtacttaatctttgtatttattatttgaaattggaagtccatctttttagattgttaggaggt

SEQ ID NO: 43039 - DNA, 77 bp, Homo sapiens; identical to SEQ ID NO: 43037

SEQ ID NO: 43040 - DNA, 67 bp, Homo sapiens; identical to SEQ ID NO: 42996

SEQ ID NO: 43041 - DNA, 61 bp, Homo sapiens; identical to SEQ ID NO: 43026

SEQ ID NO: 43042 - DNA, 67 bp, Homo sapiens; identical to SEQ ID NO: 42996

SEQ ID NO: 43043 - DNA, 115 bp, Homo sapiens
acgaggagacactcagaaatgtcctcttctgcttcagggtcaggtagaagaatcttttcaatttcacctcctgaaccccaagtagctctaagtctcattcttctgaaacccttgt

SEQ ID NO: 43044 - DNA, 60 bp, Homo sapiens
gtgatcactcggtctgtctctcaggaaggtgcaggagagatgctcaggccaggtgttcat

SEQ ID NO: 43045 - DNA, 104 bp, Homo sapiens
gtaagaggatgtaaatggttttgtatgaagtcaggctggatgagaactaatacttgtaaatatgttttttagactaaacttctgactgccacttgttttcttat

SEQ ID NO: 43046 - DNA, 62 bp, Homo sapiens
tatatatatatatatacatatacatatacatatatgtgtgtttctgtgtatgtgtatctatg

SEQ ID NO: 43047 - DNA, 104 bp, Homo sapiens
gataaaagatagcatataccattgtgcactttatttgttttttgacctggggtggggtctcactctgtcactgaggctggagtacagtggggtgatcttggctc

SEQ ID NO: 43048 - DNA, 111 bp, Homo sapiens
gccgggcatggtggcagtcgcctgttgtcccagctactcgggaggctgaggtagaagaatctcttgaacccgggaagcagaggttgcagtgagccgagactgtgccactgc

SEQ ID NO: 43049 - DNA, 58 bp, Homo sapiens
tgagacagactctcgctctgttgcacaggctggagtgcagtggcgcgatcttggctca

SEQ ID NO: 43050 - DNA, 58 bp, Homo sapiens; identical to SEQ ID NO: 1763

SEQ ID NO: 43051 - DNA, 116 bp, Homo sapiens
cagagaaggccctgagatggagtgggactctaggatgtgggcttagaatgagcattttactatctatctatctatctatctgtctgtctatctatctatctgtctatttatttttg

SEQ ID NO: 43052 - DNA, 85 bp, Homo sapiens
ggactctcactctgtcactcaggctggagtgcagtggcgcgatctcggctcattgcaacctctgcctccagggttcaagtgatcc

SEQ ID NO: 43053 - DNA, 76 bp, Homo sapiens
ggaggctgaggtggaaggatcacttgaaccctggaggcagaggttgcaatgagccgagatcgcgccactgcactcc

SEQ ID NO: 43054 - DNA, 118 bp, Homo sapiens
gctgggcgtggtggtgggcacctgtaatcctagctactagggaggctgaggttggaggatcacttgaaccggggaggcagctgcagtgagctaagattgcaccactatactccagcct

SEQ ID NO: 43055 - DNA, 80 bp, Homo sapiens
tggatgcggtgtcactctgtcactcaggaccataacggttttatctgcatgaggagtcagccaagacactttttcatcca

SEQ ID NO: 43056 - DNA, 107 bp, Homo sapiens
ctggccatgtgacttgtgggcttccctttgtcatccttcgcctagggctctgagcagggcagggacagcaaaggggtgctcagttgtcacttcccacagcacggagc

SEQ ID NO: 43057 - DNA, 131 bp, Homo sapiens
gttagccatggtgttgggatttgaaagtcctccattaggtcccagcaaagggcagaacgttacactcagactctcagggatgccagcacagtgacacactggggcttcttacgtgcagttagtggagttgc

SEQ ID NO: 43058 - DNA, 93 bp, Homo sapiens
tctgcaggttgcccaggactgcggggaggggaggaggagacctggtgcccaccctggctgcctggctcccagcatgcctagggaaccatcaga

SEQ ID NO: 43059 - DNA, 84 bp, Homo sapiens
caattatagtcagagaacacactttgcattatttcaatttttaaaaatttgttgttctgatgcagtggttcatgcctgtcattg

SEQ ID NO: 43060 - DNA, 107 bp, Homo sapiens
gagacaagagagggcaagcaaggaggaagccacagtgcctttcaggacctggtctccagagtcacactcagtcacttctaccatgttctttttttttaagttgtttt

SEQ ID NO: 43061 - DNA, 66 bp, Homo sapiens
cttgaggctgggagggagaggacagaaaaataaccagggtattcctctcactctctgactctcagg

SEQ ID NO: 43062 - DNA, 58 bp, Homo sapiens
tgagactgagtctcactctgtcacccaggctggagttcagtggtgtgatctcagctca

SEQ ID NO: 43063 - DNA, 115 bp, Homo sapiens
tttctgtctttttctggggtaagggttagtgcatttttggttgtaggcagaatagttgtatcatgctaggtggaagtatgaccttgttatttaatgcctctgtttggagatgaag

SEQ ID NO: 43064 - DNA, 118 bp, Homo sapiens
atatatatatgtatgtatatctatatgtaacatacatatatatgtatatctatatgtaacatacatatgtatatctatatgtaacatacatatgtatatctatatgtaacatacatat

SEQ ID NO: 43065 - DNA, 305 bp, Homo sapiens
gtatatctatatgtaacatatatgtatatctatatgtaacatatatgtatatctatatgtaacatatatgtatatctatatgtaacatatatgtatatctatatgtaacatatatgtatatctatatgtaacatatgtatatctatatgtaacatatgtatatctatatgtaacatacatgtatatctatatgtaacatacatgtatatctatatgtaacatacatatatatgtatatctatatgtaacatacatatgtatatctatatgtaacatacatatgtatatctatatgtaacatacat

SEQ ID NO: 43066 - DNA, 180 bp, Homo sapiens
atgtatatctatatgtaacacacatacatatgtatatctatatgtaacacacatatatatgtatatctatatgtaacacacatatatatgtatatctatatgtaacacacatatatatgtatatctatatgtaacacatatatatgtatatctatatgtaacacacacatatatgtatat

SEQ ID NO: 43067 - DNA, 97 bp, Homo sapiens
gtatatctatatgtaacacacatatatatgtatatctatatgtaacacacatatatatgtatatctatatgtaacatacatatatatgtatatatat

SEQ ID NO: 43068 - DNA, 116 bp, Homo sapiens
ggtttccttgtagaatgtttatagtttcaggtcttacatttaggtctttaatccattttgagttaatttttatatatggtgagaagtgtgggtccaatctcattcttctgcatatc

SEQ ID NO: 43069 - DNA, 87 bp, Homo sapiens
gcctagaggcaggcatgcatttggactgaattctacttttttttttttttttttttttgagacaaggcctcgctctgtctcccaggc

SEQ ID NO: 43070 - DNA, 88 bp, Homo sapiens
ggggggctattgtatgtatgtgcatgtgtgtatgtatatatgtatatatgcacatgtatacacatgcacacacatacaatagctcccc

SEQ ID NO: 43071 - DNA, 74 bp, Homo sapiens
agtggcacatgaatgtgcagtatgcacacatatccatacatgtttgtgtgtgagtgtgcatgtacatgtatatt

SEQ ID NO: 43072 - DNA, 118 bp, Homo sapiens
tctcttgcttgcatctgcctccatctggagcccagtcccctgtcatttcttgtatcttatttaatagtttcagtaggaaatgatgcttgaagtatggtttattatgtgagcaggggac

SEQ ID NO: 43073 - DNA, 60 bp, Homo sapiens; identical to SEQ ID NO: 43044

SEQ ID NO: 43074 - DNA, 77 bp, Homo sapiens
taagggaggatctgccaggactgtgccatgaaggcacagtggcacacagtctgtggcacagtctcatcagcccttgc

SEQ ID NO: 43075 - DNA, 74 bp, Homo sapiens
gtttgccttgctgcctgcctggctgccagtctgttaacagacctaggccgccactgggtggaaaacaagcaaac

SEQ ID NO: 43076 - DNA, 62 bp, Homo sapiens
agcacctgcaggcagtgaggccgctcctgtaagccatgagcctgcctcactgaatgtgtgtt

SEQ ID NO: 43077 - DNA, 76 bp, Homo sapiens
cctctcgattttacagagaagcttaatcccggttagtctcattctctcactggggattctctgtttccttgagggg

SEQ ID NO: 43078 - DNA, 121 bp, Homo sapiens
gccccctcttcccccatttgtccagggtcaactccagccaggctgtcacactgtttgtgtctgctccacagctgtctctcttggagtgggtgaccctgtattgcctggatgggggtgatgg

SEQ ID NO: 43079 - DNA, 69 bp, Homo sapiens
ttttgtatatgtgtgtatatacatatttttcatatgtatatataaaatatgtatattatatatacaaaa

SEQ ID NO: 43080 - DNA, 95 bp, Homo sapiens; identical to SEQ ID NO: 68

SEQ ID NO: 43081 - DNA, 93 bp, Homo sapiens; identical to SEQ ID NO: 69

SEQ ID NO: 43082 - DNA, 58 bp, Homo sapiens
tgagactgagtctggctctgtctcccaggctagagtacagtggcgggatctcggctca

SEQ ID NO: 43083 - DNA, 111 bp, Homo sapiens
ctgtgttttaagggtacccagggttggttttaatcaggcatggtgagacacttagacacagaagtgactgtcctgaaggaaagcagttttactcactgttcttagaagcag

SEQ ID NO: 43084 - DNA, 58 bp, Homo sapiens; identical to SEQ ID NO: 43034

SEQ ID NO: 43085 - DNA, 202 bp, Homo sapiens; identical to SEQ ID NO: 43032

SEQ ID NO: 43086 - DNA, 141 bp, Homo sapiens; identical to SEQ ID NO: 43033

SEQ ID NO: 43087 - DNA, 115 bp, Homo sapiens; identical to SEQ ID NO: 43031

SEQ ID NO: 43088 - DNA, 65 bp, Homo sapiens; identical to SEQ ID NO: 43029

SEQ ID NO: 43089 - DNA, 96 bp, Homo sapiens
gtcaagcagtctctctgtttcccatgaagtttctaatgcagaatggtcctaatgatcagagagagagagagagagagacagagagatagtgctgat

SEQ ID NO: 43090 - DNA, 100 bp, Homo sapiens; identical to SEQ ID NO: 43028

SEQ ID NO: 43091 - DNA, 67 bp, Homo sapiens; identical to SEQ ID NO: 42996

SEQ ID NO: 43092 - DNA, 58 bp, Homo sapiens
tgagattgagtctcgctctgtcacccacgctggagtgcagtggcgtgatctcggctca

SEQ ID NO: 43093 - DNA, 61 bp, Homo sapiens; identical to SEQ ID NO: 43026

SEQ ID NO: 43094 - DNA, 67 bp, Homo sapiens; identical to SEQ ID NO: 42996

SEQ ID NO: 43095 - DNA, 77 bp, Homo sapiens; identical to SEQ ID NO: 43037

SEQ ID NO: 43096 - DNA, 103 bp, Homo sapiens; identical to SEQ ID NO: 43038

SEQ ID NO: 43097 - DNA, 77 bp, Homo sapiens; identical to SEQ ID NO: 43037

SEQ ID NO: 43098 - DNA, 67 bp, Homo sapiens; identical to SEQ ID NO: 42996

SEQ ID NO: 43099 - DNA, 123 bp, Homo sapiens
ggcggctgaggcgggttggcggctgcaacgagctgggcgtctttcgttctctctcgctgcctggctggctccgctggcccctccacagcttgcggagcaaggccatagcaggggagtgggagg

SEQ ID NO: 43100 - DNA, 109 bp, Homo sapiens
gcgctcctggtgcagtaacttgctatctgatcttaaagatgtcactttgtctctcagtaaatcactccatttaagcaaagataccaatacttcgtctccccaggtacgc

SEQ ID NO: 43101 - DNA, 89 bp, Homo sapiens
gctggaggccaggagaggacagagcctgcagtcaggtcactcgtaaccccacggctgctgctgtttgtgtttacttgagcattcactgc

SEQ ID NO: 43102 - DNA, 105 bp, Homo sapiens
ggtgctgaactggacaacttaaaaggaaatctgaaggtcccttatcaagcaagatctatgagctagtaccttggtttgtttcctatggctgccttcttcaacatc

SEQ ID NO: 43103 - DNA, 142 bp, Homo sapiens
atatatatatatatatatatatatatgtgtatatatatatatatgtgtatatatatatatatgtgtatatatatatgtgtatgtgtatatatatgtgtgtgtatatatatgtgtgtatatatatatatatatatatatatgc

SEQ ID NO: 43104 - DNA, 117 bp, Homo sapiens
atctggtcatgacttctttgcagatgaagacactcaagatctgccaactttcattttatttttagaaggcagatagatgagggtattacacattgagcaatatcttagcgctcagat

SEQ ID NO: 43105 - DNA, 79 bp, Homo sapiens
ctggcacttgtttaagcatgtatgtatgtatgtatgtatgtatgtatgtatgtatgtatatcttctcaaactaggcagg

SEQ ID NO: 43106 - DNA, 97 bp, Homo sapiens
tcactcgtaaacttggggtaacttttttcataattctgtaaaaggggaatgctaattttaatcacagggaggtttgaagagccaggggtcagagtga

SEQ ID NO: 43107 - DNA, 72 bp, Homo sapiens
gggctgcagacagtgaagagtgagaagaaagcaactgatccgaaggccactcccactctcctggagcagctc

SEQ ID NO: 43108 - DNA, 113 bp, Homo sapiens
tgcatactgactgtttgtgaacactcctatgttaacataaagttctggtttttatggcccagttgtttttttttttttgttgccttttggattttacagattttagttaagca

SEQ ID NO: 43109 - DNA, 92 bp, Homo sapiens
gggcaacagggcaggaccctatctcaaaataatcatcatcatgatcatcatttattgaacatttattttgtgtcaggctttgtgataagtcc

SEQ ID NO: 43110 - DNA, 67 bp, Homo sapiens
ggtctgggagccagagttgttttgttatatatttagaactataagcaagataaccatggagacctcc

SEQ ID NO: 43111 - DNA, 110 bp, Homo sapiens
agttcaacttaggcaacagagagagaccttgtctcaaaataataatgatgatgatgatgatgatgatgatattgataattgatgcaagtgttgttctcacttgagttact

SEQ ID NO: 43112 - DNA, 121 bp, Homo sapiens
ggagtaaaaggacatgacacaggatgtaggtgaggggtggccagattatggagggctcagactgactggctcagtggatggactttgttccacagctaacaggatactggagtagattttt

SEQ ID NO: 43113 - DNA, 71 bp, Homo sapiens
gggaagacagtttcccagtctctctctctcagaaagggtcaaagcagctagaggggagggaactgctcacc

SEQ ID NO: 43114 - DNA, 67 bp, Homo sapiens
ctgtctgagctctgaaaacacagagcagaaggataaaagaccctctgtggacttcaaactcaagcag

SEQ ID NO: 43115 - DNA, 81 bp, Homo sapiens
ggttaatacatctagtcttagtgtcaaggaacacttgggtgacactagagagtgttttgacatgattttttgttgtagact

SEQ ID NO: 43116 - DNA, 82 bp, Homo sapiens
gacccagggcacttgggctttgatatactggtgggccttatgtgtctacgatcacctgtgtctgtctgtctgtctgtctgtc

SEQ ID NO: 43117 - DNA, 101 bp, Homo sapiens
tgtgggttcttttttggttccatatgaaatttaaagtagtttttttctagttctgtgaagaaagacaatggtagcttgatgggaataaaattgaatctaca

SEQ ID NO: 43118 - DNA, 58 bp, Homo sapiens; identical to SEQ ID NO: 637

SEQ ID NO: 43119 - DNA, 98 bp, Homo sapiens
catacctctacatttaatccccccagcaactttagcaacagtactcatttttatgtatgagaagatagaggactgggagtttaagtggcagagctgtg

SEQ ID NO: 43120 - DNA, 113 bp, Homo sapiens
gtgtatatatatgtagtatcccatgatgtatgtgtatatatatgtgtgtgtgtatatatgtgtgtatatatatagtgtgtgtatatatatagtagtattccatgtgtgtgtgt

SEQ ID NO: 43121 - DNA, 94 bp, Homo sapiens
cctgaacctgggaggtcaagactgcgtcgtgccaggaaaaaaataataatttttttttttttttgagacagtctcgctctgtcacctaggctgg

SEQ ID NO: 43122 - DNA, 94 bp, Homo sapiens
gaacttttggtgggttttttttttttcgagactgagtctcactctgtcgcccaggctggagtgcaggagcgcgatctcggctcactgcaagttc

SEQ ID NO: 43123 - DNA, 110 bp, Homo sapiens
tgcgagcccaactcagtgtctattagtattgtaagtttactacataataagatttttaaaagtctgttgttttgttgatctgatagtactgtgcacttcattctaatgca

SEQ ID NO: 43124 - DNA, 60 bp, Homo sapiens
cacggtgcctcacacctggaatcccagcactttgggaggctgaggtaggaggatcacttg

SEQ ID NO: 43125 - DNA, 217 bp, Homo sapiens
tatatatatggacatatatatgtgtatatatggacatatatatgtccatatatatggatatatatatggacatatatatgtgtatatatatggatatatatatggacatatatatgtgtatatatatggacatatatatgtgtatatatatggacatatatatgtgtatatatatgtatatatatggatatatatatggacatatatatgtatatgc

SEQ ID NO: 43126 - DNA, 58 bp, Homo sapiens; identical to SEQ ID NO: 18091

SEQ ID NO: 43127 - DNA, 107 bp, Homo sapiens
ctgccacatttacacacacccctggccaaagtaatattttttttttccatgtagaacaaattatgggcagaaagtaaagttagttttagaagtgctgtttgtggttg

SEQ ID NO: 43128 - DNA, 92 bp, Homo sapiens
ggctaaaattgttaggtctaaaagaatactgaagtccttttgttgttcttataaagtaaaaagcactcctctttttttggcctagaaaagcc

SEQ ID NO: 43129 - DNA, 58 bp, Homo sapiens
tgagacagagtctcgctctgtcacccaggctggagtgcagcggcgtgatctcagctca

SEQ ID NO: 43130 - DNA, 102 bp, Homo sapiens
cccaaagtgctgggattacaggcatgagccactgcgtctggcctattttgttttattttgaatgagccattgtggccacactttttgtccctaaacttgagg

SEQ ID NO: 43131 - DNA, 90 bp, Homo sapiens
gagcagtaggtggatttgctctgttgagctggaaggaagaatttttagatttcctctggctgaagaagttaaaatggaaccatctacatc

SEQ ID NO: 43132 - DNA, 118 bp, Homo sapiens
ctcttttgtgggtagaattaggaaaaaataatacatatatgtgtgtgtgtgtatatatatatatacatgtaaatatatatgtgtattgtgcatacatatatatctgtctcgtactgag

SEQ ID NO: 43133 - DNA, 114 bp, Homo sapiens
gtcccacagtccattaggcagtcttcaagtgtccaataggagagtgcatgatattagttgtttatatgcctatttctcccactggctttgagaaacttcagggattgttgtaac

SEQ ID NO: 43134 - DNA, 133 bp, Homo sapiens
cttgggggataagagggagacttctctcaaaaaaaaaaaaattcttttttcttttgagggagtctcactctgtcacccaggctggagtgcagtggcgcgatctcggctcattgcagcctatctctcttgacag

SEQ ID NO: 43135 - DNA, 90 bp, Homo sapiens; identical to SEQ ID NO: 43131

SEQ ID NO: 43136 - DNA, 197 bp, Homo sapiens
acaacaacaatatatacatatatatgtgtatacatatacgtatatatatgtgtgtatatatatacgtatatatgtgtgtatatatatacgtatatatgtgtgtatatatgtgtatatgtgtatatgtgtatatatatgtgtttgtgtatacacacatgtatacacatatacacatatatacatatacatatatgtat

SEQ ID NO: 43137 - DNA, 108 bp, Homo sapiens
gtatacagctgtgatttattcattttaattgctgaatattttatgaatataacaatttattgagctattctattgctgatggatatttgagtgttttcacattggggc

SEQ ID NO: 43138 - DNA, 106 bp, Homo sapiens
ccagattctactcatagttacagatacagaaatcctataaaaaaacaataaattgattctatcaatatataaaaaggatcatatgtaatgtctaagttggatttgg

SEQ ID NO: 43139 - DNA, 58 bp, Homo sapiens; identical to SEQ ID NO: 9124

SEQ ID NO: 43140 - DNA, 96 bp, Homo sapiens
tccactagatttgtgagtgggctgtgagaaagtggagagtgagcacaggctatccttcgccttagatacttccagacctcctgcaggttgggtgga

SEQ ID NO: 43141 - DNA, 96 bp, Homo sapiens
acttgttagtggcctccattttaaaatgtctgttgtatagttcatgataatgaccaagttgtgacaactgatacagaggaggaatccactaagagt

SEQ ID NO: 43142 - DNA, 71 bp, Homo sapiens
ttgtttttgagatggagtctcactctgtcacccaggctggagtgcggtggtgtgatctcggctcactgcaa

SEQ ID NO: 43143 - DNA, 110 bp, Homo sapiens
taagtgtgaggcccagtgtgactacataggaaggcagccctgcatccaatatatatctatatgttttgcaagttctacctctgtgatggtaaattttgtgtgtccacttg

SEQ ID NO: 43144 - DNA, 69 bp, Homo sapiens
cagctatgggaaagtgagcattttttttttttttttttgagatggagtctcactctgtcgcccaggctg

SEQ ID NO: 43145 - DNA, 58 bp, Homo sapiens
tgagacagagtctcgctctgtcactcaggctggagtgcagtggagcgatctctgctca

SEQ ID NO: 43146 - DNA, 71 bp, Homo sapiens
ggcctcacaaagtgctaggattacaggcgtgagccaccgcgcccaacatagtttataatttttaaagggcc

SEQ ID NO: 43147 - DNA, 61 bp, Homo sapiens
ccctaatgctgactgtgttatatgtatgtgttgttacacacacacacacacagttagaggg

SEQ ID NO: 43148 - DNA, 83 bp, Homo sapiens
tgctactcacaggagcttaagaaactatatatatataagaatattctaaacaaaatatggtaactttttgctttgtgatagca

SEQ ID NO: 43149 - DNA, 78 bp, Homo sapiens
tgccatcatatatatatatatatatatatatatatatatatatatatatattatgtgtatgtgtgtactatatgtatg

SEQ ID NO: 43150 - DNA, 104 bp, Homo sapiens
gtacctgatatgtttattgtacctcaatctattattatctcatatctatatctatatctatatatgagagcacagagtttggggcacaaatactcctgaggggc

SEQ ID NO: 43151 - DNA, 104 bp, Homo sapiens
gggattggtttgttcttgttctagttcctcaaggtgtgatgttaggttgttaatttgaatatttctaactttttgatgtgggcgtttagctctataaacttccc

SEQ ID NO: 43152 - DNA, 80 bp, Homo sapiens
cgtcaaaggactagtggttacaacaacagcgggactttttatttttttgaaactggtctcaccgcttctatccagtgagg

SEQ ID NO: 43153 - DNA, 104 bp, Homo sapiens
gcaagaattaattattgaaatcaattattgtgtctttccgacgactgcagtcagtcctcagtgagttgacataaaaaaatacttgtctcaatggttgtctctgt

SEQ ID NO: 43154 - DNA, 101 bp, Homo sapiens
gcagagattgtagcaacatgttcactttctagtcaaattctaggatgtttactttggaaatatggctagaacagatattaatttgtagctaatttcagtgc

SEQ ID NO: 43155 - DNA, 62 bp, Homo sapiens
agaggggactgagagactactcattttggtgaattcaagaaatgtatctagcagtgctttct

SEQ ID NO: 43156 - DNA, 80 bp, Homo sapiens
ggaatagtgtgtatgtgagggagtaggatgtatggttgttagatagacaactacaatcttttctcacaacagacagagcc

SEQ ID NO: 43157 - DNA, 116 bp, Homo sapiens
gtacaccaatactttggtaaaatacattaaaaatagtaaacctatgtcaaagtatatgtttataaacatgtaatctctttcaaaggtactattccaaaccaaaagatattctgtac

SEQ ID NO: 43158 - DNA, 118 bp, Homo sapiens
tcatataagatggcatatattttactgaaactttccttgttaatattaattaatattaattagttaactagctaacaagaggattgttcctagtttgttttgtagacacctactgtgg

SEQ ID NO: 43159 - DNA, 69 bp, Homo sapiens
ggctctctcatggtctctctctctgagcccttgccctgagaaaaacaagataccatgttgtgagtggcc

SEQ ID NO: 43160 - DNA, 85 bp, Homo sapiens
ggggggcagttttttttgagacagagtctcgctctgtcacccaggatggagtacagtggcgcagtctcggctcactgcaacctcc

SEQ ID NO: 43161 - DNA, 115 bp, Homo sapiens
ggcaacaagagcgagactccatctcaaaaaaaaaaaaaaattatgtttgctctcctgcatttcaattttttttttatttttatttattttgagacaaggtctcactctctcaccc

SEQ ID NO: 43162 - DNA, 117 bp, Homo sapiens
cagaattcagtcagttgctgtgagtttggtttgtgtgagtctatcttcttttttttttttttttgagactgagtctcacactgtcacccaggctggagtgcaatggcgccatctctg

SEQ ID NO: 43163 - DNA, 107 bp, Homo sapiens
tgcagaaaaggaatcttaaatatttatttcagcattttatatttttattggttttgtaaaccactgaaattgtagggtgtgcttagagtgagttgattccatatgca

SEQ ID NO: 43164 - DNA, 90 bp, Homo sapiens
gcactgatcctcggcatcagaaagtgacagagaacagtggggactgtggcagtcccgcgaacctaggttatatctgaagggggcagctgt

SEQ ID NO: 43165 - DNA, 117 bp, Homo sapiens
ctcagaatctgcctccaacatcactggcctgtgttttgtgaggggagcatcagtacttggttcaattgtttagaaattatacaacttgcctgtgacctaaggaggtttatgtttagg

SEQ ID NO: 43166 - DNA, 64 bp, Homo sapiens
ctctgtcaccctttctcctgcattctaaatctggcttgagagagaggagagagagaggacagag

SEQ ID NO: 43167 - DNA, 75 bp, Homo sapiens
cttttcctatagaatcaagcattgtttggatctgccattgataacagtgttcagacaaggtgatgctttgaaaag

SEQ ID NO: 43168 - DNA, 95 bp, Homo sapiens
gaaagagcacaggtcttagacacaagacagactgcagtactagggcttggctttgctggtattgctgcttacctgttttgaccctttgttggttc

SEQ ID NO: 43169 - DNA, 153 bp, Homo sapiens
tatatatgtatatacatatatttgtatatatacatatgtatatatgagtgtatacacatatttgtatatatacatatgtatatatgaatatatacatatgtgtgtatatatatacacaaatgtatatatatacacatatatatttgtatatat

SEQ ID NO: 43170 - DNA, 83 bp, Homo sapiens
atatacacatatgtatatattacatagatacatagatatataccatatatctagatatatatactatatacatatgaatatat

SEQ ID NO: 43171 - DNA, 116 bp, Homo sapiens
cagatttttgtatgctggttttgtatcctaaaactttactgaatttgtttatcactttgaacaatttttttttggtagagtctttaggtttctcaaatataagatcctaacatctg

SEQ ID NO: 43172 - DNA, 107 bp, Homo sapiens
caggtctcagagttcatatttcttcatgaactttcaatttatgtattttatgctgtcaaaagcaatagagtcagctatgcttaagtttatggctttgagaaagcctg

SEQ ID NO: 43173 - DNA, 85 bp, Homo sapiens
tgtatgtgtgtgtatatatatgtgtgtgtatatatatgtgtgtgtgtgtgtatatatatatatatacacgcacatatatatacat

SEQ ID NO: 43174 - DNA, 106 bp, Homo sapiens
gctgaatttgtattcccatgagattttatttatctgtttgtttatttttttcctttggcaaaataagcaattgtagacacctctcatatgggaaaacaaagtaagt

SEQ ID NO: 43175 - DNA, 69 bp, Homo sapiens
gaccagtcttatgccagtcttcactagttttcataaaaaagagtgatgagtgtcagcattgttttggtt

SEQ ID NO: 43176 - DNA, 95 bp, Homo sapiens; identical to SEQ ID NO: 580

SEQ ID NO: 43177 - DNA, 93 bp, Homo sapiens; identical to SEQ ID NO: 69

SEQ ID NO: 43178 - DNA, 113 bp, Homo sapiens
tgatattgatttccatttttattgcattgtggtccaagcataagctttgtatgatttcaatatttttgaatttattgagacttgctttatgaccaagcaagtggtcaacctta

SEQ ID NO: 43179 - DNA, 58 bp, Homo sapiens
tgagacagagtctcacactgtcatccagacaggagtgcagtggtgcgatcttggctca

SEQ ID NO: 43180 - DNA, 84 bp, Homo sapiens
tattaagatgtactttatataaatgacatactatgtatattcatgtatactagtatgtacatttgtacacattacagaaaaata

SEQ ID NO: 43181 - DNA, 84 bp, Homo sapiens
tgtgtgtgtgtagtgtgtgtgtatatatatgtgtgtgtgcgtgtgtatatatatatatatatatatattttatatatatatata

SEQ ID NO: 43182 - DNA, 114 bp, Homo sapiens
taaaagcagtgcagaaacataatgagttcacttattttggagcatttaataacagttatagacagttatgtgatcaggcggagttatgacttattcattctttcattgctatta

SEQ ID NO: 43183 - DNA, 90 bp, Homo sapiens
catttgttaatccttcaggggaagtgtgcatgattttattatattttgttcatgattatatgtatattcaaaccataggggaaatgaatg

SEQ ID NO: 43184 - DNA, 96 bp, Homo sapiens
gaccctttttctgatggtcggttcccttggtaaagtctgagaagacagtcagaattcaacaacatttattagtgtctactggctctcaggaaagtc

SEQ ID NO: 43185 - DNA, 115 bp, Homo sapiens
tcactgaataataaatagtccattgtctggatgtaccatagtttatttatacatttacctactgaacgccatcttggttgcttccaagctttgactgttaagaataatgctgtga

SEQ ID NO: 43186 - DNA, 83 bp, Homo sapiens
ttggtatttcaggaagttgctggaataaaaaataaattcatttttaacttttatttttatgagcaaatttcctggaatagtaa

SEQ ID NO: 43187 - DNA, 94 bp, Homo sapiens
gggattacaggcgtgagccaccgcacccagccagatacattgtatatattttaaaaacccatgcctgggcatggtgattcacacctctaatctc

SEQ ID NO: 43188 - DNA, 114 bp, Homo sapiens
gctttgttctttttgcctggaattgtcttggctataagggctcttttttggttccatatgaaatttaaagtagtttttttccaattctgtgaatggtatcttgatgagaatagc

SEQ ID NO: 43189 - DNA, 95 bp, Homo sapiens; identical to SEQ ID NO: 68

SEQ ID NO: 43190 - DNA, 93 bp, Homo sapiens; identical to SEQ ID NO: 69

SEQ ID NO: 43191 - DNA, 112 bp, Homo sapiens
gggtccatctccaggaaacaagagtcttaaaggatgtattaagcaaaaaatgtaaagaagtaagtaggtagactttgatattgttgactcttttgtctcttgttcctttccc

SEQ ID NO: 43192 - DNA, 99 bp, Homo sapiens
gggctcatcactgcattggagttctcatctctttgactcttaaaatagatgaatatttttttccatttatctttaaagacatgtgaacttgatgagatc

SEQ ID NO: 43193 - DNA, 92 bp, Homo sapiens
gtcacagccacagatgcagaaggggcaggtgaatgtcaggagaatattaaatgatgacactctttctcactcactgggtctaaggctcaaac

SEQ ID NO: 43194 - DNA, 69 bp, Homo sapiens
acagatagcaagtggccagaaaaagtagagtctttttttttttttttctgaggtcgggtctctgtctgt

SEQ ID NO: 43195 - DNA, 102 bp, Homo sapiens
ttagctgtggagccacagccactgataagaaggtgtaaaaaagtagtttgatgaagaaagggctcactcactctgtttgtgctgtggatttcatttggttgg

SEQ ID NO: 43196 - DNA, 75 bp, Homo sapiens
ccaccctgaccctctttctgtctctcttattatggctagtgtgggctcttcacagactggtggccacagggtagg

SEQ ID NO: 43197 - DNA, 111 bp, Homo sapiens
gggcctgtaagaggtgatgaggtcctgagggctctgcctttgtgaatagactcatgctgtcatcacagaagtgagtgagcgatcttgggagtctggcccccttttcctccc

SEQ ID NO: 43198 - DNA, 92 bp, Homo sapiens
atgtgccctttcactcacagatttcacagatgtcaagagtttccaggggctctggtctgtctgtgtctgcccttagagagaagcgtggccat

SEQ ID NO: 43199 - DNA, 91 bp, Homo sapiens
tcgttgaagaggtccttcacatcccttgtaagttatattcctaggtattttattctttttgtagcaattgtgaatgggagttctttcatga

SEQ ID NO: 43200 - DNA, 108 bp, Homo sapiens
ggacatagttgaaacatgacttagattgaagttgttttttatatacattttttaaatggaaagaagacttcaaaattccctaagcatcatgcatttttaatcttgcac

SEQ ID NO: 43201 - DNA, 80 bp, Homo sapiens
tactttctggaagaagccaactcagacagaccacagtgtgtgcacagcatacgtggctgctggctgtggatgagaaagta

SEQ ID NO: 43202 - DNA, 71 bp, Homo sapiens
agctcagtgtgactctgtgtgcctgtagtcccagctactggggaggctaaggtggaaggatcacttgagct

SEQ ID NO: 43203 - DNA, 86 bp, Homo sapiens
agtggactgaagctgagtaatgatacagcatctgcttttgtatttgccacagtctcaatgctctgcacttttatccccagcctact

SEQ ID NO: 43204 - DNA, 79 bp, Homo sapiens
gggcttctgctgtactatgtatttatttctgttatcaatatttatttgattgcataagtgatatggcttggctttgtcc

SEQ ID NO: 43205 - DNA, 110 bp, Homo sapiens
gtctcagattatcagttatcaattacatagcaggaaatataaggaagaaatttttttaaatttttatttttagttccagggcatatgtgcaggatgtgcaggtttgttac

SEQ ID NO: 43206 - DNA, 115 bp, Homo sapiens
agtgtagaagtattcactgccacatccatgccaacatctactgtttttgattttttttattaaggccattcttgcaggagtaagttggtattgcactgtggttttgatttgcatt

SEQ ID NO: 43207 - DNA, 111 bp, Homo sapiens
agatagtatctcactgtggtttcgatttgcatttctctaatgattagtgatattgatgtttattaaataggcttattggctggattgtatatcttcttttgagaagtgtct

SEQ ID NO: 43208 - DNA, 84 bp, Homo sapiens
ggcaaccagaagggcatggtgaccagagctcggaccccttaggagtgagtgtctgagtctctccattacataagctactgggcc

SEQ ID NO: 43209 - DNA, 81 bp, Homo sapiens
ggatatgtatatatgtatgtatgtatgtgtatgtgaatatatgtgcgtatgtacatacacacacatatatgatatatatcc

SEQ ID NO: 43210 - DNA, 57 bp, Homo sapiens
tatgtacatttttatatatatatggatatatatcatatatgtgtgtgtatgtacata

SEQ ID NO: 43211 - DNA, 64 bp, Homo sapiens
acaccttccatgtatatgtatacgtatacgtatatgtatatgtatatgtatgtgtatagtgtgt

SEQ ID NO: 43212 - DNA, 91 bp, Homo sapiens
cacccataaaccaaggttaataatacttacttcatgagcttattgacaggattcaatgaaatcatgtaagtacaagccttagtctggggtg

SEQ ID NO: 43213 - DNA, 76 bp, Homo sapiens
catgcacacgcacacacacacactcacacagtttactattaccattagggactgtggtgcatgtggctgtgtgctg

SEQ ID NO: 43214 - DNA, 76 bp, Homo sapiens
ccctgtccttgtgctgtcagcctgactctctgagccacagctccaagaacagccctggggttatagaggtgcaggg

SEQ ID NO: 43215 - DNA, 113 bp, Homo sapiens
cttcaaatgattatagacactggcctgtgctgtctcacctttctttttatatatgaaaatgaacagtacaaagcacagacccaggtcttaaaataaataagctcattcaaaag

SEQ ID NO: 43216 - DNA, 78 bp, Homo sapiens
cagtgctctctcactggctggattggcatggatgcctatttttgatagtatttctaatccttaccactgaaagcattg

SEQ ID NO: 43217 - DNA, 74 bp, Homo sapiens
ctgacagcaaagggcagagagtagactcagatctcacaccacactgggtccctcttctctctctgttatatcag

SEQ ID NO: 43218 - DNA, 101 bp, Homo sapiens
gacatcaagtagagaagtagactatgctctggggaaggcttttttttttttttttttttcaaaaaaacactctggaggaagaaacagttctactctgtgtt

SEQ ID NO: 43219 - DNA, 105 bp, Homo sapiens
gctggtgtgatggcatgcacctgtagtcccagcttctggggacggtgaggttggaggatcacttgggcccaggaggtaaaggctgcagcaagccatgattgcacc

SEQ ID NO: 43220 - DNA, 132 bp, Homo sapiens
ctgagattacagatgtgagccaccgtgcccagcctatttttattttttgaggtggtgtctcactctgtcgctcaggctggagtgcagtggtgcgatatcggctcactgcagcctccatctcccgggttcaag

SEQ ID NO: 43221 - DNA, 100 bp, Homo sapiens
gatctggttgtttgaaagtgtgtagcacctccccctttactctgtctcccactgactgtgtaaagatgtgcctgcctccccatcaccttcggccatgatt

SEQ ID NO: 43222 - DNA, 58 bp, Homo sapiens
tgagatggagtctcactctgtctctcaggctggagggcagtggcgtgatttcagctca

SEQ ID NO: 43223 - DNA, 117 bp, Homo sapiens
ctaatgctcctgaaggtgtgtcccagccaggaagctgctggcactttttgtctcattgtctcagtgtaagcagtattcggaggtgtccctggaacacctggttcagagggcagctgg

SEQ ID NO: 43224 - DNA, 86 bp, Homo sapiens
ggcctcttcctgtcccaggctgcctctgaggctgctctgtggccccacagactgggtgcagagcgggggtggggtagggggaggct

SEQ ID NO: 43225 - DNA, 82 bp, Homo sapiens
ctggggaggccgctcctcactgtctctgtctgggaaccagggtctgggactccggagagtgtacctcggagaggctccccag

SEQ ID NO: 43226 - DNA, 78 bp, Homo sapiens
ataacttcagcagtataggcagtgagtgaggtcacagggagagggctgaatttcacttccttctgtaagaccagttgt

SEQ ID NO: 43227 - DNA, 93 bp, Homo sapiens
actgctctgctccaggcttggcacatgagtcactcactaagtctttggagacaaatttactggaaaaactatgagccaggccctcagggcagt

SEQ ID NO: 43228 - DNA, 89 bp, Homo sapiens
gagacagggtctcactctgtcactcaccctggagtgcagtggtgcaatcgtatcccccaactcctaggctcaagtgattctcctgtctc

SEQ ID NO: 43229 - DNA, 86 bp, Homo sapiens
cctgtcttggcctctgaagtagctgggactacaggcacacgccaccaggcccagctactttattttttattttttgtagagacagg

SEQ ID NO: 43230 - DNA, 115 bp, Homo sapiens
cgtgtctgccccttctttgcctctcggcttgaatgagtcacttagtctctccttctctgcataatggagacagtactagtgctacctcacaggcttgtggcgaggagatcacatg

SEQ ID NO: 43231 - DNA, 82 bp, Homo sapiens
tccccatgagactgggtgtctgtttctctgtgtcgccactaaggggcagcagagcgacaacagcctgtttttgggtgcggga

SEQ ID NO: 43232 - DNA, 96 bp, Homo sapiens
ggggacatgggttgccggagcctgcaggattgaggttggatgaacctccagggcagccagccagcctctctgcctgtctaagtaactcaggttgcc

SEQ ID NO: 43233 - DNA, 68 bp, Homo sapiens
tgttttgagacagagtctcactctgtcgcccaggttggagtgcagtggtgtgatcttggctcactgca

SEQ ID NO: 43234 - DNA, 91 bp, Homo sapiens
tgctgggtcatatggtaattctatgtttaaatgtttgagaatccaccaaacttttccacagcagctgaaccattttatattgccaccagca

SEQ ID NO: 43235 - DNA, 104 bp, Homo sapiens
ctatgaatagaaaacaggcaggagaaccctttatttttatcattattttcccccctccccattaccgctagagggtcttgactgcaagttgtccaggttcttgg

SEQ ID NO: 43236 - DNA, 60 bp, Homo sapiens
gtgagacagagtctcactctgtcactcaggctggagtgcagtagcgcgaccttggctcac

SEQ ID NO: 43237 - DNA, 112 bp, Homo sapiens
gaagttcagaagttctagtctgatggtttctatttttttttttttttctgtgaaagagaaagtaaggtagtcaacaaaggggtgaactttagactatggaattcatgtactc

SEQ ID NO: 43238 - DNA, 116 bp, Homo sapiens
tggaccgactcatgaagttcagtatttgcttaggcagagagtgtcagagctgtcagaggagagtcagctaaaacccttcccctggctgggcaccgtggcttacgcttgtagtccca

SEQ ID NO: 43239 - DNA, 94 bp, Homo sapiens
tcctgtttgggccactagagtctctcttttttattttattttatttattattattattttttgagacggagtctggctctgtcaccaggctgga

SEQ ID NO: 43240 - DNA, 107 bp, Homo sapiens
cctgggcacggggcaagatgaggcctccaggagcagggctctgactgaatcactgcctcctttgaggagaaacatgaagcctccaacatccctctctccagctcagg

SEQ ID NO: 43241 - DNA, 56 bp, Homo sapiens; identical to SEQ ID NO: 324

SEQ ID NO: 43242 - DNA, 98 bp, Homo sapiens
ggcaggctgcagtgcagagggagtaaacagccaggacctgtggctttgtagcaaaaacagagtggctgatgatttgttatggtgctgtcagcacatcc

SEQ ID NO: 43243 - DNA, 113 bp, Homo sapiens
tacactttgtatatatatttttgagtgtatttatattttcaaaatgttttttttacaatactgtgaagtacacagatcttaagtgtacagctctgtgaatttatatatgtgta

SEQ ID NO: 43244 - DNA, 89 bp, Homo sapiens
cagcataggccctatggagaggatatttcctgttgtagctgaagtgtgaatcggccttatgttctctgcctccagaccctattttcctg

SEQ ID NO: 43245 - DNA, 82 bp, Homo sapiens
tctgttacacacacactgttaatgtaggagtatgtgtgcaagcatgtgtatgctcaaaggctatcaatagtgtgaaaataga

SEQ ID NO: 43246 - DNA, 119 bp, Homo sapiens
ccattgcactgcagcctgggcaacaagaacgaaactctgtcttaaaaaaaaaaaaaattttttttaattaaaaaataaaaagagagtctatttctgtcacctaggctagagtgcagtgg

SEQ ID NO: 43247 - DNA, 99 bp, Homo sapiens
agggaaagttttatctatatgtgtgtgtatgtgtatatgtgtatatatatatgtgtatgtatatatacaagtacatacattttttgagatggagtctct

SEQ ID NO: 43248 - DNA, 111 bp, Homo sapiens
ttactagtattgcctgtatgtaggtatcatgtctgtgtgtcataaatttctttctttctttttttttttgagacggagtcttgctctatcgcccaggttggagtgcagtgg

SEQ ID NO: 43249 - DNA, 100 bp, Homo sapiens
gccgaggcagcatagcaaaaccacatctgtagaaaaattatttttaattaattaattttttctttttttttgaaacagagtctcgctgtgtcacccaggc

SEQ ID NO: 43250 - DNA, 58 bp, Homo sapiens
tgagacagggtctcactctgtcacccaggttggagtggaggggtgtgatcatagctca

SEQ ID NO: 43251 - DNA, 58 bp, Homo sapiens
tgagacagagtctctcactgtcgcccaagctggagtgcagtggcgcgatcttgactca

SEQ ID NO: 43252 - DNA, 126 bp, Homo sapiens
tactggtataatatagtatatttagtatatttataccagtataatatagtatattagtatatttataccggtataaatatagcatatttagtatattataccggtataaatatagtatatttagta

SEQ ID NO: 43253 - DNA, 86 bp, Homo sapiens
agcctttcccggctgctatggacccaggcattttctttcttttttttttttatttgagacagagtctggctctgttgcccaggctg

SEQ ID NO: 43254 - DNA, 58 bp, Homo sapiens
tgaggcagagtctgtctctgtcacccaggctggagtacagtggtgcgatcttggctca

SEQ ID NO: 43255 - DNA, 109 bp, Homo sapiens
cagcctggtcagtgagggttttctggctctattttcttattttatatgtgtatgtatgtatgtacatatttatttattgagacagagtctcgctctgttgtccaggctg

SEQ ID NO: 43256 - DNA, 85 bp, Homo sapiens
ctttagtagtttcctggtgaggcgaggacacagagtgtgtggctcacttccgtctcctctgtctctgtttcactgagctctctgg

SEQ ID NO: 43257 - DNA, 114 bp, Homo sapiens
tagatttggggtctcagtagcccctatgtttcaggagagattttctttttcttatctttctttttcttttttttttttttttgagacagagttttgtttttgttgcccaggctg

SEQ ID NO: 43258 - DNA, 72 bp, Homo sapiens
ttgtttattgagctggagtctctctctgtcacccaggctggagctcagtggtgcaatttcagctcactgcaa

SEQ ID NO: 43259 - DNA, 58 bp, Homo sapiens; identical to SEQ ID NO: 2758

SEQ ID NO: 43260 - DNA, 58 bp, Homo sapiens
tgagacagggtctcgctctgtcactccggctggagtgcagtggtgtgatcttggctca

SEQ ID NO: 43261 - DNA, 78 bp, Homo sapiens
ctcctgtagaaaaaatgagcaagagttttagaagcatttcataaagtggaatgttgaatggctcatttgtagttgggg

SEQ ID NO: 43262 - DNA, 119 bp, Homo sapiens
gattatgaaaggtgaagttgagtgagaggagttgaggaacgtggaagacagtgagctctcaccctaacactataagaagcatgatctcaatagaccaataattcacctttttatacatc

SEQ ID NO: 43263 - DNA, 68 bp, Homo sapiens
tttgtagacctagtctcgctctgtcacccaggctggagtgccatggcgtgattttggcttgctgcaag

SEQ ID NO: 43264 - DNA, 84 bp, Homo sapiens
acccatatatatatatatacatatgtatgtgtatacatatatgtatgtgtgtatatatatgtatgtgtatatatatgtatgtgt

SEQ ID NO: 43265 - DNA, 106 bp, Homo sapiens
gcgaggcttcactcagtttagcttttgagttttgattttattttattattattatttttttgagatggagtcttgctctgtcacccaggctggagtgcagctgcgc

SEQ ID NO: 43266 - DNA, 114 bp, Homo sapiens
ggccagggaaacagagtgaaaaacatgaaaagctgattttcttacgtggtcgtttttttttttttttttttttttgcgggggggaagatagagtctcattctgtctcccaggct

SEQ ID NO: 43267 - DNA, 127 bp, Homo sapiens
gctatcttatctgtgttttactgcctgctctttctggctgcttgtagttagaagagaagtgatttccttgaaatgcatgaggctagaaagggagctggaacttagagtggtggtgtttgtctgagat

SEQ ID NO: 43268 - DNA, 76 bp, Homo sapiens
caaattcaagtattcatatatatatatacgtacacatacatatgtatgtatatatgtatacttggttctatttgga

SEQ ID NO: 43269 - DNA, 72 bp, Homo sapiens
actaagttcctgagggtctgcagagagggtcccctttctcaccctgtctgcctgtctatctgtcaccatagt

SEQ ID NO: 43270 - DNA, 58 bp, Homo sapiens
tgagacagggtctcactctgtcacccaggctggagtgcagtggtgcaatcttggatca

SEQ ID NO: 43271 - DNA, 69 bp, Homo sapiens
tcagagtgactcagtgaatgtgtacacgtgagagcatgtgaagcatgcggacttctgggtctcccctga

SEQ ID NO: 43272 - DNA, 63 bp, Homo sapiens
ttggagatggagtctcactctgtcacccaggctggagtgcagtggtgcgatctcagctcacag

SEQ ID NO: 43273 - DNA, 104 bp, Homo sapiens
ggcaacactgcaatgatgtagggaggctggtgctctgtgaaagagaacatacacagcagttgttccggtctaaggctttgggtttatggagtgtttcagctgcc

SEQ ID NO: 43274 - DNA, 85 bp, Homo sapiens
caaaagctgggtgtagtgacatgtaccagtagtctcagctactgaggaggctgaggtaggaggatcccttgagcccagaagtttg

SEQ ID NO: 43275 - DNA, 58 bp, Homo sapiens
tgagacagggtctcactctgtcactcaggctggagtgcagcggtgcgatctcggctca

SEQ ID NO: 43276 - DNA, 69 bp, Homo sapiens
cacgggaagggttgaggtagtaggttccaggctgcatgtccaggaatgaccccctagaacaatactgtg

SEQ ID NO: 43277 - DNA, 95 bp, Homo sapiens
ggaagtgattcctccatcccaagcgggcagccaccctcagaacgcgtctgtgtgactgtgtgtgtggctgtaagcgtggaggagggtgagtgtgc

SEQ ID NO: 43278 - DNA, 72 bp, Homo sapiens
cagggtctcactctgtcagccagtcttgagtacaatggtgtgattatagctcactgcagccttgaagtcctg

SEQ ID NO: 43279 - DNA, 83 bp, Homo sapiens
actccttctctgtctcactctttcggtgaccgctaatattgcgaatgcggcgggcactattgaggtttggctcaggaaggtgt

SEQ ID NO: 43280 - DNA, 106 bp, Homo sapiens
tatcaacaatatcacatgcctgtctatattagtctgattttgtagtagtcatatttatagttttattcttctaatatagtcatgtctgagcatttatatgttgata

SEQ ID NO: 43281 - DNA, 58 bp, Homo sapiens
tgagtcagggtctcactctgtcacccaggttggagtacagtggtatgatcttggctca

SEQ ID NO: 43282 - DNA, 117 bp, Homo sapiens
ctgggtgtggtggggcacagttgtagtcccagctacttgggaggctgaggtggaaggatccattgagcccaggaggttcagagtgcagtgggctatgattgtgccactgcactccag

SEQ ID NO: 43283 - DNA, 113 bp, Homo sapiens
gttgagttgcaggatcatagaggaactgccagactgtttttcacagtggctgtcctattttaccttcccacgagcagtatatgagcagtgtgtttctctccgtcctcaccaac

SEQ ID NO: 43284 - DNA, 58 bp, Homo sapiens; identical to SEQ ID NO: 6617

SEQ ID NO: 43285 - DNA, 56 bp, Homo sapiens; identical to SEQ ID NO: 6618

SEQ ID NO: 43286 - DNA, 95 bp, Homo sapiens
caatgtacttaattatgtatgcttatgtatatattttgtgcatataaatatatatacatgcttatgtatgctgaatatatatgatgactacaatg

SEQ ID NO: 43287 - DNA, 86 bp, Homo sapiens
agagtgaaactccatctgaaaaaagagaaaataaaagttttatttatttatttatttatttattttttgagacagagtcttgctct

SEQ ID NO: 43288 - DNA, 87 bp, Homo sapiens
gggattaatgcttaggtgagttaacatggttgaaagatagggaaatccctatgtttactatttatttatttattagagacaagtctc

SEQ ID NO: 43289 - DNA, 114 bp, Homo sapiens
gcagggataagccaccacgcccagctcatttatttatctatttatttatttatttatttatttatttatttatttatttatttttgagatggagtgttgctctgtcacccaggc

SEQ ID NO: 43290 - DNA, 95 bp, Homo sapiens; identical to SEQ ID NO: 68

SEQ ID NO: 43291 - DNA, 93 bp, Homo sapiens; identical to SEQ ID NO: 69

SEQ ID NO: 43292 - DNA, 119 bp, Homo sapiens
agattctaggggccaggtgctgtggctcatgcctgtacttctagcactttgggaggctgaggtaggaggatcgcttgaggccaggagtttgagaccagcctggccaacataaagagact

SEQ ID NO: 43293 - DNA, 92 bp, Homo sapiens
gtgctctcttctgtcagttcttccattttctgtgtaatttctttttttgttgatgatattagtggtggtgatgtgaagggagggtttggcac

SEQ ID NO: 43294 - DNA, 60 bp, Homo sapiens
ttgagacagagtctcgcactgtcacccaggctggagtgcagtggcgcgatctcggctcaa

SEQ ID NO: 43295 - DNA, 58 bp, Homo sapiens; identical to SEQ ID NO: 29624

SEQ ID NO: 43296 - DNA, 58 bp, Homo sapiens
tgagctggagtctcgctctgtctcccaggctggagtgcaatggcacgatcccggctca

SEQ ID NO: 43297 - DNA, 81 bp, Homo sapiens
gtgattctaagcagtcaggattgagaaatactgctttagacaaagccgtgcttctcagtcttgactgcacattggaatcat

SEQ ID NO: 43298 - DNA, 94 bp, Homo sapiens
ggttctttcttaattggtctgagatggggtccaggtattgtttttttctttttttaacaccctgtgttattctacagttaagattccctgaacc

SEQ ID NO: 43299 - DNA, 93 bp, Homo sapiens
tggacatgggtgggggctctgaggctctctgactcacccaatccaggggctggggtgcagcagccaacaagacactgttcccacctctcacca

SEQ ID NO: 43300 - DNA, 73 bp, Homo sapiens
gtgagaggtaaaagtgtgtgtgagagacagacagacagcgtcccaccacgcacacactgtccccagggctcac

SEQ ID NO: 43301 - DNA, 83 bp, Homo sapiens
tgagacatacttattctaaaaagtattcactgtttatctgaaattcacactgggtatgatttttaatatataagtatgttcca

SEQ ID NO: 43302 - DNA, 58 bp, Homo sapiens
atgcatgtgtctgtgcatgtatatgcatgcgtgtgtgtgtgtgtgtatctctgtgcat

SEQ ID NO: 43303 - DNA, 81 bp, Homo sapiens
ggatggcagagagaggcagtttcttttttttcttttttctttttttttttttttttgagacagggtctcactctgtcaccc

SEQ ID NO: 43304 - DNA, 90 bp, Homo sapiens
gtttatacttactagttttacttatttttatttctttttgttattttttgcaaatactagtagagcagagtgaaggtttaggtgtgatac

SEQ ID NO: 43305 - DNA, 82 bp, Homo sapiens
ggtccctaataatccccttgaggcaggagaatagtgtctggagacagggagccttcacttcagcctctgattggtgggagcc

SEQ ID NO: 43306 - DNA, 58 bp, Homo sapiens
tgctgggaacacaggcgtgagccactgcgcccagtctgagttcatcctgtaacctgca

SEQ ID NO: 43307 - DNA, 113 bp, Homo sapiens
tgtgggcaactggctttgagcataggcttacatgataatacacttttgcaagcagaacaaacatgtctttttgttgttatttcctgtattccttcttagtagggtgctcctca

SEQ ID NO: 43308 - DNA, 89 bp, Homo sapiens
cacatatatgtatatatgtgtatatatgtacgtatatatgtatatatacacatacatatgtgcatctatatacacatatgtgcatctat

SEQ ID NO: 43309 - DNA, 112 bp, Homo sapiens
ctaggtagggtacaggttatcacctctgatttcgggtaaaagggatttatttatttatttgtttatttatttatatttttgagacagagtctcgctctgtcacccaggctgg

SEQ ID NO: 43310 - DNA, 83 bp, Homo sapiens
attcaataggcctgggtgatgaggcctgagattctatatattttttttgagatggagtctcgctctgtcgcctaggctggagt

SEQ ID NO: 43311 - DNA, 115 bp, Homo sapiens
cttctaaaaaccaatggagttacgctatacttatttctatgcttgttttgagagagaatctcactctgtcacccaggctggaggagtgcagttgcataatcacggttcacggaag

SEQ ID NO: 43312 - DNA, 113 bp, Homo sapiens; identical to SEQ ID NO: 43307

SEQ ID NO: 43313 - DNA, 89 bp, Homo sapiens; identical to SEQ ID NO: 43308

SEQ ID NO: 43314 - DNA, 65 bp, Homo sapiens
tgagacacagtctcactctgtcacccagcatccaggctggagtgcggtggtgtgatcttggctca

SEQ ID NO: 43315 - DNA, 112 bp, Homo sapiens; identical to SEQ ID NO: 43309

SEQ ID NO: 43316 - DNA, 79 bp, Homo sapiens
gctgggattacaggtgtgagccaccgcgcccggccctaattaatttttttgagacggtgtctcactctgtcgcccaagt

SEQ ID NO: 43317 - DNA, 116 bp, Homo sapiens
ccagcctgggcgacagagcaagactccctctccaaaaaaagaaaactaaactttgatctttttttttttttttttttttttttttacacagagtctcgctctgtcgcccaggctgg

SEQ ID NO: 43318 - DNA, 114 bp, Homo sapiens
cagccaagttagaggattttgcttggatttcctagagccagaaaacactgaacactcaaccctaaactgcgcctgagatcttactaccagccccttaaagtcattctgactctg

SEQ ID NO: 43319 - DNA, 76 bp, Homo sapiens
tggggaagctttgaagctctcactcactgaccctcttttaggatggctgtgggcacagaggttcttttcatcctca

SEQ ID NO: 43320 - DNA, 95 bp, Homo sapiens; identical to SEQ ID NO: 68

SEQ ID NO: 43321 - DNA, 93 bp, Homo sapiens; identical to SEQ ID NO: 69

SEQ ID NO: 43322 - DNA, 113 bp, Homo sapiens
gggctcctactgcttctacatatggtgagttgtgtaattatttcattatatattacaatgtaataataatagaaataaagtgcacaataaatgtaaagcacttgaatcatccc

SEQ ID NO: 43323 - DNA, 60 bp, Homo sapiens
gtgagacagagtctcgctctgtcacctagggtagggtacagtggcgtgatcttggctcac

SEQ ID NO: 43324 - DNA, 58 bp, Homo sapiens; identical to SEQ ID NO: 43129

SEQ ID NO: 43325 - DNA, 107 bp, Homo sapiens
ctaggggcaaagcctatgagaacagaactgagttgagagagaggagaatctctggccctctctgataaatcagtttgagttcctggtctgtattctttgctttctag

SEQ ID NO: 43326 - DNA, 93 bp, Homo sapiens
gggggaaaggatgggacttaggtggacagggcttgtttttttttttttttttttggcacaagttacctgacctctctaagtctcagtttactc

SEQ ID NO: 43327 - DNA, 95 bp, Homo sapiens; identical to SEQ ID NO: 68

SEQ ID NO: 43328 - DNA, 93 bp, Homo sapiens; identical to SEQ ID NO: 69

SEQ ID NO: 43329 - DNA, 60 bp, Homo sapiens
tgagacagagtctcactctgtcttgcccaggctggagtgcagtagtgtgatcttggctca

SEQ ID NO: 43330 - DNA, 61 bp, Homo sapiens
gagtctcagtctctccctgtgtccaccactaccacaggcccatggggagtactgtggcctc

SEQ ID NO: 43331 - DNA, 69 bp, Homo sapiens
tatgtatatgtatacatatattctgtatatgtatataatatatacagaatatatgtgtatatattaata

SEQ ID NO: 43332 - DNA, 119 bp, Homo sapiens
atggtataaatctatgatgtgtgtgtgtgtgtgtgtgtgtggttttgttttttttttttttttttttttttgagacggagtctcgctctgtcacccaggctggagtgcagtggtgcgat

SEQ ID NO: 43333 - DNA, 58 bp, Homo sapiens
tgaggcggagtctcgctctgtcacccaggctggagtgcagtggcgtgatcttggctca

SEQ ID NO: 43334 - DNA, 88 bp, Homo sapiens
tactgtatttattgttcattctaagtgtttttgtttttgttttttttgagacggagtctcacgctgtcacccaggctggagtgcagtg

SEQ ID NO: 43335 - DNA, 97 bp, Homo sapiens
ggttggttttgttttgtttttttgagacagagtctcgctctgtcacccaggctggagtgcagtggcaccatctctgctcaatgcaagctctacctcc

SEQ ID NO: 43336 - DNA, 118 bp, Homo sapiens
ggggcgttcaggtctggcctggctggaggcaaggctatgaattgtatgctgtggaactgtctttcagtgtctgtgaatttgcctactagtgcctttagcagggaaggtggggtgctct

SEQ ID NO: 43337 - DNA, 89 bp, Homo sapiens
tttgccctgagtctcagatgagactctggacttcatatttttaagttgatgttggaacaagttaatgcttttgggactactggggtaga

SEQ ID NO: 43338 - DNA, 118 bp, Homo sapiens
ggggcgttcaggtctggccaggctggaggcaaggctatgaattgtatgctgtggaactgtctttcagtgtctgtgaatttgcctactagtgcctttagcagggagggtggggtgctct

SEQ ID NO: 43339 - DNA, 97 bp, Homo sapiens
tgagacaccgagtgcagaagggaagagtgaagttgcaggtctagaaggggtcttagcctaatcctttttttttttttttttgtgagacaggttctca

SEQ ID NO: 43340 - DNA, 76 bp, Homo sapiens
ggcagtggttagagaggaggagactgactggtcagtgggaagaacagggcctatccctctcctctgtctcactgtc

SEQ ID NO: 43341 - DNA, 66 bp, Homo sapiens
cctggagaaatagtgcactttcctttttttttttttttgagacggagtcttgctctgtcacccagg

SEQ ID NO: 43342 - DNA, 99 bp, Homo sapiens
gtgattccacattatggtgaattgtgtaattatttcattatatatgacaatgtaataatagaaataaagtgcacaataaatataatgtgcttgaatcat

SEQ ID NO: 43343 - DNA, 103 bp, Homo sapiens
atgcatggcctttgatcacaggccaggagtgagagaataactttcagactctctgtaagttatttgtttttcattcactgggttgatgacatggtcttggcat

SEQ ID NO: 43344 - DNA, 74 bp, Homo sapiens
gtgtgataatagtattgcagtttatatatatatataactgcaatatatatataactgcaataactgcaatatat

SEQ ID NO: 43345 - DNA, 79 bp, Homo sapiens
caccttgccgaggggaatctggctcagtgtctggcacacacacagcccctggctctgtgaaattgttaccattgcagcc

SEQ ID NO: 43346 - DNA, 58 bp, Homo sapiens; identical to SEQ ID NO: 9124

SEQ ID NO: 43347 - DNA, 60 bp, Homo sapiens
tctgtcaccctccctctgtctggacaccatcagtctgggcagcaggttgtgggcagcagg

SEQ ID NO: 43348 - DNA, 78 bp, Homo sapiens
tgagagagtctcactctgtcacccaggctggagtgcagtggcgtgacctctgctcactgtaacctctgcctcctgggt

SEQ ID NO: 43349 - DNA, 58 bp, Homo sapiens
tgagatagagtctctcactgtcacccatgctggagtgcagtggcgtgatcttggctca

SEQ ID NO: 43350 - DNA, 59 bp, Homo sapiens
ctgtcgttctgtctgtctgtctgtctatctaggaaagagacagagagatggaaatacag

SEQ ID NO: 43351 - DNA, 83 bp, Homo sapiens
gcctcgtcctcaacaaccctcactgtttggttttctaggactatttcttttaatatgctttagtgtaggctgaggcttggggc

SEQ ID NO: 43352 - DNA, 113 bp, Homo sapiens
gtgagtctggatgtattcagaagttcttcgtgtgatgattgcaacttttgcttgaaaatatttaattattttaatagttgtatattatctttaaatttcaatttatccttcat

SEQ ID NO: 43353 - DNA, 117 bp, Homo sapiens
ggggatggtgggaatgaatgtagcctctttgcagtgaagtgagagtcagagaaagaagagaagtttctacaattgctttttttgtcaaagcttcagtgagttcaccccacaataact

SEQ ID NO: 43354 - DNA, 109 bp, Homo sapiens
aagcaggatgtcatttgccagagctacatttaaaaaacaaaattaggacctaagttagtctgacttaattttttttaatacagtagaatatggggcacgtattctgctt

SEQ ID NO: 43355 - DNA, 109 bp, Homo sapiens
ggctgttaggtgatcttaagcttcactcgacagtaaaaaggcatgagtttttcttattttaaattgacctttttgtttgttgagcgaggcggtaagtaacaaagtagtt

SEQ ID NO: 43356 - DNA, 108 bp, Homo sapiens
gattgagacaagactcaaagttggctgccacttctaaaaagcatcactgaactgtctgaggacagtttaaaggggtaataatagtaacatgaaactttttgttcaatt

SEQ ID NO: 43357 - DNA, 84 bp, Homo sapiens
gagccaccttgctgacccctagctgactctagactgtgagcaataaatggtcattgttgtagtcctctgaggtttgggctgctt

SEQ ID NO: 43358 - DNA, 67 bp, Homo sapiens
gtacctatagaggcgcgtatatatatgtatatgtatctatatatgcgtatatatacctatacgtacc

SEQ ID NO: 43359 - DNA, 82 bp, Homo sapiens
gtgaaatgtgtgtggatgtgagaaggatcaggctcaaattttatgagccaagccatgattttctatatttttatgctcttgc

SEQ ID NO: 43360 - DNA, 92 bp, Homo sapiens
ttgtcatggtgctatattgaattattgtagatgtgaataaatgagataagattcccaaggtggtaattcagttaatatgtatagagtggcaa

SEQ ID NO: 43361 - DNA, 95 bp, Homo sapiens; identical to SEQ ID NO: 68

SEQ ID NO: 43362 - DNA, 93 bp, Homo sapiens; identical to SEQ ID NO: 69

SEQ ID NO: 43363 - DNA, 76 bp, Homo sapiens
gctgctactaagggatgagggaggggtggtatccatgattcacgactgctactctcagtgtctctgatataggagt

SEQ ID NO: 43364 - DNA, 112 bp, Homo sapiens
gatttttgcatgttgattttgtatcctgcaactttactgaatttgttcatttgttctaacggtttttggtaaggtcttcagggttttctgtatataatatgtcatctgcaaa

SEQ ID NO: 43365 - DNA, 97 bp, Homo sapiens
cattttcctcatgtgttatatctgtatatatatgtatacatgaatgtgtgtgtatgtgtatacatatgtatatgtatgtgtgtgtgtatatttatga

SEQ ID NO: 43366 - DNA, 79 bp, Homo sapiens
ttgtggcaaccctgcatcaagcaagtctgttggtaccattttcccaacagcatgtgctcactttgtgtctctgtcacag

SEQ ID NO: 43367 - DNA, 63 bp, Homo sapiens
gcctcagaccctcagtggctgggagcagtgccttctcccagttcagtggacttaggttatggc

SEQ ID NO: 43368 - DNA, 103 bp, Homo sapiens
aagaatactatgttgtgcatttcctatgtatggttaagaactttttatgttttttaagtgtattatcttggcaaaatgtgtacaacgaatctttagtgtgctt

SEQ ID NO: 43369 - DNA, 115 bp, Homo sapiens
tttatacatgtatatgaatatgtgtcatacgtgtgtgtatgtaaagtcaattataaatctttgtatatatgcatacagttgattctcattattcatattactttggttctataaa

SEQ ID NO: 43370 - DNA, 94 bp, Homo sapiens
gaggacatttagtgagatactatatatatatgtatatatatgtatagtatatatatatatatatatatatataaaacctattctaattgttagc

SEQ ID NO: 43371 - DNA, 80 bp, Homo sapiens
tcaaggaatacttttcctatgagttcttctttaaggaaagtattgaagaatgaacctcagaaaagtaataaagactttga

SEQ ID NO: 43372 - DNA, 105 bp, Homo sapiens
cagttgtatatgtgatctcatgcaaatgagagtgaatatagtgaacttcctggagtgcattcaattatttatatattcatttgctacttgagcaagtatttattg

SEQ ID NO: 43373 - DNA, 70 bp, Homo sapiens
gtatgtgtatatgtgtatatgtatgtgtgtgtatacatacacacacatgcatatacatgtatacacacac

SEQ ID NO: 43374 - DNA, 114 bp, Homo sapiens
gtatatatattgaagtatatacattatgtatatgtatacatatatacatatatatgataatatatatcatatgcattatgtatatgtatatgctatatgtatatatatatataa

SEQ ID NO: 43375 - DNA, 119 bp, Homo sapiens
tatatgtgtgtatatataaatatatatgtacaagtttacaatattgtctacaaatatacaatatttgtgtatatatatgtgtatatatgtatgtatgtgtgcatgtatatatatgtgtg

SEQ ID NO: 43376 - DNA, 103 bp, Homo sapiens
cattgagctatattttttaactataattcttttttttttaatgagctacattgttatttaaattctaaataagaattgttggtgcttggatagagctcatctg

SEQ ID NO: 43377 - DNA, 117 bp, Homo sapiens
gtttggtttgctgaggtatttccagcagtgtctggcatttagtggaaattcattctatatttattgagtgaataaagaattgttagacttggagggagtgttggtgaagtgtaaacc

SEQ ID NO: 43378 - DNA, 104 bp, Homo sapiens
gggaataactgacatcttgataatactgagtctttctgtccttgaatatttctctattcatttagttcttttttgacttagtatgagagtttttagttttactc

SEQ ID NO: 43379 - DNA, 62 bp, Homo sapiens
ctctaattccatatatatgtatgtgtgtatatatatatatatatatatatagagagagagag

SEQ ID NO: 43380 - DNA, 84 bp, Homo sapiens
gcataattcaaaggtatgctgaatttgtaaatgtgaagattgaatgaatcttcaggtaagtgaaagcagcacactggaagatgt

SEQ ID NO: 43381 - DNA, 62 bp, Homo sapiens
gccagagcctctgtccctgtgacagaaacactcccctgcatagagaaagggaggcggatggc

SEQ ID NO: 43382 - DNA, 107 bp, Homo sapiens
tcagctccaattcttcaaggtcagaggcttggttactgtaaatttgtagagagaagtctgtcaggaatttggagtctcagctttctttttgttgggatataagctgg

SEQ ID NO: 43383 - DNA, 88 bp, Homo sapiens
ggtattaactgaactgtgctcttatctggaggctctggagaagaatctgctcacaactgtctcagactgttggtagaattcagtttcc

SEQ ID NO: 43384 - DNA, 85 bp, Homo sapiens
ctgggaaattttcaattaggaaaacagtgattggagattgaagtctgcaagtctatggaattcttttgaaaatatctaaacccag

SEQ ID NO: 43385 - DNA, 99 bp, Homo sapiens
agatacatatacacacaaatgagaatgtgtatataaatatgtatatgttcattcatattatacacattatattccttcttttgtatgtttgtagtattt

SEQ ID NO: 43386 - DNA, 79 bp, Homo sapiens
cttgaggcttgcagaaacatgctcaattcagggactaagctgattttatttttatttgagacagagtctgtcgcccagg

SEQ ID NO: 43387 - DNA, 75 bp, Homo sapiens
caactaacttgtcttgtgtgccactcactttctgtgattacatggggtttaaagagtacacagtaagtgctgttg

SEQ ID NO: 43388 - DNA, 86 bp, Homo sapiens
ctagaaggatttctattctaccaacacagtgtcttagggagacggactagaggacaggatgattagtttagaaattatgcttctgg

SEQ ID NO: 43389 - DNA, 115 bp, Homo sapiens
tttcatttattgtaaatcagagcacatagtaccttgggaattttaaagtatgattatttaaaattaattagtatattatctttccatccttgtttaggcagtgcaatgattggag

SEQ ID NO: 43390 - DNA, 82 bp, Homo sapiens
gcctgggtgacagagcgagactccatctcaaaaaaaaaaaaaaaaaaaaaaagagagagagagagagtcagaaatcccaggc

SEQ ID NO: 43391 - DNA, 67 bp, Homo sapiens
ggattacaggcatgagccactgtgcctggcctaggcatcctctctgtgtctctctgtatatgtgtcc

SEQ ID NO: 43392 - DNA, 58 bp, Homo sapiens; identical to SEQ ID NO: 2626

SEQ ID NO: 43393 - DNA, 105 bp, Homo sapiens
acccaggcagttttatctagagccttgtctcttcctattatgaaaggtcactttttttttttttttttttgaggtggagtctcgctctgtcacccaggctggagt

SEQ ID NO: 43394 - DNA, 87 bp, Homo sapiens
ggtgtgagccaccatgcccagtctatactcttttaaaatgaagtttatactttttttttttttgagactgagtctggctctgttgcc

SEQ ID NO: 43395 - DNA, 83 bp, Homo sapiens
tagaattgtgttttcttggatcccctaaagatctctttatatttttttgaggggaggagggtctaaattgacaccttgtttta

SEQ ID NO: 43396 - DNA, 113 bp, Homo sapiens
tccttcctgattgctcaattttggtttatcctaagaagaatcacgactaaagaaatcagattttgtttttgatgacttcatttgagtagattaaaaacagcaaacagaagaga

SEQ ID NO: 43397 - DNA, 106 bp, Homo sapiens
gaaagtgctgatgatatggatggtttgttctgactttagcattctggcttaaggatctgagagagagagagagagagctccacagctctgtattattatcaatgtc

SEQ ID NO: 43398 - DNA, 76 bp, Homo sapiens
gtgtcttcctccctttctctctctctttctctagagatatagaggtgtagagagagagaaagagaaaggaatatat

SEQ ID NO: 43399 - DNA, 83 bp, Homo sapiens
ttaaaattttatatatgtatgtgtatatatatgtgtgtgtgtgtgtatatatatgtatgtgtgtttgtgtgtgtgtattttaa

SEQ ID NO: 43400 - DNA, 97 bp, Homo sapiens
ggattgggaacgcctgccttaaaaaatggaagatgaggggccactgtggctagggatttttttttttttagagacagggtctcagtctgtcatccat

SEQ ID NO: 43401 - DNA, 82 bp, Homo sapiens
cttctggacagacacagtggctcacacctataatcccagagctttgagaggctgatgagggaggatcacttgaggtcaggag

SEQ ID NO: 43402 - DNA, 91 bp, Homo sapiens
acagtaacttacttgttttgttgctaacagctggatatataagaattccatgtctgttgtctgcctggtgcaacttgagcctttctactgt

SEQ ID NO: 43403 - DNA, 72 bp, Homo sapiens
gcacaacagtggcttcttattgaggatggagcacagcagtctctctctctctctccaggaggtcaaaacagc

SEQ ID NO: 43404 - DNA, 94 bp, Homo sapiens
aatctcatatttctcagaggttttgttcattattttttatttatttttgtgtgactgagttatttctgagaagcaatctttgaggtctgagatt

SEQ ID NO: 43405 - DNA, 74 bp, Homo sapiens
gcataggttcctgtggagagtgtgaatcccccaaatgggctctcattcattcactcactcaccctcccttttgc

SEQ ID NO: 43406 - DNA, 102 bp, Homo sapiens
gtattctactctgtttacataccacattttctttttttttataatttacttttattgtaggttcgggggtatatatgcaggtttgttacatgagtatattgc

SEQ ID NO: 43407 - DNA, 98 bp, Homo sapiens
ggatgtcatggtttcaatccatttccaacagatcgatttttttttttttttgagacggagttttgctcttgttgcccaggctggagtgcaatggcgcc

SEQ ID NO: 43408 - DNA, 131 bp, Homo sapiens
tccagctttgttctttttgcttaggattgtcttggctatatgggctcttttttggttccatatgaaatttaaagtagttttttctaattctgtgaagaaagtcaatggtagcttgatggggatagcactga

SEQ ID NO: 43409 - DNA, 110 bp, Homo sapiens; identical to SEQ ID NO: 8369

SEQ ID NO: 43410 - DNA, 117 bp, Homo sapiens
tatagatattatattgtctttgctataggtgtgtgtgtgtgtgtgtgtgtatatatatatatatacacatatacatatacatatattgtgtatagtaattaaatgttagtaacttta

SEQ ID NO: 43411 - DNA, 120 bp, Homo sapiens
tggatagctgctcaatttggtgttcctggtgggggatggtgggggcaatcactggaggcttctctttggtcatcttgctctatctcctccccctaaataaaaaagtttttaaaggatcta

SEQ ID NO: 43412 - DNA, 84 bp, Homo sapiens
tgttgctctgagatgagaaccaggaagttcactaggtcctcttgctagctaagtgactccctctctcactgcagccttgcagca

SEQ ID NO: 43413 - DNA, 86 bp, Homo sapiens
ctgggactacaggaagacaggaccacatacagctaattttttattttattttagggaaaggtgctatctctctgtgtgttgcccag

SEQ ID NO: 43414 - DNA, 115 bp, Homo sapiens
cactctatgtatatatatgtgtatatatatgtgtatatatatgtgtatatatatgtgtatatatgtgtatatatctgtatatatatgtgtatatatatgtgtgtgtgtgtgtgtg

SEQ ID NO: 43415 - DNA, 79 bp, Homo sapiens
cagggtctcactctgtgcctgggttggagtgcagtggcatgattacagctcaccgcagccttgacctcctgggtttaga

SEQ ID NO: 43416 - DNA, 56 bp, Homo sapiens
gagaccgagtctcgctctgtcacccaggctggagtgcagtggcacgatcttggctc

SEQ ID NO: 43417 - DNA, 114 bp, Homo sapiens
tatatatgtatatatgtatgtgtatatatatgtgtatatatgtatgtatatatacacgtatatatgtatatatgtatgtgtatatatatgtgtatatatgtatgtatatataca

SEQ ID NO: 43418 - DNA, 60 bp, Homo sapiens
gtgaacaatgacagcacagagtgtggtgagtgctacctacagtgtgttgtgacaggacac

SEQ ID NO: 43419 - DNA, 104 bp, Homo sapiens
taatccatcaatacattagcttttaaactcattaatattatttttaattgataaatcaaaattttatacattaatggggtgcaatgtgatgttttgagagatta

SEQ ID NO: 43420 - DNA, 58 bp, Homo sapiens
tgagacagagactcactctgtcacccaggctggggtgcagtagtgcgatcttggctca

SEQ ID NO: 43421 - DNA, 58 bp, Homo sapiens
tgagccaagatcgcactactgcaccccagcctgggtgacagagtgagtctctgtctca

SEQ ID NO: 43422 - DNA, 77 bp, Homo sapiens
taagaacagagaagctttaggaaagggcagttgtggaaattgattccctaaatctgtctgtgtctctgtacttcttg

SEQ ID NO: 43423 - DNA, 83 bp, Homo sapiens
ttgtttttttttctgagagtctcactctgtcgcccagtcgcccaggctggaatgcagtggtgtaatctcggctctcactgcaa

SEQ ID NO: 43424 - DNA, 58 bp, Homo sapiens; identical to SEQ ID NO: 31816

SEQ ID NO: 43425 - DNA, 74 bp, Homo sapiens
cagggctatatgtgtatgcatgtatatatatcccttaaaatatgtatatatatacatgtatatatatatatatg

SEQ ID NO: 43426 - DNA, 95 bp, Homo sapiens
gacatttgggactagataattgttgtggggaaagttgtcaaaaaatttggacaattttttgacaatgtcccctgaggataaaatcacccttggtt

SEQ ID NO: 43427 - DNA, 113 bp, Homo sapiens
tctgtatatatacgtacgtatatatacacgtatacatatatatacgtatatgtgtatatatatgtgtgtgtatatatatgtgtgtgtgtatatatatatatgacattaacagg

SEQ ID NO: 43428 - DNA, 58 bp, Homo sapiens
tgagacagagtctcgctctgtcacccaggctggagtacagtggcaagatcttggctca

SEQ ID NO: 43429 - DNA, 95 bp, Homo sapiens; identical to SEQ ID NO: 68

SEQ ID NO: 43430 - DNA, 93 bp, Homo sapiens; identical to SEQ ID NO: 69

SEQ ID NO: 43431 - DNA, 92 bp, Homo sapiens
gtagccagcctgatgggtgtgaggtggttgaaaattgacttttttctttttttaagagacgagggctcgctctgacacccagtctggactgc

SEQ ID NO: 43432 - DNA, 77 bp, Homo sapiens
aagacaagggaatggaggttcctgtggcaaactgaagagcacctgacagcactcacaggtttttttgtttttgtttt

SEQ ID NO: 43433 - DNA, 58 bp, Homo sapiens
gggagagagaacagtgtgttcaaaggccctgatggtgagggaggcaatgttcttaccc

SEQ ID NO: 43434 - DNA, 76 bp, Homo sapiens
tgactcctgctccaggcttcacattcccagacccacactctcacccacagggacgtgaacttggctctgcttgtca

SEQ ID NO: 43435 - DNA, 73 bp, Homo sapiens
agtgtcgctctgtgaccctcagaaggtgttcacatccatgagctcatctgaacttcacagcagggcaggcatt

SEQ ID NO: 43436 - DNA, 137 bp, Homo sapiens
ccattcatggattaatgggttatcatggtagtggaactggtggcttcatgtgaagaggaagagagtcctgagtgagcacacttcaatcccttgctatgtgatgctctgtctcacttgggactcttcagagaatcctc

SEQ ID NO: 43437 - DNA, 94 bp, Homo sapiens
gttgttgttttcaaaagtcgggaaggagaaactttattttagaccaaaaggaaatctaagtggaagtgttctgtattcatttggaaacactaac

SEQ ID NO: 43438 - DNA, 136 bp, Homo sapiens
tgagttggcacattctgccagagaagaaaggccggactctgcctgtgtaacttgtgctaggagtggctctctactgtttttctctggtgtcgcccactcaaaacaaacagtttcatcagcatttgagtttggagtt

SEQ ID NO: 43439 - DNA, 92 bp, Homo sapiens
cagcatttccaggtggctctgctggattatttatttatttatttatttatttattgagatggactctggctctgtcacccaggctggtgtgc

SEQ ID NO: 43440 - DNA, 95 bp, Homo sapiens; identical to SEQ ID NO: 68

SEQ ID NO: 43441 - DNA, 93 bp, Homo sapiens; identical to SEQ ID NO: 69

SEQ ID NO: 43442 - DNA, 82 bp, Homo sapiens
caggattagctatgactgtttttgttgacgcaatacttgctgaaagcagaggtagggtggtaggcagtggtagtggagactg

SEQ ID NO: 43443 - DNA, 105 bp, Homo sapiens
gaagataattatttgtttgtaactgtttgggttataggaaggaggatgtaaagtgatgaaactactgccataagccagatagtttaattacatttaatgatcttt

SEQ ID NO: 43444 - DNA, 114 bp, Homo sapiens
gttaatggcacatcatcattatctattagtacgttgaggactgattttgtttttaagcctgagaatggttggaaagcccttgagtttgcttagagtgaaatgtggctctttaat

SEQ ID NO: 43445 - DNA, 95 bp, Homo sapiens; identical to SEQ ID NO: 68

SEQ ID NO: 43446 - DNA, 93 bp, Homo sapiens; identical to SEQ ID NO: 69

SEQ ID NO: 43447 - DNA, 95 bp, Homo sapiens
caaagtgctgggattacagacgtgagccaccgcgcccggcctttttttttttggtgggggcagagtctcactctgtcacccaggctctggagtgc

SEQ ID NO: 43448 - DNA, 80 bp, Homo sapiens
tctgggagtaggagtccaccatcttgaatttttttttttttttttttttttttgagatggagtctccctctgtctccagg

SEQ ID NO: 43449 - DNA, 76 bp, Homo sapiens
gcactatttatatatacatatacacatatataagcatatatatgtatttgtgtgtctgtgtgtgcatatatagtgt

SEQ ID NO: 43450 - DNA, 111 bp, Homo sapiens
gtgataatacttaccataacagtgaagtgatattcttgttttaatatcttcagattttttttttttttgagacagggtctcactctgttacccaggctggagtgcagtggc

SEQ ID NO: 43451 - DNA, 71 bp, Homo sapiens
tgtatttttgagtcagagtctcactgtgtccccccggctggactgcagtggggcgatcatggctcactgca

SEQ ID NO: 43452 - DNA, 93 bp, Homo sapiens
ttgaatgttgaaccagccttgtttacctggaattaatcctacttggttgtggtgtataattctttttataaaatgttggattcaattttttaa

SEQ ID NO: 43453 - DNA, 100 bp, Homo sapiens
catgctccaggaggatgctgacaccaaaataaagtgagttgtgaaaagaaacttctgatcagtctctgtctgtatgatgagtgttggaagctggaaggtg

SEQ ID NO: 43454 - DNA, 115 bp, Homo sapiens
tgagagtctcactaagctgtgatcttggggagagggggcattttgataaatataattttttttttgagagagtctcactctgtcacccaggctggagtgcagtgatgccatctca

SEQ ID NO: 43455 - DNA, 96 bp, Homo sapiens
gcagtgggaggtagcaatcacagaagacaaacatcatggctgggtacataccggttttttttttttttttttttttgagatggagtctctctctgt

SEQ ID NO: 43456 - DNA, 56 bp, Homo sapiens
ctgggagtcatcagcaagtatatgaagataatatatatatttctgagattacccag

SEQ ID NO: 43457 - DNA, 97 bp, Homo sapiens
gggaatatatgaaatatatgtatgtgtgtacatatatgtgagcatttatatatataaacttttacatatacacacatttacatctatatttatttct

SEQ ID NO: 43458 - DNA, 95 bp, Homo sapiens
cagtgagccactgtgcctagcaattttttttttttgaaacagagtcttgctttgtcacctaggatggagtgcagtggcataatcttggctcactg

SEQ ID NO: 43459 - DNA, 125 bp, Homo sapiens
actggcattaataggaagggtagattgagcaagagattggagacctggagcaggtagaagaatctattgttttttctgccctgtatccaatgtacggtcttctggtaacaatactcccacgtcct

SEQ ID NO: 43460 - DNA, 134 bp, Homo sapiens
gcgctggtcaggcacagcctctgtgataaagtgacatttgagcaaaaactttttttttttttttttttttttgagatggagtctcactctatcgcccaggctggagtgcaatggcgctatctctgctcactgca

SEQ ID NO: 43461 - DNA, 82 bp, Homo sapiens
actctgtctcaaaaaaaacccaaaaaacaaaacacaaaaacccagagtaatttttttttttttttttttgttgagacggagt

SEQ ID NO: 43462 - DNA, 133 bp, Homo sapiens
cagtctgtggggtggcagtgggctaatctttttttttttttttttttttttttttgagacggagtctcactctgtcacccaggctggagtgcagtggtgcaatcttggctcactgcaagctccgcctcccggg

SEQ ID NO: 43463 - DNA, 58 bp, Homo sapiens; identical to SEQ ID NO: 285

SEQ ID NO: 43464 - DNA, 115 bp, Homo sapiens
tacatatatatgtatatatacacacacatttatatatgtatatataaatgtatgtgtatatatatatatacacacatttatatatgtatatatatgtatgtatgtatacacatgt

SEQ ID NO: 43465 - DNA, 84 bp, Homo sapiens
tgtatgtgtatatatatacacatacatgtgtatacatacatacatatatatacatatataaatgtgtgtatatatatatataca

SEQ ID NO: 43466 - DNA, 83 bp, Homo sapiens
acgtgtgtgtgtgtagggagagggttttttttttttgttttttgttttaggacagattctcaccctgtcacccaggctaaagt

SEQ ID NO: 43467 - DNA, 57 bp, Homo sapiens
tgagatgagtctcgctctgtctcccaagctggagtacagtgctgtaatctcggctca

SEQ ID NO: 43468 - DNA, 102 bp, Homo sapiens
ctagatgggcagacagtttggtttacagaaagcttgatccttacgattttctttatgaatatttgaggtgtaattttcctaagccatgggtcctaattttag

SEQ ID NO: 43469 - DNA, 117 bp, Homo sapiens
catatatttacaaatggctcagaatgaaaactcacaggaaagattacaaaaataagcttctctgtctttttttttttttaatccttctctgtcttttgagtcctggtgaatactatg

SEQ ID NO: 43470 - DNA, 58 bp, Homo sapiens; identical to SEQ ID NO: 454

SEQ ID NO: 43471 - DNA, 115 bp, Homo sapiens
tcttccaacattgggccaattgtcactgtaatttttctctagcttgaactatttatttttaagtatcttcaagtcagatttcatatacattgtatcttggagttggtgttgtaga

SEQ ID NO: 43472 - DNA, 113 bp, Homo sapiens
agaatgagactccatctcaaaaaaaaaaaaaaaagtaatatgagccatataaatcattttatatttttcttttttttttttttttttttcttcttgagacggagtctcactct

SEQ ID NO: 43473 - DNA, 116 bp, Homo sapiens
ggggagcctctcaatttcattttttgagatacttttgaggttgtagtagaataaaactatttattttagtaagccctagaagtgggtcatagataatggataacaaatttctaacc

SEQ ID NO: 43474 - DNA, 67 bp, Homo sapiens
gtgtcccacagtgtcactccctgagaacaccatcaatttgttctacaggaatgattggtgtgggccc

SEQ ID NO: 43475 - DNA, 118 bp, Homo sapiens
atcatgctattgcagtccagcctgggtgacagagtgagaccctagccctacaatctattttttttttttttagatggagtcccactctgtctcccaggctagagtgcagtggcgtgat

SEQ ID NO: 43476 - DNA, 95 bp, Homo sapiens; identical to SEQ ID NO: 68

SEQ ID NO: 43477 - DNA, 93 bp, Homo sapiens; identical to SEQ ID NO: 69

SEQ ID NO: 43478 - DNA, 88 bp, Homo sapiens
ctgcataatattccatggtttatatgtgccacattttcttttttttaattatactttaagttttagggtacatgtgcacattgtgcag

SEQ ID NO: 43479 - DNA, 112 bp, Homo sapiens
gccaggaacagacagttaagcaccacatattttcactcatatgtgaaaactgaaaatgttgatctcatagaagtaaaaagtagaacagaggctactggaggctgggaagggt

SEQ ID NO: 43480 - DNA, 90 bp, Homo sapiens
ggtataggctgtgcctctgtgagcctctctgtagtcctgacgtctctagttgacaggcagtaacttaagctgggggtgcacagtgtatcc

SEQ ID NO: 43481 - DNA, 83 bp, Homo sapiens
gttacttcatctgcaaaataaagattgtaatactgactatgggcggttttggtggttcagtggagtgatgtatgggaagtgac

SEQ ID NO: 43482 - DNA, 73 bp, Homo sapiens
ctcacacgtcctcacatctctatctggccaattctcttggggtcaaatatcttgagagctgagtgtatgtgag

SEQ ID NO: 43483 - DNA, 95 bp, Homo sapiens; identical to SEQ ID NO: 68

SEQ ID NO: 43484 - DNA, 93 bp, Homo sapiens; identical to SEQ ID NO: 69

SEQ ID NO: 43485 - DNA, 95 bp, Homo sapiens; identical to SEQ ID NO: 68

SEQ ID NO: 43486 - DNA, 93 bp, Homo sapiens; identical to SEQ ID NO: 69

SEQ ID NO: 43487 - DNA, 70 bp, Homo sapiens
gatttaaaaatgaaaacagtgaatattctttcacagaagctgaaagagtattttttttggtttttagatt

SEQ ID NO: 43488 - DNA, 79 bp, Homo sapiens
agtgttgagagagagaattgagtgtgttctggagggctggggaggcctcatggaggcaatcaggctgctgctgggctct

SEQ ID NO: 43489 - DNA, 77 bp, Homo sapiens
ggctcttcttaaattagatgtgtgtgtgtatatatatatatatatatattttttttttttaaatttaagacagagtc

SEQ ID NO: 43490 - DNA, 83 bp, Homo sapiens
ggctatggtatgtgggagagaataagggcagagaatctgacattttcactctcagacacagagactattcaactgtaaaagtc

SEQ ID NO: 43491 - DNA, 95 bp, Homo sapiens; identical to SEQ ID NO: 68

SEQ ID NO: 43492 - DNA, 93 bp, Homo sapiens; identical to SEQ ID NO: 69

SEQ ID NO: 43493 - DNA, 95 bp, Homo sapiens; identical to SEQ ID NO: 580

SEQ ID NO: 43494 - DNA, 93 bp, Homo sapiens; identical to SEQ ID NO: 69

SEQ ID NO: 43495 - DNA, 95 bp, Homo sapiens; identical to SEQ ID NO: 68

SEQ ID NO: 43496 - DNA, 93 bp, Homo sapiens; identical to SEQ ID NO: 69

SEQ ID NO: 43497 - DNA, 91 bp, Homo sapiens
gctttttgtgcatctattaggataatcatgtgttttgttttttattctattaatatgatacgttatgttaatggatttttgtgtattaagt

SEQ ID NO: 43498 - DNA, 115 bp, Homo sapiens
tgcaattcttaggctgtttctatcccagctattcccacttcagcacagcagtcttactctgtggctgagaccctgggaaaaccagttccttgtctcaatagccaggacccctgca

SEQ ID NO: 43499 - DNA, 128 bp, Homo sapiens
catttgtatgccttctttcgaaaaatgtctttttgggtcttttgcctatttttatatttatttatttatttagagatggagtcccactctgacacccaggttggagtgcagtggtgtgatctcagctc

SEQ ID NO: 43500 - DNA, 95 bp, Homo sapiens; identical to SEQ ID NO: 68

SEQ ID NO: 43501 - DNA, 93 bp, Homo sapiens; identical to SEQ ID NO: 69

SEQ ID NO: 43502 - DNA, 77 bp, Homo sapiens
gttttcaaggctgagaaatcccagagcaaggcaccgacacagtcagtgtctgatgagggttctgttccttgattcac

SEQ ID NO: 43503 - DNA, 97 bp, Homo sapiens
ggctgacacttctagaatcggtaaatgtaccaggagaaagtagccctaaattttgagcatatctttgtatatttttgtctcctctaggatcttagcc

SEQ ID NO: 43504 - DNA, 109 bp, Homo sapiens
gaaaaactacacagactattgcagaaatcatgaaaatctgaactatgtcctaaggtagtaggaatgaatagaagaatgtgaaagtgaagagtatgtaagtggtggtttc

SEQ ID NO: 43505 - DNA, 147 bp, Homo sapiens
tgtatatacatacacgtatatatacacagacatatacacatgtgtatatctatatgtgtgtgtatatatacatatatatgtgtatatatacatatatatgtatatgtgtatatatgtgtgtatatatacatatatgtataaatgcca

SEQ ID NO: 43506 - DNA, 85 bp, Homo sapiens
gaacacatgtatacatacatatacacatacatatatatcatcaattcaatatgtatatatgtgtaattatgatgtgggatatttc

SEQ ID NO: 43507 - DNA, 107 bp, Homo sapiens
tgcttaggattgtcttggctatgctggctctttttttattccatatgaaatttaaagtagtgtttttctaattctgtgaagaaagtcagtggtagcttgatgaagca

SEQ ID NO: 43508 - DNA, 97 bp, Homo sapiens
atatacaaatgtcatatacatatatatgtatatacatgactatatatgacatattatatatatgtatatatatgacatatatttgtgtatatatata

SEQ ID NO: 43509 - DNA, 116 bp, Homo sapiens
ggtcagccacagtagcagaaggagaggcaaagtatgtgtctacagaagagagcagattggtaaatgtggtagtgatagatgtggatactaactgatcagttgagagtgaggagatt

SEQ ID NO: 43510 - DNA, 101 bp, Homo sapiens
agtggaagaaatatgtcatttatttatttgtttatttattttgagatggagtctgtctctgtcacccaagcttgagtgcagtggcataatctcgactcact

SEQ ID NO: 43511 - DNA, 113 bp, Homo sapiens
gccgtgctcaggtgtaagctttcaataaagtctatctagacagaagttttgttttttggagtctccctctgtctcccagactggagtgcagtgctgcgacctcagctcactgc

SEQ ID NO: 43512 - DNA, 106 bp, Homo sapiens
ggctattgtggatcttttgtggttccatatacaatttagaactttttttttctgtaaaaaagtaattggtattttaatagggatttcattgaatctgtagatggct

SEQ ID NO: 43513 - DNA, 61 bp, Homo sapiens
cggtacctcagttggaaatgcagaaatcacccgtcttctgtgtctctcacgctgggagctg

SEQ ID NO: 43514 - DNA, 106 bp, Homo sapiens
atgactacagtgaaataatgaaaaatggggatgtaccagctgttgtttcttgacctttaacacaatgcctgttcattttagattttttcctcaatcactgtgttgt

SEQ ID NO: 43515 - DNA, 95 bp, Homo sapiens; identical to SEQ ID NO: 68

SEQ ID NO: 43516 - DNA, 93 bp, Homo sapiens; identical to SEQ ID NO: 69

SEQ ID NO: 43517 - DNA, 95 bp, Homo sapiens; identical to SEQ ID NO: 68

SEQ ID NO: 43518 - DNA, 93 bp, Homo sapiens; identical to SEQ ID NO: 69

SEQ ID NO: 43519 - DNA, 66 bp, Homo sapiens
tgcccttgagtcactgtctcggtgtctgcttctaagggaagcagctaatgcagggatttaacagca

SEQ ID NO: 43520 - DNA, 64 bp, Homo sapiens
gtacatgtacatgtacatgtatatgtatatgtatatgtgtatatatgtgtatatgtatatgtat

SEQ ID NO: 43521 - DNA, 60 bp, Homo sapiens
ggagactgagtctcgctctgtcaccccaggctggagtgcagtggcacaatctcagttcac

SEQ ID NO: 43522 - DNA, 81 bp, Homo sapiens
acatatatgtatatatacacacatgtgtgtatatatgtatacatacacacatatgtgtgtatatatgtatatgtacacaca

SEQ ID NO: 43523 - DNA, 113 bp, Homo sapiens
taacaacttgaagaggcaatcctttgtgactggagtcaatatgtgtttatttatcaagaatctataatattattgagctaaaatcctggggatagcttgtgatgccattgtta

SEQ ID NO: 43524 - DNA, 66 bp, Homo sapiens
tcgtcagtgttaatgagatagctagttgtttttatgattttcaggagagtttattggcattggcgg

SEQ ID NO: 43525 - DNA, 101 bp, Homo sapiens
ttctagacaaatttggtttggggcaggtgttgaggtttgattttttttttttttccaccctacaaacaggccccctacacagctggatgtgttggctagaa

SEQ ID NO: 43526 - DNA, 86 bp, Homo sapiens
gccaagcatgtagcccagtctctcagtgtcacttcatgttatgtatgtggaggaactgtgatgggagatcaatggccatgggaagc

SEQ ID NO: 43527 - DNA, 68 bp, Homo sapiens
gggttgcaaagatctgtgggagaagtgtggtttcctggatggggtcacacaatcactcactgcttccc

SEQ ID NO: 43528 - DNA, 94 bp, Homo sapiens
gcctgggcaacatggtgagactctgtcactacaaaaaaaaaatttattttatttatttatttttggagacagagcctcactgtgtcactcaggc

SEQ ID NO: 43529 - DNA, 66 bp, Homo sapiens
gtgaggctctgtctccaaaaataaataaataaaataaattttttttttgtagtgacagagtctcac

SEQ ID NO: 43530 - DNA, 58 bp, Homo sapiens; identical to SEQ ID NO: 1265

SEQ ID NO: 43531 - DNA, 100 bp, Homo sapiens
gcaggcagacaaaggttcccaagtgtgtgttggcttgcgtatactattgaaacaactgtgttttgtgtttgtggccactaagaatgcttgctgctttggc

SEQ ID NO: 43532 - DNA, 58 bp, Homo sapiens
tgagacagagtctcgctctgtcacccaggctggagtgcaggggcgcgatctcggctca

SEQ ID NO: 43533 - DNA, 116 bp, Homo sapiens
cactgcttccactgcatcccataagttttggtgtgttacagtttttctttttcttttttttttttttgagacggactcttactctgttgttgcctgggctggaatgcagtggcgtg

SEQ ID NO: 43534 - DNA, 119 bp, Homo sapiens
ctgggcaacaggagcgaaactctgtctcaaaaaataaaagaaaaaagaaaatgtcaagtaggttttttttgtttgtttttttttttgagatggactctcactctgtttcttttgcctgg

SEQ ID NO: 43535 - DNA, 76 bp, Homo sapiens
tggactcagttgctcagacactctcacagacatagctgctctgggctatgctgtctttggtgtctacaagaggaca

SEQ ID NO: 43536 - DNA, 115 bp, Homo sapiens
ttagtgggggtatggtggctcatgcctatagtcccagctacttgggaggctgaggtggaaggatctcttgagcccagaaggctgagactgaagtgagctgtgatcctgccactgg

SEQ ID NO: 43537 - DNA, 150 bp, Homo sapiens
gatacatatacgtatgtatcatatacatgtacagtatgtatatgtatttttacatacgtatatgtattttacatactgtatatgtatatgatacatacgtatatgtattttacatactgtatatgtatatgatacatatgtatatgtatt

SEQ ID NO: 43538 - DNA, 116 bp, Homo sapiens
ttgttcaagtgtatttgtttagctggatggtgagattagggatagatacataattacatttacattttgtatttatatttaatagtatatagttagttgtaaaaaaccatggataa

SEQ ID NO: 43539 - DNA, 61 bp, Homo sapiens
atattttagatacttcttcctgtagacatatctaaaatatctacagaagtatctaaaatat

SEQ ID NO: 43540 - DNA, 95 bp, Homo sapiens; identical to SEQ ID NO: 68

SEQ ID NO: 43541 - DNA, 93 bp, Homo sapiens; identical to SEQ ID NO: 69

SEQ ID NO: 43542 - DNA, 102 bp, Homo sapiens
gacagataagggacttatattgtaaaaatgccaagaaatttaatgttaaacacccttattcttttttttttttttttttttgagatggagtctcactctgtc

SEQ ID NO: 43543 - DNA, 80 bp, Homo sapiens
tatatataagtgcttgtatgtacatacatatatacctgtatatgtatgtatatacatatatatgtacgtgtttatatata

SEQ ID NO: 43544 - DNA, 118 bp, Homo sapiens
gtttgaataatgatgatagtcgagtgcactttttggcaaataatgtgtaaatttaatttttttttatattggcacatccattacagcctaactgctctgactttaacatgagaaaaac

SEQ ID NO: 43545 - DNA, 58 bp, Homo sapiens
tgagacggagtctcgctctgtctcccaggctggagtacagaggtgtgatgtcggctca

SEQ ID NO: 43546 - DNA, 61 bp, Homo sapiens
gggcagaggggtgcagggagggtcatgcactcacatctctctctctcaggttcctctgtgt

SEQ ID NO: 43547 - DNA, 82 bp, Homo sapiens
agaatctgagcccaggcaccctagtttatttgtttatctttgtatccccaatgcttagtacaaagtctggtgcatagatgct

SEQ ID NO: 43548 - DNA, 116 bp, Homo sapiens
tatgaatttaatttgcaaatattttgtgggtgtccagctgttttgttattgatttttagtttagttttattgtgctctgggaccacaataaaatagtttgtataatttcggttata

SEQ ID NO: 43549 - DNA, 95 bp, Homo sapiens; identical to SEQ ID NO: 68

SEQ ID NO: 43550 - DNA, 93 bp, Homo sapiens; identical to SEQ ID NO: 69

SEQ ID NO: 43551 - DNA, 79 bp, Homo sapiens
gctgacaccaccccttcctgactcactcctgcagtggctgtgcagcctgaagagtctgtgcacttaggggagggacagc

SEQ ID NO: 43552 - DNA, 109 bp, Homo sapiens
tttcacttagttaatattttacctggaaatacttattgctttaagttctataaatatttatttgagaaaagaagttgtattcatggaagtctgaatatttacagtgaaa

SEQ ID NO: 43553 - DNA, 79 bp, Homo sapiens
cggtctaacgtgctggggcgagaccaggtggggtcagtgccctgtctctgcctgactctgccaaaggagagtgggactg

SEQ ID NO: 43554 - DNA, 78 bp, Homo sapiens
gctggattgctgccccaccactttgcttgtcttctgggggctccactccagagagatgtgagtcagcaatcactcagt

SEQ ID NO: 43555 - DNA, 102 bp, Homo sapiens
gttgattatttgctgtaatcttcccaaaagccttatgaagtagaaactgttagtatcttagtttataaataagaaagttgagatacacagtgaataagaaat

SEQ ID NO: 43556 - DNA, 82 bp, Homo sapiens
gtctgcattattttcatttttagatctcattaggggaatactttattccttcagaatgggtttgtattttttttaagtaggc

SEQ ID NO: 43557 - DNA, 108 bp, Homo sapiens
attttagggttggaagggttcttgaagggatcttgaaagtgaacattttcagtcacataatgtttaaatttttcatatttttctttgatgatctttctcacctagagt

SEQ ID NO: 43558 - DNA, 68 bp, Homo sapiens
ggaggaggtatagagcagaagatactggcagctgcctgatctctgtctgtgtgtgctggatcccttcc

SEQ ID NO: 43559 - DNA, 112 bp, Homo sapiens
tagctgggcgtggcagcccacacctgtagtcccagctactcgggaggctgaggtaggaggatcacttgagccctggagtcagagattgcagtgagccaaggtcatgccactg

SEQ ID NO: 43560 - DNA, 116 bp, Homo sapiens
gtttaccagttttctggtgtcagagttgctttattaaactggtctctgacagtcccacagtatgttctgctgagatcagcctctgaagcttaaccatcttgtgagatctggaaagc

SEQ ID NO: 43561 - DNA, 84 bp, Homo sapiens
tctttatatgttgtgtgcccattaacaaaaatatataagattttttcttactttttttgttatttaagcaccaagcacaggaga

SEQ ID NO: 43562 - DNA, 112 bp, Homo sapiens
tttgcctgagaatgtacagtaaaataaaatttgaatttttttttaacatttcaaaattcaccaaggtttgttacatacactttcatttttagtagaaagtacattctccaaa

SEQ ID NO: 43563 - DNA, 68 bp, Homo sapiens
ggctcatagtaaatgtttaaatatttttaaataaacaagtattaatatttgagcacctactgtgtgcc

SEQ ID NO: 43564 - DNA, 115 bp, Homo sapiens
tcacgcttttggatactactataagcagtactattctgttaattttattttctaatttttgctgatagtgtacagaaatacaattaattttttagattgactttgtatcctgtga

SEQ ID NO: 43565 - DNA, 103 bp, Homo sapiens
gtgtttatcactttgttttacagtaaataagatgaacaagttttatattttacatataagtaaaattaactcatcaagtgagactggttaacatatgaaatac

SEQ ID NO: 43566 - DNA, 80 bp, Homo sapiens
gtatatatgtatatatgtttgtgtatatatgtatatatgtatatatatgtgtatatatgtgtgtgtatatatatgtatgt

SEQ ID NO: 43567 - DNA, 110 bp, Homo sapiens
tgattcttaatgattagcaggttaaatattgcatactttttagggacagagtctctgtttgtcacccaggctggagtgcagtggacaataacctcaagctgctggactca

SEQ ID NO: 43568 - DNA, 99 bp, Homo sapiens
ctgactgtttcatacagttctgtaaagctctgtctaaggactctttgactgatgagagtttgaacagatttcaaatacactgaactgtaacttcgttag

SEQ ID NO: 43569 - DNA, 91 bp, Homo sapiens
ctgtctctattttttaaaaggatgtatatggaaggtaaatttttaaaggatttgcatatctgatatatctttttttttttctttgagacag

SEQ ID NO: 43570 - DNA, 115 bp, Homo sapiens
tgaaggagagggcagtgccgaatgtcacgaatccacttctcacatgggcccttccaaggatctgtagagagtgtgcactcaggaaatatttgttaactgtcaaaaaagcatttca

SEQ ID NO: 43571 - DNA, 85 bp, Homo sapiens
ttcgtgggcattgtttgagaatagctgtcattcactctcagttttcaggaactctagtgtggcaagtattgttttgcttcatgaa

SEQ ID NO: 43572 - DNA, 93 bp, Homo sapiens
gccccatttgcatgggcagggtctctttttctttctttttttttttttttttttttttgagacagagtctcgctctgtcccccaggctggagt

SEQ ID NO: 43573 - DNA, 110 bp, Homo sapiens
gtgtgtgtgtttctgggggttagttttgctcctaagaattattcttttttaaaagttcagatggagtgattctaaggttcttcttgtcaacctcagtgaactgttcacac

SEQ ID NO: 43574 - DNA, 71 bp, Homo sapiens
gaagagtaaactcaaggctgggaaagtatttctttatataagcttagtgctttctatgttgtttacccttc

SEQ ID NO: 43575 - DNA, 88 bp, Homo sapiens
agttaactataatactatttgtatattaacaaatgtgtaggatttggaattctgccttcctacatcaaatactgttatatctgtagct

SEQ ID NO: 43576 - DNA, 113 bp, Homo sapiens
tacgcatctttccccaaatttctaaagttgtgccaagactgtgtgattttgttcttttcaataaaggcaatctgttaggtttagagtctagaggggaaaaccaaaagaacgtg

SEQ ID NO: 43577 - DNA, 159 bp, Homo sapiens
atatatgtgtatattgtacacacatattatatatgtgtatattgtacacacatattatatatatgtgtatattgtacacacatattatatatatgtgtatattgtacacacatattatatatatgtgtatattgtacacacatattatatatgtgtata

SEQ ID NO: 43578 - DNA, 134 bp, Homo sapiens
atatgtgtatattgtacacacatatattttatattatatgtgtatattgtacacacatattatatatatgtgtatattgtacacacatattatatatatgtgtatattgtacacacatattatatatgtgtata

SEQ ID NO: 43579 - DNA, 176 bp, Homo sapiens
acgtatatatatgtatatattacatacgcgtatataatatatgcatatattacatatgcgtatataacatatgcatatattacacaggtgtatataatatatacgcatataatatatatacgtatatattatatactatatataatatatatacgtatatattatatacactattg

SEQ ID NO: 43580 - DNA, 88 bp, Homo sapiens
agcttggaagccaggcattgacttcacctctcttttttttacttttttttttttttttgagacggagtctcgctctgtcacccaggct

SEQ ID NO: 43581 - DNA, 92 bp, Homo sapiens
catggccaatgcattctctcctgtgtctctttttctgattatgtgtgcttgggcggggttgggggagatattgtttgtgtgtgttgtttgtg

SEQ ID NO: 43582 - DNA, 58 bp, Homo sapiens; identical to SEQ ID NO: 38489

SEQ ID NO: 43583 - DNA, 120 bp, Homo sapiens
tgtgtgtatgtatatatgtgtatatatgtgtatatgtatgtatatatgtctatatatgtatgtgtgtgtgtgtacatacacatatatatatatatatatttttttttttttttttgagac

SEQ ID NO: 43584 - DNA, 79 bp, Homo sapiens
gagggctcacagaacaaagtcaggaataggcctcatggggtctttttctgcaacactactactctgtgacatggtcttc

SEQ ID NO: 43585 - DNA, 112 bp, Homo sapiens
ctataatcctagcactttgggaggctgaggtggtagggtcacttgagcccagttcaagatcacagtgagctgtcacggtgccactgcattccagcctgagtgaaggagtgag

SEQ ID NO: 43586 - DNA, 78 bp, Homo sapiens
tggaaggaatggctaagaatgggatgacagagcaaggaaagccttgattcatatcttctctatctgtcagctctgaca

SEQ ID NO: 43587 - DNA, 114 bp, Homo sapiens
atgttgacagtgtggtgttaaagcctcccattattattgtatggaagtctaagtctctttgtcagtctctaaggacttgctttatgaatctgggtgctcctgtattgggtgcat

SEQ ID NO: 43588 - DNA, 61 bp, Homo sapiens
ggaccaggattcaaaaccagagtccagctcaggagctcaagctctgggactcactgtgtct

SEQ ID NO: 43589 - DNA, 71 bp, Homo sapiens
ccacactcttaaaggctgcagaggggacttttgacctttgttgagttctgactctgtcatcaccagtgtgg

SEQ ID NO: 43590 - DNA, 71 bp, Homo sapiens
gctagaatggtagagctgggatttgaaggtgctcaatttggctccagggttcattcttttaaacattcagc

SEQ ID NO: 43591 - DNA, 119 bp, Homo sapiens
gtgtctttccaaacctgttgtacttcactgcatccttagcattctctctctttttttttttttttaaactttaagttctgggatacatgtgcacaacgtgcaggtttgttacatagata

SEQ ID NO: 43592 - DNA, 67 bp, Homo sapiens
cagtctcagtacagagcctatggtttctttgtttttgagacaaagtctcactctgtcaccaaggctg

SEQ ID NO: 43593 - DNA, 88 bp, Homo sapiens
atatatatatatatatatatatatatatactatatatatatatactatatataatatatatatgtatgtatgtatgtatgtatgtatg

SEQ ID NO: 43594 - DNA, 99 bp, Homo sapiens
acagccatgctagctgggagcagtggcttatacctggagtcccagctactcacagagctgaggtaggaggttcacttgagcccaggaggttgaggctgt

SEQ ID NO: 43595 - DNA, 85 bp, Homo sapiens
ggtgactcagtgactcagtgcctgaaagcccagcaccctgagaggtggaaatgggagtatcacttgaggctaggagttcgagacc

SEQ ID NO: 43596 - DNA, 97 bp, Homo sapiens
taactttattcttagtcttcatgttttaggacctagcacagtgtctcactcacattaggattttataatatgtgttattaagactacagaattgtta

SEQ ID NO: 43597 - DNA, 120 bp, Homo sapiens
ggtaggatttaactattaagcttggagtagtcaatatttgagctagaaatagaaattttatacttattttaatggggacttctatatttagttttatgagacttaaaagggcatcttgct

SEQ ID NO: 43598 - DNA, 101 bp, Homo sapiens
tctgggattacaggcgtgagccaccacacccggccaattatcttgtttttatttttactttttttttttttttgagtcggagtctcactctgtctcccagg

SEQ ID NO: 43599 - DNA, 58 bp, Homo sapiens
tgagacacagtctcactgtgtcacccaggctggggtgtagcagcgtgatgtgggctca

SEQ ID NO: 43600 - DNA, 58 bp, Homo sapiens; identical to SEQ ID NO: 2442

SEQ ID NO: 43601 - DNA, 113 bp, Homo sapiens
gccgagtgcagtggcttacgcctgtaatcccagcattttgggaggctgaggtaggtggatcgcttcagcccaggaggtggaggttgcagtgagctgagactgctgccctgagc

SEQ ID NO: 43602 - DNA, 65 bp, Homo sapiens
gtccacgatttaggtagagtcccaccttctagcaggtgagtctctctgcctgcctgtctctggtc

SEQ ID NO: 43603 - DNA, 56 bp, Homo sapiens
tgaggcaggaggatcgtttgatcccaggagtttcagatcagcctctctctgtctca

SEQ ID NO: 43604 - DNA, 115 bp, Homo sapiens
tgagggggttgtcaagcagggactgtagggactgttcacactcaaatttcttccttttattgttttttgtttgtttattgtcttcttttacagcctctggggatataatctgtca

SEQ ID NO: 43605 - DNA, 87 bp, Homo sapiens
taatcactagatttctctggtcctcagttctctatctgtaaactaagtaggttgaactagaagacctctaatttaatctagagattg

SEQ ID NO: 43606 - DNA, 60 bp, Homo sapiens
gatatacatatataaatatatattcatatataagagtttatgtgtgtgtgtgtgtgtatc

SEQ ID NO: 43607 - DNA, 67 bp, Homo sapiens
gtgcttttttattttagtttttgaaaaagagtctcgctctgtcacctaggctggagtgcagtggcac

SEQ ID NO: 43608 - DNA, 106 bp, Homo sapiens
atggatgctgttattgtgggagtgggtttgttttaaaagtgagtgtggccctgtcttgctatctctcacacactttctcactctttctcgtgcacgcacttgccat

SEQ ID NO: 43609 - DNA, 60 bp, Homo sapiens
ttgagccagggtctcactctgtcacccaggctggagtgcagtggtgtgatctcggctcaa

SEQ ID NO: 43610 - DNA, 79 bp, Homo sapiens
tgcccaactccaaagacagcctgatttttttcttttaaaacccagacccagaagcaggtcattttggggtggtttagca

SEQ ID NO: 43611 - DNA, 75 bp, Homo sapiens
acttgtttttttgtgtgaccagagagagcccacagcacacagccgggttctcattggaaaggcatcagaacaagt

SEQ ID NO: 43612 - DNA, 69 bp, Homo sapiens
gggaccttttgagtctcactctgtcacccaggctgaagtacagtggcgcgatctaggctcactacaccc

SEQ ID NO: 43613 - DNA, 58 bp, Homo sapiens
gagactgagtctctctctgtcacctaggctggagtgcagtggcgcgacctcggctctc

SEQ ID NO: 43614 - DNA, 102 bp, Homo sapiens
tgtgtgtgtgtgttttggttttggttttgtgtgtttttgttttgtttttttgttttgagacaaggtctcaccctgtcgctgaagctggaatgcagtggcaca

SEQ ID NO: 43615 - DNA, 115 bp, Homo sapiens
tgcacttcagcctgggtgacagagcgagaatcccatctcaaaaaaataaaattataagatttttttttttttttttcagacaggggtttctctctgtcacccaggctggaatgca

SEQ ID NO: 43616 - DNA, 92 bp, Homo sapiens
cactagggaggctgaggtaggaggatggcttgagcccgtgaggtcaaggctgcagggagccgtagttgtaccactgcactccagcctgggtg

SEQ ID NO: 43617 - DNA, 98 bp, Homo sapiens
ccatcctctctgtttatttcaatataggttaaaggaaagcaataacagaatttctcaggtttttgtttattttattttgagaggtagggggattatgg

SEQ ID NO: 43618 - DNA, 121 bp, Homo sapiens
gtgaagacatttgctggagggtgcagactggcagagcttgtgcacacaagatactgagctgagcagtgcccagcttccttcacactgctctgctggctccgaggccatgaacaggaagggt

SEQ ID NO: 43619 - DNA, 115 bp, Homo sapiens
gggtccaggagtttgagatcagcctgggcaacatggtgaaaccccgtcagtatttttttttttttttgaaacaatctcactctgtctcccaagctggagtgcagttgccggaact

SEQ ID NO: 43620 - DNA, 79 bp, Homo sapiens
tgtgtatatatgtatatatgtgtatatatgtatatatattcgaatatatatgtgtgcatatatatatatatatatacac

SEQ ID NO: 43621 - DNA, 78 bp, Homo sapiens
tggtcaatacagttacattcaaaatgggttcttacatggggatgtccaatcacattttgaaagtatttgtaaacccca

SEQ ID NO: 43622 - DNA, 99 bp, Homo sapiens
cagattattttggtacattatcttttatctttttatatgacagctggggacccagcctcaagaagataacctttaagatttatagaaataaaaagtctg

SEQ ID NO: 43623 - DNA, 99 bp, Homo sapiens
ttatttgtgtcattgtatttcatacttgtctcttataaacagcatataactaaattattataaatttaagaggccaagtgtggtggctcacacctgtaa

SEQ ID NO: 43624 - DNA, 80 bp, Homo sapiens
gtgtttatattacatgcatatctgtaagtttttttttacatagtaaaaatcaaacacagccaggtatgtaattccggcac

SEQ ID NO: 43625 - DNA, 97 bp, Homo sapiens
actgaaagtgagatgagatgggctccttttccagctccatcactccctgagtctctgagaagcttgagaatgagagcctggtctgtagctgtccagt

SEQ ID NO: 43626 - DNA, 58 bp, Homo sapiens
ttcatgctctcacagcctctctctgctggtatcctgatctggggttggagtgggtgga

SEQ ID NO: 43627 - DNA, 82 bp, Homo sapiens
tctccttggcttggctgcattctcaccatatggcaggcatatttagtacacagaaacaagagtgaacagcttgccaagtagg

SEQ ID NO: 43628 - DNA, 59 bp, Homo sapiens
tgagacagagtctcgctctgtcacccaggctggaggacagttggcgcgatctctgctca

SEQ ID NO: 43629 - DNA, 102 bp, Homo sapiens
agcagtgtttaagagttctgttgctccacatctcagacatatatatatatgtatatagagggagagagagagggagagcgagagccagagagagcgcatgtt

SEQ ID NO: 43630 - DNA, 76 bp, Homo sapiens
ttacactggctgtgacacgagctcagccgagagtgtatttttattttaacaaggctgagtaagtacatgagtgtgg

SEQ ID NO: 43631 - DNA, 82 bp, Homo sapiens
ggcctgtccagttcgaagacaatgacccatgattgaccacggcactcttgcctcagtctctaagtcactgtctcctggggcc

SEQ ID NO: 43632 - DNA, 56 bp, Homo sapiens
gagacagggtctcactctgtcacccaggctggagtgcagtggtgtgatcatagctt

SEQ ID NO: 43633 - DNA, 67 bp, Homo sapiens
agttaggagaagtttatggaggaagtgagtcagtatctcacaggatctcacagagaaacttctaact

SEQ ID NO: 43634 - DNA, 105 bp, Homo sapiens
gaatggagcagggatgtttctgcagatccttttagtgtgttttactggtaaatgcattttacttataatattttttaaatgggagacataatcttttcttcattt

SEQ ID NO: 43635 - DNA, 111 bp, Homo sapiens
tcccctgcctagagatggccccaactgctaagaggaaaagttaacttcaggtgaataacattatattttttagaaaggtaagtggtttctttggtgaactagaacagagga

SEQ ID NO: 43636 - DNA, 69 bp, Homo sapiens
gagaagctcaagaggctgatgaaggattaagagtcacctctctcatctccatctcactctctgtctctc

SEQ ID NO: 43637 - DNA, 61 bp, Homo sapiens
tcctcctgggtgcgggaaccaggctctctgctctcagtgcctctctgtatcacagtgaggg

SEQ ID NO: 43638 - DNA, 118 bp, Homo sapiens
atatatatactataaacagtataagtatttatatactatatatagtatatatactataaaaactatatgtatttatatactataaacagtatatgtatactgtaaacagtatatgtat

SEQ ID NO: 43639 - DNA, 85 bp, Homo sapiens
gaaccagagtgggccagaagaaaggcatctcctccctgataggttcttactgaatgctctgtctgactggttctctcactggctc

SEQ ID NO: 43640 - DNA, 110 bp, Homo sapiens
gaagaggcttggaggcaagataaaggcaaggggcagtcattggggattcatggaatagatgtctctctaaatgtctctcatgtcctggtggccattccatctgtcacttt

SEQ ID NO: 43641 - DNA, 95 bp, Homo sapiens; identical to SEQ ID NO: 68

SEQ ID NO: 43642 - DNA, 93 bp, Homo sapiens; identical to SEQ ID NO: 69

SEQ ID NO: 43643 - DNA, 79 bp, Homo sapiens
tgcactgtataaatgtgagttcttattgtgttgaattcccaagaatatttagcatcttttgaaaaatatttgtattgca

SEQ ID NO: 43644 - DNA, 92 bp, Homo sapiens
gagcctttcaaaaactcagggtctgtgtgtctgggcactgtgaacttgaaagaaagccttcaccctgtccctgataaccttgtgttgtcctc

SEQ ID NO: 43645 - DNA, 73 bp, Homo sapiens
atgtgtgtgtgtgtgcatacacagtgtgtgaggaaatgactttgtaattgtatatgtaacatatttcacacat

SEQ ID NO: 43646 - DNA, 71 bp, Homo sapiens
tgtctgagtcgcattttcatctctagaaactggaagaagttctaagagtgtgaggtaatgactcaaggaca

SEQ ID NO: 43647 - DNA, 106 bp, Homo sapiens
gtaacagaataattgccatatccagtatctatgtctgtgtctgtatcactgagtggattgttggctactgcggggcagggtctgggacagagtaggtgcttgtatg

SEQ ID NO: 43648 - DNA, 103 bp, Homo sapiens
taatgttcctttgtttccgctaagatctttattttttacatttaaatatttgagccacctgagatttatttttatgtaagaagtgagagtggaaccagcatta

SEQ ID NO: 43649 - DNA, 99 bp, Homo sapiens
atatgtgtctgtgtatacgtgtgtgtatatatatatatgtatgcatatagacacatatgtatacatatatacacacacacacatgcatatatacacaca

SEQ ID NO: 43650 - DNA, 113 bp, Homo sapiens
tgcctgacacaatatgtatgtgtgcatgtgtgtgtatatttatatatgtggctgtgtatatatatgtatatgtataaataaattcactttgcacagaaccaattatttttgtt

SEQ ID NO: 43651 - DNA, 114 bp, Homo sapiens
aggctgccccaggtagagcttctataccatagatgttttctctgaaactctgtgtcagaggatggaaatgagtaggaaatattatggtacagaggatttataatctcctagcct

SEQ ID NO: 43652 - DNA, 104 bp, Homo sapiens
atatctctttaaataagtaattgcatgtgtgtgtaaatatatttaaattatatatgtatgaatatatatgtacatcaacatggaattactagatcgagtggtat

SEQ ID NO: 43653 - DNA, 58 bp, Homo sapiens
tgaggcagaatctcactctgtcacttaggctggagtgcagtggtgtgatcttggctta

SEQ ID NO: 43654 - DNA, 66 bp, Homo sapiens
tgtgtgtgtgtgtatatatatatgtgtgtgtgtatatatatgcatatgtatatatatgcatatata

SEQ ID NO: 43655 - DNA, 60 bp, Homo sapiens
cagtacagcatagaattcagagtgcagtctctagaggcctactctgtctgtgtctgtgtg

SEQ ID NO: 43656 - DNA, 98 bp, Homo sapiens
caagttgcaataagcttagagttttttttttttttttaaaggatacaggtatgtttgtccttggtgaaatgcagaaacctttctagggatccaacttg

SEQ ID NO: 43657 - DNA, 86 bp, Homo sapiens
gaggaatagcaattttgtagtgagaaggtctgggcaagggtctcagggatgccctcacctctctcagtctgtctccttgatgcgaa

SEQ ID NO: 43658 - DNA, 86 bp, Homo sapiens
attcagttcagattttgctgccaaatgtctttgtttcaaagttttgcaaaatcttttggttttcagagccttctgaatttttgaat

SEQ ID NO: 43659 - DNA, 87 bp, Homo sapiens
tatgtgtgtatatatatgtatgtgtatatatgtgtatatttgtatgtgtatatatatgtgtgtatatgtatgtgtgtatatatgtgt

SEQ ID NO: 43660 - DNA, 73 bp, Homo sapiens
tctgtatgtgtacatatatgtacgtgtgtatatatgtatgtgtatatatatgtgtgtgtgtatatatatatga

SEQ ID NO: 43661 - DNA, 94 bp, Homo sapiens
ggtttcctccctgtgcctcagttactctgtggttcaagtatgtatgcatagaaacagtagttgttgcaggtcactttggtacaattgctatacc

SEQ ID NO: 43662 - DNA, 94 bp, Homo sapiens
tatcaagagaccatggctggattaagctagataataattttgaggtataccaaaattcttttgttttgatttttatatgtgtattttcttggtg

SEQ ID NO: 43663 - DNA, 111 bp, Homo sapiens
ggagtgccagaggcaggggcctggatatgggcgaaggcagaagtgtgtgtgcacacagtaaacaaggtgaaatacttctgttctggtatttatagtcctaactctaactct

SEQ ID NO: 43664 - DNA, 103 bp, Homo sapiens
tctatgggattatagagcagtttagtgaggaattttaaatagatgttgtttaatattatatatttatatttcaattcactgtctagcttttacataaaataga

SEQ ID NO: 43665 - DNA, 103 bp, Homo sapiens
gtctttaacagtagacagtgtgtgtctgtatatatatacacacatacatatatatatatgtatatatatatataggctggacatttttatttctattacaggc

SEQ ID NO: 43666 - DNA, 95 bp, Homo sapiens; identical to SEQ ID NO: 68

SEQ ID NO: 43667 - DNA, 93 bp, Homo sapiens; identical to SEQ ID NO: 69

SEQ ID NO: 43668 - DNA, 113 bp, Homo sapiens
ttgttcaacacaactagagtatggggtactggaaagaatacagagcagggagtcaggacacttgggtttgggtttttgctctgacagtcactaacttgtgggactttgggcaa

SEQ ID NO: 43669 - DNA, 117 bp, Homo sapiens
tgagatctgtaacccacattcctctgactttgaatttaaactctgcttaagaaatgaatttgttattgacaatgatgtttgtagagttgctacagagtgcccagggcccacaatcca

SEQ ID NO: 43670 - DNA, 68 bp, Homo sapiens
tgaaacttctcatgtcagtctttatttttttaaatcatggaagaaggtgaggttgagtaggagtttca

SEQ ID NO: 43671 - DNA, 125 bp, Homo sapiens
tccttcactggctcctggagtttgtgccactgaatggggagccccagagtgtctgagcatgtccaactgggctgatggggaccttccaggcctgtttcctggatgctgcctggtgacacctgggg

SEQ ID NO: 43672 - DNA, 87 bp, Homo sapiens
gagtgcggtgcagggctctctgtgtgactgtcatgaaggcctgtctgtgtgactatcagggagaattggcctgccacaaaaggattc

SEQ ID NO: 43673 - DNA, 59 bp, Homo sapiens
gcatatatgtataggtatgtatacatgtatatatgtgtatgtatgtatatatgtgtagc

SEQ ID NO: 43674 - DNA, 114 bp, Homo sapiens
tcttaatttcctgtttcttttgtacttaggatttaacaatacggttgtgatttagatgttgctatctgtaatagggcttttctttattgtttaaaagctaattagggaaaaaga

SEQ ID NO: 43675 - DNA, 73 bp, Homo sapiens
gggcaaggaagacaggcaaggctgctgtaggcccagtctagaagcagtctctcactgacacccatctttgctc

SEQ ID NO: 43676 - DNA, 87 bp, Homo sapiens
tacttatggaagaataaactcaaaataaaagcaaatgagtaccagtactcatttgctagtttgttattttattttttgacaaaagta

SEQ ID NO: 43677 - DNA, 82 bp, Homo sapiens
ttgccagcctggctttcagactgtgctctggtgatgtcgtttcgctggagagggcagagatctgagtgggcagagtgggcag

SEQ ID NO: 43678 - DNA, 82 bp, Homo sapiens
ggatttcaccgggatgtcttctatctggcagaccacctgagattctcactgtcagacaaagggagcaaattctgtgagattc

SEQ ID NO: 43679 - DNA, 111 bp, Homo sapiens
taggctgcacagggtccgagtggggattttaattgttgccagggtatacacactcagtgtgtcatacatcacctcattacatctccccggtaatcctgcaaattaagcacc

SEQ ID NO: 43680 - DNA, 104 bp, Homo sapiens
cgtggtttggctcctaactggcagataacattggacagaacggtgacaaactctgtgcctctgtgtttctcatctgtaaacggggttaataaaacttgctcatg

SEQ ID NO: 43681 - DNA, 103 bp, Homo sapiens
ttctttcatatttgctactgttccatgatgattccaggtgctctgtgattctcactctctcacactagggcctatatatatatcattctgcagatattaagaa

SEQ ID NO: 43682 - DNA, 111 bp, Homo sapiens
cctggatgccttttctgcaggcctctgtgtgatatgtttgatatattaggttgttatttaatccaactatatatcaaacatattcctacagtgtcttgccctgtctccggg

SEQ ID NO: 43683 - DNA, 64 bp, Homo sapiens
ccacgaacggtcaggtttctgtggcgcctctccatttgagaggctctctgaaagccagtcgtgg

SEQ ID NO: 43684 - DNA, 109 bp, Homo sapiens
caggtttatttgtatatctcagaaggttttctgtgatcgtgatgtttggcttttgttgaatatttattttgatacattggctttcagttttaggttaaaatatattttg

SEQ ID NO: 43685 - DNA, 140 bp, Homo sapiens
gcagcgcctgccgggtgggagggaacctgtgtgtgcgcgcacacactgttcacgtcatagtgtctccgtgtgtgtctgcgtctatgtatgtgtctctatgtgtctgggtatttctgtgtgtctgtgtgtgcatctctgca

SEQ ID NO: 43686 - DNA, 114 bp, Homo sapiens
gtacatgtttctgtgtgcgtgggtctgtgtctatgtgtgtatacatctgttcatatttctgtgtgtgtctgtctctatgtggctgtgtctctgcatatctttgcatatctgtac

SEQ ID NO: 43687 - DNA, 80 bp, Homo sapiens
gctgtgtctgtctgtggctgggagcggggtcaggagtgcttttggagtccctggttttctaagaataggaggttcacagc

SEQ ID NO: 43688 - DNA, 103 bp, Homo sapiens
cagtgcctgcactcacagatataggcatgggggctcagagaattttttaaatttttaaattttttgtgggtacatagtaggtgtatatgtttatggggtaatg

SEQ ID NO: 43689 - DNA, 86 bp, Homo sapiens
cctgccggtctcagagcctcagtgtgtgcctgggcagtgtgtgcctgggcagtgtgtgctgtgctgaggcgtgtgggctgtggagg

SEQ ID NO: 43690 - DNA, 91 bp, Homo sapiens
gcaatgggccattagggatttctgttcagtcacatcacagtctgctcagctaaactgtaaggctgggcctggtatacagaggtaggccagc

SEQ ID NO: 43691 - DNA, 88 bp, Homo sapiens
ggagtagagaactaaggggcgtgaggtaagagatgaggctgaggactgaccatccagtaccttatctccttctgctgctatttcttta

SEQ ID NO: 43692 - DNA, 120 bp, Homo sapiens
gctgatcataattttattcttgtgttaaggacttggaataaggacagttgcaaagttaactcaatttgttgatgtattgcctgtgttctttttctgaatgctgaagtaaaatattccagt

SEQ ID NO: 43693 - DNA, 57 bp, Homo sapiens
gggacagggtctcactctgtcacccaggctggagtgcagtggtgtgatcccaggctc

SEQ ID NO: 43694 - DNA, 74 bp, Homo sapiens
tctactgagcacctagacagcctggcctgaagattatatatattatctttagagtcagatggttctgagttaga

SEQ ID NO: 43695 - DNA, 58 bp, Homo sapiens
tgagatggagtctcactctgtcactcaggctagagtgcagtggtgcgatctcggctca

SEQ ID NO: 43696 - DNA, 117 bp, Homo sapiens
ggctgtgcagctaattaccacctttctaaagtaatctctgcctgaaatgtactgtggctggagcagttcaatttcagcattgaatatgaagtgaccatgggctccgcaggcacacag

SEQ ID NO: 43697 - DNA, 67 bp, Homo sapiens
gagtctcactctgtcacccagtctggagtgcagtggtgcagtcatagctcgttacagcctggaactc

SEQ ID NO: 43698 - DNA, 88 bp, Homo sapiens
gggtgacagagaccctgtctctaagatttttttttagttttttgtaactatatttatttttttgagacagggtctcattctgtcaccc

SEQ ID NO: 43699 - DNA, 98 bp, Homo sapiens
atgcagcagaatatcttcccttttctgacccacacatatatctatttttatatggcttggccattccaaagttgagggatagggatggatgcgggtat

SEQ ID NO: 43700 - DNA, 95 bp, Homo sapiens
aggtgcgtctgttcaaagaataaggaagatagaggaataataggttattctttttttctctctcacttttttttttttttaagagacagctgctt

SEQ ID NO: 43701 - DNA, 58 bp, Homo sapiens
tgagacagagtctcgctctgtcacccaggctggagtgcagtggcgcgatttctgctta

SEQ ID NO: 43702 - DNA, 111 bp, Homo sapiens
acaattccttagtctttctttgtctttcacgagcttgacatttcatgagtattatttaattattttattgaatatctctgtcatttttttcaggatgggattgagttatgt

SEQ ID NO: 43703 - DNA, 88 bp, Homo sapiens
ggctatataatgtatgattctatttataagaaatgtacagtacaggatggccaaatgcttagagatagaaagtagattagtagttgcc

SEQ ID NO: 43704 - DNA, 117 bp, Homo sapiens
gtcagccacccagtttatggttattttgttatacagcagcctgaatgaactgagagaggaaattggtaccaagtgtggagtgctactgtaacagacacctaaaaatgtggaagctgc

SEQ ID NO: 43705 - DNA, 83 bp, Homo sapiens
ttgtggttataggggagaatgtccttaattctttttttttttttttttttttttttgagacagagtctcactctgtcacccag

SEQ ID NO: 43706 - DNA, 58 bp, Homo sapiens
gcccaggctggagtgcagcggtgcaatcacagctcactgcagtctcagtctcctaggc

SEQ ID NO: 43707 - DNA, 72 bp, Homo sapiens
ggccaggcatggtggctcacacttataattccagcactttgggaggctgaggtaggtggatcacttgaggcc

SEQ ID NO: 43708 - DNA, 72 bp, Homo sapiens
ggcctcccaaaatgctgggattacaggcatgaaccaccgcgctcggcctgtaattttattattaatgaggtt

SEQ ID NO: 43709 - DNA, 114 bp, Homo sapiens
cacctgaacagttagtctccttccatcaagcatatgagatgagaattaaattattggtaacactttttttgtttttttttttgagatggagtctcactcttgttgtgcaggctg

SEQ ID NO: 43710 - DNA, 100 bp, Homo sapiens
gcttcagaaatccctcagggacaaggtaccaatctcaagactcatggttttatttatttatttttgagacggaatcttgctctgtcgcccaggctggagt

SEQ ID NO: 43711 - DNA, 72 bp, Homo sapiens
ctgggcatggtggctcacatttgtagtcccagctacttggtaggctgaggtggaaggatcacttgaacccag

SEQ ID NO: 43712 - DNA, 490 bp, Homo sapiens
atatatttatatgtgtatatatacacatatatatgtatatatttatatgtgtatatatacacatatatatgtatatatttatatgtgtatatatatacatatatatgtatatatttatatgtgtatatatatacatatatatgtatatatttatatgtgtatatatatacatatatatgtatatatttatatgtgtatatatatacatatatgtgtatatatttatatgtgtatatatatacatatatgtgtatatatttatatgtgtatatatatacatatatgtgtatatatatacatatatatgtatatatttgtgtgtatatatatacatatatgtatatatttgtgtgtatatatatacatatatgtatatatttgtgtgtatatatatacatatatatgtatgtatttgtgtgtatatatatacatatatatgtatttgtgtgtatatatacacatatatgtatatattgtgtgtatatataca

SEQ ID NO: 43713 - DNA, 100 bp, Homo sapiens
cctagcagcacagtacctattaattagtagtagggcttcagtacattttttttcataaatcctgaagtaactattaagttctgggacagtggttcaaagg

SEQ ID NO: 43714 - DNA, 75 bp, Homo sapiens
atctcagagtatatacacacagacacacacacacacatatatatatgcatgtctgtgtatatatattttaaagat

SEQ ID NO: 43715 - DNA, 108 bp, Homo sapiens
agagatcagctgtgggaaggaaacaatttctacattctcccatctgaggcttctgcagaggtagtagcatgtagagttccataccagccttcctcacaggcatcctct

SEQ ID NO: 43716 - DNA, 112 bp, Homo sapiens
ctactgcctgatagcatgttatttctgcgtgtgtttatctcaactggattgtaaagtgtgtgagaacagattgagatcatgtcttctatttctataatatgtatctccatag

SEQ ID NO: 43717 - DNA, 73 bp, Homo sapiens
gggacaggaaagtcactgcctgcctgtaatcccagcactgtgggaggacgaggcaggcagatcacttgagccc

SEQ ID NO: 43718 - DNA, 77 bp, Homo sapiens
tctactgcctgcctgtgtgcctggcaagggttgcagttgccgccactgccatacaataccctacagaagggactaga

SEQ ID NO: 43719 - DNA, 67 bp, Homo sapiens
ggatactggcataggagctgagaccattttttttttttttgagacagtctcgctctgttgccaggct

SEQ ID NO: 43720 - DNA, 65 bp, Homo sapiens
ggtcaaggtcacagactgggtaatttcttttttttgagaaggagtctcactctgtcacccaggct

SEQ ID NO: 43721 - DNA, 103 bp, Homo sapiens
gtttaagcttccacgttttgcactaagataggcctggattcaaactttgatacattttatatttgtttctatggctttggacaagtgatgagggactctgagc

SEQ ID NO: 43722 - DNA, 82 bp, Homo sapiens
agcctgtggctcacagaggggcattttcgttttttttttgttttttttttttgagatagggtctcactctgtcacctaggct

SEQ ID NO: 43723 - DNA, 96 bp, Homo sapiens
gtggagtagaaagacctgtattcaagtgtgggctctgattggcagaggaattcctctgcctctcagggcctcactcagtgtcctcatctattccat

SEQ ID NO: 43724 - DNA, 117 bp, Homo sapiens
gtgctgggattacaggtgtgagccactgcgcccggccgtcctcattcttttttatagttacatagtattccattgcatggatgggccacagtttattacattgtctcctagttaagc

SEQ ID NO: 43725 - DNA, 112 bp, Homo sapiens
gcttgttttttcatcctcttaacagatcctttgcagagcaaaattttttgattttgatgaggtccaattaatcaaatttttgcttcaatggatcatgtttctggtgtcaagt

SEQ ID NO: 43726 - DNA, 61 bp, Homo sapiens
ctccacagtgtcactctgtgggtggcagcacactaaccagggtcactggcatcactaggag

SEQ ID NO: 43727 - DNA, 58 bp, Homo sapiens; identical to SEQ ID NO: 6359

SEQ ID NO: 43728 - DNA, 84 bp, Homo sapiens
tgttgagtcaagcccactgtgcataatgacctgggtggcatttggctgtctcctgtctctatcactgtgttctagatttttata

SEQ ID NO: 43729 - DNA, 58 bp, Homo sapiens
tgagctggagtctcactctgtcacccaggctggagtgcagtggagcgatctcagctca

SEQ ID NO: 43730 - DNA, 58 bp, Homo sapiens; identical to SEQ ID NO: 1101

SEQ ID NO: 43731 - DNA, 56 bp, Homo sapiens; identical to SEQ ID NO: 1102

SEQ ID NO: 43732 - DNA, 117 bp, Homo sapiens
gtctcagttttgtccctcccattcacaggcaagtaagcactcttttttttttttttaattttttttttaagacaagatctgactctgttgcctaggttggagtggcatgatcatggc

SEQ ID NO: 43733 - DNA, 77 bp, Homo sapiens
attgggccaggctggggtacaggaccagggttttaatttggcttgggcttctgactctgactctgagccagtccaat

SEQ ID NO: 43734 - DNA, 107 bp, Homo sapiens
tactatatatatatatatatatacacatacatacatatatatacacatacatatatgtatgtgtatatatatgtatgtatgtgtatgtgtgtatatatatgtatgta

SEQ ID NO: 43735 - DNA, 115 bp, Homo sapiens
attcgatttgcaaacactttaaagtgacatattttaatccatttatctgatatatattaatatttgtcaagggtccactgtgtgtcaggccttcttttagtgctggaggtagagt

SEQ ID NO: 43736 - DNA, 58 bp, Homo sapiens
tgagacaagatcacacactgtcactcaggctggagtgcagtggtgtgatcacagctca

SEQ ID NO: 43737 - DNA, 90 bp, Homo sapiens
ctttagggggtgaagtggaggccttgctgcccaggactttttttttttttttttttgagacagggtctcactctgtcatccaggctggag

SEQ ID NO: 43738 - DNA, 60 bp, Homo sapiens
ttgagacagggtctcactctgtcacccaggctggagttcagtggtgcgatcttggctcag

SEQ ID NO: 43739 - DNA, 71 bp, Homo sapiens
ggaggctgaggttggaggatctcttgagcccaggatttcaaggccaagatcactccactgcactccagcct

SEQ ID NO: 43740 - DNA, 70 bp, Homo sapiens
cttcctctgtagctgccagcatcttggaaagaggggccccaaatctccagatgcctgcagccaagggaag

SEQ ID NO: 43741 - DNA, 115 bp, Homo sapiens
ggacagacaggtcagtgtggactcgagttgagttttaagggagtctatgttttttattatgataaaatatacataacataaaatttaccattttatctactttttttgtttgttt

SEQ ID NO: 43742 - DNA, 81 bp, Homo sapiens
ctagattatttctcatatggtgacttctttatgtttatatttctcagatgacactggaagttacttgaggacagaaactag

SEQ ID NO: 43743 - DNA, 86 bp, Homo sapiens
agcacacgttactggcatgccaaagaactgaatgaagtgtgtgtgcagcttattttgtcttttttcatgctacagttacctatgtt

SEQ ID NO: 43744 - DNA, 69 bp, Homo sapiens
ttgtttgagacagggtctcactctgtcacccaggctggagtgcagtggtgtgatcctggctcactgcag

SEQ ID NO: 43745 - DNA, 58 bp, Homo sapiens; identical to SEQ ID NO: 25570

SEQ ID NO: 43746 - DNA, 82 bp, Homo sapiens
gtagctggagaggtgatgaggaggggtaaaggctgtgacctataggtcctgtcacctgcctcactgagtcactcacagcagc

SEQ ID NO: 43747 - DNA, 115 bp, Homo sapiens
tacttttaaacattaaagtaatacaacttttccttgccaggttaatgttacgtgatgtaatattttttaattgaaattaacagtggtaagagtgtatactgtgtttattatggta

SEQ ID NO: 43748 - DNA, 84 bp, Homo sapiens
tctgaaacagattgtggagtcaaaggtatgcacttgagtagatactttatagtttatcatttatacccacagtttggactcaga

SEQ ID NO: 43749 - DNA, 65 bp, Homo sapiens
gcctggctagctaggtggtgtttttcgtttgttttcgagaaagagtctcactctgtcacccaggc

SEQ ID NO: 43750 - DNA, 111 bp, Homo sapiens
gccaggaatggtgacatgtgcctgtagtaccagctactcgggaggctgtggtaggaggatcatttgagcccaaggggttgaggttgcagtgagccatgatcacatcaccgc

SEQ ID NO: 43751 - DNA, 108 bp, Homo sapiens
ggacagcaggaatagggtgggctgcagaggctccaagtgctgaagaggcataaggagcaggcagtctctcagtcacagcctccctaggctcacccttggcaagtttcc

SEQ ID NO: 43752 - DNA, 92 bp, Homo sapiens
gggaagcatgtcagtacccaagtggccttggtgagccagccctgtctgctcttagcctcaccctcccactcaggctctgtgcttgctttgcc

SEQ ID NO: 43753 - DNA, 112 bp, Homo sapiens
gccttgtttgcctgaaggactctcttctatctctggctgggtccctgattcggaaggattgagacagcccctcagagttttgagacattccctgttacaggctgaattatgt

SEQ ID NO: 43754 - DNA, 102 bp, Homo sapiens
gcttcagccttggatgttggttaacctggtgtgtctgtccctctctctagactgtgagctcctgaggagagaccacatctgttcatcccgtgtcctcgcagc

SEQ ID NO: 43755 - DNA, 102 bp, Homo sapiens
tgtttaggctgggtgtgctggctcatgcctgtaattctagcattttggaaggctgaggtaggaggatcgcttgaggccaggagtttgaggccagcttaggca

SEQ ID NO: 43756 - DNA, 101 bp, Homo sapiens
tgggcatttaggttgcttcagtgctgtggcaagcatctctctttctctctttttttttggagacagagtctggctgtcacccaggctggagaggatgctca

SEQ ID NO: 43757 - DNA, 74 bp, Homo sapiens
catttaaggaggcactcactctcagggtctgcaaatgcagggtcagcatctgagagtgcgggcttccttaaatg

SEQ ID NO: 43758 - DNA, 87 bp, Homo sapiens
tgtagcatgagggggctctagttaagttgtctagctctacggccacaatttaattacattctcactctgcctctccatttaaataca

SEQ ID NO: 43759 - DNA, 105 bp, Homo sapiens
gagagggtagaaaggagcaaaggtgcttagggggtcaaagctgggactctctgactcagtttctctctggggacctctggtcagagttctccttgggatcctgtc

SEQ ID NO: 43760 - DNA, 58 bp, Homo sapiens; identical to SEQ ID NO: 3966

SEQ ID NO: 43761 - DNA, 86 bp, Homo sapiens
caggggaggaggagaggaagggtatgatcataaaggaggagcacaaggaggtttcgttgggtttttttttttttttttttgctttg

SEQ ID NO: 43762 - DNA, 85 bp, Homo sapiens
gagatgctcaacaaacagacctgtgaacctgtggtgtggacttccttcagcacctctctgttcacactggctgttcagttgtttc

SEQ ID NO: 43763 - DNA, 75 bp, Homo sapiens
cataattgattgttaagtgcagtgccattatcaggcctgcctgatggcagagaatgtattttatttgtttttgtg

SEQ ID NO: 43764 - DNA, 77 bp, Homo sapiens
cttcccatggctctcctgactctcattctctctctcccgtcgagactgaaggatagaatcacaaagctcgtgggcag

SEQ ID NO: 43765 - DNA, 134 bp, Homo sapiens
tctgtcaggaccagccagtatgttttctcctctttttactgcatcctgtcacaggcctctgatttcacaggctgcaaacaagatgggcatgagtaagtcagggttgtcagtgtttcaggtggcttgggagtcat

SEQ ID NO: 43766 - DNA, 81 bp, Homo sapiens
agatacatgtgcacacataattttagacagaattggtaatttactttctatctttgtgtgtgtgtgtgtgtgtgtgtgtct

SEQ ID NO: 43767 - DNA, 100 bp, Homo sapiens
gggaggtgaagcatgtcagtgacaattgtgtggggtggctgaagtgacacaggtgacaagataggccttcattatacatcatcatgttggtgttcctgcc

SEQ ID NO: 43768 - DNA, 58 bp, Homo sapiens
tgagaccgagtctcgctctgtcacccaggctggagtgcagtggcgtaatctcggctca

SEQ ID NO: 43769 - DNA, 118 bp, Homo sapiens
tcattaccgttattagcctggttggtacacgttccttttccaagcatataactctgtttaaatataaatatatgctggacacattggcacctgtaatcccggctaatcgggaggctga

SEQ ID NO: 43770 - DNA, 110 bp, Homo sapiens
gcctcccgattagccgggattacaggtgccaatgtgtccagcatatatttatatttaaacagagttatatgcttggaaaaggaacgtgtaccaaccaggctaataacggt

SEQ ID NO: 43771 - DNA, 84 bp, Homo sapiens
ggattctagttctgactgcctgtgacccttgccctttctggacctcagtttccccactgggtacacggactgctctagctgtcc

SEQ ID NO: 43772 - DNA, 60 bp, Homo sapiens
tgtgctgaagctacgcaggtgggggtgggggctcccagcctgtctcagtggctcagggca

SEQ ID NO: 43773 - DNA, 91 bp, Homo sapiens
agcaggctgctctgtgaggatgtgcttggagcaatgactagtgacactaactcactgcctgtgagtccttacaggtaaagaagccgatgct

SEQ ID NO: 43774 - DNA, 117 bp, Homo sapiens
ctgtgtcttttaactgggacatttagcccgtttacatttaaggttaatattgttatgtgtgaatttgatcatgtcattatgatgttagctggttattttgcccgttagttgatgcag

SEQ ID NO: 43775 - DNA, 133 bp, Homo sapiens
ccctgactttgctagtggacttattgctgtgtgaccctgcttaagtccagtccatctctgggcctctcagtgtcacccaaagccacgagggagtcctctggccgagccatgggaacacaggggagccgggtag

SEQ ID NO: 43776 - DNA, 94 bp, Homo sapiens
agccacggggcctcccagcacacctcgctctctctgtccctgttgtgcttaatttggggggcgggggtgggtgaagcaagctccctgaggttcc

SEQ ID NO: 43777 - DNA, 121 bp, Homo sapiens
gctgtgtgtgggagcctggtctctgggtgcccagaatgaagggtcagacccaggtcactgcctgactctttctttcaaggaccgaagtaagaactacaggcctaacagtaacatccctggc

SEQ ID NO: 43778 - DNA, 68 bp, Homo sapiens
gccctgggaggcagaaggtctgtggtggctgtgaaaatgcccctctcagatctctgactgtgaggagc

SEQ ID NO: 43779 - DNA, 58 bp, Homo sapiens
gacacccccagtaagctgctgagtggaggtgggtctctctcagtgactctgtagtgtc

SEQ ID NO: 43780 - DNA, 110 bp, Homo sapiens
gcagtgagagctgggaaaggactgtggctgctggctctcgaagaggtactagattgtgttgtcactctcctcctgaaaaacctgcagtgactcctcgtggcttgccctgc

SEQ ID NO: 43781 - DNA, 77 bp, Homo sapiens
aggagagaagagagggctggagcttgagagaaaggtgggctctgactttcttttatctttttcttttcttctttctt

SEQ ID NO: 43782 - DNA, 101 bp, Homo sapiens
gctgagattttgggctttctggcttatttcttttaaatagatctttttaaataatttagatcatctggaatgatggagatgctttatcccacggtctttgc

SEQ ID NO: 43783 - DNA, 75 bp, Homo sapiens
atacaggacacacacacacacatatataattcactatatatgtgtatatgtgtgtgtgtgtgtgtgtgtgtgtat

SEQ ID NO: 43784 - DNA, 129 bp, Homo sapiens
gggctgactttgtattctaatagaactgttgccctctcatgctcttggcttccttttgaagtcagtgatcatagctgtttcattgaatgaatacagaaagaaaggtagtgagcgcacagtgggtgacag

SEQ ID NO: 43785 - DNA, 94 bp, Homo sapiens
tgaaaatgggacaaccttggcagaagttgagaaaggagagaactcacgtctctctcagacagtgcctttccatggggtgggtctagggttttta

SEQ ID NO: 43786 - DNA, 58 bp, Homo sapiens; identical to SEQ ID NO: 637

SEQ ID NO: 43787 - DNA, 104 bp, Homo sapiens
ggaactgaaaatactagccattggggtctgcacctgagaaccatgaattcacagccaatatctagtgacaagccttaccagtgtgactggattatctttgtttc

SEQ ID NO: 43788 - DNA, 107 bp, Homo sapiens
gttagcttccccaaccaagtaaattccaagagtgcctctgtgtgtgtgtattacacacacatacacacatacagacacacattggtgtaattgggtcatgtgccaat

SEQ ID NO: 43789 - DNA, 62 bp, Homo sapiens
gtgaggggtgagattcagtcactatttttttttttttttgagatggagtttcactctgtcac

SEQ ID NO: 43790 - DNA, 111 bp, Homo sapiens
tcaaatagctggaatcacagatgagtgccattatgcttggctaattttgtttattttaaaaatttttttggtagagactggacctttctatgttgcccaggctggtattga

SEQ ID NO: 43791 - DNA, 95 bp, Homo sapiens; identical to SEQ ID NO: 68

SEQ ID NO: 43792 - DNA, 93 bp, Homo sapiens; identical to SEQ ID NO: 69

SEQ ID NO: 43793 - DNA, 90 bp, Homo sapiens
gacagaatgagacctgtctctgaagaaaataataattgattaagttttattattattttctatatctttgagacagagtctcgctctgtc

SEQ ID NO: 43794 - DNA, 95 bp, Homo sapiens; identical to SEQ ID NO: 68

SEQ ID NO: 43795 - DNA, 93 bp, Homo sapiens; identical to SEQ ID NO: 69

SEQ ID NO: 43796 - DNA, 58 bp, Homo sapiens; identical to SEQ ID NO: 3380

SEQ ID NO: 43797 - DNA, 60 bp, Homo sapiens
atatatatagatatatatgtatatacttatgtatgtataagcatatgtgtgtgtatgtat

SEQ ID NO: 43798 - DNA, 58 bp, Homo sapiens
tgagacacagtctcgctctgtcatccaggctagagtgcagtagcgtgatcttggctca

SEQ ID NO: 43799 - DNA, 58 bp, Homo sapiens; identical to SEQ ID NO: 24442

SEQ ID NO: 43800 - DNA, 110 bp, Homo sapiens
agctttgtagtgtgcttaatatctggtaggacaaattctagctctttatttttttaaggttgacttagtcctgtttgtccacacaaatttgagagtgagtttatcaagtt

SEQ ID NO: 43801 - DNA, 76 bp, Homo sapiens
tggtatgcatatactatgtatatgtatgcatggtatgcatatactatgtatatgtatgcatggtatgcatatacta

SEQ ID NO: 43802 - DNA, 79 bp, Homo sapiens
atttcacacagtctctgtgggtcaggaacagcttggctgggcggttctaactcggtctcccatgagattttcaagaagt

SEQ ID NO: 43803 - DNA, 114 bp, Homo sapiens
tttcatttgcacagcaggactacagccagcctttagcaaatgcagggcttttgtgagaagttcgtgtttgcgtccgtgcttgtttctcccggcgtagcccaacagtacttggag

SEQ ID NO: 43804 - DNA, 109 bp, Homo sapiens
gcatgtacatttgcttcttctgggtgccagggtgttgacaaatacagagctatgttagcctctgtcagtcagtgtctggttaggaaaacagaagccctgtgccctatgt

SEQ ID NO: 43805 - DNA, 115 bp, Homo sapiens
agaacatggaggatacacactattgagagaaaacatttattttatatacaatttgtttatataatatataataatgtaaatatttattttatacgtgtgtgtgtgttgtgtatct

SEQ ID NO: 43806 - DNA, 92 bp, Homo sapiens
ttttcttttgaagtcagtagggtctgagcataaaaatatatatctttagtttttggtgattagaaactgcctggctaaaactcgactgaaaa

SEQ ID NO: 43807 - DNA, 84 bp, Homo sapiens
gcatggtttgttttgagacagtgtctcactctgttgcccaggctagagtgcagcggcaccatcacagctcacggcagcctctgc

SEQ ID NO: 43808 - DNA, 93 bp, Homo sapiens
tgtcctgggaaatgcacatgctctgtgtacatgcagcaggtacatgcacacacatgcactgacacgcagacacacacagagtctccacagaca

SEQ ID NO: 43809 - DNA, 102 bp, Homo sapiens
cttgaataattctgaaactgcttcctggctggactctgtcactcacacagacgttgctcagagactggacctcacagaatggcttaagagcaccgtggtgtg

SEQ ID NO: 43810 - DNA, 70 bp, Homo sapiens
gcctccctccgagagatgtcagtgagcagctggggttgtgaaccactgacttaatgcctctaaaggttgc

SEQ ID NO: 43811 - DNA, 73 bp, Homo sapiens
ttcccaccagcctgacaaagtggcaagacagaaggcctgcgaggcaggctgagtccctgactggctgtgggaa

SEQ ID NO: 43812 - DNA, 74 bp, Homo sapiens
gacctctcttagaaaggagtgaaaaatgagagctaagagggcatcttttttttttttttttttgagatagggtc

SEQ ID NO: 43813 - DNA, 116 bp, Homo sapiens
actgggcctctctattcactacctcccccttctcagcctcagtttccccatctgtgagatgggagagtgcactgaagatgggcggggggatgtggaggaatgctgaaagagctagt

SEQ ID NO: 43814 - DNA, 116 bp, Homo sapiens
tgcctgagtgcatgccacacacacacactgaaatgcactttcaattaactatataattttatttaatttcaaagatgtattttccctggtcttattctgttttatgttgctgggca

SEQ ID NO: 43815 - DNA, 164 bp, Homo sapiens
cagagtgagactctgtcttcaaaaaaacaaaaaaaaaaggaaagtttttaaattttaatgttaattttttttatttatttgcttttgagacagagtctcactctgtcgcccaggctggagtgtagtggtgtgatcttggctcactgcaacctccgcctcccggg

SEQ ID NO: 43816 - DNA, 113 bp, Homo sapiens
ttccatgtgcctgcctgtgcctttctgtgccagggtcttaagaaatgtgtgtgggtttcctctgtggctctgacactccatcaaacaccagggcttgtgcacgcaggtgagaa

SEQ ID NO: 43817 - DNA, 58 bp, Homo sapiens; identical to SEQ ID NO: 6359

SEQ ID NO: 43818 - DNA, 111 bp, Homo sapiens
cacggcaggccctggtgtgtgatgttctatttttgcattttcaaagtaaatatgaaatgtactctttcatgacttgtggaaaagcatgacgctcacatttcattgttcgtg

SEQ ID NO: 43819 - DNA, 68 bp, Homo sapiens
agtggattaaggaatatatagagcaggcagtggtacatggctgctttctctgtatctgtctctctact

SEQ ID NO: 43820 - DNA, 75 bp, Homo sapiens
tctgggtgtgtgtcaaatctctctgtgtctatctcttataagaacatttgtgactggatttagagtccacccagg

SEQ ID NO: 43821 - DNA, 75 bp, Homo sapiens
ggacactcactgtctgagagctgaaacaagaaggcaggcatcgtcgccttgctcagcctcagtggggagcaagcc

SEQ ID NO: 43822 - DNA, 58 bp, Homo sapiens
gctgtctccatcctgtttctcaagcgactcagcacacagagagaaggaagaggccagc

SEQ ID NO: 43823 - DNA, 62 bp, Homo sapiens
ctagacactcagtgagtgtgtccttggcaaaggggaagcacttggctggaagtggttgttgg

SEQ ID NO: 43824 - DNA, 61 bp, Homo sapiens
ttatagactatgcatatatatgtatatgtgtataaatgtgtgtatatgtatatgtttgtaa

SEQ ID NO: 43825 - DNA, 66 bp, Homo sapiens
agtctatggggtgaaagagtaaattcttcttttattgagacggagtctcactctgtcacccaggct

SEQ ID NO: 43826 - DNA, 65 bp, Homo sapiens
catgctgtctctgtgtgtctgtgtcctctcgtctctgtagaacagcagtcactggagtcaggatg

SEQ ID NO: 43827 - DNA, 67 bp, Homo sapiens
ttgctgtagctggggcgcaggcagtgtgtctgggaatcaaaggctctgtctctccctgtggaagcaa

SEQ ID NO: 43828 - DNA, 80 bp, Homo sapiens
ctggacataactgtgacttgtgtgcctggctctgaataatcagttaggccagtgaaatgggagtctctctgtgtgtctgg

SEQ ID NO: 43829 - DNA, 101 bp, Homo sapiens
gcattctcatcaggaggctcaactggggaattccacttccaagctcactcaagttgttggttgaattcatttcatttccctgtggctgtatgactgagggc

SEQ ID NO: 43830 - DNA, 116 bp, Homo sapiens
ggaagaaaacatctggacattgtggttaagatcagcattgttaataatttatcattattaaggatgataataacatagctgacatttattgaacctttctcttgctccagactttc

SEQ ID NO: 43831 - DNA, 95 bp, Homo sapiens
acaacagctaccttgtccccagagaaaattaggttgtatagatgtgaatgtggtttttttttctttttttttttttctgggggtggaagtgttgt

SEQ ID NO: 43832 - DNA, 98 bp, Homo sapiens
tgggaagatcagaaaaggcaccaattgggacgtgatcaatgggacaggaagaagacacctctctcacactctcaataaacccaaattttctataacca

SEQ ID NO: 43833 - DNA, 70 bp, Homo sapiens
atggcacagcaggattgccccacagtgaagcaaggcttttgtatctctgtgtcagtcagtcattggccat

SEQ ID NO: 43834 - DNA, 60 bp, Homo sapiens
ttgagacagggtctcactctgtcacccaggctggagtgcagtggtgtgatctctgttcag

SEQ ID NO: 43835 - DNA, 117 bp, Homo sapiens
tgtttgtgtgtgagtctgcatatgttgtctgtgtgtttttctgtgaatgcacctgagagtgtgagtctgtgtgtgtgacagagagacctggagggcagggcagaggggataggaggg

SEQ ID NO: 43836 - DNA, 80 bp, Homo sapiens
ttgaagtctgacaccatgtggatgtggtggacatggggagggtaccctgggtccctaactcctctgaatgtagactttaa

SEQ ID NO: 43837 - DNA, 116 bp, Homo sapiens
atttgcagtttgtaaatgttggcaagggattccattttctattgttttatttaaaaaaaaaaaaaaaaacccatgctagtggatcctgtgcagagcacaaggggcgagtctgtggg

SEQ ID NO: 43838 - DNA, 112 bp, Homo sapiens
cctataataagtcaccgttctgacacattgtcctgtaagtttccaagtgccatctcactccatctctcacttcgatccttacaggatcatggcaggcaggtatgtaggtagg

SEQ ID NO: 43839 - DNA, 70 bp, Homo sapiens
tttttttgagatggagtctcactctgtcacccaggctggagtgcagtggtgcgatctcggctcactggaa

SEQ ID NO: 43840 - DNA, 58 bp, Homo sapiens; identical to SEQ ID NO: 1265

SEQ ID NO: 43841 - DNA, 68 bp, Homo sapiens
gggtgaatttcactaatgacatcttttttttttgttttggatacagggtgtcactctgtctgtcaccc

SEQ ID NO: 43842 - DNA, 86 bp, Homo sapiens
ctgggggcagggaccttgtctgtctgctccaactttggactaacccagatttggggcagacagtctggctgtgtccctgcccccag

SEQ ID NO: 43843 - DNA, 82 bp, Homo sapiens
tacatatatatgtatatgtgtgtatatgtctacctatacaaatatgtatatatacatatatgcatgtatacatatgtgtgta

SEQ ID NO: 43844 - DNA, 118 bp, Homo sapiens
ttaggtctataatccattgtttgttaactctggtttggatgtatctttctttattttatttttattttcatagagacgaggtctcaccatgttacccaggctggtcttgcactcctga

SEQ ID NO: 43845 - DNA, 102 bp, Homo sapiens
ctgtgtcttcatgtggtggacagggatcatctttcttgcgtctttttttctttttttttttaatagatagggtctcattctgtcagccagactggagtgcag

SEQ ID NO: 43846 - DNA, 114 bp, Homo sapiens
gccttggttcccagtcccaggaagggccactggattgtgtgaagactgtgagctgtgtccactgcatttctccagcccatgcaacccggcatcacgaggaagggggtatggggt

SEQ ID NO: 43847 - DNA, 107 bp, Homo sapiens
agccacatctacatgggcagattcagggtttttttttcttttttcttttttcttttttttttttttaactttcaatagagacagtgtctggctgtgttgcccaggct

SEQ ID NO: 43848 - DNA, 58 bp, Homo sapiens
agggtctctgtcactgagtctggagtgcagtagcacgatcacagctcactgaagccct

SEQ ID NO: 43849 - DNA, 67 bp, Homo sapiens
atggattcaattattgtacatgtctgtgcagcccattgatggatgggctgttgatatttggatgagt

SEQ ID NO: 43850 - DNA, 58 bp, Homo sapiens
tggcctctgtccagctgctcatggactacgagtgacttgagagtgaggacagaatcca

SEQ ID NO: 43851 - DNA, 103 bp, Homo sapiens
tgcagattctaagtgataggggtttccaggaaggaaagattagtggtgtggtagaagctagtttttaaagaagggagtacctggcttgaacttgtaacgtaga

SEQ ID NO: 43852 - DNA, 111 bp, Homo sapiens
tacatgtggaatgtaaaaagggagaaaatgaaagtaacttgtaatcttaatatttttagatgttaagcagttaatactttagagtctgtcatttttagttttttctatgta

SEQ ID NO: 43853 - DNA, 95 bp, Homo sapiens; identical to SEQ ID NO: 68

SEQ ID NO: 43854 - DNA, 93 bp, Homo sapiens; identical to SEQ ID NO: 69

SEQ ID NO: 43855 - DNA, 102 bp, Homo sapiens
caatgcaggctcttttttggttccatatgaaatttaaagtagttttttctaattctatgaagaaagtcagtggtagcttcatgggactagcattgaatctgt

SEQ ID NO: 43856 - DNA, 108 bp, Homo sapiens
ggagctgccggagcatctgcgatgtgtcaaaatagagatgacagagaggagtacagagcacctcaccccacaacctctagatcagactagtccactttgaatggctct

SEQ ID NO: 43857 - DNA, 65 bp, Homo sapiens
gcctgtagtcccaggtattcgagaggctgaggtaggaggatcacttgagcctgggagtttgaggc

SEQ ID NO: 43858 - DNA, 67 bp, Homo sapiens
caagagtgggcagatataaaagtgggtccagcacctggtgcctctgtctgtctcacatgctctcttg

SEQ ID NO: 43859 - DNA, 95 bp, Homo sapiens; identical to SEQ ID NO: 68

SEQ ID NO: 43860 - DNA, 93 bp, Homo sapiens; identical to SEQ ID NO: 69

SEQ ID NO: 43861 - DNA, 68 bp, Homo sapiens
agcctagagacattaaatccactgctacccagaggtagaagcatggatttaaacccaggcatctggct

SEQ ID NO: 43862 - DNA, 74 bp, Homo sapiens
cacacatatgtatatatatgtatacatgtatacacaccacacacacatatatatgtatacataacatgtgtgtg

SEQ ID NO: 43863 - DNA, 118 bp, Homo sapiens
tgtggtgagaacatttagaatctactcttttagcaactttgaaatatacattattattaattatagtcaccttgctgtgcaatagatcaccaaaactttttcctcctgtctcactgca

SEQ ID NO: 43864 - DNA, 85 bp, Homo sapiens
ccttgccattacacagccagctttgctatggtaaaatgaatcctctacctaaatagctgacagggtgggctatgcttaggcaggg

SEQ ID NO: 43865 - DNA, 62 bp, Homo sapiens
ggtgtagctttcctctcaagctctctgagacacagagatgctctgcagaactagctgctgcc

SEQ ID NO: 43866 - DNA, 119 bp, Homo sapiens
ggagccatttctgagagtttaccatgtgctgtgtcctttacacaaaagtgattttgttcatttatctttacagtgacacagtcagagaggtattattaatccccattttacagagggct

SEQ ID NO: 43867 - DNA, 114 bp, Homo sapiens
ctgaccctttttctctgttacagcttctcctggggcctctattttccttttttttttttttgagatggagtcttgttcagtctcccaggctggagtgcagtggtgcaatctcag

SEQ ID NO: 43868 - DNA, 133 bp, Homo sapiens
ctcctgctatcctcattaatgctgatggctttttctaggccccactggctccacatctgtatatgtatttctgttctgccattattcgtctgacctggtcatctgcatggtatggagccttagatgagggacc

SEQ ID NO: 43869 - DNA, 104 bp, Homo sapiens
tttgagataatttcttgtggcttaagatggctggagaatgaagtgtgtgtgaacacaagacaggaggaggaggctggaagggcaggaagagaacgtattgcaaa

SEQ ID NO: 43870 - DNA, 58 bp, Homo sapiens; identical to SEQ ID NO: 37060

SEQ ID NO: 43871 - DNA, 116 bp, Homo sapiens
acttcactggcagatgtaagctatttgaataaacggtaataaatgctatgttcttagactgaatggttttgttgctgttttgagatggagtcttgctctgtcgtccaggctagagt

SEQ ID NO: 43872 - DNA, 76 bp, Homo sapiens
gagtctcactctgtcacccaggctggagtgcaggaggctcactgcaccctgtgtctcctgggttcaagtgattctc

SEQ ID NO: 43873 - DNA, 119 bp, Homo sapiens
tttcactttaatttgaggtttactttaaaataaaggcattattaaaatgagagctttacttctgaattagtttacattttgactgaaatgcctaggtagaagtaatacacttaatgaaa

SEQ ID NO: 43874 - DNA, 58 bp, Homo sapiens
tgagacagagtctcactctgtcacccaggctggagtgcagtggcgtgaattctgctca

SEQ ID NO: 43875 - DNA, 72 bp, Homo sapiens
ttgttttttgagtcagtgtctcgctctgtcacccaggctggagtgcagtggtgcgatcctggttcactgcag

SEQ ID NO: 43876 - DNA, 181 bp, Homo sapiens
tgtaagtatatatgtacatatacgtatatatgtacatatacgtatatacgtatatatgtacatacacgtgtatacgtatatgtatatatgtatatatgtgtatacgtatatgtatatatatgtgtatatatgtgtatatatacacatgtatatatgtgtatatatacacatgtatatatgt

SEQ ID NO: 43877 - DNA, 76 bp, Homo sapiens
ctggtagcggagagaaaaaaagttttttctttttgaggtcatctggggaagaaaaaaattatagttgttataccag

SEQ ID NO: 43878 - DNA, 86 bp, Homo sapiens
cattaaattctcataaggagtgtgcagcctagatcactctcatgtgtgattcacaatagggtttacattcctatgagaatctaatg

SEQ ID NO: 43879 - DNA, 119 bp, Homo sapiens
gatctattgtacttcatgatgactgtggtaagtaacaatacattatatacttgaaaatttctttttttttttttttgagacaattttgctcttcttgccaggctggagtgcaatggtgc

SEQ ID NO: 43880 - DNA, 68 bp, Homo sapiens
ggaattctaggctctgactcactccctcccacaaggtgggaaggagaagggagtttggcaagagtgac

SEQ ID NO: 43881 - DNA, 119 bp, Homo sapiens
caaactcactagtacttagctgtgagaattgagattagtttaagggcaggaagatggttttttatctttaattactttggtattacttgaatttttatgagcttgtattttctattttg

SEQ ID NO: 43882 - DNA, 58 bp, Homo sapiens; identical to SEQ ID NO: 1391

SEQ ID NO: 43883 - DNA, 56 bp, Homo sapiens; identical to SEQ ID NO: 1392

SEQ ID NO: 43884 - DNA, 72 bp, Homo sapiens
atatatatatgtatacatgtatatatgtatgtgtgtatatatacgtatatgtatatatatgtttatatatat

SEQ ID NO: 43885 - DNA, 91 bp, Homo sapiens
atatatacatataaagtgtatatatatatgtacaattcttttttacctttaaaaatgtgtggtgtatatatgtgtatgtttgtgtatatat

SEQ ID NO: 43886 - DNA, 58 bp, Homo sapiens
tgaaacagggtctcactctgtcacccaggctggagtgcagtggtgagatcatggctca

SEQ ID NO: 43887 - DNA, 58 bp, Homo sapiens; identical to SEQ ID NO: 7309

SEQ ID NO: 43888 - DNA, 73 bp, Homo sapiens
gggtccagtgagcgtattgagaggtgcattggtcagctgactccactctgtgactgcgtcactcaggggactt

SEQ ID NO: 43889 - DNA, 109 bp, Homo sapiens
cctggcttacctactttgactccaaaagtaatgctgacatcccccgtgagacacagtgacagactgagactaacgtagggttacgtggctcagagtcaccatggccagg

SEQ ID NO: 43890 - DNA, 123 bp, Homo sapiens
gaacagtgctaggacctgagctctgcctggccatggtgactctgagccacgtaaccctacgttagtctcagtctgtcactgtgtctcacgggggatgtcagcattacttttggagtcaaagta

SEQ ID NO: 43891 - DNA, 108 bp, Homo sapiens
gccaagtgtggcctgcgcctgtggtctcagctactcgggaggctgaggtggaaggatcacttgagcccaggaggcagaggttgcagtgagccaagatcacgccactgc

SEQ ID NO: 43892 - DNA, 95 bp, Homo sapiens
tctcctgagataacaatatatatacataaaatacatttagtgggccccttaggttttgtagatggatctatagttttatatacttggttaggaga

SEQ ID NO: 43893 - DNA, 114 bp, Homo sapiens
cttgtatcagaatctcattttgaggttgtagtttgacttctctagagacacactcgtattcacactctctgtcacacagacacactcaaaatgccatttaatgtgattcataag

SEQ ID NO: 43894 - DNA, 111 bp, Homo sapiens
tgttctaatatacattcactgaggtctgctccctgtgagactaggatgtgtagttaaaatgtcctcatgttccctgttgcagaccctgagatgaggattcttatgcaagca

SEQ ID NO: 43895 - DNA, 86 bp, Homo sapiens
gaagtgagattgctgagtcaaagagtgaagacagagagaattttgccaaattctttccatggtgattgtacaacaattttgcattc

SEQ ID NO: 43896 - DNA, 85 bp, Homo sapiens
ccctcttgtctgtggtagttggttggataactcaacatgcattctaatctcctttgccttgcccacctccactccagagactggg

SEQ ID NO: 43897 - DNA, 91 bp, Homo sapiens
tggggagcattggcaggaaattgggtgctgggctctttctcactctgcctctgctttaagagaatctcggacagttgctgtgtgttttcca

SEQ ID NO: 43898 - DNA, 69 bp, Homo sapiens
ctccagggtgagtacacacagtgctgagtgccaagatggtgcagaaagagcactgtgggcccacaggag

SEQ ID NO: 43899 - DNA, 111 bp, Homo sapiens
atgtatgtgtatatatatatgtgtatatatgtgtgtgtttatatatgtgtgtatgtgtgtgtgtgtatatatatataatacatatatacaaatatatatatatatatatat

SEQ ID NO: 43900 - DNA, 61 bp, Homo sapiens
ttgagacagagtctcgctctgtcgctcaggctggagtacagtggcgcgatctcaatcttgg

SEQ ID NO: 43901 - DNA, 81 bp, Homo sapiens
gttgctttattctcacattctaaaacagtgcctagcatatggtaggcaataaatagatgtttgttgaatggattgaacaac

SEQ ID NO: 43902 - DNA, 63 bp, Homo sapiens
tcttaagactggggcaacttctagttgaagtctgctgtgactaggaagtgttctatcctgaga

SEQ ID NO: 43903 - DNA, 77 bp, Homo sapiens
ctttgctacgtaacagttagtgctcctggttccagagttcagtctctctctgccctgcacagctgatttctccaaag

SEQ ID NO: 43904 - DNA, 82 bp, Homo sapiens
ccttgctttgttctattactcttgtgattttctacatttaatcttcatctagaattcattttagtgtaaagagcacggaagg

SEQ ID NO: 43905 - DNA, 108 bp, Homo sapiens
tgaaaaccagtttagatgtggaacttcaaaataaaaatgtatgtatacatttattattgtgtttggtactgtattttgaatttatgtcatctctgaaagtgactttta

SEQ ID NO: 43906 - DNA, 58 bp, Homo sapiens; identical to SEQ ID NO: 22301

SEQ ID NO: 43907 - DNA, 72 bp, Homo sapiens
tctggactgtgtctctgtgtccttctggggctccaggacgtctgggccacctggactcagagccaggccaga

SEQ ID NO: 43908 - DNA, 165 bp, Homo sapiens
ctgtcacagcctctgtcacagcctctgtcacagcctctatcacagtctctgtcacagcctctgtcacagcctctatcacagtctctgtcacagcctctgtcacagcctctgtcacagcctctatcacagcctctgtcacagtctctgtcacagtctctatcacag

SEQ ID NO: 43909 - DNA, 93 bp, Homo sapiens
ctgtcgcagcctctatcacagcctctgtcgcagcccctgtcacagtctctatcacagcctctgtcacagcctctgtcacagcctctgtcacag

SEQ ID NO: 43910 - DNA, 81 bp, Homo sapiens
ctgtcacagtctctgtcacagcctctgtcacagcctctatcacagcctctgtcacagcctctatcacagcctctgtcacag

SEQ ID NO: 43911 - DNA, 81 bp, Homo sapiens
ctgtcacagcctctgtcacagcccctgtcacagtctctatcacagcctctgtcacagcctctgtcacagcctctctcacag

SEQ ID NO: 43912 - DNA, 181 bp, Homo sapiens
agcctctgtcacagcccctgtcacaattcctgttacagtcgctgtcagagtctctgtcacagcccttgtcacagcccttgtcacagcctctgtcacagcctctatcacagcccctgtcacagcctctatcacagtctctgtcacagcccctgtcacagcctctatcacagcctctgtcaca

SEQ ID NO: 43913 - DNA, 58 bp, Homo sapiens
tgagaccgagtctcgctctgtcacccaggctggagtgcagaggcgcgatctcggctca

SEQ ID NO: 43914 - DNA, 81 bp, Homo sapiens
ccaagtgtgaagtcagtgtgctgactctgaggtcatcagagaggcctgaggtccccgaggcatgcctgactgtaggggttg

SEQ ID NO: 43915 - DNA, 159 bp, Homo sapiens
aaggagaaacattgttagtctccagcagtgtctttgataatgaagctgtttacctgagtactgtaaaagcctgcaagtggctagcattttctttttattttttttgagaagtagtttgctttgtcacccaggttggagtgcagtggtgtgatcctggct

SEQ ID NO: 43916 - DNA, 58 bp, Homo sapiens; identical to SEQ ID NO: 1847

SEQ ID NO: 43917 - DNA, 111 bp, Homo sapiens
gccaggcatggtggcgctcacctgtagtcccagctacttgggaggctgaggtagaagaatcacttgaacccaggaggcggaggttgcagtgaactgagatcatgccactgc

SEQ ID NO: 43918 - DNA, 76 bp, Homo sapiens
gagccaagtgcaggagcagaaattaggaatcctgggatggagactcagccttgactctgtctcactgtgcgacctt

SEQ ID NO: 43919 - DNA, 69 bp, Homo sapiens
gagacggaacagagtgaggccagggcccactggattggacagtcagcctaggtctaagcttggccactc

SEQ ID NO: 43920 - DNA, 77 bp, Homo sapiens
gagtgtctcagtctctgtgaccctgaccgcaggcaggcagctgggccagcgtgcacaggaagctggacagagcgttc

SEQ ID NO: 43921 - DNA, 96 bp, Homo sapiens
aataagtgattgctcaatggctgtctggctggctggcggtggttctattaatagtttttaattttatcagttagcaatcaatgagaaaagcttgtt

SEQ ID NO: 43922 - DNA, 91 bp, Homo sapiens
atagttatatgggcataagaactgggggctaaagtgggagtaagacactattgatcactttctatgtttttatttctgactatgtgattgt

SEQ ID NO: 43923 - DNA, 123 bp, Homo sapiens; identical to SEQ ID NO: 43890

SEQ ID NO: 43924 - DNA, 109 bp, Homo sapiens; identical to SEQ ID NO: 43889

SEQ ID NO: 43925 - DNA, 112 bp, Homo sapiens
ctgggaggtggaagccacagggcaagactctgtctcaaagaatgaatgaatgaatgaatgaatgaatgaatgaatagaggcctggcatggtggctcacacccataatcccag

SEQ ID NO: 43926 - DNA, 78 bp, Homo sapiens
tgtctgcctggaattttgtctggatctaggagcctctgctgggagataggatcaggagctgaagagtcagggcagcca

SEQ ID NO: 43927 - DNA, 116 bp, Homo sapiens
ctgtgtgaccttgggcaagtcacagcctctctggggttcattcagtctctgcctctgttacatgagaacaacatccctcaccctgctgttaagacacctaaggctggtcaccttag

SEQ ID NO: 43928 - DNA, 64 bp, Homo sapiens
tgggactggctatgtggccttgagtgagtcttttcctctctgtgggtctcactgtcctctctca

SEQ ID NO: 43929 - DNA, 56 bp, Homo sapiens
ggctggtggtgtcacagatgccaagttagacatgacctctgtctgtgtcaccagcc

SEQ ID NO: 43930 - DNA, 103 bp, Homo sapiens
gggattacaggcgtgagccactgtgcctggctgctttttttttgttttttttttttaaataaaattttaagttccttgggcttagggacatgtctgtgctccc

SEQ ID NO: 43931 - DNA, 69 bp, Homo sapiens
agggcatctgtttggaggccgttgggtgggccctggttggctctgctctctgtctctgtctcactccct

SEQ ID NO: 43932 - DNA, 81 bp, Homo sapiens
tctctcttgcttatcacagtgacatctgcagactaccctggcattctgtagaaagtgtgcactgcctggggtgggagttga

SEQ ID NO: 43933 - DNA, 86 bp, Homo sapiens
gctggggcccagagcgaggaaggagatggagggagagcatggcttctggtgaggccgcgtccctgtctcagtcagacggtccctgc

SEQ ID NO: 43934 - DNA, 120 bp, Homo sapiens
ttggggctcctggtgctcactggccttgtgggggacccactgactttcaagtgtagatgtggatgtgggaccagggttgctatggggcagtgggctcagctctgggctctgggatccaca

SEQ ID NO: 43935 - DNA, 111 bp, Homo sapiens
tagattcctgtcctgctggggtgctggatctcaccccttggccctgaggctctgagtctgtcccttccctttcccaagaatcgggcttgcttcctgctaggaggaaaggcc

SEQ ID NO: 43936 - DNA, 127 bp, Homo sapiens
atatatttaaatatgtgtgcatatagatgtgtatatgtatatatagatctatgtatatgtgagcatatatatgtgcacatatatcaaaatatatatgtatatataaaatatgagttcacaccaatac

SEQ ID NO: 43937 - DNA, 112 bp, Homo sapiens
agctccagctcctgttccttttcctgcccaccccgcccagtgaggagatcagcaccccttgtctgtctctgtgtctgtcggggttcgtgcctcactgtgtccaagcccggct

SEQ ID NO: 43938 - DNA, 70 bp, Homo sapiens
gtgcccaggcagtgtagagactgtgcccagagccagcaggaggcagattcacagcctcactctgcagcac

SEQ ID NO: 43939 - DNA, 112 bp, Homo sapiens
gtatacttctctgcagagttcacagaaaagaaaatatatgtgtgtatatttaaccagcatatatatacatatttaaatatttctatatgtaactatgtatattgtactatac

SEQ ID NO: 43940 - DNA, 83 bp, Homo sapiens
ctatctatctatctatatactttttgttttgagacagggtctcactctgtcatctaggctggggtgcagtggcctgatcatgg

SEQ ID NO: 43941 - DNA, 109 bp, Homo sapiens
caggagtggtggcatgcacctgtaatcccagctacttgggaagctgagacatgagagtcacttgaacccaggaggcagaggttacagtgagccaagatcgtactactgc

SEQ ID NO: 43942 - DNA, 102 bp, Homo sapiens
atgagcctcaccttcctcatctgttagatggggtcttataaaaacagacagcacacactgcggtgaggcttcactgacgacgtggatggtgctggcattcat

SEQ ID NO: 43943 - DNA, 87 bp, Homo sapiens
gcttgagccactgtgcccagccctttttcttttttcttttcttttttttttttttttggagacagggtctcactctgttgctcaggc

SEQ ID NO: 43944 - DNA, 64 bp, Homo sapiens
tctgggggctgacttactctactagctaggagcatcacagcagagagataggacagagaccaga

SEQ ID NO: 43945 - DNA, 94 bp, Homo sapiens
gagtcccagggtcttgccaggggtcttgggagagatctgatgtgtctggctcaggcaaagacagaccttgccctctcaggccttgggctctggg

SEQ ID NO: 43946 - DNA, 73 bp, Homo sapiens
gagcaggcatgtgggatttgggctctttttttttttttttttttttttgagacagagtctcactctgtcactc

SEQ ID NO: 43947 - DNA, 111 bp, Homo sapiens
gatctgttgtacagcatgatgactatagttaataatgtatacttgaaaattactaagagtagattttttgcttttattattattattattattattatttgagacagagtc

SEQ ID NO: 43948 - DNA, 92 bp, Homo sapiens
ctgggggctaggacttcaatgtatgattttttgtttgtttgtttgagacagagtctcacctgacacagcctctcaaagtgctagcattacag

SEQ ID NO: 43949 - DNA, 78 bp, Homo sapiens
tgggcaatagagcaagaccctgttttttttttattttgttttttgtttttttgagacggagtctggctctgttgccca

SEQ ID NO: 43950 - DNA, 89 bp, Homo sapiens
gaaatctggggctgggtgcaatggcttaggcctataatcccagcactctgggaggcagaggtggaaggatcacttgagcccaggagttc

SEQ ID NO: 43951 - DNA, 89 bp, Homo sapiens
aggtgtgaaccactacgtccagcctttttttttttttttgagacaggctctcactctctcacccaggttggagtacagtggctctatct

SEQ ID NO: 43952 - DNA, 117 bp, Homo sapiens
tttgtaagaccagtgtgcagtcaggcagttgttttgatcctagatgtgtctcatactctcaggttttgttttggcattaggctttcaacctgcctcatccatctgcttacttacaaa

SEQ ID NO: 43953 - DNA, 67 bp, Homo sapiens
caaagtgctgggattacaggcaggcgtgagccaccgcgcgcctggcttttttgtttttctttttttg

SEQ ID NO: 43954 - DNA, 76 bp, Homo sapiens
ggaggctgaggtaggaggatcccttgagcctgggaagttgaggcttcaaggaactgtgattgtaccactgcactcc

SEQ ID NO: 43955 - DNA, 132 bp, Homo sapiens
gtgtgcacacacgcatgtgtacatgtgtgactgcgtcagcatatgatgaactcgtgtgtctgtgtcactgagtctggggacatgtgattatgcacctccctgagggagtgcatctcaagctgtgtgaccgac

SEQ ID NO: 43956 - DNA, 93 bp, Homo sapiens
gcacagccccttcccttggggcctcagagagcgcacctgttggtcacaggtgaaatggtgtctgatcactggctcccggaaggggtgaggggc

SEQ ID NO: 43957 - DNA, 90 bp, Homo sapiens
acttagcagggcctgtcctcggtggacgctgagctccagtatttatctccctgtgagctctgtgagtctgtgagttctagctcagcttgt

SEQ ID NO: 43958 - DNA, 85 bp, Homo sapiens
ttgccctggctcctcgcggttgagtcctttggacctaggttccagttccaggtcagacactcactgacagtgtagacagtggcaa

SEQ ID NO: 43959 - DNA, 81 bp, Homo sapiens
agatcttgagtcattttgtaaatgtcaagcaatgatgagtactattatctgtgcttgacaggtagcaaaaagcaaaggttt

SEQ ID NO: 43960 - DNA, 73 bp, Homo sapiens
gtttttttgtgactgagtctcgctctgtcacccaggctggagtgcagtggcatgatctcggctcactttaagc

SEQ ID NO: 43961 - DNA, 135 bp, Homo sapiens
gcagtggcagtagctcaatcaggcttcgtaagtgggagcccatgctattaggctcctgctgcctctgtctctgccactgtagtcatttcatgcatgtgcccttagtaccagcactaggtggctgatgacagaggc

SEQ ID NO: 43962 - DNA, 58 bp, Homo sapiens; identical to SEQ ID NO: 10913

SEQ ID NO: 43963 - DNA, 64 bp, Homo sapiens
gtctgtgacagagactgactgtaattttttttttttgagatggagtctcactctgtcgccaggc

SEQ ID NO: 43964 - DNA, 89 bp, Homo sapiens
ggtattttactctctttgaagcaattgtgaatgggagttcactcatgagttggctctctgtttgtctgttactggagtataagaatgct

SEQ ID NO: 43965 - DNA, 112 bp, Homo sapiens
caagttaaagagaaaaccagcattaaatatctatctatctatctatatatacatgtatatatagatatagatatatatagtatttagtcatcctgggcaaaggtgtaaagtg

SEQ ID NO: 43966 - DNA, 89 bp, Homo sapiens
tgagggaggcacaaggaccattttaattcacagaatacaagaggcttgtatttcaccctgaggtaaatcaattctgaacctatccttca

SEQ ID NO: 43967 - DNA, 103 bp, Homo sapiens
ggattctcttggctgtacaggctcttttttggttccatatgaaatttaaagtagttttttctaattctgtgaagaaagtcaatggtaggttgatggggatacc

SEQ ID NO: 43968 - DNA, 112 bp, Homo sapiens
agcattgttagtggtatgagatggtatctcattgtggttttgttttgagacggagtctcgctctgtcacccaggctggagtgcagtggtgtgatctcggctcactgcaagct

SEQ ID NO: 43969 - DNA, 83 bp, Homo sapiens
agtggaagtgagtaataatggaaatcgtttgtatcaaacaggatacagaaaaatcagaaattaatattttaagtacttccatt

SEQ ID NO: 43970 - DNA, 68 bp, Homo sapiens
aaagaattttatttctgttttgaattgctgttgagaatagtaattacaaaacagtagttggtgtcttt

SEQ ID NO: 43971 - DNA, 96 bp, Homo sapiens
tcataaactatgcttttgtttgccagaagatttctttttttttaatctgccctaattttgaaaaatggtcttagaggggatagaagtctaggttga

SEQ ID NO: 43972 - DNA, 81 bp, Homo sapiens
atacacatacacatatatgtatatatgtatatatacacgtatatacgtatacacatatatgtatatgtgtgtatatatata

SEQ ID NO: 43973 - DNA, 138 bp, Homo sapiens
atatatacatatatacgtgtatgtgtatgtgtatatatacatatatatgtgtatgtgtatatgtgtatatatacatatatacatatatgtgtatgtgtatatgtgtatatatacatatatacatatatgtgtatgtgt

SEQ ID NO: 43974 - DNA, 58 bp, Homo sapiens; identical to SEQ ID NO: 23606

SEQ ID NO: 43975 - DNA, 109 bp, Homo sapiens
gccatggaaaaggtcaagtataatagtggggagaggggagaggaagcatgtttttgtttaattatacaactgtctcatgataatgcaatgatcaagaaatccagtaggt

SEQ ID NO: 43976 - DNA, 97 bp, Homo sapiens
tatcttttacttgtagcaaatggagagccactgaagaattttgagtagaggcacaatcaggattttttaaaagattctgtgagctacctatgagatg

SEQ ID NO: 43977 - DNA, 107 bp, Homo sapiens
gtagctgagactaaagacacaagccactacaccaggctcatttttttttattttttgtagagacggacttcctgtgttgcccaggcttgtcttgaactcctgggctc

SEQ ID NO: 43978 - DNA, 61 bp, Homo sapiens
gtggctcatgcctgtaatcccagctactcaggacgctgaggtaggaggatcacttgagccc

SEQ ID NO: 43979 - DNA, 62 bp, Homo sapiens
tgagatggagtctcactcactctgttgcccaggctggagtgcagtggcatgatctcagctca

SEQ ID NO: 43980 - DNA, 58 bp, Homo sapiens; identical to SEQ ID NO: 1847

SEQ ID NO: 43981 - DNA, 252 bp, Homo sapiens
atatgtgtatacatgtgtctatatgtatatatgtgtatatatgtatatatgtgtgtgtatatatgtgtatatatgtatatatgtgtatctatgcatgtatgtgtatatatgtatatatgtgtgtatatatgtgtatatgtgtacgtgtgtgtatgtgtatatatgtatatgtgtgtatatatgtgtatatatgtgtgtatatgtgtatatatgtgtgtatatatgtatatatgtgtatatatatgtgtatat

SEQ ID NO: 43982 - DNA, 73 bp, Homo sapiens
ctattttttatgatgatgatgatgatgatgatgatgattattattattattattattattattattaagttag

SEQ ID NO: 43983 - DNA, 106 bp, Homo sapiens
agcatagtaaatatttacattttattcttcagataaatcctatataaatgtaattatatatgacattctatgctctaattaggatgaaatgttatgttgttttgct

SEQ ID NO: 43984 - DNA, 78 bp, Homo sapiens
gggcatcaccaagaagtataaagacttctgcctttgtctttactaggcatttatctttatatatgttgctcaaagtcc

SEQ ID NO: 43985 - DNA, 85 bp, Homo sapiens
gttctgtgtggctaagtccagttcattccccagacctcagtctctctctctgtgcaatgggaaattggatcaggcctctaagaat

SEQ ID NO: 43986 - DNA, 80 bp, Homo sapiens
agtgtccactaggcctggctctggggttctgagtcacttttcctgtcactgacagactctctggagaagaagtggacgct

SEQ ID NO: 43987 - DNA, 75 bp, Homo sapiens
ccagcctcagtctgtgaggctgtggcaccccccaccccaagcacaaggcctatagctctcccaggcgggggttgg

SEQ ID NO: 43988 - DNA, 106 bp, Homo sapiens
ccacagggtggaagtctgggcccagaaggaaaacgaaggtactaggttgaatagtgtccccccaaattcatgtccatctggaacctcagaatgtgaccttatttgg

SEQ ID NO: 43989 - DNA, 58 bp, Homo sapiens; identical to SEQ ID NO: 2531

SEQ ID NO: 43990 - DNA, 76 bp, Homo sapiens
gagtggctctgtgaggctctgttcactgtgcctctgcctcccagaggctgtggggaggaaggccagggagcagctc

SEQ ID NO: 43991 - DNA, 126 bp, Homo sapiens
cctcgggttgggtgggtgtctggggagtacagctgggcagggctcagcctgggctggactcagtcgccctctctgcctgtgggcactggagcctcagggcctgtgggtgccggaggctgtggggag

SEQ ID NO: 43992 - DNA, 70 bp, Homo sapiens
ggagctctcagcctgtgtagtctgtgtgttcagcagaatgaacaaatgccccggagaatgtgagacctcc

SEQ ID NO: 43993 - DNA, 59 bp, Homo sapiens
ttaagatgaaccctcactcactctgtcgcccaggctggagtgcagtgacatgatcttag

SEQ ID NO: 43994 - DNA, 87 bp, Homo sapiens
ctactgttcatctctaagtctctgtttctgtgacttcaaaaggaagttagcattttccttgcagaggtgctgaggattgaatgatag

SEQ ID NO: 43995 - DNA, 117 bp, Homo sapiens
gagacatgactgccttgggccaggcctgggatagtcaaggggtcacactcacctgttgggacctggcttcagtggcttcaatctaggcaatggcctgatgggcggctgccccttctt

SEQ ID NO: 43996 - DNA, 58 bp, Homo sapiens
ggtcatggtgactctgagccaggtaacactacgttagtctcagtctgtcactgtgtct

SEQ ID NO: 43997 - DNA, 101 bp, Homo sapiens
tctgtgcagcagaactggcgagtaaaaccatctatctttttttttttttttttttttttttttttttttttttgaggcagagtctggctctgttgcccagg

SEQ ID NO: 43998 - DNA, 70 bp, Homo sapiens
ctgcagccagacatacactctcccaggaaaagtcgagaggattgttctctggggaaactggttcactcag

SEQ ID NO: 43999 - DNA, 90 bp, Homo sapiens
tgcgacatatatgacttcattggcttggtgtcagaagagagtttggagaggagagactgagacagcaagtccagttaggaagctgttgca

SEQ ID NO: 44000 - DNA, 110 bp, Homo sapiens
ggtccttgaatggcagtgacgttccgctcctcccactgaataggtgcctagatgccacatcacagagcacagtgagctggagagacttaaaggaaactggcattcatact

SEQ ID NO: 44001 - DNA, 95 bp, Homo sapiens; identical to SEQ ID NO: 68

SEQ ID NO: 44002 - DNA, 93 bp, Homo sapiens; identical to SEQ ID NO: 69

SEQ ID NO: 44003 - DNA, 68 bp, Homo sapiens
gggggcaagggtgaggtgggggagagatgaaggcctgagtcctctagacacacagtcactgggtctcc

SEQ ID NO: 44004 - DNA, 98 bp, Homo sapiens
tgaccatccatgtgtgtcctttcaggggcctgtgatagttgcttgggagtttaaacctcacagtagaaacactgctccttctagcccacttctggtta

SEQ ID NO: 44005 - DNA, 78 bp, Homo sapiens
ggtgaccgcatttgtgctgataacattgtgtgcgcagacccctgggtgttggtgctatctgtgtggctgtgtgtctct

SEQ ID NO: 44006 - DNA, 85 bp, Homo sapiens
tggttttgatttgcatttcccagatgattagtgatattgatcatttttcatatacttgttcttttgagaaatgtttatcaaacca

SEQ ID NO: 44007 - DNA, 111 bp, Homo sapiens
ttattaataacatttgatgattcaagttcataaaatttggatatgaattgtattgatacaattgattgtgttgtatcaattacatttcctgaatttgatcatttttagtag

SEQ ID NO: 44008 - DNA, 77 bp, Homo sapiens
tggacgacagagcgagattctgtctcaaaaaaaaaaaaaaaaaaatttctttggagacagtgtcactctgtcaccca

SEQ ID NO: 44009 - DNA, 79 bp, Homo sapiens
aagggaaaacttgataaggaaggcagacaagaactgggctgagtacagtgtctgtgtgtcttattctggtggctatctt

SEQ ID NO: 44010 - DNA, 112 bp, Homo sapiens
ctggtgaaaagcagagaaagagaccaaggtgaaaattcccccaaaagtgtgaacctgatcataattttttttaatttaatttttagagccagtgtctttctctgtcacccag

SEQ ID NO: 44011 - DNA, 58 bp, Homo sapiens; identical to SEQ ID NO: 87

SEQ ID NO: 44012 - DNA, 56 bp, Homo sapiens; identical to SEQ ID NO: 88

SEQ ID NO: 44013 - DNA, 119 bp, Homo sapiens
ccataggcagtgtgcccagagtagcagctcacaggcagttttgtagtcatatttatattcactttttttttttttttaagacggagtcttgctctgttgctcaggctggagtgcagtgg

SEQ ID NO: 44014 - DNA, 103 bp, Homo sapiens
gcaccagcctgggcggcaaagtgaaaccccatacctacaaaaaaaaaaaaaaaaatttttttttttttgagacagtttcactctgtcacccaggctagagtgc

SEQ ID NO: 44015 - DNA, 58 bp, Homo sapiens; identical to SEQ ID NO: 884

SEQ ID NO: 44016 - DNA, 56 bp, Homo sapiens; identical to SEQ ID NO: 885

SEQ ID NO: 44017 - DNA, 100 bp, Homo sapiens
gttctagtgtttttttgcactatagggtgatgataattgatgacaatttattatatattttcgaatagctagaagagtgcattttgaatactcccagaac

SEQ ID NO: 44018 - DNA, 67 bp, Homo sapiens
ccagagggtgcactcactctctctctgcacaaatacaaagaagaggtcacatgagtgcacaatatgg

SEQ ID NO: 44019 - DNA, 87 bp, Homo sapiens
ctactgttcatctcttagtctctgtttctgtaacttcaaaaggaagttagcattttccttgcagaggtgctgaggattgaatgagag

SEQ ID NO: 44020 - DNA, 64 bp, Homo sapiens
gtgtgcttcccatagattgaggggtttggattcagtgatgtccaaggctccctctatctgacac

SEQ ID NO: 44021 - DNA, 73 bp, Homo sapiens
gggggggggagtcagagtctcgctctgtcatccaggctggagtacagtggtacaatttctgctcactgcaacc

SEQ ID NO: 44022 - DNA, 62 bp, Homo sapiens
ttttgagactgagtctcgctctgtcgctggctggagtgcagtggcaggatctcggctcagag

SEQ ID NO: 44023 - DNA, 111 bp, Homo sapiens
gtgctgggattacaggtgtgagccactgcgcctggctggatgcatttatttttcttttaaaaaagtatctttatggtcaggcacagtggctcacacctgtaattttagcac

SEQ ID NO: 44024 - DNA, 69 bp, Homo sapiens
accctttttgtcacaactgtactgatttagttggatttctaacaaatagggattgttgttgcctggggt

SEQ ID NO: 44025 - DNA, 57 bp, Homo sapiens
tgagacagagtctcgctctgtcacccaggctggaggcagggacgcgatcttggctca

SEQ ID NO: 44026 - DNA, 79 bp, Homo sapiens
acactgcaccttgtgctgctgctccctgccacctggacaccgagggatggagggacgggcaccctctctggctcagtgt

SEQ ID NO: 44027 - DNA, 84 bp, Homo sapiens
tggacccaggtgctgctgacaatcttgtcttggctgctaaaaatcaactgagaagacacagatacagctgaaatcccagggcta

SEQ ID NO: 44028 - DNA, 104 bp, Homo sapiens
ccggccagtcacgtccccttatcacttttccagcccagctttgtgactgtaagtgttggacggagaactgataagggtaggtgattgacactcacagcctccgg

SEQ ID NO: 44029 - DNA, 69 bp, Homo sapiens
gcctcaatctgtctgactctcatcctgggctgcccaatgactgccaacgagtcagggtgcaggggaggc

SEQ ID NO: 44030 - DNA, 108 bp, Homo sapiens
tagtcttgacaaaatagtggttctagtagaatataatttaattttttaaaagcagcataggttgaaagacttggatggaatttatctaacactgtctgttattggctg

SEQ ID NO: 44031 - DNA, 104 bp, Homo sapiens
taactatatatataactatatataactatatatatatttgagactctctttatatatatatgtgtataactctctctatatatatatagttgagacagagtctc

SEQ ID NO: 44032 - DNA, 95 bp, Homo sapiens; identical to SEQ ID NO: 580

SEQ ID NO: 44033 - DNA, 93 bp, Homo sapiens; identical to SEQ ID NO: 69

SEQ ID NO: 44034 - DNA, 72 bp, Homo sapiens
cagtcagtgacactctgtgtcaatgtgtcacctttaaagggacaaaggagagatacagagggccactgattg

SEQ ID NO: 44035 - DNA, 95 bp, Homo sapiens; identical to SEQ ID NO: 68

SEQ ID NO: 44036 - DNA, 93 bp, Homo sapiens; identical to SEQ ID NO: 69

SEQ ID NO: 44037 - DNA, 91 bp, Homo sapiens
atatatatatatatatatatatatatgtaaaacattttaggtttttcttccaggctatttttactgtgtatatatatgtgtgtatatatat

SEQ ID NO: 44038 - DNA, 85 bp, Homo sapiens
tccctatgtatacagggagagaaaataagggtttttttttttttttttttttgacatgtattctctctctgtcttccagcctgga

SEQ ID NO: 44039 - DNA, 97 bp, Homo sapiens
ttcaagagaaagtgctaagcttaagtgtgggagagatctttagcaatggaagcatcatggattttttatttttaagtctgtggcacatttctctgaa

SEQ ID NO: 44040 - DNA, 57 bp, Homo sapiens
gtctagggatgagaactaacaccactgtgcatcacagtgtgtcagtctgtgccaggc

SEQ ID NO: 44041 - DNA, 86 bp, Homo sapiens
gggttgacaataacagagagagactagaaaatgggaagtgggacatttttattattattttaggacagagtctcactctgtcaccc

SEQ ID NO: 44042 - DNA, 119 bp, Homo sapiens
caccagcagtgtatgagagttccagttcttctatgtcctcgtcacacttggtattatcaatcttttttatttttgccagtctagagggtattgagaggcagtctctcagtgcgtgtgtg

SEQ ID NO: 44043 - DNA, 79 bp, Homo sapiens
ggtagagtgatcttactctctgtctctggatttgtggttttataattccacagtgcagcagttaaggaattgttctgcc

SEQ ID NO: 44044 - DNA, 111 bp, Homo sapiens
ggccaggcactgtggctcacgtctataatctcagcactttgggaggctgaggtggaaggatcacttgagcctcggagtttgagacaagcctgagcaacatagtgagacccc

SEQ ID NO: 44045 - DNA, 119 bp, Homo sapiens
gctcagaggagttaagtgagtggcccgagttcttagagctgaaagtctgtttgatacccagacccccactctcagtcactgcatcacctgccacttttgacctgcaccagatcttcagc

SEQ ID NO: 44046 - DNA, 127 bp, Homo sapiens
cctgaactgtgatgatggcagaaaaggacctagcttttcacctcttgcaagcccaccagagtcaggagagtgagctctgccccatctcttctgtcccaacccattgcacacaggcagccctggttct

SEQ ID NO: 44047 - DNA, 110 bp, Homo sapiens
tcctgaggcctctcacacacattggtttacctttgaaacactgtacattgagagctctcctgagggtgagtgtagacttgaaccaagacaatgtttttgaggacaaggga

SEQ ID NO: 44048 - DNA, 58 bp, Homo sapiens
tgagacactgtctcgctctgtcgcccaggttggagtgcagtggcgcgatcttggctca

SEQ ID NO: 44049 - DNA, 115 bp, Homo sapiens
ttgaacaaattcagtgctgctgaagggtctggaaaaatgggcattctctctcactgtttatgagaatgtaatttggtacaatatttctagaaagcagtttgaggacaaatatcaa

SEQ ID NO: 44050 - DNA, 89 bp, Homo sapiens
gtgaactcattgcggtggggaggatgccaagctattcgtggggtgcaaagctgttcctgaaggaggccacctccaacactggggatcac

SEQ ID NO: 44051 - DNA, 100 bp, Homo sapiens
tgggcatgcatttgcacctgtctgatggagtctttgcaggaggctggcccaccctgtcccttctgtctcactctcagaaagggcgtccccctctgcacca

SEQ ID NO: 44052 - DNA, 91 bp, Homo sapiens
tcagatgaaatggctcatgcctatagtcctacctactcaggaggctgaggtggtaggatcgcttgagggcaggagttcaagaccagcctgg

SEQ ID NO: 44053 - DNA, 116 bp, Homo sapiens
gcacataaggttcacagtgagggctgttctacttgtatccctggcagcctccctgattccctgtaagccctgtgctggggaggctgtgtcctctccgttatttctcttacaaagaa

SEQ ID NO: 44054 - DNA, 91 bp, Homo sapiens
ggccaaagggggtctctcctaagagctgcaggcacccccaggcttggctgtctgtcactggctgaccctctttcttcccaccgtagccccc

SEQ ID NO: 44055 - DNA, 109 bp, Homo sapiens
ggcacagtggatgcacagacagaccagcggagctgaggggcaggcgcctctgtgtctctgtgcttcttggctccagctggcagaacgagggctgtgcactctgcttgcc

SEQ ID NO: 44056 - DNA, 103 bp, Homo sapiens
tggaacaatataattatttttctgatttttctgatgatatacattcattgtttttaaagtgaagggtatagaaaagtatgaagaacaataatactgtattcca

SEQ ID NO: 44057 - DNA, 120 bp, Homo sapiens
tgtatggatatatatatacacacacatatatataatatatggatatatatacatatatataatatgtgtgtgtatatatatatacacatatatataatatgtgtgtgtgtatatatatat

SEQ ID NO: 44058 - DNA, 75 bp, Homo sapiens
gctcacaaggcacaggttgaatttctaagcttctgcacatgcttcagcttgtctcaatctctctgtatatgtggc

SEQ ID NO: 44059 - DNA, 75 bp, Homo sapiens
gcagcactggttaggagaggaaatagatggctcttccctagggcctcgtctgtgtttctctcaatgagttgaggc

SEQ ID NO: 44060 - DNA, 114 bp, Homo sapiens
gtgtcagaagtgaaattgctggctttaatatagtacccatttttaaatctttcaatataattgatattttcacggacattatatgaaactgtgcaaatccccacatctgaccac

SEQ ID NO: 44061 - DNA, 104 bp, Homo sapiens
gcatgattcctgtagtagcctgtatccacagttctttgtctcttacagtgtcagactgagcccaggatggagtaagagccaggactggcatgccctggaagtgc

SEQ ID NO: 44062 - DNA, 86 bp, Homo sapiens
aacacattcagtcagtccaatgttgactgggcagccttggtgtgccaagctactgaactaaggtctgttgggaaggaaaatgtgtt

SEQ ID NO: 44063 - DNA, 83 bp, Homo sapiens
ggatgctggtgggagaattctgaggcaggatggggtgcgggggagtcaggcacacactgtccctcatctctcggatagcagcc

SEQ ID NO: 44064 - DNA, 82 bp, Homo sapiens
ctccatgatctctgaagccccttctgtgtctgtatctctaaactcatcaatctcagaactcaggtcttcagagggcctgtag

SEQ ID NO: 44065 - DNA, 90 bp, Homo sapiens
gtctttagggagatttgtgcaaagagaacagggccaagcatgttttatttattttcaatgagggctttggactcaagtccctctgtggac

SEQ ID NO: 44066 - DNA, 73 bp, Homo sapiens
ttagcctgcgcataaaatggttctagacacagcagctgtctgtcagtcagtctgccttttatgcaaggggtgg

SEQ ID NO: 44067 - DNA, 115 bp, Homo sapiens
agaattgttctgcctctttctttccatgtgtgtgcagatgtctgagtgtgtgtgtgtctgtctgtaggtattacacctctgcctttcacattaaggaggagttttcacaacatct

SEQ ID NO: 44068 - DNA, 84 bp, Homo sapiens
ttacaacttcagacggtcaggtcactgccattggggtgccatagagcacacagaccagactacctgcagccctggagtctgtga

SEQ ID NO: 44069 - DNA, 90 bp, Homo sapiens
gttgtgtgagccagataatggagtttcaggatgatggttcctactcagcctgggtccctgagtgactgtatggaataaagctctgccgac

SEQ ID NO: 44070 - DNA, 101 bp, Homo sapiens
aggcttttagtggcctagcctctctggctcccactttgccagattttctcacattccaggaggaaaaagacagaagaggagccttctaggtcacagagcct

SEQ ID NO: 44071 - DNA, 139 bp, Homo sapiens
agtttagtgttgtctaagtgaacagtgtttgtcaggtctacagtagtgtgcagtaatgtcctggccttcacatccacttacctctcactctgactcacccagagcagctttcagcgctgcatgctctgttcatggcaag

SEQ ID NO: 44072 - DNA, 76 bp, Homo sapiens
gcatgtggtgtttggttttctatctctttgttagtttgataaggatagtggattccagcttcaatcacatccctgc

SEQ ID NO: 44073 - DNA, 119 bp, Homo sapiens
atcggtgggtgcttgcagcaggggcctgccttcagaagctctccaactgttagatagagtctaatgatgaaagagctatggtgatggccactggcaagcaccttgacttggcagctgat

SEQ ID NO: 44074 - DNA, 95 bp, Homo sapiens; identical to SEQ ID NO: 68

SEQ ID NO: 44075 - DNA, 93 bp, Homo sapiens; identical to SEQ ID NO: 69

SEQ ID NO: 44076 - DNA, 116 bp, Homo sapiens
gatagtagagtgatttctgtttattttacaataaatgtataatctgagaaaattaaatactttattttttattttatttatttattttatttcgagacagggtctctcattctgtt

SEQ ID NO: 44077 - DNA, 95 bp, Homo sapiens; identical to SEQ ID NO: 68

SEQ ID NO: 44078 - DNA, 93 bp, Homo sapiens; identical to SEQ ID NO: 69

SEQ ID NO: 44079 - DNA, 71 bp, Homo sapiens
tcctcatgtgggaggagtgagagagctctctggggtctattttataagggcactaatcccatttatgaggg

SEQ ID NO: 44080 - DNA, 100 bp, Homo sapiens
acatcttgactgtactttgctcctttcttttgatctcctgctggtacttcccactggttgagttcagctagacatgaggatgcaggaagcttgttgatgt

SEQ ID NO: 44081 - DNA, 117 bp, Homo sapiens
tatggctgcatagtattccacggtgtatatgtgccacattttctttttttttcttttttttattttttattatactttaagttttatggtacatgtgcacattgtgcaggttacata

SEQ ID NO: 44082 - DNA, 120 bp, Homo sapiens
gtatttacatctatattttaggtgatcacatatgttaatatatgttaatataatatacaatatattgatatatttacatatatattttaggtgatcatgtatgataatatatgttaatat

SEQ ID NO: 44083 - DNA, 100 bp, Homo sapiens
cattataaaatggttcaatattaggaaatctttttttatagttcatcacatgaaaggggaaaaaaaagaaaagatatttgatattgaacatttattcctg

SEQ ID NO: 44084 - DNA, 90 bp, Homo sapiens
gttaatatttagaaagcaattgcttggaaaattttttttaatctatgagagaaaatctaaattgcaattgtatattgtttggataataac

SEQ ID NO: 44085 - DNA, 104 bp, Homo sapiens
ctaccaagtggtgtgaattcaggtgatatgctacgtgctgtgtaagtatcttattaaatattcacagcaaccctgaggcgagttacatgattcccattttatag

SEQ ID NO: 44086 - DNA, 111 bp, Homo sapiens
gttgtgaagggatttagaggggaagaggagggagagagtttgttaattcgaatgtatttatcatttttaggatcattttctcccagagatccacagaaattcctacagaac

SEQ ID NO: 44087 - DNA, 83 bp, Homo sapiens
aggcagaggacacagtcttgtggcacaattaagggcacacgctatagtgatgtatccgtctgtctgtctgtatcctctggtct

SEQ ID NO: 44088 - DNA, 64 bp, Homo sapiens; identical to SEQ ID NO: 44020

SEQ ID NO: 44089 - DNA, 80 bp, Homo sapiens
ccctgagctccacagagaacacagccagcagaagacacattccctgtcatccagaaatgggtttgattctcagctgaggg

SEQ ID NO: 44090 - DNA, 63 bp, Homo sapiens
ctcttttttttttctatttgtatacgtatatttatatgtatatctatatcgagagagagagag

SEQ ID NO: 44091 - DNA, 83 bp, Homo sapiens; identical to SEQ ID NO: 44087

SEQ ID NO: 44092 - DNA, 64 bp, Homo sapiens; identical to SEQ ID NO: 44020

SEQ ID NO: 44093 - DNA, 63 bp, Homo sapiens; identical to SEQ ID NO: 44090

SEQ ID NO: 44094 - DNA, 80 bp, Homo sapiens; identical to SEQ ID NO: 44089

SEQ ID NO: 44095 - DNA, 122 bp, Homo sapiens
tatgtggtatatatatgatagatatcatatgatatcatatatatcatgatatatatatcatatgatatatatatcatatgatatcatatatatcatgatatatatatcatatgatatatata

SEQ ID NO: 44096 - DNA, 80 bp, Homo sapiens; identical to SEQ ID NO: 44089

SEQ ID NO: 44097 - DNA, 63 bp, Homo sapiens; identical to SEQ ID NO: 44090

SEQ ID NO: 44098 - DNA, 93 bp, Homo sapiens
ttgggtgctataaagatgagtctggcttggaacagttgtgacattcttgtcttactgggttgccagtgctggtttttattggcagtgtcctaa

SEQ ID NO: 44099 - DNA, 103 bp, Homo sapiens
tacacagaaactcacctcccagcacagccaggagacatgctgcctcgcctctggcatttaaacacagtgaccacagaatgtctctcctgggccaggatgtgta

SEQ ID NO: 44100 - DNA, 95 bp, Homo sapiens
aggaaaataacagctatagaagtcagttaaaaataataataataattattattattattattattatttgagacgaagtttcgctcttgttgcct

SEQ ID NO: 44101 - DNA, 113 bp, Homo sapiens
agattgagagatcggatggttgctgtgtctgtgtggaaagaagtagacatgggagacttttcattttgttctgcactaagaaaaattcctctgccttgggatcctgttgatct

SEQ ID NO: 44102 - DNA, 84 bp, Homo sapiens
gtgtgtgtttttgagacagactctctcactctgttgcctagcctggggtgcagtgttggggtctcggctcactgaaacctccac

SEQ ID NO: 44103 - DNA, 90 bp, Homo sapiens
tactactgattctttttctttttttttttttttgagacagagtctcactctgtcactcaggctggagtgcagtggtgagatctcggctca

SEQ ID NO: 44104 - DNA, 97 bp, Homo sapiens
ccatcctcgacctcccttggcaccatgatcaatgctggtgtctgctcagtctccctctctgaattgtgtgtggcctgctcaggggtttggctgatgg

SEQ ID NO: 44105 - DNA, 105 bp, Homo sapiens
attgttcagtagtattcaattgagtggatatatcacattttgtttatctgttcatcagttgatggatgttggggttttttctactttttggctattgtgaataat

SEQ ID NO: 44106 - DNA, 100 bp, Homo sapiens
ctgaaatgtggctagtgtgaccaaggggctgaattttacattttatttatttatttattttgagatggagtctcactctgtcacccaggctggagtgcag

SEQ ID NO: 44107 - DNA, 120 bp, Homo sapiens
cttccaagctcactcacatggctgttggcaggaaggcatcaggttctggctggctgtttgccagaggtatcagcttcttgttacatgggtctatccatgggggagctcacaacatggcag

SEQ ID NO: 44108 - DNA, 78 bp, Homo sapiens
acccagaagagatgctggctgtcgtgagtgagcagtcagcctttgtcaccatgcaggtcagcctctctgactgcaggt

SEQ ID NO: 44109 - DNA, 95 bp, Homo sapiens; identical to SEQ ID NO: 68

SEQ ID NO: 44110 - DNA, 93 bp, Homo sapiens; identical to SEQ ID NO: 69

SEQ ID NO: 44111 - DNA, 58 bp, Homo sapiens; identical to SEQ ID NO: 1725

SEQ ID NO: 44112 - DNA, 67 bp, Homo sapiens
cagcatgagcctgggaggattgcaaggctcgggcctcccctctgctctgtgtctctcacggtggctg

SEQ ID NO: 44113 - DNA, 111 bp, Homo sapiens
cctgctggtttggtttggttctcctcagaaatggcttactttatttgtacttgacttgagttacattaaagcaggcaaaaatatttcttaagagctgaaatttcaggttgg

SEQ ID NO: 44114 - DNA, 58 bp, Homo sapiens
tgagacagagtctcactttgtcactcaggctggagtgcggtggtgtgatctcagctca

SEQ ID NO: 44115 - DNA, 58 bp, Homo sapiens; identical to SEQ ID NO: 523

SEQ ID NO: 44116 - DNA, 62 bp, Homo sapiens
tgagactgagtctcgctctgtcacccagggtagagggcagtgaatggcgtgatctcagctca

SEQ ID NO: 44117 - DNA, 114 bp, Homo sapiens
tggggtcttttgtggttccatatgaattttaggagtctttttatatttctatgaaaaattctactggaattttgatagaggttgcattgaatttgtagatcactttggataata

SEQ ID NO: 44118 - DNA, 65 bp, Homo sapiens
gtgtgtgtgtatgtgtgtgtgtgtgtgtgtgtgtgtgtatatatatgcatgtgtatacttaacac

SEQ ID NO: 44119 - DNA, 79 bp, Homo sapiens
tctctgaagccatggcctgagttgtaccttggccccttttagctgagtggctgagtggctgagtggctgagatgcaggg

SEQ ID NO: 44120 - DNA, 121 bp, Homo sapiens
gtgtttactttcatggatatatttcatgtgtatattttcacatatatgtgtatatgtatatgtctgggtgagcatgtatgtgcacatgtgtatgtgtatatgtatatgtgtgcgggtattt

SEQ ID NO: 44121 - DNA, 80 bp, Homo sapiens; identical to SEQ ID NO: 44089

SEQ ID NO: 44122 - DNA, 127 bp, Homo sapiens
cgcatgtgtacctgtacctgtgtgactgcatcggcatctgatgaactcatatgtctgtgtcactgagtctggggacatgtgattatgcacttccctgagggagtgcatctcaagctgtgtgaccgac

SEQ ID NO: 44123 - DNA, 109 bp, Homo sapiens
ggctctccatacaaaacttaactcttttttttttctatttgtatacgtatatttatatgtatatctatatcgagagagagagagagagaaagagtcttgctgtgttgcc

SEQ ID NO: 44124 - DNA, 63 bp, Homo sapiens; identical to SEQ ID NO: 44090

SEQ ID NO: 44125 - DNA, 128 bp, Homo sapiens
tgtggagaaaaaatcagattgcctgtggggacatccgggtagctgaaggaaatccacacacccagactctcagacctgaggtaggctccccaggggctgggataggagttggacagaatggaggatgg

SEQ ID NO: 44126 - DNA, 80 bp, Homo sapiens; identical to SEQ ID NO: 44089

SEQ ID NO: 44127 - DNA, 69 bp, Homo sapiens
gtgtgtgtgtatgtgtaaatatgtgcgtgtgtgtgtatatatatgtgtatatatgcatatatataacac

SEQ ID NO: 44128 - DNA, 105 bp, Homo sapiens
tgcatttttattttaccaagtgttagaatttttactctgcttttgtgggctctgggttagctacttggttgtttagatgtaaaatgattagcagggaaaactctg

SEQ ID NO: 44129 - DNA, 86 bp, Homo sapiens
tctgaaggataggagactggggcatttattccttggctcatacctgccactggttgaaggttgtgttaattctctttactttcaga

SEQ ID NO: 44130 - DNA, 104 bp, Homo sapiens
gtgacagtaagcagtgaggggaaacttgtgctttttactctatagaaaccttttttttttttttttgagatggagtttcactcttgttgcccaggctggagtac

SEQ ID NO: 44131 - DNA, 108 bp, Homo sapiens
gccactgcactccagcctgggtgacagagtgagacctcatctcttttttttttttttttttttttgagatgaagcctcactctgtcacccaggctggagtgcaatggc

SEQ ID NO: 44132 - DNA, 90 bp, Homo sapiens
ctccagcctgggtgacagagtgaggcttcatctcaaaaaaaaaaaaaaaaaaaaaagagatgaggtctcactctgtcacccaggctggag

SEQ ID NO: 44133 - DNA, 80 bp, Homo sapiens; identical to SEQ ID NO: 44089

SEQ ID NO: 44134 - DNA, 109 bp, Homo sapiens; identical to SEQ ID NO: 44123

SEQ ID NO: 44135 - DNA, 63 bp, Homo sapiens; identical to SEQ ID NO: 44090

SEQ ID NO: 44136 - DNA, 58 bp, Homo sapiens; identical to SEQ ID NO: 637

SEQ ID NO: 44137 - DNA, 56 bp, Homo sapiens
gagatagagactcgctctgtcacccaggctggagtgcagtggtgcgatctcagctc

SEQ ID NO: 44138 - DNA, 73 bp, Homo sapiens
gttgttgttgagacagagtctcactctgtcgcccaggccagagtgcagtggcgcaatctctactcagtgcaac

SEQ ID NO: 44139 - DNA, 92 bp, Homo sapiens
tttattttttgtctgtggttgtacctataattggggagaattttttttctttaagtgtagatcaattatggtataggacattggaaggtaga

SEQ ID NO: 44140 - DNA, 87 bp, Homo sapiens
tgtacatctggatacattctcattttaatttttttttattggttctagggacttttggtaaagattgtggatgtcttcagttttaca

SEQ ID NO: 44141 - DNA, 64 bp, Homo sapiens
gagctggggtctctcactctctcgcccaggctggagtacagtggcacgagcatcaccatggctc

SEQ ID NO: 44142 - DNA, 149 bp, Homo sapiens
cctggacatgtgatgctagagagcagagactgatgtatttcttttttctttttttttttttttctgagacagtgtctctctctgtcacccaggttggagtgcagtggtgtgatctcggctcactgccagctccgcctcccgggttcaca

SEQ ID NO: 44143 - DNA, 77 bp, Homo sapiens
ggagtctctctctgtcacccaggctggagtgcagtggctcactgcaacctctgcctcccgggttcaagcaagtctcc

SEQ ID NO: 44144 - DNA, 119 bp, Homo sapiens
gtgtatatagacacatatacacgcatgcagatatacacaaatacaaattttgatatacaaatatttgtttatattttgtatatatgtatatgtgtgtacctatttgtgtatatatatac

SEQ ID NO: 44145 - DNA, 79 bp, Homo sapiens
agcaaacacaggagccctcaaatggacctagcagtgggccttgcttcctgcctgccatctctgagtctgtgtcactgct

SEQ ID NO: 44146 - DNA, 104 bp, Homo sapiens
cttatctgagattctgttgaatattcagtatatgtatgtatacatgtgtgtacatgtatgtaaatatgcatatgggcttttgaataatcatatacttagaagag

SEQ ID NO: 44147 - DNA, 113 bp, Homo sapiens
tagttgtgaataacattccattgtcaggatgtagcaaagtttatttattcatttacctactgaaggaaatcttagttgcttccaagttctggcaattatgaataaaactgctg

SEQ ID NO: 44148 - DNA, 74 bp, Homo sapiens
tgttgttttgagacagggtctcactctgtcacctaggctggagttcagtggtgcgatctcggctcactgcaaca

SEQ ID NO: 44149 - DNA, 118 bp, Homo sapiens
ctgatgggcgcttaagttgattccatatcttttctattgtgaatcgtgctacagtgaatgtgcaactgcatgtgtcttttagactgatcattttagaaggatttattttcttttgagt

SEQ ID NO: 44150 - DNA, 87 bp, Homo sapiens
tcgggcctagtatggtgcctcattcatagcaggcacttgatatatatatattagcttttaaatgaatgagtgaataaagaggtttga

SEQ ID NO: 44151 - DNA, 114 bp, Homo sapiens
aatatatacatacacataaatatatataatttatatgtgtatatactatattgtatatgcatatatatatgtatgtatgtgtgtatatattcatgtatttatgtatgtataatg

SEQ ID NO: 44152 - DNA, 82 bp, Homo sapiens
ctgtagagttttgttgcatttatttatttatccaatgaatatcaattgggtttctacaaactaaatgtactgaactctgtag

SEQ ID NO: 44153 - DNA, 112 bp, Homo sapiens
ggtcaccatgtaatagggtctcttgtaatgtttacatagaatatttatcagaatttatagttatattgtttgtgtgtgcctatgttgttgcatagttacatgtgtttcggcc

SEQ ID NO: 44154 - DNA, 80 bp, Homo sapiens
ggattacaggcatgagccaccatgctcggcccgagatgtgcgtgttttaaagggtcagtagtgattatgatgagcaatcc

SEQ ID NO: 44155 - DNA, 76 bp, Homo sapiens
ctcacgcgcatgtgtgtgtgtgtgtgtcacatacacgcacacgcacacacaaacttgccttatttaatagcttgag

SEQ ID NO: 44156 - DNA, 72 bp, Homo sapiens
gcatgtgtgtggatgtgagtgggtgtggatgtgagtgtgtacatgtgtgcatttctgcatttgtatatgtgt

SEQ ID NO: 44157 - DNA, 81 bp, Homo sapiens
tatatgcttatatatctgtagtatatatgtatatatatgtgaatatgtatccatgtataattttggatggtagggcatata

SEQ ID NO: 44158 - DNA, 70 bp, Homo sapiens
acatgtatatgtatatatatatgtgtatatagccacatgtatatgtatatgtatacatatatatacatgt

SEQ ID NO: 44159 - DNA, 84 bp, Homo sapiens
tatgtatacatttatacatatgtatgtatacatgtatatatgtatgtatacatgtatatataggtatgtatacatgtatacatg

SEQ ID NO: 44160 - DNA, 76 bp, Homo sapiens
cgcacttcctcagatctgggtgacagtccacagtgcccacaggggcctcgcggcatctcccagtctcattggcgtg

SEQ ID NO: 44161 - DNA, 103 bp, Homo sapiens
gtgctaacccaagcctggccttggcaaccttacttttcttacttttgcagctcagtgaagactgtctggaatgcatcgtggcacaggctgtgtgtgttgtcac

SEQ ID NO: 44162 - DNA, 71 bp, Homo sapiens
ataccattgcctgagttctgtcacaaagatttttatttaattggtcttggatggggcttaaacaatggtat

SEQ ID NO: 44163 - DNA, 63 bp, Homo sapiens
tctgtttgactcggacactctgtctcctccagcttggggacactggtgctcctggttctcagg

SEQ ID NO: 44164 - DNA, 107 bp, Homo sapiens
atggatgaagaaaatgtggtatatatatatatatggatgtgtgcatatatatgtgtatatatatgtatatatgtacatatacatacctgggaatactattcagccat

SEQ ID NO: 44165 - DNA, 95 bp, Homo sapiens
ctcaagttacaattggtgtcagaagtgagagtggtcttatgttggctgtgtgctctctaacttggtctgaactcacacacaagtataatagtgag

SEQ ID NO: 44166 - DNA, 110 bp, Homo sapiens
tcaatattcctgatataaaaaatatgtttattttctctttttttttctttatcatttgaatgagagcaggacagaatttggcaatactttttgtgttatgggctatatgg

SEQ ID NO: 44167 - DNA, 83 bp, Homo sapiens
taaaaatggtacgtatgctaagttcaggatttatatttttgtaaaaactatgcctgtgggcatatgtataaaaattattttta

SEQ ID NO: 44168 - DNA, 95 bp, Homo sapiens; identical to SEQ ID NO: 68

SEQ ID NO: 44169 - DNA, 93 bp, Homo sapiens; identical to SEQ ID NO: 69

SEQ ID NO: 44170 - DNA, 93 bp, Homo sapiens
tacactaaaaaatataaatatatgtgtatttataaatatacacatataaatatgtgtgtgtgtgtatatacatatattttcagtctttgtgta

SEQ ID NO: 44171 - DNA, 95 bp, Homo sapiens; identical to SEQ ID NO: 68

SEQ ID NO: 44172 - DNA, 93 bp, Homo sapiens; identical to SEQ ID NO: 69

SEQ ID NO: 44173 - DNA, 117 bp, Homo sapiens
atagttggatgtttattttatcaattctgtcagtttctgttattaatggaatgcttaatacatttatatttaatgcaattattgataagataggatttatatctaccactttgctat

SEQ ID NO: 44174 - DNA, 143 bp, Homo sapiens
tgatggtgggtaggggaactggggtgctatgtccctcatttatggtcagttcatcagatgaactgtagtgttattcatgtagtgtttctttctaatattttccaacatttatagtttatctacagataaaaagacaagaaatg

SEQ ID NO: 44175 - DNA, 58 bp, Homo sapiens; identical to SEQ ID NO: 502

SEQ ID NO: 44176 - DNA, 118 bp, Homo sapiens
acaagggtgtcactaattgaggatcatcttagaattctacctaccagagtgtgttccattcacagaaatgagagatgagagctaagtgtgctgcttcaccgaacgaggctgagcttgt

SEQ ID NO: 44177 - DNA, 61 bp, Homo sapiens
agtgtgtgtgtgtatgtgtgtgtacacatccgtatgtatatgcatgtatatatgtatgtct

SEQ ID NO: 44178 - DNA, 103 bp, Homo sapiens
ttggtgatttgtgctgatgtgtgtgtgtgtgtatgtgtgcatatgcatgtttttatgtgtatcagtatatttatacattgtattagacacacccacataccga

SEQ ID NO: 44179 - DNA, 74 bp, Homo sapiens
atgtaaatatccatatctattaacacacagttataccccctgtgtttatctgtgtgtctgtgtgtagtttgcat

SEQ ID NO: 44180 - DNA, 115 bp, Homo sapiens
tgcctatttttaatcatgttatgcattgtgtgtatgtttgctttttattattattattattatactttaagttttagggtacatgtgcacaatgtgcaggttagttacatatgta

SEQ ID NO: 44181 - DNA, 106 bp, Homo sapiens
tatacatatatatgtatatatgtgtgtgtatgtatggacataggtatgtatatgcacatgtacatgtatatatgtatatatccatcttcaatataaatatatcata

SEQ ID NO: 44182 - DNA, 116 bp, Homo sapiens
cttacggtgtactctgacagtcttttattctatttttcaagacttattttatatatacatattttttatttccataggttattggggaacaggtagtgtttggttacatgagtaag

SEQ ID NO: 44183 - DNA, 111 bp, Homo sapiens
tacataaaagaaaaatataattggctacatatatgcatatatgtgcatatacatgtatatatatatatgcatatacagatatatatagccaattacatttcttttattgtg

SEQ ID NO: 44184 - DNA, 75 bp, Homo sapiens
gccaaatgtggaagctccgtcagtctctgggacactgtcccaaggcatccttgcatggagccagcatatcttggc

SEQ ID NO: 44185 - DNA, 117 bp, Homo sapiens
gccctagcactctccctgtactgcttttattccttgaggttctttctgtcacagtctgactgtttcagcctaggttgtgcagtttctactaggggtgagatctgtgagggctaaggc

SEQ ID NO: 44186 - DNA, 109 bp, Homo sapiens
gccattccaggatcaaaaatctatcctaagaattaaagcagagatctcagattctctgaatgtcagcttctagtttggtgttagttagatatattaattggggaagggc

SEQ ID NO: 44187 - DNA, 122 bp, Homo sapiens
ggactcttcttgcatttcattgtttctgtggaaaattggttgatagagcatcaccaagtgtatggcttcttatcctcaggcatttcttccaccaacactggcgatggtccactgtgcacaga

SEQ ID NO: 44188 - DNA, 74 bp, Homo sapiens
ccagggtgagctgagtgtgagcacacaggattcttagggcatgggattgagttcataatctcagaatggcctgg

SEQ ID NO: 44189 - DNA, 115 bp, Homo sapiens
gttaaggtagtctaggctagttgtcatggaaccacgttgccagggctctgactctgactcaatcacttgtcagctctgtgacgtcaggcaaattgcttcaccttcctgcttttac

SEQ ID NO: 44190 - DNA, 96 bp, Homo sapiens
cttgatttgattttgggagttgattctgtctttctctgtctgggctaagatgctttaaatatctccctgaagttggaggagaaaaaaacaccaaaa

SEQ ID NO: 44191 - DNA, 75 bp, Homo sapiens
ggccctgtgacctgagatctctctcactgaggcagcagagtgattcatattagagcagaagaggggatcagggct

SEQ ID NO: 44192 - DNA, 73 bp, Homo sapiens
gtggaacatctcactgctctgggtcacaggcagggtgtttccctccctgctcactgctctgtttgtctctccc

SEQ ID NO: 44193 - DNA, 58 bp, Homo sapiens; identical to SEQ ID NO: 884

SEQ ID NO: 44194 - DNA, 56 bp, Homo sapiens; identical to SEQ ID NO: 885

SEQ ID NO: 44195 - DNA, 156 bp, Homo sapiens
tgcatacgtcgctgtatatatatatatacgtatatatatacatatatatgtatatatatatacgtatatatatgtgtgtatatatgtgtatatatatacacgtatatatgtgtgtatatatgtgtatatatatacacgtatatatgtgtgtatata

SEQ ID NO: 44196 - DNA, 76 bp, Homo sapiens
atgtgtatatatacacgtatatatgtgtgtatatatgtgtatatatatacacgtatatatgtgtgtatatatatat

SEQ ID NO: 44197 - DNA, 103 bp, Homo sapiens
ccaaagggaaggccgacttttctcttctggcgcaattctctgggtccttgtagctttctgctcacactgactcacaaattcccgaggtctcctttcctcttgg

SEQ ID NO: 44198 - DNA, 108 bp, Homo sapiens
ctcctgtgaagcaaaggagagaatggggactaaaatggcaaaatgatgatgatgatgatgatgattgcagccacagtttgctatactcttaccttacatcagcagggg

SEQ ID NO: 44199 - DNA, 100 bp, Homo sapiens
gaggtattttaaaaggcaaatcaaaaacacattggtattcaaagtttacaactatattctttcctgtgggtttgaccttagaagtgattagaactgcctc

SEQ ID NO: 44200 - DNA, 117 bp, Homo sapiens
ggactgttcaacttacctggcagccactcccagagcccctggaactctggcccaaggctctctgactgactccttcccagatcttctcggcttagcggctgaagactgacagtgtcc

SEQ ID NO: 44201 - DNA, 88 bp, Homo sapiens; identical to SEQ ID NO: 1308

SEQ ID NO: 44202 - DNA, 81 bp, Homo sapiens; identical to SEQ ID NO: 1309

SEQ ID NO: 44203 - DNA, 77 bp, Homo sapiens; identical to SEQ ID NO: 1310

SEQ ID NO: 44204 - DNA, 119 bp, Homo sapiens
gcctggatacagagtggaccggctggccccatctggaagactagtgattttgttgttgtcttactgcgctcaacaacaaatcccagtctacctaatggtgccagccatcgcagcggggt

SEQ ID NO: 44205 - DNA, 92 bp, Homo sapiens
gcattctctctgtgtgtgtccaaacttcctctttttatttttattttttatttttgagatggagtcttgctctgtcgcccaggctggagtgc

SEQ ID NO: 44206 - DNA, 78 bp, Homo sapiens
gcttatgatcttctgacatctctgtgtctgaccattatatagaggggatatttagcaatgttgggagacatttctggt

SEQ ID NO: 44207 - DNA, 189 bp, Homo sapiens
ggtccacagctggattcatggatgggtctataggtgagtatatggctagatccatggctgggtctatggctcagtccatgcctaggtctatggatgggtccacagctgagtccgtggctgggtctatggctgggagtgtggctgggtctatgagtgagtctatagctgggcctatagctgggtccatgg

SEQ ID NO: 44208 - DNA, 110 bp, Homo sapiens
ccagcctaggtgacaagagcaaaactctgtctcaaaaataaataaattaataaataaattaattaattaattaaatctgtgactgggtgcatggctgggtctatggctgg

SEQ ID NO: 44209 - DNA, 76 bp, Homo sapiens
agacacagatttaagtgtagatccagccatgcacccagctgaagatcctggatctgcctctctcccactctgtgct

SEQ ID NO: 44210 - DNA, 115 bp, Homo sapiens
atgaagggaatgaagaatgaagggtgctgaggaacaagttgcagtgtgaagtgtgtgtgcatatgatggaaatagcatggatgtcagagccagacatgcgttcgaatcccagcat

SEQ ID NO: 44211 - DNA, 84 bp, Homo sapiens
cttgagaatttgagactagatagagtactctcagcattttggaaatgcctgttggtaatgtatttggtagaagactattttaag

SEQ ID NO: 44212 - DNA, 116 bp, Homo sapiens
ggagggcgtagcctcctctgtcttctgacagacacctctggctcttctgctgagcctcacacagacagacgcactgccaaggggtggggatggtgaagacagaagccaggtcctct

SEQ ID NO: 44213 - DNA, 82 bp, Homo sapiens
gtgagttctaatgagatctgatggtttaaaagtgtgtggcatttccgccctcacactctcaatctctctctcctgacaccac

SEQ ID NO: 44214 - DNA, 81 bp, Homo sapiens
ggtacacactgtaggctcagctactagggaggctgaggtggaaggatggcttgagcccgggaggttgagactgcagtgacc

SEQ ID NO: 44215 - DNA, 99 bp, Homo sapiens
tgatggtggtgaccgtgtcatgaaaggagcccatctcattgagtgccagtgtcactgagaggctgtgaatcaaacgattgacaaggtcgcagggccaca

SEQ ID NO: 44216 - DNA, 90 bp, Homo sapiens
ggtggctcacgactgtaatcctagtaactcgggaggctgaggttggaggatcacttgaggcccggagtccaagaccagcctcggcaacct

SEQ ID NO: 44217 - DNA, 60 bp, Homo sapiens
ccagtcagaagtgactgagcttgcagtgagggaacagtaggccaggcttcaaggaactgg

SEQ ID NO: 44218 - DNA, 72 bp, Homo sapiens
ctgggcatggtggcgtgctcctgtagtcccatctacttgggaggctgaggtaggaggatcatttgagcccag

SEQ ID NO: 44219 - DNA, 60 bp, Homo sapiens
agtcctaactactgggaaggctgaggtggaaggatcacttgagtctaggaggtggaggct

SEQ ID NO: 44220 - DNA, 76 bp, Homo sapiens
gtttctcactctatctgtgcctccatctgaaaataatgcttttagccaggggagagcagaaagaggcatgggagac

SEQ ID NO: 44221 - DNA, 58 bp, Homo sapiens
agggtccgctgtgcagtaggctgttggacactcagtttctgtctgtaaagggggtcct

SEQ ID NO: 44222 - DNA, 72 bp, Homo sapiens
gtttttttgaggcagagtctcactctgtcacccaggagggagtgaagtagtgcaatcatggctcattgaagc

SEQ ID NO: 44223 - DNA, 58 bp, Homo sapiens
tgagacagggtctcactctgtcacccaggctggagtgcagtgatgcgatcttggctca

SEQ ID NO: 44224 - DNA, 58 bp, Homo sapiens; identical to SEQ ID NO: 3380

SEQ ID NO: 44225 - DNA, 58 bp, Homo sapiens; identical to SEQ ID NO: 1435

SEQ ID NO: 44226 - DNA, 82 bp, Homo sapiens
tgagaggctgaggtggaaggatggcttgaagccaggagttggagaccagcctgggcaatagagccagacacttacctctaca

SEQ ID NO: 44227 - DNA, 58 bp, Homo sapiens; identical to SEQ ID NO: 8851

SEQ ID NO: 44228 - DNA, 89 bp, Homo sapiens
ggaggcccgtttctctctttggttatctagctgtatgagtgccacagagccgtcataaagctagataaccgaaagtagaaatgattctc

SEQ ID NO: 44229 - DNA, 114 bp, Homo sapiens
gtgtgtgtgttcacaagcaatctgagtggctggccgtgtgtgtgtgtgtgtgtgtgtgtgtgtgcacagatataaagacaaactgcagtctggttctgtctgggtaacatgtgt

SEQ ID NO: 44230 - DNA, 130 bp, Homo sapiens
actggtggtctcatctcaggcaggatctaggtgtatgatgtggcctcaggtctgggctgacagaggacagtctggtataacacagaggcccctgtgggacctcaagcaggctctggggaagtcagtgacc

SEQ ID NO: 44231 - DNA, 82 bp, Homo sapiens
cactgtgctagatgcttctttacatacacatgtgtgtttaatcctcacaacatctgtgatgtaagcattgcagaagcaggtg

SEQ ID NO: 44232 - DNA, 115 bp, Homo sapiens
gacccttcttttaattattttggctatagacccaaaagtagaattgttgggttatacggtaattctatttttaattttttgaggagctatattattgagttttgagagttctttc

SEQ ID NO: 44233 - DNA, 81 bp, Homo sapiens
gcttgatctctctgactgtcagttttctccttcttaacatggggatgatgatagtgccaactccacagggtagttcaaagc

SEQ ID NO: 44234 - DNA, 108 bp, Homo sapiens
gctggaagtggtggcacatgcctgtggtcccagctactttggaggctgaggtaaatggatcacttgagcacgggaagtcacggcagtgagtcatgattgcaccacctc

SEQ ID NO: 44235 - DNA, 62 bp, Homo sapiens
tgagtcagagtctcactcactctgtctcctgggctggagtgcagtgccgtgatcttggctca

SEQ ID NO: 44236 - DNA, 153 bp, Homo sapiens
gggtaacaaagtgagactcagattctacaaaaaaaaatatatatatatttttttttatttatatatatattttttgagacagagtctcgctctgtcacccaggctggagtgtggtggcaccatctcggctcactgcaacctccgcctcctggg

SEQ ID NO: 44237 - DNA, 69 bp, Homo sapiens
gacttaatatttgtatatgatatgaggttggggtccaacttcattccttttgcatgtggatatccggtt

SEQ ID NO: 44238 - DNA, 68 bp, Homo sapiens
cacttccctcaatcactcagtgtcactgaactatcataaggttttgaggaaggtggtggaggggagtg

SEQ ID NO: 44239 - DNA, 86 bp, Homo sapiens
cttaggaagtttaatttcattgctgcataggatttcattatatgaatttatccattctatgactgatggaattagattgttttgag

SEQ ID NO: 44240 - DNA, 118 bp, Homo sapiens
gacttctgcttcttgatggctttctttgtgtttgtgtctgtcctcatcattttcagatgaatgtatttatttattgagacagcatgtcactctgttgcccaggctggagtgcagtggc

SEQ ID NO: 44241 - DNA, 75 bp, Homo sapiens
ggggctgcagccggagcccagagtgtgtgtgttgtgggatgaagccgccccctcactctctgtctgcctggcccc

SEQ ID NO: 44242 - DNA, 112 bp, Homo sapiens
ctcccaaagtgctgggattacaggtgtgagccactgcacccagcctctataaattttcttgtatatatcttttttttgaggtggagtctcgctctgtctgcccaggctggag

SEQ ID NO: 44243 - DNA, 95 bp, Homo sapiens
ccatcctctgtgctctgtgctctctctctctctttttcttttcttttctttttttttttttttgagacagggtctcactctgtcatcgaggctgg

SEQ ID NO: 44244 - DNA, 156 bp, Homo sapiens
gtatgtattatctttattatatacatgtagtatatatatatgtatagtacatatgtgtatatatatgtatatgtgtatatatgtatatagtatacgtgtgtgtgtgtgtgtgtatatatatatatacatatatatatatgtatatatatatacatg

SEQ ID NO: 44245 - DNA, 75 bp, Homo sapiens
ggctgggtgttctgggttgccaccttcaagcatgcttttttttttttgaaggtctcactctgtcacccagactgc

SEQ ID NO: 44246 - DNA, 72 bp, Homo sapiens
agacagacaacagacacagcacagacaagggcttggctgattttgggtgtgtctggctctgatgtcttttct

SEQ ID NO: 44247 - DNA, 79 bp, Homo sapiens
tggggttttgagagatggggtctcactctgttactcaggctggagtacagtggtgcagtcatagctcactacagcctca

SEQ ID NO: 44248 - DNA, 112 bp, Homo sapiens
gcctgattctagaatcacacataaaggaaattgagatctttattataaatttattgtaattttgtcttttgacatgtataaatattaaatatcttgtgtgtgataatgtggc

SEQ ID NO: 44249 - DNA, 102 bp, Homo sapiens
ggcatgttggcacacacatgtagttccagctacttgggaggctgaggtagaaggatcacttgagcctgggaggtcgaggctgcagtaagctataattgtgcc

SEQ ID NO: 44250 - DNA, 110 bp, Homo sapiens
tgaattgaaggtttgtggcaaggtcaagcaagtctatgagcacagcttctccaacagcatgtgctcacttagtgtctgtgtcacatcttgctgattctttcaacgtttca

SEQ ID NO: 44251 - DNA, 91 bp, Homo sapiens
gattgcagcttctgcttctttctctcaatcactcaccctggggaagccagctgacacgttgtgaggagaagctacacgtgaggaaacagtc

SEQ ID NO: 44252 - DNA, 115 bp, Homo sapiens
ttctgtattttctggaaatgtttacaacaagcacgtggtgctttaataattttttttaaagaagagaaagtgtagaggcagcaactacatgactaggcaccagcaaaatatagaa

SEQ ID NO: 44253 - DNA, 58 bp, Homo sapiens
tgagacagagtctcgctctgtcactcagactggagtgcagtggcgtgatctcggctca

SEQ ID NO: 44254 - DNA, 124 bp, Homo sapiens
gttctgggatttacaggtatgagccactgctcctggccttttttttgagacagagtctcactgtgtcacccaggctgtagtacagtggcatgatcttggctcactgcaacctctgcttcctggg

SEQ ID NO: 44255 - DNA, 72 bp, Homo sapiens
tgtgaggcagcctcagtccctctgcctcagttcaggctgggtcctagagatgggtgagaggctggctagtca

SEQ ID NO: 44256 - DNA, 97 bp, Homo sapiens
agtgaaattccgtctaaaaaaagaaaaggaaaatatgtttaaataattaaaggaaaatatggtctttttttctttttttaagagacggtgtctcact

SEQ ID NO: 44257 - DNA, 79 bp, Homo sapiens
gtccaggagtctctcagtgtctctgatgtccttccttctaggcgggggtttcagatctggtagtggtggctcttcagac

SEQ ID NO: 44258 - DNA, 99 bp, Homo sapiens
ctagcacagaccaggtgctcactcagtagtagctacagggatattctatttttttttttctttttctgagatggagtcttgctctgtcacccacgctgg

SEQ ID NO: 44259 - DNA, 59 bp, Homo sapiens
tgagacaagagtctcgctctgtcacccatgctggagtacagtggtgcgatctcggctca

SEQ ID NO: 44260 - DNA, 107 bp, Homo sapiens
gcaaatgtttctgttccgggacgactttgaagacagactttctcactctttcattgactgtggctctagaaagtattgtttcgtgttctgttgcagtacttggatgc

SEQ ID NO: 44261 - DNA, 79 bp, Homo sapiens
acagtaagcaagtaaatatccaggggagggagaaagctaatgctgactttgtattttaatggatcgttttggcttctgt

SEQ ID NO: 44262 - DNA, 75 bp, Homo sapiens
ggccagtggcagaaagttcttctgatgggagtatgtagcgctgaccctctgatatcctctctttctgtctctgtc

SEQ ID NO: 44263 - DNA, 69 bp, Homo sapiens
ccaaagtgctgggattacagacgtgagccaccacgcccggcttctgtctgtctctctatcactctttgg

SEQ ID NO: 44264 - DNA, 60 bp, Homo sapiens
ggaggactgggtgcaggcaggctgatgtgaggcccccacagcctctctgtgtctccttcc

SEQ ID NO: 44265 - DNA, 105 bp, Homo sapiens
gaggggtgtccactggggctactgagtggtggctgtaaagagtctcagtatgtcaatatgggtcttacatggttgtggtcagtggtagcagacctggcccaactc

SEQ ID NO: 44266 - DNA, 58 bp, Homo sapiens
tgagacagggtctgtctctgtcacccaggttggtgtgcagtgttgtgatcctagctca

SEQ ID NO: 44267 - DNA, 83 bp, Homo sapiens
tggatttccggttttaaaagattttgggatattggcattatacctaccagctgagcatcccaagtctgcacatttgatatcta

SEQ ID NO: 44268 - DNA, 83 bp, Homo sapiens
gcgttcttgtgcatatcttttgatgagcatgtgtaagtatttctgttggaattgcttggccaggaaggatgtactaggtcagc

SEQ ID NO: 44269 - DNA, 118 bp, Homo sapiens
tccagaggataaatttttctaactgcggttagggcggggttgtaaaatagcatatttttgttttaaaaattcgaatggggcctaaagagtatttaagagagtttaactcctgttgcga

SEQ ID NO: 44270 - DNA, 110 bp, Homo sapiens
cacggtcactgcctcattaatgcctatttaagtggaatgttctgtggatcaccctctgcctttactttagtctgttataggtttcagaatcagacattgcagttttggtg

SEQ ID NO: 44271 - DNA, 96 bp, Homo sapiens
gtggcagagatgagttttaaggctaggttagaataggacagggggtacagcttctaccttgtttactaaatcattagctctagaaccctaaactac

SEQ ID NO: 44272 - DNA, 118 bp, Homo sapiens
gagaaggagtggcaaagaattcacagcattctgattttttattttgagacagagtctcactctgtcacgcaggctggagtgcagtggcgtgatcacagttcattgcaaccttgacctc

SEQ ID NO: 44273 - DNA, 81 bp, Homo sapiens
gggtgtggcacgtacagctgctctctctctctctatatatatatatatatttatttgagacagagtctcgctctgtccccc

SEQ ID NO: 44274 - DNA, 108 bp, Homo sapiens
ggtggagagacgattgcaggtagacataggagaagaaaatgctgaatgaatctgaatttttattttctaagtacatctttatgtttaaataaaatttcttggaccagc

SEQ ID NO: 44275 - DNA, 79 bp, Homo sapiens
atgagaggagagtgaggctgggagaaacttggtgttaaaaataaagcaaagttacagactctcactctctagagctcat

SEQ ID NO: 44276 - DNA, 103 bp, Homo sapiens
gatcctttctttgttgttgttgttgaaatagtgtctcactctgtcactcaggctggagtgcagtggcactattacggctcactgcagcctcaatctcctggtc

SEQ ID NO: 44277 - DNA, 76 bp, Homo sapiens
ttgctctttccttgcataaaatgcacgataaagaaaaatgtttttttctttatcgtgcagtttatggaaccagcag

SEQ ID NO: 44278 - DNA, 78 bp, Homo sapiens
tgctgcataataagcacaggctggaggattctagagggccactctatgactcactctctgtgcttaccagtccaagca

SEQ ID NO: 44279 - DNA, 105 bp, Homo sapiens
atgatttcataactgtgggtgtgcttgtatgtatacatgaatgtttatatgtaaatatacatgttttgtatatctatacacacatgcccacaattataaaatcat

SEQ ID NO: 44280 - DNA, 63 bp, Homo sapiens
gctcagttctgtctccctcaggaccctgggcttcccagagccagcagggatatggctctgagc

SEQ ID NO: 44281 - DNA, 74 bp, Homo sapiens
cagatcttgtgtgaactgagtgagagcacacccatcaccaagggggcggtgctgagccattcataaggggtctg

SEQ ID NO: 44282 - DNA, 109 bp, Homo sapiens
caggtgccctctgtgtgtgccctgcccttggtgacagtctagtcagtgtggacgctggaggctggctgcaggaggggctggcagtgggcggttagagaaggcagacttg

SEQ ID NO: 44283 - DNA, 107 bp, Homo sapiens
ctgacttgagtcttttagtctttatagtgaagatctgtgggaggagaaacacattctgatctgattttgatgtaatgaaggaggttggactaaattatttctttcag

SEQ ID NO: 44284 - DNA, 81 bp, Homo sapiens
attgggaaagtcacacgcatttctctgactcagtgtgtgagtaacttagatgctcacagggattgctgtgatgagcccaat

SEQ ID NO: 44285 - DNA, 79 bp, Homo sapiens
tctgacatcactgggaggtagattgggctcatcacagcaatccctgtgagcatctaagttactcacacactgagtcaga

SEQ ID NO: 44286 - DNA, 85 bp, Homo sapiens
ttgagagtgggagacagcaggagcatggccacttttttcttttttttttttgagatggagtcttgcttttgttgcccaggctgga

SEQ ID NO: 44287 - DNA, 111 bp, Homo sapiens
ctcagcagccaggctggaggcagcagtgtggtttgccttccatcagatcctcacactctcagacagaggaaggaaacctgactaaacaccagctgctaagttgctgtcggg

SEQ ID NO: 44288 - DNA, 79 bp, Homo sapiens
ctccagcctaggtgatagaatgcgaccctgtctttattttattttgagatggagtctcactctgtcacccaggctggag

SEQ ID NO: 44289 - DNA, 66 bp, Homo sapiens
atctatctatatttctatctatattcatacagaataaagatatagaaggtagaagtattgatagat

SEQ ID NO: 44290 - DNA, 56 bp, Homo sapiens
gggacagagtctcgctctgtctcccaggctggagtgcagtggcgtgatctttgctc

SEQ ID NO: 44291 - DNA, 70 bp, Homo sapiens
tgagatggagtctcactctgtcacccaggctggagtgcagtgtgcagtggtagtccgtgatctcggctca

SEQ ID NO: 44292 - DNA, 104 bp, Homo sapiens
gttctggtggaggctctcaggttgcagactgctgacttttcttatcttcccatggtagagagagagaagctagagagctctctgggggtcccttttataagggc

SEQ ID NO: 44293 - DNA, 89 bp, Homo sapiens
gctaatctgaggactatgaaatactgactgaaggtcgttggacatttattttcatattttagtggtcattcatgttccttgtgaattgc

SEQ ID NO: 44294 - DNA, 77 bp, Homo sapiens
tctccaatagacatatgaaatggtgggtggctggtctgccccgtcatgctgtctcaaactgtgtctccattggtagg

SEQ ID NO: 44295 - DNA, 87 bp, Homo sapiens
ggagcagggaggaccagcaggttcctgccagagagaagagtgtctgcaaacccctgaggcaagaggagcctgtgtctttgaaggtct

SEQ ID NO: 44296 - DNA, 56 bp, Homo sapiens; identical to SEQ ID NO: 324

SEQ ID NO: 44297 - DNA, 170 bp, Homo sapiens
atatttaccacttcatacttgtgtcttgaaatatatatatatatttatgtatgtatgtgtatatatatatctgtatgtatgtgtgtgtatatatatgtgtgtatatatatgtgtgtatatatacacacatatatatacacatatatacacatatatatatacacacacat

SEQ ID NO: 44298 - DNA, 71 bp, Homo sapiens
cagatgaggctctgttctgaagactctttttttattttttatttttttttctgagacagagtctcactctg

SEQ ID NO: 44299 - DNA, 85 bp, Homo sapiens
cagactcagtcagactcacatactcgctggacgacctgcctacggaaaggagctgcccactgcgagtcttctgagagctgttctg

SEQ ID NO: 44300 - DNA, 95 bp, Homo sapiens; identical to SEQ ID NO: 68

SEQ ID NO: 44301 - DNA, 93 bp, Homo sapiens; identical to SEQ ID NO: 69

SEQ ID NO: 44302 - DNA, 95 bp, Homo sapiens; identical to SEQ ID NO: 68

SEQ ID NO: 44303 - DNA, 93 bp, Homo sapiens; identical to SEQ ID NO: 69

SEQ ID NO: 44304 - DNA, 116 bp, Homo sapiens
gtgtaagtgttctcttttctctgcagactcaccagtatcggttgtttttttgaatttttaataatagccattctgactggtgtgaaatggtgtctcatggtggttttgatttgcat

SEQ ID NO: 44305 - DNA, 98 bp, Homo sapiens
ctatgggtgtgaatgttgtcacatggaattgactagagtcagaatcagtagattcaacactagtatttctataagtgaattacattcttatgatgtgg

SEQ ID NO: 44306 - DNA, 99 bp, Homo sapiens
gtatgcatttgtcaaagtgtcaaatcacaataatgtgcatatcactctatatataaatatattgcatgtttattgtgcatttcactaagtaaattatac

SEQ ID NO: 44307 - DNA, 70 bp, Homo sapiens
ttttgtcgagacagaatctcactctgtcacccaggctgaagtgcagtggtgggatcttggcttgctaaaa

SEQ ID NO: 44308 - DNA, 105 bp, Homo sapiens
tttttgcatttataatcatatgtaaaatcagactttatatttaattttaggggacttttgaagtttttggtagagagttttacaatgtttacagatgaaagggga

SEQ ID NO: 44309 - DNA, 90 bp, Homo sapiens
aaatgagggatgcaagcttgtttagttcagattggttgaagcttgttttgttctgattggtcgaagcaggtcacagtctattatttaggt

SEQ ID NO: 44310 - DNA, 137 bp, Homo sapiens
attctggagcctagagttctgagaccttaatctctttttttttttttttttttctgagatagagtctcacactgtgacccaggctggagtgcagtggtgcaatctttgctcactgcaaccttctcctcccaggttca

SEQ ID NO: 44311 - DNA, 82 bp, Homo sapiens
atggtgatgtggaaatgaatttggaatcaggaggtctgtcttggaggccggctctctcactcacatttttgcttgttgctat

SEQ ID NO: 44312 - DNA, 125 bp, Homo sapiens
catatatgtatacacatacatatgtgtatacatatatgtatacacatgcatatgtgtatatatttatgaacatatatatgtatatacacatatgcgtatatacatatatgtatacacatatgtat

SEQ ID NO: 44313 - DNA, 178 bp, Homo sapiens
atatgtatgtaaatatatatacatatgtatgtaaatatctacacatatgtatgtaaatatatgtacatatatgtatataaatatatacatatgtgtatatacgtatatacacatatgtatatatacatatgtgtatatatacatacatatgtatatatacacatatgtataaatatat

SEQ ID NO: 44314 - DNA, 117 bp, Homo sapiens
agtcttaggaactaatgaaaatgcacatctctgagccccgcacacagactctctgattcagtgtgtctggggtggggcctgggaatttgcgtttctaacaagttcccaggtaaggct

SEQ ID NO: 44315 - DNA, 56 bp, Homo sapiens
gagactgagtctcgctctgtcacccaggctggagtgcagtggcatgatctcagctt

SEQ ID NO: 44316 - DNA, 92 bp, Homo sapiens
atatatatgtgtgtgtatatataaatatatatgtgcatatatagagatatatatgtatgtgtgtatatatatggagataaatatatgtgtat

SEQ ID NO: 44317 - DNA, 98 bp, Homo sapiens
gcacctgtatatttccctatgaatagatttgtaaatatatgtggtattttatacacatgtatatacatttatatacatacacaagacgtgtacatggc

SEQ ID NO: 44318 - DNA, 82 bp, Homo sapiens
gtggtggggggttgctgtctcactctgtcacccaggctggagtacagtggtgcagtcatgggtcactgcatcctctagcctc

SEQ ID NO: 44319 - DNA, 102 bp, Homo sapiens
atgtgaaggtgatccatctagaaagaaaattaatcaagtcttaggactttagatttttgttttaaaaacttggttcttgaagctggaatgcctagattacat

SEQ ID NO: 44320 - DNA, 98 bp, Homo sapiens
gtgagtctttgtattgtcttctctttgtgcacatttgtgtctctgtcacaatgtaccctttgtattaaggacactagttacgtcggatgaggcctcac

SEQ ID NO: 44321 - DNA, 116 bp, Homo sapiens
cagctctgccctccatcctgcctcatgtaggtctcctttctttctttctttcttttttttttttttttttttaagactgagtcttgctctgtcacccaggctggaatgcaatggtg

SEQ ID NO: 44322 - DNA, 86 bp, Homo sapiens
ctctgtttcccttccatttatttctgtggcactgactgtgtgtgcaacgagccgtgctgcagcagagataccccagagaaagagga

SEQ ID NO: 44323 - DNA, 93 bp, Homo sapiens
atagatagatagatagatagatagatagagatagatggatagatggataatatatttatgtctgtctctgtatctttatgtctataattctat

SEQ ID NO: 44324 - DNA, 128 bp, Homo sapiens
gcacatatatatatatatatatatatatatatatatacacacacacacacacatatatatgtatatatgtgtgtgtgtgtatatatatgtgtgtgtatatatgtgtgtatatatatatgtgtgtatat

SEQ ID NO: 44325 - DNA, 75 bp, Homo sapiens
ggcaaagagcctccctctgtgactcactttccactggggatttgagcaatccaggccaagggagagcactttgtt

SEQ ID NO: 44326 - DNA, 58 bp, Homo sapiens
tgagacggagtctctctctgtcacccaggctggagtgcagtggcgggatcttggctca

SEQ ID NO: 44327 - DNA, 115 bp, Homo sapiens
tggccacagagaaccctacggaccattacttcattgtttattcttgtaaattataaatatttttaaaaattccaaattatgaagttcgaaggggatattttatatctctcagcca

SEQ ID NO: 44328 - DNA, 73 bp, Homo sapiens
gcgagggtacagagctagacagcaagacagcaagataagaagtgagcgcctctctgtccctctgtggacctgt

SEQ ID NO: 44329 - DNA, 86 bp, Homo sapiens
atatgtgtgtgtatgtatatatatatgtatgtgtacgtataccaatatatgtatacacacatatattttttaaatttacaacatgc

SEQ ID NO: 44330 - DNA, 67 bp, Homo sapiens
ctggagtcattgtctctctctttttcatgatttatgactcagaagcaagacaggggcaggaggttgg

SEQ ID NO: 44331 - DNA, 114 bp, Homo sapiens
acacgcacaacctttgtaaatatgtaaagcaccaatttagacctgtagcctgtctttacaatggatttctaatctaaattgtgtttcccttttcacagagacacatcagcctgt

SEQ ID NO: 44332 - DNA, 84 bp, Homo sapiens
tatctcagttgtttattaatttatctgacaaatgctgttaagtgctagcagttactaggtgttttgggatgagcagcccaggta

SEQ ID NO: 44333 - DNA, 78 bp, Homo sapiens
tctatctatctatctatctatatgtatatgtgtatctatatctatatctatatatatgtagagagagagagagagaga

SEQ ID NO: 44334 - DNA, 210 bp, Homo sapiens
ttctcctgttctaaagtagaggctgtttttttttttttttttctgtagatttttactaccattgaaggacactgggaaagatgataagactcttgatgttggaggaaaaaaagcaatgaattcttttggattttctaatcataagcattttttccaaagttttgaagaatgttgagatggtgaaggaaaataattcagactttcctctaa

SEQ ID NO: 44335 - DNA, 114 bp, Homo sapiens
cacacacgcatatatatacacacatgcatatatatatctagggatatatacacatatgtgtatatatatgtgtgtatatgtgtgcatatatatgtgtatgtatatgtgtgtgtg

SEQ ID NO: 44336 - DNA, 96 bp, Homo sapiens
gggtcttgggtgtcaaatgtcaggccttgtactgagctgtcaaagagaagaatgggctgagatgattgatgactgggaggcctgaaacccaaacct

SEQ ID NO: 44337 - DNA, 108 bp, Homo sapiens
atgtaacatgtgtacatatgtacatgcattagatacatattatgttgatatatataagtatatgaattatatatagatcatattgtagtacattaaatatagttatat

SEQ ID NO: 44338 - DNA, 129 bp, Homo sapiens
aggttccccaggaggcttgactgagtcagagattgtggctgggaattttctggggtgtgctttcaggatctatactttccttggatggaaggaatcagaatttgatagaaggagaaatcagactgtgat

SEQ ID NO: 44339 - DNA, 91 bp, Homo sapiens
ctgatggtttaaaagtgtgtggcacttcccccttcactctctgtctcctgctgccatgtgaagaaggtgttcgcttcccctttaccatcag

SEQ ID NO: 44340 - DNA, 114 bp, Homo sapiens
acactggttttatatatatatatatatatatacacatatatatgtgtatatatatacacatatatatgtgtgtatatatatatacatatatatgtgtgtgtatatatatatata

SEQ ID NO: 44341 - DNA, 63 bp, Homo sapiens
aggctggagtgcagtggcacgatctcagctcactggctcactggctcactgcaacctctgcct

SEQ ID NO: 44342 - DNA, 78 bp, Homo sapiens
catacagaaagacacacacacgttcactgacagtgtaaaggcctgatgaacaggagcatttgtgtgtgtatatgtgtg

SEQ ID NO: 44343 - DNA, 82 bp, Homo sapiens
gccctgctcctggagttctctttgacattgcagcttgtgcaccctgccctgtggagtgtgagaaatcacagacagcagaggc

SEQ ID NO: 44344 - DNA, 99 bp, Homo sapiens
ctgtgactctggtctttgtactgggagctgaattgagtggcgagggcctttctttgtttctcactgactttgtctctgagagctagactattgctgcag

SEQ ID NO: 44345 - DNA, 107 bp, Homo sapiens
atacctcatgtttttattgtaatgaccttctctctgtcactaagaaactatcattgtgagaagagaaagtgctgagttgcaaatatttaaaatggacatgtttgtat

SEQ ID NO: 44346 - DNA, 79 bp, Homo sapiens
gtccaaaatccacctgagaaactcagaacagatgaacttaaactctgattctcagtttctttatctgtaaaatgtgggc

SEQ ID NO: 44347 - DNA, 113 bp, Homo sapiens
tcttccgccatgattttgaggtctccccagcaacatggaactgtgagtgcattaaatctctttttttctgtataaattacccagtcttgggtatgtctctatcagcggagtga

SEQ ID NO: 44348 - DNA, 82 bp, Homo sapiens
gctaaatactatgcacaaaatatattttcagattttattctcctatggttctgaatttgtgtgtgtgtgtgtgtgtgtgtgt

SEQ ID NO: 44349 - DNA, 114 bp, Homo sapiens
agggaagatggtaggtgggttgacatggcctagaaagatggttcctgacagagaacagagagatgaggggattcaggggtggtgactgttcccattttaagccacagatttgct

SEQ ID NO: 44350 - DNA, 102 bp, Homo sapiens
ggggctgccttggcagggcccaccagaccgtctgtcactctccgctgacaccggctgccggaggagggcggtccccgaggctctcgtgctggcggcagcccc

SEQ ID NO: 44351 - DNA, 92 bp, Homo sapiens
gctctgtggctgtgtctccaggaagctaaagcaacaaggcaattaaatggtgaattgtgtgtgtgtgtagagagggggctcagggggagggc

SEQ ID NO: 44352 - DNA, 174 bp, Homo sapiens
gagggcagggaaactattttatttttaatattaaaggaaaggaggacccattgaatacttaaaaaaatttttttttcattttattttgaagtggagtctcgctctgtcgctcaggctggagtgcagtggtgcgatctcagctcactgcaacctccacctcctgggttcaagtga

SEQ ID NO: 44353 - DNA, 65 bp, Homo sapiens
atgattctctgcagagcgcgtgtcagcccggcacctgcaggcttcagcgtctctgtttctatcat

SEQ ID NO: 44354 - DNA, 114 bp, Homo sapiens
tattttaaaaagaaattttctgattgcagataacttctcaatttgatttagtgtcgaacgatagtgatagggttgataagtgagcattcatcggtaattcatcttgtgctggta

SEQ ID NO: 44355 - DNA, 96 bp, Homo sapiens
cctggaaagcacagtgaggtcattcttcttctactttttttatttttatttttatttatttatttttttagacaggatctctctctgtcacccagg

SEQ ID NO: 44356 - DNA, 114 bp, Homo sapiens
ccttaacaaaggagtgactggggatgagtgcttcaaacatgtgttatgttgaagacttctgattaacaatgaaacaggttatcagcattgtcctttttccaatatcctttctgg

SEQ ID NO: 44357 - DNA, 92 bp, Homo sapiens
gatccctttatgctctgacagaaaatagtaagcacacagaaagcttgtgttgctgaaggttatgtctgtcagcatttacagcatttgaaatt

SEQ ID NO: 44358 - DNA, 83 bp, Homo sapiens
gtcccagaagggagtttcagacagaagatggacttctctgcattgactttggtctctctgtgtctcactaccggatttgcgac

SEQ ID NO: 44359 - DNA, 100 bp, Homo sapiens
ttgtcatgctggagataggcctcagagagaagagagtgagacttgactccacagtcaagactgcctggtctcccatagcctgttccccatctcagttgac

SEQ ID NO: 44360 - DNA, 84 bp, Homo sapiens
gttccttggggggcgaatgtaggctttgactcgaatttgaaagagtagatttattttctttgtagcctgagttctccaggatgc

SEQ ID NO: 44361 - DNA, 110 bp, Homo sapiens
agaacggagtcttggcacatcacttttcattttgtgacagcaagctgaaagctagagacctttttcttgtatggactcaaaatgatcacatttggggatggctctgttct

SEQ ID NO: 44362 - DNA, 118 bp, Homo sapiens
agtgagttgttctgcaatcaaaaagcggttaggttttctagtagtagctgttaggttttctagcagtagctgttaggttttccagtagtagctgttgggttttctagtagtagctcct

SEQ ID NO: 44363 - DNA, 68 bp, Homo sapiens
ttcagaccaccagagcaaggcactcttattttttttggagatggtctcactctgtcacccagtctgga

SEQ ID NO: 44364 - DNA, 64 bp, Homo sapiens
cattcgcagtgcctgtctctctgtttctagattccttgaaagaagagacttatgcttgtgggtg

SEQ ID NO: 44365 - DNA, 95 bp, Homo sapiens; identical to SEQ ID NO: 68

SEQ ID NO: 44366 - DNA, 93 bp, Homo sapiens; identical to SEQ ID NO: 69

SEQ ID NO: 44367 - DNA, 82 bp, Homo sapiens
catttaatgtgattctatttgtatgagtttctatgaattgtccaggatctacaaagtcatacaaatagaaagtagattagtg

SEQ ID NO: 44368 - DNA, 64 bp, Homo sapiens
taagtctcagtttgaatgctgacactgacattcactgacagtgtgacttcaagctggctactta

SEQ ID NO: 44369 - DNA, 73 bp, Homo sapiens
ctctggggagcagtgatgggagccaggggttgctcggtgtgaatctgagtgcctctgtgactgtttcccaggg

SEQ ID NO: 44370 - DNA, 84 bp, Homo sapiens
tcaagacctattagaaaactacagttatcaagaaagtgacagtaatcactgtcctgattactgtagtgttgtaataggtcttga

SEQ ID NO: 44371 - DNA, 69 bp, Homo sapiens
acatagtgattgtgtgtgggtatatatatatatatatatatatatatatacacacacacacatatatgt

SEQ ID NO: 44372 - DNA, 105 bp, Homo sapiens
atatacacacatatatacatatatgtgtgtgtatatatatatgtatatatatgtgtgtgtatatatatatatgggtgtgtgtgtatacatatatacacatatata

SEQ ID NO: 44373 - DNA, 119 bp, Homo sapiens
gtataatatatgtgtatatacacacatatatatgtgtgtgtatatacacatatatatgtgtgtgtatatatgtatatatatacatatatatgtgtgtgtgtgtgtatatatatatatat

SEQ ID NO: 44374 - DNA, 115 bp, Homo sapiens
ggagtagctgggattacaggcacacgccaccacgcccagatactttttgtatttttagtagggatggggttttgccatgttggtcaggctggtctccaactccttacctttggtg

SEQ ID NO: 44375 - DNA, 123 bp, Homo sapiens
ggtgtgtgtgtgtgtatatatatatatacatatatgtcacattttcatgtgacatatgtcatggtgtgtgtgtgtatatatacatatatatgtcatggtgtgtgtatatatatatgtcacatt

SEQ ID NO: 44376 - DNA, 123 bp, Homo sapiens
gtatcaatacatcacctcattccctagagttcttgatatacctaccaaagccaggtcttttgtgtttattttattttaagttctggggtacatgtgcaggatgtgcaggtttgttacataggt

SEQ ID NO: 44377 - DNA, 57 bp, Homo sapiens
tgatacggagtctcactgtgtctccaggctggagtgcagtggcgtgatctcggctca

SEQ ID NO: 44378 - DNA, 110 bp, Homo sapiens
agtggttaagagcctaagctttagagtccagatgccttgctctctcactcacaacctgtttgactttgagaaagtttaggtaacttctctgtctcagtttcttcttccct

SEQ ID NO: 44379 - DNA, 124 bp, Homo sapiens
tgtataatacatatatcgatatatatgtataatacatatatcgatatatatgtttatacatatatatcgatatatatgtattgtacatatatatcgatatatatgtattatacatatatatcga

SEQ ID NO: 44380 - DNA, 95 bp, Homo sapiens; identical to SEQ ID NO: 68

SEQ ID NO: 44381 - DNA, 93 bp, Homo sapiens; identical to SEQ ID NO: 69

SEQ ID NO: 44382 - DNA, 95 bp, Homo sapiens; identical to SEQ ID NO: 68

SEQ ID NO: 44383 - DNA, 93 bp, Homo sapiens; identical to SEQ ID NO: 69

SEQ ID NO: 44384 - DNA, 91 bp, Homo sapiens
tggctttggtttgcagaaatcagatttgtttttcttgatcttcatttattatcagaatgtgagagacatacttttctgaagagcaaggtta

SEQ ID NO: 44385 - DNA, 113 bp, Homo sapiens
tagtcatgattctccagataaatgaaaccaataggagatatatattatatgaataattttataataagcatttggttcatgttattagggaggttaagaagtatcatgatcta

SEQ ID NO: 44386 - DNA, 88 bp, Homo sapiens
ataaattatatgtgtgtagtgtctgtgtgtgtgtatatatgtgttcgtatgttatatatatgaattatattaaatgtatatgatttat

SEQ ID NO: 44387 - DNA, 172 bp, Homo sapiens
atacatatatatgtatatatatatgagtatatatgtatatatatatatgagtatatatatgaatatatgtatgtatatgaatatatgtatatatatgagtatatatatatatgagtgtatatatatatatatatatatatatatatatatatgaatgttcatgtaatgacat

SEQ ID NO: 44388 - DNA, 76 bp, Homo sapiens
gacagacagaactatgagtgcagtgggtggggccaagatggccgactagaagcagcagtggtaggaggttcctgtt

SEQ ID NO: 44389 - DNA, 113 bp, Homo sapiens
gtgcatatctatgggcatgacaattcttttatttattattttattttattttactttaagttctgggatacatgtgctgaacgtggaggtttgttacgcaggtatatatgtgc

SEQ ID NO: 44390 - DNA, 83 bp, Homo sapiens
ttccacatgttggtgctccagagatatttattactttatttatttatttgagatggagtttctctctgtcacccaggctggaa

SEQ ID NO: 44391 - DNA, 115 bp, Homo sapiens
ttacattgctatggaattctctgaactttctaatttgataaacatttcttcagctatgttatttattttttcttagtttatatgaatatagggatttccattggtgatcaagtaa

SEQ ID NO: 44392 - DNA, 121 bp, Homo sapiens
ggattttgactactacatcatagtgaaacatatcctagagatttttaaaaattataattgttttattatttaaaatagtaataaaaaccatttgggatggtcatgggttaggacacagtgg

SEQ ID NO: 44393 - DNA, 102 bp, Homo sapiens
ccaattaatggtccctggctacatatggatgcaatatgggtctgagaatgcctgatgacagaaagcagagttgtaatctattccaaatggaccatcatctgg

SEQ ID NO: 44394 - DNA, 64 bp, Homo sapiens
tatatatatacatatatatgtgtgtatatatacatttatgtgtatatatgtgtgtgtatatata

SEQ ID NO: 44395 - DNA, 123 bp, Homo sapiens
aagggggtggtgggcggagaatctctgagctaggtgtgacatatgtaggaacagaacactgtgtgcacagaaacttgaatcaggttttgttttttactacccaatcctttctcttaagcagcc

SEQ ID NO: 44396 - DNA, 89 bp, Homo sapiens
gcttttcctataaaaagcctccatgtgtgcttagtatggagactcggaagcccagggaatttttatatttattacagagagaggcaggc

SEQ ID NO: 44397 - DNA, 70 bp, Homo sapiens
gctttttgccgggaagactgtctctctggccctctggtggccggcttcttgacatcatccatatctcagc

SEQ ID NO: 44398 - DNA, 109 bp, Homo sapiens
gtattcattgtgtgtgtgtatatatacacgtgtatatatacacgtgtatatatatacatatatacacatatatatacacgtgtatatatacacatatatacatatatac

SEQ ID NO: 44399 - DNA, 329 bp, Homo sapiens
tatgtgtatatatacacgtgtatatatgtatatatatgtatatatgtgtatatatacacgtgtatatatatgtatatatgtatatatgtgtatatatacacgtgtgtatatatgtgtatatatacacgtgtgtatatatgtatatatatgtatatatgtgtatatatacacgtgtgtatatatgtgtatatatgtatatatgtgtatatatacacgtgtgtatatatgtgtatatatgtatatatgtgtatatatacacgtgtatatatatgtgtatatatgtatatatatacacgtgtatatatacacgtgtatatatacacacacac

SEQ ID NO: 44400 - DNA, 72 bp, Homo sapiens
gctgaggacagcgggtgggagtgagaggtgacagcgtgctggcagtcctcacagcccttgctcgctctcggc

SEQ ID NO: 44401 - DNA, 63 bp, Homo sapiens
gagaggtcccacatgctaagtgagcacatctgctgagcaccagcctgtgtctctgtggctctc

SEQ ID NO: 44402 - DNA, 86 bp, Homo sapiens
ggggtaggctgctgatgggagattgatatgcagcctgggtatgagagccacacggtctgtgactctgacaggagacagtcaactcc

SEQ ID NO: 44403 - DNA, 77 bp, Homo sapiens
tgcatctaattcagactcagactcacacacacatatacccagctgtgtctgtgtctgtgtctctgtgagtgtgtgca

SEQ ID NO: 44404 - DNA, 73 bp, Homo sapiens
ggttttttgaggcagggtctcactctgtcacccaggctggagtgcagtggtgctatcatggctcacagcaacc

SEQ ID NO: 44405 - DNA, 97 bp, Homo sapiens
agtgataaggaagaaactgatcagaaattcttcatgtgagaaaaatacagacaaaatgagtccaatcacatgcagaggttctttcacttcctacatt

SEQ ID NO: 44406 - DNA, 65 bp, Homo sapiens
cacccttcattctctgtctctctgttagcctagaaggtcagcccagagtcctgatagcaggggtg

SEQ ID NO: 44407 - DNA, 73 bp, Homo sapiens
ctgtgtgtgtgtgtgcgtgtgtgtgtgtacgtatgtatatatatgtatactatacatatgtgtacacccacag

SEQ ID NO: 44408 - DNA, 241 bp, Homo sapiens
atatatatatgtgtatatatatgtgtgtatatatatatatatatatatacgtatatatgtgtgtgtatatatatatatatacgtatatatgtgtgtatatatatatacgtatatatgtgtatatatgtgtatatatatatacgtatatgtgtatatatatgtgtatatatatatacgtatatatgtgtgtgtatatatatgtgtatatatatacatgtgtgtatatatgtgtatatacgtg

SEQ ID NO: 44409 - DNA, 84 bp, Homo sapiens
tctgagtctgtttttgagctactgttcttggatttttttttttttttttttgagatggagtcttgctctgttacacaggctgga

SEQ ID NO: 44410 - DNA, 80 bp, Homo sapiens
gctcttcacattaagtcttgcggctgctcactgtttgggtctgtgccatctgtaagggctgtgacactcactgtgaaggt

SEQ ID NO: 44411 - DNA, 95 bp, Homo sapiens
tggtaggtctgattgtatcattggtgtctttcccactagactgtgagctccacagtctgcagaatgggaatgtgcaatctgtgttttcactacca

SEQ ID NO: 44412 - DNA, 61 bp, Homo sapiens
cactgtctccctctctcccacgcatggaggcatgttggaaagggagctccaggcctcagtg

SEQ ID NO: 44413 - DNA, 78 bp, Homo sapiens
ccaggagtgtgcggtggtggagtccggctggcctgggttgcagatttaactttcgcctctgcctctgtgtgcctctgg

SEQ ID NO: 44414 - DNA, 75 bp, Homo sapiens
ccagcttgtctctgccacagggtccttctctgctctctcagcctgaaggcctcctctgtgtctgtgagtggctgg

SEQ ID NO: 44415 - DNA, 58 bp, Homo sapiens
tgagatggagtctcactctgtcacccaggctggggtgcagtggcatgatcttggctca

SEQ ID NO: 44416 - DNA, 58 bp, Homo sapiens
ggacgaggaggccgaggggtccagggggacgctctccatgttctctggctccaggtcc

SEQ ID NO: 44417 - DNA, 84 bp, Homo sapiens
tgctaggtatcttgattgtggtggtggtgataggaagctacactagctgaaattacacacacacacgcacacatactgcaagca

SEQ ID NO: 44418 - DNA, 106 bp, Homo sapiens
gccagacgtgatggtgtgcacctgtagttccagttactcaggaggctgaggttggaggatggcttgagcccagggagacagagattgcagtgagccatgattgagc

SEQ ID NO: 44419 - DNA, 119 bp, Homo sapiens
ggcctgagtggcttggtgggaatggaagagagtcaagatcccaggagagtgagaagtgagtgaggaggttttcattgtcagctcttgacttctctggattcccaaccatgggacttgct

SEQ ID NO: 44420 - DNA, 86 bp, Homo sapiens
cagagtgagggatccaaagcagagagagaatgaccaagaaggaagccatagtaccttttttttttttgagagggaatctcactctg

SEQ ID NO: 44421 - DNA, 94 bp, Homo sapiens
gaatgtgatgggagagggagaaatcacagtggacttcaggcgttgtggcctgagcaactggaagaagggactttccttgttttacgtggcattt

SEQ ID NO: 44422 - DNA, 108 bp, Homo sapiens
aggggctggaggaatggatgctctgtctccatgtcttccctggtccaggctgtgtatctctcagtctgagggaaagggcactgagatggtaattaaaggtcagcctct

SEQ ID NO: 44423 - DNA, 92 bp, Homo sapiens
gctgaatttggacctgcttttcctgtattttctcagttgcatctgggcagtaagctaagtatacaagaaacgagggccaacatgaagacagt

SEQ ID NO: 44424 - DNA, 90 bp, Homo sapiens
gagagtttgttaatatgcagggttggttaaggagagaggaaacagttactctctttcactcttggtagaactatatattgacatgacctt

SEQ ID NO: 44425 - DNA, 96 bp, Homo sapiens
cttcttgatgatgtgtggctctgaattatatatttttgtctttgagaggaaattctactttcttcttcagatttgagtataaatcaagtaaagaag

SEQ ID NO: 44426 - DNA, 89 bp, Homo sapiens
tctggctttgtgggccttgctgactgaggagagactgctgttcccaggactagcctgtttgccttgccctgccttccctttcccccaga

SEQ ID NO: 44427 - DNA, 58 bp, Homo sapiens
tgagactgagtctcactctgtcactcaggctggagtgcggtggcgcgatctcggctca

SEQ ID NO: 44428 - DNA, 86 bp, Homo sapiens; identical to SEQ ID NO: 42815

SEQ ID NO: 44429 - DNA, 79 bp, Homo sapiens
tgagatggagtctcgctctctcacccaggctggagtgcagtggcatgatctcgtttcactgcaacctccacctcccgag

SEQ ID NO: 44430 - DNA, 67 bp, Homo sapiens
gcagtaggctgaggtagaaggatcacttgagccccaagaggtcgaggctgcagtgagccaagattgc

SEQ ID NO: 44431 - DNA, 80 bp, Homo sapiens
tgttttgttttgagatggagtcccactctgtcactcaggctggagtgcagtggtgtgatcgcagctcactgcaaactgca

SEQ ID NO: 44432 - DNA, 58 bp, Homo sapiens; identical to SEQ ID NO: 2381

SEQ ID NO: 44433 - DNA, 87 bp, Homo sapiens
ctagaaaacactggtgcctggctccctcaatcacaggctctgatttcattgggatgaggcatgacctgggcatgtggatttttttag

SEQ ID NO: 44434 - DNA, 124 bp, Homo sapiens
atatatacactatatgtatatacatatatacatgtatatatacacatatatgtgtgtgtgtctgtgggtgtgtgtgtgtgaagttctatctctctaagaaaaccctaatacacgcacatatgtg

SEQ ID NO: 44435 - DNA, 69 bp, Homo sapiens
acacatatatgtgtatatatacatgtatatatgtatatacatatagtgtatatatacacatgtatgtgt

SEQ ID NO: 44436 - DNA, 86 bp, Homo sapiens
ccccagagcagtcctgttccctggattcccttcggggctctgattcctggaggagggacagtagacagtcaggagatgttcttggg

SEQ ID NO: 44437 - DNA, 108 bp, Homo sapiens
cattctctgtcatgatgatgtacgtatgtttcttaaaagtaagatatatttgaattttttaaaaaatgtcaaatttgggaatatgttttttcattggcagagttagtg

SEQ ID NO: 44438 - DNA, 116 bp, Homo sapiens
gatgttgagtatcatgttaattgctggtaagtcccactgtattgaacatctcctaaagggctcagtagagagtgttgagtgcctgggctgggggcacacacgttctattccatgtt

SEQ ID NO: 44439 - DNA, 101 bp, Homo sapiens
cagaaactgcctccccagaggccagtcatgacagaagacagagaacccctgcggttcatgctctgggtccataccaagcttcgctgggggcagcccatctg

SEQ ID NO: 44440 - DNA, 83 bp, Homo sapiens
ttacagattatttgttactatatatgatagtaataaatcaaaatactttattactatgtatgatagtaataaattgtctgtaa

SEQ ID NO: 44441 - DNA, 95 bp, Homo sapiens; identical to SEQ ID NO: 68

SEQ ID NO: 44442 - DNA, 93 bp, Homo sapiens; identical to SEQ ID NO: 69

SEQ ID NO: 44443 - DNA, 103 bp, Homo sapiens
gcataagccctttccttttaatacaaacagcaagatcatcctgttcagcagttgacagatgactgtgtgcaccaaaaggcaacaacgatgaggcaactgatgc

SEQ ID NO: 44444 - DNA, 59 bp, Homo sapiens
tgagacaggagtctcactctgtcacccaggctggagtgcagtggagtgatcttggctca

SEQ ID NO: 44445 - DNA, 58 bp, Homo sapiens; identical to SEQ ID NO: 1673

SEQ ID NO: 44446 - DNA, 98 bp, Homo sapiens
catcctcaaattcaagcatcagactccctgcagggcttgtcagaacacagagtgctgggccctacgccggagtgtctgaggcagtggttctggggttg

SEQ ID NO: 44447 - DNA, 77 bp, Homo sapiens
taagggactggccttgttttcacagaaaggcagagacacttccccttcggcaggctgcctgtgagccagagacctta

SEQ ID NO: 44448 - DNA, 68 bp, Homo sapiens
gggccatttagagtagtgtcactgtctctttttctcaggaaaatgggccacattcatctcgaaggccc

SEQ ID NO: 44449 - DNA, 108 bp, Homo sapiens
actaaatgttcaggagttcaattgctggttcataagtgtatttctagtttttttaaagaaactgacaaactagtttccagcgtgattgtaccatgttacattctcagt

SEQ ID NO: 44450 - DNA, 66 bp, Homo sapiens
gccacagtcagtctctgtcactgaaatccccttgcgggggcaagtaaggaggaaatgaggaagggt

SEQ ID NO: 44451 - DNA, 72 bp, Homo sapiens
ctcatcagaatatgcatatctatagatatgattattaatataatcatatctatagatcttatatctatagag

SEQ ID NO: 44452 - DNA, 76 bp, Homo sapiens
acagggtcattcagtttgatggagtgccccaggctgtcctggggcctggcctgcctccctcgctgtctgtgcctgt

SEQ ID NO: 44453 - DNA, 114 bp, Homo sapiens
ccattcatctgttgaatggacgtttgggttgtttccatcttatttttatttatttatatttatttattttttgagatggagtctcactctgtcgcccaggctgcagtgcaatgg

SEQ ID NO: 44454 - DNA, 59 bp, Homo sapiens
gctcacagaggagtgtgggctcacaccgagcagcccatgctttcaatcctcttccgggc

SEQ ID NO: 44455 - DNA, 69 bp, Homo sapiens
tgtttttgagactgagtctcacactgtcacccaggctggagtgcagtggcgcgatctcggctcactgca

SEQ ID NO: 44456 - DNA, 86 bp, Homo sapiens
gcacaggtatgtgtgagtgcacagctgtgtgtgtgtgagttcctgggaatgtgtgcgtgcaggggtgtgtgtgtgcatggttgtgt

SEQ ID NO: 44457 - DNA, 111 bp, Homo sapiens
ccactgatgcccagcatatgtggaatgattgaaacaatatttatttatgtatttatttatttatttttgagacggagttttgttcttcttgcccaggctggagtgcagtgg

SEQ ID NO: 44458 - DNA, 92 bp, Homo sapiens
atatttctgtttgtgtgtgtatacatatacatacaatatacacaaaaaattactgtgtgtatgtgtaattttatatatatatatatatatat

SEQ ID NO: 44459 - DNA, 71 bp, Homo sapiens
tatgtatctgtgtgtccatgtgcatgtctatgtggatatgtatgtgtgtatatgtgggcattaggtatatg

SEQ ID NO: 44460 - DNA, 107 bp, Homo sapiens
gctgtacattgatgatttgtgcccccttttcatatataattttttaataaaaatctgtttaaagtttttatgggctgggcatagtggttcacacttgtaatcccagc

SEQ ID NO: 44461 - DNA, 58 bp, Homo sapiens
tgagacagagtctcactctgtcacccaggctggagtgcaatggtgcaatctctgctca

SEQ ID NO: 44462 - DNA, 98 bp, Homo sapiens
gtagtagtacctgccttagggtgttggtagagaactgacttagatcttgccggtaaaactcagggcctgcaggcgtgaccttacagcaggtgggctac

SEQ ID NO: 44463 - DNA, 57 bp, Homo sapiens
ttgagacagtgtcactcgctctgtcccttaggctggagtgcaatgacacgatctcag

SEQ ID NO: 44464 - DNA, 161 bp, Homo sapiens
tatatatatatatatacacacacacacacacacgtatgtgtatatatatatgtgtgtgtgtatatatatacatatatatgtgtgtatatatacacacatatttatacgtgtatatatatgtgtgtatatatatatgtgtgtgtatgtatatgtatattgca

SEQ ID NO: 44465 - DNA, 91 bp, Homo sapiens
ctgtgtgtcgtgttttcacttcgttttttttttttttgtgacgggggtctcactctgtcacacagattggagtgcagtggcacgatctcag

SEQ ID NO: 44466 - DNA, 97 bp, Homo sapiens
gagtgagccactgtgcctggcctattttttatttttttgagacagtgtcttgctctgtctcctaagatggagtgcagtggcacgatctggctcactc

SEQ ID NO: 44467 - DNA, 135 bp, Homo sapiens
gagatcctgatggagtagatctagagtgggcataggcatctgtgttttattttctttatttattttttttgggacaaagtctcactctgtcactcaggctggagtgcagcagtgtgaacacttgggttgtcatca

SEQ ID NO: 44468 - DNA, 118 bp, Homo sapiens
ccagggttctctagagggacagaactaataggatagatgtatatataaaggggagtttattttattttattttattttttattttttttgagacggagttttgctcttgttgcctagg

SEQ ID NO: 44469 - DNA, 96 bp, Homo sapiens
tcccaggcgatgccgatgctgtccacctgtcacccacactctgagaactattcatctagagggtcacgcccctgactgcattgaaatcactgagga

SEQ ID NO: 44470 - DNA, 78 bp, Homo sapiens
ccaatagatggtagccattgagagcacgccacctgtgtgtgaatcaagtctctgccactcttctttttttttttttgg

SEQ ID NO: 44471 - DNA, 106 bp, Homo sapiens
ggcatggtggcctcgcctgtagtcctggcttctcaggaggctgaggtggaaggatggtttgagcccaggaattcaaggctgcagtgagctatggtcccaccactgc

SEQ ID NO: 44472 - DNA, 66 bp, Homo sapiens
agcctgggtgacatagcgagatcctatttcttttttgagacagagtctcagtctgtcacctaggct

SEQ ID NO: 44473 - DNA, 117 bp, Homo sapiens
gccatgcaggtcggaagtggtggggcccacgttctcggctggcctatgccactgctgtggacagaagccagtgaggaggcggaggtgatgggcctggccagaaccctgtcctgaggc

SEQ ID NO: 44474 - DNA, 58 bp, Homo sapiens; identical to SEQ ID NO: 21243

SEQ ID NO: 44475 - DNA, 69 bp, Homo sapiens
tgtttttgagctagagtctccctctgtcacccaggctggagtgcaatggctctgtctcagctcactgca

SEQ ID NO: 44476 - DNA, 98 bp, Homo sapiens
aagtgttgggtggcgaaaattttgggagtggtatggagagataatgggcaatgtttctcaggctgctttgagcaggattaggggcggtgtgggaactt

SEQ ID NO: 44477 - DNA, 89 bp, Homo sapiens
cctgcctttatgaggaatgtgagcccctttattttattattttattttttaaaatttgagacagagtctcgctctgtcacctaggctgg

SEQ ID NO: 44478 - DNA, 90 bp, Homo sapiens
tcatggttttatatgggatttctctgatgactgtgaggactgtgttgagcaccttttcatgtcattataagtcattcctaggtaaagtgg

SEQ ID NO: 44479 - DNA, 89 bp, Homo sapiens
cctatttcccttttctttctctctcttgcttgattgctgtggcctccaggatatatagtagtatgttgaatagaagtggtgaaagtggg

SEQ ID NO: 44480 - DNA, 112 bp, Homo sapiens
ggttgttccgctttcctcaggttttcttccgccgtctgtgacagcttcttgatctgtccccaggtaggtggctgcattcgacaggtgttgctcgtgacagttggggtcctcc

SEQ ID NO: 44481 - DNA, 88 bp, Homo sapiens
tccttggacagcaaagctaaaagcactgtaacacacaccctctgaggcttcacgggtcacaggcactgccctagacactgccacagga

SEQ ID NO: 44482 - DNA, 58 bp, Homo sapiens
tgatctagagtctcactgtgtcacctgggctggagtgcagtggggcaatcttggctca

SEQ ID NO: 44483 - DNA, 119 bp, Homo sapiens
caaagagacttcagaaaaatattgtatcctggtatagaatggatggttatttcattgtttatatgaaagggccttgcttgttgaccagtatttgtattttaattaatttttgtcctttc

SEQ ID NO: 44484 - DNA, 79 bp, Homo sapiens
tccaccttggtctcgcaaagtttgtttcctgtttttttttttttttgagacggagcctcactctgtcgctcaggctgga

SEQ ID NO: 44485 - DNA, 74 bp, Homo sapiens
ggcttgactggagtagctctgtgtctctgacagaagttctgtaggtcctctagggtagctctatttcacatgtc

SEQ ID NO: 44486 - DNA, 112 bp, Homo sapiens
tttctctcagttttatgattctattaagtgacaaatgggtgccacccagtatcccagaaactcctggggtgggtaggaaatggtggcgagtggggctcagacagcagagaaa

SEQ ID NO: 44487 - DNA, 58 bp, Homo sapiens
tgagacagattctcactctgtctcccacgctggagtgcagtggtgagatctcggctca

SEQ ID NO: 44488 - DNA, 117 bp, Homo sapiens
ctgagcctctgtgtgtctctgtgggtctctccctccctcccctccatctttttttttttttttcctgctgtggatgttggttgcgggtgaggggttcccagcaggccaggagccagg

SEQ ID NO: 44489 - DNA, 118 bp, Homo sapiens
atgaatattatagcatgttaacacagtgtgctaactttagatattataaatatcatagatattttattaatatcataatgtattaaccctgtgtgttagcactagatattatatttat

SEQ ID NO: 44490 - DNA, 102 bp, Homo sapiens
acatctctgtgacattagaagtaatgtctcccttggatattatgaatgtcacagagtgtccacacacggtgtacacctcctgtgacattaggagtaatatct

SEQ ID NO: 44491 - DNA, 94 bp, Homo sapiens
tgtacaccatgtgtgtacacactggtatagtattcgtaatatcctggggaatattactcttaatatcacagtgggtgttcactatgtgtgtaca

SEQ ID NO: 44492 - DNA, 90 bp, Homo sapiens
gggtgtacacgatgtgtgggatagtatttgtaatattttatggagttactactcttaatatcacagtgggtgtacaacgtgtgtacaccc

SEQ ID NO: 44493 - DNA, 89 bp, Homo sapiens
tacaccatgtgtgtacactctgagatattatttgtgatatcctcgggagatatttcttttaatatcacagtgggtgtacaccatgtgta

SEQ ID NO: 44494 - DNA, 86 bp, Homo sapiens
cacagtgagtgtacaccttgtgatattatttgtaatatcctctggagatattacttttatatcacagtgggtgtacaccatgtgtg

SEQ ID NO: 44495 - DNA, 115 bp, Homo sapiens
caccatgagtgtataccctgtgatattattcataatatcctcaggagatattacttttaatatcacagtgggtgtacaccatgtgtgtatgctctgtgatattattcatgatatc

SEQ ID NO: 44496 - DNA, 97 bp, Homo sapiens
atatatatatgtgtgtatatacatatgcgtatatatgtatgtgtatatatgtgtatatatgaatgtgtatatatatgtgtatatgtgtgtatagata

SEQ ID NO: 44497 - DNA, 70 bp, Homo sapiens
gtggtgtagatggagctgggacctgagtttgggctgtctgactccagagtgtgtgctcttagcgacccac

SEQ ID NO: 44498 - DNA, 58 bp, Homo sapiens; identical to SEQ ID NO: 1391

SEQ ID NO: 44499 - DNA, 56 bp, Homo sapiens; identical to SEQ ID NO: 1392

SEQ ID NO: 44500 - DNA, 67 bp, Homo sapiens
gccaggggcaggtgctgggctaagccctggggatggagctctggtctctgctctttctgtccctggt

SEQ ID NO: 44501 - DNA, 100 bp, Homo sapiens
cggctgagcgcagggggtcagttttgggggctcatgggtcctcagtctgtctgaatgtgtgggggctggaggaagattggaccctgatgggcaccagagc

SEQ ID NO: 44502 - DNA, 65 bp, Homo sapiens
gtcctgagttgcagggagcttgtccccacccctgggtgggtctctgtttctctccaactcagtcc

SEQ ID NO: 44503 - DNA, 98 bp, Homo sapiens
gtagtcgacatttttttatgctattgtaaatgatattgtttcaaatattcattttctaaatgtcttttgctggtatacagaaatactcagtagactgc

SEQ ID NO: 44504 - DNA, 77 bp, Homo sapiens
cattagcagcacaacctcaagtcagttactgaccctctcagggtctcagctttctcatgtgtaatgtgcagataatg

SEQ ID NO: 44505 - DNA, 111 bp, Homo sapiens
ttccaaaacccatcagcctggctgctggattgttttactgtctctgtcactccctgctgtgagctcagtccttgaaagtcgccgcctcagtttccatgttgagggtgagaa

SEQ ID NO: 44506 - DNA, 100 bp, Homo sapiens
ggcaaatgatgactgaggaagggtggtaactgatggggtcttaagtcgcacctgcaatgttgcaattttttttttttttttaagacagtctcactttgtc

SEQ ID NO: 44507 - DNA, 72 bp, Homo sapiens
gccaaggagtggcagattagttgtgttttttttttttttttttgagatggagtctcactctgtcacccaggc

SEQ ID NO: 44508 - DNA, 58 bp, Homo sapiens; identical to SEQ ID NO: 41866

SEQ ID NO: 44509 - DNA, 93 bp, Homo sapiens
gatcctgtgactcctgagactcaagtgtaatcattctgtgacactgtctcttagttgagccttcccttgaaattgtctccagctccagagatt

SEQ ID NO: 44510 - DNA, 120 bp, Homo sapiens
ctggtgggcaggatgaatggggtgggagatttgtttccatttcttttctttcttttcttttcttttctttttttttttttttagatggaatctcgctctattgtccaggctggagtgcag

SEQ ID NO: 44511 - DNA, 58 bp, Homo sapiens
tgagacagggtctcactctgtcactcaggctggagtgcagtggcatgaccttggctca

SEQ ID NO: 44512 - DNA, 87 bp, Homo sapiens
ggcatatgacaagtacatatgtatgtatatatgtatgtgtatattatatatatatatacacacacacatacatacttttcttatatc

SEQ ID NO: 44513 - DNA, 119 bp, Homo sapiens
cagagtagctgggactacaggcatgcatatgtacatatatatatatatatatatggagtgcaatggtgcaatctcagttcactgtaacctccacctcctgggttttatatatatatata

SEQ ID NO: 44514 - DNA, 58 bp, Homo sapiens
tgagccagagtctcgctctgtcacccacgctggagtgcaatggcatgatctcggctca

SEQ ID NO: 44515 - DNA, 93 bp, Homo sapiens
gtgaacaaggtttgctttttttgttttttgtttttgagacagagtctggctctgtcgtccagaatggagtgcagtggcatgatcttggctcac

SEQ ID NO: 44516 - DNA, 103 bp, Homo sapiens
ctttggaaatgctgagtctgggtgttggggatgaggctttttttttttttcatttaaatgctttcagtctccagcctgggaatggctctgagctcttccagag

SEQ ID NO: 44517 - DNA, 62 bp, Homo sapiens
ccctgcacacagcgggtcctctgcacaccaggaattggacagagagaacagaatgtggaggg

SEQ ID NO: 44518 - DNA, 109 bp, Homo sapiens
atgatgcttgtctgagtctgttactgttatgatgattgccaaatggggatttttctaattcttttttttttttaaatttattgcttacaggccaggcatggtggctcat

SEQ ID NO: 44519 - DNA, 88 bp, Homo sapiens
ttttatgtatgtatgtacgtatgtatgtatgtatgtacgtacgtatgtatgtatgtatgtacgtacgtatgtatgtatttccttagag

SEQ ID NO: 44520 - DNA, 58 bp, Homo sapiens
tgagacagggtctcgctctgtcgctcaggctggagtgcggtggtgtgatcacagctca

SEQ ID NO: 44521 - DNA, 92 bp, Homo sapiens
cttggtggtgcatgcctgtagtcccagctacttaggaggctgaggtggaaggatggcttgagcccaggaggtagaggttgcagtgagccaag

SEQ ID NO: 44522 - DNA, 75 bp, Homo sapiens
gccgggcatggtggcatgcacctgtagtctcagctacctgggaggctgaggtaggaggatcgcttgagcccaggt

SEQ ID NO: 44523 - DNA, 112 bp, Homo sapiens
tagctgagtgcaatggtggacgcctgtagtcccagctactctggaggctgaggtaggaggatcgcttgagcccaggagtttaaggctacagtgagctatgattgcagcactg

SEQ ID NO: 44524 - DNA, 78 bp, Homo sapiens
gggggcagtgggccagggactgtctctctctgttgcccaggctggagtgcaggatcgtgatcatggcccattgcagcc

SEQ ID NO: 44525 - DNA, 105 bp, Homo sapiens
tgattctgcttatcgctgataattttagtctgttcagattctgatgattctaaatattttcatttagttgctaggttgagatttagctttaaccagcaaggatca

SEQ ID NO: 44526 - DNA, 121 bp, Homo sapiens
aggtgggcatggtggtgcaagcgtgtagtcccagctacttgggaggctgaggtaggaggatcagttgagcacaggaatttgaagctatagtgcgctatcatcctcccccctataaatagcc

SEQ ID NO: 44527 - DNA, 87 bp, Homo sapiens
ggccatacactctctgtcacagttactcaattctgccattgcagcctgaaagcaaccatagataacagtaattgaatagaaatggct

SEQ ID NO: 44528 - DNA, 119 bp, Homo sapiens
gccctcaaacacaactgcttggaaatgagacaatgagactttgaaacccacatcaatgactttttttttttttaatgacacaaagtctcactctgttgcccaggctggagtgcagtggc

SEQ ID NO: 44529 - DNA, 78 bp, Homo sapiens
gctggctgggtcattcttatagaatatcttgggaaactgactctcagtctcacagtaacttctcaggaatgtgttggc

SEQ ID NO: 44530 - DNA, 133 bp, Homo sapiens
ttttcatggaccagtctgataccctattttggcccagacattttggggcatgtaattgggttgaatagttgtatgattgggcttcaggtccatccatttagaagacatcagaggctggattgcaggcctggtt

SEQ ID NO: 44531 - DNA, 123 bp, Homo sapiens
gtgttcgctgagctccagtctgtgcatgcgcccccggctggagggagtgtttgctgagctcagatctgtgtgcgtgtgcccggctggagtgaatgtttgctctgagcttgggtctgtgcatgc

SEQ ID NO: 44532 - DNA, 112 bp, Homo sapiens
gcaactaagaccttctctggacatttcgtgtacgtgggctcaggtaatctgcagcctttcggatctggcttctttcccctggctgaatgctctcacggtctatctgtgttgc

SEQ ID NO: 44533 - DNA, 77 bp, Homo sapiens
catgtgaacattcgtgtgtgtgcatgtgcatgtatatgtgagtgtgtgtgcatgtgagtgcattgtgagtgtgcatg

SEQ ID NO: 44534 - DNA, 113 bp, Homo sapiens
ttggtttctttggatcagtaatgggaatctaggtgtggctctctcttttttttttatttttttaatgagactgagtctcactctgtcgcccaggctggaatacagtggcacaa

SEQ ID NO: 44535 - DNA, 63 bp, Homo sapiens
cccttgcatttttttatttttgagacggagtctcactctgtcacccagaatagagtgcagtgg

SEQ ID NO: 44536 - DNA, 73 bp, Homo sapiens
ctgtcagtgaactccagggactatgacggcagggcgactgccgcgagagtgtttgttgttctcacactggtgg

SEQ ID NO: 44537 - DNA, 90 bp, Homo sapiens
ctactcattaccagctctgaaatgacacgattctttttctttttttttgagacggagtgtcactctgtcacccagactagagtgcagtgg

SEQ ID NO: 44538 - DNA, 73 bp, Homo sapiens
agccattgaacaaagaatgctttggtttgctgggcttcaggcaaagaataaagccctttgtttttctgtggtt

SEQ ID NO: 44539 - DNA, 85 bp, Homo sapiens
gagtctcactctgtcactcagactgcagtgcggtggcgtggtctcagctcactgcaacctctgcgtctcggttcaagtgattctc

SEQ ID NO: 44540 - DNA, 117 bp, Homo sapiens
aaccatttgctaaagaggttgagtgttttttttttttgagacagggtctctctctgtcacccaggctggagtgcagtggtgggatcttggctgaccgcaacctctgcctcccaggtt

SEQ ID NO: 44541 - DNA, 58 bp, Homo sapiens; identical to SEQ ID NO: 1763

SEQ ID NO: 44542 - DNA, 94 bp, Homo sapiens
catgtctgtggtttgaattactcagcaaatatctctgtgaccttgggcaggttacttaaactctctgagtcacagtttcttcatctacaatatg

SEQ ID NO: 44543 - DNA, 140 bp, Homo sapiens
ccagccggggcaacacagggagaccctgtctctaaatgtattatttatttatttttgagacggagtctctctctgtcacccaggctggagtgcagtggtgtgatctcagctcactgcaacctccacccccccggttcaag

SEQ ID NO: 44544 - DNA, 62 bp, Homo sapiens
gtgtctttacaagaatagaaaaagaccagagctctctctgtctctggatcatgtaaggacac

SEQ ID NO: 44545 - DNA, 181 bp, Homo sapiens
atatatatatatatatatatatatatatacacacacatatatgtatatatatatgtgtgtatatatatatacatatatgtgtatatatatatatgtatatatatatatacatatatgtatatatatatgtatatatatatatatacacatatatgtatatatatatatatatgtatatata

SEQ ID NO: 44546 - DNA, 102 bp, Homo sapiens
acattccaggcaaagccacaggtgaaattagggcagggctaactcaaccatgatgttttgctgtctgccactgtcacactcacctgcttgaaacctgcttgt

SEQ ID NO: 44547 - DNA, 68 bp, Homo sapiens
gcaatgtgtatatgcacatatgtgtacatatgcatgtatgtgtatatatgtgtgtacatgcaatgtgt

SEQ ID NO: 44548 - DNA, 70 bp, Homo sapiens
ccagctctagattgtgagcttttttttttttttttttttagacgaagtctcgctctgtcgcccaggctgg

SEQ ID NO: 44549 - DNA, 85 bp, Homo sapiens
tggggaagatctagaagttctgagccatccctaattttttgttttataacagaaaagtttcttacaacttgttcactttttccca

SEQ ID NO: 44550 - DNA, 90 bp, Homo sapiens
ctgtatctctctctctgtacatacacacacacacacacacacacacacacacacatatatgtgtatatatatatagagagagagagagag

SEQ ID NO: 44551 - DNA, 135 bp, Homo sapiens
ggtgtcttccagggtggattttattttaattaattaatttatttatttatttattttgagacggagtctcactctgtcacccaggctggggtgcagtggcaagatctctgctcactgcaagctccacctcccggg

SEQ ID NO: 44552 - DNA, 95 bp, Homo sapiens; identical to SEQ ID NO: 68

SEQ ID NO: 44553 - DNA, 93 bp, Homo sapiens; identical to SEQ ID NO: 69

SEQ ID NO: 44554 - DNA, 99 bp, Homo sapiens
aatgactgcaggctgtttgttcccaccatgaggattgtccaggctagagggagctagctttgatgagggcaatgttggttcaagcatgcaagcagcatt

SEQ ID NO: 44555 - DNA, 124 bp, Homo sapiens
gtgtgcacctgcagcctgtgtgcctgtgcatctgtgtgcacctgcagcctgtgtgcctgtgtctgtgtgcacctgcagcctgtgtgtgtgcgtgtctgtgtgcacctacagcctgtgtgcgtgt

SEQ ID NO: 44556 - DNA, 58 bp, Homo sapiens
tgagactgagtctctctctgtcacccaggctggagtacagtggcgtgatctcggctca

SEQ ID NO: 44557 - DNA, 114 bp, Homo sapiens
tgcttaggatggtcctggctatacagactctcttttttttggttccatatgaaatttaaactagttttttctaattctgtgaagaatgtcaatggtagtctgatgggaatagca

SEQ ID NO: 44558 - DNA, 58 bp, Homo sapiens
tgagccagagtctcgctctgtcacccgggctggagtgcggtggcgcgatctcggctca

SEQ ID NO: 44559 - DNA, 78 bp, Homo sapiens
ggcaaattgtcaatagtctgggtttgtaggaatcagagtcttttttttttcaatatgacgacccaagactattttgct

SEQ ID NO: 44560 - DNA, 79 bp, Homo sapiens
gcttggatatacagtttttttttttttggagagagacagagagattgaatctttgtcttgaaaagatgattataaaggc

SEQ ID NO: 44561 - DNA, 71 bp, Homo sapiens
tgacatttgagttgagacctgaatcatacataattaaaaaattttttttgacacagggtctcactgtgtca

SEQ ID NO: 44562 - DNA, 76 bp, Homo sapiens
aacaaggacagcttggtggttagaaggaagatggagtcagttaggttagatctctttcactgtctctgtcctagtt

SEQ ID NO: 44563 - DNA, 58 bp, Homo sapiens
tgagagagagtctcgctctgtcacccaggctggagtgcagtcgcaagatctcggctca

SEQ ID NO: 44564 - DNA, 134 bp, Homo sapiens
cttcttgaagtctgcctcttactagctatgggttcttggaggaattactttacctctcagggtctcagtgtctctagagggggctcatgacctctgaggtccttcctaaattccctgtattcacaccttttgct

SEQ ID NO: 44565 - DNA, 87 bp, Homo sapiens
ttcatccatgggtcctcagtccctgacacagtgcctgtcacctagtaggcatgctataaagttttgtgatatggatgattggatgga

SEQ ID NO: 44566 - DNA, 123 bp, Homo sapiens
cacacaaacatataaaattaactatatatatatatgtgtgtgtgtgtgtgtatatatatgtgtatatatataatgtgtatatacatatgtgtgtgtttatatatatgtgtgtgtgtgtgtata

SEQ ID NO: 44567 - DNA, 97 bp, Homo sapiens
gtgtgtttgtatgcctataggtatgtatgcatgtgtctgtgtgtctgtgaatgtctatgtgtgtatgtgtctgtacgtctatggtgtgtgtctatat

SEQ ID NO: 44568 - DNA, 121 bp, Homo sapiens
atatacaaacaatatatagtttatatatatatgtgtgtgtgtatatatatgtgtgtatatatatatgtaaatacttacactatatatatatgtatatatcaatagtgtgtacaggcatgca

SEQ ID NO: 44569 - DNA, 112 bp, Homo sapiens
gctgtttcccatccttcacttgtgggggctgataggtagtagcagattccatctgaggaacactagttattatgtttctgtgcccctcctctacaggtgccttcctgacagt

SEQ ID NO: 44570 - DNA, 98 bp, Homo sapiens
tgtttacagagtatcatctttggtcatgtcacatgagtgtgagcacatagcgcgtcctcactccaacctggaacatgtagtggagatcctggagagca

SEQ ID NO: 44571 - DNA, 109 bp, Homo sapiens
gacttagtgaggctgggatgtgggagagagggaaactggaggggtcagagatggtacctggtgtctttttttttttttttttttttttcagaaggagtctcactctgtc

SEQ ID NO: 44572 - DNA, 87 bp, Homo sapiens
gggaggccccggtcacctcacactcactcactgccaggtacagcgcccaggacacctgtgggtggggagggtgtccagcggcctctt

SEQ ID NO: 44573 - DNA, 67 bp, Homo sapiens
ctcaactctctctctcagtctgtgtggccgttaaaactccgtctctggcagagagactgggtttgag

SEQ ID NO: 44574 - DNA, 66 bp, Homo sapiens
agccagacgctggccccgtctgcagccgtcacaggccctctgtctgtctgctggtcatgtcatgct

SEQ ID NO: 44575 - DNA, 91 bp, Homo sapiens
cttctttcaaagacactaacactgtctcttaaaaagatatgccaccaactacagcattgtcccttatagacactgtgtgctatggaagaag

SEQ ID NO: 44576 - DNA, 94 bp, Homo sapiens
ggtcaggaggctgggtgcggtggctcaagcctgtaattccagcactttgggaggctgaggtaggaggatcacttgagcccagaaattctagatc

SEQ ID NO: 44577 - DNA, 86 bp, Homo sapiens
gtctcagtctctcaagtagctgggattacaggtgtacgccaccacatctggctaatttttgtaattttttttagtggagatgggat

SEQ ID NO: 44578 - DNA, 83 bp, Homo sapiens
gagatggagtctcactctgtcacctaggctggagtgcagtggtgcgatctcggcctcctgtgttcaagtgattctcttgactc

SEQ ID NO: 44579 - DNA, 127 bp, Homo sapiens
cccaggaggcggaggttgcagtgagctgagatcgcaccactgcactccagcctgggcgacagtcagactctgtcttggaaaaaaaaatcaggttaccacgatggagcttttactataacccaaagga

SEQ ID NO: 44580 - DNA, 113 bp, Homo sapiens
cagaactaagaaccatatgtatgtagacctaggcatgtacacacacagctatatttctgtgtctctctgtatatgtatgtgtgtgtggatctatataaatgtgtatgtagctg

SEQ ID NO: 44581 - DNA, 100 bp, Homo sapiens
ccaaagtgctgggattacaggagtgagtcaccacacccggcccattttttacaatgtaagcctggcgcagtggtacgtgcttgtaatcccagcactttgg

SEQ ID NO: 44582 - DNA, 89 bp, Homo sapiens
gcctagacacacatacatattagcttttttttttttttggagacagagtctctgtcaccaaggctagagtgcagtgatgttgtcatggc

SEQ ID NO: 44583 - DNA, 70 bp, Homo sapiens
ctgggattacaggcgtgagacactgtgcccggccttttttgttgaggcagggtctcactctgtcacccag

SEQ ID NO: 44584 - DNA, 81 bp, Homo sapiens
gccaggaacatagtgtatgattctatttatatgaaatatctagacagggtaaatccagagatagaaaactggtaacctggt

SEQ ID NO: 44585 - DNA, 60 bp, Homo sapiens
ttgagacggagtctcactctgtcacccaggctggagtgcagtggcgggatttctgctcag

SEQ ID NO: 44586 - DNA, 60 bp, Homo sapiens; identical to SEQ ID NO: 44585

SEQ ID NO: 44587 - DNA, 95 bp, Homo sapiens
gtgcaggaagtaagaatgccgtggtgatggaagaaacatgggcttgcaggccaccctgaccccaggctctctctgtctctgttcgctccctgtcc

SEQ ID NO: 44588 - DNA, 89 bp, Homo sapiens
ggtcaggatgagtcgtgttcaagaaaataaggttggagttatttctagattttttttttttttttgagacagagtctcgctctgtcacc

SEQ ID NO: 44589 - DNA, 91 bp, Homo sapiens
tatcacagagggagtacaccctgtaatattattcataatatcctagaaagataatacttttaatatcacagtgggtgtacactctgtgata

SEQ ID NO: 44590 - DNA, 77 bp, Homo sapiens
cagatatattacttttaatatcacagtgggtgtacaccctgtgtgtacaccctgtaatattattagtaatattttag

SEQ ID NO: 44591 - DNA, 69 bp, Homo sapiens
tcaagggcaggaaaacatggtggttaagaactcttggacctgggttcaaacccctgctctgccacttga

SEQ ID NO: 44592 - DNA, 72 bp, Homo sapiens
tctgtggatgtgtgcccggcatctgcctctgcccctgcctctgagagcagtgactgagcaaacagtcctgga

SEQ ID NO: 44593 - DNA, 60 bp, Homo sapiens
gtgagacagagtctcattctgtcactcaggctggagtgcagtggtgtgatctcggctcac

SEQ ID NO: 44594 - DNA, 111 bp, Homo sapiens
gctgggcgtggtggtgcatgcctgtagtcccagcagtttgggaggctgaggtagaaggatcacttgaacccaggaggttgaggctgcagtgagccaggatcatgccactgc

SEQ ID NO: 44595 - DNA, 88 bp, Homo sapiens
gtagacctagctacttgggaggcagaggtaggaggatcgcttgagcctgggagtttgaggctacagtaagctatgattgtgtcactgc

SEQ ID NO: 44596 - DNA, 105 bp, Homo sapiens
ttttgctggtgtataatacatataaaatctctctggaagaatacacaagaaactggtaatgtctgtctctagagaagaaaacatggtagggagatagaggtagga

SEQ ID NO: 44597 - DNA, 107 bp, Homo sapiens
ttgagagccaaggggtcaaatccaatctcatgtgttttacacaagcccgaactcactttcagtctgtgtgaattacatctacctggacctccatttttgtcttttaa

SEQ ID NO: 44598 - DNA, 72 bp, Homo sapiens
ctgggtgtggttgcctgtgcctgtagtcccaactactcaggaggctgaggtaggaggatcacttgagcccag

SEQ ID NO: 44599 - DNA, 73 bp, Homo sapiens
ccggttcccgtggggctgggatgggagggaacgaggacctctgtctccttctctcacagctacgagaagtcgg

SEQ ID NO: 44600 - DNA, 75 bp, Homo sapiens
tagatgcctgtgacagtctctgtcatataaataagaatatgctgcaatttatatgaactggactttaggaatctg

SEQ ID NO: 44601 - DNA, 71 bp, Homo sapiens
atacataactacatacatatacatgcagttgtgtatttatatagtgtgtgtgtgtgtgtgtgtgtgtgtgt

SEQ ID NO: 44602 - DNA, 112 bp, Homo sapiens
tatgtactatatgtaactatatatttatatatttaatatatacatttatatatttacatgtgtttacatatagtacatgttcatttatatatttactaaatatataaatata

SEQ ID NO: 44603 - DNA, 108 bp, Homo sapiens
ctccagaggatggttttccacttcccaactttcatattattattattatttttgaagggggtagcattagatgggtagagaggtagactaaagtgattcagctgtgag

SEQ ID NO: 44604 - DNA, 104 bp, Homo sapiens
ctggagggtcaggatgagtcgtgttcaagaaaataaggttggagttatttctagaatttttttttttttttttttttgagacagagtctcgctctgtcgcccag

SEQ ID NO: 44605 - DNA, 78 bp, Homo sapiens
ctggcaaagtcaccaagagccctgcgagcagctgtccacacctcctggcactctctgtatctgtcccgtccctgccag

SEQ ID NO: 44606 - DNA, 73 bp, Homo sapiens
cttgtttttgagacacagtctggctctgtcgcttaagctggagtgcaatggtgggatcttggctcactgcaag

SEQ ID NO: 44607 - DNA, 76 bp, Homo sapiens
gggtgacagagtgagtctctgtctcaaacaaacaaacaaaaaaaaattcagttgcagtggctcatgcctgtaatcc

SEQ ID NO: 44608 - DNA, 113 bp, Homo sapiens
gcttcatagaggactgtagcaggcatgtgcccagacgtttccttttttcttttcttttttcttttctttttcttttttgagacagtctggctctgttgcccaggttgaagtgt

SEQ ID NO: 44609 - DNA, 123 bp, Homo sapiens
ctgggtgtggtggtgcacctcagtggtcccagctagacaagaggctgaggtagaaggatcacttgagcccaggggcggaggttgcagtgagccgagatcctgcaactgtgctccagcctgggt

SEQ ID NO: 44610 - DNA, 72 bp, Homo sapiens
ctgtctctgtgtctctgtccctgtgtctctttttctcccatcctctctcgatgctggggccacacagggcag

SEQ ID NO: 44611 - DNA, 78 bp, Homo sapiens
tctgttacagtaacctgagtgagtctgtttcttgtacccaaagtgccagagactctctgtaacttacactggtccaga

SEQ ID NO: 44612 - DNA, 58 bp, Homo sapiens; identical to SEQ ID NO: 42073

SEQ ID NO: 44613 - DNA, 88 bp, Homo sapiens
ggctgaaggttttttgtttttgttttttgttttgagacggagtcttgctctgtcacccaggctggagtgcaatggcacaatctcggct

SEQ ID NO: 44614 - DNA, 109 bp, Homo sapiens
ctagcaaagcatgaaagttgaggacagttttggggacccccaaactcgcagctggtgtcagaagtgagagtggtcttttggactgtcctctgactttgtgcaaggctag

SEQ ID NO: 44615 - DNA, 56 bp, Homo sapiens; identical to SEQ ID NO: 36141

SEQ ID NO: 44616 - DNA, 60 bp, Homo sapiens
tgagacaggatctctcactctgtcgcccaggctgtagtgcagtggtgtgatcttggctca

SEQ ID NO: 44617 - DNA, 98 bp, Homo sapiens
gtgcattggtggttctgattcatatggttctgtataggaagctatttggaagtaaagttttctgtaaaccatggtaattatttatcactgtctctcac

SEQ ID NO: 44618 - DNA, 71 bp, Homo sapiens
gtgacagagcaagactctatctcaaataaataaataaaaattattttagagtcagggtctcactctgtcac

SEQ ID NO: 44619 - DNA, 62 bp, Homo sapiens
gagatggagtctcgctctgtctcccaggctggagctggagttcagtggtgtgatctcaggtc

SEQ ID NO: 44620 - DNA, 72 bp, Homo sapiens
gtgaggaggagcatttggggatagtctggaaagcatactttatttatttttgagacagtcttgctctgtcac

SEQ ID NO: 44621 - DNA, 78 bp, Homo sapiens
accagtctgggcagcatagcaagacttttttatttttatttttttgagacatagtctcactctgtttcccaggctggt

SEQ ID NO: 44622 - DNA, 75 bp, Homo sapiens
gcttagcagcagatggctttgcagtttccaggcagcccaaggttctgccactctcagactgtctctgcgctgagc

SEQ ID NO: 44623 - DNA, 102 bp, Homo sapiens
aattttaggtaaacaacaaacctttttttaaattttaattatgtcccttgtaacatttggaccgtgattataccaaaagagtattcttgtttatctgaaatt

SEQ ID NO: 44624 - DNA, 108 bp, Homo sapiens
tgagcaggaatcggtttgcttcttgttagatggggtcacgctctgtcacacagactggagtgcactggcaccatcttaggtcactgcagcctcaacctcccaggctca

SEQ ID NO: 44625 - DNA, 57 bp, Homo sapiens
tgagccagagtctcgctctgtcacccaggctggagggcagtgtgtgatcttggctca

SEQ ID NO: 44626 - DNA, 70 bp, Homo sapiens
cactttgggaggctgaggtatgaggatcacttgaggccaggagttcaagtcctgcctgggcaacaaagtg

SEQ ID NO: 44627 - DNA, 113 bp, Homo sapiens
agaacagctgatggtggaggtttattcttgggcaggtacatctgatctatttatgtatgtatctatgaatttgtctatttggcatggctctttagcaaaatacaggctttttt

SEQ ID NO: 44628 - DNA, 79 bp, Homo sapiens
cgctgcctgatgggaggaagacagggcttgggagtgaaacagagctgtatcaaggcctggctctctcacactggctgtg

SEQ ID NO: 44629 - DNA, 93 bp, Homo sapiens
aacagctcatctggctcacaagggggctgtcccacctctcaggcacccactgtctcttagccttctcctgctgtgctggcttttcttgctgtt

SEQ ID NO: 44630 - DNA, 91 bp, Homo sapiens
gtgtgactgttccaatgaaactttatttataaatagctggtctgtgggccatagatgcttctgatatataaagcatctggtatagtggtgt

SEQ ID NO: 44631 - DNA, 116 bp, Homo sapiens
ccacagcaatcgcaatttcactggtctggtgcaacctaggtgtcaggaagtttttttgttttttcagacagggtctcattctgtcacacaggccggaatgcagggatgctatcagg

SEQ ID NO: 44632 - DNA, 69 bp, Homo sapiens
ccggggtgcgttgatgaactctctctttttttgttttttttgggactgagtctcactctgtcacccagg

SEQ ID NO: 44633 - DNA, 58 bp, Homo sapiens; identical to SEQ ID NO: 13142

SEQ ID NO: 44634 - DNA, 76 bp, Homo sapiens
tgttactgctgctgttggtgacagctgccatgtttgccagcttactctggatctgtcactgtctggcaaagccaca

SEQ ID NO: 44635 - DNA, 76 bp, Homo sapiens
ccctgatcctccagctctgtgacaggacagtgtgcgctgcttggctttcagagctgttctgacggcacggcatggg

SEQ ID NO: 44636 - DNA, 85 bp, Homo sapiens
gcattaaatgacagaggaatgtttgtttcatttctttttttaatttttatttttttgagatggagtctcactctgtcaccaaggc

SEQ ID NO: 44637 - DNA, 79 bp, Homo sapiens
tcctcactcctctttctgacagcggtcagtatattaatactggactcaccaaaccagctgcaggcaccggaaaagaggg

SEQ ID NO: 44638 - DNA, 86 bp, Homo sapiens
gccaagtcctctgagaccaaggagggaaaagcccaagacgaccccgaggaggcttcattccccagctgtggaccgagaaccctggc

SEQ ID NO: 44639 - DNA, 103 bp, Homo sapiens
gccgcagacagtacatcgaccctggccatggctgtgctccaatatgatgtttttacaaaagcacacagtgagcacacaggcaaggagaatatttacaggcgtt

SEQ ID NO: 44640 - DNA, 77 bp, Homo sapiens; identical to SEQ ID NO: 44590

SEQ ID NO: 44641 - DNA, 86 bp, Homo sapiens
ggcggccttgacgttggtcttgtcggcaggagacagcaccatggtgggttctctctgagtctgtggggaccagaagagtgccggcc

SEQ ID NO: 44642 - DNA, 69 bp, Homo sapiens; identical to SEQ ID NO: 44591

SEQ ID NO: 44643 - DNA, 72 bp, Homo sapiens; identical to SEQ ID NO: 44592

SEQ ID NO: 44644 - DNA, 71 bp, Homo sapiens
gctaaggaacagagttttgaatttcattttttttttttttttaagatggagtctcgctctgtcacccaggc

SEQ ID NO: 44645 - DNA, 76 bp, Homo sapiens
ggtgacagagcaagacactgtctctgtctaaaaaaaaaaaatgaaatttgggccaggcgcggtggctcatgtctct

SEQ ID NO: 44646 - DNA, 78 bp, Homo sapiens; identical to SEQ ID NO: 44605

SEQ ID NO: 44647 - DNA, 97 bp, Homo sapiens
cctcagaggagagctggaaggctggggacaaggacacaagagaggcttttttatttttttatttttttgagaccgagtctcgctctcgctgcccagg

SEQ ID NO: 44648 - DNA, 69 bp, Homo sapiens
ctggaggaatgtcagagtcatccactttttttttttttttttgagacggtgtcttgctctgtcagccag

SEQ ID NO: 44649 - DNA, 70 bp, Homo sapiens
cctgacactgcatctgcttctggtggggcctcaagctgtttccacttagggcagaaggggaagtggaggg

SEQ ID NO: 44650 - DNA, 104 bp, Homo sapiens
cctggtcacaaaaacatccctcagaggctcactcagtggctgtggccatgcaggtacagacttactggccaggtgactcgtggcctggggtggaaggaccttgg

SEQ ID NO: 44651 - DNA, 61 bp, Homo sapiens
gacagtgagtctccctctgtcacccaggctggagtgcagtggtactatcttggcttgctgc

SEQ ID NO: 44652 - DNA, 118 bp, Homo sapiens
catgaatcctcagtcatttcttgtctgtgacagtttttcattattttttatagctttttttttttttgagatggtgtcttgttctgtcacccaggctggagtgcagtggtgtgatctc

SEQ ID NO: 44653 - DNA, 113 bp, Homo sapiens
atttatgttatttccagtgttttgactattatttaaagtgttgctatgaaaaaatttatatttaatttttggctatatgtaaatatagttggacatacatctagaatataaat

SEQ ID NO: 44654 - DNA, 106 bp, Homo sapiens
cactaagtgatctcacatctgctgggttcaaagcatggactctggagccagactctctctgtttgtatccaagctccaccagttaggacctgtgtgaatttggatg

SEQ ID NO: 44655 - DNA, 95 bp, Homo sapiens
gcaatatgcttagaatgatgcctggctccaagtaaggtctattaaaatgttagatattattattattgttattattattcggaatagcgtcttgc

SEQ ID NO: 44656 - DNA, 87 bp, Homo sapiens
acctggggaataatgacagaaaagaagtctgtagatgttcagtacagatgcaaccatccttttatttctgacattttgatctgaggt

SEQ ID NO: 44657 - DNA, 113 bp, Homo sapiens
ttgcttaggattgtcttggctctgcaggctcttttttggttccatatgaaatttaaagtagtttttttccaattccgtgaagaaagtcaatggtagcttgatggggatagcaa

SEQ ID NO: 44658 - DNA, 58 bp, Homo sapiens; identical to SEQ ID NO: 21658

SEQ ID NO: 44659 - DNA, 95 bp, Homo sapiens; identical to SEQ ID NO: 68

SEQ ID NO: 44660 - DNA, 93 bp, Homo sapiens; identical to SEQ ID NO: 69

SEQ ID NO: 44661 - DNA, 89 bp, Homo sapiens
gctttgatgtgggagtgactttggaccaggggctgcttttttttttttctttttgagacagagtctcgttctgtcacctaggctggagt

SEQ ID NO: 44662 - DNA, 117 bp, Homo sapiens
atatatatatatatatatatatatatatacacgtgtatatatatatatatgtacacatatatatacgtgtgtgtgtgtgtgtatatatatatatatatacacacacacgtgtatata

SEQ ID NO: 44663 - DNA, 92 bp, Homo sapiens
ccctctctagctcctgtcactctcatacactcagctgcctgttatcagagcacattgggagtcactgtggtaatgaccggcaagaagatggg

SEQ ID NO: 44664 - DNA, 92 bp, Homo sapiens
tgttcttgtggcagtgaataagtctcatgagatctgatttttttttttttttttttttcctgagatgaagtctcactctgtcactcaggcca

SEQ ID NO: 44665 - DNA, 267 bp, Homo sapiens
atacgtgtgtgtgtgtgtatatatatatatgtgtatatatatgtgtatatatatatgtatacatatgtgtatatacatatgtgtatatatatgtgtatatacatatatgtgtgtatatatatgtatatacatatatatgtgtatatatgtatatacatatatatgtgtgtgtatatatatgtatatacatatatatgtgtgtatatatatatgtgtgtgtgtgtgtatatatatatatatatatatatatatatatatatatatatg

SEQ ID NO: 44666 - DNA, 58 bp, Homo sapiens
tgagacagagtctcactctttcacccaggctggagtggagtggagcgatctgtgttca

SEQ ID NO: 44667 - DNA, 58 bp, Homo sapiens; identical to SEQ ID NO: 2595

SEQ ID NO: 44668 - DNA, 100 bp, Homo sapiens
acattacatgtgtttccttttggagctgactaaatttaatttaatttaaattgttttcactgtcagtggccttcccaagctgtggtagcacacgttctgt

SEQ ID NO: 44669 - DNA, 82 bp, Homo sapiens
tatggactagttacattgtagtcataacatcatagtttatttttttataaattgagtgtggcctaagtgtacagtgtttata

SEQ ID NO: 44670 - DNA, 81 bp, Homo sapiens
cctcattttctcatcattggtgatacagcaaaggatctgggagaaagtagtatctctggctgacaaatggggaaactgagg

SEQ ID NO: 44671 - DNA, 58 bp, Homo sapiens
tgagacggagtctcgctctgtcgctcaggctggagtgcaatggtgtgatctcggctca

SEQ ID NO: 44672 - DNA, 58 bp, Homo sapiens; identical to SEQ ID NO: 1265

SEQ ID NO: 44673 - DNA, 85 bp, Homo sapiens
agcttggagcagtcaggttccctctctctgcctcagtgtgccatctgtaaagtgaggatgacagtggtccctaatctgaaaggtt

SEQ ID NO: 44674 - DNA, 93 bp, Homo sapiens
tccatcaggttattcccagtggtggaaacagtgaatggcacacaataggtgctcagtaaatatttttgtttccttcagaaattgcctgaaaga

SEQ ID NO: 44675 - DNA, 64 bp, Homo sapiens
atcagactgtggctctgacactcctgaaatgtttctcacgtgtccacctgccaaccggtctggt

SEQ ID NO: 44676 - DNA, 118 bp, Homo sapiens
cacctgagcagagtaccctgtacccaatgtgtagtctttttctttttctttttttttttttttttttttttttgagacaaagtctcgctcttgtcatgcaggctggagtgcaatggtg

SEQ ID NO: 44677 - DNA, 82 bp, Homo sapiens
tgttgtttgtttttgagacagggtctcgctctgtcactcaggctggagtgcagtactgcaatctctgctcactcatcctcca

SEQ ID NO: 44678 - DNA, 76 bp, Homo sapiens
attggtatgccaataggccaggctaatttttttgtatttttagtagagacagtttcaccatgttggccatgctggt

SEQ ID NO: 44679 - DNA, 93 bp, Homo sapiens
ggtgttggaaatagagtagcaaacaagagggacactttctcactggctgtttacttttgtaaggagaatgtaactcactcaatttctagtctc

SEQ ID NO: 44680 - DNA, 83 bp, Homo sapiens
tttattcccagttccccaaaataccatggttttctatcttgaaatgagcagagaatttgttgtttggaagatctgggtttaaa

SEQ ID NO: 44681 - DNA, 88 bp, Homo sapiens
gctcacaagatgaagtcaataatgatgcctgaaaagtagcatgctctcagtaaatactaattatttttgttgttttcattctgtgtgt

SEQ ID NO: 44682 - DNA, 78 bp, Homo sapiens
ctgtatagtattccatgatgtatgtatgtatgtatgtatgtatgtacaatatatatatcacttttttatttgagacag

SEQ ID NO: 44683 - DNA, 114 bp, Homo sapiens
acacttactaaatgccaagcactgtgctgagaattgtctttccttttcttttcttttctttttttttttttttttttgagacagagtcttgctgtgttgcacccaggctggtgt

SEQ ID NO: 44684 - DNA, 119 bp, Homo sapiens
tattctcagtggcaatgtagtaactctccgttatgtgaaaatatttttatttacttaaatcccttattgttgcatatttaggtgtttctctttctttctctgcactgttataaagagta

SEQ ID NO: 44685 - DNA, 75 bp, Homo sapiens
aagaggtagaaattgggtgacactggctgttctttcttttcagaatttgccttggttgaatccttttctcttttt

SEQ ID NO: 44686 - DNA, 119 bp, Homo sapiens
tgttttcttagggtttttagtcattctgctgtttcccaggatgcctgataattttttttttttttttttgtagaatgctggatattttgtatgaaagatagtagaggctctggacaata

SEQ ID NO: 44687 - DNA, 112 bp, Homo sapiens
gtatgcacatgtacgtgtacacacgtgtatatgtgcacatatgtacatatgaatacatatgtataaatgtgtgtacatgtacatatgtaagtatacatgtataaatgtatac

SEQ ID NO: 44688 - DNA, 75 bp, Homo sapiens
tagatgcctgtgacagtctctgtcatataaataagaatatgctacaatttatatgaactggactttaggaatctg

SEQ ID NO: 44689 - DNA, 71 bp, Homo sapiens; identical to SEQ ID NO: 44601

SEQ ID NO: 44690 - DNA, 112 bp, Homo sapiens; identical to SEQ ID NO: 44602

SEQ ID NO: 44691 - DNA, 91 bp, Homo sapiens
tgtacaagaagcctgacactgcatctgcttctggtggggcctcaagctgtttccacttagggcagaaggggaagtggagggactgtgtgca

SEQ ID NO: 44692 - DNA, 70 bp, Homo sapiens; identical to SEQ ID NO: 44649

SEQ ID NO: 44693 - DNA, 135 bp, Homo sapiens
tatatgtatgtatgcatatatatctatagatacatataaatgtatctatagatatatgtatctatatatatctatatatatacatctatagatatacatgtatctatagatatatatatagatatgtatacatat

SEQ ID NO: 44694 - DNA, 57 bp, Homo sapiens
tggacagagtctcgctctgtcacccaggctggagtgcagtggcgcagtcttggttca

SEQ ID NO: 44695 - DNA, 97 bp, Homo sapiens; identical to SEQ ID NO: 44647

SEQ ID NO: 44696 - DNA, 106 bp, Homo sapiens
agtgctggagggtcaggatgagtcgtgttcaagaaaataaggttggagttatttctagaatttttttttttttttgagacaagagtctcgctctgtcgcccaggct

SEQ ID NO: 44697 - DNA, 78 bp, Homo sapiens; identical to SEQ ID NO: 44605

SEQ ID NO: 44698 - DNA, 76 bp, Homo sapiens; identical to SEQ ID NO: 44645

SEQ ID NO: 44699 - DNA, 71 bp, Homo sapiens; identical to SEQ ID NO: 44644

SEQ ID NO: 44700 - DNA, 72 bp, Homo sapiens; identical to SEQ ID NO: 44592

SEQ ID NO: 44701 - DNA, 69 bp, Homo sapiens; identical to SEQ ID NO: 44591

SEQ ID NO: 44702 - DNA, 144 bp, Homo sapiens
gggctggaactcagtaactgcagagaaagcacaggtgtgctgctcacaggcaagtggggcacagacacagacacagacacagacacatggagcatgggaccacgtgtgagccagtgatggtggtggaggagggtggtctaggtg

SEQ ID NO: 44703 - DNA, 66 bp, Homo sapiens
caccaccatcactggctcacacgtggtcccatgctccatgtgtctgtgtctgtgtctgtgtctgtg

SEQ ID NO: 44704 - DNA, 77 bp, Homo sapiens; identical to SEQ ID NO: 44590

SEQ ID NO: 44705 - DNA, 91 bp, Homo sapiens; identical to SEQ ID NO: 44589

SEQ ID NO: 44706 - DNA, 95 bp, Homo sapiens; identical to SEQ ID NO: 68

SEQ ID NO: 44707 - DNA, 93 bp, Homo sapiens; identical to SEQ ID NO: 69

SEQ ID NO: 44708 - DNA, 173 bp, Homo sapiens
tgtatatacatatatacactatatatagtgtgtatatgtatatatactatatatagtgtgtatatgtgtatatatatactacatatagtgtgtatatgtatatgtgtatatatatactacatatagtgtgtatatgtatatgtgtatatatacacacatatatactatatata

SEQ ID NO: 44709 - DNA, 95 bp, Homo sapiens; identical to SEQ ID NO: 44655

SEQ ID NO: 44710 - DNA, 106 bp, Homo sapiens; identical to SEQ ID NO: 44654

SEQ ID NO: 44711 - DNA, 113 bp, Homo sapiens; identical to SEQ ID NO: 44653

SEQ ID NO: 44712 - DNA, 118 bp, Homo sapiens; identical to SEQ ID NO: 44652

SEQ ID NO: 44713 - DNA, 61 bp, Homo sapiens; identical to SEQ ID NO: 44651

SEQ ID NO: 44714 - DNA, 88 bp, Homo sapiens
tagcctggtgtgatggagcttgtctgtagtcccagctactcaggaggctgaggtaggaggatcgcttgagcccaggaggtcgaggcta

SEQ ID NO: 44715 - DNA, 95 bp, Homo sapiens; identical to SEQ ID NO: 68

SEQ ID NO: 44716 - DNA, 93 bp, Homo sapiens; identical to SEQ ID NO: 69

SEQ ID NO: 44717 - DNA, 91 bp, Homo sapiens
cctgccccctagagtgggtacttttctggtttttttttttgttgttgttttcaatatatttttttgagacagtcttgctctgtcacccagg

SEQ ID NO: 44718 - DNA, 60 bp, Homo sapiens
gtatatatgtacatatacgtgtatatatgtatatatacatgtatatatgtatatatgtat

SEQ ID NO: 44719 - DNA, 107 bp, Homo sapiens
gtgcctgggtccacttagacatagcgttgtttcttttctttctttcttttttttttttttttgagacagagtctcgctctgtcacgtaggctggagtgtagtagcac

SEQ ID NO: 44720 - DNA, 115 bp, Homo sapiens
tgacacatccgtccagcaattacatagctctacatggagatgtatcaaaaattatatttatagaaggtatattattaagtgaaaaagcaaggtggaggctgggcatggtagctca

SEQ ID NO: 44721 - DNA, 113 bp, Homo sapiens; identical to SEQ ID NO: 5035

SEQ ID NO: 44722 - DNA, 94 bp, Homo sapiens
gtgagcatcatgagcacctttactggcacttcttttgagacagagtctcactctgttacccaggctggagtgcaatagtgcggtctcagctcac

SEQ ID NO: 44723 - DNA, 99 bp, Homo sapiens
gggctccagagcacacagtggacatggactgtgagtgagaaatgaacctttgtggttatttctcactcacagtctcatactgttatgctgtcgtgcctg

SEQ ID NO: 44724 - DNA, 99 bp, Homo sapiens
agcctggttttctctgcctcagctagggtctttcagtttccctcactctctttgatttcagtgctgggagacccaagttgggcaggaaatgtacaagct

SEQ ID NO: 44725 - DNA, 58 bp, Homo sapiens; identical to SEQ ID NO: 1673

SEQ ID NO: 44726 - DNA, 115 bp, Homo sapiens
gctccctcttttcttcactcaggttaccatctcagagaggccttccttgacttttttttttttttcttttgagacaaggtctcactctgtcacccaggctggagtacagtggcgt

SEQ ID NO: 44727 - DNA, 100 bp, Homo sapiens
ctctggctggctatactgtttgcattgtcacacacagtgactgagtagaggtaatgctgtttgtgactcacaaggcggacagatgactagagtctcagag

SEQ ID NO: 44728 - DNA, 78 bp, Homo sapiens
agctcaactgcaggagagactcttttttttttatttattttattttttgagatggagtctcgctctgtcacccaggct

SEQ ID NO: 44729 - DNA, 58 bp, Homo sapiens
tgagatggagtctcgctctgtcactcaggctggagtgcaatggcaagatctcagctca

SEQ ID NO: 44730 - DNA, 119 bp, Homo sapiens
cattgtgagctctcagatacccaggatgccctggggttggaagtagagtcaggaatcaggagtctctctctatttctctgtcacccattattcctgggccctaaaatagctctgttgtg

SEQ ID NO: 44731 - DNA, 93 bp, Homo sapiens
gtgagtcaccatgctcagcctatttatttatttttgagacagggtctcactctgttgctcaggctggagtgcagtggcatgatcatggctcac

SEQ ID NO: 44732 - DNA, 69 bp, Homo sapiens
atgatgtagagattctgactccaagggttgttttttttttttttttgagacggagtctcactgtgtcat

SEQ ID NO: 44733 - DNA, 90 bp, Homo sapiens
agctggccaggcacagtggctcatgcctgtagccccagctacttggaaggctgaggtggcaggatcaatagagcccaggagtttgaggct

SEQ ID NO: 44734 - DNA, 88 bp, Homo sapiens
gtttgctataaactctgtgactgtctctcaggttttgcctctcccaagagagcgtcctccatttggctgttaccgttgttgagcatcc

SEQ ID NO: 44735 - DNA, 115 bp, Homo sapiens
tacttattcagaaagtggcaaactaataaataatgctagaagtcaggagagagagtggtgtgtcttcgagagtagggtggtgatgctgactgaaggaggtgttctatttcttgat

SEQ ID NO: 44736 - DNA, 91 bp, Homo sapiens
gcccaaggccaaggtgggcggatcacttgagctctgtcttttttttttttttttctgaaacagagtctcgttctgtcacccaggctggagt

SEQ ID NO: 44737 - DNA, 62 bp, Homo sapiens
ctcacatgagatcctggatgagaagagcctttgcagtggatctaacaccatgtccatgtgag

SEQ ID NO: 44738 - DNA, 104 bp, Homo sapiens
attccacctagaaaagtcaaaagcacatgctgtgagttcaggggactgaagtgtggctggctacggcactgtgttggttgagactctttgggcttacaaggaat

SEQ ID NO: 44739 - DNA, 86 bp, Homo sapiens
gaggcttactacatgcttttggaattgcaggattttgttatttaaatttagactgtgattctctgagtaactgtatatattgcttt

SEQ ID NO: 44740 - DNA, 62 bp, Homo sapiens
ggtgactgagtctctcattctgttgcccaggctggagcacagtagtgctatctcagctcact

SEQ ID NO: 44741 - DNA, 80 bp, Homo sapiens
gggagcaggaggaagagagagaatggggaggtgccacatgctcttaaacagatctcatattaactcactcactcactccc

SEQ ID NO: 44742 - DNA, 95 bp, Homo sapiens
gtctgctcctggggatgcctggcctgggtgttcctgcagaatctttaactctctcacactcactgtcttgagccccagacagacactatgtccct

SEQ ID NO: 44743 - DNA, 107 bp, Homo sapiens
ctacctcggacttcaggcacacaccaccacacccagctaatatatatatatatttcgtcattgtttgttttggtagagatggggtttcgccatatggcccaggctgg

SEQ ID NO: 44744 - DNA, 95 bp, Homo sapiens; identical to SEQ ID NO: 68

SEQ ID NO: 44745 - DNA, 93 bp, Homo sapiens; identical to SEQ ID NO: 69

SEQ ID NO: 44746 - DNA, 68 bp, Homo sapiens
acaaccatccagagtctctctgtccctccatggactttcttaggaaagaaagaaagacacttggttgt

SEQ ID NO: 44747 - DNA, 91 bp, Homo sapiens
tgggatgtaggcgaggtgcctgtgacattggtgatttctgggcactgttgtgtccctactgtttgctttgcactttatttatgacatctca

SEQ ID NO: 44748 - DNA, 71 bp, Homo sapiens
acctggtgccttgtctgtcactctgtcggccggccccatgccttccacccagagtgtctgctgtgtaaggt

SEQ ID NO: 44749 - DNA, 71 bp, Homo sapiens
ccactgcttcttctctgtcactctgggactccttaaggagccaaggcaactggagtcaagggagcaggagg

SEQ ID NO: 44750 - DNA, 80 bp, Homo sapiens
tccagacacagagtaggcacacatctactacaaatatgaatgtatgtttgtggcctcatgtgtgtgcaaacttgtctgga

SEQ ID NO: 44751 - DNA, 120 bp, Homo sapiens
cagtcctcatcccaggcctggaaaggcactgcagaggacgggggtgcgtccttattgattgtctgtctgtccctgtgaccctgcagaccccagctccgtggaggggacgtgtgaggagtg

SEQ ID NO: 44752 - DNA, 74 bp, Homo sapiens
atgtttttctctcactgtcacgcccttctcttctaaataaggaaagaaggccgggcgcggtggctcatgaccat

SEQ ID NO: 44753 - DNA, 104 bp, Homo sapiens
ctctcctacattgtcttgggaacccttaatatgtcttttatacgcctcttctttttttgtctttaataagacatattaagagttctcaggacaatgtaggagag

SEQ ID NO: 44754 - DNA, 72 bp, Homo sapiens
catatgttaatacttagtaaactcatatatatacttatatatatgagtttatatgtattacttatacatatg

SEQ ID NO: 44755 - DNA, 116 bp, Homo sapiens
agcttgttgtgaggctggatggcaggctttccggctgagaggcggtctgtctgactgagtgtctgacttagtgtctggctgagaggctgcctggttgagaggctggcttagaggct

SEQ ID NO: 44756 - DNA, 69 bp, Homo sapiens
gcagtctgggtggctgcctggctgagaggctggttgcctgggaagctggctgagaggctgcctgcctgc

SEQ ID NO: 44757 - DNA, 90 bp, Homo sapiens
tgcccacgcgtgcacacagccacacacaccctcacgcacacacgcacagcaccatgtgggaggggttctcggctgtgacagtgaagggca

SEQ ID NO: 44758 - DNA, 58 bp, Homo sapiens
tgagacagagtctcccactgtcacccaggctggagtgcagtggcctgatcttggttca

SEQ ID NO: 44759 - DNA, 105 bp, Homo sapiens
tctgtagcctccgtgactttgtatgtgctatataatcttttcagcattttttatatataaattatgacctaccatttatattattgaagaagtcaaaggctgaga

SEQ ID NO: 44760 - DNA, 98 bp, Homo sapiens
tcctacattgtcttgggaactcttaatatgtcttttatatgcctcttctttttttgtctttaataagacatattaagagttctcaggacaatgtagga

SEQ ID NO: 44761 - DNA, 72 bp, Homo sapiens
aggctcagccccaccctgttgggccccttcagcccctctgagaggctcactgggtcctcatgggtcttgcct

SEQ ID NO: 44762 - DNA, 72 bp, Homo sapiens
aacctaccaattagataattactgaggttagtaagcataatttatattattcattgattctaattggtggtt

SEQ ID NO: 44763 - DNA, 106 bp, Homo sapiens
agcaactagggttgggaccattccttatacggagcagaagtgaatttttttttttgagagacagagtctcactatgttgcccaggttggtcttaaaaccctgggct

SEQ ID NO: 44764 - DNA, 99 bp, Homo sapiens
tgactgaaagaacttatggtgctgctgctttattttataaattttttatgttgtttcttaaaatagggcatagctgctagggcagggttttaatagaca

SEQ ID NO: 44765 - DNA, 70 bp, Homo sapiens
gggccttctctctgtgtctgtcctcatctcctcttctcataaggatatcagtcatattggattaaggccc

SEQ ID NO: 44766 - DNA, 59 bp, Homo sapiens
gcaggatctcactctcttactctgtcacccaggctggagtgcagtgggatgatcatggc

SEQ ID NO: 44767 - DNA, 111 bp, Homo sapiens
ctagtactacagatgcacacgaccatgtctggctaattatttatttaatttattttaatttttatttatttatttattttgagacagagtcttgctctgtcaccaggctag

SEQ ID NO: 44768 - DNA, 95 bp, Homo sapiens; identical to SEQ ID NO: 68

SEQ ID NO: 44769 - DNA, 93 bp, Homo sapiens; identical to SEQ ID NO: 69

SEQ ID NO: 44770 - DNA, 58 bp, Homo sapiens
tgagagagagtctcgctctgtcacccaggctggagtgccatggcgcaatctcggctca

SEQ ID NO: 44771 - DNA, 111 bp, Homo sapiens
acttatccctgaagtaagagaactaagtcttggagaagctaagtaactgtccccaaagatcagctagtaagttctttaataaccattaaaattcttacttctgaggcaagt

SEQ ID NO: 44772 - DNA, 113 bp, Homo sapiens
gccattgcactccagcctggatgacagagcaagtctccttttcttttctttctttctttttttttttttgagatggagttttgctcttgtcgcccaggctggagtgcaatggc

SEQ ID NO: 44773 - DNA, 76 bp, Homo sapiens
tatgtatctatatagatatgtatatgtatctatgtatctatatagatatgtatatatgtgcatatatatatatata

SEQ ID NO: 44774 - DNA, 167 bp, Homo sapiens
atatatatatatgtatatatatgtgtgtatatatacatatatgtgtatatatgtgtgtatatatacatatatgtgtatatatatacgtatatatatatatatgtgtatatatatacgtatatatatgtgtatatatatgtatatatatatgtgtatatatatatatg

SEQ ID NO: 44775 - DNA, 114 bp, Homo sapiens
gattgaagcatagcatttccaggcctatctcaacctgcaatatctttttttttttttttttttttttgatgttgtctcgctctgtcccccaggctggagtgcagtggcgtgatc

SEQ ID NO: 44776 - DNA, 93 bp, Homo sapiens
gtgccctctgagtacccttctctccctgtctggccctgcccttcctgccaggggagggccccagtgtggccgagatggggtctgcccctgcac

SEQ ID NO: 44777 - DNA, 74 bp, Homo sapiens
ctgtgtctctcaggctctgtggctcttgcgcactcccagtgtgcccaacagggcctgaaatggactctaatcag

SEQ ID NO: 44778 - DNA, 67 bp, Homo sapiens
tttagggattgagacagaagacagtcttgagggacctgccctcttgctggtttttgttattcctggg

SEQ ID NO: 44779 - DNA, 116 bp, Homo sapiens
caaaaactagcccagcgtggtggtggtgcacctgtagtcccagctgctggggaggctgaggtagaaggatcacctgagctggggaaggttgaggctgcagtgagctgagatcacgc

SEQ ID NO: 44780 - DNA, 69 bp, Homo sapiens
gcctttggcagattgagtggcgattggtggggctcctgcccctctgtctgcctgtgtcccccacaaggc

SEQ ID NO: 44781 - DNA, 122 bp, Homo sapiens
ggtatgggttgagattcatttttgttcttttcttggagcagggactaagtctctctctgtggcccaggccggggtgcagtgggatgatctcggctcactgcagccttagtctcctaggttca

SEQ ID NO: 44782 - DNA, 58 bp, Homo sapiens; identical to SEQ ID NO: 1215

SEQ ID NO: 44783 - DNA, 90 bp, Homo sapiens
aggatgtattatagatatacatgtattcttttcagttcaactccagacactggagaaatacttgttttttaatatcattagctgcatctt

SEQ ID NO: 44784 - DNA, 88 bp, Homo sapiens
atgagttatacgtatctcatatatattattttcttatatatatgaaatatatctcatatatataagatatgagagctatatatctcat

SEQ ID NO: 44785 - DNA, 75 bp, Homo sapiens
gcccctgagggcgggtgggagttgtggccagggaggcaggttctctgtctgtctgtctgtctgcccgtcctgggc

SEQ ID NO: 44786 - DNA, 82 bp, Homo sapiens
ctgggattgcagcattttgaaccaccgcactcagctgctttttttataaaaagtagagatggggtctctctctgtcacccag

SEQ ID NO: 44787 - DNA, 99 bp, Homo sapiens
agagagaccaaagagttttagtcaaaggacctattttatatatatgtatacacacacacatatatatatattttttttttgtagagacagggtcttgct

SEQ ID NO: 44788 - DNA, 80 bp, Homo sapiens
caggaggctgaggtaggaggatcgcttgaaacctggtaggcagaggttgcagtgagccaagatcgtgccactgccttctg

SEQ ID NO: 44789 - DNA, 106 bp, Homo sapiens
cagaaaagcagcttgtgaaaatcacattttaaaatgtaaaactgttcctctgaagatagatagcagtgatggttgaacaacaatgtgaatgcacttaatgccactg

SEQ ID NO: 44790 - DNA, 136 bp, Homo sapiens
cctcagtgacagagcaagaccctgtctctacttttttttttttttttttttgagacagagtctcgctctgtcacccaggctggagtgcagtcgtgtcatctcagctcactgcaacctccacctcctgggttcaagc

SEQ ID NO: 44791 - DNA, 154 bp, Homo sapiens
ttaggagaaatagcatggttcactgcctagctggttaatcccaagcaagtcacttaacctctctgagcctctgtgtcttcatctattttttttaatttttatttttttgagatggagtttcgttcttgttgcccaggctggagtgcaatggtgc

SEQ ID NO: 44792 - DNA, 119 bp, Homo sapiens
tgagcccttagtgcatccccaacactgctctcggcacatgacacacaatcttttttctttttttgagacagtcttgctctgtcacccaggctggagagcagtggtgcgatctcggctta

SEQ ID NO: 44793 - DNA, 102 bp, Homo sapiens
ggcatggtggcacatacctgtagtcccagctactcaggaggctgaggtaggaggatctcttgagcctgggaggcagaggctgcagtaagccatcatcacacc

SEQ ID NO: 44794 - DNA, 82 bp, Homo sapiens
ctctgctcttgggtgagactagcatgaatttttttttttttttttcttgagacggagtcttgctctgtcacccaggctggag

SEQ ID NO: 44795 - DNA, 101 bp, Homo sapiens
acctttgctggttgttcttgagctgagttaagagaaaaaaaatctacttttttttttttttttttttgagacagagatctcactctgccacccaggctggt

SEQ ID NO: 44796 - DNA, 117 bp, Homo sapiens
caggtttgttacgcaggtatacatgtgccatggtgggaaaaacttaactctttttttttttttttttttttagagacagggtcttgccatgttgcccaggttggtcttgaactcttg

SEQ ID NO: 44797 - DNA, 72 bp, Homo sapiens; identical to SEQ ID NO: 44598

SEQ ID NO: 44798 - DNA, 86 bp, Homo sapiens
actccagcctgggcaactagagtgaaactccgtctcaaaaaaaaaaaaaaaaggatggggtctccctctgtccctcaggctcaagt

SEQ ID NO: 44799 - DNA, 117 bp, Homo sapiens
cactccagcctgggtgacagagtgagatcctgtctattaaaataaatacatctgaaaatgttgtgtttttttttcttttttgagacagagtctcactctgtcacccaggcaggagtg

SEQ ID NO: 44800 - DNA, 95 bp, Homo sapiens; identical to SEQ ID NO: 68

SEQ ID NO: 44801 - DNA, 93 bp, Homo sapiens; identical to SEQ ID NO: 69

SEQ ID NO: 44802 - DNA, 63 bp, Homo sapiens
gcgtgtgacccacagactgtgactgtgtcccctcagcatttattttctggatggtcacaacgt

SEQ ID NO: 44803 - DNA, 110 bp, Homo sapiens
ccttcccctaactccttggtggaagtgctttatatgaatattgtttctatattgaattaagacattactatagtgctaagcttcagtggaagactttctgtaggggcagg

SEQ ID NO: 44804 - DNA, 147 bp, Homo sapiens
tgtgtttgtgtgtatatatacatatatgtcaatatatatatgtccgtgtgtgtgtgtatatatatatatgtatatatatacatatatatacatatatctgtgtatatatatgtgtatatatatacacatatatatacacacacacac

SEQ ID NO: 44805 - DNA, 87 bp, Homo sapiens
cccagctaaatttgaatttcagatgaataacaatttttttagtataaaaaacattcattgtttatctgacatttacatttaactggg

SEQ ID NO: 44806 - DNA, 86 bp, Homo sapiens
ttttacttctggaggaggtgttatgatggatgcctgaccctcagtgactgtcttaatcaaggatcctctggctgcaaagagtagaa

SEQ ID NO: 44807 - DNA, 92 bp, Homo sapiens
gtcctccgagacagagagcgtcagggctttgagatcaggctgaccagggatcagaatgagctctgtgactctgtcacatctgactttggccc

SEQ ID NO: 44808 - DNA, 92 bp, Homo sapiens
atcaacggagctgggatgcgttgttttggagacctctttttttttttttttttttttttggaggtcagggagctcctagcagaaaagttggt

SEQ ID NO: 44809 - DNA, 98 bp, Homo sapiens
gtatgtgggatatacagtatatttgagtgtagagtcagaccacttgggtttaaatcctggctttatgacttcaggtaaatgaattaatcgcgctgtgc

SEQ ID NO: 44810 - DNA, 58 bp, Homo sapiens; identical to SEQ ID NO: 555

SEQ ID NO: 44811 - DNA, 59 bp, Homo sapiens
gccgctgagtttcagagatgttaggtcaattgcctgaagtcacacagctcaaaagtggc

SEQ ID NO: 44812 - DNA, 116 bp, Homo sapiens
ttacaatggggtagtggttaagaagttgggttcaaaccccagttgggtcacttactcactgtgtgaccttgtggaatttactcaccctctctgtgccctggtttccccatctgtaa

SEQ ID NO: 44813 - DNA, 82 bp, Homo sapiens
ggtttgtcattttcttgttcacctgctagccaagcaccacattttggtttgagaggtgaccacattttgcgatggctaaatc

SEQ ID NO: 44814 - DNA, 145 bp, Homo sapiens
cagcctgggtaacagagcaagaccctgtctctcttttttattttattattttacttttttgagacaagagtctcactctgtcactcaggctggagtgcagtggcgtgatatcagctcactgcaacctccgcctcccgggttcaag

SEQ ID NO: 44815 - DNA, 90 bp, Homo sapiens
gggaaaagtatgtgtgtacagtgagagcaaacaacgcagcctgtgagggaggatctcctggctttgaatccactttcatgcgtctgtccc

SEQ ID NO: 44816 - DNA, 100 bp, Homo sapiens
agcctgggtggcagagtgagaccctgtctcaaaaaagtttttaatttttaattttaatttttatttttttgagacagagtctcgctctgtcacccaggct

SEQ ID NO: 44817 - DNA, 79 bp, Homo sapiens
tgagacagagtctcactctgtcacccaggctggagtgtagtggtgggatctctgctcactgcaacttctgcctcctggg

SEQ ID NO: 44818 - DNA, 111 bp, Homo sapiens
gccaggcgtggtaggtcatgactgtagtcccagctgctcaggaggctgaggtagaaggatcacttgagcccggaaagtcgaggctgcagtgagccattactatgccactgc

SEQ ID NO: 44819 - DNA, 93 bp, Homo sapiens
cagtatttaattctatacaggattattgttgacttctctctctttcacagctcaaatccagttagtcagcaaatcctgttggctctacccctg

SEQ ID NO: 44820 - DNA, 82 bp, Homo sapiens
gtaatacctatgctctgtttcggaatttattcttgagtcaattttaataacttattttattttttgagacagagtctgttgc

SEQ ID NO: 44821 - DNA, 118 bp, Homo sapiens
tgcactccagcctgggtgacaagatcgactctgtctcaaaaaataaatacatgcatatttatttatttattttatttttggagagtgtgtctctctctgtcgcccaggctggagtgca

SEQ ID NO: 44822 - DNA, 111 bp, Homo sapiens
gctctctctctctctctctccctatatatgtatatatacacacacatacatacatgcatatatgtatgtatgtatgtatgtatgtatatatatacacatttatatttgagc

SEQ ID NO: 44823 - DNA, 76 bp, Homo sapiens
atatacatatttttatgtatgtacatacgtatatacatatttttatgtatgtacatacgtatatacatatgtgtgt

SEQ ID NO: 44824 - DNA, 95 bp, Homo sapiens
gggattacaggcacctgccaacatgcccagctaatttttgtatttttaatagagacggggtttcaccatgttggccaggttggtcttgaactcct

SEQ ID NO: 44825 - DNA, 123 bp, Homo sapiens
gtatatatatgtatatatatacgtgtgtatatatatatacgtgtatatatatgtgtatatatatacaagtgtatatatatatacgtgtatatatatatatatacgtgtatatatatatatatg

SEQ ID NO: 44826 - DNA, 78 bp, Homo sapiens
gtgctatatgcccttctttacccctttcttccttcctgctagctgaaagaagggtgtgaggactccagcgtctagcat

SEQ ID NO: 44827 - DNA, 135 bp, Homo sapiens
gtgtgtgtgtgtgtgtgtgtgtgtgtatgtgtatatatatgtatatatatacacatatatatgtatgtatatatacacatatatacgtatgtatgtatacacatatatacatatatatgcatgtgtatatatata

SEQ ID NO: 44828 - DNA, 81 bp, Homo sapiens
gtgtatatagacacacataccaccatatatatacatatatacacgtatgtgtgtggtatatgtatgtatatctatatatac

SEQ ID NO: 44829 - DNA, 79 bp, Homo sapiens
tgccatccgtttttgggggggcggtttttgtgggtttttttgagacagaatctcactctgtcacccaaggtggagtgca

SEQ ID NO: 44830 - DNA, 83 bp, Homo sapiens
ggtttcagcatattggccaggctggtctcgaactcctgatctcaagtgatctccctgtctcagcctctcaaagtgctaggatt

SEQ ID NO: 44831 - DNA, 104 bp, Homo sapiens
ggtgacgaggatctgatgtaaaatgagactaggggagggattgaggcagagatggaagctgtgtctttttttttgtttttgagtcagagtttctctctgtcact

SEQ ID NO: 44832 - DNA, 86 bp, Homo sapiens
gtgcatgcaactatgctgagctgatcttttttttttttttgagatagagttttgctcttatcacccaggctggagtgcagtggcac

SEQ ID NO: 44833 - DNA, 112 bp, Homo sapiens
tcctagttgtgtggcttgggcaagttatttaacctctttctctgtgtctcagtttccccatctgtaaaatggagatgccctcagtaactctctcccacccaagtagctggga

SEQ ID NO: 44834 - DNA, 56 bp, Homo sapiens
ggattctctctgtctgtgggtggcaagggcatccactgagatggactaagggatct

SEQ ID NO: 44835 - DNA, 81 bp, Homo sapiens
ttactcaacctctctgagtctcagttccccaatccataaaaggggaataatgacagtttctccctcagaaggttgttgtga

SEQ ID NO: 44836 - DNA, 115 bp, Homo sapiens
ctagcctgggcaacatggcaagaccacatttatttatttatttatttatttatttatttatttatttatttatttatttatttgagatggagtctcactctgtcgcccaggctgg

SEQ ID NO: 44837 - DNA, 80 bp, Homo sapiens
ttggtcctgtgtctttcttcttacgctgtgttaatgtgtttactttccatttggcagagagacaagagagacacctccaa

SEQ ID NO: 44838 - DNA, 97 bp, Homo sapiens
ggtgggcgtgtgggggcttattggaatatcctggccatggtaagattttataaatatttttcaggaagggacacaggttctctctctctctccatat

SEQ ID NO: 44839 - DNA, 91 bp, Homo sapiens
tacctgtttctttcctgcaccaagatgcatctcacattgggtgatttggcacagagaaatgagtgtgcacaggaggcaggaattctgggtg

SEQ ID NO: 44840 - DNA, 86 bp, Homo sapiens
ccagcctgggcaacaagagggaaactctgtctcaaaaaaaaaaaaaaaaaaaaaaagacagagtctcgctgtgtcactcaggctgg

SEQ ID NO: 44841 - DNA, 64 bp, Homo sapiens
gggatcaagggaacaatcctgtctcactgcttgggaggctgaggttggaggatcacttgagccc

SEQ ID NO: 44842 - DNA, 58 bp, Homo sapiens
tgagactgagtctcgctctgtcacccaggctggagtgcagtggcgtgatctcgactca

SEQ ID NO: 44843 - DNA, 98 bp, Homo sapiens
gcactctagtctggtcaacgagtgagacactggctctttgcaattttttttttttttttttgagacagggtcttgctctgtcacccagactggagtgc

SEQ ID NO: 44844 - DNA, 94 bp, Homo sapiens
tgctctttattgtaaactttcatgtgccagattaacattttttatgtaaaatgtcaaaattcaagcttatatgagggttttttttaaatgagca

SEQ ID NO: 44845 - DNA, 151 bp, Homo sapiens
ggattatatctatctatctatctatatatatagttatatatatctatatatagagttgtatatatctggatatatatggttatatatatctatatatagttgtatatatctagatatatgtggttatatatctagatatatatatagttgt

SEQ ID NO: 44846 - DNA, 109 bp, Homo sapiens
gatatatacaactatatatagatatatataaccatatatatccagatatatacaactctatatatagatatatataactatatatatagatagatagatagatataatc

SEQ ID NO: 44847 - DNA, 56 bp, Homo sapiens; identical to SEQ ID NO: 24883

SEQ ID NO: 44848 - DNA, 71 bp, Homo sapiens
gggaacagggagtgatggcaaagataatgaggaattttctctttttgagacagggtctctctctgtcaccc

SEQ ID NO: 44849 - DNA, 56 bp, Homo sapiens
tgagtcagggtctcactctgtcactcaggctggagtgcagtgcagatcattgctca

SEQ ID NO: 44850 - DNA, 92 bp, Homo sapiens
cagatgcacagggatgggggcaccggaggactgaacagagagggctaaggggctctctctctgccacagggcccctgcccctcagcttcctg

SEQ ID NO: 44851 - DNA, 113 bp, Homo sapiens
tcaccgggcattgtggtgcgtgcctgtaatcccagctacttgggaggctgaggtggtaggatcacttgagcctgggaggcggaggttgcagtgagccaagatggtgccactgt

SEQ ID NO: 44852 - DNA, 114 bp, Homo sapiens
tgggatttaaacaggccttttgactctaattctagtattcctcccatgtgcagtattttattttatattgcacaatagataaaatataattttggtttctccttttttattcta

SEQ ID NO: 44853 - DNA, 111 bp, Homo sapiens
aatatgtgtctgggtgtgtactgggcgccttgcaccagtccaagtgctaatgacagagaatatgcatctggatgtgtactgggcaccttgcgctagtccaagttgtgtatt

SEQ ID NO: 44854 - DNA, 112 bp, Homo sapiens
attcacagcccctggttgcatttccatccaatagaaggtgtaagttggttcttcaaagctttttttttttttgagatggattcttgctctgtcacccagggtggagtgcaat

SEQ ID NO: 44855 - DNA, 105 bp, Homo sapiens
gctgcccggtcaccctctcgtttatttcaacgtatgaaaagctgtttctagcagggcgcagtggttcaacgttgtaatctcagcactttgggaggccgagggggc

SEQ ID NO: 44856 - DNA, 68 bp, Homo sapiens
gtgactctttttctgtgtccttgacctggtagggtgccagacacacacaggagagatttcctgagcac

SEQ ID NO: 44857 - DNA, 87 bp, Homo sapiens
acatgtacgctcacactcacactcagggaaaagcatctggggtttctgagcagctgtcctggtggctgggtggcaggtgctgcatgt

SEQ ID NO: 44858 - DNA, 58 bp, Homo sapiens
tgagacggagtctcactctgtcacccaggctggagtgcagtggtgcgatctcatctca

SEQ ID NO: 44859 - DNA, 109 bp, Homo sapiens
ggtcaaatatgcctctgagtttttgatgaaagcatatttttctaattagactaaattatttgttttttctgaagacattagaaattctttcagactgggcaacatgacc

SEQ ID NO: 44860 - DNA, 113 bp, Homo sapiens
gtaccatttcttttcctagctagttcttacaggaaaacctttaagggtaagaatatatatttttaacctttgattctctctcagtagccagtgttgtgttaggttcagggtat

SEQ ID NO: 44861 - DNA, 76 bp, Homo sapiens
ttctttatattctccttgggctatttggtggttttaggagaggcaagtatcacaaacagcttggggacatgaggga

SEQ ID NO: 44862 - DNA, 89 bp, Homo sapiens
actatcagaatgtattgtgtaaagacaggaactcttttttttttttttttttttgagacagagtcttgctctgtcgcccaggctggagt

SEQ ID NO: 44863 - DNA, 110 bp, Homo sapiens
gctctttttgttgttgttgtgttgttttttgaggaaacagtctcactctatcacccaaactggagtgtagtggttccctcatggttcactgcagcctcgacctcccgggc

SEQ ID NO: 44864 - DNA, 100 bp, Homo sapiens
gcctactaccttctgtttcatgctgtttgcctcaactatttggttgtctggattgaagtgtggttctttcagcataattgaaaatcaatgtggctcaggc

SEQ ID NO: 44865 - DNA, 119 bp, Homo sapiens
gaatgagtaaacttctggacttgggtggaataggctgttcatgtgtgtgtgtatatatatatatctgtgaggtccatttggcctattaaatacaatgctattcaagtctgatgtttctt

SEQ ID NO: 44866 - DNA, 88 bp, Homo sapiens
ggcgtcattagtgacaagttagtgttgtctgagaagtgaaagtaatatttctgcccactgtcactgactgaatctcctctgctgggcc

SEQ ID NO: 44867 - DNA, 106 bp, Homo sapiens
gtggtttggaagaagagccatgaaaagaggcccagctctctcatgctgtgtctgagtcacataagctgattgatatcctaaggcataggcccagtaaagaagctgg

SEQ ID NO: 44868 - DNA, 56 bp, Homo sapiens; identical to SEQ ID NO: 24883

SEQ ID NO: 44869 - DNA, 76 bp, Homo sapiens
gtggataaagataatgtggtatatatatataattccatagtgtgtatatatatatttcacagtatgtatattccat

SEQ ID NO: 44870 - DNA, 93 bp, Homo sapiens
gctgtcttgagagtctgggaatgaggaatgattttatttttaaacatacaggtctttgttcctttatatttcctctaaattcttattgaaagc

SEQ ID NO: 44871 - DNA, 101 bp, Homo sapiens
ggaatatgttctagtatttgatggtaaagcagggaaattatagttaacaataatttattgtatatttcaaaaaagctagaaaagaagatttgtaatgttcc

SEQ ID NO: 44872 - DNA, 114 bp, Homo sapiens
gtctgcgcagctgaggtttttttcttttttttttttttttctttcttttttttaactgttttgttgatctgggctttggggtaggtgagaaaggagtctttttgttctgttgac

SEQ ID NO: 44873 - DNA, 72 bp, Homo sapiens
ctgggcacggtggtgcattcctgtaactgcagctacttgggaggctgaggtaagaggatcacttgagcccag

SEQ ID NO: 44874 - DNA, 73 bp, Homo sapiens
gcattaaggattctgtgcagagagaacagagaatgcaactttcctggattttctgtctaatactttttgatgt

SEQ ID NO: 44875 - DNA, 111 bp, Homo sapiens
cttggtacctttgagaatacacttttgtaagtattttaattagaagatgggagagagtaaatttatacattttttgaaaagtaatgtagcaatatgtgtcaagaacccaag

SEQ ID NO: 44876 - DNA, 77 bp, Homo sapiens
actattattgcattttagtctctctctctcttcagaacttagatgtaaagagagagagaataaaatgcaataaaagt

SEQ ID NO: 44877 - DNA, 84 bp, Homo sapiens
tcacctgtgagacagagaagtcagaggccacccttttacaaactactgatttttaaattctctgtatcaattaacaccaggtga

SEQ ID NO: 44878 - DNA, 58 bp, Homo sapiens
tgagactgagtctcactctgtcacccacgctggagtgcagtggcgcgatctcagctca

SEQ ID NO: 44879 - DNA, 62 bp, Homo sapiens
aagggaaattcatggtgtaaaggatgtatactacatgtcactctgcatcttgtttttctctt

SEQ ID NO: 44880 - DNA, 118 bp, Homo sapiens
gaatctgtagttggatgatcgtcatctgcatccaggatttgaaaagcactgagctgagagagctgagagcctactgcatcgttctaggattggggtcatgaggcactggactaccgtc

SEQ ID NO: 44881 - DNA, 111 bp, Homo sapiens
gttgttatgtctggttttgttttgtttttttttggcgggggcggggggagatggagtctcactctgtcacccaggctggagtgcagtggcgcaatatcagctcactgcaac
